United States Patent 7,250,289 (METHODS OF GENETIC ANALYSIS OF MOUSE) - sequence listing, part 15

SEQ ID NO: 563583 - DNA, 25 bp, Mus musculus
gctagagagcactcatctgcttctg

SEQ ID NO: 563584 - DNA, 25 bp, Mus musculus
gctagagatcaacccgcggcagctg

SEQ ID NO: 563585 - DNA, 25 bp, Mus musculus
gctagagatcaagccgcggcagctg

SEQ ID NO: 563586 - DNA, 25 bp, Mus musculus
gctagagatgccagcgtttgaaaag

SEQ ID NO: 563587 - DNA, 25 bp, Mus musculus
gctagagatgcctgcgtttgaaaag

SEQ ID NO: 563588 - DNA, 25 bp, Mus musculus
gctagagatgctctgcttagtggca

SEQ ID NO: 563589 - DNA, 25 bp, Mus musculus
gctagagatgctgtgcttagtggca

SEQ ID NO: 563590 - DNA, 25 bp, Mus musculus
gctagagcaggacaagacgaccact

SEQ ID NO: 563591 - DNA, 25 bp, Mus musculus
gctagagcaggagaagacgaccact

SEQ ID NO: 563592 - DNA, 25 bp, Mus musculus
gctagagcatctaacacagtgtact

SEQ ID NO: 563593 - DNA, 25 bp, Mus musculus
gctagagcatcttacacagtgtact

SEQ ID NO: 563594 - DNA, 25 bp, Mus musculus
gctagagccacaaatggtcagtgaa

SEQ ID NO: 563595 - DNA, 25 bp, Mus musculus
gctagagccacatatggtcagtgaa

SEQ ID NO: 563596 - DNA, 25 bp, Mus musculus
gctagagccatcaaccacaaaagac

SEQ ID NO: 563597 - DNA, 25 bp, Mus musculus
gctagagccatctaccacaaaagac

SEQ ID NO: 563598 - DNA, 25 bp, Mus musculus
gctagagcccagacctgagttgaga

SEQ ID NO: 563599 - DNA, 25 bp, Mus musculus
gctagagcccagtcctgagttgaga

SEQ ID NO: 563600 - DNA, 25 bp, Mus musculus
gctagagccttaagaatgaaaccaa

SEQ ID NO: 563601 - DNA, 25 bp, Mus musculus
gctagagccttaagagcgagaccac

SEQ ID NO: 563602 - DNA, 25 bp, Mus musculus
gctagagccttatgaatgaaaccaa

SEQ ID NO: 563603 - DNA, 25 bp, Mus musculus
gctagagccttatgagcgagaccac

SEQ ID NO: 563604 - DNA, 25 bp, Mus musculus
gctagagcgacaacatggtattccc

SEQ ID NO: 563605 - DNA, 25 bp, Mus musculus
gctagagcgacatcatggtattccc

SEQ ID NO: 563606 - DNA, 25 bp, Mus musculus
gctagagcgtggctgctgggaccag

SEQ ID NO: 563607 - DNA, 25 bp, Mus musculus
gctagagcgtgggtgctgggaccag

SEQ ID NO: 563608 - DNA, 25 bp, Mus musculus
gctagagctaccattaaacgactgt

SEQ ID NO: 563609 - DNA, 25 bp, Mus musculus
gctagagctacctttaaacgactgt

SEQ ID NO: 563610 - DNA, 25 bp, Mus musculus
gctagagctgcgcagctcagcactg

SEQ ID NO: 563611 - DNA, 25 bp, Mus musculus
gctagagctgcggagctcagcactg

SEQ ID NO: 563612 - DNA, 25 bp, Mus musculus
gctagagctggcctataactttctt

SEQ ID NO: 563613 - DNA, 25 bp, Mus musculus
gctagagctggcgtataactttctt

SEQ ID NO: 563614 - DNA, 25 bp, Mus musculus
gctagagctgtacccaagaagaaga

SEQ ID NO: 563615 - DNA, 25 bp, Mus musculus
gctagagctgtagccaagaagaaga

SEQ ID NO: 563616 - DNA, 25 bp, Mus musculus
gctagagcttacaaagtgactcttt

SEQ ID NO: 563617 - DNA, 25 bp, Mus musculus
gctagagcttactaagtgactcttt

SEQ ID NO: 563618 - DNA, 25 bp, Mus musculus
gctagagcttcaattttataccaaa

SEQ ID NO: 563619 - DNA, 25 bp, Mus musculus
gctagagcttcatttttataccaaa

SEQ ID NO: 563620 - DNA, 25 bp, Mus musculus
gctagaggatccaactggcctctgt

SEQ ID NO: 563621 - DNA, 25 bp, Mus musculus
gctagaggatcctactggcctctgt

SEQ ID NO: 563622 - DNA, 25 bp, Mus musculus
gctagaggctcaaatacaggaaatt

SEQ ID NO: 563623 - DNA, 25 bp, Mus musculus
gctagaggctcatatacaggaaatt

SEQ ID NO: 563624 - DNA, 25 bp, Mus musculus
gctagagggactaagagaactacaa

SEQ ID NO: 563625 - DNA, 25 bp, Mus musculus
gctagagggacttagagaactacaa

SEQ ID NO: 563626 - DNA, 25 bp, Mus musculus
gctagagggttacttcatcacagga

SEQ ID NO: 563627 - DNA, 25 bp, Mus musculus
gctagagggttagttcatcacagga

SEQ ID NO: 563628 - DNA, 25 bp, Mus musculus
gctagaggtcaacgacttcacagcc

SEQ ID NO: 563629 - DNA, 25 bp, Mus musculus
gctagaggtcaaggacttcacagcc

SEQ ID NO: 563630 - DNA, 25 bp, Mus musculus
gctagaggtcccattcattgtcagg

SEQ ID NO: 563631 - DNA, 25 bp, Mus musculus
gctagaggtccctttcattgtcagg

SEQ ID NO: 563632 - DNA, 25 bp, Mus musculus
gctagaggtcggaaataagattttc

SEQ ID NO: 563633 - DNA, 25 bp, Mus musculus
gctagaggtcggtaataagattttc

SEQ ID NO: 563634 - DNA, 25 bp, Mus musculus
gctagaggttttactttgcacatca

SEQ ID NO: 563635 - DNA, 25 bp, Mus musculus
gctagaggtttttctttgcacatca

SEQ ID NO: 563636 - DNA, 25 bp, Mus musculus
gctagagtagttaagggtccctgac

SEQ ID NO: 563637 - DNA, 25 bp, Mus musculus
gctagagtagtttagggtccctgac

SEQ ID NO: 563638 - DNA, 25 bp, Mus musculus
gctagagtcataaggttgctttaat

SEQ ID NO: 563639 - DNA, 25 bp, Mus musculus
gctagagtcatatggttgctttaat

SEQ ID NO: 563640 - DNA, 25 bp, Mus musculus
gctagagtccaaacgggccaaactt

SEQ ID NO: 563641 - DNA, 25 bp, Mus musculus
gctagagtccaatcgggccaaactt

SEQ ID NO: 563642 - DNA, 25 bp, Mus musculus
gctagagtctgcaaggtcacgggca

SEQ ID NO: 563643 - DNA, 25 bp, Mus musculus
gctagagtctgctaggtcacgggca

SEQ ID NO: 563644 - DNA, 25 bp, Mus musculus
gctagagtgctcaagagttgtgaaa

SEQ ID NO: 563645 - DNA, 25 bp, Mus musculus
gctagagtgctctagagttgtgaaa

SEQ ID NO: 563646 - DNA, 25 bp, Mus musculus
gctagagtgcttatgagtaaaccca

SEQ ID NO: 563647 - DNA, 25 bp, Mus musculus
gctagagtgcttttgagtaaaccca

SEQ ID NO: 563648 - DNA, 25 bp, Mus musculus
gctagagttcttaggtcattaaggg

SEQ ID NO: 563649 - DNA, 25 bp, Mus musculus
gctagagttctttggtcattaaggg

SEQ ID NO: 563650 - DNA, 25 bp, Mus musculus
gctagagttgtgctaacgccattta

SEQ ID NO: 563651 - DNA, 25 bp, Mus musculus
gctagagttgtggtaacgccattta

SEQ ID NO: 563652 - DNA, 25 bp, Mus musculus
gctagagtttgtcttcctggatttc

SEQ ID NO: 563653 - DNA, 25 bp, Mus musculus
gctagagtttgtgttcctggatttc

SEQ ID NO: 563654 - DNA, 25 bp, Mus musculus
gctagatccacacaaccgcgagtct

SEQ ID NO: 563655 - DNA, 25 bp, Mus musculus
gctagatccacagaaccgcgagtct

SEQ ID NO: 563656 - DNA, 25 bp, Mus musculus
gctagatccatgagtatgactgaat

SEQ ID NO: 563657 - DNA, 25 bp, Mus musculus
gctagatccatgtgtatgactgaat

SEQ ID NO: 563658 - DNA, 25 bp, Mus musculus
gctagatcttagaaggagcactcct

SEQ ID NO: 563659 - DNA, 25 bp, Mus musculus
gctagatcttagtaggagcactcct

SEQ ID NO: 563660 - DNA, 25 bp, Mus musculus
gctagatgatgacaccctgtgaata

SEQ ID NO: 563661 - DNA, 25 bp, Mus musculus
gctagatgatgagaccctgtgaata

SEQ ID NO: 563662 - DNA, 25 bp, Mus musculus
gctagattcgtgaacaaacctgtgt

SEQ ID NO: 563663 - DNA, 25 bp, Mus musculus
gctagattcgtgtacaaacctgtgt

SEQ ID NO: 563664 - DNA, 25 bp, Mus musculus
gctagattgtatctgtgcctctgat

SEQ ID NO: 563665 - DNA, 25 bp, Mus musculus
gctagattgtatgtgtgcctctgat

SEQ ID NO: 563666 - DNA, 25 bp, Mus musculus
gctagattgtgaagttttctgacag

SEQ ID NO: 563667 - DNA, 25 bp, Mus musculus
gctagattgtgatgttttctgacag

SEQ ID NO: 563668 - DNA, 25 bp, Mus musculus
gctagattgtttcttgactcttcaa

SEQ ID NO: 563669 - DNA, 25 bp, Mus musculus
gctagattgtttgttgactcttcaa

SEQ ID NO: 563670 - DNA, 25 bp, Mus musculus
gctagatttataaccacacaatcag

SEQ ID NO: 563671 - DNA, 25 bp, Mus musculus
gctagatttatatccacacaatcag

SEQ ID NO: 563672 - DNA, 25 bp, Mus musculus
gctagatttatcacggaacacaatt

SEQ ID NO: 563673 - DNA, 25 bp, Mus musculus
gctagatttatctcggaacacaatt

SEQ ID NO: 563674 - DNA, 25 bp, Mus musculus
gctagatttctcaatgtgctacccc

SEQ ID NO: 563675 - DNA, 25 bp, Mus musculus
gctagatttctcaggatcttctgga

SEQ ID NO: 563676 - DNA, 25 bp, Mus musculus
gctagatttctctatgtgctacccc

SEQ ID NO: 563677 - DNA, 25 bp, Mus musculus
gctagatttctctggatcttctgga

SEQ ID NO: 563678 - DNA, 25 bp, Mus musculus
gctagcaaagcaacctgctgttctt

SEQ ID NO: 563679 - DNA, 25 bp, Mus musculus
gctagcaaagcatcctgctgttctt

SEQ ID NO: 563680 - DNA, 25 bp, Mus musculus
gctagcaaaggcaccagttttctta

SEQ ID NO: 563681 - DNA, 25 bp, Mus musculus
gctagcaaaggctccagttttctta

SEQ ID NO: 563682 - DNA, 25 bp, Mus musculus
gctagcaacactacctaacagggca

SEQ ID NO: 563683 - DNA, 25 bp, Mus musculus
gctagcaacacttcctaacagggca

SEQ ID NO: 563684 - DNA, 25 bp, Mus musculus
gctagcaagcagatatgtgagacct

SEQ ID NO: 563685 - DNA, 25 bp, Mus musculus
gctagcaagcagttatgtgagacct

SEQ ID NO: 563686 - DNA, 25 bp, Mus musculus
gctagcaaggctcagacacagtgac

SEQ ID NO: 563687 - DNA, 25 bp, Mus musculus
gctagcaaggctgagacacagtgac

SEQ ID NO: 563688 - DNA, 25 bp, Mus musculus
gctagcaatagccaaccatgtccat

SEQ ID NO: 563689 - DNA, 25 bp, Mus musculus
gctagcaatagcgaaccatgtccat

SEQ ID NO: 563690 - DNA, 25 bp, Mus musculus
gctagcaatcctcagttgtcaactg

SEQ ID NO: 563691 - DNA, 25 bp, Mus musculus
gctagcaatcctgagttgtcaactg

SEQ ID NO: 563692 - DNA, 25 bp, Mus musculus
gctagcaatgctatcggcagacaca

SEQ ID NO: 563693 - DNA, 25 bp, Mus musculus
gctagcaatgctttcggcagacaca

SEQ ID NO: 563694 - DNA, 25 bp, Mus musculus
gctagcaatggcagtatatatttca

SEQ ID NO: 563695 - DNA, 25 bp, Mus musculus
gctagcaatggctgtatatatttca

SEQ ID NO: 563696 - DNA, 25 bp, Mus musculus
gctagcaattctcttagtagtagga

SEQ ID NO: 563697 - DNA, 25 bp, Mus musculus
gctagcaattctgttagtagtagga

SEQ ID NO: 563698 - DNA, 25 bp, Mus musculus
gctagcacagatcgcatcatcagag

SEQ ID NO: 563699 - DNA, 25 bp, Mus musculus
gctagcacagatggcatcatcagag

SEQ ID NO: 563700 - DNA, 25 bp, Mus musculus
gctagcacccacaacgttgtaaatg

SEQ ID NO: 563701 - DNA, 25 bp, Mus musculus
gctagcacccactacgttgtaaatg

SEQ ID NO: 563702 - DNA, 25 bp, Mus musculus
gctagcacctcaattctcagtagag

SEQ ID NO: 563703 - DNA, 25 bp, Mus musculus
gctagcacctcatttctcagtagag

SEQ ID NO: 563704 - DNA, 25 bp, Mus musculus
gctagcacgtttccccaacaaatat

SEQ ID NO: 563705 - DNA, 25 bp, Mus musculus
gctagcacgtttgcccaacaaatat

SEQ ID NO: 563706 - DNA, 25 bp, Mus musculus
gctagcactagccaaagagcctaat

SEQ ID NO: 563707 - DNA, 25 bp, Mus musculus
gctagcactagcgaaagagcctaat

SEQ ID NO: 563708 - DNA, 25 bp, Mus musculus
gctagcactataaactcaggcttat

SEQ ID NO: 563709 - DNA, 25 bp, Mus musculus
gctagcactatatactcaggcttat

SEQ ID NO: 563710 - DNA, 25 bp, Mus musculus
gctagcactcaaaccttggaaaaca

SEQ ID NO: 563711 - DNA, 25 bp, Mus musculus
gctagcactcaatccttggaaaaca

SEQ ID NO: 563712 - DNA, 25 bp, Mus musculus
gctagcactgcaagtgctgtgcata

SEQ ID NO: 563713 - DNA, 25 bp, Mus musculus
gctagcactgcatgtgctgtgcata

SEQ ID NO: 563714 - DNA, 25 bp, Mus musculus
gctagcagcaggctcacactgtaaa

SEQ ID NO: 563715 - DNA, 25 bp, Mus musculus
gctagcagcagggtcacactgtaaa

SEQ ID NO: 563716 - DNA, 25 bp, Mus musculus
gctagcagcgtcctgaagaagctgt

SEQ ID NO: 563717 - DNA, 25 bp, Mus musculus
gctagcagcgtcgtgaagaagctgt

SEQ ID NO: 563718 - DNA, 25 bp, Mus musculus
gctagcagctgtaataccttgagtt

SEQ ID NO: 563719 - DNA, 25 bp, Mus musculus
gctagcagctgttataccttgagtt

SEQ ID NO: 563720 - DNA, 25 bp, Mus musculus
gctagcaggatccagcagtccgcat

SEQ ID NO: 563721 - DNA, 25 bp, Mus musculus
gctagcaggatcgagcagtccgcat

SEQ ID NO: 563722 - DNA, 25 bp, Mus musculus
gctagcaggctacgacaccagtggt

SEQ ID NO: 563723 - DNA, 25 bp, Mus musculus
gctagcaggctaggacaccagtggt

SEQ ID NO: 563724 - DNA, 25 bp, Mus musculus
gctagcagggttatcacatcagatt

SEQ ID NO: 563725 - DNA, 25 bp, Mus musculus
gctagcagggttttcacatcagatt

SEQ ID NO: 563726 - DNA, 25 bp, Mus musculus
gctagcagttgtctgacagcctcct

SEQ ID NO: 563727 - DNA, 25 bp, Mus musculus
gctagcagttgtgtgacagcctcct

SEQ ID NO: 563728 - DNA, 25 bp, Mus musculus
gctagcataaatattcctacatttg

SEQ ID NO: 563729 - DNA, 25 bp, Mus musculus
gctagcataaattttcctacatttg

SEQ ID NO: 563730 - DNA, 25 bp, Mus musculus
gctagcatagctacagcacttggaa

SEQ ID NO: 563731 - DNA, 25 bp, Mus musculus
gctagcatagctattcaggcactgg

SEQ ID NO: 563732 - DNA, 25 bp, Mus musculus
gctagcatagcttcagcacttggaa

SEQ ID NO: 563733 - DNA, 25 bp, Mus musculus
gctagcatagcttttcaggcactgg

SEQ ID NO: 563734 - DNA, 25 bp, Mus musculus
gctagcatttgcctactgttttgca

SEQ ID NO: 563735 - DNA, 25 bp, Mus musculus
gctagcatttgcgtactgttttgca

SEQ ID NO: 563736 - DNA, 25 bp, Mus musculus
gctagccaaaacagagctccaggtt

SEQ ID NO: 563737 - DNA, 25 bp, Mus musculus
gctagccaaaactgagctccaggtt

SEQ ID NO: 563738 - DNA, 25 bp, Mus musculus
gctagccaaatgagggcatgttatt

SEQ ID NO: 563739 - DNA, 25 bp, Mus musculus
gctagccaaatgtgggcatgttatt

SEQ ID NO: 563740 - DNA, 25 bp, Mus musculus
gctagccaagccacaaagagtcatg

SEQ ID NO: 563741 - DNA, 25 bp, Mus musculus
gctagccaagcctcaaagagtcatg

SEQ ID NO: 563742 - DNA, 25 bp, Mus musculus
gctagccaatgaacctctcggcggg

SEQ ID NO: 563743 - DNA, 25 bp, Mus musculus
gctagccaatgatcctctcggcggg

SEQ ID NO: 563744 - DNA, 25 bp, Mus musculus
gctagccagtgacacattgtcttta

SEQ ID NO: 563745 - DNA, 25 bp, Mus musculus
gctagccagtgagacattgtcttta

SEQ ID NO: 563746 - DNA, 25 bp, Mus musculus
gctagccatcttctgagtgccaatg

SEQ ID NO: 563747 - DNA, 25 bp, Mus musculus
gctagccatcttgtgagtgccaatg

SEQ ID NO: 563748 - DNA, 25 bp, Mus musculus
gctagcccatgactagtacgttttc

SEQ ID NO: 563749 - DNA, 25 bp, Mus musculus
gctagcccatgagtagtacgttttc

SEQ ID NO: 563750 - DNA, 25 bp, Mus musculus
gctagccccagtccattttcatggt

SEQ ID NO: 563751 - DNA, 25 bp, Mus musculus
gctagccccagtgcattttcatggt

SEQ ID NO: 563752 - DNA, 25 bp, Mus musculus
gctagccccccacttaaagagatat

SEQ ID NO: 563753 - DNA, 25 bp, Mus musculus
gctagccccccagttaaagagatat

SEQ ID NO: 563754 - DNA, 25 bp, Mus musculus
gctagccccggtccatgaatggaga

SEQ ID NO: 563755 - DNA, 25 bp, Mus musculus
gctagccccggtgcatgaatggaga

SEQ ID NO: 563756 - DNA, 25 bp, Mus musculus
gctagccgaaaactcttcaatgcca

SEQ ID NO: 563757 - DNA, 25 bp, Mus musculus
gctagccgaaaagtcttcaatgcca

SEQ ID NO: 563758 - DNA, 25 bp, Mus musculus
gctagccgattccttggagccgtca

SEQ ID NO: 563759 - DNA, 25 bp, Mus musculus
gctagccgattcgttggagccgtca

SEQ ID NO: 563760 - DNA, 25 bp, Mus musculus
gctagccggctaaggtgctgctgac

SEQ ID NO: 563761 - DNA, 25 bp, Mus musculus
gctagccggctatggtgctgctgac

SEQ ID NO: 563762 - DNA, 25 bp, Mus musculus
gctagccgtaacaaacgccaggttt

SEQ ID NO: 563763 - DNA, 25 bp, Mus musculus
gctagccgtaactaacgccaggttt

SEQ ID NO: 563764 - DNA, 25 bp, Mus musculus
gctagccgtcagagcttccacatgg

SEQ ID NO: 563765 - DNA, 25 bp, Mus musculus
gctagccgtcagtgcttccacatgg

SEQ ID NO: 563766 - DNA, 25 bp, Mus musculus
gctagcctacccaaccataataaga

SEQ ID NO: 563767 - DNA, 25 bp, Mus musculus
gctagcctaccctaccataataaga

SEQ ID NO: 563768 - DNA, 25 bp, Mus musculus
gctagcctagaactcgctatgcagc

SEQ ID NO: 563769 - DNA, 25 bp, Mus musculus
gctagcctagaagtcgctatgcagc

SEQ ID NO: 563770 - DNA, 25 bp, Mus musculus
gctagcctaggcaattcttgtagca

SEQ ID NO: 563771 - DNA, 25 bp, Mus musculus
gctagcctaggctattcttgtagca

SEQ ID NO: 563772 - DNA, 25 bp, Mus musculus
gctagcctcatccttaagtcaagta

SEQ ID NO: 563773 - DNA, 25 bp, Mus musculus
gctagcctcatcgttaagtcaagta

SEQ ID NO: 563774 - DNA, 25 bp, Mus musculus
gctagcctccatcaataccaggtac

SEQ ID NO: 563775 - DNA, 25 bp, Mus musculus
gctagcctccatgaataccaggtac

SEQ ID NO: 563776 - DNA, 25 bp, Mus musculus
gctagcctgcctcctctaagggtgg

SEQ ID NO: 563777 - DNA, 25 bp, Mus musculus
gctagcctgcctgctctaagggtgg

SEQ ID NO: 563778 - DNA, 25 bp, Mus musculus
gctagcctggacaatggagttatac

SEQ ID NO: 563779 - DNA, 25 bp, Mus musculus
gctagcctggactatggagttatac

SEQ ID NO: 563780 - DNA, 25 bp, Mus musculus
gctagcctggcccagttataggccc

SEQ ID NO: 563781 - DNA, 25 bp, Mus musculus
gctagcctggccgagttataggccc

SEQ ID NO: 563782 - DNA, 25 bp, Mus musculus
gctagccttcttataagcattaaga

SEQ ID NO: 563783 - DNA, 25 bp, Mus musculus
gctagccttcttttaagcattaaga

SEQ ID NO: 563784 - DNA, 25 bp, Mus musculus
gctagcggactacaagaacatttct

SEQ ID NO: 563785 - DNA, 25 bp, Mus musculus
gctagcggactagaagaacatttct

SEQ ID NO: 563786 - DNA, 25 bp, Mus musculus
gctagcggatctcatgtctctggag

SEQ ID NO: 563787 - DNA, 25 bp, Mus musculus
gctagcggatctgatgtctctggag

SEQ ID NO: 563788 - DNA, 25 bp, Mus musculus
gctagcgtttatactgcaacagcag

SEQ ID NO: 563789 - DNA, 25 bp, Mus musculus
gctagcgtttattctgcaacagcag

SEQ ID NO: 563790 - DNA, 25 bp, Mus musculus
gctagctacgatattcttcagtgtt

SEQ ID NO: 563791 - DNA, 25 bp, Mus musculus
gctagctacgattttcttcagtgtt

SEQ ID NO: 563792 - DNA, 25 bp, Mus musculus
gctagctacgtgatctacttctatt

SEQ ID NO: 563793 - DNA, 25 bp, Mus musculus
gctagctacgtgttctacttctatt

SEQ ID NO: 563794 - DNA, 25 bp, Mus musculus
gctagctagctcattatcttactgc

SEQ ID NO: 563795 - DNA, 25 bp, Mus musculus
gctagctagctctttatcttactgc

SEQ ID NO: 563796 - DNA, 25 bp, Mus musculus
gctagctatgagctgtacttaggca

SEQ ID NO: 563797 - DNA, 25 bp, Mus musculus
gctagctatgaggtgtacttaggca

SEQ ID NO: 563798 - DNA, 25 bp, Mus musculus
gctagctatgcactacatctgtggg

SEQ ID NO: 563799 - DNA, 25 bp, Mus musculus
gctagctatgcagtacatctgtggg

SEQ ID NO: 563800 - DNA, 25 bp, Mus musculus
gctagctcacttctccatgagaata

SEQ ID NO: 563801 - DNA, 25 bp, Mus musculus
gctagctcacttgtccatgagaata

SEQ ID NO: 563802 - DNA, 25 bp, Mus musculus
gctagctcatccacattgtcaatgt

SEQ ID NO: 563803 - DNA, 25 bp, Mus musculus
gctagctcatcctcattgtcaatgt

SEQ ID NO: 563804 - DNA, 25 bp, Mus musculus
gctagctcatgaatttctgttgtat

SEQ ID NO: 563805 - DNA, 25 bp, Mus musculus
gctagctcatgattttctgttgtat

SEQ ID NO: 563806 - DNA, 25 bp, Mus musculus
gctagctcttagaacttgagacaac

SEQ ID NO: 563807 - DNA, 25 bp, Mus musculus
gctagctcttagtacttgagacaac

SEQ ID NO: 563808 - DNA, 25 bp, Mus musculus
gctagctcttcaccaggccttgtaa

SEQ ID NO: 563809 - DNA, 25 bp, Mus musculus
gctagctcttcagcaggccttgtaa

SEQ ID NO: 563810 - DNA, 25 bp, Mus musculus
gctagctgacctatcacttattctg

SEQ ID NO: 563811 - DNA, 25 bp, Mus musculus
gctagctgacctttcacttattctg

SEQ ID NO: 563812 - DNA, 25 bp, Mus musculus
gctagctgactaccccagaacagaa

SEQ ID NO: 563813 - DNA, 25 bp, Mus musculus
gctagctgactagcccagaacagaa

SEQ ID NO: 563814 - DNA, 25 bp, Mus musculus
gctagctgagctagacatgttaaaa

SEQ ID NO: 563815 - DNA, 25 bp, Mus musculus
gctagctgagcttgacatgttaaaa

SEQ ID NO: 563816 - DNA, 25 bp, Mus musculus
gctagctgcagcctaagtctgttga

SEQ ID NO: 563817 - DNA, 25 bp, Mus musculus
gctagctgcagcgtaagtctgttga

SEQ ID NO: 563818 - DNA, 25 bp, Mus musculus
gctagctgccctagtataggtgact

SEQ ID NO: 563819 - DNA, 25 bp, Mus musculus
gctagctgcccttgtataggtgact

SEQ ID NO: 563820 - DNA, 25 bp, Mus musculus
gctagctgctagacaagtgatctgt

SEQ ID NO: 563821 - DNA, 25 bp, Mus musculus
gctagctgctagtcaagtgatctgt

SEQ ID NO: 563822 - DNA, 25 bp, Mus musculus
gctagctgctgtcttaagcaaccat

SEQ ID NO: 563823 - DNA, 25 bp, Mus musculus
gctagctgctgtgttaagcaaccat

SEQ ID NO: 563824 - DNA, 25 bp, Mus musculus
gctagctggagtaactttgctgttt

SEQ ID NO: 563825 - DNA, 25 bp, Mus musculus
gctagctggagttactttgctgttt

SEQ ID NO: 563826 - DNA, 25 bp, Mus musculus
gctagcttagtcatcagtctgagtt

SEQ ID NO: 563827 - DNA, 25 bp, Mus musculus
gctagcttagtcttcagtctgagtt

SEQ ID NO: 563828 - DNA, 25 bp, Mus musculus
gctagcttattcatcttttctggaa

SEQ ID NO: 563829 - DNA, 25 bp, Mus musculus
gctagcttattcttcttttctggaa

SEQ ID NO: 563830 - DNA, 25 bp, Mus musculus
gctagcttcacgcagtaagcctatc

SEQ ID NO: 563831 - DNA, 25 bp, Mus musculus
gctagcttcacggagtaagcctatc

SEQ ID NO: 563832 - DNA, 25 bp, Mus musculus
gctagcttccacatcttggatctat

SEQ ID NO: 563833 - DNA, 25 bp, Mus musculus
gctagcttccacttcttggatctat

SEQ ID NO: 563834 - DNA, 25 bp, Mus musculus
gctagcttccgtcaaatagtttctc

SEQ ID NO: 563835 - DNA, 25 bp, Mus musculus
gctagcttccgtgaaatagtttctc

SEQ ID NO: 563836 - DNA, 25 bp, Mus musculus
gctagcttgcttacagaactgggtg

SEQ ID NO: 563837 - DNA, 25 bp, Mus musculus
gctagcttgctttcagaactgggtg

SEQ ID NO: 563838 - DNA, 25 bp, Mus musculus
gctagctttaaaattcatgttctta

SEQ ID NO: 563839 - DNA, 25 bp, Mus musculus
gctagctttaaatttcatgttctta

SEQ ID NO: 563840 - DNA, 25 bp, Mus musculus
gctagctttcccagaaactactgtt

SEQ ID NO: 563841 - DNA, 25 bp, Mus musculus
gctagctttccctgaaactactgtt

SEQ ID NO: 563842 - DNA, 25 bp, Mus musculus
gctagctttcttagccccagtgtga

SEQ ID NO: 563843 - DNA, 25 bp, Mus musculus
gctagctttctttgccccagtgtga

SEQ ID NO: 563844 - DNA, 25 bp, Mus musculus
gctagctttgccatgggtcgagatc

SEQ ID NO: 563845 - DNA, 25 bp, Mus musculus
gctagctttgccttgggtcgagatc

SEQ ID NO: 563846 - DNA, 25 bp, Mus musculus
gctagcttttatctggtatcacttg

SEQ ID NO: 563847 - DNA, 25 bp, Mus musculus
gctagcttttatgtggtatcacttg

SEQ ID NO: 563848 - DNA, 25 bp, Mus musculus
gctaggaaccaaccgcccctttgtt

SEQ ID NO: 563849 - DNA, 25 bp, Mus musculus
gctaggaaccaagcgcccctttgtt

SEQ ID NO: 563850 - DNA, 25 bp, Mus musculus
gctaggaaccagagcacttggcgtt

SEQ ID NO: 563851 - DNA, 25 bp, Mus musculus
gctaggaaccagtgcacttggcgtt

SEQ ID NO: 563852 - DNA, 25 bp, Mus musculus
gctaggaacctgaacaaatctttgc

SEQ ID NO: 563853 - DNA, 25 bp, Mus musculus
gctaggaacctgtacaaatctttgc

SEQ ID NO: 563854 - DNA, 25 bp, Mus musculus
gctaggaacgagagccatctacatt

SEQ ID NO: 563855 - DNA, 25 bp, Mus musculus
gctaggaacgagtgccatctacatt

SEQ ID NO: 563856 - DNA, 25 bp, Mus musculus
gctaggaacgtgagccaatttttat

SEQ ID NO: 563857 - DNA, 25 bp, Mus musculus
gctaggaacgtgtgccaatttttat

SEQ ID NO: 563858 - DNA, 25 bp, Mus musculus
gctaggaagagcatttgcaaggatt

SEQ ID NO: 563859 - DNA, 25 bp, Mus musculus
gctaggaagagcttttgcaaggatt

SEQ ID NO: 563860 - DNA, 25 bp, Mus musculus
gctaggaagctccatgctgttggaa

SEQ ID NO: 563861 - DNA, 25 bp, Mus musculus
gctaggaagctcgatgctgttggaa

SEQ ID NO: 563862 - DNA, 25 bp, Mus musculus
gctaggaatcttccctgcattgttt

SEQ ID NO: 563863 - DNA, 25 bp, Mus musculus
gctaggaatcttgcctgcattgttt

SEQ ID NO: 563864 - DNA, 25 bp, Mus musculus
gctaggaatttaaaaggcaagttgg

SEQ ID NO: 563865 - DNA, 25 bp, Mus musculus
gctaggaatttataaggcaagttgg

SEQ ID NO: 563866 - DNA, 25 bp, Mus musculus
gctaggacatctcaccgtatcctgg

SEQ ID NO: 563867 - DNA, 25 bp, Mus musculus
gctaggacatctgaccgtatcctgg

SEQ ID NO: 563868 - DNA, 25 bp, Mus musculus
gctaggactagtagtcctgacacca

SEQ ID NO: 563869 - DNA, 25 bp, Mus musculus
gctaggactagttgtcctgacacca

SEQ ID NO: 563870 - DNA, 25 bp, Mus musculus
gctaggactgaacatcctatacccc

SEQ ID NO: 563871 - DNA, 25 bp, Mus musculus
gctaggactgaagatcctatacccc

SEQ ID NO: 563872 - DNA, 25 bp, Mus musculus
gctaggacttaacttgttacatgtt

SEQ ID NO: 563873 - DNA, 25 bp, Mus musculus
gctaggacttaagttgttacatgtt

SEQ ID NO: 563874 - DNA, 25 bp, Mus musculus
gctaggagaaacaaaccctctgttt

SEQ ID NO: 563875 - DNA, 25 bp, Mus musculus
gctaggagaaactaaccctctgttt

SEQ ID NO: 563876 - DNA, 25 bp, Mus musculus
gctaggagaatgcttttggacagtt

SEQ ID NO: 563877 - DNA, 25 bp, Mus musculus
gctaggagaatggttttggacagtt

SEQ ID NO: 563878 - DNA, 25 bp, Mus musculus
gctaggagcacgcaacactgggaaa

SEQ ID NO: 563879 - DNA, 25 bp, Mus musculus
gctaggagcacggaacactgggaaa

SEQ ID NO: 563880 - DNA, 25 bp, Mus musculus
gctaggagcactcggatgtcgtttt

SEQ ID NO: 563881 - DNA, 25 bp, Mus musculus
gctaggagcactgggatgtcgtttt

SEQ ID NO: 563882 - DNA, 25 bp, Mus musculus
gctaggagcccaaaaagttctctgt

SEQ ID NO: 563883 - DNA, 25 bp, Mus musculus
gctaggagcccataaagttctctgt

SEQ ID NO: 563884 - DNA, 25 bp, Mus musculus
gctaggagctggatggcactcagtt

SEQ ID NO: 563885 - DNA, 25 bp, Mus musculus
gctaggagctggttggcactcagtt

SEQ ID NO: 563886 - DNA, 25 bp, Mus musculus
gctaggataggaaccctcagggaca

SEQ ID NO: 563887 - DNA, 25 bp, Mus musculus
gctaggataggatccctcagggaca

SEQ ID NO: 563888 - DNA, 25 bp, Mus musculus
gctaggatatctcaaatgacaactt

SEQ ID NO: 563889 - DNA, 25 bp, Mus musculus
gctaggatatctgaaatgacaactt

SEQ ID NO: 563890 - DNA, 25 bp, Mus musculus
gctaggatcaaaagtgtgtcctacc

SEQ ID NO: 563891 - DNA, 25 bp, Mus musculus
gctaggatcaaacgcctgcatcact

SEQ ID NO: 563892 - DNA, 25 bp, Mus musculus
gctaggatcaaaggcctgcatcact

SEQ ID NO: 563893 - DNA, 25 bp, Mus musculus
gctaggatcaaatgtgtgtcctacc

SEQ ID NO: 563894 - DNA, 25 bp, Mus musculus
gctaggatcagccagtatcttgagt

SEQ ID NO: 563895 - DNA, 25 bp, Mus musculus
gctaggatcagcgagtatcttgagt

SEQ ID NO: 563896 - DNA, 25 bp, Mus musculus
gctaggatccctctatggtcttata

SEQ ID NO: 563897 - DNA, 25 bp, Mus musculus
gctaggatccctgtatggtcttata

SEQ ID NO: 563898 - DNA, 25 bp, Mus musculus
gctaggatcgaacatatttcagcaa

SEQ ID NO: 563899 - DNA, 25 bp, Mus musculus
gctaggatcgaagatatttcagcaa

SEQ ID NO: 563900 - DNA, 25 bp, Mus musculus
gctaggatggcaattcactgtgatc

SEQ ID NO: 563901 - DNA, 25 bp, Mus musculus
gctaggatggcatttcactgtgatc

SEQ ID NO: 563902 - DNA, 25 bp, Mus musculus
gctaggatgtgtaaaacccaagttc

SEQ ID NO: 563903 - DNA, 25 bp, Mus musculus
gctaggatgtgttaaacccaagttc

SEQ ID NO: 563904 - DNA, 25 bp, Mus musculus
gctaggcaagaaactgggcatccct

SEQ ID NO: 563905 - DNA, 25 bp, Mus musculus
gctaggcaagaatctgggcatccct

SEQ ID NO: 563906 - DNA, 25 bp, Mus musculus
gctaggcaatagacatcaactttca

SEQ ID NO: 563907 - DNA, 25 bp, Mus musculus
gctaggcaatagtcatcaactttca

SEQ ID NO: 563908 - DNA, 25 bp, Mus musculus
gctaggcactcaaatatggaccatt

SEQ ID NO: 563909 - DNA, 25 bp, Mus musculus
gctaggcactcatatatggaccatt

SEQ ID NO: 563910 - DNA, 25 bp, Mus musculus
gctaggcactttatcactggttatc

SEQ ID NO: 563911 - DNA, 25 bp, Mus musculus
gctaggcactttttcactggttatc

SEQ ID NO: 563912 - DNA, 25 bp, Mus musculus
gctaggcagaaacaactccactgtg

SEQ ID NO: 563913 - DNA, 25 bp, Mus musculus
gctaggcagaaagaactccactgtg

SEQ ID NO: 563914 - DNA, 25 bp, Mus musculus
gctaggcaggtaagtgttgcccttc

SEQ ID NO: 563915 - DNA, 25 bp, Mus musculus
gctaggcaggtatgtgttgcccttc

SEQ ID NO: 563916 - DNA, 25 bp, Mus musculus
gctaggcagtttaataacaaagaga

SEQ ID NO: 563917 - DNA, 25 bp, Mus musculus
gctaggcagttttataacaaagaga

SEQ ID NO: 563918 - DNA, 25 bp, Mus musculus
gctaggcatcctacagaaacgtttt

SEQ ID NO: 563919 - DNA, 25 bp, Mus musculus
gctaggcatccttcagaaacgtttt

SEQ ID NO: 563920 - DNA, 25 bp, Mus musculus
gctaggcatggcagttgtcctggaa

SEQ ID NO: 563921 - DNA, 25 bp, Mus musculus
gctaggcatggctgttgtcctggaa

SEQ ID NO: 563922 - DNA, 25 bp, Mus musculus
gctaggcatttactcagtgaccaaa

SEQ ID NO: 563923 - DNA, 25 bp, Mus musculus
gctaggcatttagtcagtgaccaaa

SEQ ID NO: 563924 - DNA, 25 bp, Mus musculus
gctaggccagccatcatcacaaggg

SEQ ID NO: 563925 - DNA, 25 bp, Mus musculus
gctaggccagccttcatcacaaggg

SEQ ID NO: 563926 - DNA, 25 bp, Mus musculus
gctaggccagctagtcaatacatgg

SEQ ID NO: 563927 - DNA, 25 bp, Mus musculus
gctaggccagcttgtcaatacatgg

SEQ ID NO: 563928 - DNA, 25 bp, Mus musculus
gctaggcccctgagtagtagtttat

SEQ ID NO: 563929 - DNA, 25 bp, Mus musculus
gctaggcccctgtgtagtagtttat

SEQ ID NO: 563930 - DNA, 25 bp, Mus musculus
gctaggccgggtcaaaacagaacag

SEQ ID NO: 563931 - DNA, 25 bp, Mus musculus
gctaggccgggtgaaaacagaacag

SEQ ID NO: 563932 - DNA, 25 bp, Mus musculus
gctaggcctgctagcaagtatatta

SEQ ID NO: 563933 - DNA, 25 bp, Mus musculus
gctaggcctgcttgcaagtatatta

SEQ ID NO: 563934 - DNA, 25 bp, Mus musculus
gctaggcctggcatatgcaaacgaa

SEQ ID NO: 563935 - DNA, 25 bp, Mus musculus
gctaggcctggcttatgcaaacgaa

SEQ ID NO: 563936 - DNA, 25 bp, Mus musculus
gctaggcgtggtagtagtttcttca

SEQ ID NO: 563937 - DNA, 25 bp, Mus musculus
gctaggcgtggttgtagtttcttca

SEQ ID NO: 563938 - DNA, 25 bp, Mus musculus
gctaggctactgctgtatggactca

SEQ ID NO: 563939 - DNA, 25 bp, Mus musculus
gctaggctactggtgtatggactca

SEQ ID NO: 563940 - DNA, 25 bp, Mus musculus
gctaggctgacgaagatgttcatct

SEQ ID NO: 563941 - DNA, 25 bp, Mus musculus
gctaggctgacgtagatgttcatct

SEQ ID NO: 563942 - DNA, 25 bp, Mus musculus
gctaggctgctcattttgtctagaa

SEQ ID NO: 563943 - DNA, 25 bp, Mus musculus
gctaggctgctctttttgtctagaa

SEQ ID NO: 563944 - DNA, 25 bp, Mus musculus
gctaggctggagaaagctttgctgt

SEQ ID NO: 563945 - DNA, 25 bp, Mus musculus
gctaggctggagtaagctttgctgt

SEQ ID NO: 563946 - DNA, 25 bp, Mus musculus
gctaggcttagtaccatgaggtcca

SEQ ID NO: 563947 - DNA, 25 bp, Mus musculus
gctaggcttagttccatgaggtcca

SEQ ID NO: 563948 - DNA, 25 bp, Mus musculus
gctaggcttgctcagtccatgcaaa

SEQ ID NO: 563949 - DNA, 25 bp, Mus musculus
gctaggcttgctgagtccatgcaaa

SEQ ID NO: 563950 - DNA, 25 bp, Mus musculus
gctaggcttgtgaggaacctgagca

SEQ ID NO: 563951 - DNA, 25 bp, Mus musculus
gctaggcttgtgtggaacctgagca

SEQ ID NO: 563952 - DNA, 25 bp, Mus musculus
gctagggaagtaattcttgctttag

SEQ ID NO: 563953 - DNA, 25 bp, Mus musculus
gctagggaagtatttcttgctttag

SEQ ID NO: 563954 - DNA, 25 bp, Mus musculus
gctagggatctacaccctccctgtg

SEQ ID NO: 563955 - DNA, 25 bp, Mus musculus
gctagggatctagaccctccctgtg

SEQ ID NO: 563956 - DNA, 25 bp, Mus musculus
gctagggatcttacagctttctacc

SEQ ID NO: 563957 - DNA, 25 bp, Mus musculus
gctagggatctttcagctttctacc

SEQ ID NO: 563958 - DNA, 25 bp, Mus musculus
gctagggatggaatggcttgacttt

SEQ ID NO: 563959 - DNA, 25 bp, Mus musculus
gctagggatggattggcttgacttt

SEQ ID NO: 563960 - DNA, 25 bp, Mus musculus
gctagggattctcaaagatttttta

SEQ ID NO: 563961 - DNA, 25 bp, Mus musculus
gctagggattctgaaagatttttta

SEQ ID NO: 563962 - DNA, 25 bp, Mus musculus
gctagggcactgcaagaacatttga

SEQ ID NO: 563963 - DNA, 25 bp, Mus musculus
gctagggcactggaagaacatttga

SEQ ID NO: 563964 - DNA, 25 bp, Mus musculus
gctagggccccgagcaagcaccttg

SEQ ID NO: 563965 - DNA, 25 bp, Mus musculus
gctagggccccgtgcaagcaccttg

SEQ ID NO: 563966 - DNA, 25 bp, Mus musculus
gctagggcggaccttgtgtttatat

SEQ ID NO: 563967 - DNA, 25 bp, Mus musculus
gctagggcggacgttgtgtttatat

SEQ ID NO: 563968 - DNA, 25 bp, Mus musculus
gctagggcgggcacaaacagcgacc

SEQ ID NO: 563969 - DNA, 25 bp, Mus musculus
gctagggcgggctcaaacagcgacc

SEQ ID NO: 563970 - DNA, 25 bp, Mus musculus
gctagggctcacaatgtgggtcata

SEQ ID NO: 563971 - DNA, 25 bp, Mus musculus
gctagggctcactatgtgggtcata

SEQ ID NO: 563972 - DNA, 25 bp, Mus musculus
gctagggtctgcagctaaggtcaac

SEQ ID NO: 563973 - DNA, 25 bp, Mus musculus
gctagggtctgctgctaaggtcaac

SEQ ID NO: 563974 - DNA, 25 bp, Mus musculus
gctagggtgtctacaatatgctgat

SEQ ID NO: 563975 - DNA, 25 bp, Mus musculus
gctagggtgtcttcaatatgctgat

SEQ ID NO: 563976 - DNA, 25 bp, Mus musculus
gctagggtttaacaatctcaactca

SEQ ID NO: 563977 - DNA, 25 bp, Mus musculus
gctagggtttaagaatctcaactca

SEQ ID NO: 563978 - DNA, 25 bp, Mus musculus
gctaggtacttgaaggctttccgaa

SEQ ID NO: 563979 - DNA, 25 bp, Mus musculus
gctaggtacttgtaggctttccgaa

SEQ ID NO: 563980 - DNA, 25 bp, Mus musculus
gctaggtagctaatattgttatgaa

SEQ ID NO: 563981 - DNA, 25 bp, Mus musculus
gctaggtagctattattgttatgaa

SEQ ID NO: 563982 - DNA, 25 bp, Mus musculus
gctaggtattcaaggcaacttatat

SEQ ID NO: 563983 - DNA, 25 bp, Mus musculus
gctaggtattcatggcaacttatat

SEQ ID NO: 563984 - DNA, 25 bp, Mus musculus
gctaggtcatgcacgaagaaggaga

SEQ ID NO: 563985 - DNA, 25 bp, Mus musculus
gctaggtcatgctcgaagaaggaga

SEQ ID NO: 563986 - DNA, 25 bp, Mus musculus
gctaggtctcacaaatatagcccag

SEQ ID NO: 563987 - DNA, 25 bp, Mus musculus
gctaggtctcactaatatagcccag

SEQ ID NO: 563988 - DNA, 25 bp, Mus musculus
gctaggtctcggaatatgttatggt

SEQ ID NO: 563989 - DNA, 25 bp, Mus musculus
gctaggtctcggtatatgttatggt

SEQ ID NO: 563990 - DNA, 25 bp, Mus musculus
gctaggtgacagcacatttacccat

SEQ ID NO: 563991 - DNA, 25 bp, Mus musculus
gctaggtgacagctttaggacattt

SEQ ID NO: 563992 - DNA, 25 bp, Mus musculus
gctaggtgacaggacatttacccat

SEQ ID NO: 563993 - DNA, 25 bp, Mus musculus
gctaggtgacaggtttaggacattt

SEQ ID NO: 563994 - DNA, 25 bp, Mus musculus
gctaggtgcccgacacgagaacggc

SEQ ID NO: 563995 - DNA, 25 bp, Mus musculus
gctaggtgcccgtcacgagaacggc

SEQ ID NO: 563996 - DNA, 25 bp, Mus musculus
gctaggtgcctaagttccaagttta

SEQ ID NO: 563997 - DNA, 25 bp, Mus musculus
gctaggtgcctatgttccaagttta

SEQ ID NO: 563998 - DNA, 25 bp, Mus musculus
gctaggtgctaccattctgtgatct

SEQ ID NO: 563999 - DNA, 25 bp, Mus musculus
gctaggtgctacgattctgtgatct

SEQ ID NO: 564000 - DNA, 25 bp, Mus musculus
gctaggtggacacagtctgctgcca

SEQ ID NO: 564001 - DNA, 25 bp, Mus musculus
gctaggtggacagagtctgctgcca

SEQ ID NO: 564002 - DNA, 25 bp, Mus musculus
gctaggtgttatcgcacatacccat

SEQ ID NO: 564003 - DNA, 25 bp, Mus musculus
gctaggtgttatggcacatacccat

SEQ ID NO: 564004 - DNA, 25 bp, Mus musculus
gctaggttctcacggagcctcccag

SEQ ID NO: 564005 - DNA, 25 bp, Mus musculus
gctaggttctcagggagcctcccag

SEQ ID NO: 564006 - DNA, 25 bp, Mus musculus
gctaggttctggcagctttggaaat

SEQ ID NO: 564007 - DNA, 25 bp, Mus musculus
gctaggttctgggagctttggaaat

SEQ ID NO: 564008 - DNA, 25 bp, Mus musculus
gctaggttgtttaagtgctttgtgg

SEQ ID NO: 564009 - DNA, 25 bp, Mus musculus
gctaggttgttttagtgctttgtgg

SEQ ID NO: 564010 - DNA, 25 bp, Mus musculus
gctaggtttacacctgattttcctg

SEQ ID NO: 564011 - DNA, 25 bp, Mus musculus
gctaggtttacagctgattttcctg

SEQ ID NO: 564012 - DNA, 25 bp, Mus musculus
gctaggtttcagacacccagagatt

SEQ ID NO: 564013 - DNA, 25 bp, Mus musculus
gctaggtttcagtcacccagagatt

SEQ ID NO: 564014 - DNA, 25 bp, Mus musculus
gctaggtttccaattagatcttcat

SEQ ID NO: 564015 - DNA, 25 bp, Mus musculus
gctaggtttccatttagatcttcat

SEQ ID NO: 564016 - DNA, 25 bp, Mus musculus
gctagtaatttacctcccaatttga

SEQ ID NO: 564017 - DNA, 25 bp, Mus musculus
gctagtaatttagctcccaatttga

SEQ ID NO: 564018 - DNA, 25 bp, Mus musculus
gctagtaccgcacatccaactggga

SEQ ID NO: 564019 - DNA, 25 bp, Mus musculus
gctagtaccgcagatccaactggga

SEQ ID NO: 564020 - DNA, 25 bp, Mus musculus
gctagtacctcaattgtctctggaa

SEQ ID NO: 564021 - DNA, 25 bp, Mus musculus
gctagtacctcatttgtctctggaa

SEQ ID NO: 564022 - DNA, 25 bp, Mus musculus
gctagtactttaaccacatggtgaa

SEQ ID NO: 564023 - DNA, 25 bp, Mus musculus
gctagtactttatccacatggtgaa

SEQ ID NO: 564024 - DNA, 25 bp, Mus musculus
gctagtagctggagagacacttccc

SEQ ID NO: 564025 - DNA, 25 bp, Mus musculus
gctagtagctggtgagacacttccc

SEQ ID NO: 564026 - DNA, 25 bp, Mus musculus
gctagtatatacaaagcccttgttt

SEQ ID NO: 564027 - DNA, 25 bp, Mus musculus
gctagtatatactaagcccttgttt

SEQ ID NO: 564028 - DNA, 25 bp, Mus musculus
gctagtatatcgctttcactctttg

SEQ ID NO: 564029 - DNA, 25 bp, Mus musculus
gctagtatatcggtttcactctttg

SEQ ID NO: 564030 - DNA, 25 bp, Mus musculus
gctagtattcatccatctcactcat

SEQ ID NO: 564031 - DNA, 25 bp, Mus musculus
gctagtattcatgcatctcactcat

SEQ ID NO: 564032 - DNA, 25 bp, Mus musculus
gctagtattcttatgctcttcaaac

SEQ ID NO: 564033 - DNA, 25 bp, Mus musculus
gctagtattcttttgctcttcaaac

SEQ ID NO: 564034 - DNA, 25 bp, Mus musculus
gctagtattgagcagagtcccctct

SEQ ID NO: 564035 - DNA, 25 bp, Mus musculus
gctagtattgaggagagtcccctct

SEQ ID NO: 564036 - DNA, 25 bp, Mus musculus
gctagtcagagcaccacaagtatac

SEQ ID NO: 564037 - DNA, 25 bp, Mus musculus
gctagtcagagctccacaagtatac

SEQ ID NO: 564038 - DNA, 25 bp, Mus musculus
gctagtcagagtccttcgagaacaa

SEQ ID NO: 564039 - DNA, 25 bp, Mus musculus
gctagtcagagtgcttcgagaacaa

SEQ ID NO: 564040 - DNA, 25 bp, Mus musculus
gctagtcaggacactgtctcaaatt

SEQ ID NO: 564041 - DNA, 25 bp, Mus musculus
gctagtcaggactctgtctcaaatt

SEQ ID NO: 564042 - DNA, 25 bp, Mus musculus
gctagtcagtcaccagagaacttta

SEQ ID NO: 564043 - DNA, 25 bp, Mus musculus
gctagtcagtcagcagagaacttta

SEQ ID NO: 564044 - DNA, 25 bp, Mus musculus
gctagtcattctacatgcttctcaa

SEQ ID NO: 564045 - DNA, 25 bp, Mus musculus
gctagtcattcttcatgcttctcaa

SEQ ID NO: 564046 - DNA, 25 bp, Mus musculus
gctagtccggacactgcgtatttcc

SEQ ID NO: 564047 - DNA, 25 bp, Mus musculus
gctagtccggactctgcgtatttcc

SEQ ID NO: 564048 - DNA, 25 bp, Mus musculus
gctagtcctttactcttagaaccct

SEQ ID NO: 564049 - DNA, 25 bp, Mus musculus
gctagtcctttagtcttagaaccct

SEQ ID NO: 564050 - DNA, 25 bp, Mus musculus
gctagtctaacaaacgttctgcaga

SEQ ID NO: 564051 - DNA, 25 bp, Mus musculus
gctagtctaacatacgttctgcaga

SEQ ID NO: 564052 - DNA, 25 bp, Mus musculus
gctagtctagttagtgtcgttcata

SEQ ID NO: 564053 - DNA, 25 bp, Mus musculus
gctagtctagtttgtgtcgttcata

SEQ ID NO: 564054 - DNA, 25 bp, Mus musculus
gctagtctcagaattgctccttgta

SEQ ID NO: 564055 - DNA, 25 bp, Mus musculus
gctagtctcagatttgctccttgta

SEQ ID NO: 564056 - DNA, 25 bp, Mus musculus
gctagtctcagtagcttatacatac

SEQ ID NO: 564057 - DNA, 25 bp, Mus musculus
gctagtctcagttgcttatacatac

SEQ ID NO: 564058 - DNA, 25 bp, Mus musculus
gctagtctgaggaacaggagacttt

SEQ ID NO: 564059 - DNA, 25 bp, Mus musculus
gctagtctgaggtacaggagacttt

SEQ ID NO: 564060 - DNA, 25 bp, Mus musculus
gctagtctgattcagcacactgcac

SEQ ID NO: 564061 - DNA, 25 bp, Mus musculus
gctagtctgattgagcacactgcac

SEQ ID NO: 564062 - DNA, 25 bp, Mus musculus
gctagtcttaaactttctagaagtt

SEQ ID NO: 564063 - DNA, 25 bp, Mus musculus
gctagtcttaaagtttctagaagtt

SEQ ID NO: 564064 - DNA, 25 bp, Mus musculus
gctagtgaactacccttggtgttct

SEQ ID NO: 564065 - DNA, 25 bp, Mus musculus
gctagtgaactagccttggtgttct

SEQ ID NO: 564066 - DNA, 25 bp, Mus musculus
gctagtgactgccattttgagcctt

SEQ ID NO: 564067 - DNA, 25 bp, Mus musculus
gctagtgactgcgattttgagcctt

SEQ ID NO: 564068 - DNA, 25 bp, Mus musculus
gctagtgagcctatggaatggcagt

SEQ ID NO: 564069 - DNA, 25 bp, Mus musculus
gctagtgagcctttggaatggcagt

SEQ ID NO: 564070 - DNA, 25 bp, Mus musculus
gctagtgatctactgtcagagaaaa

SEQ ID NO: 564071 - DNA, 25 bp, Mus musculus
gctagtgatctagtgtcagagaaaa

SEQ ID NO: 564072 - DNA, 25 bp, Mus musculus
gctagtgatggcatcatgtggtaat

SEQ ID NO: 564073 - DNA, 25 bp, Mus musculus
gctagtgatggcttcatgtggtaat

SEQ ID NO: 564074 - DNA, 25 bp, Mus musculus
gctagtgatgtcattcttgccacac

SEQ ID NO: 564075 - DNA, 25 bp, Mus musculus
gctagtgatgtctttcttgccacac

SEQ ID NO: 564076 - DNA, 25 bp, Mus musculus
gctagtgattgaaccagacaagcgg

SEQ ID NO: 564077 - DNA, 25 bp, Mus musculus
gctagtgattgatccagacaagcgg

SEQ ID NO: 564078 - DNA, 25 bp, Mus musculus
gctagtggacgactgcagccactca

SEQ ID NO: 564079 - DNA, 25 bp, Mus musculus
gctagtggacgagtgcagccactca

SEQ ID NO: 564080 - DNA, 25 bp, Mus musculus
gctagtggagacatgtgacgctgct

SEQ ID NO: 564081 - DNA, 25 bp, Mus musculus
gctagtggagacttgtgacgctgct

SEQ ID NO: 564082 - DNA, 25 bp, Mus musculus
gctagtgggatccttctcatgggtc

SEQ ID NO: 564083 - DNA, 25 bp, Mus musculus
gctagtgggatcgttctcatgggtc

SEQ ID NO: 564084 - DNA, 25 bp, Mus musculus
gctagtgggattacacatgtgtacc

SEQ ID NO: 564085 - DNA, 25 bp, Mus musculus
gctagtgggatttcacatgtgtacc

SEQ ID NO: 564086 - DNA, 25 bp, Mus musculus
gctagtgggcggctgggacatcagt

SEQ ID NO: 564087 - DNA, 25 bp, Mus musculus
gctagtgggcgggtgggacatcagt

SEQ ID NO: 564088 - DNA, 25 bp, Mus musculus
gctagtggtaccacaccatgtactg

SEQ ID NO: 564089 - DNA, 25 bp, Mus musculus
gctagtggtacctcaccatgtactg

SEQ ID NO: 564090 - DNA, 25 bp, Mus musculus
gctagtggtcgtaaacgcatttacc

SEQ ID NO: 564091 - DNA, 25 bp, Mus musculus
gctagtggtcgttaacgcatttacc

SEQ ID NO: 564092 - DNA, 25 bp, Mus musculus
gctagtgtcagcctcagcgtcaccg

SEQ ID NO: 564093 - DNA, 25 bp, Mus musculus
gctagtgtcagcgtcagcgtcaccg

SEQ ID NO: 564094 - DNA, 25 bp, Mus musculus
gctagtgtcggtattgtgtgttcta

SEQ ID NO: 564095 - DNA, 25 bp, Mus musculus
gctagtgtcggttttgtgtgttcta

SEQ ID NO: 564096 - DNA, 25 bp, Mus musculus
gctagtgtcgtccagtggttctact

SEQ ID NO: 564097 - DNA, 25 bp, Mus musculus
gctagtgtcgtcgagtggttctact

SEQ ID NO: 564098 - DNA, 25 bp, Mus musculus
gctagtgtctacatacctacagaag

SEQ ID NO: 564099 - DNA, 25 bp, Mus musculus
gctagtgtctacttacctacagaag

SEQ ID NO: 564100 - DNA, 25 bp, Mus musculus
gctagtgtctgtcagaaaagccaag

SEQ ID NO: 564101 - DNA, 25 bp, Mus musculus
gctagtgtctgtcaggtgcctttgt

SEQ ID NO: 564102 - DNA, 25 bp, Mus musculus
gctagtgtctgtgagaaaagccaag

SEQ ID NO: 564103 - DNA, 25 bp, Mus musculus
gctagtgtctgtgaggtgcctttgt

SEQ ID NO: 564104 - DNA, 25 bp, Mus musculus
gctagtgtggctcacagtgcactca

SEQ ID NO: 564105 - DNA, 25 bp, Mus musculus
gctagtgtggctgacagtgcactca

SEQ ID NO: 564106 - DNA, 25 bp, Mus musculus
gctagtgtgtgaccaggttagttca

SEQ ID NO: 564107 - DNA, 25 bp, Mus musculus
gctagtgtgtgagcaggttagttca

SEQ ID NO: 564108 - DNA, 25 bp, Mus musculus
gctagtgttaaaatccgcaatccca

SEQ ID NO: 564109 - DNA, 25 bp, Mus musculus
gctagtgttaaattccgcaatccca

SEQ ID NO: 564110 - DNA, 25 bp, Mus musculus
gctagtgttcacatggtgggtaaca

SEQ ID NO: 564111 - DNA, 25 bp, Mus musculus
gctagtgttcacttggtgggtaaca

SEQ ID NO: 564112 - DNA, 25 bp, Mus musculus
gctagtgtttgtattgtactgctaa

SEQ ID NO: 564113 - DNA, 25 bp, Mus musculus
gctagtgtttgttttgtactgctaa

SEQ ID NO: 564114 - DNA, 25 bp, Mus musculus
gctagttacttcctcaaaactcctt

SEQ ID NO: 564115 - DNA, 25 bp, Mus musculus
gctagttacttcgtcaaaactcctt

SEQ ID NO: 564116 - DNA, 25 bp, Mus musculus
gctagttagaacaacgcagtaagac

SEQ ID NO: 564117 - DNA, 25 bp, Mus musculus
gctagttagaactacgcagtaagac

SEQ ID NO: 564118 - DNA, 25 bp, Mus musculus
gctagttaggacagcatgggaccat

SEQ ID NO: 564119 - DNA, 25 bp, Mus musculus
gctagttaggactgcatgggaccat

SEQ ID NO: 564120 - DNA, 25 bp, Mus musculus
gctagttatatcagctctgcacaac

SEQ ID NO: 564121 - DNA, 25 bp, Mus musculus
gctagttatatctgctctgcacaac

SEQ ID NO: 564122 - DNA, 25 bp, Mus musculus
gctagttccagaaaactgccagttt

SEQ ID NO: 564123 - DNA, 25 bp, Mus musculus
gctagttccagataactgccagttt

SEQ ID NO: 564124 - DNA, 25 bp, Mus musculus
gctagttcctaaatgtatggaggtt

SEQ ID NO: 564125 - DNA, 25 bp, Mus musculus
gctagttcctaattgtatggaggtt

SEQ ID NO: 564126 - DNA, 25 bp, Mus musculus
gctagttccttaatgtactgctcac

SEQ ID NO: 564127 - DNA, 25 bp, Mus musculus
gctagttccttattgtactgctcac

SEQ ID NO: 564128 - DNA, 25 bp, Mus musculus
gctagttcgcacagatgctctgcag

SEQ ID NO: 564129 - DNA, 25 bp, Mus musculus
gctagttcgcactgatgctctgcag

SEQ ID NO: 564130 - DNA, 25 bp, Mus musculus
gctagttctaaccttgattctcttc

SEQ ID NO: 564131 - DNA, 25 bp, Mus musculus
gctagttctaacgttgattctcttc

SEQ ID NO: 564132 - DNA, 25 bp, Mus musculus
gctagttctcttccctggagcagaa

SEQ ID NO: 564133 - DNA, 25 bp, Mus musculus
gctagttctcttgcctggagcagaa

SEQ ID NO: 564134 - DNA, 25 bp, Mus musculus
gctagttgcaatcccatgagcagaa

SEQ ID NO: 564135 - DNA, 25 bp, Mus musculus
gctagttgcaatgccatgagcagaa

SEQ ID NO: 564136 - DNA, 25 bp, Mus musculus
gctagttgcattctgtgctaccgga

SEQ ID NO: 564137 - DNA, 25 bp, Mus musculus
gctagttgcattgtgtgctaccgga

SEQ ID NO: 564138 - DNA, 25 bp, Mus musculus
gctagttgctacagggtggcagata

SEQ ID NO: 564139 - DNA, 25 bp, Mus musculus
gctagttgctactgggtggcagata

SEQ ID NO: 564140 - DNA, 25 bp, Mus musculus
gctagttggagcacactttctctga

SEQ ID NO: 564141 - DNA, 25 bp, Mus musculus
gctagttggagctcactttctctga

SEQ ID NO: 564142 - DNA, 25 bp, Mus musculus
gctagttgggtcaaacatgcctata

SEQ ID NO: 564143 - DNA, 25 bp, Mus musculus
gctagttgggtctaacatgcctata

SEQ ID NO: 564144 - DNA, 25 bp, Mus musculus
gctagttgggtgctacatggcttta

SEQ ID NO: 564145 - DNA, 25 bp, Mus musculus
gctagttgggtggtacatggcttta

SEQ ID NO: 564146 - DNA, 25 bp, Mus musculus
gctagttgtctacgatctattcagg

SEQ ID NO: 564147 - DNA, 25 bp, Mus musculus
gctagttgtctaggatctattcagg

SEQ ID NO: 564148 - DNA, 25 bp, Mus musculus
gctagtttagcacttttactccatt

SEQ ID NO: 564149 - DNA, 25 bp, Mus musculus
gctagtttagcagttttactccatt

SEQ ID NO: 564150 - DNA, 25 bp, Mus musculus
gctagtttcaatcctttgtaagatg

SEQ ID NO: 564151 - DNA, 25 bp, Mus musculus
gctagtttcaatgctttgtaagatg

SEQ ID NO: 564152 - DNA, 25 bp, Mus musculus
gctagtttccatatgctccaggatt

SEQ ID NO: 564153 - DNA, 25 bp, Mus musculus
gctagtttccatttgctccaggatt

SEQ ID NO: 564154 - DNA, 25 bp, Mus musculus
gctagtttcctccaacccctggtga

SEQ ID NO: 564155 - DNA, 25 bp, Mus musculus
gctagtttcctcgaacccctggtga

SEQ ID NO: 564156 - DNA, 25 bp, Mus musculus
gctagtttgatccatgtgtacccat

SEQ ID NO: 564157 - DNA, 25 bp, Mus musculus
gctagtttgatcgatgtgtacccat

SEQ ID NO: 564158 - DNA, 25 bp, Mus musculus
gctagtttgctcactcaagttttta

SEQ ID NO: 564159 - DNA, 25 bp, Mus musculus
gctagtttgctctctcaagttttta

SEQ ID NO: 564160 - DNA, 25 bp, Mus musculus
gctagtttgcttcttgcatgttctg

SEQ ID NO: 564161 - DNA, 25 bp, Mus musculus
gctagtttgcttgttgcatgttctg

SEQ ID NO: 564162 - DNA, 25 bp, Mus musculus
gctagtttgtagaccacatgtatgt

SEQ ID NO: 564163 - DNA, 25 bp, Mus musculus
gctagtttgtagtccacatgtatgt

SEQ ID NO: 564164 - DNA, 25 bp, Mus musculus
gctagttttcacacacatctttccc

SEQ ID NO: 564165 - DNA, 25 bp, Mus musculus
gctagttttcactcacatctttccc

SEQ ID NO: 564166 - DNA, 25 bp, Mus musculus
gctataaaatcaccacggtctttag

SEQ ID NO: 564167 - DNA, 25 bp, Mus musculus
gctataaaatcagcacggtctttag

SEQ ID NO: 564168 - DNA, 25 bp, Mus musculus
gctataaacagtccttgtggacatg

SEQ ID NO: 564169 - DNA, 25 bp, Mus musculus
gctataaacagtgcttgtggacatg

SEQ ID NO: 564170 - DNA, 25 bp, Mus musculus
gctataaaccaactgctacatccta

SEQ ID NO: 564171 - DNA, 25 bp, Mus musculus
gctataaaccaagtgctacatccta

SEQ ID NO: 564172 - DNA, 25 bp, Mus musculus
gctataaagctcagattgtgtgtga

SEQ ID NO: 564173 - DNA, 25 bp, Mus musculus
gctataaagctctgattgtgtgtga

SEQ ID NO: 564174 - DNA, 25 bp, Mus musculus
gctataaaggtcacagtgtcccctc

SEQ ID NO: 564175 - DNA, 25 bp, Mus musculus
gctataaaggtctcagtgtcccctc

SEQ ID NO: 564176 - DNA, 25 bp, Mus musculus
gctataaagtgtatgaccttcgcta

SEQ ID NO: 564177 - DNA, 25 bp, Mus musculus
gctataaagtgtttgaccttcgcta

SEQ ID NO: 564178 - DNA, 25 bp, Mus musculus
gctataaattccagaaggcgctgaa

SEQ ID NO: 564179 - DNA, 25 bp, Mus musculus
gctataaattcctgaaggcgctgaa

SEQ ID NO: 564180 - DNA, 25 bp, Mus musculus
gctataaatttcaaattgcccctga

SEQ ID NO: 564181 - DNA, 25 bp, Mus musculus
gctataaatttctaattgcccctga

SEQ ID NO: 564182 - DNA, 25 bp, Mus musculus
gctataacacctatattggacagtg

SEQ ID NO: 564183 - DNA, 25 bp, Mus musculus
gctataacacctttattggacagtg

SEQ ID NO: 564184 - DNA, 25 bp, Mus musculus
gctataacagacctggccacatggc

SEQ ID NO: 564185 - DNA, 25 bp, Mus musculus
gctataacagacgtggccacatggc

SEQ ID NO: 564186 - DNA, 25 bp, Mus musculus
gctataacccatctggtgaacccaa

SEQ ID NO: 564187 - DNA, 25 bp, Mus musculus
gctataacccatgtggtgaacccaa

SEQ ID NO: 564188 - DNA, 25 bp, Mus musculus
gctataacctggctttataccaccc

SEQ ID NO: 564189 - DNA, 25 bp, Mus musculus
gctataacctgggtttataccaccc

SEQ ID NO: 564190 - DNA, 25 bp, Mus musculus
gctataacgggcatctcacttgagg

SEQ ID NO: 564191 - DNA, 25 bp, Mus musculus
gctataacgggcttctcacttgagg

SEQ ID NO: 564192 - DNA, 25 bp, Mus musculus
gctataactatcatttttgtgctgg

SEQ ID NO: 564193 - DNA, 25 bp, Mus musculus
gctataactatcttttttgtgctgg

SEQ ID NO: 564194 - DNA, 25 bp, Mus musculus
gctataactattcttctggctacac

SEQ ID NO: 564195 - DNA, 25 bp, Mus musculus
gctataactattgttctggctacac

SEQ ID NO: 564196 - DNA, 25 bp, Mus musculus
gctataagacttcttgctacttgca

SEQ ID NO: 564197 - DNA, 25 bp, Mus musculus
gctataagacttgttgctacttgca

SEQ ID NO: 564198 - DNA, 25 bp, Mus musculus
gctataagcgccaagcttcgggcca

SEQ ID NO: 564199 - DNA, 25 bp, Mus musculus
gctataagcgcctagcttcgggcca

SEQ ID NO: 564200 - DNA, 25 bp, Mus musculus
gctataagcttccatctttagtggg

SEQ ID NO: 564201 - DNA, 25 bp, Mus musculus
gctataagcttcgatctttagtggg

SEQ ID NO: 564202 - DNA, 25 bp, Mus musculus
gctataataacgagcttgggtgtgt

SEQ ID NO: 564203 - DNA, 25 bp, Mus musculus
gctataataacgtgcttgggtgtgt

SEQ ID NO: 564204 - DNA, 25 bp, Mus musculus
gctataatacttcactgctcctttt

SEQ ID NO: 564205 - DNA, 25 bp, Mus musculus
gctataatacttgactgctcctttt

SEQ ID NO: 564206 - DNA, 25 bp, Mus musculus
gctataatatatctgtactcctatg

SEQ ID NO: 564207 - DNA, 25 bp, Mus musculus
gctataatatatgtgtactcctatg

SEQ ID NO: 564208 - DNA, 25 bp, Mus musculus
gctataatcactctcaggtttattg

SEQ ID NO: 564209 - DNA, 25 bp, Mus musculus
gctataatcactgtcaggtttattg

SEQ ID NO: 564210 - DNA, 25 bp, Mus musculus
gctataatctagaccatgttcaaat

SEQ ID NO: 564211 - DNA, 25 bp, Mus musculus
gctataatctagtccatgttcaaat

SEQ ID NO: 564212 - DNA, 25 bp, Mus musculus
gctataatctccaaattccacattt

SEQ ID NO: 564213 - DNA, 25 bp, Mus musculus
gctataatctcctaattccacattt

SEQ ID NO: 564214 - DNA, 25 bp, Mus musculus
gctataatcttacccaatgcatgtt

SEQ ID NO: 564215 - DNA, 25 bp, Mus musculus
gctataatcttagccaatgcatgtt

SEQ ID NO: 564216 - DNA, 25 bp, Mus musculus
gctataatgtcaccatcggaggcca

SEQ ID NO: 564217 - DNA, 25 bp, Mus musculus
gctataatgtcagcatcggaggcca

SEQ ID NO: 564218 - DNA, 25 bp, Mus musculus
gctataattactacctgtttgctat

SEQ ID NO: 564219 - DNA, 25 bp, Mus musculus
gctataattacttcctgtttgctat

SEQ ID NO: 564220 - DNA, 25 bp, Mus musculus
gctataattgccaaggtcttaccgg

SEQ ID NO: 564221 - DNA, 25 bp, Mus musculus
gctataattgcctaggtcttaccgg

SEQ ID NO: 564222 - DNA, 25 bp, Mus musculus
gctatacaatttatgcacgcagaaa

SEQ ID NO: 564223 - DNA, 25 bp, Mus musculus
gctatacaatttttgcacgcagaaa

SEQ ID NO: 564224 - DNA, 25 bp, Mus musculus
gctatacactgtacatattgactgc

SEQ ID NO: 564225 - DNA, 25 bp, Mus musculus
gctatacactgttcatattgactgc

SEQ ID NO: 564226 - DNA, 25 bp, Mus musculus
gctataccaacaaaattggacccag

SEQ ID NO: 564227 - DNA, 25 bp, Mus musculus
gctataccaacataattggacccag

SEQ ID NO: 564228 - DNA, 25 bp, Mus musculus
gctataccacttctgtgaatttaaa

SEQ ID NO: 564229 - DNA, 25 bp, Mus musculus
gctataccacttgtgtgaatttaaa

SEQ ID NO: 564230 - DNA, 25 bp, Mus musculus
gctatacccgatataattccagaat

SEQ ID NO: 564231 - DNA, 25 bp, Mus musculus
gctatacccgatttaattccagaat

SEQ ID NO: 564232 - DNA, 25 bp, Mus musculus
gctataccctcaactctaacctggg

SEQ ID NO: 564233 - DNA, 25 bp, Mus musculus
gctataccctcaactgggatctcaa

SEQ ID NO: 564234 - DNA, 25 bp, Mus musculus
gctataccctcatctctaacctggg

SEQ ID NO: 564235 - DNA, 25 bp, Mus musculus
gctataccctcatctgggatctcaa

SEQ ID NO: 564236 - DNA, 25 bp, Mus musculus
gctataccctttaaagaagcaggag

SEQ ID NO: 564237 - DNA, 25 bp, Mus musculus
gctatacccttttaagaagcaggag

SEQ ID NO: 564238 - DNA, 25 bp, Mus musculus
gctatacctccacacccaaatatgt

SEQ ID NO: 564239 - DNA, 25 bp, Mus musculus
gctatacctccagacccaaatatgt

SEQ ID NO: 564240 - DNA, 25 bp, Mus musculus
gctatactgctcaatattctctcag

SEQ ID NO: 564241 - DNA, 25 bp, Mus musculus
gctatactgctctatattctctcag

SEQ ID NO: 564242 - DNA, 25 bp, Mus musculus
gctatacttaggctggctgtgtgct

SEQ ID NO: 564243 - DNA, 25 bp, Mus musculus
gctatacttagggtggctgtgtgct

SEQ ID NO: 564244 - DNA, 25 bp, Mus musculus
gctatacttggaatcaatctgatca

SEQ ID NO: 564245 - DNA, 25 bp, Mus musculus
gctatacttggattcaatctgatca

SEQ ID NO: 564246 - DNA, 25 bp, Mus musculus
gctatactttttcaatatgcacgtt

SEQ ID NO: 564247 - DNA, 25 bp, Mus musculus
gctatactttttgaatatgcacgtt

SEQ ID NO: 564248 - DNA, 25 bp, Mus musculus
gctatagaccaaatcagatgcagaa

SEQ ID NO: 564249 - DNA, 25 bp, Mus musculus
gctatagaccaattcagatgcagaa

SEQ ID NO: 564250 - DNA, 25 bp, Mus musculus
gctatagagagtcccctgaagcctg

SEQ ID NO: 564251 - DNA, 25 bp, Mus musculus
gctatagagagtgccctgaagcctg

SEQ ID NO: 564252 - DNA, 25 bp, Mus musculus
gctatagagcctctctgggtcctta

SEQ ID NO: 564253 - DNA, 25 bp, Mus musculus
gctatagagcctgtctgggtcctta

SEQ ID NO: 564254 - DNA, 25 bp, Mus musculus
gctatagaggttacgtttgcaggga

SEQ ID NO: 564255 - DNA, 25 bp, Mus musculus
gctatagaggtttcgtttgcaggga

SEQ ID NO: 564256 - DNA, 25 bp, Mus musculus
gctatagatgtgagcactgctggca

SEQ ID NO: 564257 - DNA, 25 bp, Mus musculus
gctatagatgtgtgcactgctggca

SEQ ID NO: 564258 - DNA, 25 bp, Mus musculus
gctatagcagccacgaaatcacaga

SEQ ID NO: 564259 - DNA, 25 bp, Mus musculus
gctatagcagcctcgaaatcacaga

SEQ ID NO: 564260 - DNA, 25 bp, Mus musculus
gctatagcagctatgaatttattgc

SEQ ID NO: 564261 - DNA, 25 bp, Mus musculus
gctatagcagctttgaatttattgc

SEQ ID NO: 564262 - DNA, 25 bp, Mus musculus
gctatagcagggcagggacatttct

SEQ ID NO: 564263 - DNA, 25 bp, Mus musculus
gctatagcaggggagggacatttct

SEQ ID NO: 564264 - DNA, 25 bp, Mus musculus
gctatagcatggaatgtgacacaga

SEQ ID NO: 564265 - DNA, 25 bp, Mus musculus
gctatagcatggtatgtgacacaga

SEQ ID NO: 564266 - DNA, 25 bp, Mus musculus
gctatagcccaaccctaaagattgt

SEQ ID NO: 564267 - DNA, 25 bp, Mus musculus
gctatagcccaagcctaaagattgt

SEQ ID NO: 564268 - DNA, 25 bp, Mus musculus
gctatagcctatagagagctgagat

SEQ ID NO: 564269 - DNA, 25 bp, Mus musculus
gctatagcctattgagagctgagat

SEQ ID NO: 564270 - DNA, 25 bp, Mus musculus
gctatagcctcaagggtgctggaat

SEQ ID NO: 564271 - DNA, 25 bp, Mus musculus
gctatagcctcatgggtgctggaat

SEQ ID NO: 564272 - DNA, 25 bp, Mus musculus
gctatagcctgtctatttcatctta

SEQ ID NO: 564273 - DNA, 25 bp, Mus musculus
gctatagcctgtgtatttcatctta

SEQ ID NO: 564274 - DNA, 25 bp, Mus musculus
gctataggcaagacactcaatcaga

SEQ ID NO: 564275 - DNA, 25 bp, Mus musculus
gctataggcaagtcactcaatcaga

SEQ ID NO: 564276 - DNA, 25 bp, Mus musculus
gctataggccaaaccgctgatgcag

SEQ ID NO: 564277 - DNA, 25 bp, Mus musculus
gctataggccaatccgctgatgcag

SEQ ID NO: 564278 - DNA, 25 bp, Mus musculus
gctatagggcctaaactgaattata

SEQ ID NO: 564279 - DNA, 25 bp, Mus musculus
gctatagggccttaactgaattata

SEQ ID NO: 564280 - DNA, 25 bp, Mus musculus
gctatagtatatacacatccataaa

SEQ ID NO: 564281 - DNA, 25 bp, Mus musculus
gctatagtatattcacatccataaa

SEQ ID NO: 564282 - DNA, 25 bp, Mus musculus
gctatagtcacacctacctgaaagt

SEQ ID NO: 564283 - DNA, 25 bp, Mus musculus
gctatagtcacagctacctgaaagt

SEQ ID NO: 564284 - DNA, 25 bp, Mus musculus
gctatagttcatcgtctagtgtttt

SEQ ID NO: 564285 - DNA, 25 bp, Mus musculus
gctatagttcatggtctagtgtttt

SEQ ID NO: 564286 - DNA, 25 bp, Mus musculus
gctatagttctcaatatcattatgt

SEQ ID NO: 564287 - DNA, 25 bp, Mus musculus
gctatagttctctatatcattatgt

SEQ ID NO: 564288 - DNA, 25 bp, Mus musculus
gctatatacgagaactcagaatttt

SEQ ID NO: 564289 - DNA, 25 bp, Mus musculus
gctatatacgagtactcagaatttt

SEQ ID NO: 564290 - DNA, 25 bp, Mus musculus
gctatatacttaatcatgtgggttt

SEQ ID NO: 564291 - DNA, 25 bp, Mus musculus
gctatatacttattcatgtgggttt

SEQ ID NO: 564292 - DNA, 25 bp, Mus musculus
gctatatataatcatgcaggcctgc

SEQ ID NO: 564293 - DNA, 25 bp, Mus musculus
gctatatataatgatgcaggcctgc

SEQ ID NO: 564294 - DNA, 25 bp, Mus musculus
gctatatatgtcactagggccacat

SEQ ID NO: 564295 - DNA, 25 bp, Mus musculus
gctatatatgtctctagggccacat

SEQ ID NO: 564296 - DNA, 25 bp, Mus musculus
gctatatcaaaaatcttcccaccgg

SEQ ID NO: 564297 - DNA, 25 bp, Mus musculus
gctatatcaaaattcttcccaccgg

SEQ ID NO: 564298 - DNA, 25 bp, Mus musculus
gctatatccagtactcgttttacac

SEQ ID NO: 564299 - DNA, 25 bp, Mus musculus
gctatatccagttctcgttttacac

SEQ ID NO: 564300 - DNA, 25 bp, Mus musculus
gctatatcctgacctttctagctat

SEQ ID NO: 564301 - DNA, 25 bp, Mus musculus
gctatatcctgagctttctagctat

SEQ ID NO: 564302 - DNA, 25 bp, Mus musculus
gctatatctcagactacagtccata

SEQ ID NO: 564303 - DNA, 25 bp, Mus musculus
gctatatctcagtctacagtccata

SEQ ID NO: 564304 - DNA, 25 bp, Mus musculus
gctatatcttcgacctcttttacaa

SEQ ID NO: 564305 - DNA, 25 bp, Mus musculus
gctatatcttcgtcctcttttacaa

SEQ ID NO: 564306 - DNA, 25 bp, Mus musculus
gctatatgccaacatctgtggtctc

SEQ ID NO: 564307 - DNA, 25 bp, Mus musculus
gctatatgccaagatctgtggtctc

SEQ ID NO: 564308 - DNA, 25 bp, Mus musculus
gctatatgccttcctgagtcatgga

SEQ ID NO: 564309 - DNA, 25 bp, Mus musculus
gctatatgccttgctgagtcatgga

SEQ ID NO: 564310 - DNA, 25 bp, Mus musculus
gctatatgcgccctggtggctaccg

SEQ ID NO: 564311 - DNA, 25 bp, Mus musculus
gctatatgcgccgtggtggctaccg

SEQ ID NO: 564312 - DNA, 25 bp, Mus musculus
gctatatggctacaagacctcccaa

SEQ ID NO: 564313 - DNA, 25 bp, Mus musculus
gctatatggctagaagacctcccaa

SEQ ID NO: 564314 - DNA, 25 bp, Mus musculus
gctatatgtaatctacctctgacac

SEQ ID NO: 564315 - DNA, 25 bp, Mus musculus
gctatatgtaatgtacctctgacac

SEQ ID NO: 564316 - DNA, 25 bp, Mus musculus
gctatatgtccccacatgcaggcta

SEQ ID NO: 564317 - DNA, 25 bp, Mus musculus
gctatatgtcccgacatgcaggcta

SEQ ID NO: 564318 - DNA, 25 bp, Mus musculus
gctatatgtgcaactgctaaaagca

SEQ ID NO: 564319 - DNA, 25 bp, Mus musculus
gctatatgtgcatctgctaaaagca

SEQ ID NO: 564320 - DNA, 25 bp, Mus musculus
gctatattcacaagtcttccaggca

SEQ ID NO: 564321 - DNA, 25 bp, Mus musculus
gctatattcacatgtcttccaggca

SEQ ID NO: 564322 - DNA, 25 bp, Mus musculus
gctatattcttgatgtccttttaaa

SEQ ID NO: 564323 - DNA, 25 bp, Mus musculus
gctatattcttgttgtccttttaaa

SEQ ID NO: 564324 - DNA, 25 bp, Mus musculus
gctatatttcctctaaacggcgact

SEQ ID NO: 564325 - DNA, 25 bp, Mus musculus
gctatatttcctgtaaacggcgact

SEQ ID NO: 564326 - DNA, 25 bp, Mus musculus
gctatatttgcccaaagagactcta

SEQ ID NO: 564327 - DNA, 25 bp, Mus musculus
gctatatttgccgaaagagactcta

SEQ ID NO: 564328 - DNA, 25 bp, Mus musculus
gctatattttatcagggctccagag

SEQ ID NO: 564329 - DNA, 25 bp, Mus musculus
gctatattttatcctctgggttcta

SEQ ID NO: 564330 - DNA, 25 bp, Mus musculus
gctatattttatgagggctccagag

SEQ ID NO: 564331 - DNA, 25 bp, Mus musculus
gctatattttatgctctgggttcta

SEQ ID NO: 564332 - DNA, 25 bp, Mus musculus
gctatcaactccagcatcttttatg

SEQ ID NO: 564333 - DNA, 25 bp, Mus musculus
gctatcaactcctgcatcttttatg

SEQ ID NO: 564334 - DNA, 25 bp, Mus musculus
gctatcaagatgatcacactcagat

SEQ ID NO: 564335 - DNA, 25 bp, Mus musculus
gctatcaagatgttcacactcagat

SEQ ID NO: 564336 - DNA, 25 bp, Mus musculus
gctatcaataccacagttacgcgac

SEQ ID NO: 564337 - DNA, 25 bp, Mus musculus
gctatcaatacctcagttacgcgac

SEQ ID NO: 564338 - DNA, 25 bp, Mus musculus
gctatcaatcgcaacttcactaggt

SEQ ID NO: 564339 - DNA, 25 bp, Mus musculus
gctatcaatcgctacttcactaggt

SEQ ID NO: 564340 - DNA, 25 bp, Mus musculus
gctatcaatgctactgtgatcggac

SEQ ID NO: 564341 - DNA, 25 bp, Mus musculus
gctatcaatgcttctgtgatcggac

SEQ ID NO: 564342 - DNA, 25 bp, Mus musculus
gctatcacacacatgcctaacataa

SEQ ID NO: 564343 - DNA, 25 bp, Mus musculus
gctatcacacacttgcctaacataa

SEQ ID NO: 564344 - DNA, 25 bp, Mus musculus
gctatcacatagattcctttcacta

SEQ ID NO: 564345 - DNA, 25 bp, Mus musculus
gctatcacatagtttcctttcacta

SEQ ID NO: 564346 - DNA, 25 bp, Mus musculus
gctatcaccggaagcttcgagctat

SEQ ID NO: 564347 - DNA, 25 bp, Mus musculus
gctatcaccggatgcttcgagctat

SEQ ID NO: 564348 - DNA, 25 bp, Mus musculus
gctatcaccggccacataagaaaga

SEQ ID NO: 564349 - DNA, 25 bp, Mus musculus
gctatcaccggcgacataagaaaga

SEQ ID NO: 564350 - DNA, 25 bp, Mus musculus
gctatcactttactataaaacactg

SEQ ID NO: 564351 - DNA, 25 bp, Mus musculus
gctatcactttagtataaaacactg

SEQ ID NO: 564352 - DNA, 25 bp, Mus musculus
gctatcaggcaactgatgccactgg

SEQ ID NO: 564353 - DNA, 25 bp, Mus musculus
gctatcaggcaagtgatgccactgg

SEQ ID NO: 564354 - DNA, 25 bp, Mus musculus
gctatcagtactagaatgaacatca

SEQ ID NO: 564355 - DNA, 25 bp, Mus musculus
gctatcagtacttgaatgaacatca

SEQ ID NO: 564356 - DNA, 25 bp, Mus musculus
gctatcagtagcacctattggtctt

SEQ ID NO: 564357 - DNA, 25 bp, Mus musculus
gctatcagtagctcctattggtctt

SEQ ID NO: 564358 - DNA, 25 bp, Mus musculus
gctatcagtattcttgtatgaccga

SEQ ID NO: 564359 - DNA, 25 bp, Mus musculus
gctatcagtattgttgtatgaccga

SEQ ID NO: 564360 - DNA, 25 bp, Mus musculus
gctatcagtctgatgaggtccattc

SEQ ID NO: 564361 - DNA, 25 bp, Mus musculus
gctatcagtctgttgaggtccattc

SEQ ID NO: 564362 - DNA, 25 bp, Mus musculus
gctatcagttaaccgatgaagtcgt

SEQ ID NO: 564363 - DNA, 25 bp, Mus musculus
gctatcagttaagcgatgaagtcgt

SEQ ID NO: 564364 - DNA, 25 bp, Mus musculus
gctatcatagctccactgtttgcaa

SEQ ID NO: 564365 - DNA, 25 bp, Mus musculus
gctatcatagctgcactgtttgcaa

SEQ ID NO: 564366 - DNA, 25 bp, Mus musculus
gctatcatcgtcctagtgagtattt

SEQ ID NO: 564367 - DNA, 25 bp, Mus musculus
gctatcatcgtcgtagtgagtattt

SEQ ID NO: 564368 - DNA, 25 bp, Mus musculus
gctatcatcttgacacttttgtggt

SEQ ID NO: 564369 - DNA, 25 bp, Mus musculus
gctatcatcttgtcacttttgtggt

SEQ ID NO: 564370 - DNA, 25 bp, Mus musculus
gctatcatctttctgagagttcaga

SEQ ID NO: 564371 - DNA, 25 bp, Mus musculus
gctatcatctttgtgagagttcaga

SEQ ID NO: 564372 - DNA, 25 bp, Mus musculus
gctatcatgaacagtatcttgctct

SEQ ID NO: 564373 - DNA, 25 bp, Mus musculus
gctatcatgaactgtatcttgctct

SEQ ID NO: 564374 - DNA, 25 bp, Mus musculus
gctatcattactccttctttcagag

SEQ ID NO: 564375 - DNA, 25 bp, Mus musculus
gctatcattactgcttctttcagag

SEQ ID NO: 564376 - DNA, 25 bp, Mus musculus
gctatcatttatcgacactgcttta

SEQ ID NO: 564377 - DNA, 25 bp, Mus musculus
gctatcatttatggacactgcttta

SEQ ID NO: 564378 - DNA, 25 bp, Mus musculus
gctatcatttcaaagggagactcct

SEQ ID NO: 564379 - DNA, 25 bp, Mus musculus
gctatcatttcatagggagactcct

SEQ ID NO: 564380 - DNA, 25 bp, Mus musculus
gctatccaaagcaggcaaacccaat

SEQ ID NO: 564381 - DNA, 25 bp, Mus musculus
gctatccaaagctggcaaacccaat

SEQ ID NO: 564382 - DNA, 25 bp, Mus musculus
gctatccaagacacagttgttccta

SEQ ID NO: 564383 - DNA, 25 bp, Mus musculus
gctatccaagactcagttgttccta

SEQ ID NO: 564384 - DNA, 25 bp, Mus musculus
gctatccacaggaacctttcacaac

SEQ ID NO: 564385 - DNA, 25 bp, Mus musculus
gctatccacaggtacctttcacaac

SEQ ID NO: 564386 - DNA, 25 bp, Mus musculus
gctatccactcaacaaacatttatt

SEQ ID NO: 564387 - DNA, 25 bp, Mus musculus
gctatccactcatcaaacatttatt

SEQ ID NO: 564388 - DNA, 25 bp, Mus musculus
gctatccattgtcctagtagtctcc

SEQ ID NO: 564389 - DNA, 25 bp, Mus musculus
gctatccattgtgctagtagtctcc

SEQ ID NO: 564390 - DNA, 25 bp, Mus musculus
gctatccatttcacagtcctattta

SEQ ID NO: 564391 - DNA, 25 bp, Mus musculus
gctatccatttctcagtcctattta

SEQ ID NO: 564392 - DNA, 25 bp, Mus musculus
gctatcccaagtagccagagtggct

SEQ ID NO: 564393 - DNA, 25 bp, Mus musculus
gctatcccaagttgccagagtggct

SEQ ID NO: 564394 - DNA, 25 bp, Mus musculus
gctatcccagagcaagtttaccatt

SEQ ID NO: 564395 - DNA, 25 bp, Mus musculus
gctatcccagaggaagtttaccatt

SEQ ID NO: 564396 - DNA, 25 bp, Mus musculus
gctatcccagatatttatgcctatg

SEQ ID NO: 564397 - DNA, 25 bp, Mus musculus
gctatcccagatttttatgcctatg

SEQ ID NO: 564398 - DNA, 25 bp, Mus musculus
gctatcccaggtcaaatactcggtg

SEQ ID NO: 564399 - DNA, 25 bp, Mus musculus
gctatcccaggtgaaatactcggtg

SEQ ID NO: 564400 - DNA, 25 bp, Mus musculus
gctatcccagtccaaggagctctgg

SEQ ID NO: 564401 - DNA, 25 bp, Mus musculus
gctatcccagtcgaaggagctctgg

SEQ ID NO: 564402 - DNA, 25 bp, Mus musculus
gctatccccgttcggctctgtatgt

SEQ ID NO: 564403 - DNA, 25 bp, Mus musculus
gctatccccgttgggctctgtatgt

SEQ ID NO: 564404 - DNA, 25 bp, Mus musculus
gctatccctttaacatagggttttg

SEQ ID NO: 564405 - DNA, 25 bp, Mus musculus
gctatccctttatcatagggttttg

SEQ ID NO: 564406 - DNA, 25 bp, Mus musculus
gctatcctaagcacaggtcctgaaa

SEQ ID NO: 564407 - DNA, 25 bp, Mus musculus
gctatcctaagctcaggtcctgaaa

SEQ ID NO: 564408 - DNA, 25 bp, Mus musculus
gctatcctatacactgatgccattt

SEQ ID NO: 564409 - DNA, 25 bp, Mus musculus
gctatcctatactctgatgccattt

SEQ ID NO: 564410 - DNA, 25 bp, Mus musculus
gctatcctcagcatcataacaagtt

SEQ ID NO: 564411 - DNA, 25 bp, Mus musculus
gctatcctcagcttcataacaagtt

SEQ ID NO: 564412 - DNA, 25 bp, Mus musculus
gctatcctcggaccagagaactcaa

SEQ ID NO: 564413 - DNA, 25 bp, Mus musculus
gctatcctcggagcagagaactcaa

SEQ ID NO: 564414 - DNA, 25 bp, Mus musculus
gctatcctctctcgccatttaaagt

SEQ ID NO: 564415 - DNA, 25 bp, Mus musculus
gctatcctctctggccatttaaagt

SEQ ID NO: 564416 - DNA, 25 bp, Mus musculus
gctatcctcttacttcgtaaaacct

SEQ ID NO: 564417 - DNA, 25 bp, Mus musculus
gctatcctcttagttcgtaaaacct

SEQ ID NO: 564418 - DNA, 25 bp, Mus musculus
gctatcctgcttatggatgagctgc

SEQ ID NO: 564419 - DNA, 25 bp, Mus musculus
gctatcctgcttttggatgagctgc

SEQ ID NO: 564420 - DNA, 25 bp, Mus musculus
gctatcctgtacagctttgtcaaca

SEQ ID NO: 564421 - DNA, 25 bp, Mus musculus
gctatcctgtactgctttgtcaaca

SEQ ID NO: 564422 - DNA, 25 bp, Mus musculus
gctatcctgtcacagtggtagctgt

SEQ ID NO: 564423 - DNA, 25 bp, Mus musculus
gctatcctgtcagagtggtagctgt

SEQ ID NO: 564424 - DNA, 25 bp, Mus musculus
gctatccttcctacttgctgaatat

SEQ ID NO: 564425 - DNA, 25 bp, Mus musculus
gctatccttccttcttgctgaatat

SEQ ID NO: 564426 - DNA, 25 bp, Mus musculus
gctatccttgaaaggttgctcagag

SEQ ID NO: 564427 - DNA, 25 bp, Mus musculus
gctatccttgaatggttgctcagag

SEQ ID NO: 564428 - DNA, 25 bp, Mus musculus
gctatcgtatttacatttactcaat

SEQ ID NO: 564429 - DNA, 25 bp, Mus musculus
gctatcgtattttcatttactcaat

SEQ ID NO: 564430 - DNA, 25 bp, Mus musculus
gctatctactttatgaataaccttg

SEQ ID NO: 564431 - DNA, 25 bp, Mus musculus
gctatctactttttgaataaccttg

SEQ ID NO: 564432 - DNA, 25 bp, Mus musculus
gctatctcagaacggcctggtgcac

SEQ ID NO: 564433 - DNA, 25 bp, Mus musculus
gctatctcagaagggcctggtgcac

SEQ ID NO: 564434 - DNA, 25 bp, Mus musculus
gctatctcaggcattgcaagaagaa

SEQ ID NO: 564435 - DNA, 25 bp, Mus musculus
gctatctcaggctttgcaagaagaa

SEQ ID NO: 564436 - DNA, 25 bp, Mus musculus
gctatctcaggtatcccaagaagct

SEQ ID NO: 564437 - DNA, 25 bp, Mus musculus
gctatctcaggtttcccaagaagct

SEQ ID NO: 564438 - DNA, 25 bp, Mus musculus
gctatctcagtacgcaacgggcact

SEQ ID NO: 564439 - DNA, 25 bp, Mus musculus
gctatctcagtaggcaacgggcact

SEQ ID NO: 564440 - DNA, 25 bp, Mus musculus
gctatctccatgagggagagcctct

SEQ ID NO: 564441 - DNA, 25 bp, Mus musculus
gctatctccatgtgggagagcctct

SEQ ID NO: 564442 - DNA, 25 bp, Mus musculus
gctatctccattctgtttgtctggt

SEQ ID NO: 564443 - DNA, 25 bp, Mus musculus
gctatctccattgtgtttgtctggt

SEQ ID NO: 564444 - DNA, 25 bp, Mus musculus
gctatctctttaccctgagaacaac

SEQ ID NO: 564445 - DNA, 25 bp, Mus musculus
gctatctctttagcctgagaacaac

SEQ ID NO: 564446 - DNA, 25 bp, Mus musculus
gctatctgaattatgacaaagctga

SEQ ID NO: 564447 - DNA, 25 bp, Mus musculus
gctatctgaattttgacaaagctga

SEQ ID NO: 564448 - DNA, 25 bp, Mus musculus
gctatctgacatatttgctaatttt

SEQ ID NO: 564449 - DNA, 25 bp, Mus musculus
gctatctgacatttttgctaatttt

SEQ ID NO: 564450 - DNA, 25 bp, Mus musculus
gctatctgagctaagagtgcctgca

SEQ ID NO: 564451 - DNA, 25 bp, Mus musculus
gctatctgagcttagagtgcctgca

SEQ ID NO: 564452 - DNA, 25 bp, Mus musculus
gctatctgaggaatggctcacacca

SEQ ID NO: 564453 - DNA, 25 bp, Mus musculus
gctatctgaggattggctcacacca

SEQ ID NO: 564454 - DNA, 25 bp, Mus musculus
gctatctgcatgctgcctgggcaaa

SEQ ID NO: 564455 - DNA, 25 bp, Mus musculus
gctatctgcatggtgcctgggcaaa

SEQ ID NO: 564456 - DNA, 25 bp, Mus musculus
gctatctgctttcaagaaacttccg

SEQ ID NO: 564457 - DNA, 25 bp, Mus musculus
gctatctgctttgaagaaacttccg

SEQ ID NO: 564458 - DNA, 25 bp, Mus musculus
gctatctggttcatctatttcttct

SEQ ID NO: 564459 - DNA, 25 bp, Mus musculus
gctatctggttcttctatttcttct

SEQ ID NO: 564460 - DNA, 25 bp, Mus musculus
gctatctgtgacaccagctgactta

SEQ ID NO: 564461 - DNA, 25 bp, Mus musculus
gctatctgtgactccagctgactta

SEQ ID NO: 564462 - DNA, 25 bp, Mus musculus
gctatcttccaactcatctaggtta

SEQ ID NO: 564463 - DNA, 25 bp, Mus musculus
gctatcttccaagtcatctaggtta

SEQ ID NO: 564464 - DNA, 25 bp, Mus musculus
gctatcttgaagaccgttatatgca

SEQ ID NO: 564465 - DNA, 25 bp, Mus musculus
gctatcttgaagtccgttatatgca

SEQ ID NO: 564466 - DNA, 25 bp, Mus musculus
gctatcttttccacaataaccaggt

SEQ ID NO: 564467 - DNA, 25 bp, Mus musculus
gctatcttttcctcaataaccaggt

SEQ ID NO: 564468 - DNA, 25 bp, Mus musculus
gctatcttttgaagtgcgtttccca

SEQ ID NO: 564469 - DNA, 25 bp, Mus musculus
gctatcttttgatgtgcgtttccca

SEQ ID NO: 564470 - DNA, 25 bp, Mus musculus
gctatgaaacttaaatcactcgaat

SEQ ID NO: 564471 - DNA, 25 bp, Mus musculus
gctatgaaactttaatcactcgaat

SEQ ID NO: 564472 - DNA, 25 bp, Mus musculus
gctatgaacactaggctggccccaa

SEQ ID NO: 564473 - DNA, 25 bp, Mus musculus
gctatgaacacttggctggccccaa

SEQ ID NO: 564474 - DNA, 25 bp, Mus musculus
gctatgaacatgaacttgcagaaag

SEQ ID NO: 564475 - DNA, 25 bp, Mus musculus
gctatgaacatgtacttgcagaaag

SEQ ID NO: 564476 - DNA, 25 bp, Mus musculus
gctatgaaccatcctgtacatgatt

SEQ ID NO: 564477 - DNA, 25 bp, Mus musculus
gctatgaaccatgctgtacatgatt

SEQ ID NO: 564478 - DNA, 25 bp, Mus musculus
gctatgaacctacggaccagcctaa

SEQ ID NO: 564479 - DNA, 25 bp, Mus musculus
gctatgaacctagggaccagcctaa

SEQ ID NO: 564480 - DNA, 25 bp, Mus musculus
gctatgaagctaatgtggtatgtgt

SEQ ID NO: 564481 - DNA, 25 bp, Mus musculus
gctatgaagctattgtggtatgtgt

SEQ ID NO: 564482 - DNA, 25 bp, Mus musculus
gctatgacactcatggtgctttgca

SEQ ID NO: 564483 - DNA, 25 bp, Mus musculus
gctatgacactcttggtgctttgca

SEQ ID NO: 564484 - DNA, 25 bp, Mus musculus
gctatgacagcccttacttttcaag

SEQ ID NO: 564485 - DNA, 25 bp, Mus musculus
gctatgacagccgttacttttcaag

SEQ ID NO: 564486 - DNA, 25 bp, Mus musculus
gctatgacagctcagaacgggactt

SEQ ID NO: 564487 - DNA, 25 bp, Mus musculus
gctatgacagctgagaacgggactt

SEQ ID NO: 564488 - DNA, 25 bp, Mus musculus
gctatgacatggaccgcttcggtgt

SEQ ID NO: 564489 - DNA, 25 bp, Mus musculus
gctatgacatggtccgcttcggtgt

SEQ ID NO: 564490 - DNA, 25 bp, Mus musculus
gctatgaccaatctatcccttcaga

SEQ ID NO: 564491 - DNA, 25 bp, Mus musculus
gctatgaccaatgtatcccttcaga

SEQ ID NO: 564492 - DNA, 25 bp, Mus musculus
gctatgaccacaaacctctgatgta

SEQ ID NO: 564493 - DNA, 25 bp, Mus musculus
gctatgaccacatacctctgatgta

SEQ ID NO: 564494 - DNA, 25 bp, Mus musculus
gctatgaccagcagcatctgcttag

SEQ ID NO: 564495 - DNA, 25 bp, Mus musculus
gctatgaccagctgcatctgcttag

SEQ ID NO: 564496 - DNA, 25 bp, Mus musculus
gctatgaccatacagagctaccggt

SEQ ID NO: 564497 - DNA, 25 bp, Mus musculus
gctatgaccatagagagctaccggt

SEQ ID NO: 564498 - DNA, 25 bp, Mus musculus
gctatgacctttaattctactactc

SEQ ID NO: 564499 - DNA, 25 bp, Mus musculus
gctatgaccttttattctactactc

SEQ ID NO: 564500 - DNA, 25 bp, Mus musculus
gctatgacgagtaccgaggctgctc

SEQ ID NO: 564501 - DNA, 25 bp, Mus musculus
gctatgacgagttccgaggctgctc

SEQ ID NO: 564502 - DNA, 25 bp, Mus musculus
gctatgactcgtcctgcaaaacagc

SEQ ID NO: 564503 - DNA, 25 bp, Mus musculus
gctatgactcgtgctgcaaaacagc

SEQ ID NO: 564504 - DNA, 25 bp, Mus musculus
gctatgactttcacaacatcagcat

SEQ ID NO: 564505 - DNA, 25 bp, Mus musculus
gctatgactttctcaacatcagcat

SEQ ID NO: 564506 - DNA, 25 bp, Mus musculus
gctatgactttgatatcaggatatc

SEQ ID NO: 564507 - DNA, 25 bp, Mus musculus
gctatgactttgttatcaggatatc

SEQ ID NO: 564508 - DNA, 25 bp, Mus musculus
gctatgagaaccaatgctgcctacg

SEQ ID NO: 564509 - DNA, 25 bp, Mus musculus
gctatgagaacccatgccccatgtg

SEQ ID NO: 564510 - DNA, 25 bp, Mus musculus
gctatgagaaccgatgccccatgtg

SEQ ID NO: 564511 - DNA, 25 bp, Mus musculus
gctatgagaacctatgctgcctacg

SEQ ID NO: 564512 - DNA, 25 bp, Mus musculus
gctatgagaactatcaccctatgag

SEQ ID NO: 564513 - DNA, 25 bp, Mus musculus
gctatgagaactttcaccctatgag

SEQ ID NO: 564514 - DNA, 25 bp, Mus musculus
gctatgagaagcctgtttggccagt

SEQ ID NO: 564515 - DNA, 25 bp, Mus musculus
gctatgagaagcgtgtttggccagt

SEQ ID NO: 564516 - DNA, 25 bp, Mus musculus
gctatgagacttattcctgatgtga

SEQ ID NO: 564517 - DNA, 25 bp, Mus musculus
gctatgagactttttcctgatgtga

SEQ ID NO: 564518 - DNA, 25 bp, Mus musculus
gctatgagatgcatatcccttgaaa

SEQ ID NO: 564519 - DNA, 25 bp, Mus musculus
gctatgagatgcttatcccttgaaa

SEQ ID NO: 564520 - DNA, 25 bp, Mus musculus
gctatgagcaggatgggctacctca

SEQ ID NO: 564521 - DNA, 25 bp, Mus musculus
gctatgagcaggttgggctacctca

SEQ ID NO: 564522 - DNA, 25 bp, Mus musculus
gctatgaggatacccgccacgcatg

SEQ ID NO: 564523 - DNA, 25 bp, Mus musculus
gctatgaggatagccgccacgcatg

SEQ ID NO: 564524 - DNA, 25 bp, Mus musculus
gctatgaggattacaagatacttaa

SEQ ID NO: 564525 - DNA, 25 bp, Mus musculus
gctatgaggattcctccttgttgca

SEQ ID NO: 564526 - DNA, 25 bp, Mus musculus
gctatgaggattgctccttgttgca

SEQ ID NO: 564527 - DNA, 25 bp, Mus musculus
gctatgaggatttcaagatacttaa

SEQ ID NO: 564528 - DNA, 25 bp, Mus musculus
gctatgatcatgatgattctgaaat

SEQ ID NO: 564529 - DNA, 25 bp, Mus musculus
gctatgatcatgttgattctgaaat

SEQ ID NO: 564530 - DNA, 25 bp, Mus musculus
gctatgatccacagaaacagctcat

SEQ ID NO: 564531 - DNA, 25 bp, Mus musculus
gctatgatccactgaaacagctcat

SEQ ID NO: 564532 - DNA, 25 bp, Mus musculus
gctatgatgaatagacacctctgaa

SEQ ID NO: 564533 - DNA, 25 bp, Mus musculus
gctatgatgaattgacacctctgaa

SEQ ID NO: 564534 - DNA, 25 bp, Mus musculus
gctatgatgacaagactggctgaat

SEQ ID NO: 564535 - DNA, 25 bp, Mus musculus
gctatgatgacatgactggctgaat

SEQ ID NO: 564536 - DNA, 25 bp, Mus musculus
gctatgatgagcaacggcagccttt

SEQ ID NO: 564537 - DNA, 25 bp, Mus musculus
gctatgatgagctacggcagccttt

SEQ ID NO: 564538 - DNA, 25 bp, Mus musculus
gctatgatggctaccgcatctggat

SEQ ID NO: 564539 - DNA, 25 bp, Mus musculus
gctatgatggcttccgcatctggat

SEQ ID NO: 564540 - DNA, 25 bp, Mus musculus
gctatgatgggcagacttacctcaa

SEQ ID NO: 564541 - DNA, 25 bp, Mus musculus
gctatgatgggctgacttacctcaa

SEQ ID NO: 564542 - DNA, 25 bp, Mus musculus
gctatgattccaatagaagacttct

SEQ ID NO: 564543 - DNA, 25 bp, Mus musculus
gctatgattccattagaagacttct

SEQ ID NO: 564544 - DNA, 25 bp, Mus musculus
gctatgatttcaccttgtgtcagga

SEQ ID NO: 564545 - DNA, 25 bp, Mus musculus
gctatgatttcagcttgtgtcagga

SEQ ID NO: 564546 - DNA, 25 bp, Mus musculus
gctatgatttggctttgtgtactac

SEQ ID NO: 564547 - DNA, 25 bp, Mus musculus
gctatgatttgggtttgtgtactac

SEQ ID NO: 564548 - DNA, 25 bp, Mus musculus
gctatgcaaataagcctggaccctt

SEQ ID NO: 564549 - DNA, 25 bp, Mus musculus
gctatgcaaatatgcctggaccctt

SEQ ID NO: 564550 - DNA, 25 bp, Mus musculus
gctatgcaagcaccattgtgcctgt

SEQ ID NO: 564551 - DNA, 25 bp, Mus musculus
gctatgcaagcagcattgtgcctgt

SEQ ID NO: 564552 - DNA, 25 bp, Mus musculus
gctatgcaatcaattatatgcacgt

SEQ ID NO: 564553 - DNA, 25 bp, Mus musculus
gctatgcaatcatttatatgcacgt

SEQ ID NO: 564554 - DNA, 25 bp, Mus musculus
gctatgcacattatacttgtactgt

SEQ ID NO: 564555 - DNA, 25 bp, Mus musculus
gctatgcacattttacttgtactgt

SEQ ID NO: 564556 - DNA, 25 bp, Mus musculus
gctatgcacttcaagagctcacact

SEQ ID NO: 564557 - DNA, 25 bp, Mus musculus
gctatgcacttctagagctcacact

SEQ ID NO: 564558 - DNA, 25 bp, Mus musculus
gctatgcagcatcaaagacgttaag

SEQ ID NO: 564559 - DNA, 25 bp, Mus musculus
gctatgcagcatgaaagacgttaag

SEQ ID NO: 564560 - DNA, 25 bp, Mus musculus
gctatgcatcatctttatacaggac

SEQ ID NO: 564561 - DNA, 25 bp, Mus musculus
gctatgcatcatgtttatacaggac

SEQ ID NO: 564562 - DNA, 25 bp, Mus musculus
gctatgcatcttccaattctcaatg

SEQ ID NO: 564563 - DNA, 25 bp, Mus musculus
gctatgcatcttgcaattctcaatg

SEQ ID NO: 564564 - DNA, 25 bp, Mus musculus
gctatgcatgatagacttttacaca

SEQ ID NO: 564565 - DNA, 25 bp, Mus musculus
gctatgcatgattgacttttacaca

SEQ ID NO: 564566 - DNA, 25 bp, Mus musculus
gctatgccaactcctgcttagaata

SEQ ID NO: 564567 - DNA, 25 bp, Mus musculus
gctatgccaactgctgcttagaata

SEQ ID NO: 564568 - DNA, 25 bp, Mus musculus
gctatgccacacagctgcagcagat

SEQ ID NO: 564569 - DNA, 25 bp, Mus musculus
gctatgccacactgctgcagcagat

SEQ ID NO: 564570 - DNA, 25 bp, Mus musculus
gctatgccatggcttacttcttgaa

SEQ ID NO: 564571 - DNA, 25 bp, Mus musculus
gctatgccatgggttacttcttgaa

SEQ ID NO: 564572 - DNA, 25 bp, Mus musculus
gctatgcctagcaacttatttattt

SEQ ID NO: 564573 - DNA, 25 bp, Mus musculus
gctatgcctagctacttatttattt

SEQ ID NO: 564574 - DNA, 25 bp, Mus musculus
gctatgcctgctccgtagtggtaga

SEQ ID NO: 564575 - DNA, 25 bp, Mus musculus
gctatgcctgctgcgtagtggtaga

SEQ ID NO: 564576 - DNA, 25 bp, Mus musculus
gctatgcgctgtactgtgtagcccg

SEQ ID NO: 564577 - DNA, 25 bp, Mus musculus
gctatgcgctgttctgtgtagcccg

SEQ ID NO: 564578 - DNA, 25 bp, Mus musculus
gctatgcggagaagactttggcgtt

SEQ ID NO: 564579 - DNA, 25 bp, Mus musculus
gctatgcggagatgactttggcgtt

SEQ ID NO: 564580 - DNA, 25 bp, Mus musculus
gctatgctattgacatttcctccac

SEQ ID NO: 564581 - DNA, 25 bp, Mus musculus
gctatgctattgtcatttcctccac

SEQ ID NO: 564582 - DNA, 25 bp, Mus musculus
gctatgctcaatatcctttgcaaaa

SEQ ID NO: 564583 - DNA, 25 bp, Mus musculus
gctatgctcaatttcctttgcaaaa

SEQ ID NO: 564584 - DNA, 25 bp, Mus musculus
gctatgctcagaccatctcaacaaa

SEQ ID NO: 564585 - DNA, 25 bp, Mus musculus
gctatgctcagagcatctcaacaaa

SEQ ID NO: 564586 - DNA, 25 bp, Mus musculus
gctatgctctacagaagtgtaaaca

SEQ ID NO: 564587 - DNA, 25 bp, Mus musculus
gctatgctctactgaagtgtaaaca

SEQ ID NO: 564588 - DNA, 25 bp, Mus musculus
gctatgctgacaatgtaccctgcta

SEQ ID NO: 564589 - DNA, 25 bp, Mus musculus
gctatgctgacattgtaccctgcta

SEQ ID NO: 564590 - DNA, 25 bp, Mus musculus
gctatgctgagcagggatgacccct

SEQ ID NO: 564591 - DNA, 25 bp, Mus musculus
gctatgctgagctgggatgacccct

SEQ ID NO: 564592 - DNA, 25 bp, Mus musculus
gctatgctgatcagacaatgtgtat

SEQ ID NO: 564593 - DNA, 25 bp, Mus musculus
gctatgctgatctgacaatgtgtat

SEQ ID NO: 564594 - DNA, 25 bp, Mus musculus
gctatgctgggtatctactggtcaa

SEQ ID NO: 564595 - DNA, 25 bp, Mus musculus
gctatgctgggtttctactggtcaa

SEQ ID NO: 564596 - DNA, 25 bp, Mus musculus
gctatgcttaaaagatcattaccat

SEQ ID NO: 564597 - DNA, 25 bp, Mus musculus
gctatgcttaaatgatcattaccat

SEQ ID NO: 564598 - DNA, 25 bp, Mus musculus
gctatgcttcatcgcacagtcacaa

SEQ ID NO: 564599 - DNA, 25 bp, Mus musculus
gctatgcttcatggcacagtcacaa

SEQ ID NO: 564600 - DNA, 25 bp, Mus musculus
gctatgcttcctccttggcaaaagt

SEQ ID NO: 564601 - DNA, 25 bp, Mus musculus
gctatgcttcctgcttggcaaaagt

SEQ ID NO: 564602 - DNA, 25 bp, Mus musculus
gctatgcttgaccacaggacaacat

SEQ ID NO: 564603 - DNA, 25 bp, Mus musculus
gctatgcttgacgacaggacaacat

SEQ ID NO: 564604 - DNA, 25 bp, Mus musculus
gctatgcttgatcctcttgtaatgg

SEQ ID NO: 564605 - DNA, 25 bp, Mus musculus
gctatgcttgatgctcttgtaatgg

SEQ ID NO: 564606 - DNA, 25 bp, Mus musculus
gctatgctttctatcagtaactgga

SEQ ID NO: 564607 - DNA, 25 bp, Mus musculus
gctatgctttctttcagtaactgga

SEQ ID NO: 564608 - DNA, 25 bp, Mus musculus
gctatgctttgtctgtatactccac

SEQ ID NO: 564609 - DNA, 25 bp, Mus musculus
gctatgctttgtgtgtatactccac

SEQ ID NO: 564610 - DNA, 25 bp, Mus musculus
gctatggaaagtacttttggccacc

SEQ ID NO: 564611 - DNA, 25 bp, Mus musculus
gctatggaaagttcttttggccacc

SEQ ID NO: 564612 - DNA, 25 bp, Mus musculus
gctatggaagctatgatgtcaccca

SEQ ID NO: 564613 - DNA, 25 bp, Mus musculus
gctatggaagctttgatgtcaccca

SEQ ID NO: 564614 - DNA, 25 bp, Mus musculus
gctatggaccatcctaagtccttat

SEQ ID NO: 564615 - DNA, 25 bp, Mus musculus
gctatggaccatgctaagtccttat

SEQ ID NO: 564616 - DNA, 25 bp, Mus musculus
gctatggagactaccgcgctgatga

SEQ ID NO: 564617 - DNA, 25 bp, Mus musculus
gctatggagacttccgcgctgatga

SEQ ID NO: 564618 - DNA, 25 bp, Mus musculus
gctatggagcagagcatgtgcccct

SEQ ID NO: 564619 - DNA, 25 bp, Mus musculus
gctatggagcagtgcatgtgcccct

SEQ ID NO: 564620 - DNA, 25 bp, Mus musculus
gctatggagcgcagtgtgaaactaa

SEQ ID NO: 564621 - DNA, 25 bp, Mus musculus
gctatggagcgctgtgtgaaactaa

SEQ ID NO: 564622 - DNA, 25 bp, Mus musculus
gctatggagctcctttgagactgct

SEQ ID NO: 564623 - DNA, 25 bp, Mus musculus
gctatggagctcgtttgagactgct

SEQ ID NO: 564624 - DNA, 25 bp, Mus musculus
gctatggagtgaccattcttcagcc

SEQ ID NO: 564625 - DNA, 25 bp, Mus musculus
gctatggagtgagcattcttcagcc

SEQ ID NO: 564626 - DNA, 25 bp, Mus musculus
gctatggatgctacagcttgcagga

SEQ ID NO: 564627 - DNA, 25 bp, Mus musculus
gctatggatgcttcagcttgcagga

SEQ ID NO: 564628 - DNA, 25 bp, Mus musculus
gctatggattatatgccgttgtgat

SEQ ID NO: 564629 - DNA, 25 bp, Mus musculus
gctatggattatttgccgttgtgat

SEQ ID NO: 564630 - DNA, 25 bp, Mus musculus
gctatggcagccacggaagcaggaa

SEQ ID NO: 564631 - DNA, 25 bp, Mus musculus
gctatggcagcctcggaagcaggaa

SEQ ID NO: 564632 - DNA, 25 bp, Mus musculus
gctatggctctcattattttcacaa

SEQ ID NO: 564633 - DNA, 25 bp, Mus musculus
gctatggctctctttattttcacaa

SEQ ID NO: 564634 - DNA, 25 bp, Mus musculus
gctatggctgcaattcccaagaagc

SEQ ID NO: 564635 - DNA, 25 bp, Mus musculus
gctatggctgcatttcccaagaagc

SEQ ID NO: 564636 - DNA, 25 bp, Mus musculus
gctatggctgccatatatctatatg

SEQ ID NO: 564637 - DNA, 25 bp, Mus musculus
gctatggctgccttatatctatatg

SEQ ID NO: 564638 - DNA, 25 bp, Mus musculus
gctatggcttgtaaccagtggagtt

SEQ ID NO: 564639 - DNA, 25 bp, Mus musculus
gctatggcttgttaccagtggagtt

SEQ ID NO: 564640 - DNA, 25 bp, Mus musculus
gctatgggaaacaaggcttgcttca

SEQ ID NO: 564641 - DNA, 25 bp, Mus musculus
gctatgggaaactaggcttgcttca

SEQ ID NO: 564642 - DNA, 25 bp, Mus musculus
gctatgggaagtatctcatcgcctt

SEQ ID NO: 564643 - DNA, 25 bp, Mus musculus
gctatgggaagtttctcatcgcctt

SEQ ID NO: 564644 - DNA, 25 bp, Mus musculus
gctatgggcacaatactctgtggct

SEQ ID NO: 564645 - DNA, 25 bp, Mus musculus
gctatgggcacattactctgtggct

SEQ ID NO: 564646 - DNA, 25 bp, Mus musculus
gctatgggcactaggtgatctatgt

SEQ ID NO: 564647 - DNA, 25 bp, Mus musculus
gctatgggcacttggtgatctatgt

SEQ ID NO: 564648 - DNA, 25 bp, Mus musculus
gctatgggcatgaaaccaaccgagt

SEQ ID NO: 564649 - DNA, 25 bp, Mus musculus
gctatgggcatgtaaccaaccgagt

SEQ ID NO: 564650 - DNA, 25 bp, Mus musculus
gctatgggggccagagcttgaccat

SEQ ID NO: 564651 - DNA, 25 bp, Mus musculus
gctatgggggcctgagcttgaccat

SEQ ID NO: 564652 - DNA, 25 bp, Mus musculus
gctatggtacatcagtgttttgctt

SEQ ID NO: 564653 - DNA, 25 bp, Mus musculus
gctatggtacatgagtgttttgctt

SEQ ID NO: 564654 - DNA, 25 bp, Mus musculus
gctatggtcatactcttcccagaat

SEQ ID NO: 564655 - DNA, 25 bp, Mus musculus
gctatggtcatagtcttcccagaat

SEQ ID NO: 564656 - DNA, 25 bp, Mus musculus
gctatggtccataattaaattttct

SEQ ID NO: 564657 - DNA, 25 bp, Mus musculus
gctatggtccattattaaattttct

SEQ ID NO: 564658 - DNA, 25 bp, Mus musculus
gctatggtcccaaggaggagcccca

SEQ ID NO: 564659 - DNA, 25 bp, Mus musculus
gctatggtcccatggaggagcccca

SEQ ID NO: 564660 - DNA, 25 bp, Mus musculus
gctatggtgcctatctgactctcag

SEQ ID NO: 564661 - DNA, 25 bp, Mus musculus
gctatggtgcctttctgactctcag

SEQ ID NO: 564662 - DNA, 25 bp, Mus musculus
gctatggtggaacgagcagatatta

SEQ ID NO: 564663 - DNA, 25 bp, Mus musculus
gctatggtggaaggagcagatatta

SEQ ID NO: 564664 - DNA, 25 bp, Mus musculus
gctatggtgtacactgggttcgcca

SEQ ID NO: 564665 - DNA, 25 bp, Mus musculus
gctatggtgtactctgggttcgcca

SEQ ID NO: 564666 - DNA, 25 bp, Mus musculus
gctatggtgtgacatcagagacact

SEQ ID NO: 564667 - DNA, 25 bp, Mus musculus
gctatggtgtgagatcagagacact

SEQ ID NO: 564668 - DNA, 25 bp, Mus musculus
gctatggttaccctggagtctaaga

SEQ ID NO: 564669 - DNA, 25 bp, Mus musculus
gctatggttaccgtggagtctaaga

SEQ ID NO: 564670 - DNA, 25 bp, Mus musculus
gctatggttattagactgtcctctt

SEQ ID NO: 564671 - DNA, 25 bp, Mus musculus
gctatggttatttgactgtcctctt

SEQ ID NO: 564672 - DNA, 25 bp, Mus musculus
gctatggttgacctctgtgtctgga

SEQ ID NO: 564673 - DNA, 25 bp, Mus musculus
gctatggttgacgtctgtgtctgga

SEQ ID NO: 564674 - DNA, 25 bp, Mus musculus
gctatggtttctccaatggctacat

SEQ ID NO: 564675 - DNA, 25 bp, Mus musculus
gctatggtttctgcaatggctacat

SEQ ID NO: 564676 - DNA, 25 bp, Mus musculus
gctatgtaagcacgaagacccaaat

SEQ ID NO: 564677 - DNA, 25 bp, Mus musculus
gctatgtaagcaggaagacccaaat

SEQ ID NO: 564678 - DNA, 25 bp, Mus musculus
gctatgtacgaccatttgtatgtgt

SEQ ID NO: 564679 - DNA, 25 bp, Mus musculus
gctatgtacgacgatttgtatgtgt

SEQ ID NO: 564680 - DNA, 25 bp, Mus musculus
gctatgtactccactgatgcaaggg

SEQ ID NO: 564681 - DNA, 25 bp, Mus musculus
gctatgtactcctctgatgcaaggg

SEQ ID NO: 564682 - DNA, 25 bp, Mus musculus
gctatgtagaacagccaaagtatat

SEQ ID NO: 564683 - DNA, 25 bp, Mus musculus
gctatgtagaactgccaaagtatat

SEQ ID NO: 564684 - DNA, 25 bp, Mus musculus
gctatgtagaagcagagtccagact

SEQ ID NO: 564685 - DNA, 25 bp, Mus musculus
gctatgtagaaggagagtccagact

SEQ ID NO: 564686 - DNA, 25 bp, Mus musculus
gctatgtagacaagcctgtccctgc

SEQ ID NO: 564687 - DNA, 25 bp, Mus musculus
gctatgtagacatgcctgtccctgc

SEQ ID NO: 564688 - DNA, 25 bp, Mus musculus
gctatgtagcagcttttgattccct

SEQ ID NO: 564689 - DNA, 25 bp, Mus musculus
gctatgtagcaggttttgattccct

SEQ ID NO: 564690 - DNA, 25 bp, Mus musculus
gctatgtcaaccatataaatgctta

SEQ ID NO: 564691 - DNA, 25 bp, Mus musculus
gctatgtcaaccttataaatgctta

SEQ ID NO: 564692 - DNA, 25 bp, Mus musculus
gctatgtcaagtagcaggatttcag

SEQ ID NO: 564693 - DNA, 25 bp, Mus musculus
gctatgtcaagttgcaggatttcag

SEQ ID NO: 564694 - DNA, 25 bp, Mus musculus
gctatgtcaccgaaagacacctcat

SEQ ID NO: 564695 - DNA, 25 bp, Mus musculus
gctatgtcaccgtaagacacctcat

SEQ ID NO: 564696 - DNA, 25 bp, Mus musculus
gctatgtcactaacataaggctcta

SEQ ID NO: 564697 - DNA, 25 bp, Mus musculus
gctatgtcactatcataaggctcta

SEQ ID NO: 564698 - DNA, 25 bp, Mus musculus
gctatgtcactcagtcccaataaaa

SEQ ID NO: 564699 - DNA, 25 bp, Mus musculus
gctatgtcactctgtcccaataaaa

SEQ ID NO: 564700 - DNA, 25 bp, Mus musculus
gctatgtcatcactgggcaaggcca

SEQ ID NO: 564701 - DNA, 25 bp, Mus musculus
gctatgtcatcagtgggcaaggcca

SEQ ID NO: 564702 - DNA, 25 bp, Mus musculus
gctatgtccaaactgggtcttcgac

SEQ ID NO: 564703 - DNA, 25 bp, Mus musculus
gctatgtccaaagtgggtcttcgac

SEQ ID NO: 564704 - DNA, 25 bp, Mus musculus
gctatgtgaactaacctttgtgcct

SEQ ID NO: 564705 - DNA, 25 bp, Mus musculus
gctatgtgaactagcagtgtacgta

SEQ ID NO: 564706 - DNA, 25 bp, Mus musculus
gctatgtgaacttacctttgtgcct

SEQ ID NO: 564707 - DNA, 25 bp, Mus musculus
gctatgtgaacttgcagtgtacgta

SEQ ID NO: 564708 - DNA, 25 bp, Mus musculus
gctatgtgaatcaagttgaaccagg

SEQ ID NO: 564709 - DNA, 25 bp, Mus musculus
gctatgtgaatctagttgaaccagg

SEQ ID NO: 564710 - DNA, 25 bp, Mus musculus
gctatgtgacaacgctggctttgat

SEQ ID NO: 564711 - DNA, 25 bp, Mus musculus
gctatgtgacaaggctggctttgat

SEQ ID NO: 564712 - DNA, 25 bp, Mus musculus
gctatgtgatgaccctgtctaaaaa

SEQ ID NO: 564713 - DNA, 25 bp, Mus musculus
gctatgtgatgagcctgtctaaaaa

SEQ ID NO: 564714 - DNA, 25 bp, Mus musculus
gctatgtgcagcagccagcagatga

SEQ ID NO: 564715 - DNA, 25 bp, Mus musculus
gctatgtgcagctgccagcagatga

SEQ ID NO: 564716 - DNA, 25 bp, Mus musculus
gctatgtgcctgatattgtctgggt

SEQ ID NO: 564717 - DNA, 25 bp, Mus musculus
gctatgtgcctgttattgtctgggt

SEQ ID NO: 564718 - DNA, 25 bp, Mus musculus
gctatgtgctcaaaactccaacttt

SEQ ID NO: 564719 - DNA, 25 bp, Mus musculus
gctatgtgctcataactccaacttt

SEQ ID NO: 564720 - DNA, 25 bp, Mus musculus
gctatgtgctggctttcatatgtca

SEQ ID NO: 564721 - DNA, 25 bp, Mus musculus
gctatgtgctgggtttcatatgtca

SEQ ID NO: 564722 - DNA, 25 bp, Mus musculus
gctatgtggaggagggcggtgggta

SEQ ID NO: 564723 - DNA, 25 bp, Mus musculus
gctatgtggaggtgggcggtgggta

SEQ ID NO: 564724 - DNA, 25 bp, Mus musculus
gctatgtggcctagaaggagacatt

SEQ ID NO: 564725 - DNA, 25 bp, Mus musculus
gctatgtggccttgaaggagacatt

SEQ ID NO: 564726 - DNA, 25 bp, Mus musculus
gctatgtggctgagtttcaggagca

SEQ ID NO: 564727 - DNA, 25 bp, Mus musculus
gctatgtggctgtgtttcaggagca

SEQ ID NO: 564728 - DNA, 25 bp, Mus musculus
gctatgtggcttctctccggaacgt

SEQ ID NO: 564729 - DNA, 25 bp, Mus musculus
gctatgtggcttgtctccggaacgt

SEQ ID NO: 564730 - DNA, 25 bp, Mus musculus
gctatgtgggcacaggtcaccttat

SEQ ID NO: 564731 - DNA, 25 bp, Mus musculus
gctatgtgggcactcatcctgacta

SEQ ID NO: 564732 - DNA, 25 bp, Mus musculus
gctatgtgggcagaggtcaccttat

SEQ ID NO: 564733 - DNA, 25 bp, Mus musculus
gctatgtgggcagtcatcctgacta

SEQ ID NO: 564734 - DNA, 25 bp, Mus musculus
gctatgtgtaacaagtcaacttggt

SEQ ID NO: 564735 - DNA, 25 bp, Mus musculus
gctatgtgtaactagtcaacttggt

SEQ ID NO: 564736 - DNA, 25 bp, Mus musculus
gctatgtgtccaatgctatgaaacg

SEQ ID NO: 564737 - DNA, 25 bp, Mus musculus
gctatgtgtccattgctatgaaacg

SEQ ID NO: 564738 - DNA, 25 bp, Mus musculus
gctatgtgtctcagagcataccctt

SEQ ID NO: 564739 - DNA, 25 bp, Mus musculus
gctatgtgtctctgagcataccctt

SEQ ID NO: 564740 - DNA, 25 bp, Mus musculus
gctatgtgtgatagatacctgctgg

SEQ ID NO: 564741 - DNA, 25 bp, Mus musculus
gctatgtgtgattgatacctgctgg

SEQ ID NO: 564742 - DNA, 25 bp, Mus musculus
gctatgtgtgttcacctctgaagga

SEQ ID NO: 564743 - DNA, 25 bp, Mus musculus
gctatgtgtgttgacctctgaagga

SEQ ID NO: 564744 - DNA, 25 bp, Mus musculus
gctatgttacaacctctcagagata

SEQ ID NO: 564745 - DNA, 25 bp, Mus musculus
gctatgttacaagctctcagagata

SEQ ID NO: 564746 - DNA, 25 bp, Mus musculus
gctatgttccagatacagtagatga

SEQ ID NO: 564747 - DNA, 25 bp, Mus musculus
gctatgttccagttacagtagatga

SEQ ID NO: 564748 - DNA, 25 bp, Mus musculus
gctatgttcctgataattccgctat

SEQ ID NO: 564749 - DNA, 25 bp, Mus musculus
gctatgttcctgttaattccgctat

SEQ ID NO: 564750 - DNA, 25 bp, Mus musculus
gctatgttgagcatcgttacgacga

SEQ ID NO: 564751 - DNA, 25 bp, Mus musculus
gctatgttgagcttcgttacgacga

SEQ ID NO: 564752 - DNA, 25 bp, Mus musculus
gctatgttgctcaagacttcgagca

SEQ ID NO: 564753 - DNA, 25 bp, Mus musculus
gctatgttgctctagacttcgagca

SEQ ID NO: 564754 - DNA, 25 bp, Mus musculus
gctatgttgggtcgttcaactgcct

SEQ ID NO: 564755 - DNA, 25 bp, Mus musculus
gctatgttgggtggttcaactgcct

SEQ ID NO: 564756 - DNA, 25 bp, Mus musculus
gctatgttgtcaatcatggtgtgta

SEQ ID NO: 564757 - DNA, 25 bp, Mus musculus
gctatgttgtcattcatggtgtgta

SEQ ID NO: 564758 - DNA, 25 bp, Mus musculus
gctatgtttctgatccactacgtgc

SEQ ID NO: 564759 - DNA, 25 bp, Mus musculus
gctatgtttctgttccactacgtgc

SEQ ID NO: 564760 - DNA, 25 bp, Mus musculus
gctatgtttgccacttactcgataa

SEQ ID NO: 564761 - DNA, 25 bp, Mus musculus
gctatgtttgcctcttactcgataa

SEQ ID NO: 564762 - DNA, 25 bp, Mus musculus
gctatgttttaaaatgcctcaattt

SEQ ID NO: 564763 - DNA, 25 bp, Mus musculus
gctatgttttaatatgcctcaattt

SEQ ID NO: 564764 - DNA, 25 bp, Mus musculus
gctatgtttttcatgtcgaggtgtt

SEQ ID NO: 564765 - DNA, 25 bp, Mus musculus
gctatgtttttcttgtcgaggtgtt

SEQ ID NO: 564766 - DNA, 25 bp, Mus musculus
gctattaaacgcaatcgatggtggt

SEQ ID NO: 564767 - DNA, 25 bp, Mus musculus
gctattaaacgctatcgatggtggt

SEQ ID NO: 564768 - DNA, 25 bp, Mus musculus
gctattaaggcacccgatcactggc

SEQ ID NO: 564769 - DNA, 25 bp, Mus musculus
gctattaaggcagccgatcactggc

SEQ ID NO: 564770 - DNA, 25 bp, Mus musculus
gctattaccctcatctactgagatg

SEQ ID NO: 564771 - DNA, 25 bp, Mus musculus
gctattaccctcttctactgagatg

SEQ ID NO: 564772 - DNA, 25 bp, Mus musculus
gctattacctcaaatctgtatctgg

SEQ ID NO: 564773 - DNA, 25 bp, Mus musculus
gctattacctcatatctgtatctgg

SEQ ID NO: 564774 - DNA, 25 bp, Mus musculus
gctattaccttcaggttttcttaag

SEQ ID NO: 564775 - DNA, 25 bp, Mus musculus
gctattaccttctggttttcttaag

SEQ ID NO: 564776 - DNA, 25 bp, Mus musculus
gctattacgtacatccggtggaaca

SEQ ID NO: 564777 - DNA, 25 bp, Mus musculus
gctattacgtacttccggtggaaca

SEQ ID NO: 564778 - DNA, 25 bp, Mus musculus
gctattactaatactaccaccacct

SEQ ID NO: 564779 - DNA, 25 bp, Mus musculus
gctattactaattctaccaccacct

SEQ ID NO: 564780 - DNA, 25 bp, Mus musculus
gctattagaaggatcggagctcata

SEQ ID NO: 564781 - DNA, 25 bp, Mus musculus
gctattagaaggttcggagctcata

SEQ ID NO: 564782 - DNA, 25 bp, Mus musculus
gctattagacccattttgcagttaa

SEQ ID NO: 564783 - DNA, 25 bp, Mus musculus
gctattagaccctttttgcagttaa

SEQ ID NO: 564784 - DNA, 25 bp, Mus musculus
gctattagcgctcactttgtaacaa

SEQ ID NO: 564785 - DNA, 25 bp, Mus musculus
gctattagcgctgactttgtaacaa

SEQ ID NO: 564786 - DNA, 25 bp, Mus musculus
gctattagctaacactttcctgact

SEQ ID NO: 564787 - DNA, 25 bp, Mus musculus
gctattagctaagactttcctgact

SEQ ID NO: 564788 - DNA, 25 bp, Mus musculus
gctattaggctcacaattgtgcata

SEQ ID NO: 564789 - DNA, 25 bp, Mus musculus
gctattaggctctcaattgtgcata

SEQ ID NO: 564790 - DNA, 25 bp, Mus musculus
gctattaggtatctctaacaccagc

SEQ ID NO: 564791 - DNA, 25 bp, Mus musculus
gctattaggtatgtctaacaccagc

SEQ ID NO: 564792 - DNA, 25 bp, Mus musculus
gctattatattgagtttacctgaga

SEQ ID NO: 564793 - DNA, 25 bp, Mus musculus
gctattatattgtgtttacctgaga

SEQ ID NO: 564794 - DNA, 25 bp, Mus musculus
gctattatcattacaggtatttgta

SEQ ID NO: 564795 - DNA, 25 bp, Mus musculus
gctattatcatttcaggtatttgta

SEQ ID NO: 564796 - DNA, 25 bp, Mus musculus
gctattatgtgtatttcccagccaa

SEQ ID NO: 564797 - DNA, 25 bp, Mus musculus
gctattatgtgtttttcccagccaa

SEQ ID NO: 564798 - DNA, 25 bp, Mus musculus
gctattattatccataccctgccct

SEQ ID NO: 564799 - DNA, 25 bp, Mus musculus
gctattattatcgataccctgccct

SEQ ID NO: 564800 - DNA, 25 bp, Mus musculus
gctattatttgtatcattcctgttt

SEQ ID NO: 564801 - DNA, 25 bp, Mus musculus
gctattatttgtttcattcctgttt

SEQ ID NO: 564802 - DNA, 25 bp, Mus musculus
gctattcaagatctctggcagtgga

SEQ ID NO: 564803 - DNA, 25 bp, Mus musculus
gctattcaagatgtctggcagtgga

SEQ ID NO: 564804 - DNA, 25 bp, Mus musculus
gctattcacccacaccaagataaaa

SEQ ID NO: 564805 - DNA, 25 bp, Mus musculus
gctattcacccagaccaagataaaa

SEQ ID NO: 564806 - DNA, 25 bp, Mus musculus
gctattcagaagaccttgcaagtga

SEQ ID NO: 564807 - DNA, 25 bp, Mus musculus
gctattcagaagtccttgcaagtga

SEQ ID NO: 564808 - DNA, 25 bp, Mus musculus
gctattcaggaaatgcagagaaatg

SEQ ID NO: 564809 - DNA, 25 bp, Mus musculus
gctattcaggaattgcagagaaatg

SEQ ID NO: 564810 - DNA, 25 bp, Mus musculus
gctattcagggtaccatttctgtaa

SEQ ID NO: 564811 - DNA, 25 bp, Mus musculus
gctattcagggttccatttctgtaa

SEQ ID NO: 564812 - DNA, 25 bp, Mus musculus
gctattcatggtagtcaccttcact

SEQ ID NO: 564813 - DNA, 25 bp, Mus musculus
gctattcatggtcggtgttggcctc

SEQ ID NO: 564814 - DNA, 25 bp, Mus musculus
gctattcatggtgggtgttggcctc

SEQ ID NO: 564815 - DNA, 25 bp, Mus musculus
gctattcatggttgtcaccttcact

SEQ ID NO: 564816 - DNA, 25 bp, Mus musculus
gctattccaagtatgcagcacgaag

SEQ ID NO: 564817 - DNA, 25 bp, Mus musculus
gctattccaagtttgcagcacgaag

SEQ ID NO: 564818 - DNA, 25 bp, Mus musculus
gctattccagcaatgtaccacccac

SEQ ID NO: 564819 - DNA, 25 bp, Mus musculus
gctattccagcattgtaccacccac

SEQ ID NO: 564820 - DNA, 25 bp, Mus musculus
gctattccagttcttaactcttctt

SEQ ID NO: 564821 - DNA, 25 bp, Mus musculus
gctattccagttgttaactcttctt

SEQ ID NO: 564822 - DNA, 25 bp, Mus musculus
gctattccatatcctcaatttgcat

SEQ ID NO: 564823 - DNA, 25 bp, Mus musculus
gctattccatatgctcaatttgcat

SEQ ID NO: 564824 - DNA, 25 bp, Mus musculus
gctattccgagaacgcaggcaccac

SEQ ID NO: 564825 - DNA, 25 bp, Mus musculus
gctattccgagatcgcaggcaccac

SEQ ID NO: 564826 - DNA, 25 bp, Mus musculus
gctattcctcaccaagcaaatcata

SEQ ID NO: 564827 - DNA, 25 bp, Mus musculus
gctattcctcacgaagcaaatcata

SEQ ID NO: 564828 - DNA, 25 bp, Mus musculus
gctattcctcagaaaattcccattt

SEQ ID NO: 564829 - DNA, 25 bp, Mus musculus
gctattcctcagtaaattcccattt

SEQ ID NO: 564830 - DNA, 25 bp, Mus musculus
gctattcctcttcctgctagtctgt

SEQ ID NO: 564831 - DNA, 25 bp, Mus musculus
gctattcctcttgctgctagtctgt

SEQ ID NO: 564832 - DNA, 25 bp, Mus musculus
gctattcctgaaagcgcttacactt

SEQ ID NO: 564833 - DNA, 25 bp, Mus musculus
gctattcctgaatgcgcttacactt

SEQ ID NO: 564834 - DNA, 25 bp, Mus musculus
gctattcctggaaagttgtttccat

SEQ ID NO: 564835 - DNA, 25 bp, Mus musculus
gctattcctggatagttgtttccat

SEQ ID NO: 564836 - DNA, 25 bp, Mus musculus
gctattcctgtgactctgctgatgt

SEQ ID NO: 564837 - DNA, 25 bp, Mus musculus
gctattcctgtgtctctgctgatgt

SEQ ID NO: 564838 - DNA, 25 bp, Mus musculus
gctattcgctatagccatggctgtg

SEQ ID NO: 564839 - DNA, 25 bp, Mus musculus
gctattcgctattgccatggctgtg

SEQ ID NO: 564840 - DNA, 25 bp, Mus musculus
gctattcgtaagatgcacagactcg

SEQ ID NO: 564841 - DNA, 25 bp, Mus musculus
gctattcgtaagttgcacagactcg

SEQ ID NO: 564842 - DNA, 25 bp, Mus musculus
gctattctaagacctagtgtctaca

SEQ ID NO: 564843 - DNA, 25 bp, Mus musculus
gctattctaagagctagtgtctaca

SEQ ID NO: 564844 - DNA, 25 bp, Mus musculus
gctattctagacatgatcaaaactc

SEQ ID NO: 564845 - DNA, 25 bp, Mus musculus
gctattctagacttgatcaaaactc

SEQ ID NO: 564846 - DNA, 25 bp, Mus musculus
gctattctagttagtgttttctctc

SEQ ID NO: 564847 - DNA, 25 bp, Mus musculus
gctattctagttcggagtcacagtt

SEQ ID NO: 564848 - DNA, 25 bp, Mus musculus
gctattctagttgggagtcacagtt

SEQ ID NO: 564849 - DNA, 25 bp, Mus musculus
gctattctagtttgtgttttctctc

SEQ ID NO: 564850 - DNA, 25 bp, Mus musculus
gctattctatagcattccatatggc

SEQ ID NO: 564851 - DNA, 25 bp, Mus musculus
gctattctataggattccatatggc

SEQ ID NO: 564852 - DNA, 25 bp, Mus musculus
gctattctgaacacagctggctatg

SEQ ID NO: 564853 - DNA, 25 bp, Mus musculus
gctattctgaactcagctggctatg

SEQ ID NO: 564854 - DNA, 25 bp, Mus musculus
gctattctgagcagattctgttttt

SEQ ID NO: 564855 - DNA, 25 bp, Mus musculus
gctattctgagctgattctgttttt

SEQ ID NO: 564856 - DNA, 25 bp, Mus musculus
gctattctgggaccaagtgcatgta

SEQ ID NO: 564857 - DNA, 25 bp, Mus musculus
gctattctgggagcaagtgcatgta

SEQ ID NO: 564858 - DNA, 25 bp, Mus musculus
gctattctggttctcggtgccacat

SEQ ID NO: 564859 - DNA, 25 bp, Mus musculus
gctattctggttgtcggtgccacat

SEQ ID NO: 564860 - DNA, 25 bp, Mus musculus
gctattctgtagagtgtatgtcatc

SEQ ID NO: 564861 - DNA, 25 bp, Mus musculus
gctattctgtagtgtgtatgtcatc

SEQ ID NO: 564862 - DNA, 25 bp, Mus musculus
gctattcttgttccctttttgtaaa

SEQ ID NO: 564863 - DNA, 25 bp, Mus musculus
gctattcttgttgcctttttgtaaa

SEQ ID NO: 564864 - DNA, 25 bp, Mus musculus
gctattgaacttatcacagtctatg

SEQ ID NO: 564865 - DNA, 25 bp, Mus musculus
gctattgaacttttcacagtctatg

SEQ ID NO: 564866 - DNA, 25 bp, Mus musculus
gctattgaccaaatgggacccttgt

SEQ ID NO: 564867 - DNA, 25 bp, Mus musculus
gctattgaccaattgggacccttgt

SEQ ID NO: 564868 - DNA, 25 bp, Mus musculus
gctattgacccaaacagctgttgga

SEQ ID NO: 564869 - DNA, 25 bp, Mus musculus
gctattgacccatacagctgttgga

SEQ ID NO: 564870 - DNA, 25 bp, Mus musculus
gctattgagcacctaagccacccaa

SEQ ID NO: 564871 - DNA, 25 bp, Mus musculus
gctattgagcacgtaagccacccaa

SEQ ID NO: 564872 - DNA, 25 bp, Mus musculus
gctattgagttcagagttgctagat

SEQ ID NO: 564873 - DNA, 25 bp, Mus musculus
gctattgagttctgagttgctagat

SEQ ID NO: 564874 - DNA, 25 bp, Mus musculus
gctattgatattactcactctagtg

SEQ ID NO: 564875 - DNA, 25 bp, Mus musculus
gctattgatatttctcactctagtg

SEQ ID NO: 564876 - DNA, 25 bp, Mus musculus
gctattgatctcaaagcctctgctt

SEQ ID NO: 564877 - DNA, 25 bp, Mus musculus
gctattgatctctaagcctctgctt

SEQ ID NO: 564878 - DNA, 25 bp, Mus musculus
gctattgatcttaccactttccgtg

SEQ ID NO: 564879 - DNA, 25 bp, Mus musculus
gctattgatctttccactttccgtg

SEQ ID NO: 564880 - DNA, 25 bp, Mus musculus
gctattgcatggactgtttggctca

SEQ ID NO: 564881 - DNA, 25 bp, Mus musculus
gctattgcatggtctgtttggctca

SEQ ID NO: 564882 - DNA, 25 bp, Mus musculus
gctattgccaccaccgtagggtaaa

SEQ ID NO: 564883 - DNA, 25 bp, Mus musculus
gctattgccacctccgtagggtaaa

SEQ ID NO: 564884 - DNA, 25 bp, Mus musculus
gctattgccttgctttacccaacat

SEQ ID NO: 564885 - DNA, 25 bp, Mus musculus
gctattgccttggtttacccaacat

SEQ ID NO: 564886 - DNA, 25 bp, Mus musculus
gctattgcttaactgctttctgagg

SEQ ID NO: 564887 - DNA, 25 bp, Mus musculus
gctattgcttaagtgctttctgagg

SEQ ID NO: 564888 - DNA, 25 bp, Mus musculus
gctattgcttttcctgtgaaacttt

SEQ ID NO: 564889 - DNA, 25 bp, Mus musculus
gctattgcttttgctgtgaaacttt

SEQ ID NO: 564890 - DNA, 25 bp, Mus musculus
gctattggacgtcatccagtggtat

SEQ ID NO: 564891 - DNA, 25 bp, Mus musculus
gctattggacgtgatccagtggtat

SEQ ID NO: 564892 - DNA, 25 bp, Mus musculus
gctattggattactgcaagtcaaaa

SEQ ID NO: 564893 - DNA, 25 bp, Mus musculus
gctattggattagtgcaagtcaaaa

SEQ ID NO: 564894 - DNA, 25 bp, Mus musculus
gctattggcctaactgtgtaacttt

SEQ ID NO: 564895 - DNA, 25 bp, Mus musculus
gctattggcctatctgtgtaacttt

SEQ ID NO: 564896 - DNA, 25 bp, Mus musculus
gctattggccttagatttcatctga

SEQ ID NO: 564897 - DNA, 25 bp, Mus musculus
gctattggcctttgatttcatctga

SEQ ID NO: 564898 - DNA, 25 bp, Mus musculus
gctattgggacactattatggccta

SEQ ID NO: 564899 - DNA, 25 bp, Mus musculus
gctattgggacagtattatggccta

SEQ ID NO: 564900 - DNA, 25 bp, Mus musculus
gctattgtagagctctcctaggaac

SEQ ID NO: 564901 - DNA, 25 bp, Mus musculus
gctattgtagaggtctcctaggaac

SEQ ID NO: 564902 - DNA, 25 bp, Mus musculus
gctattgtagatatgaccatcctat

SEQ ID NO: 564903 - DNA, 25 bp, Mus musculus
gctattgtagatttgaccatcctat

SEQ ID NO: 564904 - DNA, 25 bp, Mus musculus
gctattgtattcaatgtaacagtgt

SEQ ID NO: 564905 - DNA, 25 bp, Mus musculus
gctattgtattctatgtaacagtgt

SEQ ID NO: 564906 - DNA, 25 bp, Mus musculus
gctattgtccttagctagcaggttt

SEQ ID NO: 564907 - DNA, 25 bp, Mus musculus
gctattgtcctttgctagcaggttt

SEQ ID NO: 564908 - DNA, 25 bp, Mus musculus
gctattgtgctcagaaggtccattc

SEQ ID NO: 564909 - DNA, 25 bp, Mus musculus
gctattgtgctctgaaggtccattc

SEQ ID NO: 564910 - DNA, 25 bp, Mus musculus
gctattgtggctatgttactgctaa

SEQ ID NO: 564911 - DNA, 25 bp, Mus musculus
gctattgtggctttgttactgctaa

SEQ ID NO: 564912 - DNA, 25 bp, Mus musculus
gctattgttggtatgtgctgagacc

SEQ ID NO: 564913 - DNA, 25 bp, Mus musculus
gctattgttggtttgtgctgagacc

SEQ ID NO: 564914 - DNA, 25 bp, Mus musculus
gctatttaacccacaaagttgacca

SEQ ID NO: 564915 - DNA, 25 bp, Mus musculus
gctatttaaccctcaaagttgacca

SEQ ID NO: 564916 - DNA, 25 bp, Mus musculus
gctatttaagcacgaacccattttc

SEQ ID NO: 564917 - DNA, 25 bp, Mus musculus
gctatttaagcaggaacccattttc

SEQ ID NO: 564918 - DNA, 25 bp, Mus musculus
gctatttacactcgagtcaccgtca

SEQ ID NO: 564919 - DNA, 25 bp, Mus musculus
gctatttacactggagtcaccgtca

SEQ ID NO: 564920 - DNA, 25 bp, Mus musculus
gctatttacagacctggccttggat

SEQ ID NO: 564921 - DNA, 25 bp, Mus musculus
gctatttacagagctggccttggat

SEQ ID NO: 564922 - DNA, 25 bp, Mus musculus
gctatttacagtactctttccctta

SEQ ID NO: 564923 - DNA, 25 bp, Mus musculus
gctatttacagttctctttccctta

SEQ ID NO: 564924 - DNA, 25 bp, Mus musculus
gctatttaccctatccatttgtatc

SEQ ID NO: 564925 - DNA, 25 bp, Mus musculus
gctatttaccctttccatttgtatc

SEQ ID NO: 564926 - DNA, 25 bp, Mus musculus
gctatttagacccactgatctctaa

SEQ ID NO: 564927 - DNA, 25 bp, Mus musculus
gctatttagaccgactgatctctaa

SEQ ID NO: 564928 - DNA, 25 bp, Mus musculus
gctatttagcctatggtgccttaga

SEQ ID NO: 564929 - DNA, 25 bp, Mus musculus
gctatttagcctttggtgccttaga

SEQ ID NO: 564930 - DNA, 25 bp, Mus musculus
gctatttatctacccagatctgtct

SEQ ID NO: 564931 - DNA, 25 bp, Mus musculus
gctatttatctagccagatctgtct

SEQ ID NO: 564932 - DNA, 25 bp, Mus musculus
gctatttcacatcagtaggttttcc

SEQ ID NO: 564933 - DNA, 25 bp, Mus musculus
gctatttcacatgagtaggttttcc

SEQ ID NO: 564934 - DNA, 25 bp, Mus musculus
gctatttcacgacaccagggttgca

SEQ ID NO: 564935 - DNA, 25 bp, Mus musculus
gctatttcacgagaccagggttgca

SEQ ID NO: 564936 - DNA, 25 bp, Mus musculus
gctatttcaggaatgccatgtgtgc

SEQ ID NO: 564937 - DNA, 25 bp, Mus musculus
gctatttcaggattgccatgtgtgc

SEQ ID NO: 564938 - DNA, 25 bp, Mus musculus
gctatttcagggacgttacatcatg

SEQ ID NO: 564939 - DNA, 25 bp, Mus musculus
gctatttcagggtcgttacatcatg

SEQ ID NO: 564940 - DNA, 25 bp, Mus musculus
gctatttcccacaaaattcacattt

SEQ ID NO: 564941 - DNA, 25 bp, Mus musculus
gctatttcccactaaattcacattt

SEQ ID NO: 564942 - DNA, 25 bp, Mus musculus
gctatttcccttctattgcatttta

SEQ ID NO: 564943 - DNA, 25 bp, Mus musculus
gctatttcccttgtattgcatttta

SEQ ID NO: 564944 - DNA, 25 bp, Mus musculus
gctatttcctaacctgcaggcagaa

SEQ ID NO: 564945 - DNA, 25 bp, Mus musculus
gctatttcctaagctgcaggcagaa

SEQ ID NO: 564946 - DNA, 25 bp, Mus musculus
gctatttcctcactatttgccatct

SEQ ID NO: 564947 - DNA, 25 bp, Mus musculus
gctatttcctcagtatttgccatct

SEQ ID NO: 564948 - DNA, 25 bp, Mus musculus
gctatttctaaaaaccactttcctt

SEQ ID NO: 564949 - DNA, 25 bp, Mus musculus
gctatttctaaataccactttcctt

SEQ ID NO: 564950 - DNA, 25 bp, Mus musculus
gctatttctacactgtcatctccat

SEQ ID NO: 564951 - DNA, 25 bp, Mus musculus
gctatttctacagtgtcatctccat

SEQ ID NO: 564952 - DNA, 25 bp, Mus musculus
gctatttctattacttacctaaaga

SEQ ID NO: 564953 - DNA, 25 bp, Mus musculus
gctatttctatttcttacctaaaga

SEQ ID NO: 564954 - DNA, 25 bp, Mus musculus
gctatttctgagacaccagctgcag

SEQ ID NO: 564955 - DNA, 25 bp, Mus musculus
gctatttctgagtcaccagctgcag

SEQ ID NO: 564956 - DNA, 25 bp, Mus musculus
gctatttctgctacaaccaattttt

SEQ ID NO: 564957 - DNA, 25 bp, Mus musculus
gctatttctgcttcaaccaattttt

SEQ ID NO: 564958 - DNA, 25 bp, Mus musculus
gctatttctgtactgggtgatttcc

SEQ ID NO: 564959 - DNA, 25 bp, Mus musculus
gctatttctgtagtgggtgatttcc

SEQ ID NO: 564960 - DNA, 25 bp, Mus musculus
gctatttctgtgagttccaagaaca

SEQ ID NO: 564961 - DNA, 25 bp, Mus musculus
gctatttctgtgtgttccaagaaca

SEQ ID NO: 564962 - DNA, 25 bp, Mus musculus
gctatttctttgaaaagtaggacaa

SEQ ID NO: 564963 - DNA, 25 bp, Mus musculus
gctatttctttgtaaagtaggacaa

SEQ ID NO: 564964 - DNA, 25 bp, Mus musculus
gctatttgacctcaataataaattc

SEQ ID NO: 564965 - DNA, 25 bp, Mus musculus
gctatttgacctgaataataaattc

SEQ ID NO: 564966 - DNA, 25 bp, Mus musculus
gctatttgcctgcagttcataattc

SEQ ID NO: 564967 - DNA, 25 bp, Mus musculus
gctatttgcctggagttcataattc

SEQ ID NO: 564968 - DNA, 25 bp, Mus musculus
gctatttgctcaactggcatctttc

SEQ ID NO: 564969 - DNA, 25 bp, Mus musculus
gctatttgctcatctggcatctttc

SEQ ID NO: 564970 - DNA, 25 bp, Mus musculus
gctatttgcttaactgcacttactg

SEQ ID NO: 564971 - DNA, 25 bp, Mus musculus
gctatttgcttatctgcacttactg

SEQ ID NO: 564972 - DNA, 25 bp, Mus musculus
gctatttggccccagatttccaaaa

SEQ ID NO: 564973 - DNA, 25 bp, Mus musculus
gctatttggcccgagatttccaaaa

SEQ ID NO: 564974 - DNA, 25 bp, Mus musculus
gctatttggcttctttgccgtggac

SEQ ID NO: 564975 - DNA, 25 bp, Mus musculus
gctatttggcttgtttgccgtggac

SEQ ID NO: 564976 - DNA, 25 bp, Mus musculus
gctatttggtacagggcccactcag

SEQ ID NO: 564977 - DNA, 25 bp, Mus musculus
gctatttggtactgggcccactcag

SEQ ID NO: 564978 - DNA, 25 bp, Mus musculus
gctatttgtgtaacactgctgtcgt

SEQ ID NO: 564979 - DNA, 25 bp, Mus musculus
gctatttgtgtatcactgctgtcgt

SEQ ID NO: 564980 - DNA, 25 bp, Mus musculus
gctatttgttttaccatttctcaat

SEQ ID NO: 564981 - DNA, 25 bp, Mus musculus
gctatttgtttttccatttctcaat

SEQ ID NO: 564982 - DNA, 25 bp, Mus musculus
gctattttaagcaatctgggcaaac

SEQ ID NO: 564983 - DNA, 25 bp, Mus musculus
gctattttaagctatctgggcaaac

SEQ ID NO: 564984 - DNA, 25 bp, Mus musculus
gctattttacacaatcctggcattc

SEQ ID NO: 564985 - DNA, 25 bp, Mus musculus
gctattttacactatcctggcattc

SEQ ID NO: 564986 - DNA, 25 bp, Mus musculus
gctattttaccaatcttgtctactg

SEQ ID NO: 564987 - DNA, 25 bp, Mus musculus
gctattttaccattcttgtctactg

SEQ ID NO: 564988 - DNA, 25 bp, Mus musculus
gctattttagctcatattcttcccc

SEQ ID NO: 564989 - DNA, 25 bp, Mus musculus
gctattttagctgatattcttcccc

SEQ ID NO: 564990 - DNA, 25 bp, Mus musculus
gctattttatggacacatcatcacc

SEQ ID NO: 564991 - DNA, 25 bp, Mus musculus
gctattttatggtcacatcatcacc

SEQ ID NO: 564992 - DNA, 25 bp, Mus musculus
gctattttcacactaagtacactaa

SEQ ID NO: 564993 - DNA, 25 bp, Mus musculus
gctattttcacactgacatcttgaa

SEQ ID NO: 564994 - DNA, 25 bp, Mus musculus
gctattttcacagtaagtacactaa

SEQ ID NO: 564995 - DNA, 25 bp, Mus musculus
gctattttcacagtgacatcttgaa

SEQ ID NO: 564996 - DNA, 25 bp, Mus musculus
gctattttcagtaaaccttgttcca

SEQ ID NO: 564997 - DNA, 25 bp, Mus musculus
gctattttcagtagatcacagtttg

SEQ ID NO: 564998 - DNA, 25 bp, Mus musculus
gctattttcagttaaccttgttcca

SEQ ID NO: 564999 - DNA, 25 bp, Mus musculus
gctattttcagttgatcacagtttg

SEQ ID NO: 565000 - DNA, 25 bp, Mus musculus
gctattttcatacattccctgttca

SEQ ID NO: 565001 - DNA, 25 bp, Mus musculus
gctattttcatagattccctgttca

SEQ ID NO: 565002 - DNA, 25 bp, Mus musculus
gctattttccatagtttggcacaga

SEQ ID NO: 565003 - DNA, 25 bp, Mus musculus
gctattttccattgtttggcacaga

SEQ ID NO: 565004 - DNA, 25 bp, Mus musculus
gctattttcctcatcataagcttgt

SEQ ID NO: 565005 - DNA, 25 bp, Mus musculus
gctattttcctcttcataagcttgt

SEQ ID NO: 565006 - DNA, 25 bp, Mus musculus
gctattttctctaaggcaccagatt

SEQ ID NO: 565007 - DNA, 25 bp, Mus musculus
gctattttctcttaggcaccagatt

SEQ ID NO: 565008 - DNA, 25 bp, Mus musculus
gctattttgaagacatgggttccta

SEQ ID NO: 565009 - DNA, 25 bp, Mus musculus
gctattttgaagtcatgggttccta

SEQ ID NO: 565010 - DNA, 25 bp, Mus musculus
gctattttgcagcaggttaccttga

SEQ ID NO: 565011 - DNA, 25 bp, Mus musculus
gctattttgcaggaggttaccttga

SEQ ID NO: 565012 - DNA, 25 bp, Mus musculus
gctattttgcatctgttgagcccaa

SEQ ID NO: 565013 - DNA, 25 bp, Mus musculus
gctattttgcatgtgttgagcccaa

SEQ ID NO: 565014 - DNA, 25 bp, Mus musculus
gctattttggctatgtgtatattac

SEQ ID NO: 565015 - DNA, 25 bp, Mus musculus
gctattttggctttgtgtatattac

SEQ ID NO: 565016 - DNA, 25 bp, Mus musculus
gctatttttattaccgcttaaggcg

SEQ ID NO: 565017 - DNA, 25 bp, Mus musculus
gctatttttatttccgcttaaggcg

SEQ ID NO: 565018 - DNA, 25 bp, Mus musculus
gctcaaaaagcgagtgttctagtga

SEQ ID NO: 565019 - DNA, 25 bp, Mus musculus
gctcaaaaagcgtgtgttctagtga

SEQ ID NO: 565020 - DNA, 25 bp, Mus musculus
gctcaaaacatgctggctcctggca

SEQ ID NO: 565021 - DNA, 25 bp, Mus musculus
gctcaaaacatggtggctcctggca

SEQ ID NO: 565022 - DNA, 25 bp, Mus musculus
gctcaaaaccaaccatatgtgactt

SEQ ID NO: 565023 - DNA, 25 bp, Mus musculus
gctcaaaaccaagcatatgtgactt

SEQ ID NO: 565024 - DNA, 25 bp, Mus musculus
gctcaaaactccaactttgctcgga

SEQ ID NO: 565025 - DNA, 25 bp, Mus musculus
gctcaaaactcctactttgctcgga

SEQ ID NO: 565026 - DNA, 25 bp, Mus musculus
gctcaaaactctcatgtcacgaagg

SEQ ID NO: 565027 - DNA, 25 bp, Mus musculus
gctcaaaactctgatgtcacgaagg

SEQ ID NO: 565028 - DNA, 25 bp, Mus musculus
gctcaaacaagaaaccaccgcctgg

SEQ ID NO: 565029 - DNA, 25 bp, Mus musculus
gctcaaacaagataccaccgcctgg

SEQ ID NO: 565030 - DNA, 25 bp, Mus musculus
gctcaaacagaaacctgtgctgccc

SEQ ID NO: 565031 - DNA, 25 bp, Mus musculus
gctcaaacagaatcctgtgctgccc

SEQ ID NO: 565032 - DNA, 25 bp, Mus musculus
gctcaaaccgtcaattttggaaaag

SEQ ID NO: 565033 - DNA, 25 bp, Mus musculus
gctcaaaccgtctattttggaaaag

SEQ ID NO: 565034 - DNA, 25 bp, Mus musculus
gctcaaactacaatagtactagtga

SEQ ID NO: 565035 - DNA, 25 bp, Mus musculus
gctcaaactacattagtactagtga

SEQ ID NO: 565036 - DNA, 25 bp, Mus musculus
gctcaaactcagcatgctgcagatg

SEQ ID NO: 565037 - DNA, 25 bp, Mus musculus
gctcaaactcaggatgctgcagatg

SEQ ID NO: 565038 - DNA, 25 bp, Mus musculus
gctcaaactcttaggaagcttgaat

SEQ ID NO: 565039 - DNA, 25 bp, Mus musculus
gctcaaactctttggaagcttgaat

SEQ ID NO: 565040 - DNA, 25 bp, Mus musculus
gctcaaagagctattccttggtttg

SEQ ID NO: 565041 - DNA, 25 bp, Mus musculus
gctcaaagagcttttccttggtttg

SEQ ID NO: 565042 - DNA, 25 bp, Mus musculus
gctcaaagcatcatttttaatttaa

SEQ ID NO: 565043 - DNA, 25 bp, Mus musculus
gctcaaagcatcttttttaatttaa

SEQ ID NO: 565044 - DNA, 25 bp, Mus musculus
gctcaaagccttagaactattttaa

SEQ ID NO: 565045 - DNA, 25 bp, Mus musculus
gctcaaagcctttgaactattttaa

SEQ ID NO: 565046 - DNA, 25 bp, Mus musculus
gctcaaagggagaagcttgcaagac

SEQ ID NO: 565047 - DNA, 25 bp, Mus musculus
gctcaaagggagtagcttgcaagac

SEQ ID NO: 565048 - DNA, 25 bp, Mus musculus
gctcaaagtctgagggccctggatt

SEQ ID NO: 565049 - DNA, 25 bp, Mus musculus
gctcaaagtctgtgggccctggatt

SEQ ID NO: 565050 - DNA, 25 bp, Mus musculus
gctcaaatatgaagaggtgtctatt

SEQ ID NO: 565051 - DNA, 25 bp, Mus musculus
gctcaaatatgatgaggtgtctatt

SEQ ID NO: 565052 - DNA, 25 bp, Mus musculus
gctcaaatattccaaatcttcaaaa

SEQ ID NO: 565053 - DNA, 25 bp, Mus musculus
gctcaaatattcgaaatcttcaaaa

SEQ ID NO: 565054 - DNA, 25 bp, Mus musculus
gctcaaatatttacagcaagcaaaa

SEQ ID NO: 565055 - DNA, 25 bp, Mus musculus
gctcaaatattttcagcaagcaaaa

SEQ ID NO: 565056 - DNA, 25 bp, Mus musculus
gctcaaatcccaacataagagagaa

SEQ ID NO: 565057 - DNA, 25 bp, Mus musculus
gctcaaatcccatcataagagagaa

SEQ ID NO: 565058 - DNA, 25 bp, Mus musculus
gctcaaatcttacaaactactcagg

SEQ ID NO: 565059 - DNA, 25 bp, Mus musculus
gctcaaatcttagaaactactcagg

SEQ ID NO: 565060 - DNA, 25 bp, Mus musculus
gctcaaatgaccctggaagttccct

SEQ ID NO: 565061 - DNA, 25 bp, Mus musculus
gctcaaatgaccgtggaagttccct

SEQ ID NO: 565062 - DNA, 25 bp, Mus musculus
gctcaaatggctaagtgctttttat

SEQ ID NO: 565063 - DNA, 25 bp, Mus musculus
gctcaaatggcttagtgctttttat

SEQ ID NO: 565064 - DNA, 25 bp, Mus musculus
gctcaaattttaaagatggatgcct

SEQ ID NO: 565065 - DNA, 25 bp, Mus musculus
gctcaaattttatagatggatgcct

SEQ ID NO: 565066 - DNA, 25 bp, Mus musculus
gctcaacaaggcatcaattaacatg

SEQ ID NO: 565067 - DNA, 25 bp, Mus musculus
gctcaacaaggcttcaattaacatg

SEQ ID NO: 565068 - DNA, 25 bp, Mus musculus
gctcaacaatttcgacaaggtcctg

SEQ ID NO: 565069 - DNA, 25 bp, Mus musculus
gctcaacaatttggacaaggtcctg

SEQ ID NO: 565070 - DNA, 25 bp, Mus musculus
gctcaacagcgacgatgacgtcagt

SEQ ID NO: 565071 - DNA, 25 bp, Mus musculus
gctcaacagcgaggatgacgtcagt

SEQ ID NO: 565072 - DNA, 25 bp, Mus musculus
gctcaacaggccatagtgcttgctg

SEQ ID NO: 565073 - DNA, 25 bp, Mus musculus
gctcaacaggccttagtgcttgctg

SEQ ID NO: 565074 - DNA, 25 bp, Mus musculus
gctcaacatctaacattgtatccat

SEQ ID NO: 565075 - DNA, 25 bp, Mus musculus
gctcaacatctatcattgtatccat

SEQ ID NO: 565076 - DNA, 25 bp, Mus musculus
gctcaaccagttctccgtgtgaaga

SEQ ID NO: 565077 - DNA, 25 bp, Mus musculus
gctcaaccagttgtccgtgtgaaga

SEQ ID NO: 565078 - DNA, 25 bp, Mus musculus
gctcaaccctgaaggagtttacctg

SEQ ID NO: 565079 - DNA, 25 bp, Mus musculus
gctcaaccctgatggagtttacctg

SEQ ID NO: 565080 - DNA, 25 bp, Mus musculus
gctcaactacggagcagattcgaac

SEQ ID NO: 565081 - DNA, 25 bp, Mus musculus
gctcaactacggtgcagattcgaac

SEQ ID NO: 565082 - DNA, 25 bp, Mus musculus
gctcaactagctctcttcatactaa

SEQ ID NO: 565083 - DNA, 25 bp, Mus musculus
gctcaactagctgtcttcatactaa

SEQ ID NO: 565084 - DNA, 25 bp, Mus musculus
gctcaactcaggcattttgctaata

SEQ ID NO: 565085 - DNA, 25 bp, Mus musculus
gctcaactcagggattttgctaata

SEQ ID NO: 565086 - DNA, 25 bp, Mus musculus
gctcaactcctcagaagagcgtgga

SEQ ID NO: 565087 - DNA, 25 bp, Mus musculus
gctcaactcctctgaagagcgtgga

SEQ ID NO: 565088 - DNA, 25 bp, Mus musculus
gctcaactctgaatttactgtgtat

SEQ ID NO: 565089 - DNA, 25 bp, Mus musculus
gctcaactctgattttactgtgtat

SEQ ID NO: 565090 - DNA, 25 bp, Mus musculus
gctcaactcttacagtacatcagag

SEQ ID NO: 565091 - DNA, 25 bp, Mus musculus
gctcaactcttagagtacatcagag

SEQ ID NO: 565092 - DNA, 25 bp, Mus musculus
gctcaactgagcagacagaggctgt

SEQ ID NO: 565093 - DNA, 25 bp, Mus musculus
gctcaactgagctgacagaggctgt

SEQ ID NO: 565094 - DNA, 25 bp, Mus musculus
gctcaactgctaatactatgctcct

SEQ ID NO: 565095 - DNA, 25 bp, Mus musculus
gctcaactgctattactatgctcct

SEQ ID NO: 565096 - DNA, 25 bp, Mus musculus
gctcaactggctcggagtcactgtg

SEQ ID NO: 565097 - DNA, 25 bp, Mus musculus
gctcaactggctgggagtcactgtg

SEQ ID NO: 565098 - DNA, 25 bp, Mus musculus
gctcaactgtataggacttcctatg

SEQ ID NO: 565099 - DNA, 25 bp, Mus musculus
gctcaactgtattggacttcctatg

SEQ ID NO: 565100 - DNA, 25 bp, Mus musculus
gctcaacttggaattggagtccact

SEQ ID NO: 565101 - DNA, 25 bp, Mus musculus
gctcaacttggatttggagtccact

SEQ ID NO: 565102 - DNA, 25 bp, Mus musculus
gctcaacttgtgctaaggctgtctt

SEQ ID NO: 565103 - DNA, 25 bp, Mus musculus
gctcaacttgtggtaaggctgtctt

SEQ ID NO: 565104 - DNA, 25 bp, Mus musculus
gctcaagaaggaaacgtacctggaa

SEQ ID NO: 565105 - DNA, 25 bp, Mus musculus
gctcaagaaggaaattgatgacctg

SEQ ID NO: 565106 - DNA, 25 bp, Mus musculus
gctcaagaaggatacgtacctggaa

SEQ ID NO: 565107 - DNA, 25 bp, Mus musculus
gctcaagaaggatattgatgacctg

SEQ ID NO: 565108 - DNA, 25 bp, Mus musculus
gctcaagaattgctgcgactggaag

SEQ ID NO: 565109 - DNA, 25 bp, Mus musculus
gctcaagaattggtgcgactggaag

SEQ ID NO: 565110 - DNA, 25 bp, Mus musculus
gctcaagacccactgttataggaat

SEQ ID NO: 565111 - DNA, 25 bp, Mus musculus
gctcaagacccagtgttataggaat

SEQ ID NO: 565112 - DNA, 25 bp, Mus musculus
gctcaagatcttccatggctacata

SEQ ID NO: 565113 - DNA, 25 bp, Mus musculus
gctcaagatcttgcatggctacata

SEQ ID NO: 565114 - DNA, 25 bp, Mus musculus
gctcaagattgtcgccttactcaga

SEQ ID NO: 565115 - DNA, 25 bp, Mus musculus
gctcaagattgtggccttactcaga

SEQ ID NO: 565116 - DNA, 25 bp, Mus musculus
gctcaagcccctcagaatctcagtg

SEQ ID NO: 565117 - DNA, 25 bp, Mus musculus
gctcaagcccctgagaatctcagtg

SEQ ID NO: 565118 - DNA, 25 bp, Mus musculus
gctcaagcgcaaatactggtggaaa

SEQ ID NO: 565119 - DNA, 25 bp, Mus musculus
gctcaagcgcaattactggtggaaa

SEQ ID NO: 565120 - DNA, 25 bp, Mus musculus
gctcaagcgctgatgtgttcattat

SEQ ID NO: 565121 - DNA, 25 bp, Mus musculus
gctcaagcgctgttgtgttcattat

SEQ ID NO: 565122 - DNA, 25 bp, Mus musculus
gctcaagctcagaatgctgctctgt

SEQ ID NO: 565123 - DNA, 25 bp, Mus musculus
gctcaagctcagtatgctgctctgt

SEQ ID NO: 565124 - DNA, 25 bp, Mus musculus
gctcaagcttcaaccatgcagagga

SEQ ID NO: 565125 - DNA, 25 bp, Mus musculus
gctcaagcttcatccatgcagagga

SEQ ID NO: 565126 - DNA, 25 bp, Mus musculus
gctcaagcttctcttacaggtttct

SEQ ID NO: 565127 - DNA, 25 bp, Mus musculus
gctcaagcttctgttacaggtttct

SEQ ID NO: 565128 - DNA, 25 bp, Mus musculus
gctcaaggatctcgtgtccctggcc

SEQ ID NO: 565129 - DNA, 25 bp, Mus musculus
gctcaaggatctggtgtccctggcc

SEQ ID NO: 565130 - DNA, 25 bp, Mus musculus
gctcaaggatgacgtcctcaaggag

SEQ ID NO: 565131 - DNA, 25 bp, Mus musculus
gctcaaggatgaggtcctcaaggag

SEQ ID NO: 565132 - DNA, 25 bp, Mus musculus
gctcaaggattcagtgtttactcac

SEQ ID NO: 565133 - DNA, 25 bp, Mus musculus
gctcaaggattctgtgtttactcac

SEQ ID NO: 565134 - DNA, 25 bp, Mus musculus
gctcaaggcaggaatatcaaatatt

SEQ ID NO: 565135 - DNA, 25 bp, Mus musculus
gctcaaggcaggtatatcaaatatt

SEQ ID NO: 565136 - DNA, 25 bp, Mus musculus
gctcaaggcattacgcatgtgacat

SEQ ID NO: 565137 - DNA, 25 bp, Mus musculus
gctcaaggcattcgactttgcatta

SEQ ID NO: 565138 - DNA, 25 bp, Mus musculus
gctcaaggcattggactttgcatta

SEQ ID NO: 565139 - DNA, 25 bp, Mus musculus
gctcaaggcatttcgcatgtgacat

SEQ ID NO: 565140 - DNA, 25 bp, Mus musculus
gctcaaggccagctggtgtactaag

SEQ ID NO: 565141 - DNA, 25 bp, Mus musculus
gctcaaggccaggtggtgtactaag

SEQ ID NO: 565142 - DNA, 25 bp, Mus musculus
gctcaaggctaaactctgctataga

SEQ ID NO: 565143 - DNA, 25 bp, Mus musculus
gctcaaggctaatctctgctataga

SEQ ID NO: 565144 - DNA, 25 bp, Mus musculus
gctcaaggcttcactagtcttatga

SEQ ID NO: 565145 - DNA, 25 bp, Mus musculus
gctcaaggcttctctagtcttatga

SEQ ID NO: 565146 - DNA, 25 bp, Mus musculus
gctcaaggtgctacaaaaactgtcg

SEQ ID NO: 565147 - DNA, 25 bp, Mus musculus
gctcaaggtgcttcaaaaactgtcg

SEQ ID NO: 565148 - DNA, 25 bp, Mus musculus
gctcaagtaaggatggccttttcct

SEQ ID NO: 565149 - DNA, 25 bp, Mus musculus
gctcaagtaaggttggccttttcct

SEQ ID NO: 565150 - DNA, 25 bp, Mus musculus
gctcaagtatctatagtggacttct

SEQ ID NO: 565151 - DNA, 25 bp, Mus musculus
gctcaagtatctttagtggacttct

SEQ ID NO: 565152 - DNA, 25 bp, Mus musculus
gctcaagtctcacgttcattattat

SEQ ID NO: 565153 - DNA, 25 bp, Mus musculus
gctcaagtctcaggttcattattat

SEQ ID NO: 565154 - DNA, 25 bp, Mus musculus
gctcaagtcttactgtggaacacta

SEQ ID NO: 565155 - DNA, 25 bp, Mus musculus
gctcaagtcttagtgtggaacacta

SEQ ID NO: 565156 - DNA, 25 bp, Mus musculus
gctcaagtgcataaactactgacgt

SEQ ID NO: 565157 - DNA, 25 bp, Mus musculus
gctcaagtgcattaactactgacgt

SEQ ID NO: 565158 - DNA, 25 bp, Mus musculus
gctcaagtggctactctatggttaa

SEQ ID NO: 565159 - DNA, 25 bp, Mus musculus
gctcaagtggcttctctatggttaa

SEQ ID NO: 565160 - DNA, 25 bp, Mus musculus
gctcaagtgtgtaccaaggcccaag

SEQ ID NO: 565161 - DNA, 25 bp, Mus musculus
gctcaagtgtgttccaaggcccaag

SEQ ID NO: 565162 - DNA, 25 bp, Mus musculus
gctcaagttcataattctggcaaat

SEQ ID NO: 565163 - DNA, 25 bp, Mus musculus
gctcaagttcattattctggcaaat

SEQ ID NO: 565164 - DNA, 25 bp, Mus musculus
gctcaagttcccaaatatgcgagga

SEQ ID NO: 565165 - DNA, 25 bp, Mus musculus
gctcaagttccctaatatgcgagga

SEQ ID NO: 565166 - DNA, 25 bp, Mus musculus
gctcaagttggacgtctttcgggca

SEQ ID NO: 565167 - DNA, 25 bp, Mus musculus
gctcaagttggaggtctttcgggca

SEQ ID NO: 565168 - DNA, 25 bp, Mus musculus
gctcaagtttaactttcatgcactg

SEQ ID NO: 565169 - DNA, 25 bp, Mus musculus
gctcaagtttaagtttcatgcactg

SEQ ID NO: 565170 - DNA, 25 bp, Mus musculus
gctcaataacgaagtgagtcggatc

SEQ ID NO: 565171 - DNA, 25 bp, Mus musculus
gctcaataacgatgtgagtcggatc

SEQ ID NO: 565172 - DNA, 25 bp, Mus musculus
gctcaatatcccaacaaccaatgtg

SEQ ID NO: 565173 - DNA, 25 bp, Mus musculus
gctcaatatccctacaaccaatgtg

SEQ ID NO: 565174 - DNA, 25 bp, Mus musculus
gctcaatcccaaccttaaatatcac

SEQ ID NO: 565175 - DNA, 25 bp, Mus musculus
gctcaatcccaagcttaaatatcac

SEQ ID NO: 565176 - DNA, 25 bp, Mus musculus
gctcaatggataaaggcacgtgcta

SEQ ID NO: 565177 - DNA, 25 bp, Mus musculus
gctcaatggatataggcacgtgcta

SEQ ID NO: 565178 - DNA, 25 bp, Mus musculus
gctcaatggtagaacacttgtttaa

SEQ ID NO: 565179 - DNA, 25 bp, Mus musculus
gctcaatggtagtacacttgtttaa

SEQ ID NO: 565180 - DNA, 25 bp, Mus musculus
gctcaatgtgaaatcccgtggtgaa

SEQ ID NO: 565181 - DNA, 25 bp, Mus musculus
gctcaatgtgaattcccgtggtgaa

SEQ ID NO: 565182 - DNA, 25 bp, Mus musculus
gctcaatgtggtaacatggtcttaa

SEQ ID NO: 565183 - DNA, 25 bp, Mus musculus
gctcaatgtggttacatggtcttaa

SEQ ID NO: 565184 - DNA, 25 bp, Mus musculus
gctcaatgttttatggttgcatcat

SEQ ID NO: 565185 - DNA, 25 bp, Mus musculus
gctcaatgttttttggttgcatcat

SEQ ID NO: 565186 - DNA, 25 bp, Mus musculus
gctcaattaattcaagtgggtccca

SEQ ID NO: 565187 - DNA, 25 bp, Mus musculus
gctcaattaattgaagtgggtccca

SEQ ID NO: 565188 - DNA, 25 bp, Mus musculus
gctcaattatcccatgtgagtgaag

SEQ ID NO: 565189 - DNA, 25 bp, Mus musculus
gctcaattatccgatgtgagtgaag

SEQ ID NO: 565190 - DNA, 25 bp, Mus musculus
gctcaattcagcacctagagcgact

SEQ ID NO: 565191 - DNA, 25 bp, Mus musculus
gctcaattcagctcctagagcgact

SEQ ID NO: 565192 - DNA, 25 bp, Mus musculus
gctcaattccatatttcatccatga

SEQ ID NO: 565193 - DNA, 25 bp, Mus musculus
gctcaattccatttttcatccatga

SEQ ID NO: 565194 - DNA, 25 bp, Mus musculus
gctcaatttatactgctcagctcta

SEQ ID NO: 565195 - DNA, 25 bp, Mus musculus
gctcaatttatagtgctcagctcta

SEQ ID NO: 565196 - DNA, 25 bp, Mus musculus
gctcaatttcttctgctgtagtgtg

SEQ ID NO: 565197 - DNA, 25 bp, Mus musculus
gctcaatttcttgtgctgtagtgtg

SEQ ID NO: 565198 - DNA, 25 bp, Mus musculus
gctcacaaacaaccagcaatttctg

SEQ ID NO: 565199 - DNA, 25 bp, Mus musculus
gctcacaaacaagcagcaatttctg

SEQ ID NO: 565200 - DNA, 25 bp, Mus musculus
gctcacaaataaatggctcctcttt

SEQ ID NO: 565201 - DNA, 25 bp, Mus musculus
gctcacaaataattggctcctcttt

SEQ ID NO: 565202 - DNA, 25 bp, Mus musculus
gctcacaactgtccgggactccggt

SEQ ID NO: 565203 - DNA, 25 bp, Mus musculus
gctcacaactgtgcgggactccggt

SEQ ID NO: 565204 - DNA, 25 bp, Mus musculus
gctcacaagaagaactcatgccccg

SEQ ID NO: 565205 - DNA, 25 bp, Mus musculus
gctcacaagaagtactcatgccccg

SEQ ID NO: 565206 - DNA, 25 bp, Mus musculus
gctcacaagccaacacattttaacc

SEQ ID NO: 565207 - DNA, 25 bp, Mus musculus
gctcacaagccatcacattttaacc

SEQ ID NO: 565208 - DNA, 25 bp, Mus musculus
gctcacaatcatccttaactcctga

SEQ ID NO: 565209 - DNA, 25 bp, Mus musculus
gctcacaatcatgcttaactcctga

SEQ ID NO: 565210 - DNA, 25 bp, Mus musculus
gctcacacacaaattatagatgaat

SEQ ID NO: 565211 - DNA, 25 bp, Mus musculus
gctcacacacaatttatagatgaat

SEQ ID NO: 565212 - DNA, 25 bp, Mus musculus
gctcacacacccatggaatttttcc

SEQ ID NO: 565213 - DNA, 25 bp, Mus musculus
gctcacacacccttggaatttttcc

SEQ ID NO: 565214 - DNA, 25 bp, Mus musculus
gctcacacagatcttctcggataaa

SEQ ID NO: 565215 - DNA, 25 bp, Mus musculus
gctcacacagatgttctcggataaa

SEQ ID NO: 565216 - DNA, 25 bp, Mus musculus
gctcacacagctcgtggcacctgga

SEQ ID NO: 565217 - DNA, 25 bp, Mus musculus
gctcacacagctggtggcacctgga

SEQ ID NO: 565218 - DNA, 25 bp, Mus musculus
gctcacacagggaaatgccaactgt

SEQ ID NO: 565219 - DNA, 25 bp, Mus musculus
gctcacacagggtaatgccaactgt

SEQ ID NO: 565220 - DNA, 25 bp, Mus musculus
gctcacacctagcaccagggaggtt

SEQ ID NO: 565221 - DNA, 25 bp, Mus musculus
gctcacacctaggaccagggaggtt

SEQ ID NO: 565222 - DNA, 25 bp, Mus musculus
gctcacacctgtaatactaccactt

SEQ ID NO: 565223 - DNA, 25 bp, Mus musculus
gctcacacctgttatactaccactt

SEQ ID NO: 565224 - DNA, 25 bp, Mus musculus
gctcacactgagaggcaggcctaga

SEQ ID NO: 565225 - DNA, 25 bp, Mus musculus
gctcacactgagtggcaggcctaga

SEQ ID NO: 565226 - DNA, 25 bp, Mus musculus
gctcacagaagcatatacacaggaa

SEQ ID NO: 565227 - DNA, 25 bp, Mus musculus
gctcacagaagcttatacacaggaa

SEQ ID NO: 565228 - DNA, 25 bp, Mus musculus
gctcacagagaaaagtcactggtct

SEQ ID NO: 565229 - DNA, 25 bp, Mus musculus
gctcacagagaatagtcactggtct

SEQ ID NO: 565230 - DNA, 25 bp, Mus musculus
gctcacagatgcacttactaaggaa

SEQ ID NO: 565231 - DNA, 25 bp, Mus musculus
gctcacagatgctcttactaaggaa

SEQ ID NO: 565232 - DNA, 25 bp, Mus musculus
gctcacagcaaaagttcccgaacag

SEQ ID NO: 565233 - DNA, 25 bp, Mus musculus
gctcacagcaaatgttcccgaacag

SEQ ID NO: 565234 - DNA, 25 bp, Mus musculus
gctcacagcaataatagtccagttc

SEQ ID NO: 565235 - DNA, 25 bp, Mus musculus
gctcacagcaattatagtccagttc

SEQ ID NO: 565236 - DNA, 25 bp, Mus musculus
gctcacagcctcatatgattcctgt

SEQ ID NO: 565237 - DNA, 25 bp, Mus musculus
gctcacagcctcttatgattcctgt

SEQ ID NO: 565238 - DNA, 25 bp, Mus musculus
gctcacagccttatgatgattcata

SEQ ID NO: 565239 - DNA, 25 bp, Mus musculus
gctcacagccttcaaatgcaacact

SEQ ID NO: 565240 - DNA, 25 bp, Mus musculus
gctcacagccttgaaatgcaacact

SEQ ID NO: 565241 - DNA, 25 bp, Mus musculus
gctcacagccttttgatgattcata

SEQ ID NO: 565242 - DNA, 25 bp, Mus musculus
gctcacagcggcaattacacagcat

SEQ ID NO: 565243 - DNA, 25 bp, Mus musculus
gctcacagcggctattacacagcat

SEQ ID NO: 565244 - DNA, 25 bp, Mus musculus
gctcacagctgaattccaggttgca

SEQ ID NO: 565245 - DNA, 25 bp, Mus musculus
gctcacagctgatttccaggttgca

SEQ ID NO: 565246 - DNA, 25 bp, Mus musculus
gctcacaggcaaaacccagcatagg

SEQ ID NO: 565247 - DNA, 25 bp, Mus musculus
gctcacaggcaatacccagcatagg

SEQ ID NO: 565248 - DNA, 25 bp, Mus musculus
gctcacagttctacataaccacagt

SEQ ID NO: 565249 - DNA, 25 bp, Mus musculus
gctcacagttcttcataaccacagt

SEQ ID NO: 565250 - DNA, 25 bp, Mus musculus
gctcacagtttgaggctgcaaaatc

SEQ ID NO: 565251 - DNA, 25 bp, Mus musculus
gctcacagtttgtggctgcaaaatc

SEQ ID NO: 565252 - DNA, 25 bp, Mus musculus
gctcacataactcaagcctaaccta

SEQ ID NO: 565253 - DNA, 25 bp, Mus musculus
gctcacataactgaagcctaaccta

SEQ ID NO: 565254 - DNA, 25 bp, Mus musculus
gctcacatatttagagatttactgt

SEQ ID NO: 565255 - DNA, 25 bp, Mus musculus
gctcacatattttgagatttactgt

SEQ ID NO: 565256 - DNA, 25 bp, Mus musculus
gctcacatcactctccagggctgga

SEQ ID NO: 565257 - DNA, 25 bp, Mus musculus
gctcacatcactgtccagggctgga

SEQ ID NO: 565258 - DNA, 25 bp, Mus musculus
gctcacatctaaacagcccgtaggc

SEQ ID NO: 565259 - DNA, 25 bp, Mus musculus
gctcacatctaatcagcccgtaggc

SEQ ID NO: 565260 - DNA, 25 bp, Mus musculus
gctcacatgcatataagattctccc

SEQ ID NO: 565261 - DNA, 25 bp, Mus musculus
gctcacatgcatttaagattctccc

SEQ ID NO: 565262 - DNA, 25 bp, Mus musculus
gctcacattaaccatcctgaaggaa

SEQ ID NO: 565263 - DNA, 25 bp, Mus musculus
gctcacattaacgatcctgaaggaa

SEQ ID NO: 565264 - DNA, 25 bp, Mus musculus
gctcacattcagcaaatagccataa

SEQ ID NO: 565265 - DNA, 25 bp, Mus musculus
gctcacattcaggaaatagccataa

SEQ ID NO: 565266 - DNA, 25 bp, Mus musculus
gctcacattcatcagcattctagtt

SEQ ID NO: 565267 - DNA, 25 bp, Mus musculus
gctcacattcatgagcattctagtt

SEQ ID NO: 565268 - DNA, 25 bp, Mus musculus
gctcacattgatcggcaaacaacct

SEQ ID NO: 565269 - DNA, 25 bp, Mus musculus
gctcacattgatgggcaaacaacct

SEQ ID NO: 565270 - DNA, 25 bp, Mus musculus
gctcacattgtcctgtctcaaatat

SEQ ID NO: 565271 - DNA, 25 bp, Mus musculus
gctcacattgtcgtgtctcaaatat

SEQ ID NO: 565272 - DNA, 25 bp, Mus musculus
gctcacattttaccccaagcctttc

SEQ ID NO: 565273 - DNA, 25 bp, Mus musculus
gctcacattttagcccaagcctttc

SEQ ID NO: 565274 - DNA, 25 bp, Mus musculus
gctcaccaacaaagtgcttgcctag

SEQ ID NO: 565275 - DNA, 25 bp, Mus musculus
gctcaccaacaatgtgcttgcctag

SEQ ID NO: 565276 - DNA, 25 bp, Mus musculus
gctcaccataatagcattacatgaa

SEQ ID NO: 565277 - DNA, 25 bp, Mus musculus
gctcaccataattgcattacatgaa

SEQ ID NO: 565278 - DNA, 25 bp, Mus musculus
gctcacccagtactggaggcagaag

SEQ ID NO: 565279 - DNA, 25 bp, Mus musculus
gctcacccagtagtggaggcagaag

SEQ ID NO: 565280 - DNA, 25 bp, Mus musculus
gctcaccccgctaataaattcttgt

SEQ ID NO: 565281 - DNA, 25 bp, Mus musculus
gctcaccccgcttataaattcttgt

SEQ ID NO: 565282 - DNA, 25 bp, Mus musculus
gctcaccctaggcaagaagtaccct

SEQ ID NO: 565283 - DNA, 25 bp, Mus musculus
gctcaccctagggaagaagtaccct

SEQ ID NO: 565284 - DNA, 25 bp, Mus musculus
gctcaccctattcgagtcagaaaga

SEQ ID NO: 565285 - DNA, 25 bp, Mus musculus
gctcaccctattggagtcagaaaga

SEQ ID NO: 565286 - DNA, 25 bp, Mus musculus
gctcaccctggccatttacgggagg

SEQ ID NO: 565287 - DNA, 25 bp, Mus musculus
gctcaccctggcgatttacgggagg

SEQ ID NO: 565288 - DNA, 25 bp, Mus musculus
gctcacccttatagcagtagcttga

SEQ ID NO: 565289 - DNA, 25 bp, Mus musculus
gctcacccttattgcagtagcttga

SEQ ID NO: 565290 - DNA, 25 bp, Mus musculus
gctcacccttttcttgcagttacag

SEQ ID NO: 565291 - DNA, 25 bp, Mus musculus
gctcacccttttgttgcagttacag

SEQ ID NO: 565292 - DNA, 25 bp, Mus musculus
gctcaccgaggtctgcttgcgcacg

SEQ ID NO: 565293 - DNA, 25 bp, Mus musculus
gctcaccgaggtgtgcttgcgcacg

SEQ ID NO: 565294 - DNA, 25 bp, Mus musculus
gctcacctatctactctgtggttaa

SEQ ID NO: 565295 - DNA, 25 bp, Mus musculus
gctcacctatcttctctgtggttaa

SEQ ID NO: 565296 - DNA, 25 bp, Mus musculus
gctcacctcagaagctaacgttgta

SEQ ID NO: 565297 - DNA, 25 bp, Mus musculus
gctcacctcagatgctaacgttgta

SEQ ID NO: 565298 - DNA, 25 bp, Mus musculus
gctcacctcatgcacgggtcatctg

SEQ ID NO: 565299 - DNA, 25 bp, Mus musculus
gctcacctcatggacgggtcatctg

SEQ ID NO: 565300 - DNA, 25 bp, Mus musculus
gctcacctctctaagcctatggaga

SEQ ID NO: 565301 - DNA, 25 bp, Mus musculus
gctcacctctcttagcctatggaga

SEQ ID NO: 565302 - DNA, 25 bp, Mus musculus
gctcacctctgacaggtcaggctta

SEQ ID NO: 565303 - DNA, 25 bp, Mus musculus
gctcacctctgagaggtcaggctta

SEQ ID NO: 565304 - DNA, 25 bp, Mus musculus
gctcacctctgcctggaagagcttg

SEQ ID NO: 565305 - DNA, 25 bp, Mus musculus
gctcacctctgcgtggaagagcttg

SEQ ID NO: 565306 - DNA, 25 bp, Mus musculus
gctcacctgcatcaaacacaaaaca

SEQ ID NO: 565307 - DNA, 25 bp, Mus musculus
gctcacctgcatgaaacacaaaaca

SEQ ID NO: 565308 - DNA, 25 bp, Mus musculus
gctcacctgttgattggtcctcagg

SEQ ID NO: 565309 - DNA, 25 bp, Mus musculus
gctcacctgttgtttggtcctcagg

SEQ ID NO: 565310 - DNA, 25 bp, Mus musculus
gctcaccttttcattctctcatata

SEQ ID NO: 565311 - DNA, 25 bp, Mus musculus
gctcaccttttctttctctcatata

SEQ ID NO: 565312 - DNA, 25 bp, Mus musculus
gctcacgagttaagaagccctcagt

SEQ ID NO: 565313 - DNA, 25 bp, Mus musculus
gctcacgagttatgaagccctcagt

SEQ ID NO: 565314 - DNA, 25 bp, Mus musculus
gctcacgatcatatacagacacata

SEQ ID NO: 565315 - DNA, 25 bp, Mus musculus
gctcacgatcatttacagacacata

SEQ ID NO: 565316 - DNA, 25 bp, Mus musculus
gctcacgattgcctgtaatttgtca

SEQ ID NO: 565317 - DNA, 25 bp, Mus musculus
gctcacgattgcgtgtaatttgtca

SEQ ID NO: 565318 - DNA, 25 bp, Mus musculus
gctcacgcactgctagaatgcttct

SEQ ID NO: 565319 - DNA, 25 bp, Mus musculus
gctcacgcactggtagaatgcttct

SEQ ID NO: 565320 - DNA, 25 bp, Mus musculus
gctcacgcagggaccgtgtgtcctt

SEQ ID NO: 565321 - DNA, 25 bp, Mus musculus
gctcacgcagggtccgtgtgtcctt

SEQ ID NO: 565322 - DNA, 25 bp, Mus musculus
gctcacgctgcgaatacagactgga

SEQ ID NO: 565323 - DNA, 25 bp, Mus musculus
gctcacgctgcgtatacagactgga

SEQ ID NO: 565324 - DNA, 25 bp, Mus musculus
gctcacggaaaaacctcagttcttt

SEQ ID NO: 565325 - DNA, 25 bp, Mus musculus
gctcacggaaaatcctcagttcttt

SEQ ID NO: 565326 - DNA, 25 bp, Mus musculus
gctcacggacctccagtacattaag

SEQ ID NO: 565327 - DNA, 25 bp, Mus musculus
gctcacggacctgcagtacattaag

SEQ ID NO: 565328 - DNA, 25 bp, Mus musculus
gctcacggcatcatgtggcagtggt

SEQ ID NO: 565329 - DNA, 25 bp, Mus musculus
gctcacggcatcttgtggcagtggt

SEQ ID NO: 565330 - DNA, 25 bp, Mus musculus
gctcacggccccaatcagggagggt

SEQ ID NO: 565331 - DNA, 25 bp, Mus musculus
gctcacggcccctatcagggagggt

SEQ ID NO: 565332 - DNA, 25 bp, Mus musculus
gctcacggcctgagacaggcagtgt

SEQ ID NO: 565333 - DNA, 25 bp, Mus musculus
gctcacggcctgtgacaggcagtgt

SEQ ID NO: 565334 - DNA, 25 bp, Mus musculus
gctcacgggactacgttggctaaag

SEQ ID NO: 565335 - DNA, 25 bp, Mus musculus
gctcacgggacttcgttggctaaag

SEQ ID NO: 565336 - DNA, 25 bp, Mus musculus
gctcacgtgactcagctacaagctg

SEQ ID NO: 565337 - DNA, 25 bp, Mus musculus
gctcacgtgactgagctacaagctg

SEQ ID NO: 565338 - DNA, 25 bp, Mus musculus
gctcacgtgcatctgtaagtcaggg

SEQ ID NO: 565339 - DNA, 25 bp, Mus musculus
gctcacgtgcatgtgtaagtcaggg

SEQ ID NO: 565340 - DNA, 25 bp, Mus musculus
gctcacgtgtttcaaagttgcccat

SEQ ID NO: 565341 - DNA, 25 bp, Mus musculus
gctcacgtgtttgaaagttgcccat

SEQ ID NO: 565342 - DNA, 25 bp, Mus musculus
gctcacgttgatcgaaccttttaaa

SEQ ID NO: 565343 - DNA, 25 bp, Mus musculus
gctcacgttgatctcaagacgaccg

SEQ ID NO: 565344 - DNA, 25 bp, Mus musculus
gctcacgttgatggaaccttttaaa

SEQ ID NO: 565345 - DNA, 25 bp, Mus musculus
gctcacgttgatgtcaagacgaccg

SEQ ID NO: 565346 - DNA, 25 bp, Mus musculus
gctcactaaacaagcatttgcttgg

SEQ ID NO: 565347 - DNA, 25 bp, Mus musculus
gctcactaaacatgcatttgcttgg

SEQ ID NO: 565348 - DNA, 25 bp, Mus musculus
gctcactaagagcttggtgttgcca

SEQ ID NO: 565349 - DNA, 25 bp, Mus musculus
gctcactaagaggttggtgttgcca

SEQ ID NO: 565350 - DNA, 25 bp, Mus musculus
gctcactagactacaggaactgatt

SEQ ID NO: 565351 - DNA, 25 bp, Mus musculus
gctcactagacttcaggaactgatt

SEQ ID NO: 565352 - DNA, 25 bp, Mus musculus
gctcactaggcacatcgctgtcaaa

SEQ ID NO: 565353 - DNA, 25 bp, Mus musculus
gctcactaggcagatcgctgtcaaa

SEQ ID NO: 565354 - DNA, 25 bp, Mus musculus
gctcactatcatatcacattgccaa

SEQ ID NO: 565355 - DNA, 25 bp, Mus musculus
gctcactatcatttcacattgccaa

SEQ ID NO: 565356 - DNA, 25 bp, Mus musculus
gctcactcaagcagtaatgtctcag

SEQ ID NO: 565357 - DNA, 25 bp, Mus musculus
gctcactcaagctgtaatgtctcag

SEQ ID NO: 565358 - DNA, 25 bp, Mus musculus
gctcactcaatgatgtaggttctgt

SEQ ID NO: 565359 - DNA, 25 bp, Mus musculus
gctcactcaatgttgtaggttctgt

SEQ ID NO: 565360 - DNA, 25 bp, Mus musculus
gctcactcagctatatctttacatg

SEQ ID NO: 565361 - DNA, 25 bp, Mus musculus
gctcactcagctttatctttacatg

SEQ ID NO: 565362 - DNA, 25 bp, Mus musculus
gctcactccctaaggatgcagtatg

SEQ ID NO: 565363 - DNA, 25 bp, Mus musculus
gctcactccctatggatgcagtatg

SEQ ID NO: 565364 - DNA, 25 bp, Mus musculus
gctcactctttcaggactggaggga

SEQ ID NO: 565365 - DNA, 25 bp, Mus musculus
gctcactctttctggactggaggga

SEQ ID NO: 565366 - DNA, 25 bp, Mus musculus
gctcactgaagtacgtccctaaagg

SEQ ID NO: 565367 - DNA, 25 bp, Mus musculus
gctcactgaagttcgtccctaaagg

SEQ ID NO: 565368 - DNA, 25 bp, Mus musculus
gctcactgatgtcttgcttgtttaa

SEQ ID NO: 565369 - DNA, 25 bp, Mus musculus
gctcactgatgtgttgcttgtttaa

SEQ ID NO: 565370 - DNA, 25 bp, Mus musculus
gctcactgcacactactgtatgaac

SEQ ID NO: 565371 - DNA, 25 bp, Mus musculus
gctcactgcacagtactgtatgaac

SEQ ID NO: 565372 - DNA, 25 bp, Mus musculus
gctcactgcaggaacgttcatttag

SEQ ID NO: 565373 - DNA, 25 bp, Mus musculus
gctcactgcaggtacgttcatttag

SEQ ID NO: 565374 - DNA, 25 bp, Mus musculus
gctcactgctaaacaatccaagctt

SEQ ID NO: 565375 - DNA, 25 bp, Mus musculus
gctcactgctaatcaatccaagctt

SEQ ID NO: 565376 - DNA, 25 bp, Mus musculus
gctcactgctgcctataacttcaag

SEQ ID NO: 565377 - DNA, 25 bp, Mus musculus
gctcactgctgcgtataacttcaag

SEQ ID NO: 565378 - DNA, 25 bp, Mus musculus
gctcactggaaaccgatggctgccc

SEQ ID NO: 565379 - DNA, 25 bp, Mus musculus
gctcactggaaagcgatggctgccc

SEQ ID NO: 565380 - DNA, 25 bp, Mus musculus
gctcactggagaagaacaactcttt

SEQ ID NO: 565381 - DNA, 25 bp, Mus musculus
gctcactggagatgaacaactcttt

SEQ ID NO: 565382 - DNA, 25 bp, Mus musculus
gctcactggaggcttcctgagagaa

SEQ ID NO: 565383 - DNA, 25 bp, Mus musculus
gctcactggagggttcctgagagaa

SEQ ID NO: 565384 - DNA, 25 bp, Mus musculus
gctcactgggtgacatgatcttctt

SEQ ID NO: 565385 - DNA, 25 bp, Mus musculus
gctcactgggtgtcatgatcttctt

SEQ ID NO: 565386 - DNA, 25 bp, Mus musculus
gctcactgtgatcagtatttttata

SEQ ID NO: 565387 - DNA, 25 bp, Mus musculus
gctcactgtgatgagtatttttata

SEQ ID NO: 565388 - DNA, 25 bp, Mus musculus
gctcactgtttcagctagattgcca

SEQ ID NO: 565389 - DNA, 25 bp, Mus musculus
gctcactgtttctgctagattgcca

SEQ ID NO: 565390 - DNA, 25 bp, Mus musculus
gctcacttaaaaccaaactccattt

SEQ ID NO: 565391 - DNA, 25 bp, Mus musculus
gctcacttaaaagcaaactccattt

SEQ ID NO: 565392 - DNA, 25 bp, Mus musculus
gctcacttaagtctcctagttcttt

SEQ ID NO: 565393 - DNA, 25 bp, Mus musculus
gctcacttaagtgtcctagttcttt

SEQ ID NO: 565394 - DNA, 25 bp, Mus musculus
gctcacttacagcaagcgtttaacg

SEQ ID NO: 565395 - DNA, 25 bp, Mus musculus
gctcacttacaggaagcgtttaacg

SEQ ID NO: 565396 - DNA, 25 bp, Mus musculus
gctcacttatagaatgcttgcccgg

SEQ ID NO: 565397 - DNA, 25 bp, Mus musculus
gctcacttatagtatgcttgcccgg

SEQ ID NO: 565398 - DNA, 25 bp, Mus musculus
gctcacttatcactgttggttttga

SEQ ID NO: 565399 - DNA, 25 bp, Mus musculus
gctcacttatcagtgttggttttga

SEQ ID NO: 565400 - DNA, 25 bp, Mus musculus
gctcacttcctgatgatcggctcgg

SEQ ID NO: 565401 - DNA, 25 bp, Mus musculus
gctcacttcctgttgatcggctcgg

SEQ ID NO: 565402 - DNA, 25 bp, Mus musculus
gctcacttccttaaattgtcttttc

SEQ ID NO: 565403 - DNA, 25 bp, Mus musculus
gctcacttcctttaattgtcttttc

SEQ ID NO: 565404 - DNA, 25 bp, Mus musculus
gctcacttcggactccatgtggaga

SEQ ID NO: 565405 - DNA, 25 bp, Mus musculus
gctcacttcggagtccatgtggaga

SEQ ID NO: 565406 - DNA, 25 bp, Mus musculus
gctcacttctctacagacaggaata

SEQ ID NO: 565407 - DNA, 25 bp, Mus musculus
gctcacttctcttcagacaggaata

SEQ ID NO: 565408 - DNA, 25 bp, Mus musculus
gctcacttctttcacactgcattta

SEQ ID NO: 565409 - DNA, 25 bp, Mus musculus
gctcacttctttgacactgcattta

SEQ ID NO: 565410 - DNA, 25 bp, Mus musculus
gctcacttgaatagtaagccttctt

SEQ ID NO: 565411 - DNA, 25 bp, Mus musculus
gctcacttgaattgtaagccttctt

SEQ ID NO: 565412 - DNA, 25 bp, Mus musculus
gctcacttgatcaagttttaaatgt

SEQ ID NO: 565413 - DNA, 25 bp, Mus musculus
gctcacttgatctagttttaaatgt

SEQ ID NO: 565414 - DNA, 25 bp, Mus musculus
gctcacttgcttattagctcatgtg

SEQ ID NO: 565415 - DNA, 25 bp, Mus musculus
gctcacttgctttttagctcatgtg

SEQ ID NO: 565416 - DNA, 25 bp, Mus musculus
gctcacttggagcttcagcagctga

SEQ ID NO: 565417 - DNA, 25 bp, Mus musculus
gctcacttggaggttcagcagctga

SEQ ID NO: 565418 - DNA, 25 bp, Mus musculus
gctcacttggcaaggttgggaaatt

SEQ ID NO: 565419 - DNA, 25 bp, Mus musculus
gctcacttggcactttttacatccg

SEQ ID NO: 565420 - DNA, 25 bp, Mus musculus
gctcacttggcagtttttacatccg

SEQ ID NO: 565421 - DNA, 25 bp, Mus musculus
gctcacttggcatggttgggaaatt

SEQ ID NO: 565422 - DNA, 25 bp, Mus musculus
gctcacttggccctttcaaaagctg

SEQ ID NO: 565423 - DNA, 25 bp, Mus musculus
gctcacttggccgtttcaaaagctg

SEQ ID NO: 565424 - DNA, 25 bp, Mus musculus
gctcactttattagcattggcaata

SEQ ID NO: 565425 - DNA, 25 bp, Mus musculus
gctcactttatttgcattggcaata

SEQ ID NO: 565426 - DNA, 25 bp, Mus musculus
gctcactttcttatcccaggactaa

SEQ ID NO: 565427 - DNA, 25 bp, Mus musculus
gctcactttcttttcccaggactaa

SEQ ID NO: 565428 - DNA, 25 bp, Mus musculus
gctcactttgtgactagagagttct

SEQ ID NO: 565429 - DNA, 25 bp, Mus musculus
gctcactttgtgtctagagagttct

SEQ ID NO: 565430 - DNA, 25 bp, Mus musculus
gctcacttttagcaagtatctcctt

SEQ ID NO: 565431 - DNA, 25 bp, Mus musculus
gctcacttttaggaagtatctcctt

SEQ ID NO: 565432 - DNA, 25 bp, Mus musculus
gctcacttttctataatctcgatgc

SEQ ID NO: 565433 - DNA, 25 bp, Mus musculus
gctcacttttctttaatctcgatgc

SEQ ID NO: 565434 - DNA, 25 bp, Mus musculus
gctcactttttgattgacttgctca

SEQ ID NO: 565435 - DNA, 25 bp, Mus musculus
gctcactttttgtttgacttgctca

SEQ ID NO: 565436 - DNA, 25 bp, Mus musculus
gctcagaaaactagtgccctaaatt

SEQ ID NO: 565437 - DNA, 25 bp, Mus musculus
gctcagaaaacttgtgccctaaatt

SEQ ID NO: 565438 - DNA, 25 bp, Mus musculus
gctcagaaaagactcgaccctagga

SEQ ID NO: 565439 - DNA, 25 bp, Mus musculus
gctcagaaaagagtcgaccctagga

SEQ ID NO: 565440 - DNA, 25 bp, Mus musculus
gctcagaaaatgagctgtgcctgta

SEQ ID NO: 565441 - DNA, 25 bp, Mus musculus
gctcagaaaatgtgctgtgcctgta

SEQ ID NO: 565442 - DNA, 25 bp, Mus musculus
gctcagaaatcacctggtagccagg

SEQ ID NO: 565443 - DNA, 25 bp, Mus musculus
gctcagaaatcagctggtagccagg

SEQ ID NO: 565444 - DNA, 25 bp, Mus musculus
gctcagaacttactacacagtgctt

SEQ ID NO: 565445 - DNA, 25 bp, Mus musculus
gctcagaacttagtacacagtgctt

SEQ ID NO: 565446 - DNA, 25 bp, Mus musculus
gctcagaagacaaatggcatcacag

SEQ ID NO: 565447 - DNA, 25 bp, Mus musculus
gctcagaagacatatggcatcacag

SEQ ID NO: 565448 - DNA, 25 bp, Mus musculus
gctcagaagcccagggtgtcacgca

SEQ ID NO: 565449 - DNA, 25 bp, Mus musculus
gctcagaagccctgggtgtcacgca

SEQ ID NO: 565450 - DNA, 25 bp, Mus musculus
gctcagaagcgcacagctgccagca

SEQ ID NO: 565451 - DNA, 25 bp, Mus musculus
gctcagaagcgctcagctgccagca

SEQ ID NO: 565452 - DNA, 25 bp, Mus musculus
gctcagaaggcacagcctacagaag

SEQ ID NO: 565453 - DNA, 25 bp, Mus musculus
gctcagaaggcagagcctacagaag

SEQ ID NO: 565454 - DNA, 25 bp, Mus musculus
gctcagaagggtagcgcacggacat

SEQ ID NO: 565455 - DNA, 25 bp, Mus musculus
gctcagaagggttgcgcacggacat

SEQ ID NO: 565456 - DNA, 25 bp, Mus musculus
gctcagaagtcacgcaacattatca

SEQ ID NO: 565457 - DNA, 25 bp, Mus musculus
gctcagaagtcaggcaacattatca

SEQ ID NO: 565458 - DNA, 25 bp, Mus musculus
gctcagacacctacattaacttcta

SEQ ID NO: 565459 - DNA, 25 bp, Mus musculus
gctcagacaccttcattaacttcta

SEQ ID NO: 565460 - DNA, 25 bp, Mus musculus
gctcagacacttagctttcaggaag

SEQ ID NO: 565461 - DNA, 25 bp, Mus musculus
gctcagacacttaggcaggacagtt

SEQ ID NO: 565462 - DNA, 25 bp, Mus musculus
gctcagacactttgctttcaggaag

SEQ ID NO: 565463 - DNA, 25 bp, Mus musculus
gctcagacactttggcaggacagtt

SEQ ID NO: 565464 - DNA, 25 bp, Mus musculus
gctcagacagccaaggttcagccag

SEQ ID NO: 565465 - DNA, 25 bp, Mus musculus
gctcagacagccacagcagagtgat

SEQ ID NO: 565466 - DNA, 25 bp, Mus musculus
gctcagacagcctaggttcagccag

SEQ ID NO: 565467 - DNA, 25 bp, Mus musculus
gctcagacagcctcagcagagtgat

SEQ ID NO: 565468 - DNA, 25 bp, Mus musculus
gctcagacaggaaggctcggctcac

SEQ ID NO: 565469 - DNA, 25 bp, Mus musculus
gctcagacaggatggctcggctcac

SEQ ID NO: 565470 - DNA, 25 bp, Mus musculus
gctcagacaggcctttcatgaagag

SEQ ID NO: 565471 - DNA, 25 bp, Mus musculus
gctcagacaggcgtttcatgaagag

SEQ ID NO: 565472 - DNA, 25 bp, Mus musculus
gctcagacatcgatcttgatggaat

SEQ ID NO: 565473 - DNA, 25 bp, Mus musculus
gctcagacatcgttcttgatggaat

SEQ ID NO: 565474 - DNA, 25 bp, Mus musculus
gctcagacctttctagcatgaagct

SEQ ID NO: 565475 - DNA, 25 bp, Mus musculus
gctcagacctttgtagcatgaagct

SEQ ID NO: 565476 - DNA, 25 bp, Mus musculus
gctcagacgtctcctgtttgcttga

SEQ ID NO: 565477 - DNA, 25 bp, Mus musculus
gctcagacgtctgctgtttgcttga

SEQ ID NO: 565478 - DNA, 25 bp, Mus musculus
gctcagactcagaatttggcccttt

SEQ ID NO: 565479 - DNA, 25 bp, Mus musculus
gctcagactcagtatttggcccttt

SEQ ID NO: 565480 - DNA, 25 bp, Mus musculus
gctcagactgttaggcttggtggca

SEQ ID NO: 565481 - DNA, 25 bp, Mus musculus
gctcagactgtttggcttggtggca

SEQ ID NO: 565482 - DNA, 25 bp, Mus musculus
gctcagagcagccatcaaattatga

SEQ ID NO: 565483 - DNA, 25 bp, Mus musculus
gctcagagcagcgatcaaattatga

SEQ ID NO: 565484 - DNA, 25 bp, Mus musculus
gctcagagctgacaaagccctgggt

SEQ ID NO: 565485 - DNA, 25 bp, Mus musculus
gctcagagctgagaaagccctgggt

SEQ ID NO: 565486 - DNA, 25 bp, Mus musculus
gctcagagctgcctttactaggata

SEQ ID NO: 565487 - DNA, 25 bp, Mus musculus
gctcagagctgcgtttactaggata

SEQ ID NO: 565488 - DNA, 25 bp, Mus musculus
gctcagaggcgtcaagtttccaatt

SEQ ID NO: 565489 - DNA, 25 bp, Mus musculus
gctcagaggcgtgaagtttccaatt

SEQ ID NO: 565490 - DNA, 25 bp, Mus musculus
gctcagaggtggaaaatgccatcca

SEQ ID NO: 565491 - DNA, 25 bp, Mus musculus
gctcagaggtggtaaatgccatcca

SEQ ID NO: 565492 - DNA, 25 bp, Mus musculus
gctcagagtattatgggcatcatga

SEQ ID NO: 565493 - DNA, 25 bp, Mus musculus
gctcagagtattttgggcatcatga

SEQ ID NO: 565494 - DNA, 25 bp, Mus musculus
gctcagagttctccaacttctgcaa

SEQ ID NO: 565495 - DNA, 25 bp, Mus musculus
gctcagagttctgcaacttctgcaa

SEQ ID NO: 565496 - DNA, 25 bp, Mus musculus
gctcagataaagaccactgtgaagc

SEQ ID NO: 565497 - DNA, 25 bp, Mus musculus
gctcagataaagtccactgtgaagc

SEQ ID NO: 565498 - DNA, 25 bp, Mus musculus
gctcagataatcaagtcactttcga

SEQ ID NO: 565499 - DNA, 25 bp, Mus musculus
gctcagataatctagtcactttcga

SEQ ID NO: 565500 - DNA, 25 bp, Mus musculus
gctcagatagcaaattttcctaact

SEQ ID NO: 565501 - DNA, 25 bp, Mus musculus
gctcagatagcatattttcctaact

SEQ ID NO: 565502 - DNA, 25 bp, Mus musculus
gctcagatatatcagcctatagagg

SEQ ID NO: 565503 - DNA, 25 bp, Mus musculus
gctcagatatatgagcctatagagg

SEQ ID NO: 565504 - DNA, 25 bp, Mus musculus
gctcagatatctctgtcagctcaga

SEQ ID NO: 565505 - DNA, 25 bp, Mus musculus
gctcagatatctgtgtcagctcaga

SEQ ID NO: 565506 - DNA, 25 bp, Mus musculus
gctcagatccacacggcttacagaa

SEQ ID NO: 565507 - DNA, 25 bp, Mus musculus
gctcagatccactcggcttacagaa

SEQ ID NO: 565508 - DNA, 25 bp, Mus musculus
gctcagatccatattattcctcttc

SEQ ID NO: 565509 - DNA, 25 bp, Mus musculus
gctcagatccattttattcctcttc

SEQ ID NO: 565510 - DNA, 25 bp, Mus musculus
gctcagatgcacatacagtcttgtc

SEQ ID NO: 565511 - DNA, 25 bp, Mus musculus
gctcagatgcacttacagtcttgtc

SEQ ID NO: 565512 - DNA, 25 bp, Mus musculus
gctcagatgccaaccagagctgctt

SEQ ID NO: 565513 - DNA, 25 bp, Mus musculus
gctcagatgccatccagagctgctt

SEQ ID NO: 565514 - DNA, 25 bp, Mus musculus
gctcagatgtacagcaccattcgct

SEQ ID NO: 565515 - DNA, 25 bp, Mus musculus
gctcagatgtactgcaccattcgct

SEQ ID NO: 565516 - DNA, 25 bp, Mus musculus
gctcagatgtttataccccagaatg

SEQ ID NO: 565517 - DNA, 25 bp, Mus musculus
gctcagatgtttttaccccagaatg

SEQ ID NO: 565518 - DNA, 25 bp, Mus musculus
gctcagattcagagcatggccggct

SEQ ID NO: 565519 - DNA, 25 bp, Mus musculus
gctcagattcagtgcatggccggct

SEQ ID NO: 565520 - DNA, 25 bp, Mus musculus
gctcagcaacccataggagcctttc

SEQ ID NO: 565521 - DNA, 25 bp, Mus musculus
gctcagcaacccttaggagcctttc

SEQ ID NO: 565522 - DNA, 25 bp, Mus musculus
gctcagcaattcagtttttgggtct

SEQ ID NO: 565523 - DNA, 25 bp, Mus musculus
gctcagcaattctgtttttgggtct

SEQ ID NO: 565524 - DNA, 25 bp, Mus musculus
gctcagcacagcaatatttcccata

SEQ ID NO: 565525 - DNA, 25 bp, Mus musculus
gctcagcacagctatatttcccata

SEQ ID NO: 565526 - DNA, 25 bp, Mus musculus
gctcagcacagtcgcgtcagtgaca

SEQ ID NO: 565527 - DNA, 25 bp, Mus musculus
gctcagcacagtggcgtcagtgaca

SEQ ID NO: 565528 - DNA, 25 bp, Mus musculus
gctcagcacatgagtaattaatccc

SEQ ID NO: 565529 - DNA, 25 bp, Mus musculus
gctcagcacatgtgtaattaatccc

SEQ ID NO: 565530 - DNA, 25 bp, Mus musculus
gctcagcaccagcatttattgacct

SEQ ID NO: 565531 - DNA, 25 bp, Mus musculus
gctcagcaccaggatttattgacct

SEQ ID NO: 565532 - DNA, 25 bp, Mus musculus
gctcagcacgccacttgtgttagga

SEQ ID NO: 565533 - DNA, 25 bp, Mus musculus
gctcagcacgcctcttgtgttagga

SEQ ID NO: 565534 - DNA, 25 bp, Mus musculus
gctcagcactttatgctcacttccc

SEQ ID NO: 565535 - DNA, 25 bp, Mus musculus
gctcagcactttttgctcacttccc

SEQ ID NO: 565536 - DNA, 25 bp, Mus musculus
gctcagcagataaaacagcttgttg

SEQ ID NO: 565537 - DNA, 25 bp, Mus musculus
gctcagcagatataacagcttgttg

SEQ ID NO: 565538 - DNA, 25 bp, Mus musculus
gctcagcagcagctaacacttgatt

SEQ ID NO: 565539 - DNA, 25 bp, Mus musculus
gctcagcagcaggtaacacttgatt

SEQ ID NO: 565540 - DNA, 25 bp, Mus musculus
gctcagcagcgacaacaatacatct

SEQ ID NO: 565541 - DNA, 25 bp, Mus musculus
gctcagcagcgagaacaatacatct

SEQ ID NO: 565542 - DNA, 25 bp, Mus musculus
gctcagcagctcctgttaccaagtt

SEQ ID NO: 565543 - DNA, 25 bp, Mus musculus
gctcagcagctcgtgttaccaagtt

SEQ ID NO: 565544 - DNA, 25 bp, Mus musculus
gctcagcaggctactttgtaggtga

SEQ ID NO: 565545 - DNA, 25 bp, Mus musculus
gctcagcaggcttctttgtaggtga

SEQ ID NO: 565546 - DNA, 25 bp, Mus musculus
gctcagcataatcgtctgtaatctc

SEQ ID NO: 565547 - DNA, 25 bp, Mus musculus
gctcagcataatggtctgtaatctc

SEQ ID NO: 565548 - DNA, 25 bp, Mus musculus
gctcagccaagcacagagcagccat

SEQ ID NO: 565549 - DNA, 25 bp, Mus musculus
gctcagccaagctcagagcagccat

SEQ ID NO: 565550 - DNA, 25 bp, Mus musculus
gctcagccaaggcagtattgcagat

SEQ ID NO: 565551 - DNA, 25 bp, Mus musculus
gctcagccaagggagtattgcagat

SEQ ID NO: 565552 - DNA, 25 bp, Mus musculus
gctcagccataccttaagatggaaa

SEQ ID NO: 565553 - DNA, 25 bp, Mus musculus
gctcagccatacgttaagatggaaa

SEQ ID NO: 565554 - DNA, 25 bp, Mus musculus
gctcagccatcaccaggaactagta

SEQ ID NO: 565555 - DNA, 25 bp, Mus musculus
gctcagccatcagcaggaactagta

SEQ ID NO: 565556 - DNA, 25 bp, Mus musculus
gctcagcccataaaggcccttgatt

SEQ ID NO: 565557 - DNA, 25 bp, Mus musculus
gctcagcccatataggcccttgatt

SEQ ID NO: 565558 - DNA, 25 bp, Mus musculus
gctcagccctacagctggcagaagc

SEQ ID NO: 565559 - DNA, 25 bp, Mus musculus
gctcagccctactgctggcagaagc

SEQ ID NO: 565560 - DNA, 25 bp, Mus musculus
gctcagccctatagtacagtatatt

SEQ ID NO: 565561 - DNA, 25 bp, Mus musculus
gctcagccctattgtacagtatatt

SEQ ID NO: 565562 - DNA, 25 bp, Mus musculus
gctcagccgagcagataaccgccgg

SEQ ID NO: 565563 - DNA, 25 bp, Mus musculus
gctcagccgagctgataaccgccgg

SEQ ID NO: 565564 - DNA, 25 bp, Mus musculus
gctcagccgctgaagaaccaagaac

SEQ ID NO: 565565 - DNA, 25 bp, Mus musculus
gctcagccgctgtagaaccaagaac

SEQ ID NO: 565566 - DNA, 25 bp, Mus musculus
gctcagcctaagataatggcttttc

SEQ ID NO: 565567 - DNA, 25 bp, Mus musculus
gctcagcctaagttaatggcttttc

SEQ ID NO: 565568 - DNA, 25 bp, Mus musculus
gctcagcctatgaagttttcctctt

SEQ ID NO: 565569 - DNA, 25 bp, Mus musculus
gctcagcctatgtagttttcctctt

SEQ ID NO: 565570 - DNA, 25 bp, Mus musculus
gctcagcctgccaaatagaaatgtt

SEQ ID NO: 565571 - DNA, 25 bp, Mus musculus
gctcagcctgcctaatagaaatgtt

SEQ ID NO: 565572 - DNA, 25 bp, Mus musculus
gctcagcctgggatgtctatagggt

SEQ ID NO: 565573 - DNA, 25 bp, Mus musculus
gctcagcctgggttgtctatagggt

SEQ ID NO: 565574 - DNA, 25 bp, Mus musculus
gctcagccttgaacaatcgcatttt

SEQ ID NO: 565575 - DNA, 25 bp, Mus musculus
gctcagccttgatcaatcgcatttt

SEQ ID NO: 565576 - DNA, 25 bp, Mus musculus
gctcagcgagtaatgggtttccctt

SEQ ID NO: 565577 - DNA, 25 bp, Mus musculus
gctcagcgagtattgggtttccctt

SEQ ID NO: 565578 - DNA, 25 bp, Mus musculus
gctcagcgcatcacattggcagaag

SEQ ID NO: 565579 - DNA, 25 bp, Mus musculus
gctcagcgcatctcattggcagaag

SEQ ID NO: 565580 - DNA, 25 bp, Mus musculus
gctcagcggcatcgacttagtaaat

SEQ ID NO: 565581 - DNA, 25 bp, Mus musculus
gctcagcggcatggacttagtaaat

SEQ ID NO: 565582 - DNA, 25 bp, Mus musculus
gctcagcggttgacaggatgtgaca

SEQ ID NO: 565583 - DNA, 25 bp, Mus musculus
gctcagcggttgtcaggatgtgaca

SEQ ID NO: 565584 - DNA, 25 bp, Mus musculus
gctcagcgtgctcctgcctaagcta

SEQ ID NO: 565585 - DNA, 25 bp, Mus musculus
gctcagcgtgctgctgcctaagcta

SEQ ID NO: 565586 - DNA, 25 bp, Mus musculus
gctcagctagagacctacagtgcag

SEQ ID NO: 565587 - DNA, 25 bp, Mus musculus
gctcagctagagtcctacagtgcag

SEQ ID NO: 565588 - DNA, 25 bp, Mus musculus
gctcagctagggactacaggaaaat

SEQ ID NO: 565589 - DNA, 25 bp, Mus musculus
gctcagctagggacttgccaaaatg

SEQ ID NO: 565590 - DNA, 25 bp, Mus musculus
gctcagctagggtctacaggaaaat

SEQ ID NO: 565591 - DNA, 25 bp, Mus musculus
gctcagctagggtcttgccaaaatg

SEQ ID NO: 565592 - DNA, 25 bp, Mus musculus
gctcagctcaacaatactttgacct

SEQ ID NO: 565593 - DNA, 25 bp, Mus musculus
gctcagctcaactatactttgacct

SEQ ID NO: 565594 - DNA, 25 bp, Mus musculus
gctcagctcaagaccctgagtgaca

SEQ ID NO: 565595 - DNA, 25 bp, Mus musculus
gctcagctcaagtccctgagtgaca

SEQ ID NO: 565596 - DNA, 25 bp, Mus musculus
gctcagctcagcagtagaatagtag

SEQ ID NO: 565597 - DNA, 25 bp, Mus musculus
gctcagctcagctgtagaatagtag

SEQ ID NO: 565598 - DNA, 25 bp, Mus musculus
gctcagctcaggatctaactagtct

SEQ ID NO: 565599 - DNA, 25 bp, Mus musculus
gctcagctcaggttctaactagtct

SEQ ID NO: 565600 - DNA, 25 bp, Mus musculus
gctcagctccccaaaactattgatt

SEQ ID NO: 565601 - DNA, 25 bp, Mus musculus
gctcagctcccctaaactattgatt

SEQ ID NO: 565602 - DNA, 25 bp, Mus musculus
gctcagctccggattattgttgttc

SEQ ID NO: 565603 - DNA, 25 bp, Mus musculus
gctcagctccggtttattgttgttc

SEQ ID NO: 565604 - DNA, 25 bp, Mus musculus
gctcagctcctcatggcttgatagc

SEQ ID NO: 565605 - DNA, 25 bp, Mus musculus
gctcagctcctcttggcttgatagc

SEQ ID NO: 565606 - DNA, 25 bp, Mus musculus
gctcagctctgacttgtctggctca

SEQ ID NO: 565607 - DNA, 25 bp, Mus musculus
gctcagctctgagttgtctggctca

SEQ ID NO: 565608 - DNA, 25 bp, Mus musculus
gctcagctcttaacagtgcaatatt

SEQ ID NO: 565609 - DNA, 25 bp, Mus musculus
gctcagctcttatcagtgcaatatt

SEQ ID NO: 565610 - DNA, 25 bp, Mus musculus
gctcagctgaacattaggttgccat

SEQ ID NO: 565611 - DNA, 25 bp, Mus musculus
gctcagctgaactttaggttgccat

SEQ ID NO: 565612 - DNA, 25 bp, Mus musculus
gctcagctgaatatcctcatggcat

SEQ ID NO: 565613 - DNA, 25 bp, Mus musculus
gctcagctgaatttcctcatggcat

SEQ ID NO: 565614 - DNA, 25 bp, Mus musculus
gctcagctgagaaccttatggcacc

SEQ ID NO: 565615 - DNA, 25 bp, Mus musculus
gctcagctgagaagttcattttcta

SEQ ID NO: 565616 - DNA, 25 bp, Mus musculus
gctcagctgagatccttatggcacc

SEQ ID NO: 565617 - DNA, 25 bp, Mus musculus
gctcagctgagatgttcattttcta

SEQ ID NO: 565618 - DNA, 25 bp, Mus musculus
gctcagctgggtaggatattttaga

SEQ ID NO: 565619 - DNA, 25 bp, Mus musculus
gctcagctgggtaggtgaattaact

SEQ ID NO: 565620 - DNA, 25 bp, Mus musculus
gctcagctgggttggatattttaga

SEQ ID NO: 565621 - DNA, 25 bp, Mus musculus
gctcagctgggttggtgaattaact

SEQ ID NO: 565622 - DNA, 25 bp, Mus musculus
gctcagctggttctacctgacatca

SEQ ID NO: 565623 - DNA, 25 bp, Mus musculus
gctcagctggttgtacctgacatca

SEQ ID NO: 565624 - DNA, 25 bp, Mus musculus
gctcagcttcgtcggcaagcgcaga

SEQ ID NO: 565625 - DNA, 25 bp, Mus musculus
gctcagcttcgtgggcaagcgcaga

SEQ ID NO: 565626 - DNA, 25 bp, Mus musculus
gctcagctttcccaggtccacagtt

SEQ ID NO: 565627 - DNA, 25 bp, Mus musculus
gctcagctttccgaggtccacagtt

SEQ ID NO: 565628 - DNA, 25 bp, Mus musculus
gctcagcttttaacatctgcatcat

SEQ ID NO: 565629 - DNA, 25 bp, Mus musculus
gctcagcttttatcatctgcatcat

SEQ ID NO: 565630 - DNA, 25 bp, Mus musculus
gctcagctttttccagcactgattg

SEQ ID NO: 565631 - DNA, 25 bp, Mus musculus
gctcagctttttgcagcactgattg

SEQ ID NO: 565632 - DNA, 25 bp, Mus musculus
gctcaggaaagccacgttacgacag

SEQ ID NO: 565633 - DNA, 25 bp, Mus musculus
gctcaggaaagcgacgttacgacag

SEQ ID NO: 565634 - DNA, 25 bp, Mus musculus
gctcaggaacataactcttgtatat

SEQ ID NO: 565635 - DNA, 25 bp, Mus musculus
gctcaggaacattactcttgtatat

SEQ ID NO: 565636 - DNA, 25 bp, Mus musculus
gctcaggaagagacccagtgtccta

SEQ ID NO: 565637 - DNA, 25 bp, Mus musculus
gctcaggaagagtcccagtgtccta

SEQ ID NO: 565638 - DNA, 25 bp, Mus musculus
gctcaggacagaagggctctttcat

SEQ ID NO: 565639 - DNA, 25 bp, Mus musculus
gctcaggacagatgggctctttcat

SEQ ID NO: 565640 - DNA, 25 bp, Mus musculus
gctcaggaggctatgtggccatgct

SEQ ID NO: 565641 - DNA, 25 bp, Mus musculus
gctcaggaggctttgtggccatgct

SEQ ID NO: 565642 - DNA, 25 bp, Mus musculus
gctcaggagtggatcgctttcctaa

SEQ ID NO: 565643 - DNA, 25 bp, Mus musculus
gctcaggagtggttcgctttcctaa

SEQ ID NO: 565644 - DNA, 25 bp, Mus musculus
gctcaggatcgcacttgaaatactt

SEQ ID NO: 565645 - DNA, 25 bp, Mus musculus
gctcaggatcgctcttgaaatactt

SEQ ID NO: 565646 - DNA, 25 bp, Mus musculus
gctcaggatcgtcaacacctatggg

SEQ ID NO: 565647 - DNA, 25 bp, Mus musculus
gctcaggatcgtgaacacctatggg

SEQ ID NO: 565648 - DNA, 25 bp, Mus musculus
gctcaggcaatcatatacttatgct

SEQ ID NO: 565649 - DNA, 25 bp, Mus musculus
gctcaggcaatcttatacttatgct

SEQ ID NO: 565650 - DNA, 25 bp, Mus musculus
gctcaggcagctctgactttataaa

SEQ ID NO: 565651 - DNA, 25 bp, Mus musculus
gctcaggcagctgtgactttataaa

SEQ ID NO: 565652 - DNA, 25 bp, Mus musculus
gctcaggcatctaaacgcttggtcc

SEQ ID NO: 565653 - DNA, 25 bp, Mus musculus
gctcaggcatcttaacgcttggtcc

SEQ ID NO: 565654 - DNA, 25 bp, Mus musculus
gctcaggccactatcgatgtgataa

SEQ ID NO: 565655 - DNA, 25 bp, Mus musculus
gctcaggccactttcgatgtgataa

SEQ ID NO: 565656 - DNA, 25 bp, Mus musculus
gctcaggcccgccggggagtgtcta

SEQ ID NO: 565657 - DNA, 25 bp, Mus musculus
gctcaggcccgcgggggagtgtcta

SEQ ID NO: 565658 - DNA, 25 bp, Mus musculus
gctcaggccttcagcataaaagtat

SEQ ID NO: 565659 - DNA, 25 bp, Mus musculus
gctcaggccttctgcataaaagtat

SEQ ID NO: 565660 - DNA, 25 bp, Mus musculus
gctcaggctgcacgcgctgactctg

SEQ ID NO: 565661 - DNA, 25 bp, Mus musculus
gctcaggctgcaggcgctgactctg

SEQ ID NO: 565662 - DNA, 25 bp, Mus musculus
gctcaggctgctctgctacaggcag

SEQ ID NO: 565663 - DNA, 25 bp, Mus musculus
gctcaggctgctgtgctacaggcag

SEQ ID NO: 565664 - DNA, 25 bp, Mus musculus
gctcaggctggtcagaacttttata

SEQ ID NO: 565665 - DNA, 25 bp, Mus musculus
gctcaggctggtgagaacttttata

SEQ ID NO: 565666 - DNA, 25 bp, Mus musculus
gctcaggctgtcctcaaacttggaa

SEQ ID NO: 565667 - DNA, 25 bp, Mus musculus
gctcaggctgtcgtcaaacttggaa

SEQ ID NO: 565668 - DNA, 25 bp, Mus musculus
gctcaggcttgtcggctcagaaaac

SEQ ID NO: 565669 - DNA, 25 bp, Mus musculus
gctcaggcttgtgggctcagaaaac

SEQ ID NO: 565670 - DNA, 25 bp, Mus musculus
gctcaggcttttcggtactcattaa

SEQ ID NO: 565671 - DNA, 25 bp, Mus musculus
gctcaggcttttgggtactcattaa

SEQ ID NO: 565672 - DNA, 25 bp, Mus musculus
gctcagggacacctgttgggattcc

SEQ ID NO: 565673 - DNA, 25 bp, Mus musculus
gctcagggacacgtgttgggattcc

SEQ ID NO: 565674 - DNA, 25 bp, Mus musculus
gctcagggacccactggaagcagtg

SEQ ID NO: 565675 - DNA, 25 bp, Mus musculus
gctcagggaccctctggaagcagtg

SEQ ID NO: 565676 - DNA, 25 bp, Mus musculus
gctcagggacctccattagtagcat

SEQ ID NO: 565677 - DNA, 25 bp, Mus musculus
gctcagggacctgcattagtagcat

SEQ ID NO: 565678 - DNA, 25 bp, Mus musculus
gctcagggagaacactgccagccaa

SEQ ID NO: 565679 - DNA, 25 bp, Mus musculus
gctcagggagaagactgccagccaa

SEQ ID NO: 565680 - DNA, 25 bp, Mus musculus
gctcagggatttatggtggatcatt

SEQ ID NO: 565681 - DNA, 25 bp, Mus musculus
gctcagggatttttggtggatcatt

SEQ ID NO: 565682 - DNA, 25 bp, Mus musculus
gctcagggcagtaccaacatgctaa

SEQ ID NO: 565683 - DNA, 25 bp, Mus musculus
gctcagggcagttccaacatgctaa

SEQ ID NO: 565684 - DNA, 25 bp, Mus musculus
gctcagggccatccttatctaggaa

SEQ ID NO: 565685 - DNA, 25 bp, Mus musculus
gctcagggccatgcttatctaggaa

SEQ ID NO: 565686 - DNA, 25 bp, Mus musculus
gctcagggctgcattttagactatt

SEQ ID NO: 565687 - DNA, 25 bp, Mus musculus
gctcagggctgctttttagactatt

SEQ ID NO: 565688 - DNA, 25 bp, Mus musculus
gctcagggtcacacttttcaggaag

SEQ ID NO: 565689 - DNA, 25 bp, Mus musculus
gctcagggtcactcttttcaggaag

SEQ ID NO: 565690 - DNA, 25 bp, Mus musculus
gctcagggtgtaaaggtgcctgcac

SEQ ID NO: 565691 - DNA, 25 bp, Mus musculus
gctcagggtgtataggtgcctgcac

SEQ ID NO: 565692 - DNA, 25 bp, Mus musculus
gctcaggtgtttcgcaaccagctca

SEQ ID NO: 565693 - DNA, 25 bp, Mus musculus
gctcaggtgtttggcaaccagctca

SEQ ID NO: 565694 - DNA, 25 bp, Mus musculus
gctcaggttattcagtttcaggctg

SEQ ID NO: 565695 - DNA, 25 bp, Mus musculus
gctcaggttattgagtttcaggctg

SEQ ID NO: 565696 - DNA, 25 bp, Mus musculus
gctcaggttgctcggatacagactc

SEQ ID NO: 565697 - DNA, 25 bp, Mus musculus
gctcaggttgctgggatacagactc

SEQ ID NO: 565698 - DNA, 25 bp, Mus musculus
gctcagtaaaacaccattccatggg

SEQ ID NO: 565699 - DNA, 25 bp, Mus musculus
gctcagtaaaactccattccatggg

SEQ ID NO: 565700 - DNA, 25 bp, Mus musculus
gctcagtaacagcaccttgctaatt

SEQ ID NO: 565701 - DNA, 25 bp, Mus musculus
gctcagtaacaggaccttgctaatt

SEQ ID NO: 565702 - DNA, 25 bp, Mus musculus
gctcagtaatacagtcaagcaggag

SEQ ID NO: 565703 - DNA, 25 bp, Mus musculus
gctcagtaatactgtcaagcaggag

SEQ ID NO: 565704 - DNA, 25 bp, Mus musculus
gctcagtacatccagtggtgagtcg

SEQ ID NO: 565705 - DNA, 25 bp, Mus musculus
gctcagtacatcgagtggtgagtcg

SEQ ID NO: 565706 - DNA, 25 bp, Mus musculus
gctcagtaccgaagtttcctaagtt

SEQ ID NO: 565707 - DNA, 25 bp, Mus musculus
gctcagtaccgatgtttcctaagtt

SEQ ID NO: 565708 - DNA, 25 bp, Mus musculus
gctcagtagcacaaggatcaggttt

SEQ ID NO: 565709 - DNA, 25 bp, Mus musculus
gctcagtagcactaggatcaggttt

SEQ ID NO: 565710 - DNA, 25 bp, Mus musculus
gctcagtaggcaaaaagcacctgct

SEQ ID NO: 565711 - DNA, 25 bp, Mus musculus
gctcagtaggcataaagcacctgct

SEQ ID NO: 565712 - DNA, 25 bp, Mus musculus
gctcagtatctgcaacccacggaag

SEQ ID NO: 565713 - DNA, 25 bp, Mus musculus
gctcagtatctggaacccacggaag

SEQ ID NO: 565714 - DNA, 25 bp, Mus musculus
gctcagtattctactttgtccatat

SEQ ID NO: 565715 - DNA, 25 bp, Mus musculus
gctcagtattcttctttgtccatat

SEQ ID NO: 565716 - DNA, 25 bp, Mus musculus
gctcagtattgaaaaatgtttccca

SEQ ID NO: 565717 - DNA, 25 bp, Mus musculus
gctcagtattgataaatgtttccca

SEQ ID NO: 565718 - DNA, 25 bp, Mus musculus
gctcagtattgcatattgaccatct

SEQ ID NO: 565719 - DNA, 25 bp, Mus musculus
gctcagtattgcttattgaccatct

SEQ ID NO: 565720 - DNA, 25 bp, Mus musculus
gctcagtattggcacactgtcaaga

SEQ ID NO: 565721 - DNA, 25 bp, Mus musculus
gctcagtattgggacactgtcaaga

SEQ ID NO: 565722 - DNA, 25 bp, Mus musculus
gctcagtcaactccattcaagatag

SEQ ID NO: 565723 - DNA, 25 bp, Mus musculus
gctcagtcaactgcattcaagatag

SEQ ID NO: 565724 - DNA, 25 bp, Mus musculus
gctcagtcactgatgcttgcatacg

SEQ ID NO: 565725 - DNA, 25 bp, Mus musculus
gctcagtcactgttgcttgcatacg

SEQ ID NO: 565726 - DNA, 25 bp, Mus musculus
gctcagtcagaaaagggcttgccat

SEQ ID NO: 565727 - DNA, 25 bp, Mus musculus
gctcagtcagaatagggcttgccat

SEQ ID NO: 565728 - DNA, 25 bp, Mus musculus
gctcagtcagagaaggccttgcttt

SEQ ID NO: 565729 - DNA, 25 bp, Mus musculus
gctcagtcagagtaggccttgcttt

SEQ ID NO: 565730 - DNA, 25 bp, Mus musculus
gctcagtcagatagtgtttgcccag

SEQ ID NO: 565731 - DNA, 25 bp, Mus musculus
gctcagtcagattgtgtttgcccag

SEQ ID NO: 565732 - DNA, 25 bp, Mus musculus
gctcagtcagcgctagattctacgt

SEQ ID NO: 565733 - DNA, 25 bp, Mus musculus
gctcagtcagcggtagattctacgt

SEQ ID NO: 565734 - DNA, 25 bp, Mus musculus
gctcagtcaggtcagctaacttgtg

SEQ ID NO: 565735 - DNA, 25 bp, Mus musculus
gctcagtcaggtgagctaacttgtg

SEQ ID NO: 565736 - DNA, 25 bp, Mus musculus
gctcagtcattaaactttatatttt

SEQ ID NO: 565737 - DNA, 25 bp, Mus musculus
gctcagtcattatactttatatttt

SEQ ID NO: 565738 - DNA, 25 bp, Mus musculus
gctcagtccactctgttgatggcta

SEQ ID NO: 565739 - DNA, 25 bp, Mus musculus
gctcagtccactgtgttgatggcta

SEQ ID NO: 565740 - DNA, 25 bp, Mus musculus
gctcagtccgttattcttgttctat

SEQ ID NO: 565741 - DNA, 25 bp, Mus musculus
gctcagtccgtttttcttgttctat

SEQ ID NO: 565742 - DNA, 25 bp, Mus musculus
gctcagtctagaattacagcatcat

SEQ ID NO: 565743 - DNA, 25 bp, Mus musculus
gctcagtctagatttacagcatcat

SEQ ID NO: 565744 - DNA, 25 bp, Mus musculus
gctcagtctctacgtccagaaacag

SEQ ID NO: 565745 - DNA, 25 bp, Mus musculus
gctcagtctctaggtccagaaacag

SEQ ID NO: 565746 - DNA, 25 bp, Mus musculus
gctcagtctctgaaagtcctcagtt

SEQ ID NO: 565747 - DNA, 25 bp, Mus musculus
gctcagtctctgacactgagaacca

SEQ ID NO: 565748 - DNA, 25 bp, Mus musculus
gctcagtctctgtaagtcctcagtt

SEQ ID NO: 565749 - DNA, 25 bp, Mus musculus
gctcagtctctgtcactgagaacca

SEQ ID NO: 565750 - DNA, 25 bp, Mus musculus
gctcagtctgtgattttcacgagat

SEQ ID NO: 565751 - DNA, 25 bp, Mus musculus
gctcagtctgtgtttttcacgagat

SEQ ID NO: 565752 - DNA, 25 bp, Mus musculus
gctcagtcttgcaagcagcaatcat

SEQ ID NO: 565753 - DNA, 25 bp, Mus musculus
gctcagtcttgctagcagcaatcat

SEQ ID NO: 565754 - DNA, 25 bp, Mus musculus
gctcagtgacctagacagtaagaga

SEQ ID NO: 565755 - DNA, 25 bp, Mus musculus
gctcagtgaccttgacagtaagaga

SEQ ID NO: 565756 - DNA, 25 bp, Mus musculus
gctcagtgagtcagggtgcttgtca

SEQ ID NO: 565757 - DNA, 25 bp, Mus musculus
gctcagtgagtctgggtgcttgtca

SEQ ID NO: 565758 - DNA, 25 bp, Mus musculus
gctcagtgcatcacagtatttctca

SEQ ID NO: 565759 - DNA, 25 bp, Mus musculus
gctcagtgcatctcagtatttctca

SEQ ID NO: 565760 - DNA, 25 bp, Mus musculus
gctcagtgctctcgatagtcagaca

SEQ ID NO: 565761 - DNA, 25 bp, Mus musculus
gctcagtgctctggatagtcagaca

SEQ ID NO: 565762 - DNA, 25 bp, Mus musculus
gctcagtgctggatactttttgctt

SEQ ID NO: 565763 - DNA, 25 bp, Mus musculus
gctcagtgctggttactttttgctt

SEQ ID NO: 565764 - DNA, 25 bp, Mus musculus
gctcagtgctttcacctatgactat

SEQ ID NO: 565765 - DNA, 25 bp, Mus musculus
gctcagtgctttgacctatgactat

SEQ ID NO: 565766 - DNA, 25 bp, Mus musculus
gctcagtggctcaaagcacagttat

SEQ ID NO: 565767 - DNA, 25 bp, Mus musculus
gctcagtggctctaagcacagttat

SEQ ID NO: 565768 - DNA, 25 bp, Mus musculus
gctcagtggtagagcgcttgcctag

SEQ ID NO: 565769 - DNA, 25 bp, Mus musculus
gctcagtggtagtgcgcttgcctag

SEQ ID NO: 565770 - DNA, 25 bp, Mus musculus
gctcagtggtatagaatggttgcct

SEQ ID NO: 565771 - DNA, 25 bp, Mus musculus
gctcagtggtattgaatggttgcct

SEQ ID NO: 565772 - DNA, 25 bp, Mus musculus
gctcagtggttaattcccaaccagc

SEQ ID NO: 565773 - DNA, 25 bp, Mus musculus
gctcagtggttatttcccaaccagc

SEQ ID NO: 565774 - DNA, 25 bp, Mus musculus
gctcagtgtactctcttatagaacc

SEQ ID NO: 565775 - DNA, 25 bp, Mus musculus
gctcagtgtactgtcttatagaacc

SEQ ID NO: 565776 - DNA, 25 bp, Mus musculus
gctcagtgtcccagctagaattgaa

SEQ ID NO: 565777 - DNA, 25 bp, Mus musculus
gctcagtgtccctgctagaattgaa

SEQ ID NO: 565778 - DNA, 25 bp, Mus musculus
gctcagtgtgtgatgccaagcttga

SEQ ID NO: 565779 - DNA, 25 bp, Mus musculus
gctcagtgtgtgctggatcctttct

SEQ ID NO: 565780 - DNA, 25 bp, Mus musculus
gctcagtgtgtggtggatcctttct

SEQ ID NO: 565781 - DNA, 25 bp, Mus musculus
gctcagtgtgtgttgccaagcttga

SEQ ID NO: 565782 - DNA, 25 bp, Mus musculus
gctcagtgttgacttcgtgttcctc

SEQ ID NO: 565783 - DNA, 25 bp, Mus musculus
gctcagtgttgagttcgtgttcctc

SEQ ID NO: 565784 - DNA, 25 bp, Mus musculus
gctcagttactgaggtgctaaacat

SEQ ID NO: 565785 - DNA, 25 bp, Mus musculus
gctcagttactgtggtgctaaacat

SEQ ID NO: 565786 - DNA, 25 bp, Mus musculus
gctcagttcctcaagacgtggcgaa

SEQ ID NO: 565787 - DNA, 25 bp, Mus musculus
gctcagttcctctagacgtggcgaa

SEQ ID NO: 565788 - DNA, 25 bp, Mus musculus
gctcagttctcaagtttgtgttttt

SEQ ID NO: 565789 - DNA, 25 bp, Mus musculus
gctcagttctcatgtttgtgttttt

SEQ ID NO: 565790 - DNA, 25 bp, Mus musculus
gctcagttcttgagacacctcggaa

SEQ ID NO: 565791 - DNA, 25 bp, Mus musculus
gctcagttcttgtgacacctcggaa

SEQ ID NO: 565792 - DNA, 25 bp, Mus musculus
gctcagttgattctgttctactgca

SEQ ID NO: 565793 - DNA, 25 bp, Mus musculus
gctcagttgattgtgttctactgca

SEQ ID NO: 565794 - DNA, 25 bp, Mus musculus
gctcagttgcctctgtgtcaaaata

SEQ ID NO: 565795 - DNA, 25 bp, Mus musculus
gctcagttgcctgtgtgtcaaaata

SEQ ID NO: 565796 - DNA, 25 bp, Mus musculus
gctcagttgtttcaggcaagcccaa

SEQ ID NO: 565797 - DNA, 25 bp, Mus musculus
gctcagttgtttgaggcaagcccaa

SEQ ID NO: 565798 - DNA, 25 bp, Mus musculus
gctcagtttacactggcatctttta

SEQ ID NO: 565799 - DNA, 25 bp, Mus musculus
gctcagtttacagtggcatctttta

SEQ ID NO: 565800 - DNA, 25 bp, Mus musculus
gctcagtttgatccatcccattatg

SEQ ID NO: 565801 - DNA, 25 bp, Mus musculus
gctcagtttgatgcatcccattatg

SEQ ID NO: 565802 - DNA, 25 bp, Mus musculus
gctcagttttccatcaacgtcattt

SEQ ID NO: 565803 - DNA, 25 bp, Mus musculus
gctcagttttccttcaacgtcattt

SEQ ID NO: 565804 - DNA, 25 bp, Mus musculus
gctcataaaggcattatcactccaa

SEQ ID NO: 565805 - DNA, 25 bp, Mus musculus
gctcataaaggctttatcactccaa

SEQ ID NO: 565806 - DNA, 25 bp, Mus musculus
gctcataactccctgagagcggtta

SEQ ID NO: 565807 - DNA, 25 bp, Mus musculus
gctcataactccgtgagagcggtta

SEQ ID NO: 565808 - DNA, 25 bp, Mus musculus
gctcataagaggaattccaactcgg

SEQ ID NO: 565809 - DNA, 25 bp, Mus musculus
gctcataagaggtattccaactcgg

SEQ ID NO: 565810 - DNA, 25 bp, Mus musculus
gctcatacaaatcaggccaagcggg

SEQ ID NO: 565811 - DNA, 25 bp, Mus musculus
gctcatacaaatgaggccaagcggg

SEQ ID NO: 565812 - DNA, 25 bp, Mus musculus
gctcatacagctcacttcatacaaa

SEQ ID NO: 565813 - DNA, 25 bp, Mus musculus
gctcatacagctgacttcatacaaa

SEQ ID NO: 565814 - DNA, 25 bp, Mus musculus
gctcatacatgcattaatcgccttg

SEQ ID NO: 565815 - DNA, 25 bp, Mus musculus
gctcatacatgctttaatcgccttg

SEQ ID NO: 565816 - DNA, 25 bp, Mus musculus
gctcatacccagagatagacttttt

SEQ ID NO: 565817 - DNA, 25 bp, Mus musculus
gctcatacccagtgatagacttttt

SEQ ID NO: 565818 - DNA, 25 bp, Mus musculus
gctcataccctcagaagagcacctg

SEQ ID NO: 565819 - DNA, 25 bp, Mus musculus
gctcataccctctgaagagcacctg

SEQ ID NO: 565820 - DNA, 25 bp, Mus musculus
gctcatacctacacattcatcaaag

SEQ ID NO: 565821 - DNA, 25 bp, Mus musculus
gctcatacctactcattcatcaaag

SEQ ID NO: 565822 - DNA, 25 bp, Mus musculus
gctcatactatacctgcatatccag

SEQ ID NO: 565823 - DNA, 25 bp, Mus musculus
gctcatactatagctgcatatccag

SEQ ID NO: 565824 - DNA, 25 bp, Mus musculus
gctcatagagctactggagttatct

SEQ ID NO: 565825 - DNA, 25 bp, Mus musculus
gctcatagagcttctggagttatct

SEQ ID NO: 565826 - DNA, 25 bp, Mus musculus
gctcatagcagtcctggaggccatc

SEQ ID NO: 565827 - DNA, 25 bp, Mus musculus
gctcatagcagtgctggaggccatc

SEQ ID NO: 565828 - DNA, 25 bp, Mus musculus
gctcataggttcaatttctgtagag

SEQ ID NO: 565829 - DNA, 25 bp, Mus musculus
gctcataggttctatttctgtagag

SEQ ID NO: 565830 - DNA, 25 bp, Mus musculus
gctcatagtattagtttctctcttg

SEQ ID NO: 565831 - DNA, 25 bp, Mus musculus
gctcatagtatttgtttctctcttg

SEQ ID NO: 565832 - DNA, 25 bp, Mus musculus
gctcatatacctaagttggctccca

SEQ ID NO: 565833 - DNA, 25 bp, Mus musculus
gctcatataccttagttggctccca

SEQ ID NO: 565834 - DNA, 25 bp, Mus musculus
gctcatatggttctgtgccaagcac

SEQ ID NO: 565835 - DNA, 25 bp, Mus musculus
gctcatatggttgtgtgccaagcac

SEQ ID NO: 565836 - DNA, 25 bp, Mus musculus
gctcatatgtcaatcttgtttgttt

SEQ ID NO: 565837 - DNA, 25 bp, Mus musculus
gctcatatgtcattcttgtttgttt

SEQ ID NO: 565838 - DNA, 25 bp, Mus musculus
gctcatattatcagaagggaacgtt

SEQ ID NO: 565839 - DNA, 25 bp, Mus musculus
gctcatattatctgaagggaacgtt

SEQ ID NO: 565840 - DNA, 25 bp, Mus musculus
gctcatattgagcatattgtgaagg

SEQ ID NO: 565841 - DNA, 25 bp, Mus musculus
gctcatattgaggatattgtgaagg

SEQ ID NO: 565842 - DNA, 25 bp, Mus musculus
gctcatcaaattatgccttaagtac

SEQ ID NO: 565843 - DNA, 25 bp, Mus musculus
gctcatcaaattttgccttaagtac

SEQ ID NO: 565844 - DNA, 25 bp, Mus musculus
gctcatcaatatattactgtgcaca

SEQ ID NO: 565845 - DNA, 25 bp, Mus musculus
gctcatcaatattttactgtgcaca

SEQ ID NO: 565846 - DNA, 25 bp, Mus musculus
gctcatcacactagctggaccttaa

SEQ ID NO: 565847 - DNA, 25 bp, Mus musculus
gctcatcacacttgctggaccttaa

SEQ ID NO: 565848 - DNA, 25 bp, Mus musculus
gctcatcagagactggcggataagc

SEQ ID NO: 565849 - DNA, 25 bp, Mus musculus
gctcatcagagagtggcggataagc

SEQ ID NO: 565850 - DNA, 25 bp, Mus musculus
gctcatcagtatctcttcctgttat

SEQ ID NO: 565851 - DNA, 25 bp, Mus musculus
gctcatcagtatgtcttcctgttat

SEQ ID NO: 565852 - DNA, 25 bp, Mus musculus
gctcatcatctgcagaccgtggaca

SEQ ID NO: 565853 - DNA, 25 bp, Mus musculus
gctcatcatctggagaccgtggaca

SEQ ID NO: 565854 - DNA, 25 bp, Mus musculus
gctcatcatcttaagctattcggga

SEQ ID NO: 565855 - DNA, 25 bp, Mus musculus
gctcatcatcttaggaagcccaatg

SEQ ID NO: 565856 - DNA, 25 bp, Mus musculus
gctcatcatctttagctattcggga

SEQ ID NO: 565857 - DNA, 25 bp, Mus musculus
gctcatcatctttggaagcccaatg

SEQ ID NO: 565858 - DNA, 25 bp, Mus musculus
gctcatcatgtcctgggaggtacaa

SEQ ID NO: 565859 - DNA, 25 bp, Mus musculus
gctcatcatgtcgtgggaggtacaa

SEQ ID NO: 565860 - DNA, 25 bp, Mus musculus
gctcatcattgaattgatcctcagt

SEQ ID NO: 565861 - DNA, 25 bp, Mus musculus
gctcatcattgatttgatcctcagt

SEQ ID NO: 565862 - DNA, 25 bp, Mus musculus
gctcatccacacagcgcaacagaat

SEQ ID NO: 565863 - DNA, 25 bp, Mus musculus
gctcatccacactgcgcaacagaat

SEQ ID NO: 565864 - DNA, 25 bp, Mus musculus
gctcatcccccaagatccagagaga

SEQ ID NO: 565865 - DNA, 25 bp, Mus musculus
gctcatcccccatgatccagagaga

SEQ ID NO: 565866 - DNA, 25 bp, Mus musculus
gctcatccctcactgggagctgaaa

SEQ ID NO: 565867 - DNA, 25 bp, Mus musculus
gctcatccctcagtgggagctgaaa

SEQ ID NO: 565868 - DNA, 25 bp, Mus musculus
gctcatccgtacatgaaagacctga

SEQ ID NO: 565869 - DNA, 25 bp, Mus musculus
gctcatccgtacttgaaagacctga

SEQ ID NO: 565870 - DNA, 25 bp, Mus musculus
gctcatcctatgaacagaacggcac

SEQ ID NO: 565871 - DNA, 25 bp, Mus musculus
gctcatcctatgtacagaacggcac

SEQ ID NO: 565872 - DNA, 25 bp, Mus musculus
gctcatcctgtgagttaggttattt

SEQ ID NO: 565873 - DNA, 25 bp, Mus musculus
gctcatcctgtgtgttaggttattt

SEQ ID NO: 565874 - DNA, 25 bp, Mus musculus
gctcatccttgccacaaagaacttt

SEQ ID NO: 565875 - DNA, 25 bp, Mus musculus
gctcatccttgcgacaaagaacttt

SEQ ID NO: 565876 - DNA, 25 bp, Mus musculus
gctcatcgagcacgtctgttaccaa

SEQ ID NO: 565877 - DNA, 25 bp, Mus musculus
gctcatcgagcaggtctgttaccaa

SEQ ID NO: 565878 - DNA, 25 bp, Mus musculus
gctcatcgatgcagctttcacaaat

SEQ ID NO: 565879 - DNA, 25 bp, Mus musculus
gctcatcgatgctgctttcacaaat

SEQ ID NO: 565880 - DNA, 25 bp, Mus musculus
gctcatcgatttccttaagctgaaa

SEQ ID NO: 565881 - DNA, 25 bp, Mus musculus
gctcatcgatttgcttaagctgaaa

SEQ ID NO: 565882 - DNA, 25 bp, Mus musculus
gctcatcgtattaggagggctcatg

SEQ ID NO: 565883 - DNA, 25 bp, Mus musculus
gctcatcgtatttggagggctcatg

SEQ ID NO: 565884 - DNA, 25 bp, Mus musculus
gctcatcgtggacattattctgtgt

SEQ ID NO: 565885 - DNA, 25 bp, Mus musculus
gctcatcgtggagattattctgtgt

SEQ ID NO: 565886 - DNA, 25 bp, Mus musculus
gctcatctacagaggcaagcaaatg

SEQ ID NO: 565887 - DNA, 25 bp, Mus musculus
gctcatctacagtggcaagcaaatg

SEQ ID NO: 565888 - DNA, 25 bp, Mus musculus
gctcatctcaccaagttcaggaaag

SEQ ID NO: 565889 - DNA, 25 bp, Mus musculus
gctcatctcacctagttcaggaaag

SEQ ID NO: 565890 - DNA, 25 bp, Mus musculus
gctcatctcagcagacttcaggaat

SEQ ID NO: 565891 - DNA, 25 bp, Mus musculus
gctcatctcagctgacttcaggaat

SEQ ID NO: 565892 - DNA, 25 bp, Mus musculus
gctcatctctgtagatggatctcca

SEQ ID NO: 565893 - DNA, 25 bp, Mus musculus
gctcatctctgttgatggatctcca

SEQ ID NO: 565894 - DNA, 25 bp, Mus musculus
gctcatctctttatagtcatcctgt

SEQ ID NO: 565895 - DNA, 25 bp, Mus musculus
gctcatctctttttagtcatcctgt

SEQ ID NO: 565896 - DNA, 25 bp, Mus musculus
gctcatctgagtagtcactattttt

SEQ ID NO: 565897 - DNA, 25 bp, Mus musculus
gctcatctgagttgtcactattttt

SEQ ID NO: 565898 - DNA, 25 bp, Mus musculus
gctcatctgccaagggttagagagt

SEQ ID NO: 565899 - DNA, 25 bp, Mus musculus
gctcatctgccatgggttagagagt

SEQ ID NO: 565900 - DNA, 25 bp, Mus musculus
gctcatctgggtccgtgttgtttgt

SEQ ID NO: 565901 - DNA, 25 bp, Mus musculus
gctcatctgggtgcgtgttgtttgt

SEQ ID NO: 565902 - DNA, 25 bp, Mus musculus
gctcatcttagccagaaaattgcca

SEQ ID NO: 565903 - DNA, 25 bp, Mus musculus
gctcatcttagcgagaaaattgcca

SEQ ID NO: 565904 - DNA, 25 bp, Mus musculus
gctcatcttcacaggcaaagcactg

SEQ ID NO: 565905 - DNA, 25 bp, Mus musculus
gctcatcttcactggcaaagcactg

SEQ ID NO: 565906 - DNA, 25 bp, Mus musculus
gctcatcttgaactcaattgttcta

SEQ ID NO: 565907 - DNA, 25 bp, Mus musculus
gctcatcttgaagtcaattgttcta

SEQ ID NO: 565908 - DNA, 25 bp, Mus musculus
gctcatcttgagacctcgaagcagg

SEQ ID NO: 565909 - DNA, 25 bp, Mus musculus
gctcatcttgagcactgacttgata

SEQ ID NO: 565910 - DNA, 25 bp, Mus musculus
gctcatcttgaggactgacttgata

SEQ ID NO: 565911 - DNA, 25 bp, Mus musculus
gctcatcttgagtcctcgaagcagg

SEQ ID NO: 565912 - DNA, 25 bp, Mus musculus
gctcatcttgtcaaagtctgggctt

SEQ ID NO: 565913 - DNA, 25 bp, Mus musculus
gctcatcttgtctaagtctgggctt

SEQ ID NO: 565914 - DNA, 25 bp, Mus musculus
gctcatctttgaaactgtggtcaat

SEQ ID NO: 565915 - DNA, 25 bp, Mus musculus
gctcatctttgactcacaatttgaa

SEQ ID NO: 565916 - DNA, 25 bp, Mus musculus
gctcatctttgagtcacaatttgaa

SEQ ID NO: 565917 - DNA, 25 bp, Mus musculus
gctcatctttgatactgtggtcaat

SEQ ID NO: 565918 - DNA, 25 bp, Mus musculus
gctcatgaactgctggtattctggt

SEQ ID NO: 565919 - DNA, 25 bp, Mus musculus
gctcatgaactggtggtattctggt

SEQ ID NO: 565920 - DNA, 25 bp, Mus musculus
gctcatgaatgtctgtaggccttgt

SEQ ID NO: 565921 - DNA, 25 bp, Mus musculus
gctcatgaatgtgtgtaggccttgt

SEQ ID NO: 565922 - DNA, 25 bp, Mus musculus
gctcatgacacgcaggacacacttc

SEQ ID NO: 565923 - DNA, 25 bp, Mus musculus
gctcatgacacggaggacacacttc

SEQ ID NO: 565924 - DNA, 25 bp, Mus musculus
gctcatgactggctattgatttcct

SEQ ID NO: 565925 - DNA, 25 bp, Mus musculus
gctcatgactgggtattgatttcct

SEQ ID NO: 565926 - DNA, 25 bp, Mus musculus
gctcatgagctacaaggtgctccga

SEQ ID NO: 565927 - DNA, 25 bp, Mus musculus
gctcatgagctagaaggtgctccga

SEQ ID NO: 565928 - DNA, 25 bp, Mus musculus
gctcatgagctgctgttcattctgt

SEQ ID NO: 565929 - DNA, 25 bp, Mus musculus
gctcatgagctggtgttcattctgt

SEQ ID NO: 565930 - DNA, 25 bp, Mus musculus
gctcatgatacaatctgtcggtaga

SEQ ID NO: 565931 - DNA, 25 bp, Mus musculus
gctcatgatacattctgtcggtaga

SEQ ID NO: 565932 - DNA, 25 bp, Mus musculus
gctcatgatcgtcaaactgggcctg

SEQ ID NO: 565933 - DNA, 25 bp, Mus musculus
gctcatgatcgtgaaactgggcctg

SEQ ID NO: 565934 - DNA, 25 bp, Mus musculus
gctcatgcaccaagaccggtttaaa

SEQ ID NO: 565935 - DNA, 25 bp, Mus musculus
gctcatgcaccatgaccggtttaaa

SEQ ID NO: 565936 - DNA, 25 bp, Mus musculus
gctcatgcaccgaagaatccaaaat

SEQ ID NO: 565937 - DNA, 25 bp, Mus musculus
gctcatgcaccgtagaatccaaaat

SEQ ID NO: 565938 - DNA, 25 bp, Mus musculus
gctcatgcagcaaattggcctcttg

SEQ ID NO: 565939 - DNA, 25 bp, Mus musculus
gctcatgcagcatattggcctcttg

SEQ ID NO: 565940 - DNA, 25 bp, Mus musculus
gctcatgcaggacatttgtagcctt

SEQ ID NO: 565941 - DNA, 25 bp, Mus musculus
gctcatgcaggagatttgtagcctt

SEQ ID NO: 565942 - DNA, 25 bp, Mus musculus
gctcatgcagtccagatttcatccc

SEQ ID NO: 565943 - DNA, 25 bp, Mus musculus
gctcatgcagtcgagatttcatccc

SEQ ID NO: 565944 - DNA, 25 bp, Mus musculus
gctcatgccaagcttgaccggattg

SEQ ID NO: 565945 - DNA, 25 bp, Mus musculus
gctcatgccaaggttgaccggattg

SEQ ID NO: 565946 - DNA, 25 bp, Mus musculus
gctcatgccccactctgaaaaaaga

SEQ ID NO: 565947 - DNA, 25 bp, Mus musculus
gctcatgccccagtctgaaaaaaga

SEQ ID NO: 565948 - DNA, 25 bp, Mus musculus
gctcatgcctataatactaacactc

SEQ ID NO: 565949 - DNA, 25 bp, Mus musculus
gctcatgcctattatactaacactc

SEQ ID NO: 565950 - DNA, 25 bp, Mus musculus
gctcatgcctgtagttctgacatag

SEQ ID NO: 565951 - DNA, 25 bp, Mus musculus
gctcatgcctgttgttctgacatag

SEQ ID NO: 565952 - DNA, 25 bp, Mus musculus
gctcatgctagtctttgtgcatttc

SEQ ID NO: 565953 - DNA, 25 bp, Mus musculus
gctcatgctagtgtttgtgcatttc

SEQ ID NO: 565954 - DNA, 25 bp, Mus musculus
gctcatgctctcctacgtgatatat

SEQ ID NO: 565955 - DNA, 25 bp, Mus musculus
gctcatgctctcgtacgtgatatat

SEQ ID NO: 565956 - DNA, 25 bp, Mus musculus
gctcatgctctgagctttcgttggg

SEQ ID NO: 565957 - DNA, 25 bp, Mus musculus
gctcatgctctgtgctttcgttggg

SEQ ID NO: 565958 - DNA, 25 bp, Mus musculus
gctcatgcttatcacagtcgctgtg

SEQ ID NO: 565959 - DNA, 25 bp, Mus musculus
gctcatgcttatgacagtcgctgtg

SEQ ID NO: 565960 - DNA, 25 bp, Mus musculus
gctcatggagcgacttaagcaactg

SEQ ID NO: 565961 - DNA, 25 bp, Mus musculus
gctcatggagcgtcttaagcaactg

SEQ ID NO: 565962 - DNA, 25 bp, Mus musculus
gctcatggaggaactatagctgcca

SEQ ID NO: 565963 - DNA, 25 bp, Mus musculus
gctcatggaggaagtctgtctgcct

SEQ ID NO: 565964 - DNA, 25 bp, Mus musculus
gctcatggaggatctatagctgcca

SEQ ID NO: 565965 - DNA, 25 bp, Mus musculus
gctcatggaggatgtctgtctgcct

SEQ ID NO: 565966 - DNA, 25 bp, Mus musculus
gctcatggatcaaattggctatttt

SEQ ID NO: 565967 - DNA, 25 bp, Mus musculus
gctcatggatcatattggctatttt

SEQ ID NO: 565968 - DNA, 25 bp, Mus musculus
gctcatggatgcactgggcgaagca

SEQ ID NO: 565969 - DNA, 25 bp, Mus musculus
gctcatggatgctctgggcgaagca

SEQ ID NO: 565970 - DNA, 25 bp, Mus musculus
gctcatggatgtctggattgcttct

SEQ ID NO: 565971 - DNA, 25 bp, Mus musculus
gctcatggatgtgtggattgcttct

SEQ ID NO: 565972 - DNA, 25 bp, Mus musculus
gctcatggccctcaatacagagtac

SEQ ID NO: 565973 - DNA, 25 bp, Mus musculus
gctcatggccctgaatacagagtac

SEQ ID NO: 565974 - DNA, 25 bp, Mus musculus
gctcatggtgctatcaataaatttc

SEQ ID NO: 565975 - DNA, 25 bp, Mus musculus
gctcatggtgctttcaataaatttc

SEQ ID NO: 565976 - DNA, 25 bp, Mus musculus
gctcatggtgttctgatctgtgatc

SEQ ID NO: 565977 - DNA, 25 bp, Mus musculus
gctcatggtgttgtgatctgtgatc

SEQ ID NO: 565978 - DNA, 25 bp, Mus musculus
gctcatggtttcagggtgcctttat

SEQ ID NO: 565979 - DNA, 25 bp, Mus musculus
gctcatggtttctgggtgcctttat

SEQ ID NO: 565980 - DNA, 25 bp, Mus musculus
gctcatgtaaatccctatggattac

SEQ ID NO: 565981 - DNA, 25 bp, Mus musculus
gctcatgtaaatgcctatggattac

SEQ ID NO: 565982 - DNA, 25 bp, Mus musculus
gctcatgtaatcatgacagggaaat

SEQ ID NO: 565983 - DNA, 25 bp, Mus musculus
gctcatgtaatcttgacagggaaat

SEQ ID NO: 565984 - DNA, 25 bp, Mus musculus
gctcatgtacaaccctttcctgagg

SEQ ID NO: 565985 - DNA, 25 bp, Mus musculus
gctcatgtacaagcctttcctgagg

SEQ ID NO: 565986 - DNA, 25 bp, Mus musculus
gctcatgtatttagttcttcttcta

SEQ ID NO: 565987 - DNA, 25 bp, Mus musculus
gctcatgtattttgttcttcttcta

SEQ ID NO: 565988 - DNA, 25 bp, Mus musculus
gctcatgtcaatccttggcgtggga

SEQ ID NO: 565989 - DNA, 25 bp, Mus musculus
gctcatgtcaatgcttggcgtggga

SEQ ID NO: 565990 - DNA, 25 bp, Mus musculus
gctcatgtgaaaaacttagttctta

SEQ ID NO: 565991 - DNA, 25 bp, Mus musculus
gctcatgtgaaatacttagttctta

SEQ ID NO: 565992 - DNA, 25 bp, Mus musculus
gctcatgtgtaaatccaagactcca

SEQ ID NO: 565993 - DNA, 25 bp, Mus musculus
gctcatgtgtaattccaagactcca

SEQ ID NO: 565994 - DNA, 25 bp, Mus musculus
gctcatgttccaacagatgactcta

SEQ ID NO: 565995 - DNA, 25 bp, Mus musculus
gctcatgttccatcagatgactcta

SEQ ID NO: 565996 - DNA, 25 bp, Mus musculus
gctcatgttctccagcacgtagcca

SEQ ID NO: 565997 - DNA, 25 bp, Mus musculus
gctcatgttctcgagcacgtagcca

SEQ ID NO: 565998 - DNA, 25 bp, Mus musculus
gctcatgtttggatcttaaggtttt

SEQ ID NO: 565999 - DNA, 25 bp, Mus musculus
gctcatgtttggttcttaaggtttt

SEQ ID NO: 566000 - DNA, 25 bp, Mus musculus
gctcatgtttttccgaagtctgcat

SEQ ID NO: 566001 - DNA, 25 bp, Mus musculus
gctcatgtttttgcgaagtctgcat

SEQ ID NO: 566002 - DNA, 25 bp, Mus musculus
gctcattaatctacagaccacagtt

SEQ ID NO: 566003 - DNA, 25 bp, Mus musculus
gctcattaatcttcagaccacagtt

SEQ ID NO: 566004 - DNA, 25 bp, Mus musculus
gctcattacagcacttgtattggaa

SEQ ID NO: 566005 - DNA, 25 bp, Mus musculus
gctcattacagctcttgtattggaa

SEQ ID NO: 566006 - DNA, 25 bp, Mus musculus
gctcattacagtaaatttgggccat

SEQ ID NO: 566007 - DNA, 25 bp, Mus musculus
gctcattacagttaatttgggccat

SEQ ID NO: 566008 - DNA, 25 bp, Mus musculus
gctcattacctcagctacttaaaca

SEQ ID NO: 566009 - DNA, 25 bp, Mus musculus
gctcattacctctgctacttaaaca

SEQ ID NO: 566010 - DNA, 25 bp, Mus musculus
gctcattaccttactagtagcagct

SEQ ID NO: 566011 - DNA, 25 bp, Mus musculus
gctcattacctttctagtagcagct

SEQ ID NO: 566012 - DNA, 25 bp, Mus musculus
gctcattagttacctagcaacggct

SEQ ID NO: 566013 - DNA, 25 bp, Mus musculus
gctcattagttagctagcaacggct

SEQ ID NO: 566014 - DNA, 25 bp, Mus musculus
gctcattatccacagatggccagga

SEQ ID NO: 566015 - DNA, 25 bp, Mus musculus
gctcattatccagagatggccagga

SEQ ID NO: 566016 - DNA, 25 bp, Mus musculus
gctcattcacacacgtaaactcagt

SEQ ID NO: 566017 - DNA, 25 bp, Mus musculus
gctcattcacactcgtaaactcagt

SEQ ID NO: 566018 - DNA, 25 bp, Mus musculus
gctcattccttccagacctggtgga

SEQ ID NO: 566019 - DNA, 25 bp, Mus musculus
gctcattccttcgagacctggtgga

SEQ ID NO: 566020 - DNA, 25 bp, Mus musculus
gctcattctacaagggaggcttaac

SEQ ID NO: 566021 - DNA, 25 bp, Mus musculus
gctcattctacatgggaggcttaac

SEQ ID NO: 566022 - DNA, 25 bp, Mus musculus
gctcattctatcagttcttggttta

SEQ ID NO: 566023 - DNA, 25 bp, Mus musculus
gctcattctatctgttcttggttta

SEQ ID NO: 566024 - DNA, 25 bp, Mus musculus
gctcattctattctgcttataaaca

SEQ ID NO: 566025 - DNA, 25 bp, Mus musculus
gctcattctattgtgcttataaaca

SEQ ID NO: 566026 - DNA, 25 bp, Mus musculus
gctcattctcacctcatttactttg

SEQ ID NO: 566027 - DNA, 25 bp, Mus musculus
gctcattctcacgtcatttactttg

SEQ ID NO: 566028 - DNA, 25 bp, Mus musculus
gctcattctcctattagtattcata

SEQ ID NO: 566029 - DNA, 25 bp, Mus musculus
gctcattctccttttagtattcata

SEQ ID NO: 566030 - DNA, 25 bp, Mus musculus
gctcattctgctattggttggccaa

SEQ ID NO: 566031 - DNA, 25 bp, Mus musculus
gctcattctgcttttggttggccaa

SEQ ID NO: 566032 - DNA, 25 bp, Mus musculus
gctcattgacctaagacctggtcta

SEQ ID NO: 566033 - DNA, 25 bp, Mus musculus
gctcattgaccttagacctggtcta

SEQ ID NO: 566034 - DNA, 25 bp, Mus musculus
gctcattgacttctggtgctttaca

SEQ ID NO: 566035 - DNA, 25 bp, Mus musculus
gctcattgacttgtggtgctttaca

SEQ ID NO: 566036 - DNA, 25 bp, Mus musculus
gctcattgccagatttgtcattcat

SEQ ID NO: 566037 - DNA, 25 bp, Mus musculus
gctcattgccagttttgtcattcat

SEQ ID NO: 566038 - DNA, 25 bp, Mus musculus
gctcattgccctaagtttcatacac

SEQ ID NO: 566039 - DNA, 25 bp, Mus musculus
gctcattgcccttagtttcatacac

SEQ ID NO: 566040 - DNA, 25 bp, Mus musculus
gctcattgctggctacttacaagga

SEQ ID NO: 566041 - DNA, 25 bp, Mus musculus
gctcattgctgggtacttacaagga

SEQ ID NO: 566042 - DNA, 25 bp, Mus musculus
gctcattggattcaacttctctctt

SEQ ID NO: 566043 - DNA, 25 bp, Mus musculus
gctcattggattgaacttctctctt

SEQ ID NO: 566044 - DNA, 25 bp, Mus musculus
gctcattggcgtcaagctggaatcc

SEQ ID NO: 566045 - DNA, 25 bp, Mus musculus
gctcattggcgtgaagctggaatcc

SEQ ID NO: 566046 - DNA, 25 bp, Mus musculus
gctcattgtcctctccccagagaga

SEQ ID NO: 566047 - DNA, 25 bp, Mus musculus
gctcattgtcctgtccccagagaga

SEQ ID NO: 566048 - DNA, 25 bp, Mus musculus
gctcattgtgttacgtgaaggctca

SEQ ID NO: 566049 - DNA, 25 bp, Mus musculus
gctcattgtgtttcgtgaaggctca

SEQ ID NO: 566050 - DNA, 25 bp, Mus musculus
gctcattgttagctttgtgctacta

SEQ ID NO: 566051 - DNA, 25 bp, Mus musculus
gctcattgttaggtttgtgctacta

SEQ ID NO: 566052 - DNA, 25 bp, Mus musculus
gctcatttaagcaccaacactgttt

SEQ ID NO: 566053 - DNA, 25 bp, Mus musculus
gctcatttaagctccaacactgttt

SEQ ID NO: 566054 - DNA, 25 bp, Mus musculus
gctcatttaataacatctctatcat

SEQ ID NO: 566055 - DNA, 25 bp, Mus musculus
gctcatttaatatcatctctatcat

SEQ ID NO: 566056 - DNA, 25 bp, Mus musculus
gctcatttatgtagagtgcttacct

SEQ ID NO: 566057 - DNA, 25 bp, Mus musculus
gctcatttatgttgagtgcttacct

SEQ ID NO: 566058 - DNA, 25 bp, Mus musculus
gctcatttcctcaatctaggatgca

SEQ ID NO: 566059 - DNA, 25 bp, Mus musculus
gctcatttcctctatctaggatgca

SEQ ID NO: 566060 - DNA, 25 bp, Mus musculus
gctcatttccttcactggagttcag

SEQ ID NO: 566061 - DNA, 25 bp, Mus musculus
gctcatttccttgactggagttcag

SEQ ID NO: 566062 - DNA, 25 bp, Mus musculus
gctcatttgaatatcctcacatttc

SEQ ID NO: 566063 - DNA, 25 bp, Mus musculus
gctcatttgaatttcctcacatttc

SEQ ID NO: 566064 - DNA, 25 bp, Mus musculus
gctcatttgattcctgtttactaag

SEQ ID NO: 566065 - DNA, 25 bp, Mus musculus
gctcatttgattgctgtttactaag

SEQ ID NO: 566066 - DNA, 25 bp, Mus musculus
gctcatttgcagaccctgggaaatt

SEQ ID NO: 566067 - DNA, 25 bp, Mus musculus
gctcatttgcagtccctgggaaatt

SEQ ID NO: 566068 - DNA, 25 bp, Mus musculus
gctcatttgttcctttaaagcctat

SEQ ID NO: 566069 - DNA, 25 bp, Mus musculus
gctcatttgttcgtttaaagcctat

SEQ ID NO: 566070 - DNA, 25 bp, Mus musculus
gctcatttgttgaagtgggcactct

SEQ ID NO: 566071 - DNA, 25 bp, Mus musculus
gctcatttgttgtagtgggcactct

SEQ ID NO: 566072 - DNA, 25 bp, Mus musculus
gctcattttcatctctcaatcgttc

SEQ ID NO: 566073 - DNA, 25 bp, Mus musculus
gctcattttcatgtctcaatcgttc

SEQ ID NO: 566074 - DNA, 25 bp, Mus musculus
gctcattttctcagaccctttgtta

SEQ ID NO: 566075 - DNA, 25 bp, Mus musculus
gctcattttctctgaccctttgtta

SEQ ID NO: 566076 - DNA, 25 bp, Mus musculus
gctcattttgctaacttacctcaag

SEQ ID NO: 566077 - DNA, 25 bp, Mus musculus
gctcattttgctccatagtaattaa

SEQ ID NO: 566078 - DNA, 25 bp, Mus musculus
gctcattttgctgcatagtaattaa

SEQ ID NO: 566079 - DNA, 25 bp, Mus musculus
gctcattttgcttacttacctcaag

SEQ ID NO: 566080 - DNA, 25 bp, Mus musculus
gctccaaagaagagaacaagtttca

SEQ ID NO: 566081 - DNA, 25 bp, Mus musculus
gctccaaagaagtgaacaagtttca

SEQ ID NO: 566082 - DNA, 25 bp, Mus musculus
gctccaaagccaagtaaaaagaaat

SEQ ID NO: 566083 - DNA, 25 bp, Mus musculus
gctccaaagccatgtaaaaagaaat

SEQ ID NO: 566084 - DNA, 25 bp, Mus musculus
gctccaaaggaaattaggttcgatc

SEQ ID NO: 566085 - DNA, 25 bp, Mus musculus
gctccaaaggaatttaggttcgatc

SEQ ID NO: 566086 - DNA, 25 bp, Mus musculus
gctccaaagtagatactacacccct

SEQ ID NO: 566087 - DNA, 25 bp, Mus musculus
gctccaaagtagttactacacccct

SEQ ID NO: 566088 - DNA, 25 bp, Mus musculus
gctccaaatcctcacaaactagttt

SEQ ID NO: 566089 - DNA, 25 bp, Mus musculus
gctccaaatcctgacaaactagttt

SEQ ID NO: 566090 - DNA, 25 bp, Mus musculus
gctccaacagggcatgttcttcttg

SEQ ID NO: 566091 - DNA, 25 bp, Mus musculus
gctccaacaggggatgttcttcttg

SEQ ID NO: 566092 - DNA, 25 bp, Mus musculus
gctccaacatggaaaacatagctgt

SEQ ID NO: 566093 - DNA, 25 bp, Mus musculus
gctccaacatggtaaacatagctgt

SEQ ID NO: 566094 - DNA, 25 bp, Mus musculus
gctccaacatttccggaagtgtttt

SEQ ID NO: 566095 - DNA, 25 bp, Mus musculus
gctccaacatttgcggaagtgtttt

SEQ ID NO: 566096 - DNA, 25 bp, Mus musculus
gctccaaccatcaggcttagaggca

SEQ ID NO: 566097 - DNA, 25 bp, Mus musculus
gctccaaccatctggcttagaggca

SEQ ID NO: 566098 - DNA, 25 bp, Mus musculus
gctccaaccgctccataaatattaa

SEQ ID NO: 566099 - DNA, 25 bp, Mus musculus
gctccaaccgctgcataaatattaa

SEQ ID NO: 566100 - DNA, 25 bp, Mus musculus
gctccaactgtgcatgctcaaaatg

SEQ ID NO: 566101 - DNA, 25 bp, Mus musculus
gctccaactgtggatgctcaaaatg

SEQ ID NO: 566102 - DNA, 25 bp, Mus musculus
gctccaagaaatagtgtgttcgccc

SEQ ID NO: 566103 - DNA, 25 bp, Mus musculus
gctccaagaaattgtgtgttcgccc

SEQ ID NO: 566104 - DNA, 25 bp, Mus musculus
gctccaagacttctcacatctgttg

SEQ ID NO: 566105 - DNA, 25 bp, Mus musculus
gctccaagacttgtcacatctgttg

SEQ ID NO: 566106 - DNA, 25 bp, Mus musculus
gctccaagcatgaaatccttcaaag

SEQ ID NO: 566107 - DNA, 25 bp, Mus musculus
gctccaagcatgtaatccttcaaag

SEQ ID NO: 566108 - DNA, 25 bp, Mus musculus
gctccaagcggaaccattaccagga

SEQ ID NO: 566109 - DNA, 25 bp, Mus musculus
gctccaagcggatccattaccagga

SEQ ID NO: 566110 - DNA, 25 bp, Mus musculus
gctccaaggccaagcgttttctgat

SEQ ID NO: 566111 - DNA, 25 bp, Mus musculus
gctccaaggccatgcgttttctgat

SEQ ID NO: 566112 - DNA, 25 bp, Mus musculus
gctccaaggctaagcacctgtttta

SEQ ID NO: 566113 - DNA, 25 bp, Mus musculus
gctccaaggctatgcacctgtttta

SEQ ID NO: 566114 - DNA, 25 bp, Mus musculus
gctccaagggacatacaagctcaag

SEQ ID NO: 566115 - DNA, 25 bp, Mus musculus
gctccaagggacttacaagctcaag

SEQ ID NO: 566116 - DNA, 25 bp, Mus musculus
gctccaagggctccaagagaactga

SEQ ID NO: 566117 - DNA, 25 bp, Mus musculus
gctccaagggctgcaagagaactga

SEQ ID NO: 566118 - DNA, 25 bp, Mus musculus
gctccaagggtccatgcaggcagtt

SEQ ID NO: 566119 - DNA, 25 bp, Mus musculus
gctccaagggtcgatgcaggcagtt

SEQ ID NO: 566120 - DNA, 25 bp, Mus musculus
gctccaagtgtccattcataatctg

SEQ ID NO: 566121 - DNA, 25 bp, Mus musculus
gctccaagtgtccttatgtcagcag

SEQ ID NO: 566122 - DNA, 25 bp, Mus musculus
gctccaagtgtcgattcataatctg

SEQ ID NO: 566123 - DNA, 25 bp, Mus musculus
gctccaagtgtcgttatgtcagcag

SEQ ID NO: 566124 - DNA, 25 bp, Mus musculus
gctccaatagctacctgaaaccata

SEQ ID NO: 566125 - DNA, 25 bp, Mus musculus
gctccaatagcttcctgaaaccata

SEQ ID NO: 566126 - DNA, 25 bp, Mus musculus
gctccaatgcggagaacgtgttcct

SEQ ID NO: 566127 - DNA, 25 bp, Mus musculus
gctccaatgcggtgaacgtgttcct

SEQ ID NO: 566128 - DNA, 25 bp, Mus musculus
gctccaattataattgctgtctgca

SEQ ID NO: 566129 - DNA, 25 bp, Mus musculus
gctccaattatatttgctgtctgca

SEQ ID NO: 566130 - DNA, 25 bp, Mus musculus
gctccaattctaaacctctggtttt

SEQ ID NO: 566131 - DNA, 25 bp, Mus musculus
gctccaattctatacctctggtttt

SEQ ID NO: 566132 - DNA, 25 bp, Mus musculus
gctccaattctgagggaggtcgaac

SEQ ID NO: 566133 - DNA, 25 bp, Mus musculus
gctccaattctgtgggaggtcgaac

SEQ ID NO: 566134 - DNA, 25 bp, Mus musculus
gctccacacctactttctaaataat

SEQ ID NO: 566135 - DNA, 25 bp, Mus musculus
gctccacacctagtttctaaataat

SEQ ID NO: 566136 - DNA, 25 bp, Mus musculus
gctccacacttcagtgagcctgggt

SEQ ID NO: 566137 - DNA, 25 bp, Mus musculus
gctccacacttctgtgagcctgggt

SEQ ID NO: 566138 - DNA, 25 bp, Mus musculus
gctccacagatgagctctgtgagtt

SEQ ID NO: 566139 - DNA, 25 bp, Mus musculus
gctccacagatgtgctctgtgagtt

SEQ ID NO: 566140 - DNA, 25 bp, Mus musculus
gctccacaggagatgccgctacagg

SEQ ID NO: 566141 - DNA, 25 bp, Mus musculus
gctccacaggagttgccgctacagg

SEQ ID NO: 566142 - DNA, 25 bp, Mus musculus
gctccacatctaagtacgattttaa

SEQ ID NO: 566143 - DNA, 25 bp, Mus musculus
gctccacatctaatccatatccata

SEQ ID NO: 566144 - DNA, 25 bp, Mus musculus
gctccacatctatgtacgattttaa

SEQ ID NO: 566145 - DNA, 25 bp, Mus musculus
gctccacatctattccatatccata

SEQ ID NO: 566146 - DNA, 25 bp, Mus musculus
gctccacatgttactagttaatagt

SEQ ID NO: 566147 - DNA, 25 bp, Mus musculus
gctccacatgtttctagttaatagt

SEQ ID NO: 566148 - DNA, 25 bp, Mus musculus
gctccaccaccaaaacctgttagaa

SEQ ID NO: 566149 - DNA, 25 bp, Mus musculus
gctccaccaccataacctgttagaa

SEQ ID NO: 566150 - DNA, 25 bp, Mus musculus
gctccaccagcgagcgttttcaggt

SEQ ID NO: 566151 - DNA, 25 bp, Mus musculus
gctccaccagcgtgcgttttcaggt

SEQ ID NO: 566152 - DNA, 25 bp, Mus musculus
gctccacccagacaacaatctttta

SEQ ID NO: 566153 - DNA, 25 bp, Mus musculus
gctccacccagagaacaatctttta

SEQ ID NO: 566154 - DNA, 25 bp, Mus musculus
gctccaccctataataccagaacag

SEQ ID NO: 566155 - DNA, 25 bp, Mus musculus
gctccaccctattataccagaacag

SEQ ID NO: 566156 - DNA, 25 bp, Mus musculus
gctccaccctcacttatagaagatt

SEQ ID NO: 566157 - DNA, 25 bp, Mus musculus
gctccaccctcagttatagaagatt

SEQ ID NO: 566158 - DNA, 25 bp, Mus musculus
gctccaccgggaagaattagaactt

SEQ ID NO: 566159 - DNA, 25 bp, Mus musculus
gctccaccgggatgaattagaactt

SEQ ID NO: 566160 - DNA, 25 bp, Mus musculus
gctccacctactcgcggacagaaaa

SEQ ID NO: 566161 - DNA, 25 bp, Mus musculus
gctccacctactggcggacagaaaa

SEQ ID NO: 566162 - DNA, 25 bp, Mus musculus
gctccacctgctaaaattcccagaa

SEQ ID NO: 566163 - DNA, 25 bp, Mus musculus
gctccacctgcttaaattcccagaa

SEQ ID NO: 566164 - DNA, 25 bp, Mus musculus
gctccacctgtactgcttgaataca

SEQ ID NO: 566165 - DNA, 25 bp, Mus musculus
gctccacctgtagtgcttgaataca

SEQ ID NO: 566166 - DNA, 25 bp, Mus musculus
gctccacgctgtcctggacctgtgt

SEQ ID NO: 566167 - DNA, 25 bp, Mus musculus
gctccacgctgtgctggacctgtgt

SEQ ID NO: 566168 - DNA, 25 bp, Mus musculus
gctccacggaccaaataaaagtgtt

SEQ ID NO: 566169 - DNA, 25 bp, Mus musculus
gctccacggacctaataaaagtgtt

SEQ ID NO: 566170 - DNA, 25 bp, Mus musculus
gctccacggagcatttgaaatgcaa

SEQ ID NO: 566171 - DNA, 25 bp, Mus musculus
gctccacggagcttttgaaatgcaa

SEQ ID NO: 566172 - DNA, 25 bp, Mus musculus
gctccacgtgacacatagtagggaa

SEQ ID NO: 566173 - DNA, 25 bp, Mus musculus
gctccacgtgactcatagtagggaa

SEQ ID NO: 566174 - DNA, 25 bp, Mus musculus
gctccactaatgaactgccttgagg

SEQ ID NO: 566175 - DNA, 25 bp, Mus musculus
gctccactaatgtactgccttgagg

SEQ ID NO: 566176 - DNA, 25 bp, Mus musculus
gctccactagggatgccttggcagg

SEQ ID NO: 566177 - DNA, 25 bp, Mus musculus
gctccactagggttgccttggcagg

SEQ ID NO: 566178 - DNA, 25 bp, Mus musculus
gctccactgagcaaacataccaggg

SEQ ID NO: 566179 - DNA, 25 bp, Mus musculus
gctccactgagctaacataccaggg

SEQ ID NO: 566180 - DNA, 25 bp, Mus musculus
gctccactgaggaagctcggcgcga

SEQ ID NO: 566181 - DNA, 25 bp, Mus musculus
gctccactgaggtagctcggcgcga

SEQ ID NO: 566182 - DNA, 25 bp, Mus musculus
gctccactgccacagcaggagaaat

SEQ ID NO: 566183 - DNA, 25 bp, Mus musculus
gctccactgccagagcaggagaaat

SEQ ID NO: 566184 - DNA, 25 bp, Mus musculus
gctccactgctcagtctagtgtgaa

SEQ ID NO: 566185 - DNA, 25 bp, Mus musculus
gctccactgctctgtctagtgtgaa

SEQ ID NO: 566186 - DNA, 25 bp, Mus musculus
gctccactggcaacgttgtgtatga

SEQ ID NO: 566187 - DNA, 25 bp, Mus musculus
gctccactggcatcgttgtgtatga

SEQ ID NO: 566188 - DNA, 25 bp, Mus musculus
gctccactgggcatgtgaccgagga

SEQ ID NO: 566189 - DNA, 25 bp, Mus musculus
gctccactgggcttgtgaccgagga

SEQ ID NO: 566190 - DNA, 25 bp, Mus musculus
gctccactgtgaatagccattcgaa

SEQ ID NO: 566191 - DNA, 25 bp, Mus musculus
gctccactgtgattagccattcgaa

SEQ ID NO: 566192 - DNA, 25 bp, Mus musculus
gctccactgttgaaactgacgtcat

SEQ ID NO: 566193 - DNA, 25 bp, Mus musculus
gctccactgttgtaactgacgtcat

SEQ ID NO: 566194 - DNA, 25 bp, Mus musculus
gctccacttacgaagattgctgttt

SEQ ID NO: 566195 - DNA, 25 bp, Mus musculus
gctccacttacgtagattgctgttt

SEQ ID NO: 566196 - DNA, 25 bp, Mus musculus
gctccacttcacaactttctaaggg

SEQ ID NO: 566197 - DNA, 25 bp, Mus musculus
gctccacttcactactttctaaggg

SEQ ID NO: 566198 - DNA, 25 bp, Mus musculus
gctccacttcctcaggaaaggcttt

SEQ ID NO: 566199 - DNA, 25 bp, Mus musculus
gctccacttcctgaggaaaggcttt

SEQ ID NO: 566200 - DNA, 25 bp, Mus musculus
gctccacttgacaggatcttgaagt

SEQ ID NO: 566201 - DNA, 25 bp, Mus musculus
gctccacttgactggatcttgaagt

SEQ ID NO: 566202 - DNA, 25 bp, Mus musculus
gctccactttggcttcagagacgaa

SEQ ID NO: 566203 - DNA, 25 bp, Mus musculus
gctccactttgggttcagagacgaa

SEQ ID NO: 566204 - DNA, 25 bp, Mus musculus
gctccacttttgaccaatacgtcag

SEQ ID NO: 566205 - DNA, 25 bp, Mus musculus
gctccacttttgtccaatacgtcag

SEQ ID NO: 566206 - DNA, 25 bp, Mus musculus
gctccagaacttatttggtaggctt

SEQ ID NO: 566207 - DNA, 25 bp, Mus musculus
gctccagaacttttttggtaggctt

SEQ ID NO: 566208 - DNA, 25 bp, Mus musculus
gctccagaatgcatggatgtgcctt

SEQ ID NO: 566209 - DNA, 25 bp, Mus musculus
gctccagaatgcttggatgtgcctt

SEQ ID NO: 566210 - DNA, 25 bp, Mus musculus
gctccagacgagagactcacctggg

SEQ ID NO: 566211 - DNA, 25 bp, Mus musculus
gctccagacgagtgactcacctggg

SEQ ID NO: 566212 - DNA, 25 bp, Mus musculus
gctccagacgctactgctgacatgg

SEQ ID NO: 566213 - DNA, 25 bp, Mus musculus
gctccagacgcttctgctgacatgg

SEQ ID NO: 566214 - DNA, 25 bp, Mus musculus
gctccagagcgtacatcacctgtga

SEQ ID NO: 566215 - DNA, 25 bp, Mus musculus
gctccagagcgttcatcacctgtga

SEQ ID NO: 566216 - DNA, 25 bp, Mus musculus
gctccagaggccatgtgctagctgt

SEQ ID NO: 566217 - DNA, 25 bp, Mus musculus
gctccagaggccttgtgctagctgt

SEQ ID NO: 566218 - DNA, 25 bp, Mus musculus
gctccagagtacatcacctcaaatt

SEQ ID NO: 566219 - DNA, 25 bp, Mus musculus
gctccagagtacttcacctcaaatt

SEQ ID NO: 566220 - DNA, 25 bp, Mus musculus
gctccagatacgcaaaacaatctca

SEQ ID NO: 566221 - DNA, 25 bp, Mus musculus
gctccagatacggaaaacaatctca

SEQ ID NO: 566222 - DNA, 25 bp, Mus musculus
gctccagatcatacttcacgtggta

SEQ ID NO: 566223 - DNA, 25 bp, Mus musculus
gctccagatcattcttcacgtggta

SEQ ID NO: 566224 - DNA, 25 bp, Mus musculus
gctccagatgcgagcagaagcgctc

SEQ ID NO: 566225 - DNA, 25 bp, Mus musculus
gctccagatgcgtgcagaagcgctc

SEQ ID NO: 566226 - DNA, 25 bp, Mus musculus
gctccagcacatctccaagaacaag

SEQ ID NO: 566227 - DNA, 25 bp, Mus musculus
gctccagcacatgtccaagaacaag

SEQ ID NO: 566228 - DNA, 25 bp, Mus musculus
gctccagcactaccgagagactgtt

SEQ ID NO: 566229 - DNA, 25 bp, Mus musculus
gctccagcactagcgagagactgtt

SEQ ID NO: 566230 - DNA, 25 bp, Mus musculus
gctccagcatcaactgctgcaataa

SEQ ID NO: 566231 - DNA, 25 bp, Mus musculus
gctccagcatcatctgctgcaataa

SEQ ID NO: 566232 - DNA, 25 bp, Mus musculus
gctccagcatccagtgagcactgat

SEQ ID NO: 566233 - DNA, 25 bp, Mus musculus
gctccagcatccagtgcggatttca

SEQ ID NO: 566234 - DNA, 25 bp, Mus musculus
gctccagcatcctgtgagcactgat

SEQ ID NO: 566235 - DNA, 25 bp, Mus musculus
gctccagcatcctgtgcggatttca

SEQ ID NO: 566236 - DNA, 25 bp, Mus musculus
gctccagcatgcacatcacgaagga

SEQ ID NO: 566237 - DNA, 25 bp, Mus musculus
gctccagcatgctcatcacgaagga

SEQ ID NO: 566238 - DNA, 25 bp, Mus musculus
gctccagcatgtctctggctgcaca

SEQ ID NO: 566239 - DNA, 25 bp, Mus musculus
gctccagcatgtgtctggctgcaca

SEQ ID NO: 566240 - DNA, 25 bp, Mus musculus
gctccagcattgaagcagtgggctc

SEQ ID NO: 566241 - DNA, 25 bp, Mus musculus
gctccagcattgtagcagtgggctc

SEQ ID NO: 566242 - DNA, 25 bp, Mus musculus
gctccagccaggcattaaggctgca

SEQ ID NO: 566243 - DNA, 25 bp, Mus musculus
gctccagccagggattaaggctgca

SEQ ID NO: 566244 - DNA, 25 bp, Mus musculus
gctccagccagtatcacaactttta

SEQ ID NO: 566245 - DNA, 25 bp, Mus musculus
gctccagccagtttcacaactttta

SEQ ID NO: 566246 - DNA, 25 bp, Mus musculus
gctccagcccatctatgctctttgg

SEQ ID NO: 566247 - DNA, 25 bp, Mus musculus
gctccagcccatgtatgctctttgg

SEQ ID NO: 566248 - DNA, 25 bp, Mus musculus
gctccagccttaatgtttctgatga

SEQ ID NO: 566249 - DNA, 25 bp, Mus musculus
gctccagccttattgtttctgatga

SEQ ID NO: 566250 - DNA, 25 bp, Mus musculus
gctccagctacccaacagagcagtg

SEQ ID NO: 566251 - DNA, 25 bp, Mus musculus
gctccagctaccgaacagagcagtg

SEQ ID NO: 566252 - DNA, 25 bp, Mus musculus
gctccagctactctttcagatgaag

SEQ ID NO: 566253 - DNA, 25 bp, Mus musculus
gctccagctactgtttcagatgaag

SEQ ID NO: 566254 - DNA, 25 bp, Mus musculus
gctccagctctcatcagtcaaagaa

SEQ ID NO: 566255 - DNA, 25 bp, Mus musculus
gctccagctctcttcagtcaaagaa

SEQ ID NO: 566256 - DNA, 25 bp, Mus musculus
gctccagctctgcatctgttagatg

SEQ ID NO: 566257 - DNA, 25 bp, Mus musculus
gctccagctctggatctgttagatg

SEQ ID NO: 566258 - DNA, 25 bp, Mus musculus
gctccagctgacaatgtttgcctga

SEQ ID NO: 566259 - DNA, 25 bp, Mus musculus
gctccagctgactatgtttgcctga

SEQ ID NO: 566260 - DNA, 25 bp, Mus musculus
gctccagctgtaaccagtgtcagta

SEQ ID NO: 566261 - DNA, 25 bp, Mus musculus
gctccagctgtatccagtgtcagta

SEQ ID NO: 566262 - DNA, 25 bp, Mus musculus
gctccagctgtgctggatgtggcag

SEQ ID NO: 566263 - DNA, 25 bp, Mus musculus
gctccagctgtggtggatgtggcag

SEQ ID NO: 566264 - DNA, 25 bp, Mus musculus
gctccagcttggctcagctttagac

SEQ ID NO: 566265 - DNA, 25 bp, Mus musculus
gctccagcttgggtcagctttagac

SEQ ID NO: 566266 - DNA, 25 bp, Mus musculus
gctccaggaagcagtggtaggctta

SEQ ID NO: 566267 - DNA, 25 bp, Mus musculus
gctccaggaagctgtggtaggctta

SEQ ID NO: 566268 - DNA, 25 bp, Mus musculus
gctccaggacagacacgcacggagt

SEQ ID NO: 566269 - DNA, 25 bp, Mus musculus
gctccaggacagtcacgcacggagt

SEQ ID NO: 566270 - DNA, 25 bp, Mus musculus
gctccaggagaaaagtttccatgaa

SEQ ID NO: 566271 - DNA, 25 bp, Mus musculus
gctccaggagaatagtttccatgaa

SEQ ID NO: 566272 - DNA, 25 bp, Mus musculus
gctccaggagaccagtaaccgattc

SEQ ID NO: 566273 - DNA, 25 bp, Mus musculus
gctccaggagacgagtaaccgattc

SEQ ID NO: 566274 - DNA, 25 bp, Mus musculus
gctccaggaggcagactttctacag

SEQ ID NO: 566275 - DNA, 25 bp, Mus musculus
gctccaggaggctgactttctacag

SEQ ID NO: 566276 - DNA, 25 bp, Mus musculus
gctccaggatgaagctgtccagacc

SEQ ID NO: 566277 - DNA, 25 bp, Mus musculus
gctccaggatgatgctgtccagacc

SEQ ID NO: 566278 - DNA, 25 bp, Mus musculus
gctccaggattaatcaattcttctt

SEQ ID NO: 566279 - DNA, 25 bp, Mus musculus
gctccaggattattcaattcttctt

SEQ ID NO: 566280 - DNA, 25 bp, Mus musculus
gctccaggccagaccttgaagggat

SEQ ID NO: 566281 - DNA, 25 bp, Mus musculus
gctccaggccagtccttgaagggat

SEQ ID NO: 566282 - DNA, 25 bp, Mus musculus
gctccaggccatagctaatagcaat

SEQ ID NO: 566283 - DNA, 25 bp, Mus musculus
gctccaggccattgctaatagcaat

SEQ ID NO: 566284 - DNA, 25 bp, Mus musculus
gctccagggatcctcaagcatggga

SEQ ID NO: 566285 - DNA, 25 bp, Mus musculus
gctccagggatcgtcaagcatggga

SEQ ID NO: 566286 - DNA, 25 bp, Mus musculus
gctccagggcatctgcgctgtgttt

SEQ ID NO: 566287 - DNA, 25 bp, Mus musculus
gctccagggcatgtgcgctgtgttt

SEQ ID NO: 566288 - DNA, 25 bp, Mus musculus
gctccagggccccttatgaaatggc

SEQ ID NO: 566289 - DNA, 25 bp, Mus musculus
gctccagggcccgttatgaaatggc

SEQ ID NO: 566290 - DNA, 25 bp, Mus musculus
gctccagggcttagaattggctcat

SEQ ID NO: 566291 - DNA, 25 bp, Mus musculus
gctccagggctttgaattggctcat

SEQ ID NO: 566292 - DNA, 25 bp, Mus musculus
gctccaggtctgacttcttgaatac

SEQ ID NO: 566293 - DNA, 25 bp, Mus musculus
gctccaggtctgtcttcttgaatac

SEQ ID NO: 566294 - DNA, 25 bp, Mus musculus
gctccagtaagaaaaatggcacacg

SEQ ID NO: 566295 - DNA, 25 bp, Mus musculus
gctccagtaagataaatggcacacg

SEQ ID NO: 566296 - DNA, 25 bp, Mus musculus
gctccagtctcacttgagctcctgg

SEQ ID NO: 566297 - DNA, 25 bp, Mus musculus
gctccagtctcagttgagctcctgg

SEQ ID NO: 566298 - DNA, 25 bp, Mus musculus
gctccagtggccagctgacttgaga

SEQ ID NO: 566299 - DNA, 25 bp, Mus musculus
gctccagtggcctgctgacttgaga

SEQ ID NO: 566300 - DNA, 25 bp, Mus musculus
gctccagtgtcccaacctttgtagt

SEQ ID NO: 566301 - DNA, 25 bp, Mus musculus
gctccagtgtccgaacctttgtagt

SEQ ID NO: 566302 - DNA, 25 bp, Mus musculus
gctccagtgtttcattctagtgtct

SEQ ID NO: 566303 - DNA, 25 bp, Mus musculus
gctccagtgtttgattctagtgtct

SEQ ID NO: 566304 - DNA, 25 bp, Mus musculus
gctccagttcctaggactctacaag

SEQ ID NO: 566305 - DNA, 25 bp, Mus musculus
gctccagttccttggactctacaag

SEQ ID NO: 566306 - DNA, 25 bp, Mus musculus
gctccagttctaaacaccattgctt

SEQ ID NO: 566307 - DNA, 25 bp, Mus musculus
gctccagttctatacaccattgctt

SEQ ID NO: 566308 - DNA, 25 bp, Mus musculus
gctccagttctcaagcagcaaaata

SEQ ID NO: 566309 - DNA, 25 bp, Mus musculus
gctccagttctctagcagcaaaata

SEQ ID NO: 566310 - DNA, 25 bp, Mus musculus
gctccagttgagacctagtgcaatt

SEQ ID NO: 566311 - DNA, 25 bp, Mus musculus
gctccagttgagtcctagtgcaatt

SEQ ID NO: 566312 - DNA, 25 bp, Mus musculus
gctccagttggaacccgttgaagca

SEQ ID NO: 566313 - DNA, 25 bp, Mus musculus
gctccagttggatcccgttgaagca

SEQ ID NO: 566314 - DNA, 25 bp, Mus musculus
gctccagtttccaactaatcgtgaa

SEQ ID NO: 566315 - DNA, 25 bp, Mus musculus
gctccagtttcctactaatcgtgaa

SEQ ID NO: 566316 - DNA, 25 bp, Mus musculus
gctccataaccaagtgcttgcctat

SEQ ID NO: 566317 - DNA, 25 bp, Mus musculus
gctccataaccatgtgcttgcctat

SEQ ID NO: 566318 - DNA, 25 bp, Mus musculus
gctccataagtaaagcctctgcctc

SEQ ID NO: 566319 - DNA, 25 bp, Mus musculus
gctccataagtatagcctctgcctc

SEQ ID NO: 566320 - DNA, 25 bp, Mus musculus
gctccatactcacgtccaagaagaa

SEQ ID NO: 566321 - DNA, 25 bp, Mus musculus
gctccatactcaggtccaagaagaa

SEQ ID NO: 566322 - DNA, 25 bp, Mus musculus
gctccatactggcttcttgtgaagg

SEQ ID NO: 566323 - DNA, 25 bp, Mus musculus
gctccatactgggttcttgtgaagg

SEQ ID NO: 566324 - DNA, 25 bp, Mus musculus
gctccatactttcacacgaagagta

SEQ ID NO: 566325 - DNA, 25 bp, Mus musculus
gctccatactttgacacgaagagta

SEQ ID NO: 566326 - DNA, 25 bp, Mus musculus
gctccataggatatgaaggcctctt

SEQ ID NO: 566327 - DNA, 25 bp, Mus musculus
gctccataggatttgaaggcctctt

SEQ ID NO: 566328 - DNA, 25 bp, Mus musculus
gctccatagtccaggagctgggcat

SEQ ID NO: 566329 - DNA, 25 bp, Mus musculus
gctccatagtcctggagctgggcat

SEQ ID NO: 566330 - DNA, 25 bp, Mus musculus
gctccatatcccaagcagctgaata

SEQ ID NO: 566331 - DNA, 25 bp, Mus musculus
gctccatatccctagcagctgaata

SEQ ID NO: 566332 - DNA, 25 bp, Mus musculus
gctccatcccacaaagaacttacaa

SEQ ID NO: 566333 - DNA, 25 bp, Mus musculus
gctccatcccactaagaacttacaa

SEQ ID NO: 566334 - DNA, 25 bp, Mus musculus
gctccatccgccagtattacaagaa

SEQ ID NO: 566335 - DNA, 25 bp, Mus musculus
gctccatccgcctgtattacaagaa

SEQ ID NO: 566336 - DNA, 25 bp, Mus musculus
gctccatccttaaacccattattag

SEQ ID NO: 566337 - DNA, 25 bp, Mus musculus
gctccatccttatacccattattag

SEQ ID NO: 566338 - DNA, 25 bp, Mus musculus
gctccatccttccttatgaaagcaa

SEQ ID NO: 566339 - DNA, 25 bp, Mus musculus
gctccatccttcgttatgaaagcaa

SEQ ID NO: 566340 - DNA, 25 bp, Mus musculus
gctccatctgcaagagtctctgtaa

SEQ ID NO: 566341 - DNA, 25 bp, Mus musculus
gctccatctgcatgagtctctgtaa

SEQ ID NO: 566342 - DNA, 25 bp, Mus musculus
gctccatcttcaagtgacactgtac

SEQ ID NO: 566343 - DNA, 25 bp, Mus musculus
gctccatcttcatgtgacactgtac

SEQ ID NO: 566344 - DNA, 25 bp, Mus musculus
gctccatgatttagctagatttaac

SEQ ID NO: 566345 - DNA, 25 bp, Mus musculus
gctccatgattttgctagatttaac

SEQ ID NO: 566346 - DNA, 25 bp, Mus musculus
gctccatgctgaccaatgtctatgt

SEQ ID NO: 566347 - DNA, 25 bp, Mus musculus
gctccatgctgagcaatgtctatgt

SEQ ID NO: 566348 - DNA, 25 bp, Mus musculus
gctccatggctactacgtgtatgag

SEQ ID NO: 566349 - DNA, 25 bp, Mus musculus
gctccatggctacttaggacttcgt

SEQ ID NO: 566350 - DNA, 25 bp, Mus musculus
gctccatggctagtacgtgtatgag

SEQ ID NO: 566351 - DNA, 25 bp, Mus musculus
gctccatggctagttaggacttcgt

SEQ ID NO: 566352 - DNA, 25 bp, Mus musculus
gctccatgggcacccaggtatgcac

SEQ ID NO: 566353 - DNA, 25 bp, Mus musculus
gctccatgggcagccaggtatgcac

SEQ ID NO: 566354 - DNA, 25 bp, Mus musculus
gctccatgtatgaataggccctttg

SEQ ID NO: 566355 - DNA, 25 bp, Mus musculus
gctccatgtatgtataggccctttg

SEQ ID NO: 566356 - DNA, 25 bp, Mus musculus
gctccatgtccaactgacactagga

SEQ ID NO: 566357 - DNA, 25 bp, Mus musculus
gctccatgtccatctgacactagga

SEQ ID NO: 566358 - DNA, 25 bp, Mus musculus
gctccatgtgctctcttttgaggga

SEQ ID NO: 566359 - DNA, 25 bp, Mus musculus
gctccatgtgctgtcttttgaggga

SEQ ID NO: 566360 - DNA, 25 bp, Mus musculus
gctccattcataacacttttgaaat

SEQ ID NO: 566361 - DNA, 25 bp, Mus musculus
gctccattcataatgcctgcttttg

SEQ ID NO: 566362 - DNA, 25 bp, Mus musculus
gctccattcatatcacttttgaaat

SEQ ID NO: 566363 - DNA, 25 bp, Mus musculus
gctccattcatattgcctgcttttg

SEQ ID NO: 566364 - DNA, 25 bp, Mus musculus
gctccattcattactgtggtcccat

SEQ ID NO: 566365 - DNA, 25 bp, Mus musculus
gctccattcatttctgtggtcccat

SEQ ID NO: 566366 - DNA, 25 bp, Mus musculus
gctccattctgtccagcctgggaga

SEQ ID NO: 566367 - DNA, 25 bp, Mus musculus
gctccattctgtgcagcctgggaga

SEQ ID NO: 566368 - DNA, 25 bp, Mus musculus
gctccattggctccattgagtatgc

SEQ ID NO: 566369 - DNA, 25 bp, Mus musculus
gctccattggctgcattgagtatgc

SEQ ID NO: 566370 - DNA, 25 bp, Mus musculus
gctccatttggacagggtcacccag

SEQ ID NO: 566371 - DNA, 25 bp, Mus musculus
gctccatttggagagggtcacccag

SEQ ID NO: 566372 - DNA, 25 bp, Mus musculus
gctccatttttccactctgtagttt

SEQ ID NO: 566373 - DNA, 25 bp, Mus musculus
gctccatttttcgactctgtagttt

SEQ ID NO: 566374 - DNA, 25 bp, Mus musculus
gctccatttttgaaactgggatata

SEQ ID NO: 566375 - DNA, 25 bp, Mus musculus
gctccatttttgtaactgggatata

SEQ ID NO: 566376 - DNA, 25 bp, Mus musculus
gctcccaaaagcatagtctccatta

SEQ ID NO: 566377 - DNA, 25 bp, Mus musculus
gctcccaaaagcttagtctccatta

SEQ ID NO: 566378 - DNA, 25 bp, Mus musculus
gctcccaaactccttgtggttttat

SEQ ID NO: 566379 - DNA, 25 bp, Mus musculus
gctcccaaactcgttgtggttttat

SEQ ID NO: 566380 - DNA, 25 bp, Mus musculus
gctcccaaccaaaagtgcgaacaac

SEQ ID NO: 566381 - DNA, 25 bp, Mus musculus
gctcccaaccaatagtgcgaacaac

SEQ ID NO: 566382 - DNA, 25 bp, Mus musculus
gctcccaagccaagatcacagaaga

SEQ ID NO: 566383 - DNA, 25 bp, Mus musculus
gctcccaagccatgatcacagaaga

SEQ ID NO: 566384 - DNA, 25 bp, Mus musculus
gctcccaatagccattctgaatatc

SEQ ID NO: 566385 - DNA, 25 bp, Mus musculus
gctcccaatagcgattctgaatatc

SEQ ID NO: 566386 - DNA, 25 bp, Mus musculus
gctcccacaatactatcctaatttt

SEQ ID NO: 566387 - DNA, 25 bp, Mus musculus
gctcccacaatagtatcctaatttt

SEQ ID NO: 566388 - DNA, 25 bp, Mus musculus
gctcccacaggaacatcaattcaga

SEQ ID NO: 566389 - DNA, 25 bp, Mus musculus
gctcccacaggatcatcaattcaga

SEQ ID NO: 566390 - DNA, 25 bp, Mus musculus
gctcccaccaagaatacacggttgt

SEQ ID NO: 566391 - DNA, 25 bp, Mus musculus
gctcccaccaagtatacacggttgt

SEQ ID NO: 566392 - DNA, 25 bp, Mus musculus
gctcccaccggcagtattttgataa

SEQ ID NO: 566393 - DNA, 25 bp, Mus musculus
gctcccaccggctgtattttgataa

SEQ ID NO: 566394 - DNA, 25 bp, Mus musculus
gctcccacctacatttaggcatttg

SEQ ID NO: 566395 - DNA, 25 bp, Mus musculus
gctcccacctacttttaggcatttg

SEQ ID NO: 566396 - DNA, 25 bp, Mus musculus
gctcccacctttagcagatagtaga

SEQ ID NO: 566397 - DNA, 25 bp, Mus musculus
gctcccaccttttgcagatagtaga

SEQ ID NO: 566398 - DNA, 25 bp, Mus musculus
gctcccacggtgacttgtttacagc

SEQ ID NO: 566399 - DNA, 25 bp, Mus musculus
gctcccacggtgtcttgtttacagc

SEQ ID NO: 566400 - DNA, 25 bp, Mus musculus
gctcccactaatatcctcctggatg

SEQ ID NO: 566401 - DNA, 25 bp, Mus musculus
gctcccactaatttcctcctggatg

SEQ ID NO: 566402 - DNA, 25 bp, Mus musculus
gctcccagaactcaaaggcacttaa

SEQ ID NO: 566403 - DNA, 25 bp, Mus musculus
gctcccagaactgaaaggcacttaa

SEQ ID NO: 566404 - DNA, 25 bp, Mus musculus
gctcccagagctctgaaatgtctct

SEQ ID NO: 566405 - DNA, 25 bp, Mus musculus
gctcccagagctgtgaaatgtctct

SEQ ID NO: 566406 - DNA, 25 bp, Mus musculus
gctcccagaggacttactgctaagg

SEQ ID NO: 566407 - DNA, 25 bp, Mus musculus
gctcccagaggagttactgctaagg

SEQ ID NO: 566408 - DNA, 25 bp, Mus musculus
gctcccagaggcatcggccattgag

SEQ ID NO: 566409 - DNA, 25 bp, Mus musculus
gctcccagaggcttcggccattgag

SEQ ID NO: 566410 - DNA, 25 bp, Mus musculus
gctcccagagtcaccaatagttacg

SEQ ID NO: 566411 - DNA, 25 bp, Mus musculus
gctcccagagtctccaatagttacg

SEQ ID NO: 566412 - DNA, 25 bp, Mus musculus
gctcccagcaccctacaggaaagtg

SEQ ID NO: 566413 - DNA, 25 bp, Mus musculus
gctcccagcaccgtacaggaaagtg

SEQ ID NO: 566414 - DNA, 25 bp, Mus musculus
gctcccagccttagtggagtaaggt

SEQ ID NO: 566415 - DNA, 25 bp, Mus musculus
gctcccagcctttgtggagtaaggt

SEQ ID NO: 566416 - DNA, 25 bp, Mus musculus
gctcccagcggcaccagtgtaaatt

SEQ ID NO: 566417 - DNA, 25 bp, Mus musculus
gctcccagcggctccagtgtaaatt

SEQ ID NO: 566418 - DNA, 25 bp, Mus musculus
gctcccagctacaggatgcatcatc

SEQ ID NO: 566419 - DNA, 25 bp, Mus musculus
gctcccagctactggatgcatcatc

SEQ ID NO: 566420 - DNA, 25 bp, Mus musculus
gctcccaggagcagcgggcaagcaa

SEQ ID NO: 566421 - DNA, 25 bp, Mus musculus
gctcccaggagctgcgggcaagcaa

SEQ ID NO: 566422 - DNA, 25 bp, Mus musculus
gctcccaggctcagacagccaaggt

SEQ ID NO: 566423 - DNA, 25 bp, Mus musculus
gctcccaggctctgacagccaaggt

SEQ ID NO: 566424 - DNA, 25 bp, Mus musculus
gctcccaggcttccttatgtgtgtt

SEQ ID NO: 566425 - DNA, 25 bp, Mus musculus
gctcccaggcttgcttatgtgtgtt

SEQ ID NO: 566426 - DNA, 25 bp, Mus musculus
gctcccagtacccttttacacaaga

SEQ ID NO: 566427 - DNA, 25 bp, Mus musculus
gctcccagtaccgttttacacaaga

SEQ ID NO: 566428 - DNA, 25 bp, Mus musculus
gctcccataagaatggtccctgtaa

SEQ ID NO: 566429 - DNA, 25 bp, Mus musculus
gctcccataagattggtccctgtaa

SEQ ID NO: 566430 - DNA, 25 bp, Mus musculus
gctcccataaggctagtctgttttt

SEQ ID NO: 566431 - DNA, 25 bp, Mus musculus
gctcccataagggtagtctgttttt

SEQ ID NO: 566432 - DNA, 25 bp, Mus musculus
gctcccatcagcagaattcttggca

SEQ ID NO: 566433 - DNA, 25 bp, Mus musculus
gctcccatcagctgaattcttggca

SEQ ID NO: 566434 - DNA, 25 bp, Mus musculus
gctcccatccagatccagtaaagga

SEQ ID NO: 566435 - DNA, 25 bp, Mus musculus
gctcccatccagttccagtaaagga

SEQ ID NO: 566436 - DNA, 25 bp, Mus musculus
gctcccatctccaggacctgaagga

SEQ ID NO: 566437 - DNA, 25 bp, Mus musculus
gctcccatctcctggacctgaagga

SEQ ID NO: 566438 - DNA, 25 bp, Mus musculus
gctcccatgaagctatctgacatca

SEQ ID NO: 566439 - DNA, 25 bp, Mus musculus
gctcccatgaaggtatctgacatca

SEQ ID NO: 566440 - DNA, 25 bp, Mus musculus
gctcccatgactaccaaggcaaaat

SEQ ID NO: 566441 - DNA, 25 bp, Mus musculus
gctcccatgacttccaaggcaaaat

SEQ ID NO: 566442 - DNA, 25 bp, Mus musculus
gctcccatgagtagatttcagcatt

SEQ ID NO: 566443 - DNA, 25 bp, Mus musculus
gctcccatgagtcacataggtgctg

SEQ ID NO: 566444 - DNA, 25 bp, Mus musculus
gctcccatgagtgacataggtgctg

SEQ ID NO: 566445 - DNA, 25 bp, Mus musculus
gctcccatgagttgatttcagcatt

SEQ ID NO: 566446 - DNA, 25 bp, Mus musculus
gctcccatgatgacactattttgat

SEQ ID NO: 566447 - DNA, 25 bp, Mus musculus
gctcccatgatgtcactattttgat

SEQ ID NO: 566448 - DNA, 25 bp, Mus musculus
gctcccatgcttatcttgttctgtg

SEQ ID NO: 566449 - DNA, 25 bp, Mus musculus
gctcccatgcttttcttgttctgtg

SEQ ID NO: 566450 - DNA, 25 bp, Mus musculus
gctcccatggacacgagtgtttgca

SEQ ID NO: 566451 - DNA, 25 bp, Mus musculus
gctcccatggactcgagtgtttgca

SEQ ID NO: 566452 - DNA, 25 bp, Mus musculus
gctcccatggagatagtgcaggcac

SEQ ID NO: 566453 - DNA, 25 bp, Mus musculus
gctcccatggagttagtgcaggcac

SEQ ID NO: 566454 - DNA, 25 bp, Mus musculus
gctcccatggtacttgttctgtttg

SEQ ID NO: 566455 - DNA, 25 bp, Mus musculus
gctcccatggtagttgttctgtttg

SEQ ID NO: 566456 - DNA, 25 bp, Mus musculus
gctcccatggttataggttgcacga

SEQ ID NO: 566457 - DNA, 25 bp, Mus musculus
gctcccatggttttaggttgcacga

SEQ ID NO: 566458 - DNA, 25 bp, Mus musculus
gctcccattccacgctttagtagat

SEQ ID NO: 566459 - DNA, 25 bp, Mus musculus
gctcccattccaggctttagtagat

SEQ ID NO: 566460 - DNA, 25 bp, Mus musculus
gctcccattgacatcatgcttttga

SEQ ID NO: 566461 - DNA, 25 bp, Mus musculus
gctcccattgacttcatgcttttga

SEQ ID NO: 566462 - DNA, 25 bp, Mus musculus
gctcccatttacaattagcttatca

SEQ ID NO: 566463 - DNA, 25 bp, Mus musculus
gctcccatttactattagcttatca

SEQ ID NO: 566464 - DNA, 25 bp, Mus musculus
gctccccaaattacatttatatctt

SEQ ID NO: 566465 - DNA, 25 bp, Mus musculus
gctccccaaatttcatttatatctt

SEQ ID NO: 566466 - DNA, 25 bp, Mus musculus
gctccccaataaacacaaatacaca

SEQ ID NO: 566467 - DNA, 25 bp, Mus musculus
gctccccaataatcacaaatacaca

SEQ ID NO: 566468 - DNA, 25 bp, Mus musculus
gctccccactccataaagcgagaag

SEQ ID NO: 566469 - DNA, 25 bp, Mus musculus
gctccccactccttaaagcgagaag

SEQ ID NO: 566470 - DNA, 25 bp, Mus musculus
gctccccagtgtctatagttcatga

SEQ ID NO: 566471 - DNA, 25 bp, Mus musculus
gctccccagtgtctccatgaataaa

SEQ ID NO: 566472 - DNA, 25 bp, Mus musculus
gctccccagtgtgtatagttcatga

SEQ ID NO: 566473 - DNA, 25 bp, Mus musculus
gctccccagtgtgtccatgaataaa

SEQ ID NO: 566474 - DNA, 25 bp, Mus musculus
gctccccgaaacagcgcatgctgga

SEQ ID NO: 566475 - DNA, 25 bp, Mus musculus
gctccccgaaactgcgcatgctgga

SEQ ID NO: 566476 - DNA, 25 bp, Mus musculus
gctccccggaaacccgatgagatgg

SEQ ID NO: 566477 - DNA, 25 bp, Mus musculus
gctccccggaaagccgatgagatgg

SEQ ID NO: 566478 - DNA, 25 bp, Mus musculus
gctccccggtgaccttaggactaaa

SEQ ID NO: 566479 - DNA, 25 bp, Mus musculus
gctccccggtgagcttaggactaaa

SEQ ID NO: 566480 - DNA, 25 bp, Mus musculus
gctcccctcagccaaggatggcaag

SEQ ID NO: 566481 - DNA, 25 bp, Mus musculus
gctcccctcagcgaaggatggcaag

SEQ ID NO: 566482 - DNA, 25 bp, Mus musculus
gctcccctgactcggcatctggata

SEQ ID NO: 566483 - DNA, 25 bp, Mus musculus
gctcccctgactgggcatctggata

SEQ ID NO: 566484 - DNA, 25 bp, Mus musculus
gctcccctgcagcttgatgtactgg

SEQ ID NO: 566485 - DNA, 25 bp, Mus musculus
gctcccctgcaggttgatgtactgg

SEQ ID NO: 566486 - DNA, 25 bp, Mus musculus
gctcccctgctcagtggaatatatt

SEQ ID NO: 566487 - DNA, 25 bp, Mus musculus
gctcccctgctctgtggaatatatt

SEQ ID NO: 566488 - DNA, 25 bp, Mus musculus
gctcccctgcttaaagaggccaaaa

SEQ ID NO: 566489 - DNA, 25 bp, Mus musculus
gctcccctgctttaagaggccaaaa

SEQ ID NO: 566490 - DNA, 25 bp, Mus musculus
gctcccctgggaaagtttctctttg

SEQ ID NO: 566491 - DNA, 25 bp, Mus musculus
gctcccctgggatagtttctctttg

SEQ ID NO: 566492 - DNA, 25 bp, Mus musculus
gctccccttagtaggactgaagcaa

SEQ ID NO: 566493 - DNA, 25 bp, Mus musculus
gctccccttagttggactgaagcaa

SEQ ID NO: 566494 - DNA, 25 bp, Mus musculus
gctccccttgaaacatatccagatg

SEQ ID NO: 566495 - DNA, 25 bp, Mus musculus
gctccccttgaatcatatccagatg

SEQ ID NO: 566496 - DNA, 25 bp, Mus musculus
gctccccttgagaacttgcactgaa

SEQ ID NO: 566497 - DNA, 25 bp, Mus musculus
gctccccttgagtacttgcactgaa

SEQ ID NO: 566498 - DNA, 25 bp, Mus musculus
gctccccttgctaatttgtttgtgt

SEQ ID NO: 566499 - DNA, 25 bp, Mus musculus
gctccccttgcttatttgtttgtgt

SEQ ID NO: 566500 - DNA, 25 bp, Mus musculus
gctcccctttctaaggactgaagca

SEQ ID NO: 566501 - DNA, 25 bp, Mus musculus
gctcccctttcttaggactgaagca

SEQ ID NO: 566502 - DNA, 25 bp, Mus musculus
gctcccgaagctctggcaaagtctt

SEQ ID NO: 566503 - DNA, 25 bp, Mus musculus
gctcccgaagctgtggcaaagtctt

SEQ ID NO: 566504 - DNA, 25 bp, Mus musculus
gctcccgaaggaagctagactaata

SEQ ID NO: 566505 - DNA, 25 bp, Mus musculus
gctcccgaaggatgctagactaata

SEQ ID NO: 566506 - DNA, 25 bp, Mus musculus
gctcccgagagcatgtggtagactt

SEQ ID NO: 566507 - DNA, 25 bp, Mus musculus
gctcccgagagcttgtggtagactt

SEQ ID NO: 566508 - DNA, 25 bp, Mus musculus
gctcccgagttcatgtcagtgttgt

SEQ ID NO: 566509 - DNA, 25 bp, Mus musculus
gctcccgagttcttgtcagtgttgt

SEQ ID NO: 566510 - DNA, 25 bp, Mus musculus
gctcccgctcatacatacttggaag

SEQ ID NO: 566511 - DNA, 25 bp, Mus musculus
gctcccgctcattcatacttggaag

SEQ ID NO: 566512 - DNA, 25 bp, Mus musculus
gctcccggcaacatttttgctattt

SEQ ID NO: 566513 - DNA, 25 bp, Mus musculus
gctcccggcaacttttttgctattt

SEQ ID NO: 566514 - DNA, 25 bp, Mus musculus
gctcccgggagcagtactttacaga

SEQ ID NO: 566515 - DNA, 25 bp, Mus musculus
gctcccgggagctgtactttacaga

SEQ ID NO: 566516 - DNA, 25 bp, Mus musculus
gctcccgggaggaggcccaaacaag

SEQ ID NO: 566517 - DNA, 25 bp, Mus musculus
gctcccgggaggtggcccaaacaag

SEQ ID NO: 566518 - DNA, 25 bp, Mus musculus
gctcccgggatgaccgagctggaga

SEQ ID NO: 566519 - DNA, 25 bp, Mus musculus
gctcccgggatgatcagtcctgaga

SEQ ID NO: 566520 - DNA, 25 bp, Mus musculus
gctcccgggatgtccgagctggaga

SEQ ID NO: 566521 - DNA, 25 bp, Mus musculus
gctcccgggatgttcagtcctgaga

SEQ ID NO: 566522 - DNA, 25 bp, Mus musculus
gctcccggttttctgtttacagtga

SEQ ID NO: 566523 - DNA, 25 bp, Mus musculus
gctcccggttttgtgtttacagtga

SEQ ID NO: 566524 - DNA, 25 bp, Mus musculus
gctcccgtcctactttgtgagacag

SEQ ID NO: 566525 - DNA, 25 bp, Mus musculus
gctcccgtcctagtttgtgagacag

SEQ ID NO: 566526 - DNA, 25 bp, Mus musculus
gctccctaagctccaagttggtttc

SEQ ID NO: 566527 - DNA, 25 bp, Mus musculus
gctccctaagctgcaagttggtttc

SEQ ID NO: 566528 - DNA, 25 bp, Mus musculus
gctccctaagtacctttaaaatctg

SEQ ID NO: 566529 - DNA, 25 bp, Mus musculus
gctccctaagtagctttaaaatctg

SEQ ID NO: 566530 - DNA, 25 bp, Mus musculus
gctccctaagttacctagaaagccg

SEQ ID NO: 566531 - DNA, 25 bp, Mus musculus
gctccctaagtttcctagaaagccg

SEQ ID NO: 566532 - DNA, 25 bp, Mus musculus
gctccctacctgctaagcattgagg

SEQ ID NO: 566533 - DNA, 25 bp, Mus musculus
gctccctacctggtaagcattgagg

SEQ ID NO: 566534 - DNA, 25 bp, Mus musculus
gctccctagggactcctgagaactg

SEQ ID NO: 566535 - DNA, 25 bp, Mus musculus
gctccctagggagtcctgagaactg

SEQ ID NO: 566536 - DNA, 25 bp, Mus musculus
gctccctagtggatacagttctgaa

SEQ ID NO: 566537 - DNA, 25 bp, Mus musculus
gctccctagtggttacagttctgaa

SEQ ID NO: 566538 - DNA, 25 bp, Mus musculus
gctccctataaactcacaaagtttg

SEQ ID NO: 566539 - DNA, 25 bp, Mus musculus
gctccctataaagtcacaaagtttg

SEQ ID NO: 566540 - DNA, 25 bp, Mus musculus
gctccctatcctaaaaatgcagagg

SEQ ID NO: 566541 - DNA, 25 bp, Mus musculus
gctccctatccttaaaatgcagagg

SEQ ID NO: 566542 - DNA, 25 bp, Mus musculus
gctccctcaattatgattcttctct

SEQ ID NO: 566543 - DNA, 25 bp, Mus musculus
gctccctcaattttgattcttctct

SEQ ID NO: 566544 - DNA, 25 bp, Mus musculus
gctccctcaggcaagtgatgtcatg

SEQ ID NO: 566545 - DNA, 25 bp, Mus musculus
gctccctcaggctagtgatgtcatg

SEQ ID NO: 566546 - DNA, 25 bp, Mus musculus
gctccctccatgaccaaataaacag

SEQ ID NO: 566547 - DNA, 25 bp, Mus musculus
gctccctccatgtccaaataaacag

SEQ ID NO: 566548 - DNA, 25 bp, Mus musculus
gctccctcgtagcaagcagccatgt

SEQ ID NO: 566549 - DNA, 25 bp, Mus musculus
gctccctcgtaggaagcagccatgt

SEQ ID NO: 566550 - DNA, 25 bp, Mus musculus
gctccctctccgagttgcagagtca

SEQ ID NO: 566551 - DNA, 25 bp, Mus musculus
gctccctctccgtgttgcagagtca

SEQ ID NO: 566552 - DNA, 25 bp, Mus musculus
gctccctctgggactgtaagtcagg

SEQ ID NO: 566553 - DNA, 25 bp, Mus musculus
gctccctctgggattttataagatt

SEQ ID NO: 566554 - DNA, 25 bp, Mus musculus
gctccctctgggtctgtaagtcagg

SEQ ID NO: 566555 - DNA, 25 bp, Mus musculus
gctccctctgggtttttataagatt

SEQ ID NO: 566556 - DNA, 25 bp, Mus musculus
gctccctctgttaggattggaatgg

SEQ ID NO: 566557 - DNA, 25 bp, Mus musculus
gctccctctgttctccagtacagga

SEQ ID NO: 566558 - DNA, 25 bp, Mus musculus
gctccctctgttgtccagtacagga

SEQ ID NO: 566559 - DNA, 25 bp, Mus musculus
gctccctctgtttggattggaatgg

SEQ ID NO: 566560 - DNA, 25 bp, Mus musculus
gctccctcttctactcaggtgaaaa

SEQ ID NO: 566561 - DNA, 25 bp, Mus musculus
gctccctcttcttctcaggtgaaaa

SEQ ID NO: 566562 - DNA, 25 bp, Mus musculus
gctccctcttggataaactactcca

SEQ ID NO: 566563 - DNA, 25 bp, Mus musculus
gctccctcttggttaaactactcca

SEQ ID NO: 566564 - DNA, 25 bp, Mus musculus
gctccctgaataatgctaactctgc

SEQ ID NO: 566565 - DNA, 25 bp, Mus musculus
gctccctgaatacagactctcaaga

SEQ ID NO: 566566 - DNA, 25 bp, Mus musculus
gctccctgaatagagactctcaaga

SEQ ID NO: 566567 - DNA, 25 bp, Mus musculus
gctccctgaatattgctaactctgc

SEQ ID NO: 566568 - DNA, 25 bp, Mus musculus
gctccctgacatcattcgtaatgtt

SEQ ID NO: 566569 - DNA, 25 bp, Mus musculus
gctccctgacatgattcgtaatgtt

SEQ ID NO: 566570 - DNA, 25 bp, Mus musculus
gctccctgcacaccaagtggactaa

SEQ ID NO: 566571 - DNA, 25 bp, Mus musculus
gctccctgcacagcaagtggactaa

SEQ ID NO: 566572 - DNA, 25 bp, Mus musculus
gctccctgccgtaaatgtacatttt

SEQ ID NO: 566573 - DNA, 25 bp, Mus musculus
gctccctgccgttaatgtacatttt

SEQ ID NO: 566574 - DNA, 25 bp, Mus musculus
gctccctggcttagtacctaattaa

SEQ ID NO: 566575 - DNA, 25 bp, Mus musculus
gctccctggctttgtacctaattaa

SEQ ID NO: 566576 - DNA, 25 bp, Mus musculus
gctccctgggaaacagtaagcactc

SEQ ID NO: 566577 - DNA, 25 bp, Mus musculus
gctccctgggaatcagtaagcactc

SEQ ID NO: 566578 - DNA, 25 bp, Mus musculus
gctccctggtcacaaggttcagtta

SEQ ID NO: 566579 - DNA, 25 bp, Mus musculus
gctccctggtcacccataagacgga

SEQ ID NO: 566580 - DNA, 25 bp, Mus musculus
gctccctggtcagaaggttcagtta

SEQ ID NO: 566581 - DNA, 25 bp, Mus musculus
gctccctggtcagccataagacgga

SEQ ID NO: 566582 - DNA, 25 bp, Mus musculus
gctccctggtggagctttttaaggt

SEQ ID NO: 566583 - DNA, 25 bp, Mus musculus
gctccctggtggtgctttttaaggt

SEQ ID NO: 566584 - DNA, 25 bp, Mus musculus
gctccctgtagcatgtaggccagag

SEQ ID NO: 566585 - DNA, 25 bp, Mus musculus
gctccctgtagcttgtaggccagag

SEQ ID NO: 566586 - DNA, 25 bp, Mus musculus
gctccctgtcttctaacaaaaggag

SEQ ID NO: 566587 - DNA, 25 bp, Mus musculus
gctccctgtcttgtaacaaaaggag

SEQ ID NO: 566588 - DNA, 25 bp, Mus musculus
gctccctgtggtagtccagattcaa

SEQ ID NO: 566589 - DNA, 25 bp, Mus musculus
gctccctgtggttgtccagattcaa

SEQ ID NO: 566590 - DNA, 25 bp, Mus musculus
gctccctgtttgaatacccttgaga

SEQ ID NO: 566591 - DNA, 25 bp, Mus musculus
gctccctgtttgtatacccttgaga

SEQ ID NO: 566592 - DNA, 25 bp, Mus musculus
gctcccttacatactagacctatgt

SEQ ID NO: 566593 - DNA, 25 bp, Mus musculus
gctcccttacattctagacctatgt

SEQ ID NO: 566594 - DNA, 25 bp, Mus musculus
gctcccttactcatagatgaatcag

SEQ ID NO: 566595 - DNA, 25 bp, Mus musculus
gctcccttactcttagatgaatcag

SEQ ID NO: 566596 - DNA, 25 bp, Mus musculus
gctcccttatgtcaatgccttcatg

SEQ ID NO: 566597 - DNA, 25 bp, Mus musculus
gctcccttatgtgaatgccttcatg

SEQ ID NO: 566598 - DNA, 25 bp, Mus musculus
gctcccttcatccaatgtcatgggc

SEQ ID NO: 566599 - DNA, 25 bp, Mus musculus
gctcccttcatcgaatgtcatgggc

SEQ ID NO: 566600 - DNA, 25 bp, Mus musculus
gctcccttcccacatgagatgtgaa

SEQ ID NO: 566601 - DNA, 25 bp, Mus musculus
gctcccttcccagatgagatgtgaa

SEQ ID NO: 566602 - DNA, 25 bp, Mus musculus
gctcccttgagcaaatggaacaaat

SEQ ID NO: 566603 - DNA, 25 bp, Mus musculus
gctcccttgagcagatgtttatgaa

SEQ ID NO: 566604 - DNA, 25 bp, Mus musculus
gctcccttgagctaatggaacaaat

SEQ ID NO: 566605 - DNA, 25 bp, Mus musculus
gctcccttgagctgatgtttatgaa

SEQ ID NO: 566606 - DNA, 25 bp, Mus musculus
gctcccttggagagcagctgacaag

SEQ ID NO: 566607 - DNA, 25 bp, Mus musculus
gctcccttggagtgcagctgacaag

SEQ ID NO: 566608 - DNA, 25 bp, Mus musculus
gctcccttgggtactgtgtctgtca

SEQ ID NO: 566609 - DNA, 25 bp, Mus musculus
gctcccttgggttctgtgtctgtca

SEQ ID NO: 566610 - DNA, 25 bp, Mus musculus
gctcccttgtaaaaaagcagccacg

SEQ ID NO: 566611 - DNA, 25 bp, Mus musculus
gctcccttgtaaacctcagaactaa

SEQ ID NO: 566612 - DNA, 25 bp, Mus musculus
gctcccttgtaataaagcagccacg

SEQ ID NO: 566613 - DNA, 25 bp, Mus musculus
gctcccttgtaatcctcagaactaa

SEQ ID NO: 566614 - DNA, 25 bp, Mus musculus
gctcccttgtgccataggtttttat

SEQ ID NO: 566615 - DNA, 25 bp, Mus musculus
gctcccttgtgcgataggtttttat

SEQ ID NO: 566616 - DNA, 25 bp, Mus musculus
gctccgaaaggccttggttcctggt

SEQ ID NO: 566617 - DNA, 25 bp, Mus musculus
gctccgaaaggcgttggttcctggt

SEQ ID NO: 566618 - DNA, 25 bp, Mus musculus
gctccgaagagcaaatactttttaa

SEQ ID NO: 566619 - DNA, 25 bp, Mus musculus
gctccgaagagctaatactttttaa

SEQ ID NO: 566620 - DNA, 25 bp, Mus musculus
gctccgaagctccaactgtgttcta

SEQ ID NO: 566621 - DNA, 25 bp, Mus musculus
gctccgaagctcgaactgtgttcta

SEQ ID NO: 566622 - DNA, 25 bp, Mus musculus
gctccgaagtgcacctgttagcaaa

SEQ ID NO: 566623 - DNA, 25 bp, Mus musculus
gctccgaagtgctcctgttagcaaa

SEQ ID NO: 566624 - DNA, 25 bp, Mus musculus
gctccgacgaccattgttccaaaag

SEQ ID NO: 566625 - DNA, 25 bp, Mus musculus
gctccgacgacctttgttccaaaag

SEQ ID NO: 566626 - DNA, 25 bp, Mus musculus
gctccgagaagcagcaagccctctg

SEQ ID NO: 566627 - DNA, 25 bp, Mus musculus
gctccgagaagcatctttcacttag

SEQ ID NO: 566628 - DNA, 25 bp, Mus musculus
gctccgagaagctgcaagccctctg

SEQ ID NO: 566629 - DNA, 25 bp, Mus musculus
gctccgagaagcttctttcacttag

SEQ ID NO: 566630 - DNA, 25 bp, Mus musculus
gctccgagctatatccagatgcata

SEQ ID NO: 566631 - DNA, 25 bp, Mus musculus
gctccgagctatttccagatgcata

SEQ ID NO: 566632 - DNA, 25 bp, Mus musculus
gctccgaggctccagagtttggaat

SEQ ID NO: 566633 - DNA, 25 bp, Mus musculus
gctccgaggctcgagagtttggaat

SEQ ID NO: 566634 - DNA, 25 bp, Mus musculus
gctccgagtatgaacagaccgtcta

SEQ ID NO: 566635 - DNA, 25 bp, Mus musculus
gctccgagtatgtacagaccgtcta

SEQ ID NO: 566636 - DNA, 25 bp, Mus musculus
gctccgatgctcagggccgcggatc

SEQ ID NO: 566637 - DNA, 25 bp, Mus musculus
gctccgatgctctgggccgcggatc

SEQ ID NO: 566638 - DNA, 25 bp, Mus musculus
gctccgatggaaacaaccgagatct

SEQ ID NO: 566639 - DNA, 25 bp, Mus musculus
gctccgatggaatcaaccgagatct

SEQ ID NO: 566640 - DNA, 25 bp, Mus musculus
gctccgcagatacatcaacacactg

SEQ ID NO: 566641 - DNA, 25 bp, Mus musculus
gctccgcagatagatcaacacactg

SEQ ID NO: 566642 - DNA, 25 bp, Mus musculus
gctccgccttaaacactgacatgta

SEQ ID NO: 566643 - DNA, 25 bp, Mus musculus
gctccgccttaatcactgacatgta

SEQ ID NO: 566644 - DNA, 25 bp, Mus musculus
gctccgcggtagagtacattcgtgc

SEQ ID NO: 566645 - DNA, 25 bp, Mus musculus
gctccgcggtagtgtacattcgtgc

SEQ ID NO: 566646 - DNA, 25 bp, Mus musculus
gctccgctaccacaagtgtctggat

SEQ ID NO: 566647 - DNA, 25 bp, Mus musculus
gctccgctaccagaagtgtctggat

SEQ ID NO: 566648 - DNA, 25 bp, Mus musculus
gctccgctgagcaaagttgtgtctt

SEQ ID NO: 566649 - DNA, 25 bp, Mus musculus
gctccgctgagctaagttgtgtctt

SEQ ID NO: 566650 - DNA, 25 bp, Mus musculus
gctccgctgggcacggccaggaatg

SEQ ID NO: 566651 - DNA, 25 bp, Mus musculus
gctccgctgggctcggccaggaatg

SEQ ID NO: 566652 - DNA, 25 bp, Mus musculus
gctccgcttgctcgcatcgtctggg

SEQ ID NO: 566653 - DNA, 25 bp, Mus musculus
gctccgcttgctggcatcgtctggg

SEQ ID NO: 566654 - DNA, 25 bp, Mus musculus
gctccggaactaagtcccagaggat

SEQ ID NO: 566655 - DNA, 25 bp, Mus musculus
gctccggaactatgtcccagaggat

SEQ ID NO: 566656 - DNA, 25 bp, Mus musculus
gctccggaaggccattgaaggctct

SEQ ID NO: 566657 - DNA, 25 bp, Mus musculus
gctccggaaggcgattgaaggctct

SEQ ID NO: 566658 - DNA, 25 bp, Mus musculus
gctccggacctaccaagaactggaa

SEQ ID NO: 566659 - DNA, 25 bp, Mus musculus
gctccggacctagcaagaactggaa

SEQ ID NO: 566660 - DNA, 25 bp, Mus musculus
gctccggagtctacaggctgattaa

SEQ ID NO: 566661 - DNA, 25 bp, Mus musculus
gctccggagtcttcaggctgattaa

SEQ ID NO: 566662 - DNA, 25 bp, Mus musculus
gctccggagtgtactgcagatgaat

SEQ ID NO: 566663 - DNA, 25 bp, Mus musculus
gctccggagtgttctgcagatgaat

SEQ ID NO: 566664 - DNA, 25 bp, Mus musculus
gctccggatccgcaggacgagggag

SEQ ID NO: 566665 - DNA, 25 bp, Mus musculus
gctccggatccggaggacgagggag

SEQ ID NO: 566666 - DNA, 25 bp, Mus musculus
gctccggatcgacttgcatgggcat

SEQ ID NO: 566667 - DNA, 25 bp, Mus musculus
gctccggatcgagttgcatgggcat

SEQ ID NO: 566668 - DNA, 25 bp, Mus musculus
gctccggcaggcataatgcacggtg

SEQ ID NO: 566669 - DNA, 25 bp, Mus musculus
gctccggcaggcttaatgcacggtg

SEQ ID NO: 566670 - DNA, 25 bp, Mus musculus
gctccggcctgtcctttttgtttat

SEQ ID NO: 566671 - DNA, 25 bp, Mus musculus
gctccggcctgtgctttttgtttat

SEQ ID NO: 566672 - DNA, 25 bp, Mus musculus
gctccggcttcgagaaccattggga

SEQ ID NO: 566673 - DNA, 25 bp, Mus musculus
gctccggcttcgtgaaccattggga

SEQ ID NO: 566674 - DNA, 25 bp, Mus musculus
gctccgggtgaacgtcagctatcta

SEQ ID NO: 566675 - DNA, 25 bp, Mus musculus
gctccgggtgaaggtcagctatcta

SEQ ID NO: 566676 - DNA, 25 bp, Mus musculus
gctccggtaatgacctccatgatac

SEQ ID NO: 566677 - DNA, 25 bp, Mus musculus
gctccggtaatgtcctccatgatac

SEQ ID NO: 566678 - DNA, 25 bp, Mus musculus
gctccggtgattcccacgatatgat

SEQ ID NO: 566679 - DNA, 25 bp, Mus musculus
gctccggtgattgccacgatatgat

SEQ ID NO: 566680 - DNA, 25 bp, Mus musculus
gctccggtggcgagctaacctagta

SEQ ID NO: 566681 - DNA, 25 bp, Mus musculus
gctccggtggcgtgctaacctagta

SEQ ID NO: 566682 - DNA, 25 bp, Mus musculus
gctccggtgttgactgttgatgtat

SEQ ID NO: 566683 - DNA, 25 bp, Mus musculus
gctccggtgttgtctgttgatgtat

SEQ ID NO: 566684 - DNA, 25 bp, Mus musculus
gctccggttccacatttgactgatt

SEQ ID NO: 566685 - DNA, 25 bp, Mus musculus
gctccggttccagatttgactgatt

SEQ ID NO: 566686 - DNA, 25 bp, Mus musculus
gctccggtttttaccaatcagggtg

SEQ ID NO: 566687 - DNA, 25 bp, Mus musculus
gctccggttttttccaatcagggtg

SEQ ID NO: 566688 - DNA, 25 bp, Mus musculus
gctccgtaatgtatacaatgtgctc

SEQ ID NO: 566689 - DNA, 25 bp, Mus musculus
gctccgtaatgtttacaatgtgctc

SEQ ID NO: 566690 - DNA, 25 bp, Mus musculus
gctccgtacgttattgctgggtagt

SEQ ID NO: 566691 - DNA, 25 bp, Mus musculus
gctccgtacgtttttgctgggtagt

SEQ ID NO: 566692 - DNA, 25 bp, Mus musculus
gctccgttagctattacagggcggg

SEQ ID NO: 566693 - DNA, 25 bp, Mus musculus
gctccgttagcttttacagggcggg

SEQ ID NO: 566694 - DNA, 25 bp, Mus musculus
gctccgttatccagctagattgtga

SEQ ID NO: 566695 - DNA, 25 bp, Mus musculus
gctccgttatcctgctagattgtga

SEQ ID NO: 566696 - DNA, 25 bp, Mus musculus
gctccgttcaggattaatatggttc

SEQ ID NO: 566697 - DNA, 25 bp, Mus musculus
gctccgttcaggtttaatatggttc

SEQ ID NO: 566698 - DNA, 25 bp, Mus musculus
gctccgttctgcaagatgatccaat

SEQ ID NO: 566699 - DNA, 25 bp, Mus musculus
gctccgttctgctagatgatccaat

SEQ ID NO: 566700 - DNA, 25 bp, Mus musculus
gctccgtttgcacacagaccaatgt

SEQ ID NO: 566701 - DNA, 25 bp, Mus musculus
gctccgtttgcagacagaccaatgt

SEQ ID NO: 566702 - DNA, 25 bp, Mus musculus
gctcctaaaagtaatggtagcatga

SEQ ID NO: 566703 - DNA, 25 bp, Mus musculus
gctcctaaaagttatggtagcatga

SEQ ID NO: 566704 - DNA, 25 bp, Mus musculus
gctcctaaatagagttttcctgtta

SEQ ID NO: 566705 - DNA, 25 bp, Mus musculus
gctcctaaatagtgttttcctgtta

SEQ ID NO: 566706 - DNA, 25 bp, Mus musculus
gctcctaacagccattataacttca

SEQ ID NO: 566707 - DNA, 25 bp, Mus musculus
gctcctaacagcgattataacttca

SEQ ID NO: 566708 - DNA, 25 bp, Mus musculus
gctcctaagagccacaggtcttgat

SEQ ID NO: 566709 - DNA, 25 bp, Mus musculus
gctcctaagagcgacaggtcttgat

SEQ ID NO: 566710 - DNA, 25 bp, Mus musculus
gctcctacactaactgcatacactg

SEQ ID NO: 566711 - DNA, 25 bp, Mus musculus
gctcctacactatctgcatacactg

SEQ ID NO: 566712 - DNA, 25 bp, Mus musculus
gctcctacaggcatccgtgtggtaa

SEQ ID NO: 566713 - DNA, 25 bp, Mus musculus
gctcctacaggcttccgtgtggtaa

SEQ ID NO: 566714 - DNA, 25 bp, Mus musculus
gctcctacagttctaccatcagggt

SEQ ID NO: 566715 - DNA, 25 bp, Mus musculus
gctcctacagttgtaccatcagggt

SEQ ID NO: 566716 - DNA, 25 bp, Mus musculus
gctcctacataaattttcagtgcta

SEQ ID NO: 566717 - DNA, 25 bp, Mus musculus
gctcctacataatttttcagtgcta

SEQ ID NO: 566718 - DNA, 25 bp, Mus musculus
gctcctacatcccttaggtgttttt

SEQ ID NO: 566719 - DNA, 25 bp, Mus musculus
gctcctacatccgttaggtgttttt

SEQ ID NO: 566720 - DNA, 25 bp, Mus musculus
gctcctaccaaacatgtgctgactc

SEQ ID NO: 566721 - DNA, 25 bp, Mus musculus
gctcctaccaaagatgtgctgactc

SEQ ID NO: 566722 - DNA, 25 bp, Mus musculus
gctcctaccagcatatgttgccaga

SEQ ID NO: 566723 - DNA, 25 bp, Mus musculus
gctcctaccagcttatgttgccaga

SEQ ID NO: 566724 - DNA, 25 bp, Mus musculus
gctcctaccaggcaactgagggtta

SEQ ID NO: 566725 - DNA, 25 bp, Mus musculus
gctcctaccagggaactgagggtta

SEQ ID NO: 566726 - DNA, 25 bp, Mus musculus
gctcctacctggcagagatggagac

SEQ ID NO: 566727 - DNA, 25 bp, Mus musculus
gctcctacctgggagagatggagac

SEQ ID NO: 566728 - DNA, 25 bp, Mus musculus
gctcctacgaaacactcgtggattt

SEQ ID NO: 566729 - DNA, 25 bp, Mus musculus
gctcctacgaaagactcgtggattt

SEQ ID NO: 566730 - DNA, 25 bp, Mus musculus
gctcctactccaacaattttgttca

SEQ ID NO: 566731 - DNA, 25 bp, Mus musculus
gctcctactccatcaattttgttca

SEQ ID NO: 566732 - DNA, 25 bp, Mus musculus
gctcctactgttactctggaaatgg

SEQ ID NO: 566733 - DNA, 25 bp, Mus musculus
gctcctactgtttctctggaaatgg

SEQ ID NO: 566734 - DNA, 25 bp, Mus musculus
gctcctagaaatcaacttgcatagt

SEQ ID NO: 566735 - DNA, 25 bp, Mus musculus
gctcctagaaatgaacttgcatagt

SEQ ID NO: 566736 - DNA, 25 bp, Mus musculus
gctcctagagtcctcatggagggat

SEQ ID NO: 566737 - DNA, 25 bp, Mus musculus
gctcctagagtcgtcatggagggat

SEQ ID NO: 566738 - DNA, 25 bp, Mus musculus
gctcctagcgctaatgtttgagtat

SEQ ID NO: 566739 - DNA, 25 bp, Mus musculus
gctcctagcgcttatgtttgagtat

SEQ ID NO: 566740 - DNA, 25 bp, Mus musculus
gctcctaggactatggctacttata

SEQ ID NO: 566741 - DNA, 25 bp, Mus musculus
gctcctaggactttggctacttata

SEQ ID NO: 566742 - DNA, 25 bp, Mus musculus
gctcctagggctctatatgctgcat

SEQ ID NO: 566743 - DNA, 25 bp, Mus musculus
gctcctagggctgtatatgctgcat

SEQ ID NO: 566744 - DNA, 25 bp, Mus musculus
gctcctaggtctactcaagcagagg

SEQ ID NO: 566745 - DNA, 25 bp, Mus musculus
gctcctaggtcttctcaagcagagg

SEQ ID NO: 566746 - DNA, 25 bp, Mus musculus
gctcctagtggtccttgggcaataa

SEQ ID NO: 566747 - DNA, 25 bp, Mus musculus
gctcctagtggtgcttgggcaataa

SEQ ID NO: 566748 - DNA, 25 bp, Mus musculus
gctcctagttaaactcaaaggcaga

SEQ ID NO: 566749 - DNA, 25 bp, Mus musculus
gctcctagttaatctcaaaggcaga

SEQ ID NO: 566750 - DNA, 25 bp, Mus musculus
gctcctatcatacgtcaagcacgtg

SEQ ID NO: 566751 - DNA, 25 bp, Mus musculus
gctcctatcataggtcaagcacgtg

SEQ ID NO: 566752 - DNA, 25 bp, Mus musculus
gctcctatccttacaggattccgtt

SEQ ID NO: 566753 - DNA, 25 bp, Mus musculus
gctcctatcctttcaggattccgtt

SEQ ID NO: 566754 - DNA, 25 bp, Mus musculus
gctcctatctggcaaactgtgggat

SEQ ID NO: 566755 - DNA, 25 bp, Mus musculus
gctcctatctgggaaactgtgggat

SEQ ID NO: 566756 - DNA, 25 bp, Mus musculus
gctcctatgactacactgtaagatt

SEQ ID NO: 566757 - DNA, 25 bp, Mus musculus
gctcctatgacttcactgtaagatt

SEQ ID NO: 566758 - DNA, 25 bp, Mus musculus
gctcctatgggaacatccgagccgt

SEQ ID NO: 566759 - DNA, 25 bp, Mus musculus
gctcctatgggatcatccgagccgt

SEQ ID NO: 566760 - DNA, 25 bp, Mus musculus
gctcctattctgattatttgttgtt

SEQ ID NO: 566761 - DNA, 25 bp, Mus musculus
gctcctattctgtttatttgttgtt

SEQ ID NO: 566762 - DNA, 25 bp, Mus musculus
gctcctcaaagccactgacgtttat

SEQ ID NO: 566763 - DNA, 25 bp, Mus musculus
gctcctcaaagcgactgacgtttat

SEQ ID NO: 566764 - DNA, 25 bp, Mus musculus
gctcctcaaagtagccatctagatg

SEQ ID NO: 566765 - DNA, 25 bp, Mus musculus
gctcctcaaagttgccatctagatg

SEQ ID NO: 566766 - DNA, 25 bp, Mus musculus
gctcctcaatgtagaagctccgttc

SEQ ID NO: 566767 - DNA, 25 bp, Mus musculus
gctcctcaatgttgaagctccgttc

SEQ ID NO: 566768 - DNA, 25 bp, Mus musculus
gctcctcacggtcctgtgctggaca

SEQ ID NO: 566769 - DNA, 25 bp, Mus musculus
gctcctcacggtgctgtgctggaca

SEQ ID NO: 566770 - DNA, 25 bp, Mus musculus
gctcctcagcgcattgggaagaagt

SEQ ID NO: 566771 - DNA, 25 bp, Mus musculus
gctcctcagcgctttgggaagaagt

SEQ ID NO: 566772 - DNA, 25 bp, Mus musculus
gctcctcatctcctaagcggagaaa

SEQ ID NO: 566773 - DNA, 25 bp, Mus musculus
gctcctcatctcgtaagcggagaaa

SEQ ID NO: 566774 - DNA, 25 bp, Mus musculus
gctcctcattgtcgtgtttgtgtat

SEQ ID NO: 566775 - DNA, 25 bp, Mus musculus
gctcctcattgtggtgtttgtgtat

SEQ ID NO: 566776 - DNA, 25 bp, Mus musculus
gctcctccaaaaaatcttgtctctg

SEQ ID NO: 566777 - DNA, 25 bp, Mus musculus
gctcctccaaaatatcttgtctctg

SEQ ID NO: 566778 - DNA, 25 bp, Mus musculus
gctcctccatccaattgatacagta

SEQ ID NO: 566779 - DNA, 25 bp, Mus musculus
gctcctccatcctattgatacagta

SEQ ID NO: 566780 - DNA, 25 bp, Mus musculus
gctcctcccagacttggagtaacta

SEQ ID NO: 566781 - DNA, 25 bp, Mus musculus
gctcctcccagagttggagtaacta

SEQ ID NO: 566782 - DNA, 25 bp, Mus musculus
gctcctccctctattctatgaggaa

SEQ ID NO: 566783 - DNA, 25 bp, Mus musculus
gctcctccctcttttctatgaggaa

SEQ ID NO: 566784 - DNA, 25 bp, Mus musculus
gctcctcctagcatacattttttga

SEQ ID NO: 566785 - DNA, 25 bp, Mus musculus
gctcctcctagcttacattttttga

SEQ ID NO: 566786 - DNA, 25 bp, Mus musculus
gctcctcctcagacacggaacggta

SEQ ID NO: 566787 - DNA, 25 bp, Mus musculus
gctcctcctcagtcacggaacggta

SEQ ID NO: 566788 - DNA, 25 bp, Mus musculus
gctcctcctgacagggtgtggcgca

SEQ ID NO: 566789 - DNA, 25 bp, Mus musculus
gctcctcctgacattggctaataaa

SEQ ID NO: 566790 - DNA, 25 bp, Mus musculus
gctcctcctgactgggtgtggcgca

SEQ ID NO: 566791 - DNA, 25 bp, Mus musculus
gctcctcctgactttggctaataaa

SEQ ID NO: 566792 - DNA, 25 bp, Mus musculus
gctcctcctgggattttgtgagtat

SEQ ID NO: 566793 - DNA, 25 bp, Mus musculus
gctcctcctgggtttttgtgagtat

SEQ ID NO: 566794 - DNA, 25 bp, Mus musculus
gctcctccttagacctagaattgca

SEQ ID NO: 566795 - DNA, 25 bp, Mus musculus
gctcctccttagagtgctgtgagaa

SEQ ID NO: 566796 - DNA, 25 bp, Mus musculus
gctcctccttagtcctagaattgca

SEQ ID NO: 566797 - DNA, 25 bp, Mus musculus
gctcctccttagtgtgctgtgagaa

SEQ ID NO: 566798 - DNA, 25 bp, Mus musculus
gctcctcgggcactcaaagaaattc

SEQ ID NO: 566799 - DNA, 25 bp, Mus musculus
gctcctcgggcagtcaaagaaattc

SEQ ID NO: 566800 - DNA, 25 bp, Mus musculus
gctcctctcactatgctataaacta

SEQ ID NO: 566801 - DNA, 25 bp, Mus musculus
gctcctctcactttgctataaacta

SEQ ID NO: 566802 - DNA, 25 bp, Mus musculus
gctcctctcctacttggataactgt

SEQ ID NO: 566803 - DNA, 25 bp, Mus musculus
gctcctctcctagttggataactgt

SEQ ID NO: 566804 - DNA, 25 bp, Mus musculus
gctcctctcctgacagacttaaagg

SEQ ID NO: 566805 - DNA, 25 bp, Mus musculus
gctcctctcctgtcagacttaaagg

SEQ ID NO: 566806 - DNA, 25 bp, Mus musculus
gctcctctcggcagaatgtatctgt

SEQ ID NO: 566807 - DNA, 25 bp, Mus musculus
gctcctctcggctgaatgtatctgt

SEQ ID NO: 566808 - DNA, 25 bp, Mus musculus
gctcctctctttcgtcgactagctt

SEQ ID NO: 566809 - DNA, 25 bp, Mus musculus
gctcctctctttggtcgactagctt

SEQ ID NO: 566810 - DNA, 25 bp, Mus musculus
gctcctctgaaaccatgtcacattg

SEQ ID NO: 566811 - DNA, 25 bp, Mus musculus
gctcctctgaaagcatgtcacattg

SEQ ID NO: 566812 - DNA, 25 bp, Mus musculus
gctcctctgattccagatacgacga

SEQ ID NO: 566813 - DNA, 25 bp, Mus musculus
gctcctctgattgcagatacgacga

SEQ ID NO: 566814 - DNA, 25 bp, Mus musculus
gctcctctgctcatagtgtcgggaa

SEQ ID NO: 566815 - DNA, 25 bp, Mus musculus
gctcctctgctcttagtgtcgggaa

SEQ ID NO: 566816 - DNA, 25 bp, Mus musculus
gctcctctggacaacatgattggcc

SEQ ID NO: 566817 - DNA, 25 bp, Mus musculus
gctcctctggactacatgattggcc

SEQ ID NO: 566818 - DNA, 25 bp, Mus musculus
gctcctctggatctttcttttacat

SEQ ID NO: 566819 - DNA, 25 bp, Mus musculus
gctcctctggatgtttcttttacat

SEQ ID NO: 566820 - DNA, 25 bp, Mus musculus
gctcctctgggaagcgaagtttcca

SEQ ID NO: 566821 - DNA, 25 bp, Mus musculus
gctcctctgggatgcgaagtttcca

SEQ ID NO: 566822 - DNA, 25 bp, Mus musculus
gctcctctggttacttgggtaggca

SEQ ID NO: 566823 - DNA, 25 bp, Mus musculus
gctcctctggtttcttgggtaggca

SEQ ID NO: 566824 - DNA, 25 bp, Mus musculus
gctcctctgtgaatgacaagtcctg

SEQ ID NO: 566825 - DNA, 25 bp, Mus musculus
gctcctctgtgattgacaagtcctg

SEQ ID NO: 566826 - DNA, 25 bp, Mus musculus
gctcctcttactcttagtatccaaa

SEQ ID NO: 566827 - DNA, 25 bp, Mus musculus
gctcctcttactgttagtatccaaa

SEQ ID NO: 566828 - DNA, 25 bp, Mus musculus
gctcctcttcacaaatttgtatgta

SEQ ID NO: 566829 - DNA, 25 bp, Mus musculus
gctcctcttcactaatttgtatgta

SEQ ID NO: 566830 - DNA, 25 bp, Mus musculus
gctcctgaaagccacggttgactta

SEQ ID NO: 566831 - DNA, 25 bp, Mus musculus
gctcctgaaagcgacggttgactta

SEQ ID NO: 566832 - DNA, 25 bp, Mus musculus
gctcctgaacaacgtagtaataaga

SEQ ID NO: 566833 - DNA, 25 bp, Mus musculus
gctcctgaacaaggtagtaataaga

SEQ ID NO: 566834 - DNA, 25 bp, Mus musculus
gctcctgaaggacgttcccgagatg

SEQ ID NO: 566835 - DNA, 25 bp, Mus musculus
gctcctgaaggaggttcccgagatg

SEQ ID NO: 566836 - DNA, 25 bp, Mus musculus
gctcctgaagttctggaactcttcc

SEQ ID NO: 566837 - DNA, 25 bp, Mus musculus
gctcctgaagttgtggaactcttcc

SEQ ID NO: 566838 - DNA, 25 bp, Mus musculus
gctcctgacagaagcagacatgccc

SEQ ID NO: 566839 - DNA, 25 bp, Mus musculus
gctcctgacagatgcagacatgccc

SEQ ID NO: 566840 - DNA, 25 bp, Mus musculus
gctcctgacattcatgtgcagctca

SEQ ID NO: 566841 - DNA, 25 bp, Mus musculus
gctcctgacattgatgtgcagctca

SEQ ID NO: 566842 - DNA, 25 bp, Mus musculus
gctcctgactccaggcagtttaaag

SEQ ID NO: 566843 - DNA, 25 bp, Mus musculus
gctcctgactcctggcagtttaaag

SEQ ID NO: 566844 - DNA, 25 bp, Mus musculus
gctcctgactggctacgcggcaaag

SEQ ID NO: 566845 - DNA, 25 bp, Mus musculus
gctcctgactgggtacgcggcaaag

SEQ ID NO: 566846 - DNA, 25 bp, Mus musculus
gctcctgacttcacttctgaagtgt

SEQ ID NO: 566847 - DNA, 25 bp, Mus musculus
gctcctgacttctcttctgaagtgt

SEQ ID NO: 566848 - DNA, 25 bp, Mus musculus
gctcctgagcaacgtctcttttgat

SEQ ID NO: 566849 - DNA, 25 bp, Mus musculus
gctcctgagcaaggtctcttttgat

SEQ ID NO: 566850 - DNA, 25 bp, Mus musculus
gctcctgagctcatgagacttggaa

SEQ ID NO: 566851 - DNA, 25 bp, Mus musculus
gctcctgagctcttgagacttggaa

SEQ ID NO: 566852 - DNA, 25 bp, Mus musculus
gctcctgaggaaccagatgcacgtg

SEQ ID NO: 566853 - DNA, 25 bp, Mus musculus
gctcctgaggaagcagatgcacgtg

SEQ ID NO: 566854 - DNA, 25 bp, Mus musculus
gctcctgaggagactgtcgaacctt

SEQ ID NO: 566855 - DNA, 25 bp, Mus musculus
gctcctgaggagtctgtcgaacctt

SEQ ID NO: 566856 - DNA, 25 bp, Mus musculus
gctcctgaggcaccatctcacagag

SEQ ID NO: 566857 - DNA, 25 bp, Mus musculus
gctcctgaggcactctgacgagaat

SEQ ID NO: 566858 - DNA, 25 bp, Mus musculus
gctcctgaggcagcatctcacagag

SEQ ID NO: 566859 - DNA, 25 bp, Mus musculus
gctcctgaggcagtctgacgagaat

SEQ ID NO: 566860 - DNA, 25 bp, Mus musculus
gctcctgagggtcgctataagcaag

SEQ ID NO: 566861 - DNA, 25 bp, Mus musculus
gctcctgagggtggctataagcaag

SEQ ID NO: 566862 - DNA, 25 bp, Mus musculus
gctcctgataggaacctttgtggca

SEQ ID NO: 566863 - DNA, 25 bp, Mus musculus
gctcctgataggtacctttgtggca

SEQ ID NO: 566864 - DNA, 25 bp, Mus musculus
gctcctgatcaaataaagttagcaa

SEQ ID NO: 566865 - DNA, 25 bp, Mus musculus
gctcctgatcaattaaagttagcaa

SEQ ID NO: 566866 - DNA, 25 bp, Mus musculus
gctcctgatgggattgtgagtcacc

SEQ ID NO: 566867 - DNA, 25 bp, Mus musculus
gctcctgatgggtttgtgagtcacc

SEQ ID NO: 566868 - DNA, 25 bp, Mus musculus
gctcctgatgtaattttgttcacta

SEQ ID NO: 566869 - DNA, 25 bp, Mus musculus
gctcctgatgtatttttgttcacta

SEQ ID NO: 566870 - DNA, 25 bp, Mus musculus
gctcctgcaactatggaagtggctc

SEQ ID NO: 566871 - DNA, 25 bp, Mus musculus
gctcctgcaactttggaagtggctc

SEQ ID NO: 566872 - DNA, 25 bp, Mus musculus
gctcctgcactaaaggtgaccagta

SEQ ID NO: 566873 - DNA, 25 bp, Mus musculus
gctcctgcactataggtgaccagta

SEQ ID NO: 566874 - DNA, 25 bp, Mus musculus
gctcctgcaggacatactatggcta

SEQ ID NO: 566875 - DNA, 25 bp, Mus musculus
gctcctgcaggagatactatggcta

SEQ ID NO: 566876 - DNA, 25 bp, Mus musculus
gctcctgcagtgagagtctccagag

SEQ ID NO: 566877 - DNA, 25 bp, Mus musculus
gctcctgcagtgtgagtctccagag

SEQ ID NO: 566878 - DNA, 25 bp, Mus musculus
gctcctgcataaatcgatcacttgg

SEQ ID NO: 566879 - DNA, 25 bp, Mus musculus
gctcctgcataattcgatcacttgg

SEQ ID NO: 566880 - DNA, 25 bp, Mus musculus
gctcctgcatgtaattgtgcgtaca

SEQ ID NO: 566881 - DNA, 25 bp, Mus musculus
gctcctgcatgttattgtgcgtaca

SEQ ID NO: 566882 - DNA, 25 bp, Mus musculus
gctcctgcatttcactaactgtaat

SEQ ID NO: 566883 - DNA, 25 bp, Mus musculus
gctcctgcatttgactaactgtaat

SEQ ID NO: 566884 - DNA, 25 bp, Mus musculus
gctcctgccacacatgggtggaaca

SEQ ID NO: 566885 - DNA, 25 bp, Mus musculus
gctcctgccacagatgggtggaaca

SEQ ID NO: 566886 - DNA, 25 bp, Mus musculus
gctcctgcctataaagaactgtata

SEQ ID NO: 566887 - DNA, 25 bp, Mus musculus
gctcctgcctattaagaactgtata

SEQ ID NO: 566888 - DNA, 25 bp, Mus musculus
gctcctgcctgcaattacagcattt

SEQ ID NO: 566889 - DNA, 25 bp, Mus musculus
gctcctgcctgcacagaatacagtg

SEQ ID NO: 566890 - DNA, 25 bp, Mus musculus
gctcctgcctgctattacagcattt

SEQ ID NO: 566891 - DNA, 25 bp, Mus musculus
gctcctgcctgctcagaatacagtg

SEQ ID NO: 566892 - DNA, 25 bp, Mus musculus
gctcctgcgatcagcttctgaagtg

SEQ ID NO: 566893 - DNA, 25 bp, Mus musculus
gctcctgcgatctgcttctgaagtg

SEQ ID NO: 566894 - DNA, 25 bp, Mus musculus
gctcctgcggttatttgtcaacaca

SEQ ID NO: 566895 - DNA, 25 bp, Mus musculus
gctcctgcggttttttgtcaacaca

SEQ ID NO: 566896 - DNA, 25 bp, Mus musculus
gctcctgctaggaccctgcagagaa

SEQ ID NO: 566897 - DNA, 25 bp, Mus musculus
gctcctgctaggtccctgcagagaa

SEQ ID NO: 566898 - DNA, 25 bp, Mus musculus
gctcctgctatgaaacaggtgctca

SEQ ID NO: 566899 - DNA, 25 bp, Mus musculus
gctcctgctatgtaacaggtgctca

SEQ ID NO: 566900 - DNA, 25 bp, Mus musculus
gctcctgctgcaaacactgtgaatg

SEQ ID NO: 566901 - DNA, 25 bp, Mus musculus
gctcctgctgcatacactgtgaatg

SEQ ID NO: 566902 - DNA, 25 bp, Mus musculus
gctcctggaagtattcagcacagag

SEQ ID NO: 566903 - DNA, 25 bp, Mus musculus
gctcctggaagttttcagcacagag

SEQ ID NO: 566904 - DNA, 25 bp, Mus musculus
gctcctggaatgagagcagacctct

SEQ ID NO: 566905 - DNA, 25 bp, Mus musculus
gctcctggaatgtgagcagacctct

SEQ ID NO: 566906 - DNA, 25 bp, Mus musculus
gctcctggagatcttggatgcccac

SEQ ID NO: 566907 - DNA, 25 bp, Mus musculus
gctcctggagatgttggatgcccac

SEQ ID NO: 566908 - DNA, 25 bp, Mus musculus
gctcctggaggcaggcttgatgaat

SEQ ID NO: 566909 - DNA, 25 bp, Mus musculus
gctcctggaggctggcttgatgaat

SEQ ID NO: 566910 - DNA, 25 bp, Mus musculus
gctcctggataactacgcagcttgc

SEQ ID NO: 566911 - DNA, 25 bp, Mus musculus
gctcctggataagtacgcagcttgc

SEQ ID NO: 566912 - DNA, 25 bp, Mus musculus
gctcctggatttaccaagtatcttg

SEQ ID NO: 566913 - DNA, 25 bp, Mus musculus
gctcctggattttccaagtatcttg

SEQ ID NO: 566914 - DNA, 25 bp, Mus musculus
gctcctggcaatcgtcatcttcata

SEQ ID NO: 566915 - DNA, 25 bp, Mus musculus
gctcctggcaatggtcatcttcata

SEQ ID NO: 566916 - DNA, 25 bp, Mus musculus
gctcctggcagaaattgaatctacc

SEQ ID NO: 566917 - DNA, 25 bp, Mus musculus
gctcctggcagaacagcttgggttt

SEQ ID NO: 566918 - DNA, 25 bp, Mus musculus
gctcctggcagatattgaatctacc

SEQ ID NO: 566919 - DNA, 25 bp, Mus musculus
gctcctggcagatcagcttgggttt

SEQ ID NO: 566920 - DNA, 25 bp, Mus musculus
gctcctggcagtatgtctgactaag

SEQ ID NO: 566921 - DNA, 25 bp, Mus musculus
gctcctggcagtttgtctgactaag

SEQ ID NO: 566922 - DNA, 25 bp, Mus musculus
gctcctggccacaaagggactggat

SEQ ID NO: 566923 - DNA, 25 bp, Mus musculus
gctcctggccacaatcaagcagagg

SEQ ID NO: 566924 - DNA, 25 bp, Mus musculus
gctcctggccacagtatgcagcttt

SEQ ID NO: 566925 - DNA, 25 bp, Mus musculus
gctcctggccactaagggactggat

SEQ ID NO: 566926 - DNA, 25 bp, Mus musculus
gctcctggccactatcaagcagagg

SEQ ID NO: 566927 - DNA, 25 bp, Mus musculus
gctcctggccactgtatgcagcttt

SEQ ID NO: 566928 - DNA, 25 bp, Mus musculus
gctcctggccatagagagattctgg

SEQ ID NO: 566929 - DNA, 25 bp, Mus musculus
gctcctggccattgagagattctgg

SEQ ID NO: 566930 - DNA, 25 bp, Mus musculus
gctcctggccccattagcaaggtaa

SEQ ID NO: 566931 - DNA, 25 bp, Mus musculus
gctcctggcccctttagcaaggtaa

SEQ ID NO: 566932 - DNA, 25 bp, Mus musculus
gctcctggcctcatgtagtgatgat

SEQ ID NO: 566933 - DNA, 25 bp, Mus musculus
gctcctggcctcttgtagtgatgat

SEQ ID NO: 566934 - DNA, 25 bp, Mus musculus
gctcctgggcacctggaccaatgag

SEQ ID NO: 566935 - DNA, 25 bp, Mus musculus
gctcctgggcacgtggaccaatgag

SEQ ID NO: 566936 - DNA, 25 bp, Mus musculus
gctcctgggtatctggaagcatcac

SEQ ID NO: 566937 - DNA, 25 bp, Mus musculus
gctcctgggtatgtggaagcatcac

SEQ ID NO: 566938 - DNA, 25 bp, Mus musculus
gctcctggtattatcatttggatgg

SEQ ID NO: 566939 - DNA, 25 bp, Mus musculus
gctcctggtattttcatttggatgg

SEQ ID NO: 566940 - DNA, 25 bp, Mus musculus
gctcctggtccgagtgtgtgttaac

SEQ ID NO: 566941 - DNA, 25 bp, Mus musculus
gctcctggtccgtgtgtgtgttaac

SEQ ID NO: 566942 - DNA, 25 bp, Mus musculus
gctcctggtcggagtgatggtcttc

SEQ ID NO: 566943 - DNA, 25 bp, Mus musculus
gctcctggtcggtgtgatggtcttc

SEQ ID NO: 566944 - DNA, 25 bp, Mus musculus
gctcctggtctaagctgcaacaaac

SEQ ID NO: 566945 - DNA, 25 bp, Mus musculus
gctcctggtctatgctgcaacaaac

SEQ ID NO: 566946 - DNA, 25 bp, Mus musculus
gctcctgtagagaccattggtttcc

SEQ ID NO: 566947 - DNA, 25 bp, Mus musculus
gctcctgtagagtccattggtttcc

SEQ ID NO: 566948 - DNA, 25 bp, Mus musculus
gctcctgtattaataacttgcttca

SEQ ID NO: 566949 - DNA, 25 bp, Mus musculus
gctcctgtattattaacttgcttca

SEQ ID NO: 566950 - DNA, 25 bp, Mus musculus
gctcctgtcaccatcgacaaactga

SEQ ID NO: 566951 - DNA, 25 bp, Mus musculus
gctcctgtcaccttcgacaaactga

SEQ ID NO: 566952 - DNA, 25 bp, Mus musculus
gctcctgtcatacccatggacatta

SEQ ID NO: 566953 - DNA, 25 bp, Mus musculus
gctcctgtcatagccatggacatta

SEQ ID NO: 566954 - DNA, 25 bp, Mus musculus
gctcctgtccctcaggccagaagaa

SEQ ID NO: 566955 - DNA, 25 bp, Mus musculus
gctcctgtccctgaggccagaagaa

SEQ ID NO: 566956 - DNA, 25 bp, Mus musculus
gctcctgtcctgcagaggtgatgaa

SEQ ID NO: 566957 - DNA, 25 bp, Mus musculus
gctcctgtcctggagaggtgatgaa

SEQ ID NO: 566958 - DNA, 25 bp, Mus musculus
gctcctgtctgcagaattttatgag

SEQ ID NO: 566959 - DNA, 25 bp, Mus musculus
gctcctgtctgctgaattttatgag

SEQ ID NO: 566960 - DNA, 25 bp, Mus musculus
gctcctgtgaagactccatatctag

SEQ ID NO: 566961 - DNA, 25 bp, Mus musculus
gctcctgtgaagtctccatatctag

SEQ ID NO: 566962 - DNA, 25 bp, Mus musculus
gctcctgtgaggatctgaactgcaa

SEQ ID NO: 566963 - DNA, 25 bp, Mus musculus
gctcctgtgaggttctgaactgcaa

SEQ ID NO: 566964 - DNA, 25 bp, Mus musculus
gctcctgtgcccacgggtagacttt

SEQ ID NO: 566965 - DNA, 25 bp, Mus musculus
gctcctgtgccctcgggtagacttt

SEQ ID NO: 566966 - DNA, 25 bp, Mus musculus
gctcctgtgctgagggcctaagctg

SEQ ID NO: 566967 - DNA, 25 bp, Mus musculus
gctcctgtgctgtgggcctaagctg

SEQ ID NO: 566968 - DNA, 25 bp, Mus musculus
gctcctgtgcttatcctcagaatta

SEQ ID NO: 566969 - DNA, 25 bp, Mus musculus
gctcctgtgcttttcctcagaatta

SEQ ID NO: 566970 - DNA, 25 bp, Mus musculus
gctcctgtggaacatgggcttcttc

SEQ ID NO: 566971 - DNA, 25 bp, Mus musculus
gctcctgtggaagatgggcttcttc

SEQ ID NO: 566972 - DNA, 25 bp, Mus musculus
gctcctgtggatccaaaagtatatg

SEQ ID NO: 566973 - DNA, 25 bp, Mus musculus
gctcctgtggatgcaaaagtatatg

SEQ ID NO: 566974 - DNA, 25 bp, Mus musculus
gctcctgtgtgacgaaagagccctc

SEQ ID NO: 566975 - DNA, 25 bp, Mus musculus
gctcctgtgtgaggaaagagccctc

SEQ ID NO: 566976 - DNA, 25 bp, Mus musculus
gctcctgtgtgcctcatactacgag

SEQ ID NO: 566977 - DNA, 25 bp, Mus musculus
gctcctgtgtgcgtcatactacgag

SEQ ID NO: 566978 - DNA, 25 bp, Mus musculus
gctcctgtgtgtcgcatagaggtct

SEQ ID NO: 566979 - DNA, 25 bp, Mus musculus
gctcctgtgtgtggcatagaggtct

SEQ ID NO: 566980 - DNA, 25 bp, Mus musculus
gctcctgtgttcagagggattccgt

SEQ ID NO: 566981 - DNA, 25 bp, Mus musculus
gctcctgtgttctgagggattccgt

SEQ ID NO: 566982 - DNA, 25 bp, Mus musculus
gctcctgttggtagtgaccctgtca

SEQ ID NO: 566983 - DNA, 25 bp, Mus musculus
gctcctgttggttgtgaccctgtca

SEQ ID NO: 566984 - DNA, 25 bp, Mus musculus
gctcctgttgtaagggtatctccat

SEQ ID NO: 566985 - DNA, 25 bp, Mus musculus
gctcctgttgtatgggtatctccat

SEQ ID NO: 566986 - DNA, 25 bp, Mus musculus
gctcctgtttttcggatacaacatc

SEQ ID NO: 566987 - DNA, 25 bp, Mus musculus
gctcctgtttttgggatacaacatc

SEQ ID NO: 566988 - DNA, 25 bp, Mus musculus
gctccttaaactcgctattacgtgt

SEQ ID NO: 566989 - DNA, 25 bp, Mus musculus
gctccttaaactggctattacgtgt

SEQ ID NO: 566990 - DNA, 25 bp, Mus musculus
gctccttaaagcagtgaaccgtgca

SEQ ID NO: 566991 - DNA, 25 bp, Mus musculus
gctccttaaagctgtgaaccgtgca

SEQ ID NO: 566992 - DNA, 25 bp, Mus musculus
gctccttaacgtatttgagcaattt

SEQ ID NO: 566993 - DNA, 25 bp, Mus musculus
gctccttaacgtttttgagcaattt

SEQ ID NO: 566994 - DNA, 25 bp, Mus musculus
gctccttaactgatatctgtgccaa

SEQ ID NO: 566995 - DNA, 25 bp, Mus musculus
gctccttaactgttatctgtgccaa

SEQ ID NO: 566996 - DNA, 25 bp, Mus musculus
gctccttaagagattgccttcgcag

SEQ ID NO: 566997 - DNA, 25 bp, Mus musculus
gctccttaagagtttgccttcgcag

SEQ ID NO: 566998 - DNA, 25 bp, Mus musculus
gctccttaccccaagaacaagaaag

SEQ ID NO: 566999 - DNA, 25 bp, Mus musculus
gctccttacccctagaacaagaaag

SEQ ID NO: 567000 - DNA, 25 bp, Mus musculus
gctccttaccttagagggttggtga

SEQ ID NO: 567001 - DNA, 25 bp, Mus musculus
gctccttacctttgagggttggtga

SEQ ID NO: 567002 - DNA, 25 bp, Mus musculus
gctccttatactcggcacccggccc

SEQ ID NO: 567003 - DNA, 25 bp, Mus musculus
gctccttatactgggcacccggccc

SEQ ID NO: 567004 - DNA, 25 bp, Mus musculus
gctccttatggaaattttggctctg

SEQ ID NO: 567005 - DNA, 25 bp, Mus musculus
gctccttatggatattttggctctg

SEQ ID NO: 567006 - DNA, 25 bp, Mus musculus
gctccttatggtattatcaccaagt

SEQ ID NO: 567007 - DNA, 25 bp, Mus musculus
gctccttatggttttatcaccaagt

SEQ ID NO: 567008 - DNA, 25 bp, Mus musculus
gctccttcaagaaacaagagctgaa

SEQ ID NO: 567009 - DNA, 25 bp, Mus musculus
gctccttcaagaagcgtcttcgaag

SEQ ID NO: 567010 - DNA, 25 bp, Mus musculus
gctccttcaagatacaagagctgaa

SEQ ID NO: 567011 - DNA, 25 bp, Mus musculus
gctccttcaagatgcgtcttcgaag

SEQ ID NO: 567012 - DNA, 25 bp, Mus musculus
gctccttcacagataggacgtggga

SEQ ID NO: 567013 - DNA, 25 bp, Mus musculus
gctccttcacagttaggacgtggga

SEQ ID NO: 567014 - DNA, 25 bp, Mus musculus
gctccttccgttctaaagctgctaa

SEQ ID NO: 567015 - DNA, 25 bp, Mus musculus
gctccttccgttgtaaagctgctaa

SEQ ID NO: 567016 - DNA, 25 bp, Mus musculus
gctccttcctggatgtgtagtgaat

SEQ ID NO: 567017 - DNA, 25 bp, Mus musculus
gctccttcctggttgtgtagtgaat

SEQ ID NO: 567018 - DNA, 25 bp, Mus musculus
gctccttcgggcactatggcaaaga

SEQ ID NO: 567019 - DNA, 25 bp, Mus musculus
gctccttcgggcatgggaaagtgct

SEQ ID NO: 567020 - DNA, 25 bp, Mus musculus
gctccttcgggctctatggcaaaga

SEQ ID NO: 567021 - DNA, 25 bp, Mus musculus
gctccttcgggcttgggaaagtgct

SEQ ID NO: 567022 - DNA, 25 bp, Mus musculus
gctccttcgtttcttgggtttcatc

SEQ ID NO: 567023 - DNA, 25 bp, Mus musculus
gctccttcgtttgttgggtttcatc

SEQ ID NO: 567024 - DNA, 25 bp, Mus musculus
gctccttctgtacgtgtgctgatga

SEQ ID NO: 567025 - DNA, 25 bp, Mus musculus
gctccttctgtaggtgtgctgatga

SEQ ID NO: 567026 - DNA, 25 bp, Mus musculus
gctccttcttatctccacggtgaat

SEQ ID NO: 567027 - DNA, 25 bp, Mus musculus
gctccttcttatgtccacggtgaat

SEQ ID NO: 567028 - DNA, 25 bp, Mus musculus
gctccttgaaacatgccactagcct

SEQ ID NO: 567029 - DNA, 25 bp, Mus musculus
gctccttgaaacttgccactagcct

SEQ ID NO: 567030 - DNA, 25 bp, Mus musculus
gctccttgaacaataccaaagagaa

SEQ ID NO: 567031 - DNA, 25 bp, Mus musculus
gctccttgaacattaccaaagagaa

SEQ ID NO: 567032 - DNA, 25 bp, Mus musculus
gctccttgacaactttctgaacctt

SEQ ID NO: 567033 - DNA, 25 bp, Mus musculus
gctccttgacaagtttctgaacctt

SEQ ID NO: 567034 - DNA, 25 bp, Mus musculus
gctccttgacatcctttgataataa

SEQ ID NO: 567035 - DNA, 25 bp, Mus musculus
gctccttgacatgctttgataataa

SEQ ID NO: 567036 - DNA, 25 bp, Mus musculus
gctccttgagacatacttttaaagt

SEQ ID NO: 567037 - DNA, 25 bp, Mus musculus
gctccttgagacttacttttaaagt

SEQ ID NO: 567038 - DNA, 25 bp, Mus musculus
gctccttgcagtatcctgatgatga

SEQ ID NO: 567039 - DNA, 25 bp, Mus musculus
gctccttgcagtttcctgatgatga

SEQ ID NO: 567040 - DNA, 25 bp, Mus musculus
gctccttgctggcttgttactcatg

SEQ ID NO: 567041 - DNA, 25 bp, Mus musculus
gctccttgctgggttgttactcatg

SEQ ID NO: 567042 - DNA, 25 bp, Mus musculus
gctccttggtttccggtatttgcag

SEQ ID NO: 567043 - DNA, 25 bp, Mus musculus
gctccttggtttgcggtatttgcag

SEQ ID NO: 567044 - DNA, 25 bp, Mus musculus
gctccttgtatgactagggtaaacc

SEQ ID NO: 567045 - DNA, 25 bp, Mus musculus
gctccttgtatgtctagggtaaacc

SEQ ID NO: 567046 - DNA, 25 bp, Mus musculus
gctccttgtggaactctattgattt

SEQ ID NO: 567047 - DNA, 25 bp, Mus musculus
gctccttgtggatctctattgattt

SEQ ID NO: 567048 - DNA, 25 bp, Mus musculus
gctccttgttgcctggcaagatcaa

SEQ ID NO: 567049 - DNA, 25 bp, Mus musculus
gctccttgttgcgtggcaagatcaa

SEQ ID NO: 567050 - DNA, 25 bp, Mus musculus
gctccttgtttacgtgtgcattaac

SEQ ID NO: 567051 - DNA, 25 bp, Mus musculus
gctccttgtttaggtgtgcattaac

SEQ ID NO: 567052 - DNA, 25 bp, Mus musculus
gctcctttacaaacctggtactata

SEQ ID NO: 567053 - DNA, 25 bp, Mus musculus
gctcctttacaatcctggtactata

SEQ ID NO: 567054 - DNA, 25 bp, Mus musculus
gctcctttattacccacacatgaaa

SEQ ID NO: 567055 - DNA, 25 bp, Mus musculus
gctcctttattagccacacatgaaa

SEQ ID NO: 567056 - DNA, 25 bp, Mus musculus
gctcctttcaacacgaattcaatcc

SEQ ID NO: 567057 - DNA, 25 bp, Mus musculus
gctcctttcaactcgaattcaatcc

SEQ ID NO: 567058 - DNA, 25 bp, Mus musculus
gctcctttcacacctgacttttgag

SEQ ID NO: 567059 - DNA, 25 bp, Mus musculus
gctcctttcacagctgacttttgag

SEQ ID NO: 567060 - DNA, 25 bp, Mus musculus
gctcctttcagtataagaattgtcc

SEQ ID NO: 567061 - DNA, 25 bp, Mus musculus
gctcctttcagtttaagaattgtcc

SEQ ID NO: 567062 - DNA, 25 bp, Mus musculus
gctcctttcctgacaatcaactgga

SEQ ID NO: 567063 - DNA, 25 bp, Mus musculus
gctcctttcctgtcaatcaactgga

SEQ ID NO: 567064 - DNA, 25 bp, Mus musculus
gctcctttgagtatgcctagagatg

SEQ ID NO: 567065 - DNA, 25 bp, Mus musculus
gctcctttgagtttgcctagagatg

SEQ ID NO: 567066 - DNA, 25 bp, Mus musculus
gctcctttggagacacttgcttggg

SEQ ID NO: 567067 - DNA, 25 bp, Mus musculus
gctcctttggagtcacttgcttggg

SEQ ID NO: 567068 - DNA, 25 bp, Mus musculus
gctcctttggtcatgaatcttgaat

SEQ ID NO: 567069 - DNA, 25 bp, Mus musculus
gctcctttggtcttgaatcttgaat

SEQ ID NO: 567070 - DNA, 25 bp, Mus musculus
gctccttttattccaacttttccag

SEQ ID NO: 567071 - DNA, 25 bp, Mus musculus
gctccttttattgcaacttttccag

SEQ ID NO: 567072 - DNA, 25 bp, Mus musculus
gctccttttcaaccgtcagggaaga

SEQ ID NO: 567073 - DNA, 25 bp, Mus musculus
gctccttttcaagcgtcagggaaga

SEQ ID NO: 567074 - DNA, 25 bp, Mus musculus
gctccttttgccatagatactgaaa

SEQ ID NO: 567075 - DNA, 25 bp, Mus musculus
gctccttttgccttagatactgaaa

SEQ ID NO: 567076 - DNA, 25 bp, Mus musculus
gctcctttttaaataccaactgctc

SEQ ID NO: 567077 - DNA, 25 bp, Mus musculus
gctcctttttaattaccaactgctc

SEQ ID NO: 567078 - DNA, 25 bp, Mus musculus
gctcctttttcaattgtgggacagt

SEQ ID NO: 567079 - DNA, 25 bp, Mus musculus
gctcctttttcatttgtgggacagt

SEQ ID NO: 567080 - DNA, 25 bp, Mus musculus
gctcctttttctattatgatctctg

SEQ ID NO: 567081 - DNA, 25 bp, Mus musculus
gctcctttttctcataggcaatcaa

SEQ ID NO: 567082 - DNA, 25 bp, Mus musculus
gctcctttttctgataggcaatcaa

SEQ ID NO: 567083 - DNA, 25 bp, Mus musculus
gctcctttttcttttatgatctctg

SEQ ID NO: 567084 - DNA, 25 bp, Mus musculus
gctcctttttggcatgtttgaaatg

SEQ ID NO: 567085 - DNA, 25 bp, Mus musculus
gctcctttttgggatgtttgaaatg

SEQ ID NO: 567086 - DNA, 25 bp, Mus musculus
gctcctttttgtcccagactggaaa

SEQ ID NO: 567087 - DNA, 25 bp, Mus musculus
gctcctttttgtgccagactggaaa

SEQ ID NO: 567088 - DNA, 25 bp, Mus musculus
gctcgaaagttaccttagaggttaa

SEQ ID NO: 567089 - DNA, 25 bp, Mus musculus
gctcgaaagttagcttagaggttaa

SEQ ID NO: 567090 - DNA, 25 bp, Mus musculus
gctcgaacatagcagcaagtgatta

SEQ ID NO: 567091 - DNA, 25 bp, Mus musculus
gctcgaacataggagcaagtgatta

SEQ ID NO: 567092 - DNA, 25 bp, Mus musculus
gctcgaagacttcattgccgatctg

SEQ ID NO: 567093 - DNA, 25 bp, Mus musculus
gctcgaagacttgattgccgatctg

SEQ ID NO: 567094 - DNA, 25 bp, Mus musculus
gctcgaagtggtcatgatttcatcc

SEQ ID NO: 567095 - DNA, 25 bp, Mus musculus
gctcgaagtggtgatgatttcatcc

SEQ ID NO: 567096 - DNA, 25 bp, Mus musculus
gctcgaagttccatgttagctgtgc

SEQ ID NO: 567097 - DNA, 25 bp, Mus musculus
gctcgaagttccttgttagctgtgc

SEQ ID NO: 567098 - DNA, 25 bp, Mus musculus
gctcgaattaaaactgtggcatacc

SEQ ID NO: 567099 - DNA, 25 bp, Mus musculus
gctcgaattaaatctgtggcatacc

SEQ ID NO: 567100 - DNA, 25 bp, Mus musculus
gctcgaattgagcttctggtcatgt

SEQ ID NO: 567101 - DNA, 25 bp, Mus musculus
gctcgaattgaggttctggtcatgt

SEQ ID NO: 567102 - DNA, 25 bp, Mus musculus
gctcgacaaaatatactcacattca

SEQ ID NO: 567103 - DNA, 25 bp, Mus musculus
gctcgacaaaatttactcacattca

SEQ ID NO: 567104 - DNA, 25 bp, Mus musculus
gctcgacacttcattctgcaaggag

SEQ ID NO: 567105 - DNA, 25 bp, Mus musculus
gctcgacacttctttctgcaaggag

SEQ ID NO: 567106 - DNA, 25 bp, Mus musculus
gctcgacatcacagagcaggccctg

SEQ ID NO: 567107 - DNA, 25 bp, Mus musculus
gctcgacatcactgagcaggccctg

SEQ ID NO: 567108 - DNA, 25 bp, Mus musculus
gctcgacccgctaggctatgaaatt

SEQ ID NO: 567109 - DNA, 25 bp, Mus musculus
gctcgacccgcttggctatgaaatt

SEQ ID NO: 567110 - DNA, 25 bp, Mus musculus
gctcgacctccacggtgatggtctt

SEQ ID NO: 567111 - DNA, 25 bp, Mus musculus
gctcgacctccagggtgatggtctt

SEQ ID NO: 567112 - DNA, 25 bp, Mus musculus
gctcgacgctgtactattggtggaa

SEQ ID NO: 567113 - DNA, 25 bp, Mus musculus
gctcgacgctgttctattggtggaa

SEQ ID NO: 567114 - DNA, 25 bp, Mus musculus
gctcgacggaccagcactgagtgga

SEQ ID NO: 567115 - DNA, 25 bp, Mus musculus
gctcgacggacctgcactgagtgga

SEQ ID NO: 567116 - DNA, 25 bp, Mus musculus
gctcgacggattaagtggcagtttt

SEQ ID NO: 567117 - DNA, 25 bp, Mus musculus
gctcgacggatttagtggcagtttt

SEQ ID NO: 567118 - DNA, 25 bp, Mus musculus
gctcgactccaacttttgtcaatgt

SEQ ID NO: 567119 - DNA, 25 bp, Mus musculus
gctcgactccaagttttgtcaatgt

SEQ ID NO: 567120 - DNA, 25 bp, Mus musculus
gctcgactgtaactctcacatgtga

SEQ ID NO: 567121 - DNA, 25 bp, Mus musculus
gctcgactgtaagtctcacatgtga

SEQ ID NO: 567122 - DNA, 25 bp, Mus musculus
gctcgagaaacactatgtgctactg

SEQ ID NO: 567123 - DNA, 25 bp, Mus musculus
gctcgagaaacagtatgtgctactg

SEQ ID NO: 567124 - DNA, 25 bp, Mus musculus
gctcgagaattcagttgtccctttt

SEQ ID NO: 567125 - DNA, 25 bp, Mus musculus
gctcgagaattctgttgtccctttt

SEQ ID NO: 567126 - DNA, 25 bp, Mus musculus
gctcgagactacaggcaaggcactt

SEQ ID NO: 567127 - DNA, 25 bp, Mus musculus
gctcgagactactggcaaggcactt

SEQ ID NO: 567128 - DNA, 25 bp, Mus musculus
gctcgagccgggattctgtcgaaaa

SEQ ID NO: 567129 - DNA, 25 bp, Mus musculus
gctcgagccgggtttctgtcgaaaa

SEQ ID NO: 567130 - DNA, 25 bp, Mus musculus
gctcgagcgccaagatcgtgaagcc

SEQ ID NO: 567131 - DNA, 25 bp, Mus musculus
gctcgagcgccatgatcgtgaagcc

SEQ ID NO: 567132 - DNA, 25 bp, Mus musculus
gctcgagcggctccttcttaaaggg

SEQ ID NO: 567133 - DNA, 25 bp, Mus musculus
gctcgagcggctgcttcttaaaggg

SEQ ID NO: 567134 - DNA, 25 bp, Mus musculus
gctcgaggctgccaaaccaactgaa

SEQ ID NO: 567135 - DNA, 25 bp, Mus musculus
gctcgaggctgcgaaaccaactgaa

SEQ ID NO: 567136 - DNA, 25 bp, Mus musculus
gctcgagtcatcattctttaaacaa

SEQ ID NO: 567137 - DNA, 25 bp, Mus musculus
gctcgagtcatctttctttaaacaa

SEQ ID NO: 567138 - DNA, 25 bp, Mus musculus
gctcgagtcatgatccgggctttac

SEQ ID NO: 567139 - DNA, 25 bp, Mus musculus
gctcgagtcatgttccgggctttac

SEQ ID NO: 567140 - DNA, 25 bp, Mus musculus
gctcgagtcttgattttctattttc

SEQ ID NO: 567141 - DNA, 25 bp, Mus musculus
gctcgagtcttgtttttctattttc

SEQ ID NO: 567142 - DNA, 25 bp, Mus musculus
gctcgagttgatccccacaggtgta

SEQ ID NO: 567143 - DNA, 25 bp, Mus musculus
gctcgagttgatgcccacaggtgta

SEQ ID NO: 567144 - DNA, 25 bp, Mus musculus
gctcgatctgctcgattttggccac

SEQ ID NO: 567145 - DNA, 25 bp, Mus musculus
gctcgatctgctggattttggccac

SEQ ID NO: 567146 - DNA, 25 bp, Mus musculus
gctcgatctgtgagatgggtgccca

SEQ ID NO: 567147 - DNA, 25 bp, Mus musculus
gctcgatctgtgtgatgggtgccca

SEQ ID NO: 567148 - DNA, 25 bp, Mus musculus
gctcgatgcctaaagtgcaatcaat

SEQ ID NO: 567149 - DNA, 25 bp, Mus musculus
gctcgatgcctatagtgcaatcaat

SEQ ID NO: 567150 - DNA, 25 bp, Mus musculus
gctcgatgcgctacaaaaggtgtgc

SEQ ID NO: 567151 - DNA, 25 bp, Mus musculus
gctcgatgcgcttcaaaaggtgtgc

SEQ ID NO: 567152 - DNA, 25 bp, Mus musculus
gctcgatgcttcaatcctgagtggt

SEQ ID NO: 567153 - DNA, 25 bp, Mus musculus
gctcgatgcttctatcctgagtggt

SEQ ID NO: 567154 - DNA, 25 bp, Mus musculus
gctcgatggctacctgctcagacat

SEQ ID NO: 567155 - DNA, 25 bp, Mus musculus
gctcgatggctagctgctcagacat

SEQ ID NO: 567156 - DNA, 25 bp, Mus musculus
gctcgattcaaacccttcaatacct

SEQ ID NO: 567157 - DNA, 25 bp, Mus musculus
gctcgattcaaagccttcaatacct

SEQ ID NO: 567158 - DNA, 25 bp, Mus musculus
gctcgattggccatcattatcgtgt

SEQ ID NO: 567159 - DNA, 25 bp, Mus musculus
gctcgattggccttcattatcgtgt

SEQ ID NO: 567160 - DNA, 25 bp, Mus musculus
gctcgatttggtccataactgccat

SEQ ID NO: 567161 - DNA, 25 bp, Mus musculus
gctcgatttggtgcataactgccat

SEQ ID NO: 567162 - DNA, 25 bp, Mus musculus
gctcgcaaaatgactgctctttagc

SEQ ID NO: 567163 - DNA, 25 bp, Mus musculus
gctcgcaaaatgtctgctctttagc

SEQ ID NO: 567164 - DNA, 25 bp, Mus musculus
gctcgcagagctataggtaccagtt

SEQ ID NO: 567165 - DNA, 25 bp, Mus musculus
gctcgcagagctttaggtaccagtt

SEQ ID NO: 567166 - DNA, 25 bp, Mus musculus
gctcgcagccatcgttagaaccctg

SEQ ID NO: 567167 - DNA, 25 bp, Mus musculus
gctcgcagccatggttagaaccctg

SEQ ID NO: 567168 - DNA, 25 bp, Mus musculus
gctcgcagccgcagacggtctggac

SEQ ID NO: 567169 - DNA, 25 bp, Mus musculus
gctcgcagccgctgacggtctggac

SEQ ID NO: 567170 - DNA, 25 bp, Mus musculus
gctcgcaggagaatcgcacttactc

SEQ ID NO: 567171 - DNA, 25 bp, Mus musculus
gctcgcaggagattcgcacttactc

SEQ ID NO: 567172 - DNA, 25 bp, Mus musculus
gctcgcatctgtcgctatgatgaca

SEQ ID NO: 567173 - DNA, 25 bp, Mus musculus
gctcgcatctgtggctatgatgaca

SEQ ID NO: 567174 - DNA, 25 bp, Mus musculus
gctcgcatgtgtcttcattttggct

SEQ ID NO: 567175 - DNA, 25 bp, Mus musculus
gctcgcatgtgtgttcattttggct

SEQ ID NO: 567176 - DNA, 25 bp, Mus musculus
gctcgccaacgactcccaaatttgg

SEQ ID NO: 567177 - DNA, 25 bp, Mus musculus
gctcgccaacgagtcccaaatttgg

SEQ ID NO: 567178 - DNA, 25 bp, Mus musculus
gctcgccacaaaaatgggtactgcg

SEQ ID NO: 567179 - DNA, 25 bp, Mus musculus
gctcgccacaaatatgggtactgcg

SEQ ID NO: 567180 - DNA, 25 bp, Mus musculus
gctcgcccgggaaaagaagctctat

SEQ ID NO: 567181 - DNA, 25 bp, Mus musculus
gctcgcccgggataagaagctctat

SEQ ID NO: 567182 - DNA, 25 bp, Mus musculus
gctcgcccgggcagtagtaacagga

SEQ ID NO: 567183 - DNA, 25 bp, Mus musculus
gctcgcccgggctgtagtaacagga

SEQ ID NO: 567184 - DNA, 25 bp, Mus musculus
gctcgccgatctcggttcgtgtaaa

SEQ ID NO: 567185 - DNA, 25 bp, Mus musculus
gctcgccgatctgggttcgtgtaaa

SEQ ID NO: 567186 - DNA, 25 bp, Mus musculus
gctcgccggagacaagacaagtttt

SEQ ID NO: 567187 - DNA, 25 bp, Mus musculus
gctcgccggagagaagacaagtttt

SEQ ID NO: 567188 - DNA, 25 bp, Mus musculus
gctcgccggttcaaaagccgaagaa

SEQ ID NO: 567189 - DNA, 25 bp, Mus musculus
gctcgccggttctaaagccgaagaa

SEQ ID NO: 567190 - DNA, 25 bp, Mus musculus
gctcgcctaaaaagggttctcttgc

SEQ ID NO: 567191 - DNA, 25 bp, Mus musculus
gctcgcctaaaatgggttctcttgc

SEQ ID NO: 567192 - DNA, 25 bp, Mus musculus
gctcgcctagagctagtcacatctt

SEQ ID NO: 567193 - DNA, 25 bp, Mus musculus
gctcgcctagaggtagtcacatctt

SEQ ID NO: 567194 - DNA, 25 bp, Mus musculus
gctcgcctgatgaacatggtagcaa

SEQ ID NO: 567195 - DNA, 25 bp, Mus musculus
gctcgcctgatgtacatggtagcaa

SEQ ID NO: 567196 - DNA, 25 bp, Mus musculus
gctcgccttgttacagtcagggtgc

SEQ ID NO: 567197 - DNA, 25 bp, Mus musculus
gctcgccttgtttcagtcagggtgc

SEQ ID NO: 567198 - DNA, 25 bp, Mus musculus
gctcgcgcaacgaccgtctagctgg

SEQ ID NO: 567199 - DNA, 25 bp, Mus musculus
gctcgcgcaacgtccgtctagctgg

SEQ ID NO: 567200 - DNA, 25 bp, Mus musculus
gctcgcgcacataaatgtttaccag

SEQ ID NO: 567201 - DNA, 25 bp, Mus musculus
gctcgcgcacattaatgtttaccag

SEQ ID NO: 567202 - DNA, 25 bp, Mus musculus
gctcgcgctgtcctcagagaatatg

SEQ ID NO: 567203 - DNA, 25 bp, Mus musculus
gctcgcgctgtcgtcagagaatatg

SEQ ID NO: 567204 - DNA, 25 bp, Mus musculus
gctcgcgcttcaattccctcattgt

SEQ ID NO: 567205 - DNA, 25 bp, Mus musculus
gctcgcgcttcatttccctcattgt

SEQ ID NO: 567206 - DNA, 25 bp, Mus musculus
gctcgctaacacaatctgcatcatt

SEQ ID NO: 567207 - DNA, 25 bp, Mus musculus
gctcgctaacactatctgcatcatt

SEQ ID NO: 567208 - DNA, 25 bp, Mus musculus
gctcgctctgctagcgctgggtatc

SEQ ID NO: 567209 - DNA, 25 bp, Mus musculus
gctcgctctgcttgcgctgggtatc

SEQ ID NO: 567210 - DNA, 25 bp, Mus musculus
gctcgctctggaagcggctgactaa

SEQ ID NO: 567211 - DNA, 25 bp, Mus musculus
gctcgctctggatgcggctgactaa

SEQ ID NO: 567212 - DNA, 25 bp, Mus musculus
gctcgctgagagaggcttatcctta

SEQ ID NO: 567213 - DNA, 25 bp, Mus musculus
gctcgctgagagtggcttatcctta

SEQ ID NO: 567214 - DNA, 25 bp, Mus musculus
gctcgctggtcacttgaatccaagt

SEQ ID NO: 567215 - DNA, 25 bp, Mus musculus
gctcgctggtcagttgaatccaagt

SEQ ID NO: 567216 - DNA, 25 bp, Mus musculus
gctcgcttgcctagctttatgaatt

SEQ ID NO: 567217 - DNA, 25 bp, Mus musculus
gctcgcttgccttgctttatgaatt

SEQ ID NO: 567218 - DNA, 25 bp, Mus musculus
gctcgctttcctcgcaggcagcggt

SEQ ID NO: 567219 - DNA, 25 bp, Mus musculus
gctcgctttcctggcaggcagcggt

SEQ ID NO: 567220 - DNA, 25 bp, Mus musculus
gctcgctttctcatatctctgaaga

SEQ ID NO: 567221 - DNA, 25 bp, Mus musculus
gctcgctttctcttatctctgaaga

SEQ ID NO: 567222 - DNA, 25 bp, Mus musculus
gctcggaaacggcagctccaggaaa

SEQ ID NO: 567223 - DNA, 25 bp, Mus musculus
gctcggaaacgggagctccaggaaa

SEQ ID NO: 567224 - DNA, 25 bp, Mus musculus
gctcggaactctaccctggtaggaa

SEQ ID NO: 567225 - DNA, 25 bp, Mus musculus
gctcggaactcttccctggtaggaa

SEQ ID NO: 567226 - DNA, 25 bp, Mus musculus
gctcggacgagcaggcacggcacta

SEQ ID NO: 567227 - DNA, 25 bp, Mus musculus
gctcggacgagctggcacggcacta

SEQ ID NO: 567228 - DNA, 25 bp, Mus musculus
gctcggacttggctagtttgtttat

SEQ ID NO: 567229 - DNA, 25 bp, Mus musculus
gctcggacttgggtagtttgtttat

SEQ ID NO: 567230 - DNA, 25 bp, Mus musculus
gctcggagaggccaaaatcctatct

SEQ ID NO: 567231 - DNA, 25 bp, Mus musculus
gctcggagaggcgaaaatcctatct

SEQ ID NO: 567232 - DNA, 25 bp, Mus musculus
gctcggagatagaggtcctctgaca

SEQ ID NO: 567233 - DNA, 25 bp, Mus musculus
gctcggagatagtggtcctctgaca

SEQ ID NO: 567234 - DNA, 25 bp, Mus musculus
gctcggagattaatggctgcaattc

SEQ ID NO: 567235 - DNA, 25 bp, Mus musculus
gctcggagattattggctgcaattc

SEQ ID NO: 567236 - DNA, 25 bp, Mus musculus
gctcggagcttcagtggcatggtct

SEQ ID NO: 567237 - DNA, 25 bp, Mus musculus
gctcggagcttctgtggcatggtct

SEQ ID NO: 567238 - DNA, 25 bp, Mus musculus
gctcggagtgcacttcgtgtaaatt

SEQ ID NO: 567239 - DNA, 25 bp, Mus musculus
gctcggagtgcagttcgtgtaaatt

SEQ ID NO: 567240 - DNA, 25 bp, Mus musculus
gctcggagtggcctcacctaatggc

SEQ ID NO: 567241 - DNA, 25 bp, Mus musculus
gctcggagtggcgtcacctaatggc

SEQ ID NO: 567242 - DNA, 25 bp, Mus musculus
gctcggatgtagcatgttctatgta

SEQ ID NO: 567243 - DNA, 25 bp, Mus musculus
gctcggatgtaggatgttctatgta

SEQ ID NO: 567244 - DNA, 25 bp, Mus musculus
gctcggatgtctctgctatacaaag

SEQ ID NO: 567245 - DNA, 25 bp, Mus musculus
gctcggatgtctgtgctatacaaag

SEQ ID NO: 567246 - DNA, 25 bp, Mus musculus
gctcggcaatcacctgtagcagcaa

SEQ ID NO: 567247 - DNA, 25 bp, Mus musculus
gctcggcaatcagctgtagcagcaa

SEQ ID NO: 567248 - DNA, 25 bp, Mus musculus
gctcggcactggatgatttcattgg

SEQ ID NO: 567249 - DNA, 25 bp, Mus musculus
gctcggcactggttgatttcattgg

SEQ ID NO: 567250 - DNA, 25 bp, Mus musculus
gctcggcagaatacacagtggtgtg

SEQ ID NO: 567251 - DNA, 25 bp, Mus musculus
gctcggcagaattcacagtggtgtg

SEQ ID NO: 567252 - DNA, 25 bp, Mus musculus
gctcggccacagcatggttatcgta

SEQ ID NO: 567253 - DNA, 25 bp, Mus musculus
gctcggccacaggatggttatcgta

SEQ ID NO: 567254 - DNA, 25 bp, Mus musculus
gctcggccttggagaacatctgcaa

SEQ ID NO: 567255 - DNA, 25 bp, Mus musculus
gctcggccttggtgaacatctgcaa

SEQ ID NO: 567256 - DNA, 25 bp, Mus musculus
gctcggcgacgtattataaattcat

SEQ ID NO: 567257 - DNA, 25 bp, Mus musculus
gctcggcgacgttttataaattcat

SEQ ID NO: 567258 - DNA, 25 bp, Mus musculus
gctcggcgcagtctctgtgttcatc

SEQ ID NO: 567259 - DNA, 25 bp, Mus musculus
gctcggcgcagtgtctgtgttcatc

SEQ ID NO: 567260 - DNA, 25 bp, Mus musculus
gctcggctacatacttgtctctagt

SEQ ID NO: 567261 - DNA, 25 bp, Mus musculus
gctcggctacattcttgtctctagt

SEQ ID NO: 567262 - DNA, 25 bp, Mus musculus
gctcggctcaggaatttcgctttga

SEQ ID NO: 567263 - DNA, 25 bp, Mus musculus
gctcggctcaggtatttcgctttga

SEQ ID NO: 567264 - DNA, 25 bp, Mus musculus
gctcggctctggctcattgagtaac

SEQ ID NO: 567265 - DNA, 25 bp, Mus musculus
gctcggctctgggtcattgagtaac

SEQ ID NO: 567266 - DNA, 25 bp, Mus musculus
gctcggctgagaacgctaaagatga

SEQ ID NO: 567267 - DNA, 25 bp, Mus musculus
gctcggctgagatcgctaaagatga

SEQ ID NO: 567268 - DNA, 25 bp, Mus musculus
gctcggcttgcaaaggagaagtcgc

SEQ ID NO: 567269 - DNA, 25 bp, Mus musculus
gctcggcttgcacatagacggtaca

SEQ ID NO: 567270 - DNA, 25 bp, Mus musculus
gctcggcttgcagatagacggtaca

SEQ ID NO: 567271 - DNA, 25 bp, Mus musculus
gctcggcttgcataggagaagtcgc

SEQ ID NO: 567272 - DNA, 25 bp, Mus musculus
gctcggctttgtcgaccatgcagtg

SEQ ID NO: 567273 - DNA, 25 bp, Mus musculus
gctcggctttgtggaccatgcagtg

SEQ ID NO: 567274 - DNA, 25 bp, Mus musculus
gctcgggaaaccaccaaggacccag

SEQ ID NO: 567275 - DNA, 25 bp, Mus musculus
gctcgggaaacctccaaggacccag

SEQ ID NO: 567276 - DNA, 25 bp, Mus musculus
gctcgggaagtgagttcggctcata

SEQ ID NO: 567277 - DNA, 25 bp, Mus musculus
gctcgggaagtgtgttcggctcata

SEQ ID NO: 567278 - DNA, 25 bp, Mus musculus
gctcgggacactaattctggaagtt

SEQ ID NO: 567279 - DNA, 25 bp, Mus musculus
gctcgggacacttattctggaagtt

SEQ ID NO: 567280 - DNA, 25 bp, Mus musculus
gctcgggacctcacaatatgatatt

SEQ ID NO: 567281 - DNA, 25 bp, Mus musculus
gctcgggacctctcaatatgatatt

SEQ ID NO: 567282 - DNA, 25 bp, Mus musculus
gctcgggagattcccacttccacaa

SEQ ID NO: 567283 - DNA, 25 bp, Mus musculus
gctcgggagattgccacttccacaa

SEQ ID NO: 567284 - DNA, 25 bp, Mus musculus
gctcgggagtgcctaacccttctct

SEQ ID NO: 567285 - DNA, 25 bp, Mus musculus
gctcgggagtgcgtaacccttctct

SEQ ID NO: 567286 - DNA, 25 bp, Mus musculus
gctcgggagttcacagtttaacatc

SEQ ID NO: 567287 - DNA, 25 bp, Mus musculus
gctcgggagttcacttccaaaggga

SEQ ID NO: 567288 - DNA, 25 bp, Mus musculus
gctcgggagttctcagtttaacatc

SEQ ID NO: 567289 - DNA, 25 bp, Mus musculus
gctcgggagttctcttccaaaggga

SEQ ID NO: 567290 - DNA, 25 bp, Mus musculus
gctcgggcagttccttccagcctgg

SEQ ID NO: 567291 - DNA, 25 bp, Mus musculus
gctcgggcagttgcttccagcctgg

SEQ ID NO: 567292 - DNA, 25 bp, Mus musculus
gctcgggccatgaactcttaatcct

SEQ ID NO: 567293 - DNA, 25 bp, Mus musculus
gctcgggccatgtactcttaatcct

SEQ ID NO: 567294 - DNA, 25 bp, Mus musculus
gctcgggcgccgacaggtacttctg

SEQ ID NO: 567295 - DNA, 25 bp, Mus musculus
gctcgggcgccgtcaggtacttctg

SEQ ID NO: 567296 - DNA, 25 bp, Mus musculus
gctcgggctcttagctgaatacttt

SEQ ID NO: 567297 - DNA, 25 bp, Mus musculus
gctcgggctctttgctgaatacttt

SEQ ID NO: 567298 - DNA, 25 bp, Mus musculus
gctcgggcttagaggcaccaacaga

SEQ ID NO: 567299 - DNA, 25 bp, Mus musculus
gctcgggcttagtggcaccaacaga

SEQ ID NO: 567300 - DNA, 25 bp, Mus musculus
gctcgggttactcaaccttttctag

SEQ ID NO: 567301 - DNA, 25 bp, Mus musculus
gctcgggttactgaaccttttctag

SEQ ID NO: 567302 - DNA, 25 bp, Mus musculus
gctcgggtttatcactaggcatcct

SEQ ID NO: 567303 - DNA, 25 bp, Mus musculus
gctcgggtttatgactaggcatcct

SEQ ID NO: 567304 - DNA, 25 bp, Mus musculus
gctcggtaatgacgccagtagttat

SEQ ID NO: 567305 - DNA, 25 bp, Mus musculus
gctcggtaatgaggccagtagttat

SEQ ID NO: 567306 - DNA, 25 bp, Mus musculus
gctcggtatcgtatttcaaataaag

SEQ ID NO: 567307 - DNA, 25 bp, Mus musculus
gctcggtatcgtttttcaaataaag

SEQ ID NO: 567308 - DNA, 25 bp, Mus musculus
gctcggtccgcgacacagaggcgtt

SEQ ID NO: 567309 - DNA, 25 bp, Mus musculus
gctcggtccgcgtcacagaggcgtt

SEQ ID NO: 567310 - DNA, 25 bp, Mus musculus
gctcggtcctgcagcatttataaat

SEQ ID NO: 567311 - DNA, 25 bp, Mus musculus
gctcggtcctgctgcatttataaat

SEQ ID NO: 567312 - DNA, 25 bp, Mus musculus
gctcggtgatctcctgaacgtgaaa

SEQ ID NO: 567313 - DNA, 25 bp, Mus musculus
gctcggtgatctgctgaacgtgaaa

SEQ ID NO: 567314 - DNA, 25 bp, Mus musculus
gctcggtgatgaatcagcgtgtcaa

SEQ ID NO: 567315 - DNA, 25 bp, Mus musculus
gctcggtgatgattcagcgtgtcaa

SEQ ID NO: 567316 - DNA, 25 bp, Mus musculus
gctcggtgatgtcacaattctgctg

SEQ ID NO: 567317 - DNA, 25 bp, Mus musculus
gctcggtgatgtgacaattctgctg

SEQ ID NO: 567318 - DNA, 25 bp, Mus musculus
gctcggtgccagcaacatttgtgtt

SEQ ID NO: 567319 - DNA, 25 bp, Mus musculus
gctcggtgccaggaacatttgtgtt

SEQ ID NO: 567320 - DNA, 25 bp, Mus musculus
gctcggtgccttagatttcaatgca

SEQ ID NO: 567321 - DNA, 25 bp, Mus musculus
gctcggtgcctttgatttcaatgca

SEQ ID NO: 567322 - DNA, 25 bp, Mus musculus
gctcggtggttacaacgccaaggga

SEQ ID NO: 567323 - DNA, 25 bp, Mus musculus
gctcggtggttagaacgccaaggga

SEQ ID NO: 567324 - DNA, 25 bp, Mus musculus
gctcggttaagaccccatggacgga

SEQ ID NO: 567325 - DNA, 25 bp, Mus musculus
gctcggttaagagcccatggacgga

SEQ ID NO: 567326 - DNA, 25 bp, Mus musculus
gctcggttgccacgacaagactgga

SEQ ID NO: 567327 - DNA, 25 bp, Mus musculus
gctcggttgccaggacaagactgga

SEQ ID NO: 567328 - DNA, 25 bp, Mus musculus
gctcggtttcagaattcaactctcc

SEQ ID NO: 567329 - DNA, 25 bp, Mus musculus
gctcggtttcagtattcaactctcc

SEQ ID NO: 567330 - DNA, 25 bp, Mus musculus
gctcgtaaaaggatggagtttggca

SEQ ID NO: 567331 - DNA, 25 bp, Mus musculus
gctcgtaaaaggttggagtttggca

SEQ ID NO: 567332 - DNA, 25 bp, Mus musculus
gctcgtaaatcaccagcctgggaaa

SEQ ID NO: 567333 - DNA, 25 bp, Mus musculus
gctcgtaaatcagcagcctgggaaa

SEQ ID NO: 567334 - DNA, 25 bp, Mus musculus
gctcgtagtaaaagtgcgcaggcgt

SEQ ID NO: 567335 - DNA, 25 bp, Mus musculus
gctcgtagtaaatgtgcgcaggcgt

SEQ ID NO: 567336 - DNA, 25 bp, Mus musculus
gctcgtatgaatcatcacccagtca

SEQ ID NO: 567337 - DNA, 25 bp, Mus musculus
gctcgtatgaatgatcacccagtca

SEQ ID NO: 567338 - DNA, 25 bp, Mus musculus
gctcgtattttgactggattgggaa

SEQ ID NO: 567339 - DNA, 25 bp, Mus musculus
gctcgtattttgtctggattgggaa

SEQ ID NO: 567340 - DNA, 25 bp, Mus musculus
gctcgtcaggtgcaacaagtggatt

SEQ ID NO: 567341 - DNA, 25 bp, Mus musculus
gctcgtcaggtggaacaagtggatt

SEQ ID NO: 567342 - DNA, 25 bp, Mus musculus
gctcgtccatatactttcacgggaa

SEQ ID NO: 567343 - DNA, 25 bp, Mus musculus
gctcgtccatattctttcacgggaa

SEQ ID NO: 567344 - DNA, 25 bp, Mus musculus
gctcgtccctcaactgcatgagaga

SEQ ID NO: 567345 - DNA, 25 bp, Mus musculus
gctcgtccctcatctgcatgagaga

SEQ ID NO: 567346 - DNA, 25 bp, Mus musculus
gctcgtcccttgcacagggtcttta

SEQ ID NO: 567347 - DNA, 25 bp, Mus musculus
gctcgtcccttggacagggtcttta

SEQ ID NO: 567348 - DNA, 25 bp, Mus musculus
gctcgtctggccatgaaattctgaa

SEQ ID NO: 567349 - DNA, 25 bp, Mus musculus
gctcgtctggccttgaaattctgaa

SEQ ID NO: 567350 - DNA, 25 bp, Mus musculus
gctcgtcttgggatgtgtggtttta

SEQ ID NO: 567351 - DNA, 25 bp, Mus musculus
gctcgtcttgggttgtgtggtttta

SEQ ID NO: 567352 - DNA, 25 bp, Mus musculus
gctcgtgaatgacttcttcctggta

SEQ ID NO: 567353 - DNA, 25 bp, Mus musculus
gctcgtgaatgagttcttcctggta

SEQ ID NO: 567354 - DNA, 25 bp, Mus musculus
gctcgtgacaacagctccagtggag

SEQ ID NO: 567355 - DNA, 25 bp, Mus musculus
gctcgtgacaactgctccagtggag

SEQ ID NO: 567356 - DNA, 25 bp, Mus musculus
gctcgtgaggcaaaaacgcgatgaa

SEQ ID NO: 567357 - DNA, 25 bp, Mus musculus
gctcgtgaggcataaacgcgatgaa

SEQ ID NO: 567358 - DNA, 25 bp, Mus musculus
gctcgtgcccagcaggaatcatgct

SEQ ID NO: 567359 - DNA, 25 bp, Mus musculus
gctcgtgcccaggaggaatcatgct

SEQ ID NO: 567360 - DNA, 25 bp, Mus musculus
gctcgtgcctgtctttattttagta

SEQ ID NO: 567361 - DNA, 25 bp, Mus musculus
gctcgtgcctgtgtttattttagta

SEQ ID NO: 567362 - DNA, 25 bp, Mus musculus
gctcgtggactcacaacaggttggt

SEQ ID NO: 567363 - DNA, 25 bp, Mus musculus
gctcgtggactctcaacaggttggt

SEQ ID NO: 567364 - DNA, 25 bp, Mus musculus
gctcgtggagacaacttccgtgcta

SEQ ID NO: 567365 - DNA, 25 bp, Mus musculus
gctcgtggagactacttccgtgcta

SEQ ID NO: 567366 - DNA, 25 bp, Mus musculus
gctcgtgggtttcattctgcatcca

SEQ ID NO: 567367 - DNA, 25 bp, Mus musculus
gctcgtgggtttgattctgcatcca

SEQ ID NO: 567368 - DNA, 25 bp, Mus musculus
gctcgtggtgcacgacaagcaatga

SEQ ID NO: 567369 - DNA, 25 bp, Mus musculus
gctcgtggtgcaggacaagcaatga

SEQ ID NO: 567370 - DNA, 25 bp, Mus musculus
gctcgtggtttacagaccaagggaa

SEQ ID NO: 567371 - DNA, 25 bp, Mus musculus
gctcgtggtttagagaccaagggaa

SEQ ID NO: 567372 - DNA, 25 bp, Mus musculus
gctcgtgtcactcagttcaatgtca

SEQ ID NO: 567373 - DNA, 25 bp, Mus musculus
gctcgtgtcactgagttcaatgtca

SEQ ID NO: 567374 - DNA, 25 bp, Mus musculus
gctcgtgtcctaagctgtgttgaca

SEQ ID NO: 567375 - DNA, 25 bp, Mus musculus
gctcgtgtcctatgctgtgttgaca

SEQ ID NO: 567376 - DNA, 25 bp, Mus musculus
gctcgtgtccttcaagctccgggag

SEQ ID NO: 567377 - DNA, 25 bp, Mus musculus
gctcgtgtccttgaagctccgggag

SEQ ID NO: 567378 - DNA, 25 bp, Mus musculus
gctcgtgtgagcctagctccccgga

SEQ ID NO: 567379 - DNA, 25 bp, Mus musculus
gctcgtgtgagcgtagctccccgga

SEQ ID NO: 567380 - DNA, 25 bp, Mus musculus
gctcgtgttcagaaccagtggtatc

SEQ ID NO: 567381 - DNA, 25 bp, Mus musculus
gctcgtgttcagtaccagtggtatc

SEQ ID NO: 567382 - DNA, 25 bp, Mus musculus
gctcgtgtttttcagtggttgccag

SEQ ID NO: 567383 - DNA, 25 bp, Mus musculus
gctcgtgtttttgagtggttgccag

SEQ ID NO: 567384 - DNA, 25 bp, Mus musculus
gctcgttaatctattacgctgctca

SEQ ID NO: 567385 - DNA, 25 bp, Mus musculus
gctcgttaatcttttacgctgctca

SEQ ID NO: 567386 - DNA, 25 bp, Mus musculus
gctcgttagggaacatccatcacaa

SEQ ID NO: 567387 - DNA, 25 bp, Mus musculus
gctcgttagggatcatccatcacaa

SEQ ID NO: 567388 - DNA, 25 bp, Mus musculus
gctcgttccaaaccctattgtaggt

SEQ ID NO: 567389 - DNA, 25 bp, Mus musculus
gctcgttccaaagcctattgtaggt

SEQ ID NO: 567390 - DNA, 25 bp, Mus musculus
gctcgttctaggctgctaccaagga

SEQ ID NO: 567391 - DNA, 25 bp, Mus musculus
gctcgttctagggtgctaccaagga

SEQ ID NO: 567392 - DNA, 25 bp, Mus musculus
gctcgttctcgacacagtacataca

SEQ ID NO: 567393 - DNA, 25 bp, Mus musculus
gctcgttctcgagacagtacataca

SEQ ID NO: 567394 - DNA, 25 bp, Mus musculus
gctcgttgccatcggatacgctaat

SEQ ID NO: 567395 - DNA, 25 bp, Mus musculus
gctcgttgccatgggatacgctaat

SEQ ID NO: 567396 - DNA, 25 bp, Mus musculus
gctcgttgccttctttattccggaa

SEQ ID NO: 567397 - DNA, 25 bp, Mus musculus
gctcgttgccttgtttattccggaa

SEQ ID NO: 567398 - DNA, 25 bp, Mus musculus
gctcgttgggccagctaaacaaggg

SEQ ID NO: 567399 - DNA, 25 bp, Mus musculus
gctcgttgggcctgctaaacaaggg

SEQ ID NO: 567400 - DNA, 25 bp, Mus musculus
gctcgttggtatcaggaaccagctt

SEQ ID NO: 567401 - DNA, 25 bp, Mus musculus
gctcgttggtatgaggaaccagctt

SEQ ID NO: 567402 - DNA, 25 bp, Mus musculus
gctcgttgtacaagtttctgtgcta

SEQ ID NO: 567403 - DNA, 25 bp, Mus musculus
gctcgttgtacatgtttctgtgcta

SEQ ID NO: 567404 - DNA, 25 bp, Mus musculus
gctcgttgtcggcaaaggaacccag

SEQ ID NO: 567405 - DNA, 25 bp, Mus musculus
gctcgttgtcgggaaaggaacccag

SEQ ID NO: 567406 - DNA, 25 bp, Mus musculus
gctcgttgttctctcagtctttttg

SEQ ID NO: 567407 - DNA, 25 bp, Mus musculus
gctcgttgttctgtcagtctttttg

SEQ ID NO: 567408 - DNA, 25 bp, Mus musculus
gctcgtttaagcaatcactatctga

SEQ ID NO: 567409 - DNA, 25 bp, Mus musculus
gctcgtttaagctatcactatctga

SEQ ID NO: 567410 - DNA, 25 bp, Mus musculus
gctcgtttccttcaaccttttcagt

SEQ ID NO: 567411 - DNA, 25 bp, Mus musculus
gctcgtttccttgaaccttttcagt

SEQ ID NO: 567412 - DNA, 25 bp, Mus musculus
gctctaaaacagaactccctacagg

SEQ ID NO: 567413 - DNA, 25 bp, Mus musculus
gctctaaaacagtactccctacagg

SEQ ID NO: 567414 - DNA, 25 bp, Mus musculus
gctctaaaacttctctacatttctg

SEQ ID NO: 567415 - DNA, 25 bp, Mus musculus
gctctaaaacttgtctacatttctg

SEQ ID NO: 567416 - DNA, 25 bp, Mus musculus
gctctaaagccaatgcctcgaaaac

SEQ ID NO: 567417 - DNA, 25 bp, Mus musculus
gctctaaagccattgcctcgaaaac

SEQ ID NO: 567418 - DNA, 25 bp, Mus musculus
gctctaaatctgccctgcaagctca

SEQ ID NO: 567419 - DNA, 25 bp, Mus musculus
gctctaaatctggcctgcaagctca

SEQ ID NO: 567420 - DNA, 25 bp, Mus musculus
gctctaactgtgagcagcttcttaa

SEQ ID NO: 567421 - DNA, 25 bp, Mus musculus
gctctaactgtgtgcagcttcttaa

SEQ ID NO: 567422 - DNA, 25 bp, Mus musculus
gctctaactttcactctgatcagac

SEQ ID NO: 567423 - DNA, 25 bp, Mus musculus
gctctaactttctctctgatcagac

SEQ ID NO: 567424 - DNA, 25 bp, Mus musculus
gctctaagaactagtcatagcacca

SEQ ID NO: 567425 - DNA, 25 bp, Mus musculus
gctctaagaacttgtcatagcacca

SEQ ID NO: 567426 - DNA, 25 bp, Mus musculus
gctctaagccacatgttacagacca

SEQ ID NO: 567427 - DNA, 25 bp, Mus musculus
gctctaagccacttgttacagacca

SEQ ID NO: 567428 - DNA, 25 bp, Mus musculus
gctctaagcttacctttgctcattt

SEQ ID NO: 567429 - DNA, 25 bp, Mus musculus
gctctaagcttagctttgctcattt

SEQ ID NO: 567430 - DNA, 25 bp, Mus musculus
gctctaagcttgaccttcaaggtgt

SEQ ID NO: 567431 - DNA, 25 bp, Mus musculus
gctctaagcttgtccttcaaggtgt

SEQ ID NO: 567432 - DNA, 25 bp, Mus musculus
gctctaaggatcagacacttctatt

SEQ ID NO: 567433 - DNA, 25 bp, Mus musculus
gctctaaggatctgacacttctatt

SEQ ID NO: 567434 - DNA, 25 bp, Mus musculus
gctctaaggcatcccctggaactgg

SEQ ID NO: 567435 - DNA, 25 bp, Mus musculus
gctctaaggcatgccctggaactgg

SEQ ID NO: 567436 - DNA, 25 bp, Mus musculus
gctctaagtcttaaacgtgtatcca

SEQ ID NO: 567437 - DNA, 25 bp, Mus musculus
gctctaagtcttagtggttgtcgcc

SEQ ID NO: 567438 - DNA, 25 bp, Mus musculus
gctctaagtctttaacgtgtatcca

SEQ ID NO: 567439 - DNA, 25 bp, Mus musculus
gctctaagtctttgtggttgtcgcc

SEQ ID NO: 567440 - DNA, 25 bp, Mus musculus
gctctaatcaggacccattgcaagg

SEQ ID NO: 567441 - DNA, 25 bp, Mus musculus
gctctaatcaggtcccattgcaagg

SEQ ID NO: 567442 - DNA, 25 bp, Mus musculus
gctctaatccttccctgagttacag

SEQ ID NO: 567443 - DNA, 25 bp, Mus musculus
gctctaatccttgcctgagttacag

SEQ ID NO: 567444 - DNA, 25 bp, Mus musculus
gctctaatgcacagatataccacat

SEQ ID NO: 567445 - DNA, 25 bp, Mus musculus
gctctaatgcactgatataccacat

SEQ ID NO: 567446 - DNA, 25 bp, Mus musculus
gctctaatggagatcagcccgtgct

SEQ ID NO: 567447 - DNA, 25 bp, Mus musculus
gctctaatggagttcagcccgtgct

SEQ ID NO: 567448 - DNA, 25 bp, Mus musculus
gctctaatgtccctgtgcttagttc

SEQ ID NO: 567449 - DNA, 25 bp, Mus musculus
gctctaatgtccgtgtgcttagttc

SEQ ID NO: 567450 - DNA, 25 bp, Mus musculus
gctctaatgtgtaacacttcctctg

SEQ ID NO: 567451 - DNA, 25 bp, Mus musculus
gctctaatgtgttacacttcctctg

SEQ ID NO: 567452 - DNA, 25 bp, Mus musculus
gctctacacaagatcaagccagatg

SEQ ID NO: 567453 - DNA, 25 bp, Mus musculus
gctctacacaagttcaagccagatg

SEQ ID NO: 567454 - DNA, 25 bp, Mus musculus
gctctacacctccattaacaggaaa

SEQ ID NO: 567455 - DNA, 25 bp, Mus musculus
gctctacacctcgattaacaggaaa

SEQ ID NO: 567456 - DNA, 25 bp, Mus musculus
gctctacagcggatatgccttcaag

SEQ ID NO: 567457 - DNA, 25 bp, Mus musculus
gctctacagcggttatgccttcaag

SEQ ID NO: 567458 - DNA, 25 bp, Mus musculus
gctctacccacaagtgtcaattcag

SEQ ID NO: 567459 - DNA, 25 bp, Mus musculus
gctctacccacatgtgtcaattcag

SEQ ID NO: 567460 - DNA, 25 bp, Mus musculus
gctctacccagcagcacaaagacta

SEQ ID NO: 567461 - DNA, 25 bp, Mus musculus
gctctacccagctgcacaaagacta

SEQ ID NO: 567462 - DNA, 25 bp, Mus musculus
gctctaccgtgccttatgactggga

SEQ ID NO: 567463 - DNA, 25 bp, Mus musculus
gctctaccgtgcgttatgactggga

SEQ ID NO: 567464 - DNA, 25 bp, Mus musculus
gctctacctaaacctacaggtgtct

SEQ ID NO: 567465 - DNA, 25 bp, Mus musculus
gctctacctaaagctacaggtgtct

SEQ ID NO: 567466 - DNA, 25 bp, Mus musculus
gctctacctagtaaagtctctctga

SEQ ID NO: 567467 - DNA, 25 bp, Mus musculus
gctctacctagttaagtctctctga

SEQ ID NO: 567468 - DNA, 25 bp, Mus musculus
gctctacctttcatctcagagattg

SEQ ID NO: 567469 - DNA, 25 bp, Mus musculus
gctctacctttcttctcagagattg

SEQ ID NO: 567470 - DNA, 25 bp, Mus musculus
gctctaccttttcgagaacggccag

SEQ ID NO: 567471 - DNA, 25 bp, Mus musculus
gctctaccttttggagaacggccag

SEQ ID NO: 567472 - DNA, 25 bp, Mus musculus
gctctacgaaggactgctcatttgg

SEQ ID NO: 567473 - DNA, 25 bp, Mus musculus
gctctacgaaggtctgctcatttgg

SEQ ID NO: 567474 - DNA, 25 bp, Mus musculus
gctctacgcaataaatggcttcaga

SEQ ID NO: 567475 - DNA, 25 bp, Mus musculus
gctctacgcaattaatggcttcaga

SEQ ID NO: 567476 - DNA, 25 bp, Mus musculus
gctctactaaaaccagctcttaatt

SEQ ID NO: 567477 - DNA, 25 bp, Mus musculus
gctctactaaaagcagctcttaatt

SEQ ID NO: 567478 - DNA, 25 bp, Mus musculus
gctctactcagtcgtacagatagct

SEQ ID NO: 567479 - DNA, 25 bp, Mus musculus
gctctactcagtggtacagatagct

SEQ ID NO: 567480 - DNA, 25 bp, Mus musculus
gctctactcatgacgttctcgaatg

SEQ ID NO: 567481 - DNA, 25 bp, Mus musculus
gctctactcatgtcgttctcgaatg

SEQ ID NO: 567482 - DNA, 25 bp, Mus musculus
gctctactcttaactgtcctgaatt

SEQ ID NO: 567483 - DNA, 25 bp, Mus musculus
gctctactcttatctgtcctgaatt

SEQ ID NO: 567484 - DNA, 25 bp, Mus musculus
gctctactgagtaggcttgtagccc

SEQ ID NO: 567485 - DNA, 25 bp, Mus musculus
gctctactgagttggcttgtagccc

SEQ ID NO: 567486 - DNA, 25 bp, Mus musculus
gctctactgcaacctctagtaacac

SEQ ID NO: 567487 - DNA, 25 bp, Mus musculus
gctctactgcaagctctagtaacac

SEQ ID NO: 567488 - DNA, 25 bp, Mus musculus
gctctactgcagacatgtcaatggt

SEQ ID NO: 567489 - DNA, 25 bp, Mus musculus
gctctactgcagtcatgtcaatggt

SEQ ID NO: 567490 - DNA, 25 bp, Mus musculus
gctctactggaccttgaatgcttga

SEQ ID NO: 567491 - DNA, 25 bp, Mus musculus
gctctactggacgttgaatgcttga

SEQ ID NO: 567492 - DNA, 25 bp, Mus musculus
gctctactggagcatttgtattcct

SEQ ID NO: 567493 - DNA, 25 bp, Mus musculus
gctctactggaggatttgtattcct

SEQ ID NO: 567494 - DNA, 25 bp, Mus musculus
gctctactgttactttgctgtgcaa

SEQ ID NO: 567495 - DNA, 25 bp, Mus musculus
gctctactgttagtttgctgtgcaa

SEQ ID NO: 567496 - DNA, 25 bp, Mus musculus
gctctacttctcatatctgtgcagt

SEQ ID NO: 567497 - DNA, 25 bp, Mus musculus
gctctacttctcttatctgtgcagt

SEQ ID NO: 567498 - DNA, 25 bp, Mus musculus
gctctacttgtcatgaacatgagaa

SEQ ID NO: 567499 - DNA, 25 bp, Mus musculus
gctctacttgtcttgaacatgagaa

SEQ ID NO: 567500 - DNA, 25 bp, Mus musculus
gctctacttgttcgtatgcaccgtg

SEQ ID NO: 567501 - DNA, 25 bp, Mus musculus
gctctacttgttggtatgcaccgtg

SEQ ID NO: 567502 - DNA, 25 bp, Mus musculus
gctctactttggatgcatgttattc

SEQ ID NO: 567503 - DNA, 25 bp, Mus musculus
gctctactttggttgcatgttattc

SEQ ID NO: 567504 - DNA, 25 bp, Mus musculus
gctctagaacttcctgtcgtttgta

SEQ ID NO: 567505 - DNA, 25 bp, Mus musculus
gctctagaacttgctgtcgtttgta

SEQ ID NO: 567506 - DNA, 25 bp, Mus musculus
gctctagacactatcagaatggatt

SEQ ID NO: 567507 - DNA, 25 bp, Mus musculus
gctctagacactttcagaatggatt

SEQ ID NO: 567508 - DNA, 25 bp, Mus musculus
gctctagaccctcaaccagcaagtg

SEQ ID NO: 567509 - DNA, 25 bp, Mus musculus
gctctagaccctgaaccagcaagtg

SEQ ID NO: 567510 - DNA, 25 bp, Mus musculus
gctctagactggatcgggagttctc

SEQ ID NO: 567511 - DNA, 25 bp, Mus musculus
gctctagactggttcgggagttctc

SEQ ID NO: 567512 - DNA, 25 bp, Mus musculus
gctctagagcagatcttcctgcttt

SEQ ID NO: 567513 - DNA, 25 bp, Mus musculus
gctctagagcagttcttcctgcttt

SEQ ID NO: 567514 - DNA, 25 bp, Mus musculus
gctctagatggccttgtaaccctca

SEQ ID NO: 567515 - DNA, 25 bp, Mus musculus
gctctagatggcgttgtaaccctca

SEQ ID NO: 567516 - DNA, 25 bp, Mus musculus
gctctagcaactatccgtgtatgga

SEQ ID NO: 567517 - DNA, 25 bp, Mus musculus
gctctagcaactttccgtgtatgga

SEQ ID NO: 567518 - DNA, 25 bp, Mus musculus
gctctagcgaggaccgtctaggtga

SEQ ID NO: 567519 - DNA, 25 bp, Mus musculus
gctctagcgaggtccgtctaggtga

SEQ ID NO: 567520 - DNA, 25 bp, Mus musculus
gctctagctagaagtgtctcctgat

SEQ ID NO: 567521 - DNA, 25 bp, Mus musculus
gctctagctagatgtgtctcctgat

SEQ ID NO: 567522 - DNA, 25 bp, Mus musculus
gctctaggaagcaccgaagggcagt

SEQ ID NO: 567523 - DNA, 25 bp, Mus musculus
gctctaggaagctccgaagggcagt

SEQ ID NO: 567524 - DNA, 25 bp, Mus musculus
gctctaggacggattttggaacagt

SEQ ID NO: 567525 - DNA, 25 bp, Mus musculus
gctctaggacggtttttggaacagt

SEQ ID NO: 567526 - DNA, 25 bp, Mus musculus
gctctaggagccaaatccccagaca

SEQ ID NO: 567527 - DNA, 25 bp, Mus musculus
gctctaggagcctaatccccagaca

SEQ ID NO: 567528 - DNA, 25 bp, Mus musculus
gctctaggaggaaaactgatgccaa

SEQ ID NO: 567529 - DNA, 25 bp, Mus musculus
gctctaggaggataactgatgccaa

SEQ ID NO: 567530 - DNA, 25 bp, Mus musculus
gctctaggcctcattgatttttctc

SEQ ID NO: 567531 - DNA, 25 bp, Mus musculus
gctctaggcctctttgatttttctc

SEQ ID NO: 567532 - DNA, 25 bp, Mus musculus
gctctaggcttgattctgtaaccct

SEQ ID NO: 567533 - DNA, 25 bp, Mus musculus
gctctaggcttgtttctgtaaccct

SEQ ID NO: 567534 - DNA, 25 bp, Mus musculus
gctctagggaggctaccatggaact

SEQ ID NO: 567535 - DNA, 25 bp, Mus musculus
gctctagggagggtaccatggaact

SEQ ID NO: 567536 - DNA, 25 bp, Mus musculus
gctctagggttaccctggatacaca

SEQ ID NO: 567537 - DNA, 25 bp, Mus musculus
gctctagggttagcctggatacaca

SEQ ID NO: 567538 - DNA, 25 bp, Mus musculus
gctctaggtttaatttccaatgctg

SEQ ID NO: 567539 - DNA, 25 bp, Mus musculus
gctctaggtttattttccaatgctg

SEQ ID NO: 567540 - DNA, 25 bp, Mus musculus
gctctagtaacacatggacccattg

SEQ ID NO: 567541 - DNA, 25 bp, Mus musculus
gctctagtaacagatggacccattg

SEQ ID NO: 567542 - DNA, 25 bp, Mus musculus
gctctagtgatgactgcatttgtac

SEQ ID NO: 567543 - DNA, 25 bp, Mus musculus
gctctagtgatgtctgcatttgtac

SEQ ID NO: 567544 - DNA, 25 bp, Mus musculus
gctctagttctgaaaagtggcttga

SEQ ID NO: 567545 - DNA, 25 bp, Mus musculus
gctctagttctgtaaagtggcttga

SEQ ID NO: 567546 - DNA, 25 bp, Mus musculus
gctctagttgagatttctgtgtcca

SEQ ID NO: 567547 - DNA, 25 bp, Mus musculus
gctctagttgagttttctgtgtcca

SEQ ID NO: 567548 - DNA, 25 bp, Mus musculus
gctctagtttctctgagaatccctt

SEQ ID NO: 567549 - DNA, 25 bp, Mus musculus
gctctagtttctgtgagaatccctt

SEQ ID NO: 567550 - DNA, 25 bp, Mus musculus
gctctataagaacttggttgcccag

SEQ ID NO: 567551 - DNA, 25 bp, Mus musculus
gctctataagaagttggttgcccag

SEQ ID NO: 567552 - DNA, 25 bp, Mus musculus
gctctataagtgactgctctcatga

SEQ ID NO: 567553 - DNA, 25 bp, Mus musculus
gctctataagtgtctgctctcatga

SEQ ID NO: 567554 - DNA, 25 bp, Mus musculus
gctctataatagctggtcccctttt

SEQ ID NO: 567555 - DNA, 25 bp, Mus musculus
gctctataataggtggtcccctttt

SEQ ID NO: 567556 - DNA, 25 bp, Mus musculus
gctctatacaggcaccaggccatta

SEQ ID NO: 567557 - DNA, 25 bp, Mus musculus
gctctatacagggaccaggccatta

SEQ ID NO: 567558 - DNA, 25 bp, Mus musculus
gctctatacgctccatgggcaccag

SEQ ID NO: 567559 - DNA, 25 bp, Mus musculus
gctctatacgctgcatgggcaccag

SEQ ID NO: 567560 - DNA, 25 bp, Mus musculus
gctctatactacagagcctgcagct

SEQ ID NO: 567561 - DNA, 25 bp, Mus musculus
gctctatactactgagcctgcagct

SEQ ID NO: 567562 - DNA, 25 bp, Mus musculus
gctctatattcaagctatttgtgta

SEQ ID NO: 567563 - DNA, 25 bp, Mus musculus
gctctatattcatgctatttgtgta

SEQ ID NO: 567564 - DNA, 25 bp, Mus musculus
gctctatccagacgctgcaggcaga

SEQ ID NO: 567565 - DNA, 25 bp, Mus musculus
gctctatccagaggctgcaggcaga

SEQ ID NO: 567566 - DNA, 25 bp, Mus musculus
gctctatccagccaactttaatctt

SEQ ID NO: 567567 - DNA, 25 bp, Mus musculus
gctctatccagcgaactttaatctt

SEQ ID NO: 567568 - DNA, 25 bp, Mus musculus
gctctatccctgagattcctgttta

SEQ ID NO: 567569 - DNA, 25 bp, Mus musculus
gctctatccctgtgattcctgttta

SEQ ID NO: 567570 - DNA, 25 bp, Mus musculus
gctctatcctgtaccacacaatagg

SEQ ID NO: 567571 - DNA, 25 bp, Mus musculus
gctctatcctgttccacacaatagg

SEQ ID NO: 567572 - DNA, 25 bp, Mus musculus
gctctatctcgtagacacgtcgctg

SEQ ID NO: 567573 - DNA, 25 bp, Mus musculus
gctctatctcgttgacacgtcgctg

SEQ ID NO: 567574 - DNA, 25 bp, Mus musculus
gctctatgaagcatttacggccaca

SEQ ID NO: 567575 - DNA, 25 bp, Mus musculus
gctctatgaagcttttacggccaca

SEQ ID NO: 567576 - DNA, 25 bp, Mus musculus
gctctatgagcccaaagtcatgagt

SEQ ID NO: 567577 - DNA, 25 bp, Mus musculus
gctctatgagccgaaagtcatgagt

SEQ ID NO: 567578 - DNA, 25 bp, Mus musculus
gctctatgcagccagtgcttggtca

SEQ ID NO: 567579 - DNA, 25 bp, Mus musculus
gctctatgcagcgagtgcttggtca

SEQ ID NO: 567580 - DNA, 25 bp, Mus musculus
gctctatgcctcacttggagcaaat

SEQ ID NO: 567581 - DNA, 25 bp, Mus musculus
gctctatgcctctcttggagcaaat

SEQ ID NO: 567582 - DNA, 25 bp, Mus musculus
gctctatggacacaatttgggcttc

SEQ ID NO: 567583 - DNA, 25 bp, Mus musculus
gctctatggacagaatttgggcttc

SEQ ID NO: 567584 - DNA, 25 bp, Mus musculus
gctctatgggcgaggacccaggcat

SEQ ID NO: 567585 - DNA, 25 bp, Mus musculus
gctctatgggcgtggacccaggcat

SEQ ID NO: 567586 - DNA, 25 bp, Mus musculus
gctctatggtgaccctttctagata

SEQ ID NO: 567587 - DNA, 25 bp, Mus musculus
gctctatggtgagcctttctagata

SEQ ID NO: 567588 - DNA, 25 bp, Mus musculus
gctctatgtgagatgcctgggccca

SEQ ID NO: 567589 - DNA, 25 bp, Mus musculus
gctctatgtgagttgcctgggccca

SEQ ID NO: 567590 - DNA, 25 bp, Mus musculus
gctctattcagtcttgcatggcaaa

SEQ ID NO: 567591 - DNA, 25 bp, Mus musculus
gctctattcagtgttgcatggcaaa

SEQ ID NO: 567592 - DNA, 25 bp, Mus musculus
gctctattgattctacatcgtcaca

SEQ ID NO: 567593 - DNA, 25 bp, Mus musculus
gctctattgattgtacatcgtcaca

SEQ ID NO: 567594 - DNA, 25 bp, Mus musculus
gctctattgcggattttaaaatctg

SEQ ID NO: 567595 - DNA, 25 bp, Mus musculus
gctctattgcggtttttaaaatctg

SEQ ID NO: 567596 - DNA, 25 bp, Mus musculus
gctctatttggtaactattgctatg

SEQ ID NO: 567597 - DNA, 25 bp, Mus musculus
gctctatttggttactattgctatg

SEQ ID NO: 567598 - DNA, 25 bp, Mus musculus
gctctattttaaatgctcccattta

SEQ ID NO: 567599 - DNA, 25 bp, Mus musculus
gctctattttaactgcttggcagcc

SEQ ID NO: 567600 - DNA, 25 bp, Mus musculus
gctctattttaagtgcttggcagcc

SEQ ID NO: 567601 - DNA, 25 bp, Mus musculus
gctctattttaattgctcccattta

SEQ ID NO: 567602 - DNA, 25 bp, Mus musculus
gctctcaaaaaacagccatctgcat

SEQ ID NO: 567603 - DNA, 25 bp, Mus musculus
gctctcaaaaaagagccatctgcat

SEQ ID NO: 567604 - DNA, 25 bp, Mus musculus
gctctcaaatgcatgcttcctaatc

SEQ ID NO: 567605 - DNA, 25 bp, Mus musculus
gctctcaaatgcttgcttcctaatc

SEQ ID NO: 567606 - DNA, 25 bp, Mus musculus
gctctcaactagctgtttgtggcca

SEQ ID NO: 567607 - DNA, 25 bp, Mus musculus
gctctcaactaggtgtttgtggcca

SEQ ID NO: 567608 - DNA, 25 bp, Mus musculus
gctctcaaggacaggcccttggtaa

SEQ ID NO: 567609 - DNA, 25 bp, Mus musculus
gctctcaaggactggcccttggtaa

SEQ ID NO: 567610 - DNA, 25 bp, Mus musculus
gctctcaatatacaccagccacatt

SEQ ID NO: 567611 - DNA, 25 bp, Mus musculus
gctctcaatatagaccagccacatt

SEQ ID NO: 567612 - DNA, 25 bp, Mus musculus
gctctcaattggagcttatcactag

SEQ ID NO: 567613 - DNA, 25 bp, Mus musculus
gctctcaattggtgcttatcactag

SEQ ID NO: 567614 - DNA, 25 bp, Mus musculus
gctctcaatttcaggactcacagct

SEQ ID NO: 567615 - DNA, 25 bp, Mus musculus
gctctcaatttctggactcacagct

SEQ ID NO: 567616 - DNA, 25 bp, Mus musculus
gctctcacactaagccatagtggag

SEQ ID NO: 567617 - DNA, 25 bp, Mus musculus
gctctcacactatgccatagtggag

SEQ ID NO: 567618 - DNA, 25 bp, Mus musculus
gctctcacagaaccggtgggttcca

SEQ ID NO: 567619 - DNA, 25 bp, Mus musculus
gctctcacagaagcggtgggttcca

SEQ ID NO: 567620 - DNA, 25 bp, Mus musculus
gctctcacaggaaaaggctttatga

SEQ ID NO: 567621 - DNA, 25 bp, Mus musculus
gctctcacaggacaactgcgctttt

SEQ ID NO: 567622 - DNA, 25 bp, Mus musculus
gctctcacaggagaactgcgctttt

SEQ ID NO: 567623 - DNA, 25 bp, Mus musculus
gctctcacaggataaggctttatga

SEQ ID NO: 567624 - DNA, 25 bp, Mus musculus
gctctcacagtaagcctctacataa

SEQ ID NO: 567625 - DNA, 25 bp, Mus musculus
gctctcacagtatgcctctacataa

SEQ ID NO: 567626 - DNA, 25 bp, Mus musculus
gctctcaccattctaaagatttctt

SEQ ID NO: 567627 - DNA, 25 bp, Mus musculus
gctctcaccattgtaaagatttctt

SEQ ID NO: 567628 - DNA, 25 bp, Mus musculus
gctctcacccttagtgacacaagtg

SEQ ID NO: 567629 - DNA, 25 bp, Mus musculus
gctctcaccctttgtgacacaagtg

SEQ ID NO: 567630 - DNA, 25 bp, Mus musculus
gctctcacctggaccttatgaggga

SEQ ID NO: 567631 - DNA, 25 bp, Mus musculus
gctctcacctggtccttatgaggga

SEQ ID NO: 567632 - DNA, 25 bp, Mus musculus
gctctcactagcaagtctattcttt

SEQ ID NO: 567633 - DNA, 25 bp, Mus musculus
gctctcactagctagtctattcttt

SEQ ID NO: 567634 - DNA, 25 bp, Mus musculus
gctctcactagtctgaagcccaaag

SEQ ID NO: 567635 - DNA, 25 bp, Mus musculus
gctctcactagtgtgaagcccaaag

SEQ ID NO: 567636 - DNA, 25 bp, Mus musculus
gctctcactgagctggccgctgtgt

SEQ ID NO: 567637 - DNA, 25 bp, Mus musculus
gctctcactgaggtggccgctgtgt

SEQ ID NO: 567638 - DNA, 25 bp, Mus musculus
gctctcacttcacatggccatgttg

SEQ ID NO: 567639 - DNA, 25 bp, Mus musculus
gctctcacttcagatggccatgttg

SEQ ID NO: 567640 - DNA, 25 bp, Mus musculus
gctctcagaagccacgttagcgtct

SEQ ID NO: 567641 - DNA, 25 bp, Mus musculus
gctctcagaagcgacgttagcgtct

SEQ ID NO: 567642 - DNA, 25 bp, Mus musculus
gctctcagaaggcaaatgtgccgag

SEQ ID NO: 567643 - DNA, 25 bp, Mus musculus
gctctcagaagggaaatgtgccgag

SEQ ID NO: 567644 - DNA, 25 bp, Mus musculus
gctctcagagaactccaggctaata

SEQ ID NO: 567645 - DNA, 25 bp, Mus musculus
gctctcagagaagtccaggctaata

SEQ ID NO: 567646 - DNA, 25 bp, Mus musculus
gctctcagcagcacttgcttgtctt

SEQ ID NO: 567647 - DNA, 25 bp, Mus musculus
gctctcagcagctcttgcttgtctt

SEQ ID NO: 567648 - DNA, 25 bp, Mus musculus
gctctcagcaggaagcggaagctcc

SEQ ID NO: 567649 - DNA, 25 bp, Mus musculus
gctctcagcaggtagcggaagctcc

SEQ ID NO: 567650 - DNA, 25 bp, Mus musculus
gctctcagcatcagcctgttggatt

SEQ ID NO: 567651 - DNA, 25 bp, Mus musculus
gctctcagcatctgcctgttggatt

SEQ ID NO: 567652 - DNA, 25 bp, Mus musculus
gctctcagccacagccgtggagaaa

SEQ ID NO: 567653 - DNA, 25 bp, Mus musculus
gctctcagccactgccgtggagaaa

SEQ ID NO: 567654 - DNA, 25 bp, Mus musculus
gctctcagcctcacttagtgaacat

SEQ ID NO: 567655 - DNA, 25 bp, Mus musculus
gctctcagcctctcttagtgaacat

SEQ ID NO: 567656 - DNA, 25 bp, Mus musculus
gctctcaggaatcctttattcttgt

SEQ ID NO: 567657 - DNA, 25 bp, Mus musculus
gctctcaggaatgctttattcttgt

SEQ ID NO: 567658 - DNA, 25 bp, Mus musculus
gctctcaggacaatcgagtgattat

SEQ ID NO: 567659 - DNA, 25 bp, Mus musculus
gctctcaggacattcgagtgattat

SEQ ID NO: 567660 - DNA, 25 bp, Mus musculus
gctctcaggaggctacaacaggact

SEQ ID NO: 567661 - DNA, 25 bp, Mus musculus
gctctcaggagggtacaacaggact

SEQ ID NO: 567662 - DNA, 25 bp, Mus musculus
gctctcaggattaaggctgtttgct

SEQ ID NO: 567663 - DNA, 25 bp, Mus musculus
gctctcaggatttaggctgtttgct

SEQ ID NO: 567664 - DNA, 25 bp, Mus musculus
gctctcaggccaactgaagaaagtt

SEQ ID NO: 567665 - DNA, 25 bp, Mus musculus
gctctcaggccatctgaagaaagtt

SEQ ID NO: 567666 - DNA, 25 bp, Mus musculus
gctctcaggcgcagaacataatctt

SEQ ID NO: 567667 - DNA, 25 bp, Mus musculus
gctctcaggcgctgaacataatctt

SEQ ID NO: 567668 - DNA, 25 bp, Mus musculus
gctctcagtgaacgatggcctccca

SEQ ID NO: 567669 - DNA, 25 bp, Mus musculus
gctctcagtgaaggatggcctccca

SEQ ID NO: 567670 - DNA, 25 bp, Mus musculus
gctctcagtgcgacatttcctggaa

SEQ ID NO: 567671 - DNA, 25 bp, Mus musculus
gctctcagtgcgtcatttcctggaa

SEQ ID NO: 567672 - DNA, 25 bp, Mus musculus
gctctcagtggccacgtttggaaca

SEQ ID NO: 567673 - DNA, 25 bp, Mus musculus
gctctcagtggcgacgtttggaaca

SEQ ID NO: 567674 - DNA, 25 bp, Mus musculus
gctctcagtgtacaagtggacattt

SEQ ID NO: 567675 - DNA, 25 bp, Mus musculus
gctctcagtgtagaagtggacattt

SEQ ID NO: 567676 - DNA, 25 bp, Mus musculus
gctctcagttttccctgacaaacgg

SEQ ID NO: 567677 - DNA, 25 bp, Mus musculus
gctctcagttttgcctgacaaacgg

SEQ ID NO: 567678 - DNA, 25 bp, Mus musculus
gctctcataactatgcacttcattg

SEQ ID NO: 567679 - DNA, 25 bp, Mus musculus
gctctcataactttgcacttcattg

SEQ ID NO: 567680 - DNA, 25 bp, Mus musculus
gctctcatcagccttaattttggaa

SEQ ID NO: 567681 - DNA, 25 bp, Mus musculus
gctctcatcagcgttaattttggaa

SEQ ID NO: 567682 - DNA, 25 bp, Mus musculus
gctctcatctcccagttcatgagaa

SEQ ID NO: 567683 - DNA, 25 bp, Mus musculus
gctctcatctccgagttcatgagaa

SEQ ID NO: 567684 - DNA, 25 bp, Mus musculus
gctctcatctctcgttccaaaggaa

SEQ ID NO: 567685 - DNA, 25 bp, Mus musculus
gctctcatctctggttccaaaggaa

SEQ ID NO: 567686 - DNA, 25 bp, Mus musculus
gctctcatcttcattctgttgggaa

SEQ ID NO: 567687 - DNA, 25 bp, Mus musculus
gctctcatcttccatgtggaacgat

SEQ ID NO: 567688 - DNA, 25 bp, Mus musculus
gctctcatcttcgatgtggaacgat

SEQ ID NO: 567689 - DNA, 25 bp, Mus musculus
gctctcatcttctttctgttgggaa

SEQ ID NO: 567690 - DNA, 25 bp, Mus musculus
gctctcatctttcccattcagaaat

SEQ ID NO: 567691 - DNA, 25 bp, Mus musculus
gctctcatctttgccattcagaaat

SEQ ID NO: 567692 - DNA, 25 bp, Mus musculus
gctctcatgcgccactgacagaaaa

SEQ ID NO: 567693 - DNA, 25 bp, Mus musculus
gctctcatgcgcgactgacagaaaa

SEQ ID NO: 567694 - DNA, 25 bp, Mus musculus
gctctcatggatactctgcatcagg

SEQ ID NO: 567695 - DNA, 25 bp, Mus musculus
gctctcatggattctctgcatcagg

SEQ ID NO: 567696 - DNA, 25 bp, Mus musculus
gctctcatgttcaagatttctctgg

SEQ ID NO: 567697 - DNA, 25 bp, Mus musculus
gctctcatgttctagatttctctgg

SEQ ID NO: 567698 - DNA, 25 bp, Mus musculus
gctctcattaagcatgggtccaggc

SEQ ID NO: 567699 - DNA, 25 bp, Mus musculus
gctctcattaaggatgggtccaggc

SEQ ID NO: 567700 - DNA, 25 bp, Mus musculus
gctctcattcttactcgtctaaaga

SEQ ID NO: 567701 - DNA, 25 bp, Mus musculus
gctctcattctttctcgtctaaaga

SEQ ID NO: 567702 - DNA, 25 bp, Mus musculus
gctctcattggtcttttctctttat

SEQ ID NO: 567703 - DNA, 25 bp, Mus musculus
gctctcattggtgttttctctttat

SEQ ID NO: 567704 - DNA, 25 bp, Mus musculus
gctctcatttgcagtttctgtgtca

SEQ ID NO: 567705 - DNA, 25 bp, Mus musculus
gctctcatttgctgtttctgtgtca

SEQ ID NO: 567706 - DNA, 25 bp, Mus musculus
gctctccaactccaaggagttctca

SEQ ID NO: 567707 - DNA, 25 bp, Mus musculus
gctctccaactcgaaggagttctca

SEQ ID NO: 567708 - DNA, 25 bp, Mus musculus
gctctccaagttctagactagcctg

SEQ ID NO: 567709 - DNA, 25 bp, Mus musculus
gctctccaagttgtagactagcctg

SEQ ID NO: 567710 - DNA, 25 bp, Mus musculus
gctctccacaaactatccaaggtgt

SEQ ID NO: 567711 - DNA, 25 bp, Mus musculus
gctctccacaaagtatccaaggtgt

SEQ ID NO: 567712 - DNA, 25 bp, Mus musculus
gctctccaccagagtattcatactg

SEQ ID NO: 567713 - DNA, 25 bp, Mus musculus
gctctccaccagtgtattcatactg

SEQ ID NO: 567714 - DNA, 25 bp, Mus musculus
gctctccacggacgacgtcgtcggt

SEQ ID NO: 567715 - DNA, 25 bp, Mus musculus
gctctccacggaggacgtcgtcggt

SEQ ID NO: 567716 - DNA, 25 bp, Mus musculus
gctctccactgcaagcggacatgaa

SEQ ID NO: 567717 - DNA, 25 bp, Mus musculus
gctctccactgctagcggacatgaa

SEQ ID NO: 567718 - DNA, 25 bp, Mus musculus
gctctccagcacctgtgtaagtgca

SEQ ID NO: 567719 - DNA, 25 bp, Mus musculus
gctctccagcacgtgtgtaagtgca

SEQ ID NO: 567720 - DNA, 25 bp, Mus musculus
gctctccaggccatgagaaatggct

SEQ ID NO: 567721 - DNA, 25 bp, Mus musculus
gctctccaggccttgagaaatggct

SEQ ID NO: 567722 - DNA, 25 bp, Mus musculus
gctctccaggctaggagttctggga

SEQ ID NO: 567723 - DNA, 25 bp, Mus musculus
gctctccaggcttggagttctggga

SEQ ID NO: 567724 - DNA, 25 bp, Mus musculus
gctctccagtaaaacgccaggtgtg

SEQ ID NO: 567725 - DNA, 25 bp, Mus musculus
gctctccagtaatacgccaggtgtg

SEQ ID NO: 567726 - DNA, 25 bp, Mus musculus
gctctccattgtcaatgttgcccag

SEQ ID NO: 567727 - DNA, 25 bp, Mus musculus
gctctccattgtgaatgttgcccag

SEQ ID NO: 567728 - DNA, 25 bp, Mus musculus
gctctcccagcccaaggtgatgaac

SEQ ID NO: 567729 - DNA, 25 bp, Mus musculus
gctctcccagccgaaggtgatgaac

SEQ ID NO: 567730 - DNA, 25 bp, Mus musculus
gctctcccatacagaataccgaatc

SEQ ID NO: 567731 - DNA, 25 bp, Mus musculus
gctctcccatactgaataccgaatc

SEQ ID NO: 567732 - DNA, 25 bp, Mus musculus
gctctcccattaacctgttggttga

SEQ ID NO: 567733 - DNA, 25 bp, Mus musculus
gctctcccattatcctgttggttga

SEQ ID NO: 567734 - DNA, 25 bp, Mus musculus
gctctccccacacttctaatgtatg

SEQ ID NO: 567735 - DNA, 25 bp, Mus musculus
gctctccccacagttctaatgtatg

SEQ ID NO: 567736 - DNA, 25 bp, Mus musculus
gctctcccgaataagagcatgagga

SEQ ID NO: 567737 - DNA, 25 bp, Mus musculus
gctctcccgaattagagcatgagga

SEQ ID NO: 567738 - DNA, 25 bp, Mus musculus
gctctcccgatactgattctttagt

SEQ ID NO: 567739 - DNA, 25 bp, Mus musculus
gctctcccgatagtgattctttagt

SEQ ID NO: 567740 - DNA, 25 bp, Mus musculus
gctctcccggtaagttttaatgaca

SEQ ID NO: 567741 - DNA, 25 bp, Mus musculus
gctctcccggtatgttttaatgaca

SEQ ID NO: 567742 - DNA, 25 bp, Mus musculus
gctctcccggtgaatgtgatttgca

SEQ ID NO: 567743 - DNA, 25 bp, Mus musculus
gctctcccggtgtatgtgatttgca

SEQ ID NO: 567744 - DNA, 25 bp, Mus musculus
gctctccctaccctgatattaattt

SEQ ID NO: 567745 - DNA, 25 bp, Mus musculus
gctctccctaccgtgatattaattt

SEQ ID NO: 567746 - DNA, 25 bp, Mus musculus
gctctccctgttactagtgtcttaa

SEQ ID NO: 567747 - DNA, 25 bp, Mus musculus
gctctccctgtttctagtgtcttaa

SEQ ID NO: 567748 - DNA, 25 bp, Mus musculus
gctctcccttatatgttcatcgttg

SEQ ID NO: 567749 - DNA, 25 bp, Mus musculus
gctctcccttatttgttcatcgttg

SEQ ID NO: 567750 - DNA, 25 bp, Mus musculus
gctctccgggagaaaccaatcctag

SEQ ID NO: 567751 - DNA, 25 bp, Mus musculus
gctctccgggagtaaccaatcctag

SEQ ID NO: 567752 - DNA, 25 bp, Mus musculus
gctctccgggtgaccaggcgctctt

SEQ ID NO: 567753 - DNA, 25 bp, Mus musculus
gctctccgggtgtccaggcgctctt

SEQ ID NO: 567754 - DNA, 25 bp, Mus musculus
gctctccgtatgaaagcctggacat

SEQ ID NO: 567755 - DNA, 25 bp, Mus musculus
gctctccgtatgtaagcctggacat

SEQ ID NO: 567756 - DNA, 25 bp, Mus musculus
gctctcctaagtaactgagggtagt

SEQ ID NO: 567757 - DNA, 25 bp, Mus musculus
gctctcctaagttactgagggtagt

SEQ ID NO: 567758 - DNA, 25 bp, Mus musculus
gctctcctacttcctatctacaaaa

SEQ ID NO: 567759 - DNA, 25 bp, Mus musculus
gctctcctacttgctatctacaaaa

SEQ ID NO: 567760 - DNA, 25 bp, Mus musculus
gctctcctagctctggaagaaaaca

SEQ ID NO: 567761 - DNA, 25 bp, Mus musculus
gctctcctagctgtggaagaaaaca

SEQ ID NO: 567762 - DNA, 25 bp, Mus musculus
gctctcctatgaagctacctatcaa

SEQ ID NO: 567763 - DNA, 25 bp, Mus musculus
gctctcctatgatgctacctatcaa

SEQ ID NO: 567764 - DNA, 25 bp, Mus musculus
gctctcctcattatgctcaggagtt

SEQ ID NO: 567765 - DNA, 25 bp, Mus musculus
gctctcctcattttgctcaggagtt

SEQ ID NO: 567766 - DNA, 25 bp, Mus musculus
gctctcctctgcctttcagcagcag

SEQ ID NO: 567767 - DNA, 25 bp, Mus musculus
gctctcctctgcgtttcagcagcag

SEQ ID NO: 567768 - DNA, 25 bp, Mus musculus
gctctcctgctcatgatgaagcaca

SEQ ID NO: 567769 - DNA, 25 bp, Mus musculus
gctctcctgctcttgatgaagcaca

SEQ ID NO: 567770 - DNA, 25 bp, Mus musculus
gctctcctggacaccagaggcagaa

SEQ ID NO: 567771 - DNA, 25 bp, Mus musculus
gctctcctggactccagaggcagaa

SEQ ID NO: 567772 - DNA, 25 bp, Mus musculus
gctctcctgtatattataacctttg

SEQ ID NO: 567773 - DNA, 25 bp, Mus musculus
gctctcctgtattttataacctttg

SEQ ID NO: 567774 - DNA, 25 bp, Mus musculus
gctctcctgtgcagaaaagtgactg

SEQ ID NO: 567775 - DNA, 25 bp, Mus musculus
gctctcctgtgctgaaaagtgactg

SEQ ID NO: 567776 - DNA, 25 bp, Mus musculus
gctctcctgtggattttaagtctga

SEQ ID NO: 567777 - DNA, 25 bp, Mus musculus
gctctcctgtggtttttaagtctga

SEQ ID NO: 567778 - DNA, 25 bp, Mus musculus
gctctccttcttcgcgttagtggtt

SEQ ID NO: 567779 - DNA, 25 bp, Mus musculus
gctctccttcttggcgttagtggtt

SEQ ID NO: 567780 - DNA, 25 bp, Mus musculus
gctctccttgatctcttccaaatag

SEQ ID NO: 567781 - DNA, 25 bp, Mus musculus
gctctccttgatgtcttccaaatag

SEQ ID NO: 567782 - DNA, 25 bp, Mus musculus
gctctcctttaactgatgacatcca

SEQ ID NO: 567783 - DNA, 25 bp, Mus musculus
gctctcctttaagtgatgacatcca

SEQ ID NO: 567784 - DNA, 25 bp, Mus musculus
gctctcgaaggtctgtggcttgatc

SEQ ID NO: 567785 - DNA, 25 bp, Mus musculus
gctctcgaaggtgtgtggcttgatc

SEQ ID NO: 567786 - DNA, 25 bp, Mus musculus
gctctcgacctgataattgtttgat

SEQ ID NO: 567787 - DNA, 25 bp, Mus musculus
gctctcgacctgttaattgtttgat

SEQ ID NO: 567788 - DNA, 25 bp, Mus musculus
gctctcgagggacaaacagcttcct

SEQ ID NO: 567789 - DNA, 25 bp, Mus musculus
gctctcgagggagaaacagcttcct

SEQ ID NO: 567790 - DNA, 25 bp, Mus musculus
gctctcgcaatgatcctgtctaatt

SEQ ID NO: 567791 - DNA, 25 bp, Mus musculus
gctctcgcaatgttcctgtctaatt

SEQ ID NO: 567792 - DNA, 25 bp, Mus musculus
gctctcgccagaacacactaaactg

SEQ ID NO: 567793 - DNA, 25 bp, Mus musculus
gctctcgccagatcacactaaactg

SEQ ID NO: 567794 - DNA, 25 bp, Mus musculus
gctctcgctcatcagattctgttga

SEQ ID NO: 567795 - DNA, 25 bp, Mus musculus
gctctcgctcatgagattctgttga

SEQ ID NO: 567796 - DNA, 25 bp, Mus musculus
gctctcggatggacccttagatgga

SEQ ID NO: 567797 - DNA, 25 bp, Mus musculus
gctctcggatggtcccttagatgga

SEQ ID NO: 567798 - DNA, 25 bp, Mus musculus
gctctcgtttgcaaacctacagata

SEQ ID NO: 567799 - DNA, 25 bp, Mus musculus
gctctcgtttgctaacctacagata

SEQ ID NO: 567800 - DNA, 25 bp, Mus musculus
gctctctaagagagaatcccagttc

SEQ ID NO: 567801 - DNA, 25 bp, Mus musculus
gctctctaagagtgaatcccagttc

SEQ ID NO: 567802 - DNA, 25 bp, Mus musculus
gctctctaagcaagcattgcctatt

SEQ ID NO: 567803 - DNA, 25 bp, Mus musculus
gctctctaagcatgcattgcctatt

SEQ ID NO: 567804 - DNA, 25 bp, Mus musculus
gctctctaccacagttaggctggaa

SEQ ID NO: 567805 - DNA, 25 bp, Mus musculus
gctctctaccactgttaggctggaa

SEQ ID NO: 567806 - DNA, 25 bp, Mus musculus
gctctctaggcgattcttactttta

SEQ ID NO: 567807 - DNA, 25 bp, Mus musculus
gctctctaggcgtttcttactttta

SEQ ID NO: 567808 - DNA, 25 bp, Mus musculus
gctctctatcctatctgatgattca

SEQ ID NO: 567809 - DNA, 25 bp, Mus musculus
gctctctatcctttctgatgattca

SEQ ID NO: 567810 - DNA, 25 bp, Mus musculus
gctctctcaagcacgggaacaccag

SEQ ID NO: 567811 - DNA, 25 bp, Mus musculus
gctctctcaagctcgggaacaccag

SEQ ID NO: 567812 - DNA, 25 bp, Mus musculus
gctctctcactactgcttgattaag

SEQ ID NO: 567813 - DNA, 25 bp, Mus musculus
gctctctcactactgtttaagaata

SEQ ID NO: 567814 - DNA, 25 bp, Mus musculus
gctctctcactagtgcttgattaag

SEQ ID NO: 567815 - DNA, 25 bp, Mus musculus
gctctctcactagtgtttaagaata

SEQ ID NO: 567816 - DNA, 25 bp, Mus musculus
gctctctcagggaattaaagatact

SEQ ID NO: 567817 - DNA, 25 bp, Mus musculus
gctctctcagggtattaaagatact

SEQ ID NO: 567818 - DNA, 25 bp, Mus musculus
gctctctcatacacttatcaaggac

SEQ ID NO: 567819 - DNA, 25 bp, Mus musculus
gctctctcatactcttatcaaggac

SEQ ID NO: 567820 - DNA, 25 bp, Mus musculus
gctctctccagcaaacgcagtatta

SEQ ID NO: 567821 - DNA, 25 bp, Mus musculus
gctctctccagctaacgcagtatta

SEQ ID NO: 567822 - DNA, 25 bp, Mus musculus
gctctctccctaactattcaatata

SEQ ID NO: 567823 - DNA, 25 bp, Mus musculus
gctctctccctatctattcaatata

SEQ ID NO: 567824 - DNA, 25 bp, Mus musculus
gctctctccggactttcagtgatca

SEQ ID NO: 567825 - DNA, 25 bp, Mus musculus
gctctctccggagtttcagtgatca

SEQ ID NO: 567826 - DNA, 25 bp, Mus musculus
gctctctctatgcatgtgagtcaga

SEQ ID NO: 567827 - DNA, 25 bp, Mus musculus
gctctctctatggatgtgagtcaga

SEQ ID NO: 567828 - DNA, 25 bp, Mus musculus
gctctctctcctatctaaaaaacct

SEQ ID NO: 567829 - DNA, 25 bp, Mus musculus
gctctctctcctttctaaaaaacct

SEQ ID NO: 567830 - DNA, 25 bp, Mus musculus
gctctctctgacaccgaagtagtag

SEQ ID NO: 567831 - DNA, 25 bp, Mus musculus
gctctctctgactccgaagtagtag

SEQ ID NO: 567832 - DNA, 25 bp, Mus musculus
gctctctctgcacatgacgtctaac

SEQ ID NO: 567833 - DNA, 25 bp, Mus musculus
gctctctctgcagatgacgtctaac

SEQ ID NO: 567834 - DNA, 25 bp, Mus musculus
gctctctgaaacaggaccaacgata

SEQ ID NO: 567835 - DNA, 25 bp, Mus musculus
gctctctgaaactggaccaacgata

SEQ ID NO: 567836 - DNA, 25 bp, Mus musculus
gctctctgaccacatgacctttttt

SEQ ID NO: 567837 - DNA, 25 bp, Mus musculus
gctctctgaccagatgacctttttt

SEQ ID NO: 567838 - DNA, 25 bp, Mus musculus
gctctctgagagattatcgaatgaa

SEQ ID NO: 567839 - DNA, 25 bp, Mus musculus
gctctctgagagtttatcgaatgaa

SEQ ID NO: 567840 - DNA, 25 bp, Mus musculus
gctctctgaggcacttaacacaatt

SEQ ID NO: 567841 - DNA, 25 bp, Mus musculus
gctctctgaggctcttaacacaatt

SEQ ID NO: 567842 - DNA, 25 bp, Mus musculus
gctctctgataaactactccaactg

SEQ ID NO: 567843 - DNA, 25 bp, Mus musculus
gctctctgataatctactccaactg

SEQ ID NO: 567844 - DNA, 25 bp, Mus musculus
gctctctgcaccattcattgtggca

SEQ ID NO: 567845 - DNA, 25 bp, Mus musculus
gctctctgcacctttcattgtggca

SEQ ID NO: 567846 - DNA, 25 bp, Mus musculus
gctctctgcagaagccagggatgaa

SEQ ID NO: 567847 - DNA, 25 bp, Mus musculus
gctctctgcagatgccagggatgaa

SEQ ID NO: 567848 - DNA, 25 bp, Mus musculus
gctctctgcaggactgtgcagtatg

SEQ ID NO: 567849 - DNA, 25 bp, Mus musculus
gctctctgcaggtctgtgcagtatg

SEQ ID NO: 567850 - DNA, 25 bp, Mus musculus
gctctctgcctcattattttgaggt

SEQ ID NO: 567851 - DNA, 25 bp, Mus musculus
gctctctgcctctttattttgaggt

SEQ ID NO: 567852 - DNA, 25 bp, Mus musculus
gctctctgctagatagtcccagata

SEQ ID NO: 567853 - DNA, 25 bp, Mus musculus
gctctctgctagttagtcccagata

SEQ ID NO: 567854 - DNA, 25 bp, Mus musculus
gctctctgctgtcactacagggtta

SEQ ID NO: 567855 - DNA, 25 bp, Mus musculus
gctctctgctgtgactacagggtta

SEQ ID NO: 567856 - DNA, 25 bp, Mus musculus
gctctctggcaccattgcttaagat

SEQ ID NO: 567857 - DNA, 25 bp, Mus musculus
gctctctggcacgattgcttaagat

SEQ ID NO: 567858 - DNA, 25 bp, Mus musculus
gctctctgggagatgtctgacttca

SEQ ID NO: 567859 - DNA, 25 bp, Mus musculus
gctctctgggagttgtctgacttca

SEQ ID NO: 567860 - DNA, 25 bp, Mus musculus
gctctctgtacgctgtgtagtttag

SEQ ID NO: 567861 - DNA, 25 bp, Mus musculus
gctctctgtacggtgtgtagtttag

SEQ ID NO: 567862 - DNA, 25 bp, Mus musculus
gctctctgtagtatccatcattggt

SEQ ID NO: 567863 - DNA, 25 bp, Mus musculus
gctctctgtagtttccatcattggt

SEQ ID NO: 567864 - DNA, 25 bp, Mus musculus
gctctctgtcctcattttcacatga

SEQ ID NO: 567865 - DNA, 25 bp, Mus musculus
gctctctgtcctgattttcacatga

SEQ ID NO: 567866 - DNA, 25 bp, Mus musculus
gctctctgtgagatcgatcataggc

SEQ ID NO: 567867 - DNA, 25 bp, Mus musculus
gctctctgtgagttcgatcataggc

SEQ ID NO: 567868 - DNA, 25 bp, Mus musculus
gctctctgtgctaatggtttgtcac

SEQ ID NO: 567869 - DNA, 25 bp, Mus musculus
gctctctgtgcttatggtttgtcac

SEQ ID NO: 567870 - DNA, 25 bp, Mus musculus
gctctctgtggaaatctacgaccga

SEQ ID NO: 567871 - DNA, 25 bp, Mus musculus
gctctctgtggatatctacgaccga

SEQ ID NO: 567872 - DNA, 25 bp, Mus musculus
gctctctgttggactcaatcggcag

SEQ ID NO: 567873 - DNA, 25 bp, Mus musculus
gctctctgttggtctcaatcggcag

SEQ ID NO: 567874 - DNA, 25 bp, Mus musculus
gctctctgttgtacactttcaagca

SEQ ID NO: 567875 - DNA, 25 bp, Mus musculus
gctctctgttgttcactttcaagca

SEQ ID NO: 567876 - DNA, 25 bp, Mus musculus
gctctctgtttcaagatacgtcatt

SEQ ID NO: 567877 - DNA, 25 bp, Mus musculus
gctctctgtttctagatacgtcatt

SEQ ID NO: 567878 - DNA, 25 bp, Mus musculus
gctctcttacacattcgcaggaatt

SEQ ID NO: 567879 - DNA, 25 bp, Mus musculus
gctctcttacactttcgcaggaatt

SEQ ID NO: 567880 - DNA, 25 bp, Mus musculus
gctctcttacctctgggtggcccgt

SEQ ID NO: 567881 - DNA, 25 bp, Mus musculus
gctctcttacctgtgggtggcccgt

SEQ ID NO: 567882 - DNA, 25 bp, Mus musculus
gctctcttagcgactaaagcattca

SEQ ID NO: 567883 - DNA, 25 bp, Mus musculus
gctctcttagcgtctaaagcattca

SEQ ID NO: 567884 - DNA, 25 bp, Mus musculus
gctctcttagttagctgttatatat

SEQ ID NO: 567885 - DNA, 25 bp, Mus musculus
gctctcttagtttgctgttatatat

SEQ ID NO: 567886 - DNA, 25 bp, Mus musculus
gctctcttattgcacaacaggcgac

SEQ ID NO: 567887 - DNA, 25 bp, Mus musculus
gctctcttattggacaacaggcgac

SEQ ID NO: 567888 - DNA, 25 bp, Mus musculus
gctctcttcagcaccttatttatat

SEQ ID NO: 567889 - DNA, 25 bp, Mus musculus
gctctcttcagctccttatttatat

SEQ ID NO: 567890 - DNA, 25 bp, Mus musculus
gctctcttcatgaactgggagctgt

SEQ ID NO: 567891 - DNA, 25 bp, Mus musculus
gctctcttcatgtactgggagctgt

SEQ ID NO: 567892 - DNA, 25 bp, Mus musculus
gctctcttcattcattttctgccaa

SEQ ID NO: 567893 - DNA, 25 bp, Mus musculus
gctctcttcattgattttctgccaa

SEQ ID NO: 567894 - DNA, 25 bp, Mus musculus
gctctcttccctatccggtgggaat

SEQ ID NO: 567895 - DNA, 25 bp, Mus musculus
gctctcttccctcaatcagaaacta

SEQ ID NO: 567896 - DNA, 25 bp, Mus musculus
gctctcttccctgaatcagaaacta

SEQ ID NO: 567897 - DNA, 25 bp, Mus musculus
gctctcttccctttccggtgggaat

SEQ ID NO: 567898 - DNA, 25 bp, Mus musculus
gctctcttctgcatttttcaagcat

SEQ ID NO: 567899 - DNA, 25 bp, Mus musculus
gctctcttctgcttttttcaagcat

SEQ ID NO: 567900 - DNA, 25 bp, Mus musculus
gctctcttcttaaggatacctgcat

SEQ ID NO: 567901 - DNA, 25 bp, Mus musculus
gctctcttcttatggatacctgcat

SEQ ID NO: 567902 - DNA, 25 bp, Mus musculus
gctctcttgggaacaattaaccatt

SEQ ID NO: 567903 - DNA, 25 bp, Mus musculus
gctctcttgggatcaattaaccatt

SEQ ID NO: 567904 - DNA, 25 bp, Mus musculus
gctctctttagcctcacaacattta

SEQ ID NO: 567905 - DNA, 25 bp, Mus musculus
gctctctttagcgtcacaacattta

SEQ ID NO: 567906 - DNA, 25 bp, Mus musculus
gctctctttcaacgcgcagtgatag

SEQ ID NO: 567907 - DNA, 25 bp, Mus musculus
gctctctttcaaggcgcagtgatag

SEQ ID NO: 567908 - DNA, 25 bp, Mus musculus
gctctctttcctcttgtgttgttta

SEQ ID NO: 567909 - DNA, 25 bp, Mus musculus
gctctctttcctgttgtgttgttta

SEQ ID NO: 567910 - DNA, 25 bp, Mus musculus
gctctctttcttcattattcaggga

SEQ ID NO: 567911 - DNA, 25 bp, Mus musculus
gctctctttcttcccgtgaaagtga

SEQ ID NO: 567912 - DNA, 25 bp, Mus musculus
gctctctttcttgattattcaggga

SEQ ID NO: 567913 - DNA, 25 bp, Mus musculus
gctctctttcttgccgtgaaagtga

SEQ ID NO: 567914 - DNA, 25 bp, Mus musculus
gctctctttggtattggagacctca

SEQ ID NO: 567915 - DNA, 25 bp, Mus musculus
gctctctttggttttggagacctca

SEQ ID NO: 567916 - DNA, 25 bp, Mus musculus
gctctctttgtaaatcagtaactga

SEQ ID NO: 567917 - DNA, 25 bp, Mus musculus
gctctctttgtatatcagtaactga

SEQ ID NO: 567918 - DNA, 25 bp, Mus musculus
gctctctttgttccttatgccgata

SEQ ID NO: 567919 - DNA, 25 bp, Mus musculus
gctctctttgttgcttatgccgata

SEQ ID NO: 567920 - DNA, 25 bp, Mus musculus
gctctcttttaaagcagctttgaag

SEQ ID NO: 567921 - DNA, 25 bp, Mus musculus
gctctcttttaatgcagctttgaag

SEQ ID NO: 567922 - DNA, 25 bp, Mus musculus
gctctcttttccacctaagggtgaa

SEQ ID NO: 567923 - DNA, 25 bp, Mus musculus
gctctcttttcctcctaagggtgaa

SEQ ID NO: 567924 - DNA, 25 bp, Mus musculus
gctctgaaagccactagtctggcta

SEQ ID NO: 567925 - DNA, 25 bp, Mus musculus
gctctgaaagcctctagtctggcta

SEQ ID NO: 567926 - DNA, 25 bp, Mus musculus
gctctgaacaatactagactgctga

SEQ ID NO: 567927 - DNA, 25 bp, Mus musculus
gctctgaacaattctagactgctga

SEQ ID NO: 567928 - DNA, 25 bp, Mus musculus
gctctgaacagtactcattttatta

SEQ ID NO: 567929 - DNA, 25 bp, Mus musculus
gctctgaacagttctcattttatta

SEQ ID NO: 567930 - DNA, 25 bp, Mus musculus
gctctgaacccacactcaaaagatt

SEQ ID NO: 567931 - DNA, 25 bp, Mus musculus
gctctgaacccagactcaaaagatt

SEQ ID NO: 567932 - DNA, 25 bp, Mus musculus
gctctgaactatctttcactgggcc

SEQ ID NO: 567933 - DNA, 25 bp, Mus musculus
gctctgaactatgtttcactgggcc

SEQ ID NO: 567934 - DNA, 25 bp, Mus musculus
gctctgaactctctgcttggtgatg

SEQ ID NO: 567935 - DNA, 25 bp, Mus musculus
gctctgaactctgtgcttggtgatg

SEQ ID NO: 567936 - DNA, 25 bp, Mus musculus
gctctgaagaacagtggcctgggct

SEQ ID NO: 567937 - DNA, 25 bp, Mus musculus
gctctgaagaactgtggcctgggct

SEQ ID NO: 567938 - DNA, 25 bp, Mus musculus
gctctgaagatcatgttttccgaaa

SEQ ID NO: 567939 - DNA, 25 bp, Mus musculus
gctctgaagatcttgttttccgaaa

SEQ ID NO: 567940 - DNA, 25 bp, Mus musculus
gctctgaagcagctgtctctgtgtg

SEQ ID NO: 567941 - DNA, 25 bp, Mus musculus
gctctgaagcaggtgtctctgtgtg

SEQ ID NO: 567942 - DNA, 25 bp, Mus musculus
gctctgaaggtcaagctccgatttg

SEQ ID NO: 567943 - DNA, 25 bp, Mus musculus
gctctgaaggtctagctccgatttg

SEQ ID NO: 567944 - DNA, 25 bp, Mus musculus
gctctgaaggtgagtccaagatccc

SEQ ID NO: 567945 - DNA, 25 bp, Mus musculus
gctctgaaggtgtgtccaagatccc

SEQ ID NO: 567946 - DNA, 25 bp, Mus musculus
gctctgaagtgaatggttgccctgt

SEQ ID NO: 567947 - DNA, 25 bp, Mus musculus
gctctgaagtgattggttgccctgt

SEQ ID NO: 567948 - DNA, 25 bp, Mus musculus
gctctgaagtgtcgctcctgaccag

SEQ ID NO: 567949 - DNA, 25 bp, Mus musculus
gctctgaagtgtggctcctgaccag

SEQ ID NO: 567950 - DNA, 25 bp, Mus musculus
gctctgaagttgaatgctgctgcca

SEQ ID NO: 567951 - DNA, 25 bp, Mus musculus
gctctgaagttgtatgctgctgcca

SEQ ID NO: 567952 - DNA, 25 bp, Mus musculus
gctctgaatctgcatatagtcttct

SEQ ID NO: 567953 - DNA, 25 bp, Mus musculus
gctctgaatctggatatagtcttct

SEQ ID NO: 567954 - DNA, 25 bp, Mus musculus
gctctgaattaaacgctgtggaaat

SEQ ID NO: 567955 - DNA, 25 bp, Mus musculus
gctctgaattaatcgctgtggaaat

SEQ ID NO: 567956 - DNA, 25 bp, Mus musculus
gctctgacacagagagtaccataaa

SEQ ID NO: 567957 - DNA, 25 bp, Mus musculus
gctctgacacagtgagtaccataaa

SEQ ID NO: 567958 - DNA, 25 bp, Mus musculus
gctctgacaccaaaggcatgcctgg

SEQ ID NO: 567959 - DNA, 25 bp, Mus musculus
gctctgacaccataggcatgcctgg

SEQ ID NO: 567960 - DNA, 25 bp, Mus musculus
gctctgacagagctaagtgaagaac

SEQ ID NO: 567961 - DNA, 25 bp, Mus musculus
gctctgacagaggtaagtgaagaac

SEQ ID NO: 567962 - DNA, 25 bp, Mus musculus
gctctgacatcaacgtttcatacac

SEQ ID NO: 567963 - DNA, 25 bp, Mus musculus
gctctgacatcatcgtttcatacac

SEQ ID NO: 567964 - DNA, 25 bp, Mus musculus
gctctgaccttaacaagcctgggaa

SEQ ID NO: 567965 - DNA, 25 bp, Mus musculus
gctctgaccttatcaagcctgggaa

SEQ ID NO: 567966 - DNA, 25 bp, Mus musculus
gctctgactagcaatatatagattt

SEQ ID NO: 567967 - DNA, 25 bp, Mus musculus
gctctgactagctatatatagattt

SEQ ID NO: 567968 - DNA, 25 bp, Mus musculus
gctctgactataaacttgtgccact

SEQ ID NO: 567969 - DNA, 25 bp, Mus musculus
gctctgactatatacttgtgccact

SEQ ID NO: 567970 - DNA, 25 bp, Mus musculus
gctctgactcttatttggcaatctg

SEQ ID NO: 567971 - DNA, 25 bp, Mus musculus
gctctgactcttttttggcaatctg

SEQ ID NO: 567972 - DNA, 25 bp, Mus musculus
gctctgactgagagtggtcctctaa

SEQ ID NO: 567973 - DNA, 25 bp, Mus musculus
gctctgactgagtgtggtcctctaa

SEQ ID NO: 567974 - DNA, 25 bp, Mus musculus
gctctgactgatatggcctcttttc

SEQ ID NO: 567975 - DNA, 25 bp, Mus musculus
gctctgactgatttggcctcttttc

SEQ ID NO: 567976 - DNA, 25 bp, Mus musculus
gctctgactgcaactatgggcgaga

SEQ ID NO: 567977 - DNA, 25 bp, Mus musculus
gctctgactgcatctatgggcgaga

SEQ ID NO: 567978 - DNA, 25 bp, Mus musculus
gctctgacttttcccaagatgacct

SEQ ID NO: 567979 - DNA, 25 bp, Mus musculus
gctctgacttttgccaagatgacct

SEQ ID NO: 567980 - DNA, 25 bp, Mus musculus
gctctgagagcaagccgacttgccc

SEQ ID NO: 567981 - DNA, 25 bp, Mus musculus
gctctgagagcatgccgacttgccc

SEQ ID NO: 567982 - DNA, 25 bp, Mus musculus
gctctgagagtgatgttttcctgat

SEQ ID NO: 567983 - DNA, 25 bp, Mus musculus
gctctgagagtgttgttttcctgat

SEQ ID NO: 567984 - DNA, 25 bp, Mus musculus
gctctgagccctagagactttgctc

SEQ ID NO: 567985 - DNA, 25 bp, Mus musculus
gctctgagcccttgagactttgctc

SEQ ID NO: 567986 - DNA, 25 bp, Mus musculus
gctctgagctggaccattttctcta

SEQ ID NO: 567987 - DNA, 25 bp, Mus musculus
gctctgagctggtccattttctcta

SEQ ID NO: 567988 - DNA, 25 bp, Mus musculus
gctctgaggaaaaccgaccctacaa

SEQ ID NO: 567989 - DNA, 25 bp, Mus musculus
gctctgaggaaatccgaccctacaa

SEQ ID NO: 567990 - DNA, 25 bp, Mus musculus
gctctgaggacaaagcaagtctgct

SEQ ID NO: 567991 - DNA, 25 bp, Mus musculus
gctctgaggacatagcaagtctgct

SEQ ID NO: 567992 - DNA, 25 bp, Mus musculus
gctctgaggagccatgcccaaagaa

SEQ ID NO: 567993 - DNA, 25 bp, Mus musculus
gctctgaggagcgatgcccaaagaa

SEQ ID NO: 567994 - DNA, 25 bp, Mus musculus
gctctgaggtggaggcaaagtcttc

SEQ ID NO: 567995 - DNA, 25 bp, Mus musculus
gctctgaggtggtggcaaagtcttc

SEQ ID NO: 567996 - DNA, 25 bp, Mus musculus
gctctgagtattaccaggtctccaa

SEQ ID NO: 567997 - DNA, 25 bp, Mus musculus
gctctgagtattcatggcctgtgtc

SEQ ID NO: 567998 - DNA, 25 bp, Mus musculus
gctctgagtattgatggcctgtgtc

SEQ ID NO: 567999 - DNA, 25 bp, Mus musculus
gctctgagtatttccaggtctccaa

SEQ ID NO: 568000 - DNA, 25 bp, Mus musculus
gctctgagtgaacccttagtgggaa

SEQ ID NO: 568001 - DNA, 25 bp, Mus musculus
gctctgagtgaagccttagtgggaa

SEQ ID NO: 568002 - DNA, 25 bp, Mus musculus
gctctgagtttgagcacatgaatac

SEQ ID NO: 568003 - DNA, 25 bp, Mus musculus
gctctgagtttgctaaggaacccta

SEQ ID NO: 568004 - DNA, 25 bp, Mus musculus
gctctgagtttggtaaggaacccta

SEQ ID NO: 568005 - DNA, 25 bp, Mus musculus
gctctgagtttgtgcacatgaatac

SEQ ID NO: 568006 - DNA, 25 bp, Mus musculus
gctctgatagttaatgggtactgat

SEQ ID NO: 568007 - DNA, 25 bp, Mus musculus
gctctgatagtttatgggtactgat

SEQ ID NO: 568008 - DNA, 25 bp, Mus musculus
gctctgatctgacccttagaaggaa

SEQ ID NO: 568009 - DNA, 25 bp, Mus musculus
gctctgatctgagccttagaaggaa

SEQ ID NO: 568010 - DNA, 25 bp, Mus musculus
gctctgatctggaaacgatgccgga

SEQ ID NO: 568011 - DNA, 25 bp, Mus musculus
gctctgatctggtaacgatgccgga

SEQ ID NO: 568012 - DNA, 25 bp, Mus musculus
gctctgatggcacctgtctggtgaa

SEQ ID NO: 568013 - DNA, 25 bp, Mus musculus
gctctgatggcagctgtctggtgaa

SEQ ID NO: 568014 - DNA, 25 bp, Mus musculus
gctctgatggttattcaggctgctc

SEQ ID NO: 568015 - DNA, 25 bp, Mus musculus
gctctgatggtttttcaggctgctc

SEQ ID NO: 568016 - DNA, 25 bp, Mus musculus
gctctgatttgtagactgaaactgt

SEQ ID NO: 568017 - DNA, 25 bp, Mus musculus
gctctgatttgttgactgaaactgt

SEQ ID NO: 568018 - DNA, 25 bp, Mus musculus
gctctgcaaactattcttcctttga

SEQ ID NO: 568019 - DNA, 25 bp, Mus musculus
gctctgcaaacttttcttcctttga

SEQ ID NO: 568020 - DNA, 25 bp, Mus musculus
gctctgcaaagaccggactcagggt

SEQ ID NO: 568021 - DNA, 25 bp, Mus musculus
gctctgcaaagagcggactcagggt

SEQ ID NO: 568022 - DNA, 25 bp, Mus musculus
gctctgcacatacatccagcttgaa

SEQ ID NO: 568023 - DNA, 25 bp, Mus musculus
gctctgcacatagatccagcttgaa

SEQ ID NO: 568024 - DNA, 25 bp, Mus musculus
gctctgcacatccagatcgcaatta

SEQ ID NO: 568025 - DNA, 25 bp, Mus musculus
gctctgcacatcgagatcgcaatta

SEQ ID NO: 568026 - DNA, 25 bp, Mus musculus
gctctgcaccatccgcaacatggag

SEQ ID NO: 568027 - DNA, 25 bp, Mus musculus
gctctgcaccatgcgcaacatggag

SEQ ID NO: 568028 - DNA, 25 bp, Mus musculus
gctctgcacctgcaagctatttgtg

SEQ ID NO: 568029 - DNA, 25 bp, Mus musculus
gctctgcacctggaagctatttgtg

SEQ ID NO: 568030 - DNA, 25 bp, Mus musculus
gctctgcagaaacatggccagccag

SEQ ID NO: 568031 - DNA, 25 bp, Mus musculus
gctctgcagaaagatggccagccag

SEQ ID NO: 568032 - DNA, 25 bp, Mus musculus
gctctgcagaggcacttctcatata

SEQ ID NO: 568033 - DNA, 25 bp, Mus musculus
gctctgcagagggacttctcatata

SEQ ID NO: 568034 - DNA, 25 bp, Mus musculus
gctctgcagcacaggtgtgcataat

SEQ ID NO: 568035 - DNA, 25 bp, Mus musculus
gctctgcagcactggtgtgcataat

SEQ ID NO: 568036 - DNA, 25 bp, Mus musculus
gctctgcagcggctactctaagaat

SEQ ID NO: 568037 - DNA, 25 bp, Mus musculus
gctctgcagcgggtactctaagaat

SEQ ID NO: 568038 - DNA, 25 bp, Mus musculus
gctctgcaggcacttaatgctcgct

SEQ ID NO: 568039 - DNA, 25 bp, Mus musculus
gctctgcaggcagttaatgctcgct

SEQ ID NO: 568040 - DNA, 25 bp, Mus musculus
gctctgcagtggagtcactaggtga

SEQ ID NO: 568041 - DNA, 25 bp, Mus musculus
gctctgcagtggtgtcactaggtga

SEQ ID NO: 568042 - DNA, 25 bp, Mus musculus
gctctgcatgaacctgtgctctctg

SEQ ID NO: 568043 - DNA, 25 bp, Mus musculus
gctctgcatgaagctgtgctctctg

SEQ ID NO: 568044 - DNA, 25 bp, Mus musculus
gctctgcatttaatcatggctccaa

SEQ ID NO: 568045 - DNA, 25 bp, Mus musculus
gctctgcatttattcatggctccaa

SEQ ID NO: 568046 - DNA, 25 bp, Mus musculus
gctctgcattttccatctcaatatc

SEQ ID NO: 568047 - DNA, 25 bp, Mus musculus
gctctgcattttgcatctcaatatc

SEQ ID NO: 568048 - DNA, 25 bp, Mus musculus
gctctgccaaagctcctaataagtt

SEQ ID NO: 568049 - DNA, 25 bp, Mus musculus
gctctgccaaaggtcctaataagtt

SEQ ID NO: 568050 - DNA, 25 bp, Mus musculus
gctctgccaaccatgtacgggattg

SEQ ID NO: 568051 - DNA, 25 bp, Mus musculus
gctctgccaaccttgtacgggattg

SEQ ID NO: 568052 - DNA, 25 bp, Mus musculus
gctctgccagtgacagtcctggaag

SEQ ID NO: 568053 - DNA, 25 bp, Mus musculus
gctctgccagtgtcagtcctggaag

SEQ ID NO: 568054 - DNA, 25 bp, Mus musculus
gctctgccagttctcattgggcgca

SEQ ID NO: 568055 - DNA, 25 bp, Mus musculus
gctctgccagttgtcattgggcgca

SEQ ID NO: 568056 - DNA, 25 bp, Mus musculus
gctctgcccatgagctaggtaagat

SEQ ID NO: 568057 - DNA, 25 bp, Mus musculus
gctctgcccatgcatgtttagcttt

SEQ ID NO: 568058 - DNA, 25 bp, Mus musculus
gctctgcccatggatgtttagcttt

SEQ ID NO: 568059 - DNA, 25 bp, Mus musculus
gctctgcccatgtgctaggtaagat

SEQ ID NO: 568060 - DNA, 25 bp, Mus musculus
gctctgccctctcagtattaatggt

SEQ ID NO: 568061 - DNA, 25 bp, Mus musculus
gctctgccctctgagtattaatggt

SEQ ID NO: 568062 - DNA, 25 bp, Mus musculus
gctctgccctggacaatattactgg

SEQ ID NO: 568063 - DNA, 25 bp, Mus musculus
gctctgccctggtcaatattactgg

SEQ ID NO: 568064 - DNA, 25 bp, Mus musculus
gctctgccgcctctacaaaggaaac

SEQ ID NO: 568065 - DNA, 25 bp, Mus musculus
gctctgccgcctgtacaaaggaaac

SEQ ID NO: 568066 - DNA, 25 bp, Mus musculus
gctctgcctcctaatatgattttgt

SEQ ID NO: 568067 - DNA, 25 bp, Mus musculus
gctctgcctccttatatgattttgt

SEQ ID NO: 568068 - DNA, 25 bp, Mus musculus
gctctgccttttaaaagtgttgaat

SEQ ID NO: 568069 - DNA, 25 bp, Mus musculus
gctctgcctttttaaagtgttgaat

SEQ ID NO: 568070 - DNA, 25 bp, Mus musculus
gctctgcgaacacctcaagacgata

SEQ ID NO: 568071 - DNA, 25 bp, Mus musculus
gctctgcgaacagctcaagacgata

SEQ ID NO: 568072 - DNA, 25 bp, Mus musculus
gctctgcgcgtactacagtactaac

SEQ ID NO: 568073 - DNA, 25 bp, Mus musculus
gctctgcgcgtagtacagtactaac

SEQ ID NO: 568074 - DNA, 25 bp, Mus musculus
gctctgctacctaaaagccttactg

SEQ ID NO: 568075 - DNA, 25 bp, Mus musculus
gctctgctaccttaaagccttactg

SEQ ID NO: 568076 - DNA, 25 bp, Mus musculus
gctctgctcagaaaacatgaagaaa

SEQ ID NO: 568077 - DNA, 25 bp, Mus musculus
gctctgctcagataacatgaagaaa

SEQ ID NO: 568078 - DNA, 25 bp, Mus musculus
gctctgctcatgcaccaaggactat

SEQ ID NO: 568079 - DNA, 25 bp, Mus musculus
gctctgctcatggaccaaggactat

SEQ ID NO: 568080 - DNA, 25 bp, Mus musculus
gctctgctccaacggttctgtgtaa

SEQ ID NO: 568081 - DNA, 25 bp, Mus musculus
gctctgctccaagggttctgtgtaa

SEQ ID NO: 568082 - DNA, 25 bp, Mus musculus
gctctgctccagctgtgaaagggtt

SEQ ID NO: 568083 - DNA, 25 bp, Mus musculus
gctctgctccaggtgtgaaagggtt

SEQ ID NO: 568084 - DNA, 25 bp, Mus musculus
gctctgctctacaagtcagtcatta

SEQ ID NO: 568085 - DNA, 25 bp, Mus musculus
gctctgctctactagtcagtcatta

SEQ ID NO: 568086 - DNA, 25 bp, Mus musculus
gctctgctctgaagacaacttagtg

SEQ ID NO: 568087 - DNA, 25 bp, Mus musculus
gctctgctctgatgacaacttagtg

SEQ ID NO: 568088 - DNA, 25 bp, Mus musculus
gctctgctcttcaatatgtagccca

SEQ ID NO: 568089 - DNA, 25 bp, Mus musculus
gctctgctcttctatatgtagccca

SEQ ID NO: 568090 - DNA, 25 bp, Mus musculus
gctctgctgaatctacccattttaa

SEQ ID NO: 568091 - DNA, 25 bp, Mus musculus
gctctgctgaatgtacccattttaa

SEQ ID NO: 568092 - DNA, 25 bp, Mus musculus
gctctgctgacaaccaggacttgga

SEQ ID NO: 568093 - DNA, 25 bp, Mus musculus
gctctgctgacatccaggacttgga

SEQ ID NO: 568094 - DNA, 25 bp, Mus musculus
gctctgctggagatagaacccacat

SEQ ID NO: 568095 - DNA, 25 bp, Mus musculus
gctctgctggagttagaacccacat

SEQ ID NO: 568096 - DNA, 25 bp, Mus musculus
gctctgctggctctgaaaaattcgt

SEQ ID NO: 568097 - DNA, 25 bp, Mus musculus
gctctgctggctgtgaaaaattcgt

SEQ ID NO: 568098 - DNA, 25 bp, Mus musculus
gctctgctgggcagaagcctagaca

SEQ ID NO: 568099 - DNA, 25 bp, Mus musculus
gctctgctgggctgaagcctagaca

SEQ ID NO: 568100 - DNA, 25 bp, Mus musculus
gctctgctgtccactatggacattg

SEQ ID NO: 568101 - DNA, 25 bp, Mus musculus
gctctgctgtcctctatggacattg

SEQ ID NO: 568102 - DNA, 25 bp, Mus musculus
gctctgctgttaaggtatctgctca

SEQ ID NO: 568103 - DNA, 25 bp, Mus musculus
gctctgctgttatggtatctgctca

SEQ ID NO: 568104 - DNA, 25 bp, Mus musculus
gctctgctgtttacatttgctatga

SEQ ID NO: 568105 - DNA, 25 bp, Mus musculus
gctctgctgttttcatttgctatga

SEQ ID NO: 568106 - DNA, 25 bp, Mus musculus
gctctgcttcctaggtgtctgagaa

SEQ ID NO: 568107 - DNA, 25 bp, Mus musculus
gctctgcttccttggtgtctgagaa

SEQ ID NO: 568108 - DNA, 25 bp, Mus musculus
gctctgcttgcacgaggaaaggcta

SEQ ID NO: 568109 - DNA, 25 bp, Mus musculus
gctctgcttgcaggaggaaaggcta

SEQ ID NO: 568110 - DNA, 25 bp, Mus musculus
gctctgcttgtgacatttccttcgc

SEQ ID NO: 568111 - DNA, 25 bp, Mus musculus
gctctgcttgtgtcatttccttcgc

SEQ ID NO: 568112 - DNA, 25 bp, Mus musculus
gctctgctttgccactggatgaata

SEQ ID NO: 568113 - DNA, 25 bp, Mus musculus
gctctgctttgcgactggatgaata

SEQ ID NO: 568114 - DNA, 25 bp, Mus musculus
gctctgcttttaatcagttggccat

SEQ ID NO: 568115 - DNA, 25 bp, Mus musculus
gctctgcttttattcagttggccat

SEQ ID NO: 568116 - DNA, 25 bp, Mus musculus
gctctgcttttccttcacggtttta

SEQ ID NO: 568117 - DNA, 25 bp, Mus musculus
gctctgcttttcgttcacggtttta

SEQ ID NO: 568118 - DNA, 25 bp, Mus musculus
gctctggaaaccaccacaataaagg

SEQ ID NO: 568119 - DNA, 25 bp, Mus musculus
gctctggaaacctccacaataaagg

SEQ ID NO: 568120 - DNA, 25 bp, Mus musculus
gctctggaacttagctgcaggaagc

SEQ ID NO: 568121 - DNA, 25 bp, Mus musculus
gctctggaactttgctgcaggaagc

SEQ ID NO: 568122 - DNA, 25 bp, Mus musculus
gctctggaagagacgcctgaggcta

SEQ ID NO: 568123 - DNA, 25 bp, Mus musculus
gctctggaagagtcgcctgaggcta

SEQ ID NO: 568124 - DNA, 25 bp, Mus musculus
gctctggaagtccttttcgtaacgt

SEQ ID NO: 568125 - DNA, 25 bp, Mus musculus
gctctggaagtcgttttcgtaacgt

SEQ ID NO: 568126 - DNA, 25 bp, Mus musculus
gctctggaagtgacacacctttgtt

SEQ ID NO: 568127 - DNA, 25 bp, Mus musculus
gctctggaagtgtcacacctttgtt

SEQ ID NO: 568128 - DNA, 25 bp, Mus musculus
gctctggacctcagccattatcaca

SEQ ID NO: 568129 - DNA, 25 bp, Mus musculus
gctctggacctctgccattatcaca

SEQ ID NO: 568130 - DNA, 25 bp, Mus musculus
gctctggacgagctggtgccaccct

SEQ ID NO: 568131 - DNA, 25 bp, Mus musculus
gctctggacgaggtggtgccaccct

SEQ ID NO: 568132 - DNA, 25 bp, Mus musculus
gctctggactctccgcaatttcaag

SEQ ID NO: 568133 - DNA, 25 bp, Mus musculus
gctctggactctgcgcaatttcaag

SEQ ID NO: 568134 - DNA, 25 bp, Mus musculus
gctctggactttcttggctctggac

SEQ ID NO: 568135 - DNA, 25 bp, Mus musculus
gctctggactttgttggctctggac

SEQ ID NO: 568136 - DNA, 25 bp, Mus musculus
gctctggagacaactgtgggtccca

SEQ ID NO: 568137 - DNA, 25 bp, Mus musculus
gctctggagacatctgtgggtccca

SEQ ID NO: 568138 - DNA, 25 bp, Mus musculus
gctctggagcacagttgattgatca

SEQ ID NO: 568139 - DNA, 25 bp, Mus musculus
gctctggagcactgttgattgatca

SEQ ID NO: 568140 - DNA, 25 bp, Mus musculus
gctctggagccaagggaaactgcat

SEQ ID NO: 568141 - DNA, 25 bp, Mus musculus
gctctggagccatgggaaactgcat

SEQ ID NO: 568142 - DNA, 25 bp, Mus musculus
gctctggagcgcaggcaggcatcaa

SEQ ID NO: 568143 - DNA, 25 bp, Mus musculus
gctctggagcgctggcaggcatcaa

SEQ ID NO: 568144 - DNA, 25 bp, Mus musculus
gctctggagcttacagttagcccta

SEQ ID NO: 568145 - DNA, 25 bp, Mus musculus
gctctggagctttcagttagcccta

SEQ ID NO: 568146 - DNA, 25 bp, Mus musculus
gctctggagttacctcttttccaga

SEQ ID NO: 568147 - DNA, 25 bp, Mus musculus
gctctggagttagctcttttccaga

SEQ ID NO: 568148 - DNA, 25 bp, Mus musculus
gctctggataagaatatccaccagt

SEQ ID NO: 568149 - DNA, 25 bp, Mus musculus
gctctggataagtatatccaccagt

SEQ ID NO: 568150 - DNA, 25 bp, Mus musculus
gctctggataccagcttttcaagtt

SEQ ID NO: 568151 - DNA, 25 bp, Mus musculus
gctctggatacctgcttttcaagtt

SEQ ID NO: 568152 - DNA, 25 bp, Mus musculus
gctctggatacgctgacagcacatt

SEQ ID NO: 568153 - DNA, 25 bp, Mus musculus
gctctggatacggtgacagcacatt

SEQ ID NO: 568154 - DNA, 25 bp, Mus musculus
gctctggatctgacagttgtagcat

SEQ ID NO: 568155 - DNA, 25 bp, Mus musculus
gctctggatctgtcagttgtagcat

SEQ ID NO: 568156 - DNA, 25 bp, Mus musculus
gctctggatcttcttgaagtcaatc

SEQ ID NO: 568157 - DNA, 25 bp, Mus musculus
gctctggatcttgttgaagtcaatc

SEQ ID NO: 568158 - DNA, 25 bp, Mus musculus
gctctggatgaaagatacccttgaa

SEQ ID NO: 568159 - DNA, 25 bp, Mus musculus
gctctggatgaatgatacccttgaa

SEQ ID NO: 568160 - DNA, 25 bp, Mus musculus
gctctggatgtcaggatccaaccaa

SEQ ID NO: 568161 - DNA, 25 bp, Mus musculus
gctctggatgtctggatccaaccaa

SEQ ID NO: 568162 - DNA, 25 bp, Mus musculus
gctctggatttgaccctgtccttcc

SEQ ID NO: 568163 - DNA, 25 bp, Mus musculus
gctctggatttgtccctgtccttcc

SEQ ID NO: 568164 - DNA, 25 bp, Mus musculus
gctctggcagggaagaaacttccat

SEQ ID NO: 568165 - DNA, 25 bp, Mus musculus
gctctggcagggatcgatgttgaaa

SEQ ID NO: 568166 - DNA, 25 bp, Mus musculus
gctctggcagggtagaaacttccat

SEQ ID NO: 568167 - DNA, 25 bp, Mus musculus
gctctggcagggttcgatgttgaaa

SEQ ID NO: 568168 - DNA, 25 bp, Mus musculus
gctctggcaggtacttcatggcaaa

SEQ ID NO: 568169 - DNA, 25 bp, Mus musculus
gctctggcaggttcttcatggcaaa

SEQ ID NO: 568170 - DNA, 25 bp, Mus musculus
gctctggcatcccaggctttgggaa

SEQ ID NO: 568171 - DNA, 25 bp, Mus musculus
gctctggcatccgaggctttgggaa

SEQ ID NO: 568172 - DNA, 25 bp, Mus musculus
gctctggccaccacagagatgcgaa

SEQ ID NO: 568173 - DNA, 25 bp, Mus musculus
gctctggccacctcagagatgcgaa

SEQ ID NO: 568174 - DNA, 25 bp, Mus musculus
gctctggcccaaagtccaactctga

SEQ ID NO: 568175 - DNA, 25 bp, Mus musculus
gctctggcccaatgtccaactctga

SEQ ID NO: 568176 - DNA, 25 bp, Mus musculus
gctctggccgtgacctcatcaactt

SEQ ID NO: 568177 - DNA, 25 bp, Mus musculus
gctctggccgtgtcctcatcaactt

SEQ ID NO: 568178 - DNA, 25 bp, Mus musculus
gctctggctcagagcgccgaacttg

SEQ ID NO: 568179 - DNA, 25 bp, Mus musculus
gctctggctcagtgcgccgaacttg

SEQ ID NO: 568180 - DNA, 25 bp, Mus musculus
gctctggctgctaactttgtatgac

SEQ ID NO: 568181 - DNA, 25 bp, Mus musculus
gctctggctgcttactttgtatgac

SEQ ID NO: 568182 - DNA, 25 bp, Mus musculus
gctctggctgtactgtcctctaaag

SEQ ID NO: 568183 - DNA, 25 bp, Mus musculus
gctctggctgtagtgtcctctaaag

SEQ ID NO: 568184 - DNA, 25 bp, Mus musculus
gctctggcttccctggtctacaaag

SEQ ID NO: 568185 - DNA, 25 bp, Mus musculus
gctctggcttccgtggtctacaaag

SEQ ID NO: 568186 - DNA, 25 bp, Mus musculus
gctctggcttctcaattgggatcac

SEQ ID NO: 568187 - DNA, 25 bp, Mus musculus
gctctggcttctgaattgggatcac

SEQ ID NO: 568188 - DNA, 25 bp, Mus musculus
gctctggcttgcattgttggtaaca

SEQ ID NO: 568189 - DNA, 25 bp, Mus musculus
gctctggcttgctttgttggtaaca

SEQ ID NO: 568190 - DNA, 25 bp, Mus musculus
gctctggctttgactgactcctggg

SEQ ID NO: 568191 - DNA, 25 bp, Mus musculus
gctctggctttgtctgactcctggg

SEQ ID NO: 568192 - DNA, 25 bp, Mus musculus
gctctgggaaatctgcacgcgcctg

SEQ ID NO: 568193 - DNA, 25 bp, Mus musculus
gctctgggaaatgtgcacgcgcctg

SEQ ID NO: 568194 - DNA, 25 bp, Mus musculus
gctctgggactaatctttattacat

SEQ ID NO: 568195 - DNA, 25 bp, Mus musculus
gctctgggactattctttattacat

SEQ ID NO: 568196 - DNA, 25 bp, Mus musculus
gctctgggagatacgggattttcac

SEQ ID NO: 568197 - DNA, 25 bp, Mus musculus
gctctgggagattcgggattttcac

SEQ ID NO: 568198 - DNA, 25 bp, Mus musculus
gctctgggagcaaagcttaattgcc

SEQ ID NO: 568199 - DNA, 25 bp, Mus musculus
gctctgggagcatagcttaattgcc

SEQ ID NO: 568200 - DNA, 25 bp, Mus musculus
gctctgggcaccactttgcaaagcc

SEQ ID NO: 568201 - DNA, 25 bp, Mus musculus
gctctgggcacctctttgcaaagcc

SEQ ID NO: 568202 - DNA, 25 bp, Mus musculus
gctctgggcagcattactaaattac

SEQ ID NO: 568203 - DNA, 25 bp, Mus musculus
gctctgggcagctttactaaattac

SEQ ID NO: 568204 - DNA, 25 bp, Mus musculus
gctctgggctctattgtattactga

SEQ ID NO: 568205 - DNA, 25 bp, Mus musculus
gctctgggctcttttgtattactga

SEQ ID NO: 568206 - DNA, 25 bp, Mus musculus
gctctgggtactactgcaaaccgat

SEQ ID NO: 568207 - DNA, 25 bp, Mus musculus
gctctgggtacttctgcaaaccgat

SEQ ID NO: 568208 - DNA, 25 bp, Mus musculus
gctctgggtcatagagtaactctcc

SEQ ID NO: 568209 - DNA, 25 bp, Mus musculus
gctctgggtcattgagtaactctcc

SEQ ID NO: 568210 - DNA, 25 bp, Mus musculus
gctctgggttcacccggagagtcat

SEQ ID NO: 568211 - DNA, 25 bp, Mus musculus
gctctgggttcagccggagagtcat

SEQ ID NO: 568212 - DNA, 25 bp, Mus musculus
gctctgggttgcctgaaactcaagt

SEQ ID NO: 568213 - DNA, 25 bp, Mus musculus
gctctgggttgcgtgaaactcaagt

SEQ ID NO: 568214 - DNA, 25 bp, Mus musculus
gctctgggtttgatctcaggtgcat

SEQ ID NO: 568215 - DNA, 25 bp, Mus musculus
gctctgggtttgttctcaggtgcat

SEQ ID NO: 568216 - DNA, 25 bp, Mus musculus
gctctggtacacatacaaggcccaa

SEQ ID NO: 568217 - DNA, 25 bp, Mus musculus
gctctggtacacttacaaggcccaa

SEQ ID NO: 568218 - DNA, 25 bp, Mus musculus
gctctggtattcactttaccttgtg

SEQ ID NO: 568219 - DNA, 25 bp, Mus musculus
gctctggtattctctttaccttgtg

SEQ ID NO: 568220 - DNA, 25 bp, Mus musculus
gctctggtcatcactgcttcccatg

SEQ ID NO: 568221 - DNA, 25 bp, Mus musculus
gctctggtcatctctgcttcccatg

SEQ ID NO: 568222 - DNA, 25 bp, Mus musculus
gctctggtctctctattttcacccc

SEQ ID NO: 568223 - DNA, 25 bp, Mus musculus
gctctggtctctgtattttcacccc

SEQ ID NO: 568224 - DNA, 25 bp, Mus musculus
gctctggtctgcctgaaagttggac

SEQ ID NO: 568225 - DNA, 25 bp, Mus musculus
gctctggtctgcgtgaaagttggac

SEQ ID NO: 568226 - DNA, 25 bp, Mus musculus
gctctggtgatgactgagatgttct

SEQ ID NO: 568227 - DNA, 25 bp, Mus musculus
gctctggtgatgtctgagatgttct

SEQ ID NO: 568228 - DNA, 25 bp, Mus musculus
gctctggtgctgaggaggacattct

SEQ ID NO: 568229 - DNA, 25 bp, Mus musculus
gctctggtgctgtggaggacattct

SEQ ID NO: 568230 - DNA, 25 bp, Mus musculus
gctctggtgcttagctttcatttaa

SEQ ID NO: 568231 - DNA, 25 bp, Mus musculus
gctctggtgctttgctttcatttaa

SEQ ID NO: 568232 - DNA, 25 bp, Mus musculus
gctctggtgggcaaagtcctacttc

SEQ ID NO: 568233 - DNA, 25 bp, Mus musculus
gctctggtgggctaagtcctacttc

SEQ ID NO: 568234 - DNA, 25 bp, Mus musculus
gctctggtgtgcatctgtggttaaa

SEQ ID NO: 568235 - DNA, 25 bp, Mus musculus
gctctggtgtgcttctgtggttaaa

SEQ ID NO: 568236 - DNA, 25 bp, Mus musculus
gctctggttagacttaaggcacatt

SEQ ID NO: 568237 - DNA, 25 bp, Mus musculus
gctctggttagagttaaggcacatt

SEQ ID NO: 568238 - DNA, 25 bp, Mus musculus
gctctggttcacattccataaaacg

SEQ ID NO: 568239 - DNA, 25 bp, Mus musculus
gctctggttcactttccataaaacg

SEQ ID NO: 568240 - DNA, 25 bp, Mus musculus
gctctggttcagaattctcttatct

SEQ ID NO: 568241 - DNA, 25 bp, Mus musculus
gctctggttcagtattctcttatct

SEQ ID NO: 568242 - DNA, 25 bp, Mus musculus
gctctggttccaatgtgactcatat

SEQ ID NO: 568243 - DNA, 25 bp, Mus musculus
gctctggttccattgtgactcatat

SEQ ID NO: 568244 - DNA, 25 bp, Mus musculus
gctctggttcgacgaggactagact

SEQ ID NO: 568245 - DNA, 25 bp, Mus musculus
gctctggttcgaggaggactagact

SEQ ID NO: 568246 - DNA, 25 bp, Mus musculus
gctctggtttacagcaatggctcaa

SEQ ID NO: 568247 - DNA, 25 bp, Mus musculus
gctctggtttacatctaagtcattg

SEQ ID NO: 568248 - DNA, 25 bp, Mus musculus
gctctggtttactgcaatggctcaa

SEQ ID NO: 568249 - DNA, 25 bp, Mus musculus
gctctggtttacttctaagtcattg

SEQ ID NO: 568250 - DNA, 25 bp, Mus musculus
gctctggtttccagtagaccagact

SEQ ID NO: 568251 - DNA, 25 bp, Mus musculus
gctctggtttcctgtagaccagact

SEQ ID NO: 568252 - DNA, 25 bp, Mus musculus
gctctggtttgaagggtttacctgt

SEQ ID NO: 568253 - DNA, 25 bp, Mus musculus
gctctggtttgatgggtttacctgt

SEQ ID NO: 568254 - DNA, 25 bp, Mus musculus
gctctggtttgtctgtcccggacac

SEQ ID NO: 568255 - DNA, 25 bp, Mus musculus
gctctggtttgtgtgtcccggacac

SEQ ID NO: 568256 - DNA, 25 bp, Mus musculus
gctctggttttacgaagccatcaat

SEQ ID NO: 568257 - DNA, 25 bp, Mus musculus
gctctggttttaggaagccatcaat

SEQ ID NO: 568258 - DNA, 25 bp, Mus musculus
gctctgtaaacaagaacgtgcctga

SEQ ID NO: 568259 - DNA, 25 bp, Mus musculus
gctctgtaaacatgaacgtgcctga

SEQ ID NO: 568260 - DNA, 25 bp, Mus musculus
gctctgtaaggcataagtgcttctt

SEQ ID NO: 568261 - DNA, 25 bp, Mus musculus
gctctgtaaggcttaagtgcttctt

SEQ ID NO: 568262 - DNA, 25 bp, Mus musculus
gctctgtaatacagttcctaaggac

SEQ ID NO: 568263 - DNA, 25 bp, Mus musculus
gctctgtaatactgttcctaaggac

SEQ ID NO: 568264 - DNA, 25 bp, Mus musculus
gctctgtaatgacggcaggttgcta

SEQ ID NO: 568265 - DNA, 25 bp, Mus musculus
gctctgtaatgagggcaggttgcta

SEQ ID NO: 568266 - DNA, 25 bp, Mus musculus
gctctgtaattgcttatattcctga

SEQ ID NO: 568267 - DNA, 25 bp, Mus musculus
gctctgtaattggttatattcctga

SEQ ID NO: 568268 - DNA, 25 bp, Mus musculus
gctctgtacatcacgaccttaacaa

SEQ ID NO: 568269 - DNA, 25 bp, Mus musculus
gctctgtacatcagctcttgataga

SEQ ID NO: 568270 - DNA, 25 bp, Mus musculus
gctctgtacatctcgaccttaacaa

SEQ ID NO: 568271 - DNA, 25 bp, Mus musculus
gctctgtacatctgctcttgataga

SEQ ID NO: 568272 - DNA, 25 bp, Mus musculus
gctctgtactacacaaagggcaaat

SEQ ID NO: 568273 - DNA, 25 bp, Mus musculus
gctctgtactactcaaagggcaaat

SEQ ID NO: 568274 - DNA, 25 bp, Mus musculus
gctctgtacttcaacccaattatta

SEQ ID NO: 568275 - DNA, 25 bp, Mus musculus
gctctgtacttctacccaattatta

SEQ ID NO: 568276 - DNA, 25 bp, Mus musculus
gctctgtagagaattgggctgttca

SEQ ID NO: 568277 - DNA, 25 bp, Mus musculus
gctctgtagagatttgggctgttca

SEQ ID NO: 568278 - DNA, 25 bp, Mus musculus
gctctgtagcagaattgttcatgta

SEQ ID NO: 568279 - DNA, 25 bp, Mus musculus
gctctgtagcagtattgttcatgta

SEQ ID NO: 568280 - DNA, 25 bp, Mus musculus
gctctgtaggcactactctgtaaat

SEQ ID NO: 568281 - DNA, 25 bp, Mus musculus
gctctgtaggcagtactctgtaaat

SEQ ID NO: 568282 - DNA, 25 bp, Mus musculus
gctctgtagggcaggtgacctgata

SEQ ID NO: 568283 - DNA, 25 bp, Mus musculus
gctctgtagggctggtgacctgata

SEQ ID NO: 568284 - DNA, 25 bp, Mus musculus
gctctgtaggttaacctgttcagaa

SEQ ID NO: 568285 - DNA, 25 bp, Mus musculus
gctctgtaggtttacctgttcagaa

SEQ ID NO: 568286 - DNA, 25 bp, Mus musculus
gctctgtagtgacttcagccaacct

SEQ ID NO: 568287 - DNA, 25 bp, Mus musculus
gctctgtagtgagttcagccaacct

SEQ ID NO: 568288 - DNA, 25 bp, Mus musculus
gctctgtagttgagccctcatatat

SEQ ID NO: 568289 - DNA, 25 bp, Mus musculus
gctctgtagttgtgccctcatatat

SEQ ID NO: 568290 - DNA, 25 bp, Mus musculus
gctctgtatactcatgctctggatt

SEQ ID NO: 568291 - DNA, 25 bp, Mus musculus
gctctgtatactgatgctctggatt

SEQ ID NO: 568292 - DNA, 25 bp, Mus musculus
gctctgtatagtcactgttgggtaa

SEQ ID NO: 568293 - DNA, 25 bp, Mus musculus
gctctgtatagtgactgttgggtaa

SEQ ID NO: 568294 - DNA, 25 bp, Mus musculus
gctctgtatcttctatatttgccgt

SEQ ID NO: 568295 - DNA, 25 bp, Mus musculus
gctctgtatcttgtatatttgccgt

SEQ ID NO: 568296 - DNA, 25 bp, Mus musculus
gctctgtattggatgtcatgcatga

SEQ ID NO: 568297 - DNA, 25 bp, Mus musculus
gctctgtattggttgtcatgcatga

SEQ ID NO: 568298 - DNA, 25 bp, Mus musculus
gctctgtattgtattgtactggcct

SEQ ID NO: 568299 - DNA, 25 bp, Mus musculus
gctctgtattgttttgtactggcct

SEQ ID NO: 568300 - DNA, 25 bp, Mus musculus
gctctgtcaataagctgtacctcca

SEQ ID NO: 568301 - DNA, 25 bp, Mus musculus
gctctgtcaatatgctgtacctcca

SEQ ID NO: 568302 - DNA, 25 bp, Mus musculus
gctctgtcactacaatcatgctttg

SEQ ID NO: 568303 - DNA, 25 bp, Mus musculus
gctctgtcactagaatcatgctttg

SEQ ID NO: 568304 - DNA, 25 bp, Mus musculus
gctctgtcatttccattctgtagtt

SEQ ID NO: 568305 - DNA, 25 bp, Mus musculus
gctctgtcatttgcattctgtagtt

SEQ ID NO: 568306 - DNA, 25 bp, Mus musculus
gctctgtccacaccttggtgtgaat

SEQ ID NO: 568307 - DNA, 25 bp, Mus musculus
gctctgtccacagcttggtgtgaat

SEQ ID NO: 568308 - DNA, 25 bp, Mus musculus
gctctgtccagaaaggacctgagga

SEQ ID NO: 568309 - DNA, 25 bp, Mus musculus
gctctgtccagataggacctgagga

SEQ ID NO: 568310 - DNA, 25 bp, Mus musculus
gctctgtccctcaaaaattccttat

SEQ ID NO: 568311 - DNA, 25 bp, Mus musculus
gctctgtccctcagttctaacagaa

SEQ ID NO: 568312 - DNA, 25 bp, Mus musculus
gctctgtccctctaaaattccttat

SEQ ID NO: 568313 - DNA, 25 bp, Mus musculus
gctctgtccctctgttctaacagaa

SEQ ID NO: 568314 - DNA, 25 bp, Mus musculus
gctctgtcctccaatgacaagatca

SEQ ID NO: 568315 - DNA, 25 bp, Mus musculus
gctctgtcctcctatgacaagatca

SEQ ID NO: 568316 - DNA, 25 bp, Mus musculus
gctctgtcctctctggggacattca

SEQ ID NO: 568317 - DNA, 25 bp, Mus musculus
gctctgtcctctgtggggacattca

SEQ ID NO: 568318 - DNA, 25 bp, Mus musculus
gctctgtcggcgctcaataaacaca

SEQ ID NO: 568319 - DNA, 25 bp, Mus musculus
gctctgtcggcggtcaataaacaca

SEQ ID NO: 568320 - DNA, 25 bp, Mus musculus
gctctgtctcaaagatggagggcaa

SEQ ID NO: 568321 - DNA, 25 bp, Mus musculus
gctctgtctcaatgatggagggcaa

SEQ ID NO: 568322 - DNA, 25 bp, Mus musculus
gctctgtctctcagacctcacagat

SEQ ID NO: 568323 - DNA, 25 bp, Mus musculus
gctctgtctctctgacctcacagat

SEQ ID NO: 568324 - DNA, 25 bp, Mus musculus
gctctgtctctgattatgtcttgct

SEQ ID NO: 568325 - DNA, 25 bp, Mus musculus
gctctgtctctgtttatgtcttgct

SEQ ID NO: 568326 - DNA, 25 bp, Mus musculus
gctctgtctgaaacactccaagatg

SEQ ID NO: 568327 - DNA, 25 bp, Mus musculus
gctctgtctgaatcactccaagatg

SEQ ID NO: 568328 - DNA, 25 bp, Mus musculus
gctctgtctgtacctttatctggat

SEQ ID NO: 568329 - DNA, 25 bp, Mus musculus
gctctgtctgtagctttatctggat

SEQ ID NO: 568330 - DNA, 25 bp, Mus musculus
gctctgtctgttcgcaccgataaaa

SEQ ID NO: 568331 - DNA, 25 bp, Mus musculus
gctctgtctgttggcaccgataaaa

SEQ ID NO: 568332 - DNA, 25 bp, Mus musculus
gctctgtcttctaggtgttgggatt

SEQ ID NO: 568333 - DNA, 25 bp, Mus musculus
gctctgtcttcttggtgttgggatt

SEQ ID NO: 568334 - DNA, 25 bp, Mus musculus
gctctgtgaactctcatctgtgctg

SEQ ID NO: 568335 - DNA, 25 bp, Mus musculus
gctctgtgaactgtcatctgtgctg

SEQ ID NO: 568336 - DNA, 25 bp, Mus musculus
gctctgtgaaggattttcctaccca

SEQ ID NO: 568337 - DNA, 25 bp, Mus musculus
gctctgtgaaggtttttcctaccca

SEQ ID NO: 568338 - DNA, 25 bp, Mus musculus
gctctgtgacacaggactgactagt

SEQ ID NO: 568339 - DNA, 25 bp, Mus musculus
gctctgtgacactggactgactagt

SEQ ID NO: 568340 - DNA, 25 bp, Mus musculus
gctctgtgatgacttcagtggatag

SEQ ID NO: 568341 - DNA, 25 bp, Mus musculus
gctctgtgatgagttcagtggatag

SEQ ID NO: 568342 - DNA, 25 bp, Mus musculus
gctctgtgcacacttcccgtcagtg

SEQ ID NO: 568343 - DNA, 25 bp, Mus musculus
gctctgtgcacagttcccgtcagtg

SEQ ID NO: 568344 - DNA, 25 bp, Mus musculus
gctctgtgcatgcatttgttaaagg

SEQ ID NO: 568345 - DNA, 25 bp, Mus musculus
gctctgtgcatggatttgttaaagg

SEQ ID NO: 568346 - DNA, 25 bp, Mus musculus
gctctgtgccctaggttgttttgtg

SEQ ID NO: 568347 - DNA, 25 bp, Mus musculus
gctctgtgccctccatttgatcaaa

SEQ ID NO: 568348 - DNA, 25 bp, Mus musculus
gctctgtgccctgcatttgatcaaa

SEQ ID NO: 568349 - DNA, 25 bp, Mus musculus
gctctgtgcccttggttgttttgtg

SEQ ID NO: 568350 - DNA, 25 bp, Mus musculus
gctctgtgccttactattaggactt

SEQ ID NO: 568351 - DNA, 25 bp, Mus musculus
gctctgtgccttctcaatttggaaa

SEQ ID NO: 568352 - DNA, 25 bp, Mus musculus
gctctgtgccttgtcaatttggaaa

SEQ ID NO: 568353 - DNA, 25 bp, Mus musculus
gctctgtgcctttctattaggactt

SEQ ID NO: 568354 - DNA, 25 bp, Mus musculus
gctctgtgctgcaacttgggcggca

SEQ ID NO: 568355 - DNA, 25 bp, Mus musculus
gctctgtgctgctacttgggcggca

SEQ ID NO: 568356 - DNA, 25 bp, Mus musculus
gctctgtggctaaggctagcatgag

SEQ ID NO: 568357 - DNA, 25 bp, Mus musculus
gctctgtggctatggctagcatgag

SEQ ID NO: 568358 - DNA, 25 bp, Mus musculus
gctctgtgggttcctgtagtgacct

SEQ ID NO: 568359 - DNA, 25 bp, Mus musculus
gctctgtgggttgctgtagtgacct

SEQ ID NO: 568360 - DNA, 25 bp, Mus musculus
gctctgtggtacagttctggcagca

SEQ ID NO: 568361 - DNA, 25 bp, Mus musculus
gctctgtggtactgttctggcagca

SEQ ID NO: 568362 - DNA, 25 bp, Mus musculus
gctctgtgtaataagctgcttactt

SEQ ID NO: 568363 - DNA, 25 bp, Mus musculus
gctctgtgtaattagctgcttactt

SEQ ID NO: 568364 - DNA, 25 bp, Mus musculus
gctctgtgtatgattctttgcaatt

SEQ ID NO: 568365 - DNA, 25 bp, Mus musculus
gctctgtgtatgtttctttgcaatt

SEQ ID NO: 568366 - DNA, 25 bp, Mus musculus
gctctgtgtcttcgtttcacacaca

SEQ ID NO: 568367 - DNA, 25 bp, Mus musculus
gctctgtgtcttggtttcacacaca

SEQ ID NO: 568368 - DNA, 25 bp, Mus musculus
gctctgtgtgctctgccattagtta

SEQ ID NO: 568369 - DNA, 25 bp, Mus musculus
gctctgtgtgctgtgccattagtta

SEQ ID NO: 568370 - DNA, 25 bp, Mus musculus
gctctgtgtggtatggctatcccta

SEQ ID NO: 568371 - DNA, 25 bp, Mus musculus
gctctgtgtggtttggctatcccta

SEQ ID NO: 568372 - DNA, 25 bp, Mus musculus
gctctgtgtgtaagttagtgtctca

SEQ ID NO: 568373 - DNA, 25 bp, Mus musculus
gctctgtgtgtatgttagtgtctca

SEQ ID NO: 568374 - DNA, 25 bp, Mus musculus
gctctgtgttacatgagggcctgca

SEQ ID NO: 568375 - DNA, 25 bp, Mus musculus
gctctgtgttacttgagggcctgca

SEQ ID NO: 568376 - DNA, 25 bp, Mus musculus
gctctgtgttctctcataactgttc

SEQ ID NO: 568377 - DNA, 25 bp, Mus musculus
gctctgtgttctgtcataactgttc

SEQ ID NO: 568378 - DNA, 25 bp, Mus musculus
gctctgttactgagtctaccattga

SEQ ID NO: 568379 - DNA, 25 bp, Mus musculus
gctctgttactgtgtctaccattga

SEQ ID NO: 568380 - DNA, 25 bp, Mus musculus
gctctgttatccaggaggtggctgc

SEQ ID NO: 568381 - DNA, 25 bp, Mus musculus
gctctgttatcctggaggtggctgc

SEQ ID NO: 568382 - DNA, 25 bp, Mus musculus
gctctgttcctgcaccaatattatt

SEQ ID NO: 568383 - DNA, 25 bp, Mus musculus
gctctgttcctggaccaatattatt

SEQ ID NO: 568384 - DNA, 25 bp, Mus musculus
gctctgttccttagcatctttatgt

SEQ ID NO: 568385 - DNA, 25 bp, Mus musculus
gctctgttcctttgcatctttatgt

SEQ ID NO: 568386 - DNA, 25 bp, Mus musculus
gctctgttctccctactaaaaattg

SEQ ID NO: 568387 - DNA, 25 bp, Mus musculus
gctctgttctccgtactaaaaattg

SEQ ID NO: 568388 - DNA, 25 bp, Mus musculus
gctctgttctgtcctagggaagcta

SEQ ID NO: 568389 - DNA, 25 bp, Mus musculus
gctctgttctgtgctagggaagcta

SEQ ID NO: 568390 - DNA, 25 bp, Mus musculus
gctctgttcttgctcaggtggtata

SEQ ID NO: 568391 - DNA, 25 bp, Mus musculus
gctctgttcttggtcaggtggtata

SEQ ID NO: 568392 - DNA, 25 bp, Mus musculus
gctctgttgaatctcctgagtagct

SEQ ID NO: 568393 - DNA, 25 bp, Mus musculus
gctctgttgaatgtcctgagtagct

SEQ ID NO: 568394 - DNA, 25 bp, Mus musculus
gctctgttgattccgaaatcttgca

SEQ ID NO: 568395 - DNA, 25 bp, Mus musculus
gctctgttgattgcgaaatcttgca

SEQ ID NO: 568396 - DNA, 25 bp, Mus musculus
gctctgttggccacctacatataaa

SEQ ID NO: 568397 - DNA, 25 bp, Mus musculus
gctctgttggcctcctacatataaa

SEQ ID NO: 568398 - DNA, 25 bp, Mus musculus
gctctgttggctcattcctagggta

SEQ ID NO: 568399 - DNA, 25 bp, Mus musculus
gctctgttggctctgtatgtatccc

SEQ ID NO: 568400 - DNA, 25 bp, Mus musculus
gctctgttggctgattcctagggta

SEQ ID NO: 568401 - DNA, 25 bp, Mus musculus
gctctgttggctgtgtatgtatccc

SEQ ID NO: 568402 - DNA, 25 bp, Mus musculus
gctctgttggttccgaatgtgtagt

SEQ ID NO: 568403 - DNA, 25 bp, Mus musculus
gctctgttggttgcgaatgtgtagt

SEQ ID NO: 568404 - DNA, 25 bp, Mus musculus
gctctgttgtcaacttaagtgatat

SEQ ID NO: 568405 - DNA, 25 bp, Mus musculus
gctctgttgtcatcttaagtgatat

SEQ ID NO: 568406 - DNA, 25 bp, Mus musculus
gctctgtttcatcaggtatgtcaac

SEQ ID NO: 568407 - DNA, 25 bp, Mus musculus
gctctgtttcatgaggtatgtcaac

SEQ ID NO: 568408 - DNA, 25 bp, Mus musculus
gctctgtttcccacagtaatgttga

SEQ ID NO: 568409 - DNA, 25 bp, Mus musculus
gctctgtttccctcagtaatgttga

SEQ ID NO: 568410 - DNA, 25 bp, Mus musculus
gctctgtttctgctacagtttggga

SEQ ID NO: 568411 - DNA, 25 bp, Mus musculus
gctctgtttctggtacagtttggga

SEQ ID NO: 568412 - DNA, 25 bp, Mus musculus
gctctgtttgaaagaggctgctcca

SEQ ID NO: 568413 - DNA, 25 bp, Mus musculus
gctctgtttgaatgaggctgctcca

SEQ ID NO: 568414 - DNA, 25 bp, Mus musculus
gctctgtttgttaaatagcagtggt

SEQ ID NO: 568415 - DNA, 25 bp, Mus musculus
gctctgtttgtttaatagcagtggt

SEQ ID NO: 568416 - DNA, 25 bp, Mus musculus
gctctgttttaccttatcctgttta

SEQ ID NO: 568417 - DNA, 25 bp, Mus musculus
gctctgttttacgttatcctgttta

SEQ ID NO: 568418 - DNA, 25 bp, Mus musculus
gctctgttttggctcaggaaatgtt

SEQ ID NO: 568419 - DNA, 25 bp, Mus musculus
gctctgttttgggtcaggaaatgtt

SEQ ID NO: 568420 - DNA, 25 bp, Mus musculus
gctcttaaaccacaggtgatcttaa

SEQ ID NO: 568421 - DNA, 25 bp, Mus musculus
gctcttaaaccagaggtgatcttaa

SEQ ID NO: 568422 - DNA, 25 bp, Mus musculus
gctcttaacagcactaacagatgtg

SEQ ID NO: 568423 - DNA, 25 bp, Mus musculus
gctcttaacagctctaacagatgtg

SEQ ID NO: 568424 - DNA, 25 bp, Mus musculus
gctcttaacaggacccgagtttagt

SEQ ID NO: 568425 - DNA, 25 bp, Mus musculus
gctcttaacaggtcccgagtttagt

SEQ ID NO: 568426 - DNA, 25 bp, Mus musculus
gctcttaaccctaggtattagcaaa

SEQ ID NO: 568427 - DNA, 25 bp, Mus musculus
gctcttaacccttggtattagcaaa

SEQ ID NO: 568428 - DNA, 25 bp, Mus musculus
gctcttaaggttctatgttttcatt

SEQ ID NO: 568429 - DNA, 25 bp, Mus musculus
gctcttaaggttgtatgttttcatt

SEQ ID NO: 568430 - DNA, 25 bp, Mus musculus
gctcttacacctaagtcatttttga

SEQ ID NO: 568431 - DNA, 25 bp, Mus musculus
gctcttacaccttagtcatttttga

SEQ ID NO: 568432 - DNA, 25 bp, Mus musculus
gctcttacactcatttgtctttgag

SEQ ID NO: 568433 - DNA, 25 bp, Mus musculus
gctcttacactcttttgtctttgag

SEQ ID NO: 568434 - DNA, 25 bp, Mus musculus
gctcttacagatagaacctttttac

SEQ ID NO: 568435 - DNA, 25 bp, Mus musculus
gctcttacagattgaacctttttac

SEQ ID NO: 568436 - DNA, 25 bp, Mus musculus
gctcttacagtcagcctgggattct

SEQ ID NO: 568437 - DNA, 25 bp, Mus musculus
gctcttacagtctgcctgggattct

SEQ ID NO: 568438 - DNA, 25 bp, Mus musculus
gctcttacatagaactttgtagtgc

SEQ ID NO: 568439 - DNA, 25 bp, Mus musculus
gctcttacatagtactttgtagtgc

SEQ ID NO: 568440 - DNA, 25 bp, Mus musculus
gctcttaccaaacagctcccagaaa

SEQ ID NO: 568441 - DNA, 25 bp, Mus musculus
gctcttaccaaagagctcccagaaa

SEQ ID NO: 568442 - DNA, 25 bp, Mus musculus
gctcttacccagaaaactgcaatgc

SEQ ID NO: 568443 - DNA, 25 bp, Mus musculus
gctcttacccagtaaactgcaatgc

SEQ ID NO: 568444 - DNA, 25 bp, Mus musculus
gctcttaccgtgcaaatgaccatta

SEQ ID NO: 568445 - DNA, 25 bp, Mus musculus
gctcttaccgtggaaatgaccatta

SEQ ID NO: 568446 - DNA, 25 bp, Mus musculus
gctcttacctgtattacattgattt

SEQ ID NO: 568447 - DNA, 25 bp, Mus musculus
gctcttacctgttttacattgattt

SEQ ID NO: 568448 - DNA, 25 bp, Mus musculus
gctcttactacacatctggctgctg

SEQ ID NO: 568449 - DNA, 25 bp, Mus musculus
gctcttactacagatctggctgctg

SEQ ID NO: 568450 - DNA, 25 bp, Mus musculus
gctcttactcatccaccactaatat

SEQ ID NO: 568451 - DNA, 25 bp, Mus musculus
gctcttactcatgcaccactaatat

SEQ ID NO: 568452 - DNA, 25 bp, Mus musculus
gctcttactgtccagtttaagctgt

SEQ ID NO: 568453 - DNA, 25 bp, Mus musculus
gctcttactgtcgagtttaagctgt

SEQ ID NO: 568454 - DNA, 25 bp, Mus musculus
gctcttactgttccatggccaagaa

SEQ ID NO: 568455 - DNA, 25 bp, Mus musculus
gctcttactgttgcatggccaagaa

SEQ ID NO: 568456 - DNA, 25 bp, Mus musculus
gctcttacttgtagctgaggactga

SEQ ID NO: 568457 - DNA, 25 bp, Mus musculus
gctcttacttgtattgacttgaatt

SEQ ID NO: 568458 - DNA, 25 bp, Mus musculus
gctcttacttgttgctgaggactga

SEQ ID NO: 568459 - DNA, 25 bp, Mus musculus
gctcttacttgttttgacttgaatt

SEQ ID NO: 568460 - DNA, 25 bp, Mus musculus
gctcttagaaatctagctcaaggca

SEQ ID NO: 568461 - DNA, 25 bp, Mus musculus
gctcttagaaatgtagctcaaggca

SEQ ID NO: 568462 - DNA, 25 bp, Mus musculus
gctcttagagacaaccatatgtgct

SEQ ID NO: 568463 - DNA, 25 bp, Mus musculus
gctcttagagacattgcttttccct

SEQ ID NO: 568464 - DNA, 25 bp, Mus musculus
gctcttagagactaccatatgtgct

SEQ ID NO: 568465 - DNA, 25 bp, Mus musculus
gctcttagagactttgcttttccct

SEQ ID NO: 568466 - DNA, 25 bp, Mus musculus
gctcttagatggaaaccagactttc

SEQ ID NO: 568467 - DNA, 25 bp, Mus musculus
gctcttagatggtaaccagactttc

SEQ ID NO: 568468 - DNA, 25 bp, Mus musculus
gctcttagctgtagcaaaggcagat

SEQ ID NO: 568469 - DNA, 25 bp, Mus musculus
gctcttagctgttgcaaaggcagat

SEQ ID NO: 568470 - DNA, 25 bp, Mus musculus
gctcttaggactatttgcaattgct

SEQ ID NO: 568471 - DNA, 25 bp, Mus musculus
gctcttaggactccagactcctgca

SEQ ID NO: 568472 - DNA, 25 bp, Mus musculus
gctcttaggactgcagactcctgca

SEQ ID NO: 568473 - DNA, 25 bp, Mus musculus
gctcttaggactttttgcaattgct

SEQ ID NO: 568474 - DNA, 25 bp, Mus musculus
gctcttaggcagcaggttgcgatca

SEQ ID NO: 568475 - DNA, 25 bp, Mus musculus
gctcttaggcaggaggttgcgatca

SEQ ID NO: 568476 - DNA, 25 bp, Mus musculus
gctcttagtagtccctatcaggtga

SEQ ID NO: 568477 - DNA, 25 bp, Mus musculus
gctcttagtagtgcctatcaggtga

SEQ ID NO: 568478 - DNA, 25 bp, Mus musculus
gctcttagtgtcaaggtgtgggttt

SEQ ID NO: 568479 - DNA, 25 bp, Mus musculus
gctcttagtgtctaggtgtgggttt

SEQ ID NO: 568480 - DNA, 25 bp, Mus musculus
gctcttagtttgcacatcagttgaa

SEQ ID NO: 568481 - DNA, 25 bp, Mus musculus
gctcttagtttggacatcagttgaa

SEQ ID NO: 568482 - DNA, 25 bp, Mus musculus
gctcttatcaccaggtttaagcttg

SEQ ID NO: 568483 - DNA, 25 bp, Mus musculus
gctcttatcacctggtttaagcttg

SEQ ID NO: 568484 - DNA, 25 bp, Mus musculus
gctcttatcttccagtcgaggaaac

SEQ ID NO: 568485 - DNA, 25 bp, Mus musculus
gctcttatcttcgagtcgaggaaac

SEQ ID NO: 568486 - DNA, 25 bp, Mus musculus
gctcttatgcatccctctactaata

SEQ ID NO: 568487 - DNA, 25 bp, Mus musculus
gctcttatgcatgcctctactaata

SEQ ID NO: 568488 - DNA, 25 bp, Mus musculus
gctcttatgtcacctgttgtttcct

SEQ ID NO: 568489 - DNA, 25 bp, Mus musculus
gctcttatgtcagctgttgtttcct

SEQ ID NO: 568490 - DNA, 25 bp, Mus musculus
gctcttattaaaatgctggtcttct

SEQ ID NO: 568491 - DNA, 25 bp, Mus musculus
gctcttattaaattgctggtcttct

SEQ ID NO: 568492 - DNA, 25 bp, Mus musculus
gctcttattactattcttgcatgcc

SEQ ID NO: 568493 - DNA, 25 bp, Mus musculus
gctcttattacttttcttgcatgcc

SEQ ID NO: 568494 - DNA, 25 bp, Mus musculus
gctcttatttctaacaagaacgtga

SEQ ID NO: 568495 - DNA, 25 bp, Mus musculus
gctcttatttcttacaagaacgtga

SEQ ID NO: 568496 - DNA, 25 bp, Mus musculus
gctcttcaaagtactcatgtaatca

SEQ ID NO: 568497 - DNA, 25 bp, Mus musculus
gctcttcaaagttctcatgtaatca

SEQ ID NO: 568498 - DNA, 25 bp, Mus musculus
gctcttcaagagcaagcttaaggaa

SEQ ID NO: 568499 - DNA, 25 bp, Mus musculus
gctcttcaagaggaagcttaaggaa

SEQ ID NO: 568500 - DNA, 25 bp, Mus musculus
gctcttcaagatctagcccaaagaa

SEQ ID NO: 568501 - DNA, 25 bp, Mus musculus
gctcttcaagatgtagcccaaagaa

SEQ ID NO: 568502 - DNA, 25 bp, Mus musculus
gctcttcaagcacgacaagccaatc

SEQ ID NO: 568503 - DNA, 25 bp, Mus musculus
gctcttcaagcaggacaagccaatc

SEQ ID NO: 568504 - DNA, 25 bp, Mus musculus
gctcttcacacgctcagaagttgta

SEQ ID NO: 568505 - DNA, 25 bp, Mus musculus
gctcttcacacggtcagaagttgta

SEQ ID NO: 568506 - DNA, 25 bp, Mus musculus
gctcttcacgatatgacgattatga

SEQ ID NO: 568507 - DNA, 25 bp, Mus musculus
gctcttcacgatttgacgattatga

SEQ ID NO: 568508 - DNA, 25 bp, Mus musculus
gctcttcactatcttggacctgctg

SEQ ID NO: 568509 - DNA, 25 bp, Mus musculus
gctcttcactatgttggacctgctg

SEQ ID NO: 568510 - DNA, 25 bp, Mus musculus
gctcttcagaaacctccaggctgag

SEQ ID NO: 568511 - DNA, 25 bp, Mus musculus
gctcttcagaaagctccaggctgag

SEQ ID NO: 568512 - DNA, 25 bp, Mus musculus
gctcttcagcatcaagggtctccat

SEQ ID NO: 568513 - DNA, 25 bp, Mus musculus
gctcttcagcatgaagggtctccat

SEQ ID NO: 568514 - DNA, 25 bp, Mus musculus
gctcttcaggagcaaaggttggcca

SEQ ID NO: 568515 - DNA, 25 bp, Mus musculus
gctcttcaggaggaaaggttggcca

SEQ ID NO: 568516 - DNA, 25 bp, Mus musculus
gctcttcaggtacctggtgactcaa

SEQ ID NO: 568517 - DNA, 25 bp, Mus musculus
gctcttcaggtagctggtgactcaa

SEQ ID NO: 568518 - DNA, 25 bp, Mus musculus
gctcttcagtggagacgtcgtgtat

SEQ ID NO: 568519 - DNA, 25 bp, Mus musculus
gctcttcagtggtgacgtcgtgtat

SEQ ID NO: 568520 - DNA, 25 bp, Mus musculus
gctcttcatatacggttctgtcttt

SEQ ID NO: 568521 - DNA, 25 bp, Mus musculus
gctcttcatatagggttctgtcttt

SEQ ID NO: 568522 - DNA, 25 bp, Mus musculus
gctcttcatgaaaagcagcttcgca

SEQ ID NO: 568523 - DNA, 25 bp, Mus musculus
gctcttcatgaatagcagcttcgca

SEQ ID NO: 568524 - DNA, 25 bp, Mus musculus
gctcttccagaacgaacagccggct

SEQ ID NO: 568525 - DNA, 25 bp, Mus musculus
gctcttccagaaggaacagccggct

SEQ ID NO: 568526 - DNA, 25 bp, Mus musculus
gctcttccagcaagcctgggttcca

SEQ ID NO: 568527 - DNA, 25 bp, Mus musculus
gctcttccagcatgcctgggttcca

SEQ ID NO: 568528 - DNA, 25 bp, Mus musculus
gctcttccatgtagcctgcagaatt

SEQ ID NO: 568529 - DNA, 25 bp, Mus musculus
gctcttccatgttgcctgcagaatt

SEQ ID NO: 568530 - DNA, 25 bp, Mus musculus
gctcttcccagacactgacagatat

SEQ ID NO: 568531 - DNA, 25 bp, Mus musculus
gctcttcccagagactgacagatat

SEQ ID NO: 568532 - DNA, 25 bp, Mus musculus
gctcttcccgacattgtagttagta

SEQ ID NO: 568533 - DNA, 25 bp, Mus musculus
gctcttcccgactttgtagttagta

SEQ ID NO: 568534 - DNA, 25 bp, Mus musculus
gctcttccgatgagtggactgctga

SEQ ID NO: 568535 - DNA, 25 bp, Mus musculus
gctcttccgatgtgtggactgctga

SEQ ID NO: 568536 - DNA, 25 bp, Mus musculus
gctcttcctacccaacttaagagat

SEQ ID NO: 568537 - DNA, 25 bp, Mus musculus
gctcttcctaccgaacttaagagat

SEQ ID NO: 568538 - DNA, 25 bp, Mus musculus
gctcttcctagtattgcttatgcta

SEQ ID NO: 568539 - DNA, 25 bp, Mus musculus
gctcttcctagttttgcttatgcta

SEQ ID NO: 568540 - DNA, 25 bp, Mus musculus
gctcttcctataaaagttggtgaac

SEQ ID NO: 568541 - DNA, 25 bp, Mus musculus
gctcttcctatataagttggtgaac

SEQ ID NO: 568542 - DNA, 25 bp, Mus musculus
gctcttcctcggatgtctgtaaata

SEQ ID NO: 568543 - DNA, 25 bp, Mus musculus
gctcttcctcggttgtctgtaaata

SEQ ID NO: 568544 - DNA, 25 bp, Mus musculus
gctcttcctgcaaaacggctgaaag

SEQ ID NO: 568545 - DNA, 25 bp, Mus musculus
gctcttcctgcataacggctgaaag

SEQ ID NO: 568546 - DNA, 25 bp, Mus musculus
gctcttcctgccacttaattgtaga

SEQ ID NO: 568547 - DNA, 25 bp, Mus musculus
gctcttcctgcctcttaattgtaga

SEQ ID NO: 568548 - DNA, 25 bp, Mus musculus
gctcttcctgggatgttgataccca

SEQ ID NO: 568549 - DNA, 25 bp, Mus musculus
gctcttcctgggttgttgataccca

SEQ ID NO: 568550 - DNA, 25 bp, Mus musculus
gctcttcctgtgattaacgtgttcc

SEQ ID NO: 568551 - DNA, 25 bp, Mus musculus
gctcttcctgtgtttaacgtgttcc

SEQ ID NO: 568552 - DNA, 25 bp, Mus musculus
gctcttccttctcgttcattttatt

SEQ ID NO: 568553 - DNA, 25 bp, Mus musculus
gctcttccttctggttcattttatt

SEQ ID NO: 568554 - DNA, 25 bp, Mus musculus
gctcttcgatttcgtttctggttat

SEQ ID NO: 568555 - DNA, 25 bp, Mus musculus
gctcttcgatttggtttctggttat

SEQ ID NO: 568556 - DNA, 25 bp, Mus musculus
gctcttcggagtattaaggcttctt

SEQ ID NO: 568557 - DNA, 25 bp, Mus musculus
gctcttcggagttttaaggcttctt

SEQ ID NO: 568558 - DNA, 25 bp, Mus musculus
gctcttcgtatacctgttcatcggt

SEQ ID NO: 568559 - DNA, 25 bp, Mus musculus
gctcttcgtatagctgttcatcggt

SEQ ID NO: 568560 - DNA, 25 bp, Mus musculus
gctcttcgtccacttgtgttatata

SEQ ID NO: 568561 - DNA, 25 bp, Mus musculus
gctcttcgtccagttgtgttatata

SEQ ID NO: 568562 - DNA, 25 bp, Mus musculus
gctcttctacgacgcctacgggcat

SEQ ID NO: 568563 - DNA, 25 bp, Mus musculus
gctcttctacgaggcctacgggcat

SEQ ID NO: 568564 - DNA, 25 bp, Mus musculus
gctcttctacggaatgagttctgaa

SEQ ID NO: 568565 - DNA, 25 bp, Mus musculus
gctcttctacggtatgagttctgaa

SEQ ID NO: 568566 - DNA, 25 bp, Mus musculus
gctcttctagaaaaaatgtcatttg

SEQ ID NO: 568567 - DNA, 25 bp, Mus musculus
gctcttctagaaagtctgggttcaa

SEQ ID NO: 568568 - DNA, 25 bp, Mus musculus
gctcttctagaataaatgtcatttg

SEQ ID NO: 568569 - DNA, 25 bp, Mus musculus
gctcttctagaatgtctgggttcaa

SEQ ID NO: 568570 - DNA, 25 bp, Mus musculus
gctcttctagagatagggttagttc

SEQ ID NO: 568571 - DNA, 25 bp, Mus musculus
gctcttctagagttagggttagttc

SEQ ID NO: 568572 - DNA, 25 bp, Mus musculus
gctcttctaggtcactcaagtttga

SEQ ID NO: 568573 - DNA, 25 bp, Mus musculus
gctcttctaggtgactcaagtttga

SEQ ID NO: 568574 - DNA, 25 bp, Mus musculus
gctcttctcatcagaggagacctca

SEQ ID NO: 568575 - DNA, 25 bp, Mus musculus
gctcttctcatctgaggagacctca

SEQ ID NO: 568576 - DNA, 25 bp, Mus musculus
gctcttctccataagatcattctta

SEQ ID NO: 568577 - DNA, 25 bp, Mus musculus
gctcttctccattagatcattctta

SEQ ID NO: 568578 - DNA, 25 bp, Mus musculus
gctcttctctaaatgcactcaggca

SEQ ID NO: 568579 - DNA, 25 bp, Mus musculus
gctcttctctaattgcactcaggca

SEQ ID NO: 568580 - DNA, 25 bp, Mus musculus
gctcttctctctatttgcataatgt

SEQ ID NO: 568581 - DNA, 25 bp, Mus musculus
gctcttctctctttttgcataatgt

SEQ ID NO: 568582 - DNA, 25 bp, Mus musculus
gctcttctctgcattgtattgtaca

SEQ ID NO: 568583 - DNA, 25 bp, Mus musculus
gctcttctctgctttgtattgtaca

SEQ ID NO: 568584 - DNA, 25 bp, Mus musculus
gctcttctgagaaatgatgtccctg

SEQ ID NO: 568585 - DNA, 25 bp, Mus musculus
gctcttctgagatatgatgtccctg

SEQ ID NO: 568586 - DNA, 25 bp, Mus musculus
gctcttctgaggaccaacgatgctg

SEQ ID NO: 568587 - DNA, 25 bp, Mus musculus
gctcttctgaggtccaacgatgctg

SEQ ID NO: 568588 - DNA, 25 bp, Mus musculus
gctcttctggaacgcaggtcactat

SEQ ID NO: 568589 - DNA, 25 bp, Mus musculus
gctcttctggaaggcaggtcactat

SEQ ID NO: 568590 - DNA, 25 bp, Mus musculus
gctcttctggacagattggctacaa

SEQ ID NO: 568591 - DNA, 25 bp, Mus musculus
gctcttctggactgattggctacaa

SEQ ID NO: 568592 - DNA, 25 bp, Mus musculus
gctcttctgttactgtttttatgtt

SEQ ID NO: 568593 - DNA, 25 bp, Mus musculus
gctcttctgttagtgtttttatgtt

SEQ ID NO: 568594 - DNA, 25 bp, Mus musculus
gctcttctgtttcagtaaagccttg

SEQ ID NO: 568595 - DNA, 25 bp, Mus musculus
gctcttctgtttgagtaaagccttg

SEQ ID NO: 568596 - DNA, 25 bp, Mus musculus
gctcttctttcaagctctttgtgta

SEQ ID NO: 568597 - DNA, 25 bp, Mus musculus
gctcttctttcatgctctttgtgta

SEQ ID NO: 568598 - DNA, 25 bp, Mus musculus
gctcttgaagctagttgaacttcga

SEQ ID NO: 568599 - DNA, 25 bp, Mus musculus
gctcttgaagcttgttgaacttcga

SEQ ID NO: 568600 - DNA, 25 bp, Mus musculus
gctcttgaagtcacacatctaagaa

SEQ ID NO: 568601 - DNA, 25 bp, Mus musculus
gctcttgaagtctcacatctaagaa

SEQ ID NO: 568602 - DNA, 25 bp, Mus musculus
gctcttgaccaactacgacaatcta

SEQ ID NO: 568603 - DNA, 25 bp, Mus musculus
gctcttgaccaagtacgacaatcta

SEQ ID NO: 568604 - DNA, 25 bp, Mus musculus
gctcttgactgcagccaacttagtt

SEQ ID NO: 568605 - DNA, 25 bp, Mus musculus
gctcttgactgctgccaacttagtt

SEQ ID NO: 568606 - DNA, 25 bp, Mus musculus
gctcttgagacaacagtgacgcaac

SEQ ID NO: 568607 - DNA, 25 bp, Mus musculus
gctcttgagacatcagtgacgcaac

SEQ ID NO: 568608 - DNA, 25 bp, Mus musculus
gctcttgagatgatcagcatggcca

SEQ ID NO: 568609 - DNA, 25 bp, Mus musculus
gctcttgagatgttcagcatggcca

SEQ ID NO: 568610 - DNA, 25 bp, Mus musculus
gctcttgagtccaggttcacgacat

SEQ ID NO: 568611 - DNA, 25 bp, Mus musculus
gctcttgagtcccttctgatgtatt

SEQ ID NO: 568612 - DNA, 25 bp, Mus musculus
gctcttgagtccgttctgatgtatt

SEQ ID NO: 568613 - DNA, 25 bp, Mus musculus
gctcttgagtcctggttcacgacat

SEQ ID NO: 568614 - DNA, 25 bp, Mus musculus
gctcttgatacacactgagaggcag

SEQ ID NO: 568615 - DNA, 25 bp, Mus musculus
gctcttgatacagactgagaggcag

SEQ ID NO: 568616 - DNA, 25 bp, Mus musculus
gctcttgatagtaggctcgttgtgt

SEQ ID NO: 568617 - DNA, 25 bp, Mus musculus
gctcttgatagttggctcgttgtgt

SEQ ID NO: 568618 - DNA, 25 bp, Mus musculus
gctcttgcaaaactcctgctctaca

SEQ ID NO: 568619 - DNA, 25 bp, Mus musculus
gctcttgcaaaagtcctgctctaca

SEQ ID NO: 568620 - DNA, 25 bp, Mus musculus
gctcttgcaaagaacctatatcagg

SEQ ID NO: 568621 - DNA, 25 bp, Mus musculus
gctcttgcaaagtacctatatcagg

SEQ ID NO: 568622 - DNA, 25 bp, Mus musculus
gctcttgcagagcaccatggcagct

SEQ ID NO: 568623 - DNA, 25 bp, Mus musculus
gctcttgcagaggaccatggcagct

SEQ ID NO: 568624 - DNA, 25 bp, Mus musculus
gctcttgcagctacacaccaaagaa

SEQ ID NO: 568625 - DNA, 25 bp, Mus musculus
gctcttgcagcttcacaccaaagaa

SEQ ID NO: 568626 - DNA, 25 bp, Mus musculus
gctcttgcagttcttgccactatca

SEQ ID NO: 568627 - DNA, 25 bp, Mus musculus
gctcttgcagttgttgccactatca

SEQ ID NO: 568628 - DNA, 25 bp, Mus musculus
gctcttgccacacaattcactgctg

SEQ ID NO: 568629 - DNA, 25 bp, Mus musculus
gctcttgccacagaattcactgctg

SEQ ID NO: 568630 - DNA, 25 bp, Mus musculus
gctcttgcccaaagactgggaacca

SEQ ID NO: 568631 - DNA, 25 bp, Mus musculus
gctcttgcccaatgactgggaacca

SEQ ID NO: 568632 - DNA, 25 bp, Mus musculus
gctcttgcccggctgtaattataaa

SEQ ID NO: 568633 - DNA, 25 bp, Mus musculus
gctcttgcccgggtgtaattataaa

SEQ ID NO: 568634 - DNA, 25 bp, Mus musculus
gctcttgccgagcatcatctgaaac

SEQ ID NO: 568635 - DNA, 25 bp, Mus musculus
gctcttgccgaggatcatctgaaac

SEQ ID NO: 568636 - DNA, 25 bp, Mus musculus
gctcttgctttaaatagctcactaa

SEQ ID NO: 568637 - DNA, 25 bp, Mus musculus
gctcttgctttatatagctcactaa

SEQ ID NO: 568638 - DNA, 25 bp, Mus musculus
gctcttgctttcctggcatttggga

SEQ ID NO: 568639 - DNA, 25 bp, Mus musculus
gctcttgctttcgtggcatttggga

SEQ ID NO: 568640 - DNA, 25 bp, Mus musculus
gctcttggaaggactgctgaatgct

SEQ ID NO: 568641 - DNA, 25 bp, Mus musculus
gctcttggaaggtctgctgaatgct

SEQ ID NO: 568642 - DNA, 25 bp, Mus musculus
gctcttggacataattgggcttgca

SEQ ID NO: 568643 - DNA, 25 bp, Mus musculus
gctcttggacattattgggcttgca

SEQ ID NO: 568644 - DNA, 25 bp, Mus musculus
gctcttggataaacctgtaccctga

SEQ ID NO: 568645 - DNA, 25 bp, Mus musculus
gctcttggataatcctgtaccctga

SEQ ID NO: 568646 - DNA, 25 bp, Mus musculus
gctcttggccaaaactcagttattg

SEQ ID NO: 568647 - DNA, 25 bp, Mus musculus
gctcttggccaatactcagttattg

SEQ ID NO: 568648 - DNA, 25 bp, Mus musculus
gctcttggccagatgttatcagtct

SEQ ID NO: 568649 - DNA, 25 bp, Mus musculus
gctcttggccagttgttatcagtct

SEQ ID NO: 568650 - DNA, 25 bp, Mus musculus
gctcttggccttcttcagactgaag

SEQ ID NO: 568651 - DNA, 25 bp, Mus musculus
gctcttggccttgttcagactgaag

SEQ ID NO: 568652 - DNA, 25 bp, Mus musculus
gctcttggctctaacagggaacatt

SEQ ID NO: 568653 - DNA, 25 bp, Mus musculus
gctcttggctcttacagggaacatt

SEQ ID NO: 568654 - DNA, 25 bp, Mus musculus
gctcttggctggctttctctgatgt

SEQ ID NO: 568655 - DNA, 25 bp, Mus musculus
gctcttggctgggtttctctgatgt

SEQ ID NO: 568656 - DNA, 25 bp, Mus musculus
gctcttggcttaaacctcaattgta

SEQ ID NO: 568657 - DNA, 25 bp, Mus musculus
gctcttggcttatacctcaattgta

SEQ ID NO: 568658 - DNA, 25 bp, Mus musculus
gctcttgggaggctctgtgatttca

SEQ ID NO: 568659 - DNA, 25 bp, Mus musculus
gctcttgggagggtctgtgatttca

SEQ ID NO: 568660 - DNA, 25 bp, Mus musculus
gctcttgggatgagaggctgactcc

SEQ ID NO: 568661 - DNA, 25 bp, Mus musculus
gctcttgggatgtgaggctgactcc

SEQ ID NO: 568662 - DNA, 25 bp, Mus musculus
gctcttgggcaaaattctctgtaca

SEQ ID NO: 568663 - DNA, 25 bp, Mus musculus
gctcttgggcaatattctctgtaca

SEQ ID NO: 568664 - DNA, 25 bp, Mus musculus
gctcttgggcctagcatgactatac

SEQ ID NO: 568665 - DNA, 25 bp, Mus musculus
gctcttgggccttgcatgactatac

SEQ ID NO: 568666 - DNA, 25 bp, Mus musculus
gctcttgggtctctgatcagctggt

SEQ ID NO: 568667 - DNA, 25 bp, Mus musculus
gctcttgggtctgtgatcagctggt

SEQ ID NO: 568668 - DNA, 25 bp, Mus musculus
gctcttgggttgaattatcctgaga

SEQ ID NO: 568669 - DNA, 25 bp, Mus musculus
gctcttgggttgtattatcctgaga

SEQ ID NO: 568670 - DNA, 25 bp, Mus musculus
gctcttggtgctcatcactgtaatt

SEQ ID NO: 568671 - DNA, 25 bp, Mus musculus
gctcttggtgctgatcactgtaatt

SEQ ID NO: 568672 - DNA, 25 bp, Mus musculus
gctcttggtggcagtgtccaacaga

SEQ ID NO: 568673 - DNA, 25 bp, Mus musculus
gctcttggtggctgtgtccaacaga

SEQ ID NO: 568674 - DNA, 25 bp, Mus musculus
gctcttggttgcagtggccatcaca

SEQ ID NO: 568675 - DNA, 25 bp, Mus musculus
gctcttggttgctgtggccatcaca

SEQ ID NO: 568676 - DNA, 25 bp, Mus musculus
gctcttgtagagaactagactttaa

SEQ ID NO: 568677 - DNA, 25 bp, Mus musculus
gctcttgtagagctgatttgccaga

SEQ ID NO: 568678 - DNA, 25 bp, Mus musculus
gctcttgtagaggtgatttgccaga

SEQ ID NO: 568679 - DNA, 25 bp, Mus musculus
gctcttgtagagtactagactttaa

SEQ ID NO: 568680 - DNA, 25 bp, Mus musculus
gctcttgtagcactcttaacttttt

SEQ ID NO: 568681 - DNA, 25 bp, Mus musculus
gctcttgtagcagtcttaacttttt

SEQ ID NO: 568682 - DNA, 25 bp, Mus musculus
gctcttgtagttctagggataattt

SEQ ID NO: 568683 - DNA, 25 bp, Mus musculus
gctcttgtagttgtagggataattt

SEQ ID NO: 568684 - DNA, 25 bp, Mus musculus
gctcttgtatgccatggaaatgaag

SEQ ID NO: 568685 - DNA, 25 bp, Mus musculus
gctcttgtatgcgatggaaatgaag

SEQ ID NO: 568686 - DNA, 25 bp, Mus musculus
gctcttgtcactccagggctagaga

SEQ ID NO: 568687 - DNA, 25 bp, Mus musculus
gctcttgtcactgcagggctagaga

SEQ ID NO: 568688 - DNA, 25 bp, Mus musculus
gctcttgtcagaagtgtcactgcca

SEQ ID NO: 568689 - DNA, 25 bp, Mus musculus
gctcttgtcagatgtgtcactgcca

SEQ ID NO: 568690 - DNA, 25 bp, Mus musculus
gctcttgtcctcacctggaatatat

SEQ ID NO: 568691 - DNA, 25 bp, Mus musculus
gctcttgtcctctcctggaatatat

SEQ ID NO: 568692 - DNA, 25 bp, Mus musculus
gctcttgtggtaattcggcacctat

SEQ ID NO: 568693 - DNA, 25 bp, Mus musculus
gctcttgtggtatttcggcacctat

SEQ ID NO: 568694 - DNA, 25 bp, Mus musculus
gctcttgtgtctagactgtgtacca

SEQ ID NO: 568695 - DNA, 25 bp, Mus musculus
gctcttgtgtcttgactgtgtacca

SEQ ID NO: 568696 - DNA, 25 bp, Mus musculus
gctcttgttcctcttgcagagaatt

SEQ ID NO: 568697 - DNA, 25 bp, Mus musculus
gctcttgttcctgttgcagagaatt

SEQ ID NO: 568698 - DNA, 25 bp, Mus musculus
gctcttgttgagctaagtgtgccac

SEQ ID NO: 568699 - DNA, 25 bp, Mus musculus
gctcttgttgaggtaagtgtgccac

SEQ ID NO: 568700 - DNA, 25 bp, Mus musculus
gctcttgttggcaagcataccacaa

SEQ ID NO: 568701 - DNA, 25 bp, Mus musculus
gctcttgttggctagcataccacaa

SEQ ID NO: 568702 - DNA, 25 bp, Mus musculus
gctcttgttgtcacagataactccc

SEQ ID NO: 568703 - DNA, 25 bp, Mus musculus
gctcttgttgtctcagataactccc

SEQ ID NO: 568704 - DNA, 25 bp, Mus musculus
gctctttaaatacagcccgtgctgg

SEQ ID NO: 568705 - DNA, 25 bp, Mus musculus
gctctttaaatagagcccgtgctgg

SEQ ID NO: 568706 - DNA, 25 bp, Mus musculus
gctctttaactacctaaaccactgg

SEQ ID NO: 568707 - DNA, 25 bp, Mus musculus
gctctttaactagctaaaccactgg

SEQ ID NO: 568708 - DNA, 25 bp, Mus musculus
gctctttacctgaacacttgtgtta

SEQ ID NO: 568709 - DNA, 25 bp, Mus musculus
gctctttacctgtacacttgtgtta

SEQ ID NO: 568710 - DNA, 25 bp, Mus musculus
gctctttacgtgatacttttcttct

SEQ ID NO: 568711 - DNA, 25 bp, Mus musculus
gctctttacgtgttacttttcttct

SEQ ID NO: 568712 - DNA, 25 bp, Mus musculus
gctctttactgtctttccaaatgat

SEQ ID NO: 568713 - DNA, 25 bp, Mus musculus
gctctttactgtgtttccaaatgat

SEQ ID NO: 568714 - DNA, 25 bp, Mus musculus
gctctttactttactgctcaacgta

SEQ ID NO: 568715 - DNA, 25 bp, Mus musculus
gctctttacttttctgctcaacgta

SEQ ID NO: 568716 - DNA, 25 bp, Mus musculus
gctctttagggaccatgcttgtgcc

SEQ ID NO: 568717 - DNA, 25 bp, Mus musculus
gctctttagggagcatgcttgtgcc

SEQ ID NO: 568718 - DNA, 25 bp, Mus musculus
gctctttaggtcattttctctagct

SEQ ID NO: 568719 - DNA, 25 bp, Mus musculus
gctctttaggtctttttctctagct

SEQ ID NO: 568720 - DNA, 25 bp, Mus musculus
gctctttagtctatgcagcactttt

SEQ ID NO: 568721 - DNA, 25 bp, Mus musculus
gctctttagtctttgcagcactttt

SEQ ID NO: 568722 - DNA, 25 bp, Mus musculus
gctctttatcctatagatatgccta

SEQ ID NO: 568723 - DNA, 25 bp, Mus musculus
gctctttatcctttagatatgccta

SEQ ID NO: 568724 - DNA, 25 bp, Mus musculus
gctctttcacatagtcaactacata

SEQ ID NO: 568725 - DNA, 25 bp, Mus musculus
gctctttcacattgtcaactacata

SEQ ID NO: 568726 - DNA, 25 bp, Mus musculus
gctctttcacgccaatgatacatca

SEQ ID NO: 568727 - DNA, 25 bp, Mus musculus
gctctttcacgcgaatgatacatca

SEQ ID NO: 568728 - DNA, 25 bp, Mus musculus
gctctttcagttatttccttccaga

SEQ ID NO: 568729 - DNA, 25 bp, Mus musculus
gctctttcagttttttccttccaga

SEQ ID NO: 568730 - DNA, 25 bp, Mus musculus
gctctttccagaacattttcatttt

SEQ ID NO: 568731 - DNA, 25 bp, Mus musculus
gctctttccagatcattttcatttt

SEQ ID NO: 568732 - DNA, 25 bp, Mus musculus
gctctttccagcatcacatgcagga

SEQ ID NO: 568733 - DNA, 25 bp, Mus musculus
gctctttccagcttcacatgcagga

SEQ ID NO: 568734 - DNA, 25 bp, Mus musculus
gctctttcctttagtgaacagtgga

SEQ ID NO: 568735 - DNA, 25 bp, Mus musculus
gctctttccttttgtgaacagtgga

SEQ ID NO: 568736 - DNA, 25 bp, Mus musculus
gctctttcgcttagacaacgctgtt

SEQ ID NO: 568737 - DNA, 25 bp, Mus musculus
gctctttcgctttgacaacgctgtt

SEQ ID NO: 568738 - DNA, 25 bp, Mus musculus
gctctttctaacaggaaccgaactc

SEQ ID NO: 568739 - DNA, 25 bp, Mus musculus
gctctttctaactggaaccgaactc

SEQ ID NO: 568740 - DNA, 25 bp, Mus musculus
gctctttctaatactgacctgtggg

SEQ ID NO: 568741 - DNA, 25 bp, Mus musculus
gctctttctaattctgacctgtggg

SEQ ID NO: 568742 - DNA, 25 bp, Mus musculus
gctctttctcacatcattggagggt

SEQ ID NO: 568743 - DNA, 25 bp, Mus musculus
gctctttctcacttcattggagggt

SEQ ID NO: 568744 - DNA, 25 bp, Mus musculus
gctctttctgagagaattgccccag

SEQ ID NO: 568745 - DNA, 25 bp, Mus musculus
gctctttctgagtgaattgccccag

SEQ ID NO: 568746 - DNA, 25 bp, Mus musculus
gctctttctggactttcacacaagt

SEQ ID NO: 568747 - DNA, 25 bp, Mus musculus
gctctttctggagtttcacacaagt

SEQ ID NO: 568748 - DNA, 25 bp, Mus musculus
gctctttcttccatagttgcattaa

SEQ ID NO: 568749 - DNA, 25 bp, Mus musculus
gctctttcttccttagttgcattaa

SEQ ID NO: 568750 - DNA, 25 bp, Mus musculus
gctctttctttgagatctttggaag

SEQ ID NO: 568751 - DNA, 25 bp, Mus musculus
gctctttctttgtgatctttggaag

SEQ ID NO: 568752 - DNA, 25 bp, Mus musculus
gctctttgaacaaggtatctttaaa

SEQ ID NO: 568753 - DNA, 25 bp, Mus musculus
gctctttgaacatggtatctttaaa

SEQ ID NO: 568754 - DNA, 25 bp, Mus musculus
gctctttgaatgactgtagttagtg

SEQ ID NO: 568755 - DNA, 25 bp, Mus musculus
gctctttgaatgtctgtagttagtg

SEQ ID NO: 568756 - DNA, 25 bp, Mus musculus
gctctttgacagagtattggttgaa

SEQ ID NO: 568757 - DNA, 25 bp, Mus musculus
gctctttgacagtgtattggttgaa

SEQ ID NO: 568758 - DNA, 25 bp, Mus musculus
gctctttgacgcatgcttttgagta

SEQ ID NO: 568759 - DNA, 25 bp, Mus musculus
gctctttgacgcttgcttttgagta

SEQ ID NO: 568760 - DNA, 25 bp, Mus musculus
gctctttgaggaaccatgccagcca

SEQ ID NO: 568761 - DNA, 25 bp, Mus musculus
gctctttgaggatccatgccagcca

SEQ ID NO: 568762 - DNA, 25 bp, Mus musculus
gctctttgatgactccgatgagaag

SEQ ID NO: 568763 - DNA, 25 bp, Mus musculus
gctctttgatgagtccgatgagaag

SEQ ID NO: 568764 - DNA, 25 bp, Mus musculus
gctctttgcactctggatccggatt

SEQ ID NO: 568765 - DNA, 25 bp, Mus musculus
gctctttgcactgtggatccggatt

SEQ ID NO: 568766 - DNA, 25 bp, Mus musculus
gctctttgccttacaacttgcatat

SEQ ID NO: 568767 - DNA, 25 bp, Mus musculus
gctctttgcctttcaacttgcatat

SEQ ID NO: 568768 - DNA, 25 bp, Mus musculus
gctctttgctgaagacaagtgactc

SEQ ID NO: 568769 - DNA, 25 bp, Mus musculus
gctctttgctgatgacaagtgactc

SEQ ID NO: 568770 - DNA, 25 bp, Mus musculus
gctctttgggcactgctatgttaca

SEQ ID NO: 568771 - DNA, 25 bp, Mus musculus
gctctttgggcagtgctatgttaca

SEQ ID NO: 568772 - DNA, 25 bp, Mus musculus
gctctttgggtgactttttggccac

SEQ ID NO: 568773 - DNA, 25 bp, Mus musculus
gctctttgggtgtctttttggccac

SEQ ID NO: 568774 - DNA, 25 bp, Mus musculus
gctctttgggttcctctaaactaaa

SEQ ID NO: 568775 - DNA, 25 bp, Mus musculus
gctctttgggttgctctaaactaaa

SEQ ID NO: 568776 - DNA, 25 bp, Mus musculus
gctctttgtaatcagtttggacacg

SEQ ID NO: 568777 - DNA, 25 bp, Mus musculus
gctctttgtaatgagtttggacacg

SEQ ID NO: 568778 - DNA, 25 bp, Mus musculus
gctctttgtactaggtgtcgcatca

SEQ ID NO: 568779 - DNA, 25 bp, Mus musculus
gctctttgtacttggtgtcgcatca

SEQ ID NO: 568780 - DNA, 25 bp, Mus musculus
gctctttgtagccttgaaaactgtt

SEQ ID NO: 568781 - DNA, 25 bp, Mus musculus
gctctttgtagcgttgaaaactgtt

SEQ ID NO: 568782 - DNA, 25 bp, Mus musculus
gctctttgtctactggccagggctt

SEQ ID NO: 568783 - DNA, 25 bp, Mus musculus
gctctttgtctagtggccagggctt

SEQ ID NO: 568784 - DNA, 25 bp, Mus musculus
gctctttgtgtcatagggttcagtc

SEQ ID NO: 568785 - DNA, 25 bp, Mus musculus
gctctttgtgtcttagggttcagtc

SEQ ID NO: 568786 - DNA, 25 bp, Mus musculus
gctctttgttgaacattgtctgtta

SEQ ID NO: 568787 - DNA, 25 bp, Mus musculus
gctctttgttgatcattgtctgtta

SEQ ID NO: 568788 - DNA, 25 bp, Mus musculus
gctcttttaaatctttgggctcact

SEQ ID NO: 568789 - DNA, 25 bp, Mus musculus
gctcttttaaatgtttgggctcact

SEQ ID NO: 568790 - DNA, 25 bp, Mus musculus
gctcttttacccagagttgtttaca

SEQ ID NO: 568791 - DNA, 25 bp, Mus musculus
gctcttttaccctgagttgtttaca

SEQ ID NO: 568792 - DNA, 25 bp, Mus musculus
gctcttttagagcaaggccttctcc

SEQ ID NO: 568793 - DNA, 25 bp, Mus musculus
gctcttttagaggaaggccttctcc

SEQ ID NO: 568794 - DNA, 25 bp, Mus musculus
gctcttttccttagaatgtttttgc

SEQ ID NO: 568795 - DNA, 25 bp, Mus musculus
gctcttttcctttgaatgtttttgc

SEQ ID NO: 568796 - DNA, 25 bp, Mus musculus
gctcttttctctcagagtccaagca

SEQ ID NO: 568797 - DNA, 25 bp, Mus musculus
gctcttttctctgagagtccaagca

SEQ ID NO: 568798 - DNA, 25 bp, Mus musculus
gctcttttgattatcacagatggta

SEQ ID NO: 568799 - DNA, 25 bp, Mus musculus
gctcttttgattttcacagatggta

SEQ ID NO: 568800 - DNA, 25 bp, Mus musculus
gctcttttgtccacgaaggtggaaa

SEQ ID NO: 568801 - DNA, 25 bp, Mus musculus
gctcttttgtcctcgaaggtggaaa

SEQ ID NO: 568802 - DNA, 25 bp, Mus musculus
gctcttttgtgcatttgtattgtga

SEQ ID NO: 568803 - DNA, 25 bp, Mus musculus
gctcttttgtgcttttgtattgtga

SEQ ID NO: 568804 - DNA, 25 bp, Mus musculus
gctctttttataaggtcaattcaga

SEQ ID NO: 568805 - DNA, 25 bp, Mus musculus
gctctttttatatggtcaattcaga

SEQ ID NO: 568806 - DNA, 25 bp, Mus musculus
gctctttttcaacccactgaacaag

SEQ ID NO: 568807 - DNA, 25 bp, Mus musculus
gctctttttcaagccactgaacaag

SEQ ID NO: 568808 - DNA, 25 bp, Mus musculus
gctctttttccacattaccatttta

SEQ ID NO: 568809 - DNA, 25 bp, Mus musculus
gctctttttccagattaccatttta

SEQ ID NO: 568810 - DNA, 25 bp, Mus musculus
gctctttttcgaaatccattccaga

SEQ ID NO: 568811 - DNA, 25 bp, Mus musculus
gctctttttcgatatccattccaga

SEQ ID NO: 568812 - DNA, 25 bp, Mus musculus
gctgaaaaacagcaattccccaatg

SEQ ID NO: 568813 - DNA, 25 bp, Mus musculus
gctgaaaaacaggaattccccaatg

SEQ ID NO: 568814 - DNA, 25 bp, Mus musculus
gctgaaaacaggatggctcactttt

SEQ ID NO: 568815 - DNA, 25 bp, Mus musculus
gctgaaaacaggttggctcactttt

SEQ ID NO: 568816 - DNA, 25 bp, Mus musculus
gctgaaaacatgaccacaaccaaat

SEQ ID NO: 568817 - DNA, 25 bp, Mus musculus
gctgaaaacatgtccacaaccaaat

SEQ ID NO: 568818 - DNA, 25 bp, Mus musculus
gctgaaaacctgagacgccgtctag

SEQ ID NO: 568819 - DNA, 25 bp, Mus musculus
gctgaaaacctgcaatctgtgctca

SEQ ID NO: 568820 - DNA, 25 bp, Mus musculus
gctgaaaacctggaatctgtgctca

SEQ ID NO: 568821 - DNA, 25 bp, Mus musculus
gctgaaaacctgtgacgccgtctag

SEQ ID NO: 568822 - DNA, 25 bp, Mus musculus
gctgaaaagcaccaggcatttgtta

SEQ ID NO: 568823 - DNA, 25 bp, Mus musculus
gctgaaaagcacgaggcatttgtta

SEQ ID NO: 568824 - DNA, 25 bp, Mus musculus
gctgaaaagggccacaaaatccacc

SEQ ID NO: 568825 - DNA, 25 bp, Mus musculus
gctgaaaagggcgacaaaatccacc

SEQ ID NO: 568826 - DNA, 25 bp, Mus musculus
gctgaaaagttcccactgtacctgt

SEQ ID NO: 568827 - DNA, 25 bp, Mus musculus
gctgaaaagttcgcactgtacctgt

SEQ ID NO: 568828 - DNA, 25 bp, Mus musculus
gctgaaaatgctcgcctgaatccca

SEQ ID NO: 568829 - DNA, 25 bp, Mus musculus
gctgaaaatgctggcctgaatccca

SEQ ID NO: 568830 - DNA, 25 bp, Mus musculus
gctgaaacaaggcttaagcctggaa

SEQ ID NO: 568831 - DNA, 25 bp, Mus musculus
gctgaaacaagggttaagcctggaa

SEQ ID NO: 568832 - DNA, 25 bp, Mus musculus
gctgaaacactcatcccaagttgga

SEQ ID NO: 568833 - DNA, 25 bp, Mus musculus
gctgaaacactcttcccaagttgga

SEQ ID NO: 568834 - DNA, 25 bp, Mus musculus
gctgaaacacttactgtgcaggact

SEQ ID NO: 568835 - DNA, 25 bp, Mus musculus
gctgaaacactttctgtgcaggact

SEQ ID NO: 568836 - DNA, 25 bp, Mus musculus
gctgaaacaggcatgcatccaacgt

SEQ ID NO: 568837 - DNA, 25 bp, Mus musculus
gctgaaacaggcttgcatccaacgt

SEQ ID NO: 568838 - DNA, 25 bp, Mus musculus
gctgaaacccaaagactcctttgat

SEQ ID NO: 568839 - DNA, 25 bp, Mus musculus
gctgaaacccaatgactcctttgat

SEQ ID NO: 568840 - DNA, 25 bp, Mus musculus
gctgaaacccatagtgctttgtcaa

SEQ ID NO: 568841 - DNA, 25 bp, Mus musculus
gctgaaacccattgtgctttgtcaa

SEQ ID NO: 568842 - DNA, 25 bp, Mus musculus
gctgaaacctttcgcattggcacat

SEQ ID NO: 568843 - DNA, 25 bp, Mus musculus
gctgaaacctttggcattggcacat

SEQ ID NO: 568844 - DNA, 25 bp, Mus musculus
gctgaaactcaacttcaattttaag

SEQ ID NO: 568845 - DNA, 25 bp, Mus musculus
gctgaaactcaagttcaattttaag

SEQ ID NO: 568846 - DNA, 25 bp, Mus musculus
gctgaaactcccaggatgctgggcc

SEQ ID NO: 568847 - DNA, 25 bp, Mus musculus
gctgaaactccctggatgctgggcc

SEQ ID NO: 568848 - DNA, 25 bp, Mus musculus
gctgaaactgaacgcccgctagggt

SEQ ID NO: 568849 - DNA, 25 bp, Mus musculus
gctgaaactgaaggcccgctagggt

SEQ ID NO: 568850 - DNA, 25 bp, Mus musculus
gctgaaactgatacctttctgtttg

SEQ ID NO: 568851 - DNA, 25 bp, Mus musculus
gctgaaactgattcctttctgtttg

SEQ ID NO: 568852 - DNA, 25 bp, Mus musculus
gctgaaacttttctagcactttgtt

SEQ ID NO: 568853 - DNA, 25 bp, Mus musculus
gctgaaacttttgtagcactttgtt

SEQ ID NO: 568854 - DNA, 25 bp, Mus musculus
gctgaaagacatcgaggcctcaaaa

SEQ ID NO: 568855 - DNA, 25 bp, Mus musculus
gctgaaagacatggaggcctcaaaa

SEQ ID NO: 568856 - DNA, 25 bp, Mus musculus
gctgaaagataacgactcaacccaa

SEQ ID NO: 568857 - DNA, 25 bp, Mus musculus
gctgaaagataaggactcaacccaa

SEQ ID NO: 568858 - DNA, 25 bp, Mus musculus
gctgaaagcattcttgccattcctg

SEQ ID NO: 568859 - DNA, 25 bp, Mus musculus
gctgaaagcattgttgccattcctg

SEQ ID NO: 568860 - DNA, 25 bp, Mus musculus
gctgaaagcctcacctaaaactaaa

SEQ ID NO: 568861 - DNA, 25 bp, Mus musculus
gctgaaagcctctcctaaaactaaa

SEQ ID NO: 568862 - DNA, 25 bp, Mus musculus
gctgaaagcgctcactggatctaga

SEQ ID NO: 568863 - DNA, 25 bp, Mus musculus
gctgaaagcgctgactggatctaga

SEQ ID NO: 568864 - DNA, 25 bp, Mus musculus
gctgaaagcttgcaactgccgagtt

SEQ ID NO: 568865 - DNA, 25 bp, Mus musculus
gctgaaagcttggaactgccgagtt

SEQ ID NO: 568866 - DNA, 25 bp, Mus musculus
gctgaaaggtacaaatgcatctgca

SEQ ID NO: 568867 - DNA, 25 bp, Mus musculus
gctgaaaggtactaatgcatctgca

SEQ ID NO: 568868 - DNA, 25 bp, Mus musculus
gctgaaagtacaccaatagtgtggt

SEQ ID NO: 568869 - DNA, 25 bp, Mus musculus
gctgaaagtacagcaatagtgtggt

SEQ ID NO: 568870 - DNA, 25 bp, Mus musculus
gctgaaagtcttccattggagttgt

SEQ ID NO: 568871 - DNA, 25 bp, Mus musculus
gctgaaagtcttgcattggagttgt

SEQ ID NO: 568872 - DNA, 25 bp, Mus musculus
gctgaaatcaacctcttttaaagaa

SEQ ID NO: 568873 - DNA, 25 bp, Mus musculus
gctgaaatcaacgtcttttaaagaa

SEQ ID NO: 568874 - DNA, 25 bp, Mus musculus
gctgaaatccttctgtgcaacacta

SEQ ID NO: 568875 - DNA, 25 bp, Mus musculus
gctgaaatccttgtgtgcaacacta

SEQ ID NO: 568876 - DNA, 25 bp, Mus musculus
gctgaaatctacaggccctgagaga

SEQ ID NO: 568877 - DNA, 25 bp, Mus musculus
gctgaaatctactggccctgagaga

SEQ ID NO: 568878 - DNA, 25 bp, Mus musculus
gctgaaatgatccacctttcgatgt

SEQ ID NO: 568879 - DNA, 25 bp, Mus musculus
gctgaaatgatcgacctttcgatgt

SEQ ID NO: 568880 - DNA, 25 bp, Mus musculus
gctgaaatgcagatcttacctaagt

SEQ ID NO: 568881 - DNA, 25 bp, Mus musculus
gctgaaatgcagttcttacctaagt

SEQ ID NO: 568882 - DNA, 25 bp, Mus musculus
gctgaaatgctgagtccaagacctc

SEQ ID NO: 568883 - DNA, 25 bp, Mus musculus
gctgaaatgctgatctctgacctgg

SEQ ID NO: 568884 - DNA, 25 bp, Mus musculus
gctgaaatgctgtgtccaagacctc

SEQ ID NO: 568885 - DNA, 25 bp, Mus musculus
gctgaaatgctgttctctgacctgg

SEQ ID NO: 568886 - DNA, 25 bp, Mus musculus
gctgaaattagtctgtgacgccata

SEQ ID NO: 568887 - DNA, 25 bp, Mus musculus
gctgaaattagtgtgtgacgccata

SEQ ID NO: 568888 - DNA, 25 bp, Mus musculus
gctgaaattctaaatcaagttctaa

SEQ ID NO: 568889 - DNA, 25 bp, Mus musculus
gctgaaattctatatcaagttctaa

SEQ ID NO: 568890 - DNA, 25 bp, Mus musculus
gctgaaattgatcctcgtaatgaca

SEQ ID NO: 568891 - DNA, 25 bp, Mus musculus
gctgaaattgatgctcgtaatgaca

SEQ ID NO: 568892 - DNA, 25 bp, Mus musculus
gctgaaatttccacgagtattgtca

SEQ ID NO: 568893 - DNA, 25 bp, Mus musculus
gctgaaatttcctcgagtattgtca

SEQ ID NO: 568894 - DNA, 25 bp, Mus musculus
gctgaaatttctcgcatgaccatat

SEQ ID NO: 568895 - DNA, 25 bp, Mus musculus
gctgaaatttctggcatgaccatat

SEQ ID NO: 568896 - DNA, 25 bp, Mus musculus
gctgaacaagacaacggcccaggtt

SEQ ID NO: 568897 - DNA, 25 bp, Mus musculus
gctgaacaagactacggcccaggtt

SEQ ID NO: 568898 - DNA, 25 bp, Mus musculus
gctgaacacactaaccggctgaaaa

SEQ ID NO: 568899 - DNA, 25 bp, Mus musculus
gctgaacacacttaccggctgaaaa

SEQ ID NO: 568900 - DNA, 25 bp, Mus musculus
gctgaacacatcacatgccgtttta

SEQ ID NO: 568901 - DNA, 25 bp, Mus musculus
gctgaacacatctcatgccgtttta

SEQ ID NO: 568902 - DNA, 25 bp, Mus musculus
gctgaacacgagcaagcactgcttt

SEQ ID NO: 568903 - DNA, 25 bp, Mus musculus
gctgaacacgaggaagcactgcttt

SEQ ID NO: 568904 - DNA, 25 bp, Mus musculus
gctgaacagcctcggtttttgtttt

SEQ ID NO: 568905 - DNA, 25 bp, Mus musculus
gctgaacagcctgggtttttgtttt

SEQ ID NO: 568906 - DNA, 25 bp, Mus musculus
gctgaacagggacgtttcctgcaaa

SEQ ID NO: 568907 - DNA, 25 bp, Mus musculus
gctgaacagggaggtttcctgcaaa

SEQ ID NO: 568908 - DNA, 25 bp, Mus musculus
gctgaacagtaaaggccacttggcc

SEQ ID NO: 568909 - DNA, 25 bp, Mus musculus
gctgaacagtaatggccacttggcc

SEQ ID NO: 568910 - DNA, 25 bp, Mus musculus
gctgaacattcacaaaactgtagta

SEQ ID NO: 568911 - DNA, 25 bp, Mus musculus
gctgaacattcagaaaactgtagta

SEQ ID NO: 568912 - DNA, 25 bp, Mus musculus
gctgaacattccagttttagccagg

SEQ ID NO: 568913 - DNA, 25 bp, Mus musculus
gctgaacattcctgttttagccagg

SEQ ID NO: 568914 - DNA, 25 bp, Mus musculus
gctgaaccaggtacccttggtagat

SEQ ID NO: 568915 - DNA, 25 bp, Mus musculus
gctgaaccaggttcccttggtagat

SEQ ID NO: 568916 - DNA, 25 bp, Mus musculus
gctgaaccatcactttagtctagtt

SEQ ID NO: 568917 - DNA, 25 bp, Mus musculus
gctgaaccatcagtttagtctagtt

SEQ ID NO: 568918 - DNA, 25 bp, Mus musculus
gctgaaccatcccagctaagaggtg

SEQ ID NO: 568919 - DNA, 25 bp, Mus musculus
gctgaaccatccgagctaagaggtg

SEQ ID NO: 568920 - DNA, 25 bp, Mus musculus
gctgaacccataaatttgtgccgaa

SEQ ID NO: 568921 - DNA, 25 bp, Mus musculus
gctgaacccatatatttgtgccgaa

SEQ ID NO: 568922 - DNA, 25 bp, Mus musculus
gctgaaccccaaaagaccaatgttt

SEQ ID NO: 568923 - DNA, 25 bp, Mus musculus
gctgaaccccaacgtagaggtgcca

SEQ ID NO: 568924 - DNA, 25 bp, Mus musculus
gctgaaccccaaggtagaggtgcca

SEQ ID NO: 568925 - DNA, 25 bp, Mus musculus
gctgaaccccaatagaccaatgttt

SEQ ID NO: 568926 - DNA, 25 bp, Mus musculus
gctgaaccccatatcttctgtttca

SEQ ID NO: 568927 - DNA, 25 bp, Mus musculus
gctgaaccccatttcttctgtttca

SEQ ID NO: 568928 - DNA, 25 bp, Mus musculus
gctgaaccccttactaaatgcagtt

SEQ ID NO: 568929 - DNA, 25 bp, Mus musculus
gctgaacccctttctaaatgcagtt

SEQ ID NO: 568930 - DNA, 25 bp, Mus musculus
gctgaacccggaagagtaatgctaa

SEQ ID NO: 568931 - DNA, 25 bp, Mus musculus
gctgaacccggatgagtaatgctaa

SEQ ID NO: 568932 - DNA, 25 bp, Mus musculus
gctgaaccctggagttttgtacccg

SEQ ID NO: 568933 - DNA, 25 bp, Mus musculus
gctgaaccctggtgttttgtacccg

SEQ ID NO: 568934 - DNA, 25 bp, Mus musculus
gctgaaccggaacagaatggagttt

SEQ ID NO: 568935 - DNA, 25 bp, Mus musculus
gctgaaccggaagagaatggagttt

SEQ ID NO: 568936 - DNA, 25 bp, Mus musculus
gctgaacctagaatgttccacttct

SEQ ID NO: 568937 - DNA, 25 bp, Mus musculus
gctgaacctagattgttccacttct

SEQ ID NO: 568938 - DNA, 25 bp, Mus musculus
gctgaacctgttactatctgattat

SEQ ID NO: 568939 - DNA, 25 bp, Mus musculus
gctgaacctgtttctatctgattat

SEQ ID NO: 568940 - DNA, 25 bp, Mus musculus
gctgaaccttttcacccatttaact

SEQ ID NO: 568941 - DNA, 25 bp, Mus musculus
gctgaaccttttgacccatttaact

SEQ ID NO: 568942 - DNA, 25 bp, Mus musculus
gctgaacgactcaactattccatga

SEQ ID NO: 568943 - DNA, 25 bp, Mus musculus
gctgaacgactctactattccatga

SEQ ID NO: 568944 - DNA, 25 bp, Mus musculus
gctgaacgtcttacagatcccgtag

SEQ ID NO: 568945 - DNA, 25 bp, Mus musculus
gctgaacgtctttcagatcccgtag

SEQ ID NO: 568946 - DNA, 25 bp, Mus musculus
gctgaacgtggaaagctgcgtccca

SEQ ID NO: 568947 - DNA, 25 bp, Mus musculus
gctgaacgtggatagctgcgtccca

SEQ ID NO: 568948 - DNA, 25 bp, Mus musculus
gctgaactataaattccccatgaag

SEQ ID NO: 568949 - DNA, 25 bp, Mus musculus
gctgaactataatttccccatgaag

SEQ ID NO: 568950 - DNA, 25 bp, Mus musculus
gctgaactatgcacccctagagaag

SEQ ID NO: 568951 - DNA, 25 bp, Mus musculus
gctgaactatgctcccctagagaag

SEQ ID NO: 568952 - DNA, 25 bp, Mus musculus
gctgaactattcacccatgggcaag

SEQ ID NO: 568953 - DNA, 25 bp, Mus musculus
gctgaactattctcccatgggcaag

SEQ ID NO: 568954 - DNA, 25 bp, Mus musculus
gctgaactccagcattccagggtca

SEQ ID NO: 568955 - DNA, 25 bp, Mus musculus
gctgaactccaggattccagggtca

SEQ ID NO: 568956 - DNA, 25 bp, Mus musculus
gctgaactctcacttaaagcattaa

SEQ ID NO: 568957 - DNA, 25 bp, Mus musculus
gctgaactctcagttaaagcattaa

SEQ ID NO: 568958 - DNA, 25 bp, Mus musculus
gctgaactctgtcctgtctatgcaa

SEQ ID NO: 568959 - DNA, 25 bp, Mus musculus
gctgaactctgtcttagtcagtttg

SEQ ID NO: 568960 - DNA, 25 bp, Mus musculus
gctgaactctgtgctgtctatgcaa

SEQ ID NO: 568961 - DNA, 25 bp, Mus musculus
gctgaactctgtgttagtcagtttg

SEQ ID NO: 568962 - DNA, 25 bp, Mus musculus
gctgaactggaaattgaggccttat

SEQ ID NO: 568963 - DNA, 25 bp, Mus musculus
gctgaactggaatttgaggccttat

SEQ ID NO: 568964 - DNA, 25 bp, Mus musculus
gctgaactggttaaaacttttgcac

SEQ ID NO: 568965 - DNA, 25 bp, Mus musculus
gctgaactggtttaaacttttgcac

SEQ ID NO: 568966 - DNA, 25 bp, Mus musculus
gctgaactgtctctcacaaattcat

SEQ ID NO: 568967 - DNA, 25 bp, Mus musculus
gctgaactgtctgtcacaaattcat

SEQ ID NO: 568968 - DNA, 25 bp, Mus musculus
gctgaacttctgcatgagctccgga

SEQ ID NO: 568969 - DNA, 25 bp, Mus musculus
gctgaacttctggatgagctccgga

SEQ ID NO: 568970 - DNA, 25 bp, Mus musculus
gctgaagaaagtccacacgggccaa

SEQ ID NO: 568971 - DNA, 25 bp, Mus musculus
gctgaagaaagtgcacacgggccaa

SEQ ID NO: 568972 - DNA, 25 bp, Mus musculus
gctgaagaacttcttgattctgaaa

SEQ ID NO: 568973 - DNA, 25 bp, Mus musculus
gctgaagaacttgttgattctgaaa

SEQ ID NO: 568974 - DNA, 25 bp, Mus musculus
gctgaagaagctataaaggatgtta

SEQ ID NO: 568975 - DNA, 25 bp, Mus musculus
gctgaagaagctttaaaggatgtta

SEQ ID NO: 568976 - DNA, 25 bp, Mus musculus
gctgaagaaggtattccaagagtac

SEQ ID NO: 568977 - DNA, 25 bp, Mus musculus
gctgaagaaggttttccaagagtac

SEQ ID NO: 568978 - DNA, 25 bp, Mus musculus
gctgaagaattgccagtccattcac

SEQ ID NO: 568979 - DNA, 25 bp, Mus musculus
gctgaagaattggcagtccattcac

SEQ ID NO: 568980 - DNA, 25 bp, Mus musculus
gctgaagaatttccatcagctcctc

SEQ ID NO: 568981 - DNA, 25 bp, Mus musculus
gctgaagaatttgcatcagctcctc

SEQ ID NO: 568982 - DNA, 25 bp, Mus musculus
gctgaagacgacactggagatgcaa

SEQ ID NO: 568983 - DNA, 25 bp, Mus musculus
gctgaagacgactctggagatgcaa

SEQ ID NO: 568984 - DNA, 25 bp, Mus musculus
gctgaagacggtcctttaaggaagt

SEQ ID NO: 568985 - DNA, 25 bp, Mus musculus
gctgaagacggtgctttaaggaagt

SEQ ID NO: 568986 - DNA, 25 bp, Mus musculus
gctgaagactggatgtagtgatttt

SEQ ID NO: 568987 - DNA, 25 bp, Mus musculus
gctgaagactggttgtagtgatttt

SEQ ID NO: 568988 - DNA, 25 bp, Mus musculus
gctgaagacttacgttatgcctttt

SEQ ID NO: 568989 - DNA, 25 bp, Mus musculus
gctgaagacttaggttatgcctttt

SEQ ID NO: 568990 - DNA, 25 bp, Mus musculus
gctgaagagaacaatgagcctcaaa

SEQ ID NO: 568991 - DNA, 25 bp, Mus musculus
gctgaagagaactatgagcctcaaa

SEQ ID NO: 568992 - DNA, 25 bp, Mus musculus
gctgaagagactcgtggataccctc

SEQ ID NO: 568993 - DNA, 25 bp, Mus musculus
gctgaagagactggtggataccctc

SEQ ID NO: 568994 - DNA, 25 bp, Mus musculus
gctgaagagcttcagcagtttttct

SEQ ID NO: 568995 - DNA, 25 bp, Mus musculus
gctgaagagcttcctgagtccaaac

SEQ ID NO: 568996 - DNA, 25 bp, Mus musculus
gctgaagagcttgagcagtttttct

SEQ ID NO: 568997 - DNA, 25 bp, Mus musculus
gctgaagagcttgctgagtccaaac

SEQ ID NO: 568998 - DNA, 25 bp, Mus musculus
gctgaagaggttcttcatgagccga

SEQ ID NO: 568999 - DNA, 25 bp, Mus musculus
gctgaagaggttgttcatgagccga

SEQ ID NO: 569000 - DNA, 25 bp, Mus musculus
gctgaagagtggactgtgcccataa

SEQ ID NO: 569001 - DNA, 25 bp, Mus musculus
gctgaagagtggtctgtgcccataa

SEQ ID NO: 569002 - DNA, 25 bp, Mus musculus
gctgaagagttacctgccagacaaa

SEQ ID NO: 569003 - DNA, 25 bp, Mus musculus
gctgaagagttagctgccagacaaa

SEQ ID NO: 569004 - DNA, 25 bp, Mus musculus
gctgaagatccactttcctggaaat

SEQ ID NO: 569005 - DNA, 25 bp, Mus musculus
gctgaagatccagtttcctggaaat

SEQ ID NO: 569006 - DNA, 25 bp, Mus musculus
gctgaagatgctacgggtttccaca

SEQ ID NO: 569007 - DNA, 25 bp, Mus musculus
gctgaagatgcttcgggtttccaca

SEQ ID NO: 569008 - DNA, 25 bp, Mus musculus
gctgaagatggcaagtcctgggtcc

SEQ ID NO: 569009 - DNA, 25 bp, Mus musculus
gctgaagatggctagtcctgggtcc

SEQ ID NO: 569010 - DNA, 25 bp, Mus musculus
gctgaagatgtgactccccatgatg

SEQ ID NO: 569011 - DNA, 25 bp, Mus musculus
gctgaagatgtgtctccccatgatg

SEQ ID NO: 569012 - DNA, 25 bp, Mus musculus
gctgaagattcacttatggaccatc

SEQ ID NO: 569013 - DNA, 25 bp, Mus musculus
gctgaagattcagttatggaccatc

SEQ ID NO: 569014 - DNA, 25 bp, Mus musculus
gctgaagcaagacaaccacgaatcg

SEQ ID NO: 569015 - DNA, 25 bp, Mus musculus
gctgaagcaagagaaccacgaatcg

SEQ ID NO: 569016 - DNA, 25 bp, Mus musculus
gctgaagcagcccgcatattaggcg

SEQ ID NO: 569017 - DNA, 25 bp, Mus musculus
gctgaagcagccggcatattaggcg

SEQ ID NO: 569018 - DNA, 25 bp, Mus musculus
gctgaagcaggcaagaagatctttg

SEQ ID NO: 569019 - DNA, 25 bp, Mus musculus
gctgaagcaggctagaagatctttg

SEQ ID NO: 569020 - DNA, 25 bp, Mus musculus
gctgaagccaccagggcagggaatc

SEQ ID NO: 569021 - DNA, 25 bp, Mus musculus
gctgaagccacctgggcagggaatc

SEQ ID NO: 569022 - DNA, 25 bp, Mus musculus
gctgaagcccagatttccggtcaag

SEQ ID NO: 569023 - DNA, 25 bp, Mus musculus
gctgaagcccagttttccggtcaag

SEQ ID NO: 569024 - DNA, 25 bp, Mus musculus
gctgaagcccctatgtctctgccag

SEQ ID NO: 569025 - DNA, 25 bp, Mus musculus
gctgaagcccctttgtctctgccag

SEQ ID NO: 569026 - DNA, 25 bp, Mus musculus
gctgaagccgttatcagttcccttc

SEQ ID NO: 569027 - DNA, 25 bp, Mus musculus
gctgaagccgttttcagttcccttc

SEQ ID NO: 569028 - DNA, 25 bp, Mus musculus
gctgaagcgactatcctggtgctaa

SEQ ID NO: 569029 - DNA, 25 bp, Mus musculus
gctgaagcgactttcctggtgctaa

SEQ ID NO: 569030 - DNA, 25 bp, Mus musculus
gctgaagcgatgcttagactctttg

SEQ ID NO: 569031 - DNA, 25 bp, Mus musculus
gctgaagcgatggttagactctttg

SEQ ID NO: 569032 - DNA, 25 bp, Mus musculus
gctgaagcggcccaaagacgccaat

SEQ ID NO: 569033 - DNA, 25 bp, Mus musculus
gctgaagcggccgaaagacgccaat

SEQ ID NO: 569034 - DNA, 25 bp, Mus musculus
gctgaagctagaatggccggcccat

SEQ ID NO: 569035 - DNA, 25 bp, Mus musculus
gctgaagctagattggccggcccat

SEQ ID NO: 569036 - DNA, 25 bp, Mus musculus
gctgaagctgatctaccgctacgat

SEQ ID NO: 569037 - DNA, 25 bp, Mus musculus
gctgaagctgatgtaccgctacgat

SEQ ID NO: 569038 - DNA, 25 bp, Mus musculus
gctgaagctgcacatctcttccaaa

SEQ ID NO: 569039 - DNA, 25 bp, Mus musculus
gctgaagctgcagatctcttccaaa

SEQ ID NO: 569040 - DNA, 25 bp, Mus musculus
gctgaaggacagagattctgtagct

SEQ ID NO: 569041 - DNA, 25 bp, Mus musculus
gctgaaggacagcatttccaccatg

SEQ ID NO: 569042 - DNA, 25 bp, Mus musculus
gctgaaggacaggatttccaccatg

SEQ ID NO: 569043 - DNA, 25 bp, Mus musculus
gctgaaggacagtgattctgtagct

SEQ ID NO: 569044 - DNA, 25 bp, Mus musculus
gctgaaggatgaccacatcctggtt

SEQ ID NO: 569045 - DNA, 25 bp, Mus musculus
gctgaaggatgagcacatcctggtt

SEQ ID NO: 569046 - DNA, 25 bp, Mus musculus
gctgaaggcacgaccgttgtagcat

SEQ ID NO: 569047 - DNA, 25 bp, Mus musculus
gctgaaggcacgtccgttgtagcat

SEQ ID NO: 569048 - DNA, 25 bp, Mus musculus
gctgaaggccataaaagcccggaat

SEQ ID NO: 569049 - DNA, 25 bp, Mus musculus
gctgaaggccattaaagcccggaat

SEQ ID NO: 569050 - DNA, 25 bp, Mus musculus
gctgaaggcctgaatgaaaagctga

SEQ ID NO: 569051 - DNA, 25 bp, Mus musculus
gctgaaggcctgtatgaaaagctga

SEQ ID NO: 569052 - DNA, 25 bp, Mus musculus
gctgaaggccttatctcatctctgg

SEQ ID NO: 569053 - DNA, 25 bp, Mus musculus
gctgaaggccttttctcatctctgg

SEQ ID NO: 569054 - DNA, 25 bp, Mus musculus
gctgaaggcggaaatacttttccta

SEQ ID NO: 569055 - DNA, 25 bp, Mus musculus
gctgaaggcggatatacttttccta

SEQ ID NO: 569056 - DNA, 25 bp, Mus musculus
gctgaaggctcaaagcttgaccctg

SEQ ID NO: 569057 - DNA, 25 bp, Mus musculus
gctgaaggctcacatgtggtaacat

SEQ ID NO: 569058 - DNA, 25 bp, Mus musculus
gctgaaggctcagatgtggtaacat

SEQ ID NO: 569059 - DNA, 25 bp, Mus musculus
gctgaaggctcatagcttgaccctg

SEQ ID NO: 569060 - DNA, 25 bp, Mus musculus
gctgaaggtcaacccttctgtgtcc

SEQ ID NO: 569061 - DNA, 25 bp, Mus musculus
gctgaaggtcaagccttctgtgtcc

SEQ ID NO: 569062 - DNA, 25 bp, Mus musculus
gctgaaggttttaaagcaaccgtat

SEQ ID NO: 569063 - DNA, 25 bp, Mus musculus
gctgaaggtttttaagcaaccgtat

SEQ ID NO: 569064 - DNA, 25 bp, Mus musculus
gctgaagtacagcactcatcctggg

SEQ ID NO: 569065 - DNA, 25 bp, Mus musculus
gctgaagtacaggactcatcctggg

SEQ ID NO: 569066 - DNA, 25 bp, Mus musculus
gctgaagtagcaactcagttttgat

SEQ ID NO: 569067 - DNA, 25 bp, Mus musculus
gctgaagtagcatctcagttttgat

SEQ ID NO: 569068 - DNA, 25 bp, Mus musculus
gctgaagtcaccaaatctcttgtcc

SEQ ID NO: 569069 - DNA, 25 bp, Mus musculus
gctgaagtcacctaatctcttgtcc

SEQ ID NO: 569070 - DNA, 25 bp, Mus musculus
gctgaagtctggctcttagggaaaa

SEQ ID NO: 569071 - DNA, 25 bp, Mus musculus
gctgaagtctgggtcttagggaaaa

SEQ ID NO: 569072 - DNA, 25 bp, Mus musculus
gctgaagtgcagagctatgattctt

SEQ ID NO: 569073 - DNA, 25 bp, Mus musculus
gctgaagtgcagtgctatgattctt

SEQ ID NO: 569074 - DNA, 25 bp, Mus musculus
gctgaagtgctgaggttttcccatc

SEQ ID NO: 569075 - DNA, 25 bp, Mus musculus
gctgaagtgctgtggttttcccatc

SEQ ID NO: 569076 - DNA, 25 bp, Mus musculus
gctgaagtggtcagtgtcaggtact

SEQ ID NO: 569077 - DNA, 25 bp, Mus musculus
gctgaagtggtctgtgtcaggtact

SEQ ID NO: 569078 - DNA, 25 bp, Mus musculus
gctgaagttaaaatgtggttgccct

SEQ ID NO: 569079 - DNA, 25 bp, Mus musculus
gctgaagttaaattgtggttgccct

SEQ ID NO: 569080 - DNA, 25 bp, Mus musculus
gctgaagttgctcaatatcattacc

SEQ ID NO: 569081 - DNA, 25 bp, Mus musculus
gctgaagttgctcgacgcctatctc

SEQ ID NO: 569082 - DNA, 25 bp, Mus musculus
gctgaagttgctgaatatcattacc

SEQ ID NO: 569083 - DNA, 25 bp, Mus musculus
gctgaagttgctggacgcctatctc

SEQ ID NO: 569084 - DNA, 25 bp, Mus musculus
gctgaagttggtaggccctgctgca

SEQ ID NO: 569085 - DNA, 25 bp, Mus musculus
gctgaagttggttggccctgctgca

SEQ ID NO: 569086 - DNA, 25 bp, Mus musculus
gctgaataaaacctggtaccctagg

SEQ ID NO: 569087 - DNA, 25 bp, Mus musculus
gctgaataaaacgtggtaccctagg

SEQ ID NO: 569088 - DNA, 25 bp, Mus musculus
gctgaataatacaaggacaagggcc

SEQ ID NO: 569089 - DNA, 25 bp, Mus musculus
gctgaataatactaggacaagggcc

SEQ ID NO: 569090 - DNA, 25 bp, Mus musculus
gctgaataccatctattacttgaac

SEQ ID NO: 569091 - DNA, 25 bp, Mus musculus
gctgaataccatgtattacttgaac

SEQ ID NO: 569092 - DNA, 25 bp, Mus musculus
gctgaataccggaacttccaggctt

SEQ ID NO: 569093 - DNA, 25 bp, Mus musculus
gctgaataccggtacttccaggctt

SEQ ID NO: 569094 - DNA, 25 bp, Mus musculus
gctgaatactttctgatccttggca

SEQ ID NO: 569095 - DNA, 25 bp, Mus musculus
gctgaatactttgtgatccttggca

SEQ ID NO: 569096 - DNA, 25 bp, Mus musculus
gctgaatagaagaagccagttcctt

SEQ ID NO: 569097 - DNA, 25 bp, Mus musculus
gctgaatagaagtagccagttcctt

SEQ ID NO: 569098 - DNA, 25 bp, Mus musculus
gctgaatagttcaggcctaggccat

SEQ ID NO: 569099 - DNA, 25 bp, Mus musculus
gctgaatagttctggcctaggccat

SEQ ID NO: 569100 - DNA, 25 bp, Mus musculus
gctgaatataccattgaggaatttt

SEQ ID NO: 569101 - DNA, 25 bp, Mus musculus
gctgaatatacctttgaggaatttt

SEQ ID NO: 569102 - DNA, 25 bp, Mus musculus
gctgaatatctgaccactttgcgat

SEQ ID NO: 569103 - DNA, 25 bp, Mus musculus
gctgaatatctgtccactttgcgat

SEQ ID NO: 569104 - DNA, 25 bp, Mus musculus
gctgaatatgtcactgcttgggaag

SEQ ID NO: 569105 - DNA, 25 bp, Mus musculus
gctgaatatgtctctgcttgggaag

SEQ ID NO: 569106 - DNA, 25 bp, Mus musculus
gctgaatatttcatggtaggccatg

SEQ ID NO: 569107 - DNA, 25 bp, Mus musculus
gctgaatatttcctggattcccaga

SEQ ID NO: 569108 - DNA, 25 bp, Mus musculus
gctgaatatttcgtggattcccaga

SEQ ID NO: 569109 - DNA, 25 bp, Mus musculus
gctgaatatttcttggtaggccatg

SEQ ID NO: 569110 - DNA, 25 bp, Mus musculus
gctgaatcaaaaagtgccaccaccc

SEQ ID NO: 569111 - DNA, 25 bp, Mus musculus
gctgaatcaaaatgtgccaccaccc

SEQ ID NO: 569112 - DNA, 25 bp, Mus musculus
gctgaatcaactaactagcttcctc

SEQ ID NO: 569113 - DNA, 25 bp, Mus musculus
gctgaatcaactcatcctctggaaa

SEQ ID NO: 569114 - DNA, 25 bp, Mus musculus
gctgaatcaactgatcctctggaaa

SEQ ID NO: 569115 - DNA, 25 bp, Mus musculus
gctgaatcaacttactagcttcctc

SEQ ID NO: 569116 - DNA, 25 bp, Mus musculus
gctgaatcagcacgttgtcatccaa

SEQ ID NO: 569117 - DNA, 25 bp, Mus musculus
gctgaatcagcaggttgtcatccaa

SEQ ID NO: 569118 - DNA, 25 bp, Mus musculus
gctgaatcagccatgagtttgcatc

SEQ ID NO: 569119 - DNA, 25 bp, Mus musculus
gctgaatcagccttgagtttgcatc

SEQ ID NO: 569120 - DNA, 25 bp, Mus musculus
gctgaatcatccagtgtcatggcac

SEQ ID NO: 569121 - DNA, 25 bp, Mus musculus
gctgaatcatcctgtgtcatggcac

SEQ ID NO: 569122 - DNA, 25 bp, Mus musculus
gctgaatctaacacgacactgtctc

SEQ ID NO: 569123 - DNA, 25 bp, Mus musculus
gctgaatctaactcgacactgtctc

SEQ ID NO: 569124 - DNA, 25 bp, Mus musculus
gctgaatcttccatattgacaccta

SEQ ID NO: 569125 - DNA, 25 bp, Mus musculus
gctgaatcttccttattgacaccta

SEQ ID NO: 569126 - DNA, 25 bp, Mus musculus
gctgaatgagtgcatctagactaga

SEQ ID NO: 569127 - DNA, 25 bp, Mus musculus
gctgaatgagtggatctagactaga

SEQ ID NO: 569128 - DNA, 25 bp, Mus musculus
gctgaatgcagcactactgtagatt

SEQ ID NO: 569129 - DNA, 25 bp, Mus musculus
gctgaatgcagctctactgtagatt

SEQ ID NO: 569130 - DNA, 25 bp, Mus musculus
gctgaatgctccaaatttatgctaa

SEQ ID NO: 569131 - DNA, 25 bp, Mus musculus
gctgaatgctcctaatttatgctaa

SEQ ID NO: 569132 - DNA, 25 bp, Mus musculus
gctgaatgctgccatagatgattgt

SEQ ID NO: 569133 - DNA, 25 bp, Mus musculus
gctgaatgctgcgatagatgattgt

SEQ ID NO: 569134 - DNA, 25 bp, Mus musculus
gctgaatgctttagagtgacctctg

SEQ ID NO: 569135 - DNA, 25 bp, Mus musculus
gctgaatgcttttgagtgacctctg

SEQ ID NO: 569136 - DNA, 25 bp, Mus musculus
gctgaatgggatctatgaggtccta

SEQ ID NO: 569137 - DNA, 25 bp, Mus musculus
gctgaatgggatgtatgaggtccta

SEQ ID NO: 569138 - DNA, 25 bp, Mus musculus
gctgaatggtggctctcctaggaac

SEQ ID NO: 569139 - DNA, 25 bp, Mus musculus
gctgaatggtgggtctcctaggaac

SEQ ID NO: 569140 - DNA, 25 bp, Mus musculus
gctgaatgtacactgcgtatcccaa

SEQ ID NO: 569141 - DNA, 25 bp, Mus musculus
gctgaatgtacagtgcgtatcccaa

SEQ ID NO: 569142 - DNA, 25 bp, Mus musculus
gctgaatgtacccagggcctcgatt

SEQ ID NO: 569143 - DNA, 25 bp, Mus musculus
gctgaatgtaccgagggcctcgatt

SEQ ID NO: 569144 - DNA, 25 bp, Mus musculus
gctgaatgtcagctcataaattgaa

SEQ ID NO: 569145 - DNA, 25 bp, Mus musculus
gctgaatgtcaggtcataaattgaa

SEQ ID NO: 569146 - DNA, 25 bp, Mus musculus
gctgaattactgatccatggactac

SEQ ID NO: 569147 - DNA, 25 bp, Mus musculus
gctgaattactgttccatggactac

SEQ ID NO: 569148 - DNA, 25 bp, Mus musculus
gctgaattagccatggagtcctgta

SEQ ID NO: 569149 - DNA, 25 bp, Mus musculus
gctgaattagccttggagtcctgta

SEQ ID NO: 569150 - DNA, 25 bp, Mus musculus
gctgaattcagaccgtgtgggaaac

SEQ ID NO: 569151 - DNA, 25 bp, Mus musculus
gctgaattcagagcgtgtgggaaac

SEQ ID NO: 569152 - DNA, 25 bp, Mus musculus
gctgaattcagcatgctctgtgagt

SEQ ID NO: 569153 - DNA, 25 bp, Mus musculus
gctgaattcagcttgctctgtgagt

SEQ ID NO: 569154 - DNA, 25 bp, Mus musculus
gctgaattccatcgtccatactgat

SEQ ID NO: 569155 - DNA, 25 bp, Mus musculus
gctgaattccatggtccatactgat

SEQ ID NO: 569156 - DNA, 25 bp, Mus musculus
gctgaattcgttcctcctggcctct

SEQ ID NO: 569157 - DNA, 25 bp, Mus musculus
gctgaattcgttgctcctggcctct

SEQ ID NO: 569158 - DNA, 25 bp, Mus musculus
gctgaattgctaccatcactgcaga

SEQ ID NO: 569159 - DNA, 25 bp, Mus musculus
gctgaattgctagcatcactgcaga

SEQ ID NO: 569160 - DNA, 25 bp, Mus musculus
gctgaatttcacatggctgtgggta

SEQ ID NO: 569161 - DNA, 25 bp, Mus musculus
gctgaatttcacttggctgtgggta

SEQ ID NO: 569162 - DNA, 25 bp, Mus musculus
gctgaatttcagaatcggaggagac

SEQ ID NO: 569163 - DNA, 25 bp, Mus musculus
gctgaatttcagtatcggaggagac

SEQ ID NO: 569164 - DNA, 25 bp, Mus musculus
gctgaatttggactcagtctattcc

SEQ ID NO: 569165 - DNA, 25 bp, Mus musculus
gctgaatttggagtcagtctattcc

SEQ ID NO: 569166 - DNA, 25 bp, Mus musculus
gctgaattttcccaaatgcgacagg

SEQ ID NO: 569167 - DNA, 25 bp, Mus musculus
gctgaattttccgaaatgcgacagg

SEQ ID NO: 569168 - DNA, 25 bp, Mus musculus
gctgaattttgtcgtgagaccttat

SEQ ID NO: 569169 - DNA, 25 bp, Mus musculus
gctgaattttgtggtgagaccttat

SEQ ID NO: 569170 - DNA, 25 bp, Mus musculus
gctgacaaatggatatcccctggtc

SEQ ID NO: 569171 - DNA, 25 bp, Mus musculus
gctgacaaatggttatcccctggtc

SEQ ID NO: 569172 - DNA, 25 bp, Mus musculus
gctgacaaccgtataacaggctggt

SEQ ID NO: 569173 - DNA, 25 bp, Mus musculus
gctgacaaccgtttaacaggctggt

SEQ ID NO: 569174 - DNA, 25 bp, Mus musculus
gctgacaacgtgatccttctattga

SEQ ID NO: 569175 - DNA, 25 bp, Mus musculus
gctgacaacgtgttccttctattga

SEQ ID NO: 569176 - DNA, 25 bp, Mus musculus
gctgacaactgtcaagaggaacctt

SEQ ID NO: 569177 - DNA, 25 bp, Mus musculus
gctgacaactgtgaagaggaacctt

SEQ ID NO: 569178 - DNA, 25 bp, Mus musculus
gctgacaagaagactcagggtccta

SEQ ID NO: 569179 - DNA, 25 bp, Mus musculus
gctgacaagaagtctcagggtccta

SEQ ID NO: 569180 - DNA, 25 bp, Mus musculus
gctgacaagaccaacctgtgacata

SEQ ID NO: 569181 - DNA, 25 bp, Mus musculus
gctgacaagacctacctgtgacata

SEQ ID NO: 569182 - DNA, 25 bp, Mus musculus
gctgacaagtatcccaccgagaagt

SEQ ID NO: 569183 - DNA, 25 bp, Mus musculus
gctgacaagtatgccaccgagaagt

SEQ ID NO: 569184 - DNA, 25 bp, Mus musculus
gctgacaagttgaaaggagaccatt

SEQ ID NO: 569185 - DNA, 25 bp, Mus musculus
gctgacaagttgtaaggagaccatt

SEQ ID NO: 569186 - DNA, 25 bp, Mus musculus
gctgacaatactccaggtcctacac

SEQ ID NO: 569187 - DNA, 25 bp, Mus musculus
gctgacaatactgcaggtcctacac

SEQ ID NO: 569188 - DNA, 25 bp, Mus musculus
gctgacaatcctacctttaatggct

SEQ ID NO: 569189 - DNA, 25 bp, Mus musculus
gctgacaatccttcctttaatggct

SEQ ID NO: 569190 - DNA, 25 bp, Mus musculus
gctgacaattcaccaacctatcaag

SEQ ID NO: 569191 - DNA, 25 bp, Mus musculus
gctgacaattcagcaacctatcaag

SEQ ID NO: 569192 - DNA, 25 bp, Mus musculus
gctgacacaatcagcacgatctctg

SEQ ID NO: 569193 - DNA, 25 bp, Mus musculus
gctgacacaatctgcacgatctctg

SEQ ID NO: 569194 - DNA, 25 bp, Mus musculus
gctgacacacaaagcacctttttat

SEQ ID NO: 569195 - DNA, 25 bp, Mus musculus
gctgacacacaatgcacctttttat

SEQ ID NO: 569196 - DNA, 25 bp, Mus musculus
gctgacacaccaagcagagctacga

SEQ ID NO: 569197 - DNA, 25 bp, Mus musculus
gctgacacaccatgcagagctacga

SEQ ID NO: 569198 - DNA, 25 bp, Mus musculus
gctgacacaggtaccatttgttaca

SEQ ID NO: 569199 - DNA, 25 bp, Mus musculus
gctgacacaggttccatttgttaca

SEQ ID NO: 569200 - DNA, 25 bp, Mus musculus
gctgacaccaaaatttcctcggatt

SEQ ID NO: 569201 - DNA, 25 bp, Mus musculus
gctgacaccaaattttcctcggatt

SEQ ID NO: 569202 - DNA, 25 bp, Mus musculus
gctgacacctcgctatggcttaaag

SEQ ID NO: 569203 - DNA, 25 bp, Mus musculus
gctgacacctcggtatggcttaaag

SEQ ID NO: 569204 - DNA, 25 bp, Mus musculus
gctgacacctctagctgatggcgcg

SEQ ID NO: 569205 - DNA, 25 bp, Mus musculus
gctgacacctcttgctgatggcgcg

SEQ ID NO: 569206 - DNA, 25 bp, Mus musculus
gctgacacggctccagaactctggg

SEQ ID NO: 569207 - DNA, 25 bp, Mus musculus
gctgacacggctgcagaactctggg

SEQ ID NO: 569208 - DNA, 25 bp, Mus musculus
gctgacacgggcagaggctctgtac

SEQ ID NO: 569209 - DNA, 25 bp, Mus musculus
gctgacacgggctgaggctctgtac

SEQ ID NO: 569210 - DNA, 25 bp, Mus musculus
gctgacactattacagtctctggaa

SEQ ID NO: 569211 - DNA, 25 bp, Mus musculus
gctgacactatttcagtctctggaa

SEQ ID NO: 569212 - DNA, 25 bp, Mus musculus
gctgacacttacattacacatctgg

SEQ ID NO: 569213 - DNA, 25 bp, Mus musculus
gctgacacttactttacacatctgg

SEQ ID NO: 569214 - DNA, 25 bp, Mus musculus
gctgacagactccaacagaagtgta

SEQ ID NO: 569215 - DNA, 25 bp, Mus musculus
gctgacagactcgaacagaagtgta

SEQ ID NO: 569216 - DNA, 25 bp, Mus musculus
gctgacagagacacctacagaagga

SEQ ID NO: 569217 - DNA, 25 bp, Mus musculus
gctgacagagactcctacagaagga

SEQ ID NO: 569218 - DNA, 25 bp, Mus musculus
gctgacagatctatgatggtggcca

SEQ ID NO: 569219 - DNA, 25 bp, Mus musculus
gctgacagatctttgatggtggcca

SEQ ID NO: 569220 - DNA, 25 bp, Mus musculus
gctgacagcgtaagtggccctactg

SEQ ID NO: 569221 - DNA, 25 bp, Mus musculus
gctgacagcgtatgtggccctactg

SEQ ID NO: 569222 - DNA, 25 bp, Mus musculus
gctgacagcttcactgttcgcacaa

SEQ ID NO: 569223 - DNA, 25 bp, Mus musculus
gctgacagcttctctgttcgcacaa

SEQ ID NO: 569224 - DNA, 25 bp, Mus musculus
gctgacaggagcacttttatctgga

SEQ ID NO: 569225 - DNA, 25 bp, Mus musculus
gctgacaggagctcttttatctgga

SEQ ID NO: 569226 - DNA, 25 bp, Mus musculus
gctgacaggcggaatgaaacttcaa

SEQ ID NO: 569227 - DNA, 25 bp, Mus musculus
gctgacaggcggtatgaaacttcaa

SEQ ID NO: 569228 - DNA, 25 bp, Mus musculus
gctgacagtaacatgctcgctttgg

SEQ ID NO: 569229 - DNA, 25 bp, Mus musculus
gctgacagtaacttgctcgctttgg

SEQ ID NO: 569230 - DNA, 25 bp, Mus musculus
gctgacagtcaacgcatctatgtct

SEQ ID NO: 569231 - DNA, 25 bp, Mus musculus
gctgacagtcaaggcatctatgtct

SEQ ID NO: 569232 - DNA, 25 bp, Mus musculus
gctgacagtgctatttatatagtga

SEQ ID NO: 569233 - DNA, 25 bp, Mus musculus
gctgacagtgctttttatatagtga

SEQ ID NO: 569234 - DNA, 25 bp, Mus musculus
gctgacagtttgaacaacttttgct

SEQ ID NO: 569235 - DNA, 25 bp, Mus musculus
gctgacagtttgtacaacttttgct

SEQ ID NO: 569236 - DNA, 25 bp, Mus musculus
gctgacataagcacttgtctcaggt

SEQ ID NO: 569237 - DNA, 25 bp, Mus musculus
gctgacataagctcttgtctcaggt

SEQ ID NO: 569238 - DNA, 25 bp, Mus musculus
gctgacatccaaccactaactcata

SEQ ID NO: 569239 - DNA, 25 bp, Mus musculus
gctgacatccaagcactaactcata

SEQ ID NO: 569240 - DNA, 25 bp, Mus musculus
gctgacatcttacggagactactct

SEQ ID NO: 569241 - DNA, 25 bp, Mus musculus
gctgacatcttagggagactactct

SEQ ID NO: 569242 - DNA, 25 bp, Mus musculus
gctgacatcttgaggccacgaggag

SEQ ID NO: 569243 - DNA, 25 bp, Mus musculus
gctgacatcttgtggccacgaggag

SEQ ID NO: 569244 - DNA, 25 bp, Mus musculus
gctgacatgctaacataactattct

SEQ ID NO: 569245 - DNA, 25 bp, Mus musculus
gctgacatgctatcataactattct

SEQ ID NO: 569246 - DNA, 25 bp, Mus musculus
gctgacatgctgcacgttgtacaaa

SEQ ID NO: 569247 - DNA, 25 bp, Mus musculus
gctgacatgctggacgttgtacaaa

SEQ ID NO: 569248 - DNA, 25 bp, Mus musculus
gctgacatggacagtgagtgaacac

SEQ ID NO: 569249 - DNA, 25 bp, Mus musculus
gctgacatggactgtgagtgaacac

SEQ ID NO: 569250 - DNA, 25 bp, Mus musculus
gctgacatggtaatccattggacat

SEQ ID NO: 569251 - DNA, 25 bp, Mus musculus
gctgacatggtattccattggacat

SEQ ID NO: 569252 - DNA, 25 bp, Mus musculus
gctgacattgtaacttttccttgga

SEQ ID NO: 569253 - DNA, 25 bp, Mus musculus
gctgacattgtatcttttccttgga

SEQ ID NO: 569254 - DNA, 25 bp, Mus musculus
gctgaccaaaaaagtgctatctact

SEQ ID NO: 569255 - DNA, 25 bp, Mus musculus
gctgaccaaaaatgtgctatctact

SEQ ID NO: 569256 - DNA, 25 bp, Mus musculus
gctgaccacagtatattggatgggc

SEQ ID NO: 569257 - DNA, 25 bp, Mus musculus
gctgaccacagtttattggatgggc

SEQ ID NO: 569258 - DNA, 25 bp, Mus musculus
gctgaccacgttactatagccaaaa

SEQ ID NO: 569259 - DNA, 25 bp, Mus musculus
gctgaccacgtttctatagccaaaa

SEQ ID NO: 569260 - DNA, 25 bp, Mus musculus
gctgaccactacagtactggaggag

SEQ ID NO: 569261 - DNA, 25 bp, Mus musculus
gctgaccactactgtactggaggag

SEQ ID NO: 569262 - DNA, 25 bp, Mus musculus
gctgaccactccagagatgcagaaa

SEQ ID NO: 569263 - DNA, 25 bp, Mus musculus
gctgaccactcctgagatgcagaaa

SEQ ID NO: 569264 - DNA, 25 bp, Mus musculus
gctgaccagaacaaatgcttccatt

SEQ ID NO: 569265 - DNA, 25 bp, Mus musculus
gctgaccagaactaatgcttccatt

SEQ ID NO: 569266 - DNA, 25 bp, Mus musculus
gctgaccagctacaatcacatattt

SEQ ID NO: 569267 - DNA, 25 bp, Mus musculus
gctgaccagctagaatcacatattt

SEQ ID NO: 569268 - DNA, 25 bp, Mus musculus
gctgaccaggctcacatggtttgta

SEQ ID NO: 569269 - DNA, 25 bp, Mus musculus
gctgaccaggctgacatggtttgta

SEQ ID NO: 569270 - DNA, 25 bp, Mus musculus
gctgaccagggacgcaactccaaat

SEQ ID NO: 569271 - DNA, 25 bp, Mus musculus
gctgaccagggaggcaactccaaat

SEQ ID NO: 569272 - DNA, 25 bp, Mus musculus
gctgaccagggcaatatattgagac

SEQ ID NO: 569273 - DNA, 25 bp, Mus musculus
gctgaccagggctatatattgagac

SEQ ID NO: 569274 - DNA, 25 bp, Mus musculus
gctgaccagtggattgattttgttg

SEQ ID NO: 569275 - DNA, 25 bp, Mus musculus
gctgaccagtggtttgattttgttg

SEQ ID NO: 569276 - DNA, 25 bp, Mus musculus
gctgaccatatcctgaaacgcctct

SEQ ID NO: 569277 - DNA, 25 bp, Mus musculus
gctgaccatatcgtgaaacgcctct

SEQ ID NO: 569278 - DNA, 25 bp, Mus musculus
gctgaccatatgctgagtggtgaac

SEQ ID NO: 569279 - DNA, 25 bp, Mus musculus
gctgaccatatggtgagtggtgaac

SEQ ID NO: 569280 - DNA, 25 bp, Mus musculus
gctgaccatgaacacctgcatgacc

SEQ ID NO: 569281 - DNA, 25 bp, Mus musculus
gctgaccatgaagacctgcatgacc

SEQ ID NO: 569282 - DNA, 25 bp, Mus musculus
gctgaccatgggagccaacttgtta

SEQ ID NO: 569283 - DNA, 25 bp, Mus musculus
gctgaccatgggtgccaacttgtta

SEQ ID NO: 569284 - DNA, 25 bp, Mus musculus
gctgaccatgtacttgttgttggtc

SEQ ID NO: 569285 - DNA, 25 bp, Mus musculus
gctgaccatgtagttgttgttggtc

SEQ ID NO: 569286 - DNA, 25 bp, Mus musculus
gctgaccatgtgagcagcgcacata

SEQ ID NO: 569287 - DNA, 25 bp, Mus musculus
gctgaccatgtgtgcagcgcacata

SEQ ID NO: 569288 - DNA, 25 bp, Mus musculus
gctgaccattagatgtgccaggctt

SEQ ID NO: 569289 - DNA, 25 bp, Mus musculus
gctgaccattagttgtgccaggctt

SEQ ID NO: 569290 - DNA, 25 bp, Mus musculus
gctgacccaagaaccgtgcagtgtc

SEQ ID NO: 569291 - DNA, 25 bp, Mus musculus
gctgacccaagatccgtgcagtgtc

SEQ ID NO: 569292 - DNA, 25 bp, Mus musculus
gctgacccagaactatgaggcgtac

SEQ ID NO: 569293 - DNA, 25 bp, Mus musculus
gctgacccagaagtatgaggcgtac

SEQ ID NO: 569294 - DNA, 25 bp, Mus musculus
gctgacccaggtagatctccttgaa

SEQ ID NO: 569295 - DNA, 25 bp, Mus musculus
gctgacccaggttgatctccttgaa

SEQ ID NO: 569296 - DNA, 25 bp, Mus musculus
gctgacccagtaaagagctgtttcc

SEQ ID NO: 569297 - DNA, 25 bp, Mus musculus
gctgacccagtatagagctgtttcc

SEQ ID NO: 569298 - DNA, 25 bp, Mus musculus
gctgacccagtgaaggcggttttga

SEQ ID NO: 569299 - DNA, 25 bp, Mus musculus
gctgacccagtgtaggcggttttga

SEQ ID NO: 569300 - DNA, 25 bp, Mus musculus
gctgacccatgaattgtctcatgcc

SEQ ID NO: 569301 - DNA, 25 bp, Mus musculus
gctgacccatgatttgtctcatgcc

SEQ ID NO: 569302 - DNA, 25 bp, Mus musculus
gctgaccccaggactgagaagcaat

SEQ ID NO: 569303 - DNA, 25 bp, Mus musculus
gctgaccccaggtctgagaagcaat

SEQ ID NO: 569304 - DNA, 25 bp, Mus musculus
gctgaccccataactattcttttct

SEQ ID NO: 569305 - DNA, 25 bp, Mus musculus
gctgaccccatatctattcttttct

SEQ ID NO: 569306 - DNA, 25 bp, Mus musculus
gctgaccccgtccaataatttagtt

SEQ ID NO: 569307 - DNA, 25 bp, Mus musculus
gctgaccccgtcgaataatttagtt

SEQ ID NO: 569308 - DNA, 25 bp, Mus musculus
gctgaccctcacagtccatttagga

SEQ ID NO: 569309 - DNA, 25 bp, Mus musculus
gctgaccctcactgtccatttagga

SEQ ID NO: 569310 - DNA, 25 bp, Mus musculus
gctgaccctcctcggaactctgaaa

SEQ ID NO: 569311 - DNA, 25 bp, Mus musculus
gctgaccctcctgggaactctgaaa

SEQ ID NO: 569312 - DNA, 25 bp, Mus musculus
gctgaccctgacaaagctccaggag

SEQ ID NO: 569313 - DNA, 25 bp, Mus musculus
gctgaccctgactaagctccaggag

SEQ ID NO: 569314 - DNA, 25 bp, Mus musculus
gctgaccctttactgcatggagata

SEQ ID NO: 569315 - DNA, 25 bp, Mus musculus
gctgaccctttagtgcatggagata

SEQ ID NO: 569316 - DNA, 25 bp, Mus musculus
gctgacccttttcgccttcgaaagc

SEQ ID NO: 569317 - DNA, 25 bp, Mus musculus
gctgacccttttggccttcgaaagc

SEQ ID NO: 569318 - DNA, 25 bp, Mus musculus
gctgaccgaccgatgacacatatta

SEQ ID NO: 569319 - DNA, 25 bp, Mus musculus
gctgaccgaccgttgacacatatta

SEQ ID NO: 569320 - DNA, 25 bp, Mus musculus
gctgaccgctacacgctgcagggcg

SEQ ID NO: 569321 - DNA, 25 bp, Mus musculus
gctgaccgctactcgctgcagggcg

SEQ ID NO: 569322 - DNA, 25 bp, Mus musculus
gctgacctaatgagtatcatcccta

SEQ ID NO: 569323 - DNA, 25 bp, Mus musculus
gctgacctaatgtgtatcatcccta

SEQ ID NO: 569324 - DNA, 25 bp, Mus musculus
gctgacctagcccataagatacaca

SEQ ID NO: 569325 - DNA, 25 bp, Mus musculus
gctgacctagccgataagatacaca

SEQ ID NO: 569326 - DNA, 25 bp, Mus musculus
gctgacctagtgagtgcttttcggc

SEQ ID NO: 569327 - DNA, 25 bp, Mus musculus
gctgacctagtgtgtgcttttcggc

SEQ ID NO: 569328 - DNA, 25 bp, Mus musculus
gctgacctcagaatatgataccctt

SEQ ID NO: 569329 - DNA, 25 bp, Mus musculus
gctgacctcagattatgataccctt

SEQ ID NO: 569330 - DNA, 25 bp, Mus musculus
gctgacctcaggaccaggctgttgg

SEQ ID NO: 569331 - DNA, 25 bp, Mus musculus
gctgacctcaggcttattcatggtt

SEQ ID NO: 569332 - DNA, 25 bp, Mus musculus
gctgacctcagggttattcatggtt

SEQ ID NO: 569333 - DNA, 25 bp, Mus musculus
gctgacctcaggtccaggctgttgg

SEQ ID NO: 569334 - DNA, 25 bp, Mus musculus
gctgacctccatagcctatgagaag

SEQ ID NO: 569335 - DNA, 25 bp, Mus musculus
gctgacctccattgcctatgagaag

SEQ ID NO: 569336 - DNA, 25 bp, Mus musculus
gctgacctccccaaagagaacattc

SEQ ID NO: 569337 - DNA, 25 bp, Mus musculus
gctgacctcccctaagagaacattc

SEQ ID NO: 569338 - DNA, 25 bp, Mus musculus
gctgacctcctcacttgtgcagatt

SEQ ID NO: 569339 - DNA, 25 bp, Mus musculus
gctgacctcctcatgggatcagaga

SEQ ID NO: 569340 - DNA, 25 bp, Mus musculus
gctgacctcctctcttgtgcagatt

SEQ ID NO: 569341 - DNA, 25 bp, Mus musculus
gctgacctcctcttgggatcagaga

SEQ ID NO: 569342 - DNA, 25 bp, Mus musculus
gctgacctctggagagtgtgcacca

SEQ ID NO: 569343 - DNA, 25 bp, Mus musculus
gctgacctctggtgagtgtgcacca

SEQ ID NO: 569344 - DNA, 25 bp, Mus musculus
gctgacctgataatgctcccactat

SEQ ID NO: 569345 - DNA, 25 bp, Mus musculus
gctgacctgatattgctcccactat

SEQ ID NO: 569346 - DNA, 25 bp, Mus musculus
gctgacctggataaccttgattctt

SEQ ID NO: 569347 - DNA, 25 bp, Mus musculus
gctgacctggattaccttgattctt

SEQ ID NO: 569348 - DNA, 25 bp, Mus musculus
gctgacctggccaaaccccatggga

SEQ ID NO: 569349 - DNA, 25 bp, Mus musculus
gctgacctggcctaaccccatggga

SEQ ID NO: 569350 - DNA, 25 bp, Mus musculus
gctgacctggctcactttgcattag

SEQ ID NO: 569351 - DNA, 25 bp, Mus musculus
gctgacctggctgactttgcattag

SEQ ID NO: 569352 - DNA, 25 bp, Mus musculus
gctgacctgggtcatgaaggcttca

SEQ ID NO: 569353 - DNA, 25 bp, Mus musculus
gctgacctgggtgatgaaggcttca

SEQ ID NO: 569354 - DNA, 25 bp, Mus musculus
gctgacctggtaatgctggacaact

SEQ ID NO: 569355 - DNA, 25 bp, Mus musculus
gctgacctggtattgctggacaact

SEQ ID NO: 569356 - DNA, 25 bp, Mus musculus
gctgaccttaggagaagcccttcag

SEQ ID NO: 569357 - DNA, 25 bp, Mus musculus
gctgaccttaggtgaagcccttcag

SEQ ID NO: 569358 - DNA, 25 bp, Mus musculus
gctgaccttattctctaacatactc

SEQ ID NO: 569359 - DNA, 25 bp, Mus musculus
gctgaccttattgtctaacatactc

SEQ ID NO: 569360 - DNA, 25 bp, Mus musculus
gctgaccttgctatactgtgggaaa

SEQ ID NO: 569361 - DNA, 25 bp, Mus musculus
gctgaccttgctttactgtgggaaa

SEQ ID NO: 569362 - DNA, 25 bp, Mus musculus
gctgaccttggactcatagatttct

SEQ ID NO: 569363 - DNA, 25 bp, Mus musculus
gctgaccttggagtcatagatttct

SEQ ID NO: 569364 - DNA, 25 bp, Mus musculus
gctgaccttgtgagtcaataactta

SEQ ID NO: 569365 - DNA, 25 bp, Mus musculus
gctgaccttgtgatactgagcacta

SEQ ID NO: 569366 - DNA, 25 bp, Mus musculus
gctgaccttgtgtgtcaataactta

SEQ ID NO: 569367 - DNA, 25 bp, Mus musculus
gctgaccttgtgttactgagcacta

SEQ ID NO: 569368 - DNA, 25 bp, Mus musculus
gctgaccttttaatagagctcctca

SEQ ID NO: 569369 - DNA, 25 bp, Mus musculus
gctgaccttttattagagctcctca

SEQ ID NO: 569370 - DNA, 25 bp, Mus musculus
gctgacgactaacctgctggccctg

SEQ ID NO: 569371 - DNA, 25 bp, Mus musculus
gctgacgactaagctgctggccctg

SEQ ID NO: 569372 - DNA, 25 bp, Mus musculus
gctgacgatctcactacttttgaag

SEQ ID NO: 569373 - DNA, 25 bp, Mus musculus
gctgacgatctctctacttttgaag

SEQ ID NO: 569374 - DNA, 25 bp, Mus musculus
gctgacgcacccaagagtggtatat

SEQ ID NO: 569375 - DNA, 25 bp, Mus musculus
gctgacgcaccctagagtggtatat

SEQ ID NO: 569376 - DNA, 25 bp, Mus musculus
gctgacgcacgtaccggggttctta

SEQ ID NO: 569377 - DNA, 25 bp, Mus musculus
gctgacgcacgttccggggttctta

SEQ ID NO: 569378 - DNA, 25 bp, Mus musculus
gctgacgcccaaagagacatacttt

SEQ ID NO: 569379 - DNA, 25 bp, Mus musculus
gctgacgcccaatgagacatacttt

SEQ ID NO: 569380 - DNA, 25 bp, Mus musculus
gctgacgctcagctctaagagagag

SEQ ID NO: 569381 - DNA, 25 bp, Mus musculus
gctgacgctcaggtctaagagagag

SEQ ID NO: 569382 - DNA, 25 bp, Mus musculus
gctgacgctgatacagtttaacctg

SEQ ID NO: 569383 - DNA, 25 bp, Mus musculus
gctgacgctgattcagtttaacctg

SEQ ID NO: 569384 - DNA, 25 bp, Mus musculus
gctgacggactgctgtttctgcccg

SEQ ID NO: 569385 - DNA, 25 bp, Mus musculus
gctgacggactggtgtttctgcccg

SEQ ID NO: 569386 - DNA, 25 bp, Mus musculus
gctgacggattacttattcctgtgg

SEQ ID NO: 569387 - DNA, 25 bp, Mus musculus
gctgacggattagttattcctgtgg

SEQ ID NO: 569388 - DNA, 25 bp, Mus musculus
gctgacggcattctcccagaaatgg

SEQ ID NO: 569389 - DNA, 25 bp, Mus musculus
gctgacggcattgtcccagaaatgg

SEQ ID NO: 569390 - DNA, 25 bp, Mus musculus
gctgacgtagttatgattcctgtaa

SEQ ID NO: 569391 - DNA, 25 bp, Mus musculus
gctgacgtagttttgattcctgtaa

SEQ ID NO: 569392 - DNA, 25 bp, Mus musculus
gctgacgtattcatctacaggatag

SEQ ID NO: 569393 - DNA, 25 bp, Mus musculus
gctgacgtattcttctacaggatag

SEQ ID NO: 569394 - DNA, 25 bp, Mus musculus
gctgacgtcaatctctaaaaggctt

SEQ ID NO: 569395 - DNA, 25 bp, Mus musculus
gctgacgtcaatgtctaaaaggctt

SEQ ID NO: 569396 - DNA, 25 bp, Mus musculus
gctgacgtctgtcggaaccacctat

SEQ ID NO: 569397 - DNA, 25 bp, Mus musculus
gctgacgtctgtgggaaccacctat

SEQ ID NO: 569398 - DNA, 25 bp, Mus musculus
gctgacgtgtccacattggcagtgt

SEQ ID NO: 569399 - DNA, 25 bp, Mus musculus
gctgacgtgtcctcattggcagtgt

SEQ ID NO: 569400 - DNA, 25 bp, Mus musculus
gctgacgtgttacatgttccacatg

SEQ ID NO: 569401 - DNA, 25 bp, Mus musculus
gctgacgtgttagatgttccacatg

SEQ ID NO: 569402 - DNA, 25 bp, Mus musculus
gctgacgttgatatgcctgccatat

SEQ ID NO: 569403 - DNA, 25 bp, Mus musculus
gctgacgttgatttgcctgccatat

SEQ ID NO: 569404 - DNA, 25 bp, Mus musculus
gctgactaacagctgactttcccgg

SEQ ID NO: 569405 - DNA, 25 bp, Mus musculus
gctgactaacaggtgactttcccgg

SEQ ID NO: 569406 - DNA, 25 bp, Mus musculus
gctgactaacccctggtgtctgaca

SEQ ID NO: 569407 - DNA, 25 bp, Mus musculus
gctgactaacccgtggtgtctgaca

SEQ ID NO: 569408 - DNA, 25 bp, Mus musculus
gctgactacagcactgaattacttt

SEQ ID NO: 569409 - DNA, 25 bp, Mus musculus
gctgactacagctctgaattacttt

SEQ ID NO: 569410 - DNA, 25 bp, Mus musculus
gctgactacagtaatttatccaaat

SEQ ID NO: 569411 - DNA, 25 bp, Mus musculus
gctgactacagttatttatccaaat

SEQ ID NO: 569412 - DNA, 25 bp, Mus musculus
gctgactacctgaaccggtgaccag

SEQ ID NO: 569413 - DNA, 25 bp, Mus musculus
gctgactacctgtaccggtgaccag

SEQ ID NO: 569414 - DNA, 25 bp, Mus musculus
gctgactattacaatgatgtgaacc

SEQ ID NO: 569415 - DNA, 25 bp, Mus musculus
gctgactattactatgatgtgaacc

SEQ ID NO: 569416 - DNA, 25 bp, Mus musculus
gctgactattgcacactacaaaaat

SEQ ID NO: 569417 - DNA, 25 bp, Mus musculus
gctgactattgctcactacaaaaat

SEQ ID NO: 569418 - DNA, 25 bp, Mus musculus
gctgactcacataaaaggcagttat

SEQ ID NO: 569419 - DNA, 25 bp, Mus musculus
gctgactcacattaaaggcagttat

SEQ ID NO: 569420 - DNA, 25 bp, Mus musculus
gctgactcagctcaagatgaaccgt

SEQ ID NO: 569421 - DNA, 25 bp, Mus musculus
gctgactcagctgaagatgaaccgt

SEQ ID NO: 569422 - DNA, 25 bp, Mus musculus
gctgactcaggacacacattgcctt

SEQ ID NO: 569423 - DNA, 25 bp, Mus musculus
gctgactcaggagacacattgcctt

SEQ ID NO: 569424 - DNA, 25 bp, Mus musculus
gctgactcatgactatattaactct

SEQ ID NO: 569425 - DNA, 25 bp, Mus musculus
gctgactcatgagtatattaactct

SEQ ID NO: 569426 - DNA, 25 bp, Mus musculus
gctgactcccttaaatttagctgaa

SEQ ID NO: 569427 - DNA, 25 bp, Mus musculus
gctgactccctttaatttagctgaa

SEQ ID NO: 569428 - DNA, 25 bp, Mus musculus
gctgactcctttacagggatagcct

SEQ ID NO: 569429 - DNA, 25 bp, Mus musculus
gctgactccttttcagggatagcct

SEQ ID NO: 569430 - DNA, 25 bp, Mus musculus
gctgactcggttacagaggctggaa

SEQ ID NO: 569431 - DNA, 25 bp, Mus musculus
gctgactcggtttcagaggctggaa

SEQ ID NO: 569432 - DNA, 25 bp, Mus musculus
gctgactctgcaccagtctaccata

SEQ ID NO: 569433 - DNA, 25 bp, Mus musculus
gctgactctgcacggagaactccca

SEQ ID NO: 569434 - DNA, 25 bp, Mus musculus
gctgactctgcagcagtctaccata

SEQ ID NO: 569435 - DNA, 25 bp, Mus musculus
gctgactctgcagggagaactccca

SEQ ID NO: 569436 - DNA, 25 bp, Mus musculus
gctgactcttcactatttcctggaa

SEQ ID NO: 569437 - DNA, 25 bp, Mus musculus
gctgactcttcagtatttcctggaa

SEQ ID NO: 569438 - DNA, 25 bp, Mus musculus
gctgactcttggcttagtcaccagt

SEQ ID NO: 569439 - DNA, 25 bp, Mus musculus
gctgactcttgggttagtcaccagt

SEQ ID NO: 569440 - DNA, 25 bp, Mus musculus
gctgactcttgtaactgcaagctac

SEQ ID NO: 569441 - DNA, 25 bp, Mus musculus
gctgactcttgttactgcaagctac

SEQ ID NO: 569442 - DNA, 25 bp, Mus musculus
gctgactgaacaatcgttgcactaa

SEQ ID NO: 569443 - DNA, 25 bp, Mus musculus
gctgactgaacattcgttgcactaa

SEQ ID NO: 569444 - DNA, 25 bp, Mus musculus
gctgactgaagtcctgagctgcaga

SEQ ID NO: 569445 - DNA, 25 bp, Mus musculus
gctgactgaagtgctgagctgcaga

SEQ ID NO: 569446 - DNA, 25 bp, Mus musculus
gctgactgaatgctgagaccttctg

SEQ ID NO: 569447 - DNA, 25 bp, Mus musculus
gctgactgaatggtgagaccttctg

SEQ ID NO: 569448 - DNA, 25 bp, Mus musculus
gctgactgacaacctgggccttcag

SEQ ID NO: 569449 - DNA, 25 bp, Mus musculus
gctgactgacaagctgggccttcag

SEQ ID NO: 569450 - DNA, 25 bp, Mus musculus
gctgactgacacctcatacaggcag

SEQ ID NO: 569451 - DNA, 25 bp, Mus musculus
gctgactgacacgtcatacaggcag

SEQ ID NO: 569452 - DNA, 25 bp, Mus musculus
gctgactgacatccagagctgcttc

SEQ ID NO: 569453 - DNA, 25 bp, Mus musculus
gctgactgacatgcagagctgcttc

SEQ ID NO: 569454 - DNA, 25 bp, Mus musculus
gctgactgagtccatgctaactgag

SEQ ID NO: 569455 - DNA, 25 bp, Mus musculus
gctgactgagtcgatgctaactgag

SEQ ID NO: 569456 - DNA, 25 bp, Mus musculus
gctgactgcagcatgggcttgaaat

SEQ ID NO: 569457 - DNA, 25 bp, Mus musculus
gctgactgcagcttgggcttgaaat

SEQ ID NO: 569458 - DNA, 25 bp, Mus musculus
gctgactgcatgctgatgtgctact

SEQ ID NO: 569459 - DNA, 25 bp, Mus musculus
gctgactgcatggtgatgtgctact

SEQ ID NO: 569460 - DNA, 25 bp, Mus musculus
gctgactggatcaaaatgctgccca

SEQ ID NO: 569461 - DNA, 25 bp, Mus musculus
gctgactggatctaaatgctgccca

SEQ ID NO: 569462 - DNA, 25 bp, Mus musculus
gctgactggcctcgttcacatgtga

SEQ ID NO: 569463 - DNA, 25 bp, Mus musculus
gctgactggcctggttcacatgtga

SEQ ID NO: 569464 - DNA, 25 bp, Mus musculus
gctgactgtctcctaacacaagatg

SEQ ID NO: 569465 - DNA, 25 bp, Mus musculus
gctgactgtctcgtaacacaagatg

SEQ ID NO: 569466 - DNA, 25 bp, Mus musculus
gctgactgtgctactgataacccta

SEQ ID NO: 569467 - DNA, 25 bp, Mus musculus
gctgactgtgcttctgataacccta

SEQ ID NO: 569468 - DNA, 25 bp, Mus musculus
gctgacttataactgctgcatgcct

SEQ ID NO: 569469 - DNA, 25 bp, Mus musculus
gctgacttataagtgctgcatgcct

SEQ ID NO: 569470 - DNA, 25 bp, Mus musculus
gctgacttccagctctgacttgaaa

SEQ ID NO: 569471 - DNA, 25 bp, Mus musculus
gctgacttccaggtctgacttgaaa

SEQ ID NO: 569472 - DNA, 25 bp, Mus musculus
gctgacttccggcaagccatcatga

SEQ ID NO: 569473 - DNA, 25 bp, Mus musculus
gctgacttccgggaagccatcatga

SEQ ID NO: 569474 - DNA, 25 bp, Mus musculus
gctgacttctaccttttagtactat

SEQ ID NO: 569475 - DNA, 25 bp, Mus musculus
gctgacttctacgttttagtactat

SEQ ID NO: 569476 - DNA, 25 bp, Mus musculus
gctgacttggagacttctgacagtt

SEQ ID NO: 569477 - DNA, 25 bp, Mus musculus
gctgacttggagtcttctgacagtt

SEQ ID NO: 569478 - DNA, 25 bp, Mus musculus
gctgacttgggtcacatctgtctgc

SEQ ID NO: 569479 - DNA, 25 bp, Mus musculus
gctgacttgggtgacatctgtctgc

SEQ ID NO: 569480 - DNA, 25 bp, Mus musculus
gctgacttggtaagggaagccctca

SEQ ID NO: 569481 - DNA, 25 bp, Mus musculus
gctgacttggtatgggaagccctca

SEQ ID NO: 569482 - DNA, 25 bp, Mus musculus
gctgacttgtctagccttaatagaa

SEQ ID NO: 569483 - DNA, 25 bp, Mus musculus
gctgacttgtcttgccttaatagaa

SEQ ID NO: 569484 - DNA, 25 bp, Mus musculus
gctgactttcaacattatattcttc

SEQ ID NO: 569485 - DNA, 25 bp, Mus musculus
gctgactttcaagattatattcttc

SEQ ID NO: 569486 - DNA, 25 bp, Mus musculus
gctgactttgaactgccaagccagg

SEQ ID NO: 569487 - DNA, 25 bp, Mus musculus
gctgactttgaagtgccaagccagg

SEQ ID NO: 569488 - DNA, 25 bp, Mus musculus
gctgactttgagcacatcatcccca

SEQ ID NO: 569489 - DNA, 25 bp, Mus musculus
gctgactttgaggacatcatcccca

SEQ ID NO: 569490 - DNA, 25 bp, Mus musculus
gctgacttttatatgggcacttccc

SEQ ID NO: 569491 - DNA, 25 bp, Mus musculus
gctgacttttatttgggcacttccc

SEQ ID NO: 569492 - DNA, 25 bp, Mus musculus
gctgacttttgaaagggctggttat

SEQ ID NO: 569493 - DNA, 25 bp, Mus musculus
gctgacttttgatagggctggttat

SEQ ID NO: 569494 - DNA, 25 bp, Mus musculus
gctgacttttgcaatggagctgtag

SEQ ID NO: 569495 - DNA, 25 bp, Mus musculus
gctgacttttgctatggagctgtag

SEQ ID NO: 569496 - DNA, 25 bp, Mus musculus
gctgacttttgtcacgcatgctaag

SEQ ID NO: 569497 - DNA, 25 bp, Mus musculus
gctgacttttgtgacgcatgctaag

SEQ ID NO: 569498 - DNA, 25 bp, Mus musculus
gctgagaaaactaccctacatgctt

SEQ ID NO: 569499 - DNA, 25 bp, Mus musculus
gctgagaaaacttccctacatgctt

SEQ ID NO: 569500 - DNA, 25 bp, Mus musculus
gctgagaacataccagaacagacca

SEQ ID NO: 569501 - DNA, 25 bp, Mus musculus
gctgagaacatagcagaacagacca

SEQ ID NO: 569502 - DNA, 25 bp, Mus musculus
gctgagaaccaaactgaagtctttt

SEQ ID NO: 569503 - DNA, 25 bp, Mus musculus
gctgagaaccaaagttttagactgt

SEQ ID NO: 569504 - DNA, 25 bp, Mus musculus
gctgagaaccaatctgaagtctttt

SEQ ID NO: 569505 - DNA, 25 bp, Mus musculus
gctgagaaccaatgttttagactgt

SEQ ID NO: 569506 - DNA, 25 bp, Mus musculus
gctgagaaccgaaccaggagtttgt

SEQ ID NO: 569507 - DNA, 25 bp, Mus musculus
gctgagaaccgatccaggagtttgt

SEQ ID NO: 569508 - DNA, 25 bp, Mus musculus
gctgagaaccttcgtgcatgtgata

SEQ ID NO: 569509 - DNA, 25 bp, Mus musculus
gctgagaaccttggtgcatgtgata

SEQ ID NO: 569510 - DNA, 25 bp, Mus musculus
gctgagaactctcggactgggactt

SEQ ID NO: 569511 - DNA, 25 bp, Mus musculus
gctgagaactctgggactgggactt

SEQ ID NO: 569512 - DNA, 25 bp, Mus musculus
gctgagaactgaatctggttcttct

SEQ ID NO: 569513 - DNA, 25 bp, Mus musculus
gctgagaactgattctggttcttct

SEQ ID NO: 569514 - DNA, 25 bp, Mus musculus
gctgagaagcttaggaataaaaccc

SEQ ID NO: 569515 - DNA, 25 bp, Mus musculus
gctgagaagctttggaataaaaccc

SEQ ID NO: 569516 - DNA, 25 bp, Mus musculus
gctgagaaggctagtcttattgtat

SEQ ID NO: 569517 - DNA, 25 bp, Mus musculus
gctgagaaggcttgtcttattgtat

SEQ ID NO: 569518 - DNA, 25 bp, Mus musculus
gctgagacatacatgtcctctctgg

SEQ ID NO: 569519 - DNA, 25 bp, Mus musculus
gctgagacatacttgtcctctctgg

SEQ ID NO: 569520 - DNA, 25 bp, Mus musculus
gctgagacatgtacaggttaaatct

SEQ ID NO: 569521 - DNA, 25 bp, Mus musculus
gctgagacatgttcaggttaaatct

SEQ ID NO: 569522 - DNA, 25 bp, Mus musculus
gctgagaccactaaagccctaggtg

SEQ ID NO: 569523 - DNA, 25 bp, Mus musculus
gctgagaccacttaagccctaggtg

SEQ ID NO: 569524 - DNA, 25 bp, Mus musculus
gctgagactcacattaccgattttc

SEQ ID NO: 569525 - DNA, 25 bp, Mus musculus
gctgagactcactttaccgattttc

SEQ ID NO: 569526 - DNA, 25 bp, Mus musculus
gctgagactggactgctcagtgcca

SEQ ID NO: 569527 - DNA, 25 bp, Mus musculus
gctgagactggagtgctcagtgcca

SEQ ID NO: 569528 - DNA, 25 bp, Mus musculus
gctgagagccagacagtggatctta

SEQ ID NO: 569529 - DNA, 25 bp, Mus musculus
gctgagagccagtcagtggatctta

SEQ ID NO: 569530 - DNA, 25 bp, Mus musculus
gctgagagctcgctccatttgcaac

SEQ ID NO: 569531 - DNA, 25 bp, Mus musculus
gctgagagctcggtccatttgcaac

SEQ ID NO: 569532 - DNA, 25 bp, Mus musculus
gctgagaggtgtatcctcacaggaa

SEQ ID NO: 569533 - DNA, 25 bp, Mus musculus
gctgagaggtgtttcctcacaggaa

SEQ ID NO: 569534 - DNA, 25 bp, Mus musculus
gctgagagtatccttattctgcaca

SEQ ID NO: 569535 - DNA, 25 bp, Mus musculus
gctgagagtatcgttattctgcaca

SEQ ID NO: 569536 - DNA, 25 bp, Mus musculus
gctgagagtctgatttgaggatcct

SEQ ID NO: 569537 - DNA, 25 bp, Mus musculus
gctgagagtctgttttgaggatcct

SEQ ID NO: 569538 - DNA, 25 bp, Mus musculus
gctgagataagaacacccctttcgg

SEQ ID NO: 569539 - DNA, 25 bp, Mus musculus
gctgagataagatcacccctttcgg

SEQ ID NO: 569540 - DNA, 25 bp, Mus musculus
gctgagatcatcatcttccaatgcc

SEQ ID NO: 569541 - DNA, 25 bp, Mus musculus
gctgagatcatcttcttccaatgcc

SEQ ID NO: 569542 - DNA, 25 bp, Mus musculus
gctgagatccagcatccagctgtgg

SEQ ID NO: 569543 - DNA, 25 bp, Mus musculus
gctgagatccaggatccagctgtgg

SEQ ID NO: 569544 - DNA, 25 bp, Mus musculus
gctgagatcccaccagtggcaagaa

SEQ ID NO: 569545 - DNA, 25 bp, Mus musculus
gctgagatcccagcagtggcaagaa

SEQ ID NO: 569546 - DNA, 25 bp, Mus musculus
gctgagatctcacatgtctgtcact

SEQ ID NO: 569547 - DNA, 25 bp, Mus musculus
gctgagatctcagatgtctgtcact

SEQ ID NO: 569548 - DNA, 25 bp, Mus musculus
gctgagatgaacaacaagacccaag

SEQ ID NO: 569549 - DNA, 25 bp, Mus musculus
gctgagatgaacatgaactctgacc

SEQ ID NO: 569550 - DNA, 25 bp, Mus musculus
gctgagatgaactacaagacccaag

SEQ ID NO: 569551 - DNA, 25 bp, Mus musculus
gctgagatgaacttgaactctgacc

SEQ ID NO: 569552 - DNA, 25 bp, Mus musculus
gctgagatgaccaacggcagagtga

SEQ ID NO: 569553 - DNA, 25 bp, Mus musculus
gctgagatgacctacggcagagtga

SEQ ID NO: 569554 - DNA, 25 bp, Mus musculus
gctgagatgcagactgaatgttcac

SEQ ID NO: 569555 - DNA, 25 bp, Mus musculus
gctgagatgcagtctgaatgttcac

SEQ ID NO: 569556 - DNA, 25 bp, Mus musculus
gctgagatgtctctcccagactaca

SEQ ID NO: 569557 - DNA, 25 bp, Mus musculus
gctgagatgtctgtcccagactaca

SEQ ID NO: 569558 - DNA, 25 bp, Mus musculus
gctgagattcatctggcattcccta

SEQ ID NO: 569559 - DNA, 25 bp, Mus musculus
gctgagattcatgtggcattcccta

SEQ ID NO: 569560 - DNA, 25 bp, Mus musculus
gctgagattggcaggttcttactct

SEQ ID NO: 569561 - DNA, 25 bp, Mus musculus
gctgagattggctggttcttactct

SEQ ID NO: 569562 - DNA, 25 bp, Mus musculus
gctgagatttctatccattccgaaa

SEQ ID NO: 569563 - DNA, 25 bp, Mus musculus
gctgagatttctttccattccgaaa

SEQ ID NO: 569564 - DNA, 25 bp, Mus musculus
gctgagatttttagtatgaatgtga

SEQ ID NO: 569565 - DNA, 25 bp, Mus musculus
gctgagattttttgtatgaatgtga

SEQ ID NO: 569566 - DNA, 25 bp, Mus musculus
gctgagcacagtattagacctggtt

SEQ ID NO: 569567 - DNA, 25 bp, Mus musculus
gctgagcacagttttagacctggtt

SEQ ID NO: 569568 - DNA, 25 bp, Mus musculus
gctgagcaccaaatcaacctgataa

SEQ ID NO: 569569 - DNA, 25 bp, Mus musculus
gctgagcaccaattcaacctgataa

SEQ ID NO: 569570 - DNA, 25 bp, Mus musculus
gctgagcacctaatataagcctggt

SEQ ID NO: 569571 - DNA, 25 bp, Mus musculus
gctgagcacctattataagcctggt

SEQ ID NO: 569572 - DNA, 25 bp, Mus musculus
gctgagcacctcaggatactgcata

SEQ ID NO: 569573 - DNA, 25 bp, Mus musculus
gctgagcacctctggatactgcata

SEQ ID NO: 569574 - DNA, 25 bp, Mus musculus
gctgagcaccttcttggctatggaa

SEQ ID NO: 569575 - DNA, 25 bp, Mus musculus
gctgagcaccttgttggctatggaa

SEQ ID NO: 569576 - DNA, 25 bp, Mus musculus
gctgagcactggagtttatctcttt

SEQ ID NO: 569577 - DNA, 25 bp, Mus musculus
gctgagcactggtgtttatctcttt

SEQ ID NO: 569578 - DNA, 25 bp, Mus musculus
gctgagcagacaagacggccttgat

SEQ ID NO: 569579 - DNA, 25 bp, Mus musculus
gctgagcagacatgacggccttgat

SEQ ID NO: 569580 - DNA, 25 bp, Mus musculus
gctgagcagactagagtcaaggtta

SEQ ID NO: 569581 - DNA, 25 bp, Mus musculus
gctgagcagactattgtataatatt

SEQ ID NO: 569582 - DNA, 25 bp, Mus musculus
gctgagcagacttgagtcaaggtta

SEQ ID NO: 569583 - DNA, 25 bp, Mus musculus
gctgagcagacttttgtataatatt

SEQ ID NO: 569584 - DNA, 25 bp, Mus musculus
gctgagcagccaccgctgttagcca

SEQ ID NO: 569585 - DNA, 25 bp, Mus musculus
gctgagcagccagcgctgttagcca

SEQ ID NO: 569586 - DNA, 25 bp, Mus musculus
gctgagcagggcactaaacccttaa

SEQ ID NO: 569587 - DNA, 25 bp, Mus musculus
gctgagcagggctctaaacccttaa

SEQ ID NO: 569588 - DNA, 25 bp, Mus musculus
gctgagcagtatcacactgtgctaa

SEQ ID NO: 569589 - DNA, 25 bp, Mus musculus
gctgagcagtatgacactgtgctaa

SEQ ID NO: 569590 - DNA, 25 bp, Mus musculus
gctgagcagtggatgaaggtaatca

SEQ ID NO: 569591 - DNA, 25 bp, Mus musculus
gctgagcagtggttgaaggtaatca

SEQ ID NO: 569592 - DNA, 25 bp, Mus musculus
gctgagcataacagactgatccttt

SEQ ID NO: 569593 - DNA, 25 bp, Mus musculus
gctgagcataactgactgatccttt

SEQ ID NO: 569594 - DNA, 25 bp, Mus musculus
gctgagcataagaaccatgaaggta

SEQ ID NO: 569595 - DNA, 25 bp, Mus musculus
gctgagcataagtaccatgaaggta

SEQ ID NO: 569596 - DNA, 25 bp, Mus musculus
gctgagcatactctacaggtcatgt

SEQ ID NO: 569597 - DNA, 25 bp, Mus musculus
gctgagcatactgtacaggtcatgt

SEQ ID NO: 569598 - DNA, 25 bp, Mus musculus
gctgagccaagacccgatggcagcc

SEQ ID NO: 569599 - DNA, 25 bp, Mus musculus
gctgagccaagagccgatggcagcc

SEQ ID NO: 569600 - DNA, 25 bp, Mus musculus
gctgagccagagaccaactgcagag

SEQ ID NO: 569601 - DNA, 25 bp, Mus musculus
gctgagccagagtccaactgcagag

SEQ ID NO: 569602 - DNA, 25 bp, Mus musculus
gctgagccaggccaatgtctcctga

SEQ ID NO: 569603 - DNA, 25 bp, Mus musculus
gctgagccaggcgaatgtctcctga

SEQ ID NO: 569604 - DNA, 25 bp, Mus musculus
gctgagccagtcattggaaagcggc

SEQ ID NO: 569605 - DNA, 25 bp, Mus musculus
gctgagccagtctttggaaagcggc

SEQ ID NO: 569606 - DNA, 25 bp, Mus musculus
gctgagccatgaacttcagtagaat

SEQ ID NO: 569607 - DNA, 25 bp, Mus musculus
gctgagccatgatcttcagtagaat

SEQ ID NO: 569608 - DNA, 25 bp, Mus musculus
gctgagccatgtcactagccattac

SEQ ID NO: 569609 - DNA, 25 bp, Mus musculus
gctgagccatgtgactagccattac

SEQ ID NO: 569610 - DNA, 25 bp, Mus musculus
gctgagcccagcaagatctgatagg

SEQ ID NO: 569611 - DNA, 25 bp, Mus musculus
gctgagcccagctagatctgatagg

SEQ ID NO: 569612 - DNA, 25 bp, Mus musculus
gctgagcccatcattttatatccat

SEQ ID NO: 569613 - DNA, 25 bp, Mus musculus
gctgagcccatctttttatatccat

SEQ ID NO: 569614 - DNA, 25 bp, Mus musculus
gctgagcccgggacctgcgatccat

SEQ ID NO: 569615 - DNA, 25 bp, Mus musculus
gctgagcccgggtcctgcgatccat

SEQ ID NO: 569616 - DNA, 25 bp, Mus musculus
gctgagcccttgcatgagagcataa

SEQ ID NO: 569617 - DNA, 25 bp, Mus musculus
gctgagcccttggatgagagcataa

SEQ ID NO: 569618 - DNA, 25 bp, Mus musculus
gctgagccctttcaagcctttgaga

SEQ ID NO: 569619 - DNA, 25 bp, Mus musculus
gctgagccctttgaagcctttgaga

SEQ ID NO: 569620 - DNA, 25 bp, Mus musculus
gctgagccggtccaccagtttttta

SEQ ID NO: 569621 - DNA, 25 bp, Mus musculus
gctgagccggtcgaccagtttttta

SEQ ID NO: 569622 - DNA, 25 bp, Mus musculus
gctgagccgtctctgtctttaaaag

SEQ ID NO: 569623 - DNA, 25 bp, Mus musculus
gctgagccgtctgtgtctttaaaag

SEQ ID NO: 569624 - DNA, 25 bp, Mus musculus
gctgagcctaatcacctgactttat

SEQ ID NO: 569625 - DNA, 25 bp, Mus musculus
gctgagcctaatgacctgactttat

SEQ ID NO: 569626 - DNA, 25 bp, Mus musculus
gctgagcctagacagattgtcctat

SEQ ID NO: 569627 - DNA, 25 bp, Mus musculus
gctgagcctagagagattgtcctat

SEQ ID NO: 569628 - DNA, 25 bp, Mus musculus
gctgagcctctcaggaagcccaggg

SEQ ID NO: 569629 - DNA, 25 bp, Mus musculus
gctgagcctctctggaagcccaggg

SEQ ID NO: 569630 - DNA, 25 bp, Mus musculus
gctgagcctgagagtactggtgcca

SEQ ID NO: 569631 - DNA, 25 bp, Mus musculus
gctgagcctgagtgtactggtgcca

SEQ ID NO: 569632 - DNA, 25 bp, Mus musculus
gctgagcctttgactcggcctgtgg

SEQ ID NO: 569633 - DNA, 25 bp, Mus musculus
gctgagcctttgtctcggcctgtgg

SEQ ID NO: 569634 - DNA, 25 bp, Mus musculus
gctgagcgcagccacatcatcgtgt

SEQ ID NO: 569635 - DNA, 25 bp, Mus musculus
gctgagcgcagcgacatcatcgtgt

SEQ ID NO: 569636 - DNA, 25 bp, Mus musculus
gctgagcgccatcacacggaagttc

SEQ ID NO: 569637 - DNA, 25 bp, Mus musculus
gctgagcgccatgacacggaagttc

SEQ ID NO: 569638 - DNA, 25 bp, Mus musculus
gctgagcgcttgagatatgccatca

SEQ ID NO: 569639 - DNA, 25 bp, Mus musculus
gctgagcgcttgtgatatgccatca

SEQ ID NO: 569640 - DNA, 25 bp, Mus musculus
gctgagcggcggcatgatggaggag

SEQ ID NO: 569641 - DNA, 25 bp, Mus musculus
gctgagcggcgggatgatggaggag

SEQ ID NO: 569642 - DNA, 25 bp, Mus musculus
gctgagcgtgcaaagccgccgtttg

SEQ ID NO: 569643 - DNA, 25 bp, Mus musculus
gctgagcgtgcatagccgccgtttg

SEQ ID NO: 569644 - DNA, 25 bp, Mus musculus
gctgagctaaatcagtcacacttga

SEQ ID NO: 569645 - DNA, 25 bp, Mus musculus
gctgagctaaatgagtcacacttga

SEQ ID NO: 569646 - DNA, 25 bp, Mus musculus
gctgagctaagtattcttcctgtga

SEQ ID NO: 569647 - DNA, 25 bp, Mus musculus
gctgagctaagttttcttcctgtga

SEQ ID NO: 569648 - DNA, 25 bp, Mus musculus
gctgagctagtgaacaatgcaccag

SEQ ID NO: 569649 - DNA, 25 bp, Mus musculus
gctgagctagtgtacaatgcaccag

SEQ ID NO: 569650 - DNA, 25 bp, Mus musculus
gctgagctatcgctctgttatacca

SEQ ID NO: 569651 - DNA, 25 bp, Mus musculus
gctgagctatcggtctgttatacca

SEQ ID NO: 569652 - DNA, 25 bp, Mus musculus
gctgagctatctctaaagcccttaa

SEQ ID NO: 569653 - DNA, 25 bp, Mus musculus
gctgagctatctgtaaagcccttaa

SEQ ID NO: 569654 - DNA, 25 bp, Mus musculus
gctgagctatgacctgtaccctgcc

SEQ ID NO: 569655 - DNA, 25 bp, Mus musculus
gctgagctatgagctgtaccctgcc

SEQ ID NO: 569656 - DNA, 25 bp, Mus musculus
gctgagctcggcatggaagcactga

SEQ ID NO: 569657 - DNA, 25 bp, Mus musculus
gctgagctcggcttggaagcactga

SEQ ID NO: 569658 - DNA, 25 bp, Mus musculus
gctgagctcggtagccaggacaaga

SEQ ID NO: 569659 - DNA, 25 bp, Mus musculus
gctgagctcggttgccaggacaaga

SEQ ID NO: 569660 - DNA, 25 bp, Mus musculus
gctgagctggcaccagaagacctat

SEQ ID NO: 569661 - DNA, 25 bp, Mus musculus
gctgagctggcagcagaagacctat

SEQ ID NO: 569662 - DNA, 25 bp, Mus musculus
gctgagctggctcctggcacaagaa

SEQ ID NO: 569663 - DNA, 25 bp, Mus musculus
gctgagctggctgctggcacaagaa

SEQ ID NO: 569664 - DNA, 25 bp, Mus musculus
gctgagctggtgcatgctcttcagt

SEQ ID NO: 569665 - DNA, 25 bp, Mus musculus
gctgagctggtggatgctcttcagt

SEQ ID NO: 569666 - DNA, 25 bp, Mus musculus
gctgagctgtataaactgtcttccc

SEQ ID NO: 569667 - DNA, 25 bp, Mus musculus
gctgagctgtattaactgtcttccc

SEQ ID NO: 569668 - DNA, 25 bp, Mus musculus
gctgagctgtccagggcaagcagaa

SEQ ID NO: 569669 - DNA, 25 bp, Mus musculus
gctgagctgtcctgggcaagcagaa

SEQ ID NO: 569670 - DNA, 25 bp, Mus musculus
gctgagcttctgaaagtccaggaat

SEQ ID NO: 569671 - DNA, 25 bp, Mus musculus
gctgagcttctgtaagtccaggaat

SEQ ID NO: 569672 - DNA, 25 bp, Mus musculus
gctgagctttagcatgggcttctaa

SEQ ID NO: 569673 - DNA, 25 bp, Mus musculus
gctgagctttaggatgggcttctaa

SEQ ID NO: 569674 - DNA, 25 bp, Mus musculus
gctgagctttcacagctgggttcaa

SEQ ID NO: 569675 - DNA, 25 bp, Mus musculus
gctgagctttcagagctgggttcaa

SEQ ID NO: 569676 - DNA, 25 bp, Mus musculus
gctgagcttttcctcagggagcttt

SEQ ID NO: 569677 - DNA, 25 bp, Mus musculus
gctgagcttttcgtcagggagcttt

SEQ ID NO: 569678 - DNA, 25 bp, Mus musculus
gctgaggaaactatgggctgcacga

SEQ ID NO: 569679 - DNA, 25 bp, Mus musculus
gctgaggaaactttgggctgcacga

SEQ ID NO: 569680 - DNA, 25 bp, Mus musculus
gctgaggacacacccaagcgcaacg

SEQ ID NO: 569681 - DNA, 25 bp, Mus musculus
gctgaggacacagccaagcgcaacg

SEQ ID NO: 569682 - DNA, 25 bp, Mus musculus
gctgaggacagccagtaaatacata

SEQ ID NO: 569683 - DNA, 25 bp, Mus musculus
gctgaggacagcgagtaaatacata

SEQ ID NO: 569684 - DNA, 25 bp, Mus musculus
gctgaggacattctgtatcccgagt

SEQ ID NO: 569685 - DNA, 25 bp, Mus musculus
gctgaggacattgtgtatcccgagt

SEQ ID NO: 569686 - DNA, 25 bp, Mus musculus
gctgaggaccaaaggacccaactta

SEQ ID NO: 569687 - DNA, 25 bp, Mus musculus
gctgaggaccaatggacccaactta

SEQ ID NO: 569688 - DNA, 25 bp, Mus musculus
gctgaggaccacatcaatcgcaaat

SEQ ID NO: 569689 - DNA, 25 bp, Mus musculus
gctgaggaccacttcaatcgcaaat

SEQ ID NO: 569690 - DNA, 25 bp, Mus musculus
gctgaggacctacccaagcattaaa

SEQ ID NO: 569691 - DNA, 25 bp, Mus musculus
gctgaggacctagccaagcattaaa

SEQ ID NO: 569692 - DNA, 25 bp, Mus musculus
gctgaggactcacggccttaattat

SEQ ID NO: 569693 - DNA, 25 bp, Mus musculus
gctgaggactcagggccttaattat

SEQ ID NO: 569694 - DNA, 25 bp, Mus musculus
gctgaggactgacggacagactttt

SEQ ID NO: 569695 - DNA, 25 bp, Mus musculus
gctgaggactgagggacagactttt

SEQ ID NO: 569696 - DNA, 25 bp, Mus musculus
gctgaggacttaccaggtgcctgcc

SEQ ID NO: 569697 - DNA, 25 bp, Mus musculus
gctgaggacttagcaggtgcctgcc

SEQ ID NO: 569698 - DNA, 25 bp, Mus musculus
gctgaggacttgagcattgctgcta

SEQ ID NO: 569699 - DNA, 25 bp, Mus musculus
gctgaggacttgtgcattgctgcta

SEQ ID NO: 569700 - DNA, 25 bp, Mus musculus
gctgaggactttatcagatcaattt

SEQ ID NO: 569701 - DNA, 25 bp, Mus musculus
gctgaggactttttcagatcaattt

SEQ ID NO: 569702 - DNA, 25 bp, Mus musculus
gctgaggaggttctatcatttgtaa

SEQ ID NO: 569703 - DNA, 25 bp, Mus musculus
gctgaggaggttgtatcatttgtaa

SEQ ID NO: 569704 - DNA, 25 bp, Mus musculus
gctgaggatacacgaatctgcttaa

SEQ ID NO: 569705 - DNA, 25 bp, Mus musculus
gctgaggatacaggaatctgcttaa

SEQ ID NO: 569706 - DNA, 25 bp, Mus musculus
gctgaggatcccattttagtgttat

SEQ ID NO: 569707 - DNA, 25 bp, Mus musculus
gctgaggatccctttttagtgttat

SEQ ID NO: 569708 - DNA, 25 bp, Mus musculus
gctgaggatcctacttcccagacga

SEQ ID NO: 569709 - DNA, 25 bp, Mus musculus
gctgaggatccttcttcccagacga

SEQ ID NO: 569710 - DNA, 25 bp, Mus musculus
gctgaggcagcaccaggacctctta

SEQ ID NO: 569711 - DNA, 25 bp, Mus musculus
gctgaggcagcagcaggacctctta

SEQ ID NO: 569712 - DNA, 25 bp, Mus musculus
gctgaggcagctctatctgagttca

SEQ ID NO: 569713 - DNA, 25 bp, Mus musculus
gctgaggcagctgtatctgagttca

SEQ ID NO: 569714 - DNA, 25 bp, Mus musculus
gctgaggcaggaatacctcaatttt

SEQ ID NO: 569715 - DNA, 25 bp, Mus musculus
gctgaggcaggattacctcaatttt

SEQ ID NO: 569716 - DNA, 25 bp, Mus musculus
gctgaggcaggcatcctgtaaggtt

SEQ ID NO: 569717 - DNA, 25 bp, Mus musculus
gctgaggcaggcttcctgtaaggtt

SEQ ID NO: 569718 - DNA, 25 bp, Mus musculus
gctgaggccaccagtgttgtgatgt

SEQ ID NO: 569719 - DNA, 25 bp, Mus musculus
gctgaggccacctgtgttgtgatgt

SEQ ID NO: 569720 - DNA, 25 bp, Mus musculus
gctgaggcccacatcttcaaaatta

SEQ ID NO: 569721 - DNA, 25 bp, Mus musculus
gctgaggcccacttcttcaaaatta

SEQ ID NO: 569722 - DNA, 25 bp, Mus musculus
gctgaggccctgatgactctgaaga

SEQ ID NO: 569723 - DNA, 25 bp, Mus musculus
gctgaggccctgttgactctgaaga

SEQ ID NO: 569724 - DNA, 25 bp, Mus musculus
gctgaggcctccattagacttctga

SEQ ID NO: 569725 - DNA, 25 bp, Mus musculus
gctgaggcctcctttagacttctga

SEQ ID NO: 569726 - DNA, 25 bp, Mus musculus
gctgaggcctgtccagtctgtagct

SEQ ID NO: 569727 - DNA, 25 bp, Mus musculus
gctgaggcctgtgcagtctgtagct

SEQ ID NO: 569728 - DNA, 25 bp, Mus musculus
gctgaggcgctcattaatgtatcaa

SEQ ID NO: 569729 - DNA, 25 bp, Mus musculus
gctgaggcgctctttaatgtatcaa

SEQ ID NO: 569730 - DNA, 25 bp, Mus musculus
gctgaggctagcaggtggccttctt

SEQ ID NO: 569731 - DNA, 25 bp, Mus musculus
gctgaggctagctggtggccttctt

SEQ ID NO: 569732 - DNA, 25 bp, Mus musculus
gctgaggctcaaacccaggccctta

SEQ ID NO: 569733 - DNA, 25 bp, Mus musculus
gctgaggctcaatcccaggccctta

SEQ ID NO: 569734 - DNA, 25 bp, Mus musculus
gctgaggctcccagtgctgtgaact

SEQ ID NO: 569735 - DNA, 25 bp, Mus musculus
gctgaggctccctgtgctgtgaact

SEQ ID NO: 569736 - DNA, 25 bp, Mus musculus
gctgaggctgagctagtgcctttac

SEQ ID NO: 569737 - DNA, 25 bp, Mus musculus
gctgaggctgaggtagtgcctttac

SEQ ID NO: 569738 - DNA, 25 bp, Mus musculus
gctgaggctgttcaacattccacat

SEQ ID NO: 569739 - DNA, 25 bp, Mus musculus
gctgaggctgttgaacattccacat

SEQ ID NO: 569740 - DNA, 25 bp, Mus musculus
gctgaggcttaacaattgctatcct

SEQ ID NO: 569741 - DNA, 25 bp, Mus musculus
gctgaggcttaagaattgctatcct

SEQ ID NO: 569742 - DNA, 25 bp, Mus musculus
gctgaggcttggaatagtgtagttt

SEQ ID NO: 569743 - DNA, 25 bp, Mus musculus
gctgaggcttggtatagtgtagttt

SEQ ID NO: 569744 - DNA, 25 bp, Mus musculus
gctgaggctttcatacacatcagtt

SEQ ID NO: 569745 - DNA, 25 bp, Mus musculus
gctgaggctttcttacacatcagtt

SEQ ID NO: 569746 - DNA, 25 bp, Mus musculus
gctgaggctttgatgcattcggctt

SEQ ID NO: 569747 - DNA, 25 bp, Mus musculus
gctgaggctttgttgcattcggctt

SEQ ID NO: 569748 - DNA, 25 bp, Mus musculus
gctgagggacccacttgactgggta

SEQ ID NO: 569749 - DNA, 25 bp, Mus musculus
gctgagggaccctcttgactgggta

SEQ ID NO: 569750 - DNA, 25 bp, Mus musculus
gctgagggcactctgttcactgaag

SEQ ID NO: 569751 - DNA, 25 bp, Mus musculus
gctgagggcactgtgttcactgaag

SEQ ID NO: 569752 - DNA, 25 bp, Mus musculus
gctgagggcagtaatgtttctccaa

SEQ ID NO: 569753 - DNA, 25 bp, Mus musculus
gctgagggcagttatgtttctccaa

SEQ ID NO: 569754 - DNA, 25 bp, Mus musculus
gctgagggccagactgtcttgaagt

SEQ ID NO: 569755 - DNA, 25 bp, Mus musculus
gctgagggccagtctgtcttgaagt

SEQ ID NO: 569756 - DNA, 25 bp, Mus musculus
gctgagggctccagatgctgcacag

SEQ ID NO: 569757 - DNA, 25 bp, Mus musculus
gctgagggctcctgatgctgcacag

SEQ ID NO: 569758 - DNA, 25 bp, Mus musculus
gctgagggtgagatctttatccatg

SEQ ID NO: 569759 - DNA, 25 bp, Mus musculus
gctgagggtgagttctttatccatg

SEQ ID NO: 569760 - DNA, 25 bp, Mus musculus
gctgagggtgataattctcgcccac

SEQ ID NO: 569761 - DNA, 25 bp, Mus musculus
gctgagggtgattattctcgcccac

SEQ ID NO: 569762 - DNA, 25 bp, Mus musculus
gctgagggttctagctgatcacact

SEQ ID NO: 569763 - DNA, 25 bp, Mus musculus
gctgagggttcttgctgatcacact

SEQ ID NO: 569764 - DNA, 25 bp, Mus musculus
gctgagggttgaatgcttgttaatt

SEQ ID NO: 569765 - DNA, 25 bp, Mus musculus
gctgagggttgattgcttgttaatt

SEQ ID NO: 569766 - DNA, 25 bp, Mus musculus
gctgaggtacttactgaaccctgga

SEQ ID NO: 569767 - DNA, 25 bp, Mus musculus
gctgaggtactttctgaaccctgga

SEQ ID NO: 569768 - DNA, 25 bp, Mus musculus
gctgaggtctctactggagagacac

SEQ ID NO: 569769 - DNA, 25 bp, Mus musculus
gctgaggtctcttctggagagacac

SEQ ID NO: 569770 - DNA, 25 bp, Mus musculus
gctgaggtgcttctgaggacctaat

SEQ ID NO: 569771 - DNA, 25 bp, Mus musculus
gctgaggtgcttgtgaggacctaat

SEQ ID NO: 569772 - DNA, 25 bp, Mus musculus
gctgaggtgggaagattcctagtta

SEQ ID NO: 569773 - DNA, 25 bp, Mus musculus
gctgaggtgggatgattcctagtta

SEQ ID NO: 569774 - DNA, 25 bp, Mus musculus
gctgaggtgggcaaagacagaataa

SEQ ID NO: 569775 - DNA, 25 bp, Mus musculus
gctgaggtgggctaagacagaataa

SEQ ID NO: 569776 - DNA, 25 bp, Mus musculus
gctgaggttaataccctggtgttgt

SEQ ID NO: 569777 - DNA, 25 bp, Mus musculus
gctgaggttaattccctggtgttgt

SEQ ID NO: 569778 - DNA, 25 bp, Mus musculus
gctgaggttacgcataggtgtccat

SEQ ID NO: 569779 - DNA, 25 bp, Mus musculus
gctgaggttacggataggtgtccat

SEQ ID NO: 569780 - DNA, 25 bp, Mus musculus
gctgaggttctgaagcttcacaaca

SEQ ID NO: 569781 - DNA, 25 bp, Mus musculus
gctgaggttctgtagcttcacaaca

SEQ ID NO: 569782 - DNA, 25 bp, Mus musculus
gctgaggtttccagtcgaacttaca

SEQ ID NO: 569783 - DNA, 25 bp, Mus musculus
gctgaggtttcctgtcgaacttaca

SEQ ID NO: 569784 - DNA, 25 bp, Mus musculus
gctgagtaaataaaaaatctgcctt

SEQ ID NO: 569785 - DNA, 25 bp, Mus musculus
gctgagtaaatataaaatctgcctt

SEQ ID NO: 569786 - DNA, 25 bp, Mus musculus
gctgagtaaatcaggatcagaggat

SEQ ID NO: 569787 - DNA, 25 bp, Mus musculus
gctgagtaaatctggatcagaggat

SEQ ID NO: 569788 - DNA, 25 bp, Mus musculus
gctgagtacctactgattgctgctg

SEQ ID NO: 569789 - DNA, 25 bp, Mus musculus
gctgagtacctagtgattgctgctg

SEQ ID NO: 569790 - DNA, 25 bp, Mus musculus
gctgagtatagcactagacacaaat

SEQ ID NO: 569791 - DNA, 25 bp, Mus musculus
gctgagtatagctctagacacaaat

SEQ ID NO: 569792 - DNA, 25 bp, Mus musculus
gctgagtatcatatttctgtcctgt

SEQ ID NO: 569793 - DNA, 25 bp, Mus musculus
gctgagtatcatttttctgtcctgt

SEQ ID NO: 569794 - DNA, 25 bp, Mus musculus
gctgagtattgcacctgatggctga

SEQ ID NO: 569795 - DNA, 25 bp, Mus musculus
gctgagtattgctcctgatggctga

SEQ ID NO: 569796 - DNA, 25 bp, Mus musculus
gctgagtcagtaaattgtttgcctg

SEQ ID NO: 569797 - DNA, 25 bp, Mus musculus
gctgagtcagtatattgtttgcctg

SEQ ID NO: 569798 - DNA, 25 bp, Mus musculus
gctgagtcctaaatcagctctgctc

SEQ ID NO: 569799 - DNA, 25 bp, Mus musculus
gctgagtcctaattcagctctgctc

SEQ ID NO: 569800 - DNA, 25 bp, Mus musculus
gctgagtctcggcatagtgtctccc

SEQ ID NO: 569801 - DNA, 25 bp, Mus musculus
gctgagtctcgggatagtgtctccc

SEQ ID NO: 569802 - DNA, 25 bp, Mus musculus
gctgagtctgatactaacttagcca

SEQ ID NO: 569803 - DNA, 25 bp, Mus musculus
gctgagtctgattctaacttagcca

SEQ ID NO: 569804 - DNA, 25 bp, Mus musculus
gctgagtctgccatgatccttctga

SEQ ID NO: 569805 - DNA, 25 bp, Mus musculus
gctgagtctgccttgatccttctga

SEQ ID NO: 569806 - DNA, 25 bp, Mus musculus
gctgagtctggcaaggagttcatta

SEQ ID NO: 569807 - DNA, 25 bp, Mus musculus
gctgagtctggctaggagttcatta

SEQ ID NO: 569808 - DNA, 25 bp, Mus musculus
gctgagtctggtctgaccctggtca

SEQ ID NO: 569809 - DNA, 25 bp, Mus musculus
gctgagtctggtgtgaccctggtca

SEQ ID NO: 569810 - DNA, 25 bp, Mus musculus
gctgagtgaagcagggcatcccctt

SEQ ID NO: 569811 - DNA, 25 bp, Mus musculus
gctgagtgaagctgggcatcccctt

SEQ ID NO: 569812 - DNA, 25 bp, Mus musculus
gctgagtgtataagaatttgctttc

SEQ ID NO: 569813 - DNA, 25 bp, Mus musculus
gctgagtgtatatgaatttgctttc

SEQ ID NO: 569814 - DNA, 25 bp, Mus musculus
gctgagtgtctaccacaatccttga

SEQ ID NO: 569815 - DNA, 25 bp, Mus musculus
gctgagtgtctagcacaatccttga

SEQ ID NO: 569816 - DNA, 25 bp, Mus musculus
gctgagtgtggacgatgtgctgaca

SEQ ID NO: 569817 - DNA, 25 bp, Mus musculus
gctgagtgtggaggatgtgctgaca

SEQ ID NO: 569818 - DNA, 25 bp, Mus musculus
gctgagttacagagattctttccat

SEQ ID NO: 569819 - DNA, 25 bp, Mus musculus
gctgagttacagtgattctttccat

SEQ ID NO: 569820 - DNA, 25 bp, Mus musculus
gctgagttcagcatctagtgaaata

SEQ ID NO: 569821 - DNA, 25 bp, Mus musculus
gctgagttcagcttctagtgaaata

SEQ ID NO: 569822 - DNA, 25 bp, Mus musculus
gctgagttcaggatagtggttgcca

SEQ ID NO: 569823 - DNA, 25 bp, Mus musculus
gctgagttcaggttagtggttgcca

SEQ ID NO: 569824 - DNA, 25 bp, Mus musculus
gctgagttccagctggcgcgcacta

SEQ ID NO: 569825 - DNA, 25 bp, Mus musculus
gctgagttccaggtggcgcgcacta

SEQ ID NO: 569826 - DNA, 25 bp, Mus musculus
gctgagttccgaataaagtatgttg

SEQ ID NO: 569827 - DNA, 25 bp, Mus musculus
gctgagttccgattaaagtatgttg

SEQ ID NO: 569828 - DNA, 25 bp, Mus musculus
gctgagttctacaagggtgcccctg

SEQ ID NO: 569829 - DNA, 25 bp, Mus musculus
gctgagttctactagggtgcccctg

SEQ ID NO: 569830 - DNA, 25 bp, Mus musculus
gctgagttctcacctaaaatgtcag

SEQ ID NO: 569831 - DNA, 25 bp, Mus musculus
gctgagttctcagctaaaatgtcag

SEQ ID NO: 569832 - DNA, 25 bp, Mus musculus
gctgagttctgccttttgcttaaga

SEQ ID NO: 569833 - DNA, 25 bp, Mus musculus
gctgagttctgcgttttgcttaaga

SEQ ID NO: 569834 - DNA, 25 bp, Mus musculus
gctgagttgctcatcattagccaat

SEQ ID NO: 569835 - DNA, 25 bp, Mus musculus
gctgagttgctcttcattagccaat

SEQ ID NO: 569836 - DNA, 25 bp, Mus musculus
gctgagttgtacagggaccctggac

SEQ ID NO: 569837 - DNA, 25 bp, Mus musculus
gctgagttgtactgggaccctggac

SEQ ID NO: 569838 - DNA, 25 bp, Mus musculus
gctgataaaactcctactaactcct

SEQ ID NO: 569839 - DNA, 25 bp, Mus musculus
gctgataaaactgctactaactcct

SEQ ID NO: 569840 - DNA, 25 bp, Mus musculus
gctgataaacgcaggtttcctccat

SEQ ID NO: 569841 - DNA, 25 bp, Mus musculus
gctgataaacgctggtttcctccat

SEQ ID NO: 569842 - DNA, 25 bp, Mus musculus
gctgataacgggattggccacaaaa

SEQ ID NO: 569843 - DNA, 25 bp, Mus musculus
gctgataacgggtttggccacaaaa

SEQ ID NO: 569844 - DNA, 25 bp, Mus musculus
gctgataagaacatacacgggtcgt

SEQ ID NO: 569845 - DNA, 25 bp, Mus musculus
gctgataagaacttacacgggtcgt

SEQ ID NO: 569846 - DNA, 25 bp, Mus musculus
gctgataagatcagaggtgttttta

SEQ ID NO: 569847 - DNA, 25 bp, Mus musculus
gctgataagatctgaggtgttttta

SEQ ID NO: 569848 - DNA, 25 bp, Mus musculus
gctgataagctgactccattactga

SEQ ID NO: 569849 - DNA, 25 bp, Mus musculus
gctgataagctgtctccattactga

SEQ ID NO: 569850 - DNA, 25 bp, Mus musculus
gctgataatcagattggaccatttt

SEQ ID NO: 569851 - DNA, 25 bp, Mus musculus
gctgataatcagtttggaccatttt

SEQ ID NO: 569852 - DNA, 25 bp, Mus musculus
gctgatacaatcaaactggaccggt

SEQ ID NO: 569853 - DNA, 25 bp, Mus musculus
gctgatacaatctaactggaccggt

SEQ ID NO: 569854 - DNA, 25 bp, Mus musculus
gctgataccaccatctgatcaagtg

SEQ ID NO: 569855 - DNA, 25 bp, Mus musculus
gctgataccaccttctgatcaagtg

SEQ ID NO: 569856 - DNA, 25 bp, Mus musculus
gctgataccagaagccatgggactt

SEQ ID NO: 569857 - DNA, 25 bp, Mus musculus
gctgataccagatgccatgggactt

SEQ ID NO: 569858 - DNA, 25 bp, Mus musculus
gctgatacctgaacaactgcgacat

SEQ ID NO: 569859 - DNA, 25 bp, Mus musculus
gctgatacctgatcaactgcgacat

SEQ ID NO: 569860 - DNA, 25 bp, Mus musculus
gctgatactgtgcatagcttctgta

SEQ ID NO: 569861 - DNA, 25 bp, Mus musculus
gctgatactgtggatagcttctgta

SEQ ID NO: 569862 - DNA, 25 bp, Mus musculus
gctgatagaaggatgttctggcaat

SEQ ID NO: 569863 - DNA, 25 bp, Mus musculus
gctgatagaaggttgttctggcaat

SEQ ID NO: 569864 - DNA, 25 bp, Mus musculus
gctgatagacgtcatcgtgaccgct

SEQ ID NO: 569865 - DNA, 25 bp, Mus musculus
gctgatagacgtgatcgtgaccgct

SEQ ID NO: 569866 - DNA, 25 bp, Mus musculus
gctgatagcatcacacagggaagta

SEQ ID NO: 569867 - DNA, 25 bp, Mus musculus
gctgatagcatctcacagggaagta

SEQ ID NO: 569868 - DNA, 25 bp, Mus musculus
gctgataggactcttgtttgcaata

SEQ ID NO: 569869 - DNA, 25 bp, Mus musculus
gctgataggactgttgtttgcaata

SEQ ID NO: 569870 - DNA, 25 bp, Mus musculus
gctgatagggcgattttatcatatt

SEQ ID NO: 569871 - DNA, 25 bp, Mus musculus
gctgatagggcgtttttatcatatt

SEQ ID NO: 569872 - DNA, 25 bp, Mus musculus
gctgatagtcccaaatctgctgtag

SEQ ID NO: 569873 - DNA, 25 bp, Mus musculus
gctgatagtccctaatctgctgtag

SEQ ID NO: 569874 - DNA, 25 bp, Mus musculus
gctgatagtgagatgcctggaacct

SEQ ID NO: 569875 - DNA, 25 bp, Mus musculus
gctgatagtgagttgcctggaacct

SEQ ID NO: 569876 - DNA, 25 bp, Mus musculus
gctgatagtgcaagctaactgccaa

SEQ ID NO: 569877 - DNA, 25 bp, Mus musculus
gctgatagtgcatgctaactgccaa

SEQ ID NO: 569878 - DNA, 25 bp, Mus musculus
gctgatatacctcgcggctatggga

SEQ ID NO: 569879 - DNA, 25 bp, Mus musculus
gctgatatacctggcggctatggga

SEQ ID NO: 569880 - DNA, 25 bp, Mus musculus
gctgatatccggataatgttctcga

SEQ ID NO: 569881 - DNA, 25 bp, Mus musculus
gctgatatccggttaatgttctcga

SEQ ID NO: 569882 - DNA, 25 bp, Mus musculus
gctgatatgaaaactggtcctggaa

SEQ ID NO: 569883 - DNA, 25 bp, Mus musculus
gctgatatgaaatctggtcctggaa

SEQ ID NO: 569884 - DNA, 25 bp, Mus musculus
gctgatatgagcagtttccatggtg

SEQ ID NO: 569885 - DNA, 25 bp, Mus musculus
gctgatatgagctgtttccatggtg

SEQ ID NO: 569886 - DNA, 25 bp, Mus musculus
gctgatatgtttaaggctcacccta

SEQ ID NO: 569887 - DNA, 25 bp, Mus musculus
gctgatatgttttaggctcacccta

SEQ ID NO: 569888 - DNA, 25 bp, Mus musculus
gctgatattcaaagtacctcctctc

SEQ ID NO: 569889 - DNA, 25 bp, Mus musculus
gctgatattcaatgtacctcctctc

SEQ ID NO: 569890 - DNA, 25 bp, Mus musculus
gctgatattccaaatcctgactggg

SEQ ID NO: 569891 - DNA, 25 bp, Mus musculus
gctgatattccatatcctgactggg

SEQ ID NO: 569892 - DNA, 25 bp, Mus musculus
gctgatattctacctgctgacatta

SEQ ID NO: 569893 - DNA, 25 bp, Mus musculus
gctgatattctagctgctgacatta

SEQ ID NO: 569894 - DNA, 25 bp, Mus musculus
gctgatatttgcacatgactttcct

SEQ ID NO: 569895 - DNA, 25 bp, Mus musculus
gctgatatttgctcatgactttcct

SEQ ID NO: 569896 - DNA, 25 bp, Mus musculus
gctgatcaaggcaacattaaactaa

SEQ ID NO: 569897 - DNA, 25 bp, Mus musculus
gctgatcaaggctacattaaactaa

SEQ ID NO: 569898 - DNA, 25 bp, Mus musculus
gctgatcacatgagagtcagaggac

SEQ ID NO: 569899 - DNA, 25 bp, Mus musculus
gctgatcacatgtgagtcagaggac

SEQ ID NO: 569900 - DNA, 25 bp, Mus musculus
gctgatcaccagctgcgatatgagc

SEQ ID NO: 569901 - DNA, 25 bp, Mus musculus
gctgatcaccagcttggccctgtct

SEQ ID NO: 569902 - DNA, 25 bp, Mus musculus
gctgatcaccaggtgcgatatgagc

SEQ ID NO: 569903 - DNA, 25 bp, Mus musculus
gctgatcaccaggttggccctgtct

SEQ ID NO: 569904 - DNA, 25 bp, Mus musculus
gctgatcaggaacatatgcttggca

SEQ ID NO: 569905 - DNA, 25 bp, Mus musculus
gctgatcaggaagatatgcttggca

SEQ ID NO: 569906 - DNA, 25 bp, Mus musculus
gctgatcaggagcaggcaacacctc

SEQ ID NO: 569907 - DNA, 25 bp, Mus musculus
gctgatcaggaggaggcaacacctc

SEQ ID NO: 569908 - DNA, 25 bp, Mus musculus
gctgatcatacacagccaatcacgc

SEQ ID NO: 569909 - DNA, 25 bp, Mus musculus
gctgatcatacagagccaatcacgc

SEQ ID NO: 569910 - DNA, 25 bp, Mus musculus
gctgatcatttacatagctgaagga

SEQ ID NO: 569911 - DNA, 25 bp, Mus musculus
gctgatcatttagatagctgaagga

SEQ ID NO: 569912 - DNA, 25 bp, Mus musculus
gctgatccatatcacccaacggaga

SEQ ID NO: 569913 - DNA, 25 bp, Mus musculus
gctgatccatatgacccaacggaga

SEQ ID NO: 569914 - DNA, 25 bp, Mus musculus
gctgatcccagtatgcttcatgaat

SEQ ID NO: 569915 - DNA, 25 bp, Mus musculus
gctgatcccagtttgcttcatgaat

SEQ ID NO: 569916 - DNA, 25 bp, Mus musculus
gctgatccgatcagagctcatgact

SEQ ID NO: 569917 - DNA, 25 bp, Mus musculus
gctgatccgatctgagctcatgact

SEQ ID NO: 569918 - DNA, 25 bp, Mus musculus
gctgatccgctgaatcgtggagtat

SEQ ID NO: 569919 - DNA, 25 bp, Mus musculus
gctgatccgctgtatcgtggagtat

SEQ ID NO: 569920 - DNA, 25 bp, Mus musculus
gctgatccgtctatgcatctatgat

SEQ ID NO: 569921 - DNA, 25 bp, Mus musculus
gctgatccgtctttgcatctatgat

SEQ ID NO: 569922 - DNA, 25 bp, Mus musculus
gctgatctaaggactatttttgttt

SEQ ID NO: 569923 - DNA, 25 bp, Mus musculus
gctgatctaaggtctatttttgttt

SEQ ID NO: 569924 - DNA, 25 bp, Mus musculus
gctgatctaatcattatcccagagt

SEQ ID NO: 569925 - DNA, 25 bp, Mus musculus
gctgatctaatctttatcccagagt

SEQ ID NO: 569926 - DNA, 25 bp, Mus musculus
gctgatctatttcctctgttaatgg

SEQ ID NO: 569927 - DNA, 25 bp, Mus musculus
gctgatctatttgctctgttaatgg

SEQ ID NO: 569928 - DNA, 25 bp, Mus musculus
gctgatctcaataactgactccctg

SEQ ID NO: 569929 - DNA, 25 bp, Mus musculus
gctgatctcaattactgactccctg

SEQ ID NO: 569930 - DNA, 25 bp, Mus musculus
gctgatctgagcatccaaaacatta

SEQ ID NO: 569931 - DNA, 25 bp, Mus musculus
gctgatctgagcttccaaaacatta

SEQ ID NO: 569932 - DNA, 25 bp, Mus musculus
gctgatctgatcaataccataagag

SEQ ID NO: 569933 - DNA, 25 bp, Mus musculus
gctgatctgatctataccataagag

SEQ ID NO: 569934 - DNA, 25 bp, Mus musculus
gctgatctgccgcttgctgcttttg

SEQ ID NO: 569935 - DNA, 25 bp, Mus musculus
gctgatctgccggttgctgcttttg

SEQ ID NO: 569936 - DNA, 25 bp, Mus musculus
gctgatctggatcctgaaggccttt

SEQ ID NO: 569937 - DNA, 25 bp, Mus musculus
gctgatctggatgctgaaggccttt

SEQ ID NO: 569938 - DNA, 25 bp, Mus musculus
gctgatctggtcagtcactgtggaa

SEQ ID NO: 569939 - DNA, 25 bp, Mus musculus
gctgatctggtctgtcactgtggaa

SEQ ID NO: 569940 - DNA, 25 bp, Mus musculus
gctgatcttcagactatcatcatta

SEQ ID NO: 569941 - DNA, 25 bp, Mus musculus
gctgatcttcagtctatcatcatta

SEQ ID NO: 569942 - DNA, 25 bp, Mus musculus
gctgatcttcataagctggaattat

SEQ ID NO: 569943 - DNA, 25 bp, Mus musculus
gctgatcttcattagctggaattat

SEQ ID NO: 569944 - DNA, 25 bp, Mus musculus
gctgatcttctgagcaaagtcttgc

SEQ ID NO: 569945 - DNA, 25 bp, Mus musculus
gctgatcttctgtgcaaagtcttgc

SEQ ID NO: 569946 - DNA, 25 bp, Mus musculus
gctgatcttgagctgttcactgagg

SEQ ID NO: 569947 - DNA, 25 bp, Mus musculus
gctgatcttgaggtgttcactgagg

SEQ ID NO: 569948 - DNA, 25 bp, Mus musculus
gctgatcttgcgctccaaaaatggc

SEQ ID NO: 569949 - DNA, 25 bp, Mus musculus
gctgatcttgcggtccaaaaatggc

SEQ ID NO: 569950 - DNA, 25 bp, Mus musculus
gctgatctttagacacattggtaat

SEQ ID NO: 569951 - DNA, 25 bp, Mus musculus
gctgatctttagtcacattggtaat

SEQ ID NO: 569952 - DNA, 25 bp, Mus musculus
gctgatcttttgaacatatggtttg

SEQ ID NO: 569953 - DNA, 25 bp, Mus musculus
gctgatcttttgtacatatggtttg

SEQ ID NO: 569954 - DNA, 25 bp, Mus musculus
gctgatgaaacactcaacctctgga

SEQ ID NO: 569955 - DNA, 25 bp, Mus musculus
gctgatgaaacagtcaacctctgga

SEQ ID NO: 569956 - DNA, 25 bp, Mus musculus
gctgatgaagatcccatcatgggtt

SEQ ID NO: 569957 - DNA, 25 bp, Mus musculus
gctgatgaagatgccatcatgggtt

SEQ ID NO: 569958 - DNA, 25 bp, Mus musculus
gctgatgaagcaagcctcccaggaa

SEQ ID NO: 569959 - DNA, 25 bp, Mus musculus
gctgatgaagcatgcctcccaggaa

SEQ ID NO: 569960 - DNA, 25 bp, Mus musculus
gctgatgaagccctgaagttgtcct

SEQ ID NO: 569961 - DNA, 25 bp, Mus musculus
gctgatgaagccgtgaagttgtcct

SEQ ID NO: 569962 - DNA, 25 bp, Mus musculus
gctgatgacatcacaagcttagtag

SEQ ID NO: 569963 - DNA, 25 bp, Mus musculus
gctgatgacatctcaagcttagtag

SEQ ID NO: 569964 - DNA, 25 bp, Mus musculus
gctgatgacgatagctcccaatcgc

SEQ ID NO: 569965 - DNA, 25 bp, Mus musculus
gctgatgacgattgctcccaatcgc

SEQ ID NO: 569966 - DNA, 25 bp, Mus musculus
gctgatgatctgcagagctgtacct

SEQ ID NO: 569967 - DNA, 25 bp, Mus musculus
gctgatgatctggagagctgtacct

SEQ ID NO: 569968 - DNA, 25 bp, Mus musculus
gctgatgatgtgatttgccgtgaac

SEQ ID NO: 569969 - DNA, 25 bp, Mus musculus
gctgatgatgtgttttgccgtgaac

SEQ ID NO: 569970 - DNA, 25 bp, Mus musculus
gctgatgcactgataggcgtctacc

SEQ ID NO: 569971 - DNA, 25 bp, Mus musculus
gctgatgcactgttaggcgtctacc

SEQ ID NO: 569972 - DNA, 25 bp, Mus musculus
gctgatgcagaaagcccatcacttt

SEQ ID NO: 569973 - DNA, 25 bp, Mus musculus
gctgatgcagaatgcccatcacttt

SEQ ID NO: 569974 - DNA, 25 bp, Mus musculus
gctgatgcagctactcgttctcggc

SEQ ID NO: 569975 - DNA, 25 bp, Mus musculus
gctgatgcagcttctcgttctcggc

SEQ ID NO: 569976 - DNA, 25 bp, Mus musculus
gctgatgcaggtccgtggactgagt

SEQ ID NO: 569977 - DNA, 25 bp, Mus musculus
gctgatgcaggtgcgtggactgagt

SEQ ID NO: 569978 - DNA, 25 bp, Mus musculus
gctgatgcatcacgctgcactgctg

SEQ ID NO: 569979 - DNA, 25 bp, Mus musculus
gctgatgcatcaggctgcactgctg

SEQ ID NO: 569980 - DNA, 25 bp, Mus musculus
gctgatgccagtccagagaagcact

SEQ ID NO: 569981 - DNA, 25 bp, Mus musculus
gctgatgccagtgcagagaagcact

SEQ ID NO: 569982 - DNA, 25 bp, Mus musculus
gctgatgcccagagtataagaccct

SEQ ID NO: 569983 - DNA, 25 bp, Mus musculus
gctgatgcccagtgtataagaccct

SEQ ID NO: 569984 - DNA, 25 bp, Mus musculus
gctgatgcctagatgagcccctgta

SEQ ID NO: 569985 - DNA, 25 bp, Mus musculus
gctgatgcctagttgagcccctgta

SEQ ID NO: 569986 - DNA, 25 bp, Mus musculus
gctgatgcctgaccatggagaaagt

SEQ ID NO: 569987 - DNA, 25 bp, Mus musculus
gctgatgcctgagcatggagaaagt

SEQ ID NO: 569988 - DNA, 25 bp, Mus musculus
gctgatgcgcacatgtgatcccagt

SEQ ID NO: 569989 - DNA, 25 bp, Mus musculus
gctgatgcgcacttgtgatcccagt

SEQ ID NO: 569990 - DNA, 25 bp, Mus musculus
gctgatgctaatacacgtggtgttt

SEQ ID NO: 569991 - DNA, 25 bp, Mus musculus
gctgatgctaattcacgtggtgttt

SEQ ID NO: 569992 - DNA, 25 bp, Mus musculus
gctgatgctactactgcagtcttta

SEQ ID NO: 569993 - DNA, 25 bp, Mus musculus
gctgatgctacttctgcagtcttta

SEQ ID NO: 569994 - DNA, 25 bp, Mus musculus
gctgatgctcttaccgtggaaacta

SEQ ID NO: 569995 - DNA, 25 bp, Mus musculus
gctgatgctctttccgtggaaacta

SEQ ID NO: 569996 - DNA, 25 bp, Mus musculus
gctgatggatggctagcatgttaat

SEQ ID NO: 569997 - DNA, 25 bp, Mus musculus
gctgatggatgggtagcatgttaat

SEQ ID NO: 569998 - DNA, 25 bp, Mus musculus
gctgatggccctaatgtgtttgaaa

SEQ ID NO: 569999 - DNA, 25 bp, Mus musculus
gctgatggcccttatgtgtttgaaa

SEQ ID NO: 570000 - DNA, 25 bp, Mus musculus
gctgatggccggcaggaaccattca

SEQ ID NO: 570001 - DNA, 25 bp, Mus musculus
gctgatggccgggaggaaccattca

SEQ ID NO: 570002 - DNA, 25 bp, Mus musculus
gctgatggcgccaacagaggagaat

SEQ ID NO: 570003 - DNA, 25 bp, Mus musculus
gctgatggcgcctacagaggagaat

SEQ ID NO: 570004 - DNA, 25 bp, Mus musculus
gctgatggctacaaactggatccag

SEQ ID NO: 570005 - DNA, 25 bp, Mus musculus
gctgatggctactaactggatccag

SEQ ID NO: 570006 - DNA, 25 bp, Mus musculus
gctgatggctcactaatttgcacaa

SEQ ID NO: 570007 - DNA, 25 bp, Mus musculus
gctgatggctcagtaatttgcacaa

SEQ ID NO: 570008 - DNA, 25 bp, Mus musculus
gctgatgggcctatctatgatatat

SEQ ID NO: 570009 - DNA, 25 bp, Mus musculus
gctgatgggcctttctatgatatat

SEQ ID NO: 570010 - DNA, 25 bp, Mus musculus
gctgatgggtgtacagggcccttcc

SEQ ID NO: 570011 - DNA, 25 bp, Mus musculus
gctgatgggtgttcagggcccttcc

SEQ ID NO: 570012 - DNA, 25 bp, Mus musculus
gctgatgggtttctctgccttgccc

SEQ ID NO: 570013 - DNA, 25 bp, Mus musculus
gctgatgggtttgtctgccttgccc

SEQ ID NO: 570014 - DNA, 25 bp, Mus musculus
gctgatggtaacaagcatttcctta

SEQ ID NO: 570015 - DNA, 25 bp, Mus musculus
gctgatggtaactagcatttcctta

SEQ ID NO: 570016 - DNA, 25 bp, Mus musculus
gctgatggtctacggtggcatttca

SEQ ID NO: 570017 - DNA, 25 bp, Mus musculus
gctgatggtctagggtggcatttca

SEQ ID NO: 570018 - DNA, 25 bp, Mus musculus
gctgatggtctcagattaatcgcat

SEQ ID NO: 570019 - DNA, 25 bp, Mus musculus
gctgatggtctctgattaatcgcat

SEQ ID NO: 570020 - DNA, 25 bp, Mus musculus
gctgatggtgacagtgtacagctgt

SEQ ID NO: 570021 - DNA, 25 bp, Mus musculus
gctgatggtgactgtgtacagctgt

SEQ ID NO: 570022 - DNA, 25 bp, Mus musculus
gctgatggtgagacgatcaggactt

SEQ ID NO: 570023 - DNA, 25 bp, Mus musculus
gctgatggtgagtcgatcaggactt

SEQ ID NO: 570024 - DNA, 25 bp, Mus musculus
gctgatggtgcaatgacctttcaat

SEQ ID NO: 570025 - DNA, 25 bp, Mus musculus
gctgatggtgcattgacctttcaat

SEQ ID NO: 570026 - DNA, 25 bp, Mus musculus
gctgatggttacatttgcacttgaa

SEQ ID NO: 570027 - DNA, 25 bp, Mus musculus
gctgatggttacttttgcacttgaa

SEQ ID NO: 570028 - DNA, 25 bp, Mus musculus
gctgatgtacagaacttgtttccta

SEQ ID NO: 570029 - DNA, 25 bp, Mus musculus
gctgatgtacagtacttgtttccta

SEQ ID NO: 570030 - DNA, 25 bp, Mus musculus
gctgatgtactcaactgacttccat

SEQ ID NO: 570031 - DNA, 25 bp, Mus musculus
gctgatgtactctactgacttccat

SEQ ID NO: 570032 - DNA, 25 bp, Mus musculus
gctgatgtagaaacatttcctgata

SEQ ID NO: 570033 - DNA, 25 bp, Mus musculus
gctgatgtagaatcatttcctgata

SEQ ID NO: 570034 - DNA, 25 bp, Mus musculus
gctgatgtagctcttttttctatac

SEQ ID NO: 570035 - DNA, 25 bp, Mus musculus
gctgatgtagctgttttttctatac

SEQ ID NO: 570036 - DNA, 25 bp, Mus musculus
gctgatgtatagaccttgaatgcca

SEQ ID NO: 570037 - DNA, 25 bp, Mus musculus
gctgatgtatagtccttgaatgcca

SEQ ID NO: 570038 - DNA, 25 bp, Mus musculus
gctgatgtatttagtgaatggccta

SEQ ID NO: 570039 - DNA, 25 bp, Mus musculus
gctgatgtattttgtgaatggccta

SEQ ID NO: 570040 - DNA, 25 bp, Mus musculus
gctgatgtcaatcttgttccaacag

SEQ ID NO: 570041 - DNA, 25 bp, Mus musculus
gctgatgtcaatgttgttccaacag

SEQ ID NO: 570042 - DNA, 25 bp, Mus musculus
gctgatgtcatgcactacatacagc

SEQ ID NO: 570043 - DNA, 25 bp, Mus musculus
gctgatgtcatggactacatacagc

SEQ ID NO: 570044 - DNA, 25 bp, Mus musculus
gctgatgtccagatacacgcatggg

SEQ ID NO: 570045 - DNA, 25 bp, Mus musculus
gctgatgtccagttacacgcatggg

SEQ ID NO: 570046 - DNA, 25 bp, Mus musculus
gctgatgttagcagccccaaggctg

SEQ ID NO: 570047 - DNA, 25 bp, Mus musculus
gctgatgttagctgccccaaggctg

SEQ ID NO: 570048 - DNA, 25 bp, Mus musculus
gctgatgttattccagtcttttgaa

SEQ ID NO: 570049 - DNA, 25 bp, Mus musculus
gctgatgttattgcagtcttttgaa

SEQ ID NO: 570050 - DNA, 25 bp, Mus musculus
gctgatgtttgcactgcccacgtga

SEQ ID NO: 570051 - DNA, 25 bp, Mus musculus
gctgatgtttgctctgcccacgtga

SEQ ID NO: 570052 - DNA, 25 bp, Mus musculus
gctgatgtttgtcgcctgcagttga

SEQ ID NO: 570053 - DNA, 25 bp, Mus musculus
gctgatgtttgtggcctgcagttga

SEQ ID NO: 570054 - DNA, 25 bp, Mus musculus
gctgatgttttactacgactgagaa

SEQ ID NO: 570055 - DNA, 25 bp, Mus musculus
gctgatgttttagtacgactgagaa

SEQ ID NO: 570056 - DNA, 25 bp, Mus musculus
gctgattaagctctactgtacgtga

SEQ ID NO: 570057 - DNA, 25 bp, Mus musculus
gctgattaagctgtactgtacgtga

SEQ ID NO: 570058 - DNA, 25 bp, Mus musculus
gctgattacctcaacgccaagatta

SEQ ID NO: 570059 - DNA, 25 bp, Mus musculus
gctgattacctctacgccaagatta

SEQ ID NO: 570060 - DNA, 25 bp, Mus musculus
gctgattactgtcctctaggagcta

SEQ ID NO: 570061 - DNA, 25 bp, Mus musculus
gctgattactgtgctctaggagcta

SEQ ID NO: 570062 - DNA, 25 bp, Mus musculus
gctgattagacaaacatggctgcaa

SEQ ID NO: 570063 - DNA, 25 bp, Mus musculus
gctgattagacatacatggctgcaa

SEQ ID NO: 570064 - DNA, 25 bp, Mus musculus
gctgattagttgatcttaaactttt

SEQ ID NO: 570065 - DNA, 25 bp, Mus musculus
gctgattagttgttcttaaactttt

SEQ ID NO: 570066 - DNA, 25 bp, Mus musculus
gctgattattttagccttacctaag

SEQ ID NO: 570067 - DNA, 25 bp, Mus musculus
gctgattatttttgccttacctaag

SEQ ID NO: 570068 - DNA, 25 bp, Mus musculus
gctgattcacagaaaaggctgggcc

SEQ ID NO: 570069 - DNA, 25 bp, Mus musculus
gctgattcacagtaaaggctgggcc

SEQ ID NO: 570070 - DNA, 25 bp, Mus musculus
gctgattcaccacaatattggaggg

SEQ ID NO: 570071 - DNA, 25 bp, Mus musculus
gctgattcaccagaatattggaggg

SEQ ID NO: 570072 - DNA, 25 bp, Mus musculus
gctgattcatctaagggctgttaat

SEQ ID NO: 570073 - DNA, 25 bp, Mus musculus
gctgattcatcttagggctgttaat

SEQ ID NO: 570074 - DNA, 25 bp, Mus musculus
gctgattccaagcttaaatcatgga

SEQ ID NO: 570075 - DNA, 25 bp, Mus musculus
gctgattccaaggttaaatcatgga

SEQ ID NO: 570076 - DNA, 25 bp, Mus musculus
gctgattccagcacagagtgtttct

SEQ ID NO: 570077 - DNA, 25 bp, Mus musculus
gctgattccagctcagagtgtttct

SEQ ID NO: 570078 - DNA, 25 bp, Mus musculus
gctgattcccacaagacatacttaa

SEQ ID NO: 570079 - DNA, 25 bp, Mus musculus
gctgattcccactagacatacttaa

SEQ ID NO: 570080 - DNA, 25 bp, Mus musculus
gctgattcccggcttggagaccctg

SEQ ID NO: 570081 - DNA, 25 bp, Mus musculus
gctgattcccgggttggagaccctg

SEQ ID NO: 570082 - DNA, 25 bp, Mus musculus
gctgattctactatgtatctattac

SEQ ID NO: 570083 - DNA, 25 bp, Mus musculus
gctgattctactttgtatctattac

SEQ ID NO: 570084 - DNA, 25 bp, Mus musculus
gctgattctattcctattagccctt

SEQ ID NO: 570085 - DNA, 25 bp, Mus musculus
gctgattctattgctattagccctt

SEQ ID NO: 570086 - DNA, 25 bp, Mus musculus
gctgattctcagatgttttcctctg

SEQ ID NO: 570087 - DNA, 25 bp, Mus musculus
gctgattctcagttgttttcctctg

SEQ ID NO: 570088 - DNA, 25 bp, Mus musculus
gctgattctcttcggtccacataat

SEQ ID NO: 570089 - DNA, 25 bp, Mus musculus
gctgattctcttgggtccacataat

SEQ ID NO: 570090 - DNA, 25 bp, Mus musculus
gctgattctgagagccagaggccag

SEQ ID NO: 570091 - DNA, 25 bp, Mus musculus
gctgattctgagtgccagaggccag

SEQ ID NO: 570092 - DNA, 25 bp, Mus musculus
gctgattctgtgagtgggcccgtca

SEQ ID NO: 570093 - DNA, 25 bp, Mus musculus
gctgattctgtgtgtgggcccgtca

SEQ ID NO: 570094 - DNA, 25 bp, Mus musculus
gctgattctgttcaaacgcaccatt

SEQ ID NO: 570095 - DNA, 25 bp, Mus musculus
gctgattctgttgaaacgcaccatt

SEQ ID NO: 570096 - DNA, 25 bp, Mus musculus
gctgattcttagagccatgggcctt

SEQ ID NO: 570097 - DNA, 25 bp, Mus musculus
gctgattcttagtgccatgggcctt

SEQ ID NO: 570098 - DNA, 25 bp, Mus musculus
gctgattcttggcatctaccctaga

SEQ ID NO: 570099 - DNA, 25 bp, Mus musculus
gctgattcttgggatctaccctaga

SEQ ID NO: 570100 - DNA, 25 bp, Mus musculus
gctgattcttgtcagctcaactgtt

SEQ ID NO: 570101 - DNA, 25 bp, Mus musculus
gctgattcttgtgagctcaactgtt

SEQ ID NO: 570102 - DNA, 25 bp, Mus musculus
gctgattgaaggaacacaccgcctc

SEQ ID NO: 570103 - DNA, 25 bp, Mus musculus
gctgattgaaggtacacaccgcctc

SEQ ID NO: 570104 - DNA, 25 bp, Mus musculus
gctgattgaccaaggcagactccag

SEQ ID NO: 570105 - DNA, 25 bp, Mus musculus
gctgattgaccatggcagactccag

SEQ ID NO: 570106 - DNA, 25 bp, Mus musculus
gctgattggcaaattcatggaaact

SEQ ID NO: 570107 - DNA, 25 bp, Mus musculus
gctgattggcaatttcatggaaact

SEQ ID NO: 570108 - DNA, 25 bp, Mus musculus
gctgattggcttcagtgtagcccaa

SEQ ID NO: 570109 - DNA, 25 bp, Mus musculus
gctgattggcttgagtgtagcccaa

SEQ ID NO: 570110 - DNA, 25 bp, Mus musculus
gctgattggtttaggtttgccacat

SEQ ID NO: 570111 - DNA, 25 bp, Mus musculus
gctgattggttttggtttgccacat

SEQ ID NO: 570112 - DNA, 25 bp, Mus musculus
gctgattgtaacattggaggactct

SEQ ID NO: 570113 - DNA, 25 bp, Mus musculus
gctgattgtaactttggaggactct

SEQ ID NO: 570114 - DNA, 25 bp, Mus musculus
gctgattgtcttcgtttaaattata

SEQ ID NO: 570115 - DNA, 25 bp, Mus musculus
gctgattgtcttggtttaaattata

SEQ ID NO: 570116 - DNA, 25 bp, Mus musculus
gctgattgttcccaagttctctgaa

SEQ ID NO: 570117 - DNA, 25 bp, Mus musculus
gctgattgttccgaagttctctgaa

SEQ ID NO: 570118 - DNA, 25 bp, Mus musculus
gctgatttaaagaatgctgtcccaa

SEQ ID NO: 570119 - DNA, 25 bp, Mus musculus
gctgatttaaagtatgctgtcccaa

SEQ ID NO: 570120 - DNA, 25 bp, Mus musculus
gctgatttaatacgagtctcgtgtt

SEQ ID NO: 570121 - DNA, 25 bp, Mus musculus
gctgatttaataggagtctcgtgtt

SEQ ID NO: 570122 - DNA, 25 bp, Mus musculus
gctgatttatatctcatacgatgtt

SEQ ID NO: 570123 - DNA, 25 bp, Mus musculus
gctgatttatatgtcatacgatgtt

SEQ ID NO: 570124 - DNA, 25 bp, Mus musculus
gctgatttcagcagggaacttcata

SEQ ID NO: 570125 - DNA, 25 bp, Mus musculus
gctgatttcagctgggaacttcata

SEQ ID NO: 570126 - DNA, 25 bp, Mus musculus
gctgatttcagtcctgtctttcata

SEQ ID NO: 570127 - DNA, 25 bp, Mus musculus
gctgatttcagtgctgtctttcata

SEQ ID NO: 570128 - DNA, 25 bp, Mus musculus
gctgatttccagagtgtgccaagaa

SEQ ID NO: 570129 - DNA, 25 bp, Mus musculus
gctgatttccagtgtgtgccaagaa

SEQ ID NO: 570130 - DNA, 25 bp, Mus musculus
gctgatttccttcgcatttacttaa

SEQ ID NO: 570131 - DNA, 25 bp, Mus musculus
gctgatttccttggcatttacttaa

SEQ ID NO: 570132 - DNA, 25 bp, Mus musculus
gctgatttctgtctggtttggtgcc

SEQ ID NO: 570133 - DNA, 25 bp, Mus musculus
gctgatttctgtgtggtttggtgcc

SEQ ID NO: 570134 - DNA, 25 bp, Mus musculus
gctgatttgaagaacctctttggca

SEQ ID NO: 570135 - DNA, 25 bp, Mus musculus
gctgatttgaagtacctctttggca

SEQ ID NO: 570136 - DNA, 25 bp, Mus musculus
gctgatttggctcttcccaatgttt

SEQ ID NO: 570137 - DNA, 25 bp, Mus musculus
gctgatttggctctttgcaaccaat

SEQ ID NO: 570138 - DNA, 25 bp, Mus musculus
gctgatttggctgttcccaatgttt

SEQ ID NO: 570139 - DNA, 25 bp, Mus musculus
gctgatttggctgtttgcaaccaat

SEQ ID NO: 570140 - DNA, 25 bp, Mus musculus
gctgatttgtgaccatgctttctga

SEQ ID NO: 570141 - DNA, 25 bp, Mus musculus
gctgatttgtgagcatgctttctga

SEQ ID NO: 570142 - DNA, 25 bp, Mus musculus
gctgatttgtgtatggaattacccc

SEQ ID NO: 570143 - DNA, 25 bp, Mus musculus
gctgatttgtgtttggaattacccc

SEQ ID NO: 570144 - DNA, 25 bp, Mus musculus
gctgattttaatatcaaggacaata

SEQ ID NO: 570145 - DNA, 25 bp, Mus musculus
gctgattttaatttcaaggacaata

SEQ ID NO: 570146 - DNA, 25 bp, Mus musculus
gctgattttatcaaggcatttgctt

SEQ ID NO: 570147 - DNA, 25 bp, Mus musculus
gctgattttatctaggcatttgctt

SEQ ID NO: 570148 - DNA, 25 bp, Mus musculus
gctgattttctgagactggcatatt

SEQ ID NO: 570149 - DNA, 25 bp, Mus musculus
gctgattttctgtgactggcatatt

SEQ ID NO: 570150 - DNA, 25 bp, Mus musculus
gctgcaaaagctatccacaatagat

SEQ ID NO: 570151 - DNA, 25 bp, Mus musculus
gctgcaaaagctttccacaatagat

SEQ ID NO: 570152 - DNA, 25 bp, Mus musculus
gctgcaaaccccaagaccaggtagt

SEQ ID NO: 570153 - DNA, 25 bp, Mus musculus
gctgcaaacccctagaccaggtagt

SEQ ID NO: 570154 - DNA, 25 bp, Mus musculus
gctgcaaacctgcatggtggtgtcc

SEQ ID NO: 570155 - DNA, 25 bp, Mus musculus
gctgcaaacctggatggtggtgtcc

SEQ ID NO: 570156 - DNA, 25 bp, Mus musculus
gctgcaaaggaaactgcttctccat

SEQ ID NO: 570157 - DNA, 25 bp, Mus musculus
gctgcaaaggaatctgcttctccat

SEQ ID NO: 570158 - DNA, 25 bp, Mus musculus
gctgcaaaggctcctgagcctgatg

SEQ ID NO: 570159 - DNA, 25 bp, Mus musculus
gctgcaaaggctgctgagcctgatg

SEQ ID NO: 570160 - DNA, 25 bp, Mus musculus
gctgcaaagggtatctcactatctg

SEQ ID NO: 570161 - DNA, 25 bp, Mus musculus
gctgcaaagggtttctcactatctg

SEQ ID NO: 570162 - DNA, 25 bp, Mus musculus
gctgcaaatcacagtactgtccatg

SEQ ID NO: 570163 - DNA, 25 bp, Mus musculus
gctgcaaatcactgtactgtccatg

SEQ ID NO: 570164 - DNA, 25 bp, Mus musculus
gctgcaaccagaagcatgcttccta

SEQ ID NO: 570165 - DNA, 25 bp, Mus musculus
gctgcaaccagatgcatgcttccta

SEQ ID NO: 570166 - DNA, 25 bp, Mus musculus
gctgcaaccagcacgacagatgcta

SEQ ID NO: 570167 - DNA, 25 bp, Mus musculus
gctgcaaccagctcgacagatgcta

SEQ ID NO: 570168 - DNA, 25 bp, Mus musculus
gctgcaacctggctataaatattat

SEQ ID NO: 570169 - DNA, 25 bp, Mus musculus
gctgcaacctgggtataaatattat

SEQ ID NO: 570170 - DNA, 25 bp, Mus musculus
gctgcaacgtcactccatgtgaaaa

SEQ ID NO: 570171 - DNA, 25 bp, Mus musculus
gctgcaacgtcagtccatgtgaaaa

SEQ ID NO: 570172 - DNA, 25 bp, Mus musculus
gctgcaactctaataatacacattt

SEQ ID NO: 570173 - DNA, 25 bp, Mus musculus
gctgcaactctattaatacacattt

SEQ ID NO: 570174 - DNA, 25 bp, Mus musculus
gctgcaactgcaacacttttatgga

SEQ ID NO: 570175 - DNA, 25 bp, Mus musculus
gctgcaactgcatcacttttatgga

SEQ ID NO: 570176 - DNA, 25 bp, Mus musculus
gctgcaactgcgcagcacacgtaaa

SEQ ID NO: 570177 - DNA, 25 bp, Mus musculus
gctgcaactgcggagcacacgtaaa

SEQ ID NO: 570178 - DNA, 25 bp, Mus musculus
gctgcaactggccaggtacgagctt

SEQ ID NO: 570179 - DNA, 25 bp, Mus musculus
gctgcaactggcgaggtacgagctt

SEQ ID NO: 570180 - DNA, 25 bp, Mus musculus
gctgcaactgtaccaaggcccagca

SEQ ID NO: 570181 - DNA, 25 bp, Mus musculus
gctgcaactgtagcaaggcccagca

SEQ ID NO: 570182 - DNA, 25 bp, Mus musculus
gctgcaacttaaagtacttcacctg

SEQ ID NO: 570183 - DNA, 25 bp, Mus musculus
gctgcaacttaatgtacttcacctg

SEQ ID NO: 570184 - DNA, 25 bp, Mus musculus
gctgcaagaagaccttcgcgctcaa

SEQ ID NO: 570185 - DNA, 25 bp, Mus musculus
gctgcaagaagagcttcgcgctcaa

SEQ ID NO: 570186 - DNA, 25 bp, Mus musculus
gctgcaagacctatgtgcgctccga

SEQ ID NO: 570187 - DNA, 25 bp, Mus musculus
gctgcaagacctctgtgttcagtgt

SEQ ID NO: 570188 - DNA, 25 bp, Mus musculus
gctgcaagacctgtgtgttcagtgt

SEQ ID NO: 570189 - DNA, 25 bp, Mus musculus
gctgcaagacctttgtgcgctccga

SEQ ID NO: 570190 - DNA, 25 bp, Mus musculus
gctgcaagatttcgacgtcgcctta

SEQ ID NO: 570191 - DNA, 25 bp, Mus musculus
gctgcaagatttggacgtcgcctta

SEQ ID NO: 570192 - DNA, 25 bp, Mus musculus
gctgcaagccacctgatgaaatcct

SEQ ID NO: 570193 - DNA, 25 bp, Mus musculus
gctgcaagccacgtgatgaaatcct

SEQ ID NO: 570194 - DNA, 25 bp, Mus musculus
gctgcaagccatccatggctgcata

SEQ ID NO: 570195 - DNA, 25 bp, Mus musculus
gctgcaagccatgcatggctgcata

SEQ ID NO: 570196 - DNA, 25 bp, Mus musculus
gctgcaaggacgctgttgagatact

SEQ ID NO: 570197 - DNA, 25 bp, Mus musculus
gctgcaaggacggtgttgagatact

SEQ ID NO: 570198 - DNA, 25 bp, Mus musculus
gctgcaagggagactgtcccctgtg

SEQ ID NO: 570199 - DNA, 25 bp, Mus musculus
gctgcaagggagtctgtcccctgtg

SEQ ID NO: 570200 - DNA, 25 bp, Mus musculus
gctgcaagtcctctgtgaacatgat

SEQ ID NO: 570201 - DNA, 25 bp, Mus musculus
gctgcaagtcctgtgtgaacatgat

SEQ ID NO: 570202 - DNA, 25 bp, Mus musculus
gctgcaagtgagcaaaggtctctct

SEQ ID NO: 570203 - DNA, 25 bp, Mus musculus
gctgcaagtgaggaaaggtctctct

SEQ ID NO: 570204 - DNA, 25 bp, Mus musculus
gctgcaagtggtcgcctcagagctt

SEQ ID NO: 570205 - DNA, 25 bp, Mus musculus
gctgcaagtggtggcctcagagctt

SEQ ID NO: 570206 - DNA, 25 bp, Mus musculus
gctgcaagttttcacatagcactaa

SEQ ID NO: 570207 - DNA, 25 bp, Mus musculus
gctgcaagttttgacatagcactaa

SEQ ID NO: 570208 - DNA, 25 bp, Mus musculus
gctgcaatagcaagtcactgtgact

SEQ ID NO: 570209 - DNA, 25 bp, Mus musculus
gctgcaatagcatgtcactgtgact

SEQ ID NO: 570210 - DNA, 25 bp, Mus musculus
gctgcaatatgaccattctaaagca

SEQ ID NO: 570211 - DNA, 25 bp, Mus musculus
gctgcaatatgagcattctaaagca

SEQ ID NO: 570212 - DNA, 25 bp, Mus musculus
gctgcaatcccactgcaggcaggga

SEQ ID NO: 570213 - DNA, 25 bp, Mus musculus
gctgcaatcccagtgcaggcaggga

SEQ ID NO: 570214 - DNA, 25 bp, Mus musculus
gctgcaatcgataattacctacggt

SEQ ID NO: 570215 - DNA, 25 bp, Mus musculus
gctgcaatcgattattacctacggt

SEQ ID NO: 570216 - DNA, 25 bp, Mus musculus
gctgcaatgcaacaccatggccaac

SEQ ID NO: 570217 - DNA, 25 bp, Mus musculus
gctgcaatgcaagaccatggccaac

SEQ ID NO: 570218 - DNA, 25 bp, Mus musculus
gctgcaatgcttcggagcccagtag

SEQ ID NO: 570219 - DNA, 25 bp, Mus musculus
gctgcaatgcttgggagcccagtag

SEQ ID NO: 570220 - DNA, 25 bp, Mus musculus
gctgcaatgtatcaaaagactagtt

SEQ ID NO: 570221 - DNA, 25 bp, Mus musculus
gctgcaatgtatgaaaagactagtt

SEQ ID NO: 570222 - DNA, 25 bp, Mus musculus
gctgcaatttaaacagtcttgaggc

SEQ ID NO: 570223 - DNA, 25 bp, Mus musculus
gctgcaatttaatcagtcttgaggc

SEQ ID NO: 570224 - DNA, 25 bp, Mus musculus
gctgcaatttgcaattacaatgaga

SEQ ID NO: 570225 - DNA, 25 bp, Mus musculus
gctgcaatttgctattacaatgaga

SEQ ID NO: 570226 - DNA, 25 bp, Mus musculus
gctgcacaagcccacagattttgag

SEQ ID NO: 570227 - DNA, 25 bp, Mus musculus
gctgcacaagccgacagattttgag

SEQ ID NO: 570228 - DNA, 25 bp, Mus musculus
gctgcacaagtgcatttttcctctg

SEQ ID NO: 570229 - DNA, 25 bp, Mus musculus
gctgcacaagtggatttttcctctg

SEQ ID NO: 570230 - DNA, 25 bp, Mus musculus
gctgcacacagacgctaggtaccga

SEQ ID NO: 570231 - DNA, 25 bp, Mus musculus
gctgcacacagaggctaggtaccga

SEQ ID NO: 570232 - DNA, 25 bp, Mus musculus
gctgcacacatgagggccaggagct

SEQ ID NO: 570233 - DNA, 25 bp, Mus musculus
gctgcacacatgtgggccaggagct

SEQ ID NO: 570234 - DNA, 25 bp, Mus musculus
gctgcacacctaactttccaaagag

SEQ ID NO: 570235 - DNA, 25 bp, Mus musculus
gctgcacacctatctttccaaagag

SEQ ID NO: 570236 - DNA, 25 bp, Mus musculus
gctgcacacgtgaaatttaagaata

SEQ ID NO: 570237 - DNA, 25 bp, Mus musculus
gctgcacacgtgtaatttaagaata

SEQ ID NO: 570238 - DNA, 25 bp, Mus musculus
gctgcacagcagacttgtggacagt

SEQ ID NO: 570239 - DNA, 25 bp, Mus musculus
gctgcacagcagtcttgtggacagt

SEQ ID NO: 570240 - DNA, 25 bp, Mus musculus
gctgcacagctgataacattagttg

SEQ ID NO: 570241 - DNA, 25 bp, Mus musculus
gctgcacagctgttaacattagttg

SEQ ID NO: 570242 - DNA, 25 bp, Mus musculus
gctgcacagggacctatgtgttcac

SEQ ID NO: 570243 - DNA, 25 bp, Mus musculus
gctgcacagggagctatgtgttcac

SEQ ID NO: 570244 - DNA, 25 bp, Mus musculus
gctgcacagggtatcacggtcgtag

SEQ ID NO: 570245 - DNA, 25 bp, Mus musculus
gctgcacagggtttcacggtcgtag

SEQ ID NO: 570246 - DNA, 25 bp, Mus musculus
gctgcacagtagatagcgtgtctca

SEQ ID NO: 570247 - DNA, 25 bp, Mus musculus
gctgcacagtagttagcgtgtctca

SEQ ID NO: 570248 - DNA, 25 bp, Mus musculus
gctgcacagtcactttgggaactct

SEQ ID NO: 570249 - DNA, 25 bp, Mus musculus
gctgcacagtcagtttgggaactct

SEQ ID NO: 570250 - DNA, 25 bp, Mus musculus
gctgcacagtcccatgggagaacaa

SEQ ID NO: 570251 - DNA, 25 bp, Mus musculus
gctgcacagtccgatgggagaacaa

SEQ ID NO: 570252 - DNA, 25 bp, Mus musculus
gctgcacatctaatcctgtttacaa

SEQ ID NO: 570253 - DNA, 25 bp, Mus musculus
gctgcacatctattcctgtttacaa

SEQ ID NO: 570254 - DNA, 25 bp, Mus musculus
gctgcacatgcacgtccagttataa

SEQ ID NO: 570255 - DNA, 25 bp, Mus musculus
gctgcacatgcaggtccagttataa

SEQ ID NO: 570256 - DNA, 25 bp, Mus musculus
gctgcaccaagaacatctccatgaa

SEQ ID NO: 570257 - DNA, 25 bp, Mus musculus
gctgcaccaagaacttcgcaaacct

SEQ ID NO: 570258 - DNA, 25 bp, Mus musculus
gctgcaccaagatcatctccatgaa

SEQ ID NO: 570259 - DNA, 25 bp, Mus musculus
gctgcaccaagatcttcgcaaacct

SEQ ID NO: 570260 - DNA, 25 bp, Mus musculus
gctgcaccaggaacttgcataccta

SEQ ID NO: 570261 - DNA, 25 bp, Mus musculus
gctgcaccaggatcttgcataccta

SEQ ID NO: 570262 - DNA, 25 bp, Mus musculus
gctgcaccatgtcgttttttacaac

SEQ ID NO: 570263 - DNA, 25 bp, Mus musculus
gctgcaccatgtggttttttacaac

SEQ ID NO: 570264 - DNA, 25 bp, Mus musculus
gctgcacccactcttgcaagagatc

SEQ ID NO: 570265 - DNA, 25 bp, Mus musculus
gctgcacccactgttgcaagagatc

SEQ ID NO: 570266 - DNA, 25 bp, Mus musculus
gctgcacccagcaagacctgttggg

SEQ ID NO: 570267 - DNA, 25 bp, Mus musculus
gctgcacccagctagacctgttggg

SEQ ID NO: 570268 - DNA, 25 bp, Mus musculus
gctgcacccgggacattgtgctacc

SEQ ID NO: 570269 - DNA, 25 bp, Mus musculus
gctgcacccgggtcattgtgctacc

SEQ ID NO: 570270 - DNA, 25 bp, Mus musculus
gctgcaccggcacacggctgagtac

SEQ ID NO: 570271 - DNA, 25 bp, Mus musculus
gctgcaccggcagacggctgagtac

SEQ ID NO: 570272 - DNA, 25 bp, Mus musculus
gctgcaccggctacgtaggattttg

SEQ ID NO: 570273 - DNA, 25 bp, Mus musculus
gctgcaccggcttcgtaggattttg

SEQ ID NO: 570274 - DNA, 25 bp, Mus musculus
gctgcaccgttaattctagtagata

SEQ ID NO: 570275 - DNA, 25 bp, Mus musculus
gctgcaccgttatttctagtagata

SEQ ID NO: 570276 - DNA, 25 bp, Mus musculus
gctgcacctagaagttgggagtcaa

SEQ ID NO: 570277 - DNA, 25 bp, Mus musculus
gctgcacctagatgttgggagtcaa

SEQ ID NO: 570278 - DNA, 25 bp, Mus musculus
gctgcacctctgcagcactcaagag

SEQ ID NO: 570279 - DNA, 25 bp, Mus musculus
gctgcacctctggagcactcaagag

SEQ ID NO: 570280 - DNA, 25 bp, Mus musculus
gctgcacctggtactcggaatattc

SEQ ID NO: 570281 - DNA, 25 bp, Mus musculus
gctgcacctggttctcggaatattc

SEQ ID NO: 570282 - DNA, 25 bp, Mus musculus
gctgcacgcgcgctacactgactgg

SEQ ID NO: 570283 - DNA, 25 bp, Mus musculus
gctgcacgcgcggtacactgactgg

SEQ ID NO: 570284 - DNA, 25 bp, Mus musculus
gctgcacggctacggagtgtcatct

SEQ ID NO: 570285 - DNA, 25 bp, Mus musculus
gctgcacggctagggagtgtcatct

SEQ ID NO: 570286 - DNA, 25 bp, Mus musculus
gctgcacgggctacttcattcatgg

SEQ ID NO: 570287 - DNA, 25 bp, Mus musculus
gctgcacgggcttcttcattcatgg

SEQ ID NO: 570288 - DNA, 25 bp, Mus musculus
gctgcacgtagaccgttttgtaaca

SEQ ID NO: 570289 - DNA, 25 bp, Mus musculus
gctgcacgtagagcgttttgtaaca

SEQ ID NO: 570290 - DNA, 25 bp, Mus musculus
gctgcacgtgctacacttacaagga

SEQ ID NO: 570291 - DNA, 25 bp, Mus musculus
gctgcacgtgctacgggaggactat

SEQ ID NO: 570292 - DNA, 25 bp, Mus musculus
gctgcacgtgcttcacttacaagga

SEQ ID NO: 570293 - DNA, 25 bp, Mus musculus
gctgcacgtgcttcgggaggactat

SEQ ID NO: 570294 - DNA, 25 bp, Mus musculus
gctgcacgtgtcacatcagaggtgg

SEQ ID NO: 570295 - DNA, 25 bp, Mus musculus
gctgcacgtgtctcatcagaggtgg

SEQ ID NO: 570296 - DNA, 25 bp, Mus musculus
gctgcactcactccatagtggtaga

SEQ ID NO: 570297 - DNA, 25 bp, Mus musculus
gctgcactcactgcatagtggtaga

SEQ ID NO: 570298 - DNA, 25 bp, Mus musculus
gctgcactcagaaagaatcgttgaa

SEQ ID NO: 570299 - DNA, 25 bp, Mus musculus
gctgcactcagatagaatcgttgaa

SEQ ID NO: 570300 - DNA, 25 bp, Mus musculus
gctgcactcccactgttctgaacag

SEQ ID NO: 570301 - DNA, 25 bp, Mus musculus
gctgcactcccagtgttctgaacag

SEQ ID NO: 570302 - DNA, 25 bp, Mus musculus
gctgcactcctgcactgctgcaata

SEQ ID NO: 570303 - DNA, 25 bp, Mus musculus
gctgcactcctggactgctgcaata

SEQ ID NO: 570304 - DNA, 25 bp, Mus musculus
gctgcactggtgactcacttcaatg

SEQ ID NO: 570305 - DNA, 25 bp, Mus musculus
gctgcactggtgtctcacttcaatg

SEQ ID NO: 570306 - DNA, 25 bp, Mus musculus
gctgcactgttcatcagggactttt

SEQ ID NO: 570307 - DNA, 25 bp, Mus musculus
gctgcactgttcttcagggactttt

SEQ ID NO: 570308 - DNA, 25 bp, Mus musculus
gctgcacttcaactattgctacggt

SEQ ID NO: 570309 - DNA, 25 bp, Mus musculus
gctgcacttcaagtattgctacggt

SEQ ID NO: 570310 - DNA, 25 bp, Mus musculus
gctgcacttccacggttgagcttag

SEQ ID NO: 570311 - DNA, 25 bp, Mus musculus
gctgcacttccagggttgagcttag

SEQ ID NO: 570312 - DNA, 25 bp, Mus musculus
gctgcacttgtgactgactataccc

SEQ ID NO: 570313 - DNA, 25 bp, Mus musculus
gctgcacttgtgtctgactataccc

SEQ ID NO: 570314 - DNA, 25 bp, Mus musculus
gctgcactttggcactgctgagagt

SEQ ID NO: 570315 - DNA, 25 bp, Mus musculus
gctgcactttgggactgctgagagt

SEQ ID NO: 570316 - DNA, 25 bp, Mus musculus
gctgcagaaaagactgatgtcctgt

SEQ ID NO: 570317 - DNA, 25 bp, Mus musculus
gctgcagaaaagtctgatgtcctgt

SEQ ID NO: 570318 - DNA, 25 bp, Mus musculus
gctgcagaaactctatctatttgat

SEQ ID NO: 570319 - DNA, 25 bp, Mus musculus
gctgcagaaactgtatctatttgat

SEQ ID NO: 570320 - DNA, 25 bp, Mus musculus
gctgcagaacagatgctgccagcca

SEQ ID NO: 570321 - DNA, 25 bp, Mus musculus
gctgcagaacagttgctgccagcca

SEQ ID NO: 570322 - DNA, 25 bp, Mus musculus
gctgcagaagcaagcctgacccata

SEQ ID NO: 570323 - DNA, 25 bp, Mus musculus
gctgcagaagcatgcctgacccata

SEQ ID NO: 570324 - DNA, 25 bp, Mus musculus
gctgcagaagctataatcctatcta

SEQ ID NO: 570325 - DNA, 25 bp, Mus musculus
gctgcagaagctttaatcctatcta

SEQ ID NO: 570326 - DNA, 25 bp, Mus musculus
gctgcagaaggtctgtccctgcctg

SEQ ID NO: 570327 - DNA, 25 bp, Mus musculus
gctgcagaaggtgtgtccctgcctg

SEQ ID NO: 570328 - DNA, 25 bp, Mus musculus
gctgcagaagtactgctggcttcgc

SEQ ID NO: 570329 - DNA, 25 bp, Mus musculus
gctgcagaagtagtgctggcttcgc

SEQ ID NO: 570330 - DNA, 25 bp, Mus musculus
gctgcagacaacaggcccagaacaa

SEQ ID NO: 570331 - DNA, 25 bp, Mus musculus
gctgcagacaacagggatggccctt

SEQ ID NO: 570332 - DNA, 25 bp, Mus musculus
gctgcagacaactggcccagaacaa

SEQ ID NO: 570333 - DNA, 25 bp, Mus musculus
gctgcagacaactgggatggccctt

SEQ ID NO: 570334 - DNA, 25 bp, Mus musculus
gctgcagacaagaggttacgtggct

SEQ ID NO: 570335 - DNA, 25 bp, Mus musculus
gctgcagacaagtggttacgtggct

SEQ ID NO: 570336 - DNA, 25 bp, Mus musculus
gctgcagacattctaactctttctt

SEQ ID NO: 570337 - DNA, 25 bp, Mus musculus
gctgcagacattgtaactctttctt

SEQ ID NO: 570338 - DNA, 25 bp, Mus musculus
gctgcagaccaaactcgagagcctg

SEQ ID NO: 570339 - DNA, 25 bp, Mus musculus
gctgcagaccaatctcgagagcctg

SEQ ID NO: 570340 - DNA, 25 bp, Mus musculus
gctgcagactcccagtaactgtggg

SEQ ID NO: 570341 - DNA, 25 bp, Mus musculus
gctgcagactccgagtaactgtggg

SEQ ID NO: 570342 - DNA, 25 bp, Mus musculus
gctgcagactggaatgggaccccat

SEQ ID NO: 570343 - DNA, 25 bp, Mus musculus
gctgcagactggattcgcatcagtg

SEQ ID NO: 570344 - DNA, 25 bp, Mus musculus
gctgcagactggtatgggaccccat

SEQ ID NO: 570345 - DNA, 25 bp, Mus musculus
gctgcagactggtttcgcatcagtg

SEQ ID NO: 570346 - DNA, 25 bp, Mus musculus
gctgcagactgtactaaagttccgt

SEQ ID NO: 570347 - DNA, 25 bp, Mus musculus
gctgcagactgttctaaagttccgt

SEQ ID NO: 570348 - DNA, 25 bp, Mus musculus
gctgcagactttaggaggtgtccaa

SEQ ID NO: 570349 - DNA, 25 bp, Mus musculus
gctgcagacttttggaggtgtccaa

SEQ ID NO: 570350 - DNA, 25 bp, Mus musculus
gctgcagagcacagtagttttcaag

SEQ ID NO: 570351 - DNA, 25 bp, Mus musculus
gctgcagagcactgtagttttcaag

SEQ ID NO: 570352 - DNA, 25 bp, Mus musculus
gctgcagagcagaggtctatttaca

SEQ ID NO: 570353 - DNA, 25 bp, Mus musculus
gctgcagagcagattcctagtatat

SEQ ID NO: 570354 - DNA, 25 bp, Mus musculus
gctgcagagcagtggtctatttaca

SEQ ID NO: 570355 - DNA, 25 bp, Mus musculus
gctgcagagcagtttcctagtatat

SEQ ID NO: 570356 - DNA, 25 bp, Mus musculus
gctgcagaggcaaacgtcactcagt

SEQ ID NO: 570357 - DNA, 25 bp, Mus musculus
gctgcagaggcatacgtcactcagt

SEQ ID NO: 570358 - DNA, 25 bp, Mus musculus
gctgcagatctacgaatgtatgttc

SEQ ID NO: 570359 - DNA, 25 bp, Mus musculus
gctgcagatctaggaatgtatgttc

SEQ ID NO: 570360 - DNA, 25 bp, Mus musculus
gctgcagatgaaccaccataccaag

SEQ ID NO: 570361 - DNA, 25 bp, Mus musculus
gctgcagatgaagcaccataccaag

SEQ ID NO: 570362 - DNA, 25 bp, Mus musculus
gctgcagatgagaagggctctccga

SEQ ID NO: 570363 - DNA, 25 bp, Mus musculus
gctgcagatgagtagggctctccga

SEQ ID NO: 570364 - DNA, 25 bp, Mus musculus
gctgcagatgcaaagctccatagct

SEQ ID NO: 570365 - DNA, 25 bp, Mus musculus
gctgcagatgcatagctccatagct

SEQ ID NO: 570366 - DNA, 25 bp, Mus musculus
gctgcagatggtagtaaacactatg

SEQ ID NO: 570367 - DNA, 25 bp, Mus musculus
gctgcagatggttgtaaacactatg

SEQ ID NO: 570368 - DNA, 25 bp, Mus musculus
gctgcagattaaagtcctggttgga

SEQ ID NO: 570369 - DNA, 25 bp, Mus musculus
gctgcagattaatgtcctggttgga

SEQ ID NO: 570370 - DNA, 25 bp, Mus musculus
gctgcagattctagtgctccttggt

SEQ ID NO: 570371 - DNA, 25 bp, Mus musculus
gctgcagattcttgtgctccttggt

SEQ ID NO: 570372 - DNA, 25 bp, Mus musculus
gctgcagatttacctgtgagcttct

SEQ ID NO: 570373 - DNA, 25 bp, Mus musculus
gctgcagatttagctgtgagcttct

SEQ ID NO: 570374 - DNA, 25 bp, Mus musculus
gctgcagcacccagcgctcggaaga

SEQ ID NO: 570375 - DNA, 25 bp, Mus musculus
gctgcagcaccctgcgctcggaaga

SEQ ID NO: 570376 - DNA, 25 bp, Mus musculus
gctgcagcagcacaactcactggag

SEQ ID NO: 570377 - DNA, 25 bp, Mus musculus
gctgcagcagcagaactcactggag

SEQ ID NO: 570378 - DNA, 25 bp, Mus musculus
gctgcagcagctcggcattcgccga

SEQ ID NO: 570379 - DNA, 25 bp, Mus musculus
gctgcagcagctgggcattcgccga

SEQ ID NO: 570380 - DNA, 25 bp, Mus musculus
gctgcagccaccagatccctggaga

SEQ ID NO: 570381 - DNA, 25 bp, Mus musculus
gctgcagccaccctgaccagggaaa

SEQ ID NO: 570382 - DNA, 25 bp, Mus musculus
gctgcagccaccgtgaccagggaaa

SEQ ID NO: 570383 - DNA, 25 bp, Mus musculus
gctgcagccacctgatccctggaga

SEQ ID NO: 570384 - DNA, 25 bp, Mus musculus
gctgcagccactctgttactgtaag

SEQ ID NO: 570385 - DNA, 25 bp, Mus musculus
gctgcagccactgtgttactgtaag

SEQ ID NO: 570386 - DNA, 25 bp, Mus musculus
gctgcagcccagattctgactagca

SEQ ID NO: 570387 - DNA, 25 bp, Mus musculus
gctgcagcccagcaccaagttagag

SEQ ID NO: 570388 - DNA, 25 bp, Mus musculus
gctgcagcccaggaccaagttagag

SEQ ID NO: 570389 - DNA, 25 bp, Mus musculus
gctgcagcccagtttctgactagca

SEQ ID NO: 570390 - DNA, 25 bp, Mus musculus
gctgcagccctgagcacagcgagga

SEQ ID NO: 570391 - DNA, 25 bp, Mus musculus
gctgcagccctgtgcacagcgagga

SEQ ID NO: 570392 - DNA, 25 bp, Mus musculus
gctgcagcctccagagtcataggac

SEQ ID NO: 570393 - DNA, 25 bp, Mus musculus
gctgcagcctcctgagtcataggac

SEQ ID NO: 570394 - DNA, 25 bp, Mus musculus
gctgcagcctgtatgtcgatggaaa

SEQ ID NO: 570395 - DNA, 25 bp, Mus musculus
gctgcagcctgtttgtcgatggaaa

SEQ ID NO: 570396 - DNA, 25 bp, Mus musculus
gctgcagcggcacaaaccaagctta

SEQ ID NO: 570397 - DNA, 25 bp, Mus musculus
gctgcagcggcaccaaagctcccag

SEQ ID NO: 570398 - DNA, 25 bp, Mus musculus
gctgcagcggcagaaaccaagctta

SEQ ID NO: 570399 - DNA, 25 bp, Mus musculus
gctgcagcggcagcaaagctcccag

SEQ ID NO: 570400 - DNA, 25 bp, Mus musculus
gctgcagctaccatgattgtaattt

SEQ ID NO: 570401 - DNA, 25 bp, Mus musculus
gctgcagctaccttgattgtaattt

SEQ ID NO: 570402 - DNA, 25 bp, Mus musculus
gctgcagctagtatcatgtcatacc

SEQ ID NO: 570403 - DNA, 25 bp, Mus musculus
gctgcagctagtttcatgtcatacc

SEQ ID NO: 570404 - DNA, 25 bp, Mus musculus
gctgcagctcaaacacctgcaaact

SEQ ID NO: 570405 - DNA, 25 bp, Mus musculus
gctgcagctcaatcacctgcaaact

SEQ ID NO: 570406 - DNA, 25 bp, Mus musculus
gctgcagctcccaggttttaatttt

SEQ ID NO: 570407 - DNA, 25 bp, Mus musculus
gctgcagctccctggttttaatttt

SEQ ID NO: 570408 - DNA, 25 bp, Mus musculus
gctgcagctcgtatacttagagcat

SEQ ID NO: 570409 - DNA, 25 bp, Mus musculus
gctgcagctcgtttacttagagcat

SEQ ID NO: 570410 - DNA, 25 bp, Mus musculus
gctgcagctctgcatgcaatttagt

SEQ ID NO: 570411 - DNA, 25 bp, Mus musculus
gctgcagctctggatgcaatttagt

SEQ ID NO: 570412 - DNA, 25 bp, Mus musculus
gctgcagctgaaaggctatcccagt

SEQ ID NO: 570413 - DNA, 25 bp, Mus musculus
gctgcagctgaatggctatcccagt

SEQ ID NO: 570414 - DNA, 25 bp, Mus musculus
gctgcagctgatccaaatgaacgag

SEQ ID NO: 570415 - DNA, 25 bp, Mus musculus
gctgcagctgatgcaaatgaacgag

SEQ ID NO: 570416 - DNA, 25 bp, Mus musculus
gctgcagctgctaaggcagccaaat

SEQ ID NO: 570417 - DNA, 25 bp, Mus musculus
gctgcagctgctaccgatgtgataa

SEQ ID NO: 570418 - DNA, 25 bp, Mus musculus
gctgcagctgcttaggcagccaaat

SEQ ID NO: 570419 - DNA, 25 bp, Mus musculus
gctgcagctgcttccgatgtgataa

SEQ ID NO: 570420 - DNA, 25 bp, Mus musculus
gctgcagctgttaagaaaggccctt

SEQ ID NO: 570421 - DNA, 25 bp, Mus musculus
gctgcagctgtttagaaaggccctt

SEQ ID NO: 570422 - DNA, 25 bp, Mus musculus
gctgcagctttaccttgtagacgtt

SEQ ID NO: 570423 - DNA, 25 bp, Mus musculus
gctgcagctttagcttgtagacgtt

SEQ ID NO: 570424 - DNA, 25 bp, Mus musculus
gctgcaggaactcacttgcaaccca

SEQ ID NO: 570425 - DNA, 25 bp, Mus musculus
gctgcaggaactgacttgcaaccca

SEQ ID NO: 570426 - DNA, 25 bp, Mus musculus
gctgcaggaatcatgcttgggccaa

SEQ ID NO: 570427 - DNA, 25 bp, Mus musculus
gctgcaggaatcttgcttgggccaa

SEQ ID NO: 570428 - DNA, 25 bp, Mus musculus
gctgcaggaccactggaagccgcta

SEQ ID NO: 570429 - DNA, 25 bp, Mus musculus
gctgcaggaccagtggaagccgcta

SEQ ID NO: 570430 - DNA, 25 bp, Mus musculus
gctgcaggacctagtggaagtctca

SEQ ID NO: 570431 - DNA, 25 bp, Mus musculus
gctgcaggaccttgtggaagtctca

SEQ ID NO: 570432 - DNA, 25 bp, Mus musculus
gctgcaggagcacatacgggatctt

SEQ ID NO: 570433 - DNA, 25 bp, Mus musculus
gctgcaggagcagatacgggatctt

SEQ ID NO: 570434 - DNA, 25 bp, Mus musculus
gctgcaggaggcaccaccgtcatgg

SEQ ID NO: 570435 - DNA, 25 bp, Mus musculus
gctgcaggaggctccaccgtcatgg

SEQ ID NO: 570436 - DNA, 25 bp, Mus musculus
gctgcaggatatccgggtgtcaccc

SEQ ID NO: 570437 - DNA, 25 bp, Mus musculus
gctgcaggatatgcgggtgtcaccc

SEQ ID NO: 570438 - DNA, 25 bp, Mus musculus
gctgcaggatgtccgggccgaggaa

SEQ ID NO: 570439 - DNA, 25 bp, Mus musculus
gctgcaggatgtgcgggccgaggaa

SEQ ID NO: 570440 - DNA, 25 bp, Mus musculus
gctgcaggcacacctcggatggaaa

SEQ ID NO: 570441 - DNA, 25 bp, Mus musculus
gctgcaggcacagctcggatggaaa

SEQ ID NO: 570442 - DNA, 25 bp, Mus musculus
gctgcaggcagcatgcacgttagca

SEQ ID NO: 570443 - DNA, 25 bp, Mus musculus
gctgcaggcagcttgcacgttagca

SEQ ID NO: 570444 - DNA, 25 bp, Mus musculus
gctgcaggcattctagacctttggg

SEQ ID NO: 570445 - DNA, 25 bp, Mus musculus
gctgcaggcattgtagacctttggg

SEQ ID NO: 570446 - DNA, 25 bp, Mus musculus
gctgcaggcctgaaacttgtcaaat

SEQ ID NO: 570447 - DNA, 25 bp, Mus musculus
gctgcaggcctgtaacttgtcaaat

SEQ ID NO: 570448 - DNA, 25 bp, Mus musculus
gctgcaggccttattgataagtctt

SEQ ID NO: 570449 - DNA, 25 bp, Mus musculus
gctgcaggcctttttgataagtctt

SEQ ID NO: 570450 - DNA, 25 bp, Mus musculus
gctgcagggccgctgataacagcaa

SEQ ID NO: 570451 - DNA, 25 bp, Mus musculus
gctgcagggccggtgataacagcaa

SEQ ID NO: 570452 - DNA, 25 bp, Mus musculus
gctgcagggctgcattcatcagaaa

SEQ ID NO: 570453 - DNA, 25 bp, Mus musculus
gctgcagggctggattcatcagaaa

SEQ ID NO: 570454 - DNA, 25 bp, Mus musculus
gctgcagggttaaaagcactgtgtt

SEQ ID NO: 570455 - DNA, 25 bp, Mus musculus
gctgcagggttataagcactgtgtt

SEQ ID NO: 570456 - DNA, 25 bp, Mus musculus
gctgcaggtcacatgggaggatcat

SEQ ID NO: 570457 - DNA, 25 bp, Mus musculus
gctgcaggtcacttgggaggatcat

SEQ ID NO: 570458 - DNA, 25 bp, Mus musculus
gctgcaggtcggcaaaatttgcact

SEQ ID NO: 570459 - DNA, 25 bp, Mus musculus
gctgcaggtcgggaaaatttgcact

SEQ ID NO: 570460 - DNA, 25 bp, Mus musculus
gctgcaggtctgacttgtagcattc

SEQ ID NO: 570461 - DNA, 25 bp, Mus musculus
gctgcaggtctgactttgacatggg

SEQ ID NO: 570462 - DNA, 25 bp, Mus musculus
gctgcaggtctgtcttgtagcattc

SEQ ID NO: 570463 - DNA, 25 bp, Mus musculus
gctgcaggtctgtctttgacatggg

SEQ ID NO: 570464 - DNA, 25 bp, Mus musculus
gctgcaggtgtcatagcaactccat

SEQ ID NO: 570465 - DNA, 25 bp, Mus musculus
gctgcaggtgtcttagcaactccat

SEQ ID NO: 570466 - DNA, 25 bp, Mus musculus
gctgcagtaattaatggagtcccca

SEQ ID NO: 570467 - DNA, 25 bp, Mus musculus
gctgcagtaatttatggagtcccca

SEQ ID NO: 570468 - DNA, 25 bp, Mus musculus
gctgcagtacaacctgagctacttt

SEQ ID NO: 570469 - DNA, 25 bp, Mus musculus
gctgcagtacaagctgagctacttt

SEQ ID NO: 570470 - DNA, 25 bp, Mus musculus
gctgcagtatgacaggagcccttca

SEQ ID NO: 570471 - DNA, 25 bp, Mus musculus
gctgcagtatgagaggagcccttca

SEQ ID NO: 570472 - DNA, 25 bp, Mus musculus
gctgcagtcaacaccatgcaatcat

SEQ ID NO: 570473 - DNA, 25 bp, Mus musculus
gctgcagtcaactccatgcaatcat

SEQ ID NO: 570474 - DNA, 25 bp, Mus musculus
gctgcagtcactagtagtatccaaa

SEQ ID NO: 570475 - DNA, 25 bp, Mus musculus
gctgcagtcacttgtagtatccaaa

SEQ ID NO: 570476 - DNA, 25 bp, Mus musculus
gctgcagtcaggaaagcttcatccc

SEQ ID NO: 570477 - DNA, 25 bp, Mus musculus
gctgcagtcaggtaagcttcatccc

SEQ ID NO: 570478 - DNA, 25 bp, Mus musculus
gctgcagtccagcacacaattgcta

SEQ ID NO: 570479 - DNA, 25 bp, Mus musculus
gctgcagtccaggacacaattgcta

SEQ ID NO: 570480 - DNA, 25 bp, Mus musculus
gctgcagtcctgcactgaaaatatg

SEQ ID NO: 570481 - DNA, 25 bp, Mus musculus
gctgcagtcctggactgaaaatatg

SEQ ID NO: 570482 - DNA, 25 bp, Mus musculus
gctgcagtccttagttgaaaaacct

SEQ ID NO: 570483 - DNA, 25 bp, Mus musculus
gctgcagtcctttgttgaaaaacct

SEQ ID NO: 570484 - DNA, 25 bp, Mus musculus
gctgcagtctttcttcattctatat

SEQ ID NO: 570485 - DNA, 25 bp, Mus musculus
gctgcagtctttgttcattctatat

SEQ ID NO: 570486 - DNA, 25 bp, Mus musculus
gctgcagtgaatcacgcccacataa

SEQ ID NO: 570487 - DNA, 25 bp, Mus musculus
gctgcagtgaatgacgcccacataa

SEQ ID NO: 570488 - DNA, 25 bp, Mus musculus
gctgcagtgaggatggacgatccta

SEQ ID NO: 570489 - DNA, 25 bp, Mus musculus
gctgcagtgaggttggacgatccta

SEQ ID NO: 570490 - DNA, 25 bp, Mus musculus
gctgcagtgataagtttttatcagc

SEQ ID NO: 570491 - DNA, 25 bp, Mus musculus
gctgcagtgatatgtttttatcagc

SEQ ID NO: 570492 - DNA, 25 bp, Mus musculus
gctgcagtgccaacctagacacagg

SEQ ID NO: 570493 - DNA, 25 bp, Mus musculus
gctgcagtgccatcctagacacagg

SEQ ID NO: 570494 - DNA, 25 bp, Mus musculus
gctgcagtgccccaagatcaagact

SEQ ID NO: 570495 - DNA, 25 bp, Mus musculus
gctgcagtgcccgaagatcaagact

SEQ ID NO: 570496 - DNA, 25 bp, Mus musculus
gctgcagtgcctcaggttatcgtat

SEQ ID NO: 570497 - DNA, 25 bp, Mus musculus
gctgcagtgcctgaggttatcgtat

SEQ ID NO: 570498 - DNA, 25 bp, Mus musculus
gctgcagtgctgcagtcatacatcg

SEQ ID NO: 570499 - DNA, 25 bp, Mus musculus
gctgcagtgctggagtcatacatcg

SEQ ID NO: 570500 - DNA, 25 bp, Mus musculus
gctgcagtggcaatggttaactctt

SEQ ID NO: 570501 - DNA, 25 bp, Mus musculus
gctgcagtggcattggttaactctt

SEQ ID NO: 570502 - DNA, 25 bp, Mus musculus
gctgcagtggttagcgtggcttatt

SEQ ID NO: 570503 - DNA, 25 bp, Mus musculus
gctgcagtggtttgcgtggcttatt

SEQ ID NO: 570504 - DNA, 25 bp, Mus musculus
gctgcagttaaccatgttgcctttt

SEQ ID NO: 570505 - DNA, 25 bp, Mus musculus
gctgcagttaacgatgttgcctttt

SEQ ID NO: 570506 - DNA, 25 bp, Mus musculus
gctgcagttcccagttagcgaagca

SEQ ID NO: 570507 - DNA, 25 bp, Mus musculus
gctgcagttccctgttagcgaagca

SEQ ID NO: 570508 - DNA, 25 bp, Mus musculus
gctgcagttccgctttatagctgga

SEQ ID NO: 570509 - DNA, 25 bp, Mus musculus
gctgcagttccggtttatagctgga

SEQ ID NO: 570510 - DNA, 25 bp, Mus musculus
gctgcagttggaattgtttaaagta

SEQ ID NO: 570511 - DNA, 25 bp, Mus musculus
gctgcagttggatttgtttaaagta

SEQ ID NO: 570512 - DNA, 25 bp, Mus musculus
gctgcagtttgcatatattatttca

SEQ ID NO: 570513 - DNA, 25 bp, Mus musculus
gctgcagtttgcttatattatttca

SEQ ID NO: 570514 - DNA, 25 bp, Mus musculus
gctgcagttttccttgtaggctccc

SEQ ID NO: 570515 - DNA, 25 bp, Mus musculus
gctgcagttttcgttgtaggctccc

SEQ ID NO: 570516 - DNA, 25 bp, Mus musculus
gctgcataacagacctcacttgggt

SEQ ID NO: 570517 - DNA, 25 bp, Mus musculus
gctgcataacagtcctcacttgggt

SEQ ID NO: 570518 - DNA, 25 bp, Mus musculus
gctgcataatagctcaggctccggg

SEQ ID NO: 570519 - DNA, 25 bp, Mus musculus
gctgcataataggtcaggctccggg

SEQ ID NO: 570520 - DNA, 25 bp, Mus musculus
gctgcataattgagcataacttcct

SEQ ID NO: 570521 - DNA, 25 bp, Mus musculus
gctgcataattgtgcataacttcct

SEQ ID NO: 570522 - DNA, 25 bp, Mus musculus
gctgcatactaactctgggctgtga

SEQ ID NO: 570523 - DNA, 25 bp, Mus musculus
gctgcatactaagtctgggctgtga

SEQ ID NO: 570524 - DNA, 25 bp, Mus musculus
gctgcataggccaagagtcgtccta

SEQ ID NO: 570525 - DNA, 25 bp, Mus musculus
gctgcataggcctagagtcgtccta

SEQ ID NO: 570526 - DNA, 25 bp, Mus musculus
gctgcatagtgtacttcgtgtccga

SEQ ID NO: 570527 - DNA, 25 bp, Mus musculus
gctgcatagtgttcttcgtgtccga

SEQ ID NO: 570528 - DNA, 25 bp, Mus musculus
gctgcatcagtcacaagtgacatct

SEQ ID NO: 570529 - DNA, 25 bp, Mus musculus
gctgcatcagtctcaagtgacatct

SEQ ID NO: 570530 - DNA, 25 bp, Mus musculus
gctgcatcatagactactcctttaa

SEQ ID NO: 570531 - DNA, 25 bp, Mus musculus
gctgcatcatagtctactcctttaa

SEQ ID NO: 570532 - DNA, 25 bp, Mus musculus
gctgcatcatggagcctgcatgcca

SEQ ID NO: 570533 - DNA, 25 bp, Mus musculus
gctgcatcatggtgcctgcatgcca

SEQ ID NO: 570534 - DNA, 25 bp, Mus musculus
gctgcatccaaaccccagtagggag

SEQ ID NO: 570535 - DNA, 25 bp, Mus musculus
gctgcatccaaagcccagtagggag

SEQ ID NO: 570536 - DNA, 25 bp, Mus musculus
gctgcatccagacatggcctgtgat

SEQ ID NO: 570537 - DNA, 25 bp, Mus musculus
gctgcatccagagatggcctgtgat

SEQ ID NO: 570538 - DNA, 25 bp, Mus musculus
gctgcatccgatactggaacactct

SEQ ID NO: 570539 - DNA, 25 bp, Mus musculus
gctgcatccgattctggaacactct

SEQ ID NO: 570540 - DNA, 25 bp, Mus musculus
gctgcatctactcagtgccgttaat

SEQ ID NO: 570541 - DNA, 25 bp, Mus musculus
gctgcatctactgagtgccgttaat

SEQ ID NO: 570542 - DNA, 25 bp, Mus musculus
gctgcatctctaatacagcctcgta

SEQ ID NO: 570543 - DNA, 25 bp, Mus musculus
gctgcatctctattacagcctcgta

SEQ ID NO: 570544 - DNA, 25 bp, Mus musculus
gctgcatcttctcaagccaacaata

SEQ ID NO: 570545 - DNA, 25 bp, Mus musculus
gctgcatcttctgaagccaacaata

SEQ ID NO: 570546 - DNA, 25 bp, Mus musculus
gctgcatcttttcccagacgaggat

SEQ ID NO: 570547 - DNA, 25 bp, Mus musculus
gctgcatcttttgccagacgaggat

SEQ ID NO: 570548 - DNA, 25 bp, Mus musculus
gctgcatgaaacaagagagacgctc

SEQ ID NO: 570549 - DNA, 25 bp, Mus musculus
gctgcatgaaactagagagacgctc

SEQ ID NO: 570550 - DNA, 25 bp, Mus musculus
gctgcatgacctcaggcaagttatt

SEQ ID NO: 570551 - DNA, 25 bp, Mus musculus
gctgcatgacctgaggcaagttatt

SEQ ID NO: 570552 - DNA, 25 bp, Mus musculus
gctgcatgactcacttgctatgtgc

SEQ ID NO: 570553 - DNA, 25 bp, Mus musculus
gctgcatgactctcttgctatgtgc

SEQ ID NO: 570554 - DNA, 25 bp, Mus musculus
gctgcatgagagctttcttcaaaag

SEQ ID NO: 570555 - DNA, 25 bp, Mus musculus
gctgcatgagaggtttcttcaaaag

SEQ ID NO: 570556 - DNA, 25 bp, Mus musculus
gctgcatgcagtctgctaccaggat

SEQ ID NO: 570557 - DNA, 25 bp, Mus musculus
gctgcatgcagtgtgctaccaggat

SEQ ID NO: 570558 - DNA, 25 bp, Mus musculus
gctgcatgcatacgcttctggcaaa

SEQ ID NO: 570559 - DNA, 25 bp, Mus musculus
gctgcatgcataggcttctggcaaa

SEQ ID NO: 570560 - DNA, 25 bp, Mus musculus
gctgcatggagccacactcagaatt

SEQ ID NO: 570561 - DNA, 25 bp, Mus musculus
gctgcatggagcgacactcagaatt

SEQ ID NO: 570562 - DNA, 25 bp, Mus musculus
gctgcatggcatattcttgttgaat

SEQ ID NO: 570563 - DNA, 25 bp, Mus musculus
gctgcatggcattttcttgttgaat

SEQ ID NO: 570564 - DNA, 25 bp, Mus musculus
gctgcatgggcaattcaaacaaatc

SEQ ID NO: 570565 - DNA, 25 bp, Mus musculus
gctgcatgggcatttcaaacaaatc

SEQ ID NO: 570566 - DNA, 25 bp, Mus musculus
gctgcatgtaacattctatgatgga

SEQ ID NO: 570567 - DNA, 25 bp, Mus musculus
gctgcatgtaactttctatgatgga

SEQ ID NO: 570568 - DNA, 25 bp, Mus musculus
gctgcatgtacgaaccttctgtaaa

SEQ ID NO: 570569 - DNA, 25 bp, Mus musculus
gctgcatgtacgtaccttctgtaaa

SEQ ID NO: 570570 - DNA, 25 bp, Mus musculus
gctgcatgtagcatctggagtggtc

SEQ ID NO: 570571 - DNA, 25 bp, Mus musculus
gctgcatgtagcttctggagtggtc

SEQ ID NO: 570572 - DNA, 25 bp, Mus musculus
gctgcatgtcatctcactgtacaca

SEQ ID NO: 570573 - DNA, 25 bp, Mus musculus
gctgcatgtcatgtcactgtacaca

SEQ ID NO: 570574 - DNA, 25 bp, Mus musculus
gctgcatgtgaacggtctgagtttt

SEQ ID NO: 570575 - DNA, 25 bp, Mus musculus
gctgcatgtgaagggtctgagtttt

SEQ ID NO: 570576 - DNA, 25 bp, Mus musculus
gctgcatgtgtgaggctcacagagc

SEQ ID NO: 570577 - DNA, 25 bp, Mus musculus
gctgcatgtgtgtggctcacagagc

SEQ ID NO: 570578 - DNA, 25 bp, Mus musculus
gctgcattatatatacaaccgtgtg

SEQ ID NO: 570579 - DNA, 25 bp, Mus musculus
gctgcattatatttacaaccgtgtg

SEQ ID NO: 570580 - DNA, 25 bp, Mus musculus
gctgcattattaatccaccagtgag

SEQ ID NO: 570581 - DNA, 25 bp, Mus musculus
gctgcattattattccaccagtgag

SEQ ID NO: 570582 - DNA, 25 bp, Mus musculus
gctgcattccagaatggcatcaaga

SEQ ID NO: 570583 - DNA, 25 bp, Mus musculus
gctgcattccagtatggcatcaaga

SEQ ID NO: 570584 - DNA, 25 bp, Mus musculus
gctgcattccttcagaactgagtaa

SEQ ID NO: 570585 - DNA, 25 bp, Mus musculus
gctgcattccttgagaactgagtaa

SEQ ID NO: 570586 - DNA, 25 bp, Mus musculus
gctgcattcggacccgtacatcatg

SEQ ID NO: 570587 - DNA, 25 bp, Mus musculus
gctgcattcggagccgtacatcatg

SEQ ID NO: 570588 - DNA, 25 bp, Mus musculus
gctgcattcgttaaaagttctctgt

SEQ ID NO: 570589 - DNA, 25 bp, Mus musculus
gctgcattcgtttaaagttctctgt

SEQ ID NO: 570590 - DNA, 25 bp, Mus musculus
gctgcattctgcctagttctaaaat

SEQ ID NO: 570591 - DNA, 25 bp, Mus musculus
gctgcattctgcgtagttctaaaat

SEQ ID NO: 570592 - DNA, 25 bp, Mus musculus
gctgcattctggcttcttctgactg

SEQ ID NO: 570593 - DNA, 25 bp, Mus musculus
gctgcattctgggttcttctgactg

SEQ ID NO: 570594 - DNA, 25 bp, Mus musculus
gctgcattgagtactatatactata

SEQ ID NO: 570595 - DNA, 25 bp, Mus musculus
gctgcattgagttctatatactata

SEQ ID NO: 570596 - DNA, 25 bp, Mus musculus
gctgcattgcagctaccaagaagcg

SEQ ID NO: 570597 - DNA, 25 bp, Mus musculus
gctgcattgcaggtaccaagaagcg

SEQ ID NO: 570598 - DNA, 25 bp, Mus musculus
gctgcattgcctaggaccgatggta

SEQ ID NO: 570599 - DNA, 25 bp, Mus musculus
gctgcattgccttggaccgatggta

SEQ ID NO: 570600 - DNA, 25 bp, Mus musculus
gctgcattgctcatacttacacaga

SEQ ID NO: 570601 - DNA, 25 bp, Mus musculus
gctgcattgctcttacttacacaga

SEQ ID NO: 570602 - DNA, 25 bp, Mus musculus
gctgcattgggcagtaggttacagt

SEQ ID NO: 570603 - DNA, 25 bp, Mus musculus
gctgcattgggctgtaggttacagt

SEQ ID NO: 570604 - DNA, 25 bp, Mus musculus
gctgcattgtatccccaactctaaa

SEQ ID NO: 570605 - DNA, 25 bp, Mus musculus
gctgcattgtatgcccaactctaaa

SEQ ID NO: 570606 - DNA, 25 bp, Mus musculus
gctgcattttaaaggtcgtctgtgt

SEQ ID NO: 570607 - DNA, 25 bp, Mus musculus
gctgcattttaatggtcgtctgtgt

SEQ ID NO: 570608 - DNA, 25 bp, Mus musculus
gctgcattttacatcttattggaca

SEQ ID NO: 570609 - DNA, 25 bp, Mus musculus
gctgcattttacttcttattggaca

SEQ ID NO: 570610 - DNA, 25 bp, Mus musculus
gctgcattttggcaatacggtgttt

SEQ ID NO: 570611 - DNA, 25 bp, Mus musculus
gctgcattttgggaatacggtgttt

SEQ ID NO: 570612 - DNA, 25 bp, Mus musculus
gctgccaaagccattgtggatgctt

SEQ ID NO: 570613 - DNA, 25 bp, Mus musculus
gctgccaaagcctttgtggatgctt

SEQ ID NO: 570614 - DNA, 25 bp, Mus musculus
gctgccaaagcgaatctttatgtct

SEQ ID NO: 570615 - DNA, 25 bp, Mus musculus
gctgccaaagcgtatctttatgtct

SEQ ID NO: 570616 - DNA, 25 bp, Mus musculus
gctgccaaaggtcctttcatggttc

SEQ ID NO: 570617 - DNA, 25 bp, Mus musculus
gctgccaaaggtgctttcatggttc

SEQ ID NO: 570618 - DNA, 25 bp, Mus musculus
gctgccaactctataatcggtgtat

SEQ ID NO: 570619 - DNA, 25 bp, Mus musculus
gctgccaactctttaatcggtgtat

SEQ ID NO: 570620 - DNA, 25 bp, Mus musculus
gctgccaagagtaccctgggtttga

SEQ ID NO: 570621 - DNA, 25 bp, Mus musculus
gctgccaagagttccctgggtttga

SEQ ID NO: 570622 - DNA, 25 bp, Mus musculus
gctgccaagcctcgatggcatgaac

SEQ ID NO: 570623 - DNA, 25 bp, Mus musculus
gctgccaagcctggatggcatgaac

SEQ ID NO: 570624 - DNA, 25 bp, Mus musculus
gctgccaagctgaagcctaagagaa

SEQ ID NO: 570625 - DNA, 25 bp, Mus musculus
gctgccaagctgtagcctaagagaa

SEQ ID NO: 570626 - DNA, 25 bp, Mus musculus
gctgccaagtgcagttccatgggct

SEQ ID NO: 570627 - DNA, 25 bp, Mus musculus
gctgccaagtgctgttccatgggct

SEQ ID NO: 570628 - DNA, 25 bp, Mus musculus
gctgccaagtggcagctaggactca

SEQ ID NO: 570629 - DNA, 25 bp, Mus musculus
gctgccaagtgggagctaggactca

SEQ ID NO: 570630 - DNA, 25 bp, Mus musculus
gctgccaatgcactcgatcttgtca

SEQ ID NO: 570631 - DNA, 25 bp, Mus musculus
gctgccaatgcagtcgatcttgtca

SEQ ID NO: 570632 - DNA, 25 bp, Mus musculus
gctgccaatgccaagtaacctgtat

SEQ ID NO: 570633 - DNA, 25 bp, Mus musculus
gctgccaatgcctagtaacctgtat

SEQ ID NO: 570634 - DNA, 25 bp, Mus musculus
gctgccaattagatcctctgtttta

SEQ ID NO: 570635 - DNA, 25 bp, Mus musculus
gctgccaattagttcctctgtttta

SEQ ID NO: 570636 - DNA, 25 bp, Mus musculus
gctgccacacccatgtgaaatgctt

SEQ ID NO: 570637 - DNA, 25 bp, Mus musculus
gctgccacacccctaacaagaatta

SEQ ID NO: 570638 - DNA, 25 bp, Mus musculus
gctgccacacccgtaacaagaatta

SEQ ID NO: 570639 - DNA, 25 bp, Mus musculus
gctgccacacccttgtgaaatgctt

SEQ ID NO: 570640 - DNA, 25 bp, Mus musculus
gctgccacactcagctgtacagtat

SEQ ID NO: 570641 - DNA, 25 bp, Mus musculus
gctgccacactctgctgtacagtat

SEQ ID NO: 570642 - DNA, 25 bp, Mus musculus
gctgccacagcaaggaatgtctcag

SEQ ID NO: 570643 - DNA, 25 bp, Mus musculus
gctgccacagcactactttttctac

SEQ ID NO: 570644 - DNA, 25 bp, Mus musculus
gctgccacagcagtactttttctac

SEQ ID NO: 570645 - DNA, 25 bp, Mus musculus
gctgccacagcatggaatgtctcag

SEQ ID NO: 570646 - DNA, 25 bp, Mus musculus
gctgccaccagaagatgtgtcccat

SEQ ID NO: 570647 - DNA, 25 bp, Mus musculus
gctgccaccagatgatgtgtcccat

SEQ ID NO: 570648 - DNA, 25 bp, Mus musculus
gctgccaccctcaatggaaactgag

SEQ ID NO: 570649 - DNA, 25 bp, Mus musculus
gctgccaccctctatggaaactgag

SEQ ID NO: 570650 - DNA, 25 bp, Mus musculus
gctgccacgaggagtatcacatcat

SEQ ID NO: 570651 - DNA, 25 bp, Mus musculus
gctgccacgaggtgtatcacatcat

SEQ ID NO: 570652 - DNA, 25 bp, Mus musculus
gctgccacggacacaacttgttaat

SEQ ID NO: 570653 - DNA, 25 bp, Mus musculus
gctgccacggactcaacttgttaat

SEQ ID NO: 570654 - DNA, 25 bp, Mus musculus
gctgccactagaatagctgtaataa

SEQ ID NO: 570655 - DNA, 25 bp, Mus musculus
gctgccactagattagctgtaataa

SEQ ID NO: 570656 - DNA, 25 bp, Mus musculus
gctgccactctaattccaaggtgat

SEQ ID NO: 570657 - DNA, 25 bp, Mus musculus
gctgccactctatttccaaggtgat

SEQ ID NO: 570658 - DNA, 25 bp, Mus musculus
gctgccactgagactggctgtaaaa

SEQ ID NO: 570659 - DNA, 25 bp, Mus musculus
gctgccactgagtctggctgtaaaa

SEQ ID NO: 570660 - DNA, 25 bp, Mus musculus
gctgccactgtcctgtaataaagtc

SEQ ID NO: 570661 - DNA, 25 bp, Mus musculus
gctgccactgtcgtgtaataaagtc

SEQ ID NO: 570662 - DNA, 25 bp, Mus musculus
gctgccacttctattcttattcaaa

SEQ ID NO: 570663 - DNA, 25 bp, Mus musculus
gctgccacttcttttcttattcaaa

SEQ ID NO: 570664 - DNA, 25 bp, Mus musculus
gctgccagacaaagggttcgagaaa

SEQ ID NO: 570665 - DNA, 25 bp, Mus musculus
gctgccagacaatgggttcgagaaa

SEQ ID NO: 570666 - DNA, 25 bp, Mus musculus
gctgccagagtacccaccaaggaat

SEQ ID NO: 570667 - DNA, 25 bp, Mus musculus
gctgccagagtagccaccaaggaat

SEQ ID NO: 570668 - DNA, 25 bp, Mus musculus
gctgccagcaccaagtataattcct

SEQ ID NO: 570669 - DNA, 25 bp, Mus musculus
gctgccagcacctagtataattcct

SEQ ID NO: 570670 - DNA, 25 bp, Mus musculus
gctgccagcattagtaaactctgtg

SEQ ID NO: 570671 - DNA, 25 bp, Mus musculus
gctgccagcatttgtaaactctgtg

SEQ ID NO: 570672 - DNA, 25 bp, Mus musculus
gctgccagcctcaacttatagagtt

SEQ ID NO: 570673 - DNA, 25 bp, Mus musculus
gctgccagcctctacttatagagtt

SEQ ID NO: 570674 - DNA, 25 bp, Mus musculus
gctgccagctatcgaggagattcct

SEQ ID NO: 570675 - DNA, 25 bp, Mus musculus
gctgccagctatggaggagattcct

SEQ ID NO: 570676 - DNA, 25 bp, Mus musculus
gctgccagctttctattctgggtaa

SEQ ID NO: 570677 - DNA, 25 bp, Mus musculus
gctgccagctttgtattctgggtaa

SEQ ID NO: 570678 - DNA, 25 bp, Mus musculus
gctgccaggaacatgtatgtctctg

SEQ ID NO: 570679 - DNA, 25 bp, Mus musculus
gctgccaggaacttgtatgtctctg

SEQ ID NO: 570680 - DNA, 25 bp, Mus musculus
gctgccaggcatagctgctgtgagc

SEQ ID NO: 570681 - DNA, 25 bp, Mus musculus
gctgccaggcattgctgctgtgagc

SEQ ID NO: 570682 - DNA, 25 bp, Mus musculus
gctgccaggctcatcactttcaagg

SEQ ID NO: 570683 - DNA, 25 bp, Mus musculus
gctgccaggctcttcactttcaagg

SEQ ID NO: 570684 - DNA, 25 bp, Mus musculus
gctgccagggtgatcattcatcagt

SEQ ID NO: 570685 - DNA, 25 bp, Mus musculus
gctgccagggtgttcattcatcagt

SEQ ID NO: 570686 - DNA, 25 bp, Mus musculus
gctgccagtataaagtggagccttt

SEQ ID NO: 570687 - DNA, 25 bp, Mus musculus
gctgccagtatatagtggagccttt

SEQ ID NO: 570688 - DNA, 25 bp, Mus musculus
gctgccagtcacaagagaggttcat

SEQ ID NO: 570689 - DNA, 25 bp, Mus musculus
gctgccagtcactagagaggttcat

SEQ ID NO: 570690 - DNA, 25 bp, Mus musculus
gctgccagtgggagcaagcaaacct

SEQ ID NO: 570691 - DNA, 25 bp, Mus musculus
gctgccagtgggtgcaagcaaacct

SEQ ID NO: 570692 - DNA, 25 bp, Mus musculus
gctgccagtgtaaaatctgagactc

SEQ ID NO: 570693 - DNA, 25 bp, Mus musculus
gctgccagtgtataatctgagactc

SEQ ID NO: 570694 - DNA, 25 bp, Mus musculus
gctgccagtgttaagttctagactg

SEQ ID NO: 570695 - DNA, 25 bp, Mus musculus
gctgccagtgtttagttctagactg

SEQ ID NO: 570696 - DNA, 25 bp, Mus musculus
gctgccagttcaaggtgttcattga

SEQ ID NO: 570697 - DNA, 25 bp, Mus musculus
gctgccagttcatggtgttcattga

SEQ ID NO: 570698 - DNA, 25 bp, Mus musculus
gctgccagtttcatcagtggcgtaa

SEQ ID NO: 570699 - DNA, 25 bp, Mus musculus
gctgccagtttcttcagtggcgtaa

SEQ ID NO: 570700 - DNA, 25 bp, Mus musculus
gctgccataggcaccaaggtcatga

SEQ ID NO: 570701 - DNA, 25 bp, Mus musculus
gctgccataggctccaaggtcatga

SEQ ID NO: 570702 - DNA, 25 bp, Mus musculus
gctgccatatgacgatgtcgccatt

SEQ ID NO: 570703 - DNA, 25 bp, Mus musculus
gctgccatatgaggatgtcgccatt

SEQ ID NO: 570704 - DNA, 25 bp, Mus musculus
gctgccatattactgtccagttgca

SEQ ID NO: 570705 - DNA, 25 bp, Mus musculus
gctgccatattagtgtccagttgca

SEQ ID NO: 570706 - DNA, 25 bp, Mus musculus
gctgccatcatcaatctgctcagat

SEQ ID NO: 570707 - DNA, 25 bp, Mus musculus
gctgccatcatctatctgctcagat

SEQ ID NO: 570708 - DNA, 25 bp, Mus musculus
gctgccatctctatgtggtggagaa

SEQ ID NO: 570709 - DNA, 25 bp, Mus musculus
gctgccatctctttgtggtggagaa

SEQ ID NO: 570710 - DNA, 25 bp, Mus musculus
gctgccatctgcaggagtccaaagg

SEQ ID NO: 570711 - DNA, 25 bp, Mus musculus
gctgccatctgctggagtccaaagg

SEQ ID NO: 570712 - DNA, 25 bp, Mus musculus
gctgccatctttagctaaattataa

SEQ ID NO: 570713 - DNA, 25 bp, Mus musculus
gctgccatcttttgctaaattataa

SEQ ID NO: 570714 - DNA, 25 bp, Mus musculus
gctgccatgatgctggatgatcagt

SEQ ID NO: 570715 - DNA, 25 bp, Mus musculus
gctgccatgatggtggatgatcagt

SEQ ID NO: 570716 - DNA, 25 bp, Mus musculus
gctgccatgcagcatagcttgatga

SEQ ID NO: 570717 - DNA, 25 bp, Mus musculus
gctgccatgcaggatagcttgatga

SEQ ID NO: 570718 - DNA, 25 bp, Mus musculus
gctgccatgccaagcagtgagttgt

SEQ ID NO: 570719 - DNA, 25 bp, Mus musculus
gctgccatgccatgcagtgagttgt

SEQ ID NO: 570720 - DNA, 25 bp, Mus musculus
gctgccatggaacagaacctacctg

SEQ ID NO: 570721 - DNA, 25 bp, Mus musculus
gctgccatggaagagaacctacctg

SEQ ID NO: 570722 - DNA, 25 bp, Mus musculus
gctgccatgtgtatgcacttacaat

SEQ ID NO: 570723 - DNA, 25 bp, Mus musculus
gctgccatgtgtttgcacttacaat

SEQ ID NO: 570724 - DNA, 25 bp, Mus musculus
gctgccattcctctgaccaatttgg

SEQ ID NO: 570725 - DNA, 25 bp, Mus musculus
gctgccattcctgtgaccaatttgg

SEQ ID NO: 570726 - DNA, 25 bp, Mus musculus
gctgccattgaaccataccttattt

SEQ ID NO: 570727 - DNA, 25 bp, Mus musculus
gctgccattgaagcataccttattt

SEQ ID NO: 570728 - DNA, 25 bp, Mus musculus
gctgccattgacatggagacggatg

SEQ ID NO: 570729 - DNA, 25 bp, Mus musculus
gctgccattgacttggagacggatg

SEQ ID NO: 570730 - DNA, 25 bp, Mus musculus
gctgccattgatccttctcatgact

SEQ ID NO: 570731 - DNA, 25 bp, Mus musculus
gctgccattgatgcttctcatgact

SEQ ID NO: 570732 - DNA, 25 bp, Mus musculus
gctgccattggacctatgctttgta

SEQ ID NO: 570733 - DNA, 25 bp, Mus musculus
gctgccattggagctatgctttgta

SEQ ID NO: 570734 - DNA, 25 bp, Mus musculus
gctgccattgttaaaatgccaataa

SEQ ID NO: 570735 - DNA, 25 bp, Mus musculus
gctgccattgtttaaatgccaataa

SEQ ID NO: 570736 - DNA, 25 bp, Mus musculus
gctgccatttacagacaaacctggt

SEQ ID NO: 570737 - DNA, 25 bp, Mus musculus
gctgccatttactgacaaacctggt

SEQ ID NO: 570738 - DNA, 25 bp, Mus musculus
gctgccatttccagtgtgtacattt

SEQ ID NO: 570739 - DNA, 25 bp, Mus musculus
gctgccatttcctgtgtgtacattt

SEQ ID NO: 570740 - DNA, 25 bp, Mus musculus
gctgccatttgaattcctaacttgt

SEQ ID NO: 570741 - DNA, 25 bp, Mus musculus
gctgccatttgatttcctaacttgt

SEQ ID NO: 570742 - DNA, 25 bp, Mus musculus
gctgcccaaactagaggtccagagt

SEQ ID NO: 570743 - DNA, 25 bp, Mus musculus
gctgcccaaacttgaggtccagagt

SEQ ID NO: 570744 - DNA, 25 bp, Mus musculus
gctgcccacagtatcaggcatttga

SEQ ID NO: 570745 - DNA, 25 bp, Mus musculus
gctgcccacagtttcaggcatttga

SEQ ID NO: 570746 - DNA, 25 bp, Mus musculus
gctgcccacccacatggattacaag

SEQ ID NO: 570747 - DNA, 25 bp, Mus musculus
gctgcccacccagatggattacaag

SEQ ID NO: 570748 - DNA, 25 bp, Mus musculus
gctgcccacgctccaaaaactgtta

SEQ ID NO: 570749 - DNA, 25 bp, Mus musculus
gctgcccacgctgcaaaaactgtta

SEQ ID NO: 570750 - DNA, 25 bp, Mus musculus
gctgcccactcccttttgtaaaaga

SEQ ID NO: 570751 - DNA, 25 bp, Mus musculus
gctgcccactccgttttgtaaaaga

SEQ ID NO: 570752 - DNA, 25 bp, Mus musculus
gctgcccagctgacagaggaggttc

SEQ ID NO: 570753 - DNA, 25 bp, Mus musculus
gctgcccagctgtcagaggaggttc

SEQ ID NO: 570754 - DNA, 25 bp, Mus musculus
gctgcccaggcaaagtcactgaaca

SEQ ID NO: 570755 - DNA, 25 bp, Mus musculus
gctgcccaggcatagtcactgaaca

SEQ ID NO: 570756 - DNA, 25 bp, Mus musculus
gctgcccataatcaaatgttcccag

SEQ ID NO: 570757 - DNA, 25 bp, Mus musculus
gctgcccataatgaaatgttcccag

SEQ ID NO: 570758 - DNA, 25 bp, Mus musculus
gctgcccatatgacctttgccatca

SEQ ID NO: 570759 - DNA, 25 bp, Mus musculus
gctgcccatatgcaatgttgagatt

SEQ ID NO: 570760 - DNA, 25 bp, Mus musculus
gctgcccatatggaatgttgagatt

SEQ ID NO: 570761 - DNA, 25 bp, Mus musculus
gctgcccatatgtcctttgccatca

SEQ ID NO: 570762 - DNA, 25 bp, Mus musculus
gctgcccatcacaggaaatctgcat

SEQ ID NO: 570763 - DNA, 25 bp, Mus musculus
gctgcccatcactggaaatctgcat

SEQ ID NO: 570764 - DNA, 25 bp, Mus musculus
gctgcccatcagcaccaatacagat

SEQ ID NO: 570765 - DNA, 25 bp, Mus musculus
gctgcccatcaggaccaatacagat

SEQ ID NO: 570766 - DNA, 25 bp, Mus musculus
gctgcccatgcccagacagaagtag

SEQ ID NO: 570767 - DNA, 25 bp, Mus musculus
gctgcccatgccgagacagaagtag

SEQ ID NO: 570768 - DNA, 25 bp, Mus musculus
gctgcccatggcattatttatgagt

SEQ ID NO: 570769 - DNA, 25 bp, Mus musculus
gctgcccatggctttatttatgagt

SEQ ID NO: 570770 - DNA, 25 bp, Mus musculus
gctgcccattttctgagatttttat

SEQ ID NO: 570771 - DNA, 25 bp, Mus musculus
gctgcccattttgtgagatttttat

SEQ ID NO: 570772 - DNA, 25 bp, Mus musculus
gctgccccaacacactatgtaaaga

SEQ ID NO: 570773 - DNA, 25 bp, Mus musculus
gctgccccaacagactatgtaaaga

SEQ ID NO: 570774 - DNA, 25 bp, Mus musculus
gctgccccagtaacagactgatctt

SEQ ID NO: 570775 - DNA, 25 bp, Mus musculus
gctgccccagtatcagactgatctt

SEQ ID NO: 570776 - DNA, 25 bp, Mus musculus
gctgccccagttcaggaaatgttta

SEQ ID NO: 570777 - DNA, 25 bp, Mus musculus
gctgccccagttgaggaaatgttta

SEQ ID NO: 570778 - DNA, 25 bp, Mus musculus
gctgccccgatgaactgactaactt

SEQ ID NO: 570779 - DNA, 25 bp, Mus musculus
gctgccccgatgtactgactaactt

SEQ ID NO: 570780 - DNA, 25 bp, Mus musculus
gctgccccggatacggtgcggaaaa

SEQ ID NO: 570781 - DNA, 25 bp, Mus musculus
gctgccccggattcggtgcggaaaa

SEQ ID NO: 570782 - DNA, 25 bp, Mus musculus
gctgcccctctcagggatgacaaaa

SEQ ID NO: 570783 - DNA, 25 bp, Mus musculus
gctgcccctctctgggatgacaaaa

SEQ ID NO: 570784 - DNA, 25 bp, Mus musculus
gctgcccctggacattctggagttt

SEQ ID NO: 570785 - DNA, 25 bp, Mus musculus
gctgcccctggagattctggagttt

SEQ ID NO: 570786 - DNA, 25 bp, Mus musculus
gctgccccttgcaagccataacgtg

SEQ ID NO: 570787 - DNA, 25 bp, Mus musculus
gctgccccttgctagccataacgtg

SEQ ID NO: 570788 - DNA, 25 bp, Mus musculus
gctgcccgaaggagcctttgggact

SEQ ID NO: 570789 - DNA, 25 bp, Mus musculus
gctgcccgaaggtgcctttgggact

SEQ ID NO: 570790 - DNA, 25 bp, Mus musculus
gctgcccgagtgatatctgctgctg

SEQ ID NO: 570791 - DNA, 25 bp, Mus musculus
gctgcccgagtgttatctgctgctg

SEQ ID NO: 570792 - DNA, 25 bp, Mus musculus
gctgcccgggacaaagaggagattt

SEQ ID NO: 570793 - DNA, 25 bp, Mus musculus
gctgcccgggactaagaggagattt

SEQ ID NO: 570794 - DNA, 25 bp, Mus musculus
gctgcccgttttaatgctttatgta

SEQ ID NO: 570795 - DNA, 25 bp, Mus musculus
gctgcccgtttttatgctttatgta

SEQ ID NO: 570796 - DNA, 25 bp, Mus musculus
gctgccctaaaaagtctcacgacgt

SEQ ID NO: 570797 - DNA, 25 bp, Mus musculus
gctgccctaaaatgtctcacgacgt

SEQ ID NO: 570798 - DNA, 25 bp, Mus musculus
gctgccctaactctgtatgggtaga

SEQ ID NO: 570799 - DNA, 25 bp, Mus musculus
gctgccctaactgtgtatgggtaga

SEQ ID NO: 570800 - DNA, 25 bp, Mus musculus
gctgccctaaggcacagagagccta

SEQ ID NO: 570801 - DNA, 25 bp, Mus musculus
gctgccctaagggacagagagccta

SEQ ID NO: 570802 - DNA, 25 bp, Mus musculus
gctgccctacacagagttttttggt

SEQ ID NO: 570803 - DNA, 25 bp, Mus musculus
gctgccctacactgagttttttggt

SEQ ID NO: 570804 - DNA, 25 bp, Mus musculus
gctgccctagagacacttcatgtaa

SEQ ID NO: 570805 - DNA, 25 bp, Mus musculus
gctgccctagagtcacttcatgtaa

SEQ ID NO: 570806 - DNA, 25 bp, Mus musculus
gctgccctatgaagactgtgtgttt

SEQ ID NO: 570807 - DNA, 25 bp, Mus musculus
gctgccctatgatgactgtgtgttt

SEQ ID NO: 570808 - DNA, 25 bp, Mus musculus
gctgccctcaacctgggtcagagaa

SEQ ID NO: 570809 - DNA, 25 bp, Mus musculus
gctgccctcaacgtgggtcagagaa

SEQ ID NO: 570810 - DNA, 25 bp, Mus musculus
gctgccctcagcaattactgtggat

SEQ ID NO: 570811 - DNA, 25 bp, Mus musculus
gctgccctcagctattactgtggat

SEQ ID NO: 570812 - DNA, 25 bp, Mus musculus
gctgccctcataaatatataacgaa

SEQ ID NO: 570813 - DNA, 25 bp, Mus musculus
gctgccctcatatatatataacgaa

SEQ ID NO: 570814 - DNA, 25 bp, Mus musculus
gctgccctccaaatccaacggagat

SEQ ID NO: 570815 - DNA, 25 bp, Mus musculus
gctgccctccaattccaacggagat

SEQ ID NO: 570816 - DNA, 25 bp, Mus musculus
gctgccctccatcgcatttataagg

SEQ ID NO: 570817 - DNA, 25 bp, Mus musculus
gctgccctccatggcatttataagg

SEQ ID NO: 570818 - DNA, 25 bp, Mus musculus
gctgccctcggaaatccacaggatt

SEQ ID NO: 570819 - DNA, 25 bp, Mus musculus
gctgccctcggatatccacaggatt

SEQ ID NO: 570820 - DNA, 25 bp, Mus musculus
gctgccctctgcaggtcatgggtga

SEQ ID NO: 570821 - DNA, 25 bp, Mus musculus
gctgccctctgctggtcatgggtga

SEQ ID NO: 570822 - DNA, 25 bp, Mus musculus
gctgccctgattatgaactctataa

SEQ ID NO: 570823 - DNA, 25 bp, Mus musculus
gctgccctgattttgaactctataa

SEQ ID NO: 570824 - DNA, 25 bp, Mus musculus
gctgccctgcctagctgcaggtctg

SEQ ID NO: 570825 - DNA, 25 bp, Mus musculus
gctgccctgccttgctgcaggtctg

SEQ ID NO: 570826 - DNA, 25 bp, Mus musculus
gctgccctgctgacctagtagtgtg

SEQ ID NO: 570827 - DNA, 25 bp, Mus musculus
gctgccctgctgtcctagtagtgtg

SEQ ID NO: 570828 - DNA, 25 bp, Mus musculus
gctgccctgggaagtgtgacgtaca

SEQ ID NO: 570829 - DNA, 25 bp, Mus musculus
gctgccctgggacctatttgattat

SEQ ID NO: 570830 - DNA, 25 bp, Mus musculus
gctgccctgggagctatttgattat

SEQ ID NO: 570831 - DNA, 25 bp, Mus musculus
gctgccctgggatgtgtgacgtaca

SEQ ID NO: 570832 - DNA, 25 bp, Mus musculus
gctgccctgggcaaaggcatgcatg

SEQ ID NO: 570833 - DNA, 25 bp, Mus musculus
gctgccctgggctaaggcatgcatg

SEQ ID NO: 570834 - DNA, 25 bp, Mus musculus
gctgccctgggtccaagagttcaac

SEQ ID NO: 570835 - DNA, 25 bp, Mus musculus
gctgccctgggtgcaagagttcaac

SEQ ID NO: 570836 - DNA, 25 bp, Mus musculus
gctgccctgtcaacctgttgtgtgg

SEQ ID NO: 570837 - DNA, 25 bp, Mus musculus
gctgccctgtcatcctgttgtgtgg

SEQ ID NO: 570838 - DNA, 25 bp, Mus musculus
gctgcccttcaacacattttgtagt

SEQ ID NO: 570839 - DNA, 25 bp, Mus musculus
gctgcccttcaagacattttgtagt

SEQ ID NO: 570840 - DNA, 25 bp, Mus musculus
gctgcccttctgaaccgtaaataca

SEQ ID NO: 570841 - DNA, 25 bp, Mus musculus
gctgcccttctgtaccgtaaataca

SEQ ID NO: 570842 - DNA, 25 bp, Mus musculus
gctgcccttgaactcgtggtgaagc

SEQ ID NO: 570843 - DNA, 25 bp, Mus musculus
gctgcccttgaagtcgtggtgaagc

SEQ ID NO: 570844 - DNA, 25 bp, Mus musculus
gctgcccttggtatgagacccaaaa

SEQ ID NO: 570845 - DNA, 25 bp, Mus musculus
gctgcccttggtttgagacccaaaa

SEQ ID NO: 570846 - DNA, 25 bp, Mus musculus
gctgcccttgtgagcggtgttgtct

SEQ ID NO: 570847 - DNA, 25 bp, Mus musculus
gctgcccttgtgagcggtgttgttt

SEQ ID NO: 570848 - DNA, 25 bp, Mus musculus
gctgcccttgtgtgcggtgttgtct

SEQ ID NO: 570849 - DNA, 25 bp, Mus musculus
gctgcccttgtgtgcggtgttgttt

SEQ ID NO: 570850 - DNA, 25 bp, Mus musculus
gctgccctttcaagactttacaata

SEQ ID NO: 570851 - DNA, 25 bp, Mus musculus
gctgccctttcatgactttacaata

SEQ ID NO: 570852 - DNA, 25 bp, Mus musculus
gctgcccttttgaaacttctttttg

SEQ ID NO: 570853 - DNA, 25 bp, Mus musculus
gctgcccttttgtaacttctttttg

SEQ ID NO: 570854 - DNA, 25 bp, Mus musculus
gctgccgaccctatatgaacagtca

SEQ ID NO: 570855 - DNA, 25 bp, Mus musculus
gctgccgaccctttatgaacagtca

SEQ ID NO: 570856 - DNA, 25 bp, Mus musculus
gctgccgagcacaaagccatcgtga

SEQ ID NO: 570857 - DNA, 25 bp, Mus musculus
gctgccgagcactaagccatcgtga

SEQ ID NO: 570858 - DNA, 25 bp, Mus musculus
gctgccgagtgtcttgatcctcctt

SEQ ID NO: 570859 - DNA, 25 bp, Mus musculus
gctgccgagtgtgttgatcctcctt

SEQ ID NO: 570860 - DNA, 25 bp, Mus musculus
gctgccgatgttcacttcattgtta

SEQ ID NO: 570861 - DNA, 25 bp, Mus musculus
gctgccgatgttgacttcattgtta

SEQ ID NO: 570862 - DNA, 25 bp, Mus musculus
gctgccgattctcttaaacgaacgt

SEQ ID NO: 570863 - DNA, 25 bp, Mus musculus
gctgccgattctgttaaacgaacgt

SEQ ID NO: 570864 - DNA, 25 bp, Mus musculus
gctgccgccacaatgattaatctga

SEQ ID NO: 570865 - DNA, 25 bp, Mus musculus
gctgccgccacattgattaatctga

SEQ ID NO: 570866 - DNA, 25 bp, Mus musculus
gctgccgcctggatggaccatacgc

SEQ ID NO: 570867 - DNA, 25 bp, Mus musculus
gctgccgcctggttggaccatacgc

SEQ ID NO: 570868 - DNA, 25 bp, Mus musculus
gctgccgcgggaagcaagtcagtaa

SEQ ID NO: 570869 - DNA, 25 bp, Mus musculus
gctgccgcgggatgcaagtcagtaa

SEQ ID NO: 570870 - DNA, 25 bp, Mus musculus
gctgccgctgcacgttttatagttc

SEQ ID NO: 570871 - DNA, 25 bp, Mus musculus
gctgccgctgcaggttttatagttc

SEQ ID NO: 570872 - DNA, 25 bp, Mus musculus
gctgccgctgtgaaaagggagccca

SEQ ID NO: 570873 - DNA, 25 bp, Mus musculus
gctgccgctgtgtaaagggagccca

SEQ ID NO: 570874 - DNA, 25 bp, Mus musculus
gctgccggaaagagcccagaagact

SEQ ID NO: 570875 - DNA, 25 bp, Mus musculus
gctgccggaaagtgcccagaagact

SEQ ID NO: 570876 - DNA, 25 bp, Mus musculus
gctgccggcactacgaggtggctaa

SEQ ID NO: 570877 - DNA, 25 bp, Mus musculus
gctgccggcacttcgaggtggctaa

SEQ ID NO: 570878 - DNA, 25 bp, Mus musculus
gctgccggcatcagaactctttggg

SEQ ID NO: 570879 - DNA, 25 bp, Mus musculus
gctgccggcatctgaactctttggg

SEQ ID NO: 570880 - DNA, 25 bp, Mus musculus
gctgccggcatgcacaacacggtga

SEQ ID NO: 570881 - DNA, 25 bp, Mus musculus
gctgccggcatggacaacacggtga

SEQ ID NO: 570882 - DNA, 25 bp, Mus musculus
gctgccggctacagagcgactgtgc

SEQ ID NO: 570883 - DNA, 25 bp, Mus musculus
gctgccggctactgagcgactgtgc

SEQ ID NO: 570884 - DNA, 25 bp, Mus musculus
gctgccgtagcacttagtctttaca

SEQ ID NO: 570885 - DNA, 25 bp, Mus musculus
gctgccgtagcagttagtctttaca

SEQ ID NO: 570886 - DNA, 25 bp, Mus musculus
gctgccgtcagcatatacatataaa

SEQ ID NO: 570887 - DNA, 25 bp, Mus musculus
gctgccgtcagcttatacatataaa

SEQ ID NO: 570888 - DNA, 25 bp, Mus musculus
gctgccgtcgatcaggacgtcgtca

SEQ ID NO: 570889 - DNA, 25 bp, Mus musculus
gctgccgtcgatgaggacgtcgtca

SEQ ID NO: 570890 - DNA, 25 bp, Mus musculus
gctgccgtcgctatcttaactgagg

SEQ ID NO: 570891 - DNA, 25 bp, Mus musculus
gctgccgtcgctttcttaactgagg

SEQ ID NO: 570892 - DNA, 25 bp, Mus musculus
gctgccgtgctgctatgatattcta

SEQ ID NO: 570893 - DNA, 25 bp, Mus musculus
gctgccgtgctggtatgatattcta

SEQ ID NO: 570894 - DNA, 25 bp, Mus musculus
gctgccgtgtgcaggtgacatcatg

SEQ ID NO: 570895 - DNA, 25 bp, Mus musculus
gctgccgtgtgctggtgacatcatg

SEQ ID NO: 570896 - DNA, 25 bp, Mus musculus
gctgccgtgtgtcgcgtatccagaa

SEQ ID NO: 570897 - DNA, 25 bp, Mus musculus
gctgccgtgtgtggcgtatccagaa

SEQ ID NO: 570898 - DNA, 25 bp, Mus musculus
gctgccgttattatcttacttcttc

SEQ ID NO: 570899 - DNA, 25 bp, Mus musculus
gctgccgttattttcttacttcttc

SEQ ID NO: 570900 - DNA, 25 bp, Mus musculus
gctgccgttgaccttcaaccgcaaa

SEQ ID NO: 570901 - DNA, 25 bp, Mus musculus
gctgccgttgacgttcaaccgcaaa

SEQ ID NO: 570902 - DNA, 25 bp, Mus musculus
gctgccgtttgtcggattttcgtac

SEQ ID NO: 570903 - DNA, 25 bp, Mus musculus
gctgccgtttgtgggattttcgtac

SEQ ID NO: 570904 - DNA, 25 bp, Mus musculus
gctgcctaacctcaacaagagagtt

SEQ ID NO: 570905 - DNA, 25 bp, Mus musculus
gctgcctaacctgaacaagagagtt

SEQ ID NO: 570906 - DNA, 25 bp, Mus musculus
gctgcctacacgagctttagctgta

SEQ ID NO: 570907 - DNA, 25 bp, Mus musculus
gctgcctacacgtgctttagctgta

SEQ ID NO: 570908 - DNA, 25 bp, Mus musculus
gctgcctacattcagggagactcat

SEQ ID NO: 570909 - DNA, 25 bp, Mus musculus
gctgcctacattgagggagactcat

SEQ ID NO: 570910 - DNA, 25 bp, Mus musculus
gctgcctaccagactctgtatgaga

SEQ ID NO: 570911 - DNA, 25 bp, Mus musculus
gctgcctaccagtctctgtatgaga

SEQ ID NO: 570912 - DNA, 25 bp, Mus musculus
gctgcctagcccaattggagaggag

SEQ ID NO: 570913 - DNA, 25 bp, Mus musculus
gctgcctagccctattggagaggag

SEQ ID NO: 570914 - DNA, 25 bp, Mus musculus
gctgcctaggagacagggacttcaa

SEQ ID NO: 570915 - DNA, 25 bp, Mus musculus
gctgcctaggagtcagggacttcaa

SEQ ID NO: 570916 - DNA, 25 bp, Mus musculus
gctgcctatcttactctgtttttaa

SEQ ID NO: 570917 - DNA, 25 bp, Mus musculus
gctgcctatctttctctgtttttaa

SEQ ID NO: 570918 - DNA, 25 bp, Mus musculus
gctgcctatggcaccacgaaagata

SEQ ID NO: 570919 - DNA, 25 bp, Mus musculus
gctgcctatggctccacgaaagata

SEQ ID NO: 570920 - DNA, 25 bp, Mus musculus
gctgcctcaaggctatcgcatggag

SEQ ID NO: 570921 - DNA, 25 bp, Mus musculus
gctgcctcaagggtatcgcatggag

SEQ ID NO: 570922 - DNA, 25 bp, Mus musculus
gctgcctcaggaccctatgcaataa

SEQ ID NO: 570923 - DNA, 25 bp, Mus musculus
gctgcctcaggagcctatgcaataa

SEQ ID NO: 570924 - DNA, 25 bp, Mus musculus
gctgcctcaggcaagttgtattttt

SEQ ID NO: 570925 - DNA, 25 bp, Mus musculus
gctgcctcaggctagttgtattttt

SEQ ID NO: 570926 - DNA, 25 bp, Mus musculus
gctgcctccatccactatgaagaat

SEQ ID NO: 570927 - DNA, 25 bp, Mus musculus
gctgcctccatcgactatgaagaat

SEQ ID NO: 570928 - DNA, 25 bp, Mus musculus
gctgcctccgggacatactggatgg

SEQ ID NO: 570929 - DNA, 25 bp, Mus musculus
gctgcctccgggtcatactggatgg

SEQ ID NO: 570930 - DNA, 25 bp, Mus musculus
gctgcctcctgtctagccgggagtt

SEQ ID NO: 570931 - DNA, 25 bp, Mus musculus
gctgcctcctgtgtagccgggagtt

SEQ ID NO: 570932 - DNA, 25 bp, Mus musculus
gctgcctcctttatgtgtggataca

SEQ ID NO: 570933 - DNA, 25 bp, Mus musculus
gctgcctcctttcataaccatgcaa

SEQ ID NO: 570934 - DNA, 25 bp, Mus musculus
gctgcctcctttgataaccatgcaa

SEQ ID NO: 570935 - DNA, 25 bp, Mus musculus
gctgcctcctttttgtgtggataca

SEQ ID NO: 570936 - DNA, 25 bp, Mus musculus
gctgcctcgaccaatcaggttgaat

SEQ ID NO: 570937 - DNA, 25 bp, Mus musculus
gctgcctcgacctatcaggttgaat

SEQ ID NO: 570938 - DNA, 25 bp, Mus musculus
gctgcctcggaccactgaaagggat

SEQ ID NO: 570939 - DNA, 25 bp, Mus musculus
gctgcctcggacgactgaaagggat

SEQ ID NO: 570940 - DNA, 25 bp, Mus musculus
gctgcctctcatctggttcaatgga

SEQ ID NO: 570941 - DNA, 25 bp, Mus musculus
gctgcctctcatgtggttcaatgga

SEQ ID NO: 570942 - DNA, 25 bp, Mus musculus
gctgcctctggtcgcctgtcattgg

SEQ ID NO: 570943 - DNA, 25 bp, Mus musculus
gctgcctctggtggcctgtcattgg

SEQ ID NO: 570944 - DNA, 25 bp, Mus musculus
gctgcctctgtgaagtctggatcta

SEQ ID NO: 570945 - DNA, 25 bp, Mus musculus
gctgcctctgtgtagtctggatcta

SEQ ID NO: 570946 - DNA, 25 bp, Mus musculus
gctgcctgaaacaaaaatccggttc

SEQ ID NO: 570947 - DNA, 25 bp, Mus musculus
gctgcctgaaactaaaatccggttc

SEQ ID NO: 570948 - DNA, 25 bp, Mus musculus
gctgcctgacctagtatgtctgata

SEQ ID NO: 570949 - DNA, 25 bp, Mus musculus
gctgcctgaccttgtatgtctgata

SEQ ID NO: 570950 - DNA, 25 bp, Mus musculus
gctgcctgacgtctatggtgtattc

SEQ ID NO: 570951 - DNA, 25 bp, Mus musculus
gctgcctgacgtgtatggtgtattc

SEQ ID NO: 570952 - DNA, 25 bp, Mus musculus
gctgcctgactccacagattgtgag

SEQ ID NO: 570953 - DNA, 25 bp, Mus musculus
gctgcctgactcgacagattgtgag

SEQ ID NO: 570954 - DNA, 25 bp, Mus musculus
gctgcctgagagattcagtcttctg

SEQ ID NO: 570955 - DNA, 25 bp, Mus musculus
gctgcctgagagtttcagtcttctg

SEQ ID NO: 570956 - DNA, 25 bp, Mus musculus
gctgcctgagatcagttcaagggcc

SEQ ID NO: 570957 - DNA, 25 bp, Mus musculus
gctgcctgagatgagttcaagggcc

SEQ ID NO: 570958 - DNA, 25 bp, Mus musculus
gctgcctgaggaagctacggactct

SEQ ID NO: 570959 - DNA, 25 bp, Mus musculus
gctgcctgaggatgctacggactct

SEQ ID NO: 570960 - DNA, 25 bp, Mus musculus
gctgcctgattaatagtcttgccct

SEQ ID NO: 570961 - DNA, 25 bp, Mus musculus
gctgcctgattattagtcttgccct

SEQ ID NO: 570962 - DNA, 25 bp, Mus musculus
gctgcctgcaatccttagcatatgg

SEQ ID NO: 570963 - DNA, 25 bp, Mus musculus
gctgcctgcaatgcttagcatatgg

SEQ ID NO: 570964 - DNA, 25 bp, Mus musculus
gctgcctgcctaaaatctgatcaga

SEQ ID NO: 570965 - DNA, 25 bp, Mus musculus
gctgcctgcctataatctgatcaga

SEQ ID NO: 570966 - DNA, 25 bp, Mus musculus
gctgcctgcgatcaacgaagtacct

SEQ ID NO: 570967 - DNA, 25 bp, Mus musculus
gctgcctgcgatgaacgaagtacct

SEQ ID NO: 570968 - DNA, 25 bp, Mus musculus
gctgcctgctggctatagccttgaa

SEQ ID NO: 570969 - DNA, 25 bp, Mus musculus
gctgcctgctgggtatagccttgaa

SEQ ID NO: 570970 - DNA, 25 bp, Mus musculus
gctgcctgcttaatcctggagatga

SEQ ID NO: 570971 - DNA, 25 bp, Mus musculus
gctgcctgcttattcctggagatga

SEQ ID NO: 570972 - DNA, 25 bp, Mus musculus
gctgcctgcttgatagtcaccttga

SEQ ID NO: 570973 - DNA, 25 bp, Mus musculus
gctgcctgcttgttagtcaccttga

SEQ ID NO: 570974 - DNA, 25 bp, Mus musculus
gctgcctggactattttgttagcaa

SEQ ID NO: 570975 - DNA, 25 bp, Mus musculus
gctgcctggacttttttgttagcaa

SEQ ID NO: 570976 - DNA, 25 bp, Mus musculus
gctgcctggctacagttatctgttt

SEQ ID NO: 570977 - DNA, 25 bp, Mus musculus
gctgcctggctagagttatctgttt

SEQ ID NO: 570978 - DNA, 25 bp, Mus musculus
gctgcctgtacaaaagcttgaccat

SEQ ID NO: 570979 - DNA, 25 bp, Mus musculus
gctgcctgtacataagcttgaccat

SEQ ID NO: 570980 - DNA, 25 bp, Mus musculus
gctgcctgtcgtcaagtgcaagcga

SEQ ID NO: 570981 - DNA, 25 bp, Mus musculus
gctgcctgtcgtgaagtgcaagcga

SEQ ID NO: 570982 - DNA, 25 bp, Mus musculus
gctgcctgtgcactgtgtgactcac

SEQ ID NO: 570983 - DNA, 25 bp, Mus musculus
gctgcctgtgcagtgtgtgactcac

SEQ ID NO: 570984 - DNA, 25 bp, Mus musculus
gctgcctgtgtacaagtcacttggg

SEQ ID NO: 570985 - DNA, 25 bp, Mus musculus
gctgcctgtgtagaagtcacttggg

SEQ ID NO: 570986 - DNA, 25 bp, Mus musculus
gctgccttaagtcaatgcacactat

SEQ ID NO: 570987 - DNA, 25 bp, Mus musculus
gctgccttaagtgaatgcacactat

SEQ ID NO: 570988 - DNA, 25 bp, Mus musculus
gctgccttacaccagctgtttgaaa

SEQ ID NO: 570989 - DNA, 25 bp, Mus musculus
gctgccttacacgagctgtttgaaa

SEQ ID NO: 570990 - DNA, 25 bp, Mus musculus
gctgccttactacgagttctacgag

SEQ ID NO: 570991 - DNA, 25 bp, Mus musculus
gctgccttactaggagttctacgag

SEQ ID NO: 570992 - DNA, 25 bp, Mus musculus
gctgccttagctacaggaaccttga

SEQ ID NO: 570993 - DNA, 25 bp, Mus musculus
gctgccttagcttcaggaaccttga

SEQ ID NO: 570994 - DNA, 25 bp, Mus musculus
gctgccttatatcactgcatgccag

SEQ ID NO: 570995 - DNA, 25 bp, Mus musculus
gctgccttatatgactgcatgccag

SEQ ID NO: 570996 - DNA, 25 bp, Mus musculus
gctgccttcgcaatgcattctggga

SEQ ID NO: 570997 - DNA, 25 bp, Mus musculus
gctgccttcgcattgcattctggga

SEQ ID NO: 570998 - DNA, 25 bp, Mus musculus
gctgccttctgcactggatgagtat

SEQ ID NO: 570999 - DNA, 25 bp, Mus musculus
gctgccttctgctctggatgagtat

SEQ ID NO: 571000 - DNA, 25 bp, Mus musculus
gctgccttctttctagaaacatctc

SEQ ID NO: 571001 - DNA, 25 bp, Mus musculus
gctgccttctttgtagaaacatctc

SEQ ID NO: 571002 - DNA, 25 bp, Mus musculus
gctgccttgagcaaaatgtcttcta

SEQ ID NO: 571003 - DNA, 25 bp, Mus musculus
gctgccttgagctaaatgtcttcta

SEQ ID NO: 571004 - DNA, 25 bp, Mus musculus
gctgccttgcagaaaacctaggttt

SEQ ID NO: 571005 - DNA, 25 bp, Mus musculus
gctgccttgcagcaagagacagatg

SEQ ID NO: 571006 - DNA, 25 bp, Mus musculus
gctgccttgcaggaagagacagatg

SEQ ID NO: 571007 - DNA, 25 bp, Mus musculus
gctgccttgcagtaaacctaggttt

SEQ ID NO: 571008 - DNA, 25 bp, Mus musculus
gctgccttgctacagatggtgccag

SEQ ID NO: 571009 - DNA, 25 bp, Mus musculus
gctgccttgctagagatggtgccag

SEQ ID NO: 571010 - DNA, 25 bp, Mus musculus
gctgccttggaaaataatgctgcct

SEQ ID NO: 571011 - DNA, 25 bp, Mus musculus
gctgccttggaatataatgctgcct

SEQ ID NO: 571012 - DNA, 25 bp, Mus musculus
gctgccttgttcatgttgggtatac

SEQ ID NO: 571013 - DNA, 25 bp, Mus musculus
gctgccttgttcttgttgggtatac

SEQ ID NO: 571014 - DNA, 25 bp, Mus musculus
gctgcctttactaagatgttactgg

SEQ ID NO: 571015 - DNA, 25 bp, Mus musculus
gctgcctttacttagatgttactgg

SEQ ID NO: 571016 - DNA, 25 bp, Mus musculus
gctgcctttgcgaatgactcagaag

SEQ ID NO: 571017 - DNA, 25 bp, Mus musculus
gctgcctttgcgagtttgagtacca

SEQ ID NO: 571018 - DNA, 25 bp, Mus musculus
gctgcctttgcgtatgactcagaag

SEQ ID NO: 571019 - DNA, 25 bp, Mus musculus
gctgcctttgcgtgtttgagtacca

SEQ ID NO: 571020 - DNA, 25 bp, Mus musculus
gctgcctttggcaagatgatattaa

SEQ ID NO: 571021 - DNA, 25 bp, Mus musculus
gctgcctttggcagcagagcctttg

SEQ ID NO: 571022 - DNA, 25 bp, Mus musculus
gctgcctttggctagatgatattaa

SEQ ID NO: 571023 - DNA, 25 bp, Mus musculus
gctgcctttggctgcagagcctttg

SEQ ID NO: 571024 - DNA, 25 bp, Mus musculus
gctgcctttggtcaactccataaag

SEQ ID NO: 571025 - DNA, 25 bp, Mus musculus
gctgcctttggtgaactccataaag

SEQ ID NO: 571026 - DNA, 25 bp, Mus musculus
gctgccttttgaattttatcctctg

SEQ ID NO: 571027 - DNA, 25 bp, Mus musculus
gctgccttttgatttttatcctctg

SEQ ID NO: 571028 - DNA, 25 bp, Mus musculus
gctgcctttttactgagcttcatgc

SEQ ID NO: 571029 - DNA, 25 bp, Mus musculus
gctgcctttttagtgagcttcatgc

SEQ ID NO: 571030 - DNA, 25 bp, Mus musculus
gctgcctttttcatgaccgtgttgt

SEQ ID NO: 571031 - DNA, 25 bp, Mus musculus
gctgcctttttcttgaccgtgttgt

SEQ ID NO: 571032 - DNA, 25 bp, Mus musculus
gctgcgaacttgaagcctgtgtctg

SEQ ID NO: 571033 - DNA, 25 bp, Mus musculus
gctgcgaacttgtagcctgtgtctg

SEQ ID NO: 571034 - DNA, 25 bp, Mus musculus
gctgcgaagactctatttttggtta

SEQ ID NO: 571035 - DNA, 25 bp, Mus musculus
gctgcgaagactgtatttttggtta

SEQ ID NO: 571036 - DNA, 25 bp, Mus musculus
gctgcgacaaagagaacaagatgct

SEQ ID NO: 571037 - DNA, 25 bp, Mus musculus
gctgcgacaaagtgaacaagatgct

SEQ ID NO: 571038 - DNA, 25 bp, Mus musculus
gctgcgacacatcctaaggcacttg

SEQ ID NO: 571039 - DNA, 25 bp, Mus musculus
gctgcgacacatgctaaggcacttg

SEQ ID NO: 571040 - DNA, 25 bp, Mus musculus
gctgcgacactaatgctaagcctat

SEQ ID NO: 571041 - DNA, 25 bp, Mus musculus
gctgcgacactattgctaagcctat

SEQ ID NO: 571042 - DNA, 25 bp, Mus musculus
gctgcgacaggactttgtgtgcaaa

SEQ ID NO: 571043 - DNA, 25 bp, Mus musculus
gctgcgacaggagtttgtgtgcaaa

SEQ ID NO: 571044 - DNA, 25 bp, Mus musculus
gctgcgactggtattggctttaata

SEQ ID NO: 571045 - DNA, 25 bp, Mus musculus
gctgcgactggttttggctttaata

SEQ ID NO: 571046 - DNA, 25 bp, Mus musculus
gctgcgacttgaagctatgcctcta

SEQ ID NO: 571047 - DNA, 25 bp, Mus musculus
gctgcgacttgatgctatgcctcta

SEQ ID NO: 571048 - DNA, 25 bp, Mus musculus
gctgcgagaaaccttcttgaccatt

SEQ ID NO: 571049 - DNA, 25 bp, Mus musculus
gctgcgagaaacgttcttgaccatt

SEQ ID NO: 571050 - DNA, 25 bp, Mus musculus
gctgcgagcctgatggtagaactta

SEQ ID NO: 571051 - DNA, 25 bp, Mus musculus
gctgcgagcctgttggtagaactta

SEQ ID NO: 571052 - DNA, 25 bp, Mus musculus
gctgcgagcgttctcaatgggttat

SEQ ID NO: 571053 - DNA, 25 bp, Mus musculus
gctgcgagcgttgtcaatgggttat

SEQ ID NO: 571054 - DNA, 25 bp, Mus musculus
gctgcgagtcctcaaagacaagatt

SEQ ID NO: 571055 - DNA, 25 bp, Mus musculus
gctgcgagtcctgaaagacaagatt

SEQ ID NO: 571056 - DNA, 25 bp, Mus musculus
gctgcgagtgaacctggaccttcga

SEQ ID NO: 571057 - DNA, 25 bp, Mus musculus
gctgcgagtgaagctggaccttcga

SEQ ID NO: 571058 - DNA, 25 bp, Mus musculus
gctgcgatacgaagttcctgaagac

SEQ ID NO: 571059 - DNA, 25 bp, Mus musculus
gctgcgatacgatgttcctgaagac

SEQ ID NO: 571060 - DNA, 25 bp, Mus musculus
gctgcgatactaagaccaccgaatg

SEQ ID NO: 571061 - DNA, 25 bp, Mus musculus
gctgcgatactatgaccaccgaatg

SEQ ID NO: 571062 - DNA, 25 bp, Mus musculus
gctgcgatgcacagaaggttctgaa

SEQ ID NO: 571063 - DNA, 25 bp, Mus musculus
gctgcgatgcactgaaggttctgaa

SEQ ID NO: 571064 - DNA, 25 bp, Mus musculus
gctgcgattaccaggcatgatttgg

SEQ ID NO: 571065 - DNA, 25 bp, Mus musculus
gctgcgattacctggcatgatttgg

SEQ ID NO: 571066 - DNA, 25 bp, Mus musculus
gctgcgattatacgcctgagtcacc

SEQ ID NO: 571067 - DNA, 25 bp, Mus musculus
gctgcgattataggcctgagtcacc

SEQ ID NO: 571068 - DNA, 25 bp, Mus musculus
gctgcgcaagtgaataggtaaggct

SEQ ID NO: 571069 - DNA, 25 bp, Mus musculus
gctgcgcaagtgtataggtaaggct

SEQ ID NO: 571070 - DNA, 25 bp, Mus musculus
gctgcgcacgtacactgtacactat

SEQ ID NO: 571071 - DNA, 25 bp, Mus musculus
gctgcgcacgtagactgtacactat

SEQ ID NO: 571072 - DNA, 25 bp, Mus musculus
gctgcgcagaacaccggactcaagt

SEQ ID NO: 571073 - DNA, 25 bp, Mus musculus
gctgcgcagaactccggactcaagt

SEQ ID NO: 571074 - DNA, 25 bp, Mus musculus
gctgcgccactcacttgtgggtgtg

SEQ ID NO: 571075 - DNA, 25 bp, Mus musculus
gctgcgccactctcttgtgggtgtg

SEQ ID NO: 571076 - DNA, 25 bp, Mus musculus
gctgcgccgcacaggtttacagaaa

SEQ ID NO: 571077 - DNA, 25 bp, Mus musculus
gctgcgccgcactggtttacagaaa

SEQ ID NO: 571078 - DNA, 25 bp, Mus musculus
gctgcgcctgccatgtttacagagg

SEQ ID NO: 571079 - DNA, 25 bp, Mus musculus
gctgcgcctgccttgtttacagagg

SEQ ID NO: 571080 - DNA, 25 bp, Mus musculus
gctgcgcgggctagagagaaataca

SEQ ID NO: 571081 - DNA, 25 bp, Mus musculus
gctgcgcgggcttgagagaaataca

SEQ ID NO: 571082 - DNA, 25 bp, Mus musculus
gctgcgctggtccttttatttaaag

SEQ ID NO: 571083 - DNA, 25 bp, Mus musculus
gctgcgctggtcgttttatttaaag

SEQ ID NO: 571084 - DNA, 25 bp, Mus musculus
gctgcgctgtgacggtcacatctaa

SEQ ID NO: 571085 - DNA, 25 bp, Mus musculus
gctgcgctgtgagggtcacatctaa

SEQ ID NO: 571086 - DNA, 25 bp, Mus musculus
gctgcgcttaccagtgctaaagtca

SEQ ID NO: 571087 - DNA, 25 bp, Mus musculus
gctgcgcttacctgtgctaaagtca

SEQ ID NO: 571088 - DNA, 25 bp, Mus musculus
gctgcggaagaacctccctgtaaat

SEQ ID NO: 571089 - DNA, 25 bp, Mus musculus
gctgcggaagaagctccctgtaaat

SEQ ID NO: 571090 - DNA, 25 bp, Mus musculus
gctgcggaagatagcggatgataat

SEQ ID NO: 571091 - DNA, 25 bp, Mus musculus
gctgcggaagattgcggatgataat

SEQ ID NO: 571092 - DNA, 25 bp, Mus musculus
gctgcggaccaaccagagcagagcc

SEQ ID NO: 571093 - DNA, 25 bp, Mus musculus
gctgcggaccaagcagagcagagcc

SEQ ID NO: 571094 - DNA, 25 bp, Mus musculus
gctgcggacggcactgaaagctgca

SEQ ID NO: 571095 - DNA, 25 bp, Mus musculus
gctgcggacggctctgaaagctgca

SEQ ID NO: 571096 - DNA, 25 bp, Mus musculus
gctgcggagcacatctttgagtaca

SEQ ID NO: 571097 - DNA, 25 bp, Mus musculus
gctgcggagcacttctttgagtaca

SEQ ID NO: 571098 - DNA, 25 bp, Mus musculus
gctgcggagcatactgccatgatga

SEQ ID NO: 571099 - DNA, 25 bp, Mus musculus
gctgcggagcattctgccatgatga

SEQ ID NO: 571100 - DNA, 25 bp, Mus musculus
gctgcggagcccagcaatgggcaca

SEQ ID NO: 571101 - DNA, 25 bp, Mus musculus
gctgcggagccctgcaatgggcaca

SEQ ID NO: 571102 - DNA, 25 bp, Mus musculus
gctgcggcagtaaaatgggcgatat

SEQ ID NO: 571103 - DNA, 25 bp, Mus musculus
gctgcggcagtataatgggcgatat

SEQ ID NO: 571104 - DNA, 25 bp, Mus musculus
gctgcggcatgcatatctatttgta

SEQ ID NO: 571105 - DNA, 25 bp, Mus musculus
gctgcggcatgcttatctatttgta

SEQ ID NO: 571106 - DNA, 25 bp, Mus musculus
gctgcggccgagacttcaagctacc

SEQ ID NO: 571107 - DNA, 25 bp, Mus musculus
gctgcggccgagtcttcaagctacc

SEQ ID NO: 571108 - DNA, 25 bp, Mus musculus
gctgcggctaacaagatggctggaa

SEQ ID NO: 571109 - DNA, 25 bp, Mus musculus
gctgcggctaactagatggctggaa

SEQ ID NO: 571110 - DNA, 25 bp, Mus musculus
gctgcggctcatagaggactctaga

SEQ ID NO: 571111 - DNA, 25 bp, Mus musculus
gctgcggctcattgaggactctaga

SEQ ID NO: 571112 - DNA, 25 bp, Mus musculus
gctgcgggacccagatatataccat

SEQ ID NO: 571113 - DNA, 25 bp, Mus musculus
gctgcgggaccctgatatataccat

SEQ ID NO: 571114 - DNA, 25 bp, Mus musculus
gctgcgggagctatttatttctgac

SEQ ID NO: 571115 - DNA, 25 bp, Mus musculus
gctgcgggagctcttactatgtaat

SEQ ID NO: 571116 - DNA, 25 bp, Mus musculus
gctgcgggagctgttactatgtaat

SEQ ID NO: 571117 - DNA, 25 bp, Mus musculus
gctgcgggagctttttatttctgac

SEQ ID NO: 571118 - DNA, 25 bp, Mus musculus
gctgcgggtgccactgtaaatctga

SEQ ID NO: 571119 - DNA, 25 bp, Mus musculus
gctgcgggtgcctctgtaaatctga

SEQ ID NO: 571120 - DNA, 25 bp, Mus musculus
gctgcggtacaaccccgacttgaaa

SEQ ID NO: 571121 - DNA, 25 bp, Mus musculus
gctgcggtacaagcccgacttgaaa

SEQ ID NO: 571122 - DNA, 25 bp, Mus musculus
gctgcggtctttcaataccctggga

SEQ ID NO: 571123 - DNA, 25 bp, Mus musculus
gctgcggtctttgaataccctggga

SEQ ID NO: 571124 - DNA, 25 bp, Mus musculus
gctgcggtgaccagggcatgtcaca

SEQ ID NO: 571125 - DNA, 25 bp, Mus musculus
gctgcggtgacctgggcatgtcaca

SEQ ID NO: 571126 - DNA, 25 bp, Mus musculus
gctgcggttcctcgagaccatgaag

SEQ ID NO: 571127 - DNA, 25 bp, Mus musculus
gctgcggttcctggagaccatgaag

SEQ ID NO: 571128 - DNA, 25 bp, Mus musculus
gctgcggtttctctggactcgactg

SEQ ID NO: 571129 - DNA, 25 bp, Mus musculus
gctgcggtttctgtggactcgactg

SEQ ID NO: 571130 - DNA, 25 bp, Mus musculus
gctgcgtagctgaatgactatctaa

SEQ ID NO: 571131 - DNA, 25 bp, Mus musculus
gctgcgtagctgtatgactatctaa

SEQ ID NO: 571132 - DNA, 25 bp, Mus musculus
gctgcgtatcttaagtcatgggctt

SEQ ID NO: 571133 - DNA, 25 bp, Mus musculus
gctgcgtatctttagtcatgggctt

SEQ ID NO: 571134 - DNA, 25 bp, Mus musculus
gctgcgtattaacaggtttagaaga

SEQ ID NO: 571135 - DNA, 25 bp, Mus musculus
gctgcgtattaagaggtttagaaga

SEQ ID NO: 571136 - DNA, 25 bp, Mus musculus
gctgcgtcatcgacatctgcatgaa

SEQ ID NO: 571137 - DNA, 25 bp, Mus musculus
gctgcgtcatcgtcatctgcatgaa

SEQ ID NO: 571138 - DNA, 25 bp, Mus musculus
gctgcgtccaaaccgatttgcttag

SEQ ID NO: 571139 - DNA, 25 bp, Mus musculus
gctgcgtccaaagcgatttgcttag

SEQ ID NO: 571140 - DNA, 25 bp, Mus musculus
gctgcgtctgccaaggccagcactt

SEQ ID NO: 571141 - DNA, 25 bp, Mus musculus
gctgcgtctgcctaggccagcactt

SEQ ID NO: 571142 - DNA, 25 bp, Mus musculus
gctgcgtgatgcacacagttgcaat

SEQ ID NO: 571143 - DNA, 25 bp, Mus musculus
gctgcgtgatgctcacagttgcaat

SEQ ID NO: 571144 - DNA, 25 bp, Mus musculus
gctgcgtgtgagcatcgccgagcca

SEQ ID NO: 571145 - DNA, 25 bp, Mus musculus
gctgcgtgtgaggatcgccgagcca

SEQ ID NO: 571146 - DNA, 25 bp, Mus musculus
gctgcgttagctctctggaatatcc

SEQ ID NO: 571147 - DNA, 25 bp, Mus musculus
gctgcgttagctgtctggaatatcc

SEQ ID NO: 571148 - DNA, 25 bp, Mus musculus
gctgcgttcagaatcatgagtgaaa

SEQ ID NO: 571149 - DNA, 25 bp, Mus musculus
gctgcgttcagattcatgagtgaaa

SEQ ID NO: 571150 - DNA, 25 bp, Mus musculus
gctgcgttcgtcaagtcctatgaga

SEQ ID NO: 571151 - DNA, 25 bp, Mus musculus
gctgcgttcgtctagtcctatgaga

SEQ ID NO: 571152 - DNA, 25 bp, Mus musculus
gctgcgtttctcagcataaacttat

SEQ ID NO: 571153 - DNA, 25 bp, Mus musculus
gctgcgtttctctgcataaacttat

SEQ ID NO: 571154 - DNA, 25 bp, Mus musculus
gctgcgtttctgaaattgttctcca

SEQ ID NO: 571155 - DNA, 25 bp, Mus musculus
gctgcgtttctgctgtatgggtaac

SEQ ID NO: 571156 - DNA, 25 bp, Mus musculus
gctgcgtttctggtgtatgggtaac

SEQ ID NO: 571157 - DNA, 25 bp, Mus musculus
gctgcgtttctgtaattgttctcca

SEQ ID NO: 571158 - DNA, 25 bp, Mus musculus
gctgcgtttgcactaatgggtgcca

SEQ ID NO: 571159 - DNA, 25 bp, Mus musculus
gctgcgtttgcagtaatgggtgcca

SEQ ID NO: 571160 - DNA, 25 bp, Mus musculus
gctgctaaaagaacctgtctatggg

SEQ ID NO: 571161 - DNA, 25 bp, Mus musculus
gctgctaaaagatcctgtctatggg

SEQ ID NO: 571162 - DNA, 25 bp, Mus musculus
gctgctaaaaggatctcttcgcttc

SEQ ID NO: 571163 - DNA, 25 bp, Mus musculus
gctgctaaaaggttctcttcgcttc

SEQ ID NO: 571164 - DNA, 25 bp, Mus musculus
gctgctaaagccctgggtttcatcc

SEQ ID NO: 571165 - DNA, 25 bp, Mus musculus
gctgctaaagccgtgggtttcatcc

SEQ ID NO: 571166 - DNA, 25 bp, Mus musculus
gctgctaaatatattgcctcgttta

SEQ ID NO: 571167 - DNA, 25 bp, Mus musculus
gctgctaaatattttgcctcgttta

SEQ ID NO: 571168 - DNA, 25 bp, Mus musculus
gctgctaaatgacagccaaagaagg

SEQ ID NO: 571169 - DNA, 25 bp, Mus musculus
gctgctaaatgagagccaaagaagg

SEQ ID NO: 571170 - DNA, 25 bp, Mus musculus
gctgctaacagccagggtacaatta

SEQ ID NO: 571171 - DNA, 25 bp, Mus musculus
gctgctaacagcgagggtacaatta

SEQ ID NO: 571172 - DNA, 25 bp, Mus musculus
gctgctaactggctgttgctgacat

SEQ ID NO: 571173 - DNA, 25 bp, Mus musculus
gctgctaactgggtgttgctgacat

SEQ ID NO: 571174 - DNA, 25 bp, Mus musculus
gctgctaactttccgattagacaat

SEQ ID NO: 571175 - DNA, 25 bp, Mus musculus
gctgctaactttgcgattagacaat

SEQ ID NO: 571176 - DNA, 25 bp, Mus musculus
gctgctaagaacctgctaactaaga

SEQ ID NO: 571177 - DNA, 25 bp, Mus musculus
gctgctaagaacgtgctaactaaga

SEQ ID NO: 571178 - DNA, 25 bp, Mus musculus
gctgctaagcagaaccagtttgcta

SEQ ID NO: 571179 - DNA, 25 bp, Mus musculus
gctgctaagcagtaccagtttgcta

SEQ ID NO: 571180 - DNA, 25 bp, Mus musculus
gctgctaagcctacctagcttttat

SEQ ID NO: 571181 - DNA, 25 bp, Mus musculus
gctgctaagcctcacagtctgagtg

SEQ ID NO: 571182 - DNA, 25 bp, Mus musculus
gctgctaagcctgacagtctgagtg

SEQ ID NO: 571183 - DNA, 25 bp, Mus musculus
gctgctaagccttcctagcttttat

SEQ ID NO: 571184 - DNA, 25 bp, Mus musculus
gctgctaatataagcttgttggaac

SEQ ID NO: 571185 - DNA, 25 bp, Mus musculus
gctgctaatatatgcttgttggaac

SEQ ID NO: 571186 - DNA, 25 bp, Mus musculus
gctgctaatcttccgttcttgagaa

SEQ ID NO: 571187 - DNA, 25 bp, Mus musculus
gctgctaatcttgcgttcttgagaa

SEQ ID NO: 571188 - DNA, 25 bp, Mus musculus
gctgctaatgacactggactggcca

SEQ ID NO: 571189 - DNA, 25 bp, Mus musculus
gctgctaatgactctggactggcca

SEQ ID NO: 571190 - DNA, 25 bp, Mus musculus
gctgctacaaataatctgctatggt

SEQ ID NO: 571191 - DNA, 25 bp, Mus musculus
gctgctacaaattatctgctatggt

SEQ ID NO: 571192 - DNA, 25 bp, Mus musculus
gctgctacagcccagatgaactctg

SEQ ID NO: 571193 - DNA, 25 bp, Mus musculus
gctgctacagccgagatgaactctg

SEQ ID NO: 571194 - DNA, 25 bp, Mus musculus
gctgctacatatagttgtatcctgt

SEQ ID NO: 571195 - DNA, 25 bp, Mus musculus
gctgctacatattgttgtatcctgt

SEQ ID NO: 571196 - DNA, 25 bp, Mus musculus
gctgctacccctcagatcagagtga

SEQ ID NO: 571197 - DNA, 25 bp, Mus musculus
gctgctacccctccattaaaattag

SEQ ID NO: 571198 - DNA, 25 bp, Mus musculus
gctgctacccctgagatcagagtga

SEQ ID NO: 571199 - DNA, 25 bp, Mus musculus
gctgctacccctgcattaaaattag

SEQ ID NO: 571200 - DNA, 25 bp, Mus musculus
gctgctacctttacaagcttatgaa

SEQ ID NO: 571201 - DNA, 25 bp, Mus musculus
gctgctaccttttcaagcttatgaa

SEQ ID NO: 571202 - DNA, 25 bp, Mus musculus
gctgctacgggtccacaagctataa

SEQ ID NO: 571203 - DNA, 25 bp, Mus musculus
gctgctacgggtgcacaagctataa

SEQ ID NO: 571204 - DNA, 25 bp, Mus musculus
gctgctactgaactagatttccctg

SEQ ID NO: 571205 - DNA, 25 bp, Mus musculus
gctgctactgaagtagatttccctg

SEQ ID NO: 571206 - DNA, 25 bp, Mus musculus
gctgctactggtcccgaacaactca

SEQ ID NO: 571207 - DNA, 25 bp, Mus musculus
gctgctactggtgccgaacaactca

SEQ ID NO: 571208 - DNA, 25 bp, Mus musculus
gctgctactgtgagacagtctgaca

SEQ ID NO: 571209 - DNA, 25 bp, Mus musculus
gctgctactgtgtgacagtctgaca

SEQ ID NO: 571210 - DNA, 25 bp, Mus musculus
gctgctagacttcttttacatgaaa

SEQ ID NO: 571211 - DNA, 25 bp, Mus musculus
gctgctagacttgttttacatgaaa

SEQ ID NO: 571212 - DNA, 25 bp, Mus musculus
gctgctagcctgaagacacctgtgt

SEQ ID NO: 571213 - DNA, 25 bp, Mus musculus
gctgctagcctgtagacacctgtgt

SEQ ID NO: 571214 - DNA, 25 bp, Mus musculus
gctgctagcgacatactatgccaac

SEQ ID NO: 571215 - DNA, 25 bp, Mus musculus
gctgctagcgacttactatgccaac

SEQ ID NO: 571216 - DNA, 25 bp, Mus musculus
gctgctagcgctctgagctggacac

SEQ ID NO: 571217 - DNA, 25 bp, Mus musculus
gctgctagcgctgtgagctggacac

SEQ ID NO: 571218 - DNA, 25 bp, Mus musculus
gctgctagctttagcaaatggccta

SEQ ID NO: 571219 - DNA, 25 bp, Mus musculus
gctgctagcttttgcaaatggccta

SEQ ID NO: 571220 - DNA, 25 bp, Mus musculus
gctgctaggccaacccaatgttagg

SEQ ID NO: 571221 - DNA, 25 bp, Mus musculus
gctgctaggccatcccaatgttagg

SEQ ID NO: 571222 - DNA, 25 bp, Mus musculus
gctgctagtcgtattcctggagtga

SEQ ID NO: 571223 - DNA, 25 bp, Mus musculus
gctgctagtcgttttcctggagtga

SEQ ID NO: 571224 - DNA, 25 bp, Mus musculus
gctgctagtgagagcaggccagcct

SEQ ID NO: 571225 - DNA, 25 bp, Mus musculus
gctgctagtgagtgcaggccagcct

SEQ ID NO: 571226 - DNA, 25 bp, Mus musculus
gctgctagtggtcgtcaaggataat

SEQ ID NO: 571227 - DNA, 25 bp, Mus musculus
gctgctagtggtggtcaaggataat

SEQ ID NO: 571228 - DNA, 25 bp, Mus musculus
gctgctatagcaactgtgtgattaa

SEQ ID NO: 571229 - DNA, 25 bp, Mus musculus
gctgctatagcatctgtgtgattaa

SEQ ID NO: 571230 - DNA, 25 bp, Mus musculus
gctgctatagctactacaactgtct

SEQ ID NO: 571231 - DNA, 25 bp, Mus musculus
gctgctatagcttctacaactgtct

SEQ ID NO: 571232 - DNA, 25 bp, Mus musculus
gctgctatcctgaattcagtggcca

SEQ ID NO: 571233 - DNA, 25 bp, Mus musculus
gctgctatcctgagatggtgcttaa

SEQ ID NO: 571234 - DNA, 25 bp, Mus musculus
gctgctatcctgtattcagtggcca

SEQ ID NO: 571235 - DNA, 25 bp, Mus musculus
gctgctatcctgtgatggtgcttaa

SEQ ID NO: 571236 - DNA, 25 bp, Mus musculus
gctgctatctgcattcaagaaactt

SEQ ID NO: 571237 - DNA, 25 bp, Mus musculus
gctgctatctgctttcaagaaactt

SEQ ID NO: 571238 - DNA, 25 bp, Mus musculus
gctgctatctgtaaacgcgttgtaa

SEQ ID NO: 571239 - DNA, 25 bp, Mus musculus
gctgctatctgttaacgcgttgtaa

SEQ ID NO: 571240 - DNA, 25 bp, Mus musculus
gctgctatgccaccacaggtttgaa

SEQ ID NO: 571241 - DNA, 25 bp, Mus musculus
gctgctatgccagcacaggtttgaa

SEQ ID NO: 571242 - DNA, 25 bp, Mus musculus
gctgctatgcttcccagcaaatggc

SEQ ID NO: 571243 - DNA, 25 bp, Mus musculus
gctgctatgcttgccagcaaatggc

SEQ ID NO: 571244 - DNA, 25 bp, Mus musculus
gctgctatggctatactggttgctt

SEQ ID NO: 571245 - DNA, 25 bp, Mus musculus
gctgctatggctttactggttgctt

SEQ ID NO: 571246 - DNA, 25 bp, Mus musculus
gctgctatgtacacactcggtgttc

SEQ ID NO: 571247 - DNA, 25 bp, Mus musculus
gctgctatgtactcactcggtgttc

SEQ ID NO: 571248 - DNA, 25 bp, Mus musculus
gctgctatgtagacagtatctacca

SEQ ID NO: 571249 - DNA, 25 bp, Mus musculus
gctgctatgtagtcagtatctacca

SEQ ID NO: 571250 - DNA, 25 bp, Mus musculus
gctgctatgtgcaatcatctacagg

SEQ ID NO: 571251 - DNA, 25 bp, Mus musculus
gctgctatgtgctatcatctacagg

SEQ ID NO: 571252 - DNA, 25 bp, Mus musculus
gctgctattctcaaccattggacaa

SEQ ID NO: 571253 - DNA, 25 bp, Mus musculus
gctgctattctcatgggtcacacga

SEQ ID NO: 571254 - DNA, 25 bp, Mus musculus
gctgctattctctaccattggacaa

SEQ ID NO: 571255 - DNA, 25 bp, Mus musculus
gctgctattctcttgggtcacacga

SEQ ID NO: 571256 - DNA, 25 bp, Mus musculus
gctgctattcttacagatgcttcgt

SEQ ID NO: 571257 - DNA, 25 bp, Mus musculus
gctgctattctttcagatgcttcgt

SEQ ID NO: 571258 - DNA, 25 bp, Mus musculus
gctgctattgctatgtttattctta

SEQ ID NO: 571259 - DNA, 25 bp, Mus musculus
gctgctattgctttgtttattctta

SEQ ID NO: 571260 - DNA, 25 bp, Mus musculus
gctgctattgtacgttcctctttca

SEQ ID NO: 571261 - DNA, 25 bp, Mus musculus
gctgctattgtaggttcctctttca

SEQ ID NO: 571262 - DNA, 25 bp, Mus musculus
gctgctattgtgacttctgagccat

SEQ ID NO: 571263 - DNA, 25 bp, Mus musculus
gctgctattgtgtcttctgagccat

SEQ ID NO: 571264 - DNA, 25 bp, Mus musculus
gctgctatttataccttacttgtca

SEQ ID NO: 571265 - DNA, 25 bp, Mus musculus
gctgctatttattccttacttgtca

SEQ ID NO: 571266 - DNA, 25 bp, Mus musculus
gctgctatttctaaagactctgcca

SEQ ID NO: 571267 - DNA, 25 bp, Mus musculus
gctgctatttcttaagactctgcca

SEQ ID NO: 571268 - DNA, 25 bp, Mus musculus
gctgctattttcacaagtctcaact

SEQ ID NO: 571269 - DNA, 25 bp, Mus musculus
gctgctattttctcaagtctcaact

SEQ ID NO: 571270 - DNA, 25 bp, Mus musculus
gctgctattttgagcatgcttccag

SEQ ID NO: 571271 - DNA, 25 bp, Mus musculus
gctgctattttgtgcatgcttccag

SEQ ID NO: 571272 - DNA, 25 bp, Mus musculus
gctgctcaaatcattgatcatacca

SEQ ID NO: 571273 - DNA, 25 bp, Mus musculus
gctgctcaaatctttgatcatacca

SEQ ID NO: 571274 - DNA, 25 bp, Mus musculus
gctgctcaaattcctgtaaattctg

SEQ ID NO: 571275 - DNA, 25 bp, Mus musculus
gctgctcaaattgctgtaaattctg

SEQ ID NO: 571276 - DNA, 25 bp, Mus musculus
gctgctcaagagaatgggcttcctt

SEQ ID NO: 571277 - DNA, 25 bp, Mus musculus
gctgctcaagagtatgggcttcctt

SEQ ID NO: 571278 - DNA, 25 bp, Mus musculus
gctgctcaagatatcacctcaatga

SEQ ID NO: 571279 - DNA, 25 bp, Mus musculus
gctgctcaagatttcacctcaatga

SEQ ID NO: 571280 - DNA, 25 bp, Mus musculus
gctgctcaagctctgggaaaagttc

SEQ ID NO: 571281 - DNA, 25 bp, Mus musculus
gctgctcaagctgtgggaaaagttc

SEQ ID NO: 571282 - DNA, 25 bp, Mus musculus
gctgctcaatgaaatggcctctcca

SEQ ID NO: 571283 - DNA, 25 bp, Mus musculus
gctgctcaatgatatggcctctcca

SEQ ID NO: 571284 - DNA, 25 bp, Mus musculus
gctgctcacaatcctctgcagtatt

SEQ ID NO: 571285 - DNA, 25 bp, Mus musculus
gctgctcacaatgctctgcagtatt

SEQ ID NO: 571286 - DNA, 25 bp, Mus musculus
gctgctcacaggatggcccacacaa

SEQ ID NO: 571287 - DNA, 25 bp, Mus musculus
gctgctcacaggttggcccacacaa

SEQ ID NO: 571288 - DNA, 25 bp, Mus musculus
gctgctcaccaacccttaggctgag

SEQ ID NO: 571289 - DNA, 25 bp, Mus musculus
gctgctcaccaagccttaggctgag

SEQ ID NO: 571290 - DNA, 25 bp, Mus musculus
gctgctcactgaagcactcgaggat

SEQ ID NO: 571291 - DNA, 25 bp, Mus musculus
gctgctcactgacaccaagcgcaag

SEQ ID NO: 571292 - DNA, 25 bp, Mus musculus
gctgctcactgagaccaagcgcaag

SEQ ID NO: 571293 - DNA, 25 bp, Mus musculus
gctgctcactgatgcactcgaggat

SEQ ID NO: 571294 - DNA, 25 bp, Mus musculus
gctgctcagagcacacttggttgtg

SEQ ID NO: 571295 - DNA, 25 bp, Mus musculus
gctgctcagagctcacttggttgtg

SEQ ID NO: 571296 - DNA, 25 bp, Mus musculus
gctgctcagaggacaaagaatcatc

SEQ ID NO: 571297 - DNA, 25 bp, Mus musculus
gctgctcagaggtcaaagaatcatc

SEQ ID NO: 571298 - DNA, 25 bp, Mus musculus
gctgctcagcatctatacttaagtt

SEQ ID NO: 571299 - DNA, 25 bp, Mus musculus
gctgctcagcatgtatacttaagtt

SEQ ID NO: 571300 - DNA, 25 bp, Mus musculus
gctgctcagcgaactgaagttgcgt

SEQ ID NO: 571301 - DNA, 25 bp, Mus musculus
gctgctcagcgatctgaagttgcgt

SEQ ID NO: 571302 - DNA, 25 bp, Mus musculus
gctgctcagggactttgggctaaat

SEQ ID NO: 571303 - DNA, 25 bp, Mus musculus
gctgctcagggagtttgggctaaat

SEQ ID NO: 571304 - DNA, 25 bp, Mus musculus
gctgctcagtagatgcccttggtgt

SEQ ID NO: 571305 - DNA, 25 bp, Mus musculus
gctgctcagtagttgcccttggtgt

SEQ ID NO: 571306 - DNA, 25 bp, Mus musculus
gctgctcagtgcaagctatgaattt

SEQ ID NO: 571307 - DNA, 25 bp, Mus musculus
gctgctcagtgctagctatgaattt

SEQ ID NO: 571308 - DNA, 25 bp, Mus musculus
gctgctcattaaagttcttcccttg

SEQ ID NO: 571309 - DNA, 25 bp, Mus musculus
gctgctcattaatgttcttcccttg

SEQ ID NO: 571310 - DNA, 25 bp, Mus musculus
gctgctcattttaattgctcaccaa

SEQ ID NO: 571311 - DNA, 25 bp, Mus musculus
gctgctcattttcatgccagcaaag

SEQ ID NO: 571312 - DNA, 25 bp, Mus musculus
gctgctcattttgatgccagcaaag

SEQ ID NO: 571313 - DNA, 25 bp, Mus musculus
gctgctcatttttattgctcaccaa

SEQ ID NO: 571314 - DNA, 25 bp, Mus musculus
gctgctccaagcattgatgatcatt

SEQ ID NO: 571315 - DNA, 25 bp, Mus musculus
gctgctccaagctttgatgatcatt

SEQ ID NO: 571316 - DNA, 25 bp, Mus musculus
gctgctccaagtaacttaataggat

SEQ ID NO: 571317 - DNA, 25 bp, Mus musculus
gctgctccaagttacttaataggat

SEQ ID NO: 571318 - DNA, 25 bp, Mus musculus
gctgctccactcaaagagagcccaa

SEQ ID NO: 571319 - DNA, 25 bp, Mus musculus
gctgctccactctaagagagcccaa

SEQ ID NO: 571320 - DNA, 25 bp, Mus musculus
gctgctccatttatagcttgagttc

SEQ ID NO: 571321 - DNA, 25 bp, Mus musculus
gctgctccatttttagcttgagttc

SEQ ID NO: 571322 - DNA, 25 bp, Mus musculus
gctgctcccaaacaggcaagcttag

SEQ ID NO: 571323 - DNA, 25 bp, Mus musculus
gctgctcccaaagaggcaagcttag

SEQ ID NO: 571324 - DNA, 25 bp, Mus musculus
gctgctcccagtatacatgtctgaa

SEQ ID NO: 571325 - DNA, 25 bp, Mus musculus
gctgctcccagtttacatgtctgaa

SEQ ID NO: 571326 - DNA, 25 bp, Mus musculus
gctgctccgaacagggttttggatt

SEQ ID NO: 571327 - DNA, 25 bp, Mus musculus
gctgctccgaactgggttttggatt

SEQ ID NO: 571328 - DNA, 25 bp, Mus musculus
gctgctcctagcataccaaaaggtg

SEQ ID NO: 571329 - DNA, 25 bp, Mus musculus
gctgctcctagcttaccaaaaggtg

SEQ ID NO: 571330 - DNA, 25 bp, Mus musculus
gctgctcctatgcaactgatagcca

SEQ ID NO: 571331 - DNA, 25 bp, Mus musculus
gctgctcctatggaactgatagcca

SEQ ID NO: 571332 - DNA, 25 bp, Mus musculus
gctgctcctcgtatgtaacacagtt

SEQ ID NO: 571333 - DNA, 25 bp, Mus musculus
gctgctcctcgtttgtaacacagtt

SEQ ID NO: 571334 - DNA, 25 bp, Mus musculus
gctgctcctgcacagtgcacagggt

SEQ ID NO: 571335 - DNA, 25 bp, Mus musculus
gctgctcctgcagagtgcacagggt

SEQ ID NO: 571336 - DNA, 25 bp, Mus musculus
gctgctcctggacgcaaatccgtag

SEQ ID NO: 571337 - DNA, 25 bp, Mus musculus
gctgctcctggaggcaaatccgtag

SEQ ID NO: 571338 - DNA, 25 bp, Mus musculus
gctgctcgacatcaaattggccact

SEQ ID NO: 571339 - DNA, 25 bp, Mus musculus
gctgctcgacatgaaattggccact

SEQ ID NO: 571340 - DNA, 25 bp, Mus musculus
gctgctcgaggcctgtcggaatggg

SEQ ID NO: 571341 - DNA, 25 bp, Mus musculus
gctgctcgaggcgtgtcggaatggg

SEQ ID NO: 571342 - DNA, 25 bp, Mus musculus
gctgctcgcccgacggctatggcgg

SEQ ID NO: 571343 - DNA, 25 bp, Mus musculus
gctgctcgcccgtcggctatggcgg

SEQ ID NO: 571344 - DNA, 25 bp, Mus musculus
gctgctcgcttaactcagtgttaaa

SEQ ID NO: 571345 - DNA, 25 bp, Mus musculus
gctgctcgcttatctcagtgttaaa

SEQ ID NO: 571346 - DNA, 25 bp, Mus musculus
gctgctcgtgatagttcttgatttt

SEQ ID NO: 571347 - DNA, 25 bp, Mus musculus
gctgctcgtgattgttcttgatttt

SEQ ID NO: 571348 - DNA, 25 bp, Mus musculus
gctgctcgttatagggagcccttaa

SEQ ID NO: 571349 - DNA, 25 bp, Mus musculus
gctgctcgttattgggagcccttaa

SEQ ID NO: 571350 - DNA, 25 bp, Mus musculus
gctgctctaagcactagttcatgga

SEQ ID NO: 571351 - DNA, 25 bp, Mus musculus
gctgctctaagctctagttcatgga

SEQ ID NO: 571352 - DNA, 25 bp, Mus musculus
gctgctctaaggctgctgggcctat

SEQ ID NO: 571353 - DNA, 25 bp, Mus musculus
gctgctctaagggtgctgggcctat

SEQ ID NO: 571354 - DNA, 25 bp, Mus musculus
gctgctctacaaacctagggtaagt

SEQ ID NO: 571355 - DNA, 25 bp, Mus musculus
gctgctctacaatcctagggtaagt

SEQ ID NO: 571356 - DNA, 25 bp, Mus musculus
gctgctctagggaggctggatttcc

SEQ ID NO: 571357 - DNA, 25 bp, Mus musculus
gctgctctagggtggctggatttcc

SEQ ID NO: 571358 - DNA, 25 bp, Mus musculus
gctgctctagttcaggttagcgagg

SEQ ID NO: 571359 - DNA, 25 bp, Mus musculus
gctgctctagttgaggttagcgagg

SEQ ID NO: 571360 - DNA, 25 bp, Mus musculus
gctgctctcaaaaaagattctggtt

SEQ ID NO: 571361 - DNA, 25 bp, Mus musculus
gctgctctcaaataagattctggtt

SEQ ID NO: 571362 - DNA, 25 bp, Mus musculus
gctgctctcagaaaagtatagccct

SEQ ID NO: 571363 - DNA, 25 bp, Mus musculus
gctgctctcagataagtatagccct

SEQ ID NO: 571364 - DNA, 25 bp, Mus musculus
gctgctctcaggatggtcgagtgtt

SEQ ID NO: 571365 - DNA, 25 bp, Mus musculus
gctgctctcaggttggtcgagtgtt

SEQ ID NO: 571366 - DNA, 25 bp, Mus musculus
gctgctctccctcctgatgataaag

SEQ ID NO: 571367 - DNA, 25 bp, Mus musculus
gctgctctccctgctgatgataaag

SEQ ID NO: 571368 - DNA, 25 bp, Mus musculus
gctgctctctccctgtgagtagtag

SEQ ID NO: 571369 - DNA, 25 bp, Mus musculus
gctgctctctccgtgtgagtagtag

SEQ ID NO: 571370 - DNA, 25 bp, Mus musculus
gctgctctcttaatggtgggatttt

SEQ ID NO: 571371 - DNA, 25 bp, Mus musculus
gctgctctcttattggtgggatttt

SEQ ID NO: 571372 - DNA, 25 bp, Mus musculus
gctgctctcttcaaatagttacatg

SEQ ID NO: 571373 - DNA, 25 bp, Mus musculus
gctgctctcttctaatagttacatg

SEQ ID NO: 571374 - DNA, 25 bp, Mus musculus
gctgctctgctaaaagtatcgtgga

SEQ ID NO: 571375 - DNA, 25 bp, Mus musculus
gctgctctgctataagtatcgtgga

SEQ ID NO: 571376 - DNA, 25 bp, Mus musculus
gctgctctgctcacacaaaagaact

SEQ ID NO: 571377 - DNA, 25 bp, Mus musculus
gctgctctgctctcacaaaagaact

SEQ ID NO: 571378 - DNA, 25 bp, Mus musculus
gctgctctggagctcaggattccat

SEQ ID NO: 571379 - DNA, 25 bp, Mus musculus
gctgctctggaggtcaggattccat

SEQ ID NO: 571380 - DNA, 25 bp, Mus musculus
gctgctctggcaagggctgtgtttt

SEQ ID NO: 571381 - DNA, 25 bp, Mus musculus
gctgctctggcatgggctgtgtttt

SEQ ID NO: 571382 - DNA, 25 bp, Mus musculus
gctgctctgggcaagaacatagtga

SEQ ID NO: 571383 - DNA, 25 bp, Mus musculus
gctgctctgggctagaacatagtga

SEQ ID NO: 571384 - DNA, 25 bp, Mus musculus
gctgctctggttaggtccagaatca

SEQ ID NO: 571385 - DNA, 25 bp, Mus musculus
gctgctctggtttggtccagaatca

SEQ ID NO: 571386 - DNA, 25 bp, Mus musculus
gctgctctgtatccagaaacaggta

SEQ ID NO: 571387 - DNA, 25 bp, Mus musculus
gctgctctgtatgcagaaacaggta

SEQ ID NO: 571388 - DNA, 25 bp, Mus musculus
gctgctctgtttatgcgctgcatat

SEQ ID NO: 571389 - DNA, 25 bp, Mus musculus
gctgctctgtttttgcgctgcatat

SEQ ID NO: 571390 - DNA, 25 bp, Mus musculus
gctgctcttacgatggttgctgacc

SEQ ID NO: 571391 - DNA, 25 bp, Mus musculus
gctgctcttacgttggttgctgacc

SEQ ID NO: 571392 - DNA, 25 bp, Mus musculus
gctgctcttagtatggctcttcata

SEQ ID NO: 571393 - DNA, 25 bp, Mus musculus
gctgctcttagtttggctcttcata

SEQ ID NO: 571394 - DNA, 25 bp, Mus musculus
gctgctcttattctgaagttggcaa

SEQ ID NO: 571395 - DNA, 25 bp, Mus musculus
gctgctcttattgtgaagttggcaa

SEQ ID NO: 571396 - DNA, 25 bp, Mus musculus
gctgctcttcagctagaactgggtg

SEQ ID NO: 571397 - DNA, 25 bp, Mus musculus
gctgctcttcagctatgatttaggg

SEQ ID NO: 571398 - DNA, 25 bp, Mus musculus
gctgctcttcaggtagaactgggtg

SEQ ID NO: 571399 - DNA, 25 bp, Mus musculus
gctgctcttcaggtatgatttaggg

SEQ ID NO: 571400 - DNA, 25 bp, Mus musculus
gctgctcttgacatcctctacataa

SEQ ID NO: 571401 - DNA, 25 bp, Mus musculus
gctgctcttgacttcctctacataa

SEQ ID NO: 571402 - DNA, 25 bp, Mus musculus
gctgctcttggcagagaacctgagt

SEQ ID NO: 571403 - DNA, 25 bp, Mus musculus
gctgctcttggctgagaacctgagt

SEQ ID NO: 571404 - DNA, 25 bp, Mus musculus
gctgctcttggtattgtacataagg

SEQ ID NO: 571405 - DNA, 25 bp, Mus musculus
gctgctcttggttttgtacataagg

SEQ ID NO: 571406 - DNA, 25 bp, Mus musculus
gctgctgaaatgacaggagtgctga

SEQ ID NO: 571407 - DNA, 25 bp, Mus musculus
gctgctgaaatgtcaggagtgctga

SEQ ID NO: 571408 - DNA, 25 bp, Mus musculus
gctgctgaagagcaaagaggcccta

SEQ ID NO: 571409 - DNA, 25 bp, Mus musculus
gctgctgaagaggaaagaggcccta

SEQ ID NO: 571410 - DNA, 25 bp, Mus musculus
gctgctgaagatcatctgctacctg

SEQ ID NO: 571411 - DNA, 25 bp, Mus musculus
gctgctgaagatgatctgctacctg

SEQ ID NO: 571412 - DNA, 25 bp, Mus musculus
gctgctgaataaccctgcttgattt

SEQ ID NO: 571413 - DNA, 25 bp, Mus musculus
gctgctgaataagcctgcttgattt

SEQ ID NO: 571414 - DNA, 25 bp, Mus musculus
gctgctgaatggctctcatcaaggt

SEQ ID NO: 571415 - DNA, 25 bp, Mus musculus
gctgctgaatgggtctcatcaaggt

SEQ ID NO: 571416 - DNA, 25 bp, Mus musculus
gctgctgacagtctgttattccata

SEQ ID NO: 571417 - DNA, 25 bp, Mus musculus
gctgctgacagtgtgttattccata

SEQ ID NO: 571418 - DNA, 25 bp, Mus musculus
gctgctgaccaacttccagaactct

SEQ ID NO: 571419 - DNA, 25 bp, Mus musculus
gctgctgaccaagttccagaactct

SEQ ID NO: 571420 - DNA, 25 bp, Mus musculus
gctgctgaccagctgtatcatgctg

SEQ ID NO: 571421 - DNA, 25 bp, Mus musculus
gctgctgaccaggtgtatcatgctg

SEQ ID NO: 571422 - DNA, 25 bp, Mus musculus
gctgctgaccatctacttgttgttg

SEQ ID NO: 571423 - DNA, 25 bp, Mus musculus
gctgctgaccatgtacttgttgttg

SEQ ID NO: 571424 - DNA, 25 bp, Mus musculus
gctgctgactacaacttgtaccaaa

SEQ ID NO: 571425 - DNA, 25 bp, Mus musculus
gctgctgactactacttgtaccaaa

SEQ ID NO: 571426 - DNA, 25 bp, Mus musculus
gctgctgactccagcggttgagttg

SEQ ID NO: 571427 - DNA, 25 bp, Mus musculus
gctgctgactcctgcggttgagttg

SEQ ID NO: 571428 - DNA, 25 bp, Mus musculus
gctgctgacttcatgttagcctgtg

SEQ ID NO: 571429 - DNA, 25 bp, Mus musculus
gctgctgacttcttgttagcctgtg

SEQ ID NO: 571430 - DNA, 25 bp, Mus musculus
gctgctgactttcaaccacacttga

SEQ ID NO: 571431 - DNA, 25 bp, Mus musculus
gctgctgactttgaaccacacttga

SEQ ID NO: 571432 - DNA, 25 bp, Mus musculus
gctgctgagaaaacgtacaataact

SEQ ID NO: 571433 - DNA, 25 bp, Mus musculus
gctgctgagaaatcgtacaataact

SEQ ID NO: 571434 - DNA, 25 bp, Mus musculus
gctgctgagaacaatgtgccttatt

SEQ ID NO: 571435 - DNA, 25 bp, Mus musculus
gctgctgagaactatgtgccttatt

SEQ ID NO: 571436 - DNA, 25 bp, Mus musculus
gctgctgaggctacaggaccaggat

SEQ ID NO: 571437 - DNA, 25 bp, Mus musculus
gctgctgaggcttcaggaccaggat

SEQ ID NO: 571438 - DNA, 25 bp, Mus musculus
gctgctgagtctctaccatgagata

SEQ ID NO: 571439 - DNA, 25 bp, Mus musculus
gctgctgagtctgtaccatgagata

SEQ ID NO: 571440 - DNA, 25 bp, Mus musculus
gctgctgatagcaggttctttgata

SEQ ID NO: 571441 - DNA, 25 bp, Mus musculus
gctgctgatagctggttctttgata

SEQ ID NO: 571442 - DNA, 25 bp, Mus musculus
gctgctgatgccattatataacaat

SEQ ID NO: 571443 - DNA, 25 bp, Mus musculus
gctgctgatgcccttgaagcatcag

SEQ ID NO: 571444 - DNA, 25 bp, Mus musculus
gctgctgatgccgttgaagcatcag

SEQ ID NO: 571445 - DNA, 25 bp, Mus musculus
gctgctgatgcctttatataacaat

SEQ ID NO: 571446 - DNA, 25 bp, Mus musculus
gctgctgatggaatacgcgggcaac

SEQ ID NO: 571447 - DNA, 25 bp, Mus musculus
gctgctgatggattacgcgggcaac

SEQ ID NO: 571448 - DNA, 25 bp, Mus musculus
gctgctgattgaattcatacactca

SEQ ID NO: 571449 - DNA, 25 bp, Mus musculus
gctgctgattgatttcatacactca

SEQ ID NO: 571450 - DNA, 25 bp, Mus musculus
gctgctgattgcagctgccatggag

SEQ ID NO: 571451 - DNA, 25 bp, Mus musculus
gctgctgattgctgctgccatggag

SEQ ID NO: 571452 - DNA, 25 bp, Mus musculus
gctgctgatttaaggctctgtacac

SEQ ID NO: 571453 - DNA, 25 bp, Mus musculus
gctgctgatttatggctctgtacac

SEQ ID NO: 571454 - DNA, 25 bp, Mus musculus
gctgctgcaagcctgatctgaagaa

SEQ ID NO: 571455 - DNA, 25 bp, Mus musculus
gctgctgcaagcgtgatctgaagaa

SEQ ID NO: 571456 - DNA, 25 bp, Mus musculus
gctgctgcaattctgtgggactttc

SEQ ID NO: 571457 - DNA, 25 bp, Mus musculus
gctgctgcaattgtgtgggactttc

SEQ ID NO: 571458 - DNA, 25 bp, Mus musculus
gctgctgcacagcatccagaggatg

SEQ ID NO: 571459 - DNA, 25 bp, Mus musculus
gctgctgcacaggatccagaggatg

SEQ ID NO: 571460 - DNA, 25 bp, Mus musculus
gctgctgcactcacaattatagaat

SEQ ID NO: 571461 - DNA, 25 bp, Mus musculus
gctgctgcactctcaattatagaat

SEQ ID NO: 571462 - DNA, 25 bp, Mus musculus
gctgctgcactgcaatggcagcctt

SEQ ID NO: 571463 - DNA, 25 bp, Mus musculus
gctgctgcactggaatggcagcctt

SEQ ID NO: 571464 - DNA, 25 bp, Mus musculus
gctgctgcagagagatcacgaagct

SEQ ID NO: 571465 - DNA, 25 bp, Mus musculus
gctgctgcagagtgatcacgaagct

SEQ ID NO: 571466 - DNA, 25 bp, Mus musculus
gctgctgcagcacaacttgaaatag

SEQ ID NO: 571467 - DNA, 25 bp, Mus musculus
gctgctgcagcagaacttgaaatag

SEQ ID NO: 571468 - DNA, 25 bp, Mus musculus
gctgctgcagctcacgagtcgtctt

SEQ ID NO: 571469 - DNA, 25 bp, Mus musculus
gctgctgcagctgacgagtcgtctt

SEQ ID NO: 571470 - DNA, 25 bp, Mus musculus
gctgctgcaggcatcagtagagctt

SEQ ID NO: 571471 - DNA, 25 bp, Mus musculus
gctgctgcaggcatgtcccgggcca

SEQ ID NO: 571472 - DNA, 25 bp, Mus musculus
gctgctgcaggcttcagtagagctt

SEQ ID NO: 571473 - DNA, 25 bp, Mus musculus
gctgctgcaggcttgtcccgggcca

SEQ ID NO: 571474 - DNA, 25 bp, Mus musculus
gctgctgcagggaagcaggtccact

SEQ ID NO: 571475 - DNA, 25 bp, Mus musculus
gctgctgcagggtagcaggtccact

SEQ ID NO: 571476 - DNA, 25 bp, Mus musculus
gctgctgcaggtaagtctcacaaga

SEQ ID NO: 571477 - DNA, 25 bp, Mus musculus
gctgctgcaggttagtctcacaaga

SEQ ID NO: 571478 - DNA, 25 bp, Mus musculus
gctgctgcagtactttttcccatga

SEQ ID NO: 571479 - DNA, 25 bp, Mus musculus
gctgctgcagtagtttttcccatga

SEQ ID NO: 571480 - DNA, 25 bp, Mus musculus
gctgctgcatgtagccttcgagaga

SEQ ID NO: 571481 - DNA, 25 bp, Mus musculus
gctgctgcatgttgccttcgagaga

SEQ ID NO: 571482 - DNA, 25 bp, Mus musculus
gctgctgccaaaagtggagccagat

SEQ ID NO: 571483 - DNA, 25 bp, Mus musculus
gctgctgccaaatgtggagccagat

SEQ ID NO: 571484 - DNA, 25 bp, Mus musculus
gctgctgccaaccaaaccagtatta

SEQ ID NO: 571485 - DNA, 25 bp, Mus musculus
gctgctgccaacgaaaccagtatta

SEQ ID NO: 571486 - DNA, 25 bp, Mus musculus
gctgctgccacacggttcatttttg

SEQ ID NO: 571487 - DNA, 25 bp, Mus musculus
gctgctgccacagggttcatttttg

SEQ ID NO: 571488 - DNA, 25 bp, Mus musculus
gctgctgccatgattgcttactaaa

SEQ ID NO: 571489 - DNA, 25 bp, Mus musculus
gctgctgccatgtttgcttactaaa

SEQ ID NO: 571490 - DNA, 25 bp, Mus musculus
gctgctgccctcaatgtctgggtga

SEQ ID NO: 571491 - DNA, 25 bp, Mus musculus
gctgctgccctctatgtctgggtga

SEQ ID NO: 571492 - DNA, 25 bp, Mus musculus
gctgctgccgtcactcagagaaaaa

SEQ ID NO: 571493 - DNA, 25 bp, Mus musculus
gctgctgccgtctctcagagaaaaa

SEQ ID NO: 571494 - DNA, 25 bp, Mus musculus
gctgctgcctgaaatagaatggatc

SEQ ID NO: 571495 - DNA, 25 bp, Mus musculus
gctgctgcctgatatagaatggatc

SEQ ID NO: 571496 - DNA, 25 bp, Mus musculus
gctgctgcggagagcctaaagccac

SEQ ID NO: 571497 - DNA, 25 bp, Mus musculus
gctgctgcggagtgcctaaagccac

SEQ ID NO: 571498 - DNA, 25 bp, Mus musculus
gctgctgcgtttacaccttaaacat

SEQ ID NO: 571499 - DNA, 25 bp, Mus musculus
gctgctgcgttttcaccttaaacat

SEQ ID NO: 571500 - DNA, 25 bp, Mus musculus
gctgctgctaacatgcatcctgagt

SEQ ID NO: 571501 - DNA, 25 bp, Mus musculus
gctgctgctaacttgcatcctgagt

SEQ ID NO: 571502 - DNA, 25 bp, Mus musculus
gctgctgctacaatggctgtgccta

SEQ ID NO: 571503 - DNA, 25 bp, Mus musculus
gctgctgctacattggctgtgccta

SEQ ID NO: 571504 - DNA, 25 bp, Mus musculus
gctgctgctaccacttagacaagaa

SEQ ID NO: 571505 - DNA, 25 bp, Mus musculus
gctgctgctacctcttagacaagaa

SEQ ID NO: 571506 - DNA, 25 bp, Mus musculus
gctgctgctactctgttttttgaaa

SEQ ID NO: 571507 - DNA, 25 bp, Mus musculus
gctgctgctactgtgttttttgaaa

SEQ ID NO: 571508 - DNA, 25 bp, Mus musculus
gctgctgctatcctgtattgcaaat

SEQ ID NO: 571509 - DNA, 25 bp, Mus musculus
gctgctgctatcgtgtattgcaaat

SEQ ID NO: 571510 - DNA, 25 bp, Mus musculus
gctgctgctcagattggaactgggc

SEQ ID NO: 571511 - DNA, 25 bp, Mus musculus
gctgctgctcagtttggaactgggc

SEQ ID NO: 571512 - DNA, 25 bp, Mus musculus
gctgctgctctaacttggcattgaa

SEQ ID NO: 571513 - DNA, 25 bp, Mus musculus
gctgctgctctatcttggcattgaa

SEQ ID NO: 571514 - DNA, 25 bp, Mus musculus
gctgctgctgaacctgttgtttcaa

SEQ ID NO: 571515 - DNA, 25 bp, Mus musculus
gctgctgctgaagctgttgtttcaa

SEQ ID NO: 571516 - DNA, 25 bp, Mus musculus
gctgctgctgagacgggatttcgaa

SEQ ID NO: 571517 - DNA, 25 bp, Mus musculus
gctgctgctgagcacgcatgtatag

SEQ ID NO: 571518 - DNA, 25 bp, Mus musculus
gctgctgctgaggacgcatgtatag

SEQ ID NO: 571519 - DNA, 25 bp, Mus musculus
gctgctgctgagtcgggatttcgaa

SEQ ID NO: 571520 - DNA, 25 bp, Mus musculus
gctgctgctgcccagactgctgtgt

SEQ ID NO: 571521 - DNA, 25 bp, Mus musculus
gctgctgctgccgagactgctgtgt

SEQ ID NO: 571522 - DNA, 25 bp, Mus musculus
gctgctgctggacatgattgagttc

SEQ ID NO: 571523 - DNA, 25 bp, Mus musculus
gctgctgctggagatgattgagttc

SEQ ID NO: 571524 - DNA, 25 bp, Mus musculus
gctgctgctggtcgaaagtcctaga

SEQ ID NO: 571525 - DNA, 25 bp, Mus musculus
gctgctgctggtggaaagtcctaga

SEQ ID NO: 571526 - DNA, 25 bp, Mus musculus
gctgctgctgtactaccacagatta

SEQ ID NO: 571527 - DNA, 25 bp, Mus musculus
gctgctgctgtagtaccacagatta

SEQ ID NO: 571528 - DNA, 25 bp, Mus musculus
gctgctgctgtcattgtacgaagac

SEQ ID NO: 571529 - DNA, 25 bp, Mus musculus
gctgctgctgtctttgtacgaagac

SEQ ID NO: 571530 - DNA, 25 bp, Mus musculus
gctgctgctgtgacttcaaaacctg

SEQ ID NO: 571531 - DNA, 25 bp, Mus musculus
gctgctgctgtgtcttcaaaacctg

SEQ ID NO: 571532 - DNA, 25 bp, Mus musculus
gctgctgcttataggactcacctgc

SEQ ID NO: 571533 - DNA, 25 bp, Mus musculus
gctgctgcttattggactcacctgc

SEQ ID NO: 571534 - DNA, 25 bp, Mus musculus
gctgctgcttgtagctgattgttgc

SEQ ID NO: 571535 - DNA, 25 bp, Mus musculus
gctgctgcttgttgctgattgttgc

SEQ ID NO: 571536 - DNA, 25 bp, Mus musculus
gctgctggaacaagtgatgcctcta

SEQ ID NO: 571537 - DNA, 25 bp, Mus musculus
gctgctggaacatgtgatgcctcta

SEQ ID NO: 571538 - DNA, 25 bp, Mus musculus
gctgctggaggacactattatgctt

SEQ ID NO: 571539 - DNA, 25 bp, Mus musculus
gctgctggaggagactattatgctt

SEQ ID NO: 571540 - DNA, 25 bp, Mus musculus
gctgctggaggcatttcataaccgg

SEQ ID NO: 571541 - DNA, 25 bp, Mus musculus
gctgctggaggcttttcataaccgg

SEQ ID NO: 571542 - DNA, 25 bp, Mus musculus
gctgctggagtgcaactaactgccc

SEQ ID NO: 571543 - DNA, 25 bp, Mus musculus
gctgctggagtggaactaactgccc

SEQ ID NO: 571544 - DNA, 25 bp, Mus musculus
gctgctggataaagcggaagaagac

SEQ ID NO: 571545 - DNA, 25 bp, Mus musculus
gctgctggataatgcggaagaagac

SEQ ID NO: 571546 - DNA, 25 bp, Mus musculus
gctgctggattcacttacacagatg

SEQ ID NO: 571547 - DNA, 25 bp, Mus musculus
gctgctggattctcttacacagatg

SEQ ID NO: 571548 - DNA, 25 bp, Mus musculus
gctgctggcacaaccacaaatggta

SEQ ID NO: 571549 - DNA, 25 bp, Mus musculus
gctgctggcacatccacaaatggta

SEQ ID NO: 571550 - DNA, 25 bp, Mus musculus
gctgctggcagcatgaaccaggact

SEQ ID NO: 571551 - DNA, 25 bp, Mus musculus
gctgctggcagcttgaaccaggact

SEQ ID NO: 571552 - DNA, 25 bp, Mus musculus
gctgctggcagtcgatcctaagatc

SEQ ID NO: 571553 - DNA, 25 bp, Mus musculus
gctgctggcagtggatcctaagatc

SEQ ID NO: 571554 - DNA, 25 bp, Mus musculus
gctgctggccgtattttacacgacg

SEQ ID NO: 571555 - DNA, 25 bp, Mus musculus
gctgctggccgttttttacacgacg

SEQ ID NO: 571556 - DNA, 25 bp, Mus musculus
gctgctggctgaaaactgtgtctat

SEQ ID NO: 571557 - DNA, 25 bp, Mus musculus
gctgctggctgactgtttacacatt

SEQ ID NO: 571558 - DNA, 25 bp, Mus musculus
gctgctggctgagtgtttacacatt

SEQ ID NO: 571559 - DNA, 25 bp, Mus musculus
gctgctggctgataactgtgtctat

SEQ ID NO: 571560 - DNA, 25 bp, Mus musculus
gctgctggctggctgtttaattatg

SEQ ID NO: 571561 - DNA, 25 bp, Mus musculus
gctgctggctgggtgtttaattatg

SEQ ID NO: 571562 - DNA, 25 bp, Mus musculus
gctgctggctttctatcatctttat

SEQ ID NO: 571563 - DNA, 25 bp, Mus musculus
gctgctggctttgtatcatctttat

SEQ ID NO: 571564 - DNA, 25 bp, Mus musculus
gctgctgggaaaccaggaagcttct

SEQ ID NO: 571565 - DNA, 25 bp, Mus musculus
gctgctgggaaagcaggaagcttct

SEQ ID NO: 571566 - DNA, 25 bp, Mus musculus
gctgctgggcaacgaatcccgatgc

SEQ ID NO: 571567 - DNA, 25 bp, Mus musculus
gctgctgggcaaggaatcccgatgc

SEQ ID NO: 571568 - DNA, 25 bp, Mus musculus
gctgctgggtaaagcttgtgacctc

SEQ ID NO: 571569 - DNA, 25 bp, Mus musculus
gctgctgggtaatgcttgtgacctc

SEQ ID NO: 571570 - DNA, 25 bp, Mus musculus
gctgctggtcacaagcgaatacccc

SEQ ID NO: 571571 - DNA, 25 bp, Mus musculus
gctgctggtcactagcgaatacccc

SEQ ID NO: 571572 - DNA, 25 bp, Mus musculus
gctgctggtcggacttgtcgtgtat

SEQ ID NO: 571573 - DNA, 25 bp, Mus musculus
gctgctggtcggtcttgtcgtgtat

SEQ ID NO: 571574 - DNA, 25 bp, Mus musculus
gctgctggtctcatctacagttatg

SEQ ID NO: 571575 - DNA, 25 bp, Mus musculus
gctgctggtctcttctacagttatg

SEQ ID NO: 571576 - DNA, 25 bp, Mus musculus
gctgctggtgctccagtacatatgg

SEQ ID NO: 571577 - DNA, 25 bp, Mus musculus
gctgctggtgctgcagtacatatgg

SEQ ID NO: 571578 - DNA, 25 bp, Mus musculus
gctgctggtggaagaagatggctgg

SEQ ID NO: 571579 - DNA, 25 bp, Mus musculus
gctgctggtggatgaagatggctgg

SEQ ID NO: 571580 - DNA, 25 bp, Mus musculus
gctgctggtggtcttcctggctaca

SEQ ID NO: 571581 - DNA, 25 bp, Mus musculus
gctgctggtggtgttcctggctaca

SEQ ID NO: 571582 - DNA, 25 bp, Mus musculus
gctgctggtgtaagactcttgatga

SEQ ID NO: 571583 - DNA, 25 bp, Mus musculus
gctgctggtgtatgactcttgatga

SEQ ID NO: 571584 - DNA, 25 bp, Mus musculus
gctgctggttctcgctgctgtaaaa

SEQ ID NO: 571585 - DNA, 25 bp, Mus musculus
gctgctggttctggctgctgtaaaa

SEQ ID NO: 571586 - DNA, 25 bp, Mus musculus
gctgctggttgtctgttcatgagaa

SEQ ID NO: 571587 - DNA, 25 bp, Mus musculus
gctgctggttgtgtgttcatgagaa

SEQ ID NO: 571588 - DNA, 25 bp, Mus musculus
gctgctggtttgatcttgtaattgt

SEQ ID NO: 571589 - DNA, 25 bp, Mus musculus
gctgctggtttgttcttgtaattgt

SEQ ID NO: 571590 - DNA, 25 bp, Mus musculus
gctgctggttttcgacgtcagcact

SEQ ID NO: 571591 - DNA, 25 bp, Mus musculus
gctgctggttttggacgtcagcact

SEQ ID NO: 571592 - DNA, 25 bp, Mus musculus
gctgctgtacaaataacttggagat

SEQ ID NO: 571593 - DNA, 25 bp, Mus musculus
gctgctgtacaattaacttggagat

SEQ ID NO: 571594 - DNA, 25 bp, Mus musculus
gctgctgtactcagctctatagaca

SEQ ID NO: 571595 - DNA, 25 bp, Mus musculus
gctgctgtactctgctctatagaca

SEQ ID NO: 571596 - DNA, 25 bp, Mus musculus
gctgctgtagaccagcttcgaactg

SEQ ID NO: 571597 - DNA, 25 bp, Mus musculus
gctgctgtagacgagcttcgaactg

SEQ ID NO: 571598 - DNA, 25 bp, Mus musculus
gctgctgtagcaaaatgcctgagta

SEQ ID NO: 571599 - DNA, 25 bp, Mus musculus
gctgctgtagcataatgcctgagta

SEQ ID NO: 571600 - DNA, 25 bp, Mus musculus
gctgctgtagctctcagctggacct

SEQ ID NO: 571601 - DNA, 25 bp, Mus musculus
gctgctgtagctgtcagctggacct

SEQ ID NO: 571602 - DNA, 25 bp, Mus musculus
gctgctgtaggacttagggttcatc

SEQ ID NO: 571603 - DNA, 25 bp, Mus musculus
gctgctgtaggacttcagacatcca

SEQ ID NO: 571604 - DNA, 25 bp, Mus musculus
gctgctgtaggagttagggttcatc

SEQ ID NO: 571605 - DNA, 25 bp, Mus musculus
gctgctgtaggagttcagacatcca

SEQ ID NO: 571606 - DNA, 25 bp, Mus musculus
gctgctgtaggtaggaactgctgtt

SEQ ID NO: 571607 - DNA, 25 bp, Mus musculus
gctgctgtaggttggaactgctgtt

SEQ ID NO: 571608 - DNA, 25 bp, Mus musculus
gctgctgtagttatgtcccgcctct

SEQ ID NO: 571609 - DNA, 25 bp, Mus musculus
gctgctgtagttttgtcccgcctct

SEQ ID NO: 571610 - DNA, 25 bp, Mus musculus
gctgctgtataactccttcaaagtc

SEQ ID NO: 571611 - DNA, 25 bp, Mus musculus
gctgctgtataagtccttcaaagtc

SEQ ID NO: 571612 - DNA, 25 bp, Mus musculus
gctgctgtatgtcctggtgctgata

SEQ ID NO: 571613 - DNA, 25 bp, Mus musculus
gctgctgtatgtgctggtgctgata

SEQ ID NO: 571614 - DNA, 25 bp, Mus musculus
gctgctgtatttatgctgcacattt

SEQ ID NO: 571615 - DNA, 25 bp, Mus musculus
gctgctgtatttttgctgcacattt

SEQ ID NO: 571616 - DNA, 25 bp, Mus musculus
gctgctgtcagacacgagtgttatt

SEQ ID NO: 571617 - DNA, 25 bp, Mus musculus
gctgctgtcagagacgagtgttatt

SEQ ID NO: 571618 - DNA, 25 bp, Mus musculus
gctgctgtcatccttcatgttaaac

SEQ ID NO: 571619 - DNA, 25 bp, Mus musculus
gctgctgtcatcgttcatgttaaac

SEQ ID NO: 571620 - DNA, 25 bp, Mus musculus
gctgctgtccaaagttgggttttta

SEQ ID NO: 571621 - DNA, 25 bp, Mus musculus
gctgctgtccaatgttgggttttta

SEQ ID NO: 571622 - DNA, 25 bp, Mus musculus
gctgctgtcctaaactttcctgagt

SEQ ID NO: 571623 - DNA, 25 bp, Mus musculus
gctgctgtcctatactttcctgagt

SEQ ID NO: 571624 - DNA, 25 bp, Mus musculus
gctgctgtcgtcaccactaaagaaa

SEQ ID NO: 571625 - DNA, 25 bp, Mus musculus
gctgctgtcgtctccactaaagaaa

SEQ ID NO: 571626 - DNA, 25 bp, Mus musculus
gctgctgtcttactggctgcaccca

SEQ ID NO: 571627 - DNA, 25 bp, Mus musculus
gctgctgtcttagtggctgcaccca

SEQ ID NO: 571628 - DNA, 25 bp, Mus musculus
gctgctgtctttctgctatctgggc

SEQ ID NO: 571629 - DNA, 25 bp, Mus musculus
gctgctgtctttgtgctatctgggc

SEQ ID NO: 571630 - DNA, 25 bp, Mus musculus
gctgctgtgaacacggacaggcctg

SEQ ID NO: 571631 - DNA, 25 bp, Mus musculus
gctgctgtgaactcggacaggcctg

SEQ ID NO: 571632 - DNA, 25 bp, Mus musculus
gctgctgtgacccttgtatattaca

SEQ ID NO: 571633 - DNA, 25 bp, Mus musculus
gctgctgtgaccgttgtatattaca

SEQ ID NO: 571634 - DNA, 25 bp, Mus musculus
gctgctgtgcagaccgtgggaaata

SEQ ID NO: 571635 - DNA, 25 bp, Mus musculus
gctgctgtgcagcacccagctcaga

SEQ ID NO: 571636 - DNA, 25 bp, Mus musculus
gctgctgtgcagctgcctgagcaaa

SEQ ID NO: 571637 - DNA, 25 bp, Mus musculus
gctgctgtgcaggacccagctcaga

SEQ ID NO: 571638 - DNA, 25 bp, Mus musculus
gctgctgtgcaggtgcctgagcaaa

SEQ ID NO: 571639 - DNA, 25 bp, Mus musculus
gctgctgtgcagtccgtgggaaata

SEQ ID NO: 571640 - DNA, 25 bp, Mus musculus
gctgctgtgccaagaaggacctttt

SEQ ID NO: 571641 - DNA, 25 bp, Mus musculus
gctgctgtgccatgaaggacctttt

SEQ ID NO: 571642 - DNA, 25 bp, Mus musculus
gctgctgtgctaaatcattttgtaa

SEQ ID NO: 571643 - DNA, 25 bp, Mus musculus
gctgctgtgctatatcattttgtaa

SEQ ID NO: 571644 - DNA, 25 bp, Mus musculus
gctgctgtgctgaactgggacagta

SEQ ID NO: 571645 - DNA, 25 bp, Mus musculus
gctgctgtgctgtactgggacagta

SEQ ID NO: 571646 - DNA, 25 bp, Mus musculus
gctgctgtggacatatacccttgat

SEQ ID NO: 571647 - DNA, 25 bp, Mus musculus
gctgctgtggacctgcatcatgaat

SEQ ID NO: 571648 - DNA, 25 bp, Mus musculus
gctgctgtggacgtgcatcatgaat

SEQ ID NO: 571649 - DNA, 25 bp, Mus musculus
gctgctgtggacttatacccttgat

SEQ ID NO: 571650 - DNA, 25 bp, Mus musculus
gctgctgtgggtaaggtgcaccata

SEQ ID NO: 571651 - DNA, 25 bp, Mus musculus
gctgctgtgggttaggtgcaccata

SEQ ID NO: 571652 - DNA, 25 bp, Mus musculus
gctgctgtgtaaattaacttgtaaa

SEQ ID NO: 571653 - DNA, 25 bp, Mus musculus
gctgctgtgtaatttaacttgtaaa

SEQ ID NO: 571654 - DNA, 25 bp, Mus musculus
gctgctgtgtatcgcctgctgtgcc

SEQ ID NO: 571655 - DNA, 25 bp, Mus musculus
gctgctgtgtatggcctgctgtgcc

SEQ ID NO: 571656 - DNA, 25 bp, Mus musculus
gctgctgtgtccagcagttggacca

SEQ ID NO: 571657 - DNA, 25 bp, Mus musculus
gctgctgtgtcctgcagttggacca

SEQ ID NO: 571658 - DNA, 25 bp, Mus musculus
gctgctgtgtttatgctgaacatta

SEQ ID NO: 571659 - DNA, 25 bp, Mus musculus
gctgctgtgtttttgctgaacatta

SEQ ID NO: 571660 - DNA, 25 bp, Mus musculus
gctgctgttacccaaggtactttag

SEQ ID NO: 571661 - DNA, 25 bp, Mus musculus
gctgctgttaccgaaggtactttag

SEQ ID NO: 571662 - DNA, 25 bp, Mus musculus
gctgctgttactcatttctggattt

SEQ ID NO: 571663 - DNA, 25 bp, Mus musculus
gctgctgttactctggaatcatgtg

SEQ ID NO: 571664 - DNA, 25 bp, Mus musculus
gctgctgttactgatttctggattt

SEQ ID NO: 571665 - DNA, 25 bp, Mus musculus
gctgctgttactgtggaatcatgtg

SEQ ID NO: 571666 - DNA, 25 bp, Mus musculus
gctgctgttagtacctcttggatga

SEQ ID NO: 571667 - DNA, 25 bp, Mus musculus
gctgctgttagtctaacctaaccca

SEQ ID NO: 571668 - DNA, 25 bp, Mus musculus
gctgctgttagtgtaacctaaccca

SEQ ID NO: 571669 - DNA, 25 bp, Mus musculus
gctgctgttagttcctcttggatga

SEQ ID NO: 571670 - DNA, 25 bp, Mus musculus
gctgctgttcaccaaagtctgtttg

SEQ ID NO: 571671 - DNA, 25 bp, Mus musculus
gctgctgttcacgaaagtctgtttg

SEQ ID NO: 571672 - DNA, 25 bp, Mus musculus
gctgctgttctactaaaaattcttc

SEQ ID NO: 571673 - DNA, 25 bp, Mus musculus
gctgctgttctagtaaaaattcttc

SEQ ID NO: 571674 - DNA, 25 bp, Mus musculus
gctgctgttcttagggaagctgctg

SEQ ID NO: 571675 - DNA, 25 bp, Mus musculus
gctgctgttctttgggaagctgctg

SEQ ID NO: 571676 - DNA, 25 bp, Mus musculus
gctgctgttgatcctggctttgttc

SEQ ID NO: 571677 - DNA, 25 bp, Mus musculus
gctgctgttgatgctggctttgttc

SEQ ID NO: 571678 - DNA, 25 bp, Mus musculus
gctgctgttgcactataaacgctag

SEQ ID NO: 571679 - DNA, 25 bp, Mus musculus
gctgctgttgcagtataaacgctag

SEQ ID NO: 571680 - DNA, 25 bp, Mus musculus
gctgctgttgctcaaatgtggcttt

SEQ ID NO: 571681 - DNA, 25 bp, Mus musculus
gctgctgttgctgaaatgtggcttt

SEQ ID NO: 571682 - DNA, 25 bp, Mus musculus
gctgctgttgtcagtgctgtgagta

SEQ ID NO: 571683 - DNA, 25 bp, Mus musculus
gctgctgttgtctgtgctgtgagta

SEQ ID NO: 571684 - DNA, 25 bp, Mus musculus
gctgctgtttaacttgacaacttcc

SEQ ID NO: 571685 - DNA, 25 bp, Mus musculus
gctgctgtttaagttgacaacttcc

SEQ ID NO: 571686 - DNA, 25 bp, Mus musculus
gctgctgtttgaacttagcctaggg

SEQ ID NO: 571687 - DNA, 25 bp, Mus musculus
gctgctgtttgaagacatctcagca

SEQ ID NO: 571688 - DNA, 25 bp, Mus musculus
gctgctgtttgatcttagcctaggg

SEQ ID NO: 571689 - DNA, 25 bp, Mus musculus
gctgctgtttgatgacatctcagca

SEQ ID NO: 571690 - DNA, 25 bp, Mus musculus
gctgctgtttgcataaggaattatc

SEQ ID NO: 571691 - DNA, 25 bp, Mus musculus
gctgctgtttgcttaaggaattatc

SEQ ID NO: 571692 - DNA, 25 bp, Mus musculus
gctgctgtttgtaaacttctgggtg

SEQ ID NO: 571693 - DNA, 25 bp, Mus musculus
gctgctgtttgttaacttctgggtg

SEQ ID NO: 571694 - DNA, 25 bp, Mus musculus
gctgctgttttgctacttggagaaa

SEQ ID NO: 571695 - DNA, 25 bp, Mus musculus
gctgctgttttggtacttggagaaa

SEQ ID NO: 571696 - DNA, 25 bp, Mus musculus
gctgctgtttttacaaacgaaggaa

SEQ ID NO: 571697 - DNA, 25 bp, Mus musculus
gctgctgttttttcaaacgaaggaa

SEQ ID NO: 571698 - DNA, 25 bp, Mus musculus
gctgcttaaaagaaggcctctgaga

SEQ ID NO: 571699 - DNA, 25 bp, Mus musculus
gctgcttaaaagtaggcctctgaga

SEQ ID NO: 571700 - DNA, 25 bp, Mus musculus
gctgcttaactgaactacatccttg

SEQ ID NO: 571701 - DNA, 25 bp, Mus musculus
gctgcttaactgtactacatccttg

SEQ ID NO: 571702 - DNA, 25 bp, Mus musculus
gctgcttaccatccctgcaataaag

SEQ ID NO: 571703 - DNA, 25 bp, Mus musculus
gctgcttaccatgcctgcaataaag

SEQ ID NO: 571704 - DNA, 25 bp, Mus musculus
gctgcttacccaagaggccgtgtga

SEQ ID NO: 571705 - DNA, 25 bp, Mus musculus
gctgcttacccatgaggccgtgtga

SEQ ID NO: 571706 - DNA, 25 bp, Mus musculus
gctgcttaccctagcttggattgca

SEQ ID NO: 571707 - DNA, 25 bp, Mus musculus
gctgcttacccttgcttggattgca

SEQ ID NO: 571708 - DNA, 25 bp, Mus musculus
gctgcttagattattagaggtttta

SEQ ID NO: 571709 - DNA, 25 bp, Mus musculus
gctgcttagatttttagaggtttta

SEQ ID NO: 571710 - DNA, 25 bp, Mus musculus
gctgcttagtgaagcacctggtgtt

SEQ ID NO: 571711 - DNA, 25 bp, Mus musculus
gctgcttagtgatgcacctggtgtt

SEQ ID NO: 571712 - DNA, 25 bp, Mus musculus
gctgcttagtggaaccatttacttg

SEQ ID NO: 571713 - DNA, 25 bp, Mus musculus
gctgcttagtggtaccatttacttg

SEQ ID NO: 571714 - DNA, 25 bp, Mus musculus
gctgcttatattagctctgtggaag

SEQ ID NO: 571715 - DNA, 25 bp, Mus musculus
gctgcttatatttgctctgtggaag

SEQ ID NO: 571716 - DNA, 25 bp, Mus musculus
gctgcttatgagctcagttgtctct

SEQ ID NO: 571717 - DNA, 25 bp, Mus musculus
gctgcttatgaggtcagttgtctct

SEQ ID NO: 571718 - DNA, 25 bp, Mus musculus
gctgcttattccaatgtgttttctg

SEQ ID NO: 571719 - DNA, 25 bp, Mus musculus
gctgcttattcctatgtgttttctg

SEQ ID NO: 571720 - DNA, 25 bp, Mus musculus
gctgcttattgaccagttaattaac

SEQ ID NO: 571721 - DNA, 25 bp, Mus musculus
gctgcttattgagcagttaattaac

SEQ ID NO: 571722 - DNA, 25 bp, Mus musculus
gctgcttcaagcctatgacacttct

SEQ ID NO: 571723 - DNA, 25 bp, Mus musculus
gctgcttcaagcgtatgacacttct

SEQ ID NO: 571724 - DNA, 25 bp, Mus musculus
gctgcttcacagctcagaacatgta

SEQ ID NO: 571725 - DNA, 25 bp, Mus musculus
gctgcttcacaggtcagaacatgta

SEQ ID NO: 571726 - DNA, 25 bp, Mus musculus
gctgcttcagcaatttgtttcacaa

SEQ ID NO: 571727 - DNA, 25 bp, Mus musculus
gctgcttcagcattttgtttcacaa

SEQ ID NO: 571728 - DNA, 25 bp, Mus musculus
gctgcttcagccagcataggaactc

SEQ ID NO: 571729 - DNA, 25 bp, Mus musculus
gctgcttcagcctgcataggaactc

SEQ ID NO: 571730 - DNA, 25 bp, Mus musculus
gctgcttcagcgctcacagactgaa

SEQ ID NO: 571731 - DNA, 25 bp, Mus musculus
gctgcttcagcggtcacagactgaa

SEQ ID NO: 571732 - DNA, 25 bp, Mus musculus
gctgcttcagctccatccatgtgaa

SEQ ID NO: 571733 - DNA, 25 bp, Mus musculus
gctgcttcagctgcatccatgtgaa

SEQ ID NO: 571734 - DNA, 25 bp, Mus musculus
gctgcttcagtgattcacaaaccgg

SEQ ID NO: 571735 - DNA, 25 bp, Mus musculus
gctgcttcagtgtttcacaaaccgg

SEQ ID NO: 571736 - DNA, 25 bp, Mus musculus
gctgcttcccacacttgtttaggaa

SEQ ID NO: 571737 - DNA, 25 bp, Mus musculus
gctgcttcccactcttgtttaggaa

SEQ ID NO: 571738 - DNA, 25 bp, Mus musculus
gctgcttcccatacatactattgga

SEQ ID NO: 571739 - DNA, 25 bp, Mus musculus
gctgcttcccattcatactattgga

SEQ ID NO: 571740 - DNA, 25 bp, Mus musculus
gctgcttcgcctagaattggcagaa

SEQ ID NO: 571741 - DNA, 25 bp, Mus musculus
gctgcttcgccttgaattggcagaa

SEQ ID NO: 571742 - DNA, 25 bp, Mus musculus
gctgcttctgagcttggattagaga

SEQ ID NO: 571743 - DNA, 25 bp, Mus musculus
gctgcttctgaggttggattagaga

SEQ ID NO: 571744 - DNA, 25 bp, Mus musculus
gctgcttctggcaatgtggcttcaa

SEQ ID NO: 571745 - DNA, 25 bp, Mus musculus
gctgcttctggcctttagattgtgg

SEQ ID NO: 571746 - DNA, 25 bp, Mus musculus
gctgcttctggcgtttagattgtgg

SEQ ID NO: 571747 - DNA, 25 bp, Mus musculus
gctgcttctggctatgtggcttcaa

SEQ ID NO: 571748 - DNA, 25 bp, Mus musculus
gctgcttctgtcaactcaacaagag

SEQ ID NO: 571749 - DNA, 25 bp, Mus musculus
gctgcttctgtctactcaacaagag

SEQ ID NO: 571750 - DNA, 25 bp, Mus musculus
gctgcttctgtgaacacctgcttta

SEQ ID NO: 571751 - DNA, 25 bp, Mus musculus
gctgcttctgtgtacacctgcttta

SEQ ID NO: 571752 - DNA, 25 bp, Mus musculus
gctgcttgaagtatggttgccatct

SEQ ID NO: 571753 - DNA, 25 bp, Mus musculus
gctgcttgaagtttggttgccatct

SEQ ID NO: 571754 - DNA, 25 bp, Mus musculus
gctgcttgatagaagtctgtggctt

SEQ ID NO: 571755 - DNA, 25 bp, Mus musculus
gctgcttgatagtagtctgtggctt

SEQ ID NO: 571756 - DNA, 25 bp, Mus musculus
gctgcttgatcgctggcccgatgat

SEQ ID NO: 571757 - DNA, 25 bp, Mus musculus
gctgcttgatcggtggcccgatgat

SEQ ID NO: 571758 - DNA, 25 bp, Mus musculus
gctgcttgcaacaaacttccaacat

SEQ ID NO: 571759 - DNA, 25 bp, Mus musculus
gctgcttgcaactaacttccaacat

SEQ ID NO: 571760 - DNA, 25 bp, Mus musculus
gctgcttgcctaccccgtgagggaa

SEQ ID NO: 571761 - DNA, 25 bp, Mus musculus
gctgcttgcctagcccgtgagggaa

SEQ ID NO: 571762 - DNA, 25 bp, Mus musculus
gctgcttgcgttcagagttcgttaa

SEQ ID NO: 571763 - DNA, 25 bp, Mus musculus
gctgcttgcgttgagagttcgttaa

SEQ ID NO: 571764 - DNA, 25 bp, Mus musculus
gctgcttgctgactcaatacacaca

SEQ ID NO: 571765 - DNA, 25 bp, Mus musculus
gctgcttgctgagtcaatacacaca

SEQ ID NO: 571766 - DNA, 25 bp, Mus musculus
gctgcttgctgcctgaggaacttag

SEQ ID NO: 571767 - DNA, 25 bp, Mus musculus
gctgcttgctgcgtgaggaacttag

SEQ ID NO: 571768 - DNA, 25 bp, Mus musculus
gctgcttggagtatctaagggcaac

SEQ ID NO: 571769 - DNA, 25 bp, Mus musculus
gctgcttggagtttctaagggcaac

SEQ ID NO: 571770 - DNA, 25 bp, Mus musculus
gctgcttgggaaacaactgtcggta

SEQ ID NO: 571771 - DNA, 25 bp, Mus musculus
gctgcttgggaatcaactgtcggta

SEQ ID NO: 571772 - DNA, 25 bp, Mus musculus
gctgcttgggcaccgattactgtca

SEQ ID NO: 571773 - DNA, 25 bp, Mus musculus
gctgcttgggcagcgattactgtca

SEQ ID NO: 571774 - DNA, 25 bp, Mus musculus
gctgcttgggtgcgatattttccct

SEQ ID NO: 571775 - DNA, 25 bp, Mus musculus
gctgcttgggtgggatattttccct

SEQ ID NO: 571776 - DNA, 25 bp, Mus musculus
gctgcttggtagaaggataattctt

SEQ ID NO: 571777 - DNA, 25 bp, Mus musculus
gctgcttggtagtaggataattctt

SEQ ID NO: 571778 - DNA, 25 bp, Mus musculus
gctgcttgtaagaccacatattaac

SEQ ID NO: 571779 - DNA, 25 bp, Mus musculus
gctgcttgtaagtccacatattaac

SEQ ID NO: 571780 - DNA, 25 bp, Mus musculus
gctgcttgtcctaactgaactgtat

SEQ ID NO: 571781 - DNA, 25 bp, Mus musculus
gctgcttgtccttactgaactgtat

SEQ ID NO: 571782 - DNA, 25 bp, Mus musculus
gctgcttgtgctcgcggacattcga

SEQ ID NO: 571783 - DNA, 25 bp, Mus musculus
gctgcttgtgctggcggacattcga

SEQ ID NO: 571784 - DNA, 25 bp, Mus musculus
gctgcttgttaaaagcctcccttaa

SEQ ID NO: 571785 - DNA, 25 bp, Mus musculus
gctgcttgttaatagcctcccttaa

SEQ ID NO: 571786 - DNA, 25 bp, Mus musculus
gctgcttgttgcatgtgttcttcta

SEQ ID NO: 571787 - DNA, 25 bp, Mus musculus
gctgcttgttgcttgtgttcttcta

SEQ ID NO: 571788 - DNA, 25 bp, Mus musculus
gctgctttaagtcaagtgtcccact

SEQ ID NO: 571789 - DNA, 25 bp, Mus musculus
gctgctttaagtgaagtgtcccact

SEQ ID NO: 571790 - DNA, 25 bp, Mus musculus
gctgctttactcacacagtggaagg

SEQ ID NO: 571791 - DNA, 25 bp, Mus musculus
gctgctttactctcacagtggaagg

SEQ ID NO: 571792 - DNA, 25 bp, Mus musculus
gctgctttagctatactgatggaat

SEQ ID NO: 571793 - DNA, 25 bp, Mus musculus
gctgctttagctttactgatggaat

SEQ ID NO: 571794 - DNA, 25 bp, Mus musculus
gctgctttatggattctagagtttt

SEQ ID NO: 571795 - DNA, 25 bp, Mus musculus
gctgctttatggtttctagagtttt

SEQ ID NO: 571796 - DNA, 25 bp, Mus musculus
gctgctttcagcaccaggaacataa

SEQ ID NO: 571797 - DNA, 25 bp, Mus musculus
gctgctttcagctccaggaacataa

SEQ ID NO: 571798 - DNA, 25 bp, Mus musculus
gctgctttccatcaggtctgacttg

SEQ ID NO: 571799 - DNA, 25 bp, Mus musculus
gctgctttccatgaggtctgacttg

SEQ ID NO: 571800 - DNA, 25 bp, Mus musculus
gctgctttcccacaagaccagagtt

SEQ ID NO: 571801 - DNA, 25 bp, Mus musculus
gctgctttcccagaagaccagagtt

SEQ ID NO: 571802 - DNA, 25 bp, Mus musculus
gctgctttcctgacgatatttacta

SEQ ID NO: 571803 - DNA, 25 bp, Mus musculus
gctgctttcctgtcgatatttacta

SEQ ID NO: 571804 - DNA, 25 bp, Mus musculus
gctgctttcgtaacaaataatctgc

SEQ ID NO: 571805 - DNA, 25 bp, Mus musculus
gctgctttcgtatcaaataatctgc

SEQ ID NO: 571806 - DNA, 25 bp, Mus musculus
gctgctttcgtgcccaaggtgatgt

SEQ ID NO: 571807 - DNA, 25 bp, Mus musculus
gctgctttcgtggccaaggtgatgt

SEQ ID NO: 571808 - DNA, 25 bp, Mus musculus
gctgctttctctaaattatctccca

SEQ ID NO: 571809 - DNA, 25 bp, Mus musculus
gctgctttctcttaattatctccca

SEQ ID NO: 571810 - DNA, 25 bp, Mus musculus
gctgctttctggaaacataaaatat

SEQ ID NO: 571811 - DNA, 25 bp, Mus musculus
gctgctttctggtaacataaaatat

SEQ ID NO: 571812 - DNA, 25 bp, Mus musculus
gctgctttcttgattcatcagtagt

SEQ ID NO: 571813 - DNA, 25 bp, Mus musculus
gctgctttcttgtttcatcagtagt

SEQ ID NO: 571814 - DNA, 25 bp, Mus musculus
gctgctttgaccctattgtttacta

SEQ ID NO: 571815 - DNA, 25 bp, Mus musculus
gctgctttgaccgtattgtttacta

SEQ ID NO: 571816 - DNA, 25 bp, Mus musculus
gctgctttgactctagcgtcgctgg

SEQ ID NO: 571817 - DNA, 25 bp, Mus musculus
gctgctttgactgtagcgtcgctgg

SEQ ID NO: 571818 - DNA, 25 bp, Mus musculus
gctgctttgctcaagccgcgaaaag

SEQ ID NO: 571819 - DNA, 25 bp, Mus musculus
gctgctttgctctagccgcgaaaag

SEQ ID NO: 571820 - DNA, 25 bp, Mus musculus
gctgctttgctgaccaatcacaata

SEQ ID NO: 571821 - DNA, 25 bp, Mus musculus
gctgctttgctgtccaatcacaata

SEQ ID NO: 571822 - DNA, 25 bp, Mus musculus
gctgctttggtcacaatcaatggct

SEQ ID NO: 571823 - DNA, 25 bp, Mus musculus
gctgctttggtctcaatcaatggct

SEQ ID NO: 571824 - DNA, 25 bp, Mus musculus
gctgctttggttatagttgactctg

SEQ ID NO: 571825 - DNA, 25 bp, Mus musculus
gctgctttggttttagttgactctg

SEQ ID NO: 571826 - DNA, 25 bp, Mus musculus
gctgcttttaagctatacttccaag

SEQ ID NO: 571827 - DNA, 25 bp, Mus musculus
gctgcttttaaggtatacttccaag

SEQ ID NO: 571828 - DNA, 25 bp, Mus musculus
gctgcttttaatctgctgtggactg

SEQ ID NO: 571829 - DNA, 25 bp, Mus musculus
gctgcttttaatgtgctgtggactg

SEQ ID NO: 571830 - DNA, 25 bp, Mus musculus
gctgcttttagaatatcaggccttc

SEQ ID NO: 571831 - DNA, 25 bp, Mus musculus
gctgcttttagattatcaggccttc

SEQ ID NO: 571832 - DNA, 25 bp, Mus musculus
gctgcttttcctcacatctgttcat

SEQ ID NO: 571833 - DNA, 25 bp, Mus musculus
gctgcttttcctgacatctgttcat

SEQ ID NO: 571834 - DNA, 25 bp, Mus musculus
gctgcttttctaaccaagaggctgg

SEQ ID NO: 571835 - DNA, 25 bp, Mus musculus
gctgcttttctatccaagaggctgg

SEQ ID NO: 571836 - DNA, 25 bp, Mus musculus
gctgcttttggcaggacagggacca

SEQ ID NO: 571837 - DNA, 25 bp, Mus musculus
gctgcttttggctggacagggacca

SEQ ID NO: 571838 - DNA, 25 bp, Mus musculus
gctgcttttgttccctgccaggaca

SEQ ID NO: 571839 - DNA, 25 bp, Mus musculus
gctgcttttgttgcctgccaggaca

SEQ ID NO: 571840 - DNA, 25 bp, Mus musculus
gctggaaaacggaactcaccccagt

SEQ ID NO: 571841 - DNA, 25 bp, Mus musculus
gctggaaaacggtactcaccccagt

SEQ ID NO: 571842 - DNA, 25 bp, Mus musculus
gctggaaaagatacatcccactgga

SEQ ID NO: 571843 - DNA, 25 bp, Mus musculus
gctggaaaagattcatcccactgga

SEQ ID NO: 571844 - DNA, 25 bp, Mus musculus
gctggaaaagttcctagtggaaatg

SEQ ID NO: 571845 - DNA, 25 bp, Mus musculus
gctggaaaagttgctagtggaaatg

SEQ ID NO: 571846 - DNA, 25 bp, Mus musculus
gctggaaacactactcgttaactcc

SEQ ID NO: 571847 - DNA, 25 bp, Mus musculus
gctggaaacacttctcgttaactcc

SEQ ID NO: 571848 - DNA, 25 bp, Mus musculus
gctggaaacatcactgcgtactgga

SEQ ID NO: 571849 - DNA, 25 bp, Mus musculus
gctggaaacatctctgcgtactgga

SEQ ID NO: 571850 - DNA, 25 bp, Mus musculus
gctggaaaccgtacaggccgtttat

SEQ ID NO: 571851 - DNA, 25 bp, Mus musculus
gctggaaaccgttcaggccgtttat

SEQ ID NO: 571852 - DNA, 25 bp, Mus musculus
gctggaaaccttcaatttgtgtttt

SEQ ID NO: 571853 - DNA, 25 bp, Mus musculus
gctggaaaccttgaatttgtgtttt

SEQ ID NO: 571854 - DNA, 25 bp, Mus musculus
gctggaaaggtcctctcggagacta

SEQ ID NO: 571855 - DNA, 25 bp, Mus musculus
gctggaaaggtcgtctcggagacta

SEQ ID NO: 571856 - DNA, 25 bp, Mus musculus
gctggaaataatatcaaggtcttca

SEQ ID NO: 571857 - DNA, 25 bp, Mus musculus
gctggaaataatttcaaggtcttca

SEQ ID NO: 571858 - DNA, 25 bp, Mus musculus
gctggaaatacaacacctcagggta

SEQ ID NO: 571859 - DNA, 25 bp, Mus musculus
gctggaaatacatcacctcagggta

SEQ ID NO: 571860 - DNA, 25 bp, Mus musculus
gctggaaatactctacattttcagg

SEQ ID NO: 571861 - DNA, 25 bp, Mus musculus
gctggaaatactgtacattttcagg

SEQ ID NO: 571862 - DNA, 25 bp, Mus musculus
gctggaaatattctacatgctttga

SEQ ID NO: 571863 - DNA, 25 bp, Mus musculus
gctggaaatattgtacatgctttga

SEQ ID NO: 571864 - DNA, 25 bp, Mus musculus
gctggaaatccacttcttcaggaac

SEQ ID NO: 571865 - DNA, 25 bp, Mus musculus
gctggaaatccagttcttcaggaac

SEQ ID NO: 571866 - DNA, 25 bp, Mus musculus
gctggaaatgttcaggatgctccat

SEQ ID NO: 571867 - DNA, 25 bp, Mus musculus
gctggaaatgttgaggatgctccat

SEQ ID NO: 571868 - DNA, 25 bp, Mus musculus
gctggaacacagctgaccattagtt

SEQ ID NO: 571869 - DNA, 25 bp, Mus musculus
gctggaacacaggtgaccattagtt

SEQ ID NO: 571870 - DNA, 25 bp, Mus musculus
gctggaacacgacctaccgcttttg

SEQ ID NO: 571871 - DNA, 25 bp, Mus musculus
gctggaacacgagctaccgcttttg

SEQ ID NO: 571872 - DNA, 25 bp, Mus musculus
gctggaacagctcgagtcagccttt

SEQ ID NO: 571873 - DNA, 25 bp, Mus musculus
gctggaacagctggagtcagccttt

SEQ ID NO: 571874 - DNA, 25 bp, Mus musculus
gctggaacagttcgtggctgaccac

SEQ ID NO: 571875 - DNA, 25 bp, Mus musculus
gctggaacagttggtggctgaccac

SEQ ID NO: 571876 - DNA, 25 bp, Mus musculus
gctggaaccaagatctaggtattct

SEQ ID NO: 571877 - DNA, 25 bp, Mus musculus
gctggaaccaagttctaggtattct

SEQ ID NO: 571878 - DNA, 25 bp, Mus musculus
gctggaacccatactacagaacaac

SEQ ID NO: 571879 - DNA, 25 bp, Mus musculus
gctggaacccattctacagaacaac

SEQ ID NO: 571880 - DNA, 25 bp, Mus musculus
gctggaacctgaccctctagagggt

SEQ ID NO: 571881 - DNA, 25 bp, Mus musculus
gctggaacctgagcctctagagggt

SEQ ID NO: 571882 - DNA, 25 bp, Mus musculus
gctggaactgaacccaaggtctcat

SEQ ID NO: 571883 - DNA, 25 bp, Mus musculus
gctggaactgaagccaaggtctcat

SEQ ID NO: 571884 - DNA, 25 bp, Mus musculus
gctggaactgtgcttaatgatggat

SEQ ID NO: 571885 - DNA, 25 bp, Mus musculus
gctggaactgtggttaatgatggat

SEQ ID NO: 571886 - DNA, 25 bp, Mus musculus
gctggaacttggaaagctgcaggtt

SEQ ID NO: 571887 - DNA, 25 bp, Mus musculus
gctggaacttggtaagctgcaggtt

SEQ ID NO: 571888 - DNA, 25 bp, Mus musculus
gctggaagaagacgctctccaataa

SEQ ID NO: 571889 - DNA, 25 bp, Mus musculus
gctggaagaagaggctctccaataa

SEQ ID NO: 571890 - DNA, 25 bp, Mus musculus
gctggaagaccaagtgcacggctta

SEQ ID NO: 571891 - DNA, 25 bp, Mus musculus
gctggaagaccatgtgcacggctta

SEQ ID NO: 571892 - DNA, 25 bp, Mus musculus
gctggaagacgcatatggctctggt

SEQ ID NO: 571893 - DNA, 25 bp, Mus musculus
gctggaagacgcttatggctctggt

SEQ ID NO: 571894 - DNA, 25 bp, Mus musculus
gctggaagatttcaccgttaccttt

SEQ ID NO: 571895 - DNA, 25 bp, Mus musculus
gctggaagatttgaccgttaccttt

SEQ ID NO: 571896 - DNA, 25 bp, Mus musculus
gctggaagcaacaccgtgtctatct

SEQ ID NO: 571897 - DNA, 25 bp, Mus musculus
gctggaagcaactccgtgtctatct

SEQ ID NO: 571898 - DNA, 25 bp, Mus musculus
gctggaagcagactgcacttcccag

SEQ ID NO: 571899 - DNA, 25 bp, Mus musculus
gctggaagcagagtgcacttcccag

SEQ ID NO: 571900 - DNA, 25 bp, Mus musculus
gctggaagcatccacatggtcgctt

SEQ ID NO: 571901 - DNA, 25 bp, Mus musculus
gctggaagcatcgacatggtcgctt

SEQ ID NO: 571902 - DNA, 25 bp, Mus musculus
gctggaagccacagtactccgactg

SEQ ID NO: 571903 - DNA, 25 bp, Mus musculus
gctggaagccactgtactccgactg

SEQ ID NO: 571904 - DNA, 25 bp, Mus musculus
gctggaagcccaatttcatggctgt

SEQ ID NO: 571905 - DNA, 25 bp, Mus musculus
gctggaagcccattttcatggctgt

SEQ ID NO: 571906 - DNA, 25 bp, Mus musculus
gctggaagctgtccgggccaaccaa

SEQ ID NO: 571907 - DNA, 25 bp, Mus musculus
gctggaagctgtgcgggccaaccaa

SEQ ID NO: 571908 - DNA, 25 bp, Mus musculus
gctggaagcttcatagtgtgcccta

SEQ ID NO: 571909 - DNA, 25 bp, Mus musculus
gctggaagcttcttagtgtgcccta

SEQ ID NO: 571910 - DNA, 25 bp, Mus musculus
gctggaagctttaggctggctctga

SEQ ID NO: 571911 - DNA, 25 bp, Mus musculus
gctggaagcttttggctggctctga

SEQ ID NO: 571912 - DNA, 25 bp, Mus musculus
gctggaaggacaaggtctcctaccg

SEQ ID NO: 571913 - DNA, 25 bp, Mus musculus
gctggaaggacatggtctcctaccg

SEQ ID NO: 571914 - DNA, 25 bp, Mus musculus
gctggaaggcacactatatgctaca

SEQ ID NO: 571915 - DNA, 25 bp, Mus musculus
gctggaaggcactctatatgctaca

SEQ ID NO: 571916 - DNA, 25 bp, Mus musculus
gctggaaggccaaccgtgtagatct

SEQ ID NO: 571917 - DNA, 25 bp, Mus musculus
gctggaaggccaagcgatgcccatt

SEQ ID NO: 571918 - DNA, 25 bp, Mus musculus
gctggaaggccatccgtgtagatct

SEQ ID NO: 571919 - DNA, 25 bp, Mus musculus
gctggaaggccatgcgatgcccatt

SEQ ID NO: 571920 - DNA, 25 bp, Mus musculus
gctggaaggcctctgcctttctcac

SEQ ID NO: 571921 - DNA, 25 bp, Mus musculus
gctggaaggcctgtgcctttctcac

SEQ ID NO: 571922 - DNA, 25 bp, Mus musculus
gctggaaggcgccactttatttaac

SEQ ID NO: 571923 - DNA, 25 bp, Mus musculus
gctggaaggcgcgactttatttaac

SEQ ID NO: 571924 - DNA, 25 bp, Mus musculus
gctggaagggtcacttttgggtcaa

SEQ ID NO: 571925 - DNA, 25 bp, Mus musculus
gctggaagggtctcttttgggtcaa

SEQ ID NO: 571926 - DNA, 25 bp, Mus musculus
gctggaaggtaccatcttgtcaaca

SEQ ID NO: 571927 - DNA, 25 bp, Mus musculus
gctggaaggtacgatcttgtcaaca

SEQ ID NO: 571928 - DNA, 25 bp, Mus musculus
gctggaaggtggaagcaccctgata

SEQ ID NO: 571929 - DNA, 25 bp, Mus musculus
gctggaaggtggtagcaccctgata

SEQ ID NO: 571930 - DNA, 25 bp, Mus musculus
gctggaagtatcacgctgtttcaac

SEQ ID NO: 571931 - DNA, 25 bp, Mus musculus
gctggaagtatctcgctgtttcaac

SEQ ID NO: 571932 - DNA, 25 bp, Mus musculus
gctggaagtgaaaccatgaactgac

SEQ ID NO: 571933 - DNA, 25 bp, Mus musculus
gctggaagtgaatccatgaactgac

SEQ ID NO: 571934 - DNA, 25 bp, Mus musculus
gctggaatagttctccaactactgt

SEQ ID NO: 571935 - DNA, 25 bp, Mus musculus
gctggaatagttgtccaactactgt

SEQ ID NO: 571936 - DNA, 25 bp, Mus musculus
gctggaatcagtcttgatgctccta

SEQ ID NO: 571937 - DNA, 25 bp, Mus musculus
gctggaatcagtgttgatgctccta

SEQ ID NO: 571938 - DNA, 25 bp, Mus musculus
gctggaatccacatgcctttaggta

SEQ ID NO: 571939 - DNA, 25 bp, Mus musculus
gctggaatccacttgcctttaggta

SEQ ID NO: 571940 - DNA, 25 bp, Mus musculus
gctggaatcgctctcataattatgg

SEQ ID NO: 571941 - DNA, 25 bp, Mus musculus
gctggaatcgctgtcataattatgg

SEQ ID NO: 571942 - DNA, 25 bp, Mus musculus
gctggaatctgacccatacaattag

SEQ ID NO: 571943 - DNA, 25 bp, Mus musculus
gctggaatctgagccatacaattag

SEQ ID NO: 571944 - DNA, 25 bp, Mus musculus
gctggaatcttcctcgtctgtccaa

SEQ ID NO: 571945 - DNA, 25 bp, Mus musculus
gctggaatcttcgtcgtctgtccaa

SEQ ID NO: 571946 - DNA, 25 bp, Mus musculus
gctggaatgaagcacaaccaccttg

SEQ ID NO: 571947 - DNA, 25 bp, Mus musculus
gctggaatgaaggacaaccaccttg

SEQ ID NO: 571948 - DNA, 25 bp, Mus musculus
gctggaatgactatcaccacttttg

SEQ ID NO: 571949 - DNA, 25 bp, Mus musculus
gctggaatgactttcaccacttttg

SEQ ID NO: 571950 - DNA, 25 bp, Mus musculus
gctggaatgcataggtgaacgctac

SEQ ID NO: 571951 - DNA, 25 bp, Mus musculus
gctggaatgcattggtgaacgctac

SEQ ID NO: 571952 - DNA, 25 bp, Mus musculus
gctggaatgttaacccaacctcttt

SEQ ID NO: 571953 - DNA, 25 bp, Mus musculus
gctggaatgttatcccaacctcttt

SEQ ID NO: 571954 - DNA, 25 bp, Mus musculus
gctggaattactactgacctgattt

SEQ ID NO: 571955 - DNA, 25 bp, Mus musculus
gctggaattacttctgacctgattt

SEQ ID NO: 571956 - DNA, 25 bp, Mus musculus
gctggaattgctcgatgccttttgc

SEQ ID NO: 571957 - DNA, 25 bp, Mus musculus
gctggaattgctggatgccttttgc

SEQ ID NO: 571958 - DNA, 25 bp, Mus musculus
gctggacaaacgcattggccctgat

SEQ ID NO: 571959 - DNA, 25 bp, Mus musculus
gctggacaaacggattggccctgat

SEQ ID NO: 571960 - DNA, 25 bp, Mus musculus
gctggacaagcaactgccccacatt

SEQ ID NO: 571961 - DNA, 25 bp, Mus musculus
gctggacaagcacgcgttcacagaa

SEQ ID NO: 571962 - DNA, 25 bp, Mus musculus
gctggacaagcaggcgttcacagaa

SEQ ID NO: 571963 - DNA, 25 bp, Mus musculus
gctggacaagcatctgccccacatt

SEQ ID NO: 571964 - DNA, 25 bp, Mus musculus
gctggacaattactttatctctgga

SEQ ID NO: 571965 - DNA, 25 bp, Mus musculus
gctggacaattagtttatctctgga

SEQ ID NO: 571966 - DNA, 25 bp, Mus musculus
gctggacaccacctgaggaagatcc

SEQ ID NO: 571967 - DNA, 25 bp, Mus musculus
gctggacaccacgtgaggaagatcc

SEQ ID NO: 571968 - DNA, 25 bp, Mus musculus
gctggacaccctcatcagaagcttg

SEQ ID NO: 571969 - DNA, 25 bp, Mus musculus
gctggacaccctgatcagaagcttg

SEQ ID NO: 571970 - DNA, 25 bp, Mus musculus
gctggacaccttcagagcgtgtgca

SEQ ID NO: 571971 - DNA, 25 bp, Mus musculus
gctggacaccttgagagcgtgtgca

SEQ ID NO: 571972 - DNA, 25 bp, Mus musculus
gctggacacgatctgtcccaaagca

SEQ ID NO: 571973 - DNA, 25 bp, Mus musculus
gctggacacgatgtgtcccaaagca

SEQ ID NO: 571974 - DNA, 25 bp, Mus musculus
gctggacacgggaaagctgccgaca

SEQ ID NO: 571975 - DNA, 25 bp, Mus musculus
gctggacacgggtaagctgccgaca

SEQ ID NO: 571976 - DNA, 25 bp, Mus musculus
gctggacactggagggtcaactgcc

SEQ ID NO: 571977 - DNA, 25 bp, Mus musculus
gctggacactggcattggacttcaa

SEQ ID NO: 571978 - DNA, 25 bp, Mus musculus
gctggacactgggattggacttcaa

SEQ ID NO: 571979 - DNA, 25 bp, Mus musculus
gctggacactggtgggtcaactgcc

SEQ ID NO: 571980 - DNA, 25 bp, Mus musculus
gctggacacttcattgatgaatcta

SEQ ID NO: 571981 - DNA, 25 bp, Mus musculus
gctggacacttctttgatgaatcta

SEQ ID NO: 571982 - DNA, 25 bp, Mus musculus
gctggacacttgattctggttacat

SEQ ID NO: 571983 - DNA, 25 bp, Mus musculus
gctggacacttgtttctggttacat

SEQ ID NO: 571984 - DNA, 25 bp, Mus musculus
gctggacagaagcacctactattct

SEQ ID NO: 571985 - DNA, 25 bp, Mus musculus
gctggacagaaggacctactattct

SEQ ID NO: 571986 - DNA, 25 bp, Mus musculus
gctggacagagacccagttctccat

SEQ ID NO: 571987 - DNA, 25 bp, Mus musculus
gctggacagagagccagttctccat

SEQ ID NO: 571988 - DNA, 25 bp, Mus musculus
gctggacatacacacatgctaactg

SEQ ID NO: 571989 - DNA, 25 bp, Mus musculus
gctggacatacagacatgctaactg

SEQ ID NO: 571990 - DNA, 25 bp, Mus musculus
gctggacatagacccgaaggactca

SEQ ID NO: 571991 - DNA, 25 bp, Mus musculus
gctggacatagagccgaaggactca

SEQ ID NO: 571992 - DNA, 25 bp, Mus musculus
gctggacatcaacactcggctggaa

SEQ ID NO: 571993 - DNA, 25 bp, Mus musculus
gctggacatcaagactcggctggaa

SEQ ID NO: 571994 - DNA, 25 bp, Mus musculus
gctggacatgctcgtatttgcccat

SEQ ID NO: 571995 - DNA, 25 bp, Mus musculus
gctggacatgctggtatttgcccat

SEQ ID NO: 571996 - DNA, 25 bp, Mus musculus
gctggacatgtgactcatggctaga

SEQ ID NO: 571997 - DNA, 25 bp, Mus musculus
gctggacatgtgtctcatggctaga

SEQ ID NO: 571998 - DNA, 25 bp, Mus musculus
gctggacattacaaactcacattta

SEQ ID NO: 571999 - DNA, 25 bp, Mus musculus
gctggacattactaactcacattta

SEQ ID NO: 572000 - DNA, 25 bp, Mus musculus
gctggacatttactgggtttctgct

SEQ ID NO: 572001 - DNA, 25 bp, Mus musculus
gctggacatttagtgggtttctgct

SEQ ID NO: 572002 - DNA, 25 bp, Mus musculus
gctggaccaagaagcagacgacctg

SEQ ID NO: 572003 - DNA, 25 bp, Mus musculus
gctggaccaagatgcagacgacctg

SEQ ID NO: 572004 - DNA, 25 bp, Mus musculus
gctggaccacagcagctgtgtcaac

SEQ ID NO: 572005 - DNA, 25 bp, Mus musculus
gctggaccacaggagctgtgtcaac

SEQ ID NO: 572006 - DNA, 25 bp, Mus musculus
gctggaccacccattctatgttaaa

SEQ ID NO: 572007 - DNA, 25 bp, Mus musculus
gctggaccaccctttctatgttaaa

SEQ ID NO: 572008 - DNA, 25 bp, Mus musculus
gctggaccacggatcgcaaagtaca

SEQ ID NO: 572009 - DNA, 25 bp, Mus musculus
gctggaccacggttcgcaaagtaca

SEQ ID NO: 572010 - DNA, 25 bp, Mus musculus
gctggaccactgcttaaactgaaaa

SEQ ID NO: 572011 - DNA, 25 bp, Mus musculus
gctggaccactggttaaactgaaaa

SEQ ID NO: 572012 - DNA, 25 bp, Mus musculus
gctggaccatggactctttagaatc

SEQ ID NO: 572013 - DNA, 25 bp, Mus musculus
gctggaccatggtctctttagaatc

SEQ ID NO: 572014 - DNA, 25 bp, Mus musculus
gctggacccagcagagccaagcaga

SEQ ID NO: 572015 - DNA, 25 bp, Mus musculus
gctggacccagctgagccaagcaga

SEQ ID NO: 572016 - DNA, 25 bp, Mus musculus
gctggacccagtatacagtacattg

SEQ ID NO: 572017 - DNA, 25 bp, Mus musculus
gctggacccagtttacagtacattg

SEQ ID NO: 572018 - DNA, 25 bp, Mus musculus
gctggaccctgcactgctaaagaag

SEQ ID NO: 572019 - DNA, 25 bp, Mus musculus
gctggaccctgctctgctaaagaag

SEQ ID NO: 572020 - DNA, 25 bp, Mus musculus
gctggaccgaggactattgcgaatc

SEQ ID NO: 572021 - DNA, 25 bp, Mus musculus
gctggaccgaggtctattgcgaatc

SEQ ID NO: 572022 - DNA, 25 bp, Mus musculus
gctggaccgtgaagaggactcccgt

SEQ ID NO: 572023 - DNA, 25 bp, Mus musculus
gctggaccgtgatgaggactcccgt

SEQ ID NO: 572024 - DNA, 25 bp, Mus musculus
gctggacctatgcaagatcagcaaa

SEQ ID NO: 572025 - DNA, 25 bp, Mus musculus
gctggacctatggaagatcagcaaa

SEQ ID NO: 572026 - DNA, 25 bp, Mus musculus
gctggacctgaacggttgatgccaa

SEQ ID NO: 572027 - DNA, 25 bp, Mus musculus
gctggacctgaagggttgatgccaa

SEQ ID NO: 572028 - DNA, 25 bp, Mus musculus
gctggacctgccattctaggattat

SEQ ID NO: 572029 - DNA, 25 bp, Mus musculus
gctggacctgcctttctaggattat

SEQ ID NO: 572030 - DNA, 25 bp, Mus musculus
gctggacctggcagatgacaggctc

SEQ ID NO: 572031 - DNA, 25 bp, Mus musculus
gctggacctggctgatgacaggctc

SEQ ID NO: 572032 - DNA, 25 bp, Mus musculus
gctggaccttgtacaacagtcatgt

SEQ ID NO: 572033 - DNA, 25 bp, Mus musculus
gctggaccttgttcaacagtcatgt

SEQ ID NO: 572034 - DNA, 25 bp, Mus musculus
gctggacgaactcaagcgcttcttt

SEQ ID NO: 572035 - DNA, 25 bp, Mus musculus
gctggacgaactgaagcgcttcttt

SEQ ID NO: 572036 - DNA, 25 bp, Mus musculus
gctggacgagaccatggactccata

SEQ ID NO: 572037 - DNA, 25 bp, Mus musculus
gctggacgagacgatggactccata

SEQ ID NO: 572038 - DNA, 25 bp, Mus musculus
gctggacgccaactaggccagtgat

SEQ ID NO: 572039 - DNA, 25 bp, Mus musculus
gctggacgccaagtaggccagtgat

SEQ ID NO: 572040 - DNA, 25 bp, Mus musculus
gctggacgctccaagggctgaactt

SEQ ID NO: 572041 - DNA, 25 bp, Mus musculus
gctggacgctcctagggctgaactt

SEQ ID NO: 572042 - DNA, 25 bp, Mus musculus
gctggacgctgaagctgtatggcca

SEQ ID NO: 572043 - DNA, 25 bp, Mus musculus
gctggacgctgatgctgtatggcca

SEQ ID NO: 572044 - DNA, 25 bp, Mus musculus
gctggacgtgatcagtttgcaagaa

SEQ ID NO: 572045 - DNA, 25 bp, Mus musculus
gctggacgtgatgagtttgcaagaa

SEQ ID NO: 572046 - DNA, 25 bp, Mus musculus
gctggacgtgctactgaatctcgag

SEQ ID NO: 572047 - DNA, 25 bp, Mus musculus
gctggacgtgcttctgaatctcgag

SEQ ID NO: 572048 - DNA, 25 bp, Mus musculus
gctggactaactccgcgcggtttgc

SEQ ID NO: 572049 - DNA, 25 bp, Mus musculus
gctggactaactgcgcgcggtttgc

SEQ ID NO: 572050 - DNA, 25 bp, Mus musculus
gctggactacagatgtgcaccatag

SEQ ID NO: 572051 - DNA, 25 bp, Mus musculus
gctggactacagttgtgcaccatag

SEQ ID NO: 572052 - DNA, 25 bp, Mus musculus
gctggactacgacatggtgcatttt

SEQ ID NO: 572053 - DNA, 25 bp, Mus musculus
gctggactacgagatggtgcatttt

SEQ ID NO: 572054 - DNA, 25 bp, Mus musculus
gctggactactcagtcttcctggaa

SEQ ID NO: 572055 - DNA, 25 bp, Mus musculus
gctggactactctgtcttcctggaa

SEQ ID NO: 572056 - DNA, 25 bp, Mus musculus
gctggactagagaccctgtctaaga

SEQ ID NO: 572057 - DNA, 25 bp, Mus musculus
gctggactagagtccctgtctaaga

SEQ ID NO: 572058 - DNA, 25 bp, Mus musculus
gctggactatatactataggcttta

SEQ ID NO: 572059 - DNA, 25 bp, Mus musculus
gctggactatattctataggcttta

SEQ ID NO: 572060 - DNA, 25 bp, Mus musculus
gctggactcaaactccgatgtactc

SEQ ID NO: 572061 - DNA, 25 bp, Mus musculus
gctggactcaaagtccgatgtactc

SEQ ID NO: 572062 - DNA, 25 bp, Mus musculus
gctggactcaagcttcccgagagat

SEQ ID NO: 572063 - DNA, 25 bp, Mus musculus
gctggactcaaggttcccgagagat

SEQ ID NO: 572064 - DNA, 25 bp, Mus musculus
gctggactcagaagcaccatgggta

SEQ ID NO: 572065 - DNA, 25 bp, Mus musculus
gctggactcagaccacgccagattg

SEQ ID NO: 572066 - DNA, 25 bp, Mus musculus
gctggactcagagcacgccagattg

SEQ ID NO: 572067 - DNA, 25 bp, Mus musculus
gctggactcagatgcaccatgggta

SEQ ID NO: 572068 - DNA, 25 bp, Mus musculus
gctggactcagcaacatccggtttt

SEQ ID NO: 572069 - DNA, 25 bp, Mus musculus
gctggactcagcactttgccttcaa

SEQ ID NO: 572070 - DNA, 25 bp, Mus musculus
gctggactcagctacatccggtttt

SEQ ID NO: 572071 - DNA, 25 bp, Mus musculus
gctggactcagctctttgccttcaa

SEQ ID NO: 572072 - DNA, 25 bp, Mus musculus
gctggactcctaatcaaatttattt

SEQ ID NO: 572073 - DNA, 25 bp, Mus musculus
gctggactcctattcaaatttattt

SEQ ID NO: 572074 - DNA, 25 bp, Mus musculus
gctggactctgtatgcaagtacttt

SEQ ID NO: 572075 - DNA, 25 bp, Mus musculus
gctggactctgtttgcaagtacttt

SEQ ID NO: 572076 - DNA, 25 bp, Mus musculus
gctggactgatcactcttgatttca

SEQ ID NO: 572077 - DNA, 25 bp, Mus musculus
gctggactgatctctcttgatttca

SEQ ID NO: 572078 - DNA, 25 bp, Mus musculus
gctggactgattaatcacaggtgta

SEQ ID NO: 572079 - DNA, 25 bp, Mus musculus
gctggactgatttatcacaggtgta

SEQ ID NO: 572080 - DNA, 25 bp, Mus musculus
gctggactgcgacatcatgctctta

SEQ ID NO: 572081 - DNA, 25 bp, Mus musculus
gctggactgcgagatcatgctctta

SEQ ID NO: 572082 - DNA, 25 bp, Mus musculus
gctggactgctacagcaactggaga

SEQ ID NO: 572083 - DNA, 25 bp, Mus musculus
gctggactgctagagcaactggaga

SEQ ID NO: 572084 - DNA, 25 bp, Mus musculus
gctggactggtgctaattgacttct

SEQ ID NO: 572085 - DNA, 25 bp, Mus musculus
gctggactggtggtaattgacttct

SEQ ID NO: 572086 - DNA, 25 bp, Mus musculus
gctggactgtgaagcctaaattcac

SEQ ID NO: 572087 - DNA, 25 bp, Mus musculus
gctggactgtgacgtcaacaacaat

SEQ ID NO: 572088 - DNA, 25 bp, Mus musculus
gctggactgtgaggtcaacaacaat

SEQ ID NO: 572089 - DNA, 25 bp, Mus musculus
gctggactgtgatgcctaaattcac

SEQ ID NO: 572090 - DNA, 25 bp, Mus musculus
gctggactgttcataaatgcaaaca

SEQ ID NO: 572091 - DNA, 25 bp, Mus musculus
gctggactgttcttaaatgcaaaca

SEQ ID NO: 572092 - DNA, 25 bp, Mus musculus
gctggacttagtcttgtgagccaca

SEQ ID NO: 572093 - DNA, 25 bp, Mus musculus
gctggacttagtgttgtgagccaca

SEQ ID NO: 572094 - DNA, 25 bp, Mus musculus
gctggacttggcagagaacatggtt

SEQ ID NO: 572095 - DNA, 25 bp, Mus musculus
gctggacttggctgagaacatggtt

SEQ ID NO: 572096 - DNA, 25 bp, Mus musculus
gctggactttctctctttagttgaa

SEQ ID NO: 572097 - DNA, 25 bp, Mus musculus
gctggactttctgtctttagttgaa

SEQ ID NO: 572098 - DNA, 25 bp, Mus musculus
gctggactttgacctacttgtatta

SEQ ID NO: 572099 - DNA, 25 bp, Mus musculus
gctggactttgagctacttgtatta

SEQ ID NO: 572100 - DNA, 25 bp, Mus musculus
gctggagaacgaattcctggtcaat

SEQ ID NO: 572101 - DNA, 25 bp, Mus musculus
gctggagaacgatttcctggtcaat

SEQ ID NO: 572102 - DNA, 25 bp, Mus musculus
gctggagaactcacttgtcagttat

SEQ ID NO: 572103 - DNA, 25 bp, Mus musculus
gctggagaactcagctaagtcgttt

SEQ ID NO: 572104 - DNA, 25 bp, Mus musculus
gctggagaactctcttgtcagttat

SEQ ID NO: 572105 - DNA, 25 bp, Mus musculus
gctggagaactctgctaagtcgttt

SEQ ID NO: 572106 - DNA, 25 bp, Mus musculus
gctggagaatccaaatgtcctctga

SEQ ID NO: 572107 - DNA, 25 bp, Mus musculus
gctggagaatcctaatgtcctctga

SEQ ID NO: 572108 - DNA, 25 bp, Mus musculus
gctggagacaatccggattccggtt

SEQ ID NO: 572109 - DNA, 25 bp, Mus musculus
gctggagacaatgcggattccggtt

SEQ ID NO: 572110 - DNA, 25 bp, Mus musculus
gctggagacactcaaacgcaacgtt

SEQ ID NO: 572111 - DNA, 25 bp, Mus musculus
gctggagacactgaaacgcaacgtt

SEQ ID NO: 572112 - DNA, 25 bp, Mus musculus
gctggagacagtcgcctgctcttcc

SEQ ID NO: 572113 - DNA, 25 bp, Mus musculus
gctggagacagtggcctgctcttcc

SEQ ID NO: 572114 - DNA, 25 bp, Mus musculus
gctggagaccacattagagccaaac

SEQ ID NO: 572115 - DNA, 25 bp, Mus musculus
gctggagaccactttagagccaaac

SEQ ID NO: 572116 - DNA, 25 bp, Mus musculus
gctggagaccagactagaggtccct

SEQ ID NO: 572117 - DNA, 25 bp, Mus musculus
gctggagaccagcactgcctaatag

SEQ ID NO: 572118 - DNA, 25 bp, Mus musculus
gctggagaccaggactgcctaatag

SEQ ID NO: 572119 - DNA, 25 bp, Mus musculus
gctggagaccagtctagaggtccct

SEQ ID NO: 572120 - DNA, 25 bp, Mus musculus
gctggagacctcacaaggacctgga

SEQ ID NO: 572121 - DNA, 25 bp, Mus musculus
gctggagacctctcaaggacctgga

SEQ ID NO: 572122 - DNA, 25 bp, Mus musculus
gctggagaccttactatgaacaaat

SEQ ID NO: 572123 - DNA, 25 bp, Mus musculus
gctggagacctttctatgaacaaat

SEQ ID NO: 572124 - DNA, 25 bp, Mus musculus
gctggagactctcacggcctctgag

SEQ ID NO: 572125 - DNA, 25 bp, Mus musculus
gctggagactctgacggcctctgag

SEQ ID NO: 572126 - DNA, 25 bp, Mus musculus
gctggagactggagactaggaagaa

SEQ ID NO: 572127 - DNA, 25 bp, Mus musculus
gctggagactggtgactaggaagaa

SEQ ID NO: 572128 - DNA, 25 bp, Mus musculus
gctggagactgtatccgcaagcagt

SEQ ID NO: 572129 - DNA, 25 bp, Mus musculus
gctggagactgtttccgcaagcagt

SEQ ID NO: 572130 - DNA, 25 bp, Mus musculus
gctggagacttgcacttgtatggat

SEQ ID NO: 572131 - DNA, 25 bp, Mus musculus
gctggagacttggacttgtatggat

SEQ ID NO: 572132 - DNA, 25 bp, Mus musculus
gctggagagacacttcccaggacga

SEQ ID NO: 572133 - DNA, 25 bp, Mus musculus
gctggagagacagttcccaggacga

SEQ ID NO: 572134 - DNA, 25 bp, Mus musculus
gctggagagcacaaagacgttacac

SEQ ID NO: 572135 - DNA, 25 bp, Mus musculus
gctggagagcactaagacgttacac

SEQ ID NO: 572136 - DNA, 25 bp, Mus musculus
gctggagagggaacacgcatctgat

SEQ ID NO: 572137 - DNA, 25 bp, Mus musculus
gctggagagggatcacgcatctgat

SEQ ID NO: 572138 - DNA, 25 bp, Mus musculus
gctggagagtaacttctctttgtct

SEQ ID NO: 572139 - DNA, 25 bp, Mus musculus
gctggagagtaagttctctttgtct

SEQ ID NO: 572140 - DNA, 25 bp, Mus musculus
gctggagatcacaggcaggactact

SEQ ID NO: 572141 - DNA, 25 bp, Mus musculus
gctggagatcactggcaggactact

SEQ ID NO: 572142 - DNA, 25 bp, Mus musculus
gctggagatgatagcttatacctgt

SEQ ID NO: 572143 - DNA, 25 bp, Mus musculus
gctggagatgattgcttatacctgt

SEQ ID NO: 572144 - DNA, 25 bp, Mus musculus
gctggagcaaaaccatagcttgaaa

SEQ ID NO: 572145 - DNA, 25 bp, Mus musculus
gctggagcaaaagcatagcttgaaa

SEQ ID NO: 572146 - DNA, 25 bp, Mus musculus
gctggagcacttaccttcaggtgag

SEQ ID NO: 572147 - DNA, 25 bp, Mus musculus
gctggagcactttccttcaggtgag

SEQ ID NO: 572148 - DNA, 25 bp, Mus musculus
gctggagcagtgaggtctcgtaaca

SEQ ID NO: 572149 - DNA, 25 bp, Mus musculus
gctggagcagtgtggtctcgtaaca

SEQ ID NO: 572150 - DNA, 25 bp, Mus musculus
gctggagcccatatgaatagttctt

SEQ ID NO: 572151 - DNA, 25 bp, Mus musculus
gctggagcccatttgaatagttctt

SEQ ID NO: 572152 - DNA, 25 bp, Mus musculus
gctggagcccgacgcggacaggcta

SEQ ID NO: 572153 - DNA, 25 bp, Mus musculus
gctggagcccgaggcggacaggcta

SEQ ID NO: 572154 - DNA, 25 bp, Mus musculus
gctggagccctgagtctgaaggatt

SEQ ID NO: 572155 - DNA, 25 bp, Mus musculus
gctggagccctgtgtctgaaggatt

SEQ ID NO: 572156 - DNA, 25 bp, Mus musculus
gctggagcctagaagactgtatttg

SEQ ID NO: 572157 - DNA, 25 bp, Mus musculus
gctggagcctagtagactgtatttg

SEQ ID NO: 572158 - DNA, 25 bp, Mus musculus
gctggagcctggctgacattctaca

SEQ ID NO: 572159 - DNA, 25 bp, Mus musculus
gctggagcctgggtgacattctaca

SEQ ID NO: 572160 - DNA, 25 bp, Mus musculus
gctggagcgactcatgagcccttta

SEQ ID NO: 572161 - DNA, 25 bp, Mus musculus
gctggagcgactgatgagcccttta

SEQ ID NO: 572162 - DNA, 25 bp, Mus musculus
gctggagcgtctctacatttagtca

SEQ ID NO: 572163 - DNA, 25 bp, Mus musculus
gctggagcgtctgtacatttagtca

SEQ ID NO: 572164 - DNA, 25 bp, Mus musculus
gctggagctgaacaacacctggtca

SEQ ID NO: 572165 - DNA, 25 bp, Mus musculus
gctggagctgaagaacacctggtca

SEQ ID NO: 572166 - DNA, 25 bp, Mus musculus
gctggagctgctaacatcaagactt

SEQ ID NO: 572167 - DNA, 25 bp, Mus musculus
gctggagctgctcacaatcactggg

SEQ ID NO: 572168 - DNA, 25 bp, Mus musculus
gctggagctgctgacaatcactggg

SEQ ID NO: 572169 - DNA, 25 bp, Mus musculus
gctggagctgcttacatcaagactt

SEQ ID NO: 572170 - DNA, 25 bp, Mus musculus
gctggagctgggagcagctaataaa

SEQ ID NO: 572171 - DNA, 25 bp, Mus musculus
gctggagctgggtgcagctaataaa

SEQ ID NO: 572172 - DNA, 25 bp, Mus musculus
gctggagctgttagtccattatttt

SEQ ID NO: 572173 - DNA, 25 bp, Mus musculus
gctggagctgtttgtccattatttt

SEQ ID NO: 572174 - DNA, 25 bp, Mus musculus
gctggagcttgacgtccctgtgaat

SEQ ID NO: 572175 - DNA, 25 bp, Mus musculus
gctggagcttgaggtccctgtgaat

SEQ ID NO: 572176 - DNA, 25 bp, Mus musculus
gctggagctttgctccaattagttt

SEQ ID NO: 572177 - DNA, 25 bp, Mus musculus
gctggagctttggtccaattagttt

SEQ ID NO: 572178 - DNA, 25 bp, Mus musculus
gctggaggaactcgcttcaaacctt

SEQ ID NO: 572179 - DNA, 25 bp, Mus musculus
gctggaggaactggcttcaaacctt

SEQ ID NO: 572180 - DNA, 25 bp, Mus musculus
gctggaggacttcgctctgcatata

SEQ ID NO: 572181 - DNA, 25 bp, Mus musculus
gctggaggacttggctctgcatata

SEQ ID NO: 572182 - DNA, 25 bp, Mus musculus
gctggaggcactatctccttgctgc

SEQ ID NO: 572183 - DNA, 25 bp, Mus musculus
gctggaggcactttctccttgctgc

SEQ ID NO: 572184 - DNA, 25 bp, Mus musculus
gctggaggcctactgctacatcaag

SEQ ID NO: 572185 - DNA, 25 bp, Mus musculus
gctggaggcctagtgctacatcaag

SEQ ID NO: 572186 - DNA, 25 bp, Mus musculus
gctggagggacccacctgaaagcct

SEQ ID NO: 572187 - DNA, 25 bp, Mus musculus
gctggagggaccgacctgaaagcct

SEQ ID NO: 572188 - DNA, 25 bp, Mus musculus
gctggaggtcaaactggaagtctgc

SEQ ID NO: 572189 - DNA, 25 bp, Mus musculus
gctggaggtcaatctggaagtctgc

SEQ ID NO: 572190 - DNA, 25 bp, Mus musculus
gctggaggtccaattttttttagag

SEQ ID NO: 572191 - DNA, 25 bp, Mus musculus
gctggaggtccatttttttttagag

SEQ ID NO: 572192 - DNA, 25 bp, Mus musculus
gctggagtaagcattgctgtgattg

SEQ ID NO: 572193 - DNA, 25 bp, Mus musculus
gctggagtaagctttgctgtgattg

SEQ ID NO: 572194 - DNA, 25 bp, Mus musculus
gctggagtacaacctgggtccacat

SEQ ID NO: 572195 - DNA, 25 bp, Mus musculus
gctggagtacaagctgggtccacat

SEQ ID NO: 572196 - DNA, 25 bp, Mus musculus
gctggagtatgtcacattgtgtcac

SEQ ID NO: 572197 - DNA, 25 bp, Mus musculus
gctggagtatgtgacattgtgtcac

SEQ ID NO: 572198 - DNA, 25 bp, Mus musculus
gctggagtcaaacctctgactgctc

SEQ ID NO: 572199 - DNA, 25 bp, Mus musculus
gctggagtcaaagctctgactgctc

SEQ ID NO: 572200 - DNA, 25 bp, Mus musculus
gctggagtccaaacagagttcctca

SEQ ID NO: 572201 - DNA, 25 bp, Mus musculus
gctggagtccaatcagagttcctca

SEQ ID NO: 572202 - DNA, 25 bp, Mus musculus
gctggagtcccacgcgcagaaagca

SEQ ID NO: 572203 - DNA, 25 bp, Mus musculus
gctggagtcccaggcgcagaaagca

SEQ ID NO: 572204 - DNA, 25 bp, Mus musculus
gctggagtccctatctggtaacaat

SEQ ID NO: 572205 - DNA, 25 bp, Mus musculus
gctggagtccctttctggtaacaat

SEQ ID NO: 572206 - DNA, 25 bp, Mus musculus
gctggagtccgcctaaacctctttt

SEQ ID NO: 572207 - DNA, 25 bp, Mus musculus
gctggagtccgcgtaaacctctttt

SEQ ID NO: 572208 - DNA, 25 bp, Mus musculus
gctggagtgataacccttgcagtga

SEQ ID NO: 572209 - DNA, 25 bp, Mus musculus
gctggagtgatatcccttgcagtga

SEQ ID NO: 572210 - DNA, 25 bp, Mus musculus
gctggagtgcaacaactcacccatt

SEQ ID NO: 572211 - DNA, 25 bp, Mus musculus
gctggagtgcaagaactcacccatt

SEQ ID NO: 572212 - DNA, 25 bp, Mus musculus
gctggagtgcgaactgccgacatac

SEQ ID NO: 572213 - DNA, 25 bp, Mus musculus
gctggagtgcgatctgccgacatac

SEQ ID NO: 572214 - DNA, 25 bp, Mus musculus
gctggagtggaaagctatatctcag

SEQ ID NO: 572215 - DNA, 25 bp, Mus musculus
gctggagtggaatgctatatctcag

SEQ ID NO: 572216 - DNA, 25 bp, Mus musculus
gctggagtgtatatttgttgctccc

SEQ ID NO: 572217 - DNA, 25 bp, Mus musculus
gctggagtgtatttttgttgctccc

SEQ ID NO: 572218 - DNA, 25 bp, Mus musculus
gctggagttacgcttttgtcgtcac

SEQ ID NO: 572219 - DNA, 25 bp, Mus musculus
gctggagttacggttttgtcgtcac

SEQ ID NO: 572220 - DNA, 25 bp, Mus musculus
gctggagttagaagcttgggtggga

SEQ ID NO: 572221 - DNA, 25 bp, Mus musculus
gctggagttagatgcttgggtggga

SEQ ID NO: 572222 - DNA, 25 bp, Mus musculus
gctggagttcatagcattggtctat

SEQ ID NO: 572223 - DNA, 25 bp, Mus musculus
gctggagttcattgcattggtctat

SEQ ID NO: 572224 - DNA, 25 bp, Mus musculus
gctggagttcccatggataggacac

SEQ ID NO: 572225 - DNA, 25 bp, Mus musculus
gctggagttcccttggataggacac

SEQ ID NO: 572226 - DNA, 25 bp, Mus musculus
gctggagttctcaaatgttttcaaa

SEQ ID NO: 572227 - DNA, 25 bp, Mus musculus
gctggagttctctaatgttttcaaa

SEQ ID NO: 572228 - DNA, 25 bp, Mus musculus
gctggagttgctcataataacatgt

SEQ ID NO: 572229 - DNA, 25 bp, Mus musculus
gctggagttgctgataataacatgt

SEQ ID NO: 572230 - DNA, 25 bp, Mus musculus
gctggagtttgaaggatctggtcct

SEQ ID NO: 572231 - DNA, 25 bp, Mus musculus
gctggagtttgatggatctggtcct

SEQ ID NO: 572232 - DNA, 25 bp, Mus musculus
gctggatacatcatgtcaccggcat

SEQ ID NO: 572233 - DNA, 25 bp, Mus musculus
gctggatacatcttgtcaccggcat

SEQ ID NO: 572234 - DNA, 25 bp, Mus musculus
gctggatacccacgtgtcctatgaa

SEQ ID NO: 572235 - DNA, 25 bp, Mus musculus
gctggatacccaggtgtcctatgaa

SEQ ID NO: 572236 - DNA, 25 bp, Mus musculus
gctggatactcaagagcttgctcat

SEQ ID NO: 572237 - DNA, 25 bp, Mus musculus
gctggatactcatgagcttgctcat

SEQ ID NO: 572238 - DNA, 25 bp, Mus musculus
gctggatagctaatcagaacaaatc

SEQ ID NO: 572239 - DNA, 25 bp, Mus musculus
gctggatagctattcagaacaaatc

SEQ ID NO: 572240 - DNA, 25 bp, Mus musculus
gctggatatccacttctgtggcaga

SEQ ID NO: 572241 - DNA, 25 bp, Mus musculus
gctggatatccagttctgtggcaga

SEQ ID NO: 572242 - DNA, 25 bp, Mus musculus
gctggatatgttataccggcactgg

SEQ ID NO: 572243 - DNA, 25 bp, Mus musculus
gctggatatgttttaccggcactgg

SEQ ID NO: 572244 - DNA, 25 bp, Mus musculus
gctggatattgtaatacacacctat

SEQ ID NO: 572245 - DNA, 25 bp, Mus musculus
gctggatattgttatacacacctat

SEQ ID NO: 572246 - DNA, 25 bp, Mus musculus
gctggatcactaactcctgacattt

SEQ ID NO: 572247 - DNA, 25 bp, Mus musculus
gctggatcactatctcctgacattt

SEQ ID NO: 572248 - DNA, 25 bp, Mus musculus
gctggatcagataagtgcgggctct

SEQ ID NO: 572249 - DNA, 25 bp, Mus musculus
gctggatcagattagtgcgggctct

SEQ ID NO: 572250 - DNA, 25 bp, Mus musculus
gctggatcattaaacctcttgcttg

SEQ ID NO: 572251 - DNA, 25 bp, Mus musculus
gctggatcattatacctcttgcttg

SEQ ID NO: 572252 - DNA, 25 bp, Mus musculus
gctggatcattgcattcaaatcata

SEQ ID NO: 572253 - DNA, 25 bp, Mus musculus
gctggatcattggattcaaatcata

SEQ ID NO: 572254 - DNA, 25 bp, Mus musculus
gctggatcccaactgcaaagtaatt

SEQ ID NO: 572255 - DNA, 25 bp, Mus musculus
gctggatcccaagtgcaaagtaatt

SEQ ID NO: 572256 - DNA, 25 bp, Mus musculus
gctggatcccctctatatgttgaat

SEQ ID NO: 572257 - DNA, 25 bp, Mus musculus
gctggatcccctgtatatgttgaat

SEQ ID NO: 572258 - DNA, 25 bp, Mus musculus
gctggatccgacagtgttacactca

SEQ ID NO: 572259 - DNA, 25 bp, Mus musculus
gctggatccgactgtgttacactca

SEQ ID NO: 572260 - DNA, 25 bp, Mus musculus
gctggatctcccagattccagtgat

SEQ ID NO: 572261 - DNA, 25 bp, Mus musculus
gctggatctccctgattccagtgat

SEQ ID NO: 572262 - DNA, 25 bp, Mus musculus
gctggatctctcattctatcatttg

SEQ ID NO: 572263 - DNA, 25 bp, Mus musculus
gctggatctctctttctatcatttg

SEQ ID NO: 572264 - DNA, 25 bp, Mus musculus
gctggatctgaacgcggcacgtttt

SEQ ID NO: 572265 - DNA, 25 bp, Mus musculus
gctggatctgaaggcggcacgtttt

SEQ ID NO: 572266 - DNA, 25 bp, Mus musculus
gctggatctgctctttgaagcgcag

SEQ ID NO: 572267 - DNA, 25 bp, Mus musculus
gctggatctgctgtttgaagcgcag

SEQ ID NO: 572268 - DNA, 25 bp, Mus musculus
gctggatctgttaagaaaggctctg

SEQ ID NO: 572269 - DNA, 25 bp, Mus musculus
gctggatctgtttagaaaggctctg

SEQ ID NO: 572270 - DNA, 25 bp, Mus musculus
gctggatcttacaccttgatttcaa

SEQ ID NO: 572271 - DNA, 25 bp, Mus musculus
gctggatcttactccttgatttcaa

SEQ ID NO: 572272 - DNA, 25 bp, Mus musculus
gctggatctttaaatctggtccctc

SEQ ID NO: 572273 - DNA, 25 bp, Mus musculus
gctggatctttatatctggtccctc

SEQ ID NO: 572274 - DNA, 25 bp, Mus musculus
gctggatgactgacaaccgtctttc

SEQ ID NO: 572275 - DNA, 25 bp, Mus musculus
gctggatgactgtcaaccgtctttc

SEQ ID NO: 572276 - DNA, 25 bp, Mus musculus
gctggatgagaacctcgggatcata

SEQ ID NO: 572277 - DNA, 25 bp, Mus musculus
gctggatgagaagctcgggatcata

SEQ ID NO: 572278 - DNA, 25 bp, Mus musculus
gctggatgataaccgaaagccttca

SEQ ID NO: 572279 - DNA, 25 bp, Mus musculus
gctggatgataagcgaaagccttca

SEQ ID NO: 572280 - DNA, 25 bp, Mus musculus
gctggatgcaatcagtttgcagttt

SEQ ID NO: 572281 - DNA, 25 bp, Mus musculus
gctggatgcaatgagtttgcagttt

SEQ ID NO: 572282 - DNA, 25 bp, Mus musculus
gctggatgcagcctatgcttttgga

SEQ ID NO: 572283 - DNA, 25 bp, Mus musculus
gctggatgcagcgtatgcttttgga

SEQ ID NO: 572284 - DNA, 25 bp, Mus musculus
gctggatgccagatcaagattcaga

SEQ ID NO: 572285 - DNA, 25 bp, Mus musculus
gctggatgccagttcaagattcaga

SEQ ID NO: 572286 - DNA, 25 bp, Mus musculus
gctggatgctgacgaagtctctcga

SEQ ID NO: 572287 - DNA, 25 bp, Mus musculus
gctggatgctgaggaagtctctcga

SEQ ID NO: 572288 - DNA, 25 bp, Mus musculus
gctggatggcttagaggccaccaag

SEQ ID NO: 572289 - DNA, 25 bp, Mus musculus
gctggatggctttgaggccaccaag

SEQ ID NO: 572290 - DNA, 25 bp, Mus musculus
gctggatgtagcctacccctgggat

SEQ ID NO: 572291 - DNA, 25 bp, Mus musculus
gctggatgtagcgtacccctgggat

SEQ ID NO: 572292 - DNA, 25 bp, Mus musculus
gctggatgtgacagaagccaacaaa

SEQ ID NO: 572293 - DNA, 25 bp, Mus musculus
gctggatgtgactgaagccaacaaa

SEQ ID NO: 572294 - DNA, 25 bp, Mus musculus
gctggatgtgagagcacacactttt

SEQ ID NO: 572295 - DNA, 25 bp, Mus musculus
gctggatgtgagtgcacacactttt

SEQ ID NO: 572296 - DNA, 25 bp, Mus musculus
gctggatgttgcaagtgatggtcac

SEQ ID NO: 572297 - DNA, 25 bp, Mus musculus
gctggatgttgctagtgatggtcac

SEQ ID NO: 572298 - DNA, 25 bp, Mus musculus
gctggattaagcatgtgctggctcc

SEQ ID NO: 572299 - DNA, 25 bp, Mus musculus
gctggattaagcttgtgctggctcc

SEQ ID NO: 572300 - DNA, 25 bp, Mus musculus
gctggattaagtcccctcatgatgg

SEQ ID NO: 572301 - DNA, 25 bp, Mus musculus
gctggattaagtgccctcatgatgg

SEQ ID NO: 572302 - DNA, 25 bp, Mus musculus
gctggattaatcctcatttagaaat

SEQ ID NO: 572303 - DNA, 25 bp, Mus musculus
gctggattaatcgtcatttagaaat

SEQ ID NO: 572304 - DNA, 25 bp, Mus musculus
gctggattagcaagacgcacgttta

SEQ ID NO: 572305 - DNA, 25 bp, Mus musculus
gctggattagcatgacgcacgttta

SEQ ID NO: 572306 - DNA, 25 bp, Mus musculus
gctggattagccaaaggtcccggga

SEQ ID NO: 572307 - DNA, 25 bp, Mus musculus
gctggattagcctaaggtcccggga

SEQ ID NO: 572308 - DNA, 25 bp, Mus musculus
gctggattcagaagtaaccgaagaa

SEQ ID NO: 572309 - DNA, 25 bp, Mus musculus
gctggattcagatgtaaccgaagaa

SEQ ID NO: 572310 - DNA, 25 bp, Mus musculus
gctggattcagcactttggttattt

SEQ ID NO: 572311 - DNA, 25 bp, Mus musculus
gctggattcagctctttggttattt

SEQ ID NO: 572312 - DNA, 25 bp, Mus musculus
gctggattcagtcgtggaccgccaa

SEQ ID NO: 572313 - DNA, 25 bp, Mus musculus
gctggattcagtggtggaccgccaa

SEQ ID NO: 572314 - DNA, 25 bp, Mus musculus
gctggattcatgcagccagcattgc

SEQ ID NO: 572315 - DNA, 25 bp, Mus musculus
gctggattcatggagccagcattgc

SEQ ID NO: 572316 - DNA, 25 bp, Mus musculus
gctggattcccgaggattaattcta

SEQ ID NO: 572317 - DNA, 25 bp, Mus musculus
gctggattcccgtggattaattcta

SEQ ID NO: 572318 - DNA, 25 bp, Mus musculus
gctggattccgtaaagctagaagcc

SEQ ID NO: 572319 - DNA, 25 bp, Mus musculus
gctggattccgttaagctagaagcc

SEQ ID NO: 572320 - DNA, 25 bp, Mus musculus
gctggattccttctagcatgagagg

SEQ ID NO: 572321 - DNA, 25 bp, Mus musculus
gctggattccttgtagcatgagagg

SEQ ID NO: 572322 - DNA, 25 bp, Mus musculus
gctggattctagactgctgtggatt

SEQ ID NO: 572323 - DNA, 25 bp, Mus musculus
gctggattctagtctgctgtggatt

SEQ ID NO: 572324 - DNA, 25 bp, Mus musculus
gctggattctggaaaatggtcttgt

SEQ ID NO: 572325 - DNA, 25 bp, Mus musculus
gctggattctggtaaatggtcttgt

SEQ ID NO: 572326 - DNA, 25 bp, Mus musculus
gctggattcttcatgtagtaccaaa

SEQ ID NO: 572327 - DNA, 25 bp, Mus musculus
gctggattcttcttgtagtaccaaa

SEQ ID NO: 572328 - DNA, 25 bp, Mus musculus
gctggatttatgatgttttcgcaca

SEQ ID NO: 572329 - DNA, 25 bp, Mus musculus
gctggatttatgttgttttcgcaca

SEQ ID NO: 572330 - DNA, 25 bp, Mus musculus
gctggatttccactgcctctctata

SEQ ID NO: 572331 - DNA, 25 bp, Mus musculus
gctggatttccagtgcctctctata

SEQ ID NO: 572332 - DNA, 25 bp, Mus musculus
gctggatttcgaagactacctcaac

SEQ ID NO: 572333 - DNA, 25 bp, Mus musculus
gctggatttcgatgactacctcaac

SEQ ID NO: 572334 - DNA, 25 bp, Mus musculus
gctggatttctgaatgttgctgatc

SEQ ID NO: 572335 - DNA, 25 bp, Mus musculus
gctggatttctgtatgttgctgatc

SEQ ID NO: 572336 - DNA, 25 bp, Mus musculus
gctggattttaaatagacttgggtt

SEQ ID NO: 572337 - DNA, 25 bp, Mus musculus
gctggattttaattagacttgggtt

SEQ ID NO: 572338 - DNA, 25 bp, Mus musculus
gctggattttgcagaaaagctatca

SEQ ID NO: 572339 - DNA, 25 bp, Mus musculus
gctggattttgctgaaaagctatca

SEQ ID NO: 572340 - DNA, 25 bp, Mus musculus
gctggcaaacctcagagcccatggg

SEQ ID NO: 572341 - DNA, 25 bp, Mus musculus
gctggcaaacctgagagcccatggg

SEQ ID NO: 572342 - DNA, 25 bp, Mus musculus
gctggcaaacgcacttcacaataag

SEQ ID NO: 572343 - DNA, 25 bp, Mus musculus
gctggcaaacgctcttcacaataag

SEQ ID NO: 572344 - DNA, 25 bp, Mus musculus
gctggcaaatagctatggtgtttat

SEQ ID NO: 572345 - DNA, 25 bp, Mus musculus
gctggcaaataggtatggtgtttat

SEQ ID NO: 572346 - DNA, 25 bp, Mus musculus
gctggcaagagccatgtctactact

SEQ ID NO: 572347 - DNA, 25 bp, Mus musculus
gctggcaagagcgatgtctactact

SEQ ID NO: 572348 - DNA, 25 bp, Mus musculus
gctggcaagatcacgtgcttgtgcc

SEQ ID NO: 572349 - DNA, 25 bp, Mus musculus
gctggcaagatctcgtgcttgtgcc

SEQ ID NO: 572350 - DNA, 25 bp, Mus musculus
gctggcaagttcaccaatagctagt

SEQ ID NO: 572351 - DNA, 25 bp, Mus musculus
gctggcaagttctccaatagctagt

SEQ ID NO: 572352 - DNA, 25 bp, Mus musculus
gctggcaatcctaggtattatggca

SEQ ID NO: 572353 - DNA, 25 bp, Mus musculus
gctggcaatccttggtattatggca

SEQ ID NO: 572354 - DNA, 25 bp, Mus musculus
gctggcaatgtgctgcacactccaa

SEQ ID NO: 572355 - DNA, 25 bp, Mus musculus
gctggcaatgtggtgcacactccaa

SEQ ID NO: 572356 - DNA, 25 bp, Mus musculus
gctggcacaagaattccgcaagttt

SEQ ID NO: 572357 - DNA, 25 bp, Mus musculus
gctggcacaagatttccgcaagttt

SEQ ID NO: 572358 - DNA, 25 bp, Mus musculus
gctggcacagaaaattttacactaa

SEQ ID NO: 572359 - DNA, 25 bp, Mus musculus
gctggcacagaatattttacactaa

SEQ ID NO: 572360 - DNA, 25 bp, Mus musculus
gctggcacagatatgttcagaagtg

SEQ ID NO: 572361 - DNA, 25 bp, Mus musculus
gctggcacagatttgttcagaagtg

SEQ ID NO: 572362 - DNA, 25 bp, Mus musculus
gctggcacagccagaagagcctagt

SEQ ID NO: 572363 - DNA, 25 bp, Mus musculus
gctggcacagcctgaagagcctagt

SEQ ID NO: 572364 - DNA, 25 bp, Mus musculus
gctggcacagggacatatcctttca

SEQ ID NO: 572365 - DNA, 25 bp, Mus musculus
gctggcacagggtcatatcctttca

SEQ ID NO: 572366 - DNA, 25 bp, Mus musculus
gctggcacatcacgaccatctggaa

SEQ ID NO: 572367 - DNA, 25 bp, Mus musculus
gctggcacatcaggaccatctggaa

SEQ ID NO: 572368 - DNA, 25 bp, Mus musculus
gctggcacatctatctcagtgggaa

SEQ ID NO: 572369 - DNA, 25 bp, Mus musculus
gctggcacatctttctcagtgggaa

SEQ ID NO: 572370 - DNA, 25 bp, Mus musculus
gctggcacccagataggcaaggtca

SEQ ID NO: 572371 - DNA, 25 bp, Mus musculus
gctggcacccagttaggcaaggtca

SEQ ID NO: 572372 - DNA, 25 bp, Mus musculus
gctggcacccatatgcccggcagtg

SEQ ID NO: 572373 - DNA, 25 bp, Mus musculus
gctggcacccatttgcccggcagtg

SEQ ID NO: 572374 - DNA, 25 bp, Mus musculus
gctggcacgccgagagctgctctga

SEQ ID NO: 572375 - DNA, 25 bp, Mus musculus
gctggcacgccgtgagctgctctga

SEQ ID NO: 572376 - DNA, 25 bp, Mus musculus
gctggcactgctctggtgtacacct

SEQ ID NO: 572377 - DNA, 25 bp, Mus musculus
gctggcactgctgtggtgtacacct

SEQ ID NO: 572378 - DNA, 25 bp, Mus musculus
gctggcactggcagactatgtggtc

SEQ ID NO: 572379 - DNA, 25 bp, Mus musculus
gctggcactggctgactatgtggtc

SEQ ID NO: 572380 - DNA, 25 bp, Mus musculus
gctggcactggtcttcaataaagat

SEQ ID NO: 572381 - DNA, 25 bp, Mus musculus
gctggcactggtgttcaataaagat

SEQ ID NO: 572382 - DNA, 25 bp, Mus musculus
gctggcactgtgacttgggctaaaa

SEQ ID NO: 572383 - DNA, 25 bp, Mus musculus
gctggcactgtgtcttgggctaaaa

SEQ ID NO: 572384 - DNA, 25 bp, Mus musculus
gctggcactgttaaggtggctacaa

SEQ ID NO: 572385 - DNA, 25 bp, Mus musculus
gctggcactgtttaggtggctacaa

SEQ ID NO: 572386 - DNA, 25 bp, Mus musculus
gctggcagagagaggtagtcataaa

SEQ ID NO: 572387 - DNA, 25 bp, Mus musculus
gctggcagagagtggtagtcataaa

SEQ ID NO: 572388 - DNA, 25 bp, Mus musculus
gctggcagagatccgctcagagaca

SEQ ID NO: 572389 - DNA, 25 bp, Mus musculus
gctggcagagatgcgctcagagaca

SEQ ID NO: 572390 - DNA, 25 bp, Mus musculus
gctggcagagctagttcccatggag

SEQ ID NO: 572391 - DNA, 25 bp, Mus musculus
gctggcagagcttgttcccatggag

SEQ ID NO: 572392 - DNA, 25 bp, Mus musculus
gctggcagaggtcagcattagcttt

SEQ ID NO: 572393 - DNA, 25 bp, Mus musculus
gctggcagaggtgagcattagcttt

SEQ ID NO: 572394 - DNA, 25 bp, Mus musculus
gctggcagagtaaaaccttcatttc

SEQ ID NO: 572395 - DNA, 25 bp, Mus musculus
gctggcagagtataaccttcatttc

SEQ ID NO: 572396 - DNA, 25 bp, Mus musculus
gctggcagctctattgacttattta

SEQ ID NO: 572397 - DNA, 25 bp, Mus musculus
gctggcagctcttttgacttattta

SEQ ID NO: 572398 - DNA, 25 bp, Mus musculus
gctggcagctgcacggacagacatg

SEQ ID NO: 572399 - DNA, 25 bp, Mus musculus
gctggcagctgcattcaaacgagca

SEQ ID NO: 572400 - DNA, 25 bp, Mus musculus
gctggcagctgctcggacagacatg

SEQ ID NO: 572401 - DNA, 25 bp, Mus musculus
gctggcagctgctttcaaacgagca

SEQ ID NO: 572402 - DNA, 25 bp, Mus musculus
gctggcagctgtacctgtagaagac

SEQ ID NO: 572403 - DNA, 25 bp, Mus musculus
gctggcagctgttcctgtagaagac

SEQ ID NO: 572404 - DNA, 25 bp, Mus musculus
gctggcagcttaagcatggtctaac

SEQ ID NO: 572405 - DNA, 25 bp, Mus musculus
gctggcagcttatgcatggtctaac

SEQ ID NO: 572406 - DNA, 25 bp, Mus musculus
gctggcagcttgatgcacatggctt

SEQ ID NO: 572407 - DNA, 25 bp, Mus musculus
gctggcagcttgttgcacatggctt

SEQ ID NO: 572408 - DNA, 25 bp, Mus musculus
gctggcaggaatactctaggtatca

SEQ ID NO: 572409 - DNA, 25 bp, Mus musculus
gctggcaggaattctctaggtatca

SEQ ID NO: 572410 - DNA, 25 bp, Mus musculus
gctggcaggccaatgttcatattgt

SEQ ID NO: 572411 - DNA, 25 bp, Mus musculus
gctggcaggccattgttcatattgt

SEQ ID NO: 572412 - DNA, 25 bp, Mus musculus
gctggcagggtgaactgaccttact

SEQ ID NO: 572413 - DNA, 25 bp, Mus musculus
gctggcagggtgtactgaccttact

SEQ ID NO: 572414 - DNA, 25 bp, Mus musculus
gctggcagtcaacaggtctgagcaa

SEQ ID NO: 572415 - DNA, 25 bp, Mus musculus
gctggcagtcaagaggtctgagcaa

SEQ ID NO: 572416 - DNA, 25 bp, Mus musculus
gctggcagtgctagaggctagttcc

SEQ ID NO: 572417 - DNA, 25 bp, Mus musculus
gctggcagtgcttgaggctagttcc

SEQ ID NO: 572418 - DNA, 25 bp, Mus musculus
gctggcagtggcagctttgtagttt

SEQ ID NO: 572419 - DNA, 25 bp, Mus musculus
gctggcagtggctgctttgtagttt

SEQ ID NO: 572420 - DNA, 25 bp, Mus musculus
gctggcatacatcttctattccgtc

SEQ ID NO: 572421 - DNA, 25 bp, Mus musculus
gctggcatacatgttctattccgtc

SEQ ID NO: 572422 - DNA, 25 bp, Mus musculus
gctggcatatgaagggacctacaca

SEQ ID NO: 572423 - DNA, 25 bp, Mus musculus
gctggcatatgatgggacctacaca

SEQ ID NO: 572424 - DNA, 25 bp, Mus musculus
gctggcatatttcctctattccagg

SEQ ID NO: 572425 - DNA, 25 bp, Mus musculus
gctggcatatttgctctattccagg

SEQ ID NO: 572426 - DNA, 25 bp, Mus musculus
gctggcatcaggatccttttcaatg

SEQ ID NO: 572427 - DNA, 25 bp, Mus musculus
gctggcatcaggttccttttcaatg

SEQ ID NO: 572428 - DNA, 25 bp, Mus musculus
gctggcatcctaattttgtcttaag

SEQ ID NO: 572429 - DNA, 25 bp, Mus musculus
gctggcatcctatttttgtcttaag

SEQ ID NO: 572430 - DNA, 25 bp, Mus musculus
gctggcatccttccttacacagagg

SEQ ID NO: 572431 - DNA, 25 bp, Mus musculus
gctggcatccttgcttacacagagg

SEQ ID NO: 572432 - DNA, 25 bp, Mus musculus
gctggcatctgtccattaactcaaa

SEQ ID NO: 572433 - DNA, 25 bp, Mus musculus
gctggcatctgtgcattaactcaaa

SEQ ID NO: 572434 - DNA, 25 bp, Mus musculus
gctggcatgatacacaaaataaacc

SEQ ID NO: 572435 - DNA, 25 bp, Mus musculus
gctggcatgatagacaaaataaacc

SEQ ID NO: 572436 - DNA, 25 bp, Mus musculus
gctggcatgatgacccacttgtaat

SEQ ID NO: 572437 - DNA, 25 bp, Mus musculus
gctggcatgatgtcccacttgtaat

SEQ ID NO: 572438 - DNA, 25 bp, Mus musculus
gctggcatgcccagtgtgcacgaag

SEQ ID NO: 572439 - DNA, 25 bp, Mus musculus
gctggcatgccctgtgtgcacgaag

SEQ ID NO: 572440 - DNA, 25 bp, Mus musculus
gctggcatgccgcagtcattgaatt

SEQ ID NO: 572441 - DNA, 25 bp, Mus musculus
gctggcatgccggagtcattgaatt

SEQ ID NO: 572442 - DNA, 25 bp, Mus musculus
gctggcatggctcccacatctgttg

SEQ ID NO: 572443 - DNA, 25 bp, Mus musculus
gctggcatggctgccacatctgttg

SEQ ID NO: 572444 - DNA, 25 bp, Mus musculus
gctggcatgtaaacactggctttta

SEQ ID NO: 572445 - DNA, 25 bp, Mus musculus
gctggcatgtaatcactggctttta

SEQ ID NO: 572446 - DNA, 25 bp, Mus musculus
gctggcatgtctagacgcctggtga

SEQ ID NO: 572447 - DNA, 25 bp, Mus musculus
gctggcatgtcttgacgcctggtga

SEQ ID NO: 572448 - DNA, 25 bp, Mus musculus
gctggcattagtatctggatgacaa

SEQ ID NO: 572449 - DNA, 25 bp, Mus musculus
gctggcattagtttctggatgacaa

SEQ ID NO: 572450 - DNA, 25 bp, Mus musculus
gctggcattatgcatcaatccttat

SEQ ID NO: 572451 - DNA, 25 bp, Mus musculus
gctggcattatggatcaatccttat

SEQ ID NO: 572452 - DNA, 25 bp, Mus musculus
gctggcattcaacaggcaattccat

SEQ ID NO: 572453 - DNA, 25 bp, Mus musculus
gctggcattcaagaggcaattccat

SEQ ID NO: 572454 - DNA, 25 bp, Mus musculus
gctggcattggcacagtgtttggta

SEQ ID NO: 572455 - DNA, 25 bp, Mus musculus
gctggcattggctcagtgtttggta

SEQ ID NO: 572456 - DNA, 25 bp, Mus musculus
gctggcattggtactgactgtcact

SEQ ID NO: 572457 - DNA, 25 bp, Mus musculus
gctggcattggttctgactgtcact

SEQ ID NO: 572458 - DNA, 25 bp, Mus musculus
gctggcatttccaagtcgagcagaa

SEQ ID NO: 572459 - DNA, 25 bp, Mus musculus
gctggcatttcctagtcgagcagaa

SEQ ID NO: 572460 - DNA, 25 bp, Mus musculus
gctggcatttctaatgtgttgctta

SEQ ID NO: 572461 - DNA, 25 bp, Mus musculus
gctggcatttctcgatttgtgtttc

SEQ ID NO: 572462 - DNA, 25 bp, Mus musculus
gctggcatttctggatttgtgtttc

SEQ ID NO: 572463 - DNA, 25 bp, Mus musculus
gctggcatttcttatgtgttgctta

SEQ ID NO: 572464 - DNA, 25 bp, Mus musculus
gctggccaacacctacaagatcgta

SEQ ID NO: 572465 - DNA, 25 bp, Mus musculus
gctggccaacacgtacaagatcgta

SEQ ID NO: 572466 - DNA, 25 bp, Mus musculus
gctggccaagagcaatcgcagaacc

SEQ ID NO: 572467 - DNA, 25 bp, Mus musculus
gctggccaagagcagggaccttctc

SEQ ID NO: 572468 - DNA, 25 bp, Mus musculus
gctggccaagaggaatcgcagaacc

SEQ ID NO: 572469 - DNA, 25 bp, Mus musculus
gctggccaagaggagggaccttctc

SEQ ID NO: 572470 - DNA, 25 bp, Mus musculus
gctggccaaggtcaccgtgcttgct

SEQ ID NO: 572471 - DNA, 25 bp, Mus musculus
gctggccaaggtgaccgtgcttgct

SEQ ID NO: 572472 - DNA, 25 bp, Mus musculus
gctggccaagttagccgaagatgac

SEQ ID NO: 572473 - DNA, 25 bp, Mus musculus
gctggccaagtttgccgaagatgac

SEQ ID NO: 572474 - DNA, 25 bp, Mus musculus
gctggccaataaaaacgcttctctc

SEQ ID NO: 572475 - DNA, 25 bp, Mus musculus
gctggccaataaactctgttgcttt

SEQ ID NO: 572476 - DNA, 25 bp, Mus musculus
gctggccaataataacgcttctctc

SEQ ID NO: 572477 - DNA, 25 bp, Mus musculus
gctggccaataatctctgttgcttt

SEQ ID NO: 572478 - DNA, 25 bp, Mus musculus
gctggccaatcacgtgaggacacgc

SEQ ID NO: 572479 - DNA, 25 bp, Mus musculus
gctggccaatcaggtgaggacacgc

SEQ ID NO: 572480 - DNA, 25 bp, Mus musculus
gctggccaatgacaagccctatctc

SEQ ID NO: 572481 - DNA, 25 bp, Mus musculus
gctggccaatgactcacagaggtcc

SEQ ID NO: 572482 - DNA, 25 bp, Mus musculus
gctggccaatgagaagccctatctc

SEQ ID NO: 572483 - DNA, 25 bp, Mus musculus
gctggccaatgagtcacagaggtcc

SEQ ID NO: 572484 - DNA, 25 bp, Mus musculus
gctggccacacaaacttgaggacct

SEQ ID NO: 572485 - DNA, 25 bp, Mus musculus
gctggccacacatacttgaggacct

SEQ ID NO: 572486 - DNA, 25 bp, Mus musculus
gctggccacaggaggtcactgcttc

SEQ ID NO: 572487 - DNA, 25 bp, Mus musculus
gctggccacaggtggtcactgcttc

SEQ ID NO: 572488 - DNA, 25 bp, Mus musculus
gctggccacgtgacctaatgatgaa

SEQ ID NO: 572489 - DNA, 25 bp, Mus musculus
gctggccacgtgtcctaatgatgaa

SEQ ID NO: 572490 - DNA, 25 bp, Mus musculus
gctggccacttccagatacttacat

SEQ ID NO: 572491 - DNA, 25 bp, Mus musculus
gctggccacttcgagatacttacat

SEQ ID NO: 572492 - DNA, 25 bp, Mus musculus
gctggccagcctacaacaggaagtt

SEQ ID NO: 572493 - DNA, 25 bp, Mus musculus
gctggccagcctcctgaaggtgcac

SEQ ID NO: 572494 - DNA, 25 bp, Mus musculus
gctggccagcctgctgaaggtgcac

SEQ ID NO: 572495 - DNA, 25 bp, Mus musculus
gctggccagccttcaacaggaagtt

SEQ ID NO: 572496 - DNA, 25 bp, Mus musculus
gctggccagctgaataaaacaccct

SEQ ID NO: 572497 - DNA, 25 bp, Mus musculus
gctggccagctgtataaaacaccct

SEQ ID NO: 572498 - DNA, 25 bp, Mus musculus
gctggccatagcatagtgcaattgt

SEQ ID NO: 572499 - DNA, 25 bp, Mus musculus
gctggccatagcttagtgcaattgt

SEQ ID NO: 572500 - DNA, 25 bp, Mus musculus
gctggccatggacgcttctacacat

SEQ ID NO: 572501 - DNA, 25 bp, Mus musculus
gctggccatggaggcttctacacat

SEQ ID NO: 572502 - DNA, 25 bp, Mus musculus
gctggcccagatctttgttgtttgt

SEQ ID NO: 572503 - DNA, 25 bp, Mus musculus
gctggcccagatgtttgttgtttgt

SEQ ID NO: 572504 - DNA, 25 bp, Mus musculus
gctggcccaggcaaggactgactgt

SEQ ID NO: 572505 - DNA, 25 bp, Mus musculus
gctggcccaggctaggactgactgt

SEQ ID NO: 572506 - DNA, 25 bp, Mus musculus
gctggcccattacttgtcacagaat

SEQ ID NO: 572507 - DNA, 25 bp, Mus musculus
gctggcccattagttgtcacagaat

SEQ ID NO: 572508 - DNA, 25 bp, Mus musculus
gctggcccattgcttactcctaaaa

SEQ ID NO: 572509 - DNA, 25 bp, Mus musculus
gctggcccattggttactcctaaaa

SEQ ID NO: 572510 - DNA, 25 bp, Mus musculus
gctggcccatttaccacatggtata

SEQ ID NO: 572511 - DNA, 25 bp, Mus musculus
gctggcccatttctgaggaattaac

SEQ ID NO: 572512 - DNA, 25 bp, Mus musculus
gctggcccatttgtgaggaattaac

SEQ ID NO: 572513 - DNA, 25 bp, Mus musculus
gctggcccattttccacatggtata

SEQ ID NO: 572514 - DNA, 25 bp, Mus musculus
gctggccccaggaccaagagaatga

SEQ ID NO: 572515 - DNA, 25 bp, Mus musculus
gctggccccaggtccaagagaatga

SEQ ID NO: 572516 - DNA, 25 bp, Mus musculus
gctggcccctccataaagagttgat

SEQ ID NO: 572517 - DNA, 25 bp, Mus musculus
gctggcccctccttaaagagttgat

SEQ ID NO: 572518 - DNA, 25 bp, Mus musculus
gctggccccttgacatcaagcagga

SEQ ID NO: 572519 - DNA, 25 bp, Mus musculus
gctggccccttgtcatcaagcagga

SEQ ID NO: 572520 - DNA, 25 bp, Mus musculus
gctggccctaaacaagagacctttt

SEQ ID NO: 572521 - DNA, 25 bp, Mus musculus
gctggccctaaagaagagacctttt

SEQ ID NO: 572522 - DNA, 25 bp, Mus musculus
gctggccctacaacctatttttgta

SEQ ID NO: 572523 - DNA, 25 bp, Mus musculus
gctggccctacatcctatttttgta

SEQ ID NO: 572524 - DNA, 25 bp, Mus musculus
gctggccctgaccttaggagtggac

SEQ ID NO: 572525 - DNA, 25 bp, Mus musculus
gctggccctgacgttaggagtggac

SEQ ID NO: 572526 - DNA, 25 bp, Mus musculus
gctggcccttccagaaggtcaataa

SEQ ID NO: 572527 - DNA, 25 bp, Mus musculus
gctggcccttcctgaaggtcaataa

SEQ ID NO: 572528 - DNA, 25 bp, Mus musculus
gctggccgagaactcatgccgaaac

SEQ ID NO: 572529 - DNA, 25 bp, Mus musculus
gctggccgagaagtcatgccgaaac

SEQ ID NO: 572530 - DNA, 25 bp, Mus musculus
gctggccgccctctgaagagctgaa

SEQ ID NO: 572531 - DNA, 25 bp, Mus musculus
gctggccgccctgtgaagagctgaa

SEQ ID NO: 572532 - DNA, 25 bp, Mus musculus
gctggccggaatcctgatgctacta

SEQ ID NO: 572533 - DNA, 25 bp, Mus musculus
gctggccggaatgctgatgctacta

SEQ ID NO: 572534 - DNA, 25 bp, Mus musculus
gctggccggcccagacaaggagaat

SEQ ID NO: 572535 - DNA, 25 bp, Mus musculus
gctggccggccctgacaaggagaat

SEQ ID NO: 572536 - DNA, 25 bp, Mus musculus
gctggccgtgcacatgtttatcgac

SEQ ID NO: 572537 - DNA, 25 bp, Mus musculus
gctggccgtgcagatgtttatcgac

SEQ ID NO: 572538 - DNA, 25 bp, Mus musculus
gctggcctatacaagcttggctttt

SEQ ID NO: 572539 - DNA, 25 bp, Mus musculus
gctggcctatactagcttggctttt

SEQ ID NO: 572540 - DNA, 25 bp, Mus musculus
gctggcctattaccgaatctatgtc

SEQ ID NO: 572541 - DNA, 25 bp, Mus musculus
gctggcctattagcgaatctatgtc

SEQ ID NO: 572542 - DNA, 25 bp, Mus musculus
gctggcctcaagcagagccacctga

SEQ ID NO: 572543 - DNA, 25 bp, Mus musculus
gctggcctcaaggagagccacctga

SEQ ID NO: 572544 - DNA, 25 bp, Mus musculus
gctggcctgaggaaaacaccgataa

SEQ ID NO: 572545 - DNA, 25 bp, Mus musculus
gctggcctgaggtaaacaccgataa

SEQ ID NO: 572546 - DNA, 25 bp, Mus musculus
gctggcctgctcatagtgggaatga

SEQ ID NO: 572547 - DNA, 25 bp, Mus musculus
gctggcctgctcttagtgggaatga

SEQ ID NO: 572548 - DNA, 25 bp, Mus musculus
gctggcctggacatgggctagcacc

SEQ ID NO: 572549 - DNA, 25 bp, Mus musculus
gctggcctggacttgggctagcacc

SEQ ID NO: 572550 - DNA, 25 bp, Mus musculus
gctggcctggcccagaacttagaga

SEQ ID NO: 572551 - DNA, 25 bp, Mus musculus
gctggcctggccgagaacttagaga

SEQ ID NO: 572552 - DNA, 25 bp, Mus musculus
gctggcctggctacattccaagatc

SEQ ID NO: 572553 - DNA, 25 bp, Mus musculus
gctggcctggctcctagtattatga

SEQ ID NO: 572554 - DNA, 25 bp, Mus musculus
gctggcctggctgctagtattatga

SEQ ID NO: 572555 - DNA, 25 bp, Mus musculus
gctggcctggcttcattccaagatc

SEQ ID NO: 572556 - DNA, 25 bp, Mus musculus
gctggcctgggaatcgtggcaaatc

SEQ ID NO: 572557 - DNA, 25 bp, Mus musculus
gctggcctgggattcgtggcaaatc

SEQ ID NO: 572558 - DNA, 25 bp, Mus musculus
gctggcctgtgaagtattatacaac

SEQ ID NO: 572559 - DNA, 25 bp, Mus musculus
gctggcctgtgatgtattatacaac

SEQ ID NO: 572560 - DNA, 25 bp, Mus musculus
gctggcctgtgtcgcatctgctata

SEQ ID NO: 572561 - DNA, 25 bp, Mus musculus
gctggcctgtgtggcatctgctata

SEQ ID NO: 572562 - DNA, 25 bp, Mus musculus
gctggccttgggaaactggaactga

SEQ ID NO: 572563 - DNA, 25 bp, Mus musculus
gctggccttgggtaactggaactga

SEQ ID NO: 572564 - DNA, 25 bp, Mus musculus
gctggcctttgaaatgtatgttctc

SEQ ID NO: 572565 - DNA, 25 bp, Mus musculus
gctggcctttgaaccagcgagtaat

SEQ ID NO: 572566 - DNA, 25 bp, Mus musculus
gctggcctttgatatgtatgttctc

SEQ ID NO: 572567 - DNA, 25 bp, Mus musculus
gctggcctttgatccagcgagtaat

SEQ ID NO: 572568 - DNA, 25 bp, Mus musculus
gctggccttttgatttaatgggatt

SEQ ID NO: 572569 - DNA, 25 bp, Mus musculus
gctggccttttgttttaatgggatt

SEQ ID NO: 572570 - DNA, 25 bp, Mus musculus
gctggcgaagccagagcaaggccca

SEQ ID NO: 572571 - DNA, 25 bp, Mus musculus
gctggcgaagcctgagcaaggccca

SEQ ID NO: 572572 - DNA, 25 bp, Mus musculus
gctggcgactaacctgactgaactg

SEQ ID NO: 572573 - DNA, 25 bp, Mus musculus
gctggcgactaagctgactgaactg

SEQ ID NO: 572574 - DNA, 25 bp, Mus musculus
gctggcgagagtccgaaatgcatct

SEQ ID NO: 572575 - DNA, 25 bp, Mus musculus
gctggcgagagtgcgaaatgcatct

SEQ ID NO: 572576 - DNA, 25 bp, Mus musculus
gctggcgatgaacagaatcgtgcta

SEQ ID NO: 572577 - DNA, 25 bp, Mus musculus
gctggcgatgaagagaatcgtgcta

SEQ ID NO: 572578 - DNA, 25 bp, Mus musculus
gctggcgcctgcaaatgcaaacaat

SEQ ID NO: 572579 - DNA, 25 bp, Mus musculus
gctggcgcctgcagcagaactgaga

SEQ ID NO: 572580 - DNA, 25 bp, Mus musculus
gctggcgcctgctaatgcaaacaat

SEQ ID NO: 572581 - DNA, 25 bp, Mus musculus
gctggcgcctgctgcagaactgaga

SEQ ID NO: 572582 - DNA, 25 bp, Mus musculus
gctggcgcctgtcagtgaccacaca

SEQ ID NO: 572583 - DNA, 25 bp, Mus musculus
gctggcgcctgtgagtgaccacaca

SEQ ID NO: 572584 - DNA, 25 bp, Mus musculus
gctggcgcgtctcacttatgaaaca

SEQ ID NO: 572585 - DNA, 25 bp, Mus musculus
gctggcgcgtctgacttatgaaaca

SEQ ID NO: 572586 - DNA, 25 bp, Mus musculus
gctggcgctctaacagaacttggat

SEQ ID NO: 572587 - DNA, 25 bp, Mus musculus
gctggcgctctatcagaacttggat

SEQ ID NO: 572588 - DNA, 25 bp, Mus musculus
gctggcgctttcattgcatggaggg

SEQ ID NO: 572589 - DNA, 25 bp, Mus musculus
gctggcgctttctttgcatggaggg

SEQ ID NO: 572590 - DNA, 25 bp, Mus musculus
gctggcggaacccattgtgcgttaa

SEQ ID NO: 572591 - DNA, 25 bp, Mus musculus
gctggcggaaccgattgtgcgttaa

SEQ ID NO: 572592 - DNA, 25 bp, Mus musculus
gctggcggactcaagaagtctgcat

SEQ ID NO: 572593 - DNA, 25 bp, Mus musculus
gctggcggactctagaagtctgcat

SEQ ID NO: 572594 - DNA, 25 bp, Mus musculus
gctggcggatctcgcaaggcaacac

SEQ ID NO: 572595 - DNA, 25 bp, Mus musculus
gctggcggatctggcaaggcaacac

SEQ ID NO: 572596 - DNA, 25 bp, Mus musculus
gctggcggctacctatctggaaaga

SEQ ID NO: 572597 - DNA, 25 bp, Mus musculus
gctggcggctacgtatctggaaaga

SEQ ID NO: 572598 - DNA, 25 bp, Mus musculus
gctggcgggtttactgttctgaaga

SEQ ID NO: 572599 - DNA, 25 bp, Mus musculus
gctggcgggttttctgttctgaaga

SEQ ID NO: 572600 - DNA, 25 bp, Mus musculus
gctggcggtatcaatgctgtgactg

SEQ ID NO: 572601 - DNA, 25 bp, Mus musculus
gctggcggtatctatgctgtgactg

SEQ ID NO: 572602 - DNA, 25 bp, Mus musculus
gctggcggtcagagatgagatcctt

SEQ ID NO: 572603 - DNA, 25 bp, Mus musculus
gctggcggtcagtgatgagatcctt

SEQ ID NO: 572604 - DNA, 25 bp, Mus musculus
gctggcgtaattatgcaatctgaaa

SEQ ID NO: 572605 - DNA, 25 bp, Mus musculus
gctggcgtaattttgcaatctgaaa

SEQ ID NO: 572606 - DNA, 25 bp, Mus musculus
gctggcgtgtagagagatttcctaa

SEQ ID NO: 572607 - DNA, 25 bp, Mus musculus
gctggcgtgtagtgagatttcctaa

SEQ ID NO: 572608 - DNA, 25 bp, Mus musculus
gctggcgttaaaactgtactcactt

SEQ ID NO: 572609 - DNA, 25 bp, Mus musculus
gctggcgttaaatctgtactcactt

SEQ ID NO: 572610 - DNA, 25 bp, Mus musculus
gctggcgttgcaataatctcaaaag

SEQ ID NO: 572611 - DNA, 25 bp, Mus musculus
gctggcgttgcattaatctcaaaag

SEQ ID NO: 572612 - DNA, 25 bp, Mus musculus
gctggctacgacaatgttggcttca

SEQ ID NO: 572613 - DNA, 25 bp, Mus musculus
gctggctacgactatgttggcttca

SEQ ID NO: 572614 - DNA, 25 bp, Mus musculus
gctggctacggacttggctttgatc

SEQ ID NO: 572615 - DNA, 25 bp, Mus musculus
gctggctacggagttggctttgatc

SEQ ID NO: 572616 - DNA, 25 bp, Mus musculus
gctggctagcctctcagagcatgag

SEQ ID NO: 572617 - DNA, 25 bp, Mus musculus
gctggctagcctgtcagagcatgag

SEQ ID NO: 572618 - DNA, 25 bp, Mus musculus
gctggctatagtatcaatgctgtct

SEQ ID NO: 572619 - DNA, 25 bp, Mus musculus
gctggctatagtttcaatgctgtct

SEQ ID NO: 572620 - DNA, 25 bp, Mus musculus
gctggctatcaaactgaattccctc

SEQ ID NO: 572621 - DNA, 25 bp, Mus musculus
gctggctatcaatctgaattccctc

SEQ ID NO: 572622 - DNA, 25 bp, Mus musculus
gctggctatcatacagggtctgatt

SEQ ID NO: 572623 - DNA, 25 bp, Mus musculus
gctggctatcattcagggtctgatt

SEQ ID NO: 572624 - DNA, 25 bp, Mus musculus
gctggctatgaacaaatatttccac

SEQ ID NO: 572625 - DNA, 25 bp, Mus musculus
gctggctatgaagaaatatttccac

SEQ ID NO: 572626 - DNA, 25 bp, Mus musculus
gctggctatgtaattgagaggaagc

SEQ ID NO: 572627 - DNA, 25 bp, Mus musculus
gctggctatgtatttgagaggaagc

SEQ ID NO: 572628 - DNA, 25 bp, Mus musculus
gctggctcaaacacaaggaaatctt

SEQ ID NO: 572629 - DNA, 25 bp, Mus musculus
gctggctcaaactcaaggaaatctt

SEQ ID NO: 572630 - DNA, 25 bp, Mus musculus
gctggctcaaccatgatcttctata

SEQ ID NO: 572631 - DNA, 25 bp, Mus musculus
gctggctcaaccttgatcttctata

SEQ ID NO: 572632 - DNA, 25 bp, Mus musculus
gctggctcacacatgcttgcaaaga

SEQ ID NO: 572633 - DNA, 25 bp, Mus musculus
gctggctcacacttgcttgcaaaga

SEQ ID NO: 572634 - DNA, 25 bp, Mus musculus
gctggctcacccactggaaggacag

SEQ ID NO: 572635 - DNA, 25 bp, Mus musculus
gctggctcaccctctggaaggacag

SEQ ID NO: 572636 - DNA, 25 bp, Mus musculus
gctggctcacctatcaagatgttca

SEQ ID NO: 572637 - DNA, 25 bp, Mus musculus
gctggctcacctttcaagatgttca

SEQ ID NO: 572638 - DNA, 25 bp, Mus musculus
gctggctcagagatttgtggtcaca

SEQ ID NO: 572639 - DNA, 25 bp, Mus musculus
gctggctcagagttttgtggtcaca

SEQ ID NO: 572640 - DNA, 25 bp, Mus musculus
gctggctcagcaaggatccgtctta

SEQ ID NO: 572641 - DNA, 25 bp, Mus musculus
gctggctcagcatggatccgtctta

SEQ ID NO: 572642 - DNA, 25 bp, Mus musculus
gctggctcaggaagacagcctcaac

SEQ ID NO: 572643 - DNA, 25 bp, Mus musculus
gctggctcaggatgacagcctcaac

SEQ ID NO: 572644 - DNA, 25 bp, Mus musculus
gctggctcagggaaaggtccgattc

SEQ ID NO: 572645 - DNA, 25 bp, Mus musculus
gctggctcagggtaaggtccgattc

SEQ ID NO: 572646 - DNA, 25 bp, Mus musculus
gctggctccctcaactcaggaatga

SEQ ID NO: 572647 - DNA, 25 bp, Mus musculus
gctggctccctctactcaggaatga

SEQ ID NO: 572648 - DNA, 25 bp, Mus musculus
gctggctccctgcaagcttccatgt

SEQ ID NO: 572649 - DNA, 25 bp, Mus musculus
gctggctccctggaagcttccatgt

SEQ ID NO: 572650 - DNA, 25 bp, Mus musculus
gctggctcctgacaaaatttttata

SEQ ID NO: 572651 - DNA, 25 bp, Mus musculus
gctggctcctgagaaaatttttata

SEQ ID NO: 572652 - DNA, 25 bp, Mus musculus
gctggctcctttaagattgcatagt

SEQ ID NO: 572653 - DNA, 25 bp, Mus musculus
gctggctccttttagattgcatagt

SEQ ID NO: 572654 - DNA, 25 bp, Mus musculus
gctggctcgctacaagttcaaggcc

SEQ ID NO: 572655 - DNA, 25 bp, Mus musculus
gctggctcgctagaagttcaaggcc

SEQ ID NO: 572656 - DNA, 25 bp, Mus musculus
gctggctctagaatcagagttccac

SEQ ID NO: 572657 - DNA, 25 bp, Mus musculus
gctggctctagattcagagttccac

SEQ ID NO: 572658 - DNA, 25 bp, Mus musculus
gctggctctagtacgggacatccgt

SEQ ID NO: 572659 - DNA, 25 bp, Mus musculus
gctggctctagttcgggacatccgt

SEQ ID NO: 572660 - DNA, 25 bp, Mus musculus
gctggctctctgcaggaataccgca

SEQ ID NO: 572661 - DNA, 25 bp, Mus musculus
gctggctctctggaggaataccgca

SEQ ID NO: 572662 - DNA, 25 bp, Mus musculus
gctggctgacatacaagtgcgacgt

SEQ ID NO: 572663 - DNA, 25 bp, Mus musculus
gctggctgacattcaagtgcgacgt

SEQ ID NO: 572664 - DNA, 25 bp, Mus musculus
gctggctgactgctcaatacttatt

SEQ ID NO: 572665 - DNA, 25 bp, Mus musculus
gctggctgactggtcaatacttatt

SEQ ID NO: 572666 - DNA, 25 bp, Mus musculus
gctggctgatacagacatagacctt

SEQ ID NO: 572667 - DNA, 25 bp, Mus musculus
gctggctgatactgacatagacctt

SEQ ID NO: 572668 - DNA, 25 bp, Mus musculus
gctggctgatttcatcgattgtccc

SEQ ID NO: 572669 - DNA, 25 bp, Mus musculus
gctggctgatttgatcgattgtccc

SEQ ID NO: 572670 - DNA, 25 bp, Mus musculus
gctggctgcaaacgctcgtgaaatt

SEQ ID NO: 572671 - DNA, 25 bp, Mus musculus
gctggctgcaaaggctcgtgaaatt

SEQ ID NO: 572672 - DNA, 25 bp, Mus musculus
gctggctgcaccagtgatgcattcc

SEQ ID NO: 572673 - DNA, 25 bp, Mus musculus
gctggctgcacctgtgatgcattcc

SEQ ID NO: 572674 - DNA, 25 bp, Mus musculus
gctggctgcaggcaacaatctattt

SEQ ID NO: 572675 - DNA, 25 bp, Mus musculus
gctggctgcagggaacaatctattt

SEQ ID NO: 572676 - DNA, 25 bp, Mus musculus
gctggctgccagcaaatgtacaggt

SEQ ID NO: 572677 - DNA, 25 bp, Mus musculus
gctggctgccaggaaatgtacaggt

SEQ ID NO: 572678 - DNA, 25 bp, Mus musculus
gctggctgcccactaacttggagct

SEQ ID NO: 572679 - DNA, 25 bp, Mus musculus
gctggctgcccagtaacttggagct

SEQ ID NO: 572680 - DNA, 25 bp, Mus musculus
gctggctgcctcagagatgccctct

SEQ ID NO: 572681 - DNA, 25 bp, Mus musculus
gctggctgcctctgagatgccctct

SEQ ID NO: 572682 - DNA, 25 bp, Mus musculus
gctggctgccttcgagaagacttat

SEQ ID NO: 572683 - DNA, 25 bp, Mus musculus
gctggctgccttggagaagacttat

SEQ ID NO: 572684 - DNA, 25 bp, Mus musculus
gctggctgcggaaaatgacgaacct

SEQ ID NO: 572685 - DNA, 25 bp, Mus musculus
gctggctgcggataatgacgaacct

SEQ ID NO: 572686 - DNA, 25 bp, Mus musculus
gctggctgctctcatataagcattt

SEQ ID NO: 572687 - DNA, 25 bp, Mus musculus
gctggctgctctgatataagcattt

SEQ ID NO: 572688 - DNA, 25 bp, Mus musculus
gctggctgcttcacggatcgcggaa

SEQ ID NO: 572689 - DNA, 25 bp, Mus musculus
gctggctgcttctcggatcgcggaa

SEQ ID NO: 572690 - DNA, 25 bp, Mus musculus
gctggctggaacattttcccaactt

SEQ ID NO: 572691 - DNA, 25 bp, Mus musculus
gctggctggaactttttcccaactt

SEQ ID NO: 572692 - DNA, 25 bp, Mus musculus
gctggctggactcttacatgcagaa

SEQ ID NO: 572693 - DNA, 25 bp, Mus musculus
gctggctggactgttacatgcagaa

SEQ ID NO: 572694 - DNA, 25 bp, Mus musculus
gctggctggagtacccaccacttgc

SEQ ID NO: 572695 - DNA, 25 bp, Mus musculus
gctggctggagttcccaccacttgc

SEQ ID NO: 572696 - DNA, 25 bp, Mus musculus
gctggctggattcagctgtcaccat

SEQ ID NO: 572697 - DNA, 25 bp, Mus musculus
gctggctggattgagctgtcaccat

SEQ ID NO: 572698 - DNA, 25 bp, Mus musculus
gctggctgggatcatcttaagcaat

SEQ ID NO: 572699 - DNA, 25 bp, Mus musculus
gctggctgggatcttagcaagacca

SEQ ID NO: 572700 - DNA, 25 bp, Mus musculus
gctggctgggatgatcttaagcaat

SEQ ID NO: 572701 - DNA, 25 bp, Mus musculus
gctggctgggatgttagcaagacca

SEQ ID NO: 572702 - DNA, 25 bp, Mus musculus
gctggctgggccaaatggttcaata

SEQ ID NO: 572703 - DNA, 25 bp, Mus musculus
gctggctgggcctaatggttcaata

SEQ ID NO: 572704 - DNA, 25 bp, Mus musculus
gctggctgggtcagctccgctgtac

SEQ ID NO: 572705 - DNA, 25 bp, Mus musculus
gctggctgggtcataggacaatcca

SEQ ID NO: 572706 - DNA, 25 bp, Mus musculus
gctggctgggtctgctccgctgtac

SEQ ID NO: 572707 - DNA, 25 bp, Mus musculus
gctggctgggtcttaggacaatcca

SEQ ID NO: 572708 - DNA, 25 bp, Mus musculus
gctggctggtagaaaacttatctct

SEQ ID NO: 572709 - DNA, 25 bp, Mus musculus
gctggctggtagtaaacttatctct

SEQ ID NO: 572710 - DNA, 25 bp, Mus musculus
gctggctggtgactcgtatagtctc

SEQ ID NO: 572711 - DNA, 25 bp, Mus musculus
gctggctggtgactctcagagaccc

SEQ ID NO: 572712 - DNA, 25 bp, Mus musculus
gctggctggtgagtcgtatagtctc

SEQ ID NO: 572713 - DNA, 25 bp, Mus musculus
gctggctggtgagtctcagagaccc

SEQ ID NO: 572714 - DNA, 25 bp, Mus musculus
gctggctgtagaacttcgtgctgat

SEQ ID NO: 572715 - DNA, 25 bp, Mus musculus
gctggctgtagatcttcgtgctgat

SEQ ID NO: 572716 - DNA, 25 bp, Mus musculus
gctggctgtcatcggcattgtactt

SEQ ID NO: 572717 - DNA, 25 bp, Mus musculus
gctggctgtcatgggcattgtactt

SEQ ID NO: 572718 - DNA, 25 bp, Mus musculus
gctggctgtcgcagcacacaggtaa

SEQ ID NO: 572719 - DNA, 25 bp, Mus musculus
gctggctgtcgctgcacacaggtaa

SEQ ID NO: 572720 - DNA, 25 bp, Mus musculus
gctggctgtgaaatgctcctgagat

SEQ ID NO: 572721 - DNA, 25 bp, Mus musculus
gctggctgtgaattgctcctgagat

SEQ ID NO: 572722 - DNA, 25 bp, Mus musculus
gctggctgtggtaaagggccatcaa

SEQ ID NO: 572723 - DNA, 25 bp, Mus musculus
gctggctgtggttaagggccatcaa

SEQ ID NO: 572724 - DNA, 25 bp, Mus musculus
gctggctgttatctcaaagtcttcc

SEQ ID NO: 572725 - DNA, 25 bp, Mus musculus
gctggctgttatgtcaaagtcttcc

SEQ ID NO: 572726 - DNA, 25 bp, Mus musculus
gctggctgtttaattcatcgctcaa

SEQ ID NO: 572727 - DNA, 25 bp, Mus musculus
gctggctgtttatttcatcgctcaa

SEQ ID NO: 572728 - DNA, 25 bp, Mus musculus
gctggcttaagaaggaacggccgta

SEQ ID NO: 572729 - DNA, 25 bp, Mus musculus
gctggcttaagatggaacggccgta

SEQ ID NO: 572730 - DNA, 25 bp, Mus musculus
gctggcttacagcaagaatggatac

SEQ ID NO: 572731 - DNA, 25 bp, Mus musculus
gctggcttacaggaagaatggatac

SEQ ID NO: 572732 - DNA, 25 bp, Mus musculus
gctggcttacctcttatcatgacac

SEQ ID NO: 572733 - DNA, 25 bp, Mus musculus
gctggcttacctgttatcatgacac

SEQ ID NO: 572734 - DNA, 25 bp, Mus musculus
gctggcttaggtatgctaggctaca

SEQ ID NO: 572735 - DNA, 25 bp, Mus musculus
gctggcttaggtttgctaggctaca

SEQ ID NO: 572736 - DNA, 25 bp, Mus musculus
gctggcttcaagaggcaggacttca

SEQ ID NO: 572737 - DNA, 25 bp, Mus musculus
gctggcttcaagtggcaggacttca

SEQ ID NO: 572738 - DNA, 25 bp, Mus musculus
gctggcttcagacctaccattggta

SEQ ID NO: 572739 - DNA, 25 bp, Mus musculus
gctggcttcagagctaccattggta

SEQ ID NO: 572740 - DNA, 25 bp, Mus musculus
gctggcttcatgcattcataatctt

SEQ ID NO: 572741 - DNA, 25 bp, Mus musculus
gctggcttcatggattcataatctt

SEQ ID NO: 572742 - DNA, 25 bp, Mus musculus
gctggcttccagcagtgagacttct

SEQ ID NO: 572743 - DNA, 25 bp, Mus musculus
gctggcttccaggagtgagacttct

SEQ ID NO: 572744 - DNA, 25 bp, Mus musculus
gctggcttccatagtgcctaactag

SEQ ID NO: 572745 - DNA, 25 bp, Mus musculus
gctggcttccattgtgcctaactag

SEQ ID NO: 572746 - DNA, 25 bp, Mus musculus
gctggcttcccaacaacaaattcaa

SEQ ID NO: 572747 - DNA, 25 bp, Mus musculus
gctggcttcccatcaacaaattcaa

SEQ ID NO: 572748 - DNA, 25 bp, Mus musculus
gctggcttcccgaactgaatgtatt

SEQ ID NO: 572749 - DNA, 25 bp, Mus musculus
gctggcttcccgtactgaatgtatt

SEQ ID NO: 572750 - DNA, 25 bp, Mus musculus
gctggcttcctcactggaattggac

SEQ ID NO: 572751 - DNA, 25 bp, Mus musculus
gctggcttcctctctggaattggac

SEQ ID NO: 572752 - DNA, 25 bp, Mus musculus
gctggcttcttacggcacttaaaca

SEQ ID NO: 572753 - DNA, 25 bp, Mus musculus
gctggcttcttagggcacttaaaca

SEQ ID NO: 572754 - DNA, 25 bp, Mus musculus
gctggcttctttaaatcatgtactg

SEQ ID NO: 572755 - DNA, 25 bp, Mus musculus
gctggcttcttttaatcatgtactg

SEQ ID NO: 572756 - DNA, 25 bp, Mus musculus
gctggcttgctaaggttctgtaatg

SEQ ID NO: 572757 - DNA, 25 bp, Mus musculus
gctggcttgctatggttctgtaatg

SEQ ID NO: 572758 - DNA, 25 bp, Mus musculus
gctggcttgcttaactggcactctt

SEQ ID NO: 572759 - DNA, 25 bp, Mus musculus
gctggcttgctttactggcactctt

SEQ ID NO: 572760 - DNA, 25 bp, Mus musculus
gctggcttggccatgatgaacaatg

SEQ ID NO: 572761 - DNA, 25 bp, Mus musculus
gctggcttggccttgatgaacaatg

SEQ ID NO: 572762 - DNA, 25 bp, Mus musculus
gctggcttggttaggaatttgtttc

SEQ ID NO: 572763 - DNA, 25 bp, Mus musculus
gctggcttggtttggaatttgtttc

SEQ ID NO: 572764 - DNA, 25 bp, Mus musculus
gctggctttagaaatccaactgagg

SEQ ID NO: 572765 - DNA, 25 bp, Mus musculus
gctggctttagatatccaactgagg

SEQ ID NO: 572766 - DNA, 25 bp, Mus musculus
gctggctttcatcgctctccctggg

SEQ ID NO: 572767 - DNA, 25 bp, Mus musculus
gctggctttcatggctctccctggg

SEQ ID NO: 572768 - DNA, 25 bp, Mus musculus
gctggctttgaaatcgatatgtaac

SEQ ID NO: 572769 - DNA, 25 bp, Mus musculus
gctggctttgaattcgatatgtaac

SEQ ID NO: 572770 - DNA, 25 bp, Mus musculus
gctggcttttctaccaaacattggt

SEQ ID NO: 572771 - DNA, 25 bp, Mus musculus
gctggcttttcttccaaacattggt

SEQ ID NO: 572772 - DNA, 25 bp, Mus musculus
gctggcttttgcctgtgatgacaaa

SEQ ID NO: 572773 - DNA, 25 bp, Mus musculus
gctggcttttgcgtgtgatgacaaa

SEQ ID NO: 572774 - DNA, 25 bp, Mus musculus
gctgggaaactcaaatccttcactg

SEQ ID NO: 572775 - DNA, 25 bp, Mus musculus
gctgggaaactctaatccttcactg

SEQ ID NO: 572776 - DNA, 25 bp, Mus musculus
gctgggaaagttcagtcatgtctta

SEQ ID NO: 572777 - DNA, 25 bp, Mus musculus
gctgggaaagttgagtcatgtctta

SEQ ID NO: 572778 - DNA, 25 bp, Mus musculus
gctgggaaatagacacgcttttaca

SEQ ID NO: 572779 - DNA, 25 bp, Mus musculus
gctgggaaatagtcacgcttttaca

SEQ ID NO: 572780 - DNA, 25 bp, Mus musculus
gctgggaaattcaccatttacctcc

SEQ ID NO: 572781 - DNA, 25 bp, Mus musculus
gctgggaaattctccatttacctcc

SEQ ID NO: 572782 - DNA, 25 bp, Mus musculus
gctgggaaccagaggcccttaattc

SEQ ID NO: 572783 - DNA, 25 bp, Mus musculus
gctgggaaccagtggcccttaattc

SEQ ID NO: 572784 - DNA, 25 bp, Mus musculus
gctgggaacgtccaaacttcaacat

SEQ ID NO: 572785 - DNA, 25 bp, Mus musculus
gctgggaacgtcgaaacttcaacat

SEQ ID NO: 572786 - DNA, 25 bp, Mus musculus
gctgggaactaaacatgttcttccg

SEQ ID NO: 572787 - DNA, 25 bp, Mus musculus
gctgggaactaatcatgttcttccg

SEQ ID NO: 572788 - DNA, 25 bp, Mus musculus
gctgggaagacaagcaagcgccttt

SEQ ID NO: 572789 - DNA, 25 bp, Mus musculus
gctgggaagacatgcaagcgccttt

SEQ ID NO: 572790 - DNA, 25 bp, Mus musculus
gctgggaagcagatgcagaactcag

SEQ ID NO: 572791 - DNA, 25 bp, Mus musculus
gctgggaagcagttgcagaactcag

SEQ ID NO: 572792 - DNA, 25 bp, Mus musculus
gctgggaagggaccttttcttgtat

SEQ ID NO: 572793 - DNA, 25 bp, Mus musculus
gctgggaagggagcttttcttgtat

SEQ ID NO: 572794 - DNA, 25 bp, Mus musculus
gctgggaagttcaatgctttgaaat

SEQ ID NO: 572795 - DNA, 25 bp, Mus musculus
gctgggaagttctatgctttgaaat

SEQ ID NO: 572796 - DNA, 25 bp, Mus musculus
gctgggacagaaaggtgaaccacct

SEQ ID NO: 572797 - DNA, 25 bp, Mus musculus
gctgggacagaatggtgaaccacct

SEQ ID NO: 572798 - DNA, 25 bp, Mus musculus
gctgggacaggcaatttctgcagga

SEQ ID NO: 572799 - DNA, 25 bp, Mus musculus
gctgggacaggcatcagaactgcat

SEQ ID NO: 572800 - DNA, 25 bp, Mus musculus
gctgggacaggctatttctgcagga

SEQ ID NO: 572801 - DNA, 25 bp, Mus musculus
gctgggacaggcttcagaactgcat

SEQ ID NO: 572802 - DNA, 25 bp, Mus musculus
gctgggaccagacccagacacagga

SEQ ID NO: 572803 - DNA, 25 bp, Mus musculus
gctgggaccagagccagacacagga

SEQ ID NO: 572804 - DNA, 25 bp, Mus musculus
gctgggaccaggaagctggtggcca

SEQ ID NO: 572805 - DNA, 25 bp, Mus musculus
gctgggaccaggtagctggtggcca

SEQ ID NO: 572806 - DNA, 25 bp, Mus musculus
gctgggaccgctacggccccaggaa

SEQ ID NO: 572807 - DNA, 25 bp, Mus musculus
gctgggaccgcttcggccccaggaa

SEQ ID NO: 572808 - DNA, 25 bp, Mus musculus
gctgggacctgacctagaggcctca

SEQ ID NO: 572809 - DNA, 25 bp, Mus musculus
gctgggacctgagctagaggcctca

SEQ ID NO: 572810 - DNA, 25 bp, Mus musculus
gctgggacctgcatgctgaaaggaa

SEQ ID NO: 572811 - DNA, 25 bp, Mus musculus
gctgggacctgcttgctgaaaggaa

SEQ ID NO: 572812 - DNA, 25 bp, Mus musculus
gctgggactacgcagactctgtttc

SEQ ID NO: 572813 - DNA, 25 bp, Mus musculus
gctgggactacggagactctgtttc

SEQ ID NO: 572814 - DNA, 25 bp, Mus musculus
gctgggactccaacaatcatcttag

SEQ ID NO: 572815 - DNA, 25 bp, Mus musculus
gctgggactccatcaatcatcttag

SEQ ID NO: 572816 - DNA, 25 bp, Mus musculus
gctgggactgctagagataccactc

SEQ ID NO: 572817 - DNA, 25 bp, Mus musculus
gctgggactgcttgagataccactc

SEQ ID NO: 572818 - DNA, 25 bp, Mus musculus
gctgggacttaacctatggaccatc

SEQ ID NO: 572819 - DNA, 25 bp, Mus musculus
gctgggacttaagctatggaccatc

SEQ ID NO: 572820 - DNA, 25 bp, Mus musculus
gctgggagacccagattcagacaat

SEQ ID NO: 572821 - DNA, 25 bp, Mus musculus
gctgggagaccctgattcagacaat

SEQ ID NO: 572822 - DNA, 25 bp, Mus musculus
gctgggagacgcctcagtcagtaaa

SEQ ID NO: 572823 - DNA, 25 bp, Mus musculus
gctgggagacgcgtcagtcagtaaa

SEQ ID NO: 572824 - DNA, 25 bp, Mus musculus
gctgggagagatcccctggcttgca

SEQ ID NO: 572825 - DNA, 25 bp, Mus musculus
gctgggagagatgccctggcttgca

SEQ ID NO: 572826 - DNA, 25 bp, Mus musculus
gctgggagataaattctgctctaaa

SEQ ID NO: 572827 - DNA, 25 bp, Mus musculus
gctgggagataatttctgctctaaa

SEQ ID NO: 572828 - DNA, 25 bp, Mus musculus
gctgggagccggcagaggacaggca

SEQ ID NO: 572829 - DNA, 25 bp, Mus musculus
gctgggagccgggagaggacaggca

SEQ ID NO: 572830 - DNA, 25 bp, Mus musculus
gctgggagcctgaacatgacggaaa

SEQ ID NO: 572831 - DNA, 25 bp, Mus musculus
gctgggagcctgtacatgacggaaa

SEQ ID NO: 572832 - DNA, 25 bp, Mus musculus
gctgggagcgaactctcagtgttcc

SEQ ID NO: 572833 - DNA, 25 bp, Mus musculus
gctgggagcgaagtctcagtgttcc

SEQ ID NO: 572834 - DNA, 25 bp, Mus musculus
gctgggagctaaagcatgacgcaca

SEQ ID NO: 572835 - DNA, 25 bp, Mus musculus
gctgggagctaatgcatgacgcaca

SEQ ID NO: 572836 - DNA, 25 bp, Mus musculus
gctgggatagatatcctgttcttgt

SEQ ID NO: 572837 - DNA, 25 bp, Mus musculus
gctgggatagatttcctgttcttgt

SEQ ID NO: 572838 - DNA, 25 bp, Mus musculus
gctgggatccccattatcaaggcag

SEQ ID NO: 572839 - DNA, 25 bp, Mus musculus
gctgggatcccctttatcaaggcag

SEQ ID NO: 572840 - DNA, 25 bp, Mus musculus
gctgggatctgtctctggcttatca

SEQ ID NO: 572841 - DNA, 25 bp, Mus musculus
gctgggatctgtgtctggcttatca

SEQ ID NO: 572842 - DNA, 25 bp, Mus musculus
gctgggatgacacgctgcgccacca

SEQ ID NO: 572843 - DNA, 25 bp, Mus musculus
gctgggatgacaggctgcgccacca

SEQ ID NO: 572844 - DNA, 25 bp, Mus musculus
gctgggatgccaatgctcataggtc

SEQ ID NO: 572845 - DNA, 25 bp, Mus musculus
gctgggatgccattgctcataggtc

SEQ ID NO: 572846 - DNA, 25 bp, Mus musculus
gctgggatggtgatcgcaactatca

SEQ ID NO: 572847 - DNA, 25 bp, Mus musculus
gctgggatggtgttcgcaactatca

SEQ ID NO: 572848 - DNA, 25 bp, Mus musculus
gctgggatgtacataagtctcaacc

SEQ ID NO: 572849 - DNA, 25 bp, Mus musculus
gctgggatgtacttaagtctcaacc

SEQ ID NO: 572850 - DNA, 25 bp, Mus musculus
gctgggattaaacgacacggctcaa

SEQ ID NO: 572851 - DNA, 25 bp, Mus musculus
gctgggattaaaggacacggctcaa

SEQ ID NO: 572852 - DNA, 25 bp, Mus musculus
gctgggattacgagctggagccatc

SEQ ID NO: 572853 - DNA, 25 bp, Mus musculus
gctgggattacgtgctggagccatc

SEQ ID NO: 572854 - DNA, 25 bp, Mus musculus
gctgggattataagctcagcccaaa

SEQ ID NO: 572855 - DNA, 25 bp, Mus musculus
gctgggattatatgctcagcccaaa

SEQ ID NO: 572856 - DNA, 25 bp, Mus musculus
gctgggattcggatcctgtaacttg

SEQ ID NO: 572857 - DNA, 25 bp, Mus musculus
gctgggattcggttcctgtaacttg

SEQ ID NO: 572858 - DNA, 25 bp, Mus musculus
gctgggattgcaagcaacttccttt

SEQ ID NO: 572859 - DNA, 25 bp, Mus musculus
gctgggattgcatgcaacttccttt

SEQ ID NO: 572860 - DNA, 25 bp, Mus musculus
gctgggattggcattctcgagtact

SEQ ID NO: 572861 - DNA, 25 bp, Mus musculus
gctgggattggctttctcgagtact

SEQ ID NO: 572862 - DNA, 25 bp, Mus musculus
gctgggcaaagtatatgtttgttac

SEQ ID NO: 572863 - DNA, 25 bp, Mus musculus
gctgggcaaagtttatgtttgttac

SEQ ID NO: 572864 - DNA, 25 bp, Mus musculus
gctgggcaacagctcttcttagtag

SEQ ID NO: 572865 - DNA, 25 bp, Mus musculus
gctgggcaacaggtcttcttagtag

SEQ ID NO: 572866 - DNA, 25 bp, Mus musculus
gctgggcaactgacagtcaactgag

SEQ ID NO: 572867 - DNA, 25 bp, Mus musculus
gctgggcaactgtcagtcaactgag

SEQ ID NO: 572868 - DNA, 25 bp, Mus musculus
gctgggcacacaacatgcacttaga

SEQ ID NO: 572869 - DNA, 25 bp, Mus musculus
gctgggcacacatcatgcacttaga

SEQ ID NO: 572870 - DNA, 25 bp, Mus musculus
gctgggcacagactgtggatccact

SEQ ID NO: 572871 - DNA, 25 bp, Mus musculus
gctgggcacagagtgtggatccact

SEQ ID NO: 572872 - DNA, 25 bp, Mus musculus
gctgggcaccagatcatcgtgcaga

SEQ ID NO: 572873 - DNA, 25 bp, Mus musculus
gctgggcaccagttcatcgtgcaga

SEQ ID NO: 572874 - DNA, 25 bp, Mus musculus
gctgggcacgaacaactttgggttt

SEQ ID NO: 572875 - DNA, 25 bp, Mus musculus
gctgggcacgaagaactttgggttt

SEQ ID NO: 572876 - DNA, 25 bp, Mus musculus
gctgggcacgagaagtcaacctcaa

SEQ ID NO: 572877 - DNA, 25 bp, Mus musculus
gctgggcacgagtagtcaacctcaa

SEQ ID NO: 572878 - DNA, 25 bp, Mus musculus
gctgggcacgttcagtgaatctcag

SEQ ID NO: 572879 - DNA, 25 bp, Mus musculus
gctgggcacgttgagtgaatctcag

SEQ ID NO: 572880 - DNA, 25 bp, Mus musculus
gctgggcactgcactgaagatcttg

SEQ ID NO: 572881 - DNA, 25 bp, Mus musculus
gctgggcactgctctgaagatcttg

SEQ ID NO: 572882 - DNA, 25 bp, Mus musculus
gctgggcagaagagcttacctacca

SEQ ID NO: 572883 - DNA, 25 bp, Mus musculus
gctgggcagaagtgcttacctacca

SEQ ID NO: 572884 - DNA, 25 bp, Mus musculus
gctgggcagcagacaagtcctcact

SEQ ID NO: 572885 - DNA, 25 bp, Mus musculus
gctgggcagcagtcaagtcctcact

SEQ ID NO: 572886 - DNA, 25 bp, Mus musculus
gctgggcagcctactgaggtacgca

SEQ ID NO: 572887 - DNA, 25 bp, Mus musculus
gctgggcagccttctgaggtacgca

SEQ ID NO: 572888 - DNA, 25 bp, Mus musculus
gctgggcagctgcaatcagcttgtt

SEQ ID NO: 572889 - DNA, 25 bp, Mus musculus
gctgggcagctggaatcagcttgtt

SEQ ID NO: 572890 - DNA, 25 bp, Mus musculus
gctgggcagtgtagtcaaagcattt

SEQ ID NO: 572891 - DNA, 25 bp, Mus musculus
gctgggcagtgttgtcaaagcattt

SEQ ID NO: 572892 - DNA, 25 bp, Mus musculus
gctgggcatccacgcttttggtcac

SEQ ID NO: 572893 - DNA, 25 bp, Mus musculus
gctgggcatccaggcttttggtcac

SEQ ID NO: 572894 - DNA, 25 bp, Mus musculus
gctgggcatgatcacacatgctttt

SEQ ID NO: 572895 - DNA, 25 bp, Mus musculus
gctgggcatgatcatgcatacttgt

SEQ ID NO: 572896 - DNA, 25 bp, Mus musculus
gctgggcatgatgacacatgctttt

SEQ ID NO: 572897 - DNA, 25 bp, Mus musculus
gctgggcatgatgatgcatacttgt

SEQ ID NO: 572898 - DNA, 25 bp, Mus musculus
gctgggcatggcaatgtgtacctga

SEQ ID NO: 572899 - DNA, 25 bp, Mus musculus
gctgggcatggctatgtgtacctga

SEQ ID NO: 572900 - DNA, 25 bp, Mus musculus
gctgggcattacaatgatggtgatc

SEQ ID NO: 572901 - DNA, 25 bp, Mus musculus
gctgggcattactatgatggtgatc

SEQ ID NO: 572902 - DNA, 25 bp, Mus musculus
gctgggccaaggaatttggtatcct

SEQ ID NO: 572903 - DNA, 25 bp, Mus musculus
gctgggccaaggtatttggtatcct

SEQ ID NO: 572904 - DNA, 25 bp, Mus musculus
gctgggccagacaagaaggtatccg

SEQ ID NO: 572905 - DNA, 25 bp, Mus musculus
gctgggccagactagaaggtatccg

SEQ ID NO: 572906 - DNA, 25 bp, Mus musculus
gctgggccccaaaggaccaatgatg

SEQ ID NO: 572907 - DNA, 25 bp, Mus musculus
gctgggccccaatggaccaatgatg

SEQ ID NO: 572908 - DNA, 25 bp, Mus musculus
gctgggcctagtcaggtgccctcac

SEQ ID NO: 572909 - DNA, 25 bp, Mus musculus
gctgggcctagtgaggtgccctcac

SEQ ID NO: 572910 - DNA, 25 bp, Mus musculus
gctgggcctattaaagtattctctc

SEQ ID NO: 572911 - DNA, 25 bp, Mus musculus
gctgggcctatttaagtattctctc

SEQ ID NO: 572912 - DNA, 25 bp, Mus musculus
gctgggcctcagcatccgggttttc

SEQ ID NO: 572913 - DNA, 25 bp, Mus musculus
gctgggcctcaggatccgggttttc

SEQ ID NO: 572914 - DNA, 25 bp, Mus musculus
gctgggcctccacgaagaatactat

SEQ ID NO: 572915 - DNA, 25 bp, Mus musculus
gctgggcctccaggaagaatactat

SEQ ID NO: 572916 - DNA, 25 bp, Mus musculus
gctgggcctgcaactagtactgtac

SEQ ID NO: 572917 - DNA, 25 bp, Mus musculus
gctgggcctgcatctagtactgtac

SEQ ID NO: 572918 - DNA, 25 bp, Mus musculus
gctgggcctgtaatttattgcacac

SEQ ID NO: 572919 - DNA, 25 bp, Mus musculus
gctgggcctgtattttattgcacac

SEQ ID NO: 572920 - DNA, 25 bp, Mus musculus
gctgggcctgtcatttgaaatcttt

SEQ ID NO: 572921 - DNA, 25 bp, Mus musculus
gctgggcctgtcttttgaaatcttt

SEQ ID NO: 572922 - DNA, 25 bp, Mus musculus
gctgggcgagagacaactgggcctt

SEQ ID NO: 572923 - DNA, 25 bp, Mus musculus
gctgggcgagagtcaactgggcctt

SEQ ID NO: 572924 - DNA, 25 bp, Mus musculus
gctgggcgcaggaaactatcactaa

SEQ ID NO: 572925 - DNA, 25 bp, Mus musculus
gctgggcgcaggtaactatcactaa

SEQ ID NO: 572926 - DNA, 25 bp, Mus musculus
gctgggcgctgcaaatgacattttt

SEQ ID NO: 572927 - DNA, 25 bp, Mus musculus
gctgggcgctgctaatgacattttt

SEQ ID NO: 572928 - DNA, 25 bp, Mus musculus
gctgggctaaagacctaacacactg

SEQ ID NO: 572929 - DNA, 25 bp, Mus musculus
gctgggctaaagtcctaacacactg

SEQ ID NO: 572930 - DNA, 25 bp, Mus musculus
gctgggctaggcatttcattgttgt

SEQ ID NO: 572931 - DNA, 25 bp, Mus musculus
gctgggctaggcttttcattgttgt

SEQ ID NO: 572932 - DNA, 25 bp, Mus musculus
gctgggctatcactggaagcatttc

SEQ ID NO: 572933 - DNA, 25 bp, Mus musculus
gctgggctatcagtggaagcatttc

SEQ ID NO: 572934 - DNA, 25 bp, Mus musculus
gctgggctattaatcacatcctaag

SEQ ID NO: 572935 - DNA, 25 bp, Mus musculus
gctgggctattattcacatcctaag

SEQ ID NO: 572936 - DNA, 25 bp, Mus musculus
gctgggctattcatggctgggctac

SEQ ID NO: 572937 - DNA, 25 bp, Mus musculus
gctgggctattcttggctgggctac

SEQ ID NO: 572938 - DNA, 25 bp, Mus musculus
gctgggctatttagttaatttctac

SEQ ID NO: 572939 - DNA, 25 bp, Mus musculus
gctgggctattttgttaatttctac

SEQ ID NO: 572940 - DNA, 25 bp, Mus musculus
gctgggctccacagaagtcttttaa

SEQ ID NO: 572941 - DNA, 25 bp, Mus musculus
gctgggctccactgaagtcttttaa

SEQ ID NO: 572942 - DNA, 25 bp, Mus musculus
gctgggctccagatcatcttctgag

SEQ ID NO: 572943 - DNA, 25 bp, Mus musculus
gctgggctccagttcatcttctgag

SEQ ID NO: 572944 - DNA, 25 bp, Mus musculus
gctgggctcctcaagacctggaggt

SEQ ID NO: 572945 - DNA, 25 bp, Mus musculus
gctgggctcctctagacctggaggt

SEQ ID NO: 572946 - DNA, 25 bp, Mus musculus
gctgggctcggcctttttcctttca

SEQ ID NO: 572947 - DNA, 25 bp, Mus musculus
gctgggctcggcgtttttcctttca

SEQ ID NO: 572948 - DNA, 25 bp, Mus musculus
gctgggctctggcaaggcacctcaa

SEQ ID NO: 572949 - DNA, 25 bp, Mus musculus
gctgggctctgggaaggcacctcaa

SEQ ID NO: 572950 - DNA, 25 bp, Mus musculus
gctgggctggagacacagcattttt

SEQ ID NO: 572951 - DNA, 25 bp, Mus musculus
gctgggctggagtcacagcattttt

SEQ ID NO: 572952 - DNA, 25 bp, Mus musculus
gctgggctgtgtattcatcctttaa

SEQ ID NO: 572953 - DNA, 25 bp, Mus musculus
gctgggctgtgttttcatcctttaa

SEQ ID NO: 572954 - DNA, 25 bp, Mus musculus
gctgggcttaccactgtgcaccttt

SEQ ID NO: 572955 - DNA, 25 bp, Mus musculus
gctgggcttacctctgtgcaccttt

SEQ ID NO: 572956 - DNA, 25 bp, Mus musculus
gctgggcttcaaaaccaaaggtgtc

SEQ ID NO: 572957 - DNA, 25 bp, Mus musculus
gctgggcttcaataccaaaggtgtc

SEQ ID NO: 572958 - DNA, 25 bp, Mus musculus
gctgggcttcttaaactagtacctt

SEQ ID NO: 572959 - DNA, 25 bp, Mus musculus
gctgggcttcttcttcttgtttgaa

SEQ ID NO: 572960 - DNA, 25 bp, Mus musculus
gctgggcttcttgttcttgtttgaa

SEQ ID NO: 572961 - DNA, 25 bp, Mus musculus
gctgggcttctttaactagtacctt

SEQ ID NO: 572962 - DNA, 25 bp, Mus musculus
gctgggcttgatccttggaactgat

SEQ ID NO: 572963 - DNA, 25 bp, Mus musculus
gctgggcttgatgcttggaactgat

SEQ ID NO: 572964 - DNA, 25 bp, Mus musculus
gctgggcttgcaattccgtttttaa

SEQ ID NO: 572965 - DNA, 25 bp, Mus musculus
gctgggcttgcatttccgtttttaa

SEQ ID NO: 572966 - DNA, 25 bp, Mus musculus
gctgggcttgccatctgttagtgtg

SEQ ID NO: 572967 - DNA, 25 bp, Mus musculus
gctgggcttgccttctgttagtgtg

SEQ ID NO: 572968 - DNA, 25 bp, Mus musculus
gctgggggctcacagactctgaaaa

SEQ ID NO: 572969 - DNA, 25 bp, Mus musculus
gctgggggctcagagactctgaaaa

SEQ ID NO: 572970 - DNA, 25 bp, Mus musculus
gctgggtacacacagcaccgctgct

SEQ ID NO: 572971 - DNA, 25 bp, Mus musculus
gctgggtacacagagcaccgctgct

SEQ ID NO: 572972 - DNA, 25 bp, Mus musculus
gctgggtaccatctagggccatttt

SEQ ID NO: 572973 - DNA, 25 bp, Mus musculus
gctgggtaccatgtagggccatttt

SEQ ID NO: 572974 - DNA, 25 bp, Mus musculus
gctgggtaccgaaagtctacttaca

SEQ ID NO: 572975 - DNA, 25 bp, Mus musculus
gctgggtaccgatagtctacttaca

SEQ ID NO: 572976 - DNA, 25 bp, Mus musculus
gctgggtacgctagccctggccttg

SEQ ID NO: 572977 - DNA, 25 bp, Mus musculus
gctgggtacgcttgccctggccttg

SEQ ID NO: 572978 - DNA, 25 bp, Mus musculus
gctgggtagaaacatggcctgtatt

SEQ ID NO: 572979 - DNA, 25 bp, Mus musculus
gctgggtagaaagatggcctgtatt

SEQ ID NO: 572980 - DNA, 25 bp, Mus musculus
gctgggtaggccagaaggcttcaca

SEQ ID NO: 572981 - DNA, 25 bp, Mus musculus
gctgggtaggcctgaaggcttcaca

SEQ ID NO: 572982 - DNA, 25 bp, Mus musculus
gctgggtaggctcaaataatggcta

SEQ ID NO: 572983 - DNA, 25 bp, Mus musculus
gctgggtaggctgaaataatggcta

SEQ ID NO: 572984 - DNA, 25 bp, Mus musculus
gctgggtatagtatttagccttcct

SEQ ID NO: 572985 - DNA, 25 bp, Mus musculus
gctgggtatagtttttagccttcct

SEQ ID NO: 572986 - DNA, 25 bp, Mus musculus
gctgggtatcggaggtatatgcttt

SEQ ID NO: 572987 - DNA, 25 bp, Mus musculus
gctgggtatcggtggtatatgcttt

SEQ ID NO: 572988 - DNA, 25 bp, Mus musculus
gctgggtatgctaacatgtgatctc

SEQ ID NO: 572989 - DNA, 25 bp, Mus musculus
gctgggtatgcttacatgtgatctc

SEQ ID NO: 572990 - DNA, 25 bp, Mus musculus
gctgggtattgcacctttagtacta

SEQ ID NO: 572991 - DNA, 25 bp, Mus musculus
gctgggtattgctcctttagtacta

SEQ ID NO: 572992 - DNA, 25 bp, Mus musculus
gctgggtcagctctatggctgcaag

SEQ ID NO: 572993 - DNA, 25 bp, Mus musculus
gctgggtcagctgtatggctgcaag

SEQ ID NO: 572994 - DNA, 25 bp, Mus musculus
gctgggtcccatcggtgcttctgtc

SEQ ID NO: 572995 - DNA, 25 bp, Mus musculus
gctgggtcccatgggtgcttctgtc

SEQ ID NO: 572996 - DNA, 25 bp, Mus musculus
gctgggtcctgcactggatttgaac

SEQ ID NO: 572997 - DNA, 25 bp, Mus musculus
gctgggtcctgctctggatttgaac

SEQ ID NO: 572998 - DNA, 25 bp, Mus musculus
gctgggtctcgtcgtacatgcctgt

SEQ ID NO: 572999 - DNA, 25 bp, Mus musculus
gctgggtctcgtggtacatgcctgt

SEQ ID NO: 573000 - DNA, 25 bp, Mus musculus
gctgggtctgagcacttttctagga

SEQ ID NO: 573001 - DNA, 25 bp, Mus musculus
gctgggtctgaggacttttctagga

SEQ ID NO: 573002 - DNA, 25 bp, Mus musculus
gctgggtctggtcgagttcaacatc

SEQ ID NO: 573003 - DNA, 25 bp, Mus musculus
gctgggtctggtggagttcaacatc

SEQ ID NO: 573004 - DNA, 25 bp, Mus musculus
gctgggtcttcaagtagaactactt

SEQ ID NO: 573005 - DNA, 25 bp, Mus musculus
gctgggtcttcatgtagaactactt

SEQ ID NO: 573006 - DNA, 25 bp, Mus musculus
gctgggtggcaacaataggtttttt

SEQ ID NO: 573007 - DNA, 25 bp, Mus musculus
gctgggtggcaagaataggtttttt

SEQ ID NO: 573008 - DNA, 25 bp, Mus musculus
gctgggtggttcatgtctttcctaa

SEQ ID NO: 573009 - DNA, 25 bp, Mus musculus
gctgggtggttcttgtctttcctaa

SEQ ID NO: 573010 - DNA, 25 bp, Mus musculus
gctgggtgtgacacagtaaagtgaa

SEQ ID NO: 573011 - DNA, 25 bp, Mus musculus
gctgggtgtgactcagtaaagtgaa

SEQ ID NO: 573012 - DNA, 25 bp, Mus musculus
gctgggtgtgctactctctgtggcc

SEQ ID NO: 573013 - DNA, 25 bp, Mus musculus
gctgggtgtgcttctctctgtggcc

SEQ ID NO: 573014 - DNA, 25 bp, Mus musculus
gctgggtgtgttaggaatctcgtac

SEQ ID NO: 573015 - DNA, 25 bp, Mus musculus
gctgggtgtgtttggaatctcgtac

SEQ ID NO: 573016 - DNA, 25 bp, Mus musculus
gctgggttacctcggaaagccacac

SEQ ID NO: 573017 - DNA, 25 bp, Mus musculus
gctgggttacctgggaaagccacac

SEQ ID NO: 573018 - DNA, 25 bp, Mus musculus
gctgggttatttaattgcactttcc

SEQ ID NO: 573019 - DNA, 25 bp, Mus musculus
gctgggttattttattgcactttcc

SEQ ID NO: 573020 - DNA, 25 bp, Mus musculus
gctgggttcagtagcacgctcttga

SEQ ID NO: 573021 - DNA, 25 bp, Mus musculus
gctgggttcagttgcacgctcttga

SEQ ID NO: 573022 - DNA, 25 bp, Mus musculus
gctgggttccaaagaggtggtcacc

SEQ ID NO: 573023 - DNA, 25 bp, Mus musculus
gctgggttccaatgaggtggtcacc

SEQ ID NO: 573024 - DNA, 25 bp, Mus musculus
gctgggttctagaatgcagatcctc

SEQ ID NO: 573025 - DNA, 25 bp, Mus musculus
gctgggttctagtatgcagatcctc

SEQ ID NO: 573026 - DNA, 25 bp, Mus musculus
gctgggttctcaaaaagttacaagg

SEQ ID NO: 573027 - DNA, 25 bp, Mus musculus
gctgggttctcataaagttacaagg

SEQ ID NO: 573028 - DNA, 25 bp, Mus musculus
gctgggttctccaaacttaattctg

SEQ ID NO: 573029 - DNA, 25 bp, Mus musculus
gctgggttctccagtagctcttaca

SEQ ID NO: 573030 - DNA, 25 bp, Mus musculus
gctgggttctcctaacttaattctg

SEQ ID NO: 573031 - DNA, 25 bp, Mus musculus
gctgggttctcctgtagctcttaca

SEQ ID NO: 573032 - DNA, 25 bp, Mus musculus
gctgggttctgcagcagttggttca

SEQ ID NO: 573033 - DNA, 25 bp, Mus musculus
gctgggttctgctgcagttggttca

SEQ ID NO: 573034 - DNA, 25 bp, Mus musculus
gctgggttgattcttttgatttgca

SEQ ID NO: 573035 - DNA, 25 bp, Mus musculus
gctgggttgattgttttgatttgca

SEQ ID NO: 573036 - DNA, 25 bp, Mus musculus
gctgggttgcgccaaggctttctac

SEQ ID NO: 573037 - DNA, 25 bp, Mus musculus
gctgggttgcgcgaaggctttctac

SEQ ID NO: 573038 - DNA, 25 bp, Mus musculus
gctgggttgctcctgttaggcatat

SEQ ID NO: 573039 - DNA, 25 bp, Mus musculus
gctgggttgctcgtgttaggcatat

SEQ ID NO: 573040 - DNA, 25 bp, Mus musculus
gctgggttggtgattgctcagaaat

SEQ ID NO: 573041 - DNA, 25 bp, Mus musculus
gctgggttggtgtttgctcagaaat

SEQ ID NO: 573042 - DNA, 25 bp, Mus musculus
gctgggttgtagcacagtgtcacac

SEQ ID NO: 573043 - DNA, 25 bp, Mus musculus
gctgggttgtaggacagtgtcacac

SEQ ID NO: 573044 - DNA, 25 bp, Mus musculus
gctgggttgttaaactttgcctgaa

SEQ ID NO: 573045 - DNA, 25 bp, Mus musculus
gctgggttgttatactttgcctgaa

SEQ ID NO: 573046 - DNA, 25 bp, Mus musculus
gctgggtttaagagcacagtcacca

SEQ ID NO: 573047 - DNA, 25 bp, Mus musculus
gctgggtttaagtgcacagtcacca

SEQ ID NO: 573048 - DNA, 25 bp, Mus musculus
gctgggtttgaacctcacagtgaca

SEQ ID NO: 573049 - DNA, 25 bp, Mus musculus
gctgggtttgaagctcacagtgaca

SEQ ID NO: 573050 - DNA, 25 bp, Mus musculus
gctgggttttagaaaggctattaag

SEQ ID NO: 573051 - DNA, 25 bp, Mus musculus
gctgggttttagtaaggctattaag

SEQ ID NO: 573052 - DNA, 25 bp, Mus musculus
gctgggttttgcaagtagtcaggac

SEQ ID NO: 573053 - DNA, 25 bp, Mus musculus
gctgggttttgcacaatttttatat

SEQ ID NO: 573054 - DNA, 25 bp, Mus musculus
gctgggttttgctagtagtcaggac

SEQ ID NO: 573055 - DNA, 25 bp, Mus musculus
gctgggttttgctcaatttttatat

SEQ ID NO: 573056 - DNA, 25 bp, Mus musculus
gctgggttttggaaccatggcttac

SEQ ID NO: 573057 - DNA, 25 bp, Mus musculus
gctgggttttggtaccatggcttac

SEQ ID NO: 573058 - DNA, 25 bp, Mus musculus
gctggtaaaccaaatatcttctcct

SEQ ID NO: 573059 - DNA, 25 bp, Mus musculus
gctggtaaaccatatatcttctcct

SEQ ID NO: 573060 - DNA, 25 bp, Mus musculus
gctggtaaactcatggatgctgctt

SEQ ID NO: 573061 - DNA, 25 bp, Mus musculus
gctggtaaactcttggatgctgctt

SEQ ID NO: 573062 - DNA, 25 bp, Mus musculus
gctggtaactcacagtgacttgcat

SEQ ID NO: 573063 - DNA, 25 bp, Mus musculus
gctggtaactcagagtgacttgcat

SEQ ID NO: 573064 - DNA, 25 bp, Mus musculus
gctggtaactgcctggatgttgaca

SEQ ID NO: 573065 - DNA, 25 bp, Mus musculus
gctggtaactgcgtggatgttgaca

SEQ ID NO: 573066 - DNA, 25 bp, Mus musculus
gctggtaacttacgtgcctgttacc

SEQ ID NO: 573067 - DNA, 25 bp, Mus musculus
gctggtaacttaggtgcctgttacc

SEQ ID NO: 573068 - DNA, 25 bp, Mus musculus
gctggtaagcacatattctgccata

SEQ ID NO: 573069 - DNA, 25 bp, Mus musculus
gctggtaagcacttattctgccata

SEQ ID NO: 573070 - DNA, 25 bp, Mus musculus
gctggtaatagactcttgctgggcc

SEQ ID NO: 573071 - DNA, 25 bp, Mus musculus
gctggtaatagagtcttgctgggcc

SEQ ID NO: 573072 - DNA, 25 bp, Mus musculus
gctggtaatggtcgatccagatgcc

SEQ ID NO: 573073 - DNA, 25 bp, Mus musculus
gctggtaatggtggatccagatgcc

SEQ ID NO: 573074 - DNA, 25 bp, Mus musculus
gctggtacagcgacagacaggtaga

SEQ ID NO: 573075 - DNA, 25 bp, Mus musculus
gctggtacagcgtcagacaggtaga

SEQ ID NO: 573076 - DNA, 25 bp, Mus musculus
gctggtaccatccagctgtgcctgg

SEQ ID NO: 573077 - DNA, 25 bp, Mus musculus
gctggtaccatcgagctgtgcctgg

SEQ ID NO: 573078 - DNA, 25 bp, Mus musculus
gctggtaccttgctcttggctagcc

SEQ ID NO: 573079 - DNA, 25 bp, Mus musculus
gctggtaccttggtcttggctagcc

SEQ ID NO: 573080 - DNA, 25 bp, Mus musculus
gctggtactacacttcataaaaata

SEQ ID NO: 573081 - DNA, 25 bp, Mus musculus
gctggtactacagttcataaaaata

SEQ ID NO: 573082 - DNA, 25 bp, Mus musculus
gctggtactcagcaagttgtgccca

SEQ ID NO: 573083 - DNA, 25 bp, Mus musculus
gctggtactcaggaagttgtgccca

SEQ ID NO: 573084 - DNA, 25 bp, Mus musculus
gctggtactgaaatgcctggaacct

SEQ ID NO: 573085 - DNA, 25 bp, Mus musculus
gctggtactgaattgcctggaacct

SEQ ID NO: 573086 - DNA, 25 bp, Mus musculus
gctggtactgccaggagtctctgga

SEQ ID NO: 573087 - DNA, 25 bp, Mus musculus
gctggtactgcctggagtctctgga

SEQ ID NO: 573088 - DNA, 25 bp, Mus musculus
gctggtacttccagccagtggtgac

SEQ ID NO: 573089 - DNA, 25 bp, Mus musculus
gctggtacttcctgccagtggtgac

SEQ ID NO: 573090 - DNA, 25 bp, Mus musculus
gctggtacttgaactagtgttttaa

SEQ ID NO: 573091 - DNA, 25 bp, Mus musculus
gctggtacttgatctagtgttttaa

SEQ ID NO: 573092 - DNA, 25 bp, Mus musculus
gctggtagaaatctagaccttactg

SEQ ID NO: 573093 - DNA, 25 bp, Mus musculus
gctggtagaaatgtagaccttactg

SEQ ID NO: 573094 - DNA, 25 bp, Mus musculus
gctggtagacagacaggtacctcat

SEQ ID NO: 573095 - DNA, 25 bp, Mus musculus
gctggtagacagtcaggtacctcat

SEQ ID NO: 573096 - DNA, 25 bp, Mus musculus
gctggtagacgcacctactgataga

SEQ ID NO: 573097 - DNA, 25 bp, Mus musculus
gctggtagacgctcctactgataga

SEQ ID NO: 573098 - DNA, 25 bp, Mus musculus
gctggtagactaaacccggctgcgt

SEQ ID NO: 573099 - DNA, 25 bp, Mus musculus
gctggtagactatacccggctgcgt

SEQ ID NO: 573100 - DNA, 25 bp, Mus musculus
gctggtagatcaaatcgaagctctg

SEQ ID NO: 573101 - DNA, 25 bp, Mus musculus
gctggtagatcatatcgaagctctg

SEQ ID NO: 573102 - DNA, 25 bp, Mus musculus
gctggtagcataccaccgcaaattt

SEQ ID NO: 573103 - DNA, 25 bp, Mus musculus
gctggtagcatagcaccgcaaattt

SEQ ID NO: 573104 - DNA, 25 bp, Mus musculus
gctggtagctaccatgactgccaaa

SEQ ID NO: 573105 - DNA, 25 bp, Mus musculus
gctggtagctacgatgactgccaaa

SEQ ID NO: 573106 - DNA, 25 bp, Mus musculus
gctggtagctcaaacctattgattt

SEQ ID NO: 573107 - DNA, 25 bp, Mus musculus
gctggtagctcatacctattgattt

SEQ ID NO: 573108 - DNA, 25 bp, Mus musculus
gctggtagtaccactgttatgctcc

SEQ ID NO: 573109 - DNA, 25 bp, Mus musculus
gctggtagtacctctgttatgctcc

SEQ ID NO: 573110 - DNA, 25 bp, Mus musculus
gctggtatagctacgcccttggtca

SEQ ID NO: 573111 - DNA, 25 bp, Mus musculus
gctggtatagcttcgcccttggtca

SEQ ID NO: 573112 - DNA, 25 bp, Mus musculus
gctggtatgacaacacgtctgtctt

SEQ ID NO: 573113 - DNA, 25 bp, Mus musculus
gctggtatgacatcacgtctgtctt

SEQ ID NO: 573114 - DNA, 25 bp, Mus musculus
gctggtatggagaactttacacaga

SEQ ID NO: 573115 - DNA, 25 bp, Mus musculus
gctggtatggagtactttacacaga

SEQ ID NO: 573116 - DNA, 25 bp, Mus musculus
gctggtatgtgtagatttccttgta

SEQ ID NO: 573117 - DNA, 25 bp, Mus musculus
gctggtatgtgttgatttccttgta

SEQ ID NO: 573118 - DNA, 25 bp, Mus musculus
gctggtattcaaaccctgtaaaatg

SEQ ID NO: 573119 - DNA, 25 bp, Mus musculus
gctggtattcaaaccttgcattaac

SEQ ID NO: 573120 - DNA, 25 bp, Mus musculus
gctggtattcaatccctgtaaaatg

SEQ ID NO: 573121 - DNA, 25 bp, Mus musculus
gctggtattcaatccttgcattaac

SEQ ID NO: 573122 - DNA, 25 bp, Mus musculus
gctggtattcatacgagatgacaga

SEQ ID NO: 573123 - DNA, 25 bp, Mus musculus
gctggtattcattcgagatgacaga

SEQ ID NO: 573124 - DNA, 25 bp, Mus musculus
gctggtattctgaggatagtcttta

SEQ ID NO: 573125 - DNA, 25 bp, Mus musculus
gctggtattctgtggatagtcttta

SEQ ID NO: 573126 - DNA, 25 bp, Mus musculus
gctggtattggaatatgccctaaga

SEQ ID NO: 573127 - DNA, 25 bp, Mus musculus
gctggtattggattatgccctaaga

SEQ ID NO: 573128 - DNA, 25 bp, Mus musculus
gctggtatttccaagcacgctctca

SEQ ID NO: 573129 - DNA, 25 bp, Mus musculus
gctggtatttcctagcacgctctca

SEQ ID NO: 573130 - DNA, 25 bp, Mus musculus
gctggtatttgtcagattcttccat

SEQ ID NO: 573131 - DNA, 25 bp, Mus musculus
gctggtatttgtgagattcttccat

SEQ ID NO: 573132 - DNA, 25 bp, Mus musculus
gctggtcaaagtatctacctcctaa

SEQ ID NO: 573133 - DNA, 25 bp, Mus musculus
gctggtcaaagtttctacctcctaa

SEQ ID NO: 573134 - DNA, 25 bp, Mus musculus
gctggtcaaccaatttgctgtaatt

SEQ ID NO: 573135 - DNA, 25 bp, Mus musculus
gctggtcaaccattttgctgtaatt

SEQ ID NO: 573136 - DNA, 25 bp, Mus musculus
gctggtcaagacacctatctggaaa

SEQ ID NO: 573137 - DNA, 25 bp, Mus musculus
gctggtcaagactcctatctggaaa

SEQ ID NO: 573138 - DNA, 25 bp, Mus musculus
gctggtcacatcacttggcaaacgg

SEQ ID NO: 573139 - DNA, 25 bp, Mus musculus
gctggtcacatctcttggcaaacgg

SEQ ID NO: 573140 - DNA, 25 bp, Mus musculus
gctggtcaccaactgtggccgcctg

SEQ ID NO: 573141 - DNA, 25 bp, Mus musculus
gctggtcaccaagtgtggccgcctg

SEQ ID NO: 573142 - DNA, 25 bp, Mus musculus
gctggtcacccactctagtgtaatt

SEQ ID NO: 573143 - DNA, 25 bp, Mus musculus
gctggtcacccagtctagtgtaatt

SEQ ID NO: 573144 - DNA, 25 bp, Mus musculus
gctggtcacctgcactttttgacag

SEQ ID NO: 573145 - DNA, 25 bp, Mus musculus
gctggtcacctggactttttgacag

SEQ ID NO: 573146 - DNA, 25 bp, Mus musculus
gctggtcacgtcatggacaattcca

SEQ ID NO: 573147 - DNA, 25 bp, Mus musculus
gctggtcacgtcttggacaattcca

SEQ ID NO: 573148 - DNA, 25 bp, Mus musculus
gctggtcactgtcttagatattgcc

SEQ ID NO: 573149 - DNA, 25 bp, Mus musculus
gctggtcactgtgttagatattgcc

SEQ ID NO: 573150 - DNA, 25 bp, Mus musculus
gctggtcagagcctaacaatgcttt

SEQ ID NO: 573151 - DNA, 25 bp, Mus musculus
gctggtcagagcgtaacaatgcttt

SEQ ID NO: 573152 - DNA, 25 bp, Mus musculus
gctggtcagctgctagtagttttat

SEQ ID NO: 573153 - DNA, 25 bp, Mus musculus
gctggtcagctggtagtagttttat

SEQ ID NO: 573154 - DNA, 25 bp, Mus musculus
gctggtcatccgaaacacgtatgct

SEQ ID NO: 573155 - DNA, 25 bp, Mus musculus
gctggtcatccgtaacacgtatgct

SEQ ID NO: 573156 - DNA, 25 bp, Mus musculus
gctggtcatgaactcggatatactc

SEQ ID NO: 573157 - DNA, 25 bp, Mus musculus
gctggtcatgaagtcggatatactc

SEQ ID NO: 573158 - DNA, 25 bp, Mus musculus
gctggtcatgggagattcctgcatc

SEQ ID NO: 573159 - DNA, 25 bp, Mus musculus
gctggtcatgggtgattcctgcatc

SEQ ID NO: 573160 - DNA, 25 bp, Mus musculus
gctggtccaaccacatttcctggta

SEQ ID NO: 573161 - DNA, 25 bp, Mus musculus
gctggtccaacctcatttcctggta

SEQ ID NO: 573162 - DNA, 25 bp, Mus musculus
gctggtccactcatgttgaggacta

SEQ ID NO: 573163 - DNA, 25 bp, Mus musculus
gctggtccactcttgttgaggacta

SEQ ID NO: 573164 - DNA, 25 bp, Mus musculus
gctggtccacttacatgtcatgcgg

SEQ ID NO: 573165 - DNA, 25 bp, Mus musculus
gctggtccactttcatgtcatgcgg

SEQ ID NO: 573166 - DNA, 25 bp, Mus musculus
gctggtccagagattaagagcactg

SEQ ID NO: 573167 - DNA, 25 bp, Mus musculus
gctggtccagagtttaagagcactg

SEQ ID NO: 573168 - DNA, 25 bp, Mus musculus
gctggtccaggcagtgtgcattgca

SEQ ID NO: 573169 - DNA, 25 bp, Mus musculus
gctggtccaggcctatctcaagagg

SEQ ID NO: 573170 - DNA, 25 bp, Mus musculus
gctggtccaggcgtatctcaagagg

SEQ ID NO: 573171 - DNA, 25 bp, Mus musculus
gctggtccaggctgtgtgcattgca

SEQ ID NO: 573172 - DNA, 25 bp, Mus musculus
gctggtccattacccacgtacagta

SEQ ID NO: 573173 - DNA, 25 bp, Mus musculus
gctggtccattagccacgtacagta

SEQ ID NO: 573174 - DNA, 25 bp, Mus musculus
gctggtccccttaggcaggaatgaa

SEQ ID NO: 573175 - DNA, 25 bp, Mus musculus
gctggtcccctttggcaggaatgaa

SEQ ID NO: 573176 - DNA, 25 bp, Mus musculus
gctggtccgctgattatttcaaagt

SEQ ID NO: 573177 - DNA, 25 bp, Mus musculus
gctggtccgctgtttatttcaaagt

SEQ ID NO: 573178 - DNA, 25 bp, Mus musculus
gctggtccgtcgacgccatggtgaa

SEQ ID NO: 573179 - DNA, 25 bp, Mus musculus
gctggtccgtcgtcgccatggtgaa

SEQ ID NO: 573180 - DNA, 25 bp, Mus musculus
gctggtcctgaaagcctaggcgcaa

SEQ ID NO: 573181 - DNA, 25 bp, Mus musculus
gctggtcctgaatgcctaggcgcaa

SEQ ID NO: 573182 - DNA, 25 bp, Mus musculus
gctggtcctgtaatcaataagcatg

SEQ ID NO: 573183 - DNA, 25 bp, Mus musculus
gctggtcctgtattcaataagcatg

SEQ ID NO: 573184 - DNA, 25 bp, Mus musculus
gctggtcgaagaactagtctgtgct

SEQ ID NO: 573185 - DNA, 25 bp, Mus musculus
gctggtcgaagatctagtctgtgct

SEQ ID NO: 573186 - DNA, 25 bp, Mus musculus
gctggtcgctgcagtccgaggctca

SEQ ID NO: 573187 - DNA, 25 bp, Mus musculus
gctggtcgctgctgtccgaggctca

SEQ ID NO: 573188 - DNA, 25 bp, Mus musculus
gctggtcggactagtcgtgtatttt

SEQ ID NO: 573189 - DNA, 25 bp, Mus musculus
gctggtcggacttgtcgtgtatttt

SEQ ID NO: 573190 - DNA, 25 bp, Mus musculus
gctggtcgtctaaggctgtcagaac

SEQ ID NO: 573191 - DNA, 25 bp, Mus musculus
gctggtcgtctatggctgtcagaac

SEQ ID NO: 573192 - DNA, 25 bp, Mus musculus
gctggtctacagcacatgcacaata

SEQ ID NO: 573193 - DNA, 25 bp, Mus musculus
gctggtctacaggacatgcacaata

SEQ ID NO: 573194 - DNA, 25 bp, Mus musculus
gctggtctatggacctgaaggctca

SEQ ID NO: 573195 - DNA, 25 bp, Mus musculus
gctggtctatggtcctgaaggctca

SEQ ID NO: 573196 - DNA, 25 bp, Mus musculus
gctggtctcatgcactttaatttct

SEQ ID NO: 573197 - DNA, 25 bp, Mus musculus
gctggtctcatggactttaatttct

SEQ ID NO: 573198 - DNA, 25 bp, Mus musculus
gctggtctccagagtacgtggatga

SEQ ID NO: 573199 - DNA, 25 bp, Mus musculus
gctggtctccagtgtacgtggatga

SEQ ID NO: 573200 - DNA, 25 bp, Mus musculus
gctggtctcccactagaatttaaaa

SEQ ID NO: 573201 - DNA, 25 bp, Mus musculus
gctggtctcccagtagaatttaaaa

SEQ ID NO: 573202 - DNA, 25 bp, Mus musculus
gctggtctcgaacttgaagtcacag

SEQ ID NO: 573203 - DNA, 25 bp, Mus musculus
gctggtctcgaagttgaagtcacag

SEQ ID NO: 573204 - DNA, 25 bp, Mus musculus
gctggtctctgacccggtgactgtc

SEQ ID NO: 573205 - DNA, 25 bp, Mus musculus
gctggtctctgagccggtgactgtc

SEQ ID NO: 573206 - DNA, 25 bp, Mus musculus
gctggtctctggcattggcatgata

SEQ ID NO: 573207 - DNA, 25 bp, Mus musculus
gctggtctctgggattggcatgata

SEQ ID NO: 573208 - DNA, 25 bp, Mus musculus
gctggtctcttgcacatggagcctc

SEQ ID NO: 573209 - DNA, 25 bp, Mus musculus
gctggtctcttggacatggagcctc

SEQ ID NO: 573210 - DNA, 25 bp, Mus musculus
gctggtctgaccaaacagggagttt

SEQ ID NO: 573211 - DNA, 25 bp, Mus musculus
gctggtctgacctaacagggagttt

SEQ ID NO: 573212 - DNA, 25 bp, Mus musculus
gctggtctggacaggcatccttgaa

SEQ ID NO: 573213 - DNA, 25 bp, Mus musculus
gctggtctggactggcatccttgaa

SEQ ID NO: 573214 - DNA, 25 bp, Mus musculus
gctggtctggctctctagtgagcct

SEQ ID NO: 573215 - DNA, 25 bp, Mus musculus
gctggtctggctgtctagtgagcct

SEQ ID NO: 573216 - DNA, 25 bp, Mus musculus
gctggtcttcacagacgtccaacgt

SEQ ID NO: 573217 - DNA, 25 bp, Mus musculus
gctggtcttcactgacgtccaacgt

SEQ ID NO: 573218 - DNA, 25 bp, Mus musculus
gctggtcttgatattaagctgctta

SEQ ID NO: 573219 - DNA, 25 bp, Mus musculus
gctggtcttgattttaagctgctta

SEQ ID NO: 573220 - DNA, 25 bp, Mus musculus
gctggtcttggcaggttttgcttgt

SEQ ID NO: 573221 - DNA, 25 bp, Mus musculus
gctggtcttggctggttttgcttgt

SEQ ID NO: 573222 - DNA, 25 bp, Mus musculus
gctggtcttgtcagggctctttcat

SEQ ID NO: 573223 - DNA, 25 bp, Mus musculus
gctggtcttgtctgggctctttcat

SEQ ID NO: 573224 - DNA, 25 bp, Mus musculus
gctggtgaaattatgctcactgttg

SEQ ID NO: 573225 - DNA, 25 bp, Mus musculus
gctggtgaaattttgctcactgttg

SEQ ID NO: 573226 - DNA, 25 bp, Mus musculus
gctggtgaacgactgcttagccgaa

SEQ ID NO: 573227 - DNA, 25 bp, Mus musculus
gctggtgaacgagtgcttagccgaa

SEQ ID NO: 573228 - DNA, 25 bp, Mus musculus
gctggtgaactgatccaagatgatt

SEQ ID NO: 573229 - DNA, 25 bp, Mus musculus
gctggtgaactgttccaagatgatt

SEQ ID NO: 573230 - DNA, 25 bp, Mus musculus
gctggtgaagtgatgccaggccttt

SEQ ID NO: 573231 - DNA, 25 bp, Mus musculus
gctggtgaagtgttgccaggccttt

SEQ ID NO: 573232 - DNA, 25 bp, Mus musculus
gctggtgacaccacgatgagctgtg

SEQ ID NO: 573233 - DNA, 25 bp, Mus musculus
gctggtgacacctcgatgagctgtg

SEQ ID NO: 573234 - DNA, 25 bp, Mus musculus
gctggtgacagaccatctgattcat

SEQ ID NO: 573235 - DNA, 25 bp, Mus musculus
gctggtgacagagcatctgattcat

SEQ ID NO: 573236 - DNA, 25 bp, Mus musculus
gctggtgacattagcttggattgaa

SEQ ID NO: 573237 - DNA, 25 bp, Mus musculus
gctggtgacatttgcttggattgaa

SEQ ID NO: 573238 - DNA, 25 bp, Mus musculus
gctggtgacccaaatttggatgata

SEQ ID NO: 573239 - DNA, 25 bp, Mus musculus
gctggtgacccatatttggatgata

SEQ ID NO: 573240 - DNA, 25 bp, Mus musculus
gctggtgacctgatacttctcataa

SEQ ID NO: 573241 - DNA, 25 bp, Mus musculus
gctggtgacctgttacttctcataa

SEQ ID NO: 573242 - DNA, 25 bp, Mus musculus
gctggtgaccttcgcgagtcaccaa

SEQ ID NO: 573243 - DNA, 25 bp, Mus musculus
gctggtgaccttggcgagtcaccaa

SEQ ID NO: 573244 - DNA, 25 bp, Mus musculus
gctggtgacttaaggcagtgacccc

SEQ ID NO: 573245 - DNA, 25 bp, Mus musculus
gctggtgacttatggcagtgacccc

SEQ ID NO: 573246 - DNA, 25 bp, Mus musculus
gctggtgatgggaccaccgagatct

SEQ ID NO: 573247 - DNA, 25 bp, Mus musculus
gctggtgatgggtccaccgagatct

SEQ ID NO: 573248 - DNA, 25 bp, Mus musculus
gctggtgcatggagcgtgggtgccc

SEQ ID NO: 573249 - DNA, 25 bp, Mus musculus
gctggtgcatggtgcgtgggtgccc

SEQ ID NO: 573250 - DNA, 25 bp, Mus musculus
gctggtgcatgtactaccacatgta

SEQ ID NO: 573251 - DNA, 25 bp, Mus musculus
gctggtgcatgttctaccacatgta

SEQ ID NO: 573252 - DNA, 25 bp, Mus musculus
gctggtgccgtgacagctgcgacct

SEQ ID NO: 573253 - DNA, 25 bp, Mus musculus
gctggtgccgtgtcagctgcgacct

SEQ ID NO: 573254 - DNA, 25 bp, Mus musculus
gctggtgcctacatttcttgtttaa

SEQ ID NO: 573255 - DNA, 25 bp, Mus musculus
gctggtgcctaccaaaacgtttttg

SEQ ID NO: 573256 - DNA, 25 bp, Mus musculus
gctggtgcctacgaaaacgtttttg

SEQ ID NO: 573257 - DNA, 25 bp, Mus musculus
gctggtgcctacttttcttgtttaa

SEQ ID NO: 573258 - DNA, 25 bp, Mus musculus
gctggtgcgcagctacaagaaactc

SEQ ID NO: 573259 - DNA, 25 bp, Mus musculus
gctggtgcgcaggtacaagaaactc

SEQ ID NO: 573260 - DNA, 25 bp, Mus musculus
gctggtgcggttatgctttattaaa

SEQ ID NO: 573261 - DNA, 25 bp, Mus musculus
gctggtgcggttttgctttattaaa

SEQ ID NO: 573262 - DNA, 25 bp, Mus musculus
gctggtgctcagcatcgaatcggct

SEQ ID NO: 573263 - DNA, 25 bp, Mus musculus
gctggtgctcaggatcgaatcggct

SEQ ID NO: 573264 - DNA, 25 bp, Mus musculus
gctggtgctggaaatccgctttcac

SEQ ID NO: 573265 - DNA, 25 bp, Mus musculus
gctggtgctggatatccgctttcac

SEQ ID NO: 573266 - DNA, 25 bp, Mus musculus
gctggtgctgggactcattgagctc

SEQ ID NO: 573267 - DNA, 25 bp, Mus musculus
gctggtgctgggtctcattgagctc

SEQ ID NO: 573268 - DNA, 25 bp, Mus musculus
gctggtggaacgctaataaatactt

SEQ ID NO: 573269 - DNA, 25 bp, Mus musculus
gctggtggaacggtaataaatactt

SEQ ID NO: 573270 - DNA, 25 bp, Mus musculus
gctggtggaagcaactgattttcta

SEQ ID NO: 573271 - DNA, 25 bp, Mus musculus
gctggtggaagctactgattttcta

SEQ ID NO: 573272 - DNA, 25 bp, Mus musculus
gctggtggacacagaaactcttgga

SEQ ID NO: 573273 - DNA, 25 bp, Mus musculus
gctggtggacacaggcggttcttcc

SEQ ID NO: 573274 - DNA, 25 bp, Mus musculus
gctggtggacactgaaactcttgga

SEQ ID NO: 573275 - DNA, 25 bp, Mus musculus
gctggtggacactggcggttcttcc

SEQ ID NO: 573276 - DNA, 25 bp, Mus musculus
gctggtggacctagcttttcagatg

SEQ ID NO: 573277 - DNA, 25 bp, Mus musculus
gctggtggaccttgcttttcagatg

SEQ ID NO: 573278 - DNA, 25 bp, Mus musculus
gctggtggaggcattatttctgtat

SEQ ID NO: 573279 - DNA, 25 bp, Mus musculus
gctggtggaggctttatttctgtat

SEQ ID NO: 573280 - DNA, 25 bp, Mus musculus
gctggtggccctagagaacaagttt

SEQ ID NO: 573281 - DNA, 25 bp, Mus musculus
gctggtggcccttgagaacaagttt

SEQ ID NO: 573282 - DNA, 25 bp, Mus musculus
gctggtggcctcagggaccctcaca

SEQ ID NO: 573283 - DNA, 25 bp, Mus musculus
gctggtggcctctgggaccctcaca

SEQ ID NO: 573284 - DNA, 25 bp, Mus musculus
gctggtgggagaactaacgctctaa

SEQ ID NO: 573285 - DNA, 25 bp, Mus musculus
gctggtgggagatctaacgctctaa

SEQ ID NO: 573286 - DNA, 25 bp, Mus musculus
gctggtgggccaccctgagcacaaa

SEQ ID NO: 573287 - DNA, 25 bp, Mus musculus
gctggtgggccagcctgagcacaaa

SEQ ID NO: 573288 - DNA, 25 bp, Mus musculus
gctggtgggtataacttcatggatt

SEQ ID NO: 573289 - DNA, 25 bp, Mus musculus
gctggtgggtattacttcatggatt

SEQ ID NO: 573290 - DNA, 25 bp, Mus musculus
gctggtgggtctctattatgagttc

SEQ ID NO: 573291 - DNA, 25 bp, Mus musculus
gctggtgggtctgtattatgagttc

SEQ ID NO: 573292 - DNA, 25 bp, Mus musculus
gctggtggtacgagaactcttctcc

SEQ ID NO: 573293 - DNA, 25 bp, Mus musculus
gctggtggtacgtgaactcttctcc

SEQ ID NO: 573294 - DNA, 25 bp, Mus musculus
gctggtggtcagatacaccccaaaa

SEQ ID NO: 573295 - DNA, 25 bp, Mus musculus
gctggtggtcagctctgtcatcaga

SEQ ID NO: 573296 - DNA, 25 bp, Mus musculus
gctggtggtcaggtctgtcatcaga

SEQ ID NO: 573297 - DNA, 25 bp, Mus musculus
gctggtggtcagttacaccccaaaa

SEQ ID NO: 573298 - DNA, 25 bp, Mus musculus
gctggtggtcctccgcagtgaaaat

SEQ ID NO: 573299 - DNA, 25 bp, Mus musculus
gctggtggtcctgcgcagtgaaaat

SEQ ID NO: 573300 - DNA, 25 bp, Mus musculus
gctggtggtcttctgttctataacc

SEQ ID NO: 573301 - DNA, 25 bp, Mus musculus
gctggtggtcttgtgttctataacc

SEQ ID NO: 573302 - DNA, 25 bp, Mus musculus
gctggtggttacctcaaggtctaca

SEQ ID NO: 573303 - DNA, 25 bp, Mus musculus
gctggtggttacgtcaaggtctaca

SEQ ID NO: 573304 - DNA, 25 bp, Mus musculus
gctggtgtacgtaaaaggcatttct

SEQ ID NO: 573305 - DNA, 25 bp, Mus musculus
gctggtgtacgttaaaggcatttct

SEQ ID NO: 573306 - DNA, 25 bp, Mus musculus
gctggtgtactgagtcaagcattac

SEQ ID NO: 573307 - DNA, 25 bp, Mus musculus
gctggtgtactgtgtcaagcattac

SEQ ID NO: 573308 - DNA, 25 bp, Mus musculus
gctggtgtagtcattttataggttt

SEQ ID NO: 573309 - DNA, 25 bp, Mus musculus
gctggtgtagtctttttataggttt

SEQ ID NO: 573310 - DNA, 25 bp, Mus musculus
gctggtgtccagagactcaattgct

SEQ ID NO: 573311 - DNA, 25 bp, Mus musculus
gctggtgtccagtgactcaattgct

SEQ ID NO: 573312 - DNA, 25 bp, Mus musculus
gctggtgtcctgacaagagagtctc

SEQ ID NO: 573313 - DNA, 25 bp, Mus musculus
gctggtgtcctgtcaagagagtctc

SEQ ID NO: 573314 - DNA, 25 bp, Mus musculus
gctggtgtcgtcaactggctgtaca

SEQ ID NO: 573315 - DNA, 25 bp, Mus musculus
gctggtgtcgtctactggctgtaca

SEQ ID NO: 573316 - DNA, 25 bp, Mus musculus
gctggtgtgaccctgatggtccaca

SEQ ID NO: 573317 - DNA, 25 bp, Mus musculus
gctggtgtgaccgtgatggtccaca

SEQ ID NO: 573318 - DNA, 25 bp, Mus musculus
gctggtgtgatcatcacccggtgta

SEQ ID NO: 573319 - DNA, 25 bp, Mus musculus
gctggtgtgatcttcacccggtgta

SEQ ID NO: 573320 - DNA, 25 bp, Mus musculus
gctggtgtgcatcgacttcagttca

SEQ ID NO: 573321 - DNA, 25 bp, Mus musculus
gctggtgtgcatggacttcagttca

SEQ ID NO: 573322 - DNA, 25 bp, Mus musculus
gctggtgtggtcaatacggtcttca

SEQ ID NO: 573323 - DNA, 25 bp, Mus musculus
gctggtgtggtctatacggtcttca

SEQ ID NO: 573324 - DNA, 25 bp, Mus musculus
gctggtgtgtacatggtataggaac

SEQ ID NO: 573325 - DNA, 25 bp, Mus musculus
gctggtgtgtacttggtataggaac

SEQ ID NO: 573326 - DNA, 25 bp, Mus musculus
gctggtgttacaactcctcaaaagt

SEQ ID NO: 573327 - DNA, 25 bp, Mus musculus
gctggtgttacatctcctcaaaagt

SEQ ID NO: 573328 - DNA, 25 bp, Mus musculus
gctggtgttagaagatgttccgttt

SEQ ID NO: 573329 - DNA, 25 bp, Mus musculus
gctggtgttagatgatgttccgttt

SEQ ID NO: 573330 - DNA, 25 bp, Mus musculus
gctggtgttatgcatctgttctacg

SEQ ID NO: 573331 - DNA, 25 bp, Mus musculus
gctggtgttatggatctgttctacg

SEQ ID NO: 573332 - DNA, 25 bp, Mus musculus
gctggtgttcatatgtgccgtggaa

SEQ ID NO: 573333 - DNA, 25 bp, Mus musculus
gctggtgttcatttgtgccgtggaa

SEQ ID NO: 573334 - DNA, 25 bp, Mus musculus
gctggtgttgctcatgttacaatcc

SEQ ID NO: 573335 - DNA, 25 bp, Mus musculus
gctggtgttgctgatgttacaatcc

SEQ ID NO: 573336 - DNA, 25 bp, Mus musculus
gctggtgtttacagactggaccctg

SEQ ID NO: 573337 - DNA, 25 bp, Mus musculus
gctggtgtttactgactggaccctg

SEQ ID NO: 573338 - DNA, 25 bp, Mus musculus
gctggtgtttctcctcactgtgaag

SEQ ID NO: 573339 - DNA, 25 bp, Mus musculus
gctggtgtttctgctcactgtgaag

SEQ ID NO: 573340 - DNA, 25 bp, Mus musculus
gctggttaactgagtcctttcttct

SEQ ID NO: 573341 - DNA, 25 bp, Mus musculus
gctggttaactgtgtcctttcttct

SEQ ID NO: 573342 - DNA, 25 bp, Mus musculus
gctggttaaggcaagaaatacatac

SEQ ID NO: 573343 - DNA, 25 bp, Mus musculus
gctggttaaggctagaaatacatac

SEQ ID NO: 573344 - DNA, 25 bp, Mus musculus
gctggttaatagagcaacttctgta

SEQ ID NO: 573345 - DNA, 25 bp, Mus musculus
gctggttaatagtgcaacttctgta

SEQ ID NO: 573346 - DNA, 25 bp, Mus musculus
gctggttacagtattcactggagaa

SEQ ID NO: 573347 - DNA, 25 bp, Mus musculus
gctggttacagttttcactggagaa

SEQ ID NO: 573348 - DNA, 25 bp, Mus musculus
gctggttatactcatgggctttcat

SEQ ID NO: 573349 - DNA, 25 bp, Mus musculus
gctggttatactgatgggctttcat

SEQ ID NO: 573350 - DNA, 25 bp, Mus musculus
gctggttatatcactgtttgtactt

SEQ ID NO: 573351 - DNA, 25 bp, Mus musculus
gctggttatatctctgtttgtactt

SEQ ID NO: 573352 - DNA, 25 bp, Mus musculus
gctggttcatctccctgtttgtgga

SEQ ID NO: 573353 - DNA, 25 bp, Mus musculus
gctggttcatctgcctgtttgtgga

SEQ ID NO: 573354 - DNA, 25 bp, Mus musculus
gctggttccagccactgaggagcat

SEQ ID NO: 573355 - DNA, 25 bp, Mus musculus
gctggttccagcgactgaggagcat

SEQ ID NO: 573356 - DNA, 25 bp, Mus musculus
gctggttccataccagaagcactga

SEQ ID NO: 573357 - DNA, 25 bp, Mus musculus
gctggttccatagcagaagcactga

SEQ ID NO: 573358 - DNA, 25 bp, Mus musculus
gctggttccatgcaattttttctct

SEQ ID NO: 573359 - DNA, 25 bp, Mus musculus
gctggttccatggaattttttctct

SEQ ID NO: 573360 - DNA, 25 bp, Mus musculus
gctggttccctgctgtttcactgag

SEQ ID NO: 573361 - DNA, 25 bp, Mus musculus
gctggttccctggtgtttcactgag

SEQ ID NO: 573362 - DNA, 25 bp, Mus musculus
gctggttccgagatccctgctgcta

SEQ ID NO: 573363 - DNA, 25 bp, Mus musculus
gctggttccgagttccctgctgcta

SEQ ID NO: 573364 - DNA, 25 bp, Mus musculus
gctggttcgctacccgggaatttgc

SEQ ID NO: 573365 - DNA, 25 bp, Mus musculus
gctggttcgctagccgggaatttgc

SEQ ID NO: 573366 - DNA, 25 bp, Mus musculus
gctggttcggttatcttgtgcatta

SEQ ID NO: 573367 - DNA, 25 bp, Mus musculus
gctggttcggttttcttgtgcatta

SEQ ID NO: 573368 - DNA, 25 bp, Mus musculus
gctggttctctgagccctgtgtcgg

SEQ ID NO: 573369 - DNA, 25 bp, Mus musculus
gctggttctctgtgccctgtgtcgg

SEQ ID NO: 573370 - DNA, 25 bp, Mus musculus
gctggttctgctagcaacaacagga

SEQ ID NO: 573371 - DNA, 25 bp, Mus musculus
gctggttctgctattacggttttca

SEQ ID NO: 573372 - DNA, 25 bp, Mus musculus
gctggttctgcttgcaacaacagga

SEQ ID NO: 573373 - DNA, 25 bp, Mus musculus
gctggttctgcttttacggttttca

SEQ ID NO: 573374 - DNA, 25 bp, Mus musculus
gctggttcttggctattgtaatgtc

SEQ ID NO: 573375 - DNA, 25 bp, Mus musculus
gctggttcttgggtattgtaatgtc

SEQ ID NO: 573376 - DNA, 25 bp, Mus musculus
gctggttctttgcagcatgtttaca

SEQ ID NO: 573377 - DNA, 25 bp, Mus musculus
gctggttctttggagcatgtttaca

SEQ ID NO: 573378 - DNA, 25 bp, Mus musculus
gctggttgacctcattaatgttcga

SEQ ID NO: 573379 - DNA, 25 bp, Mus musculus
gctggttgacctgattaatgttcga

SEQ ID NO: 573380 - DNA, 25 bp, Mus musculus
gctggttgatttaacctgttgccaa

SEQ ID NO: 573381 - DNA, 25 bp, Mus musculus
gctggttgattttacctgttgccaa

SEQ ID NO: 573382 - DNA, 25 bp, Mus musculus
gctggttgcaacaattaagctggtt

SEQ ID NO: 573383 - DNA, 25 bp, Mus musculus
gctggttgcaactattaagctggtt

SEQ ID NO: 573384 - DNA, 25 bp, Mus musculus
gctggttgcagaaatatcctccgtc

SEQ ID NO: 573385 - DNA, 25 bp, Mus musculus
gctggttgcagaccacactttgaga

SEQ ID NO: 573386 - DNA, 25 bp, Mus musculus
gctggttgcagagcacactttgaga

SEQ ID NO: 573387 - DNA, 25 bp, Mus musculus
gctggttgcagatatatcctccgtc

SEQ ID NO: 573388 - DNA, 25 bp, Mus musculus
gctggttgccaaagcccaaacagaa

SEQ ID NO: 573389 - DNA, 25 bp, Mus musculus
gctggttgccaatgcccaaacagaa

SEQ ID NO: 573390 - DNA, 25 bp, Mus musculus
gctggttgccttactttgtagtatc

SEQ ID NO: 573391 - DNA, 25 bp, Mus musculus
gctggttgcctttctttgtagtatc

SEQ ID NO: 573392 - DNA, 25 bp, Mus musculus
gctggttggaaacagagcctacaga

SEQ ID NO: 573393 - DNA, 25 bp, Mus musculus
gctggttggaaagagagcctacaga

SEQ ID NO: 573394 - DNA, 25 bp, Mus musculus
gctggttggcacagatcttaaacgt

SEQ ID NO: 573395 - DNA, 25 bp, Mus musculus
gctggttggcactgatcttaaacgt

SEQ ID NO: 573396 - DNA, 25 bp, Mus musculus
gctggttggccgagcaagctaagct

SEQ ID NO: 573397 - DNA, 25 bp, Mus musculus
gctggttggccgtgcaagctaagct

SEQ ID NO: 573398 - DNA, 25 bp, Mus musculus
gctggttggtggaagaactctgccc

SEQ ID NO: 573399 - DNA, 25 bp, Mus musculus
gctggttggtggtagaactctgccc

SEQ ID NO: 573400 - DNA, 25 bp, Mus musculus
gctggttgtcagatatgtatgtatg

SEQ ID NO: 573401 - DNA, 25 bp, Mus musculus
gctggttgtcagttatgtatgtatg

SEQ ID NO: 573402 - DNA, 25 bp, Mus musculus
gctggttgtgctcatgatgacagaa

SEQ ID NO: 573403 - DNA, 25 bp, Mus musculus
gctggttgtgctgatgatgacagaa

SEQ ID NO: 573404 - DNA, 25 bp, Mus musculus
gctggttgtttactatcatggcatt

SEQ ID NO: 573405 - DNA, 25 bp, Mus musculus
gctggttgtttagtatcatggcatt

SEQ ID NO: 573406 - DNA, 25 bp, Mus musculus
gctggtttaagcaacttggtctctt

SEQ ID NO: 573407 - DNA, 25 bp, Mus musculus
gctggtttaagctacttggtctctt

SEQ ID NO: 573408 - DNA, 25 bp, Mus musculus
gctggtttactgcagcagatgctct

SEQ ID NO: 573409 - DNA, 25 bp, Mus musculus
gctggtttactggagcagatgctct

SEQ ID NO: 573410 - DNA, 25 bp, Mus musculus
gctggtttatcaagagcagtcctaa

SEQ ID NO: 573411 - DNA, 25 bp, Mus musculus
gctggtttatcatgagcagtcctaa

SEQ ID NO: 573412 - DNA, 25 bp, Mus musculus
gctggtttcactactgaggcaagaa

SEQ ID NO: 573413 - DNA, 25 bp, Mus musculus
gctggtttcacttctgaggcaagaa

SEQ ID NO: 573414 - DNA, 25 bp, Mus musculus
gctggtttcagacgacaatgccctt

SEQ ID NO: 573415 - DNA, 25 bp, Mus musculus
gctggtttcagaggacaatgccctt

SEQ ID NO: 573416 - DNA, 25 bp, Mus musculus
gctggtttcaggcacatccttctgc

SEQ ID NO: 573417 - DNA, 25 bp, Mus musculus
gctggtttcagggacatccttctgc

SEQ ID NO: 573418 - DNA, 25 bp, Mus musculus
gctggtttcatgctaggtgctcata

SEQ ID NO: 573419 - DNA, 25 bp, Mus musculus
gctggtttcatggtaggtgctcata

SEQ ID NO: 573420 - DNA, 25 bp, Mus musculus
gctggtttccagcactattttgtgt

SEQ ID NO: 573421 - DNA, 25 bp, Mus musculus
gctggtttccaggactattttgtgt

SEQ ID NO: 573422 - DNA, 25 bp, Mus musculus
gctggtttcccacggctaggacaaa

SEQ ID NO: 573423 - DNA, 25 bp, Mus musculus
gctggtttcccagggctaggacaaa

SEQ ID NO: 573424 - DNA, 25 bp, Mus musculus
gctggtttgcagaagaagtcccttg

SEQ ID NO: 573425 - DNA, 25 bp, Mus musculus
gctggtttgcagtagaagtcccttg

SEQ ID NO: 573426 - DNA, 25 bp, Mus musculus
gctggtttgccaactgacaaaaaga

SEQ ID NO: 573427 - DNA, 25 bp, Mus musculus
gctggtttgccatctgacaaaaaga

SEQ ID NO: 573428 - DNA, 25 bp, Mus musculus
gctggtttgctaaggaagtgcttac

SEQ ID NO: 573429 - DNA, 25 bp, Mus musculus
gctggtttgctatggaagtgcttac

SEQ ID NO: 573430 - DNA, 25 bp, Mus musculus
gctggtttgctgaacttctgtaatc

SEQ ID NO: 573431 - DNA, 25 bp, Mus musculus
gctggtttgctgtacttctgtaatc

SEQ ID NO: 573432 - DNA, 25 bp, Mus musculus
gctggtttggaaactacacctgcac

SEQ ID NO: 573433 - DNA, 25 bp, Mus musculus
gctggtttggaatctacacctgcac

SEQ ID NO: 573434 - DNA, 25 bp, Mus musculus
gctggttttaacctgcgcaaagtta

SEQ ID NO: 573435 - DNA, 25 bp, Mus musculus
gctggttttaacgtgcgcaaagtta

SEQ ID NO: 573436 - DNA, 25 bp, Mus musculus
gctggttttagaaacctgagggcca

SEQ ID NO: 573437 - DNA, 25 bp, Mus musculus
gctggttttagatacctgagggcca

SEQ ID NO: 573438 - DNA, 25 bp, Mus musculus
gctggttttattaactctactttct

SEQ ID NO: 573439 - DNA, 25 bp, Mus musculus
gctggttttatttactctactttct

SEQ ID NO: 573440 - DNA, 25 bp, Mus musculus
gctggttttcaactttggccgtacg

SEQ ID NO: 573441 - DNA, 25 bp, Mus musculus
gctggttttcaagtttggccgtacg

SEQ ID NO: 573442 - DNA, 25 bp, Mus musculus
gctggttttcctcggatggctggag

SEQ ID NO: 573443 - DNA, 25 bp, Mus musculus
gctggttttcctgggatggctggag

SEQ ID NO: 573444 - DNA, 25 bp, Mus musculus
gctggttttctaagatacgggatac

SEQ ID NO: 573445 - DNA, 25 bp, Mus musculus
gctggttttctatgatacgggatac

SEQ ID NO: 573446 - DNA, 25 bp, Mus musculus
gctggttttctcacacaggactttg

SEQ ID NO: 573447 - DNA, 25 bp, Mus musculus
gctggttttctctcacaggactttg

SEQ ID NO: 573448 - DNA, 25 bp, Mus musculus
gctggttttctgctctacagacgga

SEQ ID NO: 573449 - DNA, 25 bp, Mus musculus
gctggttttctgctgctaggacaac

SEQ ID NO: 573450 - DNA, 25 bp, Mus musculus
gctggttttctggtctacagacgga

SEQ ID NO: 573451 - DNA, 25 bp, Mus musculus
gctggttttctggtgctaggacaac

SEQ ID NO: 573452 - DNA, 25 bp, Mus musculus
gctgtaaaacaaataactagaggtc

SEQ ID NO: 573453 - DNA, 25 bp, Mus musculus
gctgtaaaacaattaactagaggtc

SEQ ID NO: 573454 - DNA, 25 bp, Mus musculus
gctgtaaacacacgctgatgattgt

SEQ ID NO: 573455 - DNA, 25 bp, Mus musculus
gctgtaaacacaggctgatgattgt

SEQ ID NO: 573456 - DNA, 25 bp, Mus musculus
gctgtaaactctctttgtgttctgt

SEQ ID NO: 573457 - DNA, 25 bp, Mus musculus
gctgtaaactctgtttgtgttctgt

SEQ ID NO: 573458 - DNA, 25 bp, Mus musculus
gctgtaaagcagctggtgcctccag

SEQ ID NO: 573459 - DNA, 25 bp, Mus musculus
gctgtaaagcaggtggtgcctccag

SEQ ID NO: 573460 - DNA, 25 bp, Mus musculus
gctgtaaatataactctgccatttt

SEQ ID NO: 573461 - DNA, 25 bp, Mus musculus
gctgtaaatatatctctgccatttt

SEQ ID NO: 573462 - DNA, 25 bp, Mus musculus
gctgtaaatcacctaccctgttaaa

SEQ ID NO: 573463 - DNA, 25 bp, Mus musculus
gctgtaaatcacgtaccctgttaaa

SEQ ID NO: 573464 - DNA, 25 bp, Mus musculus
gctgtaaattatatgaggacatcca

SEQ ID NO: 573465 - DNA, 25 bp, Mus musculus
gctgtaaattatttgaggacatcca

SEQ ID NO: 573466 - DNA, 25 bp, Mus musculus
gctgtaacaactctccaggtgtgac

SEQ ID NO: 573467 - DNA, 25 bp, Mus musculus
gctgtaacaactgtccaggtgtgac

SEQ ID NO: 573468 - DNA, 25 bp, Mus musculus
gctgtaacaagaattgcaatgcaaa

SEQ ID NO: 573469 - DNA, 25 bp, Mus musculus
gctgtaacaagatttgcaatgcaaa

SEQ ID NO: 573470 - DNA, 25 bp, Mus musculus
gctgtaacacccatcctaaactgaa

SEQ ID NO: 573471 - DNA, 25 bp, Mus musculus
gctgtaacacccttcctaaactgaa

SEQ ID NO: 573472 - DNA, 25 bp, Mus musculus
gctgtaacactcagaatgtacccaa

SEQ ID NO: 573473 - DNA, 25 bp, Mus musculus
gctgtaacactctgaatgtacccaa

SEQ ID NO: 573474 - DNA, 25 bp, Mus musculus
gctgtaacatggctcgacctgaaat

SEQ ID NO: 573475 - DNA, 25 bp, Mus musculus
gctgtaacatgggtcgacctgaaat

SEQ ID NO: 573476 - DNA, 25 bp, Mus musculus
gctgtaaccaagaaaacccacactt

SEQ ID NO: 573477 - DNA, 25 bp, Mus musculus
gctgtaaccaagtaaacccacactt

SEQ ID NO: 573478 - DNA, 25 bp, Mus musculus
gctgtaaccctcatacatggagact

SEQ ID NO: 573479 - DNA, 25 bp, Mus musculus
gctgtaaccctccactgagtgaaga

SEQ ID NO: 573480 - DNA, 25 bp, Mus musculus
gctgtaaccctcgactgagtgaaga

SEQ ID NO: 573481 - DNA, 25 bp, Mus musculus
gctgtaaccctcttacatggagact

SEQ ID NO: 573482 - DNA, 25 bp, Mus musculus
gctgtaaccggacctggccccgtag

SEQ ID NO: 573483 - DNA, 25 bp, Mus musculus
gctgtaaccggagctggccccgtag

SEQ ID NO: 573484 - DNA, 25 bp, Mus musculus
gctgtaaccttgaagcccagcagtc

SEQ ID NO: 573485 - DNA, 25 bp, Mus musculus
gctgtaaccttgtagcccagcagtc

SEQ ID NO: 573486 - DNA, 25 bp, Mus musculus
gctgtaactaccagtaacctactgg

SEQ ID NO: 573487 - DNA, 25 bp, Mus musculus
gctgtaactacctgtaacctactgg

SEQ ID NO: 573488 - DNA, 25 bp, Mus musculus
gctgtaactcatcagtggaatcact

SEQ ID NO: 573489 - DNA, 25 bp, Mus musculus
gctgtaactcatgagtggaatcact

SEQ ID NO: 573490 - DNA, 25 bp, Mus musculus
gctgtaactctactttcagagggtc

SEQ ID NO: 573491 - DNA, 25 bp, Mus musculus
gctgtaactctagtttcagagggtc

SEQ ID NO: 573492 - DNA, 25 bp, Mus musculus
gctgtaactgcaatgcacagggtgt

SEQ ID NO: 573493 - DNA, 25 bp, Mus musculus
gctgtaactgcattgcacagggtgt

SEQ ID NO: 573494 - DNA, 25 bp, Mus musculus
gctgtaacttctactcaagtgccaa

SEQ ID NO: 573495 - DNA, 25 bp, Mus musculus
gctgtaacttcttctcaagtgccaa

SEQ ID NO: 573496 - DNA, 25 bp, Mus musculus
gctgtaacttgtaaagtcgggcttc

SEQ ID NO: 573497 - DNA, 25 bp, Mus musculus
gctgtaacttgttaagtcgggcttc

SEQ ID NO: 573498 - DNA, 25 bp, Mus musculus
gctgtaagacatccatccctcaaaa

SEQ ID NO: 573499 - DNA, 25 bp, Mus musculus
gctgtaagacatgcatccctcaaaa

SEQ ID NO: 573500 - DNA, 25 bp, Mus musculus
gctgtaagattgctccagatgcctt

SEQ ID NO: 573501 - DNA, 25 bp, Mus musculus
gctgtaagattggtccagatgcctt

SEQ ID NO: 573502 - DNA, 25 bp, Mus musculus
gctgtaagcatgagtggccttctct

SEQ ID NO: 573503 - DNA, 25 bp, Mus musculus
gctgtaagcatgtgtggccttctct

SEQ ID NO: 573504 - DNA, 25 bp, Mus musculus
gctgtaagggcacgcagactcacct

SEQ ID NO: 573505 - DNA, 25 bp, Mus musculus
gctgtaagggcaggcagactcacct

SEQ ID NO: 573506 - DNA, 25 bp, Mus musculus
gctgtaaggtcccactttctgtttt

SEQ ID NO: 573507 - DNA, 25 bp, Mus musculus
gctgtaaggtccgactttctgtttt

SEQ ID NO: 573508 - DNA, 25 bp, Mus musculus
gctgtaatcatcactactttccatg

SEQ ID NO: 573509 - DNA, 25 bp, Mus musculus
gctgtaatcatctctactttccatg

SEQ ID NO: 573510 - DNA, 25 bp, Mus musculus
gctgtaatcctgaggaaccatcttt

SEQ ID NO: 573511 - DNA, 25 bp, Mus musculus
gctgtaatcctgtggaaccatcttt

SEQ ID NO: 573512 - DNA, 25 bp, Mus musculus
gctgtaatctacatagtccttgttt

SEQ ID NO: 573513 - DNA, 25 bp, Mus musculus
gctgtaatctacttagtccttgttt

SEQ ID NO: 573514 - DNA, 25 bp, Mus musculus
gctgtaatctggacaaacccacatt

SEQ ID NO: 573515 - DNA, 25 bp, Mus musculus
gctgtaatctggtcaaacccacatt

SEQ ID NO: 573516 - DNA, 25 bp, Mus musculus
gctgtaatgaccagcccaacaatct

SEQ ID NO: 573517 - DNA, 25 bp, Mus musculus
gctgtaatgacctgcccaacaatct

SEQ ID NO: 573518 - DNA, 25 bp, Mus musculus
gctgtaatgttcacaaaatattctt

SEQ ID NO: 573519 - DNA, 25 bp, Mus musculus
gctgtaatgttctcaaaatattctt

SEQ ID NO: 573520 - DNA, 25 bp, Mus musculus
gctgtaattcaaaaccatttccata

SEQ ID NO: 573521 - DNA, 25 bp, Mus musculus
gctgtaattcaataccatttccata

SEQ ID NO: 573522 - DNA, 25 bp, Mus musculus
gctgtacaagatattgatcaggcat

SEQ ID NO: 573523 - DNA, 25 bp, Mus musculus
gctgtacaagattttgatcaggcat

SEQ ID NO: 573524 - DNA, 25 bp, Mus musculus
gctgtacacacaactaaaaccctaa

SEQ ID NO: 573525 - DNA, 25 bp, Mus musculus
gctgtacacacatctaaaaccctaa

SEQ ID NO: 573526 - DNA, 25 bp, Mus musculus
gctgtacacatgcaacactgaggaa

SEQ ID NO: 573527 - DNA, 25 bp, Mus musculus
gctgtacacatggaacactgaggaa

SEQ ID NO: 573528 - DNA, 25 bp, Mus musculus
gctgtacaccgtacattttctatag

SEQ ID NO: 573529 - DNA, 25 bp, Mus musculus
gctgtacaccgttcattttctatag

SEQ ID NO: 573530 - DNA, 25 bp, Mus musculus
gctgtacacgctattcatcttgtca

SEQ ID NO: 573531 - DNA, 25 bp, Mus musculus
gctgtacacgcttttcatcttgtca

SEQ ID NO: 573532 - DNA, 25 bp, Mus musculus
gctgtacaggtgacgactttagtgt

SEQ ID NO: 573533 - DNA, 25 bp, Mus musculus
gctgtacaggtgtcgactttagtgt

SEQ ID NO: 573534 - DNA, 25 bp, Mus musculus
gctgtacagtatacttttgcaacaa

SEQ ID NO: 573535 - DNA, 25 bp, Mus musculus
gctgtacagtattcttttgcaacaa

SEQ ID NO: 573536 - DNA, 25 bp, Mus musculus
gctgtacatattctggactgctaaa

SEQ ID NO: 573537 - DNA, 25 bp, Mus musculus
gctgtacatattgtggactgctaaa

SEQ ID NO: 573538 - DNA, 25 bp, Mus musculus
gctgtacatccccagctagatggaa

SEQ ID NO: 573539 - DNA, 25 bp, Mus musculus
gctgtacatcccgagctagatggaa

SEQ ID NO: 573540 - DNA, 25 bp, Mus musculus
gctgtacatgcccaaagagttttgc

SEQ ID NO: 573541 - DNA, 25 bp, Mus musculus
gctgtacatgccgaaagagttttgc

SEQ ID NO: 573542 - DNA, 25 bp, Mus musculus
gctgtaccaagtcagtgattaagta

SEQ ID NO: 573543 - DNA, 25 bp, Mus musculus
gctgtaccaagtgagtgattaagta

SEQ ID NO: 573544 - DNA, 25 bp, Mus musculus
gctgtaccacctccgctgagtgctg

SEQ ID NO: 573545 - DNA, 25 bp, Mus musculus
gctgtaccacctgcgctgagtgctg

SEQ ID NO: 573546 - DNA, 25 bp, Mus musculus
gctgtaccagcaccttgtgtaccca

SEQ ID NO: 573547 - DNA, 25 bp, Mus musculus
gctgtaccagcagcttgtgtaccca

SEQ ID NO: 573548 - DNA, 25 bp, Mus musculus
gctgtaccaggtcgcttttcagagc

SEQ ID NO: 573549 - DNA, 25 bp, Mus musculus
gctgtaccaggtggcttttcagagc

SEQ ID NO: 573550 - DNA, 25 bp, Mus musculus
gctgtaccatatctagcatctaata

SEQ ID NO: 573551 - DNA, 25 bp, Mus musculus
gctgtaccatatgtagcatctaata

SEQ ID NO: 573552 - DNA, 25 bp, Mus musculus
gctgtaccatccagtggtcgccagg

SEQ ID NO: 573553 - DNA, 25 bp, Mus musculus
gctgtaccatcctgtggtcgccagg

SEQ ID NO: 573554 - DNA, 25 bp, Mus musculus
gctgtaccatggagttgaaccccgg

SEQ ID NO: 573555 - DNA, 25 bp, Mus musculus
gctgtaccatggtgttgaaccccgg

SEQ ID NO: 573556 - DNA, 25 bp, Mus musculus
gctgtacccaacactacaatgcatt

SEQ ID NO: 573557 - DNA, 25 bp, Mus musculus
gctgtacccaactctacaatgcatt

SEQ ID NO: 573558 - DNA, 25 bp, Mus musculus
gctgtacccagtcccatttatgtgg

SEQ ID NO: 573559 - DNA, 25 bp, Mus musculus
gctgtacccagtgccatttatgtgg

SEQ ID NO: 573560 - DNA, 25 bp, Mus musculus
gctgtacctcctacaagactttatt

SEQ ID NO: 573561 - DNA, 25 bp, Mus musculus
gctgtacctccttcaagactttatt

SEQ ID NO: 573562 - DNA, 25 bp, Mus musculus
gctgtaccttctattgttgcgttta

SEQ ID NO: 573563 - DNA, 25 bp, Mus musculus
gctgtaccttcttttgttgcgttta

SEQ ID NO: 573564 - DNA, 25 bp, Mus musculus
gctgtactatggctgattttgttta

SEQ ID NO: 573565 - DNA, 25 bp, Mus musculus
gctgtactatgggtgattttgttta

SEQ ID NO: 573566 - DNA, 25 bp, Mus musculus
gctgtactccaaacccagagtcaga

SEQ ID NO: 573567 - DNA, 25 bp, Mus musculus
gctgtactccaatcccagagtcaga

SEQ ID NO: 573568 - DNA, 25 bp, Mus musculus
gctgtactgctaaaaaatcattcaa

SEQ ID NO: 573569 - DNA, 25 bp, Mus musculus
gctgtactgctataaaatcattcaa

SEQ ID NO: 573570 - DNA, 25 bp, Mus musculus
gctgtactgctcactagttaggaat

SEQ ID NO: 573571 - DNA, 25 bp, Mus musculus
gctgtactgctctctagttaggaat

SEQ ID NO: 573572 - DNA, 25 bp, Mus musculus
gctgtactttaaaactaagcagtcc

SEQ ID NO: 573573 - DNA, 25 bp, Mus musculus
gctgtactttaatactaagcagtcc

SEQ ID NO: 573574 - DNA, 25 bp, Mus musculus
gctgtactttagaaagtggtgtttc

SEQ ID NO: 573575 - DNA, 25 bp, Mus musculus
gctgtactttagtaagtggtgtttc

SEQ ID NO: 573576 - DNA, 25 bp, Mus musculus
gctgtactttgaatgctcatgatgc

SEQ ID NO: 573577 - DNA, 25 bp, Mus musculus
gctgtactttgattgctcatgatgc

SEQ ID NO: 573578 - DNA, 25 bp, Mus musculus
gctgtagaaaagaatcaatagcttc

SEQ ID NO: 573579 - DNA, 25 bp, Mus musculus
gctgtagaaaagtatcaatagcttc

SEQ ID NO: 573580 - DNA, 25 bp, Mus musculus
gctgtagacaatctgctaatcttta

SEQ ID NO: 573581 - DNA, 25 bp, Mus musculus
gctgtagacaatgtgctaatcttta

SEQ ID NO: 573582 - DNA, 25 bp, Mus musculus
gctgtagaccatcaagaccccaggg

SEQ ID NO: 573583 - DNA, 25 bp, Mus musculus
gctgtagaccatgaagaccccaggg

SEQ ID NO: 573584 - DNA, 25 bp, Mus musculus
gctgtagactccaacgaggttcacc

SEQ ID NO: 573585 - DNA, 25 bp, Mus musculus
gctgtagactcctacgaggttcacc

SEQ ID NO: 573586 - DNA, 25 bp, Mus musculus
gctgtagagcagcatgaagttacct

SEQ ID NO: 573587 - DNA, 25 bp, Mus musculus
gctgtagagcaggatgaagttacct

SEQ ID NO: 573588 - DNA, 25 bp, Mus musculus
gctgtagatcttaacttgctggaga

SEQ ID NO: 573589 - DNA, 25 bp, Mus musculus
gctgtagatctttacttgctggaga

SEQ ID NO: 573590 - DNA, 25 bp, Mus musculus
gctgtagatggcatattttgcattc

SEQ ID NO: 573591 - DNA, 25 bp, Mus musculus
gctgtagatggcttattttgcattc

SEQ ID NO: 573592 - DNA, 25 bp, Mus musculus
gctgtagatgtgacaccctgaccga

SEQ ID NO: 573593 - DNA, 25 bp, Mus musculus
gctgtagatgtgtcaccctgaccga

SEQ ID NO: 573594 - DNA, 25 bp, Mus musculus
gctgtagcaactaaaggccccattg

SEQ ID NO: 573595 - DNA, 25 bp, Mus musculus
gctgtagcaacttaaggccccattg

SEQ ID NO: 573596 - DNA, 25 bp, Mus musculus
gctgtagcagttagctaaaatgcac

SEQ ID NO: 573597 - DNA, 25 bp, Mus musculus
gctgtagcagtttgctaaaatgcac

SEQ ID NO: 573598 - DNA, 25 bp, Mus musculus
gctgtagccaccacaggtcctgaat

SEQ ID NO: 573599 - DNA, 25 bp, Mus musculus
gctgtagccaccacatgtcttgggt

SEQ ID NO: 573600 - DNA, 25 bp, Mus musculus
gctgtagccacctcaggtcctgaat

SEQ ID NO: 573601 - DNA, 25 bp, Mus musculus
gctgtagccacctcatgtcttgggt

SEQ ID NO: 573602 - DNA, 25 bp, Mus musculus
gctgtagccggaatgcaagtgtatc

SEQ ID NO: 573603 - DNA, 25 bp, Mus musculus
gctgtagccggattgcaagtgtatc

SEQ ID NO: 573604 - DNA, 25 bp, Mus musculus
gctgtagcctcacacatgcacaaat

SEQ ID NO: 573605 - DNA, 25 bp, Mus musculus
gctgtagcctcactccctagggcag

SEQ ID NO: 573606 - DNA, 25 bp, Mus musculus
gctgtagcctcagacatgcacaaat

SEQ ID NO: 573607 - DNA, 25 bp, Mus musculus
gctgtagcctcagtccctagggcag

SEQ ID NO: 573608 - DNA, 25 bp, Mus musculus
gctgtagcgttcaatccacaaacaa

SEQ ID NO: 573609 - DNA, 25 bp, Mus musculus
gctgtagcgttctatccacaaacaa

SEQ ID NO: 573610 - DNA, 25 bp, Mus musculus
gctgtagctctcaatgttaaggtaa

SEQ ID NO: 573611 - DNA, 25 bp, Mus musculus
gctgtagctctctatgttaaggtaa

SEQ ID NO: 573612 - DNA, 25 bp, Mus musculus
gctgtaggaataactggagccattc

SEQ ID NO: 573613 - DNA, 25 bp, Mus musculus
gctgtaggaatatctggagccattc

SEQ ID NO: 573614 - DNA, 25 bp, Mus musculus
gctgtaggagacattgtgatggttt

SEQ ID NO: 573615 - DNA, 25 bp, Mus musculus
gctgtaggagactttgtgatggttt

SEQ ID NO: 573616 - DNA, 25 bp, Mus musculus
gctgtaggataaagtgctctgccat

SEQ ID NO: 573617 - DNA, 25 bp, Mus musculus
gctgtaggataatgtgctctgccat

SEQ ID NO: 573618 - DNA, 25 bp, Mus musculus
gctgtaggcagcagtgattccattt

SEQ ID NO: 573619 - DNA, 25 bp, Mus musculus
gctgtaggcagctgtgattccattt

SEQ ID NO: 573620 - DNA, 25 bp, Mus musculus
gctgtagggaccacagatgcaacat

SEQ ID NO: 573621 - DNA, 25 bp, Mus musculus
gctgtagggacctcagatgcaacat

SEQ ID NO: 573622 - DNA, 25 bp, Mus musculus
gctgtaggtcatcctgatgtgttta

SEQ ID NO: 573623 - DNA, 25 bp, Mus musculus
gctgtaggtcatgctgatgtgttta

SEQ ID NO: 573624 - DNA, 25 bp, Mus musculus
gctgtaggtgacagtagccacctct

SEQ ID NO: 573625 - DNA, 25 bp, Mus musculus
gctgtaggtgactgtagccacctct

SEQ ID NO: 573626 - DNA, 25 bp, Mus musculus
gctgtaggtgtcactgctgcagtga

SEQ ID NO: 573627 - DNA, 25 bp, Mus musculus
gctgtaggtgtctctgctgcagtga

SEQ ID NO: 573628 - DNA, 25 bp, Mus musculus
gctgtaggttttcctgagcttgtga

SEQ ID NO: 573629 - DNA, 25 bp, Mus musculus
gctgtaggttttgctgagcttgtga

SEQ ID NO: 573630 - DNA, 25 bp, Mus musculus
gctgtagtaaatctccctcaagggt

SEQ ID NO: 573631 - DNA, 25 bp, Mus musculus
gctgtagtaaatgtccctcaagggt

SEQ ID NO: 573632 - DNA, 25 bp, Mus musculus
gctgtagtactgcaatacctttgaa

SEQ ID NO: 573633 - DNA, 25 bp, Mus musculus
gctgtagtactggaatacctttgaa

SEQ ID NO: 573634 - DNA, 25 bp, Mus musculus
gctgtagtctaccacctctggatag

SEQ ID NO: 573635 - DNA, 25 bp, Mus musculus
gctgtagtctacgacctctggatag

SEQ ID NO: 573636 - DNA, 25 bp, Mus musculus
gctgtagtcttgagagatgtcccct

SEQ ID NO: 573637 - DNA, 25 bp, Mus musculus
gctgtagtcttgtgagatgtcccct

SEQ ID NO: 573638 - DNA, 25 bp, Mus musculus
gctgtagtgagccagactgaccagt

SEQ ID NO: 573639 - DNA, 25 bp, Mus musculus
gctgtagtgagcgagactgaccagt

SEQ ID NO: 573640 - DNA, 25 bp, Mus musculus
gctgtagtgcttatgaatcttgagt

SEQ ID NO: 573641 - DNA, 25 bp, Mus musculus
gctgtagtgcttttgaatcttgagt

SEQ ID NO: 573642 - DNA, 25 bp, Mus musculus
gctgtagtgtcactgcacttgcact

SEQ ID NO: 573643 - DNA, 25 bp, Mus musculus
gctgtagtgtcagtgcacttgcact

SEQ ID NO: 573644 - DNA, 25 bp, Mus musculus
gctgtagtgtggaccaagcctcatc

SEQ ID NO: 573645 - DNA, 25 bp, Mus musculus
gctgtagtgtggtccaagcctcatc

SEQ ID NO: 573646 - DNA, 25 bp, Mus musculus
gctgtagtgtttactcatgggctat

SEQ ID NO: 573647 - DNA, 25 bp, Mus musculus
gctgtagtgttttctcatgggctat

SEQ ID NO: 573648 - DNA, 25 bp, Mus musculus
gctgtagttcgcagtttgtatttct

SEQ ID NO: 573649 - DNA, 25 bp, Mus musculus
gctgtagttcgctgtttgtatttct

SEQ ID NO: 573650 - DNA, 25 bp, Mus musculus
gctgtagtttggattaacgcccctc

SEQ ID NO: 573651 - DNA, 25 bp, Mus musculus
gctgtagtttggtttaacgcccctc

SEQ ID NO: 573652 - DNA, 25 bp, Mus musculus
gctgtataacataaagggccccata

SEQ ID NO: 573653 - DNA, 25 bp, Mus musculus
gctgtataacattaagggccccata

SEQ ID NO: 573654 - DNA, 25 bp, Mus musculus
gctgtatacattattgggcaacggt

SEQ ID NO: 573655 - DNA, 25 bp, Mus musculus
gctgtatacatttttgggcaacggt

SEQ ID NO: 573656 - DNA, 25 bp, Mus musculus
gctgtatagctgatacttctgtgta

SEQ ID NO: 573657 - DNA, 25 bp, Mus musculus
gctgtatagctgttacttctgtgta

SEQ ID NO: 573658 - DNA, 25 bp, Mus musculus
gctgtatagtagagggctttctgat

SEQ ID NO: 573659 - DNA, 25 bp, Mus musculus
gctgtatagtagtgggctttctgat

SEQ ID NO: 573660 - DNA, 25 bp, Mus musculus
gctgtatagtccactacctagtttg

SEQ ID NO: 573661 - DNA, 25 bp, Mus musculus
gctgtatagtcctctacctagtttg

SEQ ID NO: 573662 - DNA, 25 bp, Mus musculus
gctgtatataccatttctcactgat

SEQ ID NO: 573663 - DNA, 25 bp, Mus musculus
gctgtatataccttttctcactgat

SEQ ID NO: 573664 - DNA, 25 bp, Mus musculus
gctgtatatatactgtaacatctgt

SEQ ID NO: 573665 - DNA, 25 bp, Mus musculus
gctgtatatatagtgtaacatctgt

SEQ ID NO: 573666 - DNA, 25 bp, Mus musculus
gctgtatattgtaggacatgtagac

SEQ ID NO: 573667 - DNA, 25 bp, Mus musculus
gctgtatattgttggacatgtagac

SEQ ID NO: 573668 - DNA, 25 bp, Mus musculus
gctgtatatttaagatggcactttc

SEQ ID NO: 573669 - DNA, 25 bp, Mus musculus
gctgtatatttatgatggcactttc

SEQ ID NO: 573670 - DNA, 25 bp, Mus musculus
gctgtatcacctcagcattgtgttt

SEQ ID NO: 573671 - DNA, 25 bp, Mus musculus
gctgtatcacctgagcattgtgttt

SEQ ID NO: 573672 - DNA, 25 bp, Mus musculus
gctgtatcaggtctggagagcaaca

SEQ ID NO: 573673 - DNA, 25 bp, Mus musculus
gctgtatcaggtgtggagagcaaca

SEQ ID NO: 573674 - DNA, 25 bp, Mus musculus
gctgtatcatttacctgagctttgt

SEQ ID NO: 573675 - DNA, 25 bp, Mus musculus
gctgtatcattttcctgagctttgt

SEQ ID NO: 573676 - DNA, 25 bp, Mus musculus
gctgtatccagccaagatgtgcttg

SEQ ID NO: 573677 - DNA, 25 bp, Mus musculus
gctgtatccagcgaagatgtgcttg

SEQ ID NO: 573678 - DNA, 25 bp, Mus musculus
gctgtatcccggcaacctgcacagg

SEQ ID NO: 573679 - DNA, 25 bp, Mus musculus
gctgtatcccgggaacctgcacagg

SEQ ID NO: 573680 - DNA, 25 bp, Mus musculus
gctgtatcggcgcaggccagaaata

SEQ ID NO: 573681 - DNA, 25 bp, Mus musculus
gctgtatcggcggaggccagaaata

SEQ ID NO: 573682 - DNA, 25 bp, Mus musculus
gctgtatctgaacaacaatgcaata

SEQ ID NO: 573683 - DNA, 25 bp, Mus musculus
gctgtatctgaagaacaatgcaata

SEQ ID NO: 573684 - DNA, 25 bp, Mus musculus
gctgtatgagctagggaaagtcact

SEQ ID NO: 573685 - DNA, 25 bp, Mus musculus
gctgtatgagcttgggaaagtcact

SEQ ID NO: 573686 - DNA, 25 bp, Mus musculus
gctgtatgagtcagaatccgaatct

SEQ ID NO: 573687 - DNA, 25 bp, Mus musculus
gctgtatgagtctgaatccgaatct

SEQ ID NO: 573688 - DNA, 25 bp, Mus musculus
gctgtatgcagccaagatacttttt

SEQ ID NO: 573689 - DNA, 25 bp, Mus musculus
gctgtatgcagcgaagatacttttt

SEQ ID NO: 573690 - DNA, 25 bp, Mus musculus
gctgtatgcgttacctgtttttgta

SEQ ID NO: 573691 - DNA, 25 bp, Mus musculus
gctgtatgcgtttcctgtttttgta

SEQ ID NO: 573692 - DNA, 25 bp, Mus musculus
gctgtatgctccatcaaaacctatt

SEQ ID NO: 573693 - DNA, 25 bp, Mus musculus
gctgtatgctccttcaaaacctatt

SEQ ID NO: 573694 - DNA, 25 bp, Mus musculus
gctgtatgctctatgtgtcaggaca

SEQ ID NO: 573695 - DNA, 25 bp, Mus musculus
gctgtatgctctttgtgtcaggaca

SEQ ID NO: 573696 - DNA, 25 bp, Mus musculus
gctgtatgctgcagcagtagcacct

SEQ ID NO: 573697 - DNA, 25 bp, Mus musculus
gctgtatgctgctgcagtagcacct

SEQ ID NO: 573698 - DNA, 25 bp, Mus musculus
gctgtatggctgcttggcatttgat

SEQ ID NO: 573699 - DNA, 25 bp, Mus musculus
gctgtatggctggttggcatttgat

SEQ ID NO: 573700 - DNA, 25 bp, Mus musculus
gctgtatgtatacgccctgcgtgtc

SEQ ID NO: 573701 - DNA, 25 bp, Mus musculus
gctgtatgtataggccctgcgtgtc

SEQ ID NO: 573702 - DNA, 25 bp, Mus musculus
gctgtatgtcgtacacagtacgcgt

SEQ ID NO: 573703 - DNA, 25 bp, Mus musculus
gctgtatgtcgttcacagtacgcgt

SEQ ID NO: 573704 - DNA, 25 bp, Mus musculus
gctgtatgtggaccctatgtgtccc

SEQ ID NO: 573705 - DNA, 25 bp, Mus musculus
gctgtatgtggagcctatgtgtccc

SEQ ID NO: 573706 - DNA, 25 bp, Mus musculus
gctgtatgttttaccaagatgttta

SEQ ID NO: 573707 - DNA, 25 bp, Mus musculus
gctgtatgtttttccaagatgttta

SEQ ID NO: 573708 - DNA, 25 bp, Mus musculus
gctgtattacaccaaaagtattttt

SEQ ID NO: 573709 - DNA, 25 bp, Mus musculus
gctgtattacacgaaaagtattttt

SEQ ID NO: 573710 - DNA, 25 bp, Mus musculus
gctgtattcacacatccatttcatg

SEQ ID NO: 573711 - DNA, 25 bp, Mus musculus
gctgtattcacagatccatttcatg

SEQ ID NO: 573712 - DNA, 25 bp, Mus musculus
gctgtattcatgagtcatgcactgg

SEQ ID NO: 573713 - DNA, 25 bp, Mus musculus
gctgtattcatgtgtcatgcactgg

SEQ ID NO: 573714 - DNA, 25 bp, Mus musculus
gctgtattccagatgctgcccacaa

SEQ ID NO: 573715 - DNA, 25 bp, Mus musculus
gctgtattccagttgctgcccacaa

SEQ ID NO: 573716 - DNA, 25 bp, Mus musculus
gctgtattcgtcatctacaagttta

SEQ ID NO: 573717 - DNA, 25 bp, Mus musculus
gctgtattcgtcttctacaagttta

SEQ ID NO: 573718 - DNA, 25 bp, Mus musculus
gctgtattctggcttgagtttgtca

SEQ ID NO: 573719 - DNA, 25 bp, Mus musculus
gctgtattctgggttgagtttgtca

SEQ ID NO: 573720 - DNA, 25 bp, Mus musculus
gctgtattctgtctaggtcgtccta

SEQ ID NO: 573721 - DNA, 25 bp, Mus musculus
gctgtattctgtgtaggtcgtccta

SEQ ID NO: 573722 - DNA, 25 bp, Mus musculus
gctgtattgagtattatttcctagt

SEQ ID NO: 573723 - DNA, 25 bp, Mus musculus
gctgtattgagttttatttcctagt

SEQ ID NO: 573724 - DNA, 25 bp, Mus musculus
gctgtattgcagaagccaccggcaa

SEQ ID NO: 573725 - DNA, 25 bp, Mus musculus
gctgtattgcagtagccaccggcaa

SEQ ID NO: 573726 - DNA, 25 bp, Mus musculus
gctgtattgtttatccgaacaattg

SEQ ID NO: 573727 - DNA, 25 bp, Mus musculus
gctgtattgtttttccgaacaattg

SEQ ID NO: 573728 - DNA, 25 bp, Mus musculus
gctgtatttacaagtttcgatttaa

SEQ ID NO: 573729 - DNA, 25 bp, Mus musculus
gctgtatttacatgtttcgatttaa

SEQ ID NO: 573730 - DNA, 25 bp, Mus musculus
gctgtatttctgaaggctctcacac

SEQ ID NO: 573731 - DNA, 25 bp, Mus musculus
gctgtatttctgataacacgtggtt

SEQ ID NO: 573732 - DNA, 25 bp, Mus musculus
gctgtatttctgtaggctctcacac

SEQ ID NO: 573733 - DNA, 25 bp, Mus musculus
gctgtatttctgttaacacgtggtt

SEQ ID NO: 573734 - DNA, 25 bp, Mus musculus
gctgtattttccctgtgtgtataat

SEQ ID NO: 573735 - DNA, 25 bp, Mus musculus
gctgtattttccgtgtgtgtataat

SEQ ID NO: 573736 - DNA, 25 bp, Mus musculus
gctgtatttttaagactcaaattgg

SEQ ID NO: 573737 - DNA, 25 bp, Mus musculus
gctgtatttttatgactcaaattgg

SEQ ID NO: 573738 - DNA, 25 bp, Mus musculus
gctgtatttttcagcaactttctta

SEQ ID NO: 573739 - DNA, 25 bp, Mus musculus
gctgtatttttctgcaactttctta

SEQ ID NO: 573740 - DNA, 25 bp, Mus musculus
gctgtcaaaactcccactaagtcga

SEQ ID NO: 573741 - DNA, 25 bp, Mus musculus
gctgtcaaaactgccactaagtcga

SEQ ID NO: 573742 - DNA, 25 bp, Mus musculus
gctgtcaaagctctaaataggttct

SEQ ID NO: 573743 - DNA, 25 bp, Mus musculus
gctgtcaaagctgtaaataggttct

SEQ ID NO: 573744 - DNA, 25 bp, Mus musculus
gctgtcaatattcttatctgggcaa

SEQ ID NO: 573745 - DNA, 25 bp, Mus musculus
gctgtcaatattgttatctgggcaa

SEQ ID NO: 573746 - DNA, 25 bp, Mus musculus
gctgtcaatcaaaacggctgcactc

SEQ ID NO: 573747 - DNA, 25 bp, Mus musculus
gctgtcaatcaatacggctgcactc

SEQ ID NO: 573748 - DNA, 25 bp, Mus musculus
gctgtcaatttgagctgtcatttca

SEQ ID NO: 573749 - DNA, 25 bp, Mus musculus
gctgtcaatttgtgctgtcatttca

SEQ ID NO: 573750 - DNA, 25 bp, Mus musculus
gctgtcacaaacacccaggtcattg

SEQ ID NO: 573751 - DNA, 25 bp, Mus musculus
gctgtcacaaactcccaggtcattg

SEQ ID NO: 573752 - DNA, 25 bp, Mus musculus
gctgtcacaactagatcgggtctca

SEQ ID NO: 573753 - DNA, 25 bp, Mus musculus
gctgtcacaacttgatcgggtctca

SEQ ID NO: 573754 - DNA, 25 bp, Mus musculus
gctgtcacaagaagccgctaattct

SEQ ID NO: 573755 - DNA, 25 bp, Mus musculus
gctgtcacaagatgccgctaattct

SEQ ID NO: 573756 - DNA, 25 bp, Mus musculus
gctgtcacacatataggcatggatg

SEQ ID NO: 573757 - DNA, 25 bp, Mus musculus
gctgtcacacatttaggcatggatg

SEQ ID NO: 573758 - DNA, 25 bp, Mus musculus
gctgtcacatggagaatcgaaattg

SEQ ID NO: 573759 - DNA, 25 bp, Mus musculus
gctgtcacatggtgaatcgaaattg

SEQ ID NO: 573760 - DNA, 25 bp, Mus musculus
gctgtcaccactacagtaagctggt

SEQ ID NO: 573761 - DNA, 25 bp, Mus musculus
gctgtcaccacttcagtaagctggt

SEQ ID NO: 573762 - DNA, 25 bp, Mus musculus
gctgtcaccagacgtccaattcatt

SEQ ID NO: 573763 - DNA, 25 bp, Mus musculus
gctgtcaccagaggtccaattcatt

SEQ ID NO: 573764 - DNA, 25 bp, Mus musculus
gctgtcaccaggcaggtcagtactg

SEQ ID NO: 573765 - DNA, 25 bp, Mus musculus
gctgtcaccagggaggtcagtactg

SEQ ID NO: 573766 - DNA, 25 bp, Mus musculus
gctgtcaccattctaaatcttggga

SEQ ID NO: 573767 - DNA, 25 bp, Mus musculus
gctgtcaccattgtaaatcttggga

SEQ ID NO: 573768 - DNA, 25 bp, Mus musculus
gctgtcaccgtaacagtttccagaa

SEQ ID NO: 573769 - DNA, 25 bp, Mus musculus
gctgtcaccgtatcagtttccagaa

SEQ ID NO: 573770 - DNA, 25 bp, Mus musculus
gctgtcacctaacctgtggtttaca

SEQ ID NO: 573771 - DNA, 25 bp, Mus musculus
gctgtcacctaagctgtggtttaca

SEQ ID NO: 573772 - DNA, 25 bp, Mus musculus
gctgtcacctccctattaatgaaag

SEQ ID NO: 573773 - DNA, 25 bp, Mus musculus
gctgtcacctccgtattaatgaaag

SEQ ID NO: 573774 - DNA, 25 bp, Mus musculus
gctgtcacgcctcccaaagcaaaga

SEQ ID NO: 573775 - DNA, 25 bp, Mus musculus
gctgtcacgcctgccaaagcaaaga

SEQ ID NO: 573776 - DNA, 25 bp, Mus musculus
gctgtcactcctcggaaagccaaat

SEQ ID NO: 573777 - DNA, 25 bp, Mus musculus
gctgtcactcctgggaaagccaaat

SEQ ID NO: 573778 - DNA, 25 bp, Mus musculus
gctgtcactgaaactgcattattca

SEQ ID NO: 573779 - DNA, 25 bp, Mus musculus
gctgtcactgaaagctaggaattga

SEQ ID NO: 573780 - DNA, 25 bp, Mus musculus
gctgtcactgaatctgcattattca

SEQ ID NO: 573781 - DNA, 25 bp, Mus musculus
gctgtcactgaatgctaggaattga

SEQ ID NO: 573782 - DNA, 25 bp, Mus musculus
gctgtcactgggaagccatcaagat

SEQ ID NO: 573783 - DNA, 25 bp, Mus musculus
gctgtcactgggtagccatcaagat

SEQ ID NO: 573784 - DNA, 25 bp, Mus musculus
gctgtcagaactaagcttggagcct

SEQ ID NO: 573785 - DNA, 25 bp, Mus musculus
gctgtcagaacttagcttggagcct

SEQ ID NO: 573786 - DNA, 25 bp, Mus musculus
gctgtcagactaaattgtttccttg

SEQ ID NO: 573787 - DNA, 25 bp, Mus musculus
gctgtcagactatattgtttccttg

SEQ ID NO: 573788 - DNA, 25 bp, Mus musculus
gctgtcagagggaccatcctgccca

SEQ ID NO: 573789 - DNA, 25 bp, Mus musculus
gctgtcagagggtccatcctgccca

SEQ ID NO: 573790 - DNA, 25 bp, Mus musculus
gctgtcagataacttgccggatgag

SEQ ID NO: 573791 - DNA, 25 bp, Mus musculus
gctgtcagataagttgccggatgag

SEQ ID NO: 573792 - DNA, 25 bp, Mus musculus
gctgtcagatcacatcaaggaccta

SEQ ID NO: 573793 - DNA, 25 bp, Mus musculus
gctgtcagatcagatcaaggaccta

SEQ ID NO: 573794 - DNA, 25 bp, Mus musculus
gctgtcagcagcactgaaggcagaa

SEQ ID NO: 573795 - DNA, 25 bp, Mus musculus
gctgtcagcagctctgaaggcagaa

SEQ ID NO: 573796 - DNA, 25 bp, Mus musculus
gctgtcagggacatatctgaagcaa

SEQ ID NO: 573797 - DNA, 25 bp, Mus musculus
gctgtcagggacttatctgaagcaa

SEQ ID NO: 573798 - DNA, 25 bp, Mus musculus
gctgtcagtacacctgtcagtctga

SEQ ID NO: 573799 - DNA, 25 bp, Mus musculus
gctgtcagtacagctgtcagtctga

SEQ ID NO: 573800 - DNA, 25 bp, Mus musculus
gctgtcagtcaactgcttacctact

SEQ ID NO: 573801 - DNA, 25 bp, Mus musculus
gctgtcagtcaagtgcttacctact

SEQ ID NO: 573802 - DNA, 25 bp, Mus musculus
gctgtcagtttaacgggtgccggaa

SEQ ID NO: 573803 - DNA, 25 bp, Mus musculus
gctgtcagtttatcgggtgccggaa

SEQ ID NO: 573804 - DNA, 25 bp, Mus musculus
gctgtcatccagctcataagcgtgt

SEQ ID NO: 573805 - DNA, 25 bp, Mus musculus
gctgtcatccagctgtctcagattg

SEQ ID NO: 573806 - DNA, 25 bp, Mus musculus
gctgtcatccaggtcataagcgtgt

SEQ ID NO: 573807 - DNA, 25 bp, Mus musculus
gctgtcatccaggtgtctcagattg

SEQ ID NO: 573808 - DNA, 25 bp, Mus musculus
gctgtcatctcactagctgctggaa

SEQ ID NO: 573809 - DNA, 25 bp, Mus musculus
gctgtcatctcagtagctgctggaa

SEQ ID NO: 573810 - DNA, 25 bp, Mus musculus
gctgtcatctgaaacatggaatctt

SEQ ID NO: 573811 - DNA, 25 bp, Mus musculus
gctgtcatctgatacatggaatctt

SEQ ID NO: 573812 - DNA, 25 bp, Mus musculus
gctgtcatcttaaaatgtgttacaa

SEQ ID NO: 573813 - DNA, 25 bp, Mus musculus
gctgtcatcttataatgtgttacaa

SEQ ID NO: 573814 - DNA, 25 bp, Mus musculus
gctgtcatcttgaggttggttccta

SEQ ID NO: 573815 - DNA, 25 bp, Mus musculus
gctgtcatcttgtggttggttccta

SEQ ID NO: 573816 - DNA, 25 bp, Mus musculus
gctgtcatgagacgccagatcctaa

SEQ ID NO: 573817 - DNA, 25 bp, Mus musculus
gctgtcatgagaggccagatcctaa

SEQ ID NO: 573818 - DNA, 25 bp, Mus musculus
gctgtcatgcctaattttttcttat

SEQ ID NO: 573819 - DNA, 25 bp, Mus musculus
gctgtcatgccttattttttcttat

SEQ ID NO: 573820 - DNA, 25 bp, Mus musculus
gctgtcatgctacccttatgtattt

SEQ ID NO: 573821 - DNA, 25 bp, Mus musculus
gctgtcatgctagccttatgtattt

SEQ ID NO: 573822 - DNA, 25 bp, Mus musculus
gctgtcatgtgcacaccattacttg

SEQ ID NO: 573823 - DNA, 25 bp, Mus musculus
gctgtcatgtgctcaccattacttg

SEQ ID NO: 573824 - DNA, 25 bp, Mus musculus
gctgtcatgtggctgttagacacac

SEQ ID NO: 573825 - DNA, 25 bp, Mus musculus
gctgtcatgtgggtgttagacacac

SEQ ID NO: 573826 - DNA, 25 bp, Mus musculus
gctgtcatgttcagtgtgagcttca

SEQ ID NO: 573827 - DNA, 25 bp, Mus musculus
gctgtcatgttctgtgtgagcttca

SEQ ID NO: 573828 - DNA, 25 bp, Mus musculus
gctgtcattacacgccattggtgta

SEQ ID NO: 573829 - DNA, 25 bp, Mus musculus
gctgtcattacaggccattggtgta

SEQ ID NO: 573830 - DNA, 25 bp, Mus musculus
gctgtcattataaacttaggaggtc

SEQ ID NO: 573831 - DNA, 25 bp, Mus musculus
gctgtcattatatacttaggaggtc

SEQ ID NO: 573832 - DNA, 25 bp, Mus musculus
gctgtcattcccatcatgcatagaa

SEQ ID NO: 573833 - DNA, 25 bp, Mus musculus
gctgtcattcccttcatgcatagaa

SEQ ID NO: 573834 - DNA, 25 bp, Mus musculus
gctgtcattgatccttttgaaacaa

SEQ ID NO: 573835 - DNA, 25 bp, Mus musculus
gctgtcattgatgcttttgaaacaa

SEQ ID NO: 573836 - DNA, 25 bp, Mus musculus
gctgtcatttaaattgggttcctta

SEQ ID NO: 573837 - DNA, 25 bp, Mus musculus
gctgtcatttaatttgggttcctta

SEQ ID NO: 573838 - DNA, 25 bp, Mus musculus
gctgtccaacaaatactactgtact

SEQ ID NO: 573839 - DNA, 25 bp, Mus musculus
gctgtccaacaattactactgtact

SEQ ID NO: 573840 - DNA, 25 bp, Mus musculus
gctgtccacaagactgttacttttt

SEQ ID NO: 573841 - DNA, 25 bp, Mus musculus
gctgtccacaagtctgttacttttt

SEQ ID NO: 573842 - DNA, 25 bp, Mus musculus
gctgtccacagcattatcgcagaaa

SEQ ID NO: 573843 - DNA, 25 bp, Mus musculus
gctgtccacagctttatcgcagaaa

SEQ ID NO: 573844 - DNA, 25 bp, Mus musculus
gctgtccactccacatctattaaat

SEQ ID NO: 573845 - DNA, 25 bp, Mus musculus
gctgtccactcctcatctattaaat

SEQ ID NO: 573846 - DNA, 25 bp, Mus musculus
gctgtccagaccaaaagggagtgtt

SEQ ID NO: 573847 - DNA, 25 bp, Mus musculus
gctgtccagacctaaagggagtgtt

SEQ ID NO: 573848 - DNA, 25 bp, Mus musculus
gctgtccagcttatactggtatcaa

SEQ ID NO: 573849 - DNA, 25 bp, Mus musculus
gctgtccagcttttactggtatcaa

SEQ ID NO: 573850 - DNA, 25 bp, Mus musculus
gctgtccaggtcaatggagagctgt

SEQ ID NO: 573851 - DNA, 25 bp, Mus musculus
gctgtccaggtctatggagagctgt

SEQ ID NO: 573852 - DNA, 25 bp, Mus musculus
gctgtccatgggattctcggatgaa

SEQ ID NO: 573853 - DNA, 25 bp, Mus musculus
gctgtccatgggtttctcggatgaa

SEQ ID NO: 573854 - DNA, 25 bp, Mus musculus
gctgtcccactgcaggctctgggaa

SEQ ID NO: 573855 - DNA, 25 bp, Mus musculus
gctgtcccactggaggctctgggaa

SEQ ID NO: 573856 - DNA, 25 bp, Mus musculus
gctgtcccagaaagtacaggagagc

SEQ ID NO: 573857 - DNA, 25 bp, Mus musculus
gctgtcccagaatgtacaggagagc

SEQ ID NO: 573858 - DNA, 25 bp, Mus musculus
gctgtcccagacaaaacaccaacat

SEQ ID NO: 573859 - DNA, 25 bp, Mus musculus
gctgtcccagactaaacaccaacat

SEQ ID NO: 573860 - DNA, 25 bp, Mus musculus
gctgtcccatttcacataactcaaa

SEQ ID NO: 573861 - DNA, 25 bp, Mus musculus
gctgtcccatttgacataactcaaa

SEQ ID NO: 573862 - DNA, 25 bp, Mus musculus
gctgtccccagtcattctgtaggga

SEQ ID NO: 573863 - DNA, 25 bp, Mus musculus
gctgtccccagtgattctgtaggga

SEQ ID NO: 573864 - DNA, 25 bp, Mus musculus
gctgtccctctgctagacactgctt

SEQ ID NO: 573865 - DNA, 25 bp, Mus musculus
gctgtccctctggtagacactgctt

SEQ ID NO: 573866 - DNA, 25 bp, Mus musculus
gctgtccctgctatgtaacccatgc

SEQ ID NO: 573867 - DNA, 25 bp, Mus musculus
gctgtccctgctttgtaacccatgc

SEQ ID NO: 573868 - DNA, 25 bp, Mus musculus
gctgtccctgtaagcctctggtcgt

SEQ ID NO: 573869 - DNA, 25 bp, Mus musculus
gctgtccctgtatgcctctggtcgt

SEQ ID NO: 573870 - DNA, 25 bp, Mus musculus
gctgtcccttacctctaacatagag

SEQ ID NO: 573871 - DNA, 25 bp, Mus musculus
gctgtcccttacgtctaacatagag

SEQ ID NO: 573872 - DNA, 25 bp, Mus musculus
gctgtccctttgagtgaatgtcacc

SEQ ID NO: 573873 - DNA, 25 bp, Mus musculus
gctgtccctttgtgtgaatgtcacc

SEQ ID NO: 573874 - DNA, 25 bp, Mus musculus
gctgtccgaatactctctgtgtaga

SEQ ID NO: 573875 - DNA, 25 bp, Mus musculus
gctgtccgaatagtctctgtgtaga

SEQ ID NO: 573876 - DNA, 25 bp, Mus musculus
gctgtccgagataaaaggctgcccc

SEQ ID NO: 573877 - DNA, 25 bp, Mus musculus
gctgtccgagattaaaggctgcccc

SEQ ID NO: 573878 - DNA, 25 bp, Mus musculus
gctgtccgagttaatagtaagtgcc

SEQ ID NO: 573879 - DNA, 25 bp, Mus musculus
gctgtccgagtttatagtaagtgcc

SEQ ID NO: 573880 - DNA, 25 bp, Mus musculus
gctgtccggaaaacccggagtggct

SEQ ID NO: 573881 - DNA, 25 bp, Mus musculus
gctgtccggaaatcccggagtggct

SEQ ID NO: 573882 - DNA, 25 bp, Mus musculus
gctgtccgtagtctccaaaggccaa

SEQ ID NO: 573883 - DNA, 25 bp, Mus musculus
gctgtccgtagtgtccaaaggccaa

SEQ ID NO: 573884 - DNA, 25 bp, Mus musculus
gctgtcctaccccaactccaaactt

SEQ ID NO: 573885 - DNA, 25 bp, Mus musculus
gctgtcctacccgaactccaaactt

SEQ ID NO: 573886 - DNA, 25 bp, Mus musculus
gctgtcctcccacatggaagcaaag

SEQ ID NO: 573887 - DNA, 25 bp, Mus musculus
gctgtcctcccagatggaagcaaag

SEQ ID NO: 573888 - DNA, 25 bp, Mus musculus
gctgtcctcttcacagatgaatctg

SEQ ID NO: 573889 - DNA, 25 bp, Mus musculus
gctgtcctcttctcagatgaatctg

SEQ ID NO: 573890 - DNA, 25 bp, Mus musculus
gctgtcctgaggattcagtagccga

SEQ ID NO: 573891 - DNA, 25 bp, Mus musculus
gctgtcctgaggtttcagtagccga

SEQ ID NO: 573892 - DNA, 25 bp, Mus musculus
gctgtcctgctaattaacacaatgt

SEQ ID NO: 573893 - DNA, 25 bp, Mus musculus
gctgtcctgctatttaacacaatgt

SEQ ID NO: 573894 - DNA, 25 bp, Mus musculus
gctgtcctgcttagtgctgctggaa

SEQ ID NO: 573895 - DNA, 25 bp, Mus musculus
gctgtcctgctttgtgctgctggaa

SEQ ID NO: 573896 - DNA, 25 bp, Mus musculus
gctgtcctggagaatattgcacatt

SEQ ID NO: 573897 - DNA, 25 bp, Mus musculus
gctgtcctggagtatattgcacatt

SEQ ID NO: 573898 - DNA, 25 bp, Mus musculus
gctgtcctgggcacctgacaccaag

SEQ ID NO: 573899 - DNA, 25 bp, Mus musculus
gctgtcctgggctcctgacaccaag

SEQ ID NO: 573900 - DNA, 25 bp, Mus musculus
gctgtcctgtttctaagcccagaga

SEQ ID NO: 573901 - DNA, 25 bp, Mus musculus
gctgtcctgtttgtaagcccagaga

SEQ ID NO: 573902 - DNA, 25 bp, Mus musculus
gctgtccttcaacaatgagtcacat

SEQ ID NO: 573903 - DNA, 25 bp, Mus musculus
gctgtccttcaagaatgagtcacat

SEQ ID NO: 573904 - DNA, 25 bp, Mus musculus
gctgtccttttcatgtgcagtatga

SEQ ID NO: 573905 - DNA, 25 bp, Mus musculus
gctgtccttttcttgtgcagtatga

SEQ ID NO: 573906 - DNA, 25 bp, Mus musculus
gctgtcgagagacgatctgaaccca

SEQ ID NO: 573907 - DNA, 25 bp, Mus musculus
gctgtcgagagaggatctgaaccca

SEQ ID NO: 573908 - DNA, 25 bp, Mus musculus
gctgtcgatcatagcaaacgccatg

SEQ ID NO: 573909 - DNA, 25 bp, Mus musculus
gctgtcgatcattgcaaacgccatg

SEQ ID NO: 573910 - DNA, 25 bp, Mus musculus
gctgtcgattaacaccggagcttgt

SEQ ID NO: 573911 - DNA, 25 bp, Mus musculus
gctgtcgattaagaccggagcttgt

SEQ ID NO: 573912 - DNA, 25 bp, Mus musculus
gctgtcgcagccattgttattatcc

SEQ ID NO: 573913 - DNA, 25 bp, Mus musculus
gctgtcgcagcctttgttattatcc

SEQ ID NO: 573914 - DNA, 25 bp, Mus musculus
gctgtcgcgattacttctcagactg

SEQ ID NO: 573915 - DNA, 25 bp, Mus musculus
gctgtcgcgatttcttctcagactg

SEQ ID NO: 573916 - DNA, 25 bp, Mus musculus
gctgtcgctcagaagtaaccttgga

SEQ ID NO: 573917 - DNA, 25 bp, Mus musculus
gctgtcgctcagtagtaaccttgga

SEQ ID NO: 573918 - DNA, 25 bp, Mus musculus
gctgtcgctgccatagacatacatg

SEQ ID NO: 573919 - DNA, 25 bp, Mus musculus
gctgtcgctgccttagacatacatg

SEQ ID NO: 573920 - DNA, 25 bp, Mus musculus
gctgtcgctggcctgacttcctatc

SEQ ID NO: 573921 - DNA, 25 bp, Mus musculus
gctgtcgctggcgtgacttcctatc

SEQ ID NO: 573922 - DNA, 25 bp, Mus musculus
gctgtcggaaggctctttctgcttt

SEQ ID NO: 573923 - DNA, 25 bp, Mus musculus
gctgtcggaagggtctttctgcttt

SEQ ID NO: 573924 - DNA, 25 bp, Mus musculus
gctgtcgtacgtagttcaggcatcc

SEQ ID NO: 573925 - DNA, 25 bp, Mus musculus
gctgtcgtacgttgttcaggcatcc

SEQ ID NO: 573926 - DNA, 25 bp, Mus musculus
gctgtcgtggaaccctttgaccaag

SEQ ID NO: 573927 - DNA, 25 bp, Mus musculus
gctgtcgtggaagcctttgaccaag

SEQ ID NO: 573928 - DNA, 25 bp, Mus musculus
gctgtcgtgtttcgctgcatattaa

SEQ ID NO: 573929 - DNA, 25 bp, Mus musculus
gctgtcgtgtttggctgcatattaa

SEQ ID NO: 573930 - DNA, 25 bp, Mus musculus
gctgtctaaagacttcaccacctgc

SEQ ID NO: 573931 - DNA, 25 bp, Mus musculus
gctgtctaaagagttcaccacctgc

SEQ ID NO: 573932 - DNA, 25 bp, Mus musculus
gctgtctaaatccaatgagtcctat

SEQ ID NO: 573933 - DNA, 25 bp, Mus musculus
gctgtctaaatcgaatgagtcctat

SEQ ID NO: 573934 - DNA, 25 bp, Mus musculus
gctgtctaagtacccatcttctaat

SEQ ID NO: 573935 - DNA, 25 bp, Mus musculus
gctgtctaagtagccatcttctaat

SEQ ID NO: 573936 - DNA, 25 bp, Mus musculus
gctgtctacaagctgccgcctttca

SEQ ID NO: 573937 - DNA, 25 bp, Mus musculus
gctgtctacaaggtgccgcctttca

SEQ ID NO: 573938 - DNA, 25 bp, Mus musculus
gctgtctacagccaaagcttggtag

SEQ ID NO: 573939 - DNA, 25 bp, Mus musculus
gctgtctacagcgaaagcttggtag

SEQ ID NO: 573940 - DNA, 25 bp, Mus musculus
gctgtctacctaccttggagggtta

SEQ ID NO: 573941 - DNA, 25 bp, Mus musculus
gctgtctacctagcttggagggtta

SEQ ID NO: 573942 - DNA, 25 bp, Mus musculus
gctgtctactcgcagcaggacacag

SEQ ID NO: 573943 - DNA, 25 bp, Mus musculus
gctgtctactcggagcaggacacag

SEQ ID NO: 573944 - DNA, 25 bp, Mus musculus
gctgtctagattcgctgaaataatt

SEQ ID NO: 573945 - DNA, 25 bp, Mus musculus
gctgtctagattggctgaaataatt

SEQ ID NO: 573946 - DNA, 25 bp, Mus musculus
gctgtctagttcattctaagcatgt

SEQ ID NO: 573947 - DNA, 25 bp, Mus musculus
gctgtctagttctttctaagcatgt

SEQ ID NO: 573948 - DNA, 25 bp, Mus musculus
gctgtctattttagtgccagcagcc

SEQ ID NO: 573949 - DNA, 25 bp, Mus musculus
gctgtctatttttgtgccagcagcc

SEQ ID NO: 573950 - DNA, 25 bp, Mus musculus
gctgtctcaagacgttgctgccctt

SEQ ID NO: 573951 - DNA, 25 bp, Mus musculus
gctgtctcaagaggttgctgccctt

SEQ ID NO: 573952 - DNA, 25 bp, Mus musculus
gctgtctcatctcaagattttccag

SEQ ID NO: 573953 - DNA, 25 bp, Mus musculus
gctgtctcatctgaagattttccag

SEQ ID NO: 573954 - DNA, 25 bp, Mus musculus
gctgtctccagtcttagaccgtggg

SEQ ID NO: 573955 - DNA, 25 bp, Mus musculus
gctgtctccagtgttagaccgtggg

SEQ ID NO: 573956 - DNA, 25 bp, Mus musculus
gctgtctccatgaacctctgaaggc

SEQ ID NO: 573957 - DNA, 25 bp, Mus musculus
gctgtctccatgtacctctgaaggc

SEQ ID NO: 573958 - DNA, 25 bp, Mus musculus
gctgtctcctcaaattctgtcccat

SEQ ID NO: 573959 - DNA, 25 bp, Mus musculus
gctgtctcctcatattctgtcccat

SEQ ID NO: 573960 - DNA, 25 bp, Mus musculus
gctgtctctcagagaagttcgtgaa

SEQ ID NO: 573961 - DNA, 25 bp, Mus musculus
gctgtctctcagtgaagttcgtgaa

SEQ ID NO: 573962 - DNA, 25 bp, Mus musculus
gctgtctctgctagggcatgtcact

SEQ ID NO: 573963 - DNA, 25 bp, Mus musculus
gctgtctctgcttgggcatgtcact

SEQ ID NO: 573964 - DNA, 25 bp, Mus musculus
gctgtctcttgtctttgcattctct

SEQ ID NO: 573965 - DNA, 25 bp, Mus musculus
gctgtctcttgtgtttgcattctct

SEQ ID NO: 573966 - DNA, 25 bp, Mus musculus
gctgtctgagtgagttaaattgtta

SEQ ID NO: 573967 - DNA, 25 bp, Mus musculus
gctgtctgagtgtgttaaattgtta

SEQ ID NO: 573968 - DNA, 25 bp, Mus musculus
gctgtctgatccactatatagtgaa

SEQ ID NO: 573969 - DNA, 25 bp, Mus musculus
gctgtctgatcctctatatagtgaa

SEQ ID NO: 573970 - DNA, 25 bp, Mus musculus
gctgtctgattcaccagtttcaggg

SEQ ID NO: 573971 - DNA, 25 bp, Mus musculus
gctgtctgattctccagtttcaggg

SEQ ID NO: 573972 - DNA, 25 bp, Mus musculus
gctgtctgcatgcaaacgcaggtat

SEQ ID NO: 573973 - DNA, 25 bp, Mus musculus
gctgtctgcatggaaacgcaggtat

SEQ ID NO: 573974 - DNA, 25 bp, Mus musculus
gctgtctgcattagctatatgggta

SEQ ID NO: 573975 - DNA, 25 bp, Mus musculus
gctgtctgcatttgctatatgggta

SEQ ID NO: 573976 - DNA, 25 bp, Mus musculus
gctgtctgccaaaagaaactgccta

SEQ ID NO: 573977 - DNA, 25 bp, Mus musculus
gctgtctgccaatagaaactgccta

SEQ ID NO: 573978 - DNA, 25 bp, Mus musculus
gctgtctgccataactccaaagtga

SEQ ID NO: 573979 - DNA, 25 bp, Mus musculus
gctgtctgccattactccaaagtga

SEQ ID NO: 573980 - DNA, 25 bp, Mus musculus
gctgtctgcctaattgattttccga

SEQ ID NO: 573981 - DNA, 25 bp, Mus musculus
gctgtctgcctatttgattttccga

SEQ ID NO: 573982 - DNA, 25 bp, Mus musculus
gctgtctgcttaaatagtcaggatt

SEQ ID NO: 573983 - DNA, 25 bp, Mus musculus
gctgtctgcttatatagtcaggatt

SEQ ID NO: 573984 - DNA, 25 bp, Mus musculus
gctgtctggatcaatattgccttaa

SEQ ID NO: 573985 - DNA, 25 bp, Mus musculus
gctgtctggatctatattgccttaa

SEQ ID NO: 573986 - DNA, 25 bp, Mus musculus
gctgtctggtgtacagtctgtccca

SEQ ID NO: 573987 - DNA, 25 bp, Mus musculus
gctgtctggtgttcagtctgtccca

SEQ ID NO: 573988 - DNA, 25 bp, Mus musculus
gctgtctgtaacatctgtgtcagga

SEQ ID NO: 573989 - DNA, 25 bp, Mus musculus
gctgtctgtaacttctgtgtcagga

SEQ ID NO: 573990 - DNA, 25 bp, Mus musculus
gctgtctgtagcaagttagccaaga

SEQ ID NO: 573991 - DNA, 25 bp, Mus musculus
gctgtctgtagctagttagccaaga

SEQ ID NO: 573992 - DNA, 25 bp, Mus musculus
gctgtctgtcaaaagtctggtatct

SEQ ID NO: 573993 - DNA, 25 bp, Mus musculus
gctgtctgtcaaagctgatccagga

SEQ ID NO: 573994 - DNA, 25 bp, Mus musculus
gctgtctgtcaacttcagcatcttt

SEQ ID NO: 573995 - DNA, 25 bp, Mus musculus
gctgtctgtcaagttcagcatcttt

SEQ ID NO: 573996 - DNA, 25 bp, Mus musculus
gctgtctgtcaatagtctggtatct

SEQ ID NO: 573997 - DNA, 25 bp, Mus musculus
gctgtctgtcaatgctgatccagga

SEQ ID NO: 573998 - DNA, 25 bp, Mus musculus
gctgtctgtcgtattgcattgtaaa

SEQ ID NO: 573999 - DNA, 25 bp, Mus musculus
gctgtctgtcgttttgcattgtaaa

SEQ ID NO: 574000 - DNA, 25 bp, Mus musculus
gctgtctgtgataccttatgtgata

SEQ ID NO: 574001 - DNA, 25 bp, Mus musculus
gctgtctgtgatctcttgctagaaa

SEQ ID NO: 574002 - DNA, 25 bp, Mus musculus
gctgtctgtgatgtcttgctagaaa

SEQ ID NO: 574003 - DNA, 25 bp, Mus musculus
gctgtctgtgattccttatgtgata

SEQ ID NO: 574004 - DNA, 25 bp, Mus musculus
gctgtctgtgcaatgtctggatata

SEQ ID NO: 574005 - DNA, 25 bp, Mus musculus
gctgtctgtgcattgtctggatata

SEQ ID NO: 574006 - DNA, 25 bp, Mus musculus
gctgtctgttcaatcaggtcttatc

SEQ ID NO: 574007 - DNA, 25 bp, Mus musculus
gctgtctgttcaatcttgttgtaaa

SEQ ID NO: 574008 - DNA, 25 bp, Mus musculus
gctgtctgttcattcaggtcttatc

SEQ ID NO: 574009 - DNA, 25 bp, Mus musculus
gctgtctgttcattcttgttgtaaa

SEQ ID NO: 574010 - DNA, 25 bp, Mus musculus
gctgtctgttcgagcatgcttaata

SEQ ID NO: 574011 - DNA, 25 bp, Mus musculus
gctgtctgttcgtgcatgcttaata

SEQ ID NO: 574012 - DNA, 25 bp, Mus musculus
gctgtcttatagcaccctgggctca

SEQ ID NO: 574013 - DNA, 25 bp, Mus musculus
gctgtcttataggaccctgggctca

SEQ ID NO: 574014 - DNA, 25 bp, Mus musculus
gctgtcttcaaccagggctgttatc

SEQ ID NO: 574015 - DNA, 25 bp, Mus musculus
gctgtcttcaacgagggctgttatc

SEQ ID NO: 574016 - DNA, 25 bp, Mus musculus
gctgtcttcaccagacgagaagcta

SEQ ID NO: 574017 - DNA, 25 bp, Mus musculus
gctgtcttcacctgacgagaagcta

SEQ ID NO: 574018 - DNA, 25 bp, Mus musculus
gctgtcttctgccttttacaaatca

SEQ ID NO: 574019 - DNA, 25 bp, Mus musculus
gctgtcttctgcgttttacaaatca

SEQ ID NO: 574020 - DNA, 25 bp, Mus musculus
gctgtcttctggcatcacaaaggca

SEQ ID NO: 574021 - DNA, 25 bp, Mus musculus
gctgtcttctgggatcacaaaggca

SEQ ID NO: 574022 - DNA, 25 bp, Mus musculus
gctgtcttctgtcgtggtccttgag

SEQ ID NO: 574023 - DNA, 25 bp, Mus musculus
gctgtcttctgtggtggtccttgag

SEQ ID NO: 574024 - DNA, 25 bp, Mus musculus
gctgtcttgaagagacctttgtcaa

SEQ ID NO: 574025 - DNA, 25 bp, Mus musculus
gctgtcttgaagtgacctttgtcaa

SEQ ID NO: 574026 - DNA, 25 bp, Mus musculus
gctgtcttgagcagatctgtacaca

SEQ ID NO: 574027 - DNA, 25 bp, Mus musculus
gctgtcttgagctgatctgtacaca

SEQ ID NO: 574028 - DNA, 25 bp, Mus musculus
gctgtcttgctcaacttcatattgt

SEQ ID NO: 574029 - DNA, 25 bp, Mus musculus
gctgtcttgctctacttcatattgt

SEQ ID NO: 574030 - DNA, 25 bp, Mus musculus
gctgtcttggtcataatgttttatc

SEQ ID NO: 574031 - DNA, 25 bp, Mus musculus
gctgtcttggtcttaatgttttatc

SEQ ID NO: 574032 - DNA, 25 bp, Mus musculus
gctgtctttaacatccacatggtgt

SEQ ID NO: 574033 - DNA, 25 bp, Mus musculus
gctgtctttaacttccacatggtgt

SEQ ID NO: 574034 - DNA, 25 bp, Mus musculus
gctgtctttaccacaatagttactt

SEQ ID NO: 574035 - DNA, 25 bp, Mus musculus
gctgtctttacctcaatagttactt

SEQ ID NO: 574036 - DNA, 25 bp, Mus musculus
gctgtctttctacaacacgcacata

SEQ ID NO: 574037 - DNA, 25 bp, Mus musculus
gctgtctttctagaacacgcacata

SEQ ID NO: 574038 - DNA, 25 bp, Mus musculus
gctgtcttttacacccttgaatttt

SEQ ID NO: 574039 - DNA, 25 bp, Mus musculus
gctgtcttttactcccttgaatttt

SEQ ID NO: 574040 - DNA, 25 bp, Mus musculus
gctgtcttttcgagtgtctggatgc

SEQ ID NO: 574041 - DNA, 25 bp, Mus musculus
gctgtcttttcgtgtgtctggatgc

SEQ ID NO: 574042 - DNA, 25 bp, Mus musculus
gctgtcttttctaaactctactcat

SEQ ID NO: 574043 - DNA, 25 bp, Mus musculus
gctgtcttttcttaactctactcat

SEQ ID NO: 574044 - DNA, 25 bp, Mus musculus
gctgtcttttgcatgaattctcatg

SEQ ID NO: 574045 - DNA, 25 bp, Mus musculus
gctgtcttttgcttgaattctcatg

SEQ ID NO: 574046 - DNA, 25 bp, Mus musculus
gctgtgaaaactcagccttctccat

SEQ ID NO: 574047 - DNA, 25 bp, Mus musculus
gctgtgaaaactccaaagctttaat

SEQ ID NO: 574048 - DNA, 25 bp, Mus musculus
gctgtgaaaactgagccttctccat

SEQ ID NO: 574049 - DNA, 25 bp, Mus musculus
gctgtgaaaactgcaaagctttaat

SEQ ID NO: 574050 - DNA, 25 bp, Mus musculus
gctgtgaaatacatgcctcaaaata

SEQ ID NO: 574051 - DNA, 25 bp, Mus musculus
gctgtgaaatacttgcctcaaaata

SEQ ID NO: 574052 - DNA, 25 bp, Mus musculus
gctgtgaacacaaggtgacatccac

SEQ ID NO: 574053 - DNA, 25 bp, Mus musculus
gctgtgaacacatggtgacatccac

SEQ ID NO: 574054 - DNA, 25 bp, Mus musculus
gctgtgaacagcactttctatcctt

SEQ ID NO: 574055 - DNA, 25 bp, Mus musculus
gctgtgaacagctctttctatcctt

SEQ ID NO: 574056 - DNA, 25 bp, Mus musculus
gctgtgaactagaccaaaggctctg

SEQ ID NO: 574057 - DNA, 25 bp, Mus musculus
gctgtgaactagattggtgtgacca

SEQ ID NO: 574058 - DNA, 25 bp, Mus musculus
gctgtgaactagtccaaaggctctg

SEQ ID NO: 574059 - DNA, 25 bp, Mus musculus
gctgtgaactagtttggtgtgacca

SEQ ID NO: 574060 - DNA, 25 bp, Mus musculus
gctgtgaactggctgctggaaatta

SEQ ID NO: 574061 - DNA, 25 bp, Mus musculus
gctgtgaactgggtgctggaaatta

SEQ ID NO: 574062 - DNA, 25 bp, Mus musculus
gctgtgaacttcataactttgtaag

SEQ ID NO: 574063 - DNA, 25 bp, Mus musculus
gctgtgaacttcttaactttgtaag

SEQ ID NO: 574064 - DNA, 25 bp, Mus musculus
gctgtgaagaaacactatggccact

SEQ ID NO: 574065 - DNA, 25 bp, Mus musculus
gctgtgaagaaagactatggccact

SEQ ID NO: 574066 - DNA, 25 bp, Mus musculus
gctgtgaagagcacccgttgaggtt

SEQ ID NO: 574067 - DNA, 25 bp, Mus musculus
gctgtgaagagctcccgttgaggtt

SEQ ID NO: 574068 - DNA, 25 bp, Mus musculus
gctgtgaagcagaagcagattcgtc

SEQ ID NO: 574069 - DNA, 25 bp, Mus musculus
gctgtgaagcagtagcagattcgtc

SEQ ID NO: 574070 - DNA, 25 bp, Mus musculus
gctgtgaaggcaaatgtccactcaa

SEQ ID NO: 574071 - DNA, 25 bp, Mus musculus
gctgtgaaggcatatgtccactcaa

SEQ ID NO: 574072 - DNA, 25 bp, Mus musculus
gctgtgaaggctcactgtgactaat

SEQ ID NO: 574073 - DNA, 25 bp, Mus musculus
gctgtgaaggctgactgtgactaat

SEQ ID NO: 574074 - DNA, 25 bp, Mus musculus
gctgtgaaggtacctagaagcccaa

SEQ ID NO: 574075 - DNA, 25 bp, Mus musculus
gctgtgaaggtagctagaagcccaa

SEQ ID NO: 574076 - DNA, 25 bp, Mus musculus
gctgtgaagtcaccgctccgactga

SEQ ID NO: 574077 - DNA, 25 bp, Mus musculus
gctgtgaagtcagcgctccgactga

SEQ ID NO: 574078 - DNA, 25 bp, Mus musculus
gctgtgaatatccacgttttttttt

SEQ ID NO: 574079 - DNA, 25 bp, Mus musculus
gctgtgaatatcgacgttttttttt

SEQ ID NO: 574080 - DNA, 25 bp, Mus musculus
gctgtgacagctcatcacttaaaac

SEQ ID NO: 574081 - DNA, 25 bp, Mus musculus
gctgtgacagctgatcacttaaaac

SEQ ID NO: 574082 - DNA, 25 bp, Mus musculus
gctgtgaccagaactacctcatact

SEQ ID NO: 574083 - DNA, 25 bp, Mus musculus
gctgtgaccagatctacctcatact

SEQ ID NO: 574084 - DNA, 25 bp, Mus musculus
gctgtgaccagtaagcaggcactgt

SEQ ID NO: 574085 - DNA, 25 bp, Mus musculus
gctgtgaccagttagcaggcactgt

SEQ ID NO: 574086 - DNA, 25 bp, Mus musculus
gctgtgacccctcccgtcacagggc

SEQ ID NO: 574087 - DNA, 25 bp, Mus musculus
gctgtgacccctgccgtcacagggc

SEQ ID NO: 574088 - DNA, 25 bp, Mus musculus
gctgtgacctatacaactttgagat

SEQ ID NO: 574089 - DNA, 25 bp, Mus musculus
gctgtgacctattcaactttgagat

SEQ ID NO: 574090 - DNA, 25 bp, Mus musculus
gctgtgacctgaattgtattttcct

SEQ ID NO: 574091 - DNA, 25 bp, Mus musculus
gctgtgacctgatttgtattttcct

SEQ ID NO: 574092 - DNA, 25 bp, Mus musculus
gctgtgacctgcaattttattcctt

SEQ ID NO: 574093 - DNA, 25 bp, Mus musculus
gctgtgacctgctattttattcctt

SEQ ID NO: 574094 - DNA, 25 bp, Mus musculus
gctgtgactaccagtgaactctgta

SEQ ID NO: 574095 - DNA, 25 bp, Mus musculus
gctgtgactacctgtgaactctgta

SEQ ID NO: 574096 - DNA, 25 bp, Mus musculus
gctgtgactcttagcggactttgcc

SEQ ID NO: 574097 - DNA, 25 bp, Mus musculus
gctgtgactctttgcggactttgcc

SEQ ID NO: 574098 - DNA, 25 bp, Mus musculus
gctgtgactgctcaggtggaatcca

SEQ ID NO: 574099 - DNA, 25 bp, Mus musculus
gctgtgactgctgaggtggaatcca

SEQ ID NO: 574100 - DNA, 25 bp, Mus musculus
gctgtgacttggctgtcaataaaga

SEQ ID NO: 574101 - DNA, 25 bp, Mus musculus
gctgtgacttgggtgtcaataaaga

SEQ ID NO: 574102 - DNA, 25 bp, Mus musculus
gctgtgactttgatatgctcagaat

SEQ ID NO: 574103 - DNA, 25 bp, Mus musculus
gctgtgactttgttatgctcagaat

SEQ ID NO: 574104 - DNA, 25 bp, Mus musculus
gctgtgagaaatcttgagaactcta

SEQ ID NO: 574105 - DNA, 25 bp, Mus musculus
gctgtgagaaatgttgagaactcta

SEQ ID NO: 574106 - DNA, 25 bp, Mus musculus
gctgtgagaattcttataacatctg

SEQ ID NO: 574107 - DNA, 25 bp, Mus musculus
gctgtgagaattgttataacatctg

SEQ ID NO: 574108 - DNA, 25 bp, Mus musculus
gctgtgagacttccatttaagattc

SEQ ID NO: 574109 - DNA, 25 bp, Mus musculus
gctgtgagacttcgcatccatatgc

SEQ ID NO: 574110 - DNA, 25 bp, Mus musculus
gctgtgagacttgcatttaagattc

SEQ ID NO: 574111 - DNA, 25 bp, Mus musculus
gctgtgagacttggcatccatatgc

SEQ ID NO: 574112 - DNA, 25 bp, Mus musculus
gctgtgagagctctgttggtttaaa

SEQ ID NO: 574113 - DNA, 25 bp, Mus musculus
gctgtgagagctgtgttggtttaaa

SEQ ID NO: 574114 - DNA, 25 bp, Mus musculus
gctgtgagagtaaaacttcatgctt

SEQ ID NO: 574115 - DNA, 25 bp, Mus musculus
gctgtgagagtataacttcatgctt

SEQ ID NO: 574116 - DNA, 25 bp, Mus musculus
gctgtgagcagaagacggtttacca

SEQ ID NO: 574117 - DNA, 25 bp, Mus musculus
gctgtgagcagatgacggtttacca

SEQ ID NO: 574118 - DNA, 25 bp, Mus musculus
gctgtgagcatcagatgtaacaaat

SEQ ID NO: 574119 - DNA, 25 bp, Mus musculus
gctgtgagcatctgatgtaacaaat

SEQ ID NO: 574120 - DNA, 25 bp, Mus musculus
gctgtgagccagaatgcccaagccc

SEQ ID NO: 574121 - DNA, 25 bp, Mus musculus
gctgtgagccagcagagttgcccac

SEQ ID NO: 574122 - DNA, 25 bp, Mus musculus
gctgtgagccaggagagttgcccac

SEQ ID NO: 574123 - DNA, 25 bp, Mus musculus
gctgtgagccagtatgcccaagccc

SEQ ID NO: 574124 - DNA, 25 bp, Mus musculus
gctgtgagctgaacctctctgaaaa

SEQ ID NO: 574125 - DNA, 25 bp, Mus musculus
gctgtgagctgatcctctctgaaaa

SEQ ID NO: 574126 - DNA, 25 bp, Mus musculus
gctgtgagcttcagggccattctgt

SEQ ID NO: 574127 - DNA, 25 bp, Mus musculus
gctgtgagcttctgggccattctgt

SEQ ID NO: 574128 - DNA, 25 bp, Mus musculus
gctgtgaggagtagtcttcaccgtc

SEQ ID NO: 574129 - DNA, 25 bp, Mus musculus
gctgtgaggagtccccacgccaaag

SEQ ID NO: 574130 - DNA, 25 bp, Mus musculus
gctgtgaggagtgcccacgccaaag

SEQ ID NO: 574131 - DNA, 25 bp, Mus musculus
gctgtgaggagttgtcttcaccgtc

SEQ ID NO: 574132 - DNA, 25 bp, Mus musculus
gctgtgagggtcaccagagcaggct

SEQ ID NO: 574133 - DNA, 25 bp, Mus musculus
gctgtgagggtctccagagcaggct

SEQ ID NO: 574134 - DNA, 25 bp, Mus musculus
gctgtgaggtctcagtgatctgcat

SEQ ID NO: 574135 - DNA, 25 bp, Mus musculus
gctgtgaggtctgagtgatctgcat

SEQ ID NO: 574136 - DNA, 25 bp, Mus musculus
gctgtgagtatgatctccaggactt

SEQ ID NO: 574137 - DNA, 25 bp, Mus musculus
gctgtgagtatgttctccaggactt

SEQ ID NO: 574138 - DNA, 25 bp, Mus musculus
gctgtgagtcttcgagacactccat

SEQ ID NO: 574139 - DNA, 25 bp, Mus musculus
gctgtgagtcttggagacactccat

SEQ ID NO: 574140 - DNA, 25 bp, Mus musculus
gctgtgagtggaaccgagcctgcat

SEQ ID NO: 574141 - DNA, 25 bp, Mus musculus
gctgtgagtggatccgagcctgcat

SEQ ID NO: 574142 - DNA, 25 bp, Mus musculus
gctgtgataataaacggcctggtga

SEQ ID NO: 574143 - DNA, 25 bp, Mus musculus
gctgtgataatatacggcctggtga

SEQ ID NO: 574144 - DNA, 25 bp, Mus musculus
gctgtgataattccaggcccaggct

SEQ ID NO: 574145 - DNA, 25 bp, Mus musculus
gctgtgataattgcaggcccaggct

SEQ ID NO: 574146 - DNA, 25 bp, Mus musculus
gctgtgatacacattttagttctgt

SEQ ID NO: 574147 - DNA, 25 bp, Mus musculus
gctgtgatacaccaacccaaagtca

SEQ ID NO: 574148 - DNA, 25 bp, Mus musculus
gctgtgatacacgaacccaaagtca

SEQ ID NO: 574149 - DNA, 25 bp, Mus musculus
gctgtgatacactttttagttctgt

SEQ ID NO: 574150 - DNA, 25 bp, Mus musculus
gctgtgatacatatccactcgtgtt

SEQ ID NO: 574151 - DNA, 25 bp, Mus musculus
gctgtgatacatttccactcgtgtt

SEQ ID NO: 574152 - DNA, 25 bp, Mus musculus
gctgtgatacttactagtaactttt

SEQ ID NO: 574153 - DNA, 25 bp, Mus musculus
gctgtgatactttctagtaactttt

SEQ ID NO: 574154 - DNA, 25 bp, Mus musculus
gctgtgatagtcactacttagtgga

SEQ ID NO: 574155 - DNA, 25 bp, Mus musculus
gctgtgatagtcatacactctctgc

SEQ ID NO: 574156 - DNA, 25 bp, Mus musculus
gctgtgatagtctctacttagtgga

SEQ ID NO: 574157 - DNA, 25 bp, Mus musculus
gctgtgatagtcttacactctctgc

SEQ ID NO: 574158 - DNA, 25 bp, Mus musculus
gctgtgatattaaaggaacgaccta

SEQ ID NO: 574159 - DNA, 25 bp, Mus musculus
gctgtgatattataggaacgaccta

SEQ ID NO: 574160 - DNA, 25 bp, Mus musculus
gctgtgatatttccaatgactgtag

SEQ ID NO: 574161 - DNA, 25 bp, Mus musculus
gctgtgatatttgcaatgactgtag

SEQ ID NO: 574162 - DNA, 25 bp, Mus musculus
gctgtgatcccaaattctttttgtt

SEQ ID NO: 574163 - DNA, 25 bp, Mus musculus
gctgtgatcccatattctttttgtt

SEQ ID NO: 574164 - DNA, 25 bp, Mus musculus
gctgtgatctagagttttaacaaag

SEQ ID NO: 574165 - DNA, 25 bp, Mus musculus
gctgtgatctagtgttttaacaaag

SEQ ID NO: 574166 - DNA, 25 bp, Mus musculus
gctgtgatctcgcagctggcgaaca

SEQ ID NO: 574167 - DNA, 25 bp, Mus musculus
gctgtgatctcggagctggcgaaca

SEQ ID NO: 574168 - DNA, 25 bp, Mus musculus
gctgtgatgcttaatgctctactaa

SEQ ID NO: 574169 - DNA, 25 bp, Mus musculus
gctgtgatgctttatgctctactaa

SEQ ID NO: 574170 - DNA, 25 bp, Mus musculus
gctgtgatggccatagcatgttatc

SEQ ID NO: 574171 - DNA, 25 bp, Mus musculus
gctgtgatggcccagcttcatgctg

SEQ ID NO: 574172 - DNA, 25 bp, Mus musculus
gctgtgatggccgagcttcatgctg

SEQ ID NO: 574173 - DNA, 25 bp, Mus musculus
gctgtgatggccttagcatgttatc

SEQ ID NO: 574174 - DNA, 25 bp, Mus musculus
gctgtgatgtccagggaccacatgt

SEQ ID NO: 574175 - DNA, 25 bp, Mus musculus
gctgtgatgtcctgggaccacatgt

SEQ ID NO: 574176 - DNA, 25 bp, Mus musculus
gctgtgattaagcatctactactac

SEQ ID NO: 574177 - DNA, 25 bp, Mus musculus
gctgtgattaaggatctactactac

SEQ ID NO: 574178 - DNA, 25 bp, Mus musculus
gctgtgattaatccatccagattgt

SEQ ID NO: 574179 - DNA, 25 bp, Mus musculus
gctgtgattaatgcatccagattgt

SEQ ID NO: 574180 - DNA, 25 bp, Mus musculus
gctgtgattacacgcttatgtcagt

SEQ ID NO: 574181 - DNA, 25 bp, Mus musculus
gctgtgattacaggcttatgtcagt

SEQ ID NO: 574182 - DNA, 25 bp, Mus musculus
gctgtgattaggaccccttatggca

SEQ ID NO: 574183 - DNA, 25 bp, Mus musculus
gctgtgattaggtccccttatggca

SEQ ID NO: 574184 - DNA, 25 bp, Mus musculus
gctgtgattattcgccctgcaagag

SEQ ID NO: 574185 - DNA, 25 bp, Mus musculus
gctgtgattattggccctgcaagag

SEQ ID NO: 574186 - DNA, 25 bp, Mus musculus
gctgtgattctgaggagagtgtcca

SEQ ID NO: 574187 - DNA, 25 bp, Mus musculus
gctgtgattctgtggagagtgtcca

SEQ ID NO: 574188 - DNA, 25 bp, Mus musculus
gctgtgattgttagtgtgccattca

SEQ ID NO: 574189 - DNA, 25 bp, Mus musculus
gctgtgattgtttgtgtgccattca

SEQ ID NO: 574190 - DNA, 25 bp, Mus musculus
gctgtgatttcccaggtcctgggcc

SEQ ID NO: 574191 - DNA, 25 bp, Mus musculus
gctgtgatttccgaggtcctgggcc

SEQ ID NO: 574192 - DNA, 25 bp, Mus musculus
gctgtgatttttcccccagagaaga

SEQ ID NO: 574193 - DNA, 25 bp, Mus musculus
gctgtgatttttgccccagagaaga

SEQ ID NO: 574194 - DNA, 25 bp, Mus musculus
gctgtgcaacgcagcccttaaaaga

SEQ ID NO: 574195 - DNA, 25 bp, Mus musculus
gctgtgcaacgctgcccttaaaaga

SEQ ID NO: 574196 - DNA, 25 bp, Mus musculus
gctgtgcaatgacttccagccactc

SEQ ID NO: 574197 - DNA, 25 bp, Mus musculus
gctgtgcaatgagttccagccactc

SEQ ID NO: 574198 - DNA, 25 bp, Mus musculus
gctgtgcaccgcagctgtcttactg

SEQ ID NO: 574199 - DNA, 25 bp, Mus musculus
gctgtgcaccgctgctgtcttactg

SEQ ID NO: 574200 - DNA, 25 bp, Mus musculus
gctgtgcactatatatagtccatgg

SEQ ID NO: 574201 - DNA, 25 bp, Mus musculus
gctgtgcactatttatagtccatgg

SEQ ID NO: 574202 - DNA, 25 bp, Mus musculus
gctgtgcactcaatcagtggaatat

SEQ ID NO: 574203 - DNA, 25 bp, Mus musculus
gctgtgcactcattcagtggaatat

SEQ ID NO: 574204 - DNA, 25 bp, Mus musculus
gctgtgcagagcacatttagttcca

SEQ ID NO: 574205 - DNA, 25 bp, Mus musculus
gctgtgcagagctcatttagttcca

SEQ ID NO: 574206 - DNA, 25 bp, Mus musculus
gctgtgcatacccatgccaggctaa

SEQ ID NO: 574207 - DNA, 25 bp, Mus musculus
gctgtgcataccgatgccaggctaa

SEQ ID NO: 574208 - DNA, 25 bp, Mus musculus
gctgtgcatagaattcccattgaga

SEQ ID NO: 574209 - DNA, 25 bp, Mus musculus
gctgtgcatagatttcccattgaga

SEQ ID NO: 574210 - DNA, 25 bp, Mus musculus
gctgtgcatataccactgctgatca

SEQ ID NO: 574211 - DNA, 25 bp, Mus musculus
gctgtgcatatagcactgctgatca

SEQ ID NO: 574212 - DNA, 25 bp, Mus musculus
gctgtgcatgcactgacgagaaaca

SEQ ID NO: 574213 - DNA, 25 bp, Mus musculus
gctgtgcatgcagtgacgagaaaca

SEQ ID NO: 574214 - DNA, 25 bp, Mus musculus
gctgtgcattacaaaaggtatgagt

SEQ ID NO: 574215 - DNA, 25 bp, Mus musculus
gctgtgcattactaaaggtatgagt

SEQ ID NO: 574216 - DNA, 25 bp, Mus musculus
gctgtgcattctcccaaacagccat

SEQ ID NO: 574217 - DNA, 25 bp, Mus musculus
gctgtgcattctgccaaacagccat

SEQ ID NO: 574218 - DNA, 25 bp, Mus musculus
gctgtgcatttacccactgagcaat

SEQ ID NO: 574219 - DNA, 25 bp, Mus musculus
gctgtgcatttagccactgagcaat

SEQ ID NO: 574220 - DNA, 25 bp, Mus musculus
gctgtgccaaccctaagagaatcaa

SEQ ID NO: 574221 - DNA, 25 bp, Mus musculus
gctgtgccaaccgtaagagaatcaa

SEQ ID NO: 574222 - DNA, 25 bp, Mus musculus
gctgtgccaagtcaggacccaaatt

SEQ ID NO: 574223 - DNA, 25 bp, Mus musculus
gctgtgccaagtgaggacccaaatt

SEQ ID NO: 574224 - DNA, 25 bp, Mus musculus
gctgtgccagctagggatcagccca

SEQ ID NO: 574225 - DNA, 25 bp, Mus musculus
gctgtgccagcttgggatcagccca

SEQ ID NO: 574226 - DNA, 25 bp, Mus musculus
gctgtgccaggacactaggaaagta

SEQ ID NO: 574227 - DNA, 25 bp, Mus musculus
gctgtgccaggagactaggaaagta

SEQ ID NO: 574228 - DNA, 25 bp, Mus musculus
gctgtgccagggagagtttcctctg

SEQ ID NO: 574229 - DNA, 25 bp, Mus musculus
gctgtgccagggtgagtttcctctg

SEQ ID NO: 574230 - DNA, 25 bp, Mus musculus
gctgtgccatataaagtcttctttg

SEQ ID NO: 574231 - DNA, 25 bp, Mus musculus
gctgtgccatattaagtcttctttg

SEQ ID NO: 574232 - DNA, 25 bp, Mus musculus
gctgtgccatgtcgccgggaaggac

SEQ ID NO: 574233 - DNA, 25 bp, Mus musculus
gctgtgccatgtggccgggaaggac

SEQ ID NO: 574234 - DNA, 25 bp, Mus musculus
gctgtgcccacaatatttctctata

SEQ ID NO: 574235 - DNA, 25 bp, Mus musculus
gctgtgcccacattatttctctata

SEQ ID NO: 574236 - DNA, 25 bp, Mus musculus
gctgtgcccactactgcttttgtaa

SEQ ID NO: 574237 - DNA, 25 bp, Mus musculus
gctgtgcccacttctgcttttgtaa

SEQ ID NO: 574238 - DNA, 25 bp, Mus musculus
gctgtgccccacatgattttgtttt

SEQ ID NO: 574239 - DNA, 25 bp, Mus musculus
gctgtgccccacttgattttgtttt

SEQ ID NO: 574240 - DNA, 25 bp, Mus musculus
gctgtgcccctaagtagcgtttaga

SEQ ID NO: 574241 - DNA, 25 bp, Mus musculus
gctgtgcccctatgtagcgtttaga

SEQ ID NO: 574242 - DNA, 25 bp, Mus musculus
gctgtgcccctgaatggtgggacaa

SEQ ID NO: 574243 - DNA, 25 bp, Mus musculus
gctgtgcccctgtatggtgggacaa

SEQ ID NO: 574244 - DNA, 25 bp, Mus musculus
gctgtgcctcgtatcctaaacaaaa

SEQ ID NO: 574245 - DNA, 25 bp, Mus musculus
gctgtgcctcgtttcctaaacaaaa

SEQ ID NO: 574246 - DNA, 25 bp, Mus musculus
gctgtgcctgatcacatactgactg

SEQ ID NO: 574247 - DNA, 25 bp, Mus musculus
gctgtgcctgatgacatactgactg

SEQ ID NO: 574248 - DNA, 25 bp, Mus musculus
gctgtgcctggcagttgtattttta

SEQ ID NO: 574249 - DNA, 25 bp, Mus musculus
gctgtgcctggctgttgtattttta

SEQ ID NO: 574250 - DNA, 25 bp, Mus musculus
gctgtgcctgggagagcatccttga

SEQ ID NO: 574251 - DNA, 25 bp, Mus musculus
gctgtgcctgggtgagcatccttga

SEQ ID NO: 574252 - DNA, 25 bp, Mus musculus
gctgtgcctgtgaactggtggtata

SEQ ID NO: 574253 - DNA, 25 bp, Mus musculus
gctgtgcctgtgaggattcaaaaga

SEQ ID NO: 574254 - DNA, 25 bp, Mus musculus
gctgtgcctgtgtactggtggtata

SEQ ID NO: 574255 - DNA, 25 bp, Mus musculus
gctgtgcctgtgtggattcaaaaga

SEQ ID NO: 574256 - DNA, 25 bp, Mus musculus
gctgtgcctgttagttgcagatcag

SEQ ID NO: 574257 - DNA, 25 bp, Mus musculus
gctgtgcctgtttgttgcagatcag

SEQ ID NO: 574258 - DNA, 25 bp, Mus musculus
gctgtgcgacagaaagcgcctgtaa

SEQ ID NO: 574259 - DNA, 25 bp, Mus musculus
gctgtgcgacagtaagcgcctgtaa

SEQ ID NO: 574260 - DNA, 25 bp, Mus musculus
gctgtgcgagctagagatccggatt

SEQ ID NO: 574261 - DNA, 25 bp, Mus musculus
gctgtgcgagcttgagatccggatt

SEQ ID NO: 574262 - DNA, 25 bp, Mus musculus
gctgtgcgcagtaggattcttggat

SEQ ID NO: 574263 - DNA, 25 bp, Mus musculus
gctgtgcgcagttggattcttggat

SEQ ID NO: 574264 - DNA, 25 bp, Mus musculus
gctgtgcgggcaaaaatctccaacc

SEQ ID NO: 574265 - DNA, 25 bp, Mus musculus
gctgtgcgggcataaatctccaacc

SEQ ID NO: 574266 - DNA, 25 bp, Mus musculus
gctgtgcgtacaactatttccttag

SEQ ID NO: 574267 - DNA, 25 bp, Mus musculus
gctgtgcgtacatctatttccttag

SEQ ID NO: 574268 - DNA, 25 bp, Mus musculus
gctgtgcgtttcaggagtggatact

SEQ ID NO: 574269 - DNA, 25 bp, Mus musculus
gctgtgcgtttctggagtggatact

SEQ ID NO: 574270 - DNA, 25 bp, Mus musculus
gctgtgctaaacatgtgaaatacat

SEQ ID NO: 574271 - DNA, 25 bp, Mus musculus
gctgtgctaaacttgtgaaatacat

SEQ ID NO: 574272 - DNA, 25 bp, Mus musculus
gctgtgctacacagggttctttgtt

SEQ ID NO: 574273 - DNA, 25 bp, Mus musculus
gctgtgctacactgggttctttgtt

SEQ ID NO: 574274 - DNA, 25 bp, Mus musculus
gctgtgctaccaatttggctgttta

SEQ ID NO: 574275 - DNA, 25 bp, Mus musculus
gctgtgctaccattttggctgttta

SEQ ID NO: 574276 - DNA, 25 bp, Mus musculus
gctgtgctagcaaaagaatctgagt

SEQ ID NO: 574277 - DNA, 25 bp, Mus musculus
gctgtgctagcataagaatctgagt

SEQ ID NO: 574278 - DNA, 25 bp, Mus musculus
gctgtgctatacatacacacttgta

SEQ ID NO: 574279 - DNA, 25 bp, Mus musculus
gctgtgctatacttacacacttgta

SEQ ID NO: 574280 - DNA, 25 bp, Mus musculus
gctgtgctatgtatgttgatggacc

SEQ ID NO: 574281 - DNA, 25 bp, Mus musculus
gctgtgctatgtttgttgatggacc

SEQ ID NO: 574282 - DNA, 25 bp, Mus musculus
gctgtgctattcaataggattccat

SEQ ID NO: 574283 - DNA, 25 bp, Mus musculus
gctgtgctattctataggattccat

SEQ ID NO: 574284 - DNA, 25 bp, Mus musculus
gctgtgctcaacactgtgccttgga

SEQ ID NO: 574285 - DNA, 25 bp, Mus musculus
gctgtgctcaactctgtgccttgga

SEQ ID NO: 574286 - DNA, 25 bp, Mus musculus
gctgtgctcactaaacttctctaga

SEQ ID NO: 574287 - DNA, 25 bp, Mus musculus
gctgtgctcacttaacttctctaga

SEQ ID NO: 574288 - DNA, 25 bp, Mus musculus
gctgtgctcagcctactgattttta

SEQ ID NO: 574289 - DNA, 25 bp, Mus musculus
gctgtgctcagcgtactgattttta

SEQ ID NO: 574290 - DNA, 25 bp, Mus musculus
gctgtgctcaggctgtacatttgaa

SEQ ID NO: 574291 - DNA, 25 bp, Mus musculus
gctgtgctcagggtgtacatttgaa

SEQ ID NO: 574292 - DNA, 25 bp, Mus musculus
gctgtgctgagcaccttggaagagt

SEQ ID NO: 574293 - DNA, 25 bp, Mus musculus
gctgtgctgagctccttggaagagt

SEQ ID NO: 574294 - DNA, 25 bp, Mus musculus
gctgtgctgaggccccacctagtga

SEQ ID NO: 574295 - DNA, 25 bp, Mus musculus
gctgtgctgagggcccacctagtga

SEQ ID NO: 574296 - DNA, 25 bp, Mus musculus
gctgtgctgatgaagtcacggcgta

SEQ ID NO: 574297 - DNA, 25 bp, Mus musculus
gctgtgctgatgtagtcacggcgta

SEQ ID NO: 574298 - DNA, 25 bp, Mus musculus
gctgtgctgccacagaaatatccct

SEQ ID NO: 574299 - DNA, 25 bp, Mus musculus
gctgtgctgccagagaaatatccct

SEQ ID NO: 574300 - DNA, 25 bp, Mus musculus
gctgtgctgcctatgaggacacaag

SEQ ID NO: 574301 - DNA, 25 bp, Mus musculus
gctgtgctgcctttgaggacacaag

SEQ ID NO: 574302 - DNA, 25 bp, Mus musculus
gctgtgctgcggcaagaatccactg

SEQ ID NO: 574303 - DNA, 25 bp, Mus musculus
gctgtgctgcgggaagaatccactg

SEQ ID NO: 574304 - DNA, 25 bp, Mus musculus
gctgtgctgcttatgagcctcagac

SEQ ID NO: 574305 - DNA, 25 bp, Mus musculus
gctgtgctgcttcctggactagaat

SEQ ID NO: 574306 - DNA, 25 bp, Mus musculus
gctgtgctgcttgctggactagaat

SEQ ID NO: 574307 - DNA, 25 bp, Mus musculus
gctgtgctgcttttgagcctcagac

SEQ ID NO: 574308 - DNA, 25 bp, Mus musculus
gctgtgctggcaaacgaattctagg

SEQ ID NO: 574309 - DNA, 25 bp, Mus musculus
gctgtgctggcatacgaattctagg

SEQ ID NO: 574310 - DNA, 25 bp, Mus musculus
gctgtgctgggtcacttttcatatc

SEQ ID NO: 574311 - DNA, 25 bp, Mus musculus
gctgtgctgggtgacttttcatatc

SEQ ID NO: 574312 - DNA, 25 bp, Mus musculus
gctgtgctgtagctagttcaggtac

SEQ ID NO: 574313 - DNA, 25 bp, Mus musculus
gctgtgctgtaggtagttcaggtac

SEQ ID NO: 574314 - DNA, 25 bp, Mus musculus
gctgtgctgtcaagcctaggatagc

SEQ ID NO: 574315 - DNA, 25 bp, Mus musculus
gctgtgctgtcatgcctaggatagc

SEQ ID NO: 574316 - DNA, 25 bp, Mus musculus
gctgtgctgtcccaggtagtcctaa

SEQ ID NO: 574317 - DNA, 25 bp, Mus musculus
gctgtgctgtccgaggtagtcctaa

SEQ ID NO: 574318 - DNA, 25 bp, Mus musculus
gctgtgctgttactagaggtccctt

SEQ ID NO: 574319 - DNA, 25 bp, Mus musculus
gctgtgctgttagtagaggtccctt

SEQ ID NO: 574320 - DNA, 25 bp, Mus musculus
gctgtgcttagcatccaagtagagg

SEQ ID NO: 574321 - DNA, 25 bp, Mus musculus
gctgtgcttagcttccaagtagagg

SEQ ID NO: 574322 - DNA, 25 bp, Mus musculus
gctgtgcttccaatgtgtccaagga

SEQ ID NO: 574323 - DNA, 25 bp, Mus musculus
gctgtgcttccattgtgtccaagga

SEQ ID NO: 574324 - DNA, 25 bp, Mus musculus
gctgtgcttctgagcgctgagaata

SEQ ID NO: 574325 - DNA, 25 bp, Mus musculus
gctgtgcttctgagtaaagtgtgca

SEQ ID NO: 574326 - DNA, 25 bp, Mus musculus
gctgtgcttctgtgcgctgagaata

SEQ ID NO: 574327 - DNA, 25 bp, Mus musculus
gctgtgcttctgtgtaaagtgtgca

SEQ ID NO: 574328 - DNA, 25 bp, Mus musculus
gctgtgcttgtaacttgaatttcca

SEQ ID NO: 574329 - DNA, 25 bp, Mus musculus
gctgtgcttgtaatgccatgtgtgt

SEQ ID NO: 574330 - DNA, 25 bp, Mus musculus
gctgtgcttgtatcttgaatttcca

SEQ ID NO: 574331 - DNA, 25 bp, Mus musculus
gctgtgcttgtattgccatgtgtgt

SEQ ID NO: 574332 - DNA, 25 bp, Mus musculus
gctgtgctttgactttcctgaacaa

SEQ ID NO: 574333 - DNA, 25 bp, Mus musculus
gctgtgctttgagtttcctgaacaa

SEQ ID NO: 574334 - DNA, 25 bp, Mus musculus
gctgtggaaaagcatgaggactact

SEQ ID NO: 574335 - DNA, 25 bp, Mus musculus
gctgtggaaaaggatgaggactact

SEQ ID NO: 574336 - DNA, 25 bp, Mus musculus
gctgtggaaaccagaacttcgcttg

SEQ ID NO: 574337 - DNA, 25 bp, Mus musculus
gctgtggaaacctgaacttcgcttg

SEQ ID NO: 574338 - DNA, 25 bp, Mus musculus
gctgtggaacttatgttttcactca

SEQ ID NO: 574339 - DNA, 25 bp, Mus musculus
gctgtggaacttttgttttcactca

SEQ ID NO: 574340 - DNA, 25 bp, Mus musculus
gctgtggaccttccggcagctcaaa

SEQ ID NO: 574341 - DNA, 25 bp, Mus musculus
gctgtggaccttgcggcagctcaaa

SEQ ID NO: 574342 - DNA, 25 bp, Mus musculus
gctgtggacgtgcattgtgatacca

SEQ ID NO: 574343 - DNA, 25 bp, Mus musculus
gctgtggacgtggattgtgatacca

SEQ ID NO: 574344 - DNA, 25 bp, Mus musculus
gctgtggactgcactgtattaggct

SEQ ID NO: 574345 - DNA, 25 bp, Mus musculus
gctgtggactgctctgtattaggct

SEQ ID NO: 574346 - DNA, 25 bp, Mus musculus
gctgtggactggaattcgtgcttca

SEQ ID NO: 574347 - DNA, 25 bp, Mus musculus
gctgtggactggtattcgtgcttca

SEQ ID NO: 574348 - DNA, 25 bp, Mus musculus
gctgtggactgtctgcccaatgaga

SEQ ID NO: 574349 - DNA, 25 bp, Mus musculus
gctgtggactgtgtgcccaatgaga

SEQ ID NO: 574350 - DNA, 25 bp, Mus musculus
gctgtggagaagagctactgcctgc

SEQ ID NO: 574351 - DNA, 25 bp, Mus musculus
gctgtggagaagtgctactgcctgc

SEQ ID NO: 574352 - DNA, 25 bp, Mus musculus
gctgtggagatcctcacactcagat

SEQ ID NO: 574353 - DNA, 25 bp, Mus musculus
gctgtggagatcgtcacactcagat

SEQ ID NO: 574354 - DNA, 25 bp, Mus musculus
gctgtggagcagacttctctgagga

SEQ ID NO: 574355 - DNA, 25 bp, Mus musculus
gctgtggagcagtcttctctgagga

SEQ ID NO: 574356 - DNA, 25 bp, Mus musculus
gctgtggagttcaaaatcgcttctg

SEQ ID NO: 574357 - DNA, 25 bp, Mus musculus
gctgtggagttctaaatcgcttctg

SEQ ID NO: 574358 - DNA, 25 bp, Mus musculus
gctgtggatataatggcctgggtat

SEQ ID NO: 574359 - DNA, 25 bp, Mus musculus
gctgtggatatattggcctgggtat

SEQ ID NO: 574360 - DNA, 25 bp, Mus musculus
gctgtggatgtgcagtctttcctaa

SEQ ID NO: 574361 - DNA, 25 bp, Mus musculus
gctgtggatgtggagtctttcctaa

SEQ ID NO: 574362 - DNA, 25 bp, Mus musculus
gctgtggatgttctgataattctct

SEQ ID NO: 574363 - DNA, 25 bp, Mus musculus
gctgtggatgttgtgataattctct

SEQ ID NO: 574364 - DNA, 25 bp, Mus musculus
gctgtggcaaaaataacctttctaa

SEQ ID NO: 574365 - DNA, 25 bp, Mus musculus
gctgtggcaaaattaacctttctaa

SEQ ID NO: 574366 - DNA, 25 bp, Mus musculus
gctgtggcacagcaggtcactctga

SEQ ID NO: 574367 - DNA, 25 bp, Mus musculus
gctgtggcacaggaggtcactctga

SEQ ID NO: 574368 - DNA, 25 bp, Mus musculus
gctgtggcacataggcaaacatgct

SEQ ID NO: 574369 - DNA, 25 bp, Mus musculus
gctgtggcacattggcaaacatgct

SEQ ID NO: 574370 - DNA, 25 bp, Mus musculus
gctgtggcactaaataacgctgaat

SEQ ID NO: 574371 - DNA, 25 bp, Mus musculus
gctgtggcactatataacgctgaat

SEQ ID NO: 574372 - DNA, 25 bp, Mus musculus
gctgtggcagagaattcacaacctg

SEQ ID NO: 574373 - DNA, 25 bp, Mus musculus
gctgtggcagagtattcacaacctg

SEQ ID NO: 574374 - DNA, 25 bp, Mus musculus
gctgtggcagccatgactgggtact

SEQ ID NO: 574375 - DNA, 25 bp, Mus musculus
gctgtggcagccttgactgggtact

SEQ ID NO: 574376 - DNA, 25 bp, Mus musculus
gctgtggcaggcagaaatgataata

SEQ ID NO: 574377 - DNA, 25 bp, Mus musculus
gctgtggcaggctgaaatgataata

SEQ ID NO: 574378 - DNA, 25 bp, Mus musculus
gctgtggcagtaactcatacgtcct

SEQ ID NO: 574379 - DNA, 25 bp, Mus musculus
gctgtggcagtatctcatacgtcct

SEQ ID NO: 574380 - DNA, 25 bp, Mus musculus
gctgtggccaaaagccccgtatcaa

SEQ ID NO: 574381 - DNA, 25 bp, Mus musculus
gctgtggccaaatgccccgtatcaa

SEQ ID NO: 574382 - DNA, 25 bp, Mus musculus
gctgtggccagaacagtgcctgtgt

SEQ ID NO: 574383 - DNA, 25 bp, Mus musculus
gctgtggccagatcagtgcctgtgt

SEQ ID NO: 574384 - DNA, 25 bp, Mus musculus
gctgtggccatcattaaagctctgg

SEQ ID NO: 574385 - DNA, 25 bp, Mus musculus
gctgtggccatcattttctttgcct

SEQ ID NO: 574386 - DNA, 25 bp, Mus musculus
gctgtggccatctttaaagctctgg

SEQ ID NO: 574387 - DNA, 25 bp, Mus musculus
gctgtggccatctttttctttgcct

SEQ ID NO: 574388 - DNA, 25 bp, Mus musculus
gctgtggcccaacggcacgtacaaa

SEQ ID NO: 574389 - DNA, 25 bp, Mus musculus
gctgtggcccaagggcacgtacaaa

SEQ ID NO: 574390 - DNA, 25 bp, Mus musculus
gctgtggcccctcaagctcagggaa

SEQ ID NO: 574391 - DNA, 25 bp, Mus musculus
gctgtggcccctgaagctcagggaa

SEQ ID NO: 574392 - DNA, 25 bp, Mus musculus
gctgtggcccgtcctgtagtctatg

SEQ ID NO: 574393 - DNA, 25 bp, Mus musculus
gctgtggcccgtgctgtagtctatg

SEQ ID NO: 574394 - DNA, 25 bp, Mus musculus
gctgtggccgcaacctgtgattaaa

SEQ ID NO: 574395 - DNA, 25 bp, Mus musculus
gctgtggccgcatcctgtgattaaa

SEQ ID NO: 574396 - DNA, 25 bp, Mus musculus
gctgtggccttcactatattttatt

SEQ ID NO: 574397 - DNA, 25 bp, Mus musculus
gctgtggccttctctatattttatt

SEQ ID NO: 574398 - DNA, 25 bp, Mus musculus
gctgtggcgccaattcaagtattac

SEQ ID NO: 574399 - DNA, 25 bp, Mus musculus
gctgtggcgccatttcaagtattac

SEQ ID NO: 574400 - DNA, 25 bp, Mus musculus
gctgtggcggcgctgggtgcacgca

SEQ ID NO: 574401 - DNA, 25 bp, Mus musculus
gctgtggcggcggtgggtgcacgca

SEQ ID NO: 574402 - DNA, 25 bp, Mus musculus
gctgtggctaggagttgatgcttta

SEQ ID NO: 574403 - DNA, 25 bp, Mus musculus
gctgtggctaggtgttgatgcttta

SEQ ID NO: 574404 - DNA, 25 bp, Mus musculus
gctgtggctgtccttggcgaaaaac

SEQ ID NO: 574405 - DNA, 25 bp, Mus musculus
gctgtggctgtcgttggcgaaaaac

SEQ ID NO: 574406 - DNA, 25 bp, Mus musculus
gctgtggcttaaccactttgtatgt

SEQ ID NO: 574407 - DNA, 25 bp, Mus musculus
gctgtggcttaagcactttgtatgt

SEQ ID NO: 574408 - DNA, 25 bp, Mus musculus
gctgtggcttggatggcagcaccat

SEQ ID NO: 574409 - DNA, 25 bp, Mus musculus
gctgtggcttggttggcagcaccat

SEQ ID NO: 574410 - DNA, 25 bp, Mus musculus
gctgtggctttacttttacgtctga

SEQ ID NO: 574411 - DNA, 25 bp, Mus musculus
gctgtggctttagttttacgtctga

SEQ ID NO: 574412 - DNA, 25 bp, Mus musculus
gctgtgggaaaccagctttgctttt

SEQ ID NO: 574413 - DNA, 25 bp, Mus musculus
gctgtgggaaacgagctttgctttt

SEQ ID NO: 574414 - DNA, 25 bp, Mus musculus
gctgtgggaagaccattcggttcta

SEQ ID NO: 574415 - DNA, 25 bp, Mus musculus
gctgtgggaagagcattcggttcta

SEQ ID NO: 574416 - DNA, 25 bp, Mus musculus
gctgtgggaagcacgaattcagtga

SEQ ID NO: 574417 - DNA, 25 bp, Mus musculus
gctgtgggaagctcgaattcagtga

SEQ ID NO: 574418 - DNA, 25 bp, Mus musculus
gctgtgggatgtccctacattttgt

SEQ ID NO: 574419 - DNA, 25 bp, Mus musculus
gctgtgggatgtgcctacattttgt

SEQ ID NO: 574420 - DNA, 25 bp, Mus musculus
gctgtgggcaggacaataattacca

SEQ ID NO: 574421 - DNA, 25 bp, Mus musculus
gctgtgggcaggtcaataattacca

SEQ ID NO: 574422 - DNA, 25 bp, Mus musculus
gctgtgggccaacccagcagagaca

SEQ ID NO: 574423 - DNA, 25 bp, Mus musculus
gctgtgggccaactattctgttttc

SEQ ID NO: 574424 - DNA, 25 bp, Mus musculus
gctgtgggccaagccagcagagaca

SEQ ID NO: 574425 - DNA, 25 bp, Mus musculus
gctgtgggccaagtattctgttttc

SEQ ID NO: 574426 - DNA, 25 bp, Mus musculus
gctgtgggccataacatgctatgta

SEQ ID NO: 574427 - DNA, 25 bp, Mus musculus
gctgtgggccattacatgctatgta

SEQ ID NO: 574428 - DNA, 25 bp, Mus musculus
gctgtgggcccaaatttgaattcct

SEQ ID NO: 574429 - DNA, 25 bp, Mus musculus
gctgtgggcccatatttgaattcct

SEQ ID NO: 574430 - DNA, 25 bp, Mus musculus
gctgtgggccctagaacttgtctgc

SEQ ID NO: 574431 - DNA, 25 bp, Mus musculus
gctgtgggcccttgaacttgtctgc

SEQ ID NO: 574432 - DNA, 25 bp, Mus musculus
gctgtgggtaggaccatgtcccttc

SEQ ID NO: 574433 - DNA, 25 bp, Mus musculus
gctgtgggtaggtccatgtcccttc

SEQ ID NO: 574434 - DNA, 25 bp, Mus musculus
gctgtgggttttccatccctaaacc

SEQ ID NO: 574435 - DNA, 25 bp, Mus musculus
gctgtgggttttgcatccctaaacc

SEQ ID NO: 574436 - DNA, 25 bp, Mus musculus
gctgtggtacagacaccaactttga

SEQ ID NO: 574437 - DNA, 25 bp, Mus musculus
gctgtggtacagtcaccaactttga

SEQ ID NO: 574438 - DNA, 25 bp, Mus musculus
gctgtggtaccaagcatgtagaact

SEQ ID NO: 574439 - DNA, 25 bp, Mus musculus
gctgtggtaccatgcatgtagaact

SEQ ID NO: 574440 - DNA, 25 bp, Mus musculus
gctgtggtacgtaagctttctaaga

SEQ ID NO: 574441 - DNA, 25 bp, Mus musculus
gctgtggtacgttagctttctaaga

SEQ ID NO: 574442 - DNA, 25 bp, Mus musculus
gctgtggtcactagaaagcactata

SEQ ID NO: 574443 - DNA, 25 bp, Mus musculus
gctgtggtcacttgaaagcactata

SEQ ID NO: 574444 - DNA, 25 bp, Mus musculus
gctgtggtcatccttggagctgtga

SEQ ID NO: 574445 - DNA, 25 bp, Mus musculus
gctgtggtcatcgttggagctgtga

SEQ ID NO: 574446 - DNA, 25 bp, Mus musculus
gctgtggtccctaatggcccaagca

SEQ ID NO: 574447 - DNA, 25 bp, Mus musculus
gctgtggtcccttatggcccaagca

SEQ ID NO: 574448 - DNA, 25 bp, Mus musculus
gctgtggtctgaatgggttcccaga

SEQ ID NO: 574449 - DNA, 25 bp, Mus musculus
gctgtggtctgattgggttcccaga

SEQ ID NO: 574450 - DNA, 25 bp, Mus musculus
gctgtggtgcaacgccatttttgct

SEQ ID NO: 574451 - DNA, 25 bp, Mus musculus
gctgtggtgcaaggccatttttgct

SEQ ID NO: 574452 - DNA, 25 bp, Mus musculus
gctgtggtgccacaaacctgaactt

SEQ ID NO: 574453 - DNA, 25 bp, Mus musculus
gctgtggtgccagaaacctgaactt

SEQ ID NO: 574454 - DNA, 25 bp, Mus musculus
gctgtggtgggcaattgttcaaaca

SEQ ID NO: 574455 - DNA, 25 bp, Mus musculus
gctgtggtgggcacatgcgctgtca

SEQ ID NO: 574456 - DNA, 25 bp, Mus musculus
gctgtggtgggctattgttcaaaca

SEQ ID NO: 574457 - DNA, 25 bp, Mus musculus
gctgtggtgggctcatgcgctgtca

SEQ ID NO: 574458 - DNA, 25 bp, Mus musculus
gctgtggtgtgaacacatccagtcc

SEQ ID NO: 574459 - DNA, 25 bp, Mus musculus
gctgtggtgtgatcacatccagtcc

SEQ ID NO: 574460 - DNA, 25 bp, Mus musculus
gctgtggttaagctctgcagtccct

SEQ ID NO: 574461 - DNA, 25 bp, Mus musculus
gctgtggttaaggtctgcagtccct

SEQ ID NO: 574462 - DNA, 25 bp, Mus musculus
gctgtggttcagctctatatcttac

SEQ ID NO: 574463 - DNA, 25 bp, Mus musculus
gctgtggttcaggtctatatcttac

SEQ ID NO: 574464 - DNA, 25 bp, Mus musculus
gctgtggttccaacattcaagtgtg

SEQ ID NO: 574465 - DNA, 25 bp, Mus musculus
gctgtggttccatcattcaagtgtg

SEQ ID NO: 574466 - DNA, 25 bp, Mus musculus
gctgtggttggcctgtactatatac

SEQ ID NO: 574467 - DNA, 25 bp, Mus musculus
gctgtggttggcgtgtactatatac

SEQ ID NO: 574468 - DNA, 25 bp, Mus musculus
gctgtggttgtaagcagatgcccta

SEQ ID NO: 574469 - DNA, 25 bp, Mus musculus
gctgtggttgtaccttcttggtaga

SEQ ID NO: 574470 - DNA, 25 bp, Mus musculus
gctgtggttgtagcttcttggtaga

SEQ ID NO: 574471 - DNA, 25 bp, Mus musculus
gctgtggttgtatgcagatgcccta

SEQ ID NO: 574472 - DNA, 25 bp, Mus musculus
gctgtggttgttccttggacctgac

SEQ ID NO: 574473 - DNA, 25 bp, Mus musculus
gctgtggttgttgcttggacctgac

SEQ ID NO: 574474 - DNA, 25 bp, Mus musculus
gctgtggtttatctcagttcttgat

SEQ ID NO: 574475 - DNA, 25 bp, Mus musculus
gctgtggtttatgtcagttcttgat

SEQ ID NO: 574476 - DNA, 25 bp, Mus musculus
gctgtggttttacacggctggcata

SEQ ID NO: 574477 - DNA, 25 bp, Mus musculus
gctgtggttttagacggctggcata

SEQ ID NO: 574478 - DNA, 25 bp, Mus musculus
gctgtgtaactcatgctgcatttga

SEQ ID NO: 574479 - DNA, 25 bp, Mus musculus
gctgtgtaactcttgctgcatttga

SEQ ID NO: 574480 - DNA, 25 bp, Mus musculus
gctgtgtaagcaacttctggcaatt

SEQ ID NO: 574481 - DNA, 25 bp, Mus musculus
gctgtgtaagcatcttctggcaatt

SEQ ID NO: 574482 - DNA, 25 bp, Mus musculus
gctgtgtaatatctttctgttataa

SEQ ID NO: 574483 - DNA, 25 bp, Mus musculus
gctgtgtaatatgtttctgttataa

SEQ ID NO: 574484 - DNA, 25 bp, Mus musculus
gctgtgtaatgaagacttgtgacac

SEQ ID NO: 574485 - DNA, 25 bp, Mus musculus
gctgtgtaatgatgacttgtgacac

SEQ ID NO: 574486 - DNA, 25 bp, Mus musculus
gctgtgtacaggcagacggtcttaa

SEQ ID NO: 574487 - DNA, 25 bp, Mus musculus
gctgtgtacagggagacggtcttaa

SEQ ID NO: 574488 - DNA, 25 bp, Mus musculus
gctgtgtacatcctgaagcatctcc

SEQ ID NO: 574489 - DNA, 25 bp, Mus musculus
gctgtgtacatcgtgaagcatctcc

SEQ ID NO: 574490 - DNA, 25 bp, Mus musculus
gctgtgtagagaagcgagcgcgctc

SEQ ID NO: 574491 - DNA, 25 bp, Mus musculus
gctgtgtagagatgcgagcgcgctc

SEQ ID NO: 574492 - DNA, 25 bp, Mus musculus
gctgtgtagagcacaagcctttcct

SEQ ID NO: 574493 - DNA, 25 bp, Mus musculus
gctgtgtagagctcaagcctttcct

SEQ ID NO: 574494 - DNA, 25 bp, Mus musculus
gctgtgtagataatatgcctttaga

SEQ ID NO: 574495 - DNA, 25 bp, Mus musculus
gctgtgtagatattatgcctttaga

SEQ ID NO: 574496 - DNA, 25 bp, Mus musculus
gctgtgtagctcagtcccgttaact

SEQ ID NO: 574497 - DNA, 25 bp, Mus musculus
gctgtgtagctctgtcccgttaact

SEQ ID NO: 574498 - DNA, 25 bp, Mus musculus
gctgtgtaggtaccctgacttgaca

SEQ ID NO: 574499 - DNA, 25 bp, Mus musculus
gctgtgtaggtagcctgacttgaca

SEQ ID NO: 574500 - DNA, 25 bp, Mus musculus
gctgtgtatagcaaactgtttttat

SEQ ID NO: 574501 - DNA, 25 bp, Mus musculus
gctgtgtatagctaactgtttttat

SEQ ID NO: 574502 - DNA, 25 bp, Mus musculus
gctgtgtatcgacgctgctattggc

SEQ ID NO: 574503 - DNA, 25 bp, Mus musculus
gctgtgtatcgaggctgctattggc

SEQ ID NO: 574504 - DNA, 25 bp, Mus musculus
gctgtgtatcggatcaactttgctg

SEQ ID NO: 574505 - DNA, 25 bp, Mus musculus
gctgtgtatcggttcaactttgctg

SEQ ID NO: 574506 - DNA, 25 bp, Mus musculus
gctgtgtatctgaatcgatgcctaa

SEQ ID NO: 574507 - DNA, 25 bp, Mus musculus
gctgtgtatctgtatcgatgcctaa

SEQ ID NO: 574508 - DNA, 25 bp, Mus musculus
gctgtgtatgcgaaattgcctgcca

SEQ ID NO: 574509 - DNA, 25 bp, Mus musculus
gctgtgtatgcgtaattgcctgcca

SEQ ID NO: 574510 - DNA, 25 bp, Mus musculus
gctgtgtatttcagatgctagtgga

SEQ ID NO: 574511 - DNA, 25 bp, Mus musculus
gctgtgtatttctgatgctagtgga

SEQ ID NO: 574512 - DNA, 25 bp, Mus musculus
gctgtgtattttatgacctgccatc

SEQ ID NO: 574513 - DNA, 25 bp, Mus musculus
gctgtgtattttttgacctgccatc

SEQ ID NO: 574514 - DNA, 25 bp, Mus musculus
gctgtgtcaaccagtcgagtgctag

SEQ ID NO: 574515 - DNA, 25 bp, Mus musculus
gctgtgtcaacctgtcgagtgctag

SEQ ID NO: 574516 - DNA, 25 bp, Mus musculus
gctgtgtcactactaacttgccatt

SEQ ID NO: 574517 - DNA, 25 bp, Mus musculus
gctgtgtcactagtaacttgccatt

SEQ ID NO: 574518 - DNA, 25 bp, Mus musculus
gctgtgtcatgcatctggaggtctg

SEQ ID NO: 574519 - DNA, 25 bp, Mus musculus
gctgtgtcatgcttctggaggtctg

SEQ ID NO: 574520 - DNA, 25 bp, Mus musculus
gctgtgtcatgtcgtgtgtgcattt

SEQ ID NO: 574521 - DNA, 25 bp, Mus musculus
gctgtgtcatgtggtgtgtgcattt

SEQ ID NO: 574522 - DNA, 25 bp, Mus musculus
gctgtgtccaggatccgtgtgagat

SEQ ID NO: 574523 - DNA, 25 bp, Mus musculus
gctgtgtccaggttccgtgtgagat

SEQ ID NO: 574524 - DNA, 25 bp, Mus musculus
gctgtgtccagtctagaaggcattt

SEQ ID NO: 574525 - DNA, 25 bp, Mus musculus
gctgtgtccagtgtagaaggcattt

SEQ ID NO: 574526 - DNA, 25 bp, Mus musculus
gctgtgtcccaaagttaattcccca

SEQ ID NO: 574527 - DNA, 25 bp, Mus musculus
gctgtgtcccaatgttaattcccca

SEQ ID NO: 574528 - DNA, 25 bp, Mus musculus
gctgtgtccggcagatgtagacagt

SEQ ID NO: 574529 - DNA, 25 bp, Mus musculus
gctgtgtccggctgatgtagacagt

SEQ ID NO: 574530 - DNA, 25 bp, Mus musculus
gctgtgtcctcacgtctgaatgagc

SEQ ID NO: 574531 - DNA, 25 bp, Mus musculus
gctgtgtcctcaggtctgaatgagc

SEQ ID NO: 574532 - DNA, 25 bp, Mus musculus
gctgtgtcctgcataggaggtctgt

SEQ ID NO: 574533 - DNA, 25 bp, Mus musculus
gctgtgtcctgcttaggaggtctgt

SEQ ID NO: 574534 - DNA, 25 bp, Mus musculus
gctgtgtccttacagcccacgggca

SEQ ID NO: 574535 - DNA, 25 bp, Mus musculus
gctgtgtccttagagcccacgggca

SEQ ID NO: 574536 - DNA, 25 bp, Mus musculus
gctgtgtcgccactgtgctcactaa

SEQ ID NO: 574537 - DNA, 25 bp, Mus musculus
gctgtgtcgccagtgtgctcactaa

SEQ ID NO: 574538 - DNA, 25 bp, Mus musculus
gctgtgtctaatagattactatgaa

SEQ ID NO: 574539 - DNA, 25 bp, Mus musculus
gctgtgtctaattgattactatgaa

SEQ ID NO: 574540 - DNA, 25 bp, Mus musculus
gctgtgtctagtatacctgtttata

SEQ ID NO: 574541 - DNA, 25 bp, Mus musculus
gctgtgtctagtttacctgtttata

SEQ ID NO: 574542 - DNA, 25 bp, Mus musculus
gctgtgtctcagcttaggtaggcct

SEQ ID NO: 574543 - DNA, 25 bp, Mus musculus
gctgtgtctcaggttaggtaggcct

SEQ ID NO: 574544 - DNA, 25 bp, Mus musculus
gctgtgtctccacagttagcttttg

SEQ ID NO: 574545 - DNA, 25 bp, Mus musculus
gctgtgtctccagagttagcttttg

SEQ ID NO: 574546 - DNA, 25 bp, Mus musculus
gctgtgtctcccaaggaggtaagca

SEQ ID NO: 574547 - DNA, 25 bp, Mus musculus
gctgtgtctccctaggaggtaagca

SEQ ID NO: 574548 - DNA, 25 bp, Mus musculus
gctgtgtctcgcagggctgcccaac

SEQ ID NO: 574549 - DNA, 25 bp, Mus musculus
gctgtgtctcgctgggctgcccaac

SEQ ID NO: 574550 - DNA, 25 bp, Mus musculus
gctgtgtctctcacagcctctacag

SEQ ID NO: 574551 - DNA, 25 bp, Mus musculus
gctgtgtctctctcagcctctacag

SEQ ID NO: 574552 - DNA, 25 bp, Mus musculus
gctgtgtctctgcatggttctgaag

SEQ ID NO: 574553 - DNA, 25 bp, Mus musculus
gctgtgtctctggatggttctgaag

SEQ ID NO: 574554 - DNA, 25 bp, Mus musculus
gctgtgtctcttctagttaaactcg

SEQ ID NO: 574555 - DNA, 25 bp, Mus musculus
gctgtgtctcttgtagttaaactcg

SEQ ID NO: 574556 - DNA, 25 bp, Mus musculus
gctgtgtctgctaagttgctatttc

SEQ ID NO: 574557 - DNA, 25 bp, Mus musculus
gctgtgtctgcttagttgctatttc

SEQ ID NO: 574558 - DNA, 25 bp, Mus musculus
gctgtgtctggaacgcgatacggct

SEQ ID NO: 574559 - DNA, 25 bp, Mus musculus
gctgtgtctggatcgcgatacggct

SEQ ID NO: 574560 - DNA, 25 bp, Mus musculus
gctgtgtctggtaggcaactgtttg

SEQ ID NO: 574561 - DNA, 25 bp, Mus musculus
gctgtgtctggttggcaactgtttg

SEQ ID NO: 574562 - DNA, 25 bp, Mus musculus
gctgtgtcttacagaagaggactct

SEQ ID NO: 574563 - DNA, 25 bp, Mus musculus
gctgtgtcttactgaagaggactct

SEQ ID NO: 574564 - DNA, 25 bp, Mus musculus
gctgtgtcttatccatggttcagaa

SEQ ID NO: 574565 - DNA, 25 bp, Mus musculus
gctgtgtcttatgcatggttcagaa

SEQ ID NO: 574566 - DNA, 25 bp, Mus musculus
gctgtgtcttgaaagaccaaggatt

SEQ ID NO: 574567 - DNA, 25 bp, Mus musculus
gctgtgtcttgatagaccaaggatt

SEQ ID NO: 574568 - DNA, 25 bp, Mus musculus
gctgtgtctttaactacccttgcta

SEQ ID NO: 574569 - DNA, 25 bp, Mus musculus
gctgtgtctttatctacccttgcta

SEQ ID NO: 574570 - DNA, 25 bp, Mus musculus
gctgtgtgacagagcgtgtgttatt

SEQ ID NO: 574571 - DNA, 25 bp, Mus musculus
gctgtgtgacagtgcgtgtgttatt

SEQ ID NO: 574572 - DNA, 25 bp, Mus musculus
gctgtgtgatgcactcttagagcaa

SEQ ID NO: 574573 - DNA, 25 bp, Mus musculus
gctgtgtgatgctctcttagagcaa

SEQ ID NO: 574574 - DNA, 25 bp, Mus musculus
gctgtgtgcactaaatgactcttcc

SEQ ID NO: 574575 - DNA, 25 bp, Mus musculus
gctgtgtgcacttaatgactcttcc

SEQ ID NO: 574576 - DNA, 25 bp, Mus musculus
gctgtgtgcagacagatgaccctca

SEQ ID NO: 574577 - DNA, 25 bp, Mus musculus
gctgtgtgcagagagatgaccctca

SEQ ID NO: 574578 - DNA, 25 bp, Mus musculus
gctgtgtgcatacggacagctctgt

SEQ ID NO: 574579 - DNA, 25 bp, Mus musculus
gctgtgtgcatagggacagctctgt

SEQ ID NO: 574580 - DNA, 25 bp, Mus musculus
gctgtgtgcatgacaggtccaccta

SEQ ID NO: 574581 - DNA, 25 bp, Mus musculus
gctgtgtgcatgtcaggtccaccta

SEQ ID NO: 574582 - DNA, 25 bp, Mus musculus
gctgtgtgccctctgtggcggagat

SEQ ID NO: 574583 - DNA, 25 bp, Mus musculus
gctgtgtgccctgtgtggcggagat

SEQ ID NO: 574584 - DNA, 25 bp, Mus musculus
gctgtgtgcctgagatgttttacag

SEQ ID NO: 574585 - DNA, 25 bp, Mus musculus
gctgtgtgcctgtgatgttttacag

SEQ ID NO: 574586 - DNA, 25 bp, Mus musculus
gctgtgtgcggcagatgctcatctc

SEQ ID NO: 574587 - DNA, 25 bp, Mus musculus
gctgtgtgcggctgatgctcatctc

SEQ ID NO: 574588 - DNA, 25 bp, Mus musculus
gctgtgtgctcaaccggaaacaggg

SEQ ID NO: 574589 - DNA, 25 bp, Mus musculus
gctgtgtgctcatccggaaacaggg

SEQ ID NO: 574590 - DNA, 25 bp, Mus musculus
gctgtgtggaagaccctccgtgtta

SEQ ID NO: 574591 - DNA, 25 bp, Mus musculus
gctgtgtggaagtccctccgtgtta

SEQ ID NO: 574592 - DNA, 25 bp, Mus musculus
gctgtgtggaccactacaaccaggc

SEQ ID NO: 574593 - DNA, 25 bp, Mus musculus
gctgtgtggacctctacaaccaggc

SEQ ID NO: 574594 - DNA, 25 bp, Mus musculus
gctgtgtggctgcaccgtgaacatt

SEQ ID NO: 574595 - DNA, 25 bp, Mus musculus
gctgtgtggctggaccgtgaacatt

SEQ ID NO: 574596 - DNA, 25 bp, Mus musculus
gctgtgtgggatatcctgattacta

SEQ ID NO: 574597 - DNA, 25 bp, Mus musculus
gctgtgtgggatttcctgattacta

SEQ ID NO: 574598 - DNA, 25 bp, Mus musculus
gctgtgtggtcgcaacatttttgaa

SEQ ID NO: 574599 - DNA, 25 bp, Mus musculus
gctgtgtggtcggaacatttttgaa

SEQ ID NO: 574600 - DNA, 25 bp, Mus musculus
gctgtgtggtttccttctagaggaa

SEQ ID NO: 574601 - DNA, 25 bp, Mus musculus
gctgtgtggtttgcttctagaggaa

SEQ ID NO: 574602 - DNA, 25 bp, Mus musculus
gctgtgtgtcaaagcaaaaactggg

SEQ ID NO: 574603 - DNA, 25 bp, Mus musculus
gctgtgtgtcaatgcaaaaactggg

SEQ ID NO: 574604 - DNA, 25 bp, Mus musculus
gctgtgtgtccaactttgtattcat

SEQ ID NO: 574605 - DNA, 25 bp, Mus musculus
gctgtgtgtccaagaggtcctcagg

SEQ ID NO: 574606 - DNA, 25 bp, Mus musculus
gctgtgtgtccatctttgtattcat

SEQ ID NO: 574607 - DNA, 25 bp, Mus musculus
gctgtgtgtccatgaggtcctcagg

SEQ ID NO: 574608 - DNA, 25 bp, Mus musculus
gctgtgtgtgttatgtattcaccac

SEQ ID NO: 574609 - DNA, 25 bp, Mus musculus
gctgtgtgtgttttgtattcaccac

SEQ ID NO: 574610 - DNA, 25 bp, Mus musculus
gctgtgtgttcaaaatgaccctctg

SEQ ID NO: 574611 - DNA, 25 bp, Mus musculus
gctgtgtgttcataatgaccctctg

SEQ ID NO: 574612 - DNA, 25 bp, Mus musculus
gctgtgtgttccaaagtctgtttac

SEQ ID NO: 574613 - DNA, 25 bp, Mus musculus
gctgtgtgttccagaggcagatctt

SEQ ID NO: 574614 - DNA, 25 bp, Mus musculus
gctgtgtgttcctaagtctgtttac

SEQ ID NO: 574615 - DNA, 25 bp, Mus musculus
gctgtgtgttcctgaggcagatctt

SEQ ID NO: 574616 - DNA, 25 bp, Mus musculus
gctgtgtgtttaatgctgctgggat

SEQ ID NO: 574617 - DNA, 25 bp, Mus musculus
gctgtgtgtttattgctgctgggat

SEQ ID NO: 574618 - DNA, 25 bp, Mus musculus
gctgtgtgtttcattcccaggaaat

SEQ ID NO: 574619 - DNA, 25 bp, Mus musculus
gctgtgtgtttctttcccaggaaat

SEQ ID NO: 574620 - DNA, 25 bp, Mus musculus
gctgtgtgttttcctgtagtgctac

SEQ ID NO: 574621 - DNA, 25 bp, Mus musculus
gctgtgtgttttgctgtagtgctac

SEQ ID NO: 574622 - DNA, 25 bp, Mus musculus
gctgtgttaaaaatgcatccttctg

SEQ ID NO: 574623 - DNA, 25 bp, Mus musculus
gctgtgttaaaattgcatccttctg

SEQ ID NO: 574624 - DNA, 25 bp, Mus musculus
gctgtgttaaggcacttctttgatc

SEQ ID NO: 574625 - DNA, 25 bp, Mus musculus
gctgtgttaagggacttctttgatc

SEQ ID NO: 574626 - DNA, 25 bp, Mus musculus
gctgtgttaatgagtgattacctcc

SEQ ID NO: 574627 - DNA, 25 bp, Mus musculus
gctgtgttaatgtgtgattacctcc

SEQ ID NO: 574628 - DNA, 25 bp, Mus musculus
gctgtgttattgctactgttaaatg

SEQ ID NO: 574629 - DNA, 25 bp, Mus musculus
gctgtgttattggtactgttaaatg

SEQ ID NO: 574630 - DNA, 25 bp, Mus musculus
gctgtgttcaatccaggttgctcct

SEQ ID NO: 574631 - DNA, 25 bp, Mus musculus
gctgtgttcaatgcaggttgctcct

SEQ ID NO: 574632 - DNA, 25 bp, Mus musculus
gctgtgttccctctgattgctgcca

SEQ ID NO: 574633 - DNA, 25 bp, Mus musculus
gctgtgttccctgtgattgctgcca

SEQ ID NO: 574634 - DNA, 25 bp, Mus musculus
gctgtgttctccaacacggttgaga

SEQ ID NO: 574635 - DNA, 25 bp, Mus musculus
gctgtgttctcctacacggttgaga

SEQ ID NO: 574636 - DNA, 25 bp, Mus musculus
gctgtgttctgaagggccaggctta

SEQ ID NO: 574637 - DNA, 25 bp, Mus musculus
gctgtgttctgatgggccaggctta

SEQ ID NO: 574638 - DNA, 25 bp, Mus musculus
gctgtgttctgcctgccataatgaa

SEQ ID NO: 574639 - DNA, 25 bp, Mus musculus
gctgtgttctgcgtgccataatgaa

SEQ ID NO: 574640 - DNA, 25 bp, Mus musculus
gctgtgttctggaaggtagtgcctt

SEQ ID NO: 574641 - DNA, 25 bp, Mus musculus
gctgtgttctggtaggtagtgcctt

SEQ ID NO: 574642 - DNA, 25 bp, Mus musculus
gctgtgttcttgctccttgttgcaa

SEQ ID NO: 574643 - DNA, 25 bp, Mus musculus
gctgtgttcttggtccttgttgcaa

SEQ ID NO: 574644 - DNA, 25 bp, Mus musculus
gctgtgttgaagacaagctcactcg

SEQ ID NO: 574645 - DNA, 25 bp, Mus musculus
gctgtgttgaagtcaagctcactcg

SEQ ID NO: 574646 - DNA, 25 bp, Mus musculus
gctgtgtttagcattttctgatttt

SEQ ID NO: 574647 - DNA, 25 bp, Mus musculus
gctgtgtttagctttttctgatttt

SEQ ID NO: 574648 - DNA, 25 bp, Mus musculus
gctgtgtttcacaagggacaaatat

SEQ ID NO: 574649 - DNA, 25 bp, Mus musculus
gctgtgtttcactagggacaaatat

SEQ ID NO: 574650 - DNA, 25 bp, Mus musculus
gctgtgtttcttatctgttgttaag

SEQ ID NO: 574651 - DNA, 25 bp, Mus musculus
gctgtgtttcttttctgttgttaag

SEQ ID NO: 574652 - DNA, 25 bp, Mus musculus
gctgttaaaaccaggatagcacctg

SEQ ID NO: 574653 - DNA, 25 bp, Mus musculus
gctgttaaaacctggatagcacctg

SEQ ID NO: 574654 - DNA, 25 bp, Mus musculus
gctgttaaaagcaatgacttcttcc

SEQ ID NO: 574655 - DNA, 25 bp, Mus musculus
gctgttaaaagctatgacttcttcc

SEQ ID NO: 574656 - DNA, 25 bp, Mus musculus
gctgttaaaggaacttactgtgtga

SEQ ID NO: 574657 - DNA, 25 bp, Mus musculus
gctgttaaaggatcttactgtgtga

SEQ ID NO: 574658 - DNA, 25 bp, Mus musculus
gctgttaacactaaagtccaacatg

SEQ ID NO: 574659 - DNA, 25 bp, Mus musculus
gctgttaacacttaagtccaacatg

SEQ ID NO: 574660 - DNA, 25 bp, Mus musculus
gctgttaactgaactgattcccttt

SEQ ID NO: 574661 - DNA, 25 bp, Mus musculus
gctgttaactgatctgattcccttt

SEQ ID NO: 574662 - DNA, 25 bp, Mus musculus
gctgttaagatgatcccacctacac

SEQ ID NO: 574663 - DNA, 25 bp, Mus musculus
gctgttaagatgttcccacctacac

SEQ ID NO: 574664 - DNA, 25 bp, Mus musculus
gctgttaagcaaaagctctttccct

SEQ ID NO: 574665 - DNA, 25 bp, Mus musculus
gctgttaagcaatagctctttccct

SEQ ID NO: 574666 - DNA, 25 bp, Mus musculus
gctgttaagcttaaaaaaccgctgt

SEQ ID NO: 574667 - DNA, 25 bp, Mus musculus
gctgttaagctttaaaaaccgctgt

SEQ ID NO: 574668 - DNA, 25 bp, Mus musculus
gctgttaagtcccaagtccgtcatg

SEQ ID NO: 574669 - DNA, 25 bp, Mus musculus
gctgttaagtccgaagtccgtcatg

SEQ ID NO: 574670 - DNA, 25 bp, Mus musculus
gctgttaatacacctcagagccatg

SEQ ID NO: 574671 - DNA, 25 bp, Mus musculus
gctgttaatacactttgcacccttt

SEQ ID NO: 574672 - DNA, 25 bp, Mus musculus
gctgttaatacagctcagagccatg

SEQ ID NO: 574673 - DNA, 25 bp, Mus musculus
gctgttaatacagtttgcacccttt

SEQ ID NO: 574674 - DNA, 25 bp, Mus musculus
gctgttaatcatagtacctggctta

SEQ ID NO: 574675 - DNA, 25 bp, Mus musculus
gctgttaatcattgtacctggctta

SEQ ID NO: 574676 - DNA, 25 bp, Mus musculus
gctgttaatgcactgttgaccttca

SEQ ID NO: 574677 - DNA, 25 bp, Mus musculus
gctgttaatgcagtgttgaccttca

SEQ ID NO: 574678 - DNA, 25 bp, Mus musculus
gctgttacacatacctcagtgctga

SEQ ID NO: 574679 - DNA, 25 bp, Mus musculus
gctgttacacattcctcagtgctga

SEQ ID NO: 574680 - DNA, 25 bp, Mus musculus
gctgttaccatgacgactgctggat

SEQ ID NO: 574681 - DNA, 25 bp, Mus musculus
gctgttaccatgtcgactgctggat

SEQ ID NO: 574682 - DNA, 25 bp, Mus musculus
gctgttacctgaatcttgttgacca

SEQ ID NO: 574683 - DNA, 25 bp, Mus musculus
gctgttacctgattcttgttgacca

SEQ ID NO: 574684 - DNA, 25 bp, Mus musculus
gctgttactgatctccaactttgaa

SEQ ID NO: 574685 - DNA, 25 bp, Mus musculus
gctgttactgatgtccaactttgaa

SEQ ID NO: 574686 - DNA, 25 bp, Mus musculus
gctgttactgctcattagtgaatct

SEQ ID NO: 574687 - DNA, 25 bp, Mus musculus
gctgttactgctgattagtgaatct

SEQ ID NO: 574688 - DNA, 25 bp, Mus musculus
gctgttactggtaattactctggac

SEQ ID NO: 574689 - DNA, 25 bp, Mus musculus
gctgttactggttattactctggac

SEQ ID NO: 574690 - DNA, 25 bp, Mus musculus
gctgttacttccattggcagttgac

SEQ ID NO: 574691 - DNA, 25 bp, Mus musculus
gctgttacttcctttggcagttgac

SEQ ID NO: 574692 - DNA, 25 bp, Mus musculus
gctgttagcaatcgaagtgcctgtt

SEQ ID NO: 574693 - DNA, 25 bp, Mus musculus
gctgttagcaatggaagtgcctgtt

SEQ ID NO: 574694 - DNA, 25 bp, Mus musculus
gctgttagcaggctcctctcacctg

SEQ ID NO: 574695 - DNA, 25 bp, Mus musculus
gctgttagcagggtcctctcacctg

SEQ ID NO: 574696 - DNA, 25 bp, Mus musculus
gctgttagccagaaacctcttttgt

SEQ ID NO: 574697 - DNA, 25 bp, Mus musculus
gctgttagccagtaacctcttttgt

SEQ ID NO: 574698 - DNA, 25 bp, Mus musculus
gctgttagctagagaggcttcccgt

SEQ ID NO: 574699 - DNA, 25 bp, Mus musculus
gctgttagctagtgaggcttcccgt

SEQ ID NO: 574700 - DNA, 25 bp, Mus musculus
gctgttagtagcatcacagggcttt

SEQ ID NO: 574701 - DNA, 25 bp, Mus musculus
gctgttagtagcttcacagggcttt

SEQ ID NO: 574702 - DNA, 25 bp, Mus musculus
gctgttagtgtaacctaacccaaat

SEQ ID NO: 574703 - DNA, 25 bp, Mus musculus
gctgttagtgtatcctaacccaaat

SEQ ID NO: 574704 - DNA, 25 bp, Mus musculus
gctgttagttcaaaggttcatcacc

SEQ ID NO: 574705 - DNA, 25 bp, Mus musculus
gctgttagttcataggttcatcacc

SEQ ID NO: 574706 - DNA, 25 bp, Mus musculus
gctgttatagacaattctggccaaa

SEQ ID NO: 574707 - DNA, 25 bp, Mus musculus
gctgttatagactattctggccaaa

SEQ ID NO: 574708 - DNA, 25 bp, Mus musculus
gctgttatagccatagttattctca

SEQ ID NO: 574709 - DNA, 25 bp, Mus musculus
gctgttatagccttagttattctca

SEQ ID NO: 574710 - DNA, 25 bp, Mus musculus
gctgttatcaaaaaggagcaccttt

SEQ ID NO: 574711 - DNA, 25 bp, Mus musculus
gctgttatcaaataggagcaccttt

SEQ ID NO: 574712 - DNA, 25 bp, Mus musculus
gctgttatctctctatctctaactc

SEQ ID NO: 574713 - DNA, 25 bp, Mus musculus
gctgttatctctgtatctctaactc

SEQ ID NO: 574714 - DNA, 25 bp, Mus musculus
gctgttatcttgaccctcaaaagtg

SEQ ID NO: 574715 - DNA, 25 bp, Mus musculus
gctgttatcttgtccctcaaaagtg

SEQ ID NO: 574716 - DNA, 25 bp, Mus musculus
gctgttatgagtactgctgctatga

SEQ ID NO: 574717 - DNA, 25 bp, Mus musculus
gctgttatgagttctgctgctatga

SEQ ID NO: 574718 - DNA, 25 bp, Mus musculus
gctgttatggaaccacttgaaagtc

SEQ ID NO: 574719 - DNA, 25 bp, Mus musculus
gctgttatggaagcacttgaaagtc

SEQ ID NO: 574720 - DNA, 25 bp, Mus musculus
gctgttatgtctattctcaccaagt

SEQ ID NO: 574721 - DNA, 25 bp, Mus musculus
gctgttatgtcttttctcaccaagt

SEQ ID NO: 574722 - DNA, 25 bp, Mus musculus
gctgttattaccattgttgcctgac

SEQ ID NO: 574723 - DNA, 25 bp, Mus musculus
gctgttattacctttgttgcctgac

SEQ ID NO: 574724 - DNA, 25 bp, Mus musculus
gctgttattgtcaacattttgcagt

SEQ ID NO: 574725 - DNA, 25 bp, Mus musculus
gctgttattgtctacattttgcagt

SEQ ID NO: 574726 - DNA, 25 bp, Mus musculus
gctgttattttcaatcttgatgttc

SEQ ID NO: 574727 - DNA, 25 bp, Mus musculus
gctgttattttctatcttgatgttc

SEQ ID NO: 574728 - DNA, 25 bp, Mus musculus
gctgttcaaacactgtatcactcta

SEQ ID NO: 574729 - DNA, 25 bp, Mus musculus
gctgttcaaacagtgtatcactcta

SEQ ID NO: 574730 - DNA, 25 bp, Mus musculus
gctgttcacatgcacctgtatctaa

SEQ ID NO: 574731 - DNA, 25 bp, Mus musculus
gctgttcacatggacctgtatctaa

SEQ ID NO: 574732 - DNA, 25 bp, Mus musculus
gctgttcactgcatgtcaagccaga

SEQ ID NO: 574733 - DNA, 25 bp, Mus musculus
gctgttcactgcttgtcaagccaga

SEQ ID NO: 574734 - DNA, 25 bp, Mus musculus
gctgttcagcagagattgtagactc

SEQ ID NO: 574735 - DNA, 25 bp, Mus musculus
gctgttcagcagtgattgtagactc

SEQ ID NO: 574736 - DNA, 25 bp, Mus musculus
gctgttcagccaccctcacaggaag

SEQ ID NO: 574737 - DNA, 25 bp, Mus musculus
gctgttcagccagcctcacaggaag

SEQ ID NO: 574738 - DNA, 25 bp, Mus musculus
gctgttcagtgcaggtgactggcat

SEQ ID NO: 574739 - DNA, 25 bp, Mus musculus
gctgttcagtgctggtgactggcat

SEQ ID NO: 574740 - DNA, 25 bp, Mus musculus
gctgttcatctgcaaatttcaaaac

SEQ ID NO: 574741 - DNA, 25 bp, Mus musculus
gctgttcatctggaaatttcaaaac

SEQ ID NO: 574742 - DNA, 25 bp, Mus musculus
gctgttcatgctagcccccagacta

SEQ ID NO: 574743 - DNA, 25 bp, Mus musculus
gctgttcatgcttgcccccagacta

SEQ ID NO: 574744 - DNA, 25 bp, Mus musculus
gctgttcattttaatcactactctt

SEQ ID NO: 574745 - DNA, 25 bp, Mus musculus
gctgttcatttttatcactactctt

SEQ ID NO: 574746 - DNA, 25 bp, Mus musculus
gctgttccaacaatgtcaagaagtg

SEQ ID NO: 574747 - DNA, 25 bp, Mus musculus
gctgttccaacattgtcaagaagtg

SEQ ID NO: 574748 - DNA, 25 bp, Mus musculus
gctgttccatccctcttaggaagag

SEQ ID NO: 574749 - DNA, 25 bp, Mus musculus
gctgttccatccgtcttaggaagag

SEQ ID NO: 574750 - DNA, 25 bp, Mus musculus
gctgttccatgtatcctatttgtgt

SEQ ID NO: 574751 - DNA, 25 bp, Mus musculus
gctgttccatgtttcctatttgtgt

SEQ ID NO: 574752 - DNA, 25 bp, Mus musculus
gctgttcccgttagttacatgtaac

SEQ ID NO: 574753 - DNA, 25 bp, Mus musculus
gctgttcccgtttgttacatgtaac

SEQ ID NO: 574754 - DNA, 25 bp, Mus musculus
gctgttccctaacccgagcaagaaa

SEQ ID NO: 574755 - DNA, 25 bp, Mus musculus
gctgttccctaagccgagcaagaaa

SEQ ID NO: 574756 - DNA, 25 bp, Mus musculus
gctgttccctagagcggtggtctca

SEQ ID NO: 574757 - DNA, 25 bp, Mus musculus
gctgttccctagtgcggtggtctca

SEQ ID NO: 574758 - DNA, 25 bp, Mus musculus
gctgttcccttactttcaatttctt

SEQ ID NO: 574759 - DNA, 25 bp, Mus musculus
gctgttcccttagtttcaatttctt

SEQ ID NO: 574760 - DNA, 25 bp, Mus musculus
gctgttcccttgctcagtttgctgt

SEQ ID NO: 574761 - DNA, 25 bp, Mus musculus
gctgttcccttggtcagtttgctgt

SEQ ID NO: 574762 - DNA, 25 bp, Mus musculus
gctgttccgacaatactacgtcatg

SEQ ID NO: 574763 - DNA, 25 bp, Mus musculus
gctgttccgacattactacgtcatg

SEQ ID NO: 574764 - DNA, 25 bp, Mus musculus
gctgttcctaagcatcgtgttggga

SEQ ID NO: 574765 - DNA, 25 bp, Mus musculus
gctgttcctaaggatcgtgttggga

SEQ ID NO: 574766 - DNA, 25 bp, Mus musculus
gctgttcctatacgaccagtatcga

SEQ ID NO: 574767 - DNA, 25 bp, Mus musculus
gctgttcctataggaccagtatcga

SEQ ID NO: 574768 - DNA, 25 bp, Mus musculus
gctgttcctgaacaccatgtagact

SEQ ID NO: 574769 - DNA, 25 bp, Mus musculus
gctgttcctgaagaccatgtagact

SEQ ID NO: 574770 - DNA, 25 bp, Mus musculus
gctgttcctgacaatgccttgagac

SEQ ID NO: 574771 - DNA, 25 bp, Mus musculus
gctgttcctgacatcttacttatat

SEQ ID NO: 574772 - DNA, 25 bp, Mus musculus
gctgttcctgactatgccttgagac

SEQ ID NO: 574773 - DNA, 25 bp, Mus musculus
gctgttcctgacttcttacttatat

SEQ ID NO: 574774 - DNA, 25 bp, Mus musculus
gctgttcctggaaggcgtggttaca

SEQ ID NO: 574775 - DNA, 25 bp, Mus musculus
gctgttcctggatggcgtggttaca

SEQ ID NO: 574776 - DNA, 25 bp, Mus musculus
gctgttcctggtcccacgagtggat

SEQ ID NO: 574777 - DNA, 25 bp, Mus musculus
gctgttcctggtctccacaaagaaa

SEQ ID NO: 574778 - DNA, 25 bp, Mus musculus
gctgttcctggtgccacgagtggat

SEQ ID NO: 574779 - DNA, 25 bp, Mus musculus
gctgttcctggtgtccacaaagaaa

SEQ ID NO: 574780 - DNA, 25 bp, Mus musculus
gctgttcctgtaagtttgctattaa

SEQ ID NO: 574781 - DNA, 25 bp, Mus musculus
gctgttcctgtatgtttgctattaa

SEQ ID NO: 574782 - DNA, 25 bp, Mus musculus
gctgttccttagcaccggttggaag

SEQ ID NO: 574783 - DNA, 25 bp, Mus musculus
gctgttccttaggaccggttggaag

SEQ ID NO: 574784 - DNA, 25 bp, Mus musculus
gctgttcgacttcggaaagagaacc

SEQ ID NO: 574785 - DNA, 25 bp, Mus musculus
gctgttcgacttgggaaagagaacc

SEQ ID NO: 574786 - DNA, 25 bp, Mus musculus
gctgttcgagtcactgatctgtgta

SEQ ID NO: 574787 - DNA, 25 bp, Mus musculus
gctgttcgagtctctgatctgtgta

SEQ ID NO: 574788 - DNA, 25 bp, Mus musculus
gctgttcgcatcatggaggttgtta

SEQ ID NO: 574789 - DNA, 25 bp, Mus musculus
gctgttcgcatcttggaggttgtta

SEQ ID NO: 574790 - DNA, 25 bp, Mus musculus
gctgttcgggagcaagagcacacca

SEQ ID NO: 574791 - DNA, 25 bp, Mus musculus
gctgttcgggaggaagagcacacca

SEQ ID NO: 574792 - DNA, 25 bp, Mus musculus
gctgttcgttttaatggctcacctc

SEQ ID NO: 574793 - DNA, 25 bp, Mus musculus
gctgttcgtttttatggctcacctc

SEQ ID NO: 574794 - DNA, 25 bp, Mus musculus
gctgttctaaatagcacttggctct

SEQ ID NO: 574795 - DNA, 25 bp, Mus musculus
gctgttctaaattgcacttggctct

SEQ ID NO: 574796 - DNA, 25 bp, Mus musculus
gctgttctacagcagtcatcttttt

SEQ ID NO: 574797 - DNA, 25 bp, Mus musculus
gctgttctacaggagtcatcttttt

SEQ ID NO: 574798 - DNA, 25 bp, Mus musculus
gctgttctactgaaaacccttggaa

SEQ ID NO: 574799 - DNA, 25 bp, Mus musculus
gctgttctactgtaaacccttggaa

SEQ ID NO: 574800 - DNA, 25 bp, Mus musculus
gctgttctatggcttttctgtgtaa

SEQ ID NO: 574801 - DNA, 25 bp, Mus musculus
gctgttctatgggttttctgtgtaa

SEQ ID NO: 574802 - DNA, 25 bp, Mus musculus
gctgttctattgcgatcaaccctct

SEQ ID NO: 574803 - DNA, 25 bp, Mus musculus
gctgttctattgggatcaaccctct

SEQ ID NO: 574804 - DNA, 25 bp, Mus musculus
gctgttctcagtaactctgccagag

SEQ ID NO: 574805 - DNA, 25 bp, Mus musculus
gctgttctcagttactctgccagag

SEQ ID NO: 574806 - DNA, 25 bp, Mus musculus
gctgttctcataagctatcctggga

SEQ ID NO: 574807 - DNA, 25 bp, Mus musculus
gctgttctcatatgctatcctggga

SEQ ID NO: 574808 - DNA, 25 bp, Mus musculus
gctgttctcatgaaaaggccgacgt

SEQ ID NO: 574809 - DNA, 25 bp, Mus musculus
gctgttctcatgtaaaggccgacgt

SEQ ID NO: 574810 - DNA, 25 bp, Mus musculus
gctgttctccctactttagtaaagt

SEQ ID NO: 574811 - DNA, 25 bp, Mus musculus
gctgttctcccttctttagtaaagt

SEQ ID NO: 574812 - DNA, 25 bp, Mus musculus
gctgttctctagatggagtctcacg

SEQ ID NO: 574813 - DNA, 25 bp, Mus musculus
gctgttctctagttggagtctcacg

SEQ ID NO: 574814 - DNA, 25 bp, Mus musculus
gctgttctcttcaggataccagcta

SEQ ID NO: 574815 - DNA, 25 bp, Mus musculus
gctgttctcttctggataccagcta

SEQ ID NO: 574816 - DNA, 25 bp, Mus musculus
gctgttctctttccaacaagcttac

SEQ ID NO: 574817 - DNA, 25 bp, Mus musculus
gctgttctctttgcaacaagcttac

SEQ ID NO: 574818 - DNA, 25 bp, Mus musculus
gctgttctgaacaggatatatggac

SEQ ID NO: 574819 - DNA, 25 bp, Mus musculus
gctgttctgaactggatatatggac

SEQ ID NO: 574820 - DNA, 25 bp, Mus musculus
gctgttctgacccatagatttggtt

SEQ ID NO: 574821 - DNA, 25 bp, Mus musculus
gctgttctgaccgatagatttggtt

SEQ ID NO: 574822 - DNA, 25 bp, Mus musculus
gctgttctgagaccacaccgtgcca

SEQ ID NO: 574823 - DNA, 25 bp, Mus musculus
gctgttctgagagcacaccgtgcca

SEQ ID NO: 574824 - DNA, 25 bp, Mus musculus
gctgttctgagtagactgtatccca

SEQ ID NO: 574825 - DNA, 25 bp, Mus musculus
gctgttctgagttgactgtatccca

SEQ ID NO: 574826 - DNA, 25 bp, Mus musculus
gctgttctgatcattctgggttaat

SEQ ID NO: 574827 - DNA, 25 bp, Mus musculus
gctgttctgatctttctgggttaat

SEQ ID NO: 574828 - DNA, 25 bp, Mus musculus
gctgttctgcatctgaatgctgcat

SEQ ID NO: 574829 - DNA, 25 bp, Mus musculus
gctgttctgcatctgtaacccacaa

SEQ ID NO: 574830 - DNA, 25 bp, Mus musculus
gctgttctgcatgtgaatgctgcat

SEQ ID NO: 574831 - DNA, 25 bp, Mus musculus
gctgttctgcatgtgtaacccacaa

SEQ ID NO: 574832 - DNA, 25 bp, Mus musculus
gctgttctgcctctaagacgttgaa

SEQ ID NO: 574833 - DNA, 25 bp, Mus musculus
gctgttctgcctgtaagacgttgaa

SEQ ID NO: 574834 - DNA, 25 bp, Mus musculus
gctgttctggacaccaggactggag

SEQ ID NO: 574835 - DNA, 25 bp, Mus musculus
gctgttctggactccaggactggag

SEQ ID NO: 574836 - DNA, 25 bp, Mus musculus
gctgttctggagacagatgcatcag

SEQ ID NO: 574837 - DNA, 25 bp, Mus musculus
gctgttctggagtcagatgcatcag

SEQ ID NO: 574838 - DNA, 25 bp, Mus musculus
gctgttctggcaataaacttgcaga

SEQ ID NO: 574839 - DNA, 25 bp, Mus musculus
gctgttctggcattaaacttgcaga

SEQ ID NO: 574840 - DNA, 25 bp, Mus musculus
gctgttctgtggctcattggataat

SEQ ID NO: 574841 - DNA, 25 bp, Mus musculus
gctgttctgtgggtcattggataat

SEQ ID NO: 574842 - DNA, 25 bp, Mus musculus
gctgttcttaggaaacacctctcga

SEQ ID NO: 574843 - DNA, 25 bp, Mus musculus
gctgttcttaggtaacacctctcga

SEQ ID NO: 574844 - DNA, 25 bp, Mus musculus
gctgttctttgtccttctgatttag

SEQ ID NO: 574845 - DNA, 25 bp, Mus musculus
gctgttctttgtgcttctgatttag

SEQ ID NO: 574846 - DNA, 25 bp, Mus musculus
gctgttctttttaggctgctgatta

SEQ ID NO: 574847 - DNA, 25 bp, Mus musculus
gctgttcttttttggctgctgatta

SEQ ID NO: 574848 - DNA, 25 bp, Mus musculus
gctgttgaacctcggacatgtgact

SEQ ID NO: 574849 - DNA, 25 bp, Mus musculus
gctgttgaacctgggacatgtgact

SEQ ID NO: 574850 - DNA, 25 bp, Mus musculus
gctgttgaaggtactcttgcatact

SEQ ID NO: 574851 - DNA, 25 bp, Mus musculus
gctgttgaaggttctcttgcatact

SEQ ID NO: 574852 - DNA, 25 bp, Mus musculus
gctgttgaataaaaccctgatcatg

SEQ ID NO: 574853 - DNA, 25 bp, Mus musculus
gctgttgaataataccctgatcatg

SEQ ID NO: 574854 - DNA, 25 bp, Mus musculus
gctgttgaatgtcaagggtcccttt

SEQ ID NO: 574855 - DNA, 25 bp, Mus musculus
gctgttgaatgtgaagggtcccttt

SEQ ID NO: 574856 - DNA, 25 bp, Mus musculus
gctgttgaccggaagaacgttgttt

SEQ ID NO: 574857 - DNA, 25 bp, Mus musculus
gctgttgaccggtagaacgttgttt

SEQ ID NO: 574858 - DNA, 25 bp, Mus musculus
gctgttgactccatgctatatacat

SEQ ID NO: 574859 - DNA, 25 bp, Mus musculus
gctgttgactccttgctatatacat

SEQ ID NO: 574860 - DNA, 25 bp, Mus musculus
gctgttgactctcacaaggctacaa

SEQ ID NO: 574861 - DNA, 25 bp, Mus musculus
gctgttgactctgacaaggctacaa

SEQ ID NO: 574862 - DNA, 25 bp, Mus musculus
gctgttgactgaaatcactttgggt

SEQ ID NO: 574863 - DNA, 25 bp, Mus musculus
gctgttgactgatatcactttgggt

SEQ ID NO: 574864 - DNA, 25 bp, Mus musculus
gctgttgagagaccagatttctaac

SEQ ID NO: 574865 - DNA, 25 bp, Mus musculus
gctgttgagagagcagatttctaac

SEQ ID NO: 574866 - DNA, 25 bp, Mus musculus
gctgttgagcttaatggcgtgttct

SEQ ID NO: 574867 - DNA, 25 bp, Mus musculus
gctgttgagctttatggcgtgttct

SEQ ID NO: 574868 - DNA, 25 bp, Mus musculus
gctgttgaggccaggctgactttct

SEQ ID NO: 574869 - DNA, 25 bp, Mus musculus
gctgttgaggcctggctgactttct

SEQ ID NO: 574870 - DNA, 25 bp, Mus musculus
gctgttgagggtatgctgagatcaa

SEQ ID NO: 574871 - DNA, 25 bp, Mus musculus
gctgttgagggtttgctgagatcaa

SEQ ID NO: 574872 - DNA, 25 bp, Mus musculus
gctgttgatagcatccttggtgact

SEQ ID NO: 574873 - DNA, 25 bp, Mus musculus
gctgttgatagcttccttggtgact

SEQ ID NO: 574874 - DNA, 25 bp, Mus musculus
gctgttgatctgctcatctaatcat

SEQ ID NO: 574875 - DNA, 25 bp, Mus musculus
gctgttgatctggtcatctaatcat

SEQ ID NO: 574876 - DNA, 25 bp, Mus musculus
gctgttgcaagcagtatacttcatt

SEQ ID NO: 574877 - DNA, 25 bp, Mus musculus
gctgttgcaagctgtatacttcatt

SEQ ID NO: 574878 - DNA, 25 bp, Mus musculus
gctgttgcagcacatggttacctca

SEQ ID NO: 574879 - DNA, 25 bp, Mus musculus
gctgttgcagcagatggttacctca

SEQ ID NO: 574880 - DNA, 25 bp, Mus musculus
gctgttgcagggacctgcaagtacc

SEQ ID NO: 574881 - DNA, 25 bp, Mus musculus
gctgttgcagggtcctgcaagtacc

SEQ ID NO: 574882 - DNA, 25 bp, Mus musculus
gctgttgcagttctgagagcaccaa

SEQ ID NO: 574883 - DNA, 25 bp, Mus musculus
gctgttgcagttgtgagagcaccaa

SEQ ID NO: 574884 - DNA, 25 bp, Mus musculus
gctgttgcataacctacttttataa

SEQ ID NO: 574885 - DNA, 25 bp, Mus musculus
gctgttgcataagctacttttataa

SEQ ID NO: 574886 - DNA, 25 bp, Mus musculus
gctgttgcattacatacttttgctt

SEQ ID NO: 574887 - DNA, 25 bp, Mus musculus
gctgttgcattagatacttttgctt

SEQ ID NO: 574888 - DNA, 25 bp, Mus musculus
gctgttgccaaaactttccagtctt

SEQ ID NO: 574889 - DNA, 25 bp, Mus musculus
gctgttgccaaatctttccagtctt

SEQ ID NO: 574890 - DNA, 25 bp, Mus musculus
gctgttgccaccacgattcagaaaa

SEQ ID NO: 574891 - DNA, 25 bp, Mus musculus
gctgttgccacctcgattcagaaaa

SEQ ID NO: 574892 - DNA, 25 bp, Mus musculus
gctgttgcccagctcagattagcag

SEQ ID NO: 574893 - DNA, 25 bp, Mus musculus
gctgttgcccaggtcagattagcag

SEQ ID NO: 574894 - DNA, 25 bp, Mus musculus
gctgttgccgaacgcgtcggtctcc

SEQ ID NO: 574895 - DNA, 25 bp, Mus musculus
gctgttgccgaaggcgtcggtctcc

SEQ ID NO: 574896 - DNA, 25 bp, Mus musculus
gctgttgcctataaatcacttactt

SEQ ID NO: 574897 - DNA, 25 bp, Mus musculus
gctgttgcctatattgttatctttt

SEQ ID NO: 574898 - DNA, 25 bp, Mus musculus
gctgttgcctattaatcacttactt

SEQ ID NO: 574899 - DNA, 25 bp, Mus musculus
gctgttgcctattttgttatctttt

SEQ ID NO: 574900 - DNA, 25 bp, Mus musculus
gctgttgcgatcctgtaagacttta

SEQ ID NO: 574901 - DNA, 25 bp, Mus musculus
gctgttgcgatcgtgtaagacttta

SEQ ID NO: 574902 - DNA, 25 bp, Mus musculus
gctgttgcgcgaacaatacttgctg

SEQ ID NO: 574903 - DNA, 25 bp, Mus musculus
gctgttgcgcgatcaatacttgctg

SEQ ID NO: 574904 - DNA, 25 bp, Mus musculus
gctgttgctcctaagagtttcacgt

SEQ ID NO: 574905 - DNA, 25 bp, Mus musculus
gctgttgctccttagagtttcacgt

SEQ ID NO: 574906 - DNA, 25 bp, Mus musculus
gctgttgctctccaaagtgccatat

SEQ ID NO: 574907 - DNA, 25 bp, Mus musculus
gctgttgctctcgaaagtgccatat

SEQ ID NO: 574908 - DNA, 25 bp, Mus musculus
gctgttgctgacatttgtatgtaca

SEQ ID NO: 574909 - DNA, 25 bp, Mus musculus
gctgttgctgacttttgtatgtaca

SEQ ID NO: 574910 - DNA, 25 bp, Mus musculus
gctgttgctggtcaacttgcaagta

SEQ ID NO: 574911 - DNA, 25 bp, Mus musculus
gctgttgctggtgaacttgcaagta

SEQ ID NO: 574912 - DNA, 25 bp, Mus musculus
gctgttgctgttcggtgccttattc

SEQ ID NO: 574913 - DNA, 25 bp, Mus musculus
gctgttgctgttgggtgccttattc

SEQ ID NO: 574914 - DNA, 25 bp, Mus musculus
gctgttgcttcaccagaagattcat

SEQ ID NO: 574915 - DNA, 25 bp, Mus musculus
gctgttgcttcagcagaagattcat

SEQ ID NO: 574916 - DNA, 25 bp, Mus musculus
gctgttgcttccaggactaaaccaa

SEQ ID NO: 574917 - DNA, 25 bp, Mus musculus
gctgttgcttcctggactaaaccaa

SEQ ID NO: 574918 - DNA, 25 bp, Mus musculus
gctgttggaagaatcactgcttgtg

SEQ ID NO: 574919 - DNA, 25 bp, Mus musculus
gctgttggaagattcactgcttgtg

SEQ ID NO: 574920 - DNA, 25 bp, Mus musculus
gctgttggacaaatatctcattctc

SEQ ID NO: 574921 - DNA, 25 bp, Mus musculus
gctgttggacaattatctcattctc

SEQ ID NO: 574922 - DNA, 25 bp, Mus musculus
gctgttggaggtagattgtgccaca

SEQ ID NO: 574923 - DNA, 25 bp, Mus musculus
gctgttggaggttgattgtgccaca

SEQ ID NO: 574924 - DNA, 25 bp, Mus musculus
gctgttggcaataaaaacccacttg

SEQ ID NO: 574925 - DNA, 25 bp, Mus musculus
gctgttggcaattaaaacccacttg

SEQ ID NO: 574926 - DNA, 25 bp, Mus musculus
gctgttggcatcaggtaaatctaat

SEQ ID NO: 574927 - DNA, 25 bp, Mus musculus
gctgttggcatctggtaaatctaat

SEQ ID NO: 574928 - DNA, 25 bp, Mus musculus
gctgttggcccactgatatactaaa

SEQ ID NO: 574929 - DNA, 25 bp, Mus musculus
gctgttggcccagtgatatactaaa

SEQ ID NO: 574930 - DNA, 25 bp, Mus musculus
gctgttggcctgctattcaatacca

SEQ ID NO: 574931 - DNA, 25 bp, Mus musculus
gctgttggcctggtattcaatacca

SEQ ID NO: 574932 - DNA, 25 bp, Mus musculus
gctgttggcggcagcagaaccagat

SEQ ID NO: 574933 - DNA, 25 bp, Mus musculus
gctgttggcggctgcagaaccagat

SEQ ID NO: 574934 - DNA, 25 bp, Mus musculus
gctgttggctagcatgataattgac

SEQ ID NO: 574935 - DNA, 25 bp, Mus musculus
gctgttggctaggatgataattgac

SEQ ID NO: 574936 - DNA, 25 bp, Mus musculus
gctgttggctcaccagcacggagca

SEQ ID NO: 574937 - DNA, 25 bp, Mus musculus
gctgttggctcagcagcacggagca

SEQ ID NO: 574938 - DNA, 25 bp, Mus musculus
gctgttgggacaaggcgggtgctca

SEQ ID NO: 574939 - DNA, 25 bp, Mus musculus
gctgttgggacatggcgggtgctca

SEQ ID NO: 574940 - DNA, 25 bp, Mus musculus
gctgttgggagccttgcactcacta

SEQ ID NO: 574941 - DNA, 25 bp, Mus musculus
gctgttgggagcgttgcactcacta

SEQ ID NO: 574942 - DNA, 25 bp, Mus musculus
gctgttgggcctcttggaaacttca

SEQ ID NO: 574943 - DNA, 25 bp, Mus musculus
gctgttgggcctgttggaaacttca

SEQ ID NO: 574944 - DNA, 25 bp, Mus musculus
gctgttgggtttcggctaagatcta

SEQ ID NO: 574945 - DNA, 25 bp, Mus musculus
gctgttgggtttgggctaagatcta

SEQ ID NO: 574946 - DNA, 25 bp, Mus musculus
gctgttggtagtatactcctttaat

SEQ ID NO: 574947 - DNA, 25 bp, Mus musculus
gctgttggtagtttactcctttaat

SEQ ID NO: 574948 - DNA, 25 bp, Mus musculus
gctgttggtcacacttgtcttcctt

SEQ ID NO: 574949 - DNA, 25 bp, Mus musculus
gctgttggtcactcttgtcttcctt

SEQ ID NO: 574950 - DNA, 25 bp, Mus musculus
gctgttggtgtaaactacttgtgca

SEQ ID NO: 574951 - DNA, 25 bp, Mus musculus
gctgttggtgtatactacttgtgca

SEQ ID NO: 574952 - DNA, 25 bp, Mus musculus
gctgttggttggatatttcctgctt

SEQ ID NO: 574953 - DNA, 25 bp, Mus musculus
gctgttggttggttatttcctgctt

SEQ ID NO: 574954 - DNA, 25 bp, Mus musculus
gctgttgtattcaaacccttggtgt

SEQ ID NO: 574955 - DNA, 25 bp, Mus musculus
gctgttgtattctaacccttggtgt

SEQ ID NO: 574956 - DNA, 25 bp, Mus musculus
gctgttgtcacactatatctacaca

SEQ ID NO: 574957 - DNA, 25 bp, Mus musculus
gctgttgtcacagtatatctacaca

SEQ ID NO: 574958 - DNA, 25 bp, Mus musculus
gctgttgtcaccctgtacacctaga

SEQ ID NO: 574959 - DNA, 25 bp, Mus musculus
gctgttgtcaccgtgtacacctaga

SEQ ID NO: 574960 - DNA, 25 bp, Mus musculus
gctgttgtcagtaactttccttcat

SEQ ID NO: 574961 - DNA, 25 bp, Mus musculus
gctgttgtcagttactttccttcat

SEQ ID NO: 574962 - DNA, 25 bp, Mus musculus
gctgttgtccaaaaagagtgaatct

SEQ ID NO: 574963 - DNA, 25 bp, Mus musculus
gctgttgtccaataagagtgaatct

SEQ ID NO: 574964 - DNA, 25 bp, Mus musculus
gctgttgtcctgagtgctaccttct

SEQ ID NO: 574965 - DNA, 25 bp, Mus musculus
gctgttgtcctgtgtgctaccttct

SEQ ID NO: 574966 - DNA, 25 bp, Mus musculus
gctgttgtccttcctctgataaaat

SEQ ID NO: 574967 - DNA, 25 bp, Mus musculus
gctgttgtccttgctctgataaaat

SEQ ID NO: 574968 - DNA, 25 bp, Mus musculus
gctgttgtctaaaccttgtggactt

SEQ ID NO: 574969 - DNA, 25 bp, Mus musculus
gctgttgtctaatccttgtggactt

SEQ ID NO: 574970 - DNA, 25 bp, Mus musculus
gctgttgtctatatctaggctcttt

SEQ ID NO: 574971 - DNA, 25 bp, Mus musculus
gctgttgtctatttctaggctcttt

SEQ ID NO: 574972 - DNA, 25 bp, Mus musculus
gctgttgtgaaccatgaattttcta

SEQ ID NO: 574973 - DNA, 25 bp, Mus musculus
gctgttgtgaacgatgaattttcta

SEQ ID NO: 574974 - DNA, 25 bp, Mus musculus
gctgttgtgactcagctgctgtgac

SEQ ID NO: 574975 - DNA, 25 bp, Mus musculus
gctgttgtgactcaggaatctgcac

SEQ ID NO: 574976 - DNA, 25 bp, Mus musculus
gctgttgtgactgagctgctgtgac

SEQ ID NO: 574977 - DNA, 25 bp, Mus musculus
gctgttgtgactgaggaatctgcac

SEQ ID NO: 574978 - DNA, 25 bp, Mus musculus
gctgttgtggacattactaaccatc

SEQ ID NO: 574979 - DNA, 25 bp, Mus musculus
gctgttgtggactttactaaccatc

SEQ ID NO: 574980 - DNA, 25 bp, Mus musculus
gctgttgtggatcctgggacaccaa

SEQ ID NO: 574981 - DNA, 25 bp, Mus musculus
gctgttgtggatgctgggacaccaa

SEQ ID NO: 574982 - DNA, 25 bp, Mus musculus
gctgttgtgttaactcctagctgac

SEQ ID NO: 574983 - DNA, 25 bp, Mus musculus
gctgttgtgttatctcctagctgac

SEQ ID NO: 574984 - DNA, 25 bp, Mus musculus
gctgttgtgttgaccttgtgaatgt

SEQ ID NO: 574985 - DNA, 25 bp, Mus musculus
gctgttgtgttgtccttgtgaatgt

SEQ ID NO: 574986 - DNA, 25 bp, Mus musculus
gctgttgttagcattggtttctgct

SEQ ID NO: 574987 - DNA, 25 bp, Mus musculus
gctgttgttagctttggtttctgct

SEQ ID NO: 574988 - DNA, 25 bp, Mus musculus
gctgttgttatgctctttccaaaga

SEQ ID NO: 574989 - DNA, 25 bp, Mus musculus
gctgttgttatggtctttccaaaga

SEQ ID NO: 574990 - DNA, 25 bp, Mus musculus
gctgttgttttgaccttaaattgaa

SEQ ID NO: 574991 - DNA, 25 bp, Mus musculus
gctgttgttttgcatcatggacttc

SEQ ID NO: 574992 - DNA, 25 bp, Mus musculus
gctgttgttttggatcatggacttc

SEQ ID NO: 574993 - DNA, 25 bp, Mus musculus
gctgttgttttgtccttaaattgaa

SEQ ID NO: 574994 - DNA, 25 bp, Mus musculus
gctgtttaaactcctttggcttggt

SEQ ID NO: 574995 - DNA, 25 bp, Mus musculus
gctgtttaaactgctttggcttggt

SEQ ID NO: 574996 - DNA, 25 bp, Mus musculus
gctgtttaaagtctttgtagcgttt

SEQ ID NO: 574997 - DNA, 25 bp, Mus musculus
gctgtttaaagtgtttgtagcgttt

SEQ ID NO: 574998 - DNA, 25 bp, Mus musculus
gctgtttaaccgaatttcacgtggt

SEQ ID NO: 574999 - DNA, 25 bp, Mus musculus
gctgtttaaccgtatttcacgtggt

SEQ ID NO: 575000 - DNA, 25 bp, Mus musculus
gctgtttaagatcgtcaggtgacct

SEQ ID NO: 575001 - DNA, 25 bp, Mus musculus
gctgtttaagatggtcaggtgacct

SEQ ID NO: 575002 - DNA, 25 bp, Mus musculus
gctgtttaagccctgtgtttggaag

SEQ ID NO: 575003 - DNA, 25 bp, Mus musculus
gctgtttaagccgtgtgtttggaag

SEQ ID NO: 575004 - DNA, 25 bp, Mus musculus
gctgtttaagttcacaacttccttc

SEQ ID NO: 575005 - DNA, 25 bp, Mus musculus
gctgtttaagttgacaacttccttc

SEQ ID NO: 575006 - DNA, 25 bp, Mus musculus
gctgtttacaacatcaccagtgcca

SEQ ID NO: 575007 - DNA, 25 bp, Mus musculus
gctgtttacaacttcaccagtgcca

SEQ ID NO: 575008 - DNA, 25 bp, Mus musculus
gctgtttacagtctctcatacccaa

SEQ ID NO: 575009 - DNA, 25 bp, Mus musculus
gctgtttacagtgtctcatacccaa

SEQ ID NO: 575010 - DNA, 25 bp, Mus musculus
gctgtttactgacatggtgctgtgt

SEQ ID NO: 575011 - DNA, 25 bp, Mus musculus
gctgtttactgagatggtgctgtgt

SEQ ID NO: 575012 - DNA, 25 bp, Mus musculus
gctgtttactggactttggtttctt

SEQ ID NO: 575013 - DNA, 25 bp, Mus musculus
gctgtttactggtctttggtttctt

SEQ ID NO: 575014 - DNA, 25 bp, Mus musculus
gctgtttacttcctgatatacgcca

SEQ ID NO: 575015 - DNA, 25 bp, Mus musculus
gctgtttacttcgtgatatacgcca

SEQ ID NO: 575016 - DNA, 25 bp, Mus musculus
gctgtttagaatcttatgcctcaca

SEQ ID NO: 575017 - DNA, 25 bp, Mus musculus
gctgtttagaatgttatgcctcaca

SEQ ID NO: 575018 - DNA, 25 bp, Mus musculus
gctgtttagactctggtgagacctt

SEQ ID NO: 575019 - DNA, 25 bp, Mus musculus
gctgtttagactgtggtgagacctt

SEQ ID NO: 575020 - DNA, 25 bp, Mus musculus
gctgtttagcagctttggtagttaa

SEQ ID NO: 575021 - DNA, 25 bp, Mus musculus
gctgtttagcaggtttggtagttaa

SEQ ID NO: 575022 - DNA, 25 bp, Mus musculus
gctgtttatattcacgttttcctag

SEQ ID NO: 575023 - DNA, 25 bp, Mus musculus
gctgtttatattgacgttttcctag

SEQ ID NO: 575024 - DNA, 25 bp, Mus musculus
gctgtttatcaacgcaaagggctat

SEQ ID NO: 575025 - DNA, 25 bp, Mus musculus
gctgtttatcaaggcaaagggctat

SEQ ID NO: 575026 - DNA, 25 bp, Mus musculus
gctgtttatggaaccttcgggagct

SEQ ID NO: 575027 - DNA, 25 bp, Mus musculus
gctgtttatggatccttcgggagct

SEQ ID NO: 575028 - DNA, 25 bp, Mus musculus
gctgtttatgtcactgagaaatgct

SEQ ID NO: 575029 - DNA, 25 bp, Mus musculus
gctgtttatgtctctgagaaatgct

SEQ ID NO: 575030 - DNA, 25 bp, Mus musculus
gctgtttattagaagtgctgtctga

SEQ ID NO: 575031 - DNA, 25 bp, Mus musculus
gctgtttattagtagtgctgtctga

SEQ ID NO: 575032 - DNA, 25 bp, Mus musculus
gctgtttcaaaacccgagtaactcg

SEQ ID NO: 575033 - DNA, 25 bp, Mus musculus
gctgtttcaaaagccgagtaactcg

SEQ ID NO: 575034 - DNA, 25 bp, Mus musculus
gctgtttcactgatgactctgggaa

SEQ ID NO: 575035 - DNA, 25 bp, Mus musculus
gctgtttcactgcttatgcggcgga

SEQ ID NO: 575036 - DNA, 25 bp, Mus musculus
gctgtttcactggttatgcggcgga

SEQ ID NO: 575037 - DNA, 25 bp, Mus musculus
gctgtttcactgttgactctgggaa

SEQ ID NO: 575038 - DNA, 25 bp, Mus musculus
gctgtttcattaactgtgcagtgta

SEQ ID NO: 575039 - DNA, 25 bp, Mus musculus
gctgtttcattatctgtgcagtgta

SEQ ID NO: 575040 - DNA, 25 bp, Mus musculus
gctgtttccataattttcctcgaat

SEQ ID NO: 575041 - DNA, 25 bp, Mus musculus
gctgtttccatatttttcctcgaat

SEQ ID NO: 575042 - DNA, 25 bp, Mus musculus
gctgtttccccgaggacactaagga

SEQ ID NO: 575043 - DNA, 25 bp, Mus musculus
gctgtttccccgtggacactaagga

SEQ ID NO: 575044 - DNA, 25 bp, Mus musculus
gctgtttcccggcagtgtgtacatg

SEQ ID NO: 575045 - DNA, 25 bp, Mus musculus
gctgtttcccgggagtgtgtacatg

SEQ ID NO: 575046 - DNA, 25 bp, Mus musculus
gctgtttccctacctcctgaaaaga

SEQ ID NO: 575047 - DNA, 25 bp, Mus musculus
gctgtttccctagctcctgaaaaga

SEQ ID NO: 575048 - DNA, 25 bp, Mus musculus
gctgtttcctgactcagaacggcca

SEQ ID NO: 575049 - DNA, 25 bp, Mus musculus
gctgtttcctgagtcagaacggcca

SEQ ID NO: 575050 - DNA, 25 bp, Mus musculus
gctgtttcctgtcgactgaacaaac

SEQ ID NO: 575051 - DNA, 25 bp, Mus musculus
gctgtttcctgtggactgaacaaac

SEQ ID NO: 575052 - DNA, 25 bp, Mus musculus
gctgtttccttcacctgggatgtga

SEQ ID NO: 575053 - DNA, 25 bp, Mus musculus
gctgtttccttcatgtaatattgta

SEQ ID NO: 575054 - DNA, 25 bp, Mus musculus
gctgtttccttctcctgggatgtga

SEQ ID NO: 575055 - DNA, 25 bp, Mus musculus
gctgtttccttcttgtaatattgta

SEQ ID NO: 575056 - DNA, 25 bp, Mus musculus
gctgtttccttgaatgcttcttgaa

SEQ ID NO: 575057 - DNA, 25 bp, Mus musculus
gctgtttccttgtatgcttcttgaa

SEQ ID NO: 575058 - DNA, 25 bp, Mus musculus
gctgtttctaaactccagggtgaca

SEQ ID NO: 575059 - DNA, 25 bp, Mus musculus
gctgtttctaaagtccagggtgaca

SEQ ID NO: 575060 - DNA, 25 bp, Mus musculus
gctgtttctaatatgactttccaga

SEQ ID NO: 575061 - DNA, 25 bp, Mus musculus
gctgtttctaatttgactttccaga

SEQ ID NO: 575062 - DNA, 25 bp, Mus musculus
gctgtttctaccatcacattacttg

SEQ ID NO: 575063 - DNA, 25 bp, Mus musculus
gctgtttctaccttcacattacttg

SEQ ID NO: 575064 - DNA, 25 bp, Mus musculus
gctgtttctagtaaagtggctgcca

SEQ ID NO: 575065 - DNA, 25 bp, Mus musculus
gctgtttctagttaagtggctgcca

SEQ ID NO: 575066 - DNA, 25 bp, Mus musculus
gctgtttctataatcatttcatcct

SEQ ID NO: 575067 - DNA, 25 bp, Mus musculus
gctgtttctatattcatttcatcct

SEQ ID NO: 575068 - DNA, 25 bp, Mus musculus
gctgtttctattaacccatagcatt

SEQ ID NO: 575069 - DNA, 25 bp, Mus musculus
gctgtttctatttacccatagcatt

SEQ ID NO: 575070 - DNA, 25 bp, Mus musculus
gctgtttctcacatacaggtatgaa

SEQ ID NO: 575071 - DNA, 25 bp, Mus musculus
gctgtttctcacttacaggtatgaa

SEQ ID NO: 575072 - DNA, 25 bp, Mus musculus
gctgtttctgaaagagtctgctggc

SEQ ID NO: 575073 - DNA, 25 bp, Mus musculus
gctgtttctgaatgagtctgctggc

SEQ ID NO: 575074 - DNA, 25 bp, Mus musculus
gctgtttctgagagggaccccagat

SEQ ID NO: 575075 - DNA, 25 bp, Mus musculus
gctgtttctgagtgggaccccagat

SEQ ID NO: 575076 - DNA, 25 bp, Mus musculus
gctgtttctggaacaccgtggttat

SEQ ID NO: 575077 - DNA, 25 bp, Mus musculus
gctgtttctggatcaccgtggttat

SEQ ID NO: 575078 - DNA, 25 bp, Mus musculus
gctgtttcttagattggtcgacctc

SEQ ID NO: 575079 - DNA, 25 bp, Mus musculus
gctgtttcttagtttggtcgacctc

SEQ ID NO: 575080 - DNA, 25 bp, Mus musculus
gctgtttcttataggcttcatgttc

SEQ ID NO: 575081 - DNA, 25 bp, Mus musculus
gctgtttcttattggcttcatgttc

SEQ ID NO: 575082 - DNA, 25 bp, Mus musculus
gctgtttcttccaaaagtgacttga

SEQ ID NO: 575083 - DNA, 25 bp, Mus musculus
gctgtttcttcctaaagtgacttga

SEQ ID NO: 575084 - DNA, 25 bp, Mus musculus
gctgtttgaaacctgatctgcttac

SEQ ID NO: 575085 - DNA, 25 bp, Mus musculus
gctgtttgaaacgtgatctgcttac

SEQ ID NO: 575086 - DNA, 25 bp, Mus musculus
gctgtttgaactaatgcgcatgtgc

SEQ ID NO: 575087 - DNA, 25 bp, Mus musculus
gctgtttgaacttatgcgcatgtgc

SEQ ID NO: 575088 - DNA, 25 bp, Mus musculus
gctgtttgaatgagatgctgcccac

SEQ ID NO: 575089 - DNA, 25 bp, Mus musculus
gctgtttgaatgtgatgctgcccac

SEQ ID NO: 575090 - DNA, 25 bp, Mus musculus
gctgtttgacaaccactacctatat

SEQ ID NO: 575091 - DNA, 25 bp, Mus musculus
gctgtttgacaagcactacctatat

SEQ ID NO: 575092 - DNA, 25 bp, Mus musculus
gctgtttgacacctctttttaatct

SEQ ID NO: 575093 - DNA, 25 bp, Mus musculus
gctgtttgacacgtctttttaatct

SEQ ID NO: 575094 - DNA, 25 bp, Mus musculus
gctgtttgaccaactggaacctgaa

SEQ ID NO: 575095 - DNA, 25 bp, Mus musculus
gctgtttgaccaagcaccagacaaa

SEQ ID NO: 575096 - DNA, 25 bp, Mus musculus
gctgtttgaccatctggaacctgaa

SEQ ID NO: 575097 - DNA, 25 bp, Mus musculus
gctgtttgaccatgcaccagacaaa

SEQ ID NO: 575098 - DNA, 25 bp, Mus musculus
gctgtttgacctcgaaaccaatctt

SEQ ID NO: 575099 - DNA, 25 bp, Mus musculus
gctgtttgacctggaaaccaatctt

SEQ ID NO: 575100 - DNA, 25 bp, Mus musculus
gctgtttgagatctgatgctggtac

SEQ ID NO: 575101 - DNA, 25 bp, Mus musculus
gctgtttgagatgtgatgctggtac

SEQ ID NO: 575102 - DNA, 25 bp, Mus musculus
gctgtttgatacagtgtgcgacgtg

SEQ ID NO: 575103 - DNA, 25 bp, Mus musculus
gctgtttgatactgtgtgcgacgtg

SEQ ID NO: 575104 - DNA, 25 bp, Mus musculus
gctgtttgatggatgctacttcttt

SEQ ID NO: 575105 - DNA, 25 bp, Mus musculus
gctgtttgatggttgctacttcttt

SEQ ID NO: 575106 - DNA, 25 bp, Mus musculus
gctgtttgattcagcattcaaggtg

SEQ ID NO: 575107 - DNA, 25 bp, Mus musculus
gctgtttgattctgcattcaaggtg

SEQ ID NO: 575108 - DNA, 25 bp, Mus musculus
gctgtttgccttcttagttcttgga

SEQ ID NO: 575109 - DNA, 25 bp, Mus musculus
gctgtttgccttgttagttcttgga

SEQ ID NO: 575110 - DNA, 25 bp, Mus musculus
gctgtttgcttgaagacacacttaa

SEQ ID NO: 575111 - DNA, 25 bp, Mus musculus
gctgtttgcttgtagacacacttaa

SEQ ID NO: 575112 - DNA, 25 bp, Mus musculus
gctgtttggcatcaccagtttttgc

SEQ ID NO: 575113 - DNA, 25 bp, Mus musculus
gctgtttggcatgaccagtttttgc

SEQ ID NO: 575114 - DNA, 25 bp, Mus musculus
gctgtttggtaaaaatatagtccta

SEQ ID NO: 575115 - DNA, 25 bp, Mus musculus
gctgtttggtaataatatagtccta

SEQ ID NO: 575116 - DNA, 25 bp, Mus musculus
gctgtttggtagctgcactaggaaa

SEQ ID NO: 575117 - DNA, 25 bp, Mus musculus
gctgtttggtaggtgcactaggaaa

SEQ ID NO: 575118 - DNA, 25 bp, Mus musculus
gctgtttggtgtaatgtttgacaac

SEQ ID NO: 575119 - DNA, 25 bp, Mus musculus
gctgtttggtgttatgtttgacaac

SEQ ID NO: 575120 - DNA, 25 bp, Mus musculus
gctgtttgtaagatccaggccatac

SEQ ID NO: 575121 - DNA, 25 bp, Mus musculus
gctgtttgtaagttccaggccatac

SEQ ID NO: 575122 - DNA, 25 bp, Mus musculus
gctgtttgtacacactttcagaaca

SEQ ID NO: 575123 - DNA, 25 bp, Mus musculus
gctgtttgtacagactttcagaaca

SEQ ID NO: 575124 - DNA, 25 bp, Mus musculus
gctgtttgtaggaactgtcgggtca

SEQ ID NO: 575125 - DNA, 25 bp, Mus musculus
gctgtttgtaggtactgtcgggtca

SEQ ID NO: 575126 - DNA, 25 bp, Mus musculus
gctgtttgtatcaggtttgcattta

SEQ ID NO: 575127 - DNA, 25 bp, Mus musculus
gctgtttgtatctggtttgcattta

SEQ ID NO: 575128 - DNA, 25 bp, Mus musculus
gctgtttgtcatcgcccgagaacat

SEQ ID NO: 575129 - DNA, 25 bp, Mus musculus
gctgtttgtcatggcccgagaacat

SEQ ID NO: 575130 - DNA, 25 bp, Mus musculus
gctgtttgtcctatttgagtctgaa

SEQ ID NO: 575131 - DNA, 25 bp, Mus musculus
gctgtttgtcctttttgagtctgaa

SEQ ID NO: 575132 - DNA, 25 bp, Mus musculus
gctgtttgtgaaagactggatcctg

SEQ ID NO: 575133 - DNA, 25 bp, Mus musculus
gctgtttgtgaatgactggatcctg

SEQ ID NO: 575134 - DNA, 25 bp, Mus musculus
gctgtttgtgacctttgatgctgac

SEQ ID NO: 575135 - DNA, 25 bp, Mus musculus
gctgtttgtgacgtttgatgctgac

SEQ ID NO: 575136 - DNA, 25 bp, Mus musculus
gctgtttgtttgcaagtccattcct

SEQ ID NO: 575137 - DNA, 25 bp, Mus musculus
gctgtttgtttggaagtccattcct

SEQ ID NO: 575138 - DNA, 25 bp, Mus musculus
gctgttttacatcacttctcttttg

SEQ ID NO: 575139 - DNA, 25 bp, Mus musculus
gctgttttacatctactaccttctt

SEQ ID NO: 575140 - DNA, 25 bp, Mus musculus
gctgttttacatgacttctcttttg

SEQ ID NO: 575141 - DNA, 25 bp, Mus musculus
gctgttttacatgtactaccttctt

SEQ ID NO: 575142 - DNA, 25 bp, Mus musculus
gctgttttaccaatttaagtctctg

SEQ ID NO: 575143 - DNA, 25 bp, Mus musculus
gctgttttaccattttaagtctctg

SEQ ID NO: 575144 - DNA, 25 bp, Mus musculus
gctgttttaggacgaacccaccatg

SEQ ID NO: 575145 - DNA, 25 bp, Mus musculus
gctgttttaggaggaacccaccatg

SEQ ID NO: 575146 - DNA, 25 bp, Mus musculus
gctgttttatgccttttaacctcca

SEQ ID NO: 575147 - DNA, 25 bp, Mus musculus
gctgttttatgcgttttaacctcca

SEQ ID NO: 575148 - DNA, 25 bp, Mus musculus
gctgttttatttcctgaagaaaata

SEQ ID NO: 575149 - DNA, 25 bp, Mus musculus
gctgttttatttgctgaagaaaata

SEQ ID NO: 575150 - DNA, 25 bp, Mus musculus
gctgttttcactagtattgacttta

SEQ ID NO: 575151 - DNA, 25 bp, Mus musculus
gctgttttcacttgtattgacttta

SEQ ID NO: 575152 - DNA, 25 bp, Mus musculus
gctgttttcaggcaggttacttcaa

SEQ ID NO: 575153 - DNA, 25 bp, Mus musculus
gctgttttcagggaggttacttcaa

SEQ ID NO: 575154 - DNA, 25 bp, Mus musculus
gctgttttcagtatttcttgatttc

SEQ ID NO: 575155 - DNA, 25 bp, Mus musculus
gctgttttcagtttttcttgatttc

SEQ ID NO: 575156 - DNA, 25 bp, Mus musculus
gctgttttccagctttcaaattcct

SEQ ID NO: 575157 - DNA, 25 bp, Mus musculus
gctgttttccaggtttcaaattcct

SEQ ID NO: 575158 - DNA, 25 bp, Mus musculus
gctgttttcctaaaaactacctaag

SEQ ID NO: 575159 - DNA, 25 bp, Mus musculus
gctgttttcctataaactacctaag

SEQ ID NO: 575160 - DNA, 25 bp, Mus musculus
gctgttttcgccagtcagccatgaa

SEQ ID NO: 575161 - DNA, 25 bp, Mus musculus
gctgttttcgcctgtcagccatgaa

SEQ ID NO: 575162 - DNA, 25 bp, Mus musculus
gctgttttctaacctgaatgatgca

SEQ ID NO: 575163 - DNA, 25 bp, Mus musculus
gctgttttctaagctgaatgatgca

SEQ ID NO: 575164 - DNA, 25 bp, Mus musculus
gctgttttctgacaggtgttatcca

SEQ ID NO: 575165 - DNA, 25 bp, Mus musculus
gctgttttctgagaggtgttatcca

SEQ ID NO: 575166 - DNA, 25 bp, Mus musculus
gctgttttctggatttagccaaact

SEQ ID NO: 575167 - DNA, 25 bp, Mus musculus
gctgttttctggttttagccaaact

SEQ ID NO: 575168 - DNA, 25 bp, Mus musculus
gctgttttgaggagattttcttgta

SEQ ID NO: 575169 - DNA, 25 bp, Mus musculus
gctgttttgaggtgattttcttgta

SEQ ID NO: 575170 - DNA, 25 bp, Mus musculus
gctgttttgcagatctttgccagta

SEQ ID NO: 575171 - DNA, 25 bp, Mus musculus
gctgttttgcagcacgagtcatagc

SEQ ID NO: 575172 - DNA, 25 bp, Mus musculus
gctgttttgcaggacgagtcatagc

SEQ ID NO: 575173 - DNA, 25 bp, Mus musculus
gctgttttgcagttctttgccagta

SEQ ID NO: 575174 - DNA, 25 bp, Mus musculus
gctgttttgcttctgggctatggaa

SEQ ID NO: 575175 - DNA, 25 bp, Mus musculus
gctgttttgcttgtgggctatggaa

SEQ ID NO: 575176 - DNA, 25 bp, Mus musculus
gctgttttggctagcccttgcccca

SEQ ID NO: 575177 - DNA, 25 bp, Mus musculus
gctgttttggcttgcccttgcccca

SEQ ID NO: 575178 - DNA, 25 bp, Mus musculus
gctgttttgttcagaatgggctaaa

SEQ ID NO: 575179 - DNA, 25 bp, Mus musculus
gctgttttgttctgaatgggctaaa

SEQ ID NO: 575180 - DNA, 25 bp, Mus musculus
gctgtttttaccaagttagcttgtg

SEQ ID NO: 575181 - DNA, 25 bp, Mus musculus
gctgtttttacctagttagcttgtg

SEQ ID NO: 575182 - DNA, 25 bp, Mus musculus
gctgtttttcctaggtggtgaatca

SEQ ID NO: 575183 - DNA, 25 bp, Mus musculus
gctgtttttccttggtggtgaatca

SEQ ID NO: 575184 - DNA, 25 bp, Mus musculus
gctgtttttcttcctagtattcgct

SEQ ID NO: 575185 - DNA, 25 bp, Mus musculus
gctgtttttcttgctagtattcgct

SEQ ID NO: 575186 - DNA, 25 bp, Mus musculus
gctgtttttgttaagttcagatcta

SEQ ID NO: 575187 - DNA, 25 bp, Mus musculus
gctgtttttgtttagttcagatcta

SEQ ID NO: 575188 - DNA, 25 bp, Mus musculus
gctgttttttatattcttgtgaatg

SEQ ID NO: 575189 - DNA, 25 bp, Mus musculus
gctgttttttattttcttgtgaatg

SEQ ID NO: 575190 - DNA, 25 bp, Mus musculus
gctgttttttctatacaggcaagaa

SEQ ID NO: 575191 - DNA, 25 bp, Mus musculus
gctgttttttctttacaggcaagaa

SEQ ID NO: 575192 - DNA, 25 bp, Mus musculus
gcttaaaaccttattgcatgtccat

SEQ ID NO: 575193 - DNA, 25 bp, Mus musculus
gcttaaaacctttttgcatgtccat

SEQ ID NO: 575194 - DNA, 25 bp, Mus musculus
gcttaaaagcagattcctgtgttgg

SEQ ID NO: 575195 - DNA, 25 bp, Mus musculus
gcttaaaagcagtttcctgtgttgg

SEQ ID NO: 575196 - DNA, 25 bp, Mus musculus
gcttaaaatgttatccttggcagaa

SEQ ID NO: 575197 - DNA, 25 bp, Mus musculus
gcttaaaatgttttccttggcagaa

SEQ ID NO: 575198 - DNA, 25 bp, Mus musculus
gcttaaacatggaaaatcacttcat

SEQ ID NO: 575199 - DNA, 25 bp, Mus musculus
gcttaaacatggtaaatcacttcat

SEQ ID NO: 575200 - DNA, 25 bp, Mus musculus
gcttaaactctgcagtagctaaaat

SEQ ID NO: 575201 - DNA, 25 bp, Mus musculus
gcttaaactctggagtagctaaaat

SEQ ID NO: 575202 - DNA, 25 bp, Mus musculus
gcttaaacttagatcctgcccagta

SEQ ID NO: 575203 - DNA, 25 bp, Mus musculus
gcttaaacttagttcctgcccagta

SEQ ID NO: 575204 - DNA, 25 bp, Mus musculus
gcttaaacttttagcagcaccgcaa

SEQ ID NO: 575205 - DNA, 25 bp, Mus musculus
gcttaaactttttgcagcaccgcaa

SEQ ID NO: 575206 - DNA, 25 bp, Mus musculus
gcttaaagcaagatctgatacagag

SEQ ID NO: 575207 - DNA, 25 bp, Mus musculus
gcttaaagcaagttctgatacagag

SEQ ID NO: 575208 - DNA, 25 bp, Mus musculus
gcttaaagcttcaagtccaggagat

SEQ ID NO: 575209 - DNA, 25 bp, Mus musculus
gcttaaagcttctagtccaggagat

SEQ ID NO: 575210 - DNA, 25 bp, Mus musculus
gcttaaaggcacatccaggagaaga

SEQ ID NO: 575211 - DNA, 25 bp, Mus musculus
gcttaaaggcacttccaggagaaga

SEQ ID NO: 575212 - DNA, 25 bp, Mus musculus
gcttaaagttgcaatgctgtctgaa

SEQ ID NO: 575213 - DNA, 25 bp, Mus musculus
gcttaaagttgctatgctgtctgaa

SEQ ID NO: 575214 - DNA, 25 bp, Mus musculus
gcttaaataagtactcatctcgaga

SEQ ID NO: 575215 - DNA, 25 bp, Mus musculus
gcttaaataagttctcatctcgaga

SEQ ID NO: 575216 - DNA, 25 bp, Mus musculus
gcttaaatacagaccctaaaatcat

SEQ ID NO: 575217 - DNA, 25 bp, Mus musculus
gcttaaatacagtccctaaaatcat

SEQ ID NO: 575218 - DNA, 25 bp, Mus musculus
gcttaaatacctacatttgtatagt

SEQ ID NO: 575219 - DNA, 25 bp, Mus musculus
gcttaaataccttcatttgtatagt

SEQ ID NO: 575220 - DNA, 25 bp, Mus musculus
gcttaaatagccaaacatcacatcc

SEQ ID NO: 575221 - DNA, 25 bp, Mus musculus
gcttaaatagcctaacatcacatcc

SEQ ID NO: 575222 - DNA, 25 bp, Mus musculus
gcttaaatcaaacatcagggaccca

SEQ ID NO: 575223 - DNA, 25 bp, Mus musculus
gcttaaatcaaagatcagggaccca

SEQ ID NO: 575224 - DNA, 25 bp, Mus musculus
gcttaaatggtgagagctttccgct

SEQ ID NO: 575225 - DNA, 25 bp, Mus musculus
gcttaaatggtgtgagctttccgct

SEQ ID NO: 575226 - DNA, 25 bp, Mus musculus
gcttaaattagaaccccgctcaggc

SEQ ID NO: 575227 - DNA, 25 bp, Mus musculus
gcttaaattagatccccgctcaggc

SEQ ID NO: 575228 - DNA, 25 bp, Mus musculus
gcttaaatttgaaaatgcccgacaa

SEQ ID NO: 575229 - DNA, 25 bp, Mus musculus
gcttaaatttgataatgcccgacaa

SEQ ID NO: 575230 - DNA, 25 bp, Mus musculus
gcttaacacttaaatggactgcaca

SEQ ID NO: 575231 - DNA, 25 bp, Mus musculus
gcttaacacttatatggactgcaca

SEQ ID NO: 575232 - DNA, 25 bp, Mus musculus
gcttaacatacgagaaaccctgggt

SEQ ID NO: 575233 - DNA, 25 bp, Mus musculus
gcttaacatacgtgaaaccctgggt

SEQ ID NO: 575234 - DNA, 25 bp, Mus musculus
gcttaacatattaaccccagtaccg

SEQ ID NO: 575235 - DNA, 25 bp, Mus musculus
gcttaacatatttaccccagtaccg

SEQ ID NO: 575236 - DNA, 25 bp, Mus musculus
gcttaacatttactgtctctctctc

SEQ ID NO: 575237 - DNA, 25 bp, Mus musculus
gcttaacatttagtgtctctctctc

SEQ ID NO: 575238 - DNA, 25 bp, Mus musculus
gcttaaccacagaggagagctgagt

SEQ ID NO: 575239 - DNA, 25 bp, Mus musculus
gcttaaccacagtggagagctgagt

SEQ ID NO: 575240 - DNA, 25 bp, Mus musculus
gcttaaccatgaagcaactacttag

SEQ ID NO: 575241 - DNA, 25 bp, Mus musculus
gcttaaccatgatgcaactacttag

SEQ ID NO: 575242 - DNA, 25 bp, Mus musculus
gcttaaccctataggccagtaaggt

SEQ ID NO: 575243 - DNA, 25 bp, Mus musculus
gcttaaccctattggccagtaaggt

SEQ ID NO: 575244 - DNA, 25 bp, Mus musculus
gcttaacgcctgattgtatgcccag

SEQ ID NO: 575245 - DNA, 25 bp, Mus musculus
gcttaacgcctgtttgtatgcccag

SEQ ID NO: 575246 - DNA, 25 bp, Mus musculus
gcttaactactgaatcacgtctcca

SEQ ID NO: 575247 - DNA, 25 bp, Mus musculus
gcttaactactgtatcacgtctcca

SEQ ID NO: 575248 - DNA, 25 bp, Mus musculus
gcttaactatagactctgcactgat

SEQ ID NO: 575249 - DNA, 25 bp, Mus musculus
gcttaactatagtctctgcactgat

SEQ ID NO: 575250 - DNA, 25 bp, Mus musculus
gcttaactatttccagtgtattcct

SEQ ID NO: 575251 - DNA, 25 bp, Mus musculus
gcttaactatttgcagtgtattcct

SEQ ID NO: 575252 - DNA, 25 bp, Mus musculus
gcttaactgtaactgctagtacttt

SEQ ID NO: 575253 - DNA, 25 bp, Mus musculus
gcttaactgtaagtgctagtacttt

SEQ ID NO: 575254 - DNA, 25 bp, Mus musculus
gcttaacttggaagctgctctagga

SEQ ID NO: 575255 - DNA, 25 bp, Mus musculus
gcttaacttggatgctgctctagga

SEQ ID NO: 575256 - DNA, 25 bp, Mus musculus
gcttaacttgttacagtggccaacg

SEQ ID NO: 575257 - DNA, 25 bp, Mus musculus
gcttaacttgtttcagtggccaacg

SEQ ID NO: 575258 - DNA, 25 bp, Mus musculus
gcttaactttcacctcagactgctt

SEQ ID NO: 575259 - DNA, 25 bp, Mus musculus
gcttaactttcagctcagactgctt

SEQ ID NO: 575260 - DNA, 25 bp, Mus musculus
gcttaagaacttagcacggacgact

SEQ ID NO: 575261 - DNA, 25 bp, Mus musculus
gcttaagaactttgcacggacgact

SEQ ID NO: 575262 - DNA, 25 bp, Mus musculus
gcttaagaagaacgtgtcccagcgg

SEQ ID NO: 575263 - DNA, 25 bp, Mus musculus
gcttaagaagaaggtgtcccagcgg

SEQ ID NO: 575264 - DNA, 25 bp, Mus musculus
gcttaagaagtaaccctgagtttga

SEQ ID NO: 575265 - DNA, 25 bp, Mus musculus
gcttaagaagtatccctgagtttga

SEQ ID NO: 575266 - DNA, 25 bp, Mus musculus
gcttaagaatataaatccacccgca

SEQ ID NO: 575267 - DNA, 25 bp, Mus musculus
gcttaagaatattaatccacccgca

SEQ ID NO: 575268 - DNA, 25 bp, Mus musculus
gcttaagaccatagcagaggaccca

SEQ ID NO: 575269 - DNA, 25 bp, Mus musculus
gcttaagaccattgcagaggaccca

SEQ ID NO: 575270 - DNA, 25 bp, Mus musculus
gcttaagacttcagagaccacacat

SEQ ID NO: 575271 - DNA, 25 bp, Mus musculus
gcttaagacttctgagaccacacat

SEQ ID NO: 575272 - DNA, 25 bp, Mus musculus
gcttaagagctgacatttgcactga

SEQ ID NO: 575273 - DNA, 25 bp, Mus musculus
gcttaagagctgtcatttgcactga

SEQ ID NO: 575274 - DNA, 25 bp, Mus musculus
gcttaagagtgcctgtttctgacaa

SEQ ID NO: 575275 - DNA, 25 bp, Mus musculus
gcttaagagtgcgtgtttctgacaa

SEQ ID NO: 575276 - DNA, 25 bp, Mus musculus
gcttaagatcccagggtctggagct

SEQ ID NO: 575277 - DNA, 25 bp, Mus musculus
gcttaagatccctgggtctggagct

SEQ ID NO: 575278 - DNA, 25 bp, Mus musculus
gcttaagatgaacccggcctcagca

SEQ ID NO: 575279 - DNA, 25 bp, Mus musculus
gcttaagatgaagccggcctcagca

SEQ ID NO: 575280 - DNA, 25 bp, Mus musculus
gcttaagcctccacgtcaaactatt

SEQ ID NO: 575281 - DNA, 25 bp, Mus musculus
gcttaagcctcctcgtcaaactatt

SEQ ID NO: 575282 - DNA, 25 bp, Mus musculus
gcttaagcgagtcttacttagcctt

SEQ ID NO: 575283 - DNA, 25 bp, Mus musculus
gcttaagcgagtgttacttagcctt

SEQ ID NO: 575284 - DNA, 25 bp, Mus musculus
gcttaagctcttaatcgttttgttg

SEQ ID NO: 575285 - DNA, 25 bp, Mus musculus
gcttaagctctttatcgttttgttg

SEQ ID NO: 575286 - DNA, 25 bp, Mus musculus
gcttaagctgcaatttggtatagga

SEQ ID NO: 575287 - DNA, 25 bp, Mus musculus
gcttaagctgcattttggtatagga

SEQ ID NO: 575288 - DNA, 25 bp, Mus musculus
gcttaaggaacccagctcttagaaa

SEQ ID NO: 575289 - DNA, 25 bp, Mus musculus
gcttaaggaaccgagctcttagaaa

SEQ ID NO: 575290 - DNA, 25 bp, Mus musculus
gcttaaggatctattacccaaataa

SEQ ID NO: 575291 - DNA, 25 bp, Mus musculus
gcttaaggatcttttacccaaataa

SEQ ID NO: 575292 - DNA, 25 bp, Mus musculus
gcttaaggctggatcataaaggcta

SEQ ID NO: 575293 - DNA, 25 bp, Mus musculus
gcttaaggctggttcataaaggcta

SEQ ID NO: 575294 - DNA, 25 bp, Mus musculus
gcttaagggatccagctgccaatat

SEQ ID NO: 575295 - DNA, 25 bp, Mus musculus
gcttaagggatcgagctgccaatat

SEQ ID NO: 575296 - DNA, 25 bp, Mus musculus
gcttaagggccaaactatactgtat

SEQ ID NO: 575297 - DNA, 25 bp, Mus musculus
gcttaagggccatactatactgtat

SEQ ID NO: 575298 - DNA, 25 bp, Mus musculus
gcttaaggtgtacagatccatctat

SEQ ID NO: 575299 - DNA, 25 bp, Mus musculus
gcttaaggtgtagagatccatctat

SEQ ID NO: 575300 - DNA, 25 bp, Mus musculus
gcttaagtcagcacaggcagagaga

SEQ ID NO: 575301 - DNA, 25 bp, Mus musculus
gcttaagtcagctcaggcagagaga

SEQ ID NO: 575302 - DNA, 25 bp, Mus musculus
gcttaagtcttaattccatccttgg

SEQ ID NO: 575303 - DNA, 25 bp, Mus musculus
gcttaagtcttatttccatccttgg

SEQ ID NO: 575304 - DNA, 25 bp, Mus musculus
gcttaagtgagcaaccattgttcat

SEQ ID NO: 575305 - DNA, 25 bp, Mus musculus
gcttaagtgagctaccattgttcat

SEQ ID NO: 575306 - DNA, 25 bp, Mus musculus
gcttaagtgggtaccgagacagaca

SEQ ID NO: 575307 - DNA, 25 bp, Mus musculus
gcttaagtgggttccgagacagaca

SEQ ID NO: 575308 - DNA, 25 bp, Mus musculus
gcttaatagtggagacttctggcct

SEQ ID NO: 575309 - DNA, 25 bp, Mus musculus
gcttaatagtggtgacttctggcct

SEQ ID NO: 575310 - DNA, 25 bp, Mus musculus
gcttaatatcataagccaccaggga

SEQ ID NO: 575311 - DNA, 25 bp, Mus musculus
gcttaatatcattagccaccaggga

SEQ ID NO: 575312 - DNA, 25 bp, Mus musculus
gcttaatatcttctcctttctttgg

SEQ ID NO: 575313 - DNA, 25 bp, Mus musculus
gcttaatatcttgtcctttctttgg

SEQ ID NO: 575314 - DNA, 25 bp, Mus musculus
gcttaatattgtaactgctttgcag

SEQ ID NO: 575315 - DNA, 25 bp, Mus musculus
gcttaatattgttactgctttgcag

SEQ ID NO: 575316 - DNA, 25 bp, Mus musculus
gcttaatcacttcagcttatgactc

SEQ ID NO: 575317 - DNA, 25 bp, Mus musculus
gcttaatcacttgagcttatgactc

SEQ ID NO: 575318 - DNA, 25 bp, Mus musculus
gcttaatctctgaacctgccatgta

SEQ ID NO: 575319 - DNA, 25 bp, Mus musculus
gcttaatctctgtacctgccatgta

SEQ ID NO: 575320 - DNA, 25 bp, Mus musculus
gcttaatgagggatctcttagccac

SEQ ID NO: 575321 - DNA, 25 bp, Mus musculus
gcttaatgagggttctcttagccac

SEQ ID NO: 575322 - DNA, 25 bp, Mus musculus
gcttaatgagtgaaatgcgccctgt

SEQ ID NO: 575323 - DNA, 25 bp, Mus musculus
gcttaatgagtgtaatgcgccctgt

SEQ ID NO: 575324 - DNA, 25 bp, Mus musculus
gcttaatgctttccaatgcccaagg

SEQ ID NO: 575325 - DNA, 25 bp, Mus musculus
gcttaatgctttgcaatgcccaagg

SEQ ID NO: 575326 - DNA, 25 bp, Mus musculus
gcttaatggctaaaactcaggcttt

SEQ ID NO: 575327 - DNA, 25 bp, Mus musculus
gcttaatggctataactcaggcttt

SEQ ID NO: 575328 - DNA, 25 bp, Mus musculus
gcttaatgggcaccattcttgccta

SEQ ID NO: 575329 - DNA, 25 bp, Mus musculus
gcttaatgggcagcattcttgccta

SEQ ID NO: 575330 - DNA, 25 bp, Mus musculus
gcttaatgtacaaggatattcctgt

SEQ ID NO: 575331 - DNA, 25 bp, Mus musculus
gcttaatgtacatggatattcctgt

SEQ ID NO: 575332 - DNA, 25 bp, Mus musculus
gcttaatgtcaacttgacccaagct

SEQ ID NO: 575333 - DNA, 25 bp, Mus musculus
gcttaatgtcaagttgacccaagct

SEQ ID NO: 575334 - DNA, 25 bp, Mus musculus
gcttaattatgcatggccttgcccc

SEQ ID NO: 575335 - DNA, 25 bp, Mus musculus
gcttaattatgcttggccttgcccc

SEQ ID NO: 575336 - DNA, 25 bp, Mus musculus
gcttaattcctcattttaacctgtg

SEQ ID NO: 575337 - DNA, 25 bp, Mus musculus
gcttaattcctctttttaacctgtg

SEQ ID NO: 575338 - DNA, 25 bp, Mus musculus
gcttaattggccagtgctgtggagt

SEQ ID NO: 575339 - DNA, 25 bp, Mus musculus
gcttaattggcctgtgctgtggagt

SEQ ID NO: 575340 - DNA, 25 bp, Mus musculus
gcttaattttacagcctgcctaggc

SEQ ID NO: 575341 - DNA, 25 bp, Mus musculus
gcttaattttactgcctgcctaggc

SEQ ID NO: 575342 - DNA, 25 bp, Mus musculus
gcttacaaagcaaacctcatactag

SEQ ID NO: 575343 - DNA, 25 bp, Mus musculus
gcttacaaagcatacctcatactag

SEQ ID NO: 575344 - DNA, 25 bp, Mus musculus
gcttacaaaggcaatttgaccccgt

SEQ ID NO: 575345 - DNA, 25 bp, Mus musculus
gcttacaaaggctatttgaccccgt

SEQ ID NO: 575346 - DNA, 25 bp, Mus musculus
gcttacaagttgctataccagtgag

SEQ ID NO: 575347 - DNA, 25 bp, Mus musculus
gcttacaagttggtataccagtgag

SEQ ID NO: 575348 - DNA, 25 bp, Mus musculus
gcttacacatggcttcaaaataggg

SEQ ID NO: 575349 - DNA, 25 bp, Mus musculus
gcttacacatgggttcaaaataggg

SEQ ID NO: 575350 - DNA, 25 bp, Mus musculus
gcttacactctgcattgcacagctg

SEQ ID NO: 575351 - DNA, 25 bp, Mus musculus
gcttacactctggattgcacagctg

SEQ ID NO: 575352 - DNA, 25 bp, Mus musculus
gcttacagaatcagttgggccataa

SEQ ID NO: 575353 - DNA, 25 bp, Mus musculus
gcttacagaatctgttgggccataa

SEQ ID NO: 575354 - DNA, 25 bp, Mus musculus
gcttacagatcaaagacctcgcacg

SEQ ID NO: 575355 - DNA, 25 bp, Mus musculus
gcttacagatcatagacctcgcacg

SEQ ID NO: 575356 - DNA, 25 bp, Mus musculus
gcttacagcttcctggacccagaag

SEQ ID NO: 575357 - DNA, 25 bp, Mus musculus
gcttacagcttcgtggacccagaag

SEQ ID NO: 575358 - DNA, 25 bp, Mus musculus
gcttacagtgatacatagaactttc

SEQ ID NO: 575359 - DNA, 25 bp, Mus musculus
gcttacagtgattcatagaactttc

SEQ ID NO: 575360 - DNA, 25 bp, Mus musculus
gcttacagttatctgtgactccagt

SEQ ID NO: 575361 - DNA, 25 bp, Mus musculus
gcttacagttatgtgtgactccagt

SEQ ID NO: 575362 - DNA, 25 bp, Mus musculus
gcttacatagcacgtgtgaagtcct

SEQ ID NO: 575363 - DNA, 25 bp, Mus musculus
gcttacatagcaggtgtgaagtcct

SEQ ID NO: 575364 - DNA, 25 bp, Mus musculus
gcttacatatggacatggcatgtgt

SEQ ID NO: 575365 - DNA, 25 bp, Mus musculus
gcttacatatggtcatggcatgtgt

SEQ ID NO: 575366 - DNA, 25 bp, Mus musculus
gcttacatgagaacgtatttcaaca

SEQ ID NO: 575367 - DNA, 25 bp, Mus musculus
gcttacatgagatcgtatttcaaca

SEQ ID NO: 575368 - DNA, 25 bp, Mus musculus
gcttacatgattcgcagctgctttc

SEQ ID NO: 575369 - DNA, 25 bp, Mus musculus
gcttacatgattggcagctgctttc

SEQ ID NO: 575370 - DNA, 25 bp, Mus musculus
gcttacatgcttaaatctggatatc

SEQ ID NO: 575371 - DNA, 25 bp, Mus musculus
gcttacatgctttaatctggatatc

SEQ ID NO: 575372 - DNA, 25 bp, Mus musculus
gcttacatggctattagtggaaaac

SEQ ID NO: 575373 - DNA, 25 bp, Mus musculus
gcttacatggcttttagtggaaaac

SEQ ID NO: 575374 - DNA, 25 bp, Mus musculus
gcttacattctcacctcccagatta

SEQ ID NO: 575375 - DNA, 25 bp, Mus musculus
gcttacattctctcctcccagatta

SEQ ID NO: 575376 - DNA, 25 bp, Mus musculus
gcttacattctgacccttggagaag

SEQ ID NO: 575377 - DNA, 25 bp, Mus musculus
gcttacattctgtcccttggagaag

SEQ ID NO: 575378 - DNA, 25 bp, Mus musculus
gcttaccaaagcattttattttgat

SEQ ID NO: 575379 - DNA, 25 bp, Mus musculus
gcttaccaaagctttttattttgat

SEQ ID NO: 575380 - DNA, 25 bp, Mus musculus
gcttaccaattcatacatctgatag

SEQ ID NO: 575381 - DNA, 25 bp, Mus musculus
gcttaccaattcttacatctgatag

SEQ ID NO: 575382 - DNA, 25 bp, Mus musculus
gcttaccacattcttaactgtagga

SEQ ID NO: 575383 - DNA, 25 bp, Mus musculus
gcttaccacattgttaactgtagga

SEQ ID NO: 575384 - DNA, 25 bp, Mus musculus
gcttaccacgcaacagcatttttca

SEQ ID NO: 575385 - DNA, 25 bp, Mus musculus
gcttaccacgcatcagcatttttca

SEQ ID NO: 575386 - DNA, 25 bp, Mus musculus
gcttaccagaccatttgcttgtccc

SEQ ID NO: 575387 - DNA, 25 bp, Mus musculus
gcttaccagaccttttgcttgtccc

SEQ ID NO: 575388 - DNA, 25 bp, Mus musculus
gcttacccacataattaaccttaat

SEQ ID NO: 575389 - DNA, 25 bp, Mus musculus
gcttacccacattattaaccttaat

SEQ ID NO: 575390 - DNA, 25 bp, Mus musculus
gcttacccagctaagaatcccattg

SEQ ID NO: 575391 - DNA, 25 bp, Mus musculus
gcttacccagcttagaatcccattg

SEQ ID NO: 575392 - DNA, 25 bp, Mus musculus
gcttacccatttcactgcagtaaac

SEQ ID NO: 575393 - DNA, 25 bp, Mus musculus
gcttacccatttgactgcagtaaac

SEQ ID NO: 575394 - DNA, 25 bp, Mus musculus
gcttaccccagcattgaggacagaa

SEQ ID NO: 575395 - DNA, 25 bp, Mus musculus
gcttaccccagctttgaggacagaa

SEQ ID NO: 575396 - DNA, 25 bp, Mus musculus
gcttacccctttcaagtggtaccag

SEQ ID NO: 575397 - DNA, 25 bp, Mus musculus
gcttacccctttgaagtggtaccag

SEQ ID NO: 575398 - DNA, 25 bp, Mus musculus
gcttaccctaccagtgctcgccttt

SEQ ID NO: 575399 - DNA, 25 bp, Mus musculus
gcttaccctacctgtgctcgccttt

SEQ ID NO: 575400 - DNA, 25 bp, Mus musculus
gcttacccttccagtttacattgga

SEQ ID NO: 575401 - DNA, 25 bp, Mus musculus
gcttacccttcctgtttacattgga

SEQ ID NO: 575402 - DNA, 25 bp, Mus musculus
gcttaccgagcacggcctaagaagc

SEQ ID NO: 575403 - DNA, 25 bp, Mus musculus
gcttaccgagcagggcctaagaagc

SEQ ID NO: 575404 - DNA, 25 bp, Mus musculus
gcttaccgtaagcaagggatgccta

SEQ ID NO: 575405 - DNA, 25 bp, Mus musculus
gcttaccgtaaggaagggatgccta

SEQ ID NO: 575406 - DNA, 25 bp, Mus musculus
gcttaccgtctgaccttgcgaaggt

SEQ ID NO: 575407 - DNA, 25 bp, Mus musculus
gcttaccgtctgtccttgcgaaggt

SEQ ID NO: 575408 - DNA, 25 bp, Mus musculus
gcttaccgtttgcaggatgacttgt

SEQ ID NO: 575409 - DNA, 25 bp, Mus musculus
gcttaccgtttggaggatgacttgt

SEQ ID NO: 575410 - DNA, 25 bp, Mus musculus
gcttacctagctagaacttttgtga

SEQ ID NO: 575411 - DNA, 25 bp, Mus musculus
gcttacctagcttgaacttttgtga

SEQ ID NO: 575412 - DNA, 25 bp, Mus musculus
gcttacctagtgctgtggaggtcca

SEQ ID NO: 575413 - DNA, 25 bp, Mus musculus
gcttacctagtggtgtggaggtcca

SEQ ID NO: 575414 - DNA, 25 bp, Mus musculus
gcttacctcgctatacaagtaatgt

SEQ ID NO: 575415 - DNA, 25 bp, Mus musculus
gcttacctcgctttacaagtaatgt

SEQ ID NO: 575416 - DNA, 25 bp, Mus musculus
gcttacctctgtagcatgctcaata

SEQ ID NO: 575417 - DNA, 25 bp, Mus musculus
gcttacctctgttgcatgctcaata

SEQ ID NO: 575418 - DNA, 25 bp, Mus musculus
gcttacctgaggacggatgtttcat

SEQ ID NO: 575419 - DNA, 25 bp, Mus musculus
gcttacctgaggtcggatgtttcat

SEQ ID NO: 575420 - DNA, 25 bp, Mus musculus
gcttacctggtaaccacagctagta

SEQ ID NO: 575421 - DNA, 25 bp, Mus musculus
gcttacctggtatccacagctagta

SEQ ID NO: 575422 - DNA, 25 bp, Mus musculus
gcttaccttcataccttctgataat

SEQ ID NO: 575423 - DNA, 25 bp, Mus musculus
gcttaccttcattccttctgataat

SEQ ID NO: 575424 - DNA, 25 bp, Mus musculus
gcttaccttctaaacgatcatggct

SEQ ID NO: 575425 - DNA, 25 bp, Mus musculus
gcttaccttctatacgatcatggct

SEQ ID NO: 575426 - DNA, 25 bp, Mus musculus
gcttacgaaaggattgtgcatttaa

SEQ ID NO: 575427 - DNA, 25 bp, Mus musculus
gcttacgaaaggtttgtgcatttaa

SEQ ID NO: 575428 - DNA, 25 bp, Mus musculus
gcttacgatgtgagcgcttacccac

SEQ ID NO: 575429 - DNA, 25 bp, Mus musculus
gcttacgatgtgtgcgcttacccac

SEQ ID NO: 575430 - DNA, 25 bp, Mus musculus
gcttacgcactgacaggcctcaaga

SEQ ID NO: 575431 - DNA, 25 bp, Mus musculus
gcttacgcactgtcaggcctcaaga

SEQ ID NO: 575432 - DNA, 25 bp, Mus musculus
gcttacgctactatcttaggacttt

SEQ ID NO: 575433 - DNA, 25 bp, Mus musculus
gcttacgctactttcttaggacttt

SEQ ID NO: 575434 - DNA, 25 bp, Mus musculus
gcttacggcgttatggatcgaggct

SEQ ID NO: 575435 - DNA, 25 bp, Mus musculus
gcttacggcgttttggatcgaggct

SEQ ID NO: 575436 - DNA, 25 bp, Mus musculus
gcttacggttttaaagcagttctca

SEQ ID NO: 575437 - DNA, 25 bp, Mus musculus
gcttacggtttttaagcagttctca

SEQ ID NO: 575438 - DNA, 25 bp, Mus musculus
gcttacgtaaggaggcagttccctc

SEQ ID NO: 575439 - DNA, 25 bp, Mus musculus
gcttacgtaaggtggcagttccctc

SEQ ID NO: 575440 - DNA, 25 bp, Mus musculus
gcttacgtagtcctgccttactgtt

SEQ ID NO: 575441 - DNA, 25 bp, Mus musculus
gcttacgtagtcgtgccttactgtt

SEQ ID NO: 575442 - DNA, 25 bp, Mus musculus
gcttacgtattgatgttggcagggt

SEQ ID NO: 575443 - DNA, 25 bp, Mus musculus
gcttacgtattgttgttggcagggt

SEQ ID NO: 575444 - DNA, 25 bp, Mus musculus
gcttacgtgtatctggagacattct

SEQ ID NO: 575445 - DNA, 25 bp, Mus musculus
gcttacgtgtatgtggagacattct

SEQ ID NO: 575446 - DNA, 25 bp, Mus musculus
gcttacgtttctacatctcaccgtt

SEQ ID NO: 575447 - DNA, 25 bp, Mus musculus
gcttacgtttcttcatctcaccgtt

SEQ ID NO: 575448 - DNA, 25 bp, Mus musculus
gcttactaattaaacagtgcatctg

SEQ ID NO: 575449 - DNA, 25 bp, Mus musculus
gcttactaattatacagtgcatctg

SEQ ID NO: 575450 - DNA, 25 bp, Mus musculus
gcttactaccacaataacccatgta

SEQ ID NO: 575451 - DNA, 25 bp, Mus musculus
gcttactaccactataacccatgta

SEQ ID NO: 575452 - DNA, 25 bp, Mus musculus
gcttactaccatacgtgctatcaat

SEQ ID NO: 575453 - DNA, 25 bp, Mus musculus
gcttactaccattcgtgctatcaat

SEQ ID NO: 575454 - DNA, 25 bp, Mus musculus
gcttactagtggagaaagacaataa

SEQ ID NO: 575455 - DNA, 25 bp, Mus musculus
gcttactagtggtgaaagacaataa

SEQ ID NO: 575456 - DNA, 25 bp, Mus musculus
gcttactagtgtccattttcatcca

SEQ ID NO: 575457 - DNA, 25 bp, Mus musculus
gcttactagtgtgcattttcatcca

SEQ ID NO: 575458 - DNA, 25 bp, Mus musculus
gcttactatccaaggccaattacgg

SEQ ID NO: 575459 - DNA, 25 bp, Mus musculus
gcttactatccatggccaattacgg

SEQ ID NO: 575460 - DNA, 25 bp, Mus musculus
gcttactcaactcgttttcttacac

SEQ ID NO: 575461 - DNA, 25 bp, Mus musculus
gcttactcaactggttttcttacac

SEQ ID NO: 575462 - DNA, 25 bp, Mus musculus
gcttactcacatcttcatatttttt

SEQ ID NO: 575463 - DNA, 25 bp, Mus musculus
gcttactcacatgttcatatttttt

SEQ ID NO: 575464 - DNA, 25 bp, Mus musculus
gcttactcacttcctataccattat

SEQ ID NO: 575465 - DNA, 25 bp, Mus musculus
gcttactcacttgctataccattat

SEQ ID NO: 575466 - DNA, 25 bp, Mus musculus
gcttactccaaaagccaactatctg

SEQ ID NO: 575467 - DNA, 25 bp, Mus musculus
gcttactccaaatgccaactatctg

SEQ ID NO: 575468 - DNA, 25 bp, Mus musculus
gcttactccatacctgtataaataa

SEQ ID NO: 575469 - DNA, 25 bp, Mus musculus
gcttactccatagctgtataaataa

SEQ ID NO: 575470 - DNA, 25 bp, Mus musculus
gcttactctaagctgcatcagaccc

SEQ ID NO: 575471 - DNA, 25 bp, Mus musculus
gcttactctaaggtgcatcagaccc

SEQ ID NO: 575472 - DNA, 25 bp, Mus musculus
gcttactctctgcaaatggacgcgt

SEQ ID NO: 575473 - DNA, 25 bp, Mus musculus
gcttactctctggaaatggacgcgt

SEQ ID NO: 575474 - DNA, 25 bp, Mus musculus
gcttactctgtacgttcattctgat

SEQ ID NO: 575475 - DNA, 25 bp, Mus musculus
gcttactctgtaggttcattctgat

SEQ ID NO: 575476 - DNA, 25 bp, Mus musculus
gcttactcttgaatagccccaaagt

SEQ ID NO: 575477 - DNA, 25 bp, Mus musculus
gcttactcttgattagccccaaagt

SEQ ID NO: 575478 - DNA, 25 bp, Mus musculus
gcttactgattgaaaatctggcttc

SEQ ID NO: 575479 - DNA, 25 bp, Mus musculus
gcttactgattgtaaatctggcttc

SEQ ID NO: 575480 - DNA, 25 bp, Mus musculus
gcttactggcatatatttacatttt

SEQ ID NO: 575481 - DNA, 25 bp, Mus musculus
gcttactggcatttatttacatttt

SEQ ID NO: 575482 - DNA, 25 bp, Mus musculus
gcttactgggctattctgggttcca

SEQ ID NO: 575483 - DNA, 25 bp, Mus musculus
gcttactgggcttttctgggttcca

SEQ ID NO: 575484 - DNA, 25 bp, Mus musculus
gcttactggtttcttgaaccatttt

SEQ ID NO: 575485 - DNA, 25 bp, Mus musculus
gcttactggtttgttgaaccatttt

SEQ ID NO: 575486 - DNA, 25 bp, Mus musculus
gcttactgtatacctggactttcca

SEQ ID NO: 575487 - DNA, 25 bp, Mus musculus
gcttactgtatagctggactttcca

SEQ ID NO: 575488 - DNA, 25 bp, Mus musculus
gcttactgtgtcattgtggcatcac

SEQ ID NO: 575489 - DNA, 25 bp, Mus musculus
gcttactgtgtctttgtggcatcac

SEQ ID NO: 575490 - DNA, 25 bp, Mus musculus
gcttactgttgactggcattgatga

SEQ ID NO: 575491 - DNA, 25 bp, Mus musculus
gcttactgttgagtggcattgatga

SEQ ID NO: 575492 - DNA, 25 bp, Mus musculus
gcttactgttgtccatatactggca

SEQ ID NO: 575493 - DNA, 25 bp, Mus musculus
gcttactgttgtgcatatactggca

SEQ ID NO: 575494 - DNA, 25 bp, Mus musculus
gcttacttaccaagttcttccatgc

SEQ ID NO: 575495 - DNA, 25 bp, Mus musculus
gcttacttaccatgttcttccatgc

SEQ ID NO: 575496 - DNA, 25 bp, Mus musculus
gcttacttagccatctggttacaga

SEQ ID NO: 575497 - DNA, 25 bp, Mus musculus
gcttacttagccttctggttacaga

SEQ ID NO: 575498 - DNA, 25 bp, Mus musculus
gcttacttcagcaaccattttcaga

SEQ ID NO: 575499 - DNA, 25 bp, Mus musculus
gcttacttcagcatacaggtttata

SEQ ID NO: 575500 - DNA, 25 bp, Mus musculus
gcttacttcagctaccattttcaga

SEQ ID NO: 575501 - DNA, 25 bp, Mus musculus
gcttacttcagcttacaggtttata

SEQ ID NO: 575502 - DNA, 25 bp, Mus musculus
gcttacttcctgatgcagctggtta

SEQ ID NO: 575503 - DNA, 25 bp, Mus musculus
gcttacttcctgttgcagctggtta

SEQ ID NO: 575504 - DNA, 25 bp, Mus musculus
gcttacttctgtagtttaccccact

SEQ ID NO: 575505 - DNA, 25 bp, Mus musculus
gcttacttctgttgtttaccccact

SEQ ID NO: 575506 - DNA, 25 bp, Mus musculus
gcttacttgcaaacataaatctggt

SEQ ID NO: 575507 - DNA, 25 bp, Mus musculus
gcttacttgcaatcataaatctggt

SEQ ID NO: 575508 - DNA, 25 bp, Mus musculus
gcttacttgcgaaatgacactcttt

SEQ ID NO: 575509 - DNA, 25 bp, Mus musculus
gcttacttgcgatatgacactcttt

SEQ ID NO: 575510 - DNA, 25 bp, Mus musculus
gcttactttctaagtatgcatgtca

SEQ ID NO: 575511 - DNA, 25 bp, Mus musculus
gcttactttctatgtatgcatgtca

SEQ ID NO: 575512 - DNA, 25 bp, Mus musculus
gcttagaaatccctagccacacaag

SEQ ID NO: 575513 - DNA, 25 bp, Mus musculus
gcttagaaatccgtagccacacaag

SEQ ID NO: 575514 - DNA, 25 bp, Mus musculus
gcttagaacactatacaatgcttta

SEQ ID NO: 575515 - DNA, 25 bp, Mus musculus
gcttagaacactttacaatgcttta

SEQ ID NO: 575516 - DNA, 25 bp, Mus musculus
gcttagaacctgataaagggatatt

SEQ ID NO: 575517 - DNA, 25 bp, Mus musculus
gcttagaacctgttaaagggatatt

SEQ ID NO: 575518 - DNA, 25 bp, Mus musculus
gcttagaactcactcatttgccaga

SEQ ID NO: 575519 - DNA, 25 bp, Mus musculus
gcttagaactcagtcatttgccaga

SEQ ID NO: 575520 - DNA, 25 bp, Mus musculus
gcttagaagaacatctgtctgtggc

SEQ ID NO: 575521 - DNA, 25 bp, Mus musculus
gcttagaagaacttctgtctgtggc

SEQ ID NO: 575522 - DNA, 25 bp, Mus musculus
gcttagaataaaaggccgaacactt

SEQ ID NO: 575523 - DNA, 25 bp, Mus musculus
gcttagaataaatggccgaacactt

SEQ ID NO: 575524 - DNA, 25 bp, Mus musculus
gcttagaatgctaccaagactgcta

SEQ ID NO: 575525 - DNA, 25 bp, Mus musculus
gcttagaatgcttccaagactgcta

SEQ ID NO: 575526 - DNA, 25 bp, Mus musculus
gcttagaattatcatgagacatacc

SEQ ID NO: 575527 - DNA, 25 bp, Mus musculus
gcttagaattatgatgagacatacc

SEQ ID NO: 575528 - DNA, 25 bp, Mus musculus
gcttagacacctatctagtagctat

SEQ ID NO: 575529 - DNA, 25 bp, Mus musculus
gcttagacacctttctagtagctat

SEQ ID NO: 575530 - DNA, 25 bp, Mus musculus
gcttagactgctcaacaagtgggtc

SEQ ID NO: 575531 - DNA, 25 bp, Mus musculus
gcttagactgctgaacaagtgggtc

SEQ ID NO: 575532 - DNA, 25 bp, Mus musculus
gcttagactgtaccttggtaacact

SEQ ID NO: 575533 - DNA, 25 bp, Mus musculus
gcttagactgtagcttggtaacact

SEQ ID NO: 575534 - DNA, 25 bp, Mus musculus
gcttagacttttaaactgtctcttg

SEQ ID NO: 575535 - DNA, 25 bp, Mus musculus
gcttagactttttaactgtctcttg

SEQ ID NO: 575536 - DNA, 25 bp, Mus musculus
gcttagagagatctcccggagattc

SEQ ID NO: 575537 - DNA, 25 bp, Mus musculus
gcttagagagatgtcccggagattc

SEQ ID NO: 575538 - DNA, 25 bp, Mus musculus
gcttagagagctctaccacttaata

SEQ ID NO: 575539 - DNA, 25 bp, Mus musculus
gcttagagagctcttgtcagacact

SEQ ID NO: 575540 - DNA, 25 bp, Mus musculus
gcttagagagctgtaccacttaata

SEQ ID NO: 575541 - DNA, 25 bp, Mus musculus
gcttagagagctgttgtcagacact

SEQ ID NO: 575542 - DNA, 25 bp, Mus musculus
gcttagaggagaagatcattttctt

SEQ ID NO: 575543 - DNA, 25 bp, Mus musculus
gcttagaggagatgatcattttctt

SEQ ID NO: 575544 - DNA, 25 bp, Mus musculus
gcttagaggctcatgaaatggaccc

SEQ ID NO: 575545 - DNA, 25 bp, Mus musculus
gcttagaggctcttgaaatggaccc

SEQ ID NO: 575546 - DNA, 25 bp, Mus musculus
gcttagagggccatgtgtcttacaa

SEQ ID NO: 575547 - DNA, 25 bp, Mus musculus
gcttagagggccttgtgtcttacaa

SEQ ID NO: 575548 - DNA, 25 bp, Mus musculus
gcttagagtgacattctgtcttaga

SEQ ID NO: 575549 - DNA, 25 bp, Mus musculus
gcttagagtgactttctgtcttaga

SEQ ID NO: 575550 - DNA, 25 bp, Mus musculus
gcttagataactcaccaacaccctg

SEQ ID NO: 575551 - DNA, 25 bp, Mus musculus
gcttagataactgaccaacaccctg

SEQ ID NO: 575552 - DNA, 25 bp, Mus musculus
gcttagatccttattcaggctcatt

SEQ ID NO: 575553 - DNA, 25 bp, Mus musculus
gcttagatcctttttcaggctcatt

SEQ ID NO: 575554 - DNA, 25 bp, Mus musculus
gcttagatcgatcggaggtcctgca

SEQ ID NO: 575555 - DNA, 25 bp, Mus musculus
gcttagatcgatgggaggtcctgca

SEQ ID NO: 575556 - DNA, 25 bp, Mus musculus
gcttagatggcaatcttttccatcc

SEQ ID NO: 575557 - DNA, 25 bp, Mus musculus
gcttagatggcaatgaccgaccgga

SEQ ID NO: 575558 - DNA, 25 bp, Mus musculus
gcttagatggcattcttttccatcc

SEQ ID NO: 575559 - DNA, 25 bp, Mus musculus
gcttagatggcattgaccgaccgga

SEQ ID NO: 575560 - DNA, 25 bp, Mus musculus
gcttagattcttatagagttgttat

SEQ ID NO: 575561 - DNA, 25 bp, Mus musculus
gcttagattcttttagagttgttat

SEQ ID NO: 575562 - DNA, 25 bp, Mus musculus
gcttagatttgaacagaagtccttt

SEQ ID NO: 575563 - DNA, 25 bp, Mus musculus
gcttagatttgatcagaagtccttt

SEQ ID NO: 575564 - DNA, 25 bp, Mus musculus
gcttagatttttctactgatgccat

SEQ ID NO: 575565 - DNA, 25 bp, Mus musculus
gcttagatttttgtactgatgccat

SEQ ID NO: 575566 - DNA, 25 bp, Mus musculus
gcttagcaatgtattctaacttaga

SEQ ID NO: 575567 - DNA, 25 bp, Mus musculus
gcttagcaatgttttctaacttaga

SEQ ID NO: 575568 - DNA, 25 bp, Mus musculus
gcttagcaattaagagccctagtag

SEQ ID NO: 575569 - DNA, 25 bp, Mus musculus
gcttagcaattatgagccctagtag

SEQ ID NO: 575570 - DNA, 25 bp, Mus musculus
gcttagcaatttaactttccctaca

SEQ ID NO: 575571 - DNA, 25 bp, Mus musculus
gcttagcaattttactttccctaca

SEQ ID NO: 575572 - DNA, 25 bp, Mus musculus
gcttagcaccagattgtgtggccct

SEQ ID NO: 575573 - DNA, 25 bp, Mus musculus
gcttagcaccagtttgtgtggccct

SEQ ID NO: 575574 - DNA, 25 bp, Mus musculus
gcttagcacccaacattaattcata

SEQ ID NO: 575575 - DNA, 25 bp, Mus musculus
gcttagcacccatcattaattcata

SEQ ID NO: 575576 - DNA, 25 bp, Mus musculus
gcttagcaccctcgaagctcgctgg

SEQ ID NO: 575577 - DNA, 25 bp, Mus musculus
gcttagcaccctggaagctcgctgg

SEQ ID NO: 575578 - DNA, 25 bp, Mus musculus
gcttagcagcttatgccgtgtgaaa

SEQ ID NO: 575579 - DNA, 25 bp, Mus musculus
gcttagcagcttttgccgtgtgaaa

SEQ ID NO: 575580 - DNA, 25 bp, Mus musculus
gcttagcatggtagtgctaccatcc

SEQ ID NO: 575581 - DNA, 25 bp, Mus musculus
gcttagcatggttgtgctaccatcc

SEQ ID NO: 575582 - DNA, 25 bp, Mus musculus
gcttagcattcgctcagacagtgat

SEQ ID NO: 575583 - DNA, 25 bp, Mus musculus
gcttagcattcggtcagacagtgat

SEQ ID NO: 575584 - DNA, 25 bp, Mus musculus
gcttagccgaagagctcccgcacat

SEQ ID NO: 575585 - DNA, 25 bp, Mus musculus
gcttagccgaagtgctcccgcacat

SEQ ID NO: 575586 - DNA, 25 bp, Mus musculus
gcttagcctaggctgtggcactatt

SEQ ID NO: 575587 - DNA, 25 bp, Mus musculus
gcttagcctagggtgtggcactatt

SEQ ID NO: 575588 - DNA, 25 bp, Mus musculus
gcttagcctattctttgcagcagaa

SEQ ID NO: 575589 - DNA, 25 bp, Mus musculus
gcttagcctattgtttgcagcagaa

SEQ ID NO: 575590 - DNA, 25 bp, Mus musculus
gcttagcctttgaataccttctgca

SEQ ID NO: 575591 - DNA, 25 bp, Mus musculus
gcttagcctttgtataccttctgca

SEQ ID NO: 575592 - DNA, 25 bp, Mus musculus
gcttagcggagactcccgaggcggc

SEQ ID NO: 575593 - DNA, 25 bp, Mus musculus
gcttagcggagagtcccgaggcggc

SEQ ID NO: 575594 - DNA, 25 bp, Mus musculus
gcttagcgtgtgagtacgcatgcat

SEQ ID NO: 575595 - DNA, 25 bp, Mus musculus
gcttagcgtgtgtgtacgcatgcat

SEQ ID NO: 575596 - DNA, 25 bp, Mus musculus
gcttagctacaccaacagcctgaga

SEQ ID NO: 575597 - DNA, 25 bp, Mus musculus
gcttagctacacgaacagcctgaga

SEQ ID NO: 575598 - DNA, 25 bp, Mus musculus
gcttagctcacacgccagtctggga

SEQ ID NO: 575599 - DNA, 25 bp, Mus musculus
gcttagctcacaggccagtctggga

SEQ ID NO: 575600 - DNA, 25 bp, Mus musculus
gcttagctcatcataggtgcaggtt

SEQ ID NO: 575601 - DNA, 25 bp, Mus musculus
gcttagctcatcttaggtgcaggtt

SEQ ID NO: 575602 - DNA, 25 bp, Mus musculus
gcttagctgagtatgtcttgctcta

SEQ ID NO: 575603 - DNA, 25 bp, Mus musculus
gcttagctgagtttgtcttgctcta

SEQ ID NO: 575604 - DNA, 25 bp, Mus musculus
gcttagctgatgcacatggctgtca

SEQ ID NO: 575605 - DNA, 25 bp, Mus musculus
gcttagctgatgctgtctatatgct

SEQ ID NO: 575606 - DNA, 25 bp, Mus musculus
gcttagctgatggacatggctgtca

SEQ ID NO: 575607 - DNA, 25 bp, Mus musculus
gcttagctgatggtgtctatatgct

SEQ ID NO: 575608 - DNA, 25 bp, Mus musculus
gcttagctgctccaaagatatccag

SEQ ID NO: 575609 - DNA, 25 bp, Mus musculus
gcttagctgctcgaaagatatccag

SEQ ID NO: 575610 - DNA, 25 bp, Mus musculus
gcttagctgctgatgttggtcttca

SEQ ID NO: 575611 - DNA, 25 bp, Mus musculus
gcttagctgctgttgttggtcttca

SEQ ID NO: 575612 - DNA, 25 bp, Mus musculus
gcttagctgcttagctccgcaagga

SEQ ID NO: 575613 - DNA, 25 bp, Mus musculus
gcttagctgctttgctccgcaagga

SEQ ID NO: 575614 - DNA, 25 bp, Mus musculus
gcttaggaaaccaatcccgaacctg

SEQ ID NO: 575615 - DNA, 25 bp, Mus musculus
gcttaggaaacctatcccgaacctg

SEQ ID NO: 575616 - DNA, 25 bp, Mus musculus
gcttaggaatttactgtatatccag

SEQ ID NO: 575617 - DNA, 25 bp, Mus musculus
gcttaggaattttctgtatatccag

SEQ ID NO: 575618 - DNA, 25 bp, Mus musculus
gcttaggacactatgctcattaaag

SEQ ID NO: 575619 - DNA, 25 bp, Mus musculus
gcttaggacactttgctcattaaag

SEQ ID NO: 575620 - DNA, 25 bp, Mus musculus
gcttaggacatacgcctacctgggt

SEQ ID NO: 575621 - DNA, 25 bp, Mus musculus
gcttaggacataggcctacctgggt

SEQ ID NO: 575622 - DNA, 25 bp, Mus musculus
gcttaggaccccacaaatactgagg

SEQ ID NO: 575623 - DNA, 25 bp, Mus musculus
gcttaggacccctcaaatactgagg

SEQ ID NO: 575624 - DNA, 25 bp, Mus musculus
gcttaggacttcagggttatcctct

SEQ ID NO: 575625 - DNA, 25 bp, Mus musculus
gcttaggacttctgggttatcctct

SEQ ID NO: 575626 - DNA, 25 bp, Mus musculus
gcttaggatgtcagaaaatgcccat

SEQ ID NO: 575627 - DNA, 25 bp, Mus musculus
gcttaggatgtctgaaaatgcccat

SEQ ID NO: 575628 - DNA, 25 bp, Mus musculus
gcttaggccaccatctagatacagg

SEQ ID NO: 575629 - DNA, 25 bp, Mus musculus
gcttaggccaccttctagatacagg

SEQ ID NO: 575630 - DNA, 25 bp, Mus musculus
gcttaggccctaagagctgaccagg

SEQ ID NO: 575631 - DNA, 25 bp, Mus musculus
gcttaggccctatgagctgaccagg

SEQ ID NO: 575632 - DNA, 25 bp, Mus musculus
gcttaggcctgactggaatcatccc

SEQ ID NO: 575633 - DNA, 25 bp, Mus musculus
gcttaggcctgagtggaatcatccc

SEQ ID NO: 575634 - DNA, 25 bp, Mus musculus
gcttaggctaagagcatgatgtcac

SEQ ID NO: 575635 - DNA, 25 bp, Mus musculus
gcttaggctaagtgcatgatgtcac

SEQ ID NO: 575636 - DNA, 25 bp, Mus musculus
gcttaggctagactttgaccaggta

SEQ ID NO: 575637 - DNA, 25 bp, Mus musculus
gcttaggctagagtttgaccaggta

SEQ ID NO: 575638 - DNA, 25 bp, Mus musculus
gcttaggctatgcagtgagactttg

SEQ ID NO: 575639 - DNA, 25 bp, Mus musculus
gcttaggctatggagtgagactttg

SEQ ID NO: 575640 - DNA, 25 bp, Mus musculus
gcttagggacgtcagcatggtaaat

SEQ ID NO: 575641 - DNA, 25 bp, Mus musculus
gcttagggacgtgagcatggtaaat

SEQ ID NO: 575642 - DNA, 25 bp, Mus musculus
gcttagggactaatcacatttcaaa

SEQ ID NO: 575643 - DNA, 25 bp, Mus musculus
gcttagggactattcacatttcaaa

SEQ ID NO: 575644 - DNA, 25 bp, Mus musculus
gcttagggcctgagtgaggacccca

SEQ ID NO: 575645 - DNA, 25 bp, Mus musculus
gcttagggcctgtgtgaggacccca

SEQ ID NO: 575646 - DNA, 25 bp, Mus musculus
gcttagggtagcatcagacttgtga

SEQ ID NO: 575647 - DNA, 25 bp, Mus musculus
gcttagggtagcttcagacttgtga

SEQ ID NO: 575648 - DNA, 25 bp, Mus musculus
gcttagggttgtactgtagatccaa

SEQ ID NO: 575649 - DNA, 25 bp, Mus musculus
gcttagggttgtctgggaagccgcc

SEQ ID NO: 575650 - DNA, 25 bp, Mus musculus
gcttagggttgtgtgggaagccgcc

SEQ ID NO: 575651 - DNA, 25 bp, Mus musculus
gcttagggttgttctgtagatccaa

SEQ ID NO: 575652 - DNA, 25 bp, Mus musculus
gcttaggtaagcatcaaaccccttt

SEQ ID NO: 575653 - DNA, 25 bp, Mus musculus
gcttaggtaagcttcaaaccccttt

SEQ ID NO: 575654 - DNA, 25 bp, Mus musculus
gcttaggtattgcaacaagccacga

SEQ ID NO: 575655 - DNA, 25 bp, Mus musculus
gcttaggtattggaacaagccacga

SEQ ID NO: 575656 - DNA, 25 bp, Mus musculus
gcttagtaacccatatacatttttg

SEQ ID NO: 575657 - DNA, 25 bp, Mus musculus
gcttagtaacccttatacatttttg

SEQ ID NO: 575658 - DNA, 25 bp, Mus musculus
gcttagtaagacaatttccagtaag

SEQ ID NO: 575659 - DNA, 25 bp, Mus musculus
gcttagtaagactatttccagtaag

SEQ ID NO: 575660 - DNA, 25 bp, Mus musculus
gcttagtaagccacagttctcaaat

SEQ ID NO: 575661 - DNA, 25 bp, Mus musculus
gcttagtaagccacctttaagcatc

SEQ ID NO: 575662 - DNA, 25 bp, Mus musculus
gcttagtaagcctcagttctcaaat

SEQ ID NO: 575663 - DNA, 25 bp, Mus musculus
gcttagtaagcctcctttaagcatc

SEQ ID NO: 575664 - DNA, 25 bp, Mus musculus
gcttagtactcacaatgtcctgggt

SEQ ID NO: 575665 - DNA, 25 bp, Mus musculus
gcttagtactcagaatgtcctgggt

SEQ ID NO: 575666 - DNA, 25 bp, Mus musculus
gcttagtatgtcacttgatttgcaa

SEQ ID NO: 575667 - DNA, 25 bp, Mus musculus
gcttagtatgtctcttgatttgcaa

SEQ ID NO: 575668 - DNA, 25 bp, Mus musculus
gcttagtcactacctctgcaaaaaa

SEQ ID NO: 575669 - DNA, 25 bp, Mus musculus
gcttagtcactacgccatttttcca

SEQ ID NO: 575670 - DNA, 25 bp, Mus musculus
gcttagtcactagctctgcaaaaaa

SEQ ID NO: 575671 - DNA, 25 bp, Mus musculus
gcttagtcactaggccatttttcca

SEQ ID NO: 575672 - DNA, 25 bp, Mus musculus
gcttagtctcatcaactctgcatca

SEQ ID NO: 575673 - DNA, 25 bp, Mus musculus
gcttagtctcatgaactctgcatca

SEQ ID NO: 575674 - DNA, 25 bp, Mus musculus
gcttagtgctttctatctgttgctc

SEQ ID NO: 575675 - DNA, 25 bp, Mus musculus
gcttagtgctttgtatctgttgctc

SEQ ID NO: 575676 - DNA, 25 bp, Mus musculus
gcttagtggatacagccattccggt

SEQ ID NO: 575677 - DNA, 25 bp, Mus musculus
gcttagtggatagagccattccggt

SEQ ID NO: 575678 - DNA, 25 bp, Mus musculus
gcttagtgtgttctgattcccgttc

SEQ ID NO: 575679 - DNA, 25 bp, Mus musculus
gcttagtgtgttgtgattcccgttc

SEQ ID NO: 575680 - DNA, 25 bp, Mus musculus
gcttagttgcatattttacatacca

SEQ ID NO: 575681 - DNA, 25 bp, Mus musculus
gcttagttgcattttttacatacca

SEQ ID NO: 575682 - DNA, 25 bp, Mus musculus
gcttagtttgtgctgggttatttaa

SEQ ID NO: 575683 - DNA, 25 bp, Mus musculus
gcttagtttgtggtgggttatttaa

SEQ ID NO: 575684 - DNA, 25 bp, Mus musculus
gcttataaacctaactctcagacca

SEQ ID NO: 575685 - DNA, 25 bp, Mus musculus
gcttataaaccttactctcagacca

SEQ ID NO: 575686 - DNA, 25 bp, Mus musculus
gcttataaatggacattcttttacc

SEQ ID NO: 575687 - DNA, 25 bp, Mus musculus
gcttataaatggtcattcttttacc

SEQ ID NO: 575688 - DNA, 25 bp, Mus musculus
gcttataacctgctactgagagaga

SEQ ID NO: 575689 - DNA, 25 bp, Mus musculus
gcttataacctggtactgagagaga

SEQ ID NO: 575690 - DNA, 25 bp, Mus musculus
gcttataacttaaaggcagtcacta

SEQ ID NO: 575691 - DNA, 25 bp, Mus musculus
gcttataacttataggcagtcacta

SEQ ID NO: 575692 - DNA, 25 bp, Mus musculus
gcttataatctcatcaccaagtcag

SEQ ID NO: 575693 - DNA, 25 bp, Mus musculus
gcttataatctcttcaccaagtcag

SEQ ID NO: 575694 - DNA, 25 bp, Mus musculus
gcttatacacacaatactggaggga

SEQ ID NO: 575695 - DNA, 25 bp, Mus musculus
gcttatacacactatactggaggga

SEQ ID NO: 575696 - DNA, 25 bp, Mus musculus
gcttatacacctcgttctcagaacc

SEQ ID NO: 575697 - DNA, 25 bp, Mus musculus
gcttatacacctggttctcagaacc

SEQ ID NO: 575698 - DNA, 25 bp, Mus musculus
gcttatacacggaaaaactcaaggg

SEQ ID NO: 575699 - DNA, 25 bp, Mus musculus
gcttatacacggtaaaactcaaggg

SEQ ID NO: 575700 - DNA, 25 bp, Mus musculus
gcttatactcccaaaccctgagtgt

SEQ ID NO: 575701 - DNA, 25 bp, Mus musculus
gcttatactccctaaccctgagtgt

SEQ ID NO: 575702 - DNA, 25 bp, Mus musculus
gcttatactggtaaccacaatgtgg

SEQ ID NO: 575703 - DNA, 25 bp, Mus musculus
gcttatactggttaccacaatgtgg

SEQ ID NO: 575704 - DNA, 25 bp, Mus musculus
gcttatagaagtcagacccagctgc

SEQ ID NO: 575705 - DNA, 25 bp, Mus musculus
gcttatagaagtgagacccagctgc

SEQ ID NO: 575706 - DNA, 25 bp, Mus musculus
gcttatagagatacattaatactgt

SEQ ID NO: 575707 - DNA, 25 bp, Mus musculus
gcttatagagattcattaatactgt

SEQ ID NO: 575708 - DNA, 25 bp, Mus musculus
gcttatagagcacagacctttgtat

SEQ ID NO: 575709 - DNA, 25 bp, Mus musculus
gcttatagagcagagacctttgtat

SEQ ID NO: 575710 - DNA, 25 bp, Mus musculus
gcttataggcagctgtgtccagtca

SEQ ID NO: 575711 - DNA, 25 bp, Mus musculus
gcttataggcaggtgtgtccagtca

SEQ ID NO: 575712 - DNA, 25 bp, Mus musculus
gcttatagggagcatcaggttcctt

SEQ ID NO: 575713 - DNA, 25 bp, Mus musculus
gcttatagggaggatcaggttcctt

SEQ ID NO: 575714 - DNA, 25 bp, Mus musculus
gcttatagtgctccagacctctgag

SEQ ID NO: 575715 - DNA, 25 bp, Mus musculus
gcttatagtgctgcagacctctgag

SEQ ID NO: 575716 - DNA, 25 bp, Mus musculus
gcttatagttttactgtacatttat

SEQ ID NO: 575717 - DNA, 25 bp, Mus musculus
gcttatagtttttctgtacatttat

SEQ ID NO: 575718 - DNA, 25 bp, Mus musculus
gcttatatctcaattcggttctttt

SEQ ID NO: 575719 - DNA, 25 bp, Mus musculus
gcttatatctcatttcggttctttt

SEQ ID NO: 575720 - DNA, 25 bp, Mus musculus
gcttatatctgaacacttttgtatt

SEQ ID NO: 575721 - DNA, 25 bp, Mus musculus
gcttatatctgatcacttttgtatt

SEQ ID NO: 575722 - DNA, 25 bp, Mus musculus
gcttatatctggaactttctgctga

SEQ ID NO: 575723 - DNA, 25 bp, Mus musculus
gcttatatctggtactttctgctga

SEQ ID NO: 575724 - DNA, 25 bp, Mus musculus
gcttatatcttaattctcagctact

SEQ ID NO: 575725 - DNA, 25 bp, Mus musculus
gcttatatcttatttctcagctact

SEQ ID NO: 575726 - DNA, 25 bp, Mus musculus
gcttatatgagaccagccagcattc

SEQ ID NO: 575727 - DNA, 25 bp, Mus musculus
gcttatatgagagcagccagcattc

SEQ ID NO: 575728 - DNA, 25 bp, Mus musculus
gcttatatgggcatctggtttaaca

SEQ ID NO: 575729 - DNA, 25 bp, Mus musculus
gcttatatgggcttctggtttaaca

SEQ ID NO: 575730 - DNA, 25 bp, Mus musculus
gcttatattcttatatccagggaca

SEQ ID NO: 575731 - DNA, 25 bp, Mus musculus
gcttatattcttttatccagggaca

SEQ ID NO: 575732 - DNA, 25 bp, Mus musculus
gcttatattggtaccacatgggaga

SEQ ID NO: 575733 - DNA, 25 bp, Mus musculus
gcttatattggttccacatgggaga

SEQ ID NO: 575734 - DNA, 25 bp, Mus musculus
gcttatcaaattactacaacactgg

SEQ ID NO: 575735 - DNA, 25 bp, Mus musculus
gcttatcaaatttctacaacactgg

SEQ ID NO: 575736 - DNA, 25 bp, Mus musculus
gcttatcagtcaagtgggatgcctt

SEQ ID NO: 575737 - DNA, 25 bp, Mus musculus
gcttatcagtcatgtgggatgcctt

SEQ ID NO: 575738 - DNA, 25 bp, Mus musculus
gcttatcatcgtataattctccata

SEQ ID NO: 575739 - DNA, 25 bp, Mus musculus
gcttatcatcgtttaattctccata

SEQ ID NO: 575740 - DNA, 25 bp, Mus musculus
gcttatccggagacaaaccctggac

SEQ ID NO: 575741 - DNA, 25 bp, Mus musculus
gcttatccggagtcaaaccctggac

SEQ ID NO: 575742 - DNA, 25 bp, Mus musculus
gcttatccgggcatgcgccgaggcc

SEQ ID NO: 575743 - DNA, 25 bp, Mus musculus
gcttatccgggcttgcgccgaggcc

SEQ ID NO: 575744 - DNA, 25 bp, Mus musculus
gcttatcctgctcttagggtggtca

SEQ ID NO: 575745 - DNA, 25 bp, Mus musculus
gcttatcctgctgttagggtggtca

SEQ ID NO: 575746 - DNA, 25 bp, Mus musculus
gcttatcgaagcaacttgaaccgag

SEQ ID NO: 575747 - DNA, 25 bp, Mus musculus
gcttatcgaagctacttgaaccgag

SEQ ID NO: 575748 - DNA, 25 bp, Mus musculus
gcttatcgtcacactgtgtagtgta

SEQ ID NO: 575749 - DNA, 25 bp, Mus musculus
gcttatcgtcactctgtgtagtgta

SEQ ID NO: 575750 - DNA, 25 bp, Mus musculus
gcttatctgactatctgctgcgttc

SEQ ID NO: 575751 - DNA, 25 bp, Mus musculus
gcttatctgactttctgctgcgttc

SEQ ID NO: 575752 - DNA, 25 bp, Mus musculus
gcttatcttataagcctgggtattt

SEQ ID NO: 575753 - DNA, 25 bp, Mus musculus
gcttatcttatatgcctgggtattt

SEQ ID NO: 575754 - DNA, 25 bp, Mus musculus
gcttatcttcgcattattccggagt

SEQ ID NO: 575755 - DNA, 25 bp, Mus musculus
gcttatcttcgctttattccggagt

SEQ ID NO: 575756 - DNA, 25 bp, Mus musculus
gcttatcttcttctttatggcgttg

SEQ ID NO: 575757 - DNA, 25 bp, Mus musculus
gcttatcttcttgtttatggcgttg

SEQ ID NO: 575758 - DNA, 25 bp, Mus musculus
gcttatcttgttagtgtgaggctca

SEQ ID NO: 575759 - DNA, 25 bp, Mus musculus
gcttatcttgtttgtgtgaggctca

SEQ ID NO: 575760 - DNA, 25 bp, Mus musculus
gcttatctttctctggagttacgga

SEQ ID NO: 575761 - DNA, 25 bp, Mus musculus
gcttatctttctgtggagttacgga

SEQ ID NO: 575762 - DNA, 25 bp, Mus musculus
gcttatgaatcactagttttgttaa

SEQ ID NO: 575763 - DNA, 25 bp, Mus musculus
gcttatgaatcagtagttttgttaa

SEQ ID NO: 575764 - DNA, 25 bp, Mus musculus
gcttatgacctcatcaacatgctct

SEQ ID NO: 575765 - DNA, 25 bp, Mus musculus
gcttatgacctcttcaacatgctct

SEQ ID NO: 575766 - DNA, 25 bp, Mus musculus
gcttatgacgttaccgatcgcctgg

SEQ ID NO: 575767 - DNA, 25 bp, Mus musculus
gcttatgacgtttccgatcgcctgg

SEQ ID NO: 575768 - DNA, 25 bp, Mus musculus
gcttatgactgcagctgtaggctca

SEQ ID NO: 575769 - DNA, 25 bp, Mus musculus
gcttatgactgctgctgtaggctca

SEQ ID NO: 575770 - DNA, 25 bp, Mus musculus
gcttatgagtctatttactttctgt

SEQ ID NO: 575771 - DNA, 25 bp, Mus musculus
gcttatgagtctttttactttctgt

SEQ ID NO: 575772 - DNA, 25 bp, Mus musculus
gcttatgataccacaaggcttagtt

SEQ ID NO: 575773 - DNA, 25 bp, Mus musculus
gcttatgatacctcaaggcttagtt

SEQ ID NO: 575774 - DNA, 25 bp, Mus musculus
gcttatgattttatagttgattgtg

SEQ ID NO: 575775 - DNA, 25 bp, Mus musculus
gcttatgattttttagttgattgtg

SEQ ID NO: 575776 - DNA, 25 bp, Mus musculus
gcttatgcacgcaaagtgtcctcga

SEQ ID NO: 575777 - DNA, 25 bp, Mus musculus
gcttatgcacgctaagtgtcctcga

SEQ ID NO: 575778 - DNA, 25 bp, Mus musculus
gcttatgccaggaagttaatcgggt

SEQ ID NO: 575779 - DNA, 25 bp, Mus musculus
gcttatgccaggtagttaatcgggt

SEQ ID NO: 575780 - DNA, 25 bp, Mus musculus
gcttatgcctataatcacatggtgg

SEQ ID NO: 575781 - DNA, 25 bp, Mus musculus
gcttatgcctattatcacatggtgg

SEQ ID NO: 575782 - DNA, 25 bp, Mus musculus
gcttatgctaagatttgcgtcctat

SEQ ID NO: 575783 - DNA, 25 bp, Mus musculus
gcttatgctaagttttgcgtcctat

SEQ ID NO: 575784 - DNA, 25 bp, Mus musculus
gcttatgctagtctgtgagccacta

SEQ ID NO: 575785 - DNA, 25 bp, Mus musculus
gcttatgctagtgtgtgagccacta

SEQ ID NO: 575786 - DNA, 25 bp, Mus musculus
gcttatggaaggacccgctgctttc

SEQ ID NO: 575787 - DNA, 25 bp, Mus musculus
gcttatggaaggtcccgctgctttc

SEQ ID NO: 575788 - DNA, 25 bp, Mus musculus
gcttatggagttctatcctatggaa

SEQ ID NO: 575789 - DNA, 25 bp, Mus musculus
gcttatggagttgtatcctatggaa

SEQ ID NO: 575790 - DNA, 25 bp, Mus musculus
gcttatggcactctaattttactcc

SEQ ID NO: 575791 - DNA, 25 bp, Mus musculus
gcttatggcactgtaattttactcc

SEQ ID NO: 575792 - DNA, 25 bp, Mus musculus
gcttatggcagtaccacacagtagt

SEQ ID NO: 575793 - DNA, 25 bp, Mus musculus
gcttatggcagttccacacagtagt

SEQ ID NO: 575794 - DNA, 25 bp, Mus musculus
gcttatggccctagaattaatcccc

SEQ ID NO: 575795 - DNA, 25 bp, Mus musculus
gcttatggcccttgaattaatcccc

SEQ ID NO: 575796 - DNA, 25 bp, Mus musculus
gcttatggctatacctttatttaga

SEQ ID NO: 575797 - DNA, 25 bp, Mus musculus
gcttatggctattcctttatttaga

SEQ ID NO: 575798 - DNA, 25 bp, Mus musculus
gcttatgggagtagctggctctcaa

SEQ ID NO: 575799 - DNA, 25 bp, Mus musculus
gcttatgggagttgctggctctcaa

SEQ ID NO: 575800 - DNA, 25 bp, Mus musculus
gcttatgggttgctgtccagacaca

SEQ ID NO: 575801 - DNA, 25 bp, Mus musculus
gcttatgggttggtgtccagacaca

SEQ ID NO: 575802 - DNA, 25 bp, Mus musculus
gcttatggtcaacataggctccctg

SEQ ID NO: 575803 - DNA, 25 bp, Mus musculus
gcttatggtcaagataggctccctg

SEQ ID NO: 575804 - DNA, 25 bp, Mus musculus
gcttatggtgtgaaatcctttgtta

SEQ ID NO: 575805 - DNA, 25 bp, Mus musculus
gcttatggtgtgtaatcctttgtta

SEQ ID NO: 575806 - DNA, 25 bp, Mus musculus
gcttatggtttacgcccacttggaa

SEQ ID NO: 575807 - DNA, 25 bp, Mus musculus
gcttatggtttaggcccacttggaa

SEQ ID NO: 575808 - DNA, 25 bp, Mus musculus
gcttatgtaattccattccggccag

SEQ ID NO: 575809 - DNA, 25 bp, Mus musculus
gcttatgtaattgcattccggccag

SEQ ID NO: 575810 - DNA, 25 bp, Mus musculus
gcttatgtagcacttttggaccctg

SEQ ID NO: 575811 - DNA, 25 bp, Mus musculus
gcttatgtagcagttttggaccctg

SEQ ID NO: 575812 - DNA, 25 bp, Mus musculus
gcttatgtagctctccttttggaaa

SEQ ID NO: 575813 - DNA, 25 bp, Mus musculus
gcttatgtagctgtccttttggaaa

SEQ ID NO: 575814 - DNA, 25 bp, Mus musculus
gcttatgtcaccagcattggcagac

SEQ ID NO: 575815 - DNA, 25 bp, Mus musculus
gcttatgtcacctgcattggcagac

SEQ ID NO: 575816 - DNA, 25 bp, Mus musculus
gcttatgtctatcgtcaggatcctt

SEQ ID NO: 575817 - DNA, 25 bp, Mus musculus
gcttatgtctatggtcaggatcctt

SEQ ID NO: 575818 - DNA, 25 bp, Mus musculus
gcttatgtgaacctaggccccagag

SEQ ID NO: 575819 - DNA, 25 bp, Mus musculus
gcttatgtgaacgtaggccccagag

SEQ ID NO: 575820 - DNA, 25 bp, Mus musculus
gcttatgtgctgatgcttggtcagt

SEQ ID NO: 575821 - DNA, 25 bp, Mus musculus
gcttatgtgctgttgcttggtcagt

SEQ ID NO: 575822 - DNA, 25 bp, Mus musculus
gcttatgtggtccaacagacattca

SEQ ID NO: 575823 - DNA, 25 bp, Mus musculus
gcttatgtggtcgaacagacattca

SEQ ID NO: 575824 - DNA, 25 bp, Mus musculus
gcttatgttaccatccagggtcatg

SEQ ID NO: 575825 - DNA, 25 bp, Mus musculus
gcttatgttaccttccagggtcatg

SEQ ID NO: 575826 - DNA, 25 bp, Mus musculus
gcttatgttctactttatgggcctc

SEQ ID NO: 575827 - DNA, 25 bp, Mus musculus
gcttatgttctagtttatgggcctc

SEQ ID NO: 575828 - DNA, 25 bp, Mus musculus
gcttatgttctcagatatgtatgta

SEQ ID NO: 575829 - DNA, 25 bp, Mus musculus
gcttatgttctctgatatgtatgta

SEQ ID NO: 575830 - DNA, 25 bp, Mus musculus
gcttatgttgtgacccattgtgaaa

SEQ ID NO: 575831 - DNA, 25 bp, Mus musculus
gcttatgttgtgtcccattgtgaaa

SEQ ID NO: 575832 - DNA, 25 bp, Mus musculus
gcttattaaaatcatggcaccatcc

SEQ ID NO: 575833 - DNA, 25 bp, Mus musculus
gcttattaaaatgatggcaccatcc

SEQ ID NO: 575834 - DNA, 25 bp, Mus musculus
gcttattatataccccgtggtcctt

SEQ ID NO: 575835 - DNA, 25 bp, Mus musculus
gcttattatatagcccgtggtcctt

SEQ ID NO: 575836 - DNA, 25 bp, Mus musculus
gcttattatgggatatccaatgagt

SEQ ID NO: 575837 - DNA, 25 bp, Mus musculus
gcttattatgggttatccaatgagt

SEQ ID NO: 575838 - DNA, 25 bp, Mus musculus
gcttattattttatatcctttaggt

SEQ ID NO: 575839 - DNA, 25 bp, Mus musculus
gcttattattttttatcctttaggt

SEQ ID NO: 575840 - DNA, 25 bp, Mus musculus
gcttattcagcactgagtctccaga

SEQ ID NO: 575841 - DNA, 25 bp, Mus musculus
gcttattcagcagtgagtctccaga

SEQ ID NO: 575842 - DNA, 25 bp, Mus musculus
gcttattccaaccaactgtgtatat

SEQ ID NO: 575843 - DNA, 25 bp, Mus musculus
gcttattccaacgaactgtgtatat

SEQ ID NO: 575844 - DNA, 25 bp, Mus musculus
gcttattcccttctaacaacactaa

SEQ ID NO: 575845 - DNA, 25 bp, Mus musculus
gcttattcccttgtaacaacactaa

SEQ ID NO: 575846 - DNA, 25 bp, Mus musculus
gcttattccgtgaagatgcttgttt

SEQ ID NO: 575847 - DNA, 25 bp, Mus musculus
gcttattccgtgtagatgcttgttt

SEQ ID NO: 575848 - DNA, 25 bp, Mus musculus
gcttattcctcactttgtctgcaac

SEQ ID NO: 575849 - DNA, 25 bp, Mus musculus
gcttattcctcagtttgtctgcaac

SEQ ID NO: 575850 - DNA, 25 bp, Mus musculus
gcttattcggatattcttgcacagt

SEQ ID NO: 575851 - DNA, 25 bp, Mus musculus
gcttattcggattttcttgcacagt

SEQ ID NO: 575852 - DNA, 25 bp, Mus musculus
gcttattctaagattgcctcttcaa

SEQ ID NO: 575853 - DNA, 25 bp, Mus musculus
gcttattctaagtttgcctcttcaa

SEQ ID NO: 575854 - DNA, 25 bp, Mus musculus
gcttattgagctcattgccaggttg

SEQ ID NO: 575855 - DNA, 25 bp, Mus musculus
gcttattgagctgattgccaggttg

SEQ ID NO: 575856 - DNA, 25 bp, Mus musculus
gcttattgatgtcggaaccggctac

SEQ ID NO: 575857 - DNA, 25 bp, Mus musculus
gcttattgatgtgggaaccggctac

SEQ ID NO: 575858 - DNA, 25 bp, Mus musculus
gcttattgcagtcgccggttgcgat

SEQ ID NO: 575859 - DNA, 25 bp, Mus musculus
gcttattgcagtggccggttgcgat

SEQ ID NO: 575860 - DNA, 25 bp, Mus musculus
gcttattgggcaacttccctgacaa

SEQ ID NO: 575861 - DNA, 25 bp, Mus musculus
gcttattgggcatcttccctgacaa

SEQ ID NO: 575862 - DNA, 25 bp, Mus musculus
gcttattgtactctggtgctttgca

SEQ ID NO: 575863 - DNA, 25 bp, Mus musculus
gcttattgtactgtggtgctttgca

SEQ ID NO: 575864 - DNA, 25 bp, Mus musculus
gcttattgttggcttccacagccaa

SEQ ID NO: 575865 - DNA, 25 bp, Mus musculus
gcttattgttgggttccacagccaa

SEQ ID NO: 575866 - DNA, 25 bp, Mus musculus
gcttatttaatgcatcaggacccac

SEQ ID NO: 575867 - DNA, 25 bp, Mus musculus
gcttatttaatggatcaggacccac

SEQ ID NO: 575868 - DNA, 25 bp, Mus musculus
gcttatttactcatggaatcccttg

SEQ ID NO: 575869 - DNA, 25 bp, Mus musculus
gcttatttactcttggaatcccttg

SEQ ID NO: 575870 - DNA, 25 bp, Mus musculus
gcttatttatctagtttggtcaccc

SEQ ID NO: 575871 - DNA, 25 bp, Mus musculus
gcttatttatcttgtttggtcaccc

SEQ ID NO: 575872 - DNA, 25 bp, Mus musculus
gcttatttccccagcagcaaattca

SEQ ID NO: 575873 - DNA, 25 bp, Mus musculus
gcttatttcccctgcagcaaattca

SEQ ID NO: 575874 - DNA, 25 bp, Mus musculus
gcttatttccctctgtcttatgtaa

SEQ ID NO: 575875 - DNA, 25 bp, Mus musculus
gcttatttccctctgtgattacagc

SEQ ID NO: 575876 - DNA, 25 bp, Mus musculus
gcttatttccctgtgtcttatgtaa

SEQ ID NO: 575877 - DNA, 25 bp, Mus musculus
gcttatttccctgtgtgattacagc

SEQ ID NO: 575878 - DNA, 25 bp, Mus musculus
gcttatttctgtattcctactagga

SEQ ID NO: 575879 - DNA, 25 bp, Mus musculus
gcttatttctgttttcctactagga

SEQ ID NO: 575880 - DNA, 25 bp, Mus musculus
gcttatttcttcctaatggtaccat

SEQ ID NO: 575881 - DNA, 25 bp, Mus musculus
gcttatttcttcgtaatggtaccat

SEQ ID NO: 575882 - DNA, 25 bp, Mus musculus
gcttatttgccaattagcctgcatt

SEQ ID NO: 575883 - DNA, 25 bp, Mus musculus
gcttatttgccatttagcctgcatt

SEQ ID NO: 575884 - DNA, 25 bp, Mus musculus
gcttattttacaattctgactttga

SEQ ID NO: 575885 - DNA, 25 bp, Mus musculus
gcttattttacatttctgactttga

SEQ ID NO: 575886 - DNA, 25 bp, Mus musculus
gcttattttgtactgcagaatccca

SEQ ID NO: 575887 - DNA, 25 bp, Mus musculus
gcttattttgtagtgcagaatccca

SEQ ID NO: 575888 - DNA, 25 bp, Mus musculus
gcttatttttccaagttctcaccag

SEQ ID NO: 575889 - DNA, 25 bp, Mus musculus
gcttatttttcctagttctcaccag

SEQ ID NO: 575890 - DNA, 25 bp, Mus musculus
gcttatttttctccatgacatctgg

SEQ ID NO: 575891 - DNA, 25 bp, Mus musculus
gcttatttttctgcatgacatctgg

SEQ ID NO: 575892 - DNA, 25 bp, Mus musculus
gcttatttttgccacgttttgctat

SEQ ID NO: 575893 - DNA, 25 bp, Mus musculus
gcttatttttgccagagggtagtaa

SEQ ID NO: 575894 - DNA, 25 bp, Mus musculus
gcttatttttgcgacgttttgctat

SEQ ID NO: 575895 - DNA, 25 bp, Mus musculus
gcttatttttgcgagagggtagtaa

SEQ ID NO: 575896 - DNA, 25 bp, Mus musculus
gcttcaaaatatacgctaccagttt

SEQ ID NO: 575897 - DNA, 25 bp, Mus musculus
gcttcaaaatattcgctaccagttt

SEQ ID NO: 575898 - DNA, 25 bp, Mus musculus
gcttcaaacccaaaccttgaacatg

SEQ ID NO: 575899 - DNA, 25 bp, Mus musculus
gcttcaaacccataccttgaacatg

SEQ ID NO: 575900 - DNA, 25 bp, Mus musculus
gcttcaaagtcacgcttatgtctga

SEQ ID NO: 575901 - DNA, 25 bp, Mus musculus
gcttcaaagtcaggcttatgtctga

SEQ ID NO: 575902 - DNA, 25 bp, Mus musculus
gcttcaaatcagagccgtgggctac

SEQ ID NO: 575903 - DNA, 25 bp, Mus musculus
gcttcaaatcagtgccgtgggctac

SEQ ID NO: 575904 - DNA, 25 bp, Mus musculus
gcttcaaatcgaatttgtacttgac

SEQ ID NO: 575905 - DNA, 25 bp, Mus musculus
gcttcaaatcgattttgtacttgac

SEQ ID NO: 575906 - DNA, 25 bp, Mus musculus
gcttcaaatctacaggatcccttca

SEQ ID NO: 575907 - DNA, 25 bp, Mus musculus
gcttcaaatctagaggatcccttca

SEQ ID NO: 575908 - DNA, 25 bp, Mus musculus
gcttcaaatgtgagatccccatgct

SEQ ID NO: 575909 - DNA, 25 bp, Mus musculus
gcttcaaatgtgtgatccccatgct

SEQ ID NO: 575910 - DNA, 25 bp, Mus musculus
gcttcaaatgttcctaaatctcttc

SEQ ID NO: 575911 - DNA, 25 bp, Mus musculus
gcttcaaatgttgctaaatctcttc

SEQ ID NO: 575912 - DNA, 25 bp, Mus musculus
gcttcaacaaccatctcgtaacaaa

SEQ ID NO: 575913 - DNA, 25 bp, Mus musculus
gcttcaacaaccttctcgtaacaaa

SEQ ID NO: 575914 - DNA, 25 bp, Mus musculus
gcttcaacaacgagcttcctcaaga

SEQ ID NO: 575915 - DNA, 25 bp, Mus musculus
gcttcaacaacgtgcttcctcaaga

SEQ ID NO: 575916 - DNA, 25 bp, Mus musculus
gcttcaacacaacaaagcttgcagt

SEQ ID NO: 575917 - DNA, 25 bp, Mus musculus
gcttcaacacaagaaagcttgcagt

SEQ ID NO: 575918 - DNA, 25 bp, Mus musculus
gcttcaacagcaacaccgttatgga

SEQ ID NO: 575919 - DNA, 25 bp, Mus musculus
gcttcaacagcatcaccgttatgga

SEQ ID NO: 575920 - DNA, 25 bp, Mus musculus
gcttcaacatccagggcagcttccg

SEQ ID NO: 575921 - DNA, 25 bp, Mus musculus
gcttcaacatcctgggcagcttccg

SEQ ID NO: 575922 - DNA, 25 bp, Mus musculus
gcttcaacatgcagtcctaggtgca

SEQ ID NO: 575923 - DNA, 25 bp, Mus musculus
gcttcaacatgctgtcctaggtgca

SEQ ID NO: 575924 - DNA, 25 bp, Mus musculus
gcttcaacccacatttgttacaatg

SEQ ID NO: 575925 - DNA, 25 bp, Mus musculus
gcttcaacccacttttgttacaatg

SEQ ID NO: 575926 - DNA, 25 bp, Mus musculus
gcttcaacgtgcagggttacaccaa

SEQ ID NO: 575927 - DNA, 25 bp, Mus musculus
gcttcaacgtgctgggttacaccaa

SEQ ID NO: 575928 - DNA, 25 bp, Mus musculus
gcttcaagagcgattcatgctgtat

SEQ ID NO: 575929 - DNA, 25 bp, Mus musculus
gcttcaagagcgtttcatgctgtat

SEQ ID NO: 575930 - DNA, 25 bp, Mus musculus
gcttcaagcagacgcgcatcaagtt

SEQ ID NO: 575931 - DNA, 25 bp, Mus musculus
gcttcaagcagaggcgcatcaagtt

SEQ ID NO: 575932 - DNA, 25 bp, Mus musculus
gcttcaagggcaaacatactgtgta

SEQ ID NO: 575933 - DNA, 25 bp, Mus musculus
gcttcaagggcatacatactgtgta

SEQ ID NO: 575934 - DNA, 25 bp, Mus musculus
gcttcaaggtcaccctttgctacat

SEQ ID NO: 575935 - DNA, 25 bp, Mus musculus
gcttcaaggtcagcctttgctacat

SEQ ID NO: 575936 - DNA, 25 bp, Mus musculus
gcttcaagtaagatttttcccctct

SEQ ID NO: 575937 - DNA, 25 bp, Mus musculus
gcttcaagtaagttttttcccctct

SEQ ID NO: 575938 - DNA, 25 bp, Mus musculus
gcttcaagtacacctatatttcctt

SEQ ID NO: 575939 - DNA, 25 bp, Mus musculus
gcttcaagtacagctatatttcctt

SEQ ID NO: 575940 - DNA, 25 bp, Mus musculus
gcttcaagtgtcaagaagtccacct

SEQ ID NO: 575941 - DNA, 25 bp, Mus musculus
gcttcaagtgtctagaagtccacct

SEQ ID NO: 575942 - DNA, 25 bp, Mus musculus
gcttcaatactcatggtgtaccaga

SEQ ID NO: 575943 - DNA, 25 bp, Mus musculus
gcttcaatactcttggtgtaccaga

SEQ ID NO: 575944 - DNA, 25 bp, Mus musculus
gcttcaatagagacctcccacacat

SEQ ID NO: 575945 - DNA, 25 bp, Mus musculus
gcttcaatagagtcctcccacacat

SEQ ID NO: 575946 - DNA, 25 bp, Mus musculus
gcttcaatccctatctctattattt

SEQ ID NO: 575947 - DNA, 25 bp, Mus musculus
gcttcaatccctttctctattattt

SEQ ID NO: 575948 - DNA, 25 bp, Mus musculus
gcttcaatgaccacaagccactgga

SEQ ID NO: 575949 - DNA, 25 bp, Mus musculus
gcttcaatgacctcaagccactgga

SEQ ID NO: 575950 - DNA, 25 bp, Mus musculus
gcttcaatgcacacagtggtcaaaa

SEQ ID NO: 575951 - DNA, 25 bp, Mus musculus
gcttcaatgcactcagtggtcaaaa

SEQ ID NO: 575952 - DNA, 25 bp, Mus musculus
gcttcaatgcccatggagacgccaa

SEQ ID NO: 575953 - DNA, 25 bp, Mus musculus
gcttcaatgcccttggagacgccaa

SEQ ID NO: 575954 - DNA, 25 bp, Mus musculus
gcttcaatgtgaatatggtcctgca

SEQ ID NO: 575955 - DNA, 25 bp, Mus musculus
gcttcaatgtgattatggtcctgca

SEQ ID NO: 575956 - DNA, 25 bp, Mus musculus
gcttcaattcttatgcttttgcttc

SEQ ID NO: 575957 - DNA, 25 bp, Mus musculus
gcttcaattcttttgcttttgcttc

SEQ ID NO: 575958 - DNA, 25 bp, Mus musculus
gcttcacaagaacttcacatggctg

SEQ ID NO: 575959 - DNA, 25 bp, Mus musculus
gcttcacaagaagttcacatggctg

SEQ ID NO: 575960 - DNA, 25 bp, Mus musculus
gcttcacacacaacacctaatttaa

SEQ ID NO: 575961 - DNA, 25 bp, Mus musculus
gcttcacacacatcacctaatttaa

SEQ ID NO: 575962 - DNA, 25 bp, Mus musculus
gcttcacaccagagtcttctagaat

SEQ ID NO: 575963 - DNA, 25 bp, Mus musculus
gcttcacaccagtgtcttctagaat

SEQ ID NO: 575964 - DNA, 25 bp, Mus musculus
gcttcacactagatcaacgctttac

SEQ ID NO: 575965 - DNA, 25 bp, Mus musculus
gcttcacactagttcaacgctttac

SEQ ID NO: 575966 - DNA, 25 bp, Mus musculus
gcttcacacttaaattgttagaaga

SEQ ID NO: 575967 - DNA, 25 bp, Mus musculus
gcttcacacttatattgttagaaga

SEQ ID NO: 575968 - DNA, 25 bp, Mus musculus
gcttcacagcaaaaattcccaaacc

SEQ ID NO: 575969 - DNA, 25 bp, Mus musculus
gcttcacagcaataattcccaaacc

SEQ ID NO: 575970 - DNA, 25 bp, Mus musculus
gcttcacagctaagggcaacactca

SEQ ID NO: 575971 - DNA, 25 bp, Mus musculus
gcttcacagctatgggcaacactca

SEQ ID NO: 575972 - DNA, 25 bp, Mus musculus
gcttcacagctgaaatactcttgat

SEQ ID NO: 575973 - DNA, 25 bp, Mus musculus
gcttcacagctgtaatactcttgat

SEQ ID NO: 575974 - DNA, 25 bp, Mus musculus
gcttcacagcttagcagtataatga

SEQ ID NO: 575975 - DNA, 25 bp, Mus musculus
gcttcacagctttgcagtataatga

SEQ ID NO: 575976 - DNA, 25 bp, Mus musculus
gcttcacatacacaactgtctacac

SEQ ID NO: 575977 - DNA, 25 bp, Mus musculus
gcttcacatacagaactgtctacac

SEQ ID NO: 575978 - DNA, 25 bp, Mus musculus
gcttcacattcaaccgaagggagga

SEQ ID NO: 575979 - DNA, 25 bp, Mus musculus
gcttcacattcatccgaagggagga

SEQ ID NO: 575980 - DNA, 25 bp, Mus musculus
gcttcacatttcacacgcctatatt

SEQ ID NO: 575981 - DNA, 25 bp, Mus musculus
gcttcacatttctcacgcctatatt

SEQ ID NO: 575982 - DNA, 25 bp, Mus musculus
gcttcaccaaggaaggttaaagaga

SEQ ID NO: 575983 - DNA, 25 bp, Mus musculus
gcttcaccaaggtaggttaaagaga

SEQ ID NO: 575984 - DNA, 25 bp, Mus musculus
gcttcaccaccacagctgagaggga

SEQ ID NO: 575985 - DNA, 25 bp, Mus musculus
gcttcaccaccagagctgagaggga

SEQ ID NO: 575986 - DNA, 25 bp, Mus musculus
gcttcaccagtgaaagttttcatca

SEQ ID NO: 575987 - DNA, 25 bp, Mus musculus
gcttcaccagtgtaagttttcatca

SEQ ID NO: 575988 - DNA, 25 bp, Mus musculus
gcttcaccagttaacggcgcatgta

SEQ ID NO: 575989 - DNA, 25 bp, Mus musculus
gcttcaccagtttacggcgcatgta

SEQ ID NO: 575990 - DNA, 25 bp, Mus musculus
gcttcacccagcatattttctattc

SEQ ID NO: 575991 - DNA, 25 bp, Mus musculus
gcttcacccagcttattttctattc

SEQ ID NO: 575992 - DNA, 25 bp, Mus musculus
gcttcacccaggattccgacgaact

SEQ ID NO: 575993 - DNA, 25 bp, Mus musculus
gcttcacccaggtttccgacgaact

SEQ ID NO: 575994 - DNA, 25 bp, Mus musculus
gcttcaccccagctttgtatggaga

SEQ ID NO: 575995 - DNA, 25 bp, Mus musculus
gcttcaccccaggtttgtatggaga

SEQ ID NO: 575996 - DNA, 25 bp, Mus musculus
gcttcacccgcgcagttaagtaagg

SEQ ID NO: 575997 - DNA, 25 bp, Mus musculus
gcttcacccgcggagttaagtaagg

SEQ ID NO: 575998 - DNA, 25 bp, Mus musculus
gcttcaccggttcagatttggctaa

SEQ ID NO: 575999 - DNA, 25 bp, Mus musculus
gcttcaccggttgagatttggctaa

SEQ ID NO: 576000 - DNA, 25 bp, Mus musculus
gcttcacctgaaatcaccatgctga

SEQ ID NO: 576001 - DNA, 25 bp, Mus musculus
gcttcacctgaattcaccatgctga

SEQ ID NO: 576002 - DNA, 25 bp, Mus musculus
gcttcacctgccaagatatcttcaa

SEQ ID NO: 576003 - DNA, 25 bp, Mus musculus
gcttcacctgcctagatatcttcaa

SEQ ID NO: 576004 - DNA, 25 bp, Mus musculus
gcttcaccttatcagaggacaaggg

SEQ ID NO: 576005 - DNA, 25 bp, Mus musculus
gcttcaccttatgagaggacaaggg

SEQ ID NO: 576006 - DNA, 25 bp, Mus musculus
gcttcaccttctatactgtggaaag

SEQ ID NO: 576007 - DNA, 25 bp, Mus musculus
gcttcaccttctttactgtggaaag

SEQ ID NO: 576008 - DNA, 25 bp, Mus musculus
gcttcaccttgaaggctatgggatc

SEQ ID NO: 576009 - DNA, 25 bp, Mus musculus
gcttcaccttgatggctatgggatc

SEQ ID NO: 576010 - DNA, 25 bp, Mus musculus
gcttcacgcaggctgcccgcggaat

SEQ ID NO: 576011 - DNA, 25 bp, Mus musculus
gcttcacgcagggtgcccgcggaat

SEQ ID NO: 576012 - DNA, 25 bp, Mus musculus
gcttcacggagtaagcctatccgat

SEQ ID NO: 576013 - DNA, 25 bp, Mus musculus
gcttcacggagttagcctatccgat

SEQ ID NO: 576014 - DNA, 25 bp, Mus musculus
gcttcacgggctacattgggcttga

SEQ ID NO: 576015 - DNA, 25 bp, Mus musculus
gcttcacgggcttcattgggcttga

SEQ ID NO: 576016 - DNA, 25 bp, Mus musculus
gcttcactcatcatttcagccaaag

SEQ ID NO: 576017 - DNA, 25 bp, Mus musculus
gcttcactcatcttttcagccaaag

SEQ ID NO: 576018 - DNA, 25 bp, Mus musculus
gcttcactccggactggcagagctt

SEQ ID NO: 576019 - DNA, 25 bp, Mus musculus
gcttcactccggtctggcagagctt

SEQ ID NO: 576020 - DNA, 25 bp, Mus musculus
gcttcactccgtctttgtttttata

SEQ ID NO: 576021 - DNA, 25 bp, Mus musculus
gcttcactccgtgtttgtttttata

SEQ ID NO: 576022 - DNA, 25 bp, Mus musculus
gcttcactctgtatacgaggaggag

SEQ ID NO: 576023 - DNA, 25 bp, Mus musculus
gcttcactctgtttacgaggaggag

SEQ ID NO: 576024 - DNA, 25 bp, Mus musculus
gcttcactgatgatgtaagcagtct

SEQ ID NO: 576025 - DNA, 25 bp, Mus musculus
gcttcactgatgttgtaagcagtct

SEQ ID NO: 576026 - DNA, 25 bp, Mus musculus
gcttcactggatcacatgcagcctt

SEQ ID NO: 576027 - DNA, 25 bp, Mus musculus
gcttcactggatgacatgcagcctt

SEQ ID NO: 576028 - DNA, 25 bp, Mus musculus
gcttcactgtcaattgtattcgctt

SEQ ID NO: 576029 - DNA, 25 bp, Mus musculus
gcttcactgtcatttgtattcgctt

SEQ ID NO: 576030 - DNA, 25 bp, Mus musculus
gcttcacttattcctaatattgcgg

SEQ ID NO: 576031 - DNA, 25 bp, Mus musculus
gcttcacttattgctaatattgcgg

SEQ ID NO: 576032 - DNA, 25 bp, Mus musculus
gcttcacttcagacatcagggcgga

SEQ ID NO: 576033 - DNA, 25 bp, Mus musculus
gcttcacttcagtcatcagggcgga

SEQ ID NO: 576034 - DNA, 25 bp, Mus musculus
gcttcacttgggagcctctggagga

SEQ ID NO: 576035 - DNA, 25 bp, Mus musculus
gcttcacttgggtgcctctggagga

SEQ ID NO: 576036 - DNA, 25 bp, Mus musculus
gcttcactttggcagtcgttggaat

SEQ ID NO: 576037 - DNA, 25 bp, Mus musculus
gcttcactttgggagtcgttggaat

SEQ ID NO: 576038 - DNA, 25 bp, Mus musculus
gcttcagaaatactgggagtttccc

SEQ ID NO: 576039 - DNA, 25 bp, Mus musculus
gcttcagaaatagtgggagtttccc

SEQ ID NO: 576040 - DNA, 25 bp, Mus musculus
gcttcagaacatcgatgatgccttt

SEQ ID NO: 576041 - DNA, 25 bp, Mus musculus
gcttcagaacatggatgatgccttt

SEQ ID NO: 576042 - DNA, 25 bp, Mus musculus
gcttcagaacccatttgtgtatgca

SEQ ID NO: 576043 - DNA, 25 bp, Mus musculus
gcttcagaacccttttgtgtatgca

SEQ ID NO: 576044 - DNA, 25 bp, Mus musculus
gcttcagaacggaggcagcctgaca

SEQ ID NO: 576045 - DNA, 25 bp, Mus musculus
gcttcagaacggtggcagcctgaca

SEQ ID NO: 576046 - DNA, 25 bp, Mus musculus
gcttcagaactgagacctgatacat

SEQ ID NO: 576047 - DNA, 25 bp, Mus musculus
gcttcagaactgtgacctgatacat

SEQ ID NO: 576048 - DNA, 25 bp, Mus musculus
gcttcagaagttaacggagattccc

SEQ ID NO: 576049 - DNA, 25 bp, Mus musculus
gcttcagaagtttacggagattccc

SEQ ID NO: 576050 - DNA, 25 bp, Mus musculus
gcttcagaattaaggacttgctaga

SEQ ID NO: 576051 - DNA, 25 bp, Mus musculus
gcttcagaattacccattgctgcca

SEQ ID NO: 576052 - DNA, 25 bp, Mus musculus
gcttcagaattagccattgctgcca

SEQ ID NO: 576053 - DNA, 25 bp, Mus musculus
gcttcagaattatggacttgctaga

SEQ ID NO: 576054 - DNA, 25 bp, Mus musculus
gcttcagacaccaacatagtgtttg

SEQ ID NO: 576055 - DNA, 25 bp, Mus musculus
gcttcagacacctacatagtgtttg

SEQ ID NO: 576056 - DNA, 25 bp, Mus musculus
gcttcagacaggaaaacccaaaaga

SEQ ID NO: 576057 - DNA, 25 bp, Mus musculus
gcttcagacaggctgagcatctctc

SEQ ID NO: 576058 - DNA, 25 bp, Mus musculus
gcttcagacagggtgagcatctctc

SEQ ID NO: 576059 - DNA, 25 bp, Mus musculus
gcttcagacaggtaaacccaaaaga

SEQ ID NO: 576060 - DNA, 25 bp, Mus musculus
gcttcagaccccacaattgtggagt

SEQ ID NO: 576061 - DNA, 25 bp, Mus musculus
gcttcagacccctcaattgtggagt

SEQ ID NO: 576062 - DNA, 25 bp, Mus musculus
gcttcagacctacgccagatggcag

SEQ ID NO: 576063 - DNA, 25 bp, Mus musculus
gcttcagacctaggccagatggcag

SEQ ID NO: 576064 - DNA, 25 bp, Mus musculus
gcttcagactctcggcttcaaaata

SEQ ID NO: 576065 - DNA, 25 bp, Mus musculus
gcttcagactctgggcttcaaaata

SEQ ID NO: 576066 - DNA, 25 bp, Mus musculus
gcttcagactgacgatgtggcatgt

SEQ ID NO: 576067 - DNA, 25 bp, Mus musculus
gcttcagactgaggatgtggcatgt

SEQ ID NO: 576068 - DNA, 25 bp, Mus musculus
gcttcagactgtagtgggtaggttt

SEQ ID NO: 576069 - DNA, 25 bp, Mus musculus
gcttcagactgttgtgggtaggttt

SEQ ID NO: 576070 - DNA, 25 bp, Mus musculus
gcttcagactttctgagcgaaaatg

SEQ ID NO: 576071 - DNA, 25 bp, Mus musculus
gcttcagactttgtgagcgaaaatg

SEQ ID NO: 576072 - DNA, 25 bp, Mus musculus
gcttcagagaagcacagtgtcccca

SEQ ID NO: 576073 - DNA, 25 bp, Mus musculus
gcttcagagaaggacagtgtcccca

SEQ ID NO: 576074 - DNA, 25 bp, Mus musculus
gcttcagagaatcacctcccagaat

SEQ ID NO: 576075 - DNA, 25 bp, Mus musculus
gcttcagagaatgacctcccagaat

SEQ ID NO: 576076 - DNA, 25 bp, Mus musculus
gcttcagagacactgtacctatcca

SEQ ID NO: 576077 - DNA, 25 bp, Mus musculus
gcttcagagacagtgtacctatcca

SEQ ID NO: 576078 - DNA, 25 bp, Mus musculus
gcttcagagcccatacaagatgcat

SEQ ID NO: 576079 - DNA, 25 bp, Mus musculus
gcttcagagcccttacaagatgcat

SEQ ID NO: 576080 - DNA, 25 bp, Mus musculus
gcttcagaggacaccgcagtggtca

SEQ ID NO: 576081 - DNA, 25 bp, Mus musculus
gcttcagaggactccgcagtggtca

SEQ ID NO: 576082 - DNA, 25 bp, Mus musculus
gcttcagaggccattgtttcagggt

SEQ ID NO: 576083 - DNA, 25 bp, Mus musculus
gcttcagaggcctttgtttcagggt

SEQ ID NO: 576084 - DNA, 25 bp, Mus musculus
gcttcagatagtatctgccagctgt

SEQ ID NO: 576085 - DNA, 25 bp, Mus musculus
gcttcagatagtttctgccagctgt

SEQ ID NO: 576086 - DNA, 25 bp, Mus musculus
gcttcagatatcaaccttgacttcc

SEQ ID NO: 576087 - DNA, 25 bp, Mus musculus
gcttcagatatctaccttgacttcc

SEQ ID NO: 576088 - DNA, 25 bp, Mus musculus
gcttcagatgtccaggttcaaggct

SEQ ID NO: 576089 - DNA, 25 bp, Mus musculus
gcttcagatgtcgaggttcaaggct

SEQ ID NO: 576090 - DNA, 25 bp, Mus musculus
gcttcagcaaagactctggttcttt

SEQ ID NO: 576091 - DNA, 25 bp, Mus musculus
gcttcagcaaagtctctggttcttt

SEQ ID NO: 576092 - DNA, 25 bp, Mus musculus
gcttcagcaacaagcggcaatggaa

SEQ ID NO: 576093 - DNA, 25 bp, Mus musculus
gcttcagcaacatgcggcaatggaa

SEQ ID NO: 576094 - DNA, 25 bp, Mus musculus
gcttcagcactgaggcgccatgaat

SEQ ID NO: 576095 - DNA, 25 bp, Mus musculus
gcttcagcactgtggcgccatgaat

SEQ ID NO: 576096 - DNA, 25 bp, Mus musculus
gcttcagcacttcgaaaataaggca

SEQ ID NO: 576097 - DNA, 25 bp, Mus musculus
gcttcagcacttggaaaataaggca

SEQ ID NO: 576098 - DNA, 25 bp, Mus musculus
gcttcagccacacaaatccaacttg

SEQ ID NO: 576099 - DNA, 25 bp, Mus musculus
gcttcagccacagaaatccaacttg

SEQ ID NO: 576100 - DNA, 25 bp, Mus musculus
gcttcagccgtgaccatggtaaaca

SEQ ID NO: 576101 - DNA, 25 bp, Mus musculus
gcttcagccgtgattatttggacat

SEQ ID NO: 576102 - DNA, 25 bp, Mus musculus
gcttcagccgtgtccatggtaaaca

SEQ ID NO: 576103 - DNA, 25 bp, Mus musculus
gcttcagccgtgtttatttggacat

SEQ ID NO: 576104 - DNA, 25 bp, Mus musculus
gcttcagcctctcaaatactggtct

SEQ ID NO: 576105 - DNA, 25 bp, Mus musculus
gcttcagcctctctcactaacaaag

SEQ ID NO: 576106 - DNA, 25 bp, Mus musculus
gcttcagcctctgaaatactggtct

SEQ ID NO: 576107 - DNA, 25 bp, Mus musculus
gcttcagcctctgtcactaacaaag

SEQ ID NO: 576108 - DNA, 25 bp, Mus musculus
gcttcagcctgcattgggaggatac

SEQ ID NO: 576109 - DNA, 25 bp, Mus musculus
gcttcagcctgctttgggaggatac

SEQ ID NO: 576110 - DNA, 25 bp, Mus musculus
gcttcagcgaaacattcctccttca

SEQ ID NO: 576111 - DNA, 25 bp, Mus musculus
gcttcagcgaaagattcctccttca

SEQ ID NO: 576112 - DNA, 25 bp, Mus musculus
gcttcagcgaacacagcatgtcaag

SEQ ID NO: 576113 - DNA, 25 bp, Mus musculus
gcttcagcgaactcagcatgtcaag

SEQ ID NO: 576114 - DNA, 25 bp, Mus musculus
gcttcagcggcaccttccagaacag

SEQ ID NO: 576115 - DNA, 25 bp, Mus musculus
gcttcagcggcagcttccagaacag

SEQ ID NO: 576116 - DNA, 25 bp, Mus musculus
gcttcagctctgacaaattgccatg

SEQ ID NO: 576117 - DNA, 25 bp, Mus musculus
gcttcagctctgtcaaattgccatg

SEQ ID NO: 576118 - DNA, 25 bp, Mus musculus
gcttcagctcttctaaatctctctg

SEQ ID NO: 576119 - DNA, 25 bp, Mus musculus
gcttcagctcttgtaaatctctctg

SEQ ID NO: 576120 - DNA, 25 bp, Mus musculus
gcttcagcttgcagttgtggcagca

SEQ ID NO: 576121 - DNA, 25 bp, Mus musculus
gcttcagcttgctgttgtggcagca

SEQ ID NO: 576122 - DNA, 25 bp, Mus musculus
gcttcaggaactacaaccttctagc

SEQ ID NO: 576123 - DNA, 25 bp, Mus musculus
gcttcaggaacttcaaccttctagc

SEQ ID NO: 576124 - DNA, 25 bp, Mus musculus
gcttcaggaagccttgtggacacgt

SEQ ID NO: 576125 - DNA, 25 bp, Mus musculus
gcttcaggaagcgttgtggacacgt

SEQ ID NO: 576126 - DNA, 25 bp, Mus musculus
gcttcaggagggagggaggtctgta

SEQ ID NO: 576127 - DNA, 25 bp, Mus musculus
gcttcaggagggtgggaggtctgta

SEQ ID NO: 576128 - DNA, 25 bp, Mus musculus
gcttcaggcaccaaggaagacccta

SEQ ID NO: 576129 - DNA, 25 bp, Mus musculus
gcttcaggcacctaggaagacccta

SEQ ID NO: 576130 - DNA, 25 bp, Mus musculus
gcttcaggcagcaagttttcagcgg

SEQ ID NO: 576131 - DNA, 25 bp, Mus musculus
gcttcaggcagctagttttcagcgg

SEQ ID NO: 576132 - DNA, 25 bp, Mus musculus
gcttcaggcccaacaggtgtttgta

SEQ ID NO: 576133 - DNA, 25 bp, Mus musculus
gcttcaggcccatcaggtgtttgta

SEQ ID NO: 576134 - DNA, 25 bp, Mus musculus
gcttcaggctatcgaaggcgacccc

SEQ ID NO: 576135 - DNA, 25 bp, Mus musculus
gcttcaggctatggaaggcgacccc

SEQ ID NO: 576136 - DNA, 25 bp, Mus musculus
gcttcagggaagaagtgtctccttt

SEQ ID NO: 576137 - DNA, 25 bp, Mus musculus
gcttcagggaagtagtgtctccttt

SEQ ID NO: 576138 - DNA, 25 bp, Mus musculus
gcttcagggaccaaggccaactcct

SEQ ID NO: 576139 - DNA, 25 bp, Mus musculus
gcttcagggacctaggccaactcct

SEQ ID NO: 576140 - DNA, 25 bp, Mus musculus
gcttcagggactccaagctggcctt

SEQ ID NO: 576141 - DNA, 25 bp, Mus musculus
gcttcagggactgcaagctggcctt

SEQ ID NO: 576142 - DNA, 25 bp, Mus musculus
gcttcagggattcactcttctttag

SEQ ID NO: 576143 - DNA, 25 bp, Mus musculus
gcttcagggattcctccgacttaac

SEQ ID NO: 576144 - DNA, 25 bp, Mus musculus
gcttcagggattgactcttctttag

SEQ ID NO: 576145 - DNA, 25 bp, Mus musculus
gcttcagggattgctccgacttaac

SEQ ID NO: 576146 - DNA, 25 bp, Mus musculus
gcttcagggtatactcttgggtttt

SEQ ID NO: 576147 - DNA, 25 bp, Mus musculus
gcttcagggtattctcttgggtttt

SEQ ID NO: 576148 - DNA, 25 bp, Mus musculus
gcttcagggtctcgcggcgcccaaa

SEQ ID NO: 576149 - DNA, 25 bp, Mus musculus
gcttcagggtctggcggcgcccaaa

SEQ ID NO: 576150 - DNA, 25 bp, Mus musculus
gcttcaggtaagattgctcattgca

SEQ ID NO: 576151 - DNA, 25 bp, Mus musculus
gcttcaggtaagtttgctcattgca

SEQ ID NO: 576152 - DNA, 25 bp, Mus musculus
gcttcaggtgcactggagttgcttt

SEQ ID NO: 576153 - DNA, 25 bp, Mus musculus
gcttcaggtgcagtggagttgcttt

SEQ ID NO: 576154 - DNA, 25 bp, Mus musculus
gcttcaggttccaagcaggcagtag

SEQ ID NO: 576155 - DNA, 25 bp, Mus musculus
gcttcaggttcctagcaggcagtag

SEQ ID NO: 576156 - DNA, 25 bp, Mus musculus
gcttcaggttgtcctgtgtttgtat

SEQ ID NO: 576157 - DNA, 25 bp, Mus musculus
gcttcaggttgtgctgtgtttgtat

SEQ ID NO: 576158 - DNA, 25 bp, Mus musculus
gcttcagtaaatcacggcatatgga

SEQ ID NO: 576159 - DNA, 25 bp, Mus musculus
gcttcagtaaatgacggcatatgga

SEQ ID NO: 576160 - DNA, 25 bp, Mus musculus
gcttcagtaagcatgcagttttatt

SEQ ID NO: 576161 - DNA, 25 bp, Mus musculus
gcttcagtaagcttgcagttttatt

SEQ ID NO: 576162 - DNA, 25 bp, Mus musculus
gcttcagtacctacatggagggcta

SEQ ID NO: 576163 - DNA, 25 bp, Mus musculus
gcttcagtaccttcatggagggcta

SEQ ID NO: 576164 - DNA, 25 bp, Mus musculus
gcttcagtagtcatcaaaaccaaaa

SEQ ID NO: 576165 - DNA, 25 bp, Mus musculus
gcttcagtagtcttcaaaaccaaaa

SEQ ID NO: 576166 - DNA, 25 bp, Mus musculus
gcttcagtatttcctcatttaatca

SEQ ID NO: 576167 - DNA, 25 bp, Mus musculus
gcttcagtatttgctcatttaatca

SEQ ID NO: 576168 - DNA, 25 bp, Mus musculus
gcttcagtcaccctaaagaggctct

SEQ ID NO: 576169 - DNA, 25 bp, Mus musculus
gcttcagtcaccgtaaagaggctct

SEQ ID NO: 576170 - DNA, 25 bp, Mus musculus
gcttcagtcagcaaaatcaacaaca

SEQ ID NO: 576171 - DNA, 25 bp, Mus musculus
gcttcagtcagctaaatcaacaaca

SEQ ID NO: 576172 - DNA, 25 bp, Mus musculus
gcttcagtcatgatgcagtactcaa

SEQ ID NO: 576173 - DNA, 25 bp, Mus musculus
gcttcagtcatgttgcagtactcaa

SEQ ID NO: 576174 - DNA, 25 bp, Mus musculus
gcttcagtcctcaaataacgcacgt

SEQ ID NO: 576175 - DNA, 25 bp, Mus musculus
gcttcagtcctcaacagggaagggt

SEQ ID NO: 576176 - DNA, 25 bp, Mus musculus
gcttcagtcctctaataacgcacgt

SEQ ID NO: 576177 - DNA, 25 bp, Mus musculus
gcttcagtcctctacagggaagggt

SEQ ID NO: 576178 - DNA, 25 bp, Mus musculus
gcttcagtcttgcagctatcaggat

SEQ ID NO: 576179 - DNA, 25 bp, Mus musculus
gcttcagtcttggagctatcaggat

SEQ ID NO: 576180 - DNA, 25 bp, Mus musculus
gcttcagtgaaacctgacctgccag

SEQ ID NO: 576181 - DNA, 25 bp, Mus musculus
gcttcagtgaaagctgacctgccag

SEQ ID NO: 576182 - DNA, 25 bp, Mus musculus
gcttcagtgactcagtttcccttca

SEQ ID NO: 576183 - DNA, 25 bp, Mus musculus
gcttcagtgactgagtttcccttca

SEQ ID NO: 576184 - DNA, 25 bp, Mus musculus
gcttcagtgattagagccattggaa

SEQ ID NO: 576185 - DNA, 25 bp, Mus musculus
gcttcagtgatttgagccattggaa

SEQ ID NO: 576186 - DNA, 25 bp, Mus musculus
gcttcagtgcatctatctttacagt

SEQ ID NO: 576187 - DNA, 25 bp, Mus musculus
gcttcagtgcatgtatctttacagt

SEQ ID NO: 576188 - DNA, 25 bp, Mus musculus
gcttcagtggagacctgatggagca

SEQ ID NO: 576189 - DNA, 25 bp, Mus musculus
gcttcagtggagtcctgatggagca

SEQ ID NO: 576190 - DNA, 25 bp, Mus musculus
gcttcagtggcaccaccacatggtg

SEQ ID NO: 576191 - DNA, 25 bp, Mus musculus
gcttcagtggcagcaccacatggtg

SEQ ID NO: 576192 - DNA, 25 bp, Mus musculus
gcttcagtgggcaccggaactcaaa

SEQ ID NO: 576193 - DNA, 25 bp, Mus musculus
gcttcagtgggctccggaactcaaa

SEQ ID NO: 576194 - DNA, 25 bp, Mus musculus
gcttcagtggttagaagactgtcat

SEQ ID NO: 576195 - DNA, 25 bp, Mus musculus
gcttcagtggtttgaagactgtcat

SEQ ID NO: 576196 - DNA, 25 bp, Mus musculus
gcttcagtgttcctgacttgcttgg

SEQ ID NO: 576197 - DNA, 25 bp, Mus musculus
gcttcagtgttcgtgacttgcttgg

SEQ ID NO: 576198 - DNA, 25 bp, Mus musculus
gcttcagttaaaagttggtatctct

SEQ ID NO: 576199 - DNA, 25 bp, Mus musculus
gcttcagttaaatgttggtatctct

SEQ ID NO: 576200 - DNA, 25 bp, Mus musculus
gcttcagttacacactgcctcttta

SEQ ID NO: 576201 - DNA, 25 bp, Mus musculus
gcttcagttacagactgcctcttta

SEQ ID NO: 576202 - DNA, 25 bp, Mus musculus
gcttcagttactatgtggcatggtg

SEQ ID NO: 576203 - DNA, 25 bp, Mus musculus
gcttcagttactttgtggcatggtg

SEQ ID NO: 576204 - DNA, 25 bp, Mus musculus
gcttcagttcctaggatccttttat

SEQ ID NO: 576205 - DNA, 25 bp, Mus musculus
gcttcagttccttggatccttttat

SEQ ID NO: 576206 - DNA, 25 bp, Mus musculus
gcttcagtttgaccagtttttgttc

SEQ ID NO: 576207 - DNA, 25 bp, Mus musculus
gcttcagtttgagcagtttttgttc

SEQ ID NO: 576208 - DNA, 25 bp, Mus musculus
gcttcagtttggacagattgttatt

SEQ ID NO: 576209 - DNA, 25 bp, Mus musculus
gcttcagtttggtcagattgttatt

SEQ ID NO: 576210 - DNA, 25 bp, Mus musculus
gcttcagttttaacaatgctacagt

SEQ ID NO: 576211 - DNA, 25 bp, Mus musculus
gcttcagttttatcaatgctacagt

SEQ ID NO: 576212 - DNA, 25 bp, Mus musculus
gcttcataaacaccctataagttat

SEQ ID NO: 576213 - DNA, 25 bp, Mus musculus
gcttcataaacagcctataagttat

SEQ ID NO: 576214 - DNA, 25 bp, Mus musculus
gcttcataaacgaggttgttgttgt

SEQ ID NO: 576215 - DNA, 25 bp, Mus musculus
gcttcataaacgtggttgttgttgt

SEQ ID NO: 576216 - DNA, 25 bp, Mus musculus
gcttcataacttacagccatctgtt

SEQ ID NO: 576217 - DNA, 25 bp, Mus musculus
gcttcataactttcagccatctgtt

SEQ ID NO: 576218 - DNA, 25 bp, Mus musculus
gcttcataagtcacaccgtgggtgg

SEQ ID NO: 576219 - DNA, 25 bp, Mus musculus
gcttcataagtctcaccgtgggtgg

SEQ ID NO: 576220 - DNA, 25 bp, Mus musculus
gcttcatacagaatgaccccaatcc

SEQ ID NO: 576221 - DNA, 25 bp, Mus musculus
gcttcatacagattgaccccaatcc

SEQ ID NO: 576222 - DNA, 25 bp, Mus musculus
gcttcataccttcctctgtatacag

SEQ ID NO: 576223 - DNA, 25 bp, Mus musculus
gcttcataccttgctctgtatacag

SEQ ID NO: 576224 - DNA, 25 bp, Mus musculus
gcttcatacgtgaaacaattttctc

SEQ ID NO: 576225 - DNA, 25 bp, Mus musculus
gcttcatacgtgtaacaattttctc

SEQ ID NO: 576226 - DNA, 25 bp, Mus musculus
gcttcatactgtcgtcctgtttggg

SEQ ID NO: 576227 - DNA, 25 bp, Mus musculus
gcttcatactgtggtcctgtttggg

SEQ ID NO: 576228 - DNA, 25 bp, Mus musculus
gcttcatagcaacctgccatcatgt

SEQ ID NO: 576229 - DNA, 25 bp, Mus musculus
gcttcatagcaagctgccatcatgt

SEQ ID NO: 576230 - DNA, 25 bp, Mus musculus
gcttcatagcatctttcaggtcagc

SEQ ID NO: 576231 - DNA, 25 bp, Mus musculus
gcttcatagcatgtttcaggtcagc

SEQ ID NO: 576232 - DNA, 25 bp, Mus musculus
gcttcatatctcctgtacttcataa

SEQ ID NO: 576233 - DNA, 25 bp, Mus musculus
gcttcatatctcgtgtacttcataa

SEQ ID NO: 576234 - DNA, 25 bp, Mus musculus
gcttcatcaaagaaggcaacgctga

SEQ ID NO: 576235 - DNA, 25 bp, Mus musculus
gcttcatcaaagtaggcaacgctga

SEQ ID NO: 576236 - DNA, 25 bp, Mus musculus
gcttcatcagatattttccagtttc

SEQ ID NO: 576237 - DNA, 25 bp, Mus musculus
gcttcatcagattttttccagtttc

SEQ ID NO: 576238 - DNA, 25 bp, Mus musculus
gcttcatcatctactaatgggaact

SEQ ID NO: 576239 - DNA, 25 bp, Mus musculus
gcttcatcatcttctaatgggaact

SEQ ID NO: 576240 - DNA, 25 bp, Mus musculus
gcttcatccagtccaccaagaaagt

SEQ ID NO: 576241 - DNA, 25 bp, Mus musculus
gcttcatccagtgcaccaagaaagt

SEQ ID NO: 576242 - DNA, 25 bp, Mus musculus
gcttcatcctggatggaaatgctag

SEQ ID NO: 576243 - DNA, 25 bp, Mus musculus
gcttcatcctggttggaaatgctag

SEQ ID NO: 576244 - DNA, 25 bp, Mus musculus
gcttcatcctgtatggaaattctac

SEQ ID NO: 576245 - DNA, 25 bp, Mus musculus
gcttcatcctgtttggaaattctac

SEQ ID NO: 576246 - DNA, 25 bp, Mus musculus
gcttcatctaaaagttccttcagag

SEQ ID NO: 576247 - DNA, 25 bp, Mus musculus
gcttcatctaaatgttccttcagag

SEQ ID NO: 576248 - DNA, 25 bp, Mus musculus
gcttcatctactcgatacaggacac

SEQ ID NO: 576249 - DNA, 25 bp, Mus musculus
gcttcatctactggatacaggacac

SEQ ID NO: 576250 - DNA, 25 bp, Mus musculus
gcttcatctcagaccttcttgtctg

SEQ ID NO: 576251 - DNA, 25 bp, Mus musculus
gcttcatctcagtccttcttgtctg

SEQ ID NO: 576252 - DNA, 25 bp, Mus musculus
gcttcatctccgctagtgtaatatt

SEQ ID NO: 576253 - DNA, 25 bp, Mus musculus
gcttcatctccggtagtgtaatatt

SEQ ID NO: 576254 - DNA, 25 bp, Mus musculus
gcttcatctctcagtagctggctaa

SEQ ID NO: 576255 - DNA, 25 bp, Mus musculus
gcttcatctctctgtagctggctaa

SEQ ID NO: 576256 - DNA, 25 bp, Mus musculus
gcttcatcttaaactgcagctcaag

SEQ ID NO: 576257 - DNA, 25 bp, Mus musculus
gcttcatcttaatctgcagctcaag

SEQ ID NO: 576258 - DNA, 25 bp, Mus musculus
gcttcatcttagcttcagaacaaac

SEQ ID NO: 576259 - DNA, 25 bp, Mus musculus
gcttcatcttaggttcagaacaaac

SEQ ID NO: 576260 - DNA, 25 bp, Mus musculus
gcttcatctttaatcaggcactaga

SEQ ID NO: 576261 - DNA, 25 bp, Mus musculus
gcttcatctttattcaggcactaga

SEQ ID NO: 576262 - DNA, 25 bp, Mus musculus
gcttcatctttcagggcgcctatga

SEQ ID NO: 576263 - DNA, 25 bp, Mus musculus
gcttcatctttctgggcgcctatga

SEQ ID NO: 576264 - DNA, 25 bp, Mus musculus
gcttcatctttgagtcatttgcagg

SEQ ID NO: 576265 - DNA, 25 bp, Mus musculus
gcttcatctttgtgtcatttgcagg

SEQ ID NO: 576266 - DNA, 25 bp, Mus musculus
gcttcatgaacaacggagccgctct

SEQ ID NO: 576267 - DNA, 25 bp, Mus musculus
gcttcatgaacatcggagccgctct

SEQ ID NO: 576268 - DNA, 25 bp, Mus musculus
gcttcatgactaaagatggacactg

SEQ ID NO: 576269 - DNA, 25 bp, Mus musculus
gcttcatgactatagatggacactg

SEQ ID NO: 576270 - DNA, 25 bp, Mus musculus
gcttcatgcaaaagtcacctgcctt

SEQ ID NO: 576271 - DNA, 25 bp, Mus musculus
gcttcatgcaaatgtcacctgcctt

SEQ ID NO: 576272 - DNA, 25 bp, Mus musculus
gcttcatgcattattgctattctgg

SEQ ID NO: 576273 - DNA, 25 bp, Mus musculus
gcttcatgcatttttgctattctgg

SEQ ID NO: 576274 - DNA, 25 bp, Mus musculus
gcttcatggagccatcgagcgcgac

SEQ ID NO: 576275 - DNA, 25 bp, Mus musculus
gcttcatggagcgatcgagcgcgac

SEQ ID NO: 576276 - DNA, 25 bp, Mus musculus
gcttcatggctgagtattatataaa

SEQ ID NO: 576277 - DNA, 25 bp, Mus musculus
gcttcatggctgtgtattatataaa

SEQ ID NO: 576278 - DNA, 25 bp, Mus musculus
gcttcatgggcgaaaaacctacctg

SEQ ID NO: 576279 - DNA, 25 bp, Mus musculus
gcttcatgggcgtaaaacctacctg

SEQ ID NO: 576280 - DNA, 25 bp, Mus musculus
gcttcatggtcacttatagtttgct

SEQ ID NO: 576281 - DNA, 25 bp, Mus musculus
gcttcatggtcagttatagtttgct

SEQ ID NO: 576282 - DNA, 25 bp, Mus musculus
gcttcatggtttcgtacaggtattc

SEQ ID NO: 576283 - DNA, 25 bp, Mus musculus
gcttcatggtttggtacaggtattc

SEQ ID NO: 576284 - DNA, 25 bp, Mus musculus
gcttcatgtatactgctgagctgca

SEQ ID NO: 576285 - DNA, 25 bp, Mus musculus
gcttcatgtatagtgctgagctgca

SEQ ID NO: 576286 - DNA, 25 bp, Mus musculus
gcttcatgtctgacccatccctata

SEQ ID NO: 576287 - DNA, 25 bp, Mus musculus
gcttcatgtctgtcccatccctata

SEQ ID NO: 576288 - DNA, 25 bp, Mus musculus
gcttcatgtgagcagtgctaactgc

SEQ ID NO: 576289 - DNA, 25 bp, Mus musculus
gcttcatgtgaggagtgctaactgc

SEQ ID NO: 576290 - DNA, 25 bp, Mus musculus
gcttcattaccactatcaacatgtg

SEQ ID NO: 576291 - DNA, 25 bp, Mus musculus
gcttcattaccagtatcaacatgtg

SEQ ID NO: 576292 - DNA, 25 bp, Mus musculus
gcttcattactaacccttgggctaa

SEQ ID NO: 576293 - DNA, 25 bp, Mus musculus
gcttcattactatcccttgggctaa

SEQ ID NO: 576294 - DNA, 25 bp, Mus musculus
gcttcattcatcatgagctgagttt

SEQ ID NO: 576295 - DNA, 25 bp, Mus musculus
gcttcattcatcttgagctgagttt

SEQ ID NO: 576296 - DNA, 25 bp, Mus musculus
gcttcattctagcttattctgcctt

SEQ ID NO: 576297 - DNA, 25 bp, Mus musculus
gcttcattctaggttattctgcctt

SEQ ID NO: 576298 - DNA, 25 bp, Mus musculus
gcttcattctgtaaaggccaacata

SEQ ID NO: 576299 - DNA, 25 bp, Mus musculus
gcttcattctgttaaggccaacata

SEQ ID NO: 576300 - DNA, 25 bp, Mus musculus
gcttcattcttcaaccgtgtgagta

SEQ ID NO: 576301 - DNA, 25 bp, Mus musculus
gcttcattcttctaccgtgtgagta

SEQ ID NO: 576302 - DNA, 25 bp, Mus musculus
gcttcattgactatgtggtttgccc

SEQ ID NO: 576303 - DNA, 25 bp, Mus musculus
gcttcattgactttgtggtttgccc

SEQ ID NO: 576304 - DNA, 25 bp, Mus musculus
gcttcattgcatctaatgtagacct

SEQ ID NO: 576305 - DNA, 25 bp, Mus musculus
gcttcattgcatgtaatgtagacct

SEQ ID NO: 576306 - DNA, 25 bp, Mus musculus
gcttcatttatgatcttgacactat

SEQ ID NO: 576307 - DNA, 25 bp, Mus musculus
gcttcatttatgttcttgacactat

SEQ ID NO: 576308 - DNA, 25 bp, Mus musculus
gcttcatttcccatgcatacagaat

SEQ ID NO: 576309 - DNA, 25 bp, Mus musculus
gcttcatttcccttgcatacagaat

SEQ ID NO: 576310 - DNA, 25 bp, Mus musculus
gcttcatttggtacagcagctggag

SEQ ID NO: 576311 - DNA, 25 bp, Mus musculus
gcttcatttggttcagcagctggag

SEQ ID NO: 576312 - DNA, 25 bp, Mus musculus
gcttcatttgtacctccaatctcta

SEQ ID NO: 576313 - DNA, 25 bp, Mus musculus
gcttcatttgtagctccaatctcta

SEQ ID NO: 576314 - DNA, 25 bp, Mus musculus
gcttcattttgcacaggacaccagg

SEQ ID NO: 576315 - DNA, 25 bp, Mus musculus
gcttcattttgctcaggacaccagg

SEQ ID NO: 576316 - DNA, 25 bp, Mus musculus
gcttccaaaggccatgttccgtctt

SEQ ID NO: 576317 - DNA, 25 bp, Mus musculus
gcttccaaaggcgatgttccgtctt

SEQ ID NO: 576318 - DNA, 25 bp, Mus musculus
gcttccaaatggcttttcctcttag

SEQ ID NO: 576319 - DNA, 25 bp, Mus musculus
gcttccaaatgggttttcctcttag

SEQ ID NO: 576320 - DNA, 25 bp, Mus musculus
gcttccaacattatccagagatatt

SEQ ID NO: 576321 - DNA, 25 bp, Mus musculus
gcttccaacattttccagagatatt

SEQ ID NO: 576322 - DNA, 25 bp, Mus musculus
gcttccaaccccagtatttttgtgg

SEQ ID NO: 576323 - DNA, 25 bp, Mus musculus
gcttccaacccctgtatttttgtgg

SEQ ID NO: 576324 - DNA, 25 bp, Mus musculus
gcttccaaccttctataggtttgta

SEQ ID NO: 576325 - DNA, 25 bp, Mus musculus
gcttccaaccttgtataggtttgta

SEQ ID NO: 576326 - DNA, 25 bp, Mus musculus
gcttccaactacatcatccgaatga

SEQ ID NO: 576327 - DNA, 25 bp, Mus musculus
gcttccaactacttcatccgaatga

SEQ ID NO: 576328 - DNA, 25 bp, Mus musculus
gcttccaagagaatgttgcctgtat

SEQ ID NO: 576329 - DNA, 25 bp, Mus musculus
gcttccaagagattgttgcctgtat

SEQ ID NO: 576330 - DNA, 25 bp, Mus musculus
gcttccaagatcacgttgggctagt

SEQ ID NO: 576331 - DNA, 25 bp, Mus musculus
gcttccaagatctcgttgggctagt

SEQ ID NO: 576332 - DNA, 25 bp, Mus musculus
gcttccaaggaacacccacaaaggc

SEQ ID NO: 576333 - DNA, 25 bp, Mus musculus
gcttccaaggaagacccacaaaggc

SEQ ID NO: 576334 - DNA, 25 bp, Mus musculus
gcttccaaggacagcaatatgtgct

SEQ ID NO: 576335 - DNA, 25 bp, Mus musculus
gcttccaaggactgcaatatgtgct

SEQ ID NO: 576336 - DNA, 25 bp, Mus musculus
gcttccaaggcacggttgttcccaa

SEQ ID NO: 576337 - DNA, 25 bp, Mus musculus
gcttccaaggcagggttgttcccaa

SEQ ID NO: 576338 - DNA, 25 bp, Mus musculus
gcttccaagggaactggtgtgcttc

SEQ ID NO: 576339 - DNA, 25 bp, Mus musculus
gcttccaagggatctggtgtgcttc

SEQ ID NO: 576340 - DNA, 25 bp, Mus musculus
gcttccaagggtcatctaaatgtcc

SEQ ID NO: 576341 - DNA, 25 bp, Mus musculus
gcttccaagggtgatctaaatgtcc

SEQ ID NO: 576342 - DNA, 25 bp, Mus musculus
gcttccaaggttagagtcagggcac

SEQ ID NO: 576343 - DNA, 25 bp, Mus musculus
gcttccaaggtttgagtcagggcac

SEQ ID NO: 576344 - DNA, 25 bp, Mus musculus
gcttccaagtcgctgttggttttaa

SEQ ID NO: 576345 - DNA, 25 bp, Mus musculus
gcttccaagtcggtgttggttttaa

SEQ ID NO: 576346 - DNA, 25 bp, Mus musculus
gcttccaagtggagccggctcctga

SEQ ID NO: 576347 - DNA, 25 bp, Mus musculus
gcttccaagtggtgccggctcctga

SEQ ID NO: 576348 - DNA, 25 bp, Mus musculus
gcttccaatgatagttggctcttta

SEQ ID NO: 576349 - DNA, 25 bp, Mus musculus
gcttccaatgattgttggctcttta

SEQ ID NO: 576350 - DNA, 25 bp, Mus musculus
gcttccaattataacctgcttgaat

SEQ ID NO: 576351 - DNA, 25 bp, Mus musculus
gcttccaattattacctgcttgaat

SEQ ID NO: 576352 - DNA, 25 bp, Mus musculus
gcttccacaacaattgcccatatta

SEQ ID NO: 576353 - DNA, 25 bp, Mus musculus
gcttccacaacatttgcccatatta

SEQ ID NO: 576354 - DNA, 25 bp, Mus musculus
gcttccacaaccagtcggagctcaa

SEQ ID NO: 576355 - DNA, 25 bp, Mus musculus
gcttccacaacctgtcggagctcaa

SEQ ID NO: 576356 - DNA, 25 bp, Mus musculus
gcttccacactactctcggaggagt

SEQ ID NO: 576357 - DNA, 25 bp, Mus musculus
gcttccacactagtctcggaggagt

SEQ ID NO: 576358 - DNA, 25 bp, Mus musculus
gcttccaccattctgttctttgtac

SEQ ID NO: 576359 - DNA, 25 bp, Mus musculus
gcttccaccattgtgttctttgtac

SEQ ID NO: 576360 - DNA, 25 bp, Mus musculus
gcttccaccgtgagcatttggtact

SEQ ID NO: 576361 - DNA, 25 bp, Mus musculus
gcttccaccgtgtgcatttggtact

SEQ ID NO: 576362 - DNA, 25 bp, Mus musculus
gcttccaccttacttttgacagaat

SEQ ID NO: 576363 - DNA, 25 bp, Mus musculus
gcttccaccttagttttgacagaat

SEQ ID NO: 576364 - DNA, 25 bp, Mus musculus
gcttccacggaaagggctcaggcaa

SEQ ID NO: 576365 - DNA, 25 bp, Mus musculus
gcttccacggaatgggctcaggcaa

SEQ ID NO: 576366 - DNA, 25 bp, Mus musculus
gcttccacggctccttagacttggg

SEQ ID NO: 576367 - DNA, 25 bp, Mus musculus
gcttccacggctgcttagacttggg

SEQ ID NO: 576368 - DNA, 25 bp, Mus musculus
gcttccacggtgagaccattcaaat

SEQ ID NO: 576369 - DNA, 25 bp, Mus musculus
gcttccacggtgtgaccattcaaat

SEQ ID NO: 576370 - DNA, 25 bp, Mus musculus
gcttccacttcccaaacagtgagat

SEQ ID NO: 576371 - DNA, 25 bp, Mus musculus
gcttccacttccgaaacagtgagat

SEQ ID NO: 576372 - DNA, 25 bp, Mus musculus
gcttccagaatccactgctgaaatt

SEQ ID NO: 576373 - DNA, 25 bp, Mus musculus
gcttccagaatcgactgctgaaatt

SEQ ID NO: 576374 - DNA, 25 bp, Mus musculus
gcttccagaattaatcagatcctat

SEQ ID NO: 576375 - DNA, 25 bp, Mus musculus
gcttccagaatttatcagatcctat

SEQ ID NO: 576376 - DNA, 25 bp, Mus musculus
gcttccagaccacagtgaaattcta

SEQ ID NO: 576377 - DNA, 25 bp, Mus musculus
gcttccagaccagagtgaaattcta

SEQ ID NO: 576378 - DNA, 25 bp, Mus musculus
gcttccagagctatctatcactagt

SEQ ID NO: 576379 - DNA, 25 bp, Mus musculus
gcttccagagctttctatcactagt

SEQ ID NO: 576380 - DNA, 25 bp, Mus musculus
gcttccagatggcactgtggtgtca

SEQ ID NO: 576381 - DNA, 25 bp, Mus musculus
gcttccagatgggactgtggtgtca

SEQ ID NO: 576382 - DNA, 25 bp, Mus musculus
gcttccagccagcagtagaggccag

SEQ ID NO: 576383 - DNA, 25 bp, Mus musculus
gcttccagccaggagtagaggccag

SEQ ID NO: 576384 - DNA, 25 bp, Mus musculus
gcttccagccttccactaagaaaga

SEQ ID NO: 576385 - DNA, 25 bp, Mus musculus
gcttccagccttgcactaagaaaga

SEQ ID NO: 576386 - DNA, 25 bp, Mus musculus
gcttccagcgtcctgtgtacttgtt

SEQ ID NO: 576387 - DNA, 25 bp, Mus musculus
gcttccagcgtcgtgtgtacttgtt

SEQ ID NO: 576388 - DNA, 25 bp, Mus musculus
gcttccaggatcactaccatgaaaa

SEQ ID NO: 576389 - DNA, 25 bp, Mus musculus
gcttccaggatctctaccatgaaaa

SEQ ID NO: 576390 - DNA, 25 bp, Mus musculus
gcttccaggatgctgaaatgctacc

SEQ ID NO: 576391 - DNA, 25 bp, Mus musculus
gcttccaggatggtgaaatgctacc

SEQ ID NO: 576392 - DNA, 25 bp, Mus musculus
gcttccaggattacaactggtctcc

SEQ ID NO: 576393 - DNA, 25 bp, Mus musculus
gcttccaggatttcaactggtctcc

SEQ ID NO: 576394 - DNA, 25 bp, Mus musculus
gcttccagggcaaagccaccaagat

SEQ ID NO: 576395 - DNA, 25 bp, Mus musculus
gcttccagggcatagccaccaagat

SEQ ID NO: 576396 - DNA, 25 bp, Mus musculus
gcttccagggccagttactatttag

SEQ ID NO: 576397 - DNA, 25 bp, Mus musculus
gcttccagggcctgttactatttag

SEQ ID NO: 576398 - DNA, 25 bp, Mus musculus
gcttccagtcaaattaccttctttg

SEQ ID NO: 576399 - DNA, 25 bp, Mus musculus
gcttccagtcaatttaccttctttg

SEQ ID NO: 576400 - DNA, 25 bp, Mus musculus
gcttccagtcctacaatacttcata

SEQ ID NO: 576401 - DNA, 25 bp, Mus musculus
gcttccagtccttcaatacttcata

SEQ ID NO: 576402 - DNA, 25 bp, Mus musculus
gcttccagtgatccttatgaggcca

SEQ ID NO: 576403 - DNA, 25 bp, Mus musculus
gcttccagtgatgcttatgaggcca

SEQ ID NO: 576404 - DNA, 25 bp, Mus musculus
gcttccagtgttcatatgtgttcaa

SEQ ID NO: 576405 - DNA, 25 bp, Mus musculus
gcttccagtgttgatatgtgttcaa

SEQ ID NO: 576406 - DNA, 25 bp, Mus musculus
gcttccataaggcaaagaacactga

SEQ ID NO: 576407 - DNA, 25 bp, Mus musculus
gcttccataagggaaagaacactga

SEQ ID NO: 576408 - DNA, 25 bp, Mus musculus
gcttccataattccctagccataaa

SEQ ID NO: 576409 - DNA, 25 bp, Mus musculus
gcttccataattgcctagccataaa

SEQ ID NO: 576410 - DNA, 25 bp, Mus musculus
gcttccatacgacagtctcaggagg

SEQ ID NO: 576411 - DNA, 25 bp, Mus musculus
gcttccatacgagagtctcaggagg

SEQ ID NO: 576412 - DNA, 25 bp, Mus musculus
gcttccatcggccaggtaattcaag

SEQ ID NO: 576413 - DNA, 25 bp, Mus musculus
gcttccatcggcgaggtaattcaag

SEQ ID NO: 576414 - DNA, 25 bp, Mus musculus
gcttccatcttccagagtcactgtg

SEQ ID NO: 576415 - DNA, 25 bp, Mus musculus
gcttccatcttcgagagtcactgtg

SEQ ID NO: 576416 - DNA, 25 bp, Mus musculus
gcttccatgggaaagagacacacat

SEQ ID NO: 576417 - DNA, 25 bp, Mus musculus
gcttccatgggacgtacttggaact

SEQ ID NO: 576418 - DNA, 25 bp, Mus musculus
gcttccatgggaggtacttggaact

SEQ ID NO: 576419 - DNA, 25 bp, Mus musculus
gcttccatgggatagagacacacat

SEQ ID NO: 576420 - DNA, 25 bp, Mus musculus
gcttccatgggcaaaactcagtaga

SEQ ID NO: 576421 - DNA, 25 bp, Mus musculus
gcttccatgggcatctgcctgcaca

SEQ ID NO: 576422 - DNA, 25 bp, Mus musculus
gcttccatgggctaaactcagtaga

SEQ ID NO: 576423 - DNA, 25 bp, Mus musculus
gcttccatgggcttctgcctgcaca

SEQ ID NO: 576424 - DNA, 25 bp, Mus musculus
gcttccatgttgaatctgtcaccat

SEQ ID NO: 576425 - DNA, 25 bp, Mus musculus
gcttccatgttgtatctgtcaccat

SEQ ID NO: 576426 - DNA, 25 bp, Mus musculus
gcttccatgtttcgtatgcaatcta

SEQ ID NO: 576427 - DNA, 25 bp, Mus musculus
gcttccatgtttggtatgcaatcta

SEQ ID NO: 576428 - DNA, 25 bp, Mus musculus
gcttccattgaaatccagcctggga

SEQ ID NO: 576429 - DNA, 25 bp, Mus musculus
gcttccattgaattccagcctggga

SEQ ID NO: 576430 - DNA, 25 bp, Mus musculus
gcttccattgcaaccttaagggttt

SEQ ID NO: 576431 - DNA, 25 bp, Mus musculus
gcttccattgcatccttaagggttt

SEQ ID NO: 576432 - DNA, 25 bp, Mus musculus
gcttccattgctcttcgcctaggaa

SEQ ID NO: 576433 - DNA, 25 bp, Mus musculus
gcttccattgctgttcgcctaggaa

SEQ ID NO: 576434 - DNA, 25 bp, Mus musculus
gcttccattggaatctgcttcagag

SEQ ID NO: 576435 - DNA, 25 bp, Mus musculus
gcttccattggattctgcttcagag

SEQ ID NO: 576436 - DNA, 25 bp, Mus musculus
gcttccatttgaaaaggagctgata

SEQ ID NO: 576437 - DNA, 25 bp, Mus musculus
gcttccatttgataaggagctgata

SEQ ID NO: 576438 - DNA, 25 bp, Mus musculus
gcttccattttcaatactcaaccaa

SEQ ID NO: 576439 - DNA, 25 bp, Mus musculus
gcttccattttctatactcaaccaa

SEQ ID NO: 576440 - DNA, 25 bp, Mus musculus
gcttccatttttacaatatctagga

SEQ ID NO: 576441 - DNA, 25 bp, Mus musculus
gcttccattttttcaatatctagga

SEQ ID NO: 576442 - DNA, 25 bp, Mus musculus
gcttcccaaaagatttccacgtgtg

SEQ ID NO: 576443 - DNA, 25 bp, Mus musculus
gcttcccaaaagctgggctcgttgt

SEQ ID NO: 576444 - DNA, 25 bp, Mus musculus
gcttcccaaaaggtgggctcgttgt

SEQ ID NO: 576445 - DNA, 25 bp, Mus musculus
gcttcccaaaagttttccacgtgtg

SEQ ID NO: 576446 - DNA, 25 bp, Mus musculus
gcttcccaacatcatctccaggaga

SEQ ID NO: 576447 - DNA, 25 bp, Mus musculus
gcttcccaacatgatctccaggaga

SEQ ID NO: 576448 - DNA, 25 bp, Mus musculus
gcttcccaactcatgtaagacctta

SEQ ID NO: 576449 - DNA, 25 bp, Mus musculus
gcttcccaactcttgtaagacctta

SEQ ID NO: 576450 - DNA, 25 bp, Mus musculus
gcttcccaagggaacatagtccaca

SEQ ID NO: 576451 - DNA, 25 bp, Mus musculus
gcttcccaagggtacatagtccaca

SEQ ID NO: 576452 - DNA, 25 bp, Mus musculus
gcttcccaagtcactcaaatctaaa

SEQ ID NO: 576453 - DNA, 25 bp, Mus musculus
gcttcccaagtctctcaaatctaaa

SEQ ID NO: 576454 - DNA, 25 bp, Mus musculus
gcttcccaatgccacgttatatcaa

SEQ ID NO: 576455 - DNA, 25 bp, Mus musculus
gcttcccaatgcgacgttatatcaa

SEQ ID NO: 576456 - DNA, 25 bp, Mus musculus
gcttcccaccaaatattacgcataa

SEQ ID NO: 576457 - DNA, 25 bp, Mus musculus
gcttcccaccaattattacgcataa

SEQ ID NO: 576458 - DNA, 25 bp, Mus musculus
gcttcccaccctcagttaatagtaa

SEQ ID NO: 576459 - DNA, 25 bp, Mus musculus
gcttcccaccctgagttaatagtaa

SEQ ID NO: 576460 - DNA, 25 bp, Mus musculus
gcttcccacgacctttccatagaga

SEQ ID NO: 576461 - DNA, 25 bp, Mus musculus
gcttcccacgacgtttccatagaga

SEQ ID NO: 576462 - DNA, 25 bp, Mus musculus
gcttcccacgtgcttgtacatattt

SEQ ID NO: 576463 - DNA, 25 bp, Mus musculus
gcttcccacgtggttgtacatattt

SEQ ID NO: 576464 - DNA, 25 bp, Mus musculus
gcttcccacttgagctgtttgaaac

SEQ ID NO: 576465 - DNA, 25 bp, Mus musculus
gcttcccacttgtgctgtttgaaac

SEQ ID NO: 576466 - DNA, 25 bp, Mus musculus
gcttcccagaagagtattcagagac

SEQ ID NO: 576467 - DNA, 25 bp, Mus musculus
gcttcccagaagtgtattcagagac

SEQ ID NO: 576468 - DNA, 25 bp, Mus musculus
gcttcccagagacattggcagtggt

SEQ ID NO: 576469 - DNA, 25 bp, Mus musculus
gcttcccagagagattggcagtggt

SEQ ID NO: 576470 - DNA, 25 bp, Mus musculus
gcttcccagatgaacctgctgagta

SEQ ID NO: 576471 - DNA, 25 bp, Mus musculus
gcttcccagatgtacctgctgagta

SEQ ID NO: 576472 - DNA, 25 bp, Mus musculus
gcttcccagggccattatctacaaa

SEQ ID NO: 576473 - DNA, 25 bp, Mus musculus
gcttcccagggcgattatctacaaa

SEQ ID NO: 576474 - DNA, 25 bp, Mus musculus
gcttcccaggttcatgctgctattg

SEQ ID NO: 576475 - DNA, 25 bp, Mus musculus
gcttcccaggttgatgctgctattg

SEQ ID NO: 576476 - DNA, 25 bp, Mus musculus
gcttcccagtgcataacttataggc

SEQ ID NO: 576477 - DNA, 25 bp, Mus musculus
gcttcccagtgcttaacttataggc

SEQ ID NO: 576478 - DNA, 25 bp, Mus musculus
gcttcccatgaacctcttatttctg

SEQ ID NO: 576479 - DNA, 25 bp, Mus musculus
gcttcccatgaagctcttatttctg

SEQ ID NO: 576480 - DNA, 25 bp, Mus musculus
gcttcccatggaaccttgtgatttg

SEQ ID NO: 576481 - DNA, 25 bp, Mus musculus
gcttcccatggaagtttcttgtaaa

SEQ ID NO: 576482 - DNA, 25 bp, Mus musculus
gcttcccatggatccttgtgatttg

SEQ ID NO: 576483 - DNA, 25 bp, Mus musculus
gcttcccatggatgtttcttgtaaa

SEQ ID NO: 576484 - DNA, 25 bp, Mus musculus
gcttcccatgttcttttcctgtaat

SEQ ID NO: 576485 - DNA, 25 bp, Mus musculus
gcttcccatgttgttttcctgtaat

SEQ ID NO: 576486 - DNA, 25 bp, Mus musculus
gcttcccattgtaagtcatcttcga

SEQ ID NO: 576487 - DNA, 25 bp, Mus musculus
gcttcccattgttagtcatcttcga

SEQ ID NO: 576488 - DNA, 25 bp, Mus musculus
gcttccccaaagcaggagtcttagg

SEQ ID NO: 576489 - DNA, 25 bp, Mus musculus
gcttccccaaaggaggagtcttagg

SEQ ID NO: 576490 - DNA, 25 bp, Mus musculus
gcttccccacaaagaactatggctt

SEQ ID NO: 576491 - DNA, 25 bp, Mus musculus
gcttccccacaatgaactatggctt

SEQ ID NO: 576492 - DNA, 25 bp, Mus musculus
gcttccccactcagtgccttagtgg

SEQ ID NO: 576493 - DNA, 25 bp, Mus musculus
gcttccccactctgtgccttagtgg

SEQ ID NO: 576494 - DNA, 25 bp, Mus musculus
gcttccccaggtaactatcgattag

SEQ ID NO: 576495 - DNA, 25 bp, Mus musculus
gcttccccaggttactatcgattag

SEQ ID NO: 576496 - DNA, 25 bp, Mus musculus
gcttccccagtaagtaaaggtcatt

SEQ ID NO: 576497 - DNA, 25 bp, Mus musculus
gcttccccagtatgtaaaggtcatt

SEQ ID NO: 576498 - DNA, 25 bp, Mus musculus
gcttccccgaaaatacaactgcatt

SEQ ID NO: 576499 - DNA, 25 bp, Mus musculus
gcttccccgaaattacaactgcatt

SEQ ID NO: 576500 - DNA, 25 bp, Mus musculus
gcttccccgaatctgggactgtagg

SEQ ID NO: 576501 - DNA, 25 bp, Mus musculus
gcttccccgaatgtgggactgtagg

SEQ ID NO: 576502 - DNA, 25 bp, Mus musculus
gcttccccggacattcaaggcaaat

SEQ ID NO: 576503 - DNA, 25 bp, Mus musculus
gcttccccggactttcaaggcaaat

SEQ ID NO: 576504 - DNA, 25 bp, Mus musculus
gcttcccctaataatgtcatgtctg

SEQ ID NO: 576505 - DNA, 25 bp, Mus musculus
gcttcccctaattatgtcatgtctg

SEQ ID NO: 576506 - DNA, 25 bp, Mus musculus
gcttcccctgatatttatactgctc

SEQ ID NO: 576507 - DNA, 25 bp, Mus musculus
gcttcccctgatttttatactgctc

SEQ ID NO: 576508 - DNA, 25 bp, Mus musculus
gcttcccctgctaatgaggcattat

SEQ ID NO: 576509 - DNA, 25 bp, Mus musculus
gcttcccctgcttatgaggcattat

SEQ ID NO: 576510 - DNA, 25 bp, Mus musculus
gcttcccctgtccatgaatggcttt

SEQ ID NO: 576511 - DNA, 25 bp, Mus musculus
gcttcccctgtcgatgaatggcttt

SEQ ID NO: 576512 - DNA, 25 bp, Mus musculus
gcttcccctttactggtttgtctct

SEQ ID NO: 576513 - DNA, 25 bp, Mus musculus
gcttcccctttagtggtttgtctct

SEQ ID NO: 576514 - DNA, 25 bp, Mus musculus
gcttcccgagtgagctttttgcaga

SEQ ID NO: 576515 - DNA, 25 bp, Mus musculus
gcttcccgagtgtgctttttgcaga

SEQ ID NO: 576516 - DNA, 25 bp, Mus musculus
gcttcccgccagattctctcagttt

SEQ ID NO: 576517 - DNA, 25 bp, Mus musculus
gcttcccgccagtttctctcagttt

SEQ ID NO: 576518 - DNA, 25 bp, Mus musculus
gcttcccgcgaactccggagattag

SEQ ID NO: 576519 - DNA, 25 bp, Mus musculus
gcttcccgcgaagtccggagattag

SEQ ID NO: 576520 - DNA, 25 bp, Mus musculus
gcttcccgggatacttctgtctgtg

SEQ ID NO: 576521 - DNA, 25 bp, Mus musculus
gcttcccgggattcttctgtctgtg

SEQ ID NO: 576522 - DNA, 25 bp, Mus musculus
gcttcccgttaaagaatgagtactt

SEQ ID NO: 576523 - DNA, 25 bp, Mus musculus
gcttcccgttaatgaatgagtactt

SEQ ID NO: 576524 - DNA, 25 bp, Mus musculus
gcttccctaagtactttcatttgtc

SEQ ID NO: 576525 - DNA, 25 bp, Mus musculus
gcttccctaagttctttcatttgtc

SEQ ID NO: 576526 - DNA, 25 bp, Mus musculus
gcttccctagcaagaagttgtgagt

SEQ ID NO: 576527 - DNA, 25 bp, Mus musculus
gcttccctagcaagtcggtggctat

SEQ ID NO: 576528 - DNA, 25 bp, Mus musculus
gcttccctagcatgaagttgtgagt

SEQ ID NO: 576529 - DNA, 25 bp, Mus musculus
gcttccctagcatgtcggtggctat

SEQ ID NO: 576530 - DNA, 25 bp, Mus musculus
gcttccctatcaagagctggagctg

SEQ ID NO: 576531 - DNA, 25 bp, Mus musculus
gcttccctatcatgagctggagctg

SEQ ID NO: 576532 - DNA, 25 bp, Mus musculus
gcttccctatgtcagcagtgagctg

SEQ ID NO: 576533 - DNA, 25 bp, Mus musculus
gcttccctatgtgagcagtgagctg

SEQ ID NO: 576534 - DNA, 25 bp, Mus musculus
gcttccctattaacttcaaggccgc

SEQ ID NO: 576535 - DNA, 25 bp, Mus musculus
gcttccctattatcttcaaggccgc

SEQ ID NO: 576536 - DNA, 25 bp, Mus musculus
gcttccctcaatacagtaccaaaag

SEQ ID NO: 576537 - DNA, 25 bp, Mus musculus
gcttccctcaatagattgctggctt

SEQ ID NO: 576538 - DNA, 25 bp, Mus musculus
gcttccctcaattcagtaccaaaag

SEQ ID NO: 576539 - DNA, 25 bp, Mus musculus
gcttccctcaattgattgctggctt

SEQ ID NO: 576540 - DNA, 25 bp, Mus musculus
gcttccctccttcataacattagtg

SEQ ID NO: 576541 - DNA, 25 bp, Mus musculus
gcttccctccttgataacattagtg

SEQ ID NO: 576542 - DNA, 25 bp, Mus musculus
gcttccctctagagattactaccat

SEQ ID NO: 576543 - DNA, 25 bp, Mus musculus
gcttccctctagtgattactaccat

SEQ ID NO: 576544 - DNA, 25 bp, Mus musculus
gcttccctctttctaattcctgagt

SEQ ID NO: 576545 - DNA, 25 bp, Mus musculus
gcttccctctttgtaattcctgagt

SEQ ID NO: 576546 - DNA, 25 bp, Mus musculus
gcttccctgatgctaactgagtccc

SEQ ID NO: 576547 - DNA, 25 bp, Mus musculus
gcttccctgatggtaactgagtccc

SEQ ID NO: 576548 - DNA, 25 bp, Mus musculus
gcttccctggagaatattgcttcac

SEQ ID NO: 576549 - DNA, 25 bp, Mus musculus
gcttccctggagtatattgcttcac

SEQ ID NO: 576550 - DNA, 25 bp, Mus musculus
gcttccctggtcctcgaggcgagaa

SEQ ID NO: 576551 - DNA, 25 bp, Mus musculus
gcttccctggtcgtcgaggcgagaa

SEQ ID NO: 576552 - DNA, 25 bp, Mus musculus
gcttccctgtagctgcaacaacatt

SEQ ID NO: 576553 - DNA, 25 bp, Mus musculus
gcttccctgtaggtgcaacaacatt

SEQ ID NO: 576554 - DNA, 25 bp, Mus musculus
gcttccctgtatctggctaatccag

SEQ ID NO: 576555 - DNA, 25 bp, Mus musculus
gcttccctgtatgtggctaatccag

SEQ ID NO: 576556 - DNA, 25 bp, Mus musculus
gcttccctgttgacaccatattaaa

SEQ ID NO: 576557 - DNA, 25 bp, Mus musculus
gcttccctgttgtcaccatattaaa

SEQ ID NO: 576558 - DNA, 25 bp, Mus musculus
gcttcccttacaatcacctgtgtaa

SEQ ID NO: 576559 - DNA, 25 bp, Mus musculus
gcttcccttacattcacctgtgtaa

SEQ ID NO: 576560 - DNA, 25 bp, Mus musculus
gcttcccttccaaattcagtagaag

SEQ ID NO: 576561 - DNA, 25 bp, Mus musculus
gcttcccttccatattcagtagaag

SEQ ID NO: 576562 - DNA, 25 bp, Mus musculus
gcttcccttcgtcacctggagaaga

SEQ ID NO: 576563 - DNA, 25 bp, Mus musculus
gcttcccttcgtgacctggagaaga

SEQ ID NO: 576564 - DNA, 25 bp, Mus musculus
gcttcccttctgagaatgcatatta

SEQ ID NO: 576565 - DNA, 25 bp, Mus musculus
gcttcccttctgtgaatgcatatta

SEQ ID NO: 576566 - DNA, 25 bp, Mus musculus
gcttcccttgctagggactgattaa

SEQ ID NO: 576567 - DNA, 25 bp, Mus musculus
gcttcccttgcttgggactgattaa

SEQ ID NO: 576568 - DNA, 25 bp, Mus musculus
gcttcccttggacattttgtgtcta

SEQ ID NO: 576569 - DNA, 25 bp, Mus musculus
gcttcccttggagattttgtgtcta

SEQ ID NO: 576570 - DNA, 25 bp, Mus musculus
gcttcccttgtaagtgctgctaatc

SEQ ID NO: 576571 - DNA, 25 bp, Mus musculus
gcttcccttgtatgtgctgctaatc

SEQ ID NO: 576572 - DNA, 25 bp, Mus musculus
gcttccgaatttcaaccgattaaat

SEQ ID NO: 576573 - DNA, 25 bp, Mus musculus
gcttccgaatttgaaccgattaaat

SEQ ID NO: 576574 - DNA, 25 bp, Mus musculus
gcttccgactcactaggaggctgat

SEQ ID NO: 576575 - DNA, 25 bp, Mus musculus
gcttccgactcagtaggaggctgat

SEQ ID NO: 576576 - DNA, 25 bp, Mus musculus
gcttccgagctgatgatgggctaca

SEQ ID NO: 576577 - DNA, 25 bp, Mus musculus
gcttccgagctgttgatgggctaca

SEQ ID NO: 576578 - DNA, 25 bp, Mus musculus
gcttccgatgtgaaacagcttggga

SEQ ID NO: 576579 - DNA, 25 bp, Mus musculus
gcttccgatgtgtaacagcttggga

SEQ ID NO: 576580 - DNA, 25 bp, Mus musculus
gcttccgccacaaatcatgattcag

SEQ ID NO: 576581 - DNA, 25 bp, Mus musculus
gcttccgccacatatcatgattcag

SEQ ID NO: 576582 - DNA, 25 bp, Mus musculus
gcttccgccccactagcaataaaaa

SEQ ID NO: 576583 - DNA, 25 bp, Mus musculus
gcttccgccccagtagcaataaaaa

SEQ ID NO: 576584 - DNA, 25 bp, Mus musculus
gcttccgctgccaggatgagagtga

SEQ ID NO: 576585 - DNA, 25 bp, Mus musculus
gcttccgctgcctggatgagagtga

SEQ ID NO: 576586 - DNA, 25 bp, Mus musculus
gcttccgctggaaggcgcagtacat

SEQ ID NO: 576587 - DNA, 25 bp, Mus musculus
gcttccgctggatggcgcagtacat

SEQ ID NO: 576588 - DNA, 25 bp, Mus musculus
gcttccgcttctacgtggacgcaga

SEQ ID NO: 576589 - DNA, 25 bp, Mus musculus
gcttccgcttcttcgtggacgcaga

SEQ ID NO: 576590 - DNA, 25 bp, Mus musculus
gcttccggcagtacgcgaaggacat

SEQ ID NO: 576591 - DNA, 25 bp, Mus musculus
gcttccggcagttcgcgaaggacat

SEQ ID NO: 576592 - DNA, 25 bp, Mus musculus
gcttccgggtgaagtagccaccaat

SEQ ID NO: 576593 - DNA, 25 bp, Mus musculus
gcttccgggtgatgtagccaccaat

SEQ ID NO: 576594 - DNA, 25 bp, Mus musculus
gcttccggtccaatcctaggaaaat

SEQ ID NO: 576595 - DNA, 25 bp, Mus musculus
gcttccggtccattcctaggaaaat

SEQ ID NO: 576596 - DNA, 25 bp, Mus musculus
gcttccgtaaccagggtttgcctgt

SEQ ID NO: 576597 - DNA, 25 bp, Mus musculus
gcttccgtaacctgggtttgcctgt

SEQ ID NO: 576598 - DNA, 25 bp, Mus musculus
gcttccgtccacagttatagtttca

SEQ ID NO: 576599 - DNA, 25 bp, Mus musculus
gcttccgtccactgttatagtttca

SEQ ID NO: 576600 - DNA, 25 bp, Mus musculus
gcttccgtctgtagtaaggccttta

SEQ ID NO: 576601 - DNA, 25 bp, Mus musculus
gcttccgtctgttgtaaggccttta

SEQ ID NO: 576602 - DNA, 25 bp, Mus musculus
gcttccgtgaacaatgactgctact

SEQ ID NO: 576603 - DNA, 25 bp, Mus musculus
gcttccgtgaactatgactgctact

SEQ ID NO: 576604 - DNA, 25 bp, Mus musculus
gcttccgtgaatactgaatgtgact

SEQ ID NO: 576605 - DNA, 25 bp, Mus musculus
gcttccgtgaattctgaatgtgact

SEQ ID NO: 576606 - DNA, 25 bp, Mus musculus
gcttccgtggtgaaggagcttccat

SEQ ID NO: 576607 - DNA, 25 bp, Mus musculus
gcttccgtggtgtaggagcttccat

SEQ ID NO: 576608 - DNA, 25 bp, Mus musculus
gcttccgttggaactgaacaaacta

SEQ ID NO: 576609 - DNA, 25 bp, Mus musculus
gcttccgttggatctgaacaaacta

SEQ ID NO: 576610 - DNA, 25 bp, Mus musculus
gcttcctaaaccaggctgagacgtg

SEQ ID NO: 576611 - DNA, 25 bp, Mus musculus
gcttcctaaacctggctgagacgtg

SEQ ID NO: 576612 - DNA, 25 bp, Mus musculus
gcttcctaacgtctttgtgtctaaa

SEQ ID NO: 576613 - DNA, 25 bp, Mus musculus
gcttcctaacgtgtttgtgtctaaa

SEQ ID NO: 576614 - DNA, 25 bp, Mus musculus
gcttcctaacttattaaccgggcag

SEQ ID NO: 576615 - DNA, 25 bp, Mus musculus
gcttcctaacttcctatcaatattt

SEQ ID NO: 576616 - DNA, 25 bp, Mus musculus
gcttcctaacttgctatcaatattt

SEQ ID NO: 576617 - DNA, 25 bp, Mus musculus
gcttcctaactttttaaccgggcag

SEQ ID NO: 576618 - DNA, 25 bp, Mus musculus
gcttcctaagcacttgtggcatact

SEQ ID NO: 576619 - DNA, 25 bp, Mus musculus
gcttcctaagcagttgtggcatact

SEQ ID NO: 576620 - DNA, 25 bp, Mus musculus
gcttcctaaggaatctctgcttgct

SEQ ID NO: 576621 - DNA, 25 bp, Mus musculus
gcttcctaaggacttaactgctatt

SEQ ID NO: 576622 - DNA, 25 bp, Mus musculus
gcttcctaaggagttaactgctatt

SEQ ID NO: 576623 - DNA, 25 bp, Mus musculus
gcttcctaaggattctctgcttgct

SEQ ID NO: 576624 - DNA, 25 bp, Mus musculus
gcttcctaagttccctctgttttgt

SEQ ID NO: 576625 - DNA, 25 bp, Mus musculus
gcttcctaagttgcctctgttttgt

SEQ ID NO: 576626 - DNA, 25 bp, Mus musculus
gcttcctacaatctaaaaactgctt

SEQ ID NO: 576627 - DNA, 25 bp, Mus musculus
gcttcctacaatgtaaaaactgctt

SEQ ID NO: 576628 - DNA, 25 bp, Mus musculus
gcttcctacagtcttctgcagtgta

SEQ ID NO: 576629 - DNA, 25 bp, Mus musculus
gcttcctacagtgttctgcagtgta

SEQ ID NO: 576630 - DNA, 25 bp, Mus musculus
gcttcctagaatagtcatgccttcg

SEQ ID NO: 576631 - DNA, 25 bp, Mus musculus
gcttcctagaattgtcatgccttcg

SEQ ID NO: 576632 - DNA, 25 bp, Mus musculus
gcttcctagaccaggttacgtattt

SEQ ID NO: 576633 - DNA, 25 bp, Mus musculus
gcttcctagacctggttacgtattt

SEQ ID NO: 576634 - DNA, 25 bp, Mus musculus
gcttcctagcttagttctgagttta

SEQ ID NO: 576635 - DNA, 25 bp, Mus musculus
gcttcctagctttgttctgagttta

SEQ ID NO: 576636 - DNA, 25 bp, Mus musculus
gcttcctaggtaagaactagcctga

SEQ ID NO: 576637 - DNA, 25 bp, Mus musculus
gcttcctaggtatgaactagcctga

SEQ ID NO: 576638 - DNA, 25 bp, Mus musculus
gcttcctagttgctgttcacttcat

SEQ ID NO: 576639 - DNA, 25 bp, Mus musculus
gcttcctagttggtgttcacttcat

SEQ ID NO: 576640 - DNA, 25 bp, Mus musculus
gcttcctagtttacagcatgatgca

SEQ ID NO: 576641 - DNA, 25 bp, Mus musculus
gcttcctagttttcagcatgatgca

SEQ ID NO: 576642 - DNA, 25 bp, Mus musculus
gcttcctatagcagctgtgttacta

SEQ ID NO: 576643 - DNA, 25 bp, Mus musculus
gcttcctatagctgctgtgttacta

SEQ ID NO: 576644 - DNA, 25 bp, Mus musculus
gcttcctatagtatttccttcacaa

SEQ ID NO: 576645 - DNA, 25 bp, Mus musculus
gcttcctatagtttttccttcacaa

SEQ ID NO: 576646 - DNA, 25 bp, Mus musculus
gcttcctatggaccagggtgtatct

SEQ ID NO: 576647 - DNA, 25 bp, Mus musculus
gcttcctatggagcagggtgtatct

SEQ ID NO: 576648 - DNA, 25 bp, Mus musculus
gcttcctcaaaaaactttctcactg

SEQ ID NO: 576649 - DNA, 25 bp, Mus musculus
gcttcctcaaaatactttctcactg

SEQ ID NO: 576650 - DNA, 25 bp, Mus musculus
gcttcctcaagcagcctagatatag

SEQ ID NO: 576651 - DNA, 25 bp, Mus musculus
gcttcctcaagctgcctagatatag

SEQ ID NO: 576652 - DNA, 25 bp, Mus musculus
gcttcctcaccactgtaagcatgga

SEQ ID NO: 576653 - DNA, 25 bp, Mus musculus
gcttcctcaccagtgtaagcatgga

SEQ ID NO: 576654 - DNA, 25 bp, Mus musculus
gcttcctcagatcagttagaccact

SEQ ID NO: 576655 - DNA, 25 bp, Mus musculus
gcttcctcagatgagttagaccact

SEQ ID NO: 576656 - DNA, 25 bp, Mus musculus
gcttcctcagcaagaaattacctgg

SEQ ID NO: 576657 - DNA, 25 bp, Mus musculus
gcttcctcagcatgaaattacctgg

SEQ ID NO: 576658 - DNA, 25 bp, Mus musculus
gcttcctcatccattaatgtgacag

SEQ ID NO: 576659 - DNA, 25 bp, Mus musculus
gcttcctcatcctttaatgtgacag

SEQ ID NO: 576660 - DNA, 25 bp, Mus musculus
gcttcctccaacaacactagggaat

SEQ ID NO: 576661 - DNA, 25 bp, Mus musculus
gcttcctccaactacactagggaat

SEQ ID NO: 576662 - DNA, 25 bp, Mus musculus
gcttcctccaatagcttgcatagag

SEQ ID NO: 576663 - DNA, 25 bp, Mus musculus
gcttcctccaattgcttgcatagag

SEQ ID NO: 576664 - DNA, 25 bp, Mus musculus
gcttcctccaggaatcattggtggt

SEQ ID NO: 576665 - DNA, 25 bp, Mus musculus
gcttcctccaggtatcattggtggt

SEQ ID NO: 576666 - DNA, 25 bp, Mus musculus
gcttcctcgaggacctggagagaaa

SEQ ID NO: 576667 - DNA, 25 bp, Mus musculus
gcttcctcgaggtcctggagagaaa

SEQ ID NO: 576668 - DNA, 25 bp, Mus musculus
gcttcctctaagacattaaacgctt

SEQ ID NO: 576669 - DNA, 25 bp, Mus musculus
gcttcctctaagtcattaaacgctt

SEQ ID NO: 576670 - DNA, 25 bp, Mus musculus
gcttcctctcaacttcacgagaaga

SEQ ID NO: 576671 - DNA, 25 bp, Mus musculus
gcttcctctcaagttcacgagaaga

SEQ ID NO: 576672 - DNA, 25 bp, Mus musculus
gcttcctctgacacaagctgcagga

SEQ ID NO: 576673 - DNA, 25 bp, Mus musculus
gcttcctctgactcaagctgcagga

SEQ ID NO: 576674 - DNA, 25 bp, Mus musculus
gcttcctctgcgatgggtccaaaga

SEQ ID NO: 576675 - DNA, 25 bp, Mus musculus
gcttcctctgcgttgggtccaaaga

SEQ ID NO: 576676 - DNA, 25 bp, Mus musculus
gcttcctcttctattccatgctctt

SEQ ID NO: 576677 - DNA, 25 bp, Mus musculus
gcttcctcttcttttccatgctctt

SEQ ID NO: 576678 - DNA, 25 bp, Mus musculus
gcttcctgactgaagaccagatcct

SEQ ID NO: 576679 - DNA, 25 bp, Mus musculus
gcttcctgactgtagaccagatcct

SEQ ID NO: 576680 - DNA, 25 bp, Mus musculus
gcttcctgagctcatctagtgacga

SEQ ID NO: 576681 - DNA, 25 bp, Mus musculus
gcttcctgagctgatctagtgacga

SEQ ID NO: 576682 - DNA, 25 bp, Mus musculus
gcttcctgagttatcccaaggatgt

SEQ ID NO: 576683 - DNA, 25 bp, Mus musculus
gcttcctgagttctgcttagactcc

SEQ ID NO: 576684 - DNA, 25 bp, Mus musculus
gcttcctgagttgtgcttagactcc

SEQ ID NO: 576685 - DNA, 25 bp, Mus musculus
gcttcctgagttttcccaaggatgt

SEQ ID NO: 576686 - DNA, 25 bp, Mus musculus
gcttcctgccacattgcattgggat

SEQ ID NO: 576687 - DNA, 25 bp, Mus musculus
gcttcctgccactttgcattgggat

SEQ ID NO: 576688 - DNA, 25 bp, Mus musculus
gcttcctgccgtccagtagacagaa

SEQ ID NO: 576689 - DNA, 25 bp, Mus musculus
gcttcctgccgtgcagtagacagaa

SEQ ID NO: 576690 - DNA, 25 bp, Mus musculus
gcttcctgcctcatacatacaataa

SEQ ID NO: 576691 - DNA, 25 bp, Mus musculus
gcttcctgcctcttacatacaataa

SEQ ID NO: 576692 - DNA, 25 bp, Mus musculus
gcttcctgctcgaatgactaccagg

SEQ ID NO: 576693 - DNA, 25 bp, Mus musculus
gcttcctgctcgtatgactaccagg

SEQ ID NO: 576694 - DNA, 25 bp, Mus musculus
gcttcctgctgcactaggtactggg

SEQ ID NO: 576695 - DNA, 25 bp, Mus musculus
gcttcctgctgctctaggtactggg

SEQ ID NO: 576696 - DNA, 25 bp, Mus musculus
gcttcctgctgtcaaaaagactgta

SEQ ID NO: 576697 - DNA, 25 bp, Mus musculus
gcttcctgctgtcgcttcaagataa

SEQ ID NO: 576698 - DNA, 25 bp, Mus musculus
gcttcctgctgtgaaaaagactgta

SEQ ID NO: 576699 - DNA, 25 bp, Mus musculus
gcttcctgctgtggcttcaagataa

SEQ ID NO: 576700 - DNA, 25 bp, Mus musculus
gcttcctgcttgaggactgagacaa

SEQ ID NO: 576701 - DNA, 25 bp, Mus musculus
gcttcctgcttgtggactgagacaa

SEQ ID NO: 576702 - DNA, 25 bp, Mus musculus
gcttcctggaagaacgaccttgacc

SEQ ID NO: 576703 - DNA, 25 bp, Mus musculus
gcttcctggaagacactgtgtataa

SEQ ID NO: 576704 - DNA, 25 bp, Mus musculus
gcttcctggaagtacgaccttgacc

SEQ ID NO: 576705 - DNA, 25 bp, Mus musculus
gcttcctggaagtcactgtgtataa

SEQ ID NO: 576706 - DNA, 25 bp, Mus musculus
gcttcctggactcagctacagtttg

SEQ ID NO: 576707 - DNA, 25 bp, Mus musculus
gcttcctggactgagctacagtttg

SEQ ID NO: 576708 - DNA, 25 bp, Mus musculus
gcttcctggcaactatcagcaaggg

SEQ ID NO: 576709 - DNA, 25 bp, Mus musculus
gcttcctggcaagtatcagcaaggg

SEQ ID NO: 576710 - DNA, 25 bp, Mus musculus
gcttcctgggctaggagcagcagaa

SEQ ID NO: 576711 - DNA, 25 bp, Mus musculus
gcttcctgggcttggagcagcagaa

SEQ ID NO: 576712 - DNA, 25 bp, Mus musculus
gcttcctgggttcccatgaactcag

SEQ ID NO: 576713 - DNA, 25 bp, Mus musculus
gcttcctgggttgccatgaactcag

SEQ ID NO: 576714 - DNA, 25 bp, Mus musculus
gcttcctggtctacttcgatatgaa

SEQ ID NO: 576715 - DNA, 25 bp, Mus musculus
gcttcctggtctcctgtatcccttg

SEQ ID NO: 576716 - DNA, 25 bp, Mus musculus
gcttcctggtctgctgtatcccttg

SEQ ID NO: 576717 - DNA, 25 bp, Mus musculus
gcttcctggtcttcttcgatatgaa

SEQ ID NO: 576718 - DNA, 25 bp, Mus musculus
gcttcctggtgaaggtagatgccct

SEQ ID NO: 576719 - DNA, 25 bp, Mus musculus
gcttcctggtgatggtagatgccct

SEQ ID NO: 576720 - DNA, 25 bp, Mus musculus
gcttcctgtaaaacaattctgtaga

SEQ ID NO: 576721 - DNA, 25 bp, Mus musculus
gcttcctgtaaatcaattctgtaga

SEQ ID NO: 576722 - DNA, 25 bp, Mus musculus
gcttcctgtaccatgacatgcaaaa

SEQ ID NO: 576723 - DNA, 25 bp, Mus musculus
gcttcctgtaccttgacatgcaaaa

SEQ ID NO: 576724 - DNA, 25 bp, Mus musculus
gcttcctgtactcttttccgtgttt

SEQ ID NO: 576725 - DNA, 25 bp, Mus musculus
gcttcctgtactgttttccgtgttt

SEQ ID NO: 576726 - DNA, 25 bp, Mus musculus
gcttcctgtagaaaacctttggtct

SEQ ID NO: 576727 - DNA, 25 bp, Mus musculus
gcttcctgtagataacctttggtct

SEQ ID NO: 576728 - DNA, 25 bp, Mus musculus
gcttcctgtgcgctggtatcaatat

SEQ ID NO: 576729 - DNA, 25 bp, Mus musculus
gcttcctgtgcggtggtatcaatat

SEQ ID NO: 576730 - DNA, 25 bp, Mus musculus
gcttcctgtggccaattgttgagag

SEQ ID NO: 576731 - DNA, 25 bp, Mus musculus
gcttcctgtggcgaattgttgagag

SEQ ID NO: 576732 - DNA, 25 bp, Mus musculus
gcttcctgttggcttcagtgaacat

SEQ ID NO: 576733 - DNA, 25 bp, Mus musculus
gcttcctgttgggttcagtgaacat

SEQ ID NO: 576734 - DNA, 25 bp, Mus musculus
gcttccttagagaaatacgttgtca

SEQ ID NO: 576735 - DNA, 25 bp, Mus musculus
gcttccttagagtaatacgttgtca

SEQ ID NO: 576736 - DNA, 25 bp, Mus musculus
gcttccttagggatggtacacatga

SEQ ID NO: 576737 - DNA, 25 bp, Mus musculus
gcttccttagggttggtacacatga

SEQ ID NO: 576738 - DNA, 25 bp, Mus musculus
gcttccttatgtagctattgtctac

SEQ ID NO: 576739 - DNA, 25 bp, Mus musculus
gcttccttatgttgctattgtctac

SEQ ID NO: 576740 - DNA, 25 bp, Mus musculus
gcttccttcacacagagctggacta

SEQ ID NO: 576741 - DNA, 25 bp, Mus musculus
gcttccttcacagagagctggacta

SEQ ID NO: 576742 - DNA, 25 bp, Mus musculus
gcttccttccagatagaagtgctat

SEQ ID NO: 576743 - DNA, 25 bp, Mus musculus
gcttccttccagttagaagtgctat

SEQ ID NO: 576744 - DNA, 25 bp, Mus musculus
gcttccttcgtcatctagtgagatt

SEQ ID NO: 576745 - DNA, 25 bp, Mus musculus
gcttccttcgtcttctagtgagatt

SEQ ID NO: 576746 - DNA, 25 bp, Mus musculus
gcttccttctaccactgtatttttt

SEQ ID NO: 576747 - DNA, 25 bp, Mus musculus
gcttccttctacgactgtatttttt

SEQ ID NO: 576748 - DNA, 25 bp, Mus musculus
gcttccttctatattgggtacaaca

SEQ ID NO: 576749 - DNA, 25 bp, Mus musculus
gcttccttctattttgggtacaaca

SEQ ID NO: 576750 - DNA, 25 bp, Mus musculus
gcttccttctccagaaatggcattt

SEQ ID NO: 576751 - DNA, 25 bp, Mus musculus
gcttccttctcctgaaatggcattt

SEQ ID NO: 576752 - DNA, 25 bp, Mus musculus
gcttccttcttgaaagaagcccctg

SEQ ID NO: 576753 - DNA, 25 bp, Mus musculus
gcttccttcttgtaagaagcccctg

SEQ ID NO: 576754 - DNA, 25 bp, Mus musculus
gcttccttctttactgagagacagg

SEQ ID NO: 576755 - DNA, 25 bp, Mus musculus
gcttccttctttactggacattctg

SEQ ID NO: 576756 - DNA, 25 bp, Mus musculus
gcttccttcttttctgagagacagg

SEQ ID NO: 576757 - DNA, 25 bp, Mus musculus
gcttccttcttttctggacattctg

SEQ ID NO: 576758 - DNA, 25 bp, Mus musculus
gcttccttgagtctcttcatggata

SEQ ID NO: 576759 - DNA, 25 bp, Mus musculus
gcttccttgagtgtcttcatggata

SEQ ID NO: 576760 - DNA, 25 bp, Mus musculus
gcttccttgattagctgacacttgg

SEQ ID NO: 576761 - DNA, 25 bp, Mus musculus
gcttccttgatttgctgacacttgg

SEQ ID NO: 576762 - DNA, 25 bp, Mus musculus
gcttccttgcagaactggcctatga

SEQ ID NO: 576763 - DNA, 25 bp, Mus musculus
gcttccttgcagtactggcctatga

SEQ ID NO: 576764 - DNA, 25 bp, Mus musculus
gcttccttggagctgattaaaccct

SEQ ID NO: 576765 - DNA, 25 bp, Mus musculus
gcttccttggaggtgattaaaccct

SEQ ID NO: 576766 - DNA, 25 bp, Mus musculus
gcttccttgtagctgattccacagt

SEQ ID NO: 576767 - DNA, 25 bp, Mus musculus
gcttccttgtaggtgattccacagt

SEQ ID NO: 576768 - DNA, 25 bp, Mus musculus
gcttccttgtgtactaacgagctat

SEQ ID NO: 576769 - DNA, 25 bp, Mus musculus
gcttccttgtgttctaacgagctat

SEQ ID NO: 576770 - DNA, 25 bp, Mus musculus
gcttccttgttccaaagctgcaggt

SEQ ID NO: 576771 - DNA, 25 bp, Mus musculus
gcttccttgttcgaaagctgcaggt

SEQ ID NO: 576772 - DNA, 25 bp, Mus musculus
gcttcctttcttaatagctctaggg

SEQ ID NO: 576773 - DNA, 25 bp, Mus musculus
gcttcctttctttatagctctaggg

SEQ ID NO: 576774 - DNA, 25 bp, Mus musculus
gcttcctttgcgattgagttcccaa

SEQ ID NO: 576775 - DNA, 25 bp, Mus musculus
gcttcctttgcgtttgagttcccaa

SEQ ID NO: 576776 - DNA, 25 bp, Mus musculus
gcttcctttggacggttggagccat

SEQ ID NO: 576777 - DNA, 25 bp, Mus musculus
gcttcctttggagggttggagccat

SEQ ID NO: 576778 - DNA, 25 bp, Mus musculus
gcttcctttgttagaattacttaag

SEQ ID NO: 576779 - DNA, 25 bp, Mus musculus
gcttcctttgttctatagttatctg

SEQ ID NO: 576780 - DNA, 25 bp, Mus musculus
gcttcctttgttgtatagttatctg

SEQ ID NO: 576781 - DNA, 25 bp, Mus musculus
gcttcctttgtttgaattacttaag

SEQ ID NO: 576782 - DNA, 25 bp, Mus musculus
gcttccttttccatgtcaacgtgaa

SEQ ID NO: 576783 - DNA, 25 bp, Mus musculus
gcttccttttccttgtcaacgtgaa

SEQ ID NO: 576784 - DNA, 25 bp, Mus musculus
gcttccttttgtaggccaaggaaag

SEQ ID NO: 576785 - DNA, 25 bp, Mus musculus
gcttccttttgtcttcagtgtcctc

SEQ ID NO: 576786 - DNA, 25 bp, Mus musculus
gcttccttttgtgttcagtgtcctc

SEQ ID NO: 576787 - DNA, 25 bp, Mus musculus
gcttccttttgttggccaaggaaag

SEQ ID NO: 576788 - DNA, 25 bp, Mus musculus
gcttcgaaaccgctactgactgaaa

SEQ ID NO: 576789 - DNA, 25 bp, Mus musculus
gcttcgaaaccggtactgactgaaa

SEQ ID NO: 576790 - DNA, 25 bp, Mus musculus
gcttcgaaaggcctgcatgcagaaa

SEQ ID NO: 576791 - DNA, 25 bp, Mus musculus
gcttcgaaaggcgtgcatgcagaaa

SEQ ID NO: 576792 - DNA, 25 bp, Mus musculus
gcttcgaacacgcacagccaaataa

SEQ ID NO: 576793 - DNA, 25 bp, Mus musculus
gcttcgaacacggacagccaaataa

SEQ ID NO: 576794 - DNA, 25 bp, Mus musculus
gcttcgaacgtgactgttggccttt

SEQ ID NO: 576795 - DNA, 25 bp, Mus musculus
gcttcgaacgtgtctgttggccttt

SEQ ID NO: 576796 - DNA, 25 bp, Mus musculus
gcttcgacatcaacgggacacttta

SEQ ID NO: 576797 - DNA, 25 bp, Mus musculus
gcttcgacatcatcgggacacttta

SEQ ID NO: 576798 - DNA, 25 bp, Mus musculus
gcttcgaccagaactgttgctcaga

SEQ ID NO: 576799 - DNA, 25 bp, Mus musculus
gcttcgaccagatctgttgctcaga

SEQ ID NO: 576800 - DNA, 25 bp, Mus musculus
gcttcgagctgtaatgttttgccat

SEQ ID NO: 576801 - DNA, 25 bp, Mus musculus
gcttcgagctgttatgttttgccat

SEQ ID NO: 576802 - DNA, 25 bp, Mus musculus
gcttcgagggagacaggctatcatg

SEQ ID NO: 576803 - DNA, 25 bp, Mus musculus
gcttcgagggagtcaggctatcatg

SEQ ID NO: 576804 - DNA, 25 bp, Mus musculus
gcttcgagggcacctgttgcctgca

SEQ ID NO: 576805 - DNA, 25 bp, Mus musculus
gcttcgagggcagctgttgcctgca

SEQ ID NO: 576806 - DNA, 25 bp, Mus musculus
gcttcgatgcaacaaaggcacttaa

SEQ ID NO: 576807 - DNA, 25 bp, Mus musculus
gcttcgatgcaagaaaggcacttaa

SEQ ID NO: 576808 - DNA, 25 bp, Mus musculus
gcttcgccacaaaccatgcagaaat

SEQ ID NO: 576809 - DNA, 25 bp, Mus musculus
gcttcgccacaatccatgcagaaat

SEQ ID NO: 576810 - DNA, 25 bp, Mus musculus
gcttcgccgtttaccagcatggtga

SEQ ID NO: 576811 - DNA, 25 bp, Mus musculus
gcttcgccgttttccagcatggtga

SEQ ID NO: 576812 - DNA, 25 bp, Mus musculus
gcttcgcctagaattggcagaaatg

SEQ ID NO: 576813 - DNA, 25 bp, Mus musculus
gcttcgcctagatttggcagaaatg

SEQ ID NO: 576814 - DNA, 25 bp, Mus musculus
gcttcgccttcacttaaactgatgt

SEQ ID NO: 576815 - DNA, 25 bp, Mus musculus
gcttcgccttcagttaaactgatgt

SEQ ID NO: 576816 - DNA, 25 bp, Mus musculus
gcttcgctggctatggctcattggg

SEQ ID NO: 576817 - DNA, 25 bp, Mus musculus
gcttcgctggctttggctcattggg

SEQ ID NO: 576818 - DNA, 25 bp, Mus musculus
gcttcggaagttcctgttgtacctg

SEQ ID NO: 576819 - DNA, 25 bp, Mus musculus
gcttcggaagttgctgttgtacctg

SEQ ID NO: 576820 - DNA, 25 bp, Mus musculus
gcttcggaggccagcaggcgctcaa

SEQ ID NO: 576821 - DNA, 25 bp, Mus musculus
gcttcggaggcctgcaggcgctcaa

SEQ ID NO: 576822 - DNA, 25 bp, Mus musculus
gcttcggccggacattagttctaac

SEQ ID NO: 576823 - DNA, 25 bp, Mus musculus
gcttcggccggagattagttctaac

SEQ ID NO: 576824 - DNA, 25 bp, Mus musculus
gcttcggctcggattttggcggcac

SEQ ID NO: 576825 - DNA, 25 bp, Mus musculus
gcttcggctcggtttttggcggcac

SEQ ID NO: 576826 - DNA, 25 bp, Mus musculus
gcttcgggacatccagcatgccatt

SEQ ID NO: 576827 - DNA, 25 bp, Mus musculus
gcttcgggacatgcagcatgccatt

SEQ ID NO: 576828 - DNA, 25 bp, Mus musculus
gcttcgggatgtagtcttgcattgt

SEQ ID NO: 576829 - DNA, 25 bp, Mus musculus
gcttcgggatgtattcattgtactc

SEQ ID NO: 576830 - DNA, 25 bp, Mus musculus
gcttcgggatgttgtcttgcattgt

SEQ ID NO: 576831 - DNA, 25 bp, Mus musculus
gcttcgggatgttttcattgtactc

SEQ ID NO: 576832 - DNA, 25 bp, Mus musculus
gcttcgggccaaagttcagaatggg

SEQ ID NO: 576833 - DNA, 25 bp, Mus musculus
gcttcgggccaatgttcagaatggg

SEQ ID NO: 576834 - DNA, 25 bp, Mus musculus
gcttcggtatgtcatggaacttcct

SEQ ID NO: 576835 - DNA, 25 bp, Mus musculus
gcttcggtatgtgatggaacttcct

SEQ ID NO: 576836 - DNA, 25 bp, Mus musculus
gcttcggtctgtaaaacaatttcct

SEQ ID NO: 576837 - DNA, 25 bp, Mus musculus
gcttcggtctgttaaacaatttcct

SEQ ID NO: 576838 - DNA, 25 bp, Mus musculus
gcttcggtgaccactcaggaggaac

SEQ ID NO: 576839 - DNA, 25 bp, Mus musculus
gcttcggtgacctctcaggaggaac

SEQ ID NO: 576840 - DNA, 25 bp, Mus musculus
gcttcggtgactcttgctgtgcatc

SEQ ID NO: 576841 - DNA, 25 bp, Mus musculus
gcttcggtgactgttgctgtgcatc

SEQ ID NO: 576842 - DNA, 25 bp, Mus musculus
gcttcggtggctattcatacacagt

SEQ ID NO: 576843 - DNA, 25 bp, Mus musculus
gcttcggtggcttttcatacacagt

SEQ ID NO: 576844 - DNA, 25 bp, Mus musculus
gcttcggttcctcgtcgcagagaaa

SEQ ID NO: 576845 - DNA, 25 bp, Mus musculus
gcttcggttcctggtcgcagagaaa

SEQ ID NO: 576846 - DNA, 25 bp, Mus musculus
gcttcggttgctctctaaccagtat

SEQ ID NO: 576847 - DNA, 25 bp, Mus musculus
gcttcggttgctgtctaaccagtat

SEQ ID NO: 576848 - DNA, 25 bp, Mus musculus
gcttcggttttccactcgaagatta

SEQ ID NO: 576849 - DNA, 25 bp, Mus musculus
gcttcggttttcgactcgaagatta

SEQ ID NO: 576850 - DNA, 25 bp, Mus musculus
gcttcgtatgaaatgtactatctga

SEQ ID NO: 576851 - DNA, 25 bp, Mus musculus
gcttcgtatgaattgtactatctga

SEQ ID NO: 576852 - DNA, 25 bp, Mus musculus
gcttcgtcagagcattccctaagag

SEQ ID NO: 576853 - DNA, 25 bp, Mus musculus
gcttcgtcagaggattccctaagag

SEQ ID NO: 576854 - DNA, 25 bp, Mus musculus
gcttcgtcatagactcaagctgtct

SEQ ID NO: 576855 - DNA, 25 bp, Mus musculus
gcttcgtcatagtctcaagctgtct

SEQ ID NO: 576856 - DNA, 25 bp, Mus musculus
gcttcgtcatggaacccttcgaata

SEQ ID NO: 576857 - DNA, 25 bp, Mus musculus
gcttcgtcatggtacccttcgaata

SEQ ID NO: 576858 - DNA, 25 bp, Mus musculus
gcttcgtcctagatacatctccagg

SEQ ID NO: 576859 - DNA, 25 bp, Mus musculus
gcttcgtcctagttacatctccagg

SEQ ID NO: 576860 - DNA, 25 bp, Mus musculus
gcttcgtctgtgatctcctgagttt

SEQ ID NO: 576861 - DNA, 25 bp, Mus musculus
gcttcgtctgtgttctcctgagttt

SEQ ID NO: 576862 - DNA, 25 bp, Mus musculus
gcttcgtcttgaagacactgcctaa

SEQ ID NO: 576863 - DNA, 25 bp, Mus musculus
gcttcgtcttgatgacactgcctaa

SEQ ID NO: 576864 - DNA, 25 bp, Mus musculus
gcttcgtgagctcacggttcatata

SEQ ID NO: 576865 - DNA, 25 bp, Mus musculus
gcttcgtgagctgacggttcatata

SEQ ID NO: 576866 - DNA, 25 bp, Mus musculus
gcttcgtgcactatgatgaaccaga

SEQ ID NO: 576867 - DNA, 25 bp, Mus musculus
gcttcgtgcactttgatgaaccaga

SEQ ID NO: 576868 - DNA, 25 bp, Mus musculus
gcttcgtgctgccaaagctctacgt

SEQ ID NO: 576869 - DNA, 25 bp, Mus musculus
gcttcgtgctgcgaaagctctacgt

SEQ ID NO: 576870 - DNA, 25 bp, Mus musculus
gcttcgtgctgtaggttttagcctg

SEQ ID NO: 576871 - DNA, 25 bp, Mus musculus
gcttcgtgctgttggttttagcctg

SEQ ID NO: 576872 - DNA, 25 bp, Mus musculus
gcttcgtgtgccagttggaccatta

SEQ ID NO: 576873 - DNA, 25 bp, Mus musculus
gcttcgtgtgcctgttggaccatta

SEQ ID NO: 576874 - DNA, 25 bp, Mus musculus
gcttcgtgttcaacagcatgatcct

SEQ ID NO: 576875 - DNA, 25 bp, Mus musculus
gcttcgtgttcatcagcatgatcct

SEQ ID NO: 576876 - DNA, 25 bp, Mus musculus
gcttcgtgtttcagtacccagtata

SEQ ID NO: 576877 - DNA, 25 bp, Mus musculus
gcttcgtgtttctgtacccagtata

SEQ ID NO: 576878 - DNA, 25 bp, Mus musculus
gcttcgttagatactggattcacat

SEQ ID NO: 576879 - DNA, 25 bp, Mus musculus
gcttcgttagattctggattcacat

SEQ ID NO: 576880 - DNA, 25 bp, Mus musculus
gcttcgttctgacgagttttgctct

SEQ ID NO: 576881 - DNA, 25 bp, Mus musculus
gcttcgttctgaggagttttgctct

SEQ ID NO: 576882 - DNA, 25 bp, Mus musculus
gcttctaaaaatcactgggtagggt

SEQ ID NO: 576883 - DNA, 25 bp, Mus musculus
gcttctaaaaatgactgggtagggt

SEQ ID NO: 576884 - DNA, 25 bp, Mus musculus
gcttctaaaacaatgccgtcaaatt

SEQ ID NO: 576885 - DNA, 25 bp, Mus musculus
gcttctaaaacattgccgtcaaatt

SEQ ID NO: 576886 - DNA, 25 bp, Mus musculus
gcttctaaaactctttctatacgtg

SEQ ID NO: 576887 - DNA, 25 bp, Mus musculus
gcttctaaaactgtttctatacgtg

SEQ ID NO: 576888 - DNA, 25 bp, Mus musculus
gcttctaaagatcctcagtcttgat

SEQ ID NO: 576889 - DNA, 25 bp, Mus musculus
gcttctaaagatgctcagtcttgat

SEQ ID NO: 576890 - DNA, 25 bp, Mus musculus
gcttctaactgtagtttgtaaaacg

SEQ ID NO: 576891 - DNA, 25 bp, Mus musculus
gcttctaactgttgtttgtaaaacg

SEQ ID NO: 576892 - DNA, 25 bp, Mus musculus
gcttctaacttcactgtgtgtaggc

SEQ ID NO: 576893 - DNA, 25 bp, Mus musculus
gcttctaacttctctgtgtgtaggc

SEQ ID NO: 576894 - DNA, 25 bp, Mus musculus
gcttctaagcacaagtccctacaag

SEQ ID NO: 576895 - DNA, 25 bp, Mus musculus
gcttctaagcactagtccctacaag

SEQ ID NO: 576896 - DNA, 25 bp, Mus musculus
gcttctaaggtgacagtcttactgt

SEQ ID NO: 576897 - DNA, 25 bp, Mus musculus
gcttctaaggtgtcagtcttactgt

SEQ ID NO: 576898 - DNA, 25 bp, Mus musculus
gcttctaagtccctacgtaatgagt

SEQ ID NO: 576899 - DNA, 25 bp, Mus musculus
gcttctaagtccgtacgtaatgagt

SEQ ID NO: 576900 - DNA, 25 bp, Mus musculus
gcttctaagttgaatcagtttcctt

SEQ ID NO: 576901 - DNA, 25 bp, Mus musculus
gcttctaagttgtatcagtttcctt

SEQ ID NO: 576902 - DNA, 25 bp, Mus musculus
gcttctaatactagtgggaaacctc

SEQ ID NO: 576903 - DNA, 25 bp, Mus musculus
gcttctaatacttgtgggaaacctc

SEQ ID NO: 576904 - DNA, 25 bp, Mus musculus
gcttctaatagtctgagtccttcca

SEQ ID NO: 576905 - DNA, 25 bp, Mus musculus
gcttctaatagtgtgagtccttcca

SEQ ID NO: 576906 - DNA, 25 bp, Mus musculus
gcttctaattcaagtacctgcacat

SEQ ID NO: 576907 - DNA, 25 bp, Mus musculus
gcttctaattcatgtacctgcacat

SEQ ID NO: 576908 - DNA, 25 bp, Mus musculus
gcttctacactcactggtactattt

SEQ ID NO: 576909 - DNA, 25 bp, Mus musculus
gcttctacactctctggtactattt

SEQ ID NO: 576910 - DNA, 25 bp, Mus musculus
gcttctaccccacacaaactagaat

SEQ ID NO: 576911 - DNA, 25 bp, Mus musculus
gcttctaccccagacaaactagaat

SEQ ID NO: 576912 - DNA, 25 bp, Mus musculus
gcttctacgtgacatgttggctttc

SEQ ID NO: 576913 - DNA, 25 bp, Mus musculus
gcttctacgtgagatgttggctttc

SEQ ID NO: 576914 - DNA, 25 bp, Mus musculus
gcttctactggaagtggagctcagg

SEQ ID NO: 576915 - DNA, 25 bp, Mus musculus
gcttctactggatgtggagctcagg

SEQ ID NO: 576916 - DNA, 25 bp, Mus musculus
gcttctactggcacttgtatgcata

SEQ ID NO: 576917 - DNA, 25 bp, Mus musculus
gcttctactggctcttgtatgcata

SEQ ID NO: 576918 - DNA, 25 bp, Mus musculus
gcttctacttctaagtctgagtcca

SEQ ID NO: 576919 - DNA, 25 bp, Mus musculus
gcttctacttcttagtctgagtcca

SEQ ID NO: 576920 - DNA, 25 bp, Mus musculus
gcttctagaagcataggtgctgcat

SEQ ID NO: 576921 - DNA, 25 bp, Mus musculus
gcttctagaagcttaggtgctgcat

SEQ ID NO: 576922 - DNA, 25 bp, Mus musculus
gcttctagaattatccaccttgcct

SEQ ID NO: 576923 - DNA, 25 bp, Mus musculus
gcttctagaattttccaccttgcct

SEQ ID NO: 576924 - DNA, 25 bp, Mus musculus
gcttctagagacagcccagtatgca

SEQ ID NO: 576925 - DNA, 25 bp, Mus musculus
gcttctagagactgcccagtatgca

SEQ ID NO: 576926 - DNA, 25 bp, Mus musculus
gcttctagagatacaggttgccgtg

SEQ ID NO: 576927 - DNA, 25 bp, Mus musculus
gcttctagagattcaggttgccgtg

SEQ ID NO: 576928 - DNA, 25 bp, Mus musculus
gcttctagcacccagactctgggaa

SEQ ID NO: 576929 - DNA, 25 bp, Mus musculus
gcttctagcaccgagactctgggaa

SEQ ID NO: 576930 - DNA, 25 bp, Mus musculus
gcttctagcagtctgagcacaacag

SEQ ID NO: 576931 - DNA, 25 bp, Mus musculus
gcttctagcagtgtgagcacaacag

SEQ ID NO: 576932 - DNA, 25 bp, Mus musculus
gcttctagcctcagtgaaatctagg

SEQ ID NO: 576933 - DNA, 25 bp, Mus musculus
gcttctagcctctgtgaaatctagg

SEQ ID NO: 576934 - DNA, 25 bp, Mus musculus
gcttctagctccagatattcgacat

SEQ ID NO: 576935 - DNA, 25 bp, Mus musculus
gcttctagctcctgatattcgacat

SEQ ID NO: 576936 - DNA, 25 bp, Mus musculus
gcttctaggcagcaacggtactctt

SEQ ID NO: 576937 - DNA, 25 bp, Mus musculus
gcttctaggcaggaacggtactctt

SEQ ID NO: 576938 - DNA, 25 bp, Mus musculus
gcttctaggcccactattagtaaaa

SEQ ID NO: 576939 - DNA, 25 bp, Mus musculus
gcttctaggccctctattagtaaaa

SEQ ID NO: 576940 - DNA, 25 bp, Mus musculus
gcttctagtagcacaggtatccttt

SEQ ID NO: 576941 - DNA, 25 bp, Mus musculus
gcttctagtagctcaggtatccttt

SEQ ID NO: 576942 - DNA, 25 bp, Mus musculus
gcttctagtgagcttgtgatctgtg

SEQ ID NO: 576943 - DNA, 25 bp, Mus musculus
gcttctagtgaggttgtgatctgtg

SEQ ID NO: 576944 - DNA, 25 bp, Mus musculus
gcttctagttcactgcaggagggaa

SEQ ID NO: 576945 - DNA, 25 bp, Mus musculus
gcttctagttcagtgcaggagggaa

SEQ ID NO: 576946 - DNA, 25 bp, Mus musculus
gcttctagttctaggcacataaaca

SEQ ID NO: 576947 - DNA, 25 bp, Mus musculus
gcttctagttcttggcacataaaca

SEQ ID NO: 576948 - DNA, 25 bp, Mus musculus
gcttctataacaaccacgcattcaa

SEQ ID NO: 576949 - DNA, 25 bp, Mus musculus
gcttctataacatccacgcattcaa

SEQ ID NO: 576950 - DNA, 25 bp, Mus musculus
gcttctatataacagtctcttccct

SEQ ID NO: 576951 - DNA, 25 bp, Mus musculus
gcttctatataagagtctcttccct

SEQ ID NO: 576952 - DNA, 25 bp, Mus musculus
gcttctatatgaactccctttgttc

SEQ ID NO: 576953 - DNA, 25 bp, Mus musculus
gcttctatatgatctccctttgttc

SEQ ID NO: 576954 - DNA, 25 bp, Mus musculus
gcttctatcagactgactccacaga

SEQ ID NO: 576955 - DNA, 25 bp, Mus musculus
gcttctatcagagtgactccacaga

SEQ ID NO: 576956 - DNA, 25 bp, Mus musculus
gcttctatctaaaacctggtcacag

SEQ ID NO: 576957 - DNA, 25 bp, Mus musculus
gcttctatctaatacctggtcacag

SEQ ID NO: 576958 - DNA, 25 bp, Mus musculus
gcttctatgaagcacactggatatt

SEQ ID NO: 576959 - DNA, 25 bp, Mus musculus
gcttctatgaaggacactggatatt

SEQ ID NO: 576960 - DNA, 25 bp, Mus musculus
gcttctatgggacttgtactagtac

SEQ ID NO: 576961 - DNA, 25 bp, Mus musculus
gcttctatgggagttgtactagtac

SEQ ID NO: 576962 - DNA, 25 bp, Mus musculus
gcttctcaaagtctccatcattctg

SEQ ID NO: 576963 - DNA, 25 bp, Mus musculus
gcttctcaaagtgtccatcattctg

SEQ ID NO: 576964 - DNA, 25 bp, Mus musculus
gcttctcaagaccttatgggctgag

SEQ ID NO: 576965 - DNA, 25 bp, Mus musculus
gcttctcaagacgttatgggctgag

SEQ ID NO: 576966 - DNA, 25 bp, Mus musculus
gcttctcaagtgcagcctctgagga

SEQ ID NO: 576967 - DNA, 25 bp, Mus musculus
gcttctcaagtggagcctctgagga

SEQ ID NO: 576968 - DNA, 25 bp, Mus musculus
gcttctcaatgcctcgtgatggtat

SEQ ID NO: 576969 - DNA, 25 bp, Mus musculus
gcttctcaatgcgtcgtgatggtat

SEQ ID NO: 576970 - DNA, 25 bp, Mus musculus
gcttctcacagaactacctcaaaat

SEQ ID NO: 576971 - DNA, 25 bp, Mus musculus
gcttctcacagatctacctcaaaat

SEQ ID NO: 576972 - DNA, 25 bp, Mus musculus
gcttctcacctgagtttattgtgca

SEQ ID NO: 576973 - DNA, 25 bp, Mus musculus
gcttctcacctgtgtttattgtgca

SEQ ID NO: 576974 - DNA, 25 bp, Mus musculus
gcttctcactagcttggcggtacat

SEQ ID NO: 576975 - DNA, 25 bp, Mus musculus
gcttctcactaggttggcggtacat

SEQ ID NO: 576976 - DNA, 25 bp, Mus musculus
gcttctcactcactaaatgttgcag

SEQ ID NO: 576977 - DNA, 25 bp, Mus musculus
gcttctcactcagtaaatgttgcag

SEQ ID NO: 576978 - DNA, 25 bp, Mus musculus
gcttctcagcagattgcagcctgaa

SEQ ID NO: 576979 - DNA, 25 bp, Mus musculus
gcttctcagcagtttgcagcctgaa

SEQ ID NO: 576980 - DNA, 25 bp, Mus musculus
gcttctcagccaatggaacttccag

SEQ ID NO: 576981 - DNA, 25 bp, Mus musculus
gcttctcagccattggaacttccag

SEQ ID NO: 576982 - DNA, 25 bp, Mus musculus
gcttctcaggagctccagctatgat

SEQ ID NO: 576983 - DNA, 25 bp, Mus musculus
gcttctcaggaggtccagctatgat

SEQ ID NO: 576984 - DNA, 25 bp, Mus musculus
gcttctcaggccctagagagatagc

SEQ ID NO: 576985 - DNA, 25 bp, Mus musculus
gcttctcaggccgtagagagatagc

SEQ ID NO: 576986 - DNA, 25 bp, Mus musculus
gcttctcagggccatatcttaataa

SEQ ID NO: 576987 - DNA, 25 bp, Mus musculus
gcttctcagggcgatatcttaataa

SEQ ID NO: 576988 - DNA, 25 bp, Mus musculus
gcttctcagtgccagatgatatggg

SEQ ID NO: 576989 - DNA, 25 bp, Mus musculus
gcttctcagtgcgagatgatatggg

SEQ ID NO: 576990 - DNA, 25 bp, Mus musculus
gcttctcatcaccacttcgtgataa

SEQ ID NO: 576991 - DNA, 25 bp, Mus musculus
gcttctcatcacgacttcgtgataa

SEQ ID NO: 576992 - DNA, 25 bp, Mus musculus
gcttctcatgggatcgtgacatcat

SEQ ID NO: 576993 - DNA, 25 bp, Mus musculus
gcttctcatgggttcgtgacatcat

SEQ ID NO: 576994 - DNA, 25 bp, Mus musculus
gcttctccaataaactccttgcaga

SEQ ID NO: 576995 - DNA, 25 bp, Mus musculus
gcttctccaatatactccttgcaga

SEQ ID NO: 576996 - DNA, 25 bp, Mus musculus
gcttctccaatgatccggcaggcaa

SEQ ID NO: 576997 - DNA, 25 bp, Mus musculus
gcttctccaatgttccggcaggcaa

SEQ ID NO: 576998 - DNA, 25 bp, Mus musculus
gcttctccacgcactggggaaggga

SEQ ID NO: 576999 - DNA, 25 bp, Mus musculus
gcttctccacgctctggggaaggga

SEQ ID NO: 577000 - DNA, 25 bp, Mus musculus
gcttctccagctcctaggtatgaga

SEQ ID NO: 577001 - DNA, 25 bp, Mus musculus
gcttctccagctgctaggtatgaga

SEQ ID NO: 577002 - DNA, 25 bp, Mus musculus
gcttctccatcccaggctatgtaaa

SEQ ID NO: 577003 - DNA, 25 bp, Mus musculus
gcttctccatccgaggctatgtaaa

SEQ ID NO: 577004 - DNA, 25 bp, Mus musculus
gcttctccatctacaatgcgtttac

SEQ ID NO: 577005 - DNA, 25 bp, Mus musculus
gcttctccatctcgaaagacaactg

SEQ ID NO: 577006 - DNA, 25 bp, Mus musculus
gcttctccatctggaaagacaactg

SEQ ID NO: 577007 - DNA, 25 bp, Mus musculus
gcttctccatcttcaatgcgtttac

SEQ ID NO: 577008 - DNA, 25 bp, Mus musculus
gcttctcccaagctacttgtaggca

SEQ ID NO: 577009 - DNA, 25 bp, Mus musculus
gcttctcccaaggtacttgtaggca

SEQ ID NO: 577010 - DNA, 25 bp, Mus musculus
gcttctcccatcagctcatctgatt

SEQ ID NO: 577011 - DNA, 25 bp, Mus musculus
gcttctcccatctgctcatctgatt

SEQ ID NO: 577012 - DNA, 25 bp, Mus musculus
gcttctcccctcaaccagaaaagga

SEQ ID NO: 577013 - DNA, 25 bp, Mus musculus
gcttctcccctctaccagaaaagga

SEQ ID NO: 577014 - DNA, 25 bp, Mus musculus
gcttctccccttacgtaaggcagtt

SEQ ID NO: 577015 - DNA, 25 bp, Mus musculus
gcttctcccctttcgtaaggcagtt

SEQ ID NO: 577016 - DNA, 25 bp, Mus musculus
gcttctccctaactatgccatttaa

SEQ ID NO: 577017 - DNA, 25 bp, Mus musculus
gcttctccctaagtatgccatttaa

SEQ ID NO: 577018 - DNA, 25 bp, Mus musculus
gcttctccgccaagtgggactatga

SEQ ID NO: 577019 - DNA, 25 bp, Mus musculus
gcttctccgccatgtgggactatga

SEQ ID NO: 577020 - DNA, 25 bp, Mus musculus
gcttctccgctcactgaaaggatgg

SEQ ID NO: 577021 - DNA, 25 bp, Mus musculus
gcttctccgctctctgaaaggatgg

SEQ ID NO: 577022 - DNA, 25 bp, Mus musculus
gcttctccttcccttaaggattact

SEQ ID NO: 577023 - DNA, 25 bp, Mus musculus
gcttctccttccgttaaggattact

SEQ ID NO: 577024 - DNA, 25 bp, Mus musculus
gcttctcgacgaaggcagacagctt

SEQ ID NO: 577025 - DNA, 25 bp, Mus musculus
gcttctcgacgatggcagacagctt

SEQ ID NO: 577026 - DNA, 25 bp, Mus musculus
gcttctcgcctgacatttgaataaa

SEQ ID NO: 577027 - DNA, 25 bp, Mus musculus
gcttctcgcctgtcatttgaataaa

SEQ ID NO: 577028 - DNA, 25 bp, Mus musculus
gcttctcgcgagcattccaggaaat

SEQ ID NO: 577029 - DNA, 25 bp, Mus musculus
gcttctcgcgaggattccaggaaat

SEQ ID NO: 577030 - DNA, 25 bp, Mus musculus
gcttctcgtcagaaatgaaaccaga

SEQ ID NO: 577031 - DNA, 25 bp, Mus musculus
gcttctcgtcagtaatgaaaccaga

SEQ ID NO: 577032 - DNA, 25 bp, Mus musculus
gcttctcgtggccatgtgatcccac

SEQ ID NO: 577033 - DNA, 25 bp, Mus musculus
gcttctcgtggcgatgtgatcccac

SEQ ID NO: 577034 - DNA, 25 bp, Mus musculus
gcttctctaacgcatgaggcaaatc

SEQ ID NO: 577035 - DNA, 25 bp, Mus musculus
gcttctctaacggatgaggcaaatc

SEQ ID NO: 577036 - DNA, 25 bp, Mus musculus
gcttctctaagactcctgggagcct

SEQ ID NO: 577037 - DNA, 25 bp, Mus musculus
gcttctctaagagtcctgggagcct

SEQ ID NO: 577038 - DNA, 25 bp, Mus musculus
gcttctctaagcagtctggactcag

SEQ ID NO: 577039 - DNA, 25 bp, Mus musculus
gcttctctaagctgtctggactcag

SEQ ID NO: 577040 - DNA, 25 bp, Mus musculus
gcttctctagctctgctaagttcag

SEQ ID NO: 577041 - DNA, 25 bp, Mus musculus
gcttctctagctgtgctaagttcag

SEQ ID NO: 577042 - DNA, 25 bp, Mus musculus
gcttctctagttctgaacacctgta

SEQ ID NO: 577043 - DNA, 25 bp, Mus musculus
gcttctctagttgtgaacacctgta

SEQ ID NO: 577044 - DNA, 25 bp, Mus musculus
gcttctctatgcactgtcattaaca

SEQ ID NO: 577045 - DNA, 25 bp, Mus musculus
gcttctctatgctctgtcattaaca

SEQ ID NO: 577046 - DNA, 25 bp, Mus musculus
gcttctctcaggaatcttcttgttg

SEQ ID NO: 577047 - DNA, 25 bp, Mus musculus
gcttctctcaggtatcttcttgttg

SEQ ID NO: 577048 - DNA, 25 bp, Mus musculus
gcttctctcctgacctagagagtga

SEQ ID NO: 577049 - DNA, 25 bp, Mus musculus
gcttctctcctgtcctagagagtga

SEQ ID NO: 577050 - DNA, 25 bp, Mus musculus
gcttctctctgcaggttaatatccg

SEQ ID NO: 577051 - DNA, 25 bp, Mus musculus
gcttctctctgctggttaatatccg

SEQ ID NO: 577052 - DNA, 25 bp, Mus musculus
gcttctctctgtctgcagattttgc

SEQ ID NO: 577053 - DNA, 25 bp, Mus musculus
gcttctctctgtgtgcagattttgc

SEQ ID NO: 577054 - DNA, 25 bp, Mus musculus
gcttctctctttaatttatgcctga

SEQ ID NO: 577055 - DNA, 25 bp, Mus musculus
gcttctctcttttatttatgcctga

SEQ ID NO: 577056 - DNA, 25 bp, Mus musculus
gcttctctgactctggtctagaaaa

SEQ ID NO: 577057 - DNA, 25 bp, Mus musculus
gcttctctgactgtggtctagaaaa

SEQ ID NO: 577058 - DNA, 25 bp, Mus musculus
gcttctctgaggctgaaactgactg

SEQ ID NO: 577059 - DNA, 25 bp, Mus musculus
gcttctctgagggtgaaactgactg

SEQ ID NO: 577060 - DNA, 25 bp, Mus musculus
gcttctctgcaaatttctggtacca

SEQ ID NO: 577061 - DNA, 25 bp, Mus musculus
gcttctctgcaattttctggtacca

SEQ ID NO: 577062 - DNA, 25 bp, Mus musculus
gcttctctgcagaaaacacatttgg

SEQ ID NO: 577063 - DNA, 25 bp, Mus musculus
gcttctctgcagacagatctcggaa

SEQ ID NO: 577064 - DNA, 25 bp, Mus musculus
gcttctctgcagcttgctagatgat

SEQ ID NO: 577065 - DNA, 25 bp, Mus musculus
gcttctctgcaggttgctagatgat

SEQ ID NO: 577066 - DNA, 25 bp, Mus musculus
gcttctctgcagtaaacacatttgg

SEQ ID NO: 577067 - DNA, 25 bp, Mus musculus
gcttctctgcagtcagatctcggaa

SEQ ID NO: 577068 - DNA, 25 bp, Mus musculus
gcttctctgcatcttgttttaccga

SEQ ID NO: 577069 - DNA, 25 bp, Mus musculus
gcttctctgcatgttgttttaccga

SEQ ID NO: 577070 - DNA, 25 bp, Mus musculus
gcttctctgccaccgagcagaagag

SEQ ID NO: 577071 - DNA, 25 bp, Mus musculus
gcttctctgccagcgagcagaagag

SEQ ID NO: 577072 - DNA, 25 bp, Mus musculus
gcttctctgcgcattgtcagattta

SEQ ID NO: 577073 - DNA, 25 bp, Mus musculus
gcttctctgcgctttgtcagattta

SEQ ID NO: 577074 - DNA, 25 bp, Mus musculus
gcttctctggtaatcctttcattat

SEQ ID NO: 577075 - DNA, 25 bp, Mus musculus
gcttctctggtattcctttcattat

SEQ ID NO: 577076 - DNA, 25 bp, Mus musculus
gcttctctgtgcatttagctgggaa

SEQ ID NO: 577077 - DNA, 25 bp, Mus musculus
gcttctctgtgcttttagctgggaa

SEQ ID NO: 577078 - DNA, 25 bp, Mus musculus
gcttctctgtggcatcccatttttc

SEQ ID NO: 577079 - DNA, 25 bp, Mus musculus
gcttctctgtgggatcccatttttc

SEQ ID NO: 577080 - DNA, 25 bp, Mus musculus
gcttctctgttgactcgtgtaaagt

SEQ ID NO: 577081 - DNA, 25 bp, Mus musculus
gcttctctgttgtctcgtgtaaagt

SEQ ID NO: 577082 - DNA, 25 bp, Mus musculus
gcttctcttactaagcctgagggac

SEQ ID NO: 577083 - DNA, 25 bp, Mus musculus
gcttctcttacttagcctgagggac

SEQ ID NO: 577084 - DNA, 25 bp, Mus musculus
gcttctcttcccacacattgtaaat

SEQ ID NO: 577085 - DNA, 25 bp, Mus musculus
gcttctcttccctcacattgtaaat

SEQ ID NO: 577086 - DNA, 25 bp, Mus musculus
gcttctcttccgatgacaagtatgt

SEQ ID NO: 577087 - DNA, 25 bp, Mus musculus
gcttctcttccgttgacaagtatgt

SEQ ID NO: 577088 - DNA, 25 bp, Mus musculus
gcttctcttcgtcgacagcttgtat

SEQ ID NO: 577089 - DNA, 25 bp, Mus musculus
gcttctcttcgtggacagcttgtat

SEQ ID NO: 577090 - DNA, 25 bp, Mus musculus
gcttctcttgacaccaagaacctgg

SEQ ID NO: 577091 - DNA, 25 bp, Mus musculus
gcttctcttgactccaagaacctgg

SEQ ID NO: 577092 - DNA, 25 bp, Mus musculus
gcttctcttgatcatgggctgtaac

SEQ ID NO: 577093 - DNA, 25 bp, Mus musculus
gcttctcttgatgatgggctgtaac

SEQ ID NO: 577094 - DNA, 25 bp, Mus musculus
gcttctcttggtatgttttgtgcat

SEQ ID NO: 577095 - DNA, 25 bp, Mus musculus
gcttctcttggtttgttttgtgcat

SEQ ID NO: 577096 - DNA, 25 bp, Mus musculus
gcttctcttgtgctctaataattta

SEQ ID NO: 577097 - DNA, 25 bp, Mus musculus
gcttctcttgtggtctaataattta

SEQ ID NO: 577098 - DNA, 25 bp, Mus musculus
gcttctcttgttagagcctgcctag

SEQ ID NO: 577099 - DNA, 25 bp, Mus musculus
gcttctcttgtttgagcctgcctag

SEQ ID NO: 577100 - DNA, 25 bp, Mus musculus
gcttctctttaaacctttccaatct

SEQ ID NO: 577101 - DNA, 25 bp, Mus musculus
gcttctctttaatcctttccaatct

SEQ ID NO: 577102 - DNA, 25 bp, Mus musculus
gcttctctttcgatttctatttcta

SEQ ID NO: 577103 - DNA, 25 bp, Mus musculus
gcttctctttcgttttctatttcta

SEQ ID NO: 577104 - DNA, 25 bp, Mus musculus
gcttctctttgcatccttaagacac

SEQ ID NO: 577105 - DNA, 25 bp, Mus musculus
gcttctctttgcttccttaagacac

SEQ ID NO: 577106 - DNA, 25 bp, Mus musculus
gcttctgaaaaactgccgtggtgca

SEQ ID NO: 577107 - DNA, 25 bp, Mus musculus
gcttctgaaaaagtgccgtggtgca

SEQ ID NO: 577108 - DNA, 25 bp, Mus musculus
gcttctgaaacaactgctcagtcat

SEQ ID NO: 577109 - DNA, 25 bp, Mus musculus
gcttctgaaacatctgctcagtcat

SEQ ID NO: 577110 - DNA, 25 bp, Mus musculus
gcttctgaagcgatagctgcacaat

SEQ ID NO: 577111 - DNA, 25 bp, Mus musculus
gcttctgaagcgttagctgcacaat

SEQ ID NO: 577112 - DNA, 25 bp, Mus musculus
gcttctgaagggagggacagtaacc

SEQ ID NO: 577113 - DNA, 25 bp, Mus musculus
gcttctgaagggtgggacagtaacc

SEQ ID NO: 577114 - DNA, 25 bp, Mus musculus
gcttctgaatagcagcttcgtgcag

SEQ ID NO: 577115 - DNA, 25 bp, Mus musculus
gcttctgaataggagcttcgtgcag

SEQ ID NO: 577116 - DNA, 25 bp, Mus musculus
gcttctgacaaactctgtgccacat

SEQ ID NO: 577117 - DNA, 25 bp, Mus musculus
gcttctgacaaagtctgtgccacat

SEQ ID NO: 577118 - DNA, 25 bp, Mus musculus
gcttctgaccccaggactacatact

SEQ ID NO: 577119 - DNA, 25 bp, Mus musculus
gcttctgacccctggactacatact

SEQ ID NO: 577120 - DNA, 25 bp, Mus musculus
gcttctgaccgcagggacaaaatag

SEQ ID NO: 577121 - DNA, 25 bp, Mus musculus
gcttctgaccgctgggacaaaatag

SEQ ID NO: 577122 - DNA, 25 bp, Mus musculus
gcttctgaccttacagggcaatgca

SEQ ID NO: 577123 - DNA, 25 bp, Mus musculus
gcttctgacctttcagggcaatgca

SEQ ID NO: 577124 - DNA, 25 bp, Mus musculus
gcttctgactttagtcttctgtgac

SEQ ID NO: 577125 - DNA, 25 bp, Mus musculus
gcttctgacttttgtcttctgtgac

SEQ ID NO: 577126 - DNA, 25 bp, Mus musculus
gcttctgagaagactttctcacctc

SEQ ID NO: 577127 - DNA, 25 bp, Mus musculus
gcttctgagaagtctttctcacctc

SEQ ID NO: 577128 - DNA, 25 bp, Mus musculus
gcttctgagactacttttgtgacca

SEQ ID NO: 577129 - DNA, 25 bp, Mus musculus
gcttctgagacttcttttgtgacca

SEQ ID NO: 577130 - DNA, 25 bp, Mus musculus
gcttctgaggaacgtcaccaggttt

SEQ ID NO: 577131 - DNA, 25 bp, Mus musculus
gcttctgaggaaggtcaccaggttt

SEQ ID NO: 577132 - DNA, 25 bp, Mus musculus
gcttctgagggaaagctcctttagg

SEQ ID NO: 577133 - DNA, 25 bp, Mus musculus
gcttctgagggaacctgtactcaca

SEQ ID NO: 577134 - DNA, 25 bp, Mus musculus
gcttctgagggatagctcctttagg

SEQ ID NO: 577135 - DNA, 25 bp, Mus musculus
gcttctgagggatcctgtactcaca

SEQ ID NO: 577136 - DNA, 25 bp, Mus musculus
gcttctgagttcctgtttcaaacgt

SEQ ID NO: 577137 - DNA, 25 bp, Mus musculus
gcttctgagttcgtgtttcaaacgt

SEQ ID NO: 577138 - DNA, 25 bp, Mus musculus
gcttctgatatgaggcccaggagct

SEQ ID NO: 577139 - DNA, 25 bp, Mus musculus
gcttctgatatgtggcccaggagct

SEQ ID NO: 577140 - DNA, 25 bp, Mus musculus
gcttctgatcagatatagttactat

SEQ ID NO: 577141 - DNA, 25 bp, Mus musculus
gcttctgatcagttatagttactat

SEQ ID NO: 577142 - DNA, 25 bp, Mus musculus
gcttctgcaagacggacttgggcct

SEQ ID NO: 577143 - DNA, 25 bp, Mus musculus
gcttctgcaagagggacttgggcct

SEQ ID NO: 577144 - DNA, 25 bp, Mus musculus
gcttctgcactgacaggaatccaca

SEQ ID NO: 577145 - DNA, 25 bp, Mus musculus
gcttctgcactgtcaggaatccaca

SEQ ID NO: 577146 - DNA, 25 bp, Mus musculus
gcttctgcagcaaccctaataaaac

SEQ ID NO: 577147 - DNA, 25 bp, Mus musculus
gcttctgcagcatccctaataaaac

SEQ ID NO: 577148 - DNA, 25 bp, Mus musculus
gcttctgcagctaggaatgatgtga

SEQ ID NO: 577149 - DNA, 25 bp, Mus musculus
gcttctgcagcttggaatgatgtga

SEQ ID NO: 577150 - DNA, 25 bp, Mus musculus
gcttctgcagggagagcacacagta

SEQ ID NO: 577151 - DNA, 25 bp, Mus musculus
gcttctgcagggatccaacgatgtt

SEQ ID NO: 577152 - DNA, 25 bp, Mus musculus
gcttctgcagggtgagcacacagta

SEQ ID NO: 577153 - DNA, 25 bp, Mus musculus
gcttctgcagggttccaacgatgtt

SEQ ID NO: 577154 - DNA, 25 bp, Mus musculus
gcttctgccatcatcacaaatattg

SEQ ID NO: 577155 - DNA, 25 bp, Mus musculus
gcttctgccatcttcacaaatattg

SEQ ID NO: 577156 - DNA, 25 bp, Mus musculus
gcttctgcctgaaagggattattac

SEQ ID NO: 577157 - DNA, 25 bp, Mus musculus
gcttctgcctgatagggattattac

SEQ ID NO: 577158 - DNA, 25 bp, Mus musculus
gcttctgcgactacctcgagctcat

SEQ ID NO: 577159 - DNA, 25 bp, Mus musculus
gcttctgcgacttcctcgagctcat

SEQ ID NO: 577160 - DNA, 25 bp, Mus musculus
gcttctgcggtgattgctgctccag

SEQ ID NO: 577161 - DNA, 25 bp, Mus musculus
gcttctgcggtgtttgctgctccag

SEQ ID NO: 577162 - DNA, 25 bp, Mus musculus
gcttctgctgagaccagggattcat

SEQ ID NO: 577163 - DNA, 25 bp, Mus musculus
gcttctgctgagtccagggattcat

SEQ ID NO: 577164 - DNA, 25 bp, Mus musculus
gcttctgctgttagtctcatgtcaa

SEQ ID NO: 577165 - DNA, 25 bp, Mus musculus
gcttctgctgtttgtctcatgtcaa

SEQ ID NO: 577166 - DNA, 25 bp, Mus musculus
gcttctgcttggagtcaacattact

SEQ ID NO: 577167 - DNA, 25 bp, Mus musculus
gcttctgcttggtgtcaacattact

SEQ ID NO: 577168 - DNA, 25 bp, Mus musculus
gcttctgctttgacacttgactgac

SEQ ID NO: 577169 - DNA, 25 bp, Mus musculus
gcttctgctttgatgaatggcacta

SEQ ID NO: 577170 - DNA, 25 bp, Mus musculus
gcttctgctttgtcacttgactgac

SEQ ID NO: 577171 - DNA, 25 bp, Mus musculus
gcttctgctttgttgaatggcacta

SEQ ID NO: 577172 - DNA, 25 bp, Mus musculus
gcttctggaaccctgtttggtttga

SEQ ID NO: 577173 - DNA, 25 bp, Mus musculus
gcttctggaaccgtgtttggtttga

SEQ ID NO: 577174 - DNA, 25 bp, Mus musculus
gcttctggacacaaactaacttttt

SEQ ID NO: 577175 - DNA, 25 bp, Mus musculus
gcttctggacacatgccgctgacat

SEQ ID NO: 577176 - DNA, 25 bp, Mus musculus
gcttctggacactaactaacttttt

SEQ ID NO: 577177 - DNA, 25 bp, Mus musculus
gcttctggacacttgccgctgacat

SEQ ID NO: 577178 - DNA, 25 bp, Mus musculus
gcttctggacagatgcctttagtga

SEQ ID NO: 577179 - DNA, 25 bp, Mus musculus
gcttctggacagttgcctttagtga

SEQ ID NO: 577180 - DNA, 25 bp, Mus musculus
gcttctggagcacttcagctaatat

SEQ ID NO: 577181 - DNA, 25 bp, Mus musculus
gcttctggagcagttcagctaatat

SEQ ID NO: 577182 - DNA, 25 bp, Mus musculus
gcttctggaggaaaaggaccctgta

SEQ ID NO: 577183 - DNA, 25 bp, Mus musculus
gcttctggaggataaggaccctgta

SEQ ID NO: 577184 - DNA, 25 bp, Mus musculus
gcttctggatatatgtcttcacttg

SEQ ID NO: 577185 - DNA, 25 bp, Mus musculus
gcttctggatatcccatgtggacat

SEQ ID NO: 577186 - DNA, 25 bp, Mus musculus
gcttctggatatgccatgtggacat

SEQ ID NO: 577187 - DNA, 25 bp, Mus musculus
gcttctggatatttgtcttcacttg

SEQ ID NO: 577188 - DNA, 25 bp, Mus musculus
gcttctggcattattctcttctgaa

SEQ ID NO: 577189 - DNA, 25 bp, Mus musculus
gcttctggcatttttctcttctgaa

SEQ ID NO: 577190 - DNA, 25 bp, Mus musculus
gcttctggcgaactgattttatttt

SEQ ID NO: 577191 - DNA, 25 bp, Mus musculus
gcttctggcgaagtgattttatttt

SEQ ID NO: 577192 - DNA, 25 bp, Mus musculus
gcttctggcgtcattaccctgagtt

SEQ ID NO: 577193 - DNA, 25 bp, Mus musculus
gcttctggcgtctttaccctgagtt

SEQ ID NO: 577194 - DNA, 25 bp, Mus musculus
gcttctggctcaatttacttggcaa

SEQ ID NO: 577195 - DNA, 25 bp, Mus musculus
gcttctggctcattttacttggcaa

SEQ ID NO: 577196 - DNA, 25 bp, Mus musculus
gcttctggctgtacattttcatctt

SEQ ID NO: 577197 - DNA, 25 bp, Mus musculus
gcttctggctgttcattttcatctt

SEQ ID NO: 577198 - DNA, 25 bp, Mus musculus
gcttctggcttgatggaggttacaa

SEQ ID NO: 577199 - DNA, 25 bp, Mus musculus
gcttctggcttgattgggattcttc

SEQ ID NO: 577200 - DNA, 25 bp, Mus musculus
gcttctggcttgttggaggttacaa

SEQ ID NO: 577201 - DNA, 25 bp, Mus musculus
gcttctggcttgtttgggattcttc

SEQ ID NO: 577202 - DNA, 25 bp, Mus musculus
gcttctgggaatctgacatgctcat

SEQ ID NO: 577203 - DNA, 25 bp, Mus musculus
gcttctgggaatgtgacatgctcat

SEQ ID NO: 577204 - DNA, 25 bp, Mus musculus
gcttctgggacactgctgcaccgtg

SEQ ID NO: 577205 - DNA, 25 bp, Mus musculus
gcttctgggacagtgctgcaccgtg

SEQ ID NO: 577206 - DNA, 25 bp, Mus musculus
gcttctgggaggactggcttttcga

SEQ ID NO: 577207 - DNA, 25 bp, Mus musculus
gcttctgggaggtctggcttttcga

SEQ ID NO: 577208 - DNA, 25 bp, Mus musculus
gcttctgggcaacataagactcctt

SEQ ID NO: 577209 - DNA, 25 bp, Mus musculus
gcttctgggcaagataagactcctt

SEQ ID NO: 577210 - DNA, 25 bp, Mus musculus
gcttctgggccaaagcattgcctga

SEQ ID NO: 577211 - DNA, 25 bp, Mus musculus
gcttctgggccatagcattgcctga

SEQ ID NO: 577212 - DNA, 25 bp, Mus musculus
gcttctgggcctcagcttggctgtc

SEQ ID NO: 577213 - DNA, 25 bp, Mus musculus
gcttctgggcctgagcttggctgtc

SEQ ID NO: 577214 - DNA, 25 bp, Mus musculus
gcttctgggtgacgtgtttactgct

SEQ ID NO: 577215 - DNA, 25 bp, Mus musculus
gcttctgggtgaggtgtttactgct

SEQ ID NO: 577216 - DNA, 25 bp, Mus musculus
gcttctggtaacctgatggcactgt

SEQ ID NO: 577217 - DNA, 25 bp, Mus musculus
gcttctggtaacgtgatggcactgt

SEQ ID NO: 577218 - DNA, 25 bp, Mus musculus
gcttctggtactactgttgttgatc

SEQ ID NO: 577219 - DNA, 25 bp, Mus musculus
gcttctggtacttctgttgttgatc

SEQ ID NO: 577220 - DNA, 25 bp, Mus musculus
gcttctggtaggcttgtgcttgcac

SEQ ID NO: 577221 - DNA, 25 bp, Mus musculus
gcttctggtagggttgtgcttgcac

SEQ ID NO: 577222 - DNA, 25 bp, Mus musculus
gcttctgtacatatgattgcttctt

SEQ ID NO: 577223 - DNA, 25 bp, Mus musculus
gcttctgtacatttgattgcttctt

SEQ ID NO: 577224 - DNA, 25 bp, Mus musculus
gcttctgtactaagatgcccgtgga

SEQ ID NO: 577225 - DNA, 25 bp, Mus musculus
gcttctgtactatgatgcccgtgga

SEQ ID NO: 577226 - DNA, 25 bp, Mus musculus
gcttctgtagaacacccaagtacca

SEQ ID NO: 577227 - DNA, 25 bp, Mus musculus
gcttctgtagaagacccaagtacca

SEQ ID NO: 577228 - DNA, 25 bp, Mus musculus
gcttctgtagctacaccagagggtg

SEQ ID NO: 577229 - DNA, 25 bp, Mus musculus
gcttctgtagcttcaccagagggtg

SEQ ID NO: 577230 - DNA, 25 bp, Mus musculus
gcttctgtatataccatgtgctaaa

SEQ ID NO: 577231 - DNA, 25 bp, Mus musculus
gcttctgtatattccatgtgctaaa

SEQ ID NO: 577232 - DNA, 25 bp, Mus musculus
gcttctgtattcacagagtgacaca

SEQ ID NO: 577233 - DNA, 25 bp, Mus musculus
gcttctgtattctcagagtgacaca

SEQ ID NO: 577234 - DNA, 25 bp, Mus musculus
gcttctgtattgagggtttggaaaa

SEQ ID NO: 577235 - DNA, 25 bp, Mus musculus
gcttctgtattgtgggtttggaaaa

SEQ ID NO: 577236 - DNA, 25 bp, Mus musculus
gcttctgtatttaataacaacctga

SEQ ID NO: 577237 - DNA, 25 bp, Mus musculus
gcttctgtattttataacaacctga

SEQ ID NO: 577238 - DNA, 25 bp, Mus musculus
gcttctgtcaggcagcacctttaac

SEQ ID NO: 577239 - DNA, 25 bp, Mus musculus
gcttctgtcagggagcacctttaac

SEQ ID NO: 577240 - DNA, 25 bp, Mus musculus
gcttctgtcttgactctggagactt

SEQ ID NO: 577241 - DNA, 25 bp, Mus musculus
gcttctgtcttgtctctggagactt

SEQ ID NO: 577242 - DNA, 25 bp, Mus musculus
gcttctgtgaacacctgctttacga

SEQ ID NO: 577243 - DNA, 25 bp, Mus musculus
gcttctgtgaactcctgctttacga

SEQ ID NO: 577244 - DNA, 25 bp, Mus musculus
gcttctgtggaaaattctgggctga

SEQ ID NO: 577245 - DNA, 25 bp, Mus musculus
gcttctgtggaatattctgggctga

SEQ ID NO: 577246 - DNA, 25 bp, Mus musculus
gcttctgtggacatcgtatgaatgt

SEQ ID NO: 577247 - DNA, 25 bp, Mus musculus
gcttctgtggacttcgtatgaatgt

SEQ ID NO: 577248 - DNA, 25 bp, Mus musculus
gcttctgtggagactgccatgcgaa

SEQ ID NO: 577249 - DNA, 25 bp, Mus musculus
gcttctgtggagtctgccatgcgaa

SEQ ID NO: 577250 - DNA, 25 bp, Mus musculus
gcttctgtgtaaatgctattttaaa

SEQ ID NO: 577251 - DNA, 25 bp, Mus musculus
gcttctgtgtaattgctattttaaa

SEQ ID NO: 577252 - DNA, 25 bp, Mus musculus
gcttctgtgtacagtcttgtgtctt

SEQ ID NO: 577253 - DNA, 25 bp, Mus musculus
gcttctgtgtactgtcttgtgtctt

SEQ ID NO: 577254 - DNA, 25 bp, Mus musculus
gcttctgtgtttctgacgattgctt

SEQ ID NO: 577255 - DNA, 25 bp, Mus musculus
gcttctgtgtttgtgacgattgctt

SEQ ID NO: 577256 - DNA, 25 bp, Mus musculus
gcttctgttcttagtacagttctga

SEQ ID NO: 577257 - DNA, 25 bp, Mus musculus
gcttctgttctttgtacagttctga

SEQ ID NO: 577258 - DNA, 25 bp, Mus musculus
gcttctgttgacagctgttgtgata

SEQ ID NO: 577259 - DNA, 25 bp, Mus musculus
gcttctgttgactgctgttgtgata

SEQ ID NO: 577260 - DNA, 25 bp, Mus musculus
gcttctgttgtgattctcaaactgc

SEQ ID NO: 577261 - DNA, 25 bp, Mus musculus
gcttctgttgtgtttctcaaactgc

SEQ ID NO: 577262 - DNA, 25 bp, Mus musculus
gcttctgtttacagccagggaggaa

SEQ ID NO: 577263 - DNA, 25 bp, Mus musculus
gcttctgtttactgccagggaggaa

SEQ ID NO: 577264 - DNA, 25 bp, Mus musculus
gcttcttaacatcaaacaccttctg

SEQ ID NO: 577265 - DNA, 25 bp, Mus musculus
gcttcttaacatgaaacaccttctg

SEQ ID NO: 577266 - DNA, 25 bp, Mus musculus
gcttcttaactaatcctgaaaccta

SEQ ID NO: 577267 - DNA, 25 bp, Mus musculus
gcttcttaactattcctgaaaccta

SEQ ID NO: 577268 - DNA, 25 bp, Mus musculus
gcttcttacagacggtttacactac

SEQ ID NO: 577269 - DNA, 25 bp, Mus musculus
gcttcttacagagggtttacactac

SEQ ID NO: 577270 - DNA, 25 bp, Mus musculus
gcttcttactagatatcttttaaag

SEQ ID NO: 577271 - DNA, 25 bp, Mus musculus
gcttcttactagttatcttttaaag

SEQ ID NO: 577272 - DNA, 25 bp, Mus musculus
gcttcttagattaggtgggtgtttt

SEQ ID NO: 577273 - DNA, 25 bp, Mus musculus
gcttcttagatttggtgggtgtttt

SEQ ID NO: 577274 - DNA, 25 bp, Mus musculus
gcttcttagcttcgagtcaggactt

SEQ ID NO: 577275 - DNA, 25 bp, Mus musculus
gcttcttagcttggagtcaggactt

SEQ ID NO: 577276 - DNA, 25 bp, Mus musculus
gcttcttatctcactcaacttcata

SEQ ID NO: 577277 - DNA, 25 bp, Mus musculus
gcttcttatctctctcaacttcata

SEQ ID NO: 577278 - DNA, 25 bp, Mus musculus
gcttcttattggaaccctactacac

SEQ ID NO: 577279 - DNA, 25 bp, Mus musculus
gcttcttattggtaccctactacac

SEQ ID NO: 577280 - DNA, 25 bp, Mus musculus
gcttcttcagatactctccaataat

SEQ ID NO: 577281 - DNA, 25 bp, Mus musculus
gcttcttcagattctctccaataat

SEQ ID NO: 577282 - DNA, 25 bp, Mus musculus
gcttcttcatcgctacgatccaata

SEQ ID NO: 577283 - DNA, 25 bp, Mus musculus
gcttcttcatcggtacgatccaata

SEQ ID NO: 577284 - DNA, 25 bp, Mus musculus
gcttcttcatctaccttcaggtacg

SEQ ID NO: 577285 - DNA, 25 bp, Mus musculus
gcttcttcatctcagtgacagaatt

SEQ ID NO: 577286 - DNA, 25 bp, Mus musculus
gcttcttcatctgagtgacagaatt

SEQ ID NO: 577287 - DNA, 25 bp, Mus musculus
gcttcttcatcttccttcaggtacg

SEQ ID NO: 577288 - DNA, 25 bp, Mus musculus
gcttcttcattgaatctattttctg

SEQ ID NO: 577289 - DNA, 25 bp, Mus musculus
gcttcttcattgtatctattttctg

SEQ ID NO: 577290 - DNA, 25 bp, Mus musculus
gcttcttcatttatagttacacact

SEQ ID NO: 577291 - DNA, 25 bp, Mus musculus
gcttcttcatttttagttacacact

SEQ ID NO: 577292 - DNA, 25 bp, Mus musculus
gcttcttccagcaagatggtggtgt

SEQ ID NO: 577293 - DNA, 25 bp, Mus musculus
gcttcttccagctagatggtggtgt

SEQ ID NO: 577294 - DNA, 25 bp, Mus musculus
gcttcttcccagacagtcttgctaa

SEQ ID NO: 577295 - DNA, 25 bp, Mus musculus
gcttcttcccagtcagtcttgctaa

SEQ ID NO: 577296 - DNA, 25 bp, Mus musculus
gcttcttcccatcttctcattgttt

SEQ ID NO: 577297 - DNA, 25 bp, Mus musculus
gcttcttcccatgttctcattgttt

SEQ ID NO: 577298 - DNA, 25 bp, Mus musculus
gcttcttccccaataattacgtgga

SEQ ID NO: 577299 - DNA, 25 bp, Mus musculus
gcttcttccccacgaatatcaaggc

SEQ ID NO: 577300 - DNA, 25 bp, Mus musculus
gcttcttccccaggaatatcaaggc

SEQ ID NO: 577301 - DNA, 25 bp, Mus musculus
gcttcttccccattaattacgtgga

SEQ ID NO: 577302 - DNA, 25 bp, Mus musculus
gcttcttcctgactaagtctcatga

SEQ ID NO: 577303 - DNA, 25 bp, Mus musculus
gcttcttcctgagtaagtctcatga

SEQ ID NO: 577304 - DNA, 25 bp, Mus musculus
gcttcttcctttatgaaagcataac

SEQ ID NO: 577305 - DNA, 25 bp, Mus musculus
gcttcttcctttttgaaagcataac

SEQ ID NO: 577306 - DNA, 25 bp, Mus musculus
gcttcttcgagcagaatgctgtgtt

SEQ ID NO: 577307 - DNA, 25 bp, Mus musculus
gcttcttcgagctgaatgctgtgtt

SEQ ID NO: 577308 - DNA, 25 bp, Mus musculus
gcttcttctataccttatctgacat

SEQ ID NO: 577309 - DNA, 25 bp, Mus musculus
gcttcttctatagcttatctgacat

SEQ ID NO: 577310 - DNA, 25 bp, Mus musculus
gcttcttctgccactatgctgattt

SEQ ID NO: 577311 - DNA, 25 bp, Mus musculus
gcttcttctgcctctatgctgattt

SEQ ID NO: 577312 - DNA, 25 bp, Mus musculus
gcttcttctggtatctggtgccgtg

SEQ ID NO: 577313 - DNA, 25 bp, Mus musculus
gcttcttctggtttctggtgccgtg

SEQ ID NO: 577314 - DNA, 25 bp, Mus musculus
gcttcttcttcgatgtgggttccaa

SEQ ID NO: 577315 - DNA, 25 bp, Mus musculus
gcttcttcttcgttgtgggttccaa

SEQ ID NO: 577316 - DNA, 25 bp, Mus musculus
gcttcttgaagacctatgtaaagaa

SEQ ID NO: 577317 - DNA, 25 bp, Mus musculus
gcttcttgaagagctatgtaaagaa

SEQ ID NO: 577318 - DNA, 25 bp, Mus musculus
gcttcttgaagccaactgcaaacat

SEQ ID NO: 577319 - DNA, 25 bp, Mus musculus
gcttcttgaagcgaactgcaaacat

SEQ ID NO: 577320 - DNA, 25 bp, Mus musculus
gcttcttgaccaacgatgttcttca

SEQ ID NO: 577321 - DNA, 25 bp, Mus musculus
gcttcttgaccatcgatgttcttca

SEQ ID NO: 577322 - DNA, 25 bp, Mus musculus
gcttcttgaggcatttattacattt

SEQ ID NO: 577323 - DNA, 25 bp, Mus musculus
gcttcttgaggcttttattacattt

SEQ ID NO: 577324 - DNA, 25 bp, Mus musculus
gcttcttgagtgagtaacgtgacat

SEQ ID NO: 577325 - DNA, 25 bp, Mus musculus
gcttcttgagtgtgtaacgtgacat

SEQ ID NO: 577326 - DNA, 25 bp, Mus musculus
gcttcttgcaaacagtccctggagt

SEQ ID NO: 577327 - DNA, 25 bp, Mus musculus
gcttcttgcaaagagtccctggagt

SEQ ID NO: 577328 - DNA, 25 bp, Mus musculus
gcttcttgcagtagcctgagtgtca

SEQ ID NO: 577329 - DNA, 25 bp, Mus musculus
gcttcttgcagttgcctgagtgtca

SEQ ID NO: 577330 - DNA, 25 bp, Mus musculus
gcttcttggaacagactaacctttt

SEQ ID NO: 577331 - DNA, 25 bp, Mus musculus
gcttcttggaactgactaacctttt

SEQ ID NO: 577332 - DNA, 25 bp, Mus musculus
gcttcttggcctcgtacttttttat

SEQ ID NO: 577333 - DNA, 25 bp, Mus musculus
gcttcttggcctggtacttttttat

SEQ ID NO: 577334 - DNA, 25 bp, Mus musculus
gcttcttgggttagggatctttgta

SEQ ID NO: 577335 - DNA, 25 bp, Mus musculus
gcttcttgggttatagtctgaataa

SEQ ID NO: 577336 - DNA, 25 bp, Mus musculus
gcttcttgggtttgggatctttgta

SEQ ID NO: 577337 - DNA, 25 bp, Mus musculus
gcttcttgggttttagtctgaataa

SEQ ID NO: 577338 - DNA, 25 bp, Mus musculus
gcttcttgtctaatatctggccatc

SEQ ID NO: 577339 - DNA, 25 bp, Mus musculus
gcttcttgtctattatctggccatc

SEQ ID NO: 577340 - DNA, 25 bp, Mus musculus
gcttcttgtgaaattgtgtacctgc

SEQ ID NO: 577341 - DNA, 25 bp, Mus musculus
gcttcttgtgaatttgtgtacctgc

SEQ ID NO: 577342 - DNA, 25 bp, Mus musculus
gcttcttgtgcacggcagaactgac

SEQ ID NO: 577343 - DNA, 25 bp, Mus musculus
gcttcttgtgcagggcagaactgac

SEQ ID NO: 577344 - DNA, 25 bp, Mus musculus
gcttcttgtgtgaatgattctgaga

SEQ ID NO: 577345 - DNA, 25 bp, Mus musculus
gcttcttgtgtgtatgattctgaga

SEQ ID NO: 577346 - DNA, 25 bp, Mus musculus
gcttcttgttggctgttgacttaaa

SEQ ID NO: 577347 - DNA, 25 bp, Mus musculus
gcttcttgttgggtgttgacttaaa

SEQ ID NO: 577348 - DNA, 25 bp, Mus musculus
gcttcttgtttgagtgtcctgaatc

SEQ ID NO: 577349 - DNA, 25 bp, Mus musculus
gcttcttgtttgattaccgattctt

SEQ ID NO: 577350 - DNA, 25 bp, Mus musculus
gcttcttgtttgtgtgtcctgaatc

SEQ ID NO: 577351 - DNA, 25 bp, Mus musculus
gcttcttgtttgtttaccgattctt

SEQ ID NO: 577352 - DNA, 25 bp, Mus musculus
gcttctttaaagcaggacaaacact

SEQ ID NO: 577353 - DNA, 25 bp, Mus musculus
gcttctttaaaggaggacaaacact

SEQ ID NO: 577354 - DNA, 25 bp, Mus musculus
gcttctttacaacacaggatctcgt

SEQ ID NO: 577355 - DNA, 25 bp, Mus musculus
gcttctttacaagacaggatctcgt

SEQ ID NO: 577356 - DNA, 25 bp, Mus musculus
gcttctttagctcatcaaatccaga

SEQ ID NO: 577357 - DNA, 25 bp, Mus musculus
gcttctttagctgatcaaatccaga

SEQ ID NO: 577358 - DNA, 25 bp, Mus musculus
gcttctttatagctgtatccctctt

SEQ ID NO: 577359 - DNA, 25 bp, Mus musculus
gcttctttataggtgtatccctctt

SEQ ID NO: 577360 - DNA, 25 bp, Mus musculus
gcttctttatggatgtttgttttgt

SEQ ID NO: 577361 - DNA, 25 bp, Mus musculus
gcttctttatggttgtttgttttgt

SEQ ID NO: 577362 - DNA, 25 bp, Mus musculus
gcttctttcaaactcaggctatggc

SEQ ID NO: 577363 - DNA, 25 bp, Mus musculus
gcttctttcaaagtcaggctatggc

SEQ ID NO: 577364 - DNA, 25 bp, Mus musculus
gcttctttccatcttgttctcagga

SEQ ID NO: 577365 - DNA, 25 bp, Mus musculus
gcttctttccatgttgttctcagga

SEQ ID NO: 577366 - DNA, 25 bp, Mus musculus
gcttctttccctacaattatcatcg

SEQ ID NO: 577367 - DNA, 25 bp, Mus musculus
gcttctttcccttcaattatcatcg

SEQ ID NO: 577368 - DNA, 25 bp, Mus musculus
gcttctttcgtactttttgcttcac

SEQ ID NO: 577369 - DNA, 25 bp, Mus musculus
gcttctttcgtagtttttgcttcac

SEQ ID NO: 577370 - DNA, 25 bp, Mus musculus
gcttctttgacaatactaggtatat

SEQ ID NO: 577371 - DNA, 25 bp, Mus musculus
gcttctttgacattactaggtatat

SEQ ID NO: 577372 - DNA, 25 bp, Mus musculus
gcttctttgaggagtgtgaccccaa

SEQ ID NO: 577373 - DNA, 25 bp, Mus musculus
gcttctttgaggtgtgtgaccccaa

SEQ ID NO: 577374 - DNA, 25 bp, Mus musculus
gcttctttggaaaatctttgggaaa

SEQ ID NO: 577375 - DNA, 25 bp, Mus musculus
gcttctttggaatatctttgggaaa

SEQ ID NO: 577376 - DNA, 25 bp, Mus musculus
gcttctttgtatataacgcaggcaa

SEQ ID NO: 577377 - DNA, 25 bp, Mus musculus
gcttctttgtatctacagaggtaat

SEQ ID NO: 577378 - DNA, 25 bp, Mus musculus
gcttctttgtatgtacagaggtaat

SEQ ID NO: 577379 - DNA, 25 bp, Mus musculus
gcttctttgtatttaacgcaggcaa

SEQ ID NO: 577380 - DNA, 25 bp, Mus musculus
gcttctttgtctcatcaggatgcaa

SEQ ID NO: 577381 - DNA, 25 bp, Mus musculus
gcttctttgtctgatcaggatgcaa

SEQ ID NO: 577382 - DNA, 25 bp, Mus musculus
gcttcttttagtcaccttcattatg

SEQ ID NO: 577383 - DNA, 25 bp, Mus musculus
gcttcttttagtgaccttcattatg

SEQ ID NO: 577384 - DNA, 25 bp, Mus musculus
gcttcttttataagttattctgtga

SEQ ID NO: 577385 - DNA, 25 bp, Mus musculus
gcttcttttatatgttattctgtga

SEQ ID NO: 577386 - DNA, 25 bp, Mus musculus
gcttcttttgctctattgttgtatc

SEQ ID NO: 577387 - DNA, 25 bp, Mus musculus
gcttcttttgctgtattgttgtatc

SEQ ID NO: 577388 - DNA, 25 bp, Mus musculus
gcttcttttgtcacaatgccttgca

SEQ ID NO: 577389 - DNA, 25 bp, Mus musculus
gcttcttttgtctcaatgccttgca

SEQ ID NO: 577390 - DNA, 25 bp, Mus musculus
gcttcttttgttaagccgtggctga

SEQ ID NO: 577391 - DNA, 25 bp, Mus musculus
gcttcttttgtttagccgtggctga

SEQ ID NO: 577392 - DNA, 25 bp, Mus musculus
gcttctttttcccttatgttacatc

SEQ ID NO: 577393 - DNA, 25 bp, Mus musculus
gcttctttttccgttatgttacatc

SEQ ID NO: 577394 - DNA, 25 bp, Mus musculus
gcttctttttgcctcaaacaggtca

SEQ ID NO: 577395 - DNA, 25 bp, Mus musculus
gcttctttttgcgtcaaacaggtca

SEQ ID NO: 577396 - DNA, 25 bp, Mus musculus
gcttgaaaaactcaaccaaatccca

SEQ ID NO: 577397 - DNA, 25 bp, Mus musculus
gcttgaaaaactgaaccaaatccca

SEQ ID NO: 577398 - DNA, 25 bp, Mus musculus
gcttgaaaattcatccttaaccact

SEQ ID NO: 577399 - DNA, 25 bp, Mus musculus
gcttgaaaattcttccttaaccact

SEQ ID NO: 577400 - DNA, 25 bp, Mus musculus
gcttgaaacctcaagcttgtgccta

SEQ ID NO: 577401 - DNA, 25 bp, Mus musculus
gcttgaaacctctagcttgtgccta

SEQ ID NO: 577402 - DNA, 25 bp, Mus musculus
gcttgaaacggaacgacctctggat

SEQ ID NO: 577403 - DNA, 25 bp, Mus musculus
gcttgaaacggatcgacctctggat

SEQ ID NO: 577404 - DNA, 25 bp, Mus musculus
gcttgaaactgtacagcctgatcct

SEQ ID NO: 577405 - DNA, 25 bp, Mus musculus
gcttgaaactgttcagcctgatcct

SEQ ID NO: 577406 - DNA, 25 bp, Mus musculus
gcttgaaaggcccactgcttgctcc

SEQ ID NO: 577407 - DNA, 25 bp, Mus musculus
gcttgaaaggccgactgcttgctcc

SEQ ID NO: 577408 - DNA, 25 bp, Mus musculus
gcttgaaagggccagtcagttatct

SEQ ID NO: 577409 - DNA, 25 bp, Mus musculus
gcttgaaagggcgagtcagttatct

SEQ ID NO: 577410 - DNA, 25 bp, Mus musculus
gcttgaaagttaatgctgctctaga

SEQ ID NO: 577411 - DNA, 25 bp, Mus musculus
gcttgaaagttattgctgctctaga

SEQ ID NO: 577412 - DNA, 25 bp, Mus musculus
gcttgaaagttcagatcccgctggg

SEQ ID NO: 577413 - DNA, 25 bp, Mus musculus
gcttgaaagttctgatcccgctggg

SEQ ID NO: 577414 - DNA, 25 bp, Mus musculus
gcttgaaattagcattttcttaatg

SEQ ID NO: 577415 - DNA, 25 bp, Mus musculus
gcttgaaattaggattttcttaatg

SEQ ID NO: 577416 - DNA, 25 bp, Mus musculus
gcttgaacaaggctgtgcttctgca

SEQ ID NO: 577417 - DNA, 25 bp, Mus musculus
gcttgaacaagggtgtgcttctgca

SEQ ID NO: 577418 - DNA, 25 bp, Mus musculus
gcttgaacagttcaccttgaatgct

SEQ ID NO: 577419 - DNA, 25 bp, Mus musculus
gcttgaacagttgaccttgaatgct

SEQ ID NO: 577420 - DNA, 25 bp, Mus musculus
gcttgaacgctcactttgaatctca

SEQ ID NO: 577421 - DNA, 25 bp, Mus musculus
gcttgaacgctctctttgaatctca

SEQ ID NO: 577422 - DNA, 25 bp, Mus musculus
gcttgaactcttcccagtgaacaga

SEQ ID NO: 577423 - DNA, 25 bp, Mus musculus
gcttgaactcttgccagtgaacaga

SEQ ID NO: 577424 - DNA, 25 bp, Mus musculus
gcttgaactgagatgatacattgaa

SEQ ID NO: 577425 - DNA, 25 bp, Mus musculus
gcttgaactgagttgatacattgaa

SEQ ID NO: 577426 - DNA, 25 bp, Mus musculus
gcttgaacttcccttaaaccagaga

SEQ ID NO: 577427 - DNA, 25 bp, Mus musculus
gcttgaacttccgttaaaccagaga

SEQ ID NO: 577428 - DNA, 25 bp, Mus musculus
gcttgaacttctctgcataccttat

SEQ ID NO: 577429 - DNA, 25 bp, Mus musculus
gcttgaacttctgtgcataccttat

SEQ ID NO: 577430 - DNA, 25 bp, Mus musculus
gcttgaacttggaccctccagtaca

SEQ ID NO: 577431 - DNA, 25 bp, Mus musculus
gcttgaacttggtccctccagtaca

SEQ ID NO: 577432 - DNA, 25 bp, Mus musculus
gcttgaagacatccaatggacccca

SEQ ID NO: 577433 - DNA, 25 bp, Mus musculus
gcttgaagacatgcaatggacccca

SEQ ID NO: 577434 - DNA, 25 bp, Mus musculus
gcttgaagatttcggagttcccaat

SEQ ID NO: 577435 - DNA, 25 bp, Mus musculus
gcttgaagatttgggagttcccaat

SEQ ID NO: 577436 - DNA, 25 bp, Mus musculus
gcttgaagctaaacagcagcaatct

SEQ ID NO: 577437 - DNA, 25 bp, Mus musculus
gcttgaagctaatcagcagcaatct

SEQ ID NO: 577438 - DNA, 25 bp, Mus musculus
gcttgaagtgtcctatcgcgatgta

SEQ ID NO: 577439 - DNA, 25 bp, Mus musculus
gcttgaagtgtcgtatcgcgatgta

SEQ ID NO: 577440 - DNA, 25 bp, Mus musculus
gcttgaatgattccggaaaactttt

SEQ ID NO: 577441 - DNA, 25 bp, Mus musculus
gcttgaatgattgcggaaaactttt

SEQ ID NO: 577442 - DNA, 25 bp, Mus musculus
gcttgaattacaaacactgggtgaa

SEQ ID NO: 577443 - DNA, 25 bp, Mus musculus
gcttgaattacatacactgggtgaa

SEQ ID NO: 577444 - DNA, 25 bp, Mus musculus
gcttgaattattaaaaacggcacat

SEQ ID NO: 577445 - DNA, 25 bp, Mus musculus
gcttgaattatttaaaacggcacat

SEQ ID NO: 577446 - DNA, 25 bp, Mus musculus
gcttgaattttaccctttacacaat

SEQ ID NO: 577447 - DNA, 25 bp, Mus musculus
gcttgaattttagcctttacacaat

SEQ ID NO: 577448 - DNA, 25 bp, Mus musculus
gcttgacaagagaaactgccacatc

SEQ ID NO: 577449 - DNA, 25 bp, Mus musculus
gcttgacaagagtaactgccacatc

SEQ ID NO: 577450 - DNA, 25 bp, Mus musculus
gcttgacaatgtagcaaaccccctc

SEQ ID NO: 577451 - DNA, 25 bp, Mus musculus
gcttgacaatgttgcaaaccccctc

SEQ ID NO: 577452 - DNA, 25 bp, Mus musculus
gcttgacacccaaggctgaaatgct

SEQ ID NO: 577453 - DNA, 25 bp, Mus musculus
gcttgacacccatggctgaaatgct

SEQ ID NO: 577454 - DNA, 25 bp, Mus musculus
gcttgacagaaaatagcagctcccc

SEQ ID NO: 577455 - DNA, 25 bp, Mus musculus
gcttgacagaaattagcagctcccc

SEQ ID NO: 577456 - DNA, 25 bp, Mus musculus
gcttgacagtgacacaggctgccat

SEQ ID NO: 577457 - DNA, 25 bp, Mus musculus
gcttgacagtgagacaggctgccat

SEQ ID NO: 577458 - DNA, 25 bp, Mus musculus
gcttgacatgagagctgggtcttac

SEQ ID NO: 577459 - DNA, 25 bp, Mus musculus
gcttgacatgagtgctgggtcttac

SEQ ID NO: 577460 - DNA, 25 bp, Mus musculus
gcttgacatttaataccttacactg

SEQ ID NO: 577461 - DNA, 25 bp, Mus musculus
gcttgacatttattaccttacactg

SEQ ID NO: 577462 - DNA, 25 bp, Mus musculus
gcttgacccagtcagtggcaggatt

SEQ ID NO: 577463 - DNA, 25 bp, Mus musculus
gcttgacccagtgagtggcaggatt

SEQ ID NO: 577464 - DNA, 25 bp, Mus musculus
gcttgaccgtgcatgaccatgatta

SEQ ID NO: 577465 - DNA, 25 bp, Mus musculus
gcttgaccgtgcttgaccatgatta

SEQ ID NO: 577466 - DNA, 25 bp, Mus musculus
gcttgacctacaacaacggcaggtt

SEQ ID NO: 577467 - DNA, 25 bp, Mus musculus
gcttgacctacatcaacggcaggtt

SEQ ID NO: 577468 - DNA, 25 bp, Mus musculus
gcttgacctgaaaggcaatgcattg

SEQ ID NO: 577469 - DNA, 25 bp, Mus musculus
gcttgacctgaatggcaatgcattg

SEQ ID NO: 577470 - DNA, 25 bp, Mus musculus
gcttgacctggcatttggactaaca

SEQ ID NO: 577471 - DNA, 25 bp, Mus musculus
gcttgacctggcttttggactaaca

SEQ ID NO: 577472 - DNA, 25 bp, Mus musculus
gcttgacctgtaaagtaaatgatct

SEQ ID NO: 577473 - DNA, 25 bp, Mus musculus
gcttgacctgtatagtaaatgatct

SEQ ID NO: 577474 - DNA, 25 bp, Mus musculus
gcttgaccttagattgagcctcaga

SEQ ID NO: 577475 - DNA, 25 bp, Mus musculus
gcttgaccttagtttgagcctcaga

SEQ ID NO: 577476 - DNA, 25 bp, Mus musculus
gcttgacggaagaatcgggcagctc

SEQ ID NO: 577477 - DNA, 25 bp, Mus musculus
gcttgacggaagtatcgggcagctc

SEQ ID NO: 577478 - DNA, 25 bp, Mus musculus
gcttgacgttctcgcccctttcaga

SEQ ID NO: 577479 - DNA, 25 bp, Mus musculus
gcttgacgttctggcccctttcaga

SEQ ID NO: 577480 - DNA, 25 bp, Mus musculus
gcttgactaaccaactccatgtgga

SEQ ID NO: 577481 - DNA, 25 bp, Mus musculus
gcttgactaacctactccatgtgga

SEQ ID NO: 577482 - DNA, 25 bp, Mus musculus
gcttgactacatagccatactcgat

SEQ ID NO: 577483 - DNA, 25 bp, Mus musculus
gcttgactacatcagaacacacagt

SEQ ID NO: 577484 - DNA, 25 bp, Mus musculus
gcttgactacatgagaacacacagt

SEQ ID NO: 577485 - DNA, 25 bp, Mus musculus
gcttgactacattgccatactcgat

SEQ ID NO: 577486 - DNA, 25 bp, Mus musculus
gcttgactatagcttgacaatgccc

SEQ ID NO: 577487 - DNA, 25 bp, Mus musculus
gcttgactataggttgacaatgccc

SEQ ID NO: 577488 - DNA, 25 bp, Mus musculus
gcttgactcaatcgcagtggcttct

SEQ ID NO: 577489 - DNA, 25 bp, Mus musculus
gcttgactcaatggcagtggcttct

SEQ ID NO: 577490 - DNA, 25 bp, Mus musculus
gcttgactcaccagatgtgcagggt

SEQ ID NO: 577491 - DNA, 25 bp, Mus musculus
gcttgactcacctgatgtgcagggt

SEQ ID NO: 577492 - DNA, 25 bp, Mus musculus
gcttgactctagaccctaaaactgt

SEQ ID NO: 577493 - DNA, 25 bp, Mus musculus
gcttgactctagtccctaaaactgt

SEQ ID NO: 577494 - DNA, 25 bp, Mus musculus
gcttgactctgcctacaaagcattt

SEQ ID NO: 577495 - DNA, 25 bp, Mus musculus
gcttgactctgcgtacaaagcattt

SEQ ID NO: 577496 - DNA, 25 bp, Mus musculus
gcttgactcttgaacctccagggga

SEQ ID NO: 577497 - DNA, 25 bp, Mus musculus
gcttgactcttgtacctccagggga

SEQ ID NO: 577498 - DNA, 25 bp, Mus musculus
gcttgactgctgagagctcgtgact

SEQ ID NO: 577499 - DNA, 25 bp, Mus musculus
gcttgactgctgtgagctcgtgact

SEQ ID NO: 577500 - DNA, 25 bp, Mus musculus
gcttgactggctatggaatctccta

SEQ ID NO: 577501 - DNA, 25 bp, Mus musculus
gcttgactggctttggaatctccta

SEQ ID NO: 577502 - DNA, 25 bp, Mus musculus
gcttgactgtgactgaagtttcagc

SEQ ID NO: 577503 - DNA, 25 bp, Mus musculus
gcttgactgtgagtgaagtttcagc

SEQ ID NO: 577504 - DNA, 25 bp, Mus musculus
gcttgacttcccatcaaacaggagg

SEQ ID NO: 577505 - DNA, 25 bp, Mus musculus
gcttgacttcccttcaaacaggagg

SEQ ID NO: 577506 - DNA, 25 bp, Mus musculus
gcttgacttctgcatgcaggcctca

SEQ ID NO: 577507 - DNA, 25 bp, Mus musculus
gcttgacttctggatgcaggcctca

SEQ ID NO: 577508 - DNA, 25 bp, Mus musculus
gcttgacttcttaatccattcttgc

SEQ ID NO: 577509 - DNA, 25 bp, Mus musculus
gcttgacttctttatccattcttgc

SEQ ID NO: 577510 - DNA, 25 bp, Mus musculus
gcttgagaagccacaatgccgtact

SEQ ID NO: 577511 - DNA, 25 bp, Mus musculus
gcttgagaagcctcaatgccgtact

SEQ ID NO: 577512 - DNA, 25 bp, Mus musculus
gcttgagaatctcacttcttctaaa

SEQ ID NO: 577513 - DNA, 25 bp, Mus musculus
gcttgagaatctgacttcttctaaa

SEQ ID NO: 577514 - DNA, 25 bp, Mus musculus
gcttgagaatgtacctctgctggca

SEQ ID NO: 577515 - DNA, 25 bp, Mus musculus
gcttgagaatgttcctctgctggca

SEQ ID NO: 577516 - DNA, 25 bp, Mus musculus
gcttgagacaccaaggatacggttt

SEQ ID NO: 577517 - DNA, 25 bp, Mus musculus
gcttgagacacctaggatacggttt

SEQ ID NO: 577518 - DNA, 25 bp, Mus musculus
gcttgagacccgcattgggtacttt

SEQ ID NO: 577519 - DNA, 25 bp, Mus musculus
gcttgagacccggattgggtacttt

SEQ ID NO: 577520 - DNA, 25 bp, Mus musculus
gcttgagagagcacagcccaggtta

SEQ ID NO: 577521 - DNA, 25 bp, Mus musculus
gcttgagagagctcagcccaggtta

SEQ ID NO: 577522 - DNA, 25 bp, Mus musculus
gcttgagatgggactgtcacctgct

SEQ ID NO: 577523 - DNA, 25 bp, Mus musculus
gcttgagatgggtctgtcacctgct

SEQ ID NO: 577524 - DNA, 25 bp, Mus musculus
gcttgagattgcagtaagaacatac

SEQ ID NO: 577525 - DNA, 25 bp, Mus musculus
gcttgagattgctgtaagaacatac

SEQ ID NO: 577526 - DNA, 25 bp, Mus musculus
gcttgagcaaccagcaaaacatcga

SEQ ID NO: 577527 - DNA, 25 bp, Mus musculus
gcttgagcaacctgcaaaacatcga

SEQ ID NO: 577528 - DNA, 25 bp, Mus musculus
gcttgagcagccctacacaaagatg

SEQ ID NO: 577529 - DNA, 25 bp, Mus musculus
gcttgagcagccgtacacaaagatg

SEQ ID NO: 577530 - DNA, 25 bp, Mus musculus
gcttgagcaggcattggaagcccac

SEQ ID NO: 577531 - DNA, 25 bp, Mus musculus
gcttgagcaggctttggaagcccac

SEQ ID NO: 577532 - DNA, 25 bp, Mus musculus
gcttgagcataacggcccggcttaa

SEQ ID NO: 577533 - DNA, 25 bp, Mus musculus
gcttgagcataagggcccggcttaa

SEQ ID NO: 577534 - DNA, 25 bp, Mus musculus
gcttgagccagtatttgtaggttac

SEQ ID NO: 577535 - DNA, 25 bp, Mus musculus
gcttgagccagtttttgtaggttac

SEQ ID NO: 577536 - DNA, 25 bp, Mus musculus
gcttgagcccaactgttgagactac

SEQ ID NO: 577537 - DNA, 25 bp, Mus musculus
gcttgagcccaagtgttgagactac

SEQ ID NO: 577538 - DNA, 25 bp, Mus musculus
gcttgagccttgaattcactgacac

SEQ ID NO: 577539 - DNA, 25 bp, Mus musculus
gcttgagccttgtattcactgacac

SEQ ID NO: 577540 - DNA, 25 bp, Mus musculus
gcttgagctaaaagacacacttcct

SEQ ID NO: 577541 - DNA, 25 bp, Mus musculus
gcttgagctaaatgacacacttcct

SEQ ID NO: 577542 - DNA, 25 bp, Mus musculus
gcttgagctgccacacagggagaat

SEQ ID NO: 577543 - DNA, 25 bp, Mus musculus
gcttgagctgccagatggctgcatt

SEQ ID NO: 577544 - DNA, 25 bp, Mus musculus
gcttgagctgcctcacagggagaat

SEQ ID NO: 577545 - DNA, 25 bp, Mus musculus
gcttgagctgcctgatggctgcatt

SEQ ID NO: 577546 - DNA, 25 bp, Mus musculus
gcttgagcttgcctttctaggcaga

SEQ ID NO: 577547 - DNA, 25 bp, Mus musculus
gcttgagcttgcgtttctaggcaga

SEQ ID NO: 577548 - DNA, 25 bp, Mus musculus
gcttgaggacataaggacccgctat

SEQ ID NO: 577549 - DNA, 25 bp, Mus musculus
gcttgaggacattaggacccgctat

SEQ ID NO: 577550 - DNA, 25 bp, Mus musculus
gcttgaggagatagtgcagttattt

SEQ ID NO: 577551 - DNA, 25 bp, Mus musculus
gcttgaggagattgtgcagttattt

SEQ ID NO: 577552 - DNA, 25 bp, Mus musculus
gcttgaggcttgaagttcatctctc

SEQ ID NO: 577553 - DNA, 25 bp, Mus musculus
gcttgaggcttgtagttcatctctc

SEQ ID NO: 577554 - DNA, 25 bp, Mus musculus
gcttgaggtcttcttagggttccct

SEQ ID NO: 577555 - DNA, 25 bp, Mus musculus
gcttgaggtcttgttagggttccct

SEQ ID NO: 577556 - DNA, 25 bp, Mus musculus
gcttgagtcacaatggtcagtcttc

SEQ ID NO: 577557 - DNA, 25 bp, Mus musculus
gcttgagtcacattggtcagtcttc

SEQ ID NO: 577558 - DNA, 25 bp, Mus musculus
gcttgagtccagacgccataagtag

SEQ ID NO: 577559 - DNA, 25 bp, Mus musculus
gcttgagtccagtcgccataagtag

SEQ ID NO: 577560 - DNA, 25 bp, Mus musculus
gcttgagtgagcatggtatagagtt

SEQ ID NO: 577561 - DNA, 25 bp, Mus musculus
gcttgagtgagcttggtatagagtt

SEQ ID NO: 577562 - DNA, 25 bp, Mus musculus
gcttgagtgaggatgaggccctgca

SEQ ID NO: 577563 - DNA, 25 bp, Mus musculus
gcttgagtgaggttgaggccctgca

SEQ ID NO: 577564 - DNA, 25 bp, Mus musculus
gcttgagtgtgtagagcccaactgc

SEQ ID NO: 577565 - DNA, 25 bp, Mus musculus
gcttgagtgtgttgagcccaactgc

SEQ ID NO: 577566 - DNA, 25 bp, Mus musculus
gcttgagtgttcattagcacgccat

SEQ ID NO: 577567 - DNA, 25 bp, Mus musculus
gcttgagtgttctttagcacgccat

SEQ ID NO: 577568 - DNA, 25 bp, Mus musculus
gcttgagttcagatgtttagatcac

SEQ ID NO: 577569 - DNA, 25 bp, Mus musculus
gcttgagttcagttgtttagatcac

SEQ ID NO: 577570 - DNA, 25 bp, Mus musculus
gcttgagtttctctataccaaccac

SEQ ID NO: 577571 - DNA, 25 bp, Mus musculus
gcttgagtttctgtataccaaccac

SEQ ID NO: 577572 - DNA, 25 bp, Mus musculus
gcttgagttttacccagcatccaag

SEQ ID NO: 577573 - DNA, 25 bp, Mus musculus
gcttgagttttagccagcatccaag

SEQ ID NO: 577574 - DNA, 25 bp, Mus musculus
gcttgataacgtcagtttaactccc

SEQ ID NO: 577575 - DNA, 25 bp, Mus musculus
gcttgataacgtgagtttaactccc

SEQ ID NO: 577576 - DNA, 25 bp, Mus musculus
gcttgataactaactgcatgatgca

SEQ ID NO: 577577 - DNA, 25 bp, Mus musculus
gcttgataactatctgcatgatgca

SEQ ID NO: 577578 - DNA, 25 bp, Mus musculus
gcttgatcatacctagaagtgggca

SEQ ID NO: 577579 - DNA, 25 bp, Mus musculus
gcttgatcatacgtagaagtgggca

SEQ ID NO: 577580 - DNA, 25 bp, Mus musculus
gcttgatgaagcagcaaaaattact

SEQ ID NO: 577581 - DNA, 25 bp, Mus musculus
gcttgatgaagctgcaaaaattact

SEQ ID NO: 577582 - DNA, 25 bp, Mus musculus
gcttgatgacagctggcctctgcaa

SEQ ID NO: 577583 - DNA, 25 bp, Mus musculus
gcttgatgacaggtggcctctgcaa

SEQ ID NO: 577584 - DNA, 25 bp, Mus musculus
gcttgatgcattatacatgggcttt

SEQ ID NO: 577585 - DNA, 25 bp, Mus musculus
gcttgatgcattttacatgggcttt

SEQ ID NO: 577586 - DNA, 25 bp, Mus musculus
gcttgatgctctaccaagggctgtg

SEQ ID NO: 577587 - DNA, 25 bp, Mus musculus
gcttgatgctcttccaagggctgtg

SEQ ID NO: 577588 - DNA, 25 bp, Mus musculus
gcttgatggatacagcgccttcagt

SEQ ID NO: 577589 - DNA, 25 bp, Mus musculus
gcttgatggatagagcgccttcagt

SEQ ID NO: 577590 - DNA, 25 bp, Mus musculus
gcttgatggcttctgcatagattct

SEQ ID NO: 577591 - DNA, 25 bp, Mus musculus
gcttgatggcttgtgcatagattct

SEQ ID NO: 577592 - DNA, 25 bp, Mus musculus
gcttgatggtttcctctgtactgaa

SEQ ID NO: 577593 - DNA, 25 bp, Mus musculus
gcttgatggtttgctctgtactgaa

SEQ ID NO: 577594 - DNA, 25 bp, Mus musculus
gcttgattagctaggtgcagttcta

SEQ ID NO: 577595 - DNA, 25 bp, Mus musculus
gcttgattagcttggtgcagttcta

SEQ ID NO: 577596 - DNA, 25 bp, Mus musculus
gcttgattctttaagcatccaactc

SEQ ID NO: 577597 - DNA, 25 bp, Mus musculus
gcttgattcttttagcatccaactc

SEQ ID NO: 577598 - DNA, 25 bp, Mus musculus
gcttgattgcttaggattgcccagc

SEQ ID NO: 577599 - DNA, 25 bp, Mus musculus
gcttgattgctttggattgcccagc

SEQ ID NO: 577600 - DNA, 25 bp, Mus musculus
gcttgatttatgattgtgggagtaa

SEQ ID NO: 577601 - DNA, 25 bp, Mus musculus
gcttgatttatgtttgtgggagtaa

SEQ ID NO: 577602 - DNA, 25 bp, Mus musculus
gcttgatttcctatgttgagactta

SEQ ID NO: 577603 - DNA, 25 bp, Mus musculus
gcttgatttcctttgttgagactta

SEQ ID NO: 577604 - DNA, 25 bp, Mus musculus
gcttgcaaaacgatgggagccacct

SEQ ID NO: 577605 - DNA, 25 bp, Mus musculus
gcttgcaaaacgttgggagccacct

SEQ ID NO: 577606 - DNA, 25 bp, Mus musculus
gcttgcaaaggaaaggcctcccgca

SEQ ID NO: 577607 - DNA, 25 bp, Mus musculus
gcttgcaaaggataggcctcccgca

SEQ ID NO: 577608 - DNA, 25 bp, Mus musculus
gcttgcaagcttctgttactagtgt

SEQ ID NO: 577609 - DNA, 25 bp, Mus musculus
gcttgcaagcttgtgttactagtgt

SEQ ID NO: 577610 - DNA, 25 bp, Mus musculus
gcttgcaaggatccatgctgtcagt

SEQ ID NO: 577611 - DNA, 25 bp, Mus musculus
gcttgcaaggatgcatgctgtcagt

SEQ ID NO: 577612 - DNA, 25 bp, Mus musculus
gcttgcaatcttatctgttaaaccc

SEQ ID NO: 577613 - DNA, 25 bp, Mus musculus
gcttgcaatcttttctgttaaaccc

SEQ ID NO: 577614 - DNA, 25 bp, Mus musculus
gcttgcaatgagaccagcgcgggca

SEQ ID NO: 577615 - DNA, 25 bp, Mus musculus
gcttgcaatgagtccagcgcgggca

SEQ ID NO: 577616 - DNA, 25 bp, Mus musculus
gcttgcacacaccagcagagctcaa

SEQ ID NO: 577617 - DNA, 25 bp, Mus musculus
gcttgcacacacgagcagagctcaa

SEQ ID NO: 577618 - DNA, 25 bp, Mus musculus
gcttgcacagacagttccccgaaaa

SEQ ID NO: 577619 - DNA, 25 bp, Mus musculus
gcttgcacagactgttccccgaaaa

SEQ ID NO: 577620 - DNA, 25 bp, Mus musculus
gcttgcacaggtacggtgggacact

SEQ ID NO: 577621 - DNA, 25 bp, Mus musculus
gcttgcacaggttcggtgggacact

SEQ ID NO: 577622 - DNA, 25 bp, Mus musculus
gcttgcacatacacggaactgtctt

SEQ ID NO: 577623 - DNA, 25 bp, Mus musculus
gcttgcacatactcggaactgtctt

SEQ ID NO: 577624 - DNA, 25 bp, Mus musculus
gcttgcacatatctattggtaccat

SEQ ID NO: 577625 - DNA, 25 bp, Mus musculus
gcttgcacatatgtattggtaccat

SEQ ID NO: 577626 - DNA, 25 bp, Mus musculus
gcttgcacattaaaggtctgcttga

SEQ ID NO: 577627 - DNA, 25 bp, Mus musculus
gcttgcacattataggtctgcttga

SEQ ID NO: 577628 - DNA, 25 bp, Mus musculus
gcttgcaccaaacaaggcggcccat

SEQ ID NO: 577629 - DNA, 25 bp, Mus musculus
gcttgcaccaaacacttaggcttca

SEQ ID NO: 577630 - DNA, 25 bp, Mus musculus
gcttgcaccaaagaaggcggcccat

SEQ ID NO: 577631 - DNA, 25 bp, Mus musculus
gcttgcaccaaagacttaggcttca

SEQ ID NO: 577632 - DNA, 25 bp, Mus musculus
gcttgcaccaatataagatgctatt

SEQ ID NO: 577633 - DNA, 25 bp, Mus musculus
gcttgcaccaatttaagatgctatt

SEQ ID NO: 577634 - DNA, 25 bp, Mus musculus
gcttgcacccagaaattttccaatg

SEQ ID NO: 577635 - DNA, 25 bp, Mus musculus
gcttgcacccagtaattttccaatg

SEQ ID NO: 577636 - DNA, 25 bp, Mus musculus
gcttgcaccctgaccagaaagaaaa

SEQ ID NO: 577637 - DNA, 25 bp, Mus musculus
gcttgcaccctgtccagaaagaaaa

SEQ ID NO: 577638 - DNA, 25 bp, Mus musculus
gcttgcactccaatttcttggatat

SEQ ID NO: 577639 - DNA, 25 bp, Mus musculus
gcttgcactccattttcttggatat

SEQ ID NO: 577640 - DNA, 25 bp, Mus musculus
gcttgcactcttcactcgatgtgtt

SEQ ID NO: 577641 - DNA, 25 bp, Mus musculus
gcttgcactcttgactcgatgtgtt

SEQ ID NO: 577642 - DNA, 25 bp, Mus musculus
gcttgcactgtgcattttctgtata

SEQ ID NO: 577643 - DNA, 25 bp, Mus musculus
gcttgcactgtggattttctgtata

SEQ ID NO: 577644 - DNA, 25 bp, Mus musculus
gcttgcagccccattagcaaatgga

SEQ ID NO: 577645 - DNA, 25 bp, Mus musculus
gcttgcagcccctttagcaaatgga

SEQ ID NO: 577646 - DNA, 25 bp, Mus musculus
gcttgcagccctatctacgatgaaa

SEQ ID NO: 577647 - DNA, 25 bp, Mus musculus
gcttgcagccctttctacgatgaaa

SEQ ID NO: 577648 - DNA, 25 bp, Mus musculus
gcttgcagccgaagtgttctacgat

SEQ ID NO: 577649 - DNA, 25 bp, Mus musculus
gcttgcagccgatgtgttctacgat

SEQ ID NO: 577650 - DNA, 25 bp, Mus musculus
gcttgcagcctgcacgattggaatt

SEQ ID NO: 577651 - DNA, 25 bp, Mus musculus
gcttgcagcctggacgattggaatt

SEQ ID NO: 577652 - DNA, 25 bp, Mus musculus
gcttgcagctatcatttcaaaggga

SEQ ID NO: 577653 - DNA, 25 bp, Mus musculus
gcttgcagctatgatttcaaaggga

SEQ ID NO: 577654 - DNA, 25 bp, Mus musculus
gcttgcaggaacatcttattggaca

SEQ ID NO: 577655 - DNA, 25 bp, Mus musculus
gcttgcaggaacttcttattggaca

SEQ ID NO: 577656 - DNA, 25 bp, Mus musculus
gcttgcagtattatacgaccaggat

SEQ ID NO: 577657 - DNA, 25 bp, Mus musculus
gcttgcagtattttacgaccaggat

SEQ ID NO: 577658 - DNA, 25 bp, Mus musculus
gcttgcagtggtaagatgccccata

SEQ ID NO: 577659 - DNA, 25 bp, Mus musculus
gcttgcagtggttagatgccccata

SEQ ID NO: 577660 - DNA, 25 bp, Mus musculus
gcttgcagttccctcgtagttttct

SEQ ID NO: 577661 - DNA, 25 bp, Mus musculus
gcttgcagttccgtcgtagttttct

SEQ ID NO: 577662 - DNA, 25 bp, Mus musculus
gcttgcatagcaatctgttctttat

SEQ ID NO: 577663 - DNA, 25 bp, Mus musculus
gcttgcatagcattctgttctttat

SEQ ID NO: 577664 - DNA, 25 bp, Mus musculus
gcttgcatcaggatgagctgtcatt

SEQ ID NO: 577665 - DNA, 25 bp, Mus musculus
gcttgcatcaggttgagctgtcatt

SEQ ID NO: 577666 - DNA, 25 bp, Mus musculus
gcttgcatccctccattaattgtat

SEQ ID NO: 577667 - DNA, 25 bp, Mus musculus
gcttgcatccctgcattaattgtat

SEQ ID NO: 577668 - DNA, 25 bp, Mus musculus
gcttgcatgaacacagtcgtcctaa

SEQ ID NO: 577669 - DNA, 25 bp, Mus musculus
gcttgcatgaactcagtcgtcctaa

SEQ ID NO: 577670 - DNA, 25 bp, Mus musculus
gcttgcatgatgataagggttccct

SEQ ID NO: 577671 - DNA, 25 bp, Mus musculus
gcttgcatgatgttaagggttccct

SEQ ID NO: 577672 - DNA, 25 bp, Mus musculus
gcttgcatggttcctccaggcccat

SEQ ID NO: 577673 - DNA, 25 bp, Mus musculus
gcttgcatggttgctccaggcccat

SEQ ID NO: 577674 - DNA, 25 bp, Mus musculus
gcttgcatgtgacagaccaggatat

SEQ ID NO: 577675 - DNA, 25 bp, Mus musculus
gcttgcatgtgagagaccaggatat

SEQ ID NO: 577676 - DNA, 25 bp, Mus musculus
gcttgcatgtgtcattaattagtga

SEQ ID NO: 577677 - DNA, 25 bp, Mus musculus
gcttgcatgtgtgattaattagtga

SEQ ID NO: 577678 - DNA, 25 bp, Mus musculus
gcttgcatttgtagtccagaatttt

SEQ ID NO: 577679 - DNA, 25 bp, Mus musculus
gcttgcatttgttgtccagaatttt

SEQ ID NO: 577680 - DNA, 25 bp, Mus musculus
gcttgcattttacttctttggttct

SEQ ID NO: 577681 - DNA, 25 bp, Mus musculus
gcttgcattttagttctttggttct

SEQ ID NO: 577682 - DNA, 25 bp, Mus musculus
gcttgccaaagcctccgaccggaga

SEQ ID NO: 577683 - DNA, 25 bp, Mus musculus
gcttgccaaagcgtccgaccggaga

SEQ ID NO: 577684 - DNA, 25 bp, Mus musculus
gcttgccaacttcggctagcaggtt

SEQ ID NO: 577685 - DNA, 25 bp, Mus musculus
gcttgccaacttgggctagcaggtt

SEQ ID NO: 577686 - DNA, 25 bp, Mus musculus
gcttgccaagttcttccagacacaa

SEQ ID NO: 577687 - DNA, 25 bp, Mus musculus
gcttgccaagttcttttgccaaaat

SEQ ID NO: 577688 - DNA, 25 bp, Mus musculus
gcttgccaagttgttccagacacaa

SEQ ID NO: 577689 - DNA, 25 bp, Mus musculus
gcttgccaagttgttttgccaaaat

SEQ ID NO: 577690 - DNA, 25 bp, Mus musculus
gcttgccaccagacgtgtaatgtaa

SEQ ID NO: 577691 - DNA, 25 bp, Mus musculus
gcttgccaccagtcgtgtaatgtaa

SEQ ID NO: 577692 - DNA, 25 bp, Mus musculus
gcttgccacggtatcagagcacaat

SEQ ID NO: 577693 - DNA, 25 bp, Mus musculus
gcttgccacggtttcagagcacaat

SEQ ID NO: 577694 - DNA, 25 bp, Mus musculus
gcttgccagtaacaggctgctgcaa

SEQ ID NO: 577695 - DNA, 25 bp, Mus musculus
gcttgccagtaagaggctgctgcaa

SEQ ID NO: 577696 - DNA, 25 bp, Mus musculus
gcttgccagtacaacagctgaccgc

SEQ ID NO: 577697 - DNA, 25 bp, Mus musculus
gcttgccagtactacagctgaccgc

SEQ ID NO: 577698 - DNA, 25 bp, Mus musculus
gcttgccatcatcatttttgtttcc

SEQ ID NO: 577699 - DNA, 25 bp, Mus musculus
gcttgccatcatgatttttgtttcc

SEQ ID NO: 577700 - DNA, 25 bp, Mus musculus
gcttgccatgagcatcaataaacca

SEQ ID NO: 577701 - DNA, 25 bp, Mus musculus
gcttgccatgaggatcaataaacca

SEQ ID NO: 577702 - DNA, 25 bp, Mus musculus
gcttgcccaggactggcaccacagt

SEQ ID NO: 577703 - DNA, 25 bp, Mus musculus
gcttgcccaggagtggcaccacagt

SEQ ID NO: 577704 - DNA, 25 bp, Mus musculus
gcttgcccagttcacccgaaaaata

SEQ ID NO: 577705 - DNA, 25 bp, Mus musculus
gcttgcccagttgacccgaaaaata

SEQ ID NO: 577706 - DNA, 25 bp, Mus musculus
gcttgccccagccttatggaaggta

SEQ ID NO: 577707 - DNA, 25 bp, Mus musculus
gcttgccccagcgttatggaaggta

SEQ ID NO: 577708 - DNA, 25 bp, Mus musculus
gcttgcccgaggaacacaatttgtg

SEQ ID NO: 577709 - DNA, 25 bp, Mus musculus
gcttgcccgaggtacacaatttgtg

SEQ ID NO: 577710 - DNA, 25 bp, Mus musculus
gcttgccctcggagtgtctttaaat

SEQ ID NO: 577711 - DNA, 25 bp, Mus musculus
gcttgccctcggtgtgtctttaaat

SEQ ID NO: 577712 - DNA, 25 bp, Mus musculus
gcttgccctgatacaaatgcaccag

SEQ ID NO: 577713 - DNA, 25 bp, Mus musculus
gcttgccctgattcaaatgcaccag

SEQ ID NO: 577714 - DNA, 25 bp, Mus musculus
gcttgccctgcacaacttcggctga

SEQ ID NO: 577715 - DNA, 25 bp, Mus musculus
gcttgccctgcagaacttcggctga

SEQ ID NO: 577716 - DNA, 25 bp, Mus musculus
gcttgccgaggcattcaggtattat

SEQ ID NO: 577717 - DNA, 25 bp, Mus musculus
gcttgccgaggctttcaggtattat

SEQ ID NO: 577718 - DNA, 25 bp, Mus musculus
gcttgccgctggaggtgccctccag

SEQ ID NO: 577719 - DNA, 25 bp, Mus musculus
gcttgccgctggtggtgccctccag

SEQ ID NO: 577720 - DNA, 25 bp, Mus musculus
gcttgccggcgaccgggattcctaa

SEQ ID NO: 577721 - DNA, 25 bp, Mus musculus
gcttgccggcgagcgggattcctaa

SEQ ID NO: 577722 - DNA, 25 bp, Mus musculus
gcttgccgttgcattaagggctgag

SEQ ID NO: 577723 - DNA, 25 bp, Mus musculus
gcttgccgttgctttaagggctgag

SEQ ID NO: 577724 - DNA, 25 bp, Mus musculus
gcttgcctaaaaaatgctgcagact

SEQ ID NO: 577725 - DNA, 25 bp, Mus musculus
gcttgcctaaaatatgctgcagact

SEQ ID NO: 577726 - DNA, 25 bp, Mus musculus
gcttgcctaataaaccatgtgcgag

SEQ ID NO: 577727 - DNA, 25 bp, Mus musculus
gcttgcctaatataccatgtgcgag

SEQ ID NO: 577728 - DNA, 25 bp, Mus musculus
gcttgcctaatgaagcatggagact

SEQ ID NO: 577729 - DNA, 25 bp, Mus musculus
gcttgcctaatgcagtaggacacca

SEQ ID NO: 577730 - DNA, 25 bp, Mus musculus
gcttgcctaatggagtaggacacca

SEQ ID NO: 577731 - DNA, 25 bp, Mus musculus
gcttgcctaatgtagcatggagact

SEQ ID NO: 577732 - DNA, 25 bp, Mus musculus
gcttgcctagcaagcgcaaggccct

SEQ ID NO: 577733 - DNA, 25 bp, Mus musculus
gcttgcctagcatgcgcaaggccct

SEQ ID NO: 577734 - DNA, 25 bp, Mus musculus
gcttgcctagctatatgaattgctt

SEQ ID NO: 577735 - DNA, 25 bp, Mus musculus
gcttgcctagctttatgaattgctt

SEQ ID NO: 577736 - DNA, 25 bp, Mus musculus
gcttgcctagtgatcatgtagcagt

SEQ ID NO: 577737 - DNA, 25 bp, Mus musculus
gcttgcctagtgttcatgtagcagt

SEQ ID NO: 577738 - DNA, 25 bp, Mus musculus
gcttgcctagttagttttaaacatc

SEQ ID NO: 577739 - DNA, 25 bp, Mus musculus
gcttgcctagtttgttttaaacatc

SEQ ID NO: 577740 - DNA, 25 bp, Mus musculus
gcttgcctctctctaggaggtgaca

SEQ ID NO: 577741 - DNA, 25 bp, Mus musculus
gcttgcctctctgtaggaggtgaca

SEQ ID NO: 577742 - DNA, 25 bp, Mus musculus
gcttgcctgactagtgtacctgctg

SEQ ID NO: 577743 - DNA, 25 bp, Mus musculus
gcttgcctgacttgtgtacctgctg

SEQ ID NO: 577744 - DNA, 25 bp, Mus musculus
gcttgcctgcacagagagcatgagt

SEQ ID NO: 577745 - DNA, 25 bp, Mus musculus
gcttgcctgcactgagagcatgagt

SEQ ID NO: 577746 - DNA, 25 bp, Mus musculus
gcttgcctggaaagcatgaatcctg

SEQ ID NO: 577747 - DNA, 25 bp, Mus musculus
gcttgcctggaatgcatgaatcctg

SEQ ID NO: 577748 - DNA, 25 bp, Mus musculus
gcttgcctggcactggacttagagt

SEQ ID NO: 577749 - DNA, 25 bp, Mus musculus
gcttgcctggcagtggacttagagt

SEQ ID NO: 577750 - DNA, 25 bp, Mus musculus
gcttgcctgtatctactgatgtatt

SEQ ID NO: 577751 - DNA, 25 bp, Mus musculus
gcttgcctgtatgtactgatgtatt

SEQ ID NO: 577752 - DNA, 25 bp, Mus musculus
gcttgcctgtgcagttggagagaaa

SEQ ID NO: 577753 - DNA, 25 bp, Mus musculus
gcttgcctgtgctgttggagagaaa

SEQ ID NO: 577754 - DNA, 25 bp, Mus musculus
gcttgcctgttccatgtctgattag

SEQ ID NO: 577755 - DNA, 25 bp, Mus musculus
gcttgcctgttcgatgtctgattag

SEQ ID NO: 577756 - DNA, 25 bp, Mus musculus
gcttgcctgtttctgtagggaaaaa

SEQ ID NO: 577757 - DNA, 25 bp, Mus musculus
gcttgcctgtttgtgtagggaaaaa

SEQ ID NO: 577758 - DNA, 25 bp, Mus musculus
gcttgccttcaaaacatttgtgttc

SEQ ID NO: 577759 - DNA, 25 bp, Mus musculus
gcttgccttcaatacatttgtgttc

SEQ ID NO: 577760 - DNA, 25 bp, Mus musculus
gcttgccttcacagggcagctagaa

SEQ ID NO: 577761 - DNA, 25 bp, Mus musculus
gcttgccttcactgggcagctagaa

SEQ ID NO: 577762 - DNA, 25 bp, Mus musculus
gcttgccttctgatagtgtggtagt

SEQ ID NO: 577763 - DNA, 25 bp, Mus musculus
gcttgccttctgttagtgtggtagt

SEQ ID NO: 577764 - DNA, 25 bp, Mus musculus
gcttgccttcttaagttctgaactt

SEQ ID NO: 577765 - DNA, 25 bp, Mus musculus
gcttgccttctttagttctgaactt

SEQ ID NO: 577766 - DNA, 25 bp, Mus musculus
gcttgcctttccatgacagtttggg

SEQ ID NO: 577767 - DNA, 25 bp, Mus musculus
gcttgcctttccttgacagtttggg

SEQ ID NO: 577768 - DNA, 25 bp, Mus musculus
gcttgcctttgaaaaacgacacttt

SEQ ID NO: 577769 - DNA, 25 bp, Mus musculus
gcttgcctttgataaacgacacttt

SEQ ID NO: 577770 - DNA, 25 bp, Mus musculus
gcttgccttttcagactgggtcttc

SEQ ID NO: 577771 - DNA, 25 bp, Mus musculus
gcttgccttttctgactgggtcttc

SEQ ID NO: 577772 - DNA, 25 bp, Mus musculus
gcttgcctttttaatgttagtcaca

SEQ ID NO: 577773 - DNA, 25 bp, Mus musculus
gcttgcctttttctactccttatag

SEQ ID NO: 577774 - DNA, 25 bp, Mus musculus
gcttgcctttttgtactccttatag

SEQ ID NO: 577775 - DNA, 25 bp, Mus musculus
gcttgccttttttatgttagtcaca

SEQ ID NO: 577776 - DNA, 25 bp, Mus musculus
gcttgcgacaagcactctcagtgcg

SEQ ID NO: 577777 - DNA, 25 bp, Mus musculus
gcttgcgacaaggactctcagtgcg

SEQ ID NO: 577778 - DNA, 25 bp, Mus musculus
gcttgcgacgtcagtggacctgtac

SEQ ID NO: 577779 - DNA, 25 bp, Mus musculus
gcttgcgacgtctgtggacctgtac

SEQ ID NO: 577780 - DNA, 25 bp, Mus musculus
gcttgcgattcaaagtgagcatctt

SEQ ID NO: 577781 - DNA, 25 bp, Mus musculus
gcttgcgattcatagtgagcatctt

SEQ ID NO: 577782 - DNA, 25 bp, Mus musculus
gcttgcgcaatcagaaaatattatc

SEQ ID NO: 577783 - DNA, 25 bp, Mus musculus
gcttgcgcaatctgaaaatattatc

SEQ ID NO: 577784 - DNA, 25 bp, Mus musculus
gcttgcgcgtgactaatctgagaat

SEQ ID NO: 577785 - DNA, 25 bp, Mus musculus
gcttgcgcgtgagtaatctgagaat

SEQ ID NO: 577786 - DNA, 25 bp, Mus musculus
gcttgcgctgctatgtgagacactg

SEQ ID NO: 577787 - DNA, 25 bp, Mus musculus
gcttgcgctgctttgtgagacactg

SEQ ID NO: 577788 - DNA, 25 bp, Mus musculus
gcttgcggctctcttgggttttcct

SEQ ID NO: 577789 - DNA, 25 bp, Mus musculus
gcttgcggctctgttgggttttcct

SEQ ID NO: 577790 - DNA, 25 bp, Mus musculus
gcttgcggtcttccatagctggaaa

SEQ ID NO: 577791 - DNA, 25 bp, Mus musculus
gcttgcggtcttgcatagctggaaa

SEQ ID NO: 577792 - DNA, 25 bp, Mus musculus
gcttgcgtatctccttgcttaatag

SEQ ID NO: 577793 - DNA, 25 bp, Mus musculus
gcttgcgtatctgcttgcttaatag

SEQ ID NO: 577794 - DNA, 25 bp, Mus musculus
gcttgcgtcttgacttttgatatgc

SEQ ID NO: 577795 - DNA, 25 bp, Mus musculus
gcttgcgtcttgtcttttgatatgc

SEQ ID NO: 577796 - DNA, 25 bp, Mus musculus
gcttgcgttcatagctcttgagatg

SEQ ID NO: 577797 - DNA, 25 bp, Mus musculus
gcttgcgttcattgctcttgagatg

SEQ ID NO: 577798 - DNA, 25 bp, Mus musculus
gcttgcgttgataaagtccctgccc

SEQ ID NO: 577799 - DNA, 25 bp, Mus musculus
gcttgcgttgattaagtccctgccc

SEQ ID NO: 577800 - DNA, 25 bp, Mus musculus
gcttgcgttgtgcaaacagggcttt

SEQ ID NO: 577801 - DNA, 25 bp, Mus musculus
gcttgcgttgtggaaacagggcttt

SEQ ID NO: 577802 - DNA, 25 bp, Mus musculus
gcttgcgtttgcctcagcggatatg

SEQ ID NO: 577803 - DNA, 25 bp, Mus musculus
gcttgcgtttgcgtcagcggatatg

SEQ ID NO: 577804 - DNA, 25 bp, Mus musculus
gcttgctaatgccaccatctgaaga

SEQ ID NO: 577805 - DNA, 25 bp, Mus musculus
gcttgctaatgcgaccatctgaaga

SEQ ID NO: 577806 - DNA, 25 bp, Mus musculus
gcttgctaccataacaactgctttg

SEQ ID NO: 577807 - DNA, 25 bp, Mus musculus
gcttgctaccattacaactgctttg

SEQ ID NO: 577808 - DNA, 25 bp, Mus musculus
gcttgctacccaacttgtgacataa

SEQ ID NO: 577809 - DNA, 25 bp, Mus musculus
gcttgctacccatcttgtgacataa

SEQ ID NO: 577810 - DNA, 25 bp, Mus musculus
gcttgctacttcaccttgaaactca

SEQ ID NO: 577811 - DNA, 25 bp, Mus musculus
gcttgctacttcattttactctttt

SEQ ID NO: 577812 - DNA, 25 bp, Mus musculus
gcttgctacttctccttgaaactca

SEQ ID NO: 577813 - DNA, 25 bp, Mus musculus
gcttgctacttctttttactctttt

SEQ ID NO: 577814 - DNA, 25 bp, Mus musculus
gcttgctagaatcaccgatggatac

SEQ ID NO: 577815 - DNA, 25 bp, Mus musculus
gcttgctagaatgaccgatggatac

SEQ ID NO: 577816 - DNA, 25 bp, Mus musculus
gcttgctagcatacagtaaggccca

SEQ ID NO: 577817 - DNA, 25 bp, Mus musculus
gcttgctagcatccacagaaccctg

SEQ ID NO: 577818 - DNA, 25 bp, Mus musculus
gcttgctagcatgcacagaaccctg

SEQ ID NO: 577819 - DNA, 25 bp, Mus musculus
gcttgctagcattcagtaaggccca

SEQ ID NO: 577820 - DNA, 25 bp, Mus musculus
gcttgctatcaactgcaggctgact

SEQ ID NO: 577821 - DNA, 25 bp, Mus musculus
gcttgctatcaagtgcaggctgact

SEQ ID NO: 577822 - DNA, 25 bp, Mus musculus
gcttgctatgtgacattattcagga

SEQ ID NO: 577823 - DNA, 25 bp, Mus musculus
gcttgctatgtgtcattattcagga

SEQ ID NO: 577824 - DNA, 25 bp, Mus musculus
gcttgctcaaaaaactggactggag

SEQ ID NO: 577825 - DNA, 25 bp, Mus musculus
gcttgctcaaaatactggactggag

SEQ ID NO: 577826 - DNA, 25 bp, Mus musculus
gcttgctcaactcctacagtcattg

SEQ ID NO: 577827 - DNA, 25 bp, Mus musculus
gcttgctcaactgctacagtcattg

SEQ ID NO: 577828 - DNA, 25 bp, Mus musculus
gcttgctcaagtacccaaatatgcg

SEQ ID NO: 577829 - DNA, 25 bp, Mus musculus
gcttgctcaagttcccaaatatgcg

SEQ ID NO: 577830 - DNA, 25 bp, Mus musculus
gcttgctcagaaataaaccgtggga

SEQ ID NO: 577831 - DNA, 25 bp, Mus musculus
gcttgctcagaattaaaccgtggga

SEQ ID NO: 577832 - DNA, 25 bp, Mus musculus
gcttgctcagccagggatacaccca

SEQ ID NO: 577833 - DNA, 25 bp, Mus musculus
gcttgctcagcctgggatacaccca

SEQ ID NO: 577834 - DNA, 25 bp, Mus musculus
gcttgctcatctcccaagggttaga

SEQ ID NO: 577835 - DNA, 25 bp, Mus musculus
gcttgctcatctgccaagggttaga

SEQ ID NO: 577836 - DNA, 25 bp, Mus musculus
gcttgctcccaaaccgtgagaagtt

SEQ ID NO: 577837 - DNA, 25 bp, Mus musculus
gcttgctcccaatccgtgagaagtt

SEQ ID NO: 577838 - DNA, 25 bp, Mus musculus
gcttgctcccacagaggatgcctca

SEQ ID NO: 577839 - DNA, 25 bp, Mus musculus
gcttgctcccactgaggatgcctca

SEQ ID NO: 577840 - DNA, 25 bp, Mus musculus
gcttgctccggaagccttcagatga

SEQ ID NO: 577841 - DNA, 25 bp, Mus musculus
gcttgctccggatgccttcagatga

SEQ ID NO: 577842 - DNA, 25 bp, Mus musculus
gcttgctcctctacattatagattt

SEQ ID NO: 577843 - DNA, 25 bp, Mus musculus
gcttgctcctcttcattatagattt

SEQ ID NO: 577844 - DNA, 25 bp, Mus musculus
gcttgctcctgtagcctgaaatcag

SEQ ID NO: 577845 - DNA, 25 bp, Mus musculus
gcttgctcctgttgcctgaaatcag

SEQ ID NO: 577846 - DNA, 25 bp, Mus musculus
gcttgctctaagctgggattggcat

SEQ ID NO: 577847 - DNA, 25 bp, Mus musculus
gcttgctctaaggtgggattggcat

SEQ ID NO: 577848 - DNA, 25 bp, Mus musculus
gcttgctctacacagggagttgcag

SEQ ID NO: 577849 - DNA, 25 bp, Mus musculus
gcttgctctacagagggagttgcag

SEQ ID NO: 577850 - DNA, 25 bp, Mus musculus
gcttgctctcaactggtcagtgcca

SEQ ID NO: 577851 - DNA, 25 bp, Mus musculus
gcttgctctcaagtggtcagtgcca

SEQ ID NO: 577852 - DNA, 25 bp, Mus musculus
gcttgctctctccatcagtgatgag

SEQ ID NO: 577853 - DNA, 25 bp, Mus musculus
gcttgctctctcgatcagtgatgag

SEQ ID NO: 577854 - DNA, 25 bp, Mus musculus
gcttgctctgaaagcttcttcttac

SEQ ID NO: 577855 - DNA, 25 bp, Mus musculus
gcttgctctgaatgcttcttcttac

SEQ ID NO: 577856 - DNA, 25 bp, Mus musculus
gcttgctctggacccaaagaccaca

SEQ ID NO: 577857 - DNA, 25 bp, Mus musculus
gcttgctctggagccaaagaccaca

SEQ ID NO: 577858 - DNA, 25 bp, Mus musculus
gcttgctctgtacagattcctcttc

SEQ ID NO: 577859 - DNA, 25 bp, Mus musculus
gcttgctctgtagagattcctcttc

SEQ ID NO: 577860 - DNA, 25 bp, Mus musculus
gcttgctgaacgagaagcccatcga

SEQ ID NO: 577861 - DNA, 25 bp, Mus musculus
gcttgctgaacgtgaagcccatcga

SEQ ID NO: 577862 - DNA, 25 bp, Mus musculus
gcttgctgaatgaatgccatccgag

SEQ ID NO: 577863 - DNA, 25 bp, Mus musculus
gcttgctgaatgtatgccatccgag

SEQ ID NO: 577864 - DNA, 25 bp, Mus musculus
gcttgctgaccccaacttgggagaa

SEQ ID NO: 577865 - DNA, 25 bp, Mus musculus
gcttgctgacccgaacttgggagaa

SEQ ID NO: 577866 - DNA, 25 bp, Mus musculus
gcttgctgagcactagagaattcat

SEQ ID NO: 577867 - DNA, 25 bp, Mus musculus
gcttgctgagcagtagagaattcat

SEQ ID NO: 577868 - DNA, 25 bp, Mus musculus
gcttgctgcagtatctgtggtccag

SEQ ID NO: 577869 - DNA, 25 bp, Mus musculus
gcttgctgcagtttctgtggtccag

SEQ ID NO: 577870 - DNA, 25 bp, Mus musculus
gcttgctgcatcaccatgtaggcca

SEQ ID NO: 577871 - DNA, 25 bp, Mus musculus
gcttgctgcatctccatgtaggcca

SEQ ID NO: 577872 - DNA, 25 bp, Mus musculus
gcttgctgccctagtctgtgaggca

SEQ ID NO: 577873 - DNA, 25 bp, Mus musculus
gcttgctgcccttgtctgtgaggca

SEQ ID NO: 577874 - DNA, 25 bp, Mus musculus
gcttgctgctccagtttctaacttg

SEQ ID NO: 577875 - DNA, 25 bp, Mus musculus
gcttgctgctcctgtttctaacttg

SEQ ID NO: 577876 - DNA, 25 bp, Mus musculus
gcttgctgctgtaactcatttctgg

SEQ ID NO: 577877 - DNA, 25 bp, Mus musculus
gcttgctgctgttactcatttctgg

SEQ ID NO: 577878 - DNA, 25 bp, Mus musculus
gcttgctgcttactctaaagtcttg

SEQ ID NO: 577879 - DNA, 25 bp, Mus musculus
gcttgctgcttagtctaaagtcttg

SEQ ID NO: 577880 - DNA, 25 bp, Mus musculus
gcttgctggaaaccacagcctcatt

SEQ ID NO: 577881 - DNA, 25 bp, Mus musculus
gcttgctggaaagcacagcctcatt

SEQ ID NO: 577882 - DNA, 25 bp, Mus musculus
gcttgctggctcacggcagggtcat

SEQ ID NO: 577883 - DNA, 25 bp, Mus musculus
gcttgctggctctcggcagggtcat

SEQ ID NO: 577884 - DNA, 25 bp, Mus musculus
gcttgctggctgaacagaggtgctt

SEQ ID NO: 577885 - DNA, 25 bp, Mus musculus
gcttgctggctgtacagaggtgctt

SEQ ID NO: 577886 - DNA, 25 bp, Mus musculus
gcttgctggcttcctgagtggaaaa

SEQ ID NO: 577887 - DNA, 25 bp, Mus musculus
gcttgctggcttcgtcctttttaca

SEQ ID NO: 577888 - DNA, 25 bp, Mus musculus
gcttgctggcttgctgagtggaaaa

SEQ ID NO: 577889 - DNA, 25 bp, Mus musculus
gcttgctggcttggtcctttttaca

SEQ ID NO: 577890 - DNA, 25 bp, Mus musculus
gcttgctggttaacgcagtggccat

SEQ ID NO: 577891 - DNA, 25 bp, Mus musculus
gcttgctggttatcgcagtggccat

SEQ ID NO: 577892 - DNA, 25 bp, Mus musculus
gcttgctgtaacatcccactggtaa

SEQ ID NO: 577893 - DNA, 25 bp, Mus musculus
gcttgctgtaacttcccactggtaa

SEQ ID NO: 577894 - DNA, 25 bp, Mus musculus
gcttgctgtagccttacgtattacg

SEQ ID NO: 577895 - DNA, 25 bp, Mus musculus
gcttgctgtagcgttacgtattacg

SEQ ID NO: 577896 - DNA, 25 bp, Mus musculus
gcttgctgtcagagtaatgcctata

SEQ ID NO: 577897 - DNA, 25 bp, Mus musculus
gcttgctgtcagtgtaatgcctata

SEQ ID NO: 577898 - DNA, 25 bp, Mus musculus
gcttgctgtctcacttgtgcagtca

SEQ ID NO: 577899 - DNA, 25 bp, Mus musculus
gcttgctgtctccatgaacctctga

SEQ ID NO: 577900 - DNA, 25 bp, Mus musculus
gcttgctgtctcgatgaacctctga

SEQ ID NO: 577901 - DNA, 25 bp, Mus musculus
gcttgctgtctctcttgtgcagtca

SEQ ID NO: 577902 - DNA, 25 bp, Mus musculus
gcttgctgtgccctgaatctgttgt

SEQ ID NO: 577903 - DNA, 25 bp, Mus musculus
gcttgctgtgccgtgaatctgttgt

SEQ ID NO: 577904 - DNA, 25 bp, Mus musculus
gcttgctgtgctacttgtattgttt

SEQ ID NO: 577905 - DNA, 25 bp, Mus musculus
gcttgctgtgcttcttgtattgttt

SEQ ID NO: 577906 - DNA, 25 bp, Mus musculus
gcttgctgtttgacctggaaaccaa

SEQ ID NO: 577907 - DNA, 25 bp, Mus musculus
gcttgctgtttgatactggacctca

SEQ ID NO: 577908 - DNA, 25 bp, Mus musculus
gcttgctgtttgtcctggaaaccaa

SEQ ID NO: 577909 - DNA, 25 bp, Mus musculus
gcttgctgtttgttactggacctca

SEQ ID NO: 577910 - DNA, 25 bp, Mus musculus
gcttgctgttttacctcttaattta

SEQ ID NO: 577911 - DNA, 25 bp, Mus musculus
gcttgctgtttttcctcttaattta

SEQ ID NO: 577912 - DNA, 25 bp, Mus musculus
gcttgcttagcaagaacgagggcct

SEQ ID NO: 577913 - DNA, 25 bp, Mus musculus
gcttgcttagcatgaacgagggcct

SEQ ID NO: 577914 - DNA, 25 bp, Mus musculus
gcttgcttatatacctttgtatagt

SEQ ID NO: 577915 - DNA, 25 bp, Mus musculus
gcttgcttatattcctttgtatagt

SEQ ID NO: 577916 - DNA, 25 bp, Mus musculus
gcttgcttatctcctctggttttgt

SEQ ID NO: 577917 - DNA, 25 bp, Mus musculus
gcttgcttatctgctctggttttgt

SEQ ID NO: 577918 - DNA, 25 bp, Mus musculus
gcttgcttcaagattggctcaagat

SEQ ID NO: 577919 - DNA, 25 bp, Mus musculus
gcttgcttcaagtttggctcaagat

SEQ ID NO: 577920 - DNA, 25 bp, Mus musculus
gcttgcttcagcagtaggcttattt

SEQ ID NO: 577921 - DNA, 25 bp, Mus musculus
gcttgcttcagctgtaggcttattt

SEQ ID NO: 577922 - DNA, 25 bp, Mus musculus
gcttgcttccaccttacttttgaca

SEQ ID NO: 577923 - DNA, 25 bp, Mus musculus
gcttgcttccacgttacttttgaca

SEQ ID NO: 577924 - DNA, 25 bp, Mus musculus
gcttgcttccagctacttggtggga

SEQ ID NO: 577925 - DNA, 25 bp, Mus musculus
gcttgcttccaggtacttggtggga

SEQ ID NO: 577926 - DNA, 25 bp, Mus musculus
gcttgcttccataaaggcactttca

SEQ ID NO: 577927 - DNA, 25 bp, Mus musculus
gcttgcttccatcatttggttctaa

SEQ ID NO: 577928 - DNA, 25 bp, Mus musculus
gcttgcttccatgatttggttctaa

SEQ ID NO: 577929 - DNA, 25 bp, Mus musculus
gcttgcttccattaaggcactttca

SEQ ID NO: 577930 - DNA, 25 bp, Mus musculus
gcttgcttctgcattggagacagca

SEQ ID NO: 577931 - DNA, 25 bp, Mus musculus
gcttgcttctgctttggagacagca

SEQ ID NO: 577932 - DNA, 25 bp, Mus musculus
gcttgcttgagacaaactttcgagt

SEQ ID NO: 577933 - DNA, 25 bp, Mus musculus
gcttgcttgagagaaactttcgagt

SEQ ID NO: 577934 - DNA, 25 bp, Mus musculus
gcttgcttggtgattatgatatctt

SEQ ID NO: 577935 - DNA, 25 bp, Mus musculus
gcttgcttggtgtttatgatatctt

SEQ ID NO: 577936 - DNA, 25 bp, Mus musculus
gcttgcttggttagcccagcagctt

SEQ ID NO: 577937 - DNA, 25 bp, Mus musculus
gcttgcttggtttgcccagcagctt

SEQ ID NO: 577938 - DNA, 25 bp, Mus musculus
gcttgctttactcaaacttctgctt

SEQ ID NO: 577939 - DNA, 25 bp, Mus musculus
gcttgctttactgaaacttctgctt

SEQ ID NO: 577940 - DNA, 25 bp, Mus musculus
gcttgctttagcaagaatggtctgt

SEQ ID NO: 577941 - DNA, 25 bp, Mus musculus
gcttgctttagcagaggtcctcttg

SEQ ID NO: 577942 - DNA, 25 bp, Mus musculus
gcttgctttagctagaatggtctgt

SEQ ID NO: 577943 - DNA, 25 bp, Mus musculus
gcttgctttagctgaggtcctcttg

SEQ ID NO: 577944 - DNA, 25 bp, Mus musculus
gcttgctttatgccatacccatcta

SEQ ID NO: 577945 - DNA, 25 bp, Mus musculus
gcttgctttatggcatacccatcta

SEQ ID NO: 577946 - DNA, 25 bp, Mus musculus
gcttgctttcacacaaatctatgga

SEQ ID NO: 577947 - DNA, 25 bp, Mus musculus
gcttgctttcactcaaatctatgga

SEQ ID NO: 577948 - DNA, 25 bp, Mus musculus
gcttgctttcgaaattgcggttgct

SEQ ID NO: 577949 - DNA, 25 bp, Mus musculus
gcttgctttcgatattgcggttgct

SEQ ID NO: 577950 - DNA, 25 bp, Mus musculus
gcttgctttcttagcgtgtcaggat

SEQ ID NO: 577951 - DNA, 25 bp, Mus musculus
gcttgctttcttctagaacttagta

SEQ ID NO: 577952 - DNA, 25 bp, Mus musculus
gcttgctttcttgtagaacttagta

SEQ ID NO: 577953 - DNA, 25 bp, Mus musculus
gcttgctttctttgcgtgtcaggat

SEQ ID NO: 577954 - DNA, 25 bp, Mus musculus
gcttgctttgagctaatgcacagga

SEQ ID NO: 577955 - DNA, 25 bp, Mus musculus
gcttgctttgaggtaatgcacagga

SEQ ID NO: 577956 - DNA, 25 bp, Mus musculus
gcttgctttgatagcgttgaaaaac

SEQ ID NO: 577957 - DNA, 25 bp, Mus musculus
gcttgctttgattgcgttgaaaaac

SEQ ID NO: 577958 - DNA, 25 bp, Mus musculus
gcttgctttggtattctttggtaat

SEQ ID NO: 577959 - DNA, 25 bp, Mus musculus
gcttgctttggttttctttggtaat

SEQ ID NO: 577960 - DNA, 25 bp, Mus musculus
gcttgcttttcaatctcagactgag

SEQ ID NO: 577961 - DNA, 25 bp, Mus musculus
gcttgcttttcattctcagactgag

SEQ ID NO: 577962 - DNA, 25 bp, Mus musculus
gcttgcttttccaaatggagatctt

SEQ ID NO: 577963 - DNA, 25 bp, Mus musculus
gcttgcttttcctaatggagatctt

SEQ ID NO: 577964 - DNA, 25 bp, Mus musculus
gcttgcttttctctagtcgttgaga

SEQ ID NO: 577965 - DNA, 25 bp, Mus musculus
gcttgcttttctgtagtcgttgaga

SEQ ID NO: 577966 - DNA, 25 bp, Mus musculus
gcttgctttttgatgcaaacttagt

SEQ ID NO: 577967 - DNA, 25 bp, Mus musculus
gcttgctttttgattccagtgctag

SEQ ID NO: 577968 - DNA, 25 bp, Mus musculus
gcttgctttttgttgcaaacttagt

SEQ ID NO: 577969 - DNA, 25 bp, Mus musculus
gcttgctttttgtttccagtgctag

SEQ ID NO: 577970 - DNA, 25 bp, Mus musculus
gcttggaaagatatcctgaaagctt

SEQ ID NO: 577971 - DNA, 25 bp, Mus musculus
gcttggaaagatttcctgaaagctt

SEQ ID NO: 577972 - DNA, 25 bp, Mus musculus
gcttggaaattactaccccagcttg

SEQ ID NO: 577973 - DNA, 25 bp, Mus musculus
gcttggaaattagtaccccagcttg

SEQ ID NO: 577974 - DNA, 25 bp, Mus musculus
gcttggaagaccaactcaagtgtta

SEQ ID NO: 577975 - DNA, 25 bp, Mus musculus
gcttggaagacctactcaagtgtta

SEQ ID NO: 577976 - DNA, 25 bp, Mus musculus
gcttggaagcacagagcatggcaga

SEQ ID NO: 577977 - DNA, 25 bp, Mus musculus
gcttggaagcactgagcatggcaga

SEQ ID NO: 577978 - DNA, 25 bp, Mus musculus
gcttggaagtgcacagctggctagt

SEQ ID NO: 577979 - DNA, 25 bp, Mus musculus
gcttggaagtgctcagctggctagt

SEQ ID NO: 577980 - DNA, 25 bp, Mus musculus
gcttggaatagtctagtttgtctct

SEQ ID NO: 577981 - DNA, 25 bp, Mus musculus
gcttggaatagtgtagtttgtctct

SEQ ID NO: 577982 - DNA, 25 bp, Mus musculus
gcttggaatcctatgataaaagtta

SEQ ID NO: 577983 - DNA, 25 bp, Mus musculus
gcttggaatcctttgataaaagtta

SEQ ID NO: 577984 - DNA, 25 bp, Mus musculus
gcttggaattgactcatggcccact

SEQ ID NO: 577985 - DNA, 25 bp, Mus musculus
gcttggaattgagtcatggcccact

SEQ ID NO: 577986 - DNA, 25 bp, Mus musculus
gcttggaattggaggatgtctacat

SEQ ID NO: 577987 - DNA, 25 bp, Mus musculus
gcttggaattggtggatgtctacat

SEQ ID NO: 577988 - DNA, 25 bp, Mus musculus
gcttggacacaacacctattgacaa

SEQ ID NO: 577989 - DNA, 25 bp, Mus musculus
gcttggacacaagacctattgacaa

SEQ ID NO: 577990 - DNA, 25 bp, Mus musculus
gcttggacctggctagtactgactg

SEQ ID NO: 577991 - DNA, 25 bp, Mus musculus
gcttggacctgggtagtactgactg

SEQ ID NO: 577992 - DNA, 25 bp, Mus musculus
gcttggacctttagctgggacctag

SEQ ID NO: 577993 - DNA, 25 bp, Mus musculus
gcttggacctttccagggaggccat

SEQ ID NO: 577994 - DNA, 25 bp, Mus musculus
gcttggacctttgcagggaggccat

SEQ ID NO: 577995 - DNA, 25 bp, Mus musculus
gcttggaccttttgctgggacctag

SEQ ID NO: 577996 - DNA, 25 bp, Mus musculus
gcttggactagaactggtaacttca

SEQ ID NO: 577997 - DNA, 25 bp, Mus musculus
gcttggactagatctggtaacttca

SEQ ID NO: 577998 - DNA, 25 bp, Mus musculus
gcttggactagtcaacatctctaac

SEQ ID NO: 577999 - DNA, 25 bp, Mus musculus
gcttggactagtgaacatctctaac

SEQ ID NO: 578000 - DNA, 25 bp, Mus musculus
gcttggactcagcagcagatttcat

SEQ ID NO: 578001 - DNA, 25 bp, Mus musculus
gcttggactcaggagcagatttcat

SEQ ID NO: 578002 - DNA, 25 bp, Mus musculus
gcttggactgcaccgactgagtgtt

SEQ ID NO: 578003 - DNA, 25 bp, Mus musculus
gcttggactgcagcgactgagtgtt

SEQ ID NO: 578004 - DNA, 25 bp, Mus musculus
gcttggactgctaagcccttccgtg

SEQ ID NO: 578005 - DNA, 25 bp, Mus musculus
gcttggactgcttagcccttccgtg

SEQ ID NO: 578006 - DNA, 25 bp, Mus musculus
gcttggagaagacacacataagaga

SEQ ID NO: 578007 - DNA, 25 bp, Mus musculus
gcttggagaagagacacataagaga

SEQ ID NO: 578008 - DNA, 25 bp, Mus musculus
gcttggagacatatcacatggcttt

SEQ ID NO: 578009 - DNA, 25 bp, Mus musculus
gcttggagacatttcacatggcttt

SEQ ID NO: 578010 - DNA, 25 bp, Mus musculus
gcttggagagcaaaggcacttcctc

SEQ ID NO: 578011 - DNA, 25 bp, Mus musculus
gcttggagagcataggcacttcctc

SEQ ID NO: 578012 - DNA, 25 bp, Mus musculus
gcttggagagttctattgctgtgat

SEQ ID NO: 578013 - DNA, 25 bp, Mus musculus
gcttggagagttgtattgctgtgat

SEQ ID NO: 578014 - DNA, 25 bp, Mus musculus
gcttggagcctgctgcagagccaac

SEQ ID NO: 578015 - DNA, 25 bp, Mus musculus
gcttggagcctggtgcagagccaac

SEQ ID NO: 578016 - DNA, 25 bp, Mus musculus
gcttggagcttgcacagtgtgtggt

SEQ ID NO: 578017 - DNA, 25 bp, Mus musculus
gcttggagcttggacagtgtgtggt

SEQ ID NO: 578018 - DNA, 25 bp, Mus musculus
gcttggagctttacaaggcacgtga

SEQ ID NO: 578019 - DNA, 25 bp, Mus musculus
gcttggagcttttcaaggcacgtga

SEQ ID NO: 578020 - DNA, 25 bp, Mus musculus
gcttggaggaggaagaacacttgct

SEQ ID NO: 578021 - DNA, 25 bp, Mus musculus
gcttggaggaggtagaacacttgct

SEQ ID NO: 578022 - DNA, 25 bp, Mus musculus
gcttggaggcatattgggcttgctt

SEQ ID NO: 578023 - DNA, 25 bp, Mus musculus
gcttggaggcattttgggcttgctt

SEQ ID NO: 578024 - DNA, 25 bp, Mus musculus
gcttggagtcagaattctttcagat

SEQ ID NO: 578025 - DNA, 25 bp, Mus musculus
gcttggagtcagtattctttcagat

SEQ ID NO: 578026 - DNA, 25 bp, Mus musculus
gcttggagtgtgctatgaacttgcc

SEQ ID NO: 578027 - DNA, 25 bp, Mus musculus
gcttggagtgtggtatgaacttgcc

SEQ ID NO: 578028 - DNA, 25 bp, Mus musculus
gcttggagtgttcttcctaataaac

SEQ ID NO: 578029 - DNA, 25 bp, Mus musculus
gcttggagtgttgttcctaataaac

SEQ ID NO: 578030 - DNA, 25 bp, Mus musculus
gcttggatagcacactctggctgaa

SEQ ID NO: 578031 - DNA, 25 bp, Mus musculus
gcttggatagcagactctggctgaa

SEQ ID NO: 578032 - DNA, 25 bp, Mus musculus
gcttggatcctcagagactcgtgta

SEQ ID NO: 578033 - DNA, 25 bp, Mus musculus
gcttggatcctctgagactcgtgta

SEQ ID NO: 578034 - DNA, 25 bp, Mus musculus
gcttggatcctgctcattataatat

SEQ ID NO: 578035 - DNA, 25 bp, Mus musculus
gcttggatcctggtcattataatat

SEQ ID NO: 578036 - DNA, 25 bp, Mus musculus
gcttggatccttctcctaagaagtt

SEQ ID NO: 578037 - DNA, 25 bp, Mus musculus
gcttggatccttgtcctaagaagtt

SEQ ID NO: 578038 - DNA, 25 bp, Mus musculus
gcttggatggttctactaatgcaca

SEQ ID NO: 578039 - DNA, 25 bp, Mus musculus
gcttggatggttgtactaatgcaca

SEQ ID NO: 578040 - DNA, 25 bp, Mus musculus
gcttggatttcgatctctagccaga

SEQ ID NO: 578041 - DNA, 25 bp, Mus musculus
gcttggatttcgttctctagccaga

SEQ ID NO: 578042 - DNA, 25 bp, Mus musculus
gcttggattttcacagggattgtac

SEQ ID NO: 578043 - DNA, 25 bp, Mus musculus
gcttggattttctcagggattgtac

SEQ ID NO: 578044 - DNA, 25 bp, Mus musculus
gcttggcaaacacaacacactgagt

SEQ ID NO: 578045 - DNA, 25 bp, Mus musculus
gcttggcaaacacctggccttgtgc

SEQ ID NO: 578046 - DNA, 25 bp, Mus musculus
gcttggcaaacagaacacactgagt

SEQ ID NO: 578047 - DNA, 25 bp, Mus musculus
gcttggcaaacagctggccttgtgc

SEQ ID NO: 578048 - DNA, 25 bp, Mus musculus
gcttggcaaactccttaatcttgtg

SEQ ID NO: 578049 - DNA, 25 bp, Mus musculus
gcttggcaaactgcttaatcttgtg

SEQ ID NO: 578050 - DNA, 25 bp, Mus musculus
gcttggcaagcaacctaccgttgag

SEQ ID NO: 578051 - DNA, 25 bp, Mus musculus
gcttggcaagcatcctaccgttgag

SEQ ID NO: 578052 - DNA, 25 bp, Mus musculus
gcttggcaagtgctgtgaccctgtt

SEQ ID NO: 578053 - DNA, 25 bp, Mus musculus
gcttggcaagtggtgtgaccctgtt

SEQ ID NO: 578054 - DNA, 25 bp, Mus musculus
gcttggcacaggctggacacttatg

SEQ ID NO: 578055 - DNA, 25 bp, Mus musculus
gcttggcacagggtggacacttatg

SEQ ID NO: 578056 - DNA, 25 bp, Mus musculus
gcttggcaccagaaacgcatgctgt

SEQ ID NO: 578057 - DNA, 25 bp, Mus musculus
gcttggcaccagtaacgcatgctgt

SEQ ID NO: 578058 - DNA, 25 bp, Mus musculus
gcttggcacctaccacggttaacaa

SEQ ID NO: 578059 - DNA, 25 bp, Mus musculus
gcttggcacctagcacggttaacaa

SEQ ID NO: 578060 - DNA, 25 bp, Mus musculus
gcttggcagagtaagtccccgcgcc

SEQ ID NO: 578061 - DNA, 25 bp, Mus musculus
gcttggcagagttagtccccgcgcc

SEQ ID NO: 578062 - DNA, 25 bp, Mus musculus
gcttggcagataatgttcagggctc

SEQ ID NO: 578063 - DNA, 25 bp, Mus musculus
gcttggcagatattgttcagggctc

SEQ ID NO: 578064 - DNA, 25 bp, Mus musculus
gcttggcagccaatcaggagtcagg

SEQ ID NO: 578065 - DNA, 25 bp, Mus musculus
gcttggcagccattcaggagtcagg

SEQ ID NO: 578066 - DNA, 25 bp, Mus musculus
gcttggcatatgaggtcctcattca

SEQ ID NO: 578067 - DNA, 25 bp, Mus musculus
gcttggcatatgtggtcctcattca

SEQ ID NO: 578068 - DNA, 25 bp, Mus musculus
gcttggcatccacttaaatcctagt

SEQ ID NO: 578069 - DNA, 25 bp, Mus musculus
gcttggcatccagttaaatcctagt

SEQ ID NO: 578070 - DNA, 25 bp, Mus musculus
gcttggcatgcccagcattcggtca

SEQ ID NO: 578071 - DNA, 25 bp, Mus musculus
gcttggcatgccgagcattcggtca

SEQ ID NO: 578072 - DNA, 25 bp, Mus musculus
gcttggcatggacatccgctcaata

SEQ ID NO: 578073 - DNA, 25 bp, Mus musculus
gcttggcatggagatccgctcaata

SEQ ID NO: 578074 - DNA, 25 bp, Mus musculus
gcttggcattgaatgacctgggtca

SEQ ID NO: 578075 - DNA, 25 bp, Mus musculus
gcttggcattgattgacctgggtca

SEQ ID NO: 578076 - DNA, 25 bp, Mus musculus
gcttggccacagacctgaggcaaaa

SEQ ID NO: 578077 - DNA, 25 bp, Mus musculus
gcttggccacagtcctgaggcaaaa

SEQ ID NO: 578078 - DNA, 25 bp, Mus musculus
gcttggccaccgcaaacatttagcg

SEQ ID NO: 578079 - DNA, 25 bp, Mus musculus
gcttggccaccggaaacatttagcg

SEQ ID NO: 578080 - DNA, 25 bp, Mus musculus
gcttggccagctatagcactttaga

SEQ ID NO: 578081 - DNA, 25 bp, Mus musculus
gcttggccagctttagcactttaga

SEQ ID NO: 578082 - DNA, 25 bp, Mus musculus
gcttggccccaacaacatctattgg

SEQ ID NO: 578083 - DNA, 25 bp, Mus musculus
gcttggccccaagaacatctattgg

SEQ ID NO: 578084 - DNA, 25 bp, Mus musculus
gcttggcccttcctttgtgattcag

SEQ ID NO: 578085 - DNA, 25 bp, Mus musculus
gcttggcccttcgtttgtgattcag

SEQ ID NO: 578086 - DNA, 25 bp, Mus musculus
gcttggccttcaatgacagtgtgct

SEQ ID NO: 578087 - DNA, 25 bp, Mus musculus
gcttggccttcattgacagtgtgct

SEQ ID NO: 578088 - DNA, 25 bp, Mus musculus
gcttggcctttacagccttgaggtt

SEQ ID NO: 578089 - DNA, 25 bp, Mus musculus
gcttggcctttagagccttgaggtt

SEQ ID NO: 578090 - DNA, 25 bp, Mus musculus
gcttggcgtctgcttaacgtctccc

SEQ ID NO: 578091 - DNA, 25 bp, Mus musculus
gcttggcgtctggttaacgtctccc

SEQ ID NO: 578092 - DNA, 25 bp, Mus musculus
gcttggctactcactcacagagaat

SEQ ID NO: 578093 - DNA, 25 bp, Mus musculus
gcttggctactctctcacagagaat

SEQ ID NO: 578094 - DNA, 25 bp, Mus musculus
gcttggctcctccagagcactcgaa

SEQ ID NO: 578095 - DNA, 25 bp, Mus musculus
gcttggctcctcgagagcactcgaa

SEQ ID NO: 578096 - DNA, 25 bp, Mus musculus
gcttggctgacaattacatcttctc

SEQ ID NO: 578097 - DNA, 25 bp, Mus musculus
gcttggctgacatttacatcttctc

SEQ ID NO: 578098 - DNA, 25 bp, Mus musculus
gcttggctgaccctgcagtggcatc

SEQ ID NO: 578099 - DNA, 25 bp, Mus musculus
gcttggctgaccgtgcagtggcatc

SEQ ID NO: 578100 - DNA, 25 bp, Mus musculus
gcttggctgagaagttttgtcttaa

SEQ ID NO: 578101 - DNA, 25 bp, Mus musculus
gcttggctgagatgttttgtcttaa

SEQ ID NO: 578102 - DNA, 25 bp, Mus musculus
gcttggctgagtccaccgaagatgt

SEQ ID NO: 578103 - DNA, 25 bp, Mus musculus
gcttggctgagtgcaccgaagatgt

SEQ ID NO: 578104 - DNA, 25 bp, Mus musculus
gcttggctggccaggacttatctag

SEQ ID NO: 578105 - DNA, 25 bp, Mus musculus
gcttggctggcctggacttatctag

SEQ ID NO: 578106 - DNA, 25 bp, Mus musculus
gcttggctgtgtatctgatctacaa

SEQ ID NO: 578107 - DNA, 25 bp, Mus musculus
gcttggctgtgtttctgatctacaa

SEQ ID NO: 578108 - DNA, 25 bp, Mus musculus
gcttggcttaacatagctgctctca

SEQ ID NO: 578109 - DNA, 25 bp, Mus musculus
gcttggcttaacttagctgctctca

SEQ ID NO: 578110 - DNA, 25 bp, Mus musculus
gcttggcttacaaactgagctaaag

SEQ ID NO: 578111 - DNA, 25 bp, Mus musculus
gcttggcttacatactgagctaaag

SEQ ID NO: 578112 - DNA, 25 bp, Mus musculus
gcttggcttagcctggtttcagttc

SEQ ID NO: 578113 - DNA, 25 bp, Mus musculus
gcttggcttagcgtggtttcagttc

SEQ ID NO: 578114 - DNA, 25 bp, Mus musculus
gcttggcttctcagcatgtggtcat

SEQ ID NO: 578115 - DNA, 25 bp, Mus musculus
gcttggcttctctgcatgtggtcat

SEQ ID NO: 578116 - DNA, 25 bp, Mus musculus
gcttggcttcttcccaggtgataca

SEQ ID NO: 578117 - DNA, 25 bp, Mus musculus
gcttggcttcttgccaggtgataca

SEQ ID NO: 578118 - DNA, 25 bp, Mus musculus
gcttggctttacagatggcattccc

SEQ ID NO: 578119 - DNA, 25 bp, Mus musculus
gcttggctttactgatggcattccc

SEQ ID NO: 578120 - DNA, 25 bp, Mus musculus
gcttggctttatcctaatcttggca

SEQ ID NO: 578121 - DNA, 25 bp, Mus musculus
gcttggctttatctttgtgtaggac

SEQ ID NO: 578122 - DNA, 25 bp, Mus musculus
gcttggctttatgctaatcttggca

SEQ ID NO: 578123 - DNA, 25 bp, Mus musculus
gcttggctttatgtttgtgtaggac

SEQ ID NO: 578124 - DNA, 25 bp, Mus musculus
gcttggctttcaatggtagcactga

SEQ ID NO: 578125 - DNA, 25 bp, Mus musculus
gcttggctttcattggtagcactga

SEQ ID NO: 578126 - DNA, 25 bp, Mus musculus
gcttggctttccagctgttggtagt

SEQ ID NO: 578127 - DNA, 25 bp, Mus musculus
gcttggctttcctgctgttggtagt

SEQ ID NO: 578128 - DNA, 25 bp, Mus musculus
gcttggcttttcctgttacaatctg

SEQ ID NO: 578129 - DNA, 25 bp, Mus musculus
gcttggcttttcgtgttacaatctg

SEQ ID NO: 578130 - DNA, 25 bp, Mus musculus
gcttgggaaccgacaagacagcttg

SEQ ID NO: 578131 - DNA, 25 bp, Mus musculus
gcttgggaaccgtcaagacagcttg

SEQ ID NO: 578132 - DNA, 25 bp, Mus musculus
gcttgggaagccaggatccttctgc

SEQ ID NO: 578133 - DNA, 25 bp, Mus musculus
gcttgggaagcctggatccttctgc

SEQ ID NO: 578134 - DNA, 25 bp, Mus musculus
gcttgggaatagcttttgccaataa

SEQ ID NO: 578135 - DNA, 25 bp, Mus musculus
gcttgggaataggttttgccaataa

SEQ ID NO: 578136 - DNA, 25 bp, Mus musculus
gcttgggagaaccactgcattcttt

SEQ ID NO: 578137 - DNA, 25 bp, Mus musculus
gcttgggagaacgactgcattcttt

SEQ ID NO: 578138 - DNA, 25 bp, Mus musculus
gcttgggagaatagtttcttccacc

SEQ ID NO: 578139 - DNA, 25 bp, Mus musculus
gcttgggagaattgtttcttccacc

SEQ ID NO: 578140 - DNA, 25 bp, Mus musculus
gcttgggagagcaacgcttagattt

SEQ ID NO: 578141 - DNA, 25 bp, Mus musculus
gcttgggagagctacgcttagattt

SEQ ID NO: 578142 - DNA, 25 bp, Mus musculus
gcttgggaggctcgcccttgttcat

SEQ ID NO: 578143 - DNA, 25 bp, Mus musculus
gcttgggaggctggcccttgttcat

SEQ ID NO: 578144 - DNA, 25 bp, Mus musculus
gcttgggatcatctgctcacctgca

SEQ ID NO: 578145 - DNA, 25 bp, Mus musculus
gcttgggatcatgtgctcacctgca

SEQ ID NO: 578146 - DNA, 25 bp, Mus musculus
gcttgggatcctactagatctctga

SEQ ID NO: 578147 - DNA, 25 bp, Mus musculus
gcttgggatccttctagatctctga

SEQ ID NO: 578148 - DNA, 25 bp, Mus musculus
gcttgggattaacttgcattctttt

SEQ ID NO: 578149 - DNA, 25 bp, Mus musculus
gcttgggattaagttgcattctttt

SEQ ID NO: 578150 - DNA, 25 bp, Mus musculus
gcttgggcaaatacactggagatat

SEQ ID NO: 578151 - DNA, 25 bp, Mus musculus
gcttgggcaaattcactggagatat

SEQ ID NO: 578152 - DNA, 25 bp, Mus musculus
gcttgggcaatgctctccggagata

SEQ ID NO: 578153 - DNA, 25 bp, Mus musculus
gcttgggcaatggtctccggagata

SEQ ID NO: 578154 - DNA, 25 bp, Mus musculus
gcttgggcagaaactttcacttaca

SEQ ID NO: 578155 - DNA, 25 bp, Mus musculus
gcttgggcagaatctttcacttaca

SEQ ID NO: 578156 - DNA, 25 bp, Mus musculus
gcttgggccacactatcacaggaca

SEQ ID NO: 578157 - DNA, 25 bp, Mus musculus
gcttgggccacagtatcacaggaca

SEQ ID NO: 578158 - DNA, 25 bp, Mus musculus
gcttgggccaccagagacagggctc

SEQ ID NO: 578159 - DNA, 25 bp, Mus musculus
gcttgggccacctgagacagggctc

SEQ ID NO: 578160 - DNA, 25 bp, Mus musculus
gcttgggccagcattgaacagtgct

SEQ ID NO: 578161 - DNA, 25 bp, Mus musculus
gcttgggccagctttgaacagtgct

SEQ ID NO: 578162 - DNA, 25 bp, Mus musculus
gcttgggccatcacaaatgcaactt

SEQ ID NO: 578163 - DNA, 25 bp, Mus musculus
gcttgggccatctcaaatgcaactt

SEQ ID NO: 578164 - DNA, 25 bp, Mus musculus
gcttgggcccctacttagaaaggag

SEQ ID NO: 578165 - DNA, 25 bp, Mus musculus
gcttgggccccttcttagaaaggag

SEQ ID NO: 578166 - DNA, 25 bp, Mus musculus
gcttgggcctttccagtaaactgaa

SEQ ID NO: 578167 - DNA, 25 bp, Mus musculus
gcttgggcctttgcagtaaactgaa

SEQ ID NO: 578168 - DNA, 25 bp, Mus musculus
gcttgggcgacaccggagacttcac

SEQ ID NO: 578169 - DNA, 25 bp, Mus musculus
gcttgggcgacagcggagacttcac

SEQ ID NO: 578170 - DNA, 25 bp, Mus musculus
gcttgggctaatcggagagggcttt

SEQ ID NO: 578171 - DNA, 25 bp, Mus musculus
gcttgggctaatgggagagggcttt

SEQ ID NO: 578172 - DNA, 25 bp, Mus musculus
gcttgggctacacacacattctcga

SEQ ID NO: 578173 - DNA, 25 bp, Mus musculus
gcttgggctacagacacattctcga

SEQ ID NO: 578174 - DNA, 25 bp, Mus musculus
gcttgggctataagtcaagaccctt

SEQ ID NO: 578175 - DNA, 25 bp, Mus musculus
gcttgggctatacaagatcctgtta

SEQ ID NO: 578176 - DNA, 25 bp, Mus musculus
gcttgggctatagaagatcctgtta

SEQ ID NO: 578177 - DNA, 25 bp, Mus musculus
gcttgggctatatgtcaagaccctt

SEQ ID NO: 578178 - DNA, 25 bp, Mus musculus
gcttgggctattaactgggcggtaa

SEQ ID NO: 578179 - DNA, 25 bp, Mus musculus
gcttgggctattaagaactgctgaa

SEQ ID NO: 578180 - DNA, 25 bp, Mus musculus
gcttgggctatttactgggcggtaa

SEQ ID NO: 578181 - DNA, 25 bp, Mus musculus
gcttgggctatttagaactgctgaa

SEQ ID NO: 578182 - DNA, 25 bp, Mus musculus
gcttgggctcaacttttgtgttcat

SEQ ID NO: 578183 - DNA, 25 bp, Mus musculus
gcttgggctcaagttttgtgttcat

SEQ ID NO: 578184 - DNA, 25 bp, Mus musculus
gcttgggctcacatctggacaaatg

SEQ ID NO: 578185 - DNA, 25 bp, Mus musculus
gcttgggctcacttctggacaaatg

SEQ ID NO: 578186 - DNA, 25 bp, Mus musculus
gcttgggctggaattcctcttgctt

SEQ ID NO: 578187 - DNA, 25 bp, Mus musculus
gcttgggctggatttcctcttgctt

SEQ ID NO: 578188 - DNA, 25 bp, Mus musculus
gcttgggtaccacttacaggacctg

SEQ ID NO: 578189 - DNA, 25 bp, Mus musculus
gcttgggtaccagttacaggacctg

SEQ ID NO: 578190 - DNA, 25 bp, Mus musculus
gcttgggtactaagtaacaatatgc

SEQ ID NO: 578191 - DNA, 25 bp, Mus musculus
gcttgggtactatgtaacaatatgc

SEQ ID NO: 578192 - DNA, 25 bp, Mus musculus
gcttgggtcaaactcttattcatct

SEQ ID NO: 578193 - DNA, 25 bp, Mus musculus
gcttgggtcaaagtcttattcatct

SEQ ID NO: 578194 - DNA, 25 bp, Mus musculus
gcttgggtcaggaatgccacctgga

SEQ ID NO: 578195 - DNA, 25 bp, Mus musculus
gcttgggtcaggtatgccacctgga

SEQ ID NO: 578196 - DNA, 25 bp, Mus musculus
gcttgggtcattatttcacatcttt

SEQ ID NO: 578197 - DNA, 25 bp, Mus musculus
gcttgggtcattttttcacatcttt

SEQ ID NO: 578198 - DNA, 25 bp, Mus musculus
gcttgggtgagaacagaccttgctt

SEQ ID NO: 578199 - DNA, 25 bp, Mus musculus
gcttgggtgagatcagaccttgctt

SEQ ID NO: 578200 - DNA, 25 bp, Mus musculus
gcttgggtggataatacttttccca

SEQ ID NO: 578201 - DNA, 25 bp, Mus musculus
gcttgggtggattatacttttccca

SEQ ID NO: 578202 - DNA, 25 bp, Mus musculus
gcttgggttatgatattggcaacga

SEQ ID NO: 578203 - DNA, 25 bp, Mus musculus
gcttgggttatgttattggcaacga

SEQ ID NO: 578204 - DNA, 25 bp, Mus musculus
gcttgggttcaactctagatggtaa

SEQ ID NO: 578205 - DNA, 25 bp, Mus musculus
gcttgggttcaagtctagatggtaa

SEQ ID NO: 578206 - DNA, 25 bp, Mus musculus
gcttgggttccgactgtagatttaa

SEQ ID NO: 578207 - DNA, 25 bp, Mus musculus
gcttgggttccgtctgtagatttaa

SEQ ID NO: 578208 - DNA, 25 bp, Mus musculus
gcttgggttgctattaaacgtggat

SEQ ID NO: 578209 - DNA, 25 bp, Mus musculus
gcttgggttgcttttaaacgtggat

SEQ ID NO: 578210 - DNA, 25 bp, Mus musculus
gcttggtaaattctttcctgccaga

SEQ ID NO: 578211 - DNA, 25 bp, Mus musculus
gcttggtaaattgtttcctgccaga

SEQ ID NO: 578212 - DNA, 25 bp, Mus musculus
gcttggtaacacagcaaagcacctc

SEQ ID NO: 578213 - DNA, 25 bp, Mus musculus
gcttggtaacactgcaaagcacctc

SEQ ID NO: 578214 - DNA, 25 bp, Mus musculus
gcttggtaagcactagtcttcgtat

SEQ ID NO: 578215 - DNA, 25 bp, Mus musculus
gcttggtaagcagtagtcttcgtat

SEQ ID NO: 578216 - DNA, 25 bp, Mus musculus
gcttggtaatctattgtatatcaca

SEQ ID NO: 578217 - DNA, 25 bp, Mus musculus
gcttggtaatcttttgtatatcaca

SEQ ID NO: 578218 - DNA, 25 bp, Mus musculus
gcttggtacgcaccaggtagtcaat

SEQ ID NO: 578219 - DNA, 25 bp, Mus musculus
gcttggtacgcagcaggtagtcaat

SEQ ID NO: 578220 - DNA, 25 bp, Mus musculus
gcttggtataagcacgcactgtagt

SEQ ID NO: 578221 - DNA, 25 bp, Mus musculus
gcttggtataaggacgcactgtagt

SEQ ID NO: 578222 - DNA, 25 bp, Mus musculus
gcttggtatcaactccaggtaaaac

SEQ ID NO: 578223 - DNA, 25 bp, Mus musculus
gcttggtatcaagtccaggtaaaac

SEQ ID NO: 578224 - DNA, 25 bp, Mus musculus
gcttggtatttgagctctgctttta

SEQ ID NO: 578225 - DNA, 25 bp, Mus musculus
gcttggtatttgtgctctgctttta

SEQ ID NO: 578226 - DNA, 25 bp, Mus musculus
gcttggtattttcctgttttcatga

SEQ ID NO: 578227 - DNA, 25 bp, Mus musculus
gcttggtattttgctgttttcatga

SEQ ID NO: 578228 - DNA, 25 bp, Mus musculus
gcttggtcaagcatactctagagca

SEQ ID NO: 578229 - DNA, 25 bp, Mus musculus
gcttggtcaagcttactctagagca

SEQ ID NO: 578230 - DNA, 25 bp, Mus musculus
gcttggtccttgctcaatgtgctgt

SEQ ID NO: 578231 - DNA, 25 bp, Mus musculus
gcttggtccttggtcaatgtgctgt

SEQ ID NO: 578232 - DNA, 25 bp, Mus musculus
gcttggtcgttcaatgttgtttatt

SEQ ID NO: 578233 - DNA, 25 bp, Mus musculus
gcttggtcgttctatgttgtttatt

SEQ ID NO: 578234 - DNA, 25 bp, Mus musculus
gcttggtctacacaggttgacagag

SEQ ID NO: 578235 - DNA, 25 bp, Mus musculus
gcttggtctacagaggttgacagag

SEQ ID NO: 578236 - DNA, 25 bp, Mus musculus
gcttggtctcatccgggacttgctg

SEQ ID NO: 578237 - DNA, 25 bp, Mus musculus
gcttggtctcatgcgggacttgctg

SEQ ID NO: 578238 - DNA, 25 bp, Mus musculus
gcttggtctccaatataagcttggt

SEQ ID NO: 578239 - DNA, 25 bp, Mus musculus
gcttggtctccattataagcttggt

SEQ ID NO: 578240 - DNA, 25 bp, Mus musculus
gcttggtctcccaaagtcctaagtc

SEQ ID NO: 578241 - DNA, 25 bp, Mus musculus
gcttggtctccctaagtcctaagtc

SEQ ID NO: 578242 - DNA, 25 bp, Mus musculus
gcttggtctgctattgtgtcatgga

SEQ ID NO: 578243 - DNA, 25 bp, Mus musculus
gcttggtctgcttttgtgtcatgga

SEQ ID NO: 578244 - DNA, 25 bp, Mus musculus
gcttggtcttggcttaaccacttcc

SEQ ID NO: 578245 - DNA, 25 bp, Mus musculus
gcttggtcttgggttaaccacttcc

SEQ ID NO: 578246 - DNA, 25 bp, Mus musculus
gcttggtcttgtccgggtacccatt

SEQ ID NO: 578247 - DNA, 25 bp, Mus musculus
gcttggtcttgtgcgggtacccatt

SEQ ID NO: 578248 - DNA, 25 bp, Mus musculus
gcttggtgacaaagtgcttgagaag

SEQ ID NO: 578249 - DNA, 25 bp, Mus musculus
gcttggtgacaatgtgcttgagaag

SEQ ID NO: 578250 - DNA, 25 bp, Mus musculus
gcttggtgactcaagataacctcgg

SEQ ID NO: 578251 - DNA, 25 bp, Mus musculus
gcttggtgactctagataacctcgg

SEQ ID NO: 578252 - DNA, 25 bp, Mus musculus
gcttggtgagacctgcttacataat

SEQ ID NO: 578253 - DNA, 25 bp, Mus musculus
gcttggtgagacgtgcttacataat

SEQ ID NO: 578254 - DNA, 25 bp, Mus musculus
gcttggtgagcaatctgttattttt

SEQ ID NO: 578255 - DNA, 25 bp, Mus musculus
gcttggtgagcattctgttattttt

SEQ ID NO: 578256 - DNA, 25 bp, Mus musculus
gcttggtgaggcataccagaggccc

SEQ ID NO: 578257 - DNA, 25 bp, Mus musculus
gcttggtgaggcttaccagaggccc

SEQ ID NO: 578258 - DNA, 25 bp, Mus musculus
gcttggtgcaacctggaggatccat

SEQ ID NO: 578259 - DNA, 25 bp, Mus musculus
gcttggtgcaacgtggaggatccat

SEQ ID NO: 578260 - DNA, 25 bp, Mus musculus
gcttggtgccatcgattatcctgtt

SEQ ID NO: 578261 - DNA, 25 bp, Mus musculus
gcttggtgccatggattatcctgtt

SEQ ID NO: 578262 - DNA, 25 bp, Mus musculus
gcttggtgccttatgctgcaggaac

SEQ ID NO: 578263 - DNA, 25 bp, Mus musculus
gcttggtgccttttgctgcaggaac

SEQ ID NO: 578264 - DNA, 25 bp, Mus musculus
gcttggtgcgggaaaattcctactt

SEQ ID NO: 578265 - DNA, 25 bp, Mus musculus
gcttggtgcgggtaaattcctactt

SEQ ID NO: 578266 - DNA, 25 bp, Mus musculus
gcttggtggtgaaacttggaagccc

SEQ ID NO: 578267 - DNA, 25 bp, Mus musculus
gcttggtggtgatacttggaagccc

SEQ ID NO: 578268 - DNA, 25 bp, Mus musculus
gcttggtggtttaaaagtgcatgct

SEQ ID NO: 578269 - DNA, 25 bp, Mus musculus
gcttggtggttttaaagtgcatgct

SEQ ID NO: 578270 - DNA, 25 bp, Mus musculus
gcttggtgtataaatgttactcaca

SEQ ID NO: 578271 - DNA, 25 bp, Mus musculus
gcttggtgtatatatgttactcaca

SEQ ID NO: 578272 - DNA, 25 bp, Mus musculus
gcttggtgtattcgcacatgtcttt

SEQ ID NO: 578273 - DNA, 25 bp, Mus musculus
gcttggtgtattggcacatgtcttt

SEQ ID NO: 578274 - DNA, 25 bp, Mus musculus
gcttggtgtctcagcatgacatgga

SEQ ID NO: 578275 - DNA, 25 bp, Mus musculus
gcttggtgtctctgcatgacatgga

SEQ ID NO: 578276 - DNA, 25 bp, Mus musculus
gcttggtgtggaagaggtccttaaa

SEQ ID NO: 578277 - DNA, 25 bp, Mus musculus
gcttggtgtggatgaggtccttaaa

SEQ ID NO: 578278 - DNA, 25 bp, Mus musculus
gcttggtgtgtgagttacggacaat

SEQ ID NO: 578279 - DNA, 25 bp, Mus musculus
gcttggtgtgtgtgttacggacaat

SEQ ID NO: 578280 - DNA, 25 bp, Mus musculus
gcttggtgttcacggccctcctgca

SEQ ID NO: 578281 - DNA, 25 bp, Mus musculus
gcttggtgttcagggccctcctgca

SEQ ID NO: 578282 - DNA, 25 bp, Mus musculus
gcttggtgttgtctgtgccccacta

SEQ ID NO: 578283 - DNA, 25 bp, Mus musculus
gcttggtgttgtgtgtgccccacta

SEQ ID NO: 578284 - DNA, 25 bp, Mus musculus
gcttggttacctcaattcccttata

SEQ ID NO: 578285 - DNA, 25 bp, Mus musculus
gcttggttacctgaattcccttata

SEQ ID NO: 578286 - DNA, 25 bp, Mus musculus
gcttggttactacgctgtatataga

SEQ ID NO: 578287 - DNA, 25 bp, Mus musculus
gcttggttactaggctgtatataga

SEQ ID NO: 578288 - DNA, 25 bp, Mus musculus
gcttggttagctcatgatgggcatt

SEQ ID NO: 578289 - DNA, 25 bp, Mus musculus
gcttggttagctgatgatgggcatt

SEQ ID NO: 578290 - DNA, 25 bp, Mus musculus
gcttggttccagaacattacgatga

SEQ ID NO: 578291 - DNA, 25 bp, Mus musculus
gcttggttccagtacattacgatga

SEQ ID NO: 578292 - DNA, 25 bp, Mus musculus
gcttggttgaacatcacaggaccct

SEQ ID NO: 578293 - DNA, 25 bp, Mus musculus
gcttggttgaacttcacaggaccct

SEQ ID NO: 578294 - DNA, 25 bp, Mus musculus
gcttggttgctgctttgtgttttgt

SEQ ID NO: 578295 - DNA, 25 bp, Mus musculus
gcttggttgctggtttgtgttttgt

SEQ ID NO: 578296 - DNA, 25 bp, Mus musculus
gcttggttgggcatgtgtttgaaat

SEQ ID NO: 578297 - DNA, 25 bp, Mus musculus
gcttggttgggcttgtgtttgaaat

SEQ ID NO: 578298 - DNA, 25 bp, Mus musculus
gcttggttgtagatgctcacacctg

SEQ ID NO: 578299 - DNA, 25 bp, Mus musculus
gcttggttgtagttgctcacacctg

SEQ ID NO: 578300 - DNA, 25 bp, Mus musculus
gcttggtttacacgacaacagccag

SEQ ID NO: 578301 - DNA, 25 bp, Mus musculus
gcttggtttacaggacaacagccag

SEQ ID NO: 578302 - DNA, 25 bp, Mus musculus
gcttggtttcatcccagataagtaa

SEQ ID NO: 578303 - DNA, 25 bp, Mus musculus
gcttggtttcatgccagataagtaa

SEQ ID NO: 578304 - DNA, 25 bp, Mus musculus
gcttggtttgacatttagttgtgac

SEQ ID NO: 578305 - DNA, 25 bp, Mus musculus
gcttggtttgacttttagttgtgac

SEQ ID NO: 578306 - DNA, 25 bp, Mus musculus
gcttggttttgcatttcatgacttt

SEQ ID NO: 578307 - DNA, 25 bp, Mus musculus
gcttggttttgcttttcatgacttt

SEQ ID NO: 578308 - DNA, 25 bp, Mus musculus
gcttgtaaagcgagcccatcatcaa

SEQ ID NO: 578309 - DNA, 25 bp, Mus musculus
gcttgtaaagcgtgcccatcatcaa

SEQ ID NO: 578310 - DNA, 25 bp, Mus musculus
gcttgtaaataaactgccagaattc

SEQ ID NO: 578311 - DNA, 25 bp, Mus musculus
gcttgtaaataatctgccagaattc

SEQ ID NO: 578312 - DNA, 25 bp, Mus musculus
gcttgtaaatgcataatctgtgccc

SEQ ID NO: 578313 - DNA, 25 bp, Mus musculus
gcttgtaaatgcttaatctgtgccc

SEQ ID NO: 578314 - DNA, 25 bp, Mus musculus
gcttgtaacagtactcctgcttcag

SEQ ID NO: 578315 - DNA, 25 bp, Mus musculus
gcttgtaacagttctcctgcttcag

SEQ ID NO: 578316 - DNA, 25 bp, Mus musculus
gcttgtaactatatgtgcttgtgac

SEQ ID NO: 578317 - DNA, 25 bp, Mus musculus
gcttgtaactatttgtgcttgtgac

SEQ ID NO: 578318 - DNA, 25 bp, Mus musculus
gcttgtaacttgatttgtgggcttt

SEQ ID NO: 578319 - DNA, 25 bp, Mus musculus
gcttgtaacttgttttgtgggcttt

SEQ ID NO: 578320 - DNA, 25 bp, Mus musculus
gcttgtaagatgacctgactctgta

SEQ ID NO: 578321 - DNA, 25 bp, Mus musculus
gcttgtaagatgtcctgactctgta

SEQ ID NO: 578322 - DNA, 25 bp, Mus musculus
gcttgtaatagcctggactctggga

SEQ ID NO: 578323 - DNA, 25 bp, Mus musculus
gcttgtaatagcgtggactctggga

SEQ ID NO: 578324 - DNA, 25 bp, Mus musculus
gcttgtaatctgctgttgaacaact

SEQ ID NO: 578325 - DNA, 25 bp, Mus musculus
gcttgtaatctggtgttgaacaact

SEQ ID NO: 578326 - DNA, 25 bp, Mus musculus
gcttgtaatgtcagtgttgctcttt

SEQ ID NO: 578327 - DNA, 25 bp, Mus musculus
gcttgtaatgtctgtgttgctcttt

SEQ ID NO: 578328 - DNA, 25 bp, Mus musculus
gcttgtaattccaataagacatgtt

SEQ ID NO: 578329 - DNA, 25 bp, Mus musculus
gcttgtaattcctataagacatgtt

SEQ ID NO: 578330 - DNA, 25 bp, Mus musculus
gcttgtaattttagcattcaggagt

SEQ ID NO: 578331 - DNA, 25 bp, Mus musculus
gcttgtaatttttgcattcaggagt

SEQ ID NO: 578332 - DNA, 25 bp, Mus musculus
gcttgtacattaagcagttgactgc

SEQ ID NO: 578333 - DNA, 25 bp, Mus musculus
gcttgtacattatgcagttgactgc

SEQ ID NO: 578334 - DNA, 25 bp, Mus musculus
gcttgtaccaaaatgcaggcacctc

SEQ ID NO: 578335 - DNA, 25 bp, Mus musculus
gcttgtaccaaattgcaggcacctc

SEQ ID NO: 578336 - DNA, 25 bp, Mus musculus
gcttgtacccaaactagtgatgtca

SEQ ID NO: 578337 - DNA, 25 bp, Mus musculus
gcttgtacccaatctagtgatgtca

SEQ ID NO: 578338 - DNA, 25 bp, Mus musculus
gcttgtacccataaagaccttgagg

SEQ ID NO: 578339 - DNA, 25 bp, Mus musculus
gcttgtacccattaagaccttgagg

SEQ ID NO: 578340 - DNA, 25 bp, Mus musculus
gcttgtaccccaaaagtagtctgtg

SEQ ID NO: 578341 - DNA, 25 bp, Mus musculus
gcttgtaccccataagtagtctgtg

SEQ ID NO: 578342 - DNA, 25 bp, Mus musculus
gcttgtaccgagcagccagtaagtg

SEQ ID NO: 578343 - DNA, 25 bp, Mus musculus
gcttgtaccgaggagccagtaagtg

SEQ ID NO: 578344 - DNA, 25 bp, Mus musculus
gcttgtacctgccatactttattta

SEQ ID NO: 578345 - DNA, 25 bp, Mus musculus
gcttgtacctgcgatactttattta

SEQ ID NO: 578346 - DNA, 25 bp, Mus musculus
gcttgtacgaggctcttgctgtaga

SEQ ID NO: 578347 - DNA, 25 bp, Mus musculus
gcttgtacgagggtcttgctgtaga

SEQ ID NO: 578348 - DNA, 25 bp, Mus musculus
gcttgtactaacaagagaccatgtt

SEQ ID NO: 578349 - DNA, 25 bp, Mus musculus
gcttgtactaactagagaccatgtt

SEQ ID NO: 578350 - DNA, 25 bp, Mus musculus
gcttgtactgtcatgaaattcttta

SEQ ID NO: 578351 - DNA, 25 bp, Mus musculus
gcttgtactgtcttgaaattcttta

SEQ ID NO: 578352 - DNA, 25 bp, Mus musculus
gcttgtaggctgctagtcatggcta

SEQ ID NO: 578353 - DNA, 25 bp, Mus musculus
gcttgtaggctggtagtcatggcta

SEQ ID NO: 578354 - DNA, 25 bp, Mus musculus
gcttgtagttgtagccaatgcagta

SEQ ID NO: 578355 - DNA, 25 bp, Mus musculus
gcttgtagttgttgccaatgcagta

SEQ ID NO: 578356 - DNA, 25 bp, Mus musculus
gcttgtatatagcttttatcatccc

SEQ ID NO: 578357 - DNA, 25 bp, Mus musculus
gcttgtatataggttttatcatccc

SEQ ID NO: 578358 - DNA, 25 bp, Mus musculus
gcttgtatcagacgacagtcacatg

SEQ ID NO: 578359 - DNA, 25 bp, Mus musculus
gcttgtatcagaggacagtcacatg

SEQ ID NO: 578360 - DNA, 25 bp, Mus musculus
gcttgtatctaaacttatggccgtc

SEQ ID NO: 578361 - DNA, 25 bp, Mus musculus
gcttgtatctaatcttatggccgtc

SEQ ID NO: 578362 - DNA, 25 bp, Mus musculus
gcttgtatgataattctttcggtgt

SEQ ID NO: 578363 - DNA, 25 bp, Mus musculus
gcttgtatgatatttctttcggtgt

SEQ ID NO: 578364 - DNA, 25 bp, Mus musculus
gcttgtatgcaaaccaaacgtgatt

SEQ ID NO: 578365 - DNA, 25 bp, Mus musculus
gcttgtatgcaatccaaacgtgatt

SEQ ID NO: 578366 - DNA, 25 bp, Mus musculus
gcttgtattatcactgtggtgggca

SEQ ID NO: 578367 - DNA, 25 bp, Mus musculus
gcttgtattatctctgtggtgggca

SEQ ID NO: 578368 - DNA, 25 bp, Mus musculus
gcttgtatttctaaatttggtaatg

SEQ ID NO: 578369 - DNA, 25 bp, Mus musculus
gcttgtatttcttaatttggtaatg

SEQ ID NO: 578370 - DNA, 25 bp, Mus musculus
gcttgtcaacaaccccacaaagata

SEQ ID NO: 578371 - DNA, 25 bp, Mus musculus
gcttgtcaacaagcccacaaagata

SEQ ID NO: 578372 - DNA, 25 bp, Mus musculus
gcttgtcaaggaaagtataccccaa

SEQ ID NO: 578373 - DNA, 25 bp, Mus musculus
gcttgtcaaggatagtataccccaa

SEQ ID NO: 578374 - DNA, 25 bp, Mus musculus
gcttgtcaagtcaccaaagttgcat

SEQ ID NO: 578375 - DNA, 25 bp, Mus musculus
gcttgtcaagtctccaaagttgcat

SEQ ID NO: 578376 - DNA, 25 bp, Mus musculus
gcttgtcacaaaaccacatactctt

SEQ ID NO: 578377 - DNA, 25 bp, Mus musculus
gcttgtcacaaatccacatactctt

SEQ ID NO: 578378 - DNA, 25 bp, Mus musculus
gcttgtcacagacaatttatttttt

SEQ ID NO: 578379 - DNA, 25 bp, Mus musculus
gcttgtcacagagaatttatttttt

SEQ ID NO: 578380 - DNA, 25 bp, Mus musculus
gcttgtcaccttagtctgatcaatg

SEQ ID NO: 578381 - DNA, 25 bp, Mus musculus
gcttgtcacctttgtctgatcaatg

SEQ ID NO: 578382 - DNA, 25 bp, Mus musculus
gcttgtcacggcactgggtggctaa

SEQ ID NO: 578383 - DNA, 25 bp, Mus musculus
gcttgtcacggctctgggtggctaa

SEQ ID NO: 578384 - DNA, 25 bp, Mus musculus
gcttgtcacttaagagagttagcca

SEQ ID NO: 578385 - DNA, 25 bp, Mus musculus
gcttgtcacttacaaatgccacgct

SEQ ID NO: 578386 - DNA, 25 bp, Mus musculus
gcttgtcacttagaaatgccacgct

SEQ ID NO: 578387 - DNA, 25 bp, Mus musculus
gcttgtcacttatgagagttagcca

SEQ ID NO: 578388 - DNA, 25 bp, Mus musculus
gcttgtcagattcaccatgctactt

SEQ ID NO: 578389 - DNA, 25 bp, Mus musculus
gcttgtcagattgaccatgctactt

SEQ ID NO: 578390 - DNA, 25 bp, Mus musculus
gcttgtcagtacaaggtcctggatt

SEQ ID NO: 578391 - DNA, 25 bp, Mus musculus
gcttgtcagtactaggtcctggatt

SEQ ID NO: 578392 - DNA, 25 bp, Mus musculus
gcttgtcagtcgatacagttactga

SEQ ID NO: 578393 - DNA, 25 bp, Mus musculus
gcttgtcagtcgttacagttactga

SEQ ID NO: 578394 - DNA, 25 bp, Mus musculus
gcttgtcataaaatgaggccagctt

SEQ ID NO: 578395 - DNA, 25 bp, Mus musculus
gcttgtcataaattgaggccagctt

SEQ ID NO: 578396 - DNA, 25 bp, Mus musculus
gcttgtcatcaacgggaagcccatc

SEQ ID NO: 578397 - DNA, 25 bp, Mus musculus
gcttgtcatcaaggggaagcccatc

SEQ ID NO: 578398 - DNA, 25 bp, Mus musculus
gcttgtcatctgcaagatccgagaa

SEQ ID NO: 578399 - DNA, 25 bp, Mus musculus
gcttgtcatctggaagatccgagaa

SEQ ID NO: 578400 - DNA, 25 bp, Mus musculus
gcttgtcatcttccagctgatagct

SEQ ID NO: 578401 - DNA, 25 bp, Mus musculus
gcttgtcatcttgcagctgatagct

SEQ ID NO: 578402 - DNA, 25 bp, Mus musculus
gcttgtcatgtcactggcacataac

SEQ ID NO: 578403 - DNA, 25 bp, Mus musculus
gcttgtcatgtctctggcacataac

SEQ ID NO: 578404 - DNA, 25 bp, Mus musculus
gcttgtcattttcctcactagtata

SEQ ID NO: 578405 - DNA, 25 bp, Mus musculus
gcttgtcattttgctcactagtata

SEQ ID NO: 578406 - DNA, 25 bp, Mus musculus
gcttgtccaaataccagtcaggctg

SEQ ID NO: 578407 - DNA, 25 bp, Mus musculus
gcttgtccaaattccagtcaggctg

SEQ ID NO: 578408 - DNA, 25 bp, Mus musculus
gcttgtccatttccctgtggagcca

SEQ ID NO: 578409 - DNA, 25 bp, Mus musculus
gcttgtccatttgcctgtggagcca

SEQ ID NO: 578410 - DNA, 25 bp, Mus musculus
gcttgtcccattccattttatgtca

SEQ ID NO: 578411 - DNA, 25 bp, Mus musculus
gcttgtcccattgcattttatgtca

SEQ ID NO: 578412 - DNA, 25 bp, Mus musculus
gcttgtcccttcctgttcatttttt

SEQ ID NO: 578413 - DNA, 25 bp, Mus musculus
gcttgtcccttcgtgttcatttttt

SEQ ID NO: 578414 - DNA, 25 bp, Mus musculus
gcttgtcctaaaatttgcccagcaa

SEQ ID NO: 578415 - DNA, 25 bp, Mus musculus
gcttgtcctaaattttgcccagcaa

SEQ ID NO: 578416 - DNA, 25 bp, Mus musculus
gcttgtcctaagagctatggcttta

SEQ ID NO: 578417 - DNA, 25 bp, Mus musculus
gcttgtcctaagtgctatggcttta

SEQ ID NO: 578418 - DNA, 25 bp, Mus musculus
gcttgtccttgtcatctaactaaca

SEQ ID NO: 578419 - DNA, 25 bp, Mus musculus
gcttgtccttgtgatctaactaaca

SEQ ID NO: 578420 - DNA, 25 bp, Mus musculus
gcttgtcgcgggagctgctttccat

SEQ ID NO: 578421 - DNA, 25 bp, Mus musculus
gcttgtcgcgggtgctgctttccat

SEQ ID NO: 578422 - DNA, 25 bp, Mus musculus
gcttgtcgtcttattcgctatatta

SEQ ID NO: 578423 - DNA, 25 bp, Mus musculus
gcttgtcgtctttttcgctatatta

SEQ ID NO: 578424 - DNA, 25 bp, Mus musculus
gcttgtctacttccagtttcgagtt

SEQ ID NO: 578425 - DNA, 25 bp, Mus musculus
gcttgtctacttgcagtttcgagtt

SEQ ID NO: 578426 - DNA, 25 bp, Mus musculus
gcttgtctagttcctgggagtcgct

SEQ ID NO: 578427 - DNA, 25 bp, Mus musculus
gcttgtctagttgctgggagtcgct

SEQ ID NO: 578428 - DNA, 25 bp, Mus musculus
gcttgtctatagatgtctgcagtac

SEQ ID NO: 578429 - DNA, 25 bp, Mus musculus
gcttgtctatagttgtctgcagtac

SEQ ID NO: 578430 - DNA, 25 bp, Mus musculus
gcttgtctatatcccacaactggtg

SEQ ID NO: 578431 - DNA, 25 bp, Mus musculus
gcttgtctatatgccacaactggtg

SEQ ID NO: 578432 - DNA, 25 bp, Mus musculus
gcttgtctcattatgactcttgaca

SEQ ID NO: 578433 - DNA, 25 bp, Mus musculus
gcttgtctcattatgggtcctgacc

SEQ ID NO: 578434 - DNA, 25 bp, Mus musculus
gcttgtctcattttgactcttgaca

SEQ ID NO: 578435 - DNA, 25 bp, Mus musculus
gcttgtctcattttgggtcctgacc

SEQ ID NO: 578436 - DNA, 25 bp, Mus musculus
gcttgtctctctattacttatctac

SEQ ID NO: 578437 - DNA, 25 bp, Mus musculus
gcttgtctctcttttacttatctac

SEQ ID NO: 578438 - DNA, 25 bp, Mus musculus
gcttgtctctgaacaaacttctttc

SEQ ID NO: 578439 - DNA, 25 bp, Mus musculus
gcttgtctctgatcaaacttctttc

SEQ ID NO: 578440 - DNA, 25 bp, Mus musculus
gcttgtctctggacccagatgtcat

SEQ ID NO: 578441 - DNA, 25 bp, Mus musculus
gcttgtctctggtcccagatgtcat

SEQ ID NO: 578442 - DNA, 25 bp, Mus musculus
gcttgtctgagaaactgacctgtac

SEQ ID NO: 578443 - DNA, 25 bp, Mus musculus
gcttgtctgagaccctggtaagagc

SEQ ID NO: 578444 - DNA, 25 bp, Mus musculus
gcttgtctgagagcctggtaagagc

SEQ ID NO: 578445 - DNA, 25 bp, Mus musculus
gcttgtctgagatactgacctgtac

SEQ ID NO: 578446 - DNA, 25 bp, Mus musculus
gcttgtctgcagactgtgcatttaa

SEQ ID NO: 578447 - DNA, 25 bp, Mus musculus
gcttgtctgcagtctgtgcatttaa

SEQ ID NO: 578448 - DNA, 25 bp, Mus musculus
gcttgtctgctgaaggaccatgaga

SEQ ID NO: 578449 - DNA, 25 bp, Mus musculus
gcttgtctgctgtaggaccatgaga

SEQ ID NO: 578450 - DNA, 25 bp, Mus musculus
gcttgtctggaacagccagggtcat

SEQ ID NO: 578451 - DNA, 25 bp, Mus musculus
gcttgtctggaaccaaatccctgga

SEQ ID NO: 578452 - DNA, 25 bp, Mus musculus
gcttgtctggaagagccagggtcat

SEQ ID NO: 578453 - DNA, 25 bp, Mus musculus
gcttgtctggaagcaaatccctgga

SEQ ID NO: 578454 - DNA, 25 bp, Mus musculus
gcttgtctgtgaagacgaccatggt

SEQ ID NO: 578455 - DNA, 25 bp, Mus musculus
gcttgtctgtgatgacgaccatggt

SEQ ID NO: 578456 - DNA, 25 bp, Mus musculus
gcttgtctgtttcctaatgtatttg

SEQ ID NO: 578457 - DNA, 25 bp, Mus musculus
gcttgtctgtttgctaatgtatttg

SEQ ID NO: 578458 - DNA, 25 bp, Mus musculus
gcttgtcttagacggcttttctttg

SEQ ID NO: 578459 - DNA, 25 bp, Mus musculus
gcttgtcttagagggcttttctttg

SEQ ID NO: 578460 - DNA, 25 bp, Mus musculus
gcttgtcttccactgctgtgtaaat

SEQ ID NO: 578461 - DNA, 25 bp, Mus musculus
gcttgtcttccagtgctgtgtaaat

SEQ ID NO: 578462 - DNA, 25 bp, Mus musculus
gcttgtcttcccagaccctgagaaa

SEQ ID NO: 578463 - DNA, 25 bp, Mus musculus
gcttgtcttccctgaccctgagaaa

SEQ ID NO: 578464 - DNA, 25 bp, Mus musculus
gcttgtcttcggaactcaacgggag

SEQ ID NO: 578465 - DNA, 25 bp, Mus musculus
gcttgtcttcggtactcaacgggag

SEQ ID NO: 578466 - DNA, 25 bp, Mus musculus
gcttgtcttgacatgtgactacaca

SEQ ID NO: 578467 - DNA, 25 bp, Mus musculus
gcttgtcttgacttgtgactacaca

SEQ ID NO: 578468 - DNA, 25 bp, Mus musculus
gcttgtcttgatagctgcctaggga

SEQ ID NO: 578469 - DNA, 25 bp, Mus musculus
gcttgtcttgattgctgcctaggga

SEQ ID NO: 578470 - DNA, 25 bp, Mus musculus
gcttgtcttgctctgcgagtgtgaa

SEQ ID NO: 578471 - DNA, 25 bp, Mus musculus
gcttgtcttgctgtgcgagtgtgaa

SEQ ID NO: 578472 - DNA, 25 bp, Mus musculus
gcttgtctttaaattagtctccagg

SEQ ID NO: 578473 - DNA, 25 bp, Mus musculus
gcttgtctttaatttagtctccagg

SEQ ID NO: 578474 - DNA, 25 bp, Mus musculus
gcttgtctttgtaatgttgcattca

SEQ ID NO: 578475 - DNA, 25 bp, Mus musculus
gcttgtctttgttatgttgcattca

SEQ ID NO: 578476 - DNA, 25 bp, Mus musculus
gcttgtcttttgagcactggcacta

SEQ ID NO: 578477 - DNA, 25 bp, Mus musculus
gcttgtcttttgtgcactggcacta

SEQ ID NO: 578478 - DNA, 25 bp, Mus musculus
gcttgtgaaacacctgcctctgagt

SEQ ID NO: 578479 - DNA, 25 bp, Mus musculus
gcttgtgaaacagctgcctctgagt

SEQ ID NO: 578480 - DNA, 25 bp, Mus musculus
gcttgtgaaattctgagtttacttt

SEQ ID NO: 578481 - DNA, 25 bp, Mus musculus
gcttgtgaaattgtgagtttacttt

SEQ ID NO: 578482 - DNA, 25 bp, Mus musculus
gcttgtgaagctcgataactcttta

SEQ ID NO: 578483 - DNA, 25 bp, Mus musculus
gcttgtgaagctggataactcttta

SEQ ID NO: 578484 - DNA, 25 bp, Mus musculus
gcttgtgaatcaactcaaaggcagt

SEQ ID NO: 578485 - DNA, 25 bp, Mus musculus
gcttgtgaatcatctcaaaggcagt

SEQ ID NO: 578486 - DNA, 25 bp, Mus musculus
gcttgtgacaaacagcagaggtgat

SEQ ID NO: 578487 - DNA, 25 bp, Mus musculus
gcttgtgacaaagagcagaggtgat

SEQ ID NO: 578488 - DNA, 25 bp, Mus musculus
gcttgtgacacacacgtttccagta

SEQ ID NO: 578489 - DNA, 25 bp, Mus musculus
gcttgtgacacagacgtttccagta

SEQ ID NO: 578490 - DNA, 25 bp, Mus musculus
gcttgtgaccatagccttgggcaat

SEQ ID NO: 578491 - DNA, 25 bp, Mus musculus
gcttgtgaccattgccttgggcaat

SEQ ID NO: 578492 - DNA, 25 bp, Mus musculus
gcttgtgaccctaataaattccaaa

SEQ ID NO: 578493 - DNA, 25 bp, Mus musculus
gcttgtgacccttataaattccaaa

SEQ ID NO: 578494 - DNA, 25 bp, Mus musculus
gcttgtgaccttatacgtcattgtt

SEQ ID NO: 578495 - DNA, 25 bp, Mus musculus
gcttgtgaccttttacgtcattgtt

SEQ ID NO: 578496 - DNA, 25 bp, Mus musculus
gcttgtgagaacagtgccagcctga

SEQ ID NO: 578497 - DNA, 25 bp, Mus musculus
gcttgtgagaactgtgccagcctga

SEQ ID NO: 578498 - DNA, 25 bp, Mus musculus
gcttgtgagctccaggcagaacctt

SEQ ID NO: 578499 - DNA, 25 bp, Mus musculus
gcttgtgagctcgaggcagaacctt

SEQ ID NO: 578500 - DNA, 25 bp, Mus musculus
gcttgtgatgagctcttttatccac

SEQ ID NO: 578501 - DNA, 25 bp, Mus musculus
gcttgtgatgaggtcttttatccac

SEQ ID NO: 578502 - DNA, 25 bp, Mus musculus
gcttgtgattttaccctctggttta

SEQ ID NO: 578503 - DNA, 25 bp, Mus musculus
gcttgtgatttttccctctggttta

SEQ ID NO: 578504 - DNA, 25 bp, Mus musculus
gcttgtgcaaatcggaactgtcttt

SEQ ID NO: 578505 - DNA, 25 bp, Mus musculus
gcttgtgcaaatgggaactgtcttt

SEQ ID NO: 578506 - DNA, 25 bp, Mus musculus
gcttgtgcacagatgacgacagccc

SEQ ID NO: 578507 - DNA, 25 bp, Mus musculus
gcttgtgcacagttgacgacagccc

SEQ ID NO: 578508 - DNA, 25 bp, Mus musculus
gcttgtgcacatagtagaccctcct

SEQ ID NO: 578509 - DNA, 25 bp, Mus musculus
gcttgtgcacattgtagaccctcct

SEQ ID NO: 578510 - DNA, 25 bp, Mus musculus
gcttgtgcagccacggggtcctctt

SEQ ID NO: 578511 - DNA, 25 bp, Mus musculus
gcttgtgcagcctcggggtcctctt

SEQ ID NO: 578512 - DNA, 25 bp, Mus musculus
gcttgtgcagtcatcactttataga

SEQ ID NO: 578513 - DNA, 25 bp, Mus musculus
gcttgtgcagtcttcactttataga

SEQ ID NO: 578514 - DNA, 25 bp, Mus musculus
gcttgtgcatatcttctgttaagtt

SEQ ID NO: 578515 - DNA, 25 bp, Mus musculus
gcttgtgcatatgttctgttaagtt

SEQ ID NO: 578516 - DNA, 25 bp, Mus musculus
gcttgtgcccaaatgtaacactcca

SEQ ID NO: 578517 - DNA, 25 bp, Mus musculus
gcttgtgcccaattgtaacactcca

SEQ ID NO: 578518 - DNA, 25 bp, Mus musculus
gcttgtgcgggaagtacaaaggaat

SEQ ID NO: 578519 - DNA, 25 bp, Mus musculus
gcttgtgcgggatgtacaaaggaat

SEQ ID NO: 578520 - DNA, 25 bp, Mus musculus
gcttgtgctaaccacctgttctggg

SEQ ID NO: 578521 - DNA, 25 bp, Mus musculus
gcttgtgctaacgacctgttctggg

SEQ ID NO: 578522 - DNA, 25 bp, Mus musculus
gcttgtgctactctgatatctgttt

SEQ ID NO: 578523 - DNA, 25 bp, Mus musculus
gcttgtgctactgtgatatctgttt

SEQ ID NO: 578524 - DNA, 25 bp, Mus musculus
gcttgtgctccaaccaaatcatttg

SEQ ID NO: 578525 - DNA, 25 bp, Mus musculus
gcttgtgctccatccaaatcatttg

SEQ ID NO: 578526 - DNA, 25 bp, Mus musculus
gcttgtgctgccatgactgttatct

SEQ ID NO: 578527 - DNA, 25 bp, Mus musculus
gcttgtgctgccttgactgttatct

SEQ ID NO: 578528 - DNA, 25 bp, Mus musculus
gcttgtgcttctctagggttgctga

SEQ ID NO: 578529 - DNA, 25 bp, Mus musculus
gcttgtgcttctgtagggttgctga

SEQ ID NO: 578530 - DNA, 25 bp, Mus musculus
gcttgtggaaggactttccttcttc

SEQ ID NO: 578531 - DNA, 25 bp, Mus musculus
gcttgtggaaggctacctgaattca

SEQ ID NO: 578532 - DNA, 25 bp, Mus musculus
gcttgtggaagggtacctgaattca

SEQ ID NO: 578533 - DNA, 25 bp, Mus musculus
gcttgtggaaggtctttccttcttc

SEQ ID NO: 578534 - DNA, 25 bp, Mus musculus
gcttgtggacagattagatcctttt

SEQ ID NO: 578535 - DNA, 25 bp, Mus musculus
gcttgtggacagtttagatcctttt

SEQ ID NO: 578536 - DNA, 25 bp, Mus musculus
gcttgtggagctaatcctttcgcat

SEQ ID NO: 578537 - DNA, 25 bp, Mus musculus
gcttgtggagcttatcctttcgcat

SEQ ID NO: 578538 - DNA, 25 bp, Mus musculus
gcttgtggatgaacaggccctgttt

SEQ ID NO: 578539 - DNA, 25 bp, Mus musculus
gcttgtggatgatcaggccctgttt

SEQ ID NO: 578540 - DNA, 25 bp, Mus musculus
gcttgtggatgtagcctggcttcat

SEQ ID NO: 578541 - DNA, 25 bp, Mus musculus
gcttgtggatgttgcctggcttcat

SEQ ID NO: 578542 - DNA, 25 bp, Mus musculus
gcttgtggcaatccaacttcaggtt

SEQ ID NO: 578543 - DNA, 25 bp, Mus musculus
gcttgtggcaatgcaacttcaggtt

SEQ ID NO: 578544 - DNA, 25 bp, Mus musculus
gcttgtggcattaactactgtggtg

SEQ ID NO: 578545 - DNA, 25 bp, Mus musculus
gcttgtggcatttactactgtggtg

SEQ ID NO: 578546 - DNA, 25 bp, Mus musculus
gcttgtggccctactttaatattag

SEQ ID NO: 578547 - DNA, 25 bp, Mus musculus
gcttgtggcccttctttaatattag

SEQ ID NO: 578548 - DNA, 25 bp, Mus musculus
gcttgtggctacaaagcgtttgata

SEQ ID NO: 578549 - DNA, 25 bp, Mus musculus
gcttgtggctactaagcgtttgata

SEQ ID NO: 578550 - DNA, 25 bp, Mus musculus
gcttgtggctcccagagagaatatt

SEQ ID NO: 578551 - DNA, 25 bp, Mus musculus
gcttgtggctccgagagagaatatt

SEQ ID NO: 578552 - DNA, 25 bp, Mus musculus
gcttgtgggactagcacggctgcat

SEQ ID NO: 578553 - DNA, 25 bp, Mus musculus
gcttgtgggacttgcacggctgcat

SEQ ID NO: 578554 - DNA, 25 bp, Mus musculus
gcttgtgggatactacaggtcagaa

SEQ ID NO: 578555 - DNA, 25 bp, Mus musculus
gcttgtgggatagtacaggtcagaa

SEQ ID NO: 578556 - DNA, 25 bp, Mus musculus
gcttgtgggattcgtcatctccttc

SEQ ID NO: 578557 - DNA, 25 bp, Mus musculus
gcttgtgggattggtcatctccttc

SEQ ID NO: 578558 - DNA, 25 bp, Mus musculus
gcttgtgggcagacttggcttcaac

SEQ ID NO: 578559 - DNA, 25 bp, Mus musculus
gcttgtgggcagtcttggcttcaac

SEQ ID NO: 578560 - DNA, 25 bp, Mus musculus
gcttgtgggctcagaaaacttgtgc

SEQ ID NO: 578561 - DNA, 25 bp, Mus musculus
gcttgtgggctctgaaaacttgtgc

SEQ ID NO: 578562 - DNA, 25 bp, Mus musculus
gcttgtggtagcagtgatttctttc

SEQ ID NO: 578563 - DNA, 25 bp, Mus musculus
gcttgtggtagctgtgatttctttc

SEQ ID NO: 578564 - DNA, 25 bp, Mus musculus
gcttgtggtgtgacacttaagcaca

SEQ ID NO: 578565 - DNA, 25 bp, Mus musculus
gcttgtggtgtgtcacttaagcaca

SEQ ID NO: 578566 - DNA, 25 bp, Mus musculus
gcttgtggtgttaatagcttgtcaa

SEQ ID NO: 578567 - DNA, 25 bp, Mus musculus
gcttgtggtgtttatagcttgtcaa

SEQ ID NO: 578568 - DNA, 25 bp, Mus musculus
gcttgtggtttaatgctttgactca

SEQ ID NO: 578569 - DNA, 25 bp, Mus musculus
gcttgtggtttattgctttgactca

SEQ ID NO: 578570 - DNA, 25 bp, Mus musculus
gcttgtgtaactctgctcataggta

SEQ ID NO: 578571 - DNA, 25 bp, Mus musculus
gcttgtgtaactgtgctcataggta

SEQ ID NO: 578572 - DNA, 25 bp, Mus musculus
gcttgtgtcccgcaaacttgaggat

SEQ ID NO: 578573 - DNA, 25 bp, Mus musculus
gcttgtgtcccggaaacttgaggat

SEQ ID NO: 578574 - DNA, 25 bp, Mus musculus
gcttgtgtctggacgtatacgtcaa

SEQ ID NO: 578575 - DNA, 25 bp, Mus musculus
gcttgtgtctggtcgtatacgtcaa

SEQ ID NO: 578576 - DNA, 25 bp, Mus musculus
gcttgtgtcttgatgtcatgcatgt

SEQ ID NO: 578577 - DNA, 25 bp, Mus musculus
gcttgtgtcttgttgtcatgcatgt

SEQ ID NO: 578578 - DNA, 25 bp, Mus musculus
gcttgtgtgaaaccaaggctgtgcc

SEQ ID NO: 578579 - DNA, 25 bp, Mus musculus
gcttgtgtgaaagcaaggctgtgcc

SEQ ID NO: 578580 - DNA, 25 bp, Mus musculus
gcttgtgtgataacttcaacctctg

SEQ ID NO: 578581 - DNA, 25 bp, Mus musculus
gcttgtgtgatatcttcaacctctg

SEQ ID NO: 578582 - DNA, 25 bp, Mus musculus
gcttgtgtgcccctagcttacatgc

SEQ ID NO: 578583 - DNA, 25 bp, Mus musculus
gcttgtgtgcccgtagcttacatgc

SEQ ID NO: 578584 - DNA, 25 bp, Mus musculus
gcttgtgtggacagtgtgtttctat

SEQ ID NO: 578585 - DNA, 25 bp, Mus musculus
gcttgtgtggactgtgtgtttctat

SEQ ID NO: 578586 - DNA, 25 bp, Mus musculus
gcttgtgtggagatttggccttcta

SEQ ID NO: 578587 - DNA, 25 bp, Mus musculus
gcttgtgtggagttttggccttcta

SEQ ID NO: 578588 - DNA, 25 bp, Mus musculus
gcttgtgtggcaaagcccatgtgta

SEQ ID NO: 578589 - DNA, 25 bp, Mus musculus
gcttgtgtggcatagcccatgtgta

SEQ ID NO: 578590 - DNA, 25 bp, Mus musculus
gcttgtgtggtaccctcagtagcaa

SEQ ID NO: 578591 - DNA, 25 bp, Mus musculus
gcttgtgtggtagcctcagtagcaa

SEQ ID NO: 578592 - DNA, 25 bp, Mus musculus
gcttgtgtggtcagcactctataat

SEQ ID NO: 578593 - DNA, 25 bp, Mus musculus
gcttgtgtggtctgcactctataat

SEQ ID NO: 578594 - DNA, 25 bp, Mus musculus
gcttgtgttccaatctcagatctac

SEQ ID NO: 578595 - DNA, 25 bp, Mus musculus
gcttgtgttccattctcagatctac

SEQ ID NO: 578596 - DNA, 25 bp, Mus musculus
gcttgtgttcggagcatctgcaaca

SEQ ID NO: 578597 - DNA, 25 bp, Mus musculus
gcttgtgttcggtgcatctgcaaca

SEQ ID NO: 578598 - DNA, 25 bp, Mus musculus
gcttgtgttgaaattctcccatttt

SEQ ID NO: 578599 - DNA, 25 bp, Mus musculus
gcttgtgttgaatttctcccatttt

SEQ ID NO: 578600 - DNA, 25 bp, Mus musculus
gcttgtgtttataactgcttgaggt

SEQ ID NO: 578601 - DNA, 25 bp, Mus musculus
gcttgtgtttattactgcttgaggt

SEQ ID NO: 578602 - DNA, 25 bp, Mus musculus
gcttgtgtttgcctttttgttgagg

SEQ ID NO: 578603 - DNA, 25 bp, Mus musculus
gcttgtgtttgcgtttttgttgagg

SEQ ID NO: 578604 - DNA, 25 bp, Mus musculus
gcttgttaatctagctcatcttgct

SEQ ID NO: 578605 - DNA, 25 bp, Mus musculus
gcttgttaatcttgctcatcttgct

SEQ ID NO: 578606 - DNA, 25 bp, Mus musculus
gcttgttaattcactctatctcttt

SEQ ID NO: 578607 - DNA, 25 bp, Mus musculus
gcttgttaattctctctatctcttt

SEQ ID NO: 578608 - DNA, 25 bp, Mus musculus
gcttgttactacaggagaggtctcc

SEQ ID NO: 578609 - DNA, 25 bp, Mus musculus
gcttgttactactggagaggtctcc

SEQ ID NO: 578610 - DNA, 25 bp, Mus musculus
gcttgttactttctgagttgttgtc

SEQ ID NO: 578611 - DNA, 25 bp, Mus musculus
gcttgttactttgtgagttgttgtc

SEQ ID NO: 578612 - DNA, 25 bp, Mus musculus
gcttgttagagtagggactgctgat

SEQ ID NO: 578613 - DNA, 25 bp, Mus musculus
gcttgttagagttgggactgctgat

SEQ ID NO: 578614 - DNA, 25 bp, Mus musculus
gcttgttagcagaacttacatacat

SEQ ID NO: 578615 - DNA, 25 bp, Mus musculus
gcttgttagcagtacttacatacat

SEQ ID NO: 578616 - DNA, 25 bp, Mus musculus
gcttgttaggacaaagtattcctga

SEQ ID NO: 578617 - DNA, 25 bp, Mus musculus
gcttgttaggactaagtattcctga

SEQ ID NO: 578618 - DNA, 25 bp, Mus musculus
gcttgttagttgaccttggcatatt

SEQ ID NO: 578619 - DNA, 25 bp, Mus musculus
gcttgttagttgtccttggcatatt

SEQ ID NO: 578620 - DNA, 25 bp, Mus musculus
gcttgttatccaccacagggccctg

SEQ ID NO: 578621 - DNA, 25 bp, Mus musculus
gcttgttatccagcacagggccctg

SEQ ID NO: 578622 - DNA, 25 bp, Mus musculus
gcttgttatgcacccatgaagacat

SEQ ID NO: 578623 - DNA, 25 bp, Mus musculus
gcttgttatgcagccatgaagacat

SEQ ID NO: 578624 - DNA, 25 bp, Mus musculus
gcttgttatttcactcactagtgga

SEQ ID NO: 578625 - DNA, 25 bp, Mus musculus
gcttgttatttctctcactagtgga

SEQ ID NO: 578626 - DNA, 25 bp, Mus musculus
gcttgttcaacaatgcagccgacag

SEQ ID NO: 578627 - DNA, 25 bp, Mus musculus
gcttgttcaacattgcagccgacag

SEQ ID NO: 578628 - DNA, 25 bp, Mus musculus
gcttgttcaattatcctgcctgtaa

SEQ ID NO: 578629 - DNA, 25 bp, Mus musculus
gcttgttcaattttcctgcctgtaa

SEQ ID NO: 578630 - DNA, 25 bp, Mus musculus
gcttgttcacaaccctctggctgga

SEQ ID NO: 578631 - DNA, 25 bp, Mus musculus
gcttgttcacaagcctctggctgga

SEQ ID NO: 578632 - DNA, 25 bp, Mus musculus
gcttgttcacaccacctagaaataa

SEQ ID NO: 578633 - DNA, 25 bp, Mus musculus
gcttgttcacacgacctagaaataa

SEQ ID NO: 578634 - DNA, 25 bp, Mus musculus
gcttgttcactcagcatacacacat

SEQ ID NO: 578635 - DNA, 25 bp, Mus musculus
gcttgttcactctgcatacacacat

SEQ ID NO: 578636 - DNA, 25 bp, Mus musculus
gcttgttcagcaaaacacagttata

SEQ ID NO: 578637 - DNA, 25 bp, Mus musculus
gcttgttcagcataacacagttata

SEQ ID NO: 578638 - DNA, 25 bp, Mus musculus
gcttgttcagctacttatgacacat

SEQ ID NO: 578639 - DNA, 25 bp, Mus musculus
gcttgttcagcttcttatgacacat

SEQ ID NO: 578640 - DNA, 25 bp, Mus musculus
gcttgttcccacatcagtttgagaa

SEQ ID NO: 578641 - DNA, 25 bp, Mus musculus
gcttgttcccacttcagtttgagaa

SEQ ID NO: 578642 - DNA, 25 bp, Mus musculus
gcttgttcccatcgagtatgtcggc

SEQ ID NO: 578643 - DNA, 25 bp, Mus musculus
gcttgttcccatggagtatgtcggc

SEQ ID NO: 578644 - DNA, 25 bp, Mus musculus
gcttgttcctgtaactacacaaata

SEQ ID NO: 578645 - DNA, 25 bp, Mus musculus
gcttgttcctgtatgatcatacgag

SEQ ID NO: 578646 - DNA, 25 bp, Mus musculus
gcttgttcctgttactacacaaata

SEQ ID NO: 578647 - DNA, 25 bp, Mus musculus
gcttgttcctgtttgatcatacgag

SEQ ID NO: 578648 - DNA, 25 bp, Mus musculus
gcttgttcgcgaccttacttgcaca

SEQ ID NO: 578649 - DNA, 25 bp, Mus musculus
gcttgttcgcgagcttacttgcaca

SEQ ID NO: 578650 - DNA, 25 bp, Mus musculus
gcttgttcgcttattgttttctaga

SEQ ID NO: 578651 - DNA, 25 bp, Mus musculus
gcttgttcgctttttgttttctaga

SEQ ID NO: 578652 - DNA, 25 bp, Mus musculus
gcttgttctacaagttttcctgaag

SEQ ID NO: 578653 - DNA, 25 bp, Mus musculus
gcttgttctacatgttttcctgaag

SEQ ID NO: 578654 - DNA, 25 bp, Mus musculus
gcttgttcttatatatgggtctcat

SEQ ID NO: 578655 - DNA, 25 bp, Mus musculus
gcttgttcttatttatgggtctcat

SEQ ID NO: 578656 - DNA, 25 bp, Mus musculus
gcttgttcttctcgcgggcatagaa

SEQ ID NO: 578657 - DNA, 25 bp, Mus musculus
gcttgttcttctggcgggcatagaa

SEQ ID NO: 578658 - DNA, 25 bp, Mus musculus
gcttgttgaactacgatcaagtaac

SEQ ID NO: 578659 - DNA, 25 bp, Mus musculus
gcttgttgaacttcgatcaagtaac

SEQ ID NO: 578660 - DNA, 25 bp, Mus musculus
gcttgttgaagcaggaaccgcgtga

SEQ ID NO: 578661 - DNA, 25 bp, Mus musculus
gcttgttgaagctggaaccgcgtga

SEQ ID NO: 578662 - DNA, 25 bp, Mus musculus
gcttgttgactcactcagagggcaa

SEQ ID NO: 578663 - DNA, 25 bp, Mus musculus
gcttgttgactctctcagagggcaa

SEQ ID NO: 578664 - DNA, 25 bp, Mus musculus
gcttgttgagctcatgtaaatgcct

SEQ ID NO: 578665 - DNA, 25 bp, Mus musculus
gcttgttgagctgatgtaaatgcct

SEQ ID NO: 578666 - DNA, 25 bp, Mus musculus
gcttgttgcagactttgctgacctg

SEQ ID NO: 578667 - DNA, 25 bp, Mus musculus
gcttgttgcagagtttgctgacctg

SEQ ID NO: 578668 - DNA, 25 bp, Mus musculus
gcttgttgccaacttagtctccagc

SEQ ID NO: 578669 - DNA, 25 bp, Mus musculus
gcttgttgccaagttagtctccagc

SEQ ID NO: 578670 - DNA, 25 bp, Mus musculus
gcttgttgccctctgaatatattaa

SEQ ID NO: 578671 - DNA, 25 bp, Mus musculus
gcttgttgccctgtgaatatattaa

SEQ ID NO: 578672 - DNA, 25 bp, Mus musculus
gcttgttgcctgcttacctgcctga

SEQ ID NO: 578673 - DNA, 25 bp, Mus musculus
gcttgttgcctggttacctgcctga

SEQ ID NO: 578674 - DNA, 25 bp, Mus musculus
gcttgttgctcaacctctgtgagat

SEQ ID NO: 578675 - DNA, 25 bp, Mus musculus
gcttgttgctcatcctctgtgagat

SEQ ID NO: 578676 - DNA, 25 bp, Mus musculus
gcttgttggcttaggatgctcttac

SEQ ID NO: 578677 - DNA, 25 bp, Mus musculus
gcttgttggctttggatgctcttac

SEQ ID NO: 578678 - DNA, 25 bp, Mus musculus
gcttgttgtatgagtgtaacccaaa

SEQ ID NO: 578679 - DNA, 25 bp, Mus musculus
gcttgttgtatgtgtgtaacccaaa

SEQ ID NO: 578680 - DNA, 25 bp, Mus musculus
gcttgttgtctgagtgttgttttgt

SEQ ID NO: 578681 - DNA, 25 bp, Mus musculus
gcttgttgtctgtgtgttgttttgt

SEQ ID NO: 578682 - DNA, 25 bp, Mus musculus
gcttgttgttaacgctttgctttcc

SEQ ID NO: 578683 - DNA, 25 bp, Mus musculus
gcttgttgttaaggctttgctttcc

SEQ ID NO: 578684 - DNA, 25 bp, Mus musculus
gcttgtttaaacaacttgaccttga

SEQ ID NO: 578685 - DNA, 25 bp, Mus musculus
gcttgtttaaactacttgaccttga

SEQ ID NO: 578686 - DNA, 25 bp, Mus musculus
gcttgtttaagaccaggcacgctga

SEQ ID NO: 578687 - DNA, 25 bp, Mus musculus
gcttgtttaagagcaggcacgctga

SEQ ID NO: 578688 - DNA, 25 bp, Mus musculus
gcttgtttacttcatctcacatttt

SEQ ID NO: 578689 - DNA, 25 bp, Mus musculus
gcttgtttacttgatctcacatttt

SEQ ID NO: 578690 - DNA, 25 bp, Mus musculus
gcttgtttagcgctgccagactgaa

SEQ ID NO: 578691 - DNA, 25 bp, Mus musculus
gcttgtttagcggtgccagactgaa

SEQ ID NO: 578692 - DNA, 25 bp, Mus musculus
gcttgtttataaaattctaacctct

SEQ ID NO: 578693 - DNA, 25 bp, Mus musculus
gcttgtttataatattctaacctct

SEQ ID NO: 578694 - DNA, 25 bp, Mus musculus
gcttgtttcactcgcatgactgtag

SEQ ID NO: 578695 - DNA, 25 bp, Mus musculus
gcttgtttcactggcatgactgtag

SEQ ID NO: 578696 - DNA, 25 bp, Mus musculus
gcttgtttccgcaaacgtcattgga

SEQ ID NO: 578697 - DNA, 25 bp, Mus musculus
gcttgtttccgctaacgtcattgga

SEQ ID NO: 578698 - DNA, 25 bp, Mus musculus
gcttgtttcctaccaggttatagcc

SEQ ID NO: 578699 - DNA, 25 bp, Mus musculus
gcttgtttcctagcaggttatagcc

SEQ ID NO: 578700 - DNA, 25 bp, Mus musculus
gcttgtttcgccatgtgtttttgtg

SEQ ID NO: 578701 - DNA, 25 bp, Mus musculus
gcttgtttcgccttgtgtttttgtg

SEQ ID NO: 578702 - DNA, 25 bp, Mus musculus
gcttgtttcgttctttgctagagct

SEQ ID NO: 578703 - DNA, 25 bp, Mus musculus
gcttgtttcgttgtttgctagagct

SEQ ID NO: 578704 - DNA, 25 bp, Mus musculus
gcttgtttctttcattagtatccga

SEQ ID NO: 578705 - DNA, 25 bp, Mus musculus
gcttgtttctttgattagtatccga

SEQ ID NO: 578706 - DNA, 25 bp, Mus musculus
gcttgtttgaaacccctcacaggag

SEQ ID NO: 578707 - DNA, 25 bp, Mus musculus
gcttgtttgaaagccctcacaggag

SEQ ID NO: 578708 - DNA, 25 bp, Mus musculus
gcttgtttgattacagcagttgata

SEQ ID NO: 578709 - DNA, 25 bp, Mus musculus
gcttgtttgatttcagcagttgata

SEQ ID NO: 578710 - DNA, 25 bp, Mus musculus
gcttgtttgcaaatgaactcaggtc

SEQ ID NO: 578711 - DNA, 25 bp, Mus musculus
gcttgtttgcaattgaactcaggtc

SEQ ID NO: 578712 - DNA, 25 bp, Mus musculus
gcttgtttgggactgggccactcaa

SEQ ID NO: 578713 - DNA, 25 bp, Mus musculus
gcttgtttgggagtgggccactcaa

SEQ ID NO: 578714 - DNA, 25 bp, Mus musculus
gcttgtttgtttcgaaatctttatc

SEQ ID NO: 578715 - DNA, 25 bp, Mus musculus
gcttgtttgtttggaaatctttatc

SEQ ID NO: 578716 - DNA, 25 bp, Mus musculus
gcttgttttaccatatttgagtttg

SEQ ID NO: 578717 - DNA, 25 bp, Mus musculus
gcttgttttaccttatttgagtttg

SEQ ID NO: 578718 - DNA, 25 bp, Mus musculus
gcttgttttcatatctggcatgagt

SEQ ID NO: 578719 - DNA, 25 bp, Mus musculus
gcttgttttcatcatgacgtcgtgc

SEQ ID NO: 578720 - DNA, 25 bp, Mus musculus
gcttgttttcatctggcgccagaaa

SEQ ID NO: 578721 - DNA, 25 bp, Mus musculus
gcttgttttcatgatgacgtcgtgc

SEQ ID NO: 578722 - DNA, 25 bp, Mus musculus
gcttgttttcatgtggcgccagaaa

SEQ ID NO: 578723 - DNA, 25 bp, Mus musculus
gcttgttttcatttctggcatgagt

SEQ ID NO: 578724 - DNA, 25 bp, Mus musculus
gcttgttttccaaggctgggaacct

SEQ ID NO: 578725 - DNA, 25 bp, Mus musculus
gcttgttttccatggctgggaacct

SEQ ID NO: 578726 - DNA, 25 bp, Mus musculus
gcttgttttcccagaatgtttgtat

SEQ ID NO: 578727 - DNA, 25 bp, Mus musculus
gcttgttttcccatatgtgcatttt

SEQ ID NO: 578728 - DNA, 25 bp, Mus musculus
gcttgttttccctgaatgtttgtat

SEQ ID NO: 578729 - DNA, 25 bp, Mus musculus
gcttgttttcccttatgtgcatttt

SEQ ID NO: 578730 - DNA, 25 bp, Mus musculus
gcttgttttgacaggtctatttcac

SEQ ID NO: 578731 - DNA, 25 bp, Mus musculus
gcttgttttgactggtctatttcac

SEQ ID NO: 578732 - DNA, 25 bp, Mus musculus
gcttgttttttcacagtcaatctat

SEQ ID NO: 578733 - DNA, 25 bp, Mus musculus
gcttgttttttctcagtcaatctat

SEQ ID NO: 578734 - DNA, 25 bp, Mus musculus
gctttaaaaagaaacctgctatcac

SEQ ID NO: 578735 - DNA, 25 bp, Mus musculus
gctttaaaaagatacctgctatcac

SEQ ID NO: 578736 - DNA, 25 bp, Mus musculus
gctttaaaacgaagagggcactctg

SEQ ID NO: 578737 - DNA, 25 bp, Mus musculus
gctttaaaacgatgagggcactctg

SEQ ID NO: 578738 - DNA, 25 bp, Mus musculus
gctttaaaacttagggctgggcgag

SEQ ID NO: 578739 - DNA, 25 bp, Mus musculus
gctttaaaactttgggctgggcgag

SEQ ID NO: 578740 - DNA, 25 bp, Mus musculus
gctttaaaatccctgtaagatccaa

SEQ ID NO: 578741 - DNA, 25 bp, Mus musculus
gctttaaaatccgtgtaagatccaa

SEQ ID NO: 578742 - DNA, 25 bp, Mus musculus
gctttaaaattacttcccttgattg

SEQ ID NO: 578743 - DNA, 25 bp, Mus musculus
gctttaaaattagttcccttgattg

SEQ ID NO: 578744 - DNA, 25 bp, Mus musculus
gctttaaacaaactggatttccagt

SEQ ID NO: 578745 - DNA, 25 bp, Mus musculus
gctttaaacaaagtggatttccagt

SEQ ID NO: 578746 - DNA, 25 bp, Mus musculus
gctttaaacagcatggccccctatt

SEQ ID NO: 578747 - DNA, 25 bp, Mus musculus
gctttaaacagcttggccccctatt

SEQ ID NO: 578748 - DNA, 25 bp, Mus musculus
gctttaaacagtcccgcatcagtgg

SEQ ID NO: 578749 - DNA, 25 bp, Mus musculus
gctttaaacagtgccgcatcagtgg

SEQ ID NO: 578750 - DNA, 25 bp, Mus musculus
gctttaaaccaaaattccatcattt

SEQ ID NO: 578751 - DNA, 25 bp, Mus musculus
gctttaaaccaatattccatcattt

SEQ ID NO: 578752 - DNA, 25 bp, Mus musculus
gctttaaactataagaccacgtatt

SEQ ID NO: 578753 - DNA, 25 bp, Mus musculus
gctttaaactattagaccacgtatt

SEQ ID NO: 578754 - DNA, 25 bp, Mus musculus
gctttaaatcaaactccctggtcct

SEQ ID NO: 578755 - DNA, 25 bp, Mus musculus
gctttaaatcaatctccctggtcct

SEQ ID NO: 578756 - DNA, 25 bp, Mus musculus
gctttaacatagagtatttcctcag

SEQ ID NO: 578757 - DNA, 25 bp, Mus musculus
gctttaacatagtgtatttcctcag

SEQ ID NO: 578758 - DNA, 25 bp, Mus musculus
gctttaacccctatgctttgctttg

SEQ ID NO: 578759 - DNA, 25 bp, Mus musculus
gctttaacccctttgctttgctttg

SEQ ID NO: 578760 - DNA, 25 bp, Mus musculus
gctttaacctatacagtggttgtat

SEQ ID NO: 578761 - DNA, 25 bp, Mus musculus
gctttaacctattcagtggttgtat

SEQ ID NO: 578762 - DNA, 25 bp, Mus musculus
gctttaacggtcaagttctagctaa

SEQ ID NO: 578763 - DNA, 25 bp, Mus musculus
gctttaacggtctagttctagctaa

SEQ ID NO: 578764 - DNA, 25 bp, Mus musculus
gctttaacgtaaacactggtgacat

SEQ ID NO: 578765 - DNA, 25 bp, Mus musculus
gctttaacgtaatcactggtgacat

SEQ ID NO: 578766 - DNA, 25 bp, Mus musculus
gctttaactctgatgttcctattgg

SEQ ID NO: 578767 - DNA, 25 bp, Mus musculus
gctttaactctgttgttcctattgg

SEQ ID NO: 578768 - DNA, 25 bp, Mus musculus
gctttaactgacactgggcttttgc

SEQ ID NO: 578769 - DNA, 25 bp, Mus musculus
gctttaactgactctgggcttttgc

SEQ ID NO: 578770 - DNA, 25 bp, Mus musculus
gctttaactgtaacctcagccaatc

SEQ ID NO: 578771 - DNA, 25 bp, Mus musculus
gctttaactgtatcctcagccaatc

SEQ ID NO: 578772 - DNA, 25 bp, Mus musculus
gctttaagagttaagtttgtgccct

SEQ ID NO: 578773 - DNA, 25 bp, Mus musculus
gctttaagagtttagtttgtgccct

SEQ ID NO: 578774 - DNA, 25 bp, Mus musculus
gctttaagcactcgagagtcgagtt

SEQ ID NO: 578775 - DNA, 25 bp, Mus musculus
gctttaagcactggagagtcgagtt

SEQ ID NO: 578776 - DNA, 25 bp, Mus musculus
gctttaaggaagacatgatgagtct

SEQ ID NO: 578777 - DNA, 25 bp, Mus musculus
gctttaaggaagtcatgatgagtct

SEQ ID NO: 578778 - DNA, 25 bp, Mus musculus
gctttaaggcttatagtgaacatct

SEQ ID NO: 578779 - DNA, 25 bp, Mus musculus
gctttaaggcttttagtgaacatct

SEQ ID NO: 578780 - DNA, 25 bp, Mus musculus
gctttaagtgtacctttttacctgt

SEQ ID NO: 578781 - DNA, 25 bp, Mus musculus
gctttaagtgtagctttttacctgt

SEQ ID NO: 578782 - DNA, 25 bp, Mus musculus
gctttaatacccctctcctaggtgc

SEQ ID NO: 578783 - DNA, 25 bp, Mus musculus
gctttaatacccgtctcctaggtgc

SEQ ID NO: 578784 - DNA, 25 bp, Mus musculus
gctttaatactcctggctcttgcac

SEQ ID NO: 578785 - DNA, 25 bp, Mus musculus
gctttaatactcgtggctcttgcac

SEQ ID NO: 578786 - DNA, 25 bp, Mus musculus
gctttaatccacacatttaagctaa

SEQ ID NO: 578787 - DNA, 25 bp, Mus musculus
gctttaatccactcatttaagctaa

SEQ ID NO: 578788 - DNA, 25 bp, Mus musculus
gctttaatctcacctttgcaataca

SEQ ID NO: 578789 - DNA, 25 bp, Mus musculus
gctttaatctcagctttgcaataca

SEQ ID NO: 578790 - DNA, 25 bp, Mus musculus
gctttaatggaaaattgggtgaatc

SEQ ID NO: 578791 - DNA, 25 bp, Mus musculus
gctttaatggaatattgggtgaatc

SEQ ID NO: 578792 - DNA, 25 bp, Mus musculus
gctttaattcttaggtttggatgct

SEQ ID NO: 578793 - DNA, 25 bp, Mus musculus
gctttaattctttggtttggatgct

SEQ ID NO: 578794 - DNA, 25 bp, Mus musculus
gctttaatttcacgcaacgttctct

SEQ ID NO: 578795 - DNA, 25 bp, Mus musculus
gctttaatttcaggcaacgttctct

SEQ ID NO: 578796 - DNA, 25 bp, Mus musculus
gctttacaagtgcacgggtgaccca

SEQ ID NO: 578797 - DNA, 25 bp, Mus musculus
gctttacaagtggacgggtgaccca

SEQ ID NO: 578798 - DNA, 25 bp, Mus musculus
gctttacactcaacttgttgtgtca

SEQ ID NO: 578799 - DNA, 25 bp, Mus musculus
gctttacactcatcttgttgtgtca

SEQ ID NO: 578800 - DNA, 25 bp, Mus musculus
gctttacagcctctggagttctgca

SEQ ID NO: 578801 - DNA, 25 bp, Mus musculus
gctttacagcctgtggagttctgca

SEQ ID NO: 578802 - DNA, 25 bp, Mus musculus
gctttacagtcaattttccactttt

SEQ ID NO: 578803 - DNA, 25 bp, Mus musculus
gctttacagtcatttttccactttt

SEQ ID NO: 578804 - DNA, 25 bp, Mus musculus
gctttacattgcatcctagtttaca

SEQ ID NO: 578805 - DNA, 25 bp, Mus musculus
gctttacattgcttcctagtttaca

SEQ ID NO: 578806 - DNA, 25 bp, Mus musculus
gctttaccaactaaacattgtgatg

SEQ ID NO: 578807 - DNA, 25 bp, Mus musculus
gctttaccaacttaacattgtgatg

SEQ ID NO: 578808 - DNA, 25 bp, Mus musculus
gctttaccacagagttcaagacctg

SEQ ID NO: 578809 - DNA, 25 bp, Mus musculus
gctttaccacagtgttcaagacctg

SEQ ID NO: 578810 - DNA, 25 bp, Mus musculus
gctttaccagttcctctgaagcagc

SEQ ID NO: 578811 - DNA, 25 bp, Mus musculus
gctttaccagttgctctgaagcagc

SEQ ID NO: 578812 - DNA, 25 bp, Mus musculus
gctttaccatgactgttttctgcta

SEQ ID NO: 578813 - DNA, 25 bp, Mus musculus
gctttaccatgagtgttttctgcta

SEQ ID NO: 578814 - DNA, 25 bp, Mus musculus
gctttacctcagacagtcagtgttc

SEQ ID NO: 578815 - DNA, 25 bp, Mus musculus
gctttacctcagtcagtcagtgttc

SEQ ID NO: 578816 - DNA, 25 bp, Mus musculus
gctttacctgagagtctgaatccaa

SEQ ID NO: 578817 - DNA, 25 bp, Mus musculus
gctttacctgagtgtctgaatccaa

SEQ ID NO: 578818 - DNA, 25 bp, Mus musculus
gctttaccttcacttttccactata

SEQ ID NO: 578819 - DNA, 25 bp, Mus musculus
gctttaccttcagttttccactata

SEQ ID NO: 578820 - DNA, 25 bp, Mus musculus
gctttacctttcctccaggacatag

SEQ ID NO: 578821 - DNA, 25 bp, Mus musculus
gctttacctttcgtccaggacatag

SEQ ID NO: 578822 - DNA, 25 bp, Mus musculus
gctttacgaggtaagcctggccttg

SEQ ID NO: 578823 - DNA, 25 bp, Mus musculus
gctttacgaggttagcctggccttg

SEQ ID NO: 578824 - DNA, 25 bp, Mus musculus
gctttacgtaaaaaacctgctctgt

SEQ ID NO: 578825 - DNA, 25 bp, Mus musculus
gctttacgtaaataacctgctctgt

SEQ ID NO: 578826 - DNA, 25 bp, Mus musculus
gctttactacaaagactgcttcctg

SEQ ID NO: 578827 - DNA, 25 bp, Mus musculus
gctttactacaatgactgcttcctg

SEQ ID NO: 578828 - DNA, 25 bp, Mus musculus
gctttactacatattggccagatct

SEQ ID NO: 578829 - DNA, 25 bp, Mus musculus
gctttactacattttggccagatct

SEQ ID NO: 578830 - DNA, 25 bp, Mus musculus
gctttactcatacacctttgacgga

SEQ ID NO: 578831 - DNA, 25 bp, Mus musculus
gctttactcatagacctttgacgga

SEQ ID NO: 578832 - DNA, 25 bp, Mus musculus
gctttactcccacagattaaggtga

SEQ ID NO: 578833 - DNA, 25 bp, Mus musculus
gctttactcccagagattaaggtga

SEQ ID NO: 578834 - DNA, 25 bp, Mus musculus
gctttactccggcactcgggtggta

SEQ ID NO: 578835 - DNA, 25 bp, Mus musculus
gctttactccgggactcgggtggta

SEQ ID NO: 578836 - DNA, 25 bp, Mus musculus
gctttactcctccttggtacaagga

SEQ ID NO: 578837 - DNA, 25 bp, Mus musculus
gctttactcctcgttggtacaagga

SEQ ID NO: 578838 - DNA, 25 bp, Mus musculus
gctttactgcaacttcctatctttg

SEQ ID NO: 578839 - DNA, 25 bp, Mus musculus
gctttactgcaagttcctatctttg

SEQ ID NO: 578840 - DNA, 25 bp, Mus musculus
gctttactgctgcaggcgtgtgatt

SEQ ID NO: 578841 - DNA, 25 bp, Mus musculus
gctttactgctggaggcgtgtgatt

SEQ ID NO: 578842 - DNA, 25 bp, Mus musculus
gctttactgtgcctgctgagtcagc

SEQ ID NO: 578843 - DNA, 25 bp, Mus musculus
gctttactgtgcgtgctgagtcagc

SEQ ID NO: 578844 - DNA, 25 bp, Mus musculus
gctttacttttgctcacgtgaacct

SEQ ID NO: 578845 - DNA, 25 bp, Mus musculus
gctttacttttggtcacgtgaacct

SEQ ID NO: 578846 - DNA, 25 bp, Mus musculus
gctttagaaaaaccccatgcctcag

SEQ ID NO: 578847 - DNA, 25 bp, Mus musculus
gctttagaaaaagcccatgcctcag

SEQ ID NO: 578848 - DNA, 25 bp, Mus musculus
gctttagaaatccaactgaggttgt

SEQ ID NO: 578849 - DNA, 25 bp, Mus musculus
gctttagaaatcgaactgaggttgt

SEQ ID NO: 578850 - DNA, 25 bp, Mus musculus
gctttagaaggccattatcttggtt

SEQ ID NO: 578851 - DNA, 25 bp, Mus musculus
gctttagaaggcgattatcttggtt

SEQ ID NO: 578852 - DNA, 25 bp, Mus musculus
gctttagaccctcacacgtggatgt

SEQ ID NO: 578853 - DNA, 25 bp, Mus musculus
gctttagaccctgacacgtggatgt

SEQ ID NO: 578854 - DNA, 25 bp, Mus musculus
gctttagactccagtatcttcggaa

SEQ ID NO: 578855 - DNA, 25 bp, Mus musculus
gctttagactcctgtatcttcggaa

SEQ ID NO: 578856 - DNA, 25 bp, Mus musculus
gctttagattgacccactttaagta

SEQ ID NO: 578857 - DNA, 25 bp, Mus musculus
gctttagattgagccactttaagta

SEQ ID NO: 578858 - DNA, 25 bp, Mus musculus
gctttagattgccagcatgttttag

SEQ ID NO: 578859 - DNA, 25 bp, Mus musculus
gctttagattgcgagcatgttttag

SEQ ID NO: 578860 - DNA, 25 bp, Mus musculus
gctttagcagttcaatctttttgtt

SEQ ID NO: 578861 - DNA, 25 bp, Mus musculus
gctttagcagttgaatctttttgtt

SEQ ID NO: 578862 - DNA, 25 bp, Mus musculus
gctttagcccttaacttggagtctt

SEQ ID NO: 578863 - DNA, 25 bp, Mus musculus
gctttagccctttacttggagtctt

SEQ ID NO: 578864 - DNA, 25 bp, Mus musculus
gctttagcctacatactacccagag

SEQ ID NO: 578865 - DNA, 25 bp, Mus musculus
gctttagcctacttactacccagag

SEQ ID NO: 578866 - DNA, 25 bp, Mus musculus
gctttagcctccagggtactgtaat

SEQ ID NO: 578867 - DNA, 25 bp, Mus musculus
gctttagcctcctgggtactgtaat

SEQ ID NO: 578868 - DNA, 25 bp, Mus musculus
gctttagctaggctcttgagggatc

SEQ ID NO: 578869 - DNA, 25 bp, Mus musculus
gctttagctagggtcttgagggatc

SEQ ID NO: 578870 - DNA, 25 bp, Mus musculus
gctttagctcaactattacacaata

SEQ ID NO: 578871 - DNA, 25 bp, Mus musculus
gctttagctcaagtattacacaata

SEQ ID NO: 578872 - DNA, 25 bp, Mus musculus
gctttagctccaatactgggaagac

SEQ ID NO: 578873 - DNA, 25 bp, Mus musculus
gctttagctccattactgggaagac

SEQ ID NO: 578874 - DNA, 25 bp, Mus musculus
gctttaggaaatattgtgtggcata

SEQ ID NO: 578875 - DNA, 25 bp, Mus musculus
gctttaggaaattttgtgtggcata

SEQ ID NO: 578876 - DNA, 25 bp, Mus musculus
gctttaggaataacaccccactatc

SEQ ID NO: 578877 - DNA, 25 bp, Mus musculus
gctttaggaatatcaccccactatc

SEQ ID NO: 578878 - DNA, 25 bp, Mus musculus
gctttaggaatgaacactgcaggga

SEQ ID NO: 578879 - DNA, 25 bp, Mus musculus
gctttaggaatgtacactgcaggga

SEQ ID NO: 578880 - DNA, 25 bp, Mus musculus
gctttaggaggcacactccaactga

SEQ ID NO: 578881 - DNA, 25 bp, Mus musculus
gctttaggaggctcactccaactga

SEQ ID NO: 578882 - DNA, 25 bp, Mus musculus
gctttaggctccagacgagagtctt

SEQ ID NO: 578883 - DNA, 25 bp, Mus musculus
gctttaggctcctgacgagagtctt

SEQ ID NO: 578884 - DNA, 25 bp, Mus musculus
gctttaggctttcatggtctctaga

SEQ ID NO: 578885 - DNA, 25 bp, Mus musculus
gctttaggctttgatggtctctaga

SEQ ID NO: 578886 - DNA, 25 bp, Mus musculus
gctttaggtagaatcgctccaggtg

SEQ ID NO: 578887 - DNA, 25 bp, Mus musculus
gctttaggtagattcgctccaggtg

SEQ ID NO: 578888 - DNA, 25 bp, Mus musculus
gctttaggtgcactggatctttgtt

SEQ ID NO: 578889 - DNA, 25 bp, Mus musculus
gctttaggtgcagtggatctttgtt

SEQ ID NO: 578890 - DNA, 25 bp, Mus musculus
gctttaggtgtaaggcctgctgcag

SEQ ID NO: 578891 - DNA, 25 bp, Mus musculus
gctttaggtgtatggcctgctgcag

SEQ ID NO: 578892 - DNA, 25 bp, Mus musculus
gctttaggttgtccctatgcctata

SEQ ID NO: 578893 - DNA, 25 bp, Mus musculus
gctttaggttgtgcctatgcctata

SEQ ID NO: 578894 - DNA, 25 bp, Mus musculus
gctttagtcttaaggagcacctgga

SEQ ID NO: 578895 - DNA, 25 bp, Mus musculus
gctttagtcttatggagcacctgga

SEQ ID NO: 578896 - DNA, 25 bp, Mus musculus
gctttagttagaaccgaggctgctt

SEQ ID NO: 578897 - DNA, 25 bp, Mus musculus
gctttagttagatccgaggctgctt

SEQ ID NO: 578898 - DNA, 25 bp, Mus musculus
gctttataaaaccaatgtctgggat

SEQ ID NO: 578899 - DNA, 25 bp, Mus musculus
gctttataaaacgaatgtctgggat

SEQ ID NO: 578900 - DNA, 25 bp, Mus musculus
gctttataaattaggctgcaccatg

SEQ ID NO: 578901 - DNA, 25 bp, Mus musculus
gctttataaatttggctgcaccatg

SEQ ID NO: 578902 - DNA, 25 bp, Mus musculus
gctttataagatatctgcagttctg

SEQ ID NO: 578903 - DNA, 25 bp, Mus musculus
gctttataagatttctgcagttctg

SEQ ID NO: 578904 - DNA, 25 bp, Mus musculus
gctttatagctccacaatgttttgt

SEQ ID NO: 578905 - DNA, 25 bp, Mus musculus
gctttatagctcgacaatgttttgt

SEQ ID NO: 578906 - DNA, 25 bp, Mus musculus
gctttatagtcaaaatacatcagtg

SEQ ID NO: 578907 - DNA, 25 bp, Mus musculus
gctttatagtcataatacatcagtg

SEQ ID NO: 578908 - DNA, 25 bp, Mus musculus
gctttatataatacgcacacacaca

SEQ ID NO: 578909 - DNA, 25 bp, Mus musculus
gctttatataattcgcacacacaca

SEQ ID NO: 578910 - DNA, 25 bp, Mus musculus
gctttatataccacatatttcctgg

SEQ ID NO: 578911 - DNA, 25 bp, Mus musculus
gctttatatacctcatatttcctgg

SEQ ID NO: 578912 - DNA, 25 bp, Mus musculus
gctttatatttaccaccaggattct

SEQ ID NO: 578913 - DNA, 25 bp, Mus musculus
gctttatatttagcaccaggattct

SEQ ID NO: 578914 - DNA, 25 bp, Mus musculus
gctttatcagctacacttgcattca

SEQ ID NO: 578915 - DNA, 25 bp, Mus musculus
gctttatcagctcagccatttttag

SEQ ID NO: 578916 - DNA, 25 bp, Mus musculus
gctttatcagctgagccatttttag

SEQ ID NO: 578917 - DNA, 25 bp, Mus musculus
gctttatcagcttcacttgcattca

SEQ ID NO: 578918 - DNA, 25 bp, Mus musculus
gctttatcgcttacatccatgcaag

SEQ ID NO: 578919 - DNA, 25 bp, Mus musculus
gctttatcgctttcatccatgcaag

SEQ ID NO: 578920 - DNA, 25 bp, Mus musculus
gctttatctctgctaagccggacag

SEQ ID NO: 578921 - DNA, 25 bp, Mus musculus
gctttatctctggtaagccggacag

SEQ ID NO: 578922 - DNA, 25 bp, Mus musculus
gctttatctttcaagcattctctaa

SEQ ID NO: 578923 - DNA, 25 bp, Mus musculus
gctttatctttcaagggttgggttg

SEQ ID NO: 578924 - DNA, 25 bp, Mus musculus
gctttatctttcaatcttggtccag

SEQ ID NO: 578925 - DNA, 25 bp, Mus musculus
gctttatctttctagcattctctaa

SEQ ID NO: 578926 - DNA, 25 bp, Mus musculus
gctttatctttctagggttgggttg

SEQ ID NO: 578927 - DNA, 25 bp, Mus musculus
gctttatctttctatcttggtccag

SEQ ID NO: 578928 - DNA, 25 bp, Mus musculus
gctttatgaagccatccgggatttt

SEQ ID NO: 578929 - DNA, 25 bp, Mus musculus
gctttatgaagcgatccgggatttt

SEQ ID NO: 578930 - DNA, 25 bp, Mus musculus
gctttatgaatacctgattgtggca

SEQ ID NO: 578931 - DNA, 25 bp, Mus musculus
gctttatgaatagctgattgtggca

SEQ ID NO: 578932 - DNA, 25 bp, Mus musculus
gctttatgccagaccatcagcaaaa

SEQ ID NO: 578933 - DNA, 25 bp, Mus musculus
gctttatgccagtccatcagcaaaa

SEQ ID NO: 578934 - DNA, 25 bp, Mus musculus
gctttatgccatacccatctatatt

SEQ ID NO: 578935 - DNA, 25 bp, Mus musculus
gctttatgccattcccatctatatt

SEQ ID NO: 578936 - DNA, 25 bp, Mus musculus
gctttatggaccaccacttcagact

SEQ ID NO: 578937 - DNA, 25 bp, Mus musculus
gctttatggacctccacttcagact

SEQ ID NO: 578938 - DNA, 25 bp, Mus musculus
gctttatggttcattagtctgtctt

SEQ ID NO: 578939 - DNA, 25 bp, Mus musculus
gctttatggttctttagtctgtctt

SEQ ID NO: 578940 - DNA, 25 bp, Mus musculus
gctttatgtactaaaccctcatgga

SEQ ID NO: 578941 - DNA, 25 bp, Mus musculus
gctttatgtacttaaccctcatgga

SEQ ID NO: 578942 - DNA, 25 bp, Mus musculus
gctttatgtattaggctggctttta

SEQ ID NO: 578943 - DNA, 25 bp, Mus musculus
gctttatgtatttggctggctttta

SEQ ID NO: 578944 - DNA, 25 bp, Mus musculus
gctttatgttatcgaaggcccatga

SEQ ID NO: 578945 - DNA, 25 bp, Mus musculus
gctttatgttatggaaggcccatga

SEQ ID NO: 578946 - DNA, 25 bp, Mus musculus
gctttattatacacgccaggacaac

SEQ ID NO: 578947 - DNA, 25 bp, Mus musculus
gctttattatactcgccaggacaac

SEQ ID NO: 578948 - DNA, 25 bp, Mus musculus
gctttattcagacgtcaaacttcaa

SEQ ID NO: 578949 - DNA, 25 bp, Mus musculus
gctttattcagaggtcaaacttcaa

SEQ ID NO: 578950 - DNA, 25 bp, Mus musculus
gctttattccatccttaaccataga

SEQ ID NO: 578951 - DNA, 25 bp, Mus musculus
gctttattccatgcttaaccataga

SEQ ID NO: 578952 - DNA, 25 bp, Mus musculus
gctttattctccaggtgacactcag

SEQ ID NO: 578953 - DNA, 25 bp, Mus musculus
gctttattctcctggtgacactcag

SEQ ID NO: 578954 - DNA, 25 bp, Mus musculus
gctttattcttaagtgctgcataat

SEQ ID NO: 578955 - DNA, 25 bp, Mus musculus
gctttattcttatgtgctgcataat

SEQ ID NO: 578956 - DNA, 25 bp, Mus musculus
gctttattgaggaagagtttccatg

SEQ ID NO: 578957 - DNA, 25 bp, Mus musculus
gctttattgaggtagagtttccatg

SEQ ID NO: 578958 - DNA, 25 bp, Mus musculus
gctttattgcagacttgttggctgt

SEQ ID NO: 578959 - DNA, 25 bp, Mus musculus
gctttattgcagtcttgttggctgt

SEQ ID NO: 578960 - DNA, 25 bp, Mus musculus
gctttatttgagatgcctttggtca

SEQ ID NO: 578961 - DNA, 25 bp, Mus musculus
gctttatttgagttgcctttggtca

SEQ ID NO: 578962 - DNA, 25 bp, Mus musculus
gctttattttagatgaacccatggg

SEQ ID NO: 578963 - DNA, 25 bp, Mus musculus
gctttattttagttgaacccatggg

SEQ ID NO: 578964 - DNA, 25 bp, Mus musculus
gctttcaaaaatctgctggacttct

SEQ ID NO: 578965 - DNA, 25 bp, Mus musculus
gctttcaaaaatgtgctggacttct

SEQ ID NO: 578966 - DNA, 25 bp, Mus musculus
gctttcaaaattcaagtccattggg

SEQ ID NO: 578967 - DNA, 25 bp, Mus musculus
gctttcaaaattgaagtccattggg

SEQ ID NO: 578968 - DNA, 25 bp, Mus musculus
gctttcaaacttcagctttagctcc

SEQ ID NO: 578969 - DNA, 25 bp, Mus musculus
gctttcaaacttgagctttagctcc

SEQ ID NO: 578970 - DNA, 25 bp, Mus musculus
gctttcaaagatcttatgtgttcac

SEQ ID NO: 578971 - DNA, 25 bp, Mus musculus
gctttcaaagatgttatgtgttcac

SEQ ID NO: 578972 - DNA, 25 bp, Mus musculus
gctttcaaagctatcctgaagtcgg

SEQ ID NO: 578973 - DNA, 25 bp, Mus musculus
gctttcaaagctttcctgaagtcgg

SEQ ID NO: 578974 - DNA, 25 bp, Mus musculus
gctttcaacaagatctgaatgtccg

SEQ ID NO: 578975 - DNA, 25 bp, Mus musculus
gctttcaacaagttctgaatgtccg

SEQ ID NO: 578976 - DNA, 25 bp, Mus musculus
gctttcaaccatcctaatgttgtga

SEQ ID NO: 578977 - DNA, 25 bp, Mus musculus
gctttcaaccatgctaatgttgtga

SEQ ID NO: 578978 - DNA, 25 bp, Mus musculus
gctttcaaccctaaagaagtgctgg

SEQ ID NO: 578979 - DNA, 25 bp, Mus musculus
gctttcaacccttaagaagtgctgg

SEQ ID NO: 578980 - DNA, 25 bp, Mus musculus
gctttcaactctatactggctttat

SEQ ID NO: 578981 - DNA, 25 bp, Mus musculus
gctttcaactctttactggctttat

SEQ ID NO: 578982 - DNA, 25 bp, Mus musculus
gctttcaacttaccagccatggtta

SEQ ID NO: 578983 - DNA, 25 bp, Mus musculus
gctttcaacttagcagccatggtta

SEQ ID NO: 578984 - DNA, 25 bp, Mus musculus
gctttcaagagaatgccagtggctt

SEQ ID NO: 578985 - DNA, 25 bp, Mus musculus
gctttcaagagattgccagtggctt

SEQ ID NO: 578986 - DNA, 25 bp, Mus musculus
gctttcaagcagcagcccagataag

SEQ ID NO: 578987 - DNA, 25 bp, Mus musculus
gctttcaagcaggagcccagataag

SEQ ID NO: 578988 - DNA, 25 bp, Mus musculus
gctttcaagccaccggctgtccaaa

SEQ ID NO: 578989 - DNA, 25 bp, Mus musculus
gctttcaagccagcggctgtccaaa

SEQ ID NO: 578990 - DNA, 25 bp, Mus musculus
gctttcaaggctagaagattattgc

SEQ ID NO: 578991 - DNA, 25 bp, Mus musculus
gctttcaaggcttgaagattattgc

SEQ ID NO: 578992 - DNA, 25 bp, Mus musculus
gctttcaagggaatgcaggcagcca

SEQ ID NO: 578993 - DNA, 25 bp, Mus musculus
gctttcaagggattgcaggcagcca

SEQ ID NO: 578994 - DNA, 25 bp, Mus musculus
gctttcaagggccagacctcgagaa

SEQ ID NO: 578995 - DNA, 25 bp, Mus musculus
gctttcaagggcgagacctcgagaa

SEQ ID NO: 578996 - DNA, 25 bp, Mus musculus
gctttcaagttcctctcacgggact

SEQ ID NO: 578997 - DNA, 25 bp, Mus musculus
gctttcaagttcgtctcacgggact

SEQ ID NO: 578998 - DNA, 25 bp, Mus musculus
gctttcacaaccatcttacatgacg

SEQ ID NO: 578999 - DNA, 25 bp, Mus musculus
gctttcacaaccttcttacatgacg

SEQ ID NO: 579000 - DNA, 25 bp, Mus musculus
gctttcacaactcttataatgtaga

SEQ ID NO: 579001 - DNA, 25 bp, Mus musculus
gctttcacaactgttataatgtaga

SEQ ID NO: 579002 - DNA, 25 bp, Mus musculus
gctttcacatggattgtgcaccaca

SEQ ID NO: 579003 - DNA, 25 bp, Mus musculus
gctttcacatggtttgtgcaccaca

SEQ ID NO: 579004 - DNA, 25 bp, Mus musculus
gctttcaccaatcgcattgccgaga

SEQ ID NO: 579005 - DNA, 25 bp, Mus musculus
gctttcaccaatggcattgccgaga

SEQ ID NO: 579006 - DNA, 25 bp, Mus musculus
gctttcaccatgactatgtcaagtt

SEQ ID NO: 579007 - DNA, 25 bp, Mus musculus
gctttcaccatgtctatgtcaagtt

SEQ ID NO: 579008 - DNA, 25 bp, Mus musculus
gctttcacctcgcacagtgtgcaga

SEQ ID NO: 579009 - DNA, 25 bp, Mus musculus
gctttcacctcggacagtgtgcaga

SEQ ID NO: 579010 - DNA, 25 bp, Mus musculus
gctttcacctttactccttgtgaag

SEQ ID NO: 579011 - DNA, 25 bp, Mus musculus
gctttcaccttttctccttgtgaag

SEQ ID NO: 579012 - DNA, 25 bp, Mus musculus
gctttcacggacaccattccaagaa

SEQ ID NO: 579013 - DNA, 25 bp, Mus musculus
gctttcacggactccattccaagaa

SEQ ID NO: 579014 - DNA, 25 bp, Mus musculus
gctttcacgtctactgtttgcttga

SEQ ID NO: 579015 - DNA, 25 bp, Mus musculus
gctttcacgtcttctgtttgcttga

SEQ ID NO: 579016 - DNA, 25 bp, Mus musculus
gctttcactactcaatgctcatgtt

SEQ ID NO: 579017 - DNA, 25 bp, Mus musculus
gctttcactactgaatgctcatgtt

SEQ ID NO: 579018 - DNA, 25 bp, Mus musculus
gctttcactctccatttcatttatg

SEQ ID NO: 579019 - DNA, 25 bp, Mus musculus
gctttcactctcgatttcatttatg

SEQ ID NO: 579020 - DNA, 25 bp, Mus musculus
gctttcactgataactgggctattt

SEQ ID NO: 579021 - DNA, 25 bp, Mus musculus
gctttcactgattactgggctattt

SEQ ID NO: 579022 - DNA, 25 bp, Mus musculus
gctttcagaaagagtgctcaccaga

SEQ ID NO: 579023 - DNA, 25 bp, Mus musculus
gctttcagaaagtgtgctcaccaga

SEQ ID NO: 579024 - DNA, 25 bp, Mus musculus
gctttcagaggtctggtctgttctt

SEQ ID NO: 579025 - DNA, 25 bp, Mus musculus
gctttcagaggtgtggtctgttctt

SEQ ID NO: 579026 - DNA, 25 bp, Mus musculus
gctttcagatacacaacctcatttt

SEQ ID NO: 579027 - DNA, 25 bp, Mus musculus
gctttcagatactcaacctcatttt

SEQ ID NO: 579028 - DNA, 25 bp, Mus musculus
gctttcagatggcaactgccattgc

SEQ ID NO: 579029 - DNA, 25 bp, Mus musculus
gctttcagatgggaactgccattgc

SEQ ID NO: 579030 - DNA, 25 bp, Mus musculus
gctttcagcagtacaaaattggcaa

SEQ ID NO: 579031 - DNA, 25 bp, Mus musculus
gctttcagcagttcaaaattggcaa

SEQ ID NO: 579032 - DNA, 25 bp, Mus musculus
gctttcagccacactacatttgatt

SEQ ID NO: 579033 - DNA, 25 bp, Mus musculus
gctttcagccactctacatttgatt

SEQ ID NO: 579034 - DNA, 25 bp, Mus musculus
gctttcagcgagcagaatctttatt

SEQ ID NO: 579035 - DNA, 25 bp, Mus musculus
gctttcagcgaggagaatctttatt

SEQ ID NO: 579036 - DNA, 25 bp, Mus musculus
gctttcagcggaccctgcaaggcaa

SEQ ID NO: 579037 - DNA, 25 bp, Mus musculus
gctttcagcggagcctgcaaggcaa

SEQ ID NO: 579038 - DNA, 25 bp, Mus musculus
gctttcagcgtaatatttggcctca

SEQ ID NO: 579039 - DNA, 25 bp, Mus musculus
gctttcagcgtattatttggcctca

SEQ ID NO: 579040 - DNA, 25 bp, Mus musculus
gctttcagcttcactaaccatcaaa

SEQ ID NO: 579041 - DNA, 25 bp, Mus musculus
gctttcagcttctctaaccatcaaa

SEQ ID NO: 579042 - DNA, 25 bp, Mus musculus
gctttcagcttgatctagacttcag

SEQ ID NO: 579043 - DNA, 25 bp, Mus musculus
gctttcagcttgttctagacttcag

SEQ ID NO: 579044 - DNA, 25 bp, Mus musculus
gctttcaggaacactccatactaca

SEQ ID NO: 579045 - DNA, 25 bp, Mus musculus
gctttcaggaactctccatactaca

SEQ ID NO: 579046 - DNA, 25 bp, Mus musculus
gctttcagggtgcaatacgtggttt

SEQ ID NO: 579047 - DNA, 25 bp, Mus musculus
gctttcagggtggaatacgtggttt

SEQ ID NO: 579048 - DNA, 25 bp, Mus musculus
gctttcaggtttacatgtatgtcgt

SEQ ID NO: 579049 - DNA, 25 bp, Mus musculus
gctttcaggttttcatgtatgtcgt

SEQ ID NO: 579050 - DNA, 25 bp, Mus musculus
gctttcagtaagaattcttccctta

SEQ ID NO: 579051 - DNA, 25 bp, Mus musculus
gctttcagtaagtattcttccctta

SEQ ID NO: 579052 - DNA, 25 bp, Mus musculus
gctttcagtcctcagagttagcagt

SEQ ID NO: 579053 - DNA, 25 bp, Mus musculus
gctttcagtcctgagagttagcagt

SEQ ID NO: 579054 - DNA, 25 bp, Mus musculus
gctttcagtcttagcatccacaagt

SEQ ID NO: 579055 - DNA, 25 bp, Mus musculus
gctttcagtctttgcatccacaagt

SEQ ID NO: 579056 - DNA, 25 bp, Mus musculus
gctttcagtgcgctgttaaattata

SEQ ID NO: 579057 - DNA, 25 bp, Mus musculus
gctttcagtgcggtgttaaattata

SEQ ID NO: 579058 - DNA, 25 bp, Mus musculus
gctttcagtgtaaggaaaacccagc

SEQ ID NO: 579059 - DNA, 25 bp, Mus musculus
gctttcagtgtatggaaaacccagc

SEQ ID NO: 579060 - DNA, 25 bp, Mus musculus
gctttcagtttgatctcagccatca

SEQ ID NO: 579061 - DNA, 25 bp, Mus musculus
gctttcagtttgttctcagccatca

SEQ ID NO: 579062 - DNA, 25 bp, Mus musculus
gctttcatagtgacttccccaaaga

SEQ ID NO: 579063 - DNA, 25 bp, Mus musculus
gctttcatagtgtcttccccaaaga

SEQ ID NO: 579064 - DNA, 25 bp, Mus musculus
gctttcatcaaaccaggctaggatt

SEQ ID NO: 579065 - DNA, 25 bp, Mus musculus
gctttcatcaaagcaggctaggatt

SEQ ID NO: 579066 - DNA, 25 bp, Mus musculus
gctttcatcagaatctcaaggcctt

SEQ ID NO: 579067 - DNA, 25 bp, Mus musculus
gctttcatcagattctcaaggcctt

SEQ ID NO: 579068 - DNA, 25 bp, Mus musculus
gctttcatcagtaccttccgaatga

SEQ ID NO: 579069 - DNA, 25 bp, Mus musculus
gctttcatcagttccttccgaatga

SEQ ID NO: 579070 - DNA, 25 bp, Mus musculus
gctttcatcatgactatggtgacta

SEQ ID NO: 579071 - DNA, 25 bp, Mus musculus
gctttcatcatgtctatggtgacta

SEQ ID NO: 579072 - DNA, 25 bp, Mus musculus
gctttcatcctaaggccgtgcgaga

SEQ ID NO: 579073 - DNA, 25 bp, Mus musculus
gctttcatcctatggccgtgcgaga

SEQ ID NO: 579074 - DNA, 25 bp, Mus musculus
gctttcatctgtatagccagcacac

SEQ ID NO: 579075 - DNA, 25 bp, Mus musculus
gctttcatctgtttagccagcacac

SEQ ID NO: 579076 - DNA, 25 bp, Mus musculus
gctttcatggctctacaaacgttgc

SEQ ID NO: 579077 - DNA, 25 bp, Mus musculus
gctttcatggctgtacaaacgttgc

SEQ ID NO: 579078 - DNA, 25 bp, Mus musculus
gctttcatgggcaggagacatcttg

SEQ ID NO: 579079 - DNA, 25 bp, Mus musculus
gctttcatgggcatgctattaggcc

SEQ ID NO: 579080 - DNA, 25 bp, Mus musculus
gctttcatgggctggagacatcttg

SEQ ID NO: 579081 - DNA, 25 bp, Mus musculus
gctttcatgggcttgctattaggcc

SEQ ID NO: 579082 - DNA, 25 bp, Mus musculus
gctttcatggttatgactccctatt

SEQ ID NO: 579083 - DNA, 25 bp, Mus musculus
gctttcatggttatgtttcccaatg

SEQ ID NO: 579084 - DNA, 25 bp, Mus musculus
gctttcatggttcctgtaatcttta

SEQ ID NO: 579085 - DNA, 25 bp, Mus musculus
gctttcatggttgctgtaatcttta

SEQ ID NO: 579086 - DNA, 25 bp, Mus musculus
gctttcatggttttgactccctatt

SEQ ID NO: 579087 - DNA, 25 bp, Mus musculus
gctttcatggttttgtttcccaatg

SEQ ID NO: 579088 - DNA, 25 bp, Mus musculus
gctttcatgtcaaaagtattccatc

SEQ ID NO: 579089 - DNA, 25 bp, Mus musculus
gctttcatgtcataagtattccatc

SEQ ID NO: 579090 - DNA, 25 bp, Mus musculus
gctttcattgccattgtttttcctg

SEQ ID NO: 579091 - DNA, 25 bp, Mus musculus
gctttcattgcctttgtttttcctg

SEQ ID NO: 579092 - DNA, 25 bp, Mus musculus
gctttcattgtaatattagttctct

SEQ ID NO: 579093 - DNA, 25 bp, Mus musculus
gctttcattgtattattagttctct

SEQ ID NO: 579094 - DNA, 25 bp, Mus musculus
gctttcattgtcctgtgaatttcca

SEQ ID NO: 579095 - DNA, 25 bp, Mus musculus
gctttcattgtcgtgtgaatttcca

SEQ ID NO: 579096 - DNA, 25 bp, Mus musculus
gctttcatttggaacagtgagactg

SEQ ID NO: 579097 - DNA, 25 bp, Mus musculus
gctttcatttggtacagtgagactg

SEQ ID NO: 579098 - DNA, 25 bp, Mus musculus
gctttcattttacaaccagatgtca

SEQ ID NO: 579099 - DNA, 25 bp, Mus musculus
gctttcattttagaaccagatgtca

SEQ ID NO: 579100 - DNA, 25 bp, Mus musculus
gctttcattttcattgtagctgatg

SEQ ID NO: 579101 - DNA, 25 bp, Mus musculus
gctttcattttctttgtagctgatg

SEQ ID NO: 579102 - DNA, 25 bp, Mus musculus
gctttccaacatcgagattactttt

SEQ ID NO: 579103 - DNA, 25 bp, Mus musculus
gctttccaacatggagattactttt

SEQ ID NO: 579104 - DNA, 25 bp, Mus musculus
gctttccaactcagatgtattttgt

SEQ ID NO: 579105 - DNA, 25 bp, Mus musculus
gctttccaactctgatgtattttgt

SEQ ID NO: 579106 - DNA, 25 bp, Mus musculus
gctttccaagatctgtctgctcctc

SEQ ID NO: 579107 - DNA, 25 bp, Mus musculus
gctttccaagatgtgtctgctcctc

SEQ ID NO: 579108 - DNA, 25 bp, Mus musculus
gctttccaagtgataggaccatggt

SEQ ID NO: 579109 - DNA, 25 bp, Mus musculus
gctttccaagtgctttgctttcaga

SEQ ID NO: 579110 - DNA, 25 bp, Mus musculus
gctttccaagtggtttgctttcaga

SEQ ID NO: 579111 - DNA, 25 bp, Mus musculus
gctttccaagtgttaggaccatggt

SEQ ID NO: 579112 - DNA, 25 bp, Mus musculus
gctttccaatgaacgctttttccag

SEQ ID NO: 579113 - DNA, 25 bp, Mus musculus
gctttccaatgatcgctttttccag

SEQ ID NO: 579114 - DNA, 25 bp, Mus musculus
gctttccaattcctgttagttatta

SEQ ID NO: 579115 - DNA, 25 bp, Mus musculus
gctttccaattcgtgttagttatta

SEQ ID NO: 579116 - DNA, 25 bp, Mus musculus
gctttccacagcagttattgagaac

SEQ ID NO: 579117 - DNA, 25 bp, Mus musculus
gctttccacagctgttattgagaac

SEQ ID NO: 579118 - DNA, 25 bp, Mus musculus
gctttccacctcaaaccttttatag

SEQ ID NO: 579119 - DNA, 25 bp, Mus musculus
gctttccacctctaaccttttatag

SEQ ID NO: 579120 - DNA, 25 bp, Mus musculus
gctttccagccaagcacctgttggg

SEQ ID NO: 579121 - DNA, 25 bp, Mus musculus
gctttccagccatgcacctgttggg

SEQ ID NO: 579122 - DNA, 25 bp, Mus musculus
gctttccagtttaatcagcgggatc

SEQ ID NO: 579123 - DNA, 25 bp, Mus musculus
gctttccagtttagagagatgcaag

SEQ ID NO: 579124 - DNA, 25 bp, Mus musculus
gctttccagttttatcagcgggatc

SEQ ID NO: 579125 - DNA, 25 bp, Mus musculus
gctttccagttttgagagatgcaag

SEQ ID NO: 579126 - DNA, 25 bp, Mus musculus
gctttccataaaacttcctcgtgtg

SEQ ID NO: 579127 - DNA, 25 bp, Mus musculus
gctttccataaatcttcctcgtgtg

SEQ ID NO: 579128 - DNA, 25 bp, Mus musculus
gctttccatgcaatgtaatatattt

SEQ ID NO: 579129 - DNA, 25 bp, Mus musculus
gctttccatgcattgtaatatattt

SEQ ID NO: 579130 - DNA, 25 bp, Mus musculus
gctttccatggcatgaacttgtatc

SEQ ID NO: 579131 - DNA, 25 bp, Mus musculus
gctttccatggcttgaacttgtatc

SEQ ID NO: 579132 - DNA, 25 bp, Mus musculus
gctttcccacctcgaataagttttg

SEQ ID NO: 579133 - DNA, 25 bp, Mus musculus
gctttcccacctggaataagttttg

SEQ ID NO: 579134 - DNA, 25 bp, Mus musculus
gctttcccagttaatctgtatggat

SEQ ID NO: 579135 - DNA, 25 bp, Mus musculus
gctttcccagtttatctgtatggat

SEQ ID NO: 579136 - DNA, 25 bp, Mus musculus
gctttcccatcaaaatatatttttg

SEQ ID NO: 579137 - DNA, 25 bp, Mus musculus
gctttcccatcataatatatttttg

SEQ ID NO: 579138 - DNA, 25 bp, Mus musculus
gctttcccatgcactgatctaatga

SEQ ID NO: 579139 - DNA, 25 bp, Mus musculus
gctttcccatgctctgatctaatga

SEQ ID NO: 579140 - DNA, 25 bp, Mus musculus
gctttcccatggctcgctcgtgcac

SEQ ID NO: 579141 - DNA, 25 bp, Mus musculus
gctttcccatgggtcgctcgtgcac

SEQ ID NO: 579142 - DNA, 25 bp, Mus musculus
gctttccccactctgtcatttaaag

SEQ ID NO: 579143 - DNA, 25 bp, Mus musculus
gctttccccactgtgtcatttaaag

SEQ ID NO: 579144 - DNA, 25 bp, Mus musculus
gctttccccagaatcatgtagctta

SEQ ID NO: 579145 - DNA, 25 bp, Mus musculus
gctttccccagattcatgtagctta

SEQ ID NO: 579146 - DNA, 25 bp, Mus musculus
gctttccccagcatgttaatttgtt

SEQ ID NO: 579147 - DNA, 25 bp, Mus musculus
gctttccccagcttgttaatttgtt

SEQ ID NO: 579148 - DNA, 25 bp, Mus musculus
gctttccccagtaccagtcatagaa

SEQ ID NO: 579149 - DNA, 25 bp, Mus musculus
gctttccccagttccagtcatagaa

SEQ ID NO: 579150 - DNA, 25 bp, Mus musculus
gctttcccctgcactggagataaag

SEQ ID NO: 579151 - DNA, 25 bp, Mus musculus
gctttcccctgctctggagataaag

SEQ ID NO: 579152 - DNA, 25 bp, Mus musculus
gctttcccgtcaaatacattgtgct

SEQ ID NO: 579153 - DNA, 25 bp, Mus musculus
gctttcccgtcatatacattgtgct

SEQ ID NO: 579154 - DNA, 25 bp, Mus musculus
gctttccctagcagaggttttttgg

SEQ ID NO: 579155 - DNA, 25 bp, Mus musculus
gctttccctagctgaggttttttgg

SEQ ID NO: 579156 - DNA, 25 bp, Mus musculus
gctttccctgcgattctttagaata

SEQ ID NO: 579157 - DNA, 25 bp, Mus musculus
gctttccctgcgtttctttagaata

SEQ ID NO: 579158 - DNA, 25 bp, Mus musculus
gctttccctggtattcagacacagc

SEQ ID NO: 579159 - DNA, 25 bp, Mus musculus
gctttccctggttttcagacacagc

SEQ ID NO: 579160 - DNA, 25 bp, Mus musculus
gctttccctttcacactggattttt

SEQ ID NO: 579161 - DNA, 25 bp, Mus musculus
gctttccctttctcactggattttt

SEQ ID NO: 579162 - DNA, 25 bp, Mus musculus
gctttccgcgcgacgatcgccaagt

SEQ ID NO: 579163 - DNA, 25 bp, Mus musculus
gctttccgcgcgtcgatcgccaagt

SEQ ID NO: 579164 - DNA, 25 bp, Mus musculus
gctttccgcttaattgtgaaccagt

SEQ ID NO: 579165 - DNA, 25 bp, Mus musculus
gctttccgcttatttgtgaaccagt

SEQ ID NO: 579166 - DNA, 25 bp, Mus musculus
gctttccgctttcctgggaccaggt

SEQ ID NO: 579167 - DNA, 25 bp, Mus musculus
gctttccgctttgctgggaccaggt

SEQ ID NO: 579168 - DNA, 25 bp, Mus musculus
gctttccgggtccagatatctaatc

SEQ ID NO: 579169 - DNA, 25 bp, Mus musculus
gctttccgggtcgagatatctaatc

SEQ ID NO: 579170 - DNA, 25 bp, Mus musculus
gctttccgtggcattgaagtttact

SEQ ID NO: 579171 - DNA, 25 bp, Mus musculus
gctttccgtggctttgaagtttact

SEQ ID NO: 579172 - DNA, 25 bp, Mus musculus
gctttcctaacccaatcatattcaa

SEQ ID NO: 579173 - DNA, 25 bp, Mus musculus
gctttcctaaccgaatcatattcaa

SEQ ID NO: 579174 - DNA, 25 bp, Mus musculus
gctttcctaatgctgacccactata

SEQ ID NO: 579175 - DNA, 25 bp, Mus musculus
gctttcctaatggtgacccactata

SEQ ID NO: 579176 - DNA, 25 bp, Mus musculus
gctttcctacccacaaatcctaaat

SEQ ID NO: 579177 - DNA, 25 bp, Mus musculus
gctttcctaccctcaaatcctaaat

SEQ ID NO: 579178 - DNA, 25 bp, Mus musculus
gctttcctaggccttgctgtgagca

SEQ ID NO: 579179 - DNA, 25 bp, Mus musculus
gctttcctaggcgttgctgtgagca

SEQ ID NO: 579180 - DNA, 25 bp, Mus musculus
gctttcctatagagtcaggtagaca

SEQ ID NO: 579181 - DNA, 25 bp, Mus musculus
gctttcctatagtgtcaggtagaca

SEQ ID NO: 579182 - DNA, 25 bp, Mus musculus
gctttcctattgctgggcatggcag

SEQ ID NO: 579183 - DNA, 25 bp, Mus musculus
gctttcctattggtgggcatggcag

SEQ ID NO: 579184 - DNA, 25 bp, Mus musculus
gctttcctcagcactttgtttgccc

SEQ ID NO: 579185 - DNA, 25 bp, Mus musculus
gctttcctcagcagctgtaagtgtg

SEQ ID NO: 579186 - DNA, 25 bp, Mus musculus
gctttcctcagctctttgtttgccc

SEQ ID NO: 579187 - DNA, 25 bp, Mus musculus
gctttcctcagctgctgtaagtgtg

SEQ ID NO: 579188 - DNA, 25 bp, Mus musculus
gctttcctcagtcagtttacatata

SEQ ID NO: 579189 - DNA, 25 bp, Mus musculus
gctttcctcagtgagtttacatata

SEQ ID NO: 579190 - DNA, 25 bp, Mus musculus
gctttcctcatgaggacctgctaga

SEQ ID NO: 579191 - DNA, 25 bp, Mus musculus
gctttcctcatgtggacctgctaga

SEQ ID NO: 579192 - DNA, 25 bp, Mus musculus
gctttcctcctgcttctgagctttt

SEQ ID NO: 579193 - DNA, 25 bp, Mus musculus
gctttcctcctggttctgagctttt

SEQ ID NO: 579194 - DNA, 25 bp, Mus musculus
gctttcctcggacacaggtggcatg

SEQ ID NO: 579195 - DNA, 25 bp, Mus musculus
gctttcctcggagacaggtggcatg

SEQ ID NO: 579196 - DNA, 25 bp, Mus musculus
gctttcctctcactagacacagtac

SEQ ID NO: 579197 - DNA, 25 bp, Mus musculus
gctttcctctcagtagacacagtac

SEQ ID NO: 579198 - DNA, 25 bp, Mus musculus
gctttcctctggatttaaaggcaca

SEQ ID NO: 579199 - DNA, 25 bp, Mus musculus
gctttcctctggttttaaaggcaca

SEQ ID NO: 579200 - DNA, 25 bp, Mus musculus
gctttcctgagaattcctggtgcaa

SEQ ID NO: 579201 - DNA, 25 bp, Mus musculus
gctttcctgagatttcctggtgcaa

SEQ ID NO: 579202 - DNA, 25 bp, Mus musculus
gctttcctgcgcagggagttcccca

SEQ ID NO: 579203 - DNA, 25 bp, Mus musculus
gctttcctgcgctgggagttcccca

SEQ ID NO: 579204 - DNA, 25 bp, Mus musculus
gctttcctgggactgagccttggca

SEQ ID NO: 579205 - DNA, 25 bp, Mus musculus
gctttcctgggagtgagccttggca

SEQ ID NO: 579206 - DNA, 25 bp, Mus musculus
gctttcctggtaagttaactcctca

SEQ ID NO: 579207 - DNA, 25 bp, Mus musculus
gctttcctggtatgttaactcctca

SEQ ID NO: 579208 - DNA, 25 bp, Mus musculus
gctttcctgtcaaagtgttctgtta

SEQ ID NO: 579209 - DNA, 25 bp, Mus musculus
gctttcctgtcatagtgttctgtta

SEQ ID NO: 579210 - DNA, 25 bp, Mus musculus
gctttcctgtctaaatctcggtaac

SEQ ID NO: 579211 - DNA, 25 bp, Mus musculus
gctttcctgtcttaatctcggtaac

SEQ ID NO: 579212 - DNA, 25 bp, Mus musculus
gctttcctgtgtcaaaaacactctc

SEQ ID NO: 579213 - DNA, 25 bp, Mus musculus
gctttcctgtgtgaaaaacactctc

SEQ ID NO: 579214 - DNA, 25 bp, Mus musculus
gctttccttgttactattgacacat

SEQ ID NO: 579215 - DNA, 25 bp, Mus musculus
gctttccttgtttctattgacacat

SEQ ID NO: 579216 - DNA, 25 bp, Mus musculus
gctttcctttcaatgcagtttcctt

SEQ ID NO: 579217 - DNA, 25 bp, Mus musculus
gctttcctttcacttatcttttctt

SEQ ID NO: 579218 - DNA, 25 bp, Mus musculus
gctttcctttcagttatcttttctt

SEQ ID NO: 579219 - DNA, 25 bp, Mus musculus
gctttcctttcattgcagtttcctt

SEQ ID NO: 579220 - DNA, 25 bp, Mus musculus
gctttcgagtaacccgaactcactt

SEQ ID NO: 579221 - DNA, 25 bp, Mus musculus
gctttcgagtaagccgaactcactt

SEQ ID NO: 579222 - DNA, 25 bp, Mus musculus
gctttcgatgaaaactttacaggat

SEQ ID NO: 579223 - DNA, 25 bp, Mus musculus
gctttcgatgaatactttacaggat

SEQ ID NO: 579224 - DNA, 25 bp, Mus musculus
gctttcgattaaaagatcactgctg

SEQ ID NO: 579225 - DNA, 25 bp, Mus musculus
gctttcgattaatagatcactgctg

SEQ ID NO: 579226 - DNA, 25 bp, Mus musculus
gctttcgccagacaagtccttagag

SEQ ID NO: 579227 - DNA, 25 bp, Mus musculus
gctttcgccagagaagtccttagag

SEQ ID NO: 579228 - DNA, 25 bp, Mus musculus
gctttcgccctcaaacacttgaaaa

SEQ ID NO: 579229 - DNA, 25 bp, Mus musculus
gctttcgccctctaacacttgaaaa

SEQ ID NO: 579230 - DNA, 25 bp, Mus musculus
gctttcggcatcactattgactttg

SEQ ID NO: 579231 - DNA, 25 bp, Mus musculus
gctttcggcatcaggaaatctgact

SEQ ID NO: 579232 - DNA, 25 bp, Mus musculus
gctttcggcatctctattgactttg

SEQ ID NO: 579233 - DNA, 25 bp, Mus musculus
gctttcggcatctggaaatctgact

SEQ ID NO: 579234 - DNA, 25 bp, Mus musculus
gctttcggcattatggtgggcaaca

SEQ ID NO: 579235 - DNA, 25 bp, Mus musculus
gctttcggcattttggtgggcaaca

SEQ ID NO: 579236 - DNA, 25 bp, Mus musculus
gctttcggtttcaagcaccattatc

SEQ ID NO: 579237 - DNA, 25 bp, Mus musculus
gctttcggtttctagcaccattatc

SEQ ID NO: 579238 - DNA, 25 bp, Mus musculus
gctttcgtatcaaataatctgcaat

SEQ ID NO: 579239 - DNA, 25 bp, Mus musculus
gctttcgtatcatataatctgcaat

SEQ ID NO: 579240 - DNA, 25 bp, Mus musculus
gctttcgtcctcctttactttgcaa

SEQ ID NO: 579241 - DNA, 25 bp, Mus musculus
gctttcgtcctcgtttactttgcaa

SEQ ID NO: 579242 - DNA, 25 bp, Mus musculus
gctttcgttaacagtagagtgaatg

SEQ ID NO: 579243 - DNA, 25 bp, Mus musculus
gctttcgttaactgtagagtgaatg

SEQ ID NO: 579244 - DNA, 25 bp, Mus musculus
gctttcgttggcaacaatgtgcaga

SEQ ID NO: 579245 - DNA, 25 bp, Mus musculus
gctttcgttggctacaatgtgcaga

SEQ ID NO: 579246 - DNA, 25 bp, Mus musculus
gctttctaaactaactacccactgg

SEQ ID NO: 579247 - DNA, 25 bp, Mus musculus
gctttctaaacttactacccactgg

SEQ ID NO: 579248 - DNA, 25 bp, Mus musculus
gctttctaaagtatgcttgcggctc

SEQ ID NO: 579249 - DNA, 25 bp, Mus musculus
gctttctaaagtttgcttgcggctc

SEQ ID NO: 579250 - DNA, 25 bp, Mus musculus
gctttctaagcccaacggataggaa

SEQ ID NO: 579251 - DNA, 25 bp, Mus musculus
gctttctaagccgaacggataggaa

SEQ ID NO: 579252 - DNA, 25 bp, Mus musculus
gctttctaagctataccagttgact

SEQ ID NO: 579253 - DNA, 25 bp, Mus musculus
gctttctaagctttaccagttgact

SEQ ID NO: 579254 - DNA, 25 bp, Mus musculus
gctttctaataaaccagtgctttgt

SEQ ID NO: 579255 - DNA, 25 bp, Mus musculus
gctttctaataatccagtgctttgt

SEQ ID NO: 579256 - DNA, 25 bp, Mus musculus
gctttctacaccctgaagtgactga

SEQ ID NO: 579257 - DNA, 25 bp, Mus musculus
gctttctacaccgtgaagtgactga

SEQ ID NO: 579258 - DNA, 25 bp, Mus musculus
gctttctacatcaggctccatgatc

SEQ ID NO: 579259 - DNA, 25 bp, Mus musculus
gctttctacatcagggattgctatt

SEQ ID NO: 579260 - DNA, 25 bp, Mus musculus
gctttctacatctggctccatgatc

SEQ ID NO: 579261 - DNA, 25 bp, Mus musculus
gctttctacatctgggattgctatt

SEQ ID NO: 579262 - DNA, 25 bp, Mus musculus
gctttctaccatcagggctacgcag

SEQ ID NO: 579263 - DNA, 25 bp, Mus musculus
gctttctaccatgagggctacgcag

SEQ ID NO: 579264 - DNA, 25 bp, Mus musculus
gctttctactggcacttaggttgac

SEQ ID NO: 579265 - DNA, 25 bp, Mus musculus
gctttctactgggacttaggttgac

SEQ ID NO: 579266 - DNA, 25 bp, Mus musculus
gctttctagaatctttctcttgata

SEQ ID NO: 579267 - DNA, 25 bp, Mus musculus
gctttctagaatgtttctcttgata

SEQ ID NO: 579268 - DNA, 25 bp, Mus musculus
gctttctagacaagaccttggatga

SEQ ID NO: 579269 - DNA, 25 bp, Mus musculus
gctttctagacatgaccttggatga

SEQ ID NO: 579270 - DNA, 25 bp, Mus musculus
gctttctagccccaagaacgatttt

SEQ ID NO: 579271 - DNA, 25 bp, Mus musculus
gctttctagcccgaagaacgatttt

SEQ ID NO: 579272 - DNA, 25 bp, Mus musculus
gctttctatagaagagtgtctccat

SEQ ID NO: 579273 - DNA, 25 bp, Mus musculus
gctttctatagatgagtgtctccat

SEQ ID NO: 579274 - DNA, 25 bp, Mus musculus
gctttctatcgacgctgatgtcaga

SEQ ID NO: 579275 - DNA, 25 bp, Mus musculus
gctttctatcgaggctgatgtcaga

SEQ ID NO: 579276 - DNA, 25 bp, Mus musculus
gctttctatgcacgtattgtacaaa

SEQ ID NO: 579277 - DNA, 25 bp, Mus musculus
gctttctatgcaggtattgtacaaa

SEQ ID NO: 579278 - DNA, 25 bp, Mus musculus
gctttctatttaattctctcctgga

SEQ ID NO: 579279 - DNA, 25 bp, Mus musculus
gctttctatttatttctctcctgga

SEQ ID NO: 579280 - DNA, 25 bp, Mus musculus
gctttctatttgatggtttcctgta

SEQ ID NO: 579281 - DNA, 25 bp, Mus musculus
gctttctatttgttggtttcctgta

SEQ ID NO: 579282 - DNA, 25 bp, Mus musculus
gctttctcactaattgacaaggacg

SEQ ID NO: 579283 - DNA, 25 bp, Mus musculus
gctttctcactatttgacaaggacg

SEQ ID NO: 579284 - DNA, 25 bp, Mus musculus
gctttctcactcatacatgtcattt

SEQ ID NO: 579285 - DNA, 25 bp, Mus musculus
gctttctcactcttacatgtcattt

SEQ ID NO: 579286 - DNA, 25 bp, Mus musculus
gctttctcagaaaactccaccaagt

SEQ ID NO: 579287 - DNA, 25 bp, Mus musculus
gctttctcagaatactccaccaagt

SEQ ID NO: 579288 - DNA, 25 bp, Mus musculus
gctttctcagatccgctaacaactt

SEQ ID NO: 579289 - DNA, 25 bp, Mus musculus
gctttctcagatgcgctaacaactt

SEQ ID NO: 579290 - DNA, 25 bp, Mus musculus
gctttctcagccacctccttttaaa

SEQ ID NO: 579291 - DNA, 25 bp, Mus musculus
gctttctcagcctcctccttttaaa

SEQ ID NO: 579292 - DNA, 25 bp, Mus musculus
gctttctcagtacatttgctccaaa

SEQ ID NO: 579293 - DNA, 25 bp, Mus musculus
gctttctcagtagatttgctccaaa

SEQ ID NO: 579294 - DNA, 25 bp, Mus musculus
gctttctcatagcatctgaggccta

SEQ ID NO: 579295 - DNA, 25 bp, Mus musculus
gctttctcataggatctgaggccta

SEQ ID NO: 579296 - DNA, 25 bp, Mus musculus
gctttctcatcacagctttgacagc

SEQ ID NO: 579297 - DNA, 25 bp, Mus musculus
gctttctcatcagagctttgacagc

SEQ ID NO: 579298 - DNA, 25 bp, Mus musculus
gctttctccacacattgcttgcaga

SEQ ID NO: 579299 - DNA, 25 bp, Mus musculus
gctttctccacagattgcttgcaga

SEQ ID NO: 579300 - DNA, 25 bp, Mus musculus
gctttctccattaatacactcgaga

SEQ ID NO: 579301 - DNA, 25 bp, Mus musculus
gctttctccatttatacactcgaga

SEQ ID NO: 579302 - DNA, 25 bp, Mus musculus
gctttctcccatatctacttttgtt

SEQ ID NO: 579303 - DNA, 25 bp, Mus musculus
gctttctcccatttctacttttgtt

SEQ ID NO: 579304 - DNA, 25 bp, Mus musculus
gctttctccctaatcgataaagatg

SEQ ID NO: 579305 - DNA, 25 bp, Mus musculus
gctttctccctattcgataaagatg

SEQ ID NO: 579306 - DNA, 25 bp, Mus musculus
gctttctccttcatcagttggtgat

SEQ ID NO: 579307 - DNA, 25 bp, Mus musculus
gctttctccttcttcagttggtgat

SEQ ID NO: 579308 - DNA, 25 bp, Mus musculus
gctttctcgtgacccaaatgtaaga

SEQ ID NO: 579309 - DNA, 25 bp, Mus musculus
gctttctcgtgagccaaatgtaaga

SEQ ID NO: 579310 - DNA, 25 bp, Mus musculus
gctttctctacaacctggcagaata

SEQ ID NO: 579311 - DNA, 25 bp, Mus musculus
gctttctctacatcctggcagaata

SEQ ID NO: 579312 - DNA, 25 bp, Mus musculus
gctttctctctccatgtggttgata

SEQ ID NO: 579313 - DNA, 25 bp, Mus musculus
gctttctctctcgatgtggttgata

SEQ ID NO: 579314 - DNA, 25 bp, Mus musculus
gctttctctgctctcatggattgaa

SEQ ID NO: 579315 - DNA, 25 bp, Mus musculus
gctttctctgctgtcatggattgaa

SEQ ID NO: 579316 - DNA, 25 bp, Mus musculus
gctttctctggaatgtagactgtac

SEQ ID NO: 579317 - DNA, 25 bp, Mus musculus
gctttctctggattgtagactgtac

SEQ ID NO: 579318 - DNA, 25 bp, Mus musculus
gctttctctgttcggaaatgggcac

SEQ ID NO: 579319 - DNA, 25 bp, Mus musculus
gctttctctgttgggaaatgggcac

SEQ ID NO: 579320 - DNA, 25 bp, Mus musculus
gctttctcttgcacaacaactaatg

SEQ ID NO: 579321 - DNA, 25 bp, Mus musculus
gctttctcttgctcaacaactaatg

SEQ ID NO: 579322 - DNA, 25 bp, Mus musculus
gctttctctttcagcctaagtctat

SEQ ID NO: 579323 - DNA, 25 bp, Mus musculus
gctttctctttctgcctaagtctat

SEQ ID NO: 579324 - DNA, 25 bp, Mus musculus
gctttctgaacaaatcacatggtag

SEQ ID NO: 579325 - DNA, 25 bp, Mus musculus
gctttctgaacatatcacatggtag

SEQ ID NO: 579326 - DNA, 25 bp, Mus musculus
gctttctgacttagacactcacgtt

SEQ ID NO: 579327 - DNA, 25 bp, Mus musculus
gctttctgactttgacactcacgtt

SEQ ID NO: 579328 - DNA, 25 bp, Mus musculus
gctttctgagatctataaattgaca

SEQ ID NO: 579329 - DNA, 25 bp, Mus musculus
gctttctgagatgtataaattgaca

SEQ ID NO: 579330 - DNA, 25 bp, Mus musculus
gctttctgagccatataccttgtga

SEQ ID NO: 579331 - DNA, 25 bp, Mus musculus
gctttctgagccttataccttgtga

SEQ ID NO: 579332 - DNA, 25 bp, Mus musculus
gctttctgaggcaacttggcatatt

SEQ ID NO: 579333 - DNA, 25 bp, Mus musculus
gctttctgaggccttcttaacaggg

SEQ ID NO: 579334 - DNA, 25 bp, Mus musculus
gctttctgaggcgttcttaacaggg

SEQ ID NO: 579335 - DNA, 25 bp, Mus musculus
gctttctgaggctacttggcatatt

SEQ ID NO: 579336 - DNA, 25 bp, Mus musculus
gctttctgatctagtgcttgaggta

SEQ ID NO: 579337 - DNA, 25 bp, Mus musculus
gctttctgatcttgtgcttgaggta

SEQ ID NO: 579338 - DNA, 25 bp, Mus musculus
gctttctgcactaaatttctagcat

SEQ ID NO: 579339 - DNA, 25 bp, Mus musculus
gctttctgcacttaatttctagcat

SEQ ID NO: 579340 - DNA, 25 bp, Mus musculus
gctttctgctcacagcaatgggtta

SEQ ID NO: 579341 - DNA, 25 bp, Mus musculus
gctttctgctcagagcaatgggtta

SEQ ID NO: 579342 - DNA, 25 bp, Mus musculus
gctttctgctccagactttttgttg

SEQ ID NO: 579343 - DNA, 25 bp, Mus musculus
gctttctgctcctgactttttgttg

SEQ ID NO: 579344 - DNA, 25 bp, Mus musculus
gctttctgctgccatggctattaca

SEQ ID NO: 579345 - DNA, 25 bp, Mus musculus
gctttctgctgcgatggctattaca

SEQ ID NO: 579346 - DNA, 25 bp, Mus musculus
gctttctgcttcacaagcaggcgtt

SEQ ID NO: 579347 - DNA, 25 bp, Mus musculus
gctttctgcttcacaggtctctagc

SEQ ID NO: 579348 - DNA, 25 bp, Mus musculus
gctttctgcttccttgggtggtttt

SEQ ID NO: 579349 - DNA, 25 bp, Mus musculus
gctttctgcttcgttgggtggtttt

SEQ ID NO: 579350 - DNA, 25 bp, Mus musculus
gctttctgcttctcaagcaggcgtt

SEQ ID NO: 579351 - DNA, 25 bp, Mus musculus
gctttctgcttctcaggtctctagc

SEQ ID NO: 579352 - DNA, 25 bp, Mus musculus
gctttctggaccaccctgagatcta

SEQ ID NO: 579353 - DNA, 25 bp, Mus musculus
gctttctggacctccctgagatcta

SEQ ID NO: 579354 - DNA, 25 bp, Mus musculus
gctttctggagcatctaccggtgat

SEQ ID NO: 579355 - DNA, 25 bp, Mus musculus
gctttctggagcttctaccggtgat

SEQ ID NO: 579356 - DNA, 25 bp, Mus musculus
gctttctggatcacgttagccacag

SEQ ID NO: 579357 - DNA, 25 bp, Mus musculus
gctttctggatctcgttagccacag

SEQ ID NO: 579358 - DNA, 25 bp, Mus musculus
gctttctggatgaggcgctgctaca

SEQ ID NO: 579359 - DNA, 25 bp, Mus musculus
gctttctggatgtggcgctgctaca

SEQ ID NO: 579360 - DNA, 25 bp, Mus musculus
gctttctgtaagatggcaacctgta

SEQ ID NO: 579361 - DNA, 25 bp, Mus musculus
gctttctgtaagttggcaacctgta

SEQ ID NO: 579362 - DNA, 25 bp, Mus musculus
gctttctgtatcacagcactaaagg

SEQ ID NO: 579363 - DNA, 25 bp, Mus musculus
gctttctgtatctcagcactaaagg

SEQ ID NO: 579364 - DNA, 25 bp, Mus musculus
gctttctgtcagcaagctgttctca

SEQ ID NO: 579365 - DNA, 25 bp, Mus musculus
gctttctgtcaggaagctgttctca

SEQ ID NO: 579366 - DNA, 25 bp, Mus musculus
gctttctgtctgcactaatctgtta

SEQ ID NO: 579367 - DNA, 25 bp, Mus musculus
gctttctgtctggactaatctgtta

SEQ ID NO: 579368 - DNA, 25 bp, Mus musculus
gctttctgtgacaaatcatgtgtat

SEQ ID NO: 579369 - DNA, 25 bp, Mus musculus
gctttctgtgactaatcatgtgtat

SEQ ID NO: 579370 - DNA, 25 bp, Mus musculus
gctttctgttatcggttttcctgtt

SEQ ID NO: 579371 - DNA, 25 bp, Mus musculus
gctttctgttatgggttttcctgtt

SEQ ID NO: 579372 - DNA, 25 bp, Mus musculus
gctttcttaaagacccatacatcag

SEQ ID NO: 579373 - DNA, 25 bp, Mus musculus
gctttcttaaagtcccatacatcag

SEQ ID NO: 579374 - DNA, 25 bp, Mus musculus
gctttcttaagaaccatgtgggcca

SEQ ID NO: 579375 - DNA, 25 bp, Mus musculus
gctttcttaagatccatgtgggcca

SEQ ID NO: 579376 - DNA, 25 bp, Mus musculus
gctttcttacccatgttctagatga

SEQ ID NO: 579377 - DNA, 25 bp, Mus musculus
gctttcttacccttgttctagatga

SEQ ID NO: 579378 - DNA, 25 bp, Mus musculus
gctttcttacctccttttaggcaat

SEQ ID NO: 579379 - DNA, 25 bp, Mus musculus
gctttcttacctgcttttaggcaat

SEQ ID NO: 579380 - DNA, 25 bp, Mus musculus
gctttcttactacaagttgtttgga

SEQ ID NO: 579381 - DNA, 25 bp, Mus musculus
gctttcttactagaagttgtttgga

SEQ ID NO: 579382 - DNA, 25 bp, Mus musculus
gctttcttagacagcctaggaccag

SEQ ID NO: 579383 - DNA, 25 bp, Mus musculus
gctttcttagactgcctaggaccag

SEQ ID NO: 579384 - DNA, 25 bp, Mus musculus
gctttcttagataatggcctcgcca

SEQ ID NO: 579385 - DNA, 25 bp, Mus musculus
gctttcttagattatggcctcgcca

SEQ ID NO: 579386 - DNA, 25 bp, Mus musculus
gctttcttagtaactctctaaatct

SEQ ID NO: 579387 - DNA, 25 bp, Mus musculus
gctttcttagtatctctctaaatct

SEQ ID NO: 579388 - DNA, 25 bp, Mus musculus
gctttcttatttctgtacccaatcc

SEQ ID NO: 579389 - DNA, 25 bp, Mus musculus
gctttcttatttgtgtacccaatcc

SEQ ID NO: 579390 - DNA, 25 bp, Mus musculus
gctttcttccctccattaaaaactt

SEQ ID NO: 579391 - DNA, 25 bp, Mus musculus
gctttcttccctgcattaaaaactt

SEQ ID NO: 579392 - DNA, 25 bp, Mus musculus
gctttcttcctccttgtttatgata

SEQ ID NO: 579393 - DNA, 25 bp, Mus musculus
gctttcttcctcgttgtttatgata

SEQ ID NO: 579394 - DNA, 25 bp, Mus musculus
gctttcttcgagcaaccagctgcct

SEQ ID NO: 579395 - DNA, 25 bp, Mus musculus
gctttcttcgaggaaccagctgcct

SEQ ID NO: 579396 - DNA, 25 bp, Mus musculus
gctttcttctagcagttgaatcact

SEQ ID NO: 579397 - DNA, 25 bp, Mus musculus
gctttcttctaggagttgaatcact

SEQ ID NO: 579398 - DNA, 25 bp, Mus musculus
gctttcttctgtaacattctgttct

SEQ ID NO: 579399 - DNA, 25 bp, Mus musculus
gctttcttctgttacattctgttct

SEQ ID NO: 579400 - DNA, 25 bp, Mus musculus
gctttcttgactatcttgcataaga

SEQ ID NO: 579401 - DNA, 25 bp, Mus musculus
gctttcttgactttcttgcataaga

SEQ ID NO: 579402 - DNA, 25 bp, Mus musculus
gctttcttgcttaacttaacgttag

SEQ ID NO: 579403 - DNA, 25 bp, Mus musculus
gctttcttgctttacttaacgttag

SEQ ID NO: 579404 - DNA, 25 bp, Mus musculus
gctttcttggaacgaataacactgt

SEQ ID NO: 579405 - DNA, 25 bp, Mus musculus
gctttcttggaaggaataacactgt

SEQ ID NO: 579406 - DNA, 25 bp, Mus musculus
gctttcttggagcaggcagtatctt

SEQ ID NO: 579407 - DNA, 25 bp, Mus musculus
gctttcttggaggaggcagtatctt

SEQ ID NO: 579408 - DNA, 25 bp, Mus musculus
gctttcttgtacagtcttaagttca

SEQ ID NO: 579409 - DNA, 25 bp, Mus musculus
gctttcttgtactgtcttaagttca

SEQ ID NO: 579410 - DNA, 25 bp, Mus musculus
gctttcttgtagatgctctgctgca

SEQ ID NO: 579411 - DNA, 25 bp, Mus musculus
gctttcttgtagttgctctgctgca

SEQ ID NO: 579412 - DNA, 25 bp, Mus musculus
gctttcttgtgcctcacagaattct

SEQ ID NO: 579413 - DNA, 25 bp, Mus musculus
gctttcttgtgcgtcacagaattct

SEQ ID NO: 579414 - DNA, 25 bp, Mus musculus
gctttctttagcaacttcaatcaac

SEQ ID NO: 579415 - DNA, 25 bp, Mus musculus
gctttctttagctacttcaatcaac

SEQ ID NO: 579416 - DNA, 25 bp, Mus musculus
gctttctttattctgcctaaagtcc

SEQ ID NO: 579417 - DNA, 25 bp, Mus musculus
gctttctttattgtgcctaaagtcc

SEQ ID NO: 579418 - DNA, 25 bp, Mus musculus
gctttctttcatcctggtgatctta

SEQ ID NO: 579419 - DNA, 25 bp, Mus musculus
gctttctttcatgctggtgatctta

SEQ ID NO: 579420 - DNA, 25 bp, Mus musculus
gctttctttccacacatatttcatg

SEQ ID NO: 579421 - DNA, 25 bp, Mus musculus
gctttctttccagacatatttcatg

SEQ ID NO: 579422 - DNA, 25 bp, Mus musculus
gctttctttcctcattgttctataa

SEQ ID NO: 579423 - DNA, 25 bp, Mus musculus
gctttctttcctgattgttctataa

SEQ ID NO: 579424 - DNA, 25 bp, Mus musculus
gctttctttctcaaacagggtctta

SEQ ID NO: 579425 - DNA, 25 bp, Mus musculus
gctttctttctctaacagggtctta

SEQ ID NO: 579426 - DNA, 25 bp, Mus musculus
gctttctttgacattctgctctgaa

SEQ ID NO: 579427 - DNA, 25 bp, Mus musculus
gctttctttgactttctgctctgaa

SEQ ID NO: 579428 - DNA, 25 bp, Mus musculus
gctttctttggcatgattctgttat

SEQ ID NO: 579429 - DNA, 25 bp, Mus musculus
gctttctttggcttgattctgttat

SEQ ID NO: 579430 - DNA, 25 bp, Mus musculus
gctttctttgtcattggctgagtaa

SEQ ID NO: 579431 - DNA, 25 bp, Mus musculus
gctttctttgtctttggctgagtaa

SEQ ID NO: 579432 - DNA, 25 bp, Mus musculus
gctttcttttcaccaatgctctgaa

SEQ ID NO: 579433 - DNA, 25 bp, Mus musculus
gctttcttttcagcaatgctctgaa

SEQ ID NO: 579434 - DNA, 25 bp, Mus musculus
gctttcttttgccatctgacctgca

SEQ ID NO: 579435 - DNA, 25 bp, Mus musculus
gctttcttttgcgatctgacctgca

SEQ ID NO: 579436 - DNA, 25 bp, Mus musculus
gctttcttttgtacacacagctcat

SEQ ID NO: 579437 - DNA, 25 bp, Mus musculus
gctttcttttgtccaattatctctg

SEQ ID NO: 579438 - DNA, 25 bp, Mus musculus
gctttcttttgtgcaattatctctg

SEQ ID NO: 579439 - DNA, 25 bp, Mus musculus
gctttcttttgttcacacagctcat

SEQ ID NO: 579440 - DNA, 25 bp, Mus musculus
gctttgaaaaagcactgccgaagaa

SEQ ID NO: 579441 - DNA, 25 bp, Mus musculus
gctttgaaaaaggactgccgaagaa

SEQ ID NO: 579442 - DNA, 25 bp, Mus musculus
gctttgaaaacactgcataatccgt

SEQ ID NO: 579443 - DNA, 25 bp, Mus musculus
gctttgaaaacagtgcataatccgt

SEQ ID NO: 579444 - DNA, 25 bp, Mus musculus
gctttgaaaaccagctgtcgtggga

SEQ ID NO: 579445 - DNA, 25 bp, Mus musculus
gctttgaaaacctgctgtcgtggga

SEQ ID NO: 579446 - DNA, 25 bp, Mus musculus
gctttgaaaagcaccgattaaacaa

SEQ ID NO: 579447 - DNA, 25 bp, Mus musculus
gctttgaaaagctccgattaaacaa

SEQ ID NO: 579448 - DNA, 25 bp, Mus musculus
gctttgaaaattccatagctgatag

SEQ ID NO: 579449 - DNA, 25 bp, Mus musculus
gctttgaaaattgcatagctgatag

SEQ ID NO: 579450 - DNA, 25 bp, Mus musculus
gctttgaaagtgctaacctcggccg

SEQ ID NO: 579451 - DNA, 25 bp, Mus musculus
gctttgaaagtggtaacctcggccg

SEQ ID NO: 579452 - DNA, 25 bp, Mus musculus
gctttgaacactcatcagatgctct

SEQ ID NO: 579453 - DNA, 25 bp, Mus musculus
gctttgaacactgatcagatgctct

SEQ ID NO: 579454 - DNA, 25 bp, Mus musculus
gctttgaacatgacttctctggcga

SEQ ID NO: 579455 - DNA, 25 bp, Mus musculus
gctttgaacatgtcttctctggcga

SEQ ID NO: 579456 - DNA, 25 bp, Mus musculus
gctttgaaccacatagtttttaatt

SEQ ID NO: 579457 - DNA, 25 bp, Mus musculus
gctttgaaccacttagtttttaatt

SEQ ID NO: 579458 - DNA, 25 bp, Mus musculus
gctttgaactcaaagctgagagtaa

SEQ ID NO: 579459 - DNA, 25 bp, Mus musculus
gctttgaactcacagagctctgcct

SEQ ID NO: 579460 - DNA, 25 bp, Mus musculus
gctttgaactcagagagctctgcct

SEQ ID NO: 579461 - DNA, 25 bp, Mus musculus
gctttgaactcatagctgagagtaa

SEQ ID NO: 579462 - DNA, 25 bp, Mus musculus
gctttgaactctagcagctgaggct

SEQ ID NO: 579463 - DNA, 25 bp, Mus musculus
gctttgaactcttgcagctgaggct

SEQ ID NO: 579464 - DNA, 25 bp, Mus musculus
gctttgaactgtataatcctcgaat

SEQ ID NO: 579465 - DNA, 25 bp, Mus musculus
gctttgaactgtatgctcatgtcac

SEQ ID NO: 579466 - DNA, 25 bp, Mus musculus
gctttgaactgtttaatcctcgaat

SEQ ID NO: 579467 - DNA, 25 bp, Mus musculus
gctttgaactgtttgctcatgtcac

SEQ ID NO: 579468 - DNA, 25 bp, Mus musculus
gctttgaacttgactatggtcctgc

SEQ ID NO: 579469 - DNA, 25 bp, Mus musculus
gctttgaacttgagagtctcctagc

SEQ ID NO: 579470 - DNA, 25 bp, Mus musculus
gctttgaacttgtctatggtcctgc

SEQ ID NO: 579471 - DNA, 25 bp, Mus musculus
gctttgaacttgtgagtctcctagc

SEQ ID NO: 579472 - DNA, 25 bp, Mus musculus
gctttgaagactcaggacggccaga

SEQ ID NO: 579473 - DNA, 25 bp, Mus musculus
gctttgaagactgaggacggccaga

SEQ ID NO: 579474 - DNA, 25 bp, Mus musculus
gctttgaaggccactcacgaggaga

SEQ ID NO: 579475 - DNA, 25 bp, Mus musculus
gctttgaaggcctctcacgaggaga

SEQ ID NO: 579476 - DNA, 25 bp, Mus musculus
gctttgaagttccacagttacagat

SEQ ID NO: 579477 - DNA, 25 bp, Mus musculus
gctttgaagttcgacagttacagat

SEQ ID NO: 579478 - DNA, 25 bp, Mus musculus
gctttgaagtttcacgtggctgtta

SEQ ID NO: 579479 - DNA, 25 bp, Mus musculus
gctttgaagtttgacgtggctgtta

SEQ ID NO: 579480 - DNA, 25 bp, Mus musculus
gctttgaatactctagtgctgcatt

SEQ ID NO: 579481 - DNA, 25 bp, Mus musculus
gctttgaatactgtagtgctgcatt

SEQ ID NO: 579482 - DNA, 25 bp, Mus musculus
gctttgaatgaaatccagttgaatt

SEQ ID NO: 579483 - DNA, 25 bp, Mus musculus
gctttgaatgaattccagttgaatt

SEQ ID NO: 579484 - DNA, 25 bp, Mus musculus
gctttgacaaggcttatgtggtcct

SEQ ID NO: 579485 - DNA, 25 bp, Mus musculus
gctttgacaagggttatgtggtcct

SEQ ID NO: 579486 - DNA, 25 bp, Mus musculus
gctttgaccagacttccaccagcat

SEQ ID NO: 579487 - DNA, 25 bp, Mus musculus
gctttgaccagagttccaccagcat

SEQ ID NO: 579488 - DNA, 25 bp, Mus musculus
gctttgacgttcaaggttgagggat

SEQ ID NO: 579489 - DNA, 25 bp, Mus musculus
gctttgacgttctaggttgagggat

SEQ ID NO: 579490 - DNA, 25 bp, Mus musculus
gctttgactcatatcctctgaaaga

SEQ ID NO: 579491 - DNA, 25 bp, Mus musculus
gctttgactcatttcctctgaaaga

SEQ ID NO: 579492 - DNA, 25 bp, Mus musculus
gctttgactgacactaagacttgcc

SEQ ID NO: 579493 - DNA, 25 bp, Mus musculus
gctttgactgactctaagacttgcc

SEQ ID NO: 579494 - DNA, 25 bp, Mus musculus
gctttgacttcccagtggcaccaga

SEQ ID NO: 579495 - DNA, 25 bp, Mus musculus
gctttgacttccgagtggcaccaga

SEQ ID NO: 579496 - DNA, 25 bp, Mus musculus
gctttgagaaagcatcgcctccacc

SEQ ID NO: 579497 - DNA, 25 bp, Mus musculus
gctttgagaaaggatcgcctccacc

SEQ ID NO: 579498 - DNA, 25 bp, Mus musculus
gctttgagaatgacagggcatgcta

SEQ ID NO: 579499 - DNA, 25 bp, Mus musculus
gctttgagaatgtcagggcatgcta

SEQ ID NO: 579500 - DNA, 25 bp, Mus musculus
gctttgagacaacagtaccatgccc

SEQ ID NO: 579501 - DNA, 25 bp, Mus musculus
gctttgagacaagagtaccatgccc

SEQ ID NO: 579502 - DNA, 25 bp, Mus musculus
gctttgagccaaagtctgtaacatg

SEQ ID NO: 579503 - DNA, 25 bp, Mus musculus
gctttgagccaatgtctgtaacatg

SEQ ID NO: 579504 - DNA, 25 bp, Mus musculus
gctttgagcccaaagatccatgcat

SEQ ID NO: 579505 - DNA, 25 bp, Mus musculus
gctttgagcccatagatccatgcat

SEQ ID NO: 579506 - DNA, 25 bp, Mus musculus
gctttgagtagtatctggcttgcta

SEQ ID NO: 579507 - DNA, 25 bp, Mus musculus
gctttgagtagtttctggcttgcta

SEQ ID NO: 579508 - DNA, 25 bp, Mus musculus
gctttgagtgtacgcctcagtgcta

SEQ ID NO: 579509 - DNA, 25 bp, Mus musculus
gctttgagtgtaggcctcagtgcta

SEQ ID NO: 579510 - DNA, 25 bp, Mus musculus
gctttgatagtgctaagccaactga

SEQ ID NO: 579511 - DNA, 25 bp, Mus musculus
gctttgatagtggtaagccaactga

SEQ ID NO: 579512 - DNA, 25 bp, Mus musculus
gctttgatcagcacccggcggtgct

SEQ ID NO: 579513 - DNA, 25 bp, Mus musculus
gctttgatcagcagctcttccgaat

SEQ ID NO: 579514 - DNA, 25 bp, Mus musculus
gctttgatcagctcccggcggtgct

SEQ ID NO: 579515 - DNA, 25 bp, Mus musculus
gctttgatcagctgctcttccgaat

SEQ ID NO: 579516 - DNA, 25 bp, Mus musculus
gctttgatccaaaatttcctcacta

SEQ ID NO: 579517 - DNA, 25 bp, Mus musculus
gctttgatccaatatttcctcacta

SEQ ID NO: 579518 - DNA, 25 bp, Mus musculus
gctttgatcctaaaatccggtttct

SEQ ID NO: 579519 - DNA, 25 bp, Mus musculus
gctttgatcctataatccggtttct

SEQ ID NO: 579520 - DNA, 25 bp, Mus musculus
gctttgatgcttaaaggcagctctt

SEQ ID NO: 579521 - DNA, 25 bp, Mus musculus
gctttgatgctttaaggcagctctt

SEQ ID NO: 579522 - DNA, 25 bp, Mus musculus
gctttgatggccctggagaccctac

SEQ ID NO: 579523 - DNA, 25 bp, Mus musculus
gctttgatggccgtggagaccctac

SEQ ID NO: 579524 - DNA, 25 bp, Mus musculus
gctttgatgtcacccagaggcgtgt

SEQ ID NO: 579525 - DNA, 25 bp, Mus musculus
gctttgatgtcagccagaggcgtgt

SEQ ID NO: 579526 - DNA, 25 bp, Mus musculus
gctttgatgtgaactgttgccggga

SEQ ID NO: 579527 - DNA, 25 bp, Mus musculus
gctttgatgtgatctgttgccggga

SEQ ID NO: 579528 - DNA, 25 bp, Mus musculus
gctttgatgttcatgtatgcaccat

SEQ ID NO: 579529 - DNA, 25 bp, Mus musculus
gctttgatgttcttgtatgcaccat

SEQ ID NO: 579530 - DNA, 25 bp, Mus musculus
gctttgattcagacggaatggcgct

SEQ ID NO: 579531 - DNA, 25 bp, Mus musculus
gctttgattcagtcggaatggcgct

SEQ ID NO: 579532 - DNA, 25 bp, Mus musculus
gctttgatttccccagagctttccc

SEQ ID NO: 579533 - DNA, 25 bp, Mus musculus
gctttgatttccgcagagctttccc

SEQ ID NO: 579534 - DNA, 25 bp, Mus musculus
gctttgcaatgtagccatgcccaag

SEQ ID NO: 579535 - DNA, 25 bp, Mus musculus
gctttgcaatgttgccatgcccaag

SEQ ID NO: 579536 - DNA, 25 bp, Mus musculus
gctttgcacaacatccttaagactg

SEQ ID NO: 579537 - DNA, 25 bp, Mus musculus
gctttgcacaacttccttaagactg

SEQ ID NO: 579538 - DNA, 25 bp, Mus musculus
gctttgcacacgctggacattccca

SEQ ID NO: 579539 - DNA, 25 bp, Mus musculus
gctttgcacacggtggacattccca

SEQ ID NO: 579540 - DNA, 25 bp, Mus musculus
gctttgcacctaattcctatcaggt

SEQ ID NO: 579541 - DNA, 25 bp, Mus musculus
gctttgcacctatttcctatcaggt

SEQ ID NO: 579542 - DNA, 25 bp, Mus musculus
gctttgcaccttatgcctttagata

SEQ ID NO: 579543 - DNA, 25 bp, Mus musculus
gctttgcaccttttgcctttagata

SEQ ID NO: 579544 - DNA, 25 bp, Mus musculus
gctttgcagacgaatttccctggaa

SEQ ID NO: 579545 - DNA, 25 bp, Mus musculus
gctttgcagacgtatttccctggaa

SEQ ID NO: 579546 - DNA, 25 bp, Mus musculus
gctttgcataataggctctttttta

SEQ ID NO: 579547 - DNA, 25 bp, Mus musculus
gctttgcataattggctctttttta

SEQ ID NO: 579548 - DNA, 25 bp, Mus musculus
gctttgcatcaacgaaataatcagt

SEQ ID NO: 579549 - DNA, 25 bp, Mus musculus
gctttgcatcaaggaaataatcagt

SEQ ID NO: 579550 - DNA, 25 bp, Mus musculus
gctttgcatccgcatgagggctgaa

SEQ ID NO: 579551 - DNA, 25 bp, Mus musculus
gctttgcatccggatgagggctgaa

SEQ ID NO: 579552 - DNA, 25 bp, Mus musculus
gctttgcatgctcaactggatcgta

SEQ ID NO: 579553 - DNA, 25 bp, Mus musculus
gctttgcatgctgaactggatcgta

SEQ ID NO: 579554 - DNA, 25 bp, Mus musculus
gctttgcatgttcgccggaattaca

SEQ ID NO: 579555 - DNA, 25 bp, Mus musculus
gctttgcatgttggccggaattaca

SEQ ID NO: 579556 - DNA, 25 bp, Mus musculus
gctttgcattggcaacaattcttct

SEQ ID NO: 579557 - DNA, 25 bp, Mus musculus
gctttgcattgggaacaattcttct

SEQ ID NO: 579558 - DNA, 25 bp, Mus musculus
gctttgcatttgagctaggcatggt

SEQ ID NO: 579559 - DNA, 25 bp, Mus musculus
gctttgcatttgtgctaggcatggt

SEQ ID NO: 579560 - DNA, 25 bp, Mus musculus
gctttgccaaagagatcagctcacg

SEQ ID NO: 579561 - DNA, 25 bp, Mus musculus
gctttgccaaagtgatcagctcacg

SEQ ID NO: 579562 - DNA, 25 bp, Mus musculus
gctttgccactgaatacatccattg

SEQ ID NO: 579563 - DNA, 25 bp, Mus musculus
gctttgccactgagcttagatgttg

SEQ ID NO: 579564 - DNA, 25 bp, Mus musculus
gctttgccactgtatacatccattg

SEQ ID NO: 579565 - DNA, 25 bp, Mus musculus
gctttgccactgtgcttagatgttg

SEQ ID NO: 579566 - DNA, 25 bp, Mus musculus
gctttgccacttccctagagggatt

SEQ ID NO: 579567 - DNA, 25 bp, Mus musculus
gctttgccacttgcctagagggatt

SEQ ID NO: 579568 - DNA, 25 bp, Mus musculus
gctttgccagaaagcccttatagga

SEQ ID NO: 579569 - DNA, 25 bp, Mus musculus
gctttgccagaatgcccttatagga

SEQ ID NO: 579570 - DNA, 25 bp, Mus musculus
gctttgccatacagacgtcaatcat

SEQ ID NO: 579571 - DNA, 25 bp, Mus musculus
gctttgccatactgacgtcaatcat

SEQ ID NO: 579572 - DNA, 25 bp, Mus musculus
gctttgccatctagatgtggaccct

SEQ ID NO: 579573 - DNA, 25 bp, Mus musculus
gctttgccatcttgatgtggaccct

SEQ ID NO: 579574 - DNA, 25 bp, Mus musculus
gctttgccattcataagtgtctgga

SEQ ID NO: 579575 - DNA, 25 bp, Mus musculus
gctttgccattcttaagtgtctgga

SEQ ID NO: 579576 - DNA, 25 bp, Mus musculus
gctttgcccacgacacaaggactgt

SEQ ID NO: 579577 - DNA, 25 bp, Mus musculus
gctttgcccacgtcacaaggactgt

SEQ ID NO: 579578 - DNA, 25 bp, Mus musculus
gctttgccccgcaaagaggatgtat

SEQ ID NO: 579579 - DNA, 25 bp, Mus musculus
gctttgccccgctaagaggatgtat

SEQ ID NO: 579580 - DNA, 25 bp, Mus musculus
gctttgcccggcagaagcactgcgg

SEQ ID NO: 579581 - DNA, 25 bp, Mus musculus
gctttgcccggctgaagcactgcgg

SEQ ID NO: 579582 - DNA, 25 bp, Mus musculus
gctttgcccttaacaatgaactgtg

SEQ ID NO: 579583 - DNA, 25 bp, Mus musculus
gctttgcccttatcaatgaactgtg

SEQ ID NO: 579584 - DNA, 25 bp, Mus musculus
gctttgcccttgaacatcctaaaag

SEQ ID NO: 579585 - DNA, 25 bp, Mus musculus
gctttgcccttgtacatcctaaaag

SEQ ID NO: 579586 - DNA, 25 bp, Mus musculus
gctttgccgagcaccagatggataa

SEQ ID NO: 579587 - DNA, 25 bp, Mus musculus
gctttgccgagctccagatggataa

SEQ ID NO: 579588 - DNA, 25 bp, Mus musculus
gctttgcctgggaaaataggactga

SEQ ID NO: 579589 - DNA, 25 bp, Mus musculus
gctttgcctgggtaaataggactga

SEQ ID NO: 579590 - DNA, 25 bp, Mus musculus
gctttgcctggtagagatcttctgt

SEQ ID NO: 579591 - DNA, 25 bp, Mus musculus
gctttgcctggttgagatcttctgt

SEQ ID NO: 579592 - DNA, 25 bp, Mus musculus
gctttgcgcactcgcttaactagga

SEQ ID NO: 579593 - DNA, 25 bp, Mus musculus
gctttgcgcactggcttaactagga

SEQ ID NO: 579594 - DNA, 25 bp, Mus musculus
gctttgctacacaacaaggaatgcc

SEQ ID NO: 579595 - DNA, 25 bp, Mus musculus
gctttgctacactacaaggaatgcc

SEQ ID NO: 579596 - DNA, 25 bp, Mus musculus
gctttgctataaccgctcacctgtt

SEQ ID NO: 579597 - DNA, 25 bp, Mus musculus
gctttgctataagcgctcacctgtt

SEQ ID NO: 579598 - DNA, 25 bp, Mus musculus
gctttgctcaccaagatttgcctgg

SEQ ID NO: 579599 - DNA, 25 bp, Mus musculus
gctttgctcacctagatttgcctgg

SEQ ID NO: 579600 - DNA, 25 bp, Mus musculus
gctttgctcatgaacagcttcggag

SEQ ID NO: 579601 - DNA, 25 bp, Mus musculus
gctttgctcatgtacagcttcggag

SEQ ID NO: 579602 - DNA, 25 bp, Mus musculus
gctttgctcattctaaagcttcaat

SEQ ID NO: 579603 - DNA, 25 bp, Mus musculus
gctttgctcattgtaaagcttcaat

SEQ ID NO: 579604 - DNA, 25 bp, Mus musculus
gctttgctcctgatgtatgacatca

SEQ ID NO: 579605 - DNA, 25 bp, Mus musculus
gctttgctcctgttgtatgacatca

SEQ ID NO: 579606 - DNA, 25 bp, Mus musculus
gctttgctcggcaggcggacatgta

SEQ ID NO: 579607 - DNA, 25 bp, Mus musculus
gctttgctcggctggcggacatgta

SEQ ID NO: 579608 - DNA, 25 bp, Mus musculus
gctttgctctggagcccgggactgc

SEQ ID NO: 579609 - DNA, 25 bp, Mus musculus
gctttgctctggtgcccgggactgc

SEQ ID NO: 579610 - DNA, 25 bp, Mus musculus
gctttgctgaccagcccaaagccga

SEQ ID NO: 579611 - DNA, 25 bp, Mus musculus
gctttgctgacctgcccaaagccga

SEQ ID NO: 579612 - DNA, 25 bp, Mus musculus
gctttgctgtgtctcttgcataaca

SEQ ID NO: 579613 - DNA, 25 bp, Mus musculus
gctttgctgtgtgtcttgcataaca

SEQ ID NO: 579614 - DNA, 25 bp, Mus musculus
gctttgcttaaactccaggcattta

SEQ ID NO: 579615 - DNA, 25 bp, Mus musculus
gctttgcttaaagtccaggcattta

SEQ ID NO: 579616 - DNA, 25 bp, Mus musculus
gctttgcttacccagggtccagtaa

SEQ ID NO: 579617 - DNA, 25 bp, Mus musculus
gctttgcttaccgagggtccagtaa

SEQ ID NO: 579618 - DNA, 25 bp, Mus musculus
gctttgcttctacccagtacaaata

SEQ ID NO: 579619 - DNA, 25 bp, Mus musculus
gctttgcttctagccagtacaaata

SEQ ID NO: 579620 - DNA, 25 bp, Mus musculus
gctttgcttcttctacaaacatttt

SEQ ID NO: 579621 - DNA, 25 bp, Mus musculus
gctttgcttcttgtacaaacatttt

SEQ ID NO: 579622 - DNA, 25 bp, Mus musculus
gctttgcttgcaaccagtggtaggt

SEQ ID NO: 579623 - DNA, 25 bp, Mus musculus
gctttgcttgcatccagtggtaggt

SEQ ID NO: 579624 - DNA, 25 bp, Mus musculus
gctttgcttgtcactgggttcctgc

SEQ ID NO: 579625 - DNA, 25 bp, Mus musculus
gctttgcttgtctctgggttcctgc

SEQ ID NO: 579626 - DNA, 25 bp, Mus musculus
gctttgctttaaataggcctctctc

SEQ ID NO: 579627 - DNA, 25 bp, Mus musculus
gctttgctttaattaggcctctctc

SEQ ID NO: 579628 - DNA, 25 bp, Mus musculus
gctttgctttaccactcaaggcaga

SEQ ID NO: 579629 - DNA, 25 bp, Mus musculus
gctttgctttacgactcaaggcaga

SEQ ID NO: 579630 - DNA, 25 bp, Mus musculus
gctttgctttccataaggtgctgca

SEQ ID NO: 579631 - DNA, 25 bp, Mus musculus
gctttgctttccttaaggtgctgca

SEQ ID NO: 579632 - DNA, 25 bp, Mus musculus
gctttgctttggcaatacttaaata

SEQ ID NO: 579633 - DNA, 25 bp, Mus musculus
gctttgctttgggaatacttaaata

SEQ ID NO: 579634 - DNA, 25 bp, Mus musculus
gctttgctttgtagggtaattgagt

SEQ ID NO: 579635 - DNA, 25 bp, Mus musculus
gctttgctttgtcggatgcacgtca

SEQ ID NO: 579636 - DNA, 25 bp, Mus musculus
gctttgctttgtgggatgcacgtca

SEQ ID NO: 579637 - DNA, 25 bp, Mus musculus
gctttgctttgttgggtaattgagt

SEQ ID NO: 579638 - DNA, 25 bp, Mus musculus
gctttgctttttctgtatgttgaat

SEQ ID NO: 579639 - DNA, 25 bp, Mus musculus
gctttgctttttgtgtatgttgaat

SEQ ID NO: 579640 - DNA, 25 bp, Mus musculus
gctttggaaaatagcattgctgtac

SEQ ID NO: 579641 - DNA, 25 bp, Mus musculus
gctttggaaaattgcattgctgtac

SEQ ID NO: 579642 - DNA, 25 bp, Mus musculus
gctttggaaacacgttgtccgttct

SEQ ID NO: 579643 - DNA, 25 bp, Mus musculus
gctttggaaacaggttgtccgttct

SEQ ID NO: 579644 - DNA, 25 bp, Mus musculus
gctttggaaactaccagcatgtgct

SEQ ID NO: 579645 - DNA, 25 bp, Mus musculus
gctttggaaacttccagcatgtgct

SEQ ID NO: 579646 - DNA, 25 bp, Mus musculus
gctttggaatccagtcagtgacccc

SEQ ID NO: 579647 - DNA, 25 bp, Mus musculus
gctttggaatcctgtcagtgacccc

SEQ ID NO: 579648 - DNA, 25 bp, Mus musculus
gctttggacccaactttaattgaga

SEQ ID NO: 579649 - DNA, 25 bp, Mus musculus
gctttggacccatctttaattgaga

SEQ ID NO: 579650 - DNA, 25 bp, Mus musculus
gctttggaccttcagttgtgcatgc

SEQ ID NO: 579651 - DNA, 25 bp, Mus musculus
gctttggaccttgagttgtgcatgc

SEQ ID NO: 579652 - DNA, 25 bp, Mus musculus
gctttggacgatcggtttcaagaca

SEQ ID NO: 579653 - DNA, 25 bp, Mus musculus
gctttggacgatgggtttcaagaca

SEQ ID NO: 579654 - DNA, 25 bp, Mus musculus
gctttggactggcaccctgacttga

SEQ ID NO: 579655 - DNA, 25 bp, Mus musculus
gctttggactgggaccctgacttga

SEQ ID NO: 579656 - DNA, 25 bp, Mus musculus
gctttggagactcgcgcttttcatg

SEQ ID NO: 579657 - DNA, 25 bp, Mus musculus
gctttggagactggcgcttttcatg

SEQ ID NO: 579658 - DNA, 25 bp, Mus musculus
gctttggagccaatcatgttgatat

SEQ ID NO: 579659 - DNA, 25 bp, Mus musculus
gctttggagccattcatgttgatat

SEQ ID NO: 579660 - DNA, 25 bp, Mus musculus
gctttggagcttcgatcactacaat

SEQ ID NO: 579661 - DNA, 25 bp, Mus musculus
gctttggagcttggatcactacaat

SEQ ID NO: 579662 - DNA, 25 bp, Mus musculus
gctttggagtgtaacagcatgggaa

SEQ ID NO: 579663 - DNA, 25 bp, Mus musculus
gctttggagtgttacagcatgggaa

SEQ ID NO: 579664 - DNA, 25 bp, Mus musculus
gctttggatccgatcactctaataa

SEQ ID NO: 579665 - DNA, 25 bp, Mus musculus
gctttggatccgttcactctaataa

SEQ ID NO: 579666 - DNA, 25 bp, Mus musculus
gctttggatgttaggttgtacctac

SEQ ID NO: 579667 - DNA, 25 bp, Mus musculus
gctttggatgtttggttgtacctac

SEQ ID NO: 579668 - DNA, 25 bp, Mus musculus
gctttggattctcatcatctgacca

SEQ ID NO: 579669 - DNA, 25 bp, Mus musculus
gctttggattctgatcatctgacca

SEQ ID NO: 579670 - DNA, 25 bp, Mus musculus
gctttggcaattatcctggtgaact

SEQ ID NO: 579671 - DNA, 25 bp, Mus musculus
gctttggcaattttcctggtgaact

SEQ ID NO: 579672 - DNA, 25 bp, Mus musculus
gctttggcagcccattatggtcttt

SEQ ID NO: 579673 - DNA, 25 bp, Mus musculus
gctttggcagccgattatggtcttt

SEQ ID NO: 579674 - DNA, 25 bp, Mus musculus
gctttggcagtgcttgttctaagaa

SEQ ID NO: 579675 - DNA, 25 bp, Mus musculus
gctttggcagtggttgttctaagaa

SEQ ID NO: 579676 - DNA, 25 bp, Mus musculus
gctttggccaatattatttcctaat

SEQ ID NO: 579677 - DNA, 25 bp, Mus musculus
gctttggccaattttatttcctaat

SEQ ID NO: 579678 - DNA, 25 bp, Mus musculus
gctttggccattacttggtttttat

SEQ ID NO: 579679 - DNA, 25 bp, Mus musculus
gctttggccatttcttggtttttat

SEQ ID NO: 579680 - DNA, 25 bp, Mus musculus
gctttggcctaccataatgtttcta

SEQ ID NO: 579681 - DNA, 25 bp, Mus musculus
gctttggcctacgataatgtttcta

SEQ ID NO: 579682 - DNA, 25 bp, Mus musculus
gctttggcgaacctctggtgtctaa

SEQ ID NO: 579683 - DNA, 25 bp, Mus musculus
gctttggcgaacgtctggtgtctaa

SEQ ID NO: 579684 - DNA, 25 bp, Mus musculus
gctttggcggctagagctgactgca

SEQ ID NO: 579685 - DNA, 25 bp, Mus musculus
gctttggcggcttgagctgactgca

SEQ ID NO: 579686 - DNA, 25 bp, Mus musculus
gctttggctacaaatcgagttctgg

SEQ ID NO: 579687 - DNA, 25 bp, Mus musculus
gctttggctacatatcgagttctgg

SEQ ID NO: 579688 - DNA, 25 bp, Mus musculus
gctttggctatcctctatttccttg

SEQ ID NO: 579689 - DNA, 25 bp, Mus musculus
gctttggctatcgtctatttccttg

SEQ ID NO: 579690 - DNA, 25 bp, Mus musculus
gctttggctattaatgtcaggcttg

SEQ ID NO: 579691 - DNA, 25 bp, Mus musculus
gctttggctatttatgtcaggcttg

SEQ ID NO: 579692 - DNA, 25 bp, Mus musculus
gctttggctcagatacattctcgca

SEQ ID NO: 579693 - DNA, 25 bp, Mus musculus
gctttggctcagttacattctcgca

SEQ ID NO: 579694 - DNA, 25 bp, Mus musculus
gctttggctctgagcttttctccag

SEQ ID NO: 579695 - DNA, 25 bp, Mus musculus
gctttggctctgtgcttttctccag

SEQ ID NO: 579696 - DNA, 25 bp, Mus musculus
gctttggctgccacttaaggaatgc

SEQ ID NO: 579697 - DNA, 25 bp, Mus musculus
gctttggctgcctcttaaggaatgc

SEQ ID NO: 579698 - DNA, 25 bp, Mus musculus
gctttggcttcacgtagttgttacc

SEQ ID NO: 579699 - DNA, 25 bp, Mus musculus
gctttggcttcaggtagttgttacc

SEQ ID NO: 579700 - DNA, 25 bp, Mus musculus
gctttgggaacgcaattggctacgt

SEQ ID NO: 579701 - DNA, 25 bp, Mus musculus
gctttgggaacggaattggctacgt

SEQ ID NO: 579702 - DNA, 25 bp, Mus musculus
gctttgggaattaggtgacattaga

SEQ ID NO: 579703 - DNA, 25 bp, Mus musculus
gctttgggaatttggtgacattaga

SEQ ID NO: 579704 - DNA, 25 bp, Mus musculus
gctttgggacatatcactagccctt

SEQ ID NO: 579705 - DNA, 25 bp, Mus musculus
gctttgggacatttcactagccctt

SEQ ID NO: 579706 - DNA, 25 bp, Mus musculus
gctttgggactgagtggttgttttt

SEQ ID NO: 579707 - DNA, 25 bp, Mus musculus
gctttgggactgtgtggttgttttt

SEQ ID NO: 579708 - DNA, 25 bp, Mus musculus
gctttgggagtcacttctgattctt

SEQ ID NO: 579709 - DNA, 25 bp, Mus musculus
gctttgggagtctcttctgattctt

SEQ ID NO: 579710 - DNA, 25 bp, Mus musculus
gctttgggatctaccttagtttctt

SEQ ID NO: 579711 - DNA, 25 bp, Mus musculus
gctttgggatcttccttagtttctt

SEQ ID NO: 579712 - DNA, 25 bp, Mus musculus
gctttgggcagcatttgaggaacaa

SEQ ID NO: 579713 - DNA, 25 bp, Mus musculus
gctttgggcagcttttgaggaacaa

SEQ ID NO: 579714 - DNA, 25 bp, Mus musculus
gctttgggcagtatggctgtgacca

SEQ ID NO: 579715 - DNA, 25 bp, Mus musculus
gctttgggcagtttggctgtgacca

SEQ ID NO: 579716 - DNA, 25 bp, Mus musculus
gctttgggctctctttgactttaaa

SEQ ID NO: 579717 - DNA, 25 bp, Mus musculus
gctttgggctctgtttgactttaaa

SEQ ID NO: 579718 - DNA, 25 bp, Mus musculus
gctttgggtagactttgagcctgca

SEQ ID NO: 579719 - DNA, 25 bp, Mus musculus
gctttgggtagagtttgagcctgca

SEQ ID NO: 579720 - DNA, 25 bp, Mus musculus
gctttgggttccatcctgagtcacc

SEQ ID NO: 579721 - DNA, 25 bp, Mus musculus
gctttgggttccttcctgagtcacc

SEQ ID NO: 579722 - DNA, 25 bp, Mus musculus
gctttggtaccaagggcctggcagt

SEQ ID NO: 579723 - DNA, 25 bp, Mus musculus
gctttggtaccatgggcctggcagt

SEQ ID NO: 579724 - DNA, 25 bp, Mus musculus
gctttggtagagaacttggcattca

SEQ ID NO: 579725 - DNA, 25 bp, Mus musculus
gctttggtagagtacttggcattca

SEQ ID NO: 579726 - DNA, 25 bp, Mus musculus
gctttggtctgtaatgctttggaat

SEQ ID NO: 579727 - DNA, 25 bp, Mus musculus
gctttggtctgttatgctttggaat

SEQ ID NO: 579728 - DNA, 25 bp, Mus musculus
gctttggtcttccttgtgactggaa

SEQ ID NO: 579729 - DNA, 25 bp, Mus musculus
gctttggtcttcgttgtgactggaa

SEQ ID NO: 579730 - DNA, 25 bp, Mus musculus
gctttggtctttaaaggtccatcca

SEQ ID NO: 579731 - DNA, 25 bp, Mus musculus
gctttggtcttttaaggtccatcca

SEQ ID NO: 579732 - DNA, 25 bp, Mus musculus
gctttggtgacacctgggccttaag

SEQ ID NO: 579733 - DNA, 25 bp, Mus musculus
gctttggtgacagctgggccttaag

SEQ ID NO: 579734 - DNA, 25 bp, Mus musculus
gctttggtgacgatttccaggtaca

SEQ ID NO: 579735 - DNA, 25 bp, Mus musculus
gctttggtgacgttttccaggtaca

SEQ ID NO: 579736 - DNA, 25 bp, Mus musculus
gctttggtgtgcaagcaggccttta

SEQ ID NO: 579737 - DNA, 25 bp, Mus musculus
gctttggtgtgctagcaggccttta

SEQ ID NO: 579738 - DNA, 25 bp, Mus musculus
gctttggtgtggaccccactaaaat

SEQ ID NO: 579739 - DNA, 25 bp, Mus musculus
gctttggtgtggtccccactaaaat

SEQ ID NO: 579740 - DNA, 25 bp, Mus musculus
gctttgtaaactccgcggcgttata

SEQ ID NO: 579741 - DNA, 25 bp, Mus musculus
gctttgtaaactgcgcggcgttata

SEQ ID NO: 579742 - DNA, 25 bp, Mus musculus
gctttgtaaagcagggatctgcatg

SEQ ID NO: 579743 - DNA, 25 bp, Mus musculus
gctttgtaaagccaaggtcctgacc

SEQ ID NO: 579744 - DNA, 25 bp, Mus musculus
gctttgtaaagcgaaggtcctgacc

SEQ ID NO: 579745 - DNA, 25 bp, Mus musculus
gctttgtaaagctgggatctgcatg

SEQ ID NO: 579746 - DNA, 25 bp, Mus musculus
gctttgtaaatgaatttcctcgaga

SEQ ID NO: 579747 - DNA, 25 bp, Mus musculus
gctttgtaaatgtatttcctcgaga

SEQ ID NO: 579748 - DNA, 25 bp, Mus musculus
gctttgtaaattacagaggaaacct

SEQ ID NO: 579749 - DNA, 25 bp, Mus musculus
gctttgtaaatttcagaggaaacct

SEQ ID NO: 579750 - DNA, 25 bp, Mus musculus
gctttgtaacctcaactgacctcaa

SEQ ID NO: 579751 - DNA, 25 bp, Mus musculus
gctttgtaacctgaactgacctcaa

SEQ ID NO: 579752 - DNA, 25 bp, Mus musculus
gctttgtaactaacgactgctccca

SEQ ID NO: 579753 - DNA, 25 bp, Mus musculus
gctttgtaactatcgactgctccca

SEQ ID NO: 579754 - DNA, 25 bp, Mus musculus
gctttgtaactgatgatggcactgt

SEQ ID NO: 579755 - DNA, 25 bp, Mus musculus
gctttgtaactgttgatggcactgt

SEQ ID NO: 579756 - DNA, 25 bp, Mus musculus
gctttgtaaggacgtgatctttctt

SEQ ID NO: 579757 - DNA, 25 bp, Mus musculus
gctttgtaaggaggtgatctttctt

SEQ ID NO: 579758 - DNA, 25 bp, Mus musculus
gctttgtacatcctaggcaaggcta

SEQ ID NO: 579759 - DNA, 25 bp, Mus musculus
gctttgtacatcgtaggcaaggcta

SEQ ID NO: 579760 - DNA, 25 bp, Mus musculus
gctttgtaccacacaaatacattct

SEQ ID NO: 579761 - DNA, 25 bp, Mus musculus
gctttgtaccactcaaatacattct

SEQ ID NO: 579762 - DNA, 25 bp, Mus musculus
gctttgtaccataaaatcgtctgaa

SEQ ID NO: 579763 - DNA, 25 bp, Mus musculus
gctttgtaccattaaatcgtctgaa

SEQ ID NO: 579764 - DNA, 25 bp, Mus musculus
gctttgtaccggcaccctgttacag

SEQ ID NO: 579765 - DNA, 25 bp, Mus musculus
gctttgtaccgggaccctgttacag

SEQ ID NO: 579766 - DNA, 25 bp, Mus musculus
gctttgtaccttaggctacaaaact

SEQ ID NO: 579767 - DNA, 25 bp, Mus musculus
gctttgtacctttggctacaaaact

SEQ ID NO: 579768 - DNA, 25 bp, Mus musculus
gctttgtactcaagtatgggtgcta

SEQ ID NO: 579769 - DNA, 25 bp, Mus musculus
gctttgtactcatgtatgggtgcta

SEQ ID NO: 579770 - DNA, 25 bp, Mus musculus
gctttgtactgtcgaatgtgcttaa

SEQ ID NO: 579771 - DNA, 25 bp, Mus musculus
gctttgtactgtggaatgtgcttaa

SEQ ID NO: 579772 - DNA, 25 bp, Mus musculus
gctttgtagacacatgctccatggg

SEQ ID NO: 579773 - DNA, 25 bp, Mus musculus
gctttgtagacagatgctccatggg

SEQ ID NO: 579774 - DNA, 25 bp, Mus musculus
gctttgtagagcattttgattatca

SEQ ID NO: 579775 - DNA, 25 bp, Mus musculus
gctttgtagagctttttgattatca

SEQ ID NO: 579776 - DNA, 25 bp, Mus musculus
gctttgtagctgaccctggttgaaa

SEQ ID NO: 579777 - DNA, 25 bp, Mus musculus
gctttgtagctgtccctggttgaaa

SEQ ID NO: 579778 - DNA, 25 bp, Mus musculus
gctttgtaggtgatcagccctccat

SEQ ID NO: 579779 - DNA, 25 bp, Mus musculus
gctttgtaggtgttcagccctccat

SEQ ID NO: 579780 - DNA, 25 bp, Mus musculus
gctttgtagtagcttgtgattctaa

SEQ ID NO: 579781 - DNA, 25 bp, Mus musculus
gctttgtagtaggttgtgattctaa

SEQ ID NO: 579782 - DNA, 25 bp, Mus musculus
gctttgtatcaaataacgccatgta

SEQ ID NO: 579783 - DNA, 25 bp, Mus musculus
gctttgtatcaattaacgccatgta

SEQ ID NO: 579784 - DNA, 25 bp, Mus musculus
gctttgtatcagacagtgctggaga

SEQ ID NO: 579785 - DNA, 25 bp, Mus musculus
gctttgtatcagtcagtgctggaga

SEQ ID NO: 579786 - DNA, 25 bp, Mus musculus
gctttgtatctgagggactagtgct

SEQ ID NO: 579787 - DNA, 25 bp, Mus musculus
gctttgtatctgtgggactagtgct

SEQ ID NO: 579788 - DNA, 25 bp, Mus musculus
gctttgtatcttccaggttttgcag

SEQ ID NO: 579789 - DNA, 25 bp, Mus musculus
gctttgtatcttgcaggttttgcag

SEQ ID NO: 579790 - DNA, 25 bp, Mus musculus
gctttgtatgatcgctgtgcgtctc

SEQ ID NO: 579791 - DNA, 25 bp, Mus musculus
gctttgtatgatggctgtgcgtctc

SEQ ID NO: 579792 - DNA, 25 bp, Mus musculus
gctttgtcaaatcgtgtccgctctt

SEQ ID NO: 579793 - DNA, 25 bp, Mus musculus
gctttgtcaaatggtgtccgctctt

SEQ ID NO: 579794 - DNA, 25 bp, Mus musculus
gctttgtcactgatagggtttccac

SEQ ID NO: 579795 - DNA, 25 bp, Mus musculus
gctttgtcactgttagggtttccac

SEQ ID NO: 579796 - DNA, 25 bp, Mus musculus
gctttgtcagttatagaccttgcca

SEQ ID NO: 579797 - DNA, 25 bp, Mus musculus
gctttgtcagttttagaccttgcca

SEQ ID NO: 579798 - DNA, 25 bp, Mus musculus
gctttgtcattcctgtgacctgtaa

SEQ ID NO: 579799 - DNA, 25 bp, Mus musculus
gctttgtcattcgtgtgacctgtaa

SEQ ID NO: 579800 - DNA, 25 bp, Mus musculus
gctttgtccagaatgtgacctccga

SEQ ID NO: 579801 - DNA, 25 bp, Mus musculus
gctttgtccagattgtgacctccga

SEQ ID NO: 579802 - DNA, 25 bp, Mus musculus
gctttgtctacacatcaccatttaa

SEQ ID NO: 579803 - DNA, 25 bp, Mus musculus
gctttgtctacagatcaccatttaa

SEQ ID NO: 579804 - DNA, 25 bp, Mus musculus
gctttgtctagaaggtggcaggaca

SEQ ID NO: 579805 - DNA, 25 bp, Mus musculus
gctttgtctagatggtggcaggaca

SEQ ID NO: 579806 - DNA, 25 bp, Mus musculus
gctttgtctagccacaacaggagaa

SEQ ID NO: 579807 - DNA, 25 bp, Mus musculus
gctttgtctagcgacaacaggagaa

SEQ ID NO: 579808 - DNA, 25 bp, Mus musculus
gctttgtctccaatttacagttgag

SEQ ID NO: 579809 - DNA, 25 bp, Mus musculus
gctttgtctccattttacagttgag

SEQ ID NO: 579810 - DNA, 25 bp, Mus musculus
gctttgtctcgcagtacggtttaaa

SEQ ID NO: 579811 - DNA, 25 bp, Mus musculus
gctttgtctcgctgtacggtttaaa

SEQ ID NO: 579812 - DNA, 25 bp, Mus musculus
gctttgtctgatatgttccttccta

SEQ ID NO: 579813 - DNA, 25 bp, Mus musculus
gctttgtctgatttgttccttccta

SEQ ID NO: 579814 - DNA, 25 bp, Mus musculus
gctttgtctttgaattcctggcact

SEQ ID NO: 579815 - DNA, 25 bp, Mus musculus
gctttgtctttgtattcctggcact

SEQ ID NO: 579816 - DNA, 25 bp, Mus musculus
gctttgtgaaacctcagaagttttt

SEQ ID NO: 579817 - DNA, 25 bp, Mus musculus
gctttgtgaaacgtcagaagttttt

SEQ ID NO: 579818 - DNA, 25 bp, Mus musculus
gctttgtgaaggacacttccgttta

SEQ ID NO: 579819 - DNA, 25 bp, Mus musculus
gctttgtgaaggtcacttccgttta

SEQ ID NO: 579820 - DNA, 25 bp, Mus musculus
gctttgtgcaccagtgtccagaaga

SEQ ID NO: 579821 - DNA, 25 bp, Mus musculus
gctttgtgcacctgtgtccagaaga

SEQ ID NO: 579822 - DNA, 25 bp, Mus musculus
gctttgtgcagaaattttgaaaaac

SEQ ID NO: 579823 - DNA, 25 bp, Mus musculus
gctttgtgcagatattttgaaaaac

SEQ ID NO: 579824 - DNA, 25 bp, Mus musculus
gctttgtgcatgataaacctggtat

SEQ ID NO: 579825 - DNA, 25 bp, Mus musculus
gctttgtgcatgttaaacctggtat

SEQ ID NO: 579826 - DNA, 25 bp, Mus musculus
gctttgtgccaaattctactgttag

SEQ ID NO: 579827 - DNA, 25 bp, Mus musculus
gctttgtgccaatttctactgttag

SEQ ID NO: 579828 - DNA, 25 bp, Mus musculus
gctttgtgcctcagagtgttactta

SEQ ID NO: 579829 - DNA, 25 bp, Mus musculus
gctttgtgcctctgagtgttactta

SEQ ID NO: 579830 - DNA, 25 bp, Mus musculus
gctttgtggattcccatctggagga

SEQ ID NO: 579831 - DNA, 25 bp, Mus musculus
gctttgtggattgccatctggagga

SEQ ID NO: 579832 - DNA, 25 bp, Mus musculus
gctttgtggccaactggaacccaga

SEQ ID NO: 579833 - DNA, 25 bp, Mus musculus
gctttgtggccatctggaacccaga

SEQ ID NO: 579834 - DNA, 25 bp, Mus musculus
gctttgtggcggctgtgatcaccat

SEQ ID NO: 579835 - DNA, 25 bp, Mus musculus
gctttgtggcgggtgtgatcaccat

SEQ ID NO: 579836 - DNA, 25 bp, Mus musculus
gctttgtggcttacatggttttcat

SEQ ID NO: 579837 - DNA, 25 bp, Mus musculus
gctttgtggctttcatggttttcat

SEQ ID NO: 579838 - DNA, 25 bp, Mus musculus
gctttgtgtctgacaccttgaactg

SEQ ID NO: 579839 - DNA, 25 bp, Mus musculus
gctttgtgtctgtcaccttgaactg

SEQ ID NO: 579840 - DNA, 25 bp, Mus musculus
gctttgtgtgggagcctggcatcat

SEQ ID NO: 579841 - DNA, 25 bp, Mus musculus
gctttgtgtgggtgcctggcatcat

SEQ ID NO: 579842 - DNA, 25 bp, Mus musculus
gctttgtgtgtgctaagtagacact

SEQ ID NO: 579843 - DNA, 25 bp, Mus musculus
gctttgtgtgtggtaagtagacact

SEQ ID NO: 579844 - DNA, 25 bp, Mus musculus
gctttgtgtgttcaatgctaggtct

SEQ ID NO: 579845 - DNA, 25 bp, Mus musculus
gctttgtgtgttgaatgctaggtct

SEQ ID NO: 579846 - DNA, 25 bp, Mus musculus
gctttgtgttcaactccttttgatt

SEQ ID NO: 579847 - DNA, 25 bp, Mus musculus
gctttgtgttcatctccttttgatt

SEQ ID NO: 579848 - DNA, 25 bp, Mus musculus
gctttgtgttgtatgctagtttgaa

SEQ ID NO: 579849 - DNA, 25 bp, Mus musculus
gctttgtgttgtattctgcattctt

SEQ ID NO: 579850 - DNA, 25 bp, Mus musculus
gctttgtgttgtttgctagtttgaa

SEQ ID NO: 579851 - DNA, 25 bp, Mus musculus
gctttgtgttgttttctgcattctt

SEQ ID NO: 579852 - DNA, 25 bp, Mus musculus
gctttgttaactaggcacagcctaa

SEQ ID NO: 579853 - DNA, 25 bp, Mus musculus
gctttgttaacttggcacagcctaa

SEQ ID NO: 579854 - DNA, 25 bp, Mus musculus
gctttgttacctctacttcagcttt

SEQ ID NO: 579855 - DNA, 25 bp, Mus musculus
gctttgttacctgtacttcagcttt

SEQ ID NO: 579856 - DNA, 25 bp, Mus musculus
gctttgttacttctgctttactcat

SEQ ID NO: 579857 - DNA, 25 bp, Mus musculus
gctttgttacttgtgctttactcat

SEQ ID NO: 579858 - DNA, 25 bp, Mus musculus
gctttgttcctacacgggagacaga

SEQ ID NO: 579859 - DNA, 25 bp, Mus musculus
gctttgttcctagacgggagacaga

SEQ ID NO: 579860 - DNA, 25 bp, Mus musculus
gctttgttcgtccagattcacattt

SEQ ID NO: 579861 - DNA, 25 bp, Mus musculus
gctttgttcgtcgagattcacattt

SEQ ID NO: 579862 - DNA, 25 bp, Mus musculus
gctttgttctcaacaaaggacatga

SEQ ID NO: 579863 - DNA, 25 bp, Mus musculus
gctttgttctcatcaaaggacatga

SEQ ID NO: 579864 - DNA, 25 bp, Mus musculus
gctttgttcttacctctactttgtt

SEQ ID NO: 579865 - DNA, 25 bp, Mus musculus
gctttgttcttagctctactttgtt

SEQ ID NO: 579866 - DNA, 25 bp, Mus musculus
gctttgttctttacctaagctcaca

SEQ ID NO: 579867 - DNA, 25 bp, Mus musculus
gctttgttctttaggtgcaggacct

SEQ ID NO: 579868 - DNA, 25 bp, Mus musculus
gctttgttcttttcctaagctcaca

SEQ ID NO: 579869 - DNA, 25 bp, Mus musculus
gctttgttcttttggtgcaggacct

SEQ ID NO: 579870 - DNA, 25 bp, Mus musculus
gctttgttggttcaacctgagtgtt

SEQ ID NO: 579871 - DNA, 25 bp, Mus musculus
gctttgttggttgaacctgagtgtt

SEQ ID NO: 579872 - DNA, 25 bp, Mus musculus
gctttgttgtctataaatccacatg

SEQ ID NO: 579873 - DNA, 25 bp, Mus musculus
gctttgttgtctttaaatccacatg

SEQ ID NO: 579874 - DNA, 25 bp, Mus musculus
gctttgtttaatccagatttcccca

SEQ ID NO: 579875 - DNA, 25 bp, Mus musculus
gctttgtttaatgcagatttcccca

SEQ ID NO: 579876 - DNA, 25 bp, Mus musculus
gctttgtttaggaagttcttaggag

SEQ ID NO: 579877 - DNA, 25 bp, Mus musculus
gctttgtttaggtagttcttaggag

SEQ ID NO: 579878 - DNA, 25 bp, Mus musculus
gctttgtttatcactcgtgccgaat

SEQ ID NO: 579879 - DNA, 25 bp, Mus musculus
gctttgtttatctctcgtgccgaat

SEQ ID NO: 579880 - DNA, 25 bp, Mus musculus
gctttgtttcatctatgtcctcaat

SEQ ID NO: 579881 - DNA, 25 bp, Mus musculus
gctttgtttcatgtatgtcctcaat

SEQ ID NO: 579882 - DNA, 25 bp, Mus musculus
gctttgtttcttagcctcagcagca

SEQ ID NO: 579883 - DNA, 25 bp, Mus musculus
gctttgtttcttcaattgacttttg

SEQ ID NO: 579884 - DNA, 25 bp, Mus musculus
gctttgtttcttcaggttatccagt

SEQ ID NO: 579885 - DNA, 25 bp, Mus musculus
gctttgtttcttgaattgacttttg

SEQ ID NO: 579886 - DNA, 25 bp, Mus musculus
gctttgtttcttgaggttatccagt

SEQ ID NO: 579887 - DNA, 25 bp, Mus musculus
gctttgtttctttgcctcagcagca

SEQ ID NO: 579888 - DNA, 25 bp, Mus musculus
gctttgttttcaagctcattctgaa

SEQ ID NO: 579889 - DNA, 25 bp, Mus musculus
gctttgttttcatgctcattctgaa

SEQ ID NO: 579890 - DNA, 25 bp, Mus musculus
gctttgttttctattactggctact

SEQ ID NO: 579891 - DNA, 25 bp, Mus musculus
gctttgttttcttttactggctact

SEQ ID NO: 579892 - DNA, 25 bp, Mus musculus
gctttgttttttccccgagcaacca

SEQ ID NO: 579893 - DNA, 25 bp, Mus musculus
gctttgttttttgcccgagcaacca

SEQ ID NO: 579894 - DNA, 25 bp, Mus musculus
gcttttaaacctagcattcgggagg

SEQ ID NO: 579895 - DNA, 25 bp, Mus musculus
gcttttaaacctctgaccgtcttgc

SEQ ID NO: 579896 - DNA, 25 bp, Mus musculus
gcttttaaacctgtgaccgtcttgc

SEQ ID NO: 579897 - DNA, 25 bp, Mus musculus
gcttttaaaccttgcattcgggagg

SEQ ID NO: 579898 - DNA, 25 bp, Mus musculus
gcttttaacacacgtgtccatctcc

SEQ ID NO: 579899 - DNA, 25 bp, Mus musculus
gcttttaacacaggtgtccatctcc

SEQ ID NO: 579900 - DNA, 25 bp, Mus musculus
gcttttaacacgattttcttcttat

SEQ ID NO: 579901 - DNA, 25 bp, Mus musculus
gcttttaacacgtttttcttcttat

SEQ ID NO: 579902 - DNA, 25 bp, Mus musculus
gcttttaactaactcttgctgtctt

SEQ ID NO: 579903 - DNA, 25 bp, Mus musculus
gcttttaactaagtcttgctgtctt

SEQ ID NO: 579904 - DNA, 25 bp, Mus musculus
gcttttaacttaatgtcccagagga

SEQ ID NO: 579905 - DNA, 25 bp, Mus musculus
gcttttaacttattgtcccagagga

SEQ ID NO: 579906 - DNA, 25 bp, Mus musculus
gcttttaactttacttgtacacaat

SEQ ID NO: 579907 - DNA, 25 bp, Mus musculus
gcttttaacttttcttgtacacaat

SEQ ID NO: 579908 - DNA, 25 bp, Mus musculus
gcttttaagttgatgggtccactga

SEQ ID NO: 579909 - DNA, 25 bp, Mus musculus
gcttttaagttgttgggtccactga

SEQ ID NO: 579910 - DNA, 25 bp, Mus musculus
gcttttaatattagtccattcctga

SEQ ID NO: 579911 - DNA, 25 bp, Mus musculus
gcttttaatatttgtccattcctga

SEQ ID NO: 579912 - DNA, 25 bp, Mus musculus
gcttttaatgcgcgagctgcgattt

SEQ ID NO: 579913 - DNA, 25 bp, Mus musculus
gcttttaatgcgggagctgcgattt

SEQ ID NO: 579914 - DNA, 25 bp, Mus musculus
gcttttacaacaatgcacagctgtg

SEQ ID NO: 579915 - DNA, 25 bp, Mus musculus
gcttttacaacattgcacagctgtg

SEQ ID NO: 579916 - DNA, 25 bp, Mus musculus
gcttttacacaaattgttcatcttc

SEQ ID NO: 579917 - DNA, 25 bp, Mus musculus
gcttttacacaatttgttcatcttc

SEQ ID NO: 579918 - DNA, 25 bp, Mus musculus
gcttttacagaacaccagagtgatt

SEQ ID NO: 579919 - DNA, 25 bp, Mus musculus
gcttttacagaagaccagagtgatt

SEQ ID NO: 579920 - DNA, 25 bp, Mus musculus
gcttttacagatctgctcgggtctc

SEQ ID NO: 579921 - DNA, 25 bp, Mus musculus
gcttttacagatgtgctcgggtctc

SEQ ID NO: 579922 - DNA, 25 bp, Mus musculus
gcttttacagctatcatgggttttg

SEQ ID NO: 579923 - DNA, 25 bp, Mus musculus
gcttttacagctttcatgggttttg

SEQ ID NO: 579924 - DNA, 25 bp, Mus musculus
gcttttacaggcactgttttgtatt

SEQ ID NO: 579925 - DNA, 25 bp, Mus musculus
gcttttacaggctctgttttgtatt

SEQ ID NO: 579926 - DNA, 25 bp, Mus musculus
gcttttacataaacctgggcctgga

SEQ ID NO: 579927 - DNA, 25 bp, Mus musculus
gcttttacataatcctgggcctgga

SEQ ID NO: 579928 - DNA, 25 bp, Mus musculus
gcttttacatttctgccagggattg

SEQ ID NO: 579929 - DNA, 25 bp, Mus musculus
gcttttacatttgtgccagggattg

SEQ ID NO: 579930 - DNA, 25 bp, Mus musculus
gcttttaccataagatggcctcctt

SEQ ID NO: 579931 - DNA, 25 bp, Mus musculus
gcttttaccatatgatggcctcctt

SEQ ID NO: 579932 - DNA, 25 bp, Mus musculus
gcttttaccccacagtgacagtgaa

SEQ ID NO: 579933 - DNA, 25 bp, Mus musculus
gcttttaccccagagtgacagtgaa

SEQ ID NO: 579934 - DNA, 25 bp, Mus musculus
gcttttacctagcaatatgcctgtg

SEQ ID NO: 579935 - DNA, 25 bp, Mus musculus
gcttttacctaggaatatgcctgtg

SEQ ID NO: 579936 - DNA, 25 bp, Mus musculus
gcttttacctatatagtattccatg

SEQ ID NO: 579937 - DNA, 25 bp, Mus musculus
gcttttacctatttagtattccatg

SEQ ID NO: 579938 - DNA, 25 bp, Mus musculus
gcttttacctttccactgagtgatt

SEQ ID NO: 579939 - DNA, 25 bp, Mus musculus
gcttttacctttgcactgagtgatt

SEQ ID NO: 579940 - DNA, 25 bp, Mus musculus
gcttttactagaaggaggcttgctc

SEQ ID NO: 579941 - DNA, 25 bp, Mus musculus
gcttttactagatggaggcttgctc

SEQ ID NO: 579942 - DNA, 25 bp, Mus musculus
gcttttactagtagggatgttcatt

SEQ ID NO: 579943 - DNA, 25 bp, Mus musculus
gcttttactagttgggatgttcatt

SEQ ID NO: 579944 - DNA, 25 bp, Mus musculus
gcttttactatgacccttcaattga

SEQ ID NO: 579945 - DNA, 25 bp, Mus musculus
gcttttactatgtcccttcaattga

SEQ ID NO: 579946 - DNA, 25 bp, Mus musculus
gcttttactctgatcatcatgctga

SEQ ID NO: 579947 - DNA, 25 bp, Mus musculus
gcttttactctgttcatcatgctga

SEQ ID NO: 579948 - DNA, 25 bp, Mus musculus
gcttttagaatcaaggcttccaggt

SEQ ID NO: 579949 - DNA, 25 bp, Mus musculus
gcttttagaatctaggcttccaggt

SEQ ID NO: 579950 - DNA, 25 bp, Mus musculus
gcttttagccaactggagctgtagt

SEQ ID NO: 579951 - DNA, 25 bp, Mus musculus
gcttttagccaagtggagctgtagt

SEQ ID NO: 579952 - DNA, 25 bp, Mus musculus
gcttttagccagaattctgggctca

SEQ ID NO: 579953 - DNA, 25 bp, Mus musculus
gcttttagccagtattctgggctca

SEQ ID NO: 579954 - DNA, 25 bp, Mus musculus
gcttttagctacagagacatctctt

SEQ ID NO: 579955 - DNA, 25 bp, Mus musculus
gcttttagctactgagacatctctt

SEQ ID NO: 579956 - DNA, 25 bp, Mus musculus
gcttttaggtatatactgggccaca

SEQ ID NO: 579957 - DNA, 25 bp, Mus musculus
gcttttaggtatttactgggccaca

SEQ ID NO: 579958 - DNA, 25 bp, Mus musculus
gcttttagtcagctcagaactttga

SEQ ID NO: 579959 - DNA, 25 bp, Mus musculus
gcttttagtcaggtcagaactttga

SEQ ID NO: 579960 - DNA, 25 bp, Mus musculus
gcttttagtcttccctatcttaggg

SEQ ID NO: 579961 - DNA, 25 bp, Mus musculus
gcttttagtcttgcctatcttaggg

SEQ ID NO: 579962 - DNA, 25 bp, Mus musculus
gcttttagtgctcgtggaatttctg

SEQ ID NO: 579963 - DNA, 25 bp, Mus musculus
gcttttagtgctggtggaatttctg

SEQ ID NO: 579964 - DNA, 25 bp, Mus musculus
gcttttagtgttcgactttgctgta

SEQ ID NO: 579965 - DNA, 25 bp, Mus musculus
gcttttagtgttggactttgctgta

SEQ ID NO: 579966 - DNA, 25 bp, Mus musculus
gcttttagtttgacagagttcccct

SEQ ID NO: 579967 - DNA, 25 bp, Mus musculus
gcttttagtttgtcagagttcccct

SEQ ID NO: 579968 - DNA, 25 bp, Mus musculus
gcttttataaagatcccaggcttag

SEQ ID NO: 579969 - DNA, 25 bp, Mus musculus
gcttttataaagttcccaggcttag

SEQ ID NO: 579970 - DNA, 25 bp, Mus musculus
gcttttatacatagatgtctgtcga

SEQ ID NO: 579971 - DNA, 25 bp, Mus musculus
gcttttatacattgatgtctgtcga

SEQ ID NO: 579972 - DNA, 25 bp, Mus musculus
gcttttataccacagtaagaaccaa

SEQ ID NO: 579973 - DNA, 25 bp, Mus musculus
gcttttataccagagtaagaaccaa

SEQ ID NO: 579974 - DNA, 25 bp, Mus musculus
gcttttatacttctcgttcattaaa

SEQ ID NO: 579975 - DNA, 25 bp, Mus musculus
gcttttatacttgtcgttcattaaa

SEQ ID NO: 579976 - DNA, 25 bp, Mus musculus
gcttttatcagactggaccagacca

SEQ ID NO: 579977 - DNA, 25 bp, Mus musculus
gcttttatcagactgttatctatca

SEQ ID NO: 579978 - DNA, 25 bp, Mus musculus
gcttttatcagagtggaccagacca

SEQ ID NO: 579979 - DNA, 25 bp, Mus musculus
gcttttatcagagtgttatctatca

SEQ ID NO: 579980 - DNA, 25 bp, Mus musculus
gcttttatgactactactgcagttg

SEQ ID NO: 579981 - DNA, 25 bp, Mus musculus
gcttttatgacttctactgcagttg

SEQ ID NO: 579982 - DNA, 25 bp, Mus musculus
gcttttatgaggctaagtaacttgt

SEQ ID NO: 579983 - DNA, 25 bp, Mus musculus
gcttttatgagggtaagtaacttgt

SEQ ID NO: 579984 - DNA, 25 bp, Mus musculus
gcttttatggtaaaaggctacttga

SEQ ID NO: 579985 - DNA, 25 bp, Mus musculus
gcttttatggtataaggctacttga

SEQ ID NO: 579986 - DNA, 25 bp, Mus musculus
gcttttatgtacagctctgattctg

SEQ ID NO: 579987 - DNA, 25 bp, Mus musculus
gcttttatgtactgctctgattctg

SEQ ID NO: 579988 - DNA, 25 bp, Mus musculus
gcttttattatcaatctcaatgtaa

SEQ ID NO: 579989 - DNA, 25 bp, Mus musculus
gcttttattatctatctcaatgtaa

SEQ ID NO: 579990 - DNA, 25 bp, Mus musculus
gcttttattgtcctgaatcctgatt

SEQ ID NO: 579991 - DNA, 25 bp, Mus musculus
gcttttattgtcgtgaatcctgatt

SEQ ID NO: 579992 - DNA, 25 bp, Mus musculus
gcttttattgtgacttagctgtaaa

SEQ ID NO: 579993 - DNA, 25 bp, Mus musculus
gcttttattgtgcttctaaccccag

SEQ ID NO: 579994 - DNA, 25 bp, Mus musculus
gcttttattgtggttctaaccccag

SEQ ID NO: 579995 - DNA, 25 bp, Mus musculus
gcttttattgtgtcttagctgtaaa

SEQ ID NO: 579996 - DNA, 25 bp, Mus musculus
gcttttatttctcgtgtgttcgttc

SEQ ID NO: 579997 - DNA, 25 bp, Mus musculus
gcttttatttctggtgtgttcgttc

SEQ ID NO: 579998 - DNA, 25 bp, Mus musculus
gcttttattttccagatagcctctg

SEQ ID NO: 579999 - DNA, 25 bp, Mus musculus
gcttttattttcgagatagcctctg

SEQ ID NO: 580000 - DNA, 25 bp, Mus musculus
gcttttcaaatgcttcgttttccca

SEQ ID NO: 580001 - DNA, 25 bp, Mus musculus
gcttttcaaatggttcgttttccca

SEQ ID NO: 580002 - DNA, 25 bp, Mus musculus
gcttttcaagtgaatttggcctctg

SEQ ID NO: 580003 - DNA, 25 bp, Mus musculus
gcttttcaagtgtatttggcctctg

SEQ ID NO: 580004 - DNA, 25 bp, Mus musculus
gcttttcaatgtcaccatcgaggtt

SEQ ID NO: 580005 - DNA, 25 bp, Mus musculus
gcttttcaatgtgaccatcgaggtt

SEQ ID NO: 580006 - DNA, 25 bp, Mus musculus
gcttttcacagaaacattcctccaa

SEQ ID NO: 580007 - DNA, 25 bp, Mus musculus
gcttttcacagatacattcctccaa

SEQ ID NO: 580008 - DNA, 25 bp, Mus musculus
gcttttcactacatggcaatgaggt

SEQ ID NO: 580009 - DNA, 25 bp, Mus musculus
gcttttcactacttggcaatgaggt

SEQ ID NO: 580010 - DNA, 25 bp, Mus musculus
gcttttcagatccatggtcaatcat

SEQ ID NO: 580011 - DNA, 25 bp, Mus musculus
gcttttcagatcgatggtcaatcat

SEQ ID NO: 580012 - DNA, 25 bp, Mus musculus
gcttttcaggcgagctgtgtgagca

SEQ ID NO: 580013 - DNA, 25 bp, Mus musculus
gcttttcaggcgtgctgtgtgagca

SEQ ID NO: 580014 - DNA, 25 bp, Mus musculus
gcttttcagtctagcagggcgaagg

SEQ ID NO: 580015 - DNA, 25 bp, Mus musculus
gcttttcagtcttgcagggcgaagg

SEQ ID NO: 580016 - DNA, 25 bp, Mus musculus
gcttttcagttcacatgttttggac

SEQ ID NO: 580017 - DNA, 25 bp, Mus musculus
gcttttcagttctcatgttttggac

SEQ ID NO: 580018 - DNA, 25 bp, Mus musculus
gcttttcatctcatatgctgacatg

SEQ ID NO: 580019 - DNA, 25 bp, Mus musculus
gcttttcatctccagggccttaata

SEQ ID NO: 580020 - DNA, 25 bp, Mus musculus
gcttttcatctcgagggccttaata

SEQ ID NO: 580021 - DNA, 25 bp, Mus musculus
gcttttcatctcttatgctgacatg

SEQ ID NO: 580022 - DNA, 25 bp, Mus musculus
gcttttcatctgatacccttatgga

SEQ ID NO: 580023 - DNA, 25 bp, Mus musculus
gcttttcatctgttacccttatgga

SEQ ID NO: 580024 - DNA, 25 bp, Mus musculus
gcttttcatgaactcctagtgccta

SEQ ID NO: 580025 - DNA, 25 bp, Mus musculus
gcttttcatgaagtcctagtgccta

SEQ ID NO: 580026 - DNA, 25 bp, Mus musculus
gcttttcatggcactgcctggacat

SEQ ID NO: 580027 - DNA, 25 bp, Mus musculus
gcttttcatggctctgcctggacat

SEQ ID NO: 580028 - DNA, 25 bp, Mus musculus
gcttttcattagacccagacactac

SEQ ID NO: 580029 - DNA, 25 bp, Mus musculus
gcttttcattagtcccagacactac

SEQ ID NO: 580030 - DNA, 25 bp, Mus musculus
gcttttccaaaaaatctgcaatctg

SEQ ID NO: 580031 - DNA, 25 bp, Mus musculus
gcttttccaaaaaggaggcctcctc

SEQ ID NO: 580032 - DNA, 25 bp, Mus musculus
gcttttccaaaatatctgcaatctg

SEQ ID NO: 580033 - DNA, 25 bp, Mus musculus
gcttttccaaaatggaggcctcctc

SEQ ID NO: 580034 - DNA, 25 bp, Mus musculus
gcttttccacagcacatttaatcta

SEQ ID NO: 580035 - DNA, 25 bp, Mus musculus
gcttttccacaggacatttaatcta

SEQ ID NO: 580036 - DNA, 25 bp, Mus musculus
gcttttccagaacggcgatatattg

SEQ ID NO: 580037 - DNA, 25 bp, Mus musculus
gcttttccagaagggcgatatattg

SEQ ID NO: 580038 - DNA, 25 bp, Mus musculus
gcttttccagctatgaggtgacatt

SEQ ID NO: 580039 - DNA, 25 bp, Mus musculus
gcttttccagctttgaggtgacatt

SEQ ID NO: 580040 - DNA, 25 bp, Mus musculus
gcttttccatagatgaatagttgta

SEQ ID NO: 580041 - DNA, 25 bp, Mus musculus
gcttttccatagttgaatagttgta

SEQ ID NO: 580042 - DNA, 25 bp, Mus musculus
gcttttccattgaactttttcacac

SEQ ID NO: 580043 - DNA, 25 bp, Mus musculus
gcttttccattgtactttttcacac

SEQ ID NO: 580044 - DNA, 25 bp, Mus musculus
gcttttcccacacagtatgagtaat

SEQ ID NO: 580045 - DNA, 25 bp, Mus musculus
gcttttcccacagagtatgagtaat

SEQ ID NO: 580046 - DNA, 25 bp, Mus musculus
gcttttcccataattcattgtgact

SEQ ID NO: 580047 - DNA, 25 bp, Mus musculus
gcttttcccatatttcattgtgact

SEQ ID NO: 580048 - DNA, 25 bp, Mus musculus
gcttttccccacagttatggcaaaa

SEQ ID NO: 580049 - DNA, 25 bp, Mus musculus
gcttttccccactgttatggcaaaa

SEQ ID NO: 580050 - DNA, 25 bp, Mus musculus
gcttttccccatagcatgttaggaa

SEQ ID NO: 580051 - DNA, 25 bp, Mus musculus
gcttttccccattgcatgttaggaa

SEQ ID NO: 580052 - DNA, 25 bp, Mus musculus
gcttttccccttcacacatgttaaa

SEQ ID NO: 580053 - DNA, 25 bp, Mus musculus
gcttttccccttgacacatgttaaa

SEQ ID NO: 580054 - DNA, 25 bp, Mus musculus
gcttttccctagctgtttgcaaaac

SEQ ID NO: 580055 - DNA, 25 bp, Mus musculus
gcttttccctaggtgtttgcaaaac

SEQ ID NO: 580056 - DNA, 25 bp, Mus musculus
gcttttccctgacaaggttgccaaa

SEQ ID NO: 580057 - DNA, 25 bp, Mus musculus
gcttttccctgagaaggttgccaaa

SEQ ID NO: 580058 - DNA, 25 bp, Mus musculus
gcttttcccttcctagatgattcta

SEQ ID NO: 580059 - DNA, 25 bp, Mus musculus
gcttttcccttcgtagatgattcta

SEQ ID NO: 580060 - DNA, 25 bp, Mus musculus
gcttttcctaagatgctaccccaca

SEQ ID NO: 580061 - DNA, 25 bp, Mus musculus
gcttttcctaagttgctaccccaca

SEQ ID NO: 580062 - DNA, 25 bp, Mus musculus
gcttttcctacgacacttttgtgga

SEQ ID NO: 580063 - DNA, 25 bp, Mus musculus
gcttttcctacgtcacttttgtgga

SEQ ID NO: 580064 - DNA, 25 bp, Mus musculus
gcttttcctactactctgaatcttg

SEQ ID NO: 580065 - DNA, 25 bp, Mus musculus
gcttttcctacttctctgaatcttg

SEQ ID NO: 580066 - DNA, 25 bp, Mus musculus
gcttttcctatcctctgaatctaaa

SEQ ID NO: 580067 - DNA, 25 bp, Mus musculus
gcttttcctatcgtctgaatctaaa

SEQ ID NO: 580068 - DNA, 25 bp, Mus musculus
gcttttcctctgcatatgtctcagt

SEQ ID NO: 580069 - DNA, 25 bp, Mus musculus
gcttttcctctggatatgtctcagt

SEQ ID NO: 580070 - DNA, 25 bp, Mus musculus
gcttttcctgaacgatctggctgca

SEQ ID NO: 580071 - DNA, 25 bp, Mus musculus
gcttttcctgaaggatctggctgca

SEQ ID NO: 580072 - DNA, 25 bp, Mus musculus
gcttttcctgagatcggtattcctg

SEQ ID NO: 580073 - DNA, 25 bp, Mus musculus
gcttttcctgagttcggtattcctg

SEQ ID NO: 580074 - DNA, 25 bp, Mus musculus
gcttttccttaacatggtgggtgag

SEQ ID NO: 580075 - DNA, 25 bp, Mus musculus
gcttttccttaagatggtgggtgag

SEQ ID NO: 580076 - DNA, 25 bp, Mus musculus
gcttttccttccataatcgatacct

SEQ ID NO: 580077 - DNA, 25 bp, Mus musculus
gcttttccttccttaatcgatacct

SEQ ID NO: 580078 - DNA, 25 bp, Mus musculus
gcttttcctttcagggtgatacagt

SEQ ID NO: 580079 - DNA, 25 bp, Mus musculus
gcttttcctttctgggtgatacagt

SEQ ID NO: 580080 - DNA, 25 bp, Mus musculus
gcttttcgacagattacagtgcaca

SEQ ID NO: 580081 - DNA, 25 bp, Mus musculus
gcttttcgacagattggcaattgtg

SEQ ID NO: 580082 - DNA, 25 bp, Mus musculus
gcttttcgacagtttacagtgcaca

SEQ ID NO: 580083 - DNA, 25 bp, Mus musculus
gcttttcgacagtttggcaattgtg

SEQ ID NO: 580084 - DNA, 25 bp, Mus musculus
gcttttcgccagaagtgagaaagtc

SEQ ID NO: 580085 - DNA, 25 bp, Mus musculus
gcttttcgccagtagtgagaaagtc

SEQ ID NO: 580086 - DNA, 25 bp, Mus musculus
gcttttcgtgtaactaagccactca

SEQ ID NO: 580087 - DNA, 25 bp, Mus musculus
gcttttcgtgtatctaagccactca

SEQ ID NO: 580088 - DNA, 25 bp, Mus musculus
gcttttctacatcatcccatttata

SEQ ID NO: 580089 - DNA, 25 bp, Mus musculus
gcttttctacatgatcccatttata

SEQ ID NO: 580090 - DNA, 25 bp, Mus musculus
gcttttctactcaacctgaatggct

SEQ ID NO: 580091 - DNA, 25 bp, Mus musculus
gcttttctactctacctgaatggct

SEQ ID NO: 580092 - DNA, 25 bp, Mus musculus
gcttttctagaaattgtgtcctcag

SEQ ID NO: 580093 - DNA, 25 bp, Mus musculus
gcttttctagaatttgtgtcctcag

SEQ ID NO: 580094 - DNA, 25 bp, Mus musculus
gcttttctagcacctggtgtgtgca

SEQ ID NO: 580095 - DNA, 25 bp, Mus musculus
gcttttctagcagctggtgtgtgca

SEQ ID NO: 580096 - DNA, 25 bp, Mus musculus
gcttttctatctcttattctttctc

SEQ ID NO: 580097 - DNA, 25 bp, Mus musculus
gcttttctatctgttattctttctc

SEQ ID NO: 580098 - DNA, 25 bp, Mus musculus
gcttttctatggattggcacagttg

SEQ ID NO: 580099 - DNA, 25 bp, Mus musculus
gcttttctatggtttggcacagttg

SEQ ID NO: 580100 - DNA, 25 bp, Mus musculus
gcttttctattaagcaactctctta

SEQ ID NO: 580101 - DNA, 25 bp, Mus musculus
gcttttctattatgcaactctctta

SEQ ID NO: 580102 - DNA, 25 bp, Mus musculus
gcttttctcattacaactcctgtga

SEQ ID NO: 580103 - DNA, 25 bp, Mus musculus
gcttttctcattccgcgttggttaa

SEQ ID NO: 580104 - DNA, 25 bp, Mus musculus
gcttttctcattgcgcgttggttaa

SEQ ID NO: 580105 - DNA, 25 bp, Mus musculus
gcttttctcatttcaactcctgtga

SEQ ID NO: 580106 - DNA, 25 bp, Mus musculus
gcttttctccaaaaagactttcaaa

SEQ ID NO: 580107 - DNA, 25 bp, Mus musculus
gcttttctccaataagactttcaaa

SEQ ID NO: 580108 - DNA, 25 bp, Mus musculus
gcttttctccccaaggctgatgata

SEQ ID NO: 580109 - DNA, 25 bp, Mus musculus
gcttttctcccctaggctgatgata

SEQ ID NO: 580110 - DNA, 25 bp, Mus musculus
gcttttctccttcctaggttaggct

SEQ ID NO: 580111 - DNA, 25 bp, Mus musculus
gcttttctccttgctaggttaggct

SEQ ID NO: 580112 - DNA, 25 bp, Mus musculus
gcttttctcgtaagtatgtgtgcct

SEQ ID NO: 580113 - DNA, 25 bp, Mus musculus
gcttttctcgtatgtatgtgtgcct

SEQ ID NO: 580114 - DNA, 25 bp, Mus musculus
gcttttctctgtactaaactacttg

SEQ ID NO: 580115 - DNA, 25 bp, Mus musculus
gcttttctctgttctaaactacttg

SEQ ID NO: 580116 - DNA, 25 bp, Mus musculus
gcttttctcttaaaggtgatcttag

SEQ ID NO: 580117 - DNA, 25 bp, Mus musculus
gcttttctcttataggtgatcttag

SEQ ID NO: 580118 - DNA, 25 bp, Mus musculus
gcttttctgattatgtcccttacat

SEQ ID NO: 580119 - DNA, 25 bp, Mus musculus
gcttttctgattttgtcccttacat

SEQ ID NO: 580120 - DNA, 25 bp, Mus musculus
gcttttctggacaacaatctttcac

SEQ ID NO: 580121 - DNA, 25 bp, Mus musculus
gcttttctggactacaatctttcac

SEQ ID NO: 580122 - DNA, 25 bp, Mus musculus
gcttttctggttagtctatcagcat

SEQ ID NO: 580123 - DNA, 25 bp, Mus musculus
gcttttctggtttgtctatcagcat

SEQ ID NO: 580124 - DNA, 25 bp, Mus musculus
gcttttcttactcaggaggcggaca

SEQ ID NO: 580125 - DNA, 25 bp, Mus musculus
gcttttcttactgaggaggcggaca

SEQ ID NO: 580126 - DNA, 25 bp, Mus musculus
gcttttcttatcacatcatcaggta

SEQ ID NO: 580127 - DNA, 25 bp, Mus musculus
gcttttcttatctcatcatcaggta

SEQ ID NO: 580128 - DNA, 25 bp, Mus musculus
gcttttcttatgaaatttctcaaca

SEQ ID NO: 580129 - DNA, 25 bp, Mus musculus
gcttttcttatgtaatttctcaaca

SEQ ID NO: 580130 - DNA, 25 bp, Mus musculus
gcttttcttcagagattaaacctct

SEQ ID NO: 580131 - DNA, 25 bp, Mus musculus
gcttttcttcagtgattaaacctct

SEQ ID NO: 580132 - DNA, 25 bp, Mus musculus
gcttttcttcataaattttggcaaa

SEQ ID NO: 580133 - DNA, 25 bp, Mus musculus
gcttttcttcattaattttggcaaa

SEQ ID NO: 580134 - DNA, 25 bp, Mus musculus
gcttttcttcgaatatgtggaataa

SEQ ID NO: 580135 - DNA, 25 bp, Mus musculus
gcttttcttcgattatgtggaataa

SEQ ID NO: 580136 - DNA, 25 bp, Mus musculus
gcttttcttctcctctatgccgaat

SEQ ID NO: 580137 - DNA, 25 bp, Mus musculus
gcttttcttctcgtctatgccgaat

SEQ ID NO: 580138 - DNA, 25 bp, Mus musculus
gcttttcttgataggcctagtacaa

SEQ ID NO: 580139 - DNA, 25 bp, Mus musculus
gcttttcttgattggcctagtacaa

SEQ ID NO: 580140 - DNA, 25 bp, Mus musculus
gcttttcttgccattggcttagaac

SEQ ID NO: 580141 - DNA, 25 bp, Mus musculus
gcttttcttgcctttggcttagaac

SEQ ID NO: 580142 - DNA, 25 bp, Mus musculus
gcttttcttgctcttttccaaccaa

SEQ ID NO: 580143 - DNA, 25 bp, Mus musculus
gcttttcttgctgttttccaaccaa

SEQ ID NO: 580144 - DNA, 25 bp, Mus musculus
gcttttcttggacagcctgttcaga

SEQ ID NO: 580145 - DNA, 25 bp, Mus musculus
gcttttcttggagagcctgttcaga

SEQ ID NO: 580146 - DNA, 25 bp, Mus musculus
gcttttcttgtgattagttatgcac

SEQ ID NO: 580147 - DNA, 25 bp, Mus musculus
gcttttcttgtgtttagttatgcac

SEQ ID NO: 580148 - DNA, 25 bp, Mus musculus
gcttttctttctcaaggaggttcaa

SEQ ID NO: 580149 - DNA, 25 bp, Mus musculus
gcttttctttctgaaggaggttcaa

SEQ ID NO: 580150 - DNA, 25 bp, Mus musculus
gcttttcttttccagctggacacaa

SEQ ID NO: 580151 - DNA, 25 bp, Mus musculus
gcttttcttttcgagctggacacaa

SEQ ID NO: 580152 - DNA, 25 bp, Mus musculus
gcttttcttttgctcttcagtaaga

SEQ ID NO: 580153 - DNA, 25 bp, Mus musculus
gcttttcttttggtcttcagtaaga

SEQ ID NO: 580154 - DNA, 25 bp, Mus musculus
gcttttgaaacacaccatctctgaa

SEQ ID NO: 580155 - DNA, 25 bp, Mus musculus
gcttttgaaacacgcgccttaccct

SEQ ID NO: 580156 - DNA, 25 bp, Mus musculus
gcttttgaaacagaccatctctgaa

SEQ ID NO: 580157 - DNA, 25 bp, Mus musculus
gcttttgaaacaggcgccttaccct

SEQ ID NO: 580158 - DNA, 25 bp, Mus musculus
gcttttgaaactcaatgtcacctta

SEQ ID NO: 580159 - DNA, 25 bp, Mus musculus
gcttttgaaactgaatgtcacctta

SEQ ID NO: 580160 - DNA, 25 bp, Mus musculus
gcttttgaaagcctattccctaaag

SEQ ID NO: 580161 - DNA, 25 bp, Mus musculus
gcttttgaaagcgtattccctaaag

SEQ ID NO: 580162 - DNA, 25 bp, Mus musculus
gcttttgaacatatgtgcgcctatc

SEQ ID NO: 580163 - DNA, 25 bp, Mus musculus
gcttttgaacatttgtgcgcctatc

SEQ ID NO: 580164 - DNA, 25 bp, Mus musculus
gcttttgaactgcagctcagctggg

SEQ ID NO: 580165 - DNA, 25 bp, Mus musculus
gcttttgaactggagctcagctggg

SEQ ID NO: 580166 - DNA, 25 bp, Mus musculus
gcttttgactttaaatccctgggtg

SEQ ID NO: 580167 - DNA, 25 bp, Mus musculus
gcttttgacttttaatccctgggtg

SEQ ID NO: 580168 - DNA, 25 bp, Mus musculus
gcttttgaggctacagtttcagtaa

SEQ ID NO: 580169 - DNA, 25 bp, Mus musculus
gcttttgaggcttcagtttcagtaa

SEQ ID NO: 580170 - DNA, 25 bp, Mus musculus
gcttttgagttgaagtacggttcct

SEQ ID NO: 580171 - DNA, 25 bp, Mus musculus
gcttttgagttgtagtacggttcct

SEQ ID NO: 580172 - DNA, 25 bp, Mus musculus
gcttttgataccacttgtacctgta

SEQ ID NO: 580173 - DNA, 25 bp, Mus musculus
gcttttgatacctcttgtacctgta

SEQ ID NO: 580174 - DNA, 25 bp, Mus musculus
gcttttgatgacactcaggactgat

SEQ ID NO: 580175 - DNA, 25 bp, Mus musculus
gcttttgatgactctcaggactgat

SEQ ID NO: 580176 - DNA, 25 bp, Mus musculus
gcttttgatgctattgatacacaca

SEQ ID NO: 580177 - DNA, 25 bp, Mus musculus
gcttttgatgcttttgatacacaca

SEQ ID NO: 580178 - DNA, 25 bp, Mus musculus
gcttttgatgttagcccaggtagtt

SEQ ID NO: 580179 - DNA, 25 bp, Mus musculus
gcttttgatgtttgcccaggtagtt

SEQ ID NO: 580180 - DNA, 25 bp, Mus musculus
gcttttgattaaacctatgcctgtt

SEQ ID NO: 580181 - DNA, 25 bp, Mus musculus
gcttttgattaatcctatgcctgtt

SEQ ID NO: 580182 - DNA, 25 bp, Mus musculus
gcttttgattctcagcatcccattt

SEQ ID NO: 580183 - DNA, 25 bp, Mus musculus
gcttttgattctgagcatcccattt

SEQ ID NO: 580184 - DNA, 25 bp, Mus musculus
gcttttgattgtacgagcagcgtgt

SEQ ID NO: 580185 - DNA, 25 bp, Mus musculus
gcttttgattgttcgagcagcgtgt

SEQ ID NO: 580186 - DNA, 25 bp, Mus musculus
gcttttgattttagagtagggcttc

SEQ ID NO: 580187 - DNA, 25 bp, Mus musculus
gcttttgatttttgagtagggcttc

SEQ ID NO: 580188 - DNA, 25 bp, Mus musculus
gcttttgcacagatgtcagtcttat

SEQ ID NO: 580189 - DNA, 25 bp, Mus musculus
gcttttgcacagttgtcagtcttat

SEQ ID NO: 580190 - DNA, 25 bp, Mus musculus
gcttttgcacgcaattatggttacc

SEQ ID NO: 580191 - DNA, 25 bp, Mus musculus
gcttttgcacgctattatggttacc

SEQ ID NO: 580192 - DNA, 25 bp, Mus musculus
gcttttgcagcacatttaaactttt

SEQ ID NO: 580193 - DNA, 25 bp, Mus musculus
gcttttgcagcagatttaaactttt

SEQ ID NO: 580194 - DNA, 25 bp, Mus musculus
gcttttgcagccctgaacgtgtgga

SEQ ID NO: 580195 - DNA, 25 bp, Mus musculus
gcttttgcagccgtgaacgtgtgga

SEQ ID NO: 580196 - DNA, 25 bp, Mus musculus
gcttttgcagcgatatactcagatg

SEQ ID NO: 580197 - DNA, 25 bp, Mus musculus
gcttttgcagcgttatactcagatg

SEQ ID NO: 580198 - DNA, 25 bp, Mus musculus
gcttttgcaggaccgtgtctttaca

SEQ ID NO: 580199 - DNA, 25 bp, Mus musculus
gcttttgcaggagcgtgtctttaca

SEQ ID NO: 580200 - DNA, 25 bp, Mus musculus
gcttttgcatgcataaggatcccaa

SEQ ID NO: 580201 - DNA, 25 bp, Mus musculus
gcttttgcatgcttaaggatcccaa

SEQ ID NO: 580202 - DNA, 25 bp, Mus musculus
gcttttgcattacagtgatatgctg

SEQ ID NO: 580203 - DNA, 25 bp, Mus musculus
gcttttgcattagagtgatatgctg

SEQ ID NO: 580204 - DNA, 25 bp, Mus musculus
gcttttgcattgaagtacactcctt

SEQ ID NO: 580205 - DNA, 25 bp, Mus musculus
gcttttgcattgtagtacactcctt

SEQ ID NO: 580206 - DNA, 25 bp, Mus musculus
gcttttgccaaaagtgaccagtcct

SEQ ID NO: 580207 - DNA, 25 bp, Mus musculus
gcttttgccaaatgtgaccagtcct

SEQ ID NO: 580208 - DNA, 25 bp, Mus musculus
gcttttgccaacctgcaggaagcaa

SEQ ID NO: 580209 - DNA, 25 bp, Mus musculus
gcttttgccaacgtgcaggaagcaa

SEQ ID NO: 580210 - DNA, 25 bp, Mus musculus
gcttttgccactacagacagtgtga

SEQ ID NO: 580211 - DNA, 25 bp, Mus musculus
gcttttgccacttcagacagtgtga

SEQ ID NO: 580212 - DNA, 25 bp, Mus musculus
gcttttgccagtctgaccttaacat

SEQ ID NO: 580213 - DNA, 25 bp, Mus musculus
gcttttgccagtgtgaccttaacat

SEQ ID NO: 580214 - DNA, 25 bp, Mus musculus
gcttttgccgcacttgaattcatct

SEQ ID NO: 580215 - DNA, 25 bp, Mus musculus
gcttttgccgcagttgaattcatct

SEQ ID NO: 580216 - DNA, 25 bp, Mus musculus
gcttttgcctaaatttgcaggtcgg

SEQ ID NO: 580217 - DNA, 25 bp, Mus musculus
gcttttgcctaattttgcaggtcgg

SEQ ID NO: 580218 - DNA, 25 bp, Mus musculus
gcttttgcctgacccatttttgggc

SEQ ID NO: 580219 - DNA, 25 bp, Mus musculus
gcttttgcctgagccatttttgggc

SEQ ID NO: 580220 - DNA, 25 bp, Mus musculus
gcttttgcgctgaaggatgaccaca

SEQ ID NO: 580221 - DNA, 25 bp, Mus musculus
gcttttgcgctgtaggatgaccaca

SEQ ID NO: 580222 - DNA, 25 bp, Mus musculus
gcttttgcggagctcccgtgtacgt

SEQ ID NO: 580223 - DNA, 25 bp, Mus musculus
gcttttgcggaggtcccgtgtacgt

SEQ ID NO: 580224 - DNA, 25 bp, Mus musculus
gcttttgctaaacgtccaagccagc

SEQ ID NO: 580225 - DNA, 25 bp, Mus musculus
gcttttgctaaaggtccaagccagc

SEQ ID NO: 580226 - DNA, 25 bp, Mus musculus
gcttttgctacaaggccatcggttg

SEQ ID NO: 580227 - DNA, 25 bp, Mus musculus
gcttttgctacatggccatcggttg

SEQ ID NO: 580228 - DNA, 25 bp, Mus musculus
gcttttgctagaactttaagtacta

SEQ ID NO: 580229 - DNA, 25 bp, Mus musculus
gcttttgctagatctttaagtacta

SEQ ID NO: 580230 - DNA, 25 bp, Mus musculus
gcttttgctatgcaaccgtacctca

SEQ ID NO: 580231 - DNA, 25 bp, Mus musculus
gcttttgctatggaaccgtacctca

SEQ ID NO: 580232 - DNA, 25 bp, Mus musculus
gcttttgctattagtatttgctact

SEQ ID NO: 580233 - DNA, 25 bp, Mus musculus
gcttttgctatttgtatttgctact

SEQ ID NO: 580234 - DNA, 25 bp, Mus musculus
gcttttgctggccagagtttgttta

SEQ ID NO: 580235 - DNA, 25 bp, Mus musculus
gcttttgctggcgagagtttgttta

SEQ ID NO: 580236 - DNA, 25 bp, Mus musculus
gcttttgcttctacatctatagagt

SEQ ID NO: 580237 - DNA, 25 bp, Mus musculus
gcttttgcttcttcatctatagagt

SEQ ID NO: 580238 - DNA, 25 bp, Mus musculus
gcttttgcttggactactcataatg

SEQ ID NO: 580239 - DNA, 25 bp, Mus musculus
gcttttgcttggtctactcataatg

SEQ ID NO: 580240 - DNA, 25 bp, Mus musculus
gcttttggaacaacgtaccagcaaa

SEQ ID NO: 580241 - DNA, 25 bp, Mus musculus
gcttttggaacatcgtaccagcaaa

SEQ ID NO: 580242 - DNA, 25 bp, Mus musculus
gcttttggaatgaaatctacttgtt

SEQ ID NO: 580243 - DNA, 25 bp, Mus musculus
gcttttggaatgtaatctacttgtt

SEQ ID NO: 580244 - DNA, 25 bp, Mus musculus
gcttttggagttccagcttgacagt

SEQ ID NO: 580245 - DNA, 25 bp, Mus musculus
gcttttggagttgcagcttgacagt

SEQ ID NO: 580246 - DNA, 25 bp, Mus musculus
gcttttggatatccttgccaatttt

SEQ ID NO: 580247 - DNA, 25 bp, Mus musculus
gcttttggatatgcttgccaatttt

SEQ ID NO: 580248 - DNA, 25 bp, Mus musculus
gcttttggcagaagtctccacagac

SEQ ID NO: 580249 - DNA, 25 bp, Mus musculus
gcttttggcagatgtctccacagac

SEQ ID NO: 580250 - DNA, 25 bp, Mus musculus
gcttttggcatgatgcttttcttca

SEQ ID NO: 580251 - DNA, 25 bp, Mus musculus
gcttttggcatgttgcttttcttca

SEQ ID NO: 580252 - DNA, 25 bp, Mus musculus
gcttttggcgcccacagtgatgatg

SEQ ID NO: 580253 - DNA, 25 bp, Mus musculus
gcttttggcgccgacagtgatgatg

SEQ ID NO: 580254 - DNA, 25 bp, Mus musculus
gcttttggctggagtccagagactc

SEQ ID NO: 580255 - DNA, 25 bp, Mus musculus
gcttttggctggtgtccagagactc

SEQ ID NO: 580256 - DNA, 25 bp, Mus musculus
gcttttggcttgaacagctgtgtgt

SEQ ID NO: 580257 - DNA, 25 bp, Mus musculus
gcttttggcttgtacagctgtgtgt

SEQ ID NO: 580258 - DNA, 25 bp, Mus musculus
gcttttgggaagctgtctttactaa

SEQ ID NO: 580259 - DNA, 25 bp, Mus musculus
gcttttgggaaggtgtctttactaa

SEQ ID NO: 580260 - DNA, 25 bp, Mus musculus
gcttttgggagactcttaaccttct

SEQ ID NO: 580261 - DNA, 25 bp, Mus musculus
gcttttgggagagtcttaaccttct

SEQ ID NO: 580262 - DNA, 25 bp, Mus musculus
gcttttgggatgacaacgctggcaa

SEQ ID NO: 580263 - DNA, 25 bp, Mus musculus
gcttttgggatgagcatgcttgaga

SEQ ID NO: 580264 - DNA, 25 bp, Mus musculus
gcttttgggatgtcaacgctggcaa

SEQ ID NO: 580265 - DNA, 25 bp, Mus musculus
gcttttgggatgtgcatgcttgaga

SEQ ID NO: 580266 - DNA, 25 bp, Mus musculus
gcttttgggctaaagagagcttttc

SEQ ID NO: 580267 - DNA, 25 bp, Mus musculus
gcttttgggctatagagagcttttc

SEQ ID NO: 580268 - DNA, 25 bp, Mus musculus
gcttttggtccaaagtttgcatgat

SEQ ID NO: 580269 - DNA, 25 bp, Mus musculus
gcttttggtccatagtttgcatgat

SEQ ID NO: 580270 - DNA, 25 bp, Mus musculus
gcttttggttagcttcgtcactcac

SEQ ID NO: 580271 - DNA, 25 bp, Mus musculus
gcttttggttaggttcgtcactcac

SEQ ID NO: 580272 - DNA, 25 bp, Mus musculus
gcttttggttctactcatacttttt

SEQ ID NO: 580273 - DNA, 25 bp, Mus musculus
gcttttggttcttctcatacttttt

SEQ ID NO: 580274 - DNA, 25 bp, Mus musculus
gcttttggttgactgacatttattc

SEQ ID NO: 580275 - DNA, 25 bp, Mus musculus
gcttttggttgagtgacatttattc

SEQ ID NO: 580276 - DNA, 25 bp, Mus musculus
gcttttgtaaggcatgctgttcagt

SEQ ID NO: 580277 - DNA, 25 bp, Mus musculus
gcttttgtaagggatgctgttcagt

SEQ ID NO: 580278 - DNA, 25 bp, Mus musculus
gcttttgtagccaatcacacggatt

SEQ ID NO: 580279 - DNA, 25 bp, Mus musculus
gcttttgtagcctatcacacggatt

SEQ ID NO: 580280 - DNA, 25 bp, Mus musculus
gcttttgtagctagtcctgatgttt

SEQ ID NO: 580281 - DNA, 25 bp, Mus musculus
gcttttgtagcttgtcctgatgttt

SEQ ID NO: 580282 - DNA, 25 bp, Mus musculus
gcttttgtagggatgtttctgacat

SEQ ID NO: 580283 - DNA, 25 bp, Mus musculus
gcttttgtagggttgtttctgacat

SEQ ID NO: 580284 - DNA, 25 bp, Mus musculus
gcttttgtaggtaggccccaggaga

SEQ ID NO: 580285 - DNA, 25 bp, Mus musculus
gcttttgtaggttggccccaggaga

SEQ ID NO: 580286 - DNA, 25 bp, Mus musculus
gcttttgtagtgaggcaccttgtca

SEQ ID NO: 580287 - DNA, 25 bp, Mus musculus
gcttttgtagtgtggcaccttgtca

SEQ ID NO: 580288 - DNA, 25 bp, Mus musculus
gcttttgtagttcttgccattgcca

SEQ ID NO: 580289 - DNA, 25 bp, Mus musculus
gcttttgtagttgttgccattgcca

SEQ ID NO: 580290 - DNA, 25 bp, Mus musculus
gcttttgtatcacctaccacatttt

SEQ ID NO: 580291 - DNA, 25 bp, Mus musculus
gcttttgtatcagctaccacatttt

SEQ ID NO: 580292 - DNA, 25 bp, Mus musculus
gcttttgtatgcagagcaggacctt

SEQ ID NO: 580293 - DNA, 25 bp, Mus musculus
gcttttgtatgctgagcaggacctt

SEQ ID NO: 580294 - DNA, 25 bp, Mus musculus
gcttttgtatttctgctctagtgga

SEQ ID NO: 580295 - DNA, 25 bp, Mus musculus
gcttttgtatttgtgctctagtgga

SEQ ID NO: 580296 - DNA, 25 bp, Mus musculus
gcttttgtccttcgtggatccaaca

SEQ ID NO: 580297 - DNA, 25 bp, Mus musculus
gcttttgtccttggtggatccaaca

SEQ ID NO: 580298 - DNA, 25 bp, Mus musculus
gcttttgtctcgatttctagatgaa

SEQ ID NO: 580299 - DNA, 25 bp, Mus musculus
gcttttgtctcgttttctagatgaa

SEQ ID NO: 580300 - DNA, 25 bp, Mus musculus
gcttttgtctgacaaccatgtctat

SEQ ID NO: 580301 - DNA, 25 bp, Mus musculus
gcttttgtctgagaaccatgtctat

SEQ ID NO: 580302 - DNA, 25 bp, Mus musculus
gcttttgtgaacagaatgagtccca

SEQ ID NO: 580303 - DNA, 25 bp, Mus musculus
gcttttgtgaactgaatgagtccca

SEQ ID NO: 580304 - DNA, 25 bp, Mus musculus
gcttttgtgaatctgtctgctttga

SEQ ID NO: 580305 - DNA, 25 bp, Mus musculus
gcttttgtgaatgtgtctgctttga

SEQ ID NO: 580306 - DNA, 25 bp, Mus musculus
gcttttgtgcacatcagtaaccgag

SEQ ID NO: 580307 - DNA, 25 bp, Mus musculus
gcttttgtgcacttcagtaaccgag

SEQ ID NO: 580308 - DNA, 25 bp, Mus musculus
gcttttgtgcctccgtaatgagcca

SEQ ID NO: 580309 - DNA, 25 bp, Mus musculus
gcttttgtgcctgcgtaatgagcca

SEQ ID NO: 580310 - DNA, 25 bp, Mus musculus
gcttttgtgctgctagtcccggaaa

SEQ ID NO: 580311 - DNA, 25 bp, Mus musculus
gcttttgtgctggtagtcccggaaa

SEQ ID NO: 580312 - DNA, 25 bp, Mus musculus
gcttttgttcccagccaggacagac

SEQ ID NO: 580313 - DNA, 25 bp, Mus musculus
gcttttgttccctgccaggacagac

SEQ ID NO: 580314 - DNA, 25 bp, Mus musculus
gcttttgttctgatcatcaacctgt

SEQ ID NO: 580315 - DNA, 25 bp, Mus musculus
gcttttgttctgttcatcaacctgt

SEQ ID NO: 580316 - DNA, 25 bp, Mus musculus
gcttttgttgccattcttgctgttt

SEQ ID NO: 580317 - DNA, 25 bp, Mus musculus
gcttttgttgcctttcttgctgttt

SEQ ID NO: 580318 - DNA, 25 bp, Mus musculus
gcttttgttgctagtctttactgtt

SEQ ID NO: 580319 - DNA, 25 bp, Mus musculus
gcttttgttgcttgtctttactgtt

SEQ ID NO: 580320 - DNA, 25 bp, Mus musculus
gcttttgtttcaactgcaggcagtg

SEQ ID NO: 580321 - DNA, 25 bp, Mus musculus
gcttttgtttcatctgcaggcagtg

SEQ ID NO: 580322 - DNA, 25 bp, Mus musculus
gctttttaaagaaggcccctcagct

SEQ ID NO: 580323 - DNA, 25 bp, Mus musculus
gctttttaaagatggcccctcagct

SEQ ID NO: 580324 - DNA, 25 bp, Mus musculus
gctttttaactaagaaacccctgag

SEQ ID NO: 580325 - DNA, 25 bp, Mus musculus
gctttttaactatgaaacccctgag

SEQ ID NO: 580326 - DNA, 25 bp, Mus musculus
gctttttaagacactattccacgta

SEQ ID NO: 580327 - DNA, 25 bp, Mus musculus
gctttttaagactctattccacgta

SEQ ID NO: 580328 - DNA, 25 bp, Mus musculus
gctttttaatacagctcgtcttcac

SEQ ID NO: 580329 - DNA, 25 bp, Mus musculus
gctttttaatactgctcgtcttcac

SEQ ID NO: 580330 - DNA, 25 bp, Mus musculus
gctttttaatcccagtcgaagaagg

SEQ ID NO: 580331 - DNA, 25 bp, Mus musculus
gctttttaatccgagtcgaagaagg

SEQ ID NO: 580332 - DNA, 25 bp, Mus musculus
gctttttaatgcatgcacttcattg

SEQ ID NO: 580333 - DNA, 25 bp, Mus musculus
gctttttaatgcttgcacttcattg

SEQ ID NO: 580334 - DNA, 25 bp, Mus musculus
gctttttacaaacgtagcttccaat

SEQ ID NO: 580335 - DNA, 25 bp, Mus musculus
gctttttacaaaggtagcttccaat

SEQ ID NO: 580336 - DNA, 25 bp, Mus musculus
gctttttacaccacagactctatct

SEQ ID NO: 580337 - DNA, 25 bp, Mus musculus
gctttttacacctcagactctatct

SEQ ID NO: 580338 - DNA, 25 bp, Mus musculus
gctttttacatgactgcactaggca

SEQ ID NO: 580339 - DNA, 25 bp, Mus musculus
gctttttacatgtctgcactaggca

SEQ ID NO: 580340 - DNA, 25 bp, Mus musculus
gctttttacattcagaagatgctgc

SEQ ID NO: 580341 - DNA, 25 bp, Mus musculus
gctttttacattgagaagatgctgc

SEQ ID NO: 580342 - DNA, 25 bp, Mus musculus
gctttttactacagatccattgttc

SEQ ID NO: 580343 - DNA, 25 bp, Mus musculus
gctttttactactgatccattgttc

SEQ ID NO: 580344 - DNA, 25 bp, Mus musculus
gctttttagacccagcgctccttta

SEQ ID NO: 580345 - DNA, 25 bp, Mus musculus
gctttttagaccgagcgctccttta

SEQ ID NO: 580346 - DNA, 25 bp, Mus musculus
gctttttagcctcttatctgtgggt

SEQ ID NO: 580347 - DNA, 25 bp, Mus musculus
gctttttagcctgttatctgtgggt

SEQ ID NO: 580348 - DNA, 25 bp, Mus musculus
gctttttagcttagtagatcctggt

SEQ ID NO: 580349 - DNA, 25 bp, Mus musculus
gctttttagctttgtagatcctggt

SEQ ID NO: 580350 - DNA, 25 bp, Mus musculus
gctttttaggacagctatctgagat

SEQ ID NO: 580351 - DNA, 25 bp, Mus musculus
gctttttaggactgctatctgagat

SEQ ID NO: 580352 - DNA, 25 bp, Mus musculus
gctttttaggtcagtggttttctga

SEQ ID NO: 580353 - DNA, 25 bp, Mus musculus
gctttttaggtctgtggttttctga

SEQ ID NO: 580354 - DNA, 25 bp, Mus musculus
gctttttagttgatatcctgcggag

SEQ ID NO: 580355 - DNA, 25 bp, Mus musculus
gctttttagttgttatcctgcggag

SEQ ID NO: 580356 - DNA, 25 bp, Mus musculus
gctttttatcctagcaacatcctag

SEQ ID NO: 580357 - DNA, 25 bp, Mus musculus
gctttttatccttgcaacatcctag

SEQ ID NO: 580358 - DNA, 25 bp, Mus musculus
gctttttatcttcggcatcagctat

SEQ ID NO: 580359 - DNA, 25 bp, Mus musculus
gctttttatcttgggcatcagctat

SEQ ID NO: 580360 - DNA, 25 bp, Mus musculus
gctttttatgtgatcgctagagatc

SEQ ID NO: 580361 - DNA, 25 bp, Mus musculus
gctttttatgtgttcgctagagatc

SEQ ID NO: 580362 - DNA, 25 bp, Mus musculus
gctttttcaagacagatgtttagat

SEQ ID NO: 580363 - DNA, 25 bp, Mus musculus
gctttttcaagagagatgtttagat

SEQ ID NO: 580364 - DNA, 25 bp, Mus musculus
gctttttcatatacccccttaggag

SEQ ID NO: 580365 - DNA, 25 bp, Mus musculus
gctttttcatattcccccttaggag

SEQ ID NO: 580366 - DNA, 25 bp, Mus musculus
gctttttcatgaacaaattaccaga

SEQ ID NO: 580367 - DNA, 25 bp, Mus musculus
gctttttcatgatcaaattaccaga

SEQ ID NO: 580368 - DNA, 25 bp, Mus musculus
gctttttcatggacatatatcactg

SEQ ID NO: 580369 - DNA, 25 bp, Mus musculus
gctttttcatggtcatatatcactg

SEQ ID NO: 580370 - DNA, 25 bp, Mus musculus
gctttttccagcaaggctttttgtt

SEQ ID NO: 580371 - DNA, 25 bp, Mus musculus
gctttttccagctaggctttttgtt

SEQ ID NO: 580372 - DNA, 25 bp, Mus musculus
gctttttccataaatgtgggccttt

SEQ ID NO: 580373 - DNA, 25 bp, Mus musculus
gctttttccatatatgtgggccttt

SEQ ID NO: 580374 - DNA, 25 bp, Mus musculus
gctttttccattatagttcaatcat

SEQ ID NO: 580375 - DNA, 25 bp, Mus musculus
gctttttccattttagttcaatcat

SEQ ID NO: 580376 - DNA, 25 bp, Mus musculus
gctttttccccaacaactatgtaga

SEQ ID NO: 580377 - DNA, 25 bp, Mus musculus
gctttttccccatcaactatgtaga

SEQ ID NO: 580378 - DNA, 25 bp, Mus musculus
gctttttctagccacatttgcatta

SEQ ID NO: 580379 - DNA, 25 bp, Mus musculus
gctttttctagcgacatttgcatta

SEQ ID NO: 580380 - DNA, 25 bp, Mus musculus
gctttttctagtcgcatgatgtaat

SEQ ID NO: 580381 - DNA, 25 bp, Mus musculus
gctttttctagtggcatgatgtaat

SEQ ID NO: 580382 - DNA, 25 bp, Mus musculus
gctttttctataacgtgcattctca

SEQ ID NO: 580383 - DNA, 25 bp, Mus musculus
gctttttctatatcgtgcattctca

SEQ ID NO: 580384 - DNA, 25 bp, Mus musculus
gctttttctgcacctcttgtaatct

SEQ ID NO: 580385 - DNA, 25 bp, Mus musculus
gctttttctgcagctcttgtaatct

SEQ ID NO: 580386 - DNA, 25 bp, Mus musculus
gctttttctgccataacttgctact

SEQ ID NO: 580387 - DNA, 25 bp, Mus musculus
gctttttctgccttaacttgctact

SEQ ID NO: 580388 - DNA, 25 bp, Mus musculus
gctttttctgctagtcaccaggaga

SEQ ID NO: 580389 - DNA, 25 bp, Mus musculus
gctttttctgcttgtcaccaggaga

SEQ ID NO: 580390 - DNA, 25 bp, Mus musculus
gctttttcttatctcttacaggtga

SEQ ID NO: 580391 - DNA, 25 bp, Mus musculus
gctttttcttatgtcttacaggtga

SEQ ID NO: 580392 - DNA, 25 bp, Mus musculus
gctttttcttgaccagagtgccctg

SEQ ID NO: 580393 - DNA, 25 bp, Mus musculus
gctttttcttgagcagagtgccctg

SEQ ID NO: 580394 - DNA, 25 bp, Mus musculus
gctttttcttggcttaacagtgcag

SEQ ID NO: 580395 - DNA, 25 bp, Mus musculus
gctttttcttgggttaacagtgcag

SEQ ID NO: 580396 - DNA, 25 bp, Mus musculus
gctttttctttactgtattcttggt

SEQ ID NO: 580397 - DNA, 25 bp, Mus musculus
gctttttctttagtgtattcttggt

SEQ ID NO: 580398 - DNA, 25 bp, Mus musculus
gctttttctttgcttcatgcttgta

SEQ ID NO: 580399 - DNA, 25 bp, Mus musculus
gctttttctttggttcatgcttgta

SEQ ID NO: 580400 - DNA, 25 bp, Mus musculus
gctttttgaaacacacagtcacatt

SEQ ID NO: 580401 - DNA, 25 bp, Mus musculus
gctttttgaaactcacagtcacatt

SEQ ID NO: 580402 - DNA, 25 bp, Mus musculus
gctttttgaacaaagcatctgatca

SEQ ID NO: 580403 - DNA, 25 bp, Mus musculus
gctttttgaacatagcatctgatca

SEQ ID NO: 580404 - DNA, 25 bp, Mus musculus
gctttttgaagaaatcctgaccagg

SEQ ID NO: 580405 - DNA, 25 bp, Mus musculus
gctttttgaagatatcctgaccagg

SEQ ID NO: 580406 - DNA, 25 bp, Mus musculus
gctttttgaatgatgcagcacttga

SEQ ID NO: 580407 - DNA, 25 bp, Mus musculus
gctttttgaatgttgcagcacttga

SEQ ID NO: 580408 - DNA, 25 bp, Mus musculus
gctttttgcaggaattctattacat

SEQ ID NO: 580409 - DNA, 25 bp, Mus musculus
gctttttgcaggtattctattacat

SEQ ID NO: 580410 - DNA, 25 bp, Mus musculus
gctttttgccacacctttatttatt

SEQ ID NO: 580411 - DNA, 25 bp, Mus musculus
gctttttgccactcctttatttatt

SEQ ID NO: 580412 - DNA, 25 bp, Mus musculus
gctttttgccagaagagaatttcct

SEQ ID NO: 580413 - DNA, 25 bp, Mus musculus
gctttttgccagtagagaatttcct

SEQ ID NO: 580414 - DNA, 25 bp, Mus musculus
gctttttggaaaacctgggtgctat

SEQ ID NO: 580415 - DNA, 25 bp, Mus musculus
gctttttggaaatcctgggtgctat

SEQ ID NO: 580416 - DNA, 25 bp, Mus musculus
gctttttggacactttctacctcat

SEQ ID NO: 580417 - DNA, 25 bp, Mus musculus
gctttttggacagtttctacctcat

SEQ ID NO: 580418 - DNA, 25 bp, Mus musculus
gctttttggtaccaatcagcctgat

SEQ ID NO: 580419 - DNA, 25 bp, Mus musculus
gctttttggtacgaatcagcctgat

SEQ ID NO: 580420 - DNA, 25 bp, Mus musculus
gctttttggtggaatgagacgttca

SEQ ID NO: 580421 - DNA, 25 bp, Mus musculus
gctttttggtggtatgagacgttca

SEQ ID NO: 580422 - DNA, 25 bp, Mus musculus
gctttttgtatccataggctccaca

SEQ ID NO: 580423 - DNA, 25 bp, Mus musculus
gctttttgtatcgataggctccaca

SEQ ID NO: 580424 - DNA, 25 bp, Mus musculus
gctttttgtctcatgtgcccccaat

SEQ ID NO: 580425 - DNA, 25 bp, Mus musculus
gctttttgtctcttgtgcccccaat

SEQ ID NO: 580426 - DNA, 25 bp, Mus musculus
gctttttgtgccatgtcttagtata

SEQ ID NO: 580427 - DNA, 25 bp, Mus musculus
gctttttgtgccttgtcttagtata

SEQ ID NO: 580428 - DNA, 25 bp, Mus musculus
gctttttgtggccaatctaattaaa

SEQ ID NO: 580429 - DNA, 25 bp, Mus musculus
gctttttgtggccactttggacaag

SEQ ID NO: 580430 - DNA, 25 bp, Mus musculus
gctttttgtggccagttgatgagat

SEQ ID NO: 580431 - DNA, 25 bp, Mus musculus
gctttttgtggcgaatctaattaaa

SEQ ID NO: 580432 - DNA, 25 bp, Mus musculus
gctttttgtggcgactttggacaag

SEQ ID NO: 580433 - DNA, 25 bp, Mus musculus
gctttttgtggcgagttgatgagat

SEQ ID NO: 580434 - DNA, 25 bp, Mus musculus
gctttttgtgttctcttcttaacct

SEQ ID NO: 580435 - DNA, 25 bp, Mus musculus
gctttttgtgttgtcttcttaacct

SEQ ID NO: 580436 - DNA, 25 bp, Mus musculus
gctttttgttgcattgtgaacacat

SEQ ID NO: 580437 - DNA, 25 bp, Mus musculus
gctttttgttgctttgtgaacacat

SEQ ID NO: 580438 - DNA, 25 bp, Mus musculus
gctttttgtttcaagtttcacttag

SEQ ID NO: 580439 - DNA, 25 bp, Mus musculus
gctttttgtttctagtttcacttag

SEQ ID NO: 580440 - DNA, 25 bp, Mus musculus
gcttttttatatacagccctgcaaa

SEQ ID NO: 580441 - DNA, 25 bp, Mus musculus
gcttttttatattcagccctgcaaa

SEQ ID NO: 580442 - DNA, 25 bp, Mus musculus
gcttttttatgtctgtacccaatcc

SEQ ID NO: 580443 - DNA, 25 bp, Mus musculus
gcttttttatgtgtgtacccaatcc

SEQ ID NO: 580444 - DNA, 25 bp, Mus musculus
gcttttttcacaaccctatattctc

SEQ ID NO: 580445 - DNA, 25 bp, Mus musculus
gcttttttcacatccctatattctc

SEQ ID NO: 580446 - DNA, 25 bp, Mus musculus
gcttttttcaggcaagttctcacta

SEQ ID NO: 580447 - DNA, 25 bp, Mus musculus
gcttttttcagggaagttctcacta

SEQ ID NO: 580448 - DNA, 25 bp, Mus musculus
gcttttttccagctcacctgttttg

SEQ ID NO: 580449 - DNA, 25 bp, Mus musculus
gcttttttccaggtcacctgttttg

SEQ ID NO: 580450 - DNA, 25 bp, Mus musculus
gcttttttcccaaagcccttgcact

SEQ ID NO: 580451 - DNA, 25 bp, Mus musculus
gcttttttcccatagcccttgcact

SEQ ID NO: 580452 - DNA, 25 bp, Mus musculus
gcttttttcgtgattcatgatactg

SEQ ID NO: 580453 - DNA, 25 bp, Mus musculus
gcttttttcgtgtttcatgatactg

SEQ ID NO: 580454 - DNA, 25 bp, Mus musculus
gcttttttctgacgtactgtatcca

SEQ ID NO: 580455 - DNA, 25 bp, Mus musculus
gcttttttctgaggtactgtatcca

SEQ ID NO: 580456 - DNA, 25 bp, Mus musculus
gcttttttgagcacgagggtcgccc

SEQ ID NO: 580457 - DNA, 25 bp, Mus musculus
gcttttttgagctcgagggtcgccc

SEQ ID NO: 580458 - DNA, 25 bp, Mus musculus
gcttttttgctgactggccattgtg

SEQ ID NO: 580459 - DNA, 25 bp, Mus musculus
gcttttttgctgtctggccattgtg

SEQ ID NO: 580460 - DNA, 25 bp, Mus musculus
gcttttttggagatggactatattt

SEQ ID NO: 580461 - DNA, 25 bp, Mus musculus
gcttttttggagttggactatattt

SEQ ID NO: 580462 - DNA, 25 bp, Mus musculus
gctttttttatcagagccagcgctg

SEQ ID NO: 580463 - DNA, 25 bp, Mus musculus
gctttttttatctgagccagcgctg

SEQ ID NO: 580464 - DNA, 25 bp, Mus musculus
ggaaaaaaccttcgctcctcaatgt

SEQ ID NO: 580465 - DNA, 25 bp, Mus musculus
ggaaaaaaccttggctcctcaatgt

SEQ ID NO: 580466 - DNA, 25 bp, Mus musculus
ggaaaaaagctccagcctccgtggt

SEQ ID NO: 580467 - DNA, 25 bp, Mus musculus
ggaaaaaagctcgagcctccgtggt

SEQ ID NO: 580468 - DNA, 25 bp, Mus musculus
ggaaaaacaacaaccaagcaaggtt

SEQ ID NO: 580469 - DNA, 25 bp, Mus musculus
ggaaaaacaacatccaagcaaggtt

SEQ ID NO: 580470 - DNA, 25 bp, Mus musculus
ggaaaaacagcacacgatctcaaaa

SEQ ID NO: 580471 - DNA, 25 bp, Mus musculus
ggaaaaacagcagacgatctcaaaa

SEQ ID NO: 580472 - DNA, 25 bp, Mus musculus
ggaaaaaccctacctggcagtagag

SEQ ID NO: 580473 - DNA, 25 bp, Mus musculus
ggaaaaaccctagctggcagtagag

SEQ ID NO: 580474 - DNA, 25 bp, Mus musculus
ggaaaaactccaagccctggcaagg

SEQ ID NO: 580475 - DNA, 25 bp, Mus musculus
ggaaaaactccatgccctggcaagg

SEQ ID NO: 580476 - DNA, 25 bp, Mus musculus
ggaaaaagaaatcctgtgacacaca

SEQ ID NO: 580477 - DNA, 25 bp, Mus musculus
ggaaaaagaaatgctgtgacacaca

SEQ ID NO: 580478 - DNA, 25 bp, Mus musculus
ggaaaaagacttcgccttccagcag

SEQ ID NO: 580479 - DNA, 25 bp, Mus musculus
ggaaaaagacttggccttccagcag

SEQ ID NO: 580480 - DNA, 25 bp, Mus musculus
ggaaaaagagaacactcccacaatt

SEQ ID NO: 580481 - DNA, 25 bp, Mus musculus
ggaaaaagagaagactcccacaatt

SEQ ID NO: 580482 - DNA, 25 bp, Mus musculus
ggaaaaagagccactgtcacccatt

SEQ ID NO: 580483 - DNA, 25 bp, Mus musculus
ggaaaaagagcctctgtcacccatt

SEQ ID NO: 580484 - DNA, 25 bp, Mus musculus
ggaaaaagattcacaggaactacac

SEQ ID NO: 580485 - DNA, 25 bp, Mus musculus
ggaaaaagattctcaggaactacac

SEQ ID NO: 580486 - DNA, 25 bp, Mus musculus
ggaaaaagcttcatgctggacttgc

SEQ ID NO: 580487 - DNA, 25 bp, Mus musculus
ggaaaaagcttcttgctggacttgc

SEQ ID NO: 580488 - DNA, 25 bp, Mus musculus
ggaaaaagtagacccctgtctgtgc

SEQ ID NO: 580489 - DNA, 25 bp, Mus musculus
ggaaaaagtagagccctgtctgtgc

SEQ ID NO: 580490 - DNA, 25 bp, Mus musculus
ggaaaaagtatgacgctctgagagt

SEQ ID NO: 580491 - DNA, 25 bp, Mus musculus
ggaaaaagtatgtcgctctgagagt

SEQ ID NO: 580492 - DNA, 25 bp, Mus musculus
ggaaaaagtgcgcgatgccgggatc

SEQ ID NO: 580493 - DNA, 25 bp, Mus musculus
ggaaaaagtgcgggatgccgggatc

SEQ ID NO: 580494 - DNA, 25 bp, Mus musculus
ggaaaaatacccatatgcataaaag

SEQ ID NO: 580495 - DNA, 25 bp, Mus musculus
ggaaaaatacccttatgcataaaag

SEQ ID NO: 580496 - DNA, 25 bp, Mus musculus
ggaaaaatatctactgcgacccagt

SEQ ID NO: 580497 - DNA, 25 bp, Mus musculus
ggaaaaatatcttctgcgacccagt

SEQ ID NO: 580498 - DNA, 25 bp, Mus musculus
ggaaaaatattcaggtctatcatat

SEQ ID NO: 580499 - DNA, 25 bp, Mus musculus
ggaaaaatattctggtctatcatat

SEQ ID NO: 580500 - DNA, 25 bp, Mus musculus
ggaaaaatcaccatcggctctagca

SEQ ID NO: 580501 - DNA, 25 bp, Mus musculus
ggaaaaatcacccatgccatcaagt

SEQ ID NO: 580502 - DNA, 25 bp, Mus musculus
ggaaaaatcaccgatgccatcaagt

SEQ ID NO: 580503 - DNA, 25 bp, Mus musculus
ggaaaaatcaccttcggctctagca

SEQ ID NO: 580504 - DNA, 25 bp, Mus musculus
ggaaaaatcagccagatgcagtata

SEQ ID NO: 580505 - DNA, 25 bp, Mus musculus
ggaaaaatcagcgagatgcagtata

SEQ ID NO: 580506 - DNA, 25 bp, Mus musculus
ggaaaaatcataatcactgaaggac

SEQ ID NO: 580507 - DNA, 25 bp, Mus musculus
ggaaaaatcatattcactgaaggac

SEQ ID NO: 580508 - DNA, 25 bp, Mus musculus
ggaaaaatcatcaacctttgttctt

SEQ ID NO: 580509 - DNA, 25 bp, Mus musculus
ggaaaaatcatctacctttgttctt

SEQ ID NO: 580510 - DNA, 25 bp, Mus musculus
ggaaaaatcctaacagtgtcaacag

SEQ ID NO: 580511 - DNA, 25 bp, Mus musculus
ggaaaaatcctaaccagctacacat

SEQ ID NO: 580512 - DNA, 25 bp, Mus musculus
ggaaaaatcctatcagtgtcaacag

SEQ ID NO: 580513 - DNA, 25 bp, Mus musculus
ggaaaaatcctatccagctacacat

SEQ ID NO: 580514 - DNA, 25 bp, Mus musculus
ggaaaaatctaccatcttgcccgat

SEQ ID NO: 580515 - DNA, 25 bp, Mus musculus
ggaaaaatctacgatcttgcccgat

SEQ ID NO: 580516 - DNA, 25 bp, Mus musculus
ggaaaaatgaccagtgccatcaccg

SEQ ID NO: 580517 - DNA, 25 bp, Mus musculus
ggaaaaatgacctgtgccatcaccg

SEQ ID NO: 580518 - DNA, 25 bp, Mus musculus
ggaaaaatggcacccacctgactag

SEQ ID NO: 580519 - DNA, 25 bp, Mus musculus
ggaaaaatggcagccacctgactag

SEQ ID NO: 580520 - DNA, 25 bp, Mus musculus
ggaaaaatgtaactgtctacctgca

SEQ ID NO: 580521 - DNA, 25 bp, Mus musculus
ggaaaaatgtaagtgtctacctgca

SEQ ID NO: 580522 - DNA, 25 bp, Mus musculus
ggaaaaattggtagcagttcttaat

SEQ ID NO: 580523 - DNA, 25 bp, Mus musculus
ggaaaaattggttgcagttcttaat

SEQ ID NO: 580524 - DNA, 25 bp, Mus musculus
ggaaaaatttgtccctgccagtaga

SEQ ID NO: 580525 - DNA, 25 bp, Mus musculus
ggaaaaatttgtgcctgccagtaga

SEQ ID NO: 580526 - DNA, 25 bp, Mus musculus
ggaaaaattttaacactgccatcac

SEQ ID NO: 580527 - DNA, 25 bp, Mus musculus
ggaaaaattttatcactgccatcac

SEQ ID NO: 580528 - DNA, 25 bp, Mus musculus
ggaaaacaacaacctgtcttagtta

SEQ ID NO: 580529 - DNA, 25 bp, Mus musculus
ggaaaacaacaagctgtcttagtta

SEQ ID NO: 580530 - DNA, 25 bp, Mus musculus
ggaaaacaacttccaccactaagag

SEQ ID NO: 580531 - DNA, 25 bp, Mus musculus
ggaaaacaacttcctgacagcctca

SEQ ID NO: 580532 - DNA, 25 bp, Mus musculus
ggaaaacaacttgcaccactaagag

SEQ ID NO: 580533 - DNA, 25 bp, Mus musculus
ggaaaacaacttgctgacagcctca

SEQ ID NO: 580534 - DNA, 25 bp, Mus musculus
ggaaaacaatatatgcagactataa

SEQ ID NO: 580535 - DNA, 25 bp, Mus musculus
ggaaaacaatatttgcagactataa

SEQ ID NO: 580536 - DNA, 25 bp, Mus musculus
ggaaaacacacaatacccatgcctt

SEQ ID NO: 580537 - DNA, 25 bp, Mus musculus
ggaaaacacacattacccatgcctt

SEQ ID NO: 580538 - DNA, 25 bp, Mus musculus
ggaaaacacagaaaccagggccatt

SEQ ID NO: 580539 - DNA, 25 bp, Mus musculus
ggaaaacacagataccagggccatt

SEQ ID NO: 580540 - DNA, 25 bp, Mus musculus
ggaaaacacatcacattcctctaga

SEQ ID NO: 580541 - DNA, 25 bp, Mus musculus
ggaaaacacatctcattcctctaga

SEQ ID NO: 580542 - DNA, 25 bp, Mus musculus
ggaaaacaccatacaacctcggatt

SEQ ID NO: 580543 - DNA, 25 bp, Mus musculus
ggaaaacaccattcaacctcggatt

SEQ ID NO: 580544 - DNA, 25 bp, Mus musculus
ggaaaacactagcattattgcaagt

SEQ ID NO: 580545 - DNA, 25 bp, Mus musculus
ggaaaacactaggattattgcaagt

SEQ ID NO: 580546 - DNA, 25 bp, Mus musculus
ggaaaacactgcattctgactgatt

SEQ ID NO: 580547 - DNA, 25 bp, Mus musculus
ggaaaacactgctttctgactgatt

SEQ ID NO: 580548 - DNA, 25 bp, Mus musculus
ggaaaacacttcaatggcaagctgg

SEQ ID NO: 580549 - DNA, 25 bp, Mus musculus
ggaaaacacttctatggcaagctgg

SEQ ID NO: 580550 - DNA, 25 bp, Mus musculus
ggaaaacagaggcatattcctgtca

SEQ ID NO: 580551 - DNA, 25 bp, Mus musculus
ggaaaacagagggatattcctgtca

SEQ ID NO: 580552 - DNA, 25 bp, Mus musculus
ggaaaacagattcccctctgcatgt

SEQ ID NO: 580553 - DNA, 25 bp, Mus musculus
ggaaaacagattgccctctgcatgt

SEQ ID NO: 580554 - DNA, 25 bp, Mus musculus
ggaaaacagtctatacagcagtaac

SEQ ID NO: 580555 - DNA, 25 bp, Mus musculus
ggaaaacagtctttacagcagtaac

SEQ ID NO: 580556 - DNA, 25 bp, Mus musculus
ggaaaacagtggagtcctcaaccta

SEQ ID NO: 580557 - DNA, 25 bp, Mus musculus
ggaaaacagtggtgtcctcaaccta

SEQ ID NO: 580558 - DNA, 25 bp, Mus musculus
ggaaaacatactccgcaccgcagag

SEQ ID NO: 580559 - DNA, 25 bp, Mus musculus
ggaaaacatactgcgcaccgcagag

SEQ ID NO: 580560 - DNA, 25 bp, Mus musculus
ggaaaacatcacaggcaccagctat

SEQ ID NO: 580561 - DNA, 25 bp, Mus musculus
ggaaaacatcactggcaccagctat

SEQ ID NO: 580562 - DNA, 25 bp, Mus musculus
ggaaaacatcgcactaaccatgctt

SEQ ID NO: 580563 - DNA, 25 bp, Mus musculus
ggaaaacatcgctctaaccatgctt

SEQ ID NO: 580564 - DNA, 25 bp, Mus musculus
ggaaaacatcttagagacgtggaaa

SEQ ID NO: 580565 - DNA, 25 bp, Mus musculus
ggaaaacatctttgagacgtggaaa

SEQ ID NO: 580566 - DNA, 25 bp, Mus musculus
ggaaaacatgctatgccacttgcct

SEQ ID NO: 580567 - DNA, 25 bp, Mus musculus
ggaaaacatgctttgccacttgcct

SEQ ID NO: 580568 - DNA, 25 bp, Mus musculus
ggaaaacattgccaccatttgtaga

SEQ ID NO: 580569 - DNA, 25 bp, Mus musculus
ggaaaacattgcgaccatttgtaga

SEQ ID NO: 580570 - DNA, 25 bp, Mus musculus
ggaaaacattggactccctctgata

SEQ ID NO: 580571 - DNA, 25 bp, Mus musculus
ggaaaacattggtctccctctgata

SEQ ID NO: 580572 - DNA, 25 bp, Mus musculus
ggaaaacattgtaacatgaggaatt

SEQ ID NO: 580573 - DNA, 25 bp, Mus musculus
ggaaaacattgttacatgaggaatt

SEQ ID NO: 580574 - DNA, 25 bp, Mus musculus
ggaaaacatttccttagcctctgct

SEQ ID NO: 580575 - DNA, 25 bp, Mus musculus
ggaaaacatttcgttagcctctgct

SEQ ID NO: 580576 - DNA, 25 bp, Mus musculus
ggaaaaccaaccaccgaacatcata

SEQ ID NO: 580577 - DNA, 25 bp, Mus musculus
ggaaaaccaacctccgaacatcata

SEQ ID NO: 580578 - DNA, 25 bp, Mus musculus
ggaaaaccaagacactcaagtaact

SEQ ID NO: 580579 - DNA, 25 bp, Mus musculus
ggaaaaccaagagactcaagtaact

SEQ ID NO: 580580 - DNA, 25 bp, Mus musculus
ggaaaaccactacaagttctacctg

SEQ ID NO: 580581 - DNA, 25 bp, Mus musculus
ggaaaaccactagaagttctacctg

SEQ ID NO: 580582 - DNA, 25 bp, Mus musculus
ggaaaaccagatccatcagcgaata

SEQ ID NO: 580583 - DNA, 25 bp, Mus musculus
ggaaaaccagatgcatcagcgaata

SEQ ID NO: 580584 - DNA, 25 bp, Mus musculus
ggaaaaccagcaactcagcaaatgt

SEQ ID NO: 580585 - DNA, 25 bp, Mus musculus
ggaaaaccagcatctcagcaaatgt

SEQ ID NO: 580586 - DNA, 25 bp, Mus musculus
ggaaaaccaggcaagtgcttgaaga

SEQ ID NO: 580587 - DNA, 25 bp, Mus musculus
ggaaaaccaggctagtgcttgaaga

SEQ ID NO: 580588 - DNA, 25 bp, Mus musculus
ggaaaaccatgccaaatcgccagtg

SEQ ID NO: 580589 - DNA, 25 bp, Mus musculus
ggaaaaccatgcgaaatcgccagtg

SEQ ID NO: 580590 - DNA, 25 bp, Mus musculus
ggaaaaccatgtcttcagcacgcat

SEQ ID NO: 580591 - DNA, 25 bp, Mus musculus
ggaaaaccatgtgttcagcacgcat

SEQ ID NO: 580592 - DNA, 25 bp, Mus musculus
ggaaaaccattcaggcagccttgct

SEQ ID NO: 580593 - DNA, 25 bp, Mus musculus
ggaaaaccattctggcagccttgct

SEQ ID NO: 580594 - DNA, 25 bp, Mus musculus
ggaaaacccaaccttcatactggag

SEQ ID NO: 580595 - DNA, 25 bp, Mus musculus
ggaaaacccaacgttcatactggag

SEQ ID NO: 580596 - DNA, 25 bp, Mus musculus
ggaaaacccagaaggtgcatattct

SEQ ID NO: 580597 - DNA, 25 bp, Mus musculus
ggaaaacccagatggtgcatattct

SEQ ID NO: 580598 - DNA, 25 bp, Mus musculus
ggaaaacccagccagcctttgacaa

SEQ ID NO: 580599 - DNA, 25 bp, Mus musculus
ggaaaacccagcgagcctttgacaa

SEQ ID NO: 580600 - DNA, 25 bp, Mus musculus
ggaaaacccagtaatcaacacagaa

SEQ ID NO: 580601 - DNA, 25 bp, Mus musculus
ggaaaacccagttatcaacacagaa

SEQ ID NO: 580602 - DNA, 25 bp, Mus musculus
ggaaaaccctgaaacattgttacgg

SEQ ID NO: 580603 - DNA, 25 bp, Mus musculus
ggaaaaccctgatacattgttacgg

SEQ ID NO: 580604 - DNA, 25 bp, Mus musculus
ggaaaaccgcagcaacccaggagac

SEQ ID NO: 580605 - DNA, 25 bp, Mus musculus
ggaaaaccgcaggaacccaggagac

SEQ ID NO: 580606 - DNA, 25 bp, Mus musculus
ggaaaaccgggcaagcgtcggctct

SEQ ID NO: 580607 - DNA, 25 bp, Mus musculus
ggaaaaccgggctagcgtcggctct

SEQ ID NO: 580608 - DNA, 25 bp, Mus musculus
ggaaaacctagcaaccagacccaag

SEQ ID NO: 580609 - DNA, 25 bp, Mus musculus
ggaaaacctagctaccagacccaag

SEQ ID NO: 580610 - DNA, 25 bp, Mus musculus
ggaaaacctcttaattgaccaccag

SEQ ID NO: 580611 - DNA, 25 bp, Mus musculus
ggaaaacctctttattgaccaccag

SEQ ID NO: 580612 - DNA, 25 bp, Mus musculus
ggaaaacctgaaactagccatgccc

SEQ ID NO: 580613 - DNA, 25 bp, Mus musculus
ggaaaacctgaatctagccatgccc

SEQ ID NO: 580614 - DNA, 25 bp, Mus musculus
ggaaaacctgctctgggatcgctca

SEQ ID NO: 580615 - DNA, 25 bp, Mus musculus
ggaaaacctgctgtgggatcgctca

SEQ ID NO: 580616 - DNA, 25 bp, Mus musculus
ggaaaacctggaccctgtaaataca

SEQ ID NO: 580617 - DNA, 25 bp, Mus musculus
ggaaaacctggactcttgggataga

SEQ ID NO: 580618 - DNA, 25 bp, Mus musculus
ggaaaacctggagcctgtaaataca

SEQ ID NO: 580619 - DNA, 25 bp, Mus musculus
ggaaaacctggagtcttgggataga

SEQ ID NO: 580620 - DNA, 25 bp, Mus musculus
ggaaaacctgggaaaatgcaagtgt

SEQ ID NO: 580621 - DNA, 25 bp, Mus musculus
ggaaaacctgggagctattgccagt

SEQ ID NO: 580622 - DNA, 25 bp, Mus musculus
ggaaaacctgggtaaatgcaagtgt

SEQ ID NO: 580623 - DNA, 25 bp, Mus musculus
ggaaaacctgggtgctattgccagt

SEQ ID NO: 580624 - DNA, 25 bp, Mus musculus
ggaaaacctgttatctgctatgtta

SEQ ID NO: 580625 - DNA, 25 bp, Mus musculus
ggaaaacctgttttctgctatgtta

SEQ ID NO: 580626 - DNA, 25 bp, Mus musculus
ggaaaaccttcaaccagattggaca

SEQ ID NO: 580627 - DNA, 25 bp, Mus musculus
ggaaaaccttcatccagattggaca

SEQ ID NO: 580628 - DNA, 25 bp, Mus musculus
ggaaaaccttgtccgtcccaggctg

SEQ ID NO: 580629 - DNA, 25 bp, Mus musculus
ggaaaaccttgtgcgtcccaggctg

SEQ ID NO: 580630 - DNA, 25 bp, Mus musculus
ggaaaaccttttctgctgcttctat

SEQ ID NO: 580631 - DNA, 25 bp, Mus musculus
ggaaaaccttttgtgctgcttctat

SEQ ID NO: 580632 - DNA, 25 bp, Mus musculus
ggaaaacgactgagcacaccttctg

SEQ ID NO: 580633 - DNA, 25 bp, Mus musculus
ggaaaacgactgatatccactgcgt

SEQ ID NO: 580634 - DNA, 25 bp, Mus musculus
ggaaaacgactgtgcacaccttctg

SEQ ID NO: 580635 - DNA, 25 bp, Mus musculus
ggaaaacgactgttatccactgcgt

SEQ ID NO: 580636 - DNA, 25 bp, Mus musculus
ggaaaacgacttagccagaggccta

SEQ ID NO: 580637 - DNA, 25 bp, Mus musculus
ggaaaacgactttgccagaggccta

SEQ ID NO: 580638 - DNA, 25 bp, Mus musculus
ggaaaacgcaccaattggacataac

SEQ ID NO: 580639 - DNA, 25 bp, Mus musculus
ggaaaacgcacctattggacataac

SEQ ID NO: 580640 - DNA, 25 bp, Mus musculus
ggaaaacgctgcaaatgtgacattt

SEQ ID NO: 580641 - DNA, 25 bp, Mus musculus
ggaaaacgctgctaatgtgacattt

SEQ ID NO: 580642 - DNA, 25 bp, Mus musculus
ggaaaacgtctaagttcacccaggc

SEQ ID NO: 580643 - DNA, 25 bp, Mus musculus
ggaaaacgtctatgttcacccaggc

SEQ ID NO: 580644 - DNA, 25 bp, Mus musculus
ggaaaactaattcaccggcgtacat

SEQ ID NO: 580645 - DNA, 25 bp, Mus musculus
ggaaaactaattgaccggcgtacat

SEQ ID NO: 580646 - DNA, 25 bp, Mus musculus
ggaaaactagcaagtgggactcact

SEQ ID NO: 580647 - DNA, 25 bp, Mus musculus
ggaaaactagcatgtgggactcact

SEQ ID NO: 580648 - DNA, 25 bp, Mus musculus
ggaaaactatccatgcaagtacaga

SEQ ID NO: 580649 - DNA, 25 bp, Mus musculus
ggaaaactatccttgcaagtacaga

SEQ ID NO: 580650 - DNA, 25 bp, Mus musculus
ggaaaactatgaagtgtgcgcgcgt

SEQ ID NO: 580651 - DNA, 25 bp, Mus musculus
ggaaaactatgatgtgtgcgcgcgt

SEQ ID NO: 580652 - DNA, 25 bp, Mus musculus
ggaaaactcagtcgccaccaaagct

SEQ ID NO: 580653 - DNA, 25 bp, Mus musculus
ggaaaactcagtggccaccaaagct

SEQ ID NO: 580654 - DNA, 25 bp, Mus musculus
ggaaaactccagatcatggttcaag

SEQ ID NO: 580655 - DNA, 25 bp, Mus musculus
ggaaaactccagttcatggttcaag

SEQ ID NO: 580656 - DNA, 25 bp, Mus musculus
ggaaaactcctcacaggactgcata

SEQ ID NO: 580657 - DNA, 25 bp, Mus musculus
ggaaaactcctctcaggactgcata

SEQ ID NO: 580658 - DNA, 25 bp, Mus musculus
ggaaaactcctgcaggtcgccaaag

SEQ ID NO: 580659 - DNA, 25 bp, Mus musculus
ggaaaactcctggaggtcgccaaag

SEQ ID NO: 580660 - DNA, 25 bp, Mus musculus
ggaaaactcgctcaagctgtcatgt

SEQ ID NO: 580661 - DNA, 25 bp, Mus musculus
ggaaaactcgctgaagctgtcatgt

SEQ ID NO: 580662 - DNA, 25 bp, Mus musculus
ggaaaactcggccatccagaaagtg

SEQ ID NO: 580663 - DNA, 25 bp, Mus musculus
ggaaaactcggcgatccagaaagtg

SEQ ID NO: 580664 - DNA, 25 bp, Mus musculus
ggaaaactgaaacaactccttgtat

SEQ ID NO: 580665 - DNA, 25 bp, Mus musculus
ggaaaactgaaactttgcactccag

SEQ ID NO: 580666 - DNA, 25 bp, Mus musculus
ggaaaactgaaagaactccttgtat

SEQ ID NO: 580667 - DNA, 25 bp, Mus musculus
ggaaaactgaaagtttgcactccag

SEQ ID NO: 580668 - DNA, 25 bp, Mus musculus
ggaaaactgcaaactcgctgtttga

SEQ ID NO: 580669 - DNA, 25 bp, Mus musculus
ggaaaactgcaatctcgctgtttga

SEQ ID NO: 580670 - DNA, 25 bp, Mus musculus
ggaaaactgccacaataatgactga

SEQ ID NO: 580671 - DNA, 25 bp, Mus musculus
ggaaaactgccagaataatgactga

SEQ ID NO: 580672 - DNA, 25 bp, Mus musculus
ggaaaactgtttagccatctataat

SEQ ID NO: 580673 - DNA, 25 bp, Mus musculus
ggaaaactgttttgccatctataat

SEQ ID NO: 580674 - DNA, 25 bp, Mus musculus
ggaaaacttcttcgctaggacatca

SEQ ID NO: 580675 - DNA, 25 bp, Mus musculus
ggaaaacttcttctgcattctggaa

SEQ ID NO: 580676 - DNA, 25 bp, Mus musculus
ggaaaacttcttggctaggacatca

SEQ ID NO: 580677 - DNA, 25 bp, Mus musculus
ggaaaacttcttgtgcattctggaa

SEQ ID NO: 580678 - DNA, 25 bp, Mus musculus
ggaaaacttgcacaccctattcaat

SEQ ID NO: 580679 - DNA, 25 bp, Mus musculus
ggaaaacttgcagaccctattcaat

SEQ ID NO: 580680 - DNA, 25 bp, Mus musculus
ggaaaacttgttccaagctccgtga

SEQ ID NO: 580681 - DNA, 25 bp, Mus musculus
ggaaaacttgttgcaagctccgtga

SEQ ID NO: 580682 - DNA, 25 bp, Mus musculus
ggaaaactttacacatgttcatgta

SEQ ID NO: 580683 - DNA, 25 bp, Mus musculus
ggaaaactttactcatgttcatgta

SEQ ID NO: 580684 - DNA, 25 bp, Mus musculus
ggaaaagaaatgaatacctgctcaa

SEQ ID NO: 580685 - DNA, 25 bp, Mus musculus
ggaaaagaaatgtatacctgctcaa

SEQ ID NO: 580686 - DNA, 25 bp, Mus musculus
ggaaaagaactaaatgattcatgta

SEQ ID NO: 580687 - DNA, 25 bp, Mus musculus
ggaaaagaactatatgattcatgta

SEQ ID NO: 580688 - DNA, 25 bp, Mus musculus
ggaaaagacatcactggactctagg

SEQ ID NO: 580689 - DNA, 25 bp, Mus musculus
ggaaaagacatctctggactctagg

SEQ ID NO: 580690 - DNA, 25 bp, Mus musculus
ggaaaagacctcatatgtgtattga

SEQ ID NO: 580691 - DNA, 25 bp, Mus musculus
ggaaaagacctcttatgtgtattga

SEQ ID NO: 580692 - DNA, 25 bp, Mus musculus
ggaaaagacgcaacatttgcctcgt

SEQ ID NO: 580693 - DNA, 25 bp, Mus musculus
ggaaaagacgcatcatttgcctcgt

SEQ ID NO: 580694 - DNA, 25 bp, Mus musculus
ggaaaagacgccatgacctctgaca

SEQ ID NO: 580695 - DNA, 25 bp, Mus musculus
ggaaaagacgccttgacctctgaca

SEQ ID NO: 580696 - DNA, 25 bp, Mus musculus
ggaaaagatacacaccaggcagggc

SEQ ID NO: 580697 - DNA, 25 bp, Mus musculus
ggaaaagatacagaccaggcagggc

SEQ ID NO: 580698 - DNA, 25 bp, Mus musculus
ggaaaagatataccacctgctctag

SEQ ID NO: 580699 - DNA, 25 bp, Mus musculus
ggaaaagatatagcacctgctctag

SEQ ID NO: 580700 - DNA, 25 bp, Mus musculus
ggaaaagcactgatctcctgctcaa

SEQ ID NO: 580701 - DNA, 25 bp, Mus musculus
ggaaaagcactgttctcctgctcaa

SEQ ID NO: 580702 - DNA, 25 bp, Mus musculus
ggaaaagcacttaacgttggcctct

SEQ ID NO: 580703 - DNA, 25 bp, Mus musculus
ggaaaagcactttacgttggcctct

SEQ ID NO: 580704 - DNA, 25 bp, Mus musculus
ggaaaagcagcacgcgggataaact

SEQ ID NO: 580705 - DNA, 25 bp, Mus musculus
ggaaaagcagcaggcgggataaact

SEQ ID NO: 580706 - DNA, 25 bp, Mus musculus
ggaaaagcatctcacctggtggcaa

SEQ ID NO: 580707 - DNA, 25 bp, Mus musculus
ggaaaagcatctgacctggtggcaa

SEQ ID NO: 580708 - DNA, 25 bp, Mus musculus
ggaaaagccagcaccggatgctgct

SEQ ID NO: 580709 - DNA, 25 bp, Mus musculus
ggaaaagccagctccggatgctgct

SEQ ID NO: 580710 - DNA, 25 bp, Mus musculus
ggaaaagccattcaagcctgattat

SEQ ID NO: 580711 - DNA, 25 bp, Mus musculus
ggaaaagccattgaagcctgattat

SEQ ID NO: 580712 - DNA, 25 bp, Mus musculus
ggaaaagcccaccaagcttcaactt

SEQ ID NO: 580713 - DNA, 25 bp, Mus musculus
ggaaaagcccacgaagcttcaactt

SEQ ID NO: 580714 - DNA, 25 bp, Mus musculus
ggaaaagccccaagtgaaaccttat

SEQ ID NO: 580715 - DNA, 25 bp, Mus musculus
ggaaaagccccatgtgaaaccttat

SEQ ID NO: 580716 - DNA, 25 bp, Mus musculus
ggaaaagcccttagatcctatgccc

SEQ ID NO: 580717 - DNA, 25 bp, Mus musculus
ggaaaagccctttgatcctatgccc

SEQ ID NO: 580718 - DNA, 25 bp, Mus musculus
ggaaaagccgctcgcttggtgttac

SEQ ID NO: 580719 - DNA, 25 bp, Mus musculus
ggaaaagccgctggcttggtgttac

SEQ ID NO: 580720 - DNA, 25 bp, Mus musculus
ggaaaagccgttagtctgtcacaca

SEQ ID NO: 580721 - DNA, 25 bp, Mus musculus
ggaaaagccgtttgtctgtcacaca

SEQ ID NO: 580722 - DNA, 25 bp, Mus musculus
ggaaaagcctgaacaacctgtgcca

SEQ ID NO: 580723 - DNA, 25 bp, Mus musculus
ggaaaagcctgatcaacctgtgcca

SEQ ID NO: 580724 - DNA, 25 bp, Mus musculus
ggaaaagcctgtcgactttcttgtc

SEQ ID NO: 580725 - DNA, 25 bp, Mus musculus
ggaaaagcctgtggactttcttgtc

SEQ ID NO: 580726 - DNA, 25 bp, Mus musculus
ggaaaagccttccattcttactcaa

SEQ ID NO: 580727 - DNA, 25 bp, Mus musculus
ggaaaagccttcgattcttactcaa

SEQ ID NO: 580728 - DNA, 25 bp, Mus musculus
ggaaaagcgtgccataactctctgc

SEQ ID NO: 580729 - DNA, 25 bp, Mus musculus
ggaaaagcgtgcgataactctctgc

SEQ ID NO: 580730 - DNA, 25 bp, Mus musculus
ggaaaagcgtgtattggcacctctc

SEQ ID NO: 580731 - DNA, 25 bp, Mus musculus
ggaaaagcgtgttttggcacctctc

SEQ ID NO: 580732 - DNA, 25 bp, Mus musculus
ggaaaagctatcaacactgctcctg

SEQ ID NO: 580733 - DNA, 25 bp, Mus musculus
ggaaaagctatctacactgctcctg

SEQ ID NO: 580734 - DNA, 25 bp, Mus musculus
ggaaaagctatgaccatggtcccac

SEQ ID NO: 580735 - DNA, 25 bp, Mus musculus
ggaaaagctatgtccatggtcccac

SEQ ID NO: 580736 - DNA, 25 bp, Mus musculus
ggaaaagctcaacaagccctccaag

SEQ ID NO: 580737 - DNA, 25 bp, Mus musculus
ggaaaagctcaagaagccctccaag

SEQ ID NO: 580738 - DNA, 25 bp, Mus musculus
ggaaaagctctaaaactcatgggta

SEQ ID NO: 580739 - DNA, 25 bp, Mus musculus
ggaaaagctctataactcatgggta

SEQ ID NO: 580740 - DNA, 25 bp, Mus musculus
ggaaaagctctcatctgccagtgcc

SEQ ID NO: 580741 - DNA, 25 bp, Mus musculus
ggaaaagctctcttctgccagtgcc

SEQ ID NO: 580742 - DNA, 25 bp, Mus musculus
ggaaaagctcttacttgggttctgt

SEQ ID NO: 580743 - DNA, 25 bp, Mus musculus
ggaaaagctctttcttgggttctgt

SEQ ID NO: 580744 - DNA, 25 bp, Mus musculus
ggaaaagctgtgacgcctggtgtaa

SEQ ID NO: 580745 - DNA, 25 bp, Mus musculus
ggaaaagctgtgtcgcctggtgtaa

SEQ ID NO: 580746 - DNA, 25 bp, Mus musculus
ggaaaagcttcaagagcagcccctc

SEQ ID NO: 580747 - DNA, 25 bp, Mus musculus
ggaaaagcttcatgagcagcccctc

SEQ ID NO: 580748 - DNA, 25 bp, Mus musculus
ggaaaagctttgcttcctacaaaca

SEQ ID NO: 580749 - DNA, 25 bp, Mus musculus
ggaaaagctttggttcctacaaaca

SEQ ID NO: 580750 - DNA, 25 bp, Mus musculus
ggaaaaggaagtctttcctgtatgg

SEQ ID NO: 580751 - DNA, 25 bp, Mus musculus
ggaaaaggaagtgtttcctgtatgg

SEQ ID NO: 580752 - DNA, 25 bp, Mus musculus
ggaaaaggacgcacagcatctgatg

SEQ ID NO: 580753 - DNA, 25 bp, Mus musculus
ggaaaaggacgctcagcatctgatg

SEQ ID NO: 580754 - DNA, 25 bp, Mus musculus
ggaaaaggcaggcatttgctttgaa

SEQ ID NO: 580755 - DNA, 25 bp, Mus musculus
ggaaaaggcagggatttgctttgaa

SEQ ID NO: 580756 - DNA, 25 bp, Mus musculus
ggaaaaggcttaagcctactcctcc

SEQ ID NO: 580757 - DNA, 25 bp, Mus musculus
ggaaaaggcttatgcctactcctcc

SEQ ID NO: 580758 - DNA, 25 bp, Mus musculus
ggaaaagggcttaaatgcacggtgc

SEQ ID NO: 580759 - DNA, 25 bp, Mus musculus
ggaaaagggctttaatgcacggtgc

SEQ ID NO: 580760 - DNA, 25 bp, Mus musculus
ggaaaaggtcctacctattgcctat

SEQ ID NO: 580761 - DNA, 25 bp, Mus musculus
ggaaaaggtccttcctattgcctat

SEQ ID NO: 580762 - DNA, 25 bp, Mus musculus
ggaaaaggtgccctagctccagatt

SEQ ID NO: 580763 - DNA, 25 bp, Mus musculus
ggaaaaggtgccgtagctccagatt

SEQ ID NO: 580764 - DNA, 25 bp, Mus musculus
ggaaaagtacacctaagtggcataa

SEQ ID NO: 580765 - DNA, 25 bp, Mus musculus
ggaaaagtacacgtaagtggcataa

SEQ ID NO: 580766 - DNA, 25 bp, Mus musculus
ggaaaagtacctcttctctatcact

SEQ ID NO: 580767 - DNA, 25 bp, Mus musculus
ggaaaagtacctgttctctatcact

SEQ ID NO: 580768 - DNA, 25 bp, Mus musculus
ggaaaagtagccaccacacttcagg

SEQ ID NO: 580769 - DNA, 25 bp, Mus musculus
ggaaaagtagcctccacacttcagg

SEQ ID NO: 580770 - DNA, 25 bp, Mus musculus
ggaaaagtattccatagtatttgtt

SEQ ID NO: 580771 - DNA, 25 bp, Mus musculus
ggaaaagtattcgatagtatttgtt

SEQ ID NO: 580772 - DNA, 25 bp, Mus musculus
ggaaaagtcgggacctcggagctca

SEQ ID NO: 580773 - DNA, 25 bp, Mus musculus
ggaaaagtcgggtcctcggagctca

SEQ ID NO: 580774 - DNA, 25 bp, Mus musculus
ggaaaagtctgcaaagggatgcttc

SEQ ID NO: 580775 - DNA, 25 bp, Mus musculus
ggaaaagtctgccttcctgaaggtg

SEQ ID NO: 580776 - DNA, 25 bp, Mus musculus
ggaaaagtctgcgttcctgaaggtg

SEQ ID NO: 580777 - DNA, 25 bp, Mus musculus
ggaaaagtctgctaagggatgcttc

SEQ ID NO: 580778 - DNA, 25 bp, Mus musculus
ggaaaagtgaccaaccctgccaagt

SEQ ID NO: 580779 - DNA, 25 bp, Mus musculus
ggaaaagtgacctaccctgccaagt

SEQ ID NO: 580780 - DNA, 25 bp, Mus musculus
ggaaaagtgccaatcgaacacctaa

SEQ ID NO: 580781 - DNA, 25 bp, Mus musculus
ggaaaagtgccaccgctgccgagca

SEQ ID NO: 580782 - DNA, 25 bp, Mus musculus
ggaaaagtgccagcgctgccgagca

SEQ ID NO: 580783 - DNA, 25 bp, Mus musculus
ggaaaagtgccattcgaacacctaa

SEQ ID NO: 580784 - DNA, 25 bp, Mus musculus
ggaaaagtgccgctgcctgtgcctc

SEQ ID NO: 580785 - DNA, 25 bp, Mus musculus
ggaaaagtgccggtgcctgtgcctc

SEQ ID NO: 580786 - DNA, 25 bp, Mus musculus
ggaaaagtgcgaactggctaggcta

SEQ ID NO: 580787 - DNA, 25 bp, Mus musculus
ggaaaagtgcgatctggctaggcta

SEQ ID NO: 580788 - DNA, 25 bp, Mus musculus
ggaaaagtgtccatctgtttctcgg

SEQ ID NO: 580789 - DNA, 25 bp, Mus musculus
ggaaaagtgtccttctgtttctcgg

SEQ ID NO: 580790 - DNA, 25 bp, Mus musculus
ggaaaagtgtgcaaggcccctgcct

SEQ ID NO: 580791 - DNA, 25 bp, Mus musculus
ggaaaagtgtgctaggcccctgcct

SEQ ID NO: 580792 - DNA, 25 bp, Mus musculus
ggaaaagttagactgccagctggat

SEQ ID NO: 580793 - DNA, 25 bp, Mus musculus
ggaaaagttagagtgccagctggat

SEQ ID NO: 580794 - DNA, 25 bp, Mus musculus
ggaaaagttcatacaagctaggttt

SEQ ID NO: 580795 - DNA, 25 bp, Mus musculus
ggaaaagttcattcaagctaggttt

SEQ ID NO: 580796 - DNA, 25 bp, Mus musculus
ggaaaagttccacgtcctcgtgtat

SEQ ID NO: 580797 - DNA, 25 bp, Mus musculus
ggaaaagttccaggtcctcgtgtat

SEQ ID NO: 580798 - DNA, 25 bp, Mus musculus
ggaaaagttcccctgtcaatggcaa

SEQ ID NO: 580799 - DNA, 25 bp, Mus musculus
ggaaaagttcccgtgtcaatggcaa

SEQ ID NO: 580800 - DNA, 25 bp, Mus musculus
ggaaaagttccgatgtgacacactt

SEQ ID NO: 580801 - DNA, 25 bp, Mus musculus
ggaaaagttccgttgtgacacactt

SEQ ID NO: 580802 - DNA, 25 bp, Mus musculus
ggaaaagttggccacaaagtgctaa

SEQ ID NO: 580803 - DNA, 25 bp, Mus musculus
ggaaaagttggcgacaaagtgctaa

SEQ ID NO: 580804 - DNA, 25 bp, Mus musculus
ggaaaatacaagcagcattcagctg

SEQ ID NO: 580805 - DNA, 25 bp, Mus musculus
ggaaaatacaaggagcattcagctg

SEQ ID NO: 580806 - DNA, 25 bp, Mus musculus
ggaaaatacatcacttctggcttga

SEQ ID NO: 580807 - DNA, 25 bp, Mus musculus
ggaaaatacatctcttctggcttga

SEQ ID NO: 580808 - DNA, 25 bp, Mus musculus
ggaaaatactcaatcagacttggaa

SEQ ID NO: 580809 - DNA, 25 bp, Mus musculus
ggaaaatactcattcagacttggaa

SEQ ID NO: 580810 - DNA, 25 bp, Mus musculus
ggaaaatatactccccaaatatgcc

SEQ ID NO: 580811 - DNA, 25 bp, Mus musculus
ggaaaatatactgcccaaatatgcc

SEQ ID NO: 580812 - DNA, 25 bp, Mus musculus
ggaaaatatcctctgtgctcttaat

SEQ ID NO: 580813 - DNA, 25 bp, Mus musculus
ggaaaatatcctgtgtgctcttaat

SEQ ID NO: 580814 - DNA, 25 bp, Mus musculus
ggaaaatattagctgcctccaccta

SEQ ID NO: 580815 - DNA, 25 bp, Mus musculus
ggaaaatattaggtgcctccaccta

SEQ ID NO: 580816 - DNA, 25 bp, Mus musculus
ggaaaatattccacccttattgttg

SEQ ID NO: 580817 - DNA, 25 bp, Mus musculus
ggaaaatattcctcccttattgttg

SEQ ID NO: 580818 - DNA, 25 bp, Mus musculus
ggaaaatattgcacgttctaactgt

SEQ ID NO: 580819 - DNA, 25 bp, Mus musculus
ggaaaatattgctcgttctaactgt

SEQ ID NO: 580820 - DNA, 25 bp, Mus musculus
ggaaaatcaacccaacatgccaccg

SEQ ID NO: 580821 - DNA, 25 bp, Mus musculus
ggaaaatcaaccgaacatgccaccg

SEQ ID NO: 580822 - DNA, 25 bp, Mus musculus
ggaaaatcaactaaacatgggcaaa

SEQ ID NO: 580823 - DNA, 25 bp, Mus musculus
ggaaaatcaacttaacatgggcaaa

SEQ ID NO: 580824 - DNA, 25 bp, Mus musculus
ggaaaatcaagcaccttggcatggt

SEQ ID NO: 580825 - DNA, 25 bp, Mus musculus
ggaaaatcaagctccttggcatggt

SEQ ID NO: 580826 - DNA, 25 bp, Mus musculus
ggaaaatcacagcaggaacctggag

SEQ ID NO: 580827 - DNA, 25 bp, Mus musculus
ggaaaatcacaggaggaacctggag

SEQ ID NO: 580828 - DNA, 25 bp, Mus musculus
ggaaaatcacttactgggtgttgga

SEQ ID NO: 580829 - DNA, 25 bp, Mus musculus
ggaaaatcactttctgggtgttgga

SEQ ID NO: 580830 - DNA, 25 bp, Mus musculus
ggaaaatcatgccttatcactagta

SEQ ID NO: 580831 - DNA, 25 bp, Mus musculus
ggaaaatcatgcgttatcactagta

SEQ ID NO: 580832 - DNA, 25 bp, Mus musculus
ggaaaatcattaagtccagataact

SEQ ID NO: 580833 - DNA, 25 bp, Mus musculus
ggaaaatcattatgtccagataact

SEQ ID NO: 580834 - DNA, 25 bp, Mus musculus
ggaaaatccaccactcacgggcaag

SEQ ID NO: 580835 - DNA, 25 bp, Mus musculus
ggaaaatccacctctcacgggcaag

SEQ ID NO: 580836 - DNA, 25 bp, Mus musculus
ggaaaatccagccaagcaccatcta

SEQ ID NO: 580837 - DNA, 25 bp, Mus musculus
ggaaaatccagcgaagcaccatcta

SEQ ID NO: 580838 - DNA, 25 bp, Mus musculus
ggaaaatcccggaggatcaggtgga

SEQ ID NO: 580839 - DNA, 25 bp, Mus musculus
ggaaaatcccggtggatcaggtgga

SEQ ID NO: 580840 - DNA, 25 bp, Mus musculus
ggaaaatccctcattcatgatatca

SEQ ID NO: 580841 - DNA, 25 bp, Mus musculus
ggaaaatccctctttcatgatatca

SEQ ID NO: 580842 - DNA, 25 bp, Mus musculus
ggaaaatcctcaaaatcaccctctg

SEQ ID NO: 580843 - DNA, 25 bp, Mus musculus
ggaaaatcctcataatcaccctctg

SEQ ID NO: 580844 - DNA, 25 bp, Mus musculus
ggaaaatcgacacaggagggaccaa

SEQ ID NO: 580845 - DNA, 25 bp, Mus musculus
ggaaaatcgacagaggagggaccaa

SEQ ID NO: 580846 - DNA, 25 bp, Mus musculus
ggaaaatcgaccattgaactgctgt

SEQ ID NO: 580847 - DNA, 25 bp, Mus musculus
ggaaaatcgacctttgaactgctgt

SEQ ID NO: 580848 - DNA, 25 bp, Mus musculus
ggaaaatcgccccattgagacatac

SEQ ID NO: 580849 - DNA, 25 bp, Mus musculus
ggaaaatcgcccgattgagacatac

SEQ ID NO: 580850 - DNA, 25 bp, Mus musculus
ggaaaatcgcttctttagtgaccat

SEQ ID NO: 580851 - DNA, 25 bp, Mus musculus
ggaaaatcgcttgtttagtgaccat

SEQ ID NO: 580852 - DNA, 25 bp, Mus musculus
ggaaaatctccacatgctacccgag

SEQ ID NO: 580853 - DNA, 25 bp, Mus musculus
ggaaaatctccagatgctacccgag

SEQ ID NO: 580854 - DNA, 25 bp, Mus musculus
ggaaaatctcggacattgttacagt

SEQ ID NO: 580855 - DNA, 25 bp, Mus musculus
ggaaaatctcggtcattgttacagt

SEQ ID NO: 580856 - DNA, 25 bp, Mus musculus
ggaaaatctgacagcacccgctgaa

SEQ ID NO: 580857 - DNA, 25 bp, Mus musculus
ggaaaatctgactgcacccgctgaa

SEQ ID NO: 580858 - DNA, 25 bp, Mus musculus
ggaaaatctgtacattgttcacctt

SEQ ID NO: 580859 - DNA, 25 bp, Mus musculus
ggaaaatctgtagattgttcacctt

SEQ ID NO: 580860 - DNA, 25 bp, Mus musculus
ggaaaatctttcagcagtagttttt

SEQ ID NO: 580861 - DNA, 25 bp, Mus musculus
ggaaaatctttctgcagtagttttt

SEQ ID NO: 580862 - DNA, 25 bp, Mus musculus
ggaaaatgaatcctactcaggcgga

SEQ ID NO: 580863 - DNA, 25 bp, Mus musculus
ggaaaatgaatcgtactcaggcgga

SEQ ID NO: 580864 - DNA, 25 bp, Mus musculus
ggaaaatgacgaacctgcccctgcg

SEQ ID NO: 580865 - DNA, 25 bp, Mus musculus
ggaaaatgacgatcctgcccctgcg

SEQ ID NO: 580866 - DNA, 25 bp, Mus musculus
ggaaaatgagcgcaccagcctggta

SEQ ID NO: 580867 - DNA, 25 bp, Mus musculus
ggaaaatgagcggaccagcctggta

SEQ ID NO: 580868 - DNA, 25 bp, Mus musculus
ggaaaatgagctctgcccggagggt

SEQ ID NO: 580869 - DNA, 25 bp, Mus musculus
ggaaaatgagctgtgcccggagggt

SEQ ID NO: 580870 - DNA, 25 bp, Mus musculus
ggaaaatgccacagctaacacgata

SEQ ID NO: 580871 - DNA, 25 bp, Mus musculus
ggaaaatgccactgctaacacgata

SEQ ID NO: 580872 - DNA, 25 bp, Mus musculus
ggaaaatgcccacccagctcgaaag

SEQ ID NO: 580873 - DNA, 25 bp, Mus musculus
ggaaaatgcccagccagctcgaaag

SEQ ID NO: 580874 - DNA, 25 bp, Mus musculus
ggaaaatgccctaagtccagtctca

SEQ ID NO: 580875 - DNA, 25 bp, Mus musculus
ggaaaatgcccttagtccagtctca

SEQ ID NO: 580876 - DNA, 25 bp, Mus musculus
ggaaaatgcggtacatctcaggaat

SEQ ID NO: 580877 - DNA, 25 bp, Mus musculus
ggaaaatgcggttcatctcaggaat

SEQ ID NO: 580878 - DNA, 25 bp, Mus musculus
ggaaaatgctgcatccacttctggt

SEQ ID NO: 580879 - DNA, 25 bp, Mus musculus
ggaaaatgctgcttccacttctggt

SEQ ID NO: 580880 - DNA, 25 bp, Mus musculus
ggaaaatggtatctctctcttgtat

SEQ ID NO: 580881 - DNA, 25 bp, Mus musculus
ggaaaatggtatgtctctcttgtat

SEQ ID NO: 580882 - DNA, 25 bp, Mus musculus
ggaaaatggtcaaccagcccagcag

SEQ ID NO: 580883 - DNA, 25 bp, Mus musculus
ggaaaatggtcatccagcccagcag

SEQ ID NO: 580884 - DNA, 25 bp, Mus musculus
ggaaaatgtctgagatcatcccggg

SEQ ID NO: 580885 - DNA, 25 bp, Mus musculus
ggaaaatgtctgtgatcatcccggg

SEQ ID NO: 580886 - DNA, 25 bp, Mus musculus
ggaaaatgtgctaagcagcttcata

SEQ ID NO: 580887 - DNA, 25 bp, Mus musculus
ggaaaatgtgcttagcagcttcata

SEQ ID NO: 580888 - DNA, 25 bp, Mus musculus
ggaaaatgtggtagcagtctgctgc

SEQ ID NO: 580889 - DNA, 25 bp, Mus musculus
ggaaaatgtggttgcagtctgctgc

SEQ ID NO: 580890 - DNA, 25 bp, Mus musculus
ggaaaattcctgcttgccggtgtct

SEQ ID NO: 580891 - DNA, 25 bp, Mus musculus
ggaaaattcctggttgccggtgtct

SEQ ID NO: 580892 - DNA, 25 bp, Mus musculus
ggaaaattcttacggctgctcttct

SEQ ID NO: 580893 - DNA, 25 bp, Mus musculus
ggaaaattcttagggctgctcttct

SEQ ID NO: 580894 - DNA, 25 bp, Mus musculus
ggaaaattcttcagcatctctttgt

SEQ ID NO: 580895 - DNA, 25 bp, Mus musculus
ggaaaattcttctgcatctctttgt

SEQ ID NO: 580896 - DNA, 25 bp, Mus musculus
ggaaaattgataccccacaagtaga

SEQ ID NO: 580897 - DNA, 25 bp, Mus musculus
ggaaaattgatagcccacaagtaga

SEQ ID NO: 580898 - DNA, 25 bp, Mus musculus
ggaaaattgttgctaatacattcac

SEQ ID NO: 580899 - DNA, 25 bp, Mus musculus
ggaaaattgttggtaatacattcac

SEQ ID NO: 580900 - DNA, 25 bp, Mus musculus
ggaaaatttcccatcaggtcaacat

SEQ ID NO: 580901 - DNA, 25 bp, Mus musculus
ggaaaatttcccttcaggtcaacat

SEQ ID NO: 580902 - DNA, 25 bp, Mus musculus
ggaaaattttccatcgatcctcaca

SEQ ID NO: 580903 - DNA, 25 bp, Mus musculus
ggaaaattttccttcgatcctcaca

SEQ ID NO: 580904 - DNA, 25 bp, Mus musculus
ggaaacaaaaacacgctgctgtcct

SEQ ID NO: 580905 - DNA, 25 bp, Mus musculus
ggaaacaaaaactcgctgctgtcct

SEQ ID NO: 580906 - DNA, 25 bp, Mus musculus
ggaaacaaaagcctcttctctgtaa

SEQ ID NO: 580907 - DNA, 25 bp, Mus musculus
ggaaacaaaagcgtcttctctgtaa

SEQ ID NO: 580908 - DNA, 25 bp, Mus musculus
ggaaacaaacaaattcttgctattt

SEQ ID NO: 580909 - DNA, 25 bp, Mus musculus
ggaaacaaacaatttcttgctattt

SEQ ID NO: 580910 - DNA, 25 bp, Mus musculus
ggaaacaaactccagtccctgacaa

SEQ ID NO: 580911 - DNA, 25 bp, Mus musculus
ggaaacaaactcgagtccctgacaa

SEQ ID NO: 580912 - DNA, 25 bp, Mus musculus
ggaaacaaagcacaaaccccatatt

SEQ ID NO: 580913 - DNA, 25 bp, Mus musculus
ggaaacaaagcagaaaccccatatt

SEQ ID NO: 580914 - DNA, 25 bp, Mus musculus
ggaaacaaatgtctctacctgaagc

SEQ ID NO: 580915 - DNA, 25 bp, Mus musculus
ggaaacaaatgtgtctacctgaagc

SEQ ID NO: 580916 - DNA, 25 bp, Mus musculus
ggaaacaaccgcagccctagcgaat

SEQ ID NO: 580917 - DNA, 25 bp, Mus musculus
ggaaacaaccgctgccctagcgaat

SEQ ID NO: 580918 - DNA, 25 bp, Mus musculus
ggaaacaacctccagtgcttgcaac

SEQ ID NO: 580919 - DNA, 25 bp, Mus musculus
ggaaacaacctcgagtgcttgcaac

SEQ ID NO: 580920 - DNA, 25 bp, Mus musculus
ggaaacaacggtcctgggaccttgt

SEQ ID NO: 580921 - DNA, 25 bp, Mus musculus
ggaaacaacggtgctgggaccttgt

SEQ ID NO: 580922 - DNA, 25 bp, Mus musculus
ggaaacaactacaccatcgagctgg

SEQ ID NO: 580923 - DNA, 25 bp, Mus musculus
ggaaacaactactccatcgagctgg

SEQ ID NO: 580924 - DNA, 25 bp, Mus musculus
ggaaacaagcccagagcaagcacag

SEQ ID NO: 580925 - DNA, 25 bp, Mus musculus
ggaaacaagccctgagcaagcacag

SEQ ID NO: 580926 - DNA, 25 bp, Mus musculus
ggaaacaataacctgggcccttgtg

SEQ ID NO: 580927 - DNA, 25 bp, Mus musculus
ggaaacaataacgtgggcccttgtg

SEQ ID NO: 580928 - DNA, 25 bp, Mus musculus
ggaaacaatcagcttcctgacacct

SEQ ID NO: 580929 - DNA, 25 bp, Mus musculus
ggaaacaatcaggttcctgacacct

SEQ ID NO: 580930 - DNA, 25 bp, Mus musculus
ggaaacaatccaaatgcaactgaag

SEQ ID NO: 580931 - DNA, 25 bp, Mus musculus
ggaaacaatccatatgcaactgaag

SEQ ID NO: 580932 - DNA, 25 bp, Mus musculus
ggaaacaattacactgaatgtggat

SEQ ID NO: 580933 - DNA, 25 bp, Mus musculus
ggaaacaattactctgaatgtggat

SEQ ID NO: 580934 - DNA, 25 bp, Mus musculus
ggaaacaattctcttggttatttgt

SEQ ID NO: 580935 - DNA, 25 bp, Mus musculus
ggaaacaattctgttggttatttgt

SEQ ID NO: 580936 - DNA, 25 bp, Mus musculus
ggaaacaatttcacgttcttcttag

SEQ ID NO: 580937 - DNA, 25 bp, Mus musculus
ggaaacaatttctcgttcttcttag

SEQ ID NO: 580938 - DNA, 25 bp, Mus musculus
ggaaacacaaacacctcctaagaag

SEQ ID NO: 580939 - DNA, 25 bp, Mus musculus
ggaaacacaaactcctcctaagaag

SEQ ID NO: 580940 - DNA, 25 bp, Mus musculus
ggaaacacaaccagtcagcacagtg

SEQ ID NO: 580941 - DNA, 25 bp, Mus musculus
ggaaacacaacctgtcagcacagtg

SEQ ID NO: 580942 - DNA, 25 bp, Mus musculus
ggaaacacaccaaggaaactgtaat

SEQ ID NO: 580943 - DNA, 25 bp, Mus musculus
ggaaacacaccatggaaactgtaat

SEQ ID NO: 580944 - DNA, 25 bp, Mus musculus
ggaaacacaggtattgtcatgaaac

SEQ ID NO: 580945 - DNA, 25 bp, Mus musculus
ggaaacacaggttttgtcatgaaac

SEQ ID NO: 580946 - DNA, 25 bp, Mus musculus
ggaaacacattgattgtgaactgga

SEQ ID NO: 580947 - DNA, 25 bp, Mus musculus
ggaaacacattgtttgtgaactgga

SEQ ID NO: 580948 - DNA, 25 bp, Mus musculus
ggaaacaccacgcattggctagtat

SEQ ID NO: 580949 - DNA, 25 bp, Mus musculus
ggaaacaccacggattggctagtat

SEQ ID NO: 580950 - DNA, 25 bp, Mus musculus
ggaaacaccactcatcctgtaacat

SEQ ID NO: 580951 - DNA, 25 bp, Mus musculus
ggaaacaccactgatcctgtaacat

SEQ ID NO: 580952 - DNA, 25 bp, Mus musculus
ggaaacaccaggcacaccattacct

SEQ ID NO: 580953 - DNA, 25 bp, Mus musculus
ggaaacaccagggacaccattacct

SEQ ID NO: 580954 - DNA, 25 bp, Mus musculus
ggaaacaccattctccagaatcttt

SEQ ID NO: 580955 - DNA, 25 bp, Mus musculus
ggaaacaccattgtccagaatcttt

SEQ ID NO: 580956 - DNA, 25 bp, Mus musculus
ggaaacacctcaagagctttgcttt

SEQ ID NO: 580957 - DNA, 25 bp, Mus musculus
ggaaacacctcatgagctttgcttt

SEQ ID NO: 580958 - DNA, 25 bp, Mus musculus
ggaaacacctttctaagcatgcaga

SEQ ID NO: 580959 - DNA, 25 bp, Mus musculus
ggaaacacctttgtaagcatgcaga

SEQ ID NO: 580960 - DNA, 25 bp, Mus musculus
ggaaacacgcccatgttgagagtga

SEQ ID NO: 580961 - DNA, 25 bp, Mus musculus
ggaaacacgcccttgttgagagtga

SEQ ID NO: 580962 - DNA, 25 bp, Mus musculus
ggaaacacggagatgaagctatttt

SEQ ID NO: 580963 - DNA, 25 bp, Mus musculus
ggaaacacggagttgaagctatttt

SEQ ID NO: 580964 - DNA, 25 bp, Mus musculus
ggaaacacggtgcacagcaggtata

SEQ ID NO: 580965 - DNA, 25 bp, Mus musculus
ggaaacacggtggacagcaggtata

SEQ ID NO: 580966 - DNA, 25 bp, Mus musculus
ggaaacactataagcaagtctctta

SEQ ID NO: 580967 - DNA, 25 bp, Mus musculus
ggaaacactatatgcaagtctctta

SEQ ID NO: 580968 - DNA, 25 bp, Mus musculus
ggaaacactattacgtagctcaaat

SEQ ID NO: 580969 - DNA, 25 bp, Mus musculus
ggaaacactatttcgtagctcaaat

SEQ ID NO: 580970 - DNA, 25 bp, Mus musculus
ggaaacactcagacaccctcgacaa

SEQ ID NO: 580971 - DNA, 25 bp, Mus musculus
ggaaacactcagtcaccctcgacaa

SEQ ID NO: 580972 - DNA, 25 bp, Mus musculus
ggaaacactcatccgtgcactaagg

SEQ ID NO: 580973 - DNA, 25 bp, Mus musculus
ggaaacactcatgcgtgcactaagg

SEQ ID NO: 580974 - DNA, 25 bp, Mus musculus
ggaaacactctgcagaaattctgag

SEQ ID NO: 580975 - DNA, 25 bp, Mus musculus
ggaaacactctggagaaattctgag

SEQ ID NO: 580976 - DNA, 25 bp, Mus musculus
ggaaacactgacatttatccagttc

SEQ ID NO: 580977 - DNA, 25 bp, Mus musculus
ggaaacactgacttttatccagttc

SEQ ID NO: 580978 - DNA, 25 bp, Mus musculus
ggaaacactgcgatatagttctttt

SEQ ID NO: 580979 - DNA, 25 bp, Mus musculus
ggaaacactgcgttatagttctttt

SEQ ID NO: 580980 - DNA, 25 bp, Mus musculus
ggaaacactgctacaaaccacgagt

SEQ ID NO: 580981 - DNA, 25 bp, Mus musculus
ggaaacactgcttcaaaccacgagt

SEQ ID NO: 580982 - DNA, 25 bp, Mus musculus
ggaaacacttatactctttaggtat

SEQ ID NO: 580983 - DNA, 25 bp, Mus musculus
ggaaacacttattctctttaggtat

SEQ ID NO: 580984 - DNA, 25 bp, Mus musculus
ggaaacactttccagttcaagacta

SEQ ID NO: 580985 - DNA, 25 bp, Mus musculus
ggaaacactttcgagttcaagacta

SEQ ID NO: 580986 - DNA, 25 bp, Mus musculus
ggaaacacttttccagatacatcta

SEQ ID NO: 580987 - DNA, 25 bp, Mus musculus
ggaaacacttttgcagatacatcta

SEQ ID NO: 580988 - DNA, 25 bp, Mus musculus
ggaaacagacacatagaggcgagat

SEQ ID NO: 580989 - DNA, 25 bp, Mus musculus
ggaaacagacacttagaggcgagat

SEQ ID NO: 580990 - DNA, 25 bp, Mus musculus
ggaaacagacatcagcatgggcaaa

SEQ ID NO: 580991 - DNA, 25 bp, Mus musculus
ggaaacagacatgagcatgggcaaa

SEQ ID NO: 580992 - DNA, 25 bp, Mus musculus
ggaaacagactgacacatggaaatc

SEQ ID NO: 580993 - DNA, 25 bp, Mus musculus
ggaaacagactgtcacatggaaatc

SEQ ID NO: 580994 - DNA, 25 bp, Mus musculus
ggaaacagagccctcctgctggcca

SEQ ID NO: 580995 - DNA, 25 bp, Mus musculus
ggaaacagagccgtcctgctggcca

SEQ ID NO: 580996 - DNA, 25 bp, Mus musculus
ggaaacagaggccaccacagcgtgt

SEQ ID NO: 580997 - DNA, 25 bp, Mus musculus
ggaaacagaggcgaccacagcgtgt

SEQ ID NO: 580998 - DNA, 25 bp, Mus musculus
ggaaacagcacaacgtcgttttggg

SEQ ID NO: 580999 - DNA, 25 bp, Mus musculus
ggaaacagcacatcgtcgttttggg

SEQ ID NO: 581000 - DNA, 25 bp, Mus musculus
ggaaacagcatcatctgcaatacca

SEQ ID NO: 581001 - DNA, 25 bp, Mus musculus
ggaaacagcatcttctgcaatacca

SEQ ID NO: 581002 - DNA, 25 bp, Mus musculus
ggaaacagccagagtcaacctctga

SEQ ID NO: 581003 - DNA, 25 bp, Mus musculus
ggaaacagccagtgtcaacctctga

SEQ ID NO: 581004 - DNA, 25 bp, Mus musculus
ggaaacagcccactctcaaaaggtt

SEQ ID NO: 581005 - DNA, 25 bp, Mus musculus
ggaaacagcccagtctcaaaaggtt

SEQ ID NO: 581006 - DNA, 25 bp, Mus musculus
ggaaacagcctcactcaaatctgaa

SEQ ID NO: 581007 - DNA, 25 bp, Mus musculus
ggaaacagcctctctcaaatctgaa

SEQ ID NO: 581008 - DNA, 25 bp, Mus musculus
ggaaacagcggcacttcgtcatcaa

SEQ ID NO: 581009 - DNA, 25 bp, Mus musculus
ggaaacagcggctcttcgtcatcaa

SEQ ID NO: 581010 - DNA, 25 bp, Mus musculus
ggaaacaggaagagcccagcttgat

SEQ ID NO: 581011 - DNA, 25 bp, Mus musculus
ggaaacaggaagtgcccagcttgat

SEQ ID NO: 581012 - DNA, 25 bp, Mus musculus
ggaaacaggctgctacagtgtacaa

SEQ ID NO: 581013 - DNA, 25 bp, Mus musculus
ggaaacaggctggtacagtgtacaa

SEQ ID NO: 581014 - DNA, 25 bp, Mus musculus
ggaaacagtaggatcagacatacaa

SEQ ID NO: 581015 - DNA, 25 bp, Mus musculus
ggaaacagtaggttcagacatacaa

SEQ ID NO: 581016 - DNA, 25 bp, Mus musculus
ggaaacagtcatatgtcagccacat

SEQ ID NO: 581017 - DNA, 25 bp, Mus musculus
ggaaacagtcatttgtcagccacat

SEQ ID NO: 581018 - DNA, 25 bp, Mus musculus
ggaaacagtgttactgtcctgaata

SEQ ID NO: 581019 - DNA, 25 bp, Mus musculus
ggaaacagtgtttctgtcctgaata

SEQ ID NO: 581020 - DNA, 25 bp, Mus musculus
ggaaacagttgacattattgcacat

SEQ ID NO: 581021 - DNA, 25 bp, Mus musculus
ggaaacagttgagattattgcacat

SEQ ID NO: 581022 - DNA, 25 bp, Mus musculus
ggaaacagttggctcaagcctgcat

SEQ ID NO: 581023 - DNA, 25 bp, Mus musculus
ggaaacagttgggtcaagcctgcat

SEQ ID NO: 581024 - DNA, 25 bp, Mus musculus
ggaaacagtttcaccatctctgtta

SEQ ID NO: 581025 - DNA, 25 bp, Mus musculus
ggaaacagtttctccatctctgtta

SEQ ID NO: 581026 - DNA, 25 bp, Mus musculus
ggaaacagttttctacctgagtagt

SEQ ID NO: 581027 - DNA, 25 bp, Mus musculus
ggaaacagttttgtacctgagtagt

SEQ ID NO: 581028 - DNA, 25 bp, Mus musculus
ggaaacataacaacggtggctcaat

SEQ ID NO: 581029 - DNA, 25 bp, Mus musculus
ggaaacataacatcggtggctcaat

SEQ ID NO: 581030 - DNA, 25 bp, Mus musculus
ggaaacataaccctggactgactga

SEQ ID NO: 581031 - DNA, 25 bp, Mus musculus
ggaaacataaccgtggactgactga

SEQ ID NO: 581032 - DNA, 25 bp, Mus musculus
ggaaacataatcacacgcttcttgt

SEQ ID NO: 581033 - DNA, 25 bp, Mus musculus
ggaaacataatctcacgcttcttgt

SEQ ID NO: 581034 - DNA, 25 bp, Mus musculus
ggaaacataccaaacatacctcaaa

SEQ ID NO: 581035 - DNA, 25 bp, Mus musculus
ggaaacataccatacatacctcaaa

SEQ ID NO: 581036 - DNA, 25 bp, Mus musculus
ggaaacatacctctggagagccata

SEQ ID NO: 581037 - DNA, 25 bp, Mus musculus
ggaaacatacctgtggagagccata

SEQ ID NO: 581038 - DNA, 25 bp, Mus musculus
ggaaacatagccctagcaatcaaat

SEQ ID NO: 581039 - DNA, 25 bp, Mus musculus
ggaaacatagccgtagcaatcaaat

SEQ ID NO: 581040 - DNA, 25 bp, Mus musculus
ggaaacatagtaactctgctattta

SEQ ID NO: 581041 - DNA, 25 bp, Mus musculus
ggaaacatagtatctctgctattta

SEQ ID NO: 581042 - DNA, 25 bp, Mus musculus
ggaaacatataccaattccttctct

SEQ ID NO: 581043 - DNA, 25 bp, Mus musculus
ggaaacatatacgaattccttctct

SEQ ID NO: 581044 - DNA, 25 bp, Mus musculus
ggaaacatcaagacatggccaggaa

SEQ ID NO: 581045 - DNA, 25 bp, Mus musculus
ggaaacatcaagtcatggccaggaa

SEQ ID NO: 581046 - DNA, 25 bp, Mus musculus
ggaaacatcactactcctccggttt

SEQ ID NO: 581047 - DNA, 25 bp, Mus musculus
ggaaacatcacttctcctccggttt

SEQ ID NO: 581048 - DNA, 25 bp, Mus musculus
ggaaacatcatgcttacagtctgta

SEQ ID NO: 581049 - DNA, 25 bp, Mus musculus
ggaaacatcatggttacagtctgta

SEQ ID NO: 581050 - DNA, 25 bp, Mus musculus
ggaaacatcccaacagcctcctgag

SEQ ID NO: 581051 - DNA, 25 bp, Mus musculus
ggaaacatcccatcagcctcctgag

SEQ ID NO: 581052 - DNA, 25 bp, Mus musculus
ggaaacatctcaaggcctagtctat

SEQ ID NO: 581053 - DNA, 25 bp, Mus musculus
ggaaacatctcaagtgcacccaagg

SEQ ID NO: 581054 - DNA, 25 bp, Mus musculus
ggaaacatctcatggcctagtctat

SEQ ID NO: 581055 - DNA, 25 bp, Mus musculus
ggaaacatctcatgtgcacccaagg

SEQ ID NO: 581056 - DNA, 25 bp, Mus musculus
ggaaacatctctaccttaagcattg

SEQ ID NO: 581057 - DNA, 25 bp, Mus musculus
ggaaacatctcttccttaagcattg

SEQ ID NO: 581058 - DNA, 25 bp, Mus musculus
ggaaacatgattaagccctcagagc

SEQ ID NO: 581059 - DNA, 25 bp, Mus musculus
ggaaacatgatttagccctcagagc

SEQ ID NO: 581060 - DNA, 25 bp, Mus musculus
ggaaacatgcagattttaactatta

SEQ ID NO: 581061 - DNA, 25 bp, Mus musculus
ggaaacatgcagtttttaactatta

SEQ ID NO: 581062 - DNA, 25 bp, Mus musculus
ggaaacatgcccacacatggacata

SEQ ID NO: 581063 - DNA, 25 bp, Mus musculus
ggaaacatgccctcacatggacata

SEQ ID NO: 581064 - DNA, 25 bp, Mus musculus
ggaaacatgcttcctcttgtcatct

SEQ ID NO: 581065 - DNA, 25 bp, Mus musculus
ggaaacatgcttgctcttgtcatct

SEQ ID NO: 581066 - DNA, 25 bp, Mus musculus
ggaaacatgggtccctaccagagct

SEQ ID NO: 581067 - DNA, 25 bp, Mus musculus
ggaaacatgggtgcctaccagagct

SEQ ID NO: 581068 - DNA, 25 bp, Mus musculus
ggaaacatgtgcctaatctataaag

SEQ ID NO: 581069 - DNA, 25 bp, Mus musculus
ggaaacatgtgcgtaatctataaag

SEQ ID NO: 581070 - DNA, 25 bp, Mus musculus
ggaaacattagcaacatccgtgtac

SEQ ID NO: 581071 - DNA, 25 bp, Mus musculus
ggaaacattagctacatccgtgtac

SEQ ID NO: 581072 - DNA, 25 bp, Mus musculus
ggaaacattcataacctgggtcaaa

SEQ ID NO: 581073 - DNA, 25 bp, Mus musculus
ggaaacattcattacctgggtcaaa

SEQ ID NO: 581074 - DNA, 25 bp, Mus musculus
ggaaacatttagcagtgtctcctag

SEQ ID NO: 581075 - DNA, 25 bp, Mus musculus
ggaaacatttaggagtgtctcctag

SEQ ID NO: 581076 - DNA, 25 bp, Mus musculus
ggaaaccaacaaactacctactgac

SEQ ID NO: 581077 - DNA, 25 bp, Mus musculus
ggaaaccaacaatctacctactgac

SEQ ID NO: 581078 - DNA, 25 bp, Mus musculus
ggaaaccaagacactctgtggccct

SEQ ID NO: 581079 - DNA, 25 bp, Mus musculus
ggaaaccaagactctctgtggccct

SEQ ID NO: 581080 - DNA, 25 bp, Mus musculus
ggaaaccaaggtcagcctggcctac

SEQ ID NO: 581081 - DNA, 25 bp, Mus musculus
ggaaaccaaggtgagcctggcctac

SEQ ID NO: 581082 - DNA, 25 bp, Mus musculus
ggaaaccacaagcaccatggactgc

SEQ ID NO: 581083 - DNA, 25 bp, Mus musculus
ggaaaccacaaggaccatggactgc

SEQ ID NO: 581084 - DNA, 25 bp, Mus musculus
ggaaaccacagaactctctacaacg

SEQ ID NO: 581085 - DNA, 25 bp, Mus musculus
ggaaaccacagatctctctacaacg

SEQ ID NO: 581086 - DNA, 25 bp, Mus musculus
ggaaaccacaggactatccccacag

SEQ ID NO: 581087 - DNA, 25 bp, Mus musculus
ggaaaccacaggtctatccccacag

SEQ ID NO: 581088 - DNA, 25 bp, Mus musculus
ggaaaccacatgacctaaatagtaa

SEQ ID NO: 581089 - DNA, 25 bp, Mus musculus
ggaaaccacatgtcctaaatagtaa

SEQ ID NO: 581090 - DNA, 25 bp, Mus musculus
ggaaaccaccgtagttacttgagag

SEQ ID NO: 581091 - DNA, 25 bp, Mus musculus
ggaaaccaccgttgttacttgagag

SEQ ID NO: 581092 - DNA, 25 bp, Mus musculus
ggaaaccagaagctctaacttcgga

SEQ ID NO: 581093 - DNA, 25 bp, Mus musculus
ggaaaccagaaggtctaacttcgga

SEQ ID NO: 581094 - DNA, 25 bp, Mus musculus
ggaaaccagacccaagttctcaaga

SEQ ID NO: 581095 - DNA, 25 bp, Mus musculus
ggaaaccagaccgaagttctcaaga

SEQ ID NO: 581096 - DNA, 25 bp, Mus musculus
ggaaaccagactatctcctactcag

SEQ ID NO: 581097 - DNA, 25 bp, Mus musculus
ggaaaccagactttctcctactcag

SEQ ID NO: 581098 - DNA, 25 bp, Mus musculus
ggaaaccagattaaagtgttttcag

SEQ ID NO: 581099 - DNA, 25 bp, Mus musculus
ggaaaccagatttaagtgttttcag

SEQ ID NO: 581100 - DNA, 25 bp, Mus musculus
ggaaaccagccaatctaaaagatgt

SEQ ID NO: 581101 - DNA, 25 bp, Mus musculus
ggaaaccagccattctaaaagatgt

SEQ ID NO: 581102 - DNA, 25 bp, Mus musculus
ggaaaccagcccagccaatggaaga

SEQ ID NO: 581103 - DNA, 25 bp, Mus musculus
ggaaaccagccctgccaatggaaga

SEQ ID NO: 581104 - DNA, 25 bp, Mus musculus
ggaaaccaggccatgcatgcagtca

SEQ ID NO: 581105 - DNA, 25 bp, Mus musculus
ggaaaccaggccttgcatgcagtca

SEQ ID NO: 581106 - DNA, 25 bp, Mus musculus
ggaaaccaggtacccagcacttaca

SEQ ID NO: 581107 - DNA, 25 bp, Mus musculus
ggaaaccaggtagccagcacttaca

SEQ ID NO: 581108 - DNA, 25 bp, Mus musculus
ggaaaccaggtcagttaaacacact

SEQ ID NO: 581109 - DNA, 25 bp, Mus musculus
ggaaaccaggtctgttaaacacact

SEQ ID NO: 581110 - DNA, 25 bp, Mus musculus
ggaaaccatactccgcggccgaggc

SEQ ID NO: 581111 - DNA, 25 bp, Mus musculus
ggaaaccatactgcgcggccgaggc

SEQ ID NO: 581112 - DNA, 25 bp, Mus musculus
ggaaaccatgaactgtacatgcgaa

SEQ ID NO: 581113 - DNA, 25 bp, Mus musculus
ggaaaccatgaagtgtacatgcgaa

SEQ ID NO: 581114 - DNA, 25 bp, Mus musculus
ggaaaccatgaccttgaagacacaa

SEQ ID NO: 581115 - DNA, 25 bp, Mus musculus
ggaaaccatgacgttgaagacacaa

SEQ ID NO: 581116 - DNA, 25 bp, Mus musculus
ggaaaccatgccagttacttacaga

SEQ ID NO: 581117 - DNA, 25 bp, Mus musculus
ggaaaccatgcctgttacttacaga

SEQ ID NO: 581118 - DNA, 25 bp, Mus musculus
ggaaaccattgaatcatccatttat

SEQ ID NO: 581119 - DNA, 25 bp, Mus musculus
ggaaaccattgattcatccatttat

SEQ ID NO: 581120 - DNA, 25 bp, Mus musculus
ggaaaccattgtcaacaagcgggaa

SEQ ID NO: 581121 - DNA, 25 bp, Mus musculus
ggaaaccattgtgaacaagcgggaa

SEQ ID NO: 581122 - DNA, 25 bp, Mus musculus
ggaaacccaagactggaatatacac

SEQ ID NO: 581123 - DNA, 25 bp, Mus musculus
ggaaacccaagagtggaatatacac

SEQ ID NO: 581124 - DNA, 25 bp, Mus musculus
ggaaacccaagcagaaactccactt

SEQ ID NO: 581125 - DNA, 25 bp, Mus musculus
ggaaacccaagctgaaactccactt

SEQ ID NO: 581126 - DNA, 25 bp, Mus musculus
ggaaacccagacagcttttgtgatg

SEQ ID NO: 581127 - DNA, 25 bp, Mus musculus
ggaaacccagactgcttttgtgatg

SEQ ID NO: 581128 - DNA, 25 bp, Mus musculus
ggaaacccagagactcttctgtcag

SEQ ID NO: 581129 - DNA, 25 bp, Mus musculus
ggaaacccagagtctcttctgtcag

SEQ ID NO: 581130 - DNA, 25 bp, Mus musculus
ggaaacccagatccagattttagta

SEQ ID NO: 581131 - DNA, 25 bp, Mus musculus
ggaaacccagatgcagattttagta

SEQ ID NO: 581132 - DNA, 25 bp, Mus musculus
ggaaacccagcaaacaactagcttt

SEQ ID NO: 581133 - DNA, 25 bp, Mus musculus
ggaaacccagcatacaactagcttt

SEQ ID NO: 581134 - DNA, 25 bp, Mus musculus
ggaaacccagcgcaaagtgacattt

SEQ ID NO: 581135 - DNA, 25 bp, Mus musculus
ggaaacccagcggaaagtgacattt

SEQ ID NO: 581136 - DNA, 25 bp, Mus musculus
ggaaacccagctcataagacaacta

SEQ ID NO: 581137 - DNA, 25 bp, Mus musculus
ggaaacccagctgataagacaacta

SEQ ID NO: 581138 - DNA, 25 bp, Mus musculus
ggaaacccagttagtgagacttaca

SEQ ID NO: 581139 - DNA, 25 bp, Mus musculus
ggaaacccagtttgtgagacttaca

SEQ ID NO: 581140 - DNA, 25 bp, Mus musculus
ggaaacccatctacgcaaactattt

SEQ ID NO: 581141 - DNA, 25 bp, Mus musculus
ggaaacccatcttcgcaaactattt

SEQ ID NO: 581142 - DNA, 25 bp, Mus musculus
ggaaacccattgcagattgttacta

SEQ ID NO: 581143 - DNA, 25 bp, Mus musculus
ggaaacccattggagattgttacta

SEQ ID NO: 581144 - DNA, 25 bp, Mus musculus
ggaaacccatttacactaattatct

SEQ ID NO: 581145 - DNA, 25 bp, Mus musculus
ggaaacccattttcactaattatct

SEQ ID NO: 581146 - DNA, 25 bp, Mus musculus
ggaaaccccaaaccttgaataatag

SEQ ID NO: 581147 - DNA, 25 bp, Mus musculus
ggaaaccccaaagcttgaataatag

SEQ ID NO: 581148 - DNA, 25 bp, Mus musculus
ggaaaccccaagatttacagagagt

SEQ ID NO: 581149 - DNA, 25 bp, Mus musculus
ggaaaccccaagttttacagagagt

SEQ ID NO: 581150 - DNA, 25 bp, Mus musculus
ggaaaccccaataatacgctgtcgc

SEQ ID NO: 581151 - DNA, 25 bp, Mus musculus
ggaaaccccaattatacgctgtcgc

SEQ ID NO: 581152 - DNA, 25 bp, Mus musculus
ggaaaccccacgaacaagcagcatc

SEQ ID NO: 581153 - DNA, 25 bp, Mus musculus
ggaaaccccacgtacaagcagcatc

SEQ ID NO: 581154 - DNA, 25 bp, Mus musculus
ggaaaccccagccagaccaggcttt

SEQ ID NO: 581155 - DNA, 25 bp, Mus musculus
ggaaaccccagcgagaccaggcttt

SEQ ID NO: 581156 - DNA, 25 bp, Mus musculus
ggaaaccccattaccattctctaga

SEQ ID NO: 581157 - DNA, 25 bp, Mus musculus
ggaaaccccatttccattctctaga

SEQ ID NO: 581158 - DNA, 25 bp, Mus musculus
ggaaaccccgtgcaatcttgtatat

SEQ ID NO: 581159 - DNA, 25 bp, Mus musculus
ggaaaccccgtggaatcttgtatat

SEQ ID NO: 581160 - DNA, 25 bp, Mus musculus
ggaaacccgagactccaataaacat

SEQ ID NO: 581161 - DNA, 25 bp, Mus musculus
ggaaacccgagagtccaataaacat

SEQ ID NO: 581162 - DNA, 25 bp, Mus musculus
ggaaacccgtgcactatggtgtaca

SEQ ID NO: 581163 - DNA, 25 bp, Mus musculus
ggaaacccgtgctctatggtgtaca

SEQ ID NO: 581164 - DNA, 25 bp, Mus musculus
ggaaaccctagaagtagctcgctgt

SEQ ID NO: 581165 - DNA, 25 bp, Mus musculus
ggaaaccctagatgtagctcgctgt

SEQ ID NO: 581166 - DNA, 25 bp, Mus musculus
ggaaaccctatcaacctcagcagaa

SEQ ID NO: 581167 - DNA, 25 bp, Mus musculus
ggaaaccctatctacctcagcagaa

SEQ ID NO: 581168 - DNA, 25 bp, Mus musculus
ggaaaccctatgaattcagcccagt

SEQ ID NO: 581169 - DNA, 25 bp, Mus musculus
ggaaaccctatgtattcagcccagt

SEQ ID NO: 581170 - DNA, 25 bp, Mus musculus
ggaaaccctgccctgggttgcacat

SEQ ID NO: 581171 - DNA, 25 bp, Mus musculus
ggaaaccctgccgtgggttgcacat

SEQ ID NO: 581172 - DNA, 25 bp, Mus musculus
ggaaaccctgtaaagtgtgtctgta

SEQ ID NO: 581173 - DNA, 25 bp, Mus musculus
ggaaaccctgtatagtgtgtctgta

SEQ ID NO: 581174 - DNA, 25 bp, Mus musculus
ggaaacccttcaatatcacttgacc

SEQ ID NO: 581175 - DNA, 25 bp, Mus musculus
ggaaacccttcattatcacttgacc

SEQ ID NO: 581176 - DNA, 25 bp, Mus musculus
ggaaaccctttcagcgagatgtacg

SEQ ID NO: 581177 - DNA, 25 bp, Mus musculus
ggaaaccctttctgcgagatgtacg

SEQ ID NO: 581178 - DNA, 25 bp, Mus musculus
ggaaaccctttgaggagcctttgag

SEQ ID NO: 581179 - DNA, 25 bp, Mus musculus
ggaaaccctttgtggagcctttgag

SEQ ID NO: 581180 - DNA, 25 bp, Mus musculus
ggaaaccgaagaacctcaggagccc

SEQ ID NO: 581181 - DNA, 25 bp, Mus musculus
ggaaaccgaagatcctcaggagccc

SEQ ID NO: 581182 - DNA, 25 bp, Mus musculus
ggaaaccgatctcggtcctctgcgg

SEQ ID NO: 581183 - DNA, 25 bp, Mus musculus
ggaaaccgatctgggtcctctgcgg

SEQ ID NO: 581184 - DNA, 25 bp, Mus musculus
ggaaaccgcagcagccgtcggagca

SEQ ID NO: 581185 - DNA, 25 bp, Mus musculus
ggaaaccgcagctgccgtcggagca

SEQ ID NO: 581186 - DNA, 25 bp, Mus musculus
ggaaaccgggctccttcctgtgagc

SEQ ID NO: 581187 - DNA, 25 bp, Mus musculus
ggaaaccgggctgcttcctgtgagc

SEQ ID NO: 581188 - DNA, 25 bp, Mus musculus
ggaaaccgtcccaacgatgtctatg

SEQ ID NO: 581189 - DNA, 25 bp, Mus musculus
ggaaaccgtccctacgatgtctatg

SEQ ID NO: 581190 - DNA, 25 bp, Mus musculus
ggaaaccgtgttagcaatgctagtg

SEQ ID NO: 581191 - DNA, 25 bp, Mus musculus
ggaaaccgtgtttgcaatgctagtg

SEQ ID NO: 581192 - DNA, 25 bp, Mus musculus
ggaaacctagctaaatcctctgtgc

SEQ ID NO: 581193 - DNA, 25 bp, Mus musculus
ggaaacctagcttaatcctctgtgc

SEQ ID NO: 581194 - DNA, 25 bp, Mus musculus
ggaaacctaggtctggctgcatata

SEQ ID NO: 581195 - DNA, 25 bp, Mus musculus
ggaaacctaggtgtggctgcatata

SEQ ID NO: 581196 - DNA, 25 bp, Mus musculus
ggaaacctagtcagcagggtgctgt

SEQ ID NO: 581197 - DNA, 25 bp, Mus musculus
ggaaacctagtctgcagggtgctgt

SEQ ID NO: 581198 - DNA, 25 bp, Mus musculus
ggaaacctcaaaaacgtccttattg

SEQ ID NO: 581199 - DNA, 25 bp, Mus musculus
ggaaacctcaaatacgtccttattg

SEQ ID NO: 581200 - DNA, 25 bp, Mus musculus
ggaaacctcaagcaaccaaacacgt

SEQ ID NO: 581201 - DNA, 25 bp, Mus musculus
ggaaacctcaaggaaccaaacacgt

SEQ ID NO: 581202 - DNA, 25 bp, Mus musculus
ggaaacctcagaactggctgctgta

SEQ ID NO: 581203 - DNA, 25 bp, Mus musculus
ggaaacctcagatctggctgctgta

SEQ ID NO: 581204 - DNA, 25 bp, Mus musculus
ggaaacctcaggatgcctttgatga

SEQ ID NO: 581205 - DNA, 25 bp, Mus musculus
ggaaacctcaggttgcctttgatga

SEQ ID NO: 581206 - DNA, 25 bp, Mus musculus
ggaaacctctggatgaatttgtgct

SEQ ID NO: 581207 - DNA, 25 bp, Mus musculus
ggaaacctctggttgaatttgtgct

SEQ ID NO: 581208 - DNA, 25 bp, Mus musculus
ggaaacctctttacatttcatgtca

SEQ ID NO: 581209 - DNA, 25 bp, Mus musculus
ggaaacctctttcatggaattctct

SEQ ID NO: 581210 - DNA, 25 bp, Mus musculus
ggaaacctctttgatggaattctct

SEQ ID NO: 581211 - DNA, 25 bp, Mus musculus
ggaaacctcttttcatttcatgtca

SEQ ID NO: 581212 - DNA, 25 bp, Mus musculus
ggaaacctgactcattgtcttcata

SEQ ID NO: 581213 - DNA, 25 bp, Mus musculus
ggaaacctgactgattgtcttcata

SEQ ID NO: 581214 - DNA, 25 bp, Mus musculus
ggaaacctgagtatacatacagctg

SEQ ID NO: 581215 - DNA, 25 bp, Mus musculus
ggaaacctgagtttacatacagctg

SEQ ID NO: 581216 - DNA, 25 bp, Mus musculus
ggaaacctgcaaacagttgcttgga

SEQ ID NO: 581217 - DNA, 25 bp, Mus musculus
ggaaacctgcaatcagttgcttgga

SEQ ID NO: 581218 - DNA, 25 bp, Mus musculus
ggaaacctgctacccaaaattagct

SEQ ID NO: 581219 - DNA, 25 bp, Mus musculus
ggaaacctgctagccaaaattagct

SEQ ID NO: 581220 - DNA, 25 bp, Mus musculus
ggaaacctgggacgccagtcatgcc

SEQ ID NO: 581221 - DNA, 25 bp, Mus musculus
ggaaacctgggaggccagtcatgcc

SEQ ID NO: 581222 - DNA, 25 bp, Mus musculus
ggaaacctggttctcattgtcttga

SEQ ID NO: 581223 - DNA, 25 bp, Mus musculus
ggaaacctggttctggtagctgtcc

SEQ ID NO: 581224 - DNA, 25 bp, Mus musculus
ggaaacctggttgtcattgtcttga

SEQ ID NO: 581225 - DNA, 25 bp, Mus musculus
ggaaacctggttgtggtagctgtcc

SEQ ID NO: 581226 - DNA, 25 bp, Mus musculus
ggaaacctgtgaaatctgtacgtat

SEQ ID NO: 581227 - DNA, 25 bp, Mus musculus
ggaaacctgtgatatctgtacgtat

SEQ ID NO: 581228 - DNA, 25 bp, Mus musculus
ggaaaccttaaacaacactgctgct

SEQ ID NO: 581229 - DNA, 25 bp, Mus musculus
ggaaaccttaaagaacactgctgct

SEQ ID NO: 581230 - DNA, 25 bp, Mus musculus
ggaaaccttaatccaaacaagtctg

SEQ ID NO: 581231 - DNA, 25 bp, Mus musculus
ggaaaccttaatgcaaacaagtctg

SEQ ID NO: 581232 - DNA, 25 bp, Mus musculus
ggaaaccttagaacttatcaattac

SEQ ID NO: 581233 - DNA, 25 bp, Mus musculus
ggaaaccttagaatgttggaaacat

SEQ ID NO: 581234 - DNA, 25 bp, Mus musculus
ggaaaccttagatcttatcaattac

SEQ ID NO: 581235 - DNA, 25 bp, Mus musculus
ggaaaccttagattgttggaaacat

SEQ ID NO: 581236 - DNA, 25 bp, Mus musculus
ggaaaccttatgactacttcactca

SEQ ID NO: 581237 - DNA, 25 bp, Mus musculus
ggaaaccttatgtctacttcactca

SEQ ID NO: 581238 - DNA, 25 bp, Mus musculus
ggaaaccttctgatcttgaattcag

SEQ ID NO: 581239 - DNA, 25 bp, Mus musculus
ggaaaccttctgttcttgaattcag

SEQ ID NO: 581240 - DNA, 25 bp, Mus musculus
ggaaaccttgacacacttagctcat

SEQ ID NO: 581241 - DNA, 25 bp, Mus musculus
ggaaaccttgactcacttagctcat

SEQ ID NO: 581242 - DNA, 25 bp, Mus musculus
ggaaaccttgctacgataaactgaa

SEQ ID NO: 581243 - DNA, 25 bp, Mus musculus
ggaaaccttgcttcgataaactgaa

SEQ ID NO: 581244 - DNA, 25 bp, Mus musculus
ggaaaccttggacacgtgaacatca

SEQ ID NO: 581245 - DNA, 25 bp, Mus musculus
ggaaaccttggagacgtgaacatca

SEQ ID NO: 581246 - DNA, 25 bp, Mus musculus
ggaaaccttgggagctacaccactt

SEQ ID NO: 581247 - DNA, 25 bp, Mus musculus
ggaaaccttgggtgctacaccactt

SEQ ID NO: 581248 - DNA, 25 bp, Mus musculus
ggaaaccttgtcacaccaaatgtgg

SEQ ID NO: 581249 - DNA, 25 bp, Mus musculus
ggaaaccttgtctcaccaaatgtgg

SEQ ID NO: 581250 - DNA, 25 bp, Mus musculus
ggaaacctttatatgtcacctgcta

SEQ ID NO: 581251 - DNA, 25 bp, Mus musculus
ggaaacctttatttgtcacctgcta

SEQ ID NO: 581252 - DNA, 25 bp, Mus musculus
ggaaacgaagatcgtccaccctagc

SEQ ID NO: 581253 - DNA, 25 bp, Mus musculus
ggaaacgaagatggtccaccctagc

SEQ ID NO: 581254 - DNA, 25 bp, Mus musculus
ggaaacgaatctcatacccttaact

SEQ ID NO: 581255 - DNA, 25 bp, Mus musculus
ggaaacgaatctgatacccttaact

SEQ ID NO: 581256 - DNA, 25 bp, Mus musculus
ggaaacgacgggaatcagcctccag

SEQ ID NO: 581257 - DNA, 25 bp, Mus musculus
ggaaacgacgggtatcagcctccag

SEQ ID NO: 581258 - DNA, 25 bp, Mus musculus
ggaaacgactacatcgaccagctga

SEQ ID NO: 581259 - DNA, 25 bp, Mus musculus
ggaaacgactacttcgaccagctga

SEQ ID NO: 581260 - DNA, 25 bp, Mus musculus
ggaaacgagtgcctccatattctcc

SEQ ID NO: 581261 - DNA, 25 bp, Mus musculus
ggaaacgagtgcgtccatattctcc

SEQ ID NO: 581262 - DNA, 25 bp, Mus musculus
ggaaacgatcaactacatcagatac

SEQ ID NO: 581263 - DNA, 25 bp, Mus musculus
ggaaacgatcaagtacatcagatac

SEQ ID NO: 581264 - DNA, 25 bp, Mus musculus
ggaaacgatgccattaccactgaaa

SEQ ID NO: 581265 - DNA, 25 bp, Mus musculus
ggaaacgatgcctttaccactgaaa

SEQ ID NO: 581266 - DNA, 25 bp, Mus musculus
ggaaacgcacttcactttcagtgat

SEQ ID NO: 581267 - DNA, 25 bp, Mus musculus
ggaaacgcacttgactttcagtgat

SEQ ID NO: 581268 - DNA, 25 bp, Mus musculus
ggaaacgcattcaatagacaacaga

SEQ ID NO: 581269 - DNA, 25 bp, Mus musculus
ggaaacgcattctatagacaacaga

SEQ ID NO: 581270 - DNA, 25 bp, Mus musculus
ggaaacgccagacggactttagtga

SEQ ID NO: 581271 - DNA, 25 bp, Mus musculus
ggaaacgccagagggactttagtga

SEQ ID NO: 581272 - DNA, 25 bp, Mus musculus
ggaaacgccatcatcatttgtgtgc

SEQ ID NO: 581273 - DNA, 25 bp, Mus musculus
ggaaacgccatcttcatttgtgtgc

SEQ ID NO: 581274 - DNA, 25 bp, Mus musculus
ggaaacgctccgagacactgtagca

SEQ ID NO: 581275 - DNA, 25 bp, Mus musculus
ggaaacgctccgtgacactgtagca

SEQ ID NO: 581276 - DNA, 25 bp, Mus musculus
ggaaacgctctgaaacatgcatgtt

SEQ ID NO: 581277 - DNA, 25 bp, Mus musculus
ggaaacgctctgtaacatgcatgtt

SEQ ID NO: 581278 - DNA, 25 bp, Mus musculus
ggaaacgctgcacaacaacatatgt

SEQ ID NO: 581279 - DNA, 25 bp, Mus musculus
ggaaacgctgcagaacaacatatgt

SEQ ID NO: 581280 - DNA, 25 bp, Mus musculus
ggaaacggaatgcactatgtatttt

SEQ ID NO: 581281 - DNA, 25 bp, Mus musculus
ggaaacggaatggactatgtatttt

SEQ ID NO: 581282 - DNA, 25 bp, Mus musculus
ggaaacggaggcacagcactgacct

SEQ ID NO: 581283 - DNA, 25 bp, Mus musculus
ggaaacggaggctcagcactgacct

SEQ ID NO: 581284 - DNA, 25 bp, Mus musculus
ggaaacggattcaccttaccttgca

SEQ ID NO: 581285 - DNA, 25 bp, Mus musculus
ggaaacggattctccttaccttgca

SEQ ID NO: 581286 - DNA, 25 bp, Mus musculus
ggaaacggatttctctagacattga

SEQ ID NO: 581287 - DNA, 25 bp, Mus musculus
ggaaacggatttgtctagacattga

SEQ ID NO: 581288 - DNA, 25 bp, Mus musculus
ggaaacggcactcggaactctacca

SEQ ID NO: 581289 - DNA, 25 bp, Mus musculus
ggaaacggcactgggaactctacca

SEQ ID NO: 581290 - DNA, 25 bp, Mus musculus
ggaaacggctatagaacttggctat

SEQ ID NO: 581291 - DNA, 25 bp, Mus musculus
ggaaacggctattgaacttggctat

SEQ ID NO: 581292 - DNA, 25 bp, Mus musculus
ggaaacgggacgatgaatctacttc

SEQ ID NO: 581293 - DNA, 25 bp, Mus musculus
ggaaacgggacgttgaatctacttc

SEQ ID NO: 581294 - DNA, 25 bp, Mus musculus
ggaaacggtattctgcatttgtggc

SEQ ID NO: 581295 - DNA, 25 bp, Mus musculus
ggaaacggtattgtgcatttgtggc

SEQ ID NO: 581296 - DNA, 25 bp, Mus musculus
ggaaacggtcctatatttatcagtg

SEQ ID NO: 581297 - DNA, 25 bp, Mus musculus
ggaaacggtcctttatttatcagtg

SEQ ID NO: 581298 - DNA, 25 bp, Mus musculus
ggaaacggtgcgacttcaaccaaga

SEQ ID NO: 581299 - DNA, 25 bp, Mus musculus
ggaaacggtgcgtcttcaaccaaga

SEQ ID NO: 581300 - DNA, 25 bp, Mus musculus
ggaaacgtacatccagtctgtccag

SEQ ID NO: 581301 - DNA, 25 bp, Mus musculus
ggaaacgtacatgcagtctgtccag

SEQ ID NO: 581302 - DNA, 25 bp, Mus musculus
ggaaacgtggttaagtggctccaat

SEQ ID NO: 581303 - DNA, 25 bp, Mus musculus
ggaaacgtggtttagtggctccaat

SEQ ID NO: 581304 - DNA, 25 bp, Mus musculus
ggaaacgtgtctccccgtgtatatg

SEQ ID NO: 581305 - DNA, 25 bp, Mus musculus
ggaaacgtgtctgcccgtgtatatg

SEQ ID NO: 581306 - DNA, 25 bp, Mus musculus
ggaaacgttaccacaataaaatcat

SEQ ID NO: 581307 - DNA, 25 bp, Mus musculus
ggaaacgttacctcaataaaatcat

SEQ ID NO: 581308 - DNA, 25 bp, Mus musculus
ggaaacgttagacattgtgccacct

SEQ ID NO: 581309 - DNA, 25 bp, Mus musculus
ggaaacgttagagattgtgccacct

SEQ ID NO: 581310 - DNA, 25 bp, Mus musculus
ggaaacgtttgtcagcgactccggt

SEQ ID NO: 581311 - DNA, 25 bp, Mus musculus
ggaaacgtttgtgagcgactccggt

SEQ ID NO: 581312 - DNA, 25 bp, Mus musculus
ggaaactaaatactatgcataactg

SEQ ID NO: 581313 - DNA, 25 bp, Mus musculus
ggaaactaaatagtatgcataactg

SEQ ID NO: 581314 - DNA, 25 bp, Mus musculus
ggaaactaacttaggatctgttctt

SEQ ID NO: 581315 - DNA, 25 bp, Mus musculus
ggaaactaactttggatctgttctt

SEQ ID NO: 581316 - DNA, 25 bp, Mus musculus
ggaaactaatctaaacccccatgct

SEQ ID NO: 581317 - DNA, 25 bp, Mus musculus
ggaaactaatcttaacccccatgct

SEQ ID NO: 581318 - DNA, 25 bp, Mus musculus
ggaaactacaatctgtaccaccttc

SEQ ID NO: 581319 - DNA, 25 bp, Mus musculus
ggaaactacaatgtgtaccaccttc

SEQ ID NO: 581320 - DNA, 25 bp, Mus musculus
ggaaactaccaactcctgttacaca

SEQ ID NO: 581321 - DNA, 25 bp, Mus musculus
ggaaactaccaagtcctgttacaca

SEQ ID NO: 581322 - DNA, 25 bp, Mus musculus
ggaaactacttccatgaattcttac

SEQ ID NO: 581323 - DNA, 25 bp, Mus musculus
ggaaactacttcgatgaattcttac

SEQ ID NO: 581324 - DNA, 25 bp, Mus musculus
ggaaactagaccattgctaccactg

SEQ ID NO: 581325 - DNA, 25 bp, Mus musculus
ggaaactagacccacaacaactctc

SEQ ID NO: 581326 - DNA, 25 bp, Mus musculus
ggaaactagaccgacaacaactctc

SEQ ID NO: 581327 - DNA, 25 bp, Mus musculus
ggaaactagacctttgctaccactg

SEQ ID NO: 581328 - DNA, 25 bp, Mus musculus
ggaaactatccacccaaatactttt

SEQ ID NO: 581329 - DNA, 25 bp, Mus musculus
ggaaactatccagccaaatactttt

SEQ ID NO: 581330 - DNA, 25 bp, Mus musculus
ggaaactatcccatgaatgatgagc

SEQ ID NO: 581331 - DNA, 25 bp, Mus musculus
ggaaactatcccttgaatgatgagc

SEQ ID NO: 581332 - DNA, 25 bp, Mus musculus
ggaaactattccaagctccagttct

SEQ ID NO: 581333 - DNA, 25 bp, Mus musculus
ggaaactattccatccaactgtgag

SEQ ID NO: 581334 - DNA, 25 bp, Mus musculus
ggaaactattcctagctccagttct

SEQ ID NO: 581335 - DNA, 25 bp, Mus musculus
ggaaactattccttccaactgtgag

SEQ ID NO: 581336 - DNA, 25 bp, Mus musculus
ggaaactcacccattatagccctaa

SEQ ID NO: 581337 - DNA, 25 bp, Mus musculus
ggaaactcaccctttatagccctaa

SEQ ID NO: 581338 - DNA, 25 bp, Mus musculus
ggaaactcactcatcagattcctta

SEQ ID NO: 581339 - DNA, 25 bp, Mus musculus
ggaaactcactcttcagattcctta

SEQ ID NO: 581340 - DNA, 25 bp, Mus musculus
ggaaactcactgagttcacttggag

SEQ ID NO: 581341 - DNA, 25 bp, Mus musculus
ggaaactcactgtgttcacttggag

SEQ ID NO: 581342 - DNA, 25 bp, Mus musculus
ggaaactcagaaaggcttgcagtcc

SEQ ID NO: 581343 - DNA, 25 bp, Mus musculus
ggaaactcagaatggcttgcagtcc

SEQ ID NO: 581344 - DNA, 25 bp, Mus musculus
ggaaactcagcacttgagacaggaa

SEQ ID NO: 581345 - DNA, 25 bp, Mus musculus
ggaaactcagcagttgagacaggaa

SEQ ID NO: 581346 - DNA, 25 bp, Mus musculus
ggaaactcatcaattccctggactc

SEQ ID NO: 581347 - DNA, 25 bp, Mus musculus
ggaaactcatcatttccctggactc

SEQ ID NO: 581348 - DNA, 25 bp, Mus musculus
ggaaactcatggaatatcctccaga

SEQ ID NO: 581349 - DNA, 25 bp, Mus musculus
ggaaactcatggtatatcctccaga

SEQ ID NO: 581350 - DNA, 25 bp, Mus musculus
ggaaactcctcacacgcatgaagct

SEQ ID NO: 581351 - DNA, 25 bp, Mus musculus
ggaaactcctcagacgcatgaagct

SEQ ID NO: 581352 - DNA, 25 bp, Mus musculus
ggaaactcctgaaaacacttgctac

SEQ ID NO: 581353 - DNA, 25 bp, Mus musculus
ggaaactcctgaatctaagcttggg

SEQ ID NO: 581354 - DNA, 25 bp, Mus musculus
ggaaactcctgataacacttgctac

SEQ ID NO: 581355 - DNA, 25 bp, Mus musculus
ggaaactcctgattctaagcttggg

SEQ ID NO: 581356 - DNA, 25 bp, Mus musculus
ggaaactcgcaacatcatttcctca

SEQ ID NO: 581357 - DNA, 25 bp, Mus musculus
ggaaactcgcaagatcatttcctca

SEQ ID NO: 581358 - DNA, 25 bp, Mus musculus
ggaaactcggccagcagggcgggat

SEQ ID NO: 581359 - DNA, 25 bp, Mus musculus
ggaaactcggcctgcagggcgggat

SEQ ID NO: 581360 - DNA, 25 bp, Mus musculus
ggaaactcgtctaaactaggctatt

SEQ ID NO: 581361 - DNA, 25 bp, Mus musculus
ggaaactcgtcttaactaggctatt

SEQ ID NO: 581362 - DNA, 25 bp, Mus musculus
ggaaactctaaaatcactggaaatt

SEQ ID NO: 581363 - DNA, 25 bp, Mus musculus
ggaaactctaaattcactggaaatt

SEQ ID NO: 581364 - DNA, 25 bp, Mus musculus
ggaaactctatgaggaccgagccaa

SEQ ID NO: 581365 - DNA, 25 bp, Mus musculus
ggaaactctatgtggaccgagccaa

SEQ ID NO: 581366 - DNA, 25 bp, Mus musculus
ggaaactctctgagcctagtagggc

SEQ ID NO: 581367 - DNA, 25 bp, Mus musculus
ggaaactctctgtgcctagtagggc

SEQ ID NO: 581368 - DNA, 25 bp, Mus musculus
ggaaactctggaagacacactatgt

SEQ ID NO: 581369 - DNA, 25 bp, Mus musculus
ggaaactctggatgacacactatgt

SEQ ID NO: 581370 - DNA, 25 bp, Mus musculus
ggaaactcttaaagataacttggtc

SEQ ID NO: 581371 - DNA, 25 bp, Mus musculus
ggaaactcttaatgataacttggtc

SEQ ID NO: 581372 - DNA, 25 bp, Mus musculus
ggaaactcttgtcatattccgagag

SEQ ID NO: 581373 - DNA, 25 bp, Mus musculus
ggaaactcttgtgatattccgagag

SEQ ID NO: 581374 - DNA, 25 bp, Mus musculus
ggaaactgaacccacccgatgagag

SEQ ID NO: 581375 - DNA, 25 bp, Mus musculus
ggaaactgaaccgacccgatgagag

SEQ ID NO: 581376 - DNA, 25 bp, Mus musculus
ggaaactgaactagcattctcagga

SEQ ID NO: 581377 - DNA, 25 bp, Mus musculus
ggaaactgaactatcttaagagcag

SEQ ID NO: 581378 - DNA, 25 bp, Mus musculus
ggaaactgaacttgcattctcagga

SEQ ID NO: 581379 - DNA, 25 bp, Mus musculus
ggaaactgaactttcttaagagcag

SEQ ID NO: 581380 - DNA, 25 bp, Mus musculus
ggaaactgacacagcgacaactcat

SEQ ID NO: 581381 - DNA, 25 bp, Mus musculus
ggaaactgacactgcgacaactcat

SEQ ID NO: 581382 - DNA, 25 bp, Mus musculus
ggaaactgacataaatactcttttt

SEQ ID NO: 581383 - DNA, 25 bp, Mus musculus
ggaaactgacattaatactcttttt

SEQ ID NO: 581384 - DNA, 25 bp, Mus musculus
ggaaactgactactgatgactatct

SEQ ID NO: 581385 - DNA, 25 bp, Mus musculus
ggaaactgactagtgatgactatct

SEQ ID NO: 581386 - DNA, 25 bp, Mus musculus
ggaaactgactcctctctggaggag

SEQ ID NO: 581387 - DNA, 25 bp, Mus musculus
ggaaactgactcgtctctggaggag

SEQ ID NO: 581388 - DNA, 25 bp, Mus musculus
ggaaactgactgacttgaagctctg

SEQ ID NO: 581389 - DNA, 25 bp, Mus musculus
ggaaactgactgtcttgaagctctg

SEQ ID NO: 581390 - DNA, 25 bp, Mus musculus
ggaaactgacttacttgcccaggtg

SEQ ID NO: 581391 - DNA, 25 bp, Mus musculus
ggaaactgactttcttgcccaggtg

SEQ ID NO: 581392 - DNA, 25 bp, Mus musculus
ggaaactgagacaaatctttttaca

SEQ ID NO: 581393 - DNA, 25 bp, Mus musculus
ggaaactgagactaatctttttaca

SEQ ID NO: 581394 - DNA, 25 bp, Mus musculus
ggaaactgagccaggtccaggccga

SEQ ID NO: 581395 - DNA, 25 bp, Mus musculus
ggaaactgagcctggtccaggccga

SEQ ID NO: 581396 - DNA, 25 bp, Mus musculus
ggaaactgagttcgcctgcataata

SEQ ID NO: 581397 - DNA, 25 bp, Mus musculus
ggaaactgagttggcctgcataata

SEQ ID NO: 581398 - DNA, 25 bp, Mus musculus
ggaaactgatctctattacctgact

SEQ ID NO: 581399 - DNA, 25 bp, Mus musculus
ggaaactgatctgtattacctgact

SEQ ID NO: 581400 - DNA, 25 bp, Mus musculus
ggaaactgatgtcgttcttaaccca

SEQ ID NO: 581401 - DNA, 25 bp, Mus musculus
ggaaactgatgtggttcttaaccca

SEQ ID NO: 581402 - DNA, 25 bp, Mus musculus
ggaaactgcaataacatgcctgtct

SEQ ID NO: 581403 - DNA, 25 bp, Mus musculus
ggaaactgcaattacatgcctgtct

SEQ ID NO: 581404 - DNA, 25 bp, Mus musculus
ggaaactgccttagagttcaccaaa

SEQ ID NO: 581405 - DNA, 25 bp, Mus musculus
ggaaactgcctttgagttcaccaaa

SEQ ID NO: 581406 - DNA, 25 bp, Mus musculus
ggaaactgcggtatgagccccggtc

SEQ ID NO: 581407 - DNA, 25 bp, Mus musculus
ggaaactgcggtttgagccccggtc

SEQ ID NO: 581408 - DNA, 25 bp, Mus musculus
ggaaactgctatattcttgtcccca

SEQ ID NO: 581409 - DNA, 25 bp, Mus musculus
ggaaactgctattttcttgtcccca

SEQ ID NO: 581410 - DNA, 25 bp, Mus musculus
ggaaactgctgtctgcactacaaca

SEQ ID NO: 581411 - DNA, 25 bp, Mus musculus
ggaaactgctgtgtgcactacaaca

SEQ ID NO: 581412 - DNA, 25 bp, Mus musculus
ggaaactggaccaaacaccgacttg

SEQ ID NO: 581413 - DNA, 25 bp, Mus musculus
ggaaactggacctaacaccgacttg

SEQ ID NO: 581414 - DNA, 25 bp, Mus musculus
ggaaactggagcaaggtaccgacct

SEQ ID NO: 581415 - DNA, 25 bp, Mus musculus
ggaaactggagctaggtaccgacct

SEQ ID NO: 581416 - DNA, 25 bp, Mus musculus
ggaaactgggcaaaccactggatat

SEQ ID NO: 581417 - DNA, 25 bp, Mus musculus
ggaaactgggcataccactggatat

SEQ ID NO: 581418 - DNA, 25 bp, Mus musculus
ggaaactgtaacatctatgtctaat

SEQ ID NO: 581419 - DNA, 25 bp, Mus musculus
ggaaactgtaacttctatgtctaat

SEQ ID NO: 581420 - DNA, 25 bp, Mus musculus
ggaaactgtagccagggatctgcat

SEQ ID NO: 581421 - DNA, 25 bp, Mus musculus
ggaaactgtagcgagggatctgcat

SEQ ID NO: 581422 - DNA, 25 bp, Mus musculus
ggaaactgtataatgagcgtcatgt

SEQ ID NO: 581423 - DNA, 25 bp, Mus musculus
ggaaactgtatattgagcgtcatgt

SEQ ID NO: 581424 - DNA, 25 bp, Mus musculus
ggaaactgtcaaatcattgcttgaa

SEQ ID NO: 581425 - DNA, 25 bp, Mus musculus
ggaaactgtcaattcattgcttgaa

SEQ ID NO: 581426 - DNA, 25 bp, Mus musculus
ggaaactgtcacaaggctctgccat

SEQ ID NO: 581427 - DNA, 25 bp, Mus musculus
ggaaactgtcactaggctctgccat

SEQ ID NO: 581428 - DNA, 25 bp, Mus musculus
ggaaactgtcggagattgcctgctt

SEQ ID NO: 581429 - DNA, 25 bp, Mus musculus
ggaaactgtcggtgattgcctgctt

SEQ ID NO: 581430 - DNA, 25 bp, Mus musculus
ggaaactgtgagcaccttgttctgc

SEQ ID NO: 581431 - DNA, 25 bp, Mus musculus
ggaaactgtgaggaccttgttctgc

SEQ ID NO: 581432 - DNA, 25 bp, Mus musculus
ggaaactgtgatccaactctcagaa

SEQ ID NO: 581433 - DNA, 25 bp, Mus musculus
ggaaactgtgatctcagctagagac

SEQ ID NO: 581434 - DNA, 25 bp, Mus musculus
ggaaactgtgatgcaactctcagaa

SEQ ID NO: 581435 - DNA, 25 bp, Mus musculus
ggaaactgtgatgtcagctagagac

SEQ ID NO: 581436 - DNA, 25 bp, Mus musculus
ggaaactgtgcaagcctgcattctt

SEQ ID NO: 581437 - DNA, 25 bp, Mus musculus
ggaaactgtgcatgcctgcattctt

SEQ ID NO: 581438 - DNA, 25 bp, Mus musculus
ggaaactgtgcccactatcagaagg

SEQ ID NO: 581439 - DNA, 25 bp, Mus musculus
ggaaactgtgccgactatcagaagg

SEQ ID NO: 581440 - DNA, 25 bp, Mus musculus
ggaaactgtggaatgctaattcccc

SEQ ID NO: 581441 - DNA, 25 bp, Mus musculus
ggaaactgtggattgctaattcccc

SEQ ID NO: 581442 - DNA, 25 bp, Mus musculus
ggaaactgtttcagttcgagctaga

SEQ ID NO: 581443 - DNA, 25 bp, Mus musculus
ggaaactgtttctgttcgagctaga

SEQ ID NO: 581444 - DNA, 25 bp, Mus musculus
ggaaacttaacccacattgctgagg

SEQ ID NO: 581445 - DNA, 25 bp, Mus musculus
ggaaacttaacccatcagaggacag

SEQ ID NO: 581446 - DNA, 25 bp, Mus musculus
ggaaacttaaccgacattgctgagg

SEQ ID NO: 581447 - DNA, 25 bp, Mus musculus
ggaaacttaaccgatcagaggacag

SEQ ID NO: 581448 - DNA, 25 bp, Mus musculus
ggaaacttaatgcagaaacatctaa

SEQ ID NO: 581449 - DNA, 25 bp, Mus musculus
ggaaacttaatggagaaacatctaa

SEQ ID NO: 581450 - DNA, 25 bp, Mus musculus
ggaaacttacagaacacttttctat

SEQ ID NO: 581451 - DNA, 25 bp, Mus musculus
ggaaacttacagtacacttttctat

SEQ ID NO: 581452 - DNA, 25 bp, Mus musculus
ggaaacttcaagctctgtctcatct

SEQ ID NO: 581453 - DNA, 25 bp, Mus musculus
ggaaacttcaaggtctgtctcatct

SEQ ID NO: 581454 - DNA, 25 bp, Mus musculus
ggaaacttcacaaagctgtcctcac

SEQ ID NO: 581455 - DNA, 25 bp, Mus musculus
ggaaacttcacactcctggacattt

SEQ ID NO: 581456 - DNA, 25 bp, Mus musculus
ggaaacttcacagtcctggacattt

SEQ ID NO: 581457 - DNA, 25 bp, Mus musculus
ggaaacttcacatagctgtcctcac

SEQ ID NO: 581458 - DNA, 25 bp, Mus musculus
ggaaacttcagcctctatgctttga

SEQ ID NO: 581459 - DNA, 25 bp, Mus musculus
ggaaacttcagcgtctatgctttga

SEQ ID NO: 581460 - DNA, 25 bp, Mus musculus
ggaaacttcctaagacagaggttta

SEQ ID NO: 581461 - DNA, 25 bp, Mus musculus
ggaaacttcctatgacagaggttta

SEQ ID NO: 581462 - DNA, 25 bp, Mus musculus
ggaaacttcctcaggtttctccata

SEQ ID NO: 581463 - DNA, 25 bp, Mus musculus
ggaaacttcctctggtttctccata

SEQ ID NO: 581464 - DNA, 25 bp, Mus musculus
ggaaacttcctgacttatttctaag

SEQ ID NO: 581465 - DNA, 25 bp, Mus musculus
ggaaacttcctgtcttatttctaag

SEQ ID NO: 581466 - DNA, 25 bp, Mus musculus
ggaaacttcgcaccgtcatggacga

SEQ ID NO: 581467 - DNA, 25 bp, Mus musculus
ggaaacttcgcagcgtcatggacga

SEQ ID NO: 581468 - DNA, 25 bp, Mus musculus
ggaaacttcgctccatctttggaaa

SEQ ID NO: 581469 - DNA, 25 bp, Mus musculus
ggaaacttcgctgcatctttggaaa

SEQ ID NO: 581470 - DNA, 25 bp, Mus musculus
ggaaacttcgtaatctgatctctga

SEQ ID NO: 581471 - DNA, 25 bp, Mus musculus
ggaaacttcgtattctgatctctga

SEQ ID NO: 581472 - DNA, 25 bp, Mus musculus
ggaaacttctccatagagctaagtc

SEQ ID NO: 581473 - DNA, 25 bp, Mus musculus
ggaaacttctccttagagctaagtc

SEQ ID NO: 581474 - DNA, 25 bp, Mus musculus
ggaaacttgagactccaccagcttc

SEQ ID NO: 581475 - DNA, 25 bp, Mus musculus
ggaaacttgagagtccaccagcttc

SEQ ID NO: 581476 - DNA, 25 bp, Mus musculus
ggaaacttgagccttcagttgccac

SEQ ID NO: 581477 - DNA, 25 bp, Mus musculus
ggaaacttgagcgttcagttgccac

SEQ ID NO: 581478 - DNA, 25 bp, Mus musculus
ggaaacttgagtccagaacctagac

SEQ ID NO: 581479 - DNA, 25 bp, Mus musculus
ggaaacttgagtgcagaacctagac

SEQ ID NO: 581480 - DNA, 25 bp, Mus musculus
ggaaacttgcccatagactgtttga

SEQ ID NO: 581481 - DNA, 25 bp, Mus musculus
ggaaacttgcccttagactgtttga

SEQ ID NO: 581482 - DNA, 25 bp, Mus musculus
ggaaacttgcctattagctgactgc

SEQ ID NO: 581483 - DNA, 25 bp, Mus musculus
ggaaacttgccttttagctgactgc

SEQ ID NO: 581484 - DNA, 25 bp, Mus musculus
ggaaacttgcgactgcacacgcgcg

SEQ ID NO: 581485 - DNA, 25 bp, Mus musculus
ggaaacttgcgagtgcacacgcgcg

SEQ ID NO: 581486 - DNA, 25 bp, Mus musculus
ggaaacttggctaacgcaacctcta

SEQ ID NO: 581487 - DNA, 25 bp, Mus musculus
ggaaacttggcttacgcaacctcta

SEQ ID NO: 581488 - DNA, 25 bp, Mus musculus
ggaaacttgggactattatctacct

SEQ ID NO: 581489 - DNA, 25 bp, Mus musculus
ggaaacttgggagtattatctacct

SEQ ID NO: 581490 - DNA, 25 bp, Mus musculus
ggaaacttggtgacaagccttcccg

SEQ ID NO: 581491 - DNA, 25 bp, Mus musculus
ggaaacttggtgtcaagccttcccg

SEQ ID NO: 581492 - DNA, 25 bp, Mus musculus
ggaaacttggttacatgtatctatc

SEQ ID NO: 581493 - DNA, 25 bp, Mus musculus
ggaaacttggtttcatgtatctatc

SEQ ID NO: 581494 - DNA, 25 bp, Mus musculus
ggaaactttagaccccacaatgata

SEQ ID NO: 581495 - DNA, 25 bp, Mus musculus
ggaaactttagagcccacaatgata

SEQ ID NO: 581496 - DNA, 25 bp, Mus musculus
ggaaactttcagacatttcccacag

SEQ ID NO: 581497 - DNA, 25 bp, Mus musculus
ggaaactttcagtcatttcccacag

SEQ ID NO: 581498 - DNA, 25 bp, Mus musculus
ggaaactttctgatttccaatctga

SEQ ID NO: 581499 - DNA, 25 bp, Mus musculus
ggaaactttctgttttccaatctga

SEQ ID NO: 581500 - DNA, 25 bp, Mus musculus
ggaaacttttacatcacagaactag

SEQ ID NO: 581501 - DNA, 25 bp, Mus musculus
ggaaacttttacttcacagaactag

SEQ ID NO: 581502 - DNA, 25 bp, Mus musculus
ggaaacttttgtaagctatccacct

SEQ ID NO: 581503 - DNA, 25 bp, Mus musculus
ggaaacttttgttagctatccacct

SEQ ID NO: 581504 - DNA, 25 bp, Mus musculus
ggaaagaaacagacactattgctat

SEQ ID NO: 581505 - DNA, 25 bp, Mus musculus
ggaaagaaacagtcactattgctat

SEQ ID NO: 581506 - DNA, 25 bp, Mus musculus
ggaaagaaacccacaacctgcattt

SEQ ID NO: 581507 - DNA, 25 bp, Mus musculus
ggaaagaaaccctcaacctgcattt

SEQ ID NO: 581508 - DNA, 25 bp, Mus musculus
ggaaagaaagatccctccaagtcaa

SEQ ID NO: 581509 - DNA, 25 bp, Mus musculus
ggaaagaaagatgcctccaagtcaa

SEQ ID NO: 581510 - DNA, 25 bp, Mus musculus
ggaaagaacaaaaacccctgattga

SEQ ID NO: 581511 - DNA, 25 bp, Mus musculus
ggaaagaacaaatacccctgattga

SEQ ID NO: 581512 - DNA, 25 bp, Mus musculus
ggaaagaacaccaccaaggcaggca

SEQ ID NO: 581513 - DNA, 25 bp, Mus musculus
ggaaagaacacctccaaggcaggca

SEQ ID NO: 581514 - DNA, 25 bp, Mus musculus
ggaaagaacacgcatcctgctggtt

SEQ ID NO: 581515 - DNA, 25 bp, Mus musculus
ggaaagaacacggatcctgctggtt

SEQ ID NO: 581516 - DNA, 25 bp, Mus musculus
ggaaagaacagcctgctcctgagct

SEQ ID NO: 581517 - DNA, 25 bp, Mus musculus
ggaaagaacagcgtgctcctgagct

SEQ ID NO: 581518 - DNA, 25 bp, Mus musculus
ggaaagaacgtaccatcagccggca

SEQ ID NO: 581519 - DNA, 25 bp, Mus musculus
ggaaagaacgtagcatcagccggca

SEQ ID NO: 581520 - DNA, 25 bp, Mus musculus
ggaaagaactctcctcataggtgag

SEQ ID NO: 581521 - DNA, 25 bp, Mus musculus
ggaaagaactctgctcataggtgag

SEQ ID NO: 581522 - DNA, 25 bp, Mus musculus
ggaaagaagaaccaagctctatttt

SEQ ID NO: 581523 - DNA, 25 bp, Mus musculus
ggaaagaagaacgaagctctatttt

SEQ ID NO: 581524 - DNA, 25 bp, Mus musculus
ggaaagaaggctctgcccactgagc

SEQ ID NO: 581525 - DNA, 25 bp, Mus musculus
ggaaagaaggctgtgcccactgagc

SEQ ID NO: 581526 - DNA, 25 bp, Mus musculus
ggaaagaatactccatccccagtgt

SEQ ID NO: 581527 - DNA, 25 bp, Mus musculus
ggaaagaatactgcatccccagtgt

SEQ ID NO: 581528 - DNA, 25 bp, Mus musculus
ggaaagacaacacacgtgcctctgt

SEQ ID NO: 581529 - DNA, 25 bp, Mus musculus
ggaaagacaacagacgtgcctctgt

SEQ ID NO: 581530 - DNA, 25 bp, Mus musculus
ggaaagacaaccatctcaatgcctg

SEQ ID NO: 581531 - DNA, 25 bp, Mus musculus
ggaaagacaaccttctcaatgcctg

SEQ ID NO: 581532 - DNA, 25 bp, Mus musculus
ggaaagacagctccaggtccacagg

SEQ ID NO: 581533 - DNA, 25 bp, Mus musculus
ggaaagacagctgcaggtccacagg

SEQ ID NO: 581534 - DNA, 25 bp, Mus musculus
ggaaagacagtgcagtctcctccat

SEQ ID NO: 581535 - DNA, 25 bp, Mus musculus
ggaaagacagtggagtctcctccat

SEQ ID NO: 581536 - DNA, 25 bp, Mus musculus
ggaaagacatccacctagttgataa

SEQ ID NO: 581537 - DNA, 25 bp, Mus musculus
ggaaagacatcctcctagttgataa

SEQ ID NO: 581538 - DNA, 25 bp, Mus musculus
ggaaagacatgcagtgtagataatg

SEQ ID NO: 581539 - DNA, 25 bp, Mus musculus
ggaaagacatgctgtgtagataatg

SEQ ID NO: 581540 - DNA, 25 bp, Mus musculus
ggaaagacattcacaggtcccagat

SEQ ID NO: 581541 - DNA, 25 bp, Mus musculus
ggaaagacattctcaggtcccagat

SEQ ID NO: 581542 - DNA, 25 bp, Mus musculus
ggaaagaccaaactgcaaacgtgca

SEQ ID NO: 581543 - DNA, 25 bp, Mus musculus
ggaaagaccaaagtgcaaacgtgca

SEQ ID NO: 581544 - DNA, 25 bp, Mus musculus
ggaaagaccactaagagcaccacta

SEQ ID NO: 581545 - DNA, 25 bp, Mus musculus
ggaaagaccacttagagcaccacta

SEQ ID NO: 581546 - DNA, 25 bp, Mus musculus
ggaaagaccattctgtatttttctg

SEQ ID NO: 581547 - DNA, 25 bp, Mus musculus
ggaaagaccattgtgtatttttctg

SEQ ID NO: 581548 - DNA, 25 bp, Mus musculus
ggaaagacccttcgagcttgtgcat

SEQ ID NO: 581549 - DNA, 25 bp, Mus musculus
ggaaagacccttggagcttgtgcat

SEQ ID NO: 581550 - DNA, 25 bp, Mus musculus
ggaaagacgagcatagccgaacccc

SEQ ID NO: 581551 - DNA, 25 bp, Mus musculus
ggaaagacgagcttagccgaacccc

SEQ ID NO: 581552 - DNA, 25 bp, Mus musculus
ggaaagactacacggcccaatccag

SEQ ID NO: 581553 - DNA, 25 bp, Mus musculus
ggaaagactacagggcccaatccag

SEQ ID NO: 581554 - DNA, 25 bp, Mus musculus
ggaaagactgccacattctgttata

SEQ ID NO: 581555 - DNA, 25 bp, Mus musculus
ggaaagactgcctcattctgttata

SEQ ID NO: 581556 - DNA, 25 bp, Mus musculus
ggaaagactgctaccatcataattt

SEQ ID NO: 581557 - DNA, 25 bp, Mus musculus
ggaaagactgcttccatcataattt

SEQ ID NO: 581558 - DNA, 25 bp, Mus musculus
ggaaagactggaaccttcaggtaca

SEQ ID NO: 581559 - DNA, 25 bp, Mus musculus
ggaaagactggatccttcaggtaca

SEQ ID NO: 581560 - DNA, 25 bp, Mus musculus
ggaaagacttcactccctatgacta

SEQ ID NO: 581561 - DNA, 25 bp, Mus musculus
ggaaagacttcagtccctatgacta

SEQ ID NO: 581562 - DNA, 25 bp, Mus musculus
ggaaagagaaacaccctcgactgcc

SEQ ID NO: 581563 - DNA, 25 bp, Mus musculus
ggaaagagaaactccctcgactgcc

SEQ ID NO: 581564 - DNA, 25 bp, Mus musculus
ggaaagagacctaatggagcaaaca

SEQ ID NO: 581565 - DNA, 25 bp, Mus musculus
ggaaagagaccttatggagcaaaca

SEQ ID NO: 581566 - DNA, 25 bp, Mus musculus
ggaaagagcacacaaccctgcgagt

SEQ ID NO: 581567 - DNA, 25 bp, Mus musculus
ggaaagagcacagaaccctgcgagt

SEQ ID NO: 581568 - DNA, 25 bp, Mus musculus
ggaaagagccaactgcatttcttaa

SEQ ID NO: 581569 - DNA, 25 bp, Mus musculus
ggaaagagccaagtgcatttcttaa

SEQ ID NO: 581570 - DNA, 25 bp, Mus musculus
ggaaagagcctgacatccccttata

SEQ ID NO: 581571 - DNA, 25 bp, Mus musculus
ggaaagagcctgtcatccccttata

SEQ ID NO: 581572 - DNA, 25 bp, Mus musculus
ggaaagaggactacctgggtccata

SEQ ID NO: 581573 - DNA, 25 bp, Mus musculus
ggaaagaggacttcctgggtccata

SEQ ID NO: 581574 - DNA, 25 bp, Mus musculus
ggaaagaggagcatacccttcactt

SEQ ID NO: 581575 - DNA, 25 bp, Mus musculus
ggaaagaggagcttacccttcactt

SEQ ID NO: 581576 - DNA, 25 bp, Mus musculus
ggaaagaggattccctacttccctg

SEQ ID NO: 581577 - DNA, 25 bp, Mus musculus
ggaaagaggattgcctacttccctg

SEQ ID NO: 581578 - DNA, 25 bp, Mus musculus
ggaaagaggtctactgtcaactgca

SEQ ID NO: 581579 - DNA, 25 bp, Mus musculus
ggaaagaggtcttctgtcaactgca

SEQ ID NO: 581580 - DNA, 25 bp, Mus musculus
ggaaagagtcaccttacctgtgaat

SEQ ID NO: 581581 - DNA, 25 bp, Mus musculus
ggaaagagtcacgttacctgtgaat

SEQ ID NO: 581582 - DNA, 25 bp, Mus musculus
ggaaagagtcttccacacagttgtg

SEQ ID NO: 581583 - DNA, 25 bp, Mus musculus
ggaaagagtcttgcacacagttgtg

SEQ ID NO: 581584 - DNA, 25 bp, Mus musculus
ggaaagagtgccctgaccatccagc

SEQ ID NO: 581585 - DNA, 25 bp, Mus musculus
ggaaagagtgccgtgaccatccagc

SEQ ID NO: 581586 - DNA, 25 bp, Mus musculus
ggaaagagtggtccccagtgctacc

SEQ ID NO: 581587 - DNA, 25 bp, Mus musculus
ggaaagagtggtgcccagtgctacc

SEQ ID NO: 581588 - DNA, 25 bp, Mus musculus
ggaaagagtttcatgcgatcctccg

SEQ ID NO: 581589 - DNA, 25 bp, Mus musculus
ggaaagagtttcttgcgatcctccg

SEQ ID NO: 581590 - DNA, 25 bp, Mus musculus
ggaaagataaaacagttcccacagg

SEQ ID NO: 581591 - DNA, 25 bp, Mus musculus
ggaaagataaaagagttcccacagg

SEQ ID NO: 581592 - DNA, 25 bp, Mus musculus
ggaaagataaacactcctcctcagt

SEQ ID NO: 581593 - DNA, 25 bp, Mus musculus
ggaaagataaactctcctcctcagt

SEQ ID NO: 581594 - DNA, 25 bp, Mus musculus
ggaaagataaccaccatctgctcta

SEQ ID NO: 581595 - DNA, 25 bp, Mus musculus
ggaaagataacctccatctgctcta

SEQ ID NO: 581596 - DNA, 25 bp, Mus musculus
ggaaagataccacctcctgcgtggg

SEQ ID NO: 581597 - DNA, 25 bp, Mus musculus
ggaaagataccagctcctgcgtggg

SEQ ID NO: 581598 - DNA, 25 bp, Mus musculus
ggaaagatcagcagtagccgggcat

SEQ ID NO: 581599 - DNA, 25 bp, Mus musculus
ggaaagatcagctgtagccgggcat

SEQ ID NO: 581600 - DNA, 25 bp, Mus musculus
ggaaagatccttaagagcacgtgtt

SEQ ID NO: 581601 - DNA, 25 bp, Mus musculus
ggaaagatccttaggcagccacaac

SEQ ID NO: 581602 - DNA, 25 bp, Mus musculus
ggaaagatcctttagagcacgtgtt

SEQ ID NO: 581603 - DNA, 25 bp, Mus musculus
ggaaagatcctttggcagccacaac

SEQ ID NO: 581604 - DNA, 25 bp, Mus musculus
ggaaagatctagaataccagggtga

SEQ ID NO: 581605 - DNA, 25 bp, Mus musculus
ggaaagatctagtataccagggtga

SEQ ID NO: 581606 - DNA, 25 bp, Mus musculus
ggaaagatctcgctctcgccacaat

SEQ ID NO: 581607 - DNA, 25 bp, Mus musculus
ggaaagatctcggtctcgccacaat

SEQ ID NO: 581608 - DNA, 25 bp, Mus musculus
ggaaagatggagacaaatacttcca

SEQ ID NO: 581609 - DNA, 25 bp, Mus musculus
ggaaagatggagtcaaatacttcca

SEQ ID NO: 581610 - DNA, 25 bp, Mus musculus
ggaaagatggctctactctgacatt

SEQ ID NO: 581611 - DNA, 25 bp, Mus musculus
ggaaagatggctgtactctgacatt

SEQ ID NO: 581612 - DNA, 25 bp, Mus musculus
ggaaagatgtccctgtctctcattt

SEQ ID NO: 581613 - DNA, 25 bp, Mus musculus
ggaaagatgtccgtgtctctcattt

SEQ ID NO: 581614 - DNA, 25 bp, Mus musculus
ggaaagatgtttctacctcaggtta

SEQ ID NO: 581615 - DNA, 25 bp, Mus musculus
ggaaagatgtttgtacctcaggtta

SEQ ID NO: 581616 - DNA, 25 bp, Mus musculus
ggaaagattaataatctgcttcggg

SEQ ID NO: 581617 - DNA, 25 bp, Mus musculus
ggaaagattaattatctgcttcggg

SEQ ID NO: 581618 - DNA, 25 bp, Mus musculus
ggaaagattgctctggattctgctt

SEQ ID NO: 581619 - DNA, 25 bp, Mus musculus
ggaaagattgctgtggattctgctt

SEQ ID NO: 581620 - DNA, 25 bp, Mus musculus
ggaaagatttcaaatgcccagctat

SEQ ID NO: 581621 - DNA, 25 bp, Mus musculus
ggaaagatttcatatgcccagctat

SEQ ID NO: 581622 - DNA, 25 bp, Mus musculus
ggaaagatttgcaccctgtatgtgc

SEQ ID NO: 581623 - DNA, 25 bp, Mus musculus
ggaaagatttgctccctgtatgtgc

SEQ ID NO: 581624 - DNA, 25 bp, Mus musculus
ggaaagatttgtataagctgctact

SEQ ID NO: 581625 - DNA, 25 bp, Mus musculus
ggaaagatttgtttaagctgctact

SEQ ID NO: 581626 - DNA, 25 bp, Mus musculus
ggaaagcaaaagctgtgcccacttc

SEQ ID NO: 581627 - DNA, 25 bp, Mus musculus
ggaaagcaaaaggtgtgcccacttc

SEQ ID NO: 581628 - DNA, 25 bp, Mus musculus
ggaaagcaaaatctaactgtactta

SEQ ID NO: 581629 - DNA, 25 bp, Mus musculus
ggaaagcaaaatgtaactgtactta

SEQ ID NO: 581630 - DNA, 25 bp, Mus musculus
ggaaagcaacttcatacacgagttt

SEQ ID NO: 581631 - DNA, 25 bp, Mus musculus
ggaaagcaacttgatacacgagttt

SEQ ID NO: 581632 - DNA, 25 bp, Mus musculus
ggaaagcaagaaaactgtgaagatg

SEQ ID NO: 581633 - DNA, 25 bp, Mus musculus
ggaaagcaagaatactgtgaagatg

SEQ ID NO: 581634 - DNA, 25 bp, Mus musculus
ggaaagcaatgcaccccaggataaa

SEQ ID NO: 581635 - DNA, 25 bp, Mus musculus
ggaaagcaatgcatagccccaagca

SEQ ID NO: 581636 - DNA, 25 bp, Mus musculus
ggaaagcaatgctccccaggataaa

SEQ ID NO: 581637 - DNA, 25 bp, Mus musculus
ggaaagcaatgcttagccccaagca

SEQ ID NO: 581638 - DNA, 25 bp, Mus musculus
ggaaagcaccataggagcggccttc

SEQ ID NO: 581639 - DNA, 25 bp, Mus musculus
ggaaagcaccattggagcggccttc

SEQ ID NO: 581640 - DNA, 25 bp, Mus musculus
ggaaagcacctgcacgcggtcgcct

SEQ ID NO: 581641 - DNA, 25 bp, Mus musculus
ggaaagcacctggacgcggtcgcct

SEQ ID NO: 581642 - DNA, 25 bp, Mus musculus
ggaaagcaccttaagccgtggagcc

SEQ ID NO: 581643 - DNA, 25 bp, Mus musculus
ggaaagcacctttagccgtggagcc

SEQ ID NO: 581644 - DNA, 25 bp, Mus musculus
ggaaagcactatctagatcacactt

SEQ ID NO: 581645 - DNA, 25 bp, Mus musculus
ggaaagcactatgtagatcacactt

SEQ ID NO: 581646 - DNA, 25 bp, Mus musculus
ggaaagcactgtatctgtccccgtg

SEQ ID NO: 581647 - DNA, 25 bp, Mus musculus
ggaaagcactgtttctgtccccgtg

SEQ ID NO: 581648 - DNA, 25 bp, Mus musculus
ggaaagcagcatagactgaagacct

SEQ ID NO: 581649 - DNA, 25 bp, Mus musculus
ggaaagcagcattgactgaagacct

SEQ ID NO: 581650 - DNA, 25 bp, Mus musculus
ggaaagcagccaataccaagtgtgt

SEQ ID NO: 581651 - DNA, 25 bp, Mus musculus
ggaaagcagccattaccaagtgtgt

SEQ ID NO: 581652 - DNA, 25 bp, Mus musculus
ggaaagcagcctaccgagagcttct

SEQ ID NO: 581653 - DNA, 25 bp, Mus musculus
ggaaagcagccttccgagagcttct

SEQ ID NO: 581654 - DNA, 25 bp, Mus musculus
ggaaagcaggccatggaagatgaca

SEQ ID NO: 581655 - DNA, 25 bp, Mus musculus
ggaaagcaggccttggaagatgaca

SEQ ID NO: 581656 - DNA, 25 bp, Mus musculus
ggaaagcatccaccaatagccctgc

SEQ ID NO: 581657 - DNA, 25 bp, Mus musculus
ggaaagcatccacgctcagcgcact

SEQ ID NO: 581658 - DNA, 25 bp, Mus musculus
ggaaagcatccagcaatagccctgc

SEQ ID NO: 581659 - DNA, 25 bp, Mus musculus
ggaaagcatccaggctcagcgcact

SEQ ID NO: 581660 - DNA, 25 bp, Mus musculus
ggaaagcatcccacaagcacagaaa

SEQ ID NO: 581661 - DNA, 25 bp, Mus musculus
ggaaagcatccctcaagcacagaaa

SEQ ID NO: 581662 - DNA, 25 bp, Mus musculus
ggaaagcatcgaaccgcattcatct

SEQ ID NO: 581663 - DNA, 25 bp, Mus musculus
ggaaagcatcgatccgcattcatct

SEQ ID NO: 581664 - DNA, 25 bp, Mus musculus
ggaaagcatcgtagactcctaccgt

SEQ ID NO: 581665 - DNA, 25 bp, Mus musculus
ggaaagcatcgttgactcctaccgt

SEQ ID NO: 581666 - DNA, 25 bp, Mus musculus
ggaaagcatgtaagcggccctctac

SEQ ID NO: 581667 - DNA, 25 bp, Mus musculus
ggaaagcatgtatgcggccctctac

SEQ ID NO: 581668 - DNA, 25 bp, Mus musculus
ggaaagcatttgaagcatgcccaaa

SEQ ID NO: 581669 - DNA, 25 bp, Mus musculus
ggaaagcatttgtagcatgcccaaa

SEQ ID NO: 581670 - DNA, 25 bp, Mus musculus
ggaaagccaaccataagtgccagtg

SEQ ID NO: 581671 - DNA, 25 bp, Mus musculus
ggaaagccaaccttaagtgccagtg

SEQ ID NO: 581672 - DNA, 25 bp, Mus musculus
ggaaagccaagaacagctctgccac

SEQ ID NO: 581673 - DNA, 25 bp, Mus musculus
ggaaagccaagatcagctctgccac

SEQ ID NO: 581674 - DNA, 25 bp, Mus musculus
ggaaagccaagtcccatcttcaaaa

SEQ ID NO: 581675 - DNA, 25 bp, Mus musculus
ggaaagccaagtgccatcttcaaaa

SEQ ID NO: 581676 - DNA, 25 bp, Mus musculus
ggaaagccaccacgatgcggacatt

SEQ ID NO: 581677 - DNA, 25 bp, Mus musculus
ggaaagccaccaggatgcggacatt

SEQ ID NO: 581678 - DNA, 25 bp, Mus musculus
ggaaagccactaagaccctgggcat

SEQ ID NO: 581679 - DNA, 25 bp, Mus musculus
ggaaagccactatgaccctgggcat

SEQ ID NO: 581680 - DNA, 25 bp, Mus musculus
ggaaagccactgaccctttgctgtt

SEQ ID NO: 581681 - DNA, 25 bp, Mus musculus
ggaaagccactgtccctttgctgtt

SEQ ID NO: 581682 - DNA, 25 bp, Mus musculus
ggaaagccagctaccaggtcatgaa

SEQ ID NO: 581683 - DNA, 25 bp, Mus musculus
ggaaagccagcttccaggtcatgaa

SEQ ID NO: 581684 - DNA, 25 bp, Mus musculus
ggaaagccagtcactgaggcgcagg

SEQ ID NO: 581685 - DNA, 25 bp, Mus musculus
ggaaagccagtctctgaggcgcagg

SEQ ID NO: 581686 - DNA, 25 bp, Mus musculus
ggaaagccatcacagaccctggctc

SEQ ID NO: 581687 - DNA, 25 bp, Mus musculus
ggaaagccatcagagaccctggctc

SEQ ID NO: 581688 - DNA, 25 bp, Mus musculus
ggaaagccatgtatgcccggttcac

SEQ ID NO: 581689 - DNA, 25 bp, Mus musculus
ggaaagccatgtcaaggttaggatt

SEQ ID NO: 581690 - DNA, 25 bp, Mus musculus
ggaaagccatgtgaaggttaggatt

SEQ ID NO: 581691 - DNA, 25 bp, Mus musculus
ggaaagccatgtttgcccggttcac

SEQ ID NO: 581692 - DNA, 25 bp, Mus musculus
ggaaagccccatattctggtacgca

SEQ ID NO: 581693 - DNA, 25 bp, Mus musculus
ggaaagccccattttctggtacgca

SEQ ID NO: 581694 - DNA, 25 bp, Mus musculus
ggaaagccctgaccttattaggaat

SEQ ID NO: 581695 - DNA, 25 bp, Mus musculus
ggaaagccctgagcttattaggaat

SEQ ID NO: 581696 - DNA, 25 bp, Mus musculus
ggaaagcccttcatactgtgtataa

SEQ ID NO: 581697 - DNA, 25 bp, Mus musculus
ggaaagcccttcttactgtgtataa

SEQ ID NO: 581698 - DNA, 25 bp, Mus musculus
ggaaagccgaagcacctgaagtaca

SEQ ID NO: 581699 - DNA, 25 bp, Mus musculus
ggaaagccgaaggacctgaagtaca

SEQ ID NO: 581700 - DNA, 25 bp, Mus musculus
ggaaagccggatccggcccatgaat

SEQ ID NO: 581701 - DNA, 25 bp, Mus musculus
ggaaagccggatgcggcccatgaat

SEQ ID NO: 581702 - DNA, 25 bp, Mus musculus
ggaaagccgtgaagagccagcattt

SEQ ID NO: 581703 - DNA, 25 bp, Mus musculus
ggaaagccgtgatgagccagcattt

SEQ ID NO: 581704 - DNA, 25 bp, Mus musculus
ggaaagccgtttcctctatgaggct

SEQ ID NO: 581705 - DNA, 25 bp, Mus musculus
ggaaagccgtttgctctatgaggct

SEQ ID NO: 581706 - DNA, 25 bp, Mus musculus
ggaaagcctcaacaacaccggcagc

SEQ ID NO: 581707 - DNA, 25 bp, Mus musculus
ggaaagcctcaagaacaccggcagc

SEQ ID NO: 581708 - DNA, 25 bp, Mus musculus
ggaaagcctggcatccgccggatga

SEQ ID NO: 581709 - DNA, 25 bp, Mus musculus
ggaaagcctggcttccgccggatga

SEQ ID NO: 581710 - DNA, 25 bp, Mus musculus
ggaaagccttcaaccagactgcaaa

SEQ ID NO: 581711 - DNA, 25 bp, Mus musculus
ggaaagccttcatccagactgcaaa

SEQ ID NO: 581712 - DNA, 25 bp, Mus musculus
ggaaagccttcgacagggccacgaa

SEQ ID NO: 581713 - DNA, 25 bp, Mus musculus
ggaaagccttcgtcagggccacgaa

SEQ ID NO: 581714 - DNA, 25 bp, Mus musculus
ggaaagccttttaacaccacagtct

SEQ ID NO: 581715 - DNA, 25 bp, Mus musculus
ggaaagcctttttacaccacagtct

SEQ ID NO: 581716 - DNA, 25 bp, Mus musculus
ggaaagcgatacatctccagacttc

SEQ ID NO: 581717 - DNA, 25 bp, Mus musculus
ggaaagcgatacttctccagacttc

SEQ ID NO: 581718 - DNA, 25 bp, Mus musculus
ggaaagcgcctcagagtccagcgcg

SEQ ID NO: 581719 - DNA, 25 bp, Mus musculus
ggaaagcgcctctgagtccagcgcg

SEQ ID NO: 581720 - DNA, 25 bp, Mus musculus
ggaaagcgggaacctggccatcttc

SEQ ID NO: 581721 - DNA, 25 bp, Mus musculus
ggaaagcgggaagctggccatcttc

SEQ ID NO: 581722 - DNA, 25 bp, Mus musculus
ggaaagcggtacattctgtggaaat

SEQ ID NO: 581723 - DNA, 25 bp, Mus musculus
ggaaagcggtactttctgtggaaat

SEQ ID NO: 581724 - DNA, 25 bp, Mus musculus
ggaaagcgttcacctgttccacata

SEQ ID NO: 581725 - DNA, 25 bp, Mus musculus
ggaaagcgttcagctgttccacata

SEQ ID NO: 581726 - DNA, 25 bp, Mus musculus
ggaaagctactcataggaacctgca

SEQ ID NO: 581727 - DNA, 25 bp, Mus musculus
ggaaagctactcttaggaacctgca

SEQ ID NO: 581728 - DNA, 25 bp, Mus musculus
ggaaagctatagcagccatgtatat

SEQ ID NO: 581729 - DNA, 25 bp, Mus musculus
ggaaagctataggagccatgtatat

SEQ ID NO: 581730 - DNA, 25 bp, Mus musculus
ggaaagctatccctgtatttttatg

SEQ ID NO: 581731 - DNA, 25 bp, Mus musculus
ggaaagctatccgtgtatttttatg

SEQ ID NO: 581732 - DNA, 25 bp, Mus musculus
ggaaagctatgcagtgccctgggct

SEQ ID NO: 581733 - DNA, 25 bp, Mus musculus
ggaaagctatgccttcaggagagat

SEQ ID NO: 581734 - DNA, 25 bp, Mus musculus
ggaaagctatgcgttcaggagagat

SEQ ID NO: 581735 - DNA, 25 bp, Mus musculus
ggaaagctatgctgtgccctgggct

SEQ ID NO: 581736 - DNA, 25 bp, Mus musculus
ggaaagctcaacagtgctgctaatc

SEQ ID NO: 581737 - DNA, 25 bp, Mus musculus
ggaaagctcaactgtgctgctaatc

SEQ ID NO: 581738 - DNA, 25 bp, Mus musculus
ggaaagctcaatccctctcagtaat

SEQ ID NO: 581739 - DNA, 25 bp, Mus musculus
ggaaagctcaatgcctctcagtaat

SEQ ID NO: 581740 - DNA, 25 bp, Mus musculus
ggaaagctcggacacagcatctcac

SEQ ID NO: 581741 - DNA, 25 bp, Mus musculus
ggaaagctcggagacagcatctcac

SEQ ID NO: 581742 - DNA, 25 bp, Mus musculus
ggaaagctctacattgcgcaatagt

SEQ ID NO: 581743 - DNA, 25 bp, Mus musculus
ggaaagctctactttgcgcaatagt

SEQ ID NO: 581744 - DNA, 25 bp, Mus musculus
ggaaagctctctacgaagcgctgaa

SEQ ID NO: 581745 - DNA, 25 bp, Mus musculus
ggaaagctctcttcgaagcgctgaa

SEQ ID NO: 581746 - DNA, 25 bp, Mus musculus
ggaaagctcttcactaagtgactct

SEQ ID NO: 581747 - DNA, 25 bp, Mus musculus
ggaaagctcttctctaagtgactct

SEQ ID NO: 581748 - DNA, 25 bp, Mus musculus
ggaaagctgagcagctacaaaatga

SEQ ID NO: 581749 - DNA, 25 bp, Mus musculus
ggaaagctgagctgctacaaaatga

SEQ ID NO: 581750 - DNA, 25 bp, Mus musculus
ggaaagctgcagaccttatctttgc

SEQ ID NO: 581751 - DNA, 25 bp, Mus musculus
ggaaagctgcagtccttatctttgc

SEQ ID NO: 581752 - DNA, 25 bp, Mus musculus
ggaaagctgcccaaaaatatagaga

SEQ ID NO: 581753 - DNA, 25 bp, Mus musculus
ggaaagctgccctaaaatatagaga

SEQ ID NO: 581754 - DNA, 25 bp, Mus musculus
ggaaagctgctcatcacgggagaaa

SEQ ID NO: 581755 - DNA, 25 bp, Mus musculus
ggaaagctgctcttcacgggagaaa

SEQ ID NO: 581756 - DNA, 25 bp, Mus musculus
ggaaagctggatcccctgacagagc

SEQ ID NO: 581757 - DNA, 25 bp, Mus musculus
ggaaagctggatgccctgacagagc

SEQ ID NO: 581758 - DNA, 25 bp, Mus musculus
ggaaagctgggcatttgccaggcat

SEQ ID NO: 581759 - DNA, 25 bp, Mus musculus
ggaaagctgggcttttgccaggcat

SEQ ID NO: 581760 - DNA, 25 bp, Mus musculus
ggaaagctgggtctcttctctgaga

SEQ ID NO: 581761 - DNA, 25 bp, Mus musculus
ggaaagctgggtgtcttctctgaga

SEQ ID NO: 581762 - DNA, 25 bp, Mus musculus
ggaaagctgtccactctaaagtgcc

SEQ ID NO: 581763 - DNA, 25 bp, Mus musculus
ggaaagctgtcctctctaaagtgcc

SEQ ID NO: 581764 - DNA, 25 bp, Mus musculus
ggaaagcttaaaatatgcccagtaa

SEQ ID NO: 581765 - DNA, 25 bp, Mus musculus
ggaaagcttaaattatgcccagtaa

SEQ ID NO: 581766 - DNA, 25 bp, Mus musculus
ggaaagcttcttactcagcgagact

SEQ ID NO: 581767 - DNA, 25 bp, Mus musculus
ggaaagcttctttctcagcgagact

SEQ ID NO: 581768 - DNA, 25 bp, Mus musculus
ggaaagcttgctctgttatcgagat

SEQ ID NO: 581769 - DNA, 25 bp, Mus musculus
ggaaagcttgctgtgttatcgagat

SEQ ID NO: 581770 - DNA, 25 bp, Mus musculus
ggaaagctttcgagcagccatggcg

SEQ ID NO: 581771 - DNA, 25 bp, Mus musculus
ggaaagctttcgtgcagccatggcg

SEQ ID NO: 581772 - DNA, 25 bp, Mus musculus
ggaaagctttgccacatttatgtca

SEQ ID NO: 581773 - DNA, 25 bp, Mus musculus
ggaaagctttgcgacatttatgtca

SEQ ID NO: 581774 - DNA, 25 bp, Mus musculus
ggaaagcttttaaccgaagcacaca

SEQ ID NO: 581775 - DNA, 25 bp, Mus musculus
ggaaagcttttatccgaagcacaca

SEQ ID NO: 581776 - DNA, 25 bp, Mus musculus
ggaaaggaacatctacagctctcta

SEQ ID NO: 581777 - DNA, 25 bp, Mus musculus
ggaaaggaacatgtacagctctcta

SEQ ID NO: 581778 - DNA, 25 bp, Mus musculus
ggaaaggaacttcgccagcttaatc

SEQ ID NO: 581779 - DNA, 25 bp, Mus musculus
ggaaaggaacttggccagcttaatc

SEQ ID NO: 581780 - DNA, 25 bp, Mus musculus
ggaaaggaagacaccaccaccattc

SEQ ID NO: 581781 - DNA, 25 bp, Mus musculus
ggaaaggaagactccaccaccattc

SEQ ID NO: 581782 - DNA, 25 bp, Mus musculus
ggaaaggaatctccccagtgtgccc

SEQ ID NO: 581783 - DNA, 25 bp, Mus musculus
ggaaaggaatctgcccagtgtgccc

SEQ ID NO: 581784 - DNA, 25 bp, Mus musculus
ggaaaggacacactgccacgagaaa

SEQ ID NO: 581785 - DNA, 25 bp, Mus musculus
ggaaaggacacagtgccacgagaaa

SEQ ID NO: 581786 - DNA, 25 bp, Mus musculus
ggaaaggacactatacagctcccat

SEQ ID NO: 581787 - DNA, 25 bp, Mus musculus
ggaaaggacactttacagctcccat

SEQ ID NO: 581788 - DNA, 25 bp, Mus musculus
ggaaaggaccccagtggagccccag

SEQ ID NO: 581789 - DNA, 25 bp, Mus musculus
ggaaaggacccctgtggagccccag

SEQ ID NO: 581790 - DNA, 25 bp, Mus musculus
ggaaaggaccgtccagaacccagct

SEQ ID NO: 581791 - DNA, 25 bp, Mus musculus
ggaaaggaccgtgcagaacccagct

SEQ ID NO: 581792 - DNA, 25 bp, Mus musculus
ggaaaggacgcaccttcaacagccc

SEQ ID NO: 581793 - DNA, 25 bp, Mus musculus
ggaaaggacgcagcttcaacagccc

SEQ ID NO: 581794 - DNA, 25 bp, Mus musculus
ggaaaggactcgctcacttggcctt

SEQ ID NO: 581795 - DNA, 25 bp, Mus musculus
ggaaaggactcggtcacttggcctt

SEQ ID NO: 581796 - DNA, 25 bp, Mus musculus
ggaaaggactgactcaacccaacga

SEQ ID NO: 581797 - DNA, 25 bp, Mus musculus
ggaaaggactgagtcaacccaacga

SEQ ID NO: 581798 - DNA, 25 bp, Mus musculus
ggaaaggagaatagccatcaccaga

SEQ ID NO: 581799 - DNA, 25 bp, Mus musculus
ggaaaggagaattgccatcaccaga

SEQ ID NO: 581800 - DNA, 25 bp, Mus musculus
ggaaaggagcaccacttcttggccc

SEQ ID NO: 581801 - DNA, 25 bp, Mus musculus
ggaaaggagcacgacttcttggccc

SEQ ID NO: 581802 - DNA, 25 bp, Mus musculus
ggaaaggagcctacttggcccatat

SEQ ID NO: 581803 - DNA, 25 bp, Mus musculus
ggaaaggagccttcttggcccatat

SEQ ID NO: 581804 - DNA, 25 bp, Mus musculus
ggaaaggatctcagtgcatgtgaca

SEQ ID NO: 581805 - DNA, 25 bp, Mus musculus
ggaaaggatctctgtgcatgtgaca

SEQ ID NO: 581806 - DNA, 25 bp, Mus musculus
ggaaaggatcttcgaccccaaatgt

SEQ ID NO: 581807 - DNA, 25 bp, Mus musculus
ggaaaggatcttggaccccaaatgt

SEQ ID NO: 581808 - DNA, 25 bp, Mus musculus
ggaaaggatgccctggtccagtcct

SEQ ID NO: 581809 - DNA, 25 bp, Mus musculus
ggaaaggatgccgtggtccagtcct

SEQ ID NO: 581810 - DNA, 25 bp, Mus musculus
ggaaaggattctaggaccactacca

SEQ ID NO: 581811 - DNA, 25 bp, Mus musculus
ggaaaggattcttggaccactacca

SEQ ID NO: 581812 - DNA, 25 bp, Mus musculus
ggaaaggattttcctgctgttaaat

SEQ ID NO: 581813 - DNA, 25 bp, Mus musculus
ggaaaggattttgctgctgttaaat

SEQ ID NO: 581814 - DNA, 25 bp, Mus musculus
ggaaaggcacaaatggatgcatcta

SEQ ID NO: 581815 - DNA, 25 bp, Mus musculus
ggaaaggcacaattggatgcatcta

SEQ ID NO: 581816 - DNA, 25 bp, Mus musculus
ggaaaggcacacctacattctcagc

SEQ ID NO: 581817 - DNA, 25 bp, Mus musculus
ggaaaggcacacgtacattctcagc

SEQ ID NO: 581818 - DNA, 25 bp, Mus musculus
ggaaaggcacctacttcttttatag

SEQ ID NO: 581819 - DNA, 25 bp, Mus musculus
ggaaaggcaccttcttcttttatag

SEQ ID NO: 581820 - DNA, 25 bp, Mus musculus
ggaaaggcacgcagttagccactgc

SEQ ID NO: 581821 - DNA, 25 bp, Mus musculus
ggaaaggcacgctgttagccactgc

SEQ ID NO: 581822 - DNA, 25 bp, Mus musculus
ggaaaggcatctcaccatgcagaat

SEQ ID NO: 581823 - DNA, 25 bp, Mus musculus
ggaaaggcatctgaccatgcagaat

SEQ ID NO: 581824 - DNA, 25 bp, Mus musculus
ggaaaggccagaccaacattttgct

SEQ ID NO: 581825 - DNA, 25 bp, Mus musculus
ggaaaggccagagcaacattttgct

SEQ ID NO: 581826 - DNA, 25 bp, Mus musculus
ggaaaggccatgcagagacttaata

SEQ ID NO: 581827 - DNA, 25 bp, Mus musculus
ggaaaggccatggagagacttaata

SEQ ID NO: 581828 - DNA, 25 bp, Mus musculus
ggaaaggcctatcttgttaaagaga

SEQ ID NO: 581829 - DNA, 25 bp, Mus musculus
ggaaaggcctatgttgttaaagaga

SEQ ID NO: 581830 - DNA, 25 bp, Mus musculus
ggaaaggcctgaaatgtgtgtgcat

SEQ ID NO: 581831 - DNA, 25 bp, Mus musculus
ggaaaggcctgaactccaatttagt

SEQ ID NO: 581832 - DNA, 25 bp, Mus musculus
ggaaaggcctgatatgtgtgtgcat

SEQ ID NO: 581833 - DNA, 25 bp, Mus musculus
ggaaaggcctgatctccaatttagt

SEQ ID NO: 581834 - DNA, 25 bp, Mus musculus
ggaaaggcgactcctctaacttcac

SEQ ID NO: 581835 - DNA, 25 bp, Mus musculus
ggaaaggcgactgctctaacttcac

SEQ ID NO: 581836 - DNA, 25 bp, Mus musculus
ggaaaggcgcgtctcggcttctcac

SEQ ID NO: 581837 - DNA, 25 bp, Mus musculus
ggaaaggcgcgtgtcggcttctcac

SEQ ID NO: 581838 - DNA, 25 bp, Mus musculus
ggaaaggctacgctagtcacagtga

SEQ ID NO: 581839 - DNA, 25 bp, Mus musculus
ggaaaggctacggtagtcacagtga

SEQ ID NO: 581840 - DNA, 25 bp, Mus musculus
ggaaaggctagcagtctccacatac

SEQ ID NO: 581841 - DNA, 25 bp, Mus musculus
ggaaaggctagctgtctccacatac

SEQ ID NO: 581842 - DNA, 25 bp, Mus musculus
ggaaaggctataaatactgcttgta

SEQ ID NO: 581843 - DNA, 25 bp, Mus musculus
ggaaaggctatatatactgcttgta

SEQ ID NO: 581844 - DNA, 25 bp, Mus musculus
ggaaaggctatccatctctctgtac

SEQ ID NO: 581845 - DNA, 25 bp, Mus musculus
ggaaaggctatcgatctctctgtac

SEQ ID NO: 581846 - DNA, 25 bp, Mus musculus
ggaaaggctcctctgtcaatggcag

SEQ ID NO: 581847 - DNA, 25 bp, Mus musculus
ggaaaggctcctgtgtcaatggcag

SEQ ID NO: 581848 - DNA, 25 bp, Mus musculus
ggaaaggctgccaaaaaatataata

SEQ ID NO: 581849 - DNA, 25 bp, Mus musculus
ggaaaggctgcctaaaaatataata

SEQ ID NO: 581850 - DNA, 25 bp, Mus musculus
ggaaaggctgtgacatcaccatctc

SEQ ID NO: 581851 - DNA, 25 bp, Mus musculus
ggaaaggctgtgtcatcaccatctc

SEQ ID NO: 581852 - DNA, 25 bp, Mus musculus
ggaaaggctgttatgtctcctgcta

SEQ ID NO: 581853 - DNA, 25 bp, Mus musculus
ggaaaggctgttttgtctcctgcta

SEQ ID NO: 581854 - DNA, 25 bp, Mus musculus
ggaaagggaactacttcatacatac

SEQ ID NO: 581855 - DNA, 25 bp, Mus musculus
ggaaagggaacttcttcatacatac

SEQ ID NO: 581856 - DNA, 25 bp, Mus musculus
ggaaagggacagactccggttcact

SEQ ID NO: 581857 - DNA, 25 bp, Mus musculus
ggaaagggacagtctccggttcact

SEQ ID NO: 581858 - DNA, 25 bp, Mus musculus
ggaaagggactcagatattgattct

SEQ ID NO: 581859 - DNA, 25 bp, Mus musculus
ggaaagggactctgatattgattct

SEQ ID NO: 581860 - DNA, 25 bp, Mus musculus
ggaaagggacttcgcccaacatcac

SEQ ID NO: 581861 - DNA, 25 bp, Mus musculus
ggaaagggacttggcccaacatcac

SEQ ID NO: 581862 - DNA, 25 bp, Mus musculus
ggaaagggcaccactggcacagagt

SEQ ID NO: 581863 - DNA, 25 bp, Mus musculus
ggaaagggcaccagagcccctggaa

SEQ ID NO: 581864 - DNA, 25 bp, Mus musculus
ggaaagggcacctctggcacagagt

SEQ ID NO: 581865 - DNA, 25 bp, Mus musculus
ggaaagggcacctgagcccctggaa

SEQ ID NO: 581866 - DNA, 25 bp, Mus musculus
ggaaagggcatgcatctcattacag

SEQ ID NO: 581867 - DNA, 25 bp, Mus musculus
ggaaagggcatggatctcattacag

SEQ ID NO: 581868 - DNA, 25 bp, Mus musculus
ggaaagggcccgaactctttctcat

SEQ ID NO: 581869 - DNA, 25 bp, Mus musculus
ggaaagggcccgtactctttctcat

SEQ ID NO: 581870 - DNA, 25 bp, Mus musculus
ggaaagggcgttaaagtgatacatt

SEQ ID NO: 581871 - DNA, 25 bp, Mus musculus
ggaaagggcgtttaagtgatacatt

SEQ ID NO: 581872 - DNA, 25 bp, Mus musculus
ggaaagggctgaacccatccctgta

SEQ ID NO: 581873 - DNA, 25 bp, Mus musculus
ggaaagggctgatcccatccctgta

SEQ ID NO: 581874 - DNA, 25 bp, Mus musculus
ggaaagggctttcccaagcaatcta

SEQ ID NO: 581875 - DNA, 25 bp, Mus musculus
ggaaagggctttgccaagcaatcta

SEQ ID NO: 581876 - DNA, 25 bp, Mus musculus
ggaaagggtacaccgctggacccca

SEQ ID NO: 581877 - DNA, 25 bp, Mus musculus
ggaaagggtacagcgctggacccca

SEQ ID NO: 581878 - DNA, 25 bp, Mus musculus
ggaaagggtcaccaagctcgcacct

SEQ ID NO: 581879 - DNA, 25 bp, Mus musculus
ggaaagggtcacgaagctcgcacct

SEQ ID NO: 581880 - DNA, 25 bp, Mus musculus
ggaaagggttcaaactctgctatca

SEQ ID NO: 581881 - DNA, 25 bp, Mus musculus
ggaaagggttcatactctgctatca

SEQ ID NO: 581882 - DNA, 25 bp, Mus musculus
ggaaaggtcactcctgatttcccag

SEQ ID NO: 581883 - DNA, 25 bp, Mus musculus
ggaaaggtcactgctgatttcccag

SEQ ID NO: 581884 - DNA, 25 bp, Mus musculus
ggaaaggtggaactgactgctctca

SEQ ID NO: 581885 - DNA, 25 bp, Mus musculus
ggaaaggtggaagtgactgctctca

SEQ ID NO: 581886 - DNA, 25 bp, Mus musculus
ggaaaggttgctctcagctgctctc

SEQ ID NO: 581887 - DNA, 25 bp, Mus musculus
ggaaaggttgctgtcagctgctctc

SEQ ID NO: 581888 - DNA, 25 bp, Mus musculus
ggaaaggttgtgacgacccctggct

SEQ ID NO: 581889 - DNA, 25 bp, Mus musculus
ggaaaggttgtgtcgacccctggct

SEQ ID NO: 581890 - DNA, 25 bp, Mus musculus
ggaaaggtttgacgcctcctctgac

SEQ ID NO: 581891 - DNA, 25 bp, Mus musculus
ggaaaggtttgaggcctcctctgac

SEQ ID NO: 581892 - DNA, 25 bp, Mus musculus
ggaaagtaatgaagttgcccagaat

SEQ ID NO: 581893 - DNA, 25 bp, Mus musculus
ggaaagtaatgatgttgcccagaat

SEQ ID NO: 581894 - DNA, 25 bp, Mus musculus
ggaaagtaccagattactcccctgc

SEQ ID NO: 581895 - DNA, 25 bp, Mus musculus
ggaaagtaccagtttactcccctgc

SEQ ID NO: 581896 - DNA, 25 bp, Mus musculus
ggaaagtactgtaggcccgagagcc

SEQ ID NO: 581897 - DNA, 25 bp, Mus musculus
ggaaagtactgttggcccgagagcc

SEQ ID NO: 581898 - DNA, 25 bp, Mus musculus
ggaaagtatcctccctaggtgctct

SEQ ID NO: 581899 - DNA, 25 bp, Mus musculus
ggaaagtatcctgcctaggtgctct

SEQ ID NO: 581900 - DNA, 25 bp, Mus musculus
ggaaagtatcgtcttacctgcccgt

SEQ ID NO: 581901 - DNA, 25 bp, Mus musculus
ggaaagtatcgtgttacctgcccgt

SEQ ID NO: 581902 - DNA, 25 bp, Mus musculus
ggaaagtattttaggcctctctgga

SEQ ID NO: 581903 - DNA, 25 bp, Mus musculus
ggaaagtatttttggcctctctgga

SEQ ID NO: 581904 - DNA, 25 bp, Mus musculus
ggaaagtcactgaccaacttatcat

SEQ ID NO: 581905 - DNA, 25 bp, Mus musculus
ggaaagtcactgtccaacttatcat

SEQ ID NO: 581906 - DNA, 25 bp, Mus musculus
ggaaagtcatggatctctgcttctc

SEQ ID NO: 581907 - DNA, 25 bp, Mus musculus
ggaaagtcatggttctctgcttctc

SEQ ID NO: 581908 - DNA, 25 bp, Mus musculus
ggaaagtccagcaaagagcgcttga

SEQ ID NO: 581909 - DNA, 25 bp, Mus musculus
ggaaagtccagctaagagcgcttga

SEQ ID NO: 581910 - DNA, 25 bp, Mus musculus
ggaaagtctgttctggttatctgca

SEQ ID NO: 581911 - DNA, 25 bp, Mus musculus
ggaaagtctgttgtggttatctgca

SEQ ID NO: 581912 - DNA, 25 bp, Mus musculus
ggaaagtcttcacccagaggtccgg

SEQ ID NO: 581913 - DNA, 25 bp, Mus musculus
ggaaagtcttcagccagaggtccgg

SEQ ID NO: 581914 - DNA, 25 bp, Mus musculus
ggaaagtcttccatgcgtagctggc

SEQ ID NO: 581915 - DNA, 25 bp, Mus musculus
ggaaagtcttccttgcgtagctggc

SEQ ID NO: 581916 - DNA, 25 bp, Mus musculus
ggaaagtcttgactcctgccaagaa

SEQ ID NO: 581917 - DNA, 25 bp, Mus musculus
ggaaagtcttgagtcctgccaagaa

SEQ ID NO: 581918 - DNA, 25 bp, Mus musculus
ggaaagtctttcagtgctgaggaga

SEQ ID NO: 581919 - DNA, 25 bp, Mus musculus
ggaaagtctttctgtgctgaggaga

SEQ ID NO: 581920 - DNA, 25 bp, Mus musculus
ggaaagtgagtgctgtcatctcttt

SEQ ID NO: 581921 - DNA, 25 bp, Mus musculus
ggaaagtgagtggtgtcatctcttt

SEQ ID NO: 581922 - DNA, 25 bp, Mus musculus
ggaaagtgatctccatccccaaaag

SEQ ID NO: 581923 - DNA, 25 bp, Mus musculus
ggaaagtgatctgcatccccaaaag

SEQ ID NO: 581924 - DNA, 25 bp, Mus musculus
ggaaagtgcattatgtgtgcacaaa

SEQ ID NO: 581925 - DNA, 25 bp, Mus musculus
ggaaagtgcattttgtgtgcacaaa

SEQ ID NO: 581926 - DNA, 25 bp, Mus musculus
ggaaagtgctgcattctagaaatta

SEQ ID NO: 581927 - DNA, 25 bp, Mus musculus
ggaaagtgctgctttctagaaatta

SEQ ID NO: 581928 - DNA, 25 bp, Mus musculus
ggaaagtgcttcatgcagctttgct

SEQ ID NO: 581929 - DNA, 25 bp, Mus musculus
ggaaagtgcttcttgcagctttgct

SEQ ID NO: 581930 - DNA, 25 bp, Mus musculus
ggaaagtggctcacaactgtctaaa

SEQ ID NO: 581931 - DNA, 25 bp, Mus musculus
ggaaagtggctctcaactgtctaaa

SEQ ID NO: 581932 - DNA, 25 bp, Mus musculus
ggaaagtgggtaatgttgtaaacag

SEQ ID NO: 581933 - DNA, 25 bp, Mus musculus
ggaaagtgggtattgttgtaaacag

SEQ ID NO: 581934 - DNA, 25 bp, Mus musculus
ggaaagtgtaacctttgaccagctt

SEQ ID NO: 581935 - DNA, 25 bp, Mus musculus
ggaaagtgtaacgtttgaccagctt

SEQ ID NO: 581936 - DNA, 25 bp, Mus musculus
ggaaagtgtactactctaggcaccc

SEQ ID NO: 581937 - DNA, 25 bp, Mus musculus
ggaaagtgtacttctctaggcaccc

SEQ ID NO: 581938 - DNA, 25 bp, Mus musculus
ggaaagtgtcttactacgtgggcac

SEQ ID NO: 581939 - DNA, 25 bp, Mus musculus
ggaaagtgtctttctacgtgggcac

SEQ ID NO: 581940 - DNA, 25 bp, Mus musculus
ggaaagtgtgatccttctcagcttc

SEQ ID NO: 581941 - DNA, 25 bp, Mus musculus
ggaaagtgtgatgcttctcagcttc

SEQ ID NO: 581942 - DNA, 25 bp, Mus musculus
ggaaagtgtggaaagcctctccaat

SEQ ID NO: 581943 - DNA, 25 bp, Mus musculus
ggaaagtgtggatagcctctccaat

SEQ ID NO: 581944 - DNA, 25 bp, Mus musculus
ggaaagttaagacccactgtcctaa

SEQ ID NO: 581945 - DNA, 25 bp, Mus musculus
ggaaagttaagagccactgtcctaa

SEQ ID NO: 581946 - DNA, 25 bp, Mus musculus
ggaaagttagaaaaggcagcctggt

SEQ ID NO: 581947 - DNA, 25 bp, Mus musculus
ggaaagttagaataggcagcctggt

SEQ ID NO: 581948 - DNA, 25 bp, Mus musculus
ggaaagttataacatgcaccacaaa

SEQ ID NO: 581949 - DNA, 25 bp, Mus musculus
ggaaagttataagatgcaccacaaa

SEQ ID NO: 581950 - DNA, 25 bp, Mus musculus
ggaaagttccacctactctttatat

SEQ ID NO: 581951 - DNA, 25 bp, Mus musculus
ggaaagttccacgtactctttatat

SEQ ID NO: 581952 - DNA, 25 bp, Mus musculus
ggaaagttcccaaactccaatgaat

SEQ ID NO: 581953 - DNA, 25 bp, Mus musculus
ggaaagttcccatactccaatgaat

SEQ ID NO: 581954 - DNA, 25 bp, Mus musculus
ggaaagttcctcacaaatgcttctc

SEQ ID NO: 581955 - DNA, 25 bp, Mus musculus
ggaaagttcctctcaaatgcttctc

SEQ ID NO: 581956 - DNA, 25 bp, Mus musculus
ggaaagttcttcatactacagcatg

SEQ ID NO: 581957 - DNA, 25 bp, Mus musculus
ggaaagttcttcttactacagcatg

SEQ ID NO: 581958 - DNA, 25 bp, Mus musculus
ggaaagttgtccactgattgtcaca

SEQ ID NO: 581959 - DNA, 25 bp, Mus musculus
ggaaagttgtcctctgattgtcaca

SEQ ID NO: 581960 - DNA, 25 bp, Mus musculus
ggaaagttgtgcaattgcctaacat

SEQ ID NO: 581961 - DNA, 25 bp, Mus musculus
ggaaagttgtgctattgcctaacat

SEQ ID NO: 581962 - DNA, 25 bp, Mus musculus
ggaaagttgtttagctccagcgaca

SEQ ID NO: 581963 - DNA, 25 bp, Mus musculus
ggaaagttgttttgctccagcgaca

SEQ ID NO: 581964 - DNA, 25 bp, Mus musculus
ggaaagtttactcttctgattataa

SEQ ID NO: 581965 - DNA, 25 bp, Mus musculus
ggaaagtttactgttctgattataa

SEQ ID NO: 581966 - DNA, 25 bp, Mus musculus
ggaaagtttctacattacatgacta

SEQ ID NO: 581967 - DNA, 25 bp, Mus musculus
ggaaagtttctagattacatgacta

SEQ ID NO: 581968 - DNA, 25 bp, Mus musculus
ggaaagtttgacagtggcacccctc

SEQ ID NO: 581969 - DNA, 25 bp, Mus musculus
ggaaagtttgactgtggcacccctc

SEQ ID NO: 581970 - DNA, 25 bp, Mus musculus
ggaaataaatgcaaccttttctctg

SEQ ID NO: 581971 - DNA, 25 bp, Mus musculus
ggaaataaatgctaccttttctctg

SEQ ID NO: 581972 - DNA, 25 bp, Mus musculus
ggaaataaattacgagcgactactt

SEQ ID NO: 581973 - DNA, 25 bp, Mus musculus
ggaaataaattaggagcgactactt

SEQ ID NO: 581974 - DNA, 25 bp, Mus musculus
ggaaataacaatacacctcagctgt

SEQ ID NO: 581975 - DNA, 25 bp, Mus musculus
ggaaataacaattcacctcagctgt

SEQ ID NO: 581976 - DNA, 25 bp, Mus musculus
ggaaataataccctacagatgagcg

SEQ ID NO: 581977 - DNA, 25 bp, Mus musculus
ggaaataataccgtacagatgagcg

SEQ ID NO: 581978 - DNA, 25 bp, Mus musculus
ggaaataatccaacaatttgactgc

SEQ ID NO: 581979 - DNA, 25 bp, Mus musculus
ggaaataatccatcaatttgactgc

SEQ ID NO: 581980 - DNA, 25 bp, Mus musculus
ggaaataatggcagtataacatgaa

SEQ ID NO: 581981 - DNA, 25 bp, Mus musculus
ggaaataatggctgtataacatgaa

SEQ ID NO: 581982 - DNA, 25 bp, Mus musculus
ggaaatacaccactttggctggcat

SEQ ID NO: 581983 - DNA, 25 bp, Mus musculus
ggaaatacaccagtttggctggcat

SEQ ID NO: 581984 - DNA, 25 bp, Mus musculus
ggaaatacacgcaccctccaggtgt

SEQ ID NO: 581985 - DNA, 25 bp, Mus musculus
ggaaatacacgctccctccaggtgt

SEQ ID NO: 581986 - DNA, 25 bp, Mus musculus
ggaaatacacttcctgggcatccct

SEQ ID NO: 581987 - DNA, 25 bp, Mus musculus
ggaaatacacttgctgggcatccct

SEQ ID NO: 581988 - DNA, 25 bp, Mus musculus
ggaaatacagatcacttcactacag

SEQ ID NO: 581989 - DNA, 25 bp, Mus musculus
ggaaatacagatgacttcactacag

SEQ ID NO: 581990 - DNA, 25 bp, Mus musculus
ggaaatacccatatgcttcgtgatg

SEQ ID NO: 581991 - DNA, 25 bp, Mus musculus
ggaaatacccatttgcttcgtgatg

SEQ ID NO: 581992 - DNA, 25 bp, Mus musculus
ggaaataccccaagaaaccaacagg

SEQ ID NO: 581993 - DNA, 25 bp, Mus musculus
ggaaataccccatgaaaccaacagg

SEQ ID NO: 581994 - DNA, 25 bp, Mus musculus
ggaaataccctaacaggtcttgctt

SEQ ID NO: 581995 - DNA, 25 bp, Mus musculus
ggaaataccctatcaggtcttgctt

SEQ ID NO: 581996 - DNA, 25 bp, Mus musculus
ggaaatacctcaagctgttcttatt

SEQ ID NO: 581997 - DNA, 25 bp, Mus musculus
ggaaatacctcatgctgttcttatt

SEQ ID NO: 581998 - DNA, 25 bp, Mus musculus
ggaaatacgattatgtctctccttt

SEQ ID NO: 581999 - DNA, 25 bp, Mus musculus
ggaaatacgattttgtctctccttt

SEQ ID NO: 582000 - DNA, 25 bp, Mus musculus
ggaaatacggcacagcacaccttgt

SEQ ID NO: 582001 - DNA, 25 bp, Mus musculus
ggaaatacggcagagcacaccttgt

SEQ ID NO: 582002 - DNA, 25 bp, Mus musculus
ggaaatacgggcctcacagagcttt

SEQ ID NO: 582003 - DNA, 25 bp, Mus musculus
ggaaatacgggcgtcacagagcttt

SEQ ID NO: 582004 - DNA, 25 bp, Mus musculus
ggaaatacggtgatggttaatgaac

SEQ ID NO: 582005 - DNA, 25 bp, Mus musculus
ggaaatacggtgttggttaatgaac

SEQ ID NO: 582006 - DNA, 25 bp, Mus musculus
ggaaatactatgactctggcccaat

SEQ ID NO: 582007 - DNA, 25 bp, Mus musculus
ggaaatactatgtctctggcccaat

SEQ ID NO: 582008 - DNA, 25 bp, Mus musculus
ggaaatactccaccaatgacgaaag

SEQ ID NO: 582009 - DNA, 25 bp, Mus musculus
ggaaatactccagcaatgacgaaag

SEQ ID NO: 582010 - DNA, 25 bp, Mus musculus
ggaaatacttgaacgttttaatgag

SEQ ID NO: 582011 - DNA, 25 bp, Mus musculus
ggaaatacttgatcgttttaatgag

SEQ ID NO: 582012 - DNA, 25 bp, Mus musculus
ggaaatagcaatcactcccacaatt

SEQ ID NO: 582013 - DNA, 25 bp, Mus musculus
ggaaatagcaatgactcccacaatt

SEQ ID NO: 582014 - DNA, 25 bp, Mus musculus
ggaaatagctataccataagtaact

SEQ ID NO: 582015 - DNA, 25 bp, Mus musculus
ggaaatagctattccataagtaact

SEQ ID NO: 582016 - DNA, 25 bp, Mus musculus
ggaaatagcttgattgaggccatat

SEQ ID NO: 582017 - DNA, 25 bp, Mus musculus
ggaaatagcttgtttgaggccatat

SEQ ID NO: 582018 - DNA, 25 bp, Mus musculus
ggaaataggaccacggccacccaag

SEQ ID NO: 582019 - DNA, 25 bp, Mus musculus
ggaaataggacctcggccacccaag

SEQ ID NO: 582020 - DNA, 25 bp, Mus musculus
ggaaatagtcacactgtcttacagg

SEQ ID NO: 582021 - DNA, 25 bp, Mus musculus
ggaaatagtcactctgtcttacagg

SEQ ID NO: 582022 - DNA, 25 bp, Mus musculus
ggaaatataactacctgttgttgaa

SEQ ID NO: 582023 - DNA, 25 bp, Mus musculus
ggaaatataactctcttctgcacat

SEQ ID NO: 582024 - DNA, 25 bp, Mus musculus
ggaaatataactgtcttctgcacat

SEQ ID NO: 582025 - DNA, 25 bp, Mus musculus
ggaaatataacttcctgttgttgaa

SEQ ID NO: 582026 - DNA, 25 bp, Mus musculus
ggaaatatagaaagcctggcaggcc

SEQ ID NO: 582027 - DNA, 25 bp, Mus musculus
ggaaatatagaatgcctggcaggcc

SEQ ID NO: 582028 - DNA, 25 bp, Mus musculus
ggaaatatattgcaacccccgcgcc

SEQ ID NO: 582029 - DNA, 25 bp, Mus musculus
ggaaatatattggaacccccgcgcc

SEQ ID NO: 582030 - DNA, 25 bp, Mus musculus
ggaaatatcaatcagaactcttgtg

SEQ ID NO: 582031 - DNA, 25 bp, Mus musculus
ggaaatatcaatgagaactcttgtg

SEQ ID NO: 582032 - DNA, 25 bp, Mus musculus
ggaaatatccagaagtaagaagtta

SEQ ID NO: 582033 - DNA, 25 bp, Mus musculus
ggaaatatccagctagttgtccata

SEQ ID NO: 582034 - DNA, 25 bp, Mus musculus
ggaaatatccaggtagttgtccata

SEQ ID NO: 582035 - DNA, 25 bp, Mus musculus
ggaaatatccagtagtaagaagtta

SEQ ID NO: 582036 - DNA, 25 bp, Mus musculus
ggaaatatcccaccctcaggagtaa

SEQ ID NO: 582037 - DNA, 25 bp, Mus musculus
ggaaatatcccagcctcaggagtaa

SEQ ID NO: 582038 - DNA, 25 bp, Mus musculus
ggaaatatcctcacggaagcgggaa

SEQ ID NO: 582039 - DNA, 25 bp, Mus musculus
ggaaatatcctcagagctaagtaag

SEQ ID NO: 582040 - DNA, 25 bp, Mus musculus
ggaaatatcctctcggaagcgggaa

SEQ ID NO: 582041 - DNA, 25 bp, Mus musculus
ggaaatatcctctgagctaagtaag

SEQ ID NO: 582042 - DNA, 25 bp, Mus musculus
ggaaatatcgaacgtatctcacttt

SEQ ID NO: 582043 - DNA, 25 bp, Mus musculus
ggaaatatcgaaggtatctcacttt

SEQ ID NO: 582044 - DNA, 25 bp, Mus musculus
ggaaatatcgtgactgctctcctga

SEQ ID NO: 582045 - DNA, 25 bp, Mus musculus
ggaaatatcgtgtctgctctcctga

SEQ ID NO: 582046 - DNA, 25 bp, Mus musculus
ggaaatatctccaagcgaaaagtaa

SEQ ID NO: 582047 - DNA, 25 bp, Mus musculus
ggaaatatctcctagcgaaaagtaa

SEQ ID NO: 582048 - DNA, 25 bp, Mus musculus
ggaaatatgaccctttgttgctttc

SEQ ID NO: 582049 - DNA, 25 bp, Mus musculus
ggaaatatgaccgtttgttgctttc

SEQ ID NO: 582050 - DNA, 25 bp, Mus musculus
ggaaatatgtgtccgcactgtctgt

SEQ ID NO: 582051 - DNA, 25 bp, Mus musculus
ggaaatatgtgtgcgcactgtctgt

SEQ ID NO: 582052 - DNA, 25 bp, Mus musculus
ggaaatattcccagtacgatacaat

SEQ ID NO: 582053 - DNA, 25 bp, Mus musculus
ggaaatattccctgtacgatacaat

SEQ ID NO: 582054 - DNA, 25 bp, Mus musculus
ggaaatattctcatgagtccgcagc

SEQ ID NO: 582055 - DNA, 25 bp, Mus musculus
ggaaatattctcttgagtccgcagc

SEQ ID NO: 582056 - DNA, 25 bp, Mus musculus
ggaaatatttatctccttcaacttg

SEQ ID NO: 582057 - DNA, 25 bp, Mus musculus
ggaaatatttatgtccttcaacttg

SEQ ID NO: 582058 - DNA, 25 bp, Mus musculus
ggaaatatttctacatgtgcatata

SEQ ID NO: 582059 - DNA, 25 bp, Mus musculus
ggaaatatttcttcatgtgcatata

SEQ ID NO: 582060 - DNA, 25 bp, Mus musculus
ggaaatcaaacccaagtcacctgga

SEQ ID NO: 582061 - DNA, 25 bp, Mus musculus
ggaaatcaaaccgaagtcacctgga

SEQ ID NO: 582062 - DNA, 25 bp, Mus musculus
ggaaatcaaagcagccctaatctta

SEQ ID NO: 582063 - DNA, 25 bp, Mus musculus
ggaaatcaaagctgccctaatctta

SEQ ID NO: 582064 - DNA, 25 bp, Mus musculus
ggaaatcaacggcatcagccccaaa

SEQ ID NO: 582065 - DNA, 25 bp, Mus musculus
ggaaatcaacgggatcagccccaaa

SEQ ID NO: 582066 - DNA, 25 bp, Mus musculus
ggaaatcaagaactttgaatcacat

SEQ ID NO: 582067 - DNA, 25 bp, Mus musculus
ggaaatcaagaagtttgaatcacat

SEQ ID NO: 582068 - DNA, 25 bp, Mus musculus
ggaaatcaaggtctcataagccatt

SEQ ID NO: 582069 - DNA, 25 bp, Mus musculus
ggaaatcaaggtgtcataagccatt

SEQ ID NO: 582070 - DNA, 25 bp, Mus musculus
ggaaatcacatcacaactgcaaaga

SEQ ID NO: 582071 - DNA, 25 bp, Mus musculus
ggaaatcacatctcaactgcaaaga

SEQ ID NO: 582072 - DNA, 25 bp, Mus musculus
ggaaatcaccaaatttttgtgcaaa

SEQ ID NO: 582073 - DNA, 25 bp, Mus musculus
ggaaatcaccaacccttgcagtagt

SEQ ID NO: 582074 - DNA, 25 bp, Mus musculus
ggaaatcaccaaccgctttgacttt

SEQ ID NO: 582075 - DNA, 25 bp, Mus musculus
ggaaatcaccaagccttgcagtagt

SEQ ID NO: 582076 - DNA, 25 bp, Mus musculus
ggaaatcaccaagcgctttgacttt

SEQ ID NO: 582077 - DNA, 25 bp, Mus musculus
ggaaatcaccaattttttgtgcaaa

SEQ ID NO: 582078 - DNA, 25 bp, Mus musculus
ggaaatcacggtaatctgcgctgcc

SEQ ID NO: 582079 - DNA, 25 bp, Mus musculus
ggaaatcacggttatctgcgctgcc

SEQ ID NO: 582080 - DNA, 25 bp, Mus musculus
ggaaatcactacatgaccacattac

SEQ ID NO: 582081 - DNA, 25 bp, Mus musculus
ggaaatcactacttgaccacattac

SEQ ID NO: 582082 - DNA, 25 bp, Mus musculus
ggaaatcactatattgctcaggctg

SEQ ID NO: 582083 - DNA, 25 bp, Mus musculus
ggaaatcactattttgctcaggctg

SEQ ID NO: 582084 - DNA, 25 bp, Mus musculus
ggaaatcactttagtccagtagcac

SEQ ID NO: 582085 - DNA, 25 bp, Mus musculus
ggaaatcacttttgtccagtagcac

SEQ ID NO: 582086 - DNA, 25 bp, Mus musculus
ggaaatcagactcttcgctggcaag

SEQ ID NO: 582087 - DNA, 25 bp, Mus musculus
ggaaatcagactgttcgctggcaag

SEQ ID NO: 582088 - DNA, 25 bp, Mus musculus
ggaaatcagatccacccatttcatg

SEQ ID NO: 582089 - DNA, 25 bp, Mus musculus
ggaaatcagatcgacccatttcatg

SEQ ID NO: 582090 - DNA, 25 bp, Mus musculus
ggaaatcagcatcttattgtagaat

SEQ ID NO: 582091 - DNA, 25 bp, Mus musculus
ggaaatcagcatgttattgtagaat

SEQ ID NO: 582092 - DNA, 25 bp, Mus musculus
ggaaatcagcttcacccaattcaga

SEQ ID NO: 582093 - DNA, 25 bp, Mus musculus
ggaaatcagcttgacccaattcaga

SEQ ID NO: 582094 - DNA, 25 bp, Mus musculus
ggaaatcaggctcccatccggcagt

SEQ ID NO: 582095 - DNA, 25 bp, Mus musculus
ggaaatcaggctgccatccggcagt

SEQ ID NO: 582096 - DNA, 25 bp, Mus musculus
ggaaatcagtacacctattgcatgt

SEQ ID NO: 582097 - DNA, 25 bp, Mus musculus
ggaaatcagtactcctattgcatgt

SEQ ID NO: 582098 - DNA, 25 bp, Mus musculus
ggaaatcagtgtcgcccagaccgtt

SEQ ID NO: 582099 - DNA, 25 bp, Mus musculus
ggaaatcagtgtggcccagaccgtt

SEQ ID NO: 582100 - DNA, 25 bp, Mus musculus
ggaaatcatcacacctgtagtttgg

SEQ ID NO: 582101 - DNA, 25 bp, Mus musculus
ggaaatcatcactcctgtagtttgg

SEQ ID NO: 582102 - DNA, 25 bp, Mus musculus
ggaaatcatgataacctaagggcga

SEQ ID NO: 582103 - DNA, 25 bp, Mus musculus
ggaaatcatgattacctaagggcga

SEQ ID NO: 582104 - DNA, 25 bp, Mus musculus
ggaaatcatgtgaagttcatcttct

SEQ ID NO: 582105 - DNA, 25 bp, Mus musculus
ggaaatcatgtgtagttcatcttct

SEQ ID NO: 582106 - DNA, 25 bp, Mus musculus
ggaaatcattaaattgaccttcagt

SEQ ID NO: 582107 - DNA, 25 bp, Mus musculus
ggaaatcattaatttgaccttcagt

SEQ ID NO: 582108 - DNA, 25 bp, Mus musculus
ggaaatcattagcacctagtcaaag

SEQ ID NO: 582109 - DNA, 25 bp, Mus musculus
ggaaatcattaggacctagtcaaag

SEQ ID NO: 582110 - DNA, 25 bp, Mus musculus
ggaaatccaaccaagacggctgcta

SEQ ID NO: 582111 - DNA, 25 bp, Mus musculus
ggaaatccaacctagacggctgcta

SEQ ID NO: 582112 - DNA, 25 bp, Mus musculus
ggaaatccaactccaagactccatc

SEQ ID NO: 582113 - DNA, 25 bp, Mus musculus
ggaaatccaactgcaagactccatc

SEQ ID NO: 582114 - DNA, 25 bp, Mus musculus
ggaaatccacagcagcccagtgaca

SEQ ID NO: 582115 - DNA, 25 bp, Mus musculus
ggaaatccacaggagcccagtgaca

SEQ ID NO: 582116 - DNA, 25 bp, Mus musculus
ggaaatccacggaaggacgctgtga

SEQ ID NO: 582117 - DNA, 25 bp, Mus musculus
ggaaatccacggtaggacgctgtga

SEQ ID NO: 582118 - DNA, 25 bp, Mus musculus
ggaaatccagaacccagaagccttt

SEQ ID NO: 582119 - DNA, 25 bp, Mus musculus
ggaaatccagaagccagaagccttt

SEQ ID NO: 582120 - DNA, 25 bp, Mus musculus
ggaaatccaggcatcactgagagaa

SEQ ID NO: 582121 - DNA, 25 bp, Mus musculus
ggaaatccaggcttcactgagagaa

SEQ ID NO: 582122 - DNA, 25 bp, Mus musculus
ggaaatccatacacttagcttgttt

SEQ ID NO: 582123 - DNA, 25 bp, Mus musculus
ggaaatccatactcttagcttgttt

SEQ ID NO: 582124 - DNA, 25 bp, Mus musculus
ggaaatcccataattgacacttgag

SEQ ID NO: 582125 - DNA, 25 bp, Mus musculus
ggaaatcccatatttgacacttgag

SEQ ID NO: 582126 - DNA, 25 bp, Mus musculus
ggaaatccctgacaaagataactta

SEQ ID NO: 582127 - DNA, 25 bp, Mus musculus
ggaaatccctgagaaagataactta

SEQ ID NO: 582128 - DNA, 25 bp, Mus musculus
ggaaatccctttacttggaggtgct

SEQ ID NO: 582129 - DNA, 25 bp, Mus musculus
ggaaatcccttttcttggaggtgct

SEQ ID NO: 582130 - DNA, 25 bp, Mus musculus
ggaaatccgggaactgcacctgagc

SEQ ID NO: 582131 - DNA, 25 bp, Mus musculus
ggaaatccgggatctgcacctgagc

SEQ ID NO: 582132 - DNA, 25 bp, Mus musculus
ggaaatcctactaggcttttggtca

SEQ ID NO: 582133 - DNA, 25 bp, Mus musculus
ggaaatcctacttggcttttggtca

SEQ ID NO: 582134 - DNA, 25 bp, Mus musculus
ggaaatcctcagaacctgatcagcc

SEQ ID NO: 582135 - DNA, 25 bp, Mus musculus
ggaaatcctcagtacctgatcagcc

SEQ ID NO: 582136 - DNA, 25 bp, Mus musculus
ggaaatcctgcaccacgtcatcgat

SEQ ID NO: 582137 - DNA, 25 bp, Mus musculus
ggaaatcctgcagcacgtcatcgat

SEQ ID NO: 582138 - DNA, 25 bp, Mus musculus
ggaaatcctggccagtgacgctgtt

SEQ ID NO: 582139 - DNA, 25 bp, Mus musculus
ggaaatcctggcgagtgacgctgtt

SEQ ID NO: 582140 - DNA, 25 bp, Mus musculus
ggaaatccttaccatgctgatgaca

SEQ ID NO: 582141 - DNA, 25 bp, Mus musculus
ggaaatccttacgatgctgatgaca

SEQ ID NO: 582142 - DNA, 25 bp, Mus musculus
ggaaatccttatctagaccatgcaa

SEQ ID NO: 582143 - DNA, 25 bp, Mus musculus
ggaaatccttatgtagaccatgcaa

SEQ ID NO: 582144 - DNA, 25 bp, Mus musculus
ggaaatcgcatcagtagccgacgcc

SEQ ID NO: 582145 - DNA, 25 bp, Mus musculus
ggaaatcgcatctgtagccgacgcc

SEQ ID NO: 582146 - DNA, 25 bp, Mus musculus
ggaaatcgcttccttgaactgctgc

SEQ ID NO: 582147 - DNA, 25 bp, Mus musculus
ggaaatcgcttcgttgaactgctgc

SEQ ID NO: 582148 - DNA, 25 bp, Mus musculus
ggaaatcgtctcagtagctgaccca

SEQ ID NO: 582149 - DNA, 25 bp, Mus musculus
ggaaatcgtctctgtagctgaccca

SEQ ID NO: 582150 - DNA, 25 bp, Mus musculus
ggaaatcgttgcacttttaaatgct

SEQ ID NO: 582151 - DNA, 25 bp, Mus musculus
ggaaatcgttgctcttttaaatgct

SEQ ID NO: 582152 - DNA, 25 bp, Mus musculus
ggaaatctaatgcataaaggaacac

SEQ ID NO: 582153 - DNA, 25 bp, Mus musculus
ggaaatctaatggataaaggaacac

SEQ ID NO: 582154 - DNA, 25 bp, Mus musculus
ggaaatctacccaggcagcaaagtc

SEQ ID NO: 582155 - DNA, 25 bp, Mus musculus
ggaaatctaccctggcagcaaagtc

SEQ ID NO: 582156 - DNA, 25 bp, Mus musculus
ggaaatctatccattggccctttta

SEQ ID NO: 582157 - DNA, 25 bp, Mus musculus
ggaaatctatcctttggccctttta

SEQ ID NO: 582158 - DNA, 25 bp, Mus musculus
ggaaatctcaacagtctctctattt

SEQ ID NO: 582159 - DNA, 25 bp, Mus musculus
ggaaatctcaactgtctctctattt

SEQ ID NO: 582160 - DNA, 25 bp, Mus musculus
ggaaatctcagccttgtacacattc

SEQ ID NO: 582161 - DNA, 25 bp, Mus musculus
ggaaatctcagcgttgtacacattc

SEQ ID NO: 582162 - DNA, 25 bp, Mus musculus
ggaaatctcagtccagtccttatta

SEQ ID NO: 582163 - DNA, 25 bp, Mus musculus
ggaaatctcagtgcagtccttatta

SEQ ID NO: 582164 - DNA, 25 bp, Mus musculus
ggaaatctccatctaccaatcggtg

SEQ ID NO: 582165 - DNA, 25 bp, Mus musculus
ggaaatctccatgtaccaatcggtg

SEQ ID NO: 582166 - DNA, 25 bp, Mus musculus
ggaaatctctgtcagcacacagcta

SEQ ID NO: 582167 - DNA, 25 bp, Mus musculus
ggaaatctctgtgagcacacagcta

SEQ ID NO: 582168 - DNA, 25 bp, Mus musculus
ggaaatctctttccttaggacgctt

SEQ ID NO: 582169 - DNA, 25 bp, Mus musculus
ggaaatctctttgcttaggacgctt

SEQ ID NO: 582170 - DNA, 25 bp, Mus musculus
ggaaatctgagtacctccgtcattt

SEQ ID NO: 582171 - DNA, 25 bp, Mus musculus
ggaaatctgagttcctccgtcattt

SEQ ID NO: 582172 - DNA, 25 bp, Mus musculus
ggaaatctgatcatttctcgctcag

SEQ ID NO: 582173 - DNA, 25 bp, Mus musculus
ggaaatctgatcttttctcgctcag

SEQ ID NO: 582174 - DNA, 25 bp, Mus musculus
ggaaatctgcttacttttgtatctt

SEQ ID NO: 582175 - DNA, 25 bp, Mus musculus
ggaaatctgctttcttttgtatctt

SEQ ID NO: 582176 - DNA, 25 bp, Mus musculus
ggaaatctgggacactatgaaacac

SEQ ID NO: 582177 - DNA, 25 bp, Mus musculus
ggaaatctgggacttttggtcctgt

SEQ ID NO: 582178 - DNA, 25 bp, Mus musculus
ggaaatctgggagactatgaaacac

SEQ ID NO: 582179 - DNA, 25 bp, Mus musculus
ggaaatctgggagttttggtcctgt

SEQ ID NO: 582180 - DNA, 25 bp, Mus musculus
ggaaatctgtgtcgttcgcttcaca

SEQ ID NO: 582181 - DNA, 25 bp, Mus musculus
ggaaatctgtgtggttcgcttcaca

SEQ ID NO: 582182 - DNA, 25 bp, Mus musculus
ggaaatctgttaaatgccccattcg

SEQ ID NO: 582183 - DNA, 25 bp, Mus musculus
ggaaatctgttatatgccccattcg

SEQ ID NO: 582184 - DNA, 25 bp, Mus musculus
ggaaatcttaagatacacaaagcta

SEQ ID NO: 582185 - DNA, 25 bp, Mus musculus
ggaaatcttaagttacacaaagcta

SEQ ID NO: 582186 - DNA, 25 bp, Mus musculus
ggaaatcttcaacagggtcaccaac

SEQ ID NO: 582187 - DNA, 25 bp, Mus musculus
ggaaatcttcaagagggtcaccaac

SEQ ID NO: 582188 - DNA, 25 bp, Mus musculus
ggaaatcttcacaggcgtcgaatac

SEQ ID NO: 582189 - DNA, 25 bp, Mus musculus
ggaaatcttcactggcgtcgaatac

SEQ ID NO: 582190 - DNA, 25 bp, Mus musculus
ggaaatcttcgaagctccaaaggaa

SEQ ID NO: 582191 - DNA, 25 bp, Mus musculus
ggaaatcttcgatgctccaaaggaa

SEQ ID NO: 582192 - DNA, 25 bp, Mus musculus
ggaaatcttgccctgtgacatatag

SEQ ID NO: 582193 - DNA, 25 bp, Mus musculus
ggaaatcttgccgtgtgacatatag

SEQ ID NO: 582194 - DNA, 25 bp, Mus musculus
ggaaatcttgttagttactgtcatt

SEQ ID NO: 582195 - DNA, 25 bp, Mus musculus
ggaaatcttgtttgttactgtcatt

SEQ ID NO: 582196 - DNA, 25 bp, Mus musculus
ggaaatctttatcacaaaactcttt

SEQ ID NO: 582197 - DNA, 25 bp, Mus musculus
ggaaatctttatgacaaaactcttt

SEQ ID NO: 582198 - DNA, 25 bp, Mus musculus
ggaaatctttccatttatacaactg

SEQ ID NO: 582199 - DNA, 25 bp, Mus musculus
ggaaatctttccttttatacaactg

SEQ ID NO: 582200 - DNA, 25 bp, Mus musculus
ggaaatctttcgagacaatgccgtc

SEQ ID NO: 582201 - DNA, 25 bp, Mus musculus
ggaaatctttcgtgacaatgccgtc

SEQ ID NO: 582202 - DNA, 25 bp, Mus musculus
ggaaatgaaataccacctccgtgaa

SEQ ID NO: 582203 - DNA, 25 bp, Mus musculus
ggaaatgaaatagcacctccgtgaa

SEQ ID NO: 582204 - DNA, 25 bp, Mus musculus
ggaaatgaacagcactatgtttgat

SEQ ID NO: 582205 - DNA, 25 bp, Mus musculus
ggaaatgaacaggactatgtttgat

SEQ ID NO: 582206 - DNA, 25 bp, Mus musculus
ggaaatgaacatctgactattgaag

SEQ ID NO: 582207 - DNA, 25 bp, Mus musculus
ggaaatgaacatgtgactattgaag

SEQ ID NO: 582208 - DNA, 25 bp, Mus musculus
ggaaatgaaccaagcagacgttaat

SEQ ID NO: 582209 - DNA, 25 bp, Mus musculus
ggaaatgaaccatgcagacgttaat

SEQ ID NO: 582210 - DNA, 25 bp, Mus musculus
ggaaatgaagaccctcacctgaact

SEQ ID NO: 582211 - DNA, 25 bp, Mus musculus
ggaaatgaagacgctcacctgaact

SEQ ID NO: 582212 - DNA, 25 bp, Mus musculus
ggaaatgaagccactgggtccccaa

SEQ ID NO: 582213 - DNA, 25 bp, Mus musculus
ggaaatgaagcctctgggtccccaa

SEQ ID NO: 582214 - DNA, 25 bp, Mus musculus
ggaaatgaagcgcaccctcagcttc

SEQ ID NO: 582215 - DNA, 25 bp, Mus musculus
ggaaatgaagcggaccctcagcttc

SEQ ID NO: 582216 - DNA, 25 bp, Mus musculus
ggaaatgacacaacgggctctctaa

SEQ ID NO: 582217 - DNA, 25 bp, Mus musculus
ggaaatgacacaccacgggcgactc

SEQ ID NO: 582218 - DNA, 25 bp, Mus musculus
ggaaatgacacagcacgggcgactc

SEQ ID NO: 582219 - DNA, 25 bp, Mus musculus
ggaaatgacacatcgggctctctaa

SEQ ID NO: 582220 - DNA, 25 bp, Mus musculus
ggaaatgaccaaccaccagaagaaa

SEQ ID NO: 582221 - DNA, 25 bp, Mus musculus
ggaaatgaccaagcaccagaagaaa

SEQ ID NO: 582222 - DNA, 25 bp, Mus musculus
ggaaatgaccataacgtaaatcgca

SEQ ID NO: 582223 - DNA, 25 bp, Mus musculus
ggaaatgaccattacgtaaatcgca

SEQ ID NO: 582224 - DNA, 25 bp, Mus musculus
ggaaatgactgaaaaccagcactca

SEQ ID NO: 582225 - DNA, 25 bp, Mus musculus
ggaaatgactgataaccagcactca

SEQ ID NO: 582226 - DNA, 25 bp, Mus musculus
ggaaatgactgcaacgccactaaga

SEQ ID NO: 582227 - DNA, 25 bp, Mus musculus
ggaaatgactgctacgccactaaga

SEQ ID NO: 582228 - DNA, 25 bp, Mus musculus
ggaaatgacttccaatggccaccac

SEQ ID NO: 582229 - DNA, 25 bp, Mus musculus
ggaaatgacttcgaatggccaccac

SEQ ID NO: 582230 - DNA, 25 bp, Mus musculus
ggaaatgagccgagtctgtagacca

SEQ ID NO: 582231 - DNA, 25 bp, Mus musculus
ggaaatgagccgtgtctgtagacca

SEQ ID NO: 582232 - DNA, 25 bp, Mus musculus
ggaaatgaggagctgtccccagaaa

SEQ ID NO: 582233 - DNA, 25 bp, Mus musculus
ggaaatgaggaggtgtccccagaaa

SEQ ID NO: 582234 - DNA, 25 bp, Mus musculus
ggaaatgataatatacgtccattcc

SEQ ID NO: 582235 - DNA, 25 bp, Mus musculus
ggaaatgataatttacgtccattcc

SEQ ID NO: 582236 - DNA, 25 bp, Mus musculus
ggaaatgatcgacttgaccctcaca

SEQ ID NO: 582237 - DNA, 25 bp, Mus musculus
ggaaatgatcgagttgaccctcaca

SEQ ID NO: 582238 - DNA, 25 bp, Mus musculus
ggaaatgatgcgacattctgttgtg

SEQ ID NO: 582239 - DNA, 25 bp, Mus musculus
ggaaatgatgcgtcattctgttgtg

SEQ ID NO: 582240 - DNA, 25 bp, Mus musculus
ggaaatgatggacaccagctgaaca

SEQ ID NO: 582241 - DNA, 25 bp, Mus musculus
ggaaatgatggagaccagctgaaca

SEQ ID NO: 582242 - DNA, 25 bp, Mus musculus
ggaaatgattttctcccaggaacat

SEQ ID NO: 582243 - DNA, 25 bp, Mus musculus
ggaaatgattttgtcccaggaacat

SEQ ID NO: 582244 - DNA, 25 bp, Mus musculus
ggaaatgcaattcaagtgtctggaa

SEQ ID NO: 582245 - DNA, 25 bp, Mus musculus
ggaaatgcaattgaagtgtctggaa

SEQ ID NO: 582246 - DNA, 25 bp, Mus musculus
ggaaatgcacccacacggtggagga

SEQ ID NO: 582247 - DNA, 25 bp, Mus musculus
ggaaatgcaccctcacggtggagga

SEQ ID NO: 582248 - DNA, 25 bp, Mus musculus
ggaaatgcacctcggagaaattact

SEQ ID NO: 582249 - DNA, 25 bp, Mus musculus
ggaaatgcacctgggagaaattact

SEQ ID NO: 582250 - DNA, 25 bp, Mus musculus
ggaaatgcagcaacccacatgtggc

SEQ ID NO: 582251 - DNA, 25 bp, Mus musculus
ggaaatgcagcatcccacatgtggc

SEQ ID NO: 582252 - DNA, 25 bp, Mus musculus
ggaaatgcagctcacacatttctgg

SEQ ID NO: 582253 - DNA, 25 bp, Mus musculus
ggaaatgcagctgacacatttctgg

SEQ ID NO: 582254 - DNA, 25 bp, Mus musculus
ggaaatgcattccaggttttctcat

SEQ ID NO: 582255 - DNA, 25 bp, Mus musculus
ggaaatgcattcgaggttttctcat

SEQ ID NO: 582256 - DNA, 25 bp, Mus musculus
ggaaatgcccacattagtgtgtaca

SEQ ID NO: 582257 - DNA, 25 bp, Mus musculus
ggaaatgcccactttagtgtgtaca

SEQ ID NO: 582258 - DNA, 25 bp, Mus musculus
ggaaatgcccagagcttaatgctta

SEQ ID NO: 582259 - DNA, 25 bp, Mus musculus
ggaaatgcccagtgcttaatgctta

SEQ ID NO: 582260 - DNA, 25 bp, Mus musculus
ggaaatgcctctaactttacatttt

SEQ ID NO: 582261 - DNA, 25 bp, Mus musculus
ggaaatgcctcttactttacatttt

SEQ ID NO: 582262 - DNA, 25 bp, Mus musculus
ggaaatgcctgaccttcttaccagc

SEQ ID NO: 582263 - DNA, 25 bp, Mus musculus
ggaaatgcctgagcttcttaccagc

SEQ ID NO: 582264 - DNA, 25 bp, Mus musculus
ggaaatgcctttctgatcccaggag

SEQ ID NO: 582265 - DNA, 25 bp, Mus musculus
ggaaatgcctttgtgatcccaggag

SEQ ID NO: 582266 - DNA, 25 bp, Mus musculus
ggaaatgcggcacacacaccagcac

SEQ ID NO: 582267 - DNA, 25 bp, Mus musculus
ggaaatgcggcagacacaccagcac

SEQ ID NO: 582268 - DNA, 25 bp, Mus musculus
ggaaatgctactagtgactggaaac

SEQ ID NO: 582269 - DNA, 25 bp, Mus musculus
ggaaatgctacttgtgactggaaac

SEQ ID NO: 582270 - DNA, 25 bp, Mus musculus
ggaaatgctctaattgttcaactat

SEQ ID NO: 582271 - DNA, 25 bp, Mus musculus
ggaaatgctctatttgttcaactat

SEQ ID NO: 582272 - DNA, 25 bp, Mus musculus
ggaaatgctgacctttaacccacat

SEQ ID NO: 582273 - DNA, 25 bp, Mus musculus
ggaaatgctgacgtttaacccacat

SEQ ID NO: 582274 - DNA, 25 bp, Mus musculus
ggaaatgctggcaacaatcaccgac

SEQ ID NO: 582275 - DNA, 25 bp, Mus musculus
ggaaatgctggctacaatcaccgac

SEQ ID NO: 582276 - DNA, 25 bp, Mus musculus
ggaaatgctgggagccgcttggcct

SEQ ID NO: 582277 - DNA, 25 bp, Mus musculus
ggaaatgctgggtgccgcttggcct

SEQ ID NO: 582278 - DNA, 25 bp, Mus musculus
ggaaatgcttccataagtgctgaca

SEQ ID NO: 582279 - DNA, 25 bp, Mus musculus
ggaaatgcttccttaagtgctgaca

SEQ ID NO: 582280 - DNA, 25 bp, Mus musculus
ggaaatgcttgcatcgaggaagatg

SEQ ID NO: 582281 - DNA, 25 bp, Mus musculus
ggaaatgcttgccactgtagaagtg

SEQ ID NO: 582282 - DNA, 25 bp, Mus musculus
ggaaatgcttgcgactgtagaagtg

SEQ ID NO: 582283 - DNA, 25 bp, Mus musculus
ggaaatgcttgcttcgaggaagatg

SEQ ID NO: 582284 - DNA, 25 bp, Mus musculus
ggaaatgctttaactctgaattcac

SEQ ID NO: 582285 - DNA, 25 bp, Mus musculus
ggaaatgctttatctctgaattcac

SEQ ID NO: 582286 - DNA, 25 bp, Mus musculus
ggaaatggaactctggttcaccagc

SEQ ID NO: 582287 - DNA, 25 bp, Mus musculus
ggaaatggaactgtggttcaccagc

SEQ ID NO: 582288 - DNA, 25 bp, Mus musculus
ggaaatggagggagccaccagccct

SEQ ID NO: 582289 - DNA, 25 bp, Mus musculus
ggaaatggagggtgccaccagccct

SEQ ID NO: 582290 - DNA, 25 bp, Mus musculus
ggaaatggagtactcgttggaaata

SEQ ID NO: 582291 - DNA, 25 bp, Mus musculus
ggaaatggagtagtcgttggaaata

SEQ ID NO: 582292 - DNA, 25 bp, Mus musculus
ggaaatggcagccagcctcaagaga

SEQ ID NO: 582293 - DNA, 25 bp, Mus musculus
ggaaatggcagcgagcctcaagaga

SEQ ID NO: 582294 - DNA, 25 bp, Mus musculus
ggaaatggcagtcatgctttcttct

SEQ ID NO: 582295 - DNA, 25 bp, Mus musculus
ggaaatggcagtgatgctttcttct

SEQ ID NO: 582296 - DNA, 25 bp, Mus musculus
ggaaatggccccagtggctgtcccc

SEQ ID NO: 582297 - DNA, 25 bp, Mus musculus
ggaaatggcccccagaaaggactct

SEQ ID NO: 582298 - DNA, 25 bp, Mus musculus
ggaaatggccccgagaaaggactct

SEQ ID NO: 582299 - DNA, 25 bp, Mus musculus
ggaaatggcccctgtggctgtcccc

SEQ ID NO: 582300 - DNA, 25 bp, Mus musculus
ggaaatggctggagactctgagtca

SEQ ID NO: 582301 - DNA, 25 bp, Mus musculus
ggaaatggctggtgactctgagtca

SEQ ID NO: 582302 - DNA, 25 bp, Mus musculus
ggaaatgggctacttctctcagtat

SEQ ID NO: 582303 - DNA, 25 bp, Mus musculus
ggaaatgggctagttctctcagtat

SEQ ID NO: 582304 - DNA, 25 bp, Mus musculus
ggaaatgggctcatagcagacctaa

SEQ ID NO: 582305 - DNA, 25 bp, Mus musculus
ggaaatgggctcttagcagacctaa

SEQ ID NO: 582306 - DNA, 25 bp, Mus musculus
ggaaatggtagacttgaaaaatcat

SEQ ID NO: 582307 - DNA, 25 bp, Mus musculus
ggaaatggtagagttgaaaaatcat

SEQ ID NO: 582308 - DNA, 25 bp, Mus musculus
ggaaatggtcacacaaacctttaat

SEQ ID NO: 582309 - DNA, 25 bp, Mus musculus
ggaaatggtcactcaaacctttaat

SEQ ID NO: 582310 - DNA, 25 bp, Mus musculus
ggaaatggtgagctaaagcatctac

SEQ ID NO: 582311 - DNA, 25 bp, Mus musculus
ggaaatggtgaggtaaagcatctac

SEQ ID NO: 582312 - DNA, 25 bp, Mus musculus
ggaaatggtgttatcttatattctt

SEQ ID NO: 582313 - DNA, 25 bp, Mus musculus
ggaaatggtgttttcttatattctt

SEQ ID NO: 582314 - DNA, 25 bp, Mus musculus
ggaaatggttggagtattttgtcag

SEQ ID NO: 582315 - DNA, 25 bp, Mus musculus
ggaaatggttggtgtattttgtcag

SEQ ID NO: 582316 - DNA, 25 bp, Mus musculus
ggaaatggtttcctgagatgtatac

SEQ ID NO: 582317 - DNA, 25 bp, Mus musculus
ggaaatggtttcgtgagatgtatac

SEQ ID NO: 582318 - DNA, 25 bp, Mus musculus
ggaaatgtacagatgctgacccttt

SEQ ID NO: 582319 - DNA, 25 bp, Mus musculus
ggaaatgtacagttgctgacccttt

SEQ ID NO: 582320 - DNA, 25 bp, Mus musculus
ggaaatgtaccgactgatgctgcag

SEQ ID NO: 582321 - DNA, 25 bp, Mus musculus
ggaaatgtaccgtctgatgctgcag

SEQ ID NO: 582322 - DNA, 25 bp, Mus musculus
ggaaatgtagccattgtcaccagcc

SEQ ID NO: 582323 - DNA, 25 bp, Mus musculus
ggaaatgtagcctttgtcaccagcc

SEQ ID NO: 582324 - DNA, 25 bp, Mus musculus
ggaaatgtagtccagaccatattta

SEQ ID NO: 582325 - DNA, 25 bp, Mus musculus
ggaaatgtagtcgagaccatattta

SEQ ID NO: 582326 - DNA, 25 bp, Mus musculus
ggaaatgtatttcatactggccaca

SEQ ID NO: 582327 - DNA, 25 bp, Mus musculus
ggaaatgtatttgatactggccaca

SEQ ID NO: 582328 - DNA, 25 bp, Mus musculus
ggaaatgtcactcagccatcactga

SEQ ID NO: 582329 - DNA, 25 bp, Mus musculus
ggaaatgtcactgagccatcactga

SEQ ID NO: 582330 - DNA, 25 bp, Mus musculus
ggaaatgtcagtattctttctctct

SEQ ID NO: 582331 - DNA, 25 bp, Mus musculus
ggaaatgtcagttttctttctctct

SEQ ID NO: 582332 - DNA, 25 bp, Mus musculus
ggaaatgtcattctcgtaacgtgtt

SEQ ID NO: 582333 - DNA, 25 bp, Mus musculus
ggaaatgtcattgtcgtaacgtgtt

SEQ ID NO: 582334 - DNA, 25 bp, Mus musculus
ggaaatgtcctccaaaggcttagat

SEQ ID NO: 582335 - DNA, 25 bp, Mus musculus
ggaaatgtcctcgaaaggcttagat

SEQ ID NO: 582336 - DNA, 25 bp, Mus musculus
ggaaatgtcttcattgtcccaagag

SEQ ID NO: 582337 - DNA, 25 bp, Mus musculus
ggaaatgtcttctttgtcccaagag

SEQ ID NO: 582338 - DNA, 25 bp, Mus musculus
ggaaatgtcttgaacttacgtacca

SEQ ID NO: 582339 - DNA, 25 bp, Mus musculus
ggaaatgtcttgacactaaaccata

SEQ ID NO: 582340 - DNA, 25 bp, Mus musculus
ggaaatgtcttgtacttacgtacca

SEQ ID NO: 582341 - DNA, 25 bp, Mus musculus
ggaaatgtcttgtcactaaaccata

SEQ ID NO: 582342 - DNA, 25 bp, Mus musculus
ggaaatgtctttatacccacagatg

SEQ ID NO: 582343 - DNA, 25 bp, Mus musculus
ggaaatgtctttttacccacagatg

SEQ ID NO: 582344 - DNA, 25 bp, Mus musculus
ggaaatgtgacaatatctcacctta

SEQ ID NO: 582345 - DNA, 25 bp, Mus musculus
ggaaatgtgacattatctcacctta

SEQ ID NO: 582346 - DNA, 25 bp, Mus musculus
ggaaatgtgtaacctgaaactaagt

SEQ ID NO: 582347 - DNA, 25 bp, Mus musculus
ggaaatgtgtaagctgaaactaagt

SEQ ID NO: 582348 - DNA, 25 bp, Mus musculus
ggaaatgtgtctatctaccatgtta

SEQ ID NO: 582349 - DNA, 25 bp, Mus musculus
ggaaatgtgtctttctaccatgtta

SEQ ID NO: 582350 - DNA, 25 bp, Mus musculus
ggaaatgttaagagccttggcctcc

SEQ ID NO: 582351 - DNA, 25 bp, Mus musculus
ggaaatgttaagtgccttggcctcc

SEQ ID NO: 582352 - DNA, 25 bp, Mus musculus
ggaaatgttccaactccttagaagg

SEQ ID NO: 582353 - DNA, 25 bp, Mus musculus
ggaaatgttccatctccttagaagg

SEQ ID NO: 582354 - DNA, 25 bp, Mus musculus
ggaaatgttccgctcaaatttagtt

SEQ ID NO: 582355 - DNA, 25 bp, Mus musculus
ggaaatgttccggtcaaatttagtt

SEQ ID NO: 582356 - DNA, 25 bp, Mus musculus
ggaaatgttctaatcggatcatggt

SEQ ID NO: 582357 - DNA, 25 bp, Mus musculus
ggaaatgttctattcggatcatggt

SEQ ID NO: 582358 - DNA, 25 bp, Mus musculus
ggaaatgttcttatgggtagtctca

SEQ ID NO: 582359 - DNA, 25 bp, Mus musculus
ggaaatgttcttttgggtagtctca

SEQ ID NO: 582360 - DNA, 25 bp, Mus musculus
ggaaatgttgtccagccagtcagca

SEQ ID NO: 582361 - DNA, 25 bp, Mus musculus
ggaaatgttgtcgagccagtcagca

SEQ ID NO: 582362 - DNA, 25 bp, Mus musculus
ggaaatgtttatatcttactccttt

SEQ ID NO: 582363 - DNA, 25 bp, Mus musculus
ggaaatgtttatttcttactccttt

SEQ ID NO: 582364 - DNA, 25 bp, Mus musculus
ggaaatgtttgtcaacgattcgaaa

SEQ ID NO: 582365 - DNA, 25 bp, Mus musculus
ggaaatgtttgtgaacgattcgaaa

SEQ ID NO: 582366 - DNA, 25 bp, Mus musculus
ggaaattaacacatcattgccctgg

SEQ ID NO: 582367 - DNA, 25 bp, Mus musculus
ggaaattaacacttcattgccctgg

SEQ ID NO: 582368 - DNA, 25 bp, Mus musculus
ggaaattaagccatctccaagcaga

SEQ ID NO: 582369 - DNA, 25 bp, Mus musculus
ggaaattaagccttctccaagcaga

SEQ ID NO: 582370 - DNA, 25 bp, Mus musculus
ggaaattaatgtcacccactgctcg

SEQ ID NO: 582371 - DNA, 25 bp, Mus musculus
ggaaattaatgtgacccactgctcg

SEQ ID NO: 582372 - DNA, 25 bp, Mus musculus
ggaaattacataccgagcttcaaat

SEQ ID NO: 582373 - DNA, 25 bp, Mus musculus
ggaaattacatagcgagcttcaaat

SEQ ID NO: 582374 - DNA, 25 bp, Mus musculus
ggaaattacccaacgtggccatata

SEQ ID NO: 582375 - DNA, 25 bp, Mus musculus
ggaaattacccatcgtggccatata

SEQ ID NO: 582376 - DNA, 25 bp, Mus musculus
ggaaattacccgactaatatcacat

SEQ ID NO: 582377 - DNA, 25 bp, Mus musculus
ggaaattacccgtctaatatcacat

SEQ ID NO: 582378 - DNA, 25 bp, Mus musculus
ggaaattactctccagctggtttgg

SEQ ID NO: 582379 - DNA, 25 bp, Mus musculus
ggaaattactctgcagctggtttgg

SEQ ID NO: 582380 - DNA, 25 bp, Mus musculus
ggaaattacttcctacattctggtc

SEQ ID NO: 582381 - DNA, 25 bp, Mus musculus
ggaaattacttcgtacattctggtc

SEQ ID NO: 582382 - DNA, 25 bp, Mus musculus
ggaaattagagaatcacttgtctct

SEQ ID NO: 582383 - DNA, 25 bp, Mus musculus
ggaaattagagattcacttgtctct

SEQ ID NO: 582384 - DNA, 25 bp, Mus musculus
ggaaattagctacacttgagacttt

SEQ ID NO: 582385 - DNA, 25 bp, Mus musculus
ggaaattagctagacttgagacttt

SEQ ID NO: 582386 - DNA, 25 bp, Mus musculus
ggaaattagctcatccaaagctatt

SEQ ID NO: 582387 - DNA, 25 bp, Mus musculus
ggaaattagctcttccaaagctatt

SEQ ID NO: 582388 - DNA, 25 bp, Mus musculus
ggaaattatctcctcataattcttt

SEQ ID NO: 582389 - DNA, 25 bp, Mus musculus
ggaaattatctcgtcataattcttt

SEQ ID NO: 582390 - DNA, 25 bp, Mus musculus
ggaaattatcttatgtaccaatgca

SEQ ID NO: 582391 - DNA, 25 bp, Mus musculus
ggaaattatcttttgtaccaatgca

SEQ ID NO: 582392 - DNA, 25 bp, Mus musculus
ggaaattatgtacctgccagaacca

SEQ ID NO: 582393 - DNA, 25 bp, Mus musculus
ggaaattatgtagctgccagaacca

SEQ ID NO: 582394 - DNA, 25 bp, Mus musculus
ggaaattcaaaacacgcagatggta

SEQ ID NO: 582395 - DNA, 25 bp, Mus musculus
ggaaattcaaaagacgcagatggta

SEQ ID NO: 582396 - DNA, 25 bp, Mus musculus
ggaaattcacataatccgaagacat

SEQ ID NO: 582397 - DNA, 25 bp, Mus musculus
ggaaattcacattatccgaagacat

SEQ ID NO: 582398 - DNA, 25 bp, Mus musculus
ggaaattcacttaaaggcaggcaag

SEQ ID NO: 582399 - DNA, 25 bp, Mus musculus
ggaaattcactttaaggcaggcaag

SEQ ID NO: 582400 - DNA, 25 bp, Mus musculus
ggaaattcatacatttcttgccttt

SEQ ID NO: 582401 - DNA, 25 bp, Mus musculus
ggaaattcatacttttcttgccttt

SEQ ID NO: 582402 - DNA, 25 bp, Mus musculus
ggaaattccagacacgggcagcagc

SEQ ID NO: 582403 - DNA, 25 bp, Mus musculus
ggaaattccagagacgggcagcagc

SEQ ID NO: 582404 - DNA, 25 bp, Mus musculus
ggaaattccatgagcattcttttta

SEQ ID NO: 582405 - DNA, 25 bp, Mus musculus
ggaaattccatgtgcattcttttta

SEQ ID NO: 582406 - DNA, 25 bp, Mus musculus
ggaaattccctacatgcacaaccat

SEQ ID NO: 582407 - DNA, 25 bp, Mus musculus
ggaaattccctagatgcacaaccat

SEQ ID NO: 582408 - DNA, 25 bp, Mus musculus
ggaaattcctgacaccttcggacat

SEQ ID NO: 582409 - DNA, 25 bp, Mus musculus
ggaaattcctgagaccttcggacat

SEQ ID NO: 582410 - DNA, 25 bp, Mus musculus
ggaaattctaaacgcatcactggta

SEQ ID NO: 582411 - DNA, 25 bp, Mus musculus
ggaaattctaaaggcatcactggta

SEQ ID NO: 582412 - DNA, 25 bp, Mus musculus
ggaaattctcaaagactgttctgat

SEQ ID NO: 582413 - DNA, 25 bp, Mus musculus
ggaaattctcaatgactgttctgat

SEQ ID NO: 582414 - DNA, 25 bp, Mus musculus
ggaaattctcatcgcctacctatgt

SEQ ID NO: 582415 - DNA, 25 bp, Mus musculus
ggaaattctcatggcctacctatgt

SEQ ID NO: 582416 - DNA, 25 bp, Mus musculus
ggaaattctgcgactgatccagttt

SEQ ID NO: 582417 - DNA, 25 bp, Mus musculus
ggaaattctgcgtctgatccagttt

SEQ ID NO: 582418 - DNA, 25 bp, Mus musculus
ggaaattctgtgaaataggagactt

SEQ ID NO: 582419 - DNA, 25 bp, Mus musculus
ggaaattctgtgtaataggagactt

SEQ ID NO: 582420 - DNA, 25 bp, Mus musculus
ggaaattcttctaaggagcctgcgt

SEQ ID NO: 582421 - DNA, 25 bp, Mus musculus
ggaaattcttcttaggagcctgcgt

SEQ ID NO: 582422 - DNA, 25 bp, Mus musculus
ggaaattcttgcacatacagctccc

SEQ ID NO: 582423 - DNA, 25 bp, Mus musculus
ggaaattcttgctcatacagctccc

SEQ ID NO: 582424 - DNA, 25 bp, Mus musculus
ggaaattgataccttagacccactt

SEQ ID NO: 582425 - DNA, 25 bp, Mus musculus
ggaaattgatacgttagacccactt

SEQ ID NO: 582426 - DNA, 25 bp, Mus musculus
ggaaattgatttccctctactaata

SEQ ID NO: 582427 - DNA, 25 bp, Mus musculus
ggaaattgatttgcctctactaata

SEQ ID NO: 582428 - DNA, 25 bp, Mus musculus
ggaaattgcaatactcctaaaccaa

SEQ ID NO: 582429 - DNA, 25 bp, Mus musculus
ggaaattgcaattctcctaaaccaa

SEQ ID NO: 582430 - DNA, 25 bp, Mus musculus
ggaaattgcagcagctactgttgta

SEQ ID NO: 582431 - DNA, 25 bp, Mus musculus
ggaaattgcagctgctactgttgta

SEQ ID NO: 582432 - DNA, 25 bp, Mus musculus
ggaaattgccagcaacctcacctgc

SEQ ID NO: 582433 - DNA, 25 bp, Mus musculus
ggaaattgccaggaacctcacctgc

SEQ ID NO: 582434 - DNA, 25 bp, Mus musculus
ggaaattgctgcaacgcggcactca

SEQ ID NO: 582435 - DNA, 25 bp, Mus musculus
ggaaattgctgctacgcggcactca

SEQ ID NO: 582436 - DNA, 25 bp, Mus musculus
ggaaattgctggcattcgcccactc

SEQ ID NO: 582437 - DNA, 25 bp, Mus musculus
ggaaattgctgggattcgcccactc

SEQ ID NO: 582438 - DNA, 25 bp, Mus musculus
ggaaattgcttcaccaaatggatac

SEQ ID NO: 582439 - DNA, 25 bp, Mus musculus
ggaaattgcttctccaaatggatac

SEQ ID NO: 582440 - DNA, 25 bp, Mus musculus
ggaaattggattcccgggctcagca

SEQ ID NO: 582441 - DNA, 25 bp, Mus musculus
ggaaattggattgccgggctcagca

SEQ ID NO: 582442 - DNA, 25 bp, Mus musculus
ggaaattgggctacacccaatctca

SEQ ID NO: 582443 - DNA, 25 bp, Mus musculus
ggaaattgggcttcacccaatctca

SEQ ID NO: 582444 - DNA, 25 bp, Mus musculus
ggaaattgtcacctatggccggatc

SEQ ID NO: 582445 - DNA, 25 bp, Mus musculus
ggaaattgtcacgtatggccggatc

SEQ ID NO: 582446 - DNA, 25 bp, Mus musculus
ggaaattgtctcctgctacaaaaca

SEQ ID NO: 582447 - DNA, 25 bp, Mus musculus
ggaaattgtctcgtgctacaaaaca

SEQ ID NO: 582448 - DNA, 25 bp, Mus musculus
ggaaattgtgatcctctctgtcttc

SEQ ID NO: 582449 - DNA, 25 bp, Mus musculus
ggaaattgtgatgctctctgtcttc

SEQ ID NO: 582450 - DNA, 25 bp, Mus musculus
ggaaattgttgtactgtctcaggag

SEQ ID NO: 582451 - DNA, 25 bp, Mus musculus
ggaaattgttgttctgtctcaggag

SEQ ID NO: 582452 - DNA, 25 bp, Mus musculus
ggaaatttaactactcttgggtcat

SEQ ID NO: 582453 - DNA, 25 bp, Mus musculus
ggaaatttaacttctcttgggtcat

SEQ ID NO: 582454 - DNA, 25 bp, Mus musculus
ggaaatttaggcagaattctctatc

SEQ ID NO: 582455 - DNA, 25 bp, Mus musculus
ggaaatttaggctgaattctctatc

SEQ ID NO: 582456 - DNA, 25 bp, Mus musculus
ggaaatttatggatcctagcccact

SEQ ID NO: 582457 - DNA, 25 bp, Mus musculus
ggaaatttatggttcctagcccact

SEQ ID NO: 582458 - DNA, 25 bp, Mus musculus
ggaaatttcaaaacatattcagaca

SEQ ID NO: 582459 - DNA, 25 bp, Mus musculus
ggaaatttcaaatcatattcagaca

SEQ ID NO: 582460 - DNA, 25 bp, Mus musculus
ggaaatttcagcattactatttggt

SEQ ID NO: 582461 - DNA, 25 bp, Mus musculus
ggaaatttcagctttactatttggt

SEQ ID NO: 582462 - DNA, 25 bp, Mus musculus
ggaaatttccatctttcttcagcta

SEQ ID NO: 582463 - DNA, 25 bp, Mus musculus
ggaaatttccatgtttcttcagcta

SEQ ID NO: 582464 - DNA, 25 bp, Mus musculus
ggaaatttctaacctcacagtggag

SEQ ID NO: 582465 - DNA, 25 bp, Mus musculus
ggaaatttctaagctcacagtggag

SEQ ID NO: 582466 - DNA, 25 bp, Mus musculus
ggaaatttctcacgataaagatttt

SEQ ID NO: 582467 - DNA, 25 bp, Mus musculus
ggaaatttctcaggataaagatttt

SEQ ID NO: 582468 - DNA, 25 bp, Mus musculus
ggaaatttcttcatcaacccaagca

SEQ ID NO: 582469 - DNA, 25 bp, Mus musculus
ggaaatttcttcttcaacccaagca

SEQ ID NO: 582470 - DNA, 25 bp, Mus musculus
ggaaatttctttctgagcttgactt

SEQ ID NO: 582471 - DNA, 25 bp, Mus musculus
ggaaatttctttgtgagcttgactt

SEQ ID NO: 582472 - DNA, 25 bp, Mus musculus
ggaaatttgcaccagctgggcatcc

SEQ ID NO: 582473 - DNA, 25 bp, Mus musculus
ggaaatttgcacgagctgggcatcc

SEQ ID NO: 582474 - DNA, 25 bp, Mus musculus
ggaaatttgcatcaaacactacaat

SEQ ID NO: 582475 - DNA, 25 bp, Mus musculus
ggaaatttgcatgaaacactacaat

SEQ ID NO: 582476 - DNA, 25 bp, Mus musculus
ggaaatttgcccatatgtgttacga

SEQ ID NO: 582477 - DNA, 25 bp, Mus musculus
ggaaatttgcccttatgtgttacga

SEQ ID NO: 582478 - DNA, 25 bp, Mus musculus
ggaaatttgcctacaccgtttctca

SEQ ID NO: 582479 - DNA, 25 bp, Mus musculus
ggaaatttgccttcaccgtttctca

SEQ ID NO: 582480 - DNA, 25 bp, Mus musculus
ggaaatttggccaacccgagacatt

SEQ ID NO: 582481 - DNA, 25 bp, Mus musculus
ggaaatttggcctacccgagacatt

SEQ ID NO: 582482 - DNA, 25 bp, Mus musculus
ggaaatttgtgtatgctcactattg

SEQ ID NO: 582483 - DNA, 25 bp, Mus musculus
ggaaatttgtgtttgctcactattg

SEQ ID NO: 582484 - DNA, 25 bp, Mus musculus
ggaaattttacaccatgcctccatg

SEQ ID NO: 582485 - DNA, 25 bp, Mus musculus
ggaaattttacagcatgcctccatg

SEQ ID NO: 582486 - DNA, 25 bp, Mus musculus
ggaaattttaccatcgcagcagctt

SEQ ID NO: 582487 - DNA, 25 bp, Mus musculus
ggaaattttaccttcgcagcagctt

SEQ ID NO: 582488 - DNA, 25 bp, Mus musculus
ggaaattttactaggatgacagaga

SEQ ID NO: 582489 - DNA, 25 bp, Mus musculus
ggaaattttacttggatgacagaga

SEQ ID NO: 582490 - DNA, 25 bp, Mus musculus
ggaaattttgctaacacaatactta

SEQ ID NO: 582491 - DNA, 25 bp, Mus musculus
ggaaattttgcttacacaatactta

SEQ ID NO: 582492 - DNA, 25 bp, Mus musculus
ggaaattttgttagttactgtcatt

SEQ ID NO: 582493 - DNA, 25 bp, Mus musculus
ggaaattttgtttgttactgtcatt

SEQ ID NO: 582494 - DNA, 25 bp, Mus musculus
ggaaatttttccctcttcaattgtg

SEQ ID NO: 582495 - DNA, 25 bp, Mus musculus
ggaaatttttccgtcttcaattgtg

SEQ ID NO: 582496 - DNA, 25 bp, Mus musculus
ggaacaaaaatgatcttcgctggaa

SEQ ID NO: 582497 - DNA, 25 bp, Mus musculus
ggaacaaaaatgttcttcgctggaa

SEQ ID NO: 582498 - DNA, 25 bp, Mus musculus
ggaacaaaacgaacaaggagacaga

SEQ ID NO: 582499 - DNA, 25 bp, Mus musculus
ggaacaaaacgatcaaggagacaga

SEQ ID NO: 582500 - DNA, 25 bp, Mus musculus
ggaacaaaagacacaagacgacgga

SEQ ID NO: 582501 - DNA, 25 bp, Mus musculus
ggaacaaaagactcaagacgacgga

SEQ ID NO: 582502 - DNA, 25 bp, Mus musculus
ggaacaaaagtaccagtccaccttg

SEQ ID NO: 582503 - DNA, 25 bp, Mus musculus
ggaacaaaagtagcagtccaccttg

SEQ ID NO: 582504 - DNA, 25 bp, Mus musculus
ggaacaaaagtgacttatggcataa

SEQ ID NO: 582505 - DNA, 25 bp, Mus musculus
ggaacaaaagtgtcttatggcataa

SEQ ID NO: 582506 - DNA, 25 bp, Mus musculus
ggaacaaaatctcctttggctcagt

SEQ ID NO: 582507 - DNA, 25 bp, Mus musculus
ggaacaaaatctgctttggctcagt

SEQ ID NO: 582508 - DNA, 25 bp, Mus musculus
ggaacaaaccttaagcatctgctgc

SEQ ID NO: 582509 - DNA, 25 bp, Mus musculus
ggaacaaacctttagcatctgctgc

SEQ ID NO: 582510 - DNA, 25 bp, Mus musculus
ggaacaaactgcaaacaccacgcca

SEQ ID NO: 582511 - DNA, 25 bp, Mus musculus
ggaacaaactgctaacaccacgcca

SEQ ID NO: 582512 - DNA, 25 bp, Mus musculus
ggaacaaactggaggatcaattata

SEQ ID NO: 582513 - DNA, 25 bp, Mus musculus
ggaacaaactggtggatcaattata

SEQ ID NO: 582514 - DNA, 25 bp, Mus musculus
ggaacaaactgtcaacattgggagt

SEQ ID NO: 582515 - DNA, 25 bp, Mus musculus
ggaacaaactgtgaacattgggagt

SEQ ID NO: 582516 - DNA, 25 bp, Mus musculus
ggaacaaacttaacctagaactgct

SEQ ID NO: 582517 - DNA, 25 bp, Mus musculus
ggaacaaacttatcctagaactgct

SEQ ID NO: 582518 - DNA, 25 bp, Mus musculus
ggaacaaagaacagatccagctgaa

SEQ ID NO: 582519 - DNA, 25 bp, Mus musculus
ggaacaaagaactgatccagctgaa

SEQ ID NO: 582520 - DNA, 25 bp, Mus musculus
ggaacaaagatgaatcccatttagt

SEQ ID NO: 582521 - DNA, 25 bp, Mus musculus
ggaacaaagatgtatcccatttagt

SEQ ID NO: 582522 - DNA, 25 bp, Mus musculus
ggaacaaagcatacatcagggttga

SEQ ID NO: 582523 - DNA, 25 bp, Mus musculus
ggaacaaagcatcgagccacccctg

SEQ ID NO: 582524 - DNA, 25 bp, Mus musculus
ggaacaaagcatggagccacccctg

SEQ ID NO: 582525 - DNA, 25 bp, Mus musculus
ggaacaaagcattcatcagggttga

SEQ ID NO: 582526 - DNA, 25 bp, Mus musculus
ggaacaaaggttatcttgcatctga

SEQ ID NO: 582527 - DNA, 25 bp, Mus musculus
ggaacaaaggttttcttgcatctga

SEQ ID NO: 582528 - DNA, 25 bp, Mus musculus
ggaacaaagtccaagctatccctgc

SEQ ID NO: 582529 - DNA, 25 bp, Mus musculus
ggaacaaagtcctagctatccctgc

SEQ ID NO: 582530 - DNA, 25 bp, Mus musculus
ggaacaaatactactacgtcgccga

SEQ ID NO: 582531 - DNA, 25 bp, Mus musculus
ggaacaaatacttctacgtcgccga

SEQ ID NO: 582532 - DNA, 25 bp, Mus musculus
ggaacaaatttgcacctgtttacaa

SEQ ID NO: 582533 - DNA, 25 bp, Mus musculus
ggaacaaatttggacctgtttacaa

SEQ ID NO: 582534 - DNA, 25 bp, Mus musculus
ggaacaacaacccagctggcctgtg

SEQ ID NO: 582535 - DNA, 25 bp, Mus musculus
ggaacaacaaccgagctggcctgtg

SEQ ID NO: 582536 - DNA, 25 bp, Mus musculus
ggaacaacaactacaactgcaggct

SEQ ID NO: 582537 - DNA, 25 bp, Mus musculus
ggaacaacaacttcaactgcaggct

SEQ ID NO: 582538 - DNA, 25 bp, Mus musculus
ggaacaacacagacctacatggccc

SEQ ID NO: 582539 - DNA, 25 bp, Mus musculus
ggaacaacacagtcctacatggccc

SEQ ID NO: 582540 - DNA, 25 bp, Mus musculus
ggaacaacagatcgtgtcaatttca

SEQ ID NO: 582541 - DNA, 25 bp, Mus musculus
ggaacaacagatggtgtcaatttca

SEQ ID NO: 582542 - DNA, 25 bp, Mus musculus
ggaacaacagttcctcactgtgacc

SEQ ID NO: 582543 - DNA, 25 bp, Mus musculus
ggaacaacagttgctcactgtgacc

SEQ ID NO: 582544 - DNA, 25 bp, Mus musculus
ggaacaaccaacctaaggccacatg

SEQ ID NO: 582545 - DNA, 25 bp, Mus musculus
ggaacaaccaacgtaaggccacatg

SEQ ID NO: 582546 - DNA, 25 bp, Mus musculus
ggaacaaccaagcatgtgccagtga

SEQ ID NO: 582547 - DNA, 25 bp, Mus musculus
ggaacaaccaaggatgtgccagtga

SEQ ID NO: 582548 - DNA, 25 bp, Mus musculus
ggaacaaccactccgggattgctac

SEQ ID NO: 582549 - DNA, 25 bp, Mus musculus
ggaacaaccactgcgggattgctac

SEQ ID NO: 582550 - DNA, 25 bp, Mus musculus
ggaacaaccccacatcagaatttct

SEQ ID NO: 582551 - DNA, 25 bp, Mus musculus
ggaacaaccccagatcagaatttct

SEQ ID NO: 582552 - DNA, 25 bp, Mus musculus
ggaacaacctcacccaggacatgga

SEQ ID NO: 582553 - DNA, 25 bp, Mus musculus
ggaacaacctcagccaggacatgga

SEQ ID NO: 582554 - DNA, 25 bp, Mus musculus
ggaacaacgagtacatcatgagttt

SEQ ID NO: 582555 - DNA, 25 bp, Mus musculus
ggaacaacgagttcatcatgagttt

SEQ ID NO: 582556 - DNA, 25 bp, Mus musculus
ggaacaacggcgctttgctgcccct

SEQ ID NO: 582557 - DNA, 25 bp, Mus musculus
ggaacaacggcggtttgctgcccct

SEQ ID NO: 582558 - DNA, 25 bp, Mus musculus
ggaacaactagtatctcattcagaa

SEQ ID NO: 582559 - DNA, 25 bp, Mus musculus
ggaacaactagtttctcattcagaa

SEQ ID NO: 582560 - DNA, 25 bp, Mus musculus
ggaacaactccgaaaagccaatgaa

SEQ ID NO: 582561 - DNA, 25 bp, Mus musculus
ggaacaactccgtaaagccaatgaa

SEQ ID NO: 582562 - DNA, 25 bp, Mus musculus
ggaacaactcctaaaccagtcacta

SEQ ID NO: 582563 - DNA, 25 bp, Mus musculus
ggaacaactccttaaccagtcacta

SEQ ID NO: 582564 - DNA, 25 bp, Mus musculus
ggaacaactctgcatcagcttacaa

SEQ ID NO: 582565 - DNA, 25 bp, Mus musculus
ggaacaactctggatcagcttacaa

SEQ ID NO: 582566 - DNA, 25 bp, Mus musculus
ggaacaactgagaagcaccatttta

SEQ ID NO: 582567 - DNA, 25 bp, Mus musculus
ggaacaactgagtagcaccatttta

SEQ ID NO: 582568 - DNA, 25 bp, Mus musculus
ggaacaactgcaaacctgacacatg

SEQ ID NO: 582569 - DNA, 25 bp, Mus musculus
ggaacaactgcatacctgacacatg

SEQ ID NO: 582570 - DNA, 25 bp, Mus musculus
ggaacaactggtatgtacagaacag

SEQ ID NO: 582571 - DNA, 25 bp, Mus musculus
ggaacaactggtttgtacagaacag

SEQ ID NO: 582572 - DNA, 25 bp, Mus musculus
ggaacaactgtacatttgccaatgg

SEQ ID NO: 582573 - DNA, 25 bp, Mus musculus
ggaacaactgtagatttgccaatgg

SEQ ID NO: 582574 - DNA, 25 bp, Mus musculus
ggaacaacttgaaacctctaatgaa

SEQ ID NO: 582575 - DNA, 25 bp, Mus musculus
ggaacaacttgatacctctaatgaa

SEQ ID NO: 582576 - DNA, 25 bp, Mus musculus
ggaacaacttgtcttttcagccggc

SEQ ID NO: 582577 - DNA, 25 bp, Mus musculus
ggaacaacttgtgttttcagccggc

SEQ ID NO: 582578 - DNA, 25 bp, Mus musculus
ggaacaagaagtcctggcccctcag

SEQ ID NO: 582579 - DNA, 25 bp, Mus musculus
ggaacaagaagtgctggcccctcag

SEQ ID NO: 582580 - DNA, 25 bp, Mus musculus
ggaacaagaccaaccaagaaatcaa

SEQ ID NO: 582581 - DNA, 25 bp, Mus musculus
ggaacaagaccatccaagaaatcaa

SEQ ID NO: 582582 - DNA, 25 bp, Mus musculus
ggaacaagcaggcagttatattcct

SEQ ID NO: 582583 - DNA, 25 bp, Mus musculus
ggaacaagcagggagttatattcct

SEQ ID NO: 582584 - DNA, 25 bp, Mus musculus
ggaacaagccagaaggcagcctctc

SEQ ID NO: 582585 - DNA, 25 bp, Mus musculus
ggaacaagccagtaggcagcctctc

SEQ ID NO: 582586 - DNA, 25 bp, Mus musculus
ggaacaagcctccaagacggtccag

SEQ ID NO: 582587 - DNA, 25 bp, Mus musculus
ggaacaagcctcgaagacggtccag

SEQ ID NO: 582588 - DNA, 25 bp, Mus musculus
ggaacaagccttatcaagacgtgaa

SEQ ID NO: 582589 - DNA, 25 bp, Mus musculus
ggaacaagccttttcaagacgtgaa

SEQ ID NO: 582590 - DNA, 25 bp, Mus musculus
ggaacaagcgaacccctgccctaat

SEQ ID NO: 582591 - DNA, 25 bp, Mus musculus
ggaacaagcgaagccctgccctaat

SEQ ID NO: 582592 - DNA, 25 bp, Mus musculus
ggaacaagcgttatacattcttctg

SEQ ID NO: 582593 - DNA, 25 bp, Mus musculus
ggaacaagcgttttacattcttctg

SEQ ID NO: 582594 - DNA, 25 bp, Mus musculus
ggaacaagctcacatcagcaaccta

SEQ ID NO: 582595 - DNA, 25 bp, Mus musculus
ggaacaagctcagatcagcaaccta

SEQ ID NO: 582596 - DNA, 25 bp, Mus musculus
ggaacaagctgtacgtctcttgcga

SEQ ID NO: 582597 - DNA, 25 bp, Mus musculus
ggaacaagctgtccttctgtcacgc

SEQ ID NO: 582598 - DNA, 25 bp, Mus musculus
ggaacaagctgtgcttctgtcacgc

SEQ ID NO: 582599 - DNA, 25 bp, Mus musculus
ggaacaagctgttcgtctcttgcga

SEQ ID NO: 582600 - DNA, 25 bp, Mus musculus
ggaacaaggcgcctgtgtcctctac

SEQ ID NO: 582601 - DNA, 25 bp, Mus musculus
ggaacaaggcgcgtgtgtcctctac

SEQ ID NO: 582602 - DNA, 25 bp, Mus musculus
ggaacaagtctcagactttgtcagt

SEQ ID NO: 582603 - DNA, 25 bp, Mus musculus
ggaacaagtctctgactttgtcagt

SEQ ID NO: 582604 - DNA, 25 bp, Mus musculus
ggaacaagtgccctgccagcagaac

SEQ ID NO: 582605 - DNA, 25 bp, Mus musculus
ggaacaagtgccgtgccagcagaac

SEQ ID NO: 582606 - DNA, 25 bp, Mus musculus
ggaacaagtgtcattctgtaccata

SEQ ID NO: 582607 - DNA, 25 bp, Mus musculus
ggaacaagtgtctttctgtaccata

SEQ ID NO: 582608 - DNA, 25 bp, Mus musculus
ggaacaatcacaccctctagttaga

SEQ ID NO: 582609 - DNA, 25 bp, Mus musculus
ggaacaatcacagcctctagttaga

SEQ ID NO: 582610 - DNA, 25 bp, Mus musculus
ggaacaatcagcaacccacaaagta

SEQ ID NO: 582611 - DNA, 25 bp, Mus musculus
ggaacaatcagctacccacaaagta

SEQ ID NO: 582612 - DNA, 25 bp, Mus musculus
ggaacaatcagtagtggaacccttt

SEQ ID NO: 582613 - DNA, 25 bp, Mus musculus
ggaacaatcagttgtggaacccttt

SEQ ID NO: 582614 - DNA, 25 bp, Mus musculus
ggaacaatcattatattttgggtaa

SEQ ID NO: 582615 - DNA, 25 bp, Mus musculus
ggaacaatcattttattttgggtaa

SEQ ID NO: 582616 - DNA, 25 bp, Mus musculus
ggaacaatcctcatctactcatgaa

SEQ ID NO: 582617 - DNA, 25 bp, Mus musculus
ggaacaatcctcttctactcatgaa

SEQ ID NO: 582618 - DNA, 25 bp, Mus musculus
ggaacaatctgcattcactaaattt

SEQ ID NO: 582619 - DNA, 25 bp, Mus musculus
ggaacaatctgctttcactaaattt

SEQ ID NO: 582620 - DNA, 25 bp, Mus musculus
ggaacaatgacaatactgaactgta

SEQ ID NO: 582621 - DNA, 25 bp, Mus musculus
ggaacaatgacattactgaactgta

SEQ ID NO: 582622 - DNA, 25 bp, Mus musculus
ggaacaatgccaacttcctcagcta

SEQ ID NO: 582623 - DNA, 25 bp, Mus musculus
ggaacaatgccatcttcctcagcta

SEQ ID NO: 582624 - DNA, 25 bp, Mus musculus
ggaacaatggccatatagagctgtg

SEQ ID NO: 582625 - DNA, 25 bp, Mus musculus
ggaacaatggccttatagagctgtg

SEQ ID NO: 582626 - DNA, 25 bp, Mus musculus
ggaacaattaccattcagctggaga

SEQ ID NO: 582627 - DNA, 25 bp, Mus musculus
ggaacaattacctttcagctggaga

SEQ ID NO: 582628 - DNA, 25 bp, Mus musculus
ggaacaattctccttgggaaccctg

SEQ ID NO: 582629 - DNA, 25 bp, Mus musculus
ggaacaattctcgttgggaaccctg

SEQ ID NO: 582630 - DNA, 25 bp, Mus musculus
ggaacaattgctattccatcacaga

SEQ ID NO: 582631 - DNA, 25 bp, Mus musculus
ggaacaattgcttttccatcacaga

SEQ ID NO: 582632 - DNA, 25 bp, Mus musculus
ggaacaattggccagttgtgaactg

SEQ ID NO: 582633 - DNA, 25 bp, Mus musculus
ggaacaattggcgagttgtgaactg

SEQ ID NO: 582634 - DNA, 25 bp, Mus musculus
ggaacacaaagtaccacctctgcat

SEQ ID NO: 582635 - DNA, 25 bp, Mus musculus
ggaacacaaagttccacctctgcat

SEQ ID NO: 582636 - DNA, 25 bp, Mus musculus
ggaacacaaatacccacctgtcact

SEQ ID NO: 582637 - DNA, 25 bp, Mus musculus
ggaacacaaatagccacctgtcact

SEQ ID NO: 582638 - DNA, 25 bp, Mus musculus
ggaacacaagctccaagcagggtcc

SEQ ID NO: 582639 - DNA, 25 bp, Mus musculus
ggaacacaagctgcaagcagggtcc

SEQ ID NO: 582640 - DNA, 25 bp, Mus musculus
ggaacacaatttacgaaaccagctt

SEQ ID NO: 582641 - DNA, 25 bp, Mus musculus
ggaacacaattttcgaaaccagctt

SEQ ID NO: 582642 - DNA, 25 bp, Mus musculus
ggaacacacaatattatcaaggcaa

SEQ ID NO: 582643 - DNA, 25 bp, Mus musculus
ggaacacacaattttatcaaggcaa

SEQ ID NO: 582644 - DNA, 25 bp, Mus musculus
ggaacacacactagggagcctcagt

SEQ ID NO: 582645 - DNA, 25 bp, Mus musculus
ggaacacacacttgggagcctcagt

SEQ ID NO: 582646 - DNA, 25 bp, Mus musculus
ggaacacacagccttaagtgtcttt

SEQ ID NO: 582647 - DNA, 25 bp, Mus musculus
ggaacacacagcgttaagtgtcttt

SEQ ID NO: 582648 - DNA, 25 bp, Mus musculus
ggaacacacagtatgcattttctga

SEQ ID NO: 582649 - DNA, 25 bp, Mus musculus
ggaacacacagtttgcattttctga

SEQ ID NO: 582650 - DNA, 25 bp, Mus musculus
ggaacacacattctctggagtgcat

SEQ ID NO: 582651 - DNA, 25 bp, Mus musculus
ggaacacacattgtctggagtgcat

SEQ ID NO: 582652 - DNA, 25 bp, Mus musculus
ggaacacaccagactcagactttat

SEQ ID NO: 582653 - DNA, 25 bp, Mus musculus
ggaacacaccagtctcagactttat

SEQ ID NO: 582654 - DNA, 25 bp, Mus musculus
ggaacacaccatatgccactattcc

SEQ ID NO: 582655 - DNA, 25 bp, Mus musculus
ggaacacaccatttgccactattcc

SEQ ID NO: 582656 - DNA, 25 bp, Mus musculus
ggaacacacccacagtaggcctgag

SEQ ID NO: 582657 - DNA, 25 bp, Mus musculus
ggaacacacccagagtaggcctgag

SEQ ID NO: 582658 - DNA, 25 bp, Mus musculus
ggaacacacgaacatacaaaaactt

SEQ ID NO: 582659 - DNA, 25 bp, Mus musculus
ggaacacacgaagatacaaaaactt

SEQ ID NO: 582660 - DNA, 25 bp, Mus musculus
ggaacacacgagaacacaagcccgg

SEQ ID NO: 582661 - DNA, 25 bp, Mus musculus
ggaacacacgagtacacaagcccgg

SEQ ID NO: 582662 - DNA, 25 bp, Mus musculus
ggaacacactaactattctttacat

SEQ ID NO: 582663 - DNA, 25 bp, Mus musculus
ggaacacactaagtattctttacat

SEQ ID NO: 582664 - DNA, 25 bp, Mus musculus
ggaacacacttacgcactgactata

SEQ ID NO: 582665 - DNA, 25 bp, Mus musculus
ggaacacacttaggcactgactata

SEQ ID NO: 582666 - DNA, 25 bp, Mus musculus
ggaacacagaataagtttggaactt

SEQ ID NO: 582667 - DNA, 25 bp, Mus musculus
ggaacacagaattagtttggaactt

SEQ ID NO: 582668 - DNA, 25 bp, Mus musculus
ggaacacagaggctcacacggctga

SEQ ID NO: 582669 - DNA, 25 bp, Mus musculus
ggaacacagagggtcacacggctga

SEQ ID NO: 582670 - DNA, 25 bp, Mus musculus
ggaacacagattatggttaccccag

SEQ ID NO: 582671 - DNA, 25 bp, Mus musculus
ggaacacagattttggttaccccag

SEQ ID NO: 582672 - DNA, 25 bp, Mus musculus
ggaacacaggacaagacactgccaa

SEQ ID NO: 582673 - DNA, 25 bp, Mus musculus
ggaacacaggaccttccctgtacat

SEQ ID NO: 582674 - DNA, 25 bp, Mus musculus
ggaacacaggacgttccctgtacat

SEQ ID NO: 582675 - DNA, 25 bp, Mus musculus
ggaacacaggactagacactgccaa

SEQ ID NO: 582676 - DNA, 25 bp, Mus musculus
ggaacacaggagcacattacctaga

SEQ ID NO: 582677 - DNA, 25 bp, Mus musculus
ggaacacaggaggacattacctaga

SEQ ID NO: 582678 - DNA, 25 bp, Mus musculus
ggaacacaggcaaacataaagacac

SEQ ID NO: 582679 - DNA, 25 bp, Mus musculus
ggaacacaggcatacataaagacac

SEQ ID NO: 582680 - DNA, 25 bp, Mus musculus
ggaacacagtaaagagtcagatgca

SEQ ID NO: 582681 - DNA, 25 bp, Mus musculus
ggaacacagtaatgagtcagatgca

SEQ ID NO: 582682 - DNA, 25 bp, Mus musculus
ggaacacagttcactacaagtctca

SEQ ID NO: 582683 - DNA, 25 bp, Mus musculus
ggaacacagttctctacaagtctca

SEQ ID NO: 582684 - DNA, 25 bp, Mus musculus
ggaacacatctgcattgaacacatc

SEQ ID NO: 582685 - DNA, 25 bp, Mus musculus
ggaacacatctggattgaacacatc

SEQ ID NO: 582686 - DNA, 25 bp, Mus musculus
ggaacacatggcagctaagctatag

SEQ ID NO: 582687 - DNA, 25 bp, Mus musculus
ggaacacatggctgctaagctatag

SEQ ID NO: 582688 - DNA, 25 bp, Mus musculus
ggaacacattctcattagggacact

SEQ ID NO: 582689 - DNA, 25 bp, Mus musculus
ggaacacattctgattagggacact

SEQ ID NO: 582690 - DNA, 25 bp, Mus musculus
ggaacacattgtcctctggagactt

SEQ ID NO: 582691 - DNA, 25 bp, Mus musculus
ggaacacattgtgctctggagactt

SEQ ID NO: 582692 - DNA, 25 bp, Mus musculus
ggaacacatttaaacacatagacag

SEQ ID NO: 582693 - DNA, 25 bp, Mus musculus
ggaacacatttatacacatagacag

SEQ ID NO: 582694 - DNA, 25 bp, Mus musculus
ggaacaccaaacaagctcccatggg

SEQ ID NO: 582695 - DNA, 25 bp, Mus musculus
ggaacaccaaactagctcccatggg

SEQ ID NO: 582696 - DNA, 25 bp, Mus musculus
ggaacaccaagtactccgatctgat

SEQ ID NO: 582697 - DNA, 25 bp, Mus musculus
ggaacaccaagttctccgatctgat

SEQ ID NO: 582698 - DNA, 25 bp, Mus musculus
ggaacaccacaaactcagatccata

SEQ ID NO: 582699 - DNA, 25 bp, Mus musculus
ggaacaccacaatctcagatccata

SEQ ID NO: 582700 - DNA, 25 bp, Mus musculus
ggaacaccacgcacctgttgcagcg

SEQ ID NO: 582701 - DNA, 25 bp, Mus musculus
ggaacaccacgctcctgttgcagcg

SEQ ID NO: 582702 - DNA, 25 bp, Mus musculus
ggaacaccagatagcagccttgaag

SEQ ID NO: 582703 - DNA, 25 bp, Mus musculus
ggaacaccagattgcagccttgaag

SEQ ID NO: 582704 - DNA, 25 bp, Mus musculus
ggaacaccagcccatgtcatcaaaa

SEQ ID NO: 582705 - DNA, 25 bp, Mus musculus
ggaacaccagccgatgtcatcaaaa

SEQ ID NO: 582706 - DNA, 25 bp, Mus musculus
ggaacaccaggtacccatttccaca

SEQ ID NO: 582707 - DNA, 25 bp, Mus musculus
ggaacaccaggtacttcctcattta

SEQ ID NO: 582708 - DNA, 25 bp, Mus musculus
ggaacaccaggttcccatttccaca

SEQ ID NO: 582709 - DNA, 25 bp, Mus musculus
ggaacaccaggttcttcctcattta

SEQ ID NO: 582710 - DNA, 25 bp, Mus musculus
ggaacaccagtcatccagaagtctg

SEQ ID NO: 582711 - DNA, 25 bp, Mus musculus
ggaacaccagtcctcacaattgtaa

SEQ ID NO: 582712 - DNA, 25 bp, Mus musculus
ggaacaccagtcgtcacaattgtaa

SEQ ID NO: 582713 - DNA, 25 bp, Mus musculus
ggaacaccagtcttccagaagtctg

SEQ ID NO: 582714 - DNA, 25 bp, Mus musculus
ggaacaccatcgcatgaaaggctac

SEQ ID NO: 582715 - DNA, 25 bp, Mus musculus
ggaacaccatcggatgaaaggctac

SEQ ID NO: 582716 - DNA, 25 bp, Mus musculus
ggaacaccatttacttggtttgcct

SEQ ID NO: 582717 - DNA, 25 bp, Mus musculus
ggaacaccattttcttggtttgcct

SEQ ID NO: 582718 - DNA, 25 bp, Mus musculus
ggaacacccaaaattaattcagcct

SEQ ID NO: 582719 - DNA, 25 bp, Mus musculus
ggaacacccaaatttaattcagcct

SEQ ID NO: 582720 - DNA, 25 bp, Mus musculus
ggaacacccaagcttgctcatgtgg

SEQ ID NO: 582721 - DNA, 25 bp, Mus musculus
ggaacacccaaggttgctcatgtgg

SEQ ID NO: 582722 - DNA, 25 bp, Mus musculus
ggaacacccatcatctcaacagagt

SEQ ID NO: 582723 - DNA, 25 bp, Mus musculus
ggaacacccatcttctcaacagagt

SEQ ID NO: 582724 - DNA, 25 bp, Mus musculus
ggaacacccattacagcctggctca

SEQ ID NO: 582725 - DNA, 25 bp, Mus musculus
ggaacacccatttcagcctggctca

SEQ ID NO: 582726 - DNA, 25 bp, Mus musculus
ggaacaccctttcctcagggagaag

SEQ ID NO: 582727 - DNA, 25 bp, Mus musculus
ggaacaccctttgctcagggagaag

SEQ ID NO: 582728 - DNA, 25 bp, Mus musculus
ggaacaccgaccactggacatggca

SEQ ID NO: 582729 - DNA, 25 bp, Mus musculus
ggaacaccgacctctggacatggca

SEQ ID NO: 582730 - DNA, 25 bp, Mus musculus
ggaacaccgactaaatgaaggagaa

SEQ ID NO: 582731 - DNA, 25 bp, Mus musculus
ggaacaccgacttaatgaaggagaa

SEQ ID NO: 582732 - DNA, 25 bp, Mus musculus
ggaacaccgtggagctcccagaaga

SEQ ID NO: 582733 - DNA, 25 bp, Mus musculus
ggaacaccgtggtgctcccagaaga

SEQ ID NO: 582734 - DNA, 25 bp, Mus musculus
ggaacaccgttcaaacacgaagtga

SEQ ID NO: 582735 - DNA, 25 bp, Mus musculus
ggaacaccgttctaacacgaagtga

SEQ ID NO: 582736 - DNA, 25 bp, Mus musculus
ggaacaccgtttcaccatcagtgca

SEQ ID NO: 582737 - DNA, 25 bp, Mus musculus
ggaacaccgtttgaccatcagtgca

SEQ ID NO: 582738 - DNA, 25 bp, Mus musculus
ggaacacctaatcttctcctctagg

SEQ ID NO: 582739 - DNA, 25 bp, Mus musculus
ggaacacctaatgttctcctctagg

SEQ ID NO: 582740 - DNA, 25 bp, Mus musculus
ggaacacctatgagccttgaaaaca

SEQ ID NO: 582741 - DNA, 25 bp, Mus musculus
ggaacacctatgtgccttgaaaaca

SEQ ID NO: 582742 - DNA, 25 bp, Mus musculus
ggaacacctcaaaaacttgtggagt

SEQ ID NO: 582743 - DNA, 25 bp, Mus musculus
ggaacacctcaataacttgtggagt

SEQ ID NO: 582744 - DNA, 25 bp, Mus musculus
ggaacacctcagaagtgacaaccaa

SEQ ID NO: 582745 - DNA, 25 bp, Mus musculus
ggaacacctcagtagtgacaaccaa

SEQ ID NO: 582746 - DNA, 25 bp, Mus musculus
ggaacacctgaactagagctaacca

SEQ ID NO: 582747 - DNA, 25 bp, Mus musculus
ggaacacctgaagtagagctaacca

SEQ ID NO: 582748 - DNA, 25 bp, Mus musculus
ggaacacctgcaaacaatgacggaa

SEQ ID NO: 582749 - DNA, 25 bp, Mus musculus
ggaacacctgcatacaatgacggaa

SEQ ID NO: 582750 - DNA, 25 bp, Mus musculus
ggaacacctgtaattgcaggacgga

SEQ ID NO: 582751 - DNA, 25 bp, Mus musculus
ggaacacctgtatttgcaggacgga

SEQ ID NO: 582752 - DNA, 25 bp, Mus musculus
ggaacacctgtgacctcagtcccga

SEQ ID NO: 582753 - DNA, 25 bp, Mus musculus
ggaacacctgtgtcctcagtcccga

SEQ ID NO: 582754 - DNA, 25 bp, Mus musculus
ggaacacctgttactagctgtcctg

SEQ ID NO: 582755 - DNA, 25 bp, Mus musculus
ggaacacctgtttctagctgtcctg

SEQ ID NO: 582756 - DNA, 25 bp, Mus musculus
ggaacaccttgccatgctgatgagg

SEQ ID NO: 582757 - DNA, 25 bp, Mus musculus
ggaacaccttgcgatgctgatgagg

SEQ ID NO: 582758 - DNA, 25 bp, Mus musculus
ggaacaccttgtcctgaattcatga

SEQ ID NO: 582759 - DNA, 25 bp, Mus musculus
ggaacaccttgtgctgaattcatga

SEQ ID NO: 582760 - DNA, 25 bp, Mus musculus
ggaacacgagctcttacggccgcat

SEQ ID NO: 582761 - DNA, 25 bp, Mus musculus
ggaacacgagctgttacggccgcat

SEQ ID NO: 582762 - DNA, 25 bp, Mus musculus
ggaacacgcacaagggtgaactgga

SEQ ID NO: 582763 - DNA, 25 bp, Mus musculus
ggaacacgcacatgggtgaactgga

SEQ ID NO: 582764 - DNA, 25 bp, Mus musculus
ggaacacgggccaattcggagttgt

SEQ ID NO: 582765 - DNA, 25 bp, Mus musculus
ggaacacgggcctattcggagttgt

SEQ ID NO: 582766 - DNA, 25 bp, Mus musculus
ggaacacgtcttcatatttttaagg

SEQ ID NO: 582767 - DNA, 25 bp, Mus musculus
ggaacacgtcttgatatttttaagg

SEQ ID NO: 582768 - DNA, 25 bp, Mus musculus
ggaacacgtgttcccacttctcagt

SEQ ID NO: 582769 - DNA, 25 bp, Mus musculus
ggaacacgtgttgccacttctcagt

SEQ ID NO: 582770 - DNA, 25 bp, Mus musculus
ggaacactacagaaatttggagact

SEQ ID NO: 582771 - DNA, 25 bp, Mus musculus
ggaacactacagtaatttggagact

SEQ ID NO: 582772 - DNA, 25 bp, Mus musculus
ggaacactacctcgctgcggaccaa

SEQ ID NO: 582773 - DNA, 25 bp, Mus musculus
ggaacactacctggctgcggaccaa

SEQ ID NO: 582774 - DNA, 25 bp, Mus musculus
ggaacactactcatacatgcgtgta

SEQ ID NO: 582775 - DNA, 25 bp, Mus musculus
ggaacactactcttacatgcgtgta

SEQ ID NO: 582776 - DNA, 25 bp, Mus musculus
ggaacactatctatttaatttgcaa

SEQ ID NO: 582777 - DNA, 25 bp, Mus musculus
ggaacactatctttttaatttgcaa

SEQ ID NO: 582778 - DNA, 25 bp, Mus musculus
ggaacactccaaatggcagctcttt

SEQ ID NO: 582779 - DNA, 25 bp, Mus musculus
ggaacactccaattggcagctcttt

SEQ ID NO: 582780 - DNA, 25 bp, Mus musculus
ggaacactcccgaaacttggccaat

SEQ ID NO: 582781 - DNA, 25 bp, Mus musculus
ggaacactcccgtaacttggccaat

SEQ ID NO: 582782 - DNA, 25 bp, Mus musculus
ggaacactctataacaagatactta

SEQ ID NO: 582783 - DNA, 25 bp, Mus musculus
ggaacactctattacaagatactta

SEQ ID NO: 582784 - DNA, 25 bp, Mus musculus
ggaacactgacgacatttatgctgt

SEQ ID NO: 582785 - DNA, 25 bp, Mus musculus
ggaacactgacgtcatttatgctgt

SEQ ID NO: 582786 - DNA, 25 bp, Mus musculus
ggaacactgatgctaactccagcta

SEQ ID NO: 582787 - DNA, 25 bp, Mus musculus
ggaacactgatggtaactccagcta

SEQ ID NO: 582788 - DNA, 25 bp, Mus musculus
ggaacactgattcttttcatctgat

SEQ ID NO: 582789 - DNA, 25 bp, Mus musculus
ggaacactgattgttttcatctgat

SEQ ID NO: 582790 - DNA, 25 bp, Mus musculus
ggaacactgcagaaaacccctatca

SEQ ID NO: 582791 - DNA, 25 bp, Mus musculus
ggaacactgcagatgagacccatgt

SEQ ID NO: 582792 - DNA, 25 bp, Mus musculus
ggaacactgcagtaaacccctatca

SEQ ID NO: 582793 - DNA, 25 bp, Mus musculus
ggaacactgcagttgagacccatgt

SEQ ID NO: 582794 - DNA, 25 bp, Mus musculus
ggaacactgccaatgctcatatatg

SEQ ID NO: 582795 - DNA, 25 bp, Mus musculus
ggaacactgccattgctcatatatg

SEQ ID NO: 582796 - DNA, 25 bp, Mus musculus
ggaacactgcccaatagatgaacat

SEQ ID NO: 582797 - DNA, 25 bp, Mus musculus
ggaacactgccctatagatgaacat

SEQ ID NO: 582798 - DNA, 25 bp, Mus musculus
ggaacactggacagttcagacaaat

SEQ ID NO: 582799 - DNA, 25 bp, Mus musculus
ggaacactggactgttcagacaaat

SEQ ID NO: 582800 - DNA, 25 bp, Mus musculus
ggaacactggtgagagcttctagat

SEQ ID NO: 582801 - DNA, 25 bp, Mus musculus
ggaacactggtgtgagcttctagat

SEQ ID NO: 582802 - DNA, 25 bp, Mus musculus
ggaacactgtaaaactctgctctat

SEQ ID NO: 582803 - DNA, 25 bp, Mus musculus
ggaacactgtaatactctgctctat

SEQ ID NO: 582804 - DNA, 25 bp, Mus musculus
ggaacactgtgtaccaagaactttt

SEQ ID NO: 582805 - DNA, 25 bp, Mus musculus
ggaacactgtgttccaagaactttt

SEQ ID NO: 582806 - DNA, 25 bp, Mus musculus
ggaacactgttgctctttcatacta

SEQ ID NO: 582807 - DNA, 25 bp, Mus musculus
ggaacactgttggtctttcatacta

SEQ ID NO: 582808 - DNA, 25 bp, Mus musculus
ggaacactgtttatatcaatggctt

SEQ ID NO: 582809 - DNA, 25 bp, Mus musculus
ggaacactgtttttatcaatggctt

SEQ ID NO: 582810 - DNA, 25 bp, Mus musculus
ggaacacttaagcaaagctgacaaa

SEQ ID NO: 582811 - DNA, 25 bp, Mus musculus
ggaacacttaaggaaagctgacaaa

SEQ ID NO: 582812 - DNA, 25 bp, Mus musculus
ggaacacttaccaactaactgactt

SEQ ID NO: 582813 - DNA, 25 bp, Mus musculus
ggaacacttacctactaactgactt

SEQ ID NO: 582814 - DNA, 25 bp, Mus musculus
ggaacacttagaacccagatttggg

SEQ ID NO: 582815 - DNA, 25 bp, Mus musculus
ggaacacttagatcccagatttggg

SEQ ID NO: 582816 - DNA, 25 bp, Mus musculus
ggaacacttaggaatgatgataatc

SEQ ID NO: 582817 - DNA, 25 bp, Mus musculus
ggaacacttaggtatgatgataatc

SEQ ID NO: 582818 - DNA, 25 bp, Mus musculus
ggaacacttccccaatgagtttact

SEQ ID NO: 582819 - DNA, 25 bp, Mus musculus
ggaacacttcccgaatgagtttact

SEQ ID NO: 582820 - DNA, 25 bp, Mus musculus
ggaacacttcttatgatcatcaggc

SEQ ID NO: 582821 - DNA, 25 bp, Mus musculus
ggaacacttcttttgatcatcaggc

SEQ ID NO: 582822 - DNA, 25 bp, Mus musculus
ggaacacttggcaaacacccaaagg

SEQ ID NO: 582823 - DNA, 25 bp, Mus musculus
ggaacacttggctaacacccaaagg

SEQ ID NO: 582824 - DNA, 25 bp, Mus musculus
ggaacactttagacattgttgctga

SEQ ID NO: 582825 - DNA, 25 bp, Mus musculus
ggaacactttagtcattgttgctga

SEQ ID NO: 582826 - DNA, 25 bp, Mus musculus
ggaacagaaaggactccaccagaac

SEQ ID NO: 582827 - DNA, 25 bp, Mus musculus
ggaacagaaaggtctccaccagaac

SEQ ID NO: 582828 - DNA, 25 bp, Mus musculus
ggaacagaaccacgccaacatcgaa

SEQ ID NO: 582829 - DNA, 25 bp, Mus musculus
ggaacagaaccaggccaacatcgaa

SEQ ID NO: 582830 - DNA, 25 bp, Mus musculus
ggaacagaactacgcccctggtgaa

SEQ ID NO: 582831 - DNA, 25 bp, Mus musculus
ggaacagaactaggcccctggtgaa

SEQ ID NO: 582832 - DNA, 25 bp, Mus musculus
ggaacagaactccttctctgagtgg

SEQ ID NO: 582833 - DNA, 25 bp, Mus musculus
ggaacagaactcgttctctgagtgg

SEQ ID NO: 582834 - DNA, 25 bp, Mus musculus
ggaacagaagtgaccagtccccagg

SEQ ID NO: 582835 - DNA, 25 bp, Mus musculus
ggaacagaagtgtccagtccccagg

SEQ ID NO: 582836 - DNA, 25 bp, Mus musculus
ggaacagaagttagctcagccaagg

SEQ ID NO: 582837 - DNA, 25 bp, Mus musculus
ggaacagaagttcgctatctgcctt

SEQ ID NO: 582838 - DNA, 25 bp, Mus musculus
ggaacagaagttggctatctgcctt

SEQ ID NO: 582839 - DNA, 25 bp, Mus musculus
ggaacagaagtttgctcagccaagg

SEQ ID NO: 582840 - DNA, 25 bp, Mus musculus
ggaacagaatctctcccttctagat

SEQ ID NO: 582841 - DNA, 25 bp, Mus musculus
ggaacagaatctgtcccttctagat

SEQ ID NO: 582842 - DNA, 25 bp, Mus musculus
ggaacagaccatatatttcaaggac

SEQ ID NO: 582843 - DNA, 25 bp, Mus musculus
ggaacagaccatttatttcaaggac

SEQ ID NO: 582844 - DNA, 25 bp, Mus musculus
ggaacagacccaacagtaaagcctt

SEQ ID NO: 582845 - DNA, 25 bp, Mus musculus
ggaacagacccaaggagcgagagct

SEQ ID NO: 582846 - DNA, 25 bp, Mus musculus
ggaacagacccatcagtaaagcctt

SEQ ID NO: 582847 - DNA, 25 bp, Mus musculus
ggaacagacccatggagcgagagct

SEQ ID NO: 582848 - DNA, 25 bp, Mus musculus
ggaacagacctcaatcagtggttgt

SEQ ID NO: 582849 - DNA, 25 bp, Mus musculus
ggaacagacctctatcagtggttgt

SEQ ID NO: 582850 - DNA, 25 bp, Mus musculus
ggaacagacctgactcatagtcaaa

SEQ ID NO: 582851 - DNA, 25 bp, Mus musculus
ggaacagacctgtctcatagtcaaa

SEQ ID NO: 582852 - DNA, 25 bp, Mus musculus
ggaacagagaagagtgtttgaaacc

SEQ ID NO: 582853 - DNA, 25 bp, Mus musculus
ggaacagagaagtgtgtttgaaacc

SEQ ID NO: 582854 - DNA, 25 bp, Mus musculus
ggaacagagaatccttgacgcccca

SEQ ID NO: 582855 - DNA, 25 bp, Mus musculus
ggaacagagaatgcttgacgcccca

SEQ ID NO: 582856 - DNA, 25 bp, Mus musculus
ggaacagagatacttaggaaacatt

SEQ ID NO: 582857 - DNA, 25 bp, Mus musculus
ggaacagagatagttaggaaacatt

SEQ ID NO: 582858 - DNA, 25 bp, Mus musculus
ggaacagaggtaactatgtatgtta

SEQ ID NO: 582859 - DNA, 25 bp, Mus musculus
ggaacagaggtatctatgtatgtta

SEQ ID NO: 582860 - DNA, 25 bp, Mus musculus
ggaacagagtccagtctttttctaa

SEQ ID NO: 582861 - DNA, 25 bp, Mus musculus
ggaacagagtcctgtctttttctaa

SEQ ID NO: 582862 - DNA, 25 bp, Mus musculus
ggaacagagtctcggcgcatcactt

SEQ ID NO: 582863 - DNA, 25 bp, Mus musculus
ggaacagagtctgggcgcatcactt

SEQ ID NO: 582864 - DNA, 25 bp, Mus musculus
ggaacagatgtcaagcctgcaagaa

SEQ ID NO: 582865 - DNA, 25 bp, Mus musculus
ggaacagatgtctagcctgcaagaa

SEQ ID NO: 582866 - DNA, 25 bp, Mus musculus
ggaacagcaaccatgaccaatgtct

SEQ ID NO: 582867 - DNA, 25 bp, Mus musculus
ggaacagcaaccttgaccaatgtct

SEQ ID NO: 582868 - DNA, 25 bp, Mus musculus
ggaacagcagaaccctgaagaactt

SEQ ID NO: 582869 - DNA, 25 bp, Mus musculus
ggaacagcagaagcctgaagaactt

SEQ ID NO: 582870 - DNA, 25 bp, Mus musculus
ggaacagcagatatcagctgcatat

SEQ ID NO: 582871 - DNA, 25 bp, Mus musculus
ggaacagcagatttcagctgcatat

SEQ ID NO: 582872 - DNA, 25 bp, Mus musculus
ggaacagcagctagattactcacat

SEQ ID NO: 582873 - DNA, 25 bp, Mus musculus
ggaacagcagcttgattactcacat

SEQ ID NO: 582874 - DNA, 25 bp, Mus musculus
ggaacagcctagaagctctgctgca

SEQ ID NO: 582875 - DNA, 25 bp, Mus musculus
ggaacagcctagtagctctgctgca

SEQ ID NO: 582876 - DNA, 25 bp, Mus musculus
ggaacagcctgcctttcagaactaa

SEQ ID NO: 582877 - DNA, 25 bp, Mus musculus
ggaacagcctgcgtttcagaactaa

SEQ ID NO: 582878 - DNA, 25 bp, Mus musculus
ggaacagcgacccagttgtaattca

SEQ ID NO: 582879 - DNA, 25 bp, Mus musculus
ggaacagcgaccgagttgtaattca

SEQ ID NO: 582880 - DNA, 25 bp, Mus musculus
ggaacagcgactcaggaacaacttg

SEQ ID NO: 582881 - DNA, 25 bp, Mus musculus
ggaacagcgactgaggaacaacttg

SEQ ID NO: 582882 - DNA, 25 bp, Mus musculus
ggaacagcgccaagccgaaaagtta

SEQ ID NO: 582883 - DNA, 25 bp, Mus musculus
ggaacagcgccatgccgaaaagtta

SEQ ID NO: 582884 - DNA, 25 bp, Mus musculus
ggaacagcggctcctgacccaagct

SEQ ID NO: 582885 - DNA, 25 bp, Mus musculus
ggaacagcggctgctgacccaagct

SEQ ID NO: 582886 - DNA, 25 bp, Mus musculus
ggaacagctaaacttcaggctgctg

SEQ ID NO: 582887 - DNA, 25 bp, Mus musculus
ggaacagctaaagttcaggctgctg

SEQ ID NO: 582888 - DNA, 25 bp, Mus musculus
ggaacagctactacaaccttctgta

SEQ ID NO: 582889 - DNA, 25 bp, Mus musculus
ggaacagctacttcaaccttctgta

SEQ ID NO: 582890 - DNA, 25 bp, Mus musculus
ggaacagctcagcagatttttgaga

SEQ ID NO: 582891 - DNA, 25 bp, Mus musculus
ggaacagctcaggagatttttgaga

SEQ ID NO: 582892 - DNA, 25 bp, Mus musculus
ggaacagctcccatagtcactgtag

SEQ ID NO: 582893 - DNA, 25 bp, Mus musculus
ggaacagctcccttagtcactgtag

SEQ ID NO: 582894 - DNA, 25 bp, Mus musculus
ggaacagctccgagtactgaggccc

SEQ ID NO: 582895 - DNA, 25 bp, Mus musculus
ggaacagctccgtgtactgaggccc

SEQ ID NO: 582896 - DNA, 25 bp, Mus musculus
ggaacagctctgcaacagttgctaa

SEQ ID NO: 582897 - DNA, 25 bp, Mus musculus
ggaacagctctggaacagttgctaa

SEQ ID NO: 582898 - DNA, 25 bp, Mus musculus
ggaacagctgagacctttaaaaatc

SEQ ID NO: 582899 - DNA, 25 bp, Mus musculus
ggaacagctgagagcggtttattat

SEQ ID NO: 582900 - DNA, 25 bp, Mus musculus
ggaacagctgagtcctttaaaaatc

SEQ ID NO: 582901 - DNA, 25 bp, Mus musculus
ggaacagctgagtgcggtttattat

SEQ ID NO: 582902 - DNA, 25 bp, Mus musculus
ggaacagctgtgacactacttcgat

SEQ ID NO: 582903 - DNA, 25 bp, Mus musculus
ggaacagctgtgtcactacttcgat

SEQ ID NO: 582904 - DNA, 25 bp, Mus musculus
ggaacaggaaggaacccagcagtga

SEQ ID NO: 582905 - DNA, 25 bp, Mus musculus
ggaacaggaaggtacccagcagtga

SEQ ID NO: 582906 - DNA, 25 bp, Mus musculus
ggaacaggaatcaacccagtggaaa

SEQ ID NO: 582907 - DNA, 25 bp, Mus musculus
ggaacaggaatctacccagtggaaa

SEQ ID NO: 582908 - DNA, 25 bp, Mus musculus
ggaacaggaatgacgcaacatcgta

SEQ ID NO: 582909 - DNA, 25 bp, Mus musculus
ggaacaggaatgtcgcaacatcgta

SEQ ID NO: 582910 - DNA, 25 bp, Mus musculus
ggaacaggaattccccacaggtgga

SEQ ID NO: 582911 - DNA, 25 bp, Mus musculus
ggaacaggaattgcccacaggtgga

SEQ ID NO: 582912 - DNA, 25 bp, Mus musculus
ggaacaggacagcatcagaaccgcc

SEQ ID NO: 582913 - DNA, 25 bp, Mus musculus
ggaacaggacaggatcagaaccgcc

SEQ ID NO: 582914 - DNA, 25 bp, Mus musculus
ggaacaggacccaagtccccatgca

SEQ ID NO: 582915 - DNA, 25 bp, Mus musculus
ggaacaggaccctagtccccatgca

SEQ ID NO: 582916 - DNA, 25 bp, Mus musculus
ggaacaggacttatcccagcaagga

SEQ ID NO: 582917 - DNA, 25 bp, Mus musculus
ggaacaggacttttcccagcaagga

SEQ ID NO: 582918 - DNA, 25 bp, Mus musculus
ggaacaggagacaatcagcccaaca

SEQ ID NO: 582919 - DNA, 25 bp, Mus musculus
ggaacaggagactatcagcccaaca

SEQ ID NO: 582920 - DNA, 25 bp, Mus musculus
ggaacaggaggcctaccgcaaccaa

SEQ ID NO: 582921 - DNA, 25 bp, Mus musculus
ggaacaggaggcgtaccgcaaccaa

SEQ ID NO: 582922 - DNA, 25 bp, Mus musculus
ggaacaggatcgagccctgcctaac

SEQ ID NO: 582923 - DNA, 25 bp, Mus musculus
ggaacaggatcgtgccctgcctaac

SEQ ID NO: 582924 - DNA, 25 bp, Mus musculus
ggaacaggattcctcttcactatcc

SEQ ID NO: 582925 - DNA, 25 bp, Mus musculus
ggaacaggattcgtcttcactatcc

SEQ ID NO: 582926 - DNA, 25 bp, Mus musculus
ggaacaggatttacgctggctccca

SEQ ID NO: 582927 - DNA, 25 bp, Mus musculus
ggaacaggattttcgctggctccca

SEQ ID NO: 582928 - DNA, 25 bp, Mus musculus
ggaacaggccaccattgaacggaac

SEQ ID NO: 582929 - DNA, 25 bp, Mus musculus
ggaacaggccacgattgaacggaac

SEQ ID NO: 582930 - DNA, 25 bp, Mus musculus
ggaacaggccagagaatagacagac

SEQ ID NO: 582931 - DNA, 25 bp, Mus musculus
ggaacaggccagtgaatagacagac

SEQ ID NO: 582932 - DNA, 25 bp, Mus musculus
ggaacaggcccaagatgcctccttc

SEQ ID NO: 582933 - DNA, 25 bp, Mus musculus
ggaacaggcccacgtgatcaatcaa

SEQ ID NO: 582934 - DNA, 25 bp, Mus musculus
ggaacaggcccaggtgatcaatcaa

SEQ ID NO: 582935 - DNA, 25 bp, Mus musculus
ggaacaggcccatgatgcctccttc

SEQ ID NO: 582936 - DNA, 25 bp, Mus musculus
ggaacaggctgcagatctttttaat

SEQ ID NO: 582937 - DNA, 25 bp, Mus musculus
ggaacaggctgcattagtaacgttt

SEQ ID NO: 582938 - DNA, 25 bp, Mus musculus
ggaacaggctgctgatctttttaat

SEQ ID NO: 582939 - DNA, 25 bp, Mus musculus
ggaacaggctgctttagtaacgttt

SEQ ID NO: 582940 - DNA, 25 bp, Mus musculus
ggaacaggctgtcccacacacaaag

SEQ ID NO: 582941 - DNA, 25 bp, Mus musculus
ggaacaggctgtgccacacacaaag

SEQ ID NO: 582942 - DNA, 25 bp, Mus musculus
ggaacagggataccccagctccggt

SEQ ID NO: 582943 - DNA, 25 bp, Mus musculus
ggaacagggatagcccagctccggt

SEQ ID NO: 582944 - DNA, 25 bp, Mus musculus
ggaacagggcaccagttgtttccac

SEQ ID NO: 582945 - DNA, 25 bp, Mus musculus
ggaacagggcacgagttgtttccac

SEQ ID NO: 582946 - DNA, 25 bp, Mus musculus
ggaacagggctccaatctatattag

SEQ ID NO: 582947 - DNA, 25 bp, Mus musculus
ggaacagggctcgaatctatattag

SEQ ID NO: 582948 - DNA, 25 bp, Mus musculus
ggaacagggcttcttttaccactga

SEQ ID NO: 582949 - DNA, 25 bp, Mus musculus
ggaacagggcttgttttaccactga

SEQ ID NO: 582950 - DNA, 25 bp, Mus musculus
ggaacagggtaactgcacaacaaag

SEQ ID NO: 582951 - DNA, 25 bp, Mus musculus
ggaacagggtaagtgcacaacaaag

SEQ ID NO: 582952 - DNA, 25 bp, Mus musculus
ggaacaggtatcaacatcaaatgaa

SEQ ID NO: 582953 - DNA, 25 bp, Mus musculus
ggaacaggtatctacatcaaatgaa

SEQ ID NO: 582954 - DNA, 25 bp, Mus musculus
ggaacaggttttacgccagactcac

SEQ ID NO: 582955 - DNA, 25 bp, Mus musculus
ggaacaggtttttcgccagactcac

SEQ ID NO: 582956 - DNA, 25 bp, Mus musculus
ggaacagtacacaactgactattgt

SEQ ID NO: 582957 - DNA, 25 bp, Mus musculus
ggaacagtacacacaacacagccac

SEQ ID NO: 582958 - DNA, 25 bp, Mus musculus
ggaacagtacactactgactattgt

SEQ ID NO: 582959 - DNA, 25 bp, Mus musculus
ggaacagtacactcaacacagccac

SEQ ID NO: 582960 - DNA, 25 bp, Mus musculus
ggaacagtactgacccagaacaaga

SEQ ID NO: 582961 - DNA, 25 bp, Mus musculus
ggaacagtactgtcccagaacaaga

SEQ ID NO: 582962 - DNA, 25 bp, Mus musculus
ggaacagtatatagcctctgtgatt

SEQ ID NO: 582963 - DNA, 25 bp, Mus musculus
ggaacagtatattgcctctgtgatt

SEQ ID NO: 582964 - DNA, 25 bp, Mus musculus
ggaacagtatgaattctgcatgtac

SEQ ID NO: 582965 - DNA, 25 bp, Mus musculus
ggaacagtatgatttctgcatgtac

SEQ ID NO: 582966 - DNA, 25 bp, Mus musculus
ggaacagtatttcccagcgcaggac

SEQ ID NO: 582967 - DNA, 25 bp, Mus musculus
ggaacagtatttgccagcgcaggac

SEQ ID NO: 582968 - DNA, 25 bp, Mus musculus
ggaacagtcattcccttggagaaat

SEQ ID NO: 582969 - DNA, 25 bp, Mus musculus
ggaacagtcattgccttggagaaat

SEQ ID NO: 582970 - DNA, 25 bp, Mus musculus
ggaacagtccaaaagtgaccatcta

SEQ ID NO: 582971 - DNA, 25 bp, Mus musculus
ggaacagtccaaattctatcttcaa

SEQ ID NO: 582972 - DNA, 25 bp, Mus musculus
ggaacagtccaatagtgaccatcta

SEQ ID NO: 582973 - DNA, 25 bp, Mus musculus
ggaacagtccaatttctatcttcaa

SEQ ID NO: 582974 - DNA, 25 bp, Mus musculus
ggaacagtcctgctgtgccacagcc

SEQ ID NO: 582975 - DNA, 25 bp, Mus musculus
ggaacagtcctggtgtgccacagcc

SEQ ID NO: 582976 - DNA, 25 bp, Mus musculus
ggaacagtccttacaccagttaatt

SEQ ID NO: 582977 - DNA, 25 bp, Mus musculus
ggaacagtcctttcaccagttaatt

SEQ ID NO: 582978 - DNA, 25 bp, Mus musculus
ggaacagtctataacacatttggtc

SEQ ID NO: 582979 - DNA, 25 bp, Mus musculus
ggaacagtctatcggcctgaattct

SEQ ID NO: 582980 - DNA, 25 bp, Mus musculus
ggaacagtctatgggcctgaattct

SEQ ID NO: 582981 - DNA, 25 bp, Mus musculus
ggaacagtctattacacatttggtc

SEQ ID NO: 582982 - DNA, 25 bp, Mus musculus
ggaacagtctggcattagtcacttt

SEQ ID NO: 582983 - DNA, 25 bp, Mus musculus
ggaacagtctgggattagtcacttt

SEQ ID NO: 582984 - DNA, 25 bp, Mus musculus
ggaacagtgcataaccctaccaata

SEQ ID NO: 582985 - DNA, 25 bp, Mus musculus
ggaacagtgcattaccctaccaata

SEQ ID NO: 582986 - DNA, 25 bp, Mus musculus
ggaacagtgcccaagatggtcgtct

SEQ ID NO: 582987 - DNA, 25 bp, Mus musculus
ggaacagtgccctagatggtcgtct

SEQ ID NO: 582988 - DNA, 25 bp, Mus musculus
ggaacagtggatattcaatgattac

SEQ ID NO: 582989 - DNA, 25 bp, Mus musculus
ggaacagtggattttcaatgattac

SEQ ID NO: 582990 - DNA, 25 bp, Mus musculus
ggaacagtggctaaagggatactta

SEQ ID NO: 582991 - DNA, 25 bp, Mus musculus
ggaacagtggcttaagggatactta

SEQ ID NO: 582992 - DNA, 25 bp, Mus musculus
ggaacagtgggaagcacactcctga

SEQ ID NO: 582993 - DNA, 25 bp, Mus musculus
ggaacagtgggatgcacactcctga

SEQ ID NO: 582994 - DNA, 25 bp, Mus musculus
ggaacagtggtacgcgcagcacacc

SEQ ID NO: 582995 - DNA, 25 bp, Mus musculus
ggaacagtggtaggcgcagcacacc

SEQ ID NO: 582996 - DNA, 25 bp, Mus musculus
ggaacagttaacagcactgagtgct

SEQ ID NO: 582997 - DNA, 25 bp, Mus musculus
ggaacagttaactgcactgagtgct

SEQ ID NO: 582998 - DNA, 25 bp, Mus musculus
ggaacagttagaacagcccatcgca

SEQ ID NO: 582999 - DNA, 25 bp, Mus musculus
ggaacagttagatcagcccatcgca

SEQ ID NO: 583000 - DNA, 25 bp, Mus musculus
ggaacagttgctccctgtgaaggat

SEQ ID NO: 583001 - DNA, 25 bp, Mus musculus
ggaacagttgctgcctgtgaaggat

SEQ ID NO: 583002 - DNA, 25 bp, Mus musculus
ggaacagtttacaggaaggcctcca

SEQ ID NO: 583003 - DNA, 25 bp, Mus musculus
ggaacagtttacaggtctaccaggt

SEQ ID NO: 583004 - DNA, 25 bp, Mus musculus
ggaacagtttactggaaggcctcca

SEQ ID NO: 583005 - DNA, 25 bp, Mus musculus
ggaacagtttactggtctaccaggt

SEQ ID NO: 583006 - DNA, 25 bp, Mus musculus
ggaacagtttctaacctctattcag

SEQ ID NO: 583007 - DNA, 25 bp, Mus musculus
ggaacagtttcttacctctattcag

SEQ ID NO: 583008 - DNA, 25 bp, Mus musculus
ggaacagtttgtctgtcctacatct

SEQ ID NO: 583009 - DNA, 25 bp, Mus musculus
ggaacagtttgtgtgtcctacatct

SEQ ID NO: 583010 - DNA, 25 bp, Mus musculus
ggaacataattcaagcagccatggt

SEQ ID NO: 583011 - DNA, 25 bp, Mus musculus
ggaacataattctagcagccatggt

SEQ ID NO: 583012 - DNA, 25 bp, Mus musculus
ggaacatactacacaaatctgggat

SEQ ID NO: 583013 - DNA, 25 bp, Mus musculus
ggaacatactactcaaatctgggat

SEQ ID NO: 583014 - DNA, 25 bp, Mus musculus
ggaacatactcaaatacaccatgac

SEQ ID NO: 583015 - DNA, 25 bp, Mus musculus
ggaacatactcatatacaccatgac

SEQ ID NO: 583016 - DNA, 25 bp, Mus musculus
ggaacatagagtagatccccaccat

SEQ ID NO: 583017 - DNA, 25 bp, Mus musculus
ggaacatagagttgatccccaccat

SEQ ID NO: 583018 - DNA, 25 bp, Mus musculus
ggaacatagattatgaagtgtcaac

SEQ ID NO: 583019 - DNA, 25 bp, Mus musculus
ggaacatagattttgaagtgtcaac

SEQ ID NO: 583020 - DNA, 25 bp, Mus musculus
ggaacatagccacctaattatttgt

SEQ ID NO: 583021 - DNA, 25 bp, Mus musculus
ggaacatagccagctaattatttgt

SEQ ID NO: 583022 - DNA, 25 bp, Mus musculus
ggaacatagctcatggagaacactt

SEQ ID NO: 583023 - DNA, 25 bp, Mus musculus
ggaacatagctcttggagaacactt

SEQ ID NO: 583024 - DNA, 25 bp, Mus musculus
ggaacatataatatctctcaacaaa

SEQ ID NO: 583025 - DNA, 25 bp, Mus musculus
ggaacatataatttctctcaacaaa

SEQ ID NO: 583026 - DNA, 25 bp, Mus musculus
ggaacatatcttctctcacagagct

SEQ ID NO: 583027 - DNA, 25 bp, Mus musculus
ggaacatatcttgtctcacagagct

SEQ ID NO: 583028 - DNA, 25 bp, Mus musculus
ggaacatcaagaccatcgccgagtg

SEQ ID NO: 583029 - DNA, 25 bp, Mus musculus
ggaacatcaagagcatcgccgagtg

SEQ ID NO: 583030 - DNA, 25 bp, Mus musculus
ggaacatcacacattctacaggctt

SEQ ID NO: 583031 - DNA, 25 bp, Mus musculus
ggaacatcacactttctacaggctt

SEQ ID NO: 583032 - DNA, 25 bp, Mus musculus
ggaacatcacttctgtactggcaac

SEQ ID NO: 583033 - DNA, 25 bp, Mus musculus
ggaacatcacttgtgtactggcaac

SEQ ID NO: 583034 - DNA, 25 bp, Mus musculus
ggaacatccaccctgattgagtgtg

SEQ ID NO: 583035 - DNA, 25 bp, Mus musculus
ggaacatccaccgtgattgagtgtg

SEQ ID NO: 583036 - DNA, 25 bp, Mus musculus
ggaacatccagtagtgccgagcatt

SEQ ID NO: 583037 - DNA, 25 bp, Mus musculus
ggaacatccagtcattttaccacat

SEQ ID NO: 583038 - DNA, 25 bp, Mus musculus
ggaacatccagtgattttaccacat

SEQ ID NO: 583039 - DNA, 25 bp, Mus musculus
ggaacatccagttgtgccgagcatt

SEQ ID NO: 583040 - DNA, 25 bp, Mus musculus
ggaacatccccaagtgaagttaact

SEQ ID NO: 583041 - DNA, 25 bp, Mus musculus
ggaacatccccatgtgaagttaact

SEQ ID NO: 583042 - DNA, 25 bp, Mus musculus
ggaacatccctgaaagcatccattc

SEQ ID NO: 583043 - DNA, 25 bp, Mus musculus
ggaacatccctgtaagcatccattc

SEQ ID NO: 583044 - DNA, 25 bp, Mus musculus
ggaacatccgagcagagcctctgaa

SEQ ID NO: 583045 - DNA, 25 bp, Mus musculus
ggaacatccgaggagagcctctgaa

SEQ ID NO: 583046 - DNA, 25 bp, Mus musculus
ggaacatcctccaaaatgactcaaa

SEQ ID NO: 583047 - DNA, 25 bp, Mus musculus
ggaacatcctcctaaatgactcaaa

SEQ ID NO: 583048 - DNA, 25 bp, Mus musculus
ggaacatcctggcattcagactcag

SEQ ID NO: 583049 - DNA, 25 bp, Mus musculus
ggaacatcctgggattcagactcag

SEQ ID NO: 583050 - DNA, 25 bp, Mus musculus
ggaacatcgccacctatgaagaaca

SEQ ID NO: 583051 - DNA, 25 bp, Mus musculus
ggaacatcgccagctatgaagaaca

SEQ ID NO: 583052 - DNA, 25 bp, Mus musculus
ggaacatcgtaacaagtcaccctga

SEQ ID NO: 583053 - DNA, 25 bp, Mus musculus
ggaacatcgtaagaagtcaccctga

SEQ ID NO: 583054 - DNA, 25 bp, Mus musculus
ggaacatcgtgtctcctgcagggat

SEQ ID NO: 583055 - DNA, 25 bp, Mus musculus
ggaacatcgtgtgtcctgcagggat

SEQ ID NO: 583056 - DNA, 25 bp, Mus musculus
ggaacatctactatgactgcagcag

SEQ ID NO: 583057 - DNA, 25 bp, Mus musculus
ggaacatctactttgactgcagcag

SEQ ID NO: 583058 - DNA, 25 bp, Mus musculus
ggaacatctccgaaactccctgtgg

SEQ ID NO: 583059 - DNA, 25 bp, Mus musculus
ggaacatctccgtaactccctgtgg

SEQ ID NO: 583060 - DNA, 25 bp, Mus musculus
ggaacatctgtaatatcccggccac

SEQ ID NO: 583061 - DNA, 25 bp, Mus musculus
ggaacatctgtattatcccggccac

SEQ ID NO: 583062 - DNA, 25 bp, Mus musculus
ggaacatcttgactcctgttggacg

SEQ ID NO: 583063 - DNA, 25 bp, Mus musculus
ggaacatcttgagtcctgttggacg

SEQ ID NO: 583064 - DNA, 25 bp, Mus musculus
ggaacatgactcagccttccaggaa

SEQ ID NO: 583065 - DNA, 25 bp, Mus musculus
ggaacatgactctgccttccaggaa

SEQ ID NO: 583066 - DNA, 25 bp, Mus musculus
ggaacatgacttccctcagtagacg

SEQ ID NO: 583067 - DNA, 25 bp, Mus musculus
ggaacatgacttgcctcagtagacg

SEQ ID NO: 583068 - DNA, 25 bp, Mus musculus
ggaacatgattcacagaggttgatc

SEQ ID NO: 583069 - DNA, 25 bp, Mus musculus
ggaacatgattctcagaggttgatc

SEQ ID NO: 583070 - DNA, 25 bp, Mus musculus
ggaacatgcacgacaggatgggcaa

SEQ ID NO: 583071 - DNA, 25 bp, Mus musculus
ggaacatgcacgtcaggatgggcaa

SEQ ID NO: 583072 - DNA, 25 bp, Mus musculus
ggaacatgccgtccccactgaagat

SEQ ID NO: 583073 - DNA, 25 bp, Mus musculus
ggaacatgccgtgcccactgaagat

SEQ ID NO: 583074 - DNA, 25 bp, Mus musculus
ggaacatgcctgaactgactaatat

SEQ ID NO: 583075 - DNA, 25 bp, Mus musculus
ggaacatgcctgtactgactaatat

SEQ ID NO: 583076 - DNA, 25 bp, Mus musculus
ggaacatgcggcagcttttatcgaa

SEQ ID NO: 583077 - DNA, 25 bp, Mus musculus
ggaacatgcggctgcttttatcgaa

SEQ ID NO: 583078 - DNA, 25 bp, Mus musculus
ggaacatgctttagcttttcaagaa

SEQ ID NO: 583079 - DNA, 25 bp, Mus musculus
ggaacatgcttttgcttttcaagaa

SEQ ID NO: 583080 - DNA, 25 bp, Mus musculus
ggaacatggatcataactttaataa

SEQ ID NO: 583081 - DNA, 25 bp, Mus musculus
ggaacatggatcttaactttaataa

SEQ ID NO: 583082 - DNA, 25 bp, Mus musculus
ggaacatggccaacaggacccaaat

SEQ ID NO: 583083 - DNA, 25 bp, Mus musculus
ggaacatggccaagttcacaccacg

SEQ ID NO: 583084 - DNA, 25 bp, Mus musculus
ggaacatggccatcaggacccaaat

SEQ ID NO: 583085 - DNA, 25 bp, Mus musculus
ggaacatggccatgttcacaccacg

SEQ ID NO: 583086 - DNA, 25 bp, Mus musculus
ggaacatgtgaaccaagcagaagta

SEQ ID NO: 583087 - DNA, 25 bp, Mus musculus
ggaacatgtgaaccgtcccatcaat

SEQ ID NO: 583088 - DNA, 25 bp, Mus musculus
ggaacatgtgaagcaagcagaagta

SEQ ID NO: 583089 - DNA, 25 bp, Mus musculus
ggaacatgtgaagcgtcccatcaat

SEQ ID NO: 583090 - DNA, 25 bp, Mus musculus
ggaacatgtgacacattgccacccc

SEQ ID NO: 583091 - DNA, 25 bp, Mus musculus
ggaacatgtgactcattgccacccc

SEQ ID NO: 583092 - DNA, 25 bp, Mus musculus
ggaacattaacccactgtataagaa

SEQ ID NO: 583093 - DNA, 25 bp, Mus musculus
ggaacattaaccgactgtataagaa

SEQ ID NO: 583094 - DNA, 25 bp, Mus musculus
ggaacattcaccacaccaggatctt

SEQ ID NO: 583095 - DNA, 25 bp, Mus musculus
ggaacattcacctcaccaggatctt

SEQ ID NO: 583096 - DNA, 25 bp, Mus musculus
ggaacattcatgacctgctcagttc

SEQ ID NO: 583097 - DNA, 25 bp, Mus musculus
ggaacattcatgtcctgctcagttc

SEQ ID NO: 583098 - DNA, 25 bp, Mus musculus
ggaacattccacaggtttccctcag

SEQ ID NO: 583099 - DNA, 25 bp, Mus musculus
ggaacattccactggtttccctcag

SEQ ID NO: 583100 - DNA, 25 bp, Mus musculus
ggaacattcctaaccaagaactata

SEQ ID NO: 583101 - DNA, 25 bp, Mus musculus
ggaacattcctatccaagaactata

SEQ ID NO: 583102 - DNA, 25 bp, Mus musculus
ggaacattcggtaatttcctctcct

SEQ ID NO: 583103 - DNA, 25 bp, Mus musculus
ggaacattcggttatttcctctcct

SEQ ID NO: 583104 - DNA, 25 bp, Mus musculus
ggaacattctacactcatctgtaaa

SEQ ID NO: 583105 - DNA, 25 bp, Mus musculus
ggaacattctactctcatctgtaaa

SEQ ID NO: 583106 - DNA, 25 bp, Mus musculus
ggaacattctctcggacggaactct

SEQ ID NO: 583107 - DNA, 25 bp, Mus musculus
ggaacattctctgggacggaactct

SEQ ID NO: 583108 - DNA, 25 bp, Mus musculus
ggaacattctgcaaagtgtgtggaa

SEQ ID NO: 583109 - DNA, 25 bp, Mus musculus
ggaacattctgcagtcacacatggg

SEQ ID NO: 583110 - DNA, 25 bp, Mus musculus
ggaacattctgctaagtgtgtggaa

SEQ ID NO: 583111 - DNA, 25 bp, Mus musculus
ggaacattctgctgtcacacatggg

SEQ ID NO: 583112 - DNA, 25 bp, Mus musculus
ggaacattgattctaagccccactg

SEQ ID NO: 583113 - DNA, 25 bp, Mus musculus
ggaacattgattgtaagccccactg

SEQ ID NO: 583114 - DNA, 25 bp, Mus musculus
ggaacattgcatacaagacacagaa

SEQ ID NO: 583115 - DNA, 25 bp, Mus musculus
ggaacattgcattcaagacacagaa

SEQ ID NO: 583116 - DNA, 25 bp, Mus musculus
ggaacattgctacctgctttacctt

SEQ ID NO: 583117 - DNA, 25 bp, Mus musculus
ggaacattgctagctgctttacctt

SEQ ID NO: 583118 - DNA, 25 bp, Mus musculus
ggaacattgctgaccaggtacgcct

SEQ ID NO: 583119 - DNA, 25 bp, Mus musculus
ggaacattgctgtccaggtacgcct

SEQ ID NO: 583120 - DNA, 25 bp, Mus musculus
ggaacattgtagaagccgctgctgt

SEQ ID NO: 583121 - DNA, 25 bp, Mus musculus
ggaacattgtagcactgtttgaaac

SEQ ID NO: 583122 - DNA, 25 bp, Mus musculus
ggaacattgtagctgtttctgtgtt

SEQ ID NO: 583123 - DNA, 25 bp, Mus musculus
ggaacattgtaggactgtttgaaac

SEQ ID NO: 583124 - DNA, 25 bp, Mus musculus
ggaacattgtaggtgtttctgtgtt

SEQ ID NO: 583125 - DNA, 25 bp, Mus musculus
ggaacattgtagtagccgctgctgt

SEQ ID NO: 583126 - DNA, 25 bp, Mus musculus
ggaacattgtatcatgactcttgat

SEQ ID NO: 583127 - DNA, 25 bp, Mus musculus
ggaacattgtatgatgactcttgat

SEQ ID NO: 583128 - DNA, 25 bp, Mus musculus
ggaacattgttcacagaaacttcta

SEQ ID NO: 583129 - DNA, 25 bp, Mus musculus
ggaacattgttctcagaaacttcta

SEQ ID NO: 583130 - DNA, 25 bp, Mus musculus
ggaacatttcacacctgagtgcaaa

SEQ ID NO: 583131 - DNA, 25 bp, Mus musculus
ggaacatttcactcctgagtgcaaa

SEQ ID NO: 583132 - DNA, 25 bp, Mus musculus
ggaacatttctgagttcctgtcctc

SEQ ID NO: 583133 - DNA, 25 bp, Mus musculus
ggaacatttctgtgttcctgtcctc

SEQ ID NO: 583134 - DNA, 25 bp, Mus musculus
ggaacatttgccaacaactgagtga

SEQ ID NO: 583135 - DNA, 25 bp, Mus musculus
ggaacatttgcctacaactgagtga

SEQ ID NO: 583136 - DNA, 25 bp, Mus musculus
ggaacattttctccttgaaactgtg

SEQ ID NO: 583137 - DNA, 25 bp, Mus musculus
ggaacattttctgcttgaaactgtg

SEQ ID NO: 583138 - DNA, 25 bp, Mus musculus
ggaacattttgaagcctcggaatga

SEQ ID NO: 583139 - DNA, 25 bp, Mus musculus
ggaacattttgatgcctcggaatga

SEQ ID NO: 583140 - DNA, 25 bp, Mus musculus
ggaaccaaaactactaggctagcag

SEQ ID NO: 583141 - DNA, 25 bp, Mus musculus
ggaaccaaaacttctaggctagcag

SEQ ID NO: 583142 - DNA, 25 bp, Mus musculus
ggaaccaaacacattacccagtaat

SEQ ID NO: 583143 - DNA, 25 bp, Mus musculus
ggaaccaaacactttacccagtaat

SEQ ID NO: 583144 - DNA, 25 bp, Mus musculus
ggaaccaaagatctgctccatgcac

SEQ ID NO: 583145 - DNA, 25 bp, Mus musculus
ggaaccaaagatgtgctccatgcac

SEQ ID NO: 583146 - DNA, 25 bp, Mus musculus
ggaaccaaagccataccaatgagaa

SEQ ID NO: 583147 - DNA, 25 bp, Mus musculus
ggaaccaaagccttaccaatgagaa

SEQ ID NO: 583148 - DNA, 25 bp, Mus musculus
ggaaccaaatcgatctgcattctgt

SEQ ID NO: 583149 - DNA, 25 bp, Mus musculus
ggaaccaaatcgttctgcattctgt

SEQ ID NO: 583150 - DNA, 25 bp, Mus musculus
ggaaccaaatgtatgcgtttctgtt

SEQ ID NO: 583151 - DNA, 25 bp, Mus musculus
ggaaccaaatgtttgcgtttctgtt

SEQ ID NO: 583152 - DNA, 25 bp, Mus musculus
ggaaccaaattcagggtcccatgta

SEQ ID NO: 583153 - DNA, 25 bp, Mus musculus
ggaaccaaattctgggtcccatgta

SEQ ID NO: 583154 - DNA, 25 bp, Mus musculus
ggaaccaacaatacggtcatatttt

SEQ ID NO: 583155 - DNA, 25 bp, Mus musculus
ggaaccaacaattcggtcatatttt

SEQ ID NO: 583156 - DNA, 25 bp, Mus musculus
ggaaccaacaggatgaagcaattac

SEQ ID NO: 583157 - DNA, 25 bp, Mus musculus
ggaaccaacaggttgaagcaattac

SEQ ID NO: 583158 - DNA, 25 bp, Mus musculus
ggaaccaacagtaagccctcaagca

SEQ ID NO: 583159 - DNA, 25 bp, Mus musculus
ggaaccaacagttagccctcaagca

SEQ ID NO: 583160 - DNA, 25 bp, Mus musculus
ggaaccaaccaaaagtctcaaatca

SEQ ID NO: 583161 - DNA, 25 bp, Mus musculus
ggaaccaaccaatagtctcaaatca

SEQ ID NO: 583162 - DNA, 25 bp, Mus musculus
ggaaccaacgctatagagctgactt

SEQ ID NO: 583163 - DNA, 25 bp, Mus musculus
ggaaccaacgctttagagctgactt

SEQ ID NO: 583164 - DNA, 25 bp, Mus musculus
ggaaccaagaagcaccctttatcat

SEQ ID NO: 583165 - DNA, 25 bp, Mus musculus
ggaaccaagaaggaccctttatcat

SEQ ID NO: 583166 - DNA, 25 bp, Mus musculus
ggaaccaagatgacccttcacgaag

SEQ ID NO: 583167 - DNA, 25 bp, Mus musculus
ggaaccaagatgtcccttcacgaag

SEQ ID NO: 583168 - DNA, 25 bp, Mus musculus
ggaaccaagattcttcattgaggat

SEQ ID NO: 583169 - DNA, 25 bp, Mus musculus
ggaaccaagattgttcattgaggat

SEQ ID NO: 583170 - DNA, 25 bp, Mus musculus
ggaaccaaggtgatgaatctttctt

SEQ ID NO: 583171 - DNA, 25 bp, Mus musculus
ggaaccaaggtgttgaatctttctt

SEQ ID NO: 583172 - DNA, 25 bp, Mus musculus
ggaaccaagtcccatggaacaacag

SEQ ID NO: 583173 - DNA, 25 bp, Mus musculus
ggaaccaagtccgatggaacaacag

SEQ ID NO: 583174 - DNA, 25 bp, Mus musculus
ggaaccaattttaatctctgtgcat

SEQ ID NO: 583175 - DNA, 25 bp, Mus musculus
ggaaccaatttttatctctgtgcat

SEQ ID NO: 583176 - DNA, 25 bp, Mus musculus
ggaaccacaagcatcatggtctaga

SEQ ID NO: 583177 - DNA, 25 bp, Mus musculus
ggaaccacaagcttcatggtctaga

SEQ ID NO: 583178 - DNA, 25 bp, Mus musculus
ggaaccacaccaatgatattttcat

SEQ ID NO: 583179 - DNA, 25 bp, Mus musculus
ggaaccacaccattgatattttcat

SEQ ID NO: 583180 - DNA, 25 bp, Mus musculus
ggaaccacacggcagagttctgtgt

SEQ ID NO: 583181 - DNA, 25 bp, Mus musculus
ggaaccacacgggagagttctgtgt

SEQ ID NO: 583182 - DNA, 25 bp, Mus musculus
ggaaccacacgtacttatgctgtaa

SEQ ID NO: 583183 - DNA, 25 bp, Mus musculus
ggaaccacacgttcttatgctgtaa

SEQ ID NO: 583184 - DNA, 25 bp, Mus musculus
ggaaccacactcaggtccaatgttg

SEQ ID NO: 583185 - DNA, 25 bp, Mus musculus
ggaaccacactctggtccaatgttg

SEQ ID NO: 583186 - DNA, 25 bp, Mus musculus
ggaaccacagacctgggctaatgca

SEQ ID NO: 583187 - DNA, 25 bp, Mus musculus
ggaaccacagacgtgggctaatgca

SEQ ID NO: 583188 - DNA, 25 bp, Mus musculus
ggaaccacagataccgctggcggga

SEQ ID NO: 583189 - DNA, 25 bp, Mus musculus
ggaaccacagattccgctggcggga

SEQ ID NO: 583190 - DNA, 25 bp, Mus musculus
ggaaccacagcgacgcctttgtgtt

SEQ ID NO: 583191 - DNA, 25 bp, Mus musculus
ggaaccacagcgtcgcctttgtgtt

SEQ ID NO: 583192 - DNA, 25 bp, Mus musculus
ggaaccacatgacttcagccagatt

SEQ ID NO: 583193 - DNA, 25 bp, Mus musculus
ggaaccacatgagttcagccagatt

SEQ ID NO: 583194 - DNA, 25 bp, Mus musculus
ggaaccacatgccttacacaaatgc

SEQ ID NO: 583195 - DNA, 25 bp, Mus musculus
ggaaccacatgcgttacacaaatgc

SEQ ID NO: 583196 - DNA, 25 bp, Mus musculus
ggaaccacatggaacacgaccttct

SEQ ID NO: 583197 - DNA, 25 bp, Mus musculus
ggaaccacatggtacacgaccttct

SEQ ID NO: 583198 - DNA, 25 bp, Mus musculus
ggaaccacattaaggatctttgtat

SEQ ID NO: 583199 - DNA, 25 bp, Mus musculus
ggaaccacattatggatctttgtat

SEQ ID NO: 583200 - DNA, 25 bp, Mus musculus
ggaaccacatttaccttctgtgaat

SEQ ID NO: 583201 - DNA, 25 bp, Mus musculus
ggaaccacattttccttctgtgaat

SEQ ID NO: 583202 - DNA, 25 bp, Mus musculus
ggaaccaccactccccagagtgtag

SEQ ID NO: 583203 - DNA, 25 bp, Mus musculus
ggaaccaccactgcccagagtgtag

SEQ ID NO: 583204 - DNA, 25 bp, Mus musculus
ggaaccacctgcagcacataagtac

SEQ ID NO: 583205 - DNA, 25 bp, Mus musculus
ggaaccacctgctgcacataagtac

SEQ ID NO: 583206 - DNA, 25 bp, Mus musculus
ggaaccacctggaaatgtgactgta

SEQ ID NO: 583207 - DNA, 25 bp, Mus musculus
ggaaccacctggtaatgtgactgta

SEQ ID NO: 583208 - DNA, 25 bp, Mus musculus
ggaaccacgtgaatgaggattctca

SEQ ID NO: 583209 - DNA, 25 bp, Mus musculus
ggaaccacgtgattgaggattctca

SEQ ID NO: 583210 - DNA, 25 bp, Mus musculus
ggaaccactctaaaagttcacttaa

SEQ ID NO: 583211 - DNA, 25 bp, Mus musculus
ggaaccactctataagttcacttaa

SEQ ID NO: 583212 - DNA, 25 bp, Mus musculus
ggaaccactgcgcaactatgacatc

SEQ ID NO: 583213 - DNA, 25 bp, Mus musculus
ggaaccactgcggaactatgacatc

SEQ ID NO: 583214 - DNA, 25 bp, Mus musculus
ggaaccactggacatcaagcatcat

SEQ ID NO: 583215 - DNA, 25 bp, Mus musculus
ggaaccactggagatcaagcatcat

SEQ ID NO: 583216 - DNA, 25 bp, Mus musculus
ggaaccactggtagatgacctaaca

SEQ ID NO: 583217 - DNA, 25 bp, Mus musculus
ggaaccactggttgatgacctaaca

SEQ ID NO: 583218 - DNA, 25 bp, Mus musculus
ggaaccacttccaaatgtaacgtca

SEQ ID NO: 583219 - DNA, 25 bp, Mus musculus
ggaaccacttccactcaaatctagt

SEQ ID NO: 583220 - DNA, 25 bp, Mus musculus
ggaaccacttcctaatgtaacgtca

SEQ ID NO: 583221 - DNA, 25 bp, Mus musculus
ggaaccacttcctctcaaatctagt

SEQ ID NO: 583222 - DNA, 25 bp, Mus musculus
ggaaccagaacgctttcttacagga

SEQ ID NO: 583223 - DNA, 25 bp, Mus musculus
ggaaccagaacggtttcttacagga

SEQ ID NO: 583224 - DNA, 25 bp, Mus musculus
ggaaccagaaggacccagcaatcct

SEQ ID NO: 583225 - DNA, 25 bp, Mus musculus
ggaaccagaaggtcccagcaatcct

SEQ ID NO: 583226 - DNA, 25 bp, Mus musculus
ggaaccagaataccacgatgcttgt

SEQ ID NO: 583227 - DNA, 25 bp, Mus musculus
ggaaccagaatagcacgatgcttgt

SEQ ID NO: 583228 - DNA, 25 bp, Mus musculus
ggaaccagacatctctagatcttct

SEQ ID NO: 583229 - DNA, 25 bp, Mus musculus
ggaaccagacatgtctagatcttct

SEQ ID NO: 583230 - DNA, 25 bp, Mus musculus
ggaaccagaccaccctaaggtgtag

SEQ ID NO: 583231 - DNA, 25 bp, Mus musculus
ggaaccagaccagcctaaggtgtag

SEQ ID NO: 583232 - DNA, 25 bp, Mus musculus
ggaaccagagctcaatttttcttta

SEQ ID NO: 583233 - DNA, 25 bp, Mus musculus
ggaaccagagctgaatttttcttta

SEQ ID NO: 583234 - DNA, 25 bp, Mus musculus
ggaaccagagtccagtaactcctgc

SEQ ID NO: 583235 - DNA, 25 bp, Mus musculus
ggaaccagagtcgagtaactcctgc

SEQ ID NO: 583236 - DNA, 25 bp, Mus musculus
ggaaccagatcactttcttatgttg

SEQ ID NO: 583237 - DNA, 25 bp, Mus musculus
ggaaccagatcagtttcttatgttg

SEQ ID NO: 583238 - DNA, 25 bp, Mus musculus
ggaaccagatggaacttagtagaac

SEQ ID NO: 583239 - DNA, 25 bp, Mus musculus
ggaaccagatggtacttagtagaac

SEQ ID NO: 583240 - DNA, 25 bp, Mus musculus
ggaaccagcaatagtttctgaaaaa

SEQ ID NO: 583241 - DNA, 25 bp, Mus musculus
ggaaccagcaattgtttctgaaaaa

SEQ ID NO: 583242 - DNA, 25 bp, Mus musculus
ggaaccagcatgacctttaccccaa

SEQ ID NO: 583243 - DNA, 25 bp, Mus musculus
ggaaccagcatgtcctttaccccaa

SEQ ID NO: 583244 - DNA, 25 bp, Mus musculus
ggaaccagccttagggtctgaacca

SEQ ID NO: 583245 - DNA, 25 bp, Mus musculus
ggaaccagcctttgggtctgaacca

SEQ ID NO: 583246 - DNA, 25 bp, Mus musculus
ggaaccagctgaactccctggaaga

SEQ ID NO: 583247 - DNA, 25 bp, Mus musculus
ggaaccagctgatctccctggaaga

SEQ ID NO: 583248 - DNA, 25 bp, Mus musculus
ggaaccagctttacggtcacaggtc

SEQ ID NO: 583249 - DNA, 25 bp, Mus musculus
ggaaccagcttttcggtcacaggtc

SEQ ID NO: 583250 - DNA, 25 bp, Mus musculus
ggaaccaggactaccagggacatca

SEQ ID NO: 583251 - DNA, 25 bp, Mus musculus
ggaaccaggacttccagggacatca

SEQ ID NO: 583252 - DNA, 25 bp, Mus musculus
ggaaccaggcttaattatctctatc

SEQ ID NO: 583253 - DNA, 25 bp, Mus musculus
ggaaccaggctttattatctctatc

SEQ ID NO: 583254 - DNA, 25 bp, Mus musculus
ggaaccagggccagccctggtgtaa

SEQ ID NO: 583255 - DNA, 25 bp, Mus musculus
ggaaccagggcctgccctggtgtaa

SEQ ID NO: 583256 - DNA, 25 bp, Mus musculus
ggaaccagtgctaagtcttgtctaa

SEQ ID NO: 583257 - DNA, 25 bp, Mus musculus
ggaaccagtgcttagtcttgtctaa

SEQ ID NO: 583258 - DNA, 25 bp, Mus musculus
ggaaccagttttagatatcaccaaa

SEQ ID NO: 583259 - DNA, 25 bp, Mus musculus
ggaaccagtttttgatatcaccaaa

SEQ ID NO: 583260 - DNA, 25 bp, Mus musculus
ggaaccatacagaggctgccctgct

SEQ ID NO: 583261 - DNA, 25 bp, Mus musculus
ggaaccatacagtggctgccctgct

SEQ ID NO: 583262 - DNA, 25 bp, Mus musculus
ggaaccatatgcataaagaactctt

SEQ ID NO: 583263 - DNA, 25 bp, Mus musculus
ggaaccatatgcttaaagaactctt

SEQ ID NO: 583264 - DNA, 25 bp, Mus musculus
ggaaccatcacacacttctgtacag

SEQ ID NO: 583265 - DNA, 25 bp, Mus musculus
ggaaccatcacagacttctgtacag

SEQ ID NO: 583266 - DNA, 25 bp, Mus musculus
ggaaccatcattaacaagaccttat

SEQ ID NO: 583267 - DNA, 25 bp, Mus musculus
ggaaccatcatttacaagaccttat

SEQ ID NO: 583268 - DNA, 25 bp, Mus musculus
ggaaccatccagatgggccggaagc

SEQ ID NO: 583269 - DNA, 25 bp, Mus musculus
ggaaccatccagttgggccggaagc

SEQ ID NO: 583270 - DNA, 25 bp, Mus musculus
ggaaccatcgccaatgtgacagtag

SEQ ID NO: 583271 - DNA, 25 bp, Mus musculus
ggaaccatcgcctatgtgacagtag

SEQ ID NO: 583272 - DNA, 25 bp, Mus musculus
ggaaccatctccaagagcttcaaga

SEQ ID NO: 583273 - DNA, 25 bp, Mus musculus
ggaaccatctcctagagcttcaaga

SEQ ID NO: 583274 - DNA, 25 bp, Mus musculus
ggaaccatctctaccaattttcagt

SEQ ID NO: 583275 - DNA, 25 bp, Mus musculus
ggaaccatctcttccaattttcagt

SEQ ID NO: 583276 - DNA, 25 bp, Mus musculus
ggaaccatctttctgcaaaacagta

SEQ ID NO: 583277 - DNA, 25 bp, Mus musculus
ggaaccatctttgtgcaaaacagta

SEQ ID NO: 583278 - DNA, 25 bp, Mus musculus
ggaaccatgcctatgcgaaacatct

SEQ ID NO: 583279 - DNA, 25 bp, Mus musculus
ggaaccatgcctttgcgaaacatct

SEQ ID NO: 583280 - DNA, 25 bp, Mus musculus
ggaaccatgctcatctagatcagtg

SEQ ID NO: 583281 - DNA, 25 bp, Mus musculus
ggaaccatgctcttctagatcagtg

SEQ ID NO: 583282 - DNA, 25 bp, Mus musculus
ggaaccatggcaaccggcaattctt

SEQ ID NO: 583283 - DNA, 25 bp, Mus musculus
ggaaccatggcatccggcaattctt

SEQ ID NO: 583284 - DNA, 25 bp, Mus musculus
ggaaccatgggtcaccctgtgacat

SEQ ID NO: 583285 - DNA, 25 bp, Mus musculus
ggaaccatgggtgaccctgtgacat

SEQ ID NO: 583286 - DNA, 25 bp, Mus musculus
ggaaccatggtgactgtcccattaa

SEQ ID NO: 583287 - DNA, 25 bp, Mus musculus
ggaaccatggtgtctgtcccattaa

SEQ ID NO: 583288 - DNA, 25 bp, Mus musculus
ggaaccatgtgcaaattttacagtg

SEQ ID NO: 583289 - DNA, 25 bp, Mus musculus
ggaaccatgtgctaattttacagtg

SEQ ID NO: 583290 - DNA, 25 bp, Mus musculus
ggaaccattaagacttgttagtctc

SEQ ID NO: 583291 - DNA, 25 bp, Mus musculus
ggaaccattaagtcttgttagtctc

SEQ ID NO: 583292 - DNA, 25 bp, Mus musculus
ggaaccattcaaagccactggttat

SEQ ID NO: 583293 - DNA, 25 bp, Mus musculus
ggaaccattcaatgccactggttat

SEQ ID NO: 583294 - DNA, 25 bp, Mus musculus
ggaaccattccactgacaagagaga

SEQ ID NO: 583295 - DNA, 25 bp, Mus musculus
ggaaccattccagtgacaagagaga

SEQ ID NO: 583296 - DNA, 25 bp, Mus musculus
ggaacccaaagaagtttattcagga

SEQ ID NO: 583297 - DNA, 25 bp, Mus musculus
ggaacccaaagatgtttattcagga

SEQ ID NO: 583298 - DNA, 25 bp, Mus musculus
ggaacccaacatatccaagctttgt

SEQ ID NO: 583299 - DNA, 25 bp, Mus musculus
ggaacccaacatcccctaacagatt

SEQ ID NO: 583300 - DNA, 25 bp, Mus musculus
ggaacccaacatgccctaacagatt

SEQ ID NO: 583301 - DNA, 25 bp, Mus musculus
ggaacccaacatttccaagctttgt

SEQ ID NO: 583302 - DNA, 25 bp, Mus musculus
ggaacccaacttagctcttagttag

SEQ ID NO: 583303 - DNA, 25 bp, Mus musculus
ggaacccaactttgctcttagttag

SEQ ID NO: 583304 - DNA, 25 bp, Mus musculus
ggaacccaaggtcttgtcttgtgca

SEQ ID NO: 583305 - DNA, 25 bp, Mus musculus
ggaacccaaggtgttgtcttgtgca

SEQ ID NO: 583306 - DNA, 25 bp, Mus musculus
ggaacccacaagaaaagctgccatg

SEQ ID NO: 583307 - DNA, 25 bp, Mus musculus
ggaacccacaagtaaagctgccatg

SEQ ID NO: 583308 - DNA, 25 bp, Mus musculus
ggaacccacattcggctcaggtgat

SEQ ID NO: 583309 - DNA, 25 bp, Mus musculus
ggaacccacattgggctcaggtgat

SEQ ID NO: 583310 - DNA, 25 bp, Mus musculus
ggaacccaccgaaagctgagagtct

SEQ ID NO: 583311 - DNA, 25 bp, Mus musculus
ggaacccaccgatagctgagagtct

SEQ ID NO: 583312 - DNA, 25 bp, Mus musculus
ggaacccacctgcatacgtagtaat

SEQ ID NO: 583313 - DNA, 25 bp, Mus musculus
ggaacccacctggatacgtagtaat

SEQ ID NO: 583314 - DNA, 25 bp, Mus musculus
ggaacccacgataaactgcttgcag

SEQ ID NO: 583315 - DNA, 25 bp, Mus musculus
ggaacccacgattaactgcttgcag

SEQ ID NO: 583316 - DNA, 25 bp, Mus musculus
ggaacccacgttcttaagcaactag

SEQ ID NO: 583317 - DNA, 25 bp, Mus musculus
ggaacccacgttgttaagcaactag

SEQ ID NO: 583318 - DNA, 25 bp, Mus musculus
ggaacccagaggacttgtgctgcct

SEQ ID NO: 583319 - DNA, 25 bp, Mus musculus
ggaacccagaggtcttgtgctgcct

SEQ ID NO: 583320 - DNA, 25 bp, Mus musculus
ggaacccagatacagcccagtgagc

SEQ ID NO: 583321 - DNA, 25 bp, Mus musculus
ggaacccagatagagcccagtgagc

SEQ ID NO: 583322 - DNA, 25 bp, Mus musculus
ggaacccagcaaaacacacttaacc

SEQ ID NO: 583323 - DNA, 25 bp, Mus musculus
ggaacccagcaatacacacttaacc

SEQ ID NO: 583324 - DNA, 25 bp, Mus musculus
ggaacccagggaaaaacaatgtagt

SEQ ID NO: 583325 - DNA, 25 bp, Mus musculus
ggaacccagggataaacaatgtagt

SEQ ID NO: 583326 - DNA, 25 bp, Mus musculus
ggaacccagggcatatggatatatc

SEQ ID NO: 583327 - DNA, 25 bp, Mus musculus
ggaacccagggcatgtgatgctgaa

SEQ ID NO: 583328 - DNA, 25 bp, Mus musculus
ggaacccagggcctagaaaatacat

SEQ ID NO: 583329 - DNA, 25 bp, Mus musculus
ggaacccagggcgtagaaaatacat

SEQ ID NO: 583330 - DNA, 25 bp, Mus musculus
ggaacccagggcttatggatatatc

SEQ ID NO: 583331 - DNA, 25 bp, Mus musculus
ggaacccagggcttgtgatgctgaa

SEQ ID NO: 583332 - DNA, 25 bp, Mus musculus
ggaacccagtagagtggcgtaaaca

SEQ ID NO: 583333 - DNA, 25 bp, Mus musculus
ggaacccagtagtgtggcgtaaaca

SEQ ID NO: 583334 - DNA, 25 bp, Mus musculus
ggaacccagtgaacaacattgtctc

SEQ ID NO: 583335 - DNA, 25 bp, Mus musculus
ggaacccagtgatcaacattgtctc

SEQ ID NO: 583336 - DNA, 25 bp, Mus musculus
ggaacccagtttcgccagtgggata

SEQ ID NO: 583337 - DNA, 25 bp, Mus musculus
ggaacccagtttggccagtgggata

SEQ ID NO: 583338 - DNA, 25 bp, Mus musculus
ggaacccataaaacctctctgtggt

SEQ ID NO: 583339 - DNA, 25 bp, Mus musculus
ggaacccataaatcctctctgtggt

SEQ ID NO: 583340 - DNA, 25 bp, Mus musculus
ggaacccatcccagtgatcatttct

SEQ ID NO: 583341 - DNA, 25 bp, Mus musculus
ggaacccatccctgtgatcatttct

SEQ ID NO: 583342 - DNA, 25 bp, Mus musculus
ggaacccatcgtctagagatctctt

SEQ ID NO: 583343 - DNA, 25 bp, Mus musculus
ggaacccatcgtgtagagatctctt

SEQ ID NO: 583344 - DNA, 25 bp, Mus musculus
ggaacccatgagatattagaggaat

SEQ ID NO: 583345 - DNA, 25 bp, Mus musculus
ggaacccatgagttattagaggaat

SEQ ID NO: 583346 - DNA, 25 bp, Mus musculus
ggaacccattcactaggcacagtgc

SEQ ID NO: 583347 - DNA, 25 bp, Mus musculus
ggaacccattcagtaggcacagtgc

SEQ ID NO: 583348 - DNA, 25 bp, Mus musculus
ggaaccccaacgatgaagtagatct

SEQ ID NO: 583349 - DNA, 25 bp, Mus musculus
ggaaccccaacgttgaagtagatct

SEQ ID NO: 583350 - DNA, 25 bp, Mus musculus
ggaaccccaagcaagtcattacgtt

SEQ ID NO: 583351 - DNA, 25 bp, Mus musculus
ggaaccccaagctagtcattacgtt

SEQ ID NO: 583352 - DNA, 25 bp, Mus musculus
ggaaccccagcaatctgtgagagca

SEQ ID NO: 583353 - DNA, 25 bp, Mus musculus
ggaaccccagcattctgtgagagca

SEQ ID NO: 583354 - DNA, 25 bp, Mus musculus
ggaaccccctaacaattgacataca

SEQ ID NO: 583355 - DNA, 25 bp, Mus musculus
ggaaccccctaagaattgacataca

SEQ ID NO: 583356 - DNA, 25 bp, Mus musculus
ggaaccccgaaactgccaaggcaga

SEQ ID NO: 583357 - DNA, 25 bp, Mus musculus
ggaaccccgaaagtgccaaggcaga

SEQ ID NO: 583358 - DNA, 25 bp, Mus musculus
ggaaccccggctaatagagttagct

SEQ ID NO: 583359 - DNA, 25 bp, Mus musculus
ggaaccccggcttatagagttagct

SEQ ID NO: 583360 - DNA, 25 bp, Mus musculus
ggaaccccggtgaggacagcagtct

SEQ ID NO: 583361 - DNA, 25 bp, Mus musculus
ggaaccccggtgtggacagcagtct

SEQ ID NO: 583362 - DNA, 25 bp, Mus musculus
ggaaccccgtgtcgttttgatacat

SEQ ID NO: 583363 - DNA, 25 bp, Mus musculus
ggaaccccgtgtggttttgatacat

SEQ ID NO: 583364 - DNA, 25 bp, Mus musculus
ggaacccctgacaagaggcataacc

SEQ ID NO: 583365 - DNA, 25 bp, Mus musculus
ggaacccctgactagaggcataacc

SEQ ID NO: 583366 - DNA, 25 bp, Mus musculus
ggaaccccttgtcagcatgctcagt

SEQ ID NO: 583367 - DNA, 25 bp, Mus musculus
ggaaccccttgtgagcatgctcagt

SEQ ID NO: 583368 - DNA, 25 bp, Mus musculus
ggaacccgaggaactgtgtcaaggc

SEQ ID NO: 583369 - DNA, 25 bp, Mus musculus
ggaacccgaggatctgtgtcaaggc

SEQ ID NO: 583370 - DNA, 25 bp, Mus musculus
ggaacccgctagaataatagtaaat

SEQ ID NO: 583371 - DNA, 25 bp, Mus musculus
ggaacccgctagtataatagtaaat

SEQ ID NO: 583372 - DNA, 25 bp, Mus musculus
ggaacccgggctctatttattgatt

SEQ ID NO: 583373 - DNA, 25 bp, Mus musculus
ggaacccgggctgtatttattgatt

SEQ ID NO: 583374 - DNA, 25 bp, Mus musculus
ggaacccgttgtcgccatgagttag

SEQ ID NO: 583375 - DNA, 25 bp, Mus musculus
ggaacccgttgtggccatgagttag

SEQ ID NO: 583376 - DNA, 25 bp, Mus musculus
ggaaccctaggacagcatatgcatc

SEQ ID NO: 583377 - DNA, 25 bp, Mus musculus
ggaaccctaggagagcatatgcatc

SEQ ID NO: 583378 - DNA, 25 bp, Mus musculus
ggaaccctaggtctctactaaacat

SEQ ID NO: 583379 - DNA, 25 bp, Mus musculus
ggaaccctaggtgtctactaaacat

SEQ ID NO: 583380 - DNA, 25 bp, Mus musculus
ggaaccctatcacacagtgccgtgg

SEQ ID NO: 583381 - DNA, 25 bp, Mus musculus
ggaaccctatcagacagtgccgtgg

SEQ ID NO: 583382 - DNA, 25 bp, Mus musculus
ggaaccctcagtcaaaggcagcctg

SEQ ID NO: 583383 - DNA, 25 bp, Mus musculus
ggaaccctcagtgaaaggcagcctg

SEQ ID NO: 583384 - DNA, 25 bp, Mus musculus
ggaaccctgaaccactctggtggca

SEQ ID NO: 583385 - DNA, 25 bp, Mus musculus
ggaaccctgaacgactctggtggca

SEQ ID NO: 583386 - DNA, 25 bp, Mus musculus
ggaaccctgactctctgaaacatga

SEQ ID NO: 583387 - DNA, 25 bp, Mus musculus
ggaaccctgactgtctgaaacatga

SEQ ID NO: 583388 - DNA, 25 bp, Mus musculus
ggaaccctgagtctggagcaagcca

SEQ ID NO: 583389 - DNA, 25 bp, Mus musculus
ggaaccctgagtgtggagcaagcca

SEQ ID NO: 583390 - DNA, 25 bp, Mus musculus
ggaaccctgcagcttttagagaccc

SEQ ID NO: 583391 - DNA, 25 bp, Mus musculus
ggaaccctgcaggttttagagaccc

SEQ ID NO: 583392 - DNA, 25 bp, Mus musculus
ggaaccctgcccacaaagatgattg

SEQ ID NO: 583393 - DNA, 25 bp, Mus musculus
ggaaccctgccctcaaagatgattg

SEQ ID NO: 583394 - DNA, 25 bp, Mus musculus
ggaaccctgtgaacggagcctcaag

SEQ ID NO: 583395 - DNA, 25 bp, Mus musculus
ggaaccctgtgatcggagcctcaag

SEQ ID NO: 583396 - DNA, 25 bp, Mus musculus
ggaacccttaatccatccattctta

SEQ ID NO: 583397 - DNA, 25 bp, Mus musculus
ggaacccttaatgcatccattctta

SEQ ID NO: 583398 - DNA, 25 bp, Mus musculus
ggaacccttccacagtgcgaagata

SEQ ID NO: 583399 - DNA, 25 bp, Mus musculus
ggaacccttccagagtgcgaagata

SEQ ID NO: 583400 - DNA, 25 bp, Mus musculus
ggaacccttccgatgattagcaatg

SEQ ID NO: 583401 - DNA, 25 bp, Mus musculus
ggaacccttccgttgattagcaatg

SEQ ID NO: 583402 - DNA, 25 bp, Mus musculus
ggaaccctttgtcccagaacctgga

SEQ ID NO: 583403 - DNA, 25 bp, Mus musculus
ggaaccctttgtgccagaacctgga

SEQ ID NO: 583404 - DNA, 25 bp, Mus musculus
ggaacccttttgcaatcatgatttg

SEQ ID NO: 583405 - DNA, 25 bp, Mus musculus
ggaacccttttggaatcatgatttg

SEQ ID NO: 583406 - DNA, 25 bp, Mus musculus
ggaaccgaattcaatctttagtact

SEQ ID NO: 583407 - DNA, 25 bp, Mus musculus
ggaaccgaattctatctttagtact

SEQ ID NO: 583408 - DNA, 25 bp, Mus musculus
ggaaccgacgaaaatttggcttgtt

SEQ ID NO: 583409 - DNA, 25 bp, Mus musculus
ggaaccgacgaatatttggcttgtt

SEQ ID NO: 583410 - DNA, 25 bp, Mus musculus
ggaaccgagactaccgctacagttt

SEQ ID NO: 583411 - DNA, 25 bp, Mus musculus
ggaaccgagacttccgctacagttt

SEQ ID NO: 583412 - DNA, 25 bp, Mus musculus
ggaaccgagtgtcgcctaccatgaa

SEQ ID NO: 583413 - DNA, 25 bp, Mus musculus
ggaaccgagtgtggcctaccatgaa

SEQ ID NO: 583414 - DNA, 25 bp, Mus musculus
ggaaccgatcgactttaccgcccag

SEQ ID NO: 583415 - DNA, 25 bp, Mus musculus
ggaaccgatcgagtttaccgcccag

SEQ ID NO: 583416 - DNA, 25 bp, Mus musculus
ggaaccgcagctatgacccttcatg

SEQ ID NO: 583417 - DNA, 25 bp, Mus musculus
ggaaccgcagctttgacccttcatg

SEQ ID NO: 583418 - DNA, 25 bp, Mus musculus
ggaaccgcatccaaaatcctcagga

SEQ ID NO: 583419 - DNA, 25 bp, Mus musculus
ggaaccgcatcccaaattacctgac

SEQ ID NO: 583420 - DNA, 25 bp, Mus musculus
ggaaccgcatccgaaattacctgac

SEQ ID NO: 583421 - DNA, 25 bp, Mus musculus
ggaaccgcatcctaaatcctcagga

SEQ ID NO: 583422 - DNA, 25 bp, Mus musculus
ggaaccgctgccatagaccgagttc

SEQ ID NO: 583423 - DNA, 25 bp, Mus musculus
ggaaccgctgccttagaccgagttc

SEQ ID NO: 583424 - DNA, 25 bp, Mus musculus
ggaaccggaatcagccataatgact

SEQ ID NO: 583425 - DNA, 25 bp, Mus musculus
ggaaccggaatctgccataatgact

SEQ ID NO: 583426 - DNA, 25 bp, Mus musculus
ggaaccggtctgacagtctctgaac

SEQ ID NO: 583427 - DNA, 25 bp, Mus musculus
ggaaccggtctgtcagtctctgaac

SEQ ID NO: 583428 - DNA, 25 bp, Mus musculus
ggaaccggttcacgctgggatccca

SEQ ID NO: 583429 - DNA, 25 bp, Mus musculus
ggaaccggttcaggctgggatccca

SEQ ID NO: 583430 - DNA, 25 bp, Mus musculus
ggaaccgtagacatcaacagtgagc

SEQ ID NO: 583431 - DNA, 25 bp, Mus musculus
ggaaccgtagacttcaacagtgagc

SEQ ID NO: 583432 - DNA, 25 bp, Mus musculus
ggaaccgtattacagtccccggatg

SEQ ID NO: 583433 - DNA, 25 bp, Mus musculus
ggaaccgtattagagtccccggatg

SEQ ID NO: 583434 - DNA, 25 bp, Mus musculus
ggaaccgtcaccatcactctgaaga

SEQ ID NO: 583435 - DNA, 25 bp, Mus musculus
ggaaccgtcaccttcactctgaaga

SEQ ID NO: 583436 - DNA, 25 bp, Mus musculus
ggaaccgtcctgagcatcgtgagag

SEQ ID NO: 583437 - DNA, 25 bp, Mus musculus
ggaaccgtcctgtgcatcgtgagag

SEQ ID NO: 583438 - DNA, 25 bp, Mus musculus
ggaaccgtcttcagctgtggaacga

SEQ ID NO: 583439 - DNA, 25 bp, Mus musculus
ggaaccgtcttctgctgtggaacga

SEQ ID NO: 583440 - DNA, 25 bp, Mus musculus
ggaaccgtgtctctgctcaaggaag

SEQ ID NO: 583441 - DNA, 25 bp, Mus musculus
ggaaccgtgtctgtgctcaaggaag

SEQ ID NO: 583442 - DNA, 25 bp, Mus musculus
ggaacctaacctcgtgctatctgaa

SEQ ID NO: 583443 - DNA, 25 bp, Mus musculus
ggaacctaacctggtgctatctgaa

SEQ ID NO: 583444 - DNA, 25 bp, Mus musculus
ggaacctaagttcttacactgtaat

SEQ ID NO: 583445 - DNA, 25 bp, Mus musculus
ggaacctaagttgttacactgtaat

SEQ ID NO: 583446 - DNA, 25 bp, Mus musculus
ggaacctacagcacgtgtattcaga

SEQ ID NO: 583447 - DNA, 25 bp, Mus musculus
ggaacctacagctcgtgtattcaga

SEQ ID NO: 583448 - DNA, 25 bp, Mus musculus
ggaacctactccagaatacatgatg

SEQ ID NO: 583449 - DNA, 25 bp, Mus musculus
ggaacctactcctgaatacatgatg

SEQ ID NO: 583450 - DNA, 25 bp, Mus musculus
ggaacctactgtcaatgcagccttg

SEQ ID NO: 583451 - DNA, 25 bp, Mus musculus
ggaacctactgtgaatgcagccttg

SEQ ID NO: 583452 - DNA, 25 bp, Mus musculus
ggaacctagctgacctcgagtcctg

SEQ ID NO: 583453 - DNA, 25 bp, Mus musculus
ggaacctagctgtcctcgagtcctg

SEQ ID NO: 583454 - DNA, 25 bp, Mus musculus
ggaacctagggcagatggctcaatg

SEQ ID NO: 583455 - DNA, 25 bp, Mus musculus
ggaacctagggctgatggctcaatg

SEQ ID NO: 583456 - DNA, 25 bp, Mus musculus
ggaacctagtctcctacttgaaaca

SEQ ID NO: 583457 - DNA, 25 bp, Mus musculus
ggaacctagtctgctacttgaaaca

SEQ ID NO: 583458 - DNA, 25 bp, Mus musculus
ggaacctatggcagcacacggattt

SEQ ID NO: 583459 - DNA, 25 bp, Mus musculus
ggaacctatggctgcacacggattt

SEQ ID NO: 583460 - DNA, 25 bp, Mus musculus
ggaacctattaaaggcttgttgatt

SEQ ID NO: 583461 - DNA, 25 bp, Mus musculus
ggaacctattaatggcttgttgatt

SEQ ID NO: 583462 - DNA, 25 bp, Mus musculus
ggaacctcaagaacacagctcacag

SEQ ID NO: 583463 - DNA, 25 bp, Mus musculus
ggaacctcaagaaggtgcagctaaa

SEQ ID NO: 583464 - DNA, 25 bp, Mus musculus
ggaacctcaagatcacagctcacag

SEQ ID NO: 583465 - DNA, 25 bp, Mus musculus
ggaacctcaagatggtgcagctaaa

SEQ ID NO: 583466 - DNA, 25 bp, Mus musculus
ggaacctcaaggctgatgctaacag

SEQ ID NO: 583467 - DNA, 25 bp, Mus musculus
ggaacctcaagggtgatgctaacag

SEQ ID NO: 583468 - DNA, 25 bp, Mus musculus
ggaacctcaccacaacactatgaaa

SEQ ID NO: 583469 - DNA, 25 bp, Mus musculus
ggaacctcaccagaacactatgaaa

SEQ ID NO: 583470 - DNA, 25 bp, Mus musculus
ggaacctcagaaagctacgagagct

SEQ ID NO: 583471 - DNA, 25 bp, Mus musculus
ggaacctcagaatgctacgagagct

SEQ ID NO: 583472 - DNA, 25 bp, Mus musculus
ggaacctcagctcgttaggcaggaa

SEQ ID NO: 583473 - DNA, 25 bp, Mus musculus
ggaacctcagctggttaggcaggaa

SEQ ID NO: 583474 - DNA, 25 bp, Mus musculus
ggaacctcagtgaaagattctcctt

SEQ ID NO: 583475 - DNA, 25 bp, Mus musculus
ggaacctcagtgtaagattctcctt

SEQ ID NO: 583476 - DNA, 25 bp, Mus musculus
ggaacctcatctacctctttgagga

SEQ ID NO: 583477 - DNA, 25 bp, Mus musculus
ggaacctcatctctgttgctttttc

SEQ ID NO: 583478 - DNA, 25 bp, Mus musculus
ggaacctcatctgtgttgctttttc

SEQ ID NO: 583479 - DNA, 25 bp, Mus musculus
ggaacctcatcttcctctttgagga

SEQ ID NO: 583480 - DNA, 25 bp, Mus musculus
ggaacctccaagaagacaaccgtgt

SEQ ID NO: 583481 - DNA, 25 bp, Mus musculus
ggaacctccaagtagacaaccgtgt

SEQ ID NO: 583482 - DNA, 25 bp, Mus musculus
ggaacctccatcctacggaagacca

SEQ ID NO: 583483 - DNA, 25 bp, Mus musculus
ggaacctccatcgtacggaagacca

SEQ ID NO: 583484 - DNA, 25 bp, Mus musculus
ggaacctcccaaattgtgataaaat

SEQ ID NO: 583485 - DNA, 25 bp, Mus musculus
ggaacctcccaatttgtgataaaat

SEQ ID NO: 583486 - DNA, 25 bp, Mus musculus
ggaacctccctgaggtcccaggagg

SEQ ID NO: 583487 - DNA, 25 bp, Mus musculus
ggaacctccctgtggtcccaggagg

SEQ ID NO: 583488 - DNA, 25 bp, Mus musculus
ggaacctcctgaagatcgcctgtag

SEQ ID NO: 583489 - DNA, 25 bp, Mus musculus
ggaacctcctgatgatcgcctgtag

SEQ ID NO: 583490 - DNA, 25 bp, Mus musculus
ggaacctcgattcaggaaacacctc

SEQ ID NO: 583491 - DNA, 25 bp, Mus musculus
ggaacctcgattgaggaaacacctc

SEQ ID NO: 583492 - DNA, 25 bp, Mus musculus
ggaacctcgcagcaagtgatctgga

SEQ ID NO: 583493 - DNA, 25 bp, Mus musculus
ggaacctcgcaggaagtgatctgga

SEQ ID NO: 583494 - DNA, 25 bp, Mus musculus
ggaacctcggttccaggagaagcca

SEQ ID NO: 583495 - DNA, 25 bp, Mus musculus
ggaacctcggttgcaggagaagcca

SEQ ID NO: 583496 - DNA, 25 bp, Mus musculus
ggaacctctacgacagcatccggaa

SEQ ID NO: 583497 - DNA, 25 bp, Mus musculus
ggaacctctacgtcagcatccggaa

SEQ ID NO: 583498 - DNA, 25 bp, Mus musculus
ggaacctctcaaatttgcgctgata

SEQ ID NO: 583499 - DNA, 25 bp, Mus musculus
ggaacctctcaattttgcgctgata

SEQ ID NO: 583500 - DNA, 25 bp, Mus musculus
ggaacctctggcaggaagtcaccca

SEQ ID NO: 583501 - DNA, 25 bp, Mus musculus
ggaacctctggctggaagtcaccca

SEQ ID NO: 583502 - DNA, 25 bp, Mus musculus
ggaacctctgttcaaatctgactga

SEQ ID NO: 583503 - DNA, 25 bp, Mus musculus
ggaacctctgttgaaatctgactga

SEQ ID NO: 583504 - DNA, 25 bp, Mus musculus
ggaacctcttagaagtcctcagaac

SEQ ID NO: 583505 - DNA, 25 bp, Mus musculus
ggaacctcttagtagtcctcagaac

SEQ ID NO: 583506 - DNA, 25 bp, Mus musculus
ggaacctctttgagattcagaacga

SEQ ID NO: 583507 - DNA, 25 bp, Mus musculus
ggaacctctttgtgattcagaacga

SEQ ID NO: 583508 - DNA, 25 bp, Mus musculus
ggaacctgaaaactcctggcattgg

SEQ ID NO: 583509 - DNA, 25 bp, Mus musculus
ggaacctgaaaagtcctggcattgg

SEQ ID NO: 583510 - DNA, 25 bp, Mus musculus
ggaacctgaaacaccccaggatgct

SEQ ID NO: 583511 - DNA, 25 bp, Mus musculus
ggaacctgaaactccccaggatgct

SEQ ID NO: 583512 - DNA, 25 bp, Mus musculus
ggaacctgaaatcctaagactacaa

SEQ ID NO: 583513 - DNA, 25 bp, Mus musculus
ggaacctgaaatgctaagactacaa

SEQ ID NO: 583514 - DNA, 25 bp, Mus musculus
ggaacctgaataaccctgcagaaaa

SEQ ID NO: 583515 - DNA, 25 bp, Mus musculus
ggaacctgaatatccctgcagaaaa

SEQ ID NO: 583516 - DNA, 25 bp, Mus musculus
ggaacctgagagactgggtcccacc

SEQ ID NO: 583517 - DNA, 25 bp, Mus musculus
ggaacctgagagtctgggtcccacc

SEQ ID NO: 583518 - DNA, 25 bp, Mus musculus
ggaacctgagatctgcaccagttga

SEQ ID NO: 583519 - DNA, 25 bp, Mus musculus
ggaacctgagatgtgcaccagttga

SEQ ID NO: 583520 - DNA, 25 bp, Mus musculus
ggaacctgagccaagggagagatca

SEQ ID NO: 583521 - DNA, 25 bp, Mus musculus
ggaacctgagccaagtcacggactg

SEQ ID NO: 583522 - DNA, 25 bp, Mus musculus
ggaacctgagcctagggagagatca

SEQ ID NO: 583523 - DNA, 25 bp, Mus musculus
ggaacctgagcctagtcacggactg

SEQ ID NO: 583524 - DNA, 25 bp, Mus musculus
ggaacctgagtcagagcatggctct

SEQ ID NO: 583525 - DNA, 25 bp, Mus musculus
ggaacctgagtccacagacctgaca

SEQ ID NO: 583526 - DNA, 25 bp, Mus musculus
ggaacctgagtcgacagacctgaca

SEQ ID NO: 583527 - DNA, 25 bp, Mus musculus
ggaacctgagtctgagcatggctct

SEQ ID NO: 583528 - DNA, 25 bp, Mus musculus
ggaacctgagtgctctggcacacag

SEQ ID NO: 583529 - DNA, 25 bp, Mus musculus
ggaacctgagtggtctggcacacag

SEQ ID NO: 583530 - DNA, 25 bp, Mus musculus
ggaacctgatataactggcaatgct

SEQ ID NO: 583531 - DNA, 25 bp, Mus musculus
ggaacctgatattactggcaatgct

SEQ ID NO: 583532 - DNA, 25 bp, Mus musculus
ggaacctgattcactgcaactaacc

SEQ ID NO: 583533 - DNA, 25 bp, Mus musculus
ggaacctgattctctgcaactaacc

SEQ ID NO: 583534 - DNA, 25 bp, Mus musculus
ggaacctgcaaacatcagccactag

SEQ ID NO: 583535 - DNA, 25 bp, Mus musculus
ggaacctgcaaagatcagccactag

SEQ ID NO: 583536 - DNA, 25 bp, Mus musculus
ggaacctgctacaagaacccagatc

SEQ ID NO: 583537 - DNA, 25 bp, Mus musculus
ggaacctgctactagaacccagatc

SEQ ID NO: 583538 - DNA, 25 bp, Mus musculus
ggaacctgctgaagctgcgcagcaa

SEQ ID NO: 583539 - DNA, 25 bp, Mus musculus
ggaacctgctgatgctgcgcagcaa

SEQ ID NO: 583540 - DNA, 25 bp, Mus musculus
ggaacctggagccaattgcagttaa

SEQ ID NO: 583541 - DNA, 25 bp, Mus musculus
ggaacctggagccacgtgccagcct

SEQ ID NO: 583542 - DNA, 25 bp, Mus musculus
ggaacctggagcgaattgcagttaa

SEQ ID NO: 583543 - DNA, 25 bp, Mus musculus
ggaacctggagcgacgtgccagcct

SEQ ID NO: 583544 - DNA, 25 bp, Mus musculus
ggaacctggtatattcagtcacttt

SEQ ID NO: 583545 - DNA, 25 bp, Mus musculus
ggaacctggtattttcagtcacttt

SEQ ID NO: 583546 - DNA, 25 bp, Mus musculus
ggaacctggtgcaccatccatggga

SEQ ID NO: 583547 - DNA, 25 bp, Mus musculus
ggaacctggtgctccatccatggga

SEQ ID NO: 583548 - DNA, 25 bp, Mus musculus
ggaacctgtatcctctgtaacaact

SEQ ID NO: 583549 - DNA, 25 bp, Mus musculus
ggaacctgtatcgtctgtaacaact

SEQ ID NO: 583550 - DNA, 25 bp, Mus musculus
ggaacctgtatgactttgctttgat

SEQ ID NO: 583551 - DNA, 25 bp, Mus musculus
ggaacctgtatgtctttgctttgat

SEQ ID NO: 583552 - DNA, 25 bp, Mus musculus
ggaacctgtctcaattcactaggtc

SEQ ID NO: 583553 - DNA, 25 bp, Mus musculus
ggaacctgtctctattcactaggtc

SEQ ID NO: 583554 - DNA, 25 bp, Mus musculus
ggaacctgtctgcaagtgaagcaat

SEQ ID NO: 583555 - DNA, 25 bp, Mus musculus
ggaacctgtctggaagtgaagcaat

SEQ ID NO: 583556 - DNA, 25 bp, Mus musculus
ggaacctgtgtccttgataatcact

SEQ ID NO: 583557 - DNA, 25 bp, Mus musculus
ggaacctgtgtcgttgataatcact

SEQ ID NO: 583558 - DNA, 25 bp, Mus musculus
ggaacctgttgccttttgacccaca

SEQ ID NO: 583559 - DNA, 25 bp, Mus musculus
ggaacctgttgcgttttgacccaca

SEQ ID NO: 583560 - DNA, 25 bp, Mus musculus
ggaaccttaatgctaacttgccctt

SEQ ID NO: 583561 - DNA, 25 bp, Mus musculus
ggaaccttaatggtaacttgccctt

SEQ ID NO: 583562 - DNA, 25 bp, Mus musculus
ggaaccttactcaaaagcatcccac

SEQ ID NO: 583563 - DNA, 25 bp, Mus musculus
ggaaccttactctaaagcatcccac

SEQ ID NO: 583564 - DNA, 25 bp, Mus musculus
ggaaccttaggtcatttgcctatca

SEQ ID NO: 583565 - DNA, 25 bp, Mus musculus
ggaaccttaggtgatttgcctatca

SEQ ID NO: 583566 - DNA, 25 bp, Mus musculus
ggaaccttattacagctgagtagcc

SEQ ID NO: 583567 - DNA, 25 bp, Mus musculus
ggaaccttattagagctgagtagcc

SEQ ID NO: 583568 - DNA, 25 bp, Mus musculus
ggaaccttcccactcatggaatata

SEQ ID NO: 583569 - DNA, 25 bp, Mus musculus
ggaaccttcccagtcatggaatata

SEQ ID NO: 583570 - DNA, 25 bp, Mus musculus
ggaaccttccttctgatttgcctgc

SEQ ID NO: 583571 - DNA, 25 bp, Mus musculus
ggaaccttccttgtgatttgcctgc

SEQ ID NO: 583572 - DNA, 25 bp, Mus musculus
ggaaccttctcaaacatcttcattt

SEQ ID NO: 583573 - DNA, 25 bp, Mus musculus
ggaaccttctcaaattccctataga

SEQ ID NO: 583574 - DNA, 25 bp, Mus musculus
ggaaccttctcatacatcttcattt

SEQ ID NO: 583575 - DNA, 25 bp, Mus musculus
ggaaccttctcatattccctataga

SEQ ID NO: 583576 - DNA, 25 bp, Mus musculus
ggaaccttctctatagttgccattg

SEQ ID NO: 583577 - DNA, 25 bp, Mus musculus
ggaaccttctctttagttgccattg

SEQ ID NO: 583578 - DNA, 25 bp, Mus musculus
ggaaccttcttaccaggatgcgaat

SEQ ID NO: 583579 - DNA, 25 bp, Mus musculus
ggaaccttcttagcaggatgcgaat

SEQ ID NO: 583580 - DNA, 25 bp, Mus musculus
ggaaccttgagtactgtgggcaatt

SEQ ID NO: 583581 - DNA, 25 bp, Mus musculus
ggaaccttgagttctgtgggcaatt

SEQ ID NO: 583582 - DNA, 25 bp, Mus musculus
ggaaccttgccacgctcaagaagaa

SEQ ID NO: 583583 - DNA, 25 bp, Mus musculus
ggaaccttgccaggctcaagaagaa

SEQ ID NO: 583584 - DNA, 25 bp, Mus musculus
ggaaccttgctcagtggtccctgaa

SEQ ID NO: 583585 - DNA, 25 bp, Mus musculus
ggaaccttgctcctgaatccagcaa

SEQ ID NO: 583586 - DNA, 25 bp, Mus musculus
ggaaccttgctcgtgaatccagcaa

SEQ ID NO: 583587 - DNA, 25 bp, Mus musculus
ggaaccttgctctgtggtccctgaa

SEQ ID NO: 583588 - DNA, 25 bp, Mus musculus
ggaaccttggacacaggatggtcta

SEQ ID NO: 583589 - DNA, 25 bp, Mus musculus
ggaaccttggactcaggatggtcta

SEQ ID NO: 583590 - DNA, 25 bp, Mus musculus
ggaaccttggccagaccaggctggc

SEQ ID NO: 583591 - DNA, 25 bp, Mus musculus
ggaaccttggccattgtgcagtctt

SEQ ID NO: 583592 - DNA, 25 bp, Mus musculus
ggaaccttggcctgaccaggctggc

SEQ ID NO: 583593 - DNA, 25 bp, Mus musculus
ggaaccttggcctttgtgcagtctt

SEQ ID NO: 583594 - DNA, 25 bp, Mus musculus
ggaaccttggctccaactgggttat

SEQ ID NO: 583595 - DNA, 25 bp, Mus musculus
ggaaccttggctgcaactgggttat

SEQ ID NO: 583596 - DNA, 25 bp, Mus musculus
ggaaccttgggtaatcatgtcacga

SEQ ID NO: 583597 - DNA, 25 bp, Mus musculus
ggaaccttgggttatcatgtcacga

SEQ ID NO: 583598 - DNA, 25 bp, Mus musculus
ggaaccttggttagcacactcagga

SEQ ID NO: 583599 - DNA, 25 bp, Mus musculus
ggaaccttggtttgcacactcagga

SEQ ID NO: 583600 - DNA, 25 bp, Mus musculus
ggaaccttgtatagtcttctgttaa

SEQ ID NO: 583601 - DNA, 25 bp, Mus musculus
ggaaccttgtattgtcttctgttaa

SEQ ID NO: 583602 - DNA, 25 bp, Mus musculus
ggaaccttgtgtactattatcttca

SEQ ID NO: 583603 - DNA, 25 bp, Mus musculus
ggaaccttgtgttctattatcttca

SEQ ID NO: 583604 - DNA, 25 bp, Mus musculus
ggaacctttcaaccctcataaatga

SEQ ID NO: 583605 - DNA, 25 bp, Mus musculus
ggaacctttcaagcctcataaatga

SEQ ID NO: 583606 - DNA, 25 bp, Mus musculus
ggaacctttgacaatatatgaatat

SEQ ID NO: 583607 - DNA, 25 bp, Mus musculus
ggaacctttgactatatatgaatat

SEQ ID NO: 583608 - DNA, 25 bp, Mus musculus
ggaacctttgagactgataccctag

SEQ ID NO: 583609 - DNA, 25 bp, Mus musculus
ggaacctttgagtctgataccctag

SEQ ID NO: 583610 - DNA, 25 bp, Mus musculus
ggaacctttgtaagtaatagctctc

SEQ ID NO: 583611 - DNA, 25 bp, Mus musculus
ggaacctttgtacgctttgctcaaa

SEQ ID NO: 583612 - DNA, 25 bp, Mus musculus
ggaacctttgtaggctttgctcaaa

SEQ ID NO: 583613 - DNA, 25 bp, Mus musculus
ggaacctttgtatgtaatagctctc

SEQ ID NO: 583614 - DNA, 25 bp, Mus musculus
ggaaccttttccatgaactacctgc

SEQ ID NO: 583615 - DNA, 25 bp, Mus musculus
ggaaccttttccttgaactacctgc

SEQ ID NO: 583616 - DNA, 25 bp, Mus musculus
ggaacgaacgttaatgtgaccatat

SEQ ID NO: 583617 - DNA, 25 bp, Mus musculus
ggaacgaacgtttatgtgaccatat

SEQ ID NO: 583618 - DNA, 25 bp, Mus musculus
ggaacgaaggctcctggttctacat

SEQ ID NO: 583619 - DNA, 25 bp, Mus musculus
ggaacgaaggctgctggttctacat

SEQ ID NO: 583620 - DNA, 25 bp, Mus musculus
ggaacgaattagaggagactgtctt

SEQ ID NO: 583621 - DNA, 25 bp, Mus musculus
ggaacgaattagtggagactgtctt

SEQ ID NO: 583622 - DNA, 25 bp, Mus musculus
ggaacgacgaccagagccttggaat

SEQ ID NO: 583623 - DNA, 25 bp, Mus musculus
ggaacgacgacctgagccttggaat

SEQ ID NO: 583624 - DNA, 25 bp, Mus musculus
ggaacgactgatacctggccaacag

SEQ ID NO: 583625 - DNA, 25 bp, Mus musculus
ggaacgactgattcctggccaacag

SEQ ID NO: 583626 - DNA, 25 bp, Mus musculus
ggaacgagaaaaacagctagctgca

SEQ ID NO: 583627 - DNA, 25 bp, Mus musculus
ggaacgagaaaatcagctagctgca

SEQ ID NO: 583628 - DNA, 25 bp, Mus musculus
ggaacgagaagcatctggccttgct

SEQ ID NO: 583629 - DNA, 25 bp, Mus musculus
ggaacgagaagcttctggccttgct

SEQ ID NO: 583630 - DNA, 25 bp, Mus musculus
ggaacgagacatatgtgttttcaat

SEQ ID NO: 583631 - DNA, 25 bp, Mus musculus
ggaacgagacatttgtgttttcaat

SEQ ID NO: 583632 - DNA, 25 bp, Mus musculus
ggaacgagaccacgatgatcacatc

SEQ ID NO: 583633 - DNA, 25 bp, Mus musculus
ggaacgagaccaggatgatcacatc

SEQ ID NO: 583634 - DNA, 25 bp, Mus musculus
ggaacgagagccatgcctttttatt

SEQ ID NO: 583635 - DNA, 25 bp, Mus musculus
ggaacgagagccttgcctttttatt

SEQ ID NO: 583636 - DNA, 25 bp, Mus musculus
ggaacgagctaccaatacctagatc

SEQ ID NO: 583637 - DNA, 25 bp, Mus musculus
ggaacgagctacgaatacctagatc

SEQ ID NO: 583638 - DNA, 25 bp, Mus musculus
ggaacgagctcaaggccctcaagga

SEQ ID NO: 583639 - DNA, 25 bp, Mus musculus
ggaacgagctcatggccctcaagga

SEQ ID NO: 583640 - DNA, 25 bp, Mus musculus
ggaacgagctccaatggaacataag

SEQ ID NO: 583641 - DNA, 25 bp, Mus musculus
ggaacgagctcctatggaacataag

SEQ ID NO: 583642 - DNA, 25 bp, Mus musculus
ggaacgagggtcacctgccattgtc

SEQ ID NO: 583643 - DNA, 25 bp, Mus musculus
ggaacgagggtctcctgccattgtc

SEQ ID NO: 583644 - DNA, 25 bp, Mus musculus
ggaacgatccatacagtggttttaa

SEQ ID NO: 583645 - DNA, 25 bp, Mus musculus
ggaacgatccattcagtggttttaa

SEQ ID NO: 583646 - DNA, 25 bp, Mus musculus
ggaacgatgccccatgtacaattaa

SEQ ID NO: 583647 - DNA, 25 bp, Mus musculus
ggaacgatgcccgatgtacaattaa

SEQ ID NO: 583648 - DNA, 25 bp, Mus musculus
ggaacgatgtctcatgctgatgctt

SEQ ID NO: 583649 - DNA, 25 bp, Mus musculus
ggaacgatgtctgatgctgatgctt

SEQ ID NO: 583650 - DNA, 25 bp, Mus musculus
ggaacgcaagtgactcctgcttaag

SEQ ID NO: 583651 - DNA, 25 bp, Mus musculus
ggaacgcaagtgtctcctgcttaag

SEQ ID NO: 583652 - DNA, 25 bp, Mus musculus
ggaacgcactgccaatgatgtcaca

SEQ ID NO: 583653 - DNA, 25 bp, Mus musculus
ggaacgcactgcgaatgatgtcaca

SEQ ID NO: 583654 - DNA, 25 bp, Mus musculus
ggaacgcaggctattgtgtcggttt

SEQ ID NO: 583655 - DNA, 25 bp, Mus musculus
ggaacgcaggcttttgtgtcggttt

SEQ ID NO: 583656 - DNA, 25 bp, Mus musculus
ggaacgccaagaactgacacactca

SEQ ID NO: 583657 - DNA, 25 bp, Mus musculus
ggaacgccaagatctgacacactca

SEQ ID NO: 583658 - DNA, 25 bp, Mus musculus
ggaacgccaggaacgtccaggagat

SEQ ID NO: 583659 - DNA, 25 bp, Mus musculus
ggaacgccaggatcgtccaggagat

SEQ ID NO: 583660 - DNA, 25 bp, Mus musculus
ggaacgccagtgatctctgctcaga

SEQ ID NO: 583661 - DNA, 25 bp, Mus musculus
ggaacgccagtgttctctgctcaga

SEQ ID NO: 583662 - DNA, 25 bp, Mus musculus
ggaacgccctctctctggaatgtgc

SEQ ID NO: 583663 - DNA, 25 bp, Mus musculus
ggaacgccctctgtctggaatgtgc

SEQ ID NO: 583664 - DNA, 25 bp, Mus musculus
ggaacgcctgacagtagctgatgcc

SEQ ID NO: 583665 - DNA, 25 bp, Mus musculus
ggaacgcctgactgtagctgatgcc

SEQ ID NO: 583666 - DNA, 25 bp, Mus musculus
ggaacgcctggcaattacgaaagaa

SEQ ID NO: 583667 - DNA, 25 bp, Mus musculus
ggaacgcctggctattacgaaagaa

SEQ ID NO: 583668 - DNA, 25 bp, Mus musculus
ggaacgcctgtaaaccttgcagtat

SEQ ID NO: 583669 - DNA, 25 bp, Mus musculus
ggaacgcctgtataccttgcagtat

SEQ ID NO: 583670 - DNA, 25 bp, Mus musculus
ggaacgcgagcactctaatctaata

SEQ ID NO: 583671 - DNA, 25 bp, Mus musculus
ggaacgcgagcagtctaatctaata

SEQ ID NO: 583672 - DNA, 25 bp, Mus musculus
ggaacgcgatagacgtatctctgga

SEQ ID NO: 583673 - DNA, 25 bp, Mus musculus
ggaacgcgatagtcgtatctctgga

SEQ ID NO: 583674 - DNA, 25 bp, Mus musculus
ggaacgctaattagatcctgtgttt

SEQ ID NO: 583675 - DNA, 25 bp, Mus musculus
ggaacgctaatttgatcctgtgttt

SEQ ID NO: 583676 - DNA, 25 bp, Mus musculus
ggaacgctactcaagaaaggtgttt

SEQ ID NO: 583677 - DNA, 25 bp, Mus musculus
ggaacgctactctagaaaggtgttt

SEQ ID NO: 583678 - DNA, 25 bp, Mus musculus
ggaacgctaggcatggcatcaaacc

SEQ ID NO: 583679 - DNA, 25 bp, Mus musculus
ggaacgctaggcttggcatcaaacc

SEQ ID NO: 583680 - DNA, 25 bp, Mus musculus
ggaacgctatgtcgagaatgcctca

SEQ ID NO: 583681 - DNA, 25 bp, Mus musculus
ggaacgctatgtggagaatgcctca

SEQ ID NO: 583682 - DNA, 25 bp, Mus musculus
ggaacgctcaagcaaccatgttttg

SEQ ID NO: 583683 - DNA, 25 bp, Mus musculus
ggaacgctcaaggaaccatgttttg

SEQ ID NO: 583684 - DNA, 25 bp, Mus musculus
ggaacgctcagaattcatcggtgaa

SEQ ID NO: 583685 - DNA, 25 bp, Mus musculus
ggaacgctcagatttcatcggtgaa

SEQ ID NO: 583686 - DNA, 25 bp, Mus musculus
ggaacgctctgcaaaaccacaagga

SEQ ID NO: 583687 - DNA, 25 bp, Mus musculus
ggaacgctctgctaaaccacaagga

SEQ ID NO: 583688 - DNA, 25 bp, Mus musculus
ggaacgctgaagactgggtttccca

SEQ ID NO: 583689 - DNA, 25 bp, Mus musculus
ggaacgctgaagtctgggtttccca

SEQ ID NO: 583690 - DNA, 25 bp, Mus musculus
ggaacgctgacactacagattctaa

SEQ ID NO: 583691 - DNA, 25 bp, Mus musculus
ggaacgctgacagtacagattctaa

SEQ ID NO: 583692 - DNA, 25 bp, Mus musculus
ggaacgctgcaacctgggtataaat

SEQ ID NO: 583693 - DNA, 25 bp, Mus musculus
ggaacgctgcaagctgggtataaat

SEQ ID NO: 583694 - DNA, 25 bp, Mus musculus
ggaacgctgcccctgcagttgtcac

SEQ ID NO: 583695 - DNA, 25 bp, Mus musculus
ggaacgctgcccgtgcagttgtcac

SEQ ID NO: 583696 - DNA, 25 bp, Mus musculus
ggaacgctgggaagcacacatctat

SEQ ID NO: 583697 - DNA, 25 bp, Mus musculus
ggaacgctgggatgcacacatctat

SEQ ID NO: 583698 - DNA, 25 bp, Mus musculus
ggaacgctggttctgctagcaacaa

SEQ ID NO: 583699 - DNA, 25 bp, Mus musculus
ggaacgctggttgtgctagcaacaa

SEQ ID NO: 583700 - DNA, 25 bp, Mus musculus
ggaacggaagcccacgcccattgtt

SEQ ID NO: 583701 - DNA, 25 bp, Mus musculus
ggaacggaagccgacgcccattgtt

SEQ ID NO: 583702 - DNA, 25 bp, Mus musculus
ggaacggaagtcacgtcgggcactt

SEQ ID NO: 583703 - DNA, 25 bp, Mus musculus
ggaacggaagtctcgtcgggcactt

SEQ ID NO: 583704 - DNA, 25 bp, Mus musculus
ggaacggactccaaaggcctgctga

SEQ ID NO: 583705 - DNA, 25 bp, Mus musculus
ggaacggactcctaaggcctgctga

SEQ ID NO: 583706 - DNA, 25 bp, Mus musculus
ggaacggactctaagctactcagtg

SEQ ID NO: 583707 - DNA, 25 bp, Mus musculus
ggaacggactcttagctactcagtg

SEQ ID NO: 583708 - DNA, 25 bp, Mus musculus
ggaacggactgtccactagagactt

SEQ ID NO: 583709 - DNA, 25 bp, Mus musculus
ggaacggactgtgcactagagactt

SEQ ID NO: 583710 - DNA, 25 bp, Mus musculus
ggaacggacttcaccagaatccaac

SEQ ID NO: 583711 - DNA, 25 bp, Mus musculus
ggaacggacttctccagaatccaac

SEQ ID NO: 583712 - DNA, 25 bp, Mus musculus
ggaacggagacaaaaccatcatgtt

SEQ ID NO: 583713 - DNA, 25 bp, Mus musculus
ggaacggagacataaccatcatgtt

SEQ ID NO: 583714 - DNA, 25 bp, Mus musculus
ggaacggcaagacctgtatttggat

SEQ ID NO: 583715 - DNA, 25 bp, Mus musculus
ggaacggcaagagctgtatttggat

SEQ ID NO: 583716 - DNA, 25 bp, Mus musculus
ggaacggcactgacaggaattttac

SEQ ID NO: 583717 - DNA, 25 bp, Mus musculus
ggaacggcactgtcaggaattttac

SEQ ID NO: 583718 - DNA, 25 bp, Mus musculus
ggaacggcagacctagactcacttg

SEQ ID NO: 583719 - DNA, 25 bp, Mus musculus
ggaacggcagacgtagactcacttg

SEQ ID NO: 583720 - DNA, 25 bp, Mus musculus
ggaacggccaaaagtactgccccaa

SEQ ID NO: 583721 - DNA, 25 bp, Mus musculus
ggaacggccaaatgtactgccccaa

SEQ ID NO: 583722 - DNA, 25 bp, Mus musculus
ggaacggcgacacctgatacaactt

SEQ ID NO: 583723 - DNA, 25 bp, Mus musculus
ggaacggcgacagctgatacaactt

SEQ ID NO: 583724 - DNA, 25 bp, Mus musculus
ggaacggctccaatgattactgtag

SEQ ID NO: 583725 - DNA, 25 bp, Mus musculus
ggaacggctccattgattactgtag

SEQ ID NO: 583726 - DNA, 25 bp, Mus musculus
ggaacggctgctccagcgctttgga

SEQ ID NO: 583727 - DNA, 25 bp, Mus musculus
ggaacggctgctgcagcgctttgga

SEQ ID NO: 583728 - DNA, 25 bp, Mus musculus
ggaacgggacacaggatcctaaact

SEQ ID NO: 583729 - DNA, 25 bp, Mus musculus
ggaacgggacactggatcctaaact

SEQ ID NO: 583730 - DNA, 25 bp, Mus musculus
ggaacgggagaccacacctgtgcaa

SEQ ID NO: 583731 - DNA, 25 bp, Mus musculus
ggaacgggagacgacacctgtgcaa

SEQ ID NO: 583732 - DNA, 25 bp, Mus musculus
ggaacgggcacacggtgacacacaa

SEQ ID NO: 583733 - DNA, 25 bp, Mus musculus
ggaacgggcacagggtgacacacaa

SEQ ID NO: 583734 - DNA, 25 bp, Mus musculus
ggaacgggccgaaaacgagaagcta

SEQ ID NO: 583735 - DNA, 25 bp, Mus musculus
ggaacgggccgataacgagaagcta

SEQ ID NO: 583736 - DNA, 25 bp, Mus musculus
ggaacggtatttacactcagcatat

SEQ ID NO: 583737 - DNA, 25 bp, Mus musculus
ggaacggtattttcactcagcatat

SEQ ID NO: 583738 - DNA, 25 bp, Mus musculus
ggaacggtctgcaaatgataaactc

SEQ ID NO: 583739 - DNA, 25 bp, Mus musculus
ggaacggtctgctaatgataaactc

SEQ ID NO: 583740 - DNA, 25 bp, Mus musculus
ggaacggtggtgactacactgctgc

SEQ ID NO: 583741 - DNA, 25 bp, Mus musculus
ggaacggtggtgtctacactgctgc

SEQ ID NO: 583742 - DNA, 25 bp, Mus musculus
ggaacggtgtccacatagacagcat

SEQ ID NO: 583743 - DNA, 25 bp, Mus musculus
ggaacggtgtcctcatagacagcat

SEQ ID NO: 583744 - DNA, 25 bp, Mus musculus
ggaacggttatgattgccagcgttt

SEQ ID NO: 583745 - DNA, 25 bp, Mus musculus
ggaacggttatgtttgccagcgttt

SEQ ID NO: 583746 - DNA, 25 bp, Mus musculus
ggaacgtaagacagccagccttgag

SEQ ID NO: 583747 - DNA, 25 bp, Mus musculus
ggaacgtaagactgccagccttgag

SEQ ID NO: 583748 - DNA, 25 bp, Mus musculus
ggaacgtaatcgagaatttcactcc

SEQ ID NO: 583749 - DNA, 25 bp, Mus musculus
ggaacgtaatcgtgaatttcactcc

SEQ ID NO: 583750 - DNA, 25 bp, Mus musculus
ggaacgtcaactcggacatacggca

SEQ ID NO: 583751 - DNA, 25 bp, Mus musculus
ggaacgtcaactgggacatacggca

SEQ ID NO: 583752 - DNA, 25 bp, Mus musculus
ggaacgtcatccattggtaagcgtc

SEQ ID NO: 583753 - DNA, 25 bp, Mus musculus
ggaacgtcatcctttggtaagcgtc

SEQ ID NO: 583754 - DNA, 25 bp, Mus musculus
ggaacgtcgctccaacggtcaagat

SEQ ID NO: 583755 - DNA, 25 bp, Mus musculus
ggaacgtcgctcgaacggtcaagat

SEQ ID NO: 583756 - DNA, 25 bp, Mus musculus
ggaacgtctccgaaagcatggctta

SEQ ID NO: 583757 - DNA, 25 bp, Mus musculus
ggaacgtctccgtaagcatggctta

SEQ ID NO: 583758 - DNA, 25 bp, Mus musculus
ggaacgtgacggacatggcctccat

SEQ ID NO: 583759 - DNA, 25 bp, Mus musculus
ggaacgtgacggtcatggcctccat

SEQ ID NO: 583760 - DNA, 25 bp, Mus musculus
ggaacgtgcttcaggtcacacagca

SEQ ID NO: 583761 - DNA, 25 bp, Mus musculus
ggaacgtgcttctggtcacacagca

SEQ ID NO: 583762 - DNA, 25 bp, Mus musculus
ggaacgtgcttgataggcctttgaa

SEQ ID NO: 583763 - DNA, 25 bp, Mus musculus
ggaacgtgcttgttaggcctttgaa

SEQ ID NO: 583764 - DNA, 25 bp, Mus musculus
ggaacgtgttttagggtgtcatcat

SEQ ID NO: 583765 - DNA, 25 bp, Mus musculus
ggaacgtgtttttgggtgtcatcat

SEQ ID NO: 583766 - DNA, 25 bp, Mus musculus
ggaacgttcaccagtatcttgaata

SEQ ID NO: 583767 - DNA, 25 bp, Mus musculus
ggaacgttcacctgtatcttgaata

SEQ ID NO: 583768 - DNA, 25 bp, Mus musculus
ggaacgttcataactcagcaaactg

SEQ ID NO: 583769 - DNA, 25 bp, Mus musculus
ggaacgttcatatctcagcaaactg

SEQ ID NO: 583770 - DNA, 25 bp, Mus musculus
ggaacgttcgctcaaagcttaatta

SEQ ID NO: 583771 - DNA, 25 bp, Mus musculus
ggaacgttcgctgaaagcttaatta

SEQ ID NO: 583772 - DNA, 25 bp, Mus musculus
ggaacgttctaaatctatgcaaaca

SEQ ID NO: 583773 - DNA, 25 bp, Mus musculus
ggaacgttctaattctatgcaaaca

SEQ ID NO: 583774 - DNA, 25 bp, Mus musculus
ggaacgttgtaaatgcctgtccaac

SEQ ID NO: 583775 - DNA, 25 bp, Mus musculus
ggaacgttgtaattgcctgtccaac

SEQ ID NO: 583776 - DNA, 25 bp, Mus musculus
ggaacgtttcaaaaactgtactgtt

SEQ ID NO: 583777 - DNA, 25 bp, Mus musculus
ggaacgtttcaataactgtactgtt

SEQ ID NO: 583778 - DNA, 25 bp, Mus musculus
ggaacgtttgctctaaagccaggga

SEQ ID NO: 583779 - DNA, 25 bp, Mus musculus
ggaacgtttgctgtaaagccaggga

SEQ ID NO: 583780 - DNA, 25 bp, Mus musculus
ggaacgttttaaagggacacagcat

SEQ ID NO: 583781 - DNA, 25 bp, Mus musculus
ggaacgttttaatgggacacagcat

SEQ ID NO: 583782 - DNA, 25 bp, Mus musculus
ggaacgttttacatcatcctagaat

SEQ ID NO: 583783 - DNA, 25 bp, Mus musculus
ggaacgttttacttcatcctagaat

SEQ ID NO: 583784 - DNA, 25 bp, Mus musculus
ggaacgtttttgctagtactctata

SEQ ID NO: 583785 - DNA, 25 bp, Mus musculus
ggaacgtttttggtagtactctata

SEQ ID NO: 583786 - DNA, 25 bp, Mus musculus
ggaactaaacctcctccagtgtttc

SEQ ID NO: 583787 - DNA, 25 bp, Mus musculus
ggaactaaacctgctccagtgtttc

SEQ ID NO: 583788 - DNA, 25 bp, Mus musculus
ggaactaaagcaatagcttagctat

SEQ ID NO: 583789 - DNA, 25 bp, Mus musculus
ggaactaaagcattagcttagctat

SEQ ID NO: 583790 - DNA, 25 bp, Mus musculus
ggaactaaatatccctatgtactta

SEQ ID NO: 583791 - DNA, 25 bp, Mus musculus
ggaactaaatatgcctatgtactta

SEQ ID NO: 583792 - DNA, 25 bp, Mus musculus
ggaactaaatttagctgtgaaggct

SEQ ID NO: 583793 - DNA, 25 bp, Mus musculus
ggaactaaattttgctgtgaaggct

SEQ ID NO: 583794 - DNA, 25 bp, Mus musculus
ggaactaacagtctccgtgggaaca

SEQ ID NO: 583795 - DNA, 25 bp, Mus musculus
ggaactaacagtgtccgtgggaaca

SEQ ID NO: 583796 - DNA, 25 bp, Mus musculus
ggaactaacattcctccagacgagc

SEQ ID NO: 583797 - DNA, 25 bp, Mus musculus
ggaactaacattgctccagacgagc

SEQ ID NO: 583798 - DNA, 25 bp, Mus musculus
ggaactaaccatctttatctgtaac

SEQ ID NO: 583799 - DNA, 25 bp, Mus musculus
ggaactaaccatgtttatctgtaac

SEQ ID NO: 583800 - DNA, 25 bp, Mus musculus
ggaactaactagcaccatcagtctc

SEQ ID NO: 583801 - DNA, 25 bp, Mus musculus
ggaactaactaggaccatcagtctc

SEQ ID NO: 583802 - DNA, 25 bp, Mus musculus
ggaactaactatctgttgcctgcat

SEQ ID NO: 583803 - DNA, 25 bp, Mus musculus
ggaactaactatgtgttgcctgcat

SEQ ID NO: 583804 - DNA, 25 bp, Mus musculus
ggaactaactgccttcactttccag

SEQ ID NO: 583805 - DNA, 25 bp, Mus musculus
ggaactaactgcgttcactttccag

SEQ ID NO: 583806 - DNA, 25 bp, Mus musculus
ggaactaagaacaaactaccatctg

SEQ ID NO: 583807 - DNA, 25 bp, Mus musculus
ggaactaagaactaactaccatctg

SEQ ID NO: 583808 - DNA, 25 bp, Mus musculus
ggaactaagatgaggctgccatgcc

SEQ ID NO: 583809 - DNA, 25 bp, Mus musculus
ggaactaagatgtggctgccatgcc

SEQ ID NO: 583810 - DNA, 25 bp, Mus musculus
ggaactaagattcatcctctgttaa

SEQ ID NO: 583811 - DNA, 25 bp, Mus musculus
ggaactaagattgatcctctgttaa

SEQ ID NO: 583812 - DNA, 25 bp, Mus musculus
ggaactaaggatccctacccagcaa

SEQ ID NO: 583813 - DNA, 25 bp, Mus musculus
ggaactaaggatgcctacccagcaa

SEQ ID NO: 583814 - DNA, 25 bp, Mus musculus
ggaactaagtcccaccggcattaca

SEQ ID NO: 583815 - DNA, 25 bp, Mus musculus
ggaactaagtccgaccggcattaca

SEQ ID NO: 583816 - DNA, 25 bp, Mus musculus
ggaactaatcatctccaccatagtg

SEQ ID NO: 583817 - DNA, 25 bp, Mus musculus
ggaactaatcatgtccaccatagtg

SEQ ID NO: 583818 - DNA, 25 bp, Mus musculus
ggaactacaagcactttatgcacta

SEQ ID NO: 583819 - DNA, 25 bp, Mus musculus
ggaactacaagctctttatgcacta

SEQ ID NO: 583820 - DNA, 25 bp, Mus musculus
ggaactacacctatgggatccggtt

SEQ ID NO: 583821 - DNA, 25 bp, Mus musculus
ggaactacacctttgggatccggtt

SEQ ID NO: 583822 - DNA, 25 bp, Mus musculus
ggaactacagacatagctgacgtca

SEQ ID NO: 583823 - DNA, 25 bp, Mus musculus
ggaactacagacttagctgacgtca

SEQ ID NO: 583824 - DNA, 25 bp, Mus musculus
ggaactacagatctttgcctagctt

SEQ ID NO: 583825 - DNA, 25 bp, Mus musculus
ggaactacagatgtttgcctagctt

SEQ ID NO: 583826 - DNA, 25 bp, Mus musculus
ggaactacagccatggctttcttca

SEQ ID NO: 583827 - DNA, 25 bp, Mus musculus
ggaactacagccttggctttcttca

SEQ ID NO: 583828 - DNA, 25 bp, Mus musculus
ggaactacaggaatgttccctccac

SEQ ID NO: 583829 - DNA, 25 bp, Mus musculus
ggaactacaggattgttccctccac

SEQ ID NO: 583830 - DNA, 25 bp, Mus musculus
ggaactacagttcccttactgggct

SEQ ID NO: 583831 - DNA, 25 bp, Mus musculus
ggaactacagttgccttactgggct

SEQ ID NO: 583832 - DNA, 25 bp, Mus musculus
ggaactacatggcaaaccgatggaa

SEQ ID NO: 583833 - DNA, 25 bp, Mus musculus
ggaactacatgggaaaccgatggaa

SEQ ID NO: 583834 - DNA, 25 bp, Mus musculus
ggaactaccttcacactgcagaaag

SEQ ID NO: 583835 - DNA, 25 bp, Mus musculus
ggaactaccttctcactgcagaaag

SEQ ID NO: 583836 - DNA, 25 bp, Mus musculus
ggaactaccttgactcttacagaag

SEQ ID NO: 583837 - DNA, 25 bp, Mus musculus
ggaactaccttgtctcttacagaag

SEQ ID NO: 583838 - DNA, 25 bp, Mus musculus
ggaactacgagacggccgctacatt

SEQ ID NO: 583839 - DNA, 25 bp, Mus musculus
ggaactacgagagggccgctacatt

SEQ ID NO: 583840 - DNA, 25 bp, Mus musculus
ggaactacgggcctgaggaaggatt

SEQ ID NO: 583841 - DNA, 25 bp, Mus musculus
ggaactacgggcgtgaggaaggatt

SEQ ID NO: 583842 - DNA, 25 bp, Mus musculus
ggaactacgtggatgctctgtcaat

SEQ ID NO: 583843 - DNA, 25 bp, Mus musculus
ggaactacgtggttgctctgtcaat

SEQ ID NO: 583844 - DNA, 25 bp, Mus musculus
ggaactactagtatgtgtatgtgac

SEQ ID NO: 583845 - DNA, 25 bp, Mus musculus
ggaactactagtttgtgtatgtgac

SEQ ID NO: 583846 - DNA, 25 bp, Mus musculus
ggaactactattagcttgattgcga

SEQ ID NO: 583847 - DNA, 25 bp, Mus musculus
ggaactactatttgcttgattgcga

SEQ ID NO: 583848 - DNA, 25 bp, Mus musculus
ggaactactccaacaataggcaaag

SEQ ID NO: 583849 - DNA, 25 bp, Mus musculus
ggaactactccatcaataggcaaag

SEQ ID NO: 583850 - DNA, 25 bp, Mus musculus
ggaactacttccaaatctttctgta

SEQ ID NO: 583851 - DNA, 25 bp, Mus musculus
ggaactacttccaatcagaccagag

SEQ ID NO: 583852 - DNA, 25 bp, Mus musculus
ggaactacttcctaatctttctgta

SEQ ID NO: 583853 - DNA, 25 bp, Mus musculus
ggaactacttcctatcagaccagag

SEQ ID NO: 583854 - DNA, 25 bp, Mus musculus
ggaactacttttccattttccaaag

SEQ ID NO: 583855 - DNA, 25 bp, Mus musculus
ggaactacttttgcattttccaaag

SEQ ID NO: 583856 - DNA, 25 bp, Mus musculus
ggaactagagagacgcctgcaagaa

SEQ ID NO: 583857 - DNA, 25 bp, Mus musculus
ggaactagagagtcgcctgcaagaa

SEQ ID NO: 583858 - DNA, 25 bp, Mus musculus
ggaactagagcaagcacacccagat

SEQ ID NO: 583859 - DNA, 25 bp, Mus musculus
ggaactagagcatgcacacccagat

SEQ ID NO: 583860 - DNA, 25 bp, Mus musculus
ggaactagagcgaatcccactcagc

SEQ ID NO: 583861 - DNA, 25 bp, Mus musculus
ggaactagagcgtatcccactcagc

SEQ ID NO: 583862 - DNA, 25 bp, Mus musculus
ggaactagaggaacactccgtgcac

SEQ ID NO: 583863 - DNA, 25 bp, Mus musculus
ggaactagaggatcactccgtgcac

SEQ ID NO: 583864 - DNA, 25 bp, Mus musculus
ggaactagatagagtcatcgtacag

SEQ ID NO: 583865 - DNA, 25 bp, Mus musculus
ggaactagatagtgtcatcgtacag

SEQ ID NO: 583866 - DNA, 25 bp, Mus musculus
ggaactagatcaaatgccaaatgta

SEQ ID NO: 583867 - DNA, 25 bp, Mus musculus
ggaactagatcatatgccaaatgta

SEQ ID NO: 583868 - DNA, 25 bp, Mus musculus
ggaactagcaacagcttcggaccgt

SEQ ID NO: 583869 - DNA, 25 bp, Mus musculus
ggaactagcaactgcttcggaccgt

SEQ ID NO: 583870 - DNA, 25 bp, Mus musculus
ggaactagcctaccattcagaaatg

SEQ ID NO: 583871 - DNA, 25 bp, Mus musculus
ggaactagcctagcattcagaaatg

SEQ ID NO: 583872 - DNA, 25 bp, Mus musculus
ggaactagctcaacttctcggtttc

SEQ ID NO: 583873 - DNA, 25 bp, Mus musculus
ggaactagctcatcttctcggtttc

SEQ ID NO: 583874 - DNA, 25 bp, Mus musculus
ggaactagggccacagagaccagcc

SEQ ID NO: 583875 - DNA, 25 bp, Mus musculus
ggaactagggcctcagagaccagcc

SEQ ID NO: 583876 - DNA, 25 bp, Mus musculus
ggaactagtccccacagcaacgaat

SEQ ID NO: 583877 - DNA, 25 bp, Mus musculus
ggaactagtcccgacagcaacgaat

SEQ ID NO: 583878 - DNA, 25 bp, Mus musculus
ggaactagtcctctccatctggtgt

SEQ ID NO: 583879 - DNA, 25 bp, Mus musculus
ggaactagtcctgtccatctggtgt

SEQ ID NO: 583880 - DNA, 25 bp, Mus musculus
ggaactagtgccagtggcagccaga

SEQ ID NO: 583881 - DNA, 25 bp, Mus musculus
ggaactagtgcctgtggcagccaga

SEQ ID NO: 583882 - DNA, 25 bp, Mus musculus
ggaactagtgtcctccctataaagg

SEQ ID NO: 583883 - DNA, 25 bp, Mus musculus
ggaactagtgtcgtccctataaagg

SEQ ID NO: 583884 - DNA, 25 bp, Mus musculus
ggaactataaaccagcaccacctag

SEQ ID NO: 583885 - DNA, 25 bp, Mus musculus
ggaactataaacgagcaccacctag

SEQ ID NO: 583886 - DNA, 25 bp, Mus musculus
ggaactataccaagaaaccctgagc

SEQ ID NO: 583887 - DNA, 25 bp, Mus musculus
ggaactataccatgaaaccctgagc

SEQ ID NO: 583888 - DNA, 25 bp, Mus musculus
ggaactatacctccaaccaagctgg

SEQ ID NO: 583889 - DNA, 25 bp, Mus musculus
ggaactatacctgcaaccaagctgg

SEQ ID NO: 583890 - DNA, 25 bp, Mus musculus
ggaactataggcatgtaccaccaag

SEQ ID NO: 583891 - DNA, 25 bp, Mus musculus
ggaactataggcttgtaccaccaag

SEQ ID NO: 583892 - DNA, 25 bp, Mus musculus
ggaactatatcaaggacttccaagt

SEQ ID NO: 583893 - DNA, 25 bp, Mus musculus
ggaactatatcaagttggccacact

SEQ ID NO: 583894 - DNA, 25 bp, Mus musculus
ggaactatatcatggacttccaagt

SEQ ID NO: 583895 - DNA, 25 bp, Mus musculus
ggaactatatcatgttggccacact

SEQ ID NO: 583896 - DNA, 25 bp, Mus musculus
ggaactatatccatcgtggtctgtg

SEQ ID NO: 583897 - DNA, 25 bp, Mus musculus
ggaactatatccttcgtggtctgtg

SEQ ID NO: 583898 - DNA, 25 bp, Mus musculus
ggaactatcatgaaacaggagagaa

SEQ ID NO: 583899 - DNA, 25 bp, Mus musculus
ggaactatcatgtaacaggagagaa

SEQ ID NO: 583900 - DNA, 25 bp, Mus musculus
ggaactatccatatccatcctttta

SEQ ID NO: 583901 - DNA, 25 bp, Mus musculus
ggaactatccatttccatcctttta

SEQ ID NO: 583902 - DNA, 25 bp, Mus musculus
ggaactatcccacggtttattcagt

SEQ ID NO: 583903 - DNA, 25 bp, Mus musculus
ggaactatcccagggtttattcagt

SEQ ID NO: 583904 - DNA, 25 bp, Mus musculus
ggaactatccccagtgtgttctctg

SEQ ID NO: 583905 - DNA, 25 bp, Mus musculus
ggaactatcccctgtgtgttctctg

SEQ ID NO: 583906 - DNA, 25 bp, Mus musculus
ggaactatctgaagactttcttagc

SEQ ID NO: 583907 - DNA, 25 bp, Mus musculus
ggaactatctgatgactttcttagc

SEQ ID NO: 583908 - DNA, 25 bp, Mus musculus
ggaactatcttcctaattatgtttc

SEQ ID NO: 583909 - DNA, 25 bp, Mus musculus
ggaactatcttcgtaattatgtttc

SEQ ID NO: 583910 - DNA, 25 bp, Mus musculus
ggaactatgcaaacacaggccctga

SEQ ID NO: 583911 - DNA, 25 bp, Mus musculus
ggaactatgcaatcacaggccctga

SEQ ID NO: 583912 - DNA, 25 bp, Mus musculus
ggaactatgtgcacattacatgtac

SEQ ID NO: 583913 - DNA, 25 bp, Mus musculus
ggaactatgtgctcattacatgtac

SEQ ID NO: 583914 - DNA, 25 bp, Mus musculus
ggaactatgttgcacgaggccacaa

SEQ ID NO: 583915 - DNA, 25 bp, Mus musculus
ggaactatgttggacgaggccacaa

SEQ ID NO: 583916 - DNA, 25 bp, Mus musculus
ggaactatgtttcactttgcagtac

SEQ ID NO: 583917 - DNA, 25 bp, Mus musculus
ggaactatgtttgactttgcagtac

SEQ ID NO: 583918 - DNA, 25 bp, Mus musculus
ggaactattcctattagcaatgtga

SEQ ID NO: 583919 - DNA, 25 bp, Mus musculus
ggaactattccttttagcaatgtga

SEQ ID NO: 583920 - DNA, 25 bp, Mus musculus
ggaactattcttaactcattttagc

SEQ ID NO: 583921 - DNA, 25 bp, Mus musculus
ggaactattctttactcattttagc

SEQ ID NO: 583922 - DNA, 25 bp, Mus musculus
ggaactatttatactttagtgcgtt

SEQ ID NO: 583923 - DNA, 25 bp, Mus musculus
ggaactatttattctttagtgcgtt

SEQ ID NO: 583924 - DNA, 25 bp, Mus musculus
ggaactattttaacacaagcgagca

SEQ ID NO: 583925 - DNA, 25 bp, Mus musculus
ggaactattttatcacaagcgagca

SEQ ID NO: 583926 - DNA, 25 bp, Mus musculus
ggaactattttcagactatcctgga

SEQ ID NO: 583927 - DNA, 25 bp, Mus musculus
ggaactattttctgactatcctgga

SEQ ID NO: 583928 - DNA, 25 bp, Mus musculus
ggaactattttgattctggtgtata

SEQ ID NO: 583929 - DNA, 25 bp, Mus musculus
ggaactattttgtttctggtgtata

SEQ ID NO: 583930 - DNA, 25 bp, Mus musculus
ggaactatttttaaactagctgtag

SEQ ID NO: 583931 - DNA, 25 bp, Mus musculus
ggaactattttttaactagctgtag

SEQ ID NO: 583932 - DNA, 25 bp, Mus musculus
ggaactcaaactcccacaggagcgt

SEQ ID NO: 583933 - DNA, 25 bp, Mus musculus
ggaactcaaactgccacaggagcgt

SEQ ID NO: 583934 - DNA, 25 bp, Mus musculus
ggaactcaaatgacttcgccaacat

SEQ ID NO: 583935 - DNA, 25 bp, Mus musculus
ggaactcaaatgtcttcgccaacat

SEQ ID NO: 583936 - DNA, 25 bp, Mus musculus
ggaactcaaattcgccccaggtagt

SEQ ID NO: 583937 - DNA, 25 bp, Mus musculus
ggaactcaaattggccccaggtagt

SEQ ID NO: 583938 - DNA, 25 bp, Mus musculus
ggaactcaacatcaagtcgtgcttt

SEQ ID NO: 583939 - DNA, 25 bp, Mus musculus
ggaactcaacatgaagtcgtgcttt

SEQ ID NO: 583940 - DNA, 25 bp, Mus musculus
ggaactcaagccaagagggtcccta

SEQ ID NO: 583941 - DNA, 25 bp, Mus musculus
ggaactcaagcctagagggtcccta

SEQ ID NO: 583942 - DNA, 25 bp, Mus musculus
ggaactcaagtaaggtcctcctcca

SEQ ID NO: 583943 - DNA, 25 bp, Mus musculus
ggaactcaagtatggtcctcctcca

SEQ ID NO: 583944 - DNA, 25 bp, Mus musculus
ggaactcaagtcacctgctttgctt

SEQ ID NO: 583945 - DNA, 25 bp, Mus musculus
ggaactcaagtctcctgctttgctt

SEQ ID NO: 583946 - DNA, 25 bp, Mus musculus
ggaactcaatcactagatgcccaga

SEQ ID NO: 583947 - DNA, 25 bp, Mus musculus
ggaactcaatcagtagatgcccaga

SEQ ID NO: 583948 - DNA, 25 bp, Mus musculus
ggaactcaatgacagcctcgccaca

SEQ ID NO: 583949 - DNA, 25 bp, Mus musculus
ggaactcaatgagagcctcgccaca

SEQ ID NO: 583950 - DNA, 25 bp, Mus musculus
ggaactcacaacatcaaactcacaa

SEQ ID NO: 583951 - DNA, 25 bp, Mus musculus
ggaactcacaacttcaaactcacaa

SEQ ID NO: 583952 - DNA, 25 bp, Mus musculus
ggaactcacacaactcatggagcat

SEQ ID NO: 583953 - DNA, 25 bp, Mus musculus
ggaactcacacatctcatggagcat

SEQ ID NO: 583954 - DNA, 25 bp, Mus musculus
ggaactcacacgacatcttccagta

SEQ ID NO: 583955 - DNA, 25 bp, Mus musculus
ggaactcacacgtcatcttccagta

SEQ ID NO: 583956 - DNA, 25 bp, Mus musculus
ggaactcacactatcaagctttgca

SEQ ID NO: 583957 - DNA, 25 bp, Mus musculus
ggaactcacactctagacctcacaa

SEQ ID NO: 583958 - DNA, 25 bp, Mus musculus
ggaactcacactgtagacctcacaa

SEQ ID NO: 583959 - DNA, 25 bp, Mus musculus
ggaactcacactttcaagctttgca

SEQ ID NO: 583960 - DNA, 25 bp, Mus musculus
ggaactcaccgacaagctgggtcta

SEQ ID NO: 583961 - DNA, 25 bp, Mus musculus
ggaactcaccgagaagctgggtcta

SEQ ID NO: 583962 - DNA, 25 bp, Mus musculus
ggaactcactacaagactaagctgg

SEQ ID NO: 583963 - DNA, 25 bp, Mus musculus
ggaactcactactagactaagctgg

SEQ ID NO: 583964 - DNA, 25 bp, Mus musculus
ggaactcactcacaaatttgtcatt

SEQ ID NO: 583965 - DNA, 25 bp, Mus musculus
ggaactcactcagaaatttgtcatt

SEQ ID NO: 583966 - DNA, 25 bp, Mus musculus
ggaactcactctaaagtaccctctt

SEQ ID NO: 583967 - DNA, 25 bp, Mus musculus
ggaactcactctcccgatcaggtcg

SEQ ID NO: 583968 - DNA, 25 bp, Mus musculus
ggaactcactctgccgatcaggtcg

SEQ ID NO: 583969 - DNA, 25 bp, Mus musculus
ggaactcactcttaagtaccctctt

SEQ ID NO: 583970 - DNA, 25 bp, Mus musculus
ggaactcagaacctacctggagaaa

SEQ ID NO: 583971 - DNA, 25 bp, Mus musculus
ggaactcagaacgtacctggagaaa

SEQ ID NO: 583972 - DNA, 25 bp, Mus musculus
ggaactcagcacatgacacacattc

SEQ ID NO: 583973 - DNA, 25 bp, Mus musculus
ggaactcagcacttgacacacattc

SEQ ID NO: 583974 - DNA, 25 bp, Mus musculus
ggaactcagcgaacatgtctgccca

SEQ ID NO: 583975 - DNA, 25 bp, Mus musculus
ggaactcagcgatcatgtctgccca

SEQ ID NO: 583976 - DNA, 25 bp, Mus musculus
ggaactcagcggaagagaccccaaa

SEQ ID NO: 583977 - DNA, 25 bp, Mus musculus
ggaactcagcggtagagaccccaaa

SEQ ID NO: 583978 - DNA, 25 bp, Mus musculus
ggaactcagcgtaggaatacgcaaa

SEQ ID NO: 583979 - DNA, 25 bp, Mus musculus
ggaactcagcgttggaatacgcaaa

SEQ ID NO: 583980 - DNA, 25 bp, Mus musculus
ggaactcagggcatcactcccagag

SEQ ID NO: 583981 - DNA, 25 bp, Mus musculus
ggaactcagggcttcactcccagag

SEQ ID NO: 583982 - DNA, 25 bp, Mus musculus
ggaactcaggttagatgcggaatct

SEQ ID NO: 583983 - DNA, 25 bp, Mus musculus
ggaactcaggtttgatgcggaatct

SEQ ID NO: 583984 - DNA, 25 bp, Mus musculus
ggaactcagtccaaacagatacatc

SEQ ID NO: 583985 - DNA, 25 bp, Mus musculus
ggaactcagtcctaacagatacatc

SEQ ID NO: 583986 - DNA, 25 bp, Mus musculus
ggaactcatacacatggtactaata

SEQ ID NO: 583987 - DNA, 25 bp, Mus musculus
ggaactcatacagatggtactaata

SEQ ID NO: 583988 - DNA, 25 bp, Mus musculus
ggaactcatcggacaggcacacgaa

SEQ ID NO: 583989 - DNA, 25 bp, Mus musculus
ggaactcatcggtcaggcacacgaa

SEQ ID NO: 583990 - DNA, 25 bp, Mus musculus
ggaactcatgaaccagccactggac

SEQ ID NO: 583991 - DNA, 25 bp, Mus musculus
ggaactcatgaagcagccactggac

SEQ ID NO: 583992 - DNA, 25 bp, Mus musculus
ggaactcatggacatctatcggcct

SEQ ID NO: 583993 - DNA, 25 bp, Mus musculus
ggaactcatggagatctatcggcct

SEQ ID NO: 583994 - DNA, 25 bp, Mus musculus
ggaactcatggcactgattgcacag

SEQ ID NO: 583995 - DNA, 25 bp, Mus musculus
ggaactcatggctctgattgcacag

SEQ ID NO: 583996 - DNA, 25 bp, Mus musculus
ggaactcatgtcacaaaacagggaa

SEQ ID NO: 583997 - DNA, 25 bp, Mus musculus
ggaactcatgtctcaaaacagggaa

SEQ ID NO: 583998 - DNA, 25 bp, Mus musculus
ggaactcattcgaatttagtactac

SEQ ID NO: 583999 - DNA, 25 bp, Mus musculus
ggaactcattcgtatttagtactac

SEQ ID NO: 584000 - DNA, 25 bp, Mus musculus
ggaactcattttatggctgtctgaa

SEQ ID NO: 584001 - DNA, 25 bp, Mus musculus
ggaactcattttttggctgtctgaa

SEQ ID NO: 584002 - DNA, 25 bp, Mus musculus
ggaactccaacgagaatgaagtcca

SEQ ID NO: 584003 - DNA, 25 bp, Mus musculus
ggaactccaacgtgaatgaagtcca

SEQ ID NO: 584004 - DNA, 25 bp, Mus musculus
ggaactccaagaagaactcagacag

SEQ ID NO: 584005 - DNA, 25 bp, Mus musculus
ggaactccaagatgaactcagacag

SEQ ID NO: 584006 - DNA, 25 bp, Mus musculus
ggaactccaaggactgcctaactaa

SEQ ID NO: 584007 - DNA, 25 bp, Mus musculus
ggaactccaaggtctgcctaactaa

SEQ ID NO: 584008 - DNA, 25 bp, Mus musculus
ggaactccacagcatgcctgttagt

SEQ ID NO: 584009 - DNA, 25 bp, Mus musculus
ggaactccacaggatgcctgttagt

SEQ ID NO: 584010 - DNA, 25 bp, Mus musculus
ggaactccagagatccctgttgcag

SEQ ID NO: 584011 - DNA, 25 bp, Mus musculus
ggaactccagagttccctgttgcag

SEQ ID NO: 584012 - DNA, 25 bp, Mus musculus
ggaactccaggcacatttgggaaag

SEQ ID NO: 584013 - DNA, 25 bp, Mus musculus
ggaactccaggctcatttgggaaag

SEQ ID NO: 584014 - DNA, 25 bp, Mus musculus
ggaactccagggactaattccaatt

SEQ ID NO: 584015 - DNA, 25 bp, Mus musculus
ggaactccagggtctaattccaatt

SEQ ID NO: 584016 - DNA, 25 bp, Mus musculus
ggaactccaggtagatcaggctctc

SEQ ID NO: 584017 - DNA, 25 bp, Mus musculus
ggaactccaggttgatcaggctctc

SEQ ID NO: 584018 - DNA, 25 bp, Mus musculus
ggaactcccagtagcacttaaatta

SEQ ID NO: 584019 - DNA, 25 bp, Mus musculus
ggaactcccagttgcacttaaatta

SEQ ID NO: 584020 - DNA, 25 bp, Mus musculus
ggaactcccctgagattgcagtaaa

SEQ ID NO: 584021 - DNA, 25 bp, Mus musculus
ggaactcccctgtgattgcagtaaa

SEQ ID NO: 584022 - DNA, 25 bp, Mus musculus
ggaactccggatctagactagccta

SEQ ID NO: 584023 - DNA, 25 bp, Mus musculus
ggaactccggatgtagactagccta

SEQ ID NO: 584024 - DNA, 25 bp, Mus musculus
ggaactcctaacattgtcctccaga

SEQ ID NO: 584025 - DNA, 25 bp, Mus musculus
ggaactcctaactttgtcctccaga

SEQ ID NO: 584026 - DNA, 25 bp, Mus musculus
ggaactcctccaattagagtcttct

SEQ ID NO: 584027 - DNA, 25 bp, Mus musculus
ggaactcctccatttagagtcttct

SEQ ID NO: 584028 - DNA, 25 bp, Mus musculus
ggaactcctgacagtaagccactga

SEQ ID NO: 584029 - DNA, 25 bp, Mus musculus
ggaactcctgactgtaagccactga

SEQ ID NO: 584030 - DNA, 25 bp, Mus musculus
ggaactcctgcaacaacagctatgg

SEQ ID NO: 584031 - DNA, 25 bp, Mus musculus
ggaactcctgcatcaacagctatgg

SEQ ID NO: 584032 - DNA, 25 bp, Mus musculus
ggaactcctggtattgttctacaga

SEQ ID NO: 584033 - DNA, 25 bp, Mus musculus
ggaactcctggttttgttctacaga

SEQ ID NO: 584034 - DNA, 25 bp, Mus musculus
ggaactccttacagtctctgaacga

SEQ ID NO: 584035 - DNA, 25 bp, Mus musculus
ggaactccttactgtctctgaacga

SEQ ID NO: 584036 - DNA, 25 bp, Mus musculus
ggaactccttcaatctacgtggaat

SEQ ID NO: 584037 - DNA, 25 bp, Mus musculus
ggaactccttcattctacgtggaat

SEQ ID NO: 584038 - DNA, 25 bp, Mus musculus
ggaactcctttgagattcccgaaca

SEQ ID NO: 584039 - DNA, 25 bp, Mus musculus
ggaactcctttgtgattcccgaaca

SEQ ID NO: 584040 - DNA, 25 bp, Mus musculus
ggaactcgacaaaagttatcctctg

SEQ ID NO: 584041 - DNA, 25 bp, Mus musculus
ggaactcgacaatagttatcctctg

SEQ ID NO: 584042 - DNA, 25 bp, Mus musculus
ggaactcgacaccttaaatcagcag

SEQ ID NO: 584043 - DNA, 25 bp, Mus musculus
ggaactcgacacgttaaatcagcag

SEQ ID NO: 584044 - DNA, 25 bp, Mus musculus
ggaactcgagagcttttactgtgat

SEQ ID NO: 584045 - DNA, 25 bp, Mus musculus
ggaactcgagaggttttactgtgat

SEQ ID NO: 584046 - DNA, 25 bp, Mus musculus
ggaactcgatctctgcatcctcaga

SEQ ID NO: 584047 - DNA, 25 bp, Mus musculus
ggaactcgatctgtgcatcctcaga

SEQ ID NO: 584048 - DNA, 25 bp, Mus musculus
ggaactcgcagaccctgcaggacta

SEQ ID NO: 584049 - DNA, 25 bp, Mus musculus
ggaactcgcagagcctgcaggacta

SEQ ID NO: 584050 - DNA, 25 bp, Mus musculus
ggaactcgccacacttatctggagc

SEQ ID NO: 584051 - DNA, 25 bp, Mus musculus
ggaactcgccactcttatctggagc

SEQ ID NO: 584052 - DNA, 25 bp, Mus musculus
ggaactcgccctccttgaagaaggg

SEQ ID NO: 584053 - DNA, 25 bp, Mus musculus
ggaactcgccctgcttgaagaaggg

SEQ ID NO: 584054 - DNA, 25 bp, Mus musculus
ggaactcggcgacggaagccctctt

SEQ ID NO: 584055 - DNA, 25 bp, Mus musculus
ggaactcggcgagggaagccctctt

SEQ ID NO: 584056 - DNA, 25 bp, Mus musculus
ggaactcggtatcctaaacagtgca

SEQ ID NO: 584057 - DNA, 25 bp, Mus musculus
ggaactcggtatgctaaacagtgca

SEQ ID NO: 584058 - DNA, 25 bp, Mus musculus
ggaactcgtataagacatgcacatt

SEQ ID NO: 584059 - DNA, 25 bp, Mus musculus
ggaactcgtatatgacatgcacatt

SEQ ID NO: 584060 - DNA, 25 bp, Mus musculus
ggaactcgttccattcattatgact

SEQ ID NO: 584061 - DNA, 25 bp, Mus musculus
ggaactcgttcctttcattatgact

SEQ ID NO: 584062 - DNA, 25 bp, Mus musculus
ggaactctaaacagctccagcaagg

SEQ ID NO: 584063 - DNA, 25 bp, Mus musculus
ggaactctaaactgctccagcaagg

SEQ ID NO: 584064 - DNA, 25 bp, Mus musculus
ggaactctacaccatggacaaatgc

SEQ ID NO: 584065 - DNA, 25 bp, Mus musculus
ggaactctacacgatggacaaatgc

SEQ ID NO: 584066 - DNA, 25 bp, Mus musculus
ggaactctaccacgaactcaaccag

SEQ ID NO: 584067 - DNA, 25 bp, Mus musculus
ggaactctaccaggaactcaaccag

SEQ ID NO: 584068 - DNA, 25 bp, Mus musculus
ggaactctatggcaatgtcaacgaa

SEQ ID NO: 584069 - DNA, 25 bp, Mus musculus
ggaactctatgggaatgtcaacgaa

SEQ ID NO: 584070 - DNA, 25 bp, Mus musculus
ggaactctcaacattggtgggatca

SEQ ID NO: 584071 - DNA, 25 bp, Mus musculus
ggaactctcaactttggtgggatca

SEQ ID NO: 584072 - DNA, 25 bp, Mus musculus
ggaactctcacccaaaacatcatga

SEQ ID NO: 584073 - DNA, 25 bp, Mus musculus
ggaactctcaccgaaaacatcatga

SEQ ID NO: 584074 - DNA, 25 bp, Mus musculus
ggaactctcatgcataaactcaata

SEQ ID NO: 584075 - DNA, 25 bp, Mus musculus
ggaactctcatggataaactcaata

SEQ ID NO: 584076 - DNA, 25 bp, Mus musculus
ggaactctctagcatcccaaataga

SEQ ID NO: 584077 - DNA, 25 bp, Mus musculus
ggaactctctaggatcccaaataga

SEQ ID NO: 584078 - DNA, 25 bp, Mus musculus
ggaactctctgcatactttatttct

SEQ ID NO: 584079 - DNA, 25 bp, Mus musculus
ggaactctctgcttactttatttct

SEQ ID NO: 584080 - DNA, 25 bp, Mus musculus
ggaactctgagacctattcacaata

SEQ ID NO: 584081 - DNA, 25 bp, Mus musculus
ggaactctgagagctattcacaata

SEQ ID NO: 584082 - DNA, 25 bp, Mus musculus
ggaactctgagtctagccaactctg

SEQ ID NO: 584083 - DNA, 25 bp, Mus musculus
ggaactctgagtgtagccaactctg

SEQ ID NO: 584084 - DNA, 25 bp, Mus musculus
ggaactctgatcaggtgtcgaggct

SEQ ID NO: 584085 - DNA, 25 bp, Mus musculus
ggaactctgatctggtgtcgaggct

SEQ ID NO: 584086 - DNA, 25 bp, Mus musculus
ggaactctgatgctatatatacatg

SEQ ID NO: 584087 - DNA, 25 bp, Mus musculus
ggaactctgatggtatatatacatg

SEQ ID NO: 584088 - DNA, 25 bp, Mus musculus
ggaactctgcaaacaactgcatgcg

SEQ ID NO: 584089 - DNA, 25 bp, Mus musculus
ggaactctgcaactttctcttgatt

SEQ ID NO: 584090 - DNA, 25 bp, Mus musculus
ggaactctgcaagtttctcttgatt

SEQ ID NO: 584091 - DNA, 25 bp, Mus musculus
ggaactctgcaatcaactgcatgcg

SEQ ID NO: 584092 - DNA, 25 bp, Mus musculus
ggaactctgctaaagtggacccaga

SEQ ID NO: 584093 - DNA, 25 bp, Mus musculus
ggaactctgctatagtggacccaga

SEQ ID NO: 584094 - DNA, 25 bp, Mus musculus
ggaactctgctcctggtgttacagt

SEQ ID NO: 584095 - DNA, 25 bp, Mus musculus
ggaactctgctcgtggtgttacagt

SEQ ID NO: 584096 - DNA, 25 bp, Mus musculus
ggaactctgctgaagtgttgctgaa

SEQ ID NO: 584097 - DNA, 25 bp, Mus musculus
ggaactctgctgtagtgttgctgaa

SEQ ID NO: 584098 - DNA, 25 bp, Mus musculus
ggaactctggaactccctaggttct

SEQ ID NO: 584099 - DNA, 25 bp, Mus musculus
ggaactctggaagtccctaggttct

SEQ ID NO: 584100 - DNA, 25 bp, Mus musculus
ggaactctggatagactggtcagtt

SEQ ID NO: 584101 - DNA, 25 bp, Mus musculus
ggaactctggattgactggtcagtt

SEQ ID NO: 584102 - DNA, 25 bp, Mus musculus
ggaactctgggaaaccttgtaccaa

SEQ ID NO: 584103 - DNA, 25 bp, Mus musculus
ggaactctgggataccttgtaccaa

SEQ ID NO: 584104 - DNA, 25 bp, Mus musculus
ggaactctgggtaacatccttcctt

SEQ ID NO: 584105 - DNA, 25 bp, Mus musculus
ggaactctgggttacatccttcctt

SEQ ID NO: 584106 - DNA, 25 bp, Mus musculus
ggaactctggttctgatatcataac

SEQ ID NO: 584107 - DNA, 25 bp, Mus musculus
ggaactctggttgtgatatcataac

SEQ ID NO: 584108 - DNA, 25 bp, Mus musculus
ggaactctgtagagccgtgatcatg

SEQ ID NO: 584109 - DNA, 25 bp, Mus musculus
ggaactctgtagtgccgtgatcatg

SEQ ID NO: 584110 - DNA, 25 bp, Mus musculus
ggaactctgtataaggccatatttt

SEQ ID NO: 584111 - DNA, 25 bp, Mus musculus
ggaactctgtataccatactaggct

SEQ ID NO: 584112 - DNA, 25 bp, Mus musculus
ggaactctgtattaggccatatttt

SEQ ID NO: 584113 - DNA, 25 bp, Mus musculus
ggaactctgtattccatactaggct

SEQ ID NO: 584114 - DNA, 25 bp, Mus musculus
ggaactctgtcgcacaccgcaggtg

SEQ ID NO: 584115 - DNA, 25 bp, Mus musculus
ggaactctgtcggacaccgcaggtg

SEQ ID NO: 584116 - DNA, 25 bp, Mus musculus
ggaactctgtctatgcagccatgga

SEQ ID NO: 584117 - DNA, 25 bp, Mus musculus
ggaactctgtctttgcagccatgga

SEQ ID NO: 584118 - DNA, 25 bp, Mus musculus
ggaactctgtttaatctatgcgact

SEQ ID NO: 584119 - DNA, 25 bp, Mus musculus
ggaactctgttttatctatgcgact

SEQ ID NO: 584120 - DNA, 25 bp, Mus musculus
ggaactcttataaactgaattttag

SEQ ID NO: 584121 - DNA, 25 bp, Mus musculus
ggaactcttataaccacccatggct

SEQ ID NO: 584122 - DNA, 25 bp, Mus musculus
ggaactcttatatactgaattttag

SEQ ID NO: 584123 - DNA, 25 bp, Mus musculus
ggaactcttatatccacccatggct

SEQ ID NO: 584124 - DNA, 25 bp, Mus musculus
ggaactcttatcacagaaatctgat

SEQ ID NO: 584125 - DNA, 25 bp, Mus musculus
ggaactcttatctcagaaatctgat

SEQ ID NO: 584126 - DNA, 25 bp, Mus musculus
ggaactcttatgacctgctttgtgc

SEQ ID NO: 584127 - DNA, 25 bp, Mus musculus
ggaactcttatgtcctgctttgtgc

SEQ ID NO: 584128 - DNA, 25 bp, Mus musculus
ggaactcttcaaaggaaccagcatg

SEQ ID NO: 584129 - DNA, 25 bp, Mus musculus
ggaactcttcaatggaaccagcatg

SEQ ID NO: 584130 - DNA, 25 bp, Mus musculus
ggaactcttcccctttggtgagatt

SEQ ID NO: 584131 - DNA, 25 bp, Mus musculus
ggaactcttcccgtttggtgagatt

SEQ ID NO: 584132 - DNA, 25 bp, Mus musculus
ggaactcttgttccctgtttgtaca

SEQ ID NO: 584133 - DNA, 25 bp, Mus musculus
ggaactcttgttgcctgtttgtaca

SEQ ID NO: 584134 - DNA, 25 bp, Mus musculus
ggaactctttgtctttttacagtga

SEQ ID NO: 584135 - DNA, 25 bp, Mus musculus
ggaactctttgtgtttttacagtga

SEQ ID NO: 584136 - DNA, 25 bp, Mus musculus
ggaactgaaatccacctgtctggca

SEQ ID NO: 584137 - DNA, 25 bp, Mus musculus
ggaactgaaatcctggaacctgact

SEQ ID NO: 584138 - DNA, 25 bp, Mus musculus
ggaactgaaatcgacctgtctggca

SEQ ID NO: 584139 - DNA, 25 bp, Mus musculus
ggaactgaaatcgtggaacctgact

SEQ ID NO: 584140 - DNA, 25 bp, Mus musculus
ggaactgaaatgactaactcaccaa

SEQ ID NO: 584141 - DNA, 25 bp, Mus musculus
ggaactgaaatgtctaactcaccaa

SEQ ID NO: 584142 - DNA, 25 bp, Mus musculus
ggaactgaacggacacttccagtgg

SEQ ID NO: 584143 - DNA, 25 bp, Mus musculus
ggaactgaacggtcacttccagtgg

SEQ ID NO: 584144 - DNA, 25 bp, Mus musculus
ggaactgaagccacaaccaatcatg

SEQ ID NO: 584145 - DNA, 25 bp, Mus musculus
ggaactgaagcctcaaccaatcatg

SEQ ID NO: 584146 - DNA, 25 bp, Mus musculus
ggaactgaagtgattccctggacag

SEQ ID NO: 584147 - DNA, 25 bp, Mus musculus
ggaactgaagtgtttccctggacag

SEQ ID NO: 584148 - DNA, 25 bp, Mus musculus
ggaactgaatccaggacctctccaa

SEQ ID NO: 584149 - DNA, 25 bp, Mus musculus
ggaactgaatcctggacctctccaa

SEQ ID NO: 584150 - DNA, 25 bp, Mus musculus
ggaactgaatgaagtgtctcttata

SEQ ID NO: 584151 - DNA, 25 bp, Mus musculus
ggaactgaatgatgtgtctcttata

SEQ ID NO: 584152 - DNA, 25 bp, Mus musculus
ggaactgacaagaacaccactggat

SEQ ID NO: 584153 - DNA, 25 bp, Mus musculus
ggaactgacaagtacaccactggat

SEQ ID NO: 584154 - DNA, 25 bp, Mus musculus
ggaactgacacacgtttatggcaca

SEQ ID NO: 584155 - DNA, 25 bp, Mus musculus
ggaactgacacaggtttatggcaca

SEQ ID NO: 584156 - DNA, 25 bp, Mus musculus
ggaactgacatgctcagctcttttc

SEQ ID NO: 584157 - DNA, 25 bp, Mus musculus
ggaactgacatggtcagctcttttc

SEQ ID NO: 584158 - DNA, 25 bp, Mus musculus
ggaactgacggccagcagacagtcc

SEQ ID NO: 584159 - DNA, 25 bp, Mus musculus
ggaactgacggcgagcagacagtcc

SEQ ID NO: 584160 - DNA, 25 bp, Mus musculus
ggaactgactgcacaaccatgtcaa

SEQ ID NO: 584161 - DNA, 25 bp, Mus musculus
ggaactgactgctcaaccatgtcaa

SEQ ID NO: 584162 - DNA, 25 bp, Mus musculus
ggaactgagccaaccacacgatgaa

SEQ ID NO: 584163 - DNA, 25 bp, Mus musculus
ggaactgagccatccacacgatgaa

SEQ ID NO: 584164 - DNA, 25 bp, Mus musculus
ggaactgagcctagcccataaaacc

SEQ ID NO: 584165 - DNA, 25 bp, Mus musculus
ggaactgagccttgcccataaaacc

SEQ ID NO: 584166 - DNA, 25 bp, Mus musculus
ggaactgagcttacaggaggagcca

SEQ ID NO: 584167 - DNA, 25 bp, Mus musculus
ggaactgagctttcaggaggagcca

SEQ ID NO: 584168 - DNA, 25 bp, Mus musculus
ggaactgaggctacgcaattactac

SEQ ID NO: 584169 - DNA, 25 bp, Mus musculus
ggaactgaggcttcgcaattactac

SEQ ID NO: 584170 - DNA, 25 bp, Mus musculus
ggaactgaggttactccccgcagat

SEQ ID NO: 584171 - DNA, 25 bp, Mus musculus
ggaactgaggtttctccccgcagat

SEQ ID NO: 584172 - DNA, 25 bp, Mus musculus
ggaactgagtttctccagggagcaa

SEQ ID NO: 584173 - DNA, 25 bp, Mus musculus
ggaactgagtttgtccagggagcaa

SEQ ID NO: 584174 - DNA, 25 bp, Mus musculus
ggaactgatcctaacagaagcactg

SEQ ID NO: 584175 - DNA, 25 bp, Mus musculus
ggaactgatccttacagaagcactg

SEQ ID NO: 584176 - DNA, 25 bp, Mus musculus
ggaactgatggcagctcacaagact

SEQ ID NO: 584177 - DNA, 25 bp, Mus musculus
ggaactgatggctgctcacaagact

SEQ ID NO: 584178 - DNA, 25 bp, Mus musculus
ggaactgattctaagctacaacaaa

SEQ ID NO: 584179 - DNA, 25 bp, Mus musculus
ggaactgattcttagctacaacaaa

SEQ ID NO: 584180 - DNA, 25 bp, Mus musculus
ggaactgattgactctaaccatgat

SEQ ID NO: 584181 - DNA, 25 bp, Mus musculus
ggaactgattgagtctaaccatgat

SEQ ID NO: 584182 - DNA, 25 bp, Mus musculus
ggaactgatttgagaccccgagact

SEQ ID NO: 584183 - DNA, 25 bp, Mus musculus
ggaactgatttgtgaccccgagact

SEQ ID NO: 584184 - DNA, 25 bp, Mus musculus
ggaactgcaagaacaaatactgtgt

SEQ ID NO: 584185 - DNA, 25 bp, Mus musculus
ggaactgcaagatcaaatactgtgt

SEQ ID NO: 584186 - DNA, 25 bp, Mus musculus
ggaactgcaatcacattcatcaata

SEQ ID NO: 584187 - DNA, 25 bp, Mus musculus
ggaactgcaatctcattcatcaata

SEQ ID NO: 584188 - DNA, 25 bp, Mus musculus
ggaactgcacacatgtggtacatag

SEQ ID NO: 584189 - DNA, 25 bp, Mus musculus
ggaactgcacacttgtggtacatag

SEQ ID NO: 584190 - DNA, 25 bp, Mus musculus
ggaactgcactaattgctggccttt

SEQ ID NO: 584191 - DNA, 25 bp, Mus musculus
ggaactgcactatttgctggccttt

SEQ ID NO: 584192 - DNA, 25 bp, Mus musculus
ggaactgcagaacatcagctcaccc

SEQ ID NO: 584193 - DNA, 25 bp, Mus musculus
ggaactgcagaagatcagctcaccc

SEQ ID NO: 584194 - DNA, 25 bp, Mus musculus
ggaactgcagttctctggcaagaac

SEQ ID NO: 584195 - DNA, 25 bp, Mus musculus
ggaactgcagttgtctggcaagaac

SEQ ID NO: 584196 - DNA, 25 bp, Mus musculus
ggaactgcatccaggcatttttctt

SEQ ID NO: 584197 - DNA, 25 bp, Mus musculus
ggaactgcatcctggcatttttctt

SEQ ID NO: 584198 - DNA, 25 bp, Mus musculus
ggaactgccaggagacggagaatct

SEQ ID NO: 584199 - DNA, 25 bp, Mus musculus
ggaactgccaggtgacggagaatct

SEQ ID NO: 584200 - DNA, 25 bp, Mus musculus
ggaactgccagtctttcccaaaaca

SEQ ID NO: 584201 - DNA, 25 bp, Mus musculus
ggaactgccagtgtttcccaaaaca

SEQ ID NO: 584202 - DNA, 25 bp, Mus musculus
ggaactgcccgtcaacctgtaggca

SEQ ID NO: 584203 - DNA, 25 bp, Mus musculus
ggaactgcccgtgaacctgtaggca

SEQ ID NO: 584204 - DNA, 25 bp, Mus musculus
ggaactgccctgacttattttagtg

SEQ ID NO: 584205 - DNA, 25 bp, Mus musculus
ggaactgccctgtcttattttagtg

SEQ ID NO: 584206 - DNA, 25 bp, Mus musculus
ggaactgccgtacccttaacagaca

SEQ ID NO: 584207 - DNA, 25 bp, Mus musculus
ggaactgccgtagccttaacagaca

SEQ ID NO: 584208 - DNA, 25 bp, Mus musculus
ggaactgccttcatgataccaaacg

SEQ ID NO: 584209 - DNA, 25 bp, Mus musculus
ggaactgccttcttgataccaaacg

SEQ ID NO: 584210 - DNA, 25 bp, Mus musculus
ggaactgcctttactgaagaccatt

SEQ ID NO: 584211 - DNA, 25 bp, Mus musculus
ggaactgccttttctgaagaccatt

SEQ ID NO: 584212 - DNA, 25 bp, Mus musculus
ggaactgcgcagactttcaagtggc

SEQ ID NO: 584213 - DNA, 25 bp, Mus musculus
ggaactgcgcagtctttcaagtggc

SEQ ID NO: 584214 - DNA, 25 bp, Mus musculus
ggaactgcgcatccgcaagctctgc

SEQ ID NO: 584215 - DNA, 25 bp, Mus musculus
ggaactgcgcatgcgcaagctctgc

SEQ ID NO: 584216 - DNA, 25 bp, Mus musculus
ggaactgcgttcaggtacttagaga

SEQ ID NO: 584217 - DNA, 25 bp, Mus musculus
ggaactgcgttctggtacttagaga

SEQ ID NO: 584218 - DNA, 25 bp, Mus musculus
ggaactgctcatcaagagccttgca

SEQ ID NO: 584219 - DNA, 25 bp, Mus musculus
ggaactgctcatgaagagccttgca

SEQ ID NO: 584220 - DNA, 25 bp, Mus musculus
ggaactgctccacaaatatgcaagt

SEQ ID NO: 584221 - DNA, 25 bp, Mus musculus
ggaactgctccacctggtaagcgta

SEQ ID NO: 584222 - DNA, 25 bp, Mus musculus
ggaactgctccagaaatatgcaagt

SEQ ID NO: 584223 - DNA, 25 bp, Mus musculus
ggaactgctccagctggtaagcgta

SEQ ID NO: 584224 - DNA, 25 bp, Mus musculus
ggaactgctcccagagtagagtgag

SEQ ID NO: 584225 - DNA, 25 bp, Mus musculus
ggaactgctccctgagtagagtgag

SEQ ID NO: 584226 - DNA, 25 bp, Mus musculus
ggaactgctcgacaagaaggcttgt

SEQ ID NO: 584227 - DNA, 25 bp, Mus musculus
ggaactgctcgagaagaaggcttgt

SEQ ID NO: 584228 - DNA, 25 bp, Mus musculus
ggaactgctctcaagtggaaactca

SEQ ID NO: 584229 - DNA, 25 bp, Mus musculus
ggaactgctctctagtggaaactca

SEQ ID NO: 584230 - DNA, 25 bp, Mus musculus
ggaactgctctgagcactgaggcca

SEQ ID NO: 584231 - DNA, 25 bp, Mus musculus
ggaactgctctgtgcactgaggcca

SEQ ID NO: 584232 - DNA, 25 bp, Mus musculus
ggaactgctcttacagaatgccaga

SEQ ID NO: 584233 - DNA, 25 bp, Mus musculus
ggaactgctctttcagaatgccaga

SEQ ID NO: 584234 - DNA, 25 bp, Mus musculus
ggaactgctgatactgctggtgaaa

SEQ ID NO: 584235 - DNA, 25 bp, Mus musculus
ggaactgctgattctgctggtgaaa

SEQ ID NO: 584236 - DNA, 25 bp, Mus musculus
ggaactgctggaaattctcttgctt

SEQ ID NO: 584237 - DNA, 25 bp, Mus musculus
ggaactgctggatattctcttgctt

SEQ ID NO: 584238 - DNA, 25 bp, Mus musculus
ggaactgctgtcctatggatccctc

SEQ ID NO: 584239 - DNA, 25 bp, Mus musculus
ggaactgctgtcgtatggatccctc

SEQ ID NO: 584240 - DNA, 25 bp, Mus musculus
ggaactgctgttactatcagacact

SEQ ID NO: 584241 - DNA, 25 bp, Mus musculus
ggaactgctgtttctatcagacact

SEQ ID NO: 584242 - DNA, 25 bp, Mus musculus
ggaactgctttcctttaggttagag

SEQ ID NO: 584243 - DNA, 25 bp, Mus musculus
ggaactgctttcgtttaggttagag

SEQ ID NO: 584244 - DNA, 25 bp, Mus musculus
ggaactgcttttcactggaagatag

SEQ ID NO: 584245 - DNA, 25 bp, Mus musculus
ggaactgcttttgactggaagatag

SEQ ID NO: 584246 - DNA, 25 bp, Mus musculus
ggaactggaaacacaagctgtgcta

SEQ ID NO: 584247 - DNA, 25 bp, Mus musculus
ggaactggaaaccttgaagcagcaa

SEQ ID NO: 584248 - DNA, 25 bp, Mus musculus
ggaactggaaacgttgaagcagcaa

SEQ ID NO: 584249 - DNA, 25 bp, Mus musculus
ggaactggaaactcaagctgtgcta

SEQ ID NO: 584250 - DNA, 25 bp, Mus musculus
ggaactggaagtccaatcttgtaaa

SEQ ID NO: 584251 - DNA, 25 bp, Mus musculus
ggaactggaagtgcaatcttgtaaa

SEQ ID NO: 584252 - DNA, 25 bp, Mus musculus
ggaactggaattaggtctggcttat

SEQ ID NO: 584253 - DNA, 25 bp, Mus musculus
ggaactggaatttggtctggcttat

SEQ ID NO: 584254 - DNA, 25 bp, Mus musculus
ggaactggaccaccggacgcacttc

SEQ ID NO: 584255 - DNA, 25 bp, Mus musculus
ggaactggaccagcggacgcacttc

SEQ ID NO: 584256 - DNA, 25 bp, Mus musculus
ggaactggagatacgggcgtcattt

SEQ ID NO: 584257 - DNA, 25 bp, Mus musculus
ggaactggagattcgggcgtcattt

SEQ ID NO: 584258 - DNA, 25 bp, Mus musculus
ggaactggaggacgccacatcttac

SEQ ID NO: 584259 - DNA, 25 bp, Mus musculus
ggaactggaggaggccacatcttac

SEQ ID NO: 584260 - DNA, 25 bp, Mus musculus
ggaactggagttcccaaaggcccag

SEQ ID NO: 584261 - DNA, 25 bp, Mus musculus
ggaactggagttgccaaaggcccag

SEQ ID NO: 584262 - DNA, 25 bp, Mus musculus
ggaactggattcatatctttgtcat

SEQ ID NO: 584263 - DNA, 25 bp, Mus musculus
ggaactggattcttatctttgtcat

SEQ ID NO: 584264 - DNA, 25 bp, Mus musculus
ggaactggcaagagtgacctctagt

SEQ ID NO: 584265 - DNA, 25 bp, Mus musculus
ggaactggcaagtgtgacctctagt

SEQ ID NO: 584266 - DNA, 25 bp, Mus musculus
ggaactggcaatcaaacttatgtat

SEQ ID NO: 584267 - DNA, 25 bp, Mus musculus
ggaactggcaatgaaacttatgtat

SEQ ID NO: 584268 - DNA, 25 bp, Mus musculus
ggaactggccacctccaataatatt

SEQ ID NO: 584269 - DNA, 25 bp, Mus musculus
ggaactggccacgtccaataatatt

SEQ ID NO: 584270 - DNA, 25 bp, Mus musculus
ggaactggccatcacttttccacat

SEQ ID NO: 584271 - DNA, 25 bp, Mus musculus
ggaactggccatgacttttccacat

SEQ ID NO: 584272 - DNA, 25 bp, Mus musculus
ggaactggccggatatctgatgtca

SEQ ID NO: 584273 - DNA, 25 bp, Mus musculus
ggaactggccggttatctgatgtca

SEQ ID NO: 584274 - DNA, 25 bp, Mus musculus
ggaactgggaataaccgcacccact

SEQ ID NO: 584275 - DNA, 25 bp, Mus musculus
ggaactgggaatcaaccggcatctc

SEQ ID NO: 584276 - DNA, 25 bp, Mus musculus
ggaactgggaatgaaccggcatctc

SEQ ID NO: 584277 - DNA, 25 bp, Mus musculus
ggaactgggaattaccgcacccact

SEQ ID NO: 584278 - DNA, 25 bp, Mus musculus
ggaactgggcaacctctttgagacc

SEQ ID NO: 584279 - DNA, 25 bp, Mus musculus
ggaactgggcaagctctttgagacc

SEQ ID NO: 584280 - DNA, 25 bp, Mus musculus
ggaactgggctgacgctcagaagta

SEQ ID NO: 584281 - DNA, 25 bp, Mus musculus
ggaactgggctgtcgctcagaagta

SEQ ID NO: 584282 - DNA, 25 bp, Mus musculus
ggaactgggtttctgcttaaatctt

SEQ ID NO: 584283 - DNA, 25 bp, Mus musculus
ggaactgggtttgtgcttaaatctt

SEQ ID NO: 584284 - DNA, 25 bp, Mus musculus
ggaactggtaggacacctcacccac

SEQ ID NO: 584285 - DNA, 25 bp, Mus musculus
ggaactggtaggtcacctcacccac

SEQ ID NO: 584286 - DNA, 25 bp, Mus musculus
ggaactggtctcacagtccaggatc

SEQ ID NO: 584287 - DNA, 25 bp, Mus musculus
ggaactggtctccatttgagacaga

SEQ ID NO: 584288 - DNA, 25 bp, Mus musculus
ggaactggtctcgatttgagacaga

SEQ ID NO: 584289 - DNA, 25 bp, Mus musculus
ggaactggtctctcagtccaggatc

SEQ ID NO: 584290 - DNA, 25 bp, Mus musculus
ggaactggtcttatacattgtgaac

SEQ ID NO: 584291 - DNA, 25 bp, Mus musculus
ggaactggtcttttacattgtgaac

SEQ ID NO: 584292 - DNA, 25 bp, Mus musculus
ggaactggtgcaagtatttttcaaa

SEQ ID NO: 584293 - DNA, 25 bp, Mus musculus
ggaactggtgcatgtatttttcaaa

SEQ ID NO: 584294 - DNA, 25 bp, Mus musculus
ggaactggtggccttatacactagc

SEQ ID NO: 584295 - DNA, 25 bp, Mus musculus
ggaactggtggcgttatacactagc

SEQ ID NO: 584296 - DNA, 25 bp, Mus musculus
ggaactggtgttaatactggcatat

SEQ ID NO: 584297 - DNA, 25 bp, Mus musculus
ggaactggtgtttatactggcatat

SEQ ID NO: 584298 - DNA, 25 bp, Mus musculus
ggaactggttagcatcggcctagat

SEQ ID NO: 584299 - DNA, 25 bp, Mus musculus
ggaactggttaggatcggcctagat

SEQ ID NO: 584300 - DNA, 25 bp, Mus musculus
ggaactggttcacggtcacactgct

SEQ ID NO: 584301 - DNA, 25 bp, Mus musculus
ggaactggttcagggtcacactgct

SEQ ID NO: 584302 - DNA, 25 bp, Mus musculus
ggaactgtaatgaacaaatgtcagg

SEQ ID NO: 584303 - DNA, 25 bp, Mus musculus
ggaactgtaatgtacaaatgtcagg

SEQ ID NO: 584304 - DNA, 25 bp, Mus musculus
ggaactgtacaaagtagcccctcta

SEQ ID NO: 584305 - DNA, 25 bp, Mus musculus
ggaactgtacaatgtagcccctcta

SEQ ID NO: 584306 - DNA, 25 bp, Mus musculus
ggaactgtacacaccttagttactt

SEQ ID NO: 584307 - DNA, 25 bp, Mus musculus
ggaactgtacactccttagttactt

SEQ ID NO: 584308 - DNA, 25 bp, Mus musculus
ggaactgtagctcccaatatgaaga

SEQ ID NO: 584309 - DNA, 25 bp, Mus musculus
ggaactgtagctgccaatatgaaga

SEQ ID NO: 584310 - DNA, 25 bp, Mus musculus
ggaactgtatctcacaaacttttga

SEQ ID NO: 584311 - DNA, 25 bp, Mus musculus
ggaactgtatctgacaaacttttga

SEQ ID NO: 584312 - DNA, 25 bp, Mus musculus
ggaactgtcaatctgtgctttcttc

SEQ ID NO: 584313 - DNA, 25 bp, Mus musculus
ggaactgtcaatgtgtgctttcttc

SEQ ID NO: 584314 - DNA, 25 bp, Mus musculus
ggaactgtcagcatgcactttcttt

SEQ ID NO: 584315 - DNA, 25 bp, Mus musculus
ggaactgtcagcttgcactttcttt

SEQ ID NO: 584316 - DNA, 25 bp, Mus musculus
ggaactgtcatcaccttagggatgt

SEQ ID NO: 584317 - DNA, 25 bp, Mus musculus
ggaactgtcatctccttagggatgt

SEQ ID NO: 584318 - DNA, 25 bp, Mus musculus
ggaactgtcatgaattacgttatca

SEQ ID NO: 584319 - DNA, 25 bp, Mus musculus
ggaactgtcatgacatttctgtgac

SEQ ID NO: 584320 - DNA, 25 bp, Mus musculus
ggaactgtcatgtattacgttatca

SEQ ID NO: 584321 - DNA, 25 bp, Mus musculus
ggaactgtcatgtcatttctgtgac

SEQ ID NO: 584322 - DNA, 25 bp, Mus musculus
ggaactgtcctgatcatcctcactg

SEQ ID NO: 584323 - DNA, 25 bp, Mus musculus
ggaactgtcctgatttagactggag

SEQ ID NO: 584324 - DNA, 25 bp, Mus musculus
ggaactgtcctgttcatcctcactg

SEQ ID NO: 584325 - DNA, 25 bp, Mus musculus
ggaactgtcctgttttagactggag

SEQ ID NO: 584326 - DNA, 25 bp, Mus musculus
ggaactgtccttagcatttggcagc

SEQ ID NO: 584327 - DNA, 25 bp, Mus musculus
ggaactgtcctttgcatttggcagc

SEQ ID NO: 584328 - DNA, 25 bp, Mus musculus
ggaactgtcgttaagagctgcaact

SEQ ID NO: 584329 - DNA, 25 bp, Mus musculus
ggaactgtcgttcctgaggtataga

SEQ ID NO: 584330 - DNA, 25 bp, Mus musculus
ggaactgtcgttgctgaggtataga

SEQ ID NO: 584331 - DNA, 25 bp, Mus musculus
ggaactgtcgtttagagctgcaact

SEQ ID NO: 584332 - DNA, 25 bp, Mus musculus
ggaactgtctctacaatcattattt

SEQ ID NO: 584333 - DNA, 25 bp, Mus musculus
ggaactgtctctacagtccagccag

SEQ ID NO: 584334 - DNA, 25 bp, Mus musculus
ggaactgtctcttcaatcattattt

SEQ ID NO: 584335 - DNA, 25 bp, Mus musculus
ggaactgtctcttcagtccagccag

SEQ ID NO: 584336 - DNA, 25 bp, Mus musculus
ggaactgtcttgaaagtcttttagc

SEQ ID NO: 584337 - DNA, 25 bp, Mus musculus
ggaactgtcttgtaagtcttttagc

SEQ ID NO: 584338 - DNA, 25 bp, Mus musculus
ggaactgtgaccctcttaacaatca

SEQ ID NO: 584339 - DNA, 25 bp, Mus musculus
ggaactgtgaccgtcttaacaatca

SEQ ID NO: 584340 - DNA, 25 bp, Mus musculus
ggaactgtgattataagacctggaa

SEQ ID NO: 584341 - DNA, 25 bp, Mus musculus
ggaactgtgattttaagacctggaa

SEQ ID NO: 584342 - DNA, 25 bp, Mus musculus
ggaactgtgcaaattggttattagc

SEQ ID NO: 584343 - DNA, 25 bp, Mus musculus
ggaactgtgcaatttggttattagc

SEQ ID NO: 584344 - DNA, 25 bp, Mus musculus
ggaactgtgccaccgcttgcagcga

SEQ ID NO: 584345 - DNA, 25 bp, Mus musculus
ggaactgtgccagcgcttgcagcga

SEQ ID NO: 584346 - DNA, 25 bp, Mus musculus
ggaactgtgcgtaacaactttgaaa

SEQ ID NO: 584347 - DNA, 25 bp, Mus musculus
ggaactgtgcgttacaactttgaaa

SEQ ID NO: 584348 - DNA, 25 bp, Mus musculus
ggaactgtgctgaggtgtgaccaat

SEQ ID NO: 584349 - DNA, 25 bp, Mus musculus
ggaactgtgctgtggtgtgaccaat

SEQ ID NO: 584350 - DNA, 25 bp, Mus musculus
ggaactgtggctcacatgagacact

SEQ ID NO: 584351 - DNA, 25 bp, Mus musculus
ggaactgtggctgacatgagacact

SEQ ID NO: 584352 - DNA, 25 bp, Mus musculus
ggaactgtgggcatctgagcattga

SEQ ID NO: 584353 - DNA, 25 bp, Mus musculus
ggaactgtgggcttctgagcattga

SEQ ID NO: 584354 - DNA, 25 bp, Mus musculus
ggaactgtggttattacgatattat

SEQ ID NO: 584355 - DNA, 25 bp, Mus musculus
ggaactgtggtttttacgatattat

SEQ ID NO: 584356 - DNA, 25 bp, Mus musculus
ggaactgttcagagctcgccctatg

SEQ ID NO: 584357 - DNA, 25 bp, Mus musculus
ggaactgttcagatgtcccatgttt

SEQ ID NO: 584358 - DNA, 25 bp, Mus musculus
ggaactgttcagtgctcgccctatg

SEQ ID NO: 584359 - DNA, 25 bp, Mus musculus
ggaactgttcagttgtcccatgttt

SEQ ID NO: 584360 - DNA, 25 bp, Mus musculus
ggaactgttcatatggtgacttgtt

SEQ ID NO: 584361 - DNA, 25 bp, Mus musculus
ggaactgttcatcagccagaaactg

SEQ ID NO: 584362 - DNA, 25 bp, Mus musculus
ggaactgttcatgagccagaaactg

SEQ ID NO: 584363 - DNA, 25 bp, Mus musculus
ggaactgttcatttggtgacttgtt

SEQ ID NO: 584364 - DNA, 25 bp, Mus musculus
ggaactgttcccaaacgatggagct

SEQ ID NO: 584365 - DNA, 25 bp, Mus musculus
ggaactgttcccctcaactggcttc

SEQ ID NO: 584366 - DNA, 25 bp, Mus musculus
ggaactgttcccgtcaactggcttc

SEQ ID NO: 584367 - DNA, 25 bp, Mus musculus
ggaactgttccctaacgatggagct

SEQ ID NO: 584368 - DNA, 25 bp, Mus musculus
ggaactgttgaaacgctgccaatat

SEQ ID NO: 584369 - DNA, 25 bp, Mus musculus
ggaactgttgaatcgctgccaatat

SEQ ID NO: 584370 - DNA, 25 bp, Mus musculus
ggaactgttgagctctgtactcttt

SEQ ID NO: 584371 - DNA, 25 bp, Mus musculus
ggaactgttgaggtctgtactcttt

SEQ ID NO: 584372 - DNA, 25 bp, Mus musculus
ggaactgttttgattgtacccaaag

SEQ ID NO: 584373 - DNA, 25 bp, Mus musculus
ggaactgttttgtttgtacccaaag

SEQ ID NO: 584374 - DNA, 25 bp, Mus musculus
ggaacttaaaacagtgccaagccat

SEQ ID NO: 584375 - DNA, 25 bp, Mus musculus
ggaacttaaaactgtgccaagccat

SEQ ID NO: 584376 - DNA, 25 bp, Mus musculus
ggaacttaaccaccctacatggtgg

SEQ ID NO: 584377 - DNA, 25 bp, Mus musculus
ggaacttaaccagcctacatggtgg

SEQ ID NO: 584378 - DNA, 25 bp, Mus musculus
ggaacttaacctaaataatgtcact

SEQ ID NO: 584379 - DNA, 25 bp, Mus musculus
ggaacttaacctaggcgtcgcacaa

SEQ ID NO: 584380 - DNA, 25 bp, Mus musculus
ggaacttaaccttaataatgtcact

SEQ ID NO: 584381 - DNA, 25 bp, Mus musculus
ggaacttaaccttggcgtcgcacaa

SEQ ID NO: 584382 - DNA, 25 bp, Mus musculus
ggaacttaagacaaactcacagaat

SEQ ID NO: 584383 - DNA, 25 bp, Mus musculus
ggaacttaagactaactcacagaat

SEQ ID NO: 584384 - DNA, 25 bp, Mus musculus
ggaacttaatgaaatctacctacct

SEQ ID NO: 584385 - DNA, 25 bp, Mus musculus
ggaacttaatgatatctacctacct

SEQ ID NO: 584386 - DNA, 25 bp, Mus musculus
ggaacttacccaatagcaatcatct

SEQ ID NO: 584387 - DNA, 25 bp, Mus musculus
ggaacttacccattagcaatcatct

SEQ ID NO: 584388 - DNA, 25 bp, Mus musculus
ggaacttacctaccagactgaggaa

SEQ ID NO: 584389 - DNA, 25 bp, Mus musculus
ggaacttacctagcagactgaggaa

SEQ ID NO: 584390 - DNA, 25 bp, Mus musculus
ggaacttactctacaaccacactat

SEQ ID NO: 584391 - DNA, 25 bp, Mus musculus
ggaacttactctcgtacttattcat

SEQ ID NO: 584392 - DNA, 25 bp, Mus musculus
ggaacttactctggtacttattcat

SEQ ID NO: 584393 - DNA, 25 bp, Mus musculus
ggaacttactcttcaaccacactat

SEQ ID NO: 584394 - DNA, 25 bp, Mus musculus
ggaacttattaacgaccgccactgt

SEQ ID NO: 584395 - DNA, 25 bp, Mus musculus
ggaacttattaaggaccgccactgt

SEQ ID NO: 584396 - DNA, 25 bp, Mus musculus
ggaacttcaagtaagcatagcattt

SEQ ID NO: 584397 - DNA, 25 bp, Mus musculus
ggaacttcaagttagcatagcattt

SEQ ID NO: 584398 - DNA, 25 bp, Mus musculus
ggaacttcacaaattatgctctggg

SEQ ID NO: 584399 - DNA, 25 bp, Mus musculus
ggaacttcacaatttatgctctggg

SEQ ID NO: 584400 - DNA, 25 bp, Mus musculus
ggaacttcagaaacagaggcacaaa

SEQ ID NO: 584401 - DNA, 25 bp, Mus musculus
ggaacttcagaacgtacccaaatga

SEQ ID NO: 584402 - DNA, 25 bp, Mus musculus
ggaacttcagaaggtacccaaatga

SEQ ID NO: 584403 - DNA, 25 bp, Mus musculus
ggaacttcagaatcagaggcacaaa

SEQ ID NO: 584404 - DNA, 25 bp, Mus musculus
ggaacttcagacaaccaagtgtgta

SEQ ID NO: 584405 - DNA, 25 bp, Mus musculus
ggaacttcagactaccaagtgtgta

SEQ ID NO: 584406 - DNA, 25 bp, Mus musculus
ggaacttcagcgctagagaacctga

SEQ ID NO: 584407 - DNA, 25 bp, Mus musculus
ggaacttcagcggtagagaacctga

SEQ ID NO: 584408 - DNA, 25 bp, Mus musculus
ggaacttcatttactatacgtctga

SEQ ID NO: 584409 - DNA, 25 bp, Mus musculus
ggaacttcattttctatacgtctga

SEQ ID NO: 584410 - DNA, 25 bp, Mus musculus
ggaacttccaggcttgtctgcacaa

SEQ ID NO: 584411 - DNA, 25 bp, Mus musculus
ggaacttccagggttgtctgcacaa

SEQ ID NO: 584412 - DNA, 25 bp, Mus musculus
ggaacttccatgctggctatttaca

SEQ ID NO: 584413 - DNA, 25 bp, Mus musculus
ggaacttccatggtggctatttaca

SEQ ID NO: 584414 - DNA, 25 bp, Mus musculus
ggaacttccattctcgttgtatcta

SEQ ID NO: 584415 - DNA, 25 bp, Mus musculus
ggaacttccattgtcgttgtatcta

SEQ ID NO: 584416 - DNA, 25 bp, Mus musculus
ggaacttcccaaagacatcagctac

SEQ ID NO: 584417 - DNA, 25 bp, Mus musculus
ggaacttcccaatgacatcagctac

SEQ ID NO: 584418 - DNA, 25 bp, Mus musculus
ggaacttcccagacttgcatggaat

SEQ ID NO: 584419 - DNA, 25 bp, Mus musculus
ggaacttcccagtcttgcatggaat

SEQ ID NO: 584420 - DNA, 25 bp, Mus musculus
ggaacttccgaaactgaaacccact

SEQ ID NO: 584421 - DNA, 25 bp, Mus musculus
ggaacttccgaatctgaaacccact

SEQ ID NO: 584422 - DNA, 25 bp, Mus musculus
ggaacttcctagcacatgcaaggta

SEQ ID NO: 584423 - DNA, 25 bp, Mus musculus
ggaacttcctaggacatgcaaggta

SEQ ID NO: 584424 - DNA, 25 bp, Mus musculus
ggaacttcctgaaaagtctggctga

SEQ ID NO: 584425 - DNA, 25 bp, Mus musculus
ggaacttcctgataagtctggctga

SEQ ID NO: 584426 - DNA, 25 bp, Mus musculus
ggaacttcctgccacttctcctggt

SEQ ID NO: 584427 - DNA, 25 bp, Mus musculus
ggaacttcctgcgacttctcctggt

SEQ ID NO: 584428 - DNA, 25 bp, Mus musculus
ggaacttcctgtattgctcactggt

SEQ ID NO: 584429 - DNA, 25 bp, Mus musculus
ggaacttcctgttttgctcactggt

SEQ ID NO: 584430 - DNA, 25 bp, Mus musculus
ggaacttcgaacctgaccattgcag

SEQ ID NO: 584431 - DNA, 25 bp, Mus musculus
ggaacttcgaacgtgaccattgcag

SEQ ID NO: 584432 - DNA, 25 bp, Mus musculus
ggaacttcgagacttactgtccatc

SEQ ID NO: 584433 - DNA, 25 bp, Mus musculus
ggaacttcgagagttactgtccatc

SEQ ID NO: 584434 - DNA, 25 bp, Mus musculus
ggaacttcgtatctgactcgttaga

SEQ ID NO: 584435 - DNA, 25 bp, Mus musculus
ggaacttcgtatgtgactcgttaga

SEQ ID NO: 584436 - DNA, 25 bp, Mus musculus
ggaacttcgtgtctgtttctattgg

SEQ ID NO: 584437 - DNA, 25 bp, Mus musculus
ggaacttcgtgtgtgtttctattgg

SEQ ID NO: 584438 - DNA, 25 bp, Mus musculus
ggaacttctacaatactctcagctg

SEQ ID NO: 584439 - DNA, 25 bp, Mus musculus
ggaacttctacattactctcagctg

SEQ ID NO: 584440 - DNA, 25 bp, Mus musculus
ggaacttctaggcacagcccatgga

SEQ ID NO: 584441 - DNA, 25 bp, Mus musculus
ggaacttctagggacagcccatgga

SEQ ID NO: 584442 - DNA, 25 bp, Mus musculus
ggaacttctcctaatgtggcacata

SEQ ID NO: 584443 - DNA, 25 bp, Mus musculus
ggaacttctccttatgtggcacata

SEQ ID NO: 584444 - DNA, 25 bp, Mus musculus
ggaacttctgagacacagggtcttg

SEQ ID NO: 584445 - DNA, 25 bp, Mus musculus
ggaacttctgagtcacagggtcttg

SEQ ID NO: 584446 - DNA, 25 bp, Mus musculus
ggaacttctgatactggttgctttt

SEQ ID NO: 584447 - DNA, 25 bp, Mus musculus
ggaacttctgattctggttgctttt

SEQ ID NO: 584448 - DNA, 25 bp, Mus musculus
ggaacttcttccctctggagaacga

SEQ ID NO: 584449 - DNA, 25 bp, Mus musculus
ggaacttcttccgtctggagaacga

SEQ ID NO: 584450 - DNA, 25 bp, Mus musculus
ggaacttcttctcggatgggcagat

SEQ ID NO: 584451 - DNA, 25 bp, Mus musculus
ggaacttcttctgggatgggcagat

SEQ ID NO: 584452 - DNA, 25 bp, Mus musculus
ggaacttcttgacagggtcctgcag

SEQ ID NO: 584453 - DNA, 25 bp, Mus musculus
ggaacttcttgagagggtcctgcag

SEQ ID NO: 584454 - DNA, 25 bp, Mus musculus
ggaacttcttggcataatttaggat

SEQ ID NO: 584455 - DNA, 25 bp, Mus musculus
ggaacttcttgggataatttaggat

SEQ ID NO: 584456 - DNA, 25 bp, Mus musculus
ggaacttgactgaccatacctggtt

SEQ ID NO: 584457 - DNA, 25 bp, Mus musculus
ggaacttgactgtccatacctggtt

SEQ ID NO: 584458 - DNA, 25 bp, Mus musculus
ggaacttgagatctataatgcacct

SEQ ID NO: 584459 - DNA, 25 bp, Mus musculus
ggaacttgagatgtataatgcacct

SEQ ID NO: 584460 - DNA, 25 bp, Mus musculus
ggaacttgagcgcttcttgcccaca

SEQ ID NO: 584461 - DNA, 25 bp, Mus musculus
ggaacttgagcggttcttgcccaca

SEQ ID NO: 584462 - DNA, 25 bp, Mus musculus
ggaacttgatctcggaccttgacga

SEQ ID NO: 584463 - DNA, 25 bp, Mus musculus
ggaacttgatctgggaccttgacga

SEQ ID NO: 584464 - DNA, 25 bp, Mus musculus
ggaacttgcattctggtgtttaact

SEQ ID NO: 584465 - DNA, 25 bp, Mus musculus
ggaacttgcattgtggtgtttaact

SEQ ID NO: 584466 - DNA, 25 bp, Mus musculus
ggaacttgccatcgtccagtggtaa

SEQ ID NO: 584467 - DNA, 25 bp, Mus musculus
ggaacttgccatggtccagtggtaa

SEQ ID NO: 584468 - DNA, 25 bp, Mus musculus
ggaacttgccgactcactggaacaa

SEQ ID NO: 584469 - DNA, 25 bp, Mus musculus
ggaacttgccgagtcactggaacaa

SEQ ID NO: 584470 - DNA, 25 bp, Mus musculus
ggaacttgcctgctgtcactgtgaa

SEQ ID NO: 584471 - DNA, 25 bp, Mus musculus
ggaacttgcctggtgtcactgtgaa

SEQ ID NO: 584472 - DNA, 25 bp, Mus musculus
ggaacttgctacagggtccaggtta

SEQ ID NO: 584473 - DNA, 25 bp, Mus musculus
ggaacttgctactgggtccaggtta

SEQ ID NO: 584474 - DNA, 25 bp, Mus musculus
ggaacttggatcagagtgaccacat

SEQ ID NO: 584475 - DNA, 25 bp, Mus musculus
ggaacttggatctgagtgaccacat

SEQ ID NO: 584476 - DNA, 25 bp, Mus musculus
ggaacttggattctactactatcaa

SEQ ID NO: 584477 - DNA, 25 bp, Mus musculus
ggaacttggattgtactactatcaa

SEQ ID NO: 584478 - DNA, 25 bp, Mus musculus
ggaacttggcataggcacacattgt

SEQ ID NO: 584479 - DNA, 25 bp, Mus musculus
ggaacttggcattggcacacattgt

SEQ ID NO: 584480 - DNA, 25 bp, Mus musculus
ggaacttgggacaaggcctcgctga

SEQ ID NO: 584481 - DNA, 25 bp, Mus musculus
ggaacttgggactaggcctcgctga

SEQ ID NO: 584482 - DNA, 25 bp, Mus musculus
ggaacttgggcaccacttgatgtcc

SEQ ID NO: 584483 - DNA, 25 bp, Mus musculus
ggaacttgggcagcacttgatgtcc

SEQ ID NO: 584484 - DNA, 25 bp, Mus musculus
ggaacttgggttcccagcaattaca

SEQ ID NO: 584485 - DNA, 25 bp, Mus musculus
ggaacttgggttgccagcaattaca

SEQ ID NO: 584486 - DNA, 25 bp, Mus musculus
ggaacttggtccctttgtctcagcc

SEQ ID NO: 584487 - DNA, 25 bp, Mus musculus
ggaacttggtccgtttgtctcagcc

SEQ ID NO: 584488 - DNA, 25 bp, Mus musculus
ggaacttggtttccactgtggagac

SEQ ID NO: 584489 - DNA, 25 bp, Mus musculus
ggaacttggtttgcactgtggagac

SEQ ID NO: 584490 - DNA, 25 bp, Mus musculus
ggaacttgtaacctgggccctacat

SEQ ID NO: 584491 - DNA, 25 bp, Mus musculus
ggaacttgtaacgtgggccctacat

SEQ ID NO: 584492 - DNA, 25 bp, Mus musculus
ggaacttgtggaactcctttcaaat

SEQ ID NO: 584493 - DNA, 25 bp, Mus musculus
ggaacttgtggatctcctttcaaat

SEQ ID NO: 584494 - DNA, 25 bp, Mus musculus
ggaacttgtgtaattatgccatttt

SEQ ID NO: 584495 - DNA, 25 bp, Mus musculus
ggaacttgtgtatttatgccatttt

SEQ ID NO: 584496 - DNA, 25 bp, Mus musculus
ggaacttgttcaagattgtgctctg

SEQ ID NO: 584497 - DNA, 25 bp, Mus musculus
ggaacttgttcatgattgtgctctg

SEQ ID NO: 584498 - DNA, 25 bp, Mus musculus
ggaacttgttgcaggtaagacgctg

SEQ ID NO: 584499 - DNA, 25 bp, Mus musculus
ggaacttgttgctggtaagacgctg

SEQ ID NO: 584500 - DNA, 25 bp, Mus musculus
ggaacttgttgtaattgaatcattt

SEQ ID NO: 584501 - DNA, 25 bp, Mus musculus
ggaacttgttgttattgaatcattt

SEQ ID NO: 584502 - DNA, 25 bp, Mus musculus
ggaacttgtttcatcaagctcttca

SEQ ID NO: 584503 - DNA, 25 bp, Mus musculus
ggaacttgtttcatcagagcatatc

SEQ ID NO: 584504 - DNA, 25 bp, Mus musculus
ggaacttgtttcttcaagctcttca

SEQ ID NO: 584505 - DNA, 25 bp, Mus musculus
ggaacttgtttcttcagagcatatc

SEQ ID NO: 584506 - DNA, 25 bp, Mus musculus
ggaactttaacaccttgccttgtag

SEQ ID NO: 584507 - DNA, 25 bp, Mus musculus
ggaactttaacagcttgccttgtag

SEQ ID NO: 584508 - DNA, 25 bp, Mus musculus
ggaactttaccaagtttctcattga

SEQ ID NO: 584509 - DNA, 25 bp, Mus musculus
ggaactttaccatgtttctcattga

SEQ ID NO: 584510 - DNA, 25 bp, Mus musculus
ggaactttagttagcgtatcttaca

SEQ ID NO: 584511 - DNA, 25 bp, Mus musculus
ggaactttagtttgcgtatcttaca

SEQ ID NO: 584512 - DNA, 25 bp, Mus musculus
ggaactttcaagaattgttgtaaat

SEQ ID NO: 584513 - DNA, 25 bp, Mus musculus
ggaactttcaagtattgttgtaaat

SEQ ID NO: 584514 - DNA, 25 bp, Mus musculus
ggaactttcaatagtgtggcctaaa

SEQ ID NO: 584515 - DNA, 25 bp, Mus musculus
ggaactttcaattgtgtggcctaaa

SEQ ID NO: 584516 - DNA, 25 bp, Mus musculus
ggaactttccagcttggcacctgaa

SEQ ID NO: 584517 - DNA, 25 bp, Mus musculus
ggaactttccaggttggcacctgaa

SEQ ID NO: 584518 - DNA, 25 bp, Mus musculus
ggaactttcgctaagaatctggatg

SEQ ID NO: 584519 - DNA, 25 bp, Mus musculus
ggaactttcgcttagaatctggatg

SEQ ID NO: 584520 - DNA, 25 bp, Mus musculus
ggaactttctacagagctatgttgt

SEQ ID NO: 584521 - DNA, 25 bp, Mus musculus
ggaactttctactgagctatgttgt

SEQ ID NO: 584522 - DNA, 25 bp, Mus musculus
ggaactttctccctctaatactctt

SEQ ID NO: 584523 - DNA, 25 bp, Mus musculus
ggaactttctccgtctaatactctt

SEQ ID NO: 584524 - DNA, 25 bp, Mus musculus
ggaactttctttattctaccaatga

SEQ ID NO: 584525 - DNA, 25 bp, Mus musculus
ggaactttcttttttctaccaatga

SEQ ID NO: 584526 - DNA, 25 bp, Mus musculus
ggaactttgattagaccagcctctg

SEQ ID NO: 584527 - DNA, 25 bp, Mus musculus
ggaactttgatttgaccagcctctg

SEQ ID NO: 584528 - DNA, 25 bp, Mus musculus
ggaactttgctcaaggcgcagactc

SEQ ID NO: 584529 - DNA, 25 bp, Mus musculus
ggaactttgctctaggcgcagactc

SEQ ID NO: 584530 - DNA, 25 bp, Mus musculus
ggaactttgtagaaactggtaatct

SEQ ID NO: 584531 - DNA, 25 bp, Mus musculus
ggaactttgtagtaactggtaatct

SEQ ID NO: 584532 - DNA, 25 bp, Mus musculus
ggaactttgtcaacaacttcaaggt

SEQ ID NO: 584533 - DNA, 25 bp, Mus musculus
ggaactttgtcatcaacttcaaggt

SEQ ID NO: 584534 - DNA, 25 bp, Mus musculus
ggaactttgtccactgtcagcaaga

SEQ ID NO: 584535 - DNA, 25 bp, Mus musculus
ggaactttgtcctctgtcagcaaga

SEQ ID NO: 584536 - DNA, 25 bp, Mus musculus
ggaactttgtgaccaacactcacct

SEQ ID NO: 584537 - DNA, 25 bp, Mus musculus
ggaactttgtgagcaacactcacct

SEQ ID NO: 584538 - DNA, 25 bp, Mus musculus
ggaacttttgatatctattgggaca

SEQ ID NO: 584539 - DNA, 25 bp, Mus musculus
ggaacttttgatttctattgggaca

SEQ ID NO: 584540 - DNA, 25 bp, Mus musculus
ggaacttttgctaatataccacgtg

SEQ ID NO: 584541 - DNA, 25 bp, Mus musculus
ggaacttttgcttatataccacgtg

SEQ ID NO: 584542 - DNA, 25 bp, Mus musculus
ggaacttttgtcaatcaccttaact

SEQ ID NO: 584543 - DNA, 25 bp, Mus musculus
ggaacttttgtctatcaccttaact

SEQ ID NO: 584544 - DNA, 25 bp, Mus musculus
ggaacttttgttacttaactctgtg

SEQ ID NO: 584545 - DNA, 25 bp, Mus musculus
ggaacttttgtttcttaactctgtg

SEQ ID NO: 584546 - DNA, 25 bp, Mus musculus
ggaactttttccactgcagaagaac

SEQ ID NO: 584547 - DNA, 25 bp, Mus musculus
ggaactttttcctctgcagaagaac

SEQ ID NO: 584548 - DNA, 25 bp, Mus musculus
ggaacttttttccagctgtcagctg

SEQ ID NO: 584549 - DNA, 25 bp, Mus musculus
ggaacttttttcgagctgtcagctg

SEQ ID NO: 584550 - DNA, 25 bp, Mus musculus
ggaagaaaacaaaagcacagcatat

SEQ ID NO: 584551 - DNA, 25 bp, Mus musculus
ggaagaaaacaaagtgtctatgtct

SEQ ID NO: 584552 - DNA, 25 bp, Mus musculus
ggaagaaaacaatagcacagcatat

SEQ ID NO: 584553 - DNA, 25 bp, Mus musculus
ggaagaaaacaatgtgtctatgtct

SEQ ID NO: 584554 - DNA, 25 bp, Mus musculus
ggaagaaaagcgagtcctgttttat

SEQ ID NO: 584555 - DNA, 25 bp, Mus musculus
ggaagaaaagcgtgtcctgttttat

SEQ ID NO: 584556 - DNA, 25 bp, Mus musculus
ggaagaaaataacgagggctcgctc

SEQ ID NO: 584557 - DNA, 25 bp, Mus musculus
ggaagaaaataaggagggctcgctc

SEQ ID NO: 584558 - DNA, 25 bp, Mus musculus
ggaagaaaatcaaagctcgggcctg

SEQ ID NO: 584559 - DNA, 25 bp, Mus musculus
ggaagaaaatcatagctcgggcctg

SEQ ID NO: 584560 - DNA, 25 bp, Mus musculus
ggaagaaaccacatagaaatcagaa

SEQ ID NO: 584561 - DNA, 25 bp, Mus musculus
ggaagaaaccacttagaaatcagaa

SEQ ID NO: 584562 - DNA, 25 bp, Mus musculus
ggaagaaaccccacaaactgtcaag

SEQ ID NO: 584563 - DNA, 25 bp, Mus musculus
ggaagaaacccctcaaactgtcaag

SEQ ID NO: 584564 - DNA, 25 bp, Mus musculus
ggaagaaactctacccacacttcat

SEQ ID NO: 584565 - DNA, 25 bp, Mus musculus
ggaagaaactcttcccacacttcat

SEQ ID NO: 584566 - DNA, 25 bp, Mus musculus
ggaagaaactgaataaacacatgtt

SEQ ID NO: 584567 - DNA, 25 bp, Mus musculus
ggaagaaactgattaaacacatgtt

SEQ ID NO: 584568 - DNA, 25 bp, Mus musculus
ggaagaaacttacaacatcgggaat

SEQ ID NO: 584569 - DNA, 25 bp, Mus musculus
ggaagaaacttagaacatcgggaat

SEQ ID NO: 584570 - DNA, 25 bp, Mus musculus
ggaagaaagatgcttctgatgactt

SEQ ID NO: 584571 - DNA, 25 bp, Mus musculus
ggaagaaagatggttctgatgactt

SEQ ID NO: 584572 - DNA, 25 bp, Mus musculus
ggaagaaagcaacccttgtcctccg

SEQ ID NO: 584573 - DNA, 25 bp, Mus musculus
ggaagaaagcaagccttgtcctccg

SEQ ID NO: 584574 - DNA, 25 bp, Mus musculus
ggaagaaagcccatgtcacctgttc

SEQ ID NO: 584575 - DNA, 25 bp, Mus musculus
ggaagaaagcccttgtcacctgttc

SEQ ID NO: 584576 - DNA, 25 bp, Mus musculus
ggaagaaagcctcctagcagtttct

SEQ ID NO: 584577 - DNA, 25 bp, Mus musculus
ggaagaaagcctgctagcagtttct

SEQ ID NO: 584578 - DNA, 25 bp, Mus musculus
ggaagaaagcgactgaaactgttgc

SEQ ID NO: 584579 - DNA, 25 bp, Mus musculus
ggaagaaagcgagtgaaactgttgc

SEQ ID NO: 584580 - DNA, 25 bp, Mus musculus
ggaagaaaggcaagacaggaaactc

SEQ ID NO: 584581 - DNA, 25 bp, Mus musculus
ggaagaaaggcatgacaggaaactc

SEQ ID NO: 584582 - DNA, 25 bp, Mus musculus
ggaagaaatatgaccagctgcttat

SEQ ID NO: 584583 - DNA, 25 bp, Mus musculus
ggaagaaatatgtccagctgcttat

SEQ ID NO: 584584 - DNA, 25 bp, Mus musculus
ggaagaaatcgcctgtatatattaa

SEQ ID NO: 584585 - DNA, 25 bp, Mus musculus
ggaagaaatcgcgtgtatatattaa

SEQ ID NO: 584586 - DNA, 25 bp, Mus musculus
ggaagaaattgaacaggcaaagaaa

SEQ ID NO: 584587 - DNA, 25 bp, Mus musculus
ggaagaaattgatcaggcaaagaaa

SEQ ID NO: 584588 - DNA, 25 bp, Mus musculus
ggaagaaattgcctagaccaggaat

SEQ ID NO: 584589 - DNA, 25 bp, Mus musculus
ggaagaaattgcgtagaccaggaat

SEQ ID NO: 584590 - DNA, 25 bp, Mus musculus
ggaagaacaaccctctcattgtcaa

SEQ ID NO: 584591 - DNA, 25 bp, Mus musculus
ggaagaacaaccgtctcattgtcaa

SEQ ID NO: 584592 - DNA, 25 bp, Mus musculus
ggaagaacaagcagtcatcaatgac

SEQ ID NO: 584593 - DNA, 25 bp, Mus musculus
ggaagaacaagctgtcatcaatgac

SEQ ID NO: 584594 - DNA, 25 bp, Mus musculus
ggaagaacacccaggatgctgtttc

SEQ ID NO: 584595 - DNA, 25 bp, Mus musculus
ggaagaacaccctggatgctgtttc

SEQ ID NO: 584596 - DNA, 25 bp, Mus musculus
ggaagaacacgtagctcagatgtac

SEQ ID NO: 584597 - DNA, 25 bp, Mus musculus
ggaagaacacgtcgcagaagtctaa

SEQ ID NO: 584598 - DNA, 25 bp, Mus musculus
ggaagaacacgtggcagaagtctaa

SEQ ID NO: 584599 - DNA, 25 bp, Mus musculus
ggaagaacacgttgctcagatgtac

SEQ ID NO: 584600 - DNA, 25 bp, Mus musculus
ggaagaacactgaatcactgtgaga

SEQ ID NO: 584601 - DNA, 25 bp, Mus musculus
ggaagaacactgtatcactgtgaga

SEQ ID NO: 584602 - DNA, 25 bp, Mus musculus
ggaagaacagctcgcccgattgtgc

SEQ ID NO: 584603 - DNA, 25 bp, Mus musculus
ggaagaacagctggcccgattgtgc

SEQ ID NO: 584604 - DNA, 25 bp, Mus musculus
ggaagaacataaaccacacccatcc

SEQ ID NO: 584605 - DNA, 25 bp, Mus musculus
ggaagaacataatccacacccatcc

SEQ ID NO: 584606 - DNA, 25 bp, Mus musculus
ggaagaacatcgacacactggaaaa

SEQ ID NO: 584607 - DNA, 25 bp, Mus musculus
ggaagaacatcgtcacactggaaaa

SEQ ID NO: 584608 - DNA, 25 bp, Mus musculus
ggaagaacatctctggtcactggga

SEQ ID NO: 584609 - DNA, 25 bp, Mus musculus
ggaagaacatctgtggtcactggga

SEQ ID NO: 584610 - DNA, 25 bp, Mus musculus
ggaagaacatgcatggttttaaata

SEQ ID NO: 584611 - DNA, 25 bp, Mus musculus
ggaagaacatgcttggttttaaata

SEQ ID NO: 584612 - DNA, 25 bp, Mus musculus
ggaagaacatggctctgtccacaac

SEQ ID NO: 584613 - DNA, 25 bp, Mus musculus
ggaagaacatgggtctgtccacaac

SEQ ID NO: 584614 - DNA, 25 bp, Mus musculus
ggaagaacatttagcctgtcctggc

SEQ ID NO: 584615 - DNA, 25 bp, Mus musculus
ggaagaacattttgcctgtcctggc

SEQ ID NO: 584616 - DNA, 25 bp, Mus musculus
ggaagaaccaaaatcacgcaaacat

SEQ ID NO: 584617 - DNA, 25 bp, Mus musculus
ggaagaaccaaattcacgcaaacat

SEQ ID NO: 584618 - DNA, 25 bp, Mus musculus
ggaagaaccaacaagcatctaaaag

SEQ ID NO: 584619 - DNA, 25 bp, Mus musculus
ggaagaaccaactagcatctaaaag

SEQ ID NO: 584620 - DNA, 25 bp, Mus musculus
ggaagaaccaccattcgtgcattat

SEQ ID NO: 584621 - DNA, 25 bp, Mus musculus
ggaagaaccacctttcgtgcattat

SEQ ID NO: 584622 - DNA, 25 bp, Mus musculus
ggaagaacccacagtcatcaaaaag

SEQ ID NO: 584623 - DNA, 25 bp, Mus musculus
ggaagaacccactgtcatcaaaaag

SEQ ID NO: 584624 - DNA, 25 bp, Mus musculus
ggaagaacccagacagtgccaggaa

SEQ ID NO: 584625 - DNA, 25 bp, Mus musculus
ggaagaacccagtcagtgccaggaa

SEQ ID NO: 584626 - DNA, 25 bp, Mus musculus
ggaagaaccccaactatgatctttg

SEQ ID NO: 584627 - DNA, 25 bp, Mus musculus
ggaagaaccccatctatgatctttg

SEQ ID NO: 584628 - DNA, 25 bp, Mus musculus
ggaagaacctacacaaccgtgttca

SEQ ID NO: 584629 - DNA, 25 bp, Mus musculus
ggaagaacctacagcggctgcagga

SEQ ID NO: 584630 - DNA, 25 bp, Mus musculus
ggaagaacctactcaaccgtgttca

SEQ ID NO: 584631 - DNA, 25 bp, Mus musculus
ggaagaacctactgcggctgcagga

SEQ ID NO: 584632 - DNA, 25 bp, Mus musculus
ggaagaacctgaacccacattgagc

SEQ ID NO: 584633 - DNA, 25 bp, Mus musculus
ggaagaacctgactgctagcatagc

SEQ ID NO: 584634 - DNA, 25 bp, Mus musculus
ggaagaacctgagtgctagcatagc

SEQ ID NO: 584635 - DNA, 25 bp, Mus musculus
ggaagaacctgatcccacattgagc

SEQ ID NO: 584636 - DNA, 25 bp, Mus musculus
ggaagaacctgtagggcgtgccctc

SEQ ID NO: 584637 - DNA, 25 bp, Mus musculus
ggaagaacctgtcaccatgagtaac

SEQ ID NO: 584638 - DNA, 25 bp, Mus musculus
ggaagaacctgtgaccatgagtaac

SEQ ID NO: 584639 - DNA, 25 bp, Mus musculus
ggaagaacctgttgggcgtgccctc

SEQ ID NO: 584640 - DNA, 25 bp, Mus musculus
ggaagaacgcggcattacaggacca

SEQ ID NO: 584641 - DNA, 25 bp, Mus musculus
ggaagaacgcgggattacaggacca

SEQ ID NO: 584642 - DNA, 25 bp, Mus musculus
ggaagaacgtatctctcagttttca

SEQ ID NO: 584643 - DNA, 25 bp, Mus musculus
ggaagaacgtatgtctcagttttca

SEQ ID NO: 584644 - DNA, 25 bp, Mus musculus
ggaagaactaggctcctacgcgcgt

SEQ ID NO: 584645 - DNA, 25 bp, Mus musculus
ggaagaactagggtcctacgcgcgt

SEQ ID NO: 584646 - DNA, 25 bp, Mus musculus
ggaagaactcaaactgctctgcaga

SEQ ID NO: 584647 - DNA, 25 bp, Mus musculus
ggaagaactcaatctgctctgcaga

SEQ ID NO: 584648 - DNA, 25 bp, Mus musculus
ggaagaactcccctacacataaaat

SEQ ID NO: 584649 - DNA, 25 bp, Mus musculus
ggaagaactcccgtacacataaaat

SEQ ID NO: 584650 - DNA, 25 bp, Mus musculus
ggaagaactcttcgtctccttacag

SEQ ID NO: 584651 - DNA, 25 bp, Mus musculus
ggaagaactcttggtctccttacag

SEQ ID NO: 584652 - DNA, 25 bp, Mus musculus
ggaagaactgagactccaaagttgt

SEQ ID NO: 584653 - DNA, 25 bp, Mus musculus
ggaagaactgagtctccaaagttgt

SEQ ID NO: 584654 - DNA, 25 bp, Mus musculus
ggaagaacttttcggccgctcaatt

SEQ ID NO: 584655 - DNA, 25 bp, Mus musculus
ggaagaacttttgggccgctcaatt

SEQ ID NO: 584656 - DNA, 25 bp, Mus musculus
ggaagaagaaacaatgcaattcaaa

SEQ ID NO: 584657 - DNA, 25 bp, Mus musculus
ggaagaagaaactatgcaattcaaa

SEQ ID NO: 584658 - DNA, 25 bp, Mus musculus
ggaagaagacaaaaataaagccatt

SEQ ID NO: 584659 - DNA, 25 bp, Mus musculus
ggaagaagacaataataaagccatt

SEQ ID NO: 584660 - DNA, 25 bp, Mus musculus
ggaagaagacgacttacagcggatc

SEQ ID NO: 584661 - DNA, 25 bp, Mus musculus
ggaagaagacgagttacagcggatc

SEQ ID NO: 584662 - DNA, 25 bp, Mus musculus
ggaagaagactgattatgttgagct

SEQ ID NO: 584663 - DNA, 25 bp, Mus musculus
ggaagaagactgtttatgttgagct

SEQ ID NO: 584664 - DNA, 25 bp, Mus musculus
ggaagaagagatccgccctccacag

SEQ ID NO: 584665 - DNA, 25 bp, Mus musculus
ggaagaagagatgcgccctccacag

SEQ ID NO: 584666 - DNA, 25 bp, Mus musculus
ggaagaagaggacgccccgtcattc

SEQ ID NO: 584667 - DNA, 25 bp, Mus musculus
ggaagaagaggaggccccgtcattc

SEQ ID NO: 584668 - DNA, 25 bp, Mus musculus
ggaagaagataaactcacgctgtat

SEQ ID NO: 584669 - DNA, 25 bp, Mus musculus
ggaagaagataatctcacgctgtat

SEQ ID NO: 584670 - DNA, 25 bp, Mus musculus
ggaagaagatgtaggcacagttaaa

SEQ ID NO: 584671 - DNA, 25 bp, Mus musculus
ggaagaagatgttggcacagttaaa

SEQ ID NO: 584672 - DNA, 25 bp, Mus musculus
ggaagaagatttaccctgagctata

SEQ ID NO: 584673 - DNA, 25 bp, Mus musculus
ggaagaagattttccctgagctata

SEQ ID NO: 584674 - DNA, 25 bp, Mus musculus
ggaagaagccacaatcaacacatag

SEQ ID NO: 584675 - DNA, 25 bp, Mus musculus
ggaagaagccactatcaacacatag

SEQ ID NO: 584676 - DNA, 25 bp, Mus musculus
ggaagaagcctgatccattgctatt

SEQ ID NO: 584677 - DNA, 25 bp, Mus musculus
ggaagaagcctgttccattgctatt

SEQ ID NO: 584678 - DNA, 25 bp, Mus musculus
ggaagaagcgatccttaccacgcca

SEQ ID NO: 584679 - DNA, 25 bp, Mus musculus
ggaagaagcgatgcttaccacgcca

SEQ ID NO: 584680 - DNA, 25 bp, Mus musculus
ggaagaagctcgaacatagcagcaa

SEQ ID NO: 584681 - DNA, 25 bp, Mus musculus
ggaagaagctcgtacatagcagcaa

SEQ ID NO: 584682 - DNA, 25 bp, Mus musculus
ggaagaaggcttatcacactagtaa

SEQ ID NO: 584683 - DNA, 25 bp, Mus musculus
ggaagaaggcttttcacactagtaa

SEQ ID NO: 584684 - DNA, 25 bp, Mus musculus
ggaagaagtacgacatctacatcga

SEQ ID NO: 584685 - DNA, 25 bp, Mus musculus
ggaagaagtacgtcatctacatcga

SEQ ID NO: 584686 - DNA, 25 bp, Mus musculus
ggaagaagtgttccctctaatttct

SEQ ID NO: 584687 - DNA, 25 bp, Mus musculus
ggaagaagtgttgcctctaatttct

SEQ ID NO: 584688 - DNA, 25 bp, Mus musculus
ggaagaagttataccctcatctccc

SEQ ID NO: 584689 - DNA, 25 bp, Mus musculus
ggaagaagttattccctcatctccc

SEQ ID NO: 584690 - DNA, 25 bp, Mus musculus
ggaagaagttccaccatcaaacatg

SEQ ID NO: 584691 - DNA, 25 bp, Mus musculus
ggaagaagttcctccatcaaacatg

SEQ ID NO: 584692 - DNA, 25 bp, Mus musculus
ggaagaataataattcactctgtga

SEQ ID NO: 584693 - DNA, 25 bp, Mus musculus
ggaagaataatatttcactctgtga

SEQ ID NO: 584694 - DNA, 25 bp, Mus musculus
ggaagaataattccatcctgcagaa

SEQ ID NO: 584695 - DNA, 25 bp, Mus musculus
ggaagaataattgcatcctgcagaa

SEQ ID NO: 584696 - DNA, 25 bp, Mus musculus
ggaagaatacccagagttgccctct

SEQ ID NO: 584697 - DNA, 25 bp, Mus musculus
ggaagaataccctgagttgccctct

SEQ ID NO: 584698 - DNA, 25 bp, Mus musculus
ggaagaatagccattgtagccatac

SEQ ID NO: 584699 - DNA, 25 bp, Mus musculus
ggaagaatagcctttgtagccatac

SEQ ID NO: 584700 - DNA, 25 bp, Mus musculus
ggaagaatatgtaacccgccaagcc

SEQ ID NO: 584701 - DNA, 25 bp, Mus musculus
ggaagaatatgttacccgccaagcc

SEQ ID NO: 584702 - DNA, 25 bp, Mus musculus
ggaagaatcaacacagctaccatct

SEQ ID NO: 584703 - DNA, 25 bp, Mus musculus
ggaagaatcaactcagctaccatct

SEQ ID NO: 584704 - DNA, 25 bp, Mus musculus
ggaagaatcagccagtttgcttttt

SEQ ID NO: 584705 - DNA, 25 bp, Mus musculus
ggaagaatcagcgagtttgcttttt

SEQ ID NO: 584706 - DNA, 25 bp, Mus musculus
ggaagaatcaggcaccagccctcaa

SEQ ID NO: 584707 - DNA, 25 bp, Mus musculus
ggaagaatcagggaccagccctcaa

SEQ ID NO: 584708 - DNA, 25 bp, Mus musculus
ggaagaatcatgctgaatttttctt

SEQ ID NO: 584709 - DNA, 25 bp, Mus musculus
ggaagaatcatggtgaatttttctt

SEQ ID NO: 584710 - DNA, 25 bp, Mus musculus
ggaagaatcccacaacaccatcctt

SEQ ID NO: 584711 - DNA, 25 bp, Mus musculus
ggaagaatcccagaacaccatcctt

SEQ ID NO: 584712 - DNA, 25 bp, Mus musculus
ggaagaatcgacacggcctctggag

SEQ ID NO: 584713 - DNA, 25 bp, Mus musculus
ggaagaatcgactcggcctctggag

SEQ ID NO: 584714 - DNA, 25 bp, Mus musculus
ggaagaatcgcacccgcagccactg

SEQ ID NO: 584715 - DNA, 25 bp, Mus musculus
ggaagaatcgcagccgcagccactg

SEQ ID NO: 584716 - DNA, 25 bp, Mus musculus
ggaagaatctggactattccagctt

SEQ ID NO: 584717 - DNA, 25 bp, Mus musculus
ggaagaatctggtctattccagctt

SEQ ID NO: 584718 - DNA, 25 bp, Mus musculus
ggaagaatcttcaacctctataaag

SEQ ID NO: 584719 - DNA, 25 bp, Mus musculus
ggaagaatcttctacctctataaag

SEQ ID NO: 584720 - DNA, 25 bp, Mus musculus
ggaagaatgctcaaatcctagatga

SEQ ID NO: 584721 - DNA, 25 bp, Mus musculus
ggaagaatgctctaatcctagatga

SEQ ID NO: 584722 - DNA, 25 bp, Mus musculus
ggaagaatggccaacatcccgaaga

SEQ ID NO: 584723 - DNA, 25 bp, Mus musculus
ggaagaatggcctacatcccgaaga

SEQ ID NO: 584724 - DNA, 25 bp, Mus musculus
ggaagaatggtgagcctgcttctca

SEQ ID NO: 584725 - DNA, 25 bp, Mus musculus
ggaagaatggtgtgcctgcttctca

SEQ ID NO: 584726 - DNA, 25 bp, Mus musculus
ggaagaattattaaccatgatggat

SEQ ID NO: 584727 - DNA, 25 bp, Mus musculus
ggaagaattattatgctcactacaa

SEQ ID NO: 584728 - DNA, 25 bp, Mus musculus
ggaagaattatttaccatgatggat

SEQ ID NO: 584729 - DNA, 25 bp, Mus musculus
ggaagaattattttgctcactacaa

SEQ ID NO: 584730 - DNA, 25 bp, Mus musculus
ggaagaattcatactgccatcaatg

SEQ ID NO: 584731 - DNA, 25 bp, Mus musculus
ggaagaattcattctgccatcaatg

SEQ ID NO: 584732 - DNA, 25 bp, Mus musculus
ggaagaattccgcttacatttcaag

SEQ ID NO: 584733 - DNA, 25 bp, Mus musculus
ggaagaattccggttacatttcaag

SEQ ID NO: 584734 - DNA, 25 bp, Mus musculus
ggaagaattcgtcaccctcaaagca

SEQ ID NO: 584735 - DNA, 25 bp, Mus musculus
ggaagaattcgtgaccctcaaagca

SEQ ID NO: 584736 - DNA, 25 bp, Mus musculus
ggaagaattgaccagaatgctagca

SEQ ID NO: 584737 - DNA, 25 bp, Mus musculus
ggaagaattgacgagaatgctagca

SEQ ID NO: 584738 - DNA, 25 bp, Mus musculus
ggaagaattgggacgccacacctgg

SEQ ID NO: 584739 - DNA, 25 bp, Mus musculus
ggaagaattgggtcgccacacctgg

SEQ ID NO: 584740 - DNA, 25 bp, Mus musculus
ggaagaattgtgctatttattaata

SEQ ID NO: 584741 - DNA, 25 bp, Mus musculus
ggaagaattgtggtatttattaata

SEQ ID NO: 584742 - DNA, 25 bp, Mus musculus
ggaagaatttcccagccacttagag

SEQ ID NO: 584743 - DNA, 25 bp, Mus musculus
ggaagaatttccgagccacttagag

SEQ ID NO: 584744 - DNA, 25 bp, Mus musculus
ggaagaatttgcctgtcctacaggt

SEQ ID NO: 584745 - DNA, 25 bp, Mus musculus
ggaagaatttgcgtgtcctacaggt

SEQ ID NO: 584746 - DNA, 25 bp, Mus musculus
ggaagacaaatccacctgcgagttg

SEQ ID NO: 584747 - DNA, 25 bp, Mus musculus
ggaagacaaatcgacctgcgagttg

SEQ ID NO: 584748 - DNA, 25 bp, Mus musculus
ggaagacaaatgagcccctcaggga

SEQ ID NO: 584749 - DNA, 25 bp, Mus musculus
ggaagacaaatgtgcccctcaggga

SEQ ID NO: 584750 - DNA, 25 bp, Mus musculus
ggaagacaacaccaggtcctccctg

SEQ ID NO: 584751 - DNA, 25 bp, Mus musculus
ggaagacaacacgaggtcctccctg

SEQ ID NO: 584752 - DNA, 25 bp, Mus musculus
ggaagacaaccaagcccgactgttt

SEQ ID NO: 584753 - DNA, 25 bp, Mus musculus
ggaagacaaccatgcccgactgttt

SEQ ID NO: 584754 - DNA, 25 bp, Mus musculus
ggaagacaacgtagctctctccctt

SEQ ID NO: 584755 - DNA, 25 bp, Mus musculus
ggaagacaacgttgctctctccctt

SEQ ID NO: 584756 - DNA, 25 bp, Mus musculus
ggaagacaaggcacaggcaaccagt

SEQ ID NO: 584757 - DNA, 25 bp, Mus musculus
ggaagacaaggctcaggcaaccagt

SEQ ID NO: 584758 - DNA, 25 bp, Mus musculus
ggaagacaagtcagcctctcagatg

SEQ ID NO: 584759 - DNA, 25 bp, Mus musculus
ggaagacaagtctgcctctcagatg

SEQ ID NO: 584760 - DNA, 25 bp, Mus musculus
ggaagacaatcaccccggaagcttt

SEQ ID NO: 584761 - DNA, 25 bp, Mus musculus
ggaagacaatcagcccggaagcttt

SEQ ID NO: 584762 - DNA, 25 bp, Mus musculus
ggaagacacaccatttcatagactg

SEQ ID NO: 584763 - DNA, 25 bp, Mus musculus
ggaagacacaccttttcatagactg

SEQ ID NO: 584764 - DNA, 25 bp, Mus musculus
ggaagacacaggactgtccgtctac

SEQ ID NO: 584765 - DNA, 25 bp, Mus musculus
ggaagacacaggtctgtccgtctac

SEQ ID NO: 584766 - DNA, 25 bp, Mus musculus
ggaagacaccaacctacatacccag

SEQ ID NO: 584767 - DNA, 25 bp, Mus musculus
ggaagacaccaagctacatacccag

SEQ ID NO: 584768 - DNA, 25 bp, Mus musculus
ggaagacaccacaccaggaggcctg

SEQ ID NO: 584769 - DNA, 25 bp, Mus musculus
ggaagacaccaccacaactgactga

SEQ ID NO: 584770 - DNA, 25 bp, Mus musculus
ggaagacaccacgacaactgactga

SEQ ID NO: 584771 - DNA, 25 bp, Mus musculus
ggaagacaccactccaggaggcctg

SEQ ID NO: 584772 - DNA, 25 bp, Mus musculus
ggaagacaccagaaggccacacaat

SEQ ID NO: 584773 - DNA, 25 bp, Mus musculus
ggaagacaccagtaggccacacaat

SEQ ID NO: 584774 - DNA, 25 bp, Mus musculus
ggaagacaccatatgctttaggatt

SEQ ID NO: 584775 - DNA, 25 bp, Mus musculus
ggaagacaccatttgctttaggatt

SEQ ID NO: 584776 - DNA, 25 bp, Mus musculus
ggaagacacctaacaccaacctttg

SEQ ID NO: 584777 - DNA, 25 bp, Mus musculus
ggaagacacctatcaccaacctttg

SEQ ID NO: 584778 - DNA, 25 bp, Mus musculus
ggaagacacgacatgcctgttagca

SEQ ID NO: 584779 - DNA, 25 bp, Mus musculus
ggaagacacgacttgcctgttagca

SEQ ID NO: 584780 - DNA, 25 bp, Mus musculus
ggaagacactaaacacacctcactg

SEQ ID NO: 584781 - DNA, 25 bp, Mus musculus
ggaagacactaatcacacctcactg

SEQ ID NO: 584782 - DNA, 25 bp, Mus musculus
ggaagacactgcacctgacagtaat

SEQ ID NO: 584783 - DNA, 25 bp, Mus musculus
ggaagacactgctcctgacagtaat

SEQ ID NO: 584784 - DNA, 25 bp, Mus musculus
ggaagacactggcacccttactctt

SEQ ID NO: 584785 - DNA, 25 bp, Mus musculus
ggaagacactgggacccttactctt

SEQ ID NO: 584786 - DNA, 25 bp, Mus musculus
ggaagacactgtactccagacttat

SEQ ID NO: 584787 - DNA, 25 bp, Mus musculus
ggaagacactgttctccagacttat

SEQ ID NO: 584788 - DNA, 25 bp, Mus musculus
ggaagacagataattctcctcccgg

SEQ ID NO: 584789 - DNA, 25 bp, Mus musculus
ggaagacagatatttctcctcccgg

SEQ ID NO: 584790 - DNA, 25 bp, Mus musculus
ggaagacagatgaaatactgactgc

SEQ ID NO: 584791 - DNA, 25 bp, Mus musculus
ggaagacagatgtaatactgactgc

SEQ ID NO: 584792 - DNA, 25 bp, Mus musculus
ggaagacagcataattagatacaac

SEQ ID NO: 584793 - DNA, 25 bp, Mus musculus
ggaagacagcattattagatacaac

SEQ ID NO: 584794 - DNA, 25 bp, Mus musculus
ggaagacagccacaggccgcttcaa

SEQ ID NO: 584795 - DNA, 25 bp, Mus musculus
ggaagacagccagaggccgcttcaa

SEQ ID NO: 584796 - DNA, 25 bp, Mus musculus
ggaagacagcccaattcatgtcaga

SEQ ID NO: 584797 - DNA, 25 bp, Mus musculus
ggaagacagcccaggaaatggtcca

SEQ ID NO: 584798 - DNA, 25 bp, Mus musculus
ggaagacagccctattcatgtcaga

SEQ ID NO: 584799 - DNA, 25 bp, Mus musculus
ggaagacagccctggaaatggtcca

SEQ ID NO: 584800 - DNA, 25 bp, Mus musculus
ggaagacagccgatactctcaacaa

SEQ ID NO: 584801 - DNA, 25 bp, Mus musculus
ggaagacagccgttactctcaacaa

SEQ ID NO: 584802 - DNA, 25 bp, Mus musculus
ggaagacagctcagtctacatcttt

SEQ ID NO: 584803 - DNA, 25 bp, Mus musculus
ggaagacagctctgtctacatcttt

SEQ ID NO: 584804 - DNA, 25 bp, Mus musculus
ggaagacaggaaacccagtgagctc

SEQ ID NO: 584805 - DNA, 25 bp, Mus musculus
ggaagacaggaatcccagtgagctc

SEQ ID NO: 584806 - DNA, 25 bp, Mus musculus
ggaagacataagcttgttgcataac

SEQ ID NO: 584807 - DNA, 25 bp, Mus musculus
ggaagacataaggttgttgcataac

SEQ ID NO: 584808 - DNA, 25 bp, Mus musculus
ggaagacatagtcctgcccaggcag

SEQ ID NO: 584809 - DNA, 25 bp, Mus musculus
ggaagacatagtgctgcccaggcag

SEQ ID NO: 584810 - DNA, 25 bp, Mus musculus
ggaagacatcaacacgggacccagg

SEQ ID NO: 584811 - DNA, 25 bp, Mus musculus
ggaagacatcaaccggatccgtgta

SEQ ID NO: 584812 - DNA, 25 bp, Mus musculus
ggaagacatcaagacgggacccagg

SEQ ID NO: 584813 - DNA, 25 bp, Mus musculus
ggaagacatcaagcggatccgtgta

SEQ ID NO: 584814 - DNA, 25 bp, Mus musculus
ggaagacatgaccacaggagtacga

SEQ ID NO: 584815 - DNA, 25 bp, Mus musculus
ggaagacatgacgacaggagtacga

SEQ ID NO: 584816 - DNA, 25 bp, Mus musculus
ggaagacatgtccattacagcttag

SEQ ID NO: 584817 - DNA, 25 bp, Mus musculus
ggaagacatgtcgattacagcttag

SEQ ID NO: 584818 - DNA, 25 bp, Mus musculus
ggaagacatgttaaagctcgcctat

SEQ ID NO: 584819 - DNA, 25 bp, Mus musculus
ggaagacatgtttaagctcgcctat

SEQ ID NO: 584820 - DNA, 25 bp, Mus musculus
ggaagacattccactgtgtttgccc

SEQ ID NO: 584821 - DNA, 25 bp, Mus musculus
ggaagacattcctctgtgtttgccc

SEQ ID NO: 584822 - DNA, 25 bp, Mus musculus
ggaagacattcgagactgagaccat

SEQ ID NO: 584823 - DNA, 25 bp, Mus musculus
ggaagacattcgtgactgagaccat

SEQ ID NO: 584824 - DNA, 25 bp, Mus musculus
ggaagacattggctgaagctctcat

SEQ ID NO: 584825 - DNA, 25 bp, Mus musculus
ggaagacattgggtgaagctctcat

SEQ ID NO: 584826 - DNA, 25 bp, Mus musculus
ggaagaccacatctggaagcaccat

SEQ ID NO: 584827 - DNA, 25 bp, Mus musculus
ggaagaccacatgtggaagcaccat

SEQ ID NO: 584828 - DNA, 25 bp, Mus musculus
ggaagaccacttaatgtaccgccat

SEQ ID NO: 584829 - DNA, 25 bp, Mus musculus
ggaagaccactttatgtaccgccat

SEQ ID NO: 584830 - DNA, 25 bp, Mus musculus
ggaagaccagatcgaccagactcca

SEQ ID NO: 584831 - DNA, 25 bp, Mus musculus
ggaagaccagatggaccagactcca

SEQ ID NO: 584832 - DNA, 25 bp, Mus musculus
ggaagaccaggcatcctctggagat

SEQ ID NO: 584833 - DNA, 25 bp, Mus musculus
ggaagaccaggcttcctctggagat

SEQ ID NO: 584834 - DNA, 25 bp, Mus musculus
ggaagaccatgcatcaccaactgga

SEQ ID NO: 584835 - DNA, 25 bp, Mus musculus
ggaagaccatgcttcaccaactgga

SEQ ID NO: 584836 - DNA, 25 bp, Mus musculus
ggaagaccattcagcagtggaccat

SEQ ID NO: 584837 - DNA, 25 bp, Mus musculus
ggaagaccattccaaccttgaatcg

SEQ ID NO: 584838 - DNA, 25 bp, Mus musculus
ggaagaccattcgaaccttgaatcg

SEQ ID NO: 584839 - DNA, 25 bp, Mus musculus
ggaagaccattctgcagtggaccat

SEQ ID NO: 584840 - DNA, 25 bp, Mus musculus
ggaagacccaacactgtgtgccatg

SEQ ID NO: 584841 - DNA, 25 bp, Mus musculus
ggaagacccaacagtccagcagttg

SEQ ID NO: 584842 - DNA, 25 bp, Mus musculus
ggaagacccaactctgtgtgccatg

SEQ ID NO: 584843 - DNA, 25 bp, Mus musculus
ggaagacccaactgtccagcagttg

SEQ ID NO: 584844 - DNA, 25 bp, Mus musculus
ggaagacccacccatcaggaatggt

SEQ ID NO: 584845 - DNA, 25 bp, Mus musculus
ggaagacccaccgatcaggaatggt

SEQ ID NO: 584846 - DNA, 25 bp, Mus musculus
ggaagacccagcacagagcctttgg

SEQ ID NO: 584847 - DNA, 25 bp, Mus musculus
ggaagacccagcacatatatattca

SEQ ID NO: 584848 - DNA, 25 bp, Mus musculus
ggaagacccagctcagagcctttgg

SEQ ID NO: 584849 - DNA, 25 bp, Mus musculus
ggaagacccagctcatatatattca

SEQ ID NO: 584850 - DNA, 25 bp, Mus musculus
ggaagacccagtccaagagtagaca

SEQ ID NO: 584851 - DNA, 25 bp, Mus musculus
ggaagacccagtgcaagagtagaca

SEQ ID NO: 584852 - DNA, 25 bp, Mus musculus
ggaagaccccaccttaggcaggcca

SEQ ID NO: 584853 - DNA, 25 bp, Mus musculus
ggaagaccccacgttaggcaggcca

SEQ ID NO: 584854 - DNA, 25 bp, Mus musculus
ggaagacccggaaatcagacaaaag

SEQ ID NO: 584855 - DNA, 25 bp, Mus musculus
ggaagacccggatatcagacaaaag

SEQ ID NO: 584856 - DNA, 25 bp, Mus musculus
ggaagacccggcaaaaattgctgta

SEQ ID NO: 584857 - DNA, 25 bp, Mus musculus
ggaagacccggctaaaattgctgta

SEQ ID NO: 584858 - DNA, 25 bp, Mus musculus
ggaagacccgttagagctacttctt

SEQ ID NO: 584859 - DNA, 25 bp, Mus musculus
ggaagacccgtttgagctacttctt

SEQ ID NO: 584860 - DNA, 25 bp, Mus musculus
ggaagaccctgaagactgagtactc

SEQ ID NO: 584861 - DNA, 25 bp, Mus musculus
ggaagaccctgatgactgagtactc

SEQ ID NO: 584862 - DNA, 25 bp, Mus musculus
ggaagaccgtaaatgcatactgaag

SEQ ID NO: 584863 - DNA, 25 bp, Mus musculus
ggaagaccgtaattgcatactgaag

SEQ ID NO: 584864 - DNA, 25 bp, Mus musculus
ggaagacctcagatcctagagctcc

SEQ ID NO: 584865 - DNA, 25 bp, Mus musculus
ggaagacctcagttcctagagctcc

SEQ ID NO: 584866 - DNA, 25 bp, Mus musculus
ggaagacctcccaaacgaatatctt

SEQ ID NO: 584867 - DNA, 25 bp, Mus musculus
ggaagacctccctaacgaatatctt

SEQ ID NO: 584868 - DNA, 25 bp, Mus musculus
ggaagacctccgaagacttacaaat

SEQ ID NO: 584869 - DNA, 25 bp, Mus musculus
ggaagacctccgtagacttacaaat

SEQ ID NO: 584870 - DNA, 25 bp, Mus musculus
ggaagacctgaacagttatgacagt

SEQ ID NO: 584871 - DNA, 25 bp, Mus musculus
ggaagacctgaagagttatgacagt

SEQ ID NO: 584872 - DNA, 25 bp, Mus musculus
ggaagacctgccaggaattggaaac

SEQ ID NO: 584873 - DNA, 25 bp, Mus musculus
ggaagacctgcctggaattggaaac

SEQ ID NO: 584874 - DNA, 25 bp, Mus musculus
ggaagacctgctataaatcggcaac

SEQ ID NO: 584875 - DNA, 25 bp, Mus musculus
ggaagacctgctttaaatcggcaac

SEQ ID NO: 584876 - DNA, 25 bp, Mus musculus
ggaagacctggaatcccaagaacag

SEQ ID NO: 584877 - DNA, 25 bp, Mus musculus
ggaagacctggacggtaaaacagag

SEQ ID NO: 584878 - DNA, 25 bp, Mus musculus
ggaagacctggagggtaaaacagag

SEQ ID NO: 584879 - DNA, 25 bp, Mus musculus
ggaagacctggattcccaagaacag

SEQ ID NO: 584880 - DNA, 25 bp, Mus musculus
ggaagacctggcctagaaactattg

SEQ ID NO: 584881 - DNA, 25 bp, Mus musculus
ggaagacctggcgtagaaactattg

SEQ ID NO: 584882 - DNA, 25 bp, Mus musculus
ggaagacctgttatagctttagtta

SEQ ID NO: 584883 - DNA, 25 bp, Mus musculus
ggaagacctgttttagctttagtta

SEQ ID NO: 584884 - DNA, 25 bp, Mus musculus
ggaagaccttccaataaatgactat

SEQ ID NO: 584885 - DNA, 25 bp, Mus musculus
ggaagaccttccatattgcaaatta

SEQ ID NO: 584886 - DNA, 25 bp, Mus musculus
ggaagaccttcctataaatgactat

SEQ ID NO: 584887 - DNA, 25 bp, Mus musculus
ggaagaccttccttattgcaaatta

SEQ ID NO: 584888 - DNA, 25 bp, Mus musculus
ggaagacgaccaagacagtcaggac

SEQ ID NO: 584889 - DNA, 25 bp, Mus musculus
ggaagacgaccatgacagtcaggac

SEQ ID NO: 584890 - DNA, 25 bp, Mus musculus
ggaagacgactcagtggtccgtgcc

SEQ ID NO: 584891 - DNA, 25 bp, Mus musculus
ggaagacgactctgtggtccgtgcc

SEQ ID NO: 584892 - DNA, 25 bp, Mus musculus
ggaagacgagctctatgcccagaaa

SEQ ID NO: 584893 - DNA, 25 bp, Mus musculus
ggaagacgagctgtatgcccagaaa

SEQ ID NO: 584894 - DNA, 25 bp, Mus musculus
ggaagacgattacccatcatcaaca

SEQ ID NO: 584895 - DNA, 25 bp, Mus musculus
ggaagacgattagccatcatcaaca

SEQ ID NO: 584896 - DNA, 25 bp, Mus musculus
ggaagacgattcctccattgaaaac

SEQ ID NO: 584897 - DNA, 25 bp, Mus musculus
ggaagacgattcgtccattgaaaac

SEQ ID NO: 584898 - DNA, 25 bp, Mus musculus
ggaagacgcaaacagcagccaatta

SEQ ID NO: 584899 - DNA, 25 bp, Mus musculus
ggaagacgcaaagagcagccaatta

SEQ ID NO: 584900 - DNA, 25 bp, Mus musculus
ggaagacgcatccagatctttgtga

SEQ ID NO: 584901 - DNA, 25 bp, Mus musculus
ggaagacgcatccagttaccaccaa

SEQ ID NO: 584902 - DNA, 25 bp, Mus musculus
ggaagacgcatcgagatctttgtga

SEQ ID NO: 584903 - DNA, 25 bp, Mus musculus
ggaagacgcatcgagttaccaccaa

SEQ ID NO: 584904 - DNA, 25 bp, Mus musculus
ggaagacgccggcatctgccttcag

SEQ ID NO: 584905 - DNA, 25 bp, Mus musculus
ggaagacgccgggatctgccttcag

SEQ ID NO: 584906 - DNA, 25 bp, Mus musculus
ggaagacggactctcctctaacggg

SEQ ID NO: 584907 - DNA, 25 bp, Mus musculus
ggaagacggactgtcctctaacggg

SEQ ID NO: 584908 - DNA, 25 bp, Mus musculus
ggaagacggagcactttttcttgaa

SEQ ID NO: 584909 - DNA, 25 bp, Mus musculus
ggaagacggagctctttttcttgaa

SEQ ID NO: 584910 - DNA, 25 bp, Mus musculus
ggaagacgtgcccatccggtaccgt

SEQ ID NO: 584911 - DNA, 25 bp, Mus musculus
ggaagacgtgccgatccggtaccgt

SEQ ID NO: 584912 - DNA, 25 bp, Mus musculus
ggaagactaaaaagttgatttgcta

SEQ ID NO: 584913 - DNA, 25 bp, Mus musculus
ggaagactaaaatgttgatttgcta

SEQ ID NO: 584914 - DNA, 25 bp, Mus musculus
ggaagactaagaccccttgaattct

SEQ ID NO: 584915 - DNA, 25 bp, Mus musculus
ggaagactaagagcccttgaattct

SEQ ID NO: 584916 - DNA, 25 bp, Mus musculus
ggaagactacatctgtgtgcgctgt

SEQ ID NO: 584917 - DNA, 25 bp, Mus musculus
ggaagactacatgtgtgtgcgctgt

SEQ ID NO: 584918 - DNA, 25 bp, Mus musculus
ggaagactacctcaaacagccacta

SEQ ID NO: 584919 - DNA, 25 bp, Mus musculus
ggaagactacctgaaacagccacta

SEQ ID NO: 584920 - DNA, 25 bp, Mus musculus
ggaagactacgtacacagttctttt

SEQ ID NO: 584921 - DNA, 25 bp, Mus musculus
ggaagactacgttcacagttctttt

SEQ ID NO: 584922 - DNA, 25 bp, Mus musculus
ggaagactactacctgacacccgag

SEQ ID NO: 584923 - DNA, 25 bp, Mus musculus
ggaagactactagctgacacccgag

SEQ ID NO: 584924 - DNA, 25 bp, Mus musculus
ggaagactactgaatcacaagcttt

SEQ ID NO: 584925 - DNA, 25 bp, Mus musculus
ggaagactactgcagcatccagagg

SEQ ID NO: 584926 - DNA, 25 bp, Mus musculus
ggaagactactggagcatccagagg

SEQ ID NO: 584927 - DNA, 25 bp, Mus musculus
ggaagactactgtatcacaagcttt

SEQ ID NO: 584928 - DNA, 25 bp, Mus musculus
ggaagactatgaacaggcgatgctg

SEQ ID NO: 584929 - DNA, 25 bp, Mus musculus
ggaagactatgacccgacagatgaa

SEQ ID NO: 584930 - DNA, 25 bp, Mus musculus
ggaagactatgagccgacagatgaa

SEQ ID NO: 584931 - DNA, 25 bp, Mus musculus
ggaagactatgatcaggcgatgctg

SEQ ID NO: 584932 - DNA, 25 bp, Mus musculus
ggaagactatttcacctccacagaa

SEQ ID NO: 584933 - DNA, 25 bp, Mus musculus
ggaagactatttgacctccacagaa

SEQ ID NO: 584934 - DNA, 25 bp, Mus musculus
ggaagactccacagaacaccaaatg

SEQ ID NO: 584935 - DNA, 25 bp, Mus musculus
ggaagactccactgaacaccaaatg

SEQ ID NO: 584936 - DNA, 25 bp, Mus musculus
ggaagactccgccaggacacctgta

SEQ ID NO: 584937 - DNA, 25 bp, Mus musculus
ggaagactccgcgaggacacctgta

SEQ ID NO: 584938 - DNA, 25 bp, Mus musculus
ggaagactcctccatccatgttggg

SEQ ID NO: 584939 - DNA, 25 bp, Mus musculus
ggaagactcctcgatccatgttggg

SEQ ID NO: 584940 - DNA, 25 bp, Mus musculus
ggaagactccttcttgtcatgttat

SEQ ID NO: 584941 - DNA, 25 bp, Mus musculus
ggaagactccttgttgtcatgttat

SEQ ID NO: 584942 - DNA, 25 bp, Mus musculus
ggaagactcggaccgctgtttgact

SEQ ID NO: 584943 - DNA, 25 bp, Mus musculus
ggaagactcggagcgctgtttgact

SEQ ID NO: 584944 - DNA, 25 bp, Mus musculus
ggaagactctgacgacgccgctcca

SEQ ID NO: 584945 - DNA, 25 bp, Mus musculus
ggaagactctgaggacgccgctcca

SEQ ID NO: 584946 - DNA, 25 bp, Mus musculus
ggaagactctgcatcagcaatcctg

SEQ ID NO: 584947 - DNA, 25 bp, Mus musculus
ggaagactctgcttcagcaatcctg

SEQ ID NO: 584948 - DNA, 25 bp, Mus musculus
ggaagactctttagctcatttacaa

SEQ ID NO: 584949 - DNA, 25 bp, Mus musculus
ggaagactcttttgctcatttacaa

SEQ ID NO: 584950 - DNA, 25 bp, Mus musculus
ggaagactgagaccgcctggaaacc

SEQ ID NO: 584951 - DNA, 25 bp, Mus musculus
ggaagactgagagcgcctggaaacc

SEQ ID NO: 584952 - DNA, 25 bp, Mus musculus
ggaagactgaggagactccactcct

SEQ ID NO: 584953 - DNA, 25 bp, Mus musculus
ggaagactgaggtgactccactcct

SEQ ID NO: 584954 - DNA, 25 bp, Mus musculus
ggaagactgattctcggaacacaaa

SEQ ID NO: 584955 - DNA, 25 bp, Mus musculus
ggaagactgattgtcggaacacaaa

SEQ ID NO: 584956 - DNA, 25 bp, Mus musculus
ggaagactgcacagatttgccagct

SEQ ID NO: 584957 - DNA, 25 bp, Mus musculus
ggaagactgcactgatttgccagct

SEQ ID NO: 584958 - DNA, 25 bp, Mus musculus
ggaagactgcttctctagctagccc

SEQ ID NO: 584959 - DNA, 25 bp, Mus musculus
ggaagactgcttgtctagctagccc

SEQ ID NO: 584960 - DNA, 25 bp, Mus musculus
ggaagactggacagcagctactata

SEQ ID NO: 584961 - DNA, 25 bp, Mus musculus
ggaagactggacagccatcaaaaag

SEQ ID NO: 584962 - DNA, 25 bp, Mus musculus
ggaagactggactgcagctactata

SEQ ID NO: 584963 - DNA, 25 bp, Mus musculus
ggaagactggactgccatcaaaaag

SEQ ID NO: 584964 - DNA, 25 bp, Mus musculus
ggaagactggcaagtgcatccttgc

SEQ ID NO: 584965 - DNA, 25 bp, Mus musculus
ggaagactggcacaagcacatctca

SEQ ID NO: 584966 - DNA, 25 bp, Mus musculus
ggaagactggcagaagcacatctca

SEQ ID NO: 584967 - DNA, 25 bp, Mus musculus
ggaagactggcatgtgcatccttgc

SEQ ID NO: 584968 - DNA, 25 bp, Mus musculus
ggaagactggccacaggagtcaaaa

SEQ ID NO: 584969 - DNA, 25 bp, Mus musculus
ggaagactggcctcaggagtcaaaa

SEQ ID NO: 584970 - DNA, 25 bp, Mus musculus
ggaagactggtacatctggaacgat

SEQ ID NO: 584971 - DNA, 25 bp, Mus musculus
ggaagactggtagatctggaacgat

SEQ ID NO: 584972 - DNA, 25 bp, Mus musculus
ggaagactggtcactaactggtttg

SEQ ID NO: 584973 - DNA, 25 bp, Mus musculus
ggaagactggtctctaactggtttg

SEQ ID NO: 584974 - DNA, 25 bp, Mus musculus
ggaagactgtatccttttttcttct

SEQ ID NO: 584975 - DNA, 25 bp, Mus musculus
ggaagactgtatctgtaagatccat

SEQ ID NO: 584976 - DNA, 25 bp, Mus musculus
ggaagactgtatgcttttttcttct

SEQ ID NO: 584977 - DNA, 25 bp, Mus musculus
ggaagactgtatgtgtaagatccat

SEQ ID NO: 584978 - DNA, 25 bp, Mus musculus
ggaagacttaagcaccacacagtaa

SEQ ID NO: 584979 - DNA, 25 bp, Mus musculus
ggaagacttaaggaccacacagtaa

SEQ ID NO: 584980 - DNA, 25 bp, Mus musculus
ggaagacttcaaactgtggcctcca

SEQ ID NO: 584981 - DNA, 25 bp, Mus musculus
ggaagacttcaatctgtggcctcca

SEQ ID NO: 584982 - DNA, 25 bp, Mus musculus
ggaagacttcttattagacaattct

SEQ ID NO: 584983 - DNA, 25 bp, Mus musculus
ggaagacttctttttagacaattct

SEQ ID NO: 584984 - DNA, 25 bp, Mus musculus
ggaagacttgataaacacaggtgac

SEQ ID NO: 584985 - DNA, 25 bp, Mus musculus
ggaagacttgattaacacaggtgac

SEQ ID NO: 584986 - DNA, 25 bp, Mus musculus
ggaagacttggcaacacaaccctgc

SEQ ID NO: 584987 - DNA, 25 bp, Mus musculus
ggaagacttggctacacaaccctgc

SEQ ID NO: 584988 - DNA, 25 bp, Mus musculus
ggaagacttgtactcactttttgaa

SEQ ID NO: 584989 - DNA, 25 bp, Mus musculus
ggaagacttgtagtcactttttgaa

SEQ ID NO: 584990 - DNA, 25 bp, Mus musculus
ggaagactttctattcttattacat

SEQ ID NO: 584991 - DNA, 25 bp, Mus musculus
ggaagactttcttttcttattacat

SEQ ID NO: 584992 - DNA, 25 bp, Mus musculus
ggaagactttgcaagagccgccagc

SEQ ID NO: 584993 - DNA, 25 bp, Mus musculus
ggaagactttgctagagccgccagc

SEQ ID NO: 584994 - DNA, 25 bp, Mus musculus
ggaagactttgtattttcaactctg

SEQ ID NO: 584995 - DNA, 25 bp, Mus musculus
ggaagactttgttttttcaactctg

SEQ ID NO: 584996 - DNA, 25 bp, Mus musculus
ggaagactttttcatcccgctaact

SEQ ID NO: 584997 - DNA, 25 bp, Mus musculus
ggaagactttttgatcccgctaact

SEQ ID NO: 584998 - DNA, 25 bp, Mus musculus
ggaagagaaactcgccgtgttatct

SEQ ID NO: 584999 - DNA, 25 bp, Mus musculus
ggaagagaaactggccgtgttatct

SEQ ID NO: 585000 - DNA, 25 bp, Mus musculus
ggaagagaaagcctctccaaccttt

SEQ ID NO: 585001 - DNA, 25 bp, Mus musculus
ggaagagaaagcgtctccaaccttt

SEQ ID NO: 585002 - DNA, 25 bp, Mus musculus
ggaagagaacatatgaccccatccc

SEQ ID NO: 585003 - DNA, 25 bp, Mus musculus
ggaagagaacatttgaccccatccc

SEQ ID NO: 585004 - DNA, 25 bp, Mus musculus
ggaagagaaccgctcagagcctgaa

SEQ ID NO: 585005 - DNA, 25 bp, Mus musculus
ggaagagaaccggtcagagcctgaa

SEQ ID NO: 585006 - DNA, 25 bp, Mus musculus
ggaagagaacctaaaccggcgcctg

SEQ ID NO: 585007 - DNA, 25 bp, Mus musculus
ggaagagaaccttaaccggcgcctg

SEQ ID NO: 585008 - DNA, 25 bp, Mus musculus
ggaagagaatccagtctgccagcag

SEQ ID NO: 585009 - DNA, 25 bp, Mus musculus
ggaagagaatccctagactccaacc

SEQ ID NO: 585010 - DNA, 25 bp, Mus musculus
ggaagagaatccgtagactccaacc

SEQ ID NO: 585011 - DNA, 25 bp, Mus musculus
ggaagagaatcctgtctgccagcag

SEQ ID NO: 585012 - DNA, 25 bp, Mus musculus
ggaagagacatcagccctagatcca

SEQ ID NO: 585013 - DNA, 25 bp, Mus musculus
ggaagagacatccactcaggagcaa

SEQ ID NO: 585014 - DNA, 25 bp, Mus musculus
ggaagagacatcgactcaggagcaa

SEQ ID NO: 585015 - DNA, 25 bp, Mus musculus
ggaagagacatctgccctagatcca

SEQ ID NO: 585016 - DNA, 25 bp, Mus musculus
ggaagagaccctaccgcacgtgaat

SEQ ID NO: 585017 - DNA, 25 bp, Mus musculus
ggaagagacccttccgcacgtgaat

SEQ ID NO: 585018 - DNA, 25 bp, Mus musculus
ggaagagacctcatgctgcctagca

SEQ ID NO: 585019 - DNA, 25 bp, Mus musculus
ggaagagacctcttgctgcctagca

SEQ ID NO: 585020 - DNA, 25 bp, Mus musculus
ggaagagacctgctgtacctctcgg

SEQ ID NO: 585021 - DNA, 25 bp, Mus musculus
ggaagagacctggtgtacctctcgg

SEQ ID NO: 585022 - DNA, 25 bp, Mus musculus
ggaagagagcgacaagcccctgatt

SEQ ID NO: 585023 - DNA, 25 bp, Mus musculus
ggaagagagcgagaagcccctgatt

SEQ ID NO: 585024 - DNA, 25 bp, Mus musculus
ggaagagagctcaggtaccctgtgc

SEQ ID NO: 585025 - DNA, 25 bp, Mus musculus
ggaagagagctctggtaccctgtgc

SEQ ID NO: 585026 - DNA, 25 bp, Mus musculus
ggaagagagtgtccaaggccactgt

SEQ ID NO: 585027 - DNA, 25 bp, Mus musculus
ggaagagagtgtgcaaggccactgt

SEQ ID NO: 585028 - DNA, 25 bp, Mus musculus
ggaagagatacccacatgagacaaa

SEQ ID NO: 585029 - DNA, 25 bp, Mus musculus
ggaagagataccgacatgagacaaa

SEQ ID NO: 585030 - DNA, 25 bp, Mus musculus
ggaagagatggtacacattttccat

SEQ ID NO: 585031 - DNA, 25 bp, Mus musculus
ggaagagatggttcacattttccat

SEQ ID NO: 585032 - DNA, 25 bp, Mus musculus
ggaagagattgcactgttctcctct

SEQ ID NO: 585033 - DNA, 25 bp, Mus musculus
ggaagagattgctctgttctcctct

SEQ ID NO: 585034 - DNA, 25 bp, Mus musculus
ggaagagcacctccagtcagttcca

SEQ ID NO: 585035 - DNA, 25 bp, Mus musculus
ggaagagcacctgcagtcagttcca

SEQ ID NO: 585036 - DNA, 25 bp, Mus musculus
ggaagagcactaaccatagcctatg

SEQ ID NO: 585037 - DNA, 25 bp, Mus musculus
ggaagagcactatccatagcctatg

SEQ ID NO: 585038 - DNA, 25 bp, Mus musculus
ggaagagcagatcgcctacgccatg

SEQ ID NO: 585039 - DNA, 25 bp, Mus musculus
ggaagagcagatggcctacgccatg

SEQ ID NO: 585040 - DNA, 25 bp, Mus musculus
ggaagagcagccattacacactcat

SEQ ID NO: 585041 - DNA, 25 bp, Mus musculus
ggaagagcagcctttacacactcat

SEQ ID NO: 585042 - DNA, 25 bp, Mus musculus
ggaagagcaggcacatgctgtcgcc

SEQ ID NO: 585043 - DNA, 25 bp, Mus musculus
ggaagagcaggctcatgctgtcgcc

SEQ ID NO: 585044 - DNA, 25 bp, Mus musculus
ggaagagcagtcactcagcagtgct

SEQ ID NO: 585045 - DNA, 25 bp, Mus musculus
ggaagagcagtctctcagcagtgct

SEQ ID NO: 585046 - DNA, 25 bp, Mus musculus
ggaagagccaagcatacacccatct

SEQ ID NO: 585047 - DNA, 25 bp, Mus musculus
ggaagagccaaggatacacccatct

SEQ ID NO: 585048 - DNA, 25 bp, Mus musculus
ggaagagccacaccagtagcggaaa

SEQ ID NO: 585049 - DNA, 25 bp, Mus musculus
ggaagagccacagcagtagcggaaa

SEQ ID NO: 585050 - DNA, 25 bp, Mus musculus
ggaagagccacccagttatttgaaa

SEQ ID NO: 585051 - DNA, 25 bp, Mus musculus
ggaagagccaccgagttatttgaaa

SEQ ID NO: 585052 - DNA, 25 bp, Mus musculus
ggaagagccatgctctgtttctctc

SEQ ID NO: 585053 - DNA, 25 bp, Mus musculus
ggaagagccatggtctgtttctctc

SEQ ID NO: 585054 - DNA, 25 bp, Mus musculus
ggaagagcccagaaccatctggaaa

SEQ ID NO: 585055 - DNA, 25 bp, Mus musculus
ggaagagcccagtaccatctggaaa

SEQ ID NO: 585056 - DNA, 25 bp, Mus musculus
ggaagagccccactatggcacgtgt

SEQ ID NO: 585057 - DNA, 25 bp, Mus musculus
ggaagagccccagtatggcacgtgt

SEQ ID NO: 585058 - DNA, 25 bp, Mus musculus
ggaagagcccggattgtaccttcta

SEQ ID NO: 585059 - DNA, 25 bp, Mus musculus
ggaagagcccggtttgtaccttcta

SEQ ID NO: 585060 - DNA, 25 bp, Mus musculus
ggaagagccctcatgtggcaagcaa

SEQ ID NO: 585061 - DNA, 25 bp, Mus musculus
ggaagagccctcttgtggcaagcaa

SEQ ID NO: 585062 - DNA, 25 bp, Mus musculus
ggaagagcccttatgatcaacttgg

SEQ ID NO: 585063 - DNA, 25 bp, Mus musculus
ggaagagcccttttgatcaacttgg

SEQ ID NO: 585064 - DNA, 25 bp, Mus musculus
ggaagagccgcaagagcacaagcat

SEQ ID NO: 585065 - DNA, 25 bp, Mus musculus
ggaagagccgcatgagcacaagcat

SEQ ID NO: 585066 - DNA, 25 bp, Mus musculus
ggaagagccgctctcctttgatgtt

SEQ ID NO: 585067 - DNA, 25 bp, Mus musculus
ggaagagccgctgtcctttgatgtt

SEQ ID NO: 585068 - DNA, 25 bp, Mus musculus
ggaagagcctcactagtcttacaga

SEQ ID NO: 585069 - DNA, 25 bp, Mus musculus
ggaagagcctcagtagtcttacaga

SEQ ID NO: 585070 - DNA, 25 bp, Mus musculus
ggaagagcctcgagcgatttgaatt

SEQ ID NO: 585071 - DNA, 25 bp, Mus musculus
ggaagagcctcgtgcgatttgaatt

SEQ ID NO: 585072 - DNA, 25 bp, Mus musculus
ggaagagcctctagatggcccaagg

SEQ ID NO: 585073 - DNA, 25 bp, Mus musculus
ggaagagcctcttgatggcccaagg

SEQ ID NO: 585074 - DNA, 25 bp, Mus musculus
ggaagagctcaaccgtttcattact

SEQ ID NO: 585075 - DNA, 25 bp, Mus musculus
ggaagagctcaagcgtttcattact

SEQ ID NO: 585076 - DNA, 25 bp, Mus musculus
ggaagagctctaacggaagtttgca

SEQ ID NO: 585077 - DNA, 25 bp, Mus musculus
ggaagagctctatcggaagtttgca

SEQ ID NO: 585078 - DNA, 25 bp, Mus musculus
ggaagagctgacaccatccacaaag

SEQ ID NO: 585079 - DNA, 25 bp, Mus musculus
ggaagagctgactccatccacaaag

SEQ ID NO: 585080 - DNA, 25 bp, Mus musculus
ggaagagctgcgctccatgttcacg

SEQ ID NO: 585081 - DNA, 25 bp, Mus musculus
ggaagagctgcggtccatgttcacg

SEQ ID NO: 585082 - DNA, 25 bp, Mus musculus
ggaagagctggcatcaacactctga

SEQ ID NO: 585083 - DNA, 25 bp, Mus musculus
ggaagagctggcttcaacactctga

SEQ ID NO: 585084 - DNA, 25 bp, Mus musculus
ggaagagctgggaatctcactcaag

SEQ ID NO: 585085 - DNA, 25 bp, Mus musculus
ggaagagctgggtatctcactcaag

SEQ ID NO: 585086 - DNA, 25 bp, Mus musculus
ggaagagcttaaccgtaaagctgcc

SEQ ID NO: 585087 - DNA, 25 bp, Mus musculus
ggaagagcttaagcgtaaagctgcc

SEQ ID NO: 585088 - DNA, 25 bp, Mus musculus
ggaagaggaatccatacgcctgctt

SEQ ID NO: 585089 - DNA, 25 bp, Mus musculus
ggaagaggaatcgatacgcctgctt

SEQ ID NO: 585090 - DNA, 25 bp, Mus musculus
ggaagaggaggcacacccaactcgg

SEQ ID NO: 585091 - DNA, 25 bp, Mus musculus
ggaagaggaggctcacccaactcgg

SEQ ID NO: 585092 - DNA, 25 bp, Mus musculus
ggaagaggatgaaacctccaataac

SEQ ID NO: 585093 - DNA, 25 bp, Mus musculus
ggaagaggatgatacctccaataac

SEQ ID NO: 585094 - DNA, 25 bp, Mus musculus
ggaagaggcatcagtcactaaccat

SEQ ID NO: 585095 - DNA, 25 bp, Mus musculus
ggaagaggcatctgtcactaaccat

SEQ ID NO: 585096 - DNA, 25 bp, Mus musculus
ggaagaggctgtatacttgagttca

SEQ ID NO: 585097 - DNA, 25 bp, Mus musculus
ggaagaggctgtttacttgagttca

SEQ ID NO: 585098 - DNA, 25 bp, Mus musculus
ggaagagggagccatcacaatgcat

SEQ ID NO: 585099 - DNA, 25 bp, Mus musculus
ggaagagggagcgatcacaatgcat

SEQ ID NO: 585100 - DNA, 25 bp, Mus musculus
ggaagagggcgacgcacccatcaaa

SEQ ID NO: 585101 - DNA, 25 bp, Mus musculus
ggaagagggcgaggcacccatcaaa

SEQ ID NO: 585102 - DNA, 25 bp, Mus musculus
ggaagagggtgcacacctttaccac

SEQ ID NO: 585103 - DNA, 25 bp, Mus musculus
ggaagagggtgctcacctttaccac

SEQ ID NO: 585104 - DNA, 25 bp, Mus musculus
ggaagaggtaagacactggtgccca

SEQ ID NO: 585105 - DNA, 25 bp, Mus musculus
ggaagaggtaagtcactggtgccca

SEQ ID NO: 585106 - DNA, 25 bp, Mus musculus
ggaagaggtcccatattcatctcca

SEQ ID NO: 585107 - DNA, 25 bp, Mus musculus
ggaagaggtcccttattcatctcca

SEQ ID NO: 585108 - DNA, 25 bp, Mus musculus
ggaagaggtgtacctgtccctaaag

SEQ ID NO: 585109 - DNA, 25 bp, Mus musculus
ggaagaggtgtagctgtccctaaag

SEQ ID NO: 585110 - DNA, 25 bp, Mus musculus
ggaagagtactcactccttaagcat

SEQ ID NO: 585111 - DNA, 25 bp, Mus musculus
ggaagagtactctctccttaagcat

SEQ ID NO: 585112 - DNA, 25 bp, Mus musculus
ggaagagtactgctccctgccacat

SEQ ID NO: 585113 - DNA, 25 bp, Mus musculus
ggaagagtactggtccctgccacat

SEQ ID NO: 585114 - DNA, 25 bp, Mus musculus
ggaagagtagtgagctccccatcac

SEQ ID NO: 585115 - DNA, 25 bp, Mus musculus
ggaagagtagtgtgctccccatcac

SEQ ID NO: 585116 - DNA, 25 bp, Mus musculus
ggaagagtatgtcgctcctccccga

SEQ ID NO: 585117 - DNA, 25 bp, Mus musculus
ggaagagtatgtggctcctccccga

SEQ ID NO: 585118 - DNA, 25 bp, Mus musculus
ggaagagtcacaacctttgcaatct

SEQ ID NO: 585119 - DNA, 25 bp, Mus musculus
ggaagagtcacaatctgctcaagat

SEQ ID NO: 585120 - DNA, 25 bp, Mus musculus
ggaagagtcacatcctttgcaatct

SEQ ID NO: 585121 - DNA, 25 bp, Mus musculus
ggaagagtcacattctgctcaagat

SEQ ID NO: 585122 - DNA, 25 bp, Mus musculus
ggaagagtcacgactcaaactgtga

SEQ ID NO: 585123 - DNA, 25 bp, Mus musculus
ggaagagtcacgtctcaaactgtga

SEQ ID NO: 585124 - DNA, 25 bp, Mus musculus
ggaagagtcctaagcgtataacaca

SEQ ID NO: 585125 - DNA, 25 bp, Mus musculus
ggaagagtcctatgcgtataacaca

SEQ ID NO: 585126 - DNA, 25 bp, Mus musculus
ggaagagtcctcacaaagcacgtga

SEQ ID NO: 585127 - DNA, 25 bp, Mus musculus
ggaagagtcctctcaaagcacgtga

SEQ ID NO: 585128 - DNA, 25 bp, Mus musculus
ggaagagtctagctccactcagctc

SEQ ID NO: 585129 - DNA, 25 bp, Mus musculus
ggaagagtctagctttcaaaaactt

SEQ ID NO: 585130 - DNA, 25 bp, Mus musculus
ggaagagtctaggtccactcagctc

SEQ ID NO: 585131 - DNA, 25 bp, Mus musculus
ggaagagtctaggtttcaaaaactt

SEQ ID NO: 585132 - DNA, 25 bp, Mus musculus
ggaagagtctgtctgtacaaagcta

SEQ ID NO: 585133 - DNA, 25 bp, Mus musculus
ggaagagtctgtgtgtacaaagcta

SEQ ID NO: 585134 - DNA, 25 bp, Mus musculus
ggaagagtgcccctcatatacatga

SEQ ID NO: 585135 - DNA, 25 bp, Mus musculus
ggaagagtgcccgtcatatacatga

SEQ ID NO: 585136 - DNA, 25 bp, Mus musculus
ggaagagttacccactattaggaat

SEQ ID NO: 585137 - DNA, 25 bp, Mus musculus
ggaagagttaccgactattaggaat

SEQ ID NO: 585138 - DNA, 25 bp, Mus musculus
ggaagagttcacacaagtctcccag

SEQ ID NO: 585139 - DNA, 25 bp, Mus musculus
ggaagagttcactcaagtctcccag

SEQ ID NO: 585140 - DNA, 25 bp, Mus musculus
ggaagagttctacagagctgctccg

SEQ ID NO: 585141 - DNA, 25 bp, Mus musculus
ggaagagttctagagagctgctccg

SEQ ID NO: 585142 - DNA, 25 bp, Mus musculus
ggaagagttgaaaaacacacattct

SEQ ID NO: 585143 - DNA, 25 bp, Mus musculus
ggaagagttgaataacacacattct

SEQ ID NO: 585144 - DNA, 25 bp, Mus musculus
ggaagagttgtcatactccagaaat

SEQ ID NO: 585145 - DNA, 25 bp, Mus musculus
ggaagagttgtcttactccagaaat

SEQ ID NO: 585146 - DNA, 25 bp, Mus musculus
ggaagataacacaactggtcctagt

SEQ ID NO: 585147 - DNA, 25 bp, Mus musculus
ggaagataacactactggtcctagt

SEQ ID NO: 585148 - DNA, 25 bp, Mus musculus
ggaagataaccaccactttctgtat

SEQ ID NO: 585149 - DNA, 25 bp, Mus musculus
ggaagataaccagcactttctgtat

SEQ ID NO: 585150 - DNA, 25 bp, Mus musculus
ggaagataagaactccctctgggag

SEQ ID NO: 585151 - DNA, 25 bp, Mus musculus
ggaagataagaagtccctctgggag

SEQ ID NO: 585152 - DNA, 25 bp, Mus musculus
ggaagataagatacacacctcccac

SEQ ID NO: 585153 - DNA, 25 bp, Mus musculus
ggaagataagattcacacctcccac

SEQ ID NO: 585154 - DNA, 25 bp, Mus musculus
ggaagataccaccaagtgtcccagc

SEQ ID NO: 585155 - DNA, 25 bp, Mus musculus
ggaagataccacgaagtgtcccagc

SEQ ID NO: 585156 - DNA, 25 bp, Mus musculus
ggaagataccatctacccatcagtt

SEQ ID NO: 585157 - DNA, 25 bp, Mus musculus
ggaagataccatgtacccatcagtt

SEQ ID NO: 585158 - DNA, 25 bp, Mus musculus
ggaagatacccaaagctaacctctg

SEQ ID NO: 585159 - DNA, 25 bp, Mus musculus
ggaagatacccatagctaacctctg

SEQ ID NO: 585160 - DNA, 25 bp, Mus musculus
ggaagatacctgagggacaaccttt

SEQ ID NO: 585161 - DNA, 25 bp, Mus musculus
ggaagatacctgtgggacaaccttt

SEQ ID NO: 585162 - DNA, 25 bp, Mus musculus
ggaagatactctacctttcaccagc

SEQ ID NO: 585163 - DNA, 25 bp, Mus musculus
ggaagatactcttcctttcaccagc

SEQ ID NO: 585164 - DNA, 25 bp, Mus musculus
ggaagatacttgaactcagcatggg

SEQ ID NO: 585165 - DNA, 25 bp, Mus musculus
ggaagatacttgtactcagcatggg

SEQ ID NO: 585166 - DNA, 25 bp, Mus musculus
ggaagatagacacaagcctcagttt

SEQ ID NO: 585167 - DNA, 25 bp, Mus musculus
ggaagatagacagaagcctcagttt

SEQ ID NO: 585168 - DNA, 25 bp, Mus musculus
ggaagatagagtacctgcgccccgg

SEQ ID NO: 585169 - DNA, 25 bp, Mus musculus
ggaagatagagttcctgcgccccgg

SEQ ID NO: 585170 - DNA, 25 bp, Mus musculus
ggaagatagatactgcctttgtata

SEQ ID NO: 585171 - DNA, 25 bp, Mus musculus
ggaagatagatagtgcctttgtata

SEQ ID NO: 585172 - DNA, 25 bp, Mus musculus
ggaagatagccactgttgacccctg

SEQ ID NO: 585173 - DNA, 25 bp, Mus musculus
ggaagatagccagtgttgacccctg

SEQ ID NO: 585174 - DNA, 25 bp, Mus musculus
ggaagataggcacctcatctgtgtc

SEQ ID NO: 585175 - DNA, 25 bp, Mus musculus
ggaagataggcagctcatctgtgtc

SEQ ID NO: 585176 - DNA, 25 bp, Mus musculus
ggaagatagggtccacccttgactc

SEQ ID NO: 585177 - DNA, 25 bp, Mus musculus
ggaagatagggtgcacccttgactc

SEQ ID NO: 585178 - DNA, 25 bp, Mus musculus
ggaagatattgaccgcatggtccaa

SEQ ID NO: 585179 - DNA, 25 bp, Mus musculus
ggaagatattgagcgcatggtccaa

SEQ ID NO: 585180 - DNA, 25 bp, Mus musculus
ggaagatattgccagcctctcccag

SEQ ID NO: 585181 - DNA, 25 bp, Mus musculus
ggaagatattgcgagcctctcccag

SEQ ID NO: 585182 - DNA, 25 bp, Mus musculus
ggaagatcaacaaacgccgtgggaa

SEQ ID NO: 585183 - DNA, 25 bp, Mus musculus
ggaagatcaacatacgccgtgggaa

SEQ ID NO: 585184 - DNA, 25 bp, Mus musculus
ggaagatcacaacttctgaaacact

SEQ ID NO: 585185 - DNA, 25 bp, Mus musculus
ggaagatcacaagttctgaaacact

SEQ ID NO: 585186 - DNA, 25 bp, Mus musculus
ggaagatcacctcctagtttttaac

SEQ ID NO: 585187 - DNA, 25 bp, Mus musculus
ggaagatcacctgctagtttttaac

SEQ ID NO: 585188 - DNA, 25 bp, Mus musculus
ggaagatcagagatctaggctagtc

SEQ ID NO: 585189 - DNA, 25 bp, Mus musculus
ggaagatcagagttctaggctagtc

SEQ ID NO: 585190 - DNA, 25 bp, Mus musculus
ggaagatcatccaattatgtcattt

SEQ ID NO: 585191 - DNA, 25 bp, Mus musculus
ggaagatcatcctattatgtcattt

SEQ ID NO: 585192 - DNA, 25 bp, Mus musculus
ggaagatccactacttcacaggcct

SEQ ID NO: 585193 - DNA, 25 bp, Mus musculus
ggaagatccacttcttcacaggcct

SEQ ID NO: 585194 - DNA, 25 bp, Mus musculus
ggaagatcccatacctaggcttctg

SEQ ID NO: 585195 - DNA, 25 bp, Mus musculus
ggaagatcccattcctaggcttctg

SEQ ID NO: 585196 - DNA, 25 bp, Mus musculus
ggaagatcccttctacatatgctag

SEQ ID NO: 585197 - DNA, 25 bp, Mus musculus
ggaagatcccttgtacatatgctag

SEQ ID NO: 585198 - DNA, 25 bp, Mus musculus
ggaagatccgtaaggccctcaaaca

SEQ ID NO: 585199 - DNA, 25 bp, Mus musculus
ggaagatccgtaatacctattgtga

SEQ ID NO: 585200 - DNA, 25 bp, Mus musculus
ggaagatccgtatggccctcaaaca

SEQ ID NO: 585201 - DNA, 25 bp, Mus musculus
ggaagatccgtattacctattgtga

SEQ ID NO: 585202 - DNA, 25 bp, Mus musculus
ggaagatcctcgcagcttctatgag

SEQ ID NO: 585203 - DNA, 25 bp, Mus musculus
ggaagatcctcggagcttctatgag

SEQ ID NO: 585204 - DNA, 25 bp, Mus musculus
ggaagatcctgacggctgcatacct

SEQ ID NO: 585205 - DNA, 25 bp, Mus musculus
ggaagatcctgagggctgcatacct

SEQ ID NO: 585206 - DNA, 25 bp, Mus musculus
ggaagatcgaaaagtgtacccagaa

SEQ ID NO: 585207 - DNA, 25 bp, Mus musculus
ggaagatcgaaatgtgtacccagaa

SEQ ID NO: 585208 - DNA, 25 bp, Mus musculus
ggaagatctaccacaagctactggg

SEQ ID NO: 585209 - DNA, 25 bp, Mus musculus
ggaagatctacctcaagctactggg

SEQ ID NO: 585210 - DNA, 25 bp, Mus musculus
ggaagatctctgacacctctatgga

SEQ ID NO: 585211 - DNA, 25 bp, Mus musculus
ggaagatctctgtcacctctatgga

SEQ ID NO: 585212 - DNA, 25 bp, Mus musculus
ggaagatctgagattgaagctgcct

SEQ ID NO: 585213 - DNA, 25 bp, Mus musculus
ggaagatctgagtttgaagctgcct

SEQ ID NO: 585214 - DNA, 25 bp, Mus musculus
ggaagatctgctcactaacatcatg

SEQ ID NO: 585215 - DNA, 25 bp, Mus musculus
ggaagatctgctgactaacatcatg

SEQ ID NO: 585216 - DNA, 25 bp, Mus musculus
ggaagatcttttactacagcagtca

SEQ ID NO: 585217 - DNA, 25 bp, Mus musculus
ggaagatctttttctacagcagtca

SEQ ID NO: 585218 - DNA, 25 bp, Mus musculus
ggaagatgatcaccacttggacctc

SEQ ID NO: 585219 - DNA, 25 bp, Mus musculus
ggaagatgatcagcacttggacctc

SEQ ID NO: 585220 - DNA, 25 bp, Mus musculus
ggaagatgatttaataaggtgtatg

SEQ ID NO: 585221 - DNA, 25 bp, Mus musculus
ggaagatgatttcagtacctatatt

SEQ ID NO: 585222 - DNA, 25 bp, Mus musculus
ggaagatgatttgagtacctatatt

SEQ ID NO: 585223 - DNA, 25 bp, Mus musculus
ggaagatgattttataaggtgtatg

SEQ ID NO: 585224 - DNA, 25 bp, Mus musculus
ggaagatgcaagcacctctcctcaa

SEQ ID NO: 585225 - DNA, 25 bp, Mus musculus
ggaagatgcaaggacctctcctcaa

SEQ ID NO: 585226 - DNA, 25 bp, Mus musculus
ggaagatgctagatcttcaggaact

SEQ ID NO: 585227 - DNA, 25 bp, Mus musculus
ggaagatgctagttcttcaggaact

SEQ ID NO: 585228 - DNA, 25 bp, Mus musculus
ggaagatgctttcttttgtgaggta

SEQ ID NO: 585229 - DNA, 25 bp, Mus musculus
ggaagatgctttgttttgtgaggta

SEQ ID NO: 585230 - DNA, 25 bp, Mus musculus
ggaagatggagaccccgttgtcacc

SEQ ID NO: 585231 - DNA, 25 bp, Mus musculus
ggaagatggagagcccgttgtcacc

SEQ ID NO: 585232 - DNA, 25 bp, Mus musculus
ggaagatggcagaagctacgctatt

SEQ ID NO: 585233 - DNA, 25 bp, Mus musculus
ggaagatggcagtagctacgctatt

SEQ ID NO: 585234 - DNA, 25 bp, Mus musculus
ggaagatggccgaatgctgctcata

SEQ ID NO: 585235 - DNA, 25 bp, Mus musculus
ggaagatggccgtatgctgctcata

SEQ ID NO: 585236 - DNA, 25 bp, Mus musculus
ggaagatggctacccctggagtctc

SEQ ID NO: 585237 - DNA, 25 bp, Mus musculus
ggaagatggctagccctggagtctc

SEQ ID NO: 585238 - DNA, 25 bp, Mus musculus
ggaagatggcttaactggcctcaaa

SEQ ID NO: 585239 - DNA, 25 bp, Mus musculus
ggaagatggctttactggcctcaaa

SEQ ID NO: 585240 - DNA, 25 bp, Mus musculus
ggaagatgggacattctcccctctt

SEQ ID NO: 585241 - DNA, 25 bp, Mus musculus
ggaagatgggactttctcccctctt

SEQ ID NO: 585242 - DNA, 25 bp, Mus musculus
ggaagatgtactaactacctaccta

SEQ ID NO: 585243 - DNA, 25 bp, Mus musculus
ggaagatgtacttactacctaccta

SEQ ID NO: 585244 - DNA, 25 bp, Mus musculus
ggaagatgtatcaaacagactttat

SEQ ID NO: 585245 - DNA, 25 bp, Mus musculus
ggaagatgtatctaacagactttat

SEQ ID NO: 585246 - DNA, 25 bp, Mus musculus
ggaagatgtcacactcacacacggt

SEQ ID NO: 585247 - DNA, 25 bp, Mus musculus
ggaagatgtcactctcacacacggt

SEQ ID NO: 585248 - DNA, 25 bp, Mus musculus
ggaagatgtcctcaatacccagtgt

SEQ ID NO: 585249 - DNA, 25 bp, Mus musculus
ggaagatgtcctgaatacccagtgt

SEQ ID NO: 585250 - DNA, 25 bp, Mus musculus
ggaagatgttacactgcaaagctgt

SEQ ID NO: 585251 - DNA, 25 bp, Mus musculus
ggaagatgttactctgcaaagctgt

SEQ ID NO: 585252 - DNA, 25 bp, Mus musculus
ggaagatgttcaccagttatagctc

SEQ ID NO: 585253 - DNA, 25 bp, Mus musculus
ggaagatgttcagcagttatagctc

SEQ ID NO: 585254 - DNA, 25 bp, Mus musculus
ggaagatgttctcaacccagggttg

SEQ ID NO: 585255 - DNA, 25 bp, Mus musculus
ggaagatgttctgaacccagggttg

SEQ ID NO: 585256 - DNA, 25 bp, Mus musculus
ggaagatgtttgatttacctacaag

SEQ ID NO: 585257 - DNA, 25 bp, Mus musculus
ggaagatgtttgttttacctacaag

SEQ ID NO: 585258 - DNA, 25 bp, Mus musculus
ggaagattaaatcctacatgtgtaa

SEQ ID NO: 585259 - DNA, 25 bp, Mus musculus
ggaagattaaatgctacatgtgtaa

SEQ ID NO: 585260 - DNA, 25 bp, Mus musculus
ggaagattactcacaaaattgtttt

SEQ ID NO: 585261 - DNA, 25 bp, Mus musculus
ggaagattactctcaaaattgtttt

SEQ ID NO: 585262 - DNA, 25 bp, Mus musculus
ggaagattactgactgagggcatac

SEQ ID NO: 585263 - DNA, 25 bp, Mus musculus
ggaagattactgtctgagggcatac

SEQ ID NO: 585264 - DNA, 25 bp, Mus musculus
ggaagattatgcaaatccttgttat

SEQ ID NO: 585265 - DNA, 25 bp, Mus musculus
ggaagattatgctaatccttgttat

SEQ ID NO: 585266 - DNA, 25 bp, Mus musculus
ggaagattcagactggacagtgttt

SEQ ID NO: 585267 - DNA, 25 bp, Mus musculus
ggaagattcagagtggacagtgttt

SEQ ID NO: 585268 - DNA, 25 bp, Mus musculus
ggaagattccagcatctcattgtgc

SEQ ID NO: 585269 - DNA, 25 bp, Mus musculus
ggaagattccaggatctcattgtgc

SEQ ID NO: 585270 - DNA, 25 bp, Mus musculus
ggaagattccataccacagctaatc

SEQ ID NO: 585271 - DNA, 25 bp, Mus musculus
ggaagattccattccacagctaatc

SEQ ID NO: 585272 - DNA, 25 bp, Mus musculus
ggaagattcttacgcctttcaggct

SEQ ID NO: 585273 - DNA, 25 bp, Mus musculus
ggaagattcttaggcctttcaggct

SEQ ID NO: 585274 - DNA, 25 bp, Mus musculus
ggaagattgacactgagcatagctc

SEQ ID NO: 585275 - DNA, 25 bp, Mus musculus
ggaagattgacagtgagcatagctc

SEQ ID NO: 585276 - DNA, 25 bp, Mus musculus
ggaagattgccacgcacaactttct

SEQ ID NO: 585277 - DNA, 25 bp, Mus musculus
ggaagattgccaggcacaactttct

SEQ ID NO: 585278 - DNA, 25 bp, Mus musculus
ggaagattgcgtactgagggccacc

SEQ ID NO: 585279 - DNA, 25 bp, Mus musculus
ggaagattgcgttctgagggccacc

SEQ ID NO: 585280 - DNA, 25 bp, Mus musculus
ggaagattggtcactgtcacagccg

SEQ ID NO: 585281 - DNA, 25 bp, Mus musculus
ggaagattggtctctgtcacagccg

SEQ ID NO: 585282 - DNA, 25 bp, Mus musculus
ggaagatttacaacgggcaagcaca

SEQ ID NO: 585283 - DNA, 25 bp, Mus musculus
ggaagatttacatcgggcaagcaca

SEQ ID NO: 585284 - DNA, 25 bp, Mus musculus
ggaagatttacgaagatgccgtcta

SEQ ID NO: 585285 - DNA, 25 bp, Mus musculus
ggaagatttacgtagatgccgtcta

SEQ ID NO: 585286 - DNA, 25 bp, Mus musculus
ggaagatttcatacctgcttcctgc

SEQ ID NO: 585287 - DNA, 25 bp, Mus musculus
ggaagatttcattcctgcttcctgc

SEQ ID NO: 585288 - DNA, 25 bp, Mus musculus
ggaagatttccaaggtttgctctct

SEQ ID NO: 585289 - DNA, 25 bp, Mus musculus
ggaagatttccatggtttgctctct

SEQ ID NO: 585290 - DNA, 25 bp, Mus musculus
ggaagatttggcactagctgaggaa

SEQ ID NO: 585291 - DNA, 25 bp, Mus musculus
ggaagatttggctctagctgaggaa

SEQ ID NO: 585292 - DNA, 25 bp, Mus musculus
ggaagattttaaatacctcagtata

SEQ ID NO: 585293 - DNA, 25 bp, Mus musculus
ggaagattttaattacctcagtata

SEQ ID NO: 585294 - DNA, 25 bp, Mus musculus
ggaagattttgaatatcccaaccca

SEQ ID NO: 585295 - DNA, 25 bp, Mus musculus
ggaagattttgattatcccaaccca

SEQ ID NO: 585296 - DNA, 25 bp, Mus musculus
ggaagcaaagccatagcccttactt

SEQ ID NO: 585297 - DNA, 25 bp, Mus musculus
ggaagcaaagccttagcccttactt

SEQ ID NO: 585298 - DNA, 25 bp, Mus musculus
ggaagcaaagctaacaatgcctttt

SEQ ID NO: 585299 - DNA, 25 bp, Mus musculus
ggaagcaaagcttacaatgcctttt

SEQ ID NO: 585300 - DNA, 25 bp, Mus musculus
ggaagcaaatggactttcagaacag

SEQ ID NO: 585301 - DNA, 25 bp, Mus musculus
ggaagcaaatggtctttcagaacag

SEQ ID NO: 585302 - DNA, 25 bp, Mus musculus
ggaagcaaatttaggttcatacata

SEQ ID NO: 585303 - DNA, 25 bp, Mus musculus
ggaagcaaattttggttcatacata

SEQ ID NO: 585304 - DNA, 25 bp, Mus musculus
ggaagcaacaaacatctctgcccac

SEQ ID NO: 585305 - DNA, 25 bp, Mus musculus
ggaagcaacaaagatctctgcccac

SEQ ID NO: 585306 - DNA, 25 bp, Mus musculus
ggaagcaacggaatcttcagcatgt

SEQ ID NO: 585307 - DNA, 25 bp, Mus musculus
ggaagcaacggattcttcagcatgt

SEQ ID NO: 585308 - DNA, 25 bp, Mus musculus
ggaagcaactgaacgacactctgga

SEQ ID NO: 585309 - DNA, 25 bp, Mus musculus
ggaagcaactgatcgacactctgga

SEQ ID NO: 585310 - DNA, 25 bp, Mus musculus
ggaagcaacttgattcttacctgaa

SEQ ID NO: 585311 - DNA, 25 bp, Mus musculus
ggaagcaacttgtttcttacctgaa

SEQ ID NO: 585312 - DNA, 25 bp, Mus musculus
ggaagcaagcagatttccatgacct

SEQ ID NO: 585313 - DNA, 25 bp, Mus musculus
ggaagcaagcagttttccatgacct

SEQ ID NO: 585314 - DNA, 25 bp, Mus musculus
ggaagcaaggaactagttccctcca

SEQ ID NO: 585315 - DNA, 25 bp, Mus musculus
ggaagcaaggaagtagttccctcca

SEQ ID NO: 585316 - DNA, 25 bp, Mus musculus
ggaagcaaggtcagtcaaacattct

SEQ ID NO: 585317 - DNA, 25 bp, Mus musculus
ggaagcaaggtctgtcaaacattct

SEQ ID NO: 585318 - DNA, 25 bp, Mus musculus
ggaagcaagtcacagtgtggtccct

SEQ ID NO: 585319 - DNA, 25 bp, Mus musculus
ggaagcaagtcagagtgtggtccct

SEQ ID NO: 585320 - DNA, 25 bp, Mus musculus
ggaagcaagtgtcctcttaattgac

SEQ ID NO: 585321 - DNA, 25 bp, Mus musculus
ggaagcaagtgtgctcttaattgac

SEQ ID NO: 585322 - DNA, 25 bp, Mus musculus
ggaagcaagttaccttctgggcaaa

SEQ ID NO: 585323 - DNA, 25 bp, Mus musculus
ggaagcaagttagcttctgggcaaa

SEQ ID NO: 585324 - DNA, 25 bp, Mus musculus
ggaagcaagttccttgtgaaactct

SEQ ID NO: 585325 - DNA, 25 bp, Mus musculus
ggaagcaagttcgttgtgaaactct

SEQ ID NO: 585326 - DNA, 25 bp, Mus musculus
ggaagcaatcccaagtactgcagaa

SEQ ID NO: 585327 - DNA, 25 bp, Mus musculus
ggaagcaatccctagtactgcagaa

SEQ ID NO: 585328 - DNA, 25 bp, Mus musculus
ggaagcaattccattggccctaaag

SEQ ID NO: 585329 - DNA, 25 bp, Mus musculus
ggaagcaattcctttggccctaaag

SEQ ID NO: 585330 - DNA, 25 bp, Mus musculus
ggaagcaatttactgtctgggagaa

SEQ ID NO: 585331 - DNA, 25 bp, Mus musculus
ggaagcaatttagtgtctgggagaa

SEQ ID NO: 585332 - DNA, 25 bp, Mus musculus
ggaagcacaactcggccctgttcta

SEQ ID NO: 585333 - DNA, 25 bp, Mus musculus
ggaagcacaactgggccctgttcta

SEQ ID NO: 585334 - DNA, 25 bp, Mus musculus
ggaagcacaagtctgtaatctcaaa

SEQ ID NO: 585335 - DNA, 25 bp, Mus musculus
ggaagcacaagtgtgtaatctcaaa

SEQ ID NO: 585336 - DNA, 25 bp, Mus musculus
ggaagcacaattctacccgagacta

SEQ ID NO: 585337 - DNA, 25 bp, Mus musculus
ggaagcacaattgtacccgagacta

SEQ ID NO: 585338 - DNA, 25 bp, Mus musculus
ggaagcacacccactcatatgtgga

SEQ ID NO: 585339 - DNA, 25 bp, Mus musculus
ggaagcacaccctctcatatgtgga

SEQ ID NO: 585340 - DNA, 25 bp, Mus musculus
ggaagcacagctaagcctggatgtt

SEQ ID NO: 585341 - DNA, 25 bp, Mus musculus
ggaagcacagcttagcctggatgtt

SEQ ID NO: 585342 - DNA, 25 bp, Mus musculus
ggaagcacagtcataaacctggtcc

SEQ ID NO: 585343 - DNA, 25 bp, Mus musculus
ggaagcacagtcttaaacctggtcc

SEQ ID NO: 585344 - DNA, 25 bp, Mus musculus
ggaagcacagttaatgatctcagtt

SEQ ID NO: 585345 - DNA, 25 bp, Mus musculus
ggaagcacagtttatgatctcagtt

SEQ ID NO: 585346 - DNA, 25 bp, Mus musculus
ggaagcacatacctttagcccagca

SEQ ID NO: 585347 - DNA, 25 bp, Mus musculus
ggaagcacatacgtttagcccagca

SEQ ID NO: 585348 - DNA, 25 bp, Mus musculus
ggaagcaccagtagaggctcccatc

SEQ ID NO: 585349 - DNA, 25 bp, Mus musculus
ggaagcaccagtccagttgcagcta

SEQ ID NO: 585350 - DNA, 25 bp, Mus musculus
ggaagcaccagtcctgagacttgat

SEQ ID NO: 585351 - DNA, 25 bp, Mus musculus
ggaagcaccagtgcagttgcagcta

SEQ ID NO: 585352 - DNA, 25 bp, Mus musculus
ggaagcaccagtgctgagacttgat

SEQ ID NO: 585353 - DNA, 25 bp, Mus musculus
ggaagcaccagttgaggctcccatc

SEQ ID NO: 585354 - DNA, 25 bp, Mus musculus
ggaagcacccaacaactaactaact

SEQ ID NO: 585355 - DNA, 25 bp, Mus musculus
ggaagcacccaagaactaactaact

SEQ ID NO: 585356 - DNA, 25 bp, Mus musculus
ggaagcacccagataacgtggactt

SEQ ID NO: 585357 - DNA, 25 bp, Mus musculus
ggaagcacccagttaacgtggactt

SEQ ID NO: 585358 - DNA, 25 bp, Mus musculus
ggaagcaccccaacgtgaacaagta

SEQ ID NO: 585359 - DNA, 25 bp, Mus musculus
ggaagcaccccatcgtgaacaagta

SEQ ID NO: 585360 - DNA, 25 bp, Mus musculus
ggaagcaccccccattggacaaagg

SEQ ID NO: 585361 - DNA, 25 bp, Mus musculus
ggaagcacccccgattggacaaagg

SEQ ID NO: 585362 - DNA, 25 bp, Mus musculus
ggaagcaccgttcttgtaactaagc

SEQ ID NO: 585363 - DNA, 25 bp, Mus musculus
ggaagcaccgttgttgtaactaagc

SEQ ID NO: 585364 - DNA, 25 bp, Mus musculus
ggaagcacctgcatgtatcaccatc

SEQ ID NO: 585365 - DNA, 25 bp, Mus musculus
ggaagcacctgcttgtatcaccatc

SEQ ID NO: 585366 - DNA, 25 bp, Mus musculus
ggaagcacgtgcaggtcctggccaa

SEQ ID NO: 585367 - DNA, 25 bp, Mus musculus
ggaagcacgtgctggtcctggccaa

SEQ ID NO: 585368 - DNA, 25 bp, Mus musculus
ggaagcacgtggactacacaagatt

SEQ ID NO: 585369 - DNA, 25 bp, Mus musculus
ggaagcacgtggtctacacaagatt

SEQ ID NO: 585370 - DNA, 25 bp, Mus musculus
ggaagcacgttacctgtcatagcaa

SEQ ID NO: 585371 - DNA, 25 bp, Mus musculus
ggaagcacgttagctgtcatagcaa

SEQ ID NO: 585372 - DNA, 25 bp, Mus musculus
ggaagcactcttactctctatttgt

SEQ ID NO: 585373 - DNA, 25 bp, Mus musculus
ggaagcactctttctctctatttgt

SEQ ID NO: 585374 - DNA, 25 bp, Mus musculus
ggaagcactgatcaattattctacc

SEQ ID NO: 585375 - DNA, 25 bp, Mus musculus
ggaagcactgatgaattattctacc

SEQ ID NO: 585376 - DNA, 25 bp, Mus musculus
ggaagcactgcacactgggcatctc

SEQ ID NO: 585377 - DNA, 25 bp, Mus musculus
ggaagcactgcagactgggcatctc

SEQ ID NO: 585378 - DNA, 25 bp, Mus musculus
ggaagcactggtacgaagaaaggcc

SEQ ID NO: 585379 - DNA, 25 bp, Mus musculus
ggaagcactggttcgaagaaaggcc

SEQ ID NO: 585380 - DNA, 25 bp, Mus musculus
ggaagcacttcactgtctgagccat

SEQ ID NO: 585381 - DNA, 25 bp, Mus musculus
ggaagcacttcagtgtctgagccat

SEQ ID NO: 585382 - DNA, 25 bp, Mus musculus
ggaagcacttcccactttttcacac

SEQ ID NO: 585383 - DNA, 25 bp, Mus musculus
ggaagcacttccgactttttcacac

SEQ ID NO: 585384 - DNA, 25 bp, Mus musculus
ggaagcacttgcaggctgccaagga

SEQ ID NO: 585385 - DNA, 25 bp, Mus musculus
ggaagcacttgctggctgccaagga

SEQ ID NO: 585386 - DNA, 25 bp, Mus musculus
ggaagcacttttaaccaccaagcca

SEQ ID NO: 585387 - DNA, 25 bp, Mus musculus
ggaagcactttttaccaccaagcca

SEQ ID NO: 585388 - DNA, 25 bp, Mus musculus
ggaagcagaccgatcacgttctaaa

SEQ ID NO: 585389 - DNA, 25 bp, Mus musculus
ggaagcagaccgttcacgttctaaa

SEQ ID NO: 585390 - DNA, 25 bp, Mus musculus
ggaagcagacgtatcaaaggctcta

SEQ ID NO: 585391 - DNA, 25 bp, Mus musculus
ggaagcagacgtttcaaaggctcta

SEQ ID NO: 585392 - DNA, 25 bp, Mus musculus
ggaagcagactgagttctacatgga

SEQ ID NO: 585393 - DNA, 25 bp, Mus musculus
ggaagcagactgcatttgtatattt

SEQ ID NO: 585394 - DNA, 25 bp, Mus musculus
ggaagcagactggatttgtatattt

SEQ ID NO: 585395 - DNA, 25 bp, Mus musculus
ggaagcagactgtgttctacatgga

SEQ ID NO: 585396 - DNA, 25 bp, Mus musculus
ggaagcagacttaggcatgcctcta

SEQ ID NO: 585397 - DNA, 25 bp, Mus musculus
ggaagcagactttggcatgcctcta

SEQ ID NO: 585398 - DNA, 25 bp, Mus musculus
ggaagcagagacatggttcagccca

SEQ ID NO: 585399 - DNA, 25 bp, Mus musculus
ggaagcagagacttggttcagccca

SEQ ID NO: 585400 - DNA, 25 bp, Mus musculus
ggaagcagagcaatgatacttgttt

SEQ ID NO: 585401 - DNA, 25 bp, Mus musculus
ggaagcagagcattgatacttgttt

SEQ ID NO: 585402 - DNA, 25 bp, Mus musculus
ggaagcagagctcttgtcttgcctt

SEQ ID NO: 585403 - DNA, 25 bp, Mus musculus
ggaagcagagctgttgtcttgcctt

SEQ ID NO: 585404 - DNA, 25 bp, Mus musculus
ggaagcagagtaacacttacctagt

SEQ ID NO: 585405 - DNA, 25 bp, Mus musculus
ggaagcagagtatcacttacctagt

SEQ ID NO: 585406 - DNA, 25 bp, Mus musculus
ggaagcagcaacatccaatgtattt

SEQ ID NO: 585407 - DNA, 25 bp, Mus musculus
ggaagcagcaacttccaatgtattt

SEQ ID NO: 585408 - DNA, 25 bp, Mus musculus
ggaagcagcactcaaagcccctgat

SEQ ID NO: 585409 - DNA, 25 bp, Mus musculus
ggaagcagcactgaaagcccctgat

SEQ ID NO: 585410 - DNA, 25 bp, Mus musculus
ggaagcagcataatcagtatttgga

SEQ ID NO: 585411 - DNA, 25 bp, Mus musculus
ggaagcagcatattcagtatttgga

SEQ ID NO: 585412 - DNA, 25 bp, Mus musculus
ggaagcagccacagaaactccttat

SEQ ID NO: 585413 - DNA, 25 bp, Mus musculus
ggaagcagccactgaaactccttat

SEQ ID NO: 585414 - DNA, 25 bp, Mus musculus
ggaagcagccatcaaccggaagaga

SEQ ID NO: 585415 - DNA, 25 bp, Mus musculus
ggaagcagccatgaaccggaagaga

SEQ ID NO: 585416 - DNA, 25 bp, Mus musculus
ggaagcagcgacaagaacatttctt

SEQ ID NO: 585417 - DNA, 25 bp, Mus musculus
ggaagcagcgactagaacatttctt

SEQ ID NO: 585418 - DNA, 25 bp, Mus musculus
ggaagcagctacaacctacagtggg

SEQ ID NO: 585419 - DNA, 25 bp, Mus musculus
ggaagcagctactacctacagtggg

SEQ ID NO: 585420 - DNA, 25 bp, Mus musculus
ggaagcagctagattcggctctggc

SEQ ID NO: 585421 - DNA, 25 bp, Mus musculus
ggaagcagctagtttcggctctggc

SEQ ID NO: 585422 - DNA, 25 bp, Mus musculus
ggaagcagctcaccaaaggcctctg

SEQ ID NO: 585423 - DNA, 25 bp, Mus musculus
ggaagcagctcagcaaaggcctctg

SEQ ID NO: 585424 - DNA, 25 bp, Mus musculus
ggaagcagctccaagaccatggcag

SEQ ID NO: 585425 - DNA, 25 bp, Mus musculus
ggaagcagctccattcagccttggg

SEQ ID NO: 585426 - DNA, 25 bp, Mus musculus
ggaagcagctcctagaccatggcag

SEQ ID NO: 585427 - DNA, 25 bp, Mus musculus
ggaagcagctcctttcagccttggg

SEQ ID NO: 585428 - DNA, 25 bp, Mus musculus
ggaagcagctctagtgcagcaggaa

SEQ ID NO: 585429 - DNA, 25 bp, Mus musculus
ggaagcagctcttgtgcagcaggaa

SEQ ID NO: 585430 - DNA, 25 bp, Mus musculus
ggaagcagctgcagatacctcaggc

SEQ ID NO: 585431 - DNA, 25 bp, Mus musculus
ggaagcagctgctgatacctcaggc

SEQ ID NO: 585432 - DNA, 25 bp, Mus musculus
ggaagcaggaacatctcctcaatgt

SEQ ID NO: 585433 - DNA, 25 bp, Mus musculus
ggaagcaggaacttctcctcaatgt

SEQ ID NO: 585434 - DNA, 25 bp, Mus musculus
ggaagcaggaccagtaagggacctt

SEQ ID NO: 585435 - DNA, 25 bp, Mus musculus
ggaagcaggacctgtaagggacctt

SEQ ID NO: 585436 - DNA, 25 bp, Mus musculus
ggaagcaggagtactatgcccgagt

SEQ ID NO: 585437 - DNA, 25 bp, Mus musculus
ggaagcaggagttctatgcccgagt

SEQ ID NO: 585438 - DNA, 25 bp, Mus musculus
ggaagcaggtctcagttcacatctc

SEQ ID NO: 585439 - DNA, 25 bp, Mus musculus
ggaagcaggtctgagttcacatctc

SEQ ID NO: 585440 - DNA, 25 bp, Mus musculus
ggaagcagtagtcacgaatcggtta

SEQ ID NO: 585441 - DNA, 25 bp, Mus musculus
ggaagcagtagtgacgaatcggtta

SEQ ID NO: 585442 - DNA, 25 bp, Mus musculus
ggaagcagtattcagctagcagcct

SEQ ID NO: 585443 - DNA, 25 bp, Mus musculus
ggaagcagtattgagctagcagcct

SEQ ID NO: 585444 - DNA, 25 bp, Mus musculus
ggaagcagtctccttaaatgctgta

SEQ ID NO: 585445 - DNA, 25 bp, Mus musculus
ggaagcagtctcgttaaatgctgta

SEQ ID NO: 585446 - DNA, 25 bp, Mus musculus
ggaagcagtggcaatcatctcggcc

SEQ ID NO: 585447 - DNA, 25 bp, Mus musculus
ggaagcagtggcagagtttactttt

SEQ ID NO: 585448 - DNA, 25 bp, Mus musculus
ggaagcagtggctatcatctcggcc

SEQ ID NO: 585449 - DNA, 25 bp, Mus musculus
ggaagcagtggctgagtttactttt

SEQ ID NO: 585450 - DNA, 25 bp, Mus musculus
ggaagcagtgttatgaccagacctg

SEQ ID NO: 585451 - DNA, 25 bp, Mus musculus
ggaagcagtgttttgaccagacctg

SEQ ID NO: 585452 - DNA, 25 bp, Mus musculus
ggaagcagttctccccatttaaatg

SEQ ID NO: 585453 - DNA, 25 bp, Mus musculus
ggaagcagttctgcccatttaaatg

SEQ ID NO: 585454 - DNA, 25 bp, Mus musculus
ggaagcataattacttgcctttcat

SEQ ID NO: 585455 - DNA, 25 bp, Mus musculus
ggaagcataatttcttgcctttcat

SEQ ID NO: 585456 - DNA, 25 bp, Mus musculus
ggaagcatcaccatagcaaccctag

SEQ ID NO: 585457 - DNA, 25 bp, Mus musculus
ggaagcatcaccttagcaaccctag

SEQ ID NO: 585458 - DNA, 25 bp, Mus musculus
ggaagcatccaactgaaatactctt

SEQ ID NO: 585459 - DNA, 25 bp, Mus musculus
ggaagcatccaagtgaaatactctt

SEQ ID NO: 585460 - DNA, 25 bp, Mus musculus
ggaagcatccagctttaagaaacga

SEQ ID NO: 585461 - DNA, 25 bp, Mus musculus
ggaagcatccaggtttaagaaacga

SEQ ID NO: 585462 - DNA, 25 bp, Mus musculus
ggaagcatcccaatcttactttgta

SEQ ID NO: 585463 - DNA, 25 bp, Mus musculus
ggaagcatcccattcttactttgta

SEQ ID NO: 585464 - DNA, 25 bp, Mus musculus
ggaagcatcctaaatcttttcattc

SEQ ID NO: 585465 - DNA, 25 bp, Mus musculus
ggaagcatcctaagtttccttcatg

SEQ ID NO: 585466 - DNA, 25 bp, Mus musculus
ggaagcatcctactcgggataacat

SEQ ID NO: 585467 - DNA, 25 bp, Mus musculus
ggaagcatcctagtcgggataacat

SEQ ID NO: 585468 - DNA, 25 bp, Mus musculus
ggaagcatcctatatcttttcattc

SEQ ID NO: 585469 - DNA, 25 bp, Mus musculus
ggaagcatcctatgtttccttcatg

SEQ ID NO: 585470 - DNA, 25 bp, Mus musculus
ggaagcatcgcgaattccacccaag

SEQ ID NO: 585471 - DNA, 25 bp, Mus musculus
ggaagcatcgcgtattccacccaag

SEQ ID NO: 585472 - DNA, 25 bp, Mus musculus
ggaagcatctggcagactgctcctc

SEQ ID NO: 585473 - DNA, 25 bp, Mus musculus
ggaagcatctgggagactgctcctc

SEQ ID NO: 585474 - DNA, 25 bp, Mus musculus
ggaagcatgagcacttaccaggcaa

SEQ ID NO: 585475 - DNA, 25 bp, Mus musculus
ggaagcatgagctcttaccaggcaa

SEQ ID NO: 585476 - DNA, 25 bp, Mus musculus
ggaagcatgatccttctgattaaga

SEQ ID NO: 585477 - DNA, 25 bp, Mus musculus
ggaagcatgatcgttctgattaaga

SEQ ID NO: 585478 - DNA, 25 bp, Mus musculus
ggaagcatgcatattttgcacttgc

SEQ ID NO: 585479 - DNA, 25 bp, Mus musculus
ggaagcatgcattttttgcacttgc

SEQ ID NO: 585480 - DNA, 25 bp, Mus musculus
ggaagcatgctcctcttacacgttt

SEQ ID NO: 585481 - DNA, 25 bp, Mus musculus
ggaagcatgctcgtcttacacgttt

SEQ ID NO: 585482 - DNA, 25 bp, Mus musculus
ggaagcatgtacacacctgcgtgaa

SEQ ID NO: 585483 - DNA, 25 bp, Mus musculus
ggaagcatgtactcacctgcgtgaa

SEQ ID NO: 585484 - DNA, 25 bp, Mus musculus
ggaagcatgtatactcacacttata

SEQ ID NO: 585485 - DNA, 25 bp, Mus musculus
ggaagcatgtattctcacacttata

SEQ ID NO: 585486 - DNA, 25 bp, Mus musculus
ggaagcatgttcatttaccctagta

SEQ ID NO: 585487 - DNA, 25 bp, Mus musculus
ggaagcatgttcttttaccctagta

SEQ ID NO: 585488 - DNA, 25 bp, Mus musculus
ggaagcattagaccactgacacatt

SEQ ID NO: 585489 - DNA, 25 bp, Mus musculus
ggaagcattagagcactgacacatt

SEQ ID NO: 585490 - DNA, 25 bp, Mus musculus
ggaagcattcctattgaaactgtta

SEQ ID NO: 585491 - DNA, 25 bp, Mus musculus
ggaagcattccttttgaaactgtta

SEQ ID NO: 585492 - DNA, 25 bp, Mus musculus
ggaagcattctgcttatcacaaaat

SEQ ID NO: 585493 - DNA, 25 bp, Mus musculus
ggaagcattctggttatcacaaaat

SEQ ID NO: 585494 - DNA, 25 bp, Mus musculus
ggaagcatttggatcgacatataac

SEQ ID NO: 585495 - DNA, 25 bp, Mus musculus
ggaagcatttggttcgacatataac

SEQ ID NO: 585496 - DNA, 25 bp, Mus musculus
ggaagcattttacccacaaattcaa

SEQ ID NO: 585497 - DNA, 25 bp, Mus musculus
ggaagcattttagccacaaattcaa

SEQ ID NO: 585498 - DNA, 25 bp, Mus musculus
ggaagccaaaagactcaggcctcag

SEQ ID NO: 585499 - DNA, 25 bp, Mus musculus
ggaagccaaaagcatctcactgcca

SEQ ID NO: 585500 - DNA, 25 bp, Mus musculus
ggaagccaaaaggatctcactgcca

SEQ ID NO: 585501 - DNA, 25 bp, Mus musculus
ggaagccaaaagtctcaggcctcag

SEQ ID NO: 585502 - DNA, 25 bp, Mus musculus
ggaagccaaagcctgttacagatgt

SEQ ID NO: 585503 - DNA, 25 bp, Mus musculus
ggaagccaaagcgtgttacagatgt

SEQ ID NO: 585504 - DNA, 25 bp, Mus musculus
ggaagccaacagacatggccgcagt

SEQ ID NO: 585505 - DNA, 25 bp, Mus musculus
ggaagccaacagtcatggccgcagt

SEQ ID NO: 585506 - DNA, 25 bp, Mus musculus
ggaagccaactaagactcggtcaaa

SEQ ID NO: 585507 - DNA, 25 bp, Mus musculus
ggaagccaactatgactcggtcaaa

SEQ ID NO: 585508 - DNA, 25 bp, Mus musculus
ggaagccaagttcggatcccattga

SEQ ID NO: 585509 - DNA, 25 bp, Mus musculus
ggaagccaagttgggatcccattga

SEQ ID NO: 585510 - DNA, 25 bp, Mus musculus
ggaagccaatataagactccccaca

SEQ ID NO: 585511 - DNA, 25 bp, Mus musculus
ggaagccaatattagactccccaca

SEQ ID NO: 585512 - DNA, 25 bp, Mus musculus
ggaagccaatttcctgaacgtcccg

SEQ ID NO: 585513 - DNA, 25 bp, Mus musculus
ggaagccaatttgctgaacgtcccg

SEQ ID NO: 585514 - DNA, 25 bp, Mus musculus
ggaagccacaagagcagccgattaa

SEQ ID NO: 585515 - DNA, 25 bp, Mus musculus
ggaagccacaagtgcagccgattaa

SEQ ID NO: 585516 - DNA, 25 bp, Mus musculus
ggaagccacaccctagcttacagaa

SEQ ID NO: 585517 - DNA, 25 bp, Mus musculus
ggaagccacaccgtagcttacagaa

SEQ ID NO: 585518 - DNA, 25 bp, Mus musculus
ggaagccacagaatgcaaacccagg

SEQ ID NO: 585519 - DNA, 25 bp, Mus musculus
ggaagccacagattgcaaacccagg

SEQ ID NO: 585520 - DNA, 25 bp, Mus musculus
ggaagccacatacgctctagttttc

SEQ ID NO: 585521 - DNA, 25 bp, Mus musculus
ggaagccacataggctctagttttc

SEQ ID NO: 585522 - DNA, 25 bp, Mus musculus
ggaagccacattactaaagaggtca

SEQ ID NO: 585523 - DNA, 25 bp, Mus musculus
ggaagccacatttctaaagaggtca

SEQ ID NO: 585524 - DNA, 25 bp, Mus musculus
ggaagccaccagcaatgctttctaa

SEQ ID NO: 585525 - DNA, 25 bp, Mus musculus
ggaagccaccaggaatgctttctaa

SEQ ID NO: 585526 - DNA, 25 bp, Mus musculus
ggaagccaccttaacattagcctgg

SEQ ID NO: 585527 - DNA, 25 bp, Mus musculus
ggaagccacctttacattagcctgg

SEQ ID NO: 585528 - DNA, 25 bp, Mus musculus
ggaagccactggattcgttacttgc

SEQ ID NO: 585529 - DNA, 25 bp, Mus musculus
ggaagccactggtttcgttacttgc

SEQ ID NO: 585530 - DNA, 25 bp, Mus musculus
ggaagccagaatataggttctcgaa

SEQ ID NO: 585531 - DNA, 25 bp, Mus musculus
ggaagccagaatttaggttctcgaa

SEQ ID NO: 585532 - DNA, 25 bp, Mus musculus
ggaagccagcctaagcatgtacagc

SEQ ID NO: 585533 - DNA, 25 bp, Mus musculus
ggaagccagccttagcatgtacagc

SEQ ID NO: 585534 - DNA, 25 bp, Mus musculus
ggaagccagctcaaatgggacgtct

SEQ ID NO: 585535 - DNA, 25 bp, Mus musculus
ggaagccagctctaatgggacgtct

SEQ ID NO: 585536 - DNA, 25 bp, Mus musculus
ggaagccaggcaagaaatagtctgt

SEQ ID NO: 585537 - DNA, 25 bp, Mus musculus
ggaagccaggcatgaaatagtctgt

SEQ ID NO: 585538 - DNA, 25 bp, Mus musculus
ggaagccaggtacccaagtgataca

SEQ ID NO: 585539 - DNA, 25 bp, Mus musculus
ggaagccaggtagccaagtgataca

SEQ ID NO: 585540 - DNA, 25 bp, Mus musculus
ggaagccagtaacagcaccacacac

SEQ ID NO: 585541 - DNA, 25 bp, Mus musculus
ggaagccagtaagagcaccacacac

SEQ ID NO: 585542 - DNA, 25 bp, Mus musculus
ggaagccagtccacctgagtatctg

SEQ ID NO: 585543 - DNA, 25 bp, Mus musculus
ggaagccagtccctaacaatgaaaa

SEQ ID NO: 585544 - DNA, 25 bp, Mus musculus
ggaagccagtccgtaacaatgaaaa

SEQ ID NO: 585545 - DNA, 25 bp, Mus musculus
ggaagccagtcctcctgagtatctg

SEQ ID NO: 585546 - DNA, 25 bp, Mus musculus
ggaagccagtgacccagttgataaa

SEQ ID NO: 585547 - DNA, 25 bp, Mus musculus
ggaagccagtgagccagttgataaa

SEQ ID NO: 585548 - DNA, 25 bp, Mus musculus
ggaagccagtttacatagacccatc

SEQ ID NO: 585549 - DNA, 25 bp, Mus musculus
ggaagccagttttcatagacccatc

SEQ ID NO: 585550 - DNA, 25 bp, Mus musculus
ggaagccatagcacagtaaatttga

SEQ ID NO: 585551 - DNA, 25 bp, Mus musculus
ggaagccatagctcagtaaatttga

SEQ ID NO: 585552 - DNA, 25 bp, Mus musculus
ggaagccatcacacgtagattcaat

SEQ ID NO: 585553 - DNA, 25 bp, Mus musculus
ggaagccatcactcgtagattcaat

SEQ ID NO: 585554 - DNA, 25 bp, Mus musculus
ggaagccatcatcgcatccatgcag

SEQ ID NO: 585555 - DNA, 25 bp, Mus musculus
ggaagccatcatggcatccatgcag

SEQ ID NO: 585556 - DNA, 25 bp, Mus musculus
ggaagccatcccagaagaagtatac

SEQ ID NO: 585557 - DNA, 25 bp, Mus musculus
ggaagccatccctgaagaagtatac

SEQ ID NO: 585558 - DNA, 25 bp, Mus musculus
ggaagccatcctcaccaataataaa

SEQ ID NO: 585559 - DNA, 25 bp, Mus musculus
ggaagccatcctgaccaataataaa

SEQ ID NO: 585560 - DNA, 25 bp, Mus musculus
ggaagccatcttcatcagtacatgt

SEQ ID NO: 585561 - DNA, 25 bp, Mus musculus
ggaagccatcttgatcagtacatgt

SEQ ID NO: 585562 - DNA, 25 bp, Mus musculus
ggaagccatgacatgtaggtactag

SEQ ID NO: 585563 - DNA, 25 bp, Mus musculus
ggaagccatgacattcaaggatgtg

SEQ ID NO: 585564 - DNA, 25 bp, Mus musculus
ggaagccatgacttgtaggtactag

SEQ ID NO: 585565 - DNA, 25 bp, Mus musculus
ggaagccatgactttcaaggatgtg

SEQ ID NO: 585566 - DNA, 25 bp, Mus musculus
ggaagcccaaagcatgaaactaaca

SEQ ID NO: 585567 - DNA, 25 bp, Mus musculus
ggaagcccaaaggatgaaactaaca

SEQ ID NO: 585568 - DNA, 25 bp, Mus musculus
ggaagcccaactccccaggtattat

SEQ ID NO: 585569 - DNA, 25 bp, Mus musculus
ggaagcccaactgcccaggtattat

SEQ ID NO: 585570 - DNA, 25 bp, Mus musculus
ggaagcccacatattctattataga

SEQ ID NO: 585571 - DNA, 25 bp, Mus musculus
ggaagcccacattttctattataga

SEQ ID NO: 585572 - DNA, 25 bp, Mus musculus
ggaagcccactgctgtgtccagagc

SEQ ID NO: 585573 - DNA, 25 bp, Mus musculus
ggaagcccactggtgtgtccagagc

SEQ ID NO: 585574 - DNA, 25 bp, Mus musculus
ggaagcccagacatactttgttcaa

SEQ ID NO: 585575 - DNA, 25 bp, Mus musculus
ggaagcccagacttactttgttcaa

SEQ ID NO: 585576 - DNA, 25 bp, Mus musculus
ggaagcccagagataccagtcaagt

SEQ ID NO: 585577 - DNA, 25 bp, Mus musculus
ggaagcccagagttaccagtcaagt

SEQ ID NO: 585578 - DNA, 25 bp, Mus musculus
ggaagcccagatcgcatcagtgcaa

SEQ ID NO: 585579 - DNA, 25 bp, Mus musculus
ggaagcccagatggcatcagtgcaa

SEQ ID NO: 585580 - DNA, 25 bp, Mus musculus
ggaagcccagcaaaagcgacaacat

SEQ ID NO: 585581 - DNA, 25 bp, Mus musculus
ggaagcccagcataagcgacaacat

SEQ ID NO: 585582 - DNA, 25 bp, Mus musculus
ggaagcccatacctacagtgacaca

SEQ ID NO: 585583 - DNA, 25 bp, Mus musculus
ggaagcccatacgtacagtgacaca

SEQ ID NO: 585584 - DNA, 25 bp, Mus musculus
ggaagcccattacttgcacggtttc

SEQ ID NO: 585585 - DNA, 25 bp, Mus musculus
ggaagcccattagttgcacggtttc

SEQ ID NO: 585586 - DNA, 25 bp, Mus musculus
ggaagcccctccaaagccagcagag

SEQ ID NO: 585587 - DNA, 25 bp, Mus musculus
ggaagcccctcctaagccagcagag

SEQ ID NO: 585588 - DNA, 25 bp, Mus musculus
ggaagcccctgcagaaagctacagt

SEQ ID NO: 585589 - DNA, 25 bp, Mus musculus
ggaagcccctgctgaaagctacagt

SEQ ID NO: 585590 - DNA, 25 bp, Mus musculus
ggaagccccttaatttctaccagag

SEQ ID NO: 585591 - DNA, 25 bp, Mus musculus
ggaagccccttattttctaccagag

SEQ ID NO: 585592 - DNA, 25 bp, Mus musculus
ggaagcccggagctctttaacatga

SEQ ID NO: 585593 - DNA, 25 bp, Mus musculus
ggaagcccggaggtctttaacatga

SEQ ID NO: 585594 - DNA, 25 bp, Mus musculus
ggaagcccggccagtaccacactgg

SEQ ID NO: 585595 - DNA, 25 bp, Mus musculus
ggaagcccggcctgtaccacactgg

SEQ ID NO: 585596 - DNA, 25 bp, Mus musculus
ggaagccctaagcttctaagcttta

SEQ ID NO: 585597 - DNA, 25 bp, Mus musculus
ggaagccctaaggttctaagcttta

SEQ ID NO: 585598 - DNA, 25 bp, Mus musculus
ggaagccctagccacttacagaaaa

SEQ ID NO: 585599 - DNA, 25 bp, Mus musculus
ggaagccctagcgacttacagaaaa

SEQ ID NO: 585600 - DNA, 25 bp, Mus musculus
ggaagccctcggactcagtgctgag

SEQ ID NO: 585601 - DNA, 25 bp, Mus musculus
ggaagccctcggtctcagtgctgag

SEQ ID NO: 585602 - DNA, 25 bp, Mus musculus
ggaagccctgacaacataaagccta

SEQ ID NO: 585603 - DNA, 25 bp, Mus musculus
ggaagccctgactacataaagccta

SEQ ID NO: 585604 - DNA, 25 bp, Mus musculus
ggaagccctgtcaaccagctgtatg

SEQ ID NO: 585605 - DNA, 25 bp, Mus musculus
ggaagccctgtctaccagctgtatg

SEQ ID NO: 585606 - DNA, 25 bp, Mus musculus
ggaagcccttccaggtcaatgtgtg

SEQ ID NO: 585607 - DNA, 25 bp, Mus musculus
ggaagcccttcctggtcaatgtgtg

SEQ ID NO: 585608 - DNA, 25 bp, Mus musculus
ggaagccctttgatccggagaacag

SEQ ID NO: 585609 - DNA, 25 bp, Mus musculus
ggaagccctttgttccggagaacag

SEQ ID NO: 585610 - DNA, 25 bp, Mus musculus
ggaagccgacatagaggacattaaa

SEQ ID NO: 585611 - DNA, 25 bp, Mus musculus
ggaagccgacattgaggacattaaa

SEQ ID NO: 585612 - DNA, 25 bp, Mus musculus
ggaagccgagacacgccatattgtg

SEQ ID NO: 585613 - DNA, 25 bp, Mus musculus
ggaagccgagactcgccatattgtg

SEQ ID NO: 585614 - DNA, 25 bp, Mus musculus
ggaagccgagcacgtacagcccagt

SEQ ID NO: 585615 - DNA, 25 bp, Mus musculus
ggaagccgagcaggtacagcccagt

SEQ ID NO: 585616 - DNA, 25 bp, Mus musculus
ggaagccgagggactgccatttgct

SEQ ID NO: 585617 - DNA, 25 bp, Mus musculus
ggaagccgagggtctgccatttgct

SEQ ID NO: 585618 - DNA, 25 bp, Mus musculus
ggaagccgcaaaccactctcaaagt

SEQ ID NO: 585619 - DNA, 25 bp, Mus musculus
ggaagccgcaaagcactctcaaagt

SEQ ID NO: 585620 - DNA, 25 bp, Mus musculus
ggaagccgcagcagtatgtacacat

SEQ ID NO: 585621 - DNA, 25 bp, Mus musculus
ggaagccgcagctgtatgtacacat

SEQ ID NO: 585622 - DNA, 25 bp, Mus musculus
ggaagccgctgtctttgccaagtac

SEQ ID NO: 585623 - DNA, 25 bp, Mus musculus
ggaagccgctgtgtttgccaagtac

SEQ ID NO: 585624 - DNA, 25 bp, Mus musculus
ggaagccggagtccactcggaccca

SEQ ID NO: 585625 - DNA, 25 bp, Mus musculus
ggaagccggagtgcactcggaccca

SEQ ID NO: 585626 - DNA, 25 bp, Mus musculus
ggaagccggcatctgcaatcttgtc

SEQ ID NO: 585627 - DNA, 25 bp, Mus musculus
ggaagccggcatgtgcaatcttgtc

SEQ ID NO: 585628 - DNA, 25 bp, Mus musculus
ggaagccgtcagatgctttatgtga

SEQ ID NO: 585629 - DNA, 25 bp, Mus musculus
ggaagccgtcagttgctttatgtga

SEQ ID NO: 585630 - DNA, 25 bp, Mus musculus
ggaagcctaacaactgtccctatgg

SEQ ID NO: 585631 - DNA, 25 bp, Mus musculus
ggaagcctaacatctgtccctatgg

SEQ ID NO: 585632 - DNA, 25 bp, Mus musculus
ggaagcctaatgatttcagaagtat

SEQ ID NO: 585633 - DNA, 25 bp, Mus musculus
ggaagcctaatgttttcagaagtat

SEQ ID NO: 585634 - DNA, 25 bp, Mus musculus
ggaagcctacctcagacagccgggc

SEQ ID NO: 585635 - DNA, 25 bp, Mus musculus
ggaagcctacctcggtctgctgcag

SEQ ID NO: 585636 - DNA, 25 bp, Mus musculus
ggaagcctacctgagacagccgggc

SEQ ID NO: 585637 - DNA, 25 bp, Mus musculus
ggaagcctacctgggtctgctgcag

SEQ ID NO: 585638 - DNA, 25 bp, Mus musculus
ggaagcctactcaagttgttccttc

SEQ ID NO: 585639 - DNA, 25 bp, Mus musculus
ggaagcctactctagttgttccttc

SEQ ID NO: 585640 - DNA, 25 bp, Mus musculus
ggaagcctactgcaaggccacacat

SEQ ID NO: 585641 - DNA, 25 bp, Mus musculus
ggaagcctactggaaggccacacat

SEQ ID NO: 585642 - DNA, 25 bp, Mus musculus
ggaagcctagaacccctgacttata

SEQ ID NO: 585643 - DNA, 25 bp, Mus musculus
ggaagcctagaagccctgacttata

SEQ ID NO: 585644 - DNA, 25 bp, Mus musculus
ggaagcctaggcacggaccccatga

SEQ ID NO: 585645 - DNA, 25 bp, Mus musculus
ggaagcctaggctcggaccccatga

SEQ ID NO: 585646 - DNA, 25 bp, Mus musculus
ggaagcctaggtctatcccagttca

SEQ ID NO: 585647 - DNA, 25 bp, Mus musculus
ggaagcctaggtgtatcccagttca

SEQ ID NO: 585648 - DNA, 25 bp, Mus musculus
ggaagcctatgtagagtcctgactc

SEQ ID NO: 585649 - DNA, 25 bp, Mus musculus
ggaagcctatgtccccagtaaacaa

SEQ ID NO: 585650 - DNA, 25 bp, Mus musculus
ggaagcctatgtgcccagtaaacaa

SEQ ID NO: 585651 - DNA, 25 bp, Mus musculus
ggaagcctatgttgagtcctgactc

SEQ ID NO: 585652 - DNA, 25 bp, Mus musculus
ggaagcctcactaaaaatcctccag

SEQ ID NO: 585653 - DNA, 25 bp, Mus musculus
ggaagcctcacttaaaatcctccag

SEQ ID NO: 585654 - DNA, 25 bp, Mus musculus
ggaagcctcagcctctaagaagtca

SEQ ID NO: 585655 - DNA, 25 bp, Mus musculus
ggaagcctcagcgtctaagaagtca

SEQ ID NO: 585656 - DNA, 25 bp, Mus musculus
ggaagcctcataaacagggagagat

SEQ ID NO: 585657 - DNA, 25 bp, Mus musculus
ggaagcctcatatacagggagagat

SEQ ID NO: 585658 - DNA, 25 bp, Mus musculus
ggaagcctcatgagaacagaaccat

SEQ ID NO: 585659 - DNA, 25 bp, Mus musculus
ggaagcctcatgtgaacagaaccat

SEQ ID NO: 585660 - DNA, 25 bp, Mus musculus
ggaagcctccaacctctaccatgag

SEQ ID NO: 585661 - DNA, 25 bp, Mus musculus
ggaagcctccaagctctaccatgag

SEQ ID NO: 585662 - DNA, 25 bp, Mus musculus
ggaagcctccacagtttgctctttt

SEQ ID NO: 585663 - DNA, 25 bp, Mus musculus
ggaagcctccactgtttgctctttt

SEQ ID NO: 585664 - DNA, 25 bp, Mus musculus
ggaagcctcctaataactgagaaca

SEQ ID NO: 585665 - DNA, 25 bp, Mus musculus
ggaagcctcctattaactgagaaca

SEQ ID NO: 585666 - DNA, 25 bp, Mus musculus
ggaagcctctatcactcttgagctg

SEQ ID NO: 585667 - DNA, 25 bp, Mus musculus
ggaagcctctatgactcttgagctg

SEQ ID NO: 585668 - DNA, 25 bp, Mus musculus
ggaagcctctccaagagaaggccct

SEQ ID NO: 585669 - DNA, 25 bp, Mus musculus
ggaagcctctcctagagaaggccct

SEQ ID NO: 585670 - DNA, 25 bp, Mus musculus
ggaagcctcttactactgggtgtac

SEQ ID NO: 585671 - DNA, 25 bp, Mus musculus
ggaagcctcttagtactgggtgtac

SEQ ID NO: 585672 - DNA, 25 bp, Mus musculus
ggaagcctgactctgctgcttacat

SEQ ID NO: 585673 - DNA, 25 bp, Mus musculus
ggaagcctgactgtgctgcttacat

SEQ ID NO: 585674 - DNA, 25 bp, Mus musculus
ggaagcctgagactggtaatctttt

SEQ ID NO: 585675 - DNA, 25 bp, Mus musculus
ggaagcctgagagtggtaatctttt

SEQ ID NO: 585676 - DNA, 25 bp, Mus musculus
ggaagcctgcggatgatctgttaga

SEQ ID NO: 585677 - DNA, 25 bp, Mus musculus
ggaagcctgcggttgatctgttaga

SEQ ID NO: 585678 - DNA, 25 bp, Mus musculus
ggaagcctgctacctgtcctagtag

SEQ ID NO: 585679 - DNA, 25 bp, Mus musculus
ggaagcctgctagctgtcctagtag

SEQ ID NO: 585680 - DNA, 25 bp, Mus musculus
ggaagcctggatcttagaactgttc

SEQ ID NO: 585681 - DNA, 25 bp, Mus musculus
ggaagcctggatgttagaactgttc

SEQ ID NO: 585682 - DNA, 25 bp, Mus musculus
ggaagcctggctatcctgggctttg

SEQ ID NO: 585683 - DNA, 25 bp, Mus musculus
ggaagcctggctttcctgggctttg

SEQ ID NO: 585684 - DNA, 25 bp, Mus musculus
ggaagcctgggcaacttggtaagaa

SEQ ID NO: 585685 - DNA, 25 bp, Mus musculus
ggaagcctgggctacttggtaagaa

SEQ ID NO: 585686 - DNA, 25 bp, Mus musculus
ggaagcctgggtctcctctagctta

SEQ ID NO: 585687 - DNA, 25 bp, Mus musculus
ggaagcctgggtgtcctctagctta

SEQ ID NO: 585688 - DNA, 25 bp, Mus musculus
ggaagcctgtgtcctaacccagatg

SEQ ID NO: 585689 - DNA, 25 bp, Mus musculus
ggaagcctgtgtgctaacccagatg

SEQ ID NO: 585690 - DNA, 25 bp, Mus musculus
ggaagccttaagctccaaaggttga

SEQ ID NO: 585691 - DNA, 25 bp, Mus musculus
ggaagccttaaggtccaaaggttga

SEQ ID NO: 585692 - DNA, 25 bp, Mus musculus
ggaagccttagacttgagcccaggt

SEQ ID NO: 585693 - DNA, 25 bp, Mus musculus
ggaagccttagagttgagcccaggt

SEQ ID NO: 585694 - DNA, 25 bp, Mus musculus
ggaagccttattctttggaaatcct

SEQ ID NO: 585695 - DNA, 25 bp, Mus musculus
ggaagccttattgtttggaaatcct

SEQ ID NO: 585696 - DNA, 25 bp, Mus musculus
ggaagccttcagacgactctcgtca

SEQ ID NO: 585697 - DNA, 25 bp, Mus musculus
ggaagccttcagtcgactctcgtca

SEQ ID NO: 585698 - DNA, 25 bp, Mus musculus
ggaagccttcctccctggaagaaca

SEQ ID NO: 585699 - DNA, 25 bp, Mus musculus
ggaagccttcctgcctggaagaaca

SEQ ID NO: 585700 - DNA, 25 bp, Mus musculus
ggaagccttgctaagtgcgacattg

SEQ ID NO: 585701 - DNA, 25 bp, Mus musculus
ggaagccttgcttagtgcgacattg

SEQ ID NO: 585702 - DNA, 25 bp, Mus musculus
ggaagcctttagctagtgcctgata

SEQ ID NO: 585703 - DNA, 25 bp, Mus musculus
ggaagcctttaggtagtgcctgata

SEQ ID NO: 585704 - DNA, 25 bp, Mus musculus
ggaagcctttgacaactaccatgag

SEQ ID NO: 585705 - DNA, 25 bp, Mus musculus
ggaagcctttgagaactaccatgag

SEQ ID NO: 585706 - DNA, 25 bp, Mus musculus
ggaagccttttgatgacgcaaaatg

SEQ ID NO: 585707 - DNA, 25 bp, Mus musculus
ggaagccttttgttgacgcaaaatg

SEQ ID NO: 585708 - DNA, 25 bp, Mus musculus
ggaagcctttttaatcggtctcatg

SEQ ID NO: 585709 - DNA, 25 bp, Mus musculus
ggaagccttttttatcggtctcatg

SEQ ID NO: 585710 - DNA, 25 bp, Mus musculus
ggaagcgaattcatctccgtgctga

SEQ ID NO: 585711 - DNA, 25 bp, Mus musculus
ggaagcgaattcttctccgtgctga

SEQ ID NO: 585712 - DNA, 25 bp, Mus musculus
ggaagcgacacgaacgagtctggaa

SEQ ID NO: 585713 - DNA, 25 bp, Mus musculus
ggaagcgacacgtacgagtctggaa

SEQ ID NO: 585714 - DNA, 25 bp, Mus musculus
ggaagcgacgccactgactttgacc

SEQ ID NO: 585715 - DNA, 25 bp, Mus musculus
ggaagcgacgcctctgactttgacc

SEQ ID NO: 585716 - DNA, 25 bp, Mus musculus
ggaagcgagagaccagcaccctgat

SEQ ID NO: 585717 - DNA, 25 bp, Mus musculus
ggaagcgagagagcagcaccctgat

SEQ ID NO: 585718 - DNA, 25 bp, Mus musculus
ggaagcgaggtcattctgcgaacat

SEQ ID NO: 585719 - DNA, 25 bp, Mus musculus
ggaagcgaggtctttctgcgaacat

SEQ ID NO: 585720 - DNA, 25 bp, Mus musculus
ggaagcgaggttcgcggtccgtctt

SEQ ID NO: 585721 - DNA, 25 bp, Mus musculus
ggaagcgaggttggcggtccgtctt

SEQ ID NO: 585722 - DNA, 25 bp, Mus musculus
ggaagcgagtcaccctaaagaataa

SEQ ID NO: 585723 - DNA, 25 bp, Mus musculus
ggaagcgagtcagcctaaagaataa

SEQ ID NO: 585724 - DNA, 25 bp, Mus musculus
ggaagcgatgctcgctcacactgga

SEQ ID NO: 585725 - DNA, 25 bp, Mus musculus
ggaagcgatgctggctcacactgga

SEQ ID NO: 585726 - DNA, 25 bp, Mus musculus
ggaagcgcaaacacttatcctacgt

SEQ ID NO: 585727 - DNA, 25 bp, Mus musculus
ggaagcgcaaactcttatcctacgt

SEQ ID NO: 585728 - DNA, 25 bp, Mus musculus
ggaagcgcaggaatggaaccctctt

SEQ ID NO: 585729 - DNA, 25 bp, Mus musculus
ggaagcgcaggattggaaccctctt

SEQ ID NO: 585730 - DNA, 25 bp, Mus musculus
ggaagcgcagtactgtttttccttc

SEQ ID NO: 585731 - DNA, 25 bp, Mus musculus
ggaagcgcagtagtgtttttccttc

SEQ ID NO: 585732 - DNA, 25 bp, Mus musculus
ggaagcgcatgaagtctgttctaat

SEQ ID NO: 585733 - DNA, 25 bp, Mus musculus
ggaagcgcatgatgtctgttctaat

SEQ ID NO: 585734 - DNA, 25 bp, Mus musculus
ggaagcgcccggattacttgagaag

SEQ ID NO: 585735 - DNA, 25 bp, Mus musculus
ggaagcgcccggtttacttgagaag

SEQ ID NO: 585736 - DNA, 25 bp, Mus musculus
ggaagcgcctagaaccctgggagat

SEQ ID NO: 585737 - DNA, 25 bp, Mus musculus
ggaagcgcctagtaccctgggagat

SEQ ID NO: 585738 - DNA, 25 bp, Mus musculus
ggaagcgccttacccaggacaccta

SEQ ID NO: 585739 - DNA, 25 bp, Mus musculus
ggaagcgccttagccaggacaccta

SEQ ID NO: 585740 - DNA, 25 bp, Mus musculus
ggaagcgcgcagacttggttctcaa

SEQ ID NO: 585741 - DNA, 25 bp, Mus musculus
ggaagcgcgcagtcttggttctcaa

SEQ ID NO: 585742 - DNA, 25 bp, Mus musculus
ggaagcgcgggtacaagatttctaa

SEQ ID NO: 585743 - DNA, 25 bp, Mus musculus
ggaagcgcgggttcaagatttctaa

SEQ ID NO: 585744 - DNA, 25 bp, Mus musculus
ggaagcgctacaaagtcatcattag

SEQ ID NO: 585745 - DNA, 25 bp, Mus musculus
ggaagcgctacatagtcatcattag

SEQ ID NO: 585746 - DNA, 25 bp, Mus musculus
ggaagcgctcacactctatttggtc

SEQ ID NO: 585747 - DNA, 25 bp, Mus musculus
ggaagcgctcactctctatttggtc

SEQ ID NO: 585748 - DNA, 25 bp, Mus musculus
ggaagcgctgtcagtttttaagtat

SEQ ID NO: 585749 - DNA, 25 bp, Mus musculus
ggaagcgctgtctgtttttaagtat

SEQ ID NO: 585750 - DNA, 25 bp, Mus musculus
ggaagcggagctcaagtgccctggg

SEQ ID NO: 585751 - DNA, 25 bp, Mus musculus
ggaagcggagctccatagcctcaga

SEQ ID NO: 585752 - DNA, 25 bp, Mus musculus
ggaagcggagctgaagtgccctggg

SEQ ID NO: 585753 - DNA, 25 bp, Mus musculus
ggaagcggagctgcatagcctcaga

SEQ ID NO: 585754 - DNA, 25 bp, Mus musculus
ggaagcggatgaataccaacccctc

SEQ ID NO: 585755 - DNA, 25 bp, Mus musculus
ggaagcggatgattaccaacccctc

SEQ ID NO: 585756 - DNA, 25 bp, Mus musculus
ggaagcggccacagactctgctcca

SEQ ID NO: 585757 - DNA, 25 bp, Mus musculus
ggaagcggccactgactctgctcca

SEQ ID NO: 585758 - DNA, 25 bp, Mus musculus
ggaagcgggctcaggaaccgaattc

SEQ ID NO: 585759 - DNA, 25 bp, Mus musculus
ggaagcgggctctggaaccgaattc

SEQ ID NO: 585760 - DNA, 25 bp, Mus musculus
ggaagcggtgtaactccctgagtgt

SEQ ID NO: 585761 - DNA, 25 bp, Mus musculus
ggaagcggtgtatctccctgagtgt

SEQ ID NO: 585762 - DNA, 25 bp, Mus musculus
ggaagcggttgacccaagctgactc

SEQ ID NO: 585763 - DNA, 25 bp, Mus musculus
ggaagcggttgagccaagctgactc

SEQ ID NO: 585764 - DNA, 25 bp, Mus musculus
ggaagcgtaactccatagctgtaca

SEQ ID NO: 585765 - DNA, 25 bp, Mus musculus
ggaagcgtaactgcatagctgtaca

SEQ ID NO: 585766 - DNA, 25 bp, Mus musculus
ggaagcgtctgcagcatgaccatga

SEQ ID NO: 585767 - DNA, 25 bp, Mus musculus
ggaagcgtctgctgcatgaccatga

SEQ ID NO: 585768 - DNA, 25 bp, Mus musculus
ggaagcgtggtgaaacaatctttta

SEQ ID NO: 585769 - DNA, 25 bp, Mus musculus
ggaagcgtggtgtaacaatctttta

SEQ ID NO: 585770 - DNA, 25 bp, Mus musculus
ggaagctaaccacgtatatctttta

SEQ ID NO: 585771 - DNA, 25 bp, Mus musculus
ggaagctaaccaggtatatctttta

SEQ ID NO: 585772 - DNA, 25 bp, Mus musculus
ggaagctaactactctcccatagac

SEQ ID NO: 585773 - DNA, 25 bp, Mus musculus
ggaagctaactagtctcccatagac

SEQ ID NO: 585774 - DNA, 25 bp, Mus musculus
ggaagctaatcccaattcctctgga

SEQ ID NO: 585775 - DNA, 25 bp, Mus musculus
ggaagctaatccgaattcctctgga

SEQ ID NO: 585776 - DNA, 25 bp, Mus musculus
ggaagctacattcgcagcagcgaat

SEQ ID NO: 585777 - DNA, 25 bp, Mus musculus
ggaagctacattggcagcagcgaat

SEQ ID NO: 585778 - DNA, 25 bp, Mus musculus
ggaagctactccaataccattataa

SEQ ID NO: 585779 - DNA, 25 bp, Mus musculus
ggaagctactcctataccattataa

SEQ ID NO: 585780 - DNA, 25 bp, Mus musculus
ggaagctactttctgaagaaacctt

SEQ ID NO: 585781 - DNA, 25 bp, Mus musculus
ggaagctactttgtgaagaaacctt

SEQ ID NO: 585782 - DNA, 25 bp, Mus musculus
ggaagctagattccttaggaacttt

SEQ ID NO: 585783 - DNA, 25 bp, Mus musculus
ggaagctagattgcttaggaacttt

SEQ ID NO: 585784 - DNA, 25 bp, Mus musculus
ggaagctagctgagtagaccatgct

SEQ ID NO: 585785 - DNA, 25 bp, Mus musculus
ggaagctagctgtgtagaccatgct

SEQ ID NO: 585786 - DNA, 25 bp, Mus musculus
ggaagctaggccagttgctgcacac

SEQ ID NO: 585787 - DNA, 25 bp, Mus musculus
ggaagctaggcctgttgctgcacac

SEQ ID NO: 585788 - DNA, 25 bp, Mus musculus
ggaagctatgctattttctgtagct

SEQ ID NO: 585789 - DNA, 25 bp, Mus musculus
ggaagctatgcttttttctgtagct

SEQ ID NO: 585790 - DNA, 25 bp, Mus musculus
ggaagctattcacccagggactggc

SEQ ID NO: 585791 - DNA, 25 bp, Mus musculus
ggaagctattcagccagggactggc

SEQ ID NO: 585792 - DNA, 25 bp, Mus musculus
ggaagctattgtcccaggatgctaa

SEQ ID NO: 585793 - DNA, 25 bp, Mus musculus
ggaagctattgtgccaggatgctaa

SEQ ID NO: 585794 - DNA, 25 bp, Mus musculus
ggaagctatttgagcaaacggaact

SEQ ID NO: 585795 - DNA, 25 bp, Mus musculus
ggaagctatttgtgcaaacggaact

SEQ ID NO: 585796 - DNA, 25 bp, Mus musculus
ggaagctcaagcaactgaaggtgtt

SEQ ID NO: 585797 - DNA, 25 bp, Mus musculus
ggaagctcaagctactgaaggtgtt

SEQ ID NO: 585798 - DNA, 25 bp, Mus musculus
ggaagctcaatactgtctgtctcaa

SEQ ID NO: 585799 - DNA, 25 bp, Mus musculus
ggaagctcaatagtgtctgtctcaa

SEQ ID NO: 585800 - DNA, 25 bp, Mus musculus
ggaagctcaccaagctttgtcatgg

SEQ ID NO: 585801 - DNA, 25 bp, Mus musculus
ggaagctcaccatgctttgtcatgg

SEQ ID NO: 585802 - DNA, 25 bp, Mus musculus
ggaagctcacctctgtcctgggtac

SEQ ID NO: 585803 - DNA, 25 bp, Mus musculus
ggaagctcacctgtgtcctgggtac

SEQ ID NO: 585804 - DNA, 25 bp, Mus musculus
ggaagctcatgtactcctttaaata

SEQ ID NO: 585805 - DNA, 25 bp, Mus musculus
ggaagctcatgtctttctgctttac

SEQ ID NO: 585806 - DNA, 25 bp, Mus musculus
ggaagctcatgtgtttctgctttac

SEQ ID NO: 585807 - DNA, 25 bp, Mus musculus
ggaagctcatgttctcctttaaata

SEQ ID NO: 585808 - DNA, 25 bp, Mus musculus
ggaagctcattaacaggcggcgccc

SEQ ID NO: 585809 - DNA, 25 bp, Mus musculus
ggaagctcattatcaggcggcgccc

SEQ ID NO: 585810 - DNA, 25 bp, Mus musculus
ggaagctccaggaagtacaccagga

SEQ ID NO: 585811 - DNA, 25 bp, Mus musculus
ggaagctccaggtagtacaccagga

SEQ ID NO: 585812 - DNA, 25 bp, Mus musculus
ggaagctcccatattgttttaaaga

SEQ ID NO: 585813 - DNA, 25 bp, Mus musculus
ggaagctcccattttgttttaaaga

SEQ ID NO: 585814 - DNA, 25 bp, Mus musculus
ggaagctccctaagagatggccacc

SEQ ID NO: 585815 - DNA, 25 bp, Mus musculus
ggaagctccctatgagatggccacc

SEQ ID NO: 585816 - DNA, 25 bp, Mus musculus
ggaagctccgcactcaccgacggga

SEQ ID NO: 585817 - DNA, 25 bp, Mus musculus
ggaagctccgcagtcaccgacggga

SEQ ID NO: 585818 - DNA, 25 bp, Mus musculus
ggaagctctaacattgcctctgtaa

SEQ ID NO: 585819 - DNA, 25 bp, Mus musculus
ggaagctctaactttgcctctgtaa

SEQ ID NO: 585820 - DNA, 25 bp, Mus musculus
ggaagctctaccagtggccaaggtt

SEQ ID NO: 585821 - DNA, 25 bp, Mus musculus
ggaagctctacctgtggccaaggtt

SEQ ID NO: 585822 - DNA, 25 bp, Mus musculus
ggaagctctcacaggaagcctgcaa

SEQ ID NO: 585823 - DNA, 25 bp, Mus musculus
ggaagctctcactggaagcctgcaa

SEQ ID NO: 585824 - DNA, 25 bp, Mus musculus
ggaagctctcatcgacttgtcaaca

SEQ ID NO: 585825 - DNA, 25 bp, Mus musculus
ggaagctctcatggacttgtcaaca

SEQ ID NO: 585826 - DNA, 25 bp, Mus musculus
ggaagctctcgactggctcatcaga

SEQ ID NO: 585827 - DNA, 25 bp, Mus musculus
ggaagctctcgagtggctcatcaga

SEQ ID NO: 585828 - DNA, 25 bp, Mus musculus
ggaagctctcgtagtctgctataaa

SEQ ID NO: 585829 - DNA, 25 bp, Mus musculus
ggaagctctcgttgtctgctataaa

SEQ ID NO: 585830 - DNA, 25 bp, Mus musculus
ggaagctctgtcaaaataacccaaa

SEQ ID NO: 585831 - DNA, 25 bp, Mus musculus
ggaagctctgtctaaataacccaaa

SEQ ID NO: 585832 - DNA, 25 bp, Mus musculus
ggaagctctgtgagtacatcaagac

SEQ ID NO: 585833 - DNA, 25 bp, Mus musculus
ggaagctctgtgtgtacatcaagac

SEQ ID NO: 585834 - DNA, 25 bp, Mus musculus
ggaagctctgttaaacttacacata

SEQ ID NO: 585835 - DNA, 25 bp, Mus musculus
ggaagctctgtttaacttacacata

SEQ ID NO: 585836 - DNA, 25 bp, Mus musculus
ggaagctcttctagaatttctgaaa

SEQ ID NO: 585837 - DNA, 25 bp, Mus musculus
ggaagctcttcttgaatttctgaaa

SEQ ID NO: 585838 - DNA, 25 bp, Mus musculus
ggaagctgaactcctcctttatttt

SEQ ID NO: 585839 - DNA, 25 bp, Mus musculus
ggaagctgaactgctcctttatttt

SEQ ID NO: 585840 - DNA, 25 bp, Mus musculus
ggaagctgacatccagaggtatttt

SEQ ID NO: 585841 - DNA, 25 bp, Mus musculus
ggaagctgacatgcagaggtatttt

SEQ ID NO: 585842 - DNA, 25 bp, Mus musculus
ggaagctgaccactcctgtgatgga

SEQ ID NO: 585843 - DNA, 25 bp, Mus musculus
ggaagctgaccagtcctgtgatgga

SEQ ID NO: 585844 - DNA, 25 bp, Mus musculus
ggaagctgacccaggtgtgctaacc

SEQ ID NO: 585845 - DNA, 25 bp, Mus musculus
ggaagctgaccctggtgtgctaacc

SEQ ID NO: 585846 - DNA, 25 bp, Mus musculus
ggaagctgactcaggaaccttctta

SEQ ID NO: 585847 - DNA, 25 bp, Mus musculus
ggaagctgactctggaaccttctta

SEQ ID NO: 585848 - DNA, 25 bp, Mus musculus
ggaagctgagagctctgccctccca

SEQ ID NO: 585849 - DNA, 25 bp, Mus musculus
ggaagctgagaggtctgccctccca

SEQ ID NO: 585850 - DNA, 25 bp, Mus musculus
ggaagctgaggaagctctgtctgaa

SEQ ID NO: 585851 - DNA, 25 bp, Mus musculus
ggaagctgaggatgctctgtctgaa

SEQ ID NO: 585852 - DNA, 25 bp, Mus musculus
ggaagctgatccagatcacctcaag

SEQ ID NO: 585853 - DNA, 25 bp, Mus musculus
ggaagctgatcctgatcacctcaag

SEQ ID NO: 585854 - DNA, 25 bp, Mus musculus
ggaagctgcagaagaagccttggat

SEQ ID NO: 585855 - DNA, 25 bp, Mus musculus
ggaagctgcagatgaagccttggat

SEQ ID NO: 585856 - DNA, 25 bp, Mus musculus
ggaagctgcagtactggtacaaact

SEQ ID NO: 585857 - DNA, 25 bp, Mus musculus
ggaagctgcagttctggtacaaact

SEQ ID NO: 585858 - DNA, 25 bp, Mus musculus
ggaagctgcctaaggcttcttcctg

SEQ ID NO: 585859 - DNA, 25 bp, Mus musculus
ggaagctgcctatggcttcttcctg

SEQ ID NO: 585860 - DNA, 25 bp, Mus musculus
ggaagctgcctcacacttctgaaaa

SEQ ID NO: 585861 - DNA, 25 bp, Mus musculus
ggaagctgcctctcacttctgaaaa

SEQ ID NO: 585862 - DNA, 25 bp, Mus musculus
ggaagctgccttagaatctgttttt

SEQ ID NO: 585863 - DNA, 25 bp, Mus musculus
ggaagctgcctttgaatctgttttt

SEQ ID NO: 585864 - DNA, 25 bp, Mus musculus
ggaagctgcggcattgggctcccat

SEQ ID NO: 585865 - DNA, 25 bp, Mus musculus
ggaagctgcggctttgggctcccat

SEQ ID NO: 585866 - DNA, 25 bp, Mus musculus
ggaagctgctccaatgaaggctgaa

SEQ ID NO: 585867 - DNA, 25 bp, Mus musculus
ggaagctgctcctatgaaggctgaa

SEQ ID NO: 585868 - DNA, 25 bp, Mus musculus
ggaagctggaaaaccctctgatgat

SEQ ID NO: 585869 - DNA, 25 bp, Mus musculus
ggaagctggaaatccctctgatgat

SEQ ID NO: 585870 - DNA, 25 bp, Mus musculus
ggaagctggactcagcactttgcct

SEQ ID NO: 585871 - DNA, 25 bp, Mus musculus
ggaagctggactgagcactttgcct

SEQ ID NO: 585872 - DNA, 25 bp, Mus musculus
ggaagctggagactgcttcttgtct

SEQ ID NO: 585873 - DNA, 25 bp, Mus musculus
ggaagctggagagtgcttcttgtct

SEQ ID NO: 585874 - DNA, 25 bp, Mus musculus
ggaagctggctgactaaacaaatgt

SEQ ID NO: 585875 - DNA, 25 bp, Mus musculus
ggaagctggctgtctaaacaaatgt

SEQ ID NO: 585876 - DNA, 25 bp, Mus musculus
ggaagctgtacaccctttatcccaa

SEQ ID NO: 585877 - DNA, 25 bp, Mus musculus
ggaagctgtacagcctttatcccaa

SEQ ID NO: 585878 - DNA, 25 bp, Mus musculus
ggaagctgtagaacctaccgtgtat

SEQ ID NO: 585879 - DNA, 25 bp, Mus musculus
ggaagctgtagatcctaccgtgtat

SEQ ID NO: 585880 - DNA, 25 bp, Mus musculus
ggaagctgtcatccaggctcctaca

SEQ ID NO: 585881 - DNA, 25 bp, Mus musculus
ggaagctgtcatgcaggctcctaca

SEQ ID NO: 585882 - DNA, 25 bp, Mus musculus
ggaagctgtctaatacatcaatgag

SEQ ID NO: 585883 - DNA, 25 bp, Mus musculus
ggaagctgtctattacatcaatgag

SEQ ID NO: 585884 - DNA, 25 bp, Mus musculus
ggaagctgtctcaccaaacaaagcc

SEQ ID NO: 585885 - DNA, 25 bp, Mus musculus
ggaagctgtctctccaaacaaagcc

SEQ ID NO: 585886 - DNA, 25 bp, Mus musculus
ggaagctgttatacaaaagcaccta

SEQ ID NO: 585887 - DNA, 25 bp, Mus musculus
ggaagctgttattcaaaagcaccta

SEQ ID NO: 585888 - DNA, 25 bp, Mus musculus
ggaagctgttcaccattgagcgact

SEQ ID NO: 585889 - DNA, 25 bp, Mus musculus
ggaagctgttcagcattgagcgact

SEQ ID NO: 585890 - DNA, 25 bp, Mus musculus
ggaagctgttgaagtcttggctcta

SEQ ID NO: 585891 - DNA, 25 bp, Mus musculus
ggaagctgttgatgtcttggctcta

SEQ ID NO: 585892 - DNA, 25 bp, Mus musculus
ggaagctgtttacaccatgccatat

SEQ ID NO: 585893 - DNA, 25 bp, Mus musculus
ggaagctgtttagaccatgccatat

SEQ ID NO: 585894 - DNA, 25 bp, Mus musculus
ggaagcttaccccaaatgactgctc

SEQ ID NO: 585895 - DNA, 25 bp, Mus musculus
ggaagcttacccgaaatgactgctc

SEQ ID NO: 585896 - DNA, 25 bp, Mus musculus
ggaagcttacttagctctaatctgt

SEQ ID NO: 585897 - DNA, 25 bp, Mus musculus
ggaagcttactttgctctaatctgt

SEQ ID NO: 585898 - DNA, 25 bp, Mus musculus
ggaagcttatagacattaattagca

SEQ ID NO: 585899 - DNA, 25 bp, Mus musculus
ggaagcttatagtcattaattagca

SEQ ID NO: 585900 - DNA, 25 bp, Mus musculus
ggaagcttcagactttttggacatt

SEQ ID NO: 585901 - DNA, 25 bp, Mus musculus
ggaagcttcagagtttttggacatt

SEQ ID NO: 585902 - DNA, 25 bp, Mus musculus
ggaagcttcctgaccggccgagctg

SEQ ID NO: 585903 - DNA, 25 bp, Mus musculus
ggaagcttcctgcacctcattttaa

SEQ ID NO: 585904 - DNA, 25 bp, Mus musculus
ggaagcttcctggacctcattttaa

SEQ ID NO: 585905 - DNA, 25 bp, Mus musculus
ggaagcttcctgtccggccgagctg

SEQ ID NO: 585906 - DNA, 25 bp, Mus musculus
ggaagcttccttatagtaatgcaga

SEQ ID NO: 585907 - DNA, 25 bp, Mus musculus
ggaagcttccttctacggaccatga

SEQ ID NO: 585908 - DNA, 25 bp, Mus musculus
ggaagcttccttgtacggaccatga

SEQ ID NO: 585909 - DNA, 25 bp, Mus musculus
ggaagcttccttttagtaatgcaga

SEQ ID NO: 585910 - DNA, 25 bp, Mus musculus
ggaagcttcgacatcatcgggacac

SEQ ID NO: 585911 - DNA, 25 bp, Mus musculus
ggaagcttcgacttcatcgggacac

SEQ ID NO: 585912 - DNA, 25 bp, Mus musculus
ggaagcttcgatctaccaagtgtat

SEQ ID NO: 585913 - DNA, 25 bp, Mus musculus
ggaagcttcgatgtaccaagtgtat

SEQ ID NO: 585914 - DNA, 25 bp, Mus musculus
ggaagcttcggaaatgggtcaacca

SEQ ID NO: 585915 - DNA, 25 bp, Mus musculus
ggaagcttcggatatgggtcaacca

SEQ ID NO: 585916 - DNA, 25 bp, Mus musculus
ggaagcttcggtagccactggttac

SEQ ID NO: 585917 - DNA, 25 bp, Mus musculus
ggaagcttcggttgccactggttac

SEQ ID NO: 585918 - DNA, 25 bp, Mus musculus
ggaagcttctaaaacctcacaaaat

SEQ ID NO: 585919 - DNA, 25 bp, Mus musculus
ggaagcttctaaagccagaccaaca

SEQ ID NO: 585920 - DNA, 25 bp, Mus musculus
ggaagcttctaatacctcacaaaat

SEQ ID NO: 585921 - DNA, 25 bp, Mus musculus
ggaagcttctaatgccagaccaaca

SEQ ID NO: 585922 - DNA, 25 bp, Mus musculus
ggaagcttctcgagctggactgaga

SEQ ID NO: 585923 - DNA, 25 bp, Mus musculus
ggaagcttctcgtgctggactgaga

SEQ ID NO: 585924 - DNA, 25 bp, Mus musculus
ggaagcttctctcactaatttaggc

SEQ ID NO: 585925 - DNA, 25 bp, Mus musculus
ggaagcttctctgactaatttaggc

SEQ ID NO: 585926 - DNA, 25 bp, Mus musculus
ggaagcttctgcacttgatacccac

SEQ ID NO: 585927 - DNA, 25 bp, Mus musculus
ggaagcttctgctcttgatacccac

SEQ ID NO: 585928 - DNA, 25 bp, Mus musculus
ggaagcttctggagtacagccattt

SEQ ID NO: 585929 - DNA, 25 bp, Mus musculus
ggaagcttctggtgtacagccattt

SEQ ID NO: 585930 - DNA, 25 bp, Mus musculus
ggaagcttctgtcggaaccagtttc

SEQ ID NO: 585931 - DNA, 25 bp, Mus musculus
ggaagcttctgtgggaaccagtttc

SEQ ID NO: 585932 - DNA, 25 bp, Mus musculus
ggaagcttcttaaacactggacact

SEQ ID NO: 585933 - DNA, 25 bp, Mus musculus
ggaagcttcttatacactggacact

SEQ ID NO: 585934 - DNA, 25 bp, Mus musculus
ggaagcttcttgatgcccgactgca

SEQ ID NO: 585935 - DNA, 25 bp, Mus musculus
ggaagcttcttgttgcccgactgca

SEQ ID NO: 585936 - DNA, 25 bp, Mus musculus
ggaagcttctttccttgggagccac

SEQ ID NO: 585937 - DNA, 25 bp, Mus musculus
ggaagcttctttgcttgggagccac

SEQ ID NO: 585938 - DNA, 25 bp, Mus musculus
ggaagcttgaacagatcaccctctc

SEQ ID NO: 585939 - DNA, 25 bp, Mus musculus
ggaagcttgaactgatcaccctctc

SEQ ID NO: 585940 - DNA, 25 bp, Mus musculus
ggaagcttggaaatcacatctcaac

SEQ ID NO: 585941 - DNA, 25 bp, Mus musculus
ggaagcttggaattcacatctcaac

SEQ ID NO: 585942 - DNA, 25 bp, Mus musculus
ggaagcttggccctggacatcacag

SEQ ID NO: 585943 - DNA, 25 bp, Mus musculus
ggaagcttggccgtggacatcacag

SEQ ID NO: 585944 - DNA, 25 bp, Mus musculus
ggaagcttgtcccttatttctgaat

SEQ ID NO: 585945 - DNA, 25 bp, Mus musculus
ggaagcttgtccgttatttctgaat

SEQ ID NO: 585946 - DNA, 25 bp, Mus musculus
ggaagcttgttgaatatgtctgaaa

SEQ ID NO: 585947 - DNA, 25 bp, Mus musculus
ggaagcttgttgtatatgtctgaaa

SEQ ID NO: 585948 - DNA, 25 bp, Mus musculus
ggaagctttcaactgtcttgcttat

SEQ ID NO: 585949 - DNA, 25 bp, Mus musculus
ggaagctttcaagtgtcttgcttat

SEQ ID NO: 585950 - DNA, 25 bp, Mus musculus
ggaagctttctacttaacacacaca

SEQ ID NO: 585951 - DNA, 25 bp, Mus musculus
ggaagctttctagttaacacacaca

SEQ ID NO: 585952 - DNA, 25 bp, Mus musculus
ggaagctttctgcaggttagtccta

SEQ ID NO: 585953 - DNA, 25 bp, Mus musculus
ggaagctttctggaggttagtccta

SEQ ID NO: 585954 - DNA, 25 bp, Mus musculus
ggaagctttgatctcacccagaggc

SEQ ID NO: 585955 - DNA, 25 bp, Mus musculus
ggaagctttgatgtcacccagaggc

SEQ ID NO: 585956 - DNA, 25 bp, Mus musculus
ggaagctttgcaaacccagcctaga

SEQ ID NO: 585957 - DNA, 25 bp, Mus musculus
ggaagctttgcacgccaatttatat

SEQ ID NO: 585958 - DNA, 25 bp, Mus musculus
ggaagctttgcaggccaatttatat

SEQ ID NO: 585959 - DNA, 25 bp, Mus musculus
ggaagctttgcatacccagcctaga

SEQ ID NO: 585960 - DNA, 25 bp, Mus musculus
ggaagctttggacgaccaaccttat

SEQ ID NO: 585961 - DNA, 25 bp, Mus musculus
ggaagctttggaggaccaaccttat

SEQ ID NO: 585962 - DNA, 25 bp, Mus musculus
ggaagctttgtgaatgacttctgcc

SEQ ID NO: 585963 - DNA, 25 bp, Mus musculus
ggaagctttgtgtatgacttctgcc

SEQ ID NO: 585964 - DNA, 25 bp, Mus musculus
ggaagcttttggaacttgcacattc

SEQ ID NO: 585965 - DNA, 25 bp, Mus musculus
ggaagcttttggtacttgcacattc

SEQ ID NO: 585966 - DNA, 25 bp, Mus musculus
ggaaggaaaaatcccgtgtcactat

SEQ ID NO: 585967 - DNA, 25 bp, Mus musculus
ggaaggaaaaatgccgtgtcactat

SEQ ID NO: 585968 - DNA, 25 bp, Mus musculus
ggaaggaaccctagagtaaccagag

SEQ ID NO: 585969 - DNA, 25 bp, Mus musculus
ggaaggaacccttgagtaaccagag

SEQ ID NO: 585970 - DNA, 25 bp, Mus musculus
ggaaggaacctcactatgtctttgc

SEQ ID NO: 585971 - DNA, 25 bp, Mus musculus
ggaaggaacctctctatgtctttgc

SEQ ID NO: 585972 - DNA, 25 bp, Mus musculus
ggaaggaacgaactgacttgtcaat

SEQ ID NO: 585973 - DNA, 25 bp, Mus musculus
ggaaggaacgaagtgacttgtcaat

SEQ ID NO: 585974 - DNA, 25 bp, Mus musculus
ggaaggaagagccattttcaacaaa

SEQ ID NO: 585975 - DNA, 25 bp, Mus musculus
ggaaggaagagcgattttcaacaaa

SEQ ID NO: 585976 - DNA, 25 bp, Mus musculus
ggaaggaagcctattctctgcagaa

SEQ ID NO: 585977 - DNA, 25 bp, Mus musculus
ggaaggaagccttttctctgcagaa

SEQ ID NO: 585978 - DNA, 25 bp, Mus musculus
ggaaggaagtgaagccctccccatt

SEQ ID NO: 585979 - DNA, 25 bp, Mus musculus
ggaaggaagtgatgccctccccatt

SEQ ID NO: 585980 - DNA, 25 bp, Mus musculus
ggaaggaagtggacactccccacgc

SEQ ID NO: 585981 - DNA, 25 bp, Mus musculus
ggaaggaagtggtcactccccacgc

SEQ ID NO: 585982 - DNA, 25 bp, Mus musculus
ggaaggaatattctaagccctgaac

SEQ ID NO: 585983 - DNA, 25 bp, Mus musculus
ggaaggaatattgtaagccctgaac

SEQ ID NO: 585984 - DNA, 25 bp, Mus musculus
ggaaggaatcccagagcacggaaat

SEQ ID NO: 585985 - DNA, 25 bp, Mus musculus
ggaaggaatccctgagcacggaaat

SEQ ID NO: 585986 - DNA, 25 bp, Mus musculus
ggaaggaatgccagatcttgcccat

SEQ ID NO: 585987 - DNA, 25 bp, Mus musculus
ggaaggaatgcctgatcttgcccat

SEQ ID NO: 585988 - DNA, 25 bp, Mus musculus
ggaaggaattttctgtccacacctc

SEQ ID NO: 585989 - DNA, 25 bp, Mus musculus
ggaaggaattttgtgtccacacctc

SEQ ID NO: 585990 - DNA, 25 bp, Mus musculus
ggaaggacacaacagcatcctcaca

SEQ ID NO: 585991 - DNA, 25 bp, Mus musculus
ggaaggacacaagagcatcctcaca

SEQ ID NO: 585992 - DNA, 25 bp, Mus musculus
ggaaggacacagctactactacatc

SEQ ID NO: 585993 - DNA, 25 bp, Mus musculus
ggaaggacacaggtactactacatc

SEQ ID NO: 585994 - DNA, 25 bp, Mus musculus
ggaaggacactcatgcagctaagct

SEQ ID NO: 585995 - DNA, 25 bp, Mus musculus
ggaaggacactcttgcagctaagct

SEQ ID NO: 585996 - DNA, 25 bp, Mus musculus
ggaaggacactgcagactttcttgt

SEQ ID NO: 585997 - DNA, 25 bp, Mus musculus
ggaaggacactggagactttcttgt

SEQ ID NO: 585998 - DNA, 25 bp, Mus musculus
ggaaggacacttccctcaggaagcc

SEQ ID NO: 585999 - DNA, 25 bp, Mus musculus
ggaaggacacttgcctcaggaagcc

SEQ ID NO: 586000 - DNA, 25 bp, Mus musculus
ggaaggacagagatccatcctcagc

SEQ ID NO: 586001 - DNA, 25 bp, Mus musculus
ggaaggacagagttccatcctcagc

SEQ ID NO: 586002 - DNA, 25 bp, Mus musculus
ggaaggacatccagtacgctactag

SEQ ID NO: 586003 - DNA, 25 bp, Mus musculus
ggaaggacatcctgtacgctactag

SEQ ID NO: 586004 - DNA, 25 bp, Mus musculus
ggaaggacatgtaattgtttcagat

SEQ ID NO: 586005 - DNA, 25 bp, Mus musculus
ggaaggacatgttattgtttcagat

SEQ ID NO: 586006 - DNA, 25 bp, Mus musculus
ggaaggacatttctttttatcactt

SEQ ID NO: 586007 - DNA, 25 bp, Mus musculus
ggaaggacatttgtttttatcactt

SEQ ID NO: 586008 - DNA, 25 bp, Mus musculus
ggaaggaccactacaaacgtctaat

SEQ ID NO: 586009 - DNA, 25 bp, Mus musculus
ggaaggaccactctgaaaaccaaca

SEQ ID NO: 586010 - DNA, 25 bp, Mus musculus
ggaaggaccactgtgaaaaccaaca

SEQ ID NO: 586011 - DNA, 25 bp, Mus musculus
ggaaggaccacttcaaacgtctaat

SEQ ID NO: 586012 - DNA, 25 bp, Mus musculus
ggaaggaccatgcatactgacatga

SEQ ID NO: 586013 - DNA, 25 bp, Mus musculus
ggaaggaccatggatactgacatga

SEQ ID NO: 586014 - DNA, 25 bp, Mus musculus
ggaaggaccattagcacaccatcat

SEQ ID NO: 586015 - DNA, 25 bp, Mus musculus
ggaaggaccatttgcacaccatcat

SEQ ID NO: 586016 - DNA, 25 bp, Mus musculus
ggaaggacccaactttccatcatat

SEQ ID NO: 586017 - DNA, 25 bp, Mus musculus
ggaaggacccaagtttccatcatat

SEQ ID NO: 586018 - DNA, 25 bp, Mus musculus
ggaaggacccgtctgtcacaagtgt

SEQ ID NO: 586019 - DNA, 25 bp, Mus musculus
ggaaggacccgtgtgtcacaagtgt

SEQ ID NO: 586020 - DNA, 25 bp, Mus musculus
ggaaggaccctaacacaaggcaaga

SEQ ID NO: 586021 - DNA, 25 bp, Mus musculus
ggaaggaccctatcacaaggcaaga

SEQ ID NO: 586022 - DNA, 25 bp, Mus musculus
ggaaggacccttcaacatgtggccc

SEQ ID NO: 586023 - DNA, 25 bp, Mus musculus
ggaaggacccttcctagctaccgac

SEQ ID NO: 586024 - DNA, 25 bp, Mus musculus
ggaaggacccttgaacatgtggccc

SEQ ID NO: 586025 - DNA, 25 bp, Mus musculus
ggaaggacccttgctagctaccgac

SEQ ID NO: 586026 - DNA, 25 bp, Mus musculus
ggaaggaccgtaaatggccctgacc

SEQ ID NO: 586027 - DNA, 25 bp, Mus musculus
ggaaggaccgtatatggccctgacc

SEQ ID NO: 586028 - DNA, 25 bp, Mus musculus
ggaaggacctgcagtgcagtctctc

SEQ ID NO: 586029 - DNA, 25 bp, Mus musculus
ggaaggacctgctgtgcagtctctc

SEQ ID NO: 586030 - DNA, 25 bp, Mus musculus
ggaaggaccttcctgtggagtcact

SEQ ID NO: 586031 - DNA, 25 bp, Mus musculus
ggaaggaccttcgtgtggagtcact

SEQ ID NO: 586032 - DNA, 25 bp, Mus musculus
ggaaggacgatgactgcctgaacat

SEQ ID NO: 586033 - DNA, 25 bp, Mus musculus
ggaaggacgatgtctgcctgaacat

SEQ ID NO: 586034 - DNA, 25 bp, Mus musculus
ggaaggacgcaccaagccgaaagta

SEQ ID NO: 586035 - DNA, 25 bp, Mus musculus
ggaaggacgcacgaagccgaaagta

SEQ ID NO: 586036 - DNA, 25 bp, Mus musculus
ggaaggacgccaacttgttaacaga

SEQ ID NO: 586037 - DNA, 25 bp, Mus musculus
ggaaggacgccatcttgttaacaga

SEQ ID NO: 586038 - DNA, 25 bp, Mus musculus
ggaaggactatgaacctggccagcc

SEQ ID NO: 586039 - DNA, 25 bp, Mus musculus
ggaaggactatgtacctggccagcc

SEQ ID NO: 586040 - DNA, 25 bp, Mus musculus
ggaaggactcatcccagcgtcttga

SEQ ID NO: 586041 - DNA, 25 bp, Mus musculus
ggaaggactcatgccagcgtcttga

SEQ ID NO: 586042 - DNA, 25 bp, Mus musculus
ggaaggactcgacaaactacatgat

SEQ ID NO: 586043 - DNA, 25 bp, Mus musculus
ggaaggactcgagaaactacatgat

SEQ ID NO: 586044 - DNA, 25 bp, Mus musculus
ggaaggactgtcaaatggctctaaa

SEQ ID NO: 586045 - DNA, 25 bp, Mus musculus
ggaaggactgtctaatggctctaaa

SEQ ID NO: 586046 - DNA, 25 bp, Mus musculus
ggaaggagaccccacactgtcaagt

SEQ ID NO: 586047 - DNA, 25 bp, Mus musculus
ggaaggagacccgacactgtcaagt

SEQ ID NO: 586048 - DNA, 25 bp, Mus musculus
ggaaggagagccacagtgcttctaa

SEQ ID NO: 586049 - DNA, 25 bp, Mus musculus
ggaaggagagcctcagtgcttctaa

SEQ ID NO: 586050 - DNA, 25 bp, Mus musculus
ggaaggagataacctccacctcttc

SEQ ID NO: 586051 - DNA, 25 bp, Mus musculus
ggaaggagataagctccacctcttc

SEQ ID NO: 586052 - DNA, 25 bp, Mus musculus
ggaaggagatccagacacctcacct

SEQ ID NO: 586053 - DNA, 25 bp, Mus musculus
ggaaggagatcctgacacctcacct

SEQ ID NO: 586054 - DNA, 25 bp, Mus musculus
ggaaggagcatcaataccacctaga

SEQ ID NO: 586055 - DNA, 25 bp, Mus musculus
ggaaggagcatctataccacctaga

SEQ ID NO: 586056 - DNA, 25 bp, Mus musculus
ggaaggagccccagagtctgcctgc

SEQ ID NO: 586057 - DNA, 25 bp, Mus musculus
ggaaggagccccagcaacataagaa

SEQ ID NO: 586058 - DNA, 25 bp, Mus musculus
ggaaggagccccatgggccagcact

SEQ ID NO: 586059 - DNA, 25 bp, Mus musculus
ggaaggagccccatttttgtagcgg

SEQ ID NO: 586060 - DNA, 25 bp, Mus musculus
ggaaggagcccctgagtctgcctgc

SEQ ID NO: 586061 - DNA, 25 bp, Mus musculus
ggaaggagcccctgcaacataagaa

SEQ ID NO: 586062 - DNA, 25 bp, Mus musculus
ggaaggagccccttgggccagcact

SEQ ID NO: 586063 - DNA, 25 bp, Mus musculus
ggaaggagccccttttttgtagcgg

SEQ ID NO: 586064 - DNA, 25 bp, Mus musculus
ggaaggagcctccataggtccacgt

SEQ ID NO: 586065 - DNA, 25 bp, Mus musculus
ggaaggagcctcgataggtccacgt

SEQ ID NO: 586066 - DNA, 25 bp, Mus musculus
ggaaggagcttcatgctaccacctc

SEQ ID NO: 586067 - DNA, 25 bp, Mus musculus
ggaaggagcttcttgctaccacctc

SEQ ID NO: 586068 - DNA, 25 bp, Mus musculus
ggaaggagctttcccgcagcctgtc

SEQ ID NO: 586069 - DNA, 25 bp, Mus musculus
ggaaggagctttgccgcagcctgtc

SEQ ID NO: 586070 - DNA, 25 bp, Mus musculus
ggaaggagtactcctgattccaccc

SEQ ID NO: 586071 - DNA, 25 bp, Mus musculus
ggaaggagtactgctgattccaccc

SEQ ID NO: 586072 - DNA, 25 bp, Mus musculus
ggaaggatacgccaatgtcaagaaa

SEQ ID NO: 586073 - DNA, 25 bp, Mus musculus
ggaaggatacgcgaatgtcaagaaa

SEQ ID NO: 586074 - DNA, 25 bp, Mus musculus
ggaaggatagttcaccctgaatatt

SEQ ID NO: 586075 - DNA, 25 bp, Mus musculus
ggaaggatagttgaccctgaatatt

SEQ ID NO: 586076 - DNA, 25 bp, Mus musculus
ggaaggatatttagtacatactgag

SEQ ID NO: 586077 - DNA, 25 bp, Mus musculus
ggaaggatatttcactgagacttgt

SEQ ID NO: 586078 - DNA, 25 bp, Mus musculus
ggaaggatatttgactgagacttgt

SEQ ID NO: 586079 - DNA, 25 bp, Mus musculus
ggaaggatattttgtacatactgag

SEQ ID NO: 586080 - DNA, 25 bp, Mus musculus
ggaaggatcacccagtaattaacta

SEQ ID NO: 586081 - DNA, 25 bp, Mus musculus
ggaaggatcaccgagtaattaacta

SEQ ID NO: 586082 - DNA, 25 bp, Mus musculus
ggaaggatctgtccatttcaatcta

SEQ ID NO: 586083 - DNA, 25 bp, Mus musculus
ggaaggatctgtgcatttcaatcta

SEQ ID NO: 586084 - DNA, 25 bp, Mus musculus
ggaaggatcttccaggagaccctcc

SEQ ID NO: 586085 - DNA, 25 bp, Mus musculus
ggaaggatcttcgaggagaccctcc

SEQ ID NO: 586086 - DNA, 25 bp, Mus musculus
ggaaggatcttgcacctgattgatg

SEQ ID NO: 586087 - DNA, 25 bp, Mus musculus
ggaaggatcttggacctgattgatg

SEQ ID NO: 586088 - DNA, 25 bp, Mus musculus
ggaaggatgaccaaacaaaaggaga

SEQ ID NO: 586089 - DNA, 25 bp, Mus musculus
ggaaggatgacctaacaaaaggaga

SEQ ID NO: 586090 - DNA, 25 bp, Mus musculus
ggaaggatgcatagagacatttcaa

SEQ ID NO: 586091 - DNA, 25 bp, Mus musculus
ggaaggatgcattgagacatttcaa

SEQ ID NO: 586092 - DNA, 25 bp, Mus musculus
ggaaggatgcgaactctgacggctt

SEQ ID NO: 586093 - DNA, 25 bp, Mus musculus
ggaaggatgcgatctctgacggctt

SEQ ID NO: 586094 - DNA, 25 bp, Mus musculus
ggaaggatgctgaagccacctacct

SEQ ID NO: 586095 - DNA, 25 bp, Mus musculus
ggaaggatgctgtagccacctacct

SEQ ID NO: 586096 - DNA, 25 bp, Mus musculus
ggaaggatggacactgctcttgccc

SEQ ID NO: 586097 - DNA, 25 bp, Mus musculus
ggaaggatggactctgctcttgccc

SEQ ID NO: 586098 - DNA, 25 bp, Mus musculus
ggaaggatgggcacagactacaata

SEQ ID NO: 586099 - DNA, 25 bp, Mus musculus
ggaaggatgggctcagactacaata

SEQ ID NO: 586100 - DNA, 25 bp, Mus musculus
ggaaggatggttcagctcttttaaa

SEQ ID NO: 586101 - DNA, 25 bp, Mus musculus
ggaaggatggttgagctcttttaaa

SEQ ID NO: 586102 - DNA, 25 bp, Mus musculus
ggaaggatgtttattcaatcacagt

SEQ ID NO: 586103 - DNA, 25 bp, Mus musculus
ggaaggatgttttttcaatcacagt

SEQ ID NO: 586104 - DNA, 25 bp, Mus musculus
ggaaggattcacacaacctactctc

SEQ ID NO: 586105 - DNA, 25 bp, Mus musculus
ggaaggattcactcaacctactctc

SEQ ID NO: 586106 - DNA, 25 bp, Mus musculus
ggaaggattccgctatgagatagac

SEQ ID NO: 586107 - DNA, 25 bp, Mus musculus
ggaaggattccggtatgagatagac

SEQ ID NO: 586108 - DNA, 25 bp, Mus musculus
ggaaggattgctagtcagccagcct

SEQ ID NO: 586109 - DNA, 25 bp, Mus musculus
ggaaggattgcttgtcagccagcct

SEQ ID NO: 586110 - DNA, 25 bp, Mus musculus
ggaaggatttatattggcccatgat

SEQ ID NO: 586111 - DNA, 25 bp, Mus musculus
ggaaggatttattttggcccatgat

SEQ ID NO: 586112 - DNA, 25 bp, Mus musculus
ggaaggatttcgctgcctgaatcct

SEQ ID NO: 586113 - DNA, 25 bp, Mus musculus
ggaaggatttcggtgcctgaatcct

SEQ ID NO: 586114 - DNA, 25 bp, Mus musculus
ggaaggatttctaccagctcgtgtg

SEQ ID NO: 586115 - DNA, 25 bp, Mus musculus
ggaaggatttctcccataatgccca

SEQ ID NO: 586116 - DNA, 25 bp, Mus musculus
ggaaggatttctgccataatgccca

SEQ ID NO: 586117 - DNA, 25 bp, Mus musculus
ggaaggatttcttccagctcgtgtg

SEQ ID NO: 586118 - DNA, 25 bp, Mus musculus
ggaaggcaacgaacaggatcaggac

SEQ ID NO: 586119 - DNA, 25 bp, Mus musculus
ggaaggcaacgatcaggatcaggac

SEQ ID NO: 586120 - DNA, 25 bp, Mus musculus
ggaaggcaacttaccctaccaccat

SEQ ID NO: 586121 - DNA, 25 bp, Mus musculus
ggaaggcaactttccctaccaccat

SEQ ID NO: 586122 - DNA, 25 bp, Mus musculus
ggaaggcaagaacctcaccagcatt

SEQ ID NO: 586123 - DNA, 25 bp, Mus musculus
ggaaggcaagaagctcaccagcatt

SEQ ID NO: 586124 - DNA, 25 bp, Mus musculus
ggaaggcaagggactgctcccatca

SEQ ID NO: 586125 - DNA, 25 bp, Mus musculus
ggaaggcaagggtctgctcccatca

SEQ ID NO: 586126 - DNA, 25 bp, Mus musculus
ggaaggcacaatagacacctcctcc

SEQ ID NO: 586127 - DNA, 25 bp, Mus musculus
ggaaggcacaattgacacctcctcc

SEQ ID NO: 586128 - DNA, 25 bp, Mus musculus
ggaaggcacccacaaagccgtgtgt

SEQ ID NO: 586129 - DNA, 25 bp, Mus musculus
ggaaggcacccagaaagccgtgtgt

SEQ ID NO: 586130 - DNA, 25 bp, Mus musculus
ggaaggcacctgcttgacacatcct

SEQ ID NO: 586131 - DNA, 25 bp, Mus musculus
ggaaggcacctggttgacacatcct

SEQ ID NO: 586132 - DNA, 25 bp, Mus musculus
ggaaggcaccttcagcagttggctt

SEQ ID NO: 586133 - DNA, 25 bp, Mus musculus
ggaaggcaccttgagcagttggctt

SEQ ID NO: 586134 - DNA, 25 bp, Mus musculus
ggaaggcactagagggcaacccagt

SEQ ID NO: 586135 - DNA, 25 bp, Mus musculus
ggaaggcactagtgggcaacccagt

SEQ ID NO: 586136 - DNA, 25 bp, Mus musculus
ggaaggcactgcatgttcattctct

SEQ ID NO: 586137 - DNA, 25 bp, Mus musculus
ggaaggcactgcttgttcattctct

SEQ ID NO: 586138 - DNA, 25 bp, Mus musculus
ggaaggcacttaatactctgtatca

SEQ ID NO: 586139 - DNA, 25 bp, Mus musculus
ggaaggcacttattactctgtatca

SEQ ID NO: 586140 - DNA, 25 bp, Mus musculus
ggaaggcagaaacccgatcgatcat

SEQ ID NO: 586141 - DNA, 25 bp, Mus musculus
ggaaggcagaaagccgatcgatcat

SEQ ID NO: 586142 - DNA, 25 bp, Mus musculus
ggaaggcagatccttggtcccactg

SEQ ID NO: 586143 - DNA, 25 bp, Mus musculus
ggaaggcagatcgttggtcccactg

SEQ ID NO: 586144 - DNA, 25 bp, Mus musculus
ggaaggcagcttcgcccctgtacag

SEQ ID NO: 586145 - DNA, 25 bp, Mus musculus
ggaaggcagcttggcccctgtacag

SEQ ID NO: 586146 - DNA, 25 bp, Mus musculus
ggaaggcaggaaaactcatttatgt

SEQ ID NO: 586147 - DNA, 25 bp, Mus musculus
ggaaggcaggaatactcatttatgt

SEQ ID NO: 586148 - DNA, 25 bp, Mus musculus
ggaaggcatcttccacttatagtgg

SEQ ID NO: 586149 - DNA, 25 bp, Mus musculus
ggaaggcatcttgcacttatagtgg

SEQ ID NO: 586150 - DNA, 25 bp, Mus musculus
ggaaggcatgctctatgttcatagt

SEQ ID NO: 586151 - DNA, 25 bp, Mus musculus
ggaaggcatgctgtatgttcatagt

SEQ ID NO: 586152 - DNA, 25 bp, Mus musculus
ggaaggcatggcatcactgatgaag

SEQ ID NO: 586153 - DNA, 25 bp, Mus musculus
ggaaggcatggcttcactgatgaag

SEQ ID NO: 586154 - DNA, 25 bp, Mus musculus
ggaaggccaatgagaatctggcata

SEQ ID NO: 586155 - DNA, 25 bp, Mus musculus
ggaaggccaatgtgaatctggcata

SEQ ID NO: 586156 - DNA, 25 bp, Mus musculus
ggaaggccacaaagttgctgattat

SEQ ID NO: 586157 - DNA, 25 bp, Mus musculus
ggaaggccacaatgttgctgattat

SEQ ID NO: 586158 - DNA, 25 bp, Mus musculus
ggaaggccacatatactgtcttgta

SEQ ID NO: 586159 - DNA, 25 bp, Mus musculus
ggaaggccacatctacttcaacaaa

SEQ ID NO: 586160 - DNA, 25 bp, Mus musculus
ggaaggccacatgtacttcaacaaa

SEQ ID NO: 586161 - DNA, 25 bp, Mus musculus
ggaaggccacatttactgtcttgta

SEQ ID NO: 586162 - DNA, 25 bp, Mus musculus
ggaaggccacttaccttgtagtgat

SEQ ID NO: 586163 - DNA, 25 bp, Mus musculus
ggaaggccactttccttgtagtgat

SEQ ID NO: 586164 - DNA, 25 bp, Mus musculus
ggaaggccagctagatcccagctgc

SEQ ID NO: 586165 - DNA, 25 bp, Mus musculus
ggaaggccagcttgatcccagctgc

SEQ ID NO: 586166 - DNA, 25 bp, Mus musculus
ggaaggccagtaatacctacagata

SEQ ID NO: 586167 - DNA, 25 bp, Mus musculus
ggaaggccagtattacctacagata

SEQ ID NO: 586168 - DNA, 25 bp, Mus musculus
ggaaggccatgaagactcggtccac

SEQ ID NO: 586169 - DNA, 25 bp, Mus musculus
ggaaggccatgatgactcggtccac

SEQ ID NO: 586170 - DNA, 25 bp, Mus musculus
ggaaggccccatcctggctttgata

SEQ ID NO: 586171 - DNA, 25 bp, Mus musculus
ggaaggccccatgctggctttgata

SEQ ID NO: 586172 - DNA, 25 bp, Mus musculus
ggaaggccccttcaggctgattaca

SEQ ID NO: 586173 - DNA, 25 bp, Mus musculus
ggaaggccccttgaggctgattaca

SEQ ID NO: 586174 - DNA, 25 bp, Mus musculus
ggaaggccctagatctgggacaaga

SEQ ID NO: 586175 - DNA, 25 bp, Mus musculus
ggaaggccctagttctgggacaaga

SEQ ID NO: 586176 - DNA, 25 bp, Mus musculus
ggaaggcctccaaacaaagtgaaga

SEQ ID NO: 586177 - DNA, 25 bp, Mus musculus
ggaaggcctccatacaaagtgaaga

SEQ ID NO: 586178 - DNA, 25 bp, Mus musculus
ggaaggcctcctcagtgtgcgggat

SEQ ID NO: 586179 - DNA, 25 bp, Mus musculus
ggaaggcctcctgagtgtgcgggat

SEQ ID NO: 586180 - DNA, 25 bp, Mus musculus
ggaaggcctgacctttaaccagaat

SEQ ID NO: 586181 - DNA, 25 bp, Mus musculus
ggaaggcctgacctttgtgatcaca

SEQ ID NO: 586182 - DNA, 25 bp, Mus musculus
ggaaggcctgacgtttaaccagaat

SEQ ID NO: 586183 - DNA, 25 bp, Mus musculus
ggaaggcctgacgtttgtgatcaca

SEQ ID NO: 586184 - DNA, 25 bp, Mus musculus
ggaaggccttaacctctattcagga

SEQ ID NO: 586185 - DNA, 25 bp, Mus musculus
ggaaggccttaagctctattcagga

SEQ ID NO: 586186 - DNA, 25 bp, Mus musculus
ggaaggccttcacgcggacctctca

SEQ ID NO: 586187 - DNA, 25 bp, Mus musculus
ggaaggccttcacttgtagctcata

SEQ ID NO: 586188 - DNA, 25 bp, Mus musculus
ggaaggccttcaggcggacctctca

SEQ ID NO: 586189 - DNA, 25 bp, Mus musculus
ggaaggccttcagttgtagctcata

SEQ ID NO: 586190 - DNA, 25 bp, Mus musculus
ggaaggcctttactgtatctgtgat

SEQ ID NO: 586191 - DNA, 25 bp, Mus musculus
ggaaggcctttagtgtatctgtgat

SEQ ID NO: 586192 - DNA, 25 bp, Mus musculus
ggaaggcgaaggactgtatctgatc

SEQ ID NO: 586193 - DNA, 25 bp, Mus musculus
ggaaggcgaaggtctgtatctgatc

SEQ ID NO: 586194 - DNA, 25 bp, Mus musculus
ggaaggcgacagacttattattgga

SEQ ID NO: 586195 - DNA, 25 bp, Mus musculus
ggaaggcgacagtcttattattgga

SEQ ID NO: 586196 - DNA, 25 bp, Mus musculus
ggaaggcgagcgacccatcaaggaa

SEQ ID NO: 586197 - DNA, 25 bp, Mus musculus
ggaaggcgagcgtcccatcaaggaa

SEQ ID NO: 586198 - DNA, 25 bp, Mus musculus
ggaaggcgcaatctctggttcttaa

SEQ ID NO: 586199 - DNA, 25 bp, Mus musculus
ggaaggcgcaatgtctggttcttaa

SEQ ID NO: 586200 - DNA, 25 bp, Mus musculus
ggaaggcgccttagccactgaggaa

SEQ ID NO: 586201 - DNA, 25 bp, Mus musculus
ggaaggcgcctttgccactgaggaa

SEQ ID NO: 586202 - DNA, 25 bp, Mus musculus
ggaaggcggcgtacagcacatcagc

SEQ ID NO: 586203 - DNA, 25 bp, Mus musculus
ggaaggcggcgttcagcacatcagc

SEQ ID NO: 586204 - DNA, 25 bp, Mus musculus
ggaaggcgtgaacacctaactaagt

SEQ ID NO: 586205 - DNA, 25 bp, Mus musculus
ggaaggcgtgaagacctaactaagt

SEQ ID NO: 586206 - DNA, 25 bp, Mus musculus
ggaaggcgttaaaaatgtcctgctt

SEQ ID NO: 586207 - DNA, 25 bp, Mus musculus
ggaaggcgttaataatgtcctgctt

SEQ ID NO: 586208 - DNA, 25 bp, Mus musculus
ggaaggctacagcttcagataccat

SEQ ID NO: 586209 - DNA, 25 bp, Mus musculus
ggaaggctacaggttcagataccat

SEQ ID NO: 586210 - DNA, 25 bp, Mus musculus
ggaaggctagctctaaatctcacca

SEQ ID NO: 586211 - DNA, 25 bp, Mus musculus
ggaaggctagctgtaaatctcacca

SEQ ID NO: 586212 - DNA, 25 bp, Mus musculus
ggaaggctaggtcagtcagccccaa

SEQ ID NO: 586213 - DNA, 25 bp, Mus musculus
ggaaggctaggtgagtcagccccaa

SEQ ID NO: 586214 - DNA, 25 bp, Mus musculus
ggaaggctatccaaggtgtgtaaac

SEQ ID NO: 586215 - DNA, 25 bp, Mus musculus
ggaaggctatcctaggtgtgtaaac

SEQ ID NO: 586216 - DNA, 25 bp, Mus musculus
ggaaggctcagcagatgtccagctt

SEQ ID NO: 586217 - DNA, 25 bp, Mus musculus
ggaaggctcagctgatgtccagctt

SEQ ID NO: 586218 - DNA, 25 bp, Mus musculus
ggaaggctcagtcgcagaccactgc

SEQ ID NO: 586219 - DNA, 25 bp, Mus musculus
ggaaggctcagtggcagaccactgc

SEQ ID NO: 586220 - DNA, 25 bp, Mus musculus
ggaaggctccaacaccccttataga

SEQ ID NO: 586221 - DNA, 25 bp, Mus musculus
ggaaggctccaagaccccttataga

SEQ ID NO: 586222 - DNA, 25 bp, Mus musculus
ggaaggctccgaaatggctaagcaa

SEQ ID NO: 586223 - DNA, 25 bp, Mus musculus
ggaaggctccgatatggctaagcaa

SEQ ID NO: 586224 - DNA, 25 bp, Mus musculus
ggaaggctcctgaatgggagtcaca

SEQ ID NO: 586225 - DNA, 25 bp, Mus musculus
ggaaggctcctgtatgggagtcaca

SEQ ID NO: 586226 - DNA, 25 bp, Mus musculus
ggaaggctcgtcataaaacacaagt

SEQ ID NO: 586227 - DNA, 25 bp, Mus musculus
ggaaggctcgtcttaaaacacaagt

SEQ ID NO: 586228 - DNA, 25 bp, Mus musculus
ggaaggctgagaacaactgctccaa

SEQ ID NO: 586229 - DNA, 25 bp, Mus musculus
ggaaggctgagatcaactgctccaa

SEQ ID NO: 586230 - DNA, 25 bp, Mus musculus
ggaaggctgcatactggcttgctac

SEQ ID NO: 586231 - DNA, 25 bp, Mus musculus
ggaaggctgcattctggcttgctac

SEQ ID NO: 586232 - DNA, 25 bp, Mus musculus
ggaaggctgctcaaacaacctcaag

SEQ ID NO: 586233 - DNA, 25 bp, Mus musculus
ggaaggctgctctaacaacctcaag

SEQ ID NO: 586234 - DNA, 25 bp, Mus musculus
ggaaggctgctgattgtggccaacc

SEQ ID NO: 586235 - DNA, 25 bp, Mus musculus
ggaaggctgctgcacactaatttta

SEQ ID NO: 586236 - DNA, 25 bp, Mus musculus
ggaaggctgctggacactaatttta

SEQ ID NO: 586237 - DNA, 25 bp, Mus musculus
ggaaggctgctgtttgtggccaacc

SEQ ID NO: 586238 - DNA, 25 bp, Mus musculus
ggaaggctgtcaaggcccagtccat

SEQ ID NO: 586239 - DNA, 25 bp, Mus musculus
ggaaggctgtcatggcccagtccat

SEQ ID NO: 586240 - DNA, 25 bp, Mus musculus
ggaaggctgtgtctctagaactcat

SEQ ID NO: 586241 - DNA, 25 bp, Mus musculus
ggaaggctgtgtgtctagaactcat

SEQ ID NO: 586242 - DNA, 25 bp, Mus musculus
ggaaggcttcagagcatttccctgt

SEQ ID NO: 586243 - DNA, 25 bp, Mus musculus
ggaaggcttcagtgcatttccctgt

SEQ ID NO: 586244 - DNA, 25 bp, Mus musculus
ggaaggcttctactgctaactgctg

SEQ ID NO: 586245 - DNA, 25 bp, Mus musculus
ggaaggcttctagtgctaactgctg

SEQ ID NO: 586246 - DNA, 25 bp, Mus musculus
ggaaggcttcttagacctcatttct

SEQ ID NO: 586247 - DNA, 25 bp, Mus musculus
ggaaggcttcttcaacctgctgacc

SEQ ID NO: 586248 - DNA, 25 bp, Mus musculus
ggaaggcttcttcaagagcttcaaa

SEQ ID NO: 586249 - DNA, 25 bp, Mus musculus
ggaaggcttcttgaacctgctgacc

SEQ ID NO: 586250 - DNA, 25 bp, Mus musculus
ggaaggcttcttgaagagcttcaaa

SEQ ID NO: 586251 - DNA, 25 bp, Mus musculus
ggaaggcttctttgacctcatttct

SEQ ID NO: 586252 - DNA, 25 bp, Mus musculus
ggaaggcttgatcctctgttctaaa

SEQ ID NO: 586253 - DNA, 25 bp, Mus musculus
ggaaggcttgatgctctgttctaaa

SEQ ID NO: 586254 - DNA, 25 bp, Mus musculus
ggaaggcttgtgacattttgcataa

SEQ ID NO: 586255 - DNA, 25 bp, Mus musculus
ggaaggcttgtgtcattttgcataa

SEQ ID NO: 586256 - DNA, 25 bp, Mus musculus
ggaaggctttccaccactggtatac

SEQ ID NO: 586257 - DNA, 25 bp, Mus musculus
ggaaggctttccatgacttaacttt

SEQ ID NO: 586258 - DNA, 25 bp, Mus musculus
ggaaggctttcctccactggtatac

SEQ ID NO: 586259 - DNA, 25 bp, Mus musculus
ggaaggctttccttgacttaacttt

SEQ ID NO: 586260 - DNA, 25 bp, Mus musculus
ggaaggctttctctggatagctatt

SEQ ID NO: 586261 - DNA, 25 bp, Mus musculus
ggaaggctttctgtggatagctatt

SEQ ID NO: 586262 - DNA, 25 bp, Mus musculus
ggaaggctttgcagaggccaccaga

SEQ ID NO: 586263 - DNA, 25 bp, Mus musculus
ggaaggctttgcattctacacatac

SEQ ID NO: 586264 - DNA, 25 bp, Mus musculus
ggaaggctttgctgaggccaccaga

SEQ ID NO: 586265 - DNA, 25 bp, Mus musculus
ggaaggctttgctttctacacatac

SEQ ID NO: 586266 - DNA, 25 bp, Mus musculus
ggaagggaatctcgccacagctcac

SEQ ID NO: 586267 - DNA, 25 bp, Mus musculus
ggaagggaatctggccacagctcac

SEQ ID NO: 586268 - DNA, 25 bp, Mus musculus
ggaagggacaagagcccctcatggc

SEQ ID NO: 586269 - DNA, 25 bp, Mus musculus
ggaagggacaagattaccacgttag

SEQ ID NO: 586270 - DNA, 25 bp, Mus musculus
ggaagggacaagtgcccctcatggc

SEQ ID NO: 586271 - DNA, 25 bp, Mus musculus
ggaagggacaagtttaccacgttag

SEQ ID NO: 586272 - DNA, 25 bp, Mus musculus
ggaagggaccttcacatttatgtct

SEQ ID NO: 586273 - DNA, 25 bp, Mus musculus
ggaagggaccttgacatttatgtct

SEQ ID NO: 586274 - DNA, 25 bp, Mus musculus
ggaagggactacaagacgccattgg

SEQ ID NO: 586275 - DNA, 25 bp, Mus musculus
ggaagggactactagacgccattgg

SEQ ID NO: 586276 - DNA, 25 bp, Mus musculus
ggaagggactttctggctcacaaaa

SEQ ID NO: 586277 - DNA, 25 bp, Mus musculus
ggaagggactttgtggctcacaaaa

SEQ ID NO: 586278 - DNA, 25 bp, Mus musculus
ggaagggagctcagcaccctggact

SEQ ID NO: 586279 - DNA, 25 bp, Mus musculus
ggaagggagctctgcaccctggact

SEQ ID NO: 586280 - DNA, 25 bp, Mus musculus
ggaagggagtccattgttgccctct

SEQ ID NO: 586281 - DNA, 25 bp, Mus musculus
ggaagggagtcctttgttgccctct

SEQ ID NO: 586282 - DNA, 25 bp, Mus musculus
ggaagggatcataaacctctctgaa

SEQ ID NO: 586283 - DNA, 25 bp, Mus musculus
ggaagggatcattaacctctctgaa

SEQ ID NO: 586284 - DNA, 25 bp, Mus musculus
ggaagggatccccagcatacagaag

SEQ ID NO: 586285 - DNA, 25 bp, Mus musculus
ggaagggatcccgagcatacagaag

SEQ ID NO: 586286 - DNA, 25 bp, Mus musculus
ggaagggatgcactgtaaaacaaaa

SEQ ID NO: 586287 - DNA, 25 bp, Mus musculus
ggaagggatgcagtgtaaaacaaaa

SEQ ID NO: 586288 - DNA, 25 bp, Mus musculus
ggaagggatggactttcacagattc

SEQ ID NO: 586289 - DNA, 25 bp, Mus musculus
ggaagggatggagtttcacagattc

SEQ ID NO: 586290 - DNA, 25 bp, Mus musculus
ggaagggatggtagaatgctgtatt

SEQ ID NO: 586291 - DNA, 25 bp, Mus musculus
ggaagggatggttgaatgctgtatt

SEQ ID NO: 586292 - DNA, 25 bp, Mus musculus
ggaagggattcaacgtgtcctcacc

SEQ ID NO: 586293 - DNA, 25 bp, Mus musculus
ggaagggattcatcgtgtcctcacc

SEQ ID NO: 586294 - DNA, 25 bp, Mus musculus
ggaagggattccacgtgcggtactc

SEQ ID NO: 586295 - DNA, 25 bp, Mus musculus
ggaagggattcctcgtgcggtactc

SEQ ID NO: 586296 - DNA, 25 bp, Mus musculus
ggaagggattctctgcatgacaaat

SEQ ID NO: 586297 - DNA, 25 bp, Mus musculus
ggaagggattctgtgcatgacaaat

SEQ ID NO: 586298 - DNA, 25 bp, Mus musculus
ggaagggcaagcatatgttggctca

SEQ ID NO: 586299 - DNA, 25 bp, Mus musculus
ggaagggcaagcttatgttggctca

SEQ ID NO: 586300 - DNA, 25 bp, Mus musculus
ggaagggcagccaaaagtccactta

SEQ ID NO: 586301 - DNA, 25 bp, Mus musculus
ggaagggcagcctaaagtccactta

SEQ ID NO: 586302 - DNA, 25 bp, Mus musculus
ggaagggcagttcggacatctttac

SEQ ID NO: 586303 - DNA, 25 bp, Mus musculus
ggaagggcagttgggacatctttac

SEQ ID NO: 586304 - DNA, 25 bp, Mus musculus
ggaagggcatctcaaattcaaggat

SEQ ID NO: 586305 - DNA, 25 bp, Mus musculus
ggaagggcatctgaaattcaaggat

SEQ ID NO: 586306 - DNA, 25 bp, Mus musculus
ggaagggcccagatgtctattatac

SEQ ID NO: 586307 - DNA, 25 bp, Mus musculus
ggaagggcccagttgtctattatac

SEQ ID NO: 586308 - DNA, 25 bp, Mus musculus
ggaagggcccatatagatccctagt

SEQ ID NO: 586309 - DNA, 25 bp, Mus musculus
ggaagggcccatttagatccctagt

SEQ ID NO: 586310 - DNA, 25 bp, Mus musculus
ggaagggcccctcacaccaagagca

SEQ ID NO: 586311 - DNA, 25 bp, Mus musculus
ggaagggcccctgacaccaagagca

SEQ ID NO: 586312 - DNA, 25 bp, Mus musculus
ggaagggccttgactctggagactt

SEQ ID NO: 586313 - DNA, 25 bp, Mus musculus
ggaagggccttgtctctggagactt

SEQ ID NO: 586314 - DNA, 25 bp, Mus musculus
ggaagggcggccaaccagcagttca

SEQ ID NO: 586315 - DNA, 25 bp, Mus musculus
ggaagggcggcctaccagcagttca

SEQ ID NO: 586316 - DNA, 25 bp, Mus musculus
ggaagggcgtttactcctcttgctg

SEQ ID NO: 586317 - DNA, 25 bp, Mus musculus
ggaagggcgttttctcctcttgctg

SEQ ID NO: 586318 - DNA, 25 bp, Mus musculus
ggaagggctacaacagtgcagtgct

SEQ ID NO: 586319 - DNA, 25 bp, Mus musculus
ggaagggctacatcagtgcagtgct

SEQ ID NO: 586320 - DNA, 25 bp, Mus musculus
ggaagggctaccaggtgcgctccat

SEQ ID NO: 586321 - DNA, 25 bp, Mus musculus
ggaagggctacctggtgcgctccat

SEQ ID NO: 586322 - DNA, 25 bp, Mus musculus
ggaagggctatccagagactgctcc

SEQ ID NO: 586323 - DNA, 25 bp, Mus musculus
ggaagggctatcgagagactgctcc

SEQ ID NO: 586324 - DNA, 25 bp, Mus musculus
ggaagggctctacctctctccaaac

SEQ ID NO: 586325 - DNA, 25 bp, Mus musculus
ggaagggctctagctctctccaaac

SEQ ID NO: 586326 - DNA, 25 bp, Mus musculus
ggaagggctcttaacagctgtctct

SEQ ID NO: 586327 - DNA, 25 bp, Mus musculus
ggaagggctctttacagctgtctct

SEQ ID NO: 586328 - DNA, 25 bp, Mus musculus
ggaagggcttcacaccatactatgc

SEQ ID NO: 586329 - DNA, 25 bp, Mus musculus
ggaagggcttcagaccatactatgc

SEQ ID NO: 586330 - DNA, 25 bp, Mus musculus
ggaagggcttctcgccaacaggtaa

SEQ ID NO: 586331 - DNA, 25 bp, Mus musculus
ggaagggcttctggccaacaggtaa

SEQ ID NO: 586332 - DNA, 25 bp, Mus musculus
ggaagggtaacaagctactgacaat

SEQ ID NO: 586333 - DNA, 25 bp, Mus musculus
ggaagggtaacatgctactgacaat

SEQ ID NO: 586334 - DNA, 25 bp, Mus musculus
ggaagggtacaacgccctgcctgct

SEQ ID NO: 586335 - DNA, 25 bp, Mus musculus
ggaagggtacaaggccctgcctgct

SEQ ID NO: 586336 - DNA, 25 bp, Mus musculus
ggaagggtatgcaacgccaccggcc

SEQ ID NO: 586337 - DNA, 25 bp, Mus musculus
ggaagggtatgcatgtagatcttac

SEQ ID NO: 586338 - DNA, 25 bp, Mus musculus
ggaagggtatgctacgccaccggcc

SEQ ID NO: 586339 - DNA, 25 bp, Mus musculus
ggaagggtatgcttgtagatcttac

SEQ ID NO: 586340 - DNA, 25 bp, Mus musculus
ggaagggtccttagcaagcataaac

SEQ ID NO: 586341 - DNA, 25 bp, Mus musculus
ggaagggtcctttgcaagcataaac

SEQ ID NO: 586342 - DNA, 25 bp, Mus musculus
ggaagggtgattacttagatctact

SEQ ID NO: 586343 - DNA, 25 bp, Mus musculus
ggaagggtgatttcttagatctact

SEQ ID NO: 586344 - DNA, 25 bp, Mus musculus
ggaagggtgttcaactgtacagtga

SEQ ID NO: 586345 - DNA, 25 bp, Mus musculus
ggaagggtgttctactgtacagtga

SEQ ID NO: 586346 - DNA, 25 bp, Mus musculus
ggaagggttaccataaactcctctg

SEQ ID NO: 586347 - DNA, 25 bp, Mus musculus
ggaagggttaccttaaactcctctg

SEQ ID NO: 586348 - DNA, 25 bp, Mus musculus
ggaagggttagactctccccacttg

SEQ ID NO: 586349 - DNA, 25 bp, Mus musculus
ggaagggttagagtctccccacttg

SEQ ID NO: 586350 - DNA, 25 bp, Mus musculus
ggaagggttatacgcacacctagaa

SEQ ID NO: 586351 - DNA, 25 bp, Mus musculus
ggaagggttataggcacacctagaa

SEQ ID NO: 586352 - DNA, 25 bp, Mus musculus
ggaagggttcaaaggccatcaggcc

SEQ ID NO: 586353 - DNA, 25 bp, Mus musculus
ggaagggttcaatggccatcaggcc

SEQ ID NO: 586354 - DNA, 25 bp, Mus musculus
ggaaggtaaagtcagggctcacaat

SEQ ID NO: 586355 - DNA, 25 bp, Mus musculus
ggaaggtaaagtgagggctcacaat

SEQ ID NO: 586356 - DNA, 25 bp, Mus musculus
ggaaggtaacgccaaagtcctcctg

SEQ ID NO: 586357 - DNA, 25 bp, Mus musculus
ggaaggtaacgcgaaagtcctcctg

SEQ ID NO: 586358 - DNA, 25 bp, Mus musculus
ggaaggtaagtcacctcggttctgt

SEQ ID NO: 586359 - DNA, 25 bp, Mus musculus
ggaaggtaagtctcctcggttctgt

SEQ ID NO: 586360 - DNA, 25 bp, Mus musculus
ggaaggtacgtgaagctattgcatg

SEQ ID NO: 586361 - DNA, 25 bp, Mus musculus
ggaaggtacgtgtagctattgcatg

SEQ ID NO: 586362 - DNA, 25 bp, Mus musculus
ggaaggtagcaaccacatctttcta

SEQ ID NO: 586363 - DNA, 25 bp, Mus musculus
ggaaggtagcaagcacatctttcta

SEQ ID NO: 586364 - DNA, 25 bp, Mus musculus
ggaaggtatcagaggctgatcgcct

SEQ ID NO: 586365 - DNA, 25 bp, Mus musculus
ggaaggtatcagtggctgatcgcct

SEQ ID NO: 586366 - DNA, 25 bp, Mus musculus
ggaaggtatcccagtggaggactct

SEQ ID NO: 586367 - DNA, 25 bp, Mus musculus
ggaaggtatccctgtggaggactct

SEQ ID NO: 586368 - DNA, 25 bp, Mus musculus
ggaaggtatttcatcactgggctga

SEQ ID NO: 586369 - DNA, 25 bp, Mus musculus
ggaaggtatttcttcactgggctga

SEQ ID NO: 586370 - DNA, 25 bp, Mus musculus
ggaaggtcaacaacagctgtgccaa

SEQ ID NO: 586371 - DNA, 25 bp, Mus musculus
ggaaggtcaacatcagctgtgccaa

SEQ ID NO: 586372 - DNA, 25 bp, Mus musculus
ggaaggtcacacagctggcccaaca

SEQ ID NO: 586373 - DNA, 25 bp, Mus musculus
ggaaggtcacactgctggcccaaca

SEQ ID NO: 586374 - DNA, 25 bp, Mus musculus
ggaaggtcaccgacaagtacgaccg

SEQ ID NO: 586375 - DNA, 25 bp, Mus musculus
ggaaggtcaccgtcaagtacgaccg

SEQ ID NO: 586376 - DNA, 25 bp, Mus musculus
ggaaggtcactaagggataggaaaa

SEQ ID NO: 586377 - DNA, 25 bp, Mus musculus
ggaaggtcactatgggataggaaaa

SEQ ID NO: 586378 - DNA, 25 bp, Mus musculus
ggaaggtcagacatggcatcatttt

SEQ ID NO: 586379 - DNA, 25 bp, Mus musculus
ggaaggtcagacttggcatcatttt

SEQ ID NO: 586380 - DNA, 25 bp, Mus musculus
ggaaggtcagcaaagggcatcgaat

SEQ ID NO: 586381 - DNA, 25 bp, Mus musculus
ggaaggtcagcatagggcatcgaat

SEQ ID NO: 586382 - DNA, 25 bp, Mus musculus
ggaaggtcagctcctccgtttcggg

SEQ ID NO: 586383 - DNA, 25 bp, Mus musculus
ggaaggtcagctgctccgtttcggg

SEQ ID NO: 586384 - DNA, 25 bp, Mus musculus
ggaaggtcatttcaagccacgggaa

SEQ ID NO: 586385 - DNA, 25 bp, Mus musculus
ggaaggtcatttgaagccacgggaa

SEQ ID NO: 586386 - DNA, 25 bp, Mus musculus
ggaaggtccaatacttcaggtccct

SEQ ID NO: 586387 - DNA, 25 bp, Mus musculus
ggaaggtccaattcttcaggtccct

SEQ ID NO: 586388 - DNA, 25 bp, Mus musculus
ggaaggtccatacggttataacagg

SEQ ID NO: 586389 - DNA, 25 bp, Mus musculus
ggaaggtccatagggttataacagg

SEQ ID NO: 586390 - DNA, 25 bp, Mus musculus
ggaaggtccctgaaatatgcccaga

SEQ ID NO: 586391 - DNA, 25 bp, Mus musculus
ggaaggtccctgtaatatgcccaga

SEQ ID NO: 586392 - DNA, 25 bp, Mus musculus
ggaaggtcctagacattacgcaaat

SEQ ID NO: 586393 - DNA, 25 bp, Mus musculus
ggaaggtcctagtcattacgcaaat

SEQ ID NO: 586394 - DNA, 25 bp, Mus musculus
ggaaggtctcacaacaggaatggat

SEQ ID NO: 586395 - DNA, 25 bp, Mus musculus
ggaaggtctcactacaggaatggat

SEQ ID NO: 586396 - DNA, 25 bp, Mus musculus
ggaaggtctgggaccacttcttcaa

SEQ ID NO: 586397 - DNA, 25 bp, Mus musculus
ggaaggtctgggtccacttcttcaa

SEQ ID NO: 586398 - DNA, 25 bp, Mus musculus
ggaaggtctgtaatcagtggtctaa

SEQ ID NO: 586399 - DNA, 25 bp, Mus musculus
ggaaggtctgtattcagtggtctaa

SEQ ID NO: 586400 - DNA, 25 bp, Mus musculus
ggaaggtctgtcagatgccaaagtc

SEQ ID NO: 586401 - DNA, 25 bp, Mus musculus
ggaaggtctgtctgatgccaaagtc

SEQ ID NO: 586402 - DNA, 25 bp, Mus musculus
ggaaggtctgttactcttattacct

SEQ ID NO: 586403 - DNA, 25 bp, Mus musculus
ggaaggtctgtttctcttattacct

SEQ ID NO: 586404 - DNA, 25 bp, Mus musculus
ggaaggtcttcaacactccagaaag

SEQ ID NO: 586405 - DNA, 25 bp, Mus musculus
ggaaggtcttcatcactccagaaag

SEQ ID NO: 586406 - DNA, 25 bp, Mus musculus
ggaaggtgacccatgtggcacagaa

SEQ ID NO: 586407 - DNA, 25 bp, Mus musculus
ggaaggtgacccttgtggcacagaa

SEQ ID NO: 586408 - DNA, 25 bp, Mus musculus
ggaaggtgacttccccccactgtgg

SEQ ID NO: 586409 - DNA, 25 bp, Mus musculus
ggaaggtgacttgcccccactgtgg

SEQ ID NO: 586410 - DNA, 25 bp, Mus musculus
ggaaggtgattacgctccaagctaa

SEQ ID NO: 586411 - DNA, 25 bp, Mus musculus
ggaaggtgattaggctccaagctaa

SEQ ID NO: 586412 - DNA, 25 bp, Mus musculus
ggaaggtgattcaagaagtactgaa

SEQ ID NO: 586413 - DNA, 25 bp, Mus musculus
ggaaggtgattctagaagtactgaa

SEQ ID NO: 586414 - DNA, 25 bp, Mus musculus
ggaaggtgcctcaacagacccaggg

SEQ ID NO: 586415 - DNA, 25 bp, Mus musculus
ggaaggtgcctctacagacccaggg

SEQ ID NO: 586416 - DNA, 25 bp, Mus musculus
ggaaggtggctcactgaaagtttgt

SEQ ID NO: 586417 - DNA, 25 bp, Mus musculus
ggaaggtggctctctgaaagtttgt

SEQ ID NO: 586418 - DNA, 25 bp, Mus musculus
ggaaggtgggaaagccattctgctc

SEQ ID NO: 586419 - DNA, 25 bp, Mus musculus
ggaaggtgggaatgccattctgctc

SEQ ID NO: 586420 - DNA, 25 bp, Mus musculus
ggaaggtgtatcaccagtctgagga

SEQ ID NO: 586421 - DNA, 25 bp, Mus musculus
ggaaggtgtatctccagtctgagga

SEQ ID NO: 586422 - DNA, 25 bp, Mus musculus
ggaaggtgtggcacattgactttaa

SEQ ID NO: 586423 - DNA, 25 bp, Mus musculus
ggaaggtgtggctcattgactttaa

SEQ ID NO: 586424 - DNA, 25 bp, Mus musculus
ggaaggtgtgttcttccctgtgaat

SEQ ID NO: 586425 - DNA, 25 bp, Mus musculus
ggaaggtgtgttgttccctgtgaat

SEQ ID NO: 586426 - DNA, 25 bp, Mus musculus
ggaaggtgtttgacctttctctctg

SEQ ID NO: 586427 - DNA, 25 bp, Mus musculus
ggaaggtgtttgtcctttctctctg

SEQ ID NO: 586428 - DNA, 25 bp, Mus musculus
ggaaggttacccaggtgccaccagt

SEQ ID NO: 586429 - DNA, 25 bp, Mus musculus
ggaaggttaccctggtgccaccagt

SEQ ID NO: 586430 - DNA, 25 bp, Mus musculus
ggaaggttagctctaatcacgtgag

SEQ ID NO: 586431 - DNA, 25 bp, Mus musculus
ggaaggttagctgtaatcacgtgag

SEQ ID NO: 586432 - DNA, 25 bp, Mus musculus
ggaaggttatgtaactctccaccca

SEQ ID NO: 586433 - DNA, 25 bp, Mus musculus
ggaaggttatgttactctccaccca

SEQ ID NO: 586434 - DNA, 25 bp, Mus musculus
ggaaggttcaagctctaccgagtcc

SEQ ID NO: 586435 - DNA, 25 bp, Mus musculus
ggaaggttcaaggtctaccgagtcc

SEQ ID NO: 586436 - DNA, 25 bp, Mus musculus
ggaaggttcatccatcgctgatcct

SEQ ID NO: 586437 - DNA, 25 bp, Mus musculus
ggaaggttcatcgatcgctgatcct

SEQ ID NO: 586438 - DNA, 25 bp, Mus musculus
ggaaggttccttagggctcagagtt

SEQ ID NO: 586439 - DNA, 25 bp, Mus musculus
ggaaggttccttcacgtgtctgccc

SEQ ID NO: 586440 - DNA, 25 bp, Mus musculus
ggaaggttccttgacgtgtctgccc

SEQ ID NO: 586441 - DNA, 25 bp, Mus musculus
ggaaggttcctttgggctcagagtt

SEQ ID NO: 586442 - DNA, 25 bp, Mus musculus
ggaaggttcgccatcaggagacaca

SEQ ID NO: 586443 - DNA, 25 bp, Mus musculus
ggaaggttcgccttcaggagacaca

SEQ ID NO: 586444 - DNA, 25 bp, Mus musculus
ggaaggttctggattcaccacacat

SEQ ID NO: 586445 - DNA, 25 bp, Mus musculus
ggaaggttctggtttcaccacacat

SEQ ID NO: 586446 - DNA, 25 bp, Mus musculus
ggaaggttcttgaaacattgtagaa

SEQ ID NO: 586447 - DNA, 25 bp, Mus musculus
ggaaggttcttgaacacgtgcccct

SEQ ID NO: 586448 - DNA, 25 bp, Mus musculus
ggaaggttcttgtaacattgtagaa

SEQ ID NO: 586449 - DNA, 25 bp, Mus musculus
ggaaggttcttgtacacgtgcccct

SEQ ID NO: 586450 - DNA, 25 bp, Mus musculus
ggaaggttgaacataagcacaattt

SEQ ID NO: 586451 - DNA, 25 bp, Mus musculus
ggaaggttgaacttaagcacaattt

SEQ ID NO: 586452 - DNA, 25 bp, Mus musculus
ggaaggttgccaagaggatccctct

SEQ ID NO: 586453 - DNA, 25 bp, Mus musculus
ggaaggttgccatgaggatccctct

SEQ ID NO: 586454 - DNA, 25 bp, Mus musculus
ggaaggttggctaacagccaccctt

SEQ ID NO: 586455 - DNA, 25 bp, Mus musculus
ggaaggttggcttacagccaccctt

SEQ ID NO: 586456 - DNA, 25 bp, Mus musculus
ggaaggtttcacagccagatactga

SEQ ID NO: 586457 - DNA, 25 bp, Mus musculus
ggaaggtttcactgccagatactga

SEQ ID NO: 586458 - DNA, 25 bp, Mus musculus
ggaaggtttccaccaactgaatcat

SEQ ID NO: 586459 - DNA, 25 bp, Mus musculus
ggaaggtttccagcaactgaatcat

SEQ ID NO: 586460 - DNA, 25 bp, Mus musculus
ggaaggttttctatttgtcctgcct

SEQ ID NO: 586461 - DNA, 25 bp, Mus musculus
ggaaggttttctttttgtcctgcct

SEQ ID NO: 586462 - DNA, 25 bp, Mus musculus
ggaaggtttttccttgctacacctg

SEQ ID NO: 586463 - DNA, 25 bp, Mus musculus
ggaaggtttttcgttgctacacctg

SEQ ID NO: 586464 - DNA, 25 bp, Mus musculus
ggaagtaaattccactgtccatttg

SEQ ID NO: 586465 - DNA, 25 bp, Mus musculus
ggaagtaaattcgactgtccatttg

SEQ ID NO: 586466 - DNA, 25 bp, Mus musculus
ggaagtaaccacacagtcctggctg

SEQ ID NO: 586467 - DNA, 25 bp, Mus musculus
ggaagtaaccactcagtcctggctg

SEQ ID NO: 586468 - DNA, 25 bp, Mus musculus
ggaagtaaccttcaggcccgactgg

SEQ ID NO: 586469 - DNA, 25 bp, Mus musculus
ggaagtaaccttgaggcccgactgg

SEQ ID NO: 586470 - DNA, 25 bp, Mus musculus
ggaagtaacggacacccaatgtcta

SEQ ID NO: 586471 - DNA, 25 bp, Mus musculus
ggaagtaacggagacccaatgtcta

SEQ ID NO: 586472 - DNA, 25 bp, Mus musculus
ggaagtaagcatagagcgtcctcag

SEQ ID NO: 586473 - DNA, 25 bp, Mus musculus
ggaagtaagcattgagcgtcctcag

SEQ ID NO: 586474 - DNA, 25 bp, Mus musculus
ggaagtaatctcactcactgtcctt

SEQ ID NO: 586475 - DNA, 25 bp, Mus musculus
ggaagtaatctctctcactgtcctt

SEQ ID NO: 586476 - DNA, 25 bp, Mus musculus
ggaagtaatgtgagccgttctccca

SEQ ID NO: 586477 - DNA, 25 bp, Mus musculus
ggaagtaatgtgtgccgttctccca

SEQ ID NO: 586478 - DNA, 25 bp, Mus musculus
ggaagtaattcacaaccagctgtta

SEQ ID NO: 586479 - DNA, 25 bp, Mus musculus
ggaagtaattcagaaccagctgtta

SEQ ID NO: 586480 - DNA, 25 bp, Mus musculus
ggaagtacaaatcctcctgagaatg

SEQ ID NO: 586481 - DNA, 25 bp, Mus musculus
ggaagtacaaatgctcctgagaatg

SEQ ID NO: 586482 - DNA, 25 bp, Mus musculus
ggaagtacacacaatactgtttgga

SEQ ID NO: 586483 - DNA, 25 bp, Mus musculus
ggaagtacacactatactgtttgga

SEQ ID NO: 586484 - DNA, 25 bp, Mus musculus
ggaagtacactaccaatctatgtct

SEQ ID NO: 586485 - DNA, 25 bp, Mus musculus
ggaagtacactagcaatctatgtct

SEQ ID NO: 586486 - DNA, 25 bp, Mus musculus
ggaagtacacttacttgtatctagt

SEQ ID NO: 586487 - DNA, 25 bp, Mus musculus
ggaagtacactttcttgtatctagt

SEQ ID NO: 586488 - DNA, 25 bp, Mus musculus
ggaagtacagacaaactgctgtttt

SEQ ID NO: 586489 - DNA, 25 bp, Mus musculus
ggaagtacagactaactgctgtttt

SEQ ID NO: 586490 - DNA, 25 bp, Mus musculus
ggaagtacagataccattgaaagga

SEQ ID NO: 586491 - DNA, 25 bp, Mus musculus
ggaagtacagattccattgaaagga

SEQ ID NO: 586492 - DNA, 25 bp, Mus musculus
ggaagtacagcactagtcctcccgg

SEQ ID NO: 586493 - DNA, 25 bp, Mus musculus
ggaagtacagcagtagtcctcccgg

SEQ ID NO: 586494 - DNA, 25 bp, Mus musculus
ggaagtacaggcatgctcagtttat

SEQ ID NO: 586495 - DNA, 25 bp, Mus musculus
ggaagtacaggcttgctcagtttat

SEQ ID NO: 586496 - DNA, 25 bp, Mus musculus
ggaagtacaggtattgcacagcatt

SEQ ID NO: 586497 - DNA, 25 bp, Mus musculus
ggaagtacaggtcgttacctaagct

SEQ ID NO: 586498 - DNA, 25 bp, Mus musculus
ggaagtacaggtggttacctaagct

SEQ ID NO: 586499 - DNA, 25 bp, Mus musculus
ggaagtacaggttttgcacagcatt

SEQ ID NO: 586500 - DNA, 25 bp, Mus musculus
ggaagtacagtcatcaggccaaccc

SEQ ID NO: 586501 - DNA, 25 bp, Mus musculus
ggaagtacagtcttcaggccaaccc

SEQ ID NO: 586502 - DNA, 25 bp, Mus musculus
ggaagtaccaatacccagaagttga

SEQ ID NO: 586503 - DNA, 25 bp, Mus musculus
ggaagtaccaattcccagaagttga

SEQ ID NO: 586504 - DNA, 25 bp, Mus musculus
ggaagtaccacactggcctctacac

SEQ ID NO: 586505 - DNA, 25 bp, Mus musculus
ggaagtaccacagtggcctctacac

SEQ ID NO: 586506 - DNA, 25 bp, Mus musculus
ggaagtaccataaccaggtctgcac

SEQ ID NO: 586507 - DNA, 25 bp, Mus musculus
ggaagtaccatatccaggtctgcac

SEQ ID NO: 586508 - DNA, 25 bp, Mus musculus
ggaagtaccctgatccaggatctgc

SEQ ID NO: 586509 - DNA, 25 bp, Mus musculus
ggaagtaccctgttccaggatctgc

SEQ ID NO: 586510 - DNA, 25 bp, Mus musculus
ggaagtacggcacctcactttggga

SEQ ID NO: 586511 - DNA, 25 bp, Mus musculus
ggaagtacggcagctcactttggga

SEQ ID NO: 586512 - DNA, 25 bp, Mus musculus
ggaagtactctaattctgagaatat

SEQ ID NO: 586513 - DNA, 25 bp, Mus musculus
ggaagtactctatttctgagaatat

SEQ ID NO: 586514 - DNA, 25 bp, Mus musculus
ggaagtactgacaggtgctgctcct

SEQ ID NO: 586515 - DNA, 25 bp, Mus musculus
ggaagtactgactggtgctgctcct

SEQ ID NO: 586516 - DNA, 25 bp, Mus musculus
ggaagtactggtagccctggtagtt

SEQ ID NO: 586517 - DNA, 25 bp, Mus musculus
ggaagtactggttgccctggtagtt

SEQ ID NO: 586518 - DNA, 25 bp, Mus musculus
ggaagtacttaaaacactgcacaag

SEQ ID NO: 586519 - DNA, 25 bp, Mus musculus
ggaagtacttaatacactgcacaag

SEQ ID NO: 586520 - DNA, 25 bp, Mus musculus
ggaagtacttggacccctcggacat

SEQ ID NO: 586521 - DNA, 25 bp, Mus musculus
ggaagtacttggtcccctcggacat

SEQ ID NO: 586522 - DNA, 25 bp, Mus musculus
ggaagtacttgtccatgagggaaac

SEQ ID NO: 586523 - DNA, 25 bp, Mus musculus
ggaagtacttgtgcatgagggaaac

SEQ ID NO: 586524 - DNA, 25 bp, Mus musculus
ggaagtagaaccctgataacatgca

SEQ ID NO: 586525 - DNA, 25 bp, Mus musculus
ggaagtagaaccgtgataacatgca

SEQ ID NO: 586526 - DNA, 25 bp, Mus musculus
ggaagtagacagagctcccatagca

SEQ ID NO: 586527 - DNA, 25 bp, Mus musculus
ggaagtagacagtgctcccatagca

SEQ ID NO: 586528 - DNA, 25 bp, Mus musculus
ggaagtagactacagttccccagct

SEQ ID NO: 586529 - DNA, 25 bp, Mus musculus
ggaagtagactagagttccccagct

SEQ ID NO: 586530 - DNA, 25 bp, Mus musculus
ggaagtagaggaacccttgggcact

SEQ ID NO: 586531 - DNA, 25 bp, Mus musculus
ggaagtagaggatcccttgggcact

SEQ ID NO: 586532 - DNA, 25 bp, Mus musculus
ggaagtagcagaatgcctccctgac

SEQ ID NO: 586533 - DNA, 25 bp, Mus musculus
ggaagtagcagattgcctccctgac

SEQ ID NO: 586534 - DNA, 25 bp, Mus musculus
ggaagtagccagctgatcctgccat

SEQ ID NO: 586535 - DNA, 25 bp, Mus musculus
ggaagtagccaggtgatcctgccat

SEQ ID NO: 586536 - DNA, 25 bp, Mus musculus
ggaagtagccgcatccataacagga

SEQ ID NO: 586537 - DNA, 25 bp, Mus musculus
ggaagtagccgcttccataacagga

SEQ ID NO: 586538 - DNA, 25 bp, Mus musculus
ggaagtagcctgaccacaagtccaa

SEQ ID NO: 586539 - DNA, 25 bp, Mus musculus
ggaagtagcctgtccacaagtccaa

SEQ ID NO: 586540 - DNA, 25 bp, Mus musculus
ggaagtaggaccagtgtcacactaa

SEQ ID NO: 586541 - DNA, 25 bp, Mus musculus
ggaagtaggacctgtgtcacactaa

SEQ ID NO: 586542 - DNA, 25 bp, Mus musculus
ggaagtagtgaaagatgctagcata

SEQ ID NO: 586543 - DNA, 25 bp, Mus musculus
ggaagtagtgaatgatgctagcata

SEQ ID NO: 586544 - DNA, 25 bp, Mus musculus
ggaagtagtgcaacacccgaggccc

SEQ ID NO: 586545 - DNA, 25 bp, Mus musculus
ggaagtagtgcatcacccgaggccc

SEQ ID NO: 586546 - DNA, 25 bp, Mus musculus
ggaagtataagaagctggctctgac

SEQ ID NO: 586547 - DNA, 25 bp, Mus musculus
ggaagtataagatgctggctctgac

SEQ ID NO: 586548 - DNA, 25 bp, Mus musculus
ggaagtatatgcaggcagccaccag

SEQ ID NO: 586549 - DNA, 25 bp, Mus musculus
ggaagtatatgctggcagccaccag

SEQ ID NO: 586550 - DNA, 25 bp, Mus musculus
ggaagtatcacaacccatagttaag

SEQ ID NO: 586551 - DNA, 25 bp, Mus musculus
ggaagtatcacatcccatagttaag

SEQ ID NO: 586552 - DNA, 25 bp, Mus musculus
ggaagtatccacatgtgtagttaga

SEQ ID NO: 586553 - DNA, 25 bp, Mus musculus
ggaagtatccacttgtgtagttaga

SEQ ID NO: 586554 - DNA, 25 bp, Mus musculus
ggaagtatcctgatgcctagttttc

SEQ ID NO: 586555 - DNA, 25 bp, Mus musculus
ggaagtatcctgttgcctagttttc

SEQ ID NO: 586556 - DNA, 25 bp, Mus musculus
ggaagtatcgagactaccacaatca

SEQ ID NO: 586557 - DNA, 25 bp, Mus musculus
ggaagtatcgagtctaccacaatca

SEQ ID NO: 586558 - DNA, 25 bp, Mus musculus
ggaagtatgacaccgggatcccacc

SEQ ID NO: 586559 - DNA, 25 bp, Mus musculus
ggaagtatgacagcgggatcccacc

SEQ ID NO: 586560 - DNA, 25 bp, Mus musculus
ggaagtatggaactatcactgcccc

SEQ ID NO: 586561 - DNA, 25 bp, Mus musculus
ggaagtatggaagtatcactgcccc

SEQ ID NO: 586562 - DNA, 25 bp, Mus musculus
ggaagtatgtccaacctctttggcc

SEQ ID NO: 586563 - DNA, 25 bp, Mus musculus
ggaagtatgtcctacctctttggcc

SEQ ID NO: 586564 - DNA, 25 bp, Mus musculus
ggaagtattctgactcctgtgattt

SEQ ID NO: 586565 - DNA, 25 bp, Mus musculus
ggaagtattctgtctcctgtgattt

SEQ ID NO: 586566 - DNA, 25 bp, Mus musculus
ggaagtattcttcgctagagttcaa

SEQ ID NO: 586567 - DNA, 25 bp, Mus musculus
ggaagtattcttggctagagttcaa

SEQ ID NO: 586568 - DNA, 25 bp, Mus musculus
ggaagtcaactgcagcccatatcac

SEQ ID NO: 586569 - DNA, 25 bp, Mus musculus
ggaagtcaactggagcccatatcac

SEQ ID NO: 586570 - DNA, 25 bp, Mus musculus
ggaagtcaatgactactagtctgta

SEQ ID NO: 586571 - DNA, 25 bp, Mus musculus
ggaagtcaatgagtactagtctgta

SEQ ID NO: 586572 - DNA, 25 bp, Mus musculus
ggaagtcacaggaccatatcacatg

SEQ ID NO: 586573 - DNA, 25 bp, Mus musculus
ggaagtcacaggtccatatcacatg

SEQ ID NO: 586574 - DNA, 25 bp, Mus musculus
ggaagtcacatacacgtctacgagc

SEQ ID NO: 586575 - DNA, 25 bp, Mus musculus
ggaagtcacatagacgtctacgagc

SEQ ID NO: 586576 - DNA, 25 bp, Mus musculus
ggaagtcaccaacaaacacactgtt

SEQ ID NO: 586577 - DNA, 25 bp, Mus musculus
ggaagtcaccaagaaacacactgtt

SEQ ID NO: 586578 - DNA, 25 bp, Mus musculus
ggaagtcacctactgatcggatctg

SEQ ID NO: 586579 - DNA, 25 bp, Mus musculus
ggaagtcacctagtgatcggatctg

SEQ ID NO: 586580 - DNA, 25 bp, Mus musculus
ggaagtcaccttactctgaatctaa

SEQ ID NO: 586581 - DNA, 25 bp, Mus musculus
ggaagtcaccttctgatttgcatgc

SEQ ID NO: 586582 - DNA, 25 bp, Mus musculus
ggaagtcaccttgtgatttgcatgc

SEQ ID NO: 586583 - DNA, 25 bp, Mus musculus
ggaagtcacctttctctgaatctaa

SEQ ID NO: 586584 - DNA, 25 bp, Mus musculus
ggaagtcactctcgtgtttttgtaa

SEQ ID NO: 586585 - DNA, 25 bp, Mus musculus
ggaagtcactctggtgtttttgtaa

SEQ ID NO: 586586 - DNA, 25 bp, Mus musculus
ggaagtcagactctgagctttgcta

SEQ ID NO: 586587 - DNA, 25 bp, Mus musculus
ggaagtcagactgtgagctttgcta

SEQ ID NO: 586588 - DNA, 25 bp, Mus musculus
ggaagtcagcatacacccacaatga

SEQ ID NO: 586589 - DNA, 25 bp, Mus musculus
ggaagtcagcatagatctcacctat

SEQ ID NO: 586590 - DNA, 25 bp, Mus musculus
ggaagtcagcattcacccacaatga

SEQ ID NO: 586591 - DNA, 25 bp, Mus musculus
ggaagtcagcattgatctcacctat

SEQ ID NO: 586592 - DNA, 25 bp, Mus musculus
ggaagtcagccaaatctgaatgaca

SEQ ID NO: 586593 - DNA, 25 bp, Mus musculus
ggaagtcagccatatctgaatgaca

SEQ ID NO: 586594 - DNA, 25 bp, Mus musculus
ggaagtcagcccaagcactttaaga

SEQ ID NO: 586595 - DNA, 25 bp, Mus musculus
ggaagtcagccctagcactttaaga

SEQ ID NO: 586596 - DNA, 25 bp, Mus musculus
ggaagtcagcctaaccatagattca

SEQ ID NO: 586597 - DNA, 25 bp, Mus musculus
ggaagtcagccttaccatagattca

SEQ ID NO: 586598 - DNA, 25 bp, Mus musculus
ggaagtcagctcactgcccctgagt

SEQ ID NO: 586599 - DNA, 25 bp, Mus musculus
ggaagtcagctctctgcccctgagt

SEQ ID NO: 586600 - DNA, 25 bp, Mus musculus
ggaagtcaggatattccttgtgagt

SEQ ID NO: 586601 - DNA, 25 bp, Mus musculus
ggaagtcaggattttccttgtgagt

SEQ ID NO: 586602 - DNA, 25 bp, Mus musculus
ggaagtcaggcacgtctactcctga

SEQ ID NO: 586603 - DNA, 25 bp, Mus musculus
ggaagtcaggcaggtctactcctga

SEQ ID NO: 586604 - DNA, 25 bp, Mus musculus
ggaagtcagggtatctttcatgaga

SEQ ID NO: 586605 - DNA, 25 bp, Mus musculus
ggaagtcagggtttctttcatgaga

SEQ ID NO: 586606 - DNA, 25 bp, Mus musculus
ggaagtcagtcactttccatctgat

SEQ ID NO: 586607 - DNA, 25 bp, Mus musculus
ggaagtcagtcagtttccatctgat

SEQ ID NO: 586608 - DNA, 25 bp, Mus musculus
ggaagtcagtgtcgcagtttcttat

SEQ ID NO: 586609 - DNA, 25 bp, Mus musculus
ggaagtcagtgtggcagtttcttat

SEQ ID NO: 586610 - DNA, 25 bp, Mus musculus
ggaagtcatcaccagagtccataag

SEQ ID NO: 586611 - DNA, 25 bp, Mus musculus
ggaagtcatcacgagagtccataag

SEQ ID NO: 586612 - DNA, 25 bp, Mus musculus
ggaagtcattacaagcctctgcatt

SEQ ID NO: 586613 - DNA, 25 bp, Mus musculus
ggaagtcattactagcctctgcatt

SEQ ID NO: 586614 - DNA, 25 bp, Mus musculus
ggaagtcattcaacgtcacaaccac

SEQ ID NO: 586615 - DNA, 25 bp, Mus musculus
ggaagtcattcatcgtcacaaccac

SEQ ID NO: 586616 - DNA, 25 bp, Mus musculus
ggaagtcattttactctagaccatg

SEQ ID NO: 586617 - DNA, 25 bp, Mus musculus
ggaagtcatttttctctagaccatg

SEQ ID NO: 586618 - DNA, 25 bp, Mus musculus
ggaagtccaactagcctggcaggat

SEQ ID NO: 586619 - DNA, 25 bp, Mus musculus
ggaagtccaacttgcctggcaggat

SEQ ID NO: 586620 - DNA, 25 bp, Mus musculus
ggaagtccaaggaacttattctcac

SEQ ID NO: 586621 - DNA, 25 bp, Mus musculus
ggaagtccaaggtacttattctcac

SEQ ID NO: 586622 - DNA, 25 bp, Mus musculus
ggaagtccacagacctacatgtcgc

SEQ ID NO: 586623 - DNA, 25 bp, Mus musculus
ggaagtccacagtcctacatgtcgc

SEQ ID NO: 586624 - DNA, 25 bp, Mus musculus
ggaagtccactcatctgaatctaag

SEQ ID NO: 586625 - DNA, 25 bp, Mus musculus
ggaagtccactcttctgaatctaag

SEQ ID NO: 586626 - DNA, 25 bp, Mus musculus
ggaagtccagaaccgctgtcatcac

SEQ ID NO: 586627 - DNA, 25 bp, Mus musculus
ggaagtccagaagcgctgtcatcac

SEQ ID NO: 586628 - DNA, 25 bp, Mus musculus
ggaagtccatagacctcagttcatt

SEQ ID NO: 586629 - DNA, 25 bp, Mus musculus
ggaagtccatagtcctcagttcatt

SEQ ID NO: 586630 - DNA, 25 bp, Mus musculus
ggaagtccccatagttcaaactgag

SEQ ID NO: 586631 - DNA, 25 bp, Mus musculus
ggaagtccccattgttcaaactgag

SEQ ID NO: 586632 - DNA, 25 bp, Mus musculus
ggaagtcccgataggcacccagagt

SEQ ID NO: 586633 - DNA, 25 bp, Mus musculus
ggaagtcccgattggcacccagagt

SEQ ID NO: 586634 - DNA, 25 bp, Mus musculus
ggaagtcccgttcctacagtcagtc

SEQ ID NO: 586635 - DNA, 25 bp, Mus musculus
ggaagtcccgttgctacagtcagtc

SEQ ID NO: 586636 - DNA, 25 bp, Mus musculus
ggaagtccctaactgtggctacctc

SEQ ID NO: 586637 - DNA, 25 bp, Mus musculus
ggaagtccctaagtgtggctacctc

SEQ ID NO: 586638 - DNA, 25 bp, Mus musculus
ggaagtccggtgatcgtgtcagcat

SEQ ID NO: 586639 - DNA, 25 bp, Mus musculus
ggaagtccggtgttcgtgtcagcat

SEQ ID NO: 586640 - DNA, 25 bp, Mus musculus
ggaagtcctaaccacacagcagtac

SEQ ID NO: 586641 - DNA, 25 bp, Mus musculus
ggaagtcctaacgacacagcagtac

SEQ ID NO: 586642 - DNA, 25 bp, Mus musculus
ggaagtcctctaccttgctacattt

SEQ ID NO: 586643 - DNA, 25 bp, Mus musculus
ggaagtcctctagcttgctacattt

SEQ ID NO: 586644 - DNA, 25 bp, Mus musculus
ggaagtcctggcataagtcctgctt

SEQ ID NO: 586645 - DNA, 25 bp, Mus musculus
ggaagtcctggcttaagtcctgctt

SEQ ID NO: 586646 - DNA, 25 bp, Mus musculus
ggaagtcctggtcgccacctatgga

SEQ ID NO: 586647 - DNA, 25 bp, Mus musculus
ggaagtcctggtggccacctatgga

SEQ ID NO: 586648 - DNA, 25 bp, Mus musculus
ggaagtccttcaagcttgcttccag

SEQ ID NO: 586649 - DNA, 25 bp, Mus musculus
ggaagtccttcaccaacagcagcaa

SEQ ID NO: 586650 - DNA, 25 bp, Mus musculus
ggaagtccttcagcaacagcagcaa

SEQ ID NO: 586651 - DNA, 25 bp, Mus musculus
ggaagtccttcatgcttgcttccag

SEQ ID NO: 586652 - DNA, 25 bp, Mus musculus
ggaagtccttgcaaagtgtgcctta

SEQ ID NO: 586653 - DNA, 25 bp, Mus musculus
ggaagtccttgctaagtgtgcctta

SEQ ID NO: 586654 - DNA, 25 bp, Mus musculus
ggaagtcctttgacaaggcacgaaa

SEQ ID NO: 586655 - DNA, 25 bp, Mus musculus
ggaagtcctttgacgacttattcta

SEQ ID NO: 586656 - DNA, 25 bp, Mus musculus
ggaagtcctttgtcaaggcacgaaa

SEQ ID NO: 586657 - DNA, 25 bp, Mus musculus
ggaagtcctttgtcgacttattcta

SEQ ID NO: 586658 - DNA, 25 bp, Mus musculus
ggaagtcgatccaagcttgattaag

SEQ ID NO: 586659 - DNA, 25 bp, Mus musculus
ggaagtcgatcctagcttgattaag

SEQ ID NO: 586660 - DNA, 25 bp, Mus musculus
ggaagtcgcctacatccttctttgt

SEQ ID NO: 586661 - DNA, 25 bp, Mus musculus
ggaagtcgcctagatccttctttgt

SEQ ID NO: 586662 - DNA, 25 bp, Mus musculus
ggaagtcgggaactcatgctttatt

SEQ ID NO: 586663 - DNA, 25 bp, Mus musculus
ggaagtcgggaagtcatgctttatt

SEQ ID NO: 586664 - DNA, 25 bp, Mus musculus
ggaagtcggtgactttagtttgctt

SEQ ID NO: 586665 - DNA, 25 bp, Mus musculus
ggaagtcggtgagtttagtttgctt

SEQ ID NO: 586666 - DNA, 25 bp, Mus musculus
ggaagtcgtagcaatcctgctcagt

SEQ ID NO: 586667 - DNA, 25 bp, Mus musculus
ggaagtcgtagctatcctgctcagt

SEQ ID NO: 586668 - DNA, 25 bp, Mus musculus
ggaagtcgtagtaactttctatcag

SEQ ID NO: 586669 - DNA, 25 bp, Mus musculus
ggaagtcgtagttactttctatcag

SEQ ID NO: 586670 - DNA, 25 bp, Mus musculus
ggaagtctacaactactcctgtgaa

SEQ ID NO: 586671 - DNA, 25 bp, Mus musculus
ggaagtctacaagtactcctgtgaa

SEQ ID NO: 586672 - DNA, 25 bp, Mus musculus
ggaagtctcagtcgataaatccctt

SEQ ID NO: 586673 - DNA, 25 bp, Mus musculus
ggaagtctcagtggataaatccctt

SEQ ID NO: 586674 - DNA, 25 bp, Mus musculus
ggaagtctccagaatgactactgtg

SEQ ID NO: 586675 - DNA, 25 bp, Mus musculus
ggaagtctccagctcattaagcatt

SEQ ID NO: 586676 - DNA, 25 bp, Mus musculus
ggaagtctccaggtcattaagcatt

SEQ ID NO: 586677 - DNA, 25 bp, Mus musculus
ggaagtctccagtatgactactgtg

SEQ ID NO: 586678 - DNA, 25 bp, Mus musculus
ggaagtctcctgcaagctaacatta

SEQ ID NO: 586679 - DNA, 25 bp, Mus musculus
ggaagtctcctgctcagattttgat

SEQ ID NO: 586680 - DNA, 25 bp, Mus musculus
ggaagtctcctggaagctaacatta

SEQ ID NO: 586681 - DNA, 25 bp, Mus musculus
ggaagtctcctggtcagattttgat

SEQ ID NO: 586682 - DNA, 25 bp, Mus musculus
ggaagtctccttcagatctttggaa

SEQ ID NO: 586683 - DNA, 25 bp, Mus musculus
ggaagtctccttgagatctttggaa

SEQ ID NO: 586684 - DNA, 25 bp, Mus musculus
ggaagtctctgcacacagaggcttg

SEQ ID NO: 586685 - DNA, 25 bp, Mus musculus
ggaagtctctgctcacagaggcttg

SEQ ID NO: 586686 - DNA, 25 bp, Mus musculus
ggaagtctgaaaaggctgtctgcat

SEQ ID NO: 586687 - DNA, 25 bp, Mus musculus
ggaagtctgaaatggctgtctgcat

SEQ ID NO: 586688 - DNA, 25 bp, Mus musculus
ggaagtctgaagacctcgcagccct

SEQ ID NO: 586689 - DNA, 25 bp, Mus musculus
ggaagtctgaagtcctcgcagccct

SEQ ID NO: 586690 - DNA, 25 bp, Mus musculus
ggaagtctgattctactctagttag

SEQ ID NO: 586691 - DNA, 25 bp, Mus musculus
ggaagtctgattgtactctagttag

SEQ ID NO: 586692 - DNA, 25 bp, Mus musculus
ggaagtctggcaagttcgtgtcagt

SEQ ID NO: 586693 - DNA, 25 bp, Mus musculus
ggaagtctggcatgttcgtgtcagt

SEQ ID NO: 586694 - DNA, 25 bp, Mus musculus
ggaagtctggccatagatgcccttc

SEQ ID NO: 586695 - DNA, 25 bp, Mus musculus
ggaagtctggccttagatgcccttc

SEQ ID NO: 586696 - DNA, 25 bp, Mus musculus
ggaagtctgtacattgggttataac

SEQ ID NO: 586697 - DNA, 25 bp, Mus musculus
ggaagtctgtactttgggttataac

SEQ ID NO: 586698 - DNA, 25 bp, Mus musculus
ggaagtctgtccctaagagccctgt

SEQ ID NO: 586699 - DNA, 25 bp, Mus musculus
ggaagtctgtccgtaagagccctgt

SEQ ID NO: 586700 - DNA, 25 bp, Mus musculus
ggaagtctgtgacaagccttgacca

SEQ ID NO: 586701 - DNA, 25 bp, Mus musculus
ggaagtctgtgagaagccttgacca

SEQ ID NO: 586702 - DNA, 25 bp, Mus musculus
ggaagtcttcagagtgatctcagca

SEQ ID NO: 586703 - DNA, 25 bp, Mus musculus
ggaagtcttcagtgtgatctcagca

SEQ ID NO: 586704 - DNA, 25 bp, Mus musculus
ggaagtcttctaccatgtgttcgcc

SEQ ID NO: 586705 - DNA, 25 bp, Mus musculus
ggaagtcttctagcatgtgttcgcc

SEQ ID NO: 586706 - DNA, 25 bp, Mus musculus
ggaagtctttcaccagaggcccata

SEQ ID NO: 586707 - DNA, 25 bp, Mus musculus
ggaagtctttcagcagaggcccata

SEQ ID NO: 586708 - DNA, 25 bp, Mus musculus
ggaagtgaaccactgactccagctt

SEQ ID NO: 586709 - DNA, 25 bp, Mus musculus
ggaagtgaaccagtgactccagctt

SEQ ID NO: 586710 - DNA, 25 bp, Mus musculus
ggaagtgacacaccaggttctccaa

SEQ ID NO: 586711 - DNA, 25 bp, Mus musculus
ggaagtgacacagcaggttctccaa

SEQ ID NO: 586712 - DNA, 25 bp, Mus musculus
ggaagtgacagcctcattaagggta

SEQ ID NO: 586713 - DNA, 25 bp, Mus musculus
ggaagtgacagcgtcattaagggta

SEQ ID NO: 586714 - DNA, 25 bp, Mus musculus
ggaagtgacagtagttgccccatta

SEQ ID NO: 586715 - DNA, 25 bp, Mus musculus
ggaagtgacagttgttgccccatta

SEQ ID NO: 586716 - DNA, 25 bp, Mus musculus
ggaagtgacatgctttagggcttta

SEQ ID NO: 586717 - DNA, 25 bp, Mus musculus
ggaagtgacatggtttagggcttta

SEQ ID NO: 586718 - DNA, 25 bp, Mus musculus
ggaagtgacattcgagctgagacct

SEQ ID NO: 586719 - DNA, 25 bp, Mus musculus
ggaagtgacattggagctgagacct

SEQ ID NO: 586720 - DNA, 25 bp, Mus musculus
ggaagtgaccctaagctgagtgcat

SEQ ID NO: 586721 - DNA, 25 bp, Mus musculus
ggaagtgacccttagctgagtgcat

SEQ ID NO: 586722 - DNA, 25 bp, Mus musculus
ggaagtgacctcagagtcgacttaa

SEQ ID NO: 586723 - DNA, 25 bp, Mus musculus
ggaagtgacctctgagtcgacttaa

SEQ ID NO: 586724 - DNA, 25 bp, Mus musculus
ggaagtgacgcaaaggctctcggcc

SEQ ID NO: 586725 - DNA, 25 bp, Mus musculus
ggaagtgacgcataggctctcggcc

SEQ ID NO: 586726 - DNA, 25 bp, Mus musculus
ggaagtgactacacagtacctgagt

SEQ ID NO: 586727 - DNA, 25 bp, Mus musculus
ggaagtgactactcagtacctgagt

SEQ ID NO: 586728 - DNA, 25 bp, Mus musculus
ggaagtgactccaacaagatctatt

SEQ ID NO: 586729 - DNA, 25 bp, Mus musculus
ggaagtgactcctacaagatctatt

SEQ ID NO: 586730 - DNA, 25 bp, Mus musculus
ggaagtgacttaatcatcctttgct

SEQ ID NO: 586731 - DNA, 25 bp, Mus musculus
ggaagtgacttattcatcctttgct

SEQ ID NO: 586732 - DNA, 25 bp, Mus musculus
ggaagtgacttgattcatccttaat

SEQ ID NO: 586733 - DNA, 25 bp, Mus musculus
ggaagtgacttgtttcatccttaat

SEQ ID NO: 586734 - DNA, 25 bp, Mus musculus
ggaagtgagaaccttttcagcgtaa

SEQ ID NO: 586735 - DNA, 25 bp, Mus musculus
ggaagtgagaacgttttcagcgtaa

SEQ ID NO: 586736 - DNA, 25 bp, Mus musculus
ggaagtgagatcacaccatgtatcc

SEQ ID NO: 586737 - DNA, 25 bp, Mus musculus
ggaagtgagatctcaccatgtatcc

SEQ ID NO: 586738 - DNA, 25 bp, Mus musculus
ggaagtgaggccctaatgacccttg

SEQ ID NO: 586739 - DNA, 25 bp, Mus musculus
ggaagtgaggccgtaatgacccttg

SEQ ID NO: 586740 - DNA, 25 bp, Mus musculus
ggaagtgaggctctcggaaacacct

SEQ ID NO: 586741 - DNA, 25 bp, Mus musculus
ggaagtgaggctgtcggaaacacct

SEQ ID NO: 586742 - DNA, 25 bp, Mus musculus
ggaagtgagggtatcttgttctcct

SEQ ID NO: 586743 - DNA, 25 bp, Mus musculus
ggaagtgagggtttcttgttctcct

SEQ ID NO: 586744 - DNA, 25 bp, Mus musculus
ggaagtgatcagacagggctagaaa

SEQ ID NO: 586745 - DNA, 25 bp, Mus musculus
ggaagtgatcagtcagggctagaaa

SEQ ID NO: 586746 - DNA, 25 bp, Mus musculus
ggaagtgatccacttacacctcaac

SEQ ID NO: 586747 - DNA, 25 bp, Mus musculus
ggaagtgatccagttacacctcaac

SEQ ID NO: 586748 - DNA, 25 bp, Mus musculus
ggaagtgatctaagtctcttccctc

SEQ ID NO: 586749 - DNA, 25 bp, Mus musculus
ggaagtgatctatgtctcttccctc

SEQ ID NO: 586750 - DNA, 25 bp, Mus musculus
ggaagtgatctgctatctcacctgg

SEQ ID NO: 586751 - DNA, 25 bp, Mus musculus
ggaagtgatctggtatctcacctgg

SEQ ID NO: 586752 - DNA, 25 bp, Mus musculus
ggaagtgatcttctaacagaaatga

SEQ ID NO: 586753 - DNA, 25 bp, Mus musculus
ggaagtgatcttgtaacagaaatga

SEQ ID NO: 586754 - DNA, 25 bp, Mus musculus
ggaagtgatgcaagcctgtcactca

SEQ ID NO: 586755 - DNA, 25 bp, Mus musculus
ggaagtgatgcatgcctgtcactca

SEQ ID NO: 586756 - DNA, 25 bp, Mus musculus
ggaagtgatgcgagccaggccctct

SEQ ID NO: 586757 - DNA, 25 bp, Mus musculus
ggaagtgatgcgtgccaggccctct

SEQ ID NO: 586758 - DNA, 25 bp, Mus musculus
ggaagtgattacctattataatgca

SEQ ID NO: 586759 - DNA, 25 bp, Mus musculus
ggaagtgattacgtattataatgca

SEQ ID NO: 586760 - DNA, 25 bp, Mus musculus
ggaagtgatttactattctcatcta

SEQ ID NO: 586761 - DNA, 25 bp, Mus musculus
ggaagtgatttagtattctcatcta

SEQ ID NO: 586762 - DNA, 25 bp, Mus musculus
ggaagtgcacacactcgacagctgt

SEQ ID NO: 586763 - DNA, 25 bp, Mus musculus
ggaagtgcacactctcgacagctgt

SEQ ID NO: 586764 - DNA, 25 bp, Mus musculus
ggaagtgcatcaagctcttcgttat

SEQ ID NO: 586765 - DNA, 25 bp, Mus musculus
ggaagtgcatcatgctcttcgttat

SEQ ID NO: 586766 - DNA, 25 bp, Mus musculus
ggaagtgcatccaattccactacgg

SEQ ID NO: 586767 - DNA, 25 bp, Mus musculus
ggaagtgcatcctattccactacgg

SEQ ID NO: 586768 - DNA, 25 bp, Mus musculus
ggaagtgcatgcactaacttgactt

SEQ ID NO: 586769 - DNA, 25 bp, Mus musculus
ggaagtgcatgctctaacttgactt

SEQ ID NO: 586770 - DNA, 25 bp, Mus musculus
ggaagtgcatttaatagctgccaat

SEQ ID NO: 586771 - DNA, 25 bp, Mus musculus
ggaagtgcattttatagctgccaat

SEQ ID NO: 586772 - DNA, 25 bp, Mus musculus
ggaagtgccaagagtggactagcat

SEQ ID NO: 586773 - DNA, 25 bp, Mus musculus
ggaagtgccaagtgtggactagcat

SEQ ID NO: 586774 - DNA, 25 bp, Mus musculus
ggaagtgccagcagtagccacacca

SEQ ID NO: 586775 - DNA, 25 bp, Mus musculus
ggaagtgccagctgtagccacacca

SEQ ID NO: 586776 - DNA, 25 bp, Mus musculus
ggaagtgccccgaggtcgcacatcc

SEQ ID NO: 586777 - DNA, 25 bp, Mus musculus
ggaagtgccccgtggtcgcacatcc

SEQ ID NO: 586778 - DNA, 25 bp, Mus musculus
ggaagtgcctacagattcaagccct

SEQ ID NO: 586779 - DNA, 25 bp, Mus musculus
ggaagtgcctactgattcaagccct

SEQ ID NO: 586780 - DNA, 25 bp, Mus musculus
ggaagtgcctatatgctgaatattt

SEQ ID NO: 586781 - DNA, 25 bp, Mus musculus
ggaagtgcctatttgctgaatattt

SEQ ID NO: 586782 - DNA, 25 bp, Mus musculus
ggaagtgcctgaccgacccggacta

SEQ ID NO: 586783 - DNA, 25 bp, Mus musculus
ggaagtgcctgagcgacccggacta

SEQ ID NO: 586784 - DNA, 25 bp, Mus musculus
ggaagtgcctgcatagcaaagtgaa

SEQ ID NO: 586785 - DNA, 25 bp, Mus musculus
ggaagtgcctgcttagcaaagtgaa

SEQ ID NO: 586786 - DNA, 25 bp, Mus musculus
ggaagtgcggctacttcaagcgagc

SEQ ID NO: 586787 - DNA, 25 bp, Mus musculus
ggaagtgcggcttcttcaagcgagc

SEQ ID NO: 586788 - DNA, 25 bp, Mus musculus
ggaagtgcgtttagagagccctcta

SEQ ID NO: 586789 - DNA, 25 bp, Mus musculus
ggaagtgcgtttctatgactgtata

SEQ ID NO: 586790 - DNA, 25 bp, Mus musculus
ggaagtgcgtttgtatgactgtata

SEQ ID NO: 586791 - DNA, 25 bp, Mus musculus
ggaagtgcgttttgagagccctcta

SEQ ID NO: 586792 - DNA, 25 bp, Mus musculus
ggaagtgctcaactgcctgaacatt

SEQ ID NO: 586793 - DNA, 25 bp, Mus musculus
ggaagtgctcaagtgcctgaacatt

SEQ ID NO: 586794 - DNA, 25 bp, Mus musculus
ggaagtgctcacagacacatcctac

SEQ ID NO: 586795 - DNA, 25 bp, Mus musculus
ggaagtgctcactgacacatcctac

SEQ ID NO: 586796 - DNA, 25 bp, Mus musculus
ggaagtgctcagcaaaattttgcta

SEQ ID NO: 586797 - DNA, 25 bp, Mus musculus
ggaagtgctcaggaaaattttgcta

SEQ ID NO: 586798 - DNA, 25 bp, Mus musculus
ggaagtgctctcactgggacaggca

SEQ ID NO: 586799 - DNA, 25 bp, Mus musculus
ggaagtgctctctctgggacaggca

SEQ ID NO: 586800 - DNA, 25 bp, Mus musculus
ggaagtgctctgattgacccaatgg

SEQ ID NO: 586801 - DNA, 25 bp, Mus musculus
ggaagtgctctgtttgacccaatgg

SEQ ID NO: 586802 - DNA, 25 bp, Mus musculus
ggaagtgctcttagtcaccgagcca

SEQ ID NO: 586803 - DNA, 25 bp, Mus musculus
ggaagtgctctttgtcaccgagcca

SEQ ID NO: 586804 - DNA, 25 bp, Mus musculus
ggaagtgctgcacgtatctctctca

SEQ ID NO: 586805 - DNA, 25 bp, Mus musculus
ggaagtgctgcactcatgaacaaga

SEQ ID NO: 586806 - DNA, 25 bp, Mus musculus
ggaagtgctgcaggtatctctctca

SEQ ID NO: 586807 - DNA, 25 bp, Mus musculus
ggaagtgctgcagtcatgaacaaga

SEQ ID NO: 586808 - DNA, 25 bp, Mus musculus
ggaagtgctggaattagcctatcta

SEQ ID NO: 586809 - DNA, 25 bp, Mus musculus
ggaagtgctggatttagcctatcta

SEQ ID NO: 586810 - DNA, 25 bp, Mus musculus
ggaagtgcttatctccttagtgata

SEQ ID NO: 586811 - DNA, 25 bp, Mus musculus
ggaagtgcttatgtccttagtgata

SEQ ID NO: 586812 - DNA, 25 bp, Mus musculus
ggaagtgcttcacccggaaggacaa

SEQ ID NO: 586813 - DNA, 25 bp, Mus musculus
ggaagtgcttcagccggaaggacaa

SEQ ID NO: 586814 - DNA, 25 bp, Mus musculus
ggaagtgcttgcattagttagacgt

SEQ ID NO: 586815 - DNA, 25 bp, Mus musculus
ggaagtgcttgctttagttagacgt

SEQ ID NO: 586816 - DNA, 25 bp, Mus musculus
ggaagtggacacaccccacgctaca

SEQ ID NO: 586817 - DNA, 25 bp, Mus musculus
ggaagtggacactccccacgctaca

SEQ ID NO: 586818 - DNA, 25 bp, Mus musculus
ggaagtggatgaatgctactgttca

SEQ ID NO: 586819 - DNA, 25 bp, Mus musculus
ggaagtggatgattgctactgttca

SEQ ID NO: 586820 - DNA, 25 bp, Mus musculus
ggaagtggatgccttcctcctgcac

SEQ ID NO: 586821 - DNA, 25 bp, Mus musculus
ggaagtggatgcgttcctcctgcac

SEQ ID NO: 586822 - DNA, 25 bp, Mus musculus
ggaagtggcaagactttaaatttga

SEQ ID NO: 586823 - DNA, 25 bp, Mus musculus
ggaagtggcaagtctttaaatttga

SEQ ID NO: 586824 - DNA, 25 bp, Mus musculus
ggaagtggcactatccaggaacaca

SEQ ID NO: 586825 - DNA, 25 bp, Mus musculus
ggaagtggcactttccaggaacaca

SEQ ID NO: 586826 - DNA, 25 bp, Mus musculus
ggaagtggcagcaatatttatttat

SEQ ID NO: 586827 - DNA, 25 bp, Mus musculus
ggaagtggcagctatatttatttat

SEQ ID NO: 586828 - DNA, 25 bp, Mus musculus
ggaagtggccaaaatgacctcagtg

SEQ ID NO: 586829 - DNA, 25 bp, Mus musculus
ggaagtggccaatatgacctcagtg

SEQ ID NO: 586830 - DNA, 25 bp, Mus musculus
ggaagtggctccacatgagctccta

SEQ ID NO: 586831 - DNA, 25 bp, Mus musculus
ggaagtggctcctcatgagctccta

SEQ ID NO: 586832 - DNA, 25 bp, Mus musculus
ggaagtggctgcacaaatcctcctt

SEQ ID NO: 586833 - DNA, 25 bp, Mus musculus
ggaagtggctgctcaaatcctcctt

SEQ ID NO: 586834 - DNA, 25 bp, Mus musculus
ggaagtggctggacagctcattatt

SEQ ID NO: 586835 - DNA, 25 bp, Mus musculus
ggaagtggctggtcagctcattatt

SEQ ID NO: 586836 - DNA, 25 bp, Mus musculus
ggaagtgggaagatcacaccagtta

SEQ ID NO: 586837 - DNA, 25 bp, Mus musculus
ggaagtgggaagttcacaccagtta

SEQ ID NO: 586838 - DNA, 25 bp, Mus musculus
ggaagtgggagacgcctttaccatc

SEQ ID NO: 586839 - DNA, 25 bp, Mus musculus
ggaagtgggagaggcctttaccatc

SEQ ID NO: 586840 - DNA, 25 bp, Mus musculus
ggaagtgggaggaatgcaaaacttt

SEQ ID NO: 586841 - DNA, 25 bp, Mus musculus
ggaagtgggaggtatgcaaaacttt

SEQ ID NO: 586842 - DNA, 25 bp, Mus musculus
ggaagtggtaccaccatgtgtgttt

SEQ ID NO: 586843 - DNA, 25 bp, Mus musculus
ggaagtggtacctccatgtgtgttt

SEQ ID NO: 586844 - DNA, 25 bp, Mus musculus
ggaagtggtatcagtcagtccataa

SEQ ID NO: 586845 - DNA, 25 bp, Mus musculus
ggaagtggtatctgtcagtccataa

SEQ ID NO: 586846 - DNA, 25 bp, Mus musculus
ggaagtgtaataactgtgagttagc

SEQ ID NO: 586847 - DNA, 25 bp, Mus musculus
ggaagtgtaatatctgtgagttagc

SEQ ID NO: 586848 - DNA, 25 bp, Mus musculus
ggaagtgtacctccatctggattag

SEQ ID NO: 586849 - DNA, 25 bp, Mus musculus
ggaagtgtacctgcatctggattag

SEQ ID NO: 586850 - DNA, 25 bp, Mus musculus
ggaagtgtacgtagagaaaggcaat

SEQ ID NO: 586851 - DNA, 25 bp, Mus musculus
ggaagtgtacgttgagaaaggcaat

SEQ ID NO: 586852 - DNA, 25 bp, Mus musculus
ggaagtgtagatcccatccgagaca

SEQ ID NO: 586853 - DNA, 25 bp, Mus musculus
ggaagtgtagatgccatccgagaca

SEQ ID NO: 586854 - DNA, 25 bp, Mus musculus
ggaagtgtatccaggctttaagcac

SEQ ID NO: 586855 - DNA, 25 bp, Mus musculus
ggaagtgtatcctggctttaagcac

SEQ ID NO: 586856 - DNA, 25 bp, Mus musculus
ggaagtgtcccacgattgcactcaa

SEQ ID NO: 586857 - DNA, 25 bp, Mus musculus
ggaagtgtcccaggattgcactcaa

SEQ ID NO: 586858 - DNA, 25 bp, Mus musculus
ggaagtgtcctaatcctacatgtga

SEQ ID NO: 586859 - DNA, 25 bp, Mus musculus
ggaagtgtcctattcctacatgtga

SEQ ID NO: 586860 - DNA, 25 bp, Mus musculus
ggaagtgtcctcagcacactctgaa

SEQ ID NO: 586861 - DNA, 25 bp, Mus musculus
ggaagtgtcctctgcacactctgaa

SEQ ID NO: 586862 - DNA, 25 bp, Mus musculus
ggaagtgtcgctcatttttgatcca

SEQ ID NO: 586863 - DNA, 25 bp, Mus musculus
ggaagtgtcgctgatttttgatcca

SEQ ID NO: 586864 - DNA, 25 bp, Mus musculus
ggaagtgtcgtgacagcacagacct

SEQ ID NO: 586865 - DNA, 25 bp, Mus musculus
ggaagtgtcgtgtcagcacagacct

SEQ ID NO: 586866 - DNA, 25 bp, Mus musculus
ggaagtgtctgacccacttatctat

SEQ ID NO: 586867 - DNA, 25 bp, Mus musculus
ggaagtgtctgagccacttatctat

SEQ ID NO: 586868 - DNA, 25 bp, Mus musculus
ggaagtgtcttgcaattgtctggaa

SEQ ID NO: 586869 - DNA, 25 bp, Mus musculus
ggaagtgtcttggaattgtctggaa

SEQ ID NO: 586870 - DNA, 25 bp, Mus musculus
ggaagtgtctttcaagccctttaag

SEQ ID NO: 586871 - DNA, 25 bp, Mus musculus
ggaagtgtctttgaagccctttaag

SEQ ID NO: 586872 - DNA, 25 bp, Mus musculus
ggaagtgtgagtacgcagcaccaga

SEQ ID NO: 586873 - DNA, 25 bp, Mus musculus
ggaagtgtgagttcgcagcaccaga

SEQ ID NO: 586874 - DNA, 25 bp, Mus musculus
ggaagtgtgattactgcttttgttt

SEQ ID NO: 586875 - DNA, 25 bp, Mus musculus
ggaagtgtgatttctgcttttgttt

SEQ ID NO: 586876 - DNA, 25 bp, Mus musculus
ggaagtgtgccaacctagaagttca

SEQ ID NO: 586877 - DNA, 25 bp, Mus musculus
ggaagtgtgccatcctagaagttca

SEQ ID NO: 586878 - DNA, 25 bp, Mus musculus
ggaagtgtggcccaatacagctcac

SEQ ID NO: 586879 - DNA, 25 bp, Mus musculus
ggaagtgtggccgaatacagctcac

SEQ ID NO: 586880 - DNA, 25 bp, Mus musculus
ggaagtgttaaccaagaccctatct

SEQ ID NO: 586881 - DNA, 25 bp, Mus musculus
ggaagtgttaacgaagaccctatct

SEQ ID NO: 586882 - DNA, 25 bp, Mus musculus
ggaagtgttaataccttggctacat

SEQ ID NO: 586883 - DNA, 25 bp, Mus musculus
ggaagtgttaattccttggctacat

SEQ ID NO: 586884 - DNA, 25 bp, Mus musculus
ggaagtgttctcaaactgcattggg

SEQ ID NO: 586885 - DNA, 25 bp, Mus musculus
ggaagtgttctctaactgcattggg

SEQ ID NO: 586886 - DNA, 25 bp, Mus musculus
ggaagtgttcttctttctaccagta

SEQ ID NO: 586887 - DNA, 25 bp, Mus musculus
ggaagtgttcttgtttctaccagta

SEQ ID NO: 586888 - DNA, 25 bp, Mus musculus
ggaagtgtttataggccctctggct

SEQ ID NO: 586889 - DNA, 25 bp, Mus musculus
ggaagtgtttattggccctctggct

SEQ ID NO: 586890 - DNA, 25 bp, Mus musculus
ggaagtgtttctcccaacactggga

SEQ ID NO: 586891 - DNA, 25 bp, Mus musculus
ggaagtgtttctgccaacactggga

SEQ ID NO: 586892 - DNA, 25 bp, Mus musculus
ggaagtgttttcagtagccttgcct

SEQ ID NO: 586893 - DNA, 25 bp, Mus musculus
ggaagtgttttctgtagccttgcct

SEQ ID NO: 586894 - DNA, 25 bp, Mus musculus
ggaagttaagcaacctagcattcag

SEQ ID NO: 586895 - DNA, 25 bp, Mus musculus
ggaagttaagcatcctagcattcag

SEQ ID NO: 586896 - DNA, 25 bp, Mus musculus
ggaagttacaccatcatctgtggga

SEQ ID NO: 586897 - DNA, 25 bp, Mus musculus
ggaagttacaccttcatctgtggga

SEQ ID NO: 586898 - DNA, 25 bp, Mus musculus
ggaagttacatacatgtgtacaaga

SEQ ID NO: 586899 - DNA, 25 bp, Mus musculus
ggaagttacatagatgtgtacaaga

SEQ ID NO: 586900 - DNA, 25 bp, Mus musculus
ggaagttacccaatcatgactacaa

SEQ ID NO: 586901 - DNA, 25 bp, Mus musculus
ggaagttacccattcatgactacaa

SEQ ID NO: 586902 - DNA, 25 bp, Mus musculus
ggaagttacgtaacttcactagaag

SEQ ID NO: 586903 - DNA, 25 bp, Mus musculus
ggaagttacgtatcttcactagaag

SEQ ID NO: 586904 - DNA, 25 bp, Mus musculus
ggaagttactaaatcggacctgact

SEQ ID NO: 586905 - DNA, 25 bp, Mus musculus
ggaagttactaattcggacctgact

SEQ ID NO: 586906 - DNA, 25 bp, Mus musculus
ggaagttatcagaccatcttgttga

SEQ ID NO: 586907 - DNA, 25 bp, Mus musculus
ggaagttatcagtccatcttgttga

SEQ ID NO: 586908 - DNA, 25 bp, Mus musculus
ggaagttatccgattgcatgaaaaa

SEQ ID NO: 586909 - DNA, 25 bp, Mus musculus
ggaagttatccgtttgcatgaaaaa

SEQ ID NO: 586910 - DNA, 25 bp, Mus musculus
ggaagttatcttcgcaagcctttcc

SEQ ID NO: 586911 - DNA, 25 bp, Mus musculus
ggaagttatcttggcaagcctttcc

SEQ ID NO: 586912 - DNA, 25 bp, Mus musculus
ggaagttatggtcacagcctttctg

SEQ ID NO: 586913 - DNA, 25 bp, Mus musculus
ggaagttatggtgacagcctttctg

SEQ ID NO: 586914 - DNA, 25 bp, Mus musculus
ggaagttatgtgaccttagcaacct

SEQ ID NO: 586915 - DNA, 25 bp, Mus musculus
ggaagttatgtgtccttagcaacct

SEQ ID NO: 586916 - DNA, 25 bp, Mus musculus
ggaagttcaactcgagcagctccga

SEQ ID NO: 586917 - DNA, 25 bp, Mus musculus
ggaagttcaactggagcagctccga

SEQ ID NO: 586918 - DNA, 25 bp, Mus musculus
ggaagttcaagaatacccttggcta

SEQ ID NO: 586919 - DNA, 25 bp, Mus musculus
ggaagttcaagattacccttggcta

SEQ ID NO: 586920 - DNA, 25 bp, Mus musculus
ggaagttcaatgcaatctgcagctt

SEQ ID NO: 586921 - DNA, 25 bp, Mus musculus
ggaagttcaatggaatctgcagctt

SEQ ID NO: 586922 - DNA, 25 bp, Mus musculus
ggaagttcacacctaagtactgtaa

SEQ ID NO: 586923 - DNA, 25 bp, Mus musculus
ggaagttcacacgtaagtactgtaa

SEQ ID NO: 586924 - DNA, 25 bp, Mus musculus
ggaagttcaggccaccagacgtagt

SEQ ID NO: 586925 - DNA, 25 bp, Mus musculus
ggaagttcaggcgaccagacgtagt

SEQ ID NO: 586926 - DNA, 25 bp, Mus musculus
ggaagttcaggtcttgggactaaca

SEQ ID NO: 586927 - DNA, 25 bp, Mus musculus
ggaagttcaggtgttgggactaaca

SEQ ID NO: 586928 - DNA, 25 bp, Mus musculus
ggaagttcatctcagcactacaatt

SEQ ID NO: 586929 - DNA, 25 bp, Mus musculus
ggaagttcatctgagcactacaatt

SEQ ID NO: 586930 - DNA, 25 bp, Mus musculus
ggaagttcatgaccaaccgtctgct

SEQ ID NO: 586931 - DNA, 25 bp, Mus musculus
ggaagttcatgagcaaccgtctgct

SEQ ID NO: 586932 - DNA, 25 bp, Mus musculus
ggaagttcattcacccataaagccc

SEQ ID NO: 586933 - DNA, 25 bp, Mus musculus
ggaagttcattctcccataaagccc

SEQ ID NO: 586934 - DNA, 25 bp, Mus musculus
ggaagttccaatctttgcatgaggt

SEQ ID NO: 586935 - DNA, 25 bp, Mus musculus
ggaagttccaatgtttgcatgaggt

SEQ ID NO: 586936 - DNA, 25 bp, Mus musculus
ggaagttccaccatgcattgacagt

SEQ ID NO: 586937 - DNA, 25 bp, Mus musculus
ggaagttccaccttgcattgacagt

SEQ ID NO: 586938 - DNA, 25 bp, Mus musculus
ggaagttccaggcagtcatgagcat

SEQ ID NO: 586939 - DNA, 25 bp, Mus musculus
ggaagttccagggagtcatgagcat

SEQ ID NO: 586940 - DNA, 25 bp, Mus musculus
ggaagttccatgctagtctggccaa

SEQ ID NO: 586941 - DNA, 25 bp, Mus musculus
ggaagttccatggtagtctggccaa

SEQ ID NO: 586942 - DNA, 25 bp, Mus musculus
ggaagttcccataataactgaacat

SEQ ID NO: 586943 - DNA, 25 bp, Mus musculus
ggaagttcccattataactgaacat

SEQ ID NO: 586944 - DNA, 25 bp, Mus musculus
ggaagttcccctcccaattagataa

SEQ ID NO: 586945 - DNA, 25 bp, Mus musculus
ggaagttcccctgccaattagataa

SEQ ID NO: 586946 - DNA, 25 bp, Mus musculus
ggaagttcccgtcagacatatgcca

SEQ ID NO: 586947 - DNA, 25 bp, Mus musculus
ggaagttcccgtgagacatatgcca

SEQ ID NO: 586948 - DNA, 25 bp, Mus musculus
ggaagttccgttctactgtaagact

SEQ ID NO: 586949 - DNA, 25 bp, Mus musculus
ggaagttccgttgtactgtaagact

SEQ ID NO: 586950 - DNA, 25 bp, Mus musculus
ggaagttcctctccgcaaaggaggt

SEQ ID NO: 586951 - DNA, 25 bp, Mus musculus
ggaagttcctctgcgcaaaggaggt

SEQ ID NO: 586952 - DNA, 25 bp, Mus musculus
ggaagttcctgcagacatcccacaa

SEQ ID NO: 586953 - DNA, 25 bp, Mus musculus
ggaagttcctgctgacatcccacaa

SEQ ID NO: 586954 - DNA, 25 bp, Mus musculus
ggaagttcctgtctgagttcaatgg

SEQ ID NO: 586955 - DNA, 25 bp, Mus musculus
ggaagttcctgtgtgagttcaatgg

SEQ ID NO: 586956 - DNA, 25 bp, Mus musculus
ggaagttccttgacagactggcttg

SEQ ID NO: 586957 - DNA, 25 bp, Mus musculus
ggaagttccttgtcagactggcttg

SEQ ID NO: 586958 - DNA, 25 bp, Mus musculus
ggaagttctcagaatacaccacagt

SEQ ID NO: 586959 - DNA, 25 bp, Mus musculus
ggaagttctcagtatacaccacagt

SEQ ID NO: 586960 - DNA, 25 bp, Mus musculus
ggaagttctcccagttcatctaaat

SEQ ID NO: 586961 - DNA, 25 bp, Mus musculus
ggaagttctccctgttcatctaaat

SEQ ID NO: 586962 - DNA, 25 bp, Mus musculus
ggaagttctcttctacaagaatttg

SEQ ID NO: 586963 - DNA, 25 bp, Mus musculus
ggaagttctcttgtacaagaatttg

SEQ ID NO: 586964 - DNA, 25 bp, Mus musculus
ggaagttctgacaatctgccaaggg

SEQ ID NO: 586965 - DNA, 25 bp, Mus musculus
ggaagttctgactatctgccaaggg

SEQ ID NO: 586966 - DNA, 25 bp, Mus musculus
ggaagttcttctaacccattgagag

SEQ ID NO: 586967 - DNA, 25 bp, Mus musculus
ggaagttcttctcaacctgatcctc

SEQ ID NO: 586968 - DNA, 25 bp, Mus musculus
ggaagttcttctgaacctgatcctc

SEQ ID NO: 586969 - DNA, 25 bp, Mus musculus
ggaagttcttcttacccattgagag

SEQ ID NO: 586970 - DNA, 25 bp, Mus musculus
ggaagttgaagaatggcgccccgcc

SEQ ID NO: 586971 - DNA, 25 bp, Mus musculus
ggaagttgaagattggcgccccgcc

SEQ ID NO: 586972 - DNA, 25 bp, Mus musculus
ggaagttgacctaagcttttgccca

SEQ ID NO: 586973 - DNA, 25 bp, Mus musculus
ggaagttgaccttagcttttgccca

SEQ ID NO: 586974 - DNA, 25 bp, Mus musculus
ggaagttgccatcatagtacctgac

SEQ ID NO: 586975 - DNA, 25 bp, Mus musculus
ggaagttgccatgatagtacctgac

SEQ ID NO: 586976 - DNA, 25 bp, Mus musculus
ggaagttgccttatgagtgtcccac

SEQ ID NO: 586977 - DNA, 25 bp, Mus musculus
ggaagttgccttttgagtgtcccac

SEQ ID NO: 586978 - DNA, 25 bp, Mus musculus
ggaagttgcttccttgggttctatt

SEQ ID NO: 586979 - DNA, 25 bp, Mus musculus
ggaagttgcttcgttgggttctatt

SEQ ID NO: 586980 - DNA, 25 bp, Mus musculus
ggaagttggccacatgacattctgt

SEQ ID NO: 586981 - DNA, 25 bp, Mus musculus
ggaagttggccagatgacattctgt

SEQ ID NO: 586982 - DNA, 25 bp, Mus musculus
ggaagttggcttcacttcttgccaa

SEQ ID NO: 586983 - DNA, 25 bp, Mus musculus
ggaagttggcttgacttcttgccaa

SEQ ID NO: 586984 - DNA, 25 bp, Mus musculus
ggaagttggtgtacttgctctagta

SEQ ID NO: 586985 - DNA, 25 bp, Mus musculus
ggaagttggtgttcttgctctagta

SEQ ID NO: 586986 - DNA, 25 bp, Mus musculus
ggaagttggtttaccttctactcag

SEQ ID NO: 586987 - DNA, 25 bp, Mus musculus
ggaagttggttttccttctactcag

SEQ ID NO: 586988 - DNA, 25 bp, Mus musculus
ggaagttgtaagcttgtgatctgat

SEQ ID NO: 586989 - DNA, 25 bp, Mus musculus
ggaagttgtaaggttgtgatctgat

SEQ ID NO: 586990 - DNA, 25 bp, Mus musculus
ggaagttgtcgcagccgtaggtcaa

SEQ ID NO: 586991 - DNA, 25 bp, Mus musculus
ggaagttgtcgctgccgtaggtcaa

SEQ ID NO: 586992 - DNA, 25 bp, Mus musculus
ggaagttgtctaattcaacctcaga

SEQ ID NO: 586993 - DNA, 25 bp, Mus musculus
ggaagttgtctatttcaacctcaga

SEQ ID NO: 586994 - DNA, 25 bp, Mus musculus
ggaagtttaaagctcgcattcaagt

SEQ ID NO: 586995 - DNA, 25 bp, Mus musculus
ggaagtttaaaggtcgcattcaagt

SEQ ID NO: 586996 - DNA, 25 bp, Mus musculus
ggaagtttacagctttgaatataca

SEQ ID NO: 586997 - DNA, 25 bp, Mus musculus
ggaagtttacaggtttgaatataca

SEQ ID NO: 586998 - DNA, 25 bp, Mus musculus
ggaagtttatctccagttctatgga

SEQ ID NO: 586999 - DNA, 25 bp, Mus musculus
ggaagtttatctgcagttctatgga

SEQ ID NO: 587000 - DNA, 25 bp, Mus musculus
ggaagtttatgaaccccacagacca

SEQ ID NO: 587001 - DNA, 25 bp, Mus musculus
ggaagtttatgatccccacagacca

SEQ ID NO: 587002 - DNA, 25 bp, Mus musculus
ggaagtttatgccatctgtgaacat

SEQ ID NO: 587003 - DNA, 25 bp, Mus musculus
ggaagtttatgcgatctgtgaacat

SEQ ID NO: 587004 - DNA, 25 bp, Mus musculus
ggaagtttatgtctgccgactccta

SEQ ID NO: 587005 - DNA, 25 bp, Mus musculus
ggaagtttatgtgtgccgactccta

SEQ ID NO: 587006 - DNA, 25 bp, Mus musculus
ggaagtttcaccatgctccagtaag

SEQ ID NO: 587007 - DNA, 25 bp, Mus musculus
ggaagtttcaccttgctccagtaag

SEQ ID NO: 587008 - DNA, 25 bp, Mus musculus
ggaagtttcagacagtgtatgccaa

SEQ ID NO: 587009 - DNA, 25 bp, Mus musculus
ggaagtttcagagagtgtatgccaa

SEQ ID NO: 587010 - DNA, 25 bp, Mus musculus
ggaagtttcaggaatctctagtcac

SEQ ID NO: 587011 - DNA, 25 bp, Mus musculus
ggaagtttcaggtatctctagtcac

SEQ ID NO: 587012 - DNA, 25 bp, Mus musculus
ggaagtttccacactaatggcatgg

SEQ ID NO: 587013 - DNA, 25 bp, Mus musculus
ggaagtttccactctaatggcatgg

SEQ ID NO: 587014 - DNA, 25 bp, Mus musculus
ggaagtttccatatgcagatctgtt

SEQ ID NO: 587015 - DNA, 25 bp, Mus musculus
ggaagtttccatttgcagatctgtt

SEQ ID NO: 587016 - DNA, 25 bp, Mus musculus
ggaagtttcgaaacactctggtata

SEQ ID NO: 587017 - DNA, 25 bp, Mus musculus
ggaagtttcgaatcactctggtata

SEQ ID NO: 587018 - DNA, 25 bp, Mus musculus
ggaagtttctacaacacctcgaggg

SEQ ID NO: 587019 - DNA, 25 bp, Mus musculus
ggaagtttctactacacctcgaggg

SEQ ID NO: 587020 - DNA, 25 bp, Mus musculus
ggaagtttcttcacggctggtgctt

SEQ ID NO: 587021 - DNA, 25 bp, Mus musculus
ggaagtttcttctcggctggtgctt

SEQ ID NO: 587022 - DNA, 25 bp, Mus musculus
ggaagtttgattagacgtgtctgct

SEQ ID NO: 587023 - DNA, 25 bp, Mus musculus
ggaagtttgatttgacgtgtctgct

SEQ ID NO: 587024 - DNA, 25 bp, Mus musculus
ggaagtttgcagacgccatccagga

SEQ ID NO: 587025 - DNA, 25 bp, Mus musculus
ggaagtttgcagtcgccatccagga

SEQ ID NO: 587026 - DNA, 25 bp, Mus musculus
ggaagtttgccaaccgtgcagacaa

SEQ ID NO: 587027 - DNA, 25 bp, Mus musculus
ggaagtttgccatccgtgcagacaa

SEQ ID NO: 587028 - DNA, 25 bp, Mus musculus
ggaagtttgcttctgaaccaactag

SEQ ID NO: 587029 - DNA, 25 bp, Mus musculus
ggaagtttgcttgtgaaccaactag

SEQ ID NO: 587030 - DNA, 25 bp, Mus musculus
ggaagtttggaaactctgctgctac

SEQ ID NO: 587031 - DNA, 25 bp, Mus musculus
ggaagtttggaatctctgctgctac

SEQ ID NO: 587032 - DNA, 25 bp, Mus musculus
ggaagtttgtaaagctgtctgaata

SEQ ID NO: 587033 - DNA, 25 bp, Mus musculus
ggaagtttgtaatgctgtctgaata

SEQ ID NO: 587034 - DNA, 25 bp, Mus musculus
ggaagtttgtgtagtaccagcgcat

SEQ ID NO: 587035 - DNA, 25 bp, Mus musculus
ggaagtttgtgttgtaccagcgcat

SEQ ID NO: 587036 - DNA, 25 bp, Mus musculus
ggaagtttgttgaaggcctccccat

SEQ ID NO: 587037 - DNA, 25 bp, Mus musculus
ggaagtttgttgtaggcctccccat

SEQ ID NO: 587038 - DNA, 25 bp, Mus musculus
ggaagttttagcaggaccaagctta

SEQ ID NO: 587039 - DNA, 25 bp, Mus musculus
ggaagttttagctggaccaagctta

SEQ ID NO: 587040 - DNA, 25 bp, Mus musculus
ggaagttttccgcttcttgaagcca

SEQ ID NO: 587041 - DNA, 25 bp, Mus musculus
ggaagttttccggttcttgaagcca

SEQ ID NO: 587042 - DNA, 25 bp, Mus musculus
ggaagttttcgtagtctgtcctcac

SEQ ID NO: 587043 - DNA, 25 bp, Mus musculus
ggaagttttcgttgtctgtcctcac

SEQ ID NO: 587044 - DNA, 25 bp, Mus musculus
ggaagttttcttaggtgttattgct

SEQ ID NO: 587045 - DNA, 25 bp, Mus musculus
ggaagttttctttggtgttattgct

SEQ ID NO: 587046 - DNA, 25 bp, Mus musculus
ggaagttttgatcttcttgacaaca

SEQ ID NO: 587047 - DNA, 25 bp, Mus musculus
ggaagttttgatgttcttgacaaca

SEQ ID NO: 587048 - DNA, 25 bp, Mus musculus
ggaagttttggaatacacacagtta

SEQ ID NO: 587049 - DNA, 25 bp, Mus musculus
ggaagttttggattacacacagtta

SEQ ID NO: 587050 - DNA, 25 bp, Mus musculus
ggaataaaacagatcctttctctat

SEQ ID NO: 587051 - DNA, 25 bp, Mus musculus
ggaataaaacagttcctttctctat

SEQ ID NO: 587052 - DNA, 25 bp, Mus musculus
ggaataaactggaagctgagcctcc

SEQ ID NO: 587053 - DNA, 25 bp, Mus musculus
ggaataaactggtagctgagcctcc

SEQ ID NO: 587054 - DNA, 25 bp, Mus musculus
ggaataaagatcattgccactgccc

SEQ ID NO: 587055 - DNA, 25 bp, Mus musculus
ggaataaagatctttgccactgccc

SEQ ID NO: 587056 - DNA, 25 bp, Mus musculus
ggaataaagcagctgtgagccacca

SEQ ID NO: 587057 - DNA, 25 bp, Mus musculus
ggaataaagcaggtgtgagccacca

SEQ ID NO: 587058 - DNA, 25 bp, Mus musculus
ggaataaagcgaagacccaggtcac

SEQ ID NO: 587059 - DNA, 25 bp, Mus musculus
ggaataaagcgatgacccaggtcac

SEQ ID NO: 587060 - DNA, 25 bp, Mus musculus
ggaataacaaaactgtctctcacac

SEQ ID NO: 587061 - DNA, 25 bp, Mus musculus
ggaataacaaaagtgtctctcacac

SEQ ID NO: 587062 - DNA, 25 bp, Mus musculus
ggaataacacgacttacaacatctg

SEQ ID NO: 587063 - DNA, 25 bp, Mus musculus
ggaataacacgagttacaacatctg

SEQ ID NO: 587064 - DNA, 25 bp, Mus musculus
ggaataacagttaggctgccatgcc

SEQ ID NO: 587065 - DNA, 25 bp, Mus musculus
ggaataacagtttggctgccatgcc

SEQ ID NO: 587066 - DNA, 25 bp, Mus musculus
ggaataacccgaacatgcatagctg

SEQ ID NO: 587067 - DNA, 25 bp, Mus musculus
ggaataacccgatcatgcatagctg

SEQ ID NO: 587068 - DNA, 25 bp, Mus musculus
ggaataactcaacaacacaatgatt

SEQ ID NO: 587069 - DNA, 25 bp, Mus musculus
ggaataactcaagaacacaatgatt

SEQ ID NO: 587070 - DNA, 25 bp, Mus musculus
ggaataactccccatttagctgctt

SEQ ID NO: 587071 - DNA, 25 bp, Mus musculus
ggaataactcccgatttagctgctt

SEQ ID NO: 587072 - DNA, 25 bp, Mus musculus
ggaataactgcaaatgttcggatat

SEQ ID NO: 587073 - DNA, 25 bp, Mus musculus
ggaataactgcatatgttcggatat

SEQ ID NO: 587074 - DNA, 25 bp, Mus musculus
ggaataacttgaatgctcgctggaa

SEQ ID NO: 587075 - DNA, 25 bp, Mus musculus
ggaataacttgattgctcgctggaa

SEQ ID NO: 587076 - DNA, 25 bp, Mus musculus
ggaataagaacaacgcctgcggcat

SEQ ID NO: 587077 - DNA, 25 bp, Mus musculus
ggaataagaacatcgcctgcggcat

SEQ ID NO: 587078 - DNA, 25 bp, Mus musculus
ggaataagcatcatagctcccctgc

SEQ ID NO: 587079 - DNA, 25 bp, Mus musculus
ggaataagcatcatgcctgagacaa

SEQ ID NO: 587080 - DNA, 25 bp, Mus musculus
ggaataagcatcttagctcccctgc

SEQ ID NO: 587081 - DNA, 25 bp, Mus musculus
ggaataagcatcttgcctgagacaa

SEQ ID NO: 587082 - DNA, 25 bp, Mus musculus
ggaataagctacactgaaccctaaa

SEQ ID NO: 587083 - DNA, 25 bp, Mus musculus
ggaataagctactctgaaccctaaa

SEQ ID NO: 587084 - DNA, 25 bp, Mus musculus
ggaataaggtccattaaaggctgca

SEQ ID NO: 587085 - DNA, 25 bp, Mus musculus
ggaataaggtcctttaaaggctgca

SEQ ID NO: 587086 - DNA, 25 bp, Mus musculus
ggaataagtgcaattttaccttgta

SEQ ID NO: 587087 - DNA, 25 bp, Mus musculus
ggaataagtgcatttttaccttgta

SEQ ID NO: 587088 - DNA, 25 bp, Mus musculus
ggaataatccttcgttgctctattg

SEQ ID NO: 587089 - DNA, 25 bp, Mus musculus
ggaataatccttggttgctctattg

SEQ ID NO: 587090 - DNA, 25 bp, Mus musculus
ggaataatcgtcactatcatatgca

SEQ ID NO: 587091 - DNA, 25 bp, Mus musculus
ggaataatcgtctctatcatatgca

SEQ ID NO: 587092 - DNA, 25 bp, Mus musculus
ggaataatgatactacctacctcac

SEQ ID NO: 587093 - DNA, 25 bp, Mus musculus
ggaataatgatagtacctacctcac

SEQ ID NO: 587094 - DNA, 25 bp, Mus musculus
ggaataattcccctcacggcgatat

SEQ ID NO: 587095 - DNA, 25 bp, Mus musculus
ggaataattcccgtcacggcgatat

SEQ ID NO: 587096 - DNA, 25 bp, Mus musculus
ggaataattctaagcaaagaccctg

SEQ ID NO: 587097 - DNA, 25 bp, Mus musculus
ggaataattctatgcaaagaccctg

SEQ ID NO: 587098 - DNA, 25 bp, Mus musculus
ggaatacaaaaaccagcctgcacat

SEQ ID NO: 587099 - DNA, 25 bp, Mus musculus
ggaatacaaaaagcagcctgcacat

SEQ ID NO: 587100 - DNA, 25 bp, Mus musculus
ggaatacaaacactccccggtctgt

SEQ ID NO: 587101 - DNA, 25 bp, Mus musculus
ggaatacaaacagtccccggtctgt

SEQ ID NO: 587102 - DNA, 25 bp, Mus musculus
ggaatacactaacgtcctcgcggtt

SEQ ID NO: 587103 - DNA, 25 bp, Mus musculus
ggaatacactaaggtcctcgcggtt

SEQ ID NO: 587104 - DNA, 25 bp, Mus musculus
ggaatacacttcaacacttctgctt

SEQ ID NO: 587105 - DNA, 25 bp, Mus musculus
ggaatacacttctacacttctgctt

SEQ ID NO: 587106 - DNA, 25 bp, Mus musculus
ggaatacagaagagccagtcagaca

SEQ ID NO: 587107 - DNA, 25 bp, Mus musculus
ggaatacagaagtgccagtcagaca

SEQ ID NO: 587108 - DNA, 25 bp, Mus musculus
ggaatacagattaccgactcacttt

SEQ ID NO: 587109 - DNA, 25 bp, Mus musculus
ggaatacagatttccgactcacttt

SEQ ID NO: 587110 - DNA, 25 bp, Mus musculus
ggaatacaggatcttctagctgctg

SEQ ID NO: 587111 - DNA, 25 bp, Mus musculus
ggaatacaggatgttctagctgctg

SEQ ID NO: 587112 - DNA, 25 bp, Mus musculus
ggaatacagtacaatcccaacccta

SEQ ID NO: 587113 - DNA, 25 bp, Mus musculus
ggaatacagtactatcccaacccta

SEQ ID NO: 587114 - DNA, 25 bp, Mus musculus
ggaatacatcagctttttgtcccct

SEQ ID NO: 587115 - DNA, 25 bp, Mus musculus
ggaatacatcaggtttttgtcccct

SEQ ID NO: 587116 - DNA, 25 bp, Mus musculus
ggaatacatgaaccggctggacacg

SEQ ID NO: 587117 - DNA, 25 bp, Mus musculus
ggaatacatgaagcggctggacacg

SEQ ID NO: 587118 - DNA, 25 bp, Mus musculus
ggaatacatgatcaagcgccagaat

SEQ ID NO: 587119 - DNA, 25 bp, Mus musculus
ggaatacatgatgaagcgccagaat

SEQ ID NO: 587120 - DNA, 25 bp, Mus musculus
ggaatacatgctaatctgccggctc

SEQ ID NO: 587121 - DNA, 25 bp, Mus musculus
ggaatacatgcttatctgccggctc

SEQ ID NO: 587122 - DNA, 25 bp, Mus musculus
ggaataccactccagacaaccgaga

SEQ ID NO: 587123 - DNA, 25 bp, Mus musculus
ggaataccactcgagacaaccgaga

SEQ ID NO: 587124 - DNA, 25 bp, Mus musculus
ggaatacccaggaagtgcctctact

SEQ ID NO: 587125 - DNA, 25 bp, Mus musculus
ggaatacccaggtagtgcctctact

SEQ ID NO: 587126 - DNA, 25 bp, Mus musculus
ggaatacccataaatacctcccatg

SEQ ID NO: 587127 - DNA, 25 bp, Mus musculus
ggaatacccatatatacctcccatg

SEQ ID NO: 587128 - DNA, 25 bp, Mus musculus
ggaataccccagagattgaacgagt

SEQ ID NO: 587129 - DNA, 25 bp, Mus musculus
ggaataccccagtgattgaacgagt

SEQ ID NO: 587130 - DNA, 25 bp, Mus musculus
ggaataccgcagcatccccagagca

SEQ ID NO: 587131 - DNA, 25 bp, Mus musculus
ggaataccgcaggatccccagagca

SEQ ID NO: 587132 - DNA, 25 bp, Mus musculus
ggaatacctatgactatgcaatgga

SEQ ID NO: 587133 - DNA, 25 bp, Mus musculus
ggaatacctatgtctatgcaatgga

SEQ ID NO: 587134 - DNA, 25 bp, Mus musculus
ggaatacctccaaagtggccagtaa

SEQ ID NO: 587135 - DNA, 25 bp, Mus musculus
ggaatacctccatagtggccagtaa

SEQ ID NO: 587136 - DNA, 25 bp, Mus musculus
ggaatacctggaagacggagctctt

SEQ ID NO: 587137 - DNA, 25 bp, Mus musculus
ggaatacctggatgacggagctctt

SEQ ID NO: 587138 - DNA, 25 bp, Mus musculus
ggaatacctgtcatctgtggaccat

SEQ ID NO: 587139 - DNA, 25 bp, Mus musculus
ggaatacctgtcttctgtggaccat

SEQ ID NO: 587140 - DNA, 25 bp, Mus musculus
ggaatacgtccaccagcgcaaagaa

SEQ ID NO: 587141 - DNA, 25 bp, Mus musculus
ggaatacgtccagcagcgcaaagaa

SEQ ID NO: 587142 - DNA, 25 bp, Mus musculus
ggaatacgtcttaaactctgaaata

SEQ ID NO: 587143 - DNA, 25 bp, Mus musculus
ggaatacgtctttaactctgaaata

SEQ ID NO: 587144 - DNA, 25 bp, Mus musculus
ggaatactacaccttaatggacatt

SEQ ID NO: 587145 - DNA, 25 bp, Mus musculus
ggaatactacacgttaatggacatt

SEQ ID NO: 587146 - DNA, 25 bp, Mus musculus
ggaatactacctcatgcagataaag

SEQ ID NO: 587147 - DNA, 25 bp, Mus musculus
ggaatactacctgatgcagataaag

SEQ ID NO: 587148 - DNA, 25 bp, Mus musculus
ggaatactcactagttgaactgcat

SEQ ID NO: 587149 - DNA, 25 bp, Mus musculus
ggaatactcacttgttgaactgcat

SEQ ID NO: 587150 - DNA, 25 bp, Mus musculus
ggaatactcatgagtgctctgctgg

SEQ ID NO: 587151 - DNA, 25 bp, Mus musculus
ggaatactcatgatttttgctggac

SEQ ID NO: 587152 - DNA, 25 bp, Mus musculus
ggaatactcatgtgtgctctgctgg

SEQ ID NO: 587153 - DNA, 25 bp, Mus musculus
ggaatactcatgttttttgctggac

SEQ ID NO: 587154 - DNA, 25 bp, Mus musculus
ggaatactccagaagctttttatga

SEQ ID NO: 587155 - DNA, 25 bp, Mus musculus
ggaatactccagtagctttttatga

SEQ ID NO: 587156 - DNA, 25 bp, Mus musculus
ggaatactccccagtctttggctga

SEQ ID NO: 587157 - DNA, 25 bp, Mus musculus
ggaatactcccctgtctttggctga

SEQ ID NO: 587158 - DNA, 25 bp, Mus musculus
ggaatactcggtccctcctgaggtt

SEQ ID NO: 587159 - DNA, 25 bp, Mus musculus
ggaatactcggtgcctcctgaggtt

SEQ ID NO: 587160 - DNA, 25 bp, Mus musculus
ggaatactctaccattaccttactt

SEQ ID NO: 587161 - DNA, 25 bp, Mus musculus
ggaatactctacgattaccttactt

SEQ ID NO: 587162 - DNA, 25 bp, Mus musculus
ggaatactctataaactgtctgcat

SEQ ID NO: 587163 - DNA, 25 bp, Mus musculus
ggaatactctattaactgtctgcat

SEQ ID NO: 587164 - DNA, 25 bp, Mus musculus
ggaatactgcttactgctccttctg

SEQ ID NO: 587165 - DNA, 25 bp, Mus musculus
ggaatactgctttctgctccttctg

SEQ ID NO: 587166 - DNA, 25 bp, Mus musculus
ggaatactgtatccttgcctgcaaa

SEQ ID NO: 587167 - DNA, 25 bp, Mus musculus
ggaatactgtatgcttgcctgcaaa

SEQ ID NO: 587168 - DNA, 25 bp, Mus musculus
ggaatacttcagcagcaccagcgag

SEQ ID NO: 587169 - DNA, 25 bp, Mus musculus
ggaatacttcaggagcaccagcgag

SEQ ID NO: 587170 - DNA, 25 bp, Mus musculus
ggaatacttggactactttacatgc

SEQ ID NO: 587171 - DNA, 25 bp, Mus musculus
ggaatacttggagtactttacatgc

SEQ ID NO: 587172 - DNA, 25 bp, Mus musculus
ggaatactttggaggccgcgctcga

SEQ ID NO: 587173 - DNA, 25 bp, Mus musculus
ggaatactttggtggccgcgctcga

SEQ ID NO: 587174 - DNA, 25 bp, Mus musculus
ggaatacttttgctacaattttctg

SEQ ID NO: 587175 - DNA, 25 bp, Mus musculus
ggaatacttttggtacaattttctg

SEQ ID NO: 587176 - DNA, 25 bp, Mus musculus
ggaatagaacacacacagccgtaga

SEQ ID NO: 587177 - DNA, 25 bp, Mus musculus
ggaatagaacactcacagccgtaga

SEQ ID NO: 587178 - DNA, 25 bp, Mus musculus
ggaatagaatttccaaccctttgag

SEQ ID NO: 587179 - DNA, 25 bp, Mus musculus
ggaatagaatttgcaaccctttgag

SEQ ID NO: 587180 - DNA, 25 bp, Mus musculus
ggaatagacaacatacattcactac

SEQ ID NO: 587181 - DNA, 25 bp, Mus musculus
ggaatagacaacttacattcactac

SEQ ID NO: 587182 - DNA, 25 bp, Mus musculus
ggaatagacctgcataattatcttt

SEQ ID NO: 587183 - DNA, 25 bp, Mus musculus
ggaatagacctggataattatcttt

SEQ ID NO: 587184 - DNA, 25 bp, Mus musculus
ggaatagagacaaacccctgggcag

SEQ ID NO: 587185 - DNA, 25 bp, Mus musculus
ggaatagagacatacccctgggcag

SEQ ID NO: 587186 - DNA, 25 bp, Mus musculus
ggaatagagagcatgcttgggcttt

SEQ ID NO: 587187 - DNA, 25 bp, Mus musculus
ggaatagagagcttgcttgggcttt

SEQ ID NO: 587188 - DNA, 25 bp, Mus musculus
ggaatagataccctgcatgctatca

SEQ ID NO: 587189 - DNA, 25 bp, Mus musculus
ggaatagataccgtgcatgctatca

SEQ ID NO: 587190 - DNA, 25 bp, Mus musculus
ggaatagatgaaactcatccaccgt

SEQ ID NO: 587191 - DNA, 25 bp, Mus musculus
ggaatagatgaatctcatccaccgt

SEQ ID NO: 587192 - DNA, 25 bp, Mus musculus
ggaatagatgacatgacacccacat

SEQ ID NO: 587193 - DNA, 25 bp, Mus musculus
ggaatagatgacttgacacccacat

SEQ ID NO: 587194 - DNA, 25 bp, Mus musculus
ggaatagcaacgacaccaactgata

SEQ ID NO: 587195 - DNA, 25 bp, Mus musculus
ggaatagcaacgtcaccaactgata

SEQ ID NO: 587196 - DNA, 25 bp, Mus musculus
ggaatagcactgacccttcgagaat

SEQ ID NO: 587197 - DNA, 25 bp, Mus musculus
ggaatagcactgtcccttcgagaat

SEQ ID NO: 587198 - DNA, 25 bp, Mus musculus
ggaatagcagctccatttctttttt

SEQ ID NO: 587199 - DNA, 25 bp, Mus musculus
ggaatagcagctgcatttctttttt

SEQ ID NO: 587200 - DNA, 25 bp, Mus musculus
ggaatagcatctatcattcgcccct

SEQ ID NO: 587201 - DNA, 25 bp, Mus musculus
ggaatagcatctttcattcgcccct

SEQ ID NO: 587202 - DNA, 25 bp, Mus musculus
ggaatagccatacggtcaccttata

SEQ ID NO: 587203 - DNA, 25 bp, Mus musculus
ggaatagccatagggtcaccttata

SEQ ID NO: 587204 - DNA, 25 bp, Mus musculus
ggaatagccttaacattggcctggg

SEQ ID NO: 587205 - DNA, 25 bp, Mus musculus
ggaatagccttatcattggcctggg

SEQ ID NO: 587206 - DNA, 25 bp, Mus musculus
ggaatagcggcacctagctcccagg

SEQ ID NO: 587207 - DNA, 25 bp, Mus musculus
ggaatagcggcagctagctcccagg

SEQ ID NO: 587208 - DNA, 25 bp, Mus musculus
ggaatagctcaccagcaggctttga

SEQ ID NO: 587209 - DNA, 25 bp, Mus musculus
ggaatagctcacgagcaggctttga

SEQ ID NO: 587210 - DNA, 25 bp, Mus musculus
ggaatagctctgctacttttccaga

SEQ ID NO: 587211 - DNA, 25 bp, Mus musculus
ggaatagctctggtacttttccaga

SEQ ID NO: 587212 - DNA, 25 bp, Mus musculus
ggaatagcttttaattccgctccaa

SEQ ID NO: 587213 - DNA, 25 bp, Mus musculus
ggaatagctttttattccgctccaa

SEQ ID NO: 587214 - DNA, 25 bp, Mus musculus
ggaataggcatcatagctacctcat

SEQ ID NO: 587215 - DNA, 25 bp, Mus musculus
ggaataggcatcttagctacctcat

SEQ ID NO: 587216 - DNA, 25 bp, Mus musculus
ggaataggctgtcggcgacccaacc

SEQ ID NO: 587217 - DNA, 25 bp, Mus musculus
ggaataggctgtgggcgacccaacc

SEQ ID NO: 587218 - DNA, 25 bp, Mus musculus
ggaatagggttccatttctctgctg

SEQ ID NO: 587219 - DNA, 25 bp, Mus musculus
ggaatagggttcgatttctctgctg

SEQ ID NO: 587220 - DNA, 25 bp, Mus musculus
ggaataggttccaaaataggttctg

SEQ ID NO: 587221 - DNA, 25 bp, Mus musculus
ggaataggttcctaaataggttctg

SEQ ID NO: 587222 - DNA, 25 bp, Mus musculus
ggaatagtcagcatcttccagacaa

SEQ ID NO: 587223 - DNA, 25 bp, Mus musculus
ggaatagtcagcttcttccagacaa

SEQ ID NO: 587224 - DNA, 25 bp, Mus musculus
ggaatagtctcaacattctttatgt

SEQ ID NO: 587225 - DNA, 25 bp, Mus musculus
ggaatagtctcatcattctttatgt

SEQ ID NO: 587226 - DNA, 25 bp, Mus musculus
ggaatagtctccatttgctgtaaag

SEQ ID NO: 587227 - DNA, 25 bp, Mus musculus
ggaatagtctccttttgctgtaaag

SEQ ID NO: 587228 - DNA, 25 bp, Mus musculus
ggaatagtgccacgacttctgtttt

SEQ ID NO: 587229 - DNA, 25 bp, Mus musculus
ggaatagtgccaggacttctgtttt

SEQ ID NO: 587230 - DNA, 25 bp, Mus musculus
ggaatagtggtaagcctataacccc

SEQ ID NO: 587231 - DNA, 25 bp, Mus musculus
ggaatagtggtatgcctataacccc

SEQ ID NO: 587232 - DNA, 25 bp, Mus musculus
ggaatagttgataataagcccagca

SEQ ID NO: 587233 - DNA, 25 bp, Mus musculus
ggaatagttgattataagcccagca

SEQ ID NO: 587234 - DNA, 25 bp, Mus musculus
ggaatagtttctcattacacagttc

SEQ ID NO: 587235 - DNA, 25 bp, Mus musculus
ggaatagtttctgattacacagttc

SEQ ID NO: 587236 - DNA, 25 bp, Mus musculus
ggaatataatacatcccaggcattg

SEQ ID NO: 587237 - DNA, 25 bp, Mus musculus
ggaatataatacttcccaggcattg

SEQ ID NO: 587238 - DNA, 25 bp, Mus musculus
ggaatatacacaagccccctcacaa

SEQ ID NO: 587239 - DNA, 25 bp, Mus musculus
ggaatatacacatgccccctcacaa

SEQ ID NO: 587240 - DNA, 25 bp, Mus musculus
ggaatatactttaagcagtcttctt

SEQ ID NO: 587241 - DNA, 25 bp, Mus musculus
ggaatatacttttagcagtcttctt

SEQ ID NO: 587242 - DNA, 25 bp, Mus musculus
ggaatatagactcatccaacccaac

SEQ ID NO: 587243 - DNA, 25 bp, Mus musculus
ggaatatagactgatccaacccaac

SEQ ID NO: 587244 - DNA, 25 bp, Mus musculus
ggaatatagctcctcatgttggtga

SEQ ID NO: 587245 - DNA, 25 bp, Mus musculus
ggaatatagctcgtcatgttggtga

SEQ ID NO: 587246 - DNA, 25 bp, Mus musculus
ggaatatagctgatctacccaaaga

SEQ ID NO: 587247 - DNA, 25 bp, Mus musculus
ggaatatagctgttctacccaaaga

SEQ ID NO: 587248 - DNA, 25 bp, Mus musculus
ggaatatagtcaatacaggcagcaa

SEQ ID NO: 587249 - DNA, 25 bp, Mus musculus
ggaatatagtcattacaggcagcaa

SEQ ID NO: 587250 - DNA, 25 bp, Mus musculus
ggaatatatcccattggtacccaga

SEQ ID NO: 587251 - DNA, 25 bp, Mus musculus
ggaatatatccctttggtacccaga

SEQ ID NO: 587252 - DNA, 25 bp, Mus musculus
ggaatatcagcccaaaccacggatg

SEQ ID NO: 587253 - DNA, 25 bp, Mus musculus
ggaatatcagccgaaaccacggatg

SEQ ID NO: 587254 - DNA, 25 bp, Mus musculus
ggaatatccaagaatcatcaccatt

SEQ ID NO: 587255 - DNA, 25 bp, Mus musculus
ggaatatccaagtatcatcaccatt

SEQ ID NO: 587256 - DNA, 25 bp, Mus musculus
ggaatatcccacaaactaaccattt

SEQ ID NO: 587257 - DNA, 25 bp, Mus musculus
ggaatatcccactaactaaccattt

SEQ ID NO: 587258 - DNA, 25 bp, Mus musculus
ggaatatcggttcctgtccaaccag

SEQ ID NO: 587259 - DNA, 25 bp, Mus musculus
ggaatatcggttgctgtccaaccag

SEQ ID NO: 587260 - DNA, 25 bp, Mus musculus
ggaatatctcagatccttgcttcca

SEQ ID NO: 587261 - DNA, 25 bp, Mus musculus
ggaatatctcagttccttgcttcca

SEQ ID NO: 587262 - DNA, 25 bp, Mus musculus
ggaatatctgcaccaaggccaggca

SEQ ID NO: 587263 - DNA, 25 bp, Mus musculus
ggaatatctgcagcaaggccaggca

SEQ ID NO: 587264 - DNA, 25 bp, Mus musculus
ggaatatcttggattctctaactat

SEQ ID NO: 587265 - DNA, 25 bp, Mus musculus
ggaatatcttggtttctctaactat

SEQ ID NO: 587266 - DNA, 25 bp, Mus musculus
ggaatatgctgtaggcctggctctc

SEQ ID NO: 587267 - DNA, 25 bp, Mus musculus
ggaatatgctgttggcctggctctc

SEQ ID NO: 587268 - DNA, 25 bp, Mus musculus
ggaatatgcttactggttttataga

SEQ ID NO: 587269 - DNA, 25 bp, Mus musculus
ggaatatgcttagtggttttataga

SEQ ID NO: 587270 - DNA, 25 bp, Mus musculus
ggaatatggcgtccgctactcgcgt

SEQ ID NO: 587271 - DNA, 25 bp, Mus musculus
ggaatatggcgtgcgctactcgcgt

SEQ ID NO: 587272 - DNA, 25 bp, Mus musculus
ggaatatgtcccacagcagctaggt

SEQ ID NO: 587273 - DNA, 25 bp, Mus musculus
ggaatatgtccctcagcagctaggt

SEQ ID NO: 587274 - DNA, 25 bp, Mus musculus
ggaatatgttctaggagctgacgga

SEQ ID NO: 587275 - DNA, 25 bp, Mus musculus
ggaatatgttcttggagctgacgga

SEQ ID NO: 587276 - DNA, 25 bp, Mus musculus
ggaatattactaaccttgtatgata

SEQ ID NO: 587277 - DNA, 25 bp, Mus musculus
ggaatattactatccttgtatgata

SEQ ID NO: 587278 - DNA, 25 bp, Mus musculus
ggaatattccagaaagtttgatctc

SEQ ID NO: 587279 - DNA, 25 bp, Mus musculus
ggaatattccagtaagtttgatctc

SEQ ID NO: 587280 - DNA, 25 bp, Mus musculus
ggaatattccatcggcttttgagaa

SEQ ID NO: 587281 - DNA, 25 bp, Mus musculus
ggaatattccatgggcttttgagaa

SEQ ID NO: 587282 - DNA, 25 bp, Mus musculus
ggaatattgctcagtgtcacagcct

SEQ ID NO: 587283 - DNA, 25 bp, Mus musculus
ggaatattgctctgtgtcacagcct

SEQ ID NO: 587284 - DNA, 25 bp, Mus musculus
ggaatattgtaacccctgaacatgt

SEQ ID NO: 587285 - DNA, 25 bp, Mus musculus
ggaatattgtaagccctgaacatgt

SEQ ID NO: 587286 - DNA, 25 bp, Mus musculus
ggaatatttattcggcccgtttgca

SEQ ID NO: 587287 - DNA, 25 bp, Mus musculus
ggaatatttattgggcccgtttgca

SEQ ID NO: 587288 - DNA, 25 bp, Mus musculus
ggaatatttcagcatatccctttgg

SEQ ID NO: 587289 - DNA, 25 bp, Mus musculus
ggaatatttcaggatatccctttgg

SEQ ID NO: 587290 - DNA, 25 bp, Mus musculus
ggaatatttcccaacttcaaagata

SEQ ID NO: 587291 - DNA, 25 bp, Mus musculus
ggaatatttccctacttcaaagata

SEQ ID NO: 587292 - DNA, 25 bp, Mus musculus
ggaatatttctaatcagctagggta

SEQ ID NO: 587293 - DNA, 25 bp, Mus musculus
ggaatatttctattcagctagggta

SEQ ID NO: 587294 - DNA, 25 bp, Mus musculus
ggaatcaaaactcatgtagaacttt

SEQ ID NO: 587295 - DNA, 25 bp, Mus musculus
ggaatcaaaactccactgtcaagaa

SEQ ID NO: 587296 - DNA, 25 bp, Mus musculus
ggaatcaaaactgatgtagaacttt

SEQ ID NO: 587297 - DNA, 25 bp, Mus musculus
ggaatcaaaactgcactgtcaagaa

SEQ ID NO: 587298 - DNA, 25 bp, Mus musculus
ggaatcaaaatcctccgtaggccac

SEQ ID NO: 587299 - DNA, 25 bp, Mus musculus
ggaatcaaaatcgtccgtaggccac

SEQ ID NO: 587300 - DNA, 25 bp, Mus musculus
ggaatcaaaatgagccctacgctgt

SEQ ID NO: 587301 - DNA, 25 bp, Mus musculus
ggaatcaaaatgtgccctacgctgt

SEQ ID NO: 587302 - DNA, 25 bp, Mus musculus
ggaatcaaacctatgtcccctgaag

SEQ ID NO: 587303 - DNA, 25 bp, Mus musculus
ggaatcaaacctttgtcccctgaag

SEQ ID NO: 587304 - DNA, 25 bp, Mus musculus
ggaatcaaactccaggctatccttg

SEQ ID NO: 587305 - DNA, 25 bp, Mus musculus
ggaatcaaactcgaggctatccttg

SEQ ID NO: 587306 - DNA, 25 bp, Mus musculus
ggaatcaaagtccagttggcccttt

SEQ ID NO: 587307 - DNA, 25 bp, Mus musculus
ggaatcaaagtcgagttggcccttt

SEQ ID NO: 587308 - DNA, 25 bp, Mus musculus
ggaatcaaatatcctcaaacccttt

SEQ ID NO: 587309 - DNA, 25 bp, Mus musculus
ggaatcaaatatgctcaaacccttt

SEQ ID NO: 587310 - DNA, 25 bp, Mus musculus
ggaatcaaatttctgtattctcagt

SEQ ID NO: 587311 - DNA, 25 bp, Mus musculus
ggaatcaaatttgtgtattctcagt

SEQ ID NO: 587312 - DNA, 25 bp, Mus musculus
ggaatcaagattatgcttctgtgaa

SEQ ID NO: 587313 - DNA, 25 bp, Mus musculus
ggaatcaagattttgcttctgtgaa

SEQ ID NO: 587314 - DNA, 25 bp, Mus musculus
ggaatcaatgccaggacattgcaat

SEQ ID NO: 587315 - DNA, 25 bp, Mus musculus
ggaatcaatgcctggacattgcaat

SEQ ID NO: 587316 - DNA, 25 bp, Mus musculus
ggaatcacaaccattggtgcccgaa

SEQ ID NO: 587317 - DNA, 25 bp, Mus musculus
ggaatcacaacctttggtgcccgaa

SEQ ID NO: 587318 - DNA, 25 bp, Mus musculus
ggaatcacacatattaccactttga

SEQ ID NO: 587319 - DNA, 25 bp, Mus musculus
ggaatcacacattttaccactttga

SEQ ID NO: 587320 - DNA, 25 bp, Mus musculus
ggaatcacagtcacactagaccaga

SEQ ID NO: 587321 - DNA, 25 bp, Mus musculus
ggaatcacagtctcactagaccaga

SEQ ID NO: 587322 - DNA, 25 bp, Mus musculus
ggaatcacatggagcacatttttga

SEQ ID NO: 587323 - DNA, 25 bp, Mus musculus
ggaatcacatggtgcacatttttga

SEQ ID NO: 587324 - DNA, 25 bp, Mus musculus
ggaatcaccacgcaggaggcagccc

SEQ ID NO: 587325 - DNA, 25 bp, Mus musculus
ggaatcaccacggaggaggcagccc

SEQ ID NO: 587326 - DNA, 25 bp, Mus musculus
ggaatcaccatgaatctcccaacag

SEQ ID NO: 587327 - DNA, 25 bp, Mus musculus
ggaatcaccatgtatctcccaacag

SEQ ID NO: 587328 - DNA, 25 bp, Mus musculus
ggaatcacccctatagatacagaaa

SEQ ID NO: 587329 - DNA, 25 bp, Mus musculus
ggaatcacccctttagatacagaaa

SEQ ID NO: 587330 - DNA, 25 bp, Mus musculus
ggaatcacctccaaatgcactacta

SEQ ID NO: 587331 - DNA, 25 bp, Mus musculus
ggaatcacctcctaatgcactacta

SEQ ID NO: 587332 - DNA, 25 bp, Mus musculus
ggaatcacctgcattaaacctattt

SEQ ID NO: 587333 - DNA, 25 bp, Mus musculus
ggaatcacctgctttaaacctattt

SEQ ID NO: 587334 - DNA, 25 bp, Mus musculus
ggaatcacctttctgttctattgca

SEQ ID NO: 587335 - DNA, 25 bp, Mus musculus
ggaatcacctttgtgttctattgca

SEQ ID NO: 587336 - DNA, 25 bp, Mus musculus
ggaatcacgttccaaacatgttcaa

SEQ ID NO: 587337 - DNA, 25 bp, Mus musculus
ggaatcacgttcgaaacatgttcaa

SEQ ID NO: 587338 - DNA, 25 bp, Mus musculus
ggaatcactaaaatgtagtccacta

SEQ ID NO: 587339 - DNA, 25 bp, Mus musculus
ggaatcactaaattgtagtccacta

SEQ ID NO: 587340 - DNA, 25 bp, Mus musculus
ggaatcactatgattggccttgttg

SEQ ID NO: 587341 - DNA, 25 bp, Mus musculus
ggaatcactatgtttggccttgttg

SEQ ID NO: 587342 - DNA, 25 bp, Mus musculus
ggaatcactcctccgagacttggaa

SEQ ID NO: 587343 - DNA, 25 bp, Mus musculus
ggaatcactcctgcgagacttggaa

SEQ ID NO: 587344 - DNA, 25 bp, Mus musculus
ggaatcactggaatatccacactaa

SEQ ID NO: 587345 - DNA, 25 bp, Mus musculus
ggaatcactggattatccacactaa

SEQ ID NO: 587346 - DNA, 25 bp, Mus musculus
ggaatcactggcacaagttgttcta

SEQ ID NO: 587347 - DNA, 25 bp, Mus musculus
ggaatcactggctcaagttgttcta

SEQ ID NO: 587348 - DNA, 25 bp, Mus musculus
ggaatcagaattagccttttgtaca

SEQ ID NO: 587349 - DNA, 25 bp, Mus musculus
ggaatcagaatttgccttttgtaca

SEQ ID NO: 587350 - DNA, 25 bp, Mus musculus
ggaatcagacagaccgaccctgtgt

SEQ ID NO: 587351 - DNA, 25 bp, Mus musculus
ggaatcagacagtccgaccctgtgt

SEQ ID NO: 587352 - DNA, 25 bp, Mus musculus
ggaatcagacttcgcctattttgga

SEQ ID NO: 587353 - DNA, 25 bp, Mus musculus
ggaatcagacttggcctattttgga

SEQ ID NO: 587354 - DNA, 25 bp, Mus musculus
ggaatcagagtgagttcaataccca

SEQ ID NO: 587355 - DNA, 25 bp, Mus musculus
ggaatcagagtgtgttcaataccca

SEQ ID NO: 587356 - DNA, 25 bp, Mus musculus
ggaatcagcatcagttacctcacaa

SEQ ID NO: 587357 - DNA, 25 bp, Mus musculus
ggaatcagcatctgttacctcacaa

SEQ ID NO: 587358 - DNA, 25 bp, Mus musculus
ggaatcagccaacaccagtttgaaa

SEQ ID NO: 587359 - DNA, 25 bp, Mus musculus
ggaatcagccaagaccagtttgaaa

SEQ ID NO: 587360 - DNA, 25 bp, Mus musculus
ggaatcagccatcaattacacagat

SEQ ID NO: 587361 - DNA, 25 bp, Mus musculus
ggaatcagccatgaattacacagat

SEQ ID NO: 587362 - DNA, 25 bp, Mus musculus
ggaatcagctatctggctcttccca

SEQ ID NO: 587363 - DNA, 25 bp, Mus musculus
ggaatcagctatgtggctcttccca

SEQ ID NO: 587364 - DNA, 25 bp, Mus musculus
ggaatcagcttcaagtaccaaggac

SEQ ID NO: 587365 - DNA, 25 bp, Mus musculus
ggaatcagcttctagtaccaaggac

SEQ ID NO: 587366 - DNA, 25 bp, Mus musculus
ggaatcagggaccaagacccttcct

SEQ ID NO: 587367 - DNA, 25 bp, Mus musculus
ggaatcagggacgaagacccttcct

SEQ ID NO: 587368 - DNA, 25 bp, Mus musculus
ggaatcagtatgacactctccatga

SEQ ID NO: 587369 - DNA, 25 bp, Mus musculus
ggaatcagtatgtcactctccatga

SEQ ID NO: 587370 - DNA, 25 bp, Mus musculus
ggaatcagtcagaatatatctatct

SEQ ID NO: 587371 - DNA, 25 bp, Mus musculus
ggaatcagtcagtatatatctatct

SEQ ID NO: 587372 - DNA, 25 bp, Mus musculus
ggaatcagtcccctagcctcttctt

SEQ ID NO: 587373 - DNA, 25 bp, Mus musculus
ggaatcagtcccgtagcctcttctt

SEQ ID NO: 587374 - DNA, 25 bp, Mus musculus
ggaatcagtggaagagtctatcaat

SEQ ID NO: 587375 - DNA, 25 bp, Mus musculus
ggaatcagtggatgagtctatcaat

SEQ ID NO: 587376 - DNA, 25 bp, Mus musculus
ggaatcagtgttcaacttgttctta

SEQ ID NO: 587377 - DNA, 25 bp, Mus musculus
ggaatcagtgttgaacttgttctta

SEQ ID NO: 587378 - DNA, 25 bp, Mus musculus
ggaatcatacatagagagcaccatg

SEQ ID NO: 587379 - DNA, 25 bp, Mus musculus
ggaatcatacattgagagcaccatg

SEQ ID NO: 587380 - DNA, 25 bp, Mus musculus
ggaatcatcaaacatatatgggtag

SEQ ID NO: 587381 - DNA, 25 bp, Mus musculus
ggaatcatcaaagatatatgggtag

SEQ ID NO: 587382 - DNA, 25 bp, Mus musculus
ggaatcatcccgcagtcaggacaaa

SEQ ID NO: 587383 - DNA, 25 bp, Mus musculus
ggaatcatcccggagtcaggacaaa

SEQ ID NO: 587384 - DNA, 25 bp, Mus musculus
ggaatcatcgccaacgcatggaaga

SEQ ID NO: 587385 - DNA, 25 bp, Mus musculus
ggaatcatcgcctacgcatggaaga

SEQ ID NO: 587386 - DNA, 25 bp, Mus musculus
ggaatcatcgttaagcttatgtgtt

SEQ ID NO: 587387 - DNA, 25 bp, Mus musculus
ggaatcatcgtttagcttatgtgtt

SEQ ID NO: 587388 - DNA, 25 bp, Mus musculus
ggaatcatctgaactcgtcggagcg

SEQ ID NO: 587389 - DNA, 25 bp, Mus musculus
ggaatcatctgatctcgtcggagcg

SEQ ID NO: 587390 - DNA, 25 bp, Mus musculus
ggaatcatcttcaaaagctgtgaca

SEQ ID NO: 587391 - DNA, 25 bp, Mus musculus
ggaatcatcttctaaagctgtgaca

SEQ ID NO: 587392 - DNA, 25 bp, Mus musculus
ggaatcatgattagtattttatggt

SEQ ID NO: 587393 - DNA, 25 bp, Mus musculus
ggaatcatgatttgtattttatggt

SEQ ID NO: 587394 - DNA, 25 bp, Mus musculus
ggaatcatggatactccaactcacc

SEQ ID NO: 587395 - DNA, 25 bp, Mus musculus
ggaatcatggattctccaactcacc

SEQ ID NO: 587396 - DNA, 25 bp, Mus musculus
ggaatcatgtacaagcctgctttct

SEQ ID NO: 587397 - DNA, 25 bp, Mus musculus
ggaatcatgtactagcctgctttct

SEQ ID NO: 587398 - DNA, 25 bp, Mus musculus
ggaatcatgttcagtgttcggccac

SEQ ID NO: 587399 - DNA, 25 bp, Mus musculus
ggaatcatgttctgtgttcggccac

SEQ ID NO: 587400 - DNA, 25 bp, Mus musculus
ggaatcattaagactgctttcagca

SEQ ID NO: 587401 - DNA, 25 bp, Mus musculus
ggaatcattaagtctgctttcagca

SEQ ID NO: 587402 - DNA, 25 bp, Mus musculus
ggaatcattcctatcgtgatttacc

SEQ ID NO: 587403 - DNA, 25 bp, Mus musculus
ggaatcattcctttcgtgatttacc

SEQ ID NO: 587404 - DNA, 25 bp, Mus musculus
ggaatcattctgataagctcttagc

SEQ ID NO: 587405 - DNA, 25 bp, Mus musculus
ggaatcattctgttaagctcttagc

SEQ ID NO: 587406 - DNA, 25 bp, Mus musculus
ggaatccaaaatcgctctccagagt

SEQ ID NO: 587407 - DNA, 25 bp, Mus musculus
ggaatccaaaatggctctccagagt

SEQ ID NO: 587408 - DNA, 25 bp, Mus musculus
ggaatccaagagatgtgctatgcct

SEQ ID NO: 587409 - DNA, 25 bp, Mus musculus
ggaatccaagagttgtgctatgcct

SEQ ID NO: 587410 - DNA, 25 bp, Mus musculus
ggaatccaagggaacttcatttgat

SEQ ID NO: 587411 - DNA, 25 bp, Mus musculus
ggaatccaagggtacttcatttgat

SEQ ID NO: 587412 - DNA, 25 bp, Mus musculus
ggaatccacagacacctgatcgtaa

SEQ ID NO: 587413 - DNA, 25 bp, Mus musculus
ggaatccacagagacctgatcgtaa

SEQ ID NO: 587414 - DNA, 25 bp, Mus musculus
ggaatccacataaagaaggtcttct

SEQ ID NO: 587415 - DNA, 25 bp, Mus musculus
ggaatccacatatagaaggtcttct

SEQ ID NO: 587416 - DNA, 25 bp, Mus musculus
ggaatccacattagatccatgtaat

SEQ ID NO: 587417 - DNA, 25 bp, Mus musculus
ggaatccacatttgatccatgtaat

SEQ ID NO: 587418 - DNA, 25 bp, Mus musculus
ggaatccaccagatactcaattctt

SEQ ID NO: 587419 - DNA, 25 bp, Mus musculus
ggaatccaccagttactcaattctt

SEQ ID NO: 587420 - DNA, 25 bp, Mus musculus
ggaatccacgaaaaacagctttata

SEQ ID NO: 587421 - DNA, 25 bp, Mus musculus
ggaatccacgaataacagctttata

SEQ ID NO: 587422 - DNA, 25 bp, Mus musculus
ggaatccactgcctgcttggtagaa

SEQ ID NO: 587423 - DNA, 25 bp, Mus musculus
ggaatccactgcgtgcttggtagaa

SEQ ID NO: 587424 - DNA, 25 bp, Mus musculus
ggaatccactgtcatgacccacaaa

SEQ ID NO: 587425 - DNA, 25 bp, Mus musculus
ggaatccactgtgatgacccacaaa

SEQ ID NO: 587426 - DNA, 25 bp, Mus musculus
ggaatccagaagatccccagtggct

SEQ ID NO: 587427 - DNA, 25 bp, Mus musculus
ggaatccagaagttccccagtggct

SEQ ID NO: 587428 - DNA, 25 bp, Mus musculus
ggaatccagacacttgtcacaacct

SEQ ID NO: 587429 - DNA, 25 bp, Mus musculus
ggaatccagacagttgtcacaacct

SEQ ID NO: 587430 - DNA, 25 bp, Mus musculus
ggaatccagagaaaacctattgtaa

SEQ ID NO: 587431 - DNA, 25 bp, Mus musculus
ggaatccagagataacctattgtaa

SEQ ID NO: 587432 - DNA, 25 bp, Mus musculus
ggaatccagcatatctttagcttct

SEQ ID NO: 587433 - DNA, 25 bp, Mus musculus
ggaatccagcatttctttagcttct

SEQ ID NO: 587434 - DNA, 25 bp, Mus musculus
ggaatccaggaactctgagagcctt

SEQ ID NO: 587435 - DNA, 25 bp, Mus musculus
ggaatccaggaagtctgagagcctt

SEQ ID NO: 587436 - DNA, 25 bp, Mus musculus
ggaatccaggatcttgtcaggcttg

SEQ ID NO: 587437 - DNA, 25 bp, Mus musculus
ggaatccaggatgttgtcaggcttg

SEQ ID NO: 587438 - DNA, 25 bp, Mus musculus
ggaatccaggcacagattagcagcc

SEQ ID NO: 587439 - DNA, 25 bp, Mus musculus
ggaatccaggcagagattagcagcc

SEQ ID NO: 587440 - DNA, 25 bp, Mus musculus
ggaatccaggccagggtgattgaat

SEQ ID NO: 587441 - DNA, 25 bp, Mus musculus
ggaatccaggcctgggtgattgaat

SEQ ID NO: 587442 - DNA, 25 bp, Mus musculus
ggaatccagggaattttctacccat

SEQ ID NO: 587443 - DNA, 25 bp, Mus musculus
ggaatccagggatttttctacccat

SEQ ID NO: 587444 - DNA, 25 bp, Mus musculus
ggaatccagggcatcttgcgtgctg

SEQ ID NO: 587445 - DNA, 25 bp, Mus musculus
ggaatccagggcttcttgcgtgctg

SEQ ID NO: 587446 - DNA, 25 bp, Mus musculus
ggaatccagtatcctagtgcttttc

SEQ ID NO: 587447 - DNA, 25 bp, Mus musculus
ggaatccagtatgctagtgcttttc

SEQ ID NO: 587448 - DNA, 25 bp, Mus musculus
ggaatccagtgtagtcttccagatt

SEQ ID NO: 587449 - DNA, 25 bp, Mus musculus
ggaatccagtgttgtcttccagatt

SEQ ID NO: 587450 - DNA, 25 bp, Mus musculus
ggaatccatagactgcatgaacccc

SEQ ID NO: 587451 - DNA, 25 bp, Mus musculus
ggaatccatagagtgcatgaacccc

SEQ ID NO: 587452 - DNA, 25 bp, Mus musculus
ggaatccatcctcaaatctagaaac

SEQ ID NO: 587453 - DNA, 25 bp, Mus musculus
ggaatccatcctgaaatctagaaac

SEQ ID NO: 587454 - DNA, 25 bp, Mus musculus
ggaatccatcttaagaacctggtag

SEQ ID NO: 587455 - DNA, 25 bp, Mus musculus
ggaatccatctttagaacctggtag

SEQ ID NO: 587456 - DNA, 25 bp, Mus musculus
ggaatccatgcaattggccaagaga

SEQ ID NO: 587457 - DNA, 25 bp, Mus musculus
ggaatccatgcatttggccaagaga

SEQ ID NO: 587458 - DNA, 25 bp, Mus musculus
ggaatccattatctaacctaggctg

SEQ ID NO: 587459 - DNA, 25 bp, Mus musculus
ggaatccattatgtaacctaggctg

SEQ ID NO: 587460 - DNA, 25 bp, Mus musculus
ggaatccattcaatgctggtttgga

SEQ ID NO: 587461 - DNA, 25 bp, Mus musculus
ggaatccattcattgctggtttgga

SEQ ID NO: 587462 - DNA, 25 bp, Mus musculus
ggaatccattggcttgagacccatg

SEQ ID NO: 587463 - DNA, 25 bp, Mus musculus
ggaatccattgggttgagacccatg

SEQ ID NO: 587464 - DNA, 25 bp, Mus musculus
ggaatcccaaagatcacaggccaag

SEQ ID NO: 587465 - DNA, 25 bp, Mus musculus
ggaatcccaaagttcacaggccaag

SEQ ID NO: 587466 - DNA, 25 bp, Mus musculus
ggaatcccaaatacttggtgtgcag

SEQ ID NO: 587467 - DNA, 25 bp, Mus musculus
ggaatcccaaattcttggtgtgcag

SEQ ID NO: 587468 - DNA, 25 bp, Mus musculus
ggaatcccaacgagcaggaggctaa

SEQ ID NO: 587469 - DNA, 25 bp, Mus musculus
ggaatcccaacgtgcaggaggctaa

SEQ ID NO: 587470 - DNA, 25 bp, Mus musculus
ggaatcccactgattggagaccatt

SEQ ID NO: 587471 - DNA, 25 bp, Mus musculus
ggaatcccactgtttggagaccatt

SEQ ID NO: 587472 - DNA, 25 bp, Mus musculus
ggaatcccagacaacagaactcttt

SEQ ID NO: 587473 - DNA, 25 bp, Mus musculus
ggaatcccagactacagaactcttt

SEQ ID NO: 587474 - DNA, 25 bp, Mus musculus
ggaatcccagagctcagttttgtaa

SEQ ID NO: 587475 - DNA, 25 bp, Mus musculus
ggaatcccagagctctactttctag

SEQ ID NO: 587476 - DNA, 25 bp, Mus musculus
ggaatcccagaggtcagttttgtaa

SEQ ID NO: 587477 - DNA, 25 bp, Mus musculus
ggaatcccagaggtctactttctag

SEQ ID NO: 587478 - DNA, 25 bp, Mus musculus
ggaatcccagatactaacaatttta

SEQ ID NO: 587479 - DNA, 25 bp, Mus musculus
ggaatcccagattctaacaatttta

SEQ ID NO: 587480 - DNA, 25 bp, Mus musculus
ggaatccccaaacagcagctatgta

SEQ ID NO: 587481 - DNA, 25 bp, Mus musculus
ggaatccccaaagagcagctatgta

SEQ ID NO: 587482 - DNA, 25 bp, Mus musculus
ggaatccccaagaccataggaacag

SEQ ID NO: 587483 - DNA, 25 bp, Mus musculus
ggaatccccaagtccataggaacag

SEQ ID NO: 587484 - DNA, 25 bp, Mus musculus
ggaatccccagaactggacctcagt

SEQ ID NO: 587485 - DNA, 25 bp, Mus musculus
ggaatccccagatctggacctcagt

SEQ ID NO: 587486 - DNA, 25 bp, Mus musculus
ggaatccccaggattgtgccgggac

SEQ ID NO: 587487 - DNA, 25 bp, Mus musculus
ggaatccccaggtttgtgccgggac

SEQ ID NO: 587488 - DNA, 25 bp, Mus musculus
ggaatcccctgacagctctcaagaa

SEQ ID NO: 587489 - DNA, 25 bp, Mus musculus
ggaatcccctgagagctctcaagaa

SEQ ID NO: 587490 - DNA, 25 bp, Mus musculus
ggaatcccgcaaagtcactatggaa

SEQ ID NO: 587491 - DNA, 25 bp, Mus musculus
ggaatcccgcaatgtcactatggaa

SEQ ID NO: 587492 - DNA, 25 bp, Mus musculus
ggaatcccggatccggcattttgtg

SEQ ID NO: 587493 - DNA, 25 bp, Mus musculus
ggaatcccggatgcggcattttgtg

SEQ ID NO: 587494 - DNA, 25 bp, Mus musculus
ggaatccctattataagtaatccag

SEQ ID NO: 587495 - DNA, 25 bp, Mus musculus
ggaatccctattttaagtaatccag

SEQ ID NO: 587496 - DNA, 25 bp, Mus musculus
ggaatccctcagcagccgataagca

SEQ ID NO: 587497 - DNA, 25 bp, Mus musculus
ggaatccctcaggagccgataagca

SEQ ID NO: 587498 - DNA, 25 bp, Mus musculus
ggaatccctctgagtgcatgaactt

SEQ ID NO: 587499 - DNA, 25 bp, Mus musculus
ggaatccctctgtgtgcatgaactt

SEQ ID NO: 587500 - DNA, 25 bp, Mus musculus
ggaatccctgagaatcactggtgct

SEQ ID NO: 587501 - DNA, 25 bp, Mus musculus
ggaatccctgagtatcactggtgct

SEQ ID NO: 587502 - DNA, 25 bp, Mus musculus
ggaatccctggaattgatgcaaatt

SEQ ID NO: 587503 - DNA, 25 bp, Mus musculus
ggaatccctggatttgatgcaaatt

SEQ ID NO: 587504 - DNA, 25 bp, Mus musculus
ggaatccctgttcctacattgacta

SEQ ID NO: 587505 - DNA, 25 bp, Mus musculus
ggaatccctgttcgtgtatcaccag

SEQ ID NO: 587506 - DNA, 25 bp, Mus musculus
ggaatccctgttgctacattgacta

SEQ ID NO: 587507 - DNA, 25 bp, Mus musculus
ggaatccctgttggtgtatcaccag

SEQ ID NO: 587508 - DNA, 25 bp, Mus musculus
ggaatccgaatcatgaactgcctat

SEQ ID NO: 587509 - DNA, 25 bp, Mus musculus
ggaatccgaatcttgaactgcctat

SEQ ID NO: 587510 - DNA, 25 bp, Mus musculus
ggaatccgccaacacactgatgccg

SEQ ID NO: 587511 - DNA, 25 bp, Mus musculus
ggaatccgccaagacactgatgccg

SEQ ID NO: 587512 - DNA, 25 bp, Mus musculus
ggaatcctaccaagctgaacgtcgg

SEQ ID NO: 587513 - DNA, 25 bp, Mus musculus
ggaatcctaccatgctgaacgtcgg

SEQ ID NO: 587514 - DNA, 25 bp, Mus musculus
ggaatcctagatactgggccgggcc

SEQ ID NO: 587515 - DNA, 25 bp, Mus musculus
ggaatcctagatatttatgttgaaa

SEQ ID NO: 587516 - DNA, 25 bp, Mus musculus
ggaatcctagattctgggccgggcc

SEQ ID NO: 587517 - DNA, 25 bp, Mus musculus
ggaatcctagatttttatgttgaaa

SEQ ID NO: 587518 - DNA, 25 bp, Mus musculus
ggaatcctagctctcgagatgctgt

SEQ ID NO: 587519 - DNA, 25 bp, Mus musculus
ggaatcctagctgtcgagatgctgt

SEQ ID NO: 587520 - DNA, 25 bp, Mus musculus
ggaatcctatgacagactctacctt

SEQ ID NO: 587521 - DNA, 25 bp, Mus musculus
ggaatcctatgagagactctacctt

SEQ ID NO: 587522 - DNA, 25 bp, Mus musculus
ggaatcctatgccttatgtaattgc

SEQ ID NO: 587523 - DNA, 25 bp, Mus musculus
ggaatcctatgcgttatgtaattgc

SEQ ID NO: 587524 - DNA, 25 bp, Mus musculus
ggaatcctcaaaccacacagtacag

SEQ ID NO: 587525 - DNA, 25 bp, Mus musculus
ggaatcctcaaagcacacagtacag

SEQ ID NO: 587526 - DNA, 25 bp, Mus musculus
ggaatcctcagaatcctaagcaaag

SEQ ID NO: 587527 - DNA, 25 bp, Mus musculus
ggaatcctcagattcctaagcaaag

SEQ ID NO: 587528 - DNA, 25 bp, Mus musculus
ggaatcctcctgctgtgcaaccaca

SEQ ID NO: 587529 - DNA, 25 bp, Mus musculus
ggaatcctcctgcttaagagtaatc

SEQ ID NO: 587530 - DNA, 25 bp, Mus musculus
ggaatcctcctggtgtgcaaccaca

SEQ ID NO: 587531 - DNA, 25 bp, Mus musculus
ggaatcctcctggttaagagtaatc

SEQ ID NO: 587532 - DNA, 25 bp, Mus musculus
ggaatcctcgtaatcagaaggccaa

SEQ ID NO: 587533 - DNA, 25 bp, Mus musculus
ggaatcctcgtattcagaaggccaa

SEQ ID NO: 587534 - DNA, 25 bp, Mus musculus
ggaatcctcgtgagtcactgcagat

SEQ ID NO: 587535 - DNA, 25 bp, Mus musculus
ggaatcctcgtgtgtcactgcagat

SEQ ID NO: 587536 - DNA, 25 bp, Mus musculus
ggaatcctcttaatttgtcacctgt

SEQ ID NO: 587537 - DNA, 25 bp, Mus musculus
ggaatcctcttattttgtcacctgt

SEQ ID NO: 587538 - DNA, 25 bp, Mus musculus
ggaatcctcttcaggccaaatgtgt

SEQ ID NO: 587539 - DNA, 25 bp, Mus musculus
ggaatcctcttctggccaaatgtgt

SEQ ID NO: 587540 - DNA, 25 bp, Mus musculus
ggaatcctgaagagatcactgaatc

SEQ ID NO: 587541 - DNA, 25 bp, Mus musculus
ggaatcctgaagtgatcactgaatc

SEQ ID NO: 587542 - DNA, 25 bp, Mus musculus
ggaatcctggccagggactagactg

SEQ ID NO: 587543 - DNA, 25 bp, Mus musculus
ggaatcctggcctgggactagactg

SEQ ID NO: 587544 - DNA, 25 bp, Mus musculus
ggaatcctgggacctttcgtcttgc

SEQ ID NO: 587545 - DNA, 25 bp, Mus musculus
ggaatcctgggagctttcgtcttgc

SEQ ID NO: 587546 - DNA, 25 bp, Mus musculus
ggaatcctgggcaacgggcatcatc

SEQ ID NO: 587547 - DNA, 25 bp, Mus musculus
ggaatcctgggctacgggcatcatc

SEQ ID NO: 587548 - DNA, 25 bp, Mus musculus
ggaatcctggttaacaccccgacag

SEQ ID NO: 587549 - DNA, 25 bp, Mus musculus
ggaatcctggtttacaccccgacag

SEQ ID NO: 587550 - DNA, 25 bp, Mus musculus
ggaatcctgtccaaagcctgtgatt

SEQ ID NO: 587551 - DNA, 25 bp, Mus musculus
ggaatcctgtcctaagcctgtgatt

SEQ ID NO: 587552 - DNA, 25 bp, Mus musculus
ggaatcctgtctccatggaaaccaa

SEQ ID NO: 587553 - DNA, 25 bp, Mus musculus
ggaatcctgtctgcatggaaaccaa

SEQ ID NO: 587554 - DNA, 25 bp, Mus musculus
ggaatcctgtggcatccatgaaact

SEQ ID NO: 587555 - DNA, 25 bp, Mus musculus
ggaatcctgtgggatccatgaaact

SEQ ID NO: 587556 - DNA, 25 bp, Mus musculus
ggaatcctgtttacactgtctaaat

SEQ ID NO: 587557 - DNA, 25 bp, Mus musculus
ggaatcctgttttcactgtctaaat

SEQ ID NO: 587558 - DNA, 25 bp, Mus musculus
ggaatccttacaactatggctgctt

SEQ ID NO: 587559 - DNA, 25 bp, Mus musculus
ggaatccttacatctatggctgctt

SEQ ID NO: 587560 - DNA, 25 bp, Mus musculus
ggaatccttcacagatgaacctggg

SEQ ID NO: 587561 - DNA, 25 bp, Mus musculus
ggaatccttcactgatgaacctggg

SEQ ID NO: 587562 - DNA, 25 bp, Mus musculus
ggaatccttcagaattggcttaaaa

SEQ ID NO: 587563 - DNA, 25 bp, Mus musculus
ggaatccttcagtattggcttaaaa

SEQ ID NO: 587564 - DNA, 25 bp, Mus musculus
ggaatccttggtctaactgatttct

SEQ ID NO: 587565 - DNA, 25 bp, Mus musculus
ggaatccttggtgtaactgatttct

SEQ ID NO: 587566 - DNA, 25 bp, Mus musculus
ggaatccttgtcattctaagggtga

SEQ ID NO: 587567 - DNA, 25 bp, Mus musculus
ggaatccttgtctttctaagggtga

SEQ ID NO: 587568 - DNA, 25 bp, Mus musculus
ggaatcctttggatattcatacgga

SEQ ID NO: 587569 - DNA, 25 bp, Mus musculus
ggaatcctttggttattcatacgga

SEQ ID NO: 587570 - DNA, 25 bp, Mus musculus
ggaatccttttgctgttggctatga

SEQ ID NO: 587571 - DNA, 25 bp, Mus musculus
ggaatccttttggtgttggctatga

SEQ ID NO: 587572 - DNA, 25 bp, Mus musculus
ggaatcgaacaaccctctgtgaata

SEQ ID NO: 587573 - DNA, 25 bp, Mus musculus
ggaatcgaacaagcctctgtgaata

SEQ ID NO: 587574 - DNA, 25 bp, Mus musculus
ggaatcgaactcagatcatcagtca

SEQ ID NO: 587575 - DNA, 25 bp, Mus musculus
ggaatcgaactctgatcatcagtca

SEQ ID NO: 587576 - DNA, 25 bp, Mus musculus
ggaatcgacatcaactagggatcat

SEQ ID NO: 587577 - DNA, 25 bp, Mus musculus
ggaatcgacatctactagggatcat

SEQ ID NO: 587578 - DNA, 25 bp, Mus musculus
ggaatcgataagatacagtgtttta

SEQ ID NO: 587579 - DNA, 25 bp, Mus musculus
ggaatcgataagttacagtgtttta

SEQ ID NO: 587580 - DNA, 25 bp, Mus musculus
ggaatcgatgcactcttatagtatt

SEQ ID NO: 587581 - DNA, 25 bp, Mus musculus
ggaatcgatgcagtcttatagtatt

SEQ ID NO: 587582 - DNA, 25 bp, Mus musculus
ggaatcgcccacaaagaactttact

SEQ ID NO: 587583 - DNA, 25 bp, Mus musculus
ggaatcgcccactaagaactttact

SEQ ID NO: 587584 - DNA, 25 bp, Mus musculus
ggaatcgcccttactttgttaatag

SEQ ID NO: 587585 - DNA, 25 bp, Mus musculus
ggaatcgccctttctttgttaatag

SEQ ID NO: 587586 - DNA, 25 bp, Mus musculus
ggaatcgctaacactgaagctggaa

SEQ ID NO: 587587 - DNA, 25 bp, Mus musculus
ggaatcgctaactctgaagctggaa

SEQ ID NO: 587588 - DNA, 25 bp, Mus musculus
ggaatcgctgtactaactgcttcac

SEQ ID NO: 587589 - DNA, 25 bp, Mus musculus
ggaatcgctgtagtaactgcttcac

SEQ ID NO: 587590 - DNA, 25 bp, Mus musculus
ggaatcggaggacgtcagaccttca

SEQ ID NO: 587591 - DNA, 25 bp, Mus musculus
ggaatcggaggaggtcagaccttca

SEQ ID NO: 587592 - DNA, 25 bp, Mus musculus
ggaatcggcaagagtgtagcactag

SEQ ID NO: 587593 - DNA, 25 bp, Mus musculus
ggaatcggcaagtgtgtagcactag

SEQ ID NO: 587594 - DNA, 25 bp, Mus musculus
ggaatcggtgcacggcatcaccatc

SEQ ID NO: 587595 - DNA, 25 bp, Mus musculus
ggaatcggtgcagggcatcaccatc

SEQ ID NO: 587596 - DNA, 25 bp, Mus musculus
ggaatcgtcccaaaatgtctcttgc

SEQ ID NO: 587597 - DNA, 25 bp, Mus musculus
ggaatcgtcccataatgtctcttgc

SEQ ID NO: 587598 - DNA, 25 bp, Mus musculus
ggaatcgtgaccaaagccgacctac

SEQ ID NO: 587599 - DNA, 25 bp, Mus musculus
ggaatcgtgacctaagccgacctac

SEQ ID NO: 587600 - DNA, 25 bp, Mus musculus
ggaatcgtgactctggaagccatat

SEQ ID NO: 587601 - DNA, 25 bp, Mus musculus
ggaatcgtgactgtggaagccatat

SEQ ID NO: 587602 - DNA, 25 bp, Mus musculus
ggaatcgtggctatttattatgaac

SEQ ID NO: 587603 - DNA, 25 bp, Mus musculus
ggaatcgtggctttttattatgaac

SEQ ID NO: 587604 - DNA, 25 bp, Mus musculus
ggaatcgtgggaactgcttactgtg

SEQ ID NO: 587605 - DNA, 25 bp, Mus musculus
ggaatcgtgggatctgcttactgtg

SEQ ID NO: 587606 - DNA, 25 bp, Mus musculus
ggaatcgtttcaaagacagtgtttt

SEQ ID NO: 587607 - DNA, 25 bp, Mus musculus
ggaatcgtttcatagacagtgtttt

SEQ ID NO: 587608 - DNA, 25 bp, Mus musculus
ggaatcgtttttaaagccactgaca

SEQ ID NO: 587609 - DNA, 25 bp, Mus musculus
ggaatcgttttttaagccactgaca

SEQ ID NO: 587610 - DNA, 25 bp, Mus musculus
ggaatctaaaaaccctccacaaggt

SEQ ID NO: 587611 - DNA, 25 bp, Mus musculus
ggaatctaaaaagcctccacaaggt

SEQ ID NO: 587612 - DNA, 25 bp, Mus musculus
ggaatctaatgtctgctggctgctt

SEQ ID NO: 587613 - DNA, 25 bp, Mus musculus
ggaatctaatgtcttcaactgtttg

SEQ ID NO: 587614 - DNA, 25 bp, Mus musculus
ggaatctaatgtgtgctggctgctt

SEQ ID NO: 587615 - DNA, 25 bp, Mus musculus
ggaatctaatgtgttcaactgtttg

SEQ ID NO: 587616 - DNA, 25 bp, Mus musculus
ggaatctaattcaataccaaagtca

SEQ ID NO: 587617 - DNA, 25 bp, Mus musculus
ggaatctaattctataccaaagtca

SEQ ID NO: 587618 - DNA, 25 bp, Mus musculus
ggaatctaccctcattcgtgagtgg

SEQ ID NO: 587619 - DNA, 25 bp, Mus musculus
ggaatctaccctgattcgtgagtgg

SEQ ID NO: 587620 - DNA, 25 bp, Mus musculus
ggaatctaccttccattaacttcta

SEQ ID NO: 587621 - DNA, 25 bp, Mus musculus
ggaatctaccttgcattaacttcta

SEQ ID NO: 587622 - DNA, 25 bp, Mus musculus
ggaatctagccacatagcaaggcat

SEQ ID NO: 587623 - DNA, 25 bp, Mus musculus
ggaatctagccagatagcaaggcat

SEQ ID NO: 587624 - DNA, 25 bp, Mus musculus
ggaatctagcggacctcaacacggt

SEQ ID NO: 587625 - DNA, 25 bp, Mus musculus
ggaatctagcggtcctcaacacggt

SEQ ID NO: 587626 - DNA, 25 bp, Mus musculus
ggaatctataatcttaaccactgaa

SEQ ID NO: 587627 - DNA, 25 bp, Mus musculus
ggaatctataatgttaaccactgaa

SEQ ID NO: 587628 - DNA, 25 bp, Mus musculus
ggaatctatcccaaagtcactaacg

SEQ ID NO: 587629 - DNA, 25 bp, Mus musculus
ggaatctatccctaagtcactaacg

SEQ ID NO: 587630 - DNA, 25 bp, Mus musculus
ggaatctatggtcgatggctcccag

SEQ ID NO: 587631 - DNA, 25 bp, Mus musculus
ggaatctatggtggatggctcccag

SEQ ID NO: 587632 - DNA, 25 bp, Mus musculus
ggaatctcaactcccatggcatttc

SEQ ID NO: 587633 - DNA, 25 bp, Mus musculus
ggaatctcaactgccatggcatttc

SEQ ID NO: 587634 - DNA, 25 bp, Mus musculus
ggaatctcaagcaacattctctatg

SEQ ID NO: 587635 - DNA, 25 bp, Mus musculus
ggaatctcaagctacattctctatg

SEQ ID NO: 587636 - DNA, 25 bp, Mus musculus
ggaatctcaatgacacttaccaaaa

SEQ ID NO: 587637 - DNA, 25 bp, Mus musculus
ggaatctcaatgtcacttaccaaaa

SEQ ID NO: 587638 - DNA, 25 bp, Mus musculus
ggaatctcagacatcgcctgtcgaa

SEQ ID NO: 587639 - DNA, 25 bp, Mus musculus
ggaatctcagacttcgcctgtcgaa

SEQ ID NO: 587640 - DNA, 25 bp, Mus musculus
ggaatctcagagacctttgatggag

SEQ ID NO: 587641 - DNA, 25 bp, Mus musculus
ggaatctcagagtcctttgatggag

SEQ ID NO: 587642 - DNA, 25 bp, Mus musculus
ggaatctcagatcatggcccatggt

SEQ ID NO: 587643 - DNA, 25 bp, Mus musculus
ggaatctcagatgatggcccatggt

SEQ ID NO: 587644 - DNA, 25 bp, Mus musculus
ggaatctcatgccagccagatgtac

SEQ ID NO: 587645 - DNA, 25 bp, Mus musculus
ggaatctcatgcgagccagatgtac

SEQ ID NO: 587646 - DNA, 25 bp, Mus musculus
ggaatctcattcacgttatatcatc

SEQ ID NO: 587647 - DNA, 25 bp, Mus musculus
ggaatctcattctcgttatatcatc

SEQ ID NO: 587648 - DNA, 25 bp, Mus musculus
ggaatctcattgagcagccctgaca

SEQ ID NO: 587649 - DNA, 25 bp, Mus musculus
ggaatctcattgtgcagccctgaca

SEQ ID NO: 587650 - DNA, 25 bp, Mus musculus
ggaatctccatcagcaaggtctgcg

SEQ ID NO: 587651 - DNA, 25 bp, Mus musculus
ggaatctccatctgcaaggtctgcg

SEQ ID NO: 587652 - DNA, 25 bp, Mus musculus
ggaatctccccacatgagtgtttgt

SEQ ID NO: 587653 - DNA, 25 bp, Mus musculus
ggaatctccccagatgagtgtttgt

SEQ ID NO: 587654 - DNA, 25 bp, Mus musculus
ggaatctccgatacaaaacaactga

SEQ ID NO: 587655 - DNA, 25 bp, Mus musculus
ggaatctccgattcaaaacaactga

SEQ ID NO: 587656 - DNA, 25 bp, Mus musculus
ggaatctcctacctgcttgagggat

SEQ ID NO: 587657 - DNA, 25 bp, Mus musculus
ggaatctcctacgtgcttgagggat

SEQ ID NO: 587658 - DNA, 25 bp, Mus musculus
ggaatctccttaagagcctacagta

SEQ ID NO: 587659 - DNA, 25 bp, Mus musculus
ggaatctccttatgagcctacagta

SEQ ID NO: 587660 - DNA, 25 bp, Mus musculus
ggaatctcgagcagttcttaggtga

SEQ ID NO: 587661 - DNA, 25 bp, Mus musculus
ggaatctcgagctgttcttaggtga

SEQ ID NO: 587662 - DNA, 25 bp, Mus musculus
ggaatctcgttcatccattcatgcg

SEQ ID NO: 587663 - DNA, 25 bp, Mus musculus
ggaatctcgttcttccattcatgcg

SEQ ID NO: 587664 - DNA, 25 bp, Mus musculus
ggaatctctaaaatgcccaggctgg

SEQ ID NO: 587665 - DNA, 25 bp, Mus musculus
ggaatctctaaattgcccaggctgg

SEQ ID NO: 587666 - DNA, 25 bp, Mus musculus
ggaatctctaagagtcccaatctgt

SEQ ID NO: 587667 - DNA, 25 bp, Mus musculus
ggaatctctaagtgtcccaatctgt

SEQ ID NO: 587668 - DNA, 25 bp, Mus musculus
ggaatctctcctctgcatggacaga

SEQ ID NO: 587669 - DNA, 25 bp, Mus musculus
ggaatctctcctgtgcatggacaga

SEQ ID NO: 587670 - DNA, 25 bp, Mus musculus
ggaatctcttacatagtcctgttgt

SEQ ID NO: 587671 - DNA, 25 bp, Mus musculus
ggaatctcttacttagtcctgttgt

SEQ ID NO: 587672 - DNA, 25 bp, Mus musculus
ggaatctcttggcacaatcttgcat

SEQ ID NO: 587673 - DNA, 25 bp, Mus musculus
ggaatctcttgggacaatcttgcat

SEQ ID NO: 587674 - DNA, 25 bp, Mus musculus
ggaatctgacagaacatctatatct

SEQ ID NO: 587675 - DNA, 25 bp, Mus musculus
ggaatctgacagtacatctatatct

SEQ ID NO: 587676 - DNA, 25 bp, Mus musculus
ggaatctgatgccttttaccactag

SEQ ID NO: 587677 - DNA, 25 bp, Mus musculus
ggaatctgatgcgttttaccactag

SEQ ID NO: 587678 - DNA, 25 bp, Mus musculus
ggaatctgctggcattcatgaaact

SEQ ID NO: 587679 - DNA, 25 bp, Mus musculus
ggaatctgctgggattcatgaaact

SEQ ID NO: 587680 - DNA, 25 bp, Mus musculus
ggaatctggaccaggcctagtgcag

SEQ ID NO: 587681 - DNA, 25 bp, Mus musculus
ggaatctggacctggcctagtgcag

SEQ ID NO: 587682 - DNA, 25 bp, Mus musculus
ggaatctggagaagtcagccctgcc

SEQ ID NO: 587683 - DNA, 25 bp, Mus musculus
ggaatctggagatgtcagccctgcc

SEQ ID NO: 587684 - DNA, 25 bp, Mus musculus
ggaatctggatcatattatcatact

SEQ ID NO: 587685 - DNA, 25 bp, Mus musculus
ggaatctggatcttattatcatact

SEQ ID NO: 587686 - DNA, 25 bp, Mus musculus
ggaatctggcagaaatggcaataaa

SEQ ID NO: 587687 - DNA, 25 bp, Mus musculus
ggaatctggcagtaatggcaataaa

SEQ ID NO: 587688 - DNA, 25 bp, Mus musculus
ggaatctggcatacagggcagcaat

SEQ ID NO: 587689 - DNA, 25 bp, Mus musculus
ggaatctggcattcagggcagcaat

SEQ ID NO: 587690 - DNA, 25 bp, Mus musculus
ggaatctggccaaagacctcaaaga

SEQ ID NO: 587691 - DNA, 25 bp, Mus musculus
ggaatctggccaccgggcttctaat

SEQ ID NO: 587692 - DNA, 25 bp, Mus musculus
ggaatctggccagcgggcttctaat

SEQ ID NO: 587693 - DNA, 25 bp, Mus musculus
ggaatctggccatagacctcaaaga

SEQ ID NO: 587694 - DNA, 25 bp, Mus musculus
ggaatctggcttatttgcccatatg

SEQ ID NO: 587695 - DNA, 25 bp, Mus musculus
ggaatctggcttttttgcccatatg

SEQ ID NO: 587696 - DNA, 25 bp, Mus musculus
ggaatctgggaacccctcatggagt

SEQ ID NO: 587697 - DNA, 25 bp, Mus musculus
ggaatctgggaagccctcatggagt

SEQ ID NO: 587698 - DNA, 25 bp, Mus musculus
ggaatctgtcctagtgaacgtcatc

SEQ ID NO: 587699 - DNA, 25 bp, Mus musculus
ggaatctgtccttgtgaacgtcatc

SEQ ID NO: 587700 - DNA, 25 bp, Mus musculus
ggaatctgtggcaacattttataaa

SEQ ID NO: 587701 - DNA, 25 bp, Mus musculus
ggaatctgtggctacattttataaa

SEQ ID NO: 587702 - DNA, 25 bp, Mus musculus
ggaatcttaaacaagtgtgcctgct

SEQ ID NO: 587703 - DNA, 25 bp, Mus musculus
ggaatcttaaactagtgtgcctgct

SEQ ID NO: 587704 - DNA, 25 bp, Mus musculus
ggaatcttaagactgtacgtttgga

SEQ ID NO: 587705 - DNA, 25 bp, Mus musculus
ggaatcttaagagtgtacgtttgga

SEQ ID NO: 587706 - DNA, 25 bp, Mus musculus
ggaatcttaatcatgctggaggctg

SEQ ID NO: 587707 - DNA, 25 bp, Mus musculus
ggaatcttaatcttgctggaggctg

SEQ ID NO: 587708 - DNA, 25 bp, Mus musculus
ggaatcttaccacgacttgaggcta

SEQ ID NO: 587709 - DNA, 25 bp, Mus musculus
ggaatcttaccaggacttgaggcta

SEQ ID NO: 587710 - DNA, 25 bp, Mus musculus
ggaatcttatatagagcttgctctc

SEQ ID NO: 587711 - DNA, 25 bp, Mus musculus
ggaatcttatattgagcttgctctc

SEQ ID NO: 587712 - DNA, 25 bp, Mus musculus
ggaatcttcaaactccgatcgcggg

SEQ ID NO: 587713 - DNA, 25 bp, Mus musculus
ggaatcttcaaagtccgatcgcggg

SEQ ID NO: 587714 - DNA, 25 bp, Mus musculus
ggaatcttcaagctctgggcaaaat

SEQ ID NO: 587715 - DNA, 25 bp, Mus musculus
ggaatcttcaaggtctgggcaaaat

SEQ ID NO: 587716 - DNA, 25 bp, Mus musculus
ggaatcttcagtatggactacttag

SEQ ID NO: 587717 - DNA, 25 bp, Mus musculus
ggaatcttcagtttggactacttag

SEQ ID NO: 587718 - DNA, 25 bp, Mus musculus
ggaatcttcccgatttttctaagat

SEQ ID NO: 587719 - DNA, 25 bp, Mus musculus
ggaatcttcccgttttttctaagat

SEQ ID NO: 587720 - DNA, 25 bp, Mus musculus
ggaatcttcggtctttgccaccatg

SEQ ID NO: 587721 - DNA, 25 bp, Mus musculus
ggaatcttcggtgtttgccaccatg

SEQ ID NO: 587722 - DNA, 25 bp, Mus musculus
ggaatcttctcaccagcgacaactt

SEQ ID NO: 587723 - DNA, 25 bp, Mus musculus
ggaatcttctcagcagcgacaactt

SEQ ID NO: 587724 - DNA, 25 bp, Mus musculus
ggaatcttctctattgtcttctaag

SEQ ID NO: 587725 - DNA, 25 bp, Mus musculus
ggaatcttctcttttgtcttctaag

SEQ ID NO: 587726 - DNA, 25 bp, Mus musculus
ggaatcttctgtcgtaggtccttat

SEQ ID NO: 587727 - DNA, 25 bp, Mus musculus
ggaatcttctgtggtaggtccttat

SEQ ID NO: 587728 - DNA, 25 bp, Mus musculus
ggaatcttgccccttcaagtgaatc

SEQ ID NO: 587729 - DNA, 25 bp, Mus musculus
ggaatcttgcccgttcaagtgaatc

SEQ ID NO: 587730 - DNA, 25 bp, Mus musculus
ggaatcttggacaaatcagctcatt

SEQ ID NO: 587731 - DNA, 25 bp, Mus musculus
ggaatcttggactaatcagctcatt

SEQ ID NO: 587732 - DNA, 25 bp, Mus musculus
ggaatcttggtgacagagctccttt

SEQ ID NO: 587733 - DNA, 25 bp, Mus musculus
ggaatcttggtgtcagagctccttt

SEQ ID NO: 587734 - DNA, 25 bp, Mus musculus
ggaatcttgtcactgtgaccacaca

SEQ ID NO: 587735 - DNA, 25 bp, Mus musculus
ggaatcttgtcagtgtgaccacaca

SEQ ID NO: 587736 - DNA, 25 bp, Mus musculus
ggaatcttgttcatgcacaactgta

SEQ ID NO: 587737 - DNA, 25 bp, Mus musculus
ggaatcttgttcttgcacaactgta

SEQ ID NO: 587738 - DNA, 25 bp, Mus musculus
ggaatctttagaccggtggcacact

SEQ ID NO: 587739 - DNA, 25 bp, Mus musculus
ggaatctttagagcggtggcacact

SEQ ID NO: 587740 - DNA, 25 bp, Mus musculus
ggaatctttcacatgcttcagaggc

SEQ ID NO: 587741 - DNA, 25 bp, Mus musculus
ggaatctttcacttgcttcagaggc

SEQ ID NO: 587742 - DNA, 25 bp, Mus musculus
ggaatctttccaatggtccaattct

SEQ ID NO: 587743 - DNA, 25 bp, Mus musculus
ggaatctttccattggtccaattct

SEQ ID NO: 587744 - DNA, 25 bp, Mus musculus
ggaatctttcccatatcgtaccaaa

SEQ ID NO: 587745 - DNA, 25 bp, Mus musculus
ggaatctttcccttatcgtaccaaa

SEQ ID NO: 587746 - DNA, 25 bp, Mus musculus
ggaatctttcctagtagcactatta

SEQ ID NO: 587747 - DNA, 25 bp, Mus musculus
ggaatctttccttgtagcactatta

SEQ ID NO: 587748 - DNA, 25 bp, Mus musculus
ggaatctttctgaagctttgtgttt

SEQ ID NO: 587749 - DNA, 25 bp, Mus musculus
ggaatctttctgtagctttgtgttt

SEQ ID NO: 587750 - DNA, 25 bp, Mus musculus
ggaatctttgataatttcctttctg

SEQ ID NO: 587751 - DNA, 25 bp, Mus musculus
ggaatctttgattatttcctttctg

SEQ ID NO: 587752 - DNA, 25 bp, Mus musculus
ggaatctttgcccaagtccagctgt

SEQ ID NO: 587753 - DNA, 25 bp, Mus musculus
ggaatctttgccgaagtccagctgt

SEQ ID NO: 587754 - DNA, 25 bp, Mus musculus
ggaatctttgggaagaactgctgaa

SEQ ID NO: 587755 - DNA, 25 bp, Mus musculus
ggaatctttgggtagaactgctgaa

SEQ ID NO: 587756 - DNA, 25 bp, Mus musculus
ggaatcttttcaatgctcacacaca

SEQ ID NO: 587757 - DNA, 25 bp, Mus musculus
ggaatcttttcattgctcacacaca

SEQ ID NO: 587758 - DNA, 25 bp, Mus musculus
ggaatctttttgacggcttctagaa

SEQ ID NO: 587759 - DNA, 25 bp, Mus musculus
ggaatctttttgtcggcttctagaa

SEQ ID NO: 587760 - DNA, 25 bp, Mus musculus
ggaatgaaactccagcccagctgct

SEQ ID NO: 587761 - DNA, 25 bp, Mus musculus
ggaatgaaactcgagcccagctgct

SEQ ID NO: 587762 - DNA, 25 bp, Mus musculus
ggaatgaaaggcctgcaccatagac

SEQ ID NO: 587763 - DNA, 25 bp, Mus musculus
ggaatgaaaggcgtgcaccatagac

SEQ ID NO: 587764 - DNA, 25 bp, Mus musculus
ggaatgaaccatctatcaacttcta

SEQ ID NO: 587765 - DNA, 25 bp, Mus musculus
ggaatgaaccatgtatcaacttcta

SEQ ID NO: 587766 - DNA, 25 bp, Mus musculus
ggaatgaacccaaactcagaacaat

SEQ ID NO: 587767 - DNA, 25 bp, Mus musculus
ggaatgaacccatactcagaacaat

SEQ ID NO: 587768 - DNA, 25 bp, Mus musculus
ggaatgaaccttcgtctcaggctcc

SEQ ID NO: 587769 - DNA, 25 bp, Mus musculus
ggaatgaaccttggtctcaggctcc

SEQ ID NO: 587770 - DNA, 25 bp, Mus musculus
ggaatgaactcacgcattccacata

SEQ ID NO: 587771 - DNA, 25 bp, Mus musculus
ggaatgaactcaggcattccacata

SEQ ID NO: 587772 - DNA, 25 bp, Mus musculus
ggaatgaactttctcatagcccttt

SEQ ID NO: 587773 - DNA, 25 bp, Mus musculus
ggaatgaactttgtcatagcccttt

SEQ ID NO: 587774 - DNA, 25 bp, Mus musculus
ggaatgaagaagctctactgcaagc

SEQ ID NO: 587775 - DNA, 25 bp, Mus musculus
ggaatgaagaaggtctactgcaagc

SEQ ID NO: 587776 - DNA, 25 bp, Mus musculus
ggaatgaagtccatgcaagcacaga

SEQ ID NO: 587777 - DNA, 25 bp, Mus musculus
ggaatgaagtccttgcaagcacaga

SEQ ID NO: 587778 - DNA, 25 bp, Mus musculus
ggaatgaatgcgctgacctcacaca

SEQ ID NO: 587779 - DNA, 25 bp, Mus musculus
ggaatgaatgcggtgacctcacaca

SEQ ID NO: 587780 - DNA, 25 bp, Mus musculus
ggaatgaatggcaccgtccatagct

SEQ ID NO: 587781 - DNA, 25 bp, Mus musculus
ggaatgaatggctccgtccatagct

SEQ ID NO: 587782 - DNA, 25 bp, Mus musculus
ggaatgaatgttcacctgacagggt

SEQ ID NO: 587783 - DNA, 25 bp, Mus musculus
ggaatgaatgttgacctgacagggt

SEQ ID NO: 587784 - DNA, 25 bp, Mus musculus
ggaatgacaaaccagcaagcgcgag

SEQ ID NO: 587785 - DNA, 25 bp, Mus musculus
ggaatgacaaacgagcaagcgcgag

SEQ ID NO: 587786 - DNA, 25 bp, Mus musculus
ggaatgacaactatcccacttctag

SEQ ID NO: 587787 - DNA, 25 bp, Mus musculus
ggaatgacaactttcccacttctag

SEQ ID NO: 587788 - DNA, 25 bp, Mus musculus
ggaatgacacccaaggttgacttct

SEQ ID NO: 587789 - DNA, 25 bp, Mus musculus
ggaatgacaccctaggttgacttct

SEQ ID NO: 587790 - DNA, 25 bp, Mus musculus
ggaatgacacctcgaaactcccaat

SEQ ID NO: 587791 - DNA, 25 bp, Mus musculus
ggaatgacacctggaaactcccaat

SEQ ID NO: 587792 - DNA, 25 bp, Mus musculus
ggaatgacagcccttgtactgcaaa

SEQ ID NO: 587793 - DNA, 25 bp, Mus musculus
ggaatgacagccgttgtactgcaaa

SEQ ID NO: 587794 - DNA, 25 bp, Mus musculus
ggaatgacatccatggttcacaagg

SEQ ID NO: 587795 - DNA, 25 bp, Mus musculus
ggaatgacatccttggttcacaagg

SEQ ID NO: 587796 - DNA, 25 bp, Mus musculus
ggaatgacatctaccatcttccgga

SEQ ID NO: 587797 - DNA, 25 bp, Mus musculus
ggaatgacatcttccatcttccgga

SEQ ID NO: 587798 - DNA, 25 bp, Mus musculus
ggaatgaccaaaactgacctttaag

SEQ ID NO: 587799 - DNA, 25 bp, Mus musculus
ggaatgaccaaatctgacctttaag

SEQ ID NO: 587800 - DNA, 25 bp, Mus musculus
ggaatgaccacgcagctcagaacct

SEQ ID NO: 587801 - DNA, 25 bp, Mus musculus
ggaatgaccacggagctcagaacct

SEQ ID NO: 587802 - DNA, 25 bp, Mus musculus
ggaatgaccatgctttcaactacag

SEQ ID NO: 587803 - DNA, 25 bp, Mus musculus
ggaatgaccatggtttcaactacag

SEQ ID NO: 587804 - DNA, 25 bp, Mus musculus
ggaatgaccgcaaacagagttctca

SEQ ID NO: 587805 - DNA, 25 bp, Mus musculus
ggaatgaccgcatacagagttctca

SEQ ID NO: 587806 - DNA, 25 bp, Mus musculus
ggaatgacgtttccactcattgtcc

SEQ ID NO: 587807 - DNA, 25 bp, Mus musculus
ggaatgacgtttgcactcattgtcc

SEQ ID NO: 587808 - DNA, 25 bp, Mus musculus
ggaatgacttatcctgttcagttgt

SEQ ID NO: 587809 - DNA, 25 bp, Mus musculus
ggaatgacttatgctgttcagttgt

SEQ ID NO: 587810 - DNA, 25 bp, Mus musculus
ggaatgactttccttgtcactttga

SEQ ID NO: 587811 - DNA, 25 bp, Mus musculus
ggaatgactttcgttgtcactttga

SEQ ID NO: 587812 - DNA, 25 bp, Mus musculus
ggaatgagacctaccacgccaggtt

SEQ ID NO: 587813 - DNA, 25 bp, Mus musculus
ggaatgagacctccgcagagaagaa

SEQ ID NO: 587814 - DNA, 25 bp, Mus musculus
ggaatgagacctgcgcagagaagaa

SEQ ID NO: 587815 - DNA, 25 bp, Mus musculus
ggaatgagaccttccacgccaggtt

SEQ ID NO: 587816 - DNA, 25 bp, Mus musculus
ggaatgagactccttcattatgtat

SEQ ID NO: 587817 - DNA, 25 bp, Mus musculus
ggaatgagactcgttcattatgtat

SEQ ID NO: 587818 - DNA, 25 bp, Mus musculus
ggaatgagatctatgcgctgtaact

SEQ ID NO: 587819 - DNA, 25 bp, Mus musculus
ggaatgagatctttgcgctgtaact

SEQ ID NO: 587820 - DNA, 25 bp, Mus musculus
ggaatgagcagtctgcaagctgttc

SEQ ID NO: 587821 - DNA, 25 bp, Mus musculus
ggaatgagcagtgtgcaagctgttc

SEQ ID NO: 587822 - DNA, 25 bp, Mus musculus
ggaatgagcgccaagctgactccat

SEQ ID NO: 587823 - DNA, 25 bp, Mus musculus
ggaatgagcgcctagctgactccat

SEQ ID NO: 587824 - DNA, 25 bp, Mus musculus
ggaatgagcgttaaggctacatctt

SEQ ID NO: 587825 - DNA, 25 bp, Mus musculus
ggaatgagcgtttaggctacatctt

SEQ ID NO: 587826 - DNA, 25 bp, Mus musculus
ggaatgagctgcaacttcactacag

SEQ ID NO: 587827 - DNA, 25 bp, Mus musculus
ggaatgagctgctacttcactacag

SEQ ID NO: 587828 - DNA, 25 bp, Mus musculus
ggaatgagctgtcttggccccaact

SEQ ID NO: 587829 - DNA, 25 bp, Mus musculus
ggaatgagctgtgttggccccaact

SEQ ID NO: 587830 - DNA, 25 bp, Mus musculus
ggaatgagcttaaactgtgactgaa

SEQ ID NO: 587831 - DNA, 25 bp, Mus musculus
ggaatgagcttatactgtgactgaa

SEQ ID NO: 587832 - DNA, 25 bp, Mus musculus
ggaatgagtttcatgacttggttat

SEQ ID NO: 587833 - DNA, 25 bp, Mus musculus
ggaatgagtttcttgacttggttat

SEQ ID NO: 587834 - DNA, 25 bp, Mus musculus
ggaatgataattctagttggccatc

SEQ ID NO: 587835 - DNA, 25 bp, Mus musculus
ggaatgataattgtagttggccatc

SEQ ID NO: 587836 - DNA, 25 bp, Mus musculus
ggaatgatagcaacctgcctctatt

SEQ ID NO: 587837 - DNA, 25 bp, Mus musculus
ggaatgatagcacggtcctctcgtc

SEQ ID NO: 587838 - DNA, 25 bp, Mus musculus
ggaatgatagcagggtcctctcgtc

SEQ ID NO: 587839 - DNA, 25 bp, Mus musculus
ggaatgatagcatcctgcctctatt

SEQ ID NO: 587840 - DNA, 25 bp, Mus musculus
ggaatgatctacatagcagctctga

SEQ ID NO: 587841 - DNA, 25 bp, Mus musculus
ggaatgatctacttagcagctctga

SEQ ID NO: 587842 - DNA, 25 bp, Mus musculus
ggaatgatgcccctgggaccagctc

SEQ ID NO: 587843 - DNA, 25 bp, Mus musculus
ggaatgatgcccgtgggaccagctc

SEQ ID NO: 587844 - DNA, 25 bp, Mus musculus
ggaatgatgctgacgctgctgaact

SEQ ID NO: 587845 - DNA, 25 bp, Mus musculus
ggaatgatgctgtcgctgctgaact

SEQ ID NO: 587846 - DNA, 25 bp, Mus musculus
ggaatgattcaaagcctgggctttc

SEQ ID NO: 587847 - DNA, 25 bp, Mus musculus
ggaatgattcaatgcctgggctttc

SEQ ID NO: 587848 - DNA, 25 bp, Mus musculus
ggaatgattcttacaaaccataatt

SEQ ID NO: 587849 - DNA, 25 bp, Mus musculus
ggaatgattctttcaaaccataatt

SEQ ID NO: 587850 - DNA, 25 bp, Mus musculus
ggaatgattgcaccttcactgccac

SEQ ID NO: 587851 - DNA, 25 bp, Mus musculus
ggaatgattgcagcttcactgccac

SEQ ID NO: 587852 - DNA, 25 bp, Mus musculus
ggaatgattgccaatcccatcatgt

SEQ ID NO: 587853 - DNA, 25 bp, Mus musculus
ggaatgattgcctatcccatcatgt

SEQ ID NO: 587854 - DNA, 25 bp, Mus musculus
ggaatgcaaactcgtattttcttac

SEQ ID NO: 587855 - DNA, 25 bp, Mus musculus
ggaatgcaaactggtattttcttac

SEQ ID NO: 587856 - DNA, 25 bp, Mus musculus
ggaatgcaagccaggacctgcccta

SEQ ID NO: 587857 - DNA, 25 bp, Mus musculus
ggaatgcaagcctggacctgcccta

SEQ ID NO: 587858 - DNA, 25 bp, Mus musculus
ggaatgcaagctaagaatctctgga

SEQ ID NO: 587859 - DNA, 25 bp, Mus musculus
ggaatgcaagcttagaatctctgga

SEQ ID NO: 587860 - DNA, 25 bp, Mus musculus
ggaatgcacagccattatccctgtt

SEQ ID NO: 587861 - DNA, 25 bp, Mus musculus
ggaatgcacagcgattatccctgtt

SEQ ID NO: 587862 - DNA, 25 bp, Mus musculus
ggaatgcaccaacactttggcatga

SEQ ID NO: 587863 - DNA, 25 bp, Mus musculus
ggaatgcaccaagactttggcatga

SEQ ID NO: 587864 - DNA, 25 bp, Mus musculus
ggaatgcaccacaataatcagctta

SEQ ID NO: 587865 - DNA, 25 bp, Mus musculus
ggaatgcaccactataatcagctta

SEQ ID NO: 587866 - DNA, 25 bp, Mus musculus
ggaatgcaccagagagactccattt

SEQ ID NO: 587867 - DNA, 25 bp, Mus musculus
ggaatgcaccagtgagactccattt

SEQ ID NO: 587868 - DNA, 25 bp, Mus musculus
ggaatgcaccatagtaacaaagcct

SEQ ID NO: 587869 - DNA, 25 bp, Mus musculus
ggaatgcaccatcatgcttggtcat

SEQ ID NO: 587870 - DNA, 25 bp, Mus musculus
ggaatgcaccatgatgcttggtcat

SEQ ID NO: 587871 - DNA, 25 bp, Mus musculus
ggaatgcaccattgtaacaaagcct

SEQ ID NO: 587872 - DNA, 25 bp, Mus musculus
ggaatgcactgcctgtatcatcata

SEQ ID NO: 587873 - DNA, 25 bp, Mus musculus
ggaatgcactgcgtgtatcatcata

SEQ ID NO: 587874 - DNA, 25 bp, Mus musculus
ggaatgcactgtcggcctttcagaa

SEQ ID NO: 587875 - DNA, 25 bp, Mus musculus
ggaatgcactgtgggcctttcagaa

SEQ ID NO: 587876 - DNA, 25 bp, Mus musculus
ggaatgcagagtcacagttcaacct

SEQ ID NO: 587877 - DNA, 25 bp, Mus musculus
ggaatgcagagtgacagttcaacct

SEQ ID NO: 587878 - DNA, 25 bp, Mus musculus
ggaatgcagcacatagatgtttaaa

SEQ ID NO: 587879 - DNA, 25 bp, Mus musculus
ggaatgcagcacttagatgtttaaa

SEQ ID NO: 587880 - DNA, 25 bp, Mus musculus
ggaatgcagccgaggaacttacaag

SEQ ID NO: 587881 - DNA, 25 bp, Mus musculus
ggaatgcagccgtggaacttacaag

SEQ ID NO: 587882 - DNA, 25 bp, Mus musculus
ggaatgcaggccaagcgtcctctgt

SEQ ID NO: 587883 - DNA, 25 bp, Mus musculus
ggaatgcaggcctagcgtcctctgt

SEQ ID NO: 587884 - DNA, 25 bp, Mus musculus
ggaatgcatgctactaacctagtct

SEQ ID NO: 587885 - DNA, 25 bp, Mus musculus
ggaatgcatgcttctaacctagtct

SEQ ID NO: 587886 - DNA, 25 bp, Mus musculus
ggaatgcatttcctgggctccagaa

SEQ ID NO: 587887 - DNA, 25 bp, Mus musculus
ggaatgcatttcgtgggctccagaa

SEQ ID NO: 587888 - DNA, 25 bp, Mus musculus
ggaatgcatttgacctgcactctaa

SEQ ID NO: 587889 - DNA, 25 bp, Mus musculus
ggaatgcatttgtcctgcactctaa

SEQ ID NO: 587890 - DNA, 25 bp, Mus musculus
ggaatgccaagaatgtcccaagctg

SEQ ID NO: 587891 - DNA, 25 bp, Mus musculus
ggaatgccaagattgtcccaagctg

SEQ ID NO: 587892 - DNA, 25 bp, Mus musculus
ggaatgccaagcactaaatattttt

SEQ ID NO: 587893 - DNA, 25 bp, Mus musculus
ggaatgccaagcactcccggtaagt

SEQ ID NO: 587894 - DNA, 25 bp, Mus musculus
ggaatgccaagctctaaatattttt

SEQ ID NO: 587895 - DNA, 25 bp, Mus musculus
ggaatgccaagctctcccggtaagt

SEQ ID NO: 587896 - DNA, 25 bp, Mus musculus
ggaatgccacagaatccctgagggc

SEQ ID NO: 587897 - DNA, 25 bp, Mus musculus
ggaatgccacagtatccctgagggc

SEQ ID NO: 587898 - DNA, 25 bp, Mus musculus
ggaatgccacatatgctaaagcgac

SEQ ID NO: 587899 - DNA, 25 bp, Mus musculus
ggaatgccacatttgctaaagcgac

SEQ ID NO: 587900 - DNA, 25 bp, Mus musculus
ggaatgccatcactctttgaacact

SEQ ID NO: 587901 - DNA, 25 bp, Mus musculus
ggaatgccatcagtctttgaacact

SEQ ID NO: 587902 - DNA, 25 bp, Mus musculus
ggaatgccatgaatttcccctgcag

SEQ ID NO: 587903 - DNA, 25 bp, Mus musculus
ggaatgccatgattttcccctgcag

SEQ ID NO: 587904 - DNA, 25 bp, Mus musculus
ggaatgcccaccaggccgagtcttc

SEQ ID NO: 587905 - DNA, 25 bp, Mus musculus
ggaatgcccacctggccgagtcttc

SEQ ID NO: 587906 - DNA, 25 bp, Mus musculus
ggaatgccccagaaaatagctcttc

SEQ ID NO: 587907 - DNA, 25 bp, Mus musculus
ggaatgccccagtaaatagctcttc

SEQ ID NO: 587908 - DNA, 25 bp, Mus musculus
ggaatgcccttgactacacctcagt

SEQ ID NO: 587909 - DNA, 25 bp, Mus musculus
ggaatgcccttgtctacacctcagt

SEQ ID NO: 587910 - DNA, 25 bp, Mus musculus
ggaatgccgagaacgcctcctatac

SEQ ID NO: 587911 - DNA, 25 bp, Mus musculus
ggaatgccgagatcgcctcctatac

SEQ ID NO: 587912 - DNA, 25 bp, Mus musculus
ggaatgccgcaacctatgaacctta

SEQ ID NO: 587913 - DNA, 25 bp, Mus musculus
ggaatgccgcaagctatgaacctta

SEQ ID NO: 587914 - DNA, 25 bp, Mus musculus
ggaatgccgcttcaccatacattat

SEQ ID NO: 587915 - DNA, 25 bp, Mus musculus
ggaatgccgcttgaccatacattat

SEQ ID NO: 587916 - DNA, 25 bp, Mus musculus
ggaatgcctccaagtctatcaagtt

SEQ ID NO: 587917 - DNA, 25 bp, Mus musculus
ggaatgcctccatgtctatcaagtt

SEQ ID NO: 587918 - DNA, 25 bp, Mus musculus
ggaatgcctcgacaaacctaatcac

SEQ ID NO: 587919 - DNA, 25 bp, Mus musculus
ggaatgcctcgagaaacctaatcac

SEQ ID NO: 587920 - DNA, 25 bp, Mus musculus
ggaatgcctctccaggaccaagtaa

SEQ ID NO: 587921 - DNA, 25 bp, Mus musculus
ggaatgcctctcgaggaccaagtaa

SEQ ID NO: 587922 - DNA, 25 bp, Mus musculus
ggaatgcctggacttaagcttacag

SEQ ID NO: 587923 - DNA, 25 bp, Mus musculus
ggaatgcctggagttaagcttacag

SEQ ID NO: 587924 - DNA, 25 bp, Mus musculus
ggaatgccttccagaggttgatgaa

SEQ ID NO: 587925 - DNA, 25 bp, Mus musculus
ggaatgccttcctgaggttgatgaa

SEQ ID NO: 587926 - DNA, 25 bp, Mus musculus
ggaatgcgagaacgcctttactagc

SEQ ID NO: 587927 - DNA, 25 bp, Mus musculus
ggaatgcgagaaggcctttactagc

SEQ ID NO: 587928 - DNA, 25 bp, Mus musculus
ggaatgctacagacactaaagtgct

SEQ ID NO: 587929 - DNA, 25 bp, Mus musculus
ggaatgctacagtcactaaagtgct

SEQ ID NO: 587930 - DNA, 25 bp, Mus musculus
ggaatgctcccaattactattagct

SEQ ID NO: 587931 - DNA, 25 bp, Mus musculus
ggaatgctcccatttactattagct

SEQ ID NO: 587932 - DNA, 25 bp, Mus musculus
ggaatgctctatatgcccaaagttt

SEQ ID NO: 587933 - DNA, 25 bp, Mus musculus
ggaatgctctatttgcccaaagttt

SEQ ID NO: 587934 - DNA, 25 bp, Mus musculus
ggaatgctctgcacttccagtggac

SEQ ID NO: 587935 - DNA, 25 bp, Mus musculus
ggaatgctctgccttttaaaagtgt

SEQ ID NO: 587936 - DNA, 25 bp, Mus musculus
ggaatgctctgcgttttaaaagtgt

SEQ ID NO: 587937 - DNA, 25 bp, Mus musculus
ggaatgctctgctcttccagtggac

SEQ ID NO: 587938 - DNA, 25 bp, Mus musculus
ggaatgctgaccagggcagccttat

SEQ ID NO: 587939 - DNA, 25 bp, Mus musculus
ggaatgctgacctgggcagccttat

SEQ ID NO: 587940 - DNA, 25 bp, Mus musculus
ggaatgctgatgaccacagtctagg

SEQ ID NO: 587941 - DNA, 25 bp, Mus musculus
ggaatgctgatgtccacagtctagg

SEQ ID NO: 587942 - DNA, 25 bp, Mus musculus
ggaatgctgattatcttgacaactc

SEQ ID NO: 587943 - DNA, 25 bp, Mus musculus
ggaatgctgattcttcatgcatgtt

SEQ ID NO: 587944 - DNA, 25 bp, Mus musculus
ggaatgctgattgttcatgcatgtt

SEQ ID NO: 587945 - DNA, 25 bp, Mus musculus
ggaatgctgattttcttgacaactc

SEQ ID NO: 587946 - DNA, 25 bp, Mus musculus
ggaatgctgcctctatgtggatgtt

SEQ ID NO: 587947 - DNA, 25 bp, Mus musculus
ggaatgctgcctgtatgtggatgtt

SEQ ID NO: 587948 - DNA, 25 bp, Mus musculus
ggaatgcttagaatttatacttcaa

SEQ ID NO: 587949 - DNA, 25 bp, Mus musculus
ggaatgcttagattttatacttcaa

SEQ ID NO: 587950 - DNA, 25 bp, Mus musculus
ggaatgcttccaattgttctgccct

SEQ ID NO: 587951 - DNA, 25 bp, Mus musculus
ggaatgcttccatttgttctgccct

SEQ ID NO: 587952 - DNA, 25 bp, Mus musculus
ggaatgcttctcctgagggcactga

SEQ ID NO: 587953 - DNA, 25 bp, Mus musculus
ggaatgcttctcgtgagggcactga

SEQ ID NO: 587954 - DNA, 25 bp, Mus musculus
ggaatgctttatacagtctgatgca

SEQ ID NO: 587955 - DNA, 25 bp, Mus musculus
ggaatgctttatccgattatttcgc

SEQ ID NO: 587956 - DNA, 25 bp, Mus musculus
ggaatgctttatgcgattatttcgc

SEQ ID NO: 587957 - DNA, 25 bp, Mus musculus
ggaatgctttattcagtctgatgca

SEQ ID NO: 587958 - DNA, 25 bp, Mus musculus
ggaatggaaatgaccctctctgggc

SEQ ID NO: 587959 - DNA, 25 bp, Mus musculus
ggaatggaaatgtccctctctgggc

SEQ ID NO: 587960 - DNA, 25 bp, Mus musculus
ggaatggaaccgatgctaaaagcta

SEQ ID NO: 587961 - DNA, 25 bp, Mus musculus
ggaatggaaccgttgctaaaagcta

SEQ ID NO: 587962 - DNA, 25 bp, Mus musculus
ggaatggaactacgttaggcctcaa

SEQ ID NO: 587963 - DNA, 25 bp, Mus musculus
ggaatggaactaggttaggcctcaa

SEQ ID NO: 587964 - DNA, 25 bp, Mus musculus
ggaatggaagctcctttgaggcaaa

SEQ ID NO: 587965 - DNA, 25 bp, Mus musculus
ggaatggaagctgctttgaggcaaa

SEQ ID NO: 587966 - DNA, 25 bp, Mus musculus
ggaatggaatcaaagcaagggctat

SEQ ID NO: 587967 - DNA, 25 bp, Mus musculus
ggaatggaatcatagcaagggctat

SEQ ID NO: 587968 - DNA, 25 bp, Mus musculus
ggaatggacctgctggattttaaaa

SEQ ID NO: 587969 - DNA, 25 bp, Mus musculus
ggaatggacctggtggattttaaaa

SEQ ID NO: 587970 - DNA, 25 bp, Mus musculus
ggaatggaggaacaccactgctcta

SEQ ID NO: 587971 - DNA, 25 bp, Mus musculus
ggaatggaggaagaccactgctcta

SEQ ID NO: 587972 - DNA, 25 bp, Mus musculus
ggaatggaggcaccttcagactcaa

SEQ ID NO: 587973 - DNA, 25 bp, Mus musculus
ggaatggaggcagcttcagactcaa

SEQ ID NO: 587974 - DNA, 25 bp, Mus musculus
ggaatggagtccacttctatcatgt

SEQ ID NO: 587975 - DNA, 25 bp, Mus musculus
ggaatggagtcctcttctatcatgt

SEQ ID NO: 587976 - DNA, 25 bp, Mus musculus
ggaatggatcctacctcttaaggtt

SEQ ID NO: 587977 - DNA, 25 bp, Mus musculus
ggaatggatccttcctcttaaggtt

SEQ ID NO: 587978 - DNA, 25 bp, Mus musculus
ggaatggatggtagcttctaatttt

SEQ ID NO: 587979 - DNA, 25 bp, Mus musculus
ggaatggatggttgcttctaatttt

SEQ ID NO: 587980 - DNA, 25 bp, Mus musculus
ggaatggattcaaagcaagatgtaa

SEQ ID NO: 587981 - DNA, 25 bp, Mus musculus
ggaatggattcatagcaagatgtaa

SEQ ID NO: 587982 - DNA, 25 bp, Mus musculus
ggaatggcacctatgtctaatgtct

SEQ ID NO: 587983 - DNA, 25 bp, Mus musculus
ggaatggcacctttgtctaatgtct

SEQ ID NO: 587984 - DNA, 25 bp, Mus musculus
ggaatggcacttaagtcttgtcgtt

SEQ ID NO: 587985 - DNA, 25 bp, Mus musculus
ggaatggcactttagtcttgtcgtt

SEQ ID NO: 587986 - DNA, 25 bp, Mus musculus
ggaatggcagacaacagtgacccct

SEQ ID NO: 587987 - DNA, 25 bp, Mus musculus
ggaatggcagactacagtgacccct

SEQ ID NO: 587988 - DNA, 25 bp, Mus musculus
ggaatggcagctccttttccaacca

SEQ ID NO: 587989 - DNA, 25 bp, Mus musculus
ggaatggcagctgcttttccaacca

SEQ ID NO: 587990 - DNA, 25 bp, Mus musculus
ggaatggcaggcagatccaccatgc

SEQ ID NO: 587991 - DNA, 25 bp, Mus musculus
ggaatggcaggctgatccaccatgc

SEQ ID NO: 587992 - DNA, 25 bp, Mus musculus
ggaatggccacactcttcatgagaa

SEQ ID NO: 587993 - DNA, 25 bp, Mus musculus
ggaatggccacagtcttcatgagaa

SEQ ID NO: 587994 - DNA, 25 bp, Mus musculus
ggaatggccagaagcctccacagct

SEQ ID NO: 587995 - DNA, 25 bp, Mus musculus
ggaatggccagatgcctccacagct

SEQ ID NO: 587996 - DNA, 25 bp, Mus musculus
ggaatggccattcccttacaagctt

SEQ ID NO: 587997 - DNA, 25 bp, Mus musculus
ggaatggccattgccttacaagctt

SEQ ID NO: 587998 - DNA, 25 bp, Mus musculus
ggaatggcccagacctcagtgggta

SEQ ID NO: 587999 - DNA, 25 bp, Mus musculus
ggaatggcccagtcctcagtgggta

SEQ ID NO: 588000 - DNA, 25 bp, Mus musculus
ggaatggcccatcgtgtcacagaat

SEQ ID NO: 588001 - DNA, 25 bp, Mus musculus
ggaatggcccatggtgtcacagaat

SEQ ID NO: 588002 - DNA, 25 bp, Mus musculus
ggaatggccctcctcagagtgactg

SEQ ID NO: 588003 - DNA, 25 bp, Mus musculus
ggaatggccctcgtcagagtgactg

SEQ ID NO: 588004 - DNA, 25 bp, Mus musculus
ggaatggcctgcatattctaagtaa

SEQ ID NO: 588005 - DNA, 25 bp, Mus musculus
ggaatggcctgccaaatccatcaaa

SEQ ID NO: 588006 - DNA, 25 bp, Mus musculus
ggaatggcctgcgaaatccatcaaa

SEQ ID NO: 588007 - DNA, 25 bp, Mus musculus
ggaatggcctgcttattctaagtaa

SEQ ID NO: 588008 - DNA, 25 bp, Mus musculus
ggaatggcctggaagacgccacttt

SEQ ID NO: 588009 - DNA, 25 bp, Mus musculus
ggaatggcctggtagacgccacttt

SEQ ID NO: 588010 - DNA, 25 bp, Mus musculus
ggaatggcgtccacttcttgtaggc

SEQ ID NO: 588011 - DNA, 25 bp, Mus musculus
ggaatggcgtcctcttcttgtaggc

SEQ ID NO: 588012 - DNA, 25 bp, Mus musculus
ggaatggcgtgtccctttgatccca

SEQ ID NO: 588013 - DNA, 25 bp, Mus musculus
ggaatggcgtgtgcctttgatccca

SEQ ID NO: 588014 - DNA, 25 bp, Mus musculus
ggaatggctcctcttttgacttagc

SEQ ID NO: 588015 - DNA, 25 bp, Mus musculus
ggaatggctcctgttttgacttagc

SEQ ID NO: 588016 - DNA, 25 bp, Mus musculus
ggaatggctggtatatgcgcaataa

SEQ ID NO: 588017 - DNA, 25 bp, Mus musculus
ggaatggctggtttatgcgcaataa

SEQ ID NO: 588018 - DNA, 25 bp, Mus musculus
ggaatggcttccaatatgcaccttg

SEQ ID NO: 588019 - DNA, 25 bp, Mus musculus
ggaatggcttccagaaacacacaca

SEQ ID NO: 588020 - DNA, 25 bp, Mus musculus
ggaatggcttcctatatgcaccttg

SEQ ID NO: 588021 - DNA, 25 bp, Mus musculus
ggaatggcttcctgaaacacacaca

SEQ ID NO: 588022 - DNA, 25 bp, Mus musculus
ggaatgggaatgcagctctcagctt

SEQ ID NO: 588023 - DNA, 25 bp, Mus musculus
ggaatgggaatggagctctcagctt

SEQ ID NO: 588024 - DNA, 25 bp, Mus musculus
ggaatgggactcatacaacatgggt

SEQ ID NO: 588025 - DNA, 25 bp, Mus musculus
ggaatgggactcttacaacatgggt

SEQ ID NO: 588026 - DNA, 25 bp, Mus musculus
ggaatgggacttacagatctggaaa

SEQ ID NO: 588027 - DNA, 25 bp, Mus musculus
ggaatgggactttcagatctggaaa

SEQ ID NO: 588028 - DNA, 25 bp, Mus musculus
ggaatgggagccaagcaatgcccct

SEQ ID NO: 588029 - DNA, 25 bp, Mus musculus
ggaatgggagcctagcaatgcccct

SEQ ID NO: 588030 - DNA, 25 bp, Mus musculus
ggaatgggccacacatgtcctgggt

SEQ ID NO: 588031 - DNA, 25 bp, Mus musculus
ggaatgggccactcatgtcctgggt

SEQ ID NO: 588032 - DNA, 25 bp, Mus musculus
ggaatgggcctcataaaaactctag

SEQ ID NO: 588033 - DNA, 25 bp, Mus musculus
ggaatgggcctcttaaaaactctag

SEQ ID NO: 588034 - DNA, 25 bp, Mus musculus
ggaatgggccttcaacacacttttg

SEQ ID NO: 588035 - DNA, 25 bp, Mus musculus
ggaatgggccttgaacacacttttg

SEQ ID NO: 588036 - DNA, 25 bp, Mus musculus
ggaatgggtctcaatgcttcaagat

SEQ ID NO: 588037 - DNA, 25 bp, Mus musculus
ggaatgggtctctatgcttcaagat

SEQ ID NO: 588038 - DNA, 25 bp, Mus musculus
ggaatggtaggtccgatatagccaa

SEQ ID NO: 588039 - DNA, 25 bp, Mus musculus
ggaatggtaggtgcgatatagccaa

SEQ ID NO: 588040 - DNA, 25 bp, Mus musculus
ggaatggtcccgatatcagttggtt

SEQ ID NO: 588041 - DNA, 25 bp, Mus musculus
ggaatggtcccgttatcagttggtt

SEQ ID NO: 588042 - DNA, 25 bp, Mus musculus
ggaatggtctacatccagtgaggta

SEQ ID NO: 588043 - DNA, 25 bp, Mus musculus
ggaatggtctacttccagtgaggta

SEQ ID NO: 588044 - DNA, 25 bp, Mus musculus
ggaatggtctgcagttatttaactc

SEQ ID NO: 588045 - DNA, 25 bp, Mus musculus
ggaatggtctgctgttatttaactc

SEQ ID NO: 588046 - DNA, 25 bp, Mus musculus
ggaatggtcttccagaggtgcatct

SEQ ID NO: 588047 - DNA, 25 bp, Mus musculus
ggaatggtcttcgagaggtgcatct

SEQ ID NO: 588048 - DNA, 25 bp, Mus musculus
ggaatggtgctgacgatttttctat

SEQ ID NO: 588049 - DNA, 25 bp, Mus musculus
ggaatggtgctgtcgatttttctat

SEQ ID NO: 588050 - DNA, 25 bp, Mus musculus
ggaatggtggagaccagccctcttt

SEQ ID NO: 588051 - DNA, 25 bp, Mus musculus
ggaatggtggagtccagccctcttt

SEQ ID NO: 588052 - DNA, 25 bp, Mus musculus
ggaatggttgagatctcccactaag

SEQ ID NO: 588053 - DNA, 25 bp, Mus musculus
ggaatggttgagttctcccactaag

SEQ ID NO: 588054 - DNA, 25 bp, Mus musculus
ggaatgtaaagaacacctgcatcaa

SEQ ID NO: 588055 - DNA, 25 bp, Mus musculus
ggaatgtaaagatcacctgcatcaa

SEQ ID NO: 588056 - DNA, 25 bp, Mus musculus
ggaatgtaaatcatcagcatatctg

SEQ ID NO: 588057 - DNA, 25 bp, Mus musculus
ggaatgtaaatcttcagcatatctg

SEQ ID NO: 588058 - DNA, 25 bp, Mus musculus
ggaatgtaactaacctgaggactcg

SEQ ID NO: 588059 - DNA, 25 bp, Mus musculus
ggaatgtaactatcctgaggactcg

SEQ ID NO: 588060 - DNA, 25 bp, Mus musculus
ggaatgtacattacctggaagcttt

SEQ ID NO: 588061 - DNA, 25 bp, Mus musculus
ggaatgtacatttcctggaagcttt

SEQ ID NO: 588062 - DNA, 25 bp, Mus musculus
ggaatgtaccagatgattttatagt

SEQ ID NO: 588063 - DNA, 25 bp, Mus musculus
ggaatgtaccagttgattttatagt

SEQ ID NO: 588064 - DNA, 25 bp, Mus musculus
ggaatgtacttccattgagcctcag

SEQ ID NO: 588065 - DNA, 25 bp, Mus musculus
ggaatgtacttcgattgagcctcag

SEQ ID NO: 588066 - DNA, 25 bp, Mus musculus
ggaatgtagataacttggaccctga

SEQ ID NO: 588067 - DNA, 25 bp, Mus musculus
ggaatgtagatatcttggaccctga

SEQ ID NO: 588068 - DNA, 25 bp, Mus musculus
ggaatgtagcctcgatcctctagaa

SEQ ID NO: 588069 - DNA, 25 bp, Mus musculus
ggaatgtagcctggatcctctagaa

SEQ ID NO: 588070 - DNA, 25 bp, Mus musculus
ggaatgtatacacctcttcacgata

SEQ ID NO: 588071 - DNA, 25 bp, Mus musculus
ggaatgtatacagctcttcacgata

SEQ ID NO: 588072 - DNA, 25 bp, Mus musculus
ggaatgtatgccaaggttaccctca

SEQ ID NO: 588073 - DNA, 25 bp, Mus musculus
ggaatgtatgcccacaccatttgtc

SEQ ID NO: 588074 - DNA, 25 bp, Mus musculus
ggaatgtatgccgacaccatttgtc

SEQ ID NO: 588075 - DNA, 25 bp, Mus musculus
ggaatgtatgcctaggttaccctca

SEQ ID NO: 588076 - DNA, 25 bp, Mus musculus
ggaatgtatggaactctttcgttca

SEQ ID NO: 588077 - DNA, 25 bp, Mus musculus
ggaatgtatggatctctttcgttca

SEQ ID NO: 588078 - DNA, 25 bp, Mus musculus
ggaatgtcaaatcgcctatgaagct

SEQ ID NO: 588079 - DNA, 25 bp, Mus musculus
ggaatgtcaaatggcctatgaagct

SEQ ID NO: 588080 - DNA, 25 bp, Mus musculus
ggaatgtcacagatttacaagaaca

SEQ ID NO: 588081 - DNA, 25 bp, Mus musculus
ggaatgtcacagttttacaagaaca

SEQ ID NO: 588082 - DNA, 25 bp, Mus musculus
ggaatgtcacgtaatccttgatgaa

SEQ ID NO: 588083 - DNA, 25 bp, Mus musculus
ggaatgtcacgttatccttgatgaa

SEQ ID NO: 588084 - DNA, 25 bp, Mus musculus
ggaatgtcaggtcaagccaccacag

SEQ ID NO: 588085 - DNA, 25 bp, Mus musculus
ggaatgtcaggtgaagccaccacag

SEQ ID NO: 588086 - DNA, 25 bp, Mus musculus
ggaatgtcatttctactggagttac

SEQ ID NO: 588087 - DNA, 25 bp, Mus musculus
ggaatgtcatttgtactggagttac

SEQ ID NO: 588088 - DNA, 25 bp, Mus musculus
ggaatgtccctgcatatagttttaa

SEQ ID NO: 588089 - DNA, 25 bp, Mus musculus
ggaatgtccctggatatagttttaa

SEQ ID NO: 588090 - DNA, 25 bp, Mus musculus
ggaatgtcctagaatcaaatgtttg

SEQ ID NO: 588091 - DNA, 25 bp, Mus musculus
ggaatgtcctagtatcaaatgtttg

SEQ ID NO: 588092 - DNA, 25 bp, Mus musculus
ggaatgtcctcaacatatatttcag

SEQ ID NO: 588093 - DNA, 25 bp, Mus musculus
ggaatgtcctcatcatatatttcag

SEQ ID NO: 588094 - DNA, 25 bp, Mus musculus
ggaatgtccttacgttgaactgtaa

SEQ ID NO: 588095 - DNA, 25 bp, Mus musculus
ggaatgtccttacttttgactcagt

SEQ ID NO: 588096 - DNA, 25 bp, Mus musculus
ggaatgtccttaggttgaactgtaa

SEQ ID NO: 588097 - DNA, 25 bp, Mus musculus
ggaatgtccttagttttgactcagt

SEQ ID NO: 588098 - DNA, 25 bp, Mus musculus
ggaatgtcgaatagattgtgataaa

SEQ ID NO: 588099 - DNA, 25 bp, Mus musculus
ggaatgtcgaattgattgtgataaa

SEQ ID NO: 588100 - DNA, 25 bp, Mus musculus
ggaatgtctaaacgtctcccgcctg

SEQ ID NO: 588101 - DNA, 25 bp, Mus musculus
ggaatgtctaaaggtctcccgcctg

SEQ ID NO: 588102 - DNA, 25 bp, Mus musculus
ggaatgtctccacgccatgggattt

SEQ ID NO: 588103 - DNA, 25 bp, Mus musculus
ggaatgtctccaggccatgggattt

SEQ ID NO: 588104 - DNA, 25 bp, Mus musculus
ggaatgtctgaaagcctgaatacgg

SEQ ID NO: 588105 - DNA, 25 bp, Mus musculus
ggaatgtctgaatgcctgaatacgg

SEQ ID NO: 588106 - DNA, 25 bp, Mus musculus
ggaatgtgaagtcactccccagccc

SEQ ID NO: 588107 - DNA, 25 bp, Mus musculus
ggaatgtgaagtgactccccagccc

SEQ ID NO: 588108 - DNA, 25 bp, Mus musculus
ggaatgtgagaccttgactcttgta

SEQ ID NO: 588109 - DNA, 25 bp, Mus musculus
ggaatgtgagacgttgactcttgta

SEQ ID NO: 588110 - DNA, 25 bp, Mus musculus
ggaatgtgcataatcgagactgtaa

SEQ ID NO: 588111 - DNA, 25 bp, Mus musculus
ggaatgtgcatattcgagactgtaa

SEQ ID NO: 588112 - DNA, 25 bp, Mus musculus
ggaatgtgccccagtcccttcctga

SEQ ID NO: 588113 - DNA, 25 bp, Mus musculus
ggaatgtgcccctgtcccttcctga

SEQ ID NO: 588114 - DNA, 25 bp, Mus musculus
ggaatgtgcttaccccgctgggact

SEQ ID NO: 588115 - DNA, 25 bp, Mus musculus
ggaatgtgcttagcccgctgggact

SEQ ID NO: 588116 - DNA, 25 bp, Mus musculus
ggaatgtgcttcattcgtaccactc

SEQ ID NO: 588117 - DNA, 25 bp, Mus musculus
ggaatgtgcttctttcgtaccactc

SEQ ID NO: 588118 - DNA, 25 bp, Mus musculus
ggaatgtggatcaggtttactagca

SEQ ID NO: 588119 - DNA, 25 bp, Mus musculus
ggaatgtggatctggtttactagca

SEQ ID NO: 588120 - DNA, 25 bp, Mus musculus
ggaatgtggcttagacttgggttaa

SEQ ID NO: 588121 - DNA, 25 bp, Mus musculus
ggaatgtggctttgacttgggttaa

SEQ ID NO: 588122 - DNA, 25 bp, Mus musculus
ggaatgtgggtgactgaccgcccta

SEQ ID NO: 588123 - DNA, 25 bp, Mus musculus
ggaatgtgggtgtctgaccgcccta

SEQ ID NO: 588124 - DNA, 25 bp, Mus musculus
ggaatgtggtccaggctttgctgcc

SEQ ID NO: 588125 - DNA, 25 bp, Mus musculus
ggaatgtggtcctggctttgctgcc

SEQ ID NO: 588126 - DNA, 25 bp, Mus musculus
ggaatgtggtgtcctttcacacata

SEQ ID NO: 588127 - DNA, 25 bp, Mus musculus
ggaatgtggtgtgctttcacacata

SEQ ID NO: 588128 - DNA, 25 bp, Mus musculus
ggaatgtgtaataaccgctgacaat

SEQ ID NO: 588129 - DNA, 25 bp, Mus musculus
ggaatgtgtaattaccgctgacaat

SEQ ID NO: 588130 - DNA, 25 bp, Mus musculus
ggaatgtgtctaaccctcagtatga

SEQ ID NO: 588131 - DNA, 25 bp, Mus musculus
ggaatgtgtctatccctcagtatga

SEQ ID NO: 588132 - DNA, 25 bp, Mus musculus
ggaatgttacaaatttgttgaacta

SEQ ID NO: 588133 - DNA, 25 bp, Mus musculus
ggaatgttacaattttgttgaacta

SEQ ID NO: 588134 - DNA, 25 bp, Mus musculus
ggaatgttattaagcccaggtcgaa

SEQ ID NO: 588135 - DNA, 25 bp, Mus musculus
ggaatgttattatgcccaggtcgaa

SEQ ID NO: 588136 - DNA, 25 bp, Mus musculus
ggaatgttcaaaatacactaagtgt

SEQ ID NO: 588137 - DNA, 25 bp, Mus musculus
ggaatgttcaaattacactaagtgt

SEQ ID NO: 588138 - DNA, 25 bp, Mus musculus
ggaatgttctacactgcgggacaaa

SEQ ID NO: 588139 - DNA, 25 bp, Mus musculus
ggaatgttctactctgcgggacaaa

SEQ ID NO: 588140 - DNA, 25 bp, Mus musculus
ggaatgttctagctttactgactta

SEQ ID NO: 588141 - DNA, 25 bp, Mus musculus
ggaatgttctaggtttactgactta

SEQ ID NO: 588142 - DNA, 25 bp, Mus musculus
ggaatgttctcacttcctacattga

SEQ ID NO: 588143 - DNA, 25 bp, Mus musculus
ggaatgttctcagttcctacattga

SEQ ID NO: 588144 - DNA, 25 bp, Mus musculus
ggaatgttctggcacgttctgacat

SEQ ID NO: 588145 - DNA, 25 bp, Mus musculus
ggaatgttctgggacgttctgacat

SEQ ID NO: 588146 - DNA, 25 bp, Mus musculus
ggaatgttctgtatctctgagctag

SEQ ID NO: 588147 - DNA, 25 bp, Mus musculus
ggaatgttctgtttctctgagctag

SEQ ID NO: 588148 - DNA, 25 bp, Mus musculus
ggaatgttgagtacacgtctgggaa

SEQ ID NO: 588149 - DNA, 25 bp, Mus musculus
ggaatgttgagttcacgtctgggaa

SEQ ID NO: 588150 - DNA, 25 bp, Mus musculus
ggaatgttgatactgcacacccact

SEQ ID NO: 588151 - DNA, 25 bp, Mus musculus
ggaatgttgatagtgcacacccact

SEQ ID NO: 588152 - DNA, 25 bp, Mus musculus
ggaatgttgccaaagtggacccttt

SEQ ID NO: 588153 - DNA, 25 bp, Mus musculus
ggaatgttgccatagtggacccttt

SEQ ID NO: 588154 - DNA, 25 bp, Mus musculus
ggaatgttggctacagactgttgtg

SEQ ID NO: 588155 - DNA, 25 bp, Mus musculus
ggaatgttggcttcagactgttgtg

SEQ ID NO: 588156 - DNA, 25 bp, Mus musculus
ggaatgttgtcaccaaggtttctct

SEQ ID NO: 588157 - DNA, 25 bp, Mus musculus
ggaatgttgtcagcaaggtttctct

SEQ ID NO: 588158 - DNA, 25 bp, Mus musculus
ggaatgttgtctacacagtgatggt

SEQ ID NO: 588159 - DNA, 25 bp, Mus musculus
ggaatgttgtcttcacagtgatggt

SEQ ID NO: 588160 - DNA, 25 bp, Mus musculus
ggaatgttgtttcctttggcattac

SEQ ID NO: 588161 - DNA, 25 bp, Mus musculus
ggaatgttgtttgctttggcattac

SEQ ID NO: 588162 - DNA, 25 bp, Mus musculus
ggaatgtttgctatgtacagacttt

SEQ ID NO: 588163 - DNA, 25 bp, Mus musculus
ggaatgtttgctttgtacagacttt

SEQ ID NO: 588164 - DNA, 25 bp, Mus musculus
ggaatgttttaaatgctcgtggtat

SEQ ID NO: 588165 - DNA, 25 bp, Mus musculus
ggaatgttttaattgctcgtggtat

SEQ ID NO: 588166 - DNA, 25 bp, Mus musculus
ggaatgttttccacagtacctttgt

SEQ ID NO: 588167 - DNA, 25 bp, Mus musculus
ggaatgttttcctcagtacctttgt

SEQ ID NO: 588168 - DNA, 25 bp, Mus musculus
ggaattaacatcctcccacaccaga

SEQ ID NO: 588169 - DNA, 25 bp, Mus musculus
ggaattaacatcgtcccacaccaga

SEQ ID NO: 588170 - DNA, 25 bp, Mus musculus
ggaattaacattcgcccagtccata

SEQ ID NO: 588171 - DNA, 25 bp, Mus musculus
ggaattaacattggcccagtccata

SEQ ID NO: 588172 - DNA, 25 bp, Mus musculus
ggaattaaccgtcgtaaagcctgat

SEQ ID NO: 588173 - DNA, 25 bp, Mus musculus
ggaattaaccgtggtaaagcctgat

SEQ ID NO: 588174 - DNA, 25 bp, Mus musculus
ggaattaacctgctagctgctaata

SEQ ID NO: 588175 - DNA, 25 bp, Mus musculus
ggaattaacctggtagctgctaata

SEQ ID NO: 588176 - DNA, 25 bp, Mus musculus
ggaattaacttaacatgcatttgct

SEQ ID NO: 588177 - DNA, 25 bp, Mus musculus
ggaattaacttatcatgcatttgct

SEQ ID NO: 588178 - DNA, 25 bp, Mus musculus
ggaattaaggctccttccacatccc

SEQ ID NO: 588179 - DNA, 25 bp, Mus musculus
ggaattaaggctgcttccacatccc

SEQ ID NO: 588180 - DNA, 25 bp, Mus musculus
ggaattaagtcaaatttggtcacaa

SEQ ID NO: 588181 - DNA, 25 bp, Mus musculus
ggaattaagtcatatttggtcacaa

SEQ ID NO: 588182 - DNA, 25 bp, Mus musculus
ggaattaatattactgtcaactgat

SEQ ID NO: 588183 - DNA, 25 bp, Mus musculus
ggaattaatatttctgtcaactgat

SEQ ID NO: 588184 - DNA, 25 bp, Mus musculus
ggaattaatcccagagtatctgaat

SEQ ID NO: 588185 - DNA, 25 bp, Mus musculus
ggaattaatccctgagtatctgaat

SEQ ID NO: 588186 - DNA, 25 bp, Mus musculus
ggaattaatctactacatgtatgca

SEQ ID NO: 588187 - DNA, 25 bp, Mus musculus
ggaattaatctagtacatgtatgca

SEQ ID NO: 588188 - DNA, 25 bp, Mus musculus
ggaattaatgcaatgtcacacacta

SEQ ID NO: 588189 - DNA, 25 bp, Mus musculus
ggaattaatgcattgtcacacacta

SEQ ID NO: 588190 - DNA, 25 bp, Mus musculus
ggaattacaaatataccactgagcc

SEQ ID NO: 588191 - DNA, 25 bp, Mus musculus
ggaattacaaatttaccactgagcc

SEQ ID NO: 588192 - DNA, 25 bp, Mus musculus
ggaattacacgtaaccagcatcatt

SEQ ID NO: 588193 - DNA, 25 bp, Mus musculus
ggaattacacgttaccagcatcatt

SEQ ID NO: 588194 - DNA, 25 bp, Mus musculus
ggaattacacttcagattcgaagag

SEQ ID NO: 588195 - DNA, 25 bp, Mus musculus
ggaattacacttgagattcgaagag

SEQ ID NO: 588196 - DNA, 25 bp, Mus musculus
ggaattacagacaacataccatttt

SEQ ID NO: 588197 - DNA, 25 bp, Mus musculus
ggaattacagacatgcgctactcta

SEQ ID NO: 588198 - DNA, 25 bp, Mus musculus
ggaattacagacatggaccacttgc

SEQ ID NO: 588199 - DNA, 25 bp, Mus musculus
ggaattacagactacataccatttt

SEQ ID NO: 588200 - DNA, 25 bp, Mus musculus
ggaattacagacttgcgctactcta

SEQ ID NO: 588201 - DNA, 25 bp, Mus musculus
ggaattacagacttggaccacttgc

SEQ ID NO: 588202 - DNA, 25 bp, Mus musculus
ggaattacaggcctgtaaaccaggc

SEQ ID NO: 588203 - DNA, 25 bp, Mus musculus
ggaattacaggcgtgtaaaccaggc

SEQ ID NO: 588204 - DNA, 25 bp, Mus musculus
ggaattaccccacttgtctatgcta

SEQ ID NO: 588205 - DNA, 25 bp, Mus musculus
ggaattaccccagttgtctatgcta

SEQ ID NO: 588206 - DNA, 25 bp, Mus musculus
ggaattactaccatagtcaccaact

SEQ ID NO: 588207 - DNA, 25 bp, Mus musculus
ggaattactaccttagtcaccaact

SEQ ID NO: 588208 - DNA, 25 bp, Mus musculus
ggaattactcagacctcctcttaag

SEQ ID NO: 588209 - DNA, 25 bp, Mus musculus
ggaattactcagtcctcctcttaag

SEQ ID NO: 588210 - DNA, 25 bp, Mus musculus
ggaattacttccatatacaaaagtc

SEQ ID NO: 588211 - DNA, 25 bp, Mus musculus
ggaattacttccttatacaaaagtc

SEQ ID NO: 588212 - DNA, 25 bp, Mus musculus
ggaattagacttcacatctgcaact

SEQ ID NO: 588213 - DNA, 25 bp, Mus musculus
ggaattagacttgacatctgcaact

SEQ ID NO: 588214 - DNA, 25 bp, Mus musculus
ggaattagagacatcaaaagcccaa

SEQ ID NO: 588215 - DNA, 25 bp, Mus musculus
ggaattagagacttcaaaagcccaa

SEQ ID NO: 588216 - DNA, 25 bp, Mus musculus
ggaattagcatactcatcacctctg

SEQ ID NO: 588217 - DNA, 25 bp, Mus musculus
ggaattagcatagtcatcacctctg

SEQ ID NO: 588218 - DNA, 25 bp, Mus musculus
ggaattagcctgacatttttcagct

SEQ ID NO: 588219 - DNA, 25 bp, Mus musculus
ggaattagcctgtcatttttcagct

SEQ ID NO: 588220 - DNA, 25 bp, Mus musculus
ggaattagctccaccccttcaaatg

SEQ ID NO: 588221 - DNA, 25 bp, Mus musculus
ggaattagctcctccccttcaaatg

SEQ ID NO: 588222 - DNA, 25 bp, Mus musculus
ggaattagtaccaggcagataccta

SEQ ID NO: 588223 - DNA, 25 bp, Mus musculus
ggaattagtacctggcagataccta

SEQ ID NO: 588224 - DNA, 25 bp, Mus musculus
ggaattatacccactgcagatacaa

SEQ ID NO: 588225 - DNA, 25 bp, Mus musculus
ggaattataccctctgcagatacaa

SEQ ID NO: 588226 - DNA, 25 bp, Mus musculus
ggaattatatgtccttttgtctgaa

SEQ ID NO: 588227 - DNA, 25 bp, Mus musculus
ggaattatatgtgcttttgtctgaa

SEQ ID NO: 588228 - DNA, 25 bp, Mus musculus
ggaattatatttctatggctatctt

SEQ ID NO: 588229 - DNA, 25 bp, Mus musculus
ggaattatatttgtatggctatctt

SEQ ID NO: 588230 - DNA, 25 bp, Mus musculus
ggaattatcagcaaatgtctggcta

SEQ ID NO: 588231 - DNA, 25 bp, Mus musculus
ggaattatcagcatgtactgtcccc

SEQ ID NO: 588232 - DNA, 25 bp, Mus musculus
ggaattatcagctaatgtctggcta

SEQ ID NO: 588233 - DNA, 25 bp, Mus musculus
ggaattatcagcttgtactgtcccc

SEQ ID NO: 588234 - DNA, 25 bp, Mus musculus
ggaattatcattctcactagtggga

SEQ ID NO: 588235 - DNA, 25 bp, Mus musculus
ggaattatcattgtcactagtggga

SEQ ID NO: 588236 - DNA, 25 bp, Mus musculus
ggaattatgaatcgctgtgagtcac

SEQ ID NO: 588237 - DNA, 25 bp, Mus musculus
ggaattatgaatggctgtgagtcac

SEQ ID NO: 588238 - DNA, 25 bp, Mus musculus
ggaattatgcacaaactctacccat

SEQ ID NO: 588239 - DNA, 25 bp, Mus musculus
ggaattatgcactaactctacccat

SEQ ID NO: 588240 - DNA, 25 bp, Mus musculus
ggaattatggtcattgcctggttat

SEQ ID NO: 588241 - DNA, 25 bp, Mus musculus
ggaattatggtctttgcctggttat

SEQ ID NO: 588242 - DNA, 25 bp, Mus musculus
ggaattatgtccatcttaatgcaga

SEQ ID NO: 588243 - DNA, 25 bp, Mus musculus
ggaattatgtccttcttaatgcaga

SEQ ID NO: 588244 - DNA, 25 bp, Mus musculus
ggaattattaatcgcttgtcagtaa

SEQ ID NO: 588245 - DNA, 25 bp, Mus musculus
ggaattattaatggcttgtcagtaa

SEQ ID NO: 588246 - DNA, 25 bp, Mus musculus
ggaattattcagcaagactcacgga

SEQ ID NO: 588247 - DNA, 25 bp, Mus musculus
ggaattattcaggaagactcacgga

SEQ ID NO: 588248 - DNA, 25 bp, Mus musculus
ggaattattccaaaggcaccagcca

SEQ ID NO: 588249 - DNA, 25 bp, Mus musculus
ggaattattccacgcatccatccag

SEQ ID NO: 588250 - DNA, 25 bp, Mus musculus
ggaattattccaggcatccatccag

SEQ ID NO: 588251 - DNA, 25 bp, Mus musculus
ggaattattccataggcaccagcca

SEQ ID NO: 588252 - DNA, 25 bp, Mus musculus
ggaattcaaagcactaatggacctt

SEQ ID NO: 588253 - DNA, 25 bp, Mus musculus
ggaattcaaagctctaatggacctt

SEQ ID NO: 588254 - DNA, 25 bp, Mus musculus
ggaattcaaggacagtacctggtta

SEQ ID NO: 588255 - DNA, 25 bp, Mus musculus
ggaattcaaggagagtacctggtta

SEQ ID NO: 588256 - DNA, 25 bp, Mus musculus
ggaattcacaggacttacttgactg

SEQ ID NO: 588257 - DNA, 25 bp, Mus musculus
ggaattcacaggtcttacttgactg

SEQ ID NO: 588258 - DNA, 25 bp, Mus musculus
ggaattcactctccataaccatcta

SEQ ID NO: 588259 - DNA, 25 bp, Mus musculus
ggaattcactctgcataaccatcta

SEQ ID NO: 588260 - DNA, 25 bp, Mus musculus
ggaattcactgccattttggttcat

SEQ ID NO: 588261 - DNA, 25 bp, Mus musculus
ggaattcactgcgattttggttcat

SEQ ID NO: 588262 - DNA, 25 bp, Mus musculus
ggaattcagactatggtggcccagt

SEQ ID NO: 588263 - DNA, 25 bp, Mus musculus
ggaattcagactttggtggcccagt

SEQ ID NO: 588264 - DNA, 25 bp, Mus musculus
ggaattcagttaaatcctctaattg

SEQ ID NO: 588265 - DNA, 25 bp, Mus musculus
ggaattcagttatatcctctaattg

SEQ ID NO: 588266 - DNA, 25 bp, Mus musculus
ggaattcatactattgcacatactg

SEQ ID NO: 588267 - DNA, 25 bp, Mus musculus
ggaattcatacttttgcacatactg

SEQ ID NO: 588268 - DNA, 25 bp, Mus musculus
ggaattcatagacatttgcccgcct

SEQ ID NO: 588269 - DNA, 25 bp, Mus musculus
ggaattcatagagatttgcccgcct

SEQ ID NO: 588270 - DNA, 25 bp, Mus musculus
ggaattcatattccctttaaggcct

SEQ ID NO: 588271 - DNA, 25 bp, Mus musculus
ggaattcatattgcctttaaggcct

SEQ ID NO: 588272 - DNA, 25 bp, Mus musculus
ggaattcatcacagagccactactc

SEQ ID NO: 588273 - DNA, 25 bp, Mus musculus
ggaattcatcactgagccactactc

SEQ ID NO: 588274 - DNA, 25 bp, Mus musculus
ggaattcatcccatacacagttacc

SEQ ID NO: 588275 - DNA, 25 bp, Mus musculus
ggaattcatcccttacacagttacc

SEQ ID NO: 588276 - DNA, 25 bp, Mus musculus
ggaattcatcttaatcagacctgtg

SEQ ID NO: 588277 - DNA, 25 bp, Mus musculus
ggaattcatctttatcagacctgtg

SEQ ID NO: 588278 - DNA, 25 bp, Mus musculus
ggaattcatgacctatgttgcgttt

SEQ ID NO: 588279 - DNA, 25 bp, Mus musculus
ggaattcatgacgtatgttgcgttt

SEQ ID NO: 588280 - DNA, 25 bp, Mus musculus
ggaattcatgggatgccttctgctg

SEQ ID NO: 588281 - DNA, 25 bp, Mus musculus
ggaattcatgggttgccttctgctg

SEQ ID NO: 588282 - DNA, 25 bp, Mus musculus
ggaattcatgtaccgcacacacata

SEQ ID NO: 588283 - DNA, 25 bp, Mus musculus
ggaattcatgtagcgcacacacata

SEQ ID NO: 588284 - DNA, 25 bp, Mus musculus
ggaattcattagctgtctcgctcac

SEQ ID NO: 588285 - DNA, 25 bp, Mus musculus
ggaattcattaggtgtctcgctcac

SEQ ID NO: 588286 - DNA, 25 bp, Mus musculus
ggaattcattatagtcatttacaat

SEQ ID NO: 588287 - DNA, 25 bp, Mus musculus
ggaattcattattgtcatttacaat

SEQ ID NO: 588288 - DNA, 25 bp, Mus musculus
ggaattcattgaagtccacgtcaaa

SEQ ID NO: 588289 - DNA, 25 bp, Mus musculus
ggaattcattgatgtccacgtcaaa

SEQ ID NO: 588290 - DNA, 25 bp, Mus musculus
ggaattcatttgacagtgtctaaac

SEQ ID NO: 588291 - DNA, 25 bp, Mus musculus
ggaattcatttgtcagtgtctaaac

SEQ ID NO: 588292 - DNA, 25 bp, Mus musculus
ggaattccaaacctgcagaggaccc

SEQ ID NO: 588293 - DNA, 25 bp, Mus musculus
ggaattccaaacgtgcagaggaccc

SEQ ID NO: 588294 - DNA, 25 bp, Mus musculus
ggaattccaacgacgtgccaaagct

SEQ ID NO: 588295 - DNA, 25 bp, Mus musculus
ggaattccaacgtcgtgccaaagct

SEQ ID NO: 588296 - DNA, 25 bp, Mus musculus
ggaattccaaggagcgctgcgtcgt

SEQ ID NO: 588297 - DNA, 25 bp, Mus musculus
ggaattccaaggtgcgctgcgtcgt

SEQ ID NO: 588298 - DNA, 25 bp, Mus musculus
ggaattccacataccacatgagcgc

SEQ ID NO: 588299 - DNA, 25 bp, Mus musculus
ggaattccacattccacatgagcgc

SEQ ID NO: 588300 - DNA, 25 bp, Mus musculus
ggaattccagaaaggcaaggtagca

SEQ ID NO: 588301 - DNA, 25 bp, Mus musculus
ggaattccagaatggcaaggtagca

SEQ ID NO: 588302 - DNA, 25 bp, Mus musculus
ggaattccagcgatgactgttctga

SEQ ID NO: 588303 - DNA, 25 bp, Mus musculus
ggaattccagcgttgactgttctga

SEQ ID NO: 588304 - DNA, 25 bp, Mus musculus
ggaattccagttacacagttctcca

SEQ ID NO: 588305 - DNA, 25 bp, Mus musculus
ggaattccagtttcacagttctcca

SEQ ID NO: 588306 - DNA, 25 bp, Mus musculus
ggaattccatagaggttcagaacaa

SEQ ID NO: 588307 - DNA, 25 bp, Mus musculus
ggaattccatagtggttcagaacaa

SEQ ID NO: 588308 - DNA, 25 bp, Mus musculus
ggaattccatcaagggcttctggga

SEQ ID NO: 588309 - DNA, 25 bp, Mus musculus
ggaattccatcaccagtggagcgtt

SEQ ID NO: 588310 - DNA, 25 bp, Mus musculus
ggaattccatcagcagtggagcgtt

SEQ ID NO: 588311 - DNA, 25 bp, Mus musculus
ggaattccatcatgggcttctggga

SEQ ID NO: 588312 - DNA, 25 bp, Mus musculus
ggaattcccagtacacttggtcatt

SEQ ID NO: 588313 - DNA, 25 bp, Mus musculus
ggaattcccagttcacttggtcatt

SEQ ID NO: 588314 - DNA, 25 bp, Mus musculus
ggaattcccataaatcagtctgttg

SEQ ID NO: 588315 - DNA, 25 bp, Mus musculus
ggaattcccatatatcagtctgttg

SEQ ID NO: 588316 - DNA, 25 bp, Mus musculus
ggaattcccatcctatttgagttga

SEQ ID NO: 588317 - DNA, 25 bp, Mus musculus
ggaattcccatcgtatttgagttga

SEQ ID NO: 588318 - DNA, 25 bp, Mus musculus
ggaattcccggacatatatctgaat

SEQ ID NO: 588319 - DNA, 25 bp, Mus musculus
ggaattcccggagatatatctgaat

SEQ ID NO: 588320 - DNA, 25 bp, Mus musculus
ggaattccgctcacaaagcctctgg

SEQ ID NO: 588321 - DNA, 25 bp, Mus musculus
ggaattccgctctcaaagcctctgg

SEQ ID NO: 588322 - DNA, 25 bp, Mus musculus
ggaattcctagaactcagtacccag

SEQ ID NO: 588323 - DNA, 25 bp, Mus musculus
ggaattcctagatctcagtacccag

SEQ ID NO: 588324 - DNA, 25 bp, Mus musculus
ggaattcctagcagagtggcgatga

SEQ ID NO: 588325 - DNA, 25 bp, Mus musculus
ggaattcctagctgagtggcgatga

SEQ ID NO: 588326 - DNA, 25 bp, Mus musculus
ggaattcctgataggtttgcctgtt

SEQ ID NO: 588327 - DNA, 25 bp, Mus musculus
ggaattcctgattggtttgcctgtt

SEQ ID NO: 588328 - DNA, 25 bp, Mus musculus
ggaattcctggtaatgcgtacctat

SEQ ID NO: 588329 - DNA, 25 bp, Mus musculus
ggaattcctggttatgcgtacctat

SEQ ID NO: 588330 - DNA, 25 bp, Mus musculus
ggaattcctgtaacacacaatccat

SEQ ID NO: 588331 - DNA, 25 bp, Mus musculus
ggaattcctgtatcacacaatccat

SEQ ID NO: 588332 - DNA, 25 bp, Mus musculus
ggaattccttacatgtggatgtcaa

SEQ ID NO: 588333 - DNA, 25 bp, Mus musculus
ggaattccttacttgtggatgtcaa

SEQ ID NO: 588334 - DNA, 25 bp, Mus musculus
ggaattccttgcaactggagctcag

SEQ ID NO: 588335 - DNA, 25 bp, Mus musculus
ggaattccttgctactggagctcag

SEQ ID NO: 588336 - DNA, 25 bp, Mus musculus
ggaattcgaaccacccatttggtgt

SEQ ID NO: 588337 - DNA, 25 bp, Mus musculus
ggaattcgaacctcccatttggtgt

SEQ ID NO: 588338 - DNA, 25 bp, Mus musculus
ggaattcgagatcggacttgcttgt

SEQ ID NO: 588339 - DNA, 25 bp, Mus musculus
ggaattcgagatgggacttgcttgt

SEQ ID NO: 588340 - DNA, 25 bp, Mus musculus
ggaattcgattacgaatggcactct

SEQ ID NO: 588341 - DNA, 25 bp, Mus musculus
ggaattcgattaggaatggcactct

SEQ ID NO: 588342 - DNA, 25 bp, Mus musculus
ggaattctaactaggcccacaagta

SEQ ID NO: 588343 - DNA, 25 bp, Mus musculus
ggaattctaactatgtgtggccatt

SEQ ID NO: 588344 - DNA, 25 bp, Mus musculus
ggaattctaacttggcccacaagta

SEQ ID NO: 588345 - DNA, 25 bp, Mus musculus
ggaattctaactttgtgtggccatt

SEQ ID NO: 588346 - DNA, 25 bp, Mus musculus
ggaattctacctaagctcagggcaa

SEQ ID NO: 588347 - DNA, 25 bp, Mus musculus
ggaattctaccttagctcagggcaa

SEQ ID NO: 588348 - DNA, 25 bp, Mus musculus
ggaattctatacaccactcaactag

SEQ ID NO: 588349 - DNA, 25 bp, Mus musculus
ggaattctatactccactcaactag

SEQ ID NO: 588350 - DNA, 25 bp, Mus musculus
ggaattctatgaagtgacctttaat

SEQ ID NO: 588351 - DNA, 25 bp, Mus musculus
ggaattctatgatgtgacctttaat

SEQ ID NO: 588352 - DNA, 25 bp, Mus musculus
ggaattctcactctcagatctgagc

SEQ ID NO: 588353 - DNA, 25 bp, Mus musculus
ggaattctcactgtcagatctgagc

SEQ ID NO: 588354 - DNA, 25 bp, Mus musculus
ggaattctcattaaggacttccttg

SEQ ID NO: 588355 - DNA, 25 bp, Mus musculus
ggaattctcatttaggacttccttg

SEQ ID NO: 588356 - DNA, 25 bp, Mus musculus
ggaattctcccactttgcaggttac

SEQ ID NO: 588357 - DNA, 25 bp, Mus musculus
ggaattctcccagtttgcaggttac

SEQ ID NO: 588358 - DNA, 25 bp, Mus musculus
ggaattctctccattatctctgaaa

SEQ ID NO: 588359 - DNA, 25 bp, Mus musculus
ggaattctctcctttatctctgaaa

SEQ ID NO: 588360 - DNA, 25 bp, Mus musculus
ggaattctcttcagaccgatttcca

SEQ ID NO: 588361 - DNA, 25 bp, Mus musculus
ggaattctcttcagcagatacggct

SEQ ID NO: 588362 - DNA, 25 bp, Mus musculus
ggaattctcttctgaccgatttcca

SEQ ID NO: 588363 - DNA, 25 bp, Mus musculus
ggaattctcttctgcagatacggct

SEQ ID NO: 588364 - DNA, 25 bp, Mus musculus
ggaattctgaccacgctctgtaaaa

SEQ ID NO: 588365 - DNA, 25 bp, Mus musculus
ggaattctgacctcgctctgtaaaa

SEQ ID NO: 588366 - DNA, 25 bp, Mus musculus
ggaattctgagtaaagtaccgccct

SEQ ID NO: 588367 - DNA, 25 bp, Mus musculus
ggaattctgagttaagtaccgccct

SEQ ID NO: 588368 - DNA, 25 bp, Mus musculus
ggaattctgattacagctgttatga

SEQ ID NO: 588369 - DNA, 25 bp, Mus musculus
ggaattctgattcattgccacatag

SEQ ID NO: 588370 - DNA, 25 bp, Mus musculus
ggaattctgattcgctgacgtctga

SEQ ID NO: 588371 - DNA, 25 bp, Mus musculus
ggaattctgattgattgccacatag

SEQ ID NO: 588372 - DNA, 25 bp, Mus musculus
ggaattctgattggctgacgtctga

SEQ ID NO: 588373 - DNA, 25 bp, Mus musculus
ggaattctgatttcagctgttatga

SEQ ID NO: 588374 - DNA, 25 bp, Mus musculus
ggaattctgcagctatccatctagc

SEQ ID NO: 588375 - DNA, 25 bp, Mus musculus
ggaattctgcaggtatccatctagc

SEQ ID NO: 588376 - DNA, 25 bp, Mus musculus
ggaattctgctaaggatacagttga

SEQ ID NO: 588377 - DNA, 25 bp, Mus musculus
ggaattctgctatggatacagttga

SEQ ID NO: 588378 - DNA, 25 bp, Mus musculus
ggaattctgcttccagtcactatta

SEQ ID NO: 588379 - DNA, 25 bp, Mus musculus
ggaattctgcttgcagtcactatta

SEQ ID NO: 588380 - DNA, 25 bp, Mus musculus
ggaattctggtgctttacaggtcca

SEQ ID NO: 588381 - DNA, 25 bp, Mus musculus
ggaattctggtggtttacaggtcca

SEQ ID NO: 588382 - DNA, 25 bp, Mus musculus
ggaattctgtaacctttctgctctt

SEQ ID NO: 588383 - DNA, 25 bp, Mus musculus
ggaattctgtaagctttctgctctt

SEQ ID NO: 588384 - DNA, 25 bp, Mus musculus
ggaattctgtagcacacctcatagg

SEQ ID NO: 588385 - DNA, 25 bp, Mus musculus
ggaattctgtaggacacctcatagg

SEQ ID NO: 588386 - DNA, 25 bp, Mus musculus
ggaattctgttactgataatcgtaa

SEQ ID NO: 588387 - DNA, 25 bp, Mus musculus
ggaattctgttagtgataatcgtaa

SEQ ID NO: 588388 - DNA, 25 bp, Mus musculus
ggaattcttaagatcctaatatact

SEQ ID NO: 588389 - DNA, 25 bp, Mus musculus
ggaattcttaagttcctaatatact

SEQ ID NO: 588390 - DNA, 25 bp, Mus musculus
ggaattcttactatttaaatctcta

SEQ ID NO: 588391 - DNA, 25 bp, Mus musculus
ggaattcttactttttaaatctcta

SEQ ID NO: 588392 - DNA, 25 bp, Mus musculus
ggaattcttcagactgatggctgtt

SEQ ID NO: 588393 - DNA, 25 bp, Mus musculus
ggaattcttcagtctgatggctgtt

SEQ ID NO: 588394 - DNA, 25 bp, Mus musculus
ggaattcttcccagatctgaatttt

SEQ ID NO: 588395 - DNA, 25 bp, Mus musculus
ggaattcttccctgatctgaatttt

SEQ ID NO: 588396 - DNA, 25 bp, Mus musculus
ggaattcttcctatctttatatggt

SEQ ID NO: 588397 - DNA, 25 bp, Mus musculus
ggaattcttcctcttccattattct

SEQ ID NO: 588398 - DNA, 25 bp, Mus musculus
ggaattcttcctgttccattattct

SEQ ID NO: 588399 - DNA, 25 bp, Mus musculus
ggaattcttcctttctttatatggt

SEQ ID NO: 588400 - DNA, 25 bp, Mus musculus
ggaattcttcttccgtgtggcagca

SEQ ID NO: 588401 - DNA, 25 bp, Mus musculus
ggaattcttcttgcgtgtggcagca

SEQ ID NO: 588402 - DNA, 25 bp, Mus musculus
ggaattctttgacttcacttacgat

SEQ ID NO: 588403 - DNA, 25 bp, Mus musculus
ggaattctttgagttcacttacgat

SEQ ID NO: 588404 - DNA, 25 bp, Mus musculus
ggaattgaaactaggccttctgtga

SEQ ID NO: 588405 - DNA, 25 bp, Mus musculus
ggaattgaaacttggccttctgtga

SEQ ID NO: 588406 - DNA, 25 bp, Mus musculus
ggaattgaacgtattgcatcctcct

SEQ ID NO: 588407 - DNA, 25 bp, Mus musculus
ggaattgaacgttttgcatcctcct

SEQ ID NO: 588408 - DNA, 25 bp, Mus musculus
ggaattgaaggccattcacagctac

SEQ ID NO: 588409 - DNA, 25 bp, Mus musculus
ggaattgaaggcgattcacagctac

SEQ ID NO: 588410 - DNA, 25 bp, Mus musculus
ggaattgaatgtccagactgctcac

SEQ ID NO: 588411 - DNA, 25 bp, Mus musculus
ggaattgaatgtgcagactgctcac

SEQ ID NO: 588412 - DNA, 25 bp, Mus musculus
ggaattgacattcttacagctttaa

SEQ ID NO: 588413 - DNA, 25 bp, Mus musculus
ggaattgacattgttacagctttaa

SEQ ID NO: 588414 - DNA, 25 bp, Mus musculus
ggaattgaccccattaatatgttaa

SEQ ID NO: 588415 - DNA, 25 bp, Mus musculus
ggaattgacccctttaatatgttaa

SEQ ID NO: 588416 - DNA, 25 bp, Mus musculus
ggaattgacctaattttagctcgta

SEQ ID NO: 588417 - DNA, 25 bp, Mus musculus
ggaattgacctatttttagctcgta

SEQ ID NO: 588418 - DNA, 25 bp, Mus musculus
ggaattgactacatttttgaaaaat

SEQ ID NO: 588419 - DNA, 25 bp, Mus musculus
ggaattgactacttttttgaaaaat

SEQ ID NO: 588420 - DNA, 25 bp, Mus musculus
ggaattgacttgcacttgctacata

SEQ ID NO: 588421 - DNA, 25 bp, Mus musculus
ggaattgacttggacttgctacata

SEQ ID NO: 588422 - DNA, 25 bp, Mus musculus
ggaattgagctgagactttaaggca

SEQ ID NO: 588423 - DNA, 25 bp, Mus musculus
ggaattgagctgtgactttaaggca

SEQ ID NO: 588424 - DNA, 25 bp, Mus musculus
ggaattgagtccaagctttgcgtaa

SEQ ID NO: 588425 - DNA, 25 bp, Mus musculus
ggaattgagtcccagtttcagccaa

SEQ ID NO: 588426 - DNA, 25 bp, Mus musculus
ggaattgagtccgagtttcagccaa

SEQ ID NO: 588427 - DNA, 25 bp, Mus musculus
ggaattgagtcctagctttgcgtaa

SEQ ID NO: 588428 - DNA, 25 bp, Mus musculus
ggaattgagtggcacttgctcctcc

SEQ ID NO: 588429 - DNA, 25 bp, Mus musculus
ggaattgagtgggacttgctcctcc

SEQ ID NO: 588430 - DNA, 25 bp, Mus musculus
ggaattgagtttaacccgagccatc

SEQ ID NO: 588431 - DNA, 25 bp, Mus musculus
ggaattgagttttacccgagccatc

SEQ ID NO: 588432 - DNA, 25 bp, Mus musculus
ggaattgatgacaaccagcccagat

SEQ ID NO: 588433 - DNA, 25 bp, Mus musculus
ggaattgatgactaccagcccagat

SEQ ID NO: 588434 - DNA, 25 bp, Mus musculus
ggaattgatgcaaacaagctgtctt

SEQ ID NO: 588435 - DNA, 25 bp, Mus musculus
ggaattgatgcatacaagctgtctt

SEQ ID NO: 588436 - DNA, 25 bp, Mus musculus
ggaattgatgctacacatgagtctt

SEQ ID NO: 588437 - DNA, 25 bp, Mus musculus
ggaattgatgcttcacatgagtctt

SEQ ID NO: 588438 - DNA, 25 bp, Mus musculus
ggaattgatgtaccttttttatgat

SEQ ID NO: 588439 - DNA, 25 bp, Mus musculus
ggaattgatgtagcttttttatgat

SEQ ID NO: 588440 - DNA, 25 bp, Mus musculus
ggaattgattcccagcttggttact

SEQ ID NO: 588441 - DNA, 25 bp, Mus musculus
ggaattgattccgagcttggttact

SEQ ID NO: 588442 - DNA, 25 bp, Mus musculus
ggaattgattctccagagatccaca

SEQ ID NO: 588443 - DNA, 25 bp, Mus musculus
ggaattgattctgcagagatccaca

SEQ ID NO: 588444 - DNA, 25 bp, Mus musculus
ggaattgatttgcattgaacacaaa

SEQ ID NO: 588445 - DNA, 25 bp, Mus musculus
ggaattgatttggattgaacacaaa

SEQ ID NO: 588446 - DNA, 25 bp, Mus musculus
ggaattgcaacaatagctccaagaa

SEQ ID NO: 588447 - DNA, 25 bp, Mus musculus
ggaattgcaacattagctccaagaa

SEQ ID NO: 588448 - DNA, 25 bp, Mus musculus
ggaattgcacagacacaggctccct

SEQ ID NO: 588449 - DNA, 25 bp, Mus musculus
ggaattgcacagtcacaggctccct

SEQ ID NO: 588450 - DNA, 25 bp, Mus musculus
ggaattgcaggcagactgccctgct

SEQ ID NO: 588451 - DNA, 25 bp, Mus musculus
ggaattgcaggctgactgccctgct

SEQ ID NO: 588452 - DNA, 25 bp, Mus musculus
ggaattgccacacaaaccactcaga

SEQ ID NO: 588453 - DNA, 25 bp, Mus musculus
ggaattgccacagaaaccactcaga

SEQ ID NO: 588454 - DNA, 25 bp, Mus musculus
ggaattgcccttattcatttggctc

SEQ ID NO: 588455 - DNA, 25 bp, Mus musculus
ggaattgccctttttcatttggctc

SEQ ID NO: 588456 - DNA, 25 bp, Mus musculus
ggaattgcctccattaaaactgtat

SEQ ID NO: 588457 - DNA, 25 bp, Mus musculus
ggaattgcctcctttaaaactgtat

SEQ ID NO: 588458 - DNA, 25 bp, Mus musculus
ggaattgcctttagtcatatgctgt

SEQ ID NO: 588459 - DNA, 25 bp, Mus musculus
ggaattgccttttgtcatatgctgt

SEQ ID NO: 588460 - DNA, 25 bp, Mus musculus
ggaattgctattataccacccctct

SEQ ID NO: 588461 - DNA, 25 bp, Mus musculus
ggaattgctattttaccacccctct

SEQ ID NO: 588462 - DNA, 25 bp, Mus musculus
ggaattgctggaactttgtttgctt

SEQ ID NO: 588463 - DNA, 25 bp, Mus musculus
ggaattgctggatctttgtttgctt

SEQ ID NO: 588464 - DNA, 25 bp, Mus musculus
ggaattgctgtacctccaagagcca

SEQ ID NO: 588465 - DNA, 25 bp, Mus musculus
ggaattgctgtagctccaagagcca

SEQ ID NO: 588466 - DNA, 25 bp, Mus musculus
ggaattgcttaactttcagctcaga

SEQ ID NO: 588467 - DNA, 25 bp, Mus musculus
ggaattgcttaagtttcagctcaga

SEQ ID NO: 588468 - DNA, 25 bp, Mus musculus
ggaattgcttcacttctctagtcaa

SEQ ID NO: 588469 - DNA, 25 bp, Mus musculus
ggaattgcttcagttctctagtcaa

SEQ ID NO: 588470 - DNA, 25 bp, Mus musculus
ggaattgcttcgagtcattgccaca

SEQ ID NO: 588471 - DNA, 25 bp, Mus musculus
ggaattgcttcgtgtcattgccaca

SEQ ID NO: 588472 - DNA, 25 bp, Mus musculus
ggaattggaaacatcatcacatcaa

SEQ ID NO: 588473 - DNA, 25 bp, Mus musculus
ggaattggaaacttcatcacatcaa

SEQ ID NO: 588474 - DNA, 25 bp, Mus musculus
ggaattggaatcaaattagcatgtc

SEQ ID NO: 588475 - DNA, 25 bp, Mus musculus
ggaattggaatctaattagcatgtc

SEQ ID NO: 588476 - DNA, 25 bp, Mus musculus
ggaattggacgtagcccatcagtac

SEQ ID NO: 588477 - DNA, 25 bp, Mus musculus
ggaattggacgttgcccatcagtac

SEQ ID NO: 588478 - DNA, 25 bp, Mus musculus
ggaattggcgcaccccgtaggacca

SEQ ID NO: 588479 - DNA, 25 bp, Mus musculus
ggaattggcgcagcccgtaggacca

SEQ ID NO: 588480 - DNA, 25 bp, Mus musculus
ggaattggctagagctcttacccga

SEQ ID NO: 588481 - DNA, 25 bp, Mus musculus
ggaattggctagtgctcttacccga

SEQ ID NO: 588482 - DNA, 25 bp, Mus musculus
ggaattgggaccatgagacgcctaa

SEQ ID NO: 588483 - DNA, 25 bp, Mus musculus
ggaattgggaccttgagacgcctaa

SEQ ID NO: 588484 - DNA, 25 bp, Mus musculus
ggaattgggatgaatttccactctt

SEQ ID NO: 588485 - DNA, 25 bp, Mus musculus
ggaattgggatgtatttccactctt

SEQ ID NO: 588486 - DNA, 25 bp, Mus musculus
ggaattggtagcagtgtgattccgt

SEQ ID NO: 588487 - DNA, 25 bp, Mus musculus
ggaattggtagctgtgtgattccgt

SEQ ID NO: 588488 - DNA, 25 bp, Mus musculus
ggaattggttcaatttcctgttcag

SEQ ID NO: 588489 - DNA, 25 bp, Mus musculus
ggaattggttcattttcctgttcag

SEQ ID NO: 588490 - DNA, 25 bp, Mus musculus
ggaattgtacctcgatcttaccatt

SEQ ID NO: 588491 - DNA, 25 bp, Mus musculus
ggaattgtacctggatcttaccatt

SEQ ID NO: 588492 - DNA, 25 bp, Mus musculus
ggaattgtagacatcgccgctggtc

SEQ ID NO: 588493 - DNA, 25 bp, Mus musculus
ggaattgtagacttcgccgctggtc

SEQ ID NO: 588494 - DNA, 25 bp, Mus musculus
ggaattgtcaaacctggaccaggca

SEQ ID NO: 588495 - DNA, 25 bp, Mus musculus
ggaattgtcaaagctggaccaggca

SEQ ID NO: 588496 - DNA, 25 bp, Mus musculus
ggaattgtcaagcaaaactcaaagt

SEQ ID NO: 588497 - DNA, 25 bp, Mus musculus
ggaattgtcaaggaaaactcaaagt

SEQ ID NO: 588498 - DNA, 25 bp, Mus musculus
ggaattgtcacactactcgggaaag

SEQ ID NO: 588499 - DNA, 25 bp, Mus musculus
ggaattgtcacagtactcgggaaag

SEQ ID NO: 588500 - DNA, 25 bp, Mus musculus
ggaattgtcatcagatcaaagaata

SEQ ID NO: 588501 - DNA, 25 bp, Mus musculus
ggaattgtcatctgatcaaagaata

SEQ ID NO: 588502 - DNA, 25 bp, Mus musculus
ggaattgtcatgatggcagccctca

SEQ ID NO: 588503 - DNA, 25 bp, Mus musculus
ggaattgtcatgttggcagccctca

SEQ ID NO: 588504 - DNA, 25 bp, Mus musculus
ggaattgtctagctgtgtttgtgta

SEQ ID NO: 588505 - DNA, 25 bp, Mus musculus
ggaattgtctaggtgtgtttgtgta

SEQ ID NO: 588506 - DNA, 25 bp, Mus musculus
ggaattgtctttaagttgacagaac

SEQ ID NO: 588507 - DNA, 25 bp, Mus musculus
ggaattgtcttttagttgacagaac

SEQ ID NO: 588508 - DNA, 25 bp, Mus musculus
ggaattgtgaaaacatcccgccact

SEQ ID NO: 588509 - DNA, 25 bp, Mus musculus
ggaattgtgaaatcatcccgccact

SEQ ID NO: 588510 - DNA, 25 bp, Mus musculus
ggaattgtgacgatcctcatgaatg

SEQ ID NO: 588511 - DNA, 25 bp, Mus musculus
ggaattgtgacgttcctcatgaatg

SEQ ID NO: 588512 - DNA, 25 bp, Mus musculus
ggaattgtgttcacggtgatgcctg

SEQ ID NO: 588513 - DNA, 25 bp, Mus musculus
ggaattgtgttctcggtgatgcctg

SEQ ID NO: 588514 - DNA, 25 bp, Mus musculus
ggaattgttaccattggaattgagg

SEQ ID NO: 588515 - DNA, 25 bp, Mus musculus
ggaattgttacctttggaattgagg

SEQ ID NO: 588516 - DNA, 25 bp, Mus musculus
ggaattgttcagaatggaattgttc

SEQ ID NO: 588517 - DNA, 25 bp, Mus musculus
ggaattgttcagtatggaattgttc

SEQ ID NO: 588518 - DNA, 25 bp, Mus musculus
ggaattgtttagacacaactttgca

SEQ ID NO: 588519 - DNA, 25 bp, Mus musculus
ggaattgtttagtcacaactttgca

SEQ ID NO: 588520 - DNA, 25 bp, Mus musculus
ggaattgtttcacggaagcccacat

SEQ ID NO: 588521 - DNA, 25 bp, Mus musculus
ggaattgtttcagggaagcccacat

SEQ ID NO: 588522 - DNA, 25 bp, Mus musculus
ggaattgtttctctccaatcaggaa

SEQ ID NO: 588523 - DNA, 25 bp, Mus musculus
ggaattgtttctgtccaatcaggaa

SEQ ID NO: 588524 - DNA, 25 bp, Mus musculus
ggaattgtttgccttgctgaatagc

SEQ ID NO: 588525 - DNA, 25 bp, Mus musculus
ggaattgtttgcgttgctgaatagc

SEQ ID NO: 588526 - DNA, 25 bp, Mus musculus
ggaatttaaagtcccgacaagcata

SEQ ID NO: 588527 - DNA, 25 bp, Mus musculus
ggaatttaaagtgccgacaagcata

SEQ ID NO: 588528 - DNA, 25 bp, Mus musculus
ggaatttataccacatagcgcatcg

SEQ ID NO: 588529 - DNA, 25 bp, Mus musculus
ggaatttatacctcatagcgcatcg

SEQ ID NO: 588530 - DNA, 25 bp, Mus musculus
ggaatttatcttagaggcccatata

SEQ ID NO: 588531 - DNA, 25 bp, Mus musculus
ggaatttatctttgaggcccatata

SEQ ID NO: 588532 - DNA, 25 bp, Mus musculus
ggaatttattcccagagaagagtac

SEQ ID NO: 588533 - DNA, 25 bp, Mus musculus
ggaatttattccgagagaagagtac

SEQ ID NO: 588534 - DNA, 25 bp, Mus musculus
ggaatttcacctatccattttgttg

SEQ ID NO: 588535 - DNA, 25 bp, Mus musculus
ggaatttcacctctcaaaccaaact

SEQ ID NO: 588536 - DNA, 25 bp, Mus musculus
ggaatttcacctgtcaaaccaaact

SEQ ID NO: 588537 - DNA, 25 bp, Mus musculus
ggaatttcacctttccattttgttg

SEQ ID NO: 588538 - DNA, 25 bp, Mus musculus
ggaatttcacttactgagcgttttt

SEQ ID NO: 588539 - DNA, 25 bp, Mus musculus
ggaatttcactttctgagcgttttt

SEQ ID NO: 588540 - DNA, 25 bp, Mus musculus
ggaatttcagtccttcatatctaaa

SEQ ID NO: 588541 - DNA, 25 bp, Mus musculus
ggaatttcagtcgttcatatctaaa

SEQ ID NO: 588542 - DNA, 25 bp, Mus musculus
ggaatttccataaggtgaccaaggc

SEQ ID NO: 588543 - DNA, 25 bp, Mus musculus
ggaatttccatatggtgaccaaggc

SEQ ID NO: 588544 - DNA, 25 bp, Mus musculus
ggaatttcctgtcacattcacacaa

SEQ ID NO: 588545 - DNA, 25 bp, Mus musculus
ggaatttcctgtgacattcacacaa

SEQ ID NO: 588546 - DNA, 25 bp, Mus musculus
ggaatttccttgatgtgtcttttct

SEQ ID NO: 588547 - DNA, 25 bp, Mus musculus
ggaatttccttgttgtgtcttttct

SEQ ID NO: 588548 - DNA, 25 bp, Mus musculus
ggaatttcgatccaacaaagtgtta

SEQ ID NO: 588549 - DNA, 25 bp, Mus musculus
ggaatttcgatcgaacaaagtgtta

SEQ ID NO: 588550 - DNA, 25 bp, Mus musculus
ggaatttctactagtatgcacagca

SEQ ID NO: 588551 - DNA, 25 bp, Mus musculus
ggaatttctacttgtatgcacagca

SEQ ID NO: 588552 - DNA, 25 bp, Mus musculus
ggaatttctcctacagactgtatga

SEQ ID NO: 588553 - DNA, 25 bp, Mus musculus
ggaatttctccttcagactgtatga

SEQ ID NO: 588554 - DNA, 25 bp, Mus musculus
ggaatttctctccaaggactctttg

SEQ ID NO: 588555 - DNA, 25 bp, Mus musculus
ggaatttctctcgaaggactctttg

SEQ ID NO: 588556 - DNA, 25 bp, Mus musculus
ggaatttctgttaaatttctctatt

SEQ ID NO: 588557 - DNA, 25 bp, Mus musculus
ggaatttctgtttaatttctctatt

SEQ ID NO: 588558 - DNA, 25 bp, Mus musculus
ggaatttcttgcagtttgatctgaa

SEQ ID NO: 588559 - DNA, 25 bp, Mus musculus
ggaatttcttgctgtttgatctgaa

SEQ ID NO: 588560 - DNA, 25 bp, Mus musculus
ggaatttctttcacccaatacaggg

SEQ ID NO: 588561 - DNA, 25 bp, Mus musculus
ggaatttctttccagctttgaggag

SEQ ID NO: 588562 - DNA, 25 bp, Mus musculus
ggaatttctttcgagctttgaggag

SEQ ID NO: 588563 - DNA, 25 bp, Mus musculus
ggaatttctttctcccaatacaggg

SEQ ID NO: 588564 - DNA, 25 bp, Mus musculus
ggaatttctttgaattgtattcaat

SEQ ID NO: 588565 - DNA, 25 bp, Mus musculus
ggaatttctttgtattgtattcaat

SEQ ID NO: 588566 - DNA, 25 bp, Mus musculus
ggaatttgatagatattgatgtgca

SEQ ID NO: 588567 - DNA, 25 bp, Mus musculus
ggaatttgatagttattgatgtgca

SEQ ID NO: 588568 - DNA, 25 bp, Mus musculus
ggaatttgatttcagccttccagct

SEQ ID NO: 588569 - DNA, 25 bp, Mus musculus
ggaatttgatttgagccttccagct

SEQ ID NO: 588570 - DNA, 25 bp, Mus musculus
ggaatttgcagcaggaatcacattt

SEQ ID NO: 588571 - DNA, 25 bp, Mus musculus
ggaatttgcagctggaatcacattt

SEQ ID NO: 588572 - DNA, 25 bp, Mus musculus
ggaatttgcaggacatcaaggccct

SEQ ID NO: 588573 - DNA, 25 bp, Mus musculus
ggaatttgcaggtcatcaaggccct

SEQ ID NO: 588574 - DNA, 25 bp, Mus musculus
ggaatttgccaaatctcagatccag

SEQ ID NO: 588575 - DNA, 25 bp, Mus musculus
ggaatttgccaattctcagatccag

SEQ ID NO: 588576 - DNA, 25 bp, Mus musculus
ggaatttgcctactatactttctga

SEQ ID NO: 588577 - DNA, 25 bp, Mus musculus
ggaatttgcctagtatactttctga

SEQ ID NO: 588578 - DNA, 25 bp, Mus musculus
ggaatttggaacatctatacctaca

SEQ ID NO: 588579 - DNA, 25 bp, Mus musculus
ggaatttggaacttctatacctaca

SEQ ID NO: 588580 - DNA, 25 bp, Mus musculus
ggaatttggcaaacttgaacccttt

SEQ ID NO: 588581 - DNA, 25 bp, Mus musculus
ggaatttggcaatcttgaacccttt

SEQ ID NO: 588582 - DNA, 25 bp, Mus musculus
ggaatttgggaaagcacgccctaaa

SEQ ID NO: 588583 - DNA, 25 bp, Mus musculus
ggaatttgggaatgcacgccctaaa

SEQ ID NO: 588584 - DNA, 25 bp, Mus musculus
ggaatttgggccctgccaacaggca

SEQ ID NO: 588585 - DNA, 25 bp, Mus musculus
ggaatttgggccgtgccaacaggca

SEQ ID NO: 588586 - DNA, 25 bp, Mus musculus
ggaatttgggctaaggctggaactt

SEQ ID NO: 588587 - DNA, 25 bp, Mus musculus
ggaatttgggcttaggctggaactt

SEQ ID NO: 588588 - DNA, 25 bp, Mus musculus
ggaatttgtcaaactctatttcaga

SEQ ID NO: 588589 - DNA, 25 bp, Mus musculus
ggaatttgtcaatctctatttcaga

SEQ ID NO: 588590 - DNA, 25 bp, Mus musculus
ggaatttgtgtaacctcattactgt

SEQ ID NO: 588591 - DNA, 25 bp, Mus musculus
ggaatttgtgtatcctcattactgt

SEQ ID NO: 588592 - DNA, 25 bp, Mus musculus
ggaatttgtgtcagccagctttgat

SEQ ID NO: 588593 - DNA, 25 bp, Mus musculus
ggaatttgtgtctgccagctttgat

SEQ ID NO: 588594 - DNA, 25 bp, Mus musculus
ggaattttagtcaattacgcattta

SEQ ID NO: 588595 - DNA, 25 bp, Mus musculus
ggaattttagtctattacgcattta

SEQ ID NO: 588596 - DNA, 25 bp, Mus musculus
ggaattttataaaacttctggcagc

SEQ ID NO: 588597 - DNA, 25 bp, Mus musculus
ggaattttataatacttctggcagc

SEQ ID NO: 588598 - DNA, 25 bp, Mus musculus
ggaattttatgcagtgatccaatac

SEQ ID NO: 588599 - DNA, 25 bp, Mus musculus
ggaattttatgctgtgatccaatac

SEQ ID NO: 588600 - DNA, 25 bp, Mus musculus
ggaattttatgtcagtgtcagttac

SEQ ID NO: 588601 - DNA, 25 bp, Mus musculus
ggaattttatgtgagtgtcagttac

SEQ ID NO: 588602 - DNA, 25 bp, Mus musculus
ggaattttatttactggacgcatca

SEQ ID NO: 588603 - DNA, 25 bp, Mus musculus
ggaattttattttctggacgcatca

SEQ ID NO: 588604 - DNA, 25 bp, Mus musculus
ggaattttcaacatgggtctatgca

SEQ ID NO: 588605 - DNA, 25 bp, Mus musculus
ggaattttcaacttgggtctatgca

SEQ ID NO: 588606 - DNA, 25 bp, Mus musculus
ggaattttcaccatactgtgtcctt

SEQ ID NO: 588607 - DNA, 25 bp, Mus musculus
ggaattttcaccttactgtgtcctt

SEQ ID NO: 588608 - DNA, 25 bp, Mus musculus
ggaattttcagaacatcggctgcat

SEQ ID NO: 588609 - DNA, 25 bp, Mus musculus
ggaattttcagacatcctgcttcga

SEQ ID NO: 588610 - DNA, 25 bp, Mus musculus
ggaattttcagagatcctgcttcga

SEQ ID NO: 588611 - DNA, 25 bp, Mus musculus
ggaattttcagatcatcggctgcat

SEQ ID NO: 588612 - DNA, 25 bp, Mus musculus
ggaattttccacaaaagtacagagt

SEQ ID NO: 588613 - DNA, 25 bp, Mus musculus
ggaattttccactaaagtacagagt

SEQ ID NO: 588614 - DNA, 25 bp, Mus musculus
ggaattttccagagtgcaaacattt

SEQ ID NO: 588615 - DNA, 25 bp, Mus musculus
ggaattttccagcactactttggca

SEQ ID NO: 588616 - DNA, 25 bp, Mus musculus
ggaattttccaggactactttggca

SEQ ID NO: 588617 - DNA, 25 bp, Mus musculus
ggaattttccagtgtgcaaacattt

SEQ ID NO: 588618 - DNA, 25 bp, Mus musculus
ggaattttctagactcttacctcat

SEQ ID NO: 588619 - DNA, 25 bp, Mus musculus
ggaattttctagtctcttacctcat

SEQ ID NO: 588620 - DNA, 25 bp, Mus musculus
ggaattttctgcatgtaccttcaac

SEQ ID NO: 588621 - DNA, 25 bp, Mus musculus
ggaattttctgcttgtaccttcaac

SEQ ID NO: 588622 - DNA, 25 bp, Mus musculus
ggaattttgagccaagcaagccctt

SEQ ID NO: 588623 - DNA, 25 bp, Mus musculus
ggaattttgagcgaagcaagccctt

SEQ ID NO: 588624 - DNA, 25 bp, Mus musculus
ggaattttgcagatgtcctcagtct

SEQ ID NO: 588625 - DNA, 25 bp, Mus musculus
ggaattttgcagttgtcctcagtct

SEQ ID NO: 588626 - DNA, 25 bp, Mus musculus
ggaattttggctacctctattttcg

SEQ ID NO: 588627 - DNA, 25 bp, Mus musculus
ggaattttggcttcctctattttcg

SEQ ID NO: 588628 - DNA, 25 bp, Mus musculus
ggaattttggttataagctctgtat

SEQ ID NO: 588629 - DNA, 25 bp, Mus musculus
ggaattttggttttaagctctgtat

SEQ ID NO: 588630 - DNA, 25 bp, Mus musculus
ggaattttgttaacctgtagctaag

SEQ ID NO: 588631 - DNA, 25 bp, Mus musculus
ggaattttgttatcctgtagctaag

SEQ ID NO: 588632 - DNA, 25 bp, Mus musculus
ggaatttttagcatagttctaactc

SEQ ID NO: 588633 - DNA, 25 bp, Mus musculus
ggaatttttagcttagttctaactc

SEQ ID NO: 588634 - DNA, 25 bp, Mus musculus
ggaatttttaggacactcatatcga

SEQ ID NO: 588635 - DNA, 25 bp, Mus musculus
ggaatttttaggcagtaagccacta

SEQ ID NO: 588636 - DNA, 25 bp, Mus musculus
ggaatttttagggagtaagccacta

SEQ ID NO: 588637 - DNA, 25 bp, Mus musculus
ggaatttttaggtcactcatatcga

SEQ ID NO: 588638 - DNA, 25 bp, Mus musculus
ggaatttttcctagcttaggctgtt

SEQ ID NO: 588639 - DNA, 25 bp, Mus musculus
ggaatttttccttgcttaggctgtt

SEQ ID NO: 588640 - DNA, 25 bp, Mus musculus
ggaatttttgtcaatcaatttcagg

SEQ ID NO: 588641 - DNA, 25 bp, Mus musculus
ggaatttttgtctatcaatttcagg

SEQ ID NO: 588642 - DNA, 25 bp, Mus musculus
ggacaaaacccaacacatatacata

SEQ ID NO: 588643 - DNA, 25 bp, Mus musculus
ggacaaaacccatcacatatacata

SEQ ID NO: 588644 - DNA, 25 bp, Mus musculus
ggacaaaacgtgctgccctgtgctg

SEQ ID NO: 588645 - DNA, 25 bp, Mus musculus
ggacaaaacgtggtgccctgtgctg

SEQ ID NO: 588646 - DNA, 25 bp, Mus musculus
ggacaaaagaatatccattcgagca

SEQ ID NO: 588647 - DNA, 25 bp, Mus musculus
ggacaaaagaatttccattcgagca

SEQ ID NO: 588648 - DNA, 25 bp, Mus musculus
ggacaaaagacactaaccctccttg

SEQ ID NO: 588649 - DNA, 25 bp, Mus musculus
ggacaaaagacagtaaccctccttg

SEQ ID NO: 588650 - DNA, 25 bp, Mus musculus
ggacaaaagcccagccttagctctg

SEQ ID NO: 588651 - DNA, 25 bp, Mus musculus
ggacaaaagccctgccttagctctg

SEQ ID NO: 588652 - DNA, 25 bp, Mus musculus
ggacaaaaggaaccccgcgccgcga

SEQ ID NO: 588653 - DNA, 25 bp, Mus musculus
ggacaaaaggaagcccgcgccgcga

SEQ ID NO: 588654 - DNA, 25 bp, Mus musculus
ggacaaaaggccagcaccacaacaa

SEQ ID NO: 588655 - DNA, 25 bp, Mus musculus
ggacaaaaggcctgcaccacaacaa

SEQ ID NO: 588656 - DNA, 25 bp, Mus musculus
ggacaaaagtatctgccacccctac

SEQ ID NO: 588657 - DNA, 25 bp, Mus musculus
ggacaaaagtatgtgccacccctac

SEQ ID NO: 588658 - DNA, 25 bp, Mus musculus
ggacaaaatcgcctctatctggatc

SEQ ID NO: 588659 - DNA, 25 bp, Mus musculus
ggacaaaatcgcgtctatctggatc

SEQ ID NO: 588660 - DNA, 25 bp, Mus musculus
ggacaaaatggtccccccggttcag

SEQ ID NO: 588661 - DNA, 25 bp, Mus musculus
ggacaaaatggtgcccccggttcag

SEQ ID NO: 588662 - DNA, 25 bp, Mus musculus
ggacaaacacacacaactttgatga

SEQ ID NO: 588663 - DNA, 25 bp, Mus musculus
ggacaaacacactcaactttgatga

SEQ ID NO: 588664 - DNA, 25 bp, Mus musculus
ggacaaacacctaggtgctccataa

SEQ ID NO: 588665 - DNA, 25 bp, Mus musculus
ggacaaacaccttggtgctccataa

SEQ ID NO: 588666 - DNA, 25 bp, Mus musculus
ggacaaacagttctttttacaatgg

SEQ ID NO: 588667 - DNA, 25 bp, Mus musculus
ggacaaacagttgtttttacaatgg

SEQ ID NO: 588668 - DNA, 25 bp, Mus musculus
ggacaaaccagcacttccgagattg

SEQ ID NO: 588669 - DNA, 25 bp, Mus musculus
ggacaaaccagctcttccgagattg

SEQ ID NO: 588670 - DNA, 25 bp, Mus musculus
ggacaaacccaacagcaatgctcga

SEQ ID NO: 588671 - DNA, 25 bp, Mus musculus
ggacaaacccaagagcaatgctcga

SEQ ID NO: 588672 - DNA, 25 bp, Mus musculus
ggacaaacctggcagttgagctttg

SEQ ID NO: 588673 - DNA, 25 bp, Mus musculus
ggacaaacctgggagttgagctttg

SEQ ID NO: 588674 - DNA, 25 bp, Mus musculus
ggacaaacgtctacgggaattgcct

SEQ ID NO: 588675 - DNA, 25 bp, Mus musculus
ggacaaacgtcttcgggaattgcct

SEQ ID NO: 588676 - DNA, 25 bp, Mus musculus
ggacaaactattacaatcaagaaag

SEQ ID NO: 588677 - DNA, 25 bp, Mus musculus
ggacaaactatttcaatcaagaaag

SEQ ID NO: 588678 - DNA, 25 bp, Mus musculus
ggacaaactccaattggtaatccac

SEQ ID NO: 588679 - DNA, 25 bp, Mus musculus
ggacaaactccatttggtaatccac

SEQ ID NO: 588680 - DNA, 25 bp, Mus musculus
ggacaaagacctctggttgagtaac

SEQ ID NO: 588681 - DNA, 25 bp, Mus musculus
ggacaaagacctgtggttgagtaac

SEQ ID NO: 588682 - DNA, 25 bp, Mus musculus
ggacaaagcagccacacgtaagcag

SEQ ID NO: 588683 - DNA, 25 bp, Mus musculus
ggacaaagcagcgacacgtaagcag

SEQ ID NO: 588684 - DNA, 25 bp, Mus musculus
ggacaaagctggacactttcccaac

SEQ ID NO: 588685 - DNA, 25 bp, Mus musculus
ggacaaagctggtcactttcccaac

SEQ ID NO: 588686 - DNA, 25 bp, Mus musculus
ggacaaagcttgacttgtttccaat

SEQ ID NO: 588687 - DNA, 25 bp, Mus musculus
ggacaaagcttgtcttgtttccaat

SEQ ID NO: 588688 - DNA, 25 bp, Mus musculus
ggacaaaggcagagattttcctact

SEQ ID NO: 588689 - DNA, 25 bp, Mus musculus
ggacaaaggcagtgattttcctact

SEQ ID NO: 588690 - DNA, 25 bp, Mus musculus
ggacaaaggcttatcaaggctctga

SEQ ID NO: 588691 - DNA, 25 bp, Mus musculus
ggacaaaggcttttcaaggctctga

SEQ ID NO: 588692 - DNA, 25 bp, Mus musculus
ggacaaagggccctgacattagagt

SEQ ID NO: 588693 - DNA, 25 bp, Mus musculus
ggacaaagggccgtgacattagagt

SEQ ID NO: 588694 - DNA, 25 bp, Mus musculus
ggacaaaggtaccttccagttctcg

SEQ ID NO: 588695 - DNA, 25 bp, Mus musculus
ggacaaaggtacgttccagttctcg

SEQ ID NO: 588696 - DNA, 25 bp, Mus musculus
ggacaaaggtcaccctcgggtgcca

SEQ ID NO: 588697 - DNA, 25 bp, Mus musculus
ggacaaaggtcagcctcgggtgcca

SEQ ID NO: 588698 - DNA, 25 bp, Mus musculus
ggacaaaggtcgagccatgttctta

SEQ ID NO: 588699 - DNA, 25 bp, Mus musculus
ggacaaaggtcgtgccatgttctta

SEQ ID NO: 588700 - DNA, 25 bp, Mus musculus
ggacaaaggtctccaacaattttga

SEQ ID NO: 588701 - DNA, 25 bp, Mus musculus
ggacaaaggtctgcaacaattttga

SEQ ID NO: 588702 - DNA, 25 bp, Mus musculus
ggacaaataatgagagccctggcaa

SEQ ID NO: 588703 - DNA, 25 bp, Mus musculus
ggacaaataatgtgagccctggcaa

SEQ ID NO: 588704 - DNA, 25 bp, Mus musculus
ggacaaatcactccatttgatttgg

SEQ ID NO: 588705 - DNA, 25 bp, Mus musculus
ggacaaatcactgcatttgatttgg

SEQ ID NO: 588706 - DNA, 25 bp, Mus musculus
ggacaaatcagtcaacttcctgcat

SEQ ID NO: 588707 - DNA, 25 bp, Mus musculus
ggacaaatcagtgaacttcctgcat

SEQ ID NO: 588708 - DNA, 25 bp, Mus musculus
ggacaaatctacacaggtgaatggg

SEQ ID NO: 588709 - DNA, 25 bp, Mus musculus
ggacaaatctactcaggtgaatggg

SEQ ID NO: 588710 - DNA, 25 bp, Mus musculus
ggacaaatctagcagcccggcttgg

SEQ ID NO: 588711 - DNA, 25 bp, Mus musculus
ggacaaatctaggagcccggcttgg

SEQ ID NO: 588712 - DNA, 25 bp, Mus musculus
ggacaaatctccattcaacagcccg

SEQ ID NO: 588713 - DNA, 25 bp, Mus musculus
ggacaaatctcctttcaacagcccg

SEQ ID NO: 588714 - DNA, 25 bp, Mus musculus
ggacaaatctgaacacactttcctc

SEQ ID NO: 588715 - DNA, 25 bp, Mus musculus
ggacaaatctgaactatcgaggttt

SEQ ID NO: 588716 - DNA, 25 bp, Mus musculus
ggacaaatctgatcacactttcctc

SEQ ID NO: 588717 - DNA, 25 bp, Mus musculus
ggacaaatctgatctatcgaggttt

SEQ ID NO: 588718 - DNA, 25 bp, Mus musculus
ggacaaatctgtccttctttatgag

SEQ ID NO: 588719 - DNA, 25 bp, Mus musculus
ggacaaatctgtgcttctttatgag

SEQ ID NO: 588720 - DNA, 25 bp, Mus musculus
ggacaaatgagaaaccctgggttct

SEQ ID NO: 588721 - DNA, 25 bp, Mus musculus
ggacaaatgagataccctgggttct

SEQ ID NO: 588722 - DNA, 25 bp, Mus musculus
ggacaaatgcccactgttccttgag

SEQ ID NO: 588723 - DNA, 25 bp, Mus musculus
ggacaaatgcccagctcttggtgct

SEQ ID NO: 588724 - DNA, 25 bp, Mus musculus
ggacaaatgccctctgttccttgag

SEQ ID NO: 588725 - DNA, 25 bp, Mus musculus
ggacaaatgccctgctcttggtgct

SEQ ID NO: 588726 - DNA, 25 bp, Mus musculus
ggacaaatgtctccagaaggcctcc

SEQ ID NO: 588727 - DNA, 25 bp, Mus musculus
ggacaaatgtctgcagaaggcctcc

SEQ ID NO: 588728 - DNA, 25 bp, Mus musculus
ggacaaattccccagacacttcaag

SEQ ID NO: 588729 - DNA, 25 bp, Mus musculus
ggacaaattcccgagacacttcaag

SEQ ID NO: 588730 - DNA, 25 bp, Mus musculus
ggacaaattgctctggaagctcaat

SEQ ID NO: 588731 - DNA, 25 bp, Mus musculus
ggacaaattgctgtggaagctcaat

SEQ ID NO: 588732 - DNA, 25 bp, Mus musculus
ggacaaatttccattaactattgag

SEQ ID NO: 588733 - DNA, 25 bp, Mus musculus
ggacaaatttcctttaactattgag

SEQ ID NO: 588734 - DNA, 25 bp, Mus musculus
ggacaaattttacaatctagacaca

SEQ ID NO: 588735 - DNA, 25 bp, Mus musculus
ggacaaattttagaatctagacaca

SEQ ID NO: 588736 - DNA, 25 bp, Mus musculus
ggacaacaagttatgccgctgggca

SEQ ID NO: 588737 - DNA, 25 bp, Mus musculus
ggacaacaagttttgccgctgggca

SEQ ID NO: 588738 - DNA, 25 bp, Mus musculus
ggacaacaatatcatcttctctctt

SEQ ID NO: 588739 - DNA, 25 bp, Mus musculus
ggacaacaatatgatcttctctctt

SEQ ID NO: 588740 - DNA, 25 bp, Mus musculus
ggacaacaatccattcgatgccacg

SEQ ID NO: 588741 - DNA, 25 bp, Mus musculus
ggacaacaatcctttcgatgccacg

SEQ ID NO: 588742 - DNA, 25 bp, Mus musculus
ggacaacaccagagcgagcccggat

SEQ ID NO: 588743 - DNA, 25 bp, Mus musculus
ggacaacaccagtgcgagcccggat

SEQ ID NO: 588744 - DNA, 25 bp, Mus musculus
ggacaacaccataactgtgccttag

SEQ ID NO: 588745 - DNA, 25 bp, Mus musculus
ggacaacaccattactgtgccttag

SEQ ID NO: 588746 - DNA, 25 bp, Mus musculus
ggacaacactcacctggactttgtg

SEQ ID NO: 588747 - DNA, 25 bp, Mus musculus
ggacaacactcagctggactttgtg

SEQ ID NO: 588748 - DNA, 25 bp, Mus musculus
ggacaacactggatcctgggagggt

SEQ ID NO: 588749 - DNA, 25 bp, Mus musculus
ggacaacactggttcctgggagggt

SEQ ID NO: 588750 - DNA, 25 bp, Mus musculus
ggacaacactttctatcttgcctgt

SEQ ID NO: 588751 - DNA, 25 bp, Mus musculus
ggacaacactttgtatcttgcctgt

SEQ ID NO: 588752 - DNA, 25 bp, Mus musculus
ggacaacagatcctgcctgaggtca

SEQ ID NO: 588753 - DNA, 25 bp, Mus musculus
ggacaacagatcgtgcctgaggtca

SEQ ID NO: 588754 - DNA, 25 bp, Mus musculus
ggacaacagcgccaaaagcagtgac

SEQ ID NO: 588755 - DNA, 25 bp, Mus musculus
ggacaacagcgcgaaaagcagtgac

SEQ ID NO: 588756 - DNA, 25 bp, Mus musculus
ggacaacagttgaagttaggcaacg

SEQ ID NO: 588757 - DNA, 25 bp, Mus musculus
ggacaacagttgtagttaggcaacg

SEQ ID NO: 588758 - DNA, 25 bp, Mus musculus
ggacaacatattctgataacgccat

SEQ ID NO: 588759 - DNA, 25 bp, Mus musculus
ggacaacatattgtgataacgccat

SEQ ID NO: 588760 - DNA, 25 bp, Mus musculus
ggacaacatccacactctcttgaaa

SEQ ID NO: 588761 - DNA, 25 bp, Mus musculus
ggacaacatccagactctcttgaaa

SEQ ID NO: 588762 - DNA, 25 bp, Mus musculus
ggacaacatcccagtcagagtcttc

SEQ ID NO: 588763 - DNA, 25 bp, Mus musculus
ggacaacatccctgtcagagtcttc

SEQ ID NO: 588764 - DNA, 25 bp, Mus musculus
ggacaacatggcctggatcagtaaa

SEQ ID NO: 588765 - DNA, 25 bp, Mus musculus
ggacaacatggcgtggatcagtaaa

SEQ ID NO: 588766 - DNA, 25 bp, Mus musculus
ggacaacattatcaaagcagcacca

SEQ ID NO: 588767 - DNA, 25 bp, Mus musculus
ggacaacattatgaaagcagcacca

SEQ ID NO: 588768 - DNA, 25 bp, Mus musculus
ggacaaccaaagcagggcctcaatt

SEQ ID NO: 588769 - DNA, 25 bp, Mus musculus
ggacaaccaaaggagggcctcaatt

SEQ ID NO: 588770 - DNA, 25 bp, Mus musculus
ggacaaccacctaataattcttgca

SEQ ID NO: 588771 - DNA, 25 bp, Mus musculus
ggacaaccaccttataattcttgca

SEQ ID NO: 588772 - DNA, 25 bp, Mus musculus
ggacaaccactgcactgagccactg

SEQ ID NO: 588773 - DNA, 25 bp, Mus musculus
ggacaaccactggactgagccactg

SEQ ID NO: 588774 - DNA, 25 bp, Mus musculus
ggacaaccagcaacaaaaggagata

SEQ ID NO: 588775 - DNA, 25 bp, Mus musculus
ggacaaccagcatcaaaaggagata

SEQ ID NO: 588776 - DNA, 25 bp, Mus musculus
ggacaaccataacatgttctcccct

SEQ ID NO: 588777 - DNA, 25 bp, Mus musculus
ggacaaccataagatgttctcccct

SEQ ID NO: 588778 - DNA, 25 bp, Mus musculus
ggacaaccatcccagtcagaggcat

SEQ ID NO: 588779 - DNA, 25 bp, Mus musculus
ggacaaccatccgagtcagaggcat

SEQ ID NO: 588780 - DNA, 25 bp, Mus musculus
ggacaacccagaacgtatcaccagt

SEQ ID NO: 588781 - DNA, 25 bp, Mus musculus
ggacaacccagatcgtatcaccagt

SEQ ID NO: 588782 - DNA, 25 bp, Mus musculus
ggacaacctgaactatatactgtga

SEQ ID NO: 588783 - DNA, 25 bp, Mus musculus
ggacaacctgaagtatatactgtga

SEQ ID NO: 588784 - DNA, 25 bp, Mus musculus
ggacaacctgcacacattgtatgct

SEQ ID NO: 588785 - DNA, 25 bp, Mus musculus
ggacaacctgcagacattgtatgct

SEQ ID NO: 588786 - DNA, 25 bp, Mus musculus
ggacaacctttgacctaaacacaca

SEQ ID NO: 588787 - DNA, 25 bp, Mus musculus
ggacaacctttgtcctaaacacaca

SEQ ID NO: 588788 - DNA, 25 bp, Mus musculus
ggacaacgacaacggcggcttccaa

SEQ ID NO: 588789 - DNA, 25 bp, Mus musculus
ggacaacgacaagggcggcttccaa

SEQ ID NO: 588790 - DNA, 25 bp, Mus musculus
ggacaacgacaccaagcatcactgc

SEQ ID NO: 588791 - DNA, 25 bp, Mus musculus
ggacaacgacacgaagcatcactgc

SEQ ID NO: 588792 - DNA, 25 bp, Mus musculus
ggacaacgccaactggtacatcact

SEQ ID NO: 588793 - DNA, 25 bp, Mus musculus
ggacaacgccaagtggtacatcact

SEQ ID NO: 588794 - DNA, 25 bp, Mus musculus
ggacaacgccctacgagatgagatg

SEQ ID NO: 588795 - DNA, 25 bp, Mus musculus
ggacaacgcccttcgagatgagatg

SEQ ID NO: 588796 - DNA, 25 bp, Mus musculus
ggacaacgccttcccaccatggaag

SEQ ID NO: 588797 - DNA, 25 bp, Mus musculus
ggacaacgccttgccaccatggaag

SEQ ID NO: 588798 - DNA, 25 bp, Mus musculus
ggacaacggtctcaaccatgttcag

SEQ ID NO: 588799 - DNA, 25 bp, Mus musculus
ggacaacggtctgaaccatgttcag

SEQ ID NO: 588800 - DNA, 25 bp, Mus musculus
ggacaacgtaacacttgtatacaat

SEQ ID NO: 588801 - DNA, 25 bp, Mus musculus
ggacaacgtaactcttgtatacaat

SEQ ID NO: 588802 - DNA, 25 bp, Mus musculus
ggacaacgtagcattaactctgtat

SEQ ID NO: 588803 - DNA, 25 bp, Mus musculus
ggacaacgtagctttaactctgtat

SEQ ID NO: 588804 - DNA, 25 bp, Mus musculus
ggacaacgtgttagacacgggcctg

SEQ ID NO: 588805 - DNA, 25 bp, Mus musculus
ggacaacgtgtttgacacgggcctg

SEQ ID NO: 588806 - DNA, 25 bp, Mus musculus
ggacaacgttatagccacctatgag

SEQ ID NO: 588807 - DNA, 25 bp, Mus musculus
ggacaacgttattgccacctatgag

SEQ ID NO: 588808 - DNA, 25 bp, Mus musculus
ggacaactaagtcgtatctgatctt

SEQ ID NO: 588809 - DNA, 25 bp, Mus musculus
ggacaactaagtggtatctgatctt

SEQ ID NO: 588810 - DNA, 25 bp, Mus musculus
ggacaactatttaacctggaagcct

SEQ ID NO: 588811 - DNA, 25 bp, Mus musculus
ggacaactattttacctggaagcct

SEQ ID NO: 588812 - DNA, 25 bp, Mus musculus
ggacaactccaaatctctacaaatg

SEQ ID NO: 588813 - DNA, 25 bp, Mus musculus
ggacaactccaattctctacaaatg

SEQ ID NO: 588814 - DNA, 25 bp, Mus musculus
ggacaactctccaggtgggtggata

SEQ ID NO: 588815 - DNA, 25 bp, Mus musculus
ggacaactctcctggtgggtggata

SEQ ID NO: 588816 - DNA, 25 bp, Mus musculus
ggacaactgaacatggaaacttaca

SEQ ID NO: 588817 - DNA, 25 bp, Mus musculus
ggacaactgaacttggaaacttaca

SEQ ID NO: 588818 - DNA, 25 bp, Mus musculus
ggacaactgaagagactacccaatt

SEQ ID NO: 588819 - DNA, 25 bp, Mus musculus
ggacaactgaagtgactacccaatt

SEQ ID NO: 588820 - DNA, 25 bp, Mus musculus
ggacaactgactaggacagctgaca

SEQ ID NO: 588821 - DNA, 25 bp, Mus musculus
ggacaactgacttggacagctgaca

SEQ ID NO: 588822 - DNA, 25 bp, Mus musculus
ggacaactgcttactgtttgagagc

SEQ ID NO: 588823 - DNA, 25 bp, Mus musculus
ggacaactgctttctgtttgagagc

SEQ ID NO: 588824 - DNA, 25 bp, Mus musculus
ggacaactggaaacctcactaaggg

SEQ ID NO: 588825 - DNA, 25 bp, Mus musculus
ggacaactggaatcctcactaaggg

SEQ ID NO: 588826 - DNA, 25 bp, Mus musculus
ggacaactggctaagagagcacgct

SEQ ID NO: 588827 - DNA, 25 bp, Mus musculus
ggacaactggcttagagagcacgct

SEQ ID NO: 588828 - DNA, 25 bp, Mus musculus
ggacaacttagccactgtgttgaat

SEQ ID NO: 588829 - DNA, 25 bp, Mus musculus
ggacaacttagcgactgtgttgaat

SEQ ID NO: 588830 - DNA, 25 bp, Mus musculus
ggacaacttcaaacatagcattatg

SEQ ID NO: 588831 - DNA, 25 bp, Mus musculus
ggacaacttcaacatggtcacctat

SEQ ID NO: 588832 - DNA, 25 bp, Mus musculus
ggacaacttcaagatggtcacctat

SEQ ID NO: 588833 - DNA, 25 bp, Mus musculus
ggacaacttcaatcatagcattatg

SEQ ID NO: 588834 - DNA, 25 bp, Mus musculus
ggacaacttcctcgacaaactgtag

SEQ ID NO: 588835 - DNA, 25 bp, Mus musculus
ggacaacttcctggacaaactgtag

SEQ ID NO: 588836 - DNA, 25 bp, Mus musculus
ggacaacttctacaattttgcttca

SEQ ID NO: 588837 - DNA, 25 bp, Mus musculus
ggacaacttctagaattttgcttca

SEQ ID NO: 588838 - DNA, 25 bp, Mus musculus
ggacaacttgaaaccatgacagtct

SEQ ID NO: 588839 - DNA, 25 bp, Mus musculus
ggacaacttgaatccatgacagtct

SEQ ID NO: 588840 - DNA, 25 bp, Mus musculus
ggacaacttgccagaatccatattg

SEQ ID NO: 588841 - DNA, 25 bp, Mus musculus
ggacaacttgcctgaatccatattg

SEQ ID NO: 588842 - DNA, 25 bp, Mus musculus
ggacaacttgtaattacattcctaa

SEQ ID NO: 588843 - DNA, 25 bp, Mus musculus
ggacaacttgtatttacattcctaa

SEQ ID NO: 588844 - DNA, 25 bp, Mus musculus
ggacaacttgttcaatcctgagtga

SEQ ID NO: 588845 - DNA, 25 bp, Mus musculus
ggacaacttgttgaatcctgagtga

SEQ ID NO: 588846 - DNA, 25 bp, Mus musculus
ggacaactttgtagcacttgccttt

SEQ ID NO: 588847 - DNA, 25 bp, Mus musculus
ggacaactttgttgcacttgccttt

SEQ ID NO: 588848 - DNA, 25 bp, Mus musculus
ggacaagaagccagggtaccacctg

SEQ ID NO: 588849 - DNA, 25 bp, Mus musculus
ggacaagaagcctgggtaccacctg

SEQ ID NO: 588850 - DNA, 25 bp, Mus musculus
ggacaagaagttatcattgaagtta

SEQ ID NO: 588851 - DNA, 25 bp, Mus musculus
ggacaagaagttttcattgaagtta

SEQ ID NO: 588852 - DNA, 25 bp, Mus musculus
ggacaagacagccacgccgaagtct

SEQ ID NO: 588853 - DNA, 25 bp, Mus musculus
ggacaagacagcgacgccgaagtct

SEQ ID NO: 588854 - DNA, 25 bp, Mus musculus
ggacaagaccaccaacagcagcgag

SEQ ID NO: 588855 - DNA, 25 bp, Mus musculus
ggacaagaccacgaacagcagcgag

SEQ ID NO: 588856 - DNA, 25 bp, Mus musculus
ggacaagacctcctcattggaatct

SEQ ID NO: 588857 - DNA, 25 bp, Mus musculus
ggacaagacctcgtcattggaatct

SEQ ID NO: 588858 - DNA, 25 bp, Mus musculus
ggacaagacgtccattgtgcatcaa

SEQ ID NO: 588859 - DNA, 25 bp, Mus musculus
ggacaagacgtcgattgtgcatcaa

SEQ ID NO: 588860 - DNA, 25 bp, Mus musculus
ggacaagactggcatgtgttgacat

SEQ ID NO: 588861 - DNA, 25 bp, Mus musculus
ggacaagactgggatgtgttgacat

SEQ ID NO: 588862 - DNA, 25 bp, Mus musculus
ggacaagagcataagcttcctctgt

SEQ ID NO: 588863 - DNA, 25 bp, Mus musculus
ggacaagagcattagcttcctctgt

SEQ ID NO: 588864 - DNA, 25 bp, Mus musculus
ggacaagagcgcacacaatcctata

SEQ ID NO: 588865 - DNA, 25 bp, Mus musculus
ggacaagagcgctcacaatcctata

SEQ ID NO: 588866 - DNA, 25 bp, Mus musculus
ggacaagagcttagtagcttgactt

SEQ ID NO: 588867 - DNA, 25 bp, Mus musculus
ggacaagagctttgtagcttgactt

SEQ ID NO: 588868 - DNA, 25 bp, Mus musculus
ggacaagagttcaatacctgccgca

SEQ ID NO: 588869 - DNA, 25 bp, Mus musculus
ggacaagagttctatacctgccgca

SEQ ID NO: 588870 - DNA, 25 bp, Mus musculus
ggacaagatccaaccgtaagccccg

SEQ ID NO: 588871 - DNA, 25 bp, Mus musculus
ggacaagatccatccgtaagccccg

SEQ ID NO: 588872 - DNA, 25 bp, Mus musculus
ggacaagatcccaattagagtaacg

SEQ ID NO: 588873 - DNA, 25 bp, Mus musculus
ggacaagatccctattagagtaacg

SEQ ID NO: 588874 - DNA, 25 bp, Mus musculus
ggacaagatctcatctataggattc

SEQ ID NO: 588875 - DNA, 25 bp, Mus musculus
ggacaagatctcttctataggattc

SEQ ID NO: 588876 - DNA, 25 bp, Mus musculus
ggacaagattgccattacctcaaat

SEQ ID NO: 588877 - DNA, 25 bp, Mus musculus
ggacaagattgcgattacctcaaat

SEQ ID NO: 588878 - DNA, 25 bp, Mus musculus
ggacaagcagtaagaatccctgtct

SEQ ID NO: 588879 - DNA, 25 bp, Mus musculus
ggacaagcagtatgaatccctgtct

SEQ ID NO: 588880 - DNA, 25 bp, Mus musculus
ggacaagccacaactgtcaccaaat

SEQ ID NO: 588881 - DNA, 25 bp, Mus musculus
ggacaagccacacaatatcttcaag

SEQ ID NO: 588882 - DNA, 25 bp, Mus musculus
ggacaagccacagaatatcttcaag

SEQ ID NO: 588883 - DNA, 25 bp, Mus musculus
ggacaagccacatctgtcaccaaat

SEQ ID NO: 588884 - DNA, 25 bp, Mus musculus
ggacaagccactatgcaaaaaacat

SEQ ID NO: 588885 - DNA, 25 bp, Mus musculus
ggacaagccactttgcaaaaaacat

SEQ ID NO: 588886 - DNA, 25 bp, Mus musculus
ggacaagccagtaaccttcctggaa

SEQ ID NO: 588887 - DNA, 25 bp, Mus musculus
ggacaagccagttaccttcctggaa

SEQ ID NO: 588888 - DNA, 25 bp, Mus musculus
ggacaagcccagaaactgtaccaat

SEQ ID NO: 588889 - DNA, 25 bp, Mus musculus
ggacaagcccagtaactgtaccaat

SEQ ID NO: 588890 - DNA, 25 bp, Mus musculus
ggacaagcccccaggagttggttct

SEQ ID NO: 588891 - DNA, 25 bp, Mus musculus
ggacaagccccctggagttggttct

SEQ ID NO: 588892 - DNA, 25 bp, Mus musculus
ggacaagcccttcaagacacaatga

SEQ ID NO: 588893 - DNA, 25 bp, Mus musculus
ggacaagcccttgaagacacaatga

SEQ ID NO: 588894 - DNA, 25 bp, Mus musculus
ggacaagcctggacttctaattctg

SEQ ID NO: 588895 - DNA, 25 bp, Mus musculus
ggacaagcctggtcttctaattctg

SEQ ID NO: 588896 - DNA, 25 bp, Mus musculus
ggacaagcctttacacctttggaga

SEQ ID NO: 588897 - DNA, 25 bp, Mus musculus
ggacaagccttttcacctttggaga

SEQ ID NO: 588898 - DNA, 25 bp, Mus musculus
ggacaagctcacatgcctagtatac

SEQ ID NO: 588899 - DNA, 25 bp, Mus musculus
ggacaagctcacttgcctagtatac

SEQ ID NO: 588900 - DNA, 25 bp, Mus musculus
ggacaagctcttaatgcaggcacat

SEQ ID NO: 588901 - DNA, 25 bp, Mus musculus
ggacaagctctttatgcaggcacat

SEQ ID NO: 588902 - DNA, 25 bp, Mus musculus
ggacaagctgaccattcaaggcctg

SEQ ID NO: 588903 - DNA, 25 bp, Mus musculus
ggacaagctgacgattcaaggcctg

SEQ ID NO: 588904 - DNA, 25 bp, Mus musculus
ggacaagctgcgcaagtccttcacg

SEQ ID NO: 588905 - DNA, 25 bp, Mus musculus
ggacaagctgcggaagtccttcacg

SEQ ID NO: 588906 - DNA, 25 bp, Mus musculus
ggacaagctgctacgatatgaccac

SEQ ID NO: 588907 - DNA, 25 bp, Mus musculus
ggacaagctgcttcgatatgaccac

SEQ ID NO: 588908 - DNA, 25 bp, Mus musculus
ggacaagctggcaacgactcagaaa

SEQ ID NO: 588909 - DNA, 25 bp, Mus musculus
ggacaagctggctacgactcagaaa

SEQ ID NO: 588910 - DNA, 25 bp, Mus musculus
ggacaagcttcgagtacttccctgt

SEQ ID NO: 588911 - DNA, 25 bp, Mus musculus
ggacaagcttcgtgtacttccctgt

SEQ ID NO: 588912 - DNA, 25 bp, Mus musculus
ggacaagcttgtagaagctttggaa

SEQ ID NO: 588913 - DNA, 25 bp, Mus musculus
ggacaagcttgttgaagctttggaa

SEQ ID NO: 588914 - DNA, 25 bp, Mus musculus
ggacaaggaaagaatctgagcttct

SEQ ID NO: 588915 - DNA, 25 bp, Mus musculus
ggacaaggaaagtatctgagcttct

SEQ ID NO: 588916 - DNA, 25 bp, Mus musculus
ggacaaggaattctaacagtgagga

SEQ ID NO: 588917 - DNA, 25 bp, Mus musculus
ggacaaggaattgtaacagtgagga

SEQ ID NO: 588918 - DNA, 25 bp, Mus musculus
ggacaaggacacacgctagagttct

SEQ ID NO: 588919 - DNA, 25 bp, Mus musculus
ggacaaggacactcgctagagttct

SEQ ID NO: 588920 - DNA, 25 bp, Mus musculus
ggacaaggacatcatcctgatcccg

SEQ ID NO: 588921 - DNA, 25 bp, Mus musculus
ggacaaggacatgatcctgatcccg

SEQ ID NO: 588922 - DNA, 25 bp, Mus musculus
ggacaaggacctccatgagaaactt

SEQ ID NO: 588923 - DNA, 25 bp, Mus musculus
ggacaaggacctgcatgagaaactt

SEQ ID NO: 588924 - DNA, 25 bp, Mus musculus
ggacaaggacggacatgcacagaga

SEQ ID NO: 588925 - DNA, 25 bp, Mus musculus
ggacaaggacggtcatgcacagaga

SEQ ID NO: 588926 - DNA, 25 bp, Mus musculus
ggacaaggactcatcctctgtggtt

SEQ ID NO: 588927 - DNA, 25 bp, Mus musculus
ggacaaggactcttcctctgtggtt

SEQ ID NO: 588928 - DNA, 25 bp, Mus musculus
ggacaaggactgagcggacaaccgc

SEQ ID NO: 588929 - DNA, 25 bp, Mus musculus
ggacaaggactgtgcggacaaccgc

SEQ ID NO: 588930 - DNA, 25 bp, Mus musculus
ggacaaggacttactaacattaaca

SEQ ID NO: 588931 - DNA, 25 bp, Mus musculus
ggacaaggactttctaacattaaca

SEQ ID NO: 588932 - DNA, 25 bp, Mus musculus
ggacaaggatagcacccaggtatac

SEQ ID NO: 588933 - DNA, 25 bp, Mus musculus
ggacaaggataggacccaggtatac

SEQ ID NO: 588934 - DNA, 25 bp, Mus musculus
ggacaaggcaatacccggcacaggg

SEQ ID NO: 588935 - DNA, 25 bp, Mus musculus
ggacaaggcaattcccggcacaggg

SEQ ID NO: 588936 - DNA, 25 bp, Mus musculus
ggacaaggcccacatagaactttga

SEQ ID NO: 588937 - DNA, 25 bp, Mus musculus
ggacaaggcccagatagaactttga

SEQ ID NO: 588938 - DNA, 25 bp, Mus musculus
ggacaaggcctccatatttactgga

SEQ ID NO: 588939 - DNA, 25 bp, Mus musculus
ggacaaggcctcgatatttactgga

SEQ ID NO: 588940 - DNA, 25 bp, Mus musculus
ggacaaggccttagagtcttaacga

SEQ ID NO: 588941 - DNA, 25 bp, Mus musculus
ggacaaggcctttgagtcttaacga

SEQ ID NO: 588942 - DNA, 25 bp, Mus musculus
ggacaaggctacactccaggccatg

SEQ ID NO: 588943 - DNA, 25 bp, Mus musculus
ggacaaggctactctccaggccatg

SEQ ID NO: 588944 - DNA, 25 bp, Mus musculus
ggacaagggcaaccataaaacagca

SEQ ID NO: 588945 - DNA, 25 bp, Mus musculus
ggacaagggcaagcataaaacagca

SEQ ID NO: 588946 - DNA, 25 bp, Mus musculus
ggacaagggcctatggtctcagcct

SEQ ID NO: 588947 - DNA, 25 bp, Mus musculus
ggacaagggcctttggtctcagcct

SEQ ID NO: 588948 - DNA, 25 bp, Mus musculus
ggacaagggctaatgtgtgtccagc

SEQ ID NO: 588949 - DNA, 25 bp, Mus musculus
ggacaagggctattgtgtgtccagc

SEQ ID NO: 588950 - DNA, 25 bp, Mus musculus
ggacaaggtaaacctctggccccac

SEQ ID NO: 588951 - DNA, 25 bp, Mus musculus
ggacaaggtaaagctctggccccac

SEQ ID NO: 588952 - DNA, 25 bp, Mus musculus
ggacaaggtatgattgcctcccacc

SEQ ID NO: 588953 - DNA, 25 bp, Mus musculus
ggacaaggtatgtttgcctcccacc

SEQ ID NO: 588954 - DNA, 25 bp, Mus musculus
ggacaaggttgaaaggagctttgct

SEQ ID NO: 588955 - DNA, 25 bp, Mus musculus
ggacaaggttgataggagctttgct

SEQ ID NO: 588956 - DNA, 25 bp, Mus musculus
ggacaagtaagtcactaccacggcc

SEQ ID NO: 588957 - DNA, 25 bp, Mus musculus
ggacaagtaagtgactaccacggcc

SEQ ID NO: 588958 - DNA, 25 bp, Mus musculus
ggacaagtacatccacaggcgctgg

SEQ ID NO: 588959 - DNA, 25 bp, Mus musculus
ggacaagtacatgcacaggcgctgg

SEQ ID NO: 588960 - DNA, 25 bp, Mus musculus
ggacaagtacccacagacctggaac

SEQ ID NO: 588961 - DNA, 25 bp, Mus musculus
ggacaagtaccctcagacctggaac

SEQ ID NO: 588962 - DNA, 25 bp, Mus musculus
ggacaagtactgctctcagcagatt

SEQ ID NO: 588963 - DNA, 25 bp, Mus musculus
ggacaagtactggtctcagcagatt

SEQ ID NO: 588964 - DNA, 25 bp, Mus musculus
ggacaagtatacaccctgctggatc

SEQ ID NO: 588965 - DNA, 25 bp, Mus musculus
ggacaagtatactccctgctggatc

SEQ ID NO: 588966 - DNA, 25 bp, Mus musculus
ggacaagtatccaccagtcaatcga

SEQ ID NO: 588967 - DNA, 25 bp, Mus musculus
ggacaagtatcctccagtcaatcga

SEQ ID NO: 588968 - DNA, 25 bp, Mus musculus
ggacaagtattcaggtcttagagga

SEQ ID NO: 588969 - DNA, 25 bp, Mus musculus
ggacaagtattctggtcttagagga

SEQ ID NO: 588970 - DNA, 25 bp, Mus musculus
ggacaagtcaatacccctggtggaa

SEQ ID NO: 588971 - DNA, 25 bp, Mus musculus
ggacaagtcaattcccctggtggaa

SEQ ID NO: 588972 - DNA, 25 bp, Mus musculus
ggacaagtcaccacaggacagtaca

SEQ ID NO: 588973 - DNA, 25 bp, Mus musculus
ggacaagtcacctcaggacagtaca

SEQ ID NO: 588974 - DNA, 25 bp, Mus musculus
ggacaagtcctaagtgaactatatg

SEQ ID NO: 588975 - DNA, 25 bp, Mus musculus
ggacaagtcctatgtgaactatatg

SEQ ID NO: 588976 - DNA, 25 bp, Mus musculus
ggacaagtcttcaatccacagctac

SEQ ID NO: 588977 - DNA, 25 bp, Mus musculus
ggacaagtcttctatccacagctac

SEQ ID NO: 588978 - DNA, 25 bp, Mus musculus
ggacaagtgaagatccccagtgccc

SEQ ID NO: 588979 - DNA, 25 bp, Mus musculus
ggacaagtgaagttccccagtgccc

SEQ ID NO: 588980 - DNA, 25 bp, Mus musculus
ggacaagtgcttaacctcggaataa

SEQ ID NO: 588981 - DNA, 25 bp, Mus musculus
ggacaagtgctttacctcggaataa

SEQ ID NO: 588982 - DNA, 25 bp, Mus musculus
ggacaagtggcaatccgaggtctct

SEQ ID NO: 588983 - DNA, 25 bp, Mus musculus
ggacaagtggcattccgaggtctct

SEQ ID NO: 588984 - DNA, 25 bp, Mus musculus
ggacaagtggccagccagggtctac

SEQ ID NO: 588985 - DNA, 25 bp, Mus musculus
ggacaagtggcctgccagggtctac

SEQ ID NO: 588986 - DNA, 25 bp, Mus musculus
ggacaagtgtgtagacacccacata

SEQ ID NO: 588987 - DNA, 25 bp, Mus musculus
ggacaagtgtgttgacacccacata

SEQ ID NO: 588988 - DNA, 25 bp, Mus musculus
ggacaagttcaacaccaggcactga

SEQ ID NO: 588989 - DNA, 25 bp, Mus musculus
ggacaagttcaagaccaggcactga

SEQ ID NO: 588990 - DNA, 25 bp, Mus musculus
ggacaagttcgaccacctgaagaga

SEQ ID NO: 588991 - DNA, 25 bp, Mus musculus
ggacaagttcgagcacctgaagaga

SEQ ID NO: 588992 - DNA, 25 bp, Mus musculus
ggacaagttcgtatcttttcctgat

SEQ ID NO: 588993 - DNA, 25 bp, Mus musculus
ggacaagttcgtttcttttcctgat

SEQ ID NO: 588994 - DNA, 25 bp, Mus musculus
ggacaagttgtgaattgttcccact

SEQ ID NO: 588995 - DNA, 25 bp, Mus musculus
ggacaagttgtgtattgttcccact

SEQ ID NO: 588996 - DNA, 25 bp, Mus musculus
ggacaagtttatacagaatcagagc

SEQ ID NO: 588997 - DNA, 25 bp, Mus musculus
ggacaagtttattcagaatcagagc

SEQ ID NO: 588998 - DNA, 25 bp, Mus musculus
ggacaataccaacgatagccatgtt

SEQ ID NO: 588999 - DNA, 25 bp, Mus musculus
ggacaataccaaggatagccatgtt

SEQ ID NO: 589000 - DNA, 25 bp, Mus musculus
ggacaatacctgagggtcggccatt

SEQ ID NO: 589001 - DNA, 25 bp, Mus musculus
ggacaatacctgtgggtcggccatt

SEQ ID NO: 589002 - DNA, 25 bp, Mus musculus
ggacaatacttgattgcacccagtt

SEQ ID NO: 589003 - DNA, 25 bp, Mus musculus
ggacaatacttgtttgcacccagtt

SEQ ID NO: 589004 - DNA, 25 bp, Mus musculus
ggacaatagaagctgccctgctatt

SEQ ID NO: 589005 - DNA, 25 bp, Mus musculus
ggacaatagaaggtgccctgctatt

SEQ ID NO: 589006 - DNA, 25 bp, Mus musculus
ggacaatagcccctctgtctgggaa

SEQ ID NO: 589007 - DNA, 25 bp, Mus musculus
ggacaatagcccgtctgtctgggaa

SEQ ID NO: 589008 - DNA, 25 bp, Mus musculus
ggacaatagtgaagggaatcccaca

SEQ ID NO: 589009 - DNA, 25 bp, Mus musculus
ggacaatagtgatgggaatcccaca

SEQ ID NO: 589010 - DNA, 25 bp, Mus musculus
ggacaatattccatcttgcagacag

SEQ ID NO: 589011 - DNA, 25 bp, Mus musculus
ggacaatattccttcttgcagacag

SEQ ID NO: 589012 - DNA, 25 bp, Mus musculus
ggacaatattttcctccaggctgag

SEQ ID NO: 589013 - DNA, 25 bp, Mus musculus
ggacaatattttgctccaggctgag

SEQ ID NO: 589014 - DNA, 25 bp, Mus musculus
ggacaatcaaataacccagccacag

SEQ ID NO: 589015 - DNA, 25 bp, Mus musculus
ggacaatcaaattacccagccacag

SEQ ID NO: 589016 - DNA, 25 bp, Mus musculus
ggacaatcctcacagatcttatttt

SEQ ID NO: 589017 - DNA, 25 bp, Mus musculus
ggacaatcctcagagatcttatttt

SEQ ID NO: 589018 - DNA, 25 bp, Mus musculus
ggacaatcgagaacctctggaccct

SEQ ID NO: 589019 - DNA, 25 bp, Mus musculus
ggacaatcgagatcctctggaccct

SEQ ID NO: 589020 - DNA, 25 bp, Mus musculus
ggacaatctaccagacttagcacct

SEQ ID NO: 589021 - DNA, 25 bp, Mus musculus
ggacaatctacctgacttagcacct

SEQ ID NO: 589022 - DNA, 25 bp, Mus musculus
ggacaatctcttcaggagtcttcac

SEQ ID NO: 589023 - DNA, 25 bp, Mus musculus
ggacaatctcttgaggagtcttcac

SEQ ID NO: 589024 - DNA, 25 bp, Mus musculus
ggacaatcttgcataacacacctca

SEQ ID NO: 589025 - DNA, 25 bp, Mus musculus
ggacaatcttgcttaacacacctca

SEQ ID NO: 589026 - DNA, 25 bp, Mus musculus
ggacaatgccttaggctggtgttca

SEQ ID NO: 589027 - DNA, 25 bp, Mus musculus
ggacaatgcctttggctggtgttca

SEQ ID NO: 589028 - DNA, 25 bp, Mus musculus
ggacaatgctgccactcaatgagag

SEQ ID NO: 589029 - DNA, 25 bp, Mus musculus
ggacaatgctgcgactcaatgagag

SEQ ID NO: 589030 - DNA, 25 bp, Mus musculus
ggacaatggaatccataggtttctt

SEQ ID NO: 589031 - DNA, 25 bp, Mus musculus
ggacaatggaatgcataggtttctt

SEQ ID NO: 589032 - DNA, 25 bp, Mus musculus
ggacaatggctgaaattttagctga

SEQ ID NO: 589033 - DNA, 25 bp, Mus musculus
ggacaatggctgtaattttagctga

SEQ ID NO: 589034 - DNA, 25 bp, Mus musculus
ggacaatggcttaggcccattagcc

SEQ ID NO: 589035 - DNA, 25 bp, Mus musculus
ggacaatggctttggcccattagcc

SEQ ID NO: 589036 - DNA, 25 bp, Mus musculus
ggacaatgggcacaaaccctacact

SEQ ID NO: 589037 - DNA, 25 bp, Mus musculus
ggacaatgggcagaaaccctacact

SEQ ID NO: 589038 - DNA, 25 bp, Mus musculus
ggacaatgtcacaagagggatattt

SEQ ID NO: 589039 - DNA, 25 bp, Mus musculus
ggacaatgtcactagagggatattt

SEQ ID NO: 589040 - DNA, 25 bp, Mus musculus
ggacaatgtctgcagtgaaaactac

SEQ ID NO: 589041 - DNA, 25 bp, Mus musculus
ggacaatgtctggagtgaaaactac

SEQ ID NO: 589042 - DNA, 25 bp, Mus musculus
ggacaatgttgtccatggccttcac

SEQ ID NO: 589043 - DNA, 25 bp, Mus musculus
ggacaatgttgtgcatggccttcac

SEQ ID NO: 589044 - DNA, 25 bp, Mus musculus
ggacaattaacgatcccactggcct

SEQ ID NO: 589045 - DNA, 25 bp, Mus musculus
ggacaattaacgttcccactggcct

SEQ ID NO: 589046 - DNA, 25 bp, Mus musculus
ggacaattagttctttacactcagg

SEQ ID NO: 589047 - DNA, 25 bp, Mus musculus
ggacaattagttgtttacactcagg

SEQ ID NO: 589048 - DNA, 25 bp, Mus musculus
ggacaattatctacctaagttttgg

SEQ ID NO: 589049 - DNA, 25 bp, Mus musculus
ggacaattatcttcctaagttttgg

SEQ ID NO: 589050 - DNA, 25 bp, Mus musculus
ggacaattcaaacagcggcatgcca

SEQ ID NO: 589051 - DNA, 25 bp, Mus musculus
ggacaattcaaagagcggcatgcca

SEQ ID NO: 589052 - DNA, 25 bp, Mus musculus
ggacaattcctaatgccttattttc

SEQ ID NO: 589053 - DNA, 25 bp, Mus musculus
ggacaattcctattgccttattttc

SEQ ID NO: 589054 - DNA, 25 bp, Mus musculus
ggacaattgaaaactgcctgccctg

SEQ ID NO: 589055 - DNA, 25 bp, Mus musculus
ggacaattgaaatctgcctgccctg

SEQ ID NO: 589056 - DNA, 25 bp, Mus musculus
ggacaattgccaactttgaccctag

SEQ ID NO: 589057 - DNA, 25 bp, Mus musculus
ggacaattgccatctttgaccctag

SEQ ID NO: 589058 - DNA, 25 bp, Mus musculus
ggacaattggacaacccaacctggt

SEQ ID NO: 589059 - DNA, 25 bp, Mus musculus
ggacaattggactacccaacctggt

SEQ ID NO: 589060 - DNA, 25 bp, Mus musculus
ggacaattgtataagcctacggatg

SEQ ID NO: 589061 - DNA, 25 bp, Mus musculus
ggacaattgtattagcctacggatg

SEQ ID NO: 589062 - DNA, 25 bp, Mus musculus
ggacaattgtttacaccccatgatg

SEQ ID NO: 589063 - DNA, 25 bp, Mus musculus
ggacaattgttttcaccccatgatg

SEQ ID NO: 589064 - DNA, 25 bp, Mus musculus
ggacacaaaagaccaccatttggtt

SEQ ID NO: 589065 - DNA, 25 bp, Mus musculus
ggacacaaaagagcaccatttggtt

SEQ ID NO: 589066 - DNA, 25 bp, Mus musculus
ggacacaaaaggcttctggaatgtt

SEQ ID NO: 589067 - DNA, 25 bp, Mus musculus
ggacacaaaagggttctggaatgtt

SEQ ID NO: 589068 - DNA, 25 bp, Mus musculus
ggacacaaacatcacgggccatgaa

SEQ ID NO: 589069 - DNA, 25 bp, Mus musculus
ggacacaaacatgacgggccatgaa

SEQ ID NO: 589070 - DNA, 25 bp, Mus musculus
ggacacaaagagcacccaagatttc

SEQ ID NO: 589071 - DNA, 25 bp, Mus musculus
ggacacaaagaggacccaagatttc

SEQ ID NO: 589072 - DNA, 25 bp, Mus musculus
ggacacaacataccaagagtacaaa

SEQ ID NO: 589073 - DNA, 25 bp, Mus musculus
ggacacaacatagcaagagtacaaa

SEQ ID NO: 589074 - DNA, 25 bp, Mus musculus
ggacacaacctcattttagcgtcag

SEQ ID NO: 589075 - DNA, 25 bp, Mus musculus
ggacacaacctctttttagcgtcag

SEQ ID NO: 589076 - DNA, 25 bp, Mus musculus
ggacacaactcaatttcagggaact

SEQ ID NO: 589077 - DNA, 25 bp, Mus musculus
ggacacaactcattttcagggaact

SEQ ID NO: 589078 - DNA, 25 bp, Mus musculus
ggacacaacttgctcaaaggctggt

SEQ ID NO: 589079 - DNA, 25 bp, Mus musculus
ggacacaacttggtcaaaggctggt

SEQ ID NO: 589080 - DNA, 25 bp, Mus musculus
ggacacaagactcggtcagggccaa

SEQ ID NO: 589081 - DNA, 25 bp, Mus musculus
ggacacaagactgggtcagggccaa

SEQ ID NO: 589082 - DNA, 25 bp, Mus musculus
ggacacaagcctaggtctgtctggc

SEQ ID NO: 589083 - DNA, 25 bp, Mus musculus
ggacacaagccttggtctgtctggc

SEQ ID NO: 589084 - DNA, 25 bp, Mus musculus
ggacacaagctcactggacaagatc

SEQ ID NO: 589085 - DNA, 25 bp, Mus musculus
ggacacaagctctctggacaagatc

SEQ ID NO: 589086 - DNA, 25 bp, Mus musculus
ggacacaagtggattcccagcggct

SEQ ID NO: 589087 - DNA, 25 bp, Mus musculus
ggacacaagtggtttcccagcggct

SEQ ID NO: 589088 - DNA, 25 bp, Mus musculus
ggacacaagttaaccttatgttctt

SEQ ID NO: 589089 - DNA, 25 bp, Mus musculus
ggacacaagttatccttatgttctt

SEQ ID NO: 589090 - DNA, 25 bp, Mus musculus
ggacacaatcacaaggagttcagga

SEQ ID NO: 589091 - DNA, 25 bp, Mus musculus
ggacacaatcactaggagttcagga

SEQ ID NO: 589092 - DNA, 25 bp, Mus musculus
ggacacaatgcacacatcaacagat

SEQ ID NO: 589093 - DNA, 25 bp, Mus musculus
ggacacaatgcagacatcaacagat

SEQ ID NO: 589094 - DNA, 25 bp, Mus musculus
ggacacaatgtcactgttcacccag

SEQ ID NO: 589095 - DNA, 25 bp, Mus musculus
ggacacaatgtctctgttcacccag

SEQ ID NO: 589096 - DNA, 25 bp, Mus musculus
ggacacaatgttatatcacctgttc

SEQ ID NO: 589097 - DNA, 25 bp, Mus musculus
ggacacaatgttttatcacctgttc

SEQ ID NO: 589098 - DNA, 25 bp, Mus musculus
ggacacaatttgaactgttgttata

SEQ ID NO: 589099 - DNA, 25 bp, Mus musculus
ggacacaatttgtactgttgttata

SEQ ID NO: 589100 - DNA, 25 bp, Mus musculus
ggacacacaaataactctttaccct

SEQ ID NO: 589101 - DNA, 25 bp, Mus musculus
ggacacacaaattactctttaccct

SEQ ID NO: 589102 - DNA, 25 bp, Mus musculus
ggacacacaactctatcaggcacct

SEQ ID NO: 589103 - DNA, 25 bp, Mus musculus
ggacacacaactgtatcaggcacct

SEQ ID NO: 589104 - DNA, 25 bp, Mus musculus
ggacacacacaactgttatcagctt

SEQ ID NO: 589105 - DNA, 25 bp, Mus musculus
ggacacacacaagtgttatcagctt

SEQ ID NO: 589106 - DNA, 25 bp, Mus musculus
ggacacacacggaaaggccctgact

SEQ ID NO: 589107 - DNA, 25 bp, Mus musculus
ggacacacacggtaaggccctgact

SEQ ID NO: 589108 - DNA, 25 bp, Mus musculus
ggacacacagatacaagtactttgt

SEQ ID NO: 589109 - DNA, 25 bp, Mus musculus
ggacacacagatagcttgacttaag

SEQ ID NO: 589110 - DNA, 25 bp, Mus musculus
ggacacacagattcaagtactttgt

SEQ ID NO: 589111 - DNA, 25 bp, Mus musculus
ggacacacagattgcttgacttaag

SEQ ID NO: 589112 - DNA, 25 bp, Mus musculus
ggacacacagcactagaagctctca

SEQ ID NO: 589113 - DNA, 25 bp, Mus musculus
ggacacacagcactgacttgtttgt

SEQ ID NO: 589114 - DNA, 25 bp, Mus musculus
ggacacacagcagtagaagctctca

SEQ ID NO: 589115 - DNA, 25 bp, Mus musculus
ggacacacagcagtgacttgtttgt

SEQ ID NO: 589116 - DNA, 25 bp, Mus musculus
ggacacacaggaagaacccctcagt

SEQ ID NO: 589117 - DNA, 25 bp, Mus musculus
ggacacacaggatgaacccctcagt

SEQ ID NO: 589118 - DNA, 25 bp, Mus musculus
ggacacacatccaagagatacaagt

SEQ ID NO: 589119 - DNA, 25 bp, Mus musculus
ggacacacatcctagagatacaagt

SEQ ID NO: 589120 - DNA, 25 bp, Mus musculus
ggacacacatgactttgatctcctc

SEQ ID NO: 589121 - DNA, 25 bp, Mus musculus
ggacacacatgagtttgatctcctc

SEQ ID NO: 589122 - DNA, 25 bp, Mus musculus
ggacacacccatatttcacttgtta

SEQ ID NO: 589123 - DNA, 25 bp, Mus musculus
ggacacacccatctcttaggcacgt

SEQ ID NO: 589124 - DNA, 25 bp, Mus musculus
ggacacacccatgtcttaggcacgt

SEQ ID NO: 589125 - DNA, 25 bp, Mus musculus
ggacacacccatttttcacttgtta

SEQ ID NO: 589126 - DNA, 25 bp, Mus musculus
ggacacaccggtacttgttaacaga

SEQ ID NO: 589127 - DNA, 25 bp, Mus musculus
ggacacaccggttcttgttaacaga

SEQ ID NO: 589128 - DNA, 25 bp, Mus musculus
ggacacaccgtcaaccagaggagga

SEQ ID NO: 589129 - DNA, 25 bp, Mus musculus
ggacacaccgtctaccagaggagga

SEQ ID NO: 589130 - DNA, 25 bp, Mus musculus
ggacacacgaacctcatttctagat

SEQ ID NO: 589131 - DNA, 25 bp, Mus musculus
ggacacacgaacgtcatttctagat

SEQ ID NO: 589132 - DNA, 25 bp, Mus musculus
ggacacactaataccgaactctgag

SEQ ID NO: 589133 - DNA, 25 bp, Mus musculus
ggacacactaattccgaactctgag

SEQ ID NO: 589134 - DNA, 25 bp, Mus musculus
ggacacactattatcttatgtcatc

SEQ ID NO: 589135 - DNA, 25 bp, Mus musculus
ggacacactattttcttatgtcatc

SEQ ID NO: 589136 - DNA, 25 bp, Mus musculus
ggacacactcagattgccagaacag

SEQ ID NO: 589137 - DNA, 25 bp, Mus musculus
ggacacactcagtttgccagaacag

SEQ ID NO: 589138 - DNA, 25 bp, Mus musculus
ggacacactcatatactctgacagt

SEQ ID NO: 589139 - DNA, 25 bp, Mus musculus
ggacacactcatttactctgacagt

SEQ ID NO: 589140 - DNA, 25 bp, Mus musculus
ggacacactgaaactgggcttgccg

SEQ ID NO: 589141 - DNA, 25 bp, Mus musculus
ggacacactgaatctgggcttgccg

SEQ ID NO: 589142 - DNA, 25 bp, Mus musculus
ggacacactgatacacctaataaag

SEQ ID NO: 589143 - DNA, 25 bp, Mus musculus
ggacacactgattcacctaataaag

SEQ ID NO: 589144 - DNA, 25 bp, Mus musculus
ggacacactgcacacatccagttct

SEQ ID NO: 589145 - DNA, 25 bp, Mus musculus
ggacacactgcagacatccagttct

SEQ ID NO: 589146 - DNA, 25 bp, Mus musculus
ggacacactggcaatgacacatcaa

SEQ ID NO: 589147 - DNA, 25 bp, Mus musculus
ggacacactggctatgacacatcaa

SEQ ID NO: 589148 - DNA, 25 bp, Mus musculus
ggacacactgtaatcacaagccaga

SEQ ID NO: 589149 - DNA, 25 bp, Mus musculus
ggacacactgtattcacaagccaga

SEQ ID NO: 589150 - DNA, 25 bp, Mus musculus
ggacacactttgaagcctatcttca

SEQ ID NO: 589151 - DNA, 25 bp, Mus musculus
ggacacactttgtagcctatcttca

SEQ ID NO: 589152 - DNA, 25 bp, Mus musculus
ggacacagaacccacgaagagctct

SEQ ID NO: 589153 - DNA, 25 bp, Mus musculus
ggacacagaaccgacgaagagctct

SEQ ID NO: 589154 - DNA, 25 bp, Mus musculus
ggacacagaactcctgctgactttc

SEQ ID NO: 589155 - DNA, 25 bp, Mus musculus
ggacacagaactgctgctgactttc

SEQ ID NO: 589156 - DNA, 25 bp, Mus musculus
ggacacagaatcaatgttccctttg

SEQ ID NO: 589157 - DNA, 25 bp, Mus musculus
ggacacagaatctatgttccctttg

SEQ ID NO: 589158 - DNA, 25 bp, Mus musculus
ggacacagactcaaaatcttttcat

SEQ ID NO: 589159 - DNA, 25 bp, Mus musculus
ggacacagactctaaatcttttcat

SEQ ID NO: 589160 - DNA, 25 bp, Mus musculus
ggacacagagcgcagaaacagaagt

SEQ ID NO: 589161 - DNA, 25 bp, Mus musculus
ggacacagagcggagaaacagaagt

SEQ ID NO: 589162 - DNA, 25 bp, Mus musculus
ggacacagaggccagtcttaaacat

SEQ ID NO: 589163 - DNA, 25 bp, Mus musculus
ggacacagaggcgagtcttaaacat

SEQ ID NO: 589164 - DNA, 25 bp, Mus musculus
ggacacagataacactatccattgg

SEQ ID NO: 589165 - DNA, 25 bp, Mus musculus
ggacacagataagactatccattgg

SEQ ID NO: 589166 - DNA, 25 bp, Mus musculus
ggacacagatgaagaaaggcaatat

SEQ ID NO: 589167 - DNA, 25 bp, Mus musculus
ggacacagatgatgaaaggcaatat

SEQ ID NO: 589168 - DNA, 25 bp, Mus musculus
ggacacagcactccggtactgggaa

SEQ ID NO: 589169 - DNA, 25 bp, Mus musculus
ggacacagcactgcggtactgggaa

SEQ ID NO: 589170 - DNA, 25 bp, Mus musculus
ggacacagcagacagatttattaat

SEQ ID NO: 589171 - DNA, 25 bp, Mus musculus
ggacacagcagagagatttattaat

SEQ ID NO: 589172 - DNA, 25 bp, Mus musculus
ggacacagcagcaccacagagataa

SEQ ID NO: 589173 - DNA, 25 bp, Mus musculus
ggacacagcagctccacagagataa

SEQ ID NO: 589174 - DNA, 25 bp, Mus musculus
ggacacagcaggaggtctcaacact

SEQ ID NO: 589175 - DNA, 25 bp, Mus musculus
ggacacagcaggtggtctcaacact

SEQ ID NO: 589176 - DNA, 25 bp, Mus musculus
ggacacagcatcaactcaggaagaa

SEQ ID NO: 589177 - DNA, 25 bp, Mus musculus
ggacacagcatctactcaggaagaa

SEQ ID NO: 589178 - DNA, 25 bp, Mus musculus
ggacacagcctgacttggtcctggg

SEQ ID NO: 589179 - DNA, 25 bp, Mus musculus
ggacacagcctgtcttggtcctggg

SEQ ID NO: 589180 - DNA, 25 bp, Mus musculus
ggacacagctcccactgttcgctgt

SEQ ID NO: 589181 - DNA, 25 bp, Mus musculus
ggacacagctccgactgttcgctgt

SEQ ID NO: 589182 - DNA, 25 bp, Mus musculus
ggacacaggcacaatcatgagggaa

SEQ ID NO: 589183 - DNA, 25 bp, Mus musculus
ggacacaggcactatcatgagggaa

SEQ ID NO: 589184 - DNA, 25 bp, Mus musculus
ggacacaggtgccaagttctaccgt

SEQ ID NO: 589185 - DNA, 25 bp, Mus musculus
ggacacaggtgcgaagttctaccgt

SEQ ID NO: 589186 - DNA, 25 bp, Mus musculus
ggacacagtaatcaacctcttgggt

SEQ ID NO: 589187 - DNA, 25 bp, Mus musculus
ggacacagtaatgaacctcttgggt

SEQ ID NO: 589188 - DNA, 25 bp, Mus musculus
ggacacagtatacatccaacgaact

SEQ ID NO: 589189 - DNA, 25 bp, Mus musculus
ggacacagtatagatccaacgaact

SEQ ID NO: 589190 - DNA, 25 bp, Mus musculus
ggacacagtggcaggccttgctgct

SEQ ID NO: 589191 - DNA, 25 bp, Mus musculus
ggacacagtggctggccttgctgct

SEQ ID NO: 589192 - DNA, 25 bp, Mus musculus
ggacacagttggacctaacacacag

SEQ ID NO: 589193 - DNA, 25 bp, Mus musculus
ggacacagttggtcctaacacacag

SEQ ID NO: 589194 - DNA, 25 bp, Mus musculus
ggacacatacagcaagaccccgtct

SEQ ID NO: 589195 - DNA, 25 bp, Mus musculus
ggacacatacaggaagaccccgtct

SEQ ID NO: 589196 - DNA, 25 bp, Mus musculus
ggacacatacccagcaattgcaagg

SEQ ID NO: 589197 - DNA, 25 bp, Mus musculus
ggacacataccctgcaattgcaagg

SEQ ID NO: 589198 - DNA, 25 bp, Mus musculus
ggacacatacttcgactgcgacact

SEQ ID NO: 589199 - DNA, 25 bp, Mus musculus
ggacacatacttggactgcgacact

SEQ ID NO: 589200 - DNA, 25 bp, Mus musculus
ggacacatagtgatatatctcaact

SEQ ID NO: 589201 - DNA, 25 bp, Mus musculus
ggacacatagtgttatatctcaact

SEQ ID NO: 589202 - DNA, 25 bp, Mus musculus
ggacacatcggtccacttttggtgc

SEQ ID NO: 589203 - DNA, 25 bp, Mus musculus
ggacacatcggtgcacttttggtgc

SEQ ID NO: 589204 - DNA, 25 bp, Mus musculus
ggacacatctgaagagctctctgca

SEQ ID NO: 589205 - DNA, 25 bp, Mus musculus
ggacacatctgatgagctctctgca

SEQ ID NO: 589206 - DNA, 25 bp, Mus musculus
ggacacatgcacctttgtggagatc

SEQ ID NO: 589207 - DNA, 25 bp, Mus musculus
ggacacatgcacgtttgtggagatc

SEQ ID NO: 589208 - DNA, 25 bp, Mus musculus
ggacacatgctacagaactctctta

SEQ ID NO: 589209 - DNA, 25 bp, Mus musculus
ggacacatgctagagaactctctta

SEQ ID NO: 589210 - DNA, 25 bp, Mus musculus
ggacacatggccaggatcggccgct

SEQ ID NO: 589211 - DNA, 25 bp, Mus musculus
ggacacatggcctggatcggccgct

SEQ ID NO: 589212 - DNA, 25 bp, Mus musculus
ggacacatgtaacaactcaaaatag

SEQ ID NO: 589213 - DNA, 25 bp, Mus musculus
ggacacatgtaagaactcaaaatag

SEQ ID NO: 589214 - DNA, 25 bp, Mus musculus
ggacacatgtccacacagagagcaa

SEQ ID NO: 589215 - DNA, 25 bp, Mus musculus
ggacacatgtcctcacagagagcaa

SEQ ID NO: 589216 - DNA, 25 bp, Mus musculus
ggacacatgtctatactctcagtac

SEQ ID NO: 589217 - DNA, 25 bp, Mus musculus
ggacacatgtctattttgcagaaca

SEQ ID NO: 589218 - DNA, 25 bp, Mus musculus
ggacacatgtctttactctcagtac

SEQ ID NO: 589219 - DNA, 25 bp, Mus musculus
ggacacatgtcttttttgcagaaca

SEQ ID NO: 589220 - DNA, 25 bp, Mus musculus
ggacacatgttcagtcatcagacat

SEQ ID NO: 589221 - DNA, 25 bp, Mus musculus
ggacacatgttctgtcatcagacat

SEQ ID NO: 589222 - DNA, 25 bp, Mus musculus
ggacacattaatccctctcacaaat

SEQ ID NO: 589223 - DNA, 25 bp, Mus musculus
ggacacattaatgcctctcacaaat

SEQ ID NO: 589224 - DNA, 25 bp, Mus musculus
ggacacattgtcaatgaccaccttc

SEQ ID NO: 589225 - DNA, 25 bp, Mus musculus
ggacacattgtctatgaccaccttc

SEQ ID NO: 589226 - DNA, 25 bp, Mus musculus
ggacacatttaaacacctcccagta

SEQ ID NO: 589227 - DNA, 25 bp, Mus musculus
ggacacatttaatcacctcccagta

SEQ ID NO: 589228 - DNA, 25 bp, Mus musculus
ggacacatttataatacctgccaca

SEQ ID NO: 589229 - DNA, 25 bp, Mus musculus
ggacacatttattatacctgccaca

SEQ ID NO: 589230 - DNA, 25 bp, Mus musculus
ggacacatttggagggatccctcta

SEQ ID NO: 589231 - DNA, 25 bp, Mus musculus
ggacacatttggtgggatccctcta

SEQ ID NO: 589232 - DNA, 25 bp, Mus musculus
ggacaccaagaaaatctcccgagga

SEQ ID NO: 589233 - DNA, 25 bp, Mus musculus
ggacaccaagaacgacgcgctgacc

SEQ ID NO: 589234 - DNA, 25 bp, Mus musculus
ggacaccaagaaggacgcgctgacc

SEQ ID NO: 589235 - DNA, 25 bp, Mus musculus
ggacaccaagaatatctcccgagga

SEQ ID NO: 589236 - DNA, 25 bp, Mus musculus
ggacaccaatggatgcgctttaatt

SEQ ID NO: 589237 - DNA, 25 bp, Mus musculus
ggacaccaatggttgcgctttaatt

SEQ ID NO: 589238 - DNA, 25 bp, Mus musculus
ggacaccacattcactacttttcct

SEQ ID NO: 589239 - DNA, 25 bp, Mus musculus
ggacaccacattgactacttttcct

SEQ ID NO: 589240 - DNA, 25 bp, Mus musculus
ggacaccaccttccagtattttaag

SEQ ID NO: 589241 - DNA, 25 bp, Mus musculus
ggacaccaccttgcagtattttaag

SEQ ID NO: 589242 - DNA, 25 bp, Mus musculus
ggacaccactgtaactaagctgctg

SEQ ID NO: 589243 - DNA, 25 bp, Mus musculus
ggacaccactgttactaagctgctg

SEQ ID NO: 589244 - DNA, 25 bp, Mus musculus
ggacaccagaataccacaggattgt

SEQ ID NO: 589245 - DNA, 25 bp, Mus musculus
ggacaccagaattccacaggattgt

SEQ ID NO: 589246 - DNA, 25 bp, Mus musculus
ggacaccagatccaccttccatggg

SEQ ID NO: 589247 - DNA, 25 bp, Mus musculus
ggacaccagatcgaccttccatggg

SEQ ID NO: 589248 - DNA, 25 bp, Mus musculus
ggacaccagattccttgcttggagt

SEQ ID NO: 589249 - DNA, 25 bp, Mus musculus
ggacaccagattgcttgcttggagt

SEQ ID NO: 589250 - DNA, 25 bp, Mus musculus
ggacaccagcccaggatgttatagt

SEQ ID NO: 589251 - DNA, 25 bp, Mus musculus
ggacaccagccctggatgttatagt

SEQ ID NO: 589252 - DNA, 25 bp, Mus musculus
ggacaccagctccaaagggtaccag

SEQ ID NO: 589253 - DNA, 25 bp, Mus musculus
ggacaccagctcgaaagggtaccag

SEQ ID NO: 589254 - DNA, 25 bp, Mus musculus
ggacaccaggcccagtggtcagacc

SEQ ID NO: 589255 - DNA, 25 bp, Mus musculus
ggacaccaggccgagtggtcagacc

SEQ ID NO: 589256 - DNA, 25 bp, Mus musculus
ggacaccagtggatctagtgcatag

SEQ ID NO: 589257 - DNA, 25 bp, Mus musculus
ggacaccagtggttctagtgcatag

SEQ ID NO: 589258 - DNA, 25 bp, Mus musculus
ggacaccatcaaaaaccaccaataa

SEQ ID NO: 589259 - DNA, 25 bp, Mus musculus
ggacaccatcaataaccaccaataa

SEQ ID NO: 589260 - DNA, 25 bp, Mus musculus
ggacaccatcccaccctagggagaa

SEQ ID NO: 589261 - DNA, 25 bp, Mus musculus
ggacaccatccctccctagggagaa

SEQ ID NO: 589262 - DNA, 25 bp, Mus musculus
ggacaccattttacatgttaaatag

SEQ ID NO: 589263 - DNA, 25 bp, Mus musculus
ggacaccattttcgcaaatgctaaa

SEQ ID NO: 589264 - DNA, 25 bp, Mus musculus
ggacaccattttggcaaatgctaaa

SEQ ID NO: 589265 - DNA, 25 bp, Mus musculus
ggacaccatttttcatgttaaatag

SEQ ID NO: 589266 - DNA, 25 bp, Mus musculus
ggacacccaccacgaggatgacgga

SEQ ID NO: 589267 - DNA, 25 bp, Mus musculus
ggacacccaccaggaggatgacgga

SEQ ID NO: 589268 - DNA, 25 bp, Mus musculus
ggacacccagaaaacctaccagtgg

SEQ ID NO: 589269 - DNA, 25 bp, Mus musculus
ggacacccagaatacctaccagtgg

SEQ ID NO: 589270 - DNA, 25 bp, Mus musculus
ggacacccagtccaaggacccaaag

SEQ ID NO: 589271 - DNA, 25 bp, Mus musculus
ggacacccagtccatggatgtttag

SEQ ID NO: 589272 - DNA, 25 bp, Mus musculus
ggacacccagtcgaaggacccaaag

SEQ ID NO: 589273 - DNA, 25 bp, Mus musculus
ggacacccagtcgatggatgtttag

SEQ ID NO: 589274 - DNA, 25 bp, Mus musculus
ggacacccagttactaaagtgactt

SEQ ID NO: 589275 - DNA, 25 bp, Mus musculus
ggacacccagtttctaaagtgactt

SEQ ID NO: 589276 - DNA, 25 bp, Mus musculus
ggacaccccaaaatccaaattcagg

SEQ ID NO: 589277 - DNA, 25 bp, Mus musculus
ggacaccccaaattccaaattcagg

SEQ ID NO: 589278 - DNA, 25 bp, Mus musculus
ggacacccgtgtaattgatagcagc

SEQ ID NO: 589279 - DNA, 25 bp, Mus musculus
ggacacccgtgttattgatagcagc

SEQ ID NO: 589280 - DNA, 25 bp, Mus musculus
ggacaccctcagatatgctgggttt

SEQ ID NO: 589281 - DNA, 25 bp, Mus musculus
ggacaccctcagttatgctgggttt

SEQ ID NO: 589282 - DNA, 25 bp, Mus musculus
ggacaccctctgctgttagttactg

SEQ ID NO: 589283 - DNA, 25 bp, Mus musculus
ggacaccctctggtgttagttactg

SEQ ID NO: 589284 - DNA, 25 bp, Mus musculus
ggacaccctgatcccattaatttcg

SEQ ID NO: 589285 - DNA, 25 bp, Mus musculus
ggacaccctgatgccattaatttcg

SEQ ID NO: 589286 - DNA, 25 bp, Mus musculus
ggacaccctgggatacatagtgcaa

SEQ ID NO: 589287 - DNA, 25 bp, Mus musculus
ggacaccctgggttacatagtgcaa

SEQ ID NO: 589288 - DNA, 25 bp, Mus musculus
ggacacccttagaatactctaccac

SEQ ID NO: 589289 - DNA, 25 bp, Mus musculus
ggacacccttagtatactctaccac

SEQ ID NO: 589290 - DNA, 25 bp, Mus musculus
ggacacccttcacgtcctgcaagac

SEQ ID NO: 589291 - DNA, 25 bp, Mus musculus
ggacacccttcaggtcctgcaagac

SEQ ID NO: 589292 - DNA, 25 bp, Mus musculus
ggacacccttgcatctgtagaaggc

SEQ ID NO: 589293 - DNA, 25 bp, Mus musculus
ggacacccttgcttctgtagaaggc

SEQ ID NO: 589294 - DNA, 25 bp, Mus musculus
ggacaccgctgcagacaagtgaggt

SEQ ID NO: 589295 - DNA, 25 bp, Mus musculus
ggacaccgctgctgacaagtgaggt

SEQ ID NO: 589296 - DNA, 25 bp, Mus musculus
ggacaccgggatctgcaaagcactc

SEQ ID NO: 589297 - DNA, 25 bp, Mus musculus
ggacaccgggatgtgcaaagcactc

SEQ ID NO: 589298 - DNA, 25 bp, Mus musculus
ggacacctaccaacctatgagtgaa

SEQ ID NO: 589299 - DNA, 25 bp, Mus musculus
ggacacctaccatcctatgagtgaa

SEQ ID NO: 589300 - DNA, 25 bp, Mus musculus
ggacacctacctacaagagcccggt

SEQ ID NO: 589301 - DNA, 25 bp, Mus musculus
ggacacctaccttcaagagcccggt

SEQ ID NO: 589302 - DNA, 25 bp, Mus musculus
ggacacctcagaaccatttcatcaa

SEQ ID NO: 589303 - DNA, 25 bp, Mus musculus
ggacacctcagatccatttcatcaa

SEQ ID NO: 589304 - DNA, 25 bp, Mus musculus
ggacacctccaccaatgtacaagaa

SEQ ID NO: 589305 - DNA, 25 bp, Mus musculus
ggacacctccacgaatgtacaagaa

SEQ ID NO: 589306 - DNA, 25 bp, Mus musculus
ggacacctccggaaatcagtgctaa

SEQ ID NO: 589307 - DNA, 25 bp, Mus musculus
ggacacctccggtaatcagtgctaa

SEQ ID NO: 589308 - DNA, 25 bp, Mus musculus
ggacacctcctgatattgtgtgttc

SEQ ID NO: 589309 - DNA, 25 bp, Mus musculus
ggacacctcctgttattgtgtgttc

SEQ ID NO: 589310 - DNA, 25 bp, Mus musculus
ggacacctctgcaagtcagtccaga

SEQ ID NO: 589311 - DNA, 25 bp, Mus musculus
ggacacctctgcattagaacaggca

SEQ ID NO: 589312 - DNA, 25 bp, Mus musculus
ggacacctctgctagtcagtccaga

SEQ ID NO: 589313 - DNA, 25 bp, Mus musculus
ggacacctctgctttagaacaggca

SEQ ID NO: 589314 - DNA, 25 bp, Mus musculus
ggacacctcttaactcttatttctt

SEQ ID NO: 589315 - DNA, 25 bp, Mus musculus
ggacacctcttatctcttatttctt

SEQ ID NO: 589316 - DNA, 25 bp, Mus musculus
ggacacctgaacatacatgtatgca

SEQ ID NO: 589317 - DNA, 25 bp, Mus musculus
ggacacctgaacttacatgtatgca

SEQ ID NO: 589318 - DNA, 25 bp, Mus musculus
ggacacctgaggacattctgagact

SEQ ID NO: 589319 - DNA, 25 bp, Mus musculus
ggacacctgaggtcattctgagact

SEQ ID NO: 589320 - DNA, 25 bp, Mus musculus
ggacacctggagactgattcacaga

SEQ ID NO: 589321 - DNA, 25 bp, Mus musculus
ggacacctggagtctgattcacaga

SEQ ID NO: 589322 - DNA, 25 bp, Mus musculus
ggacacctgggacttcactacatga

SEQ ID NO: 589323 - DNA, 25 bp, Mus musculus
ggacacctgggagttcactacatga

SEQ ID NO: 589324 - DNA, 25 bp, Mus musculus
ggacacctgggtctgtatctgtttc

SEQ ID NO: 589325 - DNA, 25 bp, Mus musculus
ggacacctgggtgtgtatctgtttc

SEQ ID NO: 589326 - DNA, 25 bp, Mus musculus
ggacacctgtgccagcctactgaga

SEQ ID NO: 589327 - DNA, 25 bp, Mus musculus
ggacacctgtgcgagcctactgaga

SEQ ID NO: 589328 - DNA, 25 bp, Mus musculus
ggacaccttcatctattgatagtct

SEQ ID NO: 589329 - DNA, 25 bp, Mus musculus
ggacaccttcatgtattgatagtct

SEQ ID NO: 589330 - DNA, 25 bp, Mus musculus
ggacaccttctgagaccattattct

SEQ ID NO: 589331 - DNA, 25 bp, Mus musculus
ggacaccttctgtgaccattattct

SEQ ID NO: 589332 - DNA, 25 bp, Mus musculus
ggacacctttcgagaactacacatt

SEQ ID NO: 589333 - DNA, 25 bp, Mus musculus
ggacacctttcgtgaactacacatt

SEQ ID NO: 589334 - DNA, 25 bp, Mus musculus
ggacacctttgcctgaatcaagcag

SEQ ID NO: 589335 - DNA, 25 bp, Mus musculus
ggacacctttgcgtgaatcaagcag

SEQ ID NO: 589336 - DNA, 25 bp, Mus musculus
ggacaccttttcactattgcagcaa

SEQ ID NO: 589337 - DNA, 25 bp, Mus musculus
ggacaccttttctctattgcagcaa

SEQ ID NO: 589338 - DNA, 25 bp, Mus musculus
ggacacgaagctaatctgtgattca

SEQ ID NO: 589339 - DNA, 25 bp, Mus musculus
ggacacgaagcttatctgtgattca

SEQ ID NO: 589340 - DNA, 25 bp, Mus musculus
ggacacgaaggcacagaaatctcta

SEQ ID NO: 589341 - DNA, 25 bp, Mus musculus
ggacacgaaggctcagaaatctcta

SEQ ID NO: 589342 - DNA, 25 bp, Mus musculus
ggacacgaccagctgattgtagaca

SEQ ID NO: 589343 - DNA, 25 bp, Mus musculus
ggacacgaccaggtgattgtagaca

SEQ ID NO: 589344 - DNA, 25 bp, Mus musculus
ggacacgacctgcagcaattaactg

SEQ ID NO: 589345 - DNA, 25 bp, Mus musculus
ggacacgacctggagcaattaactg

SEQ ID NO: 589346 - DNA, 25 bp, Mus musculus
ggacacgactcaccgtcctagagga

SEQ ID NO: 589347 - DNA, 25 bp, Mus musculus
ggacacgactcagcgtcctagagga

SEQ ID NO: 589348 - DNA, 25 bp, Mus musculus
ggacacgagtgtccggtcatttcca

SEQ ID NO: 589349 - DNA, 25 bp, Mus musculus
ggacacgagtgtgcggtcatttcca

SEQ ID NO: 589350 - DNA, 25 bp, Mus musculus
ggacacgcaggtctttttcttcttt

SEQ ID NO: 589351 - DNA, 25 bp, Mus musculus
ggacacgcaggtgtttttcttcttt

SEQ ID NO: 589352 - DNA, 25 bp, Mus musculus
ggacacgccatgattaaatctctca

SEQ ID NO: 589353 - DNA, 25 bp, Mus musculus
ggacacgccatgtttaaatctctca

SEQ ID NO: 589354 - DNA, 25 bp, Mus musculus
ggacacgcccagaagtgaagctgct

SEQ ID NO: 589355 - DNA, 25 bp, Mus musculus
ggacacgcccagtagtgaagctgct

SEQ ID NO: 589356 - DNA, 25 bp, Mus musculus
ggacacgcgagaaaagcaacttggg

SEQ ID NO: 589357 - DNA, 25 bp, Mus musculus
ggacacgcgagataagcaacttggg

SEQ ID NO: 589358 - DNA, 25 bp, Mus musculus
ggacacgctgacatggagcctgcag

SEQ ID NO: 589359 - DNA, 25 bp, Mus musculus
ggacacgctgacttggagcctgcag

SEQ ID NO: 589360 - DNA, 25 bp, Mus musculus
ggacacggacaactgtccaagcaag

SEQ ID NO: 589361 - DNA, 25 bp, Mus musculus
ggacacggacaagtgtccaagcaag

SEQ ID NO: 589362 - DNA, 25 bp, Mus musculus
ggacacggaggcagctaccttcaaa

SEQ ID NO: 589363 - DNA, 25 bp, Mus musculus
ggacacggaggctgctaccttcaaa

SEQ ID NO: 589364 - DNA, 25 bp, Mus musculus
ggacacggagtccaatctcttttgg

SEQ ID NO: 589365 - DNA, 25 bp, Mus musculus
ggacacggagtcgaatctcttttgg

SEQ ID NO: 589366 - DNA, 25 bp, Mus musculus
ggacacggatttatcgtcccaacag

SEQ ID NO: 589367 - DNA, 25 bp, Mus musculus
ggacacggatttttcgtcccaacag

SEQ ID NO: 589368 - DNA, 25 bp, Mus musculus
ggacacggcaaaagaagtcagaaca

SEQ ID NO: 589369 - DNA, 25 bp, Mus musculus
ggacacggcaaatgaagtcagaaca

SEQ ID NO: 589370 - DNA, 25 bp, Mus musculus
ggacacggccatatgctatgctaaa

SEQ ID NO: 589371 - DNA, 25 bp, Mus musculus
ggacacggccatttgctatgctaaa

SEQ ID NO: 589372 - DNA, 25 bp, Mus musculus
ggacacggtgatctctctgaatgga

SEQ ID NO: 589373 - DNA, 25 bp, Mus musculus
ggacacggtgatgtctctgaatgga

SEQ ID NO: 589374 - DNA, 25 bp, Mus musculus
ggacacggttccactaacatgatag

SEQ ID NO: 589375 - DNA, 25 bp, Mus musculus
ggacacggttcctctaacatgatag

SEQ ID NO: 589376 - DNA, 25 bp, Mus musculus
ggacacggttttcgccactagagaa

SEQ ID NO: 589377 - DNA, 25 bp, Mus musculus
ggacacggttttggccactagagaa

SEQ ID NO: 589378 - DNA, 25 bp, Mus musculus
ggacacgtaaacaaagcccacatta

SEQ ID NO: 589379 - DNA, 25 bp, Mus musculus
ggacacgtaaactaagcccacatta

SEQ ID NO: 589380 - DNA, 25 bp, Mus musculus
ggacacgtatacattgaatcaggaa

SEQ ID NO: 589381 - DNA, 25 bp, Mus musculus
ggacacgtatactttgaatcaggaa

SEQ ID NO: 589382 - DNA, 25 bp, Mus musculus
ggacacgtattcaaccttcatagag

SEQ ID NO: 589383 - DNA, 25 bp, Mus musculus
ggacacgtattctaccttcatagag

SEQ ID NO: 589384 - DNA, 25 bp, Mus musculus
ggacacgtcgcaaaggccatcccta

SEQ ID NO: 589385 - DNA, 25 bp, Mus musculus
ggacacgtcgcataggccatcccta

SEQ ID NO: 589386 - DNA, 25 bp, Mus musculus
ggacacgtctctactggcttggagt

SEQ ID NO: 589387 - DNA, 25 bp, Mus musculus
ggacacgtctcttctggcttggagt

SEQ ID NO: 589388 - DNA, 25 bp, Mus musculus
ggacacgtgatcaatggagggacta

SEQ ID NO: 589389 - DNA, 25 bp, Mus musculus
ggacacgtgatctatggagggacta

SEQ ID NO: 589390 - DNA, 25 bp, Mus musculus
ggacacgtgcacaatggccactcaa

SEQ ID NO: 589391 - DNA, 25 bp, Mus musculus
ggacacgtgcactatggccactcaa

SEQ ID NO: 589392 - DNA, 25 bp, Mus musculus
ggacacgtggcacccatatatttat

SEQ ID NO: 589393 - DNA, 25 bp, Mus musculus
ggacacgtggcagccatatatttat

SEQ ID NO: 589394 - DNA, 25 bp, Mus musculus
ggacacgtgggaattcagcaatact

SEQ ID NO: 589395 - DNA, 25 bp, Mus musculus
ggacacgtgggatttcagcaatact

SEQ ID NO: 589396 - DNA, 25 bp, Mus musculus
ggacacgtgtaccacttctgttttc

SEQ ID NO: 589397 - DNA, 25 bp, Mus musculus
ggacacgtgtacgacttctgttttc

SEQ ID NO: 589398 - DNA, 25 bp, Mus musculus
ggacacgttcacagacacccaaagt

SEQ ID NO: 589399 - DNA, 25 bp, Mus musculus
ggacacgttcactgacacccaaagt

SEQ ID NO: 589400 - DNA, 25 bp, Mus musculus
ggacacgttgatccttggtttggaa

SEQ ID NO: 589401 - DNA, 25 bp, Mus musculus
ggacacgttgatgcttggtttggaa

SEQ ID NO: 589402 - DNA, 25 bp, Mus musculus
ggacactaaatcaaccttcatttct

SEQ ID NO: 589403 - DNA, 25 bp, Mus musculus
ggacactaaatctaccttcatttct

SEQ ID NO: 589404 - DNA, 25 bp, Mus musculus
ggacactaacttccagactgcttgt

SEQ ID NO: 589405 - DNA, 25 bp, Mus musculus
ggacactaacttgcagactgcttgt

SEQ ID NO: 589406 - DNA, 25 bp, Mus musculus
ggacactaagaaccccttggtatat

SEQ ID NO: 589407 - DNA, 25 bp, Mus musculus
ggacactaagaagcccttggtatat

SEQ ID NO: 589408 - DNA, 25 bp, Mus musculus
ggacactaatcaactctttttcttg

SEQ ID NO: 589409 - DNA, 25 bp, Mus musculus
ggacactaatcatctctttttcttg

SEQ ID NO: 589410 - DNA, 25 bp, Mus musculus
ggacactaattccagtcatggtagg

SEQ ID NO: 589411 - DNA, 25 bp, Mus musculus
ggacactaattcgagtcatggtagg

SEQ ID NO: 589412 - DNA, 25 bp, Mus musculus
ggacactaccaccagtgtattgatt

SEQ ID NO: 589413 - DNA, 25 bp, Mus musculus
ggacactaccacgagtgtattgatt

SEQ ID NO: 589414 - DNA, 25 bp, Mus musculus
ggacactactcaaaatacccacagg

SEQ ID NO: 589415 - DNA, 25 bp, Mus musculus
ggacactactcataatacccacagg

SEQ ID NO: 589416 - DNA, 25 bp, Mus musculus
ggacactactgcagacactaaacag

SEQ ID NO: 589417 - DNA, 25 bp, Mus musculus
ggacactactgctgacactaaacag

SEQ ID NO: 589418 - DNA, 25 bp, Mus musculus
ggacactacttcatcttttgagatc

SEQ ID NO: 589419 - DNA, 25 bp, Mus musculus
ggacactacttccacactgcaattg

SEQ ID NO: 589420 - DNA, 25 bp, Mus musculus
ggacactacttcgacactgcaattg

SEQ ID NO: 589421 - DNA, 25 bp, Mus musculus
ggacactacttcttcttttgagatc

SEQ ID NO: 589422 - DNA, 25 bp, Mus musculus
ggacactagagtcggactcagtcaa

SEQ ID NO: 589423 - DNA, 25 bp, Mus musculus
ggacactagagtgggactcagtcaa

SEQ ID NO: 589424 - DNA, 25 bp, Mus musculus
ggacactaggtcatctttacaggag

SEQ ID NO: 589425 - DNA, 25 bp, Mus musculus
ggacactaggtcttctttacaggag

SEQ ID NO: 589426 - DNA, 25 bp, Mus musculus
ggacactagtacaccaaatctgtaa

SEQ ID NO: 589427 - DNA, 25 bp, Mus musculus
ggacactagtactccaaatctgtaa

SEQ ID NO: 589428 - DNA, 25 bp, Mus musculus
ggacactagtgcagacggttgacct

SEQ ID NO: 589429 - DNA, 25 bp, Mus musculus
ggacactagtgctgacggttgacct

SEQ ID NO: 589430 - DNA, 25 bp, Mus musculus
ggacactagtggatcctttgagtac

SEQ ID NO: 589431 - DNA, 25 bp, Mus musculus
ggacactagtggttcctttgagtac

SEQ ID NO: 589432 - DNA, 25 bp, Mus musculus
ggacactatccaagcccagaacatt

SEQ ID NO: 589433 - DNA, 25 bp, Mus musculus
ggacactatccatgcccagaacatt

SEQ ID NO: 589434 - DNA, 25 bp, Mus musculus
ggacactatcttaaccaactacatg

SEQ ID NO: 589435 - DNA, 25 bp, Mus musculus
ggacactatctttaccaactacatg

SEQ ID NO: 589436 - DNA, 25 bp, Mus musculus
ggacactcacaaacttggccatata

SEQ ID NO: 589437 - DNA, 25 bp, Mus musculus
ggacactcacaatcttggccatata

SEQ ID NO: 589438 - DNA, 25 bp, Mus musculus
ggacactcacatcttgacaactttg

SEQ ID NO: 589439 - DNA, 25 bp, Mus musculus
ggacactcacatgttgacaactttg

SEQ ID NO: 589440 - DNA, 25 bp, Mus musculus
ggacactcaccacagttgattctct

SEQ ID NO: 589441 - DNA, 25 bp, Mus musculus
ggacactcaccagagttgattctct

SEQ ID NO: 589442 - DNA, 25 bp, Mus musculus
ggacactcagcaatgcttcatttat

SEQ ID NO: 589443 - DNA, 25 bp, Mus musculus
ggacactcagcacagaatcgttttt

SEQ ID NO: 589444 - DNA, 25 bp, Mus musculus
ggacactcagcagagaatcgttttt

SEQ ID NO: 589445 - DNA, 25 bp, Mus musculus
ggacactcagcattgcttcatttat

SEQ ID NO: 589446 - DNA, 25 bp, Mus musculus
ggacactccaaaacagaggctcata

SEQ ID NO: 589447 - DNA, 25 bp, Mus musculus
ggacactccaaatcagaggctcata

SEQ ID NO: 589448 - DNA, 25 bp, Mus musculus
ggacactccagaacaacaacataga

SEQ ID NO: 589449 - DNA, 25 bp, Mus musculus
ggacactccagaactttggatattg

SEQ ID NO: 589450 - DNA, 25 bp, Mus musculus
ggacactccagatcaacaacataga

SEQ ID NO: 589451 - DNA, 25 bp, Mus musculus
ggacactccagatctttggatattg

SEQ ID NO: 589452 - DNA, 25 bp, Mus musculus
ggacactcccagatgggactgtttt

SEQ ID NO: 589453 - DNA, 25 bp, Mus musculus
ggacactcccagttgggactgtttt

SEQ ID NO: 589454 - DNA, 25 bp, Mus musculus
ggacactccgcaactgaactatata

SEQ ID NO: 589455 - DNA, 25 bp, Mus musculus
ggacactccgcatctgaactatata

SEQ ID NO: 589456 - DNA, 25 bp, Mus musculus
ggacactccttacaagtgcattgat

SEQ ID NO: 589457 - DNA, 25 bp, Mus musculus
ggacactccttagaagtgcattgat

SEQ ID NO: 589458 - DNA, 25 bp, Mus musculus
ggacactcgcacagtagactacctt

SEQ ID NO: 589459 - DNA, 25 bp, Mus musculus
ggacactcgcactgtagactacctt

SEQ ID NO: 589460 - DNA, 25 bp, Mus musculus
ggacactcggtcagagagcctgcat

SEQ ID NO: 589461 - DNA, 25 bp, Mus musculus
ggacactcggtctgagagcctgcat

SEQ ID NO: 589462 - DNA, 25 bp, Mus musculus
ggacactctactaattgcatcgcaa

SEQ ID NO: 589463 - DNA, 25 bp, Mus musculus
ggacactctacttattgcatcgcaa

SEQ ID NO: 589464 - DNA, 25 bp, Mus musculus
ggacactctatcagtagtgcgtttt

SEQ ID NO: 589465 - DNA, 25 bp, Mus musculus
ggacactctatctgtagtgcgtttt

SEQ ID NO: 589466 - DNA, 25 bp, Mus musculus
ggacactctcggaaagagcccgttg

SEQ ID NO: 589467 - DNA, 25 bp, Mus musculus
ggacactctcggtaagagcccgttg

SEQ ID NO: 589468 - DNA, 25 bp, Mus musculus
ggacactctgcgaagctttatttga

SEQ ID NO: 589469 - DNA, 25 bp, Mus musculus
ggacactctgcgtagctttatttga

SEQ ID NO: 589470 - DNA, 25 bp, Mus musculus
ggacactctgtaatcctgttttcat

SEQ ID NO: 589471 - DNA, 25 bp, Mus musculus
ggacactctgtattcctgttttcat

SEQ ID NO: 589472 - DNA, 25 bp, Mus musculus
ggacactgacatctgctgtgggtct

SEQ ID NO: 589473 - DNA, 25 bp, Mus musculus
ggacactgacatgtgctgtgggtct

SEQ ID NO: 589474 - DNA, 25 bp, Mus musculus
ggacactgacgacatccagagctat

SEQ ID NO: 589475 - DNA, 25 bp, Mus musculus
ggacactgacgagatccagagctat

SEQ ID NO: 589476 - DNA, 25 bp, Mus musculus
ggacactgacttatcaactttttga

SEQ ID NO: 589477 - DNA, 25 bp, Mus musculus
ggacactgacttttcaactttttga

SEQ ID NO: 589478 - DNA, 25 bp, Mus musculus
ggacactgagcaagagaggccctat

SEQ ID NO: 589479 - DNA, 25 bp, Mus musculus
ggacactgagcatgagaggccctat

SEQ ID NO: 589480 - DNA, 25 bp, Mus musculus
ggacactgatacaggccaaagcctt

SEQ ID NO: 589481 - DNA, 25 bp, Mus musculus
ggacactgatactggccaaagcctt

SEQ ID NO: 589482 - DNA, 25 bp, Mus musculus
ggacactgcaacaggagctgccgaa

SEQ ID NO: 589483 - DNA, 25 bp, Mus musculus
ggacactgcaactggagctgccgaa

SEQ ID NO: 589484 - DNA, 25 bp, Mus musculus
ggacactgcatgcaaagagacccag

SEQ ID NO: 589485 - DNA, 25 bp, Mus musculus
ggacactgcatggaaagagacccag

SEQ ID NO: 589486 - DNA, 25 bp, Mus musculus
ggacactgccttcgaaatgttgact

SEQ ID NO: 589487 - DNA, 25 bp, Mus musculus
ggacactgccttggaaatgttgact

SEQ ID NO: 589488 - DNA, 25 bp, Mus musculus
ggacactgcggcacaagatcctggc

SEQ ID NO: 589489 - DNA, 25 bp, Mus musculus
ggacactgcggctcaagatcctggc

SEQ ID NO: 589490 - DNA, 25 bp, Mus musculus
ggacactgctagcacttgatttttc

SEQ ID NO: 589491 - DNA, 25 bp, Mus musculus
ggacactgctaggacttgatttttc

SEQ ID NO: 589492 - DNA, 25 bp, Mus musculus
ggacactggagcacacatgtgcata

SEQ ID NO: 589493 - DNA, 25 bp, Mus musculus
ggacactggagctcacatgtgcata

SEQ ID NO: 589494 - DNA, 25 bp, Mus musculus
ggacactggattcagccgagtgaat

SEQ ID NO: 589495 - DNA, 25 bp, Mus musculus
ggacactggattgagccgagtgaat

SEQ ID NO: 589496 - DNA, 25 bp, Mus musculus
ggacactggcagctcctgatcctga

SEQ ID NO: 589497 - DNA, 25 bp, Mus musculus
ggacactggcaggtcctgatcctga

SEQ ID NO: 589498 - DNA, 25 bp, Mus musculus
ggacactggccaccttgctcaggga

SEQ ID NO: 589499 - DNA, 25 bp, Mus musculus
ggacactggccagcttgctcaggga

SEQ ID NO: 589500 - DNA, 25 bp, Mus musculus
ggacactggccccaagaactgataa

SEQ ID NO: 589501 - DNA, 25 bp, Mus musculus
ggacactggcccgaagaactgataa

SEQ ID NO: 589502 - DNA, 25 bp, Mus musculus
ggacactggcttactctaaatggga

SEQ ID NO: 589503 - DNA, 25 bp, Mus musculus
ggacactggctttctctaaatggga

SEQ ID NO: 589504 - DNA, 25 bp, Mus musculus
ggacactgggtgcatttaattttat

SEQ ID NO: 589505 - DNA, 25 bp, Mus musculus
ggacactgggtggatttaattttat

SEQ ID NO: 589506 - DNA, 25 bp, Mus musculus
ggacactggtctcttctacctcgtg

SEQ ID NO: 589507 - DNA, 25 bp, Mus musculus
ggacactggtctgttctacctcgtg

SEQ ID NO: 589508 - DNA, 25 bp, Mus musculus
ggacactggttaacttggcacatgc

SEQ ID NO: 589509 - DNA, 25 bp, Mus musculus
ggacactggttatcttggcacatgc

SEQ ID NO: 589510 - DNA, 25 bp, Mus musculus
ggacactgtcatcctactgtgacct

SEQ ID NO: 589511 - DNA, 25 bp, Mus musculus
ggacactgtcatgctactgtgacct

SEQ ID NO: 589512 - DNA, 25 bp, Mus musculus
ggacactgtcttacttattcagcat

SEQ ID NO: 589513 - DNA, 25 bp, Mus musculus
ggacactgtctttcttattcagcat

SEQ ID NO: 589514 - DNA, 25 bp, Mus musculus
ggacactgtgcaacatgtgtagttg

SEQ ID NO: 589515 - DNA, 25 bp, Mus musculus
ggacactgtgcaagattcgactgaa

SEQ ID NO: 589516 - DNA, 25 bp, Mus musculus
ggacactgtgcatcatgtgtagttg

SEQ ID NO: 589517 - DNA, 25 bp, Mus musculus
ggacactgtgcatgattcgactgaa

SEQ ID NO: 589518 - DNA, 25 bp, Mus musculus
ggacactgttataagcctctcttaa

SEQ ID NO: 589519 - DNA, 25 bp, Mus musculus
ggacactgttattagcctctcttaa

SEQ ID NO: 589520 - DNA, 25 bp, Mus musculus
ggacactgttctaaggacctgggct

SEQ ID NO: 589521 - DNA, 25 bp, Mus musculus
ggacactgttcttaggacctgggct

SEQ ID NO: 589522 - DNA, 25 bp, Mus musculus
ggacactgttgtcacttaaagcaga

SEQ ID NO: 589523 - DNA, 25 bp, Mus musculus
ggacactgttgtgacttaaagcaga

SEQ ID NO: 589524 - DNA, 25 bp, Mus musculus
ggacacttaaagcagctcacagaat

SEQ ID NO: 589525 - DNA, 25 bp, Mus musculus
ggacacttaaaggagctcacagaat

SEQ ID NO: 589526 - DNA, 25 bp, Mus musculus
ggacacttagtaccacctggacctc

SEQ ID NO: 589527 - DNA, 25 bp, Mus musculus
ggacacttagtagcacctggacctc

SEQ ID NO: 589528 - DNA, 25 bp, Mus musculus
ggacacttagtccttatgcataaaa

SEQ ID NO: 589529 - DNA, 25 bp, Mus musculus
ggacacttagtcgttatgcataaaa

SEQ ID NO: 589530 - DNA, 25 bp, Mus musculus
ggacacttagtgcacattccataac

SEQ ID NO: 589531 - DNA, 25 bp, Mus musculus
ggacacttagtggacattccataac

SEQ ID NO: 589532 - DNA, 25 bp, Mus musculus
ggacacttcctccagagatggaaat

SEQ ID NO: 589533 - DNA, 25 bp, Mus musculus
ggacacttcctcgagagatggaaat

SEQ ID NO: 589534 - DNA, 25 bp, Mus musculus
ggacacttctcccagacttttcatt

SEQ ID NO: 589535 - DNA, 25 bp, Mus musculus
ggacacttctccgagacttttcatt

SEQ ID NO: 589536 - DNA, 25 bp, Mus musculus
ggacacttctgcctcctgatagagg

SEQ ID NO: 589537 - DNA, 25 bp, Mus musculus
ggacacttctgcgtcctgatagagg

SEQ ID NO: 589538 - DNA, 25 bp, Mus musculus
ggacacttctgtaaggagggctgaa

SEQ ID NO: 589539 - DNA, 25 bp, Mus musculus
ggacacttctgttaggagggctgaa

SEQ ID NO: 589540 - DNA, 25 bp, Mus musculus
ggacacttgactcctggaggaagat

SEQ ID NO: 589541 - DNA, 25 bp, Mus musculus
ggacacttgactgctggaggaagat

SEQ ID NO: 589542 - DNA, 25 bp, Mus musculus
ggacacttgagactggctctgcata

SEQ ID NO: 589543 - DNA, 25 bp, Mus musculus
ggacacttgagagtggctctgcata

SEQ ID NO: 589544 - DNA, 25 bp, Mus musculus
ggacacttgagcagttctttctctt

SEQ ID NO: 589545 - DNA, 25 bp, Mus musculus
ggacacttgagctgttctttctctt

SEQ ID NO: 589546 - DNA, 25 bp, Mus musculus
ggacacttgctaatctcaactgaag

SEQ ID NO: 589547 - DNA, 25 bp, Mus musculus
ggacacttgctattctcaactgaag

SEQ ID NO: 589548 - DNA, 25 bp, Mus musculus
ggacacttgctcacttgataaaagt

SEQ ID NO: 589549 - DNA, 25 bp, Mus musculus
ggacacttgctctcttgataaaagt

SEQ ID NO: 589550 - DNA, 25 bp, Mus musculus
ggacacttgcttcagacgctcctct

SEQ ID NO: 589551 - DNA, 25 bp, Mus musculus
ggacacttgcttgagacgctcctct

SEQ ID NO: 589552 - DNA, 25 bp, Mus musculus
ggacacttggtactctcccagagga

SEQ ID NO: 589553 - DNA, 25 bp, Mus musculus
ggacacttggtagtctcccagagga

SEQ ID NO: 589554 - DNA, 25 bp, Mus musculus
ggacacttggtgcatctaggcaaaa

SEQ ID NO: 589555 - DNA, 25 bp, Mus musculus
ggacacttggtggatctaggcaaaa

SEQ ID NO: 589556 - DNA, 25 bp, Mus musculus
ggacacttgttacccatagcagatg

SEQ ID NO: 589557 - DNA, 25 bp, Mus musculus
ggacacttgttagccatagcagatg

SEQ ID NO: 589558 - DNA, 25 bp, Mus musculus
ggacactttattcatcttatacact

SEQ ID NO: 589559 - DNA, 25 bp, Mus musculus
ggacactttattctaatacgggagt

SEQ ID NO: 589560 - DNA, 25 bp, Mus musculus
ggacactttattgatcttatacact

SEQ ID NO: 589561 - DNA, 25 bp, Mus musculus
ggacactttattgtaatacgggagt

SEQ ID NO: 589562 - DNA, 25 bp, Mus musculus
ggacactttcatcgcagacctggtg

SEQ ID NO: 589563 - DNA, 25 bp, Mus musculus
ggacactttcatggcagacctggtg

SEQ ID NO: 589564 - DNA, 25 bp, Mus musculus
ggacactttgtgatctgttgaaaac

SEQ ID NO: 589565 - DNA, 25 bp, Mus musculus
ggacactttgtgcaattagacttag

SEQ ID NO: 589566 - DNA, 25 bp, Mus musculus
ggacactttgtggaattagacttag

SEQ ID NO: 589567 - DNA, 25 bp, Mus musculus
ggacactttgtgttctgttgaaaac

SEQ ID NO: 589568 - DNA, 25 bp, Mus musculus
ggacacttttaccacttgggcaaca

SEQ ID NO: 589569 - DNA, 25 bp, Mus musculus
ggacacttttacgacttgggcaaca

SEQ ID NO: 589570 - DNA, 25 bp, Mus musculus
ggacacttttctacgttggtgcgaa

SEQ ID NO: 589571 - DNA, 25 bp, Mus musculus
ggacacttttcttcgttggtgcgaa

SEQ ID NO: 589572 - DNA, 25 bp, Mus musculus
ggacactttttacggtgcctggaca

SEQ ID NO: 589573 - DNA, 25 bp, Mus musculus
ggacactttttagggtgcctggaca

SEQ ID NO: 589574 - DNA, 25 bp, Mus musculus
ggacagaaaacaacagctgccctgt

SEQ ID NO: 589575 - DNA, 25 bp, Mus musculus
ggacagaaaacatcagctgccctgt

SEQ ID NO: 589576 - DNA, 25 bp, Mus musculus
ggacagaaagctcctcgctgaaagg

SEQ ID NO: 589577 - DNA, 25 bp, Mus musculus
ggacagaaagctgctcgctgaaagg

SEQ ID NO: 589578 - DNA, 25 bp, Mus musculus
ggacagaaataactaagatacacat

SEQ ID NO: 589579 - DNA, 25 bp, Mus musculus
ggacagaaataagtaagatacacat

SEQ ID NO: 589580 - DNA, 25 bp, Mus musculus
ggacagaacaacatttctcccacag

SEQ ID NO: 589581 - DNA, 25 bp, Mus musculus
ggacagaacaacttttctcccacag

SEQ ID NO: 589582 - DNA, 25 bp, Mus musculus
ggacagaaccaactagggcttagct

SEQ ID NO: 589583 - DNA, 25 bp, Mus musculus
ggacagaaccaagtagggcttagct

SEQ ID NO: 589584 - DNA, 25 bp, Mus musculus
ggacagaaccagatagctgccataa

SEQ ID NO: 589585 - DNA, 25 bp, Mus musculus
ggacagaaccagttagctgccataa

SEQ ID NO: 589586 - DNA, 25 bp, Mus musculus
ggacagaagatccttttcggcccta

SEQ ID NO: 589587 - DNA, 25 bp, Mus musculus
ggacagaagatcgttttcggcccta

SEQ ID NO: 589588 - DNA, 25 bp, Mus musculus
ggacagaagcacacagaccacgatg

SEQ ID NO: 589589 - DNA, 25 bp, Mus musculus
ggacagaagcactcagaccacgatg

SEQ ID NO: 589590 - DNA, 25 bp, Mus musculus
ggacagaagccccatcgtcagatga

SEQ ID NO: 589591 - DNA, 25 bp, Mus musculus
ggacagaagcccgatcgtcagatga

SEQ ID NO: 589592 - DNA, 25 bp, Mus musculus
ggacagaagcctcgacacccctggt

SEQ ID NO: 589593 - DNA, 25 bp, Mus musculus
ggacagaagcctggacacccctggt

SEQ ID NO: 589594 - DNA, 25 bp, Mus musculus
ggacagaaggcccatttgccatgct

SEQ ID NO: 589595 - DNA, 25 bp, Mus musculus
ggacagaaggccgatttgccatgct

SEQ ID NO: 589596 - DNA, 25 bp, Mus musculus
ggacagaataaacaatgcagacact

SEQ ID NO: 589597 - DNA, 25 bp, Mus musculus
ggacagaataaagaatgcagacact

SEQ ID NO: 589598 - DNA, 25 bp, Mus musculus
ggacagaatcacattataacctact

SEQ ID NO: 589599 - DNA, 25 bp, Mus musculus
ggacagaatcactttataacctact

SEQ ID NO: 589600 - DNA, 25 bp, Mus musculus
ggacagaatgtcagatgatcccctt

SEQ ID NO: 589601 - DNA, 25 bp, Mus musculus
ggacagaatgtctgatgatcccctt

SEQ ID NO: 589602 - DNA, 25 bp, Mus musculus
ggacagaatttcaggcactgttcaa

SEQ ID NO: 589603 - DNA, 25 bp, Mus musculus
ggacagaatttctggcactgttcaa

SEQ ID NO: 589604 - DNA, 25 bp, Mus musculus
ggacagacaactcatcactgatcta

SEQ ID NO: 589605 - DNA, 25 bp, Mus musculus
ggacagacaactgatcactgatcta

SEQ ID NO: 589606 - DNA, 25 bp, Mus musculus
ggacagacaagcattgactcctctg

SEQ ID NO: 589607 - DNA, 25 bp, Mus musculus
ggacagacaagctttgactcctctg

SEQ ID NO: 589608 - DNA, 25 bp, Mus musculus
ggacagacatgcatcatcatgaaga

SEQ ID NO: 589609 - DNA, 25 bp, Mus musculus
ggacagacatgccatacaggtactt

SEQ ID NO: 589610 - DNA, 25 bp, Mus musculus
ggacagacatgcgatacaggtactt

SEQ ID NO: 589611 - DNA, 25 bp, Mus musculus
ggacagacatgcttcatcatgaaga

SEQ ID NO: 589612 - DNA, 25 bp, Mus musculus
ggacagacatggacaggaccctgct

SEQ ID NO: 589613 - DNA, 25 bp, Mus musculus
ggacagacatggtcaggaccctgct

SEQ ID NO: 589614 - DNA, 25 bp, Mus musculus
ggacagaccctgattggctgagcaa

SEQ ID NO: 589615 - DNA, 25 bp, Mus musculus
ggacagaccctgtttggctgagcaa

SEQ ID NO: 589616 - DNA, 25 bp, Mus musculus
ggacagaccgaccactttggagtaa

SEQ ID NO: 589617 - DNA, 25 bp, Mus musculus
ggacagaccgacgactttggagtaa

SEQ ID NO: 589618 - DNA, 25 bp, Mus musculus
ggacagaccgtcaagaacacctcga

SEQ ID NO: 589619 - DNA, 25 bp, Mus musculus
ggacagaccgtctagaacacctcga

SEQ ID NO: 589620 - DNA, 25 bp, Mus musculus
ggacagactaacagctgcgaagtga

SEQ ID NO: 589621 - DNA, 25 bp, Mus musculus
ggacagactaactgctgcgaagtga

SEQ ID NO: 589622 - DNA, 25 bp, Mus musculus
ggacagactggcacttaggaacccc

SEQ ID NO: 589623 - DNA, 25 bp, Mus musculus
ggacagactggctcttaggaacccc

SEQ ID NO: 589624 - DNA, 25 bp, Mus musculus
ggacagactttcaattcagcagaga

SEQ ID NO: 589625 - DNA, 25 bp, Mus musculus
ggacagactttctattcagcagaga

SEQ ID NO: 589626 - DNA, 25 bp, Mus musculus
ggacagactttgagttatgtttcta

SEQ ID NO: 589627 - DNA, 25 bp, Mus musculus
ggacagactttgtgttatgtttcta

SEQ ID NO: 589628 - DNA, 25 bp, Mus musculus
ggacagagaaaccatcgctacttat

SEQ ID NO: 589629 - DNA, 25 bp, Mus musculus
ggacagagaaacgatcgctacttat

SEQ ID NO: 589630 - DNA, 25 bp, Mus musculus
ggacagagaacacctagcaggaatg

SEQ ID NO: 589631 - DNA, 25 bp, Mus musculus
ggacagagaacagctagcaggaatg

SEQ ID NO: 589632 - DNA, 25 bp, Mus musculus
ggacagagaccaaagaccatcaaga

SEQ ID NO: 589633 - DNA, 25 bp, Mus musculus
ggacagagaccatagaccatcaaga

SEQ ID NO: 589634 - DNA, 25 bp, Mus musculus
ggacagagacccatgaccccagagt

SEQ ID NO: 589635 - DNA, 25 bp, Mus musculus
ggacagagacccttgaccccagagt

SEQ ID NO: 589636 - DNA, 25 bp, Mus musculus
ggacagagactgaccactgcctccg

SEQ ID NO: 589637 - DNA, 25 bp, Mus musculus
ggacagagactgagcacttctgatg

SEQ ID NO: 589638 - DNA, 25 bp, Mus musculus
ggacagagactgtccactgcctccg

SEQ ID NO: 589639 - DNA, 25 bp, Mus musculus
ggacagagactgtgcacttctgatg

SEQ ID NO: 589640 - DNA, 25 bp, Mus musculus
ggacagagacttactccgtgtctaa

SEQ ID NO: 589641 - DNA, 25 bp, Mus musculus
ggacagagactttctccgtgtctaa

SEQ ID NO: 589642 - DNA, 25 bp, Mus musculus
ggacagagatgccagtgttaaacaa

SEQ ID NO: 589643 - DNA, 25 bp, Mus musculus
ggacagagatgcgagtgttaaacaa

SEQ ID NO: 589644 - DNA, 25 bp, Mus musculus
ggacagagcatcaaacagacatttc

SEQ ID NO: 589645 - DNA, 25 bp, Mus musculus
ggacagagcatctaacagacatttc

SEQ ID NO: 589646 - DNA, 25 bp, Mus musculus
ggacagagccctacccactgagatg

SEQ ID NO: 589647 - DNA, 25 bp, Mus musculus
ggacagagcccttcccactgagatg

SEQ ID NO: 589648 - DNA, 25 bp, Mus musculus
ggacagaggcccacaaccaccacaa

SEQ ID NO: 589649 - DNA, 25 bp, Mus musculus
ggacagaggccctcaaccaccacaa

SEQ ID NO: 589650 - DNA, 25 bp, Mus musculus
ggacagaggcctatataatccatgg

SEQ ID NO: 589651 - DNA, 25 bp, Mus musculus
ggacagaggcctttataatccatgg

SEQ ID NO: 589652 - DNA, 25 bp, Mus musculus
ggacagagtacaaatttgggttggt

SEQ ID NO: 589653 - DNA, 25 bp, Mus musculus
ggacagagtacatatttgggttggt

SEQ ID NO: 589654 - DNA, 25 bp, Mus musculus
ggacagagtcatccctgacagggtc

SEQ ID NO: 589655 - DNA, 25 bp, Mus musculus
ggacagagtcatgcctgacagggtc

SEQ ID NO: 589656 - DNA, 25 bp, Mus musculus
ggacagagtctacgtttggcaagct

SEQ ID NO: 589657 - DNA, 25 bp, Mus musculus
ggacagagtctaggtttggcaagct

SEQ ID NO: 589658 - DNA, 25 bp, Mus musculus
ggacagagtttcctctccaccatgg

SEQ ID NO: 589659 - DNA, 25 bp, Mus musculus
ggacagagtttcgtctccaccatgg

SEQ ID NO: 589660 - DNA, 25 bp, Mus musculus
ggacagataggacagcacaaggact

SEQ ID NO: 589661 - DNA, 25 bp, Mus musculus
ggacagataggagagcacaaggact

SEQ ID NO: 589662 - DNA, 25 bp, Mus musculus
ggacagatatcaacaggcgaagcat

SEQ ID NO: 589663 - DNA, 25 bp, Mus musculus
ggacagatatcatcaggcgaagcat

SEQ ID NO: 589664 - DNA, 25 bp, Mus musculus
ggacagatcagtattgacctcttat

SEQ ID NO: 589665 - DNA, 25 bp, Mus musculus
ggacagatcagttttgacctcttat

SEQ ID NO: 589666 - DNA, 25 bp, Mus musculus
ggacagatccaccaatgttttcaac

SEQ ID NO: 589667 - DNA, 25 bp, Mus musculus
ggacagatccacgaatgttttcaac

SEQ ID NO: 589668 - DNA, 25 bp, Mus musculus
ggacagatcctaagggtggagccct

SEQ ID NO: 589669 - DNA, 25 bp, Mus musculus
ggacagatcctatgggtggagccct

SEQ ID NO: 589670 - DNA, 25 bp, Mus musculus
ggacagatcgaaagccagtattttg

SEQ ID NO: 589671 - DNA, 25 bp, Mus musculus
ggacagatcgaatgccagtattttg

SEQ ID NO: 589672 - DNA, 25 bp, Mus musculus
ggacagatctttatgacactaaggt

SEQ ID NO: 589673 - DNA, 25 bp, Mus musculus
ggacagatctttttgacactaaggt

SEQ ID NO: 589674 - DNA, 25 bp, Mus musculus
ggacagatgaacaatctttacttgg

SEQ ID NO: 589675 - DNA, 25 bp, Mus musculus
ggacagatgaactatctttacttgg

SEQ ID NO: 589676 - DNA, 25 bp, Mus musculus
ggacagatgagcacgctgactccaa

SEQ ID NO: 589677 - DNA, 25 bp, Mus musculus
ggacagatgagctcgctgactccaa

SEQ ID NO: 589678 - DNA, 25 bp, Mus musculus
ggacagatgattattacaccgtacg

SEQ ID NO: 589679 - DNA, 25 bp, Mus musculus
ggacagatgattctcccaagaactc

SEQ ID NO: 589680 - DNA, 25 bp, Mus musculus
ggacagatgattgtcccaagaactc

SEQ ID NO: 589681 - DNA, 25 bp, Mus musculus
ggacagatgatttttacaccgtacg

SEQ ID NO: 589682 - DNA, 25 bp, Mus musculus
ggacagatgcttactctcctggttt

SEQ ID NO: 589683 - DNA, 25 bp, Mus musculus
ggacagatgctttctctcctggttt

SEQ ID NO: 589684 - DNA, 25 bp, Mus musculus
ggacagatggatacttacactaggt

SEQ ID NO: 589685 - DNA, 25 bp, Mus musculus
ggacagatggattcttacactaggt

SEQ ID NO: 589686 - DNA, 25 bp, Mus musculus
ggacagatgtatccaaccctttttg

SEQ ID NO: 589687 - DNA, 25 bp, Mus musculus
ggacagatgtatgcaaccctttttg

SEQ ID NO: 589688 - DNA, 25 bp, Mus musculus
ggacagatgtctacacagagcagcc

SEQ ID NO: 589689 - DNA, 25 bp, Mus musculus
ggacagatgtcttcacagagcagcc

SEQ ID NO: 589690 - DNA, 25 bp, Mus musculus
ggacagatgttcactactcctggaa

SEQ ID NO: 589691 - DNA, 25 bp, Mus musculus
ggacagatgttctctactcctggaa

SEQ ID NO: 589692 - DNA, 25 bp, Mus musculus
ggacagatgttgaggtctcttcacc

SEQ ID NO: 589693 - DNA, 25 bp, Mus musculus
ggacagatgttgtggtctcttcacc

SEQ ID NO: 589694 - DNA, 25 bp, Mus musculus
ggacagattaacaccgatgatcagt

SEQ ID NO: 589695 - DNA, 25 bp, Mus musculus
ggacagattaactccgatgatcagt

SEQ ID NO: 589696 - DNA, 25 bp, Mus musculus
ggacagattacaacacttcttcaag

SEQ ID NO: 589697 - DNA, 25 bp, Mus musculus
ggacagattacatcacttcttcaag

SEQ ID NO: 589698 - DNA, 25 bp, Mus musculus
ggacagatttggacattggtggctt

SEQ ID NO: 589699 - DNA, 25 bp, Mus musculus
ggacagatttggtcattggtggctt

SEQ ID NO: 589700 - DNA, 25 bp, Mus musculus
ggacagcaaaatacccttggtctct

SEQ ID NO: 589701 - DNA, 25 bp, Mus musculus
ggacagcaaaattcccttggtctct

SEQ ID NO: 589702 - DNA, 25 bp, Mus musculus
ggacagcaaagacaggcaccctaca

SEQ ID NO: 589703 - DNA, 25 bp, Mus musculus
ggacagcaaagagaggcaccctaca

SEQ ID NO: 589704 - DNA, 25 bp, Mus musculus
ggacagcaacctacttgtatgttca

SEQ ID NO: 589705 - DNA, 25 bp, Mus musculus
ggacagcaaccttcttgtatgttca

SEQ ID NO: 589706 - DNA, 25 bp, Mus musculus
ggacagcaacgccacacgtagaaat

SEQ ID NO: 589707 - DNA, 25 bp, Mus musculus
ggacagcaacgcgacacgtagaaat

SEQ ID NO: 589708 - DNA, 25 bp, Mus musculus
ggacagcaactcaagcagaaactct

SEQ ID NO: 589709 - DNA, 25 bp, Mus musculus
ggacagcaactctagcagaaactct

SEQ ID NO: 589710 - DNA, 25 bp, Mus musculus
ggacagcaagcccataacgctggac

SEQ ID NO: 589711 - DNA, 25 bp, Mus musculus
ggacagcaagccgataacgctggac

SEQ ID NO: 589712 - DNA, 25 bp, Mus musculus
ggacagcaccttatgttttagaaag

SEQ ID NO: 589713 - DNA, 25 bp, Mus musculus
ggacagcaccttttgttttagaaag

SEQ ID NO: 589714 - DNA, 25 bp, Mus musculus
ggacagcacgggaaaccacctagca

SEQ ID NO: 589715 - DNA, 25 bp, Mus musculus
ggacagcacgggtaaccacctagca

SEQ ID NO: 589716 - DNA, 25 bp, Mus musculus
ggacagcacgtccacagtttggaaa

SEQ ID NO: 589717 - DNA, 25 bp, Mus musculus
ggacagcacgtcgacagtttggaaa

SEQ ID NO: 589718 - DNA, 25 bp, Mus musculus
ggacagcactaacacatcccatgaa

SEQ ID NO: 589719 - DNA, 25 bp, Mus musculus
ggacagcactaactggcttcaatgg

SEQ ID NO: 589720 - DNA, 25 bp, Mus musculus
ggacagcactaagacatcccatgaa

SEQ ID NO: 589721 - DNA, 25 bp, Mus musculus
ggacagcactaagtggcttcaatgg

SEQ ID NO: 589722 - DNA, 25 bp, Mus musculus
ggacagcactccaggccagatggac

SEQ ID NO: 589723 - DNA, 25 bp, Mus musculus
ggacagcactcctggccagatggac

SEQ ID NO: 589724 - DNA, 25 bp, Mus musculus
ggacagcagagtctatttctttaaa

SEQ ID NO: 589725 - DNA, 25 bp, Mus musculus
ggacagcagagtgtatttctttaaa

SEQ ID NO: 589726 - DNA, 25 bp, Mus musculus
ggacagcagcagattattcaggctc

SEQ ID NO: 589727 - DNA, 25 bp, Mus musculus
ggacagcagcagtttattcaggctc

SEQ ID NO: 589728 - DNA, 25 bp, Mus musculus
ggacagcagccacaaagctatcttt

SEQ ID NO: 589729 - DNA, 25 bp, Mus musculus
ggacagcagccagaaagctatcttt

SEQ ID NO: 589730 - DNA, 25 bp, Mus musculus
ggacagcagcttctagaggattctt

SEQ ID NO: 589731 - DNA, 25 bp, Mus musculus
ggacagcagcttgtagaggattctt

SEQ ID NO: 589732 - DNA, 25 bp, Mus musculus
ggacagcagtagatcctctatttgg

SEQ ID NO: 589733 - DNA, 25 bp, Mus musculus
ggacagcagtagttcctctatttgg

SEQ ID NO: 589734 - DNA, 25 bp, Mus musculus
ggacagcagtgaccctgatactggt

SEQ ID NO: 589735 - DNA, 25 bp, Mus musculus
ggacagcagtgagcctgatactggt

SEQ ID NO: 589736 - DNA, 25 bp, Mus musculus
ggacagcagttgaagcccctagaac

SEQ ID NO: 589737 - DNA, 25 bp, Mus musculus
ggacagcagttgtagcccctagaac

SEQ ID NO: 589738 - DNA, 25 bp, Mus musculus
ggacagcatcaaaccttacatgtac

SEQ ID NO: 589739 - DNA, 25 bp, Mus musculus
ggacagcatcaatccttacatgtac

SEQ ID NO: 589740 - DNA, 25 bp, Mus musculus
ggacagcatcatcactaagcataca

SEQ ID NO: 589741 - DNA, 25 bp, Mus musculus
ggacagcatcatgactaagcataca

SEQ ID NO: 589742 - DNA, 25 bp, Mus musculus
ggacagcatctcaagggacagcatc

SEQ ID NO: 589743 - DNA, 25 bp, Mus musculus
ggacagcatctctagggacagcatc

SEQ ID NO: 589744 - DNA, 25 bp, Mus musculus
ggacagcatctgatgctttctctgt

SEQ ID NO: 589745 - DNA, 25 bp, Mus musculus
ggacagcatctgctccaccagctat

SEQ ID NO: 589746 - DNA, 25 bp, Mus musculus
ggacagcatctggtccaccagctat

SEQ ID NO: 589747 - DNA, 25 bp, Mus musculus
ggacagcatctgttgctttctctgt

SEQ ID NO: 589748 - DNA, 25 bp, Mus musculus
ggacagcatgatatcctgaagcggg

SEQ ID NO: 589749 - DNA, 25 bp, Mus musculus
ggacagcatgatttcctgaagcggg

SEQ ID NO: 589750 - DNA, 25 bp, Mus musculus
ggacagcattaacattgtaagcaca

SEQ ID NO: 589751 - DNA, 25 bp, Mus musculus
ggacagcattaagattgtaagcaca

SEQ ID NO: 589752 - DNA, 25 bp, Mus musculus
ggacagcattcgcagcaggaccata

SEQ ID NO: 589753 - DNA, 25 bp, Mus musculus
ggacagcattcggagcaggaccata

SEQ ID NO: 589754 - DNA, 25 bp, Mus musculus
ggacagcatttcaagcgccagttca

SEQ ID NO: 589755 - DNA, 25 bp, Mus musculus
ggacagcatttcatacgtaaccatt

SEQ ID NO: 589756 - DNA, 25 bp, Mus musculus
ggacagcatttctagcgccagttca

SEQ ID NO: 589757 - DNA, 25 bp, Mus musculus
ggacagcatttcttacgtaaccatt

SEQ ID NO: 589758 - DNA, 25 bp, Mus musculus
ggacagccaatcaagctgaactgat

SEQ ID NO: 589759 - DNA, 25 bp, Mus musculus
ggacagccaatctagctgaactgat

SEQ ID NO: 589760 - DNA, 25 bp, Mus musculus
ggacagccacaaataccgatgttcc

SEQ ID NO: 589761 - DNA, 25 bp, Mus musculus
ggacagccacaattaccgatgttcc

SEQ ID NO: 589762 - DNA, 25 bp, Mus musculus
ggacagccagacatcaatatcagtt

SEQ ID NO: 589763 - DNA, 25 bp, Mus musculus
ggacagccagacttcaatatcagtt

SEQ ID NO: 589764 - DNA, 25 bp, Mus musculus
ggacagccagagctctcgaacttca

SEQ ID NO: 589765 - DNA, 25 bp, Mus musculus
ggacagccagaggtctcgaacttca

SEQ ID NO: 589766 - DNA, 25 bp, Mus musculus
ggacagccagcccagttgagaagta

SEQ ID NO: 589767 - DNA, 25 bp, Mus musculus
ggacagccagccgagttgagaagta

SEQ ID NO: 589768 - DNA, 25 bp, Mus musculus
ggacagccagctctactgtatggaa

SEQ ID NO: 589769 - DNA, 25 bp, Mus musculus
ggacagccagctgtactgtatggaa

SEQ ID NO: 589770 - DNA, 25 bp, Mus musculus
ggacagccagttctagaaaaccttt

SEQ ID NO: 589771 - DNA, 25 bp, Mus musculus
ggacagccagttgtagaaaaccttt

SEQ ID NO: 589772 - DNA, 25 bp, Mus musculus
ggacagcccaagaaaggacatctta

SEQ ID NO: 589773 - DNA, 25 bp, Mus musculus
ggacagcccaagtaaggacatctta

SEQ ID NO: 589774 - DNA, 25 bp, Mus musculus
ggacagcccacaccagtagtctaga

SEQ ID NO: 589775 - DNA, 25 bp, Mus musculus
ggacagcccacagcagtagtctaga

SEQ ID NO: 589776 - DNA, 25 bp, Mus musculus
ggacagcccagacagactttgccgc

SEQ ID NO: 589777 - DNA, 25 bp, Mus musculus
ggacagcccagagagactttgccgc

SEQ ID NO: 589778 - DNA, 25 bp, Mus musculus
ggacagcccagtagccattgtggga

SEQ ID NO: 589779 - DNA, 25 bp, Mus musculus
ggacagcccagttgccattgtggga

SEQ ID NO: 589780 - DNA, 25 bp, Mus musculus
ggacagcccataaatcaccgggcat

SEQ ID NO: 589781 - DNA, 25 bp, Mus musculus
ggacagcccatatatcaccgggcat

SEQ ID NO: 589782 - DNA, 25 bp, Mus musculus
ggacagccccaccatgaagaagaaa

SEQ ID NO: 589783 - DNA, 25 bp, Mus musculus
ggacagccccacgatgaagaagaaa

SEQ ID NO: 589784 - DNA, 25 bp, Mus musculus
ggacagcccctgagtgtgcttatgc

SEQ ID NO: 589785 - DNA, 25 bp, Mus musculus
ggacagcccctgtgtgtgcttatgc

SEQ ID NO: 589786 - DNA, 25 bp, Mus musculus
ggacagccctgaaggtcactacaga

SEQ ID NO: 589787 - DNA, 25 bp, Mus musculus
ggacagccctgatggtcactacaga

SEQ ID NO: 589788 - DNA, 25 bp, Mus musculus
ggacagccgggtactgcttgatgac

SEQ ID NO: 589789 - DNA, 25 bp, Mus musculus
ggacagccgggttctgcttgatgac

SEQ ID NO: 589790 - DNA, 25 bp, Mus musculus
ggacagcctaggactgagagccatt

SEQ ID NO: 589791 - DNA, 25 bp, Mus musculus
ggacagcctaggtctgagagccatt

SEQ ID NO: 589792 - DNA, 25 bp, Mus musculus
ggacagcctgctcccagacaagtct

SEQ ID NO: 589793 - DNA, 25 bp, Mus musculus
ggacagcctgctgccagacaagtct

SEQ ID NO: 589794 - DNA, 25 bp, Mus musculus
ggacagcctggaatacataggtaca

SEQ ID NO: 589795 - DNA, 25 bp, Mus musculus
ggacagcctggattacataggtaca

SEQ ID NO: 589796 - DNA, 25 bp, Mus musculus
ggacagcctgttcggcttgcagcct

SEQ ID NO: 589797 - DNA, 25 bp, Mus musculus
ggacagcctgttgggcttgcagcct

SEQ ID NO: 589798 - DNA, 25 bp, Mus musculus
ggacagcgagatccttagggcccct

SEQ ID NO: 589799 - DNA, 25 bp, Mus musculus
ggacagcgagatgcttagggcccct

SEQ ID NO: 589800 - DNA, 25 bp, Mus musculus
ggacagcgcccaacgcttgttcatc

SEQ ID NO: 589801 - DNA, 25 bp, Mus musculus
ggacagcgcccatcgcttgttcatc

SEQ ID NO: 589802 - DNA, 25 bp, Mus musculus
ggacagcgcgcaacacacgggcaca

SEQ ID NO: 589803 - DNA, 25 bp, Mus musculus
ggacagcgcgcatcacacgggcaca

SEQ ID NO: 589804 - DNA, 25 bp, Mus musculus
ggacagcgggcacgtacaccatgtc

SEQ ID NO: 589805 - DNA, 25 bp, Mus musculus
ggacagcgggcaggtacaccatgtc

SEQ ID NO: 589806 - DNA, 25 bp, Mus musculus
ggacagcgtcataattttatgacac

SEQ ID NO: 589807 - DNA, 25 bp, Mus musculus
ggacagcgtcattattttatgacac

SEQ ID NO: 589808 - DNA, 25 bp, Mus musculus
ggacagcgttcactgcacagcaggt

SEQ ID NO: 589809 - DNA, 25 bp, Mus musculus
ggacagcgttcagtgcacagcaggt

SEQ ID NO: 589810 - DNA, 25 bp, Mus musculus
ggacagctaagtactccaggagaca

SEQ ID NO: 589811 - DNA, 25 bp, Mus musculus
ggacagctaagttctccaggagaca

SEQ ID NO: 589812 - DNA, 25 bp, Mus musculus
ggacagctacaactatctgggattt

SEQ ID NO: 589813 - DNA, 25 bp, Mus musculus
ggacagctacaagtatctgggattt

SEQ ID NO: 589814 - DNA, 25 bp, Mus musculus
ggacagctaccgatggaggcattat

SEQ ID NO: 589815 - DNA, 25 bp, Mus musculus
ggacagctaccgttggaggcattat

SEQ ID NO: 589816 - DNA, 25 bp, Mus musculus
ggacagctcaccagggatggctcgt

SEQ ID NO: 589817 - DNA, 25 bp, Mus musculus
ggacagctcacctgggatggctcgt

SEQ ID NO: 589818 - DNA, 25 bp, Mus musculus
ggacagctcacgacctgaccctggg

SEQ ID NO: 589819 - DNA, 25 bp, Mus musculus
ggacagctcacgtcctgaccctggg

SEQ ID NO: 589820 - DNA, 25 bp, Mus musculus
ggacagctcactccctctaggatgg

SEQ ID NO: 589821 - DNA, 25 bp, Mus musculus
ggacagctcactgcctctaggatgg

SEQ ID NO: 589822 - DNA, 25 bp, Mus musculus
ggacagctcagtaacagcatcacat

SEQ ID NO: 589823 - DNA, 25 bp, Mus musculus
ggacagctcagttacagcatcacat

SEQ ID NO: 589824 - DNA, 25 bp, Mus musculus
ggacagctcccgaagcaacctggtt

SEQ ID NO: 589825 - DNA, 25 bp, Mus musculus
ggacagctcccgtagcaacctggtt

SEQ ID NO: 589826 - DNA, 25 bp, Mus musculus
ggacagctccggagacggtcagcac

SEQ ID NO: 589827 - DNA, 25 bp, Mus musculus
ggacagctccggtgacggtcagcac

SEQ ID NO: 589828 - DNA, 25 bp, Mus musculus
ggacagctctgaactcgggtagaca

SEQ ID NO: 589829 - DNA, 25 bp, Mus musculus
ggacagctctgatctcgggtagaca

SEQ ID NO: 589830 - DNA, 25 bp, Mus musculus
ggacagctctgtaggaaaggtttaa

SEQ ID NO: 589831 - DNA, 25 bp, Mus musculus
ggacagctctgttggaaaggtttaa

SEQ ID NO: 589832 - DNA, 25 bp, Mus musculus
ggacagctgaacctcaatcccggga

SEQ ID NO: 589833 - DNA, 25 bp, Mus musculus
ggacagctgaacgtcaatcccggga

SEQ ID NO: 589834 - DNA, 25 bp, Mus musculus
ggacagctgataattgcacatgact

SEQ ID NO: 589835 - DNA, 25 bp, Mus musculus
ggacagctgatatttgcacatgact

SEQ ID NO: 589836 - DNA, 25 bp, Mus musculus
ggacagctgggtcgcccctcttcaa

SEQ ID NO: 589837 - DNA, 25 bp, Mus musculus
ggacagctgggtggcccctcttcaa

SEQ ID NO: 589838 - DNA, 25 bp, Mus musculus
ggacagctgtacagggcagttctgc

SEQ ID NO: 589839 - DNA, 25 bp, Mus musculus
ggacagctgtacatctagctcggaa

SEQ ID NO: 589840 - DNA, 25 bp, Mus musculus
ggacagctgtactgggcagttctgc

SEQ ID NO: 589841 - DNA, 25 bp, Mus musculus
ggacagctgtacttctagctcggaa

SEQ ID NO: 589842 - DNA, 25 bp, Mus musculus
ggacagctgtctagtgcgggatttt

SEQ ID NO: 589843 - DNA, 25 bp, Mus musculus
ggacagctgtctattccggaagtga

SEQ ID NO: 589844 - DNA, 25 bp, Mus musculus
ggacagctgtcttgtgcgggatttt

SEQ ID NO: 589845 - DNA, 25 bp, Mus musculus
ggacagctgtcttttccggaagtga

SEQ ID NO: 589846 - DNA, 25 bp, Mus musculus
ggacagctgtgactgggcctaaaac

SEQ ID NO: 589847 - DNA, 25 bp, Mus musculus
ggacagctgtgagtgggcctaaaac

SEQ ID NO: 589848 - DNA, 25 bp, Mus musculus
ggacagctgtgtattaagtgagact

SEQ ID NO: 589849 - DNA, 25 bp, Mus musculus
ggacagctgtgtcagccactgccat

SEQ ID NO: 589850 - DNA, 25 bp, Mus musculus
ggacagctgtgtgagccactgccat

SEQ ID NO: 589851 - DNA, 25 bp, Mus musculus
ggacagctgtgttttaagtgagact

SEQ ID NO: 589852 - DNA, 25 bp, Mus musculus
ggacagcttaatatacctagataga

SEQ ID NO: 589853 - DNA, 25 bp, Mus musculus
ggacagcttaatttacctagataga

SEQ ID NO: 589854 - DNA, 25 bp, Mus musculus
ggacagcttaccattggattcaaac

SEQ ID NO: 589855 - DNA, 25 bp, Mus musculus
ggacagcttacctttggattcaaac

SEQ ID NO: 589856 - DNA, 25 bp, Mus musculus
ggacagcttagacccaccagctcag

SEQ ID NO: 589857 - DNA, 25 bp, Mus musculus
ggacagcttagagccaccagctcag

SEQ ID NO: 589858 - DNA, 25 bp, Mus musculus
ggacagcttcctcagttttcccaag

SEQ ID NO: 589859 - DNA, 25 bp, Mus musculus
ggacagcttcctgagttttcccaag

SEQ ID NO: 589860 - DNA, 25 bp, Mus musculus
ggacagcttctaattccatgttcct

SEQ ID NO: 589861 - DNA, 25 bp, Mus musculus
ggacagcttctatttccatgttcct

SEQ ID NO: 589862 - DNA, 25 bp, Mus musculus
ggacagcttctgacttgtctctgga

SEQ ID NO: 589863 - DNA, 25 bp, Mus musculus
ggacagcttctgtcttgtctctgga

SEQ ID NO: 589864 - DNA, 25 bp, Mus musculus
ggacagcttcttaccacattgtatt

SEQ ID NO: 589865 - DNA, 25 bp, Mus musculus
ggacagcttctttccacattgtatt

SEQ ID NO: 589866 - DNA, 25 bp, Mus musculus
ggacagcttgatcaccttagagaca

SEQ ID NO: 589867 - DNA, 25 bp, Mus musculus
ggacagcttgatgaccttagagaca

SEQ ID NO: 589868 - DNA, 25 bp, Mus musculus
ggacagcttgtacgatctctcatcc

SEQ ID NO: 589869 - DNA, 25 bp, Mus musculus
ggacagcttgtactttgccaggatt

SEQ ID NO: 589870 - DNA, 25 bp, Mus musculus
ggacagcttgtaggatctctcatcc

SEQ ID NO: 589871 - DNA, 25 bp, Mus musculus
ggacagcttgtagtttgccaggatt

SEQ ID NO: 589872 - DNA, 25 bp, Mus musculus
ggacagctttccacagaagtgatta

SEQ ID NO: 589873 - DNA, 25 bp, Mus musculus
ggacagctttcctcagaagtgatta

SEQ ID NO: 589874 - DNA, 25 bp, Mus musculus
ggacagctttgacgttcgtgtttgt

SEQ ID NO: 589875 - DNA, 25 bp, Mus musculus
ggacagctttgaggttcgtgtttgt

SEQ ID NO: 589876 - DNA, 25 bp, Mus musculus
ggacagctttgtcacatcaggtgtt

SEQ ID NO: 589877 - DNA, 25 bp, Mus musculus
ggacagctttgtgacatcaggtgtt

SEQ ID NO: 589878 - DNA, 25 bp, Mus musculus
ggacagcttttacaatcttttaaat

SEQ ID NO: 589879 - DNA, 25 bp, Mus musculus
ggacagcttttagaatcttttaaat

SEQ ID NO: 589880 - DNA, 25 bp, Mus musculus
ggacaggaaacccaagacagcacag

SEQ ID NO: 589881 - DNA, 25 bp, Mus musculus
ggacaggaaaccgaagacagcacag

SEQ ID NO: 589882 - DNA, 25 bp, Mus musculus
ggacaggaacctaaccagtgattaa

SEQ ID NO: 589883 - DNA, 25 bp, Mus musculus
ggacaggaacctactgtgccttgag

SEQ ID NO: 589884 - DNA, 25 bp, Mus musculus
ggacaggaaccttaccagtgattaa

SEQ ID NO: 589885 - DNA, 25 bp, Mus musculus
ggacaggaaccttctgtgccttgag

SEQ ID NO: 589886 - DNA, 25 bp, Mus musculus
ggacaggaagatactcctgactgct

SEQ ID NO: 589887 - DNA, 25 bp, Mus musculus
ggacaggaagattctcctgactgct

SEQ ID NO: 589888 - DNA, 25 bp, Mus musculus
ggacaggaatcaatggccatgttaa

SEQ ID NO: 589889 - DNA, 25 bp, Mus musculus
ggacaggaatcattggccatgttaa

SEQ ID NO: 589890 - DNA, 25 bp, Mus musculus
ggacaggacattaccacgcatgacc

SEQ ID NO: 589891 - DNA, 25 bp, Mus musculus
ggacaggacatttccacgcatgacc

SEQ ID NO: 589892 - DNA, 25 bp, Mus musculus
ggacaggaccctattttgattcaat

SEQ ID NO: 589893 - DNA, 25 bp, Mus musculus
ggacaggacccttttttgattcaat

SEQ ID NO: 589894 - DNA, 25 bp, Mus musculus
ggacaggacgaacgcatggctccat

SEQ ID NO: 589895 - DNA, 25 bp, Mus musculus
ggacaggacgaaggcatggctccat

SEQ ID NO: 589896 - DNA, 25 bp, Mus musculus
ggacaggactgcaccctgggaagaa

SEQ ID NO: 589897 - DNA, 25 bp, Mus musculus
ggacaggactgctccctgggaagaa

SEQ ID NO: 589898 - DNA, 25 bp, Mus musculus
ggacaggactggcttaatctccacc

SEQ ID NO: 589899 - DNA, 25 bp, Mus musculus
ggacaggactgggttaatctccacc

SEQ ID NO: 589900 - DNA, 25 bp, Mus musculus
ggacaggagcatcttgcatgtggtt

SEQ ID NO: 589901 - DNA, 25 bp, Mus musculus
ggacaggagcatgttgcatgtggtt

SEQ ID NO: 589902 - DNA, 25 bp, Mus musculus
ggacaggaggctagaccgtagtcaa

SEQ ID NO: 589903 - DNA, 25 bp, Mus musculus
ggacaggaggcttgaccgtagtcaa

SEQ ID NO: 589904 - DNA, 25 bp, Mus musculus
ggacaggagtatagccccagggctc

SEQ ID NO: 589905 - DNA, 25 bp, Mus musculus
ggacaggagtattgccccagggctc

SEQ ID NO: 589906 - DNA, 25 bp, Mus musculus
ggacaggatggtcctcatgtctcca

SEQ ID NO: 589907 - DNA, 25 bp, Mus musculus
ggacaggatggtgctcatgtctcca

SEQ ID NO: 589908 - DNA, 25 bp, Mus musculus
ggacaggcacttacccctggaggga

SEQ ID NO: 589909 - DNA, 25 bp, Mus musculus
ggacaggcactttcccctggaggga

SEQ ID NO: 589910 - DNA, 25 bp, Mus musculus
ggacaggcagagaccggccgtcata

SEQ ID NO: 589911 - DNA, 25 bp, Mus musculus
ggacaggcagagtccggccgtcata

SEQ ID NO: 589912 - DNA, 25 bp, Mus musculus
ggacaggcagccacagtacttgtat

SEQ ID NO: 589913 - DNA, 25 bp, Mus musculus
ggacaggcagcctcagtacttgtat

SEQ ID NO: 589914 - DNA, 25 bp, Mus musculus
ggacaggcagtacgccctgtgacct

SEQ ID NO: 589915 - DNA, 25 bp, Mus musculus
ggacaggcagtaggccctgtgacct

SEQ ID NO: 589916 - DNA, 25 bp, Mus musculus
ggacaggcatacaggaagccatcat

SEQ ID NO: 589917 - DNA, 25 bp, Mus musculus
ggacaggcatactggaagccatcat

SEQ ID NO: 589918 - DNA, 25 bp, Mus musculus
ggacaggccaagctgatccgccaga

SEQ ID NO: 589919 - DNA, 25 bp, Mus musculus
ggacaggccaaggtgatccgccaga

SEQ ID NO: 589920 - DNA, 25 bp, Mus musculus
ggacaggccatcatgtgatcattaa

SEQ ID NO: 589921 - DNA, 25 bp, Mus musculus
ggacaggccatcttgtgatcattaa

SEQ ID NO: 589922 - DNA, 25 bp, Mus musculus
ggacaggcccatctttggtcaggta

SEQ ID NO: 589923 - DNA, 25 bp, Mus musculus
ggacaggcccatgtttggtcaggta

SEQ ID NO: 589924 - DNA, 25 bp, Mus musculus
ggacaggcctccctaggacagatga

SEQ ID NO: 589925 - DNA, 25 bp, Mus musculus
ggacaggcctccgtaggacagatga

SEQ ID NO: 589926 - DNA, 25 bp, Mus musculus
ggacaggcgaccatacagcaagcag

SEQ ID NO: 589927 - DNA, 25 bp, Mus musculus
ggacaggcgaccttacagcaagcag

SEQ ID NO: 589928 - DNA, 25 bp, Mus musculus
ggacaggctccaaaacagcctttag

SEQ ID NO: 589929 - DNA, 25 bp, Mus musculus
ggacaggctccataacagcctttag

SEQ ID NO: 589930 - DNA, 25 bp, Mus musculus
ggacaggctgctccatgatcagagt

SEQ ID NO: 589931 - DNA, 25 bp, Mus musculus
ggacaggctgctgcatgatcagagt

SEQ ID NO: 589932 - DNA, 25 bp, Mus musculus
ggacaggctggaacacgacctaccg

SEQ ID NO: 589933 - DNA, 25 bp, Mus musculus
ggacaggctggatcacgacctaccg

SEQ ID NO: 589934 - DNA, 25 bp, Mus musculus
ggacaggcttccacaggccttgaga

SEQ ID NO: 589935 - DNA, 25 bp, Mus musculus
ggacaggcttcctcaggccttgaga

SEQ ID NO: 589936 - DNA, 25 bp, Mus musculus
ggacagggaataattcacctactcc

SEQ ID NO: 589937 - DNA, 25 bp, Mus musculus
ggacagggaatatttcacctactcc

SEQ ID NO: 589938 - DNA, 25 bp, Mus musculus
ggacagggaccaacttcagaagcag

SEQ ID NO: 589939 - DNA, 25 bp, Mus musculus
ggacagggaccaataaacttcatga

SEQ ID NO: 589940 - DNA, 25 bp, Mus musculus
ggacagggaccatcttcagaagcag

SEQ ID NO: 589941 - DNA, 25 bp, Mus musculus
ggacagggaccattaaacttcatga

SEQ ID NO: 589942 - DNA, 25 bp, Mus musculus
ggacagggagccacatgattacagc

SEQ ID NO: 589943 - DNA, 25 bp, Mus musculus
ggacagggagcctcatgattacagc

SEQ ID NO: 589944 - DNA, 25 bp, Mus musculus
ggacagggcaaactacctctgagaa

SEQ ID NO: 589945 - DNA, 25 bp, Mus musculus
ggacagggcaaagtacctctgagaa

SEQ ID NO: 589946 - DNA, 25 bp, Mus musculus
ggacagggtagcagcttggcccaaa

SEQ ID NO: 589947 - DNA, 25 bp, Mus musculus
ggacagggtagctgcttggcccaaa

SEQ ID NO: 589948 - DNA, 25 bp, Mus musculus
ggacagggtcacaagttcatgtact

SEQ ID NO: 589949 - DNA, 25 bp, Mus musculus
ggacagggtcactagttcatgtact

SEQ ID NO: 589950 - DNA, 25 bp, Mus musculus
ggacagggtctaaacttctagttag

SEQ ID NO: 589951 - DNA, 25 bp, Mus musculus
ggacagggtctatacttctagttag

SEQ ID NO: 589952 - DNA, 25 bp, Mus musculus
ggacagggtgacagttctcagtgta

SEQ ID NO: 589953 - DNA, 25 bp, Mus musculus
ggacagggtgactgttctcagtgta

SEQ ID NO: 589954 - DNA, 25 bp, Mus musculus
ggacagggtttcaaccttagaagct

SEQ ID NO: 589955 - DNA, 25 bp, Mus musculus
ggacagggtttctaccttagaagct

SEQ ID NO: 589956 - DNA, 25 bp, Mus musculus
ggacaggtacatacatagcactcag

SEQ ID NO: 589957 - DNA, 25 bp, Mus musculus
ggacaggtacattcatagcactcag

SEQ ID NO: 589958 - DNA, 25 bp, Mus musculus
ggacaggtcaccaactgagcagtgt

SEQ ID NO: 589959 - DNA, 25 bp, Mus musculus
ggacaggtcacctactgagcagtgt

SEQ ID NO: 589960 - DNA, 25 bp, Mus musculus
ggacaggtcagtacctatctgcaag

SEQ ID NO: 589961 - DNA, 25 bp, Mus musculus
ggacaggtcagttcctatctgcaag

SEQ ID NO: 589962 - DNA, 25 bp, Mus musculus
ggacaggtccatattttgagcaact

SEQ ID NO: 589963 - DNA, 25 bp, Mus musculus
ggacaggtccattttttgagcaact

SEQ ID NO: 589964 - DNA, 25 bp, Mus musculus
ggacaggtgataagatccacctact

SEQ ID NO: 589965 - DNA, 25 bp, Mus musculus
ggacaggtgatatgatccacctact

SEQ ID NO: 589966 - DNA, 25 bp, Mus musculus
ggacaggtgcacagaggacaagaca

SEQ ID NO: 589967 - DNA, 25 bp, Mus musculus
ggacaggtgcactgaggacaagaca

SEQ ID NO: 589968 - DNA, 25 bp, Mus musculus
ggacaggtgcctagacagacagatg

SEQ ID NO: 589969 - DNA, 25 bp, Mus musculus
ggacaggtgccttgacagacagatg

SEQ ID NO: 589970 - DNA, 25 bp, Mus musculus
ggacaggtggacaggtcactttaca

SEQ ID NO: 589971 - DNA, 25 bp, Mus musculus
ggacaggtggactggtcactttaca

SEQ ID NO: 589972 - DNA, 25 bp, Mus musculus
ggacaggtggttaataaaatgcaga

SEQ ID NO: 589973 - DNA, 25 bp, Mus musculus
ggacaggtggtttataaaatgcaga

SEQ ID NO: 589974 - DNA, 25 bp, Mus musculus
ggacaggttacactgcaaaatataa

SEQ ID NO: 589975 - DNA, 25 bp, Mus musculus
ggacaggttacagtgcaaaatataa

SEQ ID NO: 589976 - DNA, 25 bp, Mus musculus
ggacaggttagtacagggtcattct

SEQ ID NO: 589977 - DNA, 25 bp, Mus musculus
ggacaggttagttcagggtcattct

SEQ ID NO: 589978 - DNA, 25 bp, Mus musculus
ggacaggttcagaggattgcttgct

SEQ ID NO: 589979 - DNA, 25 bp, Mus musculus
ggacaggttcagtggattgcttgct

SEQ ID NO: 589980 - DNA, 25 bp, Mus musculus
ggacaggttcttcatacaaattaca

SEQ ID NO: 589981 - DNA, 25 bp, Mus musculus
ggacaggttcttgatacaaattaca

SEQ ID NO: 589982 - DNA, 25 bp, Mus musculus
ggacaggtttccagtctggcagaat

SEQ ID NO: 589983 - DNA, 25 bp, Mus musculus
ggacaggtttcctgtctggcagaat

SEQ ID NO: 589984 - DNA, 25 bp, Mus musculus
ggacaggtttgtagcacgtgactta

SEQ ID NO: 589985 - DNA, 25 bp, Mus musculus
ggacaggtttgttgcacgtgactta

SEQ ID NO: 589986 - DNA, 25 bp, Mus musculus
ggacagtaacgccacctggacaagg

SEQ ID NO: 589987 - DNA, 25 bp, Mus musculus
ggacagtaacgcgacctggacaagg

SEQ ID NO: 589988 - DNA, 25 bp, Mus musculus
ggacagtaagagctgccagcagctt

SEQ ID NO: 589989 - DNA, 25 bp, Mus musculus
ggacagtaagaggtgccagcagctt

SEQ ID NO: 589990 - DNA, 25 bp, Mus musculus
ggacagtaagcaaagctgccaaatt

SEQ ID NO: 589991 - DNA, 25 bp, Mus musculus
ggacagtaagcatagctgccaaatt

SEQ ID NO: 589992 - DNA, 25 bp, Mus musculus
ggacagtacaccattctgtgctgta

SEQ ID NO: 589993 - DNA, 25 bp, Mus musculus
ggacagtacacctttctgtgctgta

SEQ ID NO: 589994 - DNA, 25 bp, Mus musculus
ggacagtacactaatctcagctttt

SEQ ID NO: 589995 - DNA, 25 bp, Mus musculus
ggacagtacacttatctcagctttt

SEQ ID NO: 589996 - DNA, 25 bp, Mus musculus
ggacagtacaggatgcttgccaaaa

SEQ ID NO: 589997 - DNA, 25 bp, Mus musculus
ggacagtacaggttgcttgccaaaa

SEQ ID NO: 589998 - DNA, 25 bp, Mus musculus
ggacagtaccttaagatgccacatg

SEQ ID NO: 589999 - DNA, 25 bp, Mus musculus
ggacagtacctttagatgccacatg

SEQ ID NO: 590000 - DNA, 25 bp, Mus musculus
ggacagtactacatttggccaaaca

SEQ ID NO: 590001 - DNA, 25 bp, Mus musculus
ggacagtactacttttggccaaaca

SEQ ID NO: 590002 - DNA, 25 bp, Mus musculus
ggacagtactctcccatggctattg

SEQ ID NO: 590003 - DNA, 25 bp, Mus musculus
ggacagtactctgccatggctattg

SEQ ID NO: 590004 - DNA, 25 bp, Mus musculus
ggacagtagggcacagtcttctctc

SEQ ID NO: 590005 - DNA, 25 bp, Mus musculus
ggacagtagggctcagtcttctctc

SEQ ID NO: 590006 - DNA, 25 bp, Mus musculus
ggacagtataccaagcaagtttcag

SEQ ID NO: 590007 - DNA, 25 bp, Mus musculus
ggacagtatacctagcaagtttcag

SEQ ID NO: 590008 - DNA, 25 bp, Mus musculus
ggacagtatcacacaaatttggtca

SEQ ID NO: 590009 - DNA, 25 bp, Mus musculus
ggacagtatcactcaaatttggtca

SEQ ID NO: 590010 - DNA, 25 bp, Mus musculus
ggacagtatcttaactcaaggcact

SEQ ID NO: 590011 - DNA, 25 bp, Mus musculus
ggacagtatcttcaacttctcggat

SEQ ID NO: 590012 - DNA, 25 bp, Mus musculus
ggacagtatcttgaacttctcggat

SEQ ID NO: 590013 - DNA, 25 bp, Mus musculus
ggacagtatctttactcaaggcact

SEQ ID NO: 590014 - DNA, 25 bp, Mus musculus
ggacagtattgacgatgccaagtat

SEQ ID NO: 590015 - DNA, 25 bp, Mus musculus
ggacagtattgaggatgccaagtat

SEQ ID NO: 590016 - DNA, 25 bp, Mus musculus
ggacagtcaagtatattccctttct

SEQ ID NO: 590017 - DNA, 25 bp, Mus musculus
ggacagtcaagtttattccctttct

SEQ ID NO: 590018 - DNA, 25 bp, Mus musculus
ggacagtcacagaggcttcttagcc

SEQ ID NO: 590019 - DNA, 25 bp, Mus musculus
ggacagtcacagtggcttcttagcc

SEQ ID NO: 590020 - DNA, 25 bp, Mus musculus
ggacagtcacccaaaggaagcccag

SEQ ID NO: 590021 - DNA, 25 bp, Mus musculus
ggacagtcaccctaaggaagcccag

SEQ ID NO: 590022 - DNA, 25 bp, Mus musculus
ggacagtcagtcacctgcatcagac

SEQ ID NO: 590023 - DNA, 25 bp, Mus musculus
ggacagtcagtctcctgcatcagac

SEQ ID NO: 590024 - DNA, 25 bp, Mus musculus
ggacagtcattacttgccccggtaa

SEQ ID NO: 590025 - DNA, 25 bp, Mus musculus
ggacagtcattagttgccccggtaa

SEQ ID NO: 590026 - DNA, 25 bp, Mus musculus
ggacagtccagactttacgccaagc

SEQ ID NO: 590027 - DNA, 25 bp, Mus musculus
ggacagtccagagtttacgccaagc

SEQ ID NO: 590028 - DNA, 25 bp, Mus musculus
ggacagtcctctccagtactctaga

SEQ ID NO: 590029 - DNA, 25 bp, Mus musculus
ggacagtcctctgcagtactctaga

SEQ ID NO: 590030 - DNA, 25 bp, Mus musculus
ggacagtcggaaaggatatcttcat

SEQ ID NO: 590031 - DNA, 25 bp, Mus musculus
ggacagtcggaatggatatcttcat

SEQ ID NO: 590032 - DNA, 25 bp, Mus musculus
ggacagtctaaaaaggctgctgcat

SEQ ID NO: 590033 - DNA, 25 bp, Mus musculus
ggacagtctaaataggctgctgcat

SEQ ID NO: 590034 - DNA, 25 bp, Mus musculus
ggacagtctatccagctaccggtgt

SEQ ID NO: 590035 - DNA, 25 bp, Mus musculus
ggacagtctatcgagctaccggtgt

SEQ ID NO: 590036 - DNA, 25 bp, Mus musculus
ggacagtctctaacatttcttataa

SEQ ID NO: 590037 - DNA, 25 bp, Mus musculus
ggacagtctctatcatttcttataa

SEQ ID NO: 590038 - DNA, 25 bp, Mus musculus
ggacagtctgaactcagccatggct

SEQ ID NO: 590039 - DNA, 25 bp, Mus musculus
ggacagtctgaagtcagccatggct

SEQ ID NO: 590040 - DNA, 25 bp, Mus musculus
ggacagtctggtcccacagttaggt

SEQ ID NO: 590041 - DNA, 25 bp, Mus musculus
ggacagtctggtgccacagttaggt

SEQ ID NO: 590042 - DNA, 25 bp, Mus musculus
ggacagtcttaacccagatacagtt

SEQ ID NO: 590043 - DNA, 25 bp, Mus musculus
ggacagtcttaagccagatacagtt

SEQ ID NO: 590044 - DNA, 25 bp, Mus musculus
ggacagtctttcaaacaggttgctt

SEQ ID NO: 590045 - DNA, 25 bp, Mus musculus
ggacagtctttctaacaggttgctt

SEQ ID NO: 590046 - DNA, 25 bp, Mus musculus
ggacagtgaacaaacgcctcggcag

SEQ ID NO: 590047 - DNA, 25 bp, Mus musculus
ggacagtgaacaattctcacccctg

SEQ ID NO: 590048 - DNA, 25 bp, Mus musculus
ggacagtgaacatacgcctcggcag

SEQ ID NO: 590049 - DNA, 25 bp, Mus musculus
ggacagtgaacatttctcacccctg

SEQ ID NO: 590050 - DNA, 25 bp, Mus musculus
ggacagtgaagcaccatgtctcctg

SEQ ID NO: 590051 - DNA, 25 bp, Mus musculus
ggacagtgaagctccatgtctcctg

SEQ ID NO: 590052 - DNA, 25 bp, Mus musculus
ggacagtgacctcgttaagcatgaa

SEQ ID NO: 590053 - DNA, 25 bp, Mus musculus
ggacagtgacctggttaagcatgaa

SEQ ID NO: 590054 - DNA, 25 bp, Mus musculus
ggacagtgattacttctctgaagta

SEQ ID NO: 590055 - DNA, 25 bp, Mus musculus
ggacagtgattagttctctgaagta

SEQ ID NO: 590056 - DNA, 25 bp, Mus musculus
ggacagtgattcagaggacgactaa

SEQ ID NO: 590057 - DNA, 25 bp, Mus musculus
ggacagtgattctgaggacgactaa

SEQ ID NO: 590058 - DNA, 25 bp, Mus musculus
ggacagtgcactagattgaccccga

SEQ ID NO: 590059 - DNA, 25 bp, Mus musculus
ggacagtgcacttgattgaccccga

SEQ ID NO: 590060 - DNA, 25 bp, Mus musculus
ggacagtgccatcggtggctccatt

SEQ ID NO: 590061 - DNA, 25 bp, Mus musculus
ggacagtgccatgggtggctccatt

SEQ ID NO: 590062 - DNA, 25 bp, Mus musculus
ggacagtgcgtgagctttaaagccc

SEQ ID NO: 590063 - DNA, 25 bp, Mus musculus
ggacagtgcgtgtgctttaaagccc

SEQ ID NO: 590064 - DNA, 25 bp, Mus musculus
ggacagtgctatccagattcatttt

SEQ ID NO: 590065 - DNA, 25 bp, Mus musculus
ggacagtgctatgcagattcatttt

SEQ ID NO: 590066 - DNA, 25 bp, Mus musculus
ggacagtggcttcctgcttgtgact

SEQ ID NO: 590067 - DNA, 25 bp, Mus musculus
ggacagtggcttctggacctgcaaa

SEQ ID NO: 590068 - DNA, 25 bp, Mus musculus
ggacagtggcttgctgcttgtgact

SEQ ID NO: 590069 - DNA, 25 bp, Mus musculus
ggacagtggcttgtggacctgcaaa

SEQ ID NO: 590070 - DNA, 25 bp, Mus musculus
ggacagtgtacccatgcttgatctg

SEQ ID NO: 590071 - DNA, 25 bp, Mus musculus
ggacagtgtaccgatgcttgatctg

SEQ ID NO: 590072 - DNA, 25 bp, Mus musculus
ggacagtgtgcaaccccacagatga

SEQ ID NO: 590073 - DNA, 25 bp, Mus musculus
ggacagtgtgcaatgttatattttg

SEQ ID NO: 590074 - DNA, 25 bp, Mus musculus
ggacagtgtgcatccccacagatga

SEQ ID NO: 590075 - DNA, 25 bp, Mus musculus
ggacagtgtgcattgttatattttg

SEQ ID NO: 590076 - DNA, 25 bp, Mus musculus
ggacagtgtggcaccaatacctacc

SEQ ID NO: 590077 - DNA, 25 bp, Mus musculus
ggacagtgtggctccaatacctacc

SEQ ID NO: 590078 - DNA, 25 bp, Mus musculus
ggacagtgttgtacatctctgtcat

SEQ ID NO: 590079 - DNA, 25 bp, Mus musculus
ggacagtgttgttcatctctgtcat

SEQ ID NO: 590080 - DNA, 25 bp, Mus musculus
ggacagtgtttacatttagtgtttt

SEQ ID NO: 590081 - DNA, 25 bp, Mus musculus
ggacagtgtttagatttagtgtttt

SEQ ID NO: 590082 - DNA, 25 bp, Mus musculus
ggacagttaaagaaccaggagcttg

SEQ ID NO: 590083 - DNA, 25 bp, Mus musculus
ggacagttaaagtaccaggagcttg

SEQ ID NO: 590084 - DNA, 25 bp, Mus musculus
ggacagttaaccaagcctgtgcctt

SEQ ID NO: 590085 - DNA, 25 bp, Mus musculus
ggacagttaacctagcctgtgcctt

SEQ ID NO: 590086 - DNA, 25 bp, Mus musculus
ggacagttatggcaccagctcagct

SEQ ID NO: 590087 - DNA, 25 bp, Mus musculus
ggacagttatgggaccagctcagct

SEQ ID NO: 590088 - DNA, 25 bp, Mus musculus
ggacagttattaagtcaacttgatt

SEQ ID NO: 590089 - DNA, 25 bp, Mus musculus
ggacagttattatgtcaacttgatt

SEQ ID NO: 590090 - DNA, 25 bp, Mus musculus
ggacagttattcatgggaccaccat

SEQ ID NO: 590091 - DNA, 25 bp, Mus musculus
ggacagttattcttgggaccaccat

SEQ ID NO: 590092 - DNA, 25 bp, Mus musculus
ggacagttccgactgagtgcttgcc

SEQ ID NO: 590093 - DNA, 25 bp, Mus musculus
ggacagttccgagtgagtgcttgcc

SEQ ID NO: 590094 - DNA, 25 bp, Mus musculus
ggacagttctcacttaacacctgtt

SEQ ID NO: 590095 - DNA, 25 bp, Mus musculus
ggacagttctcagttaacacctgtt

SEQ ID NO: 590096 - DNA, 25 bp, Mus musculus
ggacagttctgtaatttttcttact

SEQ ID NO: 590097 - DNA, 25 bp, Mus musculus
ggacagttctgtacttttggatttg

SEQ ID NO: 590098 - DNA, 25 bp, Mus musculus
ggacagttctgttatttttcttact

SEQ ID NO: 590099 - DNA, 25 bp, Mus musculus
ggacagttctgttcttttggatttg

SEQ ID NO: 590100 - DNA, 25 bp, Mus musculus
ggacagttcttcaatggtcacgact

SEQ ID NO: 590101 - DNA, 25 bp, Mus musculus
ggacagttcttctatggtcacgact

SEQ ID NO: 590102 - DNA, 25 bp, Mus musculus
ggacagttctttcgaatgctcccat

SEQ ID NO: 590103 - DNA, 25 bp, Mus musculus
ggacagttctttggaatgctcccat

SEQ ID NO: 590104 - DNA, 25 bp, Mus musculus
ggacagttgcaactgccaatttccc

SEQ ID NO: 590105 - DNA, 25 bp, Mus musculus
ggacagttgcaagtgccaatttccc

SEQ ID NO: 590106 - DNA, 25 bp, Mus musculus
ggacagttgggcacagtctaactta

SEQ ID NO: 590107 - DNA, 25 bp, Mus musculus
ggacagttgggctcagtctaactta

SEQ ID NO: 590108 - DNA, 25 bp, Mus musculus
ggacagttgtttcccataggctctg

SEQ ID NO: 590109 - DNA, 25 bp, Mus musculus
ggacagttgtttgccataggctctg

SEQ ID NO: 590110 - DNA, 25 bp, Mus musculus
ggacagtttacaaactttggcattt

SEQ ID NO: 590111 - DNA, 25 bp, Mus musculus
ggacagtttacacgagttggctttc

SEQ ID NO: 590112 - DNA, 25 bp, Mus musculus
ggacagtttacaggagttggctttc

SEQ ID NO: 590113 - DNA, 25 bp, Mus musculus
ggacagtttacatactttggcattt

SEQ ID NO: 590114 - DNA, 25 bp, Mus musculus
ggacagtttcatcgaaggaggacaa

SEQ ID NO: 590115 - DNA, 25 bp, Mus musculus
ggacagtttcatggaaggaggacaa

SEQ ID NO: 590116 - DNA, 25 bp, Mus musculus
ggacagtttcctatttatctcctgt

SEQ ID NO: 590117 - DNA, 25 bp, Mus musculus
ggacagtttcctcgccgtcgacatc

SEQ ID NO: 590118 - DNA, 25 bp, Mus musculus
ggacagtttcctggccgtcgacatc

SEQ ID NO: 590119 - DNA, 25 bp, Mus musculus
ggacagtttcctttttatctcctgt

SEQ ID NO: 590120 - DNA, 25 bp, Mus musculus
ggacagtttgtcacagacgggaccc

SEQ ID NO: 590121 - DNA, 25 bp, Mus musculus
ggacagtttgtctcagacgggaccc

SEQ ID NO: 590122 - DNA, 25 bp, Mus musculus
ggacagttttagagacctgagtcat

SEQ ID NO: 590123 - DNA, 25 bp, Mus musculus
ggacagttttagtgacctgagtcat

SEQ ID NO: 590124 - DNA, 25 bp, Mus musculus
ggacagttttcacacatatctacct

SEQ ID NO: 590125 - DNA, 25 bp, Mus musculus
ggacagttttcactcagtacacctt

SEQ ID NO: 590126 - DNA, 25 bp, Mus musculus
ggacagttttcagacatatctacct

SEQ ID NO: 590127 - DNA, 25 bp, Mus musculus
ggacagttttcagtcagtacacctt

SEQ ID NO: 590128 - DNA, 25 bp, Mus musculus
ggacagttttgacagcttgacagat

SEQ ID NO: 590129 - DNA, 25 bp, Mus musculus
ggacagttttgagagcttgacagat

SEQ ID NO: 590130 - DNA, 25 bp, Mus musculus
ggacataaagttccacctcttgttt

SEQ ID NO: 590131 - DNA, 25 bp, Mus musculus
ggacataaagttgcacctcttgttt

SEQ ID NO: 590132 - DNA, 25 bp, Mus musculus
ggacataacatacatctctgctaca

SEQ ID NO: 590133 - DNA, 25 bp, Mus musculus
ggacataacatagatctctgctaca

SEQ ID NO: 590134 - DNA, 25 bp, Mus musculus
ggacataactttctgttgacgctgt

SEQ ID NO: 590135 - DNA, 25 bp, Mus musculus
ggacataactttgtgttgacgctgt

SEQ ID NO: 590136 - DNA, 25 bp, Mus musculus
ggacataaggtaccaatcacagagt

SEQ ID NO: 590137 - DNA, 25 bp, Mus musculus
ggacataaggtagcaatcacagagt

SEQ ID NO: 590138 - DNA, 25 bp, Mus musculus
ggacataagtccacgacactccagg

SEQ ID NO: 590139 - DNA, 25 bp, Mus musculus
ggacataagtcctcgacactccagg

SEQ ID NO: 590140 - DNA, 25 bp, Mus musculus
ggacataagtgacaaagttgcggtt

SEQ ID NO: 590141 - DNA, 25 bp, Mus musculus
ggacataagtgagaaagttgcggtt

SEQ ID NO: 590142 - DNA, 25 bp, Mus musculus
ggacataatagcattcatactggag

SEQ ID NO: 590143 - DNA, 25 bp, Mus musculus
ggacataatagctttcatactggag

SEQ ID NO: 590144 - DNA, 25 bp, Mus musculus
ggacataatattagacccaacacaa

SEQ ID NO: 590145 - DNA, 25 bp, Mus musculus
ggacataatatttgacccaacacaa

SEQ ID NO: 590146 - DNA, 25 bp, Mus musculus
ggacataatctcctcagcagacatg

SEQ ID NO: 590147 - DNA, 25 bp, Mus musculus
ggacataatctcgtcagcagacatg

SEQ ID NO: 590148 - DNA, 25 bp, Mus musculus
ggacataatgttacacatccagtta

SEQ ID NO: 590149 - DNA, 25 bp, Mus musculus
ggacataatgtttcacatccagtta

SEQ ID NO: 590150 - DNA, 25 bp, Mus musculus
ggacataattgacttcaccatggaa

SEQ ID NO: 590151 - DNA, 25 bp, Mus musculus
ggacataattgagttcaccatggaa

SEQ ID NO: 590152 - DNA, 25 bp, Mus musculus
ggacatacagccatgtggtggcttt

SEQ ID NO: 590153 - DNA, 25 bp, Mus musculus
ggacatacagccttgtggtggcttt

SEQ ID NO: 590154 - DNA, 25 bp, Mus musculus
ggacatacagttagttttaaattgc

SEQ ID NO: 590155 - DNA, 25 bp, Mus musculus
ggacatacagtttgttttaaattgc

SEQ ID NO: 590156 - DNA, 25 bp, Mus musculus
ggacatacatccagaaccagcaatg

SEQ ID NO: 590157 - DNA, 25 bp, Mus musculus
ggacatacatcctgaaccagcaatg

SEQ ID NO: 590158 - DNA, 25 bp, Mus musculus
ggacataccatcatatttggctcgt

SEQ ID NO: 590159 - DNA, 25 bp, Mus musculus
ggacataccatcttatttggctcgt

SEQ ID NO: 590160 - DNA, 25 bp, Mus musculus
ggacatacccgaagactttctggaa

SEQ ID NO: 590161 - DNA, 25 bp, Mus musculus
ggacatacccgatgactttctggaa

SEQ ID NO: 590162 - DNA, 25 bp, Mus musculus
ggacatacctttaaagcatccccaa

SEQ ID NO: 590163 - DNA, 25 bp, Mus musculus
ggacataccttttaagcatccccaa

SEQ ID NO: 590164 - DNA, 25 bp, Mus musculus
ggacatacgtccatgcatataaagt

SEQ ID NO: 590165 - DNA, 25 bp, Mus musculus
ggacatacgtccttgcatataaagt

SEQ ID NO: 590166 - DNA, 25 bp, Mus musculus
ggacatactacaataatccctgcaa

SEQ ID NO: 590167 - DNA, 25 bp, Mus musculus
ggacatactacattaatccctgcaa

SEQ ID NO: 590168 - DNA, 25 bp, Mus musculus
ggacatactatgaagcttgggacta

SEQ ID NO: 590169 - DNA, 25 bp, Mus musculus
ggacatactatgtagcttgggacta

SEQ ID NO: 590170 - DNA, 25 bp, Mus musculus
ggacatactctaccagtgcaaaaac

SEQ ID NO: 590171 - DNA, 25 bp, Mus musculus
ggacatactctagcagtgcaaaaac

SEQ ID NO: 590172 - DNA, 25 bp, Mus musculus
ggacatactcttagaggcctcttta

SEQ ID NO: 590173 - DNA, 25 bp, Mus musculus
ggacatactctttgaggcctcttta

SEQ ID NO: 590174 - DNA, 25 bp, Mus musculus
ggacatacttggctctgaattctct

SEQ ID NO: 590175 - DNA, 25 bp, Mus musculus
ggacatacttgggtctgaattctct

SEQ ID NO: 590176 - DNA, 25 bp, Mus musculus
ggacatagagatactctctctggag

SEQ ID NO: 590177 - DNA, 25 bp, Mus musculus
ggacatagagattctctctctggag

SEQ ID NO: 590178 - DNA, 25 bp, Mus musculus
ggacatagagggatttaagccacat

SEQ ID NO: 590179 - DNA, 25 bp, Mus musculus
ggacatagagggttttaagccacat

SEQ ID NO: 590180 - DNA, 25 bp, Mus musculus
ggacatagagtccatcgatgccctg

SEQ ID NO: 590181 - DNA, 25 bp, Mus musculus
ggacatagagtcgatcgatgccctg

SEQ ID NO: 590182 - DNA, 25 bp, Mus musculus
ggacatagatctattacccgttagc

SEQ ID NO: 590183 - DNA, 25 bp, Mus musculus
ggacatagatcttttacccgttagc

SEQ ID NO: 590184 - DNA, 25 bp, Mus musculus
ggacatagcatgaacaggcagtttt

SEQ ID NO: 590185 - DNA, 25 bp, Mus musculus
ggacatagcatgtacaggcagtttt

SEQ ID NO: 590186 - DNA, 25 bp, Mus musculus
ggacatagcattcggcatcaactgt

SEQ ID NO: 590187 - DNA, 25 bp, Mus musculus
ggacatagcattgggcatcaactgt

SEQ ID NO: 590188 - DNA, 25 bp, Mus musculus
ggacatagccaaacctcaacactag

SEQ ID NO: 590189 - DNA, 25 bp, Mus musculus
ggacatagccaatcctcaacactag

SEQ ID NO: 590190 - DNA, 25 bp, Mus musculus
ggacatagccttcggaatgcagaca

SEQ ID NO: 590191 - DNA, 25 bp, Mus musculus
ggacatagccttgggaatgcagaca

SEQ ID NO: 590192 - DNA, 25 bp, Mus musculus
ggacatagctcccagtgttacatac

SEQ ID NO: 590193 - DNA, 25 bp, Mus musculus
ggacatagctccgagtgttacatac

SEQ ID NO: 590194 - DNA, 25 bp, Mus musculus
ggacatagctttatatgccgcagtg

SEQ ID NO: 590195 - DNA, 25 bp, Mus musculus
ggacatagctttttatgccgcagtg

SEQ ID NO: 590196 - DNA, 25 bp, Mus musculus
ggacataggaaaccctcactctata

SEQ ID NO: 590197 - DNA, 25 bp, Mus musculus
ggacataggaaagcctcactctata

SEQ ID NO: 590198 - DNA, 25 bp, Mus musculus
ggacataggagcattgcaaactcta

SEQ ID NO: 590199 - DNA, 25 bp, Mus musculus
ggacataggagctttgcaaactcta

SEQ ID NO: 590200 - DNA, 25 bp, Mus musculus
ggacataggcttcattaagttggac

SEQ ID NO: 590201 - DNA, 25 bp, Mus musculus
ggacataggcttgattaagttggac

SEQ ID NO: 590202 - DNA, 25 bp, Mus musculus
ggacataggtcaacaatcctccttt

SEQ ID NO: 590203 - DNA, 25 bp, Mus musculus
ggacataggtcatcaatcctccttt

SEQ ID NO: 590204 - DNA, 25 bp, Mus musculus
ggacatagtcgaagaatcaccaaga

SEQ ID NO: 590205 - DNA, 25 bp, Mus musculus
ggacatagtcgatgaatcaccaaga

SEQ ID NO: 590206 - DNA, 25 bp, Mus musculus
ggacatagtctgattactgggcact

SEQ ID NO: 590207 - DNA, 25 bp, Mus musculus
ggacatagtctgtttactgggcact

SEQ ID NO: 590208 - DNA, 25 bp, Mus musculus
ggacatagtttaaccccagacttag

SEQ ID NO: 590209 - DNA, 25 bp, Mus musculus
ggacatagtttatccccagacttag

SEQ ID NO: 590210 - DNA, 25 bp, Mus musculus
ggacatagtttcaggcaccagtatc

SEQ ID NO: 590211 - DNA, 25 bp, Mus musculus
ggacatagtttctggcaccagtatc

SEQ ID NO: 590212 - DNA, 25 bp, Mus musculus
ggacatataaaacctctaacacata

SEQ ID NO: 590213 - DNA, 25 bp, Mus musculus
ggacatataaaagctctaacacata

SEQ ID NO: 590214 - DNA, 25 bp, Mus musculus
ggacatataaccaccaatcttctct

SEQ ID NO: 590215 - DNA, 25 bp, Mus musculus
ggacatataacctccaatcttctct

SEQ ID NO: 590216 - DNA, 25 bp, Mus musculus
ggacatatagctcatttctgttctt

SEQ ID NO: 590217 - DNA, 25 bp, Mus musculus
ggacatatagctgatttctgttctt

SEQ ID NO: 590218 - DNA, 25 bp, Mus musculus
ggacatatagtgatccctggaccca

SEQ ID NO: 590219 - DNA, 25 bp, Mus musculus
ggacatatagtgttccctggaccca

SEQ ID NO: 590220 - DNA, 25 bp, Mus musculus
ggacatatcactcaccttcataacc

SEQ ID NO: 590221 - DNA, 25 bp, Mus musculus
ggacatatcactgaccttcataacc

SEQ ID NO: 590222 - DNA, 25 bp, Mus musculus
ggacatatccacagaaaatgctcat

SEQ ID NO: 590223 - DNA, 25 bp, Mus musculus
ggacatatccactgaaaatgctcat

SEQ ID NO: 590224 - DNA, 25 bp, Mus musculus
ggacatatcgggagtatccctccaa

SEQ ID NO: 590225 - DNA, 25 bp, Mus musculus
ggacatatcgggtgtatccctccaa

SEQ ID NO: 590226 - DNA, 25 bp, Mus musculus
ggacatatgtttcctagccatctgc

SEQ ID NO: 590227 - DNA, 25 bp, Mus musculus
ggacatatgtttgctagccatctgc

SEQ ID NO: 590228 - DNA, 25 bp, Mus musculus
ggacatattgaacgccacgctgaag

SEQ ID NO: 590229 - DNA, 25 bp, Mus musculus
ggacatattgaaggccacgctgaag

SEQ ID NO: 590230 - DNA, 25 bp, Mus musculus
ggacatattgctagaatggctttct

SEQ ID NO: 590231 - DNA, 25 bp, Mus musculus
ggacatattgcttgaatggctttct

SEQ ID NO: 590232 - DNA, 25 bp, Mus musculus
ggacatatttatcgctccacttccc

SEQ ID NO: 590233 - DNA, 25 bp, Mus musculus
ggacatatttatggctccacttccc

SEQ ID NO: 590234 - DNA, 25 bp, Mus musculus
ggacatatttcacaacaagcacacg

SEQ ID NO: 590235 - DNA, 25 bp, Mus musculus
ggacatatttcagaacaagcacacg

SEQ ID NO: 590236 - DNA, 25 bp, Mus musculus
ggacatatttctaacctgtgccaag

SEQ ID NO: 590237 - DNA, 25 bp, Mus musculus
ggacatatttcttacctgtgccaag

SEQ ID NO: 590238 - DNA, 25 bp, Mus musculus
ggacatcaaagaaggcattcccctg

SEQ ID NO: 590239 - DNA, 25 bp, Mus musculus
ggacatcaaagatggcattcccctg

SEQ ID NO: 590240 - DNA, 25 bp, Mus musculus
ggacatcaagacacggctggaacag

SEQ ID NO: 590241 - DNA, 25 bp, Mus musculus
ggacatcaagactcggctggaacag

SEQ ID NO: 590242 - DNA, 25 bp, Mus musculus
ggacatcaagatccaatatttatgg

SEQ ID NO: 590243 - DNA, 25 bp, Mus musculus
ggacatcaagatgcaatatttatgg

SEQ ID NO: 590244 - DNA, 25 bp, Mus musculus
ggacatcaaggaacacctgcacgtg

SEQ ID NO: 590245 - DNA, 25 bp, Mus musculus
ggacatcaaggatcacctgcacgtg

SEQ ID NO: 590246 - DNA, 25 bp, Mus musculus
ggacatcaatttaaagtgacaacct

SEQ ID NO: 590247 - DNA, 25 bp, Mus musculus
ggacatcaattttaagtgacaacct

SEQ ID NO: 590248 - DNA, 25 bp, Mus musculus
ggacatcacaatcgaggccttcaaa

SEQ ID NO: 590249 - DNA, 25 bp, Mus musculus
ggacatcacaatggaggccttcaaa

SEQ ID NO: 590250 - DNA, 25 bp, Mus musculus
ggacatcacagaacatcgggctttc

SEQ ID NO: 590251 - DNA, 25 bp, Mus musculus
ggacatcacagatcatcgggctttc

SEQ ID NO: 590252 - DNA, 25 bp, Mus musculus
ggacatcaccgtcgagatggtctct

SEQ ID NO: 590253 - DNA, 25 bp, Mus musculus
ggacatcaccgtggagatggtctct

SEQ ID NO: 590254 - DNA, 25 bp, Mus musculus
ggacatcacggtccctggcctcgga

SEQ ID NO: 590255 - DNA, 25 bp, Mus musculus
ggacatcacggtgcctggcctcgga

SEQ ID NO: 590256 - DNA, 25 bp, Mus musculus
ggacatcagaccactgcattgcgaa

SEQ ID NO: 590257 - DNA, 25 bp, Mus musculus
ggacatcagacctctgcattgcgaa

SEQ ID NO: 590258 - DNA, 25 bp, Mus musculus
ggacatcagatcagccaccattaaa

SEQ ID NO: 590259 - DNA, 25 bp, Mus musculus
ggacatcagatctgccaccattaaa

SEQ ID NO: 590260 - DNA, 25 bp, Mus musculus
ggacatcagcctcgacagccaaggt

SEQ ID NO: 590261 - DNA, 25 bp, Mus musculus
ggacatcagcctggacagccaaggt

SEQ ID NO: 590262 - DNA, 25 bp, Mus musculus
ggacatcagggaaaccagctttgtt

SEQ ID NO: 590263 - DNA, 25 bp, Mus musculus
ggacatcagggataccagctttgtt

SEQ ID NO: 590264 - DNA, 25 bp, Mus musculus
ggacatcagtcaacaggaggcagaa

SEQ ID NO: 590265 - DNA, 25 bp, Mus musculus
ggacatcagtcatcaggaggcagaa

SEQ ID NO: 590266 - DNA, 25 bp, Mus musculus
ggacatcagtgacagccagggccaa

SEQ ID NO: 590267 - DNA, 25 bp, Mus musculus
ggacatcagtgagagccagggccaa

SEQ ID NO: 590268 - DNA, 25 bp, Mus musculus
ggacatcagttgaatgtaagccatc

SEQ ID NO: 590269 - DNA, 25 bp, Mus musculus
ggacatcagttgtatgtaagccatc

SEQ ID NO: 590270 - DNA, 25 bp, Mus musculus
ggacatcatactataataaagcaga

SEQ ID NO: 590271 - DNA, 25 bp, Mus musculus
ggacatcatactttaataaagcaga

SEQ ID NO: 590272 - DNA, 25 bp, Mus musculus
ggacatcatccacagaatcttccgg

SEQ ID NO: 590273 - DNA, 25 bp, Mus musculus
ggacatcatccagagaatcttccgg

SEQ ID NO: 590274 - DNA, 25 bp, Mus musculus
ggacatcatgcgatgctgggaaaag

SEQ ID NO: 590275 - DNA, 25 bp, Mus musculus
ggacatcatgcgttgctgggaaaag

SEQ ID NO: 590276 - DNA, 25 bp, Mus musculus
ggacatcattggagcccacaaggga

SEQ ID NO: 590277 - DNA, 25 bp, Mus musculus
ggacatcattggtgcccacaaggga

SEQ ID NO: 590278 - DNA, 25 bp, Mus musculus
ggacatcattttaatttcactgtga

SEQ ID NO: 590279 - DNA, 25 bp, Mus musculus
ggacatcattttccactatttggaa

SEQ ID NO: 590280 - DNA, 25 bp, Mus musculus
ggacatcattttgcactatttggaa

SEQ ID NO: 590281 - DNA, 25 bp, Mus musculus
ggacatcatttttatttcactgtga

SEQ ID NO: 590282 - DNA, 25 bp, Mus musculus
ggacatccaacaaaccaattttctg

SEQ ID NO: 590283 - DNA, 25 bp, Mus musculus
ggacatccaacataccaattttctg

SEQ ID NO: 590284 - DNA, 25 bp, Mus musculus
ggacatccaagacctagactgttta

SEQ ID NO: 590285 - DNA, 25 bp, Mus musculus
ggacatccaagacttgtgttactta

SEQ ID NO: 590286 - DNA, 25 bp, Mus musculus
ggacatccaagagctagactgttta

SEQ ID NO: 590287 - DNA, 25 bp, Mus musculus
ggacatccaagagttgtgttactta

SEQ ID NO: 590288 - DNA, 25 bp, Mus musculus
ggacatccactgactttcctgcttt

SEQ ID NO: 590289 - DNA, 25 bp, Mus musculus
ggacatccactgtctttcctgcttt

SEQ ID NO: 590290 - DNA, 25 bp, Mus musculus
ggacatccagtcagtggaggcaaaa

SEQ ID NO: 590291 - DNA, 25 bp, Mus musculus
ggacatccagtctgtggaggcaaaa

SEQ ID NO: 590292 - DNA, 25 bp, Mus musculus
ggacatccatcaatactttgcagat

SEQ ID NO: 590293 - DNA, 25 bp, Mus musculus
ggacatccatcattactttgcagat

SEQ ID NO: 590294 - DNA, 25 bp, Mus musculus
ggacatccattcaactcaaagggtt

SEQ ID NO: 590295 - DNA, 25 bp, Mus musculus
ggacatccattctactcaaagggtt

SEQ ID NO: 590296 - DNA, 25 bp, Mus musculus
ggacatcccaggcagggtagaaaca

SEQ ID NO: 590297 - DNA, 25 bp, Mus musculus
ggacatcccagggagggtagaaaca

SEQ ID NO: 590298 - DNA, 25 bp, Mus musculus
ggacatccctgtagagttcaagctg

SEQ ID NO: 590299 - DNA, 25 bp, Mus musculus
ggacatccctgtatgaactgttcat

SEQ ID NO: 590300 - DNA, 25 bp, Mus musculus
ggacatccctgttgagttcaagctg

SEQ ID NO: 590301 - DNA, 25 bp, Mus musculus
ggacatccctgtttgaactgttcat

SEQ ID NO: 590302 - DNA, 25 bp, Mus musculus
ggacatccgaaacctgcctgcgtgc

SEQ ID NO: 590303 - DNA, 25 bp, Mus musculus
ggacatccgaaagctgcctgcgtgc

SEQ ID NO: 590304 - DNA, 25 bp, Mus musculus
ggacatccgtggctacctaaacaaa

SEQ ID NO: 590305 - DNA, 25 bp, Mus musculus
ggacatccgtgggtacctaaacaaa

SEQ ID NO: 590306 - DNA, 25 bp, Mus musculus
ggacatccgttcatttaacgcaaca

SEQ ID NO: 590307 - DNA, 25 bp, Mus musculus
ggacatccgttcttttaacgcaaca

SEQ ID NO: 590308 - DNA, 25 bp, Mus musculus
ggacatccttacagtcaatcacgag

SEQ ID NO: 590309 - DNA, 25 bp, Mus musculus
ggacatccttactgtcaatcacgag

SEQ ID NO: 590310 - DNA, 25 bp, Mus musculus
ggacatcgaatccttgttttccaga

SEQ ID NO: 590311 - DNA, 25 bp, Mus musculus
ggacatcgaatcgttgttttccaga

SEQ ID NO: 590312 - DNA, 25 bp, Mus musculus
ggacatcgaatgcaaactacaggca

SEQ ID NO: 590313 - DNA, 25 bp, Mus musculus
ggacatcgaatggaaactacaggca

SEQ ID NO: 590314 - DNA, 25 bp, Mus musculus
ggacatcgacacaccagaggttgat

SEQ ID NO: 590315 - DNA, 25 bp, Mus musculus
ggacatcgacactccagaggttgat

SEQ ID NO: 590316 - DNA, 25 bp, Mus musculus
ggacatcgagaacaacccaagactg

SEQ ID NO: 590317 - DNA, 25 bp, Mus musculus
ggacatcgagaagaacccaagactg

SEQ ID NO: 590318 - DNA, 25 bp, Mus musculus
ggacatcgagtcattaatttggaat

SEQ ID NO: 590319 - DNA, 25 bp, Mus musculus
ggacatcgagtctttaatttggaat

SEQ ID NO: 590320 - DNA, 25 bp, Mus musculus
ggacatcgccatcctggtggaaaat

SEQ ID NO: 590321 - DNA, 25 bp, Mus musculus
ggacatcgccatgctggtggaaaat

SEQ ID NO: 590322 - DNA, 25 bp, Mus musculus
ggacatcggatacatcttcaggccc

SEQ ID NO: 590323 - DNA, 25 bp, Mus musculus
ggacatcggatagatcttcaggccc

SEQ ID NO: 590324 - DNA, 25 bp, Mus musculus
ggacatcggcgacaccatggtctac

SEQ ID NO: 590325 - DNA, 25 bp, Mus musculus
ggacatcggcgagaccatggtctac

SEQ ID NO: 590326 - DNA, 25 bp, Mus musculus
ggacatcgtccaacatctagaaggt

SEQ ID NO: 590327 - DNA, 25 bp, Mus musculus
ggacatcgtccatcatctagaaggt

SEQ ID NO: 590328 - DNA, 25 bp, Mus musculus
ggacatcgtgagcttgctgcttgac

SEQ ID NO: 590329 - DNA, 25 bp, Mus musculus
ggacatcgtgaggttgctgcttgac

SEQ ID NO: 590330 - DNA, 25 bp, Mus musculus
ggacatctaattatgctccaagcat

SEQ ID NO: 590331 - DNA, 25 bp, Mus musculus
ggacatctaattttgctccaagcat

SEQ ID NO: 590332 - DNA, 25 bp, Mus musculus
ggacatctagccctctgattgaggt

SEQ ID NO: 590333 - DNA, 25 bp, Mus musculus
ggacatctagccgtctgattgaggt

SEQ ID NO: 590334 - DNA, 25 bp, Mus musculus
ggacatctaggtcactgccatcaat

SEQ ID NO: 590335 - DNA, 25 bp, Mus musculus
ggacatctaggtgactgccatcaat

SEQ ID NO: 590336 - DNA, 25 bp, Mus musculus
ggacatctatccatcacccagagct

SEQ ID NO: 590337 - DNA, 25 bp, Mus musculus
ggacatctatccttcacccagagct

SEQ ID NO: 590338 - DNA, 25 bp, Mus musculus
ggacatctatttaacccttatccca

SEQ ID NO: 590339 - DNA, 25 bp, Mus musculus
ggacatctattttacccttatccca

SEQ ID NO: 590340 - DNA, 25 bp, Mus musculus
ggacatctccagcaaccttaaatct

SEQ ID NO: 590341 - DNA, 25 bp, Mus musculus
ggacatctccaggaaccttaaatct

SEQ ID NO: 590342 - DNA, 25 bp, Mus musculus
ggacatctccatatcaatgaacagt

SEQ ID NO: 590343 - DNA, 25 bp, Mus musculus
ggacatctccatttcaatgaacagt

SEQ ID NO: 590344 - DNA, 25 bp, Mus musculus
ggacatctcctgagcctgataagag

SEQ ID NO: 590345 - DNA, 25 bp, Mus musculus
ggacatctcctgtgcctgataagag

SEQ ID NO: 590346 - DNA, 25 bp, Mus musculus
ggacatctctgtagtgtatgatctg

SEQ ID NO: 590347 - DNA, 25 bp, Mus musculus
ggacatctctgttgtgtatgatctg

SEQ ID NO: 590348 - DNA, 25 bp, Mus musculus
ggacatctgataagtgaccgacccc

SEQ ID NO: 590349 - DNA, 25 bp, Mus musculus
ggacatctgatatgtgaccgacccc

SEQ ID NO: 590350 - DNA, 25 bp, Mus musculus
ggacatctgctacagacacaggctt

SEQ ID NO: 590351 - DNA, 25 bp, Mus musculus
ggacatctgctagagacacaggctt

SEQ ID NO: 590352 - DNA, 25 bp, Mus musculus
ggacatctggcaattcatatattca

SEQ ID NO: 590353 - DNA, 25 bp, Mus musculus
ggacatctggcatttcatatattca

SEQ ID NO: 590354 - DNA, 25 bp, Mus musculus
ggacatctgggcagacccctatcag

SEQ ID NO: 590355 - DNA, 25 bp, Mus musculus
ggacatctgggctgacccctatcag

SEQ ID NO: 590356 - DNA, 25 bp, Mus musculus
ggacatctggtgaggaccccagttt

SEQ ID NO: 590357 - DNA, 25 bp, Mus musculus
ggacatctggtgtggaccccagttt

SEQ ID NO: 590358 - DNA, 25 bp, Mus musculus
ggacatctgttgatctatgtgtaac

SEQ ID NO: 590359 - DNA, 25 bp, Mus musculus
ggacatctgttgttctatgtgtaac

SEQ ID NO: 590360 - DNA, 25 bp, Mus musculus
ggacatcttacacgcaatttccaga

SEQ ID NO: 590361 - DNA, 25 bp, Mus musculus
ggacatcttacaggcaatttccaga

SEQ ID NO: 590362 - DNA, 25 bp, Mus musculus
ggacatcttcagctggacttcctag

SEQ ID NO: 590363 - DNA, 25 bp, Mus musculus
ggacatcttcaggtggacttcctag

SEQ ID NO: 590364 - DNA, 25 bp, Mus musculus
ggacatcttcatactctaaacagca

SEQ ID NO: 590365 - DNA, 25 bp, Mus musculus
ggacatcttcattctctaaacagca

SEQ ID NO: 590366 - DNA, 25 bp, Mus musculus
ggacatcttcccagatctcaaaaga

SEQ ID NO: 590367 - DNA, 25 bp, Mus musculus
ggacatcttccctgatctcaaaaga

SEQ ID NO: 590368 - DNA, 25 bp, Mus musculus
ggacatcttcctcaacacgctgagc

SEQ ID NO: 590369 - DNA, 25 bp, Mus musculus
ggacatcttcctgaacacgctgagc

SEQ ID NO: 590370 - DNA, 25 bp, Mus musculus
ggacatcttgatagaccttttgagt

SEQ ID NO: 590371 - DNA, 25 bp, Mus musculus
ggacatcttgattgaccttttgagt

SEQ ID NO: 590372 - DNA, 25 bp, Mus musculus
ggacatcttggaactactgtttaat

SEQ ID NO: 590373 - DNA, 25 bp, Mus musculus
ggacatcttggatctactgtttaat

SEQ ID NO: 590374 - DNA, 25 bp, Mus musculus
ggacatcttttgaaccttttgactg

SEQ ID NO: 590375 - DNA, 25 bp, Mus musculus
ggacatcttttgtaccttttgactg

SEQ ID NO: 590376 - DNA, 25 bp, Mus musculus
ggacatgaaactagagccccactgt

SEQ ID NO: 590377 - DNA, 25 bp, Mus musculus
ggacatgaaacttgagccccactgt

SEQ ID NO: 590378 - DNA, 25 bp, Mus musculus
ggacatgaacaactgcacatgttta

SEQ ID NO: 590379 - DNA, 25 bp, Mus musculus
ggacatgaacaagtgcacatgttta

SEQ ID NO: 590380 - DNA, 25 bp, Mus musculus
ggacatgaactacccctctaagcag

SEQ ID NO: 590381 - DNA, 25 bp, Mus musculus
ggacatgaactagccctctaagcag

SEQ ID NO: 590382 - DNA, 25 bp, Mus musculus
ggacatgaagcccatcacagtcggg

SEQ ID NO: 590383 - DNA, 25 bp, Mus musculus
ggacatgaagccgatcacagtcggg

SEQ ID NO: 590384 - DNA, 25 bp, Mus musculus
ggacatgaagcgattcttccaagaa

SEQ ID NO: 590385 - DNA, 25 bp, Mus musculus
ggacatgaagcgtttcttccaagaa

SEQ ID NO: 590386 - DNA, 25 bp, Mus musculus
ggacatgacaccaggcacctgagag

SEQ ID NO: 590387 - DNA, 25 bp, Mus musculus
ggacatgacacctggcacctgagag

SEQ ID NO: 590388 - DNA, 25 bp, Mus musculus
ggacatgacagtatttgtctgtggc

SEQ ID NO: 590389 - DNA, 25 bp, Mus musculus
ggacatgacagtttttgtctgtggc

SEQ ID NO: 590390 - DNA, 25 bp, Mus musculus
ggacatgacattacatagcctcaat

SEQ ID NO: 590391 - DNA, 25 bp, Mus musculus
ggacatgacatttcatagcctcaat

SEQ ID NO: 590392 - DNA, 25 bp, Mus musculus
ggacatgaccaaaaggctgctgcca

SEQ ID NO: 590393 - DNA, 25 bp, Mus musculus
ggacatgaccaataggctgctgcca

SEQ ID NO: 590394 - DNA, 25 bp, Mus musculus
ggacatgactttctttcagcactgt

SEQ ID NO: 590395 - DNA, 25 bp, Mus musculus
ggacatgactttgtttcagcactgt

SEQ ID NO: 590396 - DNA, 25 bp, Mus musculus
ggacatgagacaacctatcctgctg

SEQ ID NO: 590397 - DNA, 25 bp, Mus musculus
ggacatgagacatcctatcctgctg

SEQ ID NO: 590398 - DNA, 25 bp, Mus musculus
ggacatgagcagactttccaggtct

SEQ ID NO: 590399 - DNA, 25 bp, Mus musculus
ggacatgagcagtctttccaggtct

SEQ ID NO: 590400 - DNA, 25 bp, Mus musculus
ggacatgaggatagccgctgttttc

SEQ ID NO: 590401 - DNA, 25 bp, Mus musculus
ggacatgaggattgccgctgttttc

SEQ ID NO: 590402 - DNA, 25 bp, Mus musculus
ggacatgagtccaaattccagtcta

SEQ ID NO: 590403 - DNA, 25 bp, Mus musculus
ggacatgagtcctaattccagtcta

SEQ ID NO: 590404 - DNA, 25 bp, Mus musculus
ggacatgataaaccagttctcagta

SEQ ID NO: 590405 - DNA, 25 bp, Mus musculus
ggacatgataaagcagttctcagta

SEQ ID NO: 590406 - DNA, 25 bp, Mus musculus
ggacatgatgttattcgcaagcctc

SEQ ID NO: 590407 - DNA, 25 bp, Mus musculus
ggacatgatgtttttcgcaagcctc

SEQ ID NO: 590408 - DNA, 25 bp, Mus musculus
ggacatgcaaccatttcctcggtga

SEQ ID NO: 590409 - DNA, 25 bp, Mus musculus
ggacatgcaaccttttcctcggtga

SEQ ID NO: 590410 - DNA, 25 bp, Mus musculus
ggacatgcaatcaaacccatcagac

SEQ ID NO: 590411 - DNA, 25 bp, Mus musculus
ggacatgcaatctaacccatcagac

SEQ ID NO: 590412 - DNA, 25 bp, Mus musculus
ggacatgcaatgacagtgccctgtt

SEQ ID NO: 590413 - DNA, 25 bp, Mus musculus
ggacatgcaatgtcagtgccctgtt

SEQ ID NO: 590414 - DNA, 25 bp, Mus musculus
ggacatgcaattccactggctgagc

SEQ ID NO: 590415 - DNA, 25 bp, Mus musculus
ggacatgcaattgcactggctgagc

SEQ ID NO: 590416 - DNA, 25 bp, Mus musculus
ggacatgcagaaattctatgaatat

SEQ ID NO: 590417 - DNA, 25 bp, Mus musculus
ggacatgcagaatttctatgaatat

SEQ ID NO: 590418 - DNA, 25 bp, Mus musculus
ggacatgcagcaaatccatgattgg

SEQ ID NO: 590419 - DNA, 25 bp, Mus musculus
ggacatgcagcatatccatgattgg

SEQ ID NO: 590420 - DNA, 25 bp, Mus musculus
ggacatgcaggcagctgttcatcat

SEQ ID NO: 590421 - DNA, 25 bp, Mus musculus
ggacatgcaggctgctgttcatcat

SEQ ID NO: 590422 - DNA, 25 bp, Mus musculus
ggacatgcataaacgtgccgcgcgt

SEQ ID NO: 590423 - DNA, 25 bp, Mus musculus
ggacatgcataatcgtgccgcgcgt

SEQ ID NO: 590424 - DNA, 25 bp, Mus musculus
ggacatgccaatcttctatgaacct

SEQ ID NO: 590425 - DNA, 25 bp, Mus musculus
ggacatgccaatgttctatgaacct

SEQ ID NO: 590426 - DNA, 25 bp, Mus musculus
ggacatgccacccaagagtgaattc

SEQ ID NO: 590427 - DNA, 25 bp, Mus musculus
ggacatgccaccgaagagtgaattc

SEQ ID NO: 590428 - DNA, 25 bp, Mus musculus
ggacatgccatgatacagtaaatct

SEQ ID NO: 590429 - DNA, 25 bp, Mus musculus
ggacatgccatgttacagtaaatct

SEQ ID NO: 590430 - DNA, 25 bp, Mus musculus
ggacatgcccaaccggacggcaact

SEQ ID NO: 590431 - DNA, 25 bp, Mus musculus
ggacatgcccaagcggacggcaact

SEQ ID NO: 590432 - DNA, 25 bp, Mus musculus
ggacatgcccatacgggaacatggc

SEQ ID NO: 590433 - DNA, 25 bp, Mus musculus
ggacatgcccattcgggaacatggc

SEQ ID NO: 590434 - DNA, 25 bp, Mus musculus
ggacatgccgtcaaccagcaaagtt

SEQ ID NO: 590435 - DNA, 25 bp, Mus musculus
ggacatgccgtctaccagcaaagtt

SEQ ID NO: 590436 - DNA, 25 bp, Mus musculus
ggacatgccttccaaacaacatatg

SEQ ID NO: 590437 - DNA, 25 bp, Mus musculus
ggacatgccttcgaaacaacatatg

SEQ ID NO: 590438 - DNA, 25 bp, Mus musculus
ggacatgccttgagtgtgctggaat

SEQ ID NO: 590439 - DNA, 25 bp, Mus musculus
ggacatgccttgtgtgtgctggaat

SEQ ID NO: 590440 - DNA, 25 bp, Mus musculus
ggacatgctagcagctctggagaag

SEQ ID NO: 590441 - DNA, 25 bp, Mus musculus
ggacatgctagcatttctcatgaat

SEQ ID NO: 590442 - DNA, 25 bp, Mus musculus
ggacatgctagctgctctggagaag

SEQ ID NO: 590443 - DNA, 25 bp, Mus musculus
ggacatgctagcttttctcatgaat

SEQ ID NO: 590444 - DNA, 25 bp, Mus musculus
ggacatgctcagcaactgtggctcc

SEQ ID NO: 590445 - DNA, 25 bp, Mus musculus
ggacatgctcaggaactgtggctcc

SEQ ID NO: 590446 - DNA, 25 bp, Mus musculus
ggacatgctgcgatgctgggcctca

SEQ ID NO: 590447 - DNA, 25 bp, Mus musculus
ggacatgctgcgttgctgggcctca

SEQ ID NO: 590448 - DNA, 25 bp, Mus musculus
ggacatgctgggatacactgaggac

SEQ ID NO: 590449 - DNA, 25 bp, Mus musculus
ggacatgctgggttacactgaggac

SEQ ID NO: 590450 - DNA, 25 bp, Mus musculus
ggacatggaagtactatcccaggaa

SEQ ID NO: 590451 - DNA, 25 bp, Mus musculus
ggacatggaagttctatcccaggaa

SEQ ID NO: 590452 - DNA, 25 bp, Mus musculus
ggacatggacatagtgtggcacccc

SEQ ID NO: 590453 - DNA, 25 bp, Mus musculus
ggacatggacattgtgtggcacccc

SEQ ID NO: 590454 - DNA, 25 bp, Mus musculus
ggacatggacgcacgttggcccaaa

SEQ ID NO: 590455 - DNA, 25 bp, Mus musculus
ggacatggacgctcgttggcccaaa

SEQ ID NO: 590456 - DNA, 25 bp, Mus musculus
ggacatggactcctccaagggagaa

SEQ ID NO: 590457 - DNA, 25 bp, Mus musculus
ggacatggactcgtccaagggagaa

SEQ ID NO: 590458 - DNA, 25 bp, Mus musculus
ggacatggacttacaagcctacttg

SEQ ID NO: 590459 - DNA, 25 bp, Mus musculus
ggacatggactttcaagcctacttg

SEQ ID NO: 590460 - DNA, 25 bp, Mus musculus
ggacatggagatcattatttcccaa

SEQ ID NO: 590461 - DNA, 25 bp, Mus musculus
ggacatggagatgattatttcccaa

SEQ ID NO: 590462 - DNA, 25 bp, Mus musculus
ggacatggagcgacacctgaagatc

SEQ ID NO: 590463 - DNA, 25 bp, Mus musculus
ggacatggagcgtcacctgaagatc

SEQ ID NO: 590464 - DNA, 25 bp, Mus musculus
ggacatggattcacagttggcccct

SEQ ID NO: 590465 - DNA, 25 bp, Mus musculus
ggacatggattctcagttggcccct

SEQ ID NO: 590466 - DNA, 25 bp, Mus musculus
ggacatggcccgagaacactttgat

SEQ ID NO: 590467 - DNA, 25 bp, Mus musculus
ggacatggcccgtgaacactttgat

SEQ ID NO: 590468 - DNA, 25 bp, Mus musculus
ggacatggcctgagtgaaaccccaa

SEQ ID NO: 590469 - DNA, 25 bp, Mus musculus
ggacatggcctgtgtgaaaccccaa

SEQ ID NO: 590470 - DNA, 25 bp, Mus musculus
ggacatggcggcacaaccttgtaat

SEQ ID NO: 590471 - DNA, 25 bp, Mus musculus
ggacatggcggctcaaccttgtaat

SEQ ID NO: 590472 - DNA, 25 bp, Mus musculus
ggacatggctctaaaatttcctgtt

SEQ ID NO: 590473 - DNA, 25 bp, Mus musculus
ggacatggctcttaaatttcctgtt

SEQ ID NO: 590474 - DNA, 25 bp, Mus musculus
ggacatggcttgatagcttgggcta

SEQ ID NO: 590475 - DNA, 25 bp, Mus musculus
ggacatggcttgttagcttgggcta

SEQ ID NO: 590476 - DNA, 25 bp, Mus musculus
ggacatgggaaaacctacccagatg

SEQ ID NO: 590477 - DNA, 25 bp, Mus musculus
ggacatgggaaatcctacccagatg

SEQ ID NO: 590478 - DNA, 25 bp, Mus musculus
ggacatgggcgacagggagggacaa

SEQ ID NO: 590479 - DNA, 25 bp, Mus musculus
ggacatgggcgagagggagggacaa

SEQ ID NO: 590480 - DNA, 25 bp, Mus musculus
ggacatggtagcagccttgctagaa

SEQ ID NO: 590481 - DNA, 25 bp, Mus musculus
ggacatggtagctgccttgctagaa

SEQ ID NO: 590482 - DNA, 25 bp, Mus musculus
ggacatggtcccctgtgaaacttgc

SEQ ID NO: 590483 - DNA, 25 bp, Mus musculus
ggacatggtcccgtgtgaaacttgc

SEQ ID NO: 590484 - DNA, 25 bp, Mus musculus
ggacatggtcctcgaaattccttat

SEQ ID NO: 590485 - DNA, 25 bp, Mus musculus
ggacatggtcctggaaattccttat

SEQ ID NO: 590486 - DNA, 25 bp, Mus musculus
ggacatggtggactctgctacaaca

SEQ ID NO: 590487 - DNA, 25 bp, Mus musculus
ggacatggtggagtctgctacaaca

SEQ ID NO: 590488 - DNA, 25 bp, Mus musculus
ggacatggtggtacatgcttacagt

SEQ ID NO: 590489 - DNA, 25 bp, Mus musculus
ggacatggtggtccatacctagaaa

SEQ ID NO: 590490 - DNA, 25 bp, Mus musculus
ggacatggtggtgcatacctagaaa

SEQ ID NO: 590491 - DNA, 25 bp, Mus musculus
ggacatggtggttcatgcttacagt

SEQ ID NO: 590492 - DNA, 25 bp, Mus musculus
ggacatggttgacccagtacaccca

SEQ ID NO: 590493 - DNA, 25 bp, Mus musculus
ggacatggttgagccagtacaccca

SEQ ID NO: 590494 - DNA, 25 bp, Mus musculus
ggacatgtaagaaaccaatcaagat

SEQ ID NO: 590495 - DNA, 25 bp, Mus musculus
ggacatgtaagataccaatcaagat

SEQ ID NO: 590496 - DNA, 25 bp, Mus musculus
ggacatgtacccatgcatactgttc

SEQ ID NO: 590497 - DNA, 25 bp, Mus musculus
ggacatgtacccttgcatactgttc

SEQ ID NO: 590498 - DNA, 25 bp, Mus musculus
ggacatgtaggccagaatgctctaa

SEQ ID NO: 590499 - DNA, 25 bp, Mus musculus
ggacatgtaggcgagaatgctctaa

SEQ ID NO: 590500 - DNA, 25 bp, Mus musculus
ggacatgtatacatctttgtttatt

SEQ ID NO: 590501 - DNA, 25 bp, Mus musculus
ggacatgtatacttctttgtttatt

SEQ ID NO: 590502 - DNA, 25 bp, Mus musculus
ggacatgtatgtcaccacctttctg

SEQ ID NO: 590503 - DNA, 25 bp, Mus musculus
ggacatgtatgtgaccacctttctg

SEQ ID NO: 590504 - DNA, 25 bp, Mus musculus
ggacatgtcagtaccatgaggttat

SEQ ID NO: 590505 - DNA, 25 bp, Mus musculus
ggacatgtcagttccatgaggttat

SEQ ID NO: 590506 - DNA, 25 bp, Mus musculus
ggacatgtccaaccacggcacagat

SEQ ID NO: 590507 - DNA, 25 bp, Mus musculus
ggacatgtccaagcacggcacagat

SEQ ID NO: 590508 - DNA, 25 bp, Mus musculus
ggacatgtccacagcagagagatca

SEQ ID NO: 590509 - DNA, 25 bp, Mus musculus
ggacatgtccactgcagagagatca

SEQ ID NO: 590510 - DNA, 25 bp, Mus musculus
ggacatgtccctcaatgagaccatt

SEQ ID NO: 590511 - DNA, 25 bp, Mus musculus
ggacatgtccctgaatgagaccatt

SEQ ID NO: 590512 - DNA, 25 bp, Mus musculus
ggacatgtcctaacttaggctaaac

SEQ ID NO: 590513 - DNA, 25 bp, Mus musculus
ggacatgtcctatcttaggctaaac

SEQ ID NO: 590514 - DNA, 25 bp, Mus musculus
ggacatgtccttacattcaatggaa

SEQ ID NO: 590515 - DNA, 25 bp, Mus musculus
ggacatgtcctttcattcaatggaa

SEQ ID NO: 590516 - DNA, 25 bp, Mus musculus
ggacatgtcgccagctgacgaggaa

SEQ ID NO: 590517 - DNA, 25 bp, Mus musculus
ggacatgtcgcctgctgacgaggaa

SEQ ID NO: 590518 - DNA, 25 bp, Mus musculus
ggacatgtctataagggacagctca

SEQ ID NO: 590519 - DNA, 25 bp, Mus musculus
ggacatgtctattagggacagctca

SEQ ID NO: 590520 - DNA, 25 bp, Mus musculus
ggacatgtctcacgaaaacagctag

SEQ ID NO: 590521 - DNA, 25 bp, Mus musculus
ggacatgtctcaggaaaacagctag

SEQ ID NO: 590522 - DNA, 25 bp, Mus musculus
ggacatgtctccatagtagactgtt

SEQ ID NO: 590523 - DNA, 25 bp, Mus musculus
ggacatgtctccttagtagactgtt

SEQ ID NO: 590524 - DNA, 25 bp, Mus musculus
ggacatgtgatcacaatgtgatttt

SEQ ID NO: 590525 - DNA, 25 bp, Mus musculus
ggacatgtgatctcaatgtgatttt

SEQ ID NO: 590526 - DNA, 25 bp, Mus musculus
ggacatgtgcataacctcatacaag

SEQ ID NO: 590527 - DNA, 25 bp, Mus musculus
ggacatgtgcattacctcatacaag

SEQ ID NO: 590528 - DNA, 25 bp, Mus musculus
ggacatgtgccccacagggcagaaa

SEQ ID NO: 590529 - DNA, 25 bp, Mus musculus
ggacatgtgcccgacagggcagaaa

SEQ ID NO: 590530 - DNA, 25 bp, Mus musculus
ggacatgtggacaatactgctgtac

SEQ ID NO: 590531 - DNA, 25 bp, Mus musculus
ggacatgtggactatactgctgtac

SEQ ID NO: 590532 - DNA, 25 bp, Mus musculus
ggacatgtggctactgcggcctgca

SEQ ID NO: 590533 - DNA, 25 bp, Mus musculus
ggacatgtggctcactaccaggacc

SEQ ID NO: 590534 - DNA, 25 bp, Mus musculus
ggacatgtggctgactaccaggacc

SEQ ID NO: 590535 - DNA, 25 bp, Mus musculus
ggacatgtggcttctgcggcctgca

SEQ ID NO: 590536 - DNA, 25 bp, Mus musculus
ggacatgttcataggcatcccatcc

SEQ ID NO: 590537 - DNA, 25 bp, Mus musculus
ggacatgttcattggcatcccatcc

SEQ ID NO: 590538 - DNA, 25 bp, Mus musculus
ggacatgttctccataagattccag

SEQ ID NO: 590539 - DNA, 25 bp, Mus musculus
ggacatgttctcgataagattccag

SEQ ID NO: 590540 - DNA, 25 bp, Mus musculus
ggacatgttcttcgacttaatctat

SEQ ID NO: 590541 - DNA, 25 bp, Mus musculus
ggacatgttcttggacttaatctat

SEQ ID NO: 590542 - DNA, 25 bp, Mus musculus
ggacatgtttcacagctgtttcaga

SEQ ID NO: 590543 - DNA, 25 bp, Mus musculus
ggacatgtttcagagctgtttcaga

SEQ ID NO: 590544 - DNA, 25 bp, Mus musculus
ggacatgtttggctgccacttgcct

SEQ ID NO: 590545 - DNA, 25 bp, Mus musculus
ggacatgtttgggtgccacttgcct

SEQ ID NO: 590546 - DNA, 25 bp, Mus musculus
ggacattaaaacagccttcagatca

SEQ ID NO: 590547 - DNA, 25 bp, Mus musculus
ggacattaaaactgccttcagatca

SEQ ID NO: 590548 - DNA, 25 bp, Mus musculus
ggacattaaacccatgggcaccttt

SEQ ID NO: 590549 - DNA, 25 bp, Mus musculus
ggacattaaaccgatgggcaccttt

SEQ ID NO: 590550 - DNA, 25 bp, Mus musculus
ggacattaaagtagcttcagatttt

SEQ ID NO: 590551 - DNA, 25 bp, Mus musculus
ggacattaaagttgcttcagatttt

SEQ ID NO: 590552 - DNA, 25 bp, Mus musculus
ggacattaacacagatgacctgata

SEQ ID NO: 590553 - DNA, 25 bp, Mus musculus
ggacattaacactgatgacctgata

SEQ ID NO: 590554 - DNA, 25 bp, Mus musculus
ggacattaacccacttgtctacata

SEQ ID NO: 590555 - DNA, 25 bp, Mus musculus
ggacattaaccctcttgtctacata

SEQ ID NO: 590556 - DNA, 25 bp, Mus musculus
ggacattactccaaccatatacaca

SEQ ID NO: 590557 - DNA, 25 bp, Mus musculus
ggacattactcctaccatatacaca

SEQ ID NO: 590558 - DNA, 25 bp, Mus musculus
ggacattagatcaaccatattgcct

SEQ ID NO: 590559 - DNA, 25 bp, Mus musculus
ggacattagatctaccatattgcct

SEQ ID NO: 590560 - DNA, 25 bp, Mus musculus
ggacattagccgacaaagactcaaa

SEQ ID NO: 590561 - DNA, 25 bp, Mus musculus
ggacattagccgtcaaagactcaaa

SEQ ID NO: 590562 - DNA, 25 bp, Mus musculus
ggacattagggcatcacccagatga

SEQ ID NO: 590563 - DNA, 25 bp, Mus musculus
ggacattagggcttcacccagatga

SEQ ID NO: 590564 - DNA, 25 bp, Mus musculus
ggacattagtgaatcttcttggaaa

SEQ ID NO: 590565 - DNA, 25 bp, Mus musculus
ggacattagtgattcttcttggaaa

SEQ ID NO: 590566 - DNA, 25 bp, Mus musculus
ggacattatgtaccccacagggaca

SEQ ID NO: 590567 - DNA, 25 bp, Mus musculus
ggacattatgtagcccacagggaca

SEQ ID NO: 590568 - DNA, 25 bp, Mus musculus
ggacattcaactctaccacaacctg

SEQ ID NO: 590569 - DNA, 25 bp, Mus musculus
ggacattcaactgtaccacaacctg

SEQ ID NO: 590570 - DNA, 25 bp, Mus musculus
ggacattcatgtatcacagacttca

SEQ ID NO: 590571 - DNA, 25 bp, Mus musculus
ggacattcatgtttcacagacttca

SEQ ID NO: 590572 - DNA, 25 bp, Mus musculus
ggacattccctaaaaagcctgtgcc

SEQ ID NO: 590573 - DNA, 25 bp, Mus musculus
ggacattccctataaagcctgtgcc

SEQ ID NO: 590574 - DNA, 25 bp, Mus musculus
ggacattcctgtcactctgggataa

SEQ ID NO: 590575 - DNA, 25 bp, Mus musculus
ggacattcctgtgactctgggataa

SEQ ID NO: 590576 - DNA, 25 bp, Mus musculus
ggacattcctttagtgcgctatgaa

SEQ ID NO: 590577 - DNA, 25 bp, Mus musculus
ggacattcctttccttggtgaaatg

SEQ ID NO: 590578 - DNA, 25 bp, Mus musculus
ggacattcctttgcttggtgaaatg

SEQ ID NO: 590579 - DNA, 25 bp, Mus musculus
ggacattccttttgtgcgctatgaa

SEQ ID NO: 590580 - DNA, 25 bp, Mus musculus
ggacattcggttagcgcaacatctg

SEQ ID NO: 590581 - DNA, 25 bp, Mus musculus
ggacattcggtttgcgcaacatctg

SEQ ID NO: 590582 - DNA, 25 bp, Mus musculus
ggacattctctcatctgaccagata

SEQ ID NO: 590583 - DNA, 25 bp, Mus musculus
ggacattctctcttctgaccagata

SEQ ID NO: 590584 - DNA, 25 bp, Mus musculus
ggacattctgacaaataacactttt

SEQ ID NO: 590585 - DNA, 25 bp, Mus musculus
ggacattctgactaataacactttt

SEQ ID NO: 590586 - DNA, 25 bp, Mus musculus
ggacattcttggagggtgaagccct

SEQ ID NO: 590587 - DNA, 25 bp, Mus musculus
ggacattcttggtgggtgaagccct

SEQ ID NO: 590588 - DNA, 25 bp, Mus musculus
ggacattctttaaccacccttgagc

SEQ ID NO: 590589 - DNA, 25 bp, Mus musculus
ggacattctttatccacccttgagc

SEQ ID NO: 590590 - DNA, 25 bp, Mus musculus
ggacattgaacacttatctttttat

SEQ ID NO: 590591 - DNA, 25 bp, Mus musculus
ggacattgaacagttatctttttat

SEQ ID NO: 590592 - DNA, 25 bp, Mus musculus
ggacattgaaggaaccactgttata

SEQ ID NO: 590593 - DNA, 25 bp, Mus musculus
ggacattgaaggtaccactgttata

SEQ ID NO: 590594 - DNA, 25 bp, Mus musculus
ggacattgacacattgccaacacgc

SEQ ID NO: 590595 - DNA, 25 bp, Mus musculus
ggacattgacactttgccaacacgc

SEQ ID NO: 590596 - DNA, 25 bp, Mus musculus
ggacattgacatacgcattaaggat

SEQ ID NO: 590597 - DNA, 25 bp, Mus musculus
ggacattgacatctttcatgtgtca

SEQ ID NO: 590598 - DNA, 25 bp, Mus musculus
ggacattgacatgtttcatgtgtca

SEQ ID NO: 590599 - DNA, 25 bp, Mus musculus
ggacattgacattcgcattaaggat

SEQ ID NO: 590600 - DNA, 25 bp, Mus musculus
ggacattgaccaatcaggcctggac

SEQ ID NO: 590601 - DNA, 25 bp, Mus musculus
ggacattgaccattcaggcctggac

SEQ ID NO: 590602 - DNA, 25 bp, Mus musculus
ggacattgaggaccacctgcagcgt

SEQ ID NO: 590603 - DNA, 25 bp, Mus musculus
ggacattgaggagcacctgcagcgt

SEQ ID NO: 590604 - DNA, 25 bp, Mus musculus
ggacattgatacatctgcggtggaa

SEQ ID NO: 590605 - DNA, 25 bp, Mus musculus
ggacattgatacttctgcggtggaa

SEQ ID NO: 590606 - DNA, 25 bp, Mus musculus
ggacattgattgattccaacacttg

SEQ ID NO: 590607 - DNA, 25 bp, Mus musculus
ggacattgattgtttccaacacttg

SEQ ID NO: 590608 - DNA, 25 bp, Mus musculus
ggacattgcaggaagcttgcccaat

SEQ ID NO: 590609 - DNA, 25 bp, Mus musculus
ggacattgcaggtagcttgcccaat

SEQ ID NO: 590610 - DNA, 25 bp, Mus musculus
ggacattgccatatgttcttgggct

SEQ ID NO: 590611 - DNA, 25 bp, Mus musculus
ggacattgccatttgttcttgggct

SEQ ID NO: 590612 - DNA, 25 bp, Mus musculus
ggacattgcctaccacgcccaagat

SEQ ID NO: 590613 - DNA, 25 bp, Mus musculus
ggacattgcctactttgacagtgtt

SEQ ID NO: 590614 - DNA, 25 bp, Mus musculus
ggacattgcctagcacgcccaagat

SEQ ID NO: 590615 - DNA, 25 bp, Mus musculus
ggacattgcctagtttgacagtgtt

SEQ ID NO: 590616 - DNA, 25 bp, Mus musculus
ggacattgcgcaactctgagagttc

SEQ ID NO: 590617 - DNA, 25 bp, Mus musculus
ggacattgcgcatctctgagagttc

SEQ ID NO: 590618 - DNA, 25 bp, Mus musculus
ggacattgctggctatcacaactca

SEQ ID NO: 590619 - DNA, 25 bp, Mus musculus
ggacattgctgggtatcacaactca

SEQ ID NO: 590620 - DNA, 25 bp, Mus musculus
ggacattgctgtcattgtatttata

SEQ ID NO: 590621 - DNA, 25 bp, Mus musculus
ggacattgctgtgattgtatttata

SEQ ID NO: 590622 - DNA, 25 bp, Mus musculus
ggacattgctttaagccccagtttg

SEQ ID NO: 590623 - DNA, 25 bp, Mus musculus
ggacattgctttagacaggaccctc

SEQ ID NO: 590624 - DNA, 25 bp, Mus musculus
ggacattgcttttagccccagtttg

SEQ ID NO: 590625 - DNA, 25 bp, Mus musculus
ggacattgcttttgacaggaccctc

SEQ ID NO: 590626 - DNA, 25 bp, Mus musculus
ggacattggcatacaggcaggaaat

SEQ ID NO: 590627 - DNA, 25 bp, Mus musculus
ggacattggcatattcaaccttata

SEQ ID NO: 590628 - DNA, 25 bp, Mus musculus
ggacattggcattcaggcaggaaat

SEQ ID NO: 590629 - DNA, 25 bp, Mus musculus
ggacattggcattttcaaccttata

SEQ ID NO: 590630 - DNA, 25 bp, Mus musculus
ggacattggctaagctttttaggtc

SEQ ID NO: 590631 - DNA, 25 bp, Mus musculus
ggacattggctatgctttttaggtc

SEQ ID NO: 590632 - DNA, 25 bp, Mus musculus
ggacattgggccacgggctagacaa

SEQ ID NO: 590633 - DNA, 25 bp, Mus musculus
ggacattgggcctcgggctagacaa

SEQ ID NO: 590634 - DNA, 25 bp, Mus musculus
ggacattggtccaactttatctcta

SEQ ID NO: 590635 - DNA, 25 bp, Mus musculus
ggacattggtcctactttatctcta

SEQ ID NO: 590636 - DNA, 25 bp, Mus musculus
ggacattggttaatcatctgtaaag

SEQ ID NO: 590637 - DNA, 25 bp, Mus musculus
ggacattggttattcatctgtaaag

SEQ ID NO: 590638 - DNA, 25 bp, Mus musculus
ggacattggtttagcctgactccaa

SEQ ID NO: 590639 - DNA, 25 bp, Mus musculus
ggacattggttttgcctgactccaa

SEQ ID NO: 590640 - DNA, 25 bp, Mus musculus
ggacattgtatgaattttactgcaa

SEQ ID NO: 590641 - DNA, 25 bp, Mus musculus
ggacattgtatgtattttactgcaa

SEQ ID NO: 590642 - DNA, 25 bp, Mus musculus
ggacattgtcaaaatgctcatgcac

SEQ ID NO: 590643 - DNA, 25 bp, Mus musculus
ggacattgtcaatatgctcatgcac

SEQ ID NO: 590644 - DNA, 25 bp, Mus musculus
ggacattgtcatacctcatgaagga

SEQ ID NO: 590645 - DNA, 25 bp, Mus musculus
ggacattgtcatagccgagttggat

SEQ ID NO: 590646 - DNA, 25 bp, Mus musculus
ggacattgtcattcctcatgaagga

SEQ ID NO: 590647 - DNA, 25 bp, Mus musculus
ggacattgtcattgccgagttggat

SEQ ID NO: 590648 - DNA, 25 bp, Mus musculus
ggacattgtccgagggcatcaccca

SEQ ID NO: 590649 - DNA, 25 bp, Mus musculus
ggacattgtccgtgggcatcaccca

SEQ ID NO: 590650 - DNA, 25 bp, Mus musculus
ggacattgtctcaacttcatctacc

SEQ ID NO: 590651 - DNA, 25 bp, Mus musculus
ggacattgtctctacttcatctacc

SEQ ID NO: 590652 - DNA, 25 bp, Mus musculus
ggacattgtgctatctggtgttttt

SEQ ID NO: 590653 - DNA, 25 bp, Mus musculus
ggacattgtgctttctggtgttttt

SEQ ID NO: 590654 - DNA, 25 bp, Mus musculus
ggacattgtggactcgttgccttgc

SEQ ID NO: 590655 - DNA, 25 bp, Mus musculus
ggacattgtggagtcgttgccttgc

SEQ ID NO: 590656 - DNA, 25 bp, Mus musculus
ggacattgtggcatcaggacttctg

SEQ ID NO: 590657 - DNA, 25 bp, Mus musculus
ggacattgtggcttcaggacttctg

SEQ ID NO: 590658 - DNA, 25 bp, Mus musculus
ggacattgttgaagacctgcgactc

SEQ ID NO: 590659 - DNA, 25 bp, Mus musculus
ggacattgttgatgacctgcgactc

SEQ ID NO: 590660 - DNA, 25 bp, Mus musculus
ggacattgttgcaaccatatattat

SEQ ID NO: 590661 - DNA, 25 bp, Mus musculus
ggacattgttgctaccatatattat

SEQ ID NO: 590662 - DNA, 25 bp, Mus musculus
ggacattgtttaccttatttggaat

SEQ ID NO: 590663 - DNA, 25 bp, Mus musculus
ggacattgtttagcttatttggaat

SEQ ID NO: 590664 - DNA, 25 bp, Mus musculus
ggacatttaccaatctccactggat

SEQ ID NO: 590665 - DNA, 25 bp, Mus musculus
ggacatttaccattctccactggat

SEQ ID NO: 590666 - DNA, 25 bp, Mus musculus
ggacatttagctagttcatctatct

SEQ ID NO: 590667 - DNA, 25 bp, Mus musculus
ggacatttagcttgttcatctatct

SEQ ID NO: 590668 - DNA, 25 bp, Mus musculus
ggacatttaggcagctcactctgaa

SEQ ID NO: 590669 - DNA, 25 bp, Mus musculus
ggacatttaggctgctcactctgaa

SEQ ID NO: 590670 - DNA, 25 bp, Mus musculus
ggacatttagttcaccaccagggtg

SEQ ID NO: 590671 - DNA, 25 bp, Mus musculus
ggacatttagttgaccaccagggtg

SEQ ID NO: 590672 - DNA, 25 bp, Mus musculus
ggacatttatcaagtttcttccatc

SEQ ID NO: 590673 - DNA, 25 bp, Mus musculus
ggacatttatcatgtttcttccatc

SEQ ID NO: 590674 - DNA, 25 bp, Mus musculus
ggacatttatgtacaaacttttttg

SEQ ID NO: 590675 - DNA, 25 bp, Mus musculus
ggacatttatgttcaaacttttttg

SEQ ID NO: 590676 - DNA, 25 bp, Mus musculus
ggacatttatttactcattgctcac

SEQ ID NO: 590677 - DNA, 25 bp, Mus musculus
ggacatttattttctcattgctcac

SEQ ID NO: 590678 - DNA, 25 bp, Mus musculus
ggacatttcactatctcatgtgctt

SEQ ID NO: 590679 - DNA, 25 bp, Mus musculus
ggacatttcactttctcatgtgctt

SEQ ID NO: 590680 - DNA, 25 bp, Mus musculus
ggacatttcatcctgagaggttttc

SEQ ID NO: 590681 - DNA, 25 bp, Mus musculus
ggacatttcatcgtgagaggttttc

SEQ ID NO: 590682 - DNA, 25 bp, Mus musculus
ggacatttccttaggttgtgcccag

SEQ ID NO: 590683 - DNA, 25 bp, Mus musculus
ggacatttcctttggttgtgcccag

SEQ ID NO: 590684 - DNA, 25 bp, Mus musculus
ggacatttctctcagtccatggctt

SEQ ID NO: 590685 - DNA, 25 bp, Mus musculus
ggacatttctctgagtccatggctt

SEQ ID NO: 590686 - DNA, 25 bp, Mus musculus
ggacatttcttcaaaaacccagtat

SEQ ID NO: 590687 - DNA, 25 bp, Mus musculus
ggacatttcttcagttacctgacga

SEQ ID NO: 590688 - DNA, 25 bp, Mus musculus
ggacatttcttctaaaacccagtat

SEQ ID NO: 590689 - DNA, 25 bp, Mus musculus
ggacatttcttctgttacctgacga

SEQ ID NO: 590690 - DNA, 25 bp, Mus musculus
ggacatttgagacccacttctggct

SEQ ID NO: 590691 - DNA, 25 bp, Mus musculus
ggacatttgagagccacttctggct

SEQ ID NO: 590692 - DNA, 25 bp, Mus musculus
ggacatttgctacctgaaagtatga

SEQ ID NO: 590693 - DNA, 25 bp, Mus musculus
ggacatttgctagctgaaagtatga

SEQ ID NO: 590694 - DNA, 25 bp, Mus musculus
ggacatttgctcaactttgtagcta

SEQ ID NO: 590695 - DNA, 25 bp, Mus musculus
ggacatttgctctactttgtagcta

SEQ ID NO: 590696 - DNA, 25 bp, Mus musculus
ggacatttgttcagaagcctggcca

SEQ ID NO: 590697 - DNA, 25 bp, Mus musculus
ggacatttgttcaggaatactaatc

SEQ ID NO: 590698 - DNA, 25 bp, Mus musculus
ggacatttgttctgaagcctggcca

SEQ ID NO: 590699 - DNA, 25 bp, Mus musculus
ggacatttgttctggaatactaatc

SEQ ID NO: 590700 - DNA, 25 bp, Mus musculus
ggacattttataaagactgcctctt

SEQ ID NO: 590701 - DNA, 25 bp, Mus musculus
ggacattttatatagactgcctctt

SEQ ID NO: 590702 - DNA, 25 bp, Mus musculus
ggacattttccacgcttctgttaaa

SEQ ID NO: 590703 - DNA, 25 bp, Mus musculus
ggacattttccaggcttctgttaaa

SEQ ID NO: 590704 - DNA, 25 bp, Mus musculus
ggacattttccgcacaagacagagg

SEQ ID NO: 590705 - DNA, 25 bp, Mus musculus
ggacattttccggacaagacagagg

SEQ ID NO: 590706 - DNA, 25 bp, Mus musculus
ggacattttctactcactgtgctac

SEQ ID NO: 590707 - DNA, 25 bp, Mus musculus
ggacattttctagtcactgtgctac

SEQ ID NO: 590708 - DNA, 25 bp, Mus musculus
ggacattttctcacctaacctgatt

SEQ ID NO: 590709 - DNA, 25 bp, Mus musculus
ggacattttctctcctaacctgatt

SEQ ID NO: 590710 - DNA, 25 bp, Mus musculus
ggacattttgaacacctgctgctgg

SEQ ID NO: 590711 - DNA, 25 bp, Mus musculus
ggacattttgaagacctgctgctgg

SEQ ID NO: 590712 - DNA, 25 bp, Mus musculus
ggacattttgctccattttacaact

SEQ ID NO: 590713 - DNA, 25 bp, Mus musculus
ggacattttgctgcattttacaact

SEQ ID NO: 590714 - DNA, 25 bp, Mus musculus
ggacattttggacctccaagtaaat

SEQ ID NO: 590715 - DNA, 25 bp, Mus musculus
ggacattttggagctccaagtaaat

SEQ ID NO: 590716 - DNA, 25 bp, Mus musculus
ggacattttgttccaacctcatcaa

SEQ ID NO: 590717 - DNA, 25 bp, Mus musculus
ggacattttgttgcaacctcatcaa

SEQ ID NO: 590718 - DNA, 25 bp, Mus musculus
ggacatttttgtcgagtagtttgca

SEQ ID NO: 590719 - DNA, 25 bp, Mus musculus
ggacatttttgtggagtagtttgca

SEQ ID NO: 590720 - DNA, 25 bp, Mus musculus
ggaccaaaagacactcttccagtga

SEQ ID NO: 590721 - DNA, 25 bp, Mus musculus
ggaccaaaagactctcttccagtga

SEQ ID NO: 590722 - DNA, 25 bp, Mus musculus
ggaccaaaagcacccagaggcatta

SEQ ID NO: 590723 - DNA, 25 bp, Mus musculus
ggaccaaaagcagccagaggcatta

SEQ ID NO: 590724 - DNA, 25 bp, Mus musculus
ggaccaaacaatatgtcatggcaat

SEQ ID NO: 590725 - DNA, 25 bp, Mus musculus
ggaccaaacaatttgtcatggcaat

SEQ ID NO: 590726 - DNA, 25 bp, Mus musculus
ggaccaaacctacctgtctgggaat

SEQ ID NO: 590727 - DNA, 25 bp, Mus musculus
ggaccaaacctagctgtctgggaat

SEQ ID NO: 590728 - DNA, 25 bp, Mus musculus
ggaccaaacgagacagtaagcctaa

SEQ ID NO: 590729 - DNA, 25 bp, Mus musculus
ggaccaaacgagtcagtaagcctaa

SEQ ID NO: 590730 - DNA, 25 bp, Mus musculus
ggaccaaactacctccttgctgtag

SEQ ID NO: 590731 - DNA, 25 bp, Mus musculus
ggaccaaactacgtccttgctgtag

SEQ ID NO: 590732 - DNA, 25 bp, Mus musculus
ggaccaaagagcaggcccagaccca

SEQ ID NO: 590733 - DNA, 25 bp, Mus musculus
ggaccaaagagctggcccagaccca

SEQ ID NO: 590734 - DNA, 25 bp, Mus musculus
ggaccaaagccactaaattatggaa

SEQ ID NO: 590735 - DNA, 25 bp, Mus musculus
ggaccaaagccagtaaattatggaa

SEQ ID NO: 590736 - DNA, 25 bp, Mus musculus
ggaccaaagcccagcttaggttcca

SEQ ID NO: 590737 - DNA, 25 bp, Mus musculus
ggaccaaagccctgcttaggttcca

SEQ ID NO: 590738 - DNA, 25 bp, Mus musculus
ggaccaaagctactgtaccaacagg

SEQ ID NO: 590739 - DNA, 25 bp, Mus musculus
ggaccaaagctagtgtaccaacagg

SEQ ID NO: 590740 - DNA, 25 bp, Mus musculus
ggaccaaagctgagctcagccaatt

SEQ ID NO: 590741 - DNA, 25 bp, Mus musculus
ggaccaaagctgtgctcagccaatt

SEQ ID NO: 590742 - DNA, 25 bp, Mus musculus
ggaccaaagggcatctaacagcttc

SEQ ID NO: 590743 - DNA, 25 bp, Mus musculus
ggaccaaagggcttctaacagcttc

SEQ ID NO: 590744 - DNA, 25 bp, Mus musculus
ggaccaaagtccacatagcttgctt

SEQ ID NO: 590745 - DNA, 25 bp, Mus musculus
ggaccaaagtccacatggttcttag

SEQ ID NO: 590746 - DNA, 25 bp, Mus musculus
ggaccaaagtcctcatagcttgctt

SEQ ID NO: 590747 - DNA, 25 bp, Mus musculus
ggaccaaagtcctcatggttcttag

SEQ ID NO: 590748 - DNA, 25 bp, Mus musculus
ggaccaaagtgcagcgatgcccatg

SEQ ID NO: 590749 - DNA, 25 bp, Mus musculus
ggaccaaagtgctgcgatgcccatg

SEQ ID NO: 590750 - DNA, 25 bp, Mus musculus
ggaccaaataaaagaccaaccaaat

SEQ ID NO: 590751 - DNA, 25 bp, Mus musculus
ggaccaaataaatgaccaaccaaat

SEQ ID NO: 590752 - DNA, 25 bp, Mus musculus
ggaccaaatcaacataacttcggag

SEQ ID NO: 590753 - DNA, 25 bp, Mus musculus
ggaccaaatcaagataacttcggag

SEQ ID NO: 590754 - DNA, 25 bp, Mus musculus
ggaccaaatggtacagcctcacttt

SEQ ID NO: 590755 - DNA, 25 bp, Mus musculus
ggaccaaatggtatgtctgtggcaa

SEQ ID NO: 590756 - DNA, 25 bp, Mus musculus
ggaccaaatggttcagcctcacttt

SEQ ID NO: 590757 - DNA, 25 bp, Mus musculus
ggaccaaatggtttgtctgtggcaa

SEQ ID NO: 590758 - DNA, 25 bp, Mus musculus
ggaccaaattcacttcatttatgtc

SEQ ID NO: 590759 - DNA, 25 bp, Mus musculus
ggaccaaattcagttcatttatgtc

SEQ ID NO: 590760 - DNA, 25 bp, Mus musculus
ggaccaaattcgaaccaccatgtaa

SEQ ID NO: 590761 - DNA, 25 bp, Mus musculus
ggaccaaattcgtaccaccatgtaa

SEQ ID NO: 590762 - DNA, 25 bp, Mus musculus
ggaccaaattggctcagtcacgaag

SEQ ID NO: 590763 - DNA, 25 bp, Mus musculus
ggaccaaattgggtcagtcacgaag

SEQ ID NO: 590764 - DNA, 25 bp, Mus musculus
ggaccaacaagaagccgccttatca

SEQ ID NO: 590765 - DNA, 25 bp, Mus musculus
ggaccaacaagatgccgccttatca

SEQ ID NO: 590766 - DNA, 25 bp, Mus musculus
ggaccaacaccaagtgaggacgcct

SEQ ID NO: 590767 - DNA, 25 bp, Mus musculus
ggaccaacaccatgtgaggacgcct

SEQ ID NO: 590768 - DNA, 25 bp, Mus musculus
ggaccaacacgcaggattacatctt

SEQ ID NO: 590769 - DNA, 25 bp, Mus musculus
ggaccaacacgctggattacatctt

SEQ ID NO: 590770 - DNA, 25 bp, Mus musculus
ggaccaacacttcaggttcaggcag

SEQ ID NO: 590771 - DNA, 25 bp, Mus musculus
ggaccaacacttgaggttcaggcag

SEQ ID NO: 590772 - DNA, 25 bp, Mus musculus
ggaccaacatctctacatactgtat

SEQ ID NO: 590773 - DNA, 25 bp, Mus musculus
ggaccaacatctgtacatactgtat

SEQ ID NO: 590774 - DNA, 25 bp, Mus musculus
ggaccaaccaacaaaattctctgaa

SEQ ID NO: 590775 - DNA, 25 bp, Mus musculus
ggaccaaccaactaaattctctgaa

SEQ ID NO: 590776 - DNA, 25 bp, Mus musculus
ggaccaaccacacgatcagatgtta

SEQ ID NO: 590777 - DNA, 25 bp, Mus musculus
ggaccaaccacaggatcagatgtta

SEQ ID NO: 590778 - DNA, 25 bp, Mus musculus
ggaccaaccaccctcagattttttg

SEQ ID NO: 590779 - DNA, 25 bp, Mus musculus
ggaccaaccaccgtcagattttttg

SEQ ID NO: 590780 - DNA, 25 bp, Mus musculus
ggaccaaccgagaacactggattgc

SEQ ID NO: 590781 - DNA, 25 bp, Mus musculus
ggaccaaccgagtacactggattgc

SEQ ID NO: 590782 - DNA, 25 bp, Mus musculus
ggaccaacctatcgtagttccatgt

SEQ ID NO: 590783 - DNA, 25 bp, Mus musculus
ggaccaacctatggtagttccatgt

SEQ ID NO: 590784 - DNA, 25 bp, Mus musculus
ggaccaacgagtacacagctgagca

SEQ ID NO: 590785 - DNA, 25 bp, Mus musculus
ggaccaacgagttcacagctgagca

SEQ ID NO: 590786 - DNA, 25 bp, Mus musculus
ggaccaactgcactgcatttcaaca

SEQ ID NO: 590787 - DNA, 25 bp, Mus musculus
ggaccaactgcagtgcatttcaaca

SEQ ID NO: 590788 - DNA, 25 bp, Mus musculus
ggaccaactgctcgctcatcaggga

SEQ ID NO: 590789 - DNA, 25 bp, Mus musculus
ggaccaactgctggctcatcaggga

SEQ ID NO: 590790 - DNA, 25 bp, Mus musculus
ggaccaacttcacatgagagtgtct

SEQ ID NO: 590791 - DNA, 25 bp, Mus musculus
ggaccaacttcagatgagagtgtct

SEQ ID NO: 590792 - DNA, 25 bp, Mus musculus
ggaccaacttgcattccatcagttt

SEQ ID NO: 590793 - DNA, 25 bp, Mus musculus
ggaccaacttgctttccatcagttt

SEQ ID NO: 590794 - DNA, 25 bp, Mus musculus
ggaccaagacaccactgacaaggct

SEQ ID NO: 590795 - DNA, 25 bp, Mus musculus
ggaccaagacacgactgacaaggct

SEQ ID NO: 590796 - DNA, 25 bp, Mus musculus
ggaccaagaccaaccaattcatctt

SEQ ID NO: 590797 - DNA, 25 bp, Mus musculus
ggaccaagaccatccaattcatctt

SEQ ID NO: 590798 - DNA, 25 bp, Mus musculus
ggaccaagacccctggacctggagc

SEQ ID NO: 590799 - DNA, 25 bp, Mus musculus
ggaccaagacccgtggacctggagc

SEQ ID NO: 590800 - DNA, 25 bp, Mus musculus
ggaccaagagcccacttgagggtct

SEQ ID NO: 590801 - DNA, 25 bp, Mus musculus
ggaccaagagccgacttgagggtct

SEQ ID NO: 590802 - DNA, 25 bp, Mus musculus
ggaccaagagctaagatcccagcct

SEQ ID NO: 590803 - DNA, 25 bp, Mus musculus
ggaccaagagcttagatcccagcct

SEQ ID NO: 590804 - DNA, 25 bp, Mus musculus
ggaccaagagtaaggccttcagacc

SEQ ID NO: 590805 - DNA, 25 bp, Mus musculus
ggaccaagagtatggccttcagacc

SEQ ID NO: 590806 - DNA, 25 bp, Mus musculus
ggaccaagatgacgacgccaccctt

SEQ ID NO: 590807 - DNA, 25 bp, Mus musculus
ggaccaagatgaggacgccaccctt

SEQ ID NO: 590808 - DNA, 25 bp, Mus musculus
ggaccaagatttaagcccatagctg

SEQ ID NO: 590809 - DNA, 25 bp, Mus musculus
ggaccaagattttagcccatagctg

SEQ ID NO: 590810 - DNA, 25 bp, Mus musculus
ggaccaagcaaaaccagttcttttc

SEQ ID NO: 590811 - DNA, 25 bp, Mus musculus
ggaccaagcaaatccagttcttttc

SEQ ID NO: 590812 - DNA, 25 bp, Mus musculus
ggaccaagccatcaatatcctctca

SEQ ID NO: 590813 - DNA, 25 bp, Mus musculus
ggaccaagccatgaatatcctctca

SEQ ID NO: 590814 - DNA, 25 bp, Mus musculus
ggaccaagctcacaacattatttgt

SEQ ID NO: 590815 - DNA, 25 bp, Mus musculus
ggaccaagctcagaacattatttgt

SEQ ID NO: 590816 - DNA, 25 bp, Mus musculus
ggaccaagcttaaacatcagcagaa

SEQ ID NO: 590817 - DNA, 25 bp, Mus musculus
ggaccaagcttatacatcagcagaa

SEQ ID NO: 590818 - DNA, 25 bp, Mus musculus
ggaccaaggaatatctgtgactcat

SEQ ID NO: 590819 - DNA, 25 bp, Mus musculus
ggaccaaggaatatttcccaccact

SEQ ID NO: 590820 - DNA, 25 bp, Mus musculus
ggaccaaggaatttctgtgactcat

SEQ ID NO: 590821 - DNA, 25 bp, Mus musculus
ggaccaaggaatttttcccaccact

SEQ ID NO: 590822 - DNA, 25 bp, Mus musculus
ggaccaaggcaaattctgttgccta

SEQ ID NO: 590823 - DNA, 25 bp, Mus musculus
ggaccaaggcaatttctgttgccta

SEQ ID NO: 590824 - DNA, 25 bp, Mus musculus
ggaccaaggcatattattcccgtga

SEQ ID NO: 590825 - DNA, 25 bp, Mus musculus
ggaccaaggcattttattcccgtga

SEQ ID NO: 590826 - DNA, 25 bp, Mus musculus
ggaccaagggaaacttctctcactg

SEQ ID NO: 590827 - DNA, 25 bp, Mus musculus
ggaccaagggaatcttctctcactg

SEQ ID NO: 590828 - DNA, 25 bp, Mus musculus
ggaccaagggagatctaatccagaa

SEQ ID NO: 590829 - DNA, 25 bp, Mus musculus
ggaccaagggagttctaatccagaa

SEQ ID NO: 590830 - DNA, 25 bp, Mus musculus
ggaccaagggcaaccttgggccaac

SEQ ID NO: 590831 - DNA, 25 bp, Mus musculus
ggaccaagggcatccttgggccaac

SEQ ID NO: 590832 - DNA, 25 bp, Mus musculus
ggaccaagtaatatctcctttgcct

SEQ ID NO: 590833 - DNA, 25 bp, Mus musculus
ggaccaagtaatcccgcagtaaact

SEQ ID NO: 590834 - DNA, 25 bp, Mus musculus
ggaccaagtaatgccgcagtaaact

SEQ ID NO: 590835 - DNA, 25 bp, Mus musculus
ggaccaagtaatttctcctttgcct

SEQ ID NO: 590836 - DNA, 25 bp, Mus musculus
ggaccaataactatgttcaccctga

SEQ ID NO: 590837 - DNA, 25 bp, Mus musculus
ggaccaataactttgttcaccctga

SEQ ID NO: 590838 - DNA, 25 bp, Mus musculus
ggaccaatactccttgttattttga

SEQ ID NO: 590839 - DNA, 25 bp, Mus musculus
ggaccaatactcgttgttattttga

SEQ ID NO: 590840 - DNA, 25 bp, Mus musculus
ggaccaatagtgactctcctagtaa

SEQ ID NO: 590841 - DNA, 25 bp, Mus musculus
ggaccaatagtgtctctcctagtaa

SEQ ID NO: 590842 - DNA, 25 bp, Mus musculus
ggaccaatatgccactctatcagta

SEQ ID NO: 590843 - DNA, 25 bp, Mus musculus
ggaccaatatgcgactctatcagta

SEQ ID NO: 590844 - DNA, 25 bp, Mus musculus
ggaccaatcagacatgctgtagctt

SEQ ID NO: 590845 - DNA, 25 bp, Mus musculus
ggaccaatcagagatgctgtagctt

SEQ ID NO: 590846 - DNA, 25 bp, Mus musculus
ggaccaatccttatgatatgcttag

SEQ ID NO: 590847 - DNA, 25 bp, Mus musculus
ggaccaatccttttgatatgcttag

SEQ ID NO: 590848 - DNA, 25 bp, Mus musculus
ggaccaatgctaacacccagatttt

SEQ ID NO: 590849 - DNA, 25 bp, Mus musculus
ggaccaatgctatcacccagatttt

SEQ ID NO: 590850 - DNA, 25 bp, Mus musculus
ggaccaatgtccaattacttctcag

SEQ ID NO: 590851 - DNA, 25 bp, Mus musculus
ggaccaatgtcctattacttctcag

SEQ ID NO: 590852 - DNA, 25 bp, Mus musculus
ggaccaattagcaggagatttgact

SEQ ID NO: 590853 - DNA, 25 bp, Mus musculus
ggaccaattagctggagatttgact

SEQ ID NO: 590854 - DNA, 25 bp, Mus musculus
ggaccaattgtaatctgaggccagt

SEQ ID NO: 590855 - DNA, 25 bp, Mus musculus
ggaccaattgtattctgaggccagt

SEQ ID NO: 590856 - DNA, 25 bp, Mus musculus
ggaccaatttgaacttcgtctgaat

SEQ ID NO: 590857 - DNA, 25 bp, Mus musculus
ggaccaatttgatcttcgtctgaat

SEQ ID NO: 590858 - DNA, 25 bp, Mus musculus
ggaccacaaactcagtccatcggtc

SEQ ID NO: 590859 - DNA, 25 bp, Mus musculus
ggaccacaaactgagtccatcggtc

SEQ ID NO: 590860 - DNA, 25 bp, Mus musculus
ggaccacaagcccaagtcttctact

SEQ ID NO: 590861 - DNA, 25 bp, Mus musculus
ggaccacaagccgaagtcttctact

SEQ ID NO: 590862 - DNA, 25 bp, Mus musculus
ggaccacaaggtacacagaaattga

SEQ ID NO: 590863 - DNA, 25 bp, Mus musculus
ggaccacaaggttcacagaaattga

SEQ ID NO: 590864 - DNA, 25 bp, Mus musculus
ggaccacaatggactctatgcagat

SEQ ID NO: 590865 - DNA, 25 bp, Mus musculus
ggaccacaatggtctctatgcagat

SEQ ID NO: 590866 - DNA, 25 bp, Mus musculus
ggaccacaattcagttggcagcaat

SEQ ID NO: 590867 - DNA, 25 bp, Mus musculus
ggaccacaattctgttggcagcaat

SEQ ID NO: 590868 - DNA, 25 bp, Mus musculus
ggaccacacacacattacacactta

SEQ ID NO: 590869 - DNA, 25 bp, Mus musculus
ggaccacacacagattacacactta

SEQ ID NO: 590870 - DNA, 25 bp, Mus musculus
ggaccacacgcgcattgtctttttt

SEQ ID NO: 590871 - DNA, 25 bp, Mus musculus
ggaccacacgcggattgtctttttt

SEQ ID NO: 590872 - DNA, 25 bp, Mus musculus
ggaccacactaaaagcacagattca

SEQ ID NO: 590873 - DNA, 25 bp, Mus musculus
ggaccacactaatagcacagattca

SEQ ID NO: 590874 - DNA, 25 bp, Mus musculus
ggaccacactttaatagctccccag

SEQ ID NO: 590875 - DNA, 25 bp, Mus musculus
ggaccacacttttatagctccccag

SEQ ID NO: 590876 - DNA, 25 bp, Mus musculus
ggaccacagctgagcacaaggtcat

SEQ ID NO: 590877 - DNA, 25 bp, Mus musculus
ggaccacagctgtgcacaaggtcat

SEQ ID NO: 590878 - DNA, 25 bp, Mus musculus
ggaccacagtggctggaccaatcca

SEQ ID NO: 590879 - DNA, 25 bp, Mus musculus
ggaccacagtgggtggaccaatcca

SEQ ID NO: 590880 - DNA, 25 bp, Mus musculus
ggaccacatacgcatcttccaagag

SEQ ID NO: 590881 - DNA, 25 bp, Mus musculus
ggaccacatacggatcttccaagag

SEQ ID NO: 590882 - DNA, 25 bp, Mus musculus
ggaccacatagtcagcctgcttcaa

SEQ ID NO: 590883 - DNA, 25 bp, Mus musculus
ggaccacatagtgagcctgcttcaa

SEQ ID NO: 590884 - DNA, 25 bp, Mus musculus
ggaccacatcaaacgtcatttgctg

SEQ ID NO: 590885 - DNA, 25 bp, Mus musculus
ggaccacatcaatcgtcatttgctg

SEQ ID NO: 590886 - DNA, 25 bp, Mus musculus
ggaccacatcatcgaggtgcttgtt

SEQ ID NO: 590887 - DNA, 25 bp, Mus musculus
ggaccacatcatggaggtgcttgtt

SEQ ID NO: 590888 - DNA, 25 bp, Mus musculus
ggaccacattcgacaaggcgacctg

SEQ ID NO: 590889 - DNA, 25 bp, Mus musculus
ggaccacattcgtcaaggcgacctg

SEQ ID NO: 590890 - DNA, 25 bp, Mus musculus
ggaccaccagcccagtaatggcatt

SEQ ID NO: 590891 - DNA, 25 bp, Mus musculus
ggaccaccagccgagtaatggcatt

SEQ ID NO: 590892 - DNA, 25 bp, Mus musculus
ggaccaccagtgacattgccaagga

SEQ ID NO: 590893 - DNA, 25 bp, Mus musculus
ggaccaccagtgtcattgccaagga

SEQ ID NO: 590894 - DNA, 25 bp, Mus musculus
ggaccaccatgacgactcaattgtg

SEQ ID NO: 590895 - DNA, 25 bp, Mus musculus
ggaccaccatgaggactcaattgtg

SEQ ID NO: 590896 - DNA, 25 bp, Mus musculus
ggaccacctgagaaacttacccttg

SEQ ID NO: 590897 - DNA, 25 bp, Mus musculus
ggaccacctgagtaacttacccttg

SEQ ID NO: 590898 - DNA, 25 bp, Mus musculus
ggaccacctgccagtgttgatggat

SEQ ID NO: 590899 - DNA, 25 bp, Mus musculus
ggaccacctgcctgtgttgatggat

SEQ ID NO: 590900 - DNA, 25 bp, Mus musculus
ggaccacctggactattcaacaaat

SEQ ID NO: 590901 - DNA, 25 bp, Mus musculus
ggaccacctggagtattcaacaaat

SEQ ID NO: 590902 - DNA, 25 bp, Mus musculus
ggaccaccttcacgttcagcaaagt

SEQ ID NO: 590903 - DNA, 25 bp, Mus musculus
ggaccaccttcaggttcagcaaagt

SEQ ID NO: 590904 - DNA, 25 bp, Mus musculus
ggaccaccttggcaagcttctgtag

SEQ ID NO: 590905 - DNA, 25 bp, Mus musculus
ggaccaccttgggaagcttctgtag

SEQ ID NO: 590906 - DNA, 25 bp, Mus musculus
ggaccacgagccatctggtcatctt

SEQ ID NO: 590907 - DNA, 25 bp, Mus musculus
ggaccacgagccttctggtcatctt

SEQ ID NO: 590908 - DNA, 25 bp, Mus musculus
ggaccacgaggacatttgtttcacc

SEQ ID NO: 590909 - DNA, 25 bp, Mus musculus
ggaccacgaggagatttgtttcacc

SEQ ID NO: 590910 - DNA, 25 bp, Mus musculus
ggaccacgaggcaccatcgaaaggt

SEQ ID NO: 590911 - DNA, 25 bp, Mus musculus
ggaccacgaggctccatcgaaaggt

SEQ ID NO: 590912 - DNA, 25 bp, Mus musculus
ggaccacgcccgaatgaagaccgtg

SEQ ID NO: 590913 - DNA, 25 bp, Mus musculus
ggaccacgcccgtatgaagaccgtg

SEQ ID NO: 590914 - DNA, 25 bp, Mus musculus
ggaccacgcctgaggagcacgcgaa

SEQ ID NO: 590915 - DNA, 25 bp, Mus musculus
ggaccacgcctgtggagcacgcgaa

SEQ ID NO: 590916 - DNA, 25 bp, Mus musculus
ggaccacgggatccaagctttgtaa

SEQ ID NO: 590917 - DNA, 25 bp, Mus musculus
ggaccacgggatgcaagctttgtaa

SEQ ID NO: 590918 - DNA, 25 bp, Mus musculus
ggaccacgggccacctgaaacataa

SEQ ID NO: 590919 - DNA, 25 bp, Mus musculus
ggaccacgggcctcctgaaacataa

SEQ ID NO: 590920 - DNA, 25 bp, Mus musculus
ggaccacggttccatattatctgag

SEQ ID NO: 590921 - DNA, 25 bp, Mus musculus
ggaccacggttcgatattatctgag

SEQ ID NO: 590922 - DNA, 25 bp, Mus musculus
ggaccactacatcgcagctgtctga

SEQ ID NO: 590923 - DNA, 25 bp, Mus musculus
ggaccactacatggcagctgtctga

SEQ ID NO: 590924 - DNA, 25 bp, Mus musculus
ggaccactaccaaagcacatgatac

SEQ ID NO: 590925 - DNA, 25 bp, Mus musculus
ggaccactaccatagcacatgatac

SEQ ID NO: 590926 - DNA, 25 bp, Mus musculus
ggaccactacgacgacttcggagag

SEQ ID NO: 590927 - DNA, 25 bp, Mus musculus
ggaccactacgaggacttcggagag

SEQ ID NO: 590928 - DNA, 25 bp, Mus musculus
ggaccactactacgcggccttctga

SEQ ID NO: 590929 - DNA, 25 bp, Mus musculus
ggaccactactaggcggccttctga

SEQ ID NO: 590930 - DNA, 25 bp, Mus musculus
ggaccactagaacgacagccagtac

SEQ ID NO: 590931 - DNA, 25 bp, Mus musculus
ggaccactagaaggacagccagtac

SEQ ID NO: 590932 - DNA, 25 bp, Mus musculus
ggaccactagacctgataaattaca

SEQ ID NO: 590933 - DNA, 25 bp, Mus musculus
ggaccactagacgtgataaattaca

SEQ ID NO: 590934 - DNA, 25 bp, Mus musculus
ggaccactatatagtgtgtttgcta

SEQ ID NO: 590935 - DNA, 25 bp, Mus musculus
ggaccactatattgtgtgtttgcta

SEQ ID NO: 590936 - DNA, 25 bp, Mus musculus
ggaccactcagcctatgggtagtga

SEQ ID NO: 590937 - DNA, 25 bp, Mus musculus
ggaccactcagcgtatgggtagtga

SEQ ID NO: 590938 - DNA, 25 bp, Mus musculus
ggaccactcatccacaccgattatt

SEQ ID NO: 590939 - DNA, 25 bp, Mus musculus
ggaccactcatcgacaccgattatt

SEQ ID NO: 590940 - DNA, 25 bp, Mus musculus
ggaccactctatagctagtgtcctc

SEQ ID NO: 590941 - DNA, 25 bp, Mus musculus
ggaccactctattgctagtgtcctc

SEQ ID NO: 590942 - DNA, 25 bp, Mus musculus
ggaccactctccacaataaagatta

SEQ ID NO: 590943 - DNA, 25 bp, Mus musculus
ggaccactctcctcaataaagatta

SEQ ID NO: 590944 - DNA, 25 bp, Mus musculus
ggaccactgaagcatgacggaacat

SEQ ID NO: 590945 - DNA, 25 bp, Mus musculus
ggaccactgaaggatgacggaacat

SEQ ID NO: 590946 - DNA, 25 bp, Mus musculus
ggaccactggacagtgttcatcatc

SEQ ID NO: 590947 - DNA, 25 bp, Mus musculus
ggaccactggactgtgttcatcatc

SEQ ID NO: 590948 - DNA, 25 bp, Mus musculus
ggaccactggctcactagcaactta

SEQ ID NO: 590949 - DNA, 25 bp, Mus musculus
ggaccactggctgactagcaactta

SEQ ID NO: 590950 - DNA, 25 bp, Mus musculus
ggaccacttaaactgtgccttttct

SEQ ID NO: 590951 - DNA, 25 bp, Mus musculus
ggaccacttaaagtgtgccttttct

SEQ ID NO: 590952 - DNA, 25 bp, Mus musculus
ggaccacttcctaattgtttcacaa

SEQ ID NO: 590953 - DNA, 25 bp, Mus musculus
ggaccacttccttattgtttcacaa

SEQ ID NO: 590954 - DNA, 25 bp, Mus musculus
ggaccacttggacatgcctgtagat

SEQ ID NO: 590955 - DNA, 25 bp, Mus musculus
ggaccacttggagatgcctgtagat

SEQ ID NO: 590956 - DNA, 25 bp, Mus musculus
ggaccacttggtcatactgccagta

SEQ ID NO: 590957 - DNA, 25 bp, Mus musculus
ggaccacttggtgatactgccagta

SEQ ID NO: 590958 - DNA, 25 bp, Mus musculus
ggaccactttacatttgggtctgtc

SEQ ID NO: 590959 - DNA, 25 bp, Mus musculus
ggaccactttacttttgggtctgtc

SEQ ID NO: 590960 - DNA, 25 bp, Mus musculus
ggaccacttttcaatctgtgctttc

SEQ ID NO: 590961 - DNA, 25 bp, Mus musculus
ggaccacttttctatctgtgctttc

SEQ ID NO: 590962 - DNA, 25 bp, Mus musculus
ggaccactttttcaagactctcatt

SEQ ID NO: 590963 - DNA, 25 bp, Mus musculus
ggaccactttttgaagactctcatt

SEQ ID NO: 590964 - DNA, 25 bp, Mus musculus
ggaccagaaactacctgtaattgct

SEQ ID NO: 590965 - DNA, 25 bp, Mus musculus
ggaccagaaacttcctgtaattgct

SEQ ID NO: 590966 - DNA, 25 bp, Mus musculus
ggaccagaaattactaagcccacac

SEQ ID NO: 590967 - DNA, 25 bp, Mus musculus
ggaccagaaattcctcatgggcagg

SEQ ID NO: 590968 - DNA, 25 bp, Mus musculus
ggaccagaaattgctcatgggcagg

SEQ ID NO: 590969 - DNA, 25 bp, Mus musculus
ggaccagaaatttctaagcccacac

SEQ ID NO: 590970 - DNA, 25 bp, Mus musculus
ggaccagaaccaacagggacaccag

SEQ ID NO: 590971 - DNA, 25 bp, Mus musculus
ggaccagaaccatcagggacaccag

SEQ ID NO: 590972 - DNA, 25 bp, Mus musculus
ggaccagaatgaacctcttgtgaga

SEQ ID NO: 590973 - DNA, 25 bp, Mus musculus
ggaccagaatgatcctcttgtgaga

SEQ ID NO: 590974 - DNA, 25 bp, Mus musculus
ggaccagacaagaagtcttccctca

SEQ ID NO: 590975 - DNA, 25 bp, Mus musculus
ggaccagacaagtagtcttccctca

SEQ ID NO: 590976 - DNA, 25 bp, Mus musculus
ggaccagacacactatggcctcatt

SEQ ID NO: 590977 - DNA, 25 bp, Mus musculus
ggaccagacacacttaacctcagtt

SEQ ID NO: 590978 - DNA, 25 bp, Mus musculus
ggaccagacacagtatggcctcatt

SEQ ID NO: 590979 - DNA, 25 bp, Mus musculus
ggaccagacacagttaacctcagtt

SEQ ID NO: 590980 - DNA, 25 bp, Mus musculus
ggaccagacagactttgaacaccga

SEQ ID NO: 590981 - DNA, 25 bp, Mus musculus
ggaccagacagagtttgaacaccga

SEQ ID NO: 590982 - DNA, 25 bp, Mus musculus
ggaccagacagtatataaacaattt

SEQ ID NO: 590983 - DNA, 25 bp, Mus musculus
ggaccagacagtttataaacaattt

SEQ ID NO: 590984 - DNA, 25 bp, Mus musculus
ggaccagaccgaaatgagttctgtt

SEQ ID NO: 590985 - DNA, 25 bp, Mus musculus
ggaccagaccgatatgagttctgtt

SEQ ID NO: 590986 - DNA, 25 bp, Mus musculus
ggaccagactcccagatgactcttg

SEQ ID NO: 590987 - DNA, 25 bp, Mus musculus
ggaccagactccgagatgactcttg

SEQ ID NO: 590988 - DNA, 25 bp, Mus musculus
ggaccagactgcagggtgctgtttc

SEQ ID NO: 590989 - DNA, 25 bp, Mus musculus
ggaccagactgctgggtgctgtttc

SEQ ID NO: 590990 - DNA, 25 bp, Mus musculus
ggaccagagcgaaagcatttgccaa

SEQ ID NO: 590991 - DNA, 25 bp, Mus musculus
ggaccagagcgatagcatttgccaa

SEQ ID NO: 590992 - DNA, 25 bp, Mus musculus
ggaccagaggcgatctctttgggaa

SEQ ID NO: 590993 - DNA, 25 bp, Mus musculus
ggaccagaggcgttctctttgggaa

SEQ ID NO: 590994 - DNA, 25 bp, Mus musculus
ggaccagagtctctttgcagccctc

SEQ ID NO: 590995 - DNA, 25 bp, Mus musculus
ggaccagagtctgtttgcagccctc

SEQ ID NO: 590996 - DNA, 25 bp, Mus musculus
ggaccagagtttcagggttatctat

SEQ ID NO: 590997 - DNA, 25 bp, Mus musculus
ggaccagagtttgagggttatctat

SEQ ID NO: 590998 - DNA, 25 bp, Mus musculus
ggaccagatattctcacctgtcctc

SEQ ID NO: 590999 - DNA, 25 bp, Mus musculus
ggaccagatattgtcacctgtcctc

SEQ ID NO: 591000 - DNA, 25 bp, Mus musculus
ggaccagatcctcaataacctaagc

SEQ ID NO: 591001 - DNA, 25 bp, Mus musculus
ggaccagatcctgaataacctaagc

SEQ ID NO: 591002 - DNA, 25 bp, Mus musculus
ggaccagatctaagaagcctaccgc

SEQ ID NO: 591003 - DNA, 25 bp, Mus musculus
ggaccagatctatgaagcctaccgc

SEQ ID NO: 591004 - DNA, 25 bp, Mus musculus
ggaccagattctaacagaagcactg

SEQ ID NO: 591005 - DNA, 25 bp, Mus musculus
ggaccagattcttacagaagcactg

SEQ ID NO: 591006 - DNA, 25 bp, Mus musculus
ggaccagcaacacccatcaatgtga

SEQ ID NO: 591007 - DNA, 25 bp, Mus musculus
ggaccagcaacagccatcaatgtga

SEQ ID NO: 591008 - DNA, 25 bp, Mus musculus
ggaccagcaagacagctcaccgagt

SEQ ID NO: 591009 - DNA, 25 bp, Mus musculus
ggaccagcaagagagctcaccgagt

SEQ ID NO: 591010 - DNA, 25 bp, Mus musculus
ggaccagcaccaaaaggtagtctgt

SEQ ID NO: 591011 - DNA, 25 bp, Mus musculus
ggaccagcaccataaggtagtctgt

SEQ ID NO: 591012 - DNA, 25 bp, Mus musculus
ggaccagcagcacctaagagatcat

SEQ ID NO: 591013 - DNA, 25 bp, Mus musculus
ggaccagcagcagctaagagatcat

SEQ ID NO: 591014 - DNA, 25 bp, Mus musculus
ggaccagcaggacctcatccagcaa

SEQ ID NO: 591015 - DNA, 25 bp, Mus musculus
ggaccagcaggagctcatccagcaa

SEQ ID NO: 591016 - DNA, 25 bp, Mus musculus
ggaccagcagttaccgcagtgaccg

SEQ ID NO: 591017 - DNA, 25 bp, Mus musculus
ggaccagcagtttccgcagtgaccg

SEQ ID NO: 591018 - DNA, 25 bp, Mus musculus
ggaccagcccttagagagaatttat

SEQ ID NO: 591019 - DNA, 25 bp, Mus musculus
ggaccagccctttgagagaatttat

SEQ ID NO: 591020 - DNA, 25 bp, Mus musculus
ggaccagccgacacagactgtggtg

SEQ ID NO: 591021 - DNA, 25 bp, Mus musculus
ggaccagccgactcagactgtggtg

SEQ ID NO: 591022 - DNA, 25 bp, Mus musculus
ggaccagctcagcacaaatcccaaa

SEQ ID NO: 591023 - DNA, 25 bp, Mus musculus
ggaccagctcaggacaaatcccaaa

SEQ ID NO: 591024 - DNA, 25 bp, Mus musculus
ggaccagctccaagtagagaggctg

SEQ ID NO: 591025 - DNA, 25 bp, Mus musculus
ggaccagctccatgtagagaggctg

SEQ ID NO: 591026 - DNA, 25 bp, Mus musculus
ggaccagctgacattccatggagag

SEQ ID NO: 591027 - DNA, 25 bp, Mus musculus
ggaccagctgactttccatggagag

SEQ ID NO: 591028 - DNA, 25 bp, Mus musculus
ggaccagctgctacactacaggaag

SEQ ID NO: 591029 - DNA, 25 bp, Mus musculus
ggaccagctgctatcagtgaacgga

SEQ ID NO: 591030 - DNA, 25 bp, Mus musculus
ggaccagctgcttcactacaggaag

SEQ ID NO: 591031 - DNA, 25 bp, Mus musculus
ggaccagctgctttcagtgaacgga

SEQ ID NO: 591032 - DNA, 25 bp, Mus musculus
ggaccagctggtaggctttgcagat

SEQ ID NO: 591033 - DNA, 25 bp, Mus musculus
ggaccagctggttggctttgcagat

SEQ ID NO: 591034 - DNA, 25 bp, Mus musculus
ggaccagctgtccaggcaaaaagaa

SEQ ID NO: 591035 - DNA, 25 bp, Mus musculus
ggaccagctgtcgaggcaaaaagaa

SEQ ID NO: 591036 - DNA, 25 bp, Mus musculus
ggaccaggaagccaattcctgaccc

SEQ ID NO: 591037 - DNA, 25 bp, Mus musculus
ggaccaggaagcgaattcctgaccc

SEQ ID NO: 591038 - DNA, 25 bp, Mus musculus
ggaccaggaattcagcatcactctt

SEQ ID NO: 591039 - DNA, 25 bp, Mus musculus
ggaccaggaattgagcatcactctt

SEQ ID NO: 591040 - DNA, 25 bp, Mus musculus
ggaccaggacatagcaacaggacaa

SEQ ID NO: 591041 - DNA, 25 bp, Mus musculus
ggaccaggacattgcaacaggacaa

SEQ ID NO: 591042 - DNA, 25 bp, Mus musculus
ggaccaggacctcaagtcctagacg

SEQ ID NO: 591043 - DNA, 25 bp, Mus musculus
ggaccaggacctgaagtcctagacg

SEQ ID NO: 591044 - DNA, 25 bp, Mus musculus
ggaccaggacggcttctaaaggaca

SEQ ID NO: 591045 - DNA, 25 bp, Mus musculus
ggaccaggacgggttctaaaggaca

SEQ ID NO: 591046 - DNA, 25 bp, Mus musculus
ggaccaggactcagtagggtttcat

SEQ ID NO: 591047 - DNA, 25 bp, Mus musculus
ggaccaggactctgtagggtttcat

SEQ ID NO: 591048 - DNA, 25 bp, Mus musculus
ggaccaggaggtcgccacaaagtct

SEQ ID NO: 591049 - DNA, 25 bp, Mus musculus
ggaccaggaggtggccacaaagtct

SEQ ID NO: 591050 - DNA, 25 bp, Mus musculus
ggaccaggagtccatatctgtatct

SEQ ID NO: 591051 - DNA, 25 bp, Mus musculus
ggaccaggagtcgatatctgtatct

SEQ ID NO: 591052 - DNA, 25 bp, Mus musculus
ggaccaggatgacttgtcctccctt

SEQ ID NO: 591053 - DNA, 25 bp, Mus musculus
ggaccaggatgagttgtcctccctt

SEQ ID NO: 591054 - DNA, 25 bp, Mus musculus
ggaccaggattcaattcctacctcc

SEQ ID NO: 591055 - DNA, 25 bp, Mus musculus
ggaccaggattctattcctacctcc

SEQ ID NO: 591056 - DNA, 25 bp, Mus musculus
ggaccaggcacaagtttatgtgata

SEQ ID NO: 591057 - DNA, 25 bp, Mus musculus
ggaccaggcacatgtttatgtgata

SEQ ID NO: 591058 - DNA, 25 bp, Mus musculus
ggaccaggcacgacagctctctgag

SEQ ID NO: 591059 - DNA, 25 bp, Mus musculus
ggaccaggcacgtcagctctctgag

SEQ ID NO: 591060 - DNA, 25 bp, Mus musculus
ggaccaggccctagataccctgtat

SEQ ID NO: 591061 - DNA, 25 bp, Mus musculus
ggaccaggcccttgataccctgtat

SEQ ID NO: 591062 - DNA, 25 bp, Mus musculus
ggaccaggctctcactgggtgtaat

SEQ ID NO: 591063 - DNA, 25 bp, Mus musculus
ggaccaggctctgactgggtgtaat

SEQ ID NO: 591064 - DNA, 25 bp, Mus musculus
ggaccaggctgcagactttgagagc

SEQ ID NO: 591065 - DNA, 25 bp, Mus musculus
ggaccaggctgctgactttgagagc

SEQ ID NO: 591066 - DNA, 25 bp, Mus musculus
ggaccagggaacctatttcatagta

SEQ ID NO: 591067 - DNA, 25 bp, Mus musculus
ggaccagggaacgtatttcatagta

SEQ ID NO: 591068 - DNA, 25 bp, Mus musculus
ggaccagggcgcaatgaccgaccag

SEQ ID NO: 591069 - DNA, 25 bp, Mus musculus
ggaccagggcgctatgaccgaccag

SEQ ID NO: 591070 - DNA, 25 bp, Mus musculus
ggaccaggggctccagatcatccat

SEQ ID NO: 591071 - DNA, 25 bp, Mus musculus
ggaccaggggctgcagatcatccat

SEQ ID NO: 591072 - DNA, 25 bp, Mus musculus
ggaccagggttacgaacacagctca

SEQ ID NO: 591073 - DNA, 25 bp, Mus musculus
ggaccagggttaggaacacagctca

SEQ ID NO: 591074 - DNA, 25 bp, Mus musculus
ggaccagggttcacatcattggata

SEQ ID NO: 591075 - DNA, 25 bp, Mus musculus
ggaccagggttctcatcattggata

SEQ ID NO: 591076 - DNA, 25 bp, Mus musculus
ggaccaggtaggcagatactcaata

SEQ ID NO: 591077 - DNA, 25 bp, Mus musculus
ggaccaggtagggagatactcaata

SEQ ID NO: 591078 - DNA, 25 bp, Mus musculus
ggaccaggtctgatttcgaaaagaa

SEQ ID NO: 591079 - DNA, 25 bp, Mus musculus
ggaccaggtctgttttcgaaaagaa

SEQ ID NO: 591080 - DNA, 25 bp, Mus musculus
ggaccaggtcttcttatgcagtgac

SEQ ID NO: 591081 - DNA, 25 bp, Mus musculus
ggaccaggtcttgttatgcagtgac

SEQ ID NO: 591082 - DNA, 25 bp, Mus musculus
ggaccaggtgtcatttggaaccaca

SEQ ID NO: 591083 - DNA, 25 bp, Mus musculus
ggaccaggtgtcttttggaaccaca

SEQ ID NO: 591084 - DNA, 25 bp, Mus musculus
ggaccagtacaacttgttgcaggac

SEQ ID NO: 591085 - DNA, 25 bp, Mus musculus
ggaccagtacaagttgttgcaggac

SEQ ID NO: 591086 - DNA, 25 bp, Mus musculus
ggaccagtactcactcactaagcta

SEQ ID NO: 591087 - DNA, 25 bp, Mus musculus
ggaccagtactctctcactaagcta

SEQ ID NO: 591088 - DNA, 25 bp, Mus musculus
ggaccagtatctactaacgggacct

SEQ ID NO: 591089 - DNA, 25 bp, Mus musculus
ggaccagtatcttctaacgggacct

SEQ ID NO: 591090 - DNA, 25 bp, Mus musculus
ggaccagtattgcaattctgtagag

SEQ ID NO: 591091 - DNA, 25 bp, Mus musculus
ggaccagtattggaattctgtagag

SEQ ID NO: 591092 - DNA, 25 bp, Mus musculus
ggaccagtcagacagacaggatcat

SEQ ID NO: 591093 - DNA, 25 bp, Mus musculus
ggaccagtcagagagacaggatcat

SEQ ID NO: 591094 - DNA, 25 bp, Mus musculus
ggaccagtcagcattgtgacatcct

SEQ ID NO: 591095 - DNA, 25 bp, Mus musculus
ggaccagtcagctttgtgacatcct

SEQ ID NO: 591096 - DNA, 25 bp, Mus musculus
ggaccagtcataatgggctgcttac

SEQ ID NO: 591097 - DNA, 25 bp, Mus musculus
ggaccagtcatattgggctgcttac

SEQ ID NO: 591098 - DNA, 25 bp, Mus musculus
ggaccagtcgataactgtcccactt

SEQ ID NO: 591099 - DNA, 25 bp, Mus musculus
ggaccagtcgattactgtcccactt

SEQ ID NO: 591100 - DNA, 25 bp, Mus musculus
ggaccagtgaacatagaaactaaag

SEQ ID NO: 591101 - DNA, 25 bp, Mus musculus
ggaccagtgaacttagaaactaaag

SEQ ID NO: 591102 - DNA, 25 bp, Mus musculus
ggaccagtgacccaatgcaggctac

SEQ ID NO: 591103 - DNA, 25 bp, Mus musculus
ggaccagtgaccgaatgcaggctac

SEQ ID NO: 591104 - DNA, 25 bp, Mus musculus
ggaccagtgactctgttgattgaat

SEQ ID NO: 591105 - DNA, 25 bp, Mus musculus
ggaccagtgactgtgttgattgaat

SEQ ID NO: 591106 - DNA, 25 bp, Mus musculus
ggaccagtgagaactctcattctca

SEQ ID NO: 591107 - DNA, 25 bp, Mus musculus
ggaccagtgagaagccttagcaggt

SEQ ID NO: 591108 - DNA, 25 bp, Mus musculus
ggaccagtgagatctctcattctca

SEQ ID NO: 591109 - DNA, 25 bp, Mus musculus
ggaccagtgagatgccttagcaggt

SEQ ID NO: 591110 - DNA, 25 bp, Mus musculus
ggaccagtgccgcactttctcctgg

SEQ ID NO: 591111 - DNA, 25 bp, Mus musculus
ggaccagtgccggactttctcctgg

SEQ ID NO: 591112 - DNA, 25 bp, Mus musculus
ggaccagtggagatctcacaacagt

SEQ ID NO: 591113 - DNA, 25 bp, Mus musculus
ggaccagtggagttctcacaacagt

SEQ ID NO: 591114 - DNA, 25 bp, Mus musculus
ggaccagtggcaattctgccctaga

SEQ ID NO: 591115 - DNA, 25 bp, Mus musculus
ggaccagtggcactagctgcctcag

SEQ ID NO: 591116 - DNA, 25 bp, Mus musculus
ggaccagtggcagtagctgcctcag

SEQ ID NO: 591117 - DNA, 25 bp, Mus musculus
ggaccagtggcatttctgccctaga

SEQ ID NO: 591118 - DNA, 25 bp, Mus musculus
ggaccagtgtctcctactctggata

SEQ ID NO: 591119 - DNA, 25 bp, Mus musculus
ggaccagtgtctgctactctggata

SEQ ID NO: 591120 - DNA, 25 bp, Mus musculus
ggaccagtgtgtccttattttcaga

SEQ ID NO: 591121 - DNA, 25 bp, Mus musculus
ggaccagtgtgtgcttattttcaga

SEQ ID NO: 591122 - DNA, 25 bp, Mus musculus
ggaccagttactcccttggagccag

SEQ ID NO: 591123 - DNA, 25 bp, Mus musculus
ggaccagttactgccttggagccag

SEQ ID NO: 591124 - DNA, 25 bp, Mus musculus
ggaccagttcaacccataatgcaag

SEQ ID NO: 591125 - DNA, 25 bp, Mus musculus
ggaccagttcaacgtgcctcgggac

SEQ ID NO: 591126 - DNA, 25 bp, Mus musculus
ggaccagttcaagccataatgcaag

SEQ ID NO: 591127 - DNA, 25 bp, Mus musculus
ggaccagttcaaggtgcctcgggac

SEQ ID NO: 591128 - DNA, 25 bp, Mus musculus
ggaccagttggtccttctctggaca

SEQ ID NO: 591129 - DNA, 25 bp, Mus musculus
ggaccagttggtgcttctctggaca

SEQ ID NO: 591130 - DNA, 25 bp, Mus musculus
ggaccagttgtacacagcagcctat

SEQ ID NO: 591131 - DNA, 25 bp, Mus musculus
ggaccagttgtagacagcagcctat

SEQ ID NO: 591132 - DNA, 25 bp, Mus musculus
ggaccagttgtgctgctagtgcaac

SEQ ID NO: 591133 - DNA, 25 bp, Mus musculus
ggaccagttgtggtgctagtgcaac

SEQ ID NO: 591134 - DNA, 25 bp, Mus musculus
ggaccagtttagactggactctacc

SEQ ID NO: 591135 - DNA, 25 bp, Mus musculus
ggaccagtttagtctggactctacc

SEQ ID NO: 591136 - DNA, 25 bp, Mus musculus
ggaccagttttcattgctagcagaa

SEQ ID NO: 591137 - DNA, 25 bp, Mus musculus
ggaccagttttctttgctagcagaa

SEQ ID NO: 591138 - DNA, 25 bp, Mus musculus
ggaccataaccgactcctactaaca

SEQ ID NO: 591139 - DNA, 25 bp, Mus musculus
ggaccataaccgtctcctactaaca

SEQ ID NO: 591140 - DNA, 25 bp, Mus musculus
ggaccatacatgactttttaagaag

SEQ ID NO: 591141 - DNA, 25 bp, Mus musculus
ggaccatacatgtctttttaagaag

SEQ ID NO: 591142 - DNA, 25 bp, Mus musculus
ggaccatactgtatgattacttgtt

SEQ ID NO: 591143 - DNA, 25 bp, Mus musculus
ggaccatactgtttgattacttgtt

SEQ ID NO: 591144 - DNA, 25 bp, Mus musculus
ggaccataggagatctgttttatgt

SEQ ID NO: 591145 - DNA, 25 bp, Mus musculus
ggaccataggagttctgttttatgt

SEQ ID NO: 591146 - DNA, 25 bp, Mus musculus
ggaccataggatacatgatttctga

SEQ ID NO: 591147 - DNA, 25 bp, Mus musculus
ggaccataggattcatgatttctga

SEQ ID NO: 591148 - DNA, 25 bp, Mus musculus
ggaccataggctcaaccacttcaga

SEQ ID NO: 591149 - DNA, 25 bp, Mus musculus
ggaccataggctgaaccacttcaga

SEQ ID NO: 591150 - DNA, 25 bp, Mus musculus
ggaccatagtctctgtttaccctgt

SEQ ID NO: 591151 - DNA, 25 bp, Mus musculus
ggaccatagtctgtgtttaccctgt

SEQ ID NO: 591152 - DNA, 25 bp, Mus musculus
ggaccatatctcactggctgacttg

SEQ ID NO: 591153 - DNA, 25 bp, Mus musculus
ggaccatatctctctggctgacttg

SEQ ID NO: 591154 - DNA, 25 bp, Mus musculus
ggaccatatgccattgacagacatt

SEQ ID NO: 591155 - DNA, 25 bp, Mus musculus
ggaccatatgcctttgacagacatt

SEQ ID NO: 591156 - DNA, 25 bp, Mus musculus
ggaccatcaatactttctgccttca

SEQ ID NO: 591157 - DNA, 25 bp, Mus musculus
ggaccatcaatagtttctgccttca

SEQ ID NO: 591158 - DNA, 25 bp, Mus musculus
ggaccatcaatgactaatgaactga

SEQ ID NO: 591159 - DNA, 25 bp, Mus musculus
ggaccatcaatgcaacccacaattc

SEQ ID NO: 591160 - DNA, 25 bp, Mus musculus
ggaccatcaatggaacccacaattc

SEQ ID NO: 591161 - DNA, 25 bp, Mus musculus
ggaccatcaatgtctaatgaactga

SEQ ID NO: 591162 - DNA, 25 bp, Mus musculus
ggaccatcactgcacctggtcatga

SEQ ID NO: 591163 - DNA, 25 bp, Mus musculus
ggaccatcactggacctggtcatga

SEQ ID NO: 591164 - DNA, 25 bp, Mus musculus
ggaccatcagaacatttcttcaaat

SEQ ID NO: 591165 - DNA, 25 bp, Mus musculus
ggaccatcagaagatttcttcaaat

SEQ ID NO: 591166 - DNA, 25 bp, Mus musculus
ggaccatcagttagggagccttagc

SEQ ID NO: 591167 - DNA, 25 bp, Mus musculus
ggaccatcagtttgggagccttagc

SEQ ID NO: 591168 - DNA, 25 bp, Mus musculus
ggaccatcatcaactcagttttaca

SEQ ID NO: 591169 - DNA, 25 bp, Mus musculus
ggaccatcatcatctcagttttaca

SEQ ID NO: 591170 - DNA, 25 bp, Mus musculus
ggaccatcatccatactctatgaga

SEQ ID NO: 591171 - DNA, 25 bp, Mus musculus
ggaccatcatccttactctatgaga

SEQ ID NO: 591172 - DNA, 25 bp, Mus musculus
ggaccatccaagcaccaactattaa

SEQ ID NO: 591173 - DNA, 25 bp, Mus musculus
ggaccatccaaggaccaactattaa

SEQ ID NO: 591174 - DNA, 25 bp, Mus musculus
ggaccatccatgagacgagtactat

SEQ ID NO: 591175 - DNA, 25 bp, Mus musculus
ggaccatccatgtgacgagtactat

SEQ ID NO: 591176 - DNA, 25 bp, Mus musculus
ggaccatccctgaagcagtttggaa

SEQ ID NO: 591177 - DNA, 25 bp, Mus musculus
ggaccatccctgtagcagtttggaa

SEQ ID NO: 591178 - DNA, 25 bp, Mus musculus
ggaccatccggtctgcaaaagctga

SEQ ID NO: 591179 - DNA, 25 bp, Mus musculus
ggaccatccggtgtgcaaaagctga

SEQ ID NO: 591180 - DNA, 25 bp, Mus musculus
ggaccatcctgtagttaaaaccatt

SEQ ID NO: 591181 - DNA, 25 bp, Mus musculus
ggaccatcctgtatcagttctcccg

SEQ ID NO: 591182 - DNA, 25 bp, Mus musculus
ggaccatcctgttgttaaaaccatt

SEQ ID NO: 591183 - DNA, 25 bp, Mus musculus
ggaccatcctgtttcagttctcccg

SEQ ID NO: 591184 - DNA, 25 bp, Mus musculus
ggaccatcgaatccactcagaccat

SEQ ID NO: 591185 - DNA, 25 bp, Mus musculus
ggaccatcgaatgcactcagaccat

SEQ ID NO: 591186 - DNA, 25 bp, Mus musculus
ggaccatcgagtcatcctgggagat

SEQ ID NO: 591187 - DNA, 25 bp, Mus musculus
ggaccatcgagtgatcctgggagat

SEQ ID NO: 591188 - DNA, 25 bp, Mus musculus
ggaccatctattcgaaaccccaaag

SEQ ID NO: 591189 - DNA, 25 bp, Mus musculus
ggaccatctattggaaaccccaaag

SEQ ID NO: 591190 - DNA, 25 bp, Mus musculus
ggaccatctccgcttagctcagtga

SEQ ID NO: 591191 - DNA, 25 bp, Mus musculus
ggaccatctccggttagctcagtga

SEQ ID NO: 591192 - DNA, 25 bp, Mus musculus
ggaccatcttgcatctaatcttttt

SEQ ID NO: 591193 - DNA, 25 bp, Mus musculus
ggaccatcttgcttctaatcttttt

SEQ ID NO: 591194 - DNA, 25 bp, Mus musculus
ggaccatctttcaacatttaggcat

SEQ ID NO: 591195 - DNA, 25 bp, Mus musculus
ggaccatctttctacatttaggcat

SEQ ID NO: 591196 - DNA, 25 bp, Mus musculus
ggaccatgaaggatcttttagcaca

SEQ ID NO: 591197 - DNA, 25 bp, Mus musculus
ggaccatgaaggcatctgctgtata

SEQ ID NO: 591198 - DNA, 25 bp, Mus musculus
ggaccatgaagggatctgctgtata

SEQ ID NO: 591199 - DNA, 25 bp, Mus musculus
ggaccatgaaggttcttttagcaca

SEQ ID NO: 591200 - DNA, 25 bp, Mus musculus
ggaccatgacacactaggagctgga

SEQ ID NO: 591201 - DNA, 25 bp, Mus musculus
ggaccatgacactctaggagctgga

SEQ ID NO: 591202 - DNA, 25 bp, Mus musculus
ggaccatgaccaacgtaacgcggag

SEQ ID NO: 591203 - DNA, 25 bp, Mus musculus
ggaccatgaccatcgtaacgcggag

SEQ ID NO: 591204 - DNA, 25 bp, Mus musculus
ggaccatgactacctctgagcttat

SEQ ID NO: 591205 - DNA, 25 bp, Mus musculus
ggaccatgactagctctgagcttat

SEQ ID NO: 591206 - DNA, 25 bp, Mus musculus
ggaccatgactgagagcggcgcctc

SEQ ID NO: 591207 - DNA, 25 bp, Mus musculus
ggaccatgactgtgagcggcgcctc

SEQ ID NO: 591208 - DNA, 25 bp, Mus musculus
ggaccatgatcgctagtgaagcccc

SEQ ID NO: 591209 - DNA, 25 bp, Mus musculus
ggaccatgatcggtagtgaagcccc

SEQ ID NO: 591210 - DNA, 25 bp, Mus musculus
ggaccatgattactgcagccctgag

SEQ ID NO: 591211 - DNA, 25 bp, Mus musculus
ggaccatgattagtgcagccctgag

SEQ ID NO: 591212 - DNA, 25 bp, Mus musculus
ggaccatgattcaagtgtttgctga

SEQ ID NO: 591213 - DNA, 25 bp, Mus musculus
ggaccatgattctagtgtttgctga

SEQ ID NO: 591214 - DNA, 25 bp, Mus musculus
ggaccatgcaatattggtttgcttt

SEQ ID NO: 591215 - DNA, 25 bp, Mus musculus
ggaccatgcaattttggtttgcttt

SEQ ID NO: 591216 - DNA, 25 bp, Mus musculus
ggaccatgcaggcattttatctcaa

SEQ ID NO: 591217 - DNA, 25 bp, Mus musculus
ggaccatgcagggattttatctcaa

SEQ ID NO: 591218 - DNA, 25 bp, Mus musculus
ggaccatgcatgatactaagtttaa

SEQ ID NO: 591219 - DNA, 25 bp, Mus musculus
ggaccatgcatgttactaagtttaa

SEQ ID NO: 591220 - DNA, 25 bp, Mus musculus
ggaccatgctacatattcagctgga

SEQ ID NO: 591221 - DNA, 25 bp, Mus musculus
ggaccatgctacttattcagctgga

SEQ ID NO: 591222 - DNA, 25 bp, Mus musculus
ggaccatgctggagctactgaacca

SEQ ID NO: 591223 - DNA, 25 bp, Mus musculus
ggaccatgctggtgctactgaacca

SEQ ID NO: 591224 - DNA, 25 bp, Mus musculus
ggaccatggaccactgttcattgac

SEQ ID NO: 591225 - DNA, 25 bp, Mus musculus
ggaccatggacctctgttcattgac

SEQ ID NO: 591226 - DNA, 25 bp, Mus musculus
ggaccatggcaaaacccttgtggct

SEQ ID NO: 591227 - DNA, 25 bp, Mus musculus
ggaccatggcaatacccttgtggct

SEQ ID NO: 591228 - DNA, 25 bp, Mus musculus
ggaccatggtacagtatctcacgat

SEQ ID NO: 591229 - DNA, 25 bp, Mus musculus
ggaccatggtactgtatctcacgat

SEQ ID NO: 591230 - DNA, 25 bp, Mus musculus
ggaccatggtcacctttagagcccc

SEQ ID NO: 591231 - DNA, 25 bp, Mus musculus
ggaccatggtcagctttagagcccc

SEQ ID NO: 591232 - DNA, 25 bp, Mus musculus
ggaccatggtccagatcactaacca

SEQ ID NO: 591233 - DNA, 25 bp, Mus musculus
ggaccatggtcctgatcactaacca

SEQ ID NO: 591234 - DNA, 25 bp, Mus musculus
ggaccatgtgtcacacgaacgtggg

SEQ ID NO: 591235 - DNA, 25 bp, Mus musculus
ggaccatgtgtctcacgaacgtggg

SEQ ID NO: 591236 - DNA, 25 bp, Mus musculus
ggaccatgtgttccatattcttgag

SEQ ID NO: 591237 - DNA, 25 bp, Mus musculus
ggaccatgtgttgcatattcttgag

SEQ ID NO: 591238 - DNA, 25 bp, Mus musculus
ggaccatgttctacatgctgcacat

SEQ ID NO: 591239 - DNA, 25 bp, Mus musculus
ggaccatgttcttcatgctgcacat

SEQ ID NO: 591240 - DNA, 25 bp, Mus musculus
ggaccattaactcgcctatgcaagc

SEQ ID NO: 591241 - DNA, 25 bp, Mus musculus
ggaccattaactggcctatgcaagc

SEQ ID NO: 591242 - DNA, 25 bp, Mus musculus
ggaccattacttacaactgcacgtt

SEQ ID NO: 591243 - DNA, 25 bp, Mus musculus
ggaccattactttcaactgcacgtt

SEQ ID NO: 591244 - DNA, 25 bp, Mus musculus
ggaccattagaaacttctggcagat

SEQ ID NO: 591245 - DNA, 25 bp, Mus musculus
ggaccattagaatcttctggcagat

SEQ ID NO: 591246 - DNA, 25 bp, Mus musculus
ggaccattagcaaccatgttttacc

SEQ ID NO: 591247 - DNA, 25 bp, Mus musculus
ggaccattagcatccatgttttacc

SEQ ID NO: 591248 - DNA, 25 bp, Mus musculus
ggaccattattcaatttgccctact

SEQ ID NO: 591249 - DNA, 25 bp, Mus musculus
ggaccattattctatttgccctact

SEQ ID NO: 591250 - DNA, 25 bp, Mus musculus
ggaccattattgagtctaagggaag

SEQ ID NO: 591251 - DNA, 25 bp, Mus musculus
ggaccattattgtgtctaagggaag

SEQ ID NO: 591252 - DNA, 25 bp, Mus musculus
ggaccattcaggaccacaggggaga

SEQ ID NO: 591253 - DNA, 25 bp, Mus musculus
ggaccattcaggtccacaggggaga

SEQ ID NO: 591254 - DNA, 25 bp, Mus musculus
ggaccattcattccttggcattaat

SEQ ID NO: 591255 - DNA, 25 bp, Mus musculus
ggaccattcattgcttggcattaat

SEQ ID NO: 591256 - DNA, 25 bp, Mus musculus
ggaccattcccccaatatgaagaga

SEQ ID NO: 591257 - DNA, 25 bp, Mus musculus
ggaccattccccgaatatgaagaga

SEQ ID NO: 591258 - DNA, 25 bp, Mus musculus
ggaccattccctctgcaggcagttg

SEQ ID NO: 591259 - DNA, 25 bp, Mus musculus
ggaccattccctgtgcaggcagttg

SEQ ID NO: 591260 - DNA, 25 bp, Mus musculus
ggaccattctaccaaaccatcttcg

SEQ ID NO: 591261 - DNA, 25 bp, Mus musculus
ggaccattctacgaaaccatcttcg

SEQ ID NO: 591262 - DNA, 25 bp, Mus musculus
ggaccattctctaaactggactcta

SEQ ID NO: 591263 - DNA, 25 bp, Mus musculus
ggaccattctctctggaagctgacc

SEQ ID NO: 591264 - DNA, 25 bp, Mus musculus
ggaccattctctgtggaagctgacc

SEQ ID NO: 591265 - DNA, 25 bp, Mus musculus
ggaccattctcttaactggactcta

SEQ ID NO: 591266 - DNA, 25 bp, Mus musculus
ggaccattgagcagacgggaattat

SEQ ID NO: 591267 - DNA, 25 bp, Mus musculus
ggaccattgagctgacgggaattat

SEQ ID NO: 591268 - DNA, 25 bp, Mus musculus
ggaccattgggtatatgtagtaaat

SEQ ID NO: 591269 - DNA, 25 bp, Mus musculus
ggaccattgggtttatgtagtaaat

SEQ ID NO: 591270 - DNA, 25 bp, Mus musculus
ggaccatttgcactctgggtcagta

SEQ ID NO: 591271 - DNA, 25 bp, Mus musculus
ggaccatttgcagtctgggtcagta

SEQ ID NO: 591272 - DNA, 25 bp, Mus musculus
ggaccatttgctcacgctagctagg

SEQ ID NO: 591273 - DNA, 25 bp, Mus musculus
ggaccatttgctcgactgtgggaaa

SEQ ID NO: 591274 - DNA, 25 bp, Mus musculus
ggaccatttgctcttcccattcata

SEQ ID NO: 591275 - DNA, 25 bp, Mus musculus
ggaccatttgctgacgctagctagg

SEQ ID NO: 591276 - DNA, 25 bp, Mus musculus
ggaccatttgctggactgtgggaaa

SEQ ID NO: 591277 - DNA, 25 bp, Mus musculus
ggaccatttgctgttcccattcata

SEQ ID NO: 591278 - DNA, 25 bp, Mus musculus
ggaccatttgttaaatcccacagct

SEQ ID NO: 591279 - DNA, 25 bp, Mus musculus
ggaccatttgtttaatcccacagct

SEQ ID NO: 591280 - DNA, 25 bp, Mus musculus
ggaccattttagctatgttcaattg

SEQ ID NO: 591281 - DNA, 25 bp, Mus musculus
ggaccattttaggtatgttcaattg

SEQ ID NO: 591282 - DNA, 25 bp, Mus musculus
ggaccattttgtcatggctcccatg

SEQ ID NO: 591283 - DNA, 25 bp, Mus musculus
ggaccattttgtgatggctcccatg

SEQ ID NO: 591284 - DNA, 25 bp, Mus musculus
ggaccatttttgccattccgacagt

SEQ ID NO: 591285 - DNA, 25 bp, Mus musculus
ggaccatttttggcattccgacagt

SEQ ID NO: 591286 - DNA, 25 bp, Mus musculus
ggacccaaaacaagtaacatggaat

SEQ ID NO: 591287 - DNA, 25 bp, Mus musculus
ggacccaaaacatgtaacatggaat

SEQ ID NO: 591288 - DNA, 25 bp, Mus musculus
ggacccaaaactcaaacgtcacaag

SEQ ID NO: 591289 - DNA, 25 bp, Mus musculus
ggacccaaaactgaaacgtcacaag

SEQ ID NO: 591290 - DNA, 25 bp, Mus musculus
ggacccaaagcaatattaaacacat

SEQ ID NO: 591291 - DNA, 25 bp, Mus musculus
ggacccaaagcattattaaacacat

SEQ ID NO: 591292 - DNA, 25 bp, Mus musculus
ggacccaaataacctcctatgtcta

SEQ ID NO: 591293 - DNA, 25 bp, Mus musculus
ggacccaaataagctcctatgtcta

SEQ ID NO: 591294 - DNA, 25 bp, Mus musculus
ggacccaaattcagaacttaatggt

SEQ ID NO: 591295 - DNA, 25 bp, Mus musculus
ggacccaaattctgaacttaatggt

SEQ ID NO: 591296 - DNA, 25 bp, Mus musculus
ggacccaacaaaacttctgctggct

SEQ ID NO: 591297 - DNA, 25 bp, Mus musculus
ggacccaacaaatcttctgctggct

SEQ ID NO: 591298 - DNA, 25 bp, Mus musculus
ggacccaacaatcgctattctagct

SEQ ID NO: 591299 - DNA, 25 bp, Mus musculus
ggacccaacaatggctattctagct

SEQ ID NO: 591300 - DNA, 25 bp, Mus musculus
ggacccaacattctacaccagagat

SEQ ID NO: 591301 - DNA, 25 bp, Mus musculus
ggacccaacattgtacaccagagat

SEQ ID NO: 591302 - DNA, 25 bp, Mus musculus
ggacccaacgagatcgctgaattct

SEQ ID NO: 591303 - DNA, 25 bp, Mus musculus
ggacccaacgagttcgctgaattct

SEQ ID NO: 591304 - DNA, 25 bp, Mus musculus
ggacccaactccactgtgaagtagg

SEQ ID NO: 591305 - DNA, 25 bp, Mus musculus
ggacccaactcctctgtgaagtagg

SEQ ID NO: 591306 - DNA, 25 bp, Mus musculus
ggacccaagactctggaccctggcc

SEQ ID NO: 591307 - DNA, 25 bp, Mus musculus
ggacccaagactgtggaccctggcc

SEQ ID NO: 591308 - DNA, 25 bp, Mus musculus
ggacccaaggctatacatggctaaa

SEQ ID NO: 591309 - DNA, 25 bp, Mus musculus
ggacccaaggctttacatggctaaa

SEQ ID NO: 591310 - DNA, 25 bp, Mus musculus
ggacccaagtagcttcctggtgctg

SEQ ID NO: 591311 - DNA, 25 bp, Mus musculus
ggacccaagtaggttcctggtgctg

SEQ ID NO: 591312 - DNA, 25 bp, Mus musculus
ggacccaagtatctacactttggtc

SEQ ID NO: 591313 - DNA, 25 bp, Mus musculus
ggacccaagtatgtacactttggtc

SEQ ID NO: 591314 - DNA, 25 bp, Mus musculus
ggacccaagtccagagagttcgaaa

SEQ ID NO: 591315 - DNA, 25 bp, Mus musculus
ggacccaagtcctgagagttcgaaa

SEQ ID NO: 591316 - DNA, 25 bp, Mus musculus
ggacccaataagattcactactgag

SEQ ID NO: 591317 - DNA, 25 bp, Mus musculus
ggacccaataagtttcactactgag

SEQ ID NO: 591318 - DNA, 25 bp, Mus musculus
ggacccacacttaaagcgaacgaag

SEQ ID NO: 591319 - DNA, 25 bp, Mus musculus
ggacccacactttaagcgaacgaag

SEQ ID NO: 591320 - DNA, 25 bp, Mus musculus
ggacccacagtacgacaggagcact

SEQ ID NO: 591321 - DNA, 25 bp, Mus musculus
ggacccacagtaggacaggagcact

SEQ ID NO: 591322 - DNA, 25 bp, Mus musculus
ggacccacatatcccagagacagta

SEQ ID NO: 591323 - DNA, 25 bp, Mus musculus
ggacccacatatgccagagacagta

SEQ ID NO: 591324 - DNA, 25 bp, Mus musculus
ggacccaccaggataaaccaagtga

SEQ ID NO: 591325 - DNA, 25 bp, Mus musculus
ggacccaccaggttaaaccaagtga

SEQ ID NO: 591326 - DNA, 25 bp, Mus musculus
ggacccacccaaaacacagatcatg

SEQ ID NO: 591327 - DNA, 25 bp, Mus musculus
ggacccacccaatacacagatcatg

SEQ ID NO: 591328 - DNA, 25 bp, Mus musculus
ggacccacctagagctctagaggac

SEQ ID NO: 591329 - DNA, 25 bp, Mus musculus
ggacccacctagtgctctagaggac

SEQ ID NO: 591330 - DNA, 25 bp, Mus musculus
ggacccacgcttcgcaaaaatggaa

SEQ ID NO: 591331 - DNA, 25 bp, Mus musculus
ggacccacgcttggcaaaaatggaa

SEQ ID NO: 591332 - DNA, 25 bp, Mus musculus
ggacccacgggcatcctgggatcag

SEQ ID NO: 591333 - DNA, 25 bp, Mus musculus
ggacccacgggcttcctgggatcag

SEQ ID NO: 591334 - DNA, 25 bp, Mus musculus
ggacccactattacgataacatctt

SEQ ID NO: 591335 - DNA, 25 bp, Mus musculus
ggacccactatttcgataacatctt

SEQ ID NO: 591336 - DNA, 25 bp, Mus musculus
ggacccactggaagcgtgcattcaa

SEQ ID NO: 591337 - DNA, 25 bp, Mus musculus
ggacccactggatgcgtgcattcaa

SEQ ID NO: 591338 - DNA, 25 bp, Mus musculus
ggacccactgggatgcatataggtg

SEQ ID NO: 591339 - DNA, 25 bp, Mus musculus
ggacccactgggttgcatataggtg

SEQ ID NO: 591340 - DNA, 25 bp, Mus musculus
ggacccagagagaacaagctcctga

SEQ ID NO: 591341 - DNA, 25 bp, Mus musculus
ggacccagagagtacaagctcctga

SEQ ID NO: 591342 - DNA, 25 bp, Mus musculus
ggacccagagccatgcttattgtaa

SEQ ID NO: 591343 - DNA, 25 bp, Mus musculus
ggacccagagccttgcttattgtaa

SEQ ID NO: 591344 - DNA, 25 bp, Mus musculus
ggacccagattaccaagaaaagtat

SEQ ID NO: 591345 - DNA, 25 bp, Mus musculus
ggacccagattagcaagaaaagtat

SEQ ID NO: 591346 - DNA, 25 bp, Mus musculus
ggacccagatttactttatacccat

SEQ ID NO: 591347 - DNA, 25 bp, Mus musculus
ggacccagatttcgctgcttaccta

SEQ ID NO: 591348 - DNA, 25 bp, Mus musculus
ggacccagatttggctgcttaccta

SEQ ID NO: 591349 - DNA, 25 bp, Mus musculus
ggacccagattttctttatacccat

SEQ ID NO: 591350 - DNA, 25 bp, Mus musculus
ggacccagcaacattctccatggga

SEQ ID NO: 591351 - DNA, 25 bp, Mus musculus
ggacccagcaactttctccatggga

SEQ ID NO: 591352 - DNA, 25 bp, Mus musculus
ggacccagcatcagaagtagttttt

SEQ ID NO: 591353 - DNA, 25 bp, Mus musculus
ggacccagcatctgaagtagttttt

SEQ ID NO: 591354 - DNA, 25 bp, Mus musculus
ggacccagcatgaattctgcaggat

SEQ ID NO: 591355 - DNA, 25 bp, Mus musculus
ggacccagcatgtattctgcaggat

SEQ ID NO: 591356 - DNA, 25 bp, Mus musculus
ggacccagccaacaatgcatttttt

SEQ ID NO: 591357 - DNA, 25 bp, Mus musculus
ggacccagccaagaatgcatttttt

SEQ ID NO: 591358 - DNA, 25 bp, Mus musculus
ggacccagcccgagtagtagtcgtg

SEQ ID NO: 591359 - DNA, 25 bp, Mus musculus
ggacccagcccgtgtagtagtcgtg

SEQ ID NO: 591360 - DNA, 25 bp, Mus musculus
ggacccagctccacttttagagaac

SEQ ID NO: 591361 - DNA, 25 bp, Mus musculus
ggacccagctcctcttttagagaac

SEQ ID NO: 591362 - DNA, 25 bp, Mus musculus
ggacccagctgacccaacagggaat

SEQ ID NO: 591363 - DNA, 25 bp, Mus musculus
ggacccagctgagccaacagggaat

SEQ ID NO: 591364 - DNA, 25 bp, Mus musculus
ggacccaggaccagcgttgtcgctg

SEQ ID NO: 591365 - DNA, 25 bp, Mus musculus
ggacccaggacctgcgttgtcgctg

SEQ ID NO: 591366 - DNA, 25 bp, Mus musculus
ggacccaggctcctatttgtttcct

SEQ ID NO: 591367 - DNA, 25 bp, Mus musculus
ggacccaggctcgtatttgtttcct

SEQ ID NO: 591368 - DNA, 25 bp, Mus musculus
ggacccagggaaacagctcaccaga

SEQ ID NO: 591369 - DNA, 25 bp, Mus musculus
ggacccagggaatcagctcaccaga

SEQ ID NO: 591370 - DNA, 25 bp, Mus musculus
ggacccaggtgccagttcctaagga

SEQ ID NO: 591371 - DNA, 25 bp, Mus musculus
ggacccaggtgcgagttcctaagga

SEQ ID NO: 591372 - DNA, 25 bp, Mus musculus
ggacccaggtgtcccaggtgaaaaa

SEQ ID NO: 591373 - DNA, 25 bp, Mus musculus
ggacccaggtgtgccaggtgaaaaa

SEQ ID NO: 591374 - DNA, 25 bp, Mus musculus
ggacccagtagcaggaagaacagtt

SEQ ID NO: 591375 - DNA, 25 bp, Mus musculus
ggacccagtagctggaagaacagtt

SEQ ID NO: 591376 - DNA, 25 bp, Mus musculus
ggacccagtcccaattctgaagttg

SEQ ID NO: 591377 - DNA, 25 bp, Mus musculus
ggacccagtccctattctgaagttg

SEQ ID NO: 591378 - DNA, 25 bp, Mus musculus
ggacccagttctatttccaagactc

SEQ ID NO: 591379 - DNA, 25 bp, Mus musculus
ggacccagttctttttccaagactc

SEQ ID NO: 591380 - DNA, 25 bp, Mus musculus
ggacccagttgaagcaatacacctg

SEQ ID NO: 591381 - DNA, 25 bp, Mus musculus
ggacccagttgatgcaatacacctg

SEQ ID NO: 591382 - DNA, 25 bp, Mus musculus
ggacccatacaaaatgctacctcca

SEQ ID NO: 591383 - DNA, 25 bp, Mus musculus
ggacccatacaatatgctacctcca

SEQ ID NO: 591384 - DNA, 25 bp, Mus musculus
ggacccatactgcatcccagaggtg

SEQ ID NO: 591385 - DNA, 25 bp, Mus musculus
ggacccatactggatcccagaggtg

SEQ ID NO: 591386 - DNA, 25 bp, Mus musculus
ggacccatagatattttgacagctt

SEQ ID NO: 591387 - DNA, 25 bp, Mus musculus
ggacccatagattttttgacagctt

SEQ ID NO: 591388 - DNA, 25 bp, Mus musculus
ggacccatatttaacaagcccggtg

SEQ ID NO: 591389 - DNA, 25 bp, Mus musculus
ggacccatatttaagctttgtgtgc

SEQ ID NO: 591390 - DNA, 25 bp, Mus musculus
ggacccatattttacaagcccggtg

SEQ ID NO: 591391 - DNA, 25 bp, Mus musculus
ggacccatattttagctttgtgtgc

SEQ ID NO: 591392 - DNA, 25 bp, Mus musculus
ggacccatccataaacccagagttg

SEQ ID NO: 591393 - DNA, 25 bp, Mus musculus
ggacccatccattaacccagagttg

SEQ ID NO: 591394 - DNA, 25 bp, Mus musculus
ggacccatcctgaacttgagccaga

SEQ ID NO: 591395 - DNA, 25 bp, Mus musculus
ggacccatcctgtacttgagccaga

SEQ ID NO: 591396 - DNA, 25 bp, Mus musculus
ggacccatgagcatcctggcaggcc

SEQ ID NO: 591397 - DNA, 25 bp, Mus musculus
ggacccatgagcttcctggcaggcc

SEQ ID NO: 591398 - DNA, 25 bp, Mus musculus
ggacccatgcatattgtgtatcaat

SEQ ID NO: 591399 - DNA, 25 bp, Mus musculus
ggacccatgcattttgtgtatcaat

SEQ ID NO: 591400 - DNA, 25 bp, Mus musculus
ggacccatggttatgacaagccctg

SEQ ID NO: 591401 - DNA, 25 bp, Mus musculus
ggacccatggttttgacaagccctg

SEQ ID NO: 591402 - DNA, 25 bp, Mus musculus
ggacccatgttaatgccccagggca

SEQ ID NO: 591403 - DNA, 25 bp, Mus musculus
ggacccatgttattgccccagggca

SEQ ID NO: 591404 - DNA, 25 bp, Mus musculus
ggacccatgttcaatcccaggtagt

SEQ ID NO: 591405 - DNA, 25 bp, Mus musculus
ggacccatgttctatcccaggtagt

SEQ ID NO: 591406 - DNA, 25 bp, Mus musculus
ggacccattccaccaaggtgttaca

SEQ ID NO: 591407 - DNA, 25 bp, Mus musculus
ggacccattccagcaaggtgttaca

SEQ ID NO: 591408 - DNA, 25 bp, Mus musculus
ggacccattctaccaaaagcctatt

SEQ ID NO: 591409 - DNA, 25 bp, Mus musculus
ggacccattctagcaaaagcctatt

SEQ ID NO: 591410 - DNA, 25 bp, Mus musculus
ggaccccaaaggacattgcgtcaga

SEQ ID NO: 591411 - DNA, 25 bp, Mus musculus
ggaccccaaaggtcattgcgtcaga

SEQ ID NO: 591412 - DNA, 25 bp, Mus musculus
ggaccccaatctctatagacctgat

SEQ ID NO: 591413 - DNA, 25 bp, Mus musculus
ggaccccaatctgtatagacctgat

SEQ ID NO: 591414 - DNA, 25 bp, Mus musculus
ggaccccactcgagtggagacttag

SEQ ID NO: 591415 - DNA, 25 bp, Mus musculus
ggaccccactcgtgtggagacttag

SEQ ID NO: 591416 - DNA, 25 bp, Mus musculus
ggaccccactggagtgtctggctaa

SEQ ID NO: 591417 - DNA, 25 bp, Mus musculus
ggaccccactggtgtgtctggctaa

SEQ ID NO: 591418 - DNA, 25 bp, Mus musculus
ggaccccagagaaccctcagacacc

SEQ ID NO: 591419 - DNA, 25 bp, Mus musculus
ggaccccagagatccctcagacacc

SEQ ID NO: 591420 - DNA, 25 bp, Mus musculus
ggaccccagagcagtgtacagtaga

SEQ ID NO: 591421 - DNA, 25 bp, Mus musculus
ggaccccagagctgtgtacagtaga

SEQ ID NO: 591422 - DNA, 25 bp, Mus musculus
ggaccccagcatctggaaggtaaag

SEQ ID NO: 591423 - DNA, 25 bp, Mus musculus
ggaccccagcatgtggaaggtaaag

SEQ ID NO: 591424 - DNA, 25 bp, Mus musculus
ggaccccagccaaagaataagtgac

SEQ ID NO: 591425 - DNA, 25 bp, Mus musculus
ggaccccagccatagaataagtgac

SEQ ID NO: 591426 - DNA, 25 bp, Mus musculus
ggaccccagcgtcctataccagtat

SEQ ID NO: 591427 - DNA, 25 bp, Mus musculus
ggaccccagcgtgctataccagtat

SEQ ID NO: 591428 - DNA, 25 bp, Mus musculus
ggaccccaggaacgtgtacacacta

SEQ ID NO: 591429 - DNA, 25 bp, Mus musculus
ggaccccaggaaggtgtacacacta

SEQ ID NO: 591430 - DNA, 25 bp, Mus musculus
ggaccccagggaacttttgaagcag

SEQ ID NO: 591431 - DNA, 25 bp, Mus musculus
ggaccccagggatcttttgaagcag

SEQ ID NO: 591432 - DNA, 25 bp, Mus musculus
ggaccccagtaactttccagagtct

SEQ ID NO: 591433 - DNA, 25 bp, Mus musculus
ggaccccagtaagtttccagagtct

SEQ ID NO: 591434 - DNA, 25 bp, Mus musculus
ggaccccagtgaatgtggctaccaa

SEQ ID NO: 591435 - DNA, 25 bp, Mus musculus
ggaccccagtgattgtggctaccaa

SEQ ID NO: 591436 - DNA, 25 bp, Mus musculus
ggaccccataacaaacagcctatat

SEQ ID NO: 591437 - DNA, 25 bp, Mus musculus
ggaccccataactaacagcctatat

SEQ ID NO: 591438 - DNA, 25 bp, Mus musculus
ggaccccatacaagcccaaagaaat

SEQ ID NO: 591439 - DNA, 25 bp, Mus musculus
ggaccccatacatgcccaaagaaat

SEQ ID NO: 591440 - DNA, 25 bp, Mus musculus
ggaccccatatacccttgaaacaga

SEQ ID NO: 591441 - DNA, 25 bp, Mus musculus
ggaccccatatagccttgaaacaga

SEQ ID NO: 591442 - DNA, 25 bp, Mus musculus
ggaccccatgcccagagagaacaaa

SEQ ID NO: 591443 - DNA, 25 bp, Mus musculus
ggaccccatgccgagagagaacaaa

SEQ ID NO: 591444 - DNA, 25 bp, Mus musculus
ggaccccatttcaatatactggtat

SEQ ID NO: 591445 - DNA, 25 bp, Mus musculus
ggaccccatttctatatactggtat

SEQ ID NO: 591446 - DNA, 25 bp, Mus musculus
ggacccccgatgacttgagaggcaa

SEQ ID NO: 591447 - DNA, 25 bp, Mus musculus
ggacccccgatgtcttgagaggcaa

SEQ ID NO: 591448 - DNA, 25 bp, Mus musculus
ggaccccctgggaaagacatgcagt

SEQ ID NO: 591449 - DNA, 25 bp, Mus musculus
ggaccccctgggtaagacatgcagt

SEQ ID NO: 591450 - DNA, 25 bp, Mus musculus
ggaccccgagatacctctaaaagct

SEQ ID NO: 591451 - DNA, 25 bp, Mus musculus
ggaccccgagattcctctaaaagct

SEQ ID NO: 591452 - DNA, 25 bp, Mus musculus
ggaccccgagggacagtcccgatgt

SEQ ID NO: 591453 - DNA, 25 bp, Mus musculus
ggaccccgagggtcagtcccgatgt

SEQ ID NO: 591454 - DNA, 25 bp, Mus musculus
ggaccccgccacacaataaaatagt

SEQ ID NO: 591455 - DNA, 25 bp, Mus musculus
ggaccccgccactcaataaaatagt

SEQ ID NO: 591456 - DNA, 25 bp, Mus musculus
ggaccccgtgttcatggatagccag

SEQ ID NO: 591457 - DNA, 25 bp, Mus musculus
ggaccccgtgttgatggatagccag

SEQ ID NO: 591458 - DNA, 25 bp, Mus musculus
ggacccctctagattctgtaaatat

SEQ ID NO: 591459 - DNA, 25 bp, Mus musculus
ggacccctctagtttctgtaaatat

SEQ ID NO: 591460 - DNA, 25 bp, Mus musculus
ggacccctgagccagtcagcgcaga

SEQ ID NO: 591461 - DNA, 25 bp, Mus musculus
ggacccctgagcgagtcagcgcaga

SEQ ID NO: 591462 - DNA, 25 bp, Mus musculus
ggacccctgagtattggtccagttg

SEQ ID NO: 591463 - DNA, 25 bp, Mus musculus
ggacccctgagttttggtccagttg

SEQ ID NO: 591464 - DNA, 25 bp, Mus musculus
ggacccctgcttacaaaacttacat

SEQ ID NO: 591465 - DNA, 25 bp, Mus musculus
ggacccctgcttcggccctaggaat

SEQ ID NO: 591466 - DNA, 25 bp, Mus musculus
ggacccctgcttgggccctaggaat

SEQ ID NO: 591467 - DNA, 25 bp, Mus musculus
ggacccctgctttcaaaacttacat

SEQ ID NO: 591468 - DNA, 25 bp, Mus musculus
ggacccctgggcaaggatgttatat

SEQ ID NO: 591469 - DNA, 25 bp, Mus musculus
ggacccctgggctaggatgttatat

SEQ ID NO: 591470 - DNA, 25 bp, Mus musculus
ggacccctgtgtatgaaaccagctt

SEQ ID NO: 591471 - DNA, 25 bp, Mus musculus
ggacccctgtgtttgaaaccagctt

SEQ ID NO: 591472 - DNA, 25 bp, Mus musculus
ggaccccttcatctcagatcagttg

SEQ ID NO: 591473 - DNA, 25 bp, Mus musculus
ggaccccttcatgtcagatcagttg

SEQ ID NO: 591474 - DNA, 25 bp, Mus musculus
ggaccccttgtacatcaacattgag

SEQ ID NO: 591475 - DNA, 25 bp, Mus musculus
ggaccccttgtagatcaacattgag

SEQ ID NO: 591476 - DNA, 25 bp, Mus musculus
ggacccctttgaaccggcctcggat

SEQ ID NO: 591477 - DNA, 25 bp, Mus musculus
ggacccctttgatccggcctcggat

SEQ ID NO: 591478 - DNA, 25 bp, Mus musculus
ggacccgaaattaacccagcacttg

SEQ ID NO: 591479 - DNA, 25 bp, Mus musculus
ggacccgaaatttacccagcacttg

SEQ ID NO: 591480 - DNA, 25 bp, Mus musculus
ggacccgaactcagacgacgagaaa

SEQ ID NO: 591481 - DNA, 25 bp, Mus musculus
ggacccgaactctgacgacgagaaa

SEQ ID NO: 591482 - DNA, 25 bp, Mus musculus
ggacccgaagggaaatggacctgat

SEQ ID NO: 591483 - DNA, 25 bp, Mus musculus
ggacccgaagggtaatggacctgat

SEQ ID NO: 591484 - DNA, 25 bp, Mus musculus
ggacccgaatacatctgtagaccct

SEQ ID NO: 591485 - DNA, 25 bp, Mus musculus
ggacccgaatacttctgtagaccct

SEQ ID NO: 591486 - DNA, 25 bp, Mus musculus
ggacccgaatgccaatgctgatttg

SEQ ID NO: 591487 - DNA, 25 bp, Mus musculus
ggacccgaatgcgaatgctgatttg

SEQ ID NO: 591488 - DNA, 25 bp, Mus musculus
ggacccgaattcagtcatctgagtt

SEQ ID NO: 591489 - DNA, 25 bp, Mus musculus
ggacccgaattctgtcatctgagtt

SEQ ID NO: 591490 - DNA, 25 bp, Mus musculus
ggacccgactgtatgttgagtgact

SEQ ID NO: 591491 - DNA, 25 bp, Mus musculus
ggacccgactgtttgttgagtgact

SEQ ID NO: 591492 - DNA, 25 bp, Mus musculus
ggacccgagacacgagcaacttcaa

SEQ ID NO: 591493 - DNA, 25 bp, Mus musculus
ggacccgagacaggagcaacttcaa

SEQ ID NO: 591494 - DNA, 25 bp, Mus musculus
ggacccgagagcaggccaacgatga

SEQ ID NO: 591495 - DNA, 25 bp, Mus musculus
ggacccgagagctggccaacgatga

SEQ ID NO: 591496 - DNA, 25 bp, Mus musculus
ggacccgaggaacgcactggcttct

SEQ ID NO: 591497 - DNA, 25 bp, Mus musculus
ggacccgaggaaggcactggcttct

SEQ ID NO: 591498 - DNA, 25 bp, Mus musculus
ggacccgaggcgaggttctttgcac

SEQ ID NO: 591499 - DNA, 25 bp, Mus musculus
ggacccgaggcgtggttctttgcac

SEQ ID NO: 591500 - DNA, 25 bp, Mus musculus
ggacccgagttcagtcttccagagg

SEQ ID NO: 591501 - DNA, 25 bp, Mus musculus
ggacccgagttctgtcttccagagg

SEQ ID NO: 591502 - DNA, 25 bp, Mus musculus
ggacccgatgacatagtttgcgaga

SEQ ID NO: 591503 - DNA, 25 bp, Mus musculus
ggacccgatgacttagtttgcgaga

SEQ ID NO: 591504 - DNA, 25 bp, Mus musculus
ggacccgatggccaactttattaag

SEQ ID NO: 591505 - DNA, 25 bp, Mus musculus
ggacccgatggcgaactttattaag

SEQ ID NO: 591506 - DNA, 25 bp, Mus musculus
ggacccgattgccagaatgcctgga

SEQ ID NO: 591507 - DNA, 25 bp, Mus musculus
ggacccgattgcgagaatgcctgga

SEQ ID NO: 591508 - DNA, 25 bp, Mus musculus
ggacccgcaaatccccaagtacaga

SEQ ID NO: 591509 - DNA, 25 bp, Mus musculus
ggacccgcaaatgcccaagtacaga

SEQ ID NO: 591510 - DNA, 25 bp, Mus musculus
ggacccgcagatcacattggtgcca

SEQ ID NO: 591511 - DNA, 25 bp, Mus musculus
ggacccgcagatgacattggtgcca

SEQ ID NO: 591512 - DNA, 25 bp, Mus musculus
ggacccgctagcacaggttgtatgg

SEQ ID NO: 591513 - DNA, 25 bp, Mus musculus
ggacccgctagctcaggttgtatgg

SEQ ID NO: 591514 - DNA, 25 bp, Mus musculus
ggacccgctccactatgaagagtat

SEQ ID NO: 591515 - DNA, 25 bp, Mus musculus
ggacccgctccagtatgaagagtat

SEQ ID NO: 591516 - DNA, 25 bp, Mus musculus
ggacccgctgaaaggctattgcatg

SEQ ID NO: 591517 - DNA, 25 bp, Mus musculus
ggacccgctgaacggactcttggat

SEQ ID NO: 591518 - DNA, 25 bp, Mus musculus
ggacccgctgaagggactcttggat

SEQ ID NO: 591519 - DNA, 25 bp, Mus musculus
ggacccgctgaatggctattgcatg

SEQ ID NO: 591520 - DNA, 25 bp, Mus musculus
ggacccggagccaaagtgtagagat

SEQ ID NO: 591521 - DNA, 25 bp, Mus musculus
ggacccggagcctaagtgtagagat

SEQ ID NO: 591522 - DNA, 25 bp, Mus musculus
ggacccggcgaactcagcatctgga

SEQ ID NO: 591523 - DNA, 25 bp, Mus musculus
ggacccggcgaagtcagcatctgga

SEQ ID NO: 591524 - DNA, 25 bp, Mus musculus
ggacccggctctcagagtcatttga

SEQ ID NO: 591525 - DNA, 25 bp, Mus musculus
ggacccggctctgagagtcatttga

SEQ ID NO: 591526 - DNA, 25 bp, Mus musculus
ggacccggttctcttgtgtgcagct

SEQ ID NO: 591527 - DNA, 25 bp, Mus musculus
ggacccggttctgttgtgtgcagct

SEQ ID NO: 591528 - DNA, 25 bp, Mus musculus
ggacccgtgactatacaaccaggat

SEQ ID NO: 591529 - DNA, 25 bp, Mus musculus
ggacccgtgactttacaaccaggat

SEQ ID NO: 591530 - DNA, 25 bp, Mus musculus
ggacccgtgaggacaccagagtcta

SEQ ID NO: 591531 - DNA, 25 bp, Mus musculus
ggacccgtgaggtcaccagagtcta

SEQ ID NO: 591532 - DNA, 25 bp, Mus musculus
ggacccgtggagagtttgctgattc

SEQ ID NO: 591533 - DNA, 25 bp, Mus musculus
ggacccgtggagtgtttgctgattc

SEQ ID NO: 591534 - DNA, 25 bp, Mus musculus
ggacccgttgctactggaaatacca

SEQ ID NO: 591535 - DNA, 25 bp, Mus musculus
ggacccgttgcttctggaaatacca

SEQ ID NO: 591536 - DNA, 25 bp, Mus musculus
ggacccgttgtgagtttctgtatta

SEQ ID NO: 591537 - DNA, 25 bp, Mus musculus
ggacccgttgtgtgtttctgtatta

SEQ ID NO: 591538 - DNA, 25 bp, Mus musculus
ggaccctacacgctttcagtctgtg

SEQ ID NO: 591539 - DNA, 25 bp, Mus musculus
ggaccctacacggtttcagtctgtg

SEQ ID NO: 591540 - DNA, 25 bp, Mus musculus
ggaccctagagacctcggttccgga

SEQ ID NO: 591541 - DNA, 25 bp, Mus musculus
ggaccctagagagctcggttccgga

SEQ ID NO: 591542 - DNA, 25 bp, Mus musculus
ggaccctagagcattacagtgtgtt

SEQ ID NO: 591543 - DNA, 25 bp, Mus musculus
ggaccctagagctttacagtgtgtt

SEQ ID NO: 591544 - DNA, 25 bp, Mus musculus
ggaccctataggagtggaccttgaa

SEQ ID NO: 591545 - DNA, 25 bp, Mus musculus
ggaccctataggtgtggaccttgaa

SEQ ID NO: 591546 - DNA, 25 bp, Mus musculus
ggaccctcacatcggactgggagct

SEQ ID NO: 591547 - DNA, 25 bp, Mus musculus
ggaccctcacatgggactgggagct

SEQ ID NO: 591548 - DNA, 25 bp, Mus musculus
ggaccctcagccaacaagaaagatg

SEQ ID NO: 591549 - DNA, 25 bp, Mus musculus
ggaccctcagcctacaagaaagatg

SEQ ID NO: 591550 - DNA, 25 bp, Mus musculus
ggaccctcaggcctacaaggagagc

SEQ ID NO: 591551 - DNA, 25 bp, Mus musculus
ggaccctcaggcgtacaaggagagc

SEQ ID NO: 591552 - DNA, 25 bp, Mus musculus
ggaccctcaggtaccagtggccagt

SEQ ID NO: 591553 - DNA, 25 bp, Mus musculus
ggaccctcaggttccagtggccagt

SEQ ID NO: 591554 - DNA, 25 bp, Mus musculus
ggaccctcagttatagccacgatgg

SEQ ID NO: 591555 - DNA, 25 bp, Mus musculus
ggaccctcagttttagccacgatgg

SEQ ID NO: 591556 - DNA, 25 bp, Mus musculus
ggaccctcattcaaagcatataagt

SEQ ID NO: 591557 - DNA, 25 bp, Mus musculus
ggaccctcattctaagcatataagt

SEQ ID NO: 591558 - DNA, 25 bp, Mus musculus
ggaccctccaggctgtgatcatgtt

SEQ ID NO: 591559 - DNA, 25 bp, Mus musculus
ggaccctccagggtgtgatcatgtt

SEQ ID NO: 591560 - DNA, 25 bp, Mus musculus
ggaccctcccagcacaaaattgcat

SEQ ID NO: 591561 - DNA, 25 bp, Mus musculus
ggaccctcccaggacaaaattgcat

SEQ ID NO: 591562 - DNA, 25 bp, Mus musculus
ggaccctccgcacatttatttttat

SEQ ID NO: 591563 - DNA, 25 bp, Mus musculus
ggaccctccgcagatttatttttat

SEQ ID NO: 591564 - DNA, 25 bp, Mus musculus
ggaccctcctgcagaattctgtgtt

SEQ ID NO: 591565 - DNA, 25 bp, Mus musculus
ggaccctcctgctgaattctgtgtt

SEQ ID NO: 591566 - DNA, 25 bp, Mus musculus
ggaccctctaacaatgcgagttgct

SEQ ID NO: 591567 - DNA, 25 bp, Mus musculus
ggaccctctaactatgcgagttgct

SEQ ID NO: 591568 - DNA, 25 bp, Mus musculus
ggaccctctgtacttcctggtgctt

SEQ ID NO: 591569 - DNA, 25 bp, Mus musculus
ggaccctctgtagttcctggtgctt

SEQ ID NO: 591570 - DNA, 25 bp, Mus musculus
ggaccctctgttattaggtaatcag

SEQ ID NO: 591571 - DNA, 25 bp, Mus musculus
ggaccctctgtttttaggtaatcag

SEQ ID NO: 591572 - DNA, 25 bp, Mus musculus
ggaccctcttcaagtatgaaggaga

SEQ ID NO: 591573 - DNA, 25 bp, Mus musculus
ggaccctcttcatgtatgaaggaga

SEQ ID NO: 591574 - DNA, 25 bp, Mus musculus
ggaccctcttccagtgagcacagca

SEQ ID NO: 591575 - DNA, 25 bp, Mus musculus
ggaccctcttcctgtgagcacagca

SEQ ID NO: 591576 - DNA, 25 bp, Mus musculus
ggaccctgaaaaaggcgataaccct

SEQ ID NO: 591577 - DNA, 25 bp, Mus musculus
ggaccctgaaaacttgcaccagctg

SEQ ID NO: 591578 - DNA, 25 bp, Mus musculus
ggaccctgaaaagttgcaccagctg

SEQ ID NO: 591579 - DNA, 25 bp, Mus musculus
ggaccctgaaaatggcgataaccct

SEQ ID NO: 591580 - DNA, 25 bp, Mus musculus
ggaccctgaacacccaatatacttg

SEQ ID NO: 591581 - DNA, 25 bp, Mus musculus
ggaccctgaacacggccatgaagaa

SEQ ID NO: 591582 - DNA, 25 bp, Mus musculus
ggaccctgaacagccaatatacttg

SEQ ID NO: 591583 - DNA, 25 bp, Mus musculus
ggaccctgaacagggccatgaagaa

SEQ ID NO: 591584 - DNA, 25 bp, Mus musculus
ggaccctgaatccatcatgtttaat

SEQ ID NO: 591585 - DNA, 25 bp, Mus musculus
ggaccctgaatcgatcatgtttaat

SEQ ID NO: 591586 - DNA, 25 bp, Mus musculus
ggaccctgacccaagcgcagaagcg

SEQ ID NO: 591587 - DNA, 25 bp, Mus musculus
ggaccctgaccctagcgcagaagcg

SEQ ID NO: 591588 - DNA, 25 bp, Mus musculus
ggaccctgagacaggagtggcacct

SEQ ID NO: 591589 - DNA, 25 bp, Mus musculus
ggaccctgagactggagtggcacct

SEQ ID NO: 591590 - DNA, 25 bp, Mus musculus
ggaccctgagctcatgaactatgac

SEQ ID NO: 591591 - DNA, 25 bp, Mus musculus
ggaccctgagctcgtcagacaactt

SEQ ID NO: 591592 - DNA, 25 bp, Mus musculus
ggaccctgagctgatgaactatgac

SEQ ID NO: 591593 - DNA, 25 bp, Mus musculus
ggaccctgagctggtcagacaactt

SEQ ID NO: 591594 - DNA, 25 bp, Mus musculus
ggaccctgatgcagaaggacagcca

SEQ ID NO: 591595 - DNA, 25 bp, Mus musculus
ggaccctgatgctgaaggacagcca

SEQ ID NO: 591596 - DNA, 25 bp, Mus musculus
ggaccctgattaattggctctgttt

SEQ ID NO: 591597 - DNA, 25 bp, Mus musculus
ggaccctgattatttggctctgttt

SEQ ID NO: 591598 - DNA, 25 bp, Mus musculus
ggaccctgcgggatcgtcacatcag

SEQ ID NO: 591599 - DNA, 25 bp, Mus musculus
ggaccctgcgggttcgtcacatcag

SEQ ID NO: 591600 - DNA, 25 bp, Mus musculus
ggaccctgctgactcaagtgccaga

SEQ ID NO: 591601 - DNA, 25 bp, Mus musculus
ggaccctgctgagtcaagtgccaga

SEQ ID NO: 591602 - DNA, 25 bp, Mus musculus
ggaccctgctgtactcagaatgtga

SEQ ID NO: 591603 - DNA, 25 bp, Mus musculus
ggaccctgctgttctcagaatgtga

SEQ ID NO: 591604 - DNA, 25 bp, Mus musculus
ggaccctgcttaactaaggagatct

SEQ ID NO: 591605 - DNA, 25 bp, Mus musculus
ggaccctgcttatctaaggagatct

SEQ ID NO: 591606 - DNA, 25 bp, Mus musculus
ggaccctggatgagcacagtgtatc

SEQ ID NO: 591607 - DNA, 25 bp, Mus musculus
ggaccctggatgtgcacagtgtatc

SEQ ID NO: 591608 - DNA, 25 bp, Mus musculus
ggaccctggccaaggacacctttgc

SEQ ID NO: 591609 - DNA, 25 bp, Mus musculus
ggaccctggccatggacacctttgc

SEQ ID NO: 591610 - DNA, 25 bp, Mus musculus
ggaccctggctacttacagcggatt

SEQ ID NO: 591611 - DNA, 25 bp, Mus musculus
ggaccctggctagttacagcggatt

SEQ ID NO: 591612 - DNA, 25 bp, Mus musculus
ggaccctgggaaagggagccagctc

SEQ ID NO: 591613 - DNA, 25 bp, Mus musculus
ggaccctgggaatgggagccagctc

SEQ ID NO: 591614 - DNA, 25 bp, Mus musculus
ggaccctggtaactgcagtgctatt

SEQ ID NO: 591615 - DNA, 25 bp, Mus musculus
ggaccctggtaagtgcagtgctatt

SEQ ID NO: 591616 - DNA, 25 bp, Mus musculus
ggaccctggtttcaatcctagcatg

SEQ ID NO: 591617 - DNA, 25 bp, Mus musculus
ggaccctggtttgaatcctagcatg

SEQ ID NO: 591618 - DNA, 25 bp, Mus musculus
ggaccctgtcccagcgctgttctgt

SEQ ID NO: 591619 - DNA, 25 bp, Mus musculus
ggaccctgtccctgcgctgttctgt

SEQ ID NO: 591620 - DNA, 25 bp, Mus musculus
ggaccctgtgcacagtcccatggat

SEQ ID NO: 591621 - DNA, 25 bp, Mus musculus
ggaccctgtgcagagtcccatggat

SEQ ID NO: 591622 - DNA, 25 bp, Mus musculus
ggaccctgtggacgtacagcacctg

SEQ ID NO: 591623 - DNA, 25 bp, Mus musculus
ggaccctgtggaggtacagcacctg

SEQ ID NO: 591624 - DNA, 25 bp, Mus musculus
ggaccctgtgtactgaaaatgctgt

SEQ ID NO: 591625 - DNA, 25 bp, Mus musculus
ggaccctgtgtacttccttttgagt

SEQ ID NO: 591626 - DNA, 25 bp, Mus musculus
ggaccctgtgtagtgaaaatgctgt

SEQ ID NO: 591627 - DNA, 25 bp, Mus musculus
ggaccctgtgtagttccttttgagt

SEQ ID NO: 591628 - DNA, 25 bp, Mus musculus
ggacccttacctagaaaattcagat

SEQ ID NO: 591629 - DNA, 25 bp, Mus musculus
ggacccttaccttgaaaattcagat

SEQ ID NO: 591630 - DNA, 25 bp, Mus musculus
ggacccttagatctgagaccgccct

SEQ ID NO: 591631 - DNA, 25 bp, Mus musculus
ggacccttagatgtgagaccgccct

SEQ ID NO: 591632 - DNA, 25 bp, Mus musculus
ggacccttaggcactgactaacaaa

SEQ ID NO: 591633 - DNA, 25 bp, Mus musculus
ggacccttaggctctgactaacaaa

SEQ ID NO: 591634 - DNA, 25 bp, Mus musculus
ggacccttagtcatttcttcacaag

SEQ ID NO: 591635 - DNA, 25 bp, Mus musculus
ggacccttagtcttttcttcacaag

SEQ ID NO: 591636 - DNA, 25 bp, Mus musculus
ggacccttatatatctaacagttca

SEQ ID NO: 591637 - DNA, 25 bp, Mus musculus
ggacccttatatttctaacagttca

SEQ ID NO: 591638 - DNA, 25 bp, Mus musculus
ggacccttcaaactcaatgcttctt

SEQ ID NO: 591639 - DNA, 25 bp, Mus musculus
ggacccttcaaagtcaatgcttctt

SEQ ID NO: 591640 - DNA, 25 bp, Mus musculus
ggacccttccatacattagttagtg

SEQ ID NO: 591641 - DNA, 25 bp, Mus musculus
ggacccttccattcattagttagtg

SEQ ID NO: 591642 - DNA, 25 bp, Mus musculus
ggacccttgaggactctcagaaact

SEQ ID NO: 591643 - DNA, 25 bp, Mus musculus
ggacccttgaggtctctcagaaact

SEQ ID NO: 591644 - DNA, 25 bp, Mus musculus
ggacccttgctcagaaacgtgactt

SEQ ID NO: 591645 - DNA, 25 bp, Mus musculus
ggacccttgctctgaaacgtgactt

SEQ ID NO: 591646 - DNA, 25 bp, Mus musculus
ggacccttgggtaatagctagccac

SEQ ID NO: 591647 - DNA, 25 bp, Mus musculus
ggacccttgggttatagctagccac

SEQ ID NO: 591648 - DNA, 25 bp, Mus musculus
ggacccttggtaattgtcttgcatt

SEQ ID NO: 591649 - DNA, 25 bp, Mus musculus
ggacccttggtatttgtcttgcatt

SEQ ID NO: 591650 - DNA, 25 bp, Mus musculus
ggacccttggtcagcaacatggatg

SEQ ID NO: 591651 - DNA, 25 bp, Mus musculus
ggacccttggtcagtaacaaccttg

SEQ ID NO: 591652 - DNA, 25 bp, Mus musculus
ggacccttggtctgcaacatggatg

SEQ ID NO: 591653 - DNA, 25 bp, Mus musculus
ggacccttggtctgtaacaaccttg

SEQ ID NO: 591654 - DNA, 25 bp, Mus musculus
ggaccctttcttaaactgagctcaa

SEQ ID NO: 591655 - DNA, 25 bp, Mus musculus
ggaccctttctttaactgagctcaa

SEQ ID NO: 591656 - DNA, 25 bp, Mus musculus
ggaccctttgacatagagggcccat

SEQ ID NO: 591657 - DNA, 25 bp, Mus musculus
ggaccctttgacttagagggcccat

SEQ ID NO: 591658 - DNA, 25 bp, Mus musculus
ggaccctttgccatggactttccct

SEQ ID NO: 591659 - DNA, 25 bp, Mus musculus
ggaccctttgccttggactttccct

SEQ ID NO: 591660 - DNA, 25 bp, Mus musculus
ggaccctttgctactgagcaggtaa

SEQ ID NO: 591661 - DNA, 25 bp, Mus musculus
ggaccctttgcttctgagcaggtaa

SEQ ID NO: 591662 - DNA, 25 bp, Mus musculus
ggacccttttatatctattccaaat

SEQ ID NO: 591663 - DNA, 25 bp, Mus musculus
ggacccttttatttctattccaaat

SEQ ID NO: 591664 - DNA, 25 bp, Mus musculus
ggaccgaagtatatttactgttgct

SEQ ID NO: 591665 - DNA, 25 bp, Mus musculus
ggaccgaagtatttttactgttgct

SEQ ID NO: 591666 - DNA, 25 bp, Mus musculus
ggaccgaatcgtccagttcttacgc

SEQ ID NO: 591667 - DNA, 25 bp, Mus musculus
ggaccgaatcgtgcagttcttacgc

SEQ ID NO: 591668 - DNA, 25 bp, Mus musculus
ggaccgaatgaacatgccctatacg

SEQ ID NO: 591669 - DNA, 25 bp, Mus musculus
ggaccgaatgaagatgccctatacg

SEQ ID NO: 591670 - DNA, 25 bp, Mus musculus
ggaccgacaagactcagtttcagaa

SEQ ID NO: 591671 - DNA, 25 bp, Mus musculus
ggaccgacaagagtcagtttcagaa

SEQ ID NO: 591672 - DNA, 25 bp, Mus musculus
ggaccgacagagatatttttggcaa

SEQ ID NO: 591673 - DNA, 25 bp, Mus musculus
ggaccgacagagttatttttggcaa

SEQ ID NO: 591674 - DNA, 25 bp, Mus musculus
ggaccgactccaactatgaggcatc

SEQ ID NO: 591675 - DNA, 25 bp, Mus musculus
ggaccgactccatctatgaggcatc

SEQ ID NO: 591676 - DNA, 25 bp, Mus musculus
ggaccgagaagaactgctccgggct

SEQ ID NO: 591677 - DNA, 25 bp, Mus musculus
ggaccgagaagatctgctccgggct

SEQ ID NO: 591678 - DNA, 25 bp, Mus musculus
ggaccgagagcccatggaacacatg

SEQ ID NO: 591679 - DNA, 25 bp, Mus musculus
ggaccgagagccgatggaacacatg

SEQ ID NO: 591680 - DNA, 25 bp, Mus musculus
ggaccgagccggaaatctagaaagt

SEQ ID NO: 591681 - DNA, 25 bp, Mus musculus
ggaccgagccggtaatctagaaagt

SEQ ID NO: 591682 - DNA, 25 bp, Mus musculus
ggaccgagctgcaactcacactgtg

SEQ ID NO: 591683 - DNA, 25 bp, Mus musculus
ggaccgagctgctactcacactgtg

SEQ ID NO: 591684 - DNA, 25 bp, Mus musculus
ggaccgagcttgcttccttgtcaca

SEQ ID NO: 591685 - DNA, 25 bp, Mus musculus
ggaccgagcttggttccttgtcaca

SEQ ID NO: 591686 - DNA, 25 bp, Mus musculus
ggaccgaggaataagaatggaccca

SEQ ID NO: 591687 - DNA, 25 bp, Mus musculus
ggaccgaggaattagaatggaccca

SEQ ID NO: 591688 - DNA, 25 bp, Mus musculus
ggaccgaggagaaccacgccgagtc

SEQ ID NO: 591689 - DNA, 25 bp, Mus musculus
ggaccgaggagatccacgccgagtc

SEQ ID NO: 591690 - DNA, 25 bp, Mus musculus
ggaccgaggcgtaatcgaactcctt

SEQ ID NO: 591691 - DNA, 25 bp, Mus musculus
ggaccgaggcgttatcgaactcctt

SEQ ID NO: 591692 - DNA, 25 bp, Mus musculus
ggaccgagtcaacgcaaaggaatca

SEQ ID NO: 591693 - DNA, 25 bp, Mus musculus
ggaccgagtcaaggcaaaggaatca

SEQ ID NO: 591694 - DNA, 25 bp, Mus musculus
ggaccgagtctgcaggatgcccctc

SEQ ID NO: 591695 - DNA, 25 bp, Mus musculus
ggaccgagtctggaggatgcccctc

SEQ ID NO: 591696 - DNA, 25 bp, Mus musculus
ggaccgagtgaactgatgctcccac

SEQ ID NO: 591697 - DNA, 25 bp, Mus musculus
ggaccgagtgaagtgatgctcccac

SEQ ID NO: 591698 - DNA, 25 bp, Mus musculus
ggaccgagtgacagagttcctccag

SEQ ID NO: 591699 - DNA, 25 bp, Mus musculus
ggaccgagtgactgagttcctccag

SEQ ID NO: 591700 - DNA, 25 bp, Mus musculus
ggaccgagtttgaggacatccccag

SEQ ID NO: 591701 - DNA, 25 bp, Mus musculus
ggaccgagtttgtggacatccccag

SEQ ID NO: 591702 - DNA, 25 bp, Mus musculus
ggaccgatagaccagccccagctgg

SEQ ID NO: 591703 - DNA, 25 bp, Mus musculus
ggaccgatagacgagccccagctgg

SEQ ID NO: 591704 - DNA, 25 bp, Mus musculus
ggaccgatgcttaaccaccaaagta

SEQ ID NO: 591705 - DNA, 25 bp, Mus musculus
ggaccgatgctttaccaccaaagta

SEQ ID NO: 591706 - DNA, 25 bp, Mus musculus
ggaccgattgaccaaagacaacctt

SEQ ID NO: 591707 - DNA, 25 bp, Mus musculus
ggaccgattgacgaaagacaacctt

SEQ ID NO: 591708 - DNA, 25 bp, Mus musculus
ggaccgcaaggaaggtgctacgcct

SEQ ID NO: 591709 - DNA, 25 bp, Mus musculus
ggaccgcaaggatggtgctacgcct

SEQ ID NO: 591710 - DNA, 25 bp, Mus musculus
ggaccgcacagacatactacaacca

SEQ ID NO: 591711 - DNA, 25 bp, Mus musculus
ggaccgcacagagatactacaacca

SEQ ID NO: 591712 - DNA, 25 bp, Mus musculus
ggaccgcacgaccatgcgcgacaaa

SEQ ID NO: 591713 - DNA, 25 bp, Mus musculus
ggaccgcacgacgatgcgcgacaaa

SEQ ID NO: 591714 - DNA, 25 bp, Mus musculus
ggaccgcagcataatggctctgact

SEQ ID NO: 591715 - DNA, 25 bp, Mus musculus
ggaccgcagcattatggctctgact

SEQ ID NO: 591716 - DNA, 25 bp, Mus musculus
ggaccgcatgtacaggctcagtagc

SEQ ID NO: 591717 - DNA, 25 bp, Mus musculus
ggaccgcatgtagaggctcagtagc

SEQ ID NO: 591718 - DNA, 25 bp, Mus musculus
ggaccgcattatagccaaacttcaa

SEQ ID NO: 591719 - DNA, 25 bp, Mus musculus
ggaccgcattattgccaaacttcaa

SEQ ID NO: 591720 - DNA, 25 bp, Mus musculus
ggaccgcatttaacgacacctggag

SEQ ID NO: 591721 - DNA, 25 bp, Mus musculus
ggaccgcatttatcgacacctggag

SEQ ID NO: 591722 - DNA, 25 bp, Mus musculus
ggaccgccatatccaagaggccttt

SEQ ID NO: 591723 - DNA, 25 bp, Mus musculus
ggaccgccatatgcaagaggccttt

SEQ ID NO: 591724 - DNA, 25 bp, Mus musculus
ggaccgccatcacggagattcttat

SEQ ID NO: 591725 - DNA, 25 bp, Mus musculus
ggaccgccatcagggagattcttat

SEQ ID NO: 591726 - DNA, 25 bp, Mus musculus
ggaccgccctgacacaacatgacgt

SEQ ID NO: 591727 - DNA, 25 bp, Mus musculus
ggaccgccctgagacaacatgacgt

SEQ ID NO: 591728 - DNA, 25 bp, Mus musculus
ggaccgccgactcagctggagactt

SEQ ID NO: 591729 - DNA, 25 bp, Mus musculus
ggaccgccgactgagctggagactt

SEQ ID NO: 591730 - DNA, 25 bp, Mus musculus
ggaccgccgtacactcaccagagga

SEQ ID NO: 591731 - DNA, 25 bp, Mus musculus
ggaccgccgtactctcaccagagga

SEQ ID NO: 591732 - DNA, 25 bp, Mus musculus
ggaccgcctcttcgagatcattggg

SEQ ID NO: 591733 - DNA, 25 bp, Mus musculus
ggaccgcctcttggagatcattggg

SEQ ID NO: 591734 - DNA, 25 bp, Mus musculus
ggaccgcctgaaactgcaagctggg

SEQ ID NO: 591735 - DNA, 25 bp, Mus musculus
ggaccgcctgaatctgcaagctggg

SEQ ID NO: 591736 - DNA, 25 bp, Mus musculus
ggaccgcctggtcactgcttgttgc

SEQ ID NO: 591737 - DNA, 25 bp, Mus musculus
ggaccgcctggtgactgcttgttgc

SEQ ID NO: 591738 - DNA, 25 bp, Mus musculus
ggaccgcgcagaagtgctctgcagc

SEQ ID NO: 591739 - DNA, 25 bp, Mus musculus
ggaccgcgcagatgtgctctgcagc

SEQ ID NO: 591740 - DNA, 25 bp, Mus musculus
ggaccgcgtatcagagctttgagca

SEQ ID NO: 591741 - DNA, 25 bp, Mus musculus
ggaccgcgtatctgagctttgagca

SEQ ID NO: 591742 - DNA, 25 bp, Mus musculus
ggaccgcgtgggagtgcccaactaa

SEQ ID NO: 591743 - DNA, 25 bp, Mus musculus
ggaccgcgtgggtgtgcccaactaa

SEQ ID NO: 591744 - DNA, 25 bp, Mus musculus
ggaccgctacgaattttcatcacac

SEQ ID NO: 591745 - DNA, 25 bp, Mus musculus
ggaccgctacgatttttcatcacac

SEQ ID NO: 591746 - DNA, 25 bp, Mus musculus
ggaccgctatcaccgcctgaaggat

SEQ ID NO: 591747 - DNA, 25 bp, Mus musculus
ggaccgctatcagcgcctgaaggat

SEQ ID NO: 591748 - DNA, 25 bp, Mus musculus
ggaccgctccgcctgagaatcaaat

SEQ ID NO: 591749 - DNA, 25 bp, Mus musculus
ggaccgctccgcgtgagaatcaaat

SEQ ID NO: 591750 - DNA, 25 bp, Mus musculus
ggaccgctggcaaaactactgaata

SEQ ID NO: 591751 - DNA, 25 bp, Mus musculus
ggaccgctggcataactactgaata

SEQ ID NO: 591752 - DNA, 25 bp, Mus musculus
ggaccgcttcctccgtacagagcag

SEQ ID NO: 591753 - DNA, 25 bp, Mus musculus
ggaccgcttcctgcgtacagagcag

SEQ ID NO: 591754 - DNA, 25 bp, Mus musculus
ggaccgcttggtaatcaacacgcca

SEQ ID NO: 591755 - DNA, 25 bp, Mus musculus
ggaccgcttggttatcaacacgcca

SEQ ID NO: 591756 - DNA, 25 bp, Mus musculus
ggaccgctttctatttgctctgttg

SEQ ID NO: 591757 - DNA, 25 bp, Mus musculus
ggaccgctttctttttgctctgttg

SEQ ID NO: 591758 - DNA, 25 bp, Mus musculus
ggaccggagcaacttcctggacgct

SEQ ID NO: 591759 - DNA, 25 bp, Mus musculus
ggaccggagcaagttcctggacgct

SEQ ID NO: 591760 - DNA, 25 bp, Mus musculus
ggaccggagccgaagaatctctttt

SEQ ID NO: 591761 - DNA, 25 bp, Mus musculus
ggaccggagccgtagaatctctttt

SEQ ID NO: 591762 - DNA, 25 bp, Mus musculus
ggaccggatcttagccatgatggac

SEQ ID NO: 591763 - DNA, 25 bp, Mus musculus
ggaccggatctttgccatgatggac

SEQ ID NO: 591764 - DNA, 25 bp, Mus musculus
ggaccggcaagaagatgcctagtaa

SEQ ID NO: 591765 - DNA, 25 bp, Mus musculus
ggaccggcaagatgatgcctagtaa

SEQ ID NO: 591766 - DNA, 25 bp, Mus musculus
ggaccggcatcaaggaaggctccag

SEQ ID NO: 591767 - DNA, 25 bp, Mus musculus
ggaccggcatcatggaaggctccag

SEQ ID NO: 591768 - DNA, 25 bp, Mus musculus
ggaccgggatctccatggctcgaaa

SEQ ID NO: 591769 - DNA, 25 bp, Mus musculus
ggaccgggatctgcatggctcgaaa

SEQ ID NO: 591770 - DNA, 25 bp, Mus musculus
ggaccgggcgttacaaatctataga

SEQ ID NO: 591771 - DNA, 25 bp, Mus musculus
ggaccgggcgtttcaaatctataga

SEQ ID NO: 591772 - DNA, 25 bp, Mus musculus
ggaccggttagacatctgcacagct

SEQ ID NO: 591773 - DNA, 25 bp, Mus musculus
ggaccggttagagatctgcacagct

SEQ ID NO: 591774 - DNA, 25 bp, Mus musculus
ggaccgtaagagcacccagatcgag

SEQ ID NO: 591775 - DNA, 25 bp, Mus musculus
ggaccgtaagaggacccagatcgag

SEQ ID NO: 591776 - DNA, 25 bp, Mus musculus
ggaccgtagcgtccacactgttggt

SEQ ID NO: 591777 - DNA, 25 bp, Mus musculus
ggaccgtagcgtgcacactgttggt

SEQ ID NO: 591778 - DNA, 25 bp, Mus musculus
ggaccgtataggctccagggatcct

SEQ ID NO: 591779 - DNA, 25 bp, Mus musculus
ggaccgtatagggtccagggatcct

SEQ ID NO: 591780 - DNA, 25 bp, Mus musculus
ggaccgtcatgcaagggtttgctga

SEQ ID NO: 591781 - DNA, 25 bp, Mus musculus
ggaccgtcatgctagggtttgctga

SEQ ID NO: 591782 - DNA, 25 bp, Mus musculus
ggaccgtctcctaagttattacagg

SEQ ID NO: 591783 - DNA, 25 bp, Mus musculus
ggaccgtctccttagttattacagg

SEQ ID NO: 591784 - DNA, 25 bp, Mus musculus
ggaccgtgcccaaagaattggacaa

SEQ ID NO: 591785 - DNA, 25 bp, Mus musculus
ggaccgtgcccatagaattggacaa

SEQ ID NO: 591786 - DNA, 25 bp, Mus musculus
ggaccgtggaacactccaaggaaat

SEQ ID NO: 591787 - DNA, 25 bp, Mus musculus
ggaccgtggaactctccaaggaaat

SEQ ID NO: 591788 - DNA, 25 bp, Mus musculus
ggaccgtggcagagttagcagctat

SEQ ID NO: 591789 - DNA, 25 bp, Mus musculus
ggaccgtggcagtgttagcagctat

SEQ ID NO: 591790 - DNA, 25 bp, Mus musculus
ggaccgtgggctacaggttcatgta

SEQ ID NO: 591791 - DNA, 25 bp, Mus musculus
ggaccgtgggcttcaggttcatgta

SEQ ID NO: 591792 - DNA, 25 bp, Mus musculus
ggaccgtgtacactagtacaggctt

SEQ ID NO: 591793 - DNA, 25 bp, Mus musculus
ggaccgtgtacagtagtacaggctt

SEQ ID NO: 591794 - DNA, 25 bp, Mus musculus
ggaccgtgtcgcctttggaaagata

SEQ ID NO: 591795 - DNA, 25 bp, Mus musculus
ggaccgtgtcgcgtttggaaagata

SEQ ID NO: 591796 - DNA, 25 bp, Mus musculus
ggaccgttaagcagagtgaccgttt

SEQ ID NO: 591797 - DNA, 25 bp, Mus musculus
ggaccgttaagctgagtgaccgttt

SEQ ID NO: 591798 - DNA, 25 bp, Mus musculus
ggaccgttgtaacccatggaccatg

SEQ ID NO: 591799 - DNA, 25 bp, Mus musculus
ggaccgttgtaagccatggaccatg

SEQ ID NO: 591800 - DNA, 25 bp, Mus musculus
ggaccgtttatccagacccaagagg

SEQ ID NO: 591801 - DNA, 25 bp, Mus musculus
ggaccgtttatcgagacccaagagg

SEQ ID NO: 591802 - DNA, 25 bp, Mus musculus
ggaccgtttcgacgttgacattagg

SEQ ID NO: 591803 - DNA, 25 bp, Mus musculus
ggaccgtttcgaggttgacattagg

SEQ ID NO: 591804 - DNA, 25 bp, Mus musculus
ggacctaaatgtctggcgcgcagat

SEQ ID NO: 591805 - DNA, 25 bp, Mus musculus
ggacctaaatgtgtggcgcgcagat

SEQ ID NO: 591806 - DNA, 25 bp, Mus musculus
ggacctaacaccaatatgcagcagt

SEQ ID NO: 591807 - DNA, 25 bp, Mus musculus
ggacctaacacctatatgcagcagt

SEQ ID NO: 591808 - DNA, 25 bp, Mus musculus
ggacctaacctaagtactacatttg

SEQ ID NO: 591809 - DNA, 25 bp, Mus musculus
ggacctaacctatgtactacatttg

SEQ ID NO: 591810 - DNA, 25 bp, Mus musculus
ggacctaagacactgcgcactccgg

SEQ ID NO: 591811 - DNA, 25 bp, Mus musculus
ggacctaagacagtgcgcactccgg

SEQ ID NO: 591812 - DNA, 25 bp, Mus musculus
ggacctaagattccagactgctctg

SEQ ID NO: 591813 - DNA, 25 bp, Mus musculus
ggacctaagattgcagactgctctg

SEQ ID NO: 591814 - DNA, 25 bp, Mus musculus
ggacctaagcctaagcggacttttg

SEQ ID NO: 591815 - DNA, 25 bp, Mus musculus
ggacctaagccttagcggacttttg

SEQ ID NO: 591816 - DNA, 25 bp, Mus musculus
ggacctaagcttcagtgtgcagcgt

SEQ ID NO: 591817 - DNA, 25 bp, Mus musculus
ggacctaagcttgagtgtgcagcgt

SEQ ID NO: 591818 - DNA, 25 bp, Mus musculus
ggacctaagggcactctgactgagg

SEQ ID NO: 591819 - DNA, 25 bp, Mus musculus
ggacctaagggctctctgactgagg

SEQ ID NO: 591820 - DNA, 25 bp, Mus musculus
ggacctaagtggaagccctctaagg

SEQ ID NO: 591821 - DNA, 25 bp, Mus musculus
ggacctaagtggtagccctctaagg

SEQ ID NO: 591822 - DNA, 25 bp, Mus musculus
ggacctacactaaggaatcctcatt

SEQ ID NO: 591823 - DNA, 25 bp, Mus musculus
ggacctacactatggaatcctcatt

SEQ ID NO: 591824 - DNA, 25 bp, Mus musculus
ggacctacatccagagcgagattta

SEQ ID NO: 591825 - DNA, 25 bp, Mus musculus
ggacctacatcctgagcgagattta

SEQ ID NO: 591826 - DNA, 25 bp, Mus musculus
ggacctaccagaccctagattgctt

SEQ ID NO: 591827 - DNA, 25 bp, Mus musculus
ggacctaccagagcctagattgctt

SEQ ID NO: 591828 - DNA, 25 bp, Mus musculus
ggacctaccggccagagtatgcagt

SEQ ID NO: 591829 - DNA, 25 bp, Mus musculus
ggacctaccggcgagagtatgcagt

SEQ ID NO: 591830 - DNA, 25 bp, Mus musculus
ggacctacgagcagcggaaggtggt

SEQ ID NO: 591831 - DNA, 25 bp, Mus musculus
ggacctacgagctgcggaaggtggt

SEQ ID NO: 591832 - DNA, 25 bp, Mus musculus
ggacctactaaacaatgtgccacca

SEQ ID NO: 591833 - DNA, 25 bp, Mus musculus
ggacctactaaagaatgtgccacca

SEQ ID NO: 591834 - DNA, 25 bp, Mus musculus
ggacctactagaaacttcctgaaga

SEQ ID NO: 591835 - DNA, 25 bp, Mus musculus
ggacctactagatacttcctgaaga

SEQ ID NO: 591836 - DNA, 25 bp, Mus musculus
ggacctactcaccaagttctcagag

SEQ ID NO: 591837 - DNA, 25 bp, Mus musculus
ggacctactcacgaagttctcagag

SEQ ID NO: 591838 - DNA, 25 bp, Mus musculus
ggacctactcctaacaaatcagcag

SEQ ID NO: 591839 - DNA, 25 bp, Mus musculus
ggacctactccttacaaatcagcag

SEQ ID NO: 591840 - DNA, 25 bp, Mus musculus
ggacctactgcgagccacttagttt

SEQ ID NO: 591841 - DNA, 25 bp, Mus musculus
ggacctactgcgtgccacttagttt

SEQ ID NO: 591842 - DNA, 25 bp, Mus musculus
ggacctactttaagttaagttgcac

SEQ ID NO: 591843 - DNA, 25 bp, Mus musculus
ggacctactttatgttaagttgcac

SEQ ID NO: 591844 - DNA, 25 bp, Mus musculus
ggacctagaccacaagtttcgatgc

SEQ ID NO: 591845 - DNA, 25 bp, Mus musculus
ggacctagaccagaagtttcgatgc

SEQ ID NO: 591846 - DNA, 25 bp, Mus musculus
ggacctagactacatgctaacctac

SEQ ID NO: 591847 - DNA, 25 bp, Mus musculus
ggacctagactagatgctaacctac

SEQ ID NO: 591848 - DNA, 25 bp, Mus musculus
ggacctagacttaagaagcccagaa

SEQ ID NO: 591849 - DNA, 25 bp, Mus musculus
ggacctagactttagaagcccagaa

SEQ ID NO: 591850 - DNA, 25 bp, Mus musculus
ggacctagagccacagttttttact

SEQ ID NO: 591851 - DNA, 25 bp, Mus musculus
ggacctagagcctcagttttttact

SEQ ID NO: 591852 - DNA, 25 bp, Mus musculus
ggacctagagttagctagtctccaa

SEQ ID NO: 591853 - DNA, 25 bp, Mus musculus
ggacctagagtttgctagtctccaa

SEQ ID NO: 591854 - DNA, 25 bp, Mus musculus
ggacctagatagacaagtacacttt

SEQ ID NO: 591855 - DNA, 25 bp, Mus musculus
ggacctagatagtcaagtacacttt

SEQ ID NO: 591856 - DNA, 25 bp, Mus musculus
ggacctagatgcactgttgcttttg

SEQ ID NO: 591857 - DNA, 25 bp, Mus musculus
ggacctagatgctctgttgcttttg

SEQ ID NO: 591858 - DNA, 25 bp, Mus musculus
ggacctagcaatccaggcctaccat

SEQ ID NO: 591859 - DNA, 25 bp, Mus musculus
ggacctagcaatgcaggcctaccat

SEQ ID NO: 591860 - DNA, 25 bp, Mus musculus
ggacctagcagtctgagtttttcta

SEQ ID NO: 591861 - DNA, 25 bp, Mus musculus
ggacctagcagtgtgagtttttcta

SEQ ID NO: 591862 - DNA, 25 bp, Mus musculus
ggacctagctcacaggcaagtgctt

SEQ ID NO: 591863 - DNA, 25 bp, Mus musculus
ggacctagctcagaggcaagtgctt

SEQ ID NO: 591864 - DNA, 25 bp, Mus musculus
ggacctagggccacttgaatgccag

SEQ ID NO: 591865 - DNA, 25 bp, Mus musculus
ggacctagggcctcttgaatgccag

SEQ ID NO: 591866 - DNA, 25 bp, Mus musculus
ggacctagtggacatgctgcaacaa

SEQ ID NO: 591867 - DNA, 25 bp, Mus musculus
ggacctagtggagatgctgcaacaa

SEQ ID NO: 591868 - DNA, 25 bp, Mus musculus
ggacctagtttcataatttgctgtg

SEQ ID NO: 591869 - DNA, 25 bp, Mus musculus
ggacctagtttcttaatttgctgtg

SEQ ID NO: 591870 - DNA, 25 bp, Mus musculus
ggacctataagtctatcctggttat

SEQ ID NO: 591871 - DNA, 25 bp, Mus musculus
ggacctataagtgtatcctggttat

SEQ ID NO: 591872 - DNA, 25 bp, Mus musculus
ggacctatacgtacctaggagctgt

SEQ ID NO: 591873 - DNA, 25 bp, Mus musculus
ggacctatacgttcctaggagctgt

SEQ ID NO: 591874 - DNA, 25 bp, Mus musculus
ggacctatatggactataggctggc

SEQ ID NO: 591875 - DNA, 25 bp, Mus musculus
ggacctatatggtctataggctggc

SEQ ID NO: 591876 - DNA, 25 bp, Mus musculus
ggacctatcattcatgagactctta

SEQ ID NO: 591877 - DNA, 25 bp, Mus musculus
ggacctatcattgatgagactctta

SEQ ID NO: 591878 - DNA, 25 bp, Mus musculus
ggacctatctgacgaagcccatgta

SEQ ID NO: 591879 - DNA, 25 bp, Mus musculus
ggacctatctgaggaagcccatgta

SEQ ID NO: 591880 - DNA, 25 bp, Mus musculus
ggacctatctgtaccctatgaagta

SEQ ID NO: 591881 - DNA, 25 bp, Mus musculus
ggacctatctgttccctatgaagta

SEQ ID NO: 591882 - DNA, 25 bp, Mus musculus
ggacctatgaatctgaccgacctct

SEQ ID NO: 591883 - DNA, 25 bp, Mus musculus
ggacctatgaatgtgaccgacctct

SEQ ID NO: 591884 - DNA, 25 bp, Mus musculus
ggacctatgagtcccctttctctga

SEQ ID NO: 591885 - DNA, 25 bp, Mus musculus
ggacctatgagtgccctttctctga

SEQ ID NO: 591886 - DNA, 25 bp, Mus musculus
ggacctatgcccacatctgggagaa

SEQ ID NO: 591887 - DNA, 25 bp, Mus musculus
ggacctatgccctcatctgggagaa

SEQ ID NO: 591888 - DNA, 25 bp, Mus musculus
ggacctatgtttagttcctagtatc

SEQ ID NO: 591889 - DNA, 25 bp, Mus musculus
ggacctatgttttgttcctagtatc

SEQ ID NO: 591890 - DNA, 25 bp, Mus musculus
ggacctattagaaacaacagagctg

SEQ ID NO: 591891 - DNA, 25 bp, Mus musculus
ggacctattagatacaacagagctg

SEQ ID NO: 591892 - DNA, 25 bp, Mus musculus
ggacctattattactgcaccgatac

SEQ ID NO: 591893 - DNA, 25 bp, Mus musculus
ggacctattatttctgcaccgatac

SEQ ID NO: 591894 - DNA, 25 bp, Mus musculus
ggacctcaaaagctatttttctcat

SEQ ID NO: 591895 - DNA, 25 bp, Mus musculus
ggacctcaaaaggtatttttctcat

SEQ ID NO: 591896 - DNA, 25 bp, Mus musculus
ggacctcaacagcacatatggcagc

SEQ ID NO: 591897 - DNA, 25 bp, Mus musculus
ggacctcaacaggacatatggcagc

SEQ ID NO: 591898 - DNA, 25 bp, Mus musculus
ggacctcaaccgagggtcagcctgg

SEQ ID NO: 591899 - DNA, 25 bp, Mus musculus
ggacctcaaccgtgggtcagcctgg

SEQ ID NO: 591900 - DNA, 25 bp, Mus musculus
ggacctcaactgagacgggcagcta

SEQ ID NO: 591901 - DNA, 25 bp, Mus musculus
ggacctcaactgtgacgggcagcta

SEQ ID NO: 591902 - DNA, 25 bp, Mus musculus
ggacctcaacttatcctgaacagag

SEQ ID NO: 591903 - DNA, 25 bp, Mus musculus
ggacctcaacttttcctgaacagag

SEQ ID NO: 591904 - DNA, 25 bp, Mus musculus
ggacctcaaggccagttagcagtgc

SEQ ID NO: 591905 - DNA, 25 bp, Mus musculus
ggacctcaaggcgagttagcagtgc

SEQ ID NO: 591906 - DNA, 25 bp, Mus musculus
ggacctcaagtcctagacgacactc

SEQ ID NO: 591907 - DNA, 25 bp, Mus musculus
ggacctcaagtcgtagacgacactc

SEQ ID NO: 591908 - DNA, 25 bp, Mus musculus
ggacctcaagttctaccaattattc

SEQ ID NO: 591909 - DNA, 25 bp, Mus musculus
ggacctcaagttgtaccaattattc

SEQ ID NO: 591910 - DNA, 25 bp, Mus musculus
ggacctcaatttcttcgctgcagac

SEQ ID NO: 591911 - DNA, 25 bp, Mus musculus
ggacctcaatttgttcgctgcagac

SEQ ID NO: 591912 - DNA, 25 bp, Mus musculus
ggacctcacacaccctgggtatgga

SEQ ID NO: 591913 - DNA, 25 bp, Mus musculus
ggacctcacacagcctgggtatgga

SEQ ID NO: 591914 - DNA, 25 bp, Mus musculus
ggacctcacatgaccctttatttat

SEQ ID NO: 591915 - DNA, 25 bp, Mus musculus
ggacctcacatgtccctttatttat

SEQ ID NO: 591916 - DNA, 25 bp, Mus musculus
ggacctcaccacaattttctgaaag

SEQ ID NO: 591917 - DNA, 25 bp, Mus musculus
ggacctcaccactattttctgaaag

SEQ ID NO: 591918 - DNA, 25 bp, Mus musculus
ggacctcaccgaatttgaccagtat

SEQ ID NO: 591919 - DNA, 25 bp, Mus musculus
ggacctcaccgattttgaccagtat

SEQ ID NO: 591920 - DNA, 25 bp, Mus musculus
ggacctcactagatttctatttggg

SEQ ID NO: 591921 - DNA, 25 bp, Mus musculus
ggacctcactagttttctatttggg

SEQ ID NO: 591922 - DNA, 25 bp, Mus musculus
ggacctcacttcattttcagagtta

SEQ ID NO: 591923 - DNA, 25 bp, Mus musculus
ggacctcacttctttttcagagtta

SEQ ID NO: 591924 - DNA, 25 bp, Mus musculus
ggacctcagccacaaggccgtcaag

SEQ ID NO: 591925 - DNA, 25 bp, Mus musculus
ggacctcagccagaaggccgtcaag

SEQ ID NO: 591926 - DNA, 25 bp, Mus musculus
ggacctcagcggaatgcattcttca

SEQ ID NO: 591927 - DNA, 25 bp, Mus musculus
ggacctcagcggtatgcattcttca

SEQ ID NO: 591928 - DNA, 25 bp, Mus musculus
ggacctcagcttaaggaactgccct

SEQ ID NO: 591929 - DNA, 25 bp, Mus musculus
ggacctcagctttaggaactgccct

SEQ ID NO: 591930 - DNA, 25 bp, Mus musculus
ggacctcagtttatccatgaaccag

SEQ ID NO: 591931 - DNA, 25 bp, Mus musculus
ggacctcagtttttccatgaaccag

SEQ ID NO: 591932 - DNA, 25 bp, Mus musculus
ggacctcatagacctgatctgttca

SEQ ID NO: 591933 - DNA, 25 bp, Mus musculus
ggacctcatagagctgatctgttca

SEQ ID NO: 591934 - DNA, 25 bp, Mus musculus
ggacctcatctgacaagggtctcat

SEQ ID NO: 591935 - DNA, 25 bp, Mus musculus
ggacctcatctgtcaagggtctcat

SEQ ID NO: 591936 - DNA, 25 bp, Mus musculus
ggacctcatgatctagcctttatgt

SEQ ID NO: 591937 - DNA, 25 bp, Mus musculus
ggacctcatgatgtagcctttatgt

SEQ ID NO: 591938 - DNA, 25 bp, Mus musculus
ggacctcattctaccctttgattta

SEQ ID NO: 591939 - DNA, 25 bp, Mus musculus
ggacctcattcttccctttgattta

SEQ ID NO: 591940 - DNA, 25 bp, Mus musculus
ggacctccagaaccatgggaacatt

SEQ ID NO: 591941 - DNA, 25 bp, Mus musculus
ggacctccagaagcatgggaacatt

SEQ ID NO: 591942 - DNA, 25 bp, Mus musculus
ggacctccagcaatcctatttgatg

SEQ ID NO: 591943 - DNA, 25 bp, Mus musculus
ggacctccagcattcctatttgatg

SEQ ID NO: 591944 - DNA, 25 bp, Mus musculus
ggacctccaggtcttgatctgtaca

SEQ ID NO: 591945 - DNA, 25 bp, Mus musculus
ggacctccaggtgttgatctgtaca

SEQ ID NO: 591946 - DNA, 25 bp, Mus musculus
ggacctccatctctcataggctatg

SEQ ID NO: 591947 - DNA, 25 bp, Mus musculus
ggacctccatctgtcataggctatg

SEQ ID NO: 591948 - DNA, 25 bp, Mus musculus
ggacctccattgatactcaagtgcc

SEQ ID NO: 591949 - DNA, 25 bp, Mus musculus
ggacctccattgttactcaagtgcc

SEQ ID NO: 591950 - DNA, 25 bp, Mus musculus
ggacctcccacaaactgacctttga

SEQ ID NO: 591951 - DNA, 25 bp, Mus musculus
ggacctcccacatactgacctttga

SEQ ID NO: 591952 - DNA, 25 bp, Mus musculus
ggacctcctaccacagtacaagcaa

SEQ ID NO: 591953 - DNA, 25 bp, Mus musculus
ggacctcctacctcagtacaagcaa

SEQ ID NO: 591954 - DNA, 25 bp, Mus musculus
ggacctcctcagacattcatcagag

SEQ ID NO: 591955 - DNA, 25 bp, Mus musculus
ggacctcctcagagtttactttgaa

SEQ ID NO: 591956 - DNA, 25 bp, Mus musculus
ggacctcctcagtcattcatcagag

SEQ ID NO: 591957 - DNA, 25 bp, Mus musculus
ggacctcctcagtgtttactttgaa

SEQ ID NO: 591958 - DNA, 25 bp, Mus musculus
ggacctcctgggagtcctgttagag

SEQ ID NO: 591959 - DNA, 25 bp, Mus musculus
ggacctcctgggtgtcctgttagag

SEQ ID NO: 591960 - DNA, 25 bp, Mus musculus
ggacctcgcacaaactaggcaaatg

SEQ ID NO: 591961 - DNA, 25 bp, Mus musculus
ggacctcgcacatactaggcaaatg

SEQ ID NO: 591962 - DNA, 25 bp, Mus musculus
ggacctcggacgagaagggccaaca

SEQ ID NO: 591963 - DNA, 25 bp, Mus musculus
ggacctcggacgtgaagggccaaca

SEQ ID NO: 591964 - DNA, 25 bp, Mus musculus
ggacctcggcttaccggagcgcaag

SEQ ID NO: 591965 - DNA, 25 bp, Mus musculus
ggacctcggctttccggagcgcaag

SEQ ID NO: 591966 - DNA, 25 bp, Mus musculus
ggacctcggtcacattcctgatgta

SEQ ID NO: 591967 - DNA, 25 bp, Mus musculus
ggacctcggtcagattcctgatgta

SEQ ID NO: 591968 - DNA, 25 bp, Mus musculus
ggacctcgtagaacttgtatctctc

SEQ ID NO: 591969 - DNA, 25 bp, Mus musculus
ggacctcgtagatcttgtatctctc

SEQ ID NO: 591970 - DNA, 25 bp, Mus musculus
ggacctcgtctcaatgtgtgagggt

SEQ ID NO: 591971 - DNA, 25 bp, Mus musculus
ggacctcgtctctatgtgtgagggt

SEQ ID NO: 591972 - DNA, 25 bp, Mus musculus
ggacctcgttaccatggaccagaaa

SEQ ID NO: 591973 - DNA, 25 bp, Mus musculus
ggacctcgttacgatggaccagaaa

SEQ ID NO: 591974 - DNA, 25 bp, Mus musculus
ggacctctaatgacaaatatcactg

SEQ ID NO: 591975 - DNA, 25 bp, Mus musculus
ggacctctaatgtcaaatatcactg

SEQ ID NO: 591976 - DNA, 25 bp, Mus musculus
ggacctctaggtccgtatgtatttc

SEQ ID NO: 591977 - DNA, 25 bp, Mus musculus
ggacctctaggtgcgtatgtatttc

SEQ ID NO: 591978 - DNA, 25 bp, Mus musculus
ggacctctccagctctttgcagatt

SEQ ID NO: 591979 - DNA, 25 bp, Mus musculus
ggacctctccaggtctttgcagatt

SEQ ID NO: 591980 - DNA, 25 bp, Mus musculus
ggacctctcctcagtgagcagcgaa

SEQ ID NO: 591981 - DNA, 25 bp, Mus musculus
ggacctctcctctgtgagcagcgaa

SEQ ID NO: 591982 - DNA, 25 bp, Mus musculus
ggacctctcggccacagataattgt

SEQ ID NO: 591983 - DNA, 25 bp, Mus musculus
ggacctctcggcgacagataattgt

SEQ ID NO: 591984 - DNA, 25 bp, Mus musculus
ggacctctgctaaatagatcactga

SEQ ID NO: 591985 - DNA, 25 bp, Mus musculus
ggacctctgctatatagatcactga

SEQ ID NO: 591986 - DNA, 25 bp, Mus musculus
ggacctctgtcaaactaccgtataa

SEQ ID NO: 591987 - DNA, 25 bp, Mus musculus
ggacctctgtcatactaccgtataa

SEQ ID NO: 591988 - DNA, 25 bp, Mus musculus
ggacctcttgccaacagcgttcgca

SEQ ID NO: 591989 - DNA, 25 bp, Mus musculus
ggacctcttgcctacagcgttcgca

SEQ ID NO: 591990 - DNA, 25 bp, Mus musculus
ggacctcttggccaaaatggcctcc

SEQ ID NO: 591991 - DNA, 25 bp, Mus musculus
ggacctcttggcgaaaatggcctcc

SEQ ID NO: 591992 - DNA, 25 bp, Mus musculus
ggacctcttgggatgactggaatat

SEQ ID NO: 591993 - DNA, 25 bp, Mus musculus
ggacctcttgggttgactggaatat

SEQ ID NO: 591994 - DNA, 25 bp, Mus musculus
ggacctctttgaccaattccgaact

SEQ ID NO: 591995 - DNA, 25 bp, Mus musculus
ggacctctttgagcaattccgaact

SEQ ID NO: 591996 - DNA, 25 bp, Mus musculus
ggacctctttggcatccctgggtag

SEQ ID NO: 591997 - DNA, 25 bp, Mus musculus
ggacctctttgggatccctgggtag

SEQ ID NO: 591998 - DNA, 25 bp, Mus musculus
ggacctgaaaatagtacctcatgga

SEQ ID NO: 591999 - DNA, 25 bp, Mus musculus
ggacctgaaaattgtacctcatgga

SEQ ID NO: 592000 - DNA, 25 bp, Mus musculus
ggacctgaaacccataggacctgaa

SEQ ID NO: 592001 - DNA, 25 bp, Mus musculus
ggacctgaaaccgataggacctgaa

SEQ ID NO: 592002 - DNA, 25 bp, Mus musculus
ggacctgaactcacagctgaaccca

SEQ ID NO: 592003 - DNA, 25 bp, Mus musculus
ggacctgaactctcagctgaaccca

SEQ ID NO: 592004 - DNA, 25 bp, Mus musculus
ggacctgaaggacatcacccacaat

SEQ ID NO: 592005 - DNA, 25 bp, Mus musculus
ggacctgaaggagatcacccacaat

SEQ ID NO: 592006 - DNA, 25 bp, Mus musculus
ggacctgaagtaaatcctgggagca

SEQ ID NO: 592007 - DNA, 25 bp, Mus musculus
ggacctgaagtatatcctgggagca

SEQ ID NO: 592008 - DNA, 25 bp, Mus musculus
ggacctgaagtgcattgcaacctct

SEQ ID NO: 592009 - DNA, 25 bp, Mus musculus
ggacctgaagtggattgcaacctct

SEQ ID NO: 592010 - DNA, 25 bp, Mus musculus
ggacctgaatagactctgcgtgctg

SEQ ID NO: 592011 - DNA, 25 bp, Mus musculus
ggacctgaatagtctctgcgtgctg

SEQ ID NO: 592012 - DNA, 25 bp, Mus musculus
ggacctgacaaacacatcgagttta

SEQ ID NO: 592013 - DNA, 25 bp, Mus musculus
ggacctgacaaagacatcgagttta

SEQ ID NO: 592014 - DNA, 25 bp, Mus musculus
ggacctgacaccaggttcagtcaga

SEQ ID NO: 592015 - DNA, 25 bp, Mus musculus
ggacctgacacctggttcagtcaga

SEQ ID NO: 592016 - DNA, 25 bp, Mus musculus
ggacctgaccacctgtgtcaaggca

SEQ ID NO: 592017 - DNA, 25 bp, Mus musculus
ggacctgaccacgtgtgtcaaggca

SEQ ID NO: 592018 - DNA, 25 bp, Mus musculus
ggacctgaccgaagctcatacaata

SEQ ID NO: 592019 - DNA, 25 bp, Mus musculus
ggacctgaccgatgctcatacaata

SEQ ID NO: 592020 - DNA, 25 bp, Mus musculus
ggacctgaccggagctttgtcttca

SEQ ID NO: 592021 - DNA, 25 bp, Mus musculus
ggacctgaccggtgctttgtcttca

SEQ ID NO: 592022 - DNA, 25 bp, Mus musculus
ggacctgacgggatcctgcttcgag

SEQ ID NO: 592023 - DNA, 25 bp, Mus musculus
ggacctgacgggttcctgcttcgag

SEQ ID NO: 592024 - DNA, 25 bp, Mus musculus
ggacctgactccagaagactcttgg

SEQ ID NO: 592025 - DNA, 25 bp, Mus musculus
ggacctgactcctgaagactcttgg

SEQ ID NO: 592026 - DNA, 25 bp, Mus musculus
ggacctgactgaagcagttcccata

SEQ ID NO: 592027 - DNA, 25 bp, Mus musculus
ggacctgactgatgcagttcccata

SEQ ID NO: 592028 - DNA, 25 bp, Mus musculus
ggacctgagattctgatctgctttc

SEQ ID NO: 592029 - DNA, 25 bp, Mus musculus
ggacctgagattgtgatctgctttc

SEQ ID NO: 592030 - DNA, 25 bp, Mus musculus
ggacctgagcacagttcccctgagt

SEQ ID NO: 592031 - DNA, 25 bp, Mus musculus
ggacctgagcactgttcccctgagt

SEQ ID NO: 592032 - DNA, 25 bp, Mus musculus
ggacctgagctcatgacctgtgcca

SEQ ID NO: 592033 - DNA, 25 bp, Mus musculus
ggacctgagctcttgacctgtgcca

SEQ ID NO: 592034 - DNA, 25 bp, Mus musculus
ggacctgatcacactgggaactggt

SEQ ID NO: 592035 - DNA, 25 bp, Mus musculus
ggacctgatcaccttttttgacgag

SEQ ID NO: 592036 - DNA, 25 bp, Mus musculus
ggacctgatcacgttttttgacgag

SEQ ID NO: 592037 - DNA, 25 bp, Mus musculus
ggacctgatcactctgggaactggt

SEQ ID NO: 592038 - DNA, 25 bp, Mus musculus
ggacctgatcataccaagtttcacg

SEQ ID NO: 592039 - DNA, 25 bp, Mus musculus
ggacctgatcattccaagtttcacg

SEQ ID NO: 592040 - DNA, 25 bp, Mus musculus
ggacctgatggacatctcagaccag

SEQ ID NO: 592041 - DNA, 25 bp, Mus musculus
ggacctgatggagatctcagaccag

SEQ ID NO: 592042 - DNA, 25 bp, Mus musculus
ggacctgatgtaattgccaaagcca

SEQ ID NO: 592043 - DNA, 25 bp, Mus musculus
ggacctgatgtatttgccaaagcca

SEQ ID NO: 592044 - DNA, 25 bp, Mus musculus
ggacctgatgtcagtgcatttttct

SEQ ID NO: 592045 - DNA, 25 bp, Mus musculus
ggacctgatgtctgtgcatttttct

SEQ ID NO: 592046 - DNA, 25 bp, Mus musculus
ggacctgattataagcttagttgct

SEQ ID NO: 592047 - DNA, 25 bp, Mus musculus
ggacctgattattagcttagttgct

SEQ ID NO: 592048 - DNA, 25 bp, Mus musculus
ggacctgcaaccacaaaacatctta

SEQ ID NO: 592049 - DNA, 25 bp, Mus musculus
ggacctgcaacctcaaaacatctta

SEQ ID NO: 592050 - DNA, 25 bp, Mus musculus
ggacctgcagagcaatactgactaa

SEQ ID NO: 592051 - DNA, 25 bp, Mus musculus
ggacctgcagaggaatactgactaa

SEQ ID NO: 592052 - DNA, 25 bp, Mus musculus
ggacctgcaggaagatgcctctgtg

SEQ ID NO: 592053 - DNA, 25 bp, Mus musculus
ggacctgcaggatgatgcctctgtg

SEQ ID NO: 592054 - DNA, 25 bp, Mus musculus
ggacctgcataaccttaacaaacgg

SEQ ID NO: 592055 - DNA, 25 bp, Mus musculus
ggacctgcataagcttaacaaacgg

SEQ ID NO: 592056 - DNA, 25 bp, Mus musculus
ggacctgcatccagaaggtgaattt

SEQ ID NO: 592057 - DNA, 25 bp, Mus musculus
ggacctgcatcctgaaggtgaattt

SEQ ID NO: 592058 - DNA, 25 bp, Mus musculus
ggacctgccactattgactgtggat

SEQ ID NO: 592059 - DNA, 25 bp, Mus musculus
ggacctgccacttttgactgtggat

SEQ ID NO: 592060 - DNA, 25 bp, Mus musculus
ggacctgccagcacggaacaaggct

SEQ ID NO: 592061 - DNA, 25 bp, Mus musculus
ggacctgccagctcggaacaaggct

SEQ ID NO: 592062 - DNA, 25 bp, Mus musculus
ggacctgccatcattatcggctggg

SEQ ID NO: 592063 - DNA, 25 bp, Mus musculus
ggacctgccatctttatcggctggg

SEQ ID NO: 592064 - DNA, 25 bp, Mus musculus
ggacctgccattatacttgactgat

SEQ ID NO: 592065 - DNA, 25 bp, Mus musculus
ggacctgccattttacttgactgat

SEQ ID NO: 592066 - DNA, 25 bp, Mus musculus
ggacctgcccaacagccaggaggct

SEQ ID NO: 592067 - DNA, 25 bp, Mus musculus
ggacctgcccaagagccaggaggct

SEQ ID NO: 592068 - DNA, 25 bp, Mus musculus
ggacctgcccccaagatatgaagaa

SEQ ID NO: 592069 - DNA, 25 bp, Mus musculus
ggacctgccccctagatatgaagaa

SEQ ID NO: 592070 - DNA, 25 bp, Mus musculus
ggacctgcccctatggaagcaagtg

SEQ ID NO: 592071 - DNA, 25 bp, Mus musculus
ggacctgcccctttggaagcaagtg

SEQ ID NO: 592072 - DNA, 25 bp, Mus musculus
ggacctgcccgaaccagctagctaa

SEQ ID NO: 592073 - DNA, 25 bp, Mus musculus
ggacctgcccgatccagctagctaa

SEQ ID NO: 592074 - DNA, 25 bp, Mus musculus
ggacctgccggtcatttaagtgatt

SEQ ID NO: 592075 - DNA, 25 bp, Mus musculus
ggacctgccggtgatttaagtgatt

SEQ ID NO: 592076 - DNA, 25 bp, Mus musculus
ggacctgcctgaaggactcggatga

SEQ ID NO: 592077 - DNA, 25 bp, Mus musculus
ggacctgcctgatggactcggatga

SEQ ID NO: 592078 - DNA, 25 bp, Mus musculus
ggacctgcgattatgaaacaccact

SEQ ID NO: 592079 - DNA, 25 bp, Mus musculus
ggacctgcgattttgaaacaccact

SEQ ID NO: 592080 - DNA, 25 bp, Mus musculus
ggacctgcgcagcaccttttttgcg

SEQ ID NO: 592081 - DNA, 25 bp, Mus musculus
ggacctgcgcaggaccttttttgcg

SEQ ID NO: 592082 - DNA, 25 bp, Mus musculus
ggacctgcgcggcaagaagaaggag

SEQ ID NO: 592083 - DNA, 25 bp, Mus musculus
ggacctgcgcgggaagaagaaggag

SEQ ID NO: 592084 - DNA, 25 bp, Mus musculus
ggacctgcggctacagtgcgatgca

SEQ ID NO: 592085 - DNA, 25 bp, Mus musculus
ggacctgcggcttcagtgcgatgca

SEQ ID NO: 592086 - DNA, 25 bp, Mus musculus
ggacctgctccacagatatggtcaa

SEQ ID NO: 592087 - DNA, 25 bp, Mus musculus
ggacctgctccagagatatggtcaa

SEQ ID NO: 592088 - DNA, 25 bp, Mus musculus
ggacctgctggaaaagctcgtgctc

SEQ ID NO: 592089 - DNA, 25 bp, Mus musculus
ggacctgctggataagctcgtgctc

SEQ ID NO: 592090 - DNA, 25 bp, Mus musculus
ggacctgctgtcataaatgtgtgaa

SEQ ID NO: 592091 - DNA, 25 bp, Mus musculus
ggacctgctgtcatactcttgtggc

SEQ ID NO: 592092 - DNA, 25 bp, Mus musculus
ggacctgctgtcttaaatgtgtgaa

SEQ ID NO: 592093 - DNA, 25 bp, Mus musculus
ggacctgctgtcttactcttgtggc

SEQ ID NO: 592094 - DNA, 25 bp, Mus musculus
ggacctgcttttagaatcagctttc

SEQ ID NO: 592095 - DNA, 25 bp, Mus musculus
ggacctgcttttcagtgatgacaca

SEQ ID NO: 592096 - DNA, 25 bp, Mus musculus
ggacctgcttttgagtgatgacaca

SEQ ID NO: 592097 - DNA, 25 bp, Mus musculus
ggacctgctttttgaatcagctttc

SEQ ID NO: 592098 - DNA, 25 bp, Mus musculus
ggacctggaagtaggagccacctta

SEQ ID NO: 592099 - DNA, 25 bp, Mus musculus
ggacctggaagtcagactcttaatc

SEQ ID NO: 592100 - DNA, 25 bp, Mus musculus
ggacctggaagtctcagagctgtct

SEQ ID NO: 592101 - DNA, 25 bp, Mus musculus
ggacctggaagtgagactcttaatc

SEQ ID NO: 592102 - DNA, 25 bp, Mus musculus
ggacctggaagtgtcagagctgtct

SEQ ID NO: 592103 - DNA, 25 bp, Mus musculus
ggacctggaagttggagccacctta

SEQ ID NO: 592104 - DNA, 25 bp, Mus musculus
ggacctggacctattagagagctct

SEQ ID NO: 592105 - DNA, 25 bp, Mus musculus
ggacctggaccttttagagagctct

SEQ ID NO: 592106 - DNA, 25 bp, Mus musculus
ggacctggacgcatgaagcaatcct

SEQ ID NO: 592107 - DNA, 25 bp, Mus musculus
ggacctggacgcttgaagcaatcct

SEQ ID NO: 592108 - DNA, 25 bp, Mus musculus
ggacctggacttcagctgcacagac

SEQ ID NO: 592109 - DNA, 25 bp, Mus musculus
ggacctggacttgagctgcacagac

SEQ ID NO: 592110 - DNA, 25 bp, Mus musculus
ggacctggagagcaacccacgcatg

SEQ ID NO: 592111 - DNA, 25 bp, Mus musculus
ggacctggagaggaacccacgcatg

SEQ ID NO: 592112 - DNA, 25 bp, Mus musculus
ggacctggagatcattgtcatcttg

SEQ ID NO: 592113 - DNA, 25 bp, Mus musculus
ggacctggagatgattgtcatcttg

SEQ ID NO: 592114 - DNA, 25 bp, Mus musculus
ggacctggagtcatcatagcaagcc

SEQ ID NO: 592115 - DNA, 25 bp, Mus musculus
ggacctggagtcttcatagcaagcc

SEQ ID NO: 592116 - DNA, 25 bp, Mus musculus
ggacctggagtgaaatggctagttt

SEQ ID NO: 592117 - DNA, 25 bp, Mus musculus
ggacctggagtgtaatggctagttt

SEQ ID NO: 592118 - DNA, 25 bp, Mus musculus
ggacctggataaacgaggcttgtca

SEQ ID NO: 592119 - DNA, 25 bp, Mus musculus
ggacctggataatcgaggcttgtca

SEQ ID NO: 592120 - DNA, 25 bp, Mus musculus
ggacctggatgcagatgagttagaa

SEQ ID NO: 592121 - DNA, 25 bp, Mus musculus
ggacctggatgccaatatgttacag

SEQ ID NO: 592122 - DNA, 25 bp, Mus musculus
ggacctggatgcgaatatgttacag

SEQ ID NO: 592123 - DNA, 25 bp, Mus musculus
ggacctggatgctgatgagttagaa

SEQ ID NO: 592124 - DNA, 25 bp, Mus musculus
ggacctggcacacataggcgcttaa

SEQ ID NO: 592125 - DNA, 25 bp, Mus musculus
ggacctggcacagataggcgcttaa

SEQ ID NO: 592126 - DNA, 25 bp, Mus musculus
ggacctggcagaagaactgatcaca

SEQ ID NO: 592127 - DNA, 25 bp, Mus musculus
ggacctggcagatgaactgatcaca

SEQ ID NO: 592128 - DNA, 25 bp, Mus musculus
ggacctggcccaataagaggcctca

SEQ ID NO: 592129 - DNA, 25 bp, Mus musculus
ggacctggcccattaagaggcctca

SEQ ID NO: 592130 - DNA, 25 bp, Mus musculus
ggacctggcgagagagtttctacct

SEQ ID NO: 592131 - DNA, 25 bp, Mus musculus
ggacctggcgagtgagtttctacct

SEQ ID NO: 592132 - DNA, 25 bp, Mus musculus
ggacctggctaaacaagtatttgca

SEQ ID NO: 592133 - DNA, 25 bp, Mus musculus
ggacctggctaatcaagtatttgca

SEQ ID NO: 592134 - DNA, 25 bp, Mus musculus
ggacctggctagaactgactggatc

SEQ ID NO: 592135 - DNA, 25 bp, Mus musculus
ggacctggctagtactgactggatc

SEQ ID NO: 592136 - DNA, 25 bp, Mus musculus
ggacctggctcaatgcagttctgga

SEQ ID NO: 592137 - DNA, 25 bp, Mus musculus
ggacctggctcattgcagttctgga

SEQ ID NO: 592138 - DNA, 25 bp, Mus musculus
ggacctggctctcttgtacagtgta

SEQ ID NO: 592139 - DNA, 25 bp, Mus musculus
ggacctggctctgttgtacagtgta

SEQ ID NO: 592140 - DNA, 25 bp, Mus musculus
ggacctgggaccagctccagagcgt

SEQ ID NO: 592141 - DNA, 25 bp, Mus musculus
ggacctgggacctgctccagagcgt

SEQ ID NO: 592142 - DNA, 25 bp, Mus musculus
ggacctgggcacatagtaaaacaca

SEQ ID NO: 592143 - DNA, 25 bp, Mus musculus
ggacctgggcaccatggacttagct

SEQ ID NO: 592144 - DNA, 25 bp, Mus musculus
ggacctgggcacgatggacttagct

SEQ ID NO: 592145 - DNA, 25 bp, Mus musculus
ggacctgggcacttagtaaaacaca

SEQ ID NO: 592146 - DNA, 25 bp, Mus musculus
ggacctgggctacatctacttctac

SEQ ID NO: 592147 - DNA, 25 bp, Mus musculus
ggacctgggctagatctacttctac

SEQ ID NO: 592148 - DNA, 25 bp, Mus musculus
ggacctgggctcacttgtagcgtag

SEQ ID NO: 592149 - DNA, 25 bp, Mus musculus
ggacctgggctctcttgtagcgtag

SEQ ID NO: 592150 - DNA, 25 bp, Mus musculus
ggacctgggtacacctagtgagaaa

SEQ ID NO: 592151 - DNA, 25 bp, Mus musculus
ggacctgggtactcctagtgagaaa

SEQ ID NO: 592152 - DNA, 25 bp, Mus musculus
ggacctgggtcaccttgctttgtag

SEQ ID NO: 592153 - DNA, 25 bp, Mus musculus
ggacctgggtcagcttgctttgtag

SEQ ID NO: 592154 - DNA, 25 bp, Mus musculus
ggacctgggtccagtttgtcatacc

SEQ ID NO: 592155 - DNA, 25 bp, Mus musculus
ggacctgggtcctgtttgtcatacc

SEQ ID NO: 592156 - DNA, 25 bp, Mus musculus
ggacctgggttccaattcaaaacag

SEQ ID NO: 592157 - DNA, 25 bp, Mus musculus
ggacctgggttcgaattcaaaacag

SEQ ID NO: 592158 - DNA, 25 bp, Mus musculus
ggacctggtcatcgccaagatggat

SEQ ID NO: 592159 - DNA, 25 bp, Mus musculus
ggacctggtcatggccaagatggat

SEQ ID NO: 592160 - DNA, 25 bp, Mus musculus
ggacctggtccaagagtacattgag

SEQ ID NO: 592161 - DNA, 25 bp, Mus musculus
ggacctggtccatgagtacattgag

SEQ ID NO: 592162 - DNA, 25 bp, Mus musculus
ggacctggtgaaagtctggcaccca

SEQ ID NO: 592163 - DNA, 25 bp, Mus musculus
ggacctggtgaatgtctggcaccca

SEQ ID NO: 592164 - DNA, 25 bp, Mus musculus
ggacctggtgacacattattctgaa

SEQ ID NO: 592165 - DNA, 25 bp, Mus musculus
ggacctggtgactcattattctgaa

SEQ ID NO: 592166 - DNA, 25 bp, Mus musculus
ggacctggtgtcctggattttatga

SEQ ID NO: 592167 - DNA, 25 bp, Mus musculus
ggacctggtgtcgtggattttatga

SEQ ID NO: 592168 - DNA, 25 bp, Mus musculus
ggacctggtgttcaacttctacaag

SEQ ID NO: 592169 - DNA, 25 bp, Mus musculus
ggacctggtgttgaacttctacaag

SEQ ID NO: 592170 - DNA, 25 bp, Mus musculus
ggacctgtaactacattgtcggcat

SEQ ID NO: 592171 - DNA, 25 bp, Mus musculus
ggacctgtaactagatggagaccac

SEQ ID NO: 592172 - DNA, 25 bp, Mus musculus
ggacctgtaacttcattgtcggcat

SEQ ID NO: 592173 - DNA, 25 bp, Mus musculus
ggacctgtaacttgatggagaccac

SEQ ID NO: 592174 - DNA, 25 bp, Mus musculus
ggacctgtaaggcttctgctttcaa

SEQ ID NO: 592175 - DNA, 25 bp, Mus musculus
ggacctgtaagggttctgctttcaa

SEQ ID NO: 592176 - DNA, 25 bp, Mus musculus
ggacctgtacctaaaacttgctcca

SEQ ID NO: 592177 - DNA, 25 bp, Mus musculus
ggacctgtaccttaaacttgctcca

SEQ ID NO: 592178 - DNA, 25 bp, Mus musculus
ggacctgtacgtcccgcggaaatgc

SEQ ID NO: 592179 - DNA, 25 bp, Mus musculus
ggacctgtacgtgccgcggaaatgc

SEQ ID NO: 592180 - DNA, 25 bp, Mus musculus
ggacctgtagcccagaaacaagaaa

SEQ ID NO: 592181 - DNA, 25 bp, Mus musculus
ggacctgtagccgagaaacaagaaa

SEQ ID NO: 592182 - DNA, 25 bp, Mus musculus
ggacctgtagttacagctacaaccc

SEQ ID NO: 592183 - DNA, 25 bp, Mus musculus
ggacctgtagtttcagctacaaccc

SEQ ID NO: 592184 - DNA, 25 bp, Mus musculus
ggacctgtataacaaagcactaata

SEQ ID NO: 592185 - DNA, 25 bp, Mus musculus
ggacctgtataagaaagcactaata

SEQ ID NO: 592186 - DNA, 25 bp, Mus musculus
ggacctgtatctaaatgctagcata

SEQ ID NO: 592187 - DNA, 25 bp, Mus musculus
ggacctgtatcttaatgctagcata

SEQ ID NO: 592188 - DNA, 25 bp, Mus musculus
ggacctgtcacgacagtggccagaa

SEQ ID NO: 592189 - DNA, 25 bp, Mus musculus
ggacctgtcacgtcagtggccagaa

SEQ ID NO: 592190 - DNA, 25 bp, Mus musculus
ggacctgtcactatagtcatcagaa

SEQ ID NO: 592191 - DNA, 25 bp, Mus musculus
ggacctgtcactttagtcatcagaa

SEQ ID NO: 592192 - DNA, 25 bp, Mus musculus
ggacctgtccaactgttggcacgaa

SEQ ID NO: 592193 - DNA, 25 bp, Mus musculus
ggacctgtccaagtgttggcacgaa

SEQ ID NO: 592194 - DNA, 25 bp, Mus musculus
ggacctgtcccgacaaagactaatg

SEQ ID NO: 592195 - DNA, 25 bp, Mus musculus
ggacctgtcccgtcaaagactaatg

SEQ ID NO: 592196 - DNA, 25 bp, Mus musculus
ggacctgtcgccagtttgacaagct

SEQ ID NO: 592197 - DNA, 25 bp, Mus musculus
ggacctgtcgcctgtttgacaagct

SEQ ID NO: 592198 - DNA, 25 bp, Mus musculus
ggacctgtgatcagggactaccatg

SEQ ID NO: 592199 - DNA, 25 bp, Mus musculus
ggacctgtgatctgggactaccatg

SEQ ID NO: 592200 - DNA, 25 bp, Mus musculus
ggacctgtgccaaggaaccagtctg

SEQ ID NO: 592201 - DNA, 25 bp, Mus musculus
ggacctgtgccatggaaccagtctg

SEQ ID NO: 592202 - DNA, 25 bp, Mus musculus
ggacctgtgcctaactgtggtggac

SEQ ID NO: 592203 - DNA, 25 bp, Mus musculus
ggacctgtgccttactgtggtggac

SEQ ID NO: 592204 - DNA, 25 bp, Mus musculus
ggacctgtgctaatcactggagttt

SEQ ID NO: 592205 - DNA, 25 bp, Mus musculus
ggacctgtgctattcactggagttt

SEQ ID NO: 592206 - DNA, 25 bp, Mus musculus
ggacctgtggcgaccatgtctggac

SEQ ID NO: 592207 - DNA, 25 bp, Mus musculus
ggacctgtggcgtccatgtctggac

SEQ ID NO: 592208 - DNA, 25 bp, Mus musculus
ggacctgtggtcatccagtgatggc

SEQ ID NO: 592209 - DNA, 25 bp, Mus musculus
ggacctgtggtcttccagtgatggc

SEQ ID NO: 592210 - DNA, 25 bp, Mus musculus
ggacctgtgtgtatcggtgtgatca

SEQ ID NO: 592211 - DNA, 25 bp, Mus musculus
ggacctgtgtgtttcggtgtgatca

SEQ ID NO: 592212 - DNA, 25 bp, Mus musculus
ggacctgttgcaattcatggattca

SEQ ID NO: 592213 - DNA, 25 bp, Mus musculus
ggacctgttgcatttcatggattca

SEQ ID NO: 592214 - DNA, 25 bp, Mus musculus
ggacctgttggcagtgcccacagaa

SEQ ID NO: 592215 - DNA, 25 bp, Mus musculus
ggacctgttggccactttctctgag

SEQ ID NO: 592216 - DNA, 25 bp, Mus musculus
ggacctgttggcgactttctctgag

SEQ ID NO: 592217 - DNA, 25 bp, Mus musculus
ggacctgttggctgtgcccacagaa

SEQ ID NO: 592218 - DNA, 25 bp, Mus musculus
ggacctgtttctcctcaaagagcta

SEQ ID NO: 592219 - DNA, 25 bp, Mus musculus
ggacctgtttctgctcaaagagcta

SEQ ID NO: 592220 - DNA, 25 bp, Mus musculus
ggacctgtttgacttggacagttct

SEQ ID NO: 592221 - DNA, 25 bp, Mus musculus
ggacctgtttgagttggacagttct

SEQ ID NO: 592222 - DNA, 25 bp, Mus musculus
ggacctgttttcagtcttagttatt

SEQ ID NO: 592223 - DNA, 25 bp, Mus musculus
ggacctgttttctgtcttagttatt

SEQ ID NO: 592224 - DNA, 25 bp, Mus musculus
ggaccttaaccaatgggcctcaggc

SEQ ID NO: 592225 - DNA, 25 bp, Mus musculus
ggaccttaaccattgggcctcaggc

SEQ ID NO: 592226 - DNA, 25 bp, Mus musculus
ggaccttaatttctgcagttcattt

SEQ ID NO: 592227 - DNA, 25 bp, Mus musculus
ggaccttaatttgtgcagttcattt

SEQ ID NO: 592228 - DNA, 25 bp, Mus musculus
ggaccttacaggagctcattagcaa

SEQ ID NO: 592229 - DNA, 25 bp, Mus musculus
ggaccttacaggtgctcattagcaa

SEQ ID NO: 592230 - DNA, 25 bp, Mus musculus
ggaccttacggcaatcggcctggat

SEQ ID NO: 592231 - DNA, 25 bp, Mus musculus
ggaccttacggctatcggcctggat

SEQ ID NO: 592232 - DNA, 25 bp, Mus musculus
ggaccttactcaaccagtagaagat

SEQ ID NO: 592233 - DNA, 25 bp, Mus musculus
ggaccttactcatccagtagaagat

SEQ ID NO: 592234 - DNA, 25 bp, Mus musculus
ggaccttagggaagcgccctgatgt

SEQ ID NO: 592235 - DNA, 25 bp, Mus musculus
ggaccttagggatgcgccctgatgt

SEQ ID NO: 592236 - DNA, 25 bp, Mus musculus
ggaccttagtggacagagagtttct

SEQ ID NO: 592237 - DNA, 25 bp, Mus musculus
ggaccttagtggtcagagagtttct

SEQ ID NO: 592238 - DNA, 25 bp, Mus musculus
ggaccttatagaaaatcatttgttt

SEQ ID NO: 592239 - DNA, 25 bp, Mus musculus
ggaccttatagataatcatttgttt

SEQ ID NO: 592240 - DNA, 25 bp, Mus musculus
ggaccttatcccagagttaccatta

SEQ ID NO: 592241 - DNA, 25 bp, Mus musculus
ggaccttatccctgagttaccatta

SEQ ID NO: 592242 - DNA, 25 bp, Mus musculus
ggaccttcaccaaggagtcctgttg

SEQ ID NO: 592243 - DNA, 25 bp, Mus musculus
ggaccttcaccacaaagagactttt

SEQ ID NO: 592244 - DNA, 25 bp, Mus musculus
ggaccttcaccagaaagagactttt

SEQ ID NO: 592245 - DNA, 25 bp, Mus musculus
ggaccttcaccatggagtcctgttg

SEQ ID NO: 592246 - DNA, 25 bp, Mus musculus
ggaccttcactacaagatcttaccg

SEQ ID NO: 592247 - DNA, 25 bp, Mus musculus
ggaccttcactagaagatcttaccg

SEQ ID NO: 592248 - DNA, 25 bp, Mus musculus
ggaccttcagcgacctgtcatttct

SEQ ID NO: 592249 - DNA, 25 bp, Mus musculus
ggaccttcagcgtcctgtcatttct

SEQ ID NO: 592250 - DNA, 25 bp, Mus musculus
ggaccttcatgtcggcagtaccttg

SEQ ID NO: 592251 - DNA, 25 bp, Mus musculus
ggaccttcatgtgggcagtaccttg

SEQ ID NO: 592252 - DNA, 25 bp, Mus musculus
ggaccttccactagctcaatcagga

SEQ ID NO: 592253 - DNA, 25 bp, Mus musculus
ggaccttccacttgctcaatcagga

SEQ ID NO: 592254 - DNA, 25 bp, Mus musculus
ggaccttccagacaacagtaatgct

SEQ ID NO: 592255 - DNA, 25 bp, Mus musculus
ggaccttccagagaacagtaatgct

SEQ ID NO: 592256 - DNA, 25 bp, Mus musculus
ggaccttccagtcaatgtttgacct

SEQ ID NO: 592257 - DNA, 25 bp, Mus musculus
ggaccttccagtgaatgtttgacct

SEQ ID NO: 592258 - DNA, 25 bp, Mus musculus
ggaccttccctcagacaagaggaca

SEQ ID NO: 592259 - DNA, 25 bp, Mus musculus
ggaccttccctctgacaagaggaca

SEQ ID NO: 592260 - DNA, 25 bp, Mus musculus
ggaccttcctagactctataagaca

SEQ ID NO: 592261 - DNA, 25 bp, Mus musculus
ggaccttcctagtctctataagaca

SEQ ID NO: 592262 - DNA, 25 bp, Mus musculus
ggaccttcctgaattttaacagcct

SEQ ID NO: 592263 - DNA, 25 bp, Mus musculus
ggaccttcctgatttttaacagcct

SEQ ID NO: 592264 - DNA, 25 bp, Mus musculus
ggaccttcctttaattgtaagcgag

SEQ ID NO: 592265 - DNA, 25 bp, Mus musculus
ggaccttccttttattgtaagcgag

SEQ ID NO: 592266 - DNA, 25 bp, Mus musculus
ggaccttcgaccaagctttgtcttt

SEQ ID NO: 592267 - DNA, 25 bp, Mus musculus
ggaccttcgacctagctttgtcttt

SEQ ID NO: 592268 - DNA, 25 bp, Mus musculus
ggaccttcgcacattgattgactac

SEQ ID NO: 592269 - DNA, 25 bp, Mus musculus
ggaccttcgcactttgattgactac

SEQ ID NO: 592270 - DNA, 25 bp, Mus musculus
ggaccttcgcggcaaatatgtcacc

SEQ ID NO: 592271 - DNA, 25 bp, Mus musculus
ggaccttcgcgggaaatatgtcacc

SEQ ID NO: 592272 - DNA, 25 bp, Mus musculus
ggaccttcggaacctcagtttcttg

SEQ ID NO: 592273 - DNA, 25 bp, Mus musculus
ggaccttcggaagctcagtttcttg

SEQ ID NO: 592274 - DNA, 25 bp, Mus musculus
ggaccttcggacagtaaagcacttc

SEQ ID NO: 592275 - DNA, 25 bp, Mus musculus
ggaccttcggactgtaaagcacttc

SEQ ID NO: 592276 - DNA, 25 bp, Mus musculus
ggaccttctacaatctgtcatgaac

SEQ ID NO: 592277 - DNA, 25 bp, Mus musculus
ggaccttctacattctgtcatgaac

SEQ ID NO: 592278 - DNA, 25 bp, Mus musculus
ggaccttctatgagcaaggcgcctt

SEQ ID NO: 592279 - DNA, 25 bp, Mus musculus
ggaccttctatgtgcaaggcgcctt

SEQ ID NO: 592280 - DNA, 25 bp, Mus musculus
ggaccttctcagcagtaacacatca

SEQ ID NO: 592281 - DNA, 25 bp, Mus musculus
ggaccttctcaggagtaacacatca

SEQ ID NO: 592282 - DNA, 25 bp, Mus musculus
ggaccttctccacacatatatctaa

SEQ ID NO: 592283 - DNA, 25 bp, Mus musculus
ggaccttctccagacatatatctaa

SEQ ID NO: 592284 - DNA, 25 bp, Mus musculus
ggaccttctgcaaacctgtttagaa

SEQ ID NO: 592285 - DNA, 25 bp, Mus musculus
ggaccttctgcaagctagggctcag

SEQ ID NO: 592286 - DNA, 25 bp, Mus musculus
ggaccttctgcatacctgtttagaa

SEQ ID NO: 592287 - DNA, 25 bp, Mus musculus
ggaccttctgcatgctagggctcag

SEQ ID NO: 592288 - DNA, 25 bp, Mus musculus
ggaccttctggtattcggtggccaa

SEQ ID NO: 592289 - DNA, 25 bp, Mus musculus
ggaccttctggttttcggtggccaa

SEQ ID NO: 592290 - DNA, 25 bp, Mus musculus
ggaccttcttccctagctaaagcgg

SEQ ID NO: 592291 - DNA, 25 bp, Mus musculus
ggaccttcttccgtagctaaagcgg

SEQ ID NO: 592292 - DNA, 25 bp, Mus musculus
ggaccttgagataacctggcttggc

SEQ ID NO: 592293 - DNA, 25 bp, Mus musculus
ggaccttgagattacctggcttggc

SEQ ID NO: 592294 - DNA, 25 bp, Mus musculus
ggaccttgaggaccagatcagaact

SEQ ID NO: 592295 - DNA, 25 bp, Mus musculus
ggaccttgaggacgacttcgtctat

SEQ ID NO: 592296 - DNA, 25 bp, Mus musculus
ggaccttgaggagcagatcagaact

SEQ ID NO: 592297 - DNA, 25 bp, Mus musculus
ggaccttgaggaggacttcgtctat

SEQ ID NO: 592298 - DNA, 25 bp, Mus musculus
ggaccttgatgtaatgtcacccaaa

SEQ ID NO: 592299 - DNA, 25 bp, Mus musculus
ggaccttgatgttatgtcacccaaa

SEQ ID NO: 592300 - DNA, 25 bp, Mus musculus
ggaccttgcaaaacctcacactgtg

SEQ ID NO: 592301 - DNA, 25 bp, Mus musculus
ggaccttgcaaatcctcacactgtg

SEQ ID NO: 592302 - DNA, 25 bp, Mus musculus
ggaccttgcaacacttttgtgcgtt

SEQ ID NO: 592303 - DNA, 25 bp, Mus musculus
ggaccttgcaactcttttgtgcgtt

SEQ ID NO: 592304 - DNA, 25 bp, Mus musculus
ggaccttgccaacattatgatggac

SEQ ID NO: 592305 - DNA, 25 bp, Mus musculus
ggaccttgccaagattatgatggac

SEQ ID NO: 592306 - DNA, 25 bp, Mus musculus
ggaccttgccagctaggctgatact

SEQ ID NO: 592307 - DNA, 25 bp, Mus musculus
ggaccttgccaggtaggctgatact

SEQ ID NO: 592308 - DNA, 25 bp, Mus musculus
ggaccttgccggcagatgctgactc

SEQ ID NO: 592309 - DNA, 25 bp, Mus musculus
ggaccttgccgggagatgctgactc

SEQ ID NO: 592310 - DNA, 25 bp, Mus musculus
ggaccttgctggagtagtcttttta

SEQ ID NO: 592311 - DNA, 25 bp, Mus musculus
ggaccttgctggtgtagtcttttta

SEQ ID NO: 592312 - DNA, 25 bp, Mus musculus
ggaccttggtgaaatttgctcactc

SEQ ID NO: 592313 - DNA, 25 bp, Mus musculus
ggaccttggtgatatttgctcactc

SEQ ID NO: 592314 - DNA, 25 bp, Mus musculus
ggaccttgtatacagagctatttta

SEQ ID NO: 592315 - DNA, 25 bp, Mus musculus
ggaccttgtatagagagctatttta

SEQ ID NO: 592316 - DNA, 25 bp, Mus musculus
ggaccttgttagaaattagagcaaa

SEQ ID NO: 592317 - DNA, 25 bp, Mus musculus
ggaccttgttagtaattagagcaaa

SEQ ID NO: 592318 - DNA, 25 bp, Mus musculus
ggaccttgttgacaggcctcagaca

SEQ ID NO: 592319 - DNA, 25 bp, Mus musculus
ggaccttgttgactgtgaactctaa

SEQ ID NO: 592320 - DNA, 25 bp, Mus musculus
ggaccttgttgagaggcctcagaca

SEQ ID NO: 592321 - DNA, 25 bp, Mus musculus
ggaccttgttgagtgtgaactctaa

SEQ ID NO: 592322 - DNA, 25 bp, Mus musculus
ggacctttactgcagagagttccct

SEQ ID NO: 592323 - DNA, 25 bp, Mus musculus
ggacctttactggagagagttccct

SEQ ID NO: 592324 - DNA, 25 bp, Mus musculus
ggacctttagcaaagacaccatatt

SEQ ID NO: 592325 - DNA, 25 bp, Mus musculus
ggacctttagcatagacaccatatt

SEQ ID NO: 592326 - DNA, 25 bp, Mus musculus
ggacctttatacactttgtggtgac

SEQ ID NO: 592327 - DNA, 25 bp, Mus musculus
ggacctttatactctttgtggtgac

SEQ ID NO: 592328 - DNA, 25 bp, Mus musculus
ggacctttcaagatgtaggctattt

SEQ ID NO: 592329 - DNA, 25 bp, Mus musculus
ggacctttcaagttgtaggctattt

SEQ ID NO: 592330 - DNA, 25 bp, Mus musculus
ggacctttcacactctgagcaggat

SEQ ID NO: 592331 - DNA, 25 bp, Mus musculus
ggacctttcacagtctgagcaggat

SEQ ID NO: 592332 - DNA, 25 bp, Mus musculus
ggacctttcactcttagtcagccat

SEQ ID NO: 592333 - DNA, 25 bp, Mus musculus
ggacctttcactgttagtcagccat

SEQ ID NO: 592334 - DNA, 25 bp, Mus musculus
ggacctttcaggaagatccagttgt

SEQ ID NO: 592335 - DNA, 25 bp, Mus musculus
ggacctttcaggtagatccagttgt

SEQ ID NO: 592336 - DNA, 25 bp, Mus musculus
ggacctttccctatggatgattcac

SEQ ID NO: 592337 - DNA, 25 bp, Mus musculus
ggacctttccctttggatgattcac

SEQ ID NO: 592338 - DNA, 25 bp, Mus musculus
ggacctttccttcccatagaagtgt

SEQ ID NO: 592339 - DNA, 25 bp, Mus musculus
ggacctttccttgccatagaagtgt

SEQ ID NO: 592340 - DNA, 25 bp, Mus musculus
ggacctttcgttcatgtagcaggaa

SEQ ID NO: 592341 - DNA, 25 bp, Mus musculus
ggacctttcgttgatgtagcaggaa

SEQ ID NO: 592342 - DNA, 25 bp, Mus musculus
ggacctttctcgatgcggaaaagat

SEQ ID NO: 592343 - DNA, 25 bp, Mus musculus
ggacctttctcgttgcggaaaagat

SEQ ID NO: 592344 - DNA, 25 bp, Mus musculus
ggacctttcttgagatggacgtgca

SEQ ID NO: 592345 - DNA, 25 bp, Mus musculus
ggacctttcttgtgatggacgtgca

SEQ ID NO: 592346 - DNA, 25 bp, Mus musculus
ggacctttctttccactgtgtgact

SEQ ID NO: 592347 - DNA, 25 bp, Mus musculus
ggacctttctttgcactgtgtgact

SEQ ID NO: 592348 - DNA, 25 bp, Mus musculus
ggacctttgagtacacctcgggata

SEQ ID NO: 592349 - DNA, 25 bp, Mus musculus
ggacctttgagttcacctcgggata

SEQ ID NO: 592350 - DNA, 25 bp, Mus musculus
ggacctttgatccactggctggata

SEQ ID NO: 592351 - DNA, 25 bp, Mus musculus
ggacctttgatcgactggctggata

SEQ ID NO: 592352 - DNA, 25 bp, Mus musculus
ggacctttgcagaagctgcacgggt

SEQ ID NO: 592353 - DNA, 25 bp, Mus musculus
ggacctttgcagtagctgcacgggt

SEQ ID NO: 592354 - DNA, 25 bp, Mus musculus
ggacctttgcgtccaagctgagcat

SEQ ID NO: 592355 - DNA, 25 bp, Mus musculus
ggacctttgcgtgcaagctgagcat

SEQ ID NO: 592356 - DNA, 25 bp, Mus musculus
ggacctttggaaacatgctcaagaa

SEQ ID NO: 592357 - DNA, 25 bp, Mus musculus
ggacctttggaatcatgctcaagaa

SEQ ID NO: 592358 - DNA, 25 bp, Mus musculus
ggacctttgtagatgtggtggatat

SEQ ID NO: 592359 - DNA, 25 bp, Mus musculus
ggacctttgtagttgtggtggatat

SEQ ID NO: 592360 - DNA, 25 bp, Mus musculus
ggacctttgtatagccattggctct

SEQ ID NO: 592361 - DNA, 25 bp, Mus musculus
ggacctttgtattgccattggctct

SEQ ID NO: 592362 - DNA, 25 bp, Mus musculus
ggacctttgtgtaaggtggcctcaa

SEQ ID NO: 592363 - DNA, 25 bp, Mus musculus
ggacctttgtgttaggtggcctcaa

SEQ ID NO: 592364 - DNA, 25 bp, Mus musculus
ggaccttttgaacaattcccatatt

SEQ ID NO: 592365 - DNA, 25 bp, Mus musculus
ggaccttttgaagaattcccatatt

SEQ ID NO: 592366 - DNA, 25 bp, Mus musculus
ggaccttttgatctgcagtagatcg

SEQ ID NO: 592367 - DNA, 25 bp, Mus musculus
ggaccttttgatgtgcagtagatcg

SEQ ID NO: 592368 - DNA, 25 bp, Mus musculus
ggaccttttgttcctgggcaagcag

SEQ ID NO: 592369 - DNA, 25 bp, Mus musculus
ggaccttttgttgctgggcaagcag

SEQ ID NO: 592370 - DNA, 25 bp, Mus musculus
ggacctttttcacttacatgatcgt

SEQ ID NO: 592371 - DNA, 25 bp, Mus musculus
ggacctttttcagttacatgatcgt

SEQ ID NO: 592372 - DNA, 25 bp, Mus musculus
ggacctttttcccatagtctggttg

SEQ ID NO: 592373 - DNA, 25 bp, Mus musculus
ggacctttttccgatagtctggttg

SEQ ID NO: 592374 - DNA, 25 bp, Mus musculus
ggacctttttgaagtagactggata

SEQ ID NO: 592375 - DNA, 25 bp, Mus musculus
ggacctttttgatgtagactggata

SEQ ID NO: 592376 - DNA, 25 bp, Mus musculus
ggacgaaaggccagtgaccatccag

SEQ ID NO: 592377 - DNA, 25 bp, Mus musculus
ggacgaaaggcctgtgaccatccag

SEQ ID NO: 592378 - DNA, 25 bp, Mus musculus
ggacgaaaggtcatcatagcatctt

SEQ ID NO: 592379 - DNA, 25 bp, Mus musculus
ggacgaaaggtcttcatagcatctt

SEQ ID NO: 592380 - DNA, 25 bp, Mus musculus
ggacgaaagtttaccaagcttctga

SEQ ID NO: 592381 - DNA, 25 bp, Mus musculus
ggacgaaagttttccaagcttctga

SEQ ID NO: 592382 - DNA, 25 bp, Mus musculus
ggacgaaatgctcaccctgaagttg

SEQ ID NO: 592383 - DNA, 25 bp, Mus musculus
ggacgaaatgctgaccctgaagttg

SEQ ID NO: 592384 - DNA, 25 bp, Mus musculus
ggacgaaatgtgaaagctctttgaa

SEQ ID NO: 592385 - DNA, 25 bp, Mus musculus
ggacgaaatgtgtaagctctttgaa

SEQ ID NO: 592386 - DNA, 25 bp, Mus musculus
ggacgaacatggctacatctctcgg

SEQ ID NO: 592387 - DNA, 25 bp, Mus musculus
ggacgaacatgggtacatctctcgg

SEQ ID NO: 592388 - DNA, 25 bp, Mus musculus
ggacgaagatcaacatcctccacca

SEQ ID NO: 592389 - DNA, 25 bp, Mus musculus
ggacgaagatcatcatcctccacca

SEQ ID NO: 592390 - DNA, 25 bp, Mus musculus
ggacgaagcaccacaggcagggccc

SEQ ID NO: 592391 - DNA, 25 bp, Mus musculus
ggacgaagcacctcaggcagggccc

SEQ ID NO: 592392 - DNA, 25 bp, Mus musculus
ggacgaagccagagacttcacaata

SEQ ID NO: 592393 - DNA, 25 bp, Mus musculus
ggacgaagccagtgacttcacaata

SEQ ID NO: 592394 - DNA, 25 bp, Mus musculus
ggacgaagctcaacagattcctttt

SEQ ID NO: 592395 - DNA, 25 bp, Mus musculus
ggacgaagctcatcagattcctttt

SEQ ID NO: 592396 - DNA, 25 bp, Mus musculus
ggacgaaggccaagaaccgctttca

SEQ ID NO: 592397 - DNA, 25 bp, Mus musculus
ggacgaaggccatgaaccgctttca

SEQ ID NO: 592398 - DNA, 25 bp, Mus musculus
ggacgaaggtaaagtacagcacaat

SEQ ID NO: 592399 - DNA, 25 bp, Mus musculus
ggacgaaggtaatgtacagcacaat

SEQ ID NO: 592400 - DNA, 25 bp, Mus musculus
ggacgaatccctattcagctatggt

SEQ ID NO: 592401 - DNA, 25 bp, Mus musculus
ggacgaatcccttttcagctatggt

SEQ ID NO: 592402 - DNA, 25 bp, Mus musculus
ggacgaatcctaccttgaagtcttc

SEQ ID NO: 592403 - DNA, 25 bp, Mus musculus
ggacgaatcctagcttgaagtcttc

SEQ ID NO: 592404 - DNA, 25 bp, Mus musculus
ggacgaatgccaccaagcatgtgtt

SEQ ID NO: 592405 - DNA, 25 bp, Mus musculus
ggacgaatgccagcaagcatgtgtt

SEQ ID NO: 592406 - DNA, 25 bp, Mus musculus
ggacgacaaatacaattctggcctc

SEQ ID NO: 592407 - DNA, 25 bp, Mus musculus
ggacgacaaatagaattctggcctc

SEQ ID NO: 592408 - DNA, 25 bp, Mus musculus
ggacgacaacttaatggaccctgaa

SEQ ID NO: 592409 - DNA, 25 bp, Mus musculus
ggacgacaactttatggaccctgaa

SEQ ID NO: 592410 - DNA, 25 bp, Mus musculus
ggacgacaagaaagatccggaagct

SEQ ID NO: 592411 - DNA, 25 bp, Mus musculus
ggacgacaagaatgatccggaagct

SEQ ID NO: 592412 - DNA, 25 bp, Mus musculus
ggacgacaagatcggcctcaagttc

SEQ ID NO: 592413 - DNA, 25 bp, Mus musculus
ggacgacaagatgggcctcaagttc

SEQ ID NO: 592414 - DNA, 25 bp, Mus musculus
ggacgacaaggtaggccaccgagaa

SEQ ID NO: 592415 - DNA, 25 bp, Mus musculus
ggacgacaaggttggccaccgagaa

SEQ ID NO: 592416 - DNA, 25 bp, Mus musculus
ggacgacaggaaccattgtctcctc

SEQ ID NO: 592417 - DNA, 25 bp, Mus musculus
ggacgacaggaagcattgtctcctc

SEQ ID NO: 592418 - DNA, 25 bp, Mus musculus
ggacgacatgcacgccaaactaaca

SEQ ID NO: 592419 - DNA, 25 bp, Mus musculus
ggacgacatgcaggccaaactaaca

SEQ ID NO: 592420 - DNA, 25 bp, Mus musculus
ggacgaccacacaatgtgcagccca

SEQ ID NO: 592421 - DNA, 25 bp, Mus musculus
ggacgaccacactatgtgcagccca

SEQ ID NO: 592422 - DNA, 25 bp, Mus musculus
ggacgacctcatactttttaagcta

SEQ ID NO: 592423 - DNA, 25 bp, Mus musculus
ggacgacctcattctttttaagcta

SEQ ID NO: 592424 - DNA, 25 bp, Mus musculus
ggacgacctgtgatctgacctagag

SEQ ID NO: 592425 - DNA, 25 bp, Mus musculus
ggacgacctgtgttctgacctagag

SEQ ID NO: 592426 - DNA, 25 bp, Mus musculus
ggacgacgacgacctcagcagtgat

SEQ ID NO: 592427 - DNA, 25 bp, Mus musculus
ggacgacgacgagctcagcagtgat

SEQ ID NO: 592428 - DNA, 25 bp, Mus musculus
ggacgacgccatcaggtgcagaact

SEQ ID NO: 592429 - DNA, 25 bp, Mus musculus
ggacgacgccatgaggtgcagaact

SEQ ID NO: 592430 - DNA, 25 bp, Mus musculus
ggacgactacacatctgccatagaa

SEQ ID NO: 592431 - DNA, 25 bp, Mus musculus
ggacgactacacttctgccatagaa

SEQ ID NO: 592432 - DNA, 25 bp, Mus musculus
ggacgactgcccataagaaaacgag

SEQ ID NO: 592433 - DNA, 25 bp, Mus musculus
ggacgactgcccttaagaaaacgag

SEQ ID NO: 592434 - DNA, 25 bp, Mus musculus
ggacgactggaacgacacccatccc

SEQ ID NO: 592435 - DNA, 25 bp, Mus musculus
ggacgactggaaggacacccatccc

SEQ ID NO: 592436 - DNA, 25 bp, Mus musculus
ggacgacttcgacatcgtagtcatt

SEQ ID NO: 592437 - DNA, 25 bp, Mus musculus
ggacgacttcgagatcgtagtcatt

SEQ ID NO: 592438 - DNA, 25 bp, Mus musculus
ggacgacttgcacacccaagactgg

SEQ ID NO: 592439 - DNA, 25 bp, Mus musculus
ggacgacttgcagacccaagactgg

SEQ ID NO: 592440 - DNA, 25 bp, Mus musculus
ggacgacttgttcgaatccatcctt

SEQ ID NO: 592441 - DNA, 25 bp, Mus musculus
ggacgacttgttggaatccatcctt

SEQ ID NO: 592442 - DNA, 25 bp, Mus musculus
ggacgagacattatgatctgaccat

SEQ ID NO: 592443 - DNA, 25 bp, Mus musculus
ggacgagacattttgatctgaccat

SEQ ID NO: 592444 - DNA, 25 bp, Mus musculus
ggacgagacctaaccagggtgttca

SEQ ID NO: 592445 - DNA, 25 bp, Mus musculus
ggacgagacctatccagggtgttca

SEQ ID NO: 592446 - DNA, 25 bp, Mus musculus
ggacgagatgatatttgatcctact

SEQ ID NO: 592447 - DNA, 25 bp, Mus musculus
ggacgagatgatttttgatcctact

SEQ ID NO: 592448 - DNA, 25 bp, Mus musculus
ggacgagcactcagtgatgacctac

SEQ ID NO: 592449 - DNA, 25 bp, Mus musculus
ggacgagcactctgtgatgacctac

SEQ ID NO: 592450 - DNA, 25 bp, Mus musculus
ggacgagcagatagtatttctattt

SEQ ID NO: 592451 - DNA, 25 bp, Mus musculus
ggacgagcagattgtatttctattt

SEQ ID NO: 592452 - DNA, 25 bp, Mus musculus
ggacgagcagcacacttgttgctaa

SEQ ID NO: 592453 - DNA, 25 bp, Mus musculus
ggacgagcagcagacttgttgctaa

SEQ ID NO: 592454 - DNA, 25 bp, Mus musculus
ggacgagcagtaagatctagccacc

SEQ ID NO: 592455 - DNA, 25 bp, Mus musculus
ggacgagcagtatgatctagccacc

SEQ ID NO: 592456 - DNA, 25 bp, Mus musculus
ggacgagcatctagacccttgggac

SEQ ID NO: 592457 - DNA, 25 bp, Mus musculus
ggacgagcatcttgacccttgggac

SEQ ID NO: 592458 - DNA, 25 bp, Mus musculus
ggacgagccagcatccagtagtaaa

SEQ ID NO: 592459 - DNA, 25 bp, Mus musculus
ggacgagccagcttccagtagtaaa

SEQ ID NO: 592460 - DNA, 25 bp, Mus musculus
ggacgagccccaccgactccagcag

SEQ ID NO: 592461 - DNA, 25 bp, Mus musculus
ggacgagccccagcgactccagcag

SEQ ID NO: 592462 - DNA, 25 bp, Mus musculus
ggacgagccgctcgcagcgctcgga

SEQ ID NO: 592463 - DNA, 25 bp, Mus musculus
ggacgagccgctggcagcgctcgga

SEQ ID NO: 592464 - DNA, 25 bp, Mus musculus
ggacgagcggctcttcagttccgac

SEQ ID NO: 592465 - DNA, 25 bp, Mus musculus
ggacgagcggctgttcagttccgac

SEQ ID NO: 592466 - DNA, 25 bp, Mus musculus
ggacgagctactacttagtctcaca

SEQ ID NO: 592467 - DNA, 25 bp, Mus musculus
ggacgagctacttcttagtctcaca

SEQ ID NO: 592468 - DNA, 25 bp, Mus musculus
ggacgaggaccacctagaagccttc

SEQ ID NO: 592469 - DNA, 25 bp, Mus musculus
ggacgaggaccacgcctatgctctg

SEQ ID NO: 592470 - DNA, 25 bp, Mus musculus
ggacgaggaccagctagaagccttc

SEQ ID NO: 592471 - DNA, 25 bp, Mus musculus
ggacgaggaccaggcctatgctctg

SEQ ID NO: 592472 - DNA, 25 bp, Mus musculus
ggacgaggagtcagcagccaaagtt

SEQ ID NO: 592473 - DNA, 25 bp, Mus musculus
ggacgaggagtctgcagccaaagtt

SEQ ID NO: 592474 - DNA, 25 bp, Mus musculus
ggacgaggatccagatactcccaag

SEQ ID NO: 592475 - DNA, 25 bp, Mus musculus
ggacgaggatcctgatactcccaag

SEQ ID NO: 592476 - DNA, 25 bp, Mus musculus
ggacgaggatgtattctcccaccac

SEQ ID NO: 592477 - DNA, 25 bp, Mus musculus
ggacgaggatgttttctcccaccac

SEQ ID NO: 592478 - DNA, 25 bp, Mus musculus
ggacgaggccaacaccgagaagcaa

SEQ ID NO: 592479 - DNA, 25 bp, Mus musculus
ggacgaggccaagaccgagaagcaa

SEQ ID NO: 592480 - DNA, 25 bp, Mus musculus
ggacgaggcctaagtttgattcctt

SEQ ID NO: 592481 - DNA, 25 bp, Mus musculus
ggacgaggcctatgtttgattcctt

SEQ ID NO: 592482 - DNA, 25 bp, Mus musculus
ggacgagggtccatttgttcctgca

SEQ ID NO: 592483 - DNA, 25 bp, Mus musculus
ggacgagggtccttttgttcctgca

SEQ ID NO: 592484 - DNA, 25 bp, Mus musculus
ggacgaggtggtcccaccctctaca

SEQ ID NO: 592485 - DNA, 25 bp, Mus musculus
ggacgaggtggtgccaccctctaca

SEQ ID NO: 592486 - DNA, 25 bp, Mus musculus
ggacgaggttttacccacagactct

SEQ ID NO: 592487 - DNA, 25 bp, Mus musculus
ggacgaggtttttcccacagactct

SEQ ID NO: 592488 - DNA, 25 bp, Mus musculus
ggacgagtaacaatggccccatttc

SEQ ID NO: 592489 - DNA, 25 bp, Mus musculus
ggacgagtaacattggccccatttc

SEQ ID NO: 592490 - DNA, 25 bp, Mus musculus
ggacgagtacctagcggtgccctgc

SEQ ID NO: 592491 - DNA, 25 bp, Mus musculus
ggacgagtaccttgcggtgccctgc

SEQ ID NO: 592492 - DNA, 25 bp, Mus musculus
ggacgagtcatgaaccctgaaacaa

SEQ ID NO: 592493 - DNA, 25 bp, Mus musculus
ggacgagtcatgtaccctgaaacaa

SEQ ID NO: 592494 - DNA, 25 bp, Mus musculus
ggacgagtgagactccagcagccaa

SEQ ID NO: 592495 - DNA, 25 bp, Mus musculus
ggacgagtgagagtccagcagccaa

SEQ ID NO: 592496 - DNA, 25 bp, Mus musculus
ggacgagtttaccatggcttgtgta

SEQ ID NO: 592497 - DNA, 25 bp, Mus musculus
ggacgagtttacgatggcttgtgta

SEQ ID NO: 592498 - DNA, 25 bp, Mus musculus
ggacgagtttatcgcctggcagcat

SEQ ID NO: 592499 - DNA, 25 bp, Mus musculus
ggacgagtttatggcctggcagcat

SEQ ID NO: 592500 - DNA, 25 bp, Mus musculus
ggacgataatgacctgcctctggat

SEQ ID NO: 592501 - DNA, 25 bp, Mus musculus
ggacgataatgagctgcctctggat

SEQ ID NO: 592502 - DNA, 25 bp, Mus musculus
ggacgatagctacggatctcacctc

SEQ ID NO: 592503 - DNA, 25 bp, Mus musculus
ggacgatagctagggatctcacctc

SEQ ID NO: 592504 - DNA, 25 bp, Mus musculus
ggacgatcatagatggactggccca

SEQ ID NO: 592505 - DNA, 25 bp, Mus musculus
ggacgatcatagttggactggccca

SEQ ID NO: 592506 - DNA, 25 bp, Mus musculus
ggacgatcggacaacgagagactag

SEQ ID NO: 592507 - DNA, 25 bp, Mus musculus
ggacgatcggactacgagagactag

SEQ ID NO: 592508 - DNA, 25 bp, Mus musculus
ggacgatgctttctaaggcctctta

SEQ ID NO: 592509 - DNA, 25 bp, Mus musculus
ggacgatgctttgtaaggcctctta

SEQ ID NO: 592510 - DNA, 25 bp, Mus musculus
ggacgatggcttaggcatggaccct

SEQ ID NO: 592511 - DNA, 25 bp, Mus musculus
ggacgatggctttggcatggaccct

SEQ ID NO: 592512 - DNA, 25 bp, Mus musculus
ggacgatgggatccctcattgactt

SEQ ID NO: 592513 - DNA, 25 bp, Mus musculus
ggacgatgggatgcctcattgactt

SEQ ID NO: 592514 - DNA, 25 bp, Mus musculus
ggacgatgtggacgactctcaagac

SEQ ID NO: 592515 - DNA, 25 bp, Mus musculus
ggacgatgtggaggactctcaagac

SEQ ID NO: 592516 - DNA, 25 bp, Mus musculus
ggacgatgtggtccccacgggccct

SEQ ID NO: 592517 - DNA, 25 bp, Mus musculus
ggacgatgtggtgcccacgggccct

SEQ ID NO: 592518 - DNA, 25 bp, Mus musculus
ggacgattaagtcgttcccacacac

SEQ ID NO: 592519 - DNA, 25 bp, Mus musculus
ggacgattaagtggttcccacacac

SEQ ID NO: 592520 - DNA, 25 bp, Mus musculus
ggacgattccggcatttatgtgtgt

SEQ ID NO: 592521 - DNA, 25 bp, Mus musculus
ggacgattccgggatttatgtgtgt

SEQ ID NO: 592522 - DNA, 25 bp, Mus musculus
ggacgattctgtcttttctccagac

SEQ ID NO: 592523 - DNA, 25 bp, Mus musculus
ggacgattctgtgttttctccagac

SEQ ID NO: 592524 - DNA, 25 bp, Mus musculus
ggacgattctttaccgttagaacat

SEQ ID NO: 592525 - DNA, 25 bp, Mus musculus
ggacgattcttttccgttagaacat

SEQ ID NO: 592526 - DNA, 25 bp, Mus musculus
ggacgattggagaatctccctgcct

SEQ ID NO: 592527 - DNA, 25 bp, Mus musculus
ggacgattggagtatctccctgcct

SEQ ID NO: 592528 - DNA, 25 bp, Mus musculus
ggacgattgtccagctggagaacga

SEQ ID NO: 592529 - DNA, 25 bp, Mus musculus
ggacgattgtcctgctggagaacga

SEQ ID NO: 592530 - DNA, 25 bp, Mus musculus
ggacgattttcccagcaagcccctt

SEQ ID NO: 592531 - DNA, 25 bp, Mus musculus
ggacgattttccgagcaagcccctt

SEQ ID NO: 592532 - DNA, 25 bp, Mus musculus
ggacgcaagatcagtgttggctaca

SEQ ID NO: 592533 - DNA, 25 bp, Mus musculus
ggacgcaagatctgtgttggctaca

SEQ ID NO: 592534 - DNA, 25 bp, Mus musculus
ggacgcaaggaccacccatgaggaa

SEQ ID NO: 592535 - DNA, 25 bp, Mus musculus
ggacgcaaggacgacccatgaggaa

SEQ ID NO: 592536 - DNA, 25 bp, Mus musculus
ggacgcaagggtagctgctgcctta

SEQ ID NO: 592537 - DNA, 25 bp, Mus musculus
ggacgcaagggttgctgctgcctta

SEQ ID NO: 592538 - DNA, 25 bp, Mus musculus
ggacgcaatacaagacacccagttg

SEQ ID NO: 592539 - DNA, 25 bp, Mus musculus
ggacgcaatacatgacacccagttg

SEQ ID NO: 592540 - DNA, 25 bp, Mus musculus
ggacgcacactgatgagcgacctta

SEQ ID NO: 592541 - DNA, 25 bp, Mus musculus
ggacgcacactgttgagcgacctta

SEQ ID NO: 592542 - DNA, 25 bp, Mus musculus
ggacgcacagctcgatgcttacaat

SEQ ID NO: 592543 - DNA, 25 bp, Mus musculus
ggacgcacagctggatgcttacaat

SEQ ID NO: 592544 - DNA, 25 bp, Mus musculus
ggacgcacgcacacgatgcacagga

SEQ ID NO: 592545 - DNA, 25 bp, Mus musculus
ggacgcacgcactcgatgcacagga

SEQ ID NO: 592546 - DNA, 25 bp, Mus musculus
ggacgcactgtactgcattttgcta

SEQ ID NO: 592547 - DNA, 25 bp, Mus musculus
ggacgcactgtagtgcattttgcta

SEQ ID NO: 592548 - DNA, 25 bp, Mus musculus
ggacgcagaaaccttacagcatgat

SEQ ID NO: 592549 - DNA, 25 bp, Mus musculus
ggacgcagaaacgttacagcatgat

SEQ ID NO: 592550 - DNA, 25 bp, Mus musculus
ggacgcagaatcctctctgagaact

SEQ ID NO: 592551 - DNA, 25 bp, Mus musculus
ggacgcagaatcgtctctgagaact

SEQ ID NO: 592552 - DNA, 25 bp, Mus musculus
ggacgcagacctatacatatgatgt

SEQ ID NO: 592553 - DNA, 25 bp, Mus musculus
ggacgcagacctttacatatgatgt

SEQ ID NO: 592554 - DNA, 25 bp, Mus musculus
ggacgcagctgaaatggcgcctgtt

SEQ ID NO: 592555 - DNA, 25 bp, Mus musculus
ggacgcagctgatatggcgcctgtt

SEQ ID NO: 592556 - DNA, 25 bp, Mus musculus
ggacgcaggcatcagctcagctgat

SEQ ID NO: 592557 - DNA, 25 bp, Mus musculus
ggacgcaggcatgagctcagctgat

SEQ ID NO: 592558 - DNA, 25 bp, Mus musculus
ggacgcaggtccagaaatggctgta

SEQ ID NO: 592559 - DNA, 25 bp, Mus musculus
ggacgcaggtcctgaaatggctgta

SEQ ID NO: 592560 - DNA, 25 bp, Mus musculus
ggacgcaggtctagggttttccctg

SEQ ID NO: 592561 - DNA, 25 bp, Mus musculus
ggacgcaggtcttgggttttccctg

SEQ ID NO: 592562 - DNA, 25 bp, Mus musculus
ggacgcatacctactttgttttggg

SEQ ID NO: 592563 - DNA, 25 bp, Mus musculus
ggacgcataccttctttgttttggg

SEQ ID NO: 592564 - DNA, 25 bp, Mus musculus
ggacgcatccacagcatggtgactg

SEQ ID NO: 592565 - DNA, 25 bp, Mus musculus
ggacgcatccactgcatggtgactg

SEQ ID NO: 592566 - DNA, 25 bp, Mus musculus
ggacgcatgaccatcacaagcaata

SEQ ID NO: 592567 - DNA, 25 bp, Mus musculus
ggacgcatgaccttcacaagcaata

SEQ ID NO: 592568 - DNA, 25 bp, Mus musculus
ggacgcatgcctatttacagccaaa

SEQ ID NO: 592569 - DNA, 25 bp, Mus musculus
ggacgcatgcctttttacagccaaa

SEQ ID NO: 592570 - DNA, 25 bp, Mus musculus
ggacgcatggaaaaaggcacaggaa

SEQ ID NO: 592571 - DNA, 25 bp, Mus musculus
ggacgcatggaataaggcacaggaa

SEQ ID NO: 592572 - DNA, 25 bp, Mus musculus
ggacgcatgtctattgtgttgagaa

SEQ ID NO: 592573 - DNA, 25 bp, Mus musculus
ggacgcatgtcttttgtgttgagaa

SEQ ID NO: 592574 - DNA, 25 bp, Mus musculus
ggacgcatttatatgatggtctaaa

SEQ ID NO: 592575 - DNA, 25 bp, Mus musculus
ggacgcatttatttgatggtctaaa

SEQ ID NO: 592576 - DNA, 25 bp, Mus musculus
ggacgccaattaaaacagttcagtg

SEQ ID NO: 592577 - DNA, 25 bp, Mus musculus
ggacgccaattataacagttcagtg

SEQ ID NO: 592578 - DNA, 25 bp, Mus musculus
ggacgccaccagaatagctgaggat

SEQ ID NO: 592579 - DNA, 25 bp, Mus musculus
ggacgccaccagtatagctgaggat

SEQ ID NO: 592580 - DNA, 25 bp, Mus musculus
ggacgccactgactgaaagacgcat

SEQ ID NO: 592581 - DNA, 25 bp, Mus musculus
ggacgccactgagtgaaagacgcat

SEQ ID NO: 592582 - DNA, 25 bp, Mus musculus
ggacgccagaagcacccagttcagg

SEQ ID NO: 592583 - DNA, 25 bp, Mus musculus
ggacgccagaaggacccagttcagg

SEQ ID NO: 592584 - DNA, 25 bp, Mus musculus
ggacgccagttaactcctggaggca

SEQ ID NO: 592585 - DNA, 25 bp, Mus musculus
ggacgccagttatctcctggaggca

SEQ ID NO: 592586 - DNA, 25 bp, Mus musculus
ggacgccatcagatccatgctagaa

SEQ ID NO: 592587 - DNA, 25 bp, Mus musculus
ggacgccatcagttccatgctagaa

SEQ ID NO: 592588 - DNA, 25 bp, Mus musculus
ggacgccatggactatttcccagac

SEQ ID NO: 592589 - DNA, 25 bp, Mus musculus
ggacgccatggagtatttcccagac

SEQ ID NO: 592590 - DNA, 25 bp, Mus musculus
ggacgcccagtgagaacaggcccta

SEQ ID NO: 592591 - DNA, 25 bp, Mus musculus
ggacgcccagtgtgaacaggcccta

SEQ ID NO: 592592 - DNA, 25 bp, Mus musculus
ggacgccccatcagtgtaggtcatg

SEQ ID NO: 592593 - DNA, 25 bp, Mus musculus
ggacgccccatctgtgtaggtcatg

SEQ ID NO: 592594 - DNA, 25 bp, Mus musculus
ggacgccccttgcaggtctggacca

SEQ ID NO: 592595 - DNA, 25 bp, Mus musculus
ggacgccccttggaggtctggacca

SEQ ID NO: 592596 - DNA, 25 bp, Mus musculus
ggacgccgccggcaagcactttgtt

SEQ ID NO: 592597 - DNA, 25 bp, Mus musculus
ggacgccgccgggaagcactttgtt

SEQ ID NO: 592598 - DNA, 25 bp, Mus musculus
ggacgccgtctgctttgtttcgcag

SEQ ID NO: 592599 - DNA, 25 bp, Mus musculus
ggacgccgtctggtttgtttcgcag

SEQ ID NO: 592600 - DNA, 25 bp, Mus musculus
ggacgcctcgtgattttgttttctg

SEQ ID NO: 592601 - DNA, 25 bp, Mus musculus
ggacgcctcgtgtttttgttttctg

SEQ ID NO: 592602 - DNA, 25 bp, Mus musculus
ggacgcctgttacactaatacttga

SEQ ID NO: 592603 - DNA, 25 bp, Mus musculus
ggacgcctgttagactaatacttga

SEQ ID NO: 592604 - DNA, 25 bp, Mus musculus
ggacgccttaagagatggactccgt

SEQ ID NO: 592605 - DNA, 25 bp, Mus musculus
ggacgccttaagtgatggactccgt

SEQ ID NO: 592606 - DNA, 25 bp, Mus musculus
ggacgccttgaacatagatttgcat

SEQ ID NO: 592607 - DNA, 25 bp, Mus musculus
ggacgccttgaagatagatttgcat

SEQ ID NO: 592608 - DNA, 25 bp, Mus musculus
ggacgccttgcacatttcctgtggg

SEQ ID NO: 592609 - DNA, 25 bp, Mus musculus
ggacgccttgcagatttcctgtggg

SEQ ID NO: 592610 - DNA, 25 bp, Mus musculus
ggacgccttggcatatgcccatcat

SEQ ID NO: 592611 - DNA, 25 bp, Mus musculus
ggacgccttggcttatgcccatcat

SEQ ID NO: 592612 - DNA, 25 bp, Mus musculus
ggacgcgagccacaagctgcactgt

SEQ ID NO: 592613 - DNA, 25 bp, Mus musculus
ggacgcgagccagaagctgcactgt

SEQ ID NO: 592614 - DNA, 25 bp, Mus musculus
ggacgcgcctgaacaagagcccgaa

SEQ ID NO: 592615 - DNA, 25 bp, Mus musculus
ggacgcgcctgatcaagagcccgaa

SEQ ID NO: 592616 - DNA, 25 bp, Mus musculus
ggacgcgggtacatcttcctggaac

SEQ ID NO: 592617 - DNA, 25 bp, Mus musculus
ggacgcgggtacttcttcctggaac

SEQ ID NO: 592618 - DNA, 25 bp, Mus musculus
ggacgcgtccacacaaggagatttt

SEQ ID NO: 592619 - DNA, 25 bp, Mus musculus
ggacgcgtccactcaaggagatttt

SEQ ID NO: 592620 - DNA, 25 bp, Mus musculus
ggacgctacctgcaacactggttga

SEQ ID NO: 592621 - DNA, 25 bp, Mus musculus
ggacgctacctggaacactggttga

SEQ ID NO: 592622 - DNA, 25 bp, Mus musculus
ggacgctataagctttcacacatct

SEQ ID NO: 592623 - DNA, 25 bp, Mus musculus
ggacgctataaggtttcacacatct

SEQ ID NO: 592624 - DNA, 25 bp, Mus musculus
ggacgctatgtcaaccaacaactgt

SEQ ID NO: 592625 - DNA, 25 bp, Mus musculus
ggacgctatgtctaccaacaactgt

SEQ ID NO: 592626 - DNA, 25 bp, Mus musculus
ggacgctcacttctactgcctaagt

SEQ ID NO: 592627 - DNA, 25 bp, Mus musculus
ggacgctcacttgtactgcctaagt

SEQ ID NO: 592628 - DNA, 25 bp, Mus musculus
ggacgctccagcagctggcgaagat

SEQ ID NO: 592629 - DNA, 25 bp, Mus musculus
ggacgctccagctgctggcgaagat

SEQ ID NO: 592630 - DNA, 25 bp, Mus musculus
ggacgctccgagcaatttactggta

SEQ ID NO: 592631 - DNA, 25 bp, Mus musculus
ggacgctccgaggaatttactggta

SEQ ID NO: 592632 - DNA, 25 bp, Mus musculus
ggacgctcctgtcattagggtctcc

SEQ ID NO: 592633 - DNA, 25 bp, Mus musculus
ggacgctcctgtgattagggtctcc

SEQ ID NO: 592634 - DNA, 25 bp, Mus musculus
ggacgctctgtgcatgcatttgtta

SEQ ID NO: 592635 - DNA, 25 bp, Mus musculus
ggacgctctgtggatgcatttgtta

SEQ ID NO: 592636 - DNA, 25 bp, Mus musculus
ggacgctgagaccacactcacggag

SEQ ID NO: 592637 - DNA, 25 bp, Mus musculus
ggacgctgagacgacactcacggag

SEQ ID NO: 592638 - DNA, 25 bp, Mus musculus
ggacgctgagtgacccagagaccaa

SEQ ID NO: 592639 - DNA, 25 bp, Mus musculus
ggacgctgagtgtcccagagaccaa

SEQ ID NO: 592640 - DNA, 25 bp, Mus musculus
ggacgctgatggacttaggtgtata

SEQ ID NO: 592641 - DNA, 25 bp, Mus musculus
ggacgctgatggtcttaggtgtata

SEQ ID NO: 592642 - DNA, 25 bp, Mus musculus
ggacgctgcagcagtagaccttcag

SEQ ID NO: 592643 - DNA, 25 bp, Mus musculus
ggacgctgcagctgtagaccttcag

SEQ ID NO: 592644 - DNA, 25 bp, Mus musculus
ggacgctgctacaggcaaatctgtc

SEQ ID NO: 592645 - DNA, 25 bp, Mus musculus
ggacgctgctactggcaaatctgtc

SEQ ID NO: 592646 - DNA, 25 bp, Mus musculus
ggacgctggctgaattccgtatttc

SEQ ID NO: 592647 - DNA, 25 bp, Mus musculus
ggacgctggctgtattccgtatttc

SEQ ID NO: 592648 - DNA, 25 bp, Mus musculus
ggacgctgtagcagctctgaagtgt

SEQ ID NO: 592649 - DNA, 25 bp, Mus musculus
ggacgctgtagctgctctgaagtgt

SEQ ID NO: 592650 - DNA, 25 bp, Mus musculus
ggacgctgtcagagattatcgctta

SEQ ID NO: 592651 - DNA, 25 bp, Mus musculus
ggacgctgtcagtgattatcgctta

SEQ ID NO: 592652 - DNA, 25 bp, Mus musculus
ggacgcttcgtaccagtacttgaat

SEQ ID NO: 592653 - DNA, 25 bp, Mus musculus
ggacgcttcgtagcagtacttgaat

SEQ ID NO: 592654 - DNA, 25 bp, Mus musculus
ggacgcttgaagaagtataaatctg

SEQ ID NO: 592655 - DNA, 25 bp, Mus musculus
ggacgcttgaagtagtataaatctg

SEQ ID NO: 592656 - DNA, 25 bp, Mus musculus
ggacgcttgtcactcttgcagaaga

SEQ ID NO: 592657 - DNA, 25 bp, Mus musculus
ggacgcttgtcagtcttgcagaaga

SEQ ID NO: 592658 - DNA, 25 bp, Mus musculus
ggacgctttaggcaggacctttgca

SEQ ID NO: 592659 - DNA, 25 bp, Mus musculus
ggacgctttagggaggacctttgca

SEQ ID NO: 592660 - DNA, 25 bp, Mus musculus
ggacgctttgttatataccgacagc

SEQ ID NO: 592661 - DNA, 25 bp, Mus musculus
ggacgctttgttttataccgacagc

SEQ ID NO: 592662 - DNA, 25 bp, Mus musculus
ggacggaaaatacatctaccctcaa

SEQ ID NO: 592663 - DNA, 25 bp, Mus musculus
ggacggaaaatagatctaccctcaa

SEQ ID NO: 592664 - DNA, 25 bp, Mus musculus
ggacggaaagctactcattgatgaa

SEQ ID NO: 592665 - DNA, 25 bp, Mus musculus
ggacggaaagcttctcattgatgaa

SEQ ID NO: 592666 - DNA, 25 bp, Mus musculus
ggacggacaaacctgagtttcttca

SEQ ID NO: 592667 - DNA, 25 bp, Mus musculus
ggacggacaaacgtgagtttcttca

SEQ ID NO: 592668 - DNA, 25 bp, Mus musculus
ggacggacatgcacagagagaacca

SEQ ID NO: 592669 - DNA, 25 bp, Mus musculus
ggacggacatgctcagagagaacca

SEQ ID NO: 592670 - DNA, 25 bp, Mus musculus
ggacggagacctacccccttatgat

SEQ ID NO: 592671 - DNA, 25 bp, Mus musculus
ggacggagaccttcccccttatgat

SEQ ID NO: 592672 - DNA, 25 bp, Mus musculus
ggacggagcgatactcacggaggaa

SEQ ID NO: 592673 - DNA, 25 bp, Mus musculus
ggacggagcgattctcacggaggaa

SEQ ID NO: 592674 - DNA, 25 bp, Mus musculus
ggacggaggaaaacgcgttctctct

SEQ ID NO: 592675 - DNA, 25 bp, Mus musculus
ggacggaggaaatcgcgttctctct

SEQ ID NO: 592676 - DNA, 25 bp, Mus musculus
ggacggaggcatctggcacaaccca

SEQ ID NO: 592677 - DNA, 25 bp, Mus musculus
ggacggaggcatgtggcacaaccca

SEQ ID NO: 592678 - DNA, 25 bp, Mus musculus
ggacggagtttgacagcagcctacc

SEQ ID NO: 592679 - DNA, 25 bp, Mus musculus
ggacggagtttgtcagcagcctacc

SEQ ID NO: 592680 - DNA, 25 bp, Mus musculus
ggacggatgactacccagcatcgtt

SEQ ID NO: 592681 - DNA, 25 bp, Mus musculus
ggacggatgacttcccagcatcgtt

SEQ ID NO: 592682 - DNA, 25 bp, Mus musculus
ggacggatgcggcttgctctcctcc

SEQ ID NO: 592683 - DNA, 25 bp, Mus musculus
ggacggatgcgggttgctctcctcc

SEQ ID NO: 592684 - DNA, 25 bp, Mus musculus
ggacggatgcttatactaacctgga

SEQ ID NO: 592685 - DNA, 25 bp, Mus musculus
ggacggatgcttttactaacctgga

SEQ ID NO: 592686 - DNA, 25 bp, Mus musculus
ggacggatttatccagctattttca

SEQ ID NO: 592687 - DNA, 25 bp, Mus musculus
ggacggatttatgcagctattttca

SEQ ID NO: 592688 - DNA, 25 bp, Mus musculus
ggacggcaaagcctactgtcgtaaa

SEQ ID NO: 592689 - DNA, 25 bp, Mus musculus
ggacggcaaagcgtactgtcgtaaa

SEQ ID NO: 592690 - DNA, 25 bp, Mus musculus
ggacggcaactgacaggtctgacat

SEQ ID NO: 592691 - DNA, 25 bp, Mus musculus
ggacggcaactgtcaggtctgacat

SEQ ID NO: 592692 - DNA, 25 bp, Mus musculus
ggacggcaacttactgaacatccca

SEQ ID NO: 592693 - DNA, 25 bp, Mus musculus
ggacggcaactttctgaacatccca

SEQ ID NO: 592694 - DNA, 25 bp, Mus musculus
ggacggcaatatcaacatcgatgac

SEQ ID NO: 592695 - DNA, 25 bp, Mus musculus
ggacggcaatatgaacatcgatgac

SEQ ID NO: 592696 - DNA, 25 bp, Mus musculus
ggacggcacactacatgtcactgaa

SEQ ID NO: 592697 - DNA, 25 bp, Mus musculus
ggacggcacacttcatgtcactgaa

SEQ ID NO: 592698 - DNA, 25 bp, Mus musculus
ggacggcactccattggtgaagatt

SEQ ID NO: 592699 - DNA, 25 bp, Mus musculus
ggacggcactcctttggtgaagatt

SEQ ID NO: 592700 - DNA, 25 bp, Mus musculus
ggacggcactgaagtgggctccttc

SEQ ID NO: 592701 - DNA, 25 bp, Mus musculus
ggacggcactgatgtgggctccttc

SEQ ID NO: 592702 - DNA, 25 bp, Mus musculus
ggacggcagccaagatgcccgcaag

SEQ ID NO: 592703 - DNA, 25 bp, Mus musculus
ggacggcagccatgatgcccgcaag

SEQ ID NO: 592704 - DNA, 25 bp, Mus musculus
ggacggcagctacccttttaggcat

SEQ ID NO: 592705 - DNA, 25 bp, Mus musculus
ggacggcagctagccttttaggcat

SEQ ID NO: 592706 - DNA, 25 bp, Mus musculus
ggacggcagttcagtgcactcgacc

SEQ ID NO: 592707 - DNA, 25 bp, Mus musculus
ggacggcagttctgtgcactcgacc

SEQ ID NO: 592708 - DNA, 25 bp, Mus musculus
ggacggcatttaccttcattctgat

SEQ ID NO: 592709 - DNA, 25 bp, Mus musculus
ggacggcatttagcttcattctgat

SEQ ID NO: 592710 - DNA, 25 bp, Mus musculus
ggacggccagcaccactgcaatgag

SEQ ID NO: 592711 - DNA, 25 bp, Mus musculus
ggacggccagcagcactgcaatgag

SEQ ID NO: 592712 - DNA, 25 bp, Mus musculus
ggacggcctacaccagacagcaagt

SEQ ID NO: 592713 - DNA, 25 bp, Mus musculus
ggacggcctacagcagacagcaagt

SEQ ID NO: 592714 - DNA, 25 bp, Mus musculus
ggacggcctactaagcaatgatgct

SEQ ID NO: 592715 - DNA, 25 bp, Mus musculus
ggacggcctacttagcaatgatgct

SEQ ID NO: 592716 - DNA, 25 bp, Mus musculus
ggacggcctggcagcagacacatca

SEQ ID NO: 592717 - DNA, 25 bp, Mus musculus
ggacggcctggctgcagacacatca

SEQ ID NO: 592718 - DNA, 25 bp, Mus musculus
ggacggcgcccgaaaccacggctgt

SEQ ID NO: 592719 - DNA, 25 bp, Mus musculus
ggacggcgcccgtaaccacggctgt

SEQ ID NO: 592720 - DNA, 25 bp, Mus musculus
ggacggcgcgccaatacatatcaac

SEQ ID NO: 592721 - DNA, 25 bp, Mus musculus
ggacggcgcgcctatacatatcaac

SEQ ID NO: 592722 - DNA, 25 bp, Mus musculus
ggacggcgttgcaaattatctaatt

SEQ ID NO: 592723 - DNA, 25 bp, Mus musculus
ggacggcgttgctaattatctaatt

SEQ ID NO: 592724 - DNA, 25 bp, Mus musculus
ggacggctaagaaccttcaggacca

SEQ ID NO: 592725 - DNA, 25 bp, Mus musculus
ggacggctaagatccttcaggacca

SEQ ID NO: 592726 - DNA, 25 bp, Mus musculus
ggacggctacctaactgctgagaac

SEQ ID NO: 592727 - DNA, 25 bp, Mus musculus
ggacggctaccttactgctgagaac

SEQ ID NO: 592728 - DNA, 25 bp, Mus musculus
ggacggctccggatgagaaagaact

SEQ ID NO: 592729 - DNA, 25 bp, Mus musculus
ggacggctccggttgagaaagaact

SEQ ID NO: 592730 - DNA, 25 bp, Mus musculus
ggacggctcctcattcgtggaagag

SEQ ID NO: 592731 - DNA, 25 bp, Mus musculus
ggacggctcctctttcgtggaagag

SEQ ID NO: 592732 - DNA, 25 bp, Mus musculus
ggacggctgaacagacttcctgctg

SEQ ID NO: 592733 - DNA, 25 bp, Mus musculus
ggacggctgaactgacttcctgctg

SEQ ID NO: 592734 - DNA, 25 bp, Mus musculus
ggacggctgccgctggaggtgttgg

SEQ ID NO: 592735 - DNA, 25 bp, Mus musculus
ggacggctgccggtggaggtgttgg

SEQ ID NO: 592736 - DNA, 25 bp, Mus musculus
ggacggctgctaataacactctaga

SEQ ID NO: 592737 - DNA, 25 bp, Mus musculus
ggacggctgctattaacactctaga

SEQ ID NO: 592738 - DNA, 25 bp, Mus musculus
ggacggcttagcatctggtgagact

SEQ ID NO: 592739 - DNA, 25 bp, Mus musculus
ggacggcttagcttctggtgagact

SEQ ID NO: 592740 - DNA, 25 bp, Mus musculus
ggacgggaagcgatctgctcagttt

SEQ ID NO: 592741 - DNA, 25 bp, Mus musculus
ggacgggaagcgttctgctcagttt

SEQ ID NO: 592742 - DNA, 25 bp, Mus musculus
ggacgggccattccgaataaccagg

SEQ ID NO: 592743 - DNA, 25 bp, Mus musculus
ggacgggccattgcgaataaccagg

SEQ ID NO: 592744 - DNA, 25 bp, Mus musculus
ggacgggcttatattgaactttcag

SEQ ID NO: 592745 - DNA, 25 bp, Mus musculus
ggacgggcttattttgaactttcag

SEQ ID NO: 592746 - DNA, 25 bp, Mus musculus
ggacgggcttctcgtactcacagga

SEQ ID NO: 592747 - DNA, 25 bp, Mus musculus
ggacgggcttctggtactcacagga

SEQ ID NO: 592748 - DNA, 25 bp, Mus musculus
ggacggtcagaccttcttataacct

SEQ ID NO: 592749 - DNA, 25 bp, Mus musculus
ggacggtcagacgttcttataacct

SEQ ID NO: 592750 - DNA, 25 bp, Mus musculus
ggacggtcaggcaatgcactcttta

SEQ ID NO: 592751 - DNA, 25 bp, Mus musculus
ggacggtcaggctatgcactcttta

SEQ ID NO: 592752 - DNA, 25 bp, Mus musculus
ggacggtcccttaatcagttgaatg

SEQ ID NO: 592753 - DNA, 25 bp, Mus musculus
ggacggtccctttatcagttgaatg

SEQ ID NO: 592754 - DNA, 25 bp, Mus musculus
ggacggtcgaatccacccattacag

SEQ ID NO: 592755 - DNA, 25 bp, Mus musculus
ggacggtcgaatgcacccattacag

SEQ ID NO: 592756 - DNA, 25 bp, Mus musculus
ggacggtgtcttagtttcaggtaat

SEQ ID NO: 592757 - DNA, 25 bp, Mus musculus
ggacggtgtctttgtttcaggtaat

SEQ ID NO: 592758 - DNA, 25 bp, Mus musculus
ggacggtgtggaactgcacctcctt

SEQ ID NO: 592759 - DNA, 25 bp, Mus musculus
ggacggtgtggatctgcacctcctt

SEQ ID NO: 592760 - DNA, 25 bp, Mus musculus
ggacggttcctacatcaacagtatt

SEQ ID NO: 592761 - DNA, 25 bp, Mus musculus
ggacggttcctagatcaacagtatt

SEQ ID NO: 592762 - DNA, 25 bp, Mus musculus
ggacgtacagcacgagccatgccca

SEQ ID NO: 592763 - DNA, 25 bp, Mus musculus
ggacgtacagcaggagccatgccca

SEQ ID NO: 592764 - DNA, 25 bp, Mus musculus
ggacgtactcagattgaaccaggtt

SEQ ID NO: 592765 - DNA, 25 bp, Mus musculus
ggacgtactcagtttgaaccaggtt

SEQ ID NO: 592766 - DNA, 25 bp, Mus musculus
ggacgtagagatacgtgcatcacac

SEQ ID NO: 592767 - DNA, 25 bp, Mus musculus
ggacgtagagattcgtgcatcacac

SEQ ID NO: 592768 - DNA, 25 bp, Mus musculus
ggacgtagataacattggcaaagac

SEQ ID NO: 592769 - DNA, 25 bp, Mus musculus
ggacgtagataagattggcaaagac

SEQ ID NO: 592770 - DNA, 25 bp, Mus musculus
ggacgtagcttgcaaagatttcctg

SEQ ID NO: 592771 - DNA, 25 bp, Mus musculus
ggacgtagcttggaaagatttcctg

SEQ ID NO: 592772 - DNA, 25 bp, Mus musculus
ggacgtagtgagatgcagcaaacct

SEQ ID NO: 592773 - DNA, 25 bp, Mus musculus
ggacgtagtgagttgcagcaaacct

SEQ ID NO: 592774 - DNA, 25 bp, Mus musculus
ggacgtatcggtacaggagacaact

SEQ ID NO: 592775 - DNA, 25 bp, Mus musculus
ggacgtatcggttcaggagacaact

SEQ ID NO: 592776 - DNA, 25 bp, Mus musculus
ggacgtcaactccaagcagactgaa

SEQ ID NO: 592777 - DNA, 25 bp, Mus musculus
ggacgtcaactcgaagcagactgaa

SEQ ID NO: 592778 - DNA, 25 bp, Mus musculus
ggacgtcaagtcagctctgagtact

SEQ ID NO: 592779 - DNA, 25 bp, Mus musculus
ggacgtcaagtcagggttctcatca

SEQ ID NO: 592780 - DNA, 25 bp, Mus musculus
ggacgtcaagtctgctctgagtact

SEQ ID NO: 592781 - DNA, 25 bp, Mus musculus
ggacgtcaagtctgggttctcatca

SEQ ID NO: 592782 - DNA, 25 bp, Mus musculus
ggacgtcacacaagtaccagaacag

SEQ ID NO: 592783 - DNA, 25 bp, Mus musculus
ggacgtcacacatgtaccagaacag

SEQ ID NO: 592784 - DNA, 25 bp, Mus musculus
ggacgtcacgaaataaaggatcact

SEQ ID NO: 592785 - DNA, 25 bp, Mus musculus
ggacgtcacgaattaaaggatcact

SEQ ID NO: 592786 - DNA, 25 bp, Mus musculus
ggacgtcactgtctcatgctacaat

SEQ ID NO: 592787 - DNA, 25 bp, Mus musculus
ggacgtcactgtgtcatgctacaat

SEQ ID NO: 592788 - DNA, 25 bp, Mus musculus
ggacgtcatgtccttttcagtgact

SEQ ID NO: 592789 - DNA, 25 bp, Mus musculus
ggacgtcatgtcgttttcagtgact

SEQ ID NO: 592790 - DNA, 25 bp, Mus musculus
ggacgtccacctcctggaacttctt

SEQ ID NO: 592791 - DNA, 25 bp, Mus musculus
ggacgtccacctgctggaacttctt

SEQ ID NO: 592792 - DNA, 25 bp, Mus musculus
ggacgtccccacctgggagatctga

SEQ ID NO: 592793 - DNA, 25 bp, Mus musculus
ggacgtccccacgtgggagatctga

SEQ ID NO: 592794 - DNA, 25 bp, Mus musculus
ggacgtccctgcagaataaacctct

SEQ ID NO: 592795 - DNA, 25 bp, Mus musculus
ggacgtccctgctgaataaacctct

SEQ ID NO: 592796 - DNA, 25 bp, Mus musculus
ggacgtccgtgaaggaggacctcaa

SEQ ID NO: 592797 - DNA, 25 bp, Mus musculus
ggacgtccgtgatggaggacctcaa

SEQ ID NO: 592798 - DNA, 25 bp, Mus musculus
ggacgtcctcttactgagtatagtt

SEQ ID NO: 592799 - DNA, 25 bp, Mus musculus
ggacgtcctctttctgagtatagtt

SEQ ID NO: 592800 - DNA, 25 bp, Mus musculus
ggacgtccttcgattagacttcgcg

SEQ ID NO: 592801 - DNA, 25 bp, Mus musculus
ggacgtccttcgtttagacttcgcg

SEQ ID NO: 592802 - DNA, 25 bp, Mus musculus
ggacgtcgagcccagtgttaccacc

SEQ ID NO: 592803 - DNA, 25 bp, Mus musculus
ggacgtcgagccgagtgttaccacc

SEQ ID NO: 592804 - DNA, 25 bp, Mus musculus
ggacgtcgatgtaatctcaaaggaa

SEQ ID NO: 592805 - DNA, 25 bp, Mus musculus
ggacgtcgatgttatctcaaaggaa

SEQ ID NO: 592806 - DNA, 25 bp, Mus musculus
ggacgtctacacctgcgtggttcag

SEQ ID NO: 592807 - DNA, 25 bp, Mus musculus
ggacgtctacacgtgcgtggttcag

SEQ ID NO: 592808 - DNA, 25 bp, Mus musculus
ggacgtctagtcaacaagcaaggct

SEQ ID NO: 592809 - DNA, 25 bp, Mus musculus
ggacgtctagtctacaagcaaggct

SEQ ID NO: 592810 - DNA, 25 bp, Mus musculus
ggacgtctcccacccctagagaaaa

SEQ ID NO: 592811 - DNA, 25 bp, Mus musculus
ggacgtctcccagccctagagaaaa

SEQ ID NO: 592812 - DNA, 25 bp, Mus musculus
ggacgtctgtgccagtgccatcata

SEQ ID NO: 592813 - DNA, 25 bp, Mus musculus
ggacgtctgtgcgagtgccatcata

SEQ ID NO: 592814 - DNA, 25 bp, Mus musculus
ggacgtgaaatacttcggtaataat

SEQ ID NO: 592815 - DNA, 25 bp, Mus musculus
ggacgtgaaatagttcggtaataat

SEQ ID NO: 592816 - DNA, 25 bp, Mus musculus
ggacgtgaaccacacaaagccctcg

SEQ ID NO: 592817 - DNA, 25 bp, Mus musculus
ggacgtgaaccagacaaagccctcg

SEQ ID NO: 592818 - DNA, 25 bp, Mus musculus
ggacgtgaaggacccaccctggtta

SEQ ID NO: 592819 - DNA, 25 bp, Mus musculus
ggacgtgaaggagccaccctggtta

SEQ ID NO: 592820 - DNA, 25 bp, Mus musculus
ggacgtgaccccatagtagtgtgtg

SEQ ID NO: 592821 - DNA, 25 bp, Mus musculus
ggacgtgaccccttagtagtgtgtg

SEQ ID NO: 592822 - DNA, 25 bp, Mus musculus
ggacgtgagactacttcagactgcc

SEQ ID NO: 592823 - DNA, 25 bp, Mus musculus
ggacgtgagacttcttcagactgcc

SEQ ID NO: 592824 - DNA, 25 bp, Mus musculus
ggacgtgagcccatctaaagatttc

SEQ ID NO: 592825 - DNA, 25 bp, Mus musculus
ggacgtgagcccttctaaagatttc

SEQ ID NO: 592826 - DNA, 25 bp, Mus musculus
ggacgtgatgtcagctcatttgcat

SEQ ID NO: 592827 - DNA, 25 bp, Mus musculus
ggacgtgatgtctgctcatttgcat

SEQ ID NO: 592828 - DNA, 25 bp, Mus musculus
ggacgtgcttgactccctggacatg

SEQ ID NO: 592829 - DNA, 25 bp, Mus musculus
ggacgtgcttgagtccctggacatg

SEQ ID NO: 592830 - DNA, 25 bp, Mus musculus
ggacgtggaaacattacatccaaat

SEQ ID NO: 592831 - DNA, 25 bp, Mus musculus
ggacgtggaaactttacatccaaat

SEQ ID NO: 592832 - DNA, 25 bp, Mus musculus
ggacgtggactgagctaggaaactt

SEQ ID NO: 592833 - DNA, 25 bp, Mus musculus
ggacgtggactgtgctaggaaactt

SEQ ID NO: 592834 - DNA, 25 bp, Mus musculus
ggacgtggcagtagactccatgtct

SEQ ID NO: 592835 - DNA, 25 bp, Mus musculus
ggacgtggcagttgactccatgtct

SEQ ID NO: 592836 - DNA, 25 bp, Mus musculus
ggacgtggtagcaacgagccccaca

SEQ ID NO: 592837 - DNA, 25 bp, Mus musculus
ggacgtggtagctacgagccccaca

SEQ ID NO: 592838 - DNA, 25 bp, Mus musculus
ggacgtggtccacctaaaataaaca

SEQ ID NO: 592839 - DNA, 25 bp, Mus musculus
ggacgtggtccagctaaaataaaca

SEQ ID NO: 592840 - DNA, 25 bp, Mus musculus
ggacgtggtggtcgcctactacatc

SEQ ID NO: 592841 - DNA, 25 bp, Mus musculus
ggacgtggtggtggcctactacatc

SEQ ID NO: 592842 - DNA, 25 bp, Mus musculus
ggacgtggttgtaacctccacataa

SEQ ID NO: 592843 - DNA, 25 bp, Mus musculus
ggacgtggttgttacctccacataa

SEQ ID NO: 592844 - DNA, 25 bp, Mus musculus
ggacgtgtaatgagggctttcgcaa

SEQ ID NO: 592845 - DNA, 25 bp, Mus musculus
ggacgtgtaatgtgggctttcgcaa

SEQ ID NO: 592846 - DNA, 25 bp, Mus musculus
ggacgtgtatgcagatgcttccatt

SEQ ID NO: 592847 - DNA, 25 bp, Mus musculus
ggacgtgtatgctgatgcttccatt

SEQ ID NO: 592848 - DNA, 25 bp, Mus musculus
ggacgtgtcaacataactgtaacct

SEQ ID NO: 592849 - DNA, 25 bp, Mus musculus
ggacgtgtcaacttaactgtaacct

SEQ ID NO: 592850 - DNA, 25 bp, Mus musculus
ggacgtgtccatagttcactcttat

SEQ ID NO: 592851 - DNA, 25 bp, Mus musculus
ggacgtgtccattgttcactcttat

SEQ ID NO: 592852 - DNA, 25 bp, Mus musculus
ggacgtgtcgccaaaatgttgccaa

SEQ ID NO: 592853 - DNA, 25 bp, Mus musculus
ggacgtgtcgcctaaatgttgccaa

SEQ ID NO: 592854 - DNA, 25 bp, Mus musculus
ggacgtgtgaatccatgttcctctt

SEQ ID NO: 592855 - DNA, 25 bp, Mus musculus
ggacgtgtgaatgcatgttcctctt

SEQ ID NO: 592856 - DNA, 25 bp, Mus musculus
ggacgtgtgcatcccgcaggaggaa

SEQ ID NO: 592857 - DNA, 25 bp, Mus musculus
ggacgtgtgcatctccattctccat

SEQ ID NO: 592858 - DNA, 25 bp, Mus musculus
ggacgtgtgcatgccgcaggaggaa

SEQ ID NO: 592859 - DNA, 25 bp, Mus musculus
ggacgtgtgcatgtccattctccat

SEQ ID NO: 592860 - DNA, 25 bp, Mus musculus
ggacgtgtgtgcattaaccacattt

SEQ ID NO: 592861 - DNA, 25 bp, Mus musculus
ggacgtgtgtgctttaaccacattt

SEQ ID NO: 592862 - DNA, 25 bp, Mus musculus
ggacgtgttagacagcttcctctgc

SEQ ID NO: 592863 - DNA, 25 bp, Mus musculus
ggacgtgttagagagcttcctctgc

SEQ ID NO: 592864 - DNA, 25 bp, Mus musculus
ggacgtgttcctatagtgcacattt

SEQ ID NO: 592865 - DNA, 25 bp, Mus musculus
ggacgtgttcctttagtgcacattt

SEQ ID NO: 592866 - DNA, 25 bp, Mus musculus
ggacgtgtttgcaggttccgctcca

SEQ ID NO: 592867 - DNA, 25 bp, Mus musculus
ggacgtgtttgctggttccgctcca

SEQ ID NO: 592868 - DNA, 25 bp, Mus musculus
ggacgtgtttggaaccaatgctgct

SEQ ID NO: 592869 - DNA, 25 bp, Mus musculus
ggacgtgtttggtaccaatgctgct

SEQ ID NO: 592870 - DNA, 25 bp, Mus musculus
ggacgtgttttaatcttcaggcatc

SEQ ID NO: 592871 - DNA, 25 bp, Mus musculus
ggacgtgttttattcttcaggcatc

SEQ ID NO: 592872 - DNA, 25 bp, Mus musculus
ggacgttaaaggatcatgaggtaaa

SEQ ID NO: 592873 - DNA, 25 bp, Mus musculus
ggacgttaaaggttcatgaggtaaa

SEQ ID NO: 592874 - DNA, 25 bp, Mus musculus
ggacgttacgtacttccgtgatatg

SEQ ID NO: 592875 - DNA, 25 bp, Mus musculus
ggacgttacgtagttccgtgatatg

SEQ ID NO: 592876 - DNA, 25 bp, Mus musculus
ggacgttatattcggccgttctata

SEQ ID NO: 592877 - DNA, 25 bp, Mus musculus
ggacgttatattgggccgttctata

SEQ ID NO: 592878 - DNA, 25 bp, Mus musculus
ggacgttatcatcgagagccctctg

SEQ ID NO: 592879 - DNA, 25 bp, Mus musculus
ggacgttatcatggagagccctctg

SEQ ID NO: 592880 - DNA, 25 bp, Mus musculus
ggacgttcagcgactctgagttatt

SEQ ID NO: 592881 - DNA, 25 bp, Mus musculus
ggacgttcagcgtctctgagttatt

SEQ ID NO: 592882 - DNA, 25 bp, Mus musculus
ggacgttcatgacggatcctctcaa

SEQ ID NO: 592883 - DNA, 25 bp, Mus musculus
ggacgttcatgagggatcctctcaa

SEQ ID NO: 592884 - DNA, 25 bp, Mus musculus
ggacgttctattaattttcgcagta

SEQ ID NO: 592885 - DNA, 25 bp, Mus musculus
ggacgttctatttattttcgcagta

SEQ ID NO: 592886 - DNA, 25 bp, Mus musculus
ggacgttctgtactaaccatttgtt

SEQ ID NO: 592887 - DNA, 25 bp, Mus musculus
ggacgttctgtagtaaccatttgtt

SEQ ID NO: 592888 - DNA, 25 bp, Mus musculus
ggacgttgaaacatctgctttcgga

SEQ ID NO: 592889 - DNA, 25 bp, Mus musculus
ggacgttgaaacttctgctttcgga

SEQ ID NO: 592890 - DNA, 25 bp, Mus musculus
ggacgttgccatcctcttgccttgg

SEQ ID NO: 592891 - DNA, 25 bp, Mus musculus
ggacgttgccatgctcttgccttgg

SEQ ID NO: 592892 - DNA, 25 bp, Mus musculus
ggacgttggagccatatttcttatg

SEQ ID NO: 592893 - DNA, 25 bp, Mus musculus
ggacgttggagcgatatttcttatg

SEQ ID NO: 592894 - DNA, 25 bp, Mus musculus
ggacgtttcattattatggtacatg

SEQ ID NO: 592895 - DNA, 25 bp, Mus musculus
ggacgtttcatttttatggtacatg

SEQ ID NO: 592896 - DNA, 25 bp, Mus musculus
ggacgtttccttaagaggctagctg

SEQ ID NO: 592897 - DNA, 25 bp, Mus musculus
ggacgtttcctttagaggctagctg

SEQ ID NO: 592898 - DNA, 25 bp, Mus musculus
ggacgtttgagcagccttttggcac

SEQ ID NO: 592899 - DNA, 25 bp, Mus musculus
ggacgtttgagcctgtgcagcacaa

SEQ ID NO: 592900 - DNA, 25 bp, Mus musculus
ggacgtttgagcgtgtgcagcacaa

SEQ ID NO: 592901 - DNA, 25 bp, Mus musculus
ggacgtttgagctgccttttggcac

SEQ ID NO: 592902 - DNA, 25 bp, Mus musculus
ggacgtttgctcagcttgagatgag

SEQ ID NO: 592903 - DNA, 25 bp, Mus musculus
ggacgtttgctctgcttgagatgag

SEQ ID NO: 592904 - DNA, 25 bp, Mus musculus
ggacgtttgtaaaacactgctcaac

SEQ ID NO: 592905 - DNA, 25 bp, Mus musculus
ggacgtttgtaatacactgctcaac

SEQ ID NO: 592906 - DNA, 25 bp, Mus musculus
ggactaaaaatgactgctcttgcag

SEQ ID NO: 592907 - DNA, 25 bp, Mus musculus
ggactaaaaatgtctgctcttgcag

SEQ ID NO: 592908 - DNA, 25 bp, Mus musculus
ggactaaaacacacacgtctttctg

SEQ ID NO: 592909 - DNA, 25 bp, Mus musculus
ggactaaaacactcacgtctttctg

SEQ ID NO: 592910 - DNA, 25 bp, Mus musculus
ggactaaaatacacttttcagcctg

SEQ ID NO: 592911 - DNA, 25 bp, Mus musculus
ggactaaaatactcttttcagcctg

SEQ ID NO: 592912 - DNA, 25 bp, Mus musculus
ggactaaactatactttgacacctg

SEQ ID NO: 592913 - DNA, 25 bp, Mus musculus
ggactaaactattctttgacacctg

SEQ ID NO: 592914 - DNA, 25 bp, Mus musculus
ggactaaactccagaactctgaact

SEQ ID NO: 592915 - DNA, 25 bp, Mus musculus
ggactaaactcctgaactctgaact

SEQ ID NO: 592916 - DNA, 25 bp, Mus musculus
ggactaaagcagagacacccggaga

SEQ ID NO: 592917 - DNA, 25 bp, Mus musculus
ggactaaagcagtgacacccggaga

SEQ ID NO: 592918 - DNA, 25 bp, Mus musculus
ggactaaagccgctcttcacacata

SEQ ID NO: 592919 - DNA, 25 bp, Mus musculus
ggactaaagccggtcttcacacata

SEQ ID NO: 592920 - DNA, 25 bp, Mus musculus
ggactaaatggcagggaggcccctt

SEQ ID NO: 592921 - DNA, 25 bp, Mus musculus
ggactaaatggctgggaggcccctt

SEQ ID NO: 592922 - DNA, 25 bp, Mus musculus
ggactaacactgatttgaggagctg

SEQ ID NO: 592923 - DNA, 25 bp, Mus musculus
ggactaacactgttttgaggagctg

SEQ ID NO: 592924 - DNA, 25 bp, Mus musculus
ggactaacattaatcctgtaattga

SEQ ID NO: 592925 - DNA, 25 bp, Mus musculus
ggactaacattattcctgtaattga

SEQ ID NO: 592926 - DNA, 25 bp, Mus musculus
ggactaacattcatctgctgtcgct

SEQ ID NO: 592927 - DNA, 25 bp, Mus musculus
ggactaacattcttctgctgtcgct

SEQ ID NO: 592928 - DNA, 25 bp, Mus musculus
ggactaaccaaccaatatgtaaact

SEQ ID NO: 592929 - DNA, 25 bp, Mus musculus
ggactaaccaacgaatatgtaaact

SEQ ID NO: 592930 - DNA, 25 bp, Mus musculus
ggactaaccagtactccgtgaccag

SEQ ID NO: 592931 - DNA, 25 bp, Mus musculus
ggactaaccagttctccgtgaccag

SEQ ID NO: 592932 - DNA, 25 bp, Mus musculus
ggactaacctccagcatcaatcaat

SEQ ID NO: 592933 - DNA, 25 bp, Mus musculus
ggactaacctcctgcatcaatcaat

SEQ ID NO: 592934 - DNA, 25 bp, Mus musculus
ggactaactttaagacaactggatt

SEQ ID NO: 592935 - DNA, 25 bp, Mus musculus
ggactaactttatgacaactggatt

SEQ ID NO: 592936 - DNA, 25 bp, Mus musculus
ggactaagagttacctctggaacca

SEQ ID NO: 592937 - DNA, 25 bp, Mus musculus
ggactaagagtttcctctggaacca

SEQ ID NO: 592938 - DNA, 25 bp, Mus musculus
ggactaagcagcagtaggacctcag

SEQ ID NO: 592939 - DNA, 25 bp, Mus musculus
ggactaagcagctgtaggacctcag

SEQ ID NO: 592940 - DNA, 25 bp, Mus musculus
ggactaagcgaccttgaatggattc

SEQ ID NO: 592941 - DNA, 25 bp, Mus musculus
ggactaagcgacgttgaatggattc

SEQ ID NO: 592942 - DNA, 25 bp, Mus musculus
ggactaaggacgcagctacgacatg

SEQ ID NO: 592943 - DNA, 25 bp, Mus musculus
ggactaaggacggagctacgacatg

SEQ ID NO: 592944 - DNA, 25 bp, Mus musculus
ggactaaggcagaacttatctttat

SEQ ID NO: 592945 - DNA, 25 bp, Mus musculus
ggactaaggcagtacttatctttat

SEQ ID NO: 592946 - DNA, 25 bp, Mus musculus
ggactaaggttactcgcaccttcag

SEQ ID NO: 592947 - DNA, 25 bp, Mus musculus
ggactaaggttagtcgcaccttcag

SEQ ID NO: 592948 - DNA, 25 bp, Mus musculus
ggactaagtccaactaggaaggaaa

SEQ ID NO: 592949 - DNA, 25 bp, Mus musculus
ggactaagtccatctaggaaggaaa

SEQ ID NO: 592950 - DNA, 25 bp, Mus musculus
ggactaagtttgctttcccacgact

SEQ ID NO: 592951 - DNA, 25 bp, Mus musculus
ggactaagtttggtttcccacgact

SEQ ID NO: 592952 - DNA, 25 bp, Mus musculus
ggactaatctccatggccagtgtag

SEQ ID NO: 592953 - DNA, 25 bp, Mus musculus
ggactaatctccttggccagtgtag

SEQ ID NO: 592954 - DNA, 25 bp, Mus musculus
ggactaatcttgaattcccagtaat

SEQ ID NO: 592955 - DNA, 25 bp, Mus musculus
ggactaatcttgtattcccagtaat

SEQ ID NO: 592956 - DNA, 25 bp, Mus musculus
ggactaatgccacccaagatcgaag

SEQ ID NO: 592957 - DNA, 25 bp, Mus musculus
ggactaatgccagccaagatcgaag

SEQ ID NO: 592958 - DNA, 25 bp, Mus musculus
ggactaatgcttccactgggcagct

SEQ ID NO: 592959 - DNA, 25 bp, Mus musculus
ggactaatgcttccagttgtgaatt

SEQ ID NO: 592960 - DNA, 25 bp, Mus musculus
ggactaatgcttgcactgggcagct

SEQ ID NO: 592961 - DNA, 25 bp, Mus musculus
ggactaatgcttgcagttgtgaatt

SEQ ID NO: 592962 - DNA, 25 bp, Mus musculus
ggactacaaccacttcgccatggta

SEQ ID NO: 592963 - DNA, 25 bp, Mus musculus
ggactacaaccagttcgccatggta

SEQ ID NO: 592964 - DNA, 25 bp, Mus musculus
ggactacaagtacatcctgggtttg

SEQ ID NO: 592965 - DNA, 25 bp, Mus musculus
ggactacaagtagatcctgggtttg

SEQ ID NO: 592966 - DNA, 25 bp, Mus musculus
ggactacaatggacacgttggtctt

SEQ ID NO: 592967 - DNA, 25 bp, Mus musculus
ggactacaatggtcacgttggtctt

SEQ ID NO: 592968 - DNA, 25 bp, Mus musculus
ggactacacctaaatggatcatgct

SEQ ID NO: 592969 - DNA, 25 bp, Mus musculus
ggactacacctatatggatcatgct

SEQ ID NO: 592970 - DNA, 25 bp, Mus musculus
ggactacagagtcgcttccagaaca

SEQ ID NO: 592971 - DNA, 25 bp, Mus musculus
ggactacagagtggcttccagaaca

SEQ ID NO: 592972 - DNA, 25 bp, Mus musculus
ggactacagcagcaccttaatcaag

SEQ ID NO: 592973 - DNA, 25 bp, Mus musculus
ggactacagcaggaccttaatcaag

SEQ ID NO: 592974 - DNA, 25 bp, Mus musculus
ggactacagcgtatgcacatccttg

SEQ ID NO: 592975 - DNA, 25 bp, Mus musculus
ggactacagcgtttgcacatccttg

SEQ ID NO: 592976 - DNA, 25 bp, Mus musculus
ggactacagctaccacagggaattt

SEQ ID NO: 592977 - DNA, 25 bp, Mus musculus
ggactacagctagcacagggaattt

SEQ ID NO: 592978 - DNA, 25 bp, Mus musculus
ggactacatactacaactgtgctgc

SEQ ID NO: 592979 - DNA, 25 bp, Mus musculus
ggactacatacttcaactgtgctgc

SEQ ID NO: 592980 - DNA, 25 bp, Mus musculus
ggactacatatgcaaaccgtgtctt

SEQ ID NO: 592981 - DNA, 25 bp, Mus musculus
ggactacatatggaaaccgtgtctt

SEQ ID NO: 592982 - DNA, 25 bp, Mus musculus
ggactacatcataagtaagcatgct

SEQ ID NO: 592983 - DNA, 25 bp, Mus musculus
ggactacatcattagtaagcatgct

SEQ ID NO: 592984 - DNA, 25 bp, Mus musculus
ggactacatgtaccggagaactgct

SEQ ID NO: 592985 - DNA, 25 bp, Mus musculus
ggactacatgtagcggagaactgct

SEQ ID NO: 592986 - DNA, 25 bp, Mus musculus
ggactacattaaaagggaggctttt

SEQ ID NO: 592987 - DNA, 25 bp, Mus musculus
ggactacattaatagggaggctttt

SEQ ID NO: 592988 - DNA, 25 bp, Mus musculus
ggactaccaaagagtcttcaatgct

SEQ ID NO: 592989 - DNA, 25 bp, Mus musculus
ggactaccaaagtgtcttcaatgct

SEQ ID NO: 592990 - DNA, 25 bp, Mus musculus
ggactaccactcctttgtcttattt

SEQ ID NO: 592991 - DNA, 25 bp, Mus musculus
ggactaccactcgtttgtcttattt

SEQ ID NO: 592992 - DNA, 25 bp, Mus musculus
ggactaccagatacagccagctaca

SEQ ID NO: 592993 - DNA, 25 bp, Mus musculus
ggactaccagattcagccagctaca

SEQ ID NO: 592994 - DNA, 25 bp, Mus musculus
ggactaccattaatatccccatgct

SEQ ID NO: 592995 - DNA, 25 bp, Mus musculus
ggactaccattattatccccatgct

SEQ ID NO: 592996 - DNA, 25 bp, Mus musculus
ggactacccatgataacatgccata

SEQ ID NO: 592997 - DNA, 25 bp, Mus musculus
ggactacccatgttaacatgccata

SEQ ID NO: 592998 - DNA, 25 bp, Mus musculus
ggactaccccacaagagaacagcag

SEQ ID NO: 592999 - DNA, 25 bp, Mus musculus
ggactaccccactagagaacagcag

SEQ ID NO: 593000 - DNA, 25 bp, Mus musculus
ggactaccctccatggttgtgatgt

SEQ ID NO: 593001 - DNA, 25 bp, Mus musculus
ggactaccctccttggttgtgatgt

SEQ ID NO: 593002 - DNA, 25 bp, Mus musculus
ggactaccctttactcaaacagcaa

SEQ ID NO: 593003 - DNA, 25 bp, Mus musculus
ggactacccttttctcaaacagcaa

SEQ ID NO: 593004 - DNA, 25 bp, Mus musculus
ggactaccggatcaagctttataag

SEQ ID NO: 593005 - DNA, 25 bp, Mus musculus
ggactaccggatgaagctttataag

SEQ ID NO: 593006 - DNA, 25 bp, Mus musculus
ggactacctgagagaacatctattt

SEQ ID NO: 593007 - DNA, 25 bp, Mus musculus
ggactacctgagatcctaccgcaga

SEQ ID NO: 593008 - DNA, 25 bp, Mus musculus
ggactacctgagtgaacatctattt

SEQ ID NO: 593009 - DNA, 25 bp, Mus musculus
ggactacctgagttcctaccgcaga

SEQ ID NO: 593010 - DNA, 25 bp, Mus musculus
ggactacctgccaaatatgtatttg

SEQ ID NO: 593011 - DNA, 25 bp, Mus musculus
ggactacctgcctaatatgtatttg

SEQ ID NO: 593012 - DNA, 25 bp, Mus musculus
ggactacgaactccttgtgctccag

SEQ ID NO: 593013 - DNA, 25 bp, Mus musculus
ggactacgaactgcttgtgctccag

SEQ ID NO: 593014 - DNA, 25 bp, Mus musculus
ggactacgcttacaatctgctggta

SEQ ID NO: 593015 - DNA, 25 bp, Mus musculus
ggactacgcttagaatctgctggta

SEQ ID NO: 593016 - DNA, 25 bp, Mus musculus
ggactacgtccaaacacagaagctc

SEQ ID NO: 593017 - DNA, 25 bp, Mus musculus
ggactacgtccatacacagaagctc

SEQ ID NO: 593018 - DNA, 25 bp, Mus musculus
ggactactaaatacttccatgcact

SEQ ID NO: 593019 - DNA, 25 bp, Mus musculus
ggactactaaattcttccatgcact

SEQ ID NO: 593020 - DNA, 25 bp, Mus musculus
ggactactaacaccttcatgatcat

SEQ ID NO: 593021 - DNA, 25 bp, Mus musculus
ggactactaacagcttcatgatcat

SEQ ID NO: 593022 - DNA, 25 bp, Mus musculus
ggactactaagcatgtgatttttct

SEQ ID NO: 593023 - DNA, 25 bp, Mus musculus
ggactactaagcttgtgatttttct

SEQ ID NO: 593024 - DNA, 25 bp, Mus musculus
ggactactaccaatgaagaactaga

SEQ ID NO: 593025 - DNA, 25 bp, Mus musculus
ggactactaccattgaagaactaga

SEQ ID NO: 593026 - DNA, 25 bp, Mus musculus
ggactactacctcgatgactgaggc

SEQ ID NO: 593027 - DNA, 25 bp, Mus musculus
ggactactacctggatgactgaggc

SEQ ID NO: 593028 - DNA, 25 bp, Mus musculus
ggactactcaccaaaccttgaaggg

SEQ ID NO: 593029 - DNA, 25 bp, Mus musculus
ggactactcacctaaccttgaaggg

SEQ ID NO: 593030 - DNA, 25 bp, Mus musculus
ggactactcagaacccagggaacga

SEQ ID NO: 593031 - DNA, 25 bp, Mus musculus
ggactactcagatcccagggaacga

SEQ ID NO: 593032 - DNA, 25 bp, Mus musculus
ggactactccaaccccaaagagagc

SEQ ID NO: 593033 - DNA, 25 bp, Mus musculus
ggactactccaagcccaaagagagc

SEQ ID NO: 593034 - DNA, 25 bp, Mus musculus
ggactactcttccaaacgtcccgag

SEQ ID NO: 593035 - DNA, 25 bp, Mus musculus
ggactactcttcgaaacgtcccgag

SEQ ID NO: 593036 - DNA, 25 bp, Mus musculus
ggactactgggtatgaggcacacat

SEQ ID NO: 593037 - DNA, 25 bp, Mus musculus
ggactactgggtttgaggcacacat

SEQ ID NO: 593038 - DNA, 25 bp, Mus musculus
ggactactgtaaacaagttcctgtc

SEQ ID NO: 593039 - DNA, 25 bp, Mus musculus
ggactactgtaatcaagttcctgtc

SEQ ID NO: 593040 - DNA, 25 bp, Mus musculus
ggactacttccaagaggttcttctt

SEQ ID NO: 593041 - DNA, 25 bp, Mus musculus
ggactacttccatgaggttcttctt

SEQ ID NO: 593042 - DNA, 25 bp, Mus musculus
ggactacttgaaacacttgtctcaa

SEQ ID NO: 593043 - DNA, 25 bp, Mus musculus
ggactacttgaatcacttgtctcaa

SEQ ID NO: 593044 - DNA, 25 bp, Mus musculus
ggactacttgatcctgatccacagt

SEQ ID NO: 593045 - DNA, 25 bp, Mus musculus
ggactacttgatgctgatccacagt

SEQ ID NO: 593046 - DNA, 25 bp, Mus musculus
ggactacttgctaaattgctgatta

SEQ ID NO: 593047 - DNA, 25 bp, Mus musculus
ggactacttgcttaattgctgatta

SEQ ID NO: 593048 - DNA, 25 bp, Mus musculus
ggactacttgtaatggctcccagtt

SEQ ID NO: 593049 - DNA, 25 bp, Mus musculus
ggactacttgtattggctcccagtt

SEQ ID NO: 593050 - DNA, 25 bp, Mus musculus
ggactacttgtcaagggcactggtt

SEQ ID NO: 593051 - DNA, 25 bp, Mus musculus
ggactacttgtctagggcactggtt

SEQ ID NO: 593052 - DNA, 25 bp, Mus musculus
ggactactttccagagttcgctcgc

SEQ ID NO: 593053 - DNA, 25 bp, Mus musculus
ggactactttcctgagttcgctcgc

SEQ ID NO: 593054 - DNA, 25 bp, Mus musculus
ggactactttctatttggtttgtgg

SEQ ID NO: 593055 - DNA, 25 bp, Mus musculus
ggactactttctttttggtttgtgg

SEQ ID NO: 593056 - DNA, 25 bp, Mus musculus
ggactactttgtcagctggtctaca

SEQ ID NO: 593057 - DNA, 25 bp, Mus musculus
ggactactttgtgagctggtctaca

SEQ ID NO: 593058 - DNA, 25 bp, Mus musculus
ggactacttttgaactctacccaat

SEQ ID NO: 593059 - DNA, 25 bp, Mus musculus
ggactacttttgtactctacccaat

SEQ ID NO: 593060 - DNA, 25 bp, Mus musculus
ggactagaacttaatattgtaactt

SEQ ID NO: 593061 - DNA, 25 bp, Mus musculus
ggactagaactttatattgtaactt

SEQ ID NO: 593062 - DNA, 25 bp, Mus musculus
ggactagaagccactgcatggacca

SEQ ID NO: 593063 - DNA, 25 bp, Mus musculus
ggactagaagcctctgcatggacca

SEQ ID NO: 593064 - DNA, 25 bp, Mus musculus
ggactagaagtcctggtgcctctcg

SEQ ID NO: 593065 - DNA, 25 bp, Mus musculus
ggactagaagtcgtggtgcctctcg

SEQ ID NO: 593066 - DNA, 25 bp, Mus musculus
ggactagaatgtctgtcactcttgg

SEQ ID NO: 593067 - DNA, 25 bp, Mus musculus
ggactagaatgtgtgtcactcttgg

SEQ ID NO: 593068 - DNA, 25 bp, Mus musculus
ggactagacctgacaaaccctaaga

SEQ ID NO: 593069 - DNA, 25 bp, Mus musculus
ggactagacctgtcaaaccctaaga

SEQ ID NO: 593070 - DNA, 25 bp, Mus musculus
ggactagagagtccaaacttgccca

SEQ ID NO: 593071 - DNA, 25 bp, Mus musculus
ggactagagagtgcaaacttgccca

SEQ ID NO: 593072 - DNA, 25 bp, Mus musculus
ggactagaggtgatttctgtgctgt

SEQ ID NO: 593073 - DNA, 25 bp, Mus musculus
ggactagaggtgttttctgtgctgt

SEQ ID NO: 593074 - DNA, 25 bp, Mus musculus
ggactagagtgcaaccaggacaact

SEQ ID NO: 593075 - DNA, 25 bp, Mus musculus
ggactagagtgctaccaggacaact

SEQ ID NO: 593076 - DNA, 25 bp, Mus musculus
ggactagatgtcacagcagcctcac

SEQ ID NO: 593077 - DNA, 25 bp, Mus musculus
ggactagatgtcctctggtcttttc

SEQ ID NO: 593078 - DNA, 25 bp, Mus musculus
ggactagatgtcgtctggtcttttc

SEQ ID NO: 593079 - DNA, 25 bp, Mus musculus
ggactagatgtctcagcagcctcac

SEQ ID NO: 593080 - DNA, 25 bp, Mus musculus
ggactagatgtgcttgacagatcat

SEQ ID NO: 593081 - DNA, 25 bp, Mus musculus
ggactagatgtggttgacagatcat

SEQ ID NO: 593082 - DNA, 25 bp, Mus musculus
ggactagcagagaccttgctacctt

SEQ ID NO: 593083 - DNA, 25 bp, Mus musculus
ggactagcagagtccttgctacctt

SEQ ID NO: 593084 - DNA, 25 bp, Mus musculus
ggactagcagtcaggaacaggaata

SEQ ID NO: 593085 - DNA, 25 bp, Mus musculus
ggactagcagtctggaacaggaata

SEQ ID NO: 593086 - DNA, 25 bp, Mus musculus
ggactagcatatattaaatcacaca

SEQ ID NO: 593087 - DNA, 25 bp, Mus musculus
ggactagcatattttaaatcacaca

SEQ ID NO: 593088 - DNA, 25 bp, Mus musculus
ggactagcctgtcacagccacatct

SEQ ID NO: 593089 - DNA, 25 bp, Mus musculus
ggactagcctgtgacagccacatct

SEQ ID NO: 593090 - DNA, 25 bp, Mus musculus
ggactagctctgcttcaacaaatgt

SEQ ID NO: 593091 - DNA, 25 bp, Mus musculus
ggactagctctggttcaacaaatgt

SEQ ID NO: 593092 - DNA, 25 bp, Mus musculus
ggactagctggcaaaacctgtcagt

SEQ ID NO: 593093 - DNA, 25 bp, Mus musculus
ggactagctggctaaacctgtcagt

SEQ ID NO: 593094 - DNA, 25 bp, Mus musculus
ggactagcttgaaaccatctccatc

SEQ ID NO: 593095 - DNA, 25 bp, Mus musculus
ggactagcttgataccatctccatc

SEQ ID NO: 593096 - DNA, 25 bp, Mus musculus
ggactaggaactctccgaacacaga

SEQ ID NO: 593097 - DNA, 25 bp, Mus musculus
ggactaggaactgtccgaacacaga

SEQ ID NO: 593098 - DNA, 25 bp, Mus musculus
ggactaggcataaaatactttcact

SEQ ID NO: 593099 - DNA, 25 bp, Mus musculus
ggactaggcatataatactttcact

SEQ ID NO: 593100 - DNA, 25 bp, Mus musculus
ggactaggcctaaggaagcggccca

SEQ ID NO: 593101 - DNA, 25 bp, Mus musculus
ggactaggcctatggaagcggccca

SEQ ID NO: 593102 - DNA, 25 bp, Mus musculus
ggactaggcttcactacagaggaca

SEQ ID NO: 593103 - DNA, 25 bp, Mus musculus
ggactaggcttctctacagaggaca

SEQ ID NO: 593104 - DNA, 25 bp, Mus musculus
ggactaggttgaactcttaccacat

SEQ ID NO: 593105 - DNA, 25 bp, Mus musculus
ggactaggttgatctcttaccacat

SEQ ID NO: 593106 - DNA, 25 bp, Mus musculus
ggactagtcactcccgaggccagga

SEQ ID NO: 593107 - DNA, 25 bp, Mus musculus
ggactagtcactgccgaggccagga

SEQ ID NO: 593108 - DNA, 25 bp, Mus musculus
ggactagtgaccaaacttcactcta

SEQ ID NO: 593109 - DNA, 25 bp, Mus musculus
ggactagtgacctaacttcactcta

SEQ ID NO: 593110 - DNA, 25 bp, Mus musculus
ggactagtgcttcattcgagtgctc

SEQ ID NO: 593111 - DNA, 25 bp, Mus musculus
ggactagtgcttgattcgagtgctc

SEQ ID NO: 593112 - DNA, 25 bp, Mus musculus
ggactagtggccacaaaggcagata

SEQ ID NO: 593113 - DNA, 25 bp, Mus musculus
ggactagtggcctcaaaggcagata

SEQ ID NO: 593114 - DNA, 25 bp, Mus musculus
ggactagttttcataggcctgagct

SEQ ID NO: 593115 - DNA, 25 bp, Mus musculus
ggactagttttcttaggcctgagct

SEQ ID NO: 593116 - DNA, 25 bp, Mus musculus
ggactataactacccactgtgcgca

SEQ ID NO: 593117 - DNA, 25 bp, Mus musculus
ggactataactagccactgtgcgca

SEQ ID NO: 593118 - DNA, 25 bp, Mus musculus
ggactataagacctacctggacttt

SEQ ID NO: 593119 - DNA, 25 bp, Mus musculus
ggactataagacgtacctggacttt

SEQ ID NO: 593120 - DNA, 25 bp, Mus musculus
ggactataatgacactggtttaatt

SEQ ID NO: 593121 - DNA, 25 bp, Mus musculus
ggactataatgagactggtttaatt

SEQ ID NO: 593122 - DNA, 25 bp, Mus musculus
ggactatacacaaccgtgaggaaga

SEQ ID NO: 593123 - DNA, 25 bp, Mus musculus
ggactatacacatccgtgaggaaga

SEQ ID NO: 593124 - DNA, 25 bp, Mus musculus
ggactataccacagatgaggacatg

SEQ ID NO: 593125 - DNA, 25 bp, Mus musculus
ggactataccactgatgaggacatg

SEQ ID NO: 593126 - DNA, 25 bp, Mus musculus
ggactatacccaacagaccaagaaa

SEQ ID NO: 593127 - DNA, 25 bp, Mus musculus
ggactatacccatcagaccaagaaa

SEQ ID NO: 593128 - DNA, 25 bp, Mus musculus
ggactatactttaacttgatttgca

SEQ ID NO: 593129 - DNA, 25 bp, Mus musculus
ggactatacttttacttgatttgca

SEQ ID NO: 593130 - DNA, 25 bp, Mus musculus
ggactatagcaaacaaccaccgtga

SEQ ID NO: 593131 - DNA, 25 bp, Mus musculus
ggactatagcaatcaaccaccgtga

SEQ ID NO: 593132 - DNA, 25 bp, Mus musculus
ggactatagtgacgtctggctctat

SEQ ID NO: 593133 - DNA, 25 bp, Mus musculus
ggactatagtgaggtctggctctat

SEQ ID NO: 593134 - DNA, 25 bp, Mus musculus
ggactatatggaccccgagaagccg

SEQ ID NO: 593135 - DNA, 25 bp, Mus musculus
ggactatatggagcccgagaagccg

SEQ ID NO: 593136 - DNA, 25 bp, Mus musculus
ggactatcagaccaggcaagccagt

SEQ ID NO: 593137 - DNA, 25 bp, Mus musculus
ggactatcagacgaggcaagccagt

SEQ ID NO: 593138 - DNA, 25 bp, Mus musculus
ggactatcagataggcctgccttca

SEQ ID NO: 593139 - DNA, 25 bp, Mus musculus
ggactatcagattggcctgccttca

SEQ ID NO: 593140 - DNA, 25 bp, Mus musculus
ggactatcagttccttattaaaggc

SEQ ID NO: 593141 - DNA, 25 bp, Mus musculus
ggactatcagttgcttattaaaggc

SEQ ID NO: 593142 - DNA, 25 bp, Mus musculus
ggactatcatgtatcccatgggttt

SEQ ID NO: 593143 - DNA, 25 bp, Mus musculus
ggactatcatgtttcccatgggttt

SEQ ID NO: 593144 - DNA, 25 bp, Mus musculus
ggactatccacaagctactcacaca

SEQ ID NO: 593145 - DNA, 25 bp, Mus musculus
ggactatccacatgctactcacaca

SEQ ID NO: 593146 - DNA, 25 bp, Mus musculus
ggactatccagcctatgcgagtgga

SEQ ID NO: 593147 - DNA, 25 bp, Mus musculus
ggactatccagcgtatgcgagtgga

SEQ ID NO: 593148 - DNA, 25 bp, Mus musculus
ggactatccaggaatcgtgaacccc

SEQ ID NO: 593149 - DNA, 25 bp, Mus musculus
ggactatccaggtatcgtgaacccc

SEQ ID NO: 593150 - DNA, 25 bp, Mus musculus
ggactatccatccaacttaacctgt

SEQ ID NO: 593151 - DNA, 25 bp, Mus musculus
ggactatccatcgaacttaacctgt

SEQ ID NO: 593152 - DNA, 25 bp, Mus musculus
ggactatcctacaggggattgacta

SEQ ID NO: 593153 - DNA, 25 bp, Mus musculus
ggactatcctactggggattgacta

SEQ ID NO: 593154 - DNA, 25 bp, Mus musculus
ggactatctgcactaccacattaag

SEQ ID NO: 593155 - DNA, 25 bp, Mus musculus
ggactatctgcagtaccacattaag

SEQ ID NO: 593156 - DNA, 25 bp, Mus musculus
ggactatcttgcaagatctggcatc

SEQ ID NO: 593157 - DNA, 25 bp, Mus musculus
ggactatcttgctagatctggcatc

SEQ ID NO: 593158 - DNA, 25 bp, Mus musculus
ggactatgacatcgactcctcttca

SEQ ID NO: 593159 - DNA, 25 bp, Mus musculus
ggactatgacatggactcctcttca

SEQ ID NO: 593160 - DNA, 25 bp, Mus musculus
ggactatgaccactgactcttgtct

SEQ ID NO: 593161 - DNA, 25 bp, Mus musculus
ggactatgaccagtgactcttgtct

SEQ ID NO: 593162 - DNA, 25 bp, Mus musculus
ggactatgactacctgaatgactgg

SEQ ID NO: 593163 - DNA, 25 bp, Mus musculus
ggactatgactagctgaatgactgg

SEQ ID NO: 593164 - DNA, 25 bp, Mus musculus
ggactatgcacgatgggaacacaca

SEQ ID NO: 593165 - DNA, 25 bp, Mus musculus
ggactatgcacgttgggaacacaca

SEQ ID NO: 593166 - DNA, 25 bp, Mus musculus
ggactatgcactagtattccagact

SEQ ID NO: 593167 - DNA, 25 bp, Mus musculus
ggactatgcacttgtattccagact

SEQ ID NO: 593168 - DNA, 25 bp, Mus musculus
ggactatgcagacacctaagatttg

SEQ ID NO: 593169 - DNA, 25 bp, Mus musculus
ggactatgcagacctctacctatgg

SEQ ID NO: 593170 - DNA, 25 bp, Mus musculus
ggactatgcagagacctaagatttg

SEQ ID NO: 593171 - DNA, 25 bp, Mus musculus
ggactatgcagagctctacctatgg

SEQ ID NO: 593172 - DNA, 25 bp, Mus musculus
ggactatgcctaagcccagaaacag

SEQ ID NO: 593173 - DNA, 25 bp, Mus musculus
ggactatgcctatgcccagaaacag

SEQ ID NO: 593174 - DNA, 25 bp, Mus musculus
ggactatggcaaccatctaatacag

SEQ ID NO: 593175 - DNA, 25 bp, Mus musculus
ggactatggcaagcatctaatacag

SEQ ID NO: 593176 - DNA, 25 bp, Mus musculus
ggactatggcacagagaccggcgca

SEQ ID NO: 593177 - DNA, 25 bp, Mus musculus
ggactatggcactgagaccggcgca

SEQ ID NO: 593178 - DNA, 25 bp, Mus musculus
ggactatgtgagactctgttttgaa

SEQ ID NO: 593179 - DNA, 25 bp, Mus musculus
ggactatgtgagtctctgttttgaa

SEQ ID NO: 593180 - DNA, 25 bp, Mus musculus
ggactatgtgcacatctcaggctga

SEQ ID NO: 593181 - DNA, 25 bp, Mus musculus
ggactatgtgcagatctcaggctga

SEQ ID NO: 593182 - DNA, 25 bp, Mus musculus
ggactatgtgtcctgagtacctcat

SEQ ID NO: 593183 - DNA, 25 bp, Mus musculus
ggactatgtgtcgtgagtacctcat

SEQ ID NO: 593184 - DNA, 25 bp, Mus musculus
ggactattaccgatacctggcagaa

SEQ ID NO: 593185 - DNA, 25 bp, Mus musculus
ggactattaccgttacctggcagaa

SEQ ID NO: 593186 - DNA, 25 bp, Mus musculus
ggactattactgctttatcatttgt

SEQ ID NO: 593187 - DNA, 25 bp, Mus musculus
ggactattactggtttatcatttgt

SEQ ID NO: 593188 - DNA, 25 bp, Mus musculus
ggactattcagtcagtagccttcac

SEQ ID NO: 593189 - DNA, 25 bp, Mus musculus
ggactattcagtgagtagccttcac

SEQ ID NO: 593190 - DNA, 25 bp, Mus musculus
ggactattcattaaacagccctttc

SEQ ID NO: 593191 - DNA, 25 bp, Mus musculus
ggactattcatttaacagccctttc

SEQ ID NO: 593192 - DNA, 25 bp, Mus musculus
ggactattgatcaaattctgtgtgc

SEQ ID NO: 593193 - DNA, 25 bp, Mus musculus
ggactattgatctaattctgtgtgc

SEQ ID NO: 593194 - DNA, 25 bp, Mus musculus
ggactattggttagtgcatcttaca

SEQ ID NO: 593195 - DNA, 25 bp, Mus musculus
ggactattggtttgtgcatcttaca

SEQ ID NO: 593196 - DNA, 25 bp, Mus musculus
ggactatttcacctgaattccacta

SEQ ID NO: 593197 - DNA, 25 bp, Mus musculus
ggactatttcacgtgaattccacta

SEQ ID NO: 593198 - DNA, 25 bp, Mus musculus
ggactattttctctttagctggata

SEQ ID NO: 593199 - DNA, 25 bp, Mus musculus
ggactattttctgtttagctggata

SEQ ID NO: 593200 - DNA, 25 bp, Mus musculus
ggactcaaaactcctatctgatttc

SEQ ID NO: 593201 - DNA, 25 bp, Mus musculus
ggactcaaaactgctatctgatttc

SEQ ID NO: 593202 - DNA, 25 bp, Mus musculus
ggactcaaactcacagctatcagta

SEQ ID NO: 593203 - DNA, 25 bp, Mus musculus
ggactcaaactctcagctatcagta

SEQ ID NO: 593204 - DNA, 25 bp, Mus musculus
ggactcaaagctaaacgacctcaaa

SEQ ID NO: 593205 - DNA, 25 bp, Mus musculus
ggactcaaagcttaacgacctcaaa

SEQ ID NO: 593206 - DNA, 25 bp, Mus musculus
ggactcaaaggtctaaaggtcattg

SEQ ID NO: 593207 - DNA, 25 bp, Mus musculus
ggactcaaaggtgtaaaggtcattg

SEQ ID NO: 593208 - DNA, 25 bp, Mus musculus
ggactcaaagtaacagccaggaaca

SEQ ID NO: 593209 - DNA, 25 bp, Mus musculus
ggactcaaagtatcagccaggaaca

SEQ ID NO: 593210 - DNA, 25 bp, Mus musculus
ggactcaaagtcacttcctttaggt

SEQ ID NO: 593211 - DNA, 25 bp, Mus musculus
ggactcaaagtctcttcctttaggt

SEQ ID NO: 593212 - DNA, 25 bp, Mus musculus
ggactcaaattccttagctctctga

SEQ ID NO: 593213 - DNA, 25 bp, Mus musculus
ggactcaaattcgttagctctctga

SEQ ID NO: 593214 - DNA, 25 bp, Mus musculus
ggactcaacagaatatatttaggaa

SEQ ID NO: 593215 - DNA, 25 bp, Mus musculus
ggactcaacagacaccagacatgca

SEQ ID NO: 593216 - DNA, 25 bp, Mus musculus
ggactcaacagacaggttttataga

SEQ ID NO: 593217 - DNA, 25 bp, Mus musculus
ggactcaacagagaccagacatgca

SEQ ID NO: 593218 - DNA, 25 bp, Mus musculus
ggactcaacagagaggttttataga

SEQ ID NO: 593219 - DNA, 25 bp, Mus musculus
ggactcaacagattatatttaggaa

SEQ ID NO: 593220 - DNA, 25 bp, Mus musculus
ggactcaacatcattgcagtagaag

SEQ ID NO: 593221 - DNA, 25 bp, Mus musculus
ggactcaacatctttgcagtagaag

SEQ ID NO: 593222 - DNA, 25 bp, Mus musculus
ggactcaacccaagtcatttgtctt

SEQ ID NO: 593223 - DNA, 25 bp, Mus musculus
ggactcaacccatgtcatttgtctt

SEQ ID NO: 593224 - DNA, 25 bp, Mus musculus
ggactcaaccctctgattttcagaa

SEQ ID NO: 593225 - DNA, 25 bp, Mus musculus
ggactcaaccctgtgattttcagaa

SEQ ID NO: 593226 - DNA, 25 bp, Mus musculus
ggactcaactgaatcataacgtgtt

SEQ ID NO: 593227 - DNA, 25 bp, Mus musculus
ggactcaactgattcataacgtgtt

SEQ ID NO: 593228 - DNA, 25 bp, Mus musculus
ggactcaagccccttaaatcatggt

SEQ ID NO: 593229 - DNA, 25 bp, Mus musculus
ggactcaagcccgttaaatcatggt

SEQ ID NO: 593230 - DNA, 25 bp, Mus musculus
ggactcaagttccattctcaactta

SEQ ID NO: 593231 - DNA, 25 bp, Mus musculus
ggactcaagttcgattctcaactta

SEQ ID NO: 593232 - DNA, 25 bp, Mus musculus
ggactcaattccctttgcagaacag

SEQ ID NO: 593233 - DNA, 25 bp, Mus musculus
ggactcaattccgtttgcagaacag

SEQ ID NO: 593234 - DNA, 25 bp, Mus musculus
ggactcacaagcatgctacacagac

SEQ ID NO: 593235 - DNA, 25 bp, Mus musculus
ggactcacaagcttgctacacagac

SEQ ID NO: 593236 - DNA, 25 bp, Mus musculus
ggactcacaccacacttctataaat

SEQ ID NO: 593237 - DNA, 25 bp, Mus musculus
ggactcacaccagacttctataaat

SEQ ID NO: 593238 - DNA, 25 bp, Mus musculus
ggactcacagagaatcttcactcaa

SEQ ID NO: 593239 - DNA, 25 bp, Mus musculus
ggactcacagagtatcttcactcaa

SEQ ID NO: 593240 - DNA, 25 bp, Mus musculus
ggactcacagatatcaagccaggct

SEQ ID NO: 593241 - DNA, 25 bp, Mus musculus
ggactcacagatttcaagccaggct

SEQ ID NO: 593242 - DNA, 25 bp, Mus musculus
ggactcacatatatgagcacctgct

SEQ ID NO: 593243 - DNA, 25 bp, Mus musculus
ggactcacatatcttggcagcatca

SEQ ID NO: 593244 - DNA, 25 bp, Mus musculus
ggactcacatatgttggcagcatca

SEQ ID NO: 593245 - DNA, 25 bp, Mus musculus
ggactcacatatttgagcacctgct

SEQ ID NO: 593246 - DNA, 25 bp, Mus musculus
ggactcaccccaagacaaacacaag

SEQ ID NO: 593247 - DNA, 25 bp, Mus musculus
ggactcaccccatgacaaacacaag

SEQ ID NO: 593248 - DNA, 25 bp, Mus musculus
ggactcaccgggacttcagaacttt

SEQ ID NO: 593249 - DNA, 25 bp, Mus musculus
ggactcaccgggtcttcagaacttt

SEQ ID NO: 593250 - DNA, 25 bp, Mus musculus
ggactcacggaccacttggctatgg

SEQ ID NO: 593251 - DNA, 25 bp, Mus musculus
ggactcacggacgacttggctatgg

SEQ ID NO: 593252 - DNA, 25 bp, Mus musculus
ggactcacgtttcggtaggcctgta

SEQ ID NO: 593253 - DNA, 25 bp, Mus musculus
ggactcacgtttgggtaggcctgta

SEQ ID NO: 593254 - DNA, 25 bp, Mus musculus
ggactcactgccatgatgtacgtct

SEQ ID NO: 593255 - DNA, 25 bp, Mus musculus
ggactcactgccttgatgtacgtct

SEQ ID NO: 593256 - DNA, 25 bp, Mus musculus
ggactcactgggatggttgaatcat

SEQ ID NO: 593257 - DNA, 25 bp, Mus musculus
ggactcactgggttggttgaatcat

SEQ ID NO: 593258 - DNA, 25 bp, Mus musculus
ggactcactgtaacaccctgactga

SEQ ID NO: 593259 - DNA, 25 bp, Mus musculus
ggactcactgtaaggtgcttaccaa

SEQ ID NO: 593260 - DNA, 25 bp, Mus musculus
ggactcactgtatcaccctgactga

SEQ ID NO: 593261 - DNA, 25 bp, Mus musculus
ggactcactgtatggtgcttaccaa

SEQ ID NO: 593262 - DNA, 25 bp, Mus musculus
ggactcacttgccaaatactttgtt

SEQ ID NO: 593263 - DNA, 25 bp, Mus musculus
ggactcacttgcgaaatactttgtt

SEQ ID NO: 593264 - DNA, 25 bp, Mus musculus
ggactcacttgtctctgaatggttt

SEQ ID NO: 593265 - DNA, 25 bp, Mus musculus
ggactcacttgtgtctgaatggttt

SEQ ID NO: 593266 - DNA, 25 bp, Mus musculus
ggactcagacatctcttgtctcaac

SEQ ID NO: 593267 - DNA, 25 bp, Mus musculus
ggactcagacatgtcttgtctcaac

SEQ ID NO: 593268 - DNA, 25 bp, Mus musculus
ggactcagactaataaattttggaa

SEQ ID NO: 593269 - DNA, 25 bp, Mus musculus
ggactcagactattaaattttggaa

SEQ ID NO: 593270 - DNA, 25 bp, Mus musculus
ggactcagagagacgaggcctcctg

SEQ ID NO: 593271 - DNA, 25 bp, Mus musculus
ggactcagagagtcgaggcctcctg

SEQ ID NO: 593272 - DNA, 25 bp, Mus musculus
ggactcagagatactttgacaagtt

SEQ ID NO: 593273 - DNA, 25 bp, Mus musculus
ggactcagagattctttgacaagtt

SEQ ID NO: 593274 - DNA, 25 bp, Mus musculus
ggactcagagcaacaacagcgcctt

SEQ ID NO: 593275 - DNA, 25 bp, Mus musculus
ggactcagagcatcaacagcgcctt

SEQ ID NO: 593276 - DNA, 25 bp, Mus musculus
ggactcagagtcagcagaaacttct

SEQ ID NO: 593277 - DNA, 25 bp, Mus musculus
ggactcagagtctgcagaaacttct

SEQ ID NO: 593278 - DNA, 25 bp, Mus musculus
ggactcagatgcattcttcagtggg

SEQ ID NO: 593279 - DNA, 25 bp, Mus musculus
ggactcagatgctttcttcagtggg

SEQ ID NO: 593280 - DNA, 25 bp, Mus musculus
ggactcagcaacaaccaattggcat

SEQ ID NO: 593281 - DNA, 25 bp, Mus musculus
ggactcagcaactaccaattggcat

SEQ ID NO: 593282 - DNA, 25 bp, Mus musculus
ggactcagcactatgccttcaactc

SEQ ID NO: 593283 - DNA, 25 bp, Mus musculus
ggactcagcactttgccttcaactc

SEQ ID NO: 593284 - DNA, 25 bp, Mus musculus
ggactcagccatcagttagccctgg

SEQ ID NO: 593285 - DNA, 25 bp, Mus musculus
ggactcagccatgagttagccctgg

SEQ ID NO: 593286 - DNA, 25 bp, Mus musculus
ggactcagcctcatggtggtcacat

SEQ ID NO: 593287 - DNA, 25 bp, Mus musculus
ggactcagcctcttggtggtcacat

SEQ ID NO: 593288 - DNA, 25 bp, Mus musculus
ggactcaggaggctcataagttcaa

SEQ ID NO: 593289 - DNA, 25 bp, Mus musculus
ggactcaggagggtcataagttcaa

SEQ ID NO: 593290 - DNA, 25 bp, Mus musculus
ggactcaggagtagccagtgaaact

SEQ ID NO: 593291 - DNA, 25 bp, Mus musculus
ggactcaggagttgccagtgaaact

SEQ ID NO: 593292 - DNA, 25 bp, Mus musculus
ggactcaggcctatagtcagtctct

SEQ ID NO: 593293 - DNA, 25 bp, Mus musculus
ggactcaggcctttagtcagtctct

SEQ ID NO: 593294 - DNA, 25 bp, Mus musculus
ggactcaggtgaactagacctgcct

SEQ ID NO: 593295 - DNA, 25 bp, Mus musculus
ggactcaggtgatctagacctgcct

SEQ ID NO: 593296 - DNA, 25 bp, Mus musculus
ggactcagtagacagcagggacccc

SEQ ID NO: 593297 - DNA, 25 bp, Mus musculus
ggactcagtagagagcagggacccc

SEQ ID NO: 593298 - DNA, 25 bp, Mus musculus
ggactcagtcacatcagactggaga

SEQ ID NO: 593299 - DNA, 25 bp, Mus musculus
ggactcagtcacttcagactggaga

SEQ ID NO: 593300 - DNA, 25 bp, Mus musculus
ggactcagtctcacgacgatggagc

SEQ ID NO: 593301 - DNA, 25 bp, Mus musculus
ggactcagtctctcgacgatggagc

SEQ ID NO: 593302 - DNA, 25 bp, Mus musculus
ggactcagtgacaccttagaacttg

SEQ ID NO: 593303 - DNA, 25 bp, Mus musculus
ggactcagtgactccttagaacttg

SEQ ID NO: 593304 - DNA, 25 bp, Mus musculus
ggactcagtgagaaccttcaggatg

SEQ ID NO: 593305 - DNA, 25 bp, Mus musculus
ggactcagtgagtaccttcaggatg

SEQ ID NO: 593306 - DNA, 25 bp, Mus musculus
ggactcagtgtccttataaggagga

SEQ ID NO: 593307 - DNA, 25 bp, Mus musculus
ggactcagtgtcgttataaggagga

SEQ ID NO: 593308 - DNA, 25 bp, Mus musculus
ggactcatattcattaccatgtggg

SEQ ID NO: 593309 - DNA, 25 bp, Mus musculus
ggactcatattctttaccatgtggg

SEQ ID NO: 593310 - DNA, 25 bp, Mus musculus
ggactcatcattatgcatttatatg

SEQ ID NO: 593311 - DNA, 25 bp, Mus musculus
ggactcatcattttgcatttatatg

SEQ ID NO: 593312 - DNA, 25 bp, Mus musculus
ggactcatccgtcccaggagaatga

SEQ ID NO: 593313 - DNA, 25 bp, Mus musculus
ggactcatccgtgccaggagaatga

SEQ ID NO: 593314 - DNA, 25 bp, Mus musculus
ggactcatcctgaaatacggcgtgt

SEQ ID NO: 593315 - DNA, 25 bp, Mus musculus
ggactcatcctgtaatacggcgtgt

SEQ ID NO: 593316 - DNA, 25 bp, Mus musculus
ggactcatccttccattattagggc

SEQ ID NO: 593317 - DNA, 25 bp, Mus musculus
ggactcatccttgcattattagggc

SEQ ID NO: 593318 - DNA, 25 bp, Mus musculus
ggactcatcttccaggacatgggct

SEQ ID NO: 593319 - DNA, 25 bp, Mus musculus
ggactcatcttcgaggacatgggct

SEQ ID NO: 593320 - DNA, 25 bp, Mus musculus
ggactcatggtcaaatggcacaact

SEQ ID NO: 593321 - DNA, 25 bp, Mus musculus
ggactcatggtctaatggcacaact

SEQ ID NO: 593322 - DNA, 25 bp, Mus musculus
ggactcattagaatataagccgaca

SEQ ID NO: 593323 - DNA, 25 bp, Mus musculus
ggactcattagattataagccgaca

SEQ ID NO: 593324 - DNA, 25 bp, Mus musculus
ggactcattctactccaggattcat

SEQ ID NO: 593325 - DNA, 25 bp, Mus musculus
ggactcattctagtccaggattcat

SEQ ID NO: 593326 - DNA, 25 bp, Mus musculus
ggactcattctgagcttttattctc

SEQ ID NO: 593327 - DNA, 25 bp, Mus musculus
ggactcattctgtgcttttattctc

SEQ ID NO: 593328 - DNA, 25 bp, Mus musculus
ggactcattggccaagcctgcggta

SEQ ID NO: 593329 - DNA, 25 bp, Mus musculus
ggactcattggcgaagcctgcggta

SEQ ID NO: 593330 - DNA, 25 bp, Mus musculus
ggactccaagtaaatgttgctccta

SEQ ID NO: 593331 - DNA, 25 bp, Mus musculus
ggactccaagtatatgttgctccta

SEQ ID NO: 593332 - DNA, 25 bp, Mus musculus
ggactccacctcagatgacgacggg

SEQ ID NO: 593333 - DNA, 25 bp, Mus musculus
ggactccacctctgatgacgacggg

SEQ ID NO: 593334 - DNA, 25 bp, Mus musculus
ggactccacttacccttttaagcga

SEQ ID NO: 593335 - DNA, 25 bp, Mus musculus
ggactccacttagccttttaagcga

SEQ ID NO: 593336 - DNA, 25 bp, Mus musculus
ggactccagactaatgctcctacag

SEQ ID NO: 593337 - DNA, 25 bp, Mus musculus
ggactccagacttatgctcctacag

SEQ ID NO: 593338 - DNA, 25 bp, Mus musculus
ggactccagcacaagatggtactgc

SEQ ID NO: 593339 - DNA, 25 bp, Mus musculus
ggactccagcactagatggtactgc

SEQ ID NO: 593340 - DNA, 25 bp, Mus musculus
ggactccaggaaccacgggacctgt

SEQ ID NO: 593341 - DNA, 25 bp, Mus musculus
ggactccaggaagcacgggacctgt

SEQ ID NO: 593342 - DNA, 25 bp, Mus musculus
ggactccagtaaacggtgtgtgtga

SEQ ID NO: 593343 - DNA, 25 bp, Mus musculus
ggactccagtaatcggtgtgtgtga

SEQ ID NO: 593344 - DNA, 25 bp, Mus musculus
ggactccagtccaaacttcaaatga

SEQ ID NO: 593345 - DNA, 25 bp, Mus musculus
ggactccagtcctaacttcaaatga

SEQ ID NO: 593346 - DNA, 25 bp, Mus musculus
ggactccagtgccacgttcgaaaag

SEQ ID NO: 593347 - DNA, 25 bp, Mus musculus
ggactccagtgcgacgttcgaaaag

SEQ ID NO: 593348 - DNA, 25 bp, Mus musculus
ggactccataggatttgttacttga

SEQ ID NO: 593349 - DNA, 25 bp, Mus musculus
ggactccataggttttgttacttga

SEQ ID NO: 593350 - DNA, 25 bp, Mus musculus
ggactccatctcaccagggacaaca

SEQ ID NO: 593351 - DNA, 25 bp, Mus musculus
ggactccatctctccagggacaaca

SEQ ID NO: 593352 - DNA, 25 bp, Mus musculus
ggactccatggcacacttgcacata

SEQ ID NO: 593353 - DNA, 25 bp, Mus musculus
ggactccatggctcacttgcacata

SEQ ID NO: 593354 - DNA, 25 bp, Mus musculus
ggactcccaagtacagtgctacagg

SEQ ID NO: 593355 - DNA, 25 bp, Mus musculus
ggactcccaagtcattctcagcaaa

SEQ ID NO: 593356 - DNA, 25 bp, Mus musculus
ggactcccaagtgattctcagcaaa

SEQ ID NO: 593357 - DNA, 25 bp, Mus musculus
ggactcccaagttcagtgctacagg

SEQ ID NO: 593358 - DNA, 25 bp, Mus musculus
ggactcccagcgagagcaagcggct

SEQ ID NO: 593359 - DNA, 25 bp, Mus musculus
ggactcccagcgtgagcaagcggct

SEQ ID NO: 593360 - DNA, 25 bp, Mus musculus
ggactcccagttaatagttgtctaa

SEQ ID NO: 593361 - DNA, 25 bp, Mus musculus
ggactcccagtttatagttgtctaa

SEQ ID NO: 593362 - DNA, 25 bp, Mus musculus
ggactcccataactctgaagacgtg

SEQ ID NO: 593363 - DNA, 25 bp, Mus musculus
ggactcccataagtctgaagacgtg

SEQ ID NO: 593364 - DNA, 25 bp, Mus musculus
ggactccccactctgttaatattta

SEQ ID NO: 593365 - DNA, 25 bp, Mus musculus
ggactccccactgtgttaatattta

SEQ ID NO: 593366 - DNA, 25 bp, Mus musculus
ggactccccagaagactccggatga

SEQ ID NO: 593367 - DNA, 25 bp, Mus musculus
ggactccccagatgactccggatga

SEQ ID NO: 593368 - DNA, 25 bp, Mus musculus
ggactccccttccttgggagtcata

SEQ ID NO: 593369 - DNA, 25 bp, Mus musculus
ggactccccttcgttgggagtcata

SEQ ID NO: 593370 - DNA, 25 bp, Mus musculus
ggactcccgaatccgtgaccttctg

SEQ ID NO: 593371 - DNA, 25 bp, Mus musculus
ggactcccgaatgcgtgaccttctg

SEQ ID NO: 593372 - DNA, 25 bp, Mus musculus
ggactcccggcaccctgaagacggt

SEQ ID NO: 593373 - DNA, 25 bp, Mus musculus
ggactcccggcagcctgaagacggt

SEQ ID NO: 593374 - DNA, 25 bp, Mus musculus
ggactccctaaaatttcatttctgt

SEQ ID NO: 593375 - DNA, 25 bp, Mus musculus
ggactccctaaattttcatttctgt

SEQ ID NO: 593376 - DNA, 25 bp, Mus musculus
ggactccctatcacgtgtgtatgta

SEQ ID NO: 593377 - DNA, 25 bp, Mus musculus
ggactccctatctcgtgtgtatgta

SEQ ID NO: 593378 - DNA, 25 bp, Mus musculus
ggactccctatgaagcttaagctgg

SEQ ID NO: 593379 - DNA, 25 bp, Mus musculus
ggactccctatgtagcttaagctgg

SEQ ID NO: 593380 - DNA, 25 bp, Mus musculus
ggactccctctacagcaaagccaag

SEQ ID NO: 593381 - DNA, 25 bp, Mus musculus
ggactccctctagagcaaagccaag

SEQ ID NO: 593382 - DNA, 25 bp, Mus musculus
ggactccctgccatgacctgaggca

SEQ ID NO: 593383 - DNA, 25 bp, Mus musculus
ggactccctgccttgacctgaggca

SEQ ID NO: 593384 - DNA, 25 bp, Mus musculus
ggactccctgctagatggtgtgcat

SEQ ID NO: 593385 - DNA, 25 bp, Mus musculus
ggactccctgcttgatggtgtgcat

SEQ ID NO: 593386 - DNA, 25 bp, Mus musculus
ggactccctggcagacaaaacactg

SEQ ID NO: 593387 - DNA, 25 bp, Mus musculus
ggactccctggctgacaaaacactg

SEQ ID NO: 593388 - DNA, 25 bp, Mus musculus
ggactccctgtaacctaagaaatgc

SEQ ID NO: 593389 - DNA, 25 bp, Mus musculus
ggactccctgtatcctaagaaatgc

SEQ ID NO: 593390 - DNA, 25 bp, Mus musculus
ggactccctgtgaggtgtcgatgtc

SEQ ID NO: 593391 - DNA, 25 bp, Mus musculus
ggactccctgtgtggtgtcgatgtc

SEQ ID NO: 593392 - DNA, 25 bp, Mus musculus
ggactccgatgccaaggtttcacag

SEQ ID NO: 593393 - DNA, 25 bp, Mus musculus
ggactccgatgcgaaggtttcacag

SEQ ID NO: 593394 - DNA, 25 bp, Mus musculus
ggactccgattaaggctcaggctat

SEQ ID NO: 593395 - DNA, 25 bp, Mus musculus
ggactccgattatggctcaggctat

SEQ ID NO: 593396 - DNA, 25 bp, Mus musculus
ggactccgcaggacactgactccga

SEQ ID NO: 593397 - DNA, 25 bp, Mus musculus
ggactccgcaggtcactgactccga

SEQ ID NO: 593398 - DNA, 25 bp, Mus musculus
ggactccgcagtcctttctagtgtc

SEQ ID NO: 593399 - DNA, 25 bp, Mus musculus
ggactccgcagtgctttctagtgtc

SEQ ID NO: 593400 - DNA, 25 bp, Mus musculus
ggactccgtcctagataccgatggg

SEQ ID NO: 593401 - DNA, 25 bp, Mus musculus
ggactccgtccttgataccgatggg

SEQ ID NO: 593402 - DNA, 25 bp, Mus musculus
ggactccgtctcagactaagttcag

SEQ ID NO: 593403 - DNA, 25 bp, Mus musculus
ggactccgtctctgactaagttcag

SEQ ID NO: 593404 - DNA, 25 bp, Mus musculus
ggactccgtggacaggaacacccat

SEQ ID NO: 593405 - DNA, 25 bp, Mus musculus
ggactccgtggagaggaacacccat

SEQ ID NO: 593406 - DNA, 25 bp, Mus musculus
ggactccgttgtcgatccgtctgtg

SEQ ID NO: 593407 - DNA, 25 bp, Mus musculus
ggactccgttgtggatccgtctgtg

SEQ ID NO: 593408 - DNA, 25 bp, Mus musculus
ggactcctacatattcgatctgggt

SEQ ID NO: 593409 - DNA, 25 bp, Mus musculus
ggactcctacattttcgatctgggt

SEQ ID NO: 593410 - DNA, 25 bp, Mus musculus
ggactcctattaaaagcattgcggc

SEQ ID NO: 593411 - DNA, 25 bp, Mus musculus
ggactcctattataagcattgcggc

SEQ ID NO: 593412 - DNA, 25 bp, Mus musculus
ggactcctcaccctttacttgaatg

SEQ ID NO: 593413 - DNA, 25 bp, Mus musculus
ggactcctcaccgtttacttgaatg

SEQ ID NO: 593414 - DNA, 25 bp, Mus musculus
ggactcctcacgaatgcacacaggt

SEQ ID NO: 593415 - DNA, 25 bp, Mus musculus
ggactcctcacgtatgcacacaggt

SEQ ID NO: 593416 - DNA, 25 bp, Mus musculus
ggactcctccttattgtgagcagaa

SEQ ID NO: 593417 - DNA, 25 bp, Mus musculus
ggactcctcctttttgtgagcagaa

SEQ ID NO: 593418 - DNA, 25 bp, Mus musculus
ggactcctcgtaccagaagtacagt

SEQ ID NO: 593419 - DNA, 25 bp, Mus musculus
ggactcctcgtagcagaagtacagt

SEQ ID NO: 593420 - DNA, 25 bp, Mus musculus
ggactcctctgcatcttagcaggat

SEQ ID NO: 593421 - DNA, 25 bp, Mus musculus
ggactcctctgcttcttagcaggat

SEQ ID NO: 593422 - DNA, 25 bp, Mus musculus
ggactcctcttgaagaaccctttca

SEQ ID NO: 593423 - DNA, 25 bp, Mus musculus
ggactcctcttgtagaaccctttca

SEQ ID NO: 593424 - DNA, 25 bp, Mus musculus
ggactcctgagtctggctgacttca

SEQ ID NO: 593425 - DNA, 25 bp, Mus musculus
ggactcctgagtgtggctgacttca

SEQ ID NO: 593426 - DNA, 25 bp, Mus musculus
ggactcctgatgaccctcaagggac

SEQ ID NO: 593427 - DNA, 25 bp, Mus musculus
ggactcctgatgtccctcaagggac

SEQ ID NO: 593428 - DNA, 25 bp, Mus musculus
ggactcctgcaaatcccaagaattt

SEQ ID NO: 593429 - DNA, 25 bp, Mus musculus
ggactcctgcaattcccaagaattt

SEQ ID NO: 593430 - DNA, 25 bp, Mus musculus
ggactcctgcccagggaagaggcta

SEQ ID NO: 593431 - DNA, 25 bp, Mus musculus
ggactcctgccctgggaagaggcta

SEQ ID NO: 593432 - DNA, 25 bp, Mus musculus
ggactcctggccaccattgcagtga

SEQ ID NO: 593433 - DNA, 25 bp, Mus musculus
ggactcctggcctccattgcagtga

SEQ ID NO: 593434 - DNA, 25 bp, Mus musculus
ggactcctgtcactaggcagctagc

SEQ ID NO: 593435 - DNA, 25 bp, Mus musculus
ggactcctgtcagtaggcagctagc

SEQ ID NO: 593436 - DNA, 25 bp, Mus musculus
ggactcctgttcaagagatcactgt

SEQ ID NO: 593437 - DNA, 25 bp, Mus musculus
ggactcctgttctagagatcactgt

SEQ ID NO: 593438 - DNA, 25 bp, Mus musculus
ggactccttcctagaagagaccagc

SEQ ID NO: 593439 - DNA, 25 bp, Mus musculus
ggactccttccttgaagagaccagc

SEQ ID NO: 593440 - DNA, 25 bp, Mus musculus
ggactccttgagctatttgtcctaa

SEQ ID NO: 593441 - DNA, 25 bp, Mus musculus
ggactccttgaggtatttgtcctaa

SEQ ID NO: 593442 - DNA, 25 bp, Mus musculus
ggactccttgttccacacatattta

SEQ ID NO: 593443 - DNA, 25 bp, Mus musculus
ggactccttgttgcacacatattta

SEQ ID NO: 593444 - DNA, 25 bp, Mus musculus
ggactcctttttcctagaggttcaa

SEQ ID NO: 593445 - DNA, 25 bp, Mus musculus
ggactcctttttgctagaggttcaa

SEQ ID NO: 593446 - DNA, 25 bp, Mus musculus
ggactcgaactcagggtttcatgcc

SEQ ID NO: 593447 - DNA, 25 bp, Mus musculus
ggactcgaactctgggtttcatgcc

SEQ ID NO: 593448 - DNA, 25 bp, Mus musculus
ggactcgaagggatacttgctgctg

SEQ ID NO: 593449 - DNA, 25 bp, Mus musculus
ggactcgaagggttacttgctgctg

SEQ ID NO: 593450 - DNA, 25 bp, Mus musculus
ggactcgaatctcaaaagccactta

SEQ ID NO: 593451 - DNA, 25 bp, Mus musculus
ggactcgaatctgaaaagccactta

SEQ ID NO: 593452 - DNA, 25 bp, Mus musculus
ggactcgaatttcattttgtaatgt

SEQ ID NO: 593453 - DNA, 25 bp, Mus musculus
ggactcgaatttgattttgtaatgt

SEQ ID NO: 593454 - DNA, 25 bp, Mus musculus
ggactcgactgcagacgacagttgg

SEQ ID NO: 593455 - DNA, 25 bp, Mus musculus
ggactcgactgctgacgacagttgg

SEQ ID NO: 593456 - DNA, 25 bp, Mus musculus
ggactcgagataacccacatttaga

SEQ ID NO: 593457 - DNA, 25 bp, Mus musculus
ggactcgagatatcccacatttaga

SEQ ID NO: 593458 - DNA, 25 bp, Mus musculus
ggactcgagatcaactgctggatga

SEQ ID NO: 593459 - DNA, 25 bp, Mus musculus
ggactcgagatctactgctggatga

SEQ ID NO: 593460 - DNA, 25 bp, Mus musculus
ggactcgagggcagcagatccatct

SEQ ID NO: 593461 - DNA, 25 bp, Mus musculus
ggactcgagggctgcagatccatct

SEQ ID NO: 593462 - DNA, 25 bp, Mus musculus
ggactcgccctgaaagtagttctgg

SEQ ID NO: 593463 - DNA, 25 bp, Mus musculus
ggactcgccctgtaagtagttctgg

SEQ ID NO: 593464 - DNA, 25 bp, Mus musculus
ggactcgccttcagtcgggaggaac

SEQ ID NO: 593465 - DNA, 25 bp, Mus musculus
ggactcgccttctgtcgggaggaac

SEQ ID NO: 593466 - DNA, 25 bp, Mus musculus
ggactcgcgacaacttcaccaaggc

SEQ ID NO: 593467 - DNA, 25 bp, Mus musculus
ggactcgcgacatcttcaccaaggc

SEQ ID NO: 593468 - DNA, 25 bp, Mus musculus
ggactcgcgattccgctcattcgca

SEQ ID NO: 593469 - DNA, 25 bp, Mus musculus
ggactcgcgattgcgctcattcgca

SEQ ID NO: 593470 - DNA, 25 bp, Mus musculus
ggactcgcgtgcctccacagggtca

SEQ ID NO: 593471 - DNA, 25 bp, Mus musculus
ggactcgcgtgcgtccacagggtca

SEQ ID NO: 593472 - DNA, 25 bp, Mus musculus
ggactcgctaccagcatagaattat

SEQ ID NO: 593473 - DNA, 25 bp, Mus musculus
ggactcgctacctgcatagaattat

SEQ ID NO: 593474 - DNA, 25 bp, Mus musculus
ggactcgctatgaagatcaagctaa

SEQ ID NO: 593475 - DNA, 25 bp, Mus musculus
ggactcgctatgtagatcaagctaa

SEQ ID NO: 593476 - DNA, 25 bp, Mus musculus
ggactcggctccctagtggttacag

SEQ ID NO: 593477 - DNA, 25 bp, Mus musculus
ggactcggctccgtagtggttacag

SEQ ID NO: 593478 - DNA, 25 bp, Mus musculus
ggactcgggatcatcaaccggcggc

SEQ ID NO: 593479 - DNA, 25 bp, Mus musculus
ggactcgggatcttcaaccggcggc

SEQ ID NO: 593480 - DNA, 25 bp, Mus musculus
ggactcgggcatccatatcatcctg

SEQ ID NO: 593481 - DNA, 25 bp, Mus musculus
ggactcgggcatgcatatcatcctg

SEQ ID NO: 593482 - DNA, 25 bp, Mus musculus
ggactcgggttgactgacatcgctg

SEQ ID NO: 593483 - DNA, 25 bp, Mus musculus
ggactcgggttgtctgacatcgctg

SEQ ID NO: 593484 - DNA, 25 bp, Mus musculus
ggactcggtatacctccacgtggag

SEQ ID NO: 593485 - DNA, 25 bp, Mus musculus
ggactcggtatagctccacgtggag

SEQ ID NO: 593486 - DNA, 25 bp, Mus musculus
ggactcggtatcagtgacagacagt

SEQ ID NO: 593487 - DNA, 25 bp, Mus musculus
ggactcggtatctgtgacagacagt

SEQ ID NO: 593488 - DNA, 25 bp, Mus musculus
ggactcgtacctaatgaaccacttt

SEQ ID NO: 593489 - DNA, 25 bp, Mus musculus
ggactcgtaccttatgaaccacttt

SEQ ID NO: 593490 - DNA, 25 bp, Mus musculus
ggactcgtacgactcttttatattt

SEQ ID NO: 593491 - DNA, 25 bp, Mus musculus
ggactcgtacgagtcttttatattt

SEQ ID NO: 593492 - DNA, 25 bp, Mus musculus
ggactcgtgtagcactgtccccatt

SEQ ID NO: 593493 - DNA, 25 bp, Mus musculus
ggactcgtgtaggactgtccccatt

SEQ ID NO: 593494 - DNA, 25 bp, Mus musculus
ggactctaaacccaggactcaggat

SEQ ID NO: 593495 - DNA, 25 bp, Mus musculus
ggactctaaaccgaggactcaggat

SEQ ID NO: 593496 - DNA, 25 bp, Mus musculus
ggactctaaagaatcacctagctac

SEQ ID NO: 593497 - DNA, 25 bp, Mus musculus
ggactctaaagattcacctagctac

SEQ ID NO: 593498 - DNA, 25 bp, Mus musculus
ggactctaacatatcacctgaagcc

SEQ ID NO: 593499 - DNA, 25 bp, Mus musculus
ggactctaacatttcacctgaagcc

SEQ ID NO: 593500 - DNA, 25 bp, Mus musculus
ggactctaagagatgttcactgact

SEQ ID NO: 593501 - DNA, 25 bp, Mus musculus
ggactctaagagttgttcactgact

SEQ ID NO: 593502 - DNA, 25 bp, Mus musculus
ggactctaagcactttacatggtaa

SEQ ID NO: 593503 - DNA, 25 bp, Mus musculus
ggactctaagcagtttacatggtaa

SEQ ID NO: 593504 - DNA, 25 bp, Mus musculus
ggactctaccacagtctaggacaga

SEQ ID NO: 593505 - DNA, 25 bp, Mus musculus
ggactctaccactgtctaggacaga

SEQ ID NO: 593506 - DNA, 25 bp, Mus musculus
ggactctaccataggtttcaggatt

SEQ ID NO: 593507 - DNA, 25 bp, Mus musculus
ggactctaccattggtttcaggatt

SEQ ID NO: 593508 - DNA, 25 bp, Mus musculus
ggactctacgggatcctctggatca

SEQ ID NO: 593509 - DNA, 25 bp, Mus musculus
ggactctacgggttcctctggatca

SEQ ID NO: 593510 - DNA, 25 bp, Mus musculus
ggactctactcaaatactgtacaaa

SEQ ID NO: 593511 - DNA, 25 bp, Mus musculus
ggactctactcatatactgtacaaa

SEQ ID NO: 593512 - DNA, 25 bp, Mus musculus
ggactctagataacccaagtctggc

SEQ ID NO: 593513 - DNA, 25 bp, Mus musculus
ggactctagatatcccaagtctggc

SEQ ID NO: 593514 - DNA, 25 bp, Mus musculus
ggactctagattccaggctgtacca

SEQ ID NO: 593515 - DNA, 25 bp, Mus musculus
ggactctagattgcaggctgtacca

SEQ ID NO: 593516 - DNA, 25 bp, Mus musculus
ggactctagggaatctgtattacag

SEQ ID NO: 593517 - DNA, 25 bp, Mus musculus
ggactctagggacgcagcattcaga

SEQ ID NO: 593518 - DNA, 25 bp, Mus musculus
ggactctagggaggcagcattcaga

SEQ ID NO: 593519 - DNA, 25 bp, Mus musculus
ggactctagggattctgtattacag

SEQ ID NO: 593520 - DNA, 25 bp, Mus musculus
ggactctagggcaacctgctgagat

SEQ ID NO: 593521 - DNA, 25 bp, Mus musculus
ggactctagggctacctgctgagat

SEQ ID NO: 593522 - DNA, 25 bp, Mus musculus
ggactctatatgcttctcagttata

SEQ ID NO: 593523 - DNA, 25 bp, Mus musculus
ggactctatatggttctcagttata

SEQ ID NO: 593524 - DNA, 25 bp, Mus musculus
ggactctatcaacgccatctttcct

SEQ ID NO: 593525 - DNA, 25 bp, Mus musculus
ggactctatcaaggccatctttcct

SEQ ID NO: 593526 - DNA, 25 bp, Mus musculus
ggactctatccaagttcagctgtga

SEQ ID NO: 593527 - DNA, 25 bp, Mus musculus
ggactctatccatgttcagctgtga

SEQ ID NO: 593528 - DNA, 25 bp, Mus musculus
ggactctatcttcaactcaactcca

SEQ ID NO: 593529 - DNA, 25 bp, Mus musculus
ggactctatcttgaactcaactcca

SEQ ID NO: 593530 - DNA, 25 bp, Mus musculus
ggactctattctaagccaaggataa

SEQ ID NO: 593531 - DNA, 25 bp, Mus musculus
ggactctattcttagccaaggataa

SEQ ID NO: 593532 - DNA, 25 bp, Mus musculus
ggactctcaactaccaatgactgtt

SEQ ID NO: 593533 - DNA, 25 bp, Mus musculus
ggactctcaacttccaatgactgtt

SEQ ID NO: 593534 - DNA, 25 bp, Mus musculus
ggactctcaataaccggactatcgg

SEQ ID NO: 593535 - DNA, 25 bp, Mus musculus
ggactctcaatatccggactatcgg

SEQ ID NO: 593536 - DNA, 25 bp, Mus musculus
ggactctcagaactagctcctgtgt

SEQ ID NO: 593537 - DNA, 25 bp, Mus musculus
ggactctcagaagtagctcctgtgt

SEQ ID NO: 593538 - DNA, 25 bp, Mus musculus
ggactctcatcgctggcactgagta

SEQ ID NO: 593539 - DNA, 25 bp, Mus musculus
ggactctcatcggtggcactgagta

SEQ ID NO: 593540 - DNA, 25 bp, Mus musculus
ggactctcccagcattgagtttgtt

SEQ ID NO: 593541 - DNA, 25 bp, Mus musculus
ggactctcccaggattgagtttgtt

SEQ ID NO: 593542 - DNA, 25 bp, Mus musculus
ggactctccgatacaaaattctcat

SEQ ID NO: 593543 - DNA, 25 bp, Mus musculus
ggactctccgattcaaaattctcat

SEQ ID NO: 593544 - DNA, 25 bp, Mus musculus
ggactctcctaacataacatgtttt

SEQ ID NO: 593545 - DNA, 25 bp, Mus musculus
ggactctcctaagataacatgtttt

SEQ ID NO: 593546 - DNA, 25 bp, Mus musculus
ggactctccttgaagaaccataagc

SEQ ID NO: 593547 - DNA, 25 bp, Mus musculus
ggactctccttgtagaaccataagc

SEQ ID NO: 593548 - DNA, 25 bp, Mus musculus
ggactctctgagagctcttcagaaa

SEQ ID NO: 593549 - DNA, 25 bp, Mus musculus
ggactctctgagtgctcttcagaaa

SEQ ID NO: 593550 - DNA, 25 bp, Mus musculus
ggactctcttaaattagctttctgt

SEQ ID NO: 593551 - DNA, 25 bp, Mus musculus
ggactctcttaatttagctttctgt

SEQ ID NO: 593552 - DNA, 25 bp, Mus musculus
ggactctcttatacacatgtgcttt

SEQ ID NO: 593553 - DNA, 25 bp, Mus musculus
ggactctcttattcacatgtgcttt

SEQ ID NO: 593554 - DNA, 25 bp, Mus musculus
ggactctcttggcactggcaataag

SEQ ID NO: 593555 - DNA, 25 bp, Mus musculus
ggactctcttgggactggcaataag

SEQ ID NO: 593556 - DNA, 25 bp, Mus musculus
ggactctctttaaagtcatctgtga

SEQ ID NO: 593557 - DNA, 25 bp, Mus musculus
ggactctctttatagtcatctgtga

SEQ ID NO: 593558 - DNA, 25 bp, Mus musculus
ggactctctttcactacgaccggag

SEQ ID NO: 593559 - DNA, 25 bp, Mus musculus
ggactctctttctctacgaccggag

SEQ ID NO: 593560 - DNA, 25 bp, Mus musculus
ggactctgaaagctgccccatttta

SEQ ID NO: 593561 - DNA, 25 bp, Mus musculus
ggactctgaaaggtgccccatttta

SEQ ID NO: 593562 - DNA, 25 bp, Mus musculus
ggactctgaagacattgcgtgacct

SEQ ID NO: 593563 - DNA, 25 bp, Mus musculus
ggactctgaagagattgcgtgacct

SEQ ID NO: 593564 - DNA, 25 bp, Mus musculus
ggactctgacacagcacatgaactg

SEQ ID NO: 593565 - DNA, 25 bp, Mus musculus
ggactctgacactgcacatgaactg

SEQ ID NO: 593566 - DNA, 25 bp, Mus musculus
ggactctgatcacgaggcagacatt

SEQ ID NO: 593567 - DNA, 25 bp, Mus musculus
ggactctgatcaggaggcagacatt

SEQ ID NO: 593568 - DNA, 25 bp, Mus musculus
ggactctgatgaccaccgaggtgac

SEQ ID NO: 593569 - DNA, 25 bp, Mus musculus
ggactctgatgagcaccgaggtgac

SEQ ID NO: 593570 - DNA, 25 bp, Mus musculus
ggactctgcagccttggagcctcag

SEQ ID NO: 593571 - DNA, 25 bp, Mus musculus
ggactctgcagcgttggagcctcag

SEQ ID NO: 593572 - DNA, 25 bp, Mus musculus
ggactctgccatccatttatttgct

SEQ ID NO: 593573 - DNA, 25 bp, Mus musculus
ggactctgccatgcatttatttgct

SEQ ID NO: 593574 - DNA, 25 bp, Mus musculus
ggactctgctccatgatttgccttt

SEQ ID NO: 593575 - DNA, 25 bp, Mus musculus
ggactctgctccttgatttgccttt

SEQ ID NO: 593576 - DNA, 25 bp, Mus musculus
ggactctgctgaaaaccctagagga

SEQ ID NO: 593577 - DNA, 25 bp, Mus musculus
ggactctgctgataaccctagagga

SEQ ID NO: 593578 - DNA, 25 bp, Mus musculus
ggactctgcttccagactggagctg

SEQ ID NO: 593579 - DNA, 25 bp, Mus musculus
ggactctgcttcctgtaggttaatc

SEQ ID NO: 593580 - DNA, 25 bp, Mus musculus
ggactctgcttcgagactggagctg

SEQ ID NO: 593581 - DNA, 25 bp, Mus musculus
ggactctgcttcgtgtaggttaatc

SEQ ID NO: 593582 - DNA, 25 bp, Mus musculus
ggactctggagtagccgctcaggct

SEQ ID NO: 593583 - DNA, 25 bp, Mus musculus
ggactctggagtctgttggaatttt

SEQ ID NO: 593584 - DNA, 25 bp, Mus musculus
ggactctggagtgtgttggaatttt

SEQ ID NO: 593585 - DNA, 25 bp, Mus musculus
ggactctggagttgccgctcaggct

SEQ ID NO: 593586 - DNA, 25 bp, Mus musculus
ggactctggcccagcatccatatag

SEQ ID NO: 593587 - DNA, 25 bp, Mus musculus
ggactctggccctgcatccatatag

SEQ ID NO: 593588 - DNA, 25 bp, Mus musculus
ggactctggcgcacagcttcggaga

SEQ ID NO: 593589 - DNA, 25 bp, Mus musculus
ggactctggcgctcagcttcggaga

SEQ ID NO: 593590 - DNA, 25 bp, Mus musculus
ggactctggcggaggaaagactatt

SEQ ID NO: 593591 - DNA, 25 bp, Mus musculus
ggactctggcggtggaaagactatt

SEQ ID NO: 593592 - DNA, 25 bp, Mus musculus
ggactctgggcaataatagggacaa

SEQ ID NO: 593593 - DNA, 25 bp, Mus musculus
ggactctgggcattaatagggacaa

SEQ ID NO: 593594 - DNA, 25 bp, Mus musculus
ggactctgggccagaactatactag

SEQ ID NO: 593595 - DNA, 25 bp, Mus musculus
ggactctgggcctgaactatactag

SEQ ID NO: 593596 - DNA, 25 bp, Mus musculus
ggactctggtccctccagagaggct

SEQ ID NO: 593597 - DNA, 25 bp, Mus musculus
ggactctggtccgtccagagaggct

SEQ ID NO: 593598 - DNA, 25 bp, Mus musculus
ggactctggtgtataggctcactca

SEQ ID NO: 593599 - DNA, 25 bp, Mus musculus
ggactctggtgtttaggctcactca

SEQ ID NO: 593600 - DNA, 25 bp, Mus musculus
ggactctgtccgacaggccaggaaa

SEQ ID NO: 593601 - DNA, 25 bp, Mus musculus
ggactctgtccgtcaggccaggaaa

SEQ ID NO: 593602 - DNA, 25 bp, Mus musculus
ggactctgtgatcttgccaatagta

SEQ ID NO: 593603 - DNA, 25 bp, Mus musculus
ggactctgtgatgttgccaatagta

SEQ ID NO: 593604 - DNA, 25 bp, Mus musculus
ggactctgttctccaatgtatcagt

SEQ ID NO: 593605 - DNA, 25 bp, Mus musculus
ggactctgttctgcaatgtatcagt

SEQ ID NO: 593606 - DNA, 25 bp, Mus musculus
ggactcttcaaaagttactgccagg

SEQ ID NO: 593607 - DNA, 25 bp, Mus musculus
ggactcttcaaatgttactgccagg

SEQ ID NO: 593608 - DNA, 25 bp, Mus musculus
ggactcttcagaatttctctccaac

SEQ ID NO: 593609 - DNA, 25 bp, Mus musculus
ggactcttcagattttctctccaac

SEQ ID NO: 593610 - DNA, 25 bp, Mus musculus
ggactcttcagtatttgactctagc

SEQ ID NO: 593611 - DNA, 25 bp, Mus musculus
ggactcttcagtttttgactctagc

SEQ ID NO: 593612 - DNA, 25 bp, Mus musculus
ggactcttcatgacaacttctacta

SEQ ID NO: 593613 - DNA, 25 bp, Mus musculus
ggactcttcatgtcaacttctacta

SEQ ID NO: 593614 - DNA, 25 bp, Mus musculus
ggactcttcttcatttcttgttgaa

SEQ ID NO: 593615 - DNA, 25 bp, Mus musculus
ggactcttcttcttttcttgttgaa

SEQ ID NO: 593616 - DNA, 25 bp, Mus musculus
ggactcttctttatagatatactaa

SEQ ID NO: 593617 - DNA, 25 bp, Mus musculus
ggactcttctttttagatatactaa

SEQ ID NO: 593618 - DNA, 25 bp, Mus musculus
ggactcttgagcacctctgggaagg

SEQ ID NO: 593619 - DNA, 25 bp, Mus musculus
ggactcttgagctcctctgggaagg

SEQ ID NO: 593620 - DNA, 25 bp, Mus musculus
ggactcttgataccttctgaggact

SEQ ID NO: 593621 - DNA, 25 bp, Mus musculus
ggactcttgatagcttctgaggact

SEQ ID NO: 593622 - DNA, 25 bp, Mus musculus
ggactctttgagaagcatcacggga

SEQ ID NO: 593623 - DNA, 25 bp, Mus musculus
ggactctttgagtagcatcacggga

SEQ ID NO: 593624 - DNA, 25 bp, Mus musculus
ggactctttgctcccagttgtcaaa

SEQ ID NO: 593625 - DNA, 25 bp, Mus musculus
ggactctttgctgccagttgtcaaa

SEQ ID NO: 593626 - DNA, 25 bp, Mus musculus
ggactcttttaaattcttgcctttg

SEQ ID NO: 593627 - DNA, 25 bp, Mus musculus
ggactcttttaatttcttgcctttg

SEQ ID NO: 593628 - DNA, 25 bp, Mus musculus
ggactcttttggacctaagtatctt

SEQ ID NO: 593629 - DNA, 25 bp, Mus musculus
ggactcttttggtcctaagtatctt

SEQ ID NO: 593630 - DNA, 25 bp, Mus musculus
ggactgaaaactagctggattatct

SEQ ID NO: 593631 - DNA, 25 bp, Mus musculus
ggactgaaaacttgctggattatct

SEQ ID NO: 593632 - DNA, 25 bp, Mus musculus
ggactgaaacaaagtttgctcaccc

SEQ ID NO: 593633 - DNA, 25 bp, Mus musculus
ggactgaaacaatgtttgctcaccc

SEQ ID NO: 593634 - DNA, 25 bp, Mus musculus
ggactgaaagatacctcccggagga

SEQ ID NO: 593635 - DNA, 25 bp, Mus musculus
ggactgaaagattcctcccggagga

SEQ ID NO: 593636 - DNA, 25 bp, Mus musculus
ggactgaaagtactgcctagctctc

SEQ ID NO: 593637 - DNA, 25 bp, Mus musculus
ggactgaaagtagtgcctagctctc

SEQ ID NO: 593638 - DNA, 25 bp, Mus musculus
ggactgaaccaaacccaagatctgg

SEQ ID NO: 593639 - DNA, 25 bp, Mus musculus
ggactgaaccaatcccaagatctgg

SEQ ID NO: 593640 - DNA, 25 bp, Mus musculus
ggactgaaccaccaagatgcaaaga

SEQ ID NO: 593641 - DNA, 25 bp, Mus musculus
ggactgaaccacgaagatgcaaaga

SEQ ID NO: 593642 - DNA, 25 bp, Mus musculus
ggactgaaccctcctgtgatttgat

SEQ ID NO: 593643 - DNA, 25 bp, Mus musculus
ggactgaaccctgctgtgatttgat

SEQ ID NO: 593644 - DNA, 25 bp, Mus musculus
ggactgaactacaacatcctggtgt

SEQ ID NO: 593645 - DNA, 25 bp, Mus musculus
ggactgaactactacatcctggtgt

SEQ ID NO: 593646 - DNA, 25 bp, Mus musculus
ggactgaactccaatgcacatgtac

SEQ ID NO: 593647 - DNA, 25 bp, Mus musculus
ggactgaactccagttggctgcctg

SEQ ID NO: 593648 - DNA, 25 bp, Mus musculus
ggactgaactcctatgcacatgtac

SEQ ID NO: 593649 - DNA, 25 bp, Mus musculus
ggactgaactcctgttggctgcctg

SEQ ID NO: 593650 - DNA, 25 bp, Mus musculus
ggactgaagagtccatgtggccaca

SEQ ID NO: 593651 - DNA, 25 bp, Mus musculus
ggactgaagagtgcatgtggccaca

SEQ ID NO: 593652 - DNA, 25 bp, Mus musculus
ggactgaagcccagcgtggtttcgt

SEQ ID NO: 593653 - DNA, 25 bp, Mus musculus
ggactgaagccctgcgtggtttcgt

SEQ ID NO: 593654 - DNA, 25 bp, Mus musculus
ggactgaagtacaaacctgtctgca

SEQ ID NO: 593655 - DNA, 25 bp, Mus musculus
ggactgaagtactaacctgtctgca

SEQ ID NO: 593656 - DNA, 25 bp, Mus musculus
ggactgaagtatatctccacacggg

SEQ ID NO: 593657 - DNA, 25 bp, Mus musculus
ggactgaagtatttctccacacggg

SEQ ID NO: 593658 - DNA, 25 bp, Mus musculus
ggactgaagtccatgacacaccttt

SEQ ID NO: 593659 - DNA, 25 bp, Mus musculus
ggactgaagtccttgacacaccttt

SEQ ID NO: 593660 - DNA, 25 bp, Mus musculus
ggactgaagttaacccctgttctca

SEQ ID NO: 593661 - DNA, 25 bp, Mus musculus
ggactgaagttaatggtgtcaccac

SEQ ID NO: 593662 - DNA, 25 bp, Mus musculus
ggactgaagttatcccctgttctca

SEQ ID NO: 593663 - DNA, 25 bp, Mus musculus
ggactgaagttattggtgtcaccac

SEQ ID NO: 593664 - DNA, 25 bp, Mus musculus
ggactgaagttcacaagttcacccg

SEQ ID NO: 593665 - DNA, 25 bp, Mus musculus
ggactgaagttctcaagttcacccg

SEQ ID NO: 593666 - DNA, 25 bp, Mus musculus
ggactgaataaactgtatttgcccc

SEQ ID NO: 593667 - DNA, 25 bp, Mus musculus
ggactgaataaagtgtatttgcccc

SEQ ID NO: 593668 - DNA, 25 bp, Mus musculus
ggactgaatatgcttttttggtgat

SEQ ID NO: 593669 - DNA, 25 bp, Mus musculus
ggactgaatatggttttttggtgat

SEQ ID NO: 593670 - DNA, 25 bp, Mus musculus
ggactgaatgctagcccaagccagg

SEQ ID NO: 593671 - DNA, 25 bp, Mus musculus
ggactgaatgcttgcccaagccagg

SEQ ID NO: 593672 - DNA, 25 bp, Mus musculus
ggactgaatgttatgcatctttaaa

SEQ ID NO: 593673 - DNA, 25 bp, Mus musculus
ggactgaatgttttgcatctttaaa

SEQ ID NO: 593674 - DNA, 25 bp, Mus musculus
ggactgaattccacggttttcttag

SEQ ID NO: 593675 - DNA, 25 bp, Mus musculus
ggactgaattccagttggtatattt

SEQ ID NO: 593676 - DNA, 25 bp, Mus musculus
ggactgaattcctcggttttcttag

SEQ ID NO: 593677 - DNA, 25 bp, Mus musculus
ggactgaattcctgttggtatattt

SEQ ID NO: 593678 - DNA, 25 bp, Mus musculus
ggactgaattgccaccagattattt

SEQ ID NO: 593679 - DNA, 25 bp, Mus musculus
ggactgaattgcgaccagattattt

SEQ ID NO: 593680 - DNA, 25 bp, Mus musculus
ggactgacaacaactgctactctta

SEQ ID NO: 593681 - DNA, 25 bp, Mus musculus
ggactgacaacatctgctactctta

SEQ ID NO: 593682 - DNA, 25 bp, Mus musculus
ggactgacaagaacccagacggtga

SEQ ID NO: 593683 - DNA, 25 bp, Mus musculus
ggactgacaagatcccagacggtga

SEQ ID NO: 593684 - DNA, 25 bp, Mus musculus
ggactgacagatatcattcttactt

SEQ ID NO: 593685 - DNA, 25 bp, Mus musculus
ggactgacagatttcattcttactt

SEQ ID NO: 593686 - DNA, 25 bp, Mus musculus
ggactgacatgacaccctacgggag

SEQ ID NO: 593687 - DNA, 25 bp, Mus musculus
ggactgacatgagaccctacgggag

SEQ ID NO: 593688 - DNA, 25 bp, Mus musculus
ggactgacatggactttaggtttaa

SEQ ID NO: 593689 - DNA, 25 bp, Mus musculus
ggactgacatggtctttaggtttaa

SEQ ID NO: 593690 - DNA, 25 bp, Mus musculus
ggactgacccagacttcagaagtga

SEQ ID NO: 593691 - DNA, 25 bp, Mus musculus
ggactgacccagtcttcagaagtga

SEQ ID NO: 593692 - DNA, 25 bp, Mus musculus
ggactgacccatatggatctaggaa

SEQ ID NO: 593693 - DNA, 25 bp, Mus musculus
ggactgacccatttggatctaggaa

SEQ ID NO: 593694 - DNA, 25 bp, Mus musculus
ggactgacctcgacttaagccagta

SEQ ID NO: 593695 - DNA, 25 bp, Mus musculus
ggactgacctcgtcttaagccagta

SEQ ID NO: 593696 - DNA, 25 bp, Mus musculus
ggactgacggctcggctggagccca

SEQ ID NO: 593697 - DNA, 25 bp, Mus musculus
ggactgacggctgggctggagccca

SEQ ID NO: 593698 - DNA, 25 bp, Mus musculus
ggactgactacaaggcccacatgaa

SEQ ID NO: 593699 - DNA, 25 bp, Mus musculus
ggactgactacatggcccacatgaa

SEQ ID NO: 593700 - DNA, 25 bp, Mus musculus
ggactgactcccacttttacttaat

SEQ ID NO: 593701 - DNA, 25 bp, Mus musculus
ggactgactccctcttttacttaat

SEQ ID NO: 593702 - DNA, 25 bp, Mus musculus
ggactgactcctagtttgatgacac

SEQ ID NO: 593703 - DNA, 25 bp, Mus musculus
ggactgactccttgtttgatgacac

SEQ ID NO: 593704 - DNA, 25 bp, Mus musculus
ggactgactgacaacctttgagcac

SEQ ID NO: 593705 - DNA, 25 bp, Mus musculus
ggactgactgacacatttcagtctg

SEQ ID NO: 593706 - DNA, 25 bp, Mus musculus
ggactgactgactacctttgagcac

SEQ ID NO: 593707 - DNA, 25 bp, Mus musculus
ggactgactgactcatttcagtctg

SEQ ID NO: 593708 - DNA, 25 bp, Mus musculus
ggactgacttgaataaaccctcttc

SEQ ID NO: 593709 - DNA, 25 bp, Mus musculus
ggactgacttgattaaaccctcttc

SEQ ID NO: 593710 - DNA, 25 bp, Mus musculus
ggactgagaacccaccacaccggtt

SEQ ID NO: 593711 - DNA, 25 bp, Mus musculus
ggactgagaaccgaccacaccggtt

SEQ ID NO: 593712 - DNA, 25 bp, Mus musculus
ggactgagacaaatttcctctcgtt

SEQ ID NO: 593713 - DNA, 25 bp, Mus musculus
ggactgagacaattttcctctcgtt

SEQ ID NO: 593714 - DNA, 25 bp, Mus musculus
ggactgagaccaaactgcaaaacat

SEQ ID NO: 593715 - DNA, 25 bp, Mus musculus
ggactgagaccatactgcaaaacat

SEQ ID NO: 593716 - DNA, 25 bp, Mus musculus
ggactgagacgcacttcagcgttgg

SEQ ID NO: 593717 - DNA, 25 bp, Mus musculus
ggactgagacgctcttcagcgttgg

SEQ ID NO: 593718 - DNA, 25 bp, Mus musculus
ggactgagattcaattcctcctgga

SEQ ID NO: 593719 - DNA, 25 bp, Mus musculus
ggactgagattctattcctcctgga

SEQ ID NO: 593720 - DNA, 25 bp, Mus musculus
ggactgagcaccagcactggctttg

SEQ ID NO: 593721 - DNA, 25 bp, Mus musculus
ggactgagcacctgcactggctttg

SEQ ID NO: 593722 - DNA, 25 bp, Mus musculus
ggactgagcagtaacgtttaccctt

SEQ ID NO: 593723 - DNA, 25 bp, Mus musculus
ggactgagcagttacgtttaccctt

SEQ ID NO: 593724 - DNA, 25 bp, Mus musculus
ggactgagccccaaacatacaagga

SEQ ID NO: 593725 - DNA, 25 bp, Mus musculus
ggactgagcccctaacatacaagga

SEQ ID NO: 593726 - DNA, 25 bp, Mus musculus
ggactgagctaactgctgcccaaga

SEQ ID NO: 593727 - DNA, 25 bp, Mus musculus
ggactgagctaagtgctgcccaaga

SEQ ID NO: 593728 - DNA, 25 bp, Mus musculus
ggactgagctccaccagggaggtct

SEQ ID NO: 593729 - DNA, 25 bp, Mus musculus
ggactgagctcctccagggaggtct

SEQ ID NO: 593730 - DNA, 25 bp, Mus musculus
ggactgaggaccactgggctctgcc

SEQ ID NO: 593731 - DNA, 25 bp, Mus musculus
ggactgaggacctctgggctctgcc

SEQ ID NO: 593732 - DNA, 25 bp, Mus musculus
ggactgaggatccaagttgagaaaa

SEQ ID NO: 593733 - DNA, 25 bp, Mus musculus
ggactgaggatcgaagttgagaaaa

SEQ ID NO: 593734 - DNA, 25 bp, Mus musculus
ggactgaggctgacatccgaaggca

SEQ ID NO: 593735 - DNA, 25 bp, Mus musculus
ggactgaggctgtcatccgaaggca

SEQ ID NO: 593736 - DNA, 25 bp, Mus musculus
ggactgaggtcccaatagagttttt

SEQ ID NO: 593737 - DNA, 25 bp, Mus musculus
ggactgaggtccgaatagagttttt

SEQ ID NO: 593738 - DNA, 25 bp, Mus musculus
ggactgagtctaatgtaagtggatt

SEQ ID NO: 593739 - DNA, 25 bp, Mus musculus
ggactgagtctacaattcagtggca

SEQ ID NO: 593740 - DNA, 25 bp, Mus musculus
ggactgagtctagaattcagtggca

SEQ ID NO: 593741 - DNA, 25 bp, Mus musculus
ggactgagtctattgtaagtggatt

SEQ ID NO: 593742 - DNA, 25 bp, Mus musculus
ggactgagttctctacacacttgtt

SEQ ID NO: 593743 - DNA, 25 bp, Mus musculus
ggactgagttctgtacacacttgtt

SEQ ID NO: 593744 - DNA, 25 bp, Mus musculus
ggactgagttttcagctcttttgat

SEQ ID NO: 593745 - DNA, 25 bp, Mus musculus
ggactgagttttgagctcttttgat

SEQ ID NO: 593746 - DNA, 25 bp, Mus musculus
ggactgataaagctcatggcacctt

SEQ ID NO: 593747 - DNA, 25 bp, Mus musculus
ggactgataaaggtcatggcacctt

SEQ ID NO: 593748 - DNA, 25 bp, Mus musculus
ggactgataatgagaagttcctcat

SEQ ID NO: 593749 - DNA, 25 bp, Mus musculus
ggactgataatgtgaagttcctcat

SEQ ID NO: 593750 - DNA, 25 bp, Mus musculus
ggactgataattacattttccagaa

SEQ ID NO: 593751 - DNA, 25 bp, Mus musculus
ggactgataatttcattttccagaa

SEQ ID NO: 593752 - DNA, 25 bp, Mus musculus
ggactgatatttcttctatgttgtc

SEQ ID NO: 593753 - DNA, 25 bp, Mus musculus
ggactgatatttgttctatgttgtc

SEQ ID NO: 593754 - DNA, 25 bp, Mus musculus
ggactgatccagatcgtttgctgaa

SEQ ID NO: 593755 - DNA, 25 bp, Mus musculus
ggactgatccagttcgtttgctgaa

SEQ ID NO: 593756 - DNA, 25 bp, Mus musculus
ggactgatcctgactgtgaacagca

SEQ ID NO: 593757 - DNA, 25 bp, Mus musculus
ggactgatcctgtctgtgaacagca

SEQ ID NO: 593758 - DNA, 25 bp, Mus musculus
ggactgatcgttactttgcttttaa

SEQ ID NO: 593759 - DNA, 25 bp, Mus musculus
ggactgatcgtttctttgcttttaa

SEQ ID NO: 593760 - DNA, 25 bp, Mus musculus
ggactgatcttcatgttagagtaca

SEQ ID NO: 593761 - DNA, 25 bp, Mus musculus
ggactgatcttcttgttagagtaca

SEQ ID NO: 593762 - DNA, 25 bp, Mus musculus
ggactgatgaaaacaagtgcgccaa

SEQ ID NO: 593763 - DNA, 25 bp, Mus musculus
ggactgatgaaatcaagtgcgccaa

SEQ ID NO: 593764 - DNA, 25 bp, Mus musculus
ggactgatgagaaggttccgtcaat

SEQ ID NO: 593765 - DNA, 25 bp, Mus musculus
ggactgatgagatggttccgtcaat

SEQ ID NO: 593766 - DNA, 25 bp, Mus musculus
ggactgatgcagacatgcccatgga

SEQ ID NO: 593767 - DNA, 25 bp, Mus musculus
ggactgatgcagtcatgcccatgga

SEQ ID NO: 593768 - DNA, 25 bp, Mus musculus
ggactgatgcctcaagctgaactgg

SEQ ID NO: 593769 - DNA, 25 bp, Mus musculus
ggactgatgcctgaagctgaactgg

SEQ ID NO: 593770 - DNA, 25 bp, Mus musculus
ggactgatgctcaactcctttgctg

SEQ ID NO: 593771 - DNA, 25 bp, Mus musculus
ggactgatgctcaggcctgtcctgg

SEQ ID NO: 593772 - DNA, 25 bp, Mus musculus
ggactgatgctctactcctttgctg

SEQ ID NO: 593773 - DNA, 25 bp, Mus musculus
ggactgatgctctggcctgtcctgg

SEQ ID NO: 593774 - DNA, 25 bp, Mus musculus
ggactgatggatctgtgaccccttg

SEQ ID NO: 593775 - DNA, 25 bp, Mus musculus
ggactgatggatgtgtgaccccttg

SEQ ID NO: 593776 - DNA, 25 bp, Mus musculus
ggactgatggcccaggatctccgtt

SEQ ID NO: 593777 - DNA, 25 bp, Mus musculus
ggactgatggccgaggatctccgtt

SEQ ID NO: 593778 - DNA, 25 bp, Mus musculus
ggactgatggcgatcctgttcccag

SEQ ID NO: 593779 - DNA, 25 bp, Mus musculus
ggactgatggcgttcctgttcccag

SEQ ID NO: 593780 - DNA, 25 bp, Mus musculus
ggactgatgggtagttcccaaaata

SEQ ID NO: 593781 - DNA, 25 bp, Mus musculus
ggactgatgggtctacaaacctgta

SEQ ID NO: 593782 - DNA, 25 bp, Mus musculus
ggactgatgggtgtacaaacctgta

SEQ ID NO: 593783 - DNA, 25 bp, Mus musculus
ggactgatgggttgttcccaaaata

SEQ ID NO: 593784 - DNA, 25 bp, Mus musculus
ggactgatgtgcagggatctcaaca

SEQ ID NO: 593785 - DNA, 25 bp, Mus musculus
ggactgatgtgctgggatctcaaca

SEQ ID NO: 593786 - DNA, 25 bp, Mus musculus
ggactgatgttccaccaaacactat

SEQ ID NO: 593787 - DNA, 25 bp, Mus musculus
ggactgatgttcgaccaaacactat

SEQ ID NO: 593788 - DNA, 25 bp, Mus musculus
ggactgatgtttcttctctctgtac

SEQ ID NO: 593789 - DNA, 25 bp, Mus musculus
ggactgatgtttgttctctctgtac

SEQ ID NO: 593790 - DNA, 25 bp, Mus musculus
ggactgattctcatgtggttacacg

SEQ ID NO: 593791 - DNA, 25 bp, Mus musculus
ggactgattctcttgtggttacacg

SEQ ID NO: 593792 - DNA, 25 bp, Mus musculus
ggactgattcttactttgcatctca

SEQ ID NO: 593793 - DNA, 25 bp, Mus musculus
ggactgattctttctttgcatctca

SEQ ID NO: 593794 - DNA, 25 bp, Mus musculus
ggactgattgatcgtgttcacactg

SEQ ID NO: 593795 - DNA, 25 bp, Mus musculus
ggactgattgatggtgttcacactg

SEQ ID NO: 593796 - DNA, 25 bp, Mus musculus
ggactgattggaacccatctcctgg

SEQ ID NO: 593797 - DNA, 25 bp, Mus musculus
ggactgattggatcccatctcctgg

SEQ ID NO: 593798 - DNA, 25 bp, Mus musculus
ggactgattggcacctggctttcac

SEQ ID NO: 593799 - DNA, 25 bp, Mus musculus
ggactgattggctcctggctttcac

SEQ ID NO: 593800 - DNA, 25 bp, Mus musculus
ggactgcaaaaaacccaaagctata

SEQ ID NO: 593801 - DNA, 25 bp, Mus musculus
ggactgcaaaaatcccaaagctata

SEQ ID NO: 593802 - DNA, 25 bp, Mus musculus
ggactgcaacgccttttagagctac

SEQ ID NO: 593803 - DNA, 25 bp, Mus musculus
ggactgcaacgcgttttagagctac

SEQ ID NO: 593804 - DNA, 25 bp, Mus musculus
ggactgcaactaaaacacacgactt

SEQ ID NO: 593805 - DNA, 25 bp, Mus musculus
ggactgcaactataacacacgactt

SEQ ID NO: 593806 - DNA, 25 bp, Mus musculus
ggactgcacagcatagatcacctaa

SEQ ID NO: 593807 - DNA, 25 bp, Mus musculus
ggactgcacagcttagatcacctaa

SEQ ID NO: 593808 - DNA, 25 bp, Mus musculus
ggactgcacagtatgggtattctta

SEQ ID NO: 593809 - DNA, 25 bp, Mus musculus
ggactgcacagtttgggtattctta

SEQ ID NO: 593810 - DNA, 25 bp, Mus musculus
ggactgcaccaacgactgcacattt

SEQ ID NO: 593811 - DNA, 25 bp, Mus musculus
ggactgcaccaaggactgcacattt

SEQ ID NO: 593812 - DNA, 25 bp, Mus musculus
ggactgcactgaccctggacatcaa

SEQ ID NO: 593813 - DNA, 25 bp, Mus musculus
ggactgcactgagcctggacatcaa

SEQ ID NO: 593814 - DNA, 25 bp, Mus musculus
ggactgcacttacaagataccgttt

SEQ ID NO: 593815 - DNA, 25 bp, Mus musculus
ggactgcacttagaagataccgttt

SEQ ID NO: 593816 - DNA, 25 bp, Mus musculus
ggactgcagaacagtccttccaaag

SEQ ID NO: 593817 - DNA, 25 bp, Mus musculus
ggactgcagaactgtccttccaaag

SEQ ID NO: 593818 - DNA, 25 bp, Mus musculus
ggactgcagagaatgtaaacaccta

SEQ ID NO: 593819 - DNA, 25 bp, Mus musculus
ggactgcagagattgtaaacaccta

SEQ ID NO: 593820 - DNA, 25 bp, Mus musculus
ggactgcaggacaacagcatgctga

SEQ ID NO: 593821 - DNA, 25 bp, Mus musculus
ggactgcaggactacagcatgctga

SEQ ID NO: 593822 - DNA, 25 bp, Mus musculus
ggactgcaggcgaacatccaggagt

SEQ ID NO: 593823 - DNA, 25 bp, Mus musculus
ggactgcaggcgtacatccaggagt

SEQ ID NO: 593824 - DNA, 25 bp, Mus musculus
ggactgcaggtcacagaactggagt

SEQ ID NO: 593825 - DNA, 25 bp, Mus musculus
ggactgcaggtctcagaactggagt

SEQ ID NO: 593826 - DNA, 25 bp, Mus musculus
ggactgcagtagatggagctcccca

SEQ ID NO: 593827 - DNA, 25 bp, Mus musculus
ggactgcagtagttggagctcccca

SEQ ID NO: 593828 - DNA, 25 bp, Mus musculus
ggactgcagtgtatagattcatata

SEQ ID NO: 593829 - DNA, 25 bp, Mus musculus
ggactgcagtgtttagattcatata

SEQ ID NO: 593830 - DNA, 25 bp, Mus musculus
ggactgcataataatcgaaacatag

SEQ ID NO: 593831 - DNA, 25 bp, Mus musculus
ggactgcataattatcgaaacatag

SEQ ID NO: 593832 - DNA, 25 bp, Mus musculus
ggactgcatacaatgcatagtgcta

SEQ ID NO: 593833 - DNA, 25 bp, Mus musculus
ggactgcatacattgcatagtgcta

SEQ ID NO: 593834 - DNA, 25 bp, Mus musculus
ggactgcatagacagcctgtcacaa

SEQ ID NO: 593835 - DNA, 25 bp, Mus musculus
ggactgcatagagagcctgtcacaa

SEQ ID NO: 593836 - DNA, 25 bp, Mus musculus
ggactgcatagtcataccctgactt

SEQ ID NO: 593837 - DNA, 25 bp, Mus musculus
ggactgcatagtgataccctgactt

SEQ ID NO: 593838 - DNA, 25 bp, Mus musculus
ggactgcatcttactttctaaacca

SEQ ID NO: 593839 - DNA, 25 bp, Mus musculus
ggactgcatctttctttctaaacca

SEQ ID NO: 593840 - DNA, 25 bp, Mus musculus
ggactgcatgtgaccacgtgccatc

SEQ ID NO: 593841 - DNA, 25 bp, Mus musculus
ggactgcatgtgtccacgtgccatc

SEQ ID NO: 593842 - DNA, 25 bp, Mus musculus
ggactgcattatatggctaccctct

SEQ ID NO: 593843 - DNA, 25 bp, Mus musculus
ggactgcattatttggctaccctct

SEQ ID NO: 593844 - DNA, 25 bp, Mus musculus
ggactgcattttcatcttgtatttt

SEQ ID NO: 593845 - DNA, 25 bp, Mus musculus
ggactgcattttgatcttgtatttt

SEQ ID NO: 593846 - DNA, 25 bp, Mus musculus
ggactgccaaatatcaccggtttgc

SEQ ID NO: 593847 - DNA, 25 bp, Mus musculus
ggactgccaaatttcaccggtttgc

SEQ ID NO: 593848 - DNA, 25 bp, Mus musculus
ggactgccagccaggcgcctattgg

SEQ ID NO: 593849 - DNA, 25 bp, Mus musculus
ggactgccagcctggcgcctattgg

SEQ ID NO: 593850 - DNA, 25 bp, Mus musculus
ggactgccaggtaacctttttgatt

SEQ ID NO: 593851 - DNA, 25 bp, Mus musculus
ggactgccaggtatgcccagtatag

SEQ ID NO: 593852 - DNA, 25 bp, Mus musculus
ggactgccaggttacctttttgatt

SEQ ID NO: 593853 - DNA, 25 bp, Mus musculus
ggactgccaggtttgcccagtatag

SEQ ID NO: 593854 - DNA, 25 bp, Mus musculus
ggactgccatccaaattcatcatac

SEQ ID NO: 593855 - DNA, 25 bp, Mus musculus
ggactgccatcctaattcatcatac

SEQ ID NO: 593856 - DNA, 25 bp, Mus musculus
ggactgcccagaaactgttgcacct

SEQ ID NO: 593857 - DNA, 25 bp, Mus musculus
ggactgcccagatactgttgcacct

SEQ ID NO: 593858 - DNA, 25 bp, Mus musculus
ggactgccccttaaattttgactgt

SEQ ID NO: 593859 - DNA, 25 bp, Mus musculus
ggactgcccctttaattttgactgt

SEQ ID NO: 593860 - DNA, 25 bp, Mus musculus
ggactgccctctagatggattgatg

SEQ ID NO: 593861 - DNA, 25 bp, Mus musculus
ggactgccctcttgatggattgatg

SEQ ID NO: 593862 - DNA, 25 bp, Mus musculus
ggactgcctaaacctttgtatttgt

SEQ ID NO: 593863 - DNA, 25 bp, Mus musculus
ggactgcctaaagctttgtatttgt

SEQ ID NO: 593864 - DNA, 25 bp, Mus musculus
ggactgcctgccaaggtccttgcag

SEQ ID NO: 593865 - DNA, 25 bp, Mus musculus
ggactgcctgcctaggtccttgcag

SEQ ID NO: 593866 - DNA, 25 bp, Mus musculus
ggactgctaaagcatacaagctaac

SEQ ID NO: 593867 - DNA, 25 bp, Mus musculus
ggactgctaaaggatacaagctaac

SEQ ID NO: 593868 - DNA, 25 bp, Mus musculus
ggactgctaagtcctgtggtaccca

SEQ ID NO: 593869 - DNA, 25 bp, Mus musculus
ggactgctaagtgctgtggtaccca

SEQ ID NO: 593870 - DNA, 25 bp, Mus musculus
ggactgctcagtacctttggatgac

SEQ ID NO: 593871 - DNA, 25 bp, Mus musculus
ggactgctcagttcctttggatgac

SEQ ID NO: 593872 - DNA, 25 bp, Mus musculus
ggactgctctgactataaggccagc

SEQ ID NO: 593873 - DNA, 25 bp, Mus musculus
ggactgctctgagtataaggccagc

SEQ ID NO: 593874 - DNA, 25 bp, Mus musculus
ggactgctctggatataaagtgctt

SEQ ID NO: 593875 - DNA, 25 bp, Mus musculus
ggactgctctggttataaagtgctt

SEQ ID NO: 593876 - DNA, 25 bp, Mus musculus
ggactgctgagaaatctaggttctt

SEQ ID NO: 593877 - DNA, 25 bp, Mus musculus
ggactgctgagatatctaggttctt

SEQ ID NO: 593878 - DNA, 25 bp, Mus musculus
ggactgctgagcactggtaactaac

SEQ ID NO: 593879 - DNA, 25 bp, Mus musculus
ggactgctgagctctggtaactaac

SEQ ID NO: 593880 - DNA, 25 bp, Mus musculus
ggactgctgattatggaggtgcctc

SEQ ID NO: 593881 - DNA, 25 bp, Mus musculus
ggactgctgattttggaggtgcctc

SEQ ID NO: 593882 - DNA, 25 bp, Mus musculus
ggactgctgcacacagacctggaat

SEQ ID NO: 593883 - DNA, 25 bp, Mus musculus
ggactgctgcacaggccctattagg

SEQ ID NO: 593884 - DNA, 25 bp, Mus musculus
ggactgctgcactcagacctggaat

SEQ ID NO: 593885 - DNA, 25 bp, Mus musculus
ggactgctgcactggccctattagg

SEQ ID NO: 593886 - DNA, 25 bp, Mus musculus
ggactgctgctaatcttacagatgc

SEQ ID NO: 593887 - DNA, 25 bp, Mus musculus
ggactgctgctattcttacagatgc

SEQ ID NO: 593888 - DNA, 25 bp, Mus musculus
ggactgctggaaagagtatctttca

SEQ ID NO: 593889 - DNA, 25 bp, Mus musculus
ggactgctggaatgagtatctttca

SEQ ID NO: 593890 - DNA, 25 bp, Mus musculus
ggactgctgtagatacactttttta

SEQ ID NO: 593891 - DNA, 25 bp, Mus musculus
ggactgctgtagttacactttttta

SEQ ID NO: 593892 - DNA, 25 bp, Mus musculus
ggactgctgtccagtagctgtgcat

SEQ ID NO: 593893 - DNA, 25 bp, Mus musculus
ggactgctgtcctgtagctgtgcat

SEQ ID NO: 593894 - DNA, 25 bp, Mus musculus
ggactgctgtgacgcagtgccttat

SEQ ID NO: 593895 - DNA, 25 bp, Mus musculus
ggactgctgtgaggcagtgccttat

SEQ ID NO: 593896 - DNA, 25 bp, Mus musculus
ggactgctgtgtaaaatatttctct

SEQ ID NO: 593897 - DNA, 25 bp, Mus musculus
ggactgctgtgttaaatatttctct

SEQ ID NO: 593898 - DNA, 25 bp, Mus musculus
ggactgctgttcacgagccacatgc

SEQ ID NO: 593899 - DNA, 25 bp, Mus musculus
ggactgctgttctcgagccacatgc

SEQ ID NO: 593900 - DNA, 25 bp, Mus musculus
ggactgctgtttcggctttctgaaa

SEQ ID NO: 593901 - DNA, 25 bp, Mus musculus
ggactgctgtttgggctttctgaaa

SEQ ID NO: 593902 - DNA, 25 bp, Mus musculus
ggactgcttagcagcttgatcgctg

SEQ ID NO: 593903 - DNA, 25 bp, Mus musculus
ggactgcttagctgcttgatcgctg

SEQ ID NO: 593904 - DNA, 25 bp, Mus musculus
ggactgcttagtattgcacacttct

SEQ ID NO: 593905 - DNA, 25 bp, Mus musculus
ggactgcttagttttgcacacttct

SEQ ID NO: 593906 - DNA, 25 bp, Mus musculus
ggactgcttatcctaaaatcgtgtc

SEQ ID NO: 593907 - DNA, 25 bp, Mus musculus
ggactgcttatcgtaaaatcgtgtc

SEQ ID NO: 593908 - DNA, 25 bp, Mus musculus
ggactgcttccaagttagtaaccgc

SEQ ID NO: 593909 - DNA, 25 bp, Mus musculus
ggactgcttccatgttagtaaccgc

SEQ ID NO: 593910 - DNA, 25 bp, Mus musculus
ggactgcttgatcaaatgtgtttga

SEQ ID NO: 593911 - DNA, 25 bp, Mus musculus
ggactgcttgatgaaatgtgtttga

SEQ ID NO: 593912 - DNA, 25 bp, Mus musculus
ggactgcttgctactggataatcgt

SEQ ID NO: 593913 - DNA, 25 bp, Mus musculus
ggactgcttgcttctggataatcgt

SEQ ID NO: 593914 - DNA, 25 bp, Mus musculus
ggactgctttggagatttcccactg

SEQ ID NO: 593915 - DNA, 25 bp, Mus musculus
ggactgctttggtgatttcccactg

SEQ ID NO: 593916 - DNA, 25 bp, Mus musculus
ggactgctttgtcgtggtcatcctc

SEQ ID NO: 593917 - DNA, 25 bp, Mus musculus
ggactgctttgtggtggtcatcctc

SEQ ID NO: 593918 - DNA, 25 bp, Mus musculus
ggactgcttttccattagaatgtct

SEQ ID NO: 593919 - DNA, 25 bp, Mus musculus
ggactgcttttcgattagaatgtct

SEQ ID NO: 593920 - DNA, 25 bp, Mus musculus
ggactggaaaaacccggagtgcaca

SEQ ID NO: 593921 - DNA, 25 bp, Mus musculus
ggactggaaaaagccggagtgcaca

SEQ ID NO: 593922 - DNA, 25 bp, Mus musculus
ggactggaaagtaatttgactacta

SEQ ID NO: 593923 - DNA, 25 bp, Mus musculus
ggactggaaagttatttgactacta

SEQ ID NO: 593924 - DNA, 25 bp, Mus musculus
ggactggaaatcagccactaacctc

SEQ ID NO: 593925 - DNA, 25 bp, Mus musculus
ggactggaaatctgccactaacctc

SEQ ID NO: 593926 - DNA, 25 bp, Mus musculus
ggactggaacggatcatgtagtaga

SEQ ID NO: 593927 - DNA, 25 bp, Mus musculus
ggactggaacggttcatgtagtaga

SEQ ID NO: 593928 - DNA, 25 bp, Mus musculus
ggactggaccctcgcattgaagaga

SEQ ID NO: 593929 - DNA, 25 bp, Mus musculus
ggactggaccctggcattgaagaga

SEQ ID NO: 593930 - DNA, 25 bp, Mus musculus
ggactggaccgaacatgccaattct

SEQ ID NO: 593931 - DNA, 25 bp, Mus musculus
ggactggaccgatcatgccaattct

SEQ ID NO: 593932 - DNA, 25 bp, Mus musculus
ggactggactatacttggactatgt

SEQ ID NO: 593933 - DNA, 25 bp, Mus musculus
ggactggactattcttggactatgt

SEQ ID NO: 593934 - DNA, 25 bp, Mus musculus
ggactggagaaaagagttcagttta

SEQ ID NO: 593935 - DNA, 25 bp, Mus musculus
ggactggagaaatgagttcagttta

SEQ ID NO: 593936 - DNA, 25 bp, Mus musculus
ggactggagctgatagtacataaag

SEQ ID NO: 593937 - DNA, 25 bp, Mus musculus
ggactggagctgttagtacataaag

SEQ ID NO: 593938 - DNA, 25 bp, Mus musculus
ggactggagtcaagtgtcaccacgc

SEQ ID NO: 593939 - DNA, 25 bp, Mus musculus
ggactggagtcatgtgtcaccacgc

SEQ ID NO: 593940 - DNA, 25 bp, Mus musculus
ggactggagtccctagagctgcccc

SEQ ID NO: 593941 - DNA, 25 bp, Mus musculus
ggactggagtccgtagagctgcccc

SEQ ID NO: 593942 - DNA, 25 bp, Mus musculus
ggactggagtgtcctagaccttccc

SEQ ID NO: 593943 - DNA, 25 bp, Mus musculus
ggactggagtgtgctagaccttccc

SEQ ID NO: 593944 - DNA, 25 bp, Mus musculus
ggactggataatccttccccaagct

SEQ ID NO: 593945 - DNA, 25 bp, Mus musculus
ggactggataatgcttccccaagct

SEQ ID NO: 593946 - DNA, 25 bp, Mus musculus
ggactggatatgcaccctgagacct

SEQ ID NO: 593947 - DNA, 25 bp, Mus musculus
ggactggatatggaccctgagacct

SEQ ID NO: 593948 - DNA, 25 bp, Mus musculus
ggactggatgctattctattagacc

SEQ ID NO: 593949 - DNA, 25 bp, Mus musculus
ggactggatgcttttctattagacc

SEQ ID NO: 593950 - DNA, 25 bp, Mus musculus
ggactggatgtacgtgacgaacact

SEQ ID NO: 593951 - DNA, 25 bp, Mus musculus
ggactggatgtaggtgacgaacact

SEQ ID NO: 593952 - DNA, 25 bp, Mus musculus
ggactggcaaatctcccaaacaatt

SEQ ID NO: 593953 - DNA, 25 bp, Mus musculus
ggactggcaaatgtcccaaacaatt

SEQ ID NO: 593954 - DNA, 25 bp, Mus musculus
ggactggcaagaacactcatagctt

SEQ ID NO: 593955 - DNA, 25 bp, Mus musculus
ggactggcaagatcactcatagctt

SEQ ID NO: 593956 - DNA, 25 bp, Mus musculus
ggactggcacccctgagaactgtga

SEQ ID NO: 593957 - DNA, 25 bp, Mus musculus
ggactggcacccgtgagaactgtga

SEQ ID NO: 593958 - DNA, 25 bp, Mus musculus
ggactggcacctcaattgttccttc

SEQ ID NO: 593959 - DNA, 25 bp, Mus musculus
ggactggcacctgaattgttccttc

SEQ ID NO: 593960 - DNA, 25 bp, Mus musculus
ggactggcaggtatgctttcagcaa

SEQ ID NO: 593961 - DNA, 25 bp, Mus musculus
ggactggcaggtttgctttcagcaa

SEQ ID NO: 593962 - DNA, 25 bp, Mus musculus
ggactggccacgagaatgcttagtt

SEQ ID NO: 593963 - DNA, 25 bp, Mus musculus
ggactggccacgtgaatgcttagtt

SEQ ID NO: 593964 - DNA, 25 bp, Mus musculus
ggactggccatgctggactttagaa

SEQ ID NO: 593965 - DNA, 25 bp, Mus musculus
ggactggccatggtggactttagaa

SEQ ID NO: 593966 - DNA, 25 bp, Mus musculus
ggactggccccgagtgatgtgtttt

SEQ ID NO: 593967 - DNA, 25 bp, Mus musculus
ggactggccccgtgtgatgtgtttt

SEQ ID NO: 593968 - DNA, 25 bp, Mus musculus
ggactggccgccagcttactgacta

SEQ ID NO: 593969 - DNA, 25 bp, Mus musculus
ggactggccgcctgcttactgacta

SEQ ID NO: 593970 - DNA, 25 bp, Mus musculus
ggactggccgttattgagattctcg

SEQ ID NO: 593971 - DNA, 25 bp, Mus musculus
ggactggccgtttttgagattctcg

SEQ ID NO: 593972 - DNA, 25 bp, Mus musculus
ggactggctaccacatttgcagata

SEQ ID NO: 593973 - DNA, 25 bp, Mus musculus
ggactggctacctcatttgcagata

SEQ ID NO: 593974 - DNA, 25 bp, Mus musculus
ggactggctactcgagacactttta

SEQ ID NO: 593975 - DNA, 25 bp, Mus musculus
ggactggctactggagacactttta

SEQ ID NO: 593976 - DNA, 25 bp, Mus musculus
ggactggctatcaccatggttactg

SEQ ID NO: 593977 - DNA, 25 bp, Mus musculus
ggactggctatctccatggttactg

SEQ ID NO: 593978 - DNA, 25 bp, Mus musculus
ggactggctcgaacaggactggcta

SEQ ID NO: 593979 - DNA, 25 bp, Mus musculus
ggactggctcgatcaggactggcta

SEQ ID NO: 593980 - DNA, 25 bp, Mus musculus
ggactggctggtactggatctataa

SEQ ID NO: 593981 - DNA, 25 bp, Mus musculus
ggactggctggttctggatctataa

SEQ ID NO: 593982 - DNA, 25 bp, Mus musculus
ggactgggaaaaactgcagcatcag

SEQ ID NO: 593983 - DNA, 25 bp, Mus musculus
ggactgggaaaatctgcagcatcag

SEQ ID NO: 593984 - DNA, 25 bp, Mus musculus
ggactgggaccccttacctgcaaag

SEQ ID NO: 593985 - DNA, 25 bp, Mus musculus
ggactgggacccgttacctgcaaag

SEQ ID NO: 593986 - DNA, 25 bp, Mus musculus
ggactgggacttaccttgggttgct

SEQ ID NO: 593987 - DNA, 25 bp, Mus musculus
ggactgggactttccttgggttgct

SEQ ID NO: 593988 - DNA, 25 bp, Mus musculus
ggactgggatgaacggactaccaac

SEQ ID NO: 593989 - DNA, 25 bp, Mus musculus
ggactgggatgatcggactaccaac

SEQ ID NO: 593990 - DNA, 25 bp, Mus musculus
ggactgggcaagcacagcttactgc

SEQ ID NO: 593991 - DNA, 25 bp, Mus musculus
ggactgggcaaggacagcttactgc

SEQ ID NO: 593992 - DNA, 25 bp, Mus musculus
ggactgggcatgatgtccagctagt

SEQ ID NO: 593993 - DNA, 25 bp, Mus musculus
ggactgggcatgttgtccagctagt

SEQ ID NO: 593994 - DNA, 25 bp, Mus musculus
ggactgggccacacaaacatttaca

SEQ ID NO: 593995 - DNA, 25 bp, Mus musculus
ggactgggccactcaaacatttaca

SEQ ID NO: 593996 - DNA, 25 bp, Mus musculus
ggactgggccagcttttacatagta

SEQ ID NO: 593997 - DNA, 25 bp, Mus musculus
ggactgggccaggttttacatagta

SEQ ID NO: 593998 - DNA, 25 bp, Mus musculus
ggactggtaaccattctcatttggg

SEQ ID NO: 593999 - DNA, 25 bp, Mus musculus
ggactggtaacctttctcatttggg

SEQ ID NO: 594000 - DNA, 25 bp, Mus musculus
ggactggtatgcctggatcccaaat

SEQ ID NO: 594001 - DNA, 25 bp, Mus musculus
ggactggtatgcgtggatcccaaat

SEQ ID NO: 594002 - DNA, 25 bp, Mus musculus
ggactggtcaccaacatcctttcag

SEQ ID NO: 594003 - DNA, 25 bp, Mus musculus
ggactggtcacctacatcctttcag

SEQ ID NO: 594004 - DNA, 25 bp, Mus musculus
ggactggtcataatggccctgagca

SEQ ID NO: 594005 - DNA, 25 bp, Mus musculus
ggactggtcatattggccctgagca

SEQ ID NO: 594006 - DNA, 25 bp, Mus musculus
ggactggtcattacgagtgcgctga

SEQ ID NO: 594007 - DNA, 25 bp, Mus musculus
ggactggtcatttcgagtgcgctga

SEQ ID NO: 594008 - DNA, 25 bp, Mus musculus
ggactggtcgttaccatcaaagatt

SEQ ID NO: 594009 - DNA, 25 bp, Mus musculus
ggactggtcgtttccatcaaagatt

SEQ ID NO: 594010 - DNA, 25 bp, Mus musculus
ggactggtctctcatccagagaacc

SEQ ID NO: 594011 - DNA, 25 bp, Mus musculus
ggactggtctctgatccagagaacc

SEQ ID NO: 594012 - DNA, 25 bp, Mus musculus
ggactggtgcaaacttgattctttt

SEQ ID NO: 594013 - DNA, 25 bp, Mus musculus
ggactggtgcaactggactttgatt

SEQ ID NO: 594014 - DNA, 25 bp, Mus musculus
ggactggtgcaagtggactttgatt

SEQ ID NO: 594015 - DNA, 25 bp, Mus musculus
ggactggtgcaatcttgattctttt

SEQ ID NO: 594016 - DNA, 25 bp, Mus musculus
ggactggtgcccctgggatacactt

SEQ ID NO: 594017 - DNA, 25 bp, Mus musculus
ggactggtgcccgtgggatacactt

SEQ ID NO: 594018 - DNA, 25 bp, Mus musculus
ggactggtggtcaaagctgcagcaa

SEQ ID NO: 594019 - DNA, 25 bp, Mus musculus
ggactggtggtctaagctgcagcaa

SEQ ID NO: 594020 - DNA, 25 bp, Mus musculus
ggactggtgttccatttccagcatc

SEQ ID NO: 594021 - DNA, 25 bp, Mus musculus
ggactggtgttcgatttccagcatc

SEQ ID NO: 594022 - DNA, 25 bp, Mus musculus
ggactggtgtttctgcccgccactc

SEQ ID NO: 594023 - DNA, 25 bp, Mus musculus
ggactggtgtttgtgcccgccactc

SEQ ID NO: 594024 - DNA, 25 bp, Mus musculus
ggactggtttccaaagcattcccac

SEQ ID NO: 594025 - DNA, 25 bp, Mus musculus
ggactggtttccagacccatgggca

SEQ ID NO: 594026 - DNA, 25 bp, Mus musculus
ggactggtttcctaagcattcccac

SEQ ID NO: 594027 - DNA, 25 bp, Mus musculus
ggactggtttcctgacccatgggca

SEQ ID NO: 594028 - DNA, 25 bp, Mus musculus
ggactgtaaaaaacaaacgctgtgt

SEQ ID NO: 594029 - DNA, 25 bp, Mus musculus
ggactgtaaaaatcaaacgctgtgt

SEQ ID NO: 594030 - DNA, 25 bp, Mus musculus
ggactgtaaaccagcatcagggact

SEQ ID NO: 594031 - DNA, 25 bp, Mus musculus
ggactgtaaacctgcatcagggact

SEQ ID NO: 594032 - DNA, 25 bp, Mus musculus
ggactgtaacccaggctattaccat

SEQ ID NO: 594033 - DNA, 25 bp, Mus musculus
ggactgtaaccctggctattaccat

SEQ ID NO: 594034 - DNA, 25 bp, Mus musculus
ggactgtaacgtacagcactgctgc

SEQ ID NO: 594035 - DNA, 25 bp, Mus musculus
ggactgtaacgttcagcactgctgc

SEQ ID NO: 594036 - DNA, 25 bp, Mus musculus
ggactgtaactgactgccagacgga

SEQ ID NO: 594037 - DNA, 25 bp, Mus musculus
ggactgtaactgtctgccagacgga

SEQ ID NO: 594038 - DNA, 25 bp, Mus musculus
ggactgtaagcaacatcccaggcac

SEQ ID NO: 594039 - DNA, 25 bp, Mus musculus
ggactgtaagcatcatcccaggcac

SEQ ID NO: 594040 - DNA, 25 bp, Mus musculus
ggactgtaagtaactccctttctga

SEQ ID NO: 594041 - DNA, 25 bp, Mus musculus
ggactgtaagtatctccctttctga

SEQ ID NO: 594042 - DNA, 25 bp, Mus musculus
ggactgtacacacctgttgttttat

SEQ ID NO: 594043 - DNA, 25 bp, Mus musculus
ggactgtacacagctgttgttttat

SEQ ID NO: 594044 - DNA, 25 bp, Mus musculus
ggactgtacactcctaacatcatag

SEQ ID NO: 594045 - DNA, 25 bp, Mus musculus
ggactgtacactgctaacatcatag

SEQ ID NO: 594046 - DNA, 25 bp, Mus musculus
ggactgtacctgctggttcctgtat

SEQ ID NO: 594047 - DNA, 25 bp, Mus musculus
ggactgtacctggtggttcctgtat

SEQ ID NO: 594048 - DNA, 25 bp, Mus musculus
ggactgtacgcacccttcgattgca

SEQ ID NO: 594049 - DNA, 25 bp, Mus musculus
ggactgtacgcagccttcgattgca

SEQ ID NO: 594050 - DNA, 25 bp, Mus musculus
ggactgtacggaccagcgaccttga

SEQ ID NO: 594051 - DNA, 25 bp, Mus musculus
ggactgtacggagcagcgaccttga

SEQ ID NO: 594052 - DNA, 25 bp, Mus musculus
ggactgtagatcagatatccagcat

SEQ ID NO: 594053 - DNA, 25 bp, Mus musculus
ggactgtagatctgatatccagcat

SEQ ID NO: 594054 - DNA, 25 bp, Mus musculus
ggactgtatactcatactcctacgt

SEQ ID NO: 594055 - DNA, 25 bp, Mus musculus
ggactgtatactgatactcctacgt

SEQ ID NO: 594056 - DNA, 25 bp, Mus musculus
ggactgtatcttatgcatctctgta

SEQ ID NO: 594057 - DNA, 25 bp, Mus musculus
ggactgtatcttttgcatctctgta

SEQ ID NO: 594058 - DNA, 25 bp, Mus musculus
ggactgtattaaaatcctacaatgt

SEQ ID NO: 594059 - DNA, 25 bp, Mus musculus
ggactgtattaactgcgcttgaatg

SEQ ID NO: 594060 - DNA, 25 bp, Mus musculus
ggactgtattaagtgcgcttgaatg

SEQ ID NO: 594061 - DNA, 25 bp, Mus musculus
ggactgtattaatatcctacaatgt

SEQ ID NO: 594062 - DNA, 25 bp, Mus musculus
ggactgtattcaatcaccttactat

SEQ ID NO: 594063 - DNA, 25 bp, Mus musculus
ggactgtattcattcaccttactat

SEQ ID NO: 594064 - DNA, 25 bp, Mus musculus
ggactgtattccatcattctgactg

SEQ ID NO: 594065 - DNA, 25 bp, Mus musculus
ggactgtattccttcattctgactg

SEQ ID NO: 594066 - DNA, 25 bp, Mus musculus
ggactgtattgccatgatgattggt

SEQ ID NO: 594067 - DNA, 25 bp, Mus musculus
ggactgtattgcgatgatgattggt

SEQ ID NO: 594068 - DNA, 25 bp, Mus musculus
ggactgtcacagaaacactttattt

SEQ ID NO: 594069 - DNA, 25 bp, Mus musculus
ggactgtcacagtaacactttattt

SEQ ID NO: 594070 - DNA, 25 bp, Mus musculus
ggactgtcacttcaaatgactgtat

SEQ ID NO: 594071 - DNA, 25 bp, Mus musculus
ggactgtcacttgaaatgactgtat

SEQ ID NO: 594072 - DNA, 25 bp, Mus musculus
ggactgtcagcaactcttactaaga

SEQ ID NO: 594073 - DNA, 25 bp, Mus musculus
ggactgtcagcaaggttacctgatt

SEQ ID NO: 594074 - DNA, 25 bp, Mus musculus
ggactgtcagcatctcttactaaga

SEQ ID NO: 594075 - DNA, 25 bp, Mus musculus
ggactgtcagcatggttacctgatt

SEQ ID NO: 594076 - DNA, 25 bp, Mus musculus
ggactgtcagtactgtcaagcacta

SEQ ID NO: 594077 - DNA, 25 bp, Mus musculus
ggactgtcagtagtgtcaagcacta

SEQ ID NO: 594078 - DNA, 25 bp, Mus musculus
ggactgtccatgaactttgaaccaa

SEQ ID NO: 594079 - DNA, 25 bp, Mus musculus
ggactgtccatgtactttgaaccaa

SEQ ID NO: 594080 - DNA, 25 bp, Mus musculus
ggactgtccccactttcagaaaact

SEQ ID NO: 594081 - DNA, 25 bp, Mus musculus
ggactgtccccagtttcagaaaact

SEQ ID NO: 594082 - DNA, 25 bp, Mus musculus
ggactgtccctgagcgctagaaggc

SEQ ID NO: 594083 - DNA, 25 bp, Mus musculus
ggactgtccctgcaagatctcagat

SEQ ID NO: 594084 - DNA, 25 bp, Mus musculus
ggactgtccctggaagatctcagat

SEQ ID NO: 594085 - DNA, 25 bp, Mus musculus
ggactgtccctgtgcgctagaaggc

SEQ ID NO: 594086 - DNA, 25 bp, Mus musculus
ggactgtcctctcgacctatcttga

SEQ ID NO: 594087 - DNA, 25 bp, Mus musculus
ggactgtcctctggacctatcttga

SEQ ID NO: 594088 - DNA, 25 bp, Mus musculus
ggactgtcctttaaatgttaaagct

SEQ ID NO: 594089 - DNA, 25 bp, Mus musculus
ggactgtccttttaatgttaaagct

SEQ ID NO: 594090 - DNA, 25 bp, Mus musculus
ggactgtcggccatagcgtggtctc

SEQ ID NO: 594091 - DNA, 25 bp, Mus musculus
ggactgtcggccttagcgtggtctc

SEQ ID NO: 594092 - DNA, 25 bp, Mus musculus
ggactgtctattatggtgatgcctt

SEQ ID NO: 594093 - DNA, 25 bp, Mus musculus
ggactgtctattttggtgatgcctt

SEQ ID NO: 594094 - DNA, 25 bp, Mus musculus
ggactgtctgcaattgtggagctta

SEQ ID NO: 594095 - DNA, 25 bp, Mus musculus
ggactgtctgcatttgtggagctta

SEQ ID NO: 594096 - DNA, 25 bp, Mus musculus
ggactgtctgtgactctctgacaaa

SEQ ID NO: 594097 - DNA, 25 bp, Mus musculus
ggactgtctgtgtctctctgacaaa

SEQ ID NO: 594098 - DNA, 25 bp, Mus musculus
ggactgtctttgaacttgaacttaa

SEQ ID NO: 594099 - DNA, 25 bp, Mus musculus
ggactgtctttgtacttgaacttaa

SEQ ID NO: 594100 - DNA, 25 bp, Mus musculus
ggactgtgaagtctggcacctaaga

SEQ ID NO: 594101 - DNA, 25 bp, Mus musculus
ggactgtgaagtgtggcacctaaga

SEQ ID NO: 594102 - DNA, 25 bp, Mus musculus
ggactgtgacaccaatactgtaaat

SEQ ID NO: 594103 - DNA, 25 bp, Mus musculus
ggactgtgacacgaatactgtaaat

SEQ ID NO: 594104 - DNA, 25 bp, Mus musculus
ggactgtgacctagacctgtgccat

SEQ ID NO: 594105 - DNA, 25 bp, Mus musculus
ggactgtgaccttgacctgtgccat

SEQ ID NO: 594106 - DNA, 25 bp, Mus musculus
ggactgtgactacatattctgaatt

SEQ ID NO: 594107 - DNA, 25 bp, Mus musculus
ggactgtgactagatattctgaatt

SEQ ID NO: 594108 - DNA, 25 bp, Mus musculus
ggactgtgatccaattagcttgtga

SEQ ID NO: 594109 - DNA, 25 bp, Mus musculus
ggactgtgatcctattagcttgtga

SEQ ID NO: 594110 - DNA, 25 bp, Mus musculus
ggactgtgcacacgaacttcagatt

SEQ ID NO: 594111 - DNA, 25 bp, Mus musculus
ggactgtgcacaggaacttcagatt

SEQ ID NO: 594112 - DNA, 25 bp, Mus musculus
ggactgtgcaggcacttggtcaaca

SEQ ID NO: 594113 - DNA, 25 bp, Mus musculus
ggactgtgcagggacttggtcaaca

SEQ ID NO: 594114 - DNA, 25 bp, Mus musculus
ggactgtgcgctcgtgaaccgcttt

SEQ ID NO: 594115 - DNA, 25 bp, Mus musculus
ggactgtgcgctggtgaaccgcttt

SEQ ID NO: 594116 - DNA, 25 bp, Mus musculus
ggactgtggatcaaaaacacttcta

SEQ ID NO: 594117 - DNA, 25 bp, Mus musculus
ggactgtggatctaaaacacttcta

SEQ ID NO: 594118 - DNA, 25 bp, Mus musculus
ggactgtggcagacttcacccagtg

SEQ ID NO: 594119 - DNA, 25 bp, Mus musculus
ggactgtggcagtcttcacccagtg

SEQ ID NO: 594120 - DNA, 25 bp, Mus musculus
ggactgtggcgaccttgaggccagt

SEQ ID NO: 594121 - DNA, 25 bp, Mus musculus
ggactgtggcgagcttgaggccagt

SEQ ID NO: 594122 - DNA, 25 bp, Mus musculus
ggactgtggtggccagaggcattag

SEQ ID NO: 594123 - DNA, 25 bp, Mus musculus
ggactgtggtgggcagaggcattag

SEQ ID NO: 594124 - DNA, 25 bp, Mus musculus
ggactgtgtcatctcaaatcttcta

SEQ ID NO: 594125 - DNA, 25 bp, Mus musculus
ggactgtgtcatgtcaaatcttcta

SEQ ID NO: 594126 - DNA, 25 bp, Mus musculus
ggactgtgtgacaccatagtaacca

SEQ ID NO: 594127 - DNA, 25 bp, Mus musculus
ggactgtgtgactccatagtaacca

SEQ ID NO: 594128 - DNA, 25 bp, Mus musculus
ggactgtgttccaaaagttcgtata

SEQ ID NO: 594129 - DNA, 25 bp, Mus musculus
ggactgtgttcctaaagttcgtata

SEQ ID NO: 594130 - DNA, 25 bp, Mus musculus
ggactgttacagctgaccaatgcca

SEQ ID NO: 594131 - DNA, 25 bp, Mus musculus
ggactgttacaggtgaccaatgcca

SEQ ID NO: 594132 - DNA, 25 bp, Mus musculus
ggactgttactaaattacttatgat

SEQ ID NO: 594133 - DNA, 25 bp, Mus musculus
ggactgttactatattacttatgat

SEQ ID NO: 594134 - DNA, 25 bp, Mus musculus
ggactgttcatcatgtaacatcaga

SEQ ID NO: 594135 - DNA, 25 bp, Mus musculus
ggactgttcatcttgtaacatcaga

SEQ ID NO: 594136 - DNA, 25 bp, Mus musculus
ggactgttccggacctatgatgaat

SEQ ID NO: 594137 - DNA, 25 bp, Mus musculus
ggactgttccggtcctatgatgaat

SEQ ID NO: 594138 - DNA, 25 bp, Mus musculus
ggactgttctatatagttactcttc

SEQ ID NO: 594139 - DNA, 25 bp, Mus musculus
ggactgttctatttagttactcttc

SEQ ID NO: 594140 - DNA, 25 bp, Mus musculus
ggactgttctcactgtaggcactta

SEQ ID NO: 594141 - DNA, 25 bp, Mus musculus
ggactgttctcagtgtaggcactta

SEQ ID NO: 594142 - DNA, 25 bp, Mus musculus
ggactgttctcgatctgctgtagaa

SEQ ID NO: 594143 - DNA, 25 bp, Mus musculus
ggactgttctcgttctgctgtagaa

SEQ ID NO: 594144 - DNA, 25 bp, Mus musculus
ggactgttctgacgcatcacgtgca

SEQ ID NO: 594145 - DNA, 25 bp, Mus musculus
ggactgttctgaggcatcacgtgca

SEQ ID NO: 594146 - DNA, 25 bp, Mus musculus
ggactgttctgtaaagtgactggta

SEQ ID NO: 594147 - DNA, 25 bp, Mus musculus
ggactgttctgttaagtgactggta

SEQ ID NO: 594148 - DNA, 25 bp, Mus musculus
ggactgttcttcactagactgcatg

SEQ ID NO: 594149 - DNA, 25 bp, Mus musculus
ggactgttcttctctagactgcatg

SEQ ID NO: 594150 - DNA, 25 bp, Mus musculus
ggactgttcttgataatgtactttc

SEQ ID NO: 594151 - DNA, 25 bp, Mus musculus
ggactgttcttgttaatgtactttc

SEQ ID NO: 594152 - DNA, 25 bp, Mus musculus
ggactgttggtaagtagctgatcac

SEQ ID NO: 594153 - DNA, 25 bp, Mus musculus
ggactgttggtatgtagctgatcac

SEQ ID NO: 594154 - DNA, 25 bp, Mus musculus
ggactgttgttcacaaactatggct

SEQ ID NO: 594155 - DNA, 25 bp, Mus musculus
ggactgttgttctcaaactatggct

SEQ ID NO: 594156 - DNA, 25 bp, Mus musculus
ggactgtttaaaaccactttggatc

SEQ ID NO: 594157 - DNA, 25 bp, Mus musculus
ggactgtttaaatccactttggatc

SEQ ID NO: 594158 - DNA, 25 bp, Mus musculus
ggactgtttatacttttccatgaaa

SEQ ID NO: 594159 - DNA, 25 bp, Mus musculus
ggactgtttatagttttccatgaaa

SEQ ID NO: 594160 - DNA, 25 bp, Mus musculus
ggactgtttgagcaaccacaatcta

SEQ ID NO: 594161 - DNA, 25 bp, Mus musculus
ggactgtttgaggaaccacaatcta

SEQ ID NO: 594162 - DNA, 25 bp, Mus musculus
ggactgtttgccataccttgagaaa

SEQ ID NO: 594163 - DNA, 25 bp, Mus musculus
ggactgtttgccttaccttgagaaa

SEQ ID NO: 594164 - DNA, 25 bp, Mus musculus
ggactgtttggtagaatttgtgttc

SEQ ID NO: 594165 - DNA, 25 bp, Mus musculus
ggactgtttggttgaatttgtgttc

SEQ ID NO: 594166 - DNA, 25 bp, Mus musculus
ggactgttttccacgattgactgca

SEQ ID NO: 594167 - DNA, 25 bp, Mus musculus
ggactgttttcctcgattgactgca

SEQ ID NO: 594168 - DNA, 25 bp, Mus musculus
ggactgttttctcggtggtttgatc

SEQ ID NO: 594169 - DNA, 25 bp, Mus musculus
ggactgttttctgggtggtttgatc

SEQ ID NO: 594170 - DNA, 25 bp, Mus musculus
ggacttaaaagtagctgtgcccatt

SEQ ID NO: 594171 - DNA, 25 bp, Mus musculus
ggacttaaaagtcacatcatgtgta

SEQ ID NO: 594172 - DNA, 25 bp, Mus musculus
ggacttaaaagtgacatcatgtgta

SEQ ID NO: 594173 - DNA, 25 bp, Mus musculus
ggacttaaaagttgctgtgcccatt

SEQ ID NO: 594174 - DNA, 25 bp, Mus musculus
ggacttaaacttcgatgcacatcct

SEQ ID NO: 594175 - DNA, 25 bp, Mus musculus
ggacttaaacttggatgcacatcct

SEQ ID NO: 594176 - DNA, 25 bp, Mus musculus
ggacttaaatgactcccttagaaca

SEQ ID NO: 594177 - DNA, 25 bp, Mus musculus
ggacttaaatgagtcccttagaaca

SEQ ID NO: 594178 - DNA, 25 bp, Mus musculus
ggacttaacagcaacgcagacctga

SEQ ID NO: 594179 - DNA, 25 bp, Mus musculus
ggacttaacagctacgcagacctga

SEQ ID NO: 594180 - DNA, 25 bp, Mus musculus
ggacttaactgcaattgctacttga

SEQ ID NO: 594181 - DNA, 25 bp, Mus musculus
ggacttaactgctattgctacttga

SEQ ID NO: 594182 - DNA, 25 bp, Mus musculus
ggacttaactgtacccagttactca

SEQ ID NO: 594183 - DNA, 25 bp, Mus musculus
ggacttaactgttcccagttactca

SEQ ID NO: 594184 - DNA, 25 bp, Mus musculus
ggacttaactttctttacagagact

SEQ ID NO: 594185 - DNA, 25 bp, Mus musculus
ggacttaactttgtttacagagact

SEQ ID NO: 594186 - DNA, 25 bp, Mus musculus
ggacttaagcatatcctagttttat

SEQ ID NO: 594187 - DNA, 25 bp, Mus musculus
ggacttaagcatttcctagttttat

SEQ ID NO: 594188 - DNA, 25 bp, Mus musculus
ggacttaaggctcgacattgttact

SEQ ID NO: 594189 - DNA, 25 bp, Mus musculus
ggacttaaggctggacattgttact

SEQ ID NO: 594190 - DNA, 25 bp, Mus musculus
ggacttaagtcaataggaggcccat

SEQ ID NO: 594191 - DNA, 25 bp, Mus musculus
ggacttaagtcattaggaggcccat

SEQ ID NO: 594192 - DNA, 25 bp, Mus musculus
ggacttaagtgaacaggccctaaag

SEQ ID NO: 594193 - DNA, 25 bp, Mus musculus
ggacttaagtgatcaggccctaaag

SEQ ID NO: 594194 - DNA, 25 bp, Mus musculus
ggacttaagttgaatcacgccattt

SEQ ID NO: 594195 - DNA, 25 bp, Mus musculus
ggacttaagttgtatcacgccattt

SEQ ID NO: 594196 - DNA, 25 bp, Mus musculus
ggacttaatatgacagcctagctgt

SEQ ID NO: 594197 - DNA, 25 bp, Mus musculus
ggacttaatatgtcagcctagctgt

SEQ ID NO: 594198 - DNA, 25 bp, Mus musculus
ggacttaatcctatgtttggccatg

SEQ ID NO: 594199 - DNA, 25 bp, Mus musculus
ggacttaatcctattccaggagtgt

SEQ ID NO: 594200 - DNA, 25 bp, Mus musculus
ggacttaatcctttgtttggccatg

SEQ ID NO: 594201 - DNA, 25 bp, Mus musculus
ggacttaatccttttccaggagtgt

SEQ ID NO: 594202 - DNA, 25 bp, Mus musculus
ggacttaatttcaactactgcacta

SEQ ID NO: 594203 - DNA, 25 bp, Mus musculus
ggacttaatttctactactgcacta

SEQ ID NO: 594204 - DNA, 25 bp, Mus musculus
ggacttacaggcagtcgtgagcagc

SEQ ID NO: 594205 - DNA, 25 bp, Mus musculus
ggacttacaggctgtcgtgagcagc

SEQ ID NO: 594206 - DNA, 25 bp, Mus musculus
ggacttaccaccacagaaaatcata

SEQ ID NO: 594207 - DNA, 25 bp, Mus musculus
ggacttaccacctcagaaaatcata

SEQ ID NO: 594208 - DNA, 25 bp, Mus musculus
ggacttaccagcctacagaattcat

SEQ ID NO: 594209 - DNA, 25 bp, Mus musculus
ggacttaccagcgtacagaattcat

SEQ ID NO: 594210 - DNA, 25 bp, Mus musculus
ggacttacctccagaagatatgctt

SEQ ID NO: 594211 - DNA, 25 bp, Mus musculus
ggacttacctcctgaagatatgctt

SEQ ID NO: 594212 - DNA, 25 bp, Mus musculus
ggacttacgaagctttgctacaggt

SEQ ID NO: 594213 - DNA, 25 bp, Mus musculus
ggacttacgaaggtttgctacaggt

SEQ ID NO: 594214 - DNA, 25 bp, Mus musculus
ggacttacgttgctgggcttgcaaa

SEQ ID NO: 594215 - DNA, 25 bp, Mus musculus
ggacttacgttggtgggcttgcaaa

SEQ ID NO: 594216 - DNA, 25 bp, Mus musculus
ggacttactaccacagattcctgta

SEQ ID NO: 594217 - DNA, 25 bp, Mus musculus
ggacttactacctcagattcctgta

SEQ ID NO: 594218 - DNA, 25 bp, Mus musculus
ggacttactatccaaacgtcatctg

SEQ ID NO: 594219 - DNA, 25 bp, Mus musculus
ggacttactatcgaaacgtcatctg

SEQ ID NO: 594220 - DNA, 25 bp, Mus musculus
ggacttacttatacttgaggactgc

SEQ ID NO: 594221 - DNA, 25 bp, Mus musculus
ggacttacttattcttgaggactgc

SEQ ID NO: 594222 - DNA, 25 bp, Mus musculus
ggacttacttggaatggcctactga

SEQ ID NO: 594223 - DNA, 25 bp, Mus musculus
ggacttacttggtatggcctactga

SEQ ID NO: 594224 - DNA, 25 bp, Mus musculus
ggacttagaactatcagagctgctt

SEQ ID NO: 594225 - DNA, 25 bp, Mus musculus
ggacttagaactttcagagctgctt

SEQ ID NO: 594226 - DNA, 25 bp, Mus musculus
ggacttagaggccacacttgtgaaa

SEQ ID NO: 594227 - DNA, 25 bp, Mus musculus
ggacttagaggcgacacttgtgaaa

SEQ ID NO: 594228 - DNA, 25 bp, Mus musculus
ggacttagcaccctgagctcatgat

SEQ ID NO: 594229 - DNA, 25 bp, Mus musculus
ggacttagcaccgtgagctcatgat

SEQ ID NO: 594230 - DNA, 25 bp, Mus musculus
ggacttagctagacagccaggccct

SEQ ID NO: 594231 - DNA, 25 bp, Mus musculus
ggacttagctagtcagccaggccct

SEQ ID NO: 594232 - DNA, 25 bp, Mus musculus
ggacttaggctgctgatgccccttc

SEQ ID NO: 594233 - DNA, 25 bp, Mus musculus
ggacttaggctggtgatgccccttc

SEQ ID NO: 594234 - DNA, 25 bp, Mus musculus
ggacttagggacatggccacctcct

SEQ ID NO: 594235 - DNA, 25 bp, Mus musculus
ggacttagggacttggccacctcct

SEQ ID NO: 594236 - DNA, 25 bp, Mus musculus
ggacttagtaacagaccaactcggg

SEQ ID NO: 594237 - DNA, 25 bp, Mus musculus
ggacttagtaactgaccaactcggg

SEQ ID NO: 594238 - DNA, 25 bp, Mus musculus
ggacttagtccaaagcatcgtagta

SEQ ID NO: 594239 - DNA, 25 bp, Mus musculus
ggacttagtccatagcatcgtagta

SEQ ID NO: 594240 - DNA, 25 bp, Mus musculus
ggacttagtgtgatcatccaccatg

SEQ ID NO: 594241 - DNA, 25 bp, Mus musculus
ggacttagtgtgttcatccaccatg

SEQ ID NO: 594242 - DNA, 25 bp, Mus musculus
ggacttagtgttcgcagctgttcct

SEQ ID NO: 594243 - DNA, 25 bp, Mus musculus
ggacttagtgttggcagctgttcct

SEQ ID NO: 594244 - DNA, 25 bp, Mus musculus
ggacttagttccaatagacctcagt

SEQ ID NO: 594245 - DNA, 25 bp, Mus musculus
ggacttagttccctatgctgttctt

SEQ ID NO: 594246 - DNA, 25 bp, Mus musculus
ggacttagttccgtatgctgttctt

SEQ ID NO: 594247 - DNA, 25 bp, Mus musculus
ggacttagttcctatagacctcagt

SEQ ID NO: 594248 - DNA, 25 bp, Mus musculus
ggacttataaacaggctgcatgagc

SEQ ID NO: 594249 - DNA, 25 bp, Mus musculus
ggacttataaactggctgcatgagc

SEQ ID NO: 594250 - DNA, 25 bp, Mus musculus
ggacttatgggcagatcacctgtgt

SEQ ID NO: 594251 - DNA, 25 bp, Mus musculus
ggacttatgggctgatcacctgtgt

SEQ ID NO: 594252 - DNA, 25 bp, Mus musculus
ggacttatttccaaccaactttgat

SEQ ID NO: 594253 - DNA, 25 bp, Mus musculus
ggacttatttcctaccaactttgat

SEQ ID NO: 594254 - DNA, 25 bp, Mus musculus
ggacttcaaacactttgtctgcaaa

SEQ ID NO: 594255 - DNA, 25 bp, Mus musculus
ggacttcaaacagtttgtctgcaaa

SEQ ID NO: 594256 - DNA, 25 bp, Mus musculus
ggacttcaaagccttcttagtgact

SEQ ID NO: 594257 - DNA, 25 bp, Mus musculus
ggacttcaaagcgttcttagtgact

SEQ ID NO: 594258 - DNA, 25 bp, Mus musculus
ggacttcaaatcacaaacacctcta

SEQ ID NO: 594259 - DNA, 25 bp, Mus musculus
ggacttcaaatctcaaacacctcta

SEQ ID NO: 594260 - DNA, 25 bp, Mus musculus
ggacttcaaatgctaccatgttgta

SEQ ID NO: 594261 - DNA, 25 bp, Mus musculus
ggacttcaaatggtaccatgttgta

SEQ ID NO: 594262 - DNA, 25 bp, Mus musculus
ggacttcaacaaatggaatttaatc

SEQ ID NO: 594263 - DNA, 25 bp, Mus musculus
ggacttcaacaattggaatttaatc

SEQ ID NO: 594264 - DNA, 25 bp, Mus musculus
ggacttcaagatcgcgtcactcgtg

SEQ ID NO: 594265 - DNA, 25 bp, Mus musculus
ggacttcaagatggcgtcactcgtg

SEQ ID NO: 594266 - DNA, 25 bp, Mus musculus
ggacttcaagtaccctgtctataaa

SEQ ID NO: 594267 - DNA, 25 bp, Mus musculus
ggacttcaagtagcctgtctataaa

SEQ ID NO: 594268 - DNA, 25 bp, Mus musculus
ggacttcaatcaaggtggctgacct

SEQ ID NO: 594269 - DNA, 25 bp, Mus musculus
ggacttcaatcatggtggctgacct

SEQ ID NO: 594270 - DNA, 25 bp, Mus musculus
ggacttcacactacatctggtactg

SEQ ID NO: 594271 - DNA, 25 bp, Mus musculus
ggacttcacacttcatctggtactg

SEQ ID NO: 594272 - DNA, 25 bp, Mus musculus
ggacttcacgcacaacacgttgcaa

SEQ ID NO: 594273 - DNA, 25 bp, Mus musculus
ggacttcacgcagaacacgttgcaa

SEQ ID NO: 594274 - DNA, 25 bp, Mus musculus
ggacttcacgcgcatcctgcagatg

SEQ ID NO: 594275 - DNA, 25 bp, Mus musculus
ggacttcacgcggatcctgcagatg

SEQ ID NO: 594276 - DNA, 25 bp, Mus musculus
ggacttcacggtctgttgactcaaa

SEQ ID NO: 594277 - DNA, 25 bp, Mus musculus
ggacttcacggtgtgttgactcaaa

SEQ ID NO: 594278 - DNA, 25 bp, Mus musculus
ggacttcactcaccctgcagacaag

SEQ ID NO: 594279 - DNA, 25 bp, Mus musculus
ggacttcactcagcctgcagacaag

SEQ ID NO: 594280 - DNA, 25 bp, Mus musculus
ggacttcacttcagtgcaggaggca

SEQ ID NO: 594281 - DNA, 25 bp, Mus musculus
ggacttcacttctgtgcaggaggca

SEQ ID NO: 594282 - DNA, 25 bp, Mus musculus
ggacttcagatcaagggcttccttg

SEQ ID NO: 594283 - DNA, 25 bp, Mus musculus
ggacttcagatctagggcttccttg

SEQ ID NO: 594284 - DNA, 25 bp, Mus musculus
ggacttcagcttaaacctattcagt

SEQ ID NO: 594285 - DNA, 25 bp, Mus musculus
ggacttcagctttaacctattcagt

SEQ ID NO: 594286 - DNA, 25 bp, Mus musculus
ggacttcagggcaaaggcttagaca

SEQ ID NO: 594287 - DNA, 25 bp, Mus musculus
ggacttcagggctaaggcttagaca

SEQ ID NO: 594288 - DNA, 25 bp, Mus musculus
ggacttcaggttactgacaacactg

SEQ ID NO: 594289 - DNA, 25 bp, Mus musculus
ggacttcaggtttctgacaacactg

SEQ ID NO: 594290 - DNA, 25 bp, Mus musculus
ggacttcagtaacccagtgtctgca

SEQ ID NO: 594291 - DNA, 25 bp, Mus musculus
ggacttcagtaagccagtgtctgca

SEQ ID NO: 594292 - DNA, 25 bp, Mus musculus
ggacttcagtgccattgatctaata

SEQ ID NO: 594293 - DNA, 25 bp, Mus musculus
ggacttcagtgcgattgatctaata

SEQ ID NO: 594294 - DNA, 25 bp, Mus musculus
ggacttcagttaacaccttgtttgt

SEQ ID NO: 594295 - DNA, 25 bp, Mus musculus
ggacttcagttaatttgcacccttg

SEQ ID NO: 594296 - DNA, 25 bp, Mus musculus
ggacttcagttatcaccttgtttgt

SEQ ID NO: 594297 - DNA, 25 bp, Mus musculus
ggacttcagttattttgcacccttg

SEQ ID NO: 594298 - DNA, 25 bp, Mus musculus
ggacttcagtttctcccgtggagat

SEQ ID NO: 594299 - DNA, 25 bp, Mus musculus
ggacttcagtttctcgggtctgtgc

SEQ ID NO: 594300 - DNA, 25 bp, Mus musculus
ggacttcagtttgtcccgtggagat

SEQ ID NO: 594301 - DNA, 25 bp, Mus musculus
ggacttcagtttgtcgggtctgtgc

SEQ ID NO: 594302 - DNA, 25 bp, Mus musculus
ggacttcataacaagactctaacct

SEQ ID NO: 594303 - DNA, 25 bp, Mus musculus
ggacttcataactagactctaacct

SEQ ID NO: 594304 - DNA, 25 bp, Mus musculus
ggacttcatcaaccagggtaagagg

SEQ ID NO: 594305 - DNA, 25 bp, Mus musculus
ggacttcatcaagcagggtaagagg

SEQ ID NO: 594306 - DNA, 25 bp, Mus musculus
ggacttcatgcaatcctggatcaac

SEQ ID NO: 594307 - DNA, 25 bp, Mus musculus
ggacttcatgcattcctggatcaac

SEQ ID NO: 594308 - DNA, 25 bp, Mus musculus
ggacttcatgccacgtaacaactta

SEQ ID NO: 594309 - DNA, 25 bp, Mus musculus
ggacttcatgcctcgtaacaactta

SEQ ID NO: 594310 - DNA, 25 bp, Mus musculus
ggacttcattacaaaactagcgcat

SEQ ID NO: 594311 - DNA, 25 bp, Mus musculus
ggacttcattactaaactagcgcat

SEQ ID NO: 594312 - DNA, 25 bp, Mus musculus
ggacttcattagctgagctcccttg

SEQ ID NO: 594313 - DNA, 25 bp, Mus musculus
ggacttcattaggtgagctcccttg

SEQ ID NO: 594314 - DNA, 25 bp, Mus musculus
ggacttcattatctagcagtctgaa

SEQ ID NO: 594315 - DNA, 25 bp, Mus musculus
ggacttcattatgtagcagtctgaa

SEQ ID NO: 594316 - DNA, 25 bp, Mus musculus
ggacttcattctcccagtacttata

SEQ ID NO: 594317 - DNA, 25 bp, Mus musculus
ggacttcattctgccagtacttata

SEQ ID NO: 594318 - DNA, 25 bp, Mus musculus
ggacttccaaatatgagactagcct

SEQ ID NO: 594319 - DNA, 25 bp, Mus musculus
ggacttccaaatttgagactagcct

SEQ ID NO: 594320 - DNA, 25 bp, Mus musculus
ggacttccaagtcatacctgatgat

SEQ ID NO: 594321 - DNA, 25 bp, Mus musculus
ggacttccaagtgatacctgatgat

SEQ ID NO: 594322 - DNA, 25 bp, Mus musculus
ggacttccacaaaagcttccttagt

SEQ ID NO: 594323 - DNA, 25 bp, Mus musculus
ggacttccacaaactggaaccgcta

SEQ ID NO: 594324 - DNA, 25 bp, Mus musculus
ggacttccacaatagcttccttagt

SEQ ID NO: 594325 - DNA, 25 bp, Mus musculus
ggacttccacaatctggaaccgcta

SEQ ID NO: 594326 - DNA, 25 bp, Mus musculus
ggacttccacttactactgtgtctt

SEQ ID NO: 594327 - DNA, 25 bp, Mus musculus
ggacttccactttctactgtgtctt

SEQ ID NO: 594328 - DNA, 25 bp, Mus musculus
ggacttccagaaactcttgattctt

SEQ ID NO: 594329 - DNA, 25 bp, Mus musculus
ggacttccagaacatctttcccatg

SEQ ID NO: 594330 - DNA, 25 bp, Mus musculus
ggacttccagaagatctttcccatg

SEQ ID NO: 594331 - DNA, 25 bp, Mus musculus
ggacttccagaatctcttgattctt

SEQ ID NO: 594332 - DNA, 25 bp, Mus musculus
ggacttccagatactaatttgtttt

SEQ ID NO: 594333 - DNA, 25 bp, Mus musculus
ggacttccagattctaatttgtttt

SEQ ID NO: 594334 - DNA, 25 bp, Mus musculus
ggacttccagtacgaggccatgcag

SEQ ID NO: 594335 - DNA, 25 bp, Mus musculus
ggacttccagtaggaggccatgcag

SEQ ID NO: 594336 - DNA, 25 bp, Mus musculus
ggacttccagtgaacttccaggctg

SEQ ID NO: 594337 - DNA, 25 bp, Mus musculus
ggacttccagtgtacttccaggctg

SEQ ID NO: 594338 - DNA, 25 bp, Mus musculus
ggacttccatatacactcaacgtgc

SEQ ID NO: 594339 - DNA, 25 bp, Mus musculus
ggacttccatattcactcaacgtgc

SEQ ID NO: 594340 - DNA, 25 bp, Mus musculus
ggacttccattcatatacagtagga

SEQ ID NO: 594341 - DNA, 25 bp, Mus musculus
ggacttccattcttatacagtagga

SEQ ID NO: 594342 - DNA, 25 bp, Mus musculus
ggacttcccacaataaatcccagaa

SEQ ID NO: 594343 - DNA, 25 bp, Mus musculus
ggacttcccacattaaatcccagaa

SEQ ID NO: 594344 - DNA, 25 bp, Mus musculus
ggacttcccagtcagacattgtgag

SEQ ID NO: 594345 - DNA, 25 bp, Mus musculus
ggacttcccagtgagacattgtgag

SEQ ID NO: 594346 - DNA, 25 bp, Mus musculus
ggacttccccaaaagatttggattg

SEQ ID NO: 594347 - DNA, 25 bp, Mus musculus
ggacttccccaatagatttggattg

SEQ ID NO: 594348 - DNA, 25 bp, Mus musculus
ggacttcccctaaggtcaatatggt

SEQ ID NO: 594349 - DNA, 25 bp, Mus musculus
ggacttcccctatggtcaatatggt

SEQ ID NO: 594350 - DNA, 25 bp, Mus musculus
ggacttccctcacatgggacgtttt

SEQ ID NO: 594351 - DNA, 25 bp, Mus musculus
ggacttccctcagatgggacgtttt

SEQ ID NO: 594352 - DNA, 25 bp, Mus musculus
ggacttccgcttagcaaccttgtat

SEQ ID NO: 594353 - DNA, 25 bp, Mus musculus
ggacttccgctttgcaaccttgtat

SEQ ID NO: 594354 - DNA, 25 bp, Mus musculus
ggacttccggttatgtccgctccag

SEQ ID NO: 594355 - DNA, 25 bp, Mus musculus
ggacttccggttttgtccgctccag

SEQ ID NO: 594356 - DNA, 25 bp, Mus musculus
ggacttccgtccactgggcagggta

SEQ ID NO: 594357 - DNA, 25 bp, Mus musculus
ggacttccgtcctctgggcagggta

SEQ ID NO: 594358 - DNA, 25 bp, Mus musculus
ggacttcctcagcacatttgtattt

SEQ ID NO: 594359 - DNA, 25 bp, Mus musculus
ggacttcctcaggacatttgtattt

SEQ ID NO: 594360 - DNA, 25 bp, Mus musculus
ggacttcctggaccatttgctcacg

SEQ ID NO: 594361 - DNA, 25 bp, Mus musculus
ggacttcctggagcatttgctcacg

SEQ ID NO: 594362 - DNA, 25 bp, Mus musculus
ggacttccttagactggatctcaga

SEQ ID NO: 594363 - DNA, 25 bp, Mus musculus
ggacttccttagtctggatctcaga

SEQ ID NO: 594364 - DNA, 25 bp, Mus musculus
ggacttccttcactaaaactattga

SEQ ID NO: 594365 - DNA, 25 bp, Mus musculus
ggacttccttcagtaaaactattga

SEQ ID NO: 594366 - DNA, 25 bp, Mus musculus
ggacttcctttaaacatactcatct

SEQ ID NO: 594367 - DNA, 25 bp, Mus musculus
ggacttcctttatacatactcatct

SEQ ID NO: 594368 - DNA, 25 bp, Mus musculus
ggacttcgatgactttcttgtcatg

SEQ ID NO: 594369 - DNA, 25 bp, Mus musculus
ggacttcgatgagtttcttgtcatg

SEQ ID NO: 594370 - DNA, 25 bp, Mus musculus
ggacttcgcctgagaccagtgcggc

SEQ ID NO: 594371 - DNA, 25 bp, Mus musculus
ggacttcgcctgtgaccagtgcggc

SEQ ID NO: 594372 - DNA, 25 bp, Mus musculus
ggacttcgctctcgaagtgttggaa

SEQ ID NO: 594373 - DNA, 25 bp, Mus musculus
ggacttcgctctggaagtgttggaa

SEQ ID NO: 594374 - DNA, 25 bp, Mus musculus
ggacttcgtgaaccccaagggagct

SEQ ID NO: 594375 - DNA, 25 bp, Mus musculus
ggacttcgtgaagcccaagggagct

SEQ ID NO: 594376 - DNA, 25 bp, Mus musculus
ggacttcgttttctagcaaatcaca

SEQ ID NO: 594377 - DNA, 25 bp, Mus musculus
ggacttcgttttgtagcaaatcaca

SEQ ID NO: 594378 - DNA, 25 bp, Mus musculus
ggacttctaaagcatcctggcagct

SEQ ID NO: 594379 - DNA, 25 bp, Mus musculus
ggacttctaaaggatcctggcagct

SEQ ID NO: 594380 - DNA, 25 bp, Mus musculus
ggacttctaaataaccagctctctg

SEQ ID NO: 594381 - DNA, 25 bp, Mus musculus
ggacttctaaatacaggttgctata

SEQ ID NO: 594382 - DNA, 25 bp, Mus musculus
ggacttctaaattaccagctctctg

SEQ ID NO: 594383 - DNA, 25 bp, Mus musculus
ggacttctaaattcaggttgctata

SEQ ID NO: 594384 - DNA, 25 bp, Mus musculus
ggacttctaatgcacttcgttagct

SEQ ID NO: 594385 - DNA, 25 bp, Mus musculus
ggacttctaatggacttcgttagct

SEQ ID NO: 594386 - DNA, 25 bp, Mus musculus
ggacttctacaaacaggcgtctaga

SEQ ID NO: 594387 - DNA, 25 bp, Mus musculus
ggacttctacaaccacctgtggagc

SEQ ID NO: 594388 - DNA, 25 bp, Mus musculus
ggacttctacaactgcactgagcga

SEQ ID NO: 594389 - DNA, 25 bp, Mus musculus
ggacttctacaagcacctgtggagc

SEQ ID NO: 594390 - DNA, 25 bp, Mus musculus
ggacttctacaagtgcactgagcga

SEQ ID NO: 594391 - DNA, 25 bp, Mus musculus
ggacttctacaatcaggcgtctaga

SEQ ID NO: 594392 - DNA, 25 bp, Mus musculus
ggacttctagagaaggccctcttct

SEQ ID NO: 594393 - DNA, 25 bp, Mus musculus
ggacttctagagtaggccctcttct

SEQ ID NO: 594394 - DNA, 25 bp, Mus musculus
ggacttctagttccttccctgacca

SEQ ID NO: 594395 - DNA, 25 bp, Mus musculus
ggacttctagttgcttccctgacca

SEQ ID NO: 594396 - DNA, 25 bp, Mus musculus
ggacttctatccactaggactgtga

SEQ ID NO: 594397 - DNA, 25 bp, Mus musculus
ggacttctatcctctaggactgtga

SEQ ID NO: 594398 - DNA, 25 bp, Mus musculus
ggacttctatgactgttaagctcat

SEQ ID NO: 594399 - DNA, 25 bp, Mus musculus
ggacttctatgagtgttaagctcat

SEQ ID NO: 594400 - DNA, 25 bp, Mus musculus
ggacttctcaacaggccagttgaag

SEQ ID NO: 594401 - DNA, 25 bp, Mus musculus
ggacttctcaactggccagttgaag

SEQ ID NO: 594402 - DNA, 25 bp, Mus musculus
ggacttctcaagatgtggtcactga

SEQ ID NO: 594403 - DNA, 25 bp, Mus musculus
ggacttctcaagttgtggtcactga

SEQ ID NO: 594404 - DNA, 25 bp, Mus musculus
ggacttctcactctattaaggctgc

SEQ ID NO: 594405 - DNA, 25 bp, Mus musculus
ggacttctcactgtattaaggctgc

SEQ ID NO: 594406 - DNA, 25 bp, Mus musculus
ggacttctcatcagactaacttgca

SEQ ID NO: 594407 - DNA, 25 bp, Mus musculus
ggacttctcatctgactaacttgca

SEQ ID NO: 594408 - DNA, 25 bp, Mus musculus
ggacttctctagcaacatttcatga

SEQ ID NO: 594409 - DNA, 25 bp, Mus musculus
ggacttctctaggaacatttcatga

SEQ ID NO: 594410 - DNA, 25 bp, Mus musculus
ggacttctgacaccgacactgaaag

SEQ ID NO: 594411 - DNA, 25 bp, Mus musculus
ggacttctgacagcgacactgaaag

SEQ ID NO: 594412 - DNA, 25 bp, Mus musculus
ggacttctgatactgctctggcttc

SEQ ID NO: 594413 - DNA, 25 bp, Mus musculus
ggacttctgatagtgctctggcttc

SEQ ID NO: 594414 - DNA, 25 bp, Mus musculus
ggacttctgcagagacgttggcata

SEQ ID NO: 594415 - DNA, 25 bp, Mus musculus
ggacttctgcagtgacgttggcata

SEQ ID NO: 594416 - DNA, 25 bp, Mus musculus
ggacttctgcggagccccaggaaaa

SEQ ID NO: 594417 - DNA, 25 bp, Mus musculus
ggacttctgcggtgccccaggaaaa

SEQ ID NO: 594418 - DNA, 25 bp, Mus musculus
ggacttcttcagcagtataatcagc

SEQ ID NO: 594419 - DNA, 25 bp, Mus musculus
ggacttcttcaggagtataatcagc

SEQ ID NO: 594420 - DNA, 25 bp, Mus musculus
ggacttcttgctacttcagatgcag

SEQ ID NO: 594421 - DNA, 25 bp, Mus musculus
ggacttcttgcttcttcagatgcag

SEQ ID NO: 594422 - DNA, 25 bp, Mus musculus
ggacttcttggaagtctgcgatgaa

SEQ ID NO: 594423 - DNA, 25 bp, Mus musculus
ggacttcttggatgtctgcgatgaa

SEQ ID NO: 594424 - DNA, 25 bp, Mus musculus
ggacttcttgtcattaaagggcatc

SEQ ID NO: 594425 - DNA, 25 bp, Mus musculus
ggacttcttgtctttaaagggcatc

SEQ ID NO: 594426 - DNA, 25 bp, Mus musculus
ggacttctttgaaagtaatgtgctt

SEQ ID NO: 594427 - DNA, 25 bp, Mus musculus
ggacttctttgaacccttcataatt

SEQ ID NO: 594428 - DNA, 25 bp, Mus musculus
ggacttctttgatagtaatgtgctt

SEQ ID NO: 594429 - DNA, 25 bp, Mus musculus
ggacttctttgatcccttcataatt

SEQ ID NO: 594430 - DNA, 25 bp, Mus musculus
ggacttctttgcacaagacccacac

SEQ ID NO: 594431 - DNA, 25 bp, Mus musculus
ggacttctttgcactgccattggac

SEQ ID NO: 594432 - DNA, 25 bp, Mus musculus
ggacttctttgctcaagacccacac

SEQ ID NO: 594433 - DNA, 25 bp, Mus musculus
ggacttctttgctctgccattggac

SEQ ID NO: 594434 - DNA, 25 bp, Mus musculus
ggacttctttttctcaatggcctgt

SEQ ID NO: 594435 - DNA, 25 bp, Mus musculus
ggacttctttttgtcaatggcctgt

SEQ ID NO: 594436 - DNA, 25 bp, Mus musculus
ggacttgaaaacaggcaacatggct

SEQ ID NO: 594437 - DNA, 25 bp, Mus musculus
ggacttgaaaactggcaacatggct

SEQ ID NO: 594438 - DNA, 25 bp, Mus musculus
ggacttgaacatattagctgcggca

SEQ ID NO: 594439 - DNA, 25 bp, Mus musculus
ggacttgaacattttagctgcggca

SEQ ID NO: 594440 - DNA, 25 bp, Mus musculus
ggacttgaaggcaaacgatccctat

SEQ ID NO: 594441 - DNA, 25 bp, Mus musculus
ggacttgaaggcaatagggcacttt

SEQ ID NO: 594442 - DNA, 25 bp, Mus musculus
ggacttgaaggctaacgatccctat

SEQ ID NO: 594443 - DNA, 25 bp, Mus musculus
ggacttgaaggctatagggcacttt

SEQ ID NO: 594444 - DNA, 25 bp, Mus musculus
ggacttgaagtcaggctgtacatca

SEQ ID NO: 594445 - DNA, 25 bp, Mus musculus
ggacttgaagtctggctgtacatca

SEQ ID NO: 594446 - DNA, 25 bp, Mus musculus
ggacttgaagttcaccccattacag

SEQ ID NO: 594447 - DNA, 25 bp, Mus musculus
ggacttgaagttgaccccattacag

SEQ ID NO: 594448 - DNA, 25 bp, Mus musculus
ggacttgaatacaccagttacactg

SEQ ID NO: 594449 - DNA, 25 bp, Mus musculus
ggacttgaatactccagttacactg

SEQ ID NO: 594450 - DNA, 25 bp, Mus musculus
ggacttgaatagcaggtctctgttt

SEQ ID NO: 594451 - DNA, 25 bp, Mus musculus
ggacttgaataggaggtctctgttt

SEQ ID NO: 594452 - DNA, 25 bp, Mus musculus
ggacttgacaagataatgagatctt

SEQ ID NO: 594453 - DNA, 25 bp, Mus musculus
ggacttgacaagttaatgagatctt

SEQ ID NO: 594454 - DNA, 25 bp, Mus musculus
ggacttgaccatcctaggaagcact

SEQ ID NO: 594455 - DNA, 25 bp, Mus musculus
ggacttgaccatgctaggaagcact

SEQ ID NO: 594456 - DNA, 25 bp, Mus musculus
ggacttgaccttccagatggccatg

SEQ ID NO: 594457 - DNA, 25 bp, Mus musculus
ggacttgaccttgcagatggccatg

SEQ ID NO: 594458 - DNA, 25 bp, Mus musculus
ggacttgacgacatggaaaatgctg

SEQ ID NO: 594459 - DNA, 25 bp, Mus musculus
ggacttgacgacttggaaaatgctg

SEQ ID NO: 594460 - DNA, 25 bp, Mus musculus
ggacttgactggacagtggctccaa

SEQ ID NO: 594461 - DNA, 25 bp, Mus musculus
ggacttgactggtcagtggctccaa

SEQ ID NO: 594462 - DNA, 25 bp, Mus musculus
ggacttgactgtcctggtcagaaca

SEQ ID NO: 594463 - DNA, 25 bp, Mus musculus
ggacttgactgtgctggtcagaaca

SEQ ID NO: 594464 - DNA, 25 bp, Mus musculus
ggacttgagactctgtgaccctccc

SEQ ID NO: 594465 - DNA, 25 bp, Mus musculus
ggacttgagactgtgtgaccctccc

SEQ ID NO: 594466 - DNA, 25 bp, Mus musculus
ggacttgagcttcttgttacctgaa

SEQ ID NO: 594467 - DNA, 25 bp, Mus musculus
ggacttgagcttgttgttacctgaa

SEQ ID NO: 594468 - DNA, 25 bp, Mus musculus
ggacttgaggtcattcttgtgagaa

SEQ ID NO: 594469 - DNA, 25 bp, Mus musculus
ggacttgaggtctttcttgtgagaa

SEQ ID NO: 594470 - DNA, 25 bp, Mus musculus
ggacttgagtatctgtaccttttga

SEQ ID NO: 594471 - DNA, 25 bp, Mus musculus
ggacttgagtatgtgtaccttttga

SEQ ID NO: 594472 - DNA, 25 bp, Mus musculus
ggacttgagttcaagctgtattttg

SEQ ID NO: 594473 - DNA, 25 bp, Mus musculus
ggacttgagttctagctgtattttg

SEQ ID NO: 594474 - DNA, 25 bp, Mus musculus
ggacttgataacaggatactggtgt

SEQ ID NO: 594475 - DNA, 25 bp, Mus musculus
ggacttgataactggatactggtgt

SEQ ID NO: 594476 - DNA, 25 bp, Mus musculus
ggacttgatacgctcacatagacat

SEQ ID NO: 594477 - DNA, 25 bp, Mus musculus
ggacttgatacggtcacatagacat

SEQ ID NO: 594478 - DNA, 25 bp, Mus musculus
ggacttgatccactggtatcctaac

SEQ ID NO: 594479 - DNA, 25 bp, Mus musculus
ggacttgatccagtggtatcctaac

SEQ ID NO: 594480 - DNA, 25 bp, Mus musculus
ggacttgatggccatctgtcctatc

SEQ ID NO: 594481 - DNA, 25 bp, Mus musculus
ggacttgatggcgatctgtcctatc

SEQ ID NO: 594482 - DNA, 25 bp, Mus musculus
ggacttgatggtattgtgctccaca

SEQ ID NO: 594483 - DNA, 25 bp, Mus musculus
ggacttgatggttttgtgctccaca

SEQ ID NO: 594484 - DNA, 25 bp, Mus musculus
ggacttgcaaaacgtttagctccaa

SEQ ID NO: 594485 - DNA, 25 bp, Mus musculus
ggacttgcaaaaggtttagctccaa

SEQ ID NO: 594486 - DNA, 25 bp, Mus musculus
ggacttgcacatctccaacagccag

SEQ ID NO: 594487 - DNA, 25 bp, Mus musculus
ggacttgcacatgtccaacagccag

SEQ ID NO: 594488 - DNA, 25 bp, Mus musculus
ggacttgcagcaatatacaactttg

SEQ ID NO: 594489 - DNA, 25 bp, Mus musculus
ggacttgcagcattatacaactttg

SEQ ID NO: 594490 - DNA, 25 bp, Mus musculus
ggacttgcagctaagcttcacactt

SEQ ID NO: 594491 - DNA, 25 bp, Mus musculus
ggacttgcagcttagcttcacactt

SEQ ID NO: 594492 - DNA, 25 bp, Mus musculus
ggacttgcagtgctgactatttctt

SEQ ID NO: 594493 - DNA, 25 bp, Mus musculus
ggacttgcagtggtgactatttctt

SEQ ID NO: 594494 - DNA, 25 bp, Mus musculus
ggacttgcatccagaagacccttca

SEQ ID NO: 594495 - DNA, 25 bp, Mus musculus
ggacttgcatcctgaagacccttca

SEQ ID NO: 594496 - DNA, 25 bp, Mus musculus
ggacttgcatttaggacgtcaaccc

SEQ ID NO: 594497 - DNA, 25 bp, Mus musculus
ggacttgcattttggacgtcaaccc

SEQ ID NO: 594498 - DNA, 25 bp, Mus musculus
ggacttgcctatatacttctacttg

SEQ ID NO: 594499 - DNA, 25 bp, Mus musculus
ggacttgcctatttacttctacttg

SEQ ID NO: 594500 - DNA, 25 bp, Mus musculus
ggacttgccttgattactccaacat

SEQ ID NO: 594501 - DNA, 25 bp, Mus musculus
ggacttgccttgtttactccaacat

SEQ ID NO: 594502 - DNA, 25 bp, Mus musculus
ggacttgcgggaacggccaaccaat

SEQ ID NO: 594503 - DNA, 25 bp, Mus musculus
ggacttgcgggatcggccaaccaat

SEQ ID NO: 594504 - DNA, 25 bp, Mus musculus
ggacttgcgtgtcaaagccagactg

SEQ ID NO: 594505 - DNA, 25 bp, Mus musculus
ggacttgcgtgtgaaagccagactg

SEQ ID NO: 594506 - DNA, 25 bp, Mus musculus
ggacttgctgtcaatattgatggat

SEQ ID NO: 594507 - DNA, 25 bp, Mus musculus
ggacttgctgtctatattgatggat

SEQ ID NO: 594508 - DNA, 25 bp, Mus musculus
ggacttgcttcacttagtttgctga

SEQ ID NO: 594509 - DNA, 25 bp, Mus musculus
ggacttgcttcagttagtttgctga

SEQ ID NO: 594510 - DNA, 25 bp, Mus musculus
ggacttgcttttagactcctaggac

SEQ ID NO: 594511 - DNA, 25 bp, Mus musculus
ggacttgctttttgactcctaggac

SEQ ID NO: 594512 - DNA, 25 bp, Mus musculus
ggacttggaaatatctcaggataaa

SEQ ID NO: 594513 - DNA, 25 bp, Mus musculus
ggacttggaaatttctcaggataaa

SEQ ID NO: 594514 - DNA, 25 bp, Mus musculus
ggacttggaagtactcttacaggga

SEQ ID NO: 594515 - DNA, 25 bp, Mus musculus
ggacttggaagttctcttacaggga

SEQ ID NO: 594516 - DNA, 25 bp, Mus musculus
ggacttggagtgatgaacagacttt

SEQ ID NO: 594517 - DNA, 25 bp, Mus musculus
ggacttggagtgttgaacagacttt

SEQ ID NO: 594518 - DNA, 25 bp, Mus musculus
ggacttggatacacgtgacctgcaa

SEQ ID NO: 594519 - DNA, 25 bp, Mus musculus
ggacttggatactcgtgacctgcaa

SEQ ID NO: 594520 - DNA, 25 bp, Mus musculus
ggacttggattcatgggccctggaa

SEQ ID NO: 594521 - DNA, 25 bp, Mus musculus
ggacttggattcttgggccctggaa

SEQ ID NO: 594522 - DNA, 25 bp, Mus musculus
ggacttggcatgatggctgtcaatt

SEQ ID NO: 594523 - DNA, 25 bp, Mus musculus
ggacttggcatgttggctgtcaatt

SEQ ID NO: 594524 - DNA, 25 bp, Mus musculus
ggacttggcgttcggagttcacact

SEQ ID NO: 594525 - DNA, 25 bp, Mus musculus
ggacttggcgttgggagttcacact

SEQ ID NO: 594526 - DNA, 25 bp, Mus musculus
ggacttggctcactatttgatagat

SEQ ID NO: 594527 - DNA, 25 bp, Mus musculus
ggacttggctcagtatttgatagat

SEQ ID NO: 594528 - DNA, 25 bp, Mus musculus
ggacttggctgaagagaccagagaa

SEQ ID NO: 594529 - DNA, 25 bp, Mus musculus
ggacttggctgaatgtgtcattgcg

SEQ ID NO: 594530 - DNA, 25 bp, Mus musculus
ggacttggctgatgagaccagagaa

SEQ ID NO: 594531 - DNA, 25 bp, Mus musculus
ggacttggctgattgtgtcattgcg

SEQ ID NO: 594532 - DNA, 25 bp, Mus musculus
ggacttggctgtcttgtgatgtatt

SEQ ID NO: 594533 - DNA, 25 bp, Mus musculus
ggacttggctgtgttgtgatgtatt

SEQ ID NO: 594534 - DNA, 25 bp, Mus musculus
ggacttggcttcagtagcttcgggc

SEQ ID NO: 594535 - DNA, 25 bp, Mus musculus
ggacttggcttctgtagcttcgggc

SEQ ID NO: 594536 - DNA, 25 bp, Mus musculus
ggacttgggctgcatttacctagta

SEQ ID NO: 594537 - DNA, 25 bp, Mus musculus
ggacttgggctggatttacctagta

SEQ ID NO: 594538 - DNA, 25 bp, Mus musculus
ggacttggtgacattagcaccatct

SEQ ID NO: 594539 - DNA, 25 bp, Mus musculus
ggacttggtgactttagcaccatct

SEQ ID NO: 594540 - DNA, 25 bp, Mus musculus
ggacttggtgccatttgtctaggga

SEQ ID NO: 594541 - DNA, 25 bp, Mus musculus
ggacttggtgccttttgtctaggga

SEQ ID NO: 594542 - DNA, 25 bp, Mus musculus
ggacttggtggacaaactacagact

SEQ ID NO: 594543 - DNA, 25 bp, Mus musculus
ggacttggtggagaaactacagact

SEQ ID NO: 594544 - DNA, 25 bp, Mus musculus
ggacttggtgttcgtcacagacata

SEQ ID NO: 594545 - DNA, 25 bp, Mus musculus
ggacttggtgttggtcacagacata

SEQ ID NO: 594546 - DNA, 25 bp, Mus musculus
ggacttggttctcattaactttctg

SEQ ID NO: 594547 - DNA, 25 bp, Mus musculus
ggacttggttctgattaactttctg

SEQ ID NO: 594548 - DNA, 25 bp, Mus musculus
ggacttgtaagacgcttccttccct

SEQ ID NO: 594549 - DNA, 25 bp, Mus musculus
ggacttgtaagactgcattctgggc

SEQ ID NO: 594550 - DNA, 25 bp, Mus musculus
ggacttgtaagaggcttccttccct

SEQ ID NO: 594551 - DNA, 25 bp, Mus musculus
ggacttgtaagagtgcattctgggc

SEQ ID NO: 594552 - DNA, 25 bp, Mus musculus
ggacttgtaatcaggattcaggaca

SEQ ID NO: 594553 - DNA, 25 bp, Mus musculus
ggacttgtaatctggattcaggaca

SEQ ID NO: 594554 - DNA, 25 bp, Mus musculus
ggacttgtacctactgttggtaact

SEQ ID NO: 594555 - DNA, 25 bp, Mus musculus
ggacttgtaccttctgttggtaact

SEQ ID NO: 594556 - DNA, 25 bp, Mus musculus
ggacttgtacttcacgctgtttaga

SEQ ID NO: 594557 - DNA, 25 bp, Mus musculus
ggacttgtacttgacgctgtttaga

SEQ ID NO: 594558 - DNA, 25 bp, Mus musculus
ggacttgtagctaagccattccatc

SEQ ID NO: 594559 - DNA, 25 bp, Mus musculus
ggacttgtagcttagccattccatc

SEQ ID NO: 594560 - DNA, 25 bp, Mus musculus
ggacttgtagtaacagtgcctttta

SEQ ID NO: 594561 - DNA, 25 bp, Mus musculus
ggacttgtagtatcagtgcctttta

SEQ ID NO: 594562 - DNA, 25 bp, Mus musculus
ggacttgtatcccagagtcggatgt

SEQ ID NO: 594563 - DNA, 25 bp, Mus musculus
ggacttgtatccgagagtcggatgt

SEQ ID NO: 594564 - DNA, 25 bp, Mus musculus
ggacttgtatgtcgtgccttatcac

SEQ ID NO: 594565 - DNA, 25 bp, Mus musculus
ggacttgtatgtggtgccttatcac

SEQ ID NO: 594566 - DNA, 25 bp, Mus musculus
ggacttgtcacgctggtttgtgact

SEQ ID NO: 594567 - DNA, 25 bp, Mus musculus
ggacttgtcacggtggtttgtgact

SEQ ID NO: 594568 - DNA, 25 bp, Mus musculus
ggacttgtcagaaatgttgcccatg

SEQ ID NO: 594569 - DNA, 25 bp, Mus musculus
ggacttgtcagatatgttgcccatg

SEQ ID NO: 594570 - DNA, 25 bp, Mus musculus
ggacttgtcataccatgcatcgtac

SEQ ID NO: 594571 - DNA, 25 bp, Mus musculus
ggacttgtcatagcatgcatcgtac

SEQ ID NO: 594572 - DNA, 25 bp, Mus musculus
ggacttgtgaaaaaaccaggcctgc

SEQ ID NO: 594573 - DNA, 25 bp, Mus musculus
ggacttgtgaaataaccaggcctgc

SEQ ID NO: 594574 - DNA, 25 bp, Mus musculus
ggacttgtgaggatagcccggccat

SEQ ID NO: 594575 - DNA, 25 bp, Mus musculus
ggacttgtgaggttagcccggccat

SEQ ID NO: 594576 - DNA, 25 bp, Mus musculus
ggacttgtgctaatgctacctgaga

SEQ ID NO: 594577 - DNA, 25 bp, Mus musculus
ggacttgtgctattgctacctgaga

SEQ ID NO: 594578 - DNA, 25 bp, Mus musculus
ggacttgtgctcactgcttagacag

SEQ ID NO: 594579 - DNA, 25 bp, Mus musculus
ggacttgtgctctctgcttagacag

SEQ ID NO: 594580 - DNA, 25 bp, Mus musculus
ggacttgtggacacttcaaagacat

SEQ ID NO: 594581 - DNA, 25 bp, Mus musculus
ggacttgtggactcttcaaagacat

SEQ ID NO: 594582 - DNA, 25 bp, Mus musculus
ggacttgtgtatctgtcttttcggt

SEQ ID NO: 594583 - DNA, 25 bp, Mus musculus
ggacttgtgtatgtgtcttttcggt

SEQ ID NO: 594584 - DNA, 25 bp, Mus musculus
ggacttgtgtctatgatttctctta

SEQ ID NO: 594585 - DNA, 25 bp, Mus musculus
ggacttgtgtctttgatttctctta

SEQ ID NO: 594586 - DNA, 25 bp, Mus musculus
ggacttgtgtgcaacaggctgtatt

SEQ ID NO: 594587 - DNA, 25 bp, Mus musculus
ggacttgtgtgcctgcattcacaca

SEQ ID NO: 594588 - DNA, 25 bp, Mus musculus
ggacttgtgtgcgtgcattcacaca

SEQ ID NO: 594589 - DNA, 25 bp, Mus musculus
ggacttgtgtgctacaggctgtatt

SEQ ID NO: 594590 - DNA, 25 bp, Mus musculus
ggacttgtgtggcttatacttctgt

SEQ ID NO: 594591 - DNA, 25 bp, Mus musculus
ggacttgtgtgggttatacttctgt

SEQ ID NO: 594592 - DNA, 25 bp, Mus musculus
ggacttgttaatcgtggcatccttg

SEQ ID NO: 594593 - DNA, 25 bp, Mus musculus
ggacttgttaatggtggcatccttg

SEQ ID NO: 594594 - DNA, 25 bp, Mus musculus
ggacttgttagaaatgctgattctt

SEQ ID NO: 594595 - DNA, 25 bp, Mus musculus
ggacttgttagatatgctgattctt

SEQ ID NO: 594596 - DNA, 25 bp, Mus musculus
ggacttgttgccctgcctgactctg

SEQ ID NO: 594597 - DNA, 25 bp, Mus musculus
ggacttgttgccgtgcctgactctg

SEQ ID NO: 594598 - DNA, 25 bp, Mus musculus
ggacttgttggaccagatcctaatg

SEQ ID NO: 594599 - DNA, 25 bp, Mus musculus
ggacttgttggacctgctggaccat

SEQ ID NO: 594600 - DNA, 25 bp, Mus musculus
ggacttgttggagcagatcctaatg

SEQ ID NO: 594601 - DNA, 25 bp, Mus musculus
ggacttgttggagctgctggaccat

SEQ ID NO: 594602 - DNA, 25 bp, Mus musculus
ggacttgttggcatcttgcctaggc

SEQ ID NO: 594603 - DNA, 25 bp, Mus musculus
ggacttgttggcttcttgcctaggc

SEQ ID NO: 594604 - DNA, 25 bp, Mus musculus
ggacttgtttccacgtaacagtgca

SEQ ID NO: 594605 - DNA, 25 bp, Mus musculus
ggacttgtttcctcgtaacagtgca

SEQ ID NO: 594606 - DNA, 25 bp, Mus musculus
ggacttgtttctagcgcccaggaga

SEQ ID NO: 594607 - DNA, 25 bp, Mus musculus
ggacttgtttcttgcgcccaggaga

SEQ ID NO: 594608 - DNA, 25 bp, Mus musculus
ggacttgttttcagaggcccaggac

SEQ ID NO: 594609 - DNA, 25 bp, Mus musculus
ggacttgttttctgaggcccaggac

SEQ ID NO: 594610 - DNA, 25 bp, Mus musculus
ggactttaaagaaacctcttgggag

SEQ ID NO: 594611 - DNA, 25 bp, Mus musculus
ggactttaaagatacctcttgggag

SEQ ID NO: 594612 - DNA, 25 bp, Mus musculus
ggactttaacggcaatccccattct

SEQ ID NO: 594613 - DNA, 25 bp, Mus musculus
ggactttaacgggaatccccattct

SEQ ID NO: 594614 - DNA, 25 bp, Mus musculus
ggactttaactacgcttacatactg

SEQ ID NO: 594615 - DNA, 25 bp, Mus musculus
ggactttaactaggcttacatactg

SEQ ID NO: 594616 - DNA, 25 bp, Mus musculus
ggactttaactcctatcagatggat

SEQ ID NO: 594617 - DNA, 25 bp, Mus musculus
ggactttaactcgtatcagatggat

SEQ ID NO: 594618 - DNA, 25 bp, Mus musculus
ggactttaatctaggctccttatga

SEQ ID NO: 594619 - DNA, 25 bp, Mus musculus
ggactttaatcttggctccttatga

SEQ ID NO: 594620 - DNA, 25 bp, Mus musculus
ggactttacagacactttttgaaat

SEQ ID NO: 594621 - DNA, 25 bp, Mus musculus
ggactttacagagactttttgaaat

SEQ ID NO: 594622 - DNA, 25 bp, Mus musculus
ggactttacagcatgcactttacca

SEQ ID NO: 594623 - DNA, 25 bp, Mus musculus
ggactttacagcctacgaaccatac

SEQ ID NO: 594624 - DNA, 25 bp, Mus musculus
ggactttacagcgtacgaaccatac

SEQ ID NO: 594625 - DNA, 25 bp, Mus musculus
ggactttacagcttgcactttacca

SEQ ID NO: 594626 - DNA, 25 bp, Mus musculus
ggactttactgacaagcccacttcc

SEQ ID NO: 594627 - DNA, 25 bp, Mus musculus
ggactttactgagaagcccacttcc

SEQ ID NO: 594628 - DNA, 25 bp, Mus musculus
ggactttagaacatggctcacccct

SEQ ID NO: 594629 - DNA, 25 bp, Mus musculus
ggactttagaacttggctcacccct

SEQ ID NO: 594630 - DNA, 25 bp, Mus musculus
ggactttagcccaatatatttatta

SEQ ID NO: 594631 - DNA, 25 bp, Mus musculus
ggactttagccctatatatttatta

SEQ ID NO: 594632 - DNA, 25 bp, Mus musculus
ggactttaggtcagcaaatcatgaa

SEQ ID NO: 594633 - DNA, 25 bp, Mus musculus
ggactttaggtctgcaaatcatgaa

SEQ ID NO: 594634 - DNA, 25 bp, Mus musculus
ggactttagttccttgttcatggct

SEQ ID NO: 594635 - DNA, 25 bp, Mus musculus
ggactttagttcgttgttcatggct

SEQ ID NO: 594636 - DNA, 25 bp, Mus musculus
ggactttataacaccctgtggactg

SEQ ID NO: 594637 - DNA, 25 bp, Mus musculus
ggactttataactccctgtggactg

SEQ ID NO: 594638 - DNA, 25 bp, Mus musculus
ggactttcaaagaaattctacattt

SEQ ID NO: 594639 - DNA, 25 bp, Mus musculus
ggactttcaaagtaattctacattt

SEQ ID NO: 594640 - DNA, 25 bp, Mus musculus
ggactttcaaatccaggtgatcaac

SEQ ID NO: 594641 - DNA, 25 bp, Mus musculus
ggactttcaaatgcaggtgatcaac

SEQ ID NO: 594642 - DNA, 25 bp, Mus musculus
ggactttcacagaacctgtgtgtct

SEQ ID NO: 594643 - DNA, 25 bp, Mus musculus
ggactttcacagtacctgtgtgtct

SEQ ID NO: 594644 - DNA, 25 bp, Mus musculus
ggactttcagaacagagattgtcaa

SEQ ID NO: 594645 - DNA, 25 bp, Mus musculus
ggactttcagaagagagattgtcaa

SEQ ID NO: 594646 - DNA, 25 bp, Mus musculus
ggactttcagagaagttctcagagc

SEQ ID NO: 594647 - DNA, 25 bp, Mus musculus
ggactttcagagtagttctcagagc

SEQ ID NO: 594648 - DNA, 25 bp, Mus musculus
ggactttcagcacggcgcttaccaa

SEQ ID NO: 594649 - DNA, 25 bp, Mus musculus
ggactttcagcagggcgcttaccaa

SEQ ID NO: 594650 - DNA, 25 bp, Mus musculus
ggactttcatggaaacaaacctgac

SEQ ID NO: 594651 - DNA, 25 bp, Mus musculus
ggactttcatggtaacaaacctgac

SEQ ID NO: 594652 - DNA, 25 bp, Mus musculus
ggactttcatttcaagtaacaatta

SEQ ID NO: 594653 - DNA, 25 bp, Mus musculus
ggactttcatttgaagtaacaatta

SEQ ID NO: 594654 - DNA, 25 bp, Mus musculus
ggactttccaagaatcagcgtgctt

SEQ ID NO: 594655 - DNA, 25 bp, Mus musculus
ggactttccaagtatcagcgtgctt

SEQ ID NO: 594656 - DNA, 25 bp, Mus musculus
ggactttcccatcgacactgtgcat

SEQ ID NO: 594657 - DNA, 25 bp, Mus musculus
ggactttcccatggacactgtgcat

SEQ ID NO: 594658 - DNA, 25 bp, Mus musculus
ggactttcctaacgtttcacataca

SEQ ID NO: 594659 - DNA, 25 bp, Mus musculus
ggactttcctaaggtttcacataca

SEQ ID NO: 594660 - DNA, 25 bp, Mus musculus
ggactttcctgaagggctgcccatt

SEQ ID NO: 594661 - DNA, 25 bp, Mus musculus
ggactttcctgatgggctgcccatt

SEQ ID NO: 594662 - DNA, 25 bp, Mus musculus
ggactttcctgcaattcttgtgtaa

SEQ ID NO: 594663 - DNA, 25 bp, Mus musculus
ggactttcctgctattcttgtgtaa

SEQ ID NO: 594664 - DNA, 25 bp, Mus musculus
ggactttctaagaaaccagcgaagt

SEQ ID NO: 594665 - DNA, 25 bp, Mus musculus
ggactttctaagtaaccagcgaagt

SEQ ID NO: 594666 - DNA, 25 bp, Mus musculus
ggactttctcagatattccatgcct

SEQ ID NO: 594667 - DNA, 25 bp, Mus musculus
ggactttctcagttattccatgcct

SEQ ID NO: 594668 - DNA, 25 bp, Mus musculus
ggactttctcctcgcatagagacga

SEQ ID NO: 594669 - DNA, 25 bp, Mus musculus
ggactttctcctggcatagagacga

SEQ ID NO: 594670 - DNA, 25 bp, Mus musculus
ggactttctgatcgacttgcattca

SEQ ID NO: 594671 - DNA, 25 bp, Mus musculus
ggactttctgatggacttgcattca

SEQ ID NO: 594672 - DNA, 25 bp, Mus musculus
ggactttctggaagaactgggtcat

SEQ ID NO: 594673 - DNA, 25 bp, Mus musculus
ggactttctggatgaactgggtcat

SEQ ID NO: 594674 - DNA, 25 bp, Mus musculus
ggactttcttccaggcctattacta

SEQ ID NO: 594675 - DNA, 25 bp, Mus musculus
ggactttcttcctggcctattacta

SEQ ID NO: 594676 - DNA, 25 bp, Mus musculus
ggactttctttaatcttgtacacaa

SEQ ID NO: 594677 - DNA, 25 bp, Mus musculus
ggactttctttacatgtcgtatccg

SEQ ID NO: 594678 - DNA, 25 bp, Mus musculus
ggactttctttagatgtcgtatccg

SEQ ID NO: 594679 - DNA, 25 bp, Mus musculus
ggactttctttattcttgtacacaa

SEQ ID NO: 594680 - DNA, 25 bp, Mus musculus
ggactttgaaaacctggctgtacat

SEQ ID NO: 594681 - DNA, 25 bp, Mus musculus
ggactttgaaaagctggctgtacat

SEQ ID NO: 594682 - DNA, 25 bp, Mus musculus
ggactttgaaacatctagttcaaca

SEQ ID NO: 594683 - DNA, 25 bp, Mus musculus
ggactttgaaacttctagttcaaca

SEQ ID NO: 594684 - DNA, 25 bp, Mus musculus
ggactttgaaagatgttgatccttt

SEQ ID NO: 594685 - DNA, 25 bp, Mus musculus
ggactttgaaagttgttgatccttt

SEQ ID NO: 594686 - DNA, 25 bp, Mus musculus
ggactttgaaccataccgccaccag

SEQ ID NO: 594687 - DNA, 25 bp, Mus musculus
ggactttgaaccttaccgccaccag

SEQ ID NO: 594688 - DNA, 25 bp, Mus musculus
ggactttgaactagggactcctcct

SEQ ID NO: 594689 - DNA, 25 bp, Mus musculus
ggactttgaacttgggactcctcct

SEQ ID NO: 594690 - DNA, 25 bp, Mus musculus
ggactttgagctattgtgccttgat

SEQ ID NO: 594691 - DNA, 25 bp, Mus musculus
ggactttgagcttttgtgccttgat

SEQ ID NO: 594692 - DNA, 25 bp, Mus musculus
ggactttgagtcagctgaagaccta

SEQ ID NO: 594693 - DNA, 25 bp, Mus musculus
ggactttgagtcattctggctaatt

SEQ ID NO: 594694 - DNA, 25 bp, Mus musculus
ggactttgagtctgctgaagaccta

SEQ ID NO: 594695 - DNA, 25 bp, Mus musculus
ggactttgagtctttctggctaatt

SEQ ID NO: 594696 - DNA, 25 bp, Mus musculus
ggactttgatcgacagcaacttgcc

SEQ ID NO: 594697 - DNA, 25 bp, Mus musculus
ggactttgatcgtcagcaacttgcc

SEQ ID NO: 594698 - DNA, 25 bp, Mus musculus
ggactttgatctccaatcattcccc

SEQ ID NO: 594699 - DNA, 25 bp, Mus musculus
ggactttgatctgcaatcattcccc

SEQ ID NO: 594700 - DNA, 25 bp, Mus musculus
ggactttgcagtcagttgaagccaa

SEQ ID NO: 594701 - DNA, 25 bp, Mus musculus
ggactttgcagtgagttgaagccaa

SEQ ID NO: 594702 - DNA, 25 bp, Mus musculus
ggactttgcattaatatgagcacat

SEQ ID NO: 594703 - DNA, 25 bp, Mus musculus
ggactttgcatttatatgagcacat

SEQ ID NO: 594704 - DNA, 25 bp, Mus musculus
ggactttgctaaatcctgtggagaa

SEQ ID NO: 594705 - DNA, 25 bp, Mus musculus
ggactttgctaattcctgtggagaa

SEQ ID NO: 594706 - DNA, 25 bp, Mus musculus
ggactttggcaacacagctgtctgt

SEQ ID NO: 594707 - DNA, 25 bp, Mus musculus
ggactttggcaagacagctgtctgt

SEQ ID NO: 594708 - DNA, 25 bp, Mus musculus
ggactttggcagactctctaacctt

SEQ ID NO: 594709 - DNA, 25 bp, Mus musculus
ggactttggcagtctctctaacctt

SEQ ID NO: 594710 - DNA, 25 bp, Mus musculus
ggactttggccaagatctcatcaga

SEQ ID NO: 594711 - DNA, 25 bp, Mus musculus
ggactttggccatgatctcatcaga

SEQ ID NO: 594712 - DNA, 25 bp, Mus musculus
ggactttggctcacataagaatcta

SEQ ID NO: 594713 - DNA, 25 bp, Mus musculus
ggactttggctctcataagaatcta

SEQ ID NO: 594714 - DNA, 25 bp, Mus musculus
ggactttgggacatttcatctgttg

SEQ ID NO: 594715 - DNA, 25 bp, Mus musculus
ggactttgggacttttcatctgttg

SEQ ID NO: 594716 - DNA, 25 bp, Mus musculus
ggactttggtccaggctacagtgac

SEQ ID NO: 594717 - DNA, 25 bp, Mus musculus
ggactttggtcctggctacagtgac

SEQ ID NO: 594718 - DNA, 25 bp, Mus musculus
ggactttggtgcagatgcagacttt

SEQ ID NO: 594719 - DNA, 25 bp, Mus musculus
ggactttggtgctgatgcagacttt

SEQ ID NO: 594720 - DNA, 25 bp, Mus musculus
ggactttggtttcttcataccctgc

SEQ ID NO: 594721 - DNA, 25 bp, Mus musculus
ggactttggtttgttcataccctgc

SEQ ID NO: 594722 - DNA, 25 bp, Mus musculus
ggactttgtaatccacttcatggag

SEQ ID NO: 594723 - DNA, 25 bp, Mus musculus
ggactttgtaatgcacttcatggag

SEQ ID NO: 594724 - DNA, 25 bp, Mus musculus
ggactttgtctaatctgctaatctt

SEQ ID NO: 594725 - DNA, 25 bp, Mus musculus
ggactttgtctattctgctaatctt

SEQ ID NO: 594726 - DNA, 25 bp, Mus musculus
ggactttgttacacgtgattgtcta

SEQ ID NO: 594727 - DNA, 25 bp, Mus musculus
ggactttgttactcgtgattgtcta

SEQ ID NO: 594728 - DNA, 25 bp, Mus musculus
ggacttttactgaagaagccctatt

SEQ ID NO: 594729 - DNA, 25 bp, Mus musculus
ggacttttactgtagaagccctatt

SEQ ID NO: 594730 - DNA, 25 bp, Mus musculus
ggacttttagccctgtctactttgg

SEQ ID NO: 594731 - DNA, 25 bp, Mus musculus
ggacttttagccgtgtctactttgg

SEQ ID NO: 594732 - DNA, 25 bp, Mus musculus
ggacttttcactccagaacctttca

SEQ ID NO: 594733 - DNA, 25 bp, Mus musculus
ggacttttcactgcagaacctttca

SEQ ID NO: 594734 - DNA, 25 bp, Mus musculus
ggacttttctacctaggaaatcact

SEQ ID NO: 594735 - DNA, 25 bp, Mus musculus
ggacttttctacgtaggaaatcact

SEQ ID NO: 594736 - DNA, 25 bp, Mus musculus
ggacttttctgcaatatctttgcca

SEQ ID NO: 594737 - DNA, 25 bp, Mus musculus
ggacttttctgctatatctttgcca

SEQ ID NO: 594738 - DNA, 25 bp, Mus musculus
ggacttttgaggatggacctcgtgt

SEQ ID NO: 594739 - DNA, 25 bp, Mus musculus
ggacttttgaggttggacctcgtgt

SEQ ID NO: 594740 - DNA, 25 bp, Mus musculus
ggacttttggtgctccagctgcctt

SEQ ID NO: 594741 - DNA, 25 bp, Mus musculus
ggacttttggtggtccagctgcctt

SEQ ID NO: 594742 - DNA, 25 bp, Mus musculus
ggacttttgtcaagtttgccccaat

SEQ ID NO: 594743 - DNA, 25 bp, Mus musculus
ggacttttgtcatgtttgccccaat

SEQ ID NO: 594744 - DNA, 25 bp, Mus musculus
ggacttttgtcccttaagtgtgaga

SEQ ID NO: 594745 - DNA, 25 bp, Mus musculus
ggacttttgtccgttaagtgtgaga

SEQ ID NO: 594746 - DNA, 25 bp, Mus musculus
ggacttttgtgcctttgatatcagc

SEQ ID NO: 594747 - DNA, 25 bp, Mus musculus
ggacttttgtgcgtttgatatcagc

SEQ ID NO: 594748 - DNA, 25 bp, Mus musculus
ggactttttaacagatcaacatgga

SEQ ID NO: 594749 - DNA, 25 bp, Mus musculus
ggactttttaactgatcaacatgga

SEQ ID NO: 594750 - DNA, 25 bp, Mus musculus
ggactttttactatgaattttcagg

SEQ ID NO: 594751 - DNA, 25 bp, Mus musculus
ggactttttactttgaattttcagg

SEQ ID NO: 594752 - DNA, 25 bp, Mus musculus
ggactttttagaattgcattgccac

SEQ ID NO: 594753 - DNA, 25 bp, Mus musculus
ggactttttagatttgcattgccac

SEQ ID NO: 594754 - DNA, 25 bp, Mus musculus
ggactttttctaaggccagctgtaa

SEQ ID NO: 594755 - DNA, 25 bp, Mus musculus
ggactttttctatggccagctgtaa

SEQ ID NO: 594756 - DNA, 25 bp, Mus musculus
ggacttttttccaattggacagatc

SEQ ID NO: 594757 - DNA, 25 bp, Mus musculus
ggacttttttcctattggacagatc

SEQ ID NO: 594758 - DNA, 25 bp, Mus musculus
ggacttttttgacctttattgtggt

SEQ ID NO: 594759 - DNA, 25 bp, Mus musculus
ggacttttttgagctttattgtggt

SEQ ID NO: 594760 - DNA, 25 bp, Mus musculus
ggagaaaaccaaagtggactctgtg

SEQ ID NO: 594761 - DNA, 25 bp, Mus musculus
ggagaaaaccaatgtggactctgtg

SEQ ID NO: 594762 - DNA, 25 bp, Mus musculus
ggagaaaaccacctttacgataatg

SEQ ID NO: 594763 - DNA, 25 bp, Mus musculus
ggagaaaaccacgtttacgataatg

SEQ ID NO: 594764 - DNA, 25 bp, Mus musculus
ggagaaaacccaaatgccttcgagt

SEQ ID NO: 594765 - DNA, 25 bp, Mus musculus
ggagaaaacccatatgccttcgagt

SEQ ID NO: 594766 - DNA, 25 bp, Mus musculus
ggagaaaacgcccttccttcttgag

SEQ ID NO: 594767 - DNA, 25 bp, Mus musculus
ggagaaaacgccgttccttcttgag

SEQ ID NO: 594768 - DNA, 25 bp, Mus musculus
ggagaaaactcccttaccttagctg

SEQ ID NO: 594769 - DNA, 25 bp, Mus musculus
ggagaaaactccgttaccttagctg

SEQ ID NO: 594770 - DNA, 25 bp, Mus musculus
ggagaaaagatcctatcccttcgca

SEQ ID NO: 594771 - DNA, 25 bp, Mus musculus
ggagaaaagatcgtatcccttcgca

SEQ ID NO: 594772 - DNA, 25 bp, Mus musculus
ggagaaaagcctctcccagtggatc

SEQ ID NO: 594773 - DNA, 25 bp, Mus musculus
ggagaaaagcctgtcccagtggatc

SEQ ID NO: 594774 - DNA, 25 bp, Mus musculus
ggagaaaatgcccacataggagctg

SEQ ID NO: 594775 - DNA, 25 bp, Mus musculus
ggagaaaatgccgacataggagctg

SEQ ID NO: 594776 - DNA, 25 bp, Mus musculus
ggagaaaattaaagcttgcttcgcc

SEQ ID NO: 594777 - DNA, 25 bp, Mus musculus
ggagaaaattaatgcttgcttcgcc

SEQ ID NO: 594778 - DNA, 25 bp, Mus musculus
ggagaaacaacaaccccatgtggcc

SEQ ID NO: 594779 - DNA, 25 bp, Mus musculus
ggagaaacaacatccccatgtggcc

SEQ ID NO: 594780 - DNA, 25 bp, Mus musculus
ggagaaacaaccatggcttgagaga

SEQ ID NO: 594781 - DNA, 25 bp, Mus musculus
ggagaaacaaccttggcttgagaga

SEQ ID NO: 594782 - DNA, 25 bp, Mus musculus
ggagaaacacacatcgccgggcgag

SEQ ID NO: 594783 - DNA, 25 bp, Mus musculus
ggagaaacacacttcgccgggcgag

SEQ ID NO: 594784 - DNA, 25 bp, Mus musculus
ggagaaacaccccagaacattcaga

SEQ ID NO: 594785 - DNA, 25 bp, Mus musculus
ggagaaacacccgagaacattcaga

SEQ ID NO: 594786 - DNA, 25 bp, Mus musculus
ggagaaacactaagggccatttgaa

SEQ ID NO: 594787 - DNA, 25 bp, Mus musculus
ggagaaacactatgggccatttgaa

SEQ ID NO: 594788 - DNA, 25 bp, Mus musculus
ggagaaacactcagccgagggcaac

SEQ ID NO: 594789 - DNA, 25 bp, Mus musculus
ggagaaacactctgccgagggcaac

SEQ ID NO: 594790 - DNA, 25 bp, Mus musculus
ggagaaacagctagcgtaccggttc

SEQ ID NO: 594791 - DNA, 25 bp, Mus musculus
ggagaaacagcttgcgtaccggttc

SEQ ID NO: 594792 - DNA, 25 bp, Mus musculus
ggagaaacaggccacgaacttgaaa

SEQ ID NO: 594793 - DNA, 25 bp, Mus musculus
ggagaaacaggcgacgaacttgaaa

SEQ ID NO: 594794 - DNA, 25 bp, Mus musculus
ggagaaacatctaccgaggctccaa

SEQ ID NO: 594795 - DNA, 25 bp, Mus musculus
ggagaaacatcttccgaggctccaa

SEQ ID NO: 594796 - DNA, 25 bp, Mus musculus
ggagaaacatttcatggattccaaa

SEQ ID NO: 594797 - DNA, 25 bp, Mus musculus
ggagaaacatttgatggattccaaa

SEQ ID NO: 594798 - DNA, 25 bp, Mus musculus
ggagaaaccaaaccgacctgaaaca

SEQ ID NO: 594799 - DNA, 25 bp, Mus musculus
ggagaaaccaaagcgacctgaaaca

SEQ ID NO: 594800 - DNA, 25 bp, Mus musculus
ggagaaaccactacctgggcagtag

SEQ ID NO: 594801 - DNA, 25 bp, Mus musculus
ggagaaaccacttcctgggcagtag

SEQ ID NO: 594802 - DNA, 25 bp, Mus musculus
ggagaaaccagaatagatactatag

SEQ ID NO: 594803 - DNA, 25 bp, Mus musculus
ggagaaaccagaccccgcgcagaag

SEQ ID NO: 594804 - DNA, 25 bp, Mus musculus
ggagaaaccagagcccgcgcagaag

SEQ ID NO: 594805 - DNA, 25 bp, Mus musculus
ggagaaaccagattagatactatag

SEQ ID NO: 594806 - DNA, 25 bp, Mus musculus
ggagaaaccattaccctagtgcaaa

SEQ ID NO: 594807 - DNA, 25 bp, Mus musculus
ggagaaaccatttccctagtgcaaa

SEQ ID NO: 594808 - DNA, 25 bp, Mus musculus
ggagaaacccaaaatctttaacaag

SEQ ID NO: 594809 - DNA, 25 bp, Mus musculus
ggagaaacccaatatctttaacaag

SEQ ID NO: 594810 - DNA, 25 bp, Mus musculus
ggagaaacccaccaaagctatgtca

SEQ ID NO: 594811 - DNA, 25 bp, Mus musculus
ggagaaacccacgaaagctatgtca

SEQ ID NO: 594812 - DNA, 25 bp, Mus musculus
ggagaaacccatcctggacaggcca

SEQ ID NO: 594813 - DNA, 25 bp, Mus musculus
ggagaaacccatgctggacaggcca

SEQ ID NO: 594814 - DNA, 25 bp, Mus musculus
ggagaaacctagctagccaagtctt

SEQ ID NO: 594815 - DNA, 25 bp, Mus musculus
ggagaaacctaggtagccaagtctt

SEQ ID NO: 594816 - DNA, 25 bp, Mus musculus
ggagaaacctatatgctgccctaag

SEQ ID NO: 594817 - DNA, 25 bp, Mus musculus
ggagaaacctatttgctgccctaag

SEQ ID NO: 594818 - DNA, 25 bp, Mus musculus
ggagaaacctctagtactacttcct

SEQ ID NO: 594819 - DNA, 25 bp, Mus musculus
ggagaaacctcttgtactacttcct

SEQ ID NO: 594820 - DNA, 25 bp, Mus musculus
ggagaaacctgacctacgggagcca

SEQ ID NO: 594821 - DNA, 25 bp, Mus musculus
ggagaaacctgagctacgggagcca

SEQ ID NO: 594822 - DNA, 25 bp, Mus musculus
ggagaaacctttccggtgcacagaa

SEQ ID NO: 594823 - DNA, 25 bp, Mus musculus
ggagaaacctttgcggtgcacagaa

SEQ ID NO: 594824 - DNA, 25 bp, Mus musculus
ggagaaacggcaacactataagcta

SEQ ID NO: 594825 - DNA, 25 bp, Mus musculus
ggagaaacggcatcactataagcta

SEQ ID NO: 594826 - DNA, 25 bp, Mus musculus
ggagaaactcaactcccaatggaac

SEQ ID NO: 594827 - DNA, 25 bp, Mus musculus
ggagaaactcaagtcccaatggaac

SEQ ID NO: 594828 - DNA, 25 bp, Mus musculus
ggagaaactccacgctacggaagat

SEQ ID NO: 594829 - DNA, 25 bp, Mus musculus
ggagaaactccaggctacggaagat

SEQ ID NO: 594830 - DNA, 25 bp, Mus musculus
ggagaaactcgccaaactgcaggca

SEQ ID NO: 594831 - DNA, 25 bp, Mus musculus
ggagaaactcgcgaaactgcaggca

SEQ ID NO: 594832 - DNA, 25 bp, Mus musculus
ggagaaactctgacttttgcacttt

SEQ ID NO: 594833 - DNA, 25 bp, Mus musculus
ggagaaactctgtcttttgcacttt

SEQ ID NO: 594834 - DNA, 25 bp, Mus musculus
ggagaaactcttccctcatgaggag

SEQ ID NO: 594835 - DNA, 25 bp, Mus musculus
ggagaaactcttcgatccatcttaa

SEQ ID NO: 594836 - DNA, 25 bp, Mus musculus
ggagaaactcttgcctcatgaggag

SEQ ID NO: 594837 - DNA, 25 bp, Mus musculus
ggagaaactcttggatccatcttaa

SEQ ID NO: 594838 - DNA, 25 bp, Mus musculus
ggagaaactgcaatccaggccagaa

SEQ ID NO: 594839 - DNA, 25 bp, Mus musculus
ggagaaactgcattccaggccagaa

SEQ ID NO: 594840 - DNA, 25 bp, Mus musculus
ggagaaactgcccagctgctgaaac

SEQ ID NO: 594841 - DNA, 25 bp, Mus musculus
ggagaaactgccgagctgctgaaac

SEQ ID NO: 594842 - DNA, 25 bp, Mus musculus
ggagaaactgcgatagcccacagac

SEQ ID NO: 594843 - DNA, 25 bp, Mus musculus
ggagaaactgcgttagcccacagac

SEQ ID NO: 594844 - DNA, 25 bp, Mus musculus
ggagaaacttctaatacctcatgga

SEQ ID NO: 594845 - DNA, 25 bp, Mus musculus
ggagaaacttcttatacctcatgga

SEQ ID NO: 594846 - DNA, 25 bp, Mus musculus
ggagaaagagacctactattgacct

SEQ ID NO: 594847 - DNA, 25 bp, Mus musculus
ggagaaagagacgtactattgacct

SEQ ID NO: 594848 - DNA, 25 bp, Mus musculus
ggagaaagatccactcctattattg

SEQ ID NO: 594849 - DNA, 25 bp, Mus musculus
ggagaaagatcctctcctattattg

SEQ ID NO: 594850 - DNA, 25 bp, Mus musculus
ggagaaagatgactcccccttatca

SEQ ID NO: 594851 - DNA, 25 bp, Mus musculus
ggagaaagatgagtcccccttatca

SEQ ID NO: 594852 - DNA, 25 bp, Mus musculus
ggagaaagcaatcaactgtctgttt

SEQ ID NO: 594853 - DNA, 25 bp, Mus musculus
ggagaaagcaatgaactgtctgttt

SEQ ID NO: 594854 - DNA, 25 bp, Mus musculus
ggagaaagcacgcacatcccaggtg

SEQ ID NO: 594855 - DNA, 25 bp, Mus musculus
ggagaaagcacggacatcccaggtg

SEQ ID NO: 594856 - DNA, 25 bp, Mus musculus
ggagaaagccccaacaagttagcat

SEQ ID NO: 594857 - DNA, 25 bp, Mus musculus
ggagaaagcccctacaagttagcat

SEQ ID NO: 594858 - DNA, 25 bp, Mus musculus
ggagaaagccctcggacttgtttgt

SEQ ID NO: 594859 - DNA, 25 bp, Mus musculus
ggagaaagccctgggacttgtttgt

SEQ ID NO: 594860 - DNA, 25 bp, Mus musculus
ggagaaagctgacctaccagttcag

SEQ ID NO: 594861 - DNA, 25 bp, Mus musculus
ggagaaagctgagctaccagttcag

SEQ ID NO: 594862 - DNA, 25 bp, Mus musculus
ggagaaagctgcacaacctttatca

SEQ ID NO: 594863 - DNA, 25 bp, Mus musculus
ggagaaagctgcctggaatccaaga

SEQ ID NO: 594864 - DNA, 25 bp, Mus musculus
ggagaaagctgcgtggaatccaaga

SEQ ID NO: 594865 - DNA, 25 bp, Mus musculus
ggagaaagctgctcaacctttatca

SEQ ID NO: 594866 - DNA, 25 bp, Mus musculus
ggagaaaggcacagagttcttcctc

SEQ ID NO: 594867 - DNA, 25 bp, Mus musculus
ggagaaaggcactgagttcttcctc

SEQ ID NO: 594868 - DNA, 25 bp, Mus musculus
ggagaaaggcatcgcaccccaggaa

SEQ ID NO: 594869 - DNA, 25 bp, Mus musculus
ggagaaaggcatggcaccccaggaa

SEQ ID NO: 594870 - DNA, 25 bp, Mus musculus
ggagaaagtctccagacgttccaga

SEQ ID NO: 594871 - DNA, 25 bp, Mus musculus
ggagaaagtctcgagacgttccaga

SEQ ID NO: 594872 - DNA, 25 bp, Mus musculus
ggagaaagttacacaccttgacccg

SEQ ID NO: 594873 - DNA, 25 bp, Mus musculus
ggagaaagttactcaccttgacccg

SEQ ID NO: 594874 - DNA, 25 bp, Mus musculus
ggagaaataaagaccacaagtccaa

SEQ ID NO: 594875 - DNA, 25 bp, Mus musculus
ggagaaataaagtccacaagtccaa

SEQ ID NO: 594876 - DNA, 25 bp, Mus musculus
ggagaaataaggcacccagcagcta

SEQ ID NO: 594877 - DNA, 25 bp, Mus musculus
ggagaaataagggacccagcagcta

SEQ ID NO: 594878 - DNA, 25 bp, Mus musculus
ggagaaataattccacttggtaaca

SEQ ID NO: 594879 - DNA, 25 bp, Mus musculus
ggagaaataattgcacttggtaaca

SEQ ID NO: 594880 - DNA, 25 bp, Mus musculus
ggagaaatatggaacacctctttac

SEQ ID NO: 594881 - DNA, 25 bp, Mus musculus
ggagaaatatggtacacctctttac

SEQ ID NO: 594882 - DNA, 25 bp, Mus musculus
ggagaaatattcaccggttaagagc

SEQ ID NO: 594883 - DNA, 25 bp, Mus musculus
ggagaaatattctccggttaagagc

SEQ ID NO: 594884 - DNA, 25 bp, Mus musculus
ggagaaatcgctaacctgtgactag

SEQ ID NO: 594885 - DNA, 25 bp, Mus musculus
ggagaaatcgcttacctgtgactag

SEQ ID NO: 594886 - DNA, 25 bp, Mus musculus
ggagaaatctacatgctctgggaac

SEQ ID NO: 594887 - DNA, 25 bp, Mus musculus
ggagaaatctacttgctctgggaac

SEQ ID NO: 594888 - DNA, 25 bp, Mus musculus
ggagaaatctcccacttgtgtttcc

SEQ ID NO: 594889 - DNA, 25 bp, Mus musculus
ggagaaatctccgacttgtgtttcc

SEQ ID NO: 594890 - DNA, 25 bp, Mus musculus
ggagaaatctctcctgtctgatcat

SEQ ID NO: 594891 - DNA, 25 bp, Mus musculus
ggagaaatctctgctgtctgatcat

SEQ ID NO: 594892 - DNA, 25 bp, Mus musculus
ggagaaatctgcacccagcaattgt

SEQ ID NO: 594893 - DNA, 25 bp, Mus musculus
ggagaaatctgctcccagcaattgt

SEQ ID NO: 594894 - DNA, 25 bp, Mus musculus
ggagaaatgcccaccgagtgtccaa

SEQ ID NO: 594895 - DNA, 25 bp, Mus musculus
ggagaaatgccctccgagtgtccaa

SEQ ID NO: 594896 - DNA, 25 bp, Mus musculus
ggagaaatgctcagaacccactacc

SEQ ID NO: 594897 - DNA, 25 bp, Mus musculus
ggagaaatgctctgaacccactacc

SEQ ID NO: 594898 - DNA, 25 bp, Mus musculus
ggagaaatgcttatgccaagaccaa

SEQ ID NO: 594899 - DNA, 25 bp, Mus musculus
ggagaaatgcttttgccaagaccaa

SEQ ID NO: 594900 - DNA, 25 bp, Mus musculus
ggagaaatgggcctgaaccaccgcc

SEQ ID NO: 594901 - DNA, 25 bp, Mus musculus
ggagaaatgggcgtgaaccaccgcc

SEQ ID NO: 594902 - DNA, 25 bp, Mus musculus
ggagaaatgtacactaccactgacg

SEQ ID NO: 594903 - DNA, 25 bp, Mus musculus
ggagaaatgtactctaccactgacg

SEQ ID NO: 594904 - DNA, 25 bp, Mus musculus
ggagaaattagcatcaccactttgg

SEQ ID NO: 594905 - DNA, 25 bp, Mus musculus
ggagaaattagcttcaccactttgg

SEQ ID NO: 594906 - DNA, 25 bp, Mus musculus
ggagaaattcacagaggctacccct

SEQ ID NO: 594907 - DNA, 25 bp, Mus musculus
ggagaaattcactgaggctacccct

SEQ ID NO: 594908 - DNA, 25 bp, Mus musculus
ggagaaattccaacacctcagctaa

SEQ ID NO: 594909 - DNA, 25 bp, Mus musculus
ggagaaattccaacctcattataat

SEQ ID NO: 594910 - DNA, 25 bp, Mus musculus
ggagaaattccatcacctcagctaa

SEQ ID NO: 594911 - DNA, 25 bp, Mus musculus
ggagaaattccatcctcattataat

SEQ ID NO: 594912 - DNA, 25 bp, Mus musculus
ggagaaattccgcagcctgcttttc

SEQ ID NO: 594913 - DNA, 25 bp, Mus musculus
ggagaaattccggagcctgcttttc

SEQ ID NO: 594914 - DNA, 25 bp, Mus musculus
ggagaacaacccattagtcgctata

SEQ ID NO: 594915 - DNA, 25 bp, Mus musculus
ggagaacaaccctttagtcgctata

SEQ ID NO: 594916 - DNA, 25 bp, Mus musculus
ggagaacaactacggcccaccaagc

SEQ ID NO: 594917 - DNA, 25 bp, Mus musculus
ggagaacaactagggcccaccaagc

SEQ ID NO: 594918 - DNA, 25 bp, Mus musculus
ggagaacaagacatcacctttgaaa

SEQ ID NO: 594919 - DNA, 25 bp, Mus musculus
ggagaacaagacttcacctttgaaa

SEQ ID NO: 594920 - DNA, 25 bp, Mus musculus
ggagaacaaggcctagtccagccct

SEQ ID NO: 594921 - DNA, 25 bp, Mus musculus
ggagaacaaggcgtagtccagccct

SEQ ID NO: 594922 - DNA, 25 bp, Mus musculus
ggagaacacaccatgaagggctttt

SEQ ID NO: 594923 - DNA, 25 bp, Mus musculus
ggagaacacaccttgaagggctttt

SEQ ID NO: 594924 - DNA, 25 bp, Mus musculus
ggagaacacactccctgaacagctg

SEQ ID NO: 594925 - DNA, 25 bp, Mus musculus
ggagaacacactgcctgaacagctg

SEQ ID NO: 594926 - DNA, 25 bp, Mus musculus
ggagaacacagtatccaggctactg

SEQ ID NO: 594927 - DNA, 25 bp, Mus musculus
ggagaacacagtcccaccagagcac

SEQ ID NO: 594928 - DNA, 25 bp, Mus musculus
ggagaacacagtccctttaaagata

SEQ ID NO: 594929 - DNA, 25 bp, Mus musculus
ggagaacacagtgccaccagagcac

SEQ ID NO: 594930 - DNA, 25 bp, Mus musculus
ggagaacacagtgcctttaaagata

SEQ ID NO: 594931 - DNA, 25 bp, Mus musculus
ggagaacacagtttccaggctactg

SEQ ID NO: 594932 - DNA, 25 bp, Mus musculus
ggagaacacatcacaggagacagga

SEQ ID NO: 594933 - DNA, 25 bp, Mus musculus
ggagaacacatctcaggagacagga

SEQ ID NO: 594934 - DNA, 25 bp, Mus musculus
ggagaacaccggagagaggctcttc

SEQ ID NO: 594935 - DNA, 25 bp, Mus musculus
ggagaacaccggtgagaggctcttc

SEQ ID NO: 594936 - DNA, 25 bp, Mus musculus
ggagaacaccttaaagtcggataca

SEQ ID NO: 594937 - DNA, 25 bp, Mus musculus
ggagaacacctttaagtcggataca

SEQ ID NO: 594938 - DNA, 25 bp, Mus musculus
ggagaacacttgagttgcgcagatt

SEQ ID NO: 594939 - DNA, 25 bp, Mus musculus
ggagaacacttgcactcaggccagt

SEQ ID NO: 594940 - DNA, 25 bp, Mus musculus
ggagaacacttggactcaggccagt

SEQ ID NO: 594941 - DNA, 25 bp, Mus musculus
ggagaacacttgtgttgcgcagatt

SEQ ID NO: 594942 - DNA, 25 bp, Mus musculus
ggagaacagccacctcggagttcaa

SEQ ID NO: 594943 - DNA, 25 bp, Mus musculus
ggagaacagccagctcggagttcaa

SEQ ID NO: 594944 - DNA, 25 bp, Mus musculus
ggagaacaggccaggattcacagct

SEQ ID NO: 594945 - DNA, 25 bp, Mus musculus
ggagaacaggcctggattcacagct

SEQ ID NO: 594946 - DNA, 25 bp, Mus musculus
ggagaacaggtaccgctttcctcaa

SEQ ID NO: 594947 - DNA, 25 bp, Mus musculus
ggagaacaggtagcgctttcctcaa

SEQ ID NO: 594948 - DNA, 25 bp, Mus musculus
ggagaacagtgtccttcagaccctg

SEQ ID NO: 594949 - DNA, 25 bp, Mus musculus
ggagaacagtgtgcttcagaccctg

SEQ ID NO: 594950 - DNA, 25 bp, Mus musculus
ggagaacagttacacttcacagatg

SEQ ID NO: 594951 - DNA, 25 bp, Mus musculus
ggagaacagttagacttcacagatg

SEQ ID NO: 594952 - DNA, 25 bp, Mus musculus
ggagaacataccaatggcatatcga

SEQ ID NO: 594953 - DNA, 25 bp, Mus musculus
ggagaacatacctatggcatatcga

SEQ ID NO: 594954 - DNA, 25 bp, Mus musculus
ggagaacatagaacacttgcctaca

SEQ ID NO: 594955 - DNA, 25 bp, Mus musculus
ggagaacatagatcacttgcctaca

SEQ ID NO: 594956 - DNA, 25 bp, Mus musculus
ggagaacatagccacaggatatagt

SEQ ID NO: 594957 - DNA, 25 bp, Mus musculus
ggagaacatagcgacaggatatagt

SEQ ID NO: 594958 - DNA, 25 bp, Mus musculus
ggagaacatcccaggttagcttcca

SEQ ID NO: 594959 - DNA, 25 bp, Mus musculus
ggagaacatccctggttagcttcca

SEQ ID NO: 594960 - DNA, 25 bp, Mus musculus
ggagaacatcctcagaacacttgct

SEQ ID NO: 594961 - DNA, 25 bp, Mus musculus
ggagaacatcctgagaacacttgct

SEQ ID NO: 594962 - DNA, 25 bp, Mus musculus
ggagaacatctactggctgacgaac

SEQ ID NO: 594963 - DNA, 25 bp, Mus musculus
ggagaacatctagtggctgacgaac

SEQ ID NO: 594964 - DNA, 25 bp, Mus musculus
ggagaacatgatatgaatctcttta

SEQ ID NO: 594965 - DNA, 25 bp, Mus musculus
ggagaacatgatttgaatctcttta

SEQ ID NO: 594966 - DNA, 25 bp, Mus musculus
ggagaacatgccagggagagaccta

SEQ ID NO: 594967 - DNA, 25 bp, Mus musculus
ggagaacatgcctgggagagaccta

SEQ ID NO: 594968 - DNA, 25 bp, Mus musculus
ggagaacatgttaggtcacagatga

SEQ ID NO: 594969 - DNA, 25 bp, Mus musculus
ggagaacatgtttggtcacagatga

SEQ ID NO: 594970 - DNA, 25 bp, Mus musculus
ggagaacattgaagtcacctccaat

SEQ ID NO: 594971 - DNA, 25 bp, Mus musculus
ggagaacattgacacatcccatggt

SEQ ID NO: 594972 - DNA, 25 bp, Mus musculus
ggagaacattgagacatcccatggt

SEQ ID NO: 594973 - DNA, 25 bp, Mus musculus
ggagaacattgatgtcacctccaat

SEQ ID NO: 594974 - DNA, 25 bp, Mus musculus
ggagaacattttcgaactcctcttc

SEQ ID NO: 594975 - DNA, 25 bp, Mus musculus
ggagaacattttggaactcctcttc

SEQ ID NO: 594976 - DNA, 25 bp, Mus musculus
ggagaaccaaagactcaagagcgtg

SEQ ID NO: 594977 - DNA, 25 bp, Mus musculus
ggagaaccaaagtctcaagagcgtg

SEQ ID NO: 594978 - DNA, 25 bp, Mus musculus
ggagaaccacagatcgcatcagatt

SEQ ID NO: 594979 - DNA, 25 bp, Mus musculus
ggagaaccacagttcgcatcagatt

SEQ ID NO: 594980 - DNA, 25 bp, Mus musculus
ggagaaccactaaaaggaccagttt

SEQ ID NO: 594981 - DNA, 25 bp, Mus musculus
ggagaaccactataaggaccagttt

SEQ ID NO: 594982 - DNA, 25 bp, Mus musculus
ggagaaccacttctgccgacattta

SEQ ID NO: 594983 - DNA, 25 bp, Mus musculus
ggagaaccacttgtgccgacattta

SEQ ID NO: 594984 - DNA, 25 bp, Mus musculus
ggagaaccagttagcaatcatgtga

SEQ ID NO: 594985 - DNA, 25 bp, Mus musculus
ggagaaccagtttgcaatcatgtga

SEQ ID NO: 594986 - DNA, 25 bp, Mus musculus
ggagaaccatgtcctgggctgtttc

SEQ ID NO: 594987 - DNA, 25 bp, Mus musculus
ggagaaccatgtgctgggctgtttc

SEQ ID NO: 594988 - DNA, 25 bp, Mus musculus
ggagaacccaacatcgatagccctt

SEQ ID NO: 594989 - DNA, 25 bp, Mus musculus
ggagaacccaacttcgatagccctt

SEQ ID NO: 594990 - DNA, 25 bp, Mus musculus
ggagaacccactcgaattccaacta

SEQ ID NO: 594991 - DNA, 25 bp, Mus musculus
ggagaacccactggaattccaacta

SEQ ID NO: 594992 - DNA, 25 bp, Mus musculus
ggagaacccagaatctaagcccatc

SEQ ID NO: 594993 - DNA, 25 bp, Mus musculus
ggagaacccagattctaagcccatc

SEQ ID NO: 594994 - DNA, 25 bp, Mus musculus
ggagaacccagcagatccttactga

SEQ ID NO: 594995 - DNA, 25 bp, Mus musculus
ggagaacccagctgatccttactga

SEQ ID NO: 594996 - DNA, 25 bp, Mus musculus
ggagaaccccatagtgtctccccga

SEQ ID NO: 594997 - DNA, 25 bp, Mus musculus
ggagaaccccattgtgtctccccga

SEQ ID NO: 594998 - DNA, 25 bp, Mus musculus
ggagaaccccgactgaaccctgaag

SEQ ID NO: 594999 - DNA, 25 bp, Mus musculus
ggagaaccccgagtgaaccctgaag

SEQ ID NO: 595000 - DNA, 25 bp, Mus musculus
ggagaacccgtaaaccggcaagctt

SEQ ID NO: 595001 - DNA, 25 bp, Mus musculus
ggagaacccgtataccggcaagctt

SEQ ID NO: 595002 - DNA, 25 bp, Mus musculus
ggagaaccctgcctataagaagtat

SEQ ID NO: 595003 - DNA, 25 bp, Mus musculus
ggagaaccctgcgtataagaagtat

SEQ ID NO: 595004 - DNA, 25 bp, Mus musculus
ggagaaccctttcactggagtaaat

SEQ ID NO: 595005 - DNA, 25 bp, Mus musculus
ggagaaccctttgactggagtaaat

SEQ ID NO: 595006 - DNA, 25 bp, Mus musculus
ggagaaccgactaagcaatgagaaa

SEQ ID NO: 595007 - DNA, 25 bp, Mus musculus
ggagaaccgacttagcaatgagaaa

SEQ ID NO: 595008 - DNA, 25 bp, Mus musculus
ggagaacctacaagctctttaatat

SEQ ID NO: 595009 - DNA, 25 bp, Mus musculus
ggagaacctacatgctctttaatat

SEQ ID NO: 595010 - DNA, 25 bp, Mus musculus
ggagaacctagaaccccgcagtgta

SEQ ID NO: 595011 - DNA, 25 bp, Mus musculus
ggagaacctagatccccgcagtgta

SEQ ID NO: 595012 - DNA, 25 bp, Mus musculus
ggagaacctatcctgttttatttgg

SEQ ID NO: 595013 - DNA, 25 bp, Mus musculus
ggagaacctatcgtgttttatttgg

SEQ ID NO: 595014 - DNA, 25 bp, Mus musculus
ggagaacctcacatggagaccaatg

SEQ ID NO: 595015 - DNA, 25 bp, Mus musculus
ggagaacctcacttggagaccaatg

SEQ ID NO: 595016 - DNA, 25 bp, Mus musculus
ggagaacctcccaggatggtaccca

SEQ ID NO: 595017 - DNA, 25 bp, Mus musculus
ggagaacctccctggatggtaccca

SEQ ID NO: 595018 - DNA, 25 bp, Mus musculus
ggagaacctgatcgagctgcacaac

SEQ ID NO: 595019 - DNA, 25 bp, Mus musculus
ggagaacctgatggagctgcacaac

SEQ ID NO: 595020 - DNA, 25 bp, Mus musculus
ggagaacctgctcaccccgcgatgg

SEQ ID NO: 595021 - DNA, 25 bp, Mus musculus
ggagaacctgctgaccccgcgatgg

SEQ ID NO: 595022 - DNA, 25 bp, Mus musculus
ggagaacctggtcttgatggcttcc

SEQ ID NO: 595023 - DNA, 25 bp, Mus musculus
ggagaacctggtgttgatggcttcc

SEQ ID NO: 595024 - DNA, 25 bp, Mus musculus
ggagaacgacaacgccatgctgata

SEQ ID NO: 595025 - DNA, 25 bp, Mus musculus
ggagaacgacaaggccatgctgata

SEQ ID NO: 595026 - DNA, 25 bp, Mus musculus
ggagaacgacccagctccaacatgg

SEQ ID NO: 595027 - DNA, 25 bp, Mus musculus
ggagaacgaccctgctccaacatgg

SEQ ID NO: 595028 - DNA, 25 bp, Mus musculus
ggagaacgaccgaacggctgcagct

SEQ ID NO: 595029 - DNA, 25 bp, Mus musculus
ggagaacgaccgtacggctgcagct

SEQ ID NO: 595030 - DNA, 25 bp, Mus musculus
ggagaacgagccatctgtggccatg

SEQ ID NO: 595031 - DNA, 25 bp, Mus musculus
ggagaacgagccttctgtggccatg

SEQ ID NO: 595032 - DNA, 25 bp, Mus musculus
ggagaacgcaggaagtgcccatcct

SEQ ID NO: 595033 - DNA, 25 bp, Mus musculus
ggagaacgcaggtagtgcccatcct

SEQ ID NO: 595034 - DNA, 25 bp, Mus musculus
ggagaacgccagaacttgtcaccca

SEQ ID NO: 595035 - DNA, 25 bp, Mus musculus
ggagaacgccagtacttgtcaccca

SEQ ID NO: 595036 - DNA, 25 bp, Mus musculus
ggagaacgctcccatctactgcatc

SEQ ID NO: 595037 - DNA, 25 bp, Mus musculus
ggagaacgctccgatctactgcatc

SEQ ID NO: 595038 - DNA, 25 bp, Mus musculus
ggagaacggcatacagttggtttcc

SEQ ID NO: 595039 - DNA, 25 bp, Mus musculus
ggagaacggcattcagttggtttcc

SEQ ID NO: 595040 - DNA, 25 bp, Mus musculus
ggagaacgttcactatctgcagcat

SEQ ID NO: 595041 - DNA, 25 bp, Mus musculus
ggagaacgttcagtatctgcagcat

SEQ ID NO: 595042 - DNA, 25 bp, Mus musculus
ggagaacgttctctgcgtgactcat

SEQ ID NO: 595043 - DNA, 25 bp, Mus musculus
ggagaacgttctgtgcgtgactcat

SEQ ID NO: 595044 - DNA, 25 bp, Mus musculus
ggagaacgtttgatgctgtcactaa

SEQ ID NO: 595045 - DNA, 25 bp, Mus musculus
ggagaacgtttgttgctgtcactaa

SEQ ID NO: 595046 - DNA, 25 bp, Mus musculus
ggagaactaaccagggtccctctga

SEQ ID NO: 595047 - DNA, 25 bp, Mus musculus
ggagaactaacctgggtccctctga

SEQ ID NO: 595048 - DNA, 25 bp, Mus musculus
ggagaactaactactttatgagcaa

SEQ ID NO: 595049 - DNA, 25 bp, Mus musculus
ggagaactaacttctttatgagcaa

SEQ ID NO: 595050 - DNA, 25 bp, Mus musculus
ggagaactacctctcagaacactgc

SEQ ID NO: 595051 - DNA, 25 bp, Mus musculus
ggagaactacctgtcagaacactgc

SEQ ID NO: 595052 - DNA, 25 bp, Mus musculus
ggagaactactaccgcttagcagag

SEQ ID NO: 595053 - DNA, 25 bp, Mus musculus
ggagaactactagcgcttagcagag

SEQ ID NO: 595054 - DNA, 25 bp, Mus musculus
ggagaactatttaactttattggat

SEQ ID NO: 595055 - DNA, 25 bp, Mus musculus
ggagaactatttcttacttgattca

SEQ ID NO: 595056 - DNA, 25 bp, Mus musculus
ggagaactatttgttacttgattca

SEQ ID NO: 595057 - DNA, 25 bp, Mus musculus
ggagaactattttactttattggat

SEQ ID NO: 595058 - DNA, 25 bp, Mus musculus
ggagaactcaagctggtgcccatag

SEQ ID NO: 595059 - DNA, 25 bp, Mus musculus
ggagaactcaaggtggtgcccatag

SEQ ID NO: 595060 - DNA, 25 bp, Mus musculus
ggagaactcacacatctttatatga

SEQ ID NO: 595061 - DNA, 25 bp, Mus musculus
ggagaactcacagatctttatatga

SEQ ID NO: 595062 - DNA, 25 bp, Mus musculus
ggagaactcagaagaccccgtggaa

SEQ ID NO: 595063 - DNA, 25 bp, Mus musculus
ggagaactcagatgaccccgtggaa

SEQ ID NO: 595064 - DNA, 25 bp, Mus musculus
ggagaactccagaagaggcccaacc

SEQ ID NO: 595065 - DNA, 25 bp, Mus musculus
ggagaactccagtagaggcccaacc

SEQ ID NO: 595066 - DNA, 25 bp, Mus musculus
ggagaactccatagtgttccatgga

SEQ ID NO: 595067 - DNA, 25 bp, Mus musculus
ggagaactccatcggccgaatatgg

SEQ ID NO: 595068 - DNA, 25 bp, Mus musculus
ggagaactccatgggccgaatatgg

SEQ ID NO: 595069 - DNA, 25 bp, Mus musculus
ggagaactccattgtgttccatgga

SEQ ID NO: 595070 - DNA, 25 bp, Mus musculus
ggagaactccctacagcggtgcacc

SEQ ID NO: 595071 - DNA, 25 bp, Mus musculus
ggagaactccctatagcggtgcacc

SEQ ID NO: 595072 - DNA, 25 bp, Mus musculus
ggagaactcccttcagcggtgcacc

SEQ ID NO: 595073 - DNA, 25 bp, Mus musculus
ggagaactccctttagcggtgcacc

SEQ ID NO: 595074 - DNA, 25 bp, Mus musculus
ggagaactcggaaaaacagctagaa

SEQ ID NO: 595075 - DNA, 25 bp, Mus musculus
ggagaactcggataaacagctagaa

SEQ ID NO: 595076 - DNA, 25 bp, Mus musculus
ggagaactcttaaccctgagattaa

SEQ ID NO: 595077 - DNA, 25 bp, Mus musculus
ggagaactcttactgatttattgtc

SEQ ID NO: 595078 - DNA, 25 bp, Mus musculus
ggagaactcttagtgatttattgtc

SEQ ID NO: 595079 - DNA, 25 bp, Mus musculus
ggagaactcttatccctgagattaa

SEQ ID NO: 595080 - DNA, 25 bp, Mus musculus
ggagaactctttacaccttatgacc

SEQ ID NO: 595081 - DNA, 25 bp, Mus musculus
ggagaactcttttcaccttatgacc

SEQ ID NO: 595082 - DNA, 25 bp, Mus musculus
ggagaactgacacaaagtcccaccc

SEQ ID NO: 595083 - DNA, 25 bp, Mus musculus
ggagaactgacagaaagtcccaccc

SEQ ID NO: 595084 - DNA, 25 bp, Mus musculus
ggagaactgagccacactagtccac

SEQ ID NO: 595085 - DNA, 25 bp, Mus musculus
ggagaactgagcgacactagtccac

SEQ ID NO: 595086 - DNA, 25 bp, Mus musculus
ggagaactgaggcaattgcacattc

SEQ ID NO: 595087 - DNA, 25 bp, Mus musculus
ggagaactgagggaattgcacattc

SEQ ID NO: 595088 - DNA, 25 bp, Mus musculus
ggagaactgcacaaaacccactaaa

SEQ ID NO: 595089 - DNA, 25 bp, Mus musculus
ggagaactgcactaaacccactaaa

SEQ ID NO: 595090 - DNA, 25 bp, Mus musculus
ggagaactgctcattctaagacact

SEQ ID NO: 595091 - DNA, 25 bp, Mus musculus
ggagaactgctctttctaagacact

SEQ ID NO: 595092 - DNA, 25 bp, Mus musculus
ggagaactgtgaaacccgtccaaca

SEQ ID NO: 595093 - DNA, 25 bp, Mus musculus
ggagaactgtgatacccgtccaaca

SEQ ID NO: 595094 - DNA, 25 bp, Mus musculus
ggagaacttagacgccccacagtaa

SEQ ID NO: 595095 - DNA, 25 bp, Mus musculus
ggagaacttagaggccccacagtaa

SEQ ID NO: 595096 - DNA, 25 bp, Mus musculus
ggagaacttcaaccaggcacttaag

SEQ ID NO: 595097 - DNA, 25 bp, Mus musculus
ggagaacttcaagcaggcacttaag

SEQ ID NO: 595098 - DNA, 25 bp, Mus musculus
ggagaacttccacattgctttccat

SEQ ID NO: 595099 - DNA, 25 bp, Mus musculus
ggagaacttccagattgctttccat

SEQ ID NO: 595100 - DNA, 25 bp, Mus musculus
ggagaacttctgcacgcctagaatt

SEQ ID NO: 595101 - DNA, 25 bp, Mus musculus
ggagaacttctggacgcctagaatt

SEQ ID NO: 595102 - DNA, 25 bp, Mus musculus
ggagaacttcttagagatctgcgat

SEQ ID NO: 595103 - DNA, 25 bp, Mus musculus
ggagaacttctttgagatctgcgat

SEQ ID NO: 595104 - DNA, 25 bp, Mus musculus
ggagaacttgataaccttcacagat

SEQ ID NO: 595105 - DNA, 25 bp, Mus musculus
ggagaacttgattaccttcacagat

SEQ ID NO: 595106 - DNA, 25 bp, Mus musculus
ggagaacttgcacttaatggcctaa

SEQ ID NO: 595107 - DNA, 25 bp, Mus musculus
ggagaacttgcagttaatggcctaa

SEQ ID NO: 595108 - DNA, 25 bp, Mus musculus
ggagaactttacacctaacatagct

SEQ ID NO: 595109 - DNA, 25 bp, Mus musculus
ggagaactttactcctaacatagct

SEQ ID NO: 595110 - DNA, 25 bp, Mus musculus
ggagaactttcactgaccgctcagc

SEQ ID NO: 595111 - DNA, 25 bp, Mus musculus
ggagaactttcagtgaccgctcagc

SEQ ID NO: 595112 - DNA, 25 bp, Mus musculus
ggagaagaaaagacacctggtaaga

SEQ ID NO: 595113 - DNA, 25 bp, Mus musculus
ggagaagaaaagtcacctggtaaga

SEQ ID NO: 595114 - DNA, 25 bp, Mus musculus
ggagaagaaaccagcccactggatt

SEQ ID NO: 595115 - DNA, 25 bp, Mus musculus
ggagaagaaacctgcccactggatt

SEQ ID NO: 595116 - DNA, 25 bp, Mus musculus
ggagaagaagatccgtcccctgcct

SEQ ID NO: 595117 - DNA, 25 bp, Mus musculus
ggagaagaagatgcgtcccctgcct

SEQ ID NO: 595118 - DNA, 25 bp, Mus musculus
ggagaagaatacacgccggttcctg

SEQ ID NO: 595119 - DNA, 25 bp, Mus musculus
ggagaagaatactcgccggttcctg

SEQ ID NO: 595120 - DNA, 25 bp, Mus musculus
ggagaagaatatcgctgacctcatg

SEQ ID NO: 595121 - DNA, 25 bp, Mus musculus
ggagaagaatatggctgacctcatg

SEQ ID NO: 595122 - DNA, 25 bp, Mus musculus
ggagaagaatctacaaccactctgt

SEQ ID NO: 595123 - DNA, 25 bp, Mus musculus
ggagaagaatcttcaaccactctgt

SEQ ID NO: 595124 - DNA, 25 bp, Mus musculus
ggagaagacaatcaccaagcctatt

SEQ ID NO: 595125 - DNA, 25 bp, Mus musculus
ggagaagacaatgaccaagcctatt

SEQ ID NO: 595126 - DNA, 25 bp, Mus musculus
ggagaagacaccatactgaagctaa

SEQ ID NO: 595127 - DNA, 25 bp, Mus musculus
ggagaagacaccttactgaagctaa

SEQ ID NO: 595128 - DNA, 25 bp, Mus musculus
ggagaagacattatacctcctccct

SEQ ID NO: 595129 - DNA, 25 bp, Mus musculus
ggagaagacattttacctcctccct

SEQ ID NO: 595130 - DNA, 25 bp, Mus musculus
ggagaagacctcaacgcattaagca

SEQ ID NO: 595131 - DNA, 25 bp, Mus musculus
ggagaagacctctacgcattaagca

SEQ ID NO: 595132 - DNA, 25 bp, Mus musculus
ggagaagacctgacactttccttac

SEQ ID NO: 595133 - DNA, 25 bp, Mus musculus
ggagaagacctgtcactttccttac

SEQ ID NO: 595134 - DNA, 25 bp, Mus musculus
ggagaagactacaccaaacctgggt

SEQ ID NO: 595135 - DNA, 25 bp, Mus musculus
ggagaagactactccaaacctgggt

SEQ ID NO: 595136 - DNA, 25 bp, Mus musculus
ggagaagagacaacgggaatttcat

SEQ ID NO: 595137 - DNA, 25 bp, Mus musculus
ggagaagagacatcgggaatttcat

SEQ ID NO: 595138 - DNA, 25 bp, Mus musculus
ggagaagagagccagtccagcccat

SEQ ID NO: 595139 - DNA, 25 bp, Mus musculus
ggagaagagagcgagtccagcccat

SEQ ID NO: 595140 - DNA, 25 bp, Mus musculus
ggagaagagattccatctgatccca

SEQ ID NO: 595141 - DNA, 25 bp, Mus musculus
ggagaagagattgcatctgatccca

SEQ ID NO: 595142 - DNA, 25 bp, Mus musculus
ggagaagagcacaaccactttagtt

SEQ ID NO: 595143 - DNA, 25 bp, Mus musculus
ggagaagagcactaccactttagtt

SEQ ID NO: 595144 - DNA, 25 bp, Mus musculus
ggagaagagcttatcagccgcatcc

SEQ ID NO: 595145 - DNA, 25 bp, Mus musculus
ggagaagagcttttcagccgcatcc

SEQ ID NO: 595146 - DNA, 25 bp, Mus musculus
ggagaagataacatcaccttcctgg

SEQ ID NO: 595147 - DNA, 25 bp, Mus musculus
ggagaagataacttcaccttcctgg

SEQ ID NO: 595148 - DNA, 25 bp, Mus musculus
ggagaagatcatccttgaaaccaaa

SEQ ID NO: 595149 - DNA, 25 bp, Mus musculus
ggagaagatcatgcttgaaaccaaa

SEQ ID NO: 595150 - DNA, 25 bp, Mus musculus
ggagaagatctgccaccacaccttc

SEQ ID NO: 595151 - DNA, 25 bp, Mus musculus
ggagaagatctggcaccacaccttc

SEQ ID NO: 595152 - DNA, 25 bp, Mus musculus
ggagaagatgccatcacattttctt

SEQ ID NO: 595153 - DNA, 25 bp, Mus musculus
ggagaagatgccttcacattttctt

SEQ ID NO: 595154 - DNA, 25 bp, Mus musculus
ggagaagcaaacagcacctacttca

SEQ ID NO: 595155 - DNA, 25 bp, Mus musculus
ggagaagcaaactgcacctacttca

SEQ ID NO: 595156 - DNA, 25 bp, Mus musculus
ggagaagcaccaacttccctgatcc

SEQ ID NO: 595157 - DNA, 25 bp, Mus musculus
ggagaagcaccatcttccctgatcc

SEQ ID NO: 595158 - DNA, 25 bp, Mus musculus
ggagaagcagcaacctaaacactgt

SEQ ID NO: 595159 - DNA, 25 bp, Mus musculus
ggagaagcagcatcctaaacactgt

SEQ ID NO: 595160 - DNA, 25 bp, Mus musculus
ggagaagcagccctagatagcgcct

SEQ ID NO: 595161 - DNA, 25 bp, Mus musculus
ggagaagcagccgtagatagcgcct

SEQ ID NO: 595162 - DNA, 25 bp, Mus musculus
ggagaagcagcgagccacaggtctc

SEQ ID NO: 595163 - DNA, 25 bp, Mus musculus
ggagaagcagcgtgccacaggtctc

SEQ ID NO: 595164 - DNA, 25 bp, Mus musculus
ggagaagcagctagcactacgagat

SEQ ID NO: 595165 - DNA, 25 bp, Mus musculus
ggagaagcagctcgccatggaacaa

SEQ ID NO: 595166 - DNA, 25 bp, Mus musculus
ggagaagcagctggccatggaacaa

SEQ ID NO: 595167 - DNA, 25 bp, Mus musculus
ggagaagcagcttgcactacgagat

SEQ ID NO: 595168 - DNA, 25 bp, Mus musculus
ggagaagcagtaacgtctttccagc

SEQ ID NO: 595169 - DNA, 25 bp, Mus musculus
ggagaagcagtatcgtctttccagc

SEQ ID NO: 595170 - DNA, 25 bp, Mus musculus
ggagaagcatatctacctcctcatg

SEQ ID NO: 595171 - DNA, 25 bp, Mus musculus
ggagaagcatatgtacctcctcatg

SEQ ID NO: 595172 - DNA, 25 bp, Mus musculus
ggagaagcatgtaattaaacagtga

SEQ ID NO: 595173 - DNA, 25 bp, Mus musculus
ggagaagcatgttattaaacagtga

SEQ ID NO: 595174 - DNA, 25 bp, Mus musculus
ggagaagccagacgacttctgtcct

SEQ ID NO: 595175 - DNA, 25 bp, Mus musculus
ggagaagccagaggacttctgtcct

SEQ ID NO: 595176 - DNA, 25 bp, Mus musculus
ggagaagccataccagtgcaacatg

SEQ ID NO: 595177 - DNA, 25 bp, Mus musculus
ggagaagccatagcagtgcaacatg

SEQ ID NO: 595178 - DNA, 25 bp, Mus musculus
ggagaagcccatcattgtccgctgg

SEQ ID NO: 595179 - DNA, 25 bp, Mus musculus
ggagaagcccatgattgtccgctgg

SEQ ID NO: 595180 - DNA, 25 bp, Mus musculus
ggagaagccccacacattagaggaa

SEQ ID NO: 595181 - DNA, 25 bp, Mus musculus
ggagaagccccagacattagaggaa

SEQ ID NO: 595182 - DNA, 25 bp, Mus musculus
ggagaagccctcaagtgctcaaaga

SEQ ID NO: 595183 - DNA, 25 bp, Mus musculus
ggagaagccctcacttctttcagcc

SEQ ID NO: 595184 - DNA, 25 bp, Mus musculus
ggagaagccctctagtgctcaaaga

SEQ ID NO: 595185 - DNA, 25 bp, Mus musculus
ggagaagccctctcttctttcagcc

SEQ ID NO: 595186 - DNA, 25 bp, Mus musculus
ggagaagccctgcatgagacagact

SEQ ID NO: 595187 - DNA, 25 bp, Mus musculus
ggagaagccctggatgagacagact

SEQ ID NO: 595188 - DNA, 25 bp, Mus musculus
ggagaagcccttcctgcggtttttt

SEQ ID NO: 595189 - DNA, 25 bp, Mus musculus
ggagaagcccttgctgcggtttttt

SEQ ID NO: 595190 - DNA, 25 bp, Mus musculus
ggagaagccttaataggaaccacaa

SEQ ID NO: 595191 - DNA, 25 bp, Mus musculus
ggagaagccttattaggaaccacaa

SEQ ID NO: 595192 - DNA, 25 bp, Mus musculus
ggagaagccttcaatgctctgctta

SEQ ID NO: 595193 - DNA, 25 bp, Mus musculus
ggagaagccttctatgctctgctta

SEQ ID NO: 595194 - DNA, 25 bp, Mus musculus
ggagaagcctttctgggtctaccct

SEQ ID NO: 595195 - DNA, 25 bp, Mus musculus
ggagaagcctttgtgggtctaccct

SEQ ID NO: 595196 - DNA, 25 bp, Mus musculus
ggagaagcggctcaattccccttgt

SEQ ID NO: 595197 - DNA, 25 bp, Mus musculus
ggagaagcggctgaattccccttgt

SEQ ID NO: 595198 - DNA, 25 bp, Mus musculus
ggagaagctacacttgagtcgccca

SEQ ID NO: 595199 - DNA, 25 bp, Mus musculus
ggagaagctacagttgagtcgccca

SEQ ID NO: 595200 - DNA, 25 bp, Mus musculus
ggagaagctataatccctcgggagc

SEQ ID NO: 595201 - DNA, 25 bp, Mus musculus
ggagaagctatattccctcgggagc

SEQ ID NO: 595202 - DNA, 25 bp, Mus musculus
ggagaagctattatattttgttaag

SEQ ID NO: 595203 - DNA, 25 bp, Mus musculus
ggagaagctattttattttgttaag

SEQ ID NO: 595204 - DNA, 25 bp, Mus musculus
ggagaagctcctccaccagaaagca

SEQ ID NO: 595205 - DNA, 25 bp, Mus musculus
ggagaagctcctgcaccagaaagca

SEQ ID NO: 595206 - DNA, 25 bp, Mus musculus
ggagaagctgcacccctgtcagcat

SEQ ID NO: 595207 - DNA, 25 bp, Mus musculus
ggagaagctgcagccctgtcagcat

SEQ ID NO: 595208 - DNA, 25 bp, Mus musculus
ggagaagcttctagccaatcacgct

SEQ ID NO: 595209 - DNA, 25 bp, Mus musculus
ggagaagcttcttgccaatcacgct

SEQ ID NO: 595210 - DNA, 25 bp, Mus musculus
ggagaaggaagcacccttctggtgt

SEQ ID NO: 595211 - DNA, 25 bp, Mus musculus
ggagaaggaagctcccttctggtgt

SEQ ID NO: 595212 - DNA, 25 bp, Mus musculus
ggagaaggacctcaacacgctatga

SEQ ID NO: 595213 - DNA, 25 bp, Mus musculus
ggagaaggacctgaacacgctatga

SEQ ID NO: 595214 - DNA, 25 bp, Mus musculus
ggagaaggacttatcgatccagggt

SEQ ID NO: 595215 - DNA, 25 bp, Mus musculus
ggagaaggacttttcgatccagggt

SEQ ID NO: 595216 - DNA, 25 bp, Mus musculus
ggagaaggatcaaaccaagaggtga

SEQ ID NO: 595217 - DNA, 25 bp, Mus musculus
ggagaaggatcataccaagaggtga

SEQ ID NO: 595218 - DNA, 25 bp, Mus musculus
ggagaaggcaccatctattattttc

SEQ ID NO: 595219 - DNA, 25 bp, Mus musculus
ggagaaggcaccttctattattttc

SEQ ID NO: 595220 - DNA, 25 bp, Mus musculus
ggagaaggcatcacagaaccccgag

SEQ ID NO: 595221 - DNA, 25 bp, Mus musculus
ggagaaggcatctcagaaccccgag

SEQ ID NO: 595222 - DNA, 25 bp, Mus musculus
ggagaaggccgcatcaacttctctg

SEQ ID NO: 595223 - DNA, 25 bp, Mus musculus
ggagaaggccgcttcaacttctctg

SEQ ID NO: 595224 - DNA, 25 bp, Mus musculus
ggagaaggcctgataatgtcacata

SEQ ID NO: 595225 - DNA, 25 bp, Mus musculus
ggagaaggcctgttaatgtcacata

SEQ ID NO: 595226 - DNA, 25 bp, Mus musculus
ggagaaggcgctacatcgccaaagt

SEQ ID NO: 595227 - DNA, 25 bp, Mus musculus
ggagaaggcgcttcatcgccaaagt

SEQ ID NO: 595228 - DNA, 25 bp, Mus musculus
ggagaaggctatacccttgcagcca

SEQ ID NO: 595229 - DNA, 25 bp, Mus musculus
ggagaaggctattcccttgcagcca

SEQ ID NO: 595230 - DNA, 25 bp, Mus musculus
ggagaaggctccaaacagtgtggat

SEQ ID NO: 595231 - DNA, 25 bp, Mus musculus
ggagaaggctcctaacagtgtggat

SEQ ID NO: 595232 - DNA, 25 bp, Mus musculus
ggagaagggatcctccttactctga

SEQ ID NO: 595233 - DNA, 25 bp, Mus musculus
ggagaagggatcgtccttactctga

SEQ ID NO: 595234 - DNA, 25 bp, Mus musculus
ggagaagggtccagccccaggcaca

SEQ ID NO: 595235 - DNA, 25 bp, Mus musculus
ggagaagggtcctgccccaggcaca

SEQ ID NO: 595236 - DNA, 25 bp, Mus musculus
ggagaaggtaaccaagatcttcaaa

SEQ ID NO: 595237 - DNA, 25 bp, Mus musculus
ggagaaggtaacgaagatcttcaaa

SEQ ID NO: 595238 - DNA, 25 bp, Mus musculus
ggagaaggtctaatgccactatttt

SEQ ID NO: 595239 - DNA, 25 bp, Mus musculus
ggagaaggtctattgccactatttt

SEQ ID NO: 595240 - DNA, 25 bp, Mus musculus
ggagaaggtgtcactgtgccccttc

SEQ ID NO: 595241 - DNA, 25 bp, Mus musculus
ggagaaggtgtcaggcgtggtcggg

SEQ ID NO: 595242 - DNA, 25 bp, Mus musculus
ggagaaggtgtctctgtgccccttc

SEQ ID NO: 595243 - DNA, 25 bp, Mus musculus
ggagaaggtgtctggcgtggtcggg

SEQ ID NO: 595244 - DNA, 25 bp, Mus musculus
ggagaagtaaatctccctctttact

SEQ ID NO: 595245 - DNA, 25 bp, Mus musculus
ggagaagtaaatgtccctctttact

SEQ ID NO: 595246 - DNA, 25 bp, Mus musculus
ggagaagtacccatttcagcaagga

SEQ ID NO: 595247 - DNA, 25 bp, Mus musculus
ggagaagtacccttttcagcaagga

SEQ ID NO: 595248 - DNA, 25 bp, Mus musculus
ggagaagtacctaagctcatgcttg

SEQ ID NO: 595249 - DNA, 25 bp, Mus musculus
ggagaagtaccttagctcatgcttg

SEQ ID NO: 595250 - DNA, 25 bp, Mus musculus
ggagaagtagagattgcccatttta

SEQ ID NO: 595251 - DNA, 25 bp, Mus musculus
ggagaagtagagtttgcccatttta

SEQ ID NO: 595252 - DNA, 25 bp, Mus musculus
ggagaagtcaagacccttattttca

SEQ ID NO: 595253 - DNA, 25 bp, Mus musculus
ggagaagtcaagtcccttattttca

SEQ ID NO: 595254 - DNA, 25 bp, Mus musculus
ggagaagtccagaaacggtccattc

SEQ ID NO: 595255 - DNA, 25 bp, Mus musculus
ggagaagtccagtaacggtccattc

SEQ ID NO: 595256 - DNA, 25 bp, Mus musculus
ggagaagtccccaggccgaatgctc

SEQ ID NO: 595257 - DNA, 25 bp, Mus musculus
ggagaagtcccctggccgaatgctc

SEQ ID NO: 595258 - DNA, 25 bp, Mus musculus
ggagaagtcgaacctcttcccatgc

SEQ ID NO: 595259 - DNA, 25 bp, Mus musculus
ggagaagtcgaagctcttcccatgc

SEQ ID NO: 595260 - DNA, 25 bp, Mus musculus
ggagaagtcgccattgagcacacaa

SEQ ID NO: 595261 - DNA, 25 bp, Mus musculus
ggagaagtcgcctttgagcacacaa

SEQ ID NO: 595262 - DNA, 25 bp, Mus musculus
ggagaagtcgttaaatggcccacca

SEQ ID NO: 595263 - DNA, 25 bp, Mus musculus
ggagaagtcgtttaatggcccacca

SEQ ID NO: 595264 - DNA, 25 bp, Mus musculus
ggagaagtgatacccttgtgtaaca

SEQ ID NO: 595265 - DNA, 25 bp, Mus musculus
ggagaagtgatagccttgtgtaaca

SEQ ID NO: 595266 - DNA, 25 bp, Mus musculus
ggagaagtgctactgcctgccattc

SEQ ID NO: 595267 - DNA, 25 bp, Mus musculus
ggagaagtgctagtgcctgccattc

SEQ ID NO: 595268 - DNA, 25 bp, Mus musculus
ggagaagtgctcagacatcaccaaa

SEQ ID NO: 595269 - DNA, 25 bp, Mus musculus
ggagaagtgctctgacatcaccaaa

SEQ ID NO: 595270 - DNA, 25 bp, Mus musculus
ggagaagtggtgatccagcacgccc

SEQ ID NO: 595271 - DNA, 25 bp, Mus musculus
ggagaagtggtgttccagcacgccc

SEQ ID NO: 595272 - DNA, 25 bp, Mus musculus
ggagaagtgtgtaactcacgcctca

SEQ ID NO: 595273 - DNA, 25 bp, Mus musculus
ggagaagtgtgtcggtaccaccctc

SEQ ID NO: 595274 - DNA, 25 bp, Mus musculus
ggagaagtgtgtgggtaccaccctc

SEQ ID NO: 595275 - DNA, 25 bp, Mus musculus
ggagaagtgtgttactcacgcctca

SEQ ID NO: 595276 - DNA, 25 bp, Mus musculus
ggagaagttaccagtgggtgacaca

SEQ ID NO: 595277 - DNA, 25 bp, Mus musculus
ggagaagttacctgtgggtgacaca

SEQ ID NO: 595278 - DNA, 25 bp, Mus musculus
ggagaagttactcggcttttccaat

SEQ ID NO: 595279 - DNA, 25 bp, Mus musculus
ggagaagttactgggcttttccaat

SEQ ID NO: 595280 - DNA, 25 bp, Mus musculus
ggagaagttcaaccacactgccatc

SEQ ID NO: 595281 - DNA, 25 bp, Mus musculus
ggagaagttcaagcacactgccatc

SEQ ID NO: 595282 - DNA, 25 bp, Mus musculus
ggagaagttcccagtcagtgcagtg

SEQ ID NO: 595283 - DNA, 25 bp, Mus musculus
ggagaagttccctgtcagtgcagtg

SEQ ID NO: 595284 - DNA, 25 bp, Mus musculus
ggagaagttgaacgagccagctgga

SEQ ID NO: 595285 - DNA, 25 bp, Mus musculus
ggagaagttgaaggagccagctgga

SEQ ID NO: 595286 - DNA, 25 bp, Mus musculus
ggagaagttgcactatgccagcctc

SEQ ID NO: 595287 - DNA, 25 bp, Mus musculus
ggagaagttgcagtatgccagcctc

SEQ ID NO: 595288 - DNA, 25 bp, Mus musculus
ggagaagttttacactccctcgctc

SEQ ID NO: 595289 - DNA, 25 bp, Mus musculus
ggagaagttttagactccctcgctc

SEQ ID NO: 595290 - DNA, 25 bp, Mus musculus
ggagaataacaccaccatatacagt

SEQ ID NO: 595291 - DNA, 25 bp, Mus musculus
ggagaataacacgaccatatacagt

SEQ ID NO: 595292 - DNA, 25 bp, Mus musculus
ggagaataccgtcttgctgccaaac

SEQ ID NO: 595293 - DNA, 25 bp, Mus musculus
ggagaataccgtgttgctgccaaac

SEQ ID NO: 595294 - DNA, 25 bp, Mus musculus
ggagaataccttatacccaatgcag

SEQ ID NO: 595295 - DNA, 25 bp, Mus musculus
ggagaataccttttacccaatgcag

SEQ ID NO: 595296 - DNA, 25 bp, Mus musculus
ggagaatatcctcgaggctctgaga

SEQ ID NO: 595297 - DNA, 25 bp, Mus musculus
ggagaatatcctggaggctctgaga

SEQ ID NO: 595298 - DNA, 25 bp, Mus musculus
ggagaatatgatccagaacctgggc

SEQ ID NO: 595299 - DNA, 25 bp, Mus musculus
ggagaatatgatgcagaacctgggc

SEQ ID NO: 595300 - DNA, 25 bp, Mus musculus
ggagaatatgcaatactcacaatta

SEQ ID NO: 595301 - DNA, 25 bp, Mus musculus
ggagaatatgcattactcacaatta

SEQ ID NO: 595302 - DNA, 25 bp, Mus musculus
ggagaatatttgacctgcaaaatac

SEQ ID NO: 595303 - DNA, 25 bp, Mus musculus
ggagaatatttgtcctgcaaaatac

SEQ ID NO: 595304 - DNA, 25 bp, Mus musculus
ggagaatcaagtcccatgcgctgat

SEQ ID NO: 595305 - DNA, 25 bp, Mus musculus
ggagaatcaagtgccatgcgctgat

SEQ ID NO: 595306 - DNA, 25 bp, Mus musculus
ggagaatcaccgaggacaccgagat

SEQ ID NO: 595307 - DNA, 25 bp, Mus musculus
ggagaatcaccgtggacaccgagat

SEQ ID NO: 595308 - DNA, 25 bp, Mus musculus
ggagaatcatggatttctattgaat

SEQ ID NO: 595309 - DNA, 25 bp, Mus musculus
ggagaatcatggttttctattgaat

SEQ ID NO: 595310 - DNA, 25 bp, Mus musculus
ggagaatccaagatcacgtctgact

SEQ ID NO: 595311 - DNA, 25 bp, Mus musculus
ggagaatccaagttcacgtctgact

SEQ ID NO: 595312 - DNA, 25 bp, Mus musculus
ggagaatccacaagggactagaact

SEQ ID NO: 595313 - DNA, 25 bp, Mus musculus
ggagaatccacatgggactagaact

SEQ ID NO: 595314 - DNA, 25 bp, Mus musculus
ggagaatccattagttaaaccatag

SEQ ID NO: 595315 - DNA, 25 bp, Mus musculus
ggagaatccatttgttaaaccatag

SEQ ID NO: 595316 - DNA, 25 bp, Mus musculus
ggagaatcccacattcaccgccaaa

SEQ ID NO: 595317 - DNA, 25 bp, Mus musculus
ggagaatcccactttcaccgccaaa

SEQ ID NO: 595318 - DNA, 25 bp, Mus musculus
ggagaatccctcagatacatcatga

SEQ ID NO: 595319 - DNA, 25 bp, Mus musculus
ggagaatccctctgatacatcatga

SEQ ID NO: 595320 - DNA, 25 bp, Mus musculus
ggagaatccgagatacgagcctcgt

SEQ ID NO: 595321 - DNA, 25 bp, Mus musculus
ggagaatccgagttacgagcctcgt

SEQ ID NO: 595322 - DNA, 25 bp, Mus musculus
ggagaatccgctaaacagcacccag

SEQ ID NO: 595323 - DNA, 25 bp, Mus musculus
ggagaatccgcttaacagcacccag

SEQ ID NO: 595324 - DNA, 25 bp, Mus musculus
ggagaatcctaacggcagaggcact

SEQ ID NO: 595325 - DNA, 25 bp, Mus musculus
ggagaatcctaagggcagaggcact

SEQ ID NO: 595326 - DNA, 25 bp, Mus musculus
ggagaatcctataaggcctccatct

SEQ ID NO: 595327 - DNA, 25 bp, Mus musculus
ggagaatcctattaggcctccatct

SEQ ID NO: 595328 - DNA, 25 bp, Mus musculus
ggagaatcctcccaaatctgatcag

SEQ ID NO: 595329 - DNA, 25 bp, Mus musculus
ggagaatcctccgaaatctgatcag

SEQ ID NO: 595330 - DNA, 25 bp, Mus musculus
ggagaatcctgaactttggttttgt

SEQ ID NO: 595331 - DNA, 25 bp, Mus musculus
ggagaatcctgatctttggttttgt

SEQ ID NO: 595332 - DNA, 25 bp, Mus musculus
ggagaatctacaacaagcacccaca

SEQ ID NO: 595333 - DNA, 25 bp, Mus musculus
ggagaatctacatcaagcacccaca

SEQ ID NO: 595334 - DNA, 25 bp, Mus musculus
ggagaatctacgagccaggacattt

SEQ ID NO: 595335 - DNA, 25 bp, Mus musculus
ggagaatctacgtgccaggacattt

SEQ ID NO: 595336 - DNA, 25 bp, Mus musculus
ggagaatctctcaggcttgtctggc

SEQ ID NO: 595337 - DNA, 25 bp, Mus musculus
ggagaatctctctggcttgtctggc

SEQ ID NO: 595338 - DNA, 25 bp, Mus musculus
ggagaatctgaaccttactctgaag

SEQ ID NO: 595339 - DNA, 25 bp, Mus musculus
ggagaatctgaagcttactctgaag

SEQ ID NO: 595340 - DNA, 25 bp, Mus musculus
ggagaatgaaacacaggtcaccaaa

SEQ ID NO: 595341 - DNA, 25 bp, Mus musculus
ggagaatgaaactcaggtcaccaaa

SEQ ID NO: 595342 - DNA, 25 bp, Mus musculus
ggagaatgaactccgcgctctagaa

SEQ ID NO: 595343 - DNA, 25 bp, Mus musculus
ggagaatgaactgcgcgctctagaa

SEQ ID NO: 595344 - DNA, 25 bp, Mus musculus
ggagaatgaattcccgtttttataa

SEQ ID NO: 595345 - DNA, 25 bp, Mus musculus
ggagaatgaattgccgtttttataa

SEQ ID NO: 595346 - DNA, 25 bp, Mus musculus
ggagaatgacaactaccggagacac

SEQ ID NO: 595347 - DNA, 25 bp, Mus musculus
ggagaatgacaagtaccggagacac

SEQ ID NO: 595348 - DNA, 25 bp, Mus musculus
ggagaatgcatgctaaaacggcagt

SEQ ID NO: 595349 - DNA, 25 bp, Mus musculus
ggagaatgcatggtaaaacggcagt

SEQ ID NO: 595350 - DNA, 25 bp, Mus musculus
ggagaatgcgctaaaggacctagac

SEQ ID NO: 595351 - DNA, 25 bp, Mus musculus
ggagaatgcgcttaaggacctagac

SEQ ID NO: 595352 - DNA, 25 bp, Mus musculus
ggagaatgctcaaggcccagtgctg

SEQ ID NO: 595353 - DNA, 25 bp, Mus musculus
ggagaatgctcatggcccagtgctg

SEQ ID NO: 595354 - DNA, 25 bp, Mus musculus
ggagaatgctgaaacacctgccctg

SEQ ID NO: 595355 - DNA, 25 bp, Mus musculus
ggagaatgctgatacacctgccctg

SEQ ID NO: 595356 - DNA, 25 bp, Mus musculus
ggagaatgctttcaggacaccctta

SEQ ID NO: 595357 - DNA, 25 bp, Mus musculus
ggagaatgctttgaggacaccctta

SEQ ID NO: 595358 - DNA, 25 bp, Mus musculus
ggagaatggcagatcacttaattta

SEQ ID NO: 595359 - DNA, 25 bp, Mus musculus
ggagaatggcagttcacttaattta

SEQ ID NO: 595360 - DNA, 25 bp, Mus musculus
ggagaatggccccaagcttgcaagt

SEQ ID NO: 595361 - DNA, 25 bp, Mus musculus
ggagaatggcccgaagcttgcaagt

SEQ ID NO: 595362 - DNA, 25 bp, Mus musculus
ggagaatgggtacttcctcattgaa

SEQ ID NO: 595363 - DNA, 25 bp, Mus musculus
ggagaatgggtagttcctcattgaa

SEQ ID NO: 595364 - DNA, 25 bp, Mus musculus
ggagaatgtccaacagcttggaatt

SEQ ID NO: 595365 - DNA, 25 bp, Mus musculus
ggagaatgtccatcagcttggaatt

SEQ ID NO: 595366 - DNA, 25 bp, Mus musculus
ggagaatgtctcatagctgttgttt

SEQ ID NO: 595367 - DNA, 25 bp, Mus musculus
ggagaatgtctcttagctgttgttt

SEQ ID NO: 595368 - DNA, 25 bp, Mus musculus
ggagaatgtggcattatcactaatg

SEQ ID NO: 595369 - DNA, 25 bp, Mus musculus
ggagaatgtggctttatcactaatg

SEQ ID NO: 595370 - DNA, 25 bp, Mus musculus
ggagaatgttacaggcttccacact

SEQ ID NO: 595371 - DNA, 25 bp, Mus musculus
ggagaatgttactggcttccacact

SEQ ID NO: 595372 - DNA, 25 bp, Mus musculus
ggagaattacccactgtacatccga

SEQ ID NO: 595373 - DNA, 25 bp, Mus musculus
ggagaattacccatgaagcctttaa

SEQ ID NO: 595374 - DNA, 25 bp, Mus musculus
ggagaattaccctctgtacatccga

SEQ ID NO: 595375 - DNA, 25 bp, Mus musculus
ggagaattacccttgaagcctttaa

SEQ ID NO: 595376 - DNA, 25 bp, Mus musculus
ggagaattacctatacagcccacta

SEQ ID NO: 595377 - DNA, 25 bp, Mus musculus
ggagaattacctttacagcccacta

SEQ ID NO: 595378 - DNA, 25 bp, Mus musculus
ggagaattactcagaccattgcttc

SEQ ID NO: 595379 - DNA, 25 bp, Mus musculus
ggagaattactctgaccattgcttc

SEQ ID NO: 595380 - DNA, 25 bp, Mus musculus
ggagaattatccagagttccactca

SEQ ID NO: 595381 - DNA, 25 bp, Mus musculus
ggagaattatcctgagttccactca

SEQ ID NO: 595382 - DNA, 25 bp, Mus musculus
ggagaattcagcaacgcgccagacc

SEQ ID NO: 595383 - DNA, 25 bp, Mus musculus
ggagaattcagctacgcgccagacc

SEQ ID NO: 595384 - DNA, 25 bp, Mus musculus
ggagaattctctcccatgtgaaaat

SEQ ID NO: 595385 - DNA, 25 bp, Mus musculus
ggagaattctctgccatgtgaaaat

SEQ ID NO: 595386 - DNA, 25 bp, Mus musculus
ggagaattctgcacaagtccttgct

SEQ ID NO: 595387 - DNA, 25 bp, Mus musculus
ggagaattctgcattagccctgtgg

SEQ ID NO: 595388 - DNA, 25 bp, Mus musculus
ggagaattctgctcaagtccttgct

SEQ ID NO: 595389 - DNA, 25 bp, Mus musculus
ggagaattctgctttagccctgtgg

SEQ ID NO: 595390 - DNA, 25 bp, Mus musculus
ggagaattggctcgcttgctgtcta

SEQ ID NO: 595391 - DNA, 25 bp, Mus musculus
ggagaattggctggcttgctgtcta

SEQ ID NO: 595392 - DNA, 25 bp, Mus musculus
ggagaattgtccctcacagttggat

SEQ ID NO: 595393 - DNA, 25 bp, Mus musculus
ggagaattgtccgtcacagttggat

SEQ ID NO: 595394 - DNA, 25 bp, Mus musculus
ggagaatttagtacttttcataacg

SEQ ID NO: 595395 - DNA, 25 bp, Mus musculus
ggagaatttagttcttttcataacg

SEQ ID NO: 595396 - DNA, 25 bp, Mus musculus
ggagaatttcctcagtttcccttct

SEQ ID NO: 595397 - DNA, 25 bp, Mus musculus
ggagaatttcctgagtttcccttct

SEQ ID NO: 595398 - DNA, 25 bp, Mus musculus
ggagaatttcttcaggcagtttcct

SEQ ID NO: 595399 - DNA, 25 bp, Mus musculus
ggagaatttcttgaggcagtttcct

SEQ ID NO: 595400 - DNA, 25 bp, Mus musculus
ggagaatttttcacatccaatcccc

SEQ ID NO: 595401 - DNA, 25 bp, Mus musculus
ggagaatttttctcatccaatcccc

SEQ ID NO: 595402 - DNA, 25 bp, Mus musculus
ggagacaaaactagtactgtaagat

SEQ ID NO: 595403 - DNA, 25 bp, Mus musculus
ggagacaaaacttgtactgtaagat

SEQ ID NO: 595404 - DNA, 25 bp, Mus musculus
ggagacaaacacattctacaacttc

SEQ ID NO: 595405 - DNA, 25 bp, Mus musculus
ggagacaaacactttctacaacttc

SEQ ID NO: 595406 - DNA, 25 bp, Mus musculus
ggagacaaacccaggacgcctcact

SEQ ID NO: 595407 - DNA, 25 bp, Mus musculus
ggagacaaaccctggacgcctcact

SEQ ID NO: 595408 - DNA, 25 bp, Mus musculus
ggagacaaagttcacctggcagagt

SEQ ID NO: 595409 - DNA, 25 bp, Mus musculus
ggagacaaagttgacctggcagagt

SEQ ID NO: 595410 - DNA, 25 bp, Mus musculus
ggagacaacactaactcaatcagat

SEQ ID NO: 595411 - DNA, 25 bp, Mus musculus
ggagacaacactacatcagtttcga

SEQ ID NO: 595412 - DNA, 25 bp, Mus musculus
ggagacaacacttactcaatcagat

SEQ ID NO: 595413 - DNA, 25 bp, Mus musculus
ggagacaacacttcatcagtttcga

SEQ ID NO: 595414 - DNA, 25 bp, Mus musculus
ggagacaaccctaacttacaaccag

SEQ ID NO: 595415 - DNA, 25 bp, Mus musculus
ggagacaacccttacttacaaccag

SEQ ID NO: 595416 - DNA, 25 bp, Mus musculus
ggagacaaccgcacagcctgggaca

SEQ ID NO: 595417 - DNA, 25 bp, Mus musculus
ggagacaaccgctcagcctgggaca

SEQ ID NO: 595418 - DNA, 25 bp, Mus musculus
ggagacaactcccagcatgattcac

SEQ ID NO: 595419 - DNA, 25 bp, Mus musculus
ggagacaactccgagcatgattcac

SEQ ID NO: 595420 - DNA, 25 bp, Mus musculus
ggagacaactgactttttactcaaa

SEQ ID NO: 595421 - DNA, 25 bp, Mus musculus
ggagacaactgagtttttactcaaa

SEQ ID NO: 595422 - DNA, 25 bp, Mus musculus
ggagacaactgtctaaaatgcttac

SEQ ID NO: 595423 - DNA, 25 bp, Mus musculus
ggagacaactgtgtaaaatgcttac

SEQ ID NO: 595424 - DNA, 25 bp, Mus musculus
ggagacaagattcctccttcctgag

SEQ ID NO: 595425 - DNA, 25 bp, Mus musculus
ggagacaagattgctccttcctgag

SEQ ID NO: 595426 - DNA, 25 bp, Mus musculus
ggagacaagctcattcatgtgcaga

SEQ ID NO: 595427 - DNA, 25 bp, Mus musculus
ggagacaagctctttcatgtgcaga

SEQ ID NO: 595428 - DNA, 25 bp, Mus musculus
ggagacaagctgaatttcatctaaa

SEQ ID NO: 595429 - DNA, 25 bp, Mus musculus
ggagacaagctgtatttcatctaaa

SEQ ID NO: 595430 - DNA, 25 bp, Mus musculus
ggagacaagcttcctgccctaattc

SEQ ID NO: 595431 - DNA, 25 bp, Mus musculus
ggagacaagcttgctgccctaattc

SEQ ID NO: 595432 - DNA, 25 bp, Mus musculus
ggagacaagggcaggatatgtaatc

SEQ ID NO: 595433 - DNA, 25 bp, Mus musculus
ggagacaagggctggatatgtaatc

SEQ ID NO: 595434 - DNA, 25 bp, Mus musculus
ggagacaagtaaaggccccaagaac

SEQ ID NO: 595435 - DNA, 25 bp, Mus musculus
ggagacaagtaatggccccaagaac

SEQ ID NO: 595436 - DNA, 25 bp, Mus musculus
ggagacaagtacacaccttgactct

SEQ ID NO: 595437 - DNA, 25 bp, Mus musculus
ggagacaagtactcaccttgactct

SEQ ID NO: 595438 - DNA, 25 bp, Mus musculus
ggagacaagtttaaagtggacagga

SEQ ID NO: 595439 - DNA, 25 bp, Mus musculus
ggagacaagttttaagtggacagga

SEQ ID NO: 595440 - DNA, 25 bp, Mus musculus
ggagacaatccaattaggactgagt

SEQ ID NO: 595441 - DNA, 25 bp, Mus musculus
ggagacaatccatttaggactgagt

SEQ ID NO: 595442 - DNA, 25 bp, Mus musculus
ggagacaatgacaacttcacttgca

SEQ ID NO: 595443 - DNA, 25 bp, Mus musculus
ggagacaatgactacttcacttgca

SEQ ID NO: 595444 - DNA, 25 bp, Mus musculus
ggagacaattatcctaggcttctgt

SEQ ID NO: 595445 - DNA, 25 bp, Mus musculus
ggagacaattatgctaggcttctgt

SEQ ID NO: 595446 - DNA, 25 bp, Mus musculus
ggagacaattctacacgagatacga

SEQ ID NO: 595447 - DNA, 25 bp, Mus musculus
ggagacaattcttcacgagatacga

SEQ ID NO: 595448 - DNA, 25 bp, Mus musculus
ggagacacaaagaaccatggagaaa

SEQ ID NO: 595449 - DNA, 25 bp, Mus musculus
ggagacacaaagtaccatggagaaa

SEQ ID NO: 595450 - DNA, 25 bp, Mus musculus
ggagacacaatcaccaataccatga

SEQ ID NO: 595451 - DNA, 25 bp, Mus musculus
ggagacacaatctccaataccatga

SEQ ID NO: 595452 - DNA, 25 bp, Mus musculus
ggagacacacagataccatcattca

SEQ ID NO: 595453 - DNA, 25 bp, Mus musculus
ggagacacacagttaccatcattca

SEQ ID NO: 595454 - DNA, 25 bp, Mus musculus
ggagacacactaccagccttaggga

SEQ ID NO: 595455 - DNA, 25 bp, Mus musculus
ggagacacactagcagccttaggga

SEQ ID NO: 595456 - DNA, 25 bp, Mus musculus
ggagacacagaaatcctgctatcag

SEQ ID NO: 595457 - DNA, 25 bp, Mus musculus
ggagacacagaactcaagagtggaa

SEQ ID NO: 595458 - DNA, 25 bp, Mus musculus
ggagacacagaagtcaagagtggaa

SEQ ID NO: 595459 - DNA, 25 bp, Mus musculus
ggagacacagaattcctgctatcag

SEQ ID NO: 595460 - DNA, 25 bp, Mus musculus
ggagacacagaccacagttgattat

SEQ ID NO: 595461 - DNA, 25 bp, Mus musculus
ggagacacagacgacagttgattat

SEQ ID NO: 595462 - DNA, 25 bp, Mus musculus
ggagacacaggccattaacagcagt

SEQ ID NO: 595463 - DNA, 25 bp, Mus musculus
ggagacacaggcgattaacagcagt

SEQ ID NO: 595464 - DNA, 25 bp, Mus musculus
ggagacacagtcatttccttctgag

SEQ ID NO: 595465 - DNA, 25 bp, Mus musculus
ggagacacagtcttttccttctgag

SEQ ID NO: 595466 - DNA, 25 bp, Mus musculus
ggagacacagttaagtccacttcag

SEQ ID NO: 595467 - DNA, 25 bp, Mus musculus
ggagacacagtttagtccacttcag

SEQ ID NO: 595468 - DNA, 25 bp, Mus musculus
ggagacacattaccgagtccacaca

SEQ ID NO: 595469 - DNA, 25 bp, Mus musculus
ggagacacattagcgagtccacaca

SEQ ID NO: 595470 - DNA, 25 bp, Mus musculus
ggagacaccctcacaggatttgcag

SEQ ID NO: 595471 - DNA, 25 bp, Mus musculus
ggagacaccctctcaggatttgcag

SEQ ID NO: 595472 - DNA, 25 bp, Mus musculus
ggagacacctttacttctgtcggga

SEQ ID NO: 595473 - DNA, 25 bp, Mus musculus
ggagacaccttttcttctgtcggga

SEQ ID NO: 595474 - DNA, 25 bp, Mus musculus
ggagacacgctccacatacactaca

SEQ ID NO: 595475 - DNA, 25 bp, Mus musculus
ggagacacgctcgacatacactaca

SEQ ID NO: 595476 - DNA, 25 bp, Mus musculus
ggagacacgctgcaggacatttaca

SEQ ID NO: 595477 - DNA, 25 bp, Mus musculus
ggagacacgctggaggacatttaca

SEQ ID NO: 595478 - DNA, 25 bp, Mus musculus
ggagacacggaacagcatgctcagt

SEQ ID NO: 595479 - DNA, 25 bp, Mus musculus
ggagacacggaagagcatgctcagt

SEQ ID NO: 595480 - DNA, 25 bp, Mus musculus
ggagacacgtgtcaaaatgctgact

SEQ ID NO: 595481 - DNA, 25 bp, Mus musculus
ggagacacgtgtgaaaatgctgact

SEQ ID NO: 595482 - DNA, 25 bp, Mus musculus
ggagacactagacttcaggccagat

SEQ ID NO: 595483 - DNA, 25 bp, Mus musculus
ggagacactagagttcaggccagat

SEQ ID NO: 595484 - DNA, 25 bp, Mus musculus
ggagacactaggactgactggtaaa

SEQ ID NO: 595485 - DNA, 25 bp, Mus musculus
ggagacactaggtctgactggtaaa

SEQ ID NO: 595486 - DNA, 25 bp, Mus musculus
ggagacactcctataatgaaaacaa

SEQ ID NO: 595487 - DNA, 25 bp, Mus musculus
ggagacactcctttaatgaaaacaa

SEQ ID NO: 595488 - DNA, 25 bp, Mus musculus
ggagacactcttctagctggaagga

SEQ ID NO: 595489 - DNA, 25 bp, Mus musculus
ggagacactcttgtagctggaagga

SEQ ID NO: 595490 - DNA, 25 bp, Mus musculus
ggagacactgacagatgccgagatg

SEQ ID NO: 595491 - DNA, 25 bp, Mus musculus
ggagacactgactgatgccgagatg

SEQ ID NO: 595492 - DNA, 25 bp, Mus musculus
ggagacactttcatcttatgccagt

SEQ ID NO: 595493 - DNA, 25 bp, Mus musculus
ggagacactttcttcttatgccagt

SEQ ID NO: 595494 - DNA, 25 bp, Mus musculus
ggagacagaaaaccgtgtaccagac

SEQ ID NO: 595495 - DNA, 25 bp, Mus musculus
ggagacagaaaagcgtgtaccagac

SEQ ID NO: 595496 - DNA, 25 bp, Mus musculus
ggagacagaagcatcccgcacaaga

SEQ ID NO: 595497 - DNA, 25 bp, Mus musculus
ggagacagaagcttcccgcacaaga

SEQ ID NO: 595498 - DNA, 25 bp, Mus musculus
ggagacagacagacacatatattat

SEQ ID NO: 595499 - DNA, 25 bp, Mus musculus
ggagacagacagtcacatatattat

SEQ ID NO: 595500 - DNA, 25 bp, Mus musculus
ggagacagacatccacactactgtg

SEQ ID NO: 595501 - DNA, 25 bp, Mus musculus
ggagacagacatgcacactactgtg

SEQ ID NO: 595502 - DNA, 25 bp, Mus musculus
ggagacagacggaccagggaacaaa

SEQ ID NO: 595503 - DNA, 25 bp, Mus musculus
ggagacagacggtccagggaacaaa

SEQ ID NO: 595504 - DNA, 25 bp, Mus musculus
ggagacagactcacagatggcaaca

SEQ ID NO: 595505 - DNA, 25 bp, Mus musculus
ggagacagactctcagatggcaaca

SEQ ID NO: 595506 - DNA, 25 bp, Mus musculus
ggagacagactgatggtgccttctt

SEQ ID NO: 595507 - DNA, 25 bp, Mus musculus
ggagacagactgttggtgccttctt

SEQ ID NO: 595508 - DNA, 25 bp, Mus musculus
ggagacagagccatgcttcctctgt

SEQ ID NO: 595509 - DNA, 25 bp, Mus musculus
ggagacagagccttgcttcctctgt

SEQ ID NO: 595510 - DNA, 25 bp, Mus musculus
ggagacagatgtccctgacactgaa

SEQ ID NO: 595511 - DNA, 25 bp, Mus musculus
ggagacagatgtgcctgacactgaa

SEQ ID NO: 595512 - DNA, 25 bp, Mus musculus
ggagacagcatcagcattaccacct

SEQ ID NO: 595513 - DNA, 25 bp, Mus musculus
ggagacagcatctgcattaccacct

SEQ ID NO: 595514 - DNA, 25 bp, Mus musculus
ggagacagcattaactaccaaccca

SEQ ID NO: 595515 - DNA, 25 bp, Mus musculus
ggagacagcatttactaccaaccca

SEQ ID NO: 595516 - DNA, 25 bp, Mus musculus
ggagacagccagacgttcacagagt

SEQ ID NO: 595517 - DNA, 25 bp, Mus musculus
ggagacagccagtcgttcacagagt

SEQ ID NO: 595518 - DNA, 25 bp, Mus musculus
ggagacagccccaaggacgagtcga

SEQ ID NO: 595519 - DNA, 25 bp, Mus musculus
ggagacagcccctaggacgagtcga

SEQ ID NO: 595520 - DNA, 25 bp, Mus musculus
ggagacagcctccaactgaacaaat

SEQ ID NO: 595521 - DNA, 25 bp, Mus musculus
ggagacagcctcgaactgaacaaat

SEQ ID NO: 595522 - DNA, 25 bp, Mus musculus
ggagacagctcaaaggtcacgtaat

SEQ ID NO: 595523 - DNA, 25 bp, Mus musculus
ggagacagctcataggtcacgtaat

SEQ ID NO: 595524 - DNA, 25 bp, Mus musculus
ggagacaggaggatcccccgacgat

SEQ ID NO: 595525 - DNA, 25 bp, Mus musculus
ggagacaggaggttcccccgacgat

SEQ ID NO: 595526 - DNA, 25 bp, Mus musculus
ggagacaggatacttccaccctact

SEQ ID NO: 595527 - DNA, 25 bp, Mus musculus
ggagacaggatagttccaccctact

SEQ ID NO: 595528 - DNA, 25 bp, Mus musculus
ggagacaggcgcaaaagctgccctt

SEQ ID NO: 595529 - DNA, 25 bp, Mus musculus
ggagacaggcgctaaagctgccctt

SEQ ID NO: 595530 - DNA, 25 bp, Mus musculus
ggagacaggctacagttcactgtaa

SEQ ID NO: 595531 - DNA, 25 bp, Mus musculus
ggagacaggctagagttcactgtaa

SEQ ID NO: 595532 - DNA, 25 bp, Mus musculus
ggagacaggtcccagcagcttgcta

SEQ ID NO: 595533 - DNA, 25 bp, Mus musculus
ggagacaggtccgagcagcttgcta

SEQ ID NO: 595534 - DNA, 25 bp, Mus musculus
ggagacagtcatatgctgacctgga

SEQ ID NO: 595535 - DNA, 25 bp, Mus musculus
ggagacagtcatttgctgacctgga

SEQ ID NO: 595536 - DNA, 25 bp, Mus musculus
ggagacagtgacacagcgccctgga

SEQ ID NO: 595537 - DNA, 25 bp, Mus musculus
ggagacagtgactcagcgccctgga

SEQ ID NO: 595538 - DNA, 25 bp, Mus musculus
ggagacagtgataccacggccgcca

SEQ ID NO: 595539 - DNA, 25 bp, Mus musculus
ggagacagtgatcatccatctgatg

SEQ ID NO: 595540 - DNA, 25 bp, Mus musculus
ggagacagtgatgatccatctgatg

SEQ ID NO: 595541 - DNA, 25 bp, Mus musculus
ggagacagtgattccacggccgcca

SEQ ID NO: 595542 - DNA, 25 bp, Mus musculus
ggagacataacaaccctgaatattt

SEQ ID NO: 595543 - DNA, 25 bp, Mus musculus
ggagacataacatccctgaatattt

SEQ ID NO: 595544 - DNA, 25 bp, Mus musculus
ggagacataaccctctgtttggcga

SEQ ID NO: 595545 - DNA, 25 bp, Mus musculus
ggagacataaccgtctgtttggcga

SEQ ID NO: 595546 - DNA, 25 bp, Mus musculus
ggagacatactactagtaaggaaag

SEQ ID NO: 595547 - DNA, 25 bp, Mus musculus
ggagacatactagtagtaaggaaag

SEQ ID NO: 595548 - DNA, 25 bp, Mus musculus
ggagacatagtaactttgtgttgca

SEQ ID NO: 595549 - DNA, 25 bp, Mus musculus
ggagacatagtatctttgtgttgca

SEQ ID NO: 595550 - DNA, 25 bp, Mus musculus
ggagacatcaaacccctaggcagtg

SEQ ID NO: 595551 - DNA, 25 bp, Mus musculus
ggagacatcaaagccctaggcagtg

SEQ ID NO: 595552 - DNA, 25 bp, Mus musculus
ggagacatcaccctatactgcgaaa

SEQ ID NO: 595553 - DNA, 25 bp, Mus musculus
ggagacatcaccgtatactgcgaaa

SEQ ID NO: 595554 - DNA, 25 bp, Mus musculus
ggagacatcactaccacagaaacgt

SEQ ID NO: 595555 - DNA, 25 bp, Mus musculus
ggagacatcacttccacagaaacgt

SEQ ID NO: 595556 - DNA, 25 bp, Mus musculus
ggagacatccaacaaatgggctgct

SEQ ID NO: 595557 - DNA, 25 bp, Mus musculus
ggagacatccaagaaatgggctgct

SEQ ID NO: 595558 - DNA, 25 bp, Mus musculus
ggagacatcggactatctttggaat

SEQ ID NO: 595559 - DNA, 25 bp, Mus musculus
ggagacatcggagtatctttggaat

SEQ ID NO: 595560 - DNA, 25 bp, Mus musculus
ggagacatcgtgaccgtccatgaga

SEQ ID NO: 595561 - DNA, 25 bp, Mus musculus
ggagacatcgtgtccgtccatgaga

SEQ ID NO: 595562 - DNA, 25 bp, Mus musculus
ggagacatgatgacctttctcatga

SEQ ID NO: 595563 - DNA, 25 bp, Mus musculus
ggagacatgatgagtgccttgttaa

SEQ ID NO: 595564 - DNA, 25 bp, Mus musculus
ggagacatgatgtcctttctcatga

SEQ ID NO: 595565 - DNA, 25 bp, Mus musculus
ggagacatgatgtgtgccttgttaa

SEQ ID NO: 595566 - DNA, 25 bp, Mus musculus
ggagacatggccctgggtattacca

SEQ ID NO: 595567 - DNA, 25 bp, Mus musculus
ggagacatggccgtgggtattacca

SEQ ID NO: 595568 - DNA, 25 bp, Mus musculus
ggagacatggttagcgctggcactc

SEQ ID NO: 595569 - DNA, 25 bp, Mus musculus
ggagacatggttccaactaccattg

SEQ ID NO: 595570 - DNA, 25 bp, Mus musculus
ggagacatggttgcaactaccattg

SEQ ID NO: 595571 - DNA, 25 bp, Mus musculus
ggagacatggtttgcgctggcactc

SEQ ID NO: 595572 - DNA, 25 bp, Mus musculus
ggagacattattctttatgccttag

SEQ ID NO: 595573 - DNA, 25 bp, Mus musculus
ggagacattattgtttatgccttag

SEQ ID NO: 595574 - DNA, 25 bp, Mus musculus
ggagacattcaaacagacgtgacta

SEQ ID NO: 595575 - DNA, 25 bp, Mus musculus
ggagacattcaatcagacgtgacta

SEQ ID NO: 595576 - DNA, 25 bp, Mus musculus
ggagacattgaaccattagacacta

SEQ ID NO: 595577 - DNA, 25 bp, Mus musculus
ggagacattgaagcattagacacta

SEQ ID NO: 595578 - DNA, 25 bp, Mus musculus
ggagacattgtcacagttggagagt

SEQ ID NO: 595579 - DNA, 25 bp, Mus musculus
ggagacattgtctcagttggagagt

SEQ ID NO: 595580 - DNA, 25 bp, Mus musculus
ggagacatttataggcaatacccat

SEQ ID NO: 595581 - DNA, 25 bp, Mus musculus
ggagacatttattggcaatacccat

SEQ ID NO: 595582 - DNA, 25 bp, Mus musculus
ggagacatttccatattgcagccag

SEQ ID NO: 595583 - DNA, 25 bp, Mus musculus
ggagacatttccttattgcagccag

SEQ ID NO: 595584 - DNA, 25 bp, Mus musculus
ggagacatttctactggtaccttac

SEQ ID NO: 595585 - DNA, 25 bp, Mus musculus
ggagacatttctctcagagaaattg

SEQ ID NO: 595586 - DNA, 25 bp, Mus musculus
ggagacatttctgtcagagaaattg

SEQ ID NO: 595587 - DNA, 25 bp, Mus musculus
ggagacatttcttctggtaccttac

SEQ ID NO: 595588 - DNA, 25 bp, Mus musculus
ggagacatttttacccagtgaacca

SEQ ID NO: 595589 - DNA, 25 bp, Mus musculus
ggagacattttttcccagtgaacca

SEQ ID NO: 595590 - DNA, 25 bp, Mus musculus
ggagaccaaattacccacttgtgag

SEQ ID NO: 595591 - DNA, 25 bp, Mus musculus
ggagaccaaatttcccacttgtgag

SEQ ID NO: 595592 - DNA, 25 bp, Mus musculus
ggagaccaacaaacattacacagct

SEQ ID NO: 595593 - DNA, 25 bp, Mus musculus
ggagaccaacaatcattacacagct

SEQ ID NO: 595594 - DNA, 25 bp, Mus musculus
ggagaccaaccaaagtgctgaccct

SEQ ID NO: 595595 - DNA, 25 bp, Mus musculus
ggagaccaaccatagtgctgaccct

SEQ ID NO: 595596 - DNA, 25 bp, Mus musculus
ggagaccaactgaacttaccgattc

SEQ ID NO: 595597 - DNA, 25 bp, Mus musculus
ggagaccaactgtacttaccgattc

SEQ ID NO: 595598 - DNA, 25 bp, Mus musculus
ggagaccaagccagcaggacgtgaa

SEQ ID NO: 595599 - DNA, 25 bp, Mus musculus
ggagaccaagcctgcaggacgtgaa

SEQ ID NO: 595600 - DNA, 25 bp, Mus musculus
ggagaccaaggcactgcaacaccag

SEQ ID NO: 595601 - DNA, 25 bp, Mus musculus
ggagaccaaggcattccctgaatat

SEQ ID NO: 595602 - DNA, 25 bp, Mus musculus
ggagaccaaggctctgcaacaccag

SEQ ID NO: 595603 - DNA, 25 bp, Mus musculus
ggagaccaaggctttccctgaatat

SEQ ID NO: 595604 - DNA, 25 bp, Mus musculus
ggagaccaaggtccctagcacagat

SEQ ID NO: 595605 - DNA, 25 bp, Mus musculus
ggagaccaaggtgcctagcacagat

SEQ ID NO: 595606 - DNA, 25 bp, Mus musculus
ggagaccacagcatggcccagcagt

SEQ ID NO: 595607 - DNA, 25 bp, Mus musculus
ggagaccacagcttggcccagcagt

SEQ ID NO: 595608 - DNA, 25 bp, Mus musculus
ggagaccacagtagtattctggaac

SEQ ID NO: 595609 - DNA, 25 bp, Mus musculus
ggagaccacagttgtattctggaac

SEQ ID NO: 595610 - DNA, 25 bp, Mus musculus
ggagaccacgagaggttacccatca

SEQ ID NO: 595611 - DNA, 25 bp, Mus musculus
ggagaccacgagtggttacccatca

SEQ ID NO: 595612 - DNA, 25 bp, Mus musculus
ggagaccagagaccttactagagaa

SEQ ID NO: 595613 - DNA, 25 bp, Mus musculus
ggagaccagagagcttactagagaa

SEQ ID NO: 595614 - DNA, 25 bp, Mus musculus
ggagaccagcagctaaccttagtta

SEQ ID NO: 595615 - DNA, 25 bp, Mus musculus
ggagaccagcaggtaaccttagtta

SEQ ID NO: 595616 - DNA, 25 bp, Mus musculus
ggagaccagccacaaccaagcagac

SEQ ID NO: 595617 - DNA, 25 bp, Mus musculus
ggagaccagccagaaccaagcagac

SEQ ID NO: 595618 - DNA, 25 bp, Mus musculus
ggagaccaggcccttattaaagcat

SEQ ID NO: 595619 - DNA, 25 bp, Mus musculus
ggagaccaggccgttattaaagcat

SEQ ID NO: 595620 - DNA, 25 bp, Mus musculus
ggagaccagtcccaggaaccatttt

SEQ ID NO: 595621 - DNA, 25 bp, Mus musculus
ggagaccagtccgaggaaccatttt

SEQ ID NO: 595622 - DNA, 25 bp, Mus musculus
ggagaccagtggaaatgagtatcat

SEQ ID NO: 595623 - DNA, 25 bp, Mus musculus
ggagaccagtggtaatgagtatcat

SEQ ID NO: 595624 - DNA, 25 bp, Mus musculus
ggagaccatctcaaacagaggttac

SEQ ID NO: 595625 - DNA, 25 bp, Mus musculus
ggagaccatctcagatgtcctgaat

SEQ ID NO: 595626 - DNA, 25 bp, Mus musculus
ggagaccatctctaacagaggttac

SEQ ID NO: 595627 - DNA, 25 bp, Mus musculus
ggagaccatctctgatgtcctgaat

SEQ ID NO: 595628 - DNA, 25 bp, Mus musculus
ggagaccatctgcaggtacaacttg

SEQ ID NO: 595629 - DNA, 25 bp, Mus musculus
ggagaccatctggaggtacaacttg

SEQ ID NO: 595630 - DNA, 25 bp, Mus musculus
ggagaccatgctacggttgttttat

SEQ ID NO: 595631 - DNA, 25 bp, Mus musculus
ggagaccatgcttcggttgttttat

SEQ ID NO: 595632 - DNA, 25 bp, Mus musculus
ggagaccatggccaacaactgattt

SEQ ID NO: 595633 - DNA, 25 bp, Mus musculus
ggagaccatggcgaacaactgattt

SEQ ID NO: 595634 - DNA, 25 bp, Mus musculus
ggagaccattcaatatcattttcat

SEQ ID NO: 595635 - DNA, 25 bp, Mus musculus
ggagaccattcattatcattttcat

SEQ ID NO: 595636 - DNA, 25 bp, Mus musculus
ggagaccattgccaacaactagatc

SEQ ID NO: 595637 - DNA, 25 bp, Mus musculus
ggagaccattgcgaacaactagatc

SEQ ID NO: 595638 - DNA, 25 bp, Mus musculus
ggagaccatttccaaggcaccttta

SEQ ID NO: 595639 - DNA, 25 bp, Mus musculus
ggagaccatttcgaaggcaccttta

SEQ ID NO: 595640 - DNA, 25 bp, Mus musculus
ggagacccaaacaagacactattag

SEQ ID NO: 595641 - DNA, 25 bp, Mus musculus
ggagacccaaactagacactattag

SEQ ID NO: 595642 - DNA, 25 bp, Mus musculus
ggagacccaaagacatctggccaca

SEQ ID NO: 595643 - DNA, 25 bp, Mus musculus
ggagacccaaagacctcacgaacat

SEQ ID NO: 595644 - DNA, 25 bp, Mus musculus
ggagacccaaagtcatctggccaca

SEQ ID NO: 595645 - DNA, 25 bp, Mus musculus
ggagacccaaagtcctcacgaacat

SEQ ID NO: 595646 - DNA, 25 bp, Mus musculus
ggagacccacttatcattatcatta

SEQ ID NO: 595647 - DNA, 25 bp, Mus musculus
ggagacccacttttcattatcatta

SEQ ID NO: 595648 - DNA, 25 bp, Mus musculus
ggagacccagagctcatagacacat

SEQ ID NO: 595649 - DNA, 25 bp, Mus musculus
ggagacccagaggtcatagacacat

SEQ ID NO: 595650 - DNA, 25 bp, Mus musculus
ggagacccagtcatgtcaatgcaat

SEQ ID NO: 595651 - DNA, 25 bp, Mus musculus
ggagacccagtcttgtcaatgcaat

SEQ ID NO: 595652 - DNA, 25 bp, Mus musculus
ggagacccagtgctctgactttgat

SEQ ID NO: 595653 - DNA, 25 bp, Mus musculus
ggagacccagtggtctgactttgat

SEQ ID NO: 595654 - DNA, 25 bp, Mus musculus
ggagacccatgaactgaaacttcag

SEQ ID NO: 595655 - DNA, 25 bp, Mus musculus
ggagacccatgatctgaaacttcag

SEQ ID NO: 595656 - DNA, 25 bp, Mus musculus
ggagacccatgcatccctgtctgga

SEQ ID NO: 595657 - DNA, 25 bp, Mus musculus
ggagacccatgcttccctgtctgga

SEQ ID NO: 595658 - DNA, 25 bp, Mus musculus
ggagacccatggcacgtgttctttc

SEQ ID NO: 595659 - DNA, 25 bp, Mus musculus
ggagacccatgggacgtgttctttc

SEQ ID NO: 595660 - DNA, 25 bp, Mus musculus
ggagacccatttagtcattgattca

SEQ ID NO: 595661 - DNA, 25 bp, Mus musculus
ggagacccattttgtcattgattca

SEQ ID NO: 595662 - DNA, 25 bp, Mus musculus
ggagaccccactccaagactagagt

SEQ ID NO: 595663 - DNA, 25 bp, Mus musculus
ggagaccccactgcaagactagagt

SEQ ID NO: 595664 - DNA, 25 bp, Mus musculus
ggagaccccagcagtcaaatactac

SEQ ID NO: 595665 - DNA, 25 bp, Mus musculus
ggagaccccagctgtcaaatactac

SEQ ID NO: 595666 - DNA, 25 bp, Mus musculus
ggagaccccgagagccatctcttct

SEQ ID NO: 595667 - DNA, 25 bp, Mus musculus
ggagaccccgagtgccatctcttct

SEQ ID NO: 595668 - DNA, 25 bp, Mus musculus
ggagacccctctccctgtgcttgag

SEQ ID NO: 595669 - DNA, 25 bp, Mus musculus
ggagacccctctgcctgtgcttgag

SEQ ID NO: 595670 - DNA, 25 bp, Mus musculus
ggagacccctgaaatttgacacaca

SEQ ID NO: 595671 - DNA, 25 bp, Mus musculus
ggagacccctgatatttgacacaca

SEQ ID NO: 595672 - DNA, 25 bp, Mus musculus
ggagaccccttcagagatggaaagt

SEQ ID NO: 595673 - DNA, 25 bp, Mus musculus
ggagaccccttccaaatgactgtga

SEQ ID NO: 595674 - DNA, 25 bp, Mus musculus
ggagaccccttcgaaatgactgtga

SEQ ID NO: 595675 - DNA, 25 bp, Mus musculus
ggagaccccttctgagatggaaagt

SEQ ID NO: 595676 - DNA, 25 bp, Mus musculus
ggagaccctcagagcaagatctgca

SEQ ID NO: 595677 - DNA, 25 bp, Mus musculus
ggagaccctcagtgcaagatctgca

SEQ ID NO: 595678 - DNA, 25 bp, Mus musculus
ggagaccctgccaatgacgctgttg

SEQ ID NO: 595679 - DNA, 25 bp, Mus musculus
ggagaccctgcctatgacgctgttg

SEQ ID NO: 595680 - DNA, 25 bp, Mus musculus
ggagaccctggcaaagcaaacccca

SEQ ID NO: 595681 - DNA, 25 bp, Mus musculus
ggagaccctggctaagcaaacccca

SEQ ID NO: 595682 - DNA, 25 bp, Mus musculus
ggagaccctgtactgatttaaacct

SEQ ID NO: 595683 - DNA, 25 bp, Mus musculus
ggagaccctgtagtgatttaaacct

SEQ ID NO: 595684 - DNA, 25 bp, Mus musculus
ggagacccttctactctgtggtgca

SEQ ID NO: 595685 - DNA, 25 bp, Mus musculus
ggagacccttcttctctgtggtgca

SEQ ID NO: 595686 - DNA, 25 bp, Mus musculus
ggagaccgcgacagctcacagcaga

SEQ ID NO: 595687 - DNA, 25 bp, Mus musculus
ggagaccgcgactgctcacagcaga

SEQ ID NO: 595688 - DNA, 25 bp, Mus musculus
ggagaccggagtaaactatgcgcgt

SEQ ID NO: 595689 - DNA, 25 bp, Mus musculus
ggagaccggagttaactatgcgcgt

SEQ ID NO: 595690 - DNA, 25 bp, Mus musculus
ggagaccgtgtcatatcactgggta

SEQ ID NO: 595691 - DNA, 25 bp, Mus musculus
ggagaccgtgtcttatcactgggta

SEQ ID NO: 595692 - DNA, 25 bp, Mus musculus
ggagaccgtgttatgaaccgcatca

SEQ ID NO: 595693 - DNA, 25 bp, Mus musculus
ggagaccgtgttttgaaccgcatca

SEQ ID NO: 595694 - DNA, 25 bp, Mus musculus
ggagacctacaaactatctgcaagc

SEQ ID NO: 595695 - DNA, 25 bp, Mus musculus
ggagacctacaatctatctgcaagc

SEQ ID NO: 595696 - DNA, 25 bp, Mus musculus
ggagacctacctcagattaagtgct

SEQ ID NO: 595697 - DNA, 25 bp, Mus musculus
ggagacctacctgagattaagtgct

SEQ ID NO: 595698 - DNA, 25 bp, Mus musculus
ggagacctagccaggagcttgcttg

SEQ ID NO: 595699 - DNA, 25 bp, Mus musculus
ggagacctagcctggagcttgcttg

SEQ ID NO: 595700 - DNA, 25 bp, Mus musculus
ggagacctcaaaccttgattctata

SEQ ID NO: 595701 - DNA, 25 bp, Mus musculus
ggagacctcaaagcttgattctata

SEQ ID NO: 595702 - DNA, 25 bp, Mus musculus
ggagacctcacaacatgttcacatt

SEQ ID NO: 595703 - DNA, 25 bp, Mus musculus
ggagacctcacatcatgttcacatt

SEQ ID NO: 595704 - DNA, 25 bp, Mus musculus
ggagacctcactagtaccagcaaaa

SEQ ID NO: 595705 - DNA, 25 bp, Mus musculus
ggagacctcacttgtaccagcaaaa

SEQ ID NO: 595706 - DNA, 25 bp, Mus musculus
ggagacctcagcagatattttgacc

SEQ ID NO: 595707 - DNA, 25 bp, Mus musculus
ggagacctcagctgatattttgacc

SEQ ID NO: 595708 - DNA, 25 bp, Mus musculus
ggagacctcagtcatttttcaatga

SEQ ID NO: 595709 - DNA, 25 bp, Mus musculus
ggagacctcagtgatttttcaatga

SEQ ID NO: 595710 - DNA, 25 bp, Mus musculus
ggagacctcatacatgttacaagtt

SEQ ID NO: 595711 - DNA, 25 bp, Mus musculus
ggagacctcatagatgttacaagtt

SEQ ID NO: 595712 - DNA, 25 bp, Mus musculus
ggagacctcccacagaaggattcag

SEQ ID NO: 595713 - DNA, 25 bp, Mus musculus
ggagacctcccagagaaggattcag

SEQ ID NO: 595714 - DNA, 25 bp, Mus musculus
ggagacctcgggatcctttatcggt

SEQ ID NO: 595715 - DNA, 25 bp, Mus musculus
ggagacctcgggttcctttatcggt

SEQ ID NO: 595716 - DNA, 25 bp, Mus musculus
ggagacctctaactcttctgtggag

SEQ ID NO: 595717 - DNA, 25 bp, Mus musculus
ggagacctctaagtcttctgtggag

SEQ ID NO: 595718 - DNA, 25 bp, Mus musculus
ggagacctctatctgcattcaaagc

SEQ ID NO: 595719 - DNA, 25 bp, Mus musculus
ggagacctctatgtgcattcaaagc

SEQ ID NO: 595720 - DNA, 25 bp, Mus musculus
ggagacctgaacctcgcttcagact

SEQ ID NO: 595721 - DNA, 25 bp, Mus musculus
ggagacctgaacgtcgcttcagact

SEQ ID NO: 595722 - DNA, 25 bp, Mus musculus
ggagacctgaatcatgcagccatga

SEQ ID NO: 595723 - DNA, 25 bp, Mus musculus
ggagacctgaatgatgcagccatga

SEQ ID NO: 595724 - DNA, 25 bp, Mus musculus
ggagacctgcatatgctaactcatg

SEQ ID NO: 595725 - DNA, 25 bp, Mus musculus
ggagacctgcatttgctaactcatg

SEQ ID NO: 595726 - DNA, 25 bp, Mus musculus
ggagaccttatccagtgggcctgac

SEQ ID NO: 595727 - DNA, 25 bp, Mus musculus
ggagaccttatcgagtgggcctgac

SEQ ID NO: 595728 - DNA, 25 bp, Mus musculus
ggagaccttcaccttttgccaggag

SEQ ID NO: 595729 - DNA, 25 bp, Mus musculus
ggagaccttcacgttttgccaggag

SEQ ID NO: 595730 - DNA, 25 bp, Mus musculus
ggagaccttctgactgtcctaagat

SEQ ID NO: 595731 - DNA, 25 bp, Mus musculus
ggagaccttctgagaactccacgag

SEQ ID NO: 595732 - DNA, 25 bp, Mus musculus
ggagaccttctgtctgtcctaagat

SEQ ID NO: 595733 - DNA, 25 bp, Mus musculus
ggagaccttctgtgaactccacgag

SEQ ID NO: 595734 - DNA, 25 bp, Mus musculus
ggagaccttgctctgctctgatgcc

SEQ ID NO: 595735 - DNA, 25 bp, Mus musculus
ggagaccttgctgtgctctgatgcc

SEQ ID NO: 595736 - DNA, 25 bp, Mus musculus
ggagaccttgttaccctgggagttg

SEQ ID NO: 595737 - DNA, 25 bp, Mus musculus
ggagaccttgtttccctgggagttg

SEQ ID NO: 595738 - DNA, 25 bp, Mus musculus
ggagacctttacctgaggagcctta

SEQ ID NO: 595739 - DNA, 25 bp, Mus musculus
ggagacctttacgtgaggagcctta

SEQ ID NO: 595740 - DNA, 25 bp, Mus musculus
ggagacctttgtcagcagttcaact

SEQ ID NO: 595741 - DNA, 25 bp, Mus musculus
ggagacctttgtgagcagttcaact

SEQ ID NO: 595742 - DNA, 25 bp, Mus musculus
ggagacgacatacaggttccttatg

SEQ ID NO: 595743 - DNA, 25 bp, Mus musculus
ggagacgacatagaggttccttatg

SEQ ID NO: 595744 - DNA, 25 bp, Mus musculus
ggagacgaccgcaaacagcttgatg

SEQ ID NO: 595745 - DNA, 25 bp, Mus musculus
ggagacgaccgctaacagcttgatg

SEQ ID NO: 595746 - DNA, 25 bp, Mus musculus
ggagacgactccaagcactaaaaac

SEQ ID NO: 595747 - DNA, 25 bp, Mus musculus
ggagacgactcctagcactaaaaac

SEQ ID NO: 595748 - DNA, 25 bp, Mus musculus
ggagacgactctcctagtagcttct

SEQ ID NO: 595749 - DNA, 25 bp, Mus musculus
ggagacgactctgctagtagcttct

SEQ ID NO: 595750 - DNA, 25 bp, Mus musculus
ggagacgagaatacctgctctgtct

SEQ ID NO: 595751 - DNA, 25 bp, Mus musculus
ggagacgagaattcctgctctgtct

SEQ ID NO: 595752 - DNA, 25 bp, Mus musculus
ggagacgagcagaggcagctatata

SEQ ID NO: 595753 - DNA, 25 bp, Mus musculus
ggagacgagcagtggcagctatata

SEQ ID NO: 595754 - DNA, 25 bp, Mus musculus
ggagacgatgatatgaagcgaacca

SEQ ID NO: 595755 - DNA, 25 bp, Mus musculus
ggagacgatgatttgaagcgaacca

SEQ ID NO: 595756 - DNA, 25 bp, Mus musculus
ggagacgcagaccacatcaacgact

SEQ ID NO: 595757 - DNA, 25 bp, Mus musculus
ggagacgcagacgacatcaacgact

SEQ ID NO: 595758 - DNA, 25 bp, Mus musculus
ggagacgcaggtcaaaatttggttc

SEQ ID NO: 595759 - DNA, 25 bp, Mus musculus
ggagacgcaggtgaaaatttggttc

SEQ ID NO: 595760 - DNA, 25 bp, Mus musculus
ggagacgcggatctcatcatagcac

SEQ ID NO: 595761 - DNA, 25 bp, Mus musculus
ggagacgcggatgtcatcatagcac

SEQ ID NO: 595762 - DNA, 25 bp, Mus musculus
ggagacgctcaacaagttcaacttc

SEQ ID NO: 595763 - DNA, 25 bp, Mus musculus
ggagacgctcaagaagttcaacttc

SEQ ID NO: 595764 - DNA, 25 bp, Mus musculus
ggagacgctcatcccttaggtaaga

SEQ ID NO: 595765 - DNA, 25 bp, Mus musculus
ggagacgctcatgccttaggtaaga

SEQ ID NO: 595766 - DNA, 25 bp, Mus musculus
ggagacggaaataatccattacaga

SEQ ID NO: 595767 - DNA, 25 bp, Mus musculus
ggagacggaaattatccattacaga

SEQ ID NO: 595768 - DNA, 25 bp, Mus musculus
ggagacggagatcacgacgcaaccc

SEQ ID NO: 595769 - DNA, 25 bp, Mus musculus
ggagacggagatgacgacgcaaccc

SEQ ID NO: 595770 - DNA, 25 bp, Mus musculus
ggagacggatgccaaaagcctaact

SEQ ID NO: 595771 - DNA, 25 bp, Mus musculus
ggagacggatgcgaaaagcctaact

SEQ ID NO: 595772 - DNA, 25 bp, Mus musculus
ggagacggcaacaaatcagcagcaa

SEQ ID NO: 595773 - DNA, 25 bp, Mus musculus
ggagacggcaactaatcagcagcaa

SEQ ID NO: 595774 - DNA, 25 bp, Mus musculus
ggagacggcatccttgatttacaag

SEQ ID NO: 595775 - DNA, 25 bp, Mus musculus
ggagacggcatcgttgatttacaag

SEQ ID NO: 595776 - DNA, 25 bp, Mus musculus
ggagacggcattatcttgttctggg

SEQ ID NO: 595777 - DNA, 25 bp, Mus musculus
ggagacggcattttcttgttctggg

SEQ ID NO: 595778 - DNA, 25 bp, Mus musculus
ggagacggcgacagggcttttcctc

SEQ ID NO: 595779 - DNA, 25 bp, Mus musculus
ggagacggcgactgggcttttcctc

SEQ ID NO: 595780 - DNA, 25 bp, Mus musculus
ggagacggctgtactgtccatggca

SEQ ID NO: 595781 - DNA, 25 bp, Mus musculus
ggagacggctgttctgtccatggca

SEQ ID NO: 595782 - DNA, 25 bp, Mus musculus
ggagacgggaatctctgccagctca

SEQ ID NO: 595783 - DNA, 25 bp, Mus musculus
ggagacgggaatgtctgccagctca

SEQ ID NO: 595784 - DNA, 25 bp, Mus musculus
ggagacggtttaattggatcttcca

SEQ ID NO: 595785 - DNA, 25 bp, Mus musculus
ggagacggtttatttggatcttcca

SEQ ID NO: 595786 - DNA, 25 bp, Mus musculus
ggagacgtgcagctggttcactttc

SEQ ID NO: 595787 - DNA, 25 bp, Mus musculus
ggagacgtgcaggtggttcactttc

SEQ ID NO: 595788 - DNA, 25 bp, Mus musculus
ggagacgtgctcactacagagaagc

SEQ ID NO: 595789 - DNA, 25 bp, Mus musculus
ggagacgtgctctctacagagaagc

SEQ ID NO: 595790 - DNA, 25 bp, Mus musculus
ggagacgtggacagttagacctttc

SEQ ID NO: 595791 - DNA, 25 bp, Mus musculus
ggagacgtggactgttagacctttc

SEQ ID NO: 595792 - DNA, 25 bp, Mus musculus
ggagacgtgtaacattgtgtagcct

SEQ ID NO: 595793 - DNA, 25 bp, Mus musculus
ggagacgtgtaagattgtgtagcct

SEQ ID NO: 595794 - DNA, 25 bp, Mus musculus
ggagacgtgtgcacacccagagcaa

SEQ ID NO: 595795 - DNA, 25 bp, Mus musculus
ggagacgtgtgccctgtcccttcct

SEQ ID NO: 595796 - DNA, 25 bp, Mus musculus
ggagacgtgtgcgctgtcccttcct

SEQ ID NO: 595797 - DNA, 25 bp, Mus musculus
ggagacgtgtgctcacccagagcaa

SEQ ID NO: 595798 - DNA, 25 bp, Mus musculus
ggagactaaatccagggcctagcca

SEQ ID NO: 595799 - DNA, 25 bp, Mus musculus
ggagactaaatcgagggcctagcca

SEQ ID NO: 595800 - DNA, 25 bp, Mus musculus
ggagactacagaaccgtgctcttga

SEQ ID NO: 595801 - DNA, 25 bp, Mus musculus
ggagactacagatccgtgctcttga

SEQ ID NO: 595802 - DNA, 25 bp, Mus musculus
ggagactacctgatccaggttgtca

SEQ ID NO: 595803 - DNA, 25 bp, Mus musculus
ggagactacctgttccaggttgtca

SEQ ID NO: 595804 - DNA, 25 bp, Mus musculus
ggagactagccaccagtgagccctg

SEQ ID NO: 595805 - DNA, 25 bp, Mus musculus
ggagactagccagcagtgagccctg

SEQ ID NO: 595806 - DNA, 25 bp, Mus musculus
ggagactataaaacgccagccaatc

SEQ ID NO: 595807 - DNA, 25 bp, Mus musculus
ggagactataaatcgccagccaatc

SEQ ID NO: 595808 - DNA, 25 bp, Mus musculus
ggagactatactaacttgcgaatca

SEQ ID NO: 595809 - DNA, 25 bp, Mus musculus
ggagactatacttacttgcgaatca

SEQ ID NO: 595810 - DNA, 25 bp, Mus musculus
ggagactatcacagtcactctatat

SEQ ID NO: 595811 - DNA, 25 bp, Mus musculus
ggagactatcactgtcactctatat

SEQ ID NO: 595812 - DNA, 25 bp, Mus musculus
ggagactatccaacccaaaaatcaa

SEQ ID NO: 595813 - DNA, 25 bp, Mus musculus
ggagactatccatcccaaaaatcaa

SEQ ID NO: 595814 - DNA, 25 bp, Mus musculus
ggagactatctcatctaaccttgta

SEQ ID NO: 595815 - DNA, 25 bp, Mus musculus
ggagactatctcttctaaccttgta

SEQ ID NO: 595816 - DNA, 25 bp, Mus musculus
ggagactatgtcatgtgtgtcagtt

SEQ ID NO: 595817 - DNA, 25 bp, Mus musculus
ggagactatgtcttgtgtgtcagtt

SEQ ID NO: 595818 - DNA, 25 bp, Mus musculus
ggagactattacattcctctataaa

SEQ ID NO: 595819 - DNA, 25 bp, Mus musculus
ggagactattactttcctctataaa

SEQ ID NO: 595820 - DNA, 25 bp, Mus musculus
ggagactatttgatcgaaccgcatt

SEQ ID NO: 595821 - DNA, 25 bp, Mus musculus
ggagactatttgttcgaaccgcatt

SEQ ID NO: 595822 - DNA, 25 bp, Mus musculus
ggagactcaatcaaatttgcttctg

SEQ ID NO: 595823 - DNA, 25 bp, Mus musculus
ggagactcaatctaatttgcttctg

SEQ ID NO: 595824 - DNA, 25 bp, Mus musculus
ggagactcactccagatgttccaca

SEQ ID NO: 595825 - DNA, 25 bp, Mus musculus
ggagactcactcgagatgttccaca

SEQ ID NO: 595826 - DNA, 25 bp, Mus musculus
ggagactcagcactgtacctctgtg

SEQ ID NO: 595827 - DNA, 25 bp, Mus musculus
ggagactcagcagtgtacctctgtg

SEQ ID NO: 595828 - DNA, 25 bp, Mus musculus
ggagactcaggacgcccactgatct

SEQ ID NO: 595829 - DNA, 25 bp, Mus musculus
ggagactcaggaggcccactgatct

SEQ ID NO: 595830 - DNA, 25 bp, Mus musculus
ggagactcagtcagtggcttcctgc

SEQ ID NO: 595831 - DNA, 25 bp, Mus musculus
ggagactcagtctgtggcttcctgc

SEQ ID NO: 595832 - DNA, 25 bp, Mus musculus
ggagactcagtgatccctgtagcgc

SEQ ID NO: 595833 - DNA, 25 bp, Mus musculus
ggagactcagtgttccctgtagcgc

SEQ ID NO: 595834 - DNA, 25 bp, Mus musculus
ggagactcattcaggccagttttgc

SEQ ID NO: 595835 - DNA, 25 bp, Mus musculus
ggagactcattctggccagttttgc

SEQ ID NO: 595836 - DNA, 25 bp, Mus musculus
ggagactccaaccaacaacatgatg

SEQ ID NO: 595837 - DNA, 25 bp, Mus musculus
ggagactccaacgaacaacatgatg

SEQ ID NO: 595838 - DNA, 25 bp, Mus musculus
ggagactccaggctttcacaggaaa

SEQ ID NO: 595839 - DNA, 25 bp, Mus musculus
ggagactccagggtttcacaggaaa

SEQ ID NO: 595840 - DNA, 25 bp, Mus musculus
ggagactccagtatctgactctgcc

SEQ ID NO: 595841 - DNA, 25 bp, Mus musculus
ggagactccagtttctgactctgcc

SEQ ID NO: 595842 - DNA, 25 bp, Mus musculus
ggagactccatcagtcttagaggaa

SEQ ID NO: 595843 - DNA, 25 bp, Mus musculus
ggagactccatctgtcttagaggaa

SEQ ID NO: 595844 - DNA, 25 bp, Mus musculus
ggagactcctctcgctgggaaccca

SEQ ID NO: 595845 - DNA, 25 bp, Mus musculus
ggagactcctctggctgggaaccca

SEQ ID NO: 595846 - DNA, 25 bp, Mus musculus
ggagactcctgaaaactgtcttcag

SEQ ID NO: 595847 - DNA, 25 bp, Mus musculus
ggagactcctgacttaacactggga

SEQ ID NO: 595848 - DNA, 25 bp, Mus musculus
ggagactcctgagttaacactggga

SEQ ID NO: 595849 - DNA, 25 bp, Mus musculus
ggagactcctgataactgtcttcag

SEQ ID NO: 595850 - DNA, 25 bp, Mus musculus
ggagactcgcatatcaagcctgcag

SEQ ID NO: 595851 - DNA, 25 bp, Mus musculus
ggagactcgcatttcaagcctgcag

SEQ ID NO: 595852 - DNA, 25 bp, Mus musculus
ggagactcgcttcgagggtccactt

SEQ ID NO: 595853 - DNA, 25 bp, Mus musculus
ggagactcgcttggagggtccactt

SEQ ID NO: 595854 - DNA, 25 bp, Mus musculus
ggagactctaataacctcttatttt

SEQ ID NO: 595855 - DNA, 25 bp, Mus musculus
ggagactctaattacctcttatttt

SEQ ID NO: 595856 - DNA, 25 bp, Mus musculus
ggagactctcaacggctttgcgttc

SEQ ID NO: 595857 - DNA, 25 bp, Mus musculus
ggagactctcaagggctttgcgttc

SEQ ID NO: 595858 - DNA, 25 bp, Mus musculus
ggagactctgccagcaaattcctta

SEQ ID NO: 595859 - DNA, 25 bp, Mus musculus
ggagactctgcctgcaaattcctta

SEQ ID NO: 595860 - DNA, 25 bp, Mus musculus
ggagactctggaattacagccctgc

SEQ ID NO: 595861 - DNA, 25 bp, Mus musculus
ggagactctggacattagctagttt

SEQ ID NO: 595862 - DNA, 25 bp, Mus musculus
ggagactctggagattagctagttt

SEQ ID NO: 595863 - DNA, 25 bp, Mus musculus
ggagactctggatttacagccctgc

SEQ ID NO: 595864 - DNA, 25 bp, Mus musculus
ggagactctggtaacattcccataa

SEQ ID NO: 595865 - DNA, 25 bp, Mus musculus
ggagactctggttacattcccataa

SEQ ID NO: 595866 - DNA, 25 bp, Mus musculus
ggagactcttaactttgctcttgga

SEQ ID NO: 595867 - DNA, 25 bp, Mus musculus
ggagactcttaagtttgctcttgga

SEQ ID NO: 595868 - DNA, 25 bp, Mus musculus
ggagactcttggcagcactccacta

SEQ ID NO: 595869 - DNA, 25 bp, Mus musculus
ggagactcttgggagcactccacta

SEQ ID NO: 595870 - DNA, 25 bp, Mus musculus
ggagactgaactaattaagcttaaa

SEQ ID NO: 595871 - DNA, 25 bp, Mus musculus
ggagactgaacttattaagcttaaa

SEQ ID NO: 595872 - DNA, 25 bp, Mus musculus
ggagactgaattcgatgcctctctc

SEQ ID NO: 595873 - DNA, 25 bp, Mus musculus
ggagactgaattggatgcctctctc

SEQ ID NO: 595874 - DNA, 25 bp, Mus musculus
ggagactgagcaaagcttcactgat

SEQ ID NO: 595875 - DNA, 25 bp, Mus musculus
ggagactgagcatagcttcactgat

SEQ ID NO: 595876 - DNA, 25 bp, Mus musculus
ggagactgagctctgtgttcttgac

SEQ ID NO: 595877 - DNA, 25 bp, Mus musculus
ggagactgagctgtgtgttcttgac

SEQ ID NO: 595878 - DNA, 25 bp, Mus musculus
ggagactgagtaccccgacagccat

SEQ ID NO: 595879 - DNA, 25 bp, Mus musculus
ggagactgagtagcccgacagccat

SEQ ID NO: 595880 - DNA, 25 bp, Mus musculus
ggagactgcagactccatcttcagt

SEQ ID NO: 595881 - DNA, 25 bp, Mus musculus
ggagactgcagagtccatcttcagt

SEQ ID NO: 595882 - DNA, 25 bp, Mus musculus
ggagactgcataactaggctcttag

SEQ ID NO: 595883 - DNA, 25 bp, Mus musculus
ggagactgcatatctaggctcttag

SEQ ID NO: 595884 - DNA, 25 bp, Mus musculus
ggagactgctaaaggacccagctaa

SEQ ID NO: 595885 - DNA, 25 bp, Mus musculus
ggagactgctaatggacccagctaa

SEQ ID NO: 595886 - DNA, 25 bp, Mus musculus
ggagactggaacactacgctggcct

SEQ ID NO: 595887 - DNA, 25 bp, Mus musculus
ggagactggaactctacgctggcct

SEQ ID NO: 595888 - DNA, 25 bp, Mus musculus
ggagactggaagagtcctaatccta

SEQ ID NO: 595889 - DNA, 25 bp, Mus musculus
ggagactggaagtgtcctaatccta

SEQ ID NO: 595890 - DNA, 25 bp, Mus musculus
ggagactggattatactccagctcc

SEQ ID NO: 595891 - DNA, 25 bp, Mus musculus
ggagactggattttactccagctcc

SEQ ID NO: 595892 - DNA, 25 bp, Mus musculus
ggagactggcaaaccctttgatttc

SEQ ID NO: 595893 - DNA, 25 bp, Mus musculus
ggagactggcaatccctttgatttc

SEQ ID NO: 595894 - DNA, 25 bp, Mus musculus
ggagactggcagctgtctgatccta

SEQ ID NO: 595895 - DNA, 25 bp, Mus musculus
ggagactggcaggtgtctgatccta

SEQ ID NO: 595896 - DNA, 25 bp, Mus musculus
ggagactggcctatagagtctatgt

SEQ ID NO: 595897 - DNA, 25 bp, Mus musculus
ggagactggcctttagagtctatgt

SEQ ID NO: 595898 - DNA, 25 bp, Mus musculus
ggagactggcttcccttatagtaat

SEQ ID NO: 595899 - DNA, 25 bp, Mus musculus
ggagactggcttgccttatagtaat

SEQ ID NO: 595900 - DNA, 25 bp, Mus musculus
ggagactgtcctctatggcaatgat

SEQ ID NO: 595901 - DNA, 25 bp, Mus musculus
ggagactgtcctgtatggcaatgat

SEQ ID NO: 595902 - DNA, 25 bp, Mus musculus
ggagactgtgaacccttttgaacat

SEQ ID NO: 595903 - DNA, 25 bp, Mus musculus
ggagactgtgaagccttttgaacat

SEQ ID NO: 595904 - DNA, 25 bp, Mus musculus
ggagactgtggtcacttcgcccatg

SEQ ID NO: 595905 - DNA, 25 bp, Mus musculus
ggagactgtggtgacttcgcccatg

SEQ ID NO: 595906 - DNA, 25 bp, Mus musculus
ggagactgtttaacagtagtttaga

SEQ ID NO: 595907 - DNA, 25 bp, Mus musculus
ggagactgtttatcagtagtttaga

SEQ ID NO: 595908 - DNA, 25 bp, Mus musculus
ggagactgttttatgaccaaatgat

SEQ ID NO: 595909 - DNA, 25 bp, Mus musculus
ggagactgttttttgaccaaatgat

SEQ ID NO: 595910 - DNA, 25 bp, Mus musculus
ggagacttaagaacaaaccctaggt

SEQ ID NO: 595911 - DNA, 25 bp, Mus musculus
ggagacttaagatcaaaccctaggt

SEQ ID NO: 595912 - DNA, 25 bp, Mus musculus
ggagacttacaaatgattgccttta

SEQ ID NO: 595913 - DNA, 25 bp, Mus musculus
ggagacttacaattgattgccttta

SEQ ID NO: 595914 - DNA, 25 bp, Mus musculus
ggagacttacgtcatgtgaacccat

SEQ ID NO: 595915 - DNA, 25 bp, Mus musculus
ggagacttacgtgatgtgaacccat

SEQ ID NO: 595916 - DNA, 25 bp, Mus musculus
ggagacttatacagatacaaggcag

SEQ ID NO: 595917 - DNA, 25 bp, Mus musculus
ggagacttatactgatacaaggcag

SEQ ID NO: 595918 - DNA, 25 bp, Mus musculus
ggagacttattaacttttcagccaa

SEQ ID NO: 595919 - DNA, 25 bp, Mus musculus
ggagacttattatcttttcagccaa

SEQ ID NO: 595920 - DNA, 25 bp, Mus musculus
ggagacttcaatatgccacgagaca

SEQ ID NO: 595921 - DNA, 25 bp, Mus musculus
ggagacttcaatttgccacgagaca

SEQ ID NO: 595922 - DNA, 25 bp, Mus musculus
ggagacttcaccaaatccacagggt

SEQ ID NO: 595923 - DNA, 25 bp, Mus musculus
ggagacttcacctaatccacagggt

SEQ ID NO: 595924 - DNA, 25 bp, Mus musculus
ggagacttcagtacaccagggcttt

SEQ ID NO: 595925 - DNA, 25 bp, Mus musculus
ggagacttcagttcaccagggcttt

SEQ ID NO: 595926 - DNA, 25 bp, Mus musculus
ggagacttcgtgcaggctgccctca

SEQ ID NO: 595927 - DNA, 25 bp, Mus musculus
ggagacttcgtggaggctgccctca

SEQ ID NO: 595928 - DNA, 25 bp, Mus musculus
ggagacttctggatgcctcatattc

SEQ ID NO: 595929 - DNA, 25 bp, Mus musculus
ggagacttctggttgcctcatattc

SEQ ID NO: 595930 - DNA, 25 bp, Mus musculus
ggagacttgattctgccagcccgca

SEQ ID NO: 595931 - DNA, 25 bp, Mus musculus
ggagacttgattgtgccagcccgca

SEQ ID NO: 595932 - DNA, 25 bp, Mus musculus
ggagacttgctacgatctcttgccc

SEQ ID NO: 595933 - DNA, 25 bp, Mus musculus
ggagacttgctaggatctcttgccc

SEQ ID NO: 595934 - DNA, 25 bp, Mus musculus
ggagacttgctccaaagacttataa

SEQ ID NO: 595935 - DNA, 25 bp, Mus musculus
ggagacttgctcgaaagacttataa

SEQ ID NO: 595936 - DNA, 25 bp, Mus musculus
ggagacttggtaattcaaatctact

SEQ ID NO: 595937 - DNA, 25 bp, Mus musculus
ggagacttggtatttcaaatctact

SEQ ID NO: 595938 - DNA, 25 bp, Mus musculus
ggagactttaatccttcagattctt

SEQ ID NO: 595939 - DNA, 25 bp, Mus musculus
ggagactttaatgcttcagattctt

SEQ ID NO: 595940 - DNA, 25 bp, Mus musculus
ggagactttagtaacttcttcagaa

SEQ ID NO: 595941 - DNA, 25 bp, Mus musculus
ggagactttagttacttcttcagaa

SEQ ID NO: 595942 - DNA, 25 bp, Mus musculus
ggagactttcaaaactgcccagctt

SEQ ID NO: 595943 - DNA, 25 bp, Mus musculus
ggagactttcaatactgcccagctt

SEQ ID NO: 595944 - DNA, 25 bp, Mus musculus
ggagactttccactaagcactttag

SEQ ID NO: 595945 - DNA, 25 bp, Mus musculus
ggagactttccagtaagcactttag

SEQ ID NO: 595946 - DNA, 25 bp, Mus musculus
ggagactttgacacaacagttcttc

SEQ ID NO: 595947 - DNA, 25 bp, Mus musculus
ggagactttgactcaacagttcttc

SEQ ID NO: 595948 - DNA, 25 bp, Mus musculus
ggagactttgagaaaggacacgagt

SEQ ID NO: 595949 - DNA, 25 bp, Mus musculus
ggagactttgagtaaggacacgagt

SEQ ID NO: 595950 - DNA, 25 bp, Mus musculus
ggagactttgtcaaccagggccact

SEQ ID NO: 595951 - DNA, 25 bp, Mus musculus
ggagactttgtctaccagggccact

SEQ ID NO: 595952 - DNA, 25 bp, Mus musculus
ggagacttttctaactgctatggaa

SEQ ID NO: 595953 - DNA, 25 bp, Mus musculus
ggagacttttcttactgctatggaa

SEQ ID NO: 595954 - DNA, 25 bp, Mus musculus
ggagagaaaacactccgtcccctat

SEQ ID NO: 595955 - DNA, 25 bp, Mus musculus
ggagagaaaacagtccgtcccctat

SEQ ID NO: 595956 - DNA, 25 bp, Mus musculus
ggagagaaacacagatttttacact

SEQ ID NO: 595957 - DNA, 25 bp, Mus musculus
ggagagaaacacagggcctatccct

SEQ ID NO: 595958 - DNA, 25 bp, Mus musculus
ggagagaaacactgatttttacact

SEQ ID NO: 595959 - DNA, 25 bp, Mus musculus
ggagagaaacactgggcctatccct

SEQ ID NO: 595960 - DNA, 25 bp, Mus musculus
ggagagaaacataaagccaactttt

SEQ ID NO: 595961 - DNA, 25 bp, Mus musculus
ggagagaaacattaagccaactttt

SEQ ID NO: 595962 - DNA, 25 bp, Mus musculus
ggagagaaattaccatcgccttaaa

SEQ ID NO: 595963 - DNA, 25 bp, Mus musculus
ggagagaaattagcatcgccttaaa

SEQ ID NO: 595964 - DNA, 25 bp, Mus musculus
ggagagaacatcctgctagcctgct

SEQ ID NO: 595965 - DNA, 25 bp, Mus musculus
ggagagaacatcgtgctagcctgct

SEQ ID NO: 595966 - DNA, 25 bp, Mus musculus
ggagagaacatgcacaagcttagtt

SEQ ID NO: 595967 - DNA, 25 bp, Mus musculus
ggagagaacatggacaagcttagtt

SEQ ID NO: 595968 - DNA, 25 bp, Mus musculus
ggagagaaccttctactcccagggt

SEQ ID NO: 595969 - DNA, 25 bp, Mus musculus
ggagagaaccttgtactcccagggt

SEQ ID NO: 595970 - DNA, 25 bp, Mus musculus
ggagagaacgacatccgtcattgac

SEQ ID NO: 595971 - DNA, 25 bp, Mus musculus
ggagagaacgacttccgtcattgac

SEQ ID NO: 595972 - DNA, 25 bp, Mus musculus
ggagagaactaaccaccaccctttg

SEQ ID NO: 595973 - DNA, 25 bp, Mus musculus
ggagagaactaagcaccaccctttg

SEQ ID NO: 595974 - DNA, 25 bp, Mus musculus
ggagagaactccactatccaacagc

SEQ ID NO: 595975 - DNA, 25 bp, Mus musculus
ggagagaactcctctatccaacagc

SEQ ID NO: 595976 - DNA, 25 bp, Mus musculus
ggagagaagatgaaccccataaggg

SEQ ID NO: 595977 - DNA, 25 bp, Mus musculus
ggagagaagatgtaccccataaggg

SEQ ID NO: 595978 - DNA, 25 bp, Mus musculus
ggagagaagcccacatccagtggca

SEQ ID NO: 595979 - DNA, 25 bp, Mus musculus
ggagagaagccctcatccagtggca

SEQ ID NO: 595980 - DNA, 25 bp, Mus musculus
ggagagaagctaacgctgcagcgac

SEQ ID NO: 595981 - DNA, 25 bp, Mus musculus
ggagagaagctacgcacagccccag

SEQ ID NO: 595982 - DNA, 25 bp, Mus musculus
ggagagaagctaggcacagccccag

SEQ ID NO: 595983 - DNA, 25 bp, Mus musculus
ggagagaagctatcgctgcagcgac

SEQ ID NO: 595984 - DNA, 25 bp, Mus musculus
ggagagaagtgacaagtccaccctt

SEQ ID NO: 595985 - DNA, 25 bp, Mus musculus
ggagagaagtgagaagtccaccctt

SEQ ID NO: 595986 - DNA, 25 bp, Mus musculus
ggagagaatcatcgctccatgtaca

SEQ ID NO: 595987 - DNA, 25 bp, Mus musculus
ggagagaatcatggctccatgtaca

SEQ ID NO: 595988 - DNA, 25 bp, Mus musculus
ggagagaatgtaagtgccacgtttt

SEQ ID NO: 595989 - DNA, 25 bp, Mus musculus
ggagagaatgtatgtgccacgtttt

SEQ ID NO: 595990 - DNA, 25 bp, Mus musculus
ggagagacaaacctataaatactat

SEQ ID NO: 595991 - DNA, 25 bp, Mus musculus
ggagagacaaacgtataaatactat

SEQ ID NO: 595992 - DNA, 25 bp, Mus musculus
ggagagacaccgatgaaagtagcca

SEQ ID NO: 595993 - DNA, 25 bp, Mus musculus
ggagagacaccgttgaaagtagcca

SEQ ID NO: 595994 - DNA, 25 bp, Mus musculus
ggagagacacgccatagggtaaact

SEQ ID NO: 595995 - DNA, 25 bp, Mus musculus
ggagagacacgcgatagggtaaact

SEQ ID NO: 595996 - DNA, 25 bp, Mus musculus
ggagagacacgtacaaccacttgac

SEQ ID NO: 595997 - DNA, 25 bp, Mus musculus
ggagagacacgttcaaccacttgac

SEQ ID NO: 595998 - DNA, 25 bp, Mus musculus
ggagagacatttatcaggtggacaa

SEQ ID NO: 595999 - DNA, 25 bp, Mus musculus
ggagagacatttttcaggtggacaa

SEQ ID NO: 596000 - DNA, 25 bp, Mus musculus
ggagagaccaggactatgctaacct

SEQ ID NO: 596001 - DNA, 25 bp, Mus musculus
ggagagaccaggtctatgctaacct

SEQ ID NO: 596002 - DNA, 25 bp, Mus musculus
ggagagacccacagcctgtggatct

SEQ ID NO: 596003 - DNA, 25 bp, Mus musculus
ggagagacccactgcctgtggatct

SEQ ID NO: 596004 - DNA, 25 bp, Mus musculus
ggagagaccccacttcctcagaaga

SEQ ID NO: 596005 - DNA, 25 bp, Mus musculus
ggagagaccccagttcctcagaaga

SEQ ID NO: 596006 - DNA, 25 bp, Mus musculus
ggagagacccgaacagaattactgc

SEQ ID NO: 596007 - DNA, 25 bp, Mus musculus
ggagagacccgatcagaattactgc

SEQ ID NO: 596008 - DNA, 25 bp, Mus musculus
ggagagaccctgagcaaagcacaga

SEQ ID NO: 596009 - DNA, 25 bp, Mus musculus
ggagagaccctgtgcaaagcacaga

SEQ ID NO: 596010 - DNA, 25 bp, Mus musculus
ggagagacctgccttctagactcag

SEQ ID NO: 596011 - DNA, 25 bp, Mus musculus
ggagagacctgcgttctagactcag

SEQ ID NO: 596012 - DNA, 25 bp, Mus musculus
ggagagacgcagctcatacctcact

SEQ ID NO: 596013 - DNA, 25 bp, Mus musculus
ggagagacgcaggtcatacctcact

SEQ ID NO: 596014 - DNA, 25 bp, Mus musculus
ggagagactctacccgaaaacaaga

SEQ ID NO: 596015 - DNA, 25 bp, Mus musculus
ggagagactctagccgaaaacaaga

SEQ ID NO: 596016 - DNA, 25 bp, Mus musculus
ggagagactgttattcagccacaat

SEQ ID NO: 596017 - DNA, 25 bp, Mus musculus
ggagagactgtttttcagccacaat

SEQ ID NO: 596018 - DNA, 25 bp, Mus musculus
ggagagagagaacccattatcaaat

SEQ ID NO: 596019 - DNA, 25 bp, Mus musculus
ggagagagagaagccattatcaaat

SEQ ID NO: 596020 - DNA, 25 bp, Mus musculus
ggagagagagcaaaactttcttcaa

SEQ ID NO: 596021 - DNA, 25 bp, Mus musculus
ggagagagagcataactttcttcaa

SEQ ID NO: 596022 - DNA, 25 bp, Mus musculus
ggagagagagcgcttaaaatagttt

SEQ ID NO: 596023 - DNA, 25 bp, Mus musculus
ggagagagagcggttaaaatagttt

SEQ ID NO: 596024 - DNA, 25 bp, Mus musculus
ggagagagagtcactatcacttgca

SEQ ID NO: 596025 - DNA, 25 bp, Mus musculus
ggagagagagtctctatcacttgca

SEQ ID NO: 596026 - DNA, 25 bp, Mus musculus
ggagagagatagctcacctgacctc

SEQ ID NO: 596027 - DNA, 25 bp, Mus musculus
ggagagagataggtcacctgacctc

SEQ ID NO: 596028 - DNA, 25 bp, Mus musculus
ggagagagatgcatgtcgctgccca

SEQ ID NO: 596029 - DNA, 25 bp, Mus musculus
ggagagagatgcttgtcgctgccca

SEQ ID NO: 596030 - DNA, 25 bp, Mus musculus
ggagagagattcagcacccgtttgc

SEQ ID NO: 596031 - DNA, 25 bp, Mus musculus
ggagagagattctgcacccgtttgc

SEQ ID NO: 596032 - DNA, 25 bp, Mus musculus
ggagagagcacaaacctgttagata

SEQ ID NO: 596033 - DNA, 25 bp, Mus musculus
ggagagagcacatacctgttagata

SEQ ID NO: 596034 - DNA, 25 bp, Mus musculus
ggagagagcactcagcttattccca

SEQ ID NO: 596035 - DNA, 25 bp, Mus musculus
ggagagagcactgagcttattccca

SEQ ID NO: 596036 - DNA, 25 bp, Mus musculus
ggagagagcatcagaccccaaagcc

SEQ ID NO: 596037 - DNA, 25 bp, Mus musculus
ggagagagcatctgaccccaaagcc

SEQ ID NO: 596038 - DNA, 25 bp, Mus musculus
ggagagagccaccattttggtttct

SEQ ID NO: 596039 - DNA, 25 bp, Mus musculus
ggagagagccacgattttggtttct

SEQ ID NO: 596040 - DNA, 25 bp, Mus musculus
ggagagagccatatcactgactagg

SEQ ID NO: 596041 - DNA, 25 bp, Mus musculus
ggagagagccatttcactgactagg

SEQ ID NO: 596042 - DNA, 25 bp, Mus musculus
ggagagagcgcaaggagcccaccta

SEQ ID NO: 596043 - DNA, 25 bp, Mus musculus
ggagagagcgcatggagcccaccta

SEQ ID NO: 596044 - DNA, 25 bp, Mus musculus
ggagagaggacaaatctactcaggt

SEQ ID NO: 596045 - DNA, 25 bp, Mus musculus
ggagagaggacatatctactcaggt

SEQ ID NO: 596046 - DNA, 25 bp, Mus musculus
ggagagaggctcacccaaggactgt

SEQ ID NO: 596047 - DNA, 25 bp, Mus musculus
ggagagaggctctcccaaggactgt

SEQ ID NO: 596048 - DNA, 25 bp, Mus musculus
ggagagaggctgaatgcccaccgtt

SEQ ID NO: 596049 - DNA, 25 bp, Mus musculus
ggagagaggctgtatgcccaccgtt

SEQ ID NO: 596050 - DNA, 25 bp, Mus musculus
ggagagagggacattacacacacct

SEQ ID NO: 596051 - DNA, 25 bp, Mus musculus
ggagagagggactttacacacacct

SEQ ID NO: 596052 - DNA, 25 bp, Mus musculus
ggagagagtagcaagcccggcccca

SEQ ID NO: 596053 - DNA, 25 bp, Mus musculus
ggagagagtagctagcccggcccca

SEQ ID NO: 596054 - DNA, 25 bp, Mus musculus
ggagagagtccaagctgtcagttaa

SEQ ID NO: 596055 - DNA, 25 bp, Mus musculus
ggagagagtccatgctgtcagttaa

SEQ ID NO: 596056 - DNA, 25 bp, Mus musculus
ggagagagtctgcatcttttctcat

SEQ ID NO: 596057 - DNA, 25 bp, Mus musculus
ggagagagtctggatcttttctcat

SEQ ID NO: 596058 - DNA, 25 bp, Mus musculus
ggagagagtgttcgctgttcttcca

SEQ ID NO: 596059 - DNA, 25 bp, Mus musculus
ggagagagtgttggctgttcttcca

SEQ ID NO: 596060 - DNA, 25 bp, Mus musculus
ggagagagttaactcctcctctgac

SEQ ID NO: 596061 - DNA, 25 bp, Mus musculus
ggagagagttaagtcctcctctgac

SEQ ID NO: 596062 - DNA, 25 bp, Mus musculus
ggagagagttggagatttctctgcc

SEQ ID NO: 596063 - DNA, 25 bp, Mus musculus
ggagagagttggtgatttctctgcc

SEQ ID NO: 596064 - DNA, 25 bp, Mus musculus
ggagagataccccatcaccaaagag

SEQ ID NO: 596065 - DNA, 25 bp, Mus musculus
ggagagatacccgatcaccaaagag

SEQ ID NO: 596066 - DNA, 25 bp, Mus musculus
ggagagatagctagccacctaccta

SEQ ID NO: 596067 - DNA, 25 bp, Mus musculus
ggagagatagcttgccacctaccta

SEQ ID NO: 596068 - DNA, 25 bp, Mus musculus
ggagagatattgagagccagtaata

SEQ ID NO: 596069 - DNA, 25 bp, Mus musculus
ggagagatattgtgagccagtaata

SEQ ID NO: 596070 - DNA, 25 bp, Mus musculus
ggagagatcacacccatgctgaacg

SEQ ID NO: 596071 - DNA, 25 bp, Mus musculus
ggagagatcacagccatgctgaacg

SEQ ID NO: 596072 - DNA, 25 bp, Mus musculus
ggagagatcactccttgccaaccaa

SEQ ID NO: 596073 - DNA, 25 bp, Mus musculus
ggagagatcactgcttgccaaccaa

SEQ ID NO: 596074 - DNA, 25 bp, Mus musculus
ggagagatcagacaacaccaagaat

SEQ ID NO: 596075 - DNA, 25 bp, Mus musculus
ggagagatcagagaacaccaagaat

SEQ ID NO: 596076 - DNA, 25 bp, Mus musculus
ggagagatccccaaagtgtcagcac

SEQ ID NO: 596077 - DNA, 25 bp, Mus musculus
ggagagatccccaggcttgcagaaa

SEQ ID NO: 596078 - DNA, 25 bp, Mus musculus
ggagagatcccctaagtgtcagcac

SEQ ID NO: 596079 - DNA, 25 bp, Mus musculus
ggagagatcccctggcttgcagaaa

SEQ ID NO: 596080 - DNA, 25 bp, Mus musculus
ggagagatccgcaggcctggaacta

SEQ ID NO: 596081 - DNA, 25 bp, Mus musculus
ggagagatccgctggcctggaacta

SEQ ID NO: 596082 - DNA, 25 bp, Mus musculus
ggagagatcgaaacgtatgcaaatc

SEQ ID NO: 596083 - DNA, 25 bp, Mus musculus
ggagagatcgaatcgtatgcaaatc

SEQ ID NO: 596084 - DNA, 25 bp, Mus musculus
ggagagatgccgacatctgtagcat

SEQ ID NO: 596085 - DNA, 25 bp, Mus musculus
ggagagatgccgtcatctgtagcat

SEQ ID NO: 596086 - DNA, 25 bp, Mus musculus
ggagagatgctcacactttgtagaa

SEQ ID NO: 596087 - DNA, 25 bp, Mus musculus
ggagagatgctctcactttgtagaa

SEQ ID NO: 596088 - DNA, 25 bp, Mus musculus
ggagagatggatcgtggctcataca

SEQ ID NO: 596089 - DNA, 25 bp, Mus musculus
ggagagatggatggtggctcataca

SEQ ID NO: 596090 - DNA, 25 bp, Mus musculus
ggagagatggccatgattgcccctc

SEQ ID NO: 596091 - DNA, 25 bp, Mus musculus
ggagagatggccttgattgcccctc

SEQ ID NO: 596092 - DNA, 25 bp, Mus musculus
ggagagatggtgaaatatccaaaat

SEQ ID NO: 596093 - DNA, 25 bp, Mus musculus
ggagagatggtgattgttctgtttt

SEQ ID NO: 596094 - DNA, 25 bp, Mus musculus
ggagagatggtgtaatatccaaaat

SEQ ID NO: 596095 - DNA, 25 bp, Mus musculus
ggagagatggtgtttgttctgtttt

SEQ ID NO: 596096 - DNA, 25 bp, Mus musculus
ggagagatgtgtcactcaatcctgt

SEQ ID NO: 596097 - DNA, 25 bp, Mus musculus
ggagagatgtgtgactcaatcctgt

SEQ ID NO: 596098 - DNA, 25 bp, Mus musculus
ggagagattcatcctaatagtggta

SEQ ID NO: 596099 - DNA, 25 bp, Mus musculus
ggagagattcatgctaatagtggta

SEQ ID NO: 596100 - DNA, 25 bp, Mus musculus
ggagagattcctccctagctactag

SEQ ID NO: 596101 - DNA, 25 bp, Mus musculus
ggagagattcctgcctagctactag

SEQ ID NO: 596102 - DNA, 25 bp, Mus musculus
ggagagattcgcacgccctgcagac

SEQ ID NO: 596103 - DNA, 25 bp, Mus musculus
ggagagattcgctcgccctgcagac

SEQ ID NO: 596104 - DNA, 25 bp, Mus musculus
ggagagattctcaatgttacaaatg

SEQ ID NO: 596105 - DNA, 25 bp, Mus musculus
ggagagattctctatgttacaaatg

SEQ ID NO: 596106 - DNA, 25 bp, Mus musculus
ggagagcaaagaaggtagcagcccc

SEQ ID NO: 596107 - DNA, 25 bp, Mus musculus
ggagagcaaagatggtagcagcccc

SEQ ID NO: 596108 - DNA, 25 bp, Mus musculus
ggagagcaatctccatgaccccaat

SEQ ID NO: 596109 - DNA, 25 bp, Mus musculus
ggagagcaatctgcatgaccccaat

SEQ ID NO: 596110 - DNA, 25 bp, Mus musculus
ggagagcacctcagctgaaaacatg

SEQ ID NO: 596111 - DNA, 25 bp, Mus musculus
ggagagcacctctgctgaaaacatg

SEQ ID NO: 596112 - DNA, 25 bp, Mus musculus
ggagagcactctctgcacctgtcag

SEQ ID NO: 596113 - DNA, 25 bp, Mus musculus
ggagagcactctgtgcacctgtcag

SEQ ID NO: 596114 - DNA, 25 bp, Mus musculus
ggagagcagaccaggtgtcaacttg

SEQ ID NO: 596115 - DNA, 25 bp, Mus musculus
ggagagcagacctggtgtcaacttg

SEQ ID NO: 596116 - DNA, 25 bp, Mus musculus
ggagagcagccacgcgttcctctat

SEQ ID NO: 596117 - DNA, 25 bp, Mus musculus
ggagagcagccaggcgttcctctat

SEQ ID NO: 596118 - DNA, 25 bp, Mus musculus
ggagagcagcttatgtgctttcata

SEQ ID NO: 596119 - DNA, 25 bp, Mus musculus
ggagagcagcttttgtgctttcata

SEQ ID NO: 596120 - DNA, 25 bp, Mus musculus
ggagagcatccaattctgaagccac

SEQ ID NO: 596121 - DNA, 25 bp, Mus musculus
ggagagcatccaccacgagttcaca

SEQ ID NO: 596122 - DNA, 25 bp, Mus musculus
ggagagcatccaccgttttgaacaa

SEQ ID NO: 596123 - DNA, 25 bp, Mus musculus
ggagagcatccagcacgagttcaca

SEQ ID NO: 596124 - DNA, 25 bp, Mus musculus
ggagagcatccagcgttttgaacaa

SEQ ID NO: 596125 - DNA, 25 bp, Mus musculus
ggagagcatccatttctgaagccac

SEQ ID NO: 596126 - DNA, 25 bp, Mus musculus
ggagagcatgaccttatagttgttc

SEQ ID NO: 596127 - DNA, 25 bp, Mus musculus
ggagagcatgacgttatagttgttc

SEQ ID NO: 596128 - DNA, 25 bp, Mus musculus
ggagagcatgatccgcacccttgct

SEQ ID NO: 596129 - DNA, 25 bp, Mus musculus
ggagagcatgatgcgcacccttgct

SEQ ID NO: 596130 - DNA, 25 bp, Mus musculus
ggagagcattccctgctgcccgaag

SEQ ID NO: 596131 - DNA, 25 bp, Mus musculus
ggagagcattccgtgctgcccgaag

SEQ ID NO: 596132 - DNA, 25 bp, Mus musculus
ggagagccagttagggcaagcaaat

SEQ ID NO: 596133 - DNA, 25 bp, Mus musculus
ggagagccagtttgggcaagcaaat

SEQ ID NO: 596134 - DNA, 25 bp, Mus musculus
ggagagccatacactcttggacttt

SEQ ID NO: 596135 - DNA, 25 bp, Mus musculus
ggagagccatactctcttggacttt

SEQ ID NO: 596136 - DNA, 25 bp, Mus musculus
ggagagccatatctacagcaatcaa

SEQ ID NO: 596137 - DNA, 25 bp, Mus musculus
ggagagccatatgtacagcaatcaa

SEQ ID NO: 596138 - DNA, 25 bp, Mus musculus
ggagagccatccaaactgaggaaaa

SEQ ID NO: 596139 - DNA, 25 bp, Mus musculus
ggagagccatcctaactgaggaaaa

SEQ ID NO: 596140 - DNA, 25 bp, Mus musculus
ggagagcccctcagaaagtccctgg

SEQ ID NO: 596141 - DNA, 25 bp, Mus musculus
ggagagcccctctgaaagtccctgg

SEQ ID NO: 596142 - DNA, 25 bp, Mus musculus
ggagagcccgaaatcacttcatgaa

SEQ ID NO: 596143 - DNA, 25 bp, Mus musculus
ggagagcccgaattcacttcatgaa

SEQ ID NO: 596144 - DNA, 25 bp, Mus musculus
ggagagcccgctcccgatgacagca

SEQ ID NO: 596145 - DNA, 25 bp, Mus musculus
ggagagcccgctgccgatgacagca

SEQ ID NO: 596146 - DNA, 25 bp, Mus musculus
ggagagccctttaccgcagacacag

SEQ ID NO: 596147 - DNA, 25 bp, Mus musculus
ggagagcccttttccgcagacacag

SEQ ID NO: 596148 - DNA, 25 bp, Mus musculus
ggagagccgaggatcctcccaggaa

SEQ ID NO: 596149 - DNA, 25 bp, Mus musculus
ggagagccgaggttcctcccaggaa

SEQ ID NO: 596150 - DNA, 25 bp, Mus musculus
ggagagccggatataaacttccagt

SEQ ID NO: 596151 - DNA, 25 bp, Mus musculus
ggagagccggatttaaacttccagt

SEQ ID NO: 596152 - DNA, 25 bp, Mus musculus
ggagagccgtgcagatcatctttat

SEQ ID NO: 596153 - DNA, 25 bp, Mus musculus
ggagagccgtgctgatcatctttat

SEQ ID NO: 596154 - DNA, 25 bp, Mus musculus
ggagagcctacacacttcttactgg

SEQ ID NO: 596155 - DNA, 25 bp, Mus musculus
ggagagcctacagacttcttactgg

SEQ ID NO: 596156 - DNA, 25 bp, Mus musculus
ggagagcctccaagaatgcctttgt

SEQ ID NO: 596157 - DNA, 25 bp, Mus musculus
ggagagcctccatgaatgcctttgt

SEQ ID NO: 596158 - DNA, 25 bp, Mus musculus
ggagagcctgccatggtaaagccca

SEQ ID NO: 596159 - DNA, 25 bp, Mus musculus
ggagagcctgccttggtaaagccca

SEQ ID NO: 596160 - DNA, 25 bp, Mus musculus
ggagagcctggaaattcaccagcat

SEQ ID NO: 596161 - DNA, 25 bp, Mus musculus
ggagagcctggatattcaccagcat

SEQ ID NO: 596162 - DNA, 25 bp, Mus musculus
ggagagcctgttacgtcatcaagat

SEQ ID NO: 596163 - DNA, 25 bp, Mus musculus
ggagagcctgtttcgtcatcaagat

SEQ ID NO: 596164 - DNA, 25 bp, Mus musculus
ggagagcgactgcaatcagcacaag

SEQ ID NO: 596165 - DNA, 25 bp, Mus musculus
ggagagcgactggaatcagcacaag

SEQ ID NO: 596166 - DNA, 25 bp, Mus musculus
ggagagcgcagcaggtactcaccaa

SEQ ID NO: 596167 - DNA, 25 bp, Mus musculus
ggagagcgcagctggtactcaccaa

SEQ ID NO: 596168 - DNA, 25 bp, Mus musculus
ggagagcgcatcacttcatgcaata

SEQ ID NO: 596169 - DNA, 25 bp, Mus musculus
ggagagcgcatctcttcatgcaata

SEQ ID NO: 596170 - DNA, 25 bp, Mus musculus
ggagagcgcctgattttcgcctgtg

SEQ ID NO: 596171 - DNA, 25 bp, Mus musculus
ggagagcgcctgtttttcgcctgtg

SEQ ID NO: 596172 - DNA, 25 bp, Mus musculus
ggagagcgcgccacgtttccagagc

SEQ ID NO: 596173 - DNA, 25 bp, Mus musculus
ggagagcgcgcctcgtttccagagc

SEQ ID NO: 596174 - DNA, 25 bp, Mus musculus
ggagagcggcctaacatgtgtatgt

SEQ ID NO: 596175 - DNA, 25 bp, Mus musculus
ggagagcggccttacatgtgtatgt

SEQ ID NO: 596176 - DNA, 25 bp, Mus musculus
ggagagcgtcacctggcctcagcat

SEQ ID NO: 596177 - DNA, 25 bp, Mus musculus
ggagagcgtcacgtggcctcagcat

SEQ ID NO: 596178 - DNA, 25 bp, Mus musculus
ggagagctaagcctcagcaggatta

SEQ ID NO: 596179 - DNA, 25 bp, Mus musculus
ggagagctaagcgtcagcaggatta

SEQ ID NO: 596180 - DNA, 25 bp, Mus musculus
ggagagctaatcaaccctgacatca

SEQ ID NO: 596181 - DNA, 25 bp, Mus musculus
ggagagctaatctaccctgacatca

SEQ ID NO: 596182 - DNA, 25 bp, Mus musculus
ggagagctacatcggcatccgagac

SEQ ID NO: 596183 - DNA, 25 bp, Mus musculus
ggagagctacatgggcatccgagac

SEQ ID NO: 596184 - DNA, 25 bp, Mus musculus
ggagagctagagaaccttaccgtct

SEQ ID NO: 596185 - DNA, 25 bp, Mus musculus
ggagagctagagtaccttaccgtct

SEQ ID NO: 596186 - DNA, 25 bp, Mus musculus
ggagagctagttagccccagataga

SEQ ID NO: 596187 - DNA, 25 bp, Mus musculus
ggagagctagtttgccccagataga

SEQ ID NO: 596188 - DNA, 25 bp, Mus musculus
ggagagctatatacggctgttgcag

SEQ ID NO: 596189 - DNA, 25 bp, Mus musculus
ggagagctatattcggctgttgcag

SEQ ID NO: 596190 - DNA, 25 bp, Mus musculus
ggagagctatccacatacaaattac

SEQ ID NO: 596191 - DNA, 25 bp, Mus musculus
ggagagctatcctcatacaaattac

SEQ ID NO: 596192 - DNA, 25 bp, Mus musculus
ggagagctcacacacccgaagctac

SEQ ID NO: 596193 - DNA, 25 bp, Mus musculus
ggagagctcacagacccgaagctac

SEQ ID NO: 596194 - DNA, 25 bp, Mus musculus
ggagagctccagaaggtgacatgaa

SEQ ID NO: 596195 - DNA, 25 bp, Mus musculus
ggagagctccagtaggtgacatgaa

SEQ ID NO: 596196 - DNA, 25 bp, Mus musculus
ggagagctccccatatgatgacatt

SEQ ID NO: 596197 - DNA, 25 bp, Mus musculus
ggagagctccccttatgatgacatt

SEQ ID NO: 596198 - DNA, 25 bp, Mus musculus
ggagagctccctaccggaaacaatt

SEQ ID NO: 596199 - DNA, 25 bp, Mus musculus
ggagagctcccttccggaaacaatt

SEQ ID NO: 596200 - DNA, 25 bp, Mus musculus
ggagagctcctacctggccagtgaa

SEQ ID NO: 596201 - DNA, 25 bp, Mus musculus
ggagagctcctagctggccagtgaa

SEQ ID NO: 596202 - DNA, 25 bp, Mus musculus
ggagagctcgatccagaactacccc

SEQ ID NO: 596203 - DNA, 25 bp, Mus musculus
ggagagctcgatgcagaactacccc

SEQ ID NO: 596204 - DNA, 25 bp, Mus musculus
ggagagctgaatcaccctggccctc

SEQ ID NO: 596205 - DNA, 25 bp, Mus musculus
ggagagctgaatgaccctggccctc

SEQ ID NO: 596206 - DNA, 25 bp, Mus musculus
ggagagctgagcagtccctggtgcc

SEQ ID NO: 596207 - DNA, 25 bp, Mus musculus
ggagagctgagctgtccctggtgcc

SEQ ID NO: 596208 - DNA, 25 bp, Mus musculus
ggagagctgcaaccgcctagtataa

SEQ ID NO: 596209 - DNA, 25 bp, Mus musculus
ggagagctgcaagcgcctagtataa

SEQ ID NO: 596210 - DNA, 25 bp, Mus musculus
ggagagctgcctccatatttcatgg

SEQ ID NO: 596211 - DNA, 25 bp, Mus musculus
ggagagctgcctgcatatttcatgg

SEQ ID NO: 596212 - DNA, 25 bp, Mus musculus
ggagagctgtctcaaagcatgtccc

SEQ ID NO: 596213 - DNA, 25 bp, Mus musculus
ggagagctgtctgaaagcatgtccc

SEQ ID NO: 596214 - DNA, 25 bp, Mus musculus
ggagagctgtgtctaacccctctgg

SEQ ID NO: 596215 - DNA, 25 bp, Mus musculus
ggagagctgtgtgtaacccctctgg

SEQ ID NO: 596216 - DNA, 25 bp, Mus musculus
ggagagcttacgacatcacgggcat

SEQ ID NO: 596217 - DNA, 25 bp, Mus musculus
ggagagcttacgtcatcacgggcat

SEQ ID NO: 596218 - DNA, 25 bp, Mus musculus
ggagagcttagtcaacctaggtaac

SEQ ID NO: 596219 - DNA, 25 bp, Mus musculus
ggagagcttagtgaacctaggtaac

SEQ ID NO: 596220 - DNA, 25 bp, Mus musculus
ggagagcttccacacattagacatg

SEQ ID NO: 596221 - DNA, 25 bp, Mus musculus
ggagagcttccagacattagacatg

SEQ ID NO: 596222 - DNA, 25 bp, Mus musculus
ggagagcttgggactgccttttgca

SEQ ID NO: 596223 - DNA, 25 bp, Mus musculus
ggagagcttgggtctgccttttgca

SEQ ID NO: 596224 - DNA, 25 bp, Mus musculus
ggagagctttacctagccagtacag

SEQ ID NO: 596225 - DNA, 25 bp, Mus musculus
ggagagctttacgtagccagtacag

SEQ ID NO: 596226 - DNA, 25 bp, Mus musculus
ggagagcttttcaaatcggaagtca

SEQ ID NO: 596227 - DNA, 25 bp, Mus musculus
ggagagcttttctaatcggaagtca

SEQ ID NO: 596228 - DNA, 25 bp, Mus musculus
ggagaggaaccccaattgtgaaaat

SEQ ID NO: 596229 - DNA, 25 bp, Mus musculus
ggagaggaacccgaattgtgaaaat

SEQ ID NO: 596230 - DNA, 25 bp, Mus musculus
ggagaggacaagatcttcctgatca

SEQ ID NO: 596231 - DNA, 25 bp, Mus musculus
ggagaggacaagttcttcctgatca

SEQ ID NO: 596232 - DNA, 25 bp, Mus musculus
ggagaggacattatcagactatatc

SEQ ID NO: 596233 - DNA, 25 bp, Mus musculus
ggagaggacattttcagactatatc

SEQ ID NO: 596234 - DNA, 25 bp, Mus musculus
ggagaggaccctattgtgtttggca

SEQ ID NO: 596235 - DNA, 25 bp, Mus musculus
ggagaggacccttttgtgtttggca

SEQ ID NO: 596236 - DNA, 25 bp, Mus musculus
ggagaggacgctatatttacaacca

SEQ ID NO: 596237 - DNA, 25 bp, Mus musculus
ggagaggacgctttatttacaacca

SEQ ID NO: 596238 - DNA, 25 bp, Mus musculus
ggagaggacggccatcagatacttt

SEQ ID NO: 596239 - DNA, 25 bp, Mus musculus
ggagaggacggcgatcagatacttt

SEQ ID NO: 596240 - DNA, 25 bp, Mus musculus
ggagaggactccaaggccactacct

SEQ ID NO: 596241 - DNA, 25 bp, Mus musculus
ggagaggactcctaggccactacct

SEQ ID NO: 596242 - DNA, 25 bp, Mus musculus
ggagaggatactccaggcaccagat

SEQ ID NO: 596243 - DNA, 25 bp, Mus musculus
ggagaggatactgcaggcaccagat

SEQ ID NO: 596244 - DNA, 25 bp, Mus musculus
ggagaggatccgacaagcgatgaat

SEQ ID NO: 596245 - DNA, 25 bp, Mus musculus
ggagaggatccgtcaagcgatgaat

SEQ ID NO: 596246 - DNA, 25 bp, Mus musculus
ggagaggatgaacgctctacccaca

SEQ ID NO: 596247 - DNA, 25 bp, Mus musculus
ggagaggatgaaggctctacccaca

SEQ ID NO: 596248 - DNA, 25 bp, Mus musculus
ggagaggatgccaatcaacccgagg

SEQ ID NO: 596249 - DNA, 25 bp, Mus musculus
ggagaggatgcctatcaacccgagg

SEQ ID NO: 596250 - DNA, 25 bp, Mus musculus
ggagaggcaacaacactctgagagc

SEQ ID NO: 596251 - DNA, 25 bp, Mus musculus
ggagaggcaacatcactctgagagc

SEQ ID NO: 596252 - DNA, 25 bp, Mus musculus
ggagaggcactaacgggctgccact

SEQ ID NO: 596253 - DNA, 25 bp, Mus musculus
ggagaggcactatcgggctgccact

SEQ ID NO: 596254 - DNA, 25 bp, Mus musculus
ggagaggcagaacatcttcttgatg

SEQ ID NO: 596255 - DNA, 25 bp, Mus musculus
ggagaggcagaagatcttcttgatg

SEQ ID NO: 596256 - DNA, 25 bp, Mus musculus
ggagaggcagcaaatcccaggtaaa

SEQ ID NO: 596257 - DNA, 25 bp, Mus musculus
ggagaggcagcaatggatccccatg

SEQ ID NO: 596258 - DNA, 25 bp, Mus musculus
ggagaggcagcatatcccaggtaaa

SEQ ID NO: 596259 - DNA, 25 bp, Mus musculus
ggagaggcagcattggatccccatg

SEQ ID NO: 596260 - DNA, 25 bp, Mus musculus
ggagaggccaaaatcctatctgaca

SEQ ID NO: 596261 - DNA, 25 bp, Mus musculus
ggagaggccaaattcctatctgaca

SEQ ID NO: 596262 - DNA, 25 bp, Mus musculus
ggagaggccaacatttgactactta

SEQ ID NO: 596263 - DNA, 25 bp, Mus musculus
ggagaggccaacttttgactactta

SEQ ID NO: 596264 - DNA, 25 bp, Mus musculus
ggagaggccatcaatttgtcagttt

SEQ ID NO: 596265 - DNA, 25 bp, Mus musculus
ggagaggccatctatttgtcagttt

SEQ ID NO: 596266 - DNA, 25 bp, Mus musculus
ggagaggcctgcactgcacaagcca

SEQ ID NO: 596267 - DNA, 25 bp, Mus musculus
ggagaggcctgcatacctattttgt

SEQ ID NO: 596268 - DNA, 25 bp, Mus musculus
ggagaggcctgctctgcacaagcca

SEQ ID NO: 596269 - DNA, 25 bp, Mus musculus
ggagaggcctgcttacctattttgt

SEQ ID NO: 596270 - DNA, 25 bp, Mus musculus
ggagaggccttaagtttgcaaccaa

SEQ ID NO: 596271 - DNA, 25 bp, Mus musculus
ggagaggccttatgtttgcaaccaa

SEQ ID NO: 596272 - DNA, 25 bp, Mus musculus
ggagaggctagcaagcatccttgcc

SEQ ID NO: 596273 - DNA, 25 bp, Mus musculus
ggagaggctagctagcatccttgcc

SEQ ID NO: 596274 - DNA, 25 bp, Mus musculus
ggagaggctcatcgtgcgcattggc

SEQ ID NO: 596275 - DNA, 25 bp, Mus musculus
ggagaggctcatggtgcgcattggc

SEQ ID NO: 596276 - DNA, 25 bp, Mus musculus
ggagaggctcttccgcacccgaaag

SEQ ID NO: 596277 - DNA, 25 bp, Mus musculus
ggagaggctcttgcgcacccgaaag

SEQ ID NO: 596278 - DNA, 25 bp, Mus musculus
ggagaggctgtaagtccctggctca

SEQ ID NO: 596279 - DNA, 25 bp, Mus musculus
ggagaggctgtatgtccctggctca

SEQ ID NO: 596280 - DNA, 25 bp, Mus musculus
ggagagggaccacgcacaccttgca

SEQ ID NO: 596281 - DNA, 25 bp, Mus musculus
ggagagggaccaggcacaccttgca

SEQ ID NO: 596282 - DNA, 25 bp, Mus musculus
ggagagggcaccagagttaccgcct

SEQ ID NO: 596283 - DNA, 25 bp, Mus musculus
ggagagggcacctgagttaccgcct

SEQ ID NO: 596284 - DNA, 25 bp, Mus musculus
ggagagggctctacagtttttaatg

SEQ ID NO: 596285 - DNA, 25 bp, Mus musculus
ggagagggctcttcagtttttaatg

SEQ ID NO: 596286 - DNA, 25 bp, Mus musculus
ggagagggtctcatgggcccctata

SEQ ID NO: 596287 - DNA, 25 bp, Mus musculus
ggagagggtctcttgggcccctata

SEQ ID NO: 596288 - DNA, 25 bp, Mus musculus
ggagaggtacctagactacgccatc

SEQ ID NO: 596289 - DNA, 25 bp, Mus musculus
ggagaggtaccttgactacgccatc

SEQ ID NO: 596290 - DNA, 25 bp, Mus musculus
ggagaggtgaacactggattgtttt

SEQ ID NO: 596291 - DNA, 25 bp, Mus musculus
ggagaggtgaactctggattgtttt

SEQ ID NO: 596292 - DNA, 25 bp, Mus musculus
ggagaggtgcctattgtatccccaa

SEQ ID NO: 596293 - DNA, 25 bp, Mus musculus
ggagaggtgccttttgtatccccaa

SEQ ID NO: 596294 - DNA, 25 bp, Mus musculus
ggagaggttcccatcaaccatgaga

SEQ ID NO: 596295 - DNA, 25 bp, Mus musculus
ggagaggttcccttcaaccatgaga

SEQ ID NO: 596296 - DNA, 25 bp, Mus musculus
ggagaggttgacaccatcccggagc

SEQ ID NO: 596297 - DNA, 25 bp, Mus musculus
ggagaggttgactccatcccggagc

SEQ ID NO: 596298 - DNA, 25 bp, Mus musculus
ggagaggtttccacaagccacatag

SEQ ID NO: 596299 - DNA, 25 bp, Mus musculus
ggagaggtttcctcaagccacatag

SEQ ID NO: 596300 - DNA, 25 bp, Mus musculus
ggagaggtttgacgccctgttcacc

SEQ ID NO: 596301 - DNA, 25 bp, Mus musculus
ggagaggtttgaggccctgttcacc

SEQ ID NO: 596302 - DNA, 25 bp, Mus musculus
ggagagtaactcaaagccgcgacaa

SEQ ID NO: 596303 - DNA, 25 bp, Mus musculus
ggagagtaactctaagccgcgacaa

SEQ ID NO: 596304 - DNA, 25 bp, Mus musculus
ggagagtaagccatgtgtacgtcta

SEQ ID NO: 596305 - DNA, 25 bp, Mus musculus
ggagagtaagccttgtgtacgtcta

SEQ ID NO: 596306 - DNA, 25 bp, Mus musculus
ggagagtaatacaacagccaagagc

SEQ ID NO: 596307 - DNA, 25 bp, Mus musculus
ggagagtaatactacagccaagagc

SEQ ID NO: 596308 - DNA, 25 bp, Mus musculus
ggagagtactgtagtcactagttca

SEQ ID NO: 596309 - DNA, 25 bp, Mus musculus
ggagagtactgttgtcactagttca

SEQ ID NO: 596310 - DNA, 25 bp, Mus musculus
ggagagtatttcactaactccttga

SEQ ID NO: 596311 - DNA, 25 bp, Mus musculus
ggagagtatttctctaactccttga

SEQ ID NO: 596312 - DNA, 25 bp, Mus musculus
ggagagtcaagtctacgcttcacct

SEQ ID NO: 596313 - DNA, 25 bp, Mus musculus
ggagagtcaagtgtacgcttcacct

SEQ ID NO: 596314 - DNA, 25 bp, Mus musculus
ggagagtcacaaaagcttatctgta

SEQ ID NO: 596315 - DNA, 25 bp, Mus musculus
ggagagtcacaatagcttatctgta

SEQ ID NO: 596316 - DNA, 25 bp, Mus musculus
ggagagtcactactcactcagggat

SEQ ID NO: 596317 - DNA, 25 bp, Mus musculus
ggagagtcactagtcactcagggat

SEQ ID NO: 596318 - DNA, 25 bp, Mus musculus
ggagagtcagccatgttagtagaaa

SEQ ID NO: 596319 - DNA, 25 bp, Mus musculus
ggagagtcagccttgttagtagaaa

SEQ ID NO: 596320 - DNA, 25 bp, Mus musculus
ggagagtcatttctcacggaggtac

SEQ ID NO: 596321 - DNA, 25 bp, Mus musculus
ggagagtcatttgtcacggaggtac

SEQ ID NO: 596322 - DNA, 25 bp, Mus musculus
ggagagtccaatacttcaaacttca

SEQ ID NO: 596323 - DNA, 25 bp, Mus musculus
ggagagtccaattcttcaaacttca

SEQ ID NO: 596324 - DNA, 25 bp, Mus musculus
ggagagtccatgatcttacttagca

SEQ ID NO: 596325 - DNA, 25 bp, Mus musculus
ggagagtccatgttcttacttagca

SEQ ID NO: 596326 - DNA, 25 bp, Mus musculus
ggagagtcccacagactctgctaaa

SEQ ID NO: 596327 - DNA, 25 bp, Mus musculus
ggagagtcccactgactctgctaaa

SEQ ID NO: 596328 - DNA, 25 bp, Mus musculus
ggagagtccccgcaaagttgccact

SEQ ID NO: 596329 - DNA, 25 bp, Mus musculus
ggagagtccccggaaagttgccact

SEQ ID NO: 596330 - DNA, 25 bp, Mus musculus
ggagagtcctccaaacttcacacaa

SEQ ID NO: 596331 - DNA, 25 bp, Mus musculus
ggagagtcctcctaacttcacacaa

SEQ ID NO: 596332 - DNA, 25 bp, Mus musculus
ggagagtctattacaaaaacaccat

SEQ ID NO: 596333 - DNA, 25 bp, Mus musculus
ggagagtctatttcaaaaacaccat

SEQ ID NO: 596334 - DNA, 25 bp, Mus musculus
ggagagtctgacaccagaagcccgc

SEQ ID NO: 596335 - DNA, 25 bp, Mus musculus
ggagagtctgactccagaagcccgc

SEQ ID NO: 596336 - DNA, 25 bp, Mus musculus
ggagagtctgtgacccgtgagcctc

SEQ ID NO: 596337 - DNA, 25 bp, Mus musculus
ggagagtctgtgtcccgtgagcctc

SEQ ID NO: 596338 - DNA, 25 bp, Mus musculus
ggagagtcttacaggcattggcatc

SEQ ID NO: 596339 - DNA, 25 bp, Mus musculus
ggagagtcttactggcattggcatc

SEQ ID NO: 596340 - DNA, 25 bp, Mus musculus
ggagagtcttgtcctattttccagc

SEQ ID NO: 596341 - DNA, 25 bp, Mus musculus
ggagagtcttgtgctattttccagc

SEQ ID NO: 596342 - DNA, 25 bp, Mus musculus
ggagagtgaacaagatggctcagct

SEQ ID NO: 596343 - DNA, 25 bp, Mus musculus
ggagagtgaacatgatggctcagct

SEQ ID NO: 596344 - DNA, 25 bp, Mus musculus
ggagagtgacttatacctgcgttac

SEQ ID NO: 596345 - DNA, 25 bp, Mus musculus
ggagagtgacttttacctgcgttac

SEQ ID NO: 596346 - DNA, 25 bp, Mus musculus
ggagagtgcatgagtattgttgaca

SEQ ID NO: 596347 - DNA, 25 bp, Mus musculus
ggagagtgcatgtgtattgttgaca

SEQ ID NO: 596348 - DNA, 25 bp, Mus musculus
ggagagtggcacaacagacgccaat

SEQ ID NO: 596349 - DNA, 25 bp, Mus musculus
ggagagtggcactacagacgccaat

SEQ ID NO: 596350 - DNA, 25 bp, Mus musculus
ggagagtgggctagcagcacccacc

SEQ ID NO: 596351 - DNA, 25 bp, Mus musculus
ggagagtgggcttgcagcacccacc

SEQ ID NO: 596352 - DNA, 25 bp, Mus musculus
ggagagtggtcacttttcagaaatc

SEQ ID NO: 596353 - DNA, 25 bp, Mus musculus
ggagagtggtcagttttcagaaatc

SEQ ID NO: 596354 - DNA, 25 bp, Mus musculus
ggagagtgtacgaaaccatcccgcg

SEQ ID NO: 596355 - DNA, 25 bp, Mus musculus
ggagagtgtacgtaaccatcccgcg

SEQ ID NO: 596356 - DNA, 25 bp, Mus musculus
ggagagtgtatcctatctgtgaaca

SEQ ID NO: 596357 - DNA, 25 bp, Mus musculus
ggagagtgtatcgtatctgtgaaca

SEQ ID NO: 596358 - DNA, 25 bp, Mus musculus
ggagagtgttctataccatagatca

SEQ ID NO: 596359 - DNA, 25 bp, Mus musculus
ggagagtgttctttaccatagatca

SEQ ID NO: 596360 - DNA, 25 bp, Mus musculus
ggagagttcagacgctaccatccac

SEQ ID NO: 596361 - DNA, 25 bp, Mus musculus
ggagagttcagaggctaccatccac

SEQ ID NO: 596362 - DNA, 25 bp, Mus musculus
ggagagttccagctatcaatatgaa

SEQ ID NO: 596363 - DNA, 25 bp, Mus musculus
ggagagttccaggtatcaatatgaa

SEQ ID NO: 596364 - DNA, 25 bp, Mus musculus
ggagagttcctcattgtacatatat

SEQ ID NO: 596365 - DNA, 25 bp, Mus musculus
ggagagttcctctttgtacatatat

SEQ ID NO: 596366 - DNA, 25 bp, Mus musculus
ggagagttgcccagtggttccccat

SEQ ID NO: 596367 - DNA, 25 bp, Mus musculus
ggagagttgccctgtggttccccat

SEQ ID NO: 596368 - DNA, 25 bp, Mus musculus
ggagagttgcctagaaactactggc

SEQ ID NO: 596369 - DNA, 25 bp, Mus musculus
ggagagttgccttgaaactactggc

SEQ ID NO: 596370 - DNA, 25 bp, Mus musculus
ggagagttggctctttccactctga

SEQ ID NO: 596371 - DNA, 25 bp, Mus musculus
ggagagttggctgtttccactctga

SEQ ID NO: 596372 - DNA, 25 bp, Mus musculus
ggagagtttaacatcaagtcttgat

SEQ ID NO: 596373 - DNA, 25 bp, Mus musculus
ggagagtttaacttcaagtcttgat

SEQ ID NO: 596374 - DNA, 25 bp, Mus musculus
ggagagtttcaaacctatttcattt

SEQ ID NO: 596375 - DNA, 25 bp, Mus musculus
ggagagtttcaatcctatttcattt

SEQ ID NO: 596376 - DNA, 25 bp, Mus musculus
ggagagtttcagatgattatttaat

SEQ ID NO: 596377 - DNA, 25 bp, Mus musculus
ggagagtttcagttgattatttaat

SEQ ID NO: 596378 - DNA, 25 bp, Mus musculus
ggagagtttgtccattagcttccct

SEQ ID NO: 596379 - DNA, 25 bp, Mus musculus
ggagagtttgtcgattagcttccct

SEQ ID NO: 596380 - DNA, 25 bp, Mus musculus
ggagataaaactcagcatgcttaac

SEQ ID NO: 596381 - DNA, 25 bp, Mus musculus
ggagataaaactgagcatgcttaac

SEQ ID NO: 596382 - DNA, 25 bp, Mus musculus
ggagataaatccaacccagagtcaa

SEQ ID NO: 596383 - DNA, 25 bp, Mus musculus
ggagataaatcctacccagagtcaa

SEQ ID NO: 596384 - DNA, 25 bp, Mus musculus
ggagataaccaactctacaaatatg

SEQ ID NO: 596385 - DNA, 25 bp, Mus musculus
ggagataaccaagtctacaaatatg

SEQ ID NO: 596386 - DNA, 25 bp, Mus musculus
ggagataaccaccatgccaggaatt

SEQ ID NO: 596387 - DNA, 25 bp, Mus musculus
ggagataaccacgatgccaggaatt

SEQ ID NO: 596388 - DNA, 25 bp, Mus musculus
ggagataaccctatgccattgcatc

SEQ ID NO: 596389 - DNA, 25 bp, Mus musculus
ggagataaccctttgccattgcatc

SEQ ID NO: 596390 - DNA, 25 bp, Mus musculus
ggagataagcttaccactttgtccc

SEQ ID NO: 596391 - DNA, 25 bp, Mus musculus
ggagataagctttccactttgtccc

SEQ ID NO: 596392 - DNA, 25 bp, Mus musculus
ggagataataatcgctctggctccc

SEQ ID NO: 596393 - DNA, 25 bp, Mus musculus
ggagataataatggctctggctccc

SEQ ID NO: 596394 - DNA, 25 bp, Mus musculus
ggagataatggactcctacaactgc

SEQ ID NO: 596395 - DNA, 25 bp, Mus musculus
ggagataatggagtcctacaactgc

SEQ ID NO: 596396 - DNA, 25 bp, Mus musculus
ggagatacacagacctcagacatat

SEQ ID NO: 596397 - DNA, 25 bp, Mus musculus
ggagatacacagtcctcagacatat

SEQ ID NO: 596398 - DNA, 25 bp, Mus musculus
ggagatacacataaggatgctcact

SEQ ID NO: 596399 - DNA, 25 bp, Mus musculus
ggagatacacattaggatgctcact

SEQ ID NO: 596400 - DNA, 25 bp, Mus musculus
ggagatacaccgagactcttcattc

SEQ ID NO: 596401 - DNA, 25 bp, Mus musculus
ggagatacaccgtgactcttcattc

SEQ ID NO: 596402 - DNA, 25 bp, Mus musculus
ggagatacattccatacctcagtcc

SEQ ID NO: 596403 - DNA, 25 bp, Mus musculus
ggagatacattcgatacctcagtcc

SEQ ID NO: 596404 - DNA, 25 bp, Mus musculus
ggagataccacacatgccttcagct

SEQ ID NO: 596405 - DNA, 25 bp, Mus musculus
ggagataccacagatgccttcagct

SEQ ID NO: 596406 - DNA, 25 bp, Mus musculus
ggagatacctttaagaatccctgag

SEQ ID NO: 596407 - DNA, 25 bp, Mus musculus
ggagataccttttagaatccctgag

SEQ ID NO: 596408 - DNA, 25 bp, Mus musculus
ggagatacgtgtaatttcctgtcat

SEQ ID NO: 596409 - DNA, 25 bp, Mus musculus
ggagatacgtgttatttcctgtcat

SEQ ID NO: 596410 - DNA, 25 bp, Mus musculus
ggagatactatgctactgtcatgaa

SEQ ID NO: 596411 - DNA, 25 bp, Mus musculus
ggagatactatggtactgtcatgaa

SEQ ID NO: 596412 - DNA, 25 bp, Mus musculus
ggagatactcaacacatgcccgcct

SEQ ID NO: 596413 - DNA, 25 bp, Mus musculus
ggagatactcaagacatgcccgcct

SEQ ID NO: 596414 - DNA, 25 bp, Mus musculus
ggagatactcccaggtgcaacaaga

SEQ ID NO: 596415 - DNA, 25 bp, Mus musculus
ggagatactccctggtgcaacaaga

SEQ ID NO: 596416 - DNA, 25 bp, Mus musculus
ggagatactcctagtttctttttct

SEQ ID NO: 596417 - DNA, 25 bp, Mus musculus
ggagatactccttgtttctttttct

SEQ ID NO: 596418 - DNA, 25 bp, Mus musculus
ggagatactgaaagccatgcccgat

SEQ ID NO: 596419 - DNA, 25 bp, Mus musculus
ggagatactgaatgccatgcccgat

SEQ ID NO: 596420 - DNA, 25 bp, Mus musculus
ggagatagaaaaaatgacacgcaaa

SEQ ID NO: 596421 - DNA, 25 bp, Mus musculus
ggagatagaaaatatgacacgcaaa

SEQ ID NO: 596422 - DNA, 25 bp, Mus musculus
ggagatagcggtcctttatcccaac

SEQ ID NO: 596423 - DNA, 25 bp, Mus musculus
ggagatagcggtgctttatcccaac

SEQ ID NO: 596424 - DNA, 25 bp, Mus musculus
ggagataggcctccttattgttttg

SEQ ID NO: 596425 - DNA, 25 bp, Mus musculus
ggagataggcctgcttattgttttg

SEQ ID NO: 596426 - DNA, 25 bp, Mus musculus
ggagatagtcaacttcaaggccaat

SEQ ID NO: 596427 - DNA, 25 bp, Mus musculus
ggagatagtcaagttcaaggccaat

SEQ ID NO: 596428 - DNA, 25 bp, Mus musculus
ggagatagtccaataggcaccccta

SEQ ID NO: 596429 - DNA, 25 bp, Mus musculus
ggagatagtccattaggcaccccta

SEQ ID NO: 596430 - DNA, 25 bp, Mus musculus
ggagatagtccgagaagccatccgc

SEQ ID NO: 596431 - DNA, 25 bp, Mus musculus
ggagatagtccgtgaagccatccgc

SEQ ID NO: 596432 - DNA, 25 bp, Mus musculus
ggagatagtttcatacttcctggaa

SEQ ID NO: 596433 - DNA, 25 bp, Mus musculus
ggagatagtttcttacttcctggaa

SEQ ID NO: 596434 - DNA, 25 bp, Mus musculus
ggagatataaataacctattgtcta

SEQ ID NO: 596435 - DNA, 25 bp, Mus musculus
ggagatataaattacctattgtcta

SEQ ID NO: 596436 - DNA, 25 bp, Mus musculus
ggagatatacctctggacactcgaa

SEQ ID NO: 596437 - DNA, 25 bp, Mus musculus
ggagatatacctgtggacactcgaa

SEQ ID NO: 596438 - DNA, 25 bp, Mus musculus
ggagatatacgtaaatgcccctttt

SEQ ID NO: 596439 - DNA, 25 bp, Mus musculus
ggagatatacgttaatgcccctttt

SEQ ID NO: 596440 - DNA, 25 bp, Mus musculus
ggagatatatctccaacacaacatt

SEQ ID NO: 596441 - DNA, 25 bp, Mus musculus
ggagatatatctgcaacacaacatt

SEQ ID NO: 596442 - DNA, 25 bp, Mus musculus
ggagatatcagccaccgtctgcctt

SEQ ID NO: 596443 - DNA, 25 bp, Mus musculus
ggagatatcagcgaccgtctgcctt

SEQ ID NO: 596444 - DNA, 25 bp, Mus musculus
ggagatatccaccaattacttgaat

SEQ ID NO: 596445 - DNA, 25 bp, Mus musculus
ggagatatccacgaattacttgaat

SEQ ID NO: 596446 - DNA, 25 bp, Mus musculus
ggagatatcctcagtatcacataat

SEQ ID NO: 596447 - DNA, 25 bp, Mus musculus
ggagatatcctctgtatcacataat

SEQ ID NO: 596448 - DNA, 25 bp, Mus musculus
ggagatatgataatttacatggaca

SEQ ID NO: 596449 - DNA, 25 bp, Mus musculus
ggagatatgatattttacatggaca

SEQ ID NO: 596450 - DNA, 25 bp, Mus musculus
ggagatatgcaacaagccatttgta

SEQ ID NO: 596451 - DNA, 25 bp, Mus musculus
ggagatatgcaagaagccatttgta

SEQ ID NO: 596452 - DNA, 25 bp, Mus musculus
ggagatattacacaaaccaggagaa

SEQ ID NO: 596453 - DNA, 25 bp, Mus musculus
ggagatattacagaaaccaggagaa

SEQ ID NO: 596454 - DNA, 25 bp, Mus musculus
ggagatattccaccgctgttactgc

SEQ ID NO: 596455 - DNA, 25 bp, Mus musculus
ggagatattccagcgctgttactgc

SEQ ID NO: 596456 - DNA, 25 bp, Mus musculus
ggagatattcccaagtccccagaag

SEQ ID NO: 596457 - DNA, 25 bp, Mus musculus
ggagatattccctagtccccagaag

SEQ ID NO: 596458 - DNA, 25 bp, Mus musculus
ggagatattctacttttctgtaaag

SEQ ID NO: 596459 - DNA, 25 bp, Mus musculus
ggagatattctagttttctgtaaag

SEQ ID NO: 596460 - DNA, 25 bp, Mus musculus
ggagatattctgaccacttcgctaa

SEQ ID NO: 596461 - DNA, 25 bp, Mus musculus
ggagatattctgtccacttcgctaa

SEQ ID NO: 596462 - DNA, 25 bp, Mus musculus
ggagatattcttcactggttctttt

SEQ ID NO: 596463 - DNA, 25 bp, Mus musculus
ggagatattcttgactggttctttt

SEQ ID NO: 596464 - DNA, 25 bp, Mus musculus
ggagatatttctaaaacctaccaga

SEQ ID NO: 596465 - DNA, 25 bp, Mus musculus
ggagatatttcttaaacctaccaga

SEQ ID NO: 596466 - DNA, 25 bp, Mus musculus
ggagatattttaaggactgtgtttc

SEQ ID NO: 596467 - DNA, 25 bp, Mus musculus
ggagatattttatggactgtgtttc

SEQ ID NO: 596468 - DNA, 25 bp, Mus musculus
ggagatcaaagccaaaccctttcga

SEQ ID NO: 596469 - DNA, 25 bp, Mus musculus
ggagatcaaagcgaaaccctttcga

SEQ ID NO: 596470 - DNA, 25 bp, Mus musculus
ggagatcaacagatgcttcccctgt

SEQ ID NO: 596471 - DNA, 25 bp, Mus musculus
ggagatcaacagttgcttcccctgt

SEQ ID NO: 596472 - DNA, 25 bp, Mus musculus
ggagatcaagaacaccgacgtgaaa

SEQ ID NO: 596473 - DNA, 25 bp, Mus musculus
ggagatcaagaagaccgacgtgaaa

SEQ ID NO: 596474 - DNA, 25 bp, Mus musculus
ggagatcacaaacccttattgcatc

SEQ ID NO: 596475 - DNA, 25 bp, Mus musculus
ggagatcacaaagccttattgcatc

SEQ ID NO: 596476 - DNA, 25 bp, Mus musculus
ggagatcacaacagccaaaggaaag

SEQ ID NO: 596477 - DNA, 25 bp, Mus musculus
ggagatcacaactgccaaaggaaag

SEQ ID NO: 596478 - DNA, 25 bp, Mus musculus
ggagatcaccaaatttgaggagcat

SEQ ID NO: 596479 - DNA, 25 bp, Mus musculus
ggagatcaccaattttgaggagcat

SEQ ID NO: 596480 - DNA, 25 bp, Mus musculus
ggagatcacggcagctcagtcccta

SEQ ID NO: 596481 - DNA, 25 bp, Mus musculus
ggagatcacggctgctcagtcccta

SEQ ID NO: 596482 - DNA, 25 bp, Mus musculus
ggagatcactgacacgctatgctgt

SEQ ID NO: 596483 - DNA, 25 bp, Mus musculus
ggagatcactgagacgctatgctgt

SEQ ID NO: 596484 - DNA, 25 bp, Mus musculus
ggagatcagaccagagagccccata

SEQ ID NO: 596485 - DNA, 25 bp, Mus musculus
ggagatcagacctgagagccccata

SEQ ID NO: 596486 - DNA, 25 bp, Mus musculus
ggagatcagagactaacccatggga

SEQ ID NO: 596487 - DNA, 25 bp, Mus musculus
ggagatcagagagtaacccatggga

SEQ ID NO: 596488 - DNA, 25 bp, Mus musculus
ggagatcagagcaacccagacgtgg

SEQ ID NO: 596489 - DNA, 25 bp, Mus musculus
ggagatcagagctacccagacgtgg

SEQ ID NO: 596490 - DNA, 25 bp, Mus musculus
ggagatcagcctatgtgtcccacat

SEQ ID NO: 596491 - DNA, 25 bp, Mus musculus
ggagatcagcctttgtgtcccacat

SEQ ID NO: 596492 - DNA, 25 bp, Mus musculus
ggagatcagtagacaccggaaggca

SEQ ID NO: 596493 - DNA, 25 bp, Mus musculus
ggagatcagtagtcaccggaaggca

SEQ ID NO: 596494 - DNA, 25 bp, Mus musculus
ggagatcatccgcagagcacgctgt

SEQ ID NO: 596495 - DNA, 25 bp, Mus musculus
ggagatcatccggagagcacgctgt

SEQ ID NO: 596496 - DNA, 25 bp, Mus musculus
ggagatcatcctcagcaagggttac

SEQ ID NO: 596497 - DNA, 25 bp, Mus musculus
ggagatcatcctgagcaagggttac

SEQ ID NO: 596498 - DNA, 25 bp, Mus musculus
ggagatcatcggcagcatcaaggat

SEQ ID NO: 596499 - DNA, 25 bp, Mus musculus
ggagatcatcgggagcatcaaggat

SEQ ID NO: 596500 - DNA, 25 bp, Mus musculus
ggagatcatcttaggatagcccgtt

SEQ ID NO: 596501 - DNA, 25 bp, Mus musculus
ggagatcatcttcgacactctggcg

SEQ ID NO: 596502 - DNA, 25 bp, Mus musculus
ggagatcatcttggacactctggcg

SEQ ID NO: 596503 - DNA, 25 bp, Mus musculus
ggagatcatctttggatagcccgtt

SEQ ID NO: 596504 - DNA, 25 bp, Mus musculus
ggagatcatgagaaatatgttgtaa

SEQ ID NO: 596505 - DNA, 25 bp, Mus musculus
ggagatcatgagtaatatgttgtaa

SEQ ID NO: 596506 - DNA, 25 bp, Mus musculus
ggagatcatgcaagctggtggctgg

SEQ ID NO: 596507 - DNA, 25 bp, Mus musculus
ggagatcatgcatgctggtggctgg

SEQ ID NO: 596508 - DNA, 25 bp, Mus musculus
ggagatcattaacaggcccaacaca

SEQ ID NO: 596509 - DNA, 25 bp, Mus musculus
ggagatcattaagaggcccaacaca

SEQ ID NO: 596510 - DNA, 25 bp, Mus musculus
ggagatccacccctaatcttttcct

SEQ ID NO: 596511 - DNA, 25 bp, Mus musculus
ggagatccacccgtaatcttttcct

SEQ ID NO: 596512 - DNA, 25 bp, Mus musculus
ggagatccacggagtgggccaggat

SEQ ID NO: 596513 - DNA, 25 bp, Mus musculus
ggagatccacggtgtgggccaggat

SEQ ID NO: 596514 - DNA, 25 bp, Mus musculus
ggagatccactacaaggctgagctg

SEQ ID NO: 596515 - DNA, 25 bp, Mus musculus
ggagatccactagaaggctgagctg

SEQ ID NO: 596516 - DNA, 25 bp, Mus musculus
ggagatccagatcgccatgaagcat

SEQ ID NO: 596517 - DNA, 25 bp, Mus musculus
ggagatccagatggccatgaagcat

SEQ ID NO: 596518 - DNA, 25 bp, Mus musculus
ggagatccagcaccaagcacgtcga

SEQ ID NO: 596519 - DNA, 25 bp, Mus musculus
ggagatccagcagcaagcacgtcga

SEQ ID NO: 596520 - DNA, 25 bp, Mus musculus
ggagatccagccaggtttcatccgc

SEQ ID NO: 596521 - DNA, 25 bp, Mus musculus
ggagatccagcctggtttcatccgc

SEQ ID NO: 596522 - DNA, 25 bp, Mus musculus
ggagatccaggactccccataggaa

SEQ ID NO: 596523 - DNA, 25 bp, Mus musculus
ggagatccaggagtccccataggaa

SEQ ID NO: 596524 - DNA, 25 bp, Mus musculus
ggagatccaggtatacctgtgcctg

SEQ ID NO: 596525 - DNA, 25 bp, Mus musculus
ggagatccaggtttacctgtgcctg

SEQ ID NO: 596526 - DNA, 25 bp, Mus musculus
ggagatccagtacacggagcatcta

SEQ ID NO: 596527 - DNA, 25 bp, Mus musculus
ggagatccagtagacggagcatcta

SEQ ID NO: 596528 - DNA, 25 bp, Mus musculus
ggagatccagttaaattcaaggtga

SEQ ID NO: 596529 - DNA, 25 bp, Mus musculus
ggagatccagtttaattcaaggtga

SEQ ID NO: 596530 - DNA, 25 bp, Mus musculus
ggagatcccatgatgggagaacgaa

SEQ ID NO: 596531 - DNA, 25 bp, Mus musculus
ggagatcccatgttgggagaacgaa

SEQ ID NO: 596532 - DNA, 25 bp, Mus musculus
ggagatcccctgcacatgaggagta

SEQ ID NO: 596533 - DNA, 25 bp, Mus musculus
ggagatcccctggacatgaggagta

SEQ ID NO: 596534 - DNA, 25 bp, Mus musculus
ggagatcccttcctgttgactacag

SEQ ID NO: 596535 - DNA, 25 bp, Mus musculus
ggagatcccttcgtgttgactacag

SEQ ID NO: 596536 - DNA, 25 bp, Mus musculus
ggagatccgtaactaatcggtgcta

SEQ ID NO: 596537 - DNA, 25 bp, Mus musculus
ggagatccgtaagtaatcggtgcta

SEQ ID NO: 596538 - DNA, 25 bp, Mus musculus
ggagatcctacacacctaccagaag

SEQ ID NO: 596539 - DNA, 25 bp, Mus musculus
ggagatcctacagacctaccagaag

SEQ ID NO: 596540 - DNA, 25 bp, Mus musculus
ggagatcctcaactgcagcgcttac

SEQ ID NO: 596541 - DNA, 25 bp, Mus musculus
ggagatcctcaagtgcagcgcttac

SEQ ID NO: 596542 - DNA, 25 bp, Mus musculus
ggagatcctcacagctttagaaatg

SEQ ID NO: 596543 - DNA, 25 bp, Mus musculus
ggagatcctcactgctttagaaatg

SEQ ID NO: 596544 - DNA, 25 bp, Mus musculus
ggagatcctcatctaactccatttc

SEQ ID NO: 596545 - DNA, 25 bp, Mus musculus
ggagatcctcatgtaactccatttc

SEQ ID NO: 596546 - DNA, 25 bp, Mus musculus
ggagatcctgatctacatcaatgac

SEQ ID NO: 596547 - DNA, 25 bp, Mus musculus
ggagatcctgatgtacatcaatgac

SEQ ID NO: 596548 - DNA, 25 bp, Mus musculus
ggagatcctgcacttggaggcacct

SEQ ID NO: 596549 - DNA, 25 bp, Mus musculus
ggagatcctgcagttggaggcacct

SEQ ID NO: 596550 - DNA, 25 bp, Mus musculus
ggagatcctggtcatgcagcccaac

SEQ ID NO: 596551 - DNA, 25 bp, Mus musculus
ggagatcctggtgatgcagcccaac

SEQ ID NO: 596552 - DNA, 25 bp, Mus musculus
ggagatcctttacgtgtcccagaag

SEQ ID NO: 596553 - DNA, 25 bp, Mus musculus
ggagatcctttaggtgtcccagaag

SEQ ID NO: 596554 - DNA, 25 bp, Mus musculus
ggagatcgaataccaagttttagat

SEQ ID NO: 596555 - DNA, 25 bp, Mus musculus
ggagatcgaatagcaagttttagat

SEQ ID NO: 596556 - DNA, 25 bp, Mus musculus
ggagatcgatcactctgattcagta

SEQ ID NO: 596557 - DNA, 25 bp, Mus musculus
ggagatcgatcagtctgattcagta

SEQ ID NO: 596558 - DNA, 25 bp, Mus musculus
ggagatcgtgtgagtctacggctac

SEQ ID NO: 596559 - DNA, 25 bp, Mus musculus
ggagatcgtgtgtgtctacggctac

SEQ ID NO: 596560 - DNA, 25 bp, Mus musculus
ggagatctataccaccagttttact

SEQ ID NO: 596561 - DNA, 25 bp, Mus musculus
ggagatctatacgaccagttttact

SEQ ID NO: 596562 - DNA, 25 bp, Mus musculus
ggagatctcaatatacacagtgcaa

SEQ ID NO: 596563 - DNA, 25 bp, Mus musculus
ggagatctcaatttacacagtgcaa

SEQ ID NO: 596564 - DNA, 25 bp, Mus musculus
ggagatctcacaacagttttacctg

SEQ ID NO: 596565 - DNA, 25 bp, Mus musculus
ggagatctcacatcagttttacctg

SEQ ID NO: 596566 - DNA, 25 bp, Mus musculus
ggagatctcatcaatggccagtgtg

SEQ ID NO: 596567 - DNA, 25 bp, Mus musculus
ggagatctcatctatggccagtgtg

SEQ ID NO: 596568 - DNA, 25 bp, Mus musculus
ggagatctccacagacggcctgggt

SEQ ID NO: 596569 - DNA, 25 bp, Mus musculus
ggagatctccactgacggcctgggt

SEQ ID NO: 596570 - DNA, 25 bp, Mus musculus
ggagatctccgaattgctggcctct

SEQ ID NO: 596571 - DNA, 25 bp, Mus musculus
ggagatctccgatttgctggcctct

SEQ ID NO: 596572 - DNA, 25 bp, Mus musculus
ggagatctcttcaatggtcgatatc

SEQ ID NO: 596573 - DNA, 25 bp, Mus musculus
ggagatctcttctatggtcgatatc

SEQ ID NO: 596574 - DNA, 25 bp, Mus musculus
ggagatctgaacataggccctttca

SEQ ID NO: 596575 - DNA, 25 bp, Mus musculus
ggagatctgaacttaggccctttca

SEQ ID NO: 596576 - DNA, 25 bp, Mus musculus
ggagatctgaatataccttaaccaa

SEQ ID NO: 596577 - DNA, 25 bp, Mus musculus
ggagatctgaatttaccttaaccaa

SEQ ID NO: 596578 - DNA, 25 bp, Mus musculus
ggagatctgagtccataaggttttc

SEQ ID NO: 596579 - DNA, 25 bp, Mus musculus
ggagatctgagtgcataaggttttc

SEQ ID NO: 596580 - DNA, 25 bp, Mus musculus
ggagatctgcaaagccaatgtcccc

SEQ ID NO: 596581 - DNA, 25 bp, Mus musculus
ggagatctgcaatgccaatgtcccc

SEQ ID NO: 596582 - DNA, 25 bp, Mus musculus
ggagatctggtgatcattgccttag

SEQ ID NO: 596583 - DNA, 25 bp, Mus musculus
ggagatctggtgttcattgccttag

SEQ ID NO: 596584 - DNA, 25 bp, Mus musculus
ggagatctgtataagacttctgctt

SEQ ID NO: 596585 - DNA, 25 bp, Mus musculus
ggagatctgtattagacttctgctt

SEQ ID NO: 596586 - DNA, 25 bp, Mus musculus
ggagatctgtcgaccctgtgaggca

SEQ ID NO: 596587 - DNA, 25 bp, Mus musculus
ggagatctgtcgtccctgtgaggca

SEQ ID NO: 596588 - DNA, 25 bp, Mus musculus
ggagatcttacactcctagaaacag

SEQ ID NO: 596589 - DNA, 25 bp, Mus musculus
ggagatcttacagtcctagaaacag

SEQ ID NO: 596590 - DNA, 25 bp, Mus musculus
ggagatcttatcatgaccgggactc

SEQ ID NO: 596591 - DNA, 25 bp, Mus musculus
ggagatcttatcttgaccgggactc

SEQ ID NO: 596592 - DNA, 25 bp, Mus musculus
ggagatcttcctagtatcaaatgca

SEQ ID NO: 596593 - DNA, 25 bp, Mus musculus
ggagatcttccttgtatcaaatgca

SEQ ID NO: 596594 - DNA, 25 bp, Mus musculus
ggagatctttcgcaccatcattgat

SEQ ID NO: 596595 - DNA, 25 bp, Mus musculus
ggagatctttcggaccatcattgat

SEQ ID NO: 596596 - DNA, 25 bp, Mus musculus
ggagatctttgccttgttgtttccc

SEQ ID NO: 596597 - DNA, 25 bp, Mus musculus
ggagatctttgcgttgttgtttccc

SEQ ID NO: 596598 - DNA, 25 bp, Mus musculus
ggagatctttggcaccattggaatg

SEQ ID NO: 596599 - DNA, 25 bp, Mus musculus
ggagatctttgggaccattggaatg

SEQ ID NO: 596600 - DNA, 25 bp, Mus musculus
ggagatctttgtacacggccaagga

SEQ ID NO: 596601 - DNA, 25 bp, Mus musculus
ggagatctttgttcacggccaagga

SEQ ID NO: 596602 - DNA, 25 bp, Mus musculus
ggagatgaaactccggattctgtct

SEQ ID NO: 596603 - DNA, 25 bp, Mus musculus
ggagatgaaactgcggattctgtct

SEQ ID NO: 596604 - DNA, 25 bp, Mus musculus
ggagatgaacacactgtaagctttc

SEQ ID NO: 596605 - DNA, 25 bp, Mus musculus
ggagatgaacactctgtaagctttc

SEQ ID NO: 596606 - DNA, 25 bp, Mus musculus
ggagatgaacatctggtcgcccaaa

SEQ ID NO: 596607 - DNA, 25 bp, Mus musculus
ggagatgaacatgtggtcgcccaaa

SEQ ID NO: 596608 - DNA, 25 bp, Mus musculus
ggagatgaaccaatatgtcacagat

SEQ ID NO: 596609 - DNA, 25 bp, Mus musculus
ggagatgaaccattatgtcacagat

SEQ ID NO: 596610 - DNA, 25 bp, Mus musculus
ggagatgaacccaggagcctgtaat

SEQ ID NO: 596611 - DNA, 25 bp, Mus musculus
ggagatgaaccctggagcctgtaat

SEQ ID NO: 596612 - DNA, 25 bp, Mus musculus
ggagatgaacgtctgcgacaaccta

SEQ ID NO: 596613 - DNA, 25 bp, Mus musculus
ggagatgaacgtgtgcgacaaccta

SEQ ID NO: 596614 - DNA, 25 bp, Mus musculus
ggagatgaagtacggccgcaaatcc

SEQ ID NO: 596615 - DNA, 25 bp, Mus musculus
ggagatgaagtagggccgcaaatcc

SEQ ID NO: 596616 - DNA, 25 bp, Mus musculus
ggagatgacacccaaagatttgcac

SEQ ID NO: 596617 - DNA, 25 bp, Mus musculus
ggagatgacaccgaaagatttgcac

SEQ ID NO: 596618 - DNA, 25 bp, Mus musculus
ggagatgaccaactgatttgtctta

SEQ ID NO: 596619 - DNA, 25 bp, Mus musculus
ggagatgaccaagtgatttgtctta

SEQ ID NO: 596620 - DNA, 25 bp, Mus musculus
ggagatgaccacactcccttcaggc

SEQ ID NO: 596621 - DNA, 25 bp, Mus musculus
ggagatgaccacctagctgggccaa

SEQ ID NO: 596622 - DNA, 25 bp, Mus musculus
ggagatgaccacgtagctgggccaa

SEQ ID NO: 596623 - DNA, 25 bp, Mus musculus
ggagatgaccactctcccttcaggc

SEQ ID NO: 596624 - DNA, 25 bp, Mus musculus
ggagatgacccaagcttgagctgta

SEQ ID NO: 596625 - DNA, 25 bp, Mus musculus
ggagatgacccatgcttgagctgta

SEQ ID NO: 596626 - DNA, 25 bp, Mus musculus
ggagatgaccctacgatacagccag

SEQ ID NO: 596627 - DNA, 25 bp, Mus musculus
ggagatgaccctcccctaggctttc

SEQ ID NO: 596628 - DNA, 25 bp, Mus musculus
ggagatgaccctgccctaggctttc

SEQ ID NO: 596629 - DNA, 25 bp, Mus musculus
ggagatgacccttcgatacagccag

SEQ ID NO: 596630 - DNA, 25 bp, Mus musculus
ggagatgagaaaacccgcctaattc

SEQ ID NO: 596631 - DNA, 25 bp, Mus musculus
ggagatgagaaatcccgcctaattc

SEQ ID NO: 596632 - DNA, 25 bp, Mus musculus
ggagatgagactaccataccctacc

SEQ ID NO: 596633 - DNA, 25 bp, Mus musculus
ggagatgagacttccataccctacc

SEQ ID NO: 596634 - DNA, 25 bp, Mus musculus
ggagatgagcccacaccgaaacagt

SEQ ID NO: 596635 - DNA, 25 bp, Mus musculus
ggagatgagccctcaccgaaacagt

SEQ ID NO: 596636 - DNA, 25 bp, Mus musculus
ggagatgagcgtacctttctacacc

SEQ ID NO: 596637 - DNA, 25 bp, Mus musculus
ggagatgagcgttcctttctacacc

SEQ ID NO: 596638 - DNA, 25 bp, Mus musculus
ggagatgaggacaccccaacttcag

SEQ ID NO: 596639 - DNA, 25 bp, Mus musculus
ggagatgaggactccccaacttcag

SEQ ID NO: 596640 - DNA, 25 bp, Mus musculus
ggagatgataacacctaccttgcag

SEQ ID NO: 596641 - DNA, 25 bp, Mus musculus
ggagatgataactcctaccttgcag

SEQ ID NO: 596642 - DNA, 25 bp, Mus musculus
ggagatgatcgacactgggctcttt

SEQ ID NO: 596643 - DNA, 25 bp, Mus musculus
ggagatgatcgagactgggctcttt

SEQ ID NO: 596644 - DNA, 25 bp, Mus musculus
ggagatgatcgcagagttcaaggct

SEQ ID NO: 596645 - DNA, 25 bp, Mus musculus
ggagatgatcgctgagttcaaggct

SEQ ID NO: 596646 - DNA, 25 bp, Mus musculus
ggagatgatggtatctgacttccag

SEQ ID NO: 596647 - DNA, 25 bp, Mus musculus
ggagatgatggtttctgacttccag

SEQ ID NO: 596648 - DNA, 25 bp, Mus musculus
ggagatgattttcccattgtccatg

SEQ ID NO: 596649 - DNA, 25 bp, Mus musculus
ggagatgattttgccattgtccatg

SEQ ID NO: 596650 - DNA, 25 bp, Mus musculus
ggagatgcaaccaagtctacctcta

SEQ ID NO: 596651 - DNA, 25 bp, Mus musculus
ggagatgcaacctagtctacctcta

SEQ ID NO: 596652 - DNA, 25 bp, Mus musculus
ggagatgcaagtcagcagagcctat

SEQ ID NO: 596653 - DNA, 25 bp, Mus musculus
ggagatgcaagtgagcagagcctat

SEQ ID NO: 596654 - DNA, 25 bp, Mus musculus
ggagatgcaatgactgtgcccacca

SEQ ID NO: 596655 - DNA, 25 bp, Mus musculus
ggagatgcaatgtctgtgcccacca

SEQ ID NO: 596656 - DNA, 25 bp, Mus musculus
ggagatgcacagcatcttgtctgaa

SEQ ID NO: 596657 - DNA, 25 bp, Mus musculus
ggagatgcacaggatcttgtctgaa

SEQ ID NO: 596658 - DNA, 25 bp, Mus musculus
ggagatgcacctaaaagatttcatg

SEQ ID NO: 596659 - DNA, 25 bp, Mus musculus
ggagatgcaccttaaagatttcatg

SEQ ID NO: 596660 - DNA, 25 bp, Mus musculus
ggagatgcaggtccttagcaccaca

SEQ ID NO: 596661 - DNA, 25 bp, Mus musculus
ggagatgcaggtgcttagcaccaca

SEQ ID NO: 596662 - DNA, 25 bp, Mus musculus
ggagatgcagtcacacagcaaactc

SEQ ID NO: 596663 - DNA, 25 bp, Mus musculus
ggagatgcagtctcacagcaaactc

SEQ ID NO: 596664 - DNA, 25 bp, Mus musculus
ggagatgccaacactgccaggagtc

SEQ ID NO: 596665 - DNA, 25 bp, Mus musculus
ggagatgccaactctgccaggagtc

SEQ ID NO: 596666 - DNA, 25 bp, Mus musculus
ggagatgccaagcacctcggttctg

SEQ ID NO: 596667 - DNA, 25 bp, Mus musculus
ggagatgccaaggacctcggttctg

SEQ ID NO: 596668 - DNA, 25 bp, Mus musculus
ggagatgccagcacatatgcacatt

SEQ ID NO: 596669 - DNA, 25 bp, Mus musculus
ggagatgccagctcatatgcacatt

SEQ ID NO: 596670 - DNA, 25 bp, Mus musculus
ggagatgccagtatgcacacagaaa

SEQ ID NO: 596671 - DNA, 25 bp, Mus musculus
ggagatgccagtttgcacacagaaa

SEQ ID NO: 596672 - DNA, 25 bp, Mus musculus
ggagatgccccaaagcacagagaat

SEQ ID NO: 596673 - DNA, 25 bp, Mus musculus
ggagatgccccatagcacagagaat

SEQ ID NO: 596674 - DNA, 25 bp, Mus musculus
ggagatgcctgtcgccgaccctgca

SEQ ID NO: 596675 - DNA, 25 bp, Mus musculus
ggagatgcctgtggccgaccctgca

SEQ ID NO: 596676 - DNA, 25 bp, Mus musculus
ggagatgcgagtatactcccttctt

SEQ ID NO: 596677 - DNA, 25 bp, Mus musculus
ggagatgcgagtttactcccttctt

SEQ ID NO: 596678 - DNA, 25 bp, Mus musculus
ggagatgcgcctagttaccatcaga

SEQ ID NO: 596679 - DNA, 25 bp, Mus musculus
ggagatgcgccttgttaccatcaga

SEQ ID NO: 596680 - DNA, 25 bp, Mus musculus
ggagatgcggaaactcttcatccag

SEQ ID NO: 596681 - DNA, 25 bp, Mus musculus
ggagatgcggaatctcttcatccag

SEQ ID NO: 596682 - DNA, 25 bp, Mus musculus
ggagatgcgtatcctgccagagaca

SEQ ID NO: 596683 - DNA, 25 bp, Mus musculus
ggagatgcgtatgctgccagagaca

SEQ ID NO: 596684 - DNA, 25 bp, Mus musculus
ggagatgctaatcatctcccaccac

SEQ ID NO: 596685 - DNA, 25 bp, Mus musculus
ggagatgctaatgatctcccaccac

SEQ ID NO: 596686 - DNA, 25 bp, Mus musculus
ggagatgctagtcagccgtcattta

SEQ ID NO: 596687 - DNA, 25 bp, Mus musculus
ggagatgctagtgagccgtcattta

SEQ ID NO: 596688 - DNA, 25 bp, Mus musculus
ggagatgctcaaaccctggccgtga

SEQ ID NO: 596689 - DNA, 25 bp, Mus musculus
ggagatgctcaatccctggccgtga

SEQ ID NO: 596690 - DNA, 25 bp, Mus musculus
ggagatgctctaagccaacattaag

SEQ ID NO: 596691 - DNA, 25 bp, Mus musculus
ggagatgctctatgccaacattaag

SEQ ID NO: 596692 - DNA, 25 bp, Mus musculus
ggagatgctgaaagctcacacgctt

SEQ ID NO: 596693 - DNA, 25 bp, Mus musculus
ggagatgctgaatgctcacacgctt

SEQ ID NO: 596694 - DNA, 25 bp, Mus musculus
ggagatgctgacacttttgtacatt

SEQ ID NO: 596695 - DNA, 25 bp, Mus musculus
ggagatgctgactcttttgtacatt

SEQ ID NO: 596696 - DNA, 25 bp, Mus musculus
ggagatgctgatcaaccagagcctg

SEQ ID NO: 596697 - DNA, 25 bp, Mus musculus
ggagatgctgatgaaccagagcctg

SEQ ID NO: 596698 - DNA, 25 bp, Mus musculus
ggagatgctgctaagctgatcccac

SEQ ID NO: 596699 - DNA, 25 bp, Mus musculus
ggagatgctgcttagctgatcccac

SEQ ID NO: 596700 - DNA, 25 bp, Mus musculus
ggagatgctgttattgccctggtcc

SEQ ID NO: 596701 - DNA, 25 bp, Mus musculus
ggagatgctgtttttgccctggtcc

SEQ ID NO: 596702 - DNA, 25 bp, Mus musculus
ggagatggacacagctatagcccta

SEQ ID NO: 596703 - DNA, 25 bp, Mus musculus
ggagatggacactgctatagcccta

SEQ ID NO: 596704 - DNA, 25 bp, Mus musculus
ggagatggagctcctcaacgcctac

SEQ ID NO: 596705 - DNA, 25 bp, Mus musculus
ggagatggagctgctcaacgcctac

SEQ ID NO: 596706 - DNA, 25 bp, Mus musculus
ggagatggataccactcttttctat

SEQ ID NO: 596707 - DNA, 25 bp, Mus musculus
ggagatggatacgactcttttctat

SEQ ID NO: 596708 - DNA, 25 bp, Mus musculus
ggagatggatcacagacacctgcac

SEQ ID NO: 596709 - DNA, 25 bp, Mus musculus
ggagatggatcagagacacctgcac

SEQ ID NO: 596710 - DNA, 25 bp, Mus musculus
ggagatggatgcacagctgtcacat

SEQ ID NO: 596711 - DNA, 25 bp, Mus musculus
ggagatggatgctcagctgtcacat

SEQ ID NO: 596712 - DNA, 25 bp, Mus musculus
ggagatggcacaccggaaccaccgt

SEQ ID NO: 596713 - DNA, 25 bp, Mus musculus
ggagatggcacagcggaaccaccgt

SEQ ID NO: 596714 - DNA, 25 bp, Mus musculus
ggagatggccacagagaccactgat

SEQ ID NO: 596715 - DNA, 25 bp, Mus musculus
ggagatggccactgagaccactgat

SEQ ID NO: 596716 - DNA, 25 bp, Mus musculus
ggagatggccagcattccaccagag

SEQ ID NO: 596717 - DNA, 25 bp, Mus musculus
ggagatggccaggattccaccagag

SEQ ID NO: 596718 - DNA, 25 bp, Mus musculus
ggagatggccatactaactactgtt

SEQ ID NO: 596719 - DNA, 25 bp, Mus musculus
ggagatggccattctaactactgtt

SEQ ID NO: 596720 - DNA, 25 bp, Mus musculus
ggagatggcgagacccatagcaaat

SEQ ID NO: 596721 - DNA, 25 bp, Mus musculus
ggagatggcgagtcccatagcaaat

SEQ ID NO: 596722 - DNA, 25 bp, Mus musculus
ggagatggcttcaataaccccacga

SEQ ID NO: 596723 - DNA, 25 bp, Mus musculus
ggagatggcttcagatagcttccca

SEQ ID NO: 596724 - DNA, 25 bp, Mus musculus
ggagatggcttccacatgcgtgact

SEQ ID NO: 596725 - DNA, 25 bp, Mus musculus
ggagatggcttcgacatgcgtgact

SEQ ID NO: 596726 - DNA, 25 bp, Mus musculus
ggagatggcttctataaccccacga

SEQ ID NO: 596727 - DNA, 25 bp, Mus musculus
ggagatggcttctgatagcttccca

SEQ ID NO: 596728 - DNA, 25 bp, Mus musculus
ggagatggcttgcatctatagccca

SEQ ID NO: 596729 - DNA, 25 bp, Mus musculus
ggagatggcttggatctatagccca

SEQ ID NO: 596730 - DNA, 25 bp, Mus musculus
ggagatgggccgaactacatgtacc

SEQ ID NO: 596731 - DNA, 25 bp, Mus musculus
ggagatgggccgtactacatgtacc

SEQ ID NO: 596732 - DNA, 25 bp, Mus musculus
ggagatgggcgccactactgctacc

SEQ ID NO: 596733 - DNA, 25 bp, Mus musculus
ggagatgggcgcgactactgctacc

SEQ ID NO: 596734 - DNA, 25 bp, Mus musculus
ggagatgggtcactcagaacctagt

SEQ ID NO: 596735 - DNA, 25 bp, Mus musculus
ggagatgggtcagtcagaacctagt

SEQ ID NO: 596736 - DNA, 25 bp, Mus musculus
ggagatggtgcaagccttggcatcc

SEQ ID NO: 596737 - DNA, 25 bp, Mus musculus
ggagatggtgcatgccttggcatcc

SEQ ID NO: 596738 - DNA, 25 bp, Mus musculus
ggagatggttacaacgggtacttcg

SEQ ID NO: 596739 - DNA, 25 bp, Mus musculus
ggagatggttactacgggtacttcg

SEQ ID NO: 596740 - DNA, 25 bp, Mus musculus
ggagatgtacaaaccgttccaatac

SEQ ID NO: 596741 - DNA, 25 bp, Mus musculus
ggagatgtacaatccgttccaatac

SEQ ID NO: 596742 - DNA, 25 bp, Mus musculus
ggagatgtactcatgacagtagcga

SEQ ID NO: 596743 - DNA, 25 bp, Mus musculus
ggagatgtactcttgacagtagcga

SEQ ID NO: 596744 - DNA, 25 bp, Mus musculus
ggagatgtactgcaggttcaaccca

SEQ ID NO: 596745 - DNA, 25 bp, Mus musculus
ggagatgtactggaggttcaaccca

SEQ ID NO: 596746 - DNA, 25 bp, Mus musculus
ggagatgtatgaagccgacctgtta

SEQ ID NO: 596747 - DNA, 25 bp, Mus musculus
ggagatgtatgatgccgacctgtta

SEQ ID NO: 596748 - DNA, 25 bp, Mus musculus
ggagatgtcacacccagaaccaagt

SEQ ID NO: 596749 - DNA, 25 bp, Mus musculus
ggagatgtcacagccagaaccaagt

SEQ ID NO: 596750 - DNA, 25 bp, Mus musculus
ggagatgtccctatatttattgcga

SEQ ID NO: 596751 - DNA, 25 bp, Mus musculus
ggagatgtccctttatttattgcga

SEQ ID NO: 596752 - DNA, 25 bp, Mus musculus
ggagatgtcctactgtcgcgtttca

SEQ ID NO: 596753 - DNA, 25 bp, Mus musculus
ggagatgtcctagtgtcgcgtttca

SEQ ID NO: 596754 - DNA, 25 bp, Mus musculus
ggagatgtgaccaggcacccggcat

SEQ ID NO: 596755 - DNA, 25 bp, Mus musculus
ggagatgtgacctggcacccggcat

SEQ ID NO: 596756 - DNA, 25 bp, Mus musculus
ggagatgtgccgagccccaagtcaa

SEQ ID NO: 596757 - DNA, 25 bp, Mus musculus
ggagatgtgccgtgccccaagtcaa

SEQ ID NO: 596758 - DNA, 25 bp, Mus musculus
ggagatgtgcctctcacaggttagt

SEQ ID NO: 596759 - DNA, 25 bp, Mus musculus
ggagatgtgcctgtcacaggttagt

SEQ ID NO: 596760 - DNA, 25 bp, Mus musculus
ggagatgtgctacgttcagcttaaa

SEQ ID NO: 596761 - DNA, 25 bp, Mus musculus
ggagatgtgctaggttcagcttaaa

SEQ ID NO: 596762 - DNA, 25 bp, Mus musculus
ggagatgtggccatcagactgtttc

SEQ ID NO: 596763 - DNA, 25 bp, Mus musculus
ggagatgtggccttcagactgtttc

SEQ ID NO: 596764 - DNA, 25 bp, Mus musculus
ggagatgtgtgcatatcctagaaca

SEQ ID NO: 596765 - DNA, 25 bp, Mus musculus
ggagatgtgtgcttatcctagaaca

SEQ ID NO: 596766 - DNA, 25 bp, Mus musculus
ggagatgtgttcattccacggcagc

SEQ ID NO: 596767 - DNA, 25 bp, Mus musculus
ggagatgtgttctttccacggcagc

SEQ ID NO: 596768 - DNA, 25 bp, Mus musculus
ggagatgttagtcagtgtttatcaa

SEQ ID NO: 596769 - DNA, 25 bp, Mus musculus
ggagatgttagtgagtgtttatcaa

SEQ ID NO: 596770 - DNA, 25 bp, Mus musculus
ggagatgttccacgattttgactac

SEQ ID NO: 596771 - DNA, 25 bp, Mus musculus
ggagatgttccaggattttgactac

SEQ ID NO: 596772 - DNA, 25 bp, Mus musculus
ggagatgtttccagttagtacacac

SEQ ID NO: 596773 - DNA, 25 bp, Mus musculus
ggagatgtttcctgttagtacacac

SEQ ID NO: 596774 - DNA, 25 bp, Mus musculus
ggagatgttttcatggtgcagctta

SEQ ID NO: 596775 - DNA, 25 bp, Mus musculus
ggagatgttttcttggtgcagctta

SEQ ID NO: 596776 - DNA, 25 bp, Mus musculus
ggagatgtttttcactcagtgtaat

SEQ ID NO: 596777 - DNA, 25 bp, Mus musculus
ggagatgtttttgactcagtgtaat

SEQ ID NO: 596778 - DNA, 25 bp, Mus musculus
ggagattaaccacactgctataaca

SEQ ID NO: 596779 - DNA, 25 bp, Mus musculus
ggagattaaccagactgctataaca

SEQ ID NO: 596780 - DNA, 25 bp, Mus musculus
ggagattaactaaagccggcatgcc

SEQ ID NO: 596781 - DNA, 25 bp, Mus musculus
ggagattaactatagccggcatgcc

SEQ ID NO: 596782 - DNA, 25 bp, Mus musculus
ggagattaatgcattaaaatgcact

SEQ ID NO: 596783 - DNA, 25 bp, Mus musculus
ggagattaatgctttaaaatgcact

SEQ ID NO: 596784 - DNA, 25 bp, Mus musculus
ggagattacagaactggtgccctgc

SEQ ID NO: 596785 - DNA, 25 bp, Mus musculus
ggagattacagatctggtgccctgc

SEQ ID NO: 596786 - DNA, 25 bp, Mus musculus
ggagattacttaaatgcattcggaa

SEQ ID NO: 596787 - DNA, 25 bp, Mus musculus
ggagattacttatatgcattcggaa

SEQ ID NO: 596788 - DNA, 25 bp, Mus musculus
ggagattattcacccggacgtggac

SEQ ID NO: 596789 - DNA, 25 bp, Mus musculus
ggagattattcagccggacgtggac

SEQ ID NO: 596790 - DNA, 25 bp, Mus musculus
ggagattattccacgacagctatgt

SEQ ID NO: 596791 - DNA, 25 bp, Mus musculus
ggagattattccctggcaaatgcaa

SEQ ID NO: 596792 - DNA, 25 bp, Mus musculus
ggagattattccgtggcaaatgcaa

SEQ ID NO: 596793 - DNA, 25 bp, Mus musculus
ggagattattcctcgacagctatgt

SEQ ID NO: 596794 - DNA, 25 bp, Mus musculus
ggagattcaacactttattctgacc

SEQ ID NO: 596795 - DNA, 25 bp, Mus musculus
ggagattcaacagtttattctgacc

SEQ ID NO: 596796 - DNA, 25 bp, Mus musculus
ggagattcactaacctcatctgtac

SEQ ID NO: 596797 - DNA, 25 bp, Mus musculus
ggagattcactatcctcatctgtac

SEQ ID NO: 596798 - DNA, 25 bp, Mus musculus
ggagattcagacacctgaggagttc

SEQ ID NO: 596799 - DNA, 25 bp, Mus musculus
ggagattcagactcctgaggagttc

SEQ ID NO: 596800 - DNA, 25 bp, Mus musculus
ggagattcagcaactgcagcacatg

SEQ ID NO: 596801 - DNA, 25 bp, Mus musculus
ggagattcagcatctgcagcacatg

SEQ ID NO: 596802 - DNA, 25 bp, Mus musculus
ggagattcattcagcccagtagtgg

SEQ ID NO: 596803 - DNA, 25 bp, Mus musculus
ggagattcattctgcccagtagtgg

SEQ ID NO: 596804 - DNA, 25 bp, Mus musculus
ggagattcccgaagagaccctgcga

SEQ ID NO: 596805 - DNA, 25 bp, Mus musculus
ggagattcccgatgagaccctgcga

SEQ ID NO: 596806 - DNA, 25 bp, Mus musculus
ggagattcctgaaggctatactccc

SEQ ID NO: 596807 - DNA, 25 bp, Mus musculus
ggagattcctgatggctatactccc

SEQ ID NO: 596808 - DNA, 25 bp, Mus musculus
ggagattcgggtaatgcttgtgtat

SEQ ID NO: 596809 - DNA, 25 bp, Mus musculus
ggagattcgggttatgcttgtgtat

SEQ ID NO: 596810 - DNA, 25 bp, Mus musculus
ggagattctataaccctgtgaggca

SEQ ID NO: 596811 - DNA, 25 bp, Mus musculus
ggagattctatatccctgtgaggca

SEQ ID NO: 596812 - DNA, 25 bp, Mus musculus
ggagattctcccattggattgagtt

SEQ ID NO: 596813 - DNA, 25 bp, Mus musculus
ggagattctccctttggattgagtt

SEQ ID NO: 596814 - DNA, 25 bp, Mus musculus
ggagattctcgacagctacgaccag

SEQ ID NO: 596815 - DNA, 25 bp, Mus musculus
ggagattctcgagagctacgaccag

SEQ ID NO: 596816 - DNA, 25 bp, Mus musculus
ggagattctctaaattaacatgcaa

SEQ ID NO: 596817 - DNA, 25 bp, Mus musculus
ggagattctctatattaacatgcaa

SEQ ID NO: 596818 - DNA, 25 bp, Mus musculus
ggagattctgaaacgtctcttgaat

SEQ ID NO: 596819 - DNA, 25 bp, Mus musculus
ggagattctgaatcgtctcttgaat

SEQ ID NO: 596820 - DNA, 25 bp, Mus musculus
ggagattctgtgaaggatccttgga

SEQ ID NO: 596821 - DNA, 25 bp, Mus musculus
ggagattctgtgtaggatccttgga

SEQ ID NO: 596822 - DNA, 25 bp, Mus musculus
ggagattcttaacttatagggatga

SEQ ID NO: 596823 - DNA, 25 bp, Mus musculus
ggagattcttaagttatagggatga

SEQ ID NO: 596824 - DNA, 25 bp, Mus musculus
ggagattgaagccttttccagccat

SEQ ID NO: 596825 - DNA, 25 bp, Mus musculus
ggagattgaagcgttttccagccat

SEQ ID NO: 596826 - DNA, 25 bp, Mus musculus
ggagattgaccactttacagcctgg

SEQ ID NO: 596827 - DNA, 25 bp, Mus musculus
ggagattgaccagtttacagcctgg

SEQ ID NO: 596828 - DNA, 25 bp, Mus musculus
ggagattgacgactcttcagacgat

SEQ ID NO: 596829 - DNA, 25 bp, Mus musculus
ggagattgacgagtcttcagacgat

SEQ ID NO: 596830 - DNA, 25 bp, Mus musculus
ggagattgagaaatcaagcccacca

SEQ ID NO: 596831 - DNA, 25 bp, Mus musculus
ggagattgagaattcaagcccacca

SEQ ID NO: 596832 - DNA, 25 bp, Mus musculus
ggagattgcccaagaacctgagcgt

SEQ ID NO: 596833 - DNA, 25 bp, Mus musculus
ggagattgcccatgaacctgagcgt

SEQ ID NO: 596834 - DNA, 25 bp, Mus musculus
ggagattgccctagagcacacagat

SEQ ID NO: 596835 - DNA, 25 bp, Mus musculus
ggagattgcccttgagcacacagat

SEQ ID NO: 596836 - DNA, 25 bp, Mus musculus
ggagattggctcactgtaaaggaat

SEQ ID NO: 596837 - DNA, 25 bp, Mus musculus
ggagattggctctctgtaaaggaat

SEQ ID NO: 596838 - DNA, 25 bp, Mus musculus
ggagattggtgccaccagacctgac

SEQ ID NO: 596839 - DNA, 25 bp, Mus musculus
ggagattggtgcgaccagacctgac

SEQ ID NO: 596840 - DNA, 25 bp, Mus musculus
ggagattgtgagagccatgacctat

SEQ ID NO: 596841 - DNA, 25 bp, Mus musculus
ggagattgtgagtgccatgacctat

SEQ ID NO: 596842 - DNA, 25 bp, Mus musculus
ggagattgttagagcccaagtttga

SEQ ID NO: 596843 - DNA, 25 bp, Mus musculus
ggagattgttagtgcccaagtttga

SEQ ID NO: 596844 - DNA, 25 bp, Mus musculus
ggagattgttgccatcaacgacccc

SEQ ID NO: 596845 - DNA, 25 bp, Mus musculus
ggagattgttgcgatcaacgacccc

SEQ ID NO: 596846 - DNA, 25 bp, Mus musculus
ggagattgttgtccccagtctgaac

SEQ ID NO: 596847 - DNA, 25 bp, Mus musculus
ggagattgttgtgcccagtctgaac

SEQ ID NO: 596848 - DNA, 25 bp, Mus musculus
ggagatttaaccaagtctcagtttc

SEQ ID NO: 596849 - DNA, 25 bp, Mus musculus
ggagatttaacctagtctcagtttc

SEQ ID NO: 596850 - DNA, 25 bp, Mus musculus
ggagatttacggaaagccatcacat

SEQ ID NO: 596851 - DNA, 25 bp, Mus musculus
ggagatttacggtaagccatcacat

SEQ ID NO: 596852 - DNA, 25 bp, Mus musculus
ggagatttactcaatccagacttaa

SEQ ID NO: 596853 - DNA, 25 bp, Mus musculus
ggagatttactctatccagacttaa

SEQ ID NO: 596854 - DNA, 25 bp, Mus musculus
ggagatttatcaaaagtgccaacca

SEQ ID NO: 596855 - DNA, 25 bp, Mus musculus
ggagatttatcataagtgccaacca

SEQ ID NO: 596856 - DNA, 25 bp, Mus musculus
ggagatttccctacagacacttaaa

SEQ ID NO: 596857 - DNA, 25 bp, Mus musculus
ggagatttcccttcagacacttaaa

SEQ ID NO: 596858 - DNA, 25 bp, Mus musculus
ggagatttccggaacttcctgtggc

SEQ ID NO: 596859 - DNA, 25 bp, Mus musculus
ggagatttccggtacttcctgtggc

SEQ ID NO: 596860 - DNA, 25 bp, Mus musculus
ggagatttcctaaaccacgctatgc

SEQ ID NO: 596861 - DNA, 25 bp, Mus musculus
ggagatttcctacaatggctgcacc

SEQ ID NO: 596862 - DNA, 25 bp, Mus musculus
ggagatttcctagaatggctgcacc

SEQ ID NO: 596863 - DNA, 25 bp, Mus musculus
ggagatttcctataccacgctatgc

SEQ ID NO: 596864 - DNA, 25 bp, Mus musculus
ggagatttcgatatccaaatgcaga

SEQ ID NO: 596865 - DNA, 25 bp, Mus musculus
ggagatttcgatttccaaatgcaga

SEQ ID NO: 596866 - DNA, 25 bp, Mus musculus
ggagatttctaacctttacatctat

SEQ ID NO: 596867 - DNA, 25 bp, Mus musculus
ggagatttctaagctttacatctat

SEQ ID NO: 596868 - DNA, 25 bp, Mus musculus
ggagatttctataaccacagggcca

SEQ ID NO: 596869 - DNA, 25 bp, Mus musculus
ggagatttctattaccacagggcca

SEQ ID NO: 596870 - DNA, 25 bp, Mus musculus
ggagatttctcaagtcatttctggt

SEQ ID NO: 596871 - DNA, 25 bp, Mus musculus
ggagatttctcatgtcatttctggt

SEQ ID NO: 596872 - DNA, 25 bp, Mus musculus
ggagatttcttgactcgaaagccaa

SEQ ID NO: 596873 - DNA, 25 bp, Mus musculus
ggagatttcttgtctcgaaagccaa

SEQ ID NO: 596874 - DNA, 25 bp, Mus musculus
ggagatttgaatccataccagtgtt

SEQ ID NO: 596875 - DNA, 25 bp, Mus musculus
ggagatttgaatgcataccagtgtt

SEQ ID NO: 596876 - DNA, 25 bp, Mus musculus
ggagatttggaaacactatttcgta

SEQ ID NO: 596877 - DNA, 25 bp, Mus musculus
ggagatttggaatcactatttcgta

SEQ ID NO: 596878 - DNA, 25 bp, Mus musculus
ggagatttgttcaagtcctccctcc

SEQ ID NO: 596879 - DNA, 25 bp, Mus musculus
ggagatttgttctagtcctccctcc

SEQ ID NO: 596880 - DNA, 25 bp, Mus musculus
ggagattttccgattgcccagctcg

SEQ ID NO: 596881 - DNA, 25 bp, Mus musculus
ggagattttccgtttgcccagctcg

SEQ ID NO: 596882 - DNA, 25 bp, Mus musculus
ggagattttcgtagtatacacacac

SEQ ID NO: 596883 - DNA, 25 bp, Mus musculus
ggagattttcgttgtatacacacac

SEQ ID NO: 596884 - DNA, 25 bp, Mus musculus
ggagattttctacacacacaccaga

SEQ ID NO: 596885 - DNA, 25 bp, Mus musculus
ggagattttctagacacacaccaga

SEQ ID NO: 596886 - DNA, 25 bp, Mus musculus
ggagattttgcccaccatggcgatc

SEQ ID NO: 596887 - DNA, 25 bp, Mus musculus
ggagattttgccgaccatggcgatc

SEQ ID NO: 596888 - DNA, 25 bp, Mus musculus
ggagcaaaacagaaagccttggtgt

SEQ ID NO: 596889 - DNA, 25 bp, Mus musculus
ggagcaaaacagtaagccttggtgt

SEQ ID NO: 596890 - DNA, 25 bp, Mus musculus
ggagcaaaactcacaaccacggacc

SEQ ID NO: 596891 - DNA, 25 bp, Mus musculus
ggagcaaaactctcaaccacggacc

SEQ ID NO: 596892 - DNA, 25 bp, Mus musculus
ggagcaaacaacatcaagaactggc

SEQ ID NO: 596893 - DNA, 25 bp, Mus musculus
ggagcaaacaacttcaagaactggc

SEQ ID NO: 596894 - DNA, 25 bp, Mus musculus
ggagcaaacaatcaggctgccgaat

SEQ ID NO: 596895 - DNA, 25 bp, Mus musculus
ggagcaaacaatgaggctgccgaat

SEQ ID NO: 596896 - DNA, 25 bp, Mus musculus
ggagcaaacagccatcgtcagcaca

SEQ ID NO: 596897 - DNA, 25 bp, Mus musculus
ggagcaaacagcgatcgtcagcaca

SEQ ID NO: 596898 - DNA, 25 bp, Mus musculus
ggagcaaacattcctggatgcatct

SEQ ID NO: 596899 - DNA, 25 bp, Mus musculus
ggagcaaacattgctggatgcatct

SEQ ID NO: 596900 - DNA, 25 bp, Mus musculus
ggagcaaaccaaatagacacttaag

SEQ ID NO: 596901 - DNA, 25 bp, Mus musculus
ggagcaaaccaattagacacttaag

SEQ ID NO: 596902 - DNA, 25 bp, Mus musculus
ggagcaaaccctatgccatgcgttg

SEQ ID NO: 596903 - DNA, 25 bp, Mus musculus
ggagcaaaccctttgccatgcgttg

SEQ ID NO: 596904 - DNA, 25 bp, Mus musculus
ggagcaaacctaaagctggcagtca

SEQ ID NO: 596905 - DNA, 25 bp, Mus musculus
ggagcaaacctatagctggcagtca

SEQ ID NO: 596906 - DNA, 25 bp, Mus musculus
ggagcaaacgtgaatgtcgcctcgc

SEQ ID NO: 596907 - DNA, 25 bp, Mus musculus
ggagcaaacgtgtatgtcgcctcgc

SEQ ID NO: 596908 - DNA, 25 bp, Mus musculus
ggagcaaactgcaaactcgacgaat

SEQ ID NO: 596909 - DNA, 25 bp, Mus musculus
ggagcaaactgctaactcgacgaat

SEQ ID NO: 596910 - DNA, 25 bp, Mus musculus
ggagcaaagagcctacttcagctta

SEQ ID NO: 596911 - DNA, 25 bp, Mus musculus
ggagcaaagagcgtacttcagctta

SEQ ID NO: 596912 - DNA, 25 bp, Mus musculus
ggagcaaagctaaatgttgccattg

SEQ ID NO: 596913 - DNA, 25 bp, Mus musculus
ggagcaaagctatatgttgccattg

SEQ ID NO: 596914 - DNA, 25 bp, Mus musculus
ggagcaaaggccatgtcgctctcca

SEQ ID NO: 596915 - DNA, 25 bp, Mus musculus
ggagcaaaggccttgtcgctctcca

SEQ ID NO: 596916 - DNA, 25 bp, Mus musculus
ggagcaaatcaaatggtatcgttca

SEQ ID NO: 596917 - DNA, 25 bp, Mus musculus
ggagcaaatcaattggtatcgttca

SEQ ID NO: 596918 - DNA, 25 bp, Mus musculus
ggagcaaatcgtaatctcaccagag

SEQ ID NO: 596919 - DNA, 25 bp, Mus musculus
ggagcaaatcgttatctcaccagag

SEQ ID NO: 596920 - DNA, 25 bp, Mus musculus
ggagcaaatgcaccatgttcgtagt

SEQ ID NO: 596921 - DNA, 25 bp, Mus musculus
ggagcaaatgcagcatgttcgtagt

SEQ ID NO: 596922 - DNA, 25 bp, Mus musculus
ggagcaaatgctcttgctttttcca

SEQ ID NO: 596923 - DNA, 25 bp, Mus musculus
ggagcaaatgctctttccctctgag

SEQ ID NO: 596924 - DNA, 25 bp, Mus musculus
ggagcaaatgctgttgctttttcca

SEQ ID NO: 596925 - DNA, 25 bp, Mus musculus
ggagcaaatgctgtttccctctgag

SEQ ID NO: 596926 - DNA, 25 bp, Mus musculus
ggagcaaatgtcatctgtcacttca

SEQ ID NO: 596927 - DNA, 25 bp, Mus musculus
ggagcaaatgtcttctgtcacttca

SEQ ID NO: 596928 - DNA, 25 bp, Mus musculus
ggagcaaattcccatgtgtcgtctt

SEQ ID NO: 596929 - DNA, 25 bp, Mus musculus
ggagcaaattccgatgtgtcgtctt

SEQ ID NO: 596930 - DNA, 25 bp, Mus musculus
ggagcaacacgactcttaaccgctg

SEQ ID NO: 596931 - DNA, 25 bp, Mus musculus
ggagcaacacgagtcttaaccgctg

SEQ ID NO: 596932 - DNA, 25 bp, Mus musculus
ggagcaacactgactacccatgcag

SEQ ID NO: 596933 - DNA, 25 bp, Mus musculus
ggagcaacactgtctacccatgcag

SEQ ID NO: 596934 - DNA, 25 bp, Mus musculus
ggagcaacagccaaatacctacctt

SEQ ID NO: 596935 - DNA, 25 bp, Mus musculus
ggagcaacagcctaatacctacctt

SEQ ID NO: 596936 - DNA, 25 bp, Mus musculus
ggagcaacagtgctaatttctgcta

SEQ ID NO: 596937 - DNA, 25 bp, Mus musculus
ggagcaacagtggtaatttctgcta

SEQ ID NO: 596938 - DNA, 25 bp, Mus musculus
ggagcaacatgccagcagaagtctc

SEQ ID NO: 596939 - DNA, 25 bp, Mus musculus
ggagcaacatgcgagcagaagtctc

SEQ ID NO: 596940 - DNA, 25 bp, Mus musculus
ggagcaacatggagtccttaggctt

SEQ ID NO: 596941 - DNA, 25 bp, Mus musculus
ggagcaacatggtgtccttaggctt

SEQ ID NO: 596942 - DNA, 25 bp, Mus musculus
ggagcaaccaggcagaaccaccgtc

SEQ ID NO: 596943 - DNA, 25 bp, Mus musculus
ggagcaaccagggagaaccaccgtc

SEQ ID NO: 596944 - DNA, 25 bp, Mus musculus
ggagcaaccctccagatatgggcgt

SEQ ID NO: 596945 - DNA, 25 bp, Mus musculus
ggagcaaccctcgagatatgggcgt

SEQ ID NO: 596946 - DNA, 25 bp, Mus musculus
ggagcaactaagaatcactcacaat

SEQ ID NO: 596947 - DNA, 25 bp, Mus musculus
ggagcaactaagtatcactcacaat

SEQ ID NO: 596948 - DNA, 25 bp, Mus musculus
ggagcaactcagaagtgcatttgaa

SEQ ID NO: 596949 - DNA, 25 bp, Mus musculus
ggagcaactcagtagtgcatttgaa

SEQ ID NO: 596950 - DNA, 25 bp, Mus musculus
ggagcaactccaattgatgctcaat

SEQ ID NO: 596951 - DNA, 25 bp, Mus musculus
ggagcaactccacgctgaccacgtt

SEQ ID NO: 596952 - DNA, 25 bp, Mus musculus
ggagcaactccaggctgaccacgtt

SEQ ID NO: 596953 - DNA, 25 bp, Mus musculus
ggagcaactccatttgatgctcaat

SEQ ID NO: 596954 - DNA, 25 bp, Mus musculus
ggagcaactgatacccaggtggcag

SEQ ID NO: 596955 - DNA, 25 bp, Mus musculus
ggagcaactgattcccaggtggcag

SEQ ID NO: 596956 - DNA, 25 bp, Mus musculus
ggagcaactgcacccagctcatgaa

SEQ ID NO: 596957 - DNA, 25 bp, Mus musculus
ggagcaactgcagccagctcatgaa

SEQ ID NO: 596958 - DNA, 25 bp, Mus musculus
ggagcaactgctcgatggtcccgaa

SEQ ID NO: 596959 - DNA, 25 bp, Mus musculus
ggagcaactgctggatggtcccgaa

SEQ ID NO: 596960 - DNA, 25 bp, Mus musculus
ggagcaagaatgctacccgagctta

SEQ ID NO: 596961 - DNA, 25 bp, Mus musculus
ggagcaagaatggtacccgagctta

SEQ ID NO: 596962 - DNA, 25 bp, Mus musculus
ggagcaagaattctcttcctgactt

SEQ ID NO: 596963 - DNA, 25 bp, Mus musculus
ggagcaagaattgtcttcctgactt

SEQ ID NO: 596964 - DNA, 25 bp, Mus musculus
ggagcaagactaacaacacgggtgt

SEQ ID NO: 596965 - DNA, 25 bp, Mus musculus
ggagcaagactatcaacacgggtgt

SEQ ID NO: 596966 - DNA, 25 bp, Mus musculus
ggagcaagagtccacctttagctgt

SEQ ID NO: 596967 - DNA, 25 bp, Mus musculus
ggagcaagagtcgacctttagctgt

SEQ ID NO: 596968 - DNA, 25 bp, Mus musculus
ggagcaagcacacgcctagggctca

SEQ ID NO: 596969 - DNA, 25 bp, Mus musculus
ggagcaagcacaggcctagggctca

SEQ ID NO: 596970 - DNA, 25 bp, Mus musculus
ggagcaagcactatgtgaggtcccc

SEQ ID NO: 596971 - DNA, 25 bp, Mus musculus
ggagcaagcactttgtgaggtcccc

SEQ ID NO: 596972 - DNA, 25 bp, Mus musculus
ggagcaagcagcctacaccaaacgt

SEQ ID NO: 596973 - DNA, 25 bp, Mus musculus
ggagcaagcagcgtacaccaaacgt

SEQ ID NO: 596974 - DNA, 25 bp, Mus musculus
ggagcaagcccacaacggaccggac

SEQ ID NO: 596975 - DNA, 25 bp, Mus musculus
ggagcaagcccagaacggaccggac

SEQ ID NO: 596976 - DNA, 25 bp, Mus musculus
ggagcaagcctcagactattgattc

SEQ ID NO: 596977 - DNA, 25 bp, Mus musculus
ggagcaagcctctgactattgattc

SEQ ID NO: 596978 - DNA, 25 bp, Mus musculus
ggagcaagctttaacgtacctaggt

SEQ ID NO: 596979 - DNA, 25 bp, Mus musculus
ggagcaagcttttacgtacctaggt

SEQ ID NO: 596980 - DNA, 25 bp, Mus musculus
ggagcaagggccaccacgggtacca

SEQ ID NO: 596981 - DNA, 25 bp, Mus musculus
ggagcaagggcctccacgggtacca

SEQ ID NO: 596982 - DNA, 25 bp, Mus musculus
ggagcaagtccaagactccacatga

SEQ ID NO: 596983 - DNA, 25 bp, Mus musculus
ggagcaagtccatgactccacatga

SEQ ID NO: 596984 - DNA, 25 bp, Mus musculus
ggagcaagtcttacagccgatcaag

SEQ ID NO: 596985 - DNA, 25 bp, Mus musculus
ggagcaagtctttcagccgatcaag

SEQ ID NO: 596986 - DNA, 25 bp, Mus musculus
ggagcaagtgaacaactcgcccacc

SEQ ID NO: 596987 - DNA, 25 bp, Mus musculus
ggagcaagtgaagaactcgcccacc

SEQ ID NO: 596988 - DNA, 25 bp, Mus musculus
ggagcaagtgatacactgtcagtta

SEQ ID NO: 596989 - DNA, 25 bp, Mus musculus
ggagcaagtgattcactgtcagtta

SEQ ID NO: 596990 - DNA, 25 bp, Mus musculus
ggagcaagttcccttcattatcatt

SEQ ID NO: 596991 - DNA, 25 bp, Mus musculus
ggagcaagttccgttcattatcatt

SEQ ID NO: 596992 - DNA, 25 bp, Mus musculus
ggagcaagttgtccctgagttcccc

SEQ ID NO: 596993 - DNA, 25 bp, Mus musculus
ggagcaagttgtgcctgagttcccc

SEQ ID NO: 596994 - DNA, 25 bp, Mus musculus
ggagcaatacagctccttccaaaat

SEQ ID NO: 596995 - DNA, 25 bp, Mus musculus
ggagcaatacaggtccttccaaaat

SEQ ID NO: 596996 - DNA, 25 bp, Mus musculus
ggagcaataccacagtctcacctct

SEQ ID NO: 596997 - DNA, 25 bp, Mus musculus
ggagcaataccagagtctcacctct

SEQ ID NO: 596998 - DNA, 25 bp, Mus musculus
ggagcaatcaccaacggccacaaag

SEQ ID NO: 596999 - DNA, 25 bp, Mus musculus
ggagcaatcacctacggccacaaag

SEQ ID NO: 597000 - DNA, 25 bp, Mus musculus
ggagcaatcactaacagaattccgt

SEQ ID NO: 597001 - DNA, 25 bp, Mus musculus
ggagcaatcacttacagaattccgt

SEQ ID NO: 597002 - DNA, 25 bp, Mus musculus
ggagcaatcccaccagtgaaccaag

SEQ ID NO: 597003 - DNA, 25 bp, Mus musculus
ggagcaatcccagcagtgaaccaag

SEQ ID NO: 597004 - DNA, 25 bp, Mus musculus
ggagcaatctacaatcaggctttag

SEQ ID NO: 597005 - DNA, 25 bp, Mus musculus
ggagcaatctactatcaggctttag

SEQ ID NO: 597006 - DNA, 25 bp, Mus musculus
ggagcaatgcaaaagatgccctact

SEQ ID NO: 597007 - DNA, 25 bp, Mus musculus
ggagcaatgcaatagatgccctact

SEQ ID NO: 597008 - DNA, 25 bp, Mus musculus
ggagcaatgccaagcttcagtgcct

SEQ ID NO: 597009 - DNA, 25 bp, Mus musculus
ggagcaatgccatgcttcagtgcct

SEQ ID NO: 597010 - DNA, 25 bp, Mus musculus
ggagcaatggtcagcacatctgtga

SEQ ID NO: 597011 - DNA, 25 bp, Mus musculus
ggagcaatggtctgcacatctgtga

SEQ ID NO: 597012 - DNA, 25 bp, Mus musculus
ggagcaatgtccatatagggtttaa

SEQ ID NO: 597013 - DNA, 25 bp, Mus musculus
ggagcaatgtccttatagggtttaa

SEQ ID NO: 597014 - DNA, 25 bp, Mus musculus
ggagcacaacccattatatgccaac

SEQ ID NO: 597015 - DNA, 25 bp, Mus musculus
ggagcacaaccctttatatgccaac

SEQ ID NO: 597016 - DNA, 25 bp, Mus musculus
ggagcacaagaacccaggcacccta

SEQ ID NO: 597017 - DNA, 25 bp, Mus musculus
ggagcacaagaagccaggcacccta

SEQ ID NO: 597018 - DNA, 25 bp, Mus musculus
ggagcacaagaccatgggagtccca

SEQ ID NO: 597019 - DNA, 25 bp, Mus musculus
ggagcacaagacgatgggagtccca

SEQ ID NO: 597020 - DNA, 25 bp, Mus musculus
ggagcacaagctatctttctataca

SEQ ID NO: 597021 - DNA, 25 bp, Mus musculus
ggagcacaagctttctttctataca

SEQ ID NO: 597022 - DNA, 25 bp, Mus musculus
ggagcacacaacactaacctgtttt

SEQ ID NO: 597023 - DNA, 25 bp, Mus musculus
ggagcacacaacagaatgggaattt

SEQ ID NO: 597024 - DNA, 25 bp, Mus musculus
ggagcacacaactctaacctgtttt

SEQ ID NO: 597025 - DNA, 25 bp, Mus musculus
ggagcacacaactgaatgggaattt

SEQ ID NO: 597026 - DNA, 25 bp, Mus musculus
ggagcacacagaaccgatgtttact

SEQ ID NO: 597027 - DNA, 25 bp, Mus musculus
ggagcacacagatccgatgtttact

SEQ ID NO: 597028 - DNA, 25 bp, Mus musculus
ggagcacacatgatctcatttgttt

SEQ ID NO: 597029 - DNA, 25 bp, Mus musculus
ggagcacacatgttctcatttgttt

SEQ ID NO: 597030 - DNA, 25 bp, Mus musculus
ggagcacacgttcaaaattgtgtat

SEQ ID NO: 597031 - DNA, 25 bp, Mus musculus
ggagcacacgttgaaaattgtgtat

SEQ ID NO: 597032 - DNA, 25 bp, Mus musculus
ggagcacagaacagccttgacagtc

SEQ ID NO: 597033 - DNA, 25 bp, Mus musculus
ggagcacagaacatgtcggcagcta

SEQ ID NO: 597034 - DNA, 25 bp, Mus musculus
ggagcacagaactgccttgacagtc

SEQ ID NO: 597035 - DNA, 25 bp, Mus musculus
ggagcacagaacttgtcggcagcta

SEQ ID NO: 597036 - DNA, 25 bp, Mus musculus
ggagcacagacccagtttgatgtta

SEQ ID NO: 597037 - DNA, 25 bp, Mus musculus
ggagcacagaccgagtttgatgtta

SEQ ID NO: 597038 - DNA, 25 bp, Mus musculus
ggagcacagacgataatgccgactt

SEQ ID NO: 597039 - DNA, 25 bp, Mus musculus
ggagcacagacgttaatgccgactt

SEQ ID NO: 597040 - DNA, 25 bp, Mus musculus
ggagcacagagacctttgtcactat

SEQ ID NO: 597041 - DNA, 25 bp, Mus musculus
ggagcacagagagctttgtcactat

SEQ ID NO: 597042 - DNA, 25 bp, Mus musculus
ggagcacagagcattattctgcccc

SEQ ID NO: 597043 - DNA, 25 bp, Mus musculus
ggagcacagagctttattctgcccc

SEQ ID NO: 597044 - DNA, 25 bp, Mus musculus
ggagcacagccaagcacagcagtac

SEQ ID NO: 597045 - DNA, 25 bp, Mus musculus
ggagcacagccatgcacagcagtac

SEQ ID NO: 597046 - DNA, 25 bp, Mus musculus
ggagcacaggacattggcgacaact

SEQ ID NO: 597047 - DNA, 25 bp, Mus musculus
ggagcacaggactttggcgacaact

SEQ ID NO: 597048 - DNA, 25 bp, Mus musculus
ggagcacagggaagttagcccatct

SEQ ID NO: 597049 - DNA, 25 bp, Mus musculus
ggagcacagggatgttagcccatct

SEQ ID NO: 597050 - DNA, 25 bp, Mus musculus
ggagcacagtagcttccctttcaaa

SEQ ID NO: 597051 - DNA, 25 bp, Mus musculus
ggagcacagtaggttccctttcaaa

SEQ ID NO: 597052 - DNA, 25 bp, Mus musculus
ggagcacagttcagtcagggacatt

SEQ ID NO: 597053 - DNA, 25 bp, Mus musculus
ggagcacagttctgtcagggacatt

SEQ ID NO: 597054 - DNA, 25 bp, Mus musculus
ggagcacagttgagctctgctttca

SEQ ID NO: 597055 - DNA, 25 bp, Mus musculus
ggagcacagttgtgctctgctttca

SEQ ID NO: 597056 - DNA, 25 bp, Mus musculus
ggagcacatctacttaaatcatatt

SEQ ID NO: 597057 - DNA, 25 bp, Mus musculus
ggagcacatctagttaaatcatatt

SEQ ID NO: 597058 - DNA, 25 bp, Mus musculus
ggagcacatgccactgggagcagaa

SEQ ID NO: 597059 - DNA, 25 bp, Mus musculus
ggagcacatgcctctgggagcagaa

SEQ ID NO: 597060 - DNA, 25 bp, Mus musculus
ggagcacatgggacctggtggttct

SEQ ID NO: 597061 - DNA, 25 bp, Mus musculus
ggagcacatgggtcctggtggttct

SEQ ID NO: 597062 - DNA, 25 bp, Mus musculus
ggagcacatggtaggctcggcattc

SEQ ID NO: 597063 - DNA, 25 bp, Mus musculus
ggagcacatggttggctcggcattc

SEQ ID NO: 597064 - DNA, 25 bp, Mus musculus
ggagcacattcccttacttggtaaa

SEQ ID NO: 597065 - DNA, 25 bp, Mus musculus
ggagcacattccgttacttggtaaa

SEQ ID NO: 597066 - DNA, 25 bp, Mus musculus
ggagcacatttgacattctgcttta

SEQ ID NO: 597067 - DNA, 25 bp, Mus musculus
ggagcacatttgtcattctgcttta

SEQ ID NO: 597068 - DNA, 25 bp, Mus musculus
ggagcaccaaccaagaaaaacaact

SEQ ID NO: 597069 - DNA, 25 bp, Mus musculus
ggagcaccaacctagaaaaacaact

SEQ ID NO: 597070 - DNA, 25 bp, Mus musculus
ggagcaccaagaagggccctgagaa

SEQ ID NO: 597071 - DNA, 25 bp, Mus musculus
ggagcaccaagatgggccctgagaa

SEQ ID NO: 597072 - DNA, 25 bp, Mus musculus
ggagcaccaagtccttggaacgttt

SEQ ID NO: 597073 - DNA, 25 bp, Mus musculus
ggagcaccaagtgcttggaacgttt

SEQ ID NO: 597074 - DNA, 25 bp, Mus musculus
ggagcaccacctcttgcatgggtca

SEQ ID NO: 597075 - DNA, 25 bp, Mus musculus
ggagcaccacctgttgcatgggtca

SEQ ID NO: 597076 - DNA, 25 bp, Mus musculus
ggagcaccactcagagcacgggctg

SEQ ID NO: 597077 - DNA, 25 bp, Mus musculus
ggagcaccactctgagcacgggctg

SEQ ID NO: 597078 - DNA, 25 bp, Mus musculus
ggagcaccagggagatccagtacta

SEQ ID NO: 597079 - DNA, 25 bp, Mus musculus
ggagcaccagggtgatccagtacta

SEQ ID NO: 597080 - DNA, 25 bp, Mus musculus
ggagcaccagttactagtccagaat

SEQ ID NO: 597081 - DNA, 25 bp, Mus musculus
ggagcaccagtttctagtccagaat

SEQ ID NO: 597082 - DNA, 25 bp, Mus musculus
ggagcaccatcaccagatgtccatc

SEQ ID NO: 597083 - DNA, 25 bp, Mus musculus
ggagcaccatcagcagatgtccatc

SEQ ID NO: 597084 - DNA, 25 bp, Mus musculus
ggagcaccatgtaacatgcctgcta

SEQ ID NO: 597085 - DNA, 25 bp, Mus musculus
ggagcaccatgttacatgcctgcta

SEQ ID NO: 597086 - DNA, 25 bp, Mus musculus
ggagcacccagtctgcccagaggaa

SEQ ID NO: 597087 - DNA, 25 bp, Mus musculus
ggagcacccagtgtgcccagaggaa

SEQ ID NO: 597088 - DNA, 25 bp, Mus musculus
ggagcacccctgagggtacgcgctt

SEQ ID NO: 597089 - DNA, 25 bp, Mus musculus
ggagcacccctgtgggtacgcgctt

SEQ ID NO: 597090 - DNA, 25 bp, Mus musculus
ggagcaccgagtcgctacatccaca

SEQ ID NO: 597091 - DNA, 25 bp, Mus musculus
ggagcaccgagtggctacatccaca

SEQ ID NO: 597092 - DNA, 25 bp, Mus musculus
ggagcaccgcatcatagcctgcgat

SEQ ID NO: 597093 - DNA, 25 bp, Mus musculus
ggagcaccgcatgatagcctgcgat

SEQ ID NO: 597094 - DNA, 25 bp, Mus musculus
ggagcaccggacacttcagtgtctg

SEQ ID NO: 597095 - DNA, 25 bp, Mus musculus
ggagcaccggactcttcagtgtctg

SEQ ID NO: 597096 - DNA, 25 bp, Mus musculus
ggagcacctatcagatactcagtga

SEQ ID NO: 597097 - DNA, 25 bp, Mus musculus
ggagcacctatctgatactcagtga

SEQ ID NO: 597098 - DNA, 25 bp, Mus musculus
ggagcacctatgctcgtaactgtaa

SEQ ID NO: 597099 - DNA, 25 bp, Mus musculus
ggagcacctatggtcgtaactgtaa

SEQ ID NO: 597100 - DNA, 25 bp, Mus musculus
ggagcacctccaaagacgtgtaaat

SEQ ID NO: 597101 - DNA, 25 bp, Mus musculus
ggagcacctccatagacgtgtaaat

SEQ ID NO: 597102 - DNA, 25 bp, Mus musculus
ggagcacctgaaacggagcctggcc

SEQ ID NO: 597103 - DNA, 25 bp, Mus musculus
ggagcacctgaatcggagcctggcc

SEQ ID NO: 597104 - DNA, 25 bp, Mus musculus
ggagcacctgcacacagctgaagcc

SEQ ID NO: 597105 - DNA, 25 bp, Mus musculus
ggagcacctgcagacagctgaagcc

SEQ ID NO: 597106 - DNA, 25 bp, Mus musculus
ggagcacggagaacttctgagccca

SEQ ID NO: 597107 - DNA, 25 bp, Mus musculus
ggagcacggagatcttctgagccca

SEQ ID NO: 597108 - DNA, 25 bp, Mus musculus
ggagcacggcacacagaccagtctt

SEQ ID NO: 597109 - DNA, 25 bp, Mus musculus
ggagcacggcactcagaccagtctt

SEQ ID NO: 597110 - DNA, 25 bp, Mus musculus
ggagcacggccaagtttttgtacac

SEQ ID NO: 597111 - DNA, 25 bp, Mus musculus
ggagcacggccatgtttttgtacac

SEQ ID NO: 597112 - DNA, 25 bp, Mus musculus
ggagcacgttgcagcaaagctcaat

SEQ ID NO: 597113 - DNA, 25 bp, Mus musculus
ggagcacgttgctgcaaagctcaat

SEQ ID NO: 597114 - DNA, 25 bp, Mus musculus
ggagcacgttggagcttctctgcaa

SEQ ID NO: 597115 - DNA, 25 bp, Mus musculus
ggagcacgttggtgcttctctgcaa

SEQ ID NO: 597116 - DNA, 25 bp, Mus musculus
ggagcactaaaacccttctgtccat

SEQ ID NO: 597117 - DNA, 25 bp, Mus musculus
ggagcactaaaagccttctgtccat

SEQ ID NO: 597118 - DNA, 25 bp, Mus musculus
ggagcactaaccatgtaccaaactt

SEQ ID NO: 597119 - DNA, 25 bp, Mus musculus
ggagcactaaccttgtaccaaactt

SEQ ID NO: 597120 - DNA, 25 bp, Mus musculus
ggagcactacttaattcctttgtat

SEQ ID NO: 597121 - DNA, 25 bp, Mus musculus
ggagcactactttattcctttgtat

SEQ ID NO: 597122 - DNA, 25 bp, Mus musculus
ggagcactagcaacagatttacttt

SEQ ID NO: 597123 - DNA, 25 bp, Mus musculus
ggagcactagcatcagatttacttt

SEQ ID NO: 597124 - DNA, 25 bp, Mus musculus
ggagcactatccctaaatatcatga

SEQ ID NO: 597125 - DNA, 25 bp, Mus musculus
ggagcactatccgtaaatatcatga

SEQ ID NO: 597126 - DNA, 25 bp, Mus musculus
ggagcactattgatagctggcacat

SEQ ID NO: 597127 - DNA, 25 bp, Mus musculus
ggagcactattgttagctggcacat

SEQ ID NO: 597128 - DNA, 25 bp, Mus musculus
ggagcactcaaacttgaccaaggaa

SEQ ID NO: 597129 - DNA, 25 bp, Mus musculus
ggagcactcaaagttgaccaaggaa

SEQ ID NO: 597130 - DNA, 25 bp, Mus musculus
ggagcactcacgctccactgaagct

SEQ ID NO: 597131 - DNA, 25 bp, Mus musculus
ggagcactcacggtccactgaagct

SEQ ID NO: 597132 - DNA, 25 bp, Mus musculus
ggagcactcactacatctgagctaa

SEQ ID NO: 597133 - DNA, 25 bp, Mus musculus
ggagcactcactagagagagagcaa

SEQ ID NO: 597134 - DNA, 25 bp, Mus musculus
ggagcactcacttcatctgagctaa

SEQ ID NO: 597135 - DNA, 25 bp, Mus musculus
ggagcactcacttgagagagagcaa

SEQ ID NO: 597136 - DNA, 25 bp, Mus musculus
ggagcactctgcagactgcgcctca

SEQ ID NO: 597137 - DNA, 25 bp, Mus musculus
ggagcactctgctgactgcgcctca

SEQ ID NO: 597138 - DNA, 25 bp, Mus musculus
ggagcactgaacaaagctctcaccc

SEQ ID NO: 597139 - DNA, 25 bp, Mus musculus
ggagcactgaactaagctctcaccc

SEQ ID NO: 597140 - DNA, 25 bp, Mus musculus
ggagcactgaagcttggcaccattt

SEQ ID NO: 597141 - DNA, 25 bp, Mus musculus
ggagcactgaaggttggcaccattt

SEQ ID NO: 597142 - DNA, 25 bp, Mus musculus
ggagcactgacaaacaatattggtt

SEQ ID NO: 597143 - DNA, 25 bp, Mus musculus
ggagcactgacatacaatattggtt

SEQ ID NO: 597144 - DNA, 25 bp, Mus musculus
ggagcactgagacctcagaggttct

SEQ ID NO: 597145 - DNA, 25 bp, Mus musculus
ggagcactgagagctcagaggttct

SEQ ID NO: 597146 - DNA, 25 bp, Mus musculus
ggagcactgcccaggacactgtgga

SEQ ID NO: 597147 - DNA, 25 bp, Mus musculus
ggagcactgccctggacactgtgga

SEQ ID NO: 597148 - DNA, 25 bp, Mus musculus
ggagcactgcttcgagctatctcta

SEQ ID NO: 597149 - DNA, 25 bp, Mus musculus
ggagcactgcttggagctatctcta

SEQ ID NO: 597150 - DNA, 25 bp, Mus musculus
ggagcactggaaactgttgcaaaca

SEQ ID NO: 597151 - DNA, 25 bp, Mus musculus
ggagcactggaatctgttgcaaaca

SEQ ID NO: 597152 - DNA, 25 bp, Mus musculus
ggagcactggacacactgtcaatga

SEQ ID NO: 597153 - DNA, 25 bp, Mus musculus
ggagcactggacagaactcttcctc

SEQ ID NO: 597154 - DNA, 25 bp, Mus musculus
ggagcactggactcactgtcaatga

SEQ ID NO: 597155 - DNA, 25 bp, Mus musculus
ggagcactggactgaactcttcctc

SEQ ID NO: 597156 - DNA, 25 bp, Mus musculus
ggagcactgggtagccatctgttgc

SEQ ID NO: 597157 - DNA, 25 bp, Mus musculus
ggagcactgggttgccatctgttgc

SEQ ID NO: 597158 - DNA, 25 bp, Mus musculus
ggagcactggtacacatcctacata

SEQ ID NO: 597159 - DNA, 25 bp, Mus musculus
ggagcactggtagacatcctacata

SEQ ID NO: 597160 - DNA, 25 bp, Mus musculus
ggagcactgtaaaagctcttgctga

SEQ ID NO: 597161 - DNA, 25 bp, Mus musculus
ggagcactgtaatagctcttgctga

SEQ ID NO: 597162 - DNA, 25 bp, Mus musculus
ggagcactgtccagtaatgctattc

SEQ ID NO: 597163 - DNA, 25 bp, Mus musculus
ggagcactgtcctgtaatgctattc

SEQ ID NO: 597164 - DNA, 25 bp, Mus musculus
ggagcactgtcgaaggagcccacca

SEQ ID NO: 597165 - DNA, 25 bp, Mus musculus
ggagcactgtcgtaggagcccacca

SEQ ID NO: 597166 - DNA, 25 bp, Mus musculus
ggagcactgtggacgccaaatggtt

SEQ ID NO: 597167 - DNA, 25 bp, Mus musculus
ggagcactgtggtcgccaaatggtt

SEQ ID NO: 597168 - DNA, 25 bp, Mus musculus
ggagcacttcttcgccagagacatg

SEQ ID NO: 597169 - DNA, 25 bp, Mus musculus
ggagcacttcttggccagagacatg

SEQ ID NO: 597170 - DNA, 25 bp, Mus musculus
ggagcacttgaaagcgtctgacctc

SEQ ID NO: 597171 - DNA, 25 bp, Mus musculus
ggagcacttgaatgcgtctgacctc

SEQ ID NO: 597172 - DNA, 25 bp, Mus musculus
ggagcacttgtgcatcaataccaat

SEQ ID NO: 597173 - DNA, 25 bp, Mus musculus
ggagcacttgtggatcaataccaat

SEQ ID NO: 597174 - DNA, 25 bp, Mus musculus
ggagcacttgttagcatgtttcaaa

SEQ ID NO: 597175 - DNA, 25 bp, Mus musculus
ggagcacttgtttgcatgtttcaaa

SEQ ID NO: 597176 - DNA, 25 bp, Mus musculus
ggagcactttttcagctaatcagta

SEQ ID NO: 597177 - DNA, 25 bp, Mus musculus
ggagcactttttgagctaatcagta

SEQ ID NO: 597178 - DNA, 25 bp, Mus musculus
ggagcagaaagaacttcccctgaac

SEQ ID NO: 597179 - DNA, 25 bp, Mus musculus
ggagcagaaagatcttcccctgaac

SEQ ID NO: 597180 - DNA, 25 bp, Mus musculus
ggagcagaagaactccctgaccaag

SEQ ID NO: 597181 - DNA, 25 bp, Mus musculus
ggagcagaagaagtccctgaccaag

SEQ ID NO: 597182 - DNA, 25 bp, Mus musculus
ggagcagaatatcttcttaatcttc

SEQ ID NO: 597183 - DNA, 25 bp, Mus musculus
ggagcagaatatgttcttaatcttc

SEQ ID NO: 597184 - DNA, 25 bp, Mus musculus
ggagcagaatggactcttgttgaaa

SEQ ID NO: 597185 - DNA, 25 bp, Mus musculus
ggagcagaatggtctcttgttgaaa

SEQ ID NO: 597186 - DNA, 25 bp, Mus musculus
ggagcagaattcagcctttccatgc

SEQ ID NO: 597187 - DNA, 25 bp, Mus musculus
ggagcagaattctgcctttccatgc

SEQ ID NO: 597188 - DNA, 25 bp, Mus musculus
ggagcagaatttcccagctatcgct

SEQ ID NO: 597189 - DNA, 25 bp, Mus musculus
ggagcagaatttgccagctatcgct

SEQ ID NO: 597190 - DNA, 25 bp, Mus musculus
ggagcagacaaaaggctgagcttct

SEQ ID NO: 597191 - DNA, 25 bp, Mus musculus
ggagcagacaaatggctgagcttct

SEQ ID NO: 597192 - DNA, 25 bp, Mus musculus
ggagcagacattagctagctggaca

SEQ ID NO: 597193 - DNA, 25 bp, Mus musculus
ggagcagacatttgctagctggaca

SEQ ID NO: 597194 - DNA, 25 bp, Mus musculus
ggagcagaccatcaaggacttgcag

SEQ ID NO: 597195 - DNA, 25 bp, Mus musculus
ggagcagaccatgaaggacttgcag

SEQ ID NO: 597196 - DNA, 25 bp, Mus musculus
ggagcagactcactttgacacttgt

SEQ ID NO: 597197 - DNA, 25 bp, Mus musculus
ggagcagactcagtttgacacttgt

SEQ ID NO: 597198 - DNA, 25 bp, Mus musculus
ggagcagactcccatgtggattact

SEQ ID NO: 597199 - DNA, 25 bp, Mus musculus
ggagcagactccgatgtggattact

SEQ ID NO: 597200 - DNA, 25 bp, Mus musculus
ggagcagactgcaaagcgccggaaa

SEQ ID NO: 597201 - DNA, 25 bp, Mus musculus
ggagcagactgctaagcgccggaaa

SEQ ID NO: 597202 - DNA, 25 bp, Mus musculus
ggagcagactggatttggaccttct

SEQ ID NO: 597203 - DNA, 25 bp, Mus musculus
ggagcagactggttttggaccttct

SEQ ID NO: 597204 - DNA, 25 bp, Mus musculus
ggagcagagcccctcactgagcatg

SEQ ID NO: 597205 - DNA, 25 bp, Mus musculus
ggagcagagcccgtcactgagcatg

SEQ ID NO: 597206 - DNA, 25 bp, Mus musculus
ggagcagagcgcagtgcccacttgc

SEQ ID NO: 597207 - DNA, 25 bp, Mus musculus
ggagcagagcgctgtgcccacttgc

SEQ ID NO: 597208 - DNA, 25 bp, Mus musculus
ggagcagagctcaaacaactctcca

SEQ ID NO: 597209 - DNA, 25 bp, Mus musculus
ggagcagagctcattcctcaaaatt

SEQ ID NO: 597210 - DNA, 25 bp, Mus musculus
ggagcagagctctaacaactctcca

SEQ ID NO: 597211 - DNA, 25 bp, Mus musculus
ggagcagagctctttcctcaaaatt

SEQ ID NO: 597212 - DNA, 25 bp, Mus musculus
ggagcagagctgatgaccaagccct

SEQ ID NO: 597213 - DNA, 25 bp, Mus musculus
ggagcagagctgttgaccaagccct

SEQ ID NO: 597214 - DNA, 25 bp, Mus musculus
ggagcagaggacatactttctcatt

SEQ ID NO: 597215 - DNA, 25 bp, Mus musculus
ggagcagaggacttactttctcatt

SEQ ID NO: 597216 - DNA, 25 bp, Mus musculus
ggagcagaggctaccataggtttta

SEQ ID NO: 597217 - DNA, 25 bp, Mus musculus
ggagcagaggcttccataggtttta

SEQ ID NO: 597218 - DNA, 25 bp, Mus musculus
ggagcagagtccctatgtccttgtt

SEQ ID NO: 597219 - DNA, 25 bp, Mus musculus
ggagcagagtccgtatgtccttgtt

SEQ ID NO: 597220 - DNA, 25 bp, Mus musculus
ggagcagagttactggccccatatt

SEQ ID NO: 597221 - DNA, 25 bp, Mus musculus
ggagcagagttagtggccccatatt

SEQ ID NO: 597222 - DNA, 25 bp, Mus musculus
ggagcagatactcagtgctgacaca

SEQ ID NO: 597223 - DNA, 25 bp, Mus musculus
ggagcagatactgagtgctgacaca

SEQ ID NO: 597224 - DNA, 25 bp, Mus musculus
ggagcagatccaacactttttgtca

SEQ ID NO: 597225 - DNA, 25 bp, Mus musculus
ggagcagatccaagagcagagaact

SEQ ID NO: 597226 - DNA, 25 bp, Mus musculus
ggagcagatccatcactttttgtca

SEQ ID NO: 597227 - DNA, 25 bp, Mus musculus
ggagcagatccatgagcagagaact

SEQ ID NO: 597228 - DNA, 25 bp, Mus musculus
ggagcagatttcacacagaaggcaa

SEQ ID NO: 597229 - DNA, 25 bp, Mus musculus
ggagcagatttctcacagaaggcaa

SEQ ID NO: 597230 - DNA, 25 bp, Mus musculus
ggagcagcaaatctcaagatttggg

SEQ ID NO: 597231 - DNA, 25 bp, Mus musculus
ggagcagcaaatgtcaagatttggg

SEQ ID NO: 597232 - DNA, 25 bp, Mus musculus
ggagcagcacccaagagccggaaga

SEQ ID NO: 597233 - DNA, 25 bp, Mus musculus
ggagcagcaccctagagccggaaga

SEQ ID NO: 597234 - DNA, 25 bp, Mus musculus
ggagcagcaccgaaggccagaaatt

SEQ ID NO: 597235 - DNA, 25 bp, Mus musculus
ggagcagcaccgtaggccagaaatt

SEQ ID NO: 597236 - DNA, 25 bp, Mus musculus
ggagcagcagacagctttctggatt

SEQ ID NO: 597237 - DNA, 25 bp, Mus musculus
ggagcagcagactgctttctggatt

SEQ ID NO: 597238 - DNA, 25 bp, Mus musculus
ggagcagcagagagccttgggcaaa

SEQ ID NO: 597239 - DNA, 25 bp, Mus musculus
ggagcagcagagtgccttgggcaaa

SEQ ID NO: 597240 - DNA, 25 bp, Mus musculus
ggagcagcagatccaaggccacttg

SEQ ID NO: 597241 - DNA, 25 bp, Mus musculus
ggagcagcagatgcaaggccacttg

SEQ ID NO: 597242 - DNA, 25 bp, Mus musculus
ggagcagcaggtcatcatggctttc

SEQ ID NO: 597243 - DNA, 25 bp, Mus musculus
ggagcagcaggtgatcatggctttc

SEQ ID NO: 597244 - DNA, 25 bp, Mus musculus
ggagcagcatatcaggcaccttgaa

SEQ ID NO: 597245 - DNA, 25 bp, Mus musculus
ggagcagcatatgaggcaccttgaa

SEQ ID NO: 597246 - DNA, 25 bp, Mus musculus
ggagcagcatcaaggattccccgtc

SEQ ID NO: 597247 - DNA, 25 bp, Mus musculus
ggagcagcatcatggattccccgtc

SEQ ID NO: 597248 - DNA, 25 bp, Mus musculus
ggagcagcatggaaacccctcaaat

SEQ ID NO: 597249 - DNA, 25 bp, Mus musculus
ggagcagcatggtaacccctcaaat

SEQ ID NO: 597250 - DNA, 25 bp, Mus musculus
ggagcagcatgtcgctttagtgacc

SEQ ID NO: 597251 - DNA, 25 bp, Mus musculus
ggagcagcatgtggctttagtgacc

SEQ ID NO: 597252 - DNA, 25 bp, Mus musculus
ggagcagccaagcacccagcatttg

SEQ ID NO: 597253 - DNA, 25 bp, Mus musculus
ggagcagccaaggacccagcatttg

SEQ ID NO: 597254 - DNA, 25 bp, Mus musculus
ggagcagccagcagtaaaaacctac

SEQ ID NO: 597255 - DNA, 25 bp, Mus musculus
ggagcagccagctgtaaaaacctac

SEQ ID NO: 597256 - DNA, 25 bp, Mus musculus
ggagcagccattcccagcaaagtaa

SEQ ID NO: 597257 - DNA, 25 bp, Mus musculus
ggagcagccattgccagcaaagtaa

SEQ ID NO: 597258 - DNA, 25 bp, Mus musculus
ggagcagccccactcttgtttttag

SEQ ID NO: 597259 - DNA, 25 bp, Mus musculus
ggagcagccccagtcttgtttttag

SEQ ID NO: 597260 - DNA, 25 bp, Mus musculus
ggagcagcccctaagtttgaatgaa

SEQ ID NO: 597261 - DNA, 25 bp, Mus musculus
ggagcagccccttagtttgaatgaa

SEQ ID NO: 597262 - DNA, 25 bp, Mus musculus
ggagcagcccttatggtgttgcaaa

SEQ ID NO: 597263 - DNA, 25 bp, Mus musculus
ggagcagcccttttggtgttgcaaa

SEQ ID NO: 597264 - DNA, 25 bp, Mus musculus
ggagcagcgcagacacagcgtccat

SEQ ID NO: 597265 - DNA, 25 bp, Mus musculus
ggagcagcgcagtcacagcgtccat

SEQ ID NO: 597266 - DNA, 25 bp, Mus musculus
ggagcagcggacacgtagtctctag

SEQ ID NO: 597267 - DNA, 25 bp, Mus musculus
ggagcagcggactcgtagtctctag

SEQ ID NO: 597268 - DNA, 25 bp, Mus musculus
ggagcagcggccatgctgaactaca

SEQ ID NO: 597269 - DNA, 25 bp, Mus musculus
ggagcagcggccttgctgaactaca

SEQ ID NO: 597270 - DNA, 25 bp, Mus musculus
ggagcagctattcaacatggccaag

SEQ ID NO: 597271 - DNA, 25 bp, Mus musculus
ggagcagctattgaacatggccaag

SEQ ID NO: 597272 - DNA, 25 bp, Mus musculus
ggagcagctcagcatatcactggag

SEQ ID NO: 597273 - DNA, 25 bp, Mus musculus
ggagcagctcaggatatcactggag

SEQ ID NO: 597274 - DNA, 25 bp, Mus musculus
ggagcagctcatcttgcacgaatac

SEQ ID NO: 597275 - DNA, 25 bp, Mus musculus
ggagcagctcatctttgctttcttt

SEQ ID NO: 597276 - DNA, 25 bp, Mus musculus
ggagcagctcatgttgcacgaatac

SEQ ID NO: 597277 - DNA, 25 bp, Mus musculus
ggagcagctcatgtttgctttcttt

SEQ ID NO: 597278 - DNA, 25 bp, Mus musculus
ggagcagctccgcaaggaaccaagc

SEQ ID NO: 597279 - DNA, 25 bp, Mus musculus
ggagcagctccggaaggaaccaagc

SEQ ID NO: 597280 - DNA, 25 bp, Mus musculus
ggagcagctcctaaggttatttaat

SEQ ID NO: 597281 - DNA, 25 bp, Mus musculus
ggagcagctccttaggttatttaat

SEQ ID NO: 597282 - DNA, 25 bp, Mus musculus
ggagcagctgataacccaactcttg

SEQ ID NO: 597283 - DNA, 25 bp, Mus musculus
ggagcagctgattacccaactcttg

SEQ ID NO: 597284 - DNA, 25 bp, Mus musculus
ggagcagctggtacctcacgcagga

SEQ ID NO: 597285 - DNA, 25 bp, Mus musculus
ggagcagctggtccactttcatgtc

SEQ ID NO: 597286 - DNA, 25 bp, Mus musculus
ggagcagctggtgcactttcatgtc

SEQ ID NO: 597287 - DNA, 25 bp, Mus musculus
ggagcagctggttcctcacgcagga

SEQ ID NO: 597288 - DNA, 25 bp, Mus musculus
ggagcagctgttcctgagaaagtca

SEQ ID NO: 597289 - DNA, 25 bp, Mus musculus
ggagcagctgttgctgagaaagtca

SEQ ID NO: 597290 - DNA, 25 bp, Mus musculus
ggagcaggacaacacacatcactaa

SEQ ID NO: 597291 - DNA, 25 bp, Mus musculus
ggagcaggacaagacacatcactaa

SEQ ID NO: 597292 - DNA, 25 bp, Mus musculus
ggagcaggaccaaggaagagcttta

SEQ ID NO: 597293 - DNA, 25 bp, Mus musculus
ggagcaggaccatggaagagcttta

SEQ ID NO: 597294 - DNA, 25 bp, Mus musculus
ggagcaggacctcccgatgtcctga

SEQ ID NO: 597295 - DNA, 25 bp, Mus musculus
ggagcaggacctgccgatgtcctga

SEQ ID NO: 597296 - DNA, 25 bp, Mus musculus
ggagcaggagttccgttccattttc

SEQ ID NO: 597297 - DNA, 25 bp, Mus musculus
ggagcaggagttgcgttccattttc

SEQ ID NO: 597298 - DNA, 25 bp, Mus musculus
ggagcaggatgcatatttttccaag

SEQ ID NO: 597299 - DNA, 25 bp, Mus musculus
ggagcaggatgcttatttttccaag

SEQ ID NO: 597300 - DNA, 25 bp, Mus musculus
ggagcaggcatgctatttcaaatct

SEQ ID NO: 597301 - DNA, 25 bp, Mus musculus
ggagcaggcatggtatttcaaatct

SEQ ID NO: 597302 - DNA, 25 bp, Mus musculus
ggagcaggccaacgaaatcgagatc

SEQ ID NO: 597303 - DNA, 25 bp, Mus musculus
ggagcaggccaaggaaatcgagatc

SEQ ID NO: 597304 - DNA, 25 bp, Mus musculus
ggagcaggcccaactgtactcaagc

SEQ ID NO: 597305 - DNA, 25 bp, Mus musculus
ggagcaggcccatctgtactcaagc

SEQ ID NO: 597306 - DNA, 25 bp, Mus musculus
ggagcaggctatagctggttcacct

SEQ ID NO: 597307 - DNA, 25 bp, Mus musculus
ggagcaggctattgctggttcacct

SEQ ID NO: 597308 - DNA, 25 bp, Mus musculus
ggagcaggctgcatttatgcaacag

SEQ ID NO: 597309 - DNA, 25 bp, Mus musculus
ggagcaggctgcttttatgcaacag

SEQ ID NO: 597310 - DNA, 25 bp, Mus musculus
ggagcaggctttatgactgttcacc

SEQ ID NO: 597311 - DNA, 25 bp, Mus musculus
ggagcaggctttttgactgttcacc

SEQ ID NO: 597312 - DNA, 25 bp, Mus musculus
ggagcaggtagcacatgtcatacat

SEQ ID NO: 597313 - DNA, 25 bp, Mus musculus
ggagcaggtagctcatgtcatacat

SEQ ID NO: 597314 - DNA, 25 bp, Mus musculus
ggagcaggtcttactgagctttgcc

SEQ ID NO: 597315 - DNA, 25 bp, Mus musculus
ggagcaggtctttctgagctttgcc

SEQ ID NO: 597316 - DNA, 25 bp, Mus musculus
ggagcaggttcaacgaggcatcaaa

SEQ ID NO: 597317 - DNA, 25 bp, Mus musculus
ggagcaggttcatcgaggcatcaaa

SEQ ID NO: 597318 - DNA, 25 bp, Mus musculus
ggagcagtaaccagacaactaatat

SEQ ID NO: 597319 - DNA, 25 bp, Mus musculus
ggagcagtaacctgacaactaatat

SEQ ID NO: 597320 - DNA, 25 bp, Mus musculus
ggagcagtacatataccctaccatt

SEQ ID NO: 597321 - DNA, 25 bp, Mus musculus
ggagcagtacatttaccctaccatt

SEQ ID NO: 597322 - DNA, 25 bp, Mus musculus
ggagcagtaccgctccgtcctcaag

SEQ ID NO: 597323 - DNA, 25 bp, Mus musculus
ggagcagtaccggtccgtcctcaag

SEQ ID NO: 597324 - DNA, 25 bp, Mus musculus
ggagcagtagcaacaccatcgtgtt

SEQ ID NO: 597325 - DNA, 25 bp, Mus musculus
ggagcagtagcatcaccatcgtgtt

SEQ ID NO: 597326 - DNA, 25 bp, Mus musculus
ggagcagtatgtcttggccatcatg

SEQ ID NO: 597327 - DNA, 25 bp, Mus musculus
ggagcagtatgtgttggccatcatg

SEQ ID NO: 597328 - DNA, 25 bp, Mus musculus
ggagcagtcaaacacaggttgtcag

SEQ ID NO: 597329 - DNA, 25 bp, Mus musculus
ggagcagtcaaagacaggttgtcag

SEQ ID NO: 597330 - DNA, 25 bp, Mus musculus
ggagcagtcacaactgggatggcct

SEQ ID NO: 597331 - DNA, 25 bp, Mus musculus
ggagcagtcacatctgggatggcct

SEQ ID NO: 597332 - DNA, 25 bp, Mus musculus
ggagcagtcagaaacttttacttta

SEQ ID NO: 597333 - DNA, 25 bp, Mus musculus
ggagcagtcagatacttttacttta

SEQ ID NO: 597334 - DNA, 25 bp, Mus musculus
ggagcagtcagcagatggccacgac

SEQ ID NO: 597335 - DNA, 25 bp, Mus musculus
ggagcagtcagctgatggccacgac

SEQ ID NO: 597336 - DNA, 25 bp, Mus musculus
ggagcagtcgtgatctcagtttgta

SEQ ID NO: 597337 - DNA, 25 bp, Mus musculus
ggagcagtcgtgttctcagtttgta

SEQ ID NO: 597338 - DNA, 25 bp, Mus musculus
ggagcagtctcacagaacaccctgg

SEQ ID NO: 597339 - DNA, 25 bp, Mus musculus
ggagcagtctcagagaacaccctgg

SEQ ID NO: 597340 - DNA, 25 bp, Mus musculus
ggagcagtctgaccataggaccaca

SEQ ID NO: 597341 - DNA, 25 bp, Mus musculus
ggagcagtctgagcataggaccaca

SEQ ID NO: 597342 - DNA, 25 bp, Mus musculus
ggagcagtgagactgtcagataaca

SEQ ID NO: 597343 - DNA, 25 bp, Mus musculus
ggagcagtgagagtgtcagataaca

SEQ ID NO: 597344 - DNA, 25 bp, Mus musculus
ggagcagtgcatcatacacgtgccc

SEQ ID NO: 597345 - DNA, 25 bp, Mus musculus
ggagcagtgcatgatacacgtgccc

SEQ ID NO: 597346 - DNA, 25 bp, Mus musculus
ggagcagtgcttacttcagaggtac

SEQ ID NO: 597347 - DNA, 25 bp, Mus musculus
ggagcagtgctttcttcagaggtac

SEQ ID NO: 597348 - DNA, 25 bp, Mus musculus
ggagcagtggctaacagacttacat

SEQ ID NO: 597349 - DNA, 25 bp, Mus musculus
ggagcagtggcttacagacttacat

SEQ ID NO: 597350 - DNA, 25 bp, Mus musculus
ggagcagtgtctcccactggtataa

SEQ ID NO: 597351 - DNA, 25 bp, Mus musculus
ggagcagtgtctctgtgactacccc

SEQ ID NO: 597352 - DNA, 25 bp, Mus musculus
ggagcagtgtctgccactggtataa

SEQ ID NO: 597353 - DNA, 25 bp, Mus musculus
ggagcagtgtctgtgtgactacccc

SEQ ID NO: 597354 - DNA, 25 bp, Mus musculus
ggagcagtgtgaaacagggtaacca

SEQ ID NO: 597355 - DNA, 25 bp, Mus musculus
ggagcagtgtgaccgtgcctaccct

SEQ ID NO: 597356 - DNA, 25 bp, Mus musculus
ggagcagtgtgagcgtgcctaccct

SEQ ID NO: 597357 - DNA, 25 bp, Mus musculus
ggagcagtgtgatacagggtaacca

SEQ ID NO: 597358 - DNA, 25 bp, Mus musculus
ggagcagtgtgccaatgtcgacttc

SEQ ID NO: 597359 - DNA, 25 bp, Mus musculus
ggagcagtgtgcgaatgtcgacttc

SEQ ID NO: 597360 - DNA, 25 bp, Mus musculus
ggagcagtgttgaaaagaagccagt

SEQ ID NO: 597361 - DNA, 25 bp, Mus musculus
ggagcagtgttgtaaagaagccagt

SEQ ID NO: 597362 - DNA, 25 bp, Mus musculus
ggagcagttaagcaggacccacaga

SEQ ID NO: 597363 - DNA, 25 bp, Mus musculus
ggagcagttaaggaggacccacaga

SEQ ID NO: 597364 - DNA, 25 bp, Mus musculus
ggagcagttactccccaggtaagca

SEQ ID NO: 597365 - DNA, 25 bp, Mus musculus
ggagcagttactgcccaggtaagca

SEQ ID NO: 597366 - DNA, 25 bp, Mus musculus
ggagcagttccaactatctgtaaca

SEQ ID NO: 597367 - DNA, 25 bp, Mus musculus
ggagcagttccatctatctgtaaca

SEQ ID NO: 597368 - DNA, 25 bp, Mus musculus
ggagcagttcccagacatcagtcaa

SEQ ID NO: 597369 - DNA, 25 bp, Mus musculus
ggagcagttccctgacatcagtcaa

SEQ ID NO: 597370 - DNA, 25 bp, Mus musculus
ggagcagttctcctaggacatcttg

SEQ ID NO: 597371 - DNA, 25 bp, Mus musculus
ggagcagttctcgtaggacatcttg

SEQ ID NO: 597372 - DNA, 25 bp, Mus musculus
ggagcagttgtcatcatcttttagt

SEQ ID NO: 597373 - DNA, 25 bp, Mus musculus
ggagcagttgtcttcatcttttagt

SEQ ID NO: 597374 - DNA, 25 bp, Mus musculus
ggagcagttgttctaactttgccaa

SEQ ID NO: 597375 - DNA, 25 bp, Mus musculus
ggagcagttgttgtaactttgccaa

SEQ ID NO: 597376 - DNA, 25 bp, Mus musculus
ggagcagtttcaatcccagagattt

SEQ ID NO: 597377 - DNA, 25 bp, Mus musculus
ggagcagtttcattcccagagattt

SEQ ID NO: 597378 - DNA, 25 bp, Mus musculus
ggagcagtttctagttattttgtca

SEQ ID NO: 597379 - DNA, 25 bp, Mus musculus
ggagcagtttctcggcgagctttca

SEQ ID NO: 597380 - DNA, 25 bp, Mus musculus
ggagcagtttctgggcgagctttca

SEQ ID NO: 597381 - DNA, 25 bp, Mus musculus
ggagcagtttcttgttattttgtca

SEQ ID NO: 597382 - DNA, 25 bp, Mus musculus
ggagcataataacaataacgccttt

SEQ ID NO: 597383 - DNA, 25 bp, Mus musculus
ggagcataataagaataacgccttt

SEQ ID NO: 597384 - DNA, 25 bp, Mus musculus
ggagcatactttaaaccaacatggg

SEQ ID NO: 597385 - DNA, 25 bp, Mus musculus
ggagcatacttttaaccaacatggg

SEQ ID NO: 597386 - DNA, 25 bp, Mus musculus
ggagcatagactccgggctttttct

SEQ ID NO: 597387 - DNA, 25 bp, Mus musculus
ggagcatagactgcgggctttttct

SEQ ID NO: 597388 - DNA, 25 bp, Mus musculus
ggagcatagatgacttcacatactc

SEQ ID NO: 597389 - DNA, 25 bp, Mus musculus
ggagcatagatgtcttcacatactc

SEQ ID NO: 597390 - DNA, 25 bp, Mus musculus
ggagcatagcgactcatcatcgact

SEQ ID NO: 597391 - DNA, 25 bp, Mus musculus
ggagcatagcgagtcatcatcgact

SEQ ID NO: 597392 - DNA, 25 bp, Mus musculus
ggagcatagcgtacacctgggaaaa

SEQ ID NO: 597393 - DNA, 25 bp, Mus musculus
ggagcatagcgttcacctgggaaaa

SEQ ID NO: 597394 - DNA, 25 bp, Mus musculus
ggagcatagttcacaactctcattc

SEQ ID NO: 597395 - DNA, 25 bp, Mus musculus
ggagcatagttctcaactctcattc

SEQ ID NO: 597396 - DNA, 25 bp, Mus musculus
ggagcatatcctacaggacgtgtct

SEQ ID NO: 597397 - DNA, 25 bp, Mus musculus
ggagcatatccttcaggacgtgtct

SEQ ID NO: 597398 - DNA, 25 bp, Mus musculus
ggagcatatctaaaccttcactgcc

SEQ ID NO: 597399 - DNA, 25 bp, Mus musculus
ggagcatatctataccttcactgcc

SEQ ID NO: 597400 - DNA, 25 bp, Mus musculus
ggagcatcaaatattttagagaaac

SEQ ID NO: 597401 - DNA, 25 bp, Mus musculus
ggagcatcaaattttttagagaaac

SEQ ID NO: 597402 - DNA, 25 bp, Mus musculus
ggagcatcaagcctaccgctggctg

SEQ ID NO: 597403 - DNA, 25 bp, Mus musculus
ggagcatcaagcgtaccgctggctg

SEQ ID NO: 597404 - DNA, 25 bp, Mus musculus
ggagcatcaataatcagcaactact

SEQ ID NO: 597405 - DNA, 25 bp, Mus musculus
ggagcatcaatattcagcaactact

SEQ ID NO: 597406 - DNA, 25 bp, Mus musculus
ggagcatcagatccagagcgtgcaa

SEQ ID NO: 597407 - DNA, 25 bp, Mus musculus
ggagcatcagatgcagagcgtgcaa

SEQ ID NO: 597408 - DNA, 25 bp, Mus musculus
ggagcatcagccagcgatacctgga

SEQ ID NO: 597409 - DNA, 25 bp, Mus musculus
ggagcatcagccagtgaacctgttt

SEQ ID NO: 597410 - DNA, 25 bp, Mus musculus
ggagcatcagcctgcgatacctgga

SEQ ID NO: 597411 - DNA, 25 bp, Mus musculus
ggagcatcagcctgtgaacctgttt

SEQ ID NO: 597412 - DNA, 25 bp, Mus musculus
ggagcatcaggacttgggttttcta

SEQ ID NO: 597413 - DNA, 25 bp, Mus musculus
ggagcatcaggagttgggttttcta

SEQ ID NO: 597414 - DNA, 25 bp, Mus musculus
ggagcatcatcgatgttgttcacta

SEQ ID NO: 597415 - DNA, 25 bp, Mus musculus
ggagcatcatcgttgttgttcacta

SEQ ID NO: 597416 - DNA, 25 bp, Mus musculus
ggagcatcatgcagggattgaaccc

SEQ ID NO: 597417 - DNA, 25 bp, Mus musculus
ggagcatcatgctgggattgaaccc

SEQ ID NO: 597418 - DNA, 25 bp, Mus musculus
ggagcatcatttcatgtgttcttca

SEQ ID NO: 597419 - DNA, 25 bp, Mus musculus
ggagcatcatttgatgtgttcttca

SEQ ID NO: 597420 - DNA, 25 bp, Mus musculus
ggagcatccaaactttgagaccagc

SEQ ID NO: 597421 - DNA, 25 bp, Mus musculus
ggagcatccaaagtttgagaccagc

SEQ ID NO: 597422 - DNA, 25 bp, Mus musculus
ggagcatcccgacccagaatcagag

SEQ ID NO: 597423 - DNA, 25 bp, Mus musculus
ggagcatcccgagccagaatcagag

SEQ ID NO: 597424 - DNA, 25 bp, Mus musculus
ggagcatccctaccagaattttaag

SEQ ID NO: 597425 - DNA, 25 bp, Mus musculus
ggagcatccctagcagaattttaag

SEQ ID NO: 597426 - DNA, 25 bp, Mus musculus
ggagcatccctgcatctgcaggaat

SEQ ID NO: 597427 - DNA, 25 bp, Mus musculus
ggagcatccctggatctgcaggaat

SEQ ID NO: 597428 - DNA, 25 bp, Mus musculus
ggagcatcctcaagttgtaagcact

SEQ ID NO: 597429 - DNA, 25 bp, Mus musculus
ggagcatcctcatgttgtaagcact

SEQ ID NO: 597430 - DNA, 25 bp, Mus musculus
ggagcatcctgacccgtgatacaag

SEQ ID NO: 597431 - DNA, 25 bp, Mus musculus
ggagcatcctgagccgtgatacaag

SEQ ID NO: 597432 - DNA, 25 bp, Mus musculus
ggagcatcctggatctaatgactca

SEQ ID NO: 597433 - DNA, 25 bp, Mus musculus
ggagcatcctggttctaatgactca

SEQ ID NO: 597434 - DNA, 25 bp, Mus musculus
ggagcatcctttagatctgagttca

SEQ ID NO: 597435 - DNA, 25 bp, Mus musculus
ggagcatccttttgatctgagttca

SEQ ID NO: 597436 - DNA, 25 bp, Mus musculus
ggagcatcgttaccacctgagctaa

SEQ ID NO: 597437 - DNA, 25 bp, Mus musculus
ggagcatcgttagcacctgagctaa

SEQ ID NO: 597438 - DNA, 25 bp, Mus musculus
ggagcatctaggcaccaggctacat

SEQ ID NO: 597439 - DNA, 25 bp, Mus musculus
ggagcatctagggaccaggctacat

SEQ ID NO: 597440 - DNA, 25 bp, Mus musculus
ggagcatctcaaagtgtcactacct

SEQ ID NO: 597441 - DNA, 25 bp, Mus musculus
ggagcatctcaatgtgtcactacct

SEQ ID NO: 597442 - DNA, 25 bp, Mus musculus
ggagcatctgagcttccacgtgcat

SEQ ID NO: 597443 - DNA, 25 bp, Mus musculus
ggagcatctgaggttccacgtgcat

SEQ ID NO: 597444 - DNA, 25 bp, Mus musculus
ggagcatctgcacaaaccaggccag

SEQ ID NO: 597445 - DNA, 25 bp, Mus musculus
ggagcatctgcagaaaccaggccag

SEQ ID NO: 597446 - DNA, 25 bp, Mus musculus
ggagcatctgcccaatttgttcttc

SEQ ID NO: 597447 - DNA, 25 bp, Mus musculus
ggagcatctgccgaatttgttcttc

SEQ ID NO: 597448 - DNA, 25 bp, Mus musculus
ggagcatctgctaatcctagatctt

SEQ ID NO: 597449 - DNA, 25 bp, Mus musculus
ggagcatctgcttatcctagatctt

SEQ ID NO: 597450 - DNA, 25 bp, Mus musculus
ggagcatctgttcctgcttatccga

SEQ ID NO: 597451 - DNA, 25 bp, Mus musculus
ggagcatctgttgctgcttatccga

SEQ ID NO: 597452 - DNA, 25 bp, Mus musculus
ggagcatcttcgattgagtggagca

SEQ ID NO: 597453 - DNA, 25 bp, Mus musculus
ggagcatcttcgtttgagtggagca

SEQ ID NO: 597454 - DNA, 25 bp, Mus musculus
ggagcatgactcctttcaaatcctc

SEQ ID NO: 597455 - DNA, 25 bp, Mus musculus
ggagcatgactcgtttcaaatcctc

SEQ ID NO: 597456 - DNA, 25 bp, Mus musculus
ggagcatgatgcagagacaagacag

SEQ ID NO: 597457 - DNA, 25 bp, Mus musculus
ggagcatgatgctgagacaagacag

SEQ ID NO: 597458 - DNA, 25 bp, Mus musculus
ggagcatgcatacgagactcatacg

SEQ ID NO: 597459 - DNA, 25 bp, Mus musculus
ggagcatgcataggagactcatacg

SEQ ID NO: 597460 - DNA, 25 bp, Mus musculus
ggagcatgccaaagaccttcgagtg

SEQ ID NO: 597461 - DNA, 25 bp, Mus musculus
ggagcatgccaatgaccttcgagtg

SEQ ID NO: 597462 - DNA, 25 bp, Mus musculus
ggagcatgctaccaactaaatcaca

SEQ ID NO: 597463 - DNA, 25 bp, Mus musculus
ggagcatgctacgaactaaatcaca

SEQ ID NO: 597464 - DNA, 25 bp, Mus musculus
ggagcatgctttaaatctcataact

SEQ ID NO: 597465 - DNA, 25 bp, Mus musculus
ggagcatgcttttaatctcataact

SEQ ID NO: 597466 - DNA, 25 bp, Mus musculus
ggagcatggcatacaaaagcttcat

SEQ ID NO: 597467 - DNA, 25 bp, Mus musculus
ggagcatggcatacataaccgctgg

SEQ ID NO: 597468 - DNA, 25 bp, Mus musculus
ggagcatggcattcaaaagcttcat

SEQ ID NO: 597469 - DNA, 25 bp, Mus musculus
ggagcatggcattcataaccgctgg

SEQ ID NO: 597470 - DNA, 25 bp, Mus musculus
ggagcatggctccatgataagagca

SEQ ID NO: 597471 - DNA, 25 bp, Mus musculus
ggagcatggctcctgtattataagg

SEQ ID NO: 597472 - DNA, 25 bp, Mus musculus
ggagcatggctcgatgataagagca

SEQ ID NO: 597473 - DNA, 25 bp, Mus musculus
ggagcatggctcgtgtattataagg

SEQ ID NO: 597474 - DNA, 25 bp, Mus musculus
ggagcatgtccgcagcgacagcttt

SEQ ID NO: 597475 - DNA, 25 bp, Mus musculus
ggagcatgtccggagcgacagcttt

SEQ ID NO: 597476 - DNA, 25 bp, Mus musculus
ggagcatgtgcgcatggtcatcatc

SEQ ID NO: 597477 - DNA, 25 bp, Mus musculus
ggagcatgtgcggatggtcatcatc

SEQ ID NO: 597478 - DNA, 25 bp, Mus musculus
ggagcattaggtctgttcccacttc

SEQ ID NO: 597479 - DNA, 25 bp, Mus musculus
ggagcattaggtgtgttcccacttc

SEQ ID NO: 597480 - DNA, 25 bp, Mus musculus
ggagcattatttatgccttttgaac

SEQ ID NO: 597481 - DNA, 25 bp, Mus musculus
ggagcattatttttgccttttgaac

SEQ ID NO: 597482 - DNA, 25 bp, Mus musculus
ggagcattccccaacagaagatcag

SEQ ID NO: 597483 - DNA, 25 bp, Mus musculus
ggagcattcccctacagaagatcag

SEQ ID NO: 597484 - DNA, 25 bp, Mus musculus
ggagcattctgcatcttaagagtag

SEQ ID NO: 597485 - DNA, 25 bp, Mus musculus
ggagcattctgcttcttaagagtag

SEQ ID NO: 597486 - DNA, 25 bp, Mus musculus
ggagcattctggataaatccctaag

SEQ ID NO: 597487 - DNA, 25 bp, Mus musculus
ggagcattctggttaaatccctaag

SEQ ID NO: 597488 - DNA, 25 bp, Mus musculus
ggagcattgagaagcgccttcaccg

SEQ ID NO: 597489 - DNA, 25 bp, Mus musculus
ggagcattgagatgcgccttcaccg

SEQ ID NO: 597490 - DNA, 25 bp, Mus musculus
ggagcattgagtactttggttttgt

SEQ ID NO: 597491 - DNA, 25 bp, Mus musculus
ggagcattgagttctttggttttgt

SEQ ID NO: 597492 - DNA, 25 bp, Mus musculus
ggagcattgcaaaattcttaggtca

SEQ ID NO: 597493 - DNA, 25 bp, Mus musculus
ggagcattgcaatattcttaggtca

SEQ ID NO: 597494 - DNA, 25 bp, Mus musculus
ggagcattgctgacaccaggagcta

SEQ ID NO: 597495 - DNA, 25 bp, Mus musculus
ggagcattgctgatacttagcatca

SEQ ID NO: 597496 - DNA, 25 bp, Mus musculus
ggagcattgctgtcaccaggagcta

SEQ ID NO: 597497 - DNA, 25 bp, Mus musculus
ggagcattgctgttacttagcatca

SEQ ID NO: 597498 - DNA, 25 bp, Mus musculus
ggagcattgtaaacgcttggttaat

SEQ ID NO: 597499 - DNA, 25 bp, Mus musculus
ggagcattgtaatcgcttggttaat

SEQ ID NO: 597500 - DNA, 25 bp, Mus musculus
ggagcatttcctctcatttataaac

SEQ ID NO: 597501 - DNA, 25 bp, Mus musculus
ggagcatttcctgtcatttataaac

SEQ ID NO: 597502 - DNA, 25 bp, Mus musculus
ggagcattttagctgaagattgcag

SEQ ID NO: 597503 - DNA, 25 bp, Mus musculus
ggagcattttaggtgaagattgcag

SEQ ID NO: 597504 - DNA, 25 bp, Mus musculus
ggagcattttccagattgatgcttc

SEQ ID NO: 597505 - DNA, 25 bp, Mus musculus
ggagcattttcctgattgatgcttc

SEQ ID NO: 597506 - DNA, 25 bp, Mus musculus
ggagcattttgcagagctgtccctt

SEQ ID NO: 597507 - DNA, 25 bp, Mus musculus
ggagcattttgctgagctgtccctt

SEQ ID NO: 597508 - DNA, 25 bp, Mus musculus
ggagcatttttgcactgtgttttaa

SEQ ID NO: 597509 - DNA, 25 bp, Mus musculus
ggagcatttttggactgtgttttaa

SEQ ID NO: 597510 - DNA, 25 bp, Mus musculus
ggagccaaaagacccaaacacataa

SEQ ID NO: 597511 - DNA, 25 bp, Mus musculus
ggagccaaaagagccaaacacataa

SEQ ID NO: 597512 - DNA, 25 bp, Mus musculus
ggagccaaagccaacggagttccca

SEQ ID NO: 597513 - DNA, 25 bp, Mus musculus
ggagccaaagcctacggagttccca

SEQ ID NO: 597514 - DNA, 25 bp, Mus musculus
ggagccaaagtgatcttttctggtt

SEQ ID NO: 597515 - DNA, 25 bp, Mus musculus
ggagccaaagtgttcttttctggtt

SEQ ID NO: 597516 - DNA, 25 bp, Mus musculus
ggagccaaatcaccttgtgtgtatt

SEQ ID NO: 597517 - DNA, 25 bp, Mus musculus
ggagccaaatcagcttgtgtgtatt

SEQ ID NO: 597518 - DNA, 25 bp, Mus musculus
ggagccaacaaacatccagtcttga

SEQ ID NO: 597519 - DNA, 25 bp, Mus musculus
ggagccaacaaagatccagtcttga

SEQ ID NO: 597520 - DNA, 25 bp, Mus musculus
ggagccaacctcatccgaaaggagt

SEQ ID NO: 597521 - DNA, 25 bp, Mus musculus
ggagccaacctcttccgaaaggagt

SEQ ID NO: 597522 - DNA, 25 bp, Mus musculus
ggagccaacgccagcttgataggta

SEQ ID NO: 597523 - DNA, 25 bp, Mus musculus
ggagccaacgcctgcttgataggta

SEQ ID NO: 597524 - DNA, 25 bp, Mus musculus
ggagccaacgtaagcctgcgctgtg

SEQ ID NO: 597525 - DNA, 25 bp, Mus musculus
ggagccaacgtatgcctgcgctgtg

SEQ ID NO: 597526 - DNA, 25 bp, Mus musculus
ggagccaactaaataggaccttcta

SEQ ID NO: 597527 - DNA, 25 bp, Mus musculus
ggagccaactaattaggaccttcta

SEQ ID NO: 597528 - DNA, 25 bp, Mus musculus
ggagccaactgtatatcttcagctg

SEQ ID NO: 597529 - DNA, 25 bp, Mus musculus
ggagccaactgtttatcttcagctg

SEQ ID NO: 597530 - DNA, 25 bp, Mus musculus
ggagccaacttgctttagcttcaga

SEQ ID NO: 597531 - DNA, 25 bp, Mus musculus
ggagccaacttggtttagcttcaga

SEQ ID NO: 597532 - DNA, 25 bp, Mus musculus
ggagccaagcagctgtcatcaaata

SEQ ID NO: 597533 - DNA, 25 bp, Mus musculus
ggagccaagcaggtgtcatcaaata

SEQ ID NO: 597534 - DNA, 25 bp, Mus musculus
ggagccaagctgaacagtttagttc

SEQ ID NO: 597535 - DNA, 25 bp, Mus musculus
ggagccaagctgtacagtttagttc

SEQ ID NO: 597536 - DNA, 25 bp, Mus musculus
ggagccaaggatccacagttaacca

SEQ ID NO: 597537 - DNA, 25 bp, Mus musculus
ggagccaaggatgcacagttaacca

SEQ ID NO: 597538 - DNA, 25 bp, Mus musculus
ggagccaagtcaattaagacctttt

SEQ ID NO: 597539 - DNA, 25 bp, Mus musculus
ggagccaagtcatttaagacctttt

SEQ ID NO: 597540 - DNA, 25 bp, Mus musculus
ggagccaagtgtcgtagctcatgcc

SEQ ID NO: 597541 - DNA, 25 bp, Mus musculus
ggagccaagtgtggtagctcatgcc

SEQ ID NO: 597542 - DNA, 25 bp, Mus musculus
ggagccaatggcctcccggtacaga

SEQ ID NO: 597543 - DNA, 25 bp, Mus musculus
ggagccaatggcgtcccggtacaga

SEQ ID NO: 597544 - DNA, 25 bp, Mus musculus
ggagccaattccctgtgagcagttg

SEQ ID NO: 597545 - DNA, 25 bp, Mus musculus
ggagccaattccgtgtgagcagttg

SEQ ID NO: 597546 - DNA, 25 bp, Mus musculus
ggagccaatttcctgggcgagatta

SEQ ID NO: 597547 - DNA, 25 bp, Mus musculus
ggagccaatttcgtgggcgagatta

SEQ ID NO: 597548 - DNA, 25 bp, Mus musculus
ggagccacaagcctgcagtgaatgt

SEQ ID NO: 597549 - DNA, 25 bp, Mus musculus
ggagccacaagcgtgcagtgaatgt

SEQ ID NO: 597550 - DNA, 25 bp, Mus musculus
ggagccacaatcctctgttgagtac

SEQ ID NO: 597551 - DNA, 25 bp, Mus musculus
ggagccacaatcgtctgttgagtac

SEQ ID NO: 597552 - DNA, 25 bp, Mus musculus
ggagccacacacagaaggagttgca

SEQ ID NO: 597553 - DNA, 25 bp, Mus musculus
ggagccacacactgaaggagttgca

SEQ ID NO: 597554 - DNA, 25 bp, Mus musculus
ggagccacactaactcaatctcaaa

SEQ ID NO: 597555 - DNA, 25 bp, Mus musculus
ggagccacactatctcaatctcaaa

SEQ ID NO: 597556 - DNA, 25 bp, Mus musculus
ggagccacagatccttgtacagtac

SEQ ID NO: 597557 - DNA, 25 bp, Mus musculus
ggagccacagatgcttgtacagtac

SEQ ID NO: 597558 - DNA, 25 bp, Mus musculus
ggagccacagctatgtgcgggccat

SEQ ID NO: 597559 - DNA, 25 bp, Mus musculus
ggagccacagctcaaccccgagttt

SEQ ID NO: 597560 - DNA, 25 bp, Mus musculus
ggagccacagctgaaccccgagttt

SEQ ID NO: 597561 - DNA, 25 bp, Mus musculus
ggagccacagctttgtgcgggccat

SEQ ID NO: 597562 - DNA, 25 bp, Mus musculus
ggagccacagtcatcccttgtacag

SEQ ID NO: 597563 - DNA, 25 bp, Mus musculus
ggagccacagtcttcccttgtacag

SEQ ID NO: 597564 - DNA, 25 bp, Mus musculus
ggagccacattaagttcatctgttc

SEQ ID NO: 597565 - DNA, 25 bp, Mus musculus
ggagccacattatgttcatctgttc

SEQ ID NO: 597566 - DNA, 25 bp, Mus musculus
ggagccaccactcagtggtcctgag

SEQ ID NO: 597567 - DNA, 25 bp, Mus musculus
ggagccaccactgagtggtcctgag

SEQ ID NO: 597568 - DNA, 25 bp, Mus musculus
ggagccacctccaacgtggaaaaag

SEQ ID NO: 597569 - DNA, 25 bp, Mus musculus
ggagccacctcctacgtggaaaaag

SEQ ID NO: 597570 - DNA, 25 bp, Mus musculus
ggagccacctgtccaaccagagttg

SEQ ID NO: 597571 - DNA, 25 bp, Mus musculus
ggagccacctgtgcaaccagagttg

SEQ ID NO: 597572 - DNA, 25 bp, Mus musculus
ggagccacgactaacagtactgttt

SEQ ID NO: 597573 - DNA, 25 bp, Mus musculus
ggagccacgacttacagtactgttt

SEQ ID NO: 597574 - DNA, 25 bp, Mus musculus
ggagccacggccactatgaatagga

SEQ ID NO: 597575 - DNA, 25 bp, Mus musculus
ggagccacggcctctatgaatagga

SEQ ID NO: 597576 - DNA, 25 bp, Mus musculus
ggagccacggtcatctctgccaagg

SEQ ID NO: 597577 - DNA, 25 bp, Mus musculus
ggagccacggtcttctctgccaagg

SEQ ID NO: 597578 - DNA, 25 bp, Mus musculus
ggagccactaacagcccttttgaga

SEQ ID NO: 597579 - DNA, 25 bp, Mus musculus
ggagccactaactgcccttttgaga

SEQ ID NO: 597580 - DNA, 25 bp, Mus musculus
ggagccactaatacttttgcactta

SEQ ID NO: 597581 - DNA, 25 bp, Mus musculus
ggagccactaattcttttgcactta

SEQ ID NO: 597582 - DNA, 25 bp, Mus musculus
ggagccactcagaacacaactgtat

SEQ ID NO: 597583 - DNA, 25 bp, Mus musculus
ggagccactcagtacacaactgtat

SEQ ID NO: 597584 - DNA, 25 bp, Mus musculus
ggagccactgatacatagcacttat

SEQ ID NO: 597585 - DNA, 25 bp, Mus musculus
ggagccactgattcatagcacttat

SEQ ID NO: 597586 - DNA, 25 bp, Mus musculus
ggagccactgcaccctgagaagcat

SEQ ID NO: 597587 - DNA, 25 bp, Mus musculus
ggagccactgcagcctgagaagcat

SEQ ID NO: 597588 - DNA, 25 bp, Mus musculus
ggagccactgggagcatctcaactt

SEQ ID NO: 597589 - DNA, 25 bp, Mus musculus
ggagccactgggtgcatctcaactt

SEQ ID NO: 597590 - DNA, 25 bp, Mus musculus
ggagccactgtgacactgttgggaa

SEQ ID NO: 597591 - DNA, 25 bp, Mus musculus
ggagccactgtgtcactgttgggaa

SEQ ID NO: 597592 - DNA, 25 bp, Mus musculus
ggagccacttagcaactcctgtact

SEQ ID NO: 597593 - DNA, 25 bp, Mus musculus
ggagccacttaggaactcctgtact

SEQ ID NO: 597594 - DNA, 25 bp, Mus musculus
ggagccacttccatttaccagaagg

SEQ ID NO: 597595 - DNA, 25 bp, Mus musculus
ggagccacttccttttaccagaagg

SEQ ID NO: 597596 - DNA, 25 bp, Mus musculus
ggagccacttgtagttttgcacatt

SEQ ID NO: 597597 - DNA, 25 bp, Mus musculus
ggagccacttgttgttttgcacatt

SEQ ID NO: 597598 - DNA, 25 bp, Mus musculus
ggagccactttgcaggaacacacct

SEQ ID NO: 597599 - DNA, 25 bp, Mus musculus
ggagccactttggaggaacacacct

SEQ ID NO: 597600 - DNA, 25 bp, Mus musculus
ggagccagaattaaacactgagttc

SEQ ID NO: 597601 - DNA, 25 bp, Mus musculus
ggagccagaatttaacactgagttc

SEQ ID NO: 597602 - DNA, 25 bp, Mus musculus
ggagccagactccattttctcaagt

SEQ ID NO: 597603 - DNA, 25 bp, Mus musculus
ggagccagactcgattttctcaagt

SEQ ID NO: 597604 - DNA, 25 bp, Mus musculus
ggagccagatccaacttgtgcacca

SEQ ID NO: 597605 - DNA, 25 bp, Mus musculus
ggagccagatcctacttgtgcacca

SEQ ID NO: 597606 - DNA, 25 bp, Mus musculus
ggagccagctatccaagtacttaga

SEQ ID NO: 597607 - DNA, 25 bp, Mus musculus
ggagccagctatgcaagtacttaga

SEQ ID NO: 597608 - DNA, 25 bp, Mus musculus
ggagccagcttgcaaaatcttgaaa

SEQ ID NO: 597609 - DNA, 25 bp, Mus musculus
ggagccagcttggaaaatcttgaaa

SEQ ID NO: 597610 - DNA, 25 bp, Mus musculus
ggagccaggaataaaatctcaacta

SEQ ID NO: 597611 - DNA, 25 bp, Mus musculus
ggagccaggaattaaatctcaacta

SEQ ID NO: 597612 - DNA, 25 bp, Mus musculus
ggagccaggcccaagtgttggcaac

SEQ ID NO: 597613 - DNA, 25 bp, Mus musculus
ggagccaggccctagtgttggcaac

SEQ ID NO: 597614 - DNA, 25 bp, Mus musculus
ggagccaggtataagaccctaccct

SEQ ID NO: 597615 - DNA, 25 bp, Mus musculus
ggagccaggtattagaccctaccct

SEQ ID NO: 597616 - DNA, 25 bp, Mus musculus
ggagccagtacaccctaagtcagaa

SEQ ID NO: 597617 - DNA, 25 bp, Mus musculus
ggagccagtacagcctaagtcagaa

SEQ ID NO: 597618 - DNA, 25 bp, Mus musculus
ggagccagtcccctgtattttacaa

SEQ ID NO: 597619 - DNA, 25 bp, Mus musculus
ggagccagtcccgtgtattttacaa

SEQ ID NO: 597620 - DNA, 25 bp, Mus musculus
ggagccagtgtcagtgtcttgcctg

SEQ ID NO: 597621 - DNA, 25 bp, Mus musculus
ggagccagtgtctgtgtcttgcctg

SEQ ID NO: 597622 - DNA, 25 bp, Mus musculus
ggagccagtttgcaactgataatgc

SEQ ID NO: 597623 - DNA, 25 bp, Mus musculus
ggagccagtttggaactgataatgc

SEQ ID NO: 597624 - DNA, 25 bp, Mus musculus
ggagccataagcactggtaccactt

SEQ ID NO: 597625 - DNA, 25 bp, Mus musculus
ggagccataagctctggtaccactt

SEQ ID NO: 597626 - DNA, 25 bp, Mus musculus
ggagccatagcaaccataatcttac

SEQ ID NO: 597627 - DNA, 25 bp, Mus musculus
ggagccatagcatccataatcttac

SEQ ID NO: 597628 - DNA, 25 bp, Mus musculus
ggagccatagccagtttcccctccc

SEQ ID NO: 597629 - DNA, 25 bp, Mus musculus
ggagccatagcctgtttcccctccc

SEQ ID NO: 597630 - DNA, 25 bp, Mus musculus
ggagccatatcacgtccaggtgcta

SEQ ID NO: 597631 - DNA, 25 bp, Mus musculus
ggagccatatcaggtccaggtgcta

SEQ ID NO: 597632 - DNA, 25 bp, Mus musculus
ggagccatcacaccttaagtaggtt

SEQ ID NO: 597633 - DNA, 25 bp, Mus musculus
ggagccatcacagcttaagtaggtt

SEQ ID NO: 597634 - DNA, 25 bp, Mus musculus
ggagccatcaccacatgcaggagta

SEQ ID NO: 597635 - DNA, 25 bp, Mus musculus
ggagccatcacctcatgcaggagta

SEQ ID NO: 597636 - DNA, 25 bp, Mus musculus
ggagccatccagaagcctgaatttg

SEQ ID NO: 597637 - DNA, 25 bp, Mus musculus
ggagccatccagcactcaagggtga

SEQ ID NO: 597638 - DNA, 25 bp, Mus musculus
ggagccatccaggactcaagggtga

SEQ ID NO: 597639 - DNA, 25 bp, Mus musculus
ggagccatccagtagcctgaatttg

SEQ ID NO: 597640 - DNA, 25 bp, Mus musculus
ggagccatcccaaacagaactgcca

SEQ ID NO: 597641 - DNA, 25 bp, Mus musculus
ggagccatcccatacagaactgcca

SEQ ID NO: 597642 - DNA, 25 bp, Mus musculus
ggagccatcctaagaggtcacatga

SEQ ID NO: 597643 - DNA, 25 bp, Mus musculus
ggagccatcctatgaggtcacatga

SEQ ID NO: 597644 - DNA, 25 bp, Mus musculus
ggagccatctatcccaaaatgtctt

SEQ ID NO: 597645 - DNA, 25 bp, Mus musculus
ggagccatctatgccaaaatgtctt

SEQ ID NO: 597646 - DNA, 25 bp, Mus musculus
ggagccatgcatctctccatgtata

SEQ ID NO: 597647 - DNA, 25 bp, Mus musculus
ggagccatgcatgtctccatgtata

SEQ ID NO: 597648 - DNA, 25 bp, Mus musculus
ggagccatgccaaacgttcagtata

SEQ ID NO: 597649 - DNA, 25 bp, Mus musculus
ggagccatgccatacgttcagtata

SEQ ID NO: 597650 - DNA, 25 bp, Mus musculus
ggagccatgctgctgacatattctg

SEQ ID NO: 597651 - DNA, 25 bp, Mus musculus
ggagccatgctggtgacatattctg

SEQ ID NO: 597652 - DNA, 25 bp, Mus musculus
ggagccatggccatggtgaaactcc

SEQ ID NO: 597653 - DNA, 25 bp, Mus musculus
ggagccatggccttggtgaaactcc

SEQ ID NO: 597654 - DNA, 25 bp, Mus musculus
ggagccatggctcagtccaggttac

SEQ ID NO: 597655 - DNA, 25 bp, Mus musculus
ggagccatggctgagtccaggttac

SEQ ID NO: 597656 - DNA, 25 bp, Mus musculus
ggagccatgttaccctagcatctga

SEQ ID NO: 597657 - DNA, 25 bp, Mus musculus
ggagccatgttagcctagcatctga

SEQ ID NO: 597658 - DNA, 25 bp, Mus musculus
ggagccatgttcaaattcatcaaag

SEQ ID NO: 597659 - DNA, 25 bp, Mus musculus
ggagccatgttctaattcatcaaag

SEQ ID NO: 597660 - DNA, 25 bp, Mus musculus
ggagccatgtttccattgtatcaaa

SEQ ID NO: 597661 - DNA, 25 bp, Mus musculus
ggagccatgtttgcattgtatcaaa

SEQ ID NO: 597662 - DNA, 25 bp, Mus musculus
ggagccattaaaatcactttactat

SEQ ID NO: 597663 - DNA, 25 bp, Mus musculus
ggagccattaaaccattgcctggat

SEQ ID NO: 597664 - DNA, 25 bp, Mus musculus
ggagccattaaagcattgcctggat

SEQ ID NO: 597665 - DNA, 25 bp, Mus musculus
ggagccattaaattcactttactat

SEQ ID NO: 597666 - DNA, 25 bp, Mus musculus
ggagccattacaagatcccctttag

SEQ ID NO: 597667 - DNA, 25 bp, Mus musculus
ggagccattacatgatcccctttag

SEQ ID NO: 597668 - DNA, 25 bp, Mus musculus
ggagccattataatggtagggtact

SEQ ID NO: 597669 - DNA, 25 bp, Mus musculus
ggagccattatattggtagggtact

SEQ ID NO: 597670 - DNA, 25 bp, Mus musculus
ggagccattccccttactttttgag

SEQ ID NO: 597671 - DNA, 25 bp, Mus musculus
ggagccattcccgttactttttgag

SEQ ID NO: 597672 - DNA, 25 bp, Mus musculus
ggagccattctcctggttctgatcc

SEQ ID NO: 597673 - DNA, 25 bp, Mus musculus
ggagccattctcgtggttctgatcc

SEQ ID NO: 597674 - DNA, 25 bp, Mus musculus
ggagccattcttagcacacccatga

SEQ ID NO: 597675 - DNA, 25 bp, Mus musculus
ggagccattctttgcacacccatga

SEQ ID NO: 597676 - DNA, 25 bp, Mus musculus
ggagccattggcatggtgcctaaag

SEQ ID NO: 597677 - DNA, 25 bp, Mus musculus
ggagccattggcttggtgcctaaag

SEQ ID NO: 597678 - DNA, 25 bp, Mus musculus
ggagccattttcaagagcaaccctt

SEQ ID NO: 597679 - DNA, 25 bp, Mus musculus
ggagccattttctagagcaaccctt

SEQ ID NO: 597680 - DNA, 25 bp, Mus musculus
ggagcccaaagtcgtcacagataca

SEQ ID NO: 597681 - DNA, 25 bp, Mus musculus
ggagcccaaagtggtcacagataca

SEQ ID NO: 597682 - DNA, 25 bp, Mus musculus
ggagcccaaccaataatcatgtgtc

SEQ ID NO: 597683 - DNA, 25 bp, Mus musculus
ggagcccaaccattaatcatgtgtc

SEQ ID NO: 597684 - DNA, 25 bp, Mus musculus
ggagcccaagcaacttagctgcaaa

SEQ ID NO: 597685 - DNA, 25 bp, Mus musculus
ggagcccaagcatcttagctgcaaa

SEQ ID NO: 597686 - DNA, 25 bp, Mus musculus
ggagcccaaggcaatcttagtgttg

SEQ ID NO: 597687 - DNA, 25 bp, Mus musculus
ggagcccaaggctatcttagtgttg

SEQ ID NO: 597688 - DNA, 25 bp, Mus musculus
ggagcccaaggtaaggtttatatga

SEQ ID NO: 597689 - DNA, 25 bp, Mus musculus
ggagcccaaggtcttccaagaatac

SEQ ID NO: 597690 - DNA, 25 bp, Mus musculus
ggagcccaaggtgttccaagaatac

SEQ ID NO: 597691 - DNA, 25 bp, Mus musculus
ggagcccaaggttaggtttatatga

SEQ ID NO: 597692 - DNA, 25 bp, Mus musculus
ggagcccacaagcatattagaactt

SEQ ID NO: 597693 - DNA, 25 bp, Mus musculus
ggagcccacaaggatattagaactt

SEQ ID NO: 597694 - DNA, 25 bp, Mus musculus
ggagcccacacacaaccaacatgaa

SEQ ID NO: 597695 - DNA, 25 bp, Mus musculus
ggagcccacacagaaccaacatgaa

SEQ ID NO: 597696 - DNA, 25 bp, Mus musculus
ggagcccacgctagaggacatccga

SEQ ID NO: 597697 - DNA, 25 bp, Mus musculus
ggagcccacgcttgaggacatccga

SEQ ID NO: 597698 - DNA, 25 bp, Mus musculus
ggagcccacgggaagttgctatctc

SEQ ID NO: 597699 - DNA, 25 bp, Mus musculus
ggagcccacgggtagttgctatctc

SEQ ID NO: 597700 - DNA, 25 bp, Mus musculus
ggagcccactggcagtccacaagtg

SEQ ID NO: 597701 - DNA, 25 bp, Mus musculus
ggagcccactgggagtccacaagtg

SEQ ID NO: 597702 - DNA, 25 bp, Mus musculus
ggagcccagaaaaacaattgtgacc

SEQ ID NO: 597703 - DNA, 25 bp, Mus musculus
ggagcccagaaacacggaacctagc

SEQ ID NO: 597704 - DNA, 25 bp, Mus musculus
ggagcccagaaagacggaacctagc

SEQ ID NO: 597705 - DNA, 25 bp, Mus musculus
ggagcccagaaatacaattgtgacc

SEQ ID NO: 597706 - DNA, 25 bp, Mus musculus
ggagcccagaagcaagcggcacact

SEQ ID NO: 597707 - DNA, 25 bp, Mus musculus
ggagcccagaaggaagcggcacact

SEQ ID NO: 597708 - DNA, 25 bp, Mus musculus
ggagcccagaccagcctcaagccct

SEQ ID NO: 597709 - DNA, 25 bp, Mus musculus
ggagcccagacccaacttttagaag

SEQ ID NO: 597710 - DNA, 25 bp, Mus musculus
ggagcccagaccgaacttttagaag

SEQ ID NO: 597711 - DNA, 25 bp, Mus musculus
ggagcccagacctgcctcaagccct

SEQ ID NO: 597712 - DNA, 25 bp, Mus musculus
ggagcccagagacacgctttgggtg

SEQ ID NO: 597713 - DNA, 25 bp, Mus musculus
ggagcccagagagacgctttgggtg

SEQ ID NO: 597714 - DNA, 25 bp, Mus musculus
ggagcccagaggacaagctgttact

SEQ ID NO: 597715 - DNA, 25 bp, Mus musculus
ggagcccagaggtcaagctgttact

SEQ ID NO: 597716 - DNA, 25 bp, Mus musculus
ggagcccagagtcattccagatcat

SEQ ID NO: 597717 - DNA, 25 bp, Mus musculus
ggagcccagagtcttctaatgctga

SEQ ID NO: 597718 - DNA, 25 bp, Mus musculus
ggagcccagagtgattccagatcat

SEQ ID NO: 597719 - DNA, 25 bp, Mus musculus
ggagcccagagtgttctaatgctga

SEQ ID NO: 597720 - DNA, 25 bp, Mus musculus
ggagcccagatactatgataccaaa

SEQ ID NO: 597721 - DNA, 25 bp, Mus musculus
ggagcccagatagtatgataccaaa

SEQ ID NO: 597722 - DNA, 25 bp, Mus musculus
ggagcccagcttaagtcatttgaac

SEQ ID NO: 597723 - DNA, 25 bp, Mus musculus
ggagcccagctttagtcatttgaac

SEQ ID NO: 597724 - DNA, 25 bp, Mus musculus
ggagcccaggaacctattgacaact

SEQ ID NO: 597725 - DNA, 25 bp, Mus musculus
ggagcccaggaagctattgacaact

SEQ ID NO: 597726 - DNA, 25 bp, Mus musculus
ggagcccaggacatcagaactgctg

SEQ ID NO: 597727 - DNA, 25 bp, Mus musculus
ggagcccaggacttcagaactgctg

SEQ ID NO: 597728 - DNA, 25 bp, Mus musculus
ggagcccaggagattggtcagcata

SEQ ID NO: 597729 - DNA, 25 bp, Mus musculus
ggagcccaggagcaaccgtcatgcc

SEQ ID NO: 597730 - DNA, 25 bp, Mus musculus
ggagcccaggaggaaccgtcatgcc

SEQ ID NO: 597731 - DNA, 25 bp, Mus musculus
ggagcccaggagtttggtcagcata

SEQ ID NO: 597732 - DNA, 25 bp, Mus musculus
ggagcccaggatccatacagagact

SEQ ID NO: 597733 - DNA, 25 bp, Mus musculus
ggagcccaggatctctggatgtcta

SEQ ID NO: 597734 - DNA, 25 bp, Mus musculus
ggagcccaggatgcatacagagact

SEQ ID NO: 597735 - DNA, 25 bp, Mus musculus
ggagcccaggatgtctggatgtcta

SEQ ID NO: 597736 - DNA, 25 bp, Mus musculus
ggagcccaggcaataaggtgtctta

SEQ ID NO: 597737 - DNA, 25 bp, Mus musculus
ggagcccaggcattaaggtgtctta

SEQ ID NO: 597738 - DNA, 25 bp, Mus musculus
ggagcccagtccaaagcaactatta

SEQ ID NO: 597739 - DNA, 25 bp, Mus musculus
ggagcccagtcctaagcaactatta

SEQ ID NO: 597740 - DNA, 25 bp, Mus musculus
ggagcccagtctcggattctaagaa

SEQ ID NO: 597741 - DNA, 25 bp, Mus musculus
ggagcccagtctgggattctaagaa

SEQ ID NO: 597742 - DNA, 25 bp, Mus musculus
ggagcccagtgcacacctagaaaga

SEQ ID NO: 597743 - DNA, 25 bp, Mus musculus
ggagcccagtgctcacctagaaaga

SEQ ID NO: 597744 - DNA, 25 bp, Mus musculus
ggagcccagtggcaatcccttaaga

SEQ ID NO: 597745 - DNA, 25 bp, Mus musculus
ggagcccagtgggaatcccttaaga

SEQ ID NO: 597746 - DNA, 25 bp, Mus musculus
ggagcccagtgtcaatcgtttatat

SEQ ID NO: 597747 - DNA, 25 bp, Mus musculus
ggagcccagtgtcatcacagtgtcc

SEQ ID NO: 597748 - DNA, 25 bp, Mus musculus
ggagcccagtgtgaatcgtttatat

SEQ ID NO: 597749 - DNA, 25 bp, Mus musculus
ggagcccagtgtgatcacagtgtcc

SEQ ID NO: 597750 - DNA, 25 bp, Mus musculus
ggagcccagtttatggacgcaacct

SEQ ID NO: 597751 - DNA, 25 bp, Mus musculus
ggagcccagtttttggacgcaacct

SEQ ID NO: 597752 - DNA, 25 bp, Mus musculus
ggagcccataagcattagctggtta

SEQ ID NO: 597753 - DNA, 25 bp, Mus musculus
ggagcccataaggattagctggtta

SEQ ID NO: 597754 - DNA, 25 bp, Mus musculus
ggagcccatacaagccactgcaaag

SEQ ID NO: 597755 - DNA, 25 bp, Mus musculus
ggagcccatacatgccactgcaaag

SEQ ID NO: 597756 - DNA, 25 bp, Mus musculus
ggagcccatggacaaacggatgcat

SEQ ID NO: 597757 - DNA, 25 bp, Mus musculus
ggagcccatggagaaacggatgcat

SEQ ID NO: 597758 - DNA, 25 bp, Mus musculus
ggagcccatggccaggactgacttt

SEQ ID NO: 597759 - DNA, 25 bp, Mus musculus
ggagcccatggcgaggactgacttt

SEQ ID NO: 597760 - DNA, 25 bp, Mus musculus
ggagcccatgtgcacttctatgact

SEQ ID NO: 597761 - DNA, 25 bp, Mus musculus
ggagcccatgtggacttctatgact

SEQ ID NO: 597762 - DNA, 25 bp, Mus musculus
ggagcccattccatacgaattcatg

SEQ ID NO: 597763 - DNA, 25 bp, Mus musculus
ggagcccattccttacgaattcatg

SEQ ID NO: 597764 - DNA, 25 bp, Mus musculus
ggagccccaagtatgaagcagtgag

SEQ ID NO: 597765 - DNA, 25 bp, Mus musculus
ggagccccaagtttgaagcagtgag

SEQ ID NO: 597766 - DNA, 25 bp, Mus musculus
ggagccccacacatcagaaacagaa

SEQ ID NO: 597767 - DNA, 25 bp, Mus musculus
ggagccccacacttcagaaacagaa

SEQ ID NO: 597768 - DNA, 25 bp, Mus musculus
ggagccccacttcaagagtgaccta

SEQ ID NO: 597769 - DNA, 25 bp, Mus musculus
ggagccccacttgaagagtgaccta

SEQ ID NO: 597770 - DNA, 25 bp, Mus musculus
ggagccccagccaaggcgaactact

SEQ ID NO: 597771 - DNA, 25 bp, Mus musculus
ggagccccagccagttacagagtgg

SEQ ID NO: 597772 - DNA, 25 bp, Mus musculus
ggagccccagcctaggcgaactact

SEQ ID NO: 597773 - DNA, 25 bp, Mus musculus
ggagccccagcctgttacagagtgg

SEQ ID NO: 597774 - DNA, 25 bp, Mus musculus
ggagccccaggaatcataaacttgt

SEQ ID NO: 597775 - DNA, 25 bp, Mus musculus
ggagccccaggattcataaacttgt

SEQ ID NO: 597776 - DNA, 25 bp, Mus musculus
ggagccccaggcataccatgagatc

SEQ ID NO: 597777 - DNA, 25 bp, Mus musculus
ggagccccaggcttaccatgagatc

SEQ ID NO: 597778 - DNA, 25 bp, Mus musculus
ggagccccagggaccgcttcgaaga

SEQ ID NO: 597779 - DNA, 25 bp, Mus musculus
ggagccccagggatgtcaagaagca

SEQ ID NO: 597780 - DNA, 25 bp, Mus musculus
ggagccccagggtccgcttcgaaga

SEQ ID NO: 597781 - DNA, 25 bp, Mus musculus
ggagccccagggttgtcaagaagca

SEQ ID NO: 597782 - DNA, 25 bp, Mus musculus
ggagccccagttcttaggctgtgtt

SEQ ID NO: 597783 - DNA, 25 bp, Mus musculus
ggagccccagttgttaggctgtgtt

SEQ ID NO: 597784 - DNA, 25 bp, Mus musculus
ggagccccatgcaacatgagaccag

SEQ ID NO: 597785 - DNA, 25 bp, Mus musculus
ggagccccatgctacatgagaccag

SEQ ID NO: 597786 - DNA, 25 bp, Mus musculus
ggagccccatgtcgagcagatcact

SEQ ID NO: 597787 - DNA, 25 bp, Mus musculus
ggagccccatgtggagcagatcact

SEQ ID NO: 597788 - DNA, 25 bp, Mus musculus
ggagccccccagcaactgaatcatt

SEQ ID NO: 597789 - DNA, 25 bp, Mus musculus
ggagccccccaggaactgaatcatt

SEQ ID NO: 597790 - DNA, 25 bp, Mus musculus
ggagccccggcccacatgaaataaa

SEQ ID NO: 597791 - DNA, 25 bp, Mus musculus
ggagccccggccgacatgaaataaa

SEQ ID NO: 597792 - DNA, 25 bp, Mus musculus
ggagcccctataaaatggagttaca

SEQ ID NO: 597793 - DNA, 25 bp, Mus musculus
ggagcccctatataatggagttaca

SEQ ID NO: 597794 - DNA, 25 bp, Mus musculus
ggagcccctgccaaagtagagagga

SEQ ID NO: 597795 - DNA, 25 bp, Mus musculus
ggagcccctgcctaagtagagagga

SEQ ID NO: 597796 - DNA, 25 bp, Mus musculus
ggagccccttttatcccagacacgg

SEQ ID NO: 597797 - DNA, 25 bp, Mus musculus
ggagccccttttttcccagacacgg

SEQ ID NO: 597798 - DNA, 25 bp, Mus musculus
ggagcccgagagaaggactgaactt

SEQ ID NO: 597799 - DNA, 25 bp, Mus musculus
ggagcccgagagtaggactgaactt

SEQ ID NO: 597800 - DNA, 25 bp, Mus musculus
ggagcccgaggcattgaatttgact

SEQ ID NO: 597801 - DNA, 25 bp, Mus musculus
ggagcccgaggctttgaatttgact

SEQ ID NO: 597802 - DNA, 25 bp, Mus musculus
ggagcccgcttcctggatgtacacg

SEQ ID NO: 597803 - DNA, 25 bp, Mus musculus
ggagcccgcttcgtggatgtacacg

SEQ ID NO: 597804 - DNA, 25 bp, Mus musculus
ggagcccggcccagattgcaaagta

SEQ ID NO: 597805 - DNA, 25 bp, Mus musculus
ggagcccggccctgattgcaaagta

SEQ ID NO: 597806 - DNA, 25 bp, Mus musculus
ggagcccgggtcagctaaatctcag

SEQ ID NO: 597807 - DNA, 25 bp, Mus musculus
ggagcccgggtctgctaaatctcag

SEQ ID NO: 597808 - DNA, 25 bp, Mus musculus
ggagcccggttactactatgtgtac

SEQ ID NO: 597809 - DNA, 25 bp, Mus musculus
ggagcccggttagtactatgtgtac

SEQ ID NO: 597810 - DNA, 25 bp, Mus musculus
ggagcccgtatgcatttcacacagc

SEQ ID NO: 597811 - DNA, 25 bp, Mus musculus
ggagcccgtatggatttcacacagc

SEQ ID NO: 597812 - DNA, 25 bp, Mus musculus
ggagccctacgaccccgagaagaag

SEQ ID NO: 597813 - DNA, 25 bp, Mus musculus
ggagccctacgagcccgagaagaag

SEQ ID NO: 597814 - DNA, 25 bp, Mus musculus
ggagccctagaacctaccatggaga

SEQ ID NO: 597815 - DNA, 25 bp, Mus musculus
ggagccctagaagctaccatggaga

SEQ ID NO: 597816 - DNA, 25 bp, Mus musculus
ggagccctatgtccaagtgtcagac

SEQ ID NO: 597817 - DNA, 25 bp, Mus musculus
ggagccctatgtgcaagtgtcagac

SEQ ID NO: 597818 - DNA, 25 bp, Mus musculus
ggagccctcatcatttggattgtca

SEQ ID NO: 597819 - DNA, 25 bp, Mus musculus
ggagccctcatcttttggattgtca

SEQ ID NO: 597820 - DNA, 25 bp, Mus musculus
ggagccctcgaacagtagaggctta

SEQ ID NO: 597821 - DNA, 25 bp, Mus musculus
ggagccctcgaagagtagaggctta

SEQ ID NO: 597822 - DNA, 25 bp, Mus musculus
ggagccctcgacacttgtaaataca

SEQ ID NO: 597823 - DNA, 25 bp, Mus musculus
ggagccctcgactcttgtaaataca

SEQ ID NO: 597824 - DNA, 25 bp, Mus musculus
ggagccctcgagacctaccagggag

SEQ ID NO: 597825 - DNA, 25 bp, Mus musculus
ggagccctcgagtcctaccagggag

SEQ ID NO: 597826 - DNA, 25 bp, Mus musculus
ggagccctctggagaacagtattct

SEQ ID NO: 597827 - DNA, 25 bp, Mus musculus
ggagccctctggtgaacagtattct

SEQ ID NO: 597828 - DNA, 25 bp, Mus musculus
ggagccctctgtcccattagcgtta

SEQ ID NO: 597829 - DNA, 25 bp, Mus musculus
ggagccctctgtgccattagcgtta

SEQ ID NO: 597830 - DNA, 25 bp, Mus musculus
ggagccctcttacctaattatgaaa

SEQ ID NO: 597831 - DNA, 25 bp, Mus musculus
ggagccctcttagctaattatgaaa

SEQ ID NO: 597832 - DNA, 25 bp, Mus musculus
ggagccctctttaccacagtgtaaa

SEQ ID NO: 597833 - DNA, 25 bp, Mus musculus
ggagccctcttttccacagtgtaaa

SEQ ID NO: 597834 - DNA, 25 bp, Mus musculus
ggagccctgactctgattaagttct

SEQ ID NO: 597835 - DNA, 25 bp, Mus musculus
ggagccctgactgtgattaagttct

SEQ ID NO: 597836 - DNA, 25 bp, Mus musculus
ggagccctgagaacgaggagtacat

SEQ ID NO: 597837 - DNA, 25 bp, Mus musculus
ggagccctgagatcgaggagtacat

SEQ ID NO: 597838 - DNA, 25 bp, Mus musculus
ggagccctgccaacaaaaagagtca

SEQ ID NO: 597839 - DNA, 25 bp, Mus musculus
ggagccctgccatcaaaaagagtca

SEQ ID NO: 597840 - DNA, 25 bp, Mus musculus
ggagccctgctacgtaaagttccct

SEQ ID NO: 597841 - DNA, 25 bp, Mus musculus
ggagccctgctaggtaaagttccct

SEQ ID NO: 597842 - DNA, 25 bp, Mus musculus
ggagccctgcttaagaaccacgtag

SEQ ID NO: 597843 - DNA, 25 bp, Mus musculus
ggagccctgctttagaaccacgtag

SEQ ID NO: 597844 - DNA, 25 bp, Mus musculus
ggagccctggagcaaaagaccatct

SEQ ID NO: 597845 - DNA, 25 bp, Mus musculus
ggagccctggaggaaaagaccatct

SEQ ID NO: 597846 - DNA, 25 bp, Mus musculus
ggagccctggccaaattctcttatg

SEQ ID NO: 597847 - DNA, 25 bp, Mus musculus
ggagccctggccctgtctgcaatct

SEQ ID NO: 597848 - DNA, 25 bp, Mus musculus
ggagccctggccgtgtctgcaatct

SEQ ID NO: 597849 - DNA, 25 bp, Mus musculus
ggagccctggcctaattctcttatg

SEQ ID NO: 597850 - DNA, 25 bp, Mus musculus
ggagccctggctatcggaattggtc

SEQ ID NO: 597851 - DNA, 25 bp, Mus musculus
ggagccctggctttcggaattggtc

SEQ ID NO: 597852 - DNA, 25 bp, Mus musculus
ggagccctgtaccaagatagactgc

SEQ ID NO: 597853 - DNA, 25 bp, Mus musculus
ggagccctgtacgaagatagactgc

SEQ ID NO: 597854 - DNA, 25 bp, Mus musculus
ggagccctgttgagccttttcatat

SEQ ID NO: 597855 - DNA, 25 bp, Mus musculus
ggagccctgttgtgccttttcatat

SEQ ID NO: 597856 - DNA, 25 bp, Mus musculus
ggagccgaaaatataccatggttgc

SEQ ID NO: 597857 - DNA, 25 bp, Mus musculus
ggagccgaaaatttaccatggttgc

SEQ ID NO: 597858 - DNA, 25 bp, Mus musculus
ggagccgaatcacatgacctagcca

SEQ ID NO: 597859 - DNA, 25 bp, Mus musculus
ggagccgaatcagatgacctagcca

SEQ ID NO: 597860 - DNA, 25 bp, Mus musculus
ggagccgacaaactcaacaccttct

SEQ ID NO: 597861 - DNA, 25 bp, Mus musculus
ggagccgacaaagtcaacaccttct

SEQ ID NO: 597862 - DNA, 25 bp, Mus musculus
ggagccgagcttacgagccactaat

SEQ ID NO: 597863 - DNA, 25 bp, Mus musculus
ggagccgagctttcgagccactaat

SEQ ID NO: 597864 - DNA, 25 bp, Mus musculus
ggagccgatggtccccgtccctgaa

SEQ ID NO: 597865 - DNA, 25 bp, Mus musculus
ggagccgatggtgcccgtccctgaa

SEQ ID NO: 597866 - DNA, 25 bp, Mus musculus
ggagccgatgtcaacaactacgtga

SEQ ID NO: 597867 - DNA, 25 bp, Mus musculus
ggagccgatgtctacaactacgtga

SEQ ID NO: 597868 - DNA, 25 bp, Mus musculus
ggagccgcacaaaccggagcgacag

SEQ ID NO: 597869 - DNA, 25 bp, Mus musculus
ggagccgcacaatccggagcgacag

SEQ ID NO: 597870 - DNA, 25 bp, Mus musculus
ggagccgcacacatgaggccactga

SEQ ID NO: 597871 - DNA, 25 bp, Mus musculus
ggagccgcacacttgaggccactga

SEQ ID NO: 597872 - DNA, 25 bp, Mus musculus
ggagccgcgcaacatcaacatctac

SEQ ID NO: 597873 - DNA, 25 bp, Mus musculus
ggagccgcgcaagatcaacatctac

SEQ ID NO: 597874 - DNA, 25 bp, Mus musculus
ggagccgcttagctactaggagcat

SEQ ID NO: 597875 - DNA, 25 bp, Mus musculus
ggagccgcttaggtactaggagcat

SEQ ID NO: 597876 - DNA, 25 bp, Mus musculus
ggagccggaaatcatccagccctgg

SEQ ID NO: 597877 - DNA, 25 bp, Mus musculus
ggagccggaaatgatccagccctgg

SEQ ID NO: 597878 - DNA, 25 bp, Mus musculus
ggagccggaattctggatccagctt

SEQ ID NO: 597879 - DNA, 25 bp, Mus musculus
ggagccggaattgtggatccagctt

SEQ ID NO: 597880 - DNA, 25 bp, Mus musculus
ggagccggagccaatgctgatgaca

SEQ ID NO: 597881 - DNA, 25 bp, Mus musculus
ggagccggagcctatgctgatgaca

SEQ ID NO: 597882 - DNA, 25 bp, Mus musculus
ggagccggagtcaagtaggttacat

SEQ ID NO: 597883 - DNA, 25 bp, Mus musculus
ggagccggagtctagtaggttacat

SEQ ID NO: 597884 - DNA, 25 bp, Mus musculus
ggagccggcgagcaaggcgcgccag

SEQ ID NO: 597885 - DNA, 25 bp, Mus musculus
ggagccggcgaggaaggcgcgccag

SEQ ID NO: 597886 - DNA, 25 bp, Mus musculus
ggagccggctccattgctctgtcta

SEQ ID NO: 597887 - DNA, 25 bp, Mus musculus
ggagccggctcctttgctctgtcta

SEQ ID NO: 597888 - DNA, 25 bp, Mus musculus
ggagccgggaccactaagactgctg

SEQ ID NO: 597889 - DNA, 25 bp, Mus musculus
ggagccgggacctctaagactgctg

SEQ ID NO: 597890 - DNA, 25 bp, Mus musculus
ggagccgggcttccaaaccaagttg

SEQ ID NO: 597891 - DNA, 25 bp, Mus musculus
ggagccgggcttgcaaaccaagttg

SEQ ID NO: 597892 - DNA, 25 bp, Mus musculus
ggagccggtgccatacacagcgaag

SEQ ID NO: 597893 - DNA, 25 bp, Mus musculus
ggagccggtgccttacacagcgaag

SEQ ID NO: 597894 - DNA, 25 bp, Mus musculus
ggagccgtgactctaattgccctac

SEQ ID NO: 597895 - DNA, 25 bp, Mus musculus
ggagccgtgactgtaattgccctac

SEQ ID NO: 597896 - DNA, 25 bp, Mus musculus
ggagccgttaccagagccggagcct

SEQ ID NO: 597897 - DNA, 25 bp, Mus musculus
ggagccgttacctgagccggagcct

SEQ ID NO: 597898 - DNA, 25 bp, Mus musculus
ggagccgtttcaaccacaggacatg

SEQ ID NO: 597899 - DNA, 25 bp, Mus musculus
ggagccgtttcatccacaggacatg

SEQ ID NO: 597900 - DNA, 25 bp, Mus musculus
ggagccgtttgtacatttcatcact

SEQ ID NO: 597901 - DNA, 25 bp, Mus musculus
ggagccgtttgttcatttcatcact

SEQ ID NO: 597902 - DNA, 25 bp, Mus musculus
ggagcctaaagaaaacgccaaaaga

SEQ ID NO: 597903 - DNA, 25 bp, Mus musculus
ggagcctaaagataacgccaaaaga

SEQ ID NO: 597904 - DNA, 25 bp, Mus musculus
ggagcctaacagcaccggacccttt

SEQ ID NO: 597905 - DNA, 25 bp, Mus musculus
ggagcctaacaggaccggacccttt

SEQ ID NO: 597906 - DNA, 25 bp, Mus musculus
ggagcctaagctcaagactcactga

SEQ ID NO: 597907 - DNA, 25 bp, Mus musculus
ggagcctaagctgaagactcactga

SEQ ID NO: 597908 - DNA, 25 bp, Mus musculus
ggagcctacatcaaaagaccccaag

SEQ ID NO: 597909 - DNA, 25 bp, Mus musculus
ggagcctacatccagaatgagcaca

SEQ ID NO: 597910 - DNA, 25 bp, Mus musculus
ggagcctacatcgagaatgagcaca

SEQ ID NO: 597911 - DNA, 25 bp, Mus musculus
ggagcctacatctaaagaccccaag

SEQ ID NO: 597912 - DNA, 25 bp, Mus musculus
ggagcctacatgactgccaaggatt

SEQ ID NO: 597913 - DNA, 25 bp, Mus musculus
ggagcctacatgtctgccaaggatt

SEQ ID NO: 597914 - DNA, 25 bp, Mus musculus
ggagcctacgaacatccagctgctt

SEQ ID NO: 597915 - DNA, 25 bp, Mus musculus
ggagcctacgaagatccagctgctt

SEQ ID NO: 597916 - DNA, 25 bp, Mus musculus
ggagcctactgtcactggttgctga

SEQ ID NO: 597917 - DNA, 25 bp, Mus musculus
ggagcctactgtgactggttgctga

SEQ ID NO: 597918 - DNA, 25 bp, Mus musculus
ggagcctaggccagggagtcttatc

SEQ ID NO: 597919 - DNA, 25 bp, Mus musculus
ggagcctaggcctgggagtcttatc

SEQ ID NO: 597920 - DNA, 25 bp, Mus musculus
ggagcctaggttctttgaggcccca

SEQ ID NO: 597921 - DNA, 25 bp, Mus musculus
ggagcctaggttgtttgaggcccca

SEQ ID NO: 597922 - DNA, 25 bp, Mus musculus
ggagcctatgcaaacagcatctttt

SEQ ID NO: 597923 - DNA, 25 bp, Mus musculus
ggagcctatgcatacagcatctttt

SEQ ID NO: 597924 - DNA, 25 bp, Mus musculus
ggagcctatgccacttttaatgtta

SEQ ID NO: 597925 - DNA, 25 bp, Mus musculus
ggagcctatgcctcttttaatgtta

SEQ ID NO: 597926 - DNA, 25 bp, Mus musculus
ggagcctatgttctgtcatcaaaaa

SEQ ID NO: 597927 - DNA, 25 bp, Mus musculus
ggagcctatgttgtgtcatcaaaaa

SEQ ID NO: 597928 - DNA, 25 bp, Mus musculus
ggagcctcaagtattttaagattct

SEQ ID NO: 597929 - DNA, 25 bp, Mus musculus
ggagcctcaagttttttaagattct

SEQ ID NO: 597930 - DNA, 25 bp, Mus musculus
ggagcctccacacctactgcagtta

SEQ ID NO: 597931 - DNA, 25 bp, Mus musculus
ggagcctccacagctactgcagtta

SEQ ID NO: 597932 - DNA, 25 bp, Mus musculus
ggagcctccagtcctctagtaaatt

SEQ ID NO: 597933 - DNA, 25 bp, Mus musculus
ggagcctccagtgctctagtaaatt

SEQ ID NO: 597934 - DNA, 25 bp, Mus musculus
ggagcctccatcaatcagatttttg

SEQ ID NO: 597935 - DNA, 25 bp, Mus musculus
ggagcctccatccacctggagaaga

SEQ ID NO: 597936 - DNA, 25 bp, Mus musculus
ggagcctccatcgacctggagaaga

SEQ ID NO: 597937 - DNA, 25 bp, Mus musculus
ggagcctccatctatcagatttttg

SEQ ID NO: 597938 - DNA, 25 bp, Mus musculus
ggagcctccctccatgttggaggat

SEQ ID NO: 597939 - DNA, 25 bp, Mus musculus
ggagcctccctcgatgttggaggat

SEQ ID NO: 597940 - DNA, 25 bp, Mus musculus
ggagcctccctgagattaagagtca

SEQ ID NO: 597941 - DNA, 25 bp, Mus musculus
ggagcctccctgtgattaagagtca

SEQ ID NO: 597942 - DNA, 25 bp, Mus musculus
ggagcctcgaaaactgttcaacccg

SEQ ID NO: 597943 - DNA, 25 bp, Mus musculus
ggagcctcgaaatctgttcaacccg

SEQ ID NO: 597944 - DNA, 25 bp, Mus musculus
ggagcctcgtagaccgccaaaaaga

SEQ ID NO: 597945 - DNA, 25 bp, Mus musculus
ggagcctcgtagattaagcctagaa

SEQ ID NO: 597946 - DNA, 25 bp, Mus musculus
ggagcctcgtagtccgccaaaaaga

SEQ ID NO: 597947 - DNA, 25 bp, Mus musculus
ggagcctcgtagtttaagcctagaa

SEQ ID NO: 597948 - DNA, 25 bp, Mus musculus
ggagcctctcatattgctttacttt

SEQ ID NO: 597949 - DNA, 25 bp, Mus musculus
ggagcctctcattttgctttacttt

SEQ ID NO: 597950 - DNA, 25 bp, Mus musculus
ggagcctctccaattgagatacggt

SEQ ID NO: 597951 - DNA, 25 bp, Mus musculus
ggagcctctccatttgagatacggt

SEQ ID NO: 597952 - DNA, 25 bp, Mus musculus
ggagcctctctactattcaggtttt

SEQ ID NO: 597953 - DNA, 25 bp, Mus musculus
ggagcctctctagtattcaggtttt

SEQ ID NO: 597954 - DNA, 25 bp, Mus musculus
ggagcctctcttctgtctccacaaa

SEQ ID NO: 597955 - DNA, 25 bp, Mus musculus
ggagcctctcttgtgtctccacaaa

SEQ ID NO: 597956 - DNA, 25 bp, Mus musculus
ggagcctctgaaccataagtcaaaa

SEQ ID NO: 597957 - DNA, 25 bp, Mus musculus
ggagcctctgaagcataagtcaaaa

SEQ ID NO: 597958 - DNA, 25 bp, Mus musculus
ggagcctctgagaattgtctaaaac

SEQ ID NO: 597959 - DNA, 25 bp, Mus musculus
ggagcctctgagacactgaacttgc

SEQ ID NO: 597960 - DNA, 25 bp, Mus musculus
ggagcctctgagtattgtctaaaac

SEQ ID NO: 597961 - DNA, 25 bp, Mus musculus
ggagcctctgagtcactgaacttgc

SEQ ID NO: 597962 - DNA, 25 bp, Mus musculus
ggagcctctggtaacacatatttta

SEQ ID NO: 597963 - DNA, 25 bp, Mus musculus
ggagcctctggttacacatatttta

SEQ ID NO: 597964 - DNA, 25 bp, Mus musculus
ggagcctcttttaggattctcagct

SEQ ID NO: 597965 - DNA, 25 bp, Mus musculus
ggagcctctttttggattctcagct

SEQ ID NO: 597966 - DNA, 25 bp, Mus musculus
ggagcctgaaacaagcacactgtgc

SEQ ID NO: 597967 - DNA, 25 bp, Mus musculus
ggagcctgaaactagcacactgtgc

SEQ ID NO: 597968 - DNA, 25 bp, Mus musculus
ggagcctgaataaaccaatgtttgc

SEQ ID NO: 597969 - DNA, 25 bp, Mus musculus
ggagcctgaatataccaatgtttgc

SEQ ID NO: 597970 - DNA, 25 bp, Mus musculus
ggagcctgagatacgctgctctcaa

SEQ ID NO: 597971 - DNA, 25 bp, Mus musculus
ggagcctgagattcgctgctctcaa

SEQ ID NO: 597972 - DNA, 25 bp, Mus musculus
ggagcctgaggcatttgggattatt

SEQ ID NO: 597973 - DNA, 25 bp, Mus musculus
ggagcctgaggcttttgggattatt

SEQ ID NO: 597974 - DNA, 25 bp, Mus musculus
ggagcctgagtgagctttactatca

SEQ ID NO: 597975 - DNA, 25 bp, Mus musculus
ggagcctgagtgtgctttactatca

SEQ ID NO: 597976 - DNA, 25 bp, Mus musculus
ggagcctgatatcacagttccctga

SEQ ID NO: 597977 - DNA, 25 bp, Mus musculus
ggagcctgatatgacagttccctga

SEQ ID NO: 597978 - DNA, 25 bp, Mus musculus
ggagcctgatgaacccatagccttc

SEQ ID NO: 597979 - DNA, 25 bp, Mus musculus
ggagcctgatgatcccatagccttc

SEQ ID NO: 597980 - DNA, 25 bp, Mus musculus
ggagcctgatgcagcctatgtagac

SEQ ID NO: 597981 - DNA, 25 bp, Mus musculus
ggagcctgatgctgcctatgtagac

SEQ ID NO: 597982 - DNA, 25 bp, Mus musculus
ggagcctgatggatattctccgttc

SEQ ID NO: 597983 - DNA, 25 bp, Mus musculus
ggagcctgatggttattctccgttc

SEQ ID NO: 597984 - DNA, 25 bp, Mus musculus
ggagcctgattaacttcttaaattt

SEQ ID NO: 597985 - DNA, 25 bp, Mus musculus
ggagcctgattatcttcttaaattt

SEQ ID NO: 597986 - DNA, 25 bp, Mus musculus
ggagcctgattgagtgttgcgcctt

SEQ ID NO: 597987 - DNA, 25 bp, Mus musculus
ggagcctgattgtgtgttgcgcctt

SEQ ID NO: 597988 - DNA, 25 bp, Mus musculus
ggagcctgcagaatacaactctcaa

SEQ ID NO: 597989 - DNA, 25 bp, Mus musculus
ggagcctgcagattacaactctcaa

SEQ ID NO: 597990 - DNA, 25 bp, Mus musculus
ggagcctgcggaagttcctgtacct

SEQ ID NO: 597991 - DNA, 25 bp, Mus musculus
ggagcctgcggatgttcctgtacct

SEQ ID NO: 597992 - DNA, 25 bp, Mus musculus
ggagcctgctcgatctagggtgcta

SEQ ID NO: 597993 - DNA, 25 bp, Mus musculus
ggagcctgctcgttctagggtgcta

SEQ ID NO: 597994 - DNA, 25 bp, Mus musculus
ggagcctggacactgcagactgcca

SEQ ID NO: 597995 - DNA, 25 bp, Mus musculus
ggagcctggacagtgcagactgcca

SEQ ID NO: 597996 - DNA, 25 bp, Mus musculus
ggagcctggcatcatcgtggctggg

SEQ ID NO: 597997 - DNA, 25 bp, Mus musculus
ggagcctggcatgatcgtggctggg

SEQ ID NO: 597998 - DNA, 25 bp, Mus musculus
ggagcctggccacctttactgtgcc

SEQ ID NO: 597999 - DNA, 25 bp, Mus musculus
ggagcctggccagctttactgtgcc

SEQ ID NO: 598000 - DNA, 25 bp, Mus musculus
ggagcctggcttaagcaacaataaa

SEQ ID NO: 598001 - DNA, 25 bp, Mus musculus
ggagcctggctttagcaacaataaa

SEQ ID NO: 598002 - DNA, 25 bp, Mus musculus
ggagcctgggctcctaaagtcatca

SEQ ID NO: 598003 - DNA, 25 bp, Mus musculus
ggagcctgggctgctaaagtcatca

SEQ ID NO: 598004 - DNA, 25 bp, Mus musculus
ggagcctgggtcaaggctgcaatta

SEQ ID NO: 598005 - DNA, 25 bp, Mus musculus
ggagcctgggtctaggctgcaatta

SEQ ID NO: 598006 - DNA, 25 bp, Mus musculus
ggagcctggtccagtatgtatgtac

SEQ ID NO: 598007 - DNA, 25 bp, Mus musculus
ggagcctggtcctgtatgtatgtac

SEQ ID NO: 598008 - DNA, 25 bp, Mus musculus
ggagcctggtgtccactcaatgatg

SEQ ID NO: 598009 - DNA, 25 bp, Mus musculus
ggagcctggtgtgcactcaatgatg

SEQ ID NO: 598010 - DNA, 25 bp, Mus musculus
ggagcctgtaccaaaccacgaagag

SEQ ID NO: 598011 - DNA, 25 bp, Mus musculus
ggagcctgtacctaaccacgaagag

SEQ ID NO: 598012 - DNA, 25 bp, Mus musculus
ggagcctgtagacgttctatcccca

SEQ ID NO: 598013 - DNA, 25 bp, Mus musculus
ggagcctgtagaggttctatcccca

SEQ ID NO: 598014 - DNA, 25 bp, Mus musculus
ggagcctgtagcatttcttgggtac

SEQ ID NO: 598015 - DNA, 25 bp, Mus musculus
ggagcctgtagcttttcttgggtac

SEQ ID NO: 598016 - DNA, 25 bp, Mus musculus
ggagcctgtccaccagcgttcagct

SEQ ID NO: 598017 - DNA, 25 bp, Mus musculus
ggagcctgtccaccattatatcatt

SEQ ID NO: 598018 - DNA, 25 bp, Mus musculus
ggagcctgtccagcagcgttcagct

SEQ ID NO: 598019 - DNA, 25 bp, Mus musculus
ggagcctgtccagcattatatcatt

SEQ ID NO: 598020 - DNA, 25 bp, Mus musculus
ggagcctgtccgcatcaccaagtct

SEQ ID NO: 598021 - DNA, 25 bp, Mus musculus
ggagcctgtccggatcaccaagtct

SEQ ID NO: 598022 - DNA, 25 bp, Mus musculus
ggagcctgtgatcattgtccgctgc

SEQ ID NO: 598023 - DNA, 25 bp, Mus musculus
ggagcctgtgatgattgtccgctgc

SEQ ID NO: 598024 - DNA, 25 bp, Mus musculus
ggagcctgtggcacattttggcctg

SEQ ID NO: 598025 - DNA, 25 bp, Mus musculus
ggagcctgtggctcattttggcctg

SEQ ID NO: 598026 - DNA, 25 bp, Mus musculus
ggagcctgtggtacagagatctcaa

SEQ ID NO: 598027 - DNA, 25 bp, Mus musculus
ggagcctgtggttcagagatctcaa

SEQ ID NO: 598028 - DNA, 25 bp, Mus musculus
ggagcctgtgtccagaattaaaaca

SEQ ID NO: 598029 - DNA, 25 bp, Mus musculus
ggagcctgtgtcgagaattaaaaca

SEQ ID NO: 598030 - DNA, 25 bp, Mus musculus
ggagccttaaatctatgtggttttt

SEQ ID NO: 598031 - DNA, 25 bp, Mus musculus
ggagccttaaatgtatgtggttttt

SEQ ID NO: 598032 - DNA, 25 bp, Mus musculus
ggagccttaagtactacacacgcag

SEQ ID NO: 598033 - DNA, 25 bp, Mus musculus
ggagccttaagttctacacacgcag

SEQ ID NO: 598034 - DNA, 25 bp, Mus musculus
ggagccttacatctctaaaccagaa

SEQ ID NO: 598035 - DNA, 25 bp, Mus musculus
ggagccttacatgtctaaaccagaa

SEQ ID NO: 598036 - DNA, 25 bp, Mus musculus
ggagccttagatcccctttgaaggg

SEQ ID NO: 598037 - DNA, 25 bp, Mus musculus
ggagccttagatgccctttgaaggg

SEQ ID NO: 598038 - DNA, 25 bp, Mus musculus
ggagccttaggaccttaggattcca

SEQ ID NO: 598039 - DNA, 25 bp, Mus musculus
ggagccttaggagcttaggattcca

SEQ ID NO: 598040 - DNA, 25 bp, Mus musculus
ggagccttaggcctcaaagggacaa

SEQ ID NO: 598041 - DNA, 25 bp, Mus musculus
ggagccttaggcgtcaaagggacaa

SEQ ID NO: 598042 - DNA, 25 bp, Mus musculus
ggagccttcaagaataccttgcctg

SEQ ID NO: 598043 - DNA, 25 bp, Mus musculus
ggagccttcaagtataccttgcctg

SEQ ID NO: 598044 - DNA, 25 bp, Mus musculus
ggagccttccacctagcagcaagga

SEQ ID NO: 598045 - DNA, 25 bp, Mus musculus
ggagccttccacgtagcagcaagga

SEQ ID NO: 598046 - DNA, 25 bp, Mus musculus
ggagccttcggaaagtgcttttatg

SEQ ID NO: 598047 - DNA, 25 bp, Mus musculus
ggagccttcggatagtgcttttatg

SEQ ID NO: 598048 - DNA, 25 bp, Mus musculus
ggagccttcgtgctgtgctccaaga

SEQ ID NO: 598049 - DNA, 25 bp, Mus musculus
ggagccttcgtggtgtgctccaaga

SEQ ID NO: 598050 - DNA, 25 bp, Mus musculus
ggagccttctggagtcagcatacca

SEQ ID NO: 598051 - DNA, 25 bp, Mus musculus
ggagccttctggtgtcagcatacca

SEQ ID NO: 598052 - DNA, 25 bp, Mus musculus
ggagccttcttgctgctggatgaaa

SEQ ID NO: 598053 - DNA, 25 bp, Mus musculus
ggagccttcttggtgctggatgaaa

SEQ ID NO: 598054 - DNA, 25 bp, Mus musculus
ggagccttgaataagcactgatgca

SEQ ID NO: 598055 - DNA, 25 bp, Mus musculus
ggagccttgaattagcactgatgca

SEQ ID NO: 598056 - DNA, 25 bp, Mus musculus
ggagccttgagtcggcaaaactgct

SEQ ID NO: 598057 - DNA, 25 bp, Mus musculus
ggagccttgagtgggcaaaactgct

SEQ ID NO: 598058 - DNA, 25 bp, Mus musculus
ggagccttgctcactgctagtacag

SEQ ID NO: 598059 - DNA, 25 bp, Mus musculus
ggagccttgctctctgctagtacag

SEQ ID NO: 598060 - DNA, 25 bp, Mus musculus
ggagccttgctgaaagaaccttctt

SEQ ID NO: 598061 - DNA, 25 bp, Mus musculus
ggagccttgctgtaagaaccttctt

SEQ ID NO: 598062 - DNA, 25 bp, Mus musculus
ggagccttggctatttgcaatcgaa

SEQ ID NO: 598063 - DNA, 25 bp, Mus musculus
ggagccttggctttttgcaatcgaa

SEQ ID NO: 598064 - DNA, 25 bp, Mus musculus
ggagccttggttctgtaactcggat

SEQ ID NO: 598065 - DNA, 25 bp, Mus musculus
ggagccttggttgtgtaactcggat

SEQ ID NO: 598066 - DNA, 25 bp, Mus musculus
ggagccttgtaactctgggctgtaa

SEQ ID NO: 598067 - DNA, 25 bp, Mus musculus
ggagccttgtaagtctgggctgtaa

SEQ ID NO: 598068 - DNA, 25 bp, Mus musculus
ggagcctttactaacaggccccact

SEQ ID NO: 598069 - DNA, 25 bp, Mus musculus
ggagcctttactaggtctgtggaca

SEQ ID NO: 598070 - DNA, 25 bp, Mus musculus
ggagcctttacttacaggccccact

SEQ ID NO: 598071 - DNA, 25 bp, Mus musculus
ggagcctttacttggtctgtggaca

SEQ ID NO: 598072 - DNA, 25 bp, Mus musculus
ggagcctttctactgagttagatca

SEQ ID NO: 598073 - DNA, 25 bp, Mus musculus
ggagcctttctagtgagttagatca

SEQ ID NO: 598074 - DNA, 25 bp, Mus musculus
ggagcctttcttcttctgttaggaa

SEQ ID NO: 598075 - DNA, 25 bp, Mus musculus
ggagcctttcttgttctgttaggaa

SEQ ID NO: 598076 - DNA, 25 bp, Mus musculus
ggagcctttgacaggagtgtgtata

SEQ ID NO: 598077 - DNA, 25 bp, Mus musculus
ggagcctttgactggagtgtgtata

SEQ ID NO: 598078 - DNA, 25 bp, Mus musculus
ggagcctttgcactgtagattctaa

SEQ ID NO: 598079 - DNA, 25 bp, Mus musculus
ggagcctttgcagtgtagattctaa

SEQ ID NO: 598080 - DNA, 25 bp, Mus musculus
ggagcctttgggaagactgtatctg

SEQ ID NO: 598081 - DNA, 25 bp, Mus musculus
ggagcctttgggtagactgtatctg

SEQ ID NO: 598082 - DNA, 25 bp, Mus musculus
ggagcctttgtcattagcataggac

SEQ ID NO: 598083 - DNA, 25 bp, Mus musculus
ggagcctttgtctttagcataggac

SEQ ID NO: 598084 - DNA, 25 bp, Mus musculus
ggagcctttgtgcatgctgtacaca

SEQ ID NO: 598085 - DNA, 25 bp, Mus musculus
ggagcctttgtggatgctgtacaca

SEQ ID NO: 598086 - DNA, 25 bp, Mus musculus
ggagcctttgttaatctagggccaa

SEQ ID NO: 598087 - DNA, 25 bp, Mus musculus
ggagcctttgtttatctagggccaa

SEQ ID NO: 598088 - DNA, 25 bp, Mus musculus
ggagccttttatctaatctctttcc

SEQ ID NO: 598089 - DNA, 25 bp, Mus musculus
ggagccttttatgtaatctctttcc

SEQ ID NO: 598090 - DNA, 25 bp, Mus musculus
ggagcgaacagtcgctattgttgaa

SEQ ID NO: 598091 - DNA, 25 bp, Mus musculus
ggagcgaacagtggctattgttgaa

SEQ ID NO: 598092 - DNA, 25 bp, Mus musculus
ggagcgaagcctccacactgtgaga

SEQ ID NO: 598093 - DNA, 25 bp, Mus musculus
ggagcgaagcctgcacactgtgaga

SEQ ID NO: 598094 - DNA, 25 bp, Mus musculus
ggagcgaatgttacacaacccgaac

SEQ ID NO: 598095 - DNA, 25 bp, Mus musculus
ggagcgaatgtttcacaacccgaac

SEQ ID NO: 598096 - DNA, 25 bp, Mus musculus
ggagcgacccaaagcgtctctgtgc

SEQ ID NO: 598097 - DNA, 25 bp, Mus musculus
ggagcgacccaatgcgtctctgtgc

SEQ ID NO: 598098 - DNA, 25 bp, Mus musculus
ggagcgaccggaatgacgccatgac

SEQ ID NO: 598099 - DNA, 25 bp, Mus musculus
ggagcgaccggattgacgccatgac

SEQ ID NO: 598100 - DNA, 25 bp, Mus musculus
ggagcgacctggagttactctacga

SEQ ID NO: 598101 - DNA, 25 bp, Mus musculus
ggagcgacctggtgttactctacga

SEQ ID NO: 598102 - DNA, 25 bp, Mus musculus
ggagcgacggtcagcacagttctat

SEQ ID NO: 598103 - DNA, 25 bp, Mus musculus
ggagcgacggtctgcacagttctat

SEQ ID NO: 598104 - DNA, 25 bp, Mus musculus
ggagcgactccacttcacacttgca

SEQ ID NO: 598105 - DNA, 25 bp, Mus musculus
ggagcgactccagttcacacttgca

SEQ ID NO: 598106 - DNA, 25 bp, Mus musculus
ggagcgagaatcagcacccaagagc

SEQ ID NO: 598107 - DNA, 25 bp, Mus musculus
ggagcgagaatctgcacccaagagc

SEQ ID NO: 598108 - DNA, 25 bp, Mus musculus
ggagcgagctgcacactagtgcctc

SEQ ID NO: 598109 - DNA, 25 bp, Mus musculus
ggagcgagctgctcactagtgcctc

SEQ ID NO: 598110 - DNA, 25 bp, Mus musculus
ggagcgatacaacacagggaagaac

SEQ ID NO: 598111 - DNA, 25 bp, Mus musculus
ggagcgatacaagacagggaagaac

SEQ ID NO: 598112 - DNA, 25 bp, Mus musculus
ggagcgatcattaggttcctctata

SEQ ID NO: 598113 - DNA, 25 bp, Mus musculus
ggagcgatcatttggttcctctata

SEQ ID NO: 598114 - DNA, 25 bp, Mus musculus
ggagcgatctttcggttcctggcca

SEQ ID NO: 598115 - DNA, 25 bp, Mus musculus
ggagcgatctttgggttcctggcca

SEQ ID NO: 598116 - DNA, 25 bp, Mus musculus
ggagcgcaacacatcagcttatttc

SEQ ID NO: 598117 - DNA, 25 bp, Mus musculus
ggagcgcaacaccatcctgggtgaa

SEQ ID NO: 598118 - DNA, 25 bp, Mus musculus
ggagcgcaacacgatcctgggtgaa

SEQ ID NO: 598119 - DNA, 25 bp, Mus musculus
ggagcgcaacacttcagcttatttc

SEQ ID NO: 598120 - DNA, 25 bp, Mus musculus
ggagcgcacatcaggccgaggtcac

SEQ ID NO: 598121 - DNA, 25 bp, Mus musculus
ggagcgcacatctggccgaggtcac

SEQ ID NO: 598122 - DNA, 25 bp, Mus musculus
ggagcgcagaacaaggacggcactt

SEQ ID NO: 598123 - DNA, 25 bp, Mus musculus
ggagcgcagaactaggacggcactt

SEQ ID NO: 598124 - DNA, 25 bp, Mus musculus
ggagcgcagatcctttcaaaaagct

SEQ ID NO: 598125 - DNA, 25 bp, Mus musculus
ggagcgcagatcgtttcaaaaagct

SEQ ID NO: 598126 - DNA, 25 bp, Mus musculus
ggagcgcatgcacacctatcaggat

SEQ ID NO: 598127 - DNA, 25 bp, Mus musculus
ggagcgcatgcagacctatcaggat

SEQ ID NO: 598128 - DNA, 25 bp, Mus musculus
ggagcgcatgctcgctattactgaa

SEQ ID NO: 598129 - DNA, 25 bp, Mus musculus
ggagcgcatgctggctattactgaa

SEQ ID NO: 598130 - DNA, 25 bp, Mus musculus
ggagcgcattttccagcagaatcac

SEQ ID NO: 598131 - DNA, 25 bp, Mus musculus
ggagcgcattttgcagcagaatcac

SEQ ID NO: 598132 - DNA, 25 bp, Mus musculus
ggagcgccatggagcacactcagga

SEQ ID NO: 598133 - DNA, 25 bp, Mus musculus
ggagcgccatggtgcacactcagga

SEQ ID NO: 598134 - DNA, 25 bp, Mus musculus
ggagcgccgctgaattccattggcc

SEQ ID NO: 598135 - DNA, 25 bp, Mus musculus
ggagcgccgctgtattccattggcc

SEQ ID NO: 598136 - DNA, 25 bp, Mus musculus
ggagcgccgttaaatataacaatgt

SEQ ID NO: 598137 - DNA, 25 bp, Mus musculus
ggagcgccgttatatataacaatgt

SEQ ID NO: 598138 - DNA, 25 bp, Mus musculus
ggagcgcctgcacatcatgtatacc

SEQ ID NO: 598139 - DNA, 25 bp, Mus musculus
ggagcgcctgcagatcatgtatacc

SEQ ID NO: 598140 - DNA, 25 bp, Mus musculus
ggagcgctacaacgccacgcagaaa

SEQ ID NO: 598141 - DNA, 25 bp, Mus musculus
ggagcgctacaaggccacgcagaaa

SEQ ID NO: 598142 - DNA, 25 bp, Mus musculus
ggagcgctgggcaggtaacgtgtat

SEQ ID NO: 598143 - DNA, 25 bp, Mus musculus
ggagcgctgggctggtaacgtgtat

SEQ ID NO: 598144 - DNA, 25 bp, Mus musculus
ggagcggaaattcgtctgtctcttc

SEQ ID NO: 598145 - DNA, 25 bp, Mus musculus
ggagcggaaattggtctgtctcttc

SEQ ID NO: 598146 - DNA, 25 bp, Mus musculus
ggagcggcagaaccatgagtatcag

SEQ ID NO: 598147 - DNA, 25 bp, Mus musculus
ggagcggcagaagcatgagtatcag

SEQ ID NO: 598148 - DNA, 25 bp, Mus musculus
ggagcggcagctccctttctgattt

SEQ ID NO: 598149 - DNA, 25 bp, Mus musculus
ggagcggcagctgcctttctgattt

SEQ ID NO: 598150 - DNA, 25 bp, Mus musculus
ggagcggccaacatggcggaacgca

SEQ ID NO: 598151 - DNA, 25 bp, Mus musculus
ggagcggccaacttggcggaacgca

SEQ ID NO: 598152 - DNA, 25 bp, Mus musculus
ggagcggccccacaggagcaaacat

SEQ ID NO: 598153 - DNA, 25 bp, Mus musculus
ggagcggccccagaggagcaaacat

SEQ ID NO: 598154 - DNA, 25 bp, Mus musculus
ggagcggccgctaatggtgttcaac

SEQ ID NO: 598155 - DNA, 25 bp, Mus musculus
ggagcggccgcttatggtgttcaac

SEQ ID NO: 598156 - DNA, 25 bp, Mus musculus
ggagcggctaaccaagttcaaggct

SEQ ID NO: 598157 - DNA, 25 bp, Mus musculus
ggagcggctaacgaagttcaaggct

SEQ ID NO: 598158 - DNA, 25 bp, Mus musculus
ggagcgggtgcacggcgcttctgtc

SEQ ID NO: 598159 - DNA, 25 bp, Mus musculus
ggagcgggtgcagggcgcttctgtc

SEQ ID NO: 598160 - DNA, 25 bp, Mus musculus
ggagcgggtgtgactttgtatttaa

SEQ ID NO: 598161 - DNA, 25 bp, Mus musculus
ggagcgggtgtgtctttgtatttaa

SEQ ID NO: 598162 - DNA, 25 bp, Mus musculus
ggagcggtcccgagactcagcaagt

SEQ ID NO: 598163 - DNA, 25 bp, Mus musculus
ggagcggtcccgtgactcagcaagt

SEQ ID NO: 598164 - DNA, 25 bp, Mus musculus
ggagcggtgcagcttcctaaactca

SEQ ID NO: 598165 - DNA, 25 bp, Mus musculus
ggagcggtgcaggttcctaaactca

SEQ ID NO: 598166 - DNA, 25 bp, Mus musculus
ggagcggttccaagacacgaacagc

SEQ ID NO: 598167 - DNA, 25 bp, Mus musculus
ggagcggttccatgacacgaacagc

SEQ ID NO: 598168 - DNA, 25 bp, Mus musculus
ggagcgtatcgaattctcaataaat

SEQ ID NO: 598169 - DNA, 25 bp, Mus musculus
ggagcgtatcgatttctcaataaat

SEQ ID NO: 598170 - DNA, 25 bp, Mus musculus
ggagcgtcaatgacagtgtctctgt

SEQ ID NO: 598171 - DNA, 25 bp, Mus musculus
ggagcgtcaatgtcagtgtctctgt

SEQ ID NO: 598172 - DNA, 25 bp, Mus musculus
ggagcgtctgatcatggcctaagtt

SEQ ID NO: 598173 - DNA, 25 bp, Mus musculus
ggagcgtctgatgatggcctaagtt

SEQ ID NO: 598174 - DNA, 25 bp, Mus musculus
ggagcgtcttagctgcatagttcta

SEQ ID NO: 598175 - DNA, 25 bp, Mus musculus
ggagcgtcttaggtgcatagttcta

SEQ ID NO: 598176 - DNA, 25 bp, Mus musculus
ggagcgtgctacctgaataagattg

SEQ ID NO: 598177 - DNA, 25 bp, Mus musculus
ggagcgtgctacgtgaataagattg

SEQ ID NO: 598178 - DNA, 25 bp, Mus musculus
ggagcgtgctcaaagacggcttcac

SEQ ID NO: 598179 - DNA, 25 bp, Mus musculus
ggagcgtgctcatagacggcttcac

SEQ ID NO: 598180 - DNA, 25 bp, Mus musculus
ggagcgtggcctccatctgagattc

SEQ ID NO: 598181 - DNA, 25 bp, Mus musculus
ggagcgtggcctgcatctgagattc

SEQ ID NO: 598182 - DNA, 25 bp, Mus musculus
ggagcgtggcttcgagcatttccta

SEQ ID NO: 598183 - DNA, 25 bp, Mus musculus
ggagcgtggcttggagcatttccta

SEQ ID NO: 598184 - DNA, 25 bp, Mus musculus
ggagcgttaaccacaccttactaat

SEQ ID NO: 598185 - DNA, 25 bp, Mus musculus
ggagcgttaaccactttgcttttct

SEQ ID NO: 598186 - DNA, 25 bp, Mus musculus
ggagcgttaacctcaccttactaat

SEQ ID NO: 598187 - DNA, 25 bp, Mus musculus
ggagcgttaacctctttgcttttct

SEQ ID NO: 598188 - DNA, 25 bp, Mus musculus
ggagctaaacgtatctatacacatc

SEQ ID NO: 598189 - DNA, 25 bp, Mus musculus
ggagctaaacgtttctatacacatc

SEQ ID NO: 598190 - DNA, 25 bp, Mus musculus
ggagctaaagctagcccataaactc

SEQ ID NO: 598191 - DNA, 25 bp, Mus musculus
ggagctaaagctcctgattcagtca

SEQ ID NO: 598192 - DNA, 25 bp, Mus musculus
ggagctaaagctgctgattcagtca

SEQ ID NO: 598193 - DNA, 25 bp, Mus musculus
ggagctaaagcttgcccataaactc

SEQ ID NO: 598194 - DNA, 25 bp, Mus musculus
ggagctaacagtacccagaattcct

SEQ ID NO: 598195 - DNA, 25 bp, Mus musculus
ggagctaacagttcccagaattcct

SEQ ID NO: 598196 - DNA, 25 bp, Mus musculus
ggagctaacgtgactcttcatgcag

SEQ ID NO: 598197 - DNA, 25 bp, Mus musculus
ggagctaacgtgtctcttcatgcag

SEQ ID NO: 598198 - DNA, 25 bp, Mus musculus
ggagctaactgaaaagccccagccg

SEQ ID NO: 598199 - DNA, 25 bp, Mus musculus
ggagctaactgacctgaatggagtc

SEQ ID NO: 598200 - DNA, 25 bp, Mus musculus
ggagctaactgagctgaatggagtc

SEQ ID NO: 598201 - DNA, 25 bp, Mus musculus
ggagctaactgataagccccagccg

SEQ ID NO: 598202 - DNA, 25 bp, Mus musculus
ggagctaagaaaccacagtatgaca

SEQ ID NO: 598203 - DNA, 25 bp, Mus musculus
ggagctaagaaagcacagtatgaca

SEQ ID NO: 598204 - DNA, 25 bp, Mus musculus
ggagctaagacaaattcattctgat

SEQ ID NO: 598205 - DNA, 25 bp, Mus musculus
ggagctaagacaaggtccctctgtg

SEQ ID NO: 598206 - DNA, 25 bp, Mus musculus
ggagctaagacatattcattctgat

SEQ ID NO: 598207 - DNA, 25 bp, Mus musculus
ggagctaagacatggtccctctgtg

SEQ ID NO: 598208 - DNA, 25 bp, Mus musculus
ggagctaagactacttatcaagaac

SEQ ID NO: 598209 - DNA, 25 bp, Mus musculus
ggagctaagacttcttatcaagaac

SEQ ID NO: 598210 - DNA, 25 bp, Mus musculus
ggagctaagaggatgcactagtcaa

SEQ ID NO: 598211 - DNA, 25 bp, Mus musculus
ggagctaagaggttgcactagtcaa

SEQ ID NO: 598212 - DNA, 25 bp, Mus musculus
ggagctaagcctcagaccctaaagt

SEQ ID NO: 598213 - DNA, 25 bp, Mus musculus
ggagctaagcctgagaccctaaagt

SEQ ID NO: 598214 - DNA, 25 bp, Mus musculus
ggagctaagcttaatcctgctgcag

SEQ ID NO: 598215 - DNA, 25 bp, Mus musculus
ggagctaagctttatcctgctgcag

SEQ ID NO: 598216 - DNA, 25 bp, Mus musculus
ggagctaaggatagacaccatgctt

SEQ ID NO: 598217 - DNA, 25 bp, Mus musculus
ggagctaaggattgacaccatgctt

SEQ ID NO: 598218 - DNA, 25 bp, Mus musculus
ggagctaatcctcatctcatgggat

SEQ ID NO: 598219 - DNA, 25 bp, Mus musculus
ggagctaatcctgatctcatgggat

SEQ ID NO: 598220 - DNA, 25 bp, Mus musculus
ggagctaattaacacagacccagag

SEQ ID NO: 598221 - DNA, 25 bp, Mus musculus
ggagctaattaagacagacccagag

SEQ ID NO: 598222 - DNA, 25 bp, Mus musculus
ggagctaattcacaatgcgacggta

SEQ ID NO: 598223 - DNA, 25 bp, Mus musculus
ggagctaattcagaatgcgacggta

SEQ ID NO: 598224 - DNA, 25 bp, Mus musculus
ggagctacaacgactgggtgcccat

SEQ ID NO: 598225 - DNA, 25 bp, Mus musculus
ggagctacaacgtctgggtgcccat

SEQ ID NO: 598226 - DNA, 25 bp, Mus musculus
ggagctacacatcattagtgcatat

SEQ ID NO: 598227 - DNA, 25 bp, Mus musculus
ggagctacacatgattagtgcatat

SEQ ID NO: 598228 - DNA, 25 bp, Mus musculus
ggagctacagttccttcctcatctg

SEQ ID NO: 598229 - DNA, 25 bp, Mus musculus
ggagctacagttgcttcctcatctg

SEQ ID NO: 598230 - DNA, 25 bp, Mus musculus
ggagctacatgaacaagtggcctgt

SEQ ID NO: 598231 - DNA, 25 bp, Mus musculus
ggagctacatgatcaagtggcctgt

SEQ ID NO: 598232 - DNA, 25 bp, Mus musculus
ggagctacccggacatcaggcgaga

SEQ ID NO: 598233 - DNA, 25 bp, Mus musculus
ggagctacccggtcatcaggcgaga

SEQ ID NO: 598234 - DNA, 25 bp, Mus musculus
ggagctactaccaatgatctgatta

SEQ ID NO: 598235 - DNA, 25 bp, Mus musculus
ggagctactacctatgatctgatta

SEQ ID NO: 598236 - DNA, 25 bp, Mus musculus
ggagctactcctcggagccgatgat

SEQ ID NO: 598237 - DNA, 25 bp, Mus musculus
ggagctactcctgggagccgatgat

SEQ ID NO: 598238 - DNA, 25 bp, Mus musculus
ggagctactctactaattgctttat

SEQ ID NO: 598239 - DNA, 25 bp, Mus musculus
ggagctactctagtaattgctttat

SEQ ID NO: 598240 - DNA, 25 bp, Mus musculus
ggagctactgagaacataaaccctt

SEQ ID NO: 598241 - DNA, 25 bp, Mus musculus
ggagctactgagtacataaaccctt

SEQ ID NO: 598242 - DNA, 25 bp, Mus musculus
ggagctactgctctaagcctaaatg

SEQ ID NO: 598243 - DNA, 25 bp, Mus musculus
ggagctactgctgtaagcctaaatg

SEQ ID NO: 598244 - DNA, 25 bp, Mus musculus
ggagctagaatcatagacctttcca

SEQ ID NO: 598245 - DNA, 25 bp, Mus musculus
ggagctagaatcttagacctttcca

SEQ ID NO: 598246 - DNA, 25 bp, Mus musculus
ggagctagagttagatgcctatcac

SEQ ID NO: 598247 - DNA, 25 bp, Mus musculus
ggagctagagtttgatgcctatcac

SEQ ID NO: 598248 - DNA, 25 bp, Mus musculus
ggagctagatttatctgtcccagaa

SEQ ID NO: 598249 - DNA, 25 bp, Mus musculus
ggagctagatttttctgtcccagaa

SEQ ID NO: 598250 - DNA, 25 bp, Mus musculus
ggagctagcaagatgtctgatcaaa

SEQ ID NO: 598251 - DNA, 25 bp, Mus musculus
ggagctagcaagttgtctgatcaaa

SEQ ID NO: 598252 - DNA, 25 bp, Mus musculus
ggagctagcctgctgttctgaccat

SEQ ID NO: 598253 - DNA, 25 bp, Mus musculus
ggagctagcctggtgttctgaccat

SEQ ID NO: 598254 - DNA, 25 bp, Mus musculus
ggagctagctgccttaatattctca

SEQ ID NO: 598255 - DNA, 25 bp, Mus musculus
ggagctagctgcgttaatattctca

SEQ ID NO: 598256 - DNA, 25 bp, Mus musculus
ggagctaggactcggactcctgcac

SEQ ID NO: 598257 - DNA, 25 bp, Mus musculus
ggagctaggactgggactcctgcac

SEQ ID NO: 598258 - DNA, 25 bp, Mus musculus
ggagctaggcacctcatcagaagtt

SEQ ID NO: 598259 - DNA, 25 bp, Mus musculus
ggagctaggcacgtcatcagaagtt

SEQ ID NO: 598260 - DNA, 25 bp, Mus musculus
ggagctagggcaagtggcactctat

SEQ ID NO: 598261 - DNA, 25 bp, Mus musculus
ggagctagggcatgtggcactctat

SEQ ID NO: 598262 - DNA, 25 bp, Mus musculus
ggagctagtatcacagcctgtggta

SEQ ID NO: 598263 - DNA, 25 bp, Mus musculus
ggagctagtatctcagcctgtggta

SEQ ID NO: 598264 - DNA, 25 bp, Mus musculus
ggagctagtcatctcagagtaaaca

SEQ ID NO: 598265 - DNA, 25 bp, Mus musculus
ggagctagtcatgtcagagtaaaca

SEQ ID NO: 598266 - DNA, 25 bp, Mus musculus
ggagctagtgtccaccatggccaca

SEQ ID NO: 598267 - DNA, 25 bp, Mus musculus
ggagctagtgtcgaccatggccaca

SEQ ID NO: 598268 - DNA, 25 bp, Mus musculus
ggagctataagccttgtgccccttg

SEQ ID NO: 598269 - DNA, 25 bp, Mus musculus
ggagctataagcgttgtgccccttg

SEQ ID NO: 598270 - DNA, 25 bp, Mus musculus
ggagctataatgacaccatcggagg

SEQ ID NO: 598271 - DNA, 25 bp, Mus musculus
ggagctataatgtcaccatcggagg

SEQ ID NO: 598272 - DNA, 25 bp, Mus musculus
ggagctatagatatgcccttcaaga

SEQ ID NO: 598273 - DNA, 25 bp, Mus musculus
ggagctatagatttgcccttcaaga

SEQ ID NO: 598274 - DNA, 25 bp, Mus musculus
ggagctatcaacaataatggccgtg

SEQ ID NO: 598275 - DNA, 25 bp, Mus musculus
ggagctatcaactataatggccgtg

SEQ ID NO: 598276 - DNA, 25 bp, Mus musculus
ggagctatcaagagtcccattttga

SEQ ID NO: 598277 - DNA, 25 bp, Mus musculus
ggagctatcaagtgtcccattttga

SEQ ID NO: 598278 - DNA, 25 bp, Mus musculus
ggagctatccagacgtggtagacta

SEQ ID NO: 598279 - DNA, 25 bp, Mus musculus
ggagctatccagtcgtggtagacta

SEQ ID NO: 598280 - DNA, 25 bp, Mus musculus
ggagctatcctaacagagactgggc

SEQ ID NO: 598281 - DNA, 25 bp, Mus musculus
ggagctatcctatcagagactgggc

SEQ ID NO: 598282 - DNA, 25 bp, Mus musculus
ggagctatctctacatttagtgaat

SEQ ID NO: 598283 - DNA, 25 bp, Mus musculus
ggagctatctcttcatttagtgaat

SEQ ID NO: 598284 - DNA, 25 bp, Mus musculus
ggagctatcttcattcacttataaa

SEQ ID NO: 598285 - DNA, 25 bp, Mus musculus
ggagctatcttctttcacttataaa

SEQ ID NO: 598286 - DNA, 25 bp, Mus musculus
ggagctatgaacaccttttcatcaa

SEQ ID NO: 598287 - DNA, 25 bp, Mus musculus
ggagctatgaactccttttcatcaa

SEQ ID NO: 598288 - DNA, 25 bp, Mus musculus
ggagctatgctgacaatcatattaa

SEQ ID NO: 598289 - DNA, 25 bp, Mus musculus
ggagctatgctgtcaatcatattaa

SEQ ID NO: 598290 - DNA, 25 bp, Mus musculus
ggagctatggagagattaaaattca

SEQ ID NO: 598291 - DNA, 25 bp, Mus musculus
ggagctatggagtgattaaaattca

SEQ ID NO: 598292 - DNA, 25 bp, Mus musculus
ggagctatgtcacggcctatctgaa

SEQ ID NO: 598293 - DNA, 25 bp, Mus musculus
ggagctatgtcagggcctatctgaa

SEQ ID NO: 598294 - DNA, 25 bp, Mus musculus
ggagctattattaactcctcttaat

SEQ ID NO: 598295 - DNA, 25 bp, Mus musculus
ggagctattatttactcctcttaat

SEQ ID NO: 598296 - DNA, 25 bp, Mus musculus
ggagctattcagcaattgcagagaa

SEQ ID NO: 598297 - DNA, 25 bp, Mus musculus
ggagctattcaggaattgcagagaa

SEQ ID NO: 598298 - DNA, 25 bp, Mus musculus
ggagctattcatatcctgggagttt

SEQ ID NO: 598299 - DNA, 25 bp, Mus musculus
ggagctattcatttcctgggagttt

SEQ ID NO: 598300 - DNA, 25 bp, Mus musculus
ggagctattccacaaaggatgacta

SEQ ID NO: 598301 - DNA, 25 bp, Mus musculus
ggagctattccagaaaggatgacta

SEQ ID NO: 598302 - DNA, 25 bp, Mus musculus
ggagctattctcctaactttgttct

SEQ ID NO: 598303 - DNA, 25 bp, Mus musculus
ggagctattctcgtaactttgttct

SEQ ID NO: 598304 - DNA, 25 bp, Mus musculus
ggagctattgatctttccactttcc

SEQ ID NO: 598305 - DNA, 25 bp, Mus musculus
ggagctattgatgtttccactttcc

SEQ ID NO: 598306 - DNA, 25 bp, Mus musculus
ggagctattggcatgttggcataac

SEQ ID NO: 598307 - DNA, 25 bp, Mus musculus
ggagctattggcttgttggcataac

SEQ ID NO: 598308 - DNA, 25 bp, Mus musculus
ggagctatttctaatcagttcatgt

SEQ ID NO: 598309 - DNA, 25 bp, Mus musculus
ggagctatttcttatcagttcatgt

SEQ ID NO: 598310 - DNA, 25 bp, Mus musculus
ggagctcaaaccacagatgcaggag

SEQ ID NO: 598311 - DNA, 25 bp, Mus musculus
ggagctcaaacctcagatgcaggag

SEQ ID NO: 598312 - DNA, 25 bp, Mus musculus
ggagctcaaactcactgactatcgt

SEQ ID NO: 598313 - DNA, 25 bp, Mus musculus
ggagctcaaactgactgactatcgt

SEQ ID NO: 598314 - DNA, 25 bp, Mus musculus
ggagctcaacaaaccattcattaag

SEQ ID NO: 598315 - DNA, 25 bp, Mus musculus
ggagctcaacaatccattcattaag

SEQ ID NO: 598316 - DNA, 25 bp, Mus musculus
ggagctcaacgtctgcactgcttgt

SEQ ID NO: 598317 - DNA, 25 bp, Mus musculus
ggagctcaacgtgtgcactgcttgt

SEQ ID NO: 598318 - DNA, 25 bp, Mus musculus
ggagctcaagggacacgccctcaga

SEQ ID NO: 598319 - DNA, 25 bp, Mus musculus
ggagctcaagggtcacgccctcaga

SEQ ID NO: 598320 - DNA, 25 bp, Mus musculus
ggagctcaatgacttggaccccgtc

SEQ ID NO: 598321 - DNA, 25 bp, Mus musculus
ggagctcaatgagttggaccccgtc

SEQ ID NO: 598322 - DNA, 25 bp, Mus musculus
ggagctcaatgtctagattctttca

SEQ ID NO: 598323 - DNA, 25 bp, Mus musculus
ggagctcaatgtgtagattctttca

SEQ ID NO: 598324 - DNA, 25 bp, Mus musculus
ggagctcaattcaatgcagttgtgc

SEQ ID NO: 598325 - DNA, 25 bp, Mus musculus
ggagctcaattctatgcagttgtgc

SEQ ID NO: 598326 - DNA, 25 bp, Mus musculus
ggagctcacaacatagcagaattct

SEQ ID NO: 598327 - DNA, 25 bp, Mus musculus
ggagctcacaacttagcagaattct

SEQ ID NO: 598328 - DNA, 25 bp, Mus musculus
ggagctcacagtattacaccacact

SEQ ID NO: 598329 - DNA, 25 bp, Mus musculus
ggagctcacagttttacaccacact

SEQ ID NO: 598330 - DNA, 25 bp, Mus musculus
ggagctcacgtcagtatccaggttg

SEQ ID NO: 598331 - DNA, 25 bp, Mus musculus
ggagctcacgtctgtatccaggttg

SEQ ID NO: 598332 - DNA, 25 bp, Mus musculus
ggagctcacgtgaagatgctgcctc

SEQ ID NO: 598333 - DNA, 25 bp, Mus musculus
ggagctcacgtgtagatgctgcctc

SEQ ID NO: 598334 - DNA, 25 bp, Mus musculus
ggagctcactggaggattcctttcc

SEQ ID NO: 598335 - DNA, 25 bp, Mus musculus
ggagctcactggtggattcctttcc

SEQ ID NO: 598336 - DNA, 25 bp, Mus musculus
ggagctcagaatatttcgtgtttgt

SEQ ID NO: 598337 - DNA, 25 bp, Mus musculus
ggagctcagaatttttcgtgtttgt

SEQ ID NO: 598338 - DNA, 25 bp, Mus musculus
ggagctcagctaagcaatgtaaggt

SEQ ID NO: 598339 - DNA, 25 bp, Mus musculus
ggagctcagctatgcaatgtaaggt

SEQ ID NO: 598340 - DNA, 25 bp, Mus musculus
ggagctcaggagaagcctacctctg

SEQ ID NO: 598341 - DNA, 25 bp, Mus musculus
ggagctcaggagactcagtcccagc

SEQ ID NO: 598342 - DNA, 25 bp, Mus musculus
ggagctcaggagattcctatcctag

SEQ ID NO: 598343 - DNA, 25 bp, Mus musculus
ggagctcaggagtagcctacctctg

SEQ ID NO: 598344 - DNA, 25 bp, Mus musculus
ggagctcaggagtctcagtcccagc

SEQ ID NO: 598345 - DNA, 25 bp, Mus musculus
ggagctcaggagtttcctatcctag

SEQ ID NO: 598346 - DNA, 25 bp, Mus musculus
ggagctcagggccttcatgctaaac

SEQ ID NO: 598347 - DNA, 25 bp, Mus musculus
ggagctcagggcgttcatgctaaac

SEQ ID NO: 598348 - DNA, 25 bp, Mus musculus
ggagctcagttaattttcatggtat

SEQ ID NO: 598349 - DNA, 25 bp, Mus musculus
ggagctcagttatttttcatggtat

SEQ ID NO: 598350 - DNA, 25 bp, Mus musculus
ggagctcatagtctatactaaggat

SEQ ID NO: 598351 - DNA, 25 bp, Mus musculus
ggagctcatagtgtatactaaggat

SEQ ID NO: 598352 - DNA, 25 bp, Mus musculus
ggagctcatctcacgtaacttaagt

SEQ ID NO: 598353 - DNA, 25 bp, Mus musculus
ggagctcatctctcgtaacttaagt

SEQ ID NO: 598354 - DNA, 25 bp, Mus musculus
ggagctcatgcaactgaaggctgaa

SEQ ID NO: 598355 - DNA, 25 bp, Mus musculus
ggagctcatgcatctgaaggctgaa

SEQ ID NO: 598356 - DNA, 25 bp, Mus musculus
ggagctcatgctacatatttaaacc

SEQ ID NO: 598357 - DNA, 25 bp, Mus musculus
ggagctcatgcttcatatttaaacc

SEQ ID NO: 598358 - DNA, 25 bp, Mus musculus
ggagctcatgtaccactacaagact

SEQ ID NO: 598359 - DNA, 25 bp, Mus musculus
ggagctcatgtagcactacaagact

SEQ ID NO: 598360 - DNA, 25 bp, Mus musculus
ggagctcattgaatagaagataaca

SEQ ID NO: 598361 - DNA, 25 bp, Mus musculus
ggagctcattgattagaagataaca

SEQ ID NO: 598362 - DNA, 25 bp, Mus musculus
ggagctcatttgctactcaaaccat

SEQ ID NO: 598363 - DNA, 25 bp, Mus musculus
ggagctcatttggtactcaaaccat

SEQ ID NO: 598364 - DNA, 25 bp, Mus musculus
ggagctccaagtcccagcaagtgag

SEQ ID NO: 598365 - DNA, 25 bp, Mus musculus
ggagctccaagtgccagcaagtgag

SEQ ID NO: 598366 - DNA, 25 bp, Mus musculus
ggagctccaataccctcaagcatag

SEQ ID NO: 598367 - DNA, 25 bp, Mus musculus
ggagctccaatagcctcaagcatag

SEQ ID NO: 598368 - DNA, 25 bp, Mus musculus
ggagctccacagaacttgctgatga

SEQ ID NO: 598369 - DNA, 25 bp, Mus musculus
ggagctccacagtacttgctgatga

SEQ ID NO: 598370 - DNA, 25 bp, Mus musculus
ggagctccaggaaaccatcaaagta

SEQ ID NO: 598371 - DNA, 25 bp, Mus musculus
ggagctccaggataccatcaaagta

SEQ ID NO: 598372 - DNA, 25 bp, Mus musculus
ggagctccatacaaagcacgtgtgt

SEQ ID NO: 598373 - DNA, 25 bp, Mus musculus
ggagctccatactaagcacgtgtgt

SEQ ID NO: 598374 - DNA, 25 bp, Mus musculus
ggagctccatctagcactgggcaga

SEQ ID NO: 598375 - DNA, 25 bp, Mus musculus
ggagctccatcttgcactgggcaga

SEQ ID NO: 598376 - DNA, 25 bp, Mus musculus
ggagctcccaacatagtgcttctag

SEQ ID NO: 598377 - DNA, 25 bp, Mus musculus
ggagctcccaacttagtgcttctag

SEQ ID NO: 598378 - DNA, 25 bp, Mus musculus
ggagctcccaccaaagtggatcatg

SEQ ID NO: 598379 - DNA, 25 bp, Mus musculus
ggagctcccacctaagtggatcatg

SEQ ID NO: 598380 - DNA, 25 bp, Mus musculus
ggagctcccggccaattggaacagt

SEQ ID NO: 598381 - DNA, 25 bp, Mus musculus
ggagctcccggcgaattggaacagt

SEQ ID NO: 598382 - DNA, 25 bp, Mus musculus
ggagctcccgtgatgaatttattag

SEQ ID NO: 598383 - DNA, 25 bp, Mus musculus
ggagctcccgtgttgaatttattag

SEQ ID NO: 598384 - DNA, 25 bp, Mus musculus
ggagctccctacactcggtgttggt

SEQ ID NO: 598385 - DNA, 25 bp, Mus musculus
ggagctccctactctcggtgttggt

SEQ ID NO: 598386 - DNA, 25 bp, Mus musculus
ggagctccgcagagaccaccaagta

SEQ ID NO: 598387 - DNA, 25 bp, Mus musculus
ggagctccgcagtgaccaccaagta

SEQ ID NO: 598388 - DNA, 25 bp, Mus musculus
ggagctccgggacaatcccttcaaa

SEQ ID NO: 598389 - DNA, 25 bp, Mus musculus
ggagctccgggagaatcccttcaaa

SEQ ID NO: 598390 - DNA, 25 bp, Mus musculus
ggagctcctacaaggtgcactggaa

SEQ ID NO: 598391 - DNA, 25 bp, Mus musculus
ggagctcctacatggtgcactggaa

SEQ ID NO: 598392 - DNA, 25 bp, Mus musculus
ggagctcctgatcaaataaagttag

SEQ ID NO: 598393 - DNA, 25 bp, Mus musculus
ggagctcctgatgaaataaagttag

SEQ ID NO: 598394 - DNA, 25 bp, Mus musculus
ggagctcctgctagtagccattcct

SEQ ID NO: 598395 - DNA, 25 bp, Mus musculus
ggagctcctgcttgtagccattcct

SEQ ID NO: 598396 - DNA, 25 bp, Mus musculus
ggagctccttccaagaaaagcaaga

SEQ ID NO: 598397 - DNA, 25 bp, Mus musculus
ggagctccttcctagaaaagcaaga

SEQ ID NO: 598398 - DNA, 25 bp, Mus musculus
ggagctcctttgaagtaacagtaag

SEQ ID NO: 598399 - DNA, 25 bp, Mus musculus
ggagctcctttgcatatatatgaga

SEQ ID NO: 598400 - DNA, 25 bp, Mus musculus
ggagctcctttgcatctccagggct

SEQ ID NO: 598401 - DNA, 25 bp, Mus musculus
ggagctcctttggatatatatgaga

SEQ ID NO: 598402 - DNA, 25 bp, Mus musculus
ggagctcctttggatctccagggct

SEQ ID NO: 598403 - DNA, 25 bp, Mus musculus
ggagctcctttgtagtaacagtaag

SEQ ID NO: 598404 - DNA, 25 bp, Mus musculus
ggagctcgactcagacgtggataaa

SEQ ID NO: 598405 - DNA, 25 bp, Mus musculus
ggagctcgactctgacgtggataaa

SEQ ID NO: 598406 - DNA, 25 bp, Mus musculus
ggagctcgagcaaccacagtggaga

SEQ ID NO: 598407 - DNA, 25 bp, Mus musculus
ggagctcgagcatccacagtggaga

SEQ ID NO: 598408 - DNA, 25 bp, Mus musculus
ggagctcgagccatcgccgccaagt

SEQ ID NO: 598409 - DNA, 25 bp, Mus musculus
ggagctcgagccttcgccgccaagt

SEQ ID NO: 598410 - DNA, 25 bp, Mus musculus
ggagctcgcactcacagctatggga

SEQ ID NO: 598411 - DNA, 25 bp, Mus musculus
ggagctcgcactgacagctatggga

SEQ ID NO: 598412 - DNA, 25 bp, Mus musculus
ggagctcgcttcaggttgccaatgt

SEQ ID NO: 598413 - DNA, 25 bp, Mus musculus
ggagctcgcttctggttgccaatgt

SEQ ID NO: 598414 - DNA, 25 bp, Mus musculus
ggagctcggcggcttttctcacgct

SEQ ID NO: 598415 - DNA, 25 bp, Mus musculus
ggagctcggcgggttttctcacgct

SEQ ID NO: 598416 - DNA, 25 bp, Mus musculus
ggagctctaagaccatttacacagg

SEQ ID NO: 598417 - DNA, 25 bp, Mus musculus
ggagctctaagagcatttacacagg

SEQ ID NO: 598418 - DNA, 25 bp, Mus musculus
ggagctctaagcatctagatcattc

SEQ ID NO: 598419 - DNA, 25 bp, Mus musculus
ggagctctaagcttctagatcattc

SEQ ID NO: 598420 - DNA, 25 bp, Mus musculus
ggagctctacaaaatctctcagcga

SEQ ID NO: 598421 - DNA, 25 bp, Mus musculus
ggagctctacaatatctctcagcga

SEQ ID NO: 598422 - DNA, 25 bp, Mus musculus
ggagctctagttatttggaccatat

SEQ ID NO: 598423 - DNA, 25 bp, Mus musculus
ggagctctagttttttggaccatat

SEQ ID NO: 598424 - DNA, 25 bp, Mus musculus
ggagctctataaacaagggcttcgt

SEQ ID NO: 598425 - DNA, 25 bp, Mus musculus
ggagctctataatcaagggcttcgt

SEQ ID NO: 598426 - DNA, 25 bp, Mus musculus
ggagctctcaaacgcgctctggcaa

SEQ ID NO: 598427 - DNA, 25 bp, Mus musculus
ggagctctcaaaggcgctctggcaa

SEQ ID NO: 598428 - DNA, 25 bp, Mus musculus
ggagctctcaagctatactcttaga

SEQ ID NO: 598429 - DNA, 25 bp, Mus musculus
ggagctctcaaggtatactcttaga

SEQ ID NO: 598430 - DNA, 25 bp, Mus musculus
ggagctctcaatcctatcctggatt

SEQ ID NO: 598431 - DNA, 25 bp, Mus musculus
ggagctctcaatgctatcctggatt

SEQ ID NO: 598432 - DNA, 25 bp, Mus musculus
ggagctctcacaaactgtcccggac

SEQ ID NO: 598433 - DNA, 25 bp, Mus musculus
ggagctctcacatactgtcccggac

SEQ ID NO: 598434 - DNA, 25 bp, Mus musculus
ggagctctcagacctgattgtcttc

SEQ ID NO: 598435 - DNA, 25 bp, Mus musculus
ggagctctcagagctgattgtcttc

SEQ ID NO: 598436 - DNA, 25 bp, Mus musculus
ggagctctccaaagaggtcatgtct

SEQ ID NO: 598437 - DNA, 25 bp, Mus musculus
ggagctctccaatgaggtcatgtct

SEQ ID NO: 598438 - DNA, 25 bp, Mus musculus
ggagctctccatagaacatcgactg

SEQ ID NO: 598439 - DNA, 25 bp, Mus musculus
ggagctctccattgaacatcgactg

SEQ ID NO: 598440 - DNA, 25 bp, Mus musculus
ggagctctcctcagttggaagcaat

SEQ ID NO: 598441 - DNA, 25 bp, Mus musculus
ggagctctcctctgttggaagcaat

SEQ ID NO: 598442 - DNA, 25 bp, Mus musculus
ggagctctcgccaagtaatttattt

SEQ ID NO: 598443 - DNA, 25 bp, Mus musculus
ggagctctcgcctagtaatttattt

SEQ ID NO: 598444 - DNA, 25 bp, Mus musculus
ggagctctcgggactttctgaagaa

SEQ ID NO: 598445 - DNA, 25 bp, Mus musculus
ggagctctcgggtctttctgaagaa

SEQ ID NO: 598446 - DNA, 25 bp, Mus musculus
ggagctctctaaccatcaagttgtg

SEQ ID NO: 598447 - DNA, 25 bp, Mus musculus
ggagctctctaagcatcaagttgtg

SEQ ID NO: 598448 - DNA, 25 bp, Mus musculus
ggagctctctatacaacttgcagtc

SEQ ID NO: 598449 - DNA, 25 bp, Mus musculus
ggagctctctattcaacttgcagtc

SEQ ID NO: 598450 - DNA, 25 bp, Mus musculus
ggagctctctgtcttcagggcagcc

SEQ ID NO: 598451 - DNA, 25 bp, Mus musculus
ggagctctctgtgttcagggcagcc

SEQ ID NO: 598452 - DNA, 25 bp, Mus musculus
ggagctctgaacctggcattatcta

SEQ ID NO: 598453 - DNA, 25 bp, Mus musculus
ggagctctgaacgtggcattatcta

SEQ ID NO: 598454 - DNA, 25 bp, Mus musculus
ggagctctgacactctctgtaggac

SEQ ID NO: 598455 - DNA, 25 bp, Mus musculus
ggagctctgacagtctctgtaggac

SEQ ID NO: 598456 - DNA, 25 bp, Mus musculus
ggagctctgagccttgtatgctata

SEQ ID NO: 598457 - DNA, 25 bp, Mus musculus
ggagctctgagcgttgtatgctata

SEQ ID NO: 598458 - DNA, 25 bp, Mus musculus
ggagctctgcagactgaccagctgg

SEQ ID NO: 598459 - DNA, 25 bp, Mus musculus
ggagctctgcagtctgaccagctgg

SEQ ID NO: 598460 - DNA, 25 bp, Mus musculus
ggagctctgcatatctgtttttcta

SEQ ID NO: 598461 - DNA, 25 bp, Mus musculus
ggagctctgcatttctgtttttcta

SEQ ID NO: 598462 - DNA, 25 bp, Mus musculus
ggagctctgcccatttctgctggtt

SEQ ID NO: 598463 - DNA, 25 bp, Mus musculus
ggagctctgcccttttctgctggtt

SEQ ID NO: 598464 - DNA, 25 bp, Mus musculus
ggagctctggacagaactgcatcaa

SEQ ID NO: 598465 - DNA, 25 bp, Mus musculus
ggagctctggactgaactgcatcaa

SEQ ID NO: 598466 - DNA, 25 bp, Mus musculus
ggagctctggcaacgggttcttgaa

SEQ ID NO: 598467 - DNA, 25 bp, Mus musculus
ggagctctggcatcgggttcttgaa

SEQ ID NO: 598468 - DNA, 25 bp, Mus musculus
ggagctctgggaaaacctgtggata

SEQ ID NO: 598469 - DNA, 25 bp, Mus musculus
ggagctctgggataacctgtggata

SEQ ID NO: 598470 - DNA, 25 bp, Mus musculus
ggagctctgtaaatattctctaaga

SEQ ID NO: 598471 - DNA, 25 bp, Mus musculus
ggagctctgtaattattctctaaga

SEQ ID NO: 598472 - DNA, 25 bp, Mus musculus
ggagctctgtagcttttctgtggct

SEQ ID NO: 598473 - DNA, 25 bp, Mus musculus
ggagctctgtaggttttctgtggct

SEQ ID NO: 598474 - DNA, 25 bp, Mus musculus
ggagctctgtcacccggaagttcag

SEQ ID NO: 598475 - DNA, 25 bp, Mus musculus
ggagctctgtcagccggaagttcag

SEQ ID NO: 598476 - DNA, 25 bp, Mus musculus
ggagctctgtgacgcttgttataga

SEQ ID NO: 598477 - DNA, 25 bp, Mus musculus
ggagctctgtgaggcttgttataga

SEQ ID NO: 598478 - DNA, 25 bp, Mus musculus
ggagctctgtgcagtctgtagactc

SEQ ID NO: 598479 - DNA, 25 bp, Mus musculus
ggagctctgtgctgtctgtagactc

SEQ ID NO: 598480 - DNA, 25 bp, Mus musculus
ggagctcttagactagaaggcatct

SEQ ID NO: 598481 - DNA, 25 bp, Mus musculus
ggagctcttagagtagaaggcatct

SEQ ID NO: 598482 - DNA, 25 bp, Mus musculus
ggagctcttaggaattacactggac

SEQ ID NO: 598483 - DNA, 25 bp, Mus musculus
ggagctcttaggtattacactggac

SEQ ID NO: 598484 - DNA, 25 bp, Mus musculus
ggagctcttccacaagatgcctttt

SEQ ID NO: 598485 - DNA, 25 bp, Mus musculus
ggagctcttccacttgtttagctat

SEQ ID NO: 598486 - DNA, 25 bp, Mus musculus
ggagctcttccagaagatgcctttt

SEQ ID NO: 598487 - DNA, 25 bp, Mus musculus
ggagctcttccagttgtttagctat

SEQ ID NO: 598488 - DNA, 25 bp, Mus musculus
ggagctcttccgcaatgacattgcc

SEQ ID NO: 598489 - DNA, 25 bp, Mus musculus
ggagctcttccggaatgacattgcc

SEQ ID NO: 598490 - DNA, 25 bp, Mus musculus
ggagctcttcgacttcgtcacagat

SEQ ID NO: 598491 - DNA, 25 bp, Mus musculus
ggagctcttcgagttcgtcacagat

SEQ ID NO: 598492 - DNA, 25 bp, Mus musculus
ggagctcttcttcactgcaatgcga

SEQ ID NO: 598493 - DNA, 25 bp, Mus musculus
ggagctcttcttgactgcaatgcga

SEQ ID NO: 598494 - DNA, 25 bp, Mus musculus
ggagctcttgaacacaacacagcct

SEQ ID NO: 598495 - DNA, 25 bp, Mus musculus
ggagctcttgaagacaacacagcct

SEQ ID NO: 598496 - DNA, 25 bp, Mus musculus
ggagctcttgacagttctccagaga

SEQ ID NO: 598497 - DNA, 25 bp, Mus musculus
ggagctcttgactgttctccagaga

SEQ ID NO: 598498 - DNA, 25 bp, Mus musculus
ggagctcttgccatcacctgtggat

SEQ ID NO: 598499 - DNA, 25 bp, Mus musculus
ggagctcttgccttcacctgtggat

SEQ ID NO: 598500 - DNA, 25 bp, Mus musculus
ggagctcttggtatccagggcaaag

SEQ ID NO: 598501 - DNA, 25 bp, Mus musculus
ggagctcttggtttccagggcaaag

SEQ ID NO: 598502 - DNA, 25 bp, Mus musculus
ggagctctttcacgctaaggaccac

SEQ ID NO: 598503 - DNA, 25 bp, Mus musculus
ggagctctttcaggctaaggaccac

SEQ ID NO: 598504 - DNA, 25 bp, Mus musculus
ggagctctttctccagagttcctat

SEQ ID NO: 598505 - DNA, 25 bp, Mus musculus
ggagctctttctgcagagttcctat

SEQ ID NO: 598506 - DNA, 25 bp, Mus musculus
ggagctgaaacccagcctctaatgg

SEQ ID NO: 598507 - DNA, 25 bp, Mus musculus
ggagctgaaaccgagcctctaatgg

SEQ ID NO: 598508 - DNA, 25 bp, Mus musculus
ggagctgaaatcattgtaatattaa

SEQ ID NO: 598509 - DNA, 25 bp, Mus musculus
ggagctgaaatctttgtaatattaa

SEQ ID NO: 598510 - DNA, 25 bp, Mus musculus
ggagctgaacgcctttatataaatc

SEQ ID NO: 598511 - DNA, 25 bp, Mus musculus
ggagctgaacgcgtttatataaatc

SEQ ID NO: 598512 - DNA, 25 bp, Mus musculus
ggagctgaacggacaagtcttcttg

SEQ ID NO: 598513 - DNA, 25 bp, Mus musculus
ggagctgaacggtcaagtcttcttg

SEQ ID NO: 598514 - DNA, 25 bp, Mus musculus
ggagctgaactcacttacactgaag

SEQ ID NO: 598515 - DNA, 25 bp, Mus musculus
ggagctgaactccatctgtttgcat

SEQ ID NO: 598516 - DNA, 25 bp, Mus musculus
ggagctgaactcgatctgtttgcat

SEQ ID NO: 598517 - DNA, 25 bp, Mus musculus
ggagctgaactctcttacactgaag

SEQ ID NO: 598518 - DNA, 25 bp, Mus musculus
ggagctgaactgacctgtggatatc

SEQ ID NO: 598519 - DNA, 25 bp, Mus musculus
ggagctgaactgtcctgtggatatc

SEQ ID NO: 598520 - DNA, 25 bp, Mus musculus
ggagctgaagaaacgattgtggatt

SEQ ID NO: 598521 - DNA, 25 bp, Mus musculus
ggagctgaagaacgcgcaccccaac

SEQ ID NO: 598522 - DNA, 25 bp, Mus musculus
ggagctgaagaaggcgcaccccaac

SEQ ID NO: 598523 - DNA, 25 bp, Mus musculus
ggagctgaagaatcgattgtggatt

SEQ ID NO: 598524 - DNA, 25 bp, Mus musculus
ggagctgaagttatacgtctactat

SEQ ID NO: 598525 - DNA, 25 bp, Mus musculus
ggagctgaagttttacgtctactat

SEQ ID NO: 598526 - DNA, 25 bp, Mus musculus
ggagctgaatccaagctttcatgta

SEQ ID NO: 598527 - DNA, 25 bp, Mus musculus
ggagctgaatcctagctttcatgta

SEQ ID NO: 598528 - DNA, 25 bp, Mus musculus
ggagctgaatctcaggcttcgagat

SEQ ID NO: 598529 - DNA, 25 bp, Mus musculus
ggagctgaatctgaggcttcgagat

SEQ ID NO: 598530 - DNA, 25 bp, Mus musculus
ggagctgaatgtcttcggacctaac

SEQ ID NO: 598531 - DNA, 25 bp, Mus musculus
ggagctgaatgtgttcggacctaac

SEQ ID NO: 598532 - DNA, 25 bp, Mus musculus
ggagctgacactcgtcatcactggt

SEQ ID NO: 598533 - DNA, 25 bp, Mus musculus
ggagctgacactggtcatcactggt

SEQ ID NO: 598534 - DNA, 25 bp, Mus musculus
ggagctgacatcagcacatgcgctg

SEQ ID NO: 598535 - DNA, 25 bp, Mus musculus
ggagctgacatctgcacatgcgctg

SEQ ID NO: 598536 - DNA, 25 bp, Mus musculus
ggagctgaccttagtttctagtcta

SEQ ID NO: 598537 - DNA, 25 bp, Mus musculus
ggagctgaccttcaaaaccatgatt

SEQ ID NO: 598538 - DNA, 25 bp, Mus musculus
ggagctgaccttgaaaaccatgatt

SEQ ID NO: 598539 - DNA, 25 bp, Mus musculus
ggagctgacctttgtttctagtcta

SEQ ID NO: 598540 - DNA, 25 bp, Mus musculus
ggagctgacttgaaatgccttctag

SEQ ID NO: 598541 - DNA, 25 bp, Mus musculus
ggagctgacttgtaatgccttctag

SEQ ID NO: 598542 - DNA, 25 bp, Mus musculus
ggagctgagaccagaataacaagta

SEQ ID NO: 598543 - DNA, 25 bp, Mus musculus
ggagctgagacctgaataacaagta

SEQ ID NO: 598544 - DNA, 25 bp, Mus musculus
ggagctgagagccatgccccttaaa

SEQ ID NO: 598545 - DNA, 25 bp, Mus musculus
ggagctgagagcgatgccccttaaa

SEQ ID NO: 598546 - DNA, 25 bp, Mus musculus
ggagctgagatgatcaaccattcac

SEQ ID NO: 598547 - DNA, 25 bp, Mus musculus
ggagctgagatgatccaccacaacc

SEQ ID NO: 598548 - DNA, 25 bp, Mus musculus
ggagctgagatgttcaaccattcac

SEQ ID NO: 598549 - DNA, 25 bp, Mus musculus
ggagctgagatgttccaccacaacc

SEQ ID NO: 598550 - DNA, 25 bp, Mus musculus
ggagctgagattatcaactgtgact

SEQ ID NO: 598551 - DNA, 25 bp, Mus musculus
ggagctgagattttcaactgtgact

SEQ ID NO: 598552 - DNA, 25 bp, Mus musculus
ggagctgagcccaatgagtttgtct

SEQ ID NO: 598553 - DNA, 25 bp, Mus musculus
ggagctgagccctatgagtttgtct

SEQ ID NO: 598554 - DNA, 25 bp, Mus musculus
ggagctgagcgaatgcctgtcatat

SEQ ID NO: 598555 - DNA, 25 bp, Mus musculus
ggagctgagcgattgcctgtcatat

SEQ ID NO: 598556 - DNA, 25 bp, Mus musculus
ggagctgagctgctgggtgaatggc

SEQ ID NO: 598557 - DNA, 25 bp, Mus musculus
ggagctgagctggtgggtgaatggc

SEQ ID NO: 598558 - DNA, 25 bp, Mus musculus
ggagctgagggtaccagaccaccag

SEQ ID NO: 598559 - DNA, 25 bp, Mus musculus
ggagctgagggttccagaccaccag

SEQ ID NO: 598560 - DNA, 25 bp, Mus musculus
ggagctgaggtcacaccatattcta

SEQ ID NO: 598561 - DNA, 25 bp, Mus musculus
ggagctgaggtctcaccatattcta

SEQ ID NO: 598562 - DNA, 25 bp, Mus musculus
ggagctgatacaagtatttggatca

SEQ ID NO: 598563 - DNA, 25 bp, Mus musculus
ggagctgatacatgtatttggatca

SEQ ID NO: 598564 - DNA, 25 bp, Mus musculus
ggagctgatcatactgttttccagt

SEQ ID NO: 598565 - DNA, 25 bp, Mus musculus
ggagctgatcattctgttttccagt

SEQ ID NO: 598566 - DNA, 25 bp, Mus musculus
ggagctgatcccctaagtgccggct

SEQ ID NO: 598567 - DNA, 25 bp, Mus musculus
ggagctgatcccgtaagtgccggct

SEQ ID NO: 598568 - DNA, 25 bp, Mus musculus
ggagctgatctgagacaatcctgtt

SEQ ID NO: 598569 - DNA, 25 bp, Mus musculus
ggagctgatctgtgacaatcctgtt

SEQ ID NO: 598570 - DNA, 25 bp, Mus musculus
ggagctgatgccattagcagttcta

SEQ ID NO: 598571 - DNA, 25 bp, Mus musculus
ggagctgatgccatttgtacaatgt

SEQ ID NO: 598572 - DNA, 25 bp, Mus musculus
ggagctgatgcctttagcagttcta

SEQ ID NO: 598573 - DNA, 25 bp, Mus musculus
ggagctgatgccttttgtacaatgt

SEQ ID NO: 598574 - DNA, 25 bp, Mus musculus
ggagctgatgctctgttatttgatt

SEQ ID NO: 598575 - DNA, 25 bp, Mus musculus
ggagctgatgctgtgttatttgatt

SEQ ID NO: 598576 - DNA, 25 bp, Mus musculus
ggagctgatggaacacccattcttc

SEQ ID NO: 598577 - DNA, 25 bp, Mus musculus
ggagctgatggatcacccattcttc

SEQ ID NO: 598578 - DNA, 25 bp, Mus musculus
ggagctgatgtcacagaacacttgt

SEQ ID NO: 598579 - DNA, 25 bp, Mus musculus
ggagctgatgtctcagaacacttgt

SEQ ID NO: 598580 - DNA, 25 bp, Mus musculus
ggagctgatgttactatcatcttaa

SEQ ID NO: 598581 - DNA, 25 bp, Mus musculus
ggagctgatgttccggtccactcac

SEQ ID NO: 598582 - DNA, 25 bp, Mus musculus
ggagctgatgttgcggtccactcac

SEQ ID NO: 598583 - DNA, 25 bp, Mus musculus
ggagctgatgtttctatcatcttaa

SEQ ID NO: 598584 - DNA, 25 bp, Mus musculus
ggagctgattgcatccagggagtct

SEQ ID NO: 598585 - DNA, 25 bp, Mus musculus
ggagctgattgcttccagggagtct

SEQ ID NO: 598586 - DNA, 25 bp, Mus musculus
ggagctgcaaacactcttggatgtt

SEQ ID NO: 598587 - DNA, 25 bp, Mus musculus
ggagctgcaaactctcttggatgtt

SEQ ID NO: 598588 - DNA, 25 bp, Mus musculus
ggagctgcactcattgcactatgga

SEQ ID NO: 598589 - DNA, 25 bp, Mus musculus
ggagctgcactctttgcactatgga

SEQ ID NO: 598590 - DNA, 25 bp, Mus musculus
ggagctgcactgacccaggaaagga

SEQ ID NO: 598591 - DNA, 25 bp, Mus musculus
ggagctgcactgtcccaggaaagga

SEQ ID NO: 598592 - DNA, 25 bp, Mus musculus
ggagctgcacttcaaatcattctga

SEQ ID NO: 598593 - DNA, 25 bp, Mus musculus
ggagctgcacttgaaatcattctga

SEQ ID NO: 598594 - DNA, 25 bp, Mus musculus
ggagctgcagacagtagtcagacat

SEQ ID NO: 598595 - DNA, 25 bp, Mus musculus
ggagctgcagactgtagtcagacat

SEQ ID NO: 598596 - DNA, 25 bp, Mus musculus
ggagctgcagatagaagtggtctta

SEQ ID NO: 598597 - DNA, 25 bp, Mus musculus
ggagctgcagattgaagtggtctta

SEQ ID NO: 598598 - DNA, 25 bp, Mus musculus
ggagctgcagcaacgcatccaggcc

SEQ ID NO: 598599 - DNA, 25 bp, Mus musculus
ggagctgcagcatcgcatccaggcc

SEQ ID NO: 598600 - DNA, 25 bp, Mus musculus
ggagctgcaggcatgggacctgcca

SEQ ID NO: 598601 - DNA, 25 bp, Mus musculus
ggagctgcaggcttgggacctgcca

SEQ ID NO: 598602 - DNA, 25 bp, Mus musculus
ggagctgcatatcctagtcgactat

SEQ ID NO: 598603 - DNA, 25 bp, Mus musculus
ggagctgcatatgctagtcgactat

SEQ ID NO: 598604 - DNA, 25 bp, Mus musculus
ggagctgcatcactagcaccgagca

SEQ ID NO: 598605 - DNA, 25 bp, Mus musculus
ggagctgcatcagtagcaccgagca

SEQ ID NO: 598606 - DNA, 25 bp, Mus musculus
ggagctgcatgaccttgctcagttc

SEQ ID NO: 598607 - DNA, 25 bp, Mus musculus
ggagctgcatgagcttgctcagttc

SEQ ID NO: 598608 - DNA, 25 bp, Mus musculus
ggagctgccaacacttccagaggga

SEQ ID NO: 598609 - DNA, 25 bp, Mus musculus
ggagctgccaactcttccagaggga

SEQ ID NO: 598610 - DNA, 25 bp, Mus musculus
ggagctgccaccaaacacgggaaga

SEQ ID NO: 598611 - DNA, 25 bp, Mus musculus
ggagctgccacctaacacgggaaga

SEQ ID NO: 598612 - DNA, 25 bp, Mus musculus
ggagctgccaggagtgattagcact

SEQ ID NO: 598613 - DNA, 25 bp, Mus musculus
ggagctgccaggtgtgattagcact

SEQ ID NO: 598614 - DNA, 25 bp, Mus musculus
ggagctgccatgatttaggtcaatc

SEQ ID NO: 598615 - DNA, 25 bp, Mus musculus
ggagctgccatgttttaggtcaatc

SEQ ID NO: 598616 - DNA, 25 bp, Mus musculus
ggagctgccggaaaaaggtaccctt

SEQ ID NO: 598617 - DNA, 25 bp, Mus musculus
ggagctgccggataaaggtaccctt

SEQ ID NO: 598618 - DNA, 25 bp, Mus musculus
ggagctgcctaacaatattacctga

SEQ ID NO: 598619 - DNA, 25 bp, Mus musculus
ggagctgcctaagaatattacctga

SEQ ID NO: 598620 - DNA, 25 bp, Mus musculus
ggagctgcctccaagaatgaatctc

SEQ ID NO: 598621 - DNA, 25 bp, Mus musculus
ggagctgcctcctagaatgaatctc

SEQ ID NO: 598622 - DNA, 25 bp, Mus musculus
ggagctgccttcaatctgtagttta

SEQ ID NO: 598623 - DNA, 25 bp, Mus musculus
ggagctgccttctatctgtagttta

SEQ ID NO: 598624 - DNA, 25 bp, Mus musculus
ggagctgcctttcaagaacgtcgta

SEQ ID NO: 598625 - DNA, 25 bp, Mus musculus
ggagctgcctttgaagaacgtcgta

SEQ ID NO: 598626 - DNA, 25 bp, Mus musculus
ggagctgctagccttagaggttttc

SEQ ID NO: 598627 - DNA, 25 bp, Mus musculus
ggagctgctagcgttagaggttttc

SEQ ID NO: 598628 - DNA, 25 bp, Mus musculus
ggagctgctataatcacagggatct

SEQ ID NO: 598629 - DNA, 25 bp, Mus musculus
ggagctgctatattcacagggatct

SEQ ID NO: 598630 - DNA, 25 bp, Mus musculus
ggagctgctcagacagaagaccagg

SEQ ID NO: 598631 - DNA, 25 bp, Mus musculus
ggagctgctcagtcagaagaccagg

SEQ ID NO: 598632 - DNA, 25 bp, Mus musculus
ggagctgctccacctgagcatcgag

SEQ ID NO: 598633 - DNA, 25 bp, Mus musculus
ggagctgctccagctgagcatcgag

SEQ ID NO: 598634 - DNA, 25 bp, Mus musculus
ggagctgctcccctgaaagaagatg

SEQ ID NO: 598635 - DNA, 25 bp, Mus musculus
ggagctgctcccgtgaaagaagatg

SEQ ID NO: 598636 - DNA, 25 bp, Mus musculus
ggagctgctgaactgtagtcacgtt

SEQ ID NO: 598637 - DNA, 25 bp, Mus musculus
ggagctgctgaagtgtagtcacgtt

SEQ ID NO: 598638 - DNA, 25 bp, Mus musculus
ggagctgctgacattatcctgtgtt

SEQ ID NO: 598639 - DNA, 25 bp, Mus musculus
ggagctgctgactttatcctgtgtt

SEQ ID NO: 598640 - DNA, 25 bp, Mus musculus
ggagctgctgtaacgaagtgccaaa

SEQ ID NO: 598641 - DNA, 25 bp, Mus musculus
ggagctgctgtatcgaagtgccaaa

SEQ ID NO: 598642 - DNA, 25 bp, Mus musculus
ggagctgctgtgattaggccactta

SEQ ID NO: 598643 - DNA, 25 bp, Mus musculus
ggagctgctgtgtttaggccactta

SEQ ID NO: 598644 - DNA, 25 bp, Mus musculus
ggagctgcttaaccgagtgttactt

SEQ ID NO: 598645 - DNA, 25 bp, Mus musculus
ggagctgcttaagcgagtgttactt

SEQ ID NO: 598646 - DNA, 25 bp, Mus musculus
ggagctgcttctcccctggatggat

SEQ ID NO: 598647 - DNA, 25 bp, Mus musculus
ggagctgcttctgccctggatggat

SEQ ID NO: 598648 - DNA, 25 bp, Mus musculus
ggagctgctttcaaatttatctgta

SEQ ID NO: 598649 - DNA, 25 bp, Mus musculus
ggagctgctttctaatttatctgta

SEQ ID NO: 598650 - DNA, 25 bp, Mus musculus
ggagctggaagtcacagcactccca

SEQ ID NO: 598651 - DNA, 25 bp, Mus musculus
ggagctggaagtgacagcactccca

SEQ ID NO: 598652 - DNA, 25 bp, Mus musculus
ggagctggacagacatcttctcggc

SEQ ID NO: 598653 - DNA, 25 bp, Mus musculus
ggagctggacagtcatcttctcggc

SEQ ID NO: 598654 - DNA, 25 bp, Mus musculus
ggagctggagccctagtccatcgta

SEQ ID NO: 598655 - DNA, 25 bp, Mus musculus
ggagctggagccgtagtccatcgta

SEQ ID NO: 598656 - DNA, 25 bp, Mus musculus
ggagctggagcgacactatagccgc

SEQ ID NO: 598657 - DNA, 25 bp, Mus musculus
ggagctggagcgtcactatagccgc

SEQ ID NO: 598658 - DNA, 25 bp, Mus musculus
ggagctggagctcctcaacgcttac

SEQ ID NO: 598659 - DNA, 25 bp, Mus musculus
ggagctggagctgctcaacgcttac

SEQ ID NO: 598660 - DNA, 25 bp, Mus musculus
ggagctggatccatgtgaggacaaa

SEQ ID NO: 598661 - DNA, 25 bp, Mus musculus
ggagctggatccttgtgaggacaaa

SEQ ID NO: 598662 - DNA, 25 bp, Mus musculus
ggagctggccaaccaaaggatcgat

SEQ ID NO: 598663 - DNA, 25 bp, Mus musculus
ggagctggccaaccacgcggtgtcg

SEQ ID NO: 598664 - DNA, 25 bp, Mus musculus
ggagctggccaaccatgccgtgtcc

SEQ ID NO: 598665 - DNA, 25 bp, Mus musculus
ggagctggccaagcaaaggatcgat

SEQ ID NO: 598666 - DNA, 25 bp, Mus musculus
ggagctggccaagcacgcggtgtcg

SEQ ID NO: 598667 - DNA, 25 bp, Mus musculus
ggagctggccaagcatgccgtgtcc

SEQ ID NO: 598668 - DNA, 25 bp, Mus musculus
ggagctggccgtccctaaaacaagg

SEQ ID NO: 598669 - DNA, 25 bp, Mus musculus
ggagctggccgtgcctaaaacaagg

SEQ ID NO: 598670 - DNA, 25 bp, Mus musculus
ggagctggcgcactgattcataccc

SEQ ID NO: 598671 - DNA, 25 bp, Mus musculus
ggagctggcgcagtgattcataccc

SEQ ID NO: 598672 - DNA, 25 bp, Mus musculus
ggagctggcggtcaatatcatcttc

SEQ ID NO: 598673 - DNA, 25 bp, Mus musculus
ggagctggcggtgaatatcatcttc

SEQ ID NO: 598674 - DNA, 25 bp, Mus musculus
ggagctggctacagttggactcatt

SEQ ID NO: 598675 - DNA, 25 bp, Mus musculus
ggagctggctactgttggactcatt

SEQ ID NO: 598676 - DNA, 25 bp, Mus musculus
ggagctggctcaaagcatactgtca

SEQ ID NO: 598677 - DNA, 25 bp, Mus musculus
ggagctggctcacagattagcaaga

SEQ ID NO: 598678 - DNA, 25 bp, Mus musculus
ggagctggctcagagattagcaaga

SEQ ID NO: 598679 - DNA, 25 bp, Mus musculus
ggagctggctcatagcatactgtca

SEQ ID NO: 598680 - DNA, 25 bp, Mus musculus
ggagctgggaacagtactttagatt

SEQ ID NO: 598681 - DNA, 25 bp, Mus musculus
ggagctgggaactgtactttagatt

SEQ ID NO: 598682 - DNA, 25 bp, Mus musculus
ggagctgggactcttttgcctatgc

SEQ ID NO: 598683 - DNA, 25 bp, Mus musculus
ggagctgggactgttttgcctatgc

SEQ ID NO: 598684 - DNA, 25 bp, Mus musculus
ggagctgggagccaaccctgccttt

SEQ ID NO: 598685 - DNA, 25 bp, Mus musculus
ggagctgggagcgaaccctgccttt

SEQ ID NO: 598686 - DNA, 25 bp, Mus musculus
ggagctgggcacacaacatgcactt

SEQ ID NO: 598687 - DNA, 25 bp, Mus musculus
ggagctgggcactcaacatgcactt

SEQ ID NO: 598688 - DNA, 25 bp, Mus musculus
ggagctgggcagaacacacgaagat

SEQ ID NO: 598689 - DNA, 25 bp, Mus musculus
ggagctgggcagtacacacgaagat

SEQ ID NO: 598690 - DNA, 25 bp, Mus musculus
ggagctgggtggaggcccgggagca

SEQ ID NO: 598691 - DNA, 25 bp, Mus musculus
ggagctgggtggtggcccgggagca

SEQ ID NO: 598692 - DNA, 25 bp, Mus musculus
ggagctggtgctacattatcaacac

SEQ ID NO: 598693 - DNA, 25 bp, Mus musculus
ggagctggtgcttcattatcaacac

SEQ ID NO: 598694 - DNA, 25 bp, Mus musculus
ggagctggttaaaatcacttgttga

SEQ ID NO: 598695 - DNA, 25 bp, Mus musculus
ggagctggttaatatcacttgttga

SEQ ID NO: 598696 - DNA, 25 bp, Mus musculus
ggagctggttctcttgcactaaaga

SEQ ID NO: 598697 - DNA, 25 bp, Mus musculus
ggagctggttctgttgcactaaaga

SEQ ID NO: 598698 - DNA, 25 bp, Mus musculus
ggagctgtaaagagtcctttccctc

SEQ ID NO: 598699 - DNA, 25 bp, Mus musculus
ggagctgtaaagtgtcctttccctc

SEQ ID NO: 598700 - DNA, 25 bp, Mus musculus
ggagctgtacaaactgctgggcatt

SEQ ID NO: 598701 - DNA, 25 bp, Mus musculus
ggagctgtacaatctgctgggcatt

SEQ ID NO: 598702 - DNA, 25 bp, Mus musculus
ggagctgtatctcgcgctttttcta

SEQ ID NO: 598703 - DNA, 25 bp, Mus musculus
ggagctgtatctggcgctttttcta

SEQ ID NO: 598704 - DNA, 25 bp, Mus musculus
ggagctgtattcatcatgaccatta

SEQ ID NO: 598705 - DNA, 25 bp, Mus musculus
ggagctgtattcttcatgaccatta

SEQ ID NO: 598706 - DNA, 25 bp, Mus musculus
ggagctgtcaaacccgagagaccag

SEQ ID NO: 598707 - DNA, 25 bp, Mus musculus
ggagctgtcaaacctgagtgtctca

SEQ ID NO: 598708 - DNA, 25 bp, Mus musculus
ggagctgtcaaagccgagagaccag

SEQ ID NO: 598709 - DNA, 25 bp, Mus musculus
ggagctgtcaaagctgagtgtctca

SEQ ID NO: 598710 - DNA, 25 bp, Mus musculus
ggagctgtcacaaaagatggaccat

SEQ ID NO: 598711 - DNA, 25 bp, Mus musculus
ggagctgtcacaataggccagccag

SEQ ID NO: 598712 - DNA, 25 bp, Mus musculus
ggagctgtcacaatgttactgcaga

SEQ ID NO: 598713 - DNA, 25 bp, Mus musculus
ggagctgtcacacgatttattactg

SEQ ID NO: 598714 - DNA, 25 bp, Mus musculus
ggagctgtcacaggatttattactg

SEQ ID NO: 598715 - DNA, 25 bp, Mus musculus
ggagctgtcacataagatggaccat

SEQ ID NO: 598716 - DNA, 25 bp, Mus musculus
ggagctgtcacattaggccagccag

SEQ ID NO: 598717 - DNA, 25 bp, Mus musculus
ggagctgtcacattgttactgcaga

SEQ ID NO: 598718 - DNA, 25 bp, Mus musculus
ggagctgtcagaatggatccaccag

SEQ ID NO: 598719 - DNA, 25 bp, Mus musculus
ggagctgtcagattggatccaccag

SEQ ID NO: 598720 - DNA, 25 bp, Mus musculus
ggagctgtcagcatgtcatcggctt

SEQ ID NO: 598721 - DNA, 25 bp, Mus musculus
ggagctgtcagccaatgatcaaaac

SEQ ID NO: 598722 - DNA, 25 bp, Mus musculus
ggagctgtcagcgaatgatcaaaac

SEQ ID NO: 598723 - DNA, 25 bp, Mus musculus
ggagctgtcagcttgtcatcggctt

SEQ ID NO: 598724 - DNA, 25 bp, Mus musculus
ggagctgtccagagctgaacccgag

SEQ ID NO: 598725 - DNA, 25 bp, Mus musculus
ggagctgtccagattgttgtaaatc

SEQ ID NO: 598726 - DNA, 25 bp, Mus musculus
ggagctgtccagtgctgaacccgag

SEQ ID NO: 598727 - DNA, 25 bp, Mus musculus
ggagctgtccagtttgttgtaaatc

SEQ ID NO: 598728 - DNA, 25 bp, Mus musculus
ggagctgtccccataggatgcatag

SEQ ID NO: 598729 - DNA, 25 bp, Mus musculus
ggagctgtccccttaggatgcatag

SEQ ID NO: 598730 - DNA, 25 bp, Mus musculus
ggagctgtcccgcaggcctacctga

SEQ ID NO: 598731 - DNA, 25 bp, Mus musculus
ggagctgtcccggaggcctacctga

SEQ ID NO: 598732 - DNA, 25 bp, Mus musculus
ggagctgtcctgagacaagttccct

SEQ ID NO: 598733 - DNA, 25 bp, Mus musculus
ggagctgtcctgtgacaagttccct

SEQ ID NO: 598734 - DNA, 25 bp, Mus musculus
ggagctgtcgcccttcagtactatc

SEQ ID NO: 598735 - DNA, 25 bp, Mus musculus
ggagctgtcgccgttcagtactatc

SEQ ID NO: 598736 - DNA, 25 bp, Mus musculus
ggagctgtctgcattggcctctcag

SEQ ID NO: 598737 - DNA, 25 bp, Mus musculus
ggagctgtctgctttggcctctcag

SEQ ID NO: 598738 - DNA, 25 bp, Mus musculus
ggagctgtcttgaaaatggtatata

SEQ ID NO: 598739 - DNA, 25 bp, Mus musculus
ggagctgtcttgtaaatggtatata

SEQ ID NO: 598740 - DNA, 25 bp, Mus musculus
ggagctgtgatcactgtgaggtaca

SEQ ID NO: 598741 - DNA, 25 bp, Mus musculus
ggagctgtgatctctgtgaggtaca

SEQ ID NO: 598742 - DNA, 25 bp, Mus musculus
ggagctgtgatgactaaaaaccctt

SEQ ID NO: 598743 - DNA, 25 bp, Mus musculus
ggagctgtgatgtctaaaaaccctt

SEQ ID NO: 598744 - DNA, 25 bp, Mus musculus
ggagctgtgcaactgttagcattta

SEQ ID NO: 598745 - DNA, 25 bp, Mus musculus
ggagctgtgcaagtgttagcattta

SEQ ID NO: 598746 - DNA, 25 bp, Mus musculus
ggagctgtgcacaaacttgaagatt

SEQ ID NO: 598747 - DNA, 25 bp, Mus musculus
ggagctgtgcactaacttgaagatt

SEQ ID NO: 598748 - DNA, 25 bp, Mus musculus
ggagctgtgctaatttcactatcaa

SEQ ID NO: 598749 - DNA, 25 bp, Mus musculus
ggagctgtgctattttcactatcaa

SEQ ID NO: 598750 - DNA, 25 bp, Mus musculus
ggagctgtgtcaccaattaccagcg

SEQ ID NO: 598751 - DNA, 25 bp, Mus musculus
ggagctgtgtcagcaattaccagcg

SEQ ID NO: 598752 - DNA, 25 bp, Mus musculus
ggagctgtgttcaagggactgaatt

SEQ ID NO: 598753 - DNA, 25 bp, Mus musculus
ggagctgtgttctagggactgaatt

SEQ ID NO: 598754 - DNA, 25 bp, Mus musculus
ggagctgttagtctgatagtcaaaa

SEQ ID NO: 598755 - DNA, 25 bp, Mus musculus
ggagctgttagtgtgatagtcaaaa

SEQ ID NO: 598756 - DNA, 25 bp, Mus musculus
ggagctgttcccacagacagaggaa

SEQ ID NO: 598757 - DNA, 25 bp, Mus musculus
ggagctgttccctcagacagaggaa

SEQ ID NO: 598758 - DNA, 25 bp, Mus musculus
ggagctgttcgacattttctcccta

SEQ ID NO: 598759 - DNA, 25 bp, Mus musculus
ggagctgttcgagattttctcccta

SEQ ID NO: 598760 - DNA, 25 bp, Mus musculus
ggagctgttcggaactaaatcattt

SEQ ID NO: 598761 - DNA, 25 bp, Mus musculus
ggagctgttcggtactaaatcattt

SEQ ID NO: 598762 - DNA, 25 bp, Mus musculus
ggagctgttctacttaggatcttaa

SEQ ID NO: 598763 - DNA, 25 bp, Mus musculus
ggagctgttctagttaggatcttaa

SEQ ID NO: 598764 - DNA, 25 bp, Mus musculus
ggagctgttgaaacaactggacgat

SEQ ID NO: 598765 - DNA, 25 bp, Mus musculus
ggagctgttgaaacgacactcggag

SEQ ID NO: 598766 - DNA, 25 bp, Mus musculus
ggagctgttgaatcaactggacgat

SEQ ID NO: 598767 - DNA, 25 bp, Mus musculus
ggagctgttgaatcgacactcggag

SEQ ID NO: 598768 - DNA, 25 bp, Mus musculus
ggagctgttgacatcttcagtgaca

SEQ ID NO: 598769 - DNA, 25 bp, Mus musculus
ggagctgttgacttcttcagtgaca

SEQ ID NO: 598770 - DNA, 25 bp, Mus musculus
ggagctgttgcaccaattagtcctc

SEQ ID NO: 598771 - DNA, 25 bp, Mus musculus
ggagctgttgcagcaattagtcctc

SEQ ID NO: 598772 - DNA, 25 bp, Mus musculus
ggagctgtttacaaaccctttgtat

SEQ ID NO: 598773 - DNA, 25 bp, Mus musculus
ggagctgtttactaaccctttgtat

SEQ ID NO: 598774 - DNA, 25 bp, Mus musculus
ggagctgtttatactttccatgcct

SEQ ID NO: 598775 - DNA, 25 bp, Mus musculus
ggagctgtttatcgcaatttaatac

SEQ ID NO: 598776 - DNA, 25 bp, Mus musculus
ggagctgtttatggcaatttaatac

SEQ ID NO: 598777 - DNA, 25 bp, Mus musculus
ggagctgtttattctttccatgcct

SEQ ID NO: 598778 - DNA, 25 bp, Mus musculus
ggagctgtttcactcaatccagaga

SEQ ID NO: 598779 - DNA, 25 bp, Mus musculus
ggagctgtttcagtcaatccagaga

SEQ ID NO: 598780 - DNA, 25 bp, Mus musculus
ggagctgtttttctgtctacttttc

SEQ ID NO: 598781 - DNA, 25 bp, Mus musculus
ggagctgtttttgtgtctacttttc

SEQ ID NO: 598782 - DNA, 25 bp, Mus musculus
ggagcttaaaccccttgtatatttg

SEQ ID NO: 598783 - DNA, 25 bp, Mus musculus
ggagcttaaaccgcttgtatatttg

SEQ ID NO: 598784 - DNA, 25 bp, Mus musculus
ggagcttaaagcatagcccataaat

SEQ ID NO: 598785 - DNA, 25 bp, Mus musculus
ggagcttaaagcttagcccataaat

SEQ ID NO: 598786 - DNA, 25 bp, Mus musculus
ggagcttaaattagagaagaggaca

SEQ ID NO: 598787 - DNA, 25 bp, Mus musculus
ggagcttaaatttgagaagaggaca

SEQ ID NO: 598788 - DNA, 25 bp, Mus musculus
ggagcttaaggaatctcagtccctc

SEQ ID NO: 598789 - DNA, 25 bp, Mus musculus
ggagcttaaggattctcagtccctc

SEQ ID NO: 598790 - DNA, 25 bp, Mus musculus
ggagcttaatgcattgttaggatca

SEQ ID NO: 598791 - DNA, 25 bp, Mus musculus
ggagcttaatgctttgttaggatca

SEQ ID NO: 598792 - DNA, 25 bp, Mus musculus
ggagcttacactcatcttttccaag

SEQ ID NO: 598793 - DNA, 25 bp, Mus musculus
ggagcttacactgatcttttccaag

SEQ ID NO: 598794 - DNA, 25 bp, Mus musculus
ggagcttaccagaggaacctagaaa

SEQ ID NO: 598795 - DNA, 25 bp, Mus musculus
ggagcttaccagtggaacctagaaa

SEQ ID NO: 598796 - DNA, 25 bp, Mus musculus
ggagcttacttaccagacagaagaa

SEQ ID NO: 598797 - DNA, 25 bp, Mus musculus
ggagcttacttagcagacagaagaa

SEQ ID NO: 598798 - DNA, 25 bp, Mus musculus
ggagcttagcaccatgaaccttcct

SEQ ID NO: 598799 - DNA, 25 bp, Mus musculus
ggagcttagcacgatgaaccttcct

SEQ ID NO: 598800 - DNA, 25 bp, Mus musculus
ggagcttaggacactaatccatcag

SEQ ID NO: 598801 - DNA, 25 bp, Mus musculus
ggagcttaggactctaatccatcag

SEQ ID NO: 598802 - DNA, 25 bp, Mus musculus
ggagcttagggcagctcagccttac

SEQ ID NO: 598803 - DNA, 25 bp, Mus musculus
ggagcttagggctgctcagccttac

SEQ ID NO: 598804 - DNA, 25 bp, Mus musculus
ggagcttagggtactaccagctaca

SEQ ID NO: 598805 - DNA, 25 bp, Mus musculus
ggagcttagggttctaccagctaca

SEQ ID NO: 598806 - DNA, 25 bp, Mus musculus
ggagcttagtaaatgttcattaata

SEQ ID NO: 598807 - DNA, 25 bp, Mus musculus
ggagcttagtaattgttcattaata

SEQ ID NO: 598808 - DNA, 25 bp, Mus musculus
ggagcttatcagcaaggctattgaa

SEQ ID NO: 598809 - DNA, 25 bp, Mus musculus
ggagcttatcaggaaggctattgaa

SEQ ID NO: 598810 - DNA, 25 bp, Mus musculus
ggagcttatgccctgtggacagtat

SEQ ID NO: 598811 - DNA, 25 bp, Mus musculus
ggagcttatgccgtgtggacagtat

SEQ ID NO: 598812 - DNA, 25 bp, Mus musculus
ggagcttattccaaccaactgtgta

SEQ ID NO: 598813 - DNA, 25 bp, Mus musculus
ggagcttattcctaccaactgtgta

SEQ ID NO: 598814 - DNA, 25 bp, Mus musculus
ggagcttattctagtttctgcttta

SEQ ID NO: 598815 - DNA, 25 bp, Mus musculus
ggagcttattcttgtttctgcttta

SEQ ID NO: 598816 - DNA, 25 bp, Mus musculus
ggagcttcaatcagccctaccagga

SEQ ID NO: 598817 - DNA, 25 bp, Mus musculus
ggagcttcaatctgccctaccagga

SEQ ID NO: 598818 - DNA, 25 bp, Mus musculus
ggagcttcaatgagcgtcacctaca

SEQ ID NO: 598819 - DNA, 25 bp, Mus musculus
ggagcttcaatgtgcgtcacctaca

SEQ ID NO: 598820 - DNA, 25 bp, Mus musculus
ggagcttcagacagcgagtcagatg

SEQ ID NO: 598821 - DNA, 25 bp, Mus musculus
ggagcttcagactgcgagtcagatg

SEQ ID NO: 598822 - DNA, 25 bp, Mus musculus
ggagcttcagtcaggtggccacaaa

SEQ ID NO: 598823 - DNA, 25 bp, Mus musculus
ggagcttcagtctggtggccacaaa

SEQ ID NO: 598824 - DNA, 25 bp, Mus musculus
ggagcttccagtctatgacatcacc

SEQ ID NO: 598825 - DNA, 25 bp, Mus musculus
ggagcttccagtgtatgacatcacc

SEQ ID NO: 598826 - DNA, 25 bp, Mus musculus
ggagcttcccgcatttgaagtgcaa

SEQ ID NO: 598827 - DNA, 25 bp, Mus musculus
ggagcttcccgcttttgaagtgcaa

SEQ ID NO: 598828 - DNA, 25 bp, Mus musculus
ggagcttcctggacagttccgtcca

SEQ ID NO: 598829 - DNA, 25 bp, Mus musculus
ggagcttcctggtcagttccgtcca

SEQ ID NO: 598830 - DNA, 25 bp, Mus musculus
ggagcttccttaaagaatgacctga

SEQ ID NO: 598831 - DNA, 25 bp, Mus musculus
ggagcttccttaatacctcagataa

SEQ ID NO: 598832 - DNA, 25 bp, Mus musculus
ggagcttccttatagaatgacctga

SEQ ID NO: 598833 - DNA, 25 bp, Mus musculus
ggagcttccttattacctcagataa

SEQ ID NO: 598834 - DNA, 25 bp, Mus musculus
ggagcttccttgatcgaaagctgca

SEQ ID NO: 598835 - DNA, 25 bp, Mus musculus
ggagcttccttgttcgaaagctgca

SEQ ID NO: 598836 - DNA, 25 bp, Mus musculus
ggagcttcgtggatgggacccacat

SEQ ID NO: 598837 - DNA, 25 bp, Mus musculus
ggagcttcgtggttgggacccacat

SEQ ID NO: 598838 - DNA, 25 bp, Mus musculus
ggagcttctacacggcacaggctgt

SEQ ID NO: 598839 - DNA, 25 bp, Mus musculus
ggagcttctacagggcacaggctgt

SEQ ID NO: 598840 - DNA, 25 bp, Mus musculus
ggagcttctcataggcggacagcca

SEQ ID NO: 598841 - DNA, 25 bp, Mus musculus
ggagcttctcatatccaatgctgga

SEQ ID NO: 598842 - DNA, 25 bp, Mus musculus
ggagcttctcattggcggacagcca

SEQ ID NO: 598843 - DNA, 25 bp, Mus musculus
ggagcttctcatttccaatgctgga

SEQ ID NO: 598844 - DNA, 25 bp, Mus musculus
ggagcttctccaaccagaggcgagg

SEQ ID NO: 598845 - DNA, 25 bp, Mus musculus
ggagcttctccaatggaaacttgtc

SEQ ID NO: 598846 - DNA, 25 bp, Mus musculus
ggagcttctccacgccttcgagatg

SEQ ID NO: 598847 - DNA, 25 bp, Mus musculus
ggagcttctccaggccttcgagatg

SEQ ID NO: 598848 - DNA, 25 bp, Mus musculus
ggagcttctccatccagaggcgagg

SEQ ID NO: 598849 - DNA, 25 bp, Mus musculus
ggagcttctccattggaaacttgtc

SEQ ID NO: 598850 - DNA, 25 bp, Mus musculus
ggagcttctcggcagtggaatccaa

SEQ ID NO: 598851 - DNA, 25 bp, Mus musculus
ggagcttctcgggagtggaatccaa

SEQ ID NO: 598852 - DNA, 25 bp, Mus musculus
ggagcttctctacctcgggtgaagc

SEQ ID NO: 598853 - DNA, 25 bp, Mus musculus
ggagcttctctagctcgggtgaagc

SEQ ID NO: 598854 - DNA, 25 bp, Mus musculus
ggagcttgaagcatcctaggcagcc

SEQ ID NO: 598855 - DNA, 25 bp, Mus musculus
ggagcttgaagcttcctaggcagcc

SEQ ID NO: 598856 - DNA, 25 bp, Mus musculus
ggagcttgacaacaattcctctttg

SEQ ID NO: 598857 - DNA, 25 bp, Mus musculus
ggagcttgacaagaattcctctttg

SEQ ID NO: 598858 - DNA, 25 bp, Mus musculus
ggagcttgaccccagttcgagacag

SEQ ID NO: 598859 - DNA, 25 bp, Mus musculus
ggagcttgacccgagttcgagacag

SEQ ID NO: 598860 - DNA, 25 bp, Mus musculus
ggagcttgacctctgtagacaggct

SEQ ID NO: 598861 - DNA, 25 bp, Mus musculus
ggagcttgacctgtgtagacaggct

SEQ ID NO: 598862 - DNA, 25 bp, Mus musculus
ggagcttgagctcggtatccccgct

SEQ ID NO: 598863 - DNA, 25 bp, Mus musculus
ggagcttgagctgggtatccccgct

SEQ ID NO: 598864 - DNA, 25 bp, Mus musculus
ggagcttgagggagttcgcaaattc

SEQ ID NO: 598865 - DNA, 25 bp, Mus musculus
ggagcttgagggtgttcgcaaattc

SEQ ID NO: 598866 - DNA, 25 bp, Mus musculus
ggagcttgattccaagcctcaccaa

SEQ ID NO: 598867 - DNA, 25 bp, Mus musculus
ggagcttgattcgaagcctcaccaa

SEQ ID NO: 598868 - DNA, 25 bp, Mus musculus
ggagcttgcaccatcgtgttttaag

SEQ ID NO: 598869 - DNA, 25 bp, Mus musculus
ggagcttgcaccttcgtgttttaag

SEQ ID NO: 598870 - DNA, 25 bp, Mus musculus
ggagcttgcaggaccctttttatta

SEQ ID NO: 598871 - DNA, 25 bp, Mus musculus
ggagcttgcaggtccctttttatta

SEQ ID NO: 598872 - DNA, 25 bp, Mus musculus
ggagcttgcattcggttttgtgcca

SEQ ID NO: 598873 - DNA, 25 bp, Mus musculus
ggagcttgcattgggttttgtgcca

SEQ ID NO: 598874 - DNA, 25 bp, Mus musculus
ggagcttgccctaagaaatgtctag

SEQ ID NO: 598875 - DNA, 25 bp, Mus musculus
ggagcttgcccttagaaatgtctag

SEQ ID NO: 598876 - DNA, 25 bp, Mus musculus
ggagcttgcctgacttagctgggaa

SEQ ID NO: 598877 - DNA, 25 bp, Mus musculus
ggagcttgcctgtcttagctgggaa

SEQ ID NO: 598878 - DNA, 25 bp, Mus musculus
ggagcttgcggtacttgcaaatctt

SEQ ID NO: 598879 - DNA, 25 bp, Mus musculus
ggagcttgcggttcttgcaaatctt

SEQ ID NO: 598880 - DNA, 25 bp, Mus musculus
ggagcttgctacaaagtccaacgac

SEQ ID NO: 598881 - DNA, 25 bp, Mus musculus
ggagcttgctactaagtccaacgac

SEQ ID NO: 598882 - DNA, 25 bp, Mus musculus
ggagcttgctatcgccttacagtgc

SEQ ID NO: 598883 - DNA, 25 bp, Mus musculus
ggagcttgctatggccttacagtgc

SEQ ID NO: 598884 - DNA, 25 bp, Mus musculus
ggagcttgctctagactgttgtaag

SEQ ID NO: 598885 - DNA, 25 bp, Mus musculus
ggagcttgctcttgactgttgtaag

SEQ ID NO: 598886 - DNA, 25 bp, Mus musculus
ggagcttgctgcctagcccaaagat

SEQ ID NO: 598887 - DNA, 25 bp, Mus musculus
ggagcttgctgcgtagcccaaagat

SEQ ID NO: 598888 - DNA, 25 bp, Mus musculus
ggagcttggattctttctctgctgc

SEQ ID NO: 598889 - DNA, 25 bp, Mus musculus
ggagcttggattgtttctctgctgc

SEQ ID NO: 598890 - DNA, 25 bp, Mus musculus
ggagcttggcatagttcagtttcta

SEQ ID NO: 598891 - DNA, 25 bp, Mus musculus
ggagcttggcattgttcagtttcta

SEQ ID NO: 598892 - DNA, 25 bp, Mus musculus
ggagcttgggcgactgtaagttaac

SEQ ID NO: 598893 - DNA, 25 bp, Mus musculus
ggagcttgggcgtctgtaagttaac

SEQ ID NO: 598894 - DNA, 25 bp, Mus musculus
ggagcttgggctctttacctcagac

SEQ ID NO: 598895 - DNA, 25 bp, Mus musculus
ggagcttgggctgtttacctcagac

SEQ ID NO: 598896 - DNA, 25 bp, Mus musculus
ggagcttggtttaatgtgcattcat

SEQ ID NO: 598897 - DNA, 25 bp, Mus musculus
ggagcttggttttatgtgcattcat

SEQ ID NO: 598898 - DNA, 25 bp, Mus musculus
ggagcttgtccaactgttagtgctt

SEQ ID NO: 598899 - DNA, 25 bp, Mus musculus
ggagcttgtccatctgttagtgctt

SEQ ID NO: 598900 - DNA, 25 bp, Mus musculus
ggagcttgtccccagaagaaacaca

SEQ ID NO: 598901 - DNA, 25 bp, Mus musculus
ggagcttgtcccgagaagaaacaca

SEQ ID NO: 598902 - DNA, 25 bp, Mus musculus
ggagcttgtgagatttggatgcatc

SEQ ID NO: 598903 - DNA, 25 bp, Mus musculus
ggagcttgtgagttttggatgcatc

SEQ ID NO: 598904 - DNA, 25 bp, Mus musculus
ggagcttgttcccagacatacactt

SEQ ID NO: 598905 - DNA, 25 bp, Mus musculus
ggagcttgttccgagacatacactt

SEQ ID NO: 598906 - DNA, 25 bp, Mus musculus
ggagcttgttcgagatccacaggca

SEQ ID NO: 598907 - DNA, 25 bp, Mus musculus
ggagcttgttcgtgatccacaggca

SEQ ID NO: 598908 - DNA, 25 bp, Mus musculus
ggagctttaagtatcatacccttgc

SEQ ID NO: 598909 - DNA, 25 bp, Mus musculus
ggagctttaagtttcatacccttgc

SEQ ID NO: 598910 - DNA, 25 bp, Mus musculus
ggagctttactcaaattgatgttta

SEQ ID NO: 598911 - DNA, 25 bp, Mus musculus
ggagctttactctaattgatgttta

SEQ ID NO: 598912 - DNA, 25 bp, Mus musculus
ggagctttagtcaagagccctcaga

SEQ ID NO: 598913 - DNA, 25 bp, Mus musculus
ggagctttagtctagagccctcaga

SEQ ID NO: 598914 - DNA, 25 bp, Mus musculus
ggagctttagttacttctgcttgta

SEQ ID NO: 598915 - DNA, 25 bp, Mus musculus
ggagctttagtttcttctgcttgta

SEQ ID NO: 598916 - DNA, 25 bp, Mus musculus
ggagctttatgtaacttccatttaa

SEQ ID NO: 598917 - DNA, 25 bp, Mus musculus
ggagctttatgttacttccatttaa

SEQ ID NO: 598918 - DNA, 25 bp, Mus musculus
ggagctttatttcatttaccgtatt

SEQ ID NO: 598919 - DNA, 25 bp, Mus musculus
ggagctttatttgatttaccgtatt

SEQ ID NO: 598920 - DNA, 25 bp, Mus musculus
ggagctttcaatctgaccacaggac

SEQ ID NO: 598921 - DNA, 25 bp, Mus musculus
ggagctttcaatgtgaccacaggac

SEQ ID NO: 598922 - DNA, 25 bp, Mus musculus
ggagctttcacacgtccagggctga

SEQ ID NO: 598923 - DNA, 25 bp, Mus musculus
ggagctttcacaggtccagggctga

SEQ ID NO: 598924 - DNA, 25 bp, Mus musculus
ggagctttccaaattacatcactga

SEQ ID NO: 598925 - DNA, 25 bp, Mus musculus
ggagctttccaatttacatcactga

SEQ ID NO: 598926 - DNA, 25 bp, Mus musculus
ggagctttccctagtgtagagtaaa

SEQ ID NO: 598927 - DNA, 25 bp, Mus musculus
ggagctttcccttgtgtagagtaaa

SEQ ID NO: 598928 - DNA, 25 bp, Mus musculus
ggagctttcctcatggaacagttaa

SEQ ID NO: 598929 - DNA, 25 bp, Mus musculus
ggagctttcctcttggaacagttaa

SEQ ID NO: 598930 - DNA, 25 bp, Mus musculus
ggagctttcgatctgcaatattaga

SEQ ID NO: 598931 - DNA, 25 bp, Mus musculus
ggagctttcgatgtgcaatattaga

SEQ ID NO: 598932 - DNA, 25 bp, Mus musculus
ggagctttcgcacggcccaacatag

SEQ ID NO: 598933 - DNA, 25 bp, Mus musculus
ggagctttcgcagggcccaacatag

SEQ ID NO: 598934 - DNA, 25 bp, Mus musculus
ggagctttctggcatggatctataa

SEQ ID NO: 598935 - DNA, 25 bp, Mus musculus
ggagctttctgggatggatctataa

SEQ ID NO: 598936 - DNA, 25 bp, Mus musculus
ggagctttctttactaagtggtgac

SEQ ID NO: 598937 - DNA, 25 bp, Mus musculus
ggagctttcttttctaagtggtgac

SEQ ID NO: 598938 - DNA, 25 bp, Mus musculus
ggagctttgaagctgtaccgtccct

SEQ ID NO: 598939 - DNA, 25 bp, Mus musculus
ggagctttgaaggtgtaccgtccct

SEQ ID NO: 598940 - DNA, 25 bp, Mus musculus
ggagctttgcttagcactgggcgaa

SEQ ID NO: 598941 - DNA, 25 bp, Mus musculus
ggagctttgctttgcactgggcgaa

SEQ ID NO: 598942 - DNA, 25 bp, Mus musculus
ggagctttggagaggttctatacga

SEQ ID NO: 598943 - DNA, 25 bp, Mus musculus
ggagctttggagtggttctatacga

SEQ ID NO: 598944 - DNA, 25 bp, Mus musculus
ggagctttgtaaaatctgcaatacc

SEQ ID NO: 598945 - DNA, 25 bp, Mus musculus
ggagctttgtaactggtcatttgcc

SEQ ID NO: 598946 - DNA, 25 bp, Mus musculus
ggagctttgtaagtggtcatttgcc

SEQ ID NO: 598947 - DNA, 25 bp, Mus musculus
ggagctttgtaatatctgcaatacc

SEQ ID NO: 598948 - DNA, 25 bp, Mus musculus
ggagctttgtctagtgcttgtcaca

SEQ ID NO: 598949 - DNA, 25 bp, Mus musculus
ggagctttgtcttgtgcttgtcaca

SEQ ID NO: 598950 - DNA, 25 bp, Mus musculus
ggagctttgtggattacctttcaca

SEQ ID NO: 598951 - DNA, 25 bp, Mus musculus
ggagctttgtggtttacctttcaca

SEQ ID NO: 598952 - DNA, 25 bp, Mus musculus
ggagctttgttcaattcactcaatg

SEQ ID NO: 598953 - DNA, 25 bp, Mus musculus
ggagctttgttctattcactcaatg

SEQ ID NO: 598954 - DNA, 25 bp, Mus musculus
ggagcttttgccatgtagcagagca

SEQ ID NO: 598955 - DNA, 25 bp, Mus musculus
ggagcttttgccttgtagcagagca

SEQ ID NO: 598956 - DNA, 25 bp, Mus musculus
ggagcttttgtgatgcagctaccat

SEQ ID NO: 598957 - DNA, 25 bp, Mus musculus
ggagcttttgtgttgcagctaccat

SEQ ID NO: 598958 - DNA, 25 bp, Mus musculus
ggagcttttgttcggttcagattca

SEQ ID NO: 598959 - DNA, 25 bp, Mus musculus
ggagcttttgttgggttcagattca

SEQ ID NO: 598960 - DNA, 25 bp, Mus musculus
ggagctttttccacgatgagaccaa

SEQ ID NO: 598961 - DNA, 25 bp, Mus musculus
ggagctttttcctcgatgagaccaa

SEQ ID NO: 598962 - DNA, 25 bp, Mus musculus
ggagctttttggatattcctctgag

SEQ ID NO: 598963 - DNA, 25 bp, Mus musculus
ggagctttttggttattcctctgag

SEQ ID NO: 598964 - DNA, 25 bp, Mus musculus
ggagcttttttgatgccttatctag

SEQ ID NO: 598965 - DNA, 25 bp, Mus musculus
ggagcttttttgttgccttatctag

SEQ ID NO: 598966 - DNA, 25 bp, Mus musculus
ggaggaaaacaacttgctgacagcc

SEQ ID NO: 598967 - DNA, 25 bp, Mus musculus
ggaggaaaacaagttgctgacagcc

SEQ ID NO: 598968 - DNA, 25 bp, Mus musculus
ggaggaaaacctagttctgtcagaa

SEQ ID NO: 598969 - DNA, 25 bp, Mus musculus
ggaggaaaaccttgttctgtcagaa

SEQ ID NO: 598970 - DNA, 25 bp, Mus musculus
ggaggaaaagccagcccgtgcccag

SEQ ID NO: 598971 - DNA, 25 bp, Mus musculus
ggaggaaaagcctgcccgtgcccag

SEQ ID NO: 598972 - DNA, 25 bp, Mus musculus
ggaggaaaatgcatattcaacaggc

SEQ ID NO: 598973 - DNA, 25 bp, Mus musculus
ggaggaaaatgcttattcaacaggc

SEQ ID NO: 598974 - DNA, 25 bp, Mus musculus
ggaggaaacactcaagaggcttcag

SEQ ID NO: 598975 - DNA, 25 bp, Mus musculus
ggaggaaacactgaagaggcttcag

SEQ ID NO: 598976 - DNA, 25 bp, Mus musculus
ggaggaaactcaccaatctctatga

SEQ ID NO: 598977 - DNA, 25 bp, Mus musculus
ggaggaaactcagcaatctctatga

SEQ ID NO: 598978 - DNA, 25 bp, Mus musculus
ggaggaaactgcaatcatgactggg

SEQ ID NO: 598979 - DNA, 25 bp, Mus musculus
ggaggaaactgctatcatgactggg

SEQ ID NO: 598980 - DNA, 25 bp, Mus musculus
ggaggaaagagaaaccatgtttatt

SEQ ID NO: 598981 - DNA, 25 bp, Mus musculus
ggaggaaagagataccatgtttatt

SEQ ID NO: 598982 - DNA, 25 bp, Mus musculus
ggaggaaagagcatcgaaattacag

SEQ ID NO: 598983 - DNA, 25 bp, Mus musculus
ggaggaaagagcttcgaaattacag

SEQ ID NO: 598984 - DNA, 25 bp, Mus musculus
ggaggaaagcatccgcctctctgct

SEQ ID NO: 598985 - DNA, 25 bp, Mus musculus
ggaggaaagcatgcgcctctctgct

SEQ ID NO: 598986 - DNA, 25 bp, Mus musculus
ggaggaaatcgcatctaccccgtgg

SEQ ID NO: 598987 - DNA, 25 bp, Mus musculus
ggaggaaatcgcttctaccccgtgg

SEQ ID NO: 598988 - DNA, 25 bp, Mus musculus
ggaggaaatctcatcgtattcgaaa

SEQ ID NO: 598989 - DNA, 25 bp, Mus musculus
ggaggaaatctcttcgtattcgaaa

SEQ ID NO: 598990 - DNA, 25 bp, Mus musculus
ggaggaaatggcagtcatgctttct

SEQ ID NO: 598991 - DNA, 25 bp, Mus musculus
ggaggaaatggctgtcatgctttct

SEQ ID NO: 598992 - DNA, 25 bp, Mus musculus
ggaggaacaactcttaaaagctctg

SEQ ID NO: 598993 - DNA, 25 bp, Mus musculus
ggaggaacaactgttaaaagctctg

SEQ ID NO: 598994 - DNA, 25 bp, Mus musculus
ggaggaacaatcatcactaaagaat

SEQ ID NO: 598995 - DNA, 25 bp, Mus musculus
ggaggaacaatcttcactaaagaat

SEQ ID NO: 598996 - DNA, 25 bp, Mus musculus
ggaggaacacatatgctgcacacag

SEQ ID NO: 598997 - DNA, 25 bp, Mus musculus
ggaggaacacatttgctgcacacag

SEQ ID NO: 598998 - DNA, 25 bp, Mus musculus
ggaggaacagggagtatttaagctt

SEQ ID NO: 598999 - DNA, 25 bp, Mus musculus
ggaggaacagggtgtatttaagctt

SEQ ID NO: 599000 - DNA, 25 bp, Mus musculus
ggaggaacatcacctattcccatat

SEQ ID NO: 599001 - DNA, 25 bp, Mus musculus
ggaggaacatcagctattcccatat

SEQ ID NO: 599002 - DNA, 25 bp, Mus musculus
ggaggaacatggctgattctactta

SEQ ID NO: 599003 - DNA, 25 bp, Mus musculus
ggaggaacatgggtgattctactta

SEQ ID NO: 599004 - DNA, 25 bp, Mus musculus
ggaggaacattgaccgtgtgctctt

SEQ ID NO: 599005 - DNA, 25 bp, Mus musculus
ggaggaacattgtccgtgtgctctt

SEQ ID NO: 599006 - DNA, 25 bp, Mus musculus
ggaggaaccacaactcagatacaag

SEQ ID NO: 599007 - DNA, 25 bp, Mus musculus
ggaggaaccacatctcagatacaag

SEQ ID NO: 599008 - DNA, 25 bp, Mus musculus
ggaggaaccagcaacccatcaatgt

SEQ ID NO: 599009 - DNA, 25 bp, Mus musculus
ggaggaaccagctacccatcaatgt

SEQ ID NO: 599010 - DNA, 25 bp, Mus musculus
ggaggaacccatccaacttaagcgg

SEQ ID NO: 599011 - DNA, 25 bp, Mus musculus
ggaggaacccatgcaacttaagcgg

SEQ ID NO: 599012 - DNA, 25 bp, Mus musculus
ggaggaaccctcatgacaacccaat

SEQ ID NO: 599013 - DNA, 25 bp, Mus musculus
ggaggaaccctcattttaggtccag

SEQ ID NO: 599014 - DNA, 25 bp, Mus musculus
ggaggaaccctcttgacaacccaat

SEQ ID NO: 599015 - DNA, 25 bp, Mus musculus
ggaggaaccctctttttaggtccag

SEQ ID NO: 599016 - DNA, 25 bp, Mus musculus
ggaggaacctgaagatctgcgcccg

SEQ ID NO: 599017 - DNA, 25 bp, Mus musculus
ggaggaacctgatgatctgcgcccg

SEQ ID NO: 599018 - DNA, 25 bp, Mus musculus
ggaggaacgctcattttaatgacag

SEQ ID NO: 599019 - DNA, 25 bp, Mus musculus
ggaggaacgctctttttaatgacag

SEQ ID NO: 599020 - DNA, 25 bp, Mus musculus
ggaggaacggacactgaacccacgg

SEQ ID NO: 599021 - DNA, 25 bp, Mus musculus
ggaggaacggactctgaacccacgg

SEQ ID NO: 599022 - DNA, 25 bp, Mus musculus
ggaggaactacaactgttagcagaa

SEQ ID NO: 599023 - DNA, 25 bp, Mus musculus
ggaggaactacatctgttagcagaa

SEQ ID NO: 599024 - DNA, 25 bp, Mus musculus
ggaggaactattacacttgtggaga

SEQ ID NO: 599025 - DNA, 25 bp, Mus musculus
ggaggaactatttcacttgtggaga

SEQ ID NO: 599026 - DNA, 25 bp, Mus musculus
ggaggaactcaaccctagctctggg

SEQ ID NO: 599027 - DNA, 25 bp, Mus musculus
ggaggaactcaagcctagctctggg

SEQ ID NO: 599028 - DNA, 25 bp, Mus musculus
ggaggaactcataactgtcttcaga

SEQ ID NO: 599029 - DNA, 25 bp, Mus musculus
ggaggaactcattactgtcttcaga

SEQ ID NO: 599030 - DNA, 25 bp, Mus musculus
ggaggaactctgatggcacccagat

SEQ ID NO: 599031 - DNA, 25 bp, Mus musculus
ggaggaactctgttggcacccagat

SEQ ID NO: 599032 - DNA, 25 bp, Mus musculus
ggaggaactcttaaaccaattgcaa

SEQ ID NO: 599033 - DNA, 25 bp, Mus musculus
ggaggaactctttaaccaattgcaa

SEQ ID NO: 599034 - DNA, 25 bp, Mus musculus
ggaggaacttatccaccagctgagg

SEQ ID NO: 599035 - DNA, 25 bp, Mus musculus
ggaggaacttatgcaccagctgagg

SEQ ID NO: 599036 - DNA, 25 bp, Mus musculus
ggaggaagaacccagctggctttac

SEQ ID NO: 599037 - DNA, 25 bp, Mus musculus
ggaggaagaaccgagctggctttac

SEQ ID NO: 599038 - DNA, 25 bp, Mus musculus
ggaggaagacagatccctttcccac

SEQ ID NO: 599039 - DNA, 25 bp, Mus musculus
ggaggaagacagttccctttcccac

SEQ ID NO: 599040 - DNA, 25 bp, Mus musculus
ggaggaagaccaagctacagagatc

SEQ ID NO: 599041 - DNA, 25 bp, Mus musculus
ggaggaagaccaccagttaagaact

SEQ ID NO: 599042 - DNA, 25 bp, Mus musculus
ggaggaagaccagcagttaagaact

SEQ ID NO: 599043 - DNA, 25 bp, Mus musculus
ggaggaagaccatgctacagagatc

SEQ ID NO: 599044 - DNA, 25 bp, Mus musculus
ggaggaagagacacaccccacactg

SEQ ID NO: 599045 - DNA, 25 bp, Mus musculus
ggaggaagagactcaccccacactg

SEQ ID NO: 599046 - DNA, 25 bp, Mus musculus
ggaggaagagttcgcccaatcagaa

SEQ ID NO: 599047 - DNA, 25 bp, Mus musculus
ggaggaagagttggcccaatcagaa

SEQ ID NO: 599048 - DNA, 25 bp, Mus musculus
ggaggaagatgaaccggtccctgcc

SEQ ID NO: 599049 - DNA, 25 bp, Mus musculus
ggaggaagatgatccggtccctgcc

SEQ ID NO: 599050 - DNA, 25 bp, Mus musculus
ggaggaagcacaagagagccacatt

SEQ ID NO: 599051 - DNA, 25 bp, Mus musculus
ggaggaagcacaattttcactgttt

SEQ ID NO: 599052 - DNA, 25 bp, Mus musculus
ggaggaagcacatgagagccacatt

SEQ ID NO: 599053 - DNA, 25 bp, Mus musculus
ggaggaagcacatttttcactgttt

SEQ ID NO: 599054 - DNA, 25 bp, Mus musculus
ggaggaagcagcactgaaagcccct

SEQ ID NO: 599055 - DNA, 25 bp, Mus musculus
ggaggaagcagctctgaaagcccct

SEQ ID NO: 599056 - DNA, 25 bp, Mus musculus
ggaggaagccctagtgcatgccaga

SEQ ID NO: 599057 - DNA, 25 bp, Mus musculus
ggaggaagcccttgtgcatgccaga

SEQ ID NO: 599058 - DNA, 25 bp, Mus musculus
ggaggaagccgcagcgaacgcaaac

SEQ ID NO: 599059 - DNA, 25 bp, Mus musculus
ggaggaagccgctgcgaacgcaaac

SEQ ID NO: 599060 - DNA, 25 bp, Mus musculus
ggaggaagcctcaagcacagccaca

SEQ ID NO: 599061 - DNA, 25 bp, Mus musculus
ggaggaagcctctagcacagccaca

SEQ ID NO: 599062 - DNA, 25 bp, Mus musculus
ggaggaagccttccgtgtagccctt

SEQ ID NO: 599063 - DNA, 25 bp, Mus musculus
ggaggaagccttgcgtgtagccctt

SEQ ID NO: 599064 - DNA, 25 bp, Mus musculus
ggaggaagcgcaccttgcacaagaa

SEQ ID NO: 599065 - DNA, 25 bp, Mus musculus
ggaggaagcgcagcttgcacaagaa

SEQ ID NO: 599066 - DNA, 25 bp, Mus musculus
ggaggaagctacagcagcttccgga

SEQ ID NO: 599067 - DNA, 25 bp, Mus musculus
ggaggaagctactgcagcttccgga

SEQ ID NO: 599068 - DNA, 25 bp, Mus musculus
ggaggaagctatcctacctgtagaa

SEQ ID NO: 599069 - DNA, 25 bp, Mus musculus
ggaggaagctatgctacctgtagaa

SEQ ID NO: 599070 - DNA, 25 bp, Mus musculus
ggaggaaggagcagatacatgtatt

SEQ ID NO: 599071 - DNA, 25 bp, Mus musculus
ggaggaaggagctgatacatgtatt

SEQ ID NO: 599072 - DNA, 25 bp, Mus musculus
ggaggaaggcacatagacattccct

SEQ ID NO: 599073 - DNA, 25 bp, Mus musculus
ggaggaaggcacttagacattccct

SEQ ID NO: 599074 - DNA, 25 bp, Mus musculus
ggaggaaggctaagacctgctctca

SEQ ID NO: 599075 - DNA, 25 bp, Mus musculus
ggaggaaggctatgacctgctctca

SEQ ID NO: 599076 - DNA, 25 bp, Mus musculus
ggaggaagtaccatccgataaagtt

SEQ ID NO: 599077 - DNA, 25 bp, Mus musculus
ggaggaagtaccttccgataaagtt

SEQ ID NO: 599078 - DNA, 25 bp, Mus musculus
ggaggaagtcagaagccgcctgtct

SEQ ID NO: 599079 - DNA, 25 bp, Mus musculus
ggaggaagtcagtagccgcctgtct

SEQ ID NO: 599080 - DNA, 25 bp, Mus musculus
ggaggaagtgaaccattacagcaat

SEQ ID NO: 599081 - DNA, 25 bp, Mus musculus
ggaggaagtgaagcattacagcaat

SEQ ID NO: 599082 - DNA, 25 bp, Mus musculus
ggaggaagttcacaccacacctgaa

SEQ ID NO: 599083 - DNA, 25 bp, Mus musculus
ggaggaagttcagaccacacctgaa

SEQ ID NO: 599084 - DNA, 25 bp, Mus musculus
ggaggaagttccaccatgcattgac

SEQ ID NO: 599085 - DNA, 25 bp, Mus musculus
ggaggaagttcctccatgcattgac

SEQ ID NO: 599086 - DNA, 25 bp, Mus musculus
ggaggaagtttcacaaggtaccact

SEQ ID NO: 599087 - DNA, 25 bp, Mus musculus
ggaggaagtttctcaaggtaccact

SEQ ID NO: 599088 - DNA, 25 bp, Mus musculus
ggaggaatacacatacctaggtaat

SEQ ID NO: 599089 - DNA, 25 bp, Mus musculus
ggaggaatacacttacctaggtaat

SEQ ID NO: 599090 - DNA, 25 bp, Mus musculus
ggaggaatatcgaagctggccgctt

SEQ ID NO: 599091 - DNA, 25 bp, Mus musculus
ggaggaatatcgtagctggccgctt

SEQ ID NO: 599092 - DNA, 25 bp, Mus musculus
ggaggaatcctcactcgtgttcaaa

SEQ ID NO: 599093 - DNA, 25 bp, Mus musculus
ggaggaatcctctctcgtgttcaaa

SEQ ID NO: 599094 - DNA, 25 bp, Mus musculus
ggaggaatctgactctgaagctgaa

SEQ ID NO: 599095 - DNA, 25 bp, Mus musculus
ggaggaatctgagtctgaagctgaa

SEQ ID NO: 599096 - DNA, 25 bp, Mus musculus
ggaggaatcttcatgtacccagcca

SEQ ID NO: 599097 - DNA, 25 bp, Mus musculus
ggaggaatcttcttgtacccagcca

SEQ ID NO: 599098 - DNA, 25 bp, Mus musculus
ggaggaatgagccttcactgccctg

SEQ ID NO: 599099 - DNA, 25 bp, Mus musculus
ggaggaatgagcgttcactgccctg

SEQ ID NO: 599100 - DNA, 25 bp, Mus musculus
ggaggaatggaacaaccttccgatt

SEQ ID NO: 599101 - DNA, 25 bp, Mus musculus
ggaggaatggaagaaccttccgatt

SEQ ID NO: 599102 - DNA, 25 bp, Mus musculus
ggaggaatggctccttccttttccc

SEQ ID NO: 599103 - DNA, 25 bp, Mus musculus
ggaggaatggctgcttccttttccc

SEQ ID NO: 599104 - DNA, 25 bp, Mus musculus
ggaggaatggtactattggcatggg

SEQ ID NO: 599105 - DNA, 25 bp, Mus musculus
ggaggaatggtagtattggcatggg

SEQ ID NO: 599106 - DNA, 25 bp, Mus musculus
ggaggaatgtatattcatctactca

SEQ ID NO: 599107 - DNA, 25 bp, Mus musculus
ggaggaatgtattttcatctactca

SEQ ID NO: 599108 - DNA, 25 bp, Mus musculus
ggaggaattctacaccaaggctgag

SEQ ID NO: 599109 - DNA, 25 bp, Mus musculus
ggaggaattctagaccaaggctgag

SEQ ID NO: 599110 - DNA, 25 bp, Mus musculus
ggaggaattgagcaccaccatcaac

SEQ ID NO: 599111 - DNA, 25 bp, Mus musculus
ggaggaattgaggaccaccatcaac

SEQ ID NO: 599112 - DNA, 25 bp, Mus musculus
ggaggaatttagacccgacttgata

SEQ ID NO: 599113 - DNA, 25 bp, Mus musculus
ggaggaatttagtcccgacttgata

SEQ ID NO: 599114 - DNA, 25 bp, Mus musculus
ggaggaatttccaatctgggatatc

SEQ ID NO: 599115 - DNA, 25 bp, Mus musculus
ggaggaatttcctatctgggatatc

SEQ ID NO: 599116 - DNA, 25 bp, Mus musculus
ggaggaatttctcggacagtgcaat

SEQ ID NO: 599117 - DNA, 25 bp, Mus musculus
ggaggaatttctgggacagtgcaat

SEQ ID NO: 599118 - DNA, 25 bp, Mus musculus
ggaggacaaaaccactgagagcgct

SEQ ID NO: 599119 - DNA, 25 bp, Mus musculus
ggaggacaaaacgactgagagcgct

SEQ ID NO: 599120 - DNA, 25 bp, Mus musculus
ggaggacaactccttcaattgaaga

SEQ ID NO: 599121 - DNA, 25 bp, Mus musculus
ggaggacaactcgttcaattgaaga

SEQ ID NO: 599122 - DNA, 25 bp, Mus musculus
ggaggacacaaacgttttccctgtg

SEQ ID NO: 599123 - DNA, 25 bp, Mus musculus
ggaggacacaaaggttttccctgtg

SEQ ID NO: 599124 - DNA, 25 bp, Mus musculus
ggaggacacactcggctcacttact

SEQ ID NO: 599125 - DNA, 25 bp, Mus musculus
ggaggacacactgggctcacttact

SEQ ID NO: 599126 - DNA, 25 bp, Mus musculus
ggaggacacatgaatgctgtgtaca

SEQ ID NO: 599127 - DNA, 25 bp, Mus musculus
ggaggacacatgtatgctgtgtaca

SEQ ID NO: 599128 - DNA, 25 bp, Mus musculus
ggaggacactcaccccaaaagagat

SEQ ID NO: 599129 - DNA, 25 bp, Mus musculus
ggaggacactcagcccaaaagagat

SEQ ID NO: 599130 - DNA, 25 bp, Mus musculus
ggaggacactctaccaaatacaagt

SEQ ID NO: 599131 - DNA, 25 bp, Mus musculus
ggaggacactcttccaaatacaagt

SEQ ID NO: 599132 - DNA, 25 bp, Mus musculus
ggaggacactggacatgtttttcac

SEQ ID NO: 599133 - DNA, 25 bp, Mus musculus
ggaggacactggtcatgtttttcac

SEQ ID NO: 599134 - DNA, 25 bp, Mus musculus
ggaggacacttgctggacaatctat

SEQ ID NO: 599135 - DNA, 25 bp, Mus musculus
ggaggacacttggtggacaatctat

SEQ ID NO: 599136 - DNA, 25 bp, Mus musculus
ggaggacagaggacactagcctcta

SEQ ID NO: 599137 - DNA, 25 bp, Mus musculus
ggaggacagaggtcactagcctcta

SEQ ID NO: 599138 - DNA, 25 bp, Mus musculus
ggaggacagctcagattggccacgt

SEQ ID NO: 599139 - DNA, 25 bp, Mus musculus
ggaggacagctctgattggccacgt

SEQ ID NO: 599140 - DNA, 25 bp, Mus musculus
ggaggacagcttagacacgagcaca

SEQ ID NO: 599141 - DNA, 25 bp, Mus musculus
ggaggacagctttgacacgagcaca

SEQ ID NO: 599142 - DNA, 25 bp, Mus musculus
ggaggacatctcagaggactcctag

SEQ ID NO: 599143 - DNA, 25 bp, Mus musculus
ggaggacatctctgaggactcctag

SEQ ID NO: 599144 - DNA, 25 bp, Mus musculus
ggaggacatgacatttcctgacatt

SEQ ID NO: 599145 - DNA, 25 bp, Mus musculus
ggaggacatgacttttcctgacatt

SEQ ID NO: 599146 - DNA, 25 bp, Mus musculus
ggaggacatggacctgtatcatctg

SEQ ID NO: 599147 - DNA, 25 bp, Mus musculus
ggaggacatggagctgtatcatctg

SEQ ID NO: 599148 - DNA, 25 bp, Mus musculus
ggaggacatgtcacaggtgttctga

SEQ ID NO: 599149 - DNA, 25 bp, Mus musculus
ggaggacatgtctcaggtgttctga

SEQ ID NO: 599150 - DNA, 25 bp, Mus musculus
ggaggacattgtattcctgccccaa

SEQ ID NO: 599151 - DNA, 25 bp, Mus musculus
ggaggacattgtcacagtctctcat

SEQ ID NO: 599152 - DNA, 25 bp, Mus musculus
ggaggacattgtcccttggtacttt

SEQ ID NO: 599153 - DNA, 25 bp, Mus musculus
ggaggacattgtgacagtctctcat

SEQ ID NO: 599154 - DNA, 25 bp, Mus musculus
ggaggacattgtgccttggtacttt

SEQ ID NO: 599155 - DNA, 25 bp, Mus musculus
ggaggacattgttttcctgccccaa

SEQ ID NO: 599156 - DNA, 25 bp, Mus musculus
ggaggaccaagcaaagtctttctgt

SEQ ID NO: 599157 - DNA, 25 bp, Mus musculus
ggaggaccaagctaagtctttctgt

SEQ ID NO: 599158 - DNA, 25 bp, Mus musculus
ggaggaccaatacatcaggagcctt

SEQ ID NO: 599159 - DNA, 25 bp, Mus musculus
ggaggaccaatagatcaggagcctt

SEQ ID NO: 599160 - DNA, 25 bp, Mus musculus
ggaggaccacagaaccactgggata

SEQ ID NO: 599161 - DNA, 25 bp, Mus musculus
ggaggaccacagtaccactgggata

SEQ ID NO: 599162 - DNA, 25 bp, Mus musculus
ggaggaccacccctgccagaagtgt

SEQ ID NO: 599163 - DNA, 25 bp, Mus musculus
ggaggaccacccgtgccagaagtgt

SEQ ID NO: 599164 - DNA, 25 bp, Mus musculus
ggaggaccacctctatcaggaagaa

SEQ ID NO: 599165 - DNA, 25 bp, Mus musculus
ggaggaccacctgtatcaggaagaa

SEQ ID NO: 599166 - DNA, 25 bp, Mus musculus
ggaggaccactcactggaacacaga

SEQ ID NO: 599167 - DNA, 25 bp, Mus musculus
ggaggaccactctctggaacacaga

SEQ ID NO: 599168 - DNA, 25 bp, Mus musculus
ggaggaccagacacaggaagatcat

SEQ ID NO: 599169 - DNA, 25 bp, Mus musculus
ggaggaccagactcaggaagatcat

SEQ ID NO: 599170 - DNA, 25 bp, Mus musculus
ggaggaccagagagtcaggccttct

SEQ ID NO: 599171 - DNA, 25 bp, Mus musculus
ggaggaccagagtgtcaggccttct

SEQ ID NO: 599172 - DNA, 25 bp, Mus musculus
ggaggaccagccaggagtcagcatc

SEQ ID NO: 599173 - DNA, 25 bp, Mus musculus
ggaggaccagcctggagtcagcatc

SEQ ID NO: 599174 - DNA, 25 bp, Mus musculus
ggaggaccaggcactaattctactg

SEQ ID NO: 599175 - DNA, 25 bp, Mus musculus
ggaggaccaggctctaattctactg

SEQ ID NO: 599176 - DNA, 25 bp, Mus musculus
ggaggaccatgactcttcagctgca

SEQ ID NO: 599177 - DNA, 25 bp, Mus musculus
ggaggaccatgagtcttcagctgca

SEQ ID NO: 599178 - DNA, 25 bp, Mus musculus
ggaggaccatggatcacactgacac

SEQ ID NO: 599179 - DNA, 25 bp, Mus musculus
ggaggaccatggttcacactgacac

SEQ ID NO: 599180 - DNA, 25 bp, Mus musculus
ggaggaccccttaaatattcagact

SEQ ID NO: 599181 - DNA, 25 bp, Mus musculus
ggaggacccctttaatattcagact

SEQ ID NO: 599182 - DNA, 25 bp, Mus musculus
ggaggaccctgccacattgtcatat

SEQ ID NO: 599183 - DNA, 25 bp, Mus musculus
ggaggaccctgcgacattgtcatat

SEQ ID NO: 599184 - DNA, 25 bp, Mus musculus
ggaggaccgaggaacagattctcaa

SEQ ID NO: 599185 - DNA, 25 bp, Mus musculus
ggaggaccgaggtacagattctcaa

SEQ ID NO: 599186 - DNA, 25 bp, Mus musculus
ggaggaccggcgagtacccttcaag

SEQ ID NO: 599187 - DNA, 25 bp, Mus musculus
ggaggaccggcgtgtacccttcaag

SEQ ID NO: 599188 - DNA, 25 bp, Mus musculus
ggaggacctccaagcccagatttct

SEQ ID NO: 599189 - DNA, 25 bp, Mus musculus
ggaggacctccatgcccagatttct

SEQ ID NO: 599190 - DNA, 25 bp, Mus musculus
ggaggacctctacattactgtcatt

SEQ ID NO: 599191 - DNA, 25 bp, Mus musculus
ggaggacctctagattactgtcatt

SEQ ID NO: 599192 - DNA, 25 bp, Mus musculus
ggaggacctctcaaaactcttcaag

SEQ ID NO: 599193 - DNA, 25 bp, Mus musculus
ggaggacctctctaaactcttcaag

SEQ ID NO: 599194 - DNA, 25 bp, Mus musculus
ggaggacctgtaactgcatgtgaac

SEQ ID NO: 599195 - DNA, 25 bp, Mus musculus
ggaggacctgtatctgcatgtgaac

SEQ ID NO: 599196 - DNA, 25 bp, Mus musculus
ggaggaccttctaaaccagtttcag

SEQ ID NO: 599197 - DNA, 25 bp, Mus musculus
ggaggaccttcttaaccagtttcag

SEQ ID NO: 599198 - DNA, 25 bp, Mus musculus
ggaggacctttcagtaaagcgactt

SEQ ID NO: 599199 - DNA, 25 bp, Mus musculus
ggaggacctttctgtaaagcgactt

SEQ ID NO: 599200 - DNA, 25 bp, Mus musculus
ggaggaccttttagggaagatgcca

SEQ ID NO: 599201 - DNA, 25 bp, Mus musculus
ggaggacctttttgggaagatgcca

SEQ ID NO: 599202 - DNA, 25 bp, Mus musculus
ggaggacgacttatcaactacgaga

SEQ ID NO: 599203 - DNA, 25 bp, Mus musculus
ggaggacgacttttcaactacgaga

SEQ ID NO: 599204 - DNA, 25 bp, Mus musculus
ggaggacgatgcatcttgtgagttt

SEQ ID NO: 599205 - DNA, 25 bp, Mus musculus
ggaggacgatgcttcttgtgagttt

SEQ ID NO: 599206 - DNA, 25 bp, Mus musculus
ggaggacggagtctttgacatccac

SEQ ID NO: 599207 - DNA, 25 bp, Mus musculus
ggaggacggagtgtttgacatccac

SEQ ID NO: 599208 - DNA, 25 bp, Mus musculus
ggaggacgtcaacaccgagatacat

SEQ ID NO: 599209 - DNA, 25 bp, Mus musculus
ggaggacgtcaagaccgagatacat

SEQ ID NO: 599210 - DNA, 25 bp, Mus musculus
ggaggacgtcttctcatttgccgtc

SEQ ID NO: 599211 - DNA, 25 bp, Mus musculus
ggaggacgtcttgtcatttgccgtc

SEQ ID NO: 599212 - DNA, 25 bp, Mus musculus
ggaggactacacagctaacttagat

SEQ ID NO: 599213 - DNA, 25 bp, Mus musculus
ggaggactacactgctaacttagat

SEQ ID NO: 599214 - DNA, 25 bp, Mus musculus
ggaggactacttaacggccacagag

SEQ ID NO: 599215 - DNA, 25 bp, Mus musculus
ggaggactacttacttacaaggtat

SEQ ID NO: 599216 - DNA, 25 bp, Mus musculus
ggaggactactttacggccacagag

SEQ ID NO: 599217 - DNA, 25 bp, Mus musculus
ggaggactactttcttacaaggtat

SEQ ID NO: 599218 - DNA, 25 bp, Mus musculus
ggaggactagacaccttagcagcag

SEQ ID NO: 599219 - DNA, 25 bp, Mus musculus
ggaggactagactccttagcagcag

SEQ ID NO: 599220 - DNA, 25 bp, Mus musculus
ggaggactagctctattgcagcaca

SEQ ID NO: 599221 - DNA, 25 bp, Mus musculus
ggaggactagctgtattgcagcaca

SEQ ID NO: 599222 - DNA, 25 bp, Mus musculus
ggaggactatccaggaatcgtgaac

SEQ ID NO: 599223 - DNA, 25 bp, Mus musculus
ggaggactatcctggaatcgtgaac

SEQ ID NO: 599224 - DNA, 25 bp, Mus musculus
ggaggactcaccataacctatgtgg

SEQ ID NO: 599225 - DNA, 25 bp, Mus musculus
ggaggactcaccttaacctatgtgg

SEQ ID NO: 599226 - DNA, 25 bp, Mus musculus
ggaggactcccaccatgggcatagt

SEQ ID NO: 599227 - DNA, 25 bp, Mus musculus
ggaggactcccagcatgggcatagt

SEQ ID NO: 599228 - DNA, 25 bp, Mus musculus
ggaggactcctgactaacccaaatg

SEQ ID NO: 599229 - DNA, 25 bp, Mus musculus
ggaggactcctgtctaacccaaatg

SEQ ID NO: 599230 - DNA, 25 bp, Mus musculus
ggaggactcgaaaaactgcagtatt

SEQ ID NO: 599231 - DNA, 25 bp, Mus musculus
ggaggactcgaacacactgcgtgcc

SEQ ID NO: 599232 - DNA, 25 bp, Mus musculus
ggaggactcgaagacactgcgtgcc

SEQ ID NO: 599233 - DNA, 25 bp, Mus musculus
ggaggactcgaataactgcagtatt

SEQ ID NO: 599234 - DNA, 25 bp, Mus musculus
ggaggactcgttcggttttcacgct

SEQ ID NO: 599235 - DNA, 25 bp, Mus musculus
ggaggactcgttgggttttcacgct

SEQ ID NO: 599236 - DNA, 25 bp, Mus musculus
ggaggactctgaaactctgttcaaa

SEQ ID NO: 599237 - DNA, 25 bp, Mus musculus
ggaggactctgatactctgttcaaa

SEQ ID NO: 599238 - DNA, 25 bp, Mus musculus
ggaggactctgcagacggcatccaa

SEQ ID NO: 599239 - DNA, 25 bp, Mus musculus
ggaggactctgctgacggcatccaa

SEQ ID NO: 599240 - DNA, 25 bp, Mus musculus
ggaggactctgtcttctctcatgag

SEQ ID NO: 599241 - DNA, 25 bp, Mus musculus
ggaggactctgtgttctctcatgag

SEQ ID NO: 599242 - DNA, 25 bp, Mus musculus
ggaggactctttcaagagcccatta

SEQ ID NO: 599243 - DNA, 25 bp, Mus musculus
ggaggactctttgaagagcccatta

SEQ ID NO: 599244 - DNA, 25 bp, Mus musculus
ggaggactgaggactatggactact

SEQ ID NO: 599245 - DNA, 25 bp, Mus musculus
ggaggactgaggtctatggactact

SEQ ID NO: 599246 - DNA, 25 bp, Mus musculus
ggaggactgcgtcgcaactatcaat

SEQ ID NO: 599247 - DNA, 25 bp, Mus musculus
ggaggactgcgtggcaactatcaat

SEQ ID NO: 599248 - DNA, 25 bp, Mus musculus
ggaggactgctaaccattactcagc

SEQ ID NO: 599249 - DNA, 25 bp, Mus musculus
ggaggactgctatccattactcagc

SEQ ID NO: 599250 - DNA, 25 bp, Mus musculus
ggaggacttacacgacaggcatgta

SEQ ID NO: 599251 - DNA, 25 bp, Mus musculus
ggaggacttacaggacaggcatgta

SEQ ID NO: 599252 - DNA, 25 bp, Mus musculus
ggaggacttcatccgttgatactta

SEQ ID NO: 599253 - DNA, 25 bp, Mus musculus
ggaggacttcatgcgttgatactta

SEQ ID NO: 599254 - DNA, 25 bp, Mus musculus
ggaggacttccacagcagagtgtta

SEQ ID NO: 599255 - DNA, 25 bp, Mus musculus
ggaggacttccaccgggttatcaat

SEQ ID NO: 599256 - DNA, 25 bp, Mus musculus
ggaggacttccagagcagagtgtta

SEQ ID NO: 599257 - DNA, 25 bp, Mus musculus
ggaggacttccagcgggttatcaat

SEQ ID NO: 599258 - DNA, 25 bp, Mus musculus
ggaggacttccgcatgtaccaccag

SEQ ID NO: 599259 - DNA, 25 bp, Mus musculus
ggaggacttccggatgtaccaccag

SEQ ID NO: 599260 - DNA, 25 bp, Mus musculus
ggaggacttcgaataggacccaatg

SEQ ID NO: 599261 - DNA, 25 bp, Mus musculus
ggaggacttcgattaggacccaatg

SEQ ID NO: 599262 - DNA, 25 bp, Mus musculus
ggaggacttctaccgagcaagcagt

SEQ ID NO: 599263 - DNA, 25 bp, Mus musculus
ggaggacttctagcgagcaagcagt

SEQ ID NO: 599264 - DNA, 25 bp, Mus musculus
ggaggacttgacataattaaggagc

SEQ ID NO: 599265 - DNA, 25 bp, Mus musculus
ggaggacttgacttaattaaggagc

SEQ ID NO: 599266 - DNA, 25 bp, Mus musculus
ggaggacttggaacagctagaagca

SEQ ID NO: 599267 - DNA, 25 bp, Mus musculus
ggaggacttggaccgcgcggtgaca

SEQ ID NO: 599268 - DNA, 25 bp, Mus musculus
ggaggacttggagcgcgcggtgaca

SEQ ID NO: 599269 - DNA, 25 bp, Mus musculus
ggaggacttggatcagctagaagca

SEQ ID NO: 599270 - DNA, 25 bp, Mus musculus
ggaggactttgtcctctactgcttc

SEQ ID NO: 599271 - DNA, 25 bp, Mus musculus
ggaggactttgtgctctactgcttc

SEQ ID NO: 599272 - DNA, 25 bp, Mus musculus
ggaggacttttcaatgacctggaac

SEQ ID NO: 599273 - DNA, 25 bp, Mus musculus
ggaggacttttctatgacctggaac

SEQ ID NO: 599274 - DNA, 25 bp, Mus musculus
ggaggagaactcagttcccaggacc

SEQ ID NO: 599275 - DNA, 25 bp, Mus musculus
ggaggagaactctgttcccaggacc

SEQ ID NO: 599276 - DNA, 25 bp, Mus musculus
ggaggagaattccaattttagggat

SEQ ID NO: 599277 - DNA, 25 bp, Mus musculus
ggaggagaattcgaattttagggat

SEQ ID NO: 599278 - DNA, 25 bp, Mus musculus
ggaggagacaaacaccccaggagaa

SEQ ID NO: 599279 - DNA, 25 bp, Mus musculus
ggaggagacaaagaccccaggagaa

SEQ ID NO: 599280 - DNA, 25 bp, Mus musculus
ggaggagacacaaggcctgaaattt

SEQ ID NO: 599281 - DNA, 25 bp, Mus musculus
ggaggagacacatggcctgaaattt

SEQ ID NO: 599282 - DNA, 25 bp, Mus musculus
ggaggagacactatatttcaacaaa

SEQ ID NO: 599283 - DNA, 25 bp, Mus musculus
ggaggagacactttatttcaacaaa

SEQ ID NO: 599284 - DNA, 25 bp, Mus musculus
ggaggagacagcatccctgggttct

SEQ ID NO: 599285 - DNA, 25 bp, Mus musculus
ggaggagacagcttccctgggttct

SEQ ID NO: 599286 - DNA, 25 bp, Mus musculus
ggaggagacagtcccctttgctttg

SEQ ID NO: 599287 - DNA, 25 bp, Mus musculus
ggaggagacagtgccctttgctttg

SEQ ID NO: 599288 - DNA, 25 bp, Mus musculus
ggaggagaccctagtacagcacaaa

SEQ ID NO: 599289 - DNA, 25 bp, Mus musculus
ggaggagacccttgtacagcacaaa

SEQ ID NO: 599290 - DNA, 25 bp, Mus musculus
ggaggagaccttccccacaaagcca

SEQ ID NO: 599291 - DNA, 25 bp, Mus musculus
ggaggagaccttgcccacaaagcca

SEQ ID NO: 599292 - DNA, 25 bp, Mus musculus
ggaggagacgttcctcgcttagtcc

SEQ ID NO: 599293 - DNA, 25 bp, Mus musculus
ggaggagacgttgctcgcttagtcc

SEQ ID NO: 599294 - DNA, 25 bp, Mus musculus
ggaggagactcacttcttactgcca

SEQ ID NO: 599295 - DNA, 25 bp, Mus musculus
ggaggagactcagttcttactgcca

SEQ ID NO: 599296 - DNA, 25 bp, Mus musculus
ggaggagagaccaacaccatcggcc

SEQ ID NO: 599297 - DNA, 25 bp, Mus musculus
ggaggagagacctacaccatcggcc

SEQ ID NO: 599298 - DNA, 25 bp, Mus musculus
ggaggagagcataacacattcaatt

SEQ ID NO: 599299 - DNA, 25 bp, Mus musculus
ggaggagagcattacacattcaatt

SEQ ID NO: 599300 - DNA, 25 bp, Mus musculus
ggaggagagcccagtacccttgctg

SEQ ID NO: 599301 - DNA, 25 bp, Mus musculus
ggaggagagcccattctccatgttt

SEQ ID NO: 599302 - DNA, 25 bp, Mus musculus
ggaggagagccctgtacccttgctg

SEQ ID NO: 599303 - DNA, 25 bp, Mus musculus
ggaggagagccctttctccatgttt

SEQ ID NO: 599304 - DNA, 25 bp, Mus musculus
ggaggagagcctcattatttgtaat

SEQ ID NO: 599305 - DNA, 25 bp, Mus musculus
ggaggagagcctgattatttgtaat

SEQ ID NO: 599306 - DNA, 25 bp, Mus musculus
ggaggagaggaaccgccccaacatc

SEQ ID NO: 599307 - DNA, 25 bp, Mus musculus
ggaggagaggaagcgccccaacatc

SEQ ID NO: 599308 - DNA, 25 bp, Mus musculus
ggaggagaggatacaccatacactt

SEQ ID NO: 599309 - DNA, 25 bp, Mus musculus
ggaggagaggattcaccatacactt

SEQ ID NO: 599310 - DNA, 25 bp, Mus musculus
ggaggagaggcacggctggcagcta

SEQ ID NO: 599311 - DNA, 25 bp, Mus musculus
ggaggagaggcagggctggcagcta

SEQ ID NO: 599312 - DNA, 25 bp, Mus musculus
ggaggagaggttatcccccatagcc

SEQ ID NO: 599313 - DNA, 25 bp, Mus musculus
ggaggagaggttttcccccatagcc

SEQ ID NO: 599314 - DNA, 25 bp, Mus musculus
ggaggagagttaatattgcccatta

SEQ ID NO: 599315 - DNA, 25 bp, Mus musculus
ggaggagagttattattgcccatta

SEQ ID NO: 599316 - DNA, 25 bp, Mus musculus
ggaggagataaaacacatcccacaa

SEQ ID NO: 599317 - DNA, 25 bp, Mus musculus
ggaggagataaatcacatcccacaa

SEQ ID NO: 599318 - DNA, 25 bp, Mus musculus
ggaggagatctcatggctcacgcag

SEQ ID NO: 599319 - DNA, 25 bp, Mus musculus
ggaggagatctcttggctcacgcag

SEQ ID NO: 599320 - DNA, 25 bp, Mus musculus
ggaggagatcttcagtctcctttga

SEQ ID NO: 599321 - DNA, 25 bp, Mus musculus
ggaggagatcttgagtctcctttga

SEQ ID NO: 599322 - DNA, 25 bp, Mus musculus
ggaggagatgctcctctgctcaaca

SEQ ID NO: 599323 - DNA, 25 bp, Mus musculus
ggaggagatgctgctctgctcaaca

SEQ ID NO: 599324 - DNA, 25 bp, Mus musculus
ggaggagatggaaccctgtctacag

SEQ ID NO: 599325 - DNA, 25 bp, Mus musculus
ggaggagatggatccctgtctacag

SEQ ID NO: 599326 - DNA, 25 bp, Mus musculus
ggaggagatttccttggccaacctg

SEQ ID NO: 599327 - DNA, 25 bp, Mus musculus
ggaggagatttcgttggccaacctg

SEQ ID NO: 599328 - DNA, 25 bp, Mus musculus
ggaggagcaaacagccttgggactg

SEQ ID NO: 599329 - DNA, 25 bp, Mus musculus
ggaggagcaaactgccttgggactg

SEQ ID NO: 599330 - DNA, 25 bp, Mus musculus
ggaggagcaagcagaatgccaatat

SEQ ID NO: 599331 - DNA, 25 bp, Mus musculus
ggaggagcaagctgaatgccaatat

SEQ ID NO: 599332 - DNA, 25 bp, Mus musculus
ggaggagcaccgcatcaaaatggaa

SEQ ID NO: 599333 - DNA, 25 bp, Mus musculus
ggaggagcaccggatcaaaatggaa

SEQ ID NO: 599334 - DNA, 25 bp, Mus musculus
ggaggagcacttactcatctctgca

SEQ ID NO: 599335 - DNA, 25 bp, Mus musculus
ggaggagcactttctcatctctgca

SEQ ID NO: 599336 - DNA, 25 bp, Mus musculus
ggaggagcagcaacgatcccacgag

SEQ ID NO: 599337 - DNA, 25 bp, Mus musculus
ggaggagcagcaacggactccacgt

SEQ ID NO: 599338 - DNA, 25 bp, Mus musculus
ggaggagcagcatcgatcccacgag

SEQ ID NO: 599339 - DNA, 25 bp, Mus musculus
ggaggagcagcatcggactccacgt

SEQ ID NO: 599340 - DNA, 25 bp, Mus musculus
ggaggagcagtacctcctaactggc

SEQ ID NO: 599341 - DNA, 25 bp, Mus musculus
ggaggagcagtagctcctaactggc

SEQ ID NO: 599342 - DNA, 25 bp, Mus musculus
ggaggagcatccactatcagtattt

SEQ ID NO: 599343 - DNA, 25 bp, Mus musculus
ggaggagcatcctctatcagtattt

SEQ ID NO: 599344 - DNA, 25 bp, Mus musculus
ggaggagcatggcttaccgcctcat

SEQ ID NO: 599345 - DNA, 25 bp, Mus musculus
ggaggagcatgggttaccgcctcat

SEQ ID NO: 599346 - DNA, 25 bp, Mus musculus
ggaggagccaaaacctatttagact

SEQ ID NO: 599347 - DNA, 25 bp, Mus musculus
ggaggagccaaatcctatttagact

SEQ ID NO: 599348 - DNA, 25 bp, Mus musculus
ggaggagccaccagacttcgtgcca

SEQ ID NO: 599349 - DNA, 25 bp, Mus musculus
ggaggagccacctgacttcgtgcca

SEQ ID NO: 599350 - DNA, 25 bp, Mus musculus
ggaggagccattcgaaactcagaaa

SEQ ID NO: 599351 - DNA, 25 bp, Mus musculus
ggaggagccattggaaactcagaaa

SEQ ID NO: 599352 - DNA, 25 bp, Mus musculus
ggaggagccccaagaacttcttgta

SEQ ID NO: 599353 - DNA, 25 bp, Mus musculus
ggaggagccccatgaacttcttgta

SEQ ID NO: 599354 - DNA, 25 bp, Mus musculus
ggaggagccgccaccttaccaagga

SEQ ID NO: 599355 - DNA, 25 bp, Mus musculus
ggaggagccgcctccttaccaagga

SEQ ID NO: 599356 - DNA, 25 bp, Mus musculus
ggaggagcctatactgatttatgat

SEQ ID NO: 599357 - DNA, 25 bp, Mus musculus
ggaggagcctattctgatttatgat

SEQ ID NO: 599358 - DNA, 25 bp, Mus musculus
ggaggagcctgtcaacttgattaaa

SEQ ID NO: 599359 - DNA, 25 bp, Mus musculus
ggaggagcctgtgaacttgattaaa

SEQ ID NO: 599360 - DNA, 25 bp, Mus musculus
ggaggagcctttcttaatgttttca

SEQ ID NO: 599361 - DNA, 25 bp, Mus musculus
ggaggagcctttgttaatgttttca

SEQ ID NO: 599362 - DNA, 25 bp, Mus musculus
ggaggagcgattcccagaccgatcc

SEQ ID NO: 599363 - DNA, 25 bp, Mus musculus
ggaggagcgattgccagaccgatcc

SEQ ID NO: 599364 - DNA, 25 bp, Mus musculus
ggaggagcgctcattatacacagca

SEQ ID NO: 599365 - DNA, 25 bp, Mus musculus
ggaggagcgctctttatacacagca

SEQ ID NO: 599366 - DNA, 25 bp, Mus musculus
ggaggagcgctgattcccagacttc

SEQ ID NO: 599367 - DNA, 25 bp, Mus musculus
ggaggagcgctgtttcccagacttc

SEQ ID NO: 599368 - DNA, 25 bp, Mus musculus
ggaggagcggccatctgactttcct

SEQ ID NO: 599369 - DNA, 25 bp, Mus musculus
ggaggagcggccttctgactttcct

SEQ ID NO: 599370 - DNA, 25 bp, Mus musculus
ggaggagctatgcaccaagatcaca

SEQ ID NO: 599371 - DNA, 25 bp, Mus musculus
ggaggagctatggaccaagatcaca

SEQ ID NO: 599372 - DNA, 25 bp, Mus musculus
ggaggagctcacaggttgataactt

SEQ ID NO: 599373 - DNA, 25 bp, Mus musculus
ggaggagctcactggttgataactt

SEQ ID NO: 599374 - DNA, 25 bp, Mus musculus
ggaggagctcagaccttactgcttg

SEQ ID NO: 599375 - DNA, 25 bp, Mus musculus
ggaggagctcagtccttactgcttg

SEQ ID NO: 599376 - DNA, 25 bp, Mus musculus
ggaggagctccgagcatctgatcca

SEQ ID NO: 599377 - DNA, 25 bp, Mus musculus
ggaggagctccgtgcatctgatcca

SEQ ID NO: 599378 - DNA, 25 bp, Mus musculus
ggaggagctcttccggcacatgttt

SEQ ID NO: 599379 - DNA, 25 bp, Mus musculus
ggaggagctcttgcggcacatgttt

SEQ ID NO: 599380 - DNA, 25 bp, Mus musculus
ggaggagctgatattcctaaagaga

SEQ ID NO: 599381 - DNA, 25 bp, Mus musculus
ggaggagctgattttcctaaagaga

SEQ ID NO: 599382 - DNA, 25 bp, Mus musculus
ggaggagctgcgaaccacagcgccc

SEQ ID NO: 599383 - DNA, 25 bp, Mus musculus
ggaggagctgcgctctttgctcaca

SEQ ID NO: 599384 - DNA, 25 bp, Mus musculus
ggaggagctgcggtctttgctcaca

SEQ ID NO: 599385 - DNA, 25 bp, Mus musculus
ggaggagctgcgtaccacagcgccc

SEQ ID NO: 599386 - DNA, 25 bp, Mus musculus
ggaggagctgtaccccccagctttg

SEQ ID NO: 599387 - DNA, 25 bp, Mus musculus
ggaggagctgtagcccccagctttg

SEQ ID NO: 599388 - DNA, 25 bp, Mus musculus
ggaggagctgtcatctgtttcattc

SEQ ID NO: 599389 - DNA, 25 bp, Mus musculus
ggaggagctgtcttctgtttcattc

SEQ ID NO: 599390 - DNA, 25 bp, Mus musculus
ggaggaggaaatcccttcatacttg

SEQ ID NO: 599391 - DNA, 25 bp, Mus musculus
ggaggaggaaatgccttcatacttg

SEQ ID NO: 599392 - DNA, 25 bp, Mus musculus
ggaggaggaaccaacaaagccagtc

SEQ ID NO: 599393 - DNA, 25 bp, Mus musculus
ggaggaggaaccactggctctgtcc

SEQ ID NO: 599394 - DNA, 25 bp, Mus musculus
ggaggaggaacctacaaagccagtc

SEQ ID NO: 599395 - DNA, 25 bp, Mus musculus
ggaggaggaacctctggctctgtcc

SEQ ID NO: 599396 - DNA, 25 bp, Mus musculus
ggaggaggaactaagagcatacaca

SEQ ID NO: 599397 - DNA, 25 bp, Mus musculus
ggaggaggaacttagagcatacaca

SEQ ID NO: 599398 - DNA, 25 bp, Mus musculus
ggaggaggacctccaagcccagatt

SEQ ID NO: 599399 - DNA, 25 bp, Mus musculus
ggaggaggacctgcaagcccagatt

SEQ ID NO: 599400 - DNA, 25 bp, Mus musculus
ggaggaggactgacagcctccctga

SEQ ID NO: 599401 - DNA, 25 bp, Mus musculus
ggaggaggactgtcagcctccctga

SEQ ID NO: 599402 - DNA, 25 bp, Mus musculus
ggaggaggcatcaagcacaagaaaa

SEQ ID NO: 599403 - DNA, 25 bp, Mus musculus
ggaggaggcatctagcacaagaaaa

SEQ ID NO: 599404 - DNA, 25 bp, Mus musculus
ggaggaggccccaacttgataagga

SEQ ID NO: 599405 - DNA, 25 bp, Mus musculus
ggaggaggcccctacttgataagga

SEQ ID NO: 599406 - DNA, 25 bp, Mus musculus
ggaggaggcgttctgatttctacat

SEQ ID NO: 599407 - DNA, 25 bp, Mus musculus
ggaggaggcgttgtgatttctacat

SEQ ID NO: 599408 - DNA, 25 bp, Mus musculus
ggaggaggctcaaccgctacgtgac

SEQ ID NO: 599409 - DNA, 25 bp, Mus musculus
ggaggaggctcatccgctacgtgac

SEQ ID NO: 599410 - DNA, 25 bp, Mus musculus
ggaggaggctccctcattgtcctat

SEQ ID NO: 599411 - DNA, 25 bp, Mus musculus
ggaggaggctccgtcattgtcctat

SEQ ID NO: 599412 - DNA, 25 bp, Mus musculus
ggaggaggctgcagaatacgctaaa

SEQ ID NO: 599413 - DNA, 25 bp, Mus musculus
ggaggaggctgctgaatacgctaaa

SEQ ID NO: 599414 - DNA, 25 bp, Mus musculus
ggaggaggcttaaaccatgtttctg

SEQ ID NO: 599415 - DNA, 25 bp, Mus musculus
ggaggaggcttataccatgtttctg

SEQ ID NO: 599416 - DNA, 25 bp, Mus musculus
ggaggagggcatcgctttcaccata

SEQ ID NO: 599417 - DNA, 25 bp, Mus musculus
ggaggagggcatggctttcaccata

SEQ ID NO: 599418 - DNA, 25 bp, Mus musculus
ggaggaggtcataatcagctggtca

SEQ ID NO: 599419 - DNA, 25 bp, Mus musculus
ggaggaggtcattatcagctggtca

SEQ ID NO: 599420 - DNA, 25 bp, Mus musculus
ggaggaggtcccactgccgcagact

SEQ ID NO: 599421 - DNA, 25 bp, Mus musculus
ggaggaggtccctctgccgcagact

SEQ ID NO: 599422 - DNA, 25 bp, Mus musculus
ggaggaggtcctactaaactggtgt

SEQ ID NO: 599423 - DNA, 25 bp, Mus musculus
ggaggaggtccttctaaactggtgt

SEQ ID NO: 599424 - DNA, 25 bp, Mus musculus
ggaggaggtcttcctcctcttggct

SEQ ID NO: 599425 - DNA, 25 bp, Mus musculus
ggaggaggtcttgctcctcttggct

SEQ ID NO: 599426 - DNA, 25 bp, Mus musculus
ggaggaggtggcacctaccctgcct

SEQ ID NO: 599427 - DNA, 25 bp, Mus musculus
ggaggaggtggctcctaccctgcct

SEQ ID NO: 599428 - DNA, 25 bp, Mus musculus
ggaggaggtgtccagcatattccca

SEQ ID NO: 599429 - DNA, 25 bp, Mus musculus
ggaggaggtgtcgagcatattccca

SEQ ID NO: 599430 - DNA, 25 bp, Mus musculus
ggaggaggtgttcctatatttctcc

SEQ ID NO: 599431 - DNA, 25 bp, Mus musculus
ggaggaggtgttgctatatttctcc

SEQ ID NO: 599432 - DNA, 25 bp, Mus musculus
ggaggagtacagcaccgacgaggac

SEQ ID NO: 599433 - DNA, 25 bp, Mus musculus
ggaggagtacaggaccgacgaggac

SEQ ID NO: 599434 - DNA, 25 bp, Mus musculus
ggaggagtacttagagtgtgtccat

SEQ ID NO: 599435 - DNA, 25 bp, Mus musculus
ggaggagtacttcagctccactccg

SEQ ID NO: 599436 - DNA, 25 bp, Mus musculus
ggaggagtacttgagctccactccg

SEQ ID NO: 599437 - DNA, 25 bp, Mus musculus
ggaggagtactttgagtgtgtccat

SEQ ID NO: 599438 - DNA, 25 bp, Mus musculus
ggaggagtataaacacgaccccaca

SEQ ID NO: 599439 - DNA, 25 bp, Mus musculus
ggaggagtataatcacgaccccaca

SEQ ID NO: 599440 - DNA, 25 bp, Mus musculus
ggaggagtcactatgctcaaaccca

SEQ ID NO: 599441 - DNA, 25 bp, Mus musculus
ggaggagtcactttgctcaaaccca

SEQ ID NO: 599442 - DNA, 25 bp, Mus musculus
ggaggagtccaacagatttcacaga

SEQ ID NO: 599443 - DNA, 25 bp, Mus musculus
ggaggagtccaagagatttcacaga

SEQ ID NO: 599444 - DNA, 25 bp, Mus musculus
ggaggagtcctcaagtggaattctt

SEQ ID NO: 599445 - DNA, 25 bp, Mus musculus
ggaggagtcctctagtggaattctt

SEQ ID NO: 599446 - DNA, 25 bp, Mus musculus
ggaggagtcgccatccaagccttag

SEQ ID NO: 599447 - DNA, 25 bp, Mus musculus
ggaggagtcgccttccaagccttag

SEQ ID NO: 599448 - DNA, 25 bp, Mus musculus
ggaggagtgctcactcccggccacg

SEQ ID NO: 599449 - DNA, 25 bp, Mus musculus
ggaggagtgctctctcccggccacg

SEQ ID NO: 599450 - DNA, 25 bp, Mus musculus
ggaggagtgctgagacctgccccaa

SEQ ID NO: 599451 - DNA, 25 bp, Mus musculus
ggaggagtgctgtgacctgccccaa

SEQ ID NO: 599452 - DNA, 25 bp, Mus musculus
ggaggagtgtcacgctcaccagatt

SEQ ID NO: 599453 - DNA, 25 bp, Mus musculus
ggaggagtgtcaggctcaccagatt

SEQ ID NO: 599454 - DNA, 25 bp, Mus musculus
ggaggagtgtttacccacctactga

SEQ ID NO: 599455 - DNA, 25 bp, Mus musculus
ggaggagtgttttcccacctactga

SEQ ID NO: 599456 - DNA, 25 bp, Mus musculus
ggaggagttaacctgtcccatctgt

SEQ ID NO: 599457 - DNA, 25 bp, Mus musculus
ggaggagttaacgtgtcccatctgt

SEQ ID NO: 599458 - DNA, 25 bp, Mus musculus
ggaggagttactactctcagagtgt

SEQ ID NO: 599459 - DNA, 25 bp, Mus musculus
ggaggagttacttctctcagagtgt

SEQ ID NO: 599460 - DNA, 25 bp, Mus musculus
ggaggagttcccagttttgacacat

SEQ ID NO: 599461 - DNA, 25 bp, Mus musculus
ggaggagttccctgttttgacacat

SEQ ID NO: 599462 - DNA, 25 bp, Mus musculus
ggaggagttgcaacattcatttgtc

SEQ ID NO: 599463 - DNA, 25 bp, Mus musculus
ggaggagttgcatcattcatttgtc

SEQ ID NO: 599464 - DNA, 25 bp, Mus musculus
ggaggagtttcaacctaccaaccat

SEQ ID NO: 599465 - DNA, 25 bp, Mus musculus
ggaggagtttcatcctaccaaccat

SEQ ID NO: 599466 - DNA, 25 bp, Mus musculus
ggaggataaccccaagtccctgaag

SEQ ID NO: 599467 - DNA, 25 bp, Mus musculus
ggaggataacccgaagtccctgaag

SEQ ID NO: 599468 - DNA, 25 bp, Mus musculus
ggaggataattccacgactatgatt

SEQ ID NO: 599469 - DNA, 25 bp, Mus musculus
ggaggataattcgacgactatgatt

SEQ ID NO: 599470 - DNA, 25 bp, Mus musculus
ggaggatactctaaccattctggga

SEQ ID NO: 599471 - DNA, 25 bp, Mus musculus
ggaggatactcttaccattctggga

SEQ ID NO: 599472 - DNA, 25 bp, Mus musculus
ggaggatagctacttcaaggccaag

SEQ ID NO: 599473 - DNA, 25 bp, Mus musculus
ggaggatagctagttcaaggccaag

SEQ ID NO: 599474 - DNA, 25 bp, Mus musculus
ggaggataggtcaggtgcgttatct

SEQ ID NO: 599475 - DNA, 25 bp, Mus musculus
ggaggataggtctggtgcgttatct

SEQ ID NO: 599476 - DNA, 25 bp, Mus musculus
ggaggatatcacaaaccctgggctc

SEQ ID NO: 599477 - DNA, 25 bp, Mus musculus
ggaggatatcactaaccctgggctc

SEQ ID NO: 599478 - DNA, 25 bp, Mus musculus
ggaggatatctgagtctccctttct

SEQ ID NO: 599479 - DNA, 25 bp, Mus musculus
ggaggatatctgcaacagcctttct

SEQ ID NO: 599480 - DNA, 25 bp, Mus musculus
ggaggatatctggaacagcctttct

SEQ ID NO: 599481 - DNA, 25 bp, Mus musculus
ggaggatatctgtgtctccctttct

SEQ ID NO: 599482 - DNA, 25 bp, Mus musculus
ggaggatatggaccccaatgccaca

SEQ ID NO: 599483 - DNA, 25 bp, Mus musculus
ggaggatatggagcccaatgccaca

SEQ ID NO: 599484 - DNA, 25 bp, Mus musculus
ggaggatcaaccagaacgaccagtg

SEQ ID NO: 599485 - DNA, 25 bp, Mus musculus
ggaggatcaacctgaacgaccagtg

SEQ ID NO: 599486 - DNA, 25 bp, Mus musculus
ggaggatcacacctgtccctacaca

SEQ ID NO: 599487 - DNA, 25 bp, Mus musculus
ggaggatcacacgtgtccctacaca

SEQ ID NO: 599488 - DNA, 25 bp, Mus musculus
ggaggatcacagacatcttgaacta

SEQ ID NO: 599489 - DNA, 25 bp, Mus musculus
ggaggatcacagtcatcttgaacta

SEQ ID NO: 599490 - DNA, 25 bp, Mus musculus
ggaggatcagacaccctctcttgag

SEQ ID NO: 599491 - DNA, 25 bp, Mus musculus
ggaggatcagactccctctcttgag

SEQ ID NO: 599492 - DNA, 25 bp, Mus musculus
ggaggatcagcacagggtcaactat

SEQ ID NO: 599493 - DNA, 25 bp, Mus musculus
ggaggatcagcagagggtcaactat

SEQ ID NO: 599494 - DNA, 25 bp, Mus musculus
ggaggatcagggataaccagtgaat

SEQ ID NO: 599495 - DNA, 25 bp, Mus musculus
ggaggatcagggttaaccagtgaat

SEQ ID NO: 599496 - DNA, 25 bp, Mus musculus
ggaggatcatccaatgagttactaa

SEQ ID NO: 599497 - DNA, 25 bp, Mus musculus
ggaggatcatccaggccagtcacgg

SEQ ID NO: 599498 - DNA, 25 bp, Mus musculus
ggaggatcatcctatgagttactaa

SEQ ID NO: 599499 - DNA, 25 bp, Mus musculus
ggaggatcatcctggccagtcacgg

SEQ ID NO: 599500 - DNA, 25 bp, Mus musculus
ggaggatcatcgcagatacagctgt

SEQ ID NO: 599501 - DNA, 25 bp, Mus musculus
ggaggatcatcggagatacagctgt

SEQ ID NO: 599502 - DNA, 25 bp, Mus musculus
ggaggatcatgcatctggcaaggaa

SEQ ID NO: 599503 - DNA, 25 bp, Mus musculus
ggaggatcatgcttctggcaaggaa

SEQ ID NO: 599504 - DNA, 25 bp, Mus musculus
ggaggatccagcacctaaactgttt

SEQ ID NO: 599505 - DNA, 25 bp, Mus musculus
ggaggatccagctcctaaactgttt

SEQ ID NO: 599506 - DNA, 25 bp, Mus musculus
ggaggatccccaaaggcagtcacca

SEQ ID NO: 599507 - DNA, 25 bp, Mus musculus
ggaggatccccataggcagtcacca

SEQ ID NO: 599508 - DNA, 25 bp, Mus musculus
ggaggatcgcttcgcattactgact

SEQ ID NO: 599509 - DNA, 25 bp, Mus musculus
ggaggatcgcttggcattactgact

SEQ ID NO: 599510 - DNA, 25 bp, Mus musculus
ggaggatcgtcaacggccagtattc

SEQ ID NO: 599511 - DNA, 25 bp, Mus musculus
ggaggatcgtcatcggccagtattc

SEQ ID NO: 599512 - DNA, 25 bp, Mus musculus
ggaggatctaaccttaccagcaacc

SEQ ID NO: 599513 - DNA, 25 bp, Mus musculus
ggaggatctaacgttaccagcaacc

SEQ ID NO: 599514 - DNA, 25 bp, Mus musculus
ggaggatctaatacatgagatctat

SEQ ID NO: 599515 - DNA, 25 bp, Mus musculus
ggaggatctaattcatgagatctat

SEQ ID NO: 599516 - DNA, 25 bp, Mus musculus
ggaggatctactcctgtacagctaa

SEQ ID NO: 599517 - DNA, 25 bp, Mus musculus
ggaggatctactgctgtacagctaa

SEQ ID NO: 599518 - DNA, 25 bp, Mus musculus
ggaggatctctacaaaatcaagttc

SEQ ID NO: 599519 - DNA, 25 bp, Mus musculus
ggaggatctctagaaaatcaagttc

SEQ ID NO: 599520 - DNA, 25 bp, Mus musculus
ggaggatctgccatgatgaagctca

SEQ ID NO: 599521 - DNA, 25 bp, Mus musculus
ggaggatctgccttgatgaagctca

SEQ ID NO: 599522 - DNA, 25 bp, Mus musculus
ggaggatctgggattccaaacctga

SEQ ID NO: 599523 - DNA, 25 bp, Mus musculus
ggaggatctgggtttccaaacctga

SEQ ID NO: 599524 - DNA, 25 bp, Mus musculus
ggaggatgaaccatctgaccaacac

SEQ ID NO: 599525 - DNA, 25 bp, Mus musculus
ggaggatgaaccttctgaccaacac

SEQ ID NO: 599526 - DNA, 25 bp, Mus musculus
ggaggatgcaccctctacagacatc

SEQ ID NO: 599527 - DNA, 25 bp, Mus musculus
ggaggatgcaccgtctacagacatc

SEQ ID NO: 599528 - DNA, 25 bp, Mus musculus
ggaggatgcacgcagccaaccagat

SEQ ID NO: 599529 - DNA, 25 bp, Mus musculus
ggaggatgcacggagccaaccagat

SEQ ID NO: 599530 - DNA, 25 bp, Mus musculus
ggaggatgccttatacacactggta

SEQ ID NO: 599531 - DNA, 25 bp, Mus musculus
ggaggatgccttttacacactggta

SEQ ID NO: 599532 - DNA, 25 bp, Mus musculus
ggaggatgctctctggtcctgatgc

SEQ ID NO: 599533 - DNA, 25 bp, Mus musculus
ggaggatgctctgtggtcctgatgc

SEQ ID NO: 599534 - DNA, 25 bp, Mus musculus
ggaggatgctgcacgtgccattgca

SEQ ID NO: 599535 - DNA, 25 bp, Mus musculus
ggaggatgctgctcgtgccattgca

SEQ ID NO: 599536 - DNA, 25 bp, Mus musculus
ggaggatgtgatccaagacctgatc

SEQ ID NO: 599537 - DNA, 25 bp, Mus musculus
ggaggatgtgatgcaagacctgatc

SEQ ID NO: 599538 - DNA, 25 bp, Mus musculus
ggaggatgtgcgaccccgcgggccg

SEQ ID NO: 599539 - DNA, 25 bp, Mus musculus
ggaggatgtgcgtccccgcgggccg

SEQ ID NO: 599540 - DNA, 25 bp, Mus musculus
ggaggattactgagcattccaggat

SEQ ID NO: 599541 - DNA, 25 bp, Mus musculus
ggaggattactgtgcattccaggat

SEQ ID NO: 599542 - DNA, 25 bp, Mus musculus
ggaggattatcacaagtccctggag

SEQ ID NO: 599543 - DNA, 25 bp, Mus musculus
ggaggattatcagaagtccctggag

SEQ ID NO: 599544 - DNA, 25 bp, Mus musculus
ggaggattccaaagtccgagccatc

SEQ ID NO: 599545 - DNA, 25 bp, Mus musculus
ggaggattccaatgtccgagccatc

SEQ ID NO: 599546 - DNA, 25 bp, Mus musculus
ggaggattccagacttcacagtcga

SEQ ID NO: 599547 - DNA, 25 bp, Mus musculus
ggaggattccagtcttcacagtcga

SEQ ID NO: 599548 - DNA, 25 bp, Mus musculus
ggaggattcctaagcttgagtttat

SEQ ID NO: 599549 - DNA, 25 bp, Mus musculus
ggaggattcctaatggaggtgtcaa

SEQ ID NO: 599550 - DNA, 25 bp, Mus musculus
ggaggattcctatgcttgagtttat

SEQ ID NO: 599551 - DNA, 25 bp, Mus musculus
ggaggattcctattggaggtgtcaa

SEQ ID NO: 599552 - DNA, 25 bp, Mus musculus
ggaggattccttcatggtttttgct

SEQ ID NO: 599553 - DNA, 25 bp, Mus musculus
ggaggattccttgatggtttttgct

SEQ ID NO: 599554 - DNA, 25 bp, Mus musculus
ggaggattcgcactcagggttttta

SEQ ID NO: 599555 - DNA, 25 bp, Mus musculus
ggaggattcgcagtcagggttttta

SEQ ID NO: 599556 - DNA, 25 bp, Mus musculus
ggaggattctctataccactctgac

SEQ ID NO: 599557 - DNA, 25 bp, Mus musculus
ggaggattctctttaccactctgac

SEQ ID NO: 599558 - DNA, 25 bp, Mus musculus
ggaggattctgtagtgatcatctta

SEQ ID NO: 599559 - DNA, 25 bp, Mus musculus
ggaggattctgttgtgatcatctta

SEQ ID NO: 599560 - DNA, 25 bp, Mus musculus
ggaggattgcttctaatctggtgtt

SEQ ID NO: 599561 - DNA, 25 bp, Mus musculus
ggaggattgcttgtaatctggtgtt

SEQ ID NO: 599562 - DNA, 25 bp, Mus musculus
ggaggattggatatcttagttctag

SEQ ID NO: 599563 - DNA, 25 bp, Mus musculus
ggaggattggatttcttagttctag

SEQ ID NO: 599564 - DNA, 25 bp, Mus musculus
ggaggatttagtccctgccttagaa

SEQ ID NO: 599565 - DNA, 25 bp, Mus musculus
ggaggatttagtgcctgccttagaa

SEQ ID NO: 599566 - DNA, 25 bp, Mus musculus
ggaggatttcccaagcatgctcgag

SEQ ID NO: 599567 - DNA, 25 bp, Mus musculus
ggaggatttccctagcatgctcgag

SEQ ID NO: 599568 - DNA, 25 bp, Mus musculus
ggaggatttcttccctgcaatttaa

SEQ ID NO: 599569 - DNA, 25 bp, Mus musculus
ggaggatttcttgcctgcaatttaa

SEQ ID NO: 599570 - DNA, 25 bp, Mus musculus
ggaggatttggcaccttttggccca

SEQ ID NO: 599571 - DNA, 25 bp, Mus musculus
ggaggatttggctccttttggccca

SEQ ID NO: 599572 - DNA, 25 bp, Mus musculus
ggaggatttgggaatgctttgtaaa

SEQ ID NO: 599573 - DNA, 25 bp, Mus musculus
ggaggatttgggtatgctttgtaaa

SEQ ID NO: 599574 - DNA, 25 bp, Mus musculus
ggaggattttgtcccatgtatgaaa

SEQ ID NO: 599575 - DNA, 25 bp, Mus musculus
ggaggattttgtgccatgtatgaaa

SEQ ID NO: 599576 - DNA, 25 bp, Mus musculus
ggaggatttttcaggctacgacttt

SEQ ID NO: 599577 - DNA, 25 bp, Mus musculus
ggaggatttttccagcatccagcca

SEQ ID NO: 599578 - DNA, 25 bp, Mus musculus
ggaggatttttcgagcatccagcca

SEQ ID NO: 599579 - DNA, 25 bp, Mus musculus
ggaggatttttctggctacgacttt

SEQ ID NO: 599580 - DNA, 25 bp, Mus musculus
ggaggatttttgactgcttttcact

SEQ ID NO: 599581 - DNA, 25 bp, Mus musculus
ggaggatttttgtctgcttttcact

SEQ ID NO: 599582 - DNA, 25 bp, Mus musculus
ggaggcaacagaaacccgggctgct

SEQ ID NO: 599583 - DNA, 25 bp, Mus musculus
ggaggcaacagatacccgggctgct

SEQ ID NO: 599584 - DNA, 25 bp, Mus musculus
ggaggcaaccacatgaccacaggga

SEQ ID NO: 599585 - DNA, 25 bp, Mus musculus
ggaggcaaccacttgaccacaggga

SEQ ID NO: 599586 - DNA, 25 bp, Mus musculus
ggaggcaactatcttctcaacattg

SEQ ID NO: 599587 - DNA, 25 bp, Mus musculus
ggaggcaactatgttctcaacattg

SEQ ID NO: 599588 - DNA, 25 bp, Mus musculus
ggaggcaactggagtctgctctcac

SEQ ID NO: 599589 - DNA, 25 bp, Mus musculus
ggaggcaactggtgtctgctctcac

SEQ ID NO: 599590 - DNA, 25 bp, Mus musculus
ggaggcaacttccatcggagtcctg

SEQ ID NO: 599591 - DNA, 25 bp, Mus musculus
ggaggcaacttcgatcggagtcctg

SEQ ID NO: 599592 - DNA, 25 bp, Mus musculus
ggaggcaagatgaccccacgacctg

SEQ ID NO: 599593 - DNA, 25 bp, Mus musculus
ggaggcaagatgtccccacgacctg

SEQ ID NO: 599594 - DNA, 25 bp, Mus musculus
ggaggcaaggaccttcatcacttct

SEQ ID NO: 599595 - DNA, 25 bp, Mus musculus
ggaggcaaggacgttcatcacttct

SEQ ID NO: 599596 - DNA, 25 bp, Mus musculus
ggaggcaagtttctcttaccttgaa

SEQ ID NO: 599597 - DNA, 25 bp, Mus musculus
ggaggcaagtttgtcttaccttgaa

SEQ ID NO: 599598 - DNA, 25 bp, Mus musculus
ggaggcaatgacctggattacaata

SEQ ID NO: 599599 - DNA, 25 bp, Mus musculus
ggaggcaatgacgtggattacaata

SEQ ID NO: 599600 - DNA, 25 bp, Mus musculus
ggaggcaatgcccagcgaacgattt

SEQ ID NO: 599601 - DNA, 25 bp, Mus musculus
ggaggcaatgccgagcgaacgattt

SEQ ID NO: 599602 - DNA, 25 bp, Mus musculus
ggaggcaattctccagttgaggttc

SEQ ID NO: 599603 - DNA, 25 bp, Mus musculus
ggaggcaattctgcagttgaggttc

SEQ ID NO: 599604 - DNA, 25 bp, Mus musculus
ggaggcaattgcatttaactgctta

SEQ ID NO: 599605 - DNA, 25 bp, Mus musculus
ggaggcaattgcttttaactgctta

SEQ ID NO: 599606 - DNA, 25 bp, Mus musculus
ggaggcacaggaaacctggcatttt

SEQ ID NO: 599607 - DNA, 25 bp, Mus musculus
ggaggcacaggatacctggcatttt

SEQ ID NO: 599608 - DNA, 25 bp, Mus musculus
ggaggcacatgcataatctccatgt

SEQ ID NO: 599609 - DNA, 25 bp, Mus musculus
ggaggcacatgcttaatctccatgt

SEQ ID NO: 599610 - DNA, 25 bp, Mus musculus
ggaggcaccaacacctagaggtctt

SEQ ID NO: 599611 - DNA, 25 bp, Mus musculus
ggaggcaccaactcctagaggtctt

SEQ ID NO: 599612 - DNA, 25 bp, Mus musculus
ggaggcaccacccatggagaagcct

SEQ ID NO: 599613 - DNA, 25 bp, Mus musculus
ggaggcaccaccgatggagaagcct

SEQ ID NO: 599614 - DNA, 25 bp, Mus musculus
ggaggcaccactcgacaaggcctgt

SEQ ID NO: 599615 - DNA, 25 bp, Mus musculus
ggaggcaccactggacaaggcctgt

SEQ ID NO: 599616 - DNA, 25 bp, Mus musculus
ggaggcacctccaagttactgatag

SEQ ID NO: 599617 - DNA, 25 bp, Mus musculus
ggaggcacctccagtacctgggccg

SEQ ID NO: 599618 - DNA, 25 bp, Mus musculus
ggaggcacctcctagttactgatag

SEQ ID NO: 599619 - DNA, 25 bp, Mus musculus
ggaggcacctcctgtacctgggccg

SEQ ID NO: 599620 - DNA, 25 bp, Mus musculus
ggaggcacctgcatggaatccctgc

SEQ ID NO: 599621 - DNA, 25 bp, Mus musculus
ggaggcacctgcttggaatccctgc

SEQ ID NO: 599622 - DNA, 25 bp, Mus musculus
ggaggcacctgtattgtaaaatgct

SEQ ID NO: 599623 - DNA, 25 bp, Mus musculus
ggaggcacctgttttgtaaaatgct

SEQ ID NO: 599624 - DNA, 25 bp, Mus musculus
ggaggcactaagcatcttggtttaa

SEQ ID NO: 599625 - DNA, 25 bp, Mus musculus
ggaggcactaaggatcttggtttaa

SEQ ID NO: 599626 - DNA, 25 bp, Mus musculus
ggaggcactcagaagctgcttgtta

SEQ ID NO: 599627 - DNA, 25 bp, Mus musculus
ggaggcactcagagacattaagcaa

SEQ ID NO: 599628 - DNA, 25 bp, Mus musculus
ggaggcactcagtagctgcttgtta

SEQ ID NO: 599629 - DNA, 25 bp, Mus musculus
ggaggcactcagtgacattaagcaa

SEQ ID NO: 599630 - DNA, 25 bp, Mus musculus
ggaggcactccaaagtgatttcaga

SEQ ID NO: 599631 - DNA, 25 bp, Mus musculus
ggaggcactccatagtgatttcaga

SEQ ID NO: 599632 - DNA, 25 bp, Mus musculus
ggaggcactctaagcaaacaataat

SEQ ID NO: 599633 - DNA, 25 bp, Mus musculus
ggaggcactctatgcaaacaataat

SEQ ID NO: 599634 - DNA, 25 bp, Mus musculus
ggaggcagaaaccacacagcaggac

SEQ ID NO: 599635 - DNA, 25 bp, Mus musculus
ggaggcagaaacgacacagcaggac

SEQ ID NO: 599636 - DNA, 25 bp, Mus musculus
ggaggcagaagcaagtgactctttg

SEQ ID NO: 599637 - DNA, 25 bp, Mus musculus
ggaggcagaagctagtgactctttg

SEQ ID NO: 599638 - DNA, 25 bp, Mus musculus
ggaggcagaccaccctgacagattt

SEQ ID NO: 599639 - DNA, 25 bp, Mus musculus
ggaggcagaccagcctgacagattt

SEQ ID NO: 599640 - DNA, 25 bp, Mus musculus
ggaggcagaccgattgtaagagaca

SEQ ID NO: 599641 - DNA, 25 bp, Mus musculus
ggaggcagaccgtttgtaagagaca

SEQ ID NO: 599642 - DNA, 25 bp, Mus musculus
ggaggcagagaaccgatcatcagtc

SEQ ID NO: 599643 - DNA, 25 bp, Mus musculus
ggaggcagagaagcgatcatcagtc

SEQ ID NO: 599644 - DNA, 25 bp, Mus musculus
ggaggcagagctcggtaccaacact

SEQ ID NO: 599645 - DNA, 25 bp, Mus musculus
ggaggcagagctgggtaccaacact

SEQ ID NO: 599646 - DNA, 25 bp, Mus musculus
ggaggcagcacaaactcagcatcta

SEQ ID NO: 599647 - DNA, 25 bp, Mus musculus
ggaggcagcacatactcagcatcta

SEQ ID NO: 599648 - DNA, 25 bp, Mus musculus
ggaggcagcactaagtcccagcact

SEQ ID NO: 599649 - DNA, 25 bp, Mus musculus
ggaggcagcacttagtcccagcact

SEQ ID NO: 599650 - DNA, 25 bp, Mus musculus
ggaggcagcagaacccagaccatca

SEQ ID NO: 599651 - DNA, 25 bp, Mus musculus
ggaggcagcagactgaactagcaca

SEQ ID NO: 599652 - DNA, 25 bp, Mus musculus
ggaggcagcagagtgaactagcaca

SEQ ID NO: 599653 - DNA, 25 bp, Mus musculus
ggaggcagcagatcccagaccatca

SEQ ID NO: 599654 - DNA, 25 bp, Mus musculus
ggaggcagccttcttaaaatcttca

SEQ ID NO: 599655 - DNA, 25 bp, Mus musculus
ggaggcagccttgttaaaatcttca

SEQ ID NO: 599656 - DNA, 25 bp, Mus musculus
ggaggcaggagaatgccccttcctc

SEQ ID NO: 599657 - DNA, 25 bp, Mus musculus
ggaggcaggagattgccccttcctc

SEQ ID NO: 599658 - DNA, 25 bp, Mus musculus
ggaggcaggcataatccggatgctt

SEQ ID NO: 599659 - DNA, 25 bp, Mus musculus
ggaggcaggcattatccggatgctt

SEQ ID NO: 599660 - DNA, 25 bp, Mus musculus
ggaggcaggctcactatattgcctt

SEQ ID NO: 599661 - DNA, 25 bp, Mus musculus
ggaggcaggctctctatattgcctt

SEQ ID NO: 599662 - DNA, 25 bp, Mus musculus
ggaggcagtagtctggatccttcat

SEQ ID NO: 599663 - DNA, 25 bp, Mus musculus
ggaggcagtagtgtggatccttcat

SEQ ID NO: 599664 - DNA, 25 bp, Mus musculus
ggaggcagtcagacttgtaccaagc

SEQ ID NO: 599665 - DNA, 25 bp, Mus musculus
ggaggcagtcagtcttgtaccaagc

SEQ ID NO: 599666 - DNA, 25 bp, Mus musculus
ggaggcagtgtcaaaccagcaagga

SEQ ID NO: 599667 - DNA, 25 bp, Mus musculus
ggaggcagtgtctaaccagcaagga

SEQ ID NO: 599668 - DNA, 25 bp, Mus musculus
ggaggcagtgttaagtgtcctgaat

SEQ ID NO: 599669 - DNA, 25 bp, Mus musculus
ggaggcagtgtttagtgtcctgaat

SEQ ID NO: 599670 - DNA, 25 bp, Mus musculus
ggaggcagttcaactactcactgga

SEQ ID NO: 599671 - DNA, 25 bp, Mus musculus
ggaggcagttcatctactcactgga

SEQ ID NO: 599672 - DNA, 25 bp, Mus musculus
ggaggcagttttatgcctgttctct

SEQ ID NO: 599673 - DNA, 25 bp, Mus musculus
ggaggcagttttttgcctgttctct

SEQ ID NO: 599674 - DNA, 25 bp, Mus musculus
ggaggcatatagaacaagtggctgt

SEQ ID NO: 599675 - DNA, 25 bp, Mus musculus
ggaggcatatagtacaagtggctgt

SEQ ID NO: 599676 - DNA, 25 bp, Mus musculus
ggaggcatcaaactggaaaggcttc

SEQ ID NO: 599677 - DNA, 25 bp, Mus musculus
ggaggcatcaaagtggaaaggcttc

SEQ ID NO: 599678 - DNA, 25 bp, Mus musculus
ggaggcatcccaacacagcttccag

SEQ ID NO: 599679 - DNA, 25 bp, Mus musculus
ggaggcatcccatcacagcttccag

SEQ ID NO: 599680 - DNA, 25 bp, Mus musculus
ggaggcatccttcttgtattgtgtg

SEQ ID NO: 599681 - DNA, 25 bp, Mus musculus
ggaggcatccttgttgtattgtgtg

SEQ ID NO: 599682 - DNA, 25 bp, Mus musculus
ggaggcatctagaccatagcagtag

SEQ ID NO: 599683 - DNA, 25 bp, Mus musculus
ggaggcatctagtccatagcagtag

SEQ ID NO: 599684 - DNA, 25 bp, Mus musculus
ggaggcatctggctaattatgcaaa

SEQ ID NO: 599685 - DNA, 25 bp, Mus musculus
ggaggcatctgggtaattatgcaaa

SEQ ID NO: 599686 - DNA, 25 bp, Mus musculus
ggaggcatcttccatctagaccatg

SEQ ID NO: 599687 - DNA, 25 bp, Mus musculus
ggaggcatcttcgatctagaccatg

SEQ ID NO: 599688 - DNA, 25 bp, Mus musculus
ggaggcatgattctcatcacgtcca

SEQ ID NO: 599689 - DNA, 25 bp, Mus musculus
ggaggcatgattgtcatcacgtcca

SEQ ID NO: 599690 - DNA, 25 bp, Mus musculus
ggaggcatggttatctagttccttg

SEQ ID NO: 599691 - DNA, 25 bp, Mus musculus
ggaggcatggttttctagttccttg

SEQ ID NO: 599692 - DNA, 25 bp, Mus musculus
ggaggcatgtggaattccttccctg

SEQ ID NO: 599693 - DNA, 25 bp, Mus musculus
ggaggcatgtggtattccttccctg

SEQ ID NO: 599694 - DNA, 25 bp, Mus musculus
ggaggcattccaactttcggttagt

SEQ ID NO: 599695 - DNA, 25 bp, Mus musculus
ggaggcattccatctttcggttagt

SEQ ID NO: 599696 - DNA, 25 bp, Mus musculus
ggaggcattcctatgttaatagggt

SEQ ID NO: 599697 - DNA, 25 bp, Mus musculus
ggaggcattcctttgttaatagggt

SEQ ID NO: 599698 - DNA, 25 bp, Mus musculus
ggaggcattgacatctctaggagtt

SEQ ID NO: 599699 - DNA, 25 bp, Mus musculus
ggaggcattgacttctctaggagtt

SEQ ID NO: 599700 - DNA, 25 bp, Mus musculus
ggaggcatttttaggtccagaccat

SEQ ID NO: 599701 - DNA, 25 bp, Mus musculus
ggaggcattttttggtccagaccat

SEQ ID NO: 599702 - DNA, 25 bp, Mus musculus
ggaggccaaaatctgtcatcaaatt

SEQ ID NO: 599703 - DNA, 25 bp, Mus musculus
ggaggccaaaatgtgtcatcaaatt

SEQ ID NO: 599704 - DNA, 25 bp, Mus musculus
ggaggccaacagcaaatccaagcat

SEQ ID NO: 599705 - DNA, 25 bp, Mus musculus
ggaggccaacaggaaatccaagcat

SEQ ID NO: 599706 - DNA, 25 bp, Mus musculus
ggaggccaacccagcaatgtggaga

SEQ ID NO: 599707 - DNA, 25 bp, Mus musculus
ggaggccaaccctgcaatgtggaga

SEQ ID NO: 599708 - DNA, 25 bp, Mus musculus
ggaggccaaccgctctacaggctgt

SEQ ID NO: 599709 - DNA, 25 bp, Mus musculus
ggaggccaaccggtctacaggctgt

SEQ ID NO: 599710 - DNA, 25 bp, Mus musculus
ggaggccaactaagacgagtacgct

SEQ ID NO: 599711 - DNA, 25 bp, Mus musculus
ggaggccaactatgacgagtacgct

SEQ ID NO: 599712 - DNA, 25 bp, Mus musculus
ggaggccaagacaccagcagacacc

SEQ ID NO: 599713 - DNA, 25 bp, Mus musculus
ggaggccaagactccagcagacacc

SEQ ID NO: 599714 - DNA, 25 bp, Mus musculus
ggaggccaaggtctgtaacccacta

SEQ ID NO: 599715 - DNA, 25 bp, Mus musculus
ggaggccaaggtgtgtaacccacta

SEQ ID NO: 599716 - DNA, 25 bp, Mus musculus
ggaggccaccagcaagaatcccgga

SEQ ID NO: 599717 - DNA, 25 bp, Mus musculus
ggaggccaccagcttttattaccaa

SEQ ID NO: 599718 - DNA, 25 bp, Mus musculus
ggaggccaccaggaagaatcccgga

SEQ ID NO: 599719 - DNA, 25 bp, Mus musculus
ggaggccaccaggttttattaccaa

SEQ ID NO: 599720 - DNA, 25 bp, Mus musculus
ggaggccagagaccaaaacttttct

SEQ ID NO: 599721 - DNA, 25 bp, Mus musculus
ggaggccagagagcaaaacttttct

SEQ ID NO: 599722 - DNA, 25 bp, Mus musculus
ggaggccagcctcgaatcaagctga

SEQ ID NO: 599723 - DNA, 25 bp, Mus musculus
ggaggccagcctggaatcaagctga

SEQ ID NO: 599724 - DNA, 25 bp, Mus musculus
ggaggccaggctaagattcaggtct

SEQ ID NO: 599725 - DNA, 25 bp, Mus musculus
ggaggccaggcttagattcaggtct

SEQ ID NO: 599726 - DNA, 25 bp, Mus musculus
ggaggccagtacattgctaaaccac

SEQ ID NO: 599727 - DNA, 25 bp, Mus musculus
ggaggccagtactttgctaaaccac

SEQ ID NO: 599728 - DNA, 25 bp, Mus musculus
ggaggccagtctagtactaacatct

SEQ ID NO: 599729 - DNA, 25 bp, Mus musculus
ggaggccagtcttgtactaacatct

SEQ ID NO: 599730 - DNA, 25 bp, Mus musculus
ggaggccataatactgatgaaagac

SEQ ID NO: 599731 - DNA, 25 bp, Mus musculus
ggaggccataattctgatgaaagac

SEQ ID NO: 599732 - DNA, 25 bp, Mus musculus
ggaggccatagcaggattgtcacgt

SEQ ID NO: 599733 - DNA, 25 bp, Mus musculus
ggaggccatagctggattgtcacgt

SEQ ID NO: 599734 - DNA, 25 bp, Mus musculus
ggaggccatcagcagtataattaag

SEQ ID NO: 599735 - DNA, 25 bp, Mus musculus
ggaggccatcaggagtataattaag

SEQ ID NO: 599736 - DNA, 25 bp, Mus musculus
ggaggccatcccatatccaagatca

SEQ ID NO: 599737 - DNA, 25 bp, Mus musculus
ggaggccatcccttatccaagatca

SEQ ID NO: 599738 - DNA, 25 bp, Mus musculus
ggaggccatcggaaggcaccaatga

SEQ ID NO: 599739 - DNA, 25 bp, Mus musculus
ggaggccatcggtaggcaccaatga

SEQ ID NO: 599740 - DNA, 25 bp, Mus musculus
ggaggccatcttactatacaaacca

SEQ ID NO: 599741 - DNA, 25 bp, Mus musculus
ggaggccatctttctatacaaacca

SEQ ID NO: 599742 - DNA, 25 bp, Mus musculus
ggaggccatgtcctgccattcacaa

SEQ ID NO: 599743 - DNA, 25 bp, Mus musculus
ggaggccatgtcgtgccattcacaa

SEQ ID NO: 599744 - DNA, 25 bp, Mus musculus
ggaggccatgttacacacttcccta

SEQ ID NO: 599745 - DNA, 25 bp, Mus musculus
ggaggccatgtttcacacttcccta

SEQ ID NO: 599746 - DNA, 25 bp, Mus musculus
ggaggccattccagacatgtgcaag

SEQ ID NO: 599747 - DNA, 25 bp, Mus musculus
ggaggccattcctgacatgtgcaag

SEQ ID NO: 599748 - DNA, 25 bp, Mus musculus
ggaggccattgcatctgctggcaaa

SEQ ID NO: 599749 - DNA, 25 bp, Mus musculus
ggaggccattgcttctgctggcaaa

SEQ ID NO: 599750 - DNA, 25 bp, Mus musculus
ggaggccattgtagcgtgtgcacct

SEQ ID NO: 599751 - DNA, 25 bp, Mus musculus
ggaggccattgttgcgtgtgcacct

SEQ ID NO: 599752 - DNA, 25 bp, Mus musculus
ggaggcccacttaagcctggtccgt

SEQ ID NO: 599753 - DNA, 25 bp, Mus musculus
ggaggcccactttagcctggtccgt

SEQ ID NO: 599754 - DNA, 25 bp, Mus musculus
ggaggcccagaacagcaatgacact

SEQ ID NO: 599755 - DNA, 25 bp, Mus musculus
ggaggcccagaagagcaatgacact

SEQ ID NO: 599756 - DNA, 25 bp, Mus musculus
ggaggcccagcaaagccaagcctgt

SEQ ID NO: 599757 - DNA, 25 bp, Mus musculus
ggaggcccagcatagccaagcctgt

SEQ ID NO: 599758 - DNA, 25 bp, Mus musculus
ggaggcccaggacaagtgccatcaa

SEQ ID NO: 599759 - DNA, 25 bp, Mus musculus
ggaggcccaggagaagtgccatcaa

SEQ ID NO: 599760 - DNA, 25 bp, Mus musculus
ggaggcccagttaaacagtttctct

SEQ ID NO: 599761 - DNA, 25 bp, Mus musculus
ggaggcccagtttaacagtttctct

SEQ ID NO: 599762 - DNA, 25 bp, Mus musculus
ggaggcccatataaggaccctggaa

SEQ ID NO: 599763 - DNA, 25 bp, Mus musculus
ggaggcccatattaggaccctggaa

SEQ ID NO: 599764 - DNA, 25 bp, Mus musculus
ggaggcccatcaaggctcagcagta

SEQ ID NO: 599765 - DNA, 25 bp, Mus musculus
ggaggcccatcatggctcagcagta

SEQ ID NO: 599766 - DNA, 25 bp, Mus musculus
ggaggcccatgtccagaacagtgtc

SEQ ID NO: 599767 - DNA, 25 bp, Mus musculus
ggaggcccatgtgcagaacagtgtc

SEQ ID NO: 599768 - DNA, 25 bp, Mus musculus
ggaggcccattcaggctcccatgga

SEQ ID NO: 599769 - DNA, 25 bp, Mus musculus
ggaggcccattctggctcccatgga

SEQ ID NO: 599770 - DNA, 25 bp, Mus musculus
ggaggccccaataccaggaaggatt

SEQ ID NO: 599771 - DNA, 25 bp, Mus musculus
ggaggccccaattccaggaaggatt

SEQ ID NO: 599772 - DNA, 25 bp, Mus musculus
ggaggccccacacatgaactatatc

SEQ ID NO: 599773 - DNA, 25 bp, Mus musculus
ggaggccccacagatgaactatatc

SEQ ID NO: 599774 - DNA, 25 bp, Mus musculus
ggaggccccaccagatgaagaacct

SEQ ID NO: 599775 - DNA, 25 bp, Mus musculus
ggaggccccaccaggccaggcttga

SEQ ID NO: 599776 - DNA, 25 bp, Mus musculus
ggaggccccacctgatgaagaacct

SEQ ID NO: 599777 - DNA, 25 bp, Mus musculus
ggaggccccacctggccaggcttga

SEQ ID NO: 599778 - DNA, 25 bp, Mus musculus
ggaggcccctttctgtgtgaagaca

SEQ ID NO: 599779 - DNA, 25 bp, Mus musculus
ggaggcccctttgtgtgtgaagaca

SEQ ID NO: 599780 - DNA, 25 bp, Mus musculus
ggaggccctaggcactacaacctac

SEQ ID NO: 599781 - DNA, 25 bp, Mus musculus
ggaggccctagggactacaacctac

SEQ ID NO: 599782 - DNA, 25 bp, Mus musculus
ggaggccctatcaaagcttttaagt

SEQ ID NO: 599783 - DNA, 25 bp, Mus musculus
ggaggccctatctaagcttttaagt

SEQ ID NO: 599784 - DNA, 25 bp, Mus musculus
ggaggccctcctagtttggttgtct

SEQ ID NO: 599785 - DNA, 25 bp, Mus musculus
ggaggccctccttgtttggttgtct

SEQ ID NO: 599786 - DNA, 25 bp, Mus musculus
ggaggccctgccatagccaggagcc

SEQ ID NO: 599787 - DNA, 25 bp, Mus musculus
ggaggccctgccttagccaggagcc

SEQ ID NO: 599788 - DNA, 25 bp, Mus musculus
ggaggccgattcatctcaatgactt

SEQ ID NO: 599789 - DNA, 25 bp, Mus musculus
ggaggccgattcttctcaatgactt

SEQ ID NO: 599790 - DNA, 25 bp, Mus musculus
ggaggccgcctgagtaaggacctct

SEQ ID NO: 599791 - DNA, 25 bp, Mus musculus
ggaggccgcctgtgtaaggacctct

SEQ ID NO: 599792 - DNA, 25 bp, Mus musculus
ggaggccgtgatagactactttgat

SEQ ID NO: 599793 - DNA, 25 bp, Mus musculus
ggaggccgtgattgactactttgat

SEQ ID NO: 599794 - DNA, 25 bp, Mus musculus
ggaggcctcactcggaattagccaa

SEQ ID NO: 599795 - DNA, 25 bp, Mus musculus
ggaggcctcactgggaattagccaa

SEQ ID NO: 599796 - DNA, 25 bp, Mus musculus
ggaggcctccaacgaaaccatcaag

SEQ ID NO: 599797 - DNA, 25 bp, Mus musculus
ggaggcctccaaggaaaccatcaag

SEQ ID NO: 599798 - DNA, 25 bp, Mus musculus
ggaggcctccacaatggtctaggga

SEQ ID NO: 599799 - DNA, 25 bp, Mus musculus
ggaggcctccactatggtctaggga

SEQ ID NO: 599800 - DNA, 25 bp, Mus musculus
ggaggcctccagagccttcgagtca

SEQ ID NO: 599801 - DNA, 25 bp, Mus musculus
ggaggcctccagtgccttcgagtca

SEQ ID NO: 599802 - DNA, 25 bp, Mus musculus
ggaggcctctcacatggcgccattg

SEQ ID NO: 599803 - DNA, 25 bp, Mus musculus
ggaggcctctcagatggcgccattg

SEQ ID NO: 599804 - DNA, 25 bp, Mus musculus
ggaggcctctgaagaccttaagcct

SEQ ID NO: 599805 - DNA, 25 bp, Mus musculus
ggaggcctctgaatgaacctgcttc

SEQ ID NO: 599806 - DNA, 25 bp, Mus musculus
ggaggcctctgaatgactttttaaa

SEQ ID NO: 599807 - DNA, 25 bp, Mus musculus
ggaggcctctgatgaccttaagcct

SEQ ID NO: 599808 - DNA, 25 bp, Mus musculus
ggaggcctctgattgaacctgcttc

SEQ ID NO: 599809 - DNA, 25 bp, Mus musculus
ggaggcctctgattgactttttaaa

SEQ ID NO: 599810 - DNA, 25 bp, Mus musculus
ggaggcctctggcaaccacagatct

SEQ ID NO: 599811 - DNA, 25 bp, Mus musculus
ggaggcctctgggaaccacagatct

SEQ ID NO: 599812 - DNA, 25 bp, Mus musculus
ggaggcctcttactaacttcaggga

SEQ ID NO: 599813 - DNA, 25 bp, Mus musculus
ggaggcctcttagtaacttcaggga

SEQ ID NO: 599814 - DNA, 25 bp, Mus musculus
ggaggcctcttcagaatgttgacta

SEQ ID NO: 599815 - DNA, 25 bp, Mus musculus
ggaggcctcttctgaatgttgacta

SEQ ID NO: 599816 - DNA, 25 bp, Mus musculus
ggaggcctgacaccagaccctgagc

SEQ ID NO: 599817 - DNA, 25 bp, Mus musculus
ggaggcctgacagcagaccctgagc

SEQ ID NO: 599818 - DNA, 25 bp, Mus musculus
ggaggcctgagcactcttccattgt

SEQ ID NO: 599819 - DNA, 25 bp, Mus musculus
ggaggcctgagctctcttccattgt

SEQ ID NO: 599820 - DNA, 25 bp, Mus musculus
ggaggcctgtgtagctgctcttctg

SEQ ID NO: 599821 - DNA, 25 bp, Mus musculus
ggaggcctgtgttgctgctcttctg

SEQ ID NO: 599822 - DNA, 25 bp, Mus musculus
ggaggccttactactttgactgaac

SEQ ID NO: 599823 - DNA, 25 bp, Mus musculus
ggaggccttactccctcaccattta

SEQ ID NO: 599824 - DNA, 25 bp, Mus musculus
ggaggccttactgcctcaccattta

SEQ ID NO: 599825 - DNA, 25 bp, Mus musculus
ggaggccttacttctttgactgaac

SEQ ID NO: 599826 - DNA, 25 bp, Mus musculus
ggaggccttagaaaccaggttgcaa

SEQ ID NO: 599827 - DNA, 25 bp, Mus musculus
ggaggccttagataccaggttgcaa

SEQ ID NO: 599828 - DNA, 25 bp, Mus musculus
ggaggccttctcagacagcctgagg

SEQ ID NO: 599829 - DNA, 25 bp, Mus musculus
ggaggccttctcctatggccagaag

SEQ ID NO: 599830 - DNA, 25 bp, Mus musculus
ggaggccttctcgtatggccagaag

SEQ ID NO: 599831 - DNA, 25 bp, Mus musculus
ggaggccttctctgacagcctgagg

SEQ ID NO: 599832 - DNA, 25 bp, Mus musculus
ggaggccttgaacaacacggtcaag

SEQ ID NO: 599833 - DNA, 25 bp, Mus musculus
ggaggccttgaacatgcagcttatt

SEQ ID NO: 599834 - DNA, 25 bp, Mus musculus
ggaggccttgaagaacacggtcaag

SEQ ID NO: 599835 - DNA, 25 bp, Mus musculus
ggaggccttgaagatgcagcttatt

SEQ ID NO: 599836 - DNA, 25 bp, Mus musculus
ggaggccttgcaagtgaccttgatg

SEQ ID NO: 599837 - DNA, 25 bp, Mus musculus
ggaggccttgcatgtgaccttgatg

SEQ ID NO: 599838 - DNA, 25 bp, Mus musculus
ggaggccttgtacctttgcttaccc

SEQ ID NO: 599839 - DNA, 25 bp, Mus musculus
ggaggccttgtagctttgcttaccc

SEQ ID NO: 599840 - DNA, 25 bp, Mus musculus
ggaggcctttggattccgaagatag

SEQ ID NO: 599841 - DNA, 25 bp, Mus musculus
ggaggcctttggtttccgaagatag

SEQ ID NO: 599842 - DNA, 25 bp, Mus musculus
ggaggccttttcactagacataact

SEQ ID NO: 599843 - DNA, 25 bp, Mus musculus
ggaggccttttccactaaatacttg

SEQ ID NO: 599844 - DNA, 25 bp, Mus musculus
ggaggccttttcgactaaatacttg

SEQ ID NO: 599845 - DNA, 25 bp, Mus musculus
ggaggccttttctctagacataact

SEQ ID NO: 599846 - DNA, 25 bp, Mus musculus
ggaggcgaagtgctgactcacacaa

SEQ ID NO: 599847 - DNA, 25 bp, Mus musculus
ggaggcgaagtggtgactcacacaa

SEQ ID NO: 599848 - DNA, 25 bp, Mus musculus
ggaggcgaccccactgtacagagct

SEQ ID NO: 599849 - DNA, 25 bp, Mus musculus
ggaggcgacccctctgtacagagct

SEQ ID NO: 599850 - DNA, 25 bp, Mus musculus
ggaggcgactccagcagtaccaagt

SEQ ID NO: 599851 - DNA, 25 bp, Mus musculus
ggaggcgactcctgcagtaccaagt

SEQ ID NO: 599852 - DNA, 25 bp, Mus musculus
ggaggcgaggatatctcattgacaa

SEQ ID NO: 599853 - DNA, 25 bp, Mus musculus
ggaggcgaggatttctcattgacaa

SEQ ID NO: 599854 - DNA, 25 bp, Mus musculus
ggaggcgaggcactaccatagttct

SEQ ID NO: 599855 - DNA, 25 bp, Mus musculus
ggaggcgaggcagtaccatagttct

SEQ ID NO: 599856 - DNA, 25 bp, Mus musculus
ggaggcgatctaacacactgtgaga

SEQ ID NO: 599857 - DNA, 25 bp, Mus musculus
ggaggcgatctatcacactgtgaga

SEQ ID NO: 599858 - DNA, 25 bp, Mus musculus
ggaggcgcccaaaagggtacacgct

SEQ ID NO: 599859 - DNA, 25 bp, Mus musculus
ggaggcgcccaatagggtacacgct

SEQ ID NO: 599860 - DNA, 25 bp, Mus musculus
ggaggcgcccagaaacacaataaaa

SEQ ID NO: 599861 - DNA, 25 bp, Mus musculus
ggaggcgcccagtaacacaataaaa

SEQ ID NO: 599862 - DNA, 25 bp, Mus musculus
ggaggcgcgtccatagaccacttag

SEQ ID NO: 599863 - DNA, 25 bp, Mus musculus
ggaggcgcgtccttagaccacttag

SEQ ID NO: 599864 - DNA, 25 bp, Mus musculus
ggaggcgctcagaattatcggcgac

SEQ ID NO: 599865 - DNA, 25 bp, Mus musculus
ggaggcgctcagtattatcggcgac

SEQ ID NO: 599866 - DNA, 25 bp, Mus musculus
ggaggcgctgctaaagatcttccct

SEQ ID NO: 599867 - DNA, 25 bp, Mus musculus
ggaggcgctgcttaagatcttccct

SEQ ID NO: 599868 - DNA, 25 bp, Mus musculus
ggaggcgtactcaagacactgccta

SEQ ID NO: 599869 - DNA, 25 bp, Mus musculus
ggaggcgtactctagacactgccta

SEQ ID NO: 599870 - DNA, 25 bp, Mus musculus
ggaggcgtagccattgcattccagg

SEQ ID NO: 599871 - DNA, 25 bp, Mus musculus
ggaggcgtagcctttgcattccagg

SEQ ID NO: 599872 - DNA, 25 bp, Mus musculus
ggaggcgtccagaatgctgcacgtc

SEQ ID NO: 599873 - DNA, 25 bp, Mus musculus
ggaggcgtccagtatgctgcacgtc

SEQ ID NO: 599874 - DNA, 25 bp, Mus musculus
ggaggctaagacctaactatgttac

SEQ ID NO: 599875 - DNA, 25 bp, Mus musculus
ggaggctaagacgtaactatgttac

SEQ ID NO: 599876 - DNA, 25 bp, Mus musculus
ggaggctacaaaccttccagcctga

SEQ ID NO: 599877 - DNA, 25 bp, Mus musculus
ggaggctacaaagcttccagcctga

SEQ ID NO: 599878 - DNA, 25 bp, Mus musculus
ggaggctacagaatgcctttgtcag

SEQ ID NO: 599879 - DNA, 25 bp, Mus musculus
ggaggctacagacactatgccctat

SEQ ID NO: 599880 - DNA, 25 bp, Mus musculus
ggaggctacagagactatgccctat

SEQ ID NO: 599881 - DNA, 25 bp, Mus musculus
ggaggctacagattgcctttgtcag

SEQ ID NO: 599882 - DNA, 25 bp, Mus musculus
ggaggctaggaccaccttacttcct

SEQ ID NO: 599883 - DNA, 25 bp, Mus musculus
ggaggctaggacgaccttacttcct

SEQ ID NO: 599884 - DNA, 25 bp, Mus musculus
ggaggctattcactccttggttgaa

SEQ ID NO: 599885 - DNA, 25 bp, Mus musculus
ggaggctattcagtccttggttgaa

SEQ ID NO: 599886 - DNA, 25 bp, Mus musculus
ggaggctcaaacatgtgaaggttaa

SEQ ID NO: 599887 - DNA, 25 bp, Mus musculus
ggaggctcaaacttgtgaaggttaa

SEQ ID NO: 599888 - DNA, 25 bp, Mus musculus
ggaggctcacaaaactggatcagat

SEQ ID NO: 599889 - DNA, 25 bp, Mus musculus
ggaggctcacaatactggatcagat

SEQ ID NO: 599890 - DNA, 25 bp, Mus musculus
ggaggctcacacatttgcacgaagg

SEQ ID NO: 599891 - DNA, 25 bp, Mus musculus
ggaggctcacacttttgcacgaagg

SEQ ID NO: 599892 - DNA, 25 bp, Mus musculus
ggaggctcacgcactgactattagg

SEQ ID NO: 599893 - DNA, 25 bp, Mus musculus
ggaggctcacgctctgactattagg

SEQ ID NO: 599894 - DNA, 25 bp, Mus musculus
ggaggctcactgcagttccaggcca

SEQ ID NO: 599895 - DNA, 25 bp, Mus musculus
ggaggctcactggagttccaggcca

SEQ ID NO: 599896 - DNA, 25 bp, Mus musculus
ggaggctcacttacatagcctacag

SEQ ID NO: 599897 - DNA, 25 bp, Mus musculus
ggaggctcactttcatagcctacag

SEQ ID NO: 599898 - DNA, 25 bp, Mus musculus
ggaggctcagaaattcccttctcaa

SEQ ID NO: 599899 - DNA, 25 bp, Mus musculus
ggaggctcagaatttcccttctcaa

SEQ ID NO: 599900 - DNA, 25 bp, Mus musculus
ggaggctcagacattaccaggtaca

SEQ ID NO: 599901 - DNA, 25 bp, Mus musculus
ggaggctcagactttaccaggtaca

SEQ ID NO: 599902 - DNA, 25 bp, Mus musculus
ggaggctcagctagaatcaggactt

SEQ ID NO: 599903 - DNA, 25 bp, Mus musculus
ggaggctcagctatcaaatctgtga

SEQ ID NO: 599904 - DNA, 25 bp, Mus musculus
ggaggctcagcttgaatcaggactt

SEQ ID NO: 599905 - DNA, 25 bp, Mus musculus
ggaggctcagctttcaaatctgtga

SEQ ID NO: 599906 - DNA, 25 bp, Mus musculus
ggaggctcaggcacacagctcagtg

SEQ ID NO: 599907 - DNA, 25 bp, Mus musculus
ggaggctcaggctcacagctcagtg

SEQ ID NO: 599908 - DNA, 25 bp, Mus musculus
ggaggctcagtcagatcgcacaggc

SEQ ID NO: 599909 - DNA, 25 bp, Mus musculus
ggaggctcagtctgatcgcacaggc

SEQ ID NO: 599910 - DNA, 25 bp, Mus musculus
ggaggctcagttatgggtctaacca

SEQ ID NO: 599911 - DNA, 25 bp, Mus musculus
ggaggctcagttttgggtctaacca

SEQ ID NO: 599912 - DNA, 25 bp, Mus musculus
ggaggctcatatatgagggacccct

SEQ ID NO: 599913 - DNA, 25 bp, Mus musculus
ggaggctcatatttgagggacccct

SEQ ID NO: 599914 - DNA, 25 bp, Mus musculus
ggaggctcatctacctgcacgctaa

SEQ ID NO: 599915 - DNA, 25 bp, Mus musculus
ggaggctcatcttcctgcacgctaa

SEQ ID NO: 599916 - DNA, 25 bp, Mus musculus
ggaggctcattccttcaccaatcca

SEQ ID NO: 599917 - DNA, 25 bp, Mus musculus
ggaggctcattcgttcaccaatcca

SEQ ID NO: 599918 - DNA, 25 bp, Mus musculus
ggaggctccaaactcagctacaaat

SEQ ID NO: 599919 - DNA, 25 bp, Mus musculus
ggaggctccaaagtcagctacaaat

SEQ ID NO: 599920 - DNA, 25 bp, Mus musculus
ggaggctccaacagtagcatctcta

SEQ ID NO: 599921 - DNA, 25 bp, Mus musculus
ggaggctccaactgtagcatctcta

SEQ ID NO: 599922 - DNA, 25 bp, Mus musculus
ggaggctccatccagaaccgcaagt

SEQ ID NO: 599923 - DNA, 25 bp, Mus musculus
ggaggctccatcgagaaccgcaagt

SEQ ID NO: 599924 - DNA, 25 bp, Mus musculus
ggaggctcccagagacttagactaa

SEQ ID NO: 599925 - DNA, 25 bp, Mus musculus
ggaggctcccagtgacttagactaa

SEQ ID NO: 599926 - DNA, 25 bp, Mus musculus
ggaggctccggtagggctcagggct

SEQ ID NO: 599927 - DNA, 25 bp, Mus musculus
ggaggctccggttgggctcagggct

SEQ ID NO: 599928 - DNA, 25 bp, Mus musculus
ggaggctccgtgctcttcagtccta

SEQ ID NO: 599929 - DNA, 25 bp, Mus musculus
ggaggctccgtggtcttcagtccta

SEQ ID NO: 599930 - DNA, 25 bp, Mus musculus
ggaggctcctaactaataaccgcac

SEQ ID NO: 599931 - DNA, 25 bp, Mus musculus
ggaggctcctaagtaataaccgcac

SEQ ID NO: 599932 - DNA, 25 bp, Mus musculus
ggaggctcctatagagtctgtccct

SEQ ID NO: 599933 - DNA, 25 bp, Mus musculus
ggaggctcctattgagtctgtccct

SEQ ID NO: 599934 - DNA, 25 bp, Mus musculus
ggaggctcctttccggaactctaga

SEQ ID NO: 599935 - DNA, 25 bp, Mus musculus
ggaggctcctttgcggaactctaga

SEQ ID NO: 599936 - DNA, 25 bp, Mus musculus
ggaggctcggtgactatgagaactt

SEQ ID NO: 599937 - DNA, 25 bp, Mus musculus
ggaggctcggtgtctatgagaactt

SEQ ID NO: 599938 - DNA, 25 bp, Mus musculus
ggaggctctaatcgccatcgataag

SEQ ID NO: 599939 - DNA, 25 bp, Mus musculus
ggaggctctaatggccatcgataag

SEQ ID NO: 599940 - DNA, 25 bp, Mus musculus
ggaggctctagaattctccagagtt

SEQ ID NO: 599941 - DNA, 25 bp, Mus musculus
ggaggctctagatttctccagagtt

SEQ ID NO: 599942 - DNA, 25 bp, Mus musculus
ggaggctctcttaccgtagtcggag

SEQ ID NO: 599943 - DNA, 25 bp, Mus musculus
ggaggctctctttccgtagtcggag

SEQ ID NO: 599944 - DNA, 25 bp, Mus musculus
ggaggctctgctcgctttcatacct

SEQ ID NO: 599945 - DNA, 25 bp, Mus musculus
ggaggctctgctggctttcatacct

SEQ ID NO: 599946 - DNA, 25 bp, Mus musculus
ggaggctgaaccagaccggccttgt

SEQ ID NO: 599947 - DNA, 25 bp, Mus musculus
ggaggctgaacctgaccggccttgt

SEQ ID NO: 599948 - DNA, 25 bp, Mus musculus
ggaggctgacctagagtcatgccca

SEQ ID NO: 599949 - DNA, 25 bp, Mus musculus
ggaggctgaccttgagtcatgccca

SEQ ID NO: 599950 - DNA, 25 bp, Mus musculus
ggaggctgactcaagcccagctgca

SEQ ID NO: 599951 - DNA, 25 bp, Mus musculus
ggaggctgactctagcccagctgca

SEQ ID NO: 599952 - DNA, 25 bp, Mus musculus
ggaggctgactgaaaggctgtcact

SEQ ID NO: 599953 - DNA, 25 bp, Mus musculus
ggaggctgactgcttcagatgtcca

SEQ ID NO: 599954 - DNA, 25 bp, Mus musculus
ggaggctgactggttcagatgtcca

SEQ ID NO: 599955 - DNA, 25 bp, Mus musculus
ggaggctgactgtaaggctgtcact

SEQ ID NO: 599956 - DNA, 25 bp, Mus musculus
ggaggctgacttcctgtatgcttac

SEQ ID NO: 599957 - DNA, 25 bp, Mus musculus
ggaggctgacttgctgtatgcttac

SEQ ID NO: 599958 - DNA, 25 bp, Mus musculus
ggaggctgaggaattctaccgagct

SEQ ID NO: 599959 - DNA, 25 bp, Mus musculus
ggaggctgaggatttctaccgagct

SEQ ID NO: 599960 - DNA, 25 bp, Mus musculus
ggaggctgagttacctttgatatta

SEQ ID NO: 599961 - DNA, 25 bp, Mus musculus
ggaggctgagtttcctttgatatta

SEQ ID NO: 599962 - DNA, 25 bp, Mus musculus
ggaggctgatccatccagcatttat

SEQ ID NO: 599963 - DNA, 25 bp, Mus musculus
ggaggctgatccttccagcatttat

SEQ ID NO: 599964 - DNA, 25 bp, Mus musculus
ggaggctgatctcttttgccagaac

SEQ ID NO: 599965 - DNA, 25 bp, Mus musculus
ggaggctgatctgttttgccagaac

SEQ ID NO: 599966 - DNA, 25 bp, Mus musculus
ggaggctgatgaacaagccaatgct

SEQ ID NO: 599967 - DNA, 25 bp, Mus musculus
ggaggctgatgatcaagccaatgct

SEQ ID NO: 599968 - DNA, 25 bp, Mus musculus
ggaggctgattcatccacaggaagc

SEQ ID NO: 599969 - DNA, 25 bp, Mus musculus
ggaggctgattccaccccaagagtg

SEQ ID NO: 599970 - DNA, 25 bp, Mus musculus
ggaggctgattcgaccccaagagtg

SEQ ID NO: 599971 - DNA, 25 bp, Mus musculus
ggaggctgattcttccacaggaagc

SEQ ID NO: 599972 - DNA, 25 bp, Mus musculus
ggaggctgatttcccaggtcctctc

SEQ ID NO: 599973 - DNA, 25 bp, Mus musculus
ggaggctgatttgccaggtcctctc

SEQ ID NO: 599974 - DNA, 25 bp, Mus musculus
ggaggctgcacaccaagcaagatgt

SEQ ID NO: 599975 - DNA, 25 bp, Mus musculus
ggaggctgcacagcaagcaagatgt

SEQ ID NO: 599976 - DNA, 25 bp, Mus musculus
ggaggctgcactatgaagcggacca

SEQ ID NO: 599977 - DNA, 25 bp, Mus musculus
ggaggctgcactttgaagcggacca

SEQ ID NO: 599978 - DNA, 25 bp, Mus musculus
ggaggctgccttcactctcattgga

SEQ ID NO: 599979 - DNA, 25 bp, Mus musculus
ggaggctgccttgactctcattgga

SEQ ID NO: 599980 - DNA, 25 bp, Mus musculus
ggaggctgctagagacaccctgtgt

SEQ ID NO: 599981 - DNA, 25 bp, Mus musculus
ggaggctgctagtgacaccctgtgt

SEQ ID NO: 599982 - DNA, 25 bp, Mus musculus
ggaggctgctccctagattctagga

SEQ ID NO: 599983 - DNA, 25 bp, Mus musculus
ggaggctgctccgtagattctagga

SEQ ID NO: 599984 - DNA, 25 bp, Mus musculus
ggaggctgctgaaagttggcaccaa

SEQ ID NO: 599985 - DNA, 25 bp, Mus musculus
ggaggctgctgacgacattgcgtac

SEQ ID NO: 599986 - DNA, 25 bp, Mus musculus
ggaggctgctgaggacattgcgtac

SEQ ID NO: 599987 - DNA, 25 bp, Mus musculus
ggaggctgctgatagttggcaccaa

SEQ ID NO: 599988 - DNA, 25 bp, Mus musculus
ggaggctgctgcaatgattcccaca

SEQ ID NO: 599989 - DNA, 25 bp, Mus musculus
ggaggctgctgcataccatcagcgt

SEQ ID NO: 599990 - DNA, 25 bp, Mus musculus
ggaggctgctgctatgattcccaca

SEQ ID NO: 599991 - DNA, 25 bp, Mus musculus
ggaggctgctgcttaccatcagcgt

SEQ ID NO: 599992 - DNA, 25 bp, Mus musculus
ggaggctgctttcatcattggcgac

SEQ ID NO: 599993 - DNA, 25 bp, Mus musculus
ggaggctgctttcgatgcccagaca

SEQ ID NO: 599994 - DNA, 25 bp, Mus musculus
ggaggctgctttgatcattggcgac

SEQ ID NO: 599995 - DNA, 25 bp, Mus musculus
ggaggctgctttggatgcccagaca

SEQ ID NO: 599996 - DNA, 25 bp, Mus musculus
ggaggctggaagctagtcccctttc

SEQ ID NO: 599997 - DNA, 25 bp, Mus musculus
ggaggctggaaggtagtcccctttc

SEQ ID NO: 599998 - DNA, 25 bp, Mus musculus
ggaggctggccaaaatacttctcaa

SEQ ID NO: 599999 - DNA, 25 bp, Mus musculus
ggaggctggccataatacttctcaa

SEQ ID NO: 600000 - DNA, 25 bp, Mus musculus
ggaggctggctgatactcctgtgca

SEQ ID NO: 600001 - DNA, 25 bp, Mus musculus
ggaggctggctgttactcctgtgca

SEQ ID NO: 600002 - DNA, 25 bp, Mus musculus
ggaggctgtacaatttgcagagttt

SEQ ID NO: 600003 - DNA, 25 bp, Mus musculus
ggaggctgtacattttgcagagttt

SEQ ID NO: 600004 - DNA, 25 bp, Mus musculus
ggaggctgttgaattcaaccttttt

SEQ ID NO: 600005 - DNA, 25 bp, Mus musculus
ggaggctgttgatttcaaccttttt

SEQ ID NO: 600006 - DNA, 25 bp, Mus musculus
ggaggcttaaccctaattgaatctt

SEQ ID NO: 600007 - DNA, 25 bp, Mus musculus
ggaggcttaaccgtaattgaatctt

SEQ ID NO: 600008 - DNA, 25 bp, Mus musculus
ggaggcttaagtacttttacataca

SEQ ID NO: 600009 - DNA, 25 bp, Mus musculus
ggaggcttaagttcttttacataca

SEQ ID NO: 600010 - DNA, 25 bp, Mus musculus
ggaggcttactgcagagcccactgc

SEQ ID NO: 600011 - DNA, 25 bp, Mus musculus
ggaggcttactggagagcccactgc

SEQ ID NO: 600012 - DNA, 25 bp, Mus musculus
ggaggcttatagatctgtgctaaac

SEQ ID NO: 600013 - DNA, 25 bp, Mus musculus
ggaggcttatagttctgtgctaaac

SEQ ID NO: 600014 - DNA, 25 bp, Mus musculus
ggaggcttatttatccgcgagctgc

SEQ ID NO: 600015 - DNA, 25 bp, Mus musculus
ggaggcttatttttccgcgagctgc

SEQ ID NO: 600016 - DNA, 25 bp, Mus musculus
ggaggcttcaacacagctccaaatc

SEQ ID NO: 600017 - DNA, 25 bp, Mus musculus
ggaggcttcaactcagctccaaatc

SEQ ID NO: 600018 - DNA, 25 bp, Mus musculus
ggaggcttcaatcccactttacctg

SEQ ID NO: 600019 - DNA, 25 bp, Mus musculus
ggaggcttcaatgccactttacctg

SEQ ID NO: 600020 - DNA, 25 bp, Mus musculus
ggaggcttcattatcctcttcgatc

SEQ ID NO: 600021 - DNA, 25 bp, Mus musculus
ggaggcttcattttcctcttcgatc

SEQ ID NO: 600022 - DNA, 25 bp, Mus musculus
ggaggcttccatatctcatatttgg

SEQ ID NO: 600023 - DNA, 25 bp, Mus musculus
ggaggcttccatttctcatatttgg

SEQ ID NO: 600024 - DNA, 25 bp, Mus musculus
ggaggcttccgcaccacagccagta

SEQ ID NO: 600025 - DNA, 25 bp, Mus musculus
ggaggcttccgctccacagccagta

SEQ ID NO: 600026 - DNA, 25 bp, Mus musculus
ggaggcttcctccttgtacggctga

SEQ ID NO: 600027 - DNA, 25 bp, Mus musculus
ggaggcttcctcgttgtacggctga

SEQ ID NO: 600028 - DNA, 25 bp, Mus musculus
ggaggcttctgcactgaacactttg

SEQ ID NO: 600029 - DNA, 25 bp, Mus musculus
ggaggcttctgctctgaacactttg

SEQ ID NO: 600030 - DNA, 25 bp, Mus musculus
ggaggcttgctccatctatatatgg

SEQ ID NO: 600031 - DNA, 25 bp, Mus musculus
ggaggcttgctcgatctatatatgg

SEQ ID NO: 600032 - DNA, 25 bp, Mus musculus
ggaggcttggttaacctgtgaccca

SEQ ID NO: 600033 - DNA, 25 bp, Mus musculus
ggaggcttggtttacctgtgaccca

SEQ ID NO: 600034 - DNA, 25 bp, Mus musculus
ggaggcttgtaacctccctgccatg

SEQ ID NO: 600035 - DNA, 25 bp, Mus musculus
ggaggcttgtaagctccctgccatg

SEQ ID NO: 600036 - DNA, 25 bp, Mus musculus
ggaggcttgtacctttattagctaa

SEQ ID NO: 600037 - DNA, 25 bp, Mus musculus
ggaggcttgtacgtttattagctaa

SEQ ID NO: 600038 - DNA, 25 bp, Mus musculus
ggaggctttgccatgacctggaaag

SEQ ID NO: 600039 - DNA, 25 bp, Mus musculus
ggaggctttgccttgacctggaaag

SEQ ID NO: 600040 - DNA, 25 bp, Mus musculus
ggaggctttgggaaatgctaccttt

SEQ ID NO: 600041 - DNA, 25 bp, Mus musculus
ggaggctttgggtaatgctaccttt

SEQ ID NO: 600042 - DNA, 25 bp, Mus musculus
ggaggctttgtcctcacgttcatgt

SEQ ID NO: 600043 - DNA, 25 bp, Mus musculus
ggaggctttgtcgtcacgttcatgt

SEQ ID NO: 600044 - DNA, 25 bp, Mus musculus
ggaggctttgttcgccagtccctgt

SEQ ID NO: 600045 - DNA, 25 bp, Mus musculus
ggaggctttgttggccagtccctgt

SEQ ID NO: 600046 - DNA, 25 bp, Mus musculus
ggagggaaaactcgctaagtgcttt

SEQ ID NO: 600047 - DNA, 25 bp, Mus musculus
ggagggaaaactggctaagtgcttt

SEQ ID NO: 600048 - DNA, 25 bp, Mus musculus
ggagggaaacctaatacttatgcat

SEQ ID NO: 600049 - DNA, 25 bp, Mus musculus
ggagggaaaccttatacttatgcat

SEQ ID NO: 600050 - DNA, 25 bp, Mus musculus
ggagggaaagacaaacttcaaacat

SEQ ID NO: 600051 - DNA, 25 bp, Mus musculus
ggagggaaagactaacttcaaacat

SEQ ID NO: 600052 - DNA, 25 bp, Mus musculus
ggagggaaatggattcatgtagtcc

SEQ ID NO: 600053 - DNA, 25 bp, Mus musculus
ggagggaaatggtttcatgtagtcc

SEQ ID NO: 600054 - DNA, 25 bp, Mus musculus
ggagggaacaccaggatcagagact

SEQ ID NO: 600055 - DNA, 25 bp, Mus musculus
ggagggaacacctggatcagagact

SEQ ID NO: 600056 - DNA, 25 bp, Mus musculus
ggagggaaccctccagtataattca

SEQ ID NO: 600057 - DNA, 25 bp, Mus musculus
ggagggaaccctgcagtataattca

SEQ ID NO: 600058 - DNA, 25 bp, Mus musculus
ggagggaacctaagctgtgtgaaca

SEQ ID NO: 600059 - DNA, 25 bp, Mus musculus
ggagggaacctatgctgtgtgaaca

SEQ ID NO: 600060 - DNA, 25 bp, Mus musculus
ggagggaacgccacggatcctcgca

SEQ ID NO: 600061 - DNA, 25 bp, Mus musculus
ggagggaacgcctcggatcctcgca

SEQ ID NO: 600062 - DNA, 25 bp, Mus musculus
ggagggaactaccttcaaaatacag

SEQ ID NO: 600063 - DNA, 25 bp, Mus musculus
ggagggaactacgttcaaaatacag

SEQ ID NO: 600064 - DNA, 25 bp, Mus musculus
ggagggaaggatacctcccacttct

SEQ ID NO: 600065 - DNA, 25 bp, Mus musculus
ggagggaaggattcctcccacttct

SEQ ID NO: 600066 - DNA, 25 bp, Mus musculus
ggagggacacaaacctgcttttgtc

SEQ ID NO: 600067 - DNA, 25 bp, Mus musculus
ggagggacacaatcctgcttttgtc

SEQ ID NO: 600068 - DNA, 25 bp, Mus musculus
ggagggacacatcattgactatcat

SEQ ID NO: 600069 - DNA, 25 bp, Mus musculus
ggagggacacatgattgactatcat

SEQ ID NO: 600070 - DNA, 25 bp, Mus musculus
ggagggacactcactacttcattaa

SEQ ID NO: 600071 - DNA, 25 bp, Mus musculus
ggagggacactctctacttcattaa

SEQ ID NO: 600072 - DNA, 25 bp, Mus musculus
ggagggacatcgacagctatgtgct

SEQ ID NO: 600073 - DNA, 25 bp, Mus musculus
ggagggacatcgtcagctatgtgct

SEQ ID NO: 600074 - DNA, 25 bp, Mus musculus
ggagggaccagcagagtcttgcata

SEQ ID NO: 600075 - DNA, 25 bp, Mus musculus
ggagggaccagctgagtcttgcata

SEQ ID NO: 600076 - DNA, 25 bp, Mus musculus
ggagggaccaggaccaacagaaact

SEQ ID NO: 600077 - DNA, 25 bp, Mus musculus
ggagggaccaggtccaacagaaact

SEQ ID NO: 600078 - DNA, 25 bp, Mus musculus
ggagggaccccaaagccaaaacatt

SEQ ID NO: 600079 - DNA, 25 bp, Mus musculus
ggagggaccccatagccaaaacatt

SEQ ID NO: 600080 - DNA, 25 bp, Mus musculus
ggagggacgactccagatccttttc

SEQ ID NO: 600081 - DNA, 25 bp, Mus musculus
ggagggacgactgcagatccttttc

SEQ ID NO: 600082 - DNA, 25 bp, Mus musculus
ggagggactcaaaaggacacaaggt

SEQ ID NO: 600083 - DNA, 25 bp, Mus musculus
ggagggactcaataggacacaaggt

SEQ ID NO: 600084 - DNA, 25 bp, Mus musculus
ggagggactctaattccaaggacaa

SEQ ID NO: 600085 - DNA, 25 bp, Mus musculus
ggagggactctatttccaaggacaa

SEQ ID NO: 600086 - DNA, 25 bp, Mus musculus
ggagggactctcagccaggattact

SEQ ID NO: 600087 - DNA, 25 bp, Mus musculus
ggagggactctctgccaggattact

SEQ ID NO: 600088 - DNA, 25 bp, Mus musculus
ggagggactgagcacttttgacttt

SEQ ID NO: 600089 - DNA, 25 bp, Mus musculus
ggagggactgaggacttttgacttt

SEQ ID NO: 600090 - DNA, 25 bp, Mus musculus
ggagggactgccaatcttcattctt

SEQ ID NO: 600091 - DNA, 25 bp, Mus musculus
ggagggactgcctatcttcattctt

SEQ ID NO: 600092 - DNA, 25 bp, Mus musculus
ggagggactggaccaagcaccccac

SEQ ID NO: 600093 - DNA, 25 bp, Mus musculus
ggagggactggagcaagcaccccac

SEQ ID NO: 600094 - DNA, 25 bp, Mus musculus
ggagggagaacgcttctttagtcct

SEQ ID NO: 600095 - DNA, 25 bp, Mus musculus
ggagggagaacggttctttagtcct

SEQ ID NO: 600096 - DNA, 25 bp, Mus musculus
ggagggagagacaaacttgttttat

SEQ ID NO: 600097 - DNA, 25 bp, Mus musculus
ggagggagagactaacttgttttat

SEQ ID NO: 600098 - DNA, 25 bp, Mus musculus
ggagggagatacctgacacagttcc

SEQ ID NO: 600099 - DNA, 25 bp, Mus musculus
ggagggagatacgtgacacagttcc

SEQ ID NO: 600100 - DNA, 25 bp, Mus musculus
ggagggagcagaaccgcagcaccca

SEQ ID NO: 600101 - DNA, 25 bp, Mus musculus
ggagggagcagatccgcagcaccca

SEQ ID NO: 600102 - DNA, 25 bp, Mus musculus
ggagggatattgatgtctctctttt

SEQ ID NO: 600103 - DNA, 25 bp, Mus musculus
ggagggatattgttgtctctctttt

SEQ ID NO: 600104 - DNA, 25 bp, Mus musculus
ggagggatcagcatcaggcctgaat

SEQ ID NO: 600105 - DNA, 25 bp, Mus musculus
ggagggatcagcttcaggcctgaat

SEQ ID NO: 600106 - DNA, 25 bp, Mus musculus
ggagggatctgcatctgcggaaata

SEQ ID NO: 600107 - DNA, 25 bp, Mus musculus
ggagggatctgcttctgcggaaata

SEQ ID NO: 600108 - DNA, 25 bp, Mus musculus
ggagggatgaccactgttcagtgcc

SEQ ID NO: 600109 - DNA, 25 bp, Mus musculus
ggagggatgacctctgttcagtgcc

SEQ ID NO: 600110 - DNA, 25 bp, Mus musculus
ggagggattattacagcttactgtt

SEQ ID NO: 600111 - DNA, 25 bp, Mus musculus
ggagggattatttcagcttactgtt

SEQ ID NO: 600112 - DNA, 25 bp, Mus musculus
ggagggattcttctgatcaaatatc

SEQ ID NO: 600113 - DNA, 25 bp, Mus musculus
ggagggattcttgtgatcaaatatc

SEQ ID NO: 600114 - DNA, 25 bp, Mus musculus
ggagggatttatatactgtgcttgt

SEQ ID NO: 600115 - DNA, 25 bp, Mus musculus
ggagggatttatttactgtgcttgt

SEQ ID NO: 600116 - DNA, 25 bp, Mus musculus
ggagggatttcccaatcaacactaa

SEQ ID NO: 600117 - DNA, 25 bp, Mus musculus
ggagggatttccgaatcaacactaa

SEQ ID NO: 600118 - DNA, 25 bp, Mus musculus
ggagggatttgaccttgttcccaag

SEQ ID NO: 600119 - DNA, 25 bp, Mus musculus
ggagggatttgagcttgttcccaag

SEQ ID NO: 600120 - DNA, 25 bp, Mus musculus
ggagggcaaagcacaggaccaactt

SEQ ID NO: 600121 - DNA, 25 bp, Mus musculus
ggagggcaaagctcaggaccaactt

SEQ ID NO: 600122 - DNA, 25 bp, Mus musculus
ggagggcaaccaattgctgtgccat

SEQ ID NO: 600123 - DNA, 25 bp, Mus musculus
ggagggcaaccatttgctgtgccat

SEQ ID NO: 600124 - DNA, 25 bp, Mus musculus
ggagggcaatgtatttcattatata

SEQ ID NO: 600125 - DNA, 25 bp, Mus musculus
ggagggcaatgtttttcattatata

SEQ ID NO: 600126 - DNA, 25 bp, Mus musculus
ggagggcacaaacggccactttagt

SEQ ID NO: 600127 - DNA, 25 bp, Mus musculus
ggagggcacaaagggccactttagt

SEQ ID NO: 600128 - DNA, 25 bp, Mus musculus
ggagggcacacacagatgatcccga

SEQ ID NO: 600129 - DNA, 25 bp, Mus musculus
ggagggcacacagagatgatcccga

SEQ ID NO: 600130 - DNA, 25 bp, Mus musculus
ggagggcacaggaacgtccacaacc

SEQ ID NO: 600131 - DNA, 25 bp, Mus musculus
ggagggcacaggtacgtccacaacc

SEQ ID NO: 600132 - DNA, 25 bp, Mus musculus
ggagggcaccacaaagcactgcatg

SEQ ID NO: 600133 - DNA, 25 bp, Mus musculus
ggagggcaccacacagtctatgcaa

SEQ ID NO: 600134 - DNA, 25 bp, Mus musculus
ggagggcaccactaagcactgcatg

SEQ ID NO: 600135 - DNA, 25 bp, Mus musculus
ggagggcaccactcagtctatgcaa

SEQ ID NO: 600136 - DNA, 25 bp, Mus musculus
ggagggcaccctcaaagtaccactg

SEQ ID NO: 600137 - DNA, 25 bp, Mus musculus
ggagggcaccctgaaagtaccactg

SEQ ID NO: 600138 - DNA, 25 bp, Mus musculus
ggagggcacctcatggctttgtgca

SEQ ID NO: 600139 - DNA, 25 bp, Mus musculus
ggagggcacctcttggctttgtgca

SEQ ID NO: 600140 - DNA, 25 bp, Mus musculus
ggagggcacctgcaacactggatat

SEQ ID NO: 600141 - DNA, 25 bp, Mus musculus
ggagggcacctggaacactggatat

SEQ ID NO: 600142 - DNA, 25 bp, Mus musculus
ggagggcactcaattttctttacaa

SEQ ID NO: 600143 - DNA, 25 bp, Mus musculus
ggagggcactcatttttctttacaa

SEQ ID NO: 600144 - DNA, 25 bp, Mus musculus
ggagggcactgtcatgtctctagct

SEQ ID NO: 600145 - DNA, 25 bp, Mus musculus
ggagggcactgtgatgtctctagct

SEQ ID NO: 600146 - DNA, 25 bp, Mus musculus
ggagggcagaacaacttgcaagttt

SEQ ID NO: 600147 - DNA, 25 bp, Mus musculus
ggagggcagaaccatgcagtcttct

SEQ ID NO: 600148 - DNA, 25 bp, Mus musculus
ggagggcagaacgatgcagtcttct

SEQ ID NO: 600149 - DNA, 25 bp, Mus musculus
ggagggcagaactacttgcaagttt

SEQ ID NO: 600150 - DNA, 25 bp, Mus musculus
ggagggcagaccacattgcttttca

SEQ ID NO: 600151 - DNA, 25 bp, Mus musculus
ggagggcagacctcattgcttttca

SEQ ID NO: 600152 - DNA, 25 bp, Mus musculus
ggagggcagattaacattatatcaa

SEQ ID NO: 600153 - DNA, 25 bp, Mus musculus
ggagggcagatttacattatatcaa

SEQ ID NO: 600154 - DNA, 25 bp, Mus musculus
ggagggcaggaccacctgtctccat

SEQ ID NO: 600155 - DNA, 25 bp, Mus musculus
ggagggcaggacgacctgtctccat

SEQ ID NO: 600156 - DNA, 25 bp, Mus musculus
ggagggcagtccagtgaacctgacc

SEQ ID NO: 600157 - DNA, 25 bp, Mus musculus
ggagggcagtcctgtgaacctgacc

SEQ ID NO: 600158 - DNA, 25 bp, Mus musculus
ggagggcatggtatcttctgagcct

SEQ ID NO: 600159 - DNA, 25 bp, Mus musculus
ggagggcatggtttcttctgagcct

SEQ ID NO: 600160 - DNA, 25 bp, Mus musculus
ggagggcatgttctgtatttttgtt

SEQ ID NO: 600161 - DNA, 25 bp, Mus musculus
ggagggcatgttgtgtatttttgtt

SEQ ID NO: 600162 - DNA, 25 bp, Mus musculus
ggagggcattgaacacagtgtaaat

SEQ ID NO: 600163 - DNA, 25 bp, Mus musculus
ggagggcattgatcacagtgtaaat

SEQ ID NO: 600164 - DNA, 25 bp, Mus musculus
ggagggccaattcctgatagtactg

SEQ ID NO: 600165 - DNA, 25 bp, Mus musculus
ggagggccaattgctgatagtactg

SEQ ID NO: 600166 - DNA, 25 bp, Mus musculus
ggagggccatcaagaatgactctgt

SEQ ID NO: 600167 - DNA, 25 bp, Mus musculus
ggagggccatcatgaatgactctgt

SEQ ID NO: 600168 - DNA, 25 bp, Mus musculus
ggagggccccagagataagaataat

SEQ ID NO: 600169 - DNA, 25 bp, Mus musculus
ggagggccccagtgataagaataat

SEQ ID NO: 600170 - DNA, 25 bp, Mus musculus
ggagggcccgtcacagtccgatgaa

SEQ ID NO: 600171 - DNA, 25 bp, Mus musculus
ggagggcccgtctcagtccgatgaa

SEQ ID NO: 600172 - DNA, 25 bp, Mus musculus
ggagggccctaaaagctatgtagaa

SEQ ID NO: 600173 - DNA, 25 bp, Mus musculus
ggagggccctaatagctatgtagaa

SEQ ID NO: 600174 - DNA, 25 bp, Mus musculus
ggagggccgtatcacttatttcttt

SEQ ID NO: 600175 - DNA, 25 bp, Mus musculus
ggagggccgtatgacttatttcttt

SEQ ID NO: 600176 - DNA, 25 bp, Mus musculus
ggagggcctctacaacggaacacag

SEQ ID NO: 600177 - DNA, 25 bp, Mus musculus
ggagggcctctagaacggaacacag

SEQ ID NO: 600178 - DNA, 25 bp, Mus musculus
ggagggcctgagatttttatcactg

SEQ ID NO: 600179 - DNA, 25 bp, Mus musculus
ggagggcctgagttttttatcactg

SEQ ID NO: 600180 - DNA, 25 bp, Mus musculus
ggagggcctgtgcacctcattacat

SEQ ID NO: 600181 - DNA, 25 bp, Mus musculus
ggagggcctgtggacctcattacat

SEQ ID NO: 600182 - DNA, 25 bp, Mus musculus
ggagggcgacacaaaagacaagaaa

SEQ ID NO: 600183 - DNA, 25 bp, Mus musculus
ggagggcgacactaaagacaagaaa

SEQ ID NO: 600184 - DNA, 25 bp, Mus musculus
ggagggcgtgcaccaagattcaaac

SEQ ID NO: 600185 - DNA, 25 bp, Mus musculus
ggagggcgtgcagcaagattcaaac

SEQ ID NO: 600186 - DNA, 25 bp, Mus musculus
ggagggcgtttgatgcagctggact

SEQ ID NO: 600187 - DNA, 25 bp, Mus musculus
ggagggcgtttgttgcagctggact

SEQ ID NO: 600188 - DNA, 25 bp, Mus musculus
ggagggctaatccaactgaccagct

SEQ ID NO: 600189 - DNA, 25 bp, Mus musculus
ggagggctaatcgaactgaccagct

SEQ ID NO: 600190 - DNA, 25 bp, Mus musculus
ggagggctactcatctgactgctga

SEQ ID NO: 600191 - DNA, 25 bp, Mus musculus
ggagggctactcttctgactgctga

SEQ ID NO: 600192 - DNA, 25 bp, Mus musculus
ggagggctatcaaacacatgcacac

SEQ ID NO: 600193 - DNA, 25 bp, Mus musculus
ggagggctatcatacacatgcacac

SEQ ID NO: 600194 - DNA, 25 bp, Mus musculus
ggagggctcattcctaaaacactta

SEQ ID NO: 600195 - DNA, 25 bp, Mus musculus
ggagggctcattgctaaaacactta

SEQ ID NO: 600196 - DNA, 25 bp, Mus musculus
ggagggctcctcagctgtacgtgtc

SEQ ID NO: 600197 - DNA, 25 bp, Mus musculus
ggagggctcctctgctgtacgtgtc

SEQ ID NO: 600198 - DNA, 25 bp, Mus musculus
ggagggctctatcgatccttatcat

SEQ ID NO: 600199 - DNA, 25 bp, Mus musculus
ggagggctctatggatccttatcat

SEQ ID NO: 600200 - DNA, 25 bp, Mus musculus
ggagggctctcaataacaaggtcta

SEQ ID NO: 600201 - DNA, 25 bp, Mus musculus
ggagggctctcattaacaaggtcta

SEQ ID NO: 600202 - DNA, 25 bp, Mus musculus
ggagggctctgtcacattggtacta

SEQ ID NO: 600203 - DNA, 25 bp, Mus musculus
ggagggctctgtgacattggtacta

SEQ ID NO: 600204 - DNA, 25 bp, Mus musculus
ggagggctgactagccatcaaggca

SEQ ID NO: 600205 - DNA, 25 bp, Mus musculus
ggagggctgacttgccatcaaggca

SEQ ID NO: 600206 - DNA, 25 bp, Mus musculus
ggagggctggcccattacttgtcac

SEQ ID NO: 600207 - DNA, 25 bp, Mus musculus
ggagggctggccgattacttgtcac

SEQ ID NO: 600208 - DNA, 25 bp, Mus musculus
ggagggctgtgaattttccagtatt

SEQ ID NO: 600209 - DNA, 25 bp, Mus musculus
ggagggctgtgatttttccagtatt

SEQ ID NO: 600210 - DNA, 25 bp, Mus musculus
ggagggcttcccagctgagcagaac

SEQ ID NO: 600211 - DNA, 25 bp, Mus musculus
ggagggcttccctgctgagcagaac

SEQ ID NO: 600212 - DNA, 25 bp, Mus musculus
ggagggcttctccacctagatttcc

SEQ ID NO: 600213 - DNA, 25 bp, Mus musculus
ggagggcttctcgacctagatttcc

SEQ ID NO: 600214 - DNA, 25 bp, Mus musculus
ggagggcttgttaactgacatacac

SEQ ID NO: 600215 - DNA, 25 bp, Mus musculus
ggagggcttgttaagcaacattgaa

SEQ ID NO: 600216 - DNA, 25 bp, Mus musculus
ggagggcttgttattatgaccttga

SEQ ID NO: 600217 - DNA, 25 bp, Mus musculus
ggagggcttgtttactgacatacac

SEQ ID NO: 600218 - DNA, 25 bp, Mus musculus
ggagggcttgtttagcaacattgaa

SEQ ID NO: 600219 - DNA, 25 bp, Mus musculus
ggagggcttgtttttatgaccttga

SEQ ID NO: 600220 - DNA, 25 bp, Mus musculus
ggagggtaccacacacatggaacca

SEQ ID NO: 600221 - DNA, 25 bp, Mus musculus
ggagggtaccactcacatggaacca

SEQ ID NO: 600222 - DNA, 25 bp, Mus musculus
ggagggtacgacaccacaggtcaca

SEQ ID NO: 600223 - DNA, 25 bp, Mus musculus
ggagggtacgactccacaggtcaca

SEQ ID NO: 600224 - DNA, 25 bp, Mus musculus
ggagggtactgtctcagagccattt

SEQ ID NO: 600225 - DNA, 25 bp, Mus musculus
ggagggtactgtgtcagagccattt

SEQ ID NO: 600226 - DNA, 25 bp, Mus musculus
ggagggtcacagatccagtgcgtct

SEQ ID NO: 600227 - DNA, 25 bp, Mus musculus
ggagggtcacagttccagtgcgtct

SEQ ID NO: 600228 - DNA, 25 bp, Mus musculus
ggagggtcacttatgagtttgagac

SEQ ID NO: 600229 - DNA, 25 bp, Mus musculus
ggagggtcacttttgagtttgagac

SEQ ID NO: 600230 - DNA, 25 bp, Mus musculus
ggagggtcagggattcaaagccatt

SEQ ID NO: 600231 - DNA, 25 bp, Mus musculus
ggagggtcagggtttcaaagccatt

SEQ ID NO: 600232 - DNA, 25 bp, Mus musculus
ggagggtcatataaattaatctggt

SEQ ID NO: 600233 - DNA, 25 bp, Mus musculus
ggagggtcatattaattaatctggt

SEQ ID NO: 600234 - DNA, 25 bp, Mus musculus
ggagggtcatgcatcctgagaaatg

SEQ ID NO: 600235 - DNA, 25 bp, Mus musculus
ggagggtcatgcttcctgagaaatg

SEQ ID NO: 600236 - DNA, 25 bp, Mus musculus
ggagggtccacccagttccttgaga

SEQ ID NO: 600237 - DNA, 25 bp, Mus musculus
ggagggtccaccgagttccttgaga

SEQ ID NO: 600238 - DNA, 25 bp, Mus musculus
ggagggtccatcacggaagcctctg

SEQ ID NO: 600239 - DNA, 25 bp, Mus musculus
ggagggtccatctcggaagcctctg

SEQ ID NO: 600240 - DNA, 25 bp, Mus musculus
ggagggtcccaaaccaagagtctag

SEQ ID NO: 600241 - DNA, 25 bp, Mus musculus
ggagggtcccaatccaagagtctag

SEQ ID NO: 600242 - DNA, 25 bp, Mus musculus
ggagggtcggatacaatctgaactt

SEQ ID NO: 600243 - DNA, 25 bp, Mus musculus
ggagggtcggattcaatctgaactt

SEQ ID NO: 600244 - DNA, 25 bp, Mus musculus
ggagggtctataacctggacttcaa

SEQ ID NO: 600245 - DNA, 25 bp, Mus musculus
ggagggtctatatcctggacttcaa

SEQ ID NO: 600246 - DNA, 25 bp, Mus musculus
ggagggtctcctaatttttcatgat

SEQ ID NO: 600247 - DNA, 25 bp, Mus musculus
ggagggtctccttatttttcatgat

SEQ ID NO: 600248 - DNA, 25 bp, Mus musculus
ggagggtctcttcgacatatacttt

SEQ ID NO: 600249 - DNA, 25 bp, Mus musculus
ggagggtctcttggacatatacttt

SEQ ID NO: 600250 - DNA, 25 bp, Mus musculus
ggagggtctgcgagacaattacttt

SEQ ID NO: 600251 - DNA, 25 bp, Mus musculus
ggagggtctgcgtgacaattacttt

SEQ ID NO: 600252 - DNA, 25 bp, Mus musculus
ggagggtcttcacgcaaaaccacaa

SEQ ID NO: 600253 - DNA, 25 bp, Mus musculus
ggagggtcttcaggcaaaaccacaa

SEQ ID NO: 600254 - DNA, 25 bp, Mus musculus
ggagggtgaccaccattctcaacaa

SEQ ID NO: 600255 - DNA, 25 bp, Mus musculus
ggagggtgaccagcattctcaacaa

SEQ ID NO: 600256 - DNA, 25 bp, Mus musculus
ggagggtgatccacaagttcaaggc

SEQ ID NO: 600257 - DNA, 25 bp, Mus musculus
ggagggtgatcctcaagttcaaggc

SEQ ID NO: 600258 - DNA, 25 bp, Mus musculus
ggagggtgctacatgacccactgga

SEQ ID NO: 600259 - DNA, 25 bp, Mus musculus
ggagggtgctacttgacccactgga

SEQ ID NO: 600260 - DNA, 25 bp, Mus musculus
ggagggtgtctcagtaagtaccaca

SEQ ID NO: 600261 - DNA, 25 bp, Mus musculus
ggagggtgtctctgtaagtaccaca

SEQ ID NO: 600262 - DNA, 25 bp, Mus musculus
ggagggtgtgacactaacccgcgca

SEQ ID NO: 600263 - DNA, 25 bp, Mus musculus
ggagggtgtgactctaacccgcgca

SEQ ID NO: 600264 - DNA, 25 bp, Mus musculus
ggagggttagacacgtccagccact

SEQ ID NO: 600265 - DNA, 25 bp, Mus musculus
ggagggttagactcgtccagccact

SEQ ID NO: 600266 - DNA, 25 bp, Mus musculus
ggagggttcaaaccttcaccctact

SEQ ID NO: 600267 - DNA, 25 bp, Mus musculus
ggagggttcaaagcttcaccctact

SEQ ID NO: 600268 - DNA, 25 bp, Mus musculus
ggagggttcaacaccttctctggtg

SEQ ID NO: 600269 - DNA, 25 bp, Mus musculus
ggagggttcaactccttctctggtg

SEQ ID NO: 600270 - DNA, 25 bp, Mus musculus
ggagggttcgttatgtagatcgtca

SEQ ID NO: 600271 - DNA, 25 bp, Mus musculus
ggagggttcgttttgtagatcgtca

SEQ ID NO: 600272 - DNA, 25 bp, Mus musculus
ggagggttctaaagaaaggcaagct

SEQ ID NO: 600273 - DNA, 25 bp, Mus musculus
ggagggttctaatgaaaggcaagct

SEQ ID NO: 600274 - DNA, 25 bp, Mus musculus
ggagggttctagactgtgcaaacat

SEQ ID NO: 600275 - DNA, 25 bp, Mus musculus
ggagggttctagtctgtgcaaacat

SEQ ID NO: 600276 - DNA, 25 bp, Mus musculus
ggagggttctttcagcctctctccc

SEQ ID NO: 600277 - DNA, 25 bp, Mus musculus
ggagggttctttgagcctctctccc

SEQ ID NO: 600278 - DNA, 25 bp, Mus musculus
ggagggttgccactgaattgattaa

SEQ ID NO: 600279 - DNA, 25 bp, Mus musculus
ggagggttgccagtgaattgattaa

SEQ ID NO: 600280 - DNA, 25 bp, Mus musculus
ggagggtttgtaaaatgcacggcaa

SEQ ID NO: 600281 - DNA, 25 bp, Mus musculus
ggagggtttgtataatgcacggcaa

SEQ ID NO: 600282 - DNA, 25 bp, Mus musculus
ggagggtttgtgactagcttttccg

SEQ ID NO: 600283 - DNA, 25 bp, Mus musculus
ggagggtttgtgtctagcttttccg

SEQ ID NO: 600284 - DNA, 25 bp, Mus musculus
ggaggtaacactcctgatcgacaag

SEQ ID NO: 600285 - DNA, 25 bp, Mus musculus
ggaggtaacactgctgatcgacaag

SEQ ID NO: 600286 - DNA, 25 bp, Mus musculus
ggaggtaacaggcacagcttaagca

SEQ ID NO: 600287 - DNA, 25 bp, Mus musculus
ggaggtaacagggacagcttaagca

SEQ ID NO: 600288 - DNA, 25 bp, Mus musculus
ggaggtaacagtaagcattatttca

SEQ ID NO: 600289 - DNA, 25 bp, Mus musculus
ggaggtaacagttagcattatttca

SEQ ID NO: 600290 - DNA, 25 bp, Mus musculus
ggaggtaaccagctccttggcctaa

SEQ ID NO: 600291 - DNA, 25 bp, Mus musculus
ggaggtaaccaggtccttggcctaa

SEQ ID NO: 600292 - DNA, 25 bp, Mus musculus
ggaggtaacccaccggcacagtgca

SEQ ID NO: 600293 - DNA, 25 bp, Mus musculus
ggaggtaacccagcggcacagtgca

SEQ ID NO: 600294 - DNA, 25 bp, Mus musculus
ggaggtaacctcattcgtttgttct

SEQ ID NO: 600295 - DNA, 25 bp, Mus musculus
ggaggtaacctctttcgtttgttct

SEQ ID NO: 600296 - DNA, 25 bp, Mus musculus
ggaggtaatcacacattaacacagc

SEQ ID NO: 600297 - DNA, 25 bp, Mus musculus
ggaggtaatcactcattaacacagc

SEQ ID NO: 600298 - DNA, 25 bp, Mus musculus
ggaggtacagataagcccagagtta

SEQ ID NO: 600299 - DNA, 25 bp, Mus musculus
ggaggtacagattagcccagagtta

SEQ ID NO: 600300 - DNA, 25 bp, Mus musculus
ggaggtacatgcaacacctgtactt

SEQ ID NO: 600301 - DNA, 25 bp, Mus musculus
ggaggtacatgctacacctgtactt

SEQ ID NO: 600302 - DNA, 25 bp, Mus musculus
ggaggtaccaaccaacacatgtaag

SEQ ID NO: 600303 - DNA, 25 bp, Mus musculus
ggaggtaccaacgaacacatgtaag

SEQ ID NO: 600304 - DNA, 25 bp, Mus musculus
ggaggtaccatcaaatgtgttgcat

SEQ ID NO: 600305 - DNA, 25 bp, Mus musculus
ggaggtaccatctaatgtgttgcat

SEQ ID NO: 600306 - DNA, 25 bp, Mus musculus
ggaggtaccgacacagtgtccacgc

SEQ ID NO: 600307 - DNA, 25 bp, Mus musculus
ggaggtaccgacaccctggctgcta

SEQ ID NO: 600308 - DNA, 25 bp, Mus musculus
ggaggtaccgactcagtgtccacgc

SEQ ID NO: 600309 - DNA, 25 bp, Mus musculus
ggaggtaccgactccctggctgcta

SEQ ID NO: 600310 - DNA, 25 bp, Mus musculus
ggaggtacctcacaatccttccact

SEQ ID NO: 600311 - DNA, 25 bp, Mus musculus
ggaggtacctcagaatccttccact

SEQ ID NO: 600312 - DNA, 25 bp, Mus musculus
ggaggtactgtgctttattccttca

SEQ ID NO: 600313 - DNA, 25 bp, Mus musculus
ggaggtactgtggtttattccttca

SEQ ID NO: 600314 - DNA, 25 bp, Mus musculus
ggaggtagacacagggcccaagcaa

SEQ ID NO: 600315 - DNA, 25 bp, Mus musculus
ggaggtagacactgggcccaagcaa

SEQ ID NO: 600316 - DNA, 25 bp, Mus musculus
ggaggtagaggcaaccagatctgtt

SEQ ID NO: 600317 - DNA, 25 bp, Mus musculus
ggaggtagaggcacctaaccccagt

SEQ ID NO: 600318 - DNA, 25 bp, Mus musculus
ggaggtagaggctaccagatctgtt

SEQ ID NO: 600319 - DNA, 25 bp, Mus musculus
ggaggtagaggctcctaaccccagt

SEQ ID NO: 600320 - DNA, 25 bp, Mus musculus
ggaggtagatgaatatttgccaaat

SEQ ID NO: 600321 - DNA, 25 bp, Mus musculus
ggaggtagatgattatttgccaaat

SEQ ID NO: 600322 - DNA, 25 bp, Mus musculus
ggaggtagatggctttcataatatt

SEQ ID NO: 600323 - DNA, 25 bp, Mus musculus
ggaggtagatgggtttcataatatt

SEQ ID NO: 600324 - DNA, 25 bp, Mus musculus
ggaggtagccagacccaaaattgtt

SEQ ID NO: 600325 - DNA, 25 bp, Mus musculus
ggaggtagccagtcccaaaattgtt

SEQ ID NO: 600326 - DNA, 25 bp, Mus musculus
ggaggtagccccatgttagagaaaa

SEQ ID NO: 600327 - DNA, 25 bp, Mus musculus
ggaggtagccccttgttagagaaaa

SEQ ID NO: 600328 - DNA, 25 bp, Mus musculus
ggaggtagctctaggtctctgaagc

SEQ ID NO: 600329 - DNA, 25 bp, Mus musculus
ggaggtagctcttggtctctgaagc

SEQ ID NO: 600330 - DNA, 25 bp, Mus musculus
ggaggtaggcaaagttccctttcta

SEQ ID NO: 600331 - DNA, 25 bp, Mus musculus
ggaggtaggcaacatccagccttct

SEQ ID NO: 600332 - DNA, 25 bp, Mus musculus
ggaggtaggcaagatccagccttct

SEQ ID NO: 600333 - DNA, 25 bp, Mus musculus
ggaggtaggcaatgttccctttcta

SEQ ID NO: 600334 - DNA, 25 bp, Mus musculus
ggaggtaggctgcacgcaccacttc

SEQ ID NO: 600335 - DNA, 25 bp, Mus musculus
ggaggtaggctggacgcaccacttc

SEQ ID NO: 600336 - DNA, 25 bp, Mus musculus
ggaggtagtctgacattgaccttga

SEQ ID NO: 600337 - DNA, 25 bp, Mus musculus
ggaggtagtctgtcattgaccttga

SEQ ID NO: 600338 - DNA, 25 bp, Mus musculus
ggaggtatcactactcacatgtcaa

SEQ ID NO: 600339 - DNA, 25 bp, Mus musculus
ggaggtatcacttctcacatgtcaa

SEQ ID NO: 600340 - DNA, 25 bp, Mus musculus
ggaggtatgataaaacaggcttttc

SEQ ID NO: 600341 - DNA, 25 bp, Mus musculus
ggaggtatgatataacaggcttttc

SEQ ID NO: 600342 - DNA, 25 bp, Mus musculus
ggaggtatgtgcatacaattccagc

SEQ ID NO: 600343 - DNA, 25 bp, Mus musculus
ggaggtatgtgcttacaattccagc

SEQ ID NO: 600344 - DNA, 25 bp, Mus musculus
ggaggtattcgcagtcttctctcgg

SEQ ID NO: 600345 - DNA, 25 bp, Mus musculus
ggaggtattcgctgtcttctctcgg

SEQ ID NO: 600346 - DNA, 25 bp, Mus musculus
ggaggtattgttatgaaatgtgacc

SEQ ID NO: 600347 - DNA, 25 bp, Mus musculus
ggaggtattgttttgaaatgtgacc

SEQ ID NO: 600348 - DNA, 25 bp, Mus musculus
ggaggtcaacccagcctattcagta

SEQ ID NO: 600349 - DNA, 25 bp, Mus musculus
ggaggtcaaccctgcctattcagta

SEQ ID NO: 600350 - DNA, 25 bp, Mus musculus
ggaggtcacagaaggagcgacacgt

SEQ ID NO: 600351 - DNA, 25 bp, Mus musculus
ggaggtcacagatggagcgacacgt

SEQ ID NO: 600352 - DNA, 25 bp, Mus musculus
ggaggtcacccaaggttccgttctt

SEQ ID NO: 600353 - DNA, 25 bp, Mus musculus
ggaggtcacccatggttccgttctt

SEQ ID NO: 600354 - DNA, 25 bp, Mus musculus
ggaggtcactgcatttacggtgcac

SEQ ID NO: 600355 - DNA, 25 bp, Mus musculus
ggaggtcactgcttttacggtgcac

SEQ ID NO: 600356 - DNA, 25 bp, Mus musculus
ggaggtcactggctcattctgaagt

SEQ ID NO: 600357 - DNA, 25 bp, Mus musculus
ggaggtcactgggtcattctgaagt

SEQ ID NO: 600358 - DNA, 25 bp, Mus musculus
ggaggtcagaacatcctgtctaggg

SEQ ID NO: 600359 - DNA, 25 bp, Mus musculus
ggaggtcagaacttcctgtctaggg

SEQ ID NO: 600360 - DNA, 25 bp, Mus musculus
ggaggtcagaagcttcctagttcct

SEQ ID NO: 600361 - DNA, 25 bp, Mus musculus
ggaggtcagaaggttcctagttcct

SEQ ID NO: 600362 - DNA, 25 bp, Mus musculus
ggaggtcagaatcacatgcatacat

SEQ ID NO: 600363 - DNA, 25 bp, Mus musculus
ggaggtcagaatgacatgcatacat

SEQ ID NO: 600364 - DNA, 25 bp, Mus musculus
ggaggtcagagaacactttctgaag

SEQ ID NO: 600365 - DNA, 25 bp, Mus musculus
ggaggtcagagatcactttctgaag

SEQ ID NO: 600366 - DNA, 25 bp, Mus musculus
ggaggtcaggagatattacctgagt

SEQ ID NO: 600367 - DNA, 25 bp, Mus musculus
ggaggtcaggagttattacctgagt

SEQ ID NO: 600368 - DNA, 25 bp, Mus musculus
ggaggtcagggacgtctctttccac

SEQ ID NO: 600369 - DNA, 25 bp, Mus musculus
ggaggtcagggaggtctctttccac

SEQ ID NO: 600370 - DNA, 25 bp, Mus musculus
ggaggtcagtggcaggcccctgggt

SEQ ID NO: 600371 - DNA, 25 bp, Mus musculus
ggaggtcagtgggaggcccctgggt

SEQ ID NO: 600372 - DNA, 25 bp, Mus musculus
ggaggtcataggagaatggccaaac

SEQ ID NO: 600373 - DNA, 25 bp, Mus musculus
ggaggtcataggtgaatggccaaac

SEQ ID NO: 600374 - DNA, 25 bp, Mus musculus
ggaggtcatctgaggttctttgaac

SEQ ID NO: 600375 - DNA, 25 bp, Mus musculus
ggaggtcatctgtggttctttgaac

SEQ ID NO: 600376 - DNA, 25 bp, Mus musculus
ggaggtcatggaccatagattcttc

SEQ ID NO: 600377 - DNA, 25 bp, Mus musculus
ggaggtcatggagcatagattcttc

SEQ ID NO: 600378 - DNA, 25 bp, Mus musculus
ggaggtccaaggacacctttcgtgc

SEQ ID NO: 600379 - DNA, 25 bp, Mus musculus
ggaggtccaaggtcacctttcgtgc

SEQ ID NO: 600380 - DNA, 25 bp, Mus musculus
ggaggtccaccactgactgaactgg

SEQ ID NO: 600381 - DNA, 25 bp, Mus musculus
ggaggtccaccagtgactgaactgg

SEQ ID NO: 600382 - DNA, 25 bp, Mus musculus
ggaggtccagcaatggtgtcagttt

SEQ ID NO: 600383 - DNA, 25 bp, Mus musculus
ggaggtccagcattggtgtcagttt

SEQ ID NO: 600384 - DNA, 25 bp, Mus musculus
ggaggtccagccatcttgcgaaagc

SEQ ID NO: 600385 - DNA, 25 bp, Mus musculus
ggaggtccagccttcttgcgaaagc

SEQ ID NO: 600386 - DNA, 25 bp, Mus musculus
ggaggtccaggcatttatgacatct

SEQ ID NO: 600387 - DNA, 25 bp, Mus musculus
ggaggtccaggcttttatgacatct

SEQ ID NO: 600388 - DNA, 25 bp, Mus musculus
ggaggtccagtaattcttcaagatc

SEQ ID NO: 600389 - DNA, 25 bp, Mus musculus
ggaggtccagtatttcttcaagatc

SEQ ID NO: 600390 - DNA, 25 bp, Mus musculus
ggaggtccatgcagctaatcctagc

SEQ ID NO: 600391 - DNA, 25 bp, Mus musculus
ggaggtccatgctgctaatcctagc

SEQ ID NO: 600392 - DNA, 25 bp, Mus musculus
ggaggtcccaaacgatttccatcaa

SEQ ID NO: 600393 - DNA, 25 bp, Mus musculus
ggaggtcccaaaggatttccatcaa

SEQ ID NO: 600394 - DNA, 25 bp, Mus musculus
ggaggtccctaacctgctgctgaag

SEQ ID NO: 600395 - DNA, 25 bp, Mus musculus
ggaggtccctaagctgctgctgaag

SEQ ID NO: 600396 - DNA, 25 bp, Mus musculus
ggaggtccctttacaggccagcatt

SEQ ID NO: 600397 - DNA, 25 bp, Mus musculus
ggaggtcccttttcaggccagcatt

SEQ ID NO: 600398 - DNA, 25 bp, Mus musculus
ggaggtccttatcctaaatcaggtt

SEQ ID NO: 600399 - DNA, 25 bp, Mus musculus
ggaggtccttatgctaaatcaggtt

SEQ ID NO: 600400 - DNA, 25 bp, Mus musculus
ggaggtccttgaaactatcatttag

SEQ ID NO: 600401 - DNA, 25 bp, Mus musculus
ggaggtccttgatactatcatttag

SEQ ID NO: 600402 - DNA, 25 bp, Mus musculus
ggaggtcgagatcgccgtggtcatt

SEQ ID NO: 600403 - DNA, 25 bp, Mus musculus
ggaggtcgagatggccgtggtcatt

SEQ ID NO: 600404 - DNA, 25 bp, Mus musculus
ggaggtcgccagaaaaccgcccatc

SEQ ID NO: 600405 - DNA, 25 bp, Mus musculus
ggaggtcgccagtaaaccgcccatc

SEQ ID NO: 600406 - DNA, 25 bp, Mus musculus
ggaggtcgggatacctattgtttag

SEQ ID NO: 600407 - DNA, 25 bp, Mus musculus
ggaggtcgggattcctattgtttag

SEQ ID NO: 600408 - DNA, 25 bp, Mus musculus
ggaggtctacgactccaactccaaa

SEQ ID NO: 600409 - DNA, 25 bp, Mus musculus
ggaggtctacgactttattgcttct

SEQ ID NO: 600410 - DNA, 25 bp, Mus musculus
ggaggtctacgagtccaactccaaa

SEQ ID NO: 600411 - DNA, 25 bp, Mus musculus
ggaggtctacgagtttattgcttct

SEQ ID NO: 600412 - DNA, 25 bp, Mus musculus
ggaggtctactcaccaggaaaatgt

SEQ ID NO: 600413 - DNA, 25 bp, Mus musculus
ggaggtctactctccaggaaaatgt

SEQ ID NO: 600414 - DNA, 25 bp, Mus musculus
ggaggtctcaccatttaaacataac

SEQ ID NO: 600415 - DNA, 25 bp, Mus musculus
ggaggtctcaccttttaaacataac

SEQ ID NO: 600416 - DNA, 25 bp, Mus musculus
ggaggtctcatcaatgttcttttta

SEQ ID NO: 600417 - DNA, 25 bp, Mus musculus
ggaggtctcatctatgttcttttta

SEQ ID NO: 600418 - DNA, 25 bp, Mus musculus
ggaggtctccaaatacctgcacaga

SEQ ID NO: 600419 - DNA, 25 bp, Mus musculus
ggaggtctccaattacctgcacaga

SEQ ID NO: 600420 - DNA, 25 bp, Mus musculus
ggaggtctcctgcatcaaagtggac

SEQ ID NO: 600421 - DNA, 25 bp, Mus musculus
ggaggtctcctggatcaaagtggac

SEQ ID NO: 600422 - DNA, 25 bp, Mus musculus
ggaggtctcgttagcgtgagcacac

SEQ ID NO: 600423 - DNA, 25 bp, Mus musculus
ggaggtctcgtttgcgtgagcacac

SEQ ID NO: 600424 - DNA, 25 bp, Mus musculus
ggaggtctgaaaatgcctacccagt

SEQ ID NO: 600425 - DNA, 25 bp, Mus musculus
ggaggtctgaaattgcctacccagt

SEQ ID NO: 600426 - DNA, 25 bp, Mus musculus
ggaggtctgccacgatatagctcct

SEQ ID NO: 600427 - DNA, 25 bp, Mus musculus
ggaggtctgccaggatatagctcct

SEQ ID NO: 600428 - DNA, 25 bp, Mus musculus
ggaggtcttatacttaatctattgt

SEQ ID NO: 600429 - DNA, 25 bp, Mus musculus
ggaggtcttatagttaatctattgt

SEQ ID NO: 600430 - DNA, 25 bp, Mus musculus
ggaggtcttatgatctatcctgaac

SEQ ID NO: 600431 - DNA, 25 bp, Mus musculus
ggaggtcttatgttctatcctgaac

SEQ ID NO: 600432 - DNA, 25 bp, Mus musculus
ggaggtcttgctcctcttggctttc

SEQ ID NO: 600433 - DNA, 25 bp, Mus musculus
ggaggtcttgctgctcttggctttc

SEQ ID NO: 600434 - DNA, 25 bp, Mus musculus
ggaggtcttgggagaaccttcacta

SEQ ID NO: 600435 - DNA, 25 bp, Mus musculus
ggaggtcttgggtgaaccttcacta

SEQ ID NO: 600436 - DNA, 25 bp, Mus musculus
ggaggtcttttccagtgctgactgc

SEQ ID NO: 600437 - DNA, 25 bp, Mus musculus
ggaggtcttttcgagtgctgactgc

SEQ ID NO: 600438 - DNA, 25 bp, Mus musculus
ggaggtgacacaagcaacccaggca

SEQ ID NO: 600439 - DNA, 25 bp, Mus musculus
ggaggtgacacatgcaacccaggca

SEQ ID NO: 600440 - DNA, 25 bp, Mus musculus
ggaggtgacaccatttaccaagagc

SEQ ID NO: 600441 - DNA, 25 bp, Mus musculus
ggaggtgacaccttttaccaagagc

SEQ ID NO: 600442 - DNA, 25 bp, Mus musculus
ggaggtgaccccactgattggcagc

SEQ ID NO: 600443 - DNA, 25 bp, Mus musculus
ggaggtgacccctctgattggcagc

SEQ ID NO: 600444 - DNA, 25 bp, Mus musculus
ggaggtgacctgacataccaaagca

SEQ ID NO: 600445 - DNA, 25 bp, Mus musculus
ggaggtgacctgtcataccaaagca

SEQ ID NO: 600446 - DNA, 25 bp, Mus musculus
ggaggtgaggctacctttgtgtcct

SEQ ID NO: 600447 - DNA, 25 bp, Mus musculus
ggaggtgaggcttcctttgtgtcct

SEQ ID NO: 600448 - DNA, 25 bp, Mus musculus
ggaggtgatagacatcaggccttct

SEQ ID NO: 600449 - DNA, 25 bp, Mus musculus
ggaggtgatagagatcaggccttct

SEQ ID NO: 600450 - DNA, 25 bp, Mus musculus
ggaggtgatcaacgacatttaagaa

SEQ ID NO: 600451 - DNA, 25 bp, Mus musculus
ggaggtgatcaaggacatttaagaa

SEQ ID NO: 600452 - DNA, 25 bp, Mus musculus
ggaggtgatctcagactgcaagttt

SEQ ID NO: 600453 - DNA, 25 bp, Mus musculus
ggaggtgatctctgactgcaagttt

SEQ ID NO: 600454 - DNA, 25 bp, Mus musculus
ggaggtgatgaaatattagcagaca

SEQ ID NO: 600455 - DNA, 25 bp, Mus musculus
ggaggtgatgaattattagcagaca

SEQ ID NO: 600456 - DNA, 25 bp, Mus musculus
ggaggtgattcaagcgttctcggcc

SEQ ID NO: 600457 - DNA, 25 bp, Mus musculus
ggaggtgattcatgcgttctcggcc

SEQ ID NO: 600458 - DNA, 25 bp, Mus musculus
ggaggtgattgacggcaaattaaaa

SEQ ID NO: 600459 - DNA, 25 bp, Mus musculus
ggaggtgattgagggcaaattaaaa

SEQ ID NO: 600460 - DNA, 25 bp, Mus musculus
ggaggtgatttcaaaggcctttcta

SEQ ID NO: 600461 - DNA, 25 bp, Mus musculus
ggaggtgatttctaaggcctttcta

SEQ ID NO: 600462 - DNA, 25 bp, Mus musculus
ggaggtgcacgccttctccggatca

SEQ ID NO: 600463 - DNA, 25 bp, Mus musculus
ggaggtgcacgcgttctccggatca

SEQ ID NO: 600464 - DNA, 25 bp, Mus musculus
ggaggtgcactgagcctttctaaag

SEQ ID NO: 600465 - DNA, 25 bp, Mus musculus
ggaggtgcactgtgcctttctaaag

SEQ ID NO: 600466 - DNA, 25 bp, Mus musculus
ggaggtgcatatctgatcagcccac

SEQ ID NO: 600467 - DNA, 25 bp, Mus musculus
ggaggtgcatatgtgatcagcccac

SEQ ID NO: 600468 - DNA, 25 bp, Mus musculus
ggaggtgcccttcaatctactgagg

SEQ ID NO: 600469 - DNA, 25 bp, Mus musculus
ggaggtgcccttgaatctactgagg

SEQ ID NO: 600470 - DNA, 25 bp, Mus musculus
ggaggtgcctgcagtttataatgtt

SEQ ID NO: 600471 - DNA, 25 bp, Mus musculus
ggaggtgcctgctgtttataatgtt

SEQ ID NO: 600472 - DNA, 25 bp, Mus musculus
ggaggtgcgagtacctcagtgacca

SEQ ID NO: 600473 - DNA, 25 bp, Mus musculus
ggaggtgcgagttcctcagtgacca

SEQ ID NO: 600474 - DNA, 25 bp, Mus musculus
ggaggtgctagaaccacagaaccgc

SEQ ID NO: 600475 - DNA, 25 bp, Mus musculus
ggaggtgctagatccacagaaccgc

SEQ ID NO: 600476 - DNA, 25 bp, Mus musculus
ggaggtgctcccagcatactatgac

SEQ ID NO: 600477 - DNA, 25 bp, Mus musculus
ggaggtgctccctgcatactatgac

SEQ ID NO: 600478 - DNA, 25 bp, Mus musculus
ggaggtgctcgtagctgtgatcgta

SEQ ID NO: 600479 - DNA, 25 bp, Mus musculus
ggaggtgctcgttgctgtgatcgta

SEQ ID NO: 600480 - DNA, 25 bp, Mus musculus
ggaggtgctgatccctcctttcgaa

SEQ ID NO: 600481 - DNA, 25 bp, Mus musculus
ggaggtgctgatgcctcctttcgaa

SEQ ID NO: 600482 - DNA, 25 bp, Mus musculus
ggaggtgcttttacagaccgctaat

SEQ ID NO: 600483 - DNA, 25 bp, Mus musculus
ggaggtgctttttcagaccgctaat

SEQ ID NO: 600484 - DNA, 25 bp, Mus musculus
ggaggtggaaccagccaggtccttt

SEQ ID NO: 600485 - DNA, 25 bp, Mus musculus
ggaggtggaacctgccaggtccttt

SEQ ID NO: 600486 - DNA, 25 bp, Mus musculus
ggaggtggagctaccgaaattgaat

SEQ ID NO: 600487 - DNA, 25 bp, Mus musculus
ggaggtggagcttccgaaattgaat

SEQ ID NO: 600488 - DNA, 25 bp, Mus musculus
ggaggtggagttctttatgctacac

SEQ ID NO: 600489 - DNA, 25 bp, Mus musculus
ggaggtggagttgtttatgctacac

SEQ ID NO: 600490 - DNA, 25 bp, Mus musculus
ggaggtggatgactcattgttccaa

SEQ ID NO: 600491 - DNA, 25 bp, Mus musculus
ggaggtggatgagtcattgttccaa

SEQ ID NO: 600492 - DNA, 25 bp, Mus musculus
ggaggtggattcattctccttcagc

SEQ ID NO: 600493 - DNA, 25 bp, Mus musculus
ggaggtggattctttctccttcagc

SEQ ID NO: 600494 - DNA, 25 bp, Mus musculus
ggaggtggatttatctcttccatta

SEQ ID NO: 600495 - DNA, 25 bp, Mus musculus
ggaggtggatttttctcttccatta

SEQ ID NO: 600496 - DNA, 25 bp, Mus musculus
ggaggtggcaacagagctaccatgc

SEQ ID NO: 600497 - DNA, 25 bp, Mus musculus
ggaggtggcaactgagctaccatgc

SEQ ID NO: 600498 - DNA, 25 bp, Mus musculus
ggaggtggccatatcaagtaaatac

SEQ ID NO: 600499 - DNA, 25 bp, Mus musculus
ggaggtggccatttcaagtaaatac

SEQ ID NO: 600500 - DNA, 25 bp, Mus musculus
ggaggtgggaccatcccctgagttc

SEQ ID NO: 600501 - DNA, 25 bp, Mus musculus
ggaggtgggaccttcccctgagttc

SEQ ID NO: 600502 - DNA, 25 bp, Mus musculus
ggaggtgggtgaaatctactgtata

SEQ ID NO: 600503 - DNA, 25 bp, Mus musculus
ggaggtgggtgatatctactgtata

SEQ ID NO: 600504 - DNA, 25 bp, Mus musculus
ggaggtggtcacagtttcgcattgc

SEQ ID NO: 600505 - DNA, 25 bp, Mus musculus
ggaggtggtcactgtttcgcattgc

SEQ ID NO: 600506 - DNA, 25 bp, Mus musculus
ggaggtggtctcaagaactacatgg

SEQ ID NO: 600507 - DNA, 25 bp, Mus musculus
ggaggtggtctctagaactacatgg

SEQ ID NO: 600508 - DNA, 25 bp, Mus musculus
ggaggtgtaaagaaaccatcttaca

SEQ ID NO: 600509 - DNA, 25 bp, Mus musculus
ggaggtgtaaagtaaccatcttaca

SEQ ID NO: 600510 - DNA, 25 bp, Mus musculus
ggaggtgtaaggacatttgttttca

SEQ ID NO: 600511 - DNA, 25 bp, Mus musculus
ggaggtgtaaggtcatttgttttca

SEQ ID NO: 600512 - DNA, 25 bp, Mus musculus
ggaggtgtaccaaggccccgcaaag

SEQ ID NO: 600513 - DNA, 25 bp, Mus musculus
ggaggtgtaccatggccccgcaaag

SEQ ID NO: 600514 - DNA, 25 bp, Mus musculus
ggaggtgtatctacaattaaacaat

SEQ ID NO: 600515 - DNA, 25 bp, Mus musculus
ggaggtgtatcttcaattaaacaat

SEQ ID NO: 600516 - DNA, 25 bp, Mus musculus
ggaggtgtcaagactacaagcaaga

SEQ ID NO: 600517 - DNA, 25 bp, Mus musculus
ggaggtgtcaagtctacaagcaaga

SEQ ID NO: 600518 - DNA, 25 bp, Mus musculus
ggaggtgtcacaataccgcaggacc

SEQ ID NO: 600519 - DNA, 25 bp, Mus musculus
ggaggtgtcacattaccgcaggacc

SEQ ID NO: 600520 - DNA, 25 bp, Mus musculus
ggaggtgtcagtctcctgcagaaat

SEQ ID NO: 600521 - DNA, 25 bp, Mus musculus
ggaggtgtcagtgtcctgcagaaat

SEQ ID NO: 600522 - DNA, 25 bp, Mus musculus
ggaggtgtcctacttagagtttcta

SEQ ID NO: 600523 - DNA, 25 bp, Mus musculus
ggaggtgtcctagttagagtttcta

SEQ ID NO: 600524 - DNA, 25 bp, Mus musculus
ggaggtgtcctgaataacacaagtg

SEQ ID NO: 600525 - DNA, 25 bp, Mus musculus
ggaggtgtcctgtataacacaagtg

SEQ ID NO: 600526 - DNA, 25 bp, Mus musculus
ggaggtgtcgatcttagactcaaca

SEQ ID NO: 600527 - DNA, 25 bp, Mus musculus
ggaggtgtcgatgttagactcaaca

SEQ ID NO: 600528 - DNA, 25 bp, Mus musculus
ggaggtgtcttaagttctttgctta

SEQ ID NO: 600529 - DNA, 25 bp, Mus musculus
ggaggtgtcttacttttccctatct

SEQ ID NO: 600530 - DNA, 25 bp, Mus musculus
ggaggtgtcttagttttccctatct

SEQ ID NO: 600531 - DNA, 25 bp, Mus musculus
ggaggtgtcttatgttctttgctta

SEQ ID NO: 600532 - DNA, 25 bp, Mus musculus
ggaggtgtgactacagcatccacta

SEQ ID NO: 600533 - DNA, 25 bp, Mus musculus
ggaggtgtgacttcagcatccacta

SEQ ID NO: 600534 - DNA, 25 bp, Mus musculus
ggaggtgtgcaaaccactgcgtcca

SEQ ID NO: 600535 - DNA, 25 bp, Mus musculus
ggaggtgtgcaatccactgcgtcca

SEQ ID NO: 600536 - DNA, 25 bp, Mus musculus
ggaggtgtgtgtacagaagcaaaca

SEQ ID NO: 600537 - DNA, 25 bp, Mus musculus
ggaggtgtgtgttcagaagcaaaca

SEQ ID NO: 600538 - DNA, 25 bp, Mus musculus
ggaggtgttacaatcttcaggttca

SEQ ID NO: 600539 - DNA, 25 bp, Mus musculus
ggaggtgttacattcttcaggttca

SEQ ID NO: 600540 - DNA, 25 bp, Mus musculus
ggaggtgttcaacactccccgtgcc

SEQ ID NO: 600541 - DNA, 25 bp, Mus musculus
ggaggtgttcaagactccccgtgcc

SEQ ID NO: 600542 - DNA, 25 bp, Mus musculus
ggaggttaaagcatctgccacacac

SEQ ID NO: 600543 - DNA, 25 bp, Mus musculus
ggaggttaaagcttctgccacacac

SEQ ID NO: 600544 - DNA, 25 bp, Mus musculus
ggaggttaatttagccaaggccctg

SEQ ID NO: 600545 - DNA, 25 bp, Mus musculus
ggaggttaattttgccaaggccctg

SEQ ID NO: 600546 - DNA, 25 bp, Mus musculus
ggaggttacatcattctgtgacaac

SEQ ID NO: 600547 - DNA, 25 bp, Mus musculus
ggaggttacatctttctgtgacaac

SEQ ID NO: 600548 - DNA, 25 bp, Mus musculus
ggaggttacctgagtcaccacattg

SEQ ID NO: 600549 - DNA, 25 bp, Mus musculus
ggaggttacctgtgtcaccacattg

SEQ ID NO: 600550 - DNA, 25 bp, Mus musculus
ggaggttagaaacccttgcctcctt

SEQ ID NO: 600551 - DNA, 25 bp, Mus musculus
ggaggttagaaagccttgcctcctt

SEQ ID NO: 600552 - DNA, 25 bp, Mus musculus
ggaggttatcctatcaatgatgtac

SEQ ID NO: 600553 - DNA, 25 bp, Mus musculus
ggaggttatcctttcaatgatgtac

SEQ ID NO: 600554 - DNA, 25 bp, Mus musculus
ggaggttatctaccaagttatacca

SEQ ID NO: 600555 - DNA, 25 bp, Mus musculus
ggaggttatctagcaagttatacca

SEQ ID NO: 600556 - DNA, 25 bp, Mus musculus
ggaggttatgtcatttctgcacaac

SEQ ID NO: 600557 - DNA, 25 bp, Mus musculus
ggaggttatgtcttttctgcacaac

SEQ ID NO: 600558 - DNA, 25 bp, Mus musculus
ggaggttcaacacaggtcactttgt

SEQ ID NO: 600559 - DNA, 25 bp, Mus musculus
ggaggttcaacagaggtcactttgt

SEQ ID NO: 600560 - DNA, 25 bp, Mus musculus
ggaggttcagatcctgcacttagag

SEQ ID NO: 600561 - DNA, 25 bp, Mus musculus
ggaggttcagatgctgcacttagag

SEQ ID NO: 600562 - DNA, 25 bp, Mus musculus
ggaggttcagccacactaataataa

SEQ ID NO: 600563 - DNA, 25 bp, Mus musculus
ggaggttcagcctcactaataataa

SEQ ID NO: 600564 - DNA, 25 bp, Mus musculus
ggaggttcatggaatccaactctat

SEQ ID NO: 600565 - DNA, 25 bp, Mus musculus
ggaggttcatggtatccaactctat

SEQ ID NO: 600566 - DNA, 25 bp, Mus musculus
ggaggttccagaatcaattcctagc

SEQ ID NO: 600567 - DNA, 25 bp, Mus musculus
ggaggttccagattcaattcctagc

SEQ ID NO: 600568 - DNA, 25 bp, Mus musculus
ggaggttcccaacctcagtaactca

SEQ ID NO: 600569 - DNA, 25 bp, Mus musculus
ggaggttcccaagctcagtaactca

SEQ ID NO: 600570 - DNA, 25 bp, Mus musculus
ggaggttcccttacttgtagtcatc

SEQ ID NO: 600571 - DNA, 25 bp, Mus musculus
ggaggttccctttcttgtagtcatc

SEQ ID NO: 600572 - DNA, 25 bp, Mus musculus
ggaggttcctccatggtggcacaca

SEQ ID NO: 600573 - DNA, 25 bp, Mus musculus
ggaggttcctccttggtggcacaca

SEQ ID NO: 600574 - DNA, 25 bp, Mus musculus
ggaggttcgcgtagtcacgtgaaat

SEQ ID NO: 600575 - DNA, 25 bp, Mus musculus
ggaggttcgcgttgtcacgtgaaat

SEQ ID NO: 600576 - DNA, 25 bp, Mus musculus
ggaggttctacaccgagatctgcta

SEQ ID NO: 600577 - DNA, 25 bp, Mus musculus
ggaggttctacagcgagatctgcta

SEQ ID NO: 600578 - DNA, 25 bp, Mus musculus
ggaggttctcgcagtttctagggat

SEQ ID NO: 600579 - DNA, 25 bp, Mus musculus
ggaggttctcgctgtttctagggat

SEQ ID NO: 600580 - DNA, 25 bp, Mus musculus
ggaggttctcttaggtatgtcccct

SEQ ID NO: 600581 - DNA, 25 bp, Mus musculus
ggaggttctctttggtatgtcccct

SEQ ID NO: 600582 - DNA, 25 bp, Mus musculus
ggaggttctggcaatccactgggat

SEQ ID NO: 600583 - DNA, 25 bp, Mus musculus
ggaggttctggctatccactgggat

SEQ ID NO: 600584 - DNA, 25 bp, Mus musculus
ggaggttctgttaactcagccgaat

SEQ ID NO: 600585 - DNA, 25 bp, Mus musculus
ggaggttctgtttactcagccgaat

SEQ ID NO: 600586 - DNA, 25 bp, Mus musculus
ggaggttcttctaattttgtgagcc

SEQ ID NO: 600587 - DNA, 25 bp, Mus musculus
ggaggttcttcttattttgtgagcc

SEQ ID NO: 600588 - DNA, 25 bp, Mus musculus
ggaggttcttgcctttgattccagc

SEQ ID NO: 600589 - DNA, 25 bp, Mus musculus
ggaggttcttgcgtttgattccagc

SEQ ID NO: 600590 - DNA, 25 bp, Mus musculus
ggaggttgaaccatcgcagccagtg

SEQ ID NO: 600591 - DNA, 25 bp, Mus musculus
ggaggttgaaccttcgcagccagtg

SEQ ID NO: 600592 - DNA, 25 bp, Mus musculus
ggaggttgacacagtggaattgcaa

SEQ ID NO: 600593 - DNA, 25 bp, Mus musculus
ggaggttgacactgtggaattgcaa

SEQ ID NO: 600594 - DNA, 25 bp, Mus musculus
ggaggttgcataacaccactgcgca

SEQ ID NO: 600595 - DNA, 25 bp, Mus musculus
ggaggttgcatatcaccactgcgca

SEQ ID NO: 600596 - DNA, 25 bp, Mus musculus
ggaggttgccaaccagtgcacagat

SEQ ID NO: 600597 - DNA, 25 bp, Mus musculus
ggaggttgccaagcagtgcacagat

SEQ ID NO: 600598 - DNA, 25 bp, Mus musculus
ggaggttgcgccaagaccatgctga

SEQ ID NO: 600599 - DNA, 25 bp, Mus musculus
ggaggttgcgcctagaccatgctga

SEQ ID NO: 600600 - DNA, 25 bp, Mus musculus
ggaggttgctccagttggttatgta

SEQ ID NO: 600601 - DNA, 25 bp, Mus musculus
ggaggttgctcctgttggttatgta

SEQ ID NO: 600602 - DNA, 25 bp, Mus musculus
ggaggttgggttctactatcttcac

SEQ ID NO: 600603 - DNA, 25 bp, Mus musculus
ggaggttgggttgtactatcttcac

SEQ ID NO: 600604 - DNA, 25 bp, Mus musculus
ggaggttgtcaaccctaagcccagg

SEQ ID NO: 600605 - DNA, 25 bp, Mus musculus
ggaggttgtcaagcctaagcccagg

SEQ ID NO: 600606 - DNA, 25 bp, Mus musculus
ggaggttgtcttactaaaacagctg

SEQ ID NO: 600607 - DNA, 25 bp, Mus musculus
ggaggttgtctttctaaaacagctg

SEQ ID NO: 600608 - DNA, 25 bp, Mus musculus
ggaggttgtgccaccagcaatgtac

SEQ ID NO: 600609 - DNA, 25 bp, Mus musculus
ggaggttgtgccattaagagccact

SEQ ID NO: 600610 - DNA, 25 bp, Mus musculus
ggaggttgtgcctccagcaatgtac

SEQ ID NO: 600611 - DNA, 25 bp, Mus musculus
ggaggttgtgcctttaagagccact

SEQ ID NO: 600612 - DNA, 25 bp, Mus musculus
ggaggttgtttcctataggctttga

SEQ ID NO: 600613 - DNA, 25 bp, Mus musculus
ggaggttgtttcgtataggctttga

SEQ ID NO: 600614 - DNA, 25 bp, Mus musculus
ggaggtttaatactaccagtacaca

SEQ ID NO: 600615 - DNA, 25 bp, Mus musculus
ggaggtttaatagtaccagtacaca

SEQ ID NO: 600616 - DNA, 25 bp, Mus musculus
ggaggtttagatcccacgctggata

SEQ ID NO: 600617 - DNA, 25 bp, Mus musculus
ggaggtttagatgccacgctggata

SEQ ID NO: 600618 - DNA, 25 bp, Mus musculus
ggaggtttatgaagaccacagcttt

SEQ ID NO: 600619 - DNA, 25 bp, Mus musculus
ggaggtttatgatgaccacagcttt

SEQ ID NO: 600620 - DNA, 25 bp, Mus musculus
ggaggtttcagaaagcccagcccag

SEQ ID NO: 600621 - DNA, 25 bp, Mus musculus
ggaggtttcagatagcccagcccag

SEQ ID NO: 600622 - DNA, 25 bp, Mus musculus
ggaggtttccaacctagactcagtc

SEQ ID NO: 600623 - DNA, 25 bp, Mus musculus
ggaggtttccaagctagactcagtc

SEQ ID NO: 600624 - DNA, 25 bp, Mus musculus
ggaggtttcggtatgctaacaccat

SEQ ID NO: 600625 - DNA, 25 bp, Mus musculus
ggaggtttcggtttgctaacaccat

SEQ ID NO: 600626 - DNA, 25 bp, Mus musculus
ggaggtttctcaaagtgccatagca

SEQ ID NO: 600627 - DNA, 25 bp, Mus musculus
ggaggtttctcatagtgccatagca

SEQ ID NO: 600628 - DNA, 25 bp, Mus musculus
ggaggtttgaagacttgcacatcta

SEQ ID NO: 600629 - DNA, 25 bp, Mus musculus
ggaggtttgaagtcttgcacatcta

SEQ ID NO: 600630 - DNA, 25 bp, Mus musculus
ggaggtttgagtcatcactggctac

SEQ ID NO: 600631 - DNA, 25 bp, Mus musculus
ggaggtttgagtgatcactggctac

SEQ ID NO: 600632 - DNA, 25 bp, Mus musculus
ggaggttttcctacattacagagtg

SEQ ID NO: 600633 - DNA, 25 bp, Mus musculus
ggaggttttccttcattacagagtg

SEQ ID NO: 600634 - DNA, 25 bp, Mus musculus
ggaggttttgacatccatcactcag

SEQ ID NO: 600635 - DNA, 25 bp, Mus musculus
ggaggttttgacttccatcactcag

SEQ ID NO: 600636 - DNA, 25 bp, Mus musculus
ggaggtttttacagcctactagcac

SEQ ID NO: 600637 - DNA, 25 bp, Mus musculus
ggaggtttttactgcctactagcac

SEQ ID NO: 600638 - DNA, 25 bp, Mus musculus
ggaggtttttgaactgctttttgtc

SEQ ID NO: 600639 - DNA, 25 bp, Mus musculus
ggaggtttttgacaggcttcctgaa

SEQ ID NO: 600640 - DNA, 25 bp, Mus musculus
ggaggtttttgagaggcttcctgaa

SEQ ID NO: 600641 - DNA, 25 bp, Mus musculus
ggaggtttttgatctgctttttgtc

SEQ ID NO: 600642 - DNA, 25 bp, Mus musculus
ggaggttttttgataaggcatgaca

SEQ ID NO: 600643 - DNA, 25 bp, Mus musculus
ggaggttttttgttaaggcatgaca

SEQ ID NO: 600644 - DNA, 25 bp, Mus musculus
ggagtaaactatccacactttctta

SEQ ID NO: 600645 - DNA, 25 bp, Mus musculus
ggagtaaactatgcacactttctta

SEQ ID NO: 600646 - DNA, 25 bp, Mus musculus
ggagtaaacttgcatcaaactgtaa

SEQ ID NO: 600647 - DNA, 25 bp, Mus musculus
ggagtaaacttggatcaaactgtaa

SEQ ID NO: 600648 - DNA, 25 bp, Mus musculus
ggagtaaactttatgctgttgccta

SEQ ID NO: 600649 - DNA, 25 bp, Mus musculus
ggagtaaactttttgctgttgccta

SEQ ID NO: 600650 - DNA, 25 bp, Mus musculus
ggagtaaaggctaggtgtttccctg

SEQ ID NO: 600651 - DNA, 25 bp, Mus musculus
ggagtaaaggcttggtgtttccctg

SEQ ID NO: 600652 - DNA, 25 bp, Mus musculus
ggagtaaaggtaattgccatcctgt

SEQ ID NO: 600653 - DNA, 25 bp, Mus musculus
ggagtaaaggtatttgccatcctgt

SEQ ID NO: 600654 - DNA, 25 bp, Mus musculus
ggagtaaatcggacatcgccattat

SEQ ID NO: 600655 - DNA, 25 bp, Mus musculus
ggagtaaatcggtcatcgccattat

SEQ ID NO: 600656 - DNA, 25 bp, Mus musculus
ggagtaaatctcacaggatgcaaat

SEQ ID NO: 600657 - DNA, 25 bp, Mus musculus
ggagtaaatctctcaggatgcaaat

SEQ ID NO: 600658 - DNA, 25 bp, Mus musculus
ggagtaaatgccatcagcccttgga

SEQ ID NO: 600659 - DNA, 25 bp, Mus musculus
ggagtaaatgccttcagcccttgga

SEQ ID NO: 600660 - DNA, 25 bp, Mus musculus
ggagtaaatgttcagagccctgcac

SEQ ID NO: 600661 - DNA, 25 bp, Mus musculus
ggagtaaatgttcttgccttcaaat

SEQ ID NO: 600662 - DNA, 25 bp, Mus musculus
ggagtaaatgttgagagccctgcac

SEQ ID NO: 600663 - DNA, 25 bp, Mus musculus
ggagtaaatgttgttgccttcaaat

SEQ ID NO: 600664 - DNA, 25 bp, Mus musculus
ggagtaacaaaacaagtgaccatta

SEQ ID NO: 600665 - DNA, 25 bp, Mus musculus
ggagtaacaaaagaagtgaccatta

SEQ ID NO: 600666 - DNA, 25 bp, Mus musculus
ggagtaacaacacgaatattccttt

SEQ ID NO: 600667 - DNA, 25 bp, Mus musculus
ggagtaacaacaggaatattccttt

SEQ ID NO: 600668 - DNA, 25 bp, Mus musculus
ggagtaacacccagcccctgtggga

SEQ ID NO: 600669 - DNA, 25 bp, Mus musculus
ggagtaacaccctgcccctgtggga

SEQ ID NO: 600670 - DNA, 25 bp, Mus musculus
ggagtaacctgaccattttgtcttc

SEQ ID NO: 600671 - DNA, 25 bp, Mus musculus
ggagtaacctgagcattttgtcttc

SEQ ID NO: 600672 - DNA, 25 bp, Mus musculus
ggagtaactccgatgtgctgaatta

SEQ ID NO: 600673 - DNA, 25 bp, Mus musculus
ggagtaactccgttgtgctgaatta

SEQ ID NO: 600674 - DNA, 25 bp, Mus musculus
ggagtaactgcaatcgattccctta

SEQ ID NO: 600675 - DNA, 25 bp, Mus musculus
ggagtaactgcattcgattccctta

SEQ ID NO: 600676 - DNA, 25 bp, Mus musculus
ggagtaacttcactgctcagtgcag

SEQ ID NO: 600677 - DNA, 25 bp, Mus musculus
ggagtaacttcagtgctcagtgcag

SEQ ID NO: 600678 - DNA, 25 bp, Mus musculus
ggagtaagactcctggcctttctct

SEQ ID NO: 600679 - DNA, 25 bp, Mus musculus
ggagtaagactcgtggcctttctct

SEQ ID NO: 600680 - DNA, 25 bp, Mus musculus
ggagtaagcagccaacgttgtataa

SEQ ID NO: 600681 - DNA, 25 bp, Mus musculus
ggagtaagcagcgaacgttgtataa

SEQ ID NO: 600682 - DNA, 25 bp, Mus musculus
ggagtaagcctaaccgatccctgca

SEQ ID NO: 600683 - DNA, 25 bp, Mus musculus
ggagtaagcctatccgatccctgca

SEQ ID NO: 600684 - DNA, 25 bp, Mus musculus
ggagtaaggctcatcatcagcttgc

SEQ ID NO: 600685 - DNA, 25 bp, Mus musculus
ggagtaaggctcttcatcagcttgc

SEQ ID NO: 600686 - DNA, 25 bp, Mus musculus
ggagtaagtttgcttcatgcttttt

SEQ ID NO: 600687 - DNA, 25 bp, Mus musculus
ggagtaagtttggttcatgcttttt

SEQ ID NO: 600688 - DNA, 25 bp, Mus musculus
ggagtaatatgcatcacgtcagtgt

SEQ ID NO: 600689 - DNA, 25 bp, Mus musculus
ggagtaatatgcttcacgtcagtgt

SEQ ID NO: 600690 - DNA, 25 bp, Mus musculus
ggagtaatgcctcctctttattaaa

SEQ ID NO: 600691 - DNA, 25 bp, Mus musculus
ggagtaatgcctgctctttattaaa

SEQ ID NO: 600692 - DNA, 25 bp, Mus musculus
ggagtaatgctcctgcccaagtact

SEQ ID NO: 600693 - DNA, 25 bp, Mus musculus
ggagtaatgctcgtgcccaagtact

SEQ ID NO: 600694 - DNA, 25 bp, Mus musculus
ggagtaatgtccaaccgagtgataa

SEQ ID NO: 600695 - DNA, 25 bp, Mus musculus
ggagtaatgtcctaccgagtgataa

SEQ ID NO: 600696 - DNA, 25 bp, Mus musculus
ggagtaatgtttctgcagctaagcc

SEQ ID NO: 600697 - DNA, 25 bp, Mus musculus
ggagtaatgtttgtgcagctaagcc

SEQ ID NO: 600698 - DNA, 25 bp, Mus musculus
ggagtaattgctaatgatacctaga

SEQ ID NO: 600699 - DNA, 25 bp, Mus musculus
ggagtaattgctctcttgatattca

SEQ ID NO: 600700 - DNA, 25 bp, Mus musculus
ggagtaattgctgtcttgatattca

SEQ ID NO: 600701 - DNA, 25 bp, Mus musculus
ggagtaattgcttatgatacctaga

SEQ ID NO: 600702 - DNA, 25 bp, Mus musculus
ggagtaattgtcagagccctcagcc

SEQ ID NO: 600703 - DNA, 25 bp, Mus musculus
ggagtaattgtctgagccctcagcc

SEQ ID NO: 600704 - DNA, 25 bp, Mus musculus
ggagtacaagccagccccagcgtgc

SEQ ID NO: 600705 - DNA, 25 bp, Mus musculus
ggagtacaagcctgccccagcgtgc

SEQ ID NO: 600706 - DNA, 25 bp, Mus musculus
ggagtacacatacttccagctgcat

SEQ ID NO: 600707 - DNA, 25 bp, Mus musculus
ggagtacacatagttccagctgcat

SEQ ID NO: 600708 - DNA, 25 bp, Mus musculus
ggagtacacatcatttcctttctgc

SEQ ID NO: 600709 - DNA, 25 bp, Mus musculus
ggagtacacatcttttcctttctgc

SEQ ID NO: 600710 - DNA, 25 bp, Mus musculus
ggagtacactctaaatccaatccca

SEQ ID NO: 600711 - DNA, 25 bp, Mus musculus
ggagtacactcttaatccaatccca

SEQ ID NO: 600712 - DNA, 25 bp, Mus musculus
ggagtacagttgatctttctgtgga

SEQ ID NO: 600713 - DNA, 25 bp, Mus musculus
ggagtacagttgttctttctgtgga

SEQ ID NO: 600714 - DNA, 25 bp, Mus musculus
ggagtacatgagaaatgccagcatt

SEQ ID NO: 600715 - DNA, 25 bp, Mus musculus
ggagtacatgagtaatgccagcatt

SEQ ID NO: 600716 - DNA, 25 bp, Mus musculus
ggagtaccaaagcacccaggccagt

SEQ ID NO: 600717 - DNA, 25 bp, Mus musculus
ggagtaccaaaggacccaggccagt

SEQ ID NO: 600718 - DNA, 25 bp, Mus musculus
ggagtaccaagcatctaaccggctg

SEQ ID NO: 600719 - DNA, 25 bp, Mus musculus
ggagtaccaagcttctaaccggctg

SEQ ID NO: 600720 - DNA, 25 bp, Mus musculus
ggagtaccagataaagaccaaccaa

SEQ ID NO: 600721 - DNA, 25 bp, Mus musculus
ggagtaccagattaagaccaaccaa

SEQ ID NO: 600722 - DNA, 25 bp, Mus musculus
ggagtaccagttcactatcctggat

SEQ ID NO: 600723 - DNA, 25 bp, Mus musculus
ggagtaccagttgactatcctggat

SEQ ID NO: 600724 - DNA, 25 bp, Mus musculus
ggagtaccccaaaaatgttgacagt

SEQ ID NO: 600725 - DNA, 25 bp, Mus musculus
ggagtaccccaataatgttgacagt

SEQ ID NO: 600726 - DNA, 25 bp, Mus musculus
ggagtaccccggaacccgatctcag

SEQ ID NO: 600727 - DNA, 25 bp, Mus musculus
ggagtaccccggtacccgatctcag

SEQ ID NO: 600728 - DNA, 25 bp, Mus musculus
ggagtaccctagactttcatagacc

SEQ ID NO: 600729 - DNA, 25 bp, Mus musculus
ggagtaccctagtctttcatagacc

SEQ ID NO: 600730 - DNA, 25 bp, Mus musculus
ggagtaccgcaccataatcacagag

SEQ ID NO: 600731 - DNA, 25 bp, Mus musculus
ggagtaccgcacgataatcacagag

SEQ ID NO: 600732 - DNA, 25 bp, Mus musculus
ggagtaccggccatcaattctgata

SEQ ID NO: 600733 - DNA, 25 bp, Mus musculus
ggagtaccggccttcaattctgata

SEQ ID NO: 600734 - DNA, 25 bp, Mus musculus
ggagtacctatgagaccagatttca

SEQ ID NO: 600735 - DNA, 25 bp, Mus musculus
ggagtacctatgtgaccagatttca

SEQ ID NO: 600736 - DNA, 25 bp, Mus musculus
ggagtacctcaaccaagagcaggca

SEQ ID NO: 600737 - DNA, 25 bp, Mus musculus
ggagtacctcaagcaagagcaggca

SEQ ID NO: 600738 - DNA, 25 bp, Mus musculus
ggagtacctggtcgctttttctagc

SEQ ID NO: 600739 - DNA, 25 bp, Mus musculus
ggagtacctggtggctttttctagc

SEQ ID NO: 600740 - DNA, 25 bp, Mus musculus
ggagtacctgtaccaagtcctagga

SEQ ID NO: 600741 - DNA, 25 bp, Mus musculus
ggagtacctgtagcaagtcctagga

SEQ ID NO: 600742 - DNA, 25 bp, Mus musculus
ggagtacgctccagtttgggttctt

SEQ ID NO: 600743 - DNA, 25 bp, Mus musculus
ggagtacgctcctgtttgggttctt

SEQ ID NO: 600744 - DNA, 25 bp, Mus musculus
ggagtacgctggacccaaggtgtaa

SEQ ID NO: 600745 - DNA, 25 bp, Mus musculus
ggagtacgctggtcccaaggtgtaa

SEQ ID NO: 600746 - DNA, 25 bp, Mus musculus
ggagtacgtcatagcgaccgagcgc

SEQ ID NO: 600747 - DNA, 25 bp, Mus musculus
ggagtacgtcattgcgaccgagcgc

SEQ ID NO: 600748 - DNA, 25 bp, Mus musculus
ggagtacgtgagacagcaggacata

SEQ ID NO: 600749 - DNA, 25 bp, Mus musculus
ggagtacgtgagtcagcaggacata

SEQ ID NO: 600750 - DNA, 25 bp, Mus musculus
ggagtacgtgcgctcacttgccagc

SEQ ID NO: 600751 - DNA, 25 bp, Mus musculus
ggagtacgtgcggtcacttgccagc

SEQ ID NO: 600752 - DNA, 25 bp, Mus musculus
ggagtactacagcaaacgcggcatt

SEQ ID NO: 600753 - DNA, 25 bp, Mus musculus
ggagtactacaggaaacgcggcatt

SEQ ID NO: 600754 - DNA, 25 bp, Mus musculus
ggagtactactcaggttgcgcttgt

SEQ ID NO: 600755 - DNA, 25 bp, Mus musculus
ggagtactactctggttgcgcttgt

SEQ ID NO: 600756 - DNA, 25 bp, Mus musculus
ggagtactataccataaccagcttt

SEQ ID NO: 600757 - DNA, 25 bp, Mus musculus
ggagtactatacgataaccagcttt

SEQ ID NO: 600758 - DNA, 25 bp, Mus musculus
ggagtactcagaaagcaacagccgc

SEQ ID NO: 600759 - DNA, 25 bp, Mus musculus
ggagtactcagatagcaacagccgc

SEQ ID NO: 600760 - DNA, 25 bp, Mus musculus
ggagtactgcaaccgtgtgccttac

SEQ ID NO: 600761 - DNA, 25 bp, Mus musculus
ggagtactgcaagcgtgtgccttac

SEQ ID NO: 600762 - DNA, 25 bp, Mus musculus
ggagtacttacaaccatctttacca

SEQ ID NO: 600763 - DNA, 25 bp, Mus musculus
ggagtacttacatccatctttacca

SEQ ID NO: 600764 - DNA, 25 bp, Mus musculus
ggagtacttataatccagccgcgcg

SEQ ID NO: 600765 - DNA, 25 bp, Mus musculus
ggagtacttatattccagccgcgcg

SEQ ID NO: 600766 - DNA, 25 bp, Mus musculus
ggagtacttccgctggccagctctt

SEQ ID NO: 600767 - DNA, 25 bp, Mus musculus
ggagtacttccggtggccagctctt

SEQ ID NO: 600768 - DNA, 25 bp, Mus musculus
ggagtacttgacatatcttcatcat

SEQ ID NO: 600769 - DNA, 25 bp, Mus musculus
ggagtacttgacttatcttcatcat

SEQ ID NO: 600770 - DNA, 25 bp, Mus musculus
ggagtacttggaactttttgggaat

SEQ ID NO: 600771 - DNA, 25 bp, Mus musculus
ggagtacttggatctttttgggaat

SEQ ID NO: 600772 - DNA, 25 bp, Mus musculus
ggagtactttgtaaccagccagttc

SEQ ID NO: 600773 - DNA, 25 bp, Mus musculus
ggagtactttgttaccagccagttc

SEQ ID NO: 600774 - DNA, 25 bp, Mus musculus
ggagtagaaatacacgccacactag

SEQ ID NO: 600775 - DNA, 25 bp, Mus musculus
ggagtagaaatagacgccacactag

SEQ ID NO: 600776 - DNA, 25 bp, Mus musculus
ggagtagaacgcctttaatgtcagc

SEQ ID NO: 600777 - DNA, 25 bp, Mus musculus
ggagtagaacgcgtttaatgtcagc

SEQ ID NO: 600778 - DNA, 25 bp, Mus musculus
ggagtagaaggcattctggtcacaa

SEQ ID NO: 600779 - DNA, 25 bp, Mus musculus
ggagtagaaggctttctggtcacaa

SEQ ID NO: 600780 - DNA, 25 bp, Mus musculus
ggagtagacagtccgtcacagacaa

SEQ ID NO: 600781 - DNA, 25 bp, Mus musculus
ggagtagacagtgcgtcacagacaa

SEQ ID NO: 600782 - DNA, 25 bp, Mus musculus
ggagtagactctagacccttgtgga

SEQ ID NO: 600783 - DNA, 25 bp, Mus musculus
ggagtagactcttgacccttgtgga

SEQ ID NO: 600784 - DNA, 25 bp, Mus musculus
ggagtagagcttactggagcccctt

SEQ ID NO: 600785 - DNA, 25 bp, Mus musculus
ggagtagagctttctggagcccctt

SEQ ID NO: 600786 - DNA, 25 bp, Mus musculus
ggagtagagtcaaccattcctcaga

SEQ ID NO: 600787 - DNA, 25 bp, Mus musculus
ggagtagagtcacagtccattctta

SEQ ID NO: 600788 - DNA, 25 bp, Mus musculus
ggagtagagtcagagtccattctta

SEQ ID NO: 600789 - DNA, 25 bp, Mus musculus
ggagtagagtcatccattcctcaga

SEQ ID NO: 600790 - DNA, 25 bp, Mus musculus
ggagtagagtctaaccagtttcaaa

SEQ ID NO: 600791 - DNA, 25 bp, Mus musculus
ggagtagagtcttaccagtttcaaa

SEQ ID NO: 600792 - DNA, 25 bp, Mus musculus
ggagtagatccaccctttaaataat

SEQ ID NO: 600793 - DNA, 25 bp, Mus musculus
ggagtagatccagcctttaaataat

SEQ ID NO: 600794 - DNA, 25 bp, Mus musculus
ggagtagattccaggcacattcctc

SEQ ID NO: 600795 - DNA, 25 bp, Mus musculus
ggagtagattcctggcacattcctc

SEQ ID NO: 600796 - DNA, 25 bp, Mus musculus
ggagtagcgaccatgtatccagtac

SEQ ID NO: 600797 - DNA, 25 bp, Mus musculus
ggagtagcgaccttgtatccagtac

SEQ ID NO: 600798 - DNA, 25 bp, Mus musculus
ggagtagctattacgttcttgaaaa

SEQ ID NO: 600799 - DNA, 25 bp, Mus musculus
ggagtagctatttcgttcttgaaaa

SEQ ID NO: 600800 - DNA, 25 bp, Mus musculus
ggagtagctggaaacattggtttta

SEQ ID NO: 600801 - DNA, 25 bp, Mus musculus
ggagtagctggatacattggtttta

SEQ ID NO: 600802 - DNA, 25 bp, Mus musculus
ggagtagctgtaatcactttgtttt

SEQ ID NO: 600803 - DNA, 25 bp, Mus musculus
ggagtagctgtaccctttttgcagt

SEQ ID NO: 600804 - DNA, 25 bp, Mus musculus
ggagtagctgtagcctttttgcagt

SEQ ID NO: 600805 - DNA, 25 bp, Mus musculus
ggagtagctgtattcactttgtttt

SEQ ID NO: 600806 - DNA, 25 bp, Mus musculus
ggagtagctgttactttcctaaaga

SEQ ID NO: 600807 - DNA, 25 bp, Mus musculus
ggagtagctgtttctttcctaaaga

SEQ ID NO: 600808 - DNA, 25 bp, Mus musculus
ggagtaggaccaaactcaggtagtc

SEQ ID NO: 600809 - DNA, 25 bp, Mus musculus
ggagtaggaccatactcaggtagtc

SEQ ID NO: 600810 - DNA, 25 bp, Mus musculus
ggagtaggagcccacacaaacgaaa

SEQ ID NO: 600811 - DNA, 25 bp, Mus musculus
ggagtaggagccgacacaaacgaaa

SEQ ID NO: 600812 - DNA, 25 bp, Mus musculus
ggagtaggatgactcagccagccct

SEQ ID NO: 600813 - DNA, 25 bp, Mus musculus
ggagtaggatgagtcagccagccct

SEQ ID NO: 600814 - DNA, 25 bp, Mus musculus
ggagtaggcagaatctcttccccaa

SEQ ID NO: 600815 - DNA, 25 bp, Mus musculus
ggagtaggcagattctcttccccaa

SEQ ID NO: 600816 - DNA, 25 bp, Mus musculus
ggagtaggctcaaggtaaccgatga

SEQ ID NO: 600817 - DNA, 25 bp, Mus musculus
ggagtaggctcatggtaaccgatga

SEQ ID NO: 600818 - DNA, 25 bp, Mus musculus
ggagtagggtgcagtttcactagta

SEQ ID NO: 600819 - DNA, 25 bp, Mus musculus
ggagtagggtgctgtttcactagta

SEQ ID NO: 600820 - DNA, 25 bp, Mus musculus
ggagtagtaagactccttgtctttg

SEQ ID NO: 600821 - DNA, 25 bp, Mus musculus
ggagtagtaagagtccttgtctttg

SEQ ID NO: 600822 - DNA, 25 bp, Mus musculus
ggagtagtaccaacttttgtgagct

SEQ ID NO: 600823 - DNA, 25 bp, Mus musculus
ggagtagtaccatcttttgtgagct

SEQ ID NO: 600824 - DNA, 25 bp, Mus musculus
ggagtagtatacagaaggcttaaag

SEQ ID NO: 600825 - DNA, 25 bp, Mus musculus
ggagtagtatactgaaggcttaaag

SEQ ID NO: 600826 - DNA, 25 bp, Mus musculus
ggagtagtattcaccagttttatct

SEQ ID NO: 600827 - DNA, 25 bp, Mus musculus
ggagtagtattctccagttttatct

SEQ ID NO: 600828 - DNA, 25 bp, Mus musculus
ggagtagtcagccaacacagacctg

SEQ ID NO: 600829 - DNA, 25 bp, Mus musculus
ggagtagtcagcgaacacagacctg

SEQ ID NO: 600830 - DNA, 25 bp, Mus musculus
ggagtagtctggcacctattagaat

SEQ ID NO: 600831 - DNA, 25 bp, Mus musculus
ggagtagtctgggacctattagaat

SEQ ID NO: 600832 - DNA, 25 bp, Mus musculus
ggagtagtgccacccacagtacaca

SEQ ID NO: 600833 - DNA, 25 bp, Mus musculus
ggagtagtgccagccacagtacaca

SEQ ID NO: 600834 - DNA, 25 bp, Mus musculus
ggagtagttgaaatccttctagaga

SEQ ID NO: 600835 - DNA, 25 bp, Mus musculus
ggagtagttgaattccttctagaga

SEQ ID NO: 600836 - DNA, 25 bp, Mus musculus
ggagtagttgtcacttactggccac

SEQ ID NO: 600837 - DNA, 25 bp, Mus musculus
ggagtagttgtctcttactggccac

SEQ ID NO: 600838 - DNA, 25 bp, Mus musculus
ggagtataagttatcagttttctag

SEQ ID NO: 600839 - DNA, 25 bp, Mus musculus
ggagtataagttttcagttttctag

SEQ ID NO: 600840 - DNA, 25 bp, Mus musculus
ggagtatactggagcacaccccaat

SEQ ID NO: 600841 - DNA, 25 bp, Mus musculus
ggagtatactggtgcacaccccaat

SEQ ID NO: 600842 - DNA, 25 bp, Mus musculus
ggagtatagccacctaagcctgtca

SEQ ID NO: 600843 - DNA, 25 bp, Mus musculus
ggagtatagccagctaagcctgtca

SEQ ID NO: 600844 - DNA, 25 bp, Mus musculus
ggagtatatatgcacatgggccagc

SEQ ID NO: 600845 - DNA, 25 bp, Mus musculus
ggagtatatatggacatgggccagc

SEQ ID NO: 600846 - DNA, 25 bp, Mus musculus
ggagtatcacacacagtcacgacta

SEQ ID NO: 600847 - DNA, 25 bp, Mus musculus
ggagtatcacactcagtcacgacta

SEQ ID NO: 600848 - DNA, 25 bp, Mus musculus
ggagtatccagacttagggtgccaa

SEQ ID NO: 600849 - DNA, 25 bp, Mus musculus
ggagtatccagagttagggtgccaa

SEQ ID NO: 600850 - DNA, 25 bp, Mus musculus
ggagtatccctaacttcaagctgga

SEQ ID NO: 600851 - DNA, 25 bp, Mus musculus
ggagtatccctatcttcaagctgga

SEQ ID NO: 600852 - DNA, 25 bp, Mus musculus
ggagtatccgacatgaggaactact

SEQ ID NO: 600853 - DNA, 25 bp, Mus musculus
ggagtatccgacttgaggaactact

SEQ ID NO: 600854 - DNA, 25 bp, Mus musculus
ggagtatctgcccaaagtcaccggc

SEQ ID NO: 600855 - DNA, 25 bp, Mus musculus
ggagtatctgccgaaagtcaccggc

SEQ ID NO: 600856 - DNA, 25 bp, Mus musculus
ggagtatctggacttctgatccaaa

SEQ ID NO: 600857 - DNA, 25 bp, Mus musculus
ggagtatctggagttctgatccaaa

SEQ ID NO: 600858 - DNA, 25 bp, Mus musculus
ggagtatcttgtactcaccctaaca

SEQ ID NO: 600859 - DNA, 25 bp, Mus musculus
ggagtatcttgtatgcagacgaacg

SEQ ID NO: 600860 - DNA, 25 bp, Mus musculus
ggagtatcttgttctcaccctaaca

SEQ ID NO: 600861 - DNA, 25 bp, Mus musculus
ggagtatcttgtttgcagacgaacg

SEQ ID NO: 600862 - DNA, 25 bp, Mus musculus
ggagtatgccacattcattgcctgg

SEQ ID NO: 600863 - DNA, 25 bp, Mus musculus
ggagtatgccactttcattgcctgg

SEQ ID NO: 600864 - DNA, 25 bp, Mus musculus
ggagtatgctcccattaacgctgcc

SEQ ID NO: 600865 - DNA, 25 bp, Mus musculus
ggagtatgctccgattaacgctgcc

SEQ ID NO: 600866 - DNA, 25 bp, Mus musculus
ggagtatggagcacaactttgaaaa

SEQ ID NO: 600867 - DNA, 25 bp, Mus musculus
ggagtatggagccactttgaccact

SEQ ID NO: 600868 - DNA, 25 bp, Mus musculus
ggagtatggagcgactttgaccact

SEQ ID NO: 600869 - DNA, 25 bp, Mus musculus
ggagtatggagctcaactttgaaaa

SEQ ID NO: 600870 - DNA, 25 bp, Mus musculus
ggagtatggcggaagctctttgcct

SEQ ID NO: 600871 - DNA, 25 bp, Mus musculus
ggagtatggcggtagctctttgcct

SEQ ID NO: 600872 - DNA, 25 bp, Mus musculus
ggagtatggcttaagcctgggttat

SEQ ID NO: 600873 - DNA, 25 bp, Mus musculus
ggagtatggctttagcctgggttat

SEQ ID NO: 600874 - DNA, 25 bp, Mus musculus
ggagtatgggtcaccttctgcctgc

SEQ ID NO: 600875 - DNA, 25 bp, Mus musculus
ggagtatgggtctccttctgcctgc

SEQ ID NO: 600876 - DNA, 25 bp, Mus musculus
ggagtatggtctcctgcatagtcca

SEQ ID NO: 600877 - DNA, 25 bp, Mus musculus
ggagtatggtctgctgcatagtcca

SEQ ID NO: 600878 - DNA, 25 bp, Mus musculus
ggagtatgtgccaagcgttcatgaa

SEQ ID NO: 600879 - DNA, 25 bp, Mus musculus
ggagtatgtgcctagcgttcatgaa

SEQ ID NO: 600880 - DNA, 25 bp, Mus musculus
ggagtattacgacgagcaaaggaac

SEQ ID NO: 600881 - DNA, 25 bp, Mus musculus
ggagtattacgaggagcaaaggaac

SEQ ID NO: 600882 - DNA, 25 bp, Mus musculus
ggagtattcagccaatctgcttaga

SEQ ID NO: 600883 - DNA, 25 bp, Mus musculus
ggagtattcagcgaatctgcttaga

SEQ ID NO: 600884 - DNA, 25 bp, Mus musculus
ggagtattgatcacttcactgttat

SEQ ID NO: 600885 - DNA, 25 bp, Mus musculus
ggagtattgatctcttcactgttat

SEQ ID NO: 600886 - DNA, 25 bp, Mus musculus
ggagtattgctccaacagggcctgc

SEQ ID NO: 600887 - DNA, 25 bp, Mus musculus
ggagtattgctcgaacagggcctgc

SEQ ID NO: 600888 - DNA, 25 bp, Mus musculus
ggagtatttctcagtcctggtcaac

SEQ ID NO: 600889 - DNA, 25 bp, Mus musculus
ggagtatttctctgtcctggtcaac

SEQ ID NO: 600890 - DNA, 25 bp, Mus musculus
ggagtattttcacggtttgcaacac

SEQ ID NO: 600891 - DNA, 25 bp, Mus musculus
ggagtattttcagggtttgcaacac

SEQ ID NO: 600892 - DNA, 25 bp, Mus musculus
ggagtcaaagataggttccctggaa

SEQ ID NO: 600893 - DNA, 25 bp, Mus musculus
ggagtcaaagattggttccctggaa

SEQ ID NO: 600894 - DNA, 25 bp, Mus musculus
ggagtcaaaggactattattccaca

SEQ ID NO: 600895 - DNA, 25 bp, Mus musculus
ggagtcaaaggagtattattccaca

SEQ ID NO: 600896 - DNA, 25 bp, Mus musculus
ggagtcaaatccacgtggtttgtat

SEQ ID NO: 600897 - DNA, 25 bp, Mus musculus
ggagtcaaatcctcgtggtttgtat

SEQ ID NO: 600898 - DNA, 25 bp, Mus musculus
ggagtcaacaggatagagagaccat

SEQ ID NO: 600899 - DNA, 25 bp, Mus musculus
ggagtcaacaggttagagagaccat

SEQ ID NO: 600900 - DNA, 25 bp, Mus musculus
ggagtcaacctcagatttttcggga

SEQ ID NO: 600901 - DNA, 25 bp, Mus musculus
ggagtcaacctctgatttttcggga

SEQ ID NO: 600902 - DNA, 25 bp, Mus musculus
ggagtcaacggacccacggagccac

SEQ ID NO: 600903 - DNA, 25 bp, Mus musculus
ggagtcaacggagccacggagccac

SEQ ID NO: 600904 - DNA, 25 bp, Mus musculus
ggagtcaactgtcggcatttggttt

SEQ ID NO: 600905 - DNA, 25 bp, Mus musculus
ggagtcaactgtgggcatttggttt

SEQ ID NO: 600906 - DNA, 25 bp, Mus musculus
ggagtcaagctacggtttctggtaa

SEQ ID NO: 600907 - DNA, 25 bp, Mus musculus
ggagtcaagctagggtttctggtaa

SEQ ID NO: 600908 - DNA, 25 bp, Mus musculus
ggagtcaagtcccttggttggcaca

SEQ ID NO: 600909 - DNA, 25 bp, Mus musculus
ggagtcaagtccgttggttggcaca

SEQ ID NO: 600910 - DNA, 25 bp, Mus musculus
ggagtcaatttgattgtgacactag

SEQ ID NO: 600911 - DNA, 25 bp, Mus musculus
ggagtcaatttgtttgtgacactag

SEQ ID NO: 600912 - DNA, 25 bp, Mus musculus
ggagtcacaacactccagccggcgg

SEQ ID NO: 600913 - DNA, 25 bp, Mus musculus
ggagtcacaacagtccagccggcgg

SEQ ID NO: 600914 - DNA, 25 bp, Mus musculus
ggagtcacactgcactgtcatctca

SEQ ID NO: 600915 - DNA, 25 bp, Mus musculus
ggagtcacactggactgtcatctca

SEQ ID NO: 600916 - DNA, 25 bp, Mus musculus
ggagtcacagaaagctctgcagttg

SEQ ID NO: 600917 - DNA, 25 bp, Mus musculus
ggagtcacagaatgctctgcagttg

SEQ ID NO: 600918 - DNA, 25 bp, Mus musculus
ggagtcacaggaccgtgctttccaa

SEQ ID NO: 600919 - DNA, 25 bp, Mus musculus
ggagtcacaggagcgtgctttccaa

SEQ ID NO: 600920 - DNA, 25 bp, Mus musculus
ggagtcacaggtctgtggctcacac

SEQ ID NO: 600921 - DNA, 25 bp, Mus musculus
ggagtcacaggtgtgtggctcacac

SEQ ID NO: 600922 - DNA, 25 bp, Mus musculus
ggagtcacataacctcctctttatg

SEQ ID NO: 600923 - DNA, 25 bp, Mus musculus
ggagtcacataagctcctctttatg

SEQ ID NO: 600924 - DNA, 25 bp, Mus musculus
ggagtcacatgtaacatcccagcct

SEQ ID NO: 600925 - DNA, 25 bp, Mus musculus
ggagtcacatgtagccaagaggttg

SEQ ID NO: 600926 - DNA, 25 bp, Mus musculus
ggagtcacatgttacatcccagcct

SEQ ID NO: 600927 - DNA, 25 bp, Mus musculus
ggagtcacatgttgccaagaggttg

SEQ ID NO: 600928 - DNA, 25 bp, Mus musculus
ggagtcacctccctcaacagaagag

SEQ ID NO: 600929 - DNA, 25 bp, Mus musculus
ggagtcacctccgtcaacagaagag

SEQ ID NO: 600930 - DNA, 25 bp, Mus musculus
ggagtcacctcgcattctagagaca

SEQ ID NO: 600931 - DNA, 25 bp, Mus musculus
ggagtcacctcggattctagagaca

SEQ ID NO: 600932 - DNA, 25 bp, Mus musculus
ggagtcacctgaatgagctgccttt

SEQ ID NO: 600933 - DNA, 25 bp, Mus musculus
ggagtcacctgattgagctgccttt

SEQ ID NO: 600934 - DNA, 25 bp, Mus musculus
ggagtcaccttgataagctcttgtg

SEQ ID NO: 600935 - DNA, 25 bp, Mus musculus
ggagtcaccttgttaagctcttgtg

SEQ ID NO: 600936 - DNA, 25 bp, Mus musculus
ggagtcacctttcagtactacctag

SEQ ID NO: 600937 - DNA, 25 bp, Mus musculus
ggagtcacctttgagtactacctag

SEQ ID NO: 600938 - DNA, 25 bp, Mus musculus
ggagtcacggacatctttcagaata

SEQ ID NO: 600939 - DNA, 25 bp, Mus musculus
ggagtcacggacttctttcagaata

SEQ ID NO: 600940 - DNA, 25 bp, Mus musculus
ggagtcacgtaccaagcagccataa

SEQ ID NO: 600941 - DNA, 25 bp, Mus musculus
ggagtcacgtacgaagcagccataa

SEQ ID NO: 600942 - DNA, 25 bp, Mus musculus
ggagtcacgtctctcactgccatta

SEQ ID NO: 600943 - DNA, 25 bp, Mus musculus
ggagtcacgtctgtcactgccatta

SEQ ID NO: 600944 - DNA, 25 bp, Mus musculus
ggagtcactgatctcacatgcaata

SEQ ID NO: 600945 - DNA, 25 bp, Mus musculus
ggagtcactgatgtcacatgcaata

SEQ ID NO: 600946 - DNA, 25 bp, Mus musculus
ggagtcactgcacgccaacgtgcag

SEQ ID NO: 600947 - DNA, 25 bp, Mus musculus
ggagtcactgcaggccaacgtgcag

SEQ ID NO: 600948 - DNA, 25 bp, Mus musculus
ggagtcactgtgactacaccaccag

SEQ ID NO: 600949 - DNA, 25 bp, Mus musculus
ggagtcactgtgtctacaccaccag

SEQ ID NO: 600950 - DNA, 25 bp, Mus musculus
ggagtcacttccagagcccataaaa

SEQ ID NO: 600951 - DNA, 25 bp, Mus musculus
ggagtcacttcctgagcccataaaa

SEQ ID NO: 600952 - DNA, 25 bp, Mus musculus
ggagtcagaaaacggcacagtgcac

SEQ ID NO: 600953 - DNA, 25 bp, Mus musculus
ggagtcagaaaagggcacagtgcac

SEQ ID NO: 600954 - DNA, 25 bp, Mus musculus
ggagtcagactcctgtcatgtatat

SEQ ID NO: 600955 - DNA, 25 bp, Mus musculus
ggagtcagactcgtgtcatgtatat

SEQ ID NO: 600956 - DNA, 25 bp, Mus musculus
ggagtcagagaaaattgcctatata

SEQ ID NO: 600957 - DNA, 25 bp, Mus musculus
ggagtcagagaatattgcctatata

SEQ ID NO: 600958 - DNA, 25 bp, Mus musculus
ggagtcagagctctctcagagaccc

SEQ ID NO: 600959 - DNA, 25 bp, Mus musculus
ggagtcagagctgtctcagagaccc

SEQ ID NO: 600960 - DNA, 25 bp, Mus musculus
ggagtcagatccagatgccttaaat

SEQ ID NO: 600961 - DNA, 25 bp, Mus musculus
ggagtcagatcctgatgccttaaat

SEQ ID NO: 600962 - DNA, 25 bp, Mus musculus
ggagtcagatggaccgcctcattca

SEQ ID NO: 600963 - DNA, 25 bp, Mus musculus
ggagtcagatggtccgcctcattca

SEQ ID NO: 600964 - DNA, 25 bp, Mus musculus
ggagtcagattgactgtctcctctc

SEQ ID NO: 600965 - DNA, 25 bp, Mus musculus
ggagtcagattgatcagggtccaat

SEQ ID NO: 600966 - DNA, 25 bp, Mus musculus
ggagtcagattgtctgtctcctctc

SEQ ID NO: 600967 - DNA, 25 bp, Mus musculus
ggagtcagattgttcagggtccaat

SEQ ID NO: 600968 - DNA, 25 bp, Mus musculus
ggagtcagcaagatctggtatagta

SEQ ID NO: 600969 - DNA, 25 bp, Mus musculus
ggagtcagcaagttctggtatagta

SEQ ID NO: 600970 - DNA, 25 bp, Mus musculus
ggagtcagcaatccatccatgatca

SEQ ID NO: 600971 - DNA, 25 bp, Mus musculus
ggagtcagcaatgcatccatgatca

SEQ ID NO: 600972 - DNA, 25 bp, Mus musculus
ggagtcagcattatcaccaaggata

SEQ ID NO: 600973 - DNA, 25 bp, Mus musculus
ggagtcagcattttcaccaaggata

SEQ ID NO: 600974 - DNA, 25 bp, Mus musculus
ggagtcagcgatacctggctaggac

SEQ ID NO: 600975 - DNA, 25 bp, Mus musculus
ggagtcagcgattcctggctaggac

SEQ ID NO: 600976 - DNA, 25 bp, Mus musculus
ggagtcagcggtatgcacctggcat

SEQ ID NO: 600977 - DNA, 25 bp, Mus musculus
ggagtcagcggtttgcacctggcat

SEQ ID NO: 600978 - DNA, 25 bp, Mus musculus
ggagtcagctggaattcatgaaaca

SEQ ID NO: 600979 - DNA, 25 bp, Mus musculus
ggagtcagctggtattcatgaaaca

SEQ ID NO: 600980 - DNA, 25 bp, Mus musculus
ggagtcagctttacactgaggattc

SEQ ID NO: 600981 - DNA, 25 bp, Mus musculus
ggagtcagcttttcactgaggattc

SEQ ID NO: 600982 - DNA, 25 bp, Mus musculus
ggagtcaggcaaatgctctctggag

SEQ ID NO: 600983 - DNA, 25 bp, Mus musculus
ggagtcaggcaattgctctctggag

SEQ ID NO: 600984 - DNA, 25 bp, Mus musculus
ggagtcaggctcaagaagcccaaca

SEQ ID NO: 600985 - DNA, 25 bp, Mus musculus
ggagtcaggctcagtgcacgtctta

SEQ ID NO: 600986 - DNA, 25 bp, Mus musculus
ggagtcaggctctagaagcccaaca

SEQ ID NO: 600987 - DNA, 25 bp, Mus musculus
ggagtcaggctctgtgcacgtctta

SEQ ID NO: 600988 - DNA, 25 bp, Mus musculus
ggagtcagtgctaaatgggcactaa

SEQ ID NO: 600989 - DNA, 25 bp, Mus musculus
ggagtcagtgcttaatgggcactaa

SEQ ID NO: 600990 - DNA, 25 bp, Mus musculus
ggagtcagttccctcttgcactacg

SEQ ID NO: 600991 - DNA, 25 bp, Mus musculus
ggagtcagttccgtcttgcactacg

SEQ ID NO: 600992 - DNA, 25 bp, Mus musculus
ggagtcatacagcagtcagagccat

SEQ ID NO: 600993 - DNA, 25 bp, Mus musculus
ggagtcatacaggagtcagagccat

SEQ ID NO: 600994 - DNA, 25 bp, Mus musculus
ggagtcatatctacggaccttcgga

SEQ ID NO: 600995 - DNA, 25 bp, Mus musculus
ggagtcatatcttcggaccttcgga

SEQ ID NO: 600996 - DNA, 25 bp, Mus musculus
ggagtcatcaccattaattccagga

SEQ ID NO: 600997 - DNA, 25 bp, Mus musculus
ggagtcatcacctttaattccagga

SEQ ID NO: 600998 - DNA, 25 bp, Mus musculus
ggagtcatccatcaacctacaaatg

SEQ ID NO: 600999 - DNA, 25 bp, Mus musculus
ggagtcatccatgaacctacaaatg

SEQ ID NO: 601000 - DNA, 25 bp, Mus musculus
ggagtcatcctactctaggacaatg

SEQ ID NO: 601001 - DNA, 25 bp, Mus musculus
ggagtcatcctagtctaggacaatg

SEQ ID NO: 601002 - DNA, 25 bp, Mus musculus
ggagtcatctcaaaggtcaggttct

SEQ ID NO: 601003 - DNA, 25 bp, Mus musculus
ggagtcatctcataggtcaggttct

SEQ ID NO: 601004 - DNA, 25 bp, Mus musculus
ggagtcatctcccaggaccattcaa

SEQ ID NO: 601005 - DNA, 25 bp, Mus musculus
ggagtcatctccgaggaccattcaa

SEQ ID NO: 601006 - DNA, 25 bp, Mus musculus
ggagtcatggacattaaggacactt

SEQ ID NO: 601007 - DNA, 25 bp, Mus musculus
ggagtcatggactttaaggacactt

SEQ ID NO: 601008 - DNA, 25 bp, Mus musculus
ggagtcattcaaagcgtcattcaag

SEQ ID NO: 601009 - DNA, 25 bp, Mus musculus
ggagtcattcaatgcgtcattcaag

SEQ ID NO: 601010 - DNA, 25 bp, Mus musculus
ggagtcattctaaccatctacttta

SEQ ID NO: 601011 - DNA, 25 bp, Mus musculus
ggagtcattctatccatctacttta

SEQ ID NO: 601012 - DNA, 25 bp, Mus musculus
ggagtcattctcattcctcaaaatg

SEQ ID NO: 601013 - DNA, 25 bp, Mus musculus
ggagtcattctctttcctcaaaatg

SEQ ID NO: 601014 - DNA, 25 bp, Mus musculus
ggagtcattgttccattgtcagaat

SEQ ID NO: 601015 - DNA, 25 bp, Mus musculus
ggagtcattgttgcattgtcagaat

SEQ ID NO: 601016 - DNA, 25 bp, Mus musculus
ggagtcatttcaatgagtgtcagat

SEQ ID NO: 601017 - DNA, 25 bp, Mus musculus
ggagtcatttcattgagtgtcagat

SEQ ID NO: 601018 - DNA, 25 bp, Mus musculus
ggagtcattttaacagccatcgtct

SEQ ID NO: 601019 - DNA, 25 bp, Mus musculus
ggagtcattttatcagccatcgtct

SEQ ID NO: 601020 - DNA, 25 bp, Mus musculus
ggagtcatttttaatgcttacctag

SEQ ID NO: 601021 - DNA, 25 bp, Mus musculus
ggagtcattttttatgcttacctag

SEQ ID NO: 601022 - DNA, 25 bp, Mus musculus
ggagtccaaattccctgacagatgg

SEQ ID NO: 601023 - DNA, 25 bp, Mus musculus
ggagtccaaattgcctgacagatgg

SEQ ID NO: 601024 - DNA, 25 bp, Mus musculus
ggagtccaatgaatgctgctcatat

SEQ ID NO: 601025 - DNA, 25 bp, Mus musculus
ggagtccaatgattgctgctcatat

SEQ ID NO: 601026 - DNA, 25 bp, Mus musculus
ggagtccacattcaaacggcccagg

SEQ ID NO: 601027 - DNA, 25 bp, Mus musculus
ggagtccacattgaaacggcccagg

SEQ ID NO: 601028 - DNA, 25 bp, Mus musculus
ggagtccaccagcatcctgtagtgc

SEQ ID NO: 601029 - DNA, 25 bp, Mus musculus
ggagtccaccaggatcctgtagtgc

SEQ ID NO: 601030 - DNA, 25 bp, Mus musculus
ggagtccagacacaaggccttgact

SEQ ID NO: 601031 - DNA, 25 bp, Mus musculus
ggagtccagacagaaggccttgact

SEQ ID NO: 601032 - DNA, 25 bp, Mus musculus
ggagtccagacgcaaccagctttaa

SEQ ID NO: 601033 - DNA, 25 bp, Mus musculus
ggagtccagacggaaccagctttaa

SEQ ID NO: 601034 - DNA, 25 bp, Mus musculus
ggagtccagataacttgcccatgtt

SEQ ID NO: 601035 - DNA, 25 bp, Mus musculus
ggagtccagatatcttgcccatgtt

SEQ ID NO: 601036 - DNA, 25 bp, Mus musculus
ggagtccagcaaatgcagatcaact

SEQ ID NO: 601037 - DNA, 25 bp, Mus musculus
ggagtccagcaattgcagatcaact

SEQ ID NO: 601038 - DNA, 25 bp, Mus musculus
ggagtccagcggcaagtacacattt

SEQ ID NO: 601039 - DNA, 25 bp, Mus musculus
ggagtccagcgggaagtacacattt

SEQ ID NO: 601040 - DNA, 25 bp, Mus musculus
ggagtccagctcatgtcgaaaagtg

SEQ ID NO: 601041 - DNA, 25 bp, Mus musculus
ggagtccagctcttgtcgaaaagtg

SEQ ID NO: 601042 - DNA, 25 bp, Mus musculus
ggagtccaggataccgccccaaata

SEQ ID NO: 601043 - DNA, 25 bp, Mus musculus
ggagtccaggattccgccccaaata

SEQ ID NO: 601044 - DNA, 25 bp, Mus musculus
ggagtccagggcacctgcctaggaa

SEQ ID NO: 601045 - DNA, 25 bp, Mus musculus
ggagtccagggctcctgcctaggaa

SEQ ID NO: 601046 - DNA, 25 bp, Mus musculus
ggagtccaggtaaatgccagccaga

SEQ ID NO: 601047 - DNA, 25 bp, Mus musculus
ggagtccaggtatatgccagccaga

SEQ ID NO: 601048 - DNA, 25 bp, Mus musculus
ggagtccagtggagtgtttcctatc

SEQ ID NO: 601049 - DNA, 25 bp, Mus musculus
ggagtccagtggatgccaaatgcca

SEQ ID NO: 601050 - DNA, 25 bp, Mus musculus
ggagtccagtggtgtgtttcctatc

SEQ ID NO: 601051 - DNA, 25 bp, Mus musculus
ggagtccagtggttgccaaatgcca

SEQ ID NO: 601052 - DNA, 25 bp, Mus musculus
ggagtccataacatcaacgcaattg

SEQ ID NO: 601053 - DNA, 25 bp, Mus musculus
ggagtccataacttcaacgcaattg

SEQ ID NO: 601054 - DNA, 25 bp, Mus musculus
ggagtccatcttctactcaggcaga

SEQ ID NO: 601055 - DNA, 25 bp, Mus musculus
ggagtccatcttgtactcaggcaga

SEQ ID NO: 601056 - DNA, 25 bp, Mus musculus
ggagtccatgaccaacagctgatag

SEQ ID NO: 601057 - DNA, 25 bp, Mus musculus
ggagtccatgacgaacagctgatag

SEQ ID NO: 601058 - DNA, 25 bp, Mus musculus
ggagtccattagctgtatcagataa

SEQ ID NO: 601059 - DNA, 25 bp, Mus musculus
ggagtccattaggtgtatcagataa

SEQ ID NO: 601060 - DNA, 25 bp, Mus musculus
ggagtccattctaatccaggctgcc

SEQ ID NO: 601061 - DNA, 25 bp, Mus musculus
ggagtccattctagaggcttgctct

SEQ ID NO: 601062 - DNA, 25 bp, Mus musculus
ggagtccattcttatccaggctgcc

SEQ ID NO: 601063 - DNA, 25 bp, Mus musculus
ggagtccattcttgaggcttgctct

SEQ ID NO: 601064 - DNA, 25 bp, Mus musculus
ggagtcccaagcatcccttaggaag

SEQ ID NO: 601065 - DNA, 25 bp, Mus musculus
ggagtcccaagcttcccttaggaag

SEQ ID NO: 601066 - DNA, 25 bp, Mus musculus
ggagtcccacagacagggtctaaca

SEQ ID NO: 601067 - DNA, 25 bp, Mus musculus
ggagtcccacagtcagggtctaaca

SEQ ID NO: 601068 - DNA, 25 bp, Mus musculus
ggagtcccacatatgatgtctcttc

SEQ ID NO: 601069 - DNA, 25 bp, Mus musculus
ggagtcccacatttgatgtctcttc

SEQ ID NO: 601070 - DNA, 25 bp, Mus musculus
ggagtcccaggaagtgacctatgcc

SEQ ID NO: 601071 - DNA, 25 bp, Mus musculus
ggagtcccaggaagtttccttactg

SEQ ID NO: 601072 - DNA, 25 bp, Mus musculus
ggagtcccaggatgtgacctatgcc

SEQ ID NO: 601073 - DNA, 25 bp, Mus musculus
ggagtcccaggatgtttccttactg

SEQ ID NO: 601074 - DNA, 25 bp, Mus musculus
ggagtcccagggagcacttggtctc

SEQ ID NO: 601075 - DNA, 25 bp, Mus musculus
ggagtcccagggtgcacttggtctc

SEQ ID NO: 601076 - DNA, 25 bp, Mus musculus
ggagtcccatgcatagagtcactgt

SEQ ID NO: 601077 - DNA, 25 bp, Mus musculus
ggagtcccatgcttagagtcactgt

SEQ ID NO: 601078 - DNA, 25 bp, Mus musculus
ggagtccccaaacatgtcagccact

SEQ ID NO: 601079 - DNA, 25 bp, Mus musculus
ggagtccccaaagatgtcagccact

SEQ ID NO: 601080 - DNA, 25 bp, Mus musculus
ggagtccccaagcagatctggcatg

SEQ ID NO: 601081 - DNA, 25 bp, Mus musculus
ggagtccccaagcttttactatgat

SEQ ID NO: 601082 - DNA, 25 bp, Mus musculus
ggagtccccaaggagatctggcatg

SEQ ID NO: 601083 - DNA, 25 bp, Mus musculus
ggagtccccaaggttttactatgat

SEQ ID NO: 601084 - DNA, 25 bp, Mus musculus
ggagtccccagaaattggccatcag

SEQ ID NO: 601085 - DNA, 25 bp, Mus musculus
ggagtccccagatattggccatcag

SEQ ID NO: 601086 - DNA, 25 bp, Mus musculus
ggagtcccgatcctgtaggcgacac

SEQ ID NO: 601087 - DNA, 25 bp, Mus musculus
ggagtcccgatcgtgtaggcgacac

SEQ ID NO: 601088 - DNA, 25 bp, Mus musculus
ggagtcccgcagacttgattcgact

SEQ ID NO: 601089 - DNA, 25 bp, Mus musculus
ggagtcccgcagtcttgattcgact

SEQ ID NO: 601090 - DNA, 25 bp, Mus musculus
ggagtcccgctcagcgagtgcaaag

SEQ ID NO: 601091 - DNA, 25 bp, Mus musculus
ggagtcccgctctgcgagtgcaaag

SEQ ID NO: 601092 - DNA, 25 bp, Mus musculus
ggagtcccggagatagctttgagtc

SEQ ID NO: 601093 - DNA, 25 bp, Mus musculus
ggagtcccggagttagctttgagtc

SEQ ID NO: 601094 - DNA, 25 bp, Mus musculus
ggagtcccggatacggaccttctat

SEQ ID NO: 601095 - DNA, 25 bp, Mus musculus
ggagtcccggattcggaccttctat

SEQ ID NO: 601096 - DNA, 25 bp, Mus musculus
ggagtcccgggcagtacaatggcaa

SEQ ID NO: 601097 - DNA, 25 bp, Mus musculus
ggagtcccgggctgtacaatggcaa

SEQ ID NO: 601098 - DNA, 25 bp, Mus musculus
ggagtccctatcagacaacatcttc

SEQ ID NO: 601099 - DNA, 25 bp, Mus musculus
ggagtccctatctgacaacatcttc

SEQ ID NO: 601100 - DNA, 25 bp, Mus musculus
ggagtccctctcctaattttagtga

SEQ ID NO: 601101 - DNA, 25 bp, Mus musculus
ggagtccctctcgtaattttagtga

SEQ ID NO: 601102 - DNA, 25 bp, Mus musculus
ggagtccctgacaccactgtaaaat

SEQ ID NO: 601103 - DNA, 25 bp, Mus musculus
ggagtccctgactccactgtaaaat

SEQ ID NO: 601104 - DNA, 25 bp, Mus musculus
ggagtccctgagagagaactgtgac

SEQ ID NO: 601105 - DNA, 25 bp, Mus musculus
ggagtccctgagtgagaactgtgac

SEQ ID NO: 601106 - DNA, 25 bp, Mus musculus
ggagtccctgataaatctctaaacc

SEQ ID NO: 601107 - DNA, 25 bp, Mus musculus
ggagtccctgattaatctctaaacc

SEQ ID NO: 601108 - DNA, 25 bp, Mus musculus
ggagtccctgcgaatgcgaaagcct

SEQ ID NO: 601109 - DNA, 25 bp, Mus musculus
ggagtccctgcgtatgcgaaagcct

SEQ ID NO: 601110 - DNA, 25 bp, Mus musculus
ggagtccctgggacagctagagaca

SEQ ID NO: 601111 - DNA, 25 bp, Mus musculus
ggagtccctgggtcagctagagaca

SEQ ID NO: 601112 - DNA, 25 bp, Mus musculus
ggagtccctgtcatcacaagtcaca

SEQ ID NO: 601113 - DNA, 25 bp, Mus musculus
ggagtccctgtcttcacaagtcaca

SEQ ID NO: 601114 - DNA, 25 bp, Mus musculus
ggagtccgaattacacaccaagagg

SEQ ID NO: 601115 - DNA, 25 bp, Mus musculus
ggagtccgaatttcacaccaagagg

SEQ ID NO: 601116 - DNA, 25 bp, Mus musculus
ggagtccgagtgatcatcgagaaga

SEQ ID NO: 601117 - DNA, 25 bp, Mus musculus
ggagtccgagtgttcatcgagaaga

SEQ ID NO: 601118 - DNA, 25 bp, Mus musculus
ggagtccgcactagacatttcacag

SEQ ID NO: 601119 - DNA, 25 bp, Mus musculus
ggagtccgcacttgacatttcacag

SEQ ID NO: 601120 - DNA, 25 bp, Mus musculus
ggagtccgcagactcagatgaagtc

SEQ ID NO: 601121 - DNA, 25 bp, Mus musculus
ggagtccgcagagtcagatgaagtc

SEQ ID NO: 601122 - DNA, 25 bp, Mus musculus
ggagtccgtactcaagatttcgtca

SEQ ID NO: 601123 - DNA, 25 bp, Mus musculus
ggagtccgtactgaagatttcgtca

SEQ ID NO: 601124 - DNA, 25 bp, Mus musculus
ggagtccgtctcattctgtacaggg

SEQ ID NO: 601125 - DNA, 25 bp, Mus musculus
ggagtccgtctctttctgtacaggg

SEQ ID NO: 601126 - DNA, 25 bp, Mus musculus
ggagtcctacacctgaagtcaaggg

SEQ ID NO: 601127 - DNA, 25 bp, Mus musculus
ggagtcctacacgtgaagtcaaggg

SEQ ID NO: 601128 - DNA, 25 bp, Mus musculus
ggagtcctacatactagaagccacc

SEQ ID NO: 601129 - DNA, 25 bp, Mus musculus
ggagtcctacattctagaagccacc

SEQ ID NO: 601130 - DNA, 25 bp, Mus musculus
ggagtcctactcagaggtcgcactg

SEQ ID NO: 601131 - DNA, 25 bp, Mus musculus
ggagtcctactctgaggtcgcactg

SEQ ID NO: 601132 - DNA, 25 bp, Mus musculus
ggagtcctagacacagcagggtcca

SEQ ID NO: 601133 - DNA, 25 bp, Mus musculus
ggagtcctagactcagcagggtcca

SEQ ID NO: 601134 - DNA, 25 bp, Mus musculus
ggagtcctatagaagtttcagcgtt

SEQ ID NO: 601135 - DNA, 25 bp, Mus musculus
ggagtcctatagtagtttcagcgtt

SEQ ID NO: 601136 - DNA, 25 bp, Mus musculus
ggagtcctatgaaatcagtcccttc

SEQ ID NO: 601137 - DNA, 25 bp, Mus musculus
ggagtcctatgatatcagtcccttc

SEQ ID NO: 601138 - DNA, 25 bp, Mus musculus
ggagtcctcacgaaggcaagtctgc

SEQ ID NO: 601139 - DNA, 25 bp, Mus musculus
ggagtcctcacgtaggcaagtctgc

SEQ ID NO: 601140 - DNA, 25 bp, Mus musculus
ggagtcctcctcctacagtgcaggg

SEQ ID NO: 601141 - DNA, 25 bp, Mus musculus
ggagtcctcctcgtacagtgcaggg

SEQ ID NO: 601142 - DNA, 25 bp, Mus musculus
ggagtcctcgagagcatgtatgcca

SEQ ID NO: 601143 - DNA, 25 bp, Mus musculus
ggagtcctcgagtgcatgtatgcca

SEQ ID NO: 601144 - DNA, 25 bp, Mus musculus
ggagtcctctagagacaaattatat

SEQ ID NO: 601145 - DNA, 25 bp, Mus musculus
ggagtcctctagtgacaaattatat

SEQ ID NO: 601146 - DNA, 25 bp, Mus musculus
ggagtcctgatcaaagccagcccaa

SEQ ID NO: 601147 - DNA, 25 bp, Mus musculus
ggagtcctgatctaagccagcccaa

SEQ ID NO: 601148 - DNA, 25 bp, Mus musculus
ggagtcctgattcaaaacctaccct

SEQ ID NO: 601149 - DNA, 25 bp, Mus musculus
ggagtcctgattgaaaacctaccct

SEQ ID NO: 601150 - DNA, 25 bp, Mus musculus
ggagtcctgcagaacatattcggaa

SEQ ID NO: 601151 - DNA, 25 bp, Mus musculus
ggagtcctgcagtacatattcggaa

SEQ ID NO: 601152 - DNA, 25 bp, Mus musculus
ggagtcctgccactaggcatttgaa

SEQ ID NO: 601153 - DNA, 25 bp, Mus musculus
ggagtcctgccagtaggcatttgaa

SEQ ID NO: 601154 - DNA, 25 bp, Mus musculus
ggagtcctgctcacatctctttggt

SEQ ID NO: 601155 - DNA, 25 bp, Mus musculus
ggagtcctgctctcatctctttggt

SEQ ID NO: 601156 - DNA, 25 bp, Mus musculus
ggagtcctgggtacttatttctggc

SEQ ID NO: 601157 - DNA, 25 bp, Mus musculus
ggagtcctgggttcttatttctggc

SEQ ID NO: 601158 - DNA, 25 bp, Mus musculus
ggagtcctggttacagggttcccat

SEQ ID NO: 601159 - DNA, 25 bp, Mus musculus
ggagtcctggtttcagggttcccat

SEQ ID NO: 601160 - DNA, 25 bp, Mus musculus
ggagtccttcctaagctagtttgaa

SEQ ID NO: 601161 - DNA, 25 bp, Mus musculus
ggagtccttcctaggaagctctgct

SEQ ID NO: 601162 - DNA, 25 bp, Mus musculus
ggagtccttccttagctagtttgaa

SEQ ID NO: 601163 - DNA, 25 bp, Mus musculus
ggagtccttccttggaagctctgct

SEQ ID NO: 601164 - DNA, 25 bp, Mus musculus
ggagtccttgaacctactgagataa

SEQ ID NO: 601165 - DNA, 25 bp, Mus musculus
ggagtccttgaagctactgagataa

SEQ ID NO: 601166 - DNA, 25 bp, Mus musculus
ggagtccttggaaccactgctgaaa

SEQ ID NO: 601167 - DNA, 25 bp, Mus musculus
ggagtccttggatccactgctgaaa

SEQ ID NO: 601168 - DNA, 25 bp, Mus musculus
ggagtccttggtacaagtcagctgt

SEQ ID NO: 601169 - DNA, 25 bp, Mus musculus
ggagtccttggttcaagtcagctgt

SEQ ID NO: 601170 - DNA, 25 bp, Mus musculus
ggagtccttttaatactaatccatt

SEQ ID NO: 601171 - DNA, 25 bp, Mus musculus
ggagtccttttattactaatccatt

SEQ ID NO: 601172 - DNA, 25 bp, Mus musculus
ggagtcgcagcccaagaacacacat

SEQ ID NO: 601173 - DNA, 25 bp, Mus musculus
ggagtcgcagccgaagaacacacat

SEQ ID NO: 601174 - DNA, 25 bp, Mus musculus
ggagtcgccagcctcaaagatatag

SEQ ID NO: 601175 - DNA, 25 bp, Mus musculus
ggagtcgccagcgtcaaagatatag

SEQ ID NO: 601176 - DNA, 25 bp, Mus musculus
ggagtcgccatgagcaaagcccacc

SEQ ID NO: 601177 - DNA, 25 bp, Mus musculus
ggagtcgccatgtgcaaagcccacc

SEQ ID NO: 601178 - DNA, 25 bp, Mus musculus
ggagtcgcccgacgtcacaagcctg

SEQ ID NO: 601179 - DNA, 25 bp, Mus musculus
ggagtcgcccgaggtcacaagcctg

SEQ ID NO: 601180 - DNA, 25 bp, Mus musculus
ggagtcgctctcatcgccaggaagc

SEQ ID NO: 601181 - DNA, 25 bp, Mus musculus
ggagtcgctctcttcgccaggaagc

SEQ ID NO: 601182 - DNA, 25 bp, Mus musculus
ggagtcgcttccctcggacttcagg

SEQ ID NO: 601183 - DNA, 25 bp, Mus musculus
ggagtcgcttccgtcggacttcagg

SEQ ID NO: 601184 - DNA, 25 bp, Mus musculus
ggagtcgctttcattgcccttgtaa

SEQ ID NO: 601185 - DNA, 25 bp, Mus musculus
ggagtcgctttctttgcccttgtaa

SEQ ID NO: 601186 - DNA, 25 bp, Mus musculus
ggagtcggagagcgccactggtgaa

SEQ ID NO: 601187 - DNA, 25 bp, Mus musculus
ggagtcggagagggccactggtgaa

SEQ ID NO: 601188 - DNA, 25 bp, Mus musculus
ggagtcggagatatgaatgcccttg

SEQ ID NO: 601189 - DNA, 25 bp, Mus musculus
ggagtcggagatttgaatgcccttg

SEQ ID NO: 601190 - DNA, 25 bp, Mus musculus
ggagtcggcgcgcaaagcgaaagcg

SEQ ID NO: 601191 - DNA, 25 bp, Mus musculus
ggagtcggcgcggaaagcgaaagcg

SEQ ID NO: 601192 - DNA, 25 bp, Mus musculus
ggagtcgggataaatcacattccta

SEQ ID NO: 601193 - DNA, 25 bp, Mus musculus
ggagtcgggatatatcacattccta

SEQ ID NO: 601194 - DNA, 25 bp, Mus musculus
ggagtcgggcccacacggatagtaa

SEQ ID NO: 601195 - DNA, 25 bp, Mus musculus
ggagtcgggccctcacggatagtaa

SEQ ID NO: 601196 - DNA, 25 bp, Mus musculus
ggagtcggtcatatattgttatcat

SEQ ID NO: 601197 - DNA, 25 bp, Mus musculus
ggagtcggtcatttattgttatcat

SEQ ID NO: 601198 - DNA, 25 bp, Mus musculus
ggagtcggtcttcacacaaattcag

SEQ ID NO: 601199 - DNA, 25 bp, Mus musculus
ggagtcggtcttgacacaaattcag

SEQ ID NO: 601200 - DNA, 25 bp, Mus musculus
ggagtcgtcggtcccttcctacagg

SEQ ID NO: 601201 - DNA, 25 bp, Mus musculus
ggagtcgtcggtgccttcctacagg

SEQ ID NO: 601202 - DNA, 25 bp, Mus musculus
ggagtcgtgaatctctgccgacgcc

SEQ ID NO: 601203 - DNA, 25 bp, Mus musculus
ggagtcgtgaatgtctgccgacgcc

SEQ ID NO: 601204 - DNA, 25 bp, Mus musculus
ggagtcgtttgcaaaagccctgaga

SEQ ID NO: 601205 - DNA, 25 bp, Mus musculus
ggagtcgtttgctaaagccctgaga

SEQ ID NO: 601206 - DNA, 25 bp, Mus musculus
ggagtctaacttagcctctggctta

SEQ ID NO: 601207 - DNA, 25 bp, Mus musculus
ggagtctaactttgcctctggctta

SEQ ID NO: 601208 - DNA, 25 bp, Mus musculus
ggagtctacacacacgtggccaact

SEQ ID NO: 601209 - DNA, 25 bp, Mus musculus
ggagtctacacagacgtggccaact

SEQ ID NO: 601210 - DNA, 25 bp, Mus musculus
ggagtctacaccaaagtttctgagt

SEQ ID NO: 601211 - DNA, 25 bp, Mus musculus
ggagtctacacctaagtttctgagt

SEQ ID NO: 601212 - DNA, 25 bp, Mus musculus
ggagtctacacgaaggtctgcaaat

SEQ ID NO: 601213 - DNA, 25 bp, Mus musculus
ggagtctacacgtaggtctgcaaat

SEQ ID NO: 601214 - DNA, 25 bp, Mus musculus
ggagtctaccatctgatcttcatct

SEQ ID NO: 601215 - DNA, 25 bp, Mus musculus
ggagtctaccatgtgatcttcatct

SEQ ID NO: 601216 - DNA, 25 bp, Mus musculus
ggagtctacgataccatttcagatc

SEQ ID NO: 601217 - DNA, 25 bp, Mus musculus
ggagtctacgattccatttcagatc

SEQ ID NO: 601218 - DNA, 25 bp, Mus musculus
ggagtctagcaaagtcgtgactgct

SEQ ID NO: 601219 - DNA, 25 bp, Mus musculus
ggagtctagcaatgtcgtgactgct

SEQ ID NO: 601220 - DNA, 25 bp, Mus musculus
ggagtctagctaagcaaagcaggca

SEQ ID NO: 601221 - DNA, 25 bp, Mus musculus
ggagtctagctatgcaaagcaggca

SEQ ID NO: 601222 - DNA, 25 bp, Mus musculus
ggagtctaggacacttgcggccttt

SEQ ID NO: 601223 - DNA, 25 bp, Mus musculus
ggagtctaggactcttgcggccttt

SEQ ID NO: 601224 - DNA, 25 bp, Mus musculus
ggagtctaggataacaacagtcata

SEQ ID NO: 601225 - DNA, 25 bp, Mus musculus
ggagtctaggattacaacagtcata

SEQ ID NO: 601226 - DNA, 25 bp, Mus musculus
ggagtctagtagcttacattcgaaa

SEQ ID NO: 601227 - DNA, 25 bp, Mus musculus
ggagtctagtaggttacattcgaaa

SEQ ID NO: 601228 - DNA, 25 bp, Mus musculus
ggagtctatatgactctcacacaca

SEQ ID NO: 601229 - DNA, 25 bp, Mus musculus
ggagtctatatgtctctcacacaca

SEQ ID NO: 601230 - DNA, 25 bp, Mus musculus
ggagtctatcacctggctttccggt

SEQ ID NO: 601231 - DNA, 25 bp, Mus musculus
ggagtctatcacgtggctttccggt

SEQ ID NO: 601232 - DNA, 25 bp, Mus musculus
ggagtctatctcctcaagtttgata

SEQ ID NO: 601233 - DNA, 25 bp, Mus musculus
ggagtctatctcgtcaagtttgata

SEQ ID NO: 601234 - DNA, 25 bp, Mus musculus
ggagtctatgcaatttacaggaaca

SEQ ID NO: 601235 - DNA, 25 bp, Mus musculus
ggagtctatgcattttacaggaaca

SEQ ID NO: 601236 - DNA, 25 bp, Mus musculus
ggagtctattgaaattaacctacac

SEQ ID NO: 601237 - DNA, 25 bp, Mus musculus
ggagtctattgatattaacctacac

SEQ ID NO: 601238 - DNA, 25 bp, Mus musculus
ggagtctcaagactaccagagtcag

SEQ ID NO: 601239 - DNA, 25 bp, Mus musculus
ggagtctcaagagtaccagagtcag

SEQ ID NO: 601240 - DNA, 25 bp, Mus musculus
ggagtctcacccctagacaaacaag

SEQ ID NO: 601241 - DNA, 25 bp, Mus musculus
ggagtctcacccgtagacaaacaag

SEQ ID NO: 601242 - DNA, 25 bp, Mus musculus
ggagtctcagtccaaacccaggatg

SEQ ID NO: 601243 - DNA, 25 bp, Mus musculus
ggagtctcagtcgaaacccaggatg

SEQ ID NO: 601244 - DNA, 25 bp, Mus musculus
ggagtctccaaaccagagtgcacca

SEQ ID NO: 601245 - DNA, 25 bp, Mus musculus
ggagtctccaaagcagagtgcacca

SEQ ID NO: 601246 - DNA, 25 bp, Mus musculus
ggagtctccaatcgcactgagtcct

SEQ ID NO: 601247 - DNA, 25 bp, Mus musculus
ggagtctccaatggcactgagtcct

SEQ ID NO: 601248 - DNA, 25 bp, Mus musculus
ggagtctccatactgcacgtgaaga

SEQ ID NO: 601249 - DNA, 25 bp, Mus musculus
ggagtctccatagtgcacgtgaaga

SEQ ID NO: 601250 - DNA, 25 bp, Mus musculus
ggagtctccatcaacgtcattgctg

SEQ ID NO: 601251 - DNA, 25 bp, Mus musculus
ggagtctccatctacgtcattgctg

SEQ ID NO: 601252 - DNA, 25 bp, Mus musculus
ggagtctcctgaaacatgactgctt

SEQ ID NO: 601253 - DNA, 25 bp, Mus musculus
ggagtctcctgaccgctcggcagaa

SEQ ID NO: 601254 - DNA, 25 bp, Mus musculus
ggagtctcctgagcgctcggcagaa

SEQ ID NO: 601255 - DNA, 25 bp, Mus musculus
ggagtctcctgatacatgactgctt

SEQ ID NO: 601256 - DNA, 25 bp, Mus musculus
ggagtctcctgcaggtgaaagagaa

SEQ ID NO: 601257 - DNA, 25 bp, Mus musculus
ggagtctcctgctggtgaaagagaa

SEQ ID NO: 601258 - DNA, 25 bp, Mus musculus
ggagtctcgaggctgaaatcacaga

SEQ ID NO: 601259 - DNA, 25 bp, Mus musculus
ggagtctcgagggtgaaatcacaga

SEQ ID NO: 601260 - DNA, 25 bp, Mus musculus
ggagtctcggagctcgccatctccg

SEQ ID NO: 601261 - DNA, 25 bp, Mus musculus
ggagtctcggaggtcgccatctccg

SEQ ID NO: 601262 - DNA, 25 bp, Mus musculus
ggagtctcgtttctgttacaacctt

SEQ ID NO: 601263 - DNA, 25 bp, Mus musculus
ggagtctcgtttgtgttacaacctt

SEQ ID NO: 601264 - DNA, 25 bp, Mus musculus
ggagtctctaacatcagcattcgga

SEQ ID NO: 601265 - DNA, 25 bp, Mus musculus
ggagtctctaacttcagcattcgga

SEQ ID NO: 601266 - DNA, 25 bp, Mus musculus
ggagtctctacacaagatgtccttc

SEQ ID NO: 601267 - DNA, 25 bp, Mus musculus
ggagtctctacagaagatgtccttc

SEQ ID NO: 601268 - DNA, 25 bp, Mus musculus
ggagtctctggcaggaccccattaa

SEQ ID NO: 601269 - DNA, 25 bp, Mus musculus
ggagtctctggctggaccccattaa

SEQ ID NO: 601270 - DNA, 25 bp, Mus musculus
ggagtctcttaaactgcctttctaa

SEQ ID NO: 601271 - DNA, 25 bp, Mus musculus
ggagtctcttaatctgcctttctaa

SEQ ID NO: 601272 - DNA, 25 bp, Mus musculus
ggagtctctttacgaatctcgcctc

SEQ ID NO: 601273 - DNA, 25 bp, Mus musculus
ggagtctctttaggaatctcgcctc

SEQ ID NO: 601274 - DNA, 25 bp, Mus musculus
ggagtctgaaacctacaagtctatc

SEQ ID NO: 601275 - DNA, 25 bp, Mus musculus
ggagtctgaaacgtacaagtctatc

SEQ ID NO: 601276 - DNA, 25 bp, Mus musculus
ggagtctgaacccacctaggagatg

SEQ ID NO: 601277 - DNA, 25 bp, Mus musculus
ggagtctgaaccgacctaggagatg

SEQ ID NO: 601278 - DNA, 25 bp, Mus musculus
ggagtctgaagcattattcctcaag

SEQ ID NO: 601279 - DNA, 25 bp, Mus musculus
ggagtctgaagctttattcctcaag

SEQ ID NO: 601280 - DNA, 25 bp, Mus musculus
ggagtctgacatcagtcaccagatt

SEQ ID NO: 601281 - DNA, 25 bp, Mus musculus
ggagtctgacatgagtcaccagatt

SEQ ID NO: 601282 - DNA, 25 bp, Mus musculus
ggagtctgacctcttctcaacagcc

SEQ ID NO: 601283 - DNA, 25 bp, Mus musculus
ggagtctgacctgttctcaacagcc

SEQ ID NO: 601284 - DNA, 25 bp, Mus musculus
ggagtctgatggagaggatgagcat

SEQ ID NO: 601285 - DNA, 25 bp, Mus musculus
ggagtctgatggtgaggatgagcat

SEQ ID NO: 601286 - DNA, 25 bp, Mus musculus
ggagtctgcattaagtcccttggac

SEQ ID NO: 601287 - DNA, 25 bp, Mus musculus
ggagtctgcattactaaaaccccaa

SEQ ID NO: 601288 - DNA, 25 bp, Mus musculus
ggagtctgcatttagtcccttggac

SEQ ID NO: 601289 - DNA, 25 bp, Mus musculus
ggagtctgcatttctaaaaccccaa

SEQ ID NO: 601290 - DNA, 25 bp, Mus musculus
ggagtctgccaacgtcttcctgacc

SEQ ID NO: 601291 - DNA, 25 bp, Mus musculus
ggagtctgccaaggtcttcctgacc

SEQ ID NO: 601292 - DNA, 25 bp, Mus musculus
ggagtctgctcacaaaagatgcttt

SEQ ID NO: 601293 - DNA, 25 bp, Mus musculus
ggagtctgctcagaaaagatgcttt

SEQ ID NO: 601294 - DNA, 25 bp, Mus musculus
ggagtctgctgcctcaccccatggg

SEQ ID NO: 601295 - DNA, 25 bp, Mus musculus
ggagtctgctgcgtcaccccatggg

SEQ ID NO: 601296 - DNA, 25 bp, Mus musculus
ggagtctggaagacgactctccctt

SEQ ID NO: 601297 - DNA, 25 bp, Mus musculus
ggagtctggaagtcgactctccctt

SEQ ID NO: 601298 - DNA, 25 bp, Mus musculus
ggagtctggactaagctccatccac

SEQ ID NO: 601299 - DNA, 25 bp, Mus musculus
ggagtctggacttagctccatccac

SEQ ID NO: 601300 - DNA, 25 bp, Mus musculus
ggagtctggagaccatgtttctgaa

SEQ ID NO: 601301 - DNA, 25 bp, Mus musculus
ggagtctggagagcatgtttctgaa

SEQ ID NO: 601302 - DNA, 25 bp, Mus musculus
ggagtctggtacacccattggaaca

SEQ ID NO: 601303 - DNA, 25 bp, Mus musculus
ggagtctggtactcccattggaaca

SEQ ID NO: 601304 - DNA, 25 bp, Mus musculus
ggagtctggtcgattgtgacatcat

SEQ ID NO: 601305 - DNA, 25 bp, Mus musculus
ggagtctggtcgtttgtgacatcat

SEQ ID NO: 601306 - DNA, 25 bp, Mus musculus
ggagtctggtgcagcatttacgaga

SEQ ID NO: 601307 - DNA, 25 bp, Mus musculus
ggagtctggtgctgcatttacgaga

SEQ ID NO: 601308 - DNA, 25 bp, Mus musculus
ggagtctggtttaacctcacaggcc

SEQ ID NO: 601309 - DNA, 25 bp, Mus musculus
ggagtctggttttacctcacaggcc

SEQ ID NO: 601310 - DNA, 25 bp, Mus musculus
ggagtctgtatgcaacatggcgttt

SEQ ID NO: 601311 - DNA, 25 bp, Mus musculus
ggagtctgtatggaacatggcgttt

SEQ ID NO: 601312 - DNA, 25 bp, Mus musculus
ggagtctgtcatcagccagtgctaa

SEQ ID NO: 601313 - DNA, 25 bp, Mus musculus
ggagtctgtcatgagccagtgctaa

SEQ ID NO: 601314 - DNA, 25 bp, Mus musculus
ggagtctgtccacaatagcctaccc

SEQ ID NO: 601315 - DNA, 25 bp, Mus musculus
ggagtctgtccagaatagcctaccc

SEQ ID NO: 601316 - DNA, 25 bp, Mus musculus
ggagtctgtgacatccttggatact

SEQ ID NO: 601317 - DNA, 25 bp, Mus musculus
ggagtctgtgacttccttggatact

SEQ ID NO: 601318 - DNA, 25 bp, Mus musculus
ggagtctgtgcaatcaaatcaacat

SEQ ID NO: 601319 - DNA, 25 bp, Mus musculus
ggagtctgtgcattcaaatcaacat

SEQ ID NO: 601320 - DNA, 25 bp, Mus musculus
ggagtctgtgttcctctaaattgac

SEQ ID NO: 601321 - DNA, 25 bp, Mus musculus
ggagtctgtgttgctctaaattgac

SEQ ID NO: 601322 - DNA, 25 bp, Mus musculus
ggagtctgttttccaggtcatatga

SEQ ID NO: 601323 - DNA, 25 bp, Mus musculus
ggagtctgttttgcaggtcatatga

SEQ ID NO: 601324 - DNA, 25 bp, Mus musculus
ggagtcttaagacacagtttcccct

SEQ ID NO: 601325 - DNA, 25 bp, Mus musculus
ggagtcttaagagacagtttcccct

SEQ ID NO: 601326 - DNA, 25 bp, Mus musculus
ggagtcttaccaattttctgctttg

SEQ ID NO: 601327 - DNA, 25 bp, Mus musculus
ggagtcttaccatttttctgctttg

SEQ ID NO: 601328 - DNA, 25 bp, Mus musculus
ggagtcttagagctttgtaattcct

SEQ ID NO: 601329 - DNA, 25 bp, Mus musculus
ggagtcttagaggtttgtaattcct

SEQ ID NO: 601330 - DNA, 25 bp, Mus musculus
ggagtcttatgccatgttccataca

SEQ ID NO: 601331 - DNA, 25 bp, Mus musculus
ggagtcttatgcgatgttccataca

SEQ ID NO: 601332 - DNA, 25 bp, Mus musculus
ggagtcttatggcatcacattcctt

SEQ ID NO: 601333 - DNA, 25 bp, Mus musculus
ggagtcttatgggatcacattcctt

SEQ ID NO: 601334 - DNA, 25 bp, Mus musculus
ggagtcttatttacttgaggcggaa

SEQ ID NO: 601335 - DNA, 25 bp, Mus musculus
ggagtcttattttcttgaggcggaa

SEQ ID NO: 601336 - DNA, 25 bp, Mus musculus
ggagtcttcaagaatgtcccttacc

SEQ ID NO: 601337 - DNA, 25 bp, Mus musculus
ggagtcttcaagtatgtcccttacc

SEQ ID NO: 601338 - DNA, 25 bp, Mus musculus
ggagtcttcattccaaatgccagaa

SEQ ID NO: 601339 - DNA, 25 bp, Mus musculus
ggagtcttcattgcaaatgccagaa

SEQ ID NO: 601340 - DNA, 25 bp, Mus musculus
ggagtcttccctacagggtgtgtcc

SEQ ID NO: 601341 - DNA, 25 bp, Mus musculus
ggagtcttcccttcagggtgtgtcc

SEQ ID NO: 601342 - DNA, 25 bp, Mus musculus
ggagtcttctccaaaccagaaggtt

SEQ ID NO: 601343 - DNA, 25 bp, Mus musculus
ggagtcttctcctaaccagaaggtt

SEQ ID NO: 601344 - DNA, 25 bp, Mus musculus
ggagtcttgagcctgattcaccaga

SEQ ID NO: 601345 - DNA, 25 bp, Mus musculus
ggagtcttgagcgtgattcaccaga

SEQ ID NO: 601346 - DNA, 25 bp, Mus musculus
ggagtcttggatacccactgagaac

SEQ ID NO: 601347 - DNA, 25 bp, Mus musculus
ggagtcttggattcccactgagaac

SEQ ID NO: 601348 - DNA, 25 bp, Mus musculus
ggagtctttagtcatcttctcagag

SEQ ID NO: 601349 - DNA, 25 bp, Mus musculus
ggagtctttagtgatcttctcagag

SEQ ID NO: 601350 - DNA, 25 bp, Mus musculus
ggagtctttctcatctatgtacatt

SEQ ID NO: 601351 - DNA, 25 bp, Mus musculus
ggagtctttctcttctatgtacatt

SEQ ID NO: 601352 - DNA, 25 bp, Mus musculus
ggagtctttctgaatctcctgaaga

SEQ ID NO: 601353 - DNA, 25 bp, Mus musculus
ggagtctttctgtatctcctgaaga

SEQ ID NO: 601354 - DNA, 25 bp, Mus musculus
ggagtctttgatccgtctgacagag

SEQ ID NO: 601355 - DNA, 25 bp, Mus musculus
ggagtctttgatgcgtctgacagag

SEQ ID NO: 601356 - DNA, 25 bp, Mus musculus
ggagtgaaactcaagacttcctgtt

SEQ ID NO: 601357 - DNA, 25 bp, Mus musculus
ggagtgaaactctagacttcctgtt

SEQ ID NO: 601358 - DNA, 25 bp, Mus musculus
ggagtgaaaggccaatctgctctat

SEQ ID NO: 601359 - DNA, 25 bp, Mus musculus
ggagtgaaaggcgaatctgctctat

SEQ ID NO: 601360 - DNA, 25 bp, Mus musculus
ggagtgaaattccatcaagcacatg

SEQ ID NO: 601361 - DNA, 25 bp, Mus musculus
ggagtgaaattcgatcaagcacatg

SEQ ID NO: 601362 - DNA, 25 bp, Mus musculus
ggagtgaacagaacatattccctta

SEQ ID NO: 601363 - DNA, 25 bp, Mus musculus
ggagtgaacagatcatattccctta

SEQ ID NO: 601364 - DNA, 25 bp, Mus musculus
ggagtgaaccagaaggctagatcct

SEQ ID NO: 601365 - DNA, 25 bp, Mus musculus
ggagtgaaccagtaggctagatcct

SEQ ID NO: 601366 - DNA, 25 bp, Mus musculus
ggagtgaacccaacatgaaccccaa

SEQ ID NO: 601367 - DNA, 25 bp, Mus musculus
ggagtgaacccatcatgaaccccaa

SEQ ID NO: 601368 - DNA, 25 bp, Mus musculus
ggagtgaactcaagtctactgctaa

SEQ ID NO: 601369 - DNA, 25 bp, Mus musculus
ggagtgaactcatgtctactgctaa

SEQ ID NO: 601370 - DNA, 25 bp, Mus musculus
ggagtgaagcgcatctccggcctca

SEQ ID NO: 601371 - DNA, 25 bp, Mus musculus
ggagtgaagcgcttctccggcctca

SEQ ID NO: 601372 - DNA, 25 bp, Mus musculus
ggagtgaaggtcagcccagcttctg

SEQ ID NO: 601373 - DNA, 25 bp, Mus musculus
ggagtgaaggtctgcccagcttctg

SEQ ID NO: 601374 - DNA, 25 bp, Mus musculus
ggagtgaatacccagtaagccagcg

SEQ ID NO: 601375 - DNA, 25 bp, Mus musculus
ggagtgaataccgagtaagccagcg

SEQ ID NO: 601376 - DNA, 25 bp, Mus musculus
ggagtgaatagacaggctaccctaa

SEQ ID NO: 601377 - DNA, 25 bp, Mus musculus
ggagtgaatagagaggctaccctaa

SEQ ID NO: 601378 - DNA, 25 bp, Mus musculus
ggagtgaatccaattctgttatttt

SEQ ID NO: 601379 - DNA, 25 bp, Mus musculus
ggagtgaatccatttctgttatttt

SEQ ID NO: 601380 - DNA, 25 bp, Mus musculus
ggagtgacagccacctcgggatcta

SEQ ID NO: 601381 - DNA, 25 bp, Mus musculus
ggagtgacagcctcctcgggatcta

SEQ ID NO: 601382 - DNA, 25 bp, Mus musculus
ggagtgacagttccaagctgaacca

SEQ ID NO: 601383 - DNA, 25 bp, Mus musculus
ggagtgacagttgcaagctgaacca

SEQ ID NO: 601384 - DNA, 25 bp, Mus musculus
ggagtgaccaacacatcccagagtc

SEQ ID NO: 601385 - DNA, 25 bp, Mus musculus
ggagtgaccaactcatcccagagtc

SEQ ID NO: 601386 - DNA, 25 bp, Mus musculus
ggagtgaccaatcgagtccccatca

SEQ ID NO: 601387 - DNA, 25 bp, Mus musculus
ggagtgaccaatggagtccccatca

SEQ ID NO: 601388 - DNA, 25 bp, Mus musculus
ggagtgaccagtacacggtgtgcac

SEQ ID NO: 601389 - DNA, 25 bp, Mus musculus
ggagtgaccagttcacggtgtgcac

SEQ ID NO: 601390 - DNA, 25 bp, Mus musculus
ggagtgacccctacttggaatacaa

SEQ ID NO: 601391 - DNA, 25 bp, Mus musculus
ggagtgaccccttcttggaatacaa

SEQ ID NO: 601392 - DNA, 25 bp, Mus musculus
ggagtgacgcataaagcagaggttt

SEQ ID NO: 601393 - DNA, 25 bp, Mus musculus
ggagtgacgcattaagcagaggttt

SEQ ID NO: 601394 - DNA, 25 bp, Mus musculus
ggagtgactacccaggacgcacaag

SEQ ID NO: 601395 - DNA, 25 bp, Mus musculus
ggagtgactaccgaggacgcacaag

SEQ ID NO: 601396 - DNA, 25 bp, Mus musculus
ggagtgactatgaaggtggcacaca

SEQ ID NO: 601397 - DNA, 25 bp, Mus musculus
ggagtgactatgtaggtggcacaca

SEQ ID NO: 601398 - DNA, 25 bp, Mus musculus
ggagtgactattactgccatattta

SEQ ID NO: 601399 - DNA, 25 bp, Mus musculus
ggagtgactatttctgccatattta

SEQ ID NO: 601400 - DNA, 25 bp, Mus musculus
ggagtgactctaatcagaggtgtga

SEQ ID NO: 601401 - DNA, 25 bp, Mus musculus
ggagtgactctattcagaggtgtga

SEQ ID NO: 601402 - DNA, 25 bp, Mus musculus
ggagtgactgcgatttcatgtgtgt

SEQ ID NO: 601403 - DNA, 25 bp, Mus musculus
ggagtgactgcgttttcatgtgtgt

SEQ ID NO: 601404 - DNA, 25 bp, Mus musculus
ggagtgagactccacagagacttga

SEQ ID NO: 601405 - DNA, 25 bp, Mus musculus
ggagtgagactcgacagagacttga

SEQ ID NO: 601406 - DNA, 25 bp, Mus musculus
ggagtgagagagcccacagcttaat

SEQ ID NO: 601407 - DNA, 25 bp, Mus musculus
ggagtgagagaggccacagcttaat

SEQ ID NO: 601408 - DNA, 25 bp, Mus musculus
ggagtgagattgacctgtttaacat

SEQ ID NO: 601409 - DNA, 25 bp, Mus musculus
ggagtgagattgtcctgtttaacat

SEQ ID NO: 601410 - DNA, 25 bp, Mus musculus
ggagtgagcaagacctcctggtgca

SEQ ID NO: 601411 - DNA, 25 bp, Mus musculus
ggagtgagcaagtcctcctggtgca

SEQ ID NO: 601412 - DNA, 25 bp, Mus musculus
ggagtgagccaaaccgcagacccat

SEQ ID NO: 601413 - DNA, 25 bp, Mus musculus
ggagtgagccaatccgcagacccat

SEQ ID NO: 601414 - DNA, 25 bp, Mus musculus
ggagtgaggcgcacacttgactcta

SEQ ID NO: 601415 - DNA, 25 bp, Mus musculus
ggagtgaggcgctcacttgactcta

SEQ ID NO: 601416 - DNA, 25 bp, Mus musculus
ggagtgataactcccaataacattt

SEQ ID NO: 601417 - DNA, 25 bp, Mus musculus
ggagtgataactgccaataacattt

SEQ ID NO: 601418 - DNA, 25 bp, Mus musculus
ggagtgataatgacagcacattcat

SEQ ID NO: 601419 - DNA, 25 bp, Mus musculus
ggagtgataatgtcagcacattcat

SEQ ID NO: 601420 - DNA, 25 bp, Mus musculus
ggagtgatcacccatcagtgacttt

SEQ ID NO: 601421 - DNA, 25 bp, Mus musculus
ggagtgatcaccgatcagtgacttt

SEQ ID NO: 601422 - DNA, 25 bp, Mus musculus
ggagtgatccacactaaggtgacta

SEQ ID NO: 601423 - DNA, 25 bp, Mus musculus
ggagtgatccactctaaggtgacta

SEQ ID NO: 601424 - DNA, 25 bp, Mus musculus
ggagtgatcctacagccacagcaca

SEQ ID NO: 601425 - DNA, 25 bp, Mus musculus
ggagtgatcctagagccacagcaca

SEQ ID NO: 601426 - DNA, 25 bp, Mus musculus
ggagtgatctcaccactgtgtgtca

SEQ ID NO: 601427 - DNA, 25 bp, Mus musculus
ggagtgatctcagcactgtgtgtca

SEQ ID NO: 601428 - DNA, 25 bp, Mus musculus
ggagtgattccaaccatgttgggat

SEQ ID NO: 601429 - DNA, 25 bp, Mus musculus
ggagtgattccatccatgttgggat

SEQ ID NO: 601430 - DNA, 25 bp, Mus musculus
ggagtgattcccacaatattgtatg

SEQ ID NO: 601431 - DNA, 25 bp, Mus musculus
ggagtgattccctcaatattgtatg

SEQ ID NO: 601432 - DNA, 25 bp, Mus musculus
ggagtgattgtgacaccctcagaaa

SEQ ID NO: 601433 - DNA, 25 bp, Mus musculus
ggagtgattgtgtcaccctcagaaa

SEQ ID NO: 601434 - DNA, 25 bp, Mus musculus
ggagtgatttcacacgccccagtat

SEQ ID NO: 601435 - DNA, 25 bp, Mus musculus
ggagtgatttcagacgccccagtat

SEQ ID NO: 601436 - DNA, 25 bp, Mus musculus
ggagtgcacaaaacgcttgccttaa

SEQ ID NO: 601437 - DNA, 25 bp, Mus musculus
ggagtgcacaaatcgcttgccttaa

SEQ ID NO: 601438 - DNA, 25 bp, Mus musculus
ggagtgcacaacacattacccaagg

SEQ ID NO: 601439 - DNA, 25 bp, Mus musculus
ggagtgcacaactcattacccaagg

SEQ ID NO: 601440 - DNA, 25 bp, Mus musculus
ggagtgcacaatcaaaccaaacggg

SEQ ID NO: 601441 - DNA, 25 bp, Mus musculus
ggagtgcacaatgaaaccaaacggg

SEQ ID NO: 601442 - DNA, 25 bp, Mus musculus
ggagtgcacactaggccaggtagac

SEQ ID NO: 601443 - DNA, 25 bp, Mus musculus
ggagtgcacacttggccaggtagac

SEQ ID NO: 601444 - DNA, 25 bp, Mus musculus
ggagtgcaccacaaagtcaggagat

SEQ ID NO: 601445 - DNA, 25 bp, Mus musculus
ggagtgcaccactaagtcaggagat

SEQ ID NO: 601446 - DNA, 25 bp, Mus musculus
ggagtgcagagcaactgcttctaat

SEQ ID NO: 601447 - DNA, 25 bp, Mus musculus
ggagtgcagagctactgcttctaat

SEQ ID NO: 601448 - DNA, 25 bp, Mus musculus
ggagtgcagcctatacaactaattg

SEQ ID NO: 601449 - DNA, 25 bp, Mus musculus
ggagtgcagcctttacaactaattg

SEQ ID NO: 601450 - DNA, 25 bp, Mus musculus
ggagtgcagctcaattagccgtgga

SEQ ID NO: 601451 - DNA, 25 bp, Mus musculus
ggagtgcagctctattagccgtgga

SEQ ID NO: 601452 - DNA, 25 bp, Mus musculus
ggagtgcagttcatgcttcttcgat

SEQ ID NO: 601453 - DNA, 25 bp, Mus musculus
ggagtgcagttcttgcttcttcgat

SEQ ID NO: 601454 - DNA, 25 bp, Mus musculus
ggagtgcatatcaagacagagtgat

SEQ ID NO: 601455 - DNA, 25 bp, Mus musculus
ggagtgcatatctagacagagtgat

SEQ ID NO: 601456 - DNA, 25 bp, Mus musculus
ggagtgcatcctctgttaaagtcaa

SEQ ID NO: 601457 - DNA, 25 bp, Mus musculus
ggagtgcatcctgtgttaaagtcaa

SEQ ID NO: 601458 - DNA, 25 bp, Mus musculus
ggagtgcatcttcacatgtaacagt

SEQ ID NO: 601459 - DNA, 25 bp, Mus musculus
ggagtgcatcttgacatgtaacagt

SEQ ID NO: 601460 - DNA, 25 bp, Mus musculus
ggagtgccaaaaaacctctgctggt

SEQ ID NO: 601461 - DNA, 25 bp, Mus musculus
ggagtgccaaaatacctctgctggt

SEQ ID NO: 601462 - DNA, 25 bp, Mus musculus
ggagtgccacctacaaaccaggctg

SEQ ID NO: 601463 - DNA, 25 bp, Mus musculus
ggagtgccaccttcaaaccaggctg

SEQ ID NO: 601464 - DNA, 25 bp, Mus musculus
ggagtgccagcaatagttcatagta

SEQ ID NO: 601465 - DNA, 25 bp, Mus musculus
ggagtgccagcattagttcatagta

SEQ ID NO: 601466 - DNA, 25 bp, Mus musculus
ggagtgccattcacacctgccatga

SEQ ID NO: 601467 - DNA, 25 bp, Mus musculus
ggagtgccattctcacctgccatga

SEQ ID NO: 601468 - DNA, 25 bp, Mus musculus
ggagtgcccataacattttttcgtc

SEQ ID NO: 601469 - DNA, 25 bp, Mus musculus
ggagtgcccatatcattttttcgtc

SEQ ID NO: 601470 - DNA, 25 bp, Mus musculus
ggagtgccccaaccatcgatatgta

SEQ ID NO: 601471 - DNA, 25 bp, Mus musculus
ggagtgccccaagcatcgatatgta

SEQ ID NO: 601472 - DNA, 25 bp, Mus musculus
ggagtgcccctgagagtcaccactt

SEQ ID NO: 601473 - DNA, 25 bp, Mus musculus
ggagtgcccctgtgagtcaccactt

SEQ ID NO: 601474 - DNA, 25 bp, Mus musculus
ggagtgccctatatgtagtctccac

SEQ ID NO: 601475 - DNA, 25 bp, Mus musculus
ggagtgccctatttgtagtctccac

SEQ ID NO: 601476 - DNA, 25 bp, Mus musculus
ggagtgccctgcaagcatgtgtgct

SEQ ID NO: 601477 - DNA, 25 bp, Mus musculus
ggagtgccctgctagcatgtgtgct

SEQ ID NO: 601478 - DNA, 25 bp, Mus musculus
ggagtgccgacaaatatgtcctaaa

SEQ ID NO: 601479 - DNA, 25 bp, Mus musculus
ggagtgccgacatatatgtcctaaa

SEQ ID NO: 601480 - DNA, 25 bp, Mus musculus
ggagtgcctcaaacaacagggccag

SEQ ID NO: 601481 - DNA, 25 bp, Mus musculus
ggagtgcctcaatcaacagggccag

SEQ ID NO: 601482 - DNA, 25 bp, Mus musculus
ggagtgcctctaaggccaggaaaat

SEQ ID NO: 601483 - DNA, 25 bp, Mus musculus
ggagtgcctctatggccaggaaaat

SEQ ID NO: 601484 - DNA, 25 bp, Mus musculus
ggagtgccttacaataaaccacatg

SEQ ID NO: 601485 - DNA, 25 bp, Mus musculus
ggagtgccttactataaaccacatg

SEQ ID NO: 601486 - DNA, 25 bp, Mus musculus
ggagtgcgaactcccgacatacagt

SEQ ID NO: 601487 - DNA, 25 bp, Mus musculus
ggagtgcgaactgccgacatacagt

SEQ ID NO: 601488 - DNA, 25 bp, Mus musculus
ggagtgcgactcacaccagcttctc

SEQ ID NO: 601489 - DNA, 25 bp, Mus musculus
ggagtgcgactctcaccagcttctc

SEQ ID NO: 601490 - DNA, 25 bp, Mus musculus
ggagtgctcagcactgacccagaga

SEQ ID NO: 601491 - DNA, 25 bp, Mus musculus
ggagtgctcagctctgacccagaga

SEQ ID NO: 601492 - DNA, 25 bp, Mus musculus
ggagtgctctcaataagatcagcca

SEQ ID NO: 601493 - DNA, 25 bp, Mus musculus
ggagtgctctcattaagatcagcca

SEQ ID NO: 601494 - DNA, 25 bp, Mus musculus
ggagtgctgaagaccgccacgagct

SEQ ID NO: 601495 - DNA, 25 bp, Mus musculus
ggagtgctgaagtccgccacgagct

SEQ ID NO: 601496 - DNA, 25 bp, Mus musculus
ggagtgctgaggacttccctgcata

SEQ ID NO: 601497 - DNA, 25 bp, Mus musculus
ggagtgctgaggtcttccctgcata

SEQ ID NO: 601498 - DNA, 25 bp, Mus musculus
ggagtgctgcacaaaaggagttatt

SEQ ID NO: 601499 - DNA, 25 bp, Mus musculus
ggagtgctgcactaaaggagttatt

SEQ ID NO: 601500 - DNA, 25 bp, Mus musculus
ggagtgctgcatcaacacacgtaca

SEQ ID NO: 601501 - DNA, 25 bp, Mus musculus
ggagtgctgcatgaacacacgtaca

SEQ ID NO: 601502 - DNA, 25 bp, Mus musculus
ggagtgctgccgaaactgtaaccaa

SEQ ID NO: 601503 - DNA, 25 bp, Mus musculus
ggagtgctgccgtaactgtaaccaa

SEQ ID NO: 601504 - DNA, 25 bp, Mus musculus
ggagtgctgctccatcaggacccat

SEQ ID NO: 601505 - DNA, 25 bp, Mus musculus
ggagtgctgctcgatcaggacccat

SEQ ID NO: 601506 - DNA, 25 bp, Mus musculus
ggagtgctgggcaactagcttctac

SEQ ID NO: 601507 - DNA, 25 bp, Mus musculus
ggagtgctgggctactagcttctac

SEQ ID NO: 601508 - DNA, 25 bp, Mus musculus
ggagtgctggttatggatatatgtt

SEQ ID NO: 601509 - DNA, 25 bp, Mus musculus
ggagtgctggttttggatatatgtt

SEQ ID NO: 601510 - DNA, 25 bp, Mus musculus
ggagtgctgtaacttctaacatatt

SEQ ID NO: 601511 - DNA, 25 bp, Mus musculus
ggagtgctgtaagttctaacatatt

SEQ ID NO: 601512 - DNA, 25 bp, Mus musculus
ggagtgctgttaactggacatgaca

SEQ ID NO: 601513 - DNA, 25 bp, Mus musculus
ggagtgctgttatctggacatgaca

SEQ ID NO: 601514 - DNA, 25 bp, Mus musculus
ggagtgctttctcaatcattactag

SEQ ID NO: 601515 - DNA, 25 bp, Mus musculus
ggagtgctttctgaatcattactag

SEQ ID NO: 601516 - DNA, 25 bp, Mus musculus
ggagtggaaccaccgccaaagtgaa

SEQ ID NO: 601517 - DNA, 25 bp, Mus musculus
ggagtggaaccagcgccaaagtgaa

SEQ ID NO: 601518 - DNA, 25 bp, Mus musculus
ggagtggaacctagtgcttcaccca

SEQ ID NO: 601519 - DNA, 25 bp, Mus musculus
ggagtggaaccttgtgcttcaccca

SEQ ID NO: 601520 - DNA, 25 bp, Mus musculus
ggagtggaactcattaacaggatca

SEQ ID NO: 601521 - DNA, 25 bp, Mus musculus
ggagtggaactctttaacaggatca

SEQ ID NO: 601522 - DNA, 25 bp, Mus musculus
ggagtggaactgagcaatcttaaac

SEQ ID NO: 601523 - DNA, 25 bp, Mus musculus
ggagtggaactgtgcaatcttaaac

SEQ ID NO: 601524 - DNA, 25 bp, Mus musculus
ggagtggaagctattctcttgctta

SEQ ID NO: 601525 - DNA, 25 bp, Mus musculus
ggagtggaagcttttctcttgctta

SEQ ID NO: 601526 - DNA, 25 bp, Mus musculus
ggagtggacaatcacctactgagga

SEQ ID NO: 601527 - DNA, 25 bp, Mus musculus
ggagtggacaatgacctactgagga

SEQ ID NO: 601528 - DNA, 25 bp, Mus musculus
ggagtggaccatccttatgtcacca

SEQ ID NO: 601529 - DNA, 25 bp, Mus musculus
ggagtggaccatgcttatgtcacca

SEQ ID NO: 601530 - DNA, 25 bp, Mus musculus
ggagtggacccaagggcttcacaca

SEQ ID NO: 601531 - DNA, 25 bp, Mus musculus
ggagtggacccatgggcttcacaca

SEQ ID NO: 601532 - DNA, 25 bp, Mus musculus
ggagtggaccctcaaaaaccctctg

SEQ ID NO: 601533 - DNA, 25 bp, Mus musculus
ggagtggaccctgaaaaaccctctg

SEQ ID NO: 601534 - DNA, 25 bp, Mus musculus
ggagtggacctcatctacagtattt

SEQ ID NO: 601535 - DNA, 25 bp, Mus musculus
ggagtggacctcttctacagtattt

SEQ ID NO: 601536 - DNA, 25 bp, Mus musculus
ggagtggactgaacccttgggcatc

SEQ ID NO: 601537 - DNA, 25 bp, Mus musculus
ggagtggactgatcccttgggcatc

SEQ ID NO: 601538 - DNA, 25 bp, Mus musculus
ggagtggacttcagacacagacctc

SEQ ID NO: 601539 - DNA, 25 bp, Mus musculus
ggagtggacttctgacacagacctc

SEQ ID NO: 601540 - DNA, 25 bp, Mus musculus
ggagtggagaccacacaacacacga

SEQ ID NO: 601541 - DNA, 25 bp, Mus musculus
ggagtggagacctcacaacacacga

SEQ ID NO: 601542 - DNA, 25 bp, Mus musculus
ggagtggagcatctttatgactgat

SEQ ID NO: 601543 - DNA, 25 bp, Mus musculus
ggagtggagcatgtttatgactgat

SEQ ID NO: 601544 - DNA, 25 bp, Mus musculus
ggagtggagcccagtgagatttccc

SEQ ID NO: 601545 - DNA, 25 bp, Mus musculus
ggagtggagccctgtgagatttccc

SEQ ID NO: 601546 - DNA, 25 bp, Mus musculus
ggagtggagcttccctgcctgccaa

SEQ ID NO: 601547 - DNA, 25 bp, Mus musculus
ggagtggagcttgcctgcctgccaa

SEQ ID NO: 601548 - DNA, 25 bp, Mus musculus
ggagtggcaccaagcaactgctcgc

SEQ ID NO: 601549 - DNA, 25 bp, Mus musculus
ggagtggcaccatgcaactgctcgc

SEQ ID NO: 601550 - DNA, 25 bp, Mus musculus
ggagtggcatccaggaacaagaaat

SEQ ID NO: 601551 - DNA, 25 bp, Mus musculus
ggagtggcatcctggaacaagaaat

SEQ ID NO: 601552 - DNA, 25 bp, Mus musculus
ggagtggccacaaggaaccattaag

SEQ ID NO: 601553 - DNA, 25 bp, Mus musculus
ggagtggccacatggaaccattaag

SEQ ID NO: 601554 - DNA, 25 bp, Mus musculus
ggagtggccagtacactctcagaga

SEQ ID NO: 601555 - DNA, 25 bp, Mus musculus
ggagtggccagttcactctcagaga

SEQ ID NO: 601556 - DNA, 25 bp, Mus musculus
ggagtggcccaaaaccagccagtga

SEQ ID NO: 601557 - DNA, 25 bp, Mus musculus
ggagtggcccaataccagccagtga

SEQ ID NO: 601558 - DNA, 25 bp, Mus musculus
ggagtggccccaaatttgagtgttt

SEQ ID NO: 601559 - DNA, 25 bp, Mus musculus
ggagtggccccatatttgagtgttt

SEQ ID NO: 601560 - DNA, 25 bp, Mus musculus
ggagtggcctacaaatccagagaca

SEQ ID NO: 601561 - DNA, 25 bp, Mus musculus
ggagtggcctactaatccagagaca

SEQ ID NO: 601562 - DNA, 25 bp, Mus musculus
ggagtggcctgtactgcaagttgaa

SEQ ID NO: 601563 - DNA, 25 bp, Mus musculus
ggagtggcctgttctgcaagttgaa

SEQ ID NO: 601564 - DNA, 25 bp, Mus musculus
ggagtggcggccatcgcatctctct

SEQ ID NO: 601565 - DNA, 25 bp, Mus musculus
ggagtggcggccttcgcatctctct

SEQ ID NO: 601566 - DNA, 25 bp, Mus musculus
ggagtggcttgaaccatcatggcaa

SEQ ID NO: 601567 - DNA, 25 bp, Mus musculus
ggagtggcttgatccatcatggcaa

SEQ ID NO: 601568 - DNA, 25 bp, Mus musculus
ggagtgggtagtagaacagatttta

SEQ ID NO: 601569 - DNA, 25 bp, Mus musculus
ggagtgggtagttgaacagatttta

SEQ ID NO: 601570 - DNA, 25 bp, Mus musculus
ggagtggtacctccaggatccctac

SEQ ID NO: 601571 - DNA, 25 bp, Mus musculus
ggagtggtacctgcaggatccctac

SEQ ID NO: 601572 - DNA, 25 bp, Mus musculus
ggagtggtatagctacatatatcca

SEQ ID NO: 601573 - DNA, 25 bp, Mus musculus
ggagtggtataggtacatatatcca

SEQ ID NO: 601574 - DNA, 25 bp, Mus musculus
ggagtggtcaagaccacacatgtgt

SEQ ID NO: 601575 - DNA, 25 bp, Mus musculus
ggagtggtcaagtccacacatgtgt

SEQ ID NO: 601576 - DNA, 25 bp, Mus musculus
ggagtggtgagaatttccatacctc

SEQ ID NO: 601577 - DNA, 25 bp, Mus musculus
ggagtggtgagattttccatacctc

SEQ ID NO: 601578 - DNA, 25 bp, Mus musculus
ggagtggtgatgattgttgctttta

SEQ ID NO: 601579 - DNA, 25 bp, Mus musculus
ggagtggtgatgtttgttgctttta

SEQ ID NO: 601580 - DNA, 25 bp, Mus musculus
ggagtggtgcccactttaggcacat

SEQ ID NO: 601581 - DNA, 25 bp, Mus musculus
ggagtggtgccctctttaggcacat

SEQ ID NO: 601582 - DNA, 25 bp, Mus musculus
ggagtggtgccgagatcatttccca

SEQ ID NO: 601583 - DNA, 25 bp, Mus musculus
ggagtggtgccgtgatcatttccca

SEQ ID NO: 601584 - DNA, 25 bp, Mus musculus
ggagtggttcctccaagataatgtt

SEQ ID NO: 601585 - DNA, 25 bp, Mus musculus
ggagtggttcctgcaagataatgtt

SEQ ID NO: 601586 - DNA, 25 bp, Mus musculus
ggagtggtttatattcgcccgagct

SEQ ID NO: 601587 - DNA, 25 bp, Mus musculus
ggagtggtttattttcgcccgagct

SEQ ID NO: 601588 - DNA, 25 bp, Mus musculus
ggagtgtacacgattctgtccagca

SEQ ID NO: 601589 - DNA, 25 bp, Mus musculus
ggagtgtacacgtttctgtccagca

SEQ ID NO: 601590 - DNA, 25 bp, Mus musculus
ggagtgtagcaaacctgctcatcat

SEQ ID NO: 601591 - DNA, 25 bp, Mus musculus
ggagtgtagcaatcctgctcatcat

SEQ ID NO: 601592 - DNA, 25 bp, Mus musculus
ggagtgtatagaagcagccgttgca

SEQ ID NO: 601593 - DNA, 25 bp, Mus musculus
ggagtgtatagatgcagccgttgca

SEQ ID NO: 601594 - DNA, 25 bp, Mus musculus
ggagtgtatcttccaaacttttccc

SEQ ID NO: 601595 - DNA, 25 bp, Mus musculus
ggagtgtatcttgcaaacttttccc

SEQ ID NO: 601596 - DNA, 25 bp, Mus musculus
ggagtgtatgtaagttggcctatgc

SEQ ID NO: 601597 - DNA, 25 bp, Mus musculus
ggagtgtatgtatgttggcctatgc

SEQ ID NO: 601598 - DNA, 25 bp, Mus musculus
ggagtgtcacctctggaatggaaca

SEQ ID NO: 601599 - DNA, 25 bp, Mus musculus
ggagtgtcacctgtggaatggaaca

SEQ ID NO: 601600 - DNA, 25 bp, Mus musculus
ggagtgtcagcaacatgctccccat

SEQ ID NO: 601601 - DNA, 25 bp, Mus musculus
ggagtgtcagcatcatgctccccat

SEQ ID NO: 601602 - DNA, 25 bp, Mus musculus
ggagtgtcagtaagtgctttcccca

SEQ ID NO: 601603 - DNA, 25 bp, Mus musculus
ggagtgtcagtatgtgctttcccca

SEQ ID NO: 601604 - DNA, 25 bp, Mus musculus
ggagtgtcagtgaagtaccgctact

SEQ ID NO: 601605 - DNA, 25 bp, Mus musculus
ggagtgtcagtgactttagccatga

SEQ ID NO: 601606 - DNA, 25 bp, Mus musculus
ggagtgtcagtgtagtaccgctact

SEQ ID NO: 601607 - DNA, 25 bp, Mus musculus
ggagtgtcagtgtctttagccatga

SEQ ID NO: 601608 - DNA, 25 bp, Mus musculus
ggagtgtcatgccaccattagtcac

SEQ ID NO: 601609 - DNA, 25 bp, Mus musculus
ggagtgtcatgcgaccattagtcac

SEQ ID NO: 601610 - DNA, 25 bp, Mus musculus
ggagtgtccaacctgaattgaaatc

SEQ ID NO: 601611 - DNA, 25 bp, Mus musculus
ggagtgtccaacgtgaattgaaatc

SEQ ID NO: 601612 - DNA, 25 bp, Mus musculus
ggagtgtccaccaggctcaagatga

SEQ ID NO: 601613 - DNA, 25 bp, Mus musculus
ggagtgtccacctggctcaagatga

SEQ ID NO: 601614 - DNA, 25 bp, Mus musculus
ggagtgtccactatcagcatcttat

SEQ ID NO: 601615 - DNA, 25 bp, Mus musculus
ggagtgtccactttcagcatcttat

SEQ ID NO: 601616 - DNA, 25 bp, Mus musculus
ggagtgtccatgacctctctaggga

SEQ ID NO: 601617 - DNA, 25 bp, Mus musculus
ggagtgtccatgtcctctctaggga

SEQ ID NO: 601618 - DNA, 25 bp, Mus musculus
ggagtgtcccaaagttacctcaaca

SEQ ID NO: 601619 - DNA, 25 bp, Mus musculus
ggagtgtcccaatgttacctcaaca

SEQ ID NO: 601620 - DNA, 25 bp, Mus musculus
ggagtgtcctggctaagtagactat

SEQ ID NO: 601621 - DNA, 25 bp, Mus musculus
ggagtgtcctgggtaagtagactat

SEQ ID NO: 601622 - DNA, 25 bp, Mus musculus
ggagtgtccttcagttagcttttcc

SEQ ID NO: 601623 - DNA, 25 bp, Mus musculus
ggagtgtccttctgttagcttttcc

SEQ ID NO: 601624 - DNA, 25 bp, Mus musculus
ggagtgtctcaaccacagtgacctg

SEQ ID NO: 601625 - DNA, 25 bp, Mus musculus
ggagtgtctcaagcacagtgacctg

SEQ ID NO: 601626 - DNA, 25 bp, Mus musculus
ggagtgtctgaacacagctacagtg

SEQ ID NO: 601627 - DNA, 25 bp, Mus musculus
ggagtgtctgaagacagctacagtg

SEQ ID NO: 601628 - DNA, 25 bp, Mus musculus
ggagtgtcttgaaaggtttatgccc

SEQ ID NO: 601629 - DNA, 25 bp, Mus musculus
ggagtgtcttgataggtttatgccc

SEQ ID NO: 601630 - DNA, 25 bp, Mus musculus
ggagtgtgaactcacccctggaaag

SEQ ID NO: 601631 - DNA, 25 bp, Mus musculus
ggagtgtgaactgacccctggaaag

SEQ ID NO: 601632 - DNA, 25 bp, Mus musculus
ggagtgtgacgcacttagtcttctc

SEQ ID NO: 601633 - DNA, 25 bp, Mus musculus
ggagtgtgacgctcttagtcttctc

SEQ ID NO: 601634 - DNA, 25 bp, Mus musculus
ggagtgtgacttatccaacttcctt

SEQ ID NO: 601635 - DNA, 25 bp, Mus musculus
ggagtgtgacttttccaacttcctt

SEQ ID NO: 601636 - DNA, 25 bp, Mus musculus
ggagtgtgagccagtatccttggcc

SEQ ID NO: 601637 - DNA, 25 bp, Mus musculus
ggagtgtgagcctgtatccttggcc

SEQ ID NO: 601638 - DNA, 25 bp, Mus musculus
ggagtgtgatccatctggcgcaatg

SEQ ID NO: 601639 - DNA, 25 bp, Mus musculus
ggagtgtgatccttctggcgcaatg

SEQ ID NO: 601640 - DNA, 25 bp, Mus musculus
ggagtgtgcaaaaacagttcagaac

SEQ ID NO: 601641 - DNA, 25 bp, Mus musculus
ggagtgtgcaaatacagttcagaac

SEQ ID NO: 601642 - DNA, 25 bp, Mus musculus
ggagtgtgcactccacttggaaaag

SEQ ID NO: 601643 - DNA, 25 bp, Mus musculus
ggagtgtgcactgcacttggaaaag

SEQ ID NO: 601644 - DNA, 25 bp, Mus musculus
ggagtgtgcatgagcgacctccaac

SEQ ID NO: 601645 - DNA, 25 bp, Mus musculus
ggagtgtgcatgtgcgacctccaac

SEQ ID NO: 601646 - DNA, 25 bp, Mus musculus
ggagtgtgcctccataccgacctca

SEQ ID NO: 601647 - DNA, 25 bp, Mus musculus
ggagtgtgcctcgataccgacctca

SEQ ID NO: 601648 - DNA, 25 bp, Mus musculus
ggagtgtggcctatctggcatagat

SEQ ID NO: 601649 - DNA, 25 bp, Mus musculus
ggagtgtggcctttctggcatagat

SEQ ID NO: 601650 - DNA, 25 bp, Mus musculus
ggagtgtgtcgacttcaaagccagc

SEQ ID NO: 601651 - DNA, 25 bp, Mus musculus
ggagtgtgtcgagttcaaagccagc

SEQ ID NO: 601652 - DNA, 25 bp, Mus musculus
ggagtgttactaattgcctctactt

SEQ ID NO: 601653 - DNA, 25 bp, Mus musculus
ggagtgttactatttgcctctactt

SEQ ID NO: 601654 - DNA, 25 bp, Mus musculus
ggagtgttataccatcttataccat

SEQ ID NO: 601655 - DNA, 25 bp, Mus musculus
ggagtgttatacgatcttataccat

SEQ ID NO: 601656 - DNA, 25 bp, Mus musculus
ggagtgttcttgagggtatttatgt

SEQ ID NO: 601657 - DNA, 25 bp, Mus musculus
ggagtgttcttgagtccctgtgacc

SEQ ID NO: 601658 - DNA, 25 bp, Mus musculus
ggagtgttcttgtgggtatttatgt

SEQ ID NO: 601659 - DNA, 25 bp, Mus musculus
ggagtgttcttgtgtccctgtgacc

SEQ ID NO: 601660 - DNA, 25 bp, Mus musculus
ggagtgttgcgaatttgcttccagt

SEQ ID NO: 601661 - DNA, 25 bp, Mus musculus
ggagtgttgcgattttgcttccagt

SEQ ID NO: 601662 - DNA, 25 bp, Mus musculus
ggagtgttgtaacctattactcaaa

SEQ ID NO: 601663 - DNA, 25 bp, Mus musculus
ggagtgttgtaagctattactcaaa

SEQ ID NO: 601664 - DNA, 25 bp, Mus musculus
ggagtgtttacaatacacaagaaaa

SEQ ID NO: 601665 - DNA, 25 bp, Mus musculus
ggagtgtttacattacacaagaaaa

SEQ ID NO: 601666 - DNA, 25 bp, Mus musculus
ggagtgtttcagataaagctataaa

SEQ ID NO: 601667 - DNA, 25 bp, Mus musculus
ggagtgtttcagttaaagctataaa

SEQ ID NO: 601668 - DNA, 25 bp, Mus musculus
ggagtgtttcctaaaagtggataca

SEQ ID NO: 601669 - DNA, 25 bp, Mus musculus
ggagtgtttcctatccccggttcag

SEQ ID NO: 601670 - DNA, 25 bp, Mus musculus
ggagtgtttccttaaagtggataca

SEQ ID NO: 601671 - DNA, 25 bp, Mus musculus
ggagtgtttcctttccccggttcag

SEQ ID NO: 601672 - DNA, 25 bp, Mus musculus
ggagtgtttctcatatttcaattta

SEQ ID NO: 601673 - DNA, 25 bp, Mus musculus
ggagtgtttctcttatttcaattta

SEQ ID NO: 601674 - DNA, 25 bp, Mus musculus
ggagtgtttgacatccacttataaa

SEQ ID NO: 601675 - DNA, 25 bp, Mus musculus
ggagtgtttgacttccacttataaa

SEQ ID NO: 601676 - DNA, 25 bp, Mus musculus
ggagtgtttggaatgtaactataaa

SEQ ID NO: 601677 - DNA, 25 bp, Mus musculus
ggagtgtttggattgtaactataaa

SEQ ID NO: 601678 - DNA, 25 bp, Mus musculus
ggagtgtttttcaaataccagctga

SEQ ID NO: 601679 - DNA, 25 bp, Mus musculus
ggagtgtttttctaataccagctga

SEQ ID NO: 601680 - DNA, 25 bp, Mus musculus
ggagttaaaatcactcatctcccct

SEQ ID NO: 601681 - DNA, 25 bp, Mus musculus
ggagttaaaatctctcatctcccct

SEQ ID NO: 601682 - DNA, 25 bp, Mus musculus
ggagttaaatgtctcaagtacacaa

SEQ ID NO: 601683 - DNA, 25 bp, Mus musculus
ggagttaaatgtgtcaagtacacaa

SEQ ID NO: 601684 - DNA, 25 bp, Mus musculus
ggagttaacacaatcacatttactg

SEQ ID NO: 601685 - DNA, 25 bp, Mus musculus
ggagttaacacattcacatttactg

SEQ ID NO: 601686 - DNA, 25 bp, Mus musculus
ggagttaacagaatcaacccaagaa

SEQ ID NO: 601687 - DNA, 25 bp, Mus musculus
ggagttaacagattcaacccaagaa

SEQ ID NO: 601688 - DNA, 25 bp, Mus musculus
ggagttaacatcatcagcttgcata

SEQ ID NO: 601689 - DNA, 25 bp, Mus musculus
ggagttaacatcttcagcttgcata

SEQ ID NO: 601690 - DNA, 25 bp, Mus musculus
ggagttaaccacctctcgtctacga

SEQ ID NO: 601691 - DNA, 25 bp, Mus musculus
ggagttaaccacgtctcgtctacga

SEQ ID NO: 601692 - DNA, 25 bp, Mus musculus
ggagttaacgatctcctgtttcttg

SEQ ID NO: 601693 - DNA, 25 bp, Mus musculus
ggagttaacgatgtcctgtttcttg

SEQ ID NO: 601694 - DNA, 25 bp, Mus musculus
ggagttacaaggctttgccacaact

SEQ ID NO: 601695 - DNA, 25 bp, Mus musculus
ggagttacaagggtttgccacaact

SEQ ID NO: 601696 - DNA, 25 bp, Mus musculus
ggagttacactcattgctctttcct

SEQ ID NO: 601697 - DNA, 25 bp, Mus musculus
ggagttacactctttgctctttcct

SEQ ID NO: 601698 - DNA, 25 bp, Mus musculus
ggagttacagccaactatagcacct

SEQ ID NO: 601699 - DNA, 25 bp, Mus musculus
ggagttacagcctactatagcacct

SEQ ID NO: 601700 - DNA, 25 bp, Mus musculus
ggagttacagttccaagtcacccaa

SEQ ID NO: 601701 - DNA, 25 bp, Mus musculus
ggagttacagttgcaagtcacccaa

SEQ ID NO: 601702 - DNA, 25 bp, Mus musculus
ggagttacattgcatccactaacca

SEQ ID NO: 601703 - DNA, 25 bp, Mus musculus
ggagttacattggatccactaacca

SEQ ID NO: 601704 - DNA, 25 bp, Mus musculus
ggagttaccacaacactatgagctg

SEQ ID NO: 601705 - DNA, 25 bp, Mus musculus
ggagttaccacatcactatgagctg

SEQ ID NO: 601706 - DNA, 25 bp, Mus musculus
ggagttactaaccacttcaacccag

SEQ ID NO: 601707 - DNA, 25 bp, Mus musculus
ggagttactaacgacttcaacccag

SEQ ID NO: 601708 - DNA, 25 bp, Mus musculus
ggagttactagactgcacgttcact

SEQ ID NO: 601709 - DNA, 25 bp, Mus musculus
ggagttactagagtgcacgttcact

SEQ ID NO: 601710 - DNA, 25 bp, Mus musculus
ggagttactcagaccagctgggatg

SEQ ID NO: 601711 - DNA, 25 bp, Mus musculus
ggagttactcagtccagctgggatg

SEQ ID NO: 601712 - DNA, 25 bp, Mus musculus
ggagttactctgatcaccaaagacg

SEQ ID NO: 601713 - DNA, 25 bp, Mus musculus
ggagttactctgttcaccaaagacg

SEQ ID NO: 601714 - DNA, 25 bp, Mus musculus
ggagttagaacgattgctgccccga

SEQ ID NO: 601715 - DNA, 25 bp, Mus musculus
ggagttagaacgtttgctgccccga

SEQ ID NO: 601716 - DNA, 25 bp, Mus musculus
ggagttagacacagtatgggcccat

SEQ ID NO: 601717 - DNA, 25 bp, Mus musculus
ggagttagacactgtatgggcccat

SEQ ID NO: 601718 - DNA, 25 bp, Mus musculus
ggagttagactcaaagaagtactgt

SEQ ID NO: 601719 - DNA, 25 bp, Mus musculus
ggagttagactctaagaagtactgt

SEQ ID NO: 601720 - DNA, 25 bp, Mus musculus
ggagttagagaccttttcatccttt

SEQ ID NO: 601721 - DNA, 25 bp, Mus musculus
ggagttagagacgttttcatccttt

SEQ ID NO: 601722 - DNA, 25 bp, Mus musculus
ggagttagcaggaaatgcttccaaa

SEQ ID NO: 601723 - DNA, 25 bp, Mus musculus
ggagttagcaggtaatgcttccaaa

SEQ ID NO: 601724 - DNA, 25 bp, Mus musculus
ggagttaggcatagctgtgaacact

SEQ ID NO: 601725 - DNA, 25 bp, Mus musculus
ggagttaggcattgctgtgaacact

SEQ ID NO: 601726 - DNA, 25 bp, Mus musculus
ggagttagtcctcttagtgttaaat

SEQ ID NO: 601727 - DNA, 25 bp, Mus musculus
ggagttagtcctgttagtgttaaat

SEQ ID NO: 601728 - DNA, 25 bp, Mus musculus
ggagttagtgtcaggccagctgtcc

SEQ ID NO: 601729 - DNA, 25 bp, Mus musculus
ggagttagtgtctggccagctgtcc

SEQ ID NO: 601730 - DNA, 25 bp, Mus musculus
ggagttagttgaaccatacttgaga

SEQ ID NO: 601731 - DNA, 25 bp, Mus musculus
ggagttagttgatccatacttgaga

SEQ ID NO: 601732 - DNA, 25 bp, Mus musculus
ggagttataggtcgctgtcttagtt

SEQ ID NO: 601733 - DNA, 25 bp, Mus musculus
ggagttataggtggctgtcttagtt

SEQ ID NO: 601734 - DNA, 25 bp, Mus musculus
ggagttatccacacctctgcaggcc

SEQ ID NO: 601735 - DNA, 25 bp, Mus musculus
ggagttatccactcctctgcaggcc

SEQ ID NO: 601736 - DNA, 25 bp, Mus musculus
ggagttatccgaaacctgggtttct

SEQ ID NO: 601737 - DNA, 25 bp, Mus musculus
ggagttatccgatacctgggtttct

SEQ ID NO: 601738 - DNA, 25 bp, Mus musculus
ggagttatctgcattcctggaacca

SEQ ID NO: 601739 - DNA, 25 bp, Mus musculus
ggagttatctgctttcctggaacca

SEQ ID NO: 601740 - DNA, 25 bp, Mus musculus
ggagttatcttcatgggtgcctata

SEQ ID NO: 601741 - DNA, 25 bp, Mus musculus
ggagttatcttcttgggtgcctata

SEQ ID NO: 601742 - DNA, 25 bp, Mus musculus
ggagttatctttcaaatgtcctata

SEQ ID NO: 601743 - DNA, 25 bp, Mus musculus
ggagttatctttgaaatgtcctata

SEQ ID NO: 601744 - DNA, 25 bp, Mus musculus
ggagttattcccaaatctctgtctg

SEQ ID NO: 601745 - DNA, 25 bp, Mus musculus
ggagttattccctaatctctgtctg

SEQ ID NO: 601746 - DNA, 25 bp, Mus musculus
ggagttattgacctcatctttgaga

SEQ ID NO: 601747 - DNA, 25 bp, Mus musculus
ggagttattgacgtcatctttgaga

SEQ ID NO: 601748 - DNA, 25 bp, Mus musculus
ggagttatttaaccactatgttcag

SEQ ID NO: 601749 - DNA, 25 bp, Mus musculus
ggagttatttaagcactatgttcag

SEQ ID NO: 601750 - DNA, 25 bp, Mus musculus
ggagttatttcccaccaaatgtgac

SEQ ID NO: 601751 - DNA, 25 bp, Mus musculus
ggagttatttccgaccaaatgtgac

SEQ ID NO: 601752 - DNA, 25 bp, Mus musculus
ggagttatttctcaccatatttttc

SEQ ID NO: 601753 - DNA, 25 bp, Mus musculus
ggagttatttctgaccatatttttc

SEQ ID NO: 601754 - DNA, 25 bp, Mus musculus
ggagttcaaactcttgttgtaccag

SEQ ID NO: 601755 - DNA, 25 bp, Mus musculus
ggagttcaaactgttgttgtaccag

SEQ ID NO: 601756 - DNA, 25 bp, Mus musculus
ggagttcaagacactctggctgaag

SEQ ID NO: 601757 - DNA, 25 bp, Mus musculus
ggagttcaagactctctggctgaag

SEQ ID NO: 601758 - DNA, 25 bp, Mus musculus
ggagttcaagggactatcccacagc

SEQ ID NO: 601759 - DNA, 25 bp, Mus musculus
ggagttcaagggtctatcccacagc

SEQ ID NO: 601760 - DNA, 25 bp, Mus musculus
ggagttcacagaacaagcaggagcc

SEQ ID NO: 601761 - DNA, 25 bp, Mus musculus
ggagttcacagatcaagcaggagcc

SEQ ID NO: 601762 - DNA, 25 bp, Mus musculus
ggagttcacggtcatcatctactta

SEQ ID NO: 601763 - DNA, 25 bp, Mus musculus
ggagttcacggtgatcatctactta

SEQ ID NO: 601764 - DNA, 25 bp, Mus musculus
ggagttcacgtcagagttacaccca

SEQ ID NO: 601765 - DNA, 25 bp, Mus musculus
ggagttcacgtctgagttacaccca

SEQ ID NO: 601766 - DNA, 25 bp, Mus musculus
ggagttcagaatcctgagtccacac

SEQ ID NO: 601767 - DNA, 25 bp, Mus musculus
ggagttcagaatgctgagtccacac

SEQ ID NO: 601768 - DNA, 25 bp, Mus musculus
ggagttcagaggacttgctgccagc

SEQ ID NO: 601769 - DNA, 25 bp, Mus musculus
ggagttcagaggtcttgctgccagc

SEQ ID NO: 601770 - DNA, 25 bp, Mus musculus
ggagttcagagtcgctctgtacaga

SEQ ID NO: 601771 - DNA, 25 bp, Mus musculus
ggagttcagagtggctctgtacaga

SEQ ID NO: 601772 - DNA, 25 bp, Mus musculus
ggagttcaggccattcagagacgaa

SEQ ID NO: 601773 - DNA, 25 bp, Mus musculus
ggagttcaggcctttcagagacgaa

SEQ ID NO: 601774 - DNA, 25 bp, Mus musculus
ggagttcatcatatgacatctgggt

SEQ ID NO: 601775 - DNA, 25 bp, Mus musculus
ggagttcatcatttgacatctgggt

SEQ ID NO: 601776 - DNA, 25 bp, Mus musculus
ggagttcatgagacgacctctagag

SEQ ID NO: 601777 - DNA, 25 bp, Mus musculus
ggagttcatgagtcgacctctagag

SEQ ID NO: 601778 - DNA, 25 bp, Mus musculus
ggagttcatgatcaaaacccgtcgt

SEQ ID NO: 601779 - DNA, 25 bp, Mus musculus
ggagttcatgatgaaaacccgtcgt

SEQ ID NO: 601780 - DNA, 25 bp, Mus musculus
ggagttcatgtaagactccttcaga

SEQ ID NO: 601781 - DNA, 25 bp, Mus musculus
ggagttcatgtatgactccttcaga

SEQ ID NO: 601782 - DNA, 25 bp, Mus musculus
ggagttcatgtcaaatcctatgctc

SEQ ID NO: 601783 - DNA, 25 bp, Mus musculus
ggagttcatgtctaatcctatgctc

SEQ ID NO: 601784 - DNA, 25 bp, Mus musculus
ggagttcattaaccagggcatcgag

SEQ ID NO: 601785 - DNA, 25 bp, Mus musculus
ggagttcattaagcagggcatcgag

SEQ ID NO: 601786 - DNA, 25 bp, Mus musculus
ggagttccaaatcatgtcattctac

SEQ ID NO: 601787 - DNA, 25 bp, Mus musculus
ggagttccaaatgatgtcattctac

SEQ ID NO: 601788 - DNA, 25 bp, Mus musculus
ggagttccacatacaactgcatcaa

SEQ ID NO: 601789 - DNA, 25 bp, Mus musculus
ggagttccacattcaactgcatcaa

SEQ ID NO: 601790 - DNA, 25 bp, Mus musculus
ggagttccacttaccagttatcctg

SEQ ID NO: 601791 - DNA, 25 bp, Mus musculus
ggagttccactttccagttatcctg

SEQ ID NO: 601792 - DNA, 25 bp, Mus musculus
ggagttccagaaccttgtccagctg

SEQ ID NO: 601793 - DNA, 25 bp, Mus musculus
ggagttccagaagcttgtccagctg

SEQ ID NO: 601794 - DNA, 25 bp, Mus musculus
ggagttccagttatgggttgagcca

SEQ ID NO: 601795 - DNA, 25 bp, Mus musculus
ggagttccagttttgggttgagcca

SEQ ID NO: 601796 - DNA, 25 bp, Mus musculus
ggagttccatgcactaagcctgatg

SEQ ID NO: 601797 - DNA, 25 bp, Mus musculus
ggagttccatgctctaagcctgatg

SEQ ID NO: 601798 - DNA, 25 bp, Mus musculus
ggagttccatgtcctgcagcagcga

SEQ ID NO: 601799 - DNA, 25 bp, Mus musculus
ggagttccatgtgctgcagcagcga

SEQ ID NO: 601800 - DNA, 25 bp, Mus musculus
ggagttcccaaaagttgtcttctga

SEQ ID NO: 601801 - DNA, 25 bp, Mus musculus
ggagttcccaaatgttgtcttctga

SEQ ID NO: 601802 - DNA, 25 bp, Mus musculus
ggagttcccactagctcctctggat

SEQ ID NO: 601803 - DNA, 25 bp, Mus musculus
ggagttcccacttgctcctctggat

SEQ ID NO: 601804 - DNA, 25 bp, Mus musculus
ggagttcccatcagtcaccttggag

SEQ ID NO: 601805 - DNA, 25 bp, Mus musculus
ggagttcccatctgtcaccttggag

SEQ ID NO: 601806 - DNA, 25 bp, Mus musculus
ggagttccccaacttcaacagcaga

SEQ ID NO: 601807 - DNA, 25 bp, Mus musculus
ggagttccccaagttcaacagcaga

SEQ ID NO: 601808 - DNA, 25 bp, Mus musculus
ggagttcccctgatggctttcccaa

SEQ ID NO: 601809 - DNA, 25 bp, Mus musculus
ggagttcccctgttggctttcccaa

SEQ ID NO: 601810 - DNA, 25 bp, Mus musculus
ggagttcccgtcctgcaggagacac

SEQ ID NO: 601811 - DNA, 25 bp, Mus musculus
ggagttcccgtcgtgcaggagacac

SEQ ID NO: 601812 - DNA, 25 bp, Mus musculus
ggagttccctgaagttatgctgagc

SEQ ID NO: 601813 - DNA, 25 bp, Mus musculus
ggagttccctgatgttatgctgagc

SEQ ID NO: 601814 - DNA, 25 bp, Mus musculus
ggagttccctggaaactagtgcaca

SEQ ID NO: 601815 - DNA, 25 bp, Mus musculus
ggagttccctggtaactagtgcaca

SEQ ID NO: 601816 - DNA, 25 bp, Mus musculus
ggagttcctcacacgtgctgagctg

SEQ ID NO: 601817 - DNA, 25 bp, Mus musculus
ggagttcctcacactaatcaggagc

SEQ ID NO: 601818 - DNA, 25 bp, Mus musculus
ggagttcctcactcgtgctgagctg

SEQ ID NO: 601819 - DNA, 25 bp, Mus musculus
ggagttcctcactctaatcaggagc

SEQ ID NO: 601820 - DNA, 25 bp, Mus musculus
ggagttcctcggagtgatcaggtca

SEQ ID NO: 601821 - DNA, 25 bp, Mus musculus
ggagttcctcggtgtgatcaggtca

SEQ ID NO: 601822 - DNA, 25 bp, Mus musculus
ggagttcctgatatacgtcctcaac

SEQ ID NO: 601823 - DNA, 25 bp, Mus musculus
ggagttcctgatttacgtcctcaac

SEQ ID NO: 601824 - DNA, 25 bp, Mus musculus
ggagttcgaagcaatcctgagatac

SEQ ID NO: 601825 - DNA, 25 bp, Mus musculus
ggagttcgaagctatcctgagatac

SEQ ID NO: 601826 - DNA, 25 bp, Mus musculus
ggagttcgagttagtcaccaccgag

SEQ ID NO: 601827 - DNA, 25 bp, Mus musculus
ggagttcgagtttgtcaccaccgag

SEQ ID NO: 601828 - DNA, 25 bp, Mus musculus
ggagttcgcaaaagtatcagcccct

SEQ ID NO: 601829 - DNA, 25 bp, Mus musculus
ggagttcgcaaatgtatcagcccct

SEQ ID NO: 601830 - DNA, 25 bp, Mus musculus
ggagttcgccagacaagagcttcag

SEQ ID NO: 601831 - DNA, 25 bp, Mus musculus
ggagttcgccagtcaagagcttcag

SEQ ID NO: 601832 - DNA, 25 bp, Mus musculus
ggagttctaacccatgcaattcttt

SEQ ID NO: 601833 - DNA, 25 bp, Mus musculus
ggagttctaaccgatgcaattcttt

SEQ ID NO: 601834 - DNA, 25 bp, Mus musculus
ggagttctcactcctcaaaaactga

SEQ ID NO: 601835 - DNA, 25 bp, Mus musculus
ggagttctcactgctcaaaaactga

SEQ ID NO: 601836 - DNA, 25 bp, Mus musculus
ggagttctcagaacactttcgctgc

SEQ ID NO: 601837 - DNA, 25 bp, Mus musculus
ggagttctcagatcactttcgctgc

SEQ ID NO: 601838 - DNA, 25 bp, Mus musculus
ggagttctcatccagacattctgaa

SEQ ID NO: 601839 - DNA, 25 bp, Mus musculus
ggagttctcatcgagacattctgaa

SEQ ID NO: 601840 - DNA, 25 bp, Mus musculus
ggagttctccgacggcttggcccaa

SEQ ID NO: 601841 - DNA, 25 bp, Mus musculus
ggagttctccgagggcttggcccaa

SEQ ID NO: 601842 - DNA, 25 bp, Mus musculus
ggagttctcctgatccagtgaggcc

SEQ ID NO: 601843 - DNA, 25 bp, Mus musculus
ggagttctcctgttccagtgaggcc

SEQ ID NO: 601844 - DNA, 25 bp, Mus musculus
ggagttctctgtcagtgaccaccaa

SEQ ID NO: 601845 - DNA, 25 bp, Mus musculus
ggagttctctgtgagtgaccaccaa

SEQ ID NO: 601846 - DNA, 25 bp, Mus musculus
ggagttctgaagaaggccacacaaa

SEQ ID NO: 601847 - DNA, 25 bp, Mus musculus
ggagttctgaagtaggccacacaaa

SEQ ID NO: 601848 - DNA, 25 bp, Mus musculus
ggagttctgactcgtttttccaaat

SEQ ID NO: 601849 - DNA, 25 bp, Mus musculus
ggagttctgactggtttttccaaat

SEQ ID NO: 601850 - DNA, 25 bp, Mus musculus
ggagttctgataatgaatggaatta

SEQ ID NO: 601851 - DNA, 25 bp, Mus musculus
ggagttctgatattgaatggaatta

SEQ ID NO: 601852 - DNA, 25 bp, Mus musculus
ggagttctgcagatatggtatacca

SEQ ID NO: 601853 - DNA, 25 bp, Mus musculus
ggagttctgcagttatggtatacca

SEQ ID NO: 601854 - DNA, 25 bp, Mus musculus
ggagttctgcatccaaaacgctcct

SEQ ID NO: 601855 - DNA, 25 bp, Mus musculus
ggagttctgcatgcaaaacgctcct

SEQ ID NO: 601856 - DNA, 25 bp, Mus musculus
ggagttctgcgtagccaagcaccag

SEQ ID NO: 601857 - DNA, 25 bp, Mus musculus
ggagttctgcgttgccaagcaccag

SEQ ID NO: 601858 - DNA, 25 bp, Mus musculus
ggagttctgggaagaaactcagcca

SEQ ID NO: 601859 - DNA, 25 bp, Mus musculus
ggagttctgggatgaaactcagcca

SEQ ID NO: 601860 - DNA, 25 bp, Mus musculus
ggagttctggtaaacctcatcttca

SEQ ID NO: 601861 - DNA, 25 bp, Mus musculus
ggagttctggtatacctcatcttca

SEQ ID NO: 601862 - DNA, 25 bp, Mus musculus
ggagttctgtagagacaaataatca

SEQ ID NO: 601863 - DNA, 25 bp, Mus musculus
ggagttctgtagtgacaaataatca

SEQ ID NO: 601864 - DNA, 25 bp, Mus musculus
ggagttctgtgcaaaccaaaatctg

SEQ ID NO: 601865 - DNA, 25 bp, Mus musculus
ggagttctgtgctaaccaaaatctg

SEQ ID NO: 601866 - DNA, 25 bp, Mus musculus
ggagttcttattccgtgactgtagg

SEQ ID NO: 601867 - DNA, 25 bp, Mus musculus
ggagttcttattgcgtgactgtagg

SEQ ID NO: 601868 - DNA, 25 bp, Mus musculus
ggagttcttcaaataccagaggtaa

SEQ ID NO: 601869 - DNA, 25 bp, Mus musculus
ggagttcttcaattaccagaggtaa

SEQ ID NO: 601870 - DNA, 25 bp, Mus musculus
ggagttcttcggaaacccaagagtg

SEQ ID NO: 601871 - DNA, 25 bp, Mus musculus
ggagttcttcggtaacccaagagtg

SEQ ID NO: 601872 - DNA, 25 bp, Mus musculus
ggagttcttgataccagtgtttctg

SEQ ID NO: 601873 - DNA, 25 bp, Mus musculus
ggagttcttgattccagtgtttctg

SEQ ID NO: 601874 - DNA, 25 bp, Mus musculus
ggagttcttggcaacagcaaggcca

SEQ ID NO: 601875 - DNA, 25 bp, Mus musculus
ggagttcttggctacagcaaggcca

SEQ ID NO: 601876 - DNA, 25 bp, Mus musculus
ggagttcttgggagaaatttagtat

SEQ ID NO: 601877 - DNA, 25 bp, Mus musculus
ggagttcttgggtgaaatttagtat

SEQ ID NO: 601878 - DNA, 25 bp, Mus musculus
ggagttctttacacatgattttcat

SEQ ID NO: 601879 - DNA, 25 bp, Mus musculus
ggagttctttactcatgattttcat

SEQ ID NO: 601880 - DNA, 25 bp, Mus musculus
ggagttctttcccacatgaacagca

SEQ ID NO: 601881 - DNA, 25 bp, Mus musculus
ggagttctttccgacatgaacagca

SEQ ID NO: 601882 - DNA, 25 bp, Mus musculus
ggagttctttctattgtaggttgtg

SEQ ID NO: 601883 - DNA, 25 bp, Mus musculus
ggagttctttcttttgtaggttgtg

SEQ ID NO: 601884 - DNA, 25 bp, Mus musculus
ggagttcttttcagctatcctgcct

SEQ ID NO: 601885 - DNA, 25 bp, Mus musculus
ggagttcttttcataccacttttgg

SEQ ID NO: 601886 - DNA, 25 bp, Mus musculus
ggagttcttttctgctatcctgcct

SEQ ID NO: 601887 - DNA, 25 bp, Mus musculus
ggagttcttttcttaccacttttgg

SEQ ID NO: 601888 - DNA, 25 bp, Mus musculus
ggagttctttttagccacaatcttt

SEQ ID NO: 601889 - DNA, 25 bp, Mus musculus
ggagttcttttttgccacaatcttt

SEQ ID NO: 601890 - DNA, 25 bp, Mus musculus
ggagttgaactacgccctcatgtgc

SEQ ID NO: 601891 - DNA, 25 bp, Mus musculus
ggagttgaactaggccctcatgtgc

SEQ ID NO: 601892 - DNA, 25 bp, Mus musculus
ggagttgaacttctgatggcttcta

SEQ ID NO: 601893 - DNA, 25 bp, Mus musculus
ggagttgaacttgtgatggcttcta

SEQ ID NO: 601894 - DNA, 25 bp, Mus musculus
ggagttgaattgattttgctacaca

SEQ ID NO: 601895 - DNA, 25 bp, Mus musculus
ggagttgaattgtttttgctacaca

SEQ ID NO: 601896 - DNA, 25 bp, Mus musculus
ggagttgaatttcctcttcccaaga

SEQ ID NO: 601897 - DNA, 25 bp, Mus musculus
ggagttgaatttgctcttcccaaga

SEQ ID NO: 601898 - DNA, 25 bp, Mus musculus
ggagttgacatacttcttcatgtaa

SEQ ID NO: 601899 - DNA, 25 bp, Mus musculus
ggagttgacatagttcttcatgtaa

SEQ ID NO: 601900 - DNA, 25 bp, Mus musculus
ggagttgagctcctcctgcaaggtc

SEQ ID NO: 601901 - DNA, 25 bp, Mus musculus
ggagttgagctcgtcctgcaaggtc

SEQ ID NO: 601902 - DNA, 25 bp, Mus musculus
ggagttgatcgcctatagccagtac

SEQ ID NO: 601903 - DNA, 25 bp, Mus musculus
ggagttgatcgcgtatagccagtac

SEQ ID NO: 601904 - DNA, 25 bp, Mus musculus
ggagttgcaaacagctatgaaccat

SEQ ID NO: 601905 - DNA, 25 bp, Mus musculus
ggagttgcaaactgctatgaaccat

SEQ ID NO: 601906 - DNA, 25 bp, Mus musculus
ggagttgcacctatgggacaccata

SEQ ID NO: 601907 - DNA, 25 bp, Mus musculus
ggagttgcacctttgggacaccata

SEQ ID NO: 601908 - DNA, 25 bp, Mus musculus
ggagttgcactaagattgttccaag

SEQ ID NO: 601909 - DNA, 25 bp, Mus musculus
ggagttgcactatgattgttccaag

SEQ ID NO: 601910 - DNA, 25 bp, Mus musculus
ggagttgcagccagcgctgccccat

SEQ ID NO: 601911 - DNA, 25 bp, Mus musculus
ggagttgcagcctgcgctgccccat

SEQ ID NO: 601912 - DNA, 25 bp, Mus musculus
ggagttgccagtatcccagtgtgct

SEQ ID NO: 601913 - DNA, 25 bp, Mus musculus
ggagttgccagtttcccagtgtgct

SEQ ID NO: 601914 - DNA, 25 bp, Mus musculus
ggagttgcccatatgtttggagtgt

SEQ ID NO: 601915 - DNA, 25 bp, Mus musculus
ggagttgcccatttgtttggagtgt

SEQ ID NO: 601916 - DNA, 25 bp, Mus musculus
ggagttgcccgtactcgcgagtgca

SEQ ID NO: 601917 - DNA, 25 bp, Mus musculus
ggagttgcccgttctcgcgagtgca

SEQ ID NO: 601918 - DNA, 25 bp, Mus musculus
ggagttgccgctccctataagtttg

SEQ ID NO: 601919 - DNA, 25 bp, Mus musculus
ggagttgccgctgcctataagtttg

SEQ ID NO: 601920 - DNA, 25 bp, Mus musculus
ggagttgccgttatactgttctggg

SEQ ID NO: 601921 - DNA, 25 bp, Mus musculus
ggagttgccgttttactgttctggg

SEQ ID NO: 601922 - DNA, 25 bp, Mus musculus
ggagttgcctcacaatgccatttgg

SEQ ID NO: 601923 - DNA, 25 bp, Mus musculus
ggagttgcctcagaatgccatttgg

SEQ ID NO: 601924 - DNA, 25 bp, Mus musculus
ggagttgctactatctagtatatgt

SEQ ID NO: 601925 - DNA, 25 bp, Mus musculus
ggagttgctactttctagtatatgt

SEQ ID NO: 601926 - DNA, 25 bp, Mus musculus
ggagttgctccccaaaaatgttact

SEQ ID NO: 601927 - DNA, 25 bp, Mus musculus
ggagttgctcccgaaaaatgttact

SEQ ID NO: 601928 - DNA, 25 bp, Mus musculus
ggagttggaattaccaccgggctag

SEQ ID NO: 601929 - DNA, 25 bp, Mus musculus
ggagttggaatttccaccgggctag

SEQ ID NO: 601930 - DNA, 25 bp, Mus musculus
ggagttggaccacgttttcaacgat

SEQ ID NO: 601931 - DNA, 25 bp, Mus musculus
ggagttggaccaggttttcaacgat

SEQ ID NO: 601932 - DNA, 25 bp, Mus musculus
ggagttggactcagtgcaatgcaca

SEQ ID NO: 601933 - DNA, 25 bp, Mus musculus
ggagttggactctgtgcaatgcaca

SEQ ID NO: 601934 - DNA, 25 bp, Mus musculus
ggagttggagccattcggaagcaaa

SEQ ID NO: 601935 - DNA, 25 bp, Mus musculus
ggagttggagcctttcggaagcaaa

SEQ ID NO: 601936 - DNA, 25 bp, Mus musculus
ggagttggatcaaaccatcttgtcc

SEQ ID NO: 601937 - DNA, 25 bp, Mus musculus
ggagttggatcataccatcttgtcc

SEQ ID NO: 601938 - DNA, 25 bp, Mus musculus
ggagttggatccagagacctctcca

SEQ ID NO: 601939 - DNA, 25 bp, Mus musculus
ggagttggatcctgagacctctcca

SEQ ID NO: 601940 - DNA, 25 bp, Mus musculus
ggagttggcataaatttcaagttgt

SEQ ID NO: 601941 - DNA, 25 bp, Mus musculus
ggagttggcatatatttcaagttgt

SEQ ID NO: 601942 - DNA, 25 bp, Mus musculus
ggagttggcctcatataaaccatga

SEQ ID NO: 601943 - DNA, 25 bp, Mus musculus
ggagttggcctcttataaaccatga

SEQ ID NO: 601944 - DNA, 25 bp, Mus musculus
ggagttggctgtccggtaccatcct

SEQ ID NO: 601945 - DNA, 25 bp, Mus musculus
ggagttggctgtgcggtaccatcct

SEQ ID NO: 601946 - DNA, 25 bp, Mus musculus
ggagttggcttaacctttagcttac

SEQ ID NO: 601947 - DNA, 25 bp, Mus musculus
ggagttggcttatcctttagcttac

SEQ ID NO: 601948 - DNA, 25 bp, Mus musculus
ggagttgggctacacaattcccaaa

SEQ ID NO: 601949 - DNA, 25 bp, Mus musculus
ggagttgggctagacaattcccaaa

SEQ ID NO: 601950 - DNA, 25 bp, Mus musculus
ggagttgggtgtaacttccagccct

SEQ ID NO: 601951 - DNA, 25 bp, Mus musculus
ggagttgggtgttacttccagccct

SEQ ID NO: 601952 - DNA, 25 bp, Mus musculus
ggagttgggttcagcagcttcacct

SEQ ID NO: 601953 - DNA, 25 bp, Mus musculus
ggagttgggttctgcagcttcacct

SEQ ID NO: 601954 - DNA, 25 bp, Mus musculus
ggagttggttcactgcatgtatgtt

SEQ ID NO: 601955 - DNA, 25 bp, Mus musculus
ggagttggttcagtgcatgtatgtt

SEQ ID NO: 601956 - DNA, 25 bp, Mus musculus
ggagttgtaagcaggacctaggcct

SEQ ID NO: 601957 - DNA, 25 bp, Mus musculus
ggagttgtaagctggacctaggcct

SEQ ID NO: 601958 - DNA, 25 bp, Mus musculus
ggagttgtactgagtcctttcattt

SEQ ID NO: 601959 - DNA, 25 bp, Mus musculus
ggagttgtactgtgtcctttcattt

SEQ ID NO: 601960 - DNA, 25 bp, Mus musculus
ggagttgtatgcctcctacgtctat

SEQ ID NO: 601961 - DNA, 25 bp, Mus musculus
ggagttgtatgcgtcctacgtctat

SEQ ID NO: 601962 - DNA, 25 bp, Mus musculus
ggagttgtcacccagtctctttcct

SEQ ID NO: 601963 - DNA, 25 bp, Mus musculus
ggagttgtcaccgagtctctttcct

SEQ ID NO: 601964 - DNA, 25 bp, Mus musculus
ggagttgtcagaagaacccctcgat

SEQ ID NO: 601965 - DNA, 25 bp, Mus musculus
ggagttgtcagaatgtctctctcac

SEQ ID NO: 601966 - DNA, 25 bp, Mus musculus
ggagttgtcagatgaacccctcgat

SEQ ID NO: 601967 - DNA, 25 bp, Mus musculus
ggagttgtcagattgtctctctcac

SEQ ID NO: 601968 - DNA, 25 bp, Mus musculus
ggagttgtcagtacagctcgtcaaa

SEQ ID NO: 601969 - DNA, 25 bp, Mus musculus
ggagttgtcagttcagctcgtcaaa

SEQ ID NO: 601970 - DNA, 25 bp, Mus musculus
ggagttgtccatacattacttgaga

SEQ ID NO: 601971 - DNA, 25 bp, Mus musculus
ggagttgtccattcattacttgaga

SEQ ID NO: 601972 - DNA, 25 bp, Mus musculus
ggagttgtccttactgggatctttc

SEQ ID NO: 601973 - DNA, 25 bp, Mus musculus
ggagttgtcctttctgggatctttc

SEQ ID NO: 601974 - DNA, 25 bp, Mus musculus
ggagttgtgaacctcttttcattga

SEQ ID NO: 601975 - DNA, 25 bp, Mus musculus
ggagttgtgaacgtcttttcattga

SEQ ID NO: 601976 - DNA, 25 bp, Mus musculus
ggagttgtgcagagctagcccagaa

SEQ ID NO: 601977 - DNA, 25 bp, Mus musculus
ggagttgtgcagtgctagcccagaa

SEQ ID NO: 601978 - DNA, 25 bp, Mus musculus
ggagttgttcacatttgccctgcac

SEQ ID NO: 601979 - DNA, 25 bp, Mus musculus
ggagttgttcacttttgccctgcac

SEQ ID NO: 601980 - DNA, 25 bp, Mus musculus
ggagttgtttgtcaagtctttgcat

SEQ ID NO: 601981 - DNA, 25 bp, Mus musculus
ggagttgtttgtgaagtctttgcat

SEQ ID NO: 601982 - DNA, 25 bp, Mus musculus
ggagttgtttttcagatcttcaata

SEQ ID NO: 601983 - DNA, 25 bp, Mus musculus
ggagttgtttttgagatcttcaata

SEQ ID NO: 601984 - DNA, 25 bp, Mus musculus
ggagtttacaatcccatcctatggc

SEQ ID NO: 601985 - DNA, 25 bp, Mus musculus
ggagtttacaatgccatcctatggc

SEQ ID NO: 601986 - DNA, 25 bp, Mus musculus
ggagtttacccaagacatccagtct

SEQ ID NO: 601987 - DNA, 25 bp, Mus musculus
ggagtttacccatgacatccagtct

SEQ ID NO: 601988 - DNA, 25 bp, Mus musculus
ggagtttactgacctggtccccgag

SEQ ID NO: 601989 - DNA, 25 bp, Mus musculus
ggagtttactgagctggtccccgag

SEQ ID NO: 601990 - DNA, 25 bp, Mus musculus
ggagtttagcctcataatcttgtgg

SEQ ID NO: 601991 - DNA, 25 bp, Mus musculus
ggagtttagcctgataatcttgtgg

SEQ ID NO: 601992 - DNA, 25 bp, Mus musculus
ggagtttagtctcccgccctttgat

SEQ ID NO: 601993 - DNA, 25 bp, Mus musculus
ggagtttagtctgccgccctttgat

SEQ ID NO: 601994 - DNA, 25 bp, Mus musculus
ggagtttatgatctgaccttgttga

SEQ ID NO: 601995 - DNA, 25 bp, Mus musculus
ggagtttatgatgtgaccttgttga

SEQ ID NO: 601996 - DNA, 25 bp, Mus musculus
ggagtttattacagctttcaaggtt

SEQ ID NO: 601997 - DNA, 25 bp, Mus musculus
ggagtttattactgctttcaaggtt

SEQ ID NO: 601998 - DNA, 25 bp, Mus musculus
ggagtttcaaaaatcaaccagtcac

SEQ ID NO: 601999 - DNA, 25 bp, Mus musculus
ggagtttcaaaattcaaccagtcac

SEQ ID NO: 602000 - DNA, 25 bp, Mus musculus
ggagtttcaaatctagtcacgcctt

SEQ ID NO: 602001 - DNA, 25 bp, Mus musculus
ggagtttcaaatgtagtcacgcctt

SEQ ID NO: 602002 - DNA, 25 bp, Mus musculus
ggagtttcaataccggagatcatgc

SEQ ID NO: 602003 - DNA, 25 bp, Mus musculus
ggagtttcaatagcggagatcatgc

SEQ ID NO: 602004 - DNA, 25 bp, Mus musculus
ggagtttcagaacacttggcccaat

SEQ ID NO: 602005 - DNA, 25 bp, Mus musculus
ggagtttcagaagacttggcccaat

SEQ ID NO: 602006 - DNA, 25 bp, Mus musculus
ggagtttcagctctttattgctaag

SEQ ID NO: 602007 - DNA, 25 bp, Mus musculus
ggagtttcagctgtttattgctaag

SEQ ID NO: 602008 - DNA, 25 bp, Mus musculus
ggagtttcatgtcaataccttacac

SEQ ID NO: 602009 - DNA, 25 bp, Mus musculus
ggagtttcatgtgaataccttacac

SEQ ID NO: 602010 - DNA, 25 bp, Mus musculus
ggagtttcattgacaagtccttgac

SEQ ID NO: 602011 - DNA, 25 bp, Mus musculus
ggagtttcattgtcaagtccttgac

SEQ ID NO: 602012 - DNA, 25 bp, Mus musculus
ggagtttccacacactcagctgcag

SEQ ID NO: 602013 - DNA, 25 bp, Mus musculus
ggagtttccacagactcagctgcag

SEQ ID NO: 602014 - DNA, 25 bp, Mus musculus
ggagtttccagaccctcagagacag

SEQ ID NO: 602015 - DNA, 25 bp, Mus musculus
ggagtttccagagcctcagagacag

SEQ ID NO: 602016 - DNA, 25 bp, Mus musculus
ggagtttccagtactgagaactact

SEQ ID NO: 602017 - DNA, 25 bp, Mus musculus
ggagtttccagttctgagaactact

SEQ ID NO: 602018 - DNA, 25 bp, Mus musculus
ggagtttcccagaatgcctttattt

SEQ ID NO: 602019 - DNA, 25 bp, Mus musculus
ggagtttcccagtatgcctttattt

SEQ ID NO: 602020 - DNA, 25 bp, Mus musculus
ggagtttcccatactattgtttact

SEQ ID NO: 602021 - DNA, 25 bp, Mus musculus
ggagtttcccattctattgtttact

SEQ ID NO: 602022 - DNA, 25 bp, Mus musculus
ggagtttcccctagtatatcttgga

SEQ ID NO: 602023 - DNA, 25 bp, Mus musculus
ggagtttccccttgtatatcttgga

SEQ ID NO: 602024 - DNA, 25 bp, Mus musculus
ggagtttcctatagtaataccaaag

SEQ ID NO: 602025 - DNA, 25 bp, Mus musculus
ggagtttcctattgtaataccaaag

SEQ ID NO: 602026 - DNA, 25 bp, Mus musculus
ggagtttcgctcacatcacaaagta

SEQ ID NO: 602027 - DNA, 25 bp, Mus musculus
ggagtttcgctctcatcacaaagta

SEQ ID NO: 602028 - DNA, 25 bp, Mus musculus
ggagtttctcatatatacttagaca

SEQ ID NO: 602029 - DNA, 25 bp, Mus musculus
ggagtttctcatttatacttagaca

SEQ ID NO: 602030 - DNA, 25 bp, Mus musculus
ggagtttctgcccactgtcgggcat

SEQ ID NO: 602031 - DNA, 25 bp, Mus musculus
ggagtttctgccgactgtcgggcat

SEQ ID NO: 602032 - DNA, 25 bp, Mus musculus
ggagtttcttgtaacaatgcccttt

SEQ ID NO: 602033 - DNA, 25 bp, Mus musculus
ggagtttcttgttacaatgcccttt

SEQ ID NO: 602034 - DNA, 25 bp, Mus musculus
ggagtttgatcaacacgaacacgtt

SEQ ID NO: 602035 - DNA, 25 bp, Mus musculus
ggagtttgatcatcacgaacacgtt

SEQ ID NO: 602036 - DNA, 25 bp, Mus musculus
ggagtttgatctccatggctcaaga

SEQ ID NO: 602037 - DNA, 25 bp, Mus musculus
ggagtttgatctgcatggctcaaga

SEQ ID NO: 602038 - DNA, 25 bp, Mus musculus
ggagtttgattacaccatctgtgaa

SEQ ID NO: 602039 - DNA, 25 bp, Mus musculus
ggagtttgattagaccatctgtgaa

SEQ ID NO: 602040 - DNA, 25 bp, Mus musculus
ggagtttgatttatagattctattg

SEQ ID NO: 602041 - DNA, 25 bp, Mus musculus
ggagtttgatttttagattctattg

SEQ ID NO: 602042 - DNA, 25 bp, Mus musculus
ggagtttgcatcacatttacatgga

SEQ ID NO: 602043 - DNA, 25 bp, Mus musculus
ggagtttgcatctcatttacatgga

SEQ ID NO: 602044 - DNA, 25 bp, Mus musculus
ggagtttgccaaccggctttcaggc

SEQ ID NO: 602045 - DNA, 25 bp, Mus musculus
ggagtttgccaagcggctttcaggc

SEQ ID NO: 602046 - DNA, 25 bp, Mus musculus
ggagtttgccatctattgacttaaa

SEQ ID NO: 602047 - DNA, 25 bp, Mus musculus
ggagtttgccatgtattgacttaaa

SEQ ID NO: 602048 - DNA, 25 bp, Mus musculus
ggagtttgcgtcactgttgtacaaa

SEQ ID NO: 602049 - DNA, 25 bp, Mus musculus
ggagtttgcgtctctgttgtacaaa

SEQ ID NO: 602050 - DNA, 25 bp, Mus musculus
ggagtttgctcaatactgcaacttc

SEQ ID NO: 602051 - DNA, 25 bp, Mus musculus
ggagtttgctcactatgttctgttt

SEQ ID NO: 602052 - DNA, 25 bp, Mus musculus
ggagtttgctcagtatgttctgttt

SEQ ID NO: 602053 - DNA, 25 bp, Mus musculus
ggagtttgctcattactgcaacttc

SEQ ID NO: 602054 - DNA, 25 bp, Mus musculus
ggagtttgctcgaatcatgaccatg

SEQ ID NO: 602055 - DNA, 25 bp, Mus musculus
ggagtttgctcgtatcatgaccatg

SEQ ID NO: 602056 - DNA, 25 bp, Mus musculus
ggagtttgtacacgaagccatgaaa

SEQ ID NO: 602057 - DNA, 25 bp, Mus musculus
ggagtttgtacaggaagccatgaaa

SEQ ID NO: 602058 - DNA, 25 bp, Mus musculus
ggagtttgtgctcttctacgagagc

SEQ ID NO: 602059 - DNA, 25 bp, Mus musculus
ggagtttgtgctgttctacgagagc

SEQ ID NO: 602060 - DNA, 25 bp, Mus musculus
ggagtttgttgcacttttctagaaa

SEQ ID NO: 602061 - DNA, 25 bp, Mus musculus
ggagtttgttgctcttttctagaaa

SEQ ID NO: 602062 - DNA, 25 bp, Mus musculus
ggagttttaaagacagtacgatcat

SEQ ID NO: 602063 - DNA, 25 bp, Mus musculus
ggagttttaaagtcagtacgatcat

SEQ ID NO: 602064 - DNA, 25 bp, Mus musculus
ggagttttaaataccacatgcggga

SEQ ID NO: 602065 - DNA, 25 bp, Mus musculus
ggagttttaaattccacatgcggga

SEQ ID NO: 602066 - DNA, 25 bp, Mus musculus
ggagttttacagctgccttctcaga

SEQ ID NO: 602067 - DNA, 25 bp, Mus musculus
ggagttttacaggtgccttctcaga

SEQ ID NO: 602068 - DNA, 25 bp, Mus musculus
ggagttttactacaagccttgtctc

SEQ ID NO: 602069 - DNA, 25 bp, Mus musculus
ggagttttactagaagccttgtctc

SEQ ID NO: 602070 - DNA, 25 bp, Mus musculus
ggagttttatatactgacaggcttt

SEQ ID NO: 602071 - DNA, 25 bp, Mus musculus
ggagttttatattctgacaggcttt

SEQ ID NO: 602072 - DNA, 25 bp, Mus musculus
ggagttttatcacatacccactcac

SEQ ID NO: 602073 - DNA, 25 bp, Mus musculus
ggagttttatcagatacccactcac

SEQ ID NO: 602074 - DNA, 25 bp, Mus musculus
ggagttttcaccatatagcttagca

SEQ ID NO: 602075 - DNA, 25 bp, Mus musculus
ggagttttcaccttatagcttagca

SEQ ID NO: 602076 - DNA, 25 bp, Mus musculus
ggagttttcatactttattctgtaa

SEQ ID NO: 602077 - DNA, 25 bp, Mus musculus
ggagttttcatagtttattctgtaa

SEQ ID NO: 602078 - DNA, 25 bp, Mus musculus
ggagttttcctcaacatgggagtct

SEQ ID NO: 602079 - DNA, 25 bp, Mus musculus
ggagttttcctctacatgggagtct

SEQ ID NO: 602080 - DNA, 25 bp, Mus musculus
ggagttttcgctcaggcaaacaagt

SEQ ID NO: 602081 - DNA, 25 bp, Mus musculus
ggagttttcgctgaggcaaacaagt

SEQ ID NO: 602082 - DNA, 25 bp, Mus musculus
ggagttttcggacccagagagagaa

SEQ ID NO: 602083 - DNA, 25 bp, Mus musculus
ggagttttcggagccagagagagaa

SEQ ID NO: 602084 - DNA, 25 bp, Mus musculus
ggagttttctcaccctgaaataaat

SEQ ID NO: 602085 - DNA, 25 bp, Mus musculus
ggagttttctcagcctgaaataaat

SEQ ID NO: 602086 - DNA, 25 bp, Mus musculus
ggagttttctgcagtggacccagtt

SEQ ID NO: 602087 - DNA, 25 bp, Mus musculus
ggagttttctgctgtggacccagtt

SEQ ID NO: 602088 - DNA, 25 bp, Mus musculus
ggagttttctgtcggagctaaggga

SEQ ID NO: 602089 - DNA, 25 bp, Mus musculus
ggagttttctgtgggagctaaggga

SEQ ID NO: 602090 - DNA, 25 bp, Mus musculus
ggagttttcttgctaggaatcacca

SEQ ID NO: 602091 - DNA, 25 bp, Mus musculus
ggagttttcttggtaggaatcacca

SEQ ID NO: 602092 - DNA, 25 bp, Mus musculus
ggagttttgatactggatacccaag

SEQ ID NO: 602093 - DNA, 25 bp, Mus musculus
ggagttttgatagtggatacccaag

SEQ ID NO: 602094 - DNA, 25 bp, Mus musculus
ggagttttgcaaatctcagcactgg

SEQ ID NO: 602095 - DNA, 25 bp, Mus musculus
ggagttttgcaattctcagcactgg

SEQ ID NO: 602096 - DNA, 25 bp, Mus musculus
ggagttttgctgaggtaccaaccat

SEQ ID NO: 602097 - DNA, 25 bp, Mus musculus
ggagttttgctgtggtaccaaccat

SEQ ID NO: 602098 - DNA, 25 bp, Mus musculus
ggagttttggccaattctccagcac

SEQ ID NO: 602099 - DNA, 25 bp, Mus musculus
ggagttttggcctattctccagcac

SEQ ID NO: 602100 - DNA, 25 bp, Mus musculus
ggagtttttctccaagtgaaccaat

SEQ ID NO: 602101 - DNA, 25 bp, Mus musculus
ggagtttttctcgaagtgaaccaat

SEQ ID NO: 602102 - DNA, 25 bp, Mus musculus
ggataaaacatcctaccgctggttc

SEQ ID NO: 602103 - DNA, 25 bp, Mus musculus
ggataaaacatcgtaccgctggttc

SEQ ID NO: 602104 - DNA, 25 bp, Mus musculus
ggataaaaccttagcaaagctgtat

SEQ ID NO: 602105 - DNA, 25 bp, Mus musculus
ggataaaaccttccatgacctagtt

SEQ ID NO: 602106 - DNA, 25 bp, Mus musculus
ggataaaaccttgcatgacctagtt

SEQ ID NO: 602107 - DNA, 25 bp, Mus musculus
ggataaaacctttgcaaagctgtat

SEQ ID NO: 602108 - DNA, 25 bp, Mus musculus
ggataaaactggatccctatctttg

SEQ ID NO: 602109 - DNA, 25 bp, Mus musculus
ggataaaactggttccctatctttg

SEQ ID NO: 602110 - DNA, 25 bp, Mus musculus
ggataaaagcccagtccgtgactgg

SEQ ID NO: 602111 - DNA, 25 bp, Mus musculus
ggataaaagccctgtccgtgactgg

SEQ ID NO: 602112 - DNA, 25 bp, Mus musculus
ggataaaagggacccatgctgtgct

SEQ ID NO: 602113 - DNA, 25 bp, Mus musculus
ggataaaagggagccatgctgtgct

SEQ ID NO: 602114 - DNA, 25 bp, Mus musculus
ggataaaatctccaacatggcgttt

SEQ ID NO: 602115 - DNA, 25 bp, Mus musculus
ggataaaatctcgaacatggcgttt

SEQ ID NO: 602116 - DNA, 25 bp, Mus musculus
ggataaaattccctactccagcttc

SEQ ID NO: 602117 - DNA, 25 bp, Mus musculus
ggataaaattccgtactccagcttc

SEQ ID NO: 602118 - DNA, 25 bp, Mus musculus
ggataaaatttacgctcatgataca

SEQ ID NO: 602119 - DNA, 25 bp, Mus musculus
ggataaaatttaggctcatgataca

SEQ ID NO: 602120 - DNA, 25 bp, Mus musculus
ggataaacaagcagacacacatgtg

SEQ ID NO: 602121 - DNA, 25 bp, Mus musculus
ggataaacaagctgacacacatgtg

SEQ ID NO: 602122 - DNA, 25 bp, Mus musculus
ggataaacaattcctgtgtctaatt

SEQ ID NO: 602123 - DNA, 25 bp, Mus musculus
ggataaacaattgctgtgtctaatt

SEQ ID NO: 602124 - DNA, 25 bp, Mus musculus
ggataaacagctagaaacccttcaa

SEQ ID NO: 602125 - DNA, 25 bp, Mus musculus
ggataaacagcttgaaacccttcaa

SEQ ID NO: 602126 - DNA, 25 bp, Mus musculus
ggataaaccctgaagacctctgagg

SEQ ID NO: 602127 - DNA, 25 bp, Mus musculus
ggataaaccctgtagacctctgagg

SEQ ID NO: 602128 - DNA, 25 bp, Mus musculus
ggataaaccgaaagcacttcgccaa

SEQ ID NO: 602129 - DNA, 25 bp, Mus musculus
ggataaaccgaatgcacttcgccaa

SEQ ID NO: 602130 - DNA, 25 bp, Mus musculus
ggataaaccgagagcctgttcagcc

SEQ ID NO: 602131 - DNA, 25 bp, Mus musculus
ggataaaccgagtgcctgttcagcc

SEQ ID NO: 602132 - DNA, 25 bp, Mus musculus
ggataaacgcttacagactgcaccc

SEQ ID NO: 602133 - DNA, 25 bp, Mus musculus
ggataaacgctttcagactgcaccc

SEQ ID NO: 602134 - DNA, 25 bp, Mus musculus
ggataaacggacaggcccagaagcc

SEQ ID NO: 602135 - DNA, 25 bp, Mus musculus
ggataaacggactggcccagaagcc

SEQ ID NO: 602136 - DNA, 25 bp, Mus musculus
ggataaactgagcaccaatacattt

SEQ ID NO: 602137 - DNA, 25 bp, Mus musculus
ggataaactgaggaccaatacattt

SEQ ID NO: 602138 - DNA, 25 bp, Mus musculus
ggataaactggactgcctgcatgac

SEQ ID NO: 602139 - DNA, 25 bp, Mus musculus
ggataaactggagtgcctgcatgac

SEQ ID NO: 602140 - DNA, 25 bp, Mus musculus
ggataaacttagcttcaagaacaca

SEQ ID NO: 602141 - DNA, 25 bp, Mus musculus
ggataaacttaggttcaagaacaca

SEQ ID NO: 602142 - DNA, 25 bp, Mus musculus
ggataaactttgcaccttcaagaag

SEQ ID NO: 602143 - DNA, 25 bp, Mus musculus
ggataaactttggaccttcaagaag

SEQ ID NO: 602144 - DNA, 25 bp, Mus musculus
ggataaagaccactgtgcctctctc

SEQ ID NO: 602145 - DNA, 25 bp, Mus musculus
ggataaagaccagtgtgcctctctc

SEQ ID NO: 602146 - DNA, 25 bp, Mus musculus
ggataaagagaacttgctcctgcaa

SEQ ID NO: 602147 - DNA, 25 bp, Mus musculus
ggataaagagaagttgctcctgcaa

SEQ ID NO: 602148 - DNA, 25 bp, Mus musculus
ggataaagatttccctcagtacaca

SEQ ID NO: 602149 - DNA, 25 bp, Mus musculus
ggataaagatttgcctcagtacaca

SEQ ID NO: 602150 - DNA, 25 bp, Mus musculus
ggataaagcactcgccatggacact

SEQ ID NO: 602151 - DNA, 25 bp, Mus musculus
ggataaagcactggccatggacact

SEQ ID NO: 602152 - DNA, 25 bp, Mus musculus
ggataaagccgactaatcattaata

SEQ ID NO: 602153 - DNA, 25 bp, Mus musculus
ggataaagccgagtaatcattaata

SEQ ID NO: 602154 - DNA, 25 bp, Mus musculus
ggataaagcctaagcaaccctgaag

SEQ ID NO: 602155 - DNA, 25 bp, Mus musculus
ggataaagcctatgcaaccctgaag

SEQ ID NO: 602156 - DNA, 25 bp, Mus musculus
ggataaagctggcagatctctgtgt

SEQ ID NO: 602157 - DNA, 25 bp, Mus musculus
ggataaagctgggagatctctgtgt

SEQ ID NO: 602158 - DNA, 25 bp, Mus musculus
ggataaagctgtatttctgtcacat

SEQ ID NO: 602159 - DNA, 25 bp, Mus musculus
ggataaagctgtttttctgtcacat

SEQ ID NO: 602160 - DNA, 25 bp, Mus musculus
ggataaagtaccatttcacagtatg

SEQ ID NO: 602161 - DNA, 25 bp, Mus musculus
ggataaagtaccttttcacagtatg

SEQ ID NO: 602162 - DNA, 25 bp, Mus musculus
ggataaataacgacctccctagtat

SEQ ID NO: 602163 - DNA, 25 bp, Mus musculus
ggataaataacgtcctccctagtat

SEQ ID NO: 602164 - DNA, 25 bp, Mus musculus
ggataaatacaaccgactctagcct

SEQ ID NO: 602165 - DNA, 25 bp, Mus musculus
ggataaatacaagcgactctagcct

SEQ ID NO: 602166 - DNA, 25 bp, Mus musculus
ggataaatagttctgcagatactca

SEQ ID NO: 602167 - DNA, 25 bp, Mus musculus
ggataaatagttgtgcagatactca

SEQ ID NO: 602168 - DNA, 25 bp, Mus musculus
ggataaatcactaacatgctcaatg

SEQ ID NO: 602169 - DNA, 25 bp, Mus musculus
ggataaatcacttacatgctcaatg

SEQ ID NO: 602170 - DNA, 25 bp, Mus musculus
ggataaatcattactacttacatta

SEQ ID NO: 602171 - DNA, 25 bp, Mus musculus
ggataaatcatttctacttacatta

SEQ ID NO: 602172 - DNA, 25 bp, Mus musculus
ggataaatccacagctggttccttg

SEQ ID NO: 602173 - DNA, 25 bp, Mus musculus
ggataaatccactgctggttccttg

SEQ ID NO: 602174 - DNA, 25 bp, Mus musculus
ggataaatctgtctggaccctacta

SEQ ID NO: 602175 - DNA, 25 bp, Mus musculus
ggataaatctgtgtggaccctacta

SEQ ID NO: 602176 - DNA, 25 bp, Mus musculus
ggataaatcttgctcctctactata

SEQ ID NO: 602177 - DNA, 25 bp, Mus musculus
ggataaatcttggtcctctactata

SEQ ID NO: 602178 - DNA, 25 bp, Mus musculus
ggataaatgctccttcccctagcgg

SEQ ID NO: 602179 - DNA, 25 bp, Mus musculus
ggataaatgctcgttcccctagcgg

SEQ ID NO: 602180 - DNA, 25 bp, Mus musculus
ggataaatgcttccttgtctagtta

SEQ ID NO: 602181 - DNA, 25 bp, Mus musculus
ggataaatgcttgcttgtctagtta

SEQ ID NO: 602182 - DNA, 25 bp, Mus musculus
ggataaatggacaacctgagctggc

SEQ ID NO: 602183 - DNA, 25 bp, Mus musculus
ggataaatggactacctgagctggc

SEQ ID NO: 602184 - DNA, 25 bp, Mus musculus
ggataaattggaactcacaacttca

SEQ ID NO: 602185 - DNA, 25 bp, Mus musculus
ggataaattggatctcacaacttca

SEQ ID NO: 602186 - DNA, 25 bp, Mus musculus
ggataacaaagcactgcctggcctt

SEQ ID NO: 602187 - DNA, 25 bp, Mus musculus
ggataacaaagctctgcctggcctt

SEQ ID NO: 602188 - DNA, 25 bp, Mus musculus
ggataacaagtgactctgattctct

SEQ ID NO: 602189 - DNA, 25 bp, Mus musculus
ggataacaagtgtctctgattctct

SEQ ID NO: 602190 - DNA, 25 bp, Mus musculus
ggataacacacacactattgtctga

SEQ ID NO: 602191 - DNA, 25 bp, Mus musculus
ggataacacacagactattgtctga

SEQ ID NO: 602192 - DNA, 25 bp, Mus musculus
ggataacagataacgcaggagtcag

SEQ ID NO: 602193 - DNA, 25 bp, Mus musculus
ggataacagatatcgcaggagtcag

SEQ ID NO: 602194 - DNA, 25 bp, Mus musculus
ggataacatcctagtgattctttct

SEQ ID NO: 602195 - DNA, 25 bp, Mus musculus
ggataacatccttgtgattctttct

SEQ ID NO: 602196 - DNA, 25 bp, Mus musculus
ggataaccaaagaacagaggcagac

SEQ ID NO: 602197 - DNA, 25 bp, Mus musculus
ggataaccaaagtacagaggcagac

SEQ ID NO: 602198 - DNA, 25 bp, Mus musculus
ggataaccctgacttgttacatagt

SEQ ID NO: 602199 - DNA, 25 bp, Mus musculus
ggataaccctgagttgttacatagt

SEQ ID NO: 602200 - DNA, 25 bp, Mus musculus
ggataaccctgtaatgataaccctt

SEQ ID NO: 602201 - DNA, 25 bp, Mus musculus
ggataaccctgttatgataaccctt

SEQ ID NO: 602202 - DNA, 25 bp, Mus musculus
ggataacctatccttacatacaagc

SEQ ID NO: 602203 - DNA, 25 bp, Mus musculus
ggataacctatcgttacatacaagc

SEQ ID NO: 602204 - DNA, 25 bp, Mus musculus
ggataacctgagaccctgggcatgg

SEQ ID NO: 602205 - DNA, 25 bp, Mus musculus
ggataacctgagtccctgggcatgg

SEQ ID NO: 602206 - DNA, 25 bp, Mus musculus
ggataacctgtcagatccatcctta

SEQ ID NO: 602207 - DNA, 25 bp, Mus musculus
ggataacctgtctgatccatcctta

SEQ ID NO: 602208 - DNA, 25 bp, Mus musculus
ggataaccttagaaccccactctga

SEQ ID NO: 602209 - DNA, 25 bp, Mus musculus
ggataaccttagtaccccactctga

SEQ ID NO: 602210 - DNA, 25 bp, Mus musculus
ggataaccttgaagtccagtactat

SEQ ID NO: 602211 - DNA, 25 bp, Mus musculus
ggataaccttgatgtccagtactat

SEQ ID NO: 602212 - DNA, 25 bp, Mus musculus
ggataacgacagagatggcatcaac

SEQ ID NO: 602213 - DNA, 25 bp, Mus musculus
ggataacgacagtgatggcatcaac

SEQ ID NO: 602214 - DNA, 25 bp, Mus musculus
ggataactaccacagggacatctct

SEQ ID NO: 602215 - DNA, 25 bp, Mus musculus
ggataactaccagagggacatctct

SEQ ID NO: 602216 - DNA, 25 bp, Mus musculus
ggataactatacatttggttgcata

SEQ ID NO: 602217 - DNA, 25 bp, Mus musculus
ggataactatacttttggttgcata

SEQ ID NO: 602218 - DNA, 25 bp, Mus musculus
ggataactcagcactcatgatcagc

SEQ ID NO: 602219 - DNA, 25 bp, Mus musculus
ggataactcagctctcatgatcagc

SEQ ID NO: 602220 - DNA, 25 bp, Mus musculus
ggataactcggacactccagcagga

SEQ ID NO: 602221 - DNA, 25 bp, Mus musculus
ggataactcggagactccagcagga

SEQ ID NO: 602222 - DNA, 25 bp, Mus musculus
ggataactctccaaaatagggacag

SEQ ID NO: 602223 - DNA, 25 bp, Mus musculus
ggataactctcctaaatagggacag

SEQ ID NO: 602224 - DNA, 25 bp, Mus musculus
ggataactgacacaaccttctacct

SEQ ID NO: 602225 - DNA, 25 bp, Mus musculus
ggataactgacagaaccttctacct

SEQ ID NO: 602226 - DNA, 25 bp, Mus musculus
ggataactgagcactctgcttttaa

SEQ ID NO: 602227 - DNA, 25 bp, Mus musculus
ggataactgagctctctgcttttaa

SEQ ID NO: 602228 - DNA, 25 bp, Mus musculus
ggataactgcaacaggtccgccctt

SEQ ID NO: 602229 - DNA, 25 bp, Mus musculus
ggataactgcaagaggtccgccctt

SEQ ID NO: 602230 - DNA, 25 bp, Mus musculus
ggataactgtccactgttcttctaa

SEQ ID NO: 602231 - DNA, 25 bp, Mus musculus
ggataactgtcctctgttcttctaa

SEQ ID NO: 602232 - DNA, 25 bp, Mus musculus
ggataactgtctacaaaagcatagc

SEQ ID NO: 602233 - DNA, 25 bp, Mus musculus
ggataactgtcttcaaaagcatagc

SEQ ID NO: 602234 - DNA, 25 bp, Mus musculus
ggataactgtggaaattctagagct

SEQ ID NO: 602235 - DNA, 25 bp, Mus musculus
ggataactgtggtaattctagagct

SEQ ID NO: 602236 - DNA, 25 bp, Mus musculus
ggataacttgtccattccttcttcc

SEQ ID NO: 602237 - DNA, 25 bp, Mus musculus
ggataacttgtcgattccttcttcc

SEQ ID NO: 602238 - DNA, 25 bp, Mus musculus
ggataactttgactcaccctatgat

SEQ ID NO: 602239 - DNA, 25 bp, Mus musculus
ggataactttgagtcaccctatgat

SEQ ID NO: 602240 - DNA, 25 bp, Mus musculus
ggataagaaaccatccctgtttgag

SEQ ID NO: 602241 - DNA, 25 bp, Mus musculus
ggataagaaaccttccctgtttgag

SEQ ID NO: 602242 - DNA, 25 bp, Mus musculus
ggataagaacatcggcgctcgcaga

SEQ ID NO: 602243 - DNA, 25 bp, Mus musculus
ggataagaacatgggcgctcgcaga

SEQ ID NO: 602244 - DNA, 25 bp, Mus musculus
ggataagaacctctctgtgcactgg

SEQ ID NO: 602245 - DNA, 25 bp, Mus musculus
ggataagaacctgtctgtgcactgg

SEQ ID NO: 602246 - DNA, 25 bp, Mus musculus
ggataagaccttcctgaacagcctc

SEQ ID NO: 602247 - DNA, 25 bp, Mus musculus
ggataagaccttgctgaacagcctc

SEQ ID NO: 602248 - DNA, 25 bp, Mus musculus
ggataagagcccacagcatcgggct

SEQ ID NO: 602249 - DNA, 25 bp, Mus musculus
ggataagagccctcagcatcgggct

SEQ ID NO: 602250 - DNA, 25 bp, Mus musculus
ggataagagcgacccacactgtcct

SEQ ID NO: 602251 - DNA, 25 bp, Mus musculus
ggataagagcgagccacactgtcct

SEQ ID NO: 602252 - DNA, 25 bp, Mus musculus
ggataagatcaaagccctcattaaa

SEQ ID NO: 602253 - DNA, 25 bp, Mus musculus
ggataagatcaatgccctcattaaa

SEQ ID NO: 602254 - DNA, 25 bp, Mus musculus
ggataagatgacagcaggcccacct

SEQ ID NO: 602255 - DNA, 25 bp, Mus musculus
ggataagatgactgcaggcccacct

SEQ ID NO: 602256 - DNA, 25 bp, Mus musculus
ggataagcacatcaccttgaaggaa

SEQ ID NO: 602257 - DNA, 25 bp, Mus musculus
ggataagcacatgaccttgaaggaa

SEQ ID NO: 602258 - DNA, 25 bp, Mus musculus
ggataagcaccaccttaggctgtaa

SEQ ID NO: 602259 - DNA, 25 bp, Mus musculus
ggataagcaccagcttaggctgtaa

SEQ ID NO: 602260 - DNA, 25 bp, Mus musculus
ggataagcagcaaaactcagtggaa

SEQ ID NO: 602261 - DNA, 25 bp, Mus musculus
ggataagcagcataactcagtggaa

SEQ ID NO: 602262 - DNA, 25 bp, Mus musculus
ggataagcaggaaggtgagtttcta

SEQ ID NO: 602263 - DNA, 25 bp, Mus musculus
ggataagcaggatggtgagtttcta

SEQ ID NO: 602264 - DNA, 25 bp, Mus musculus
ggataagcatgccatttgttagaaa

SEQ ID NO: 602265 - DNA, 25 bp, Mus musculus
ggataagcatgcgatttgttagaaa

SEQ ID NO: 602266 - DNA, 25 bp, Mus musculus
ggataagccagacggatatgccatc

SEQ ID NO: 602267 - DNA, 25 bp, Mus musculus
ggataagccagagggatatgccatc

SEQ ID NO: 602268 - DNA, 25 bp, Mus musculus
ggataagcccagcacacagagttgt

SEQ ID NO: 602269 - DNA, 25 bp, Mus musculus
ggataagcccaggacacagagttgt

SEQ ID NO: 602270 - DNA, 25 bp, Mus musculus
ggataagcctccaaatgattgttaa

SEQ ID NO: 602271 - DNA, 25 bp, Mus musculus
ggataagcctcctaatgattgttaa

SEQ ID NO: 602272 - DNA, 25 bp, Mus musculus
ggataagcttcgcagtccctatggc

SEQ ID NO: 602273 - DNA, 25 bp, Mus musculus
ggataagcttcggagtccctatggc

SEQ ID NO: 602274 - DNA, 25 bp, Mus musculus
ggataaggcaaactgtgtttccagc

SEQ ID NO: 602275 - DNA, 25 bp, Mus musculus
ggataaggcaaagtgtgtttccagc

SEQ ID NO: 602276 - DNA, 25 bp, Mus musculus
ggataagtacgcagcttgccgtggc

SEQ ID NO: 602277 - DNA, 25 bp, Mus musculus
ggataagtacgctgcttgccgtggc

SEQ ID NO: 602278 - DNA, 25 bp, Mus musculus
ggataagtccagatattcataaagt

SEQ ID NO: 602279 - DNA, 25 bp, Mus musculus
ggataagtccagttattcataaagt

SEQ ID NO: 602280 - DNA, 25 bp, Mus musculus
ggataataaagacatttgccccaaa

SEQ ID NO: 602281 - DNA, 25 bp, Mus musculus
ggataataaagagatttgccccaaa

SEQ ID NO: 602282 - DNA, 25 bp, Mus musculus
ggataataatttctgcctgggtacc

SEQ ID NO: 602283 - DNA, 25 bp, Mus musculus
ggataataatttgtgcctgggtacc

SEQ ID NO: 602284 - DNA, 25 bp, Mus musculus
ggataatacactcgtctctccagaa

SEQ ID NO: 602285 - DNA, 25 bp, Mus musculus
ggataatacactggtctctccagaa

SEQ ID NO: 602286 - DNA, 25 bp, Mus musculus
ggataatacagtcgcccttggcctg

SEQ ID NO: 602287 - DNA, 25 bp, Mus musculus
ggataatacagtggcccttggcctg

SEQ ID NO: 602288 - DNA, 25 bp, Mus musculus
ggataatatggtcacttctttcaac

SEQ ID NO: 602289 - DNA, 25 bp, Mus musculus
ggataatatggtgacttctttcaac

SEQ ID NO: 602290 - DNA, 25 bp, Mus musculus
ggataatcacctccatcctctgcaa

SEQ ID NO: 602291 - DNA, 25 bp, Mus musculus
ggataatcacctgcatcctctgcaa

SEQ ID NO: 602292 - DNA, 25 bp, Mus musculus
ggataatcaggcaccaattgcactt

SEQ ID NO: 602293 - DNA, 25 bp, Mus musculus
ggataatcaggctccaattgcactt

SEQ ID NO: 602294 - DNA, 25 bp, Mus musculus
ggataatccattactataacctgtt

SEQ ID NO: 602295 - DNA, 25 bp, Mus musculus
ggataatccatttctataacctgtt

SEQ ID NO: 602296 - DNA, 25 bp, Mus musculus
ggataatccgtacatgttcccagaa

SEQ ID NO: 602297 - DNA, 25 bp, Mus musculus
ggataatccgtagatgttcccagaa

SEQ ID NO: 602298 - DNA, 25 bp, Mus musculus
ggataatcctcactggttccatcaa

SEQ ID NO: 602299 - DNA, 25 bp, Mus musculus
ggataatcctcagtggttccatcaa

SEQ ID NO: 602300 - DNA, 25 bp, Mus musculus
ggataatctactcaggtggcctttt

SEQ ID NO: 602301 - DNA, 25 bp, Mus musculus
ggataatctactgaggtggcctttt

SEQ ID NO: 602302 - DNA, 25 bp, Mus musculus
ggataatctatcaggagggcccctc

SEQ ID NO: 602303 - DNA, 25 bp, Mus musculus
ggataatctatctggagggcccctc

SEQ ID NO: 602304 - DNA, 25 bp, Mus musculus
ggataatgactgaacttgcaccttc

SEQ ID NO: 602305 - DNA, 25 bp, Mus musculus
ggataatgactgtacttgcaccttc

SEQ ID NO: 602306 - DNA, 25 bp, Mus musculus
ggataatgatgaagtttcttttgcc

SEQ ID NO: 602307 - DNA, 25 bp, Mus musculus
ggataatgatgatgtttcttttgcc

SEQ ID NO: 602308 - DNA, 25 bp, Mus musculus
ggataatgccgacaaacgcctaatt

SEQ ID NO: 602309 - DNA, 25 bp, Mus musculus
ggataatgccgagaaacgcctaatt

SEQ ID NO: 602310 - DNA, 25 bp, Mus musculus
ggataatgcttgctgtcttggaaga

SEQ ID NO: 602311 - DNA, 25 bp, Mus musculus
ggataatgcttggtgtcttggaaga

SEQ ID NO: 602312 - DNA, 25 bp, Mus musculus
ggataatggacgcacatgccctcac

SEQ ID NO: 602313 - DNA, 25 bp, Mus musculus
ggataatggacggacatgccctcac

SEQ ID NO: 602314 - DNA, 25 bp, Mus musculus
ggataatggactcaccctagcctag

SEQ ID NO: 602315 - DNA, 25 bp, Mus musculus
ggataatggactgaccctagcctag

SEQ ID NO: 602316 - DNA, 25 bp, Mus musculus
ggataatgttgaactgcccaatcta

SEQ ID NO: 602317 - DNA, 25 bp, Mus musculus
ggataatgttgatctgcccaatcta

SEQ ID NO: 602318 - DNA, 25 bp, Mus musculus
ggataattatctatatacacttcta

SEQ ID NO: 602319 - DNA, 25 bp, Mus musculus
ggataattatctttatacacttcta

SEQ ID NO: 602320 - DNA, 25 bp, Mus musculus
ggataattccaccttgaaccagccc

SEQ ID NO: 602321 - DNA, 25 bp, Mus musculus
ggataattccacgttgaaccagccc

SEQ ID NO: 602322 - DNA, 25 bp, Mus musculus
ggataattccatagttgatcttgtc

SEQ ID NO: 602323 - DNA, 25 bp, Mus musculus
ggataattccattgttgatcttgtc

SEQ ID NO: 602324 - DNA, 25 bp, Mus musculus
ggataattccttacacagtgtttgc

SEQ ID NO: 602325 - DNA, 25 bp, Mus musculus
ggataattcctttcacagtgtttgc

SEQ ID NO: 602326 - DNA, 25 bp, Mus musculus
ggataattcttgctcttctccaaag

SEQ ID NO: 602327 - DNA, 25 bp, Mus musculus
ggataattcttggtcttctccaaag

SEQ ID NO: 602328 - DNA, 25 bp, Mus musculus
ggataattgctactgagcctttctt

SEQ ID NO: 602329 - DNA, 25 bp, Mus musculus
ggataattgctagtgagcctttctt

SEQ ID NO: 602330 - DNA, 25 bp, Mus musculus
ggataattgggaatacaactccttg

SEQ ID NO: 602331 - DNA, 25 bp, Mus musculus
ggataattgggattacaactccttg

SEQ ID NO: 602332 - DNA, 25 bp, Mus musculus
ggataatttctaagaaatcgcgctt

SEQ ID NO: 602333 - DNA, 25 bp, Mus musculus
ggataatttctatgaaatcgcgctt

SEQ ID NO: 602334 - DNA, 25 bp, Mus musculus
ggataatttctgaaaccccatcgtt

SEQ ID NO: 602335 - DNA, 25 bp, Mus musculus
ggataatttctgtaaccccatcgtt

SEQ ID NO: 602336 - DNA, 25 bp, Mus musculus
ggataattttctagactgacttggt

SEQ ID NO: 602337 - DNA, 25 bp, Mus musculus
ggataattttcttgactgacttggt

SEQ ID NO: 602338 - DNA, 25 bp, Mus musculus
ggatacaaacttcccgatttatttg

SEQ ID NO: 602339 - DNA, 25 bp, Mus musculus
ggatacaaacttgccgatttatttg

SEQ ID NO: 602340 - DNA, 25 bp, Mus musculus
ggatacaacagcaggacgcatcaaa

SEQ ID NO: 602341 - DNA, 25 bp, Mus musculus
ggatacaacagctggacgcatcaaa

SEQ ID NO: 602342 - DNA, 25 bp, Mus musculus
ggatacaagccccacaatgcagctg

SEQ ID NO: 602343 - DNA, 25 bp, Mus musculus
ggatacaagcccgacaatgcagctg

SEQ ID NO: 602344 - DNA, 25 bp, Mus musculus
ggatacaatataattttctactgga

SEQ ID NO: 602345 - DNA, 25 bp, Mus musculus
ggatacaatatatttttctactgga

SEQ ID NO: 602346 - DNA, 25 bp, Mus musculus
ggatacacaactcaggagtcaggct

SEQ ID NO: 602347 - DNA, 25 bp, Mus musculus
ggatacacaactgaggagtcaggct

SEQ ID NO: 602348 - DNA, 25 bp, Mus musculus
ggatacacaatactgacctggtttg

SEQ ID NO: 602349 - DNA, 25 bp, Mus musculus
ggatacacaatagtgacctggtttg

SEQ ID NO: 602350 - DNA, 25 bp, Mus musculus
ggatacacaggcactcagtgatacc

SEQ ID NO: 602351 - DNA, 25 bp, Mus musculus
ggatacacaggctctcagtgatacc

SEQ ID NO: 602352 - DNA, 25 bp, Mus musculus
ggatacacatctaactctgggctaa

SEQ ID NO: 602353 - DNA, 25 bp, Mus musculus
ggatacacatcttactctgggctaa

SEQ ID NO: 602354 - DNA, 25 bp, Mus musculus
ggatacacattcactagctatgtta

SEQ ID NO: 602355 - DNA, 25 bp, Mus musculus
ggatacacattctctagctatgtta

SEQ ID NO: 602356 - DNA, 25 bp, Mus musculus
ggatacaccatcacttacaattttt

SEQ ID NO: 602357 - DNA, 25 bp, Mus musculus
ggatacaccatctcttacaattttt

SEQ ID NO: 602358 - DNA, 25 bp, Mus musculus
ggatacacccggaattggtaacatt

SEQ ID NO: 602359 - DNA, 25 bp, Mus musculus
ggatacacccggtattggtaacatt

SEQ ID NO: 602360 - DNA, 25 bp, Mus musculus
ggatacacctacaagacccagatgt

SEQ ID NO: 602361 - DNA, 25 bp, Mus musculus
ggatacacctactagacccagatgt

SEQ ID NO: 602362 - DNA, 25 bp, Mus musculus
ggatacacctatctatacctctgtt

SEQ ID NO: 602363 - DNA, 25 bp, Mus musculus
ggatacacctatgtatacctctgtt

SEQ ID NO: 602364 - DNA, 25 bp, Mus musculus
ggatacacctcccagatgaaactat

SEQ ID NO: 602365 - DNA, 25 bp, Mus musculus
ggatacacctccgagatgaaactat

SEQ ID NO: 602366 - DNA, 25 bp, Mus musculus
ggatacactcgactctgtttattga

SEQ ID NO: 602367 - DNA, 25 bp, Mus musculus
ggatacactcgagtctgtttattga

SEQ ID NO: 602368 - DNA, 25 bp, Mus musculus
ggatacactgcacagaacattttac

SEQ ID NO: 602369 - DNA, 25 bp, Mus musculus
ggatacactgcagagaacattttac

SEQ ID NO: 602370 - DNA, 25 bp, Mus musculus
ggatacacttagatccatcattaaa

SEQ ID NO: 602371 - DNA, 25 bp, Mus musculus
ggatacacttagttccatcattaaa

SEQ ID NO: 602372 - DNA, 25 bp, Mus musculus
ggatacacttggcatgatacttgct

SEQ ID NO: 602373 - DNA, 25 bp, Mus musculus
ggatacacttgggatgatacttgct

SEQ ID NO: 602374 - DNA, 25 bp, Mus musculus
ggatacactttgagtgctttaatgt

SEQ ID NO: 602375 - DNA, 25 bp, Mus musculus
ggatacactttgtgtgctttaatgt

SEQ ID NO: 602376 - DNA, 25 bp, Mus musculus
ggatacagaactatcacgactctaa

SEQ ID NO: 602377 - DNA, 25 bp, Mus musculus
ggatacagaactttcacgactctaa

SEQ ID NO: 602378 - DNA, 25 bp, Mus musculus
ggatacagaagcacgcttgcctctg

SEQ ID NO: 602379 - DNA, 25 bp, Mus musculus
ggatacagaagctcgcttgcctctg

SEQ ID NO: 602380 - DNA, 25 bp, Mus musculus
ggatacagagatcccctaaggccct

SEQ ID NO: 602381 - DNA, 25 bp, Mus musculus
ggatacagagatgccctaaggccct

SEQ ID NO: 602382 - DNA, 25 bp, Mus musculus
ggatacagatgtactgccacctgaa

SEQ ID NO: 602383 - DNA, 25 bp, Mus musculus
ggatacagatgttctgccacctgaa

SEQ ID NO: 602384 - DNA, 25 bp, Mus musculus
ggatacagcaagctggtactccact

SEQ ID NO: 602385 - DNA, 25 bp, Mus musculus
ggatacagcaaggtggtactccact

SEQ ID NO: 602386 - DNA, 25 bp, Mus musculus
ggatacagccgaactactggcagcc

SEQ ID NO: 602387 - DNA, 25 bp, Mus musculus
ggatacagccgatctactggcagcc

SEQ ID NO: 602388 - DNA, 25 bp, Mus musculus
ggatacaggcatattgtggacataa

SEQ ID NO: 602389 - DNA, 25 bp, Mus musculus
ggatacaggcattttgtggacataa

SEQ ID NO: 602390 - DNA, 25 bp, Mus musculus
ggatacagtccgacaacaagaaatg

SEQ ID NO: 602391 - DNA, 25 bp, Mus musculus
ggatacagtccgtcaacaagaaatg

SEQ ID NO: 602392 - DNA, 25 bp, Mus musculus
ggatacagtttgagtccagtatata

SEQ ID NO: 602393 - DNA, 25 bp, Mus musculus
ggatacagtttgtgtccagtatata

SEQ ID NO: 602394 - DNA, 25 bp, Mus musculus
ggatacataatgctattctcagtgg

SEQ ID NO: 602395 - DNA, 25 bp, Mus musculus
ggatacataatggtattctcagtgg

SEQ ID NO: 602396 - DNA, 25 bp, Mus musculus
ggatacatagtgacactgtgtcccc

SEQ ID NO: 602397 - DNA, 25 bp, Mus musculus
ggatacatagtgtcactgtgtcccc

SEQ ID NO: 602398 - DNA, 25 bp, Mus musculus
ggatacatcaagcaccccaaggtct

SEQ ID NO: 602399 - DNA, 25 bp, Mus musculus
ggatacatcaaggaccccaaggtct

SEQ ID NO: 602400 - DNA, 25 bp, Mus musculus
ggatacatcaataacctcagaggat

SEQ ID NO: 602401 - DNA, 25 bp, Mus musculus
ggatacatcaattacctcagaggat

SEQ ID NO: 602402 - DNA, 25 bp, Mus musculus
ggatacatcattctctgaccttaag

SEQ ID NO: 602403 - DNA, 25 bp, Mus musculus
ggatacatcattgtctgaccttaag

SEQ ID NO: 602404 - DNA, 25 bp, Mus musculus
ggatacatctatatccttctgatac

SEQ ID NO: 602405 - DNA, 25 bp, Mus musculus
ggatacatctatttccttctgatac

SEQ ID NO: 602406 - DNA, 25 bp, Mus musculus
ggatacatgaacacactgagcccag

SEQ ID NO: 602407 - DNA, 25 bp, Mus musculus
ggatacatgaactcactgagcccag

SEQ ID NO: 602408 - DNA, 25 bp, Mus musculus
ggatacatgatacccagatactgca

SEQ ID NO: 602409 - DNA, 25 bp, Mus musculus
ggatacatgatagccagatactgca

SEQ ID NO: 602410 - DNA, 25 bp, Mus musculus
ggatacatgatccacaatcagttta

SEQ ID NO: 602411 - DNA, 25 bp, Mus musculus
ggatacatgatcgacaatcagttta

SEQ ID NO: 602412 - DNA, 25 bp, Mus musculus
ggatacatgctaacggcatctcatc

SEQ ID NO: 602413 - DNA, 25 bp, Mus musculus
ggatacatgctatcggcatctcatc

SEQ ID NO: 602414 - DNA, 25 bp, Mus musculus
ggatacatggtcacaacccttcggt

SEQ ID NO: 602415 - DNA, 25 bp, Mus musculus
ggatacatggtctcaacccttcggt

SEQ ID NO: 602416 - DNA, 25 bp, Mus musculus
ggatacatgtagctttgccagatat

SEQ ID NO: 602417 - DNA, 25 bp, Mus musculus
ggatacatgtaggtttgccagatat

SEQ ID NO: 602418 - DNA, 25 bp, Mus musculus
ggatacatgtcgctagcctggaaat

SEQ ID NO: 602419 - DNA, 25 bp, Mus musculus
ggatacatgtcggtagcctggaaat

SEQ ID NO: 602420 - DNA, 25 bp, Mus musculus
ggatacatgtggagccaatgccaag

SEQ ID NO: 602421 - DNA, 25 bp, Mus musculus
ggatacatgtggtgccaatgccaag

SEQ ID NO: 602422 - DNA, 25 bp, Mus musculus
ggatacattaagctgcaaatcttct

SEQ ID NO: 602423 - DNA, 25 bp, Mus musculus
ggatacattaagctgcaagctctct

SEQ ID NO: 602424 - DNA, 25 bp, Mus musculus
ggatacattaaggtgcaaatcttct

SEQ ID NO: 602425 - DNA, 25 bp, Mus musculus
ggatacattaaggtgcaagctctct

SEQ ID NO: 602426 - DNA, 25 bp, Mus musculus
ggatacattactaccagttgaggac

SEQ ID NO: 602427 - DNA, 25 bp, Mus musculus
ggatacattacttccagttgaggac

SEQ ID NO: 602428 - DNA, 25 bp, Mus musculus
ggatacatttcgatcccaaatacat

SEQ ID NO: 602429 - DNA, 25 bp, Mus musculus
ggatacatttcgttcccaaatacat

SEQ ID NO: 602430 - DNA, 25 bp, Mus musculus
ggataccaagccagacagtcactgt

SEQ ID NO: 602431 - DNA, 25 bp, Mus musculus
ggataccaagcctgacagtcactgt

SEQ ID NO: 602432 - DNA, 25 bp, Mus musculus
ggataccaagggatcgtgttctgga

SEQ ID NO: 602433 - DNA, 25 bp, Mus musculus
ggataccaagggttcgtgttctgga

SEQ ID NO: 602434 - DNA, 25 bp, Mus musculus
ggataccaatgtcaccaaaacgaag

SEQ ID NO: 602435 - DNA, 25 bp, Mus musculus
ggataccaatgtgaccaaaacgaag

SEQ ID NO: 602436 - DNA, 25 bp, Mus musculus
ggataccacaaccaacagggattgc

SEQ ID NO: 602437 - DNA, 25 bp, Mus musculus
ggataccacaacgaacagggattgc

SEQ ID NO: 602438 - DNA, 25 bp, Mus musculus
ggataccacttaagtcccaaacctg

SEQ ID NO: 602439 - DNA, 25 bp, Mus musculus
ggataccacttatgtcccaaacctg

SEQ ID NO: 602440 - DNA, 25 bp, Mus musculus
ggataccatctacgtccatgagaag

SEQ ID NO: 602441 - DNA, 25 bp, Mus musculus
ggataccatctaggtccatgagaag

SEQ ID NO: 602442 - DNA, 25 bp, Mus musculus
ggatacccaaccatagttagacaag

SEQ ID NO: 602443 - DNA, 25 bp, Mus musculus
ggatacccaaccttagttagacaag

SEQ ID NO: 602444 - DNA, 25 bp, Mus musculus
ggatacccaatgcaaattacttact

SEQ ID NO: 602445 - DNA, 25 bp, Mus musculus
ggatacccaatggaaattacttact

SEQ ID NO: 602446 - DNA, 25 bp, Mus musculus
ggatacccacgtaactggacatttg

SEQ ID NO: 602447 - DNA, 25 bp, Mus musculus
ggatacccacgttactggacatttg

SEQ ID NO: 602448 - DNA, 25 bp, Mus musculus
ggatacccatgcagcattaaggctt

SEQ ID NO: 602449 - DNA, 25 bp, Mus musculus
ggatacccatgctgcattaaggctt

SEQ ID NO: 602450 - DNA, 25 bp, Mus musculus
ggataccccagtactcttggatgat

SEQ ID NO: 602451 - DNA, 25 bp, Mus musculus
ggataccccagttctcttggatgat

SEQ ID NO: 602452 - DNA, 25 bp, Mus musculus
ggatacccgaatccctcagtaaaag

SEQ ID NO: 602453 - DNA, 25 bp, Mus musculus
ggatacccgaatgcctcagtaaaag

SEQ ID NO: 602454 - DNA, 25 bp, Mus musculus
ggatacccggttctggacatggata

SEQ ID NO: 602455 - DNA, 25 bp, Mus musculus
ggatacccggttgtggacatggata

SEQ ID NO: 602456 - DNA, 25 bp, Mus musculus
ggatacccgtgtctgaacactcgta

SEQ ID NO: 602457 - DNA, 25 bp, Mus musculus
ggatacccgtgtgtgaacactcgta

SEQ ID NO: 602458 - DNA, 25 bp, Mus musculus
ggataccctcttctttaggactaga

SEQ ID NO: 602459 - DNA, 25 bp, Mus musculus
ggataccctcttgtttaggactaga

SEQ ID NO: 602460 - DNA, 25 bp, Mus musculus
ggataccgagttctaagccaagttt

SEQ ID NO: 602461 - DNA, 25 bp, Mus musculus
ggataccgagttgtaagccaagttt

SEQ ID NO: 602462 - DNA, 25 bp, Mus musculus
ggataccgatttagtacttcctcaa

SEQ ID NO: 602463 - DNA, 25 bp, Mus musculus
ggataccgattttgtacttcctcaa

SEQ ID NO: 602464 - DNA, 25 bp, Mus musculus
ggataccgttcacgttttagatcag

SEQ ID NO: 602465 - DNA, 25 bp, Mus musculus
ggataccgttcaggttttagatcag

SEQ ID NO: 602466 - DNA, 25 bp, Mus musculus
ggatacctaattagtccgtgacatt

SEQ ID NO: 602467 - DNA, 25 bp, Mus musculus
ggatacctaatttgtccgtgacatt

SEQ ID NO: 602468 - DNA, 25 bp, Mus musculus
ggatacctagttctgatcactattt

SEQ ID NO: 602469 - DNA, 25 bp, Mus musculus
ggatacctagttgtgatcactattt

SEQ ID NO: 602470 - DNA, 25 bp, Mus musculus
ggatacctatctccagatctcagta

SEQ ID NO: 602471 - DNA, 25 bp, Mus musculus
ggatacctatctgcagatctcagta

SEQ ID NO: 602472 - DNA, 25 bp, Mus musculus
ggatacctcattcctactagaaact

SEQ ID NO: 602473 - DNA, 25 bp, Mus musculus
ggatacctcattgctactagaaact

SEQ ID NO: 602474 - DNA, 25 bp, Mus musculus
ggatacctgaagaacccctgaagct

SEQ ID NO: 602475 - DNA, 25 bp, Mus musculus
ggatacctgaagtacccctgaagct

SEQ ID NO: 602476 - DNA, 25 bp, Mus musculus
ggatacctgaggacctgagactgca

SEQ ID NO: 602477 - DNA, 25 bp, Mus musculus
ggatacctgaggtcctgagactgca

SEQ ID NO: 602478 - DNA, 25 bp, Mus musculus
ggatacctggagcagtttttactgt

SEQ ID NO: 602479 - DNA, 25 bp, Mus musculus
ggatacctggaggagtttttactgt

SEQ ID NO: 602480 - DNA, 25 bp, Mus musculus
ggataccttactcaagaacttcctg

SEQ ID NO: 602481 - DNA, 25 bp, Mus musculus
ggataccttactgaagaacttcctg

SEQ ID NO: 602482 - DNA, 25 bp, Mus musculus
ggataccttggaacactggctagac

SEQ ID NO: 602483 - DNA, 25 bp, Mus musculus
ggataccttggatcactggctagac

SEQ ID NO: 602484 - DNA, 25 bp, Mus musculus
ggatacgaaagtcccagcactccgt

SEQ ID NO: 602485 - DNA, 25 bp, Mus musculus
ggatacgaaagtgccagcactccgt

SEQ ID NO: 602486 - DNA, 25 bp, Mus musculus
ggatacgaaatcaacccagcttgca

SEQ ID NO: 602487 - DNA, 25 bp, Mus musculus
ggatacgaaatctacccagcttgca

SEQ ID NO: 602488 - DNA, 25 bp, Mus musculus
ggatacgaagcacaacttgaccact

SEQ ID NO: 602489 - DNA, 25 bp, Mus musculus
ggatacgaagcagaacttgaccact

SEQ ID NO: 602490 - DNA, 25 bp, Mus musculus
ggatacgagaccatttatatgaaca

SEQ ID NO: 602491 - DNA, 25 bp, Mus musculus
ggatacgagaccttttatatgaaca

SEQ ID NO: 602492 - DNA, 25 bp, Mus musculus
ggatacgaggaaattctgccaagat

SEQ ID NO: 602493 - DNA, 25 bp, Mus musculus
ggatacgaggaatttctgccaagat

SEQ ID NO: 602494 - DNA, 25 bp, Mus musculus
ggatacgatccactgtgccaagaaa

SEQ ID NO: 602495 - DNA, 25 bp, Mus musculus
ggatacgatccagtgtgccaagaaa

SEQ ID NO: 602496 - DNA, 25 bp, Mus musculus
ggatacgatcttcccttctacaaaa

SEQ ID NO: 602497 - DNA, 25 bp, Mus musculus
ggatacgatcttgccttctacaaaa

SEQ ID NO: 602498 - DNA, 25 bp, Mus musculus
ggatacgccattcatttctcctttt

SEQ ID NO: 602499 - DNA, 25 bp, Mus musculus
ggatacgccattgatttctcctttt

SEQ ID NO: 602500 - DNA, 25 bp, Mus musculus
ggatacgcccctaatttctgtacta

SEQ ID NO: 602501 - DNA, 25 bp, Mus musculus
ggatacgccccttatttctgtacta

SEQ ID NO: 602502 - DNA, 25 bp, Mus musculus
ggatacgtatttcgtggttgcttaa

SEQ ID NO: 602503 - DNA, 25 bp, Mus musculus
ggatacgtatttggtggttgcttaa

SEQ ID NO: 602504 - DNA, 25 bp, Mus musculus
ggatacgtcacaaaatttcaagtca

SEQ ID NO: 602505 - DNA, 25 bp, Mus musculus
ggatacgtcacataatttcaagtca

SEQ ID NO: 602506 - DNA, 25 bp, Mus musculus
ggatacgtgataatgaagtgaccat

SEQ ID NO: 602507 - DNA, 25 bp, Mus musculus
ggatacgtgatattgaagtgaccat

SEQ ID NO: 602508 - DNA, 25 bp, Mus musculus
ggatacgtggttacatagttaggaa

SEQ ID NO: 602509 - DNA, 25 bp, Mus musculus
ggatacgtggtttcatagttaggaa

SEQ ID NO: 602510 - DNA, 25 bp, Mus musculus
ggatacgtttttcccatagaatttg

SEQ ID NO: 602511 - DNA, 25 bp, Mus musculus
ggatacgtttttgccatagaatttg

SEQ ID NO: 602512 - DNA, 25 bp, Mus musculus
ggatactaacatacctgaaaaagca

SEQ ID NO: 602513 - DNA, 25 bp, Mus musculus
ggatactaacattcctgaaaaagca

SEQ ID NO: 602514 - DNA, 25 bp, Mus musculus
ggatactaaccacatgtacaaatac

SEQ ID NO: 602515 - DNA, 25 bp, Mus musculus
ggatactaaccagatgtacaaatac

SEQ ID NO: 602516 - DNA, 25 bp, Mus musculus
ggatactaatctacccattttattt

SEQ ID NO: 602517 - DNA, 25 bp, Mus musculus
ggatactaatcttcccattttattt

SEQ ID NO: 602518 - DNA, 25 bp, Mus musculus
ggatactacatcattaaacagcgtt

SEQ ID NO: 602519 - DNA, 25 bp, Mus musculus
ggatactacatctttaaacagcgtt

SEQ ID NO: 602520 - DNA, 25 bp, Mus musculus
ggatactactctagttgcatccctc

SEQ ID NO: 602521 - DNA, 25 bp, Mus musculus
ggatactactcttgttgcatccctc

SEQ ID NO: 602522 - DNA, 25 bp, Mus musculus
ggatactatcaacacaaccttacag

SEQ ID NO: 602523 - DNA, 25 bp, Mus musculus
ggatactatcaagacaaccttacag

SEQ ID NO: 602524 - DNA, 25 bp, Mus musculus
ggatactatgatattaccccgaaga

SEQ ID NO: 602525 - DNA, 25 bp, Mus musculus
ggatactatgattttaccccgaaga

SEQ ID NO: 602526 - DNA, 25 bp, Mus musculus
ggatactatggtaacattgcccagc

SEQ ID NO: 602527 - DNA, 25 bp, Mus musculus
ggatactatggttacattgcccagc

SEQ ID NO: 602528 - DNA, 25 bp, Mus musculus
ggatactatgtacctcccataactg

SEQ ID NO: 602529 - DNA, 25 bp, Mus musculus
ggatactatgtagctcccataactg

SEQ ID NO: 602530 - DNA, 25 bp, Mus musculus
ggatactcaaataacgtgttccctg

SEQ ID NO: 602531 - DNA, 25 bp, Mus musculus
ggatactcaaattacgtgttccctg

SEQ ID NO: 602532 - DNA, 25 bp, Mus musculus
ggatactcagacatacttctgcaga

SEQ ID NO: 602533 - DNA, 25 bp, Mus musculus
ggatactcagacttacttctgcaga

SEQ ID NO: 602534 - DNA, 25 bp, Mus musculus
ggatactcatttatgattttagaaa

SEQ ID NO: 602535 - DNA, 25 bp, Mus musculus
ggatactcatttttgattttagaaa

SEQ ID NO: 602536 - DNA, 25 bp, Mus musculus
ggatactccagaaacacctgagcaa

SEQ ID NO: 602537 - DNA, 25 bp, Mus musculus
ggatactccagatacacctgagcaa

SEQ ID NO: 602538 - DNA, 25 bp, Mus musculus
ggatactcttacatgtgattatgac

SEQ ID NO: 602539 - DNA, 25 bp, Mus musculus
ggatactcttacttgtgattatgac

SEQ ID NO: 602540 - DNA, 25 bp, Mus musculus
ggatactcttgtacctgtggttcat

SEQ ID NO: 602541 - DNA, 25 bp, Mus musculus
ggatactcttgttcctgtggttcat

SEQ ID NO: 602542 - DNA, 25 bp, Mus musculus
ggatactgaaagcaatacctctcgt

SEQ ID NO: 602543 - DNA, 25 bp, Mus musculus
ggatactgaaaggaatacctctcgt

SEQ ID NO: 602544 - DNA, 25 bp, Mus musculus
ggatactgaagcaccttaatatgac

SEQ ID NO: 602545 - DNA, 25 bp, Mus musculus
ggatactgaagctccttaatatgac

SEQ ID NO: 602546 - DNA, 25 bp, Mus musculus
ggatactgagttctttacacttttg

SEQ ID NO: 602547 - DNA, 25 bp, Mus musculus
ggatactgagttgtttacacttttg

SEQ ID NO: 602548 - DNA, 25 bp, Mus musculus
ggatactgatcgagtcatcccttct

SEQ ID NO: 602549 - DNA, 25 bp, Mus musculus
ggatactgatcgtgtcatcccttct

SEQ ID NO: 602550 - DNA, 25 bp, Mus musculus
ggatactgccctattgccaaatgac

SEQ ID NO: 602551 - DNA, 25 bp, Mus musculus
ggatactgcccttttgccaaatgac

SEQ ID NO: 602552 - DNA, 25 bp, Mus musculus
ggatactgctccaactactggtgaa

SEQ ID NO: 602553 - DNA, 25 bp, Mus musculus
ggatactgctcctactactggtgaa

SEQ ID NO: 602554 - DNA, 25 bp, Mus musculus
ggatactgggctcacttcattgacc

SEQ ID NO: 602555 - DNA, 25 bp, Mus musculus
ggatactgggctgacttcattgacc

SEQ ID NO: 602556 - DNA, 25 bp, Mus musculus
ggatactgggtcatagtgtacaact

SEQ ID NO: 602557 - DNA, 25 bp, Mus musculus
ggatactgggtcttagtgtacaact

SEQ ID NO: 602558 - DNA, 25 bp, Mus musculus
ggatactggtcaccttgtctcaaaa

SEQ ID NO: 602559 - DNA, 25 bp, Mus musculus
ggatactggtcagcttgtctcaaaa

SEQ ID NO: 602560 - DNA, 25 bp, Mus musculus
ggatactggtggctgacattcaaaa

SEQ ID NO: 602561 - DNA, 25 bp, Mus musculus
ggatactggtgggtgacattcaaaa

SEQ ID NO: 602562 - DNA, 25 bp, Mus musculus
ggatactgtaatacagccaaaactt

SEQ ID NO: 602563 - DNA, 25 bp, Mus musculus
ggatactgtaattcagccaaaactt

SEQ ID NO: 602564 - DNA, 25 bp, Mus musculus
ggatactgtacaaacttacagcata

SEQ ID NO: 602565 - DNA, 25 bp, Mus musculus
ggatactgtacatacttacagcata

SEQ ID NO: 602566 - DNA, 25 bp, Mus musculus
ggatactgtgctacgatatcgatgc

SEQ ID NO: 602567 - DNA, 25 bp, Mus musculus
ggatactgtgcttcgatatcgatgc

SEQ ID NO: 602568 - DNA, 25 bp, Mus musculus
ggatactgtggtattctcccttcct

SEQ ID NO: 602569 - DNA, 25 bp, Mus musculus
ggatactgtggttttctcccttcct

SEQ ID NO: 602570 - DNA, 25 bp, Mus musculus
ggatacttagtaacgagaacctcac

SEQ ID NO: 602571 - DNA, 25 bp, Mus musculus
ggatacttagtatcgagaacctcac

SEQ ID NO: 602572 - DNA, 25 bp, Mus musculus
ggatacttcaggcttttccctcttg

SEQ ID NO: 602573 - DNA, 25 bp, Mus musculus
ggatacttcagggttttccctcttg

SEQ ID NO: 602574 - DNA, 25 bp, Mus musculus
ggatacttcattctatttctcactt

SEQ ID NO: 602575 - DNA, 25 bp, Mus musculus
ggatacttcattgtatttctcactt

SEQ ID NO: 602576 - DNA, 25 bp, Mus musculus
ggatacttctccattttctcaaaat

SEQ ID NO: 602577 - DNA, 25 bp, Mus musculus
ggatacttctcctttttctcaaaat

SEQ ID NO: 602578 - DNA, 25 bp, Mus musculus
ggatacttctttcgacccttggaga

SEQ ID NO: 602579 - DNA, 25 bp, Mus musculus
ggatacttctttggacccttggaga

SEQ ID NO: 602580 - DNA, 25 bp, Mus musculus
ggatacttgagtatgccagctttta

SEQ ID NO: 602581 - DNA, 25 bp, Mus musculus
ggatacttgagtttgccagctttta

SEQ ID NO: 602582 - DNA, 25 bp, Mus musculus
ggatacttgcaacccaagcaccttc

SEQ ID NO: 602583 - DNA, 25 bp, Mus musculus
ggatacttgcaagccaagcaccttc

SEQ ID NO: 602584 - DNA, 25 bp, Mus musculus
ggatacttgcatacccagaagcaat

SEQ ID NO: 602585 - DNA, 25 bp, Mus musculus
ggatacttgcattcccagaagcaat

SEQ ID NO: 602586 - DNA, 25 bp, Mus musculus
ggatacttgcgcctgaattcacatt

SEQ ID NO: 602587 - DNA, 25 bp, Mus musculus
ggatacttgcgcgtgaattcacatt

SEQ ID NO: 602588 - DNA, 25 bp, Mus musculus
ggatacttggatcttccctcagaaa

SEQ ID NO: 602589 - DNA, 25 bp, Mus musculus
ggatacttggatgttccctcagaaa

SEQ ID NO: 602590 - DNA, 25 bp, Mus musculus
ggatacttgggaattccatcattca

SEQ ID NO: 602591 - DNA, 25 bp, Mus musculus
ggatacttgggatttccatcattca

SEQ ID NO: 602592 - DNA, 25 bp, Mus musculus
ggatactttcaaataatgcccacaa

SEQ ID NO: 602593 - DNA, 25 bp, Mus musculus
ggatactttcaattaatgcccacaa

SEQ ID NO: 602594 - DNA, 25 bp, Mus musculus
ggatactttcatactgtccaaggag

SEQ ID NO: 602595 - DNA, 25 bp, Mus musculus
ggatactttcattctgtccaaggag

SEQ ID NO: 602596 - DNA, 25 bp, Mus musculus
ggatactttccaagtgttaaatcac

SEQ ID NO: 602597 - DNA, 25 bp, Mus musculus
ggatactttccatgtgttaaatcac

SEQ ID NO: 602598 - DNA, 25 bp, Mus musculus
ggatactttctaatgtctacaattc

SEQ ID NO: 602599 - DNA, 25 bp, Mus musculus
ggatactttctattgtctacaattc

SEQ ID NO: 602600 - DNA, 25 bp, Mus musculus
ggatactttctgagtctacaattta

SEQ ID NO: 602601 - DNA, 25 bp, Mus musculus
ggatactttctgtgtctacaattta

SEQ ID NO: 602602 - DNA, 25 bp, Mus musculus
ggatactttcttaccttctgagagc

SEQ ID NO: 602603 - DNA, 25 bp, Mus musculus
ggatactttctttccttctgagagc

SEQ ID NO: 602604 - DNA, 25 bp, Mus musculus
ggatactttgaaccactatttctgt

SEQ ID NO: 602605 - DNA, 25 bp, Mus musculus
ggatactttgaagcactatttctgt

SEQ ID NO: 602606 - DNA, 25 bp, Mus musculus
ggatacttttccagactgaagcctt

SEQ ID NO: 602607 - DNA, 25 bp, Mus musculus
ggatacttttcctgactgaagcctt

SEQ ID NO: 602608 - DNA, 25 bp, Mus musculus
ggatacttttgtacctatgttcaag

SEQ ID NO: 602609 - DNA, 25 bp, Mus musculus
ggatacttttgttcctatgttcaag

SEQ ID NO: 602610 - DNA, 25 bp, Mus musculus
ggatagaaatccacagtacttgata

SEQ ID NO: 602611 - DNA, 25 bp, Mus musculus
ggatagaaatcctcagtacttgata

SEQ ID NO: 602612 - DNA, 25 bp, Mus musculus
ggatagaacaatcacccgcaggatg

SEQ ID NO: 602613 - DNA, 25 bp, Mus musculus
ggatagaacaatgacccgcaggatg

SEQ ID NO: 602614 - DNA, 25 bp, Mus musculus
ggatagaacacacagcattatggaa

SEQ ID NO: 602615 - DNA, 25 bp, Mus musculus
ggatagaacacagagcattatggaa

SEQ ID NO: 602616 - DNA, 25 bp, Mus musculus
ggatagaacccacgctaccacaaat

SEQ ID NO: 602617 - DNA, 25 bp, Mus musculus
ggatagaacccaggctaccacaaat

SEQ ID NO: 602618 - DNA, 25 bp, Mus musculus
ggatagaaccttcataactgcacat

SEQ ID NO: 602619 - DNA, 25 bp, Mus musculus
ggatagaaccttgataactgcacat

SEQ ID NO: 602620 - DNA, 25 bp, Mus musculus
ggatagaagattccgaggccgctac

SEQ ID NO: 602621 - DNA, 25 bp, Mus musculus
ggatagaagattgcgaggccgctac

SEQ ID NO: 602622 - DNA, 25 bp, Mus musculus
ggatagacaatcacatttttagaaa

SEQ ID NO: 602623 - DNA, 25 bp, Mus musculus
ggatagacaatctcatttttagaaa

SEQ ID NO: 602624 - DNA, 25 bp, Mus musculus
ggatagacacccaagattgagctct

SEQ ID NO: 602625 - DNA, 25 bp, Mus musculus
ggatagacaccctagattgagctct

SEQ ID NO: 602626 - DNA, 25 bp, Mus musculus
ggatagaccataactcagcgtcctg

SEQ ID NO: 602627 - DNA, 25 bp, Mus musculus
ggatagaccatatctcagcgtcctg

SEQ ID NO: 602628 - DNA, 25 bp, Mus musculus
ggatagaccttgaggttgctgtctg

SEQ ID NO: 602629 - DNA, 25 bp, Mus musculus
ggatagaccttgtggttgctgtctg

SEQ ID NO: 602630 - DNA, 25 bp, Mus musculus
ggatagactacaatcttcgccatga

SEQ ID NO: 602631 - DNA, 25 bp, Mus musculus
ggatagactacattcttcgccatga

SEQ ID NO: 602632 - DNA, 25 bp, Mus musculus
ggatagactctgaggcagactgctt

SEQ ID NO: 602633 - DNA, 25 bp, Mus musculus
ggatagactctgtggcagactgctt

SEQ ID NO: 602634 - DNA, 25 bp, Mus musculus
ggatagagatgtatgtatgcagttc

SEQ ID NO: 602635 - DNA, 25 bp, Mus musculus
ggatagagatgtttgtatgcagttc

SEQ ID NO: 602636 - DNA, 25 bp, Mus musculus
ggatagagcaggagttcctcacgga

SEQ ID NO: 602637 - DNA, 25 bp, Mus musculus
ggatagagcaggtgttcctcacgga

SEQ ID NO: 602638 - DNA, 25 bp, Mus musculus
ggatagagctataataacacattaa

SEQ ID NO: 602639 - DNA, 25 bp, Mus musculus
ggatagagctattataacacattaa

SEQ ID NO: 602640 - DNA, 25 bp, Mus musculus
ggatagagtgctactgctcctcaga

SEQ ID NO: 602641 - DNA, 25 bp, Mus musculus
ggatagagtgcttctgctcctcaga

SEQ ID NO: 602642 - DNA, 25 bp, Mus musculus
ggatagatacgtcatgtctggtcat

SEQ ID NO: 602643 - DNA, 25 bp, Mus musculus
ggatagatacgtgatgtctggtcat

SEQ ID NO: 602644 - DNA, 25 bp, Mus musculus
ggatagatactcatgttccctttct

SEQ ID NO: 602645 - DNA, 25 bp, Mus musculus
ggatagatactcttgttccctttct

SEQ ID NO: 602646 - DNA, 25 bp, Mus musculus
ggatagatatccattcagttcttca

SEQ ID NO: 602647 - DNA, 25 bp, Mus musculus
ggatagatatcctttcagttcttca

SEQ ID NO: 602648 - DNA, 25 bp, Mus musculus
ggatagatccctagagcactctggc

SEQ ID NO: 602649 - DNA, 25 bp, Mus musculus
ggatagatcccttgagcactctggc

SEQ ID NO: 602650 - DNA, 25 bp, Mus musculus
ggatagatgataacttttactgctc

SEQ ID NO: 602651 - DNA, 25 bp, Mus musculus
ggatagatgatatcttttactgctc

SEQ ID NO: 602652 - DNA, 25 bp, Mus musculus
ggatagattcacattgcaggaaata

SEQ ID NO: 602653 - DNA, 25 bp, Mus musculus
ggatagattcactttgcaggaaata

SEQ ID NO: 602654 - DNA, 25 bp, Mus musculus
ggatagatttcacctcagtttcatg

SEQ ID NO: 602655 - DNA, 25 bp, Mus musculus
ggatagatttcagctcagtttcatg

SEQ ID NO: 602656 - DNA, 25 bp, Mus musculus
ggatagatttgtacgacgagccaga

SEQ ID NO: 602657 - DNA, 25 bp, Mus musculus
ggatagatttgttcgacgagccaga

SEQ ID NO: 602658 - DNA, 25 bp, Mus musculus
ggatagattttgacaatcagctgga

SEQ ID NO: 602659 - DNA, 25 bp, Mus musculus
ggatagattttgtcaatcagctgga

SEQ ID NO: 602660 - DNA, 25 bp, Mus musculus
ggatagcaaaaactactgtcaacaa

SEQ ID NO: 602661 - DNA, 25 bp, Mus musculus
ggatagcaaaaagtactgtcaacaa

SEQ ID NO: 602662 - DNA, 25 bp, Mus musculus
ggatagcaacgacgcctactagaaa

SEQ ID NO: 602663 - DNA, 25 bp, Mus musculus
ggatagcaacgaggcctactagaaa

SEQ ID NO: 602664 - DNA, 25 bp, Mus musculus
ggatagcagacacagatcttacttt

SEQ ID NO: 602665 - DNA, 25 bp, Mus musculus
ggatagcagacagagatcttacttt

SEQ ID NO: 602666 - DNA, 25 bp, Mus musculus
ggatagcagcagcttctttctcagc

SEQ ID NO: 602667 - DNA, 25 bp, Mus musculus
ggatagcagcaggttctttctcagc

SEQ ID NO: 602668 - DNA, 25 bp, Mus musculus
ggatagcagtcactcacgattagga

SEQ ID NO: 602669 - DNA, 25 bp, Mus musculus
ggatagcagtcagtcacgattagga

SEQ ID NO: 602670 - DNA, 25 bp, Mus musculus
ggatagcatctcatgtcagccatct

SEQ ID NO: 602671 - DNA, 25 bp, Mus musculus
ggatagcatctcttgtcagccatct

SEQ ID NO: 602672 - DNA, 25 bp, Mus musculus
ggatagcatttcagggttcctgggc

SEQ ID NO: 602673 - DNA, 25 bp, Mus musculus
ggatagcatttctgggttcctgggc

SEQ ID NO: 602674 - DNA, 25 bp, Mus musculus
ggatagccactgatctgcttcagaa

SEQ ID NO: 602675 - DNA, 25 bp, Mus musculus
ggatagccactgttctgcttcagaa

SEQ ID NO: 602676 - DNA, 25 bp, Mus musculus
ggatagcccgaaaagatttcctaca

SEQ ID NO: 602677 - DNA, 25 bp, Mus musculus
ggatagcccgaatagatttcctaca

SEQ ID NO: 602678 - DNA, 25 bp, Mus musculus
ggatagccgagactacccagatgca

SEQ ID NO: 602679 - DNA, 25 bp, Mus musculus
ggatagccgagagtacccagatgca

SEQ ID NO: 602680 - DNA, 25 bp, Mus musculus
ggatagcctagccaacatgagcatt

SEQ ID NO: 602681 - DNA, 25 bp, Mus musculus
ggatagcctagcgaacatgagcatt

SEQ ID NO: 602682 - DNA, 25 bp, Mus musculus
ggatagcctcagaatcactaagtat

SEQ ID NO: 602683 - DNA, 25 bp, Mus musculus
ggatagcctcagtatcactaagtat

SEQ ID NO: 602684 - DNA, 25 bp, Mus musculus
ggatagcctgcaaaactttacacca

SEQ ID NO: 602685 - DNA, 25 bp, Mus musculus
ggatagcctgcataactttacacca

SEQ ID NO: 602686 - DNA, 25 bp, Mus musculus
ggatagcgtcaccacaggctcccag

SEQ ID NO: 602687 - DNA, 25 bp, Mus musculus
ggatagcgtcacgacaggctcccag

SEQ ID NO: 602688 - DNA, 25 bp, Mus musculus
ggatagcgttccatgtgagagcaca

SEQ ID NO: 602689 - DNA, 25 bp, Mus musculus
ggatagcgttccttgtgagagcaca

SEQ ID NO: 602690 - DNA, 25 bp, Mus musculus
ggatagctccaactagcttcatcta

SEQ ID NO: 602691 - DNA, 25 bp, Mus musculus
ggatagctccaagtagcttcatcta

SEQ ID NO: 602692 - DNA, 25 bp, Mus musculus
ggatagctccagacaccaagagagt

SEQ ID NO: 602693 - DNA, 25 bp, Mus musculus
ggatagctccagtcaccaagagagt

SEQ ID NO: 602694 - DNA, 25 bp, Mus musculus
ggatagctctatcaactctattttt

SEQ ID NO: 602695 - DNA, 25 bp, Mus musculus
ggatagctctatgaactctattttt

SEQ ID NO: 602696 - DNA, 25 bp, Mus musculus
ggatagctctctactatagccagga

SEQ ID NO: 602697 - DNA, 25 bp, Mus musculus
ggatagctctcttctatagccagga

SEQ ID NO: 602698 - DNA, 25 bp, Mus musculus
ggatagctctgaaaacagcgtgcgt

SEQ ID NO: 602699 - DNA, 25 bp, Mus musculus
ggatagctctgataacagcgtgcgt

SEQ ID NO: 602700 - DNA, 25 bp, Mus musculus
ggatagctgatccaaaccaactagg

SEQ ID NO: 602701 - DNA, 25 bp, Mus musculus
ggatagctgatcgaaaccaactagg

SEQ ID NO: 602702 - DNA, 25 bp, Mus musculus
ggatagctggaccttcaaattcccc

SEQ ID NO: 602703 - DNA, 25 bp, Mus musculus
ggatagctggacgttcaaattcccc

SEQ ID NO: 602704 - DNA, 25 bp, Mus musculus
ggatagctttggcagttcctcattt

SEQ ID NO: 602705 - DNA, 25 bp, Mus musculus
ggatagctttgggagttcctcattt

SEQ ID NO: 602706 - DNA, 25 bp, Mus musculus
ggatagcttttccttcagcagaacg

SEQ ID NO: 602707 - DNA, 25 bp, Mus musculus
ggatagcttttcgttcagcagaacg

SEQ ID NO: 602708 - DNA, 25 bp, Mus musculus
ggataggaagccactgttctccagg

SEQ ID NO: 602709 - DNA, 25 bp, Mus musculus
ggataggaagcctctgttctccagg

SEQ ID NO: 602710 - DNA, 25 bp, Mus musculus
ggataggaggatcattcatgtccag

SEQ ID NO: 602711 - DNA, 25 bp, Mus musculus
ggataggaggatgattcatgtccag

SEQ ID NO: 602712 - DNA, 25 bp, Mus musculus
ggataggatatcatgtccgggttct

SEQ ID NO: 602713 - DNA, 25 bp, Mus musculus
ggataggatatcttgtccgggttct

SEQ ID NO: 602714 - DNA, 25 bp, Mus musculus
ggataggattccactacagtcaact

SEQ ID NO: 602715 - DNA, 25 bp, Mus musculus
ggataggattcctctacagtcaact

SEQ ID NO: 602716 - DNA, 25 bp, Mus musculus
ggataggcactcctctgatgaaaga

SEQ ID NO: 602717 - DNA, 25 bp, Mus musculus
ggataggcactcgtctgatgaaaga

SEQ ID NO: 602718 - DNA, 25 bp, Mus musculus
ggataggctgcaatgtctcctccta

SEQ ID NO: 602719 - DNA, 25 bp, Mus musculus
ggataggctgcattgtctcctccta

SEQ ID NO: 602720 - DNA, 25 bp, Mus musculus
ggatagggatccaacccaggttgtt

SEQ ID NO: 602721 - DNA, 25 bp, Mus musculus
ggatagggatcctacccaggttgtt

SEQ ID NO: 602722 - DNA, 25 bp, Mus musculus
ggataggttcacatgggccacagta

SEQ ID NO: 602723 - DNA, 25 bp, Mus musculus
ggataggttcacttgggccacagta

SEQ ID NO: 602724 - DNA, 25 bp, Mus musculus
ggataggttcccctcagtcacagtt

SEQ ID NO: 602725 - DNA, 25 bp, Mus musculus
ggataggttcccgtcagtcacagtt

SEQ ID NO: 602726 - DNA, 25 bp, Mus musculus
ggatagtatataccctgtgctccag

SEQ ID NO: 602727 - DNA, 25 bp, Mus musculus
ggatagtatatagcctgtgctccag

SEQ ID NO: 602728 - DNA, 25 bp, Mus musculus
ggatagtcatatagccacacacccg

SEQ ID NO: 602729 - DNA, 25 bp, Mus musculus
ggatagtcatattgccacacacccg

SEQ ID NO: 602730 - DNA, 25 bp, Mus musculus
ggatagtctccaaaatgattttcag

SEQ ID NO: 602731 - DNA, 25 bp, Mus musculus
ggatagtctccacctcgagattaag

SEQ ID NO: 602732 - DNA, 25 bp, Mus musculus
ggatagtctccagctcgagattaag

SEQ ID NO: 602733 - DNA, 25 bp, Mus musculus
ggatagtctccataatgattttcag

SEQ ID NO: 602734 - DNA, 25 bp, Mus musculus
ggatagtcttaactccagaacccca

SEQ ID NO: 602735 - DNA, 25 bp, Mus musculus
ggatagtcttaagtccagaacccca

SEQ ID NO: 602736 - DNA, 25 bp, Mus musculus
ggatagtcttgaactgagactctct

SEQ ID NO: 602737 - DNA, 25 bp, Mus musculus
ggatagtcttgatctgagactctct

SEQ ID NO: 602738 - DNA, 25 bp, Mus musculus
ggatagtgcgctaggctgcaagact

SEQ ID NO: 602739 - DNA, 25 bp, Mus musculus
ggatagtgcgcttggctgcaagact

SEQ ID NO: 602740 - DNA, 25 bp, Mus musculus
ggatagtggcccagcacagtctgca

SEQ ID NO: 602741 - DNA, 25 bp, Mus musculus
ggatagtggccctgcacagtctgca

SEQ ID NO: 602742 - DNA, 25 bp, Mus musculus
ggatagtgtccaacgagacctttca

SEQ ID NO: 602743 - DNA, 25 bp, Mus musculus
ggatagtgtccatcgagacctttca

SEQ ID NO: 602744 - DNA, 25 bp, Mus musculus
ggatagtgtcggaaaagtccaggca

SEQ ID NO: 602745 - DNA, 25 bp, Mus musculus
ggatagtgtcggtaaagtccaggca

SEQ ID NO: 602746 - DNA, 25 bp, Mus musculus
ggatagtgtgtgctgtaaaccacaa

SEQ ID NO: 602747 - DNA, 25 bp, Mus musculus
ggatagtgtgtggtgtaaaccacaa

SEQ ID NO: 602748 - DNA, 25 bp, Mus musculus
ggatagttaccaaacctctgaagtg

SEQ ID NO: 602749 - DNA, 25 bp, Mus musculus
ggatagttaccatacctctgaagtg

SEQ ID NO: 602750 - DNA, 25 bp, Mus musculus
ggatagttctgtagagttcagtctg

SEQ ID NO: 602751 - DNA, 25 bp, Mus musculus
ggatagttctgttgagttcagtctg

SEQ ID NO: 602752 - DNA, 25 bp, Mus musculus
ggatagtttcttcccaaacctgcct

SEQ ID NO: 602753 - DNA, 25 bp, Mus musculus
ggatagtttcttgccaaacctgcct

SEQ ID NO: 602754 - DNA, 25 bp, Mus musculus
ggatagtttgcccttacttagacaa

SEQ ID NO: 602755 - DNA, 25 bp, Mus musculus
ggatagtttgccgttacttagacaa

SEQ ID NO: 602756 - DNA, 25 bp, Mus musculus
ggatataacacccatcttcaggaaa

SEQ ID NO: 602757 - DNA, 25 bp, Mus musculus
ggatataacaccgatcttcaggaaa

SEQ ID NO: 602758 - DNA, 25 bp, Mus musculus
ggatataagcaccagcgttccatct

SEQ ID NO: 602759 - DNA, 25 bp, Mus musculus
ggatataagcacgagcgttccatct

SEQ ID NO: 602760 - DNA, 25 bp, Mus musculus
ggatataagtgcacctcttggacat

SEQ ID NO: 602761 - DNA, 25 bp, Mus musculus
ggatataagtgctcctcttggacat

SEQ ID NO: 602762 - DNA, 25 bp, Mus musculus
ggatataatcataggtctgtttctg

SEQ ID NO: 602763 - DNA, 25 bp, Mus musculus
ggatataatcattggtctgtttctg

SEQ ID NO: 602764 - DNA, 25 bp, Mus musculus
ggatatacaatcctacaacacttac

SEQ ID NO: 602765 - DNA, 25 bp, Mus musculus
ggatatacaatcgtacaacacttac

SEQ ID NO: 602766 - DNA, 25 bp, Mus musculus
ggatatacacatcacctgatagact

SEQ ID NO: 602767 - DNA, 25 bp, Mus musculus
ggatatacacatgacctgatagact

SEQ ID NO: 602768 - DNA, 25 bp, Mus musculus
ggatataccgggagcccctttcctg

SEQ ID NO: 602769 - DNA, 25 bp, Mus musculus
ggatataccgggtgcccctttcctg

SEQ ID NO: 602770 - DNA, 25 bp, Mus musculus
ggatatactcaaacaggaactcttt

SEQ ID NO: 602771 - DNA, 25 bp, Mus musculus
ggatatactcaatcaggaactcttt

SEQ ID NO: 602772 - DNA, 25 bp, Mus musculus
ggatatactcagatagaagccaatc

SEQ ID NO: 602773 - DNA, 25 bp, Mus musculus
ggatatactcagttagaagccaatc

SEQ ID NO: 602774 - DNA, 25 bp, Mus musculus
ggatatactgaaaaaccatctttgt

SEQ ID NO: 602775 - DNA, 25 bp, Mus musculus
ggatatactgaataaccatctttgt

SEQ ID NO: 602776 - DNA, 25 bp, Mus musculus
ggatatagacttcccaccatcaaag

SEQ ID NO: 602777 - DNA, 25 bp, Mus musculus
ggatatagacttgccaccatcaaag

SEQ ID NO: 602778 - DNA, 25 bp, Mus musculus
ggatatagagctctgcttcttcact

SEQ ID NO: 602779 - DNA, 25 bp, Mus musculus
ggatatagagctgtgcttcttcact

SEQ ID NO: 602780 - DNA, 25 bp, Mus musculus
ggatatagagtgcattcttaggata

SEQ ID NO: 602781 - DNA, 25 bp, Mus musculus
ggatatagagtggattcttaggata

SEQ ID NO: 602782 - DNA, 25 bp, Mus musculus
ggatatagattaattggacagcaca

SEQ ID NO: 602783 - DNA, 25 bp, Mus musculus
ggatatagattatttggacagcaca

SEQ ID NO: 602784 - DNA, 25 bp, Mus musculus
ggatataggcgcagttcaaatgtag

SEQ ID NO: 602785 - DNA, 25 bp, Mus musculus
ggatataggcgctgttcaaatgtag

SEQ ID NO: 602786 - DNA, 25 bp, Mus musculus
ggatatagtcttatctgtattctgt

SEQ ID NO: 602787 - DNA, 25 bp, Mus musculus
ggatatagtcttttctgtattctgt

SEQ ID NO: 602788 - DNA, 25 bp, Mus musculus
ggatatagtggtacaggccttgata

SEQ ID NO: 602789 - DNA, 25 bp, Mus musculus
ggatatagtggttcaggccttgata

SEQ ID NO: 602790 - DNA, 25 bp, Mus musculus
ggatatatagctccaaccacactga

SEQ ID NO: 602791 - DNA, 25 bp, Mus musculus
ggatatatagctccaggttacggaa

SEQ ID NO: 602792 - DNA, 25 bp, Mus musculus
ggatatatagctgcaaccacactga

SEQ ID NO: 602793 - DNA, 25 bp, Mus musculus
ggatatatagctgcaggttacggaa

SEQ ID NO: 602794 - DNA, 25 bp, Mus musculus
ggatatatattcacggcacctggta

SEQ ID NO: 602795 - DNA, 25 bp, Mus musculus
ggatatatattctcggcacctggta

SEQ ID NO: 602796 - DNA, 25 bp, Mus musculus
ggatatatcacaaaagcaagctaca

SEQ ID NO: 602797 - DNA, 25 bp, Mus musculus
ggatatatcacataagcaagctaca

SEQ ID NO: 602798 - DNA, 25 bp, Mus musculus
ggatatatcagcaaaaacacaccat

SEQ ID NO: 602799 - DNA, 25 bp, Mus musculus
ggatatatcagctaaaacacaccat

SEQ ID NO: 602800 - DNA, 25 bp, Mus musculus
ggatatatctcactgtcttactggt

SEQ ID NO: 602801 - DNA, 25 bp, Mus musculus
ggatatatctcagtgtcttactggt

SEQ ID NO: 602802 - DNA, 25 bp, Mus musculus
ggatatatgaaccacactctagaag

SEQ ID NO: 602803 - DNA, 25 bp, Mus musculus
ggatatatgaacgacactctagaag

SEQ ID NO: 602804 - DNA, 25 bp, Mus musculus
ggatatatgcctccacttacagcct

SEQ ID NO: 602805 - DNA, 25 bp, Mus musculus
ggatatatgcctgcacttacagcct

SEQ ID NO: 602806 - DNA, 25 bp, Mus musculus
ggatatatggagactcacctctcct

SEQ ID NO: 602807 - DNA, 25 bp, Mus musculus
ggatatatggagtctcacctctcct

SEQ ID NO: 602808 - DNA, 25 bp, Mus musculus
ggatatattcctcatcatcgtaatc

SEQ ID NO: 602809 - DNA, 25 bp, Mus musculus
ggatatattcctgatcatcgtaatc

SEQ ID NO: 602810 - DNA, 25 bp, Mus musculus
ggatatcaagatccccaaattcaag

SEQ ID NO: 602811 - DNA, 25 bp, Mus musculus
ggatatcaagatgcccaaattcaag

SEQ ID NO: 602812 - DNA, 25 bp, Mus musculus
ggatatcaatggcaaactgtttctt

SEQ ID NO: 602813 - DNA, 25 bp, Mus musculus
ggatatcaatgggaaactgtttctt

SEQ ID NO: 602814 - DNA, 25 bp, Mus musculus
ggatatcactctcaagctgggtaca

SEQ ID NO: 602815 - DNA, 25 bp, Mus musculus
ggatatcactctgaagctgggtaca

SEQ ID NO: 602816 - DNA, 25 bp, Mus musculus
ggatatcagaccaaatcacacgatt

SEQ ID NO: 602817 - DNA, 25 bp, Mus musculus
ggatatcagacctaatcacacgatt

SEQ ID NO: 602818 - DNA, 25 bp, Mus musculus
ggatatcagccgatcagatcacaga

SEQ ID NO: 602819 - DNA, 25 bp, Mus musculus
ggatatcagccgttcagatcacaga

SEQ ID NO: 602820 - DNA, 25 bp, Mus musculus
ggatatcaggctagcacatggtgca

SEQ ID NO: 602821 - DNA, 25 bp, Mus musculus
ggatatcaggcttgcacatggtgca

SEQ ID NO: 602822 - DNA, 25 bp, Mus musculus
ggatatcagttcacgcagcagggac

SEQ ID NO: 602823 - DNA, 25 bp, Mus musculus
ggatatcagttctcgcagcagggac

SEQ ID NO: 602824 - DNA, 25 bp, Mus musculus
ggatatcagtttaccttacctgcaa

SEQ ID NO: 602825 - DNA, 25 bp, Mus musculus
ggatatcagttttccttacctgcaa

SEQ ID NO: 602826 - DNA, 25 bp, Mus musculus
ggatatcatcctctagccaggtcat

SEQ ID NO: 602827 - DNA, 25 bp, Mus musculus
ggatatcatcctgtagccaggtcat

SEQ ID NO: 602828 - DNA, 25 bp, Mus musculus
ggatatcatgcgcaggtttcctgtg

SEQ ID NO: 602829 - DNA, 25 bp, Mus musculus
ggatatcatgcggaggtttcctgtg

SEQ ID NO: 602830 - DNA, 25 bp, Mus musculus
ggatatcatgttattaccctgggcc

SEQ ID NO: 602831 - DNA, 25 bp, Mus musculus
ggatatcatgtttttaccctgggcc

SEQ ID NO: 602832 - DNA, 25 bp, Mus musculus
ggatatcattctccagtatcctgaa

SEQ ID NO: 602833 - DNA, 25 bp, Mus musculus
ggatatcattctgcagtatcctgaa

SEQ ID NO: 602834 - DNA, 25 bp, Mus musculus
ggatatcattgtcttcatacagaga

SEQ ID NO: 602835 - DNA, 25 bp, Mus musculus
ggatatcattgtgttcatacagaga

SEQ ID NO: 602836 - DNA, 25 bp, Mus musculus
ggatatccaaaaagagccccagtga

SEQ ID NO: 602837 - DNA, 25 bp, Mus musculus
ggatatccaaaatgagccccagtga

SEQ ID NO: 602838 - DNA, 25 bp, Mus musculus
ggatatccaagccacttaactcatt

SEQ ID NO: 602839 - DNA, 25 bp, Mus musculus
ggatatccaagcgacttaactcatt

SEQ ID NO: 602840 - DNA, 25 bp, Mus musculus
ggatatccacgaagatgtcccactg

SEQ ID NO: 602841 - DNA, 25 bp, Mus musculus
ggatatccacgatgatgtcccactg

SEQ ID NO: 602842 - DNA, 25 bp, Mus musculus
ggatatccagccatctagcgtgttc

SEQ ID NO: 602843 - DNA, 25 bp, Mus musculus
ggatatccagccttctagcgtgttc

SEQ ID NO: 602844 - DNA, 25 bp, Mus musculus
ggatatccaggaacttgactcaaga

SEQ ID NO: 602845 - DNA, 25 bp, Mus musculus
ggatatccaggatcttgactcaaga

SEQ ID NO: 602846 - DNA, 25 bp, Mus musculus
ggatatcccataacaggccttggat

SEQ ID NO: 602847 - DNA, 25 bp, Mus musculus
ggatatcccatatcaggccttggat

SEQ ID NO: 602848 - DNA, 25 bp, Mus musculus
ggatatcccgggaattgccaaatgc

SEQ ID NO: 602849 - DNA, 25 bp, Mus musculus
ggatatcccgggtattgccaaatgc

SEQ ID NO: 602850 - DNA, 25 bp, Mus musculus
ggatatcccttcctgaatgggcagt

SEQ ID NO: 602851 - DNA, 25 bp, Mus musculus
ggatatcccttcgtgaatgggcagt

SEQ ID NO: 602852 - DNA, 25 bp, Mus musculus
ggatatcctccaagctaaagcactc

SEQ ID NO: 602853 - DNA, 25 bp, Mus musculus
ggatatcctccatgctaaagcactc

SEQ ID NO: 602854 - DNA, 25 bp, Mus musculus
ggatatcctcggctttatcatggga

SEQ ID NO: 602855 - DNA, 25 bp, Mus musculus
ggatatcctcgggtttatcatggga

SEQ ID NO: 602856 - DNA, 25 bp, Mus musculus
ggatatcctcttctgctatctctca

SEQ ID NO: 602857 - DNA, 25 bp, Mus musculus
ggatatcctcttgtgctatctctca

SEQ ID NO: 602858 - DNA, 25 bp, Mus musculus
ggatatcctgacaggaacaaacttg

SEQ ID NO: 602859 - DNA, 25 bp, Mus musculus
ggatatcctgactggaacaaacttg

SEQ ID NO: 602860 - DNA, 25 bp, Mus musculus
ggatatcctgccataggcttgttaa

SEQ ID NO: 602861 - DNA, 25 bp, Mus musculus
ggatatcctgccttaggcttgttaa

SEQ ID NO: 602862 - DNA, 25 bp, Mus musculus
ggatatcctggaccgcaacaaggcg

SEQ ID NO: 602863 - DNA, 25 bp, Mus musculus
ggatatcctggagcgcaacaaggcg

SEQ ID NO: 602864 - DNA, 25 bp, Mus musculus
ggatatcgccaacgcctctgatgag

SEQ ID NO: 602865 - DNA, 25 bp, Mus musculus
ggatatcgccaaggcctctgatgag

SEQ ID NO: 602866 - DNA, 25 bp, Mus musculus
ggatatcgcctcagacagtttggga

SEQ ID NO: 602867 - DNA, 25 bp, Mus musculus
ggatatcgcctctgacagtttggga

SEQ ID NO: 602868 - DNA, 25 bp, Mus musculus
ggatatcgcttgcaactgatggcat

SEQ ID NO: 602869 - DNA, 25 bp, Mus musculus
ggatatcgcttggaactgatggcat

SEQ ID NO: 602870 - DNA, 25 bp, Mus musculus
ggatatcgtacaatatgacccaaca

SEQ ID NO: 602871 - DNA, 25 bp, Mus musculus
ggatatcgtacattatgacccaaca

SEQ ID NO: 602872 - DNA, 25 bp, Mus musculus
ggatatctaacaaggccatgctctg

SEQ ID NO: 602873 - DNA, 25 bp, Mus musculus
ggatatctaacatggccatgctctg

SEQ ID NO: 602874 - DNA, 25 bp, Mus musculus
ggatatctaagtatcccatctgagt

SEQ ID NO: 602875 - DNA, 25 bp, Mus musculus
ggatatctaagtttcccatctgagt

SEQ ID NO: 602876 - DNA, 25 bp, Mus musculus
ggatatctaccccaaactggtgtca

SEQ ID NO: 602877 - DNA, 25 bp, Mus musculus
ggatatctacccgaaactggtgtca

SEQ ID NO: 602878 - DNA, 25 bp, Mus musculus
ggatatctagaaattttgtgacttg

SEQ ID NO: 602879 - DNA, 25 bp, Mus musculus
ggatatctagaatttttgtgacttg

SEQ ID NO: 602880 - DNA, 25 bp, Mus musculus
ggatatctccttaagaggtaagtca

SEQ ID NO: 602881 - DNA, 25 bp, Mus musculus
ggatatctccttcgctctgtcttct

SEQ ID NO: 602882 - DNA, 25 bp, Mus musculus
ggatatctccttggctctgtcttct

SEQ ID NO: 602883 - DNA, 25 bp, Mus musculus
ggatatctcctttagaggtaagtca

SEQ ID NO: 602884 - DNA, 25 bp, Mus musculus
ggatatctctaacgttgctcttcaa

SEQ ID NO: 602885 - DNA, 25 bp, Mus musculus
ggatatctctaaggttgctcttcaa

SEQ ID NO: 602886 - DNA, 25 bp, Mus musculus
ggatatctgaatagattccgggcct

SEQ ID NO: 602887 - DNA, 25 bp, Mus musculus
ggatatctgaattgattccgggcct

SEQ ID NO: 602888 - DNA, 25 bp, Mus musculus
ggatatgaaatactttcctaactga

SEQ ID NO: 602889 - DNA, 25 bp, Mus musculus
ggatatgaaatagtttcctaactga

SEQ ID NO: 602890 - DNA, 25 bp, Mus musculus
ggatatgacagcatgcacggatttt

SEQ ID NO: 602891 - DNA, 25 bp, Mus musculus
ggatatgacagcttgcacggatttt

SEQ ID NO: 602892 - DNA, 25 bp, Mus musculus
ggatatgacgtcatcttgcagacta

SEQ ID NO: 602893 - DNA, 25 bp, Mus musculus
ggatatgacgtcttcttgcagacta

SEQ ID NO: 602894 - DNA, 25 bp, Mus musculus
ggatatgactaacaactctgccctt

SEQ ID NO: 602895 - DNA, 25 bp, Mus musculus
ggatatgactaagaactctgccctt

SEQ ID NO: 602896 - DNA, 25 bp, Mus musculus
ggatatgactctatggttgagtaaa

SEQ ID NO: 602897 - DNA, 25 bp, Mus musculus
ggatatgactctcggagcacctgct

SEQ ID NO: 602898 - DNA, 25 bp, Mus musculus
ggatatgactctgggagcacctgct

SEQ ID NO: 602899 - DNA, 25 bp, Mus musculus
ggatatgactctttggttgagtaaa

SEQ ID NO: 602900 - DNA, 25 bp, Mus musculus
ggatatgattaactgcaggctctgc

SEQ ID NO: 602901 - DNA, 25 bp, Mus musculus
ggatatgattaagtgcaggctctgc

SEQ ID NO: 602902 - DNA, 25 bp, Mus musculus
ggatatgcagccatacctgtttgca

SEQ ID NO: 602903 - DNA, 25 bp, Mus musculus
ggatatgcagccttacctgtttgca

SEQ ID NO: 602904 - DNA, 25 bp, Mus musculus
ggatatgccaccagcagactattac

SEQ ID NO: 602905 - DNA, 25 bp, Mus musculus
ggatatgccacctgcagactattac

SEQ ID NO: 602906 - DNA, 25 bp, Mus musculus
ggatatgccagacggttatgcgccc

SEQ ID NO: 602907 - DNA, 25 bp, Mus musculus
ggatatgccagagggttatgcgccc

SEQ ID NO: 602908 - DNA, 25 bp, Mus musculus
ggatatgcccatcacatatttggaa

SEQ ID NO: 602909 - DNA, 25 bp, Mus musculus
ggatatgcccatgacatatttggaa

SEQ ID NO: 602910 - DNA, 25 bp, Mus musculus
ggatatgccgcaccagcgcgtcgat

SEQ ID NO: 602911 - DNA, 25 bp, Mus musculus
ggatatgccgcagcagcgcgtcgat

SEQ ID NO: 602912 - DNA, 25 bp, Mus musculus
ggatatgcctaactcacatgggaat

SEQ ID NO: 602913 - DNA, 25 bp, Mus musculus
ggatatgcctaagtcacatgggaat

SEQ ID NO: 602914 - DNA, 25 bp, Mus musculus
ggatatgcctacatctagatgctaa

SEQ ID NO: 602915 - DNA, 25 bp, Mus musculus
ggatatgcctacttctagatgctaa

SEQ ID NO: 602916 - DNA, 25 bp, Mus musculus
ggatatgcctcacagctcattggct

SEQ ID NO: 602917 - DNA, 25 bp, Mus musculus
ggatatgcctcagagctcattggct

SEQ ID NO: 602918 - DNA, 25 bp, Mus musculus
ggatatgctatcaagttaccttctg

SEQ ID NO: 602919 - DNA, 25 bp, Mus musculus
ggatatgctatctagttaccttctg

SEQ ID NO: 602920 - DNA, 25 bp, Mus musculus
ggatatgctcatatgatttctatag

SEQ ID NO: 602921 - DNA, 25 bp, Mus musculus
ggatatgctcatttgatttctatag

SEQ ID NO: 602922 - DNA, 25 bp, Mus musculus
ggatatgctctgcatgtttccagca

SEQ ID NO: 602923 - DNA, 25 bp, Mus musculus
ggatatgctctggatgtttccagca

SEQ ID NO: 602924 - DNA, 25 bp, Mus musculus
ggatatgctgtgagtctgtctgaga

SEQ ID NO: 602925 - DNA, 25 bp, Mus musculus
ggatatgctgtgtgtctgtctgaga

SEQ ID NO: 602926 - DNA, 25 bp, Mus musculus
ggatatggaaccctagctgctttga

SEQ ID NO: 602927 - DNA, 25 bp, Mus musculus
ggatatggaaccgtagctgctttga

SEQ ID NO: 602928 - DNA, 25 bp, Mus musculus
ggatatggaattactactcacagga

SEQ ID NO: 602929 - DNA, 25 bp, Mus musculus
ggatatggaatttctactcacagga

SEQ ID NO: 602930 - DNA, 25 bp, Mus musculus
ggatatggacgaatcatcgctgctg

SEQ ID NO: 602931 - DNA, 25 bp, Mus musculus
ggatatggacgattcatcgctgctg

SEQ ID NO: 602932 - DNA, 25 bp, Mus musculus
ggatatggatccaaggctggcccag

SEQ ID NO: 602933 - DNA, 25 bp, Mus musculus
ggatatggatcctaggctggcccag

SEQ ID NO: 602934 - DNA, 25 bp, Mus musculus
ggatatggcattcattaaaatcatt

SEQ ID NO: 602935 - DNA, 25 bp, Mus musculus
ggatatggcattgattaaaatcatt

SEQ ID NO: 602936 - DNA, 25 bp, Mus musculus
ggatatggcctgcaatctcagcagc

SEQ ID NO: 602937 - DNA, 25 bp, Mus musculus
ggatatggcctggaatctcagcagc

SEQ ID NO: 602938 - DNA, 25 bp, Mus musculus
ggatatggtcacctaaactcccaga

SEQ ID NO: 602939 - DNA, 25 bp, Mus musculus
ggatatggtcacgtaaactcccaga

SEQ ID NO: 602940 - DNA, 25 bp, Mus musculus
ggatatggtgacagtgcccttcaaa

SEQ ID NO: 602941 - DNA, 25 bp, Mus musculus
ggatatggtgactgtgcccttcaaa

SEQ ID NO: 602942 - DNA, 25 bp, Mus musculus
ggatatggttccactactttttaag

SEQ ID NO: 602943 - DNA, 25 bp, Mus musculus
ggatatggttcctctactttttaag

SEQ ID NO: 602944 - DNA, 25 bp, Mus musculus
ggatatggtttccactcatgagaag

SEQ ID NO: 602945 - DNA, 25 bp, Mus musculus
ggatatggtttcgactcatgagaag

SEQ ID NO: 602946 - DNA, 25 bp, Mus musculus
ggatatgtaagtccttcctgcataa

SEQ ID NO: 602947 - DNA, 25 bp, Mus musculus
ggatatgtaagtgcttcctgcataa

SEQ ID NO: 602948 - DNA, 25 bp, Mus musculus
ggatatgtagccaaattttaccgaa

SEQ ID NO: 602949 - DNA, 25 bp, Mus musculus
ggatatgtagccaggactacctaaa

SEQ ID NO: 602950 - DNA, 25 bp, Mus musculus
ggatatgtagcctaattttaccgaa

SEQ ID NO: 602951 - DNA, 25 bp, Mus musculus
ggatatgtagcctggactacctaaa

SEQ ID NO: 602952 - DNA, 25 bp, Mus musculus
ggatatgtagtcagccaggctgcac

SEQ ID NO: 602953 - DNA, 25 bp, Mus musculus
ggatatgtagtctgccaggctgcac

SEQ ID NO: 602954 - DNA, 25 bp, Mus musculus
ggatatgtatcaaagcgctgcccaa

SEQ ID NO: 602955 - DNA, 25 bp, Mus musculus
ggatatgtatcatagcgctgcccaa

SEQ ID NO: 602956 - DNA, 25 bp, Mus musculus
ggatatgtccatcaacgtatactta

SEQ ID NO: 602957 - DNA, 25 bp, Mus musculus
ggatatgtccatgaacgtatactta

SEQ ID NO: 602958 - DNA, 25 bp, Mus musculus
ggatatgtcctcagctatgtggtaa

SEQ ID NO: 602959 - DNA, 25 bp, Mus musculus
ggatatgtcctctgctatgtggtaa

SEQ ID NO: 602960 - DNA, 25 bp, Mus musculus
ggatatgtgatccactctctcatgg

SEQ ID NO: 602961 - DNA, 25 bp, Mus musculus
ggatatgtgatcgactctctcatgg

SEQ ID NO: 602962 - DNA, 25 bp, Mus musculus
ggatatgtgtggaggtgcttagcca

SEQ ID NO: 602963 - DNA, 25 bp, Mus musculus
ggatatgtgtggtggtgcttagcca

SEQ ID NO: 602964 - DNA, 25 bp, Mus musculus
ggatatgttgacagctttccccttt

SEQ ID NO: 602965 - DNA, 25 bp, Mus musculus
ggatatgttgactgctttccccttt

SEQ ID NO: 602966 - DNA, 25 bp, Mus musculus
ggatatgttttaccggcactgggca

SEQ ID NO: 602967 - DNA, 25 bp, Mus musculus
ggatatgttttagcggcactgggca

SEQ ID NO: 602968 - DNA, 25 bp, Mus musculus
ggatattaattcaatgtgccttttt

SEQ ID NO: 602969 - DNA, 25 bp, Mus musculus
ggatattaattctatgtgccttttt

SEQ ID NO: 602970 - DNA, 25 bp, Mus musculus
ggatattaccgcatattttcataca

SEQ ID NO: 602971 - DNA, 25 bp, Mus musculus
ggatattaccgcttattttcataca

SEQ ID NO: 602972 - DNA, 25 bp, Mus musculus
ggatattacctccagtgtgttattt

SEQ ID NO: 602973 - DNA, 25 bp, Mus musculus
ggatattacctcgagtgtgttattt

SEQ ID NO: 602974 - DNA, 25 bp, Mus musculus
ggatattactctagtccctcatggt

SEQ ID NO: 602975 - DNA, 25 bp, Mus musculus
ggatattactcttgtccctcatggt

SEQ ID NO: 602976 - DNA, 25 bp, Mus musculus
ggatattagactactcttggatttg

SEQ ID NO: 602977 - DNA, 25 bp, Mus musculus
ggatattagacttctcttggatttg

SEQ ID NO: 602978 - DNA, 25 bp, Mus musculus
ggatattagcagcagcctgtgccag

SEQ ID NO: 602979 - DNA, 25 bp, Mus musculus
ggatattagcaggagcctgtgccag

SEQ ID NO: 602980 - DNA, 25 bp, Mus musculus
ggatattagctccttgtcctaagtg

SEQ ID NO: 602981 - DNA, 25 bp, Mus musculus
ggatattagctcgttgtcctaagtg

SEQ ID NO: 602982 - DNA, 25 bp, Mus musculus
ggatattaggttacaatttctgttt

SEQ ID NO: 602983 - DNA, 25 bp, Mus musculus
ggatattaggtttcaatttctgttt

SEQ ID NO: 602984 - DNA, 25 bp, Mus musculus
ggatattataggatttgagctttaa

SEQ ID NO: 602985 - DNA, 25 bp, Mus musculus
ggatattataggttttgagctttaa

SEQ ID NO: 602986 - DNA, 25 bp, Mus musculus
ggatattatcccaatactttcatga

SEQ ID NO: 602987 - DNA, 25 bp, Mus musculus
ggatattatccctatactttcatga

SEQ ID NO: 602988 - DNA, 25 bp, Mus musculus
ggatattattagctgcttcccggca

SEQ ID NO: 602989 - DNA, 25 bp, Mus musculus
ggatattattaggtgcttcccggca

SEQ ID NO: 602990 - DNA, 25 bp, Mus musculus
ggatattcaaccatccgtggactga

SEQ ID NO: 602991 - DNA, 25 bp, Mus musculus
ggatattcaaccttccgtggactga

SEQ ID NO: 602992 - DNA, 25 bp, Mus musculus
ggatattcaagcctaccagtcagcc

SEQ ID NO: 602993 - DNA, 25 bp, Mus musculus
ggatattcaagcgtaccagtcagcc

SEQ ID NO: 602994 - DNA, 25 bp, Mus musculus
ggatattcagtgaggcctagggcca

SEQ ID NO: 602995 - DNA, 25 bp, Mus musculus
ggatattcagtgtggcctagggcca

SEQ ID NO: 602996 - DNA, 25 bp, Mus musculus
ggatattcatgtatcattggccaaa

SEQ ID NO: 602997 - DNA, 25 bp, Mus musculus
ggatattcatgtttcattggccaaa

SEQ ID NO: 602998 - DNA, 25 bp, Mus musculus
ggatattcatttcatgcgtttgctt

SEQ ID NO: 602999 - DNA, 25 bp, Mus musculus
ggatattcatttgatgcgtttgctt

SEQ ID NO: 603000 - DNA, 25 bp, Mus musculus
ggatattcctacacacttcgtaaag

SEQ ID NO: 603001 - DNA, 25 bp, Mus musculus
ggatattcctacagtgccttcgacg

SEQ ID NO: 603002 - DNA, 25 bp, Mus musculus
ggatattcctactcacttcgtaaag

SEQ ID NO: 603003 - DNA, 25 bp, Mus musculus
ggatattcctactgtgccttcgacg

SEQ ID NO: 603004 - DNA, 25 bp, Mus musculus
ggatattcctgtcagaaaatgtcaa

SEQ ID NO: 603005 - DNA, 25 bp, Mus musculus
ggatattcctgtgagaaaatgtcaa

SEQ ID NO: 603006 - DNA, 25 bp, Mus musculus
ggatattcggataaccttgatctga

SEQ ID NO: 603007 - DNA, 25 bp, Mus musculus
ggatattcggattaccttgatctga

SEQ ID NO: 603008 - DNA, 25 bp, Mus musculus
ggatattcgttgcacacacggccaa

SEQ ID NO: 603009 - DNA, 25 bp, Mus musculus
ggatattcgttggacacacggccaa

SEQ ID NO: 603010 - DNA, 25 bp, Mus musculus
ggatattctcataccctaagtttat

SEQ ID NO: 603011 - DNA, 25 bp, Mus musculus
ggatattctcattccctaagtttat

SEQ ID NO: 603012 - DNA, 25 bp, Mus musculus
ggatattctgacatggaccggtacc

SEQ ID NO: 603013 - DNA, 25 bp, Mus musculus
ggatattctgacttggaccggtacc

SEQ ID NO: 603014 - DNA, 25 bp, Mus musculus
ggatattctgtgcttgactcctcag

SEQ ID NO: 603015 - DNA, 25 bp, Mus musculus
ggatattctgtggttgactcctcag

SEQ ID NO: 603016 - DNA, 25 bp, Mus musculus
ggatattctgttagccatgtccact

SEQ ID NO: 603017 - DNA, 25 bp, Mus musculus
ggatattctgtttgccatgtccact

SEQ ID NO: 603018 - DNA, 25 bp, Mus musculus
ggatattcttccagattccgagcca

SEQ ID NO: 603019 - DNA, 25 bp, Mus musculus
ggatattcttcctgattccgagcca

SEQ ID NO: 603020 - DNA, 25 bp, Mus musculus
ggatattctttactcttgcacatga

SEQ ID NO: 603021 - DNA, 25 bp, Mus musculus
ggatattctttagtcttgcacatga

SEQ ID NO: 603022 - DNA, 25 bp, Mus musculus
ggatattgaagcaatccaagctttt

SEQ ID NO: 603023 - DNA, 25 bp, Mus musculus
ggatattgaagctatccaagctttt

SEQ ID NO: 603024 - DNA, 25 bp, Mus musculus
ggatattgaccacctttacagggaa

SEQ ID NO: 603025 - DNA, 25 bp, Mus musculus
ggatattgaccagctttacagggaa

SEQ ID NO: 603026 - DNA, 25 bp, Mus musculus
ggatattgattacccctaaggacca

SEQ ID NO: 603027 - DNA, 25 bp, Mus musculus
ggatattgattagccctaaggacca

SEQ ID NO: 603028 - DNA, 25 bp, Mus musculus
ggatattgccgtaatcagcaactct

SEQ ID NO: 603029 - DNA, 25 bp, Mus musculus
ggatattgccgttatcagcaactct

SEQ ID NO: 603030 - DNA, 25 bp, Mus musculus
ggatattgcggtaagccagcatgct

SEQ ID NO: 603031 - DNA, 25 bp, Mus musculus
ggatattgcggttagccagcatgct

SEQ ID NO: 603032 - DNA, 25 bp, Mus musculus
ggatattggcagatcacagtggaca

SEQ ID NO: 603033 - DNA, 25 bp, Mus musculus
ggatattggcagttcacagtggaca

SEQ ID NO: 603034 - DNA, 25 bp, Mus musculus
ggatattgggtaactcgaccggtcc

SEQ ID NO: 603035 - DNA, 25 bp, Mus musculus
ggatattgggtatctcgaccggtcc

SEQ ID NO: 603036 - DNA, 25 bp, Mus musculus
ggatattgtagtctgtgaatgctca

SEQ ID NO: 603037 - DNA, 25 bp, Mus musculus
ggatattgtagtgtgtgaatgctca

SEQ ID NO: 603038 - DNA, 25 bp, Mus musculus
ggatattgtccacctcaaatgtcag

SEQ ID NO: 603039 - DNA, 25 bp, Mus musculus
ggatattgtccagctcaaatgtcag

SEQ ID NO: 603040 - DNA, 25 bp, Mus musculus
ggatattgttgtcgcttcacactta

SEQ ID NO: 603041 - DNA, 25 bp, Mus musculus
ggatattgttgtggcttcacactta

SEQ ID NO: 603042 - DNA, 25 bp, Mus musculus
ggatatttaagaaagctggatgctc

SEQ ID NO: 603043 - DNA, 25 bp, Mus musculus
ggatatttaagatagctggatgctc

SEQ ID NO: 603044 - DNA, 25 bp, Mus musculus
ggatatttactgatgtctgaatgct

SEQ ID NO: 603045 - DNA, 25 bp, Mus musculus
ggatatttactgcttctgtgttgtc

SEQ ID NO: 603046 - DNA, 25 bp, Mus musculus
ggatatttactggttctgtgttgtc

SEQ ID NO: 603047 - DNA, 25 bp, Mus musculus
ggatatttactgttgtctgaatgct

SEQ ID NO: 603048 - DNA, 25 bp, Mus musculus
ggatatttagtgagtccttgcccac

SEQ ID NO: 603049 - DNA, 25 bp, Mus musculus
ggatatttagtgtgtccttgcccac

SEQ ID NO: 603050 - DNA, 25 bp, Mus musculus
ggatatttatatagccatattctta

SEQ ID NO: 603051 - DNA, 25 bp, Mus musculus
ggatatttatattgccatattctta

SEQ ID NO: 603052 - DNA, 25 bp, Mus musculus
ggatatttatccctaggtcatgtac

SEQ ID NO: 603053 - DNA, 25 bp, Mus musculus
ggatatttatccgtaggtcatgtac

SEQ ID NO: 603054 - DNA, 25 bp, Mus musculus
ggatatttatttctgcatagtacta

SEQ ID NO: 603055 - DNA, 25 bp, Mus musculus
ggatatttatttgtgcatagtacta

SEQ ID NO: 603056 - DNA, 25 bp, Mus musculus
ggatatttcaaacacactgctacta

SEQ ID NO: 603057 - DNA, 25 bp, Mus musculus
ggatatttcaaagacactgctacta

SEQ ID NO: 603058 - DNA, 25 bp, Mus musculus
ggatatttcatcaggtcttctgtat

SEQ ID NO: 603059 - DNA, 25 bp, Mus musculus
ggatatttcatctggtcttctgtat

SEQ ID NO: 603060 - DNA, 25 bp, Mus musculus
ggatatttctctacattcctgaaac

SEQ ID NO: 603061 - DNA, 25 bp, Mus musculus
ggatatttctcttcattcctgaaac

SEQ ID NO: 603062 - DNA, 25 bp, Mus musculus
ggatatttctgcaaggctgacgact

SEQ ID NO: 603063 - DNA, 25 bp, Mus musculus
ggatatttctgctaggctgacgact

SEQ ID NO: 603064 - DNA, 25 bp, Mus musculus
ggatatttgaccagccattaaaaaa

SEQ ID NO: 603065 - DNA, 25 bp, Mus musculus
ggatatttgacctgccattaaaaaa

SEQ ID NO: 603066 - DNA, 25 bp, Mus musculus
ggatatttggtgaccttaaatgtag

SEQ ID NO: 603067 - DNA, 25 bp, Mus musculus
ggatatttggtgtccttaaatgtag

SEQ ID NO: 603068 - DNA, 25 bp, Mus musculus
ggatatttgtcaccctcaggaacga

SEQ ID NO: 603069 - DNA, 25 bp, Mus musculus
ggatatttgtcagcctcaggaacga

SEQ ID NO: 603070 - DNA, 25 bp, Mus musculus
ggatatttgtccacagccttattga

SEQ ID NO: 603071 - DNA, 25 bp, Mus musculus
ggatatttgtcctcagccttattga

SEQ ID NO: 603072 - DNA, 25 bp, Mus musculus
ggatatttgtcgacttctctttatg

SEQ ID NO: 603073 - DNA, 25 bp, Mus musculus
ggatatttgtcgtcttctctttatg

SEQ ID NO: 603074 - DNA, 25 bp, Mus musculus
ggatattttcatagcaagtgtacta

SEQ ID NO: 603075 - DNA, 25 bp, Mus musculus
ggatattttcattgcaagtgtacta

SEQ ID NO: 603076 - DNA, 25 bp, Mus musculus
ggatattttcccaggttcctctatg

SEQ ID NO: 603077 - DNA, 25 bp, Mus musculus
ggatattttccctggttcctctatg

SEQ ID NO: 603078 - DNA, 25 bp, Mus musculus
ggatattttcctatttagacctcag

SEQ ID NO: 603079 - DNA, 25 bp, Mus musculus
ggatattttcctttttagacctcag

SEQ ID NO: 603080 - DNA, 25 bp, Mus musculus
ggatattttcgtcctatagaacaaa

SEQ ID NO: 603081 - DNA, 25 bp, Mus musculus
ggatattttcgtgctatagaacaaa

SEQ ID NO: 603082 - DNA, 25 bp, Mus musculus
ggatattttctactaaagcatgctt

SEQ ID NO: 603083 - DNA, 25 bp, Mus musculus
ggatattttctagtaaagcatgctt

SEQ ID NO: 603084 - DNA, 25 bp, Mus musculus
ggatattttcttcgctgaactctac

SEQ ID NO: 603085 - DNA, 25 bp, Mus musculus
ggatattttcttggctgaactctac

SEQ ID NO: 603086 - DNA, 25 bp, Mus musculus
ggatattttggcactgggtataaca

SEQ ID NO: 603087 - DNA, 25 bp, Mus musculus
ggatattttggccacaatctcagaa

SEQ ID NO: 603088 - DNA, 25 bp, Mus musculus
ggatattttggcgacaatctcagaa

SEQ ID NO: 603089 - DNA, 25 bp, Mus musculus
ggatattttggctctgggtataaca

SEQ ID NO: 603090 - DNA, 25 bp, Mus musculus
ggatattttgtcactcagaactctt

SEQ ID NO: 603091 - DNA, 25 bp, Mus musculus
ggatattttgtctctcagaactctt

SEQ ID NO: 603092 - DNA, 25 bp, Mus musculus
ggatatttttaacacatcacattgg

SEQ ID NO: 603093 - DNA, 25 bp, Mus musculus
ggatatttttaagacatcacattgg

SEQ ID NO: 603094 - DNA, 25 bp, Mus musculus
ggatattttttcactatttccaatc

SEQ ID NO: 603095 - DNA, 25 bp, Mus musculus
ggatattttttctctatttccaatc

SEQ ID NO: 603096 - DNA, 25 bp, Mus musculus
ggatcaaaaccactttgatttggga

SEQ ID NO: 603097 - DNA, 25 bp, Mus musculus
ggatcaaaaccagtttgatttggga

SEQ ID NO: 603098 - DNA, 25 bp, Mus musculus
ggatcaaaatcaagaactgtgtaga

SEQ ID NO: 603099 - DNA, 25 bp, Mus musculus
ggatcaaaatcatgaactgtgtaga

SEQ ID NO: 603100 - DNA, 25 bp, Mus musculus
ggatcaaaatcccagtcttgcagta

SEQ ID NO: 603101 - DNA, 25 bp, Mus musculus
ggatcaaaatccgagtcttgcagta

SEQ ID NO: 603102 - DNA, 25 bp, Mus musculus
ggatcaaacatgagtcttcttgctt

SEQ ID NO: 603103 - DNA, 25 bp, Mus musculus
ggatcaaacatgtgtcttcttgctt

SEQ ID NO: 603104 - DNA, 25 bp, Mus musculus
ggatcaaacccacagtgtctgctct

SEQ ID NO: 603105 - DNA, 25 bp, Mus musculus
ggatcaaacccagagtgtctgctct

SEQ ID NO: 603106 - DNA, 25 bp, Mus musculus
ggatcaaacctaactgttccataaa

SEQ ID NO: 603107 - DNA, 25 bp, Mus musculus
ggatcaaacctatctgttccataaa

SEQ ID NO: 603108 - DNA, 25 bp, Mus musculus
ggatcaaaccttaccagtgtccaga

SEQ ID NO: 603109 - DNA, 25 bp, Mus musculus
ggatcaaacctttccagtgtccaga

SEQ ID NO: 603110 - DNA, 25 bp, Mus musculus
ggatcaaaggatctatccccctacc

SEQ ID NO: 603111 - DNA, 25 bp, Mus musculus
ggatcaaaggatgtatccccctacc

SEQ ID NO: 603112 - DNA, 25 bp, Mus musculus
ggatcaaaggctcaaggtatccttg

SEQ ID NO: 603113 - DNA, 25 bp, Mus musculus
ggatcaaaggctgaaggtatccttg

SEQ ID NO: 603114 - DNA, 25 bp, Mus musculus
ggatcaaaggtcaatgcgtggcaac

SEQ ID NO: 603115 - DNA, 25 bp, Mus musculus
ggatcaaaggtctatgcgtggcaac

SEQ ID NO: 603116 - DNA, 25 bp, Mus musculus
ggatcaaagttcctgttcaccttat

SEQ ID NO: 603117 - DNA, 25 bp, Mus musculus
ggatcaaagttcgtgttcaccttat

SEQ ID NO: 603118 - DNA, 25 bp, Mus musculus
ggatcaaatcccctggaattagagt

SEQ ID NO: 603119 - DNA, 25 bp, Mus musculus
ggatcaaatcccgtggaattagagt

SEQ ID NO: 603120 - DNA, 25 bp, Mus musculus
ggatcaaatctaccatggccagcat

SEQ ID NO: 603121 - DNA, 25 bp, Mus musculus
ggatcaaatctagcatggccagcat

SEQ ID NO: 603122 - DNA, 25 bp, Mus musculus
ggatcaaatcttccaagccattcag

SEQ ID NO: 603123 - DNA, 25 bp, Mus musculus
ggatcaaatcttgcaagccattcag

SEQ ID NO: 603124 - DNA, 25 bp, Mus musculus
ggatcaaatgcaacaaggctgccat

SEQ ID NO: 603125 - DNA, 25 bp, Mus musculus
ggatcaaatgcacctcactcatgaa

SEQ ID NO: 603126 - DNA, 25 bp, Mus musculus
ggatcaaatgcagctcactcatgaa

SEQ ID NO: 603127 - DNA, 25 bp, Mus musculus
ggatcaaatgcatcaaggctgccat

SEQ ID NO: 603128 - DNA, 25 bp, Mus musculus
ggatcaaatggcactttttcccttt

SEQ ID NO: 603129 - DNA, 25 bp, Mus musculus
ggatcaaatggctctttttcccttt

SEQ ID NO: 603130 - DNA, 25 bp, Mus musculus
ggatcaaattcacgtcgctaggcct

SEQ ID NO: 603131 - DNA, 25 bp, Mus musculus
ggatcaaattcaggtcgctaggcct

SEQ ID NO: 603132 - DNA, 25 bp, Mus musculus
ggatcaaattccatctaggtcagaa

SEQ ID NO: 603133 - DNA, 25 bp, Mus musculus
ggatcaaattccttctaggtcagaa

SEQ ID NO: 603134 - DNA, 25 bp, Mus musculus
ggatcaaattggagagattccattt

SEQ ID NO: 603135 - DNA, 25 bp, Mus musculus
ggatcaaattggtgagattccattt

SEQ ID NO: 603136 - DNA, 25 bp, Mus musculus
ggatcaaatttaattccaaccttgt

SEQ ID NO: 603137 - DNA, 25 bp, Mus musculus
ggatcaaatttatttccaaccttgt

SEQ ID NO: 603138 - DNA, 25 bp, Mus musculus
ggatcaacagacaacaccaggcaga

SEQ ID NO: 603139 - DNA, 25 bp, Mus musculus
ggatcaacagactacaccaggcaga

SEQ ID NO: 603140 - DNA, 25 bp, Mus musculus
ggatcaacagcccattcccatgatg

SEQ ID NO: 603141 - DNA, 25 bp, Mus musculus
ggatcaacagccgattcccatgatg

SEQ ID NO: 603142 - DNA, 25 bp, Mus musculus
ggatcaacatgaaattttttggcaa

SEQ ID NO: 603143 - DNA, 25 bp, Mus musculus
ggatcaacatgatattttttggcaa

SEQ ID NO: 603144 - DNA, 25 bp, Mus musculus
ggatcaacccacaggagtacctttg

SEQ ID NO: 603145 - DNA, 25 bp, Mus musculus
ggatcaacccactggagtacctttg

SEQ ID NO: 603146 - DNA, 25 bp, Mus musculus
ggatcaaccgacagctggaggcatt

SEQ ID NO: 603147 - DNA, 25 bp, Mus musculus
ggatcaaccgactgctggaggcatt

SEQ ID NO: 603148 - DNA, 25 bp, Mus musculus
ggatcaactcatcagaaactcagga

SEQ ID NO: 603149 - DNA, 25 bp, Mus musculus
ggatcaactcatgagaaactcagga

SEQ ID NO: 603150 - DNA, 25 bp, Mus musculus
ggatcaacttcaccaagcccgaggc

SEQ ID NO: 603151 - DNA, 25 bp, Mus musculus
ggatcaacttcagcaagcccgaggc

SEQ ID NO: 603152 - DNA, 25 bp, Mus musculus
ggatcaagaaccaggctagactttt

SEQ ID NO: 603153 - DNA, 25 bp, Mus musculus
ggatcaagaacctggctagactttt

SEQ ID NO: 603154 - DNA, 25 bp, Mus musculus
ggatcaagactgaattttgcttcaa

SEQ ID NO: 603155 - DNA, 25 bp, Mus musculus
ggatcaagactgtattttgcttcaa

SEQ ID NO: 603156 - DNA, 25 bp, Mus musculus
ggatcaagagtcaccctttgttaca

SEQ ID NO: 603157 - DNA, 25 bp, Mus musculus
ggatcaagagtctccctttgttaca

SEQ ID NO: 603158 - DNA, 25 bp, Mus musculus
ggatcaagcccacttcttctaagaa

SEQ ID NO: 603159 - DNA, 25 bp, Mus musculus
ggatcaagcccagttcttctaagaa

SEQ ID NO: 603160 - DNA, 25 bp, Mus musculus
ggatcaagcctacccaggacctttg

SEQ ID NO: 603161 - DNA, 25 bp, Mus musculus
ggatcaagcctagccaggacctttg

SEQ ID NO: 603162 - DNA, 25 bp, Mus musculus
ggatcaaggacgaggaccagctaga

SEQ ID NO: 603163 - DNA, 25 bp, Mus musculus
ggatcaaggacgctgccactatgaa

SEQ ID NO: 603164 - DNA, 25 bp, Mus musculus
ggatcaaggacggtgccactatgaa

SEQ ID NO: 603165 - DNA, 25 bp, Mus musculus
ggatcaaggacgtggaccagctaga

SEQ ID NO: 603166 - DNA, 25 bp, Mus musculus
ggatcaagggccacgtctgtagcac

SEQ ID NO: 603167 - DNA, 25 bp, Mus musculus
ggatcaagggcctcgtctgtagcac

SEQ ID NO: 603168 - DNA, 25 bp, Mus musculus
ggatcaagtgccccgagaccagaag

SEQ ID NO: 603169 - DNA, 25 bp, Mus musculus
ggatcaagtgccgcgagaccagaag

SEQ ID NO: 603170 - DNA, 25 bp, Mus musculus
ggatcaagtgtaactcttctttcat

SEQ ID NO: 603171 - DNA, 25 bp, Mus musculus
ggatcaagtgtatctcttctttcat

SEQ ID NO: 603172 - DNA, 25 bp, Mus musculus
ggatcaataaacattacctgcacag

SEQ ID NO: 603173 - DNA, 25 bp, Mus musculus
ggatcaataaactttacctgcacag

SEQ ID NO: 603174 - DNA, 25 bp, Mus musculus
ggatcaatacagctaaagccccagg

SEQ ID NO: 603175 - DNA, 25 bp, Mus musculus
ggatcaatacaggtaaagccccagg

SEQ ID NO: 603176 - DNA, 25 bp, Mus musculus
ggatcaatacccacaatatacaaag

SEQ ID NO: 603177 - DNA, 25 bp, Mus musculus
ggatcaataccctcaatatacaaag

SEQ ID NO: 603178 - DNA, 25 bp, Mus musculus
ggatcaatcagaacccctttaaaga

SEQ ID NO: 603179 - DNA, 25 bp, Mus musculus
ggatcaatcagatcccctttaaaga

SEQ ID NO: 603180 - DNA, 25 bp, Mus musculus
ggatcaatcagcacattgggcagct

SEQ ID NO: 603181 - DNA, 25 bp, Mus musculus
ggatcaatcagctcattgggcagct

SEQ ID NO: 603182 - DNA, 25 bp, Mus musculus
ggatcaatcccactctaatagcagt

SEQ ID NO: 603183 - DNA, 25 bp, Mus musculus
ggatcaatcccagtctaatagcagt

SEQ ID NO: 603184 - DNA, 25 bp, Mus musculus
ggatcaatcgttatgcttggccgaa

SEQ ID NO: 603185 - DNA, 25 bp, Mus musculus
ggatcaatcgttttgcttggccgaa

SEQ ID NO: 603186 - DNA, 25 bp, Mus musculus
ggatcaatctatagaacccatcttg

SEQ ID NO: 603187 - DNA, 25 bp, Mus musculus
ggatcaatctattgaacccatcttg

SEQ ID NO: 603188 - DNA, 25 bp, Mus musculus
ggatcaatgtgtagatgccattctt

SEQ ID NO: 603189 - DNA, 25 bp, Mus musculus
ggatcaatgtgttgatgccattctt

SEQ ID NO: 603190 - DNA, 25 bp, Mus musculus
ggatcaattacacccgcttccaaga

SEQ ID NO: 603191 - DNA, 25 bp, Mus musculus
ggatcaattacagccgcttccaaga

SEQ ID NO: 603192 - DNA, 25 bp, Mus musculus
ggatcaattcatcctttactaacca

SEQ ID NO: 603193 - DNA, 25 bp, Mus musculus
ggatcaattcatgctttactaacca

SEQ ID NO: 603194 - DNA, 25 bp, Mus musculus
ggatcaattctacaatcagaggcta

SEQ ID NO: 603195 - DNA, 25 bp, Mus musculus
ggatcaattctagaatcagaggcta

SEQ ID NO: 603196 - DNA, 25 bp, Mus musculus
ggatcaattgctcgttgtattttca

SEQ ID NO: 603197 - DNA, 25 bp, Mus musculus
ggatcaattgctggttgtattttca

SEQ ID NO: 603198 - DNA, 25 bp, Mus musculus
ggatcacaacttcctatgacattat

SEQ ID NO: 603199 - DNA, 25 bp, Mus musculus
ggatcacaacttgctatgacattat

SEQ ID NO: 603200 - DNA, 25 bp, Mus musculus
ggatcacaagcgctgttttgcacac

SEQ ID NO: 603201 - DNA, 25 bp, Mus musculus
ggatcacaagcggtgttttgcacac

SEQ ID NO: 603202 - DNA, 25 bp, Mus musculus
ggatcacaagtaaaaggccagctca

SEQ ID NO: 603203 - DNA, 25 bp, Mus musculus
ggatcacaagtataaggccagctca

SEQ ID NO: 603204 - DNA, 25 bp, Mus musculus
ggatcacaagtgcagcattctctaa

SEQ ID NO: 603205 - DNA, 25 bp, Mus musculus
ggatcacaagtggagcattctctaa

SEQ ID NO: 603206 - DNA, 25 bp, Mus musculus
ggatcacaattgaatatgtctcctc

SEQ ID NO: 603207 - DNA, 25 bp, Mus musculus
ggatcacaattgtatatgtctcctc

SEQ ID NO: 603208 - DNA, 25 bp, Mus musculus
ggatcacacaaaagtcacacaactc

SEQ ID NO: 603209 - DNA, 25 bp, Mus musculus
ggatcacacaaatgtcacacaactc

SEQ ID NO: 603210 - DNA, 25 bp, Mus musculus
ggatcacacattagcaagggaccac

SEQ ID NO: 603211 - DNA, 25 bp, Mus musculus
ggatcacacattcgagccttcatag

SEQ ID NO: 603212 - DNA, 25 bp, Mus musculus
ggatcacacattggagccttcatag

SEQ ID NO: 603213 - DNA, 25 bp, Mus musculus
ggatcacacatttgcaagggaccac

SEQ ID NO: 603214 - DNA, 25 bp, Mus musculus
ggatcacagaatacagtccttttgt

SEQ ID NO: 603215 - DNA, 25 bp, Mus musculus
ggatcacagaattcagtccttttgt

SEQ ID NO: 603216 - DNA, 25 bp, Mus musculus
ggatcacagcaaatgacccttgttg

SEQ ID NO: 603217 - DNA, 25 bp, Mus musculus
ggatcacagcaattgacccttgttg

SEQ ID NO: 603218 - DNA, 25 bp, Mus musculus
ggatcacagcagaaaggtaagtcta

SEQ ID NO: 603219 - DNA, 25 bp, Mus musculus
ggatcacagcagtaaggtaagtcta

SEQ ID NO: 603220 - DNA, 25 bp, Mus musculus
ggatcacagcctacacttgggagct

SEQ ID NO: 603221 - DNA, 25 bp, Mus musculus
ggatcacagccttcacttgggagct

SEQ ID NO: 603222 - DNA, 25 bp, Mus musculus
ggatcacagctcattgctctgtaaa

SEQ ID NO: 603223 - DNA, 25 bp, Mus musculus
ggatcacagctctttgctctgtaaa

SEQ ID NO: 603224 - DNA, 25 bp, Mus musculus
ggatcacatacaagtgcctgggctt

SEQ ID NO: 603225 - DNA, 25 bp, Mus musculus
ggatcacatacatgtgcctgggctt

SEQ ID NO: 603226 - DNA, 25 bp, Mus musculus
ggatcacatgttactcctttctgca

SEQ ID NO: 603227 - DNA, 25 bp, Mus musculus
ggatcacatgtttctcctttctgca

SEQ ID NO: 603228 - DNA, 25 bp, Mus musculus
ggatcacattctcaaaccacttcgg

SEQ ID NO: 603229 - DNA, 25 bp, Mus musculus
ggatcacattctgaaaccacttcgg

SEQ ID NO: 603230 - DNA, 25 bp, Mus musculus
ggatcaccaatgacatctcgtccac

SEQ ID NO: 603231 - DNA, 25 bp, Mus musculus
ggatcaccaatgtcatctcgtccac

SEQ ID NO: 603232 - DNA, 25 bp, Mus musculus
ggatcaccaggaatggtgcacatgg

SEQ ID NO: 603233 - DNA, 25 bp, Mus musculus
ggatcaccaggattggtgcacatgg

SEQ ID NO: 603234 - DNA, 25 bp, Mus musculus
ggatcaccatgcagaaactgacctt

SEQ ID NO: 603235 - DNA, 25 bp, Mus musculus
ggatcaccatgccttcaaggctgaa

SEQ ID NO: 603236 - DNA, 25 bp, Mus musculus
ggatcaccatgcgttcaaggctgaa

SEQ ID NO: 603237 - DNA, 25 bp, Mus musculus
ggatcaccatgctgaaactgacctt

SEQ ID NO: 603238 - DNA, 25 bp, Mus musculus
ggatcacccctcagccagaagggta

SEQ ID NO: 603239 - DNA, 25 bp, Mus musculus
ggatcacccctctgccagaagggta

SEQ ID NO: 603240 - DNA, 25 bp, Mus musculus
ggatcaccgaacaagacacagcatt

SEQ ID NO: 603241 - DNA, 25 bp, Mus musculus
ggatcaccgaactagacacagcatt

SEQ ID NO: 603242 - DNA, 25 bp, Mus musculus
ggatcaccgattacgtggcttacgt

SEQ ID NO: 603243 - DNA, 25 bp, Mus musculus
ggatcaccgatttcgtggcttacgt

SEQ ID NO: 603244 - DNA, 25 bp, Mus musculus
ggatcacctggtcgaggtcccgacc

SEQ ID NO: 603245 - DNA, 25 bp, Mus musculus
ggatcacctggtggaggtcccgacc

SEQ ID NO: 603246 - DNA, 25 bp, Mus musculus
ggatcaccttacagtacaaatcata

SEQ ID NO: 603247 - DNA, 25 bp, Mus musculus
ggatcaccttactgtacaaatcata

SEQ ID NO: 603248 - DNA, 25 bp, Mus musculus
ggatcacgaggaactgtccagcctg

SEQ ID NO: 603249 - DNA, 25 bp, Mus musculus
ggatcacgaggatctgtccagcctg

SEQ ID NO: 603250 - DNA, 25 bp, Mus musculus
ggatcacgagttcgaagccagctta

SEQ ID NO: 603251 - DNA, 25 bp, Mus musculus
ggatcacgagttggaagccagctta

SEQ ID NO: 603252 - DNA, 25 bp, Mus musculus
ggatcacggactcctatcgctgggt

SEQ ID NO: 603253 - DNA, 25 bp, Mus musculus
ggatcacggactgctatcgctgggt

SEQ ID NO: 603254 - DNA, 25 bp, Mus musculus
ggatcactcataacgtgtcccaggg

SEQ ID NO: 603255 - DNA, 25 bp, Mus musculus
ggatcactcatatcgtgtcccaggg

SEQ ID NO: 603256 - DNA, 25 bp, Mus musculus
ggatcactcatcacagacaatcttg

SEQ ID NO: 603257 - DNA, 25 bp, Mus musculus
ggatcactcatctcagacaatcttg

SEQ ID NO: 603258 - DNA, 25 bp, Mus musculus
ggatcactccatctggtttcatgcc

SEQ ID NO: 603259 - DNA, 25 bp, Mus musculus
ggatcactccatgtggtttcatgcc

SEQ ID NO: 603260 - DNA, 25 bp, Mus musculus
ggatcactcctgaatactatctagt

SEQ ID NO: 603261 - DNA, 25 bp, Mus musculus
ggatcactcctgtatactatctagt

SEQ ID NO: 603262 - DNA, 25 bp, Mus musculus
ggatcactcttaagacgcctacaaa

SEQ ID NO: 603263 - DNA, 25 bp, Mus musculus
ggatcactcttatgacgcctacaaa

SEQ ID NO: 603264 - DNA, 25 bp, Mus musculus
ggatcactgaacatccagttcaagt

SEQ ID NO: 603265 - DNA, 25 bp, Mus musculus
ggatcactgaacttccagttcaagt

SEQ ID NO: 603266 - DNA, 25 bp, Mus musculus
ggatcactgaatattgcccctggaa

SEQ ID NO: 603267 - DNA, 25 bp, Mus musculus
ggatcactgaattttgcccctggaa

SEQ ID NO: 603268 - DNA, 25 bp, Mus musculus
ggatcactgattcactggctcccat

SEQ ID NO: 603269 - DNA, 25 bp, Mus musculus
ggatcactgattcccacagatactc

SEQ ID NO: 603270 - DNA, 25 bp, Mus musculus
ggatcactgattgactggctcccat

SEQ ID NO: 603271 - DNA, 25 bp, Mus musculus
ggatcactgattgccacagatactc

SEQ ID NO: 603272 - DNA, 25 bp, Mus musculus
ggatcactgcaacaccaccctggtt

SEQ ID NO: 603273 - DNA, 25 bp, Mus musculus
ggatcactgcaagaccaccctggtt

SEQ ID NO: 603274 - DNA, 25 bp, Mus musculus
ggatcactgccaagtggcctgtagg

SEQ ID NO: 603275 - DNA, 25 bp, Mus musculus
ggatcactgccatgtggcctgtagg

SEQ ID NO: 603276 - DNA, 25 bp, Mus musculus
ggatcactggatatgcatttggcta

SEQ ID NO: 603277 - DNA, 25 bp, Mus musculus
ggatcactggatttgcatttggcta

SEQ ID NO: 603278 - DNA, 25 bp, Mus musculus
ggatcactggcaacccagatgtaca

SEQ ID NO: 603279 - DNA, 25 bp, Mus musculus
ggatcactggcatcccagatgtaca

SEQ ID NO: 603280 - DNA, 25 bp, Mus musculus
ggatcactgtatagactgttaaatt

SEQ ID NO: 603281 - DNA, 25 bp, Mus musculus
ggatcactgtattgactgttaaatt

SEQ ID NO: 603282 - DNA, 25 bp, Mus musculus
ggatcactgtgacacacgtgtgcct

SEQ ID NO: 603283 - DNA, 25 bp, Mus musculus
ggatcactgtgagacacgtgtgcct

SEQ ID NO: 603284 - DNA, 25 bp, Mus musculus
ggatcactgtgtacacattggccaa

SEQ ID NO: 603285 - DNA, 25 bp, Mus musculus
ggatcactgtgtctatgaggccagc

SEQ ID NO: 603286 - DNA, 25 bp, Mus musculus
ggatcactgtgtgtatgaggccagc

SEQ ID NO: 603287 - DNA, 25 bp, Mus musculus
ggatcactgtgttcacattggccaa

SEQ ID NO: 603288 - DNA, 25 bp, Mus musculus
ggatcacttactccctaatgctacc

SEQ ID NO: 603289 - DNA, 25 bp, Mus musculus
ggatcacttactgcctaatgctacc

SEQ ID NO: 603290 - DNA, 25 bp, Mus musculus
ggatcacttagaacaattgaggtgc

SEQ ID NO: 603291 - DNA, 25 bp, Mus musculus
ggatcacttagatcaattgaggtgc

SEQ ID NO: 603292 - DNA, 25 bp, Mus musculus
ggatcacttatgaacgccatcacat

SEQ ID NO: 603293 - DNA, 25 bp, Mus musculus
ggatcacttatgtacgccatcacat

SEQ ID NO: 603294 - DNA, 25 bp, Mus musculus
ggatcacttcctatagacccattgg

SEQ ID NO: 603295 - DNA, 25 bp, Mus musculus
ggatcacttcctttagacccattgg

SEQ ID NO: 603296 - DNA, 25 bp, Mus musculus
ggatcacttctgaatgtaacttttt

SEQ ID NO: 603297 - DNA, 25 bp, Mus musculus
ggatcacttctgtatgtaacttttt

SEQ ID NO: 603298 - DNA, 25 bp, Mus musculus
ggatcacttgagcccgggaagttca

SEQ ID NO: 603299 - DNA, 25 bp, Mus musculus
ggatcacttgaggccgggaagttca

SEQ ID NO: 603300 - DNA, 25 bp, Mus musculus
ggatcactttttactgactctagct

SEQ ID NO: 603301 - DNA, 25 bp, Mus musculus
ggatcacttttttctgactctagct

SEQ ID NO: 603302 - DNA, 25 bp, Mus musculus
ggatcagaagtgactggccaattca

SEQ ID NO: 603303 - DNA, 25 bp, Mus musculus
ggatcagaagtgtctggccaattca

SEQ ID NO: 603304 - DNA, 25 bp, Mus musculus
ggatcagaagttcaccctttgccac

SEQ ID NO: 603305 - DNA, 25 bp, Mus musculus
ggatcagaagttgaccctttgccac

SEQ ID NO: 603306 - DNA, 25 bp, Mus musculus
ggatcagaatgtccacacaaagttt

SEQ ID NO: 603307 - DNA, 25 bp, Mus musculus
ggatcagaatgtgcacacaaagttt

SEQ ID NO: 603308 - DNA, 25 bp, Mus musculus
ggatcagaattcacctgtcctgaca

SEQ ID NO: 603309 - DNA, 25 bp, Mus musculus
ggatcagaattctcctgtcctgaca

SEQ ID NO: 603310 - DNA, 25 bp, Mus musculus
ggatcagacattaccaggtcatgtt

SEQ ID NO: 603311 - DNA, 25 bp, Mus musculus
ggatcagacatttccaggtcatgtt

SEQ ID NO: 603312 - DNA, 25 bp, Mus musculus
ggatcagactgaagagtagcttcaa

SEQ ID NO: 603313 - DNA, 25 bp, Mus musculus
ggatcagactgatgagtagcttcaa

SEQ ID NO: 603314 - DNA, 25 bp, Mus musculus
ggatcagagccacaacctagactct

SEQ ID NO: 603315 - DNA, 25 bp, Mus musculus
ggatcagagccagaacctagactct

SEQ ID NO: 603316 - DNA, 25 bp, Mus musculus
ggatcagatcatccccaggatcacg

SEQ ID NO: 603317 - DNA, 25 bp, Mus musculus
ggatcagatcatgcccaggatcacg

SEQ ID NO: 603318 - DNA, 25 bp, Mus musculus
ggatcagatgaacggacaggccctc

SEQ ID NO: 603319 - DNA, 25 bp, Mus musculus
ggatcagatgaagggacaggccctc

SEQ ID NO: 603320 - DNA, 25 bp, Mus musculus
ggatcagatgcaagccaaacctagt

SEQ ID NO: 603321 - DNA, 25 bp, Mus musculus
ggatcagatgcatgccaaacctagt

SEQ ID NO: 603322 - DNA, 25 bp, Mus musculus
ggatcagatgccacatacggtcctt

SEQ ID NO: 603323 - DNA, 25 bp, Mus musculus
ggatcagatgcctcatacggtcctt

SEQ ID NO: 603324 - DNA, 25 bp, Mus musculus
ggatcagatgtgagccttaatattt

SEQ ID NO: 603325 - DNA, 25 bp, Mus musculus
ggatcagatgtgtgccttaatattt

SEQ ID NO: 603326 - DNA, 25 bp, Mus musculus
ggatcagattacaagcctgctgtgc

SEQ ID NO: 603327 - DNA, 25 bp, Mus musculus
ggatcagattactagcctgctgtgc

SEQ ID NO: 603328 - DNA, 25 bp, Mus musculus
ggatcagattgtacctaccccattg

SEQ ID NO: 603329 - DNA, 25 bp, Mus musculus
ggatcagattgttcctaccccattg

SEQ ID NO: 603330 - DNA, 25 bp, Mus musculus
ggatcagcagacctaggcatcatgg

SEQ ID NO: 603331 - DNA, 25 bp, Mus musculus
ggatcagcagacgtaggcatcatgg

SEQ ID NO: 603332 - DNA, 25 bp, Mus musculus
ggatcagcagccacacgaggtttat

SEQ ID NO: 603333 - DNA, 25 bp, Mus musculus
ggatcagcagcctcacgaggtttat

SEQ ID NO: 603334 - DNA, 25 bp, Mus musculus
ggatcagcaggcaaccttgtttcca

SEQ ID NO: 603335 - DNA, 25 bp, Mus musculus
ggatcagcaggctaccttgtttcca

SEQ ID NO: 603336 - DNA, 25 bp, Mus musculus
ggatcagcagttcgaggagctatat

SEQ ID NO: 603337 - DNA, 25 bp, Mus musculus
ggatcagcagttggaggagctatat

SEQ ID NO: 603338 - DNA, 25 bp, Mus musculus
ggatcagccctgcacaagagatttc

SEQ ID NO: 603339 - DNA, 25 bp, Mus musculus
ggatcagccctggacaagagatttc

SEQ ID NO: 603340 - DNA, 25 bp, Mus musculus
ggatcagccgatatcgaaggtgctt

SEQ ID NO: 603341 - DNA, 25 bp, Mus musculus
ggatcagccgatttcgaaggtgctt

SEQ ID NO: 603342 - DNA, 25 bp, Mus musculus
ggatcagcgcttctgtacgcagtac

SEQ ID NO: 603343 - DNA, 25 bp, Mus musculus
ggatcagcgcttgtgtacgcagtac

SEQ ID NO: 603344 - DNA, 25 bp, Mus musculus
ggatcagctatgagaagaccctgga

SEQ ID NO: 603345 - DNA, 25 bp, Mus musculus
ggatcagctatgtgaagaccctgga

SEQ ID NO: 603346 - DNA, 25 bp, Mus musculus
ggatcagctcccagaatgcatgcag

SEQ ID NO: 603347 - DNA, 25 bp, Mus musculus
ggatcagctccctgaatgcatgcag

SEQ ID NO: 603348 - DNA, 25 bp, Mus musculus
ggatcagctcgtcgcaaactgctca

SEQ ID NO: 603349 - DNA, 25 bp, Mus musculus
ggatcagctcgtggcaaactgctca

SEQ ID NO: 603350 - DNA, 25 bp, Mus musculus
ggatcagctttcagtcctgtaaaac

SEQ ID NO: 603351 - DNA, 25 bp, Mus musculus
ggatcagctttctgtcctgtaaaac

SEQ ID NO: 603352 - DNA, 25 bp, Mus musculus
ggatcaggaacacaatattctctca

SEQ ID NO: 603353 - DNA, 25 bp, Mus musculus
ggatcaggaacagaatattctctca

SEQ ID NO: 603354 - DNA, 25 bp, Mus musculus
ggatcaggaccactggatgatctag

SEQ ID NO: 603355 - DNA, 25 bp, Mus musculus
ggatcaggaccagtggatgatctag

SEQ ID NO: 603356 - DNA, 25 bp, Mus musculus
ggatcaggacttcaggctacatcgc

SEQ ID NO: 603357 - DNA, 25 bp, Mus musculus
ggatcaggacttgaggctacatcgc

SEQ ID NO: 603358 - DNA, 25 bp, Mus musculus
ggatcaggccacacaacttgggaag

SEQ ID NO: 603359 - DNA, 25 bp, Mus musculus
ggatcaggccactcaacttgggaag

SEQ ID NO: 603360 - DNA, 25 bp, Mus musculus
ggatcaggccagaagatatcagtta

SEQ ID NO: 603361 - DNA, 25 bp, Mus musculus
ggatcaggccagtagatatcagtta

SEQ ID NO: 603362 - DNA, 25 bp, Mus musculus
ggatcaggccctcattgcagtgagc

SEQ ID NO: 603363 - DNA, 25 bp, Mus musculus
ggatcaggccctgattgcagtgagc

SEQ ID NO: 603364 - DNA, 25 bp, Mus musculus
ggatcagggcagactgtgcacgtca

SEQ ID NO: 603365 - DNA, 25 bp, Mus musculus
ggatcagggcagtctgtgcacgtca

SEQ ID NO: 603366 - DNA, 25 bp, Mus musculus
ggatcagggccaagaccttccatgg

SEQ ID NO: 603367 - DNA, 25 bp, Mus musculus
ggatcagggccatgaccttccatgg

SEQ ID NO: 603368 - DNA, 25 bp, Mus musculus
ggatcaggtacaccagtgcctctca

SEQ ID NO: 603369 - DNA, 25 bp, Mus musculus
ggatcaggtacagcagtgcctctca

SEQ ID NO: 603370 - DNA, 25 bp, Mus musculus
ggatcaggttctctttaagcctcca

SEQ ID NO: 603371 - DNA, 25 bp, Mus musculus
ggatcaggttctgtttaagcctcca

SEQ ID NO: 603372 - DNA, 25 bp, Mus musculus
ggatcagtaaataccctgtgcactc

SEQ ID NO: 603373 - DNA, 25 bp, Mus musculus
ggatcagtaaattccctgtgcactc

SEQ ID NO: 603374 - DNA, 25 bp, Mus musculus
ggatcagtaacaaccatggcaagta

SEQ ID NO: 603375 - DNA, 25 bp, Mus musculus
ggatcagtaacatccatggcaagta

SEQ ID NO: 603376 - DNA, 25 bp, Mus musculus
ggatcagtattactcctcgttttac

SEQ ID NO: 603377 - DNA, 25 bp, Mus musculus
ggatcagtattagtcctcgttttac

SEQ ID NO: 603378 - DNA, 25 bp, Mus musculus
ggatcagtccccattgtctgaaaag

SEQ ID NO: 603379 - DNA, 25 bp, Mus musculus
ggatcagtcccctttgtctgaaaag

SEQ ID NO: 603380 - DNA, 25 bp, Mus musculus
ggatcagtctctccagcctttgtca

SEQ ID NO: 603381 - DNA, 25 bp, Mus musculus
ggatcagtctctgcagcctttgtca

SEQ ID NO: 603382 - DNA, 25 bp, Mus musculus
ggatcagtgcaacctgcagctatat

SEQ ID NO: 603383 - DNA, 25 bp, Mus musculus
ggatcagtgcaagctgcagctatat

SEQ ID NO: 603384 - DNA, 25 bp, Mus musculus
ggatcagtggtacagtgtttgcctt

SEQ ID NO: 603385 - DNA, 25 bp, Mus musculus
ggatcagtggtagagtgtttgcctt

SEQ ID NO: 603386 - DNA, 25 bp, Mus musculus
ggatcagtggtgacataaccctcac

SEQ ID NO: 603387 - DNA, 25 bp, Mus musculus
ggatcagtggtgtcataaccctcac

SEQ ID NO: 603388 - DNA, 25 bp, Mus musculus
ggatcagtgtatcacgtatctccca

SEQ ID NO: 603389 - DNA, 25 bp, Mus musculus
ggatcagtgtatgacgtatctccca

SEQ ID NO: 603390 - DNA, 25 bp, Mus musculus
ggatcagtgtgcagacttcgtccat

SEQ ID NO: 603391 - DNA, 25 bp, Mus musculus
ggatcagtgtgctgacttcgtccat

SEQ ID NO: 603392 - DNA, 25 bp, Mus musculus
ggatcagttcaacgcatcactacca

SEQ ID NO: 603393 - DNA, 25 bp, Mus musculus
ggatcagttcaaggcatcactacca

SEQ ID NO: 603394 - DNA, 25 bp, Mus musculus
ggatcagttcgacaggcgtgcatct

SEQ ID NO: 603395 - DNA, 25 bp, Mus musculus
ggatcagttcgagaggcgtgcatct

SEQ ID NO: 603396 - DNA, 25 bp, Mus musculus
ggatcagttctactccttggtaggc

SEQ ID NO: 603397 - DNA, 25 bp, Mus musculus
ggatcagttctagtccttggtaggc

SEQ ID NO: 603398 - DNA, 25 bp, Mus musculus
ggatcagttctcattgcgcgaaaat

SEQ ID NO: 603399 - DNA, 25 bp, Mus musculus
ggatcagttctctttgcgcgaaaat

SEQ ID NO: 603400 - DNA, 25 bp, Mus musculus
ggatcagttggtctgttctccatgt

SEQ ID NO: 603401 - DNA, 25 bp, Mus musculus
ggatcagttggtgtgttctccatgt

SEQ ID NO: 603402 - DNA, 25 bp, Mus musculus
ggatcataaagcattgtagataata

SEQ ID NO: 603403 - DNA, 25 bp, Mus musculus
ggatcataaagctttgtagataata

SEQ ID NO: 603404 - DNA, 25 bp, Mus musculus
ggatcataatacagtatccctgtgc

SEQ ID NO: 603405 - DNA, 25 bp, Mus musculus
ggatcataatactgtatccctgtgc

SEQ ID NO: 603406 - DNA, 25 bp, Mus musculus
ggatcataattcctttgcctgctgg

SEQ ID NO: 603407 - DNA, 25 bp, Mus musculus
ggatcataattcgtttgcctgctgg

SEQ ID NO: 603408 - DNA, 25 bp, Mus musculus
ggatcatacaatatctatagagctt

SEQ ID NO: 603409 - DNA, 25 bp, Mus musculus
ggatcatacaatttctatagagctt

SEQ ID NO: 603410 - DNA, 25 bp, Mus musculus
ggatcatacctaaaaccccagtatt

SEQ ID NO: 603411 - DNA, 25 bp, Mus musculus
ggatcatacctataaccccagtatt

SEQ ID NO: 603412 - DNA, 25 bp, Mus musculus
ggatcatacggcagatgtccagtta

SEQ ID NO: 603413 - DNA, 25 bp, Mus musculus
ggatcatacggctgatgtccagtta

SEQ ID NO: 603414 - DNA, 25 bp, Mus musculus
ggatcataggcaaatcagttacctt

SEQ ID NO: 603415 - DNA, 25 bp, Mus musculus
ggatcataggcatatcagttacctt

SEQ ID NO: 603416 - DNA, 25 bp, Mus musculus
ggatcataggctcttttgaagggaa

SEQ ID NO: 603417 - DNA, 25 bp, Mus musculus
ggatcataggctgttttgaagggaa

SEQ ID NO: 603418 - DNA, 25 bp, Mus musculus
ggatcatcaaggctgcaccctcctg

SEQ ID NO: 603419 - DNA, 25 bp, Mus musculus
ggatcatcaagggtgcaccctcctg

SEQ ID NO: 603420 - DNA, 25 bp, Mus musculus
ggatcatcaatccttgtggcacaga

SEQ ID NO: 603421 - DNA, 25 bp, Mus musculus
ggatcatcaatcgttgtggcacaga

SEQ ID NO: 603422 - DNA, 25 bp, Mus musculus
ggatcatcaccgctgcaaaccactg

SEQ ID NO: 603423 - DNA, 25 bp, Mus musculus
ggatcatcaccggtgcaaaccactg

SEQ ID NO: 603424 - DNA, 25 bp, Mus musculus
ggatcatccaagctgttgtaaatac

SEQ ID NO: 603425 - DNA, 25 bp, Mus musculus
ggatcatccaaggtgttgtaaatac

SEQ ID NO: 603426 - DNA, 25 bp, Mus musculus
ggatcatccaccaacaacaatgagg

SEQ ID NO: 603427 - DNA, 25 bp, Mus musculus
ggatcatccaccaggagtgcagaat

SEQ ID NO: 603428 - DNA, 25 bp, Mus musculus
ggatcatccacctacaacaatgagg

SEQ ID NO: 603429 - DNA, 25 bp, Mus musculus
ggatcatccacctggagtgcagaat

SEQ ID NO: 603430 - DNA, 25 bp, Mus musculus
ggatcatccagaatatttgtacaga

SEQ ID NO: 603431 - DNA, 25 bp, Mus musculus
ggatcatccagattatttgtacaga

SEQ ID NO: 603432 - DNA, 25 bp, Mus musculus
ggatcatccagtatacactgcagtt

SEQ ID NO: 603433 - DNA, 25 bp, Mus musculus
ggatcatccagtttacactgcagtt

SEQ ID NO: 603434 - DNA, 25 bp, Mus musculus
ggatcatccccacgtgggattcgat

SEQ ID NO: 603435 - DNA, 25 bp, Mus musculus
ggatcatccccaggtgggattcgat

SEQ ID NO: 603436 - DNA, 25 bp, Mus musculus
ggatcatcggttatcttcctattac

SEQ ID NO: 603437 - DNA, 25 bp, Mus musculus
ggatcatcggttttcttcctattac

SEQ ID NO: 603438 - DNA, 25 bp, Mus musculus
ggatcatctcctaagagttcattgt

SEQ ID NO: 603439 - DNA, 25 bp, Mus musculus
ggatcatctccttagagttcattgt

SEQ ID NO: 603440 - DNA, 25 bp, Mus musculus
ggatcatctttcaatggctccccaa

SEQ ID NO: 603441 - DNA, 25 bp, Mus musculus
ggatcatctttctatggctccccaa

SEQ ID NO: 603442 - DNA, 25 bp, Mus musculus
ggatcatgacccatagactcagcaa

SEQ ID NO: 603443 - DNA, 25 bp, Mus musculus
ggatcatgacccttagactcagcaa

SEQ ID NO: 603444 - DNA, 25 bp, Mus musculus
ggatcatgacctagaggctcagctc

SEQ ID NO: 603445 - DNA, 25 bp, Mus musculus
ggatcatgaccttgaggctcagctc

SEQ ID NO: 603446 - DNA, 25 bp, Mus musculus
ggatcatgacggagctcctcaagca

SEQ ID NO: 603447 - DNA, 25 bp, Mus musculus
ggatcatgacggtgctcctcaagca

SEQ ID NO: 603448 - DNA, 25 bp, Mus musculus
ggatcatgagacaagtgaacacact

SEQ ID NO: 603449 - DNA, 25 bp, Mus musculus
ggatcatgagactagtgaacacact

SEQ ID NO: 603450 - DNA, 25 bp, Mus musculus
ggatcatgagtgacaacatcttttg

SEQ ID NO: 603451 - DNA, 25 bp, Mus musculus
ggatcatgagtgtcaacatcttttg

SEQ ID NO: 603452 - DNA, 25 bp, Mus musculus
ggatcatgatagaggcttcttggaa

SEQ ID NO: 603453 - DNA, 25 bp, Mus musculus
ggatcatgatagtggcttcttggaa

SEQ ID NO: 603454 - DNA, 25 bp, Mus musculus
ggatcatgatgccaacctcttacgt

SEQ ID NO: 603455 - DNA, 25 bp, Mus musculus
ggatcatgatgcgaacctcttacgt

SEQ ID NO: 603456 - DNA, 25 bp, Mus musculus
ggatcatgatttccgagctacttta

SEQ ID NO: 603457 - DNA, 25 bp, Mus musculus
ggatcatgatttgcgagctacttta

SEQ ID NO: 603458 - DNA, 25 bp, Mus musculus
ggatcatgccgtcaatccactgtac

SEQ ID NO: 603459 - DNA, 25 bp, Mus musculus
ggatcatgccgtgaatccactgtac

SEQ ID NO: 603460 - DNA, 25 bp, Mus musculus
ggatcatgccttacacccctgtact

SEQ ID NO: 603461 - DNA, 25 bp, Mus musculus
ggatcatgcctttcacccctgtact

SEQ ID NO: 603462 - DNA, 25 bp, Mus musculus
ggatcatgctctacttctcatatct

SEQ ID NO: 603463 - DNA, 25 bp, Mus musculus
ggatcatgctcttcttctcatatct

SEQ ID NO: 603464 - DNA, 25 bp, Mus musculus
ggatcatggacgacctcgtctgcaa

SEQ ID NO: 603465 - DNA, 25 bp, Mus musculus
ggatcatggacgtcctcgtctgcaa

SEQ ID NO: 603466 - DNA, 25 bp, Mus musculus
ggatcatggcatatagttagtaaca

SEQ ID NO: 603467 - DNA, 25 bp, Mus musculus
ggatcatggcatttagttagtaaca

SEQ ID NO: 603468 - DNA, 25 bp, Mus musculus
ggatcatggcccaggttgcagctta

SEQ ID NO: 603469 - DNA, 25 bp, Mus musculus
ggatcatggccctggttgcagctta

SEQ ID NO: 603470 - DNA, 25 bp, Mus musculus
ggatcatgggacatccatcttagtt

SEQ ID NO: 603471 - DNA, 25 bp, Mus musculus
ggatcatgggacttccatcttagtt

SEQ ID NO: 603472 - DNA, 25 bp, Mus musculus
ggatcatgtcatcacaaaagtaatt

SEQ ID NO: 603473 - DNA, 25 bp, Mus musculus
ggatcatgtcatgacaaaagtaatt

SEQ ID NO: 603474 - DNA, 25 bp, Mus musculus
ggatcatgtgaactccttagtaaca

SEQ ID NO: 603475 - DNA, 25 bp, Mus musculus
ggatcatgtgaagtccttagtaaca

SEQ ID NO: 603476 - DNA, 25 bp, Mus musculus
ggatcatgttccaggaggtcacgcc

SEQ ID NO: 603477 - DNA, 25 bp, Mus musculus
ggatcatgttcctggaggtcacgcc

SEQ ID NO: 603478 - DNA, 25 bp, Mus musculus
ggatcattacctaactccacttata

SEQ ID NO: 603479 - DNA, 25 bp, Mus musculus
ggatcattaccttactccacttata

SEQ ID NO: 603480 - DNA, 25 bp, Mus musculus
ggatcattatctaaacggcctattt

SEQ ID NO: 603481 - DNA, 25 bp, Mus musculus
ggatcattatcttaacggcctattt

SEQ ID NO: 603482 - DNA, 25 bp, Mus musculus
ggatcattcaccaacatcatggcta

SEQ ID NO: 603483 - DNA, 25 bp, Mus musculus
ggatcattcacctacatcatggcta

SEQ ID NO: 603484 - DNA, 25 bp, Mus musculus
ggatcattcagaagtcacctttctt

SEQ ID NO: 603485 - DNA, 25 bp, Mus musculus
ggatcattcagatgtcacctttctt

SEQ ID NO: 603486 - DNA, 25 bp, Mus musculus
ggatcattcatcaataaacacctgc

SEQ ID NO: 603487 - DNA, 25 bp, Mus musculus
ggatcattcatccactggcgggcat

SEQ ID NO: 603488 - DNA, 25 bp, Mus musculus
ggatcattcatcgactggcgggcat

SEQ ID NO: 603489 - DNA, 25 bp, Mus musculus
ggatcattcatctataaacacctgc

SEQ ID NO: 603490 - DNA, 25 bp, Mus musculus
ggatcattcattacatcgcaagcga

SEQ ID NO: 603491 - DNA, 25 bp, Mus musculus
ggatcattcatttcatcgcaagcga

SEQ ID NO: 603492 - DNA, 25 bp, Mus musculus
ggatcattcgggatcttcgacactt

SEQ ID NO: 603493 - DNA, 25 bp, Mus musculus
ggatcattcgggttcttcgacactt

SEQ ID NO: 603494 - DNA, 25 bp, Mus musculus
ggatcattctggatcctgtctgtac

SEQ ID NO: 603495 - DNA, 25 bp, Mus musculus
ggatcattctggttcctgtctgtac

SEQ ID NO: 603496 - DNA, 25 bp, Mus musculus
ggatcattgactcccagatttccaa

SEQ ID NO: 603497 - DNA, 25 bp, Mus musculus
ggatcattgactgccagatttccaa

SEQ ID NO: 603498 - DNA, 25 bp, Mus musculus
ggatcattgcctacttaggaacgtg

SEQ ID NO: 603499 - DNA, 25 bp, Mus musculus
ggatcattgccttcttaggaacgtg

SEQ ID NO: 603500 - DNA, 25 bp, Mus musculus
ggatcattgtctccttcatgtgcag

SEQ ID NO: 603501 - DNA, 25 bp, Mus musculus
ggatcattgtctgcttcatgtgcag

SEQ ID NO: 603502 - DNA, 25 bp, Mus musculus
ggatcatttatgagcccttaccgga

SEQ ID NO: 603503 - DNA, 25 bp, Mus musculus
ggatcatttatgtgcccttaccgga

SEQ ID NO: 603504 - DNA, 25 bp, Mus musculus
ggatcatttcagatcttcctccaga

SEQ ID NO: 603505 - DNA, 25 bp, Mus musculus
ggatcatttcagttcttcctccaga

SEQ ID NO: 603506 - DNA, 25 bp, Mus musculus
ggatcatttccacaacaagtacact

SEQ ID NO: 603507 - DNA, 25 bp, Mus musculus
ggatcatttccagaacaagtacact

SEQ ID NO: 603508 - DNA, 25 bp, Mus musculus
ggatcattttagcttcattattttt

SEQ ID NO: 603509 - DNA, 25 bp, Mus musculus
ggatcattttaggttcattattttt

SEQ ID NO: 603510 - DNA, 25 bp, Mus musculus
ggatcattttgaatcacctgcatga

SEQ ID NO: 603511 - DNA, 25 bp, Mus musculus
ggatcattttgattcacctgcatga

SEQ ID NO: 603512 - DNA, 25 bp, Mus musculus
ggatcattttgcaatactctcttaa

SEQ ID NO: 603513 - DNA, 25 bp, Mus musculus
ggatcattttgctatactctcttaa

SEQ ID NO: 603514 - DNA, 25 bp, Mus musculus
ggatccaaacccagccagtggaagc

SEQ ID NO: 603515 - DNA, 25 bp, Mus musculus
ggatccaaaccctgccagtggaagc

SEQ ID NO: 603516 - DNA, 25 bp, Mus musculus
ggatccaaagatcaaccacacattc

SEQ ID NO: 603517 - DNA, 25 bp, Mus musculus
ggatccaaagatgaaccacacattc

SEQ ID NO: 603518 - DNA, 25 bp, Mus musculus
ggatccaaagcaacacttcagtgtt

SEQ ID NO: 603519 - DNA, 25 bp, Mus musculus
ggatccaaagcatcacttcagtgtt

SEQ ID NO: 603520 - DNA, 25 bp, Mus musculus
ggatccaaaggactatcaccttcct

SEQ ID NO: 603521 - DNA, 25 bp, Mus musculus
ggatccaaaggagtatcaccttcct

SEQ ID NO: 603522 - DNA, 25 bp, Mus musculus
ggatccaaagtacaaggcttgccgc

SEQ ID NO: 603523 - DNA, 25 bp, Mus musculus
ggatccaaagtagaaggcttgccgc

SEQ ID NO: 603524 - DNA, 25 bp, Mus musculus
ggatccaaatgcctttctttttgac

SEQ ID NO: 603525 - DNA, 25 bp, Mus musculus
ggatccaaatgcgtttctttttgac

SEQ ID NO: 603526 - DNA, 25 bp, Mus musculus
ggatccaacattattcctcatgata

SEQ ID NO: 603527 - DNA, 25 bp, Mus musculus
ggatccaacatttttcctcatgata

SEQ ID NO: 603528 - DNA, 25 bp, Mus musculus
ggatccaaccacagtgtgccccaga

SEQ ID NO: 603529 - DNA, 25 bp, Mus musculus
ggatccaaccactgtgtgccccaga

SEQ ID NO: 603530 - DNA, 25 bp, Mus musculus
ggatccaaccttatgggtcactgag

SEQ ID NO: 603531 - DNA, 25 bp, Mus musculus
ggatccaaccttttgggtcactgag

SEQ ID NO: 603532 - DNA, 25 bp, Mus musculus
ggatccaactgactggctagccaga

SEQ ID NO: 603533 - DNA, 25 bp, Mus musculus
ggatccaactgagtggctagccaga

SEQ ID NO: 603534 - DNA, 25 bp, Mus musculus
ggatccaacttgaggaccggaacac

SEQ ID NO: 603535 - DNA, 25 bp, Mus musculus
ggatccaacttgtggaccggaacac

SEQ ID NO: 603536 - DNA, 25 bp, Mus musculus
ggatccaagaacacctgctgggaag

SEQ ID NO: 603537 - DNA, 25 bp, Mus musculus
ggatccaagaactcctgctgggaag

SEQ ID NO: 603538 - DNA, 25 bp, Mus musculus
ggatccaagaccacctgttgctggg

SEQ ID NO: 603539 - DNA, 25 bp, Mus musculus
ggatccaagacctcctgttgctggg

SEQ ID NO: 603540 - DNA, 25 bp, Mus musculus
ggatccaagcacaatgacttcttct

SEQ ID NO: 603541 - DNA, 25 bp, Mus musculus
ggatccaagcactatgacttcttct

SEQ ID NO: 603542 - DNA, 25 bp, Mus musculus
ggatccaagccaagtacagaccata

SEQ ID NO: 603543 - DNA, 25 bp, Mus musculus
ggatccaagccatgtacagaccata

SEQ ID NO: 603544 - DNA, 25 bp, Mus musculus
ggatccaagtgcagaatacccttag

SEQ ID NO: 603545 - DNA, 25 bp, Mus musculus
ggatccaagtgctgaatacccttag

SEQ ID NO: 603546 - DNA, 25 bp, Mus musculus
ggatccaataggcaagctggagcac

SEQ ID NO: 603547 - DNA, 25 bp, Mus musculus
ggatccaatagggaagctggagcac

SEQ ID NO: 603548 - DNA, 25 bp, Mus musculus
ggatccaatttgagtcctatataca

SEQ ID NO: 603549 - DNA, 25 bp, Mus musculus
ggatccaatttgtgtcctatataca

SEQ ID NO: 603550 - DNA, 25 bp, Mus musculus
ggatccacaagacgcgtcggtcatg

SEQ ID NO: 603551 - DNA, 25 bp, Mus musculus
ggatccacaagaggcgtcggtcatg

SEQ ID NO: 603552 - DNA, 25 bp, Mus musculus
ggatccacagcaatcatgtacttaa

SEQ ID NO: 603553 - DNA, 25 bp, Mus musculus
ggatccacagcattcatgtacttaa

SEQ ID NO: 603554 - DNA, 25 bp, Mus musculus
ggatccacatggatccttgggagtt

SEQ ID NO: 603555 - DNA, 25 bp, Mus musculus
ggatccacatggttccttgggagtt

SEQ ID NO: 603556 - DNA, 25 bp, Mus musculus
ggatccacatttatcctaagtatct

SEQ ID NO: 603557 - DNA, 25 bp, Mus musculus
ggatccacatttttcctaagtatct

SEQ ID NO: 603558 - DNA, 25 bp, Mus musculus
ggatccaccaccaaagtaccttatg

SEQ ID NO: 603559 - DNA, 25 bp, Mus musculus
ggatccaccacctaagtaccttatg

SEQ ID NO: 603560 - DNA, 25 bp, Mus musculus
ggatccacgggtactgctccactga

SEQ ID NO: 603561 - DNA, 25 bp, Mus musculus
ggatccacgggttctgctccactga

SEQ ID NO: 603562 - DNA, 25 bp, Mus musculus
ggatccactccacatagagtatgca

SEQ ID NO: 603563 - DNA, 25 bp, Mus musculus
ggatccactccagatagagtatgca

SEQ ID NO: 603564 - DNA, 25 bp, Mus musculus
ggatccactgtgatgaagactcttg

SEQ ID NO: 603565 - DNA, 25 bp, Mus musculus
ggatccactgtgctgacggctctgt

SEQ ID NO: 603566 - DNA, 25 bp, Mus musculus
ggatccactgtggtgacggctctgt

SEQ ID NO: 603567 - DNA, 25 bp, Mus musculus
ggatccactgtgttgaagactcttg

SEQ ID NO: 603568 - DNA, 25 bp, Mus musculus
ggatccactgttccatttggagcac

SEQ ID NO: 603569 - DNA, 25 bp, Mus musculus
ggatccactgttgcatttggagcac

SEQ ID NO: 603570 - DNA, 25 bp, Mus musculus
ggatccacttgacccaaacctggat

SEQ ID NO: 603571 - DNA, 25 bp, Mus musculus
ggatccacttgagccaaacctggat

SEQ ID NO: 603572 - DNA, 25 bp, Mus musculus
ggatccagaagactcagctgtctat

SEQ ID NO: 603573 - DNA, 25 bp, Mus musculus
ggatccagaagagtcagctgtctat

SEQ ID NO: 603574 - DNA, 25 bp, Mus musculus
ggatccagacacacttctttgtgat

SEQ ID NO: 603575 - DNA, 25 bp, Mus musculus
ggatccagacactcttctttgtgat

SEQ ID NO: 603576 - DNA, 25 bp, Mus musculus
ggatccagacatactgtgttcctga

SEQ ID NO: 603577 - DNA, 25 bp, Mus musculus
ggatccagacattctgtgttcctga

SEQ ID NO: 603578 - DNA, 25 bp, Mus musculus
ggatccagagcccaattcaaaagac

SEQ ID NO: 603579 - DNA, 25 bp, Mus musculus
ggatccagagccgaattcaaaagac

SEQ ID NO: 603580 - DNA, 25 bp, Mus musculus
ggatccagagctcataatgactgct

SEQ ID NO: 603581 - DNA, 25 bp, Mus musculus
ggatccagagctgataatgactgct

SEQ ID NO: 603582 - DNA, 25 bp, Mus musculus
ggatccagagggaaggcctgccctt

SEQ ID NO: 603583 - DNA, 25 bp, Mus musculus
ggatccagagggtaggcctgccctt

SEQ ID NO: 603584 - DNA, 25 bp, Mus musculus
ggatccagcaagaagcagcctttct

SEQ ID NO: 603585 - DNA, 25 bp, Mus musculus
ggatccagcaagtagcagcctttct

SEQ ID NO: 603586 - DNA, 25 bp, Mus musculus
ggatccagccatcatgtttttatat

SEQ ID NO: 603587 - DNA, 25 bp, Mus musculus
ggatccagccatgatgtttttatat

SEQ ID NO: 603588 - DNA, 25 bp, Mus musculus
ggatccagctctctatgcttatcag

SEQ ID NO: 603589 - DNA, 25 bp, Mus musculus
ggatccagctctgtatgcttatcag

SEQ ID NO: 603590 - DNA, 25 bp, Mus musculus
ggatccaggataaatttcccacagt

SEQ ID NO: 603591 - DNA, 25 bp, Mus musculus
ggatccaggatatatttcccacagt

SEQ ID NO: 603592 - DNA, 25 bp, Mus musculus
ggatccaggatcatgtctgctaaca

SEQ ID NO: 603593 - DNA, 25 bp, Mus musculus
ggatccaggatcttgtctgctaaca

SEQ ID NO: 603594 - DNA, 25 bp, Mus musculus
ggatccaggcaacgagagtccagac

SEQ ID NO: 603595 - DNA, 25 bp, Mus musculus
ggatccaggcaaggagagtccagac

SEQ ID NO: 603596 - DNA, 25 bp, Mus musculus
ggatccagtgtgagatctaatcttt

SEQ ID NO: 603597 - DNA, 25 bp, Mus musculus
ggatccagtgtgtgatctaatcttt

SEQ ID NO: 603598 - DNA, 25 bp, Mus musculus
ggatccagttgcaaagtttggaaaa

SEQ ID NO: 603599 - DNA, 25 bp, Mus musculus
ggatccagttgctaagtttggaaaa

SEQ ID NO: 603600 - DNA, 25 bp, Mus musculus
ggatccagttgtccagtagagttca
